United States Patent 9,782,462 (MODIFIED POLYNUCLEOTIDES FOR THE PRODUCTION OF PROTEINS ASSOCIATED WITH HUMAN DISEASE) - sequence listing, part 117

SEQ ID NO: 227413 - DNA, 1452 bp, Artificial Sequence
  Description of Artificial Sequence: Synthetic coding sequence
atgtccggtcacaaatgcagctatccctgggacctgcaggaccgatatgcccaggataaatcagttgtgaacaaaatgcagcaaaaatactgggaaaccaaacaagccttcattaaggctactggtaaaaaggaagacgagcacgtggtcgcctccgatgcagacctggatgctaagctagaactcttccatagcattcagcgaacctgcctggatctctctaaagctatcgtcctgtaccagaagagaatatgctttctttctcaagaagaaaacgaactcggcaagttcctgcggtcgcaaggtttccaggataaaacccgtgcgggtaagatgatgcaggcaacaggcaaagctctgtgttttagctctcagcaacggctagcgctgaggaaccccctgtgcagattccaccaagaagtggagacgttcagacacagggcaatcagcgatacttggcttacggtgaataggatggagcagtgcagaacagagtatagaggagccctgctatggatgaaagatgtttctcaggaactggatccagacctgtacaagcagatggagaagtttcgaaaggttcaaacgcaggtgcggcttgccaagaagaatttcgataagctgaagatggatgtgtgccagaaggtcgatctcctgggtgctagtagatgcaaccttctgtcacatatgctggccacctaccagacgactctactacacttctgggaaaagacatcccatacgatggcagccatacacgagagctttaagggctatcagccctacgagttcaccacattgaaatctctccaggaccccatgaagaagttggtcgagaaggaggagaaaaagaagattaaccagcaggaatccaccgacgccgctgtgcaagagccgtctcaactgatctccctggaggaagagaatcaacgaaaagaatcttctagcttcaagaccgaggacggaaaatcaatcttgtctgctctggacaaaggcagtacacacacagcctgctcaggacccattgacgaattactagatatgaagagtgaggagggtgcctgcctgggcccagtcgccggtacgccggaaccagagggggctgataaagacgacctgctgctgttgtcagaaattttcaatgcatcgagccttgaggaaggcgagtttagcaaggaatgggccgcagtcttcggggatggccaagtgaaggaaccagtgcctacaatggcacttggagagcctgatcccaaggcacagaccggaagcggatttctgccctcccagctcctcgaccaaaatatgaaagacctgcaagcttctctccaagagcccgctaaagcagcatccgaccttaccgcgtggttttcactgtttgcagaccttgacccgctttccaatcctgatgctgttggaaagaccgacaaagaacacgagctccttaacgcctag

SEQ ID NO: 227414 - DNA, 1452 bp, Artificial Sequence
  Description of Artificial Sequence: Synthetic coding sequence
atgagcggacacaagtgttcctacccttgggaccttcaggacaggtatgcacaggacaagagcgtcgttaataagatgcaacaaaagtactgggaaacgaagcaggcatttatcaaagcaacaggaaagaaggaagacgaacacgtggtcgccagcgatgcagacctggatgccaaactggagctcttccactcaatccaacgcacatgcctggacctcagcaaggcaattgtgctgtatcagaaaaggatatgctttctttcacaggaggagaacgaattggggaaattccttcggtcgcagggatttcaggacaagacaagggctggcaagatgatgcaagcaactggtaaggcactttgtttctctagccaacagcgcctcgcattacgcaaccccctctgtcggttccaccaggaggtagagacctttcgtcatcgcgctatcagcgacacctggctgaccgtgaaccggatggaacagtgccgcaccgagtacagaggtgcactactgtggatgaaagacgtgtctcaggagctggacccagatctgtataagcagatggaaaagtttaggaaggtgcagactcaggtgaggttggcaaagaaaaacttcgacaagctgaaaatggacgtgtgtcagaaagtcgacctgctcggggcttccaggtgcaaccttctgtcgcacatgctcgccacgtatcagactaccctgcttcatttctgggagaaaacatcacatacaatggcggcaatccatgaatcctttaaaggctatcagccctatgaattcacaactctgaagagtctgcaagatccaatgaagaagctggtggagaaggaggagaagaagaaaattaatcagcaagagtcgactgatgctgctgtccaggagcctagtcaactcatcagcctggaagaggaaaatcaacggaaagagagcagctctttcaagacagaggacggcaaatcaatcctctccgcgctggacaagggatcaacccacacagcgtgcagcgggcctattgatgagttgttggatatgaagagtgaggagggcgcatgtctgggcccagtggctggcacaccagaacccgagggcgcagataaagacgacctcctgctcctgtcagaaatttttaacgcaagttctctcgaggaaggggagttttctaaagagtgggcagcagtgtttggggatggccaggttaaggagcccgtcccaactatggcacttggcgagcccgaccccaaggcccagacagggagcggattcctcccttcacaattattagaccaaaacatgaaggatcttcaggcttcactgcaagagccggctaaagcggcttcggatctgacggcctggttttccctattcgctgacctggacccactcagtaacccggacgccgtgggaaaaactgataaagagcacgaactcttgaatgcctag

SEQ ID NO: 227415 - DNA, 1539 bp, Artificial Sequence
  Description of Artificial Sequence: Synthetic coding sequence
atgagtggacataaatgctcatacccctgggacctccaggataggtacgcccaagacaagtccgtggttaacaagatgcaacagaagtactgggagacgaagcaagcatttattaaggccacgggcaaaaaggaagacgagcatgttgtcgcatccgatgcggatctggatgccaagctcgagctcttccactcaatacagcgcacttgcctggatctgtcaaaggcaattgtgctgtatcagaagcgaatctgctttctaagtcaggaagaaaacgagctgggcaagttcttgagaagccaggggtttcaggacaagactagagccggtaaaatgatgcaggctactggtaaggctttgtgtttcagcagtcagcagcgcctcgccctgcgcaaccccctttgtcgttttcaccaggaagtggagacctttcgccatagagctatcagcgatacatggctaaccgtgaaccggatggaacagtgtagaaccgaataccgcggagcgctgctgtggatgaaagatgtctcccaggagttggatcctgacttgtacaagcagatggagaagttccggaaagtccagactcaagttagattggccaagaagaatttcgacaaattgaaaatggatgtctgtcagaaagtggatctcctgggtgcttcccggtgtaatctgctgtcacacatgcttgccacctaccagacgaccctgctgcatttctgggagaagacatcccacactatggcagctattcatgagtcctttaagggatatcagccttatgagttcactaccctcaaaagtctgcaggacccaatgaagaaattggttgagaaggaggaaaaaaaaaaaattaatcagcaggaatcaaccgacgccgctgtccaggagccaagtcaatatcttcagaacatatgcctggagatgaaagctaattcagatatcaagatgcttcagaagggtaaagaggggcaacagatcggcatactaattagtctggaggaagaaaaccagcggaaggaaagctccagcttcaagacggaagatggcaaatccattttatcagctctcgacaaaggctccacgcacacggcttgttctggcccaatcgacgagttgttagatatgaagtcagaagagggcgcttgtctgggtcctgtagcgggaacacctgagccggaaggagcggataaggacgacctcctgctgttgtcagagatattcaacgcctctagtctagaggaaggagagttctcaaaagagtgggcagctgtctttggggatggccaggttaaggaaccagttcccaccatggcactgggggagcctgacccaaaggctcagactgggtctggcttcctcccgtctcagctgttggaccaaaatatgaaggatttgcaggcatctctgcaagaaccagccaaagcggcttccgaccttaccgcatggtttagtctctttgctgacctcgaccctctgtccaatcccgacgccgtgggtaaaaccgataaggaacacgagctccttaatgcctag

SEQ ID NO: 227416 - DNA, 405 bp, Artificial Sequence
  Description of Artificial Sequence: Synthetic coding sequence
atgagcgggcataagtgctatccctgggatttgcaggataggtacgctcaagacaaatctgtcgtaaacaagatgcagcaaaaatactgggaaaccaagcaagctttcataaaagctaccggcaaaaaggaggatgagcacgttgtcgcatccgatgctgacctggacgccaagttggagctctttcacagcattcagcgcacctgtctcgatctgtccaaagccattgttctgtatcagaaaaggatttgcttcctgagccaggaagagaacgaactgggcaaatttctgcgatctcaaggcttccaggataagactcgggctgggaagatgatgcaagcaactggcaaggccctgtgtttttcatctcagcagagactcgccctgaggaaccccctatgctag

SEQ ID NO: 227417 - DNA, 489 bp, Artificial Sequence
  Description of Artificial Sequence: Synthetic coding sequence
atgagcgggcataaatgttcttatccttgggatctacaggataggtatgctcaggataagtcggttgtcaataagatgcagcagaagtactgggagacaaaacaggccttcattaaagcaacaggcaaaaaagaggatgaacacgtggtggcttccgacgccgacctcgacgcaaagctggaactcttccattctattcagaggacgtgtctggacttaagcaaagctatcgtgctctaccagaagagaatatgcttcctgtcacaggaggaaaacgagctgggtaaattccttaggagtcaggggttccaggacaaaacccgtgccggaaaaatgatgcaggctaccgggaaagccctgtgttttagttcgcagcagaggctggctctgcggaacccgctgtgcagattccaccaagaagtggagacttttagacatagagccatatctgatacttggctcaccgtgaataggatggaacagtgttag

SEQ ID NO: 227418 - DNA, 666 bp, Artificial Sequence
  Description of Artificial Sequence: Synthetic coding sequence
atggctgcagccaggccgtctctcgggagggttctgccaggctcctcagtcctgtttctctgcgatatgcaagagaagttccgtcacaacattgcatatttcccacaaattgtttcagttgctgcacgcatgctaaaggttgccagattgcttgaagtaccagtcatgctcactgaacagtatccccagggactcgggcctactgtgcctgaactgggaacagaaggcttgagacctctggctaagacatgtttctccatggttcccgctcttcaacaggagctagacagccgcccacagttgagatctgtcctcctctgcggcatagaagcacaggcttgtatcttagaccccagaagctaccctgggctcgcactcactagtctttatccacagaacacaaccttagacctgctggaccggggtctgcaggtgcatgttgtagtggacgcctgttcctctaggtcacaggtggaccggctggttgctctggcccgtatgaggcagagcggcgcttttcttagtacaagtgagggcctcatactgcaattagtaggcgatgcagtccatccacagtttaaagaaatccaaaaactgattaaagagccagcccctgactcggggctgcttgggctcttccaggggcagaattctctgctccactag

SEQ ID NO: 227419 - DNA, 618 bp, Artificial Sequence
  Description of Artificial Sequence: Synthetic coding sequence
atggctgcggctcggccaagtctcggtagagtactgccgggttcctccgtgctgttcttatgtgacatgcaagaaaagttcagacataatatcgcctatttcccccaaatcgttagcgtggcagccagaatgctgaaggtcgccagacttctcgaagtccctgtgatgctcaccgagcagtatccccagggattgggccctactgtcccagaactcggtactgagggacttcggccactggccaagacgtgtttctctatggtccccgcactgcagcaggagctggattcacgaccccaacttcgatccgttctgctgtgcgggatcgaggcacaggcctgcatcctcaacacaacactcgacctcctggaccgtggtctgcaagtgcacgtggtggtcgacgcttgctcatccagatcacaggtcgataggctcgtcgccctggcccgaatgaggcagagcggtgcttttctgagcacaagtgagggtctaattctacagctggtcggagacgccgtgcaccctcagtttaaagagattcaaaaactcataaaagagcctgccccagattcaggccttcttggccttttccagggtcagaacagccttctgcactag

SEQ ID NO: 227420 - DNA, 408 bp, Artificial Sequence
  Description of Artificial Sequence: Synthetic coding sequence
atggccgctgccaggccatctctaggtcgagttttaccaggctcctcggtgctgttcttgtgcgatatgcaagagaaatttcgccacaatatcgcatacttcccacagattgtgtccgtggctgccaggatgctaaaaaatactacactcgatttgctggatcgcggtctgcaggtccacgtggtggttgacgcatgcagctccaggtctcaggtagaccggctggttgctcttgcccgtatgcggcagtctggggcattcctgagtacgtccgagggtttaatcctgcagctggtgggagacgcagtccacccacaattcaaagagattcagaagctaattaaggaacccgctcctgattccggtttactgggcctgtttcagggccagaattccttgctccactag

SEQ ID NO: 227421 - DNA, 1101 bp, Artificial Sequence
  Description of Artificial Sequence: Synthetic coding sequence
atggccggaccagcctggatatcaaaggtcagtcgcttgctgggagccttccacaaccccaagcaagttacacggggttttaccggcggagtacagaccgtgaccctaatccctggagatggcatcggccctgaaataagtgcagcagtgatgaagatcttcgatgccgctaaagcccctatccagtgggaggagaggaatgtgacagctattcaaggcccagggggaaaatggatgattccctctgaggctaaggaatcaatggataagaataaaatggggctcaaggggcctctgaagaccccaatcgcagctggccatccctccatgaacctgctgctgaggaagacttttgatctctacgccaacgttcggccatgcgtatcaatcgaggggtacaaaacaccttatacagacgtcaacatagtgactatcagagagaatacagagggagaatactccgggattgagcatgtcattgtggacggagtggtgcaatccatcaagctgatcacagagggcgcttcaaaacggatcgcggagttcgctttcgaatacgctaggaataaccataggtctaatgtcaccgcagtgcataaagcaaatattatgcgaatgtctgacggtctttttctgcagaagtgccgggaggtggctgaaagctgtaaggatatcaagttcaatgagatgtacctggacactgtgtgtctcaatatggtccaagatccatctcaatttgacgtcctcgttatgcctaatctctatggagatattctgtccgacctctgtgccggtctcatcggaggcttgggtgtgacgccaagtggcaacatcggtgccaatggcgtagccattttcgaaagcgttcacggtacagcgcctgacatcgccggaaaagacatggctaatcccacggccctactgctgtccgccgtgatgatgctgcgtcatatgggactgttcgatcacgccgctcgcatcgaggctgcctgttttgcgaccattaaggatggtaagtccctgaccaaggacttaggcggaaatgctaagtgttcagactttacggaggaaatttgtcgaagagtcaaggatctagattag

SEQ ID NO: 227422 - DNA, 774 bp, Artificial Sequence
  Description of Artificial Sequence: Synthetic coding sequence
atgaacttgctgttgcgaaagacctttgacctgtatgcaaacgtgaggccctgtgtctctatcgaaggctataaaaccccatacactgatgtgaacatcgtgaccattagagaaaacaccgagggtgaatatagcggcattgagcatgtgatcgttgatggagttgtgcagtcaattaaacttattacagaaggcgcatcgaaacggatcgccgaatttgcatttgagtacgcgcgtaataaccataggagcaacgttacagctgtccacaaggccaacattatgaggatgtctgatgggctgttcttgcaaaagtgccgagaggtcgcggaatcctgcaaggacatcaaattcaacgaaatgtatcttgacacagtctgcttgaacatggtccaggatccttcccagttcgatgtgctggtgatgccaaacctctatggcgatattctttctgacctatgcgctggtctaattggcggactgggagtgaccccctctggcaacatcggcgcaaacggcgtggctatctttgaatccgtgcatggtaccgccccagatatcgcaggaaaagacatggccaatccaacggcgctgttgctgagtgccgtgatgatgctgaggcatatggggctgtttgaccacgccgcaaggattgaggctgcctgctttgcaaccatcaaagatgggaagtccctgaccaaggacctggggggaaatgccaaatgctccgacttcaccgaagaaatttgccggagagtgaaagatctggattag

SEQ ID NO: 227423 - DNA, 495 bp, Artificial Sequence
  Description of Artificial Sequence: Synthetic coding sequence
atggctgccctttccggagtccggtggctcacgagggctctggtgtcagccggtaacccaggcgcttggagaggcctctccactagcgccgctgctcacgctgcgagtcgctctcaggcggaggatgtgcgagtcgaaggatcgttccccgtgaccatgctccccggagacggtgtgggacccgagctcatgcatgctgtgaaggaggtgttcaaagcagctgcagtccctgttgagttccaagagcatcacctcagcgaagtccagaacatggcctctgaggaaaaactggagcaggtcctctcttcaatgaaggaaaataaggtggctattattggcaaaattcacacaccgatggagtataagggagaactggcctcatacgacatgaggctcagaaggaaacttgacctgtttgcaaatgtagttcacgttaaatcactcccgggatatgacagtgctcaacagagtcgccctggtgaccacagtaggtag

SEQ ID NO: 227424 - DNA, 1158 bp, Artificial Sequence
  Description of Artificial Sequence: Synthetic coding sequence
atggctgccttaagcggcgttagatggctaacgcgtgcacttgtgtccgccggaaaccccggtgcatggagaggactgtctactagtgccgctgctcacgccgcatcccggtcccaggctgaagatgttagagtcgagggcagttttcccgtcactatgcttcccggagacggagtgggcccagagctcatgcacgctgttaaagaagtcttcaaggcagcggctgtcccagtggaatttcaggagcaccacctgagcgaagttcaaaacatggcctctgaggagaagcttgaacaagtgctatcaagtatgaaggaaaacaaggtcgcgatcattggcaaaatccacaccccaatggaatacaaaggcgagctcgcttcatatgacatgagactcagaagaaaactggatctgttcgccaacgtagtgcacgtaaaatcactcccaggttatatgactcgccacaacaatcttgatctggtaatcataagggagcagacagagggcgagtactcctctctggagcatgagtctgccaggggcgtaatcgaatgcctgaagatcgtaacaagggccaagtctcagcgcatagccaaatttgccttcgattatgctactaaaaaaggtcgtggaaaagtgacagccgttcacaaggcaaatatcatgaagctgggagatggcctctttttacagtgctgcgaggaagtggccgaactctatccgaaaatcaaattcgagacaatgataatcgacaactgctgtatgcagctcgtgcagaacccctatcagttcgatgttttagtcatgccaaacctctacggaaacatcattgataacttagccgcaggcttggtgggcggagccggagtagttcctggggaatcatacagcgctgaatacgccgtgttcgaaaccggtgccagacacccattcgcacaggcagttgggcgaaacattgctaacccgacggccatgctcctttccgctagtaacatgctgagacatctgaatctcgaatatcacagctctatgattgcagatgccgtgaaaaaggttatcaaagtgggcaaggtcagaacccgcgatatgggaggttacagtactacaacggatttcattaaatcagtgattggccacctccagaccaagggctcttag

SEQ ID NO: 227425 - DNA, 1152 bp, Artificial Sequence
  Description of Artificial Sequence: Synthetic coding sequence
atggccgctctttccggcgttcggtggttaactcgagcactagtgagcgctggcaacccaggagcctggcggggtttatcgactagtgcagccgcacacgctgcctcacgtagccaggctgaggatgtgcgtgtggaagggagcttccctgtgaccatgcttcctggggacggagtgggccctgagcttatgcatgctgtaaaggaggtttttaaggctgccgcagttcctgtggaattccaggagcaccacctctctgaggtgcagaacatggcgtcggaagagaagcttgaacaggtcttaagttctatgaaagagaacaaggtcgcaatcattggaaagattcatacacccatggagtacaagggagaactcgctagctacgacatgcgtcttcgcaggaagcttgacctatttgcaaatgttgtgcatgttaaatccctgccaggatacatgactagacacaataaccttgatctagtgattatccgcgagcagacagaaggtgaatattccagtctcgagcacgagagcgctcgaggggtgatcgagtgccttaagatcgtgactcgggcaaagtcacagaggattgctaagttcgccttcgattacgctaccaagaagggaagagggaaggtaaccgcggtccacaaggctaatatcatgaaacttggcgatggactgtttctccagtgctgcgaagaggtcgcggaactttatcccaagatcaaatttgaaacaatgatcatagataactgctgcatgcagttagtgcagaacccttaccagttcgatgtactggttatgcctaacctgtatggtaatataatcgataacctggctgccggactggtgggtggcgctggcgtagtgcccggtgaaagctatagcgccgaatatgctgtcttcgagaccggagcccgacatccatttgcccaggcagttggcaggaatattgcaaatcctacagccatgctcttgtcagccagtaatatgctcaggcatttgaacttagaatatcactcaagcatgatcgctgacgccgttaaaaaggtgatcaaagtgggaaaagtccggactagcgatatgggcggatacgccacatgtcacgacttcacagaggccgtgattgcggctctgccacacccatag

SEQ ID NO: 227426 - DNA, 702 bp, Artificial Sequence
  Description of Artificial Sequence: Synthetic coding sequence
atgaaaatgggggagagatggagctctctattccccttccccgtcagcccatcgtgttgctttttactgacccagtctgccaggggtgtgattgagtgcctgaagatcgtgactcgtgccaagtcacagcggatcgcaaaatttgcatttgactatgccactaaaaaggggagggggaaagtgacagccgtgcataaggccaacatcatgaagctgggagacggattattcttgcagtgttgcgaggaggtggctgagctttaccccaaaattaaattcgagaccatgattatcgacaactgttgtatgcaattagttcagaatccatatcagttcgacgttctggtgatgccaaatctgtacggcaatattattgataaccttgctgcagggctggtaggcggtgcaggggtagtgccaggggagtcgtattctgccgagtatgccgtcttcgaaacaggcgctaggcacccttttgcccaagcagttggacgaaacatcgccaatcccactgctatgctcctttcagccagtaatatgctgaggcatctgaacctggagtaccactctagcatgatcgccgacgccgtcaaaaaggtgatcaaagtaggcaaggttaggactagggatatgggtggatacagcaccactacagactttattaagtctgtgattgggcatcttcagactaagggttcatag

SEQ ID NO: 227427 - DNA, 795 bp, Artificial Sequence
  Description of Artificial Sequence: Synthetic coding sequence
atggaaagtggaaagacggcaagtccaaagtctatgcccaaagatgcgcagatgatggctcagattctcaaagatatgggaattacagaatacgaacctagggtcatcaatcagatgctggagttcgccttcagatacgtgaccactattctggacgacgctaaaatctattccagccatgccaagaaggcaactgttgacgcagacgacgtgaggttagcaatccagtgccgcgctgaccagagtttcacctcgcctccacccagggatttcctccttgacatagctcggcagagaaaccagaccccactgccattgataaaaccatacagcggtcccaggctgcctccggataggtattgtctgacagccccaaactaccgccttaagagtttgcagaagaaagcaagtactagcgcaggtagaattacggtgcctcgactgtctgtgggcagcgtcacaagcaggcccagtacaccaacactggggaccccaactccccagactatgtccgtctcaaccaaggtggggacccctatgtcccttactgggcagcgattcactgtgcagatgcccacctcacagtctccagccgtcaaagcgagcatccctgctacttctgccgtgcagaacgtcctgatcaaccccagcctgataggcagtaagaacatcctcattaccactaatatgatgtctagtcagaataccgctaatgagtccagcaacgccttaaagcgaaaaagagaggacgatgacgatgacgatgatgatgacgatgattacgacaacttatag

SEQ ID NO: 227428 - DNA, 906 bp, Artificial Sequence
  Description of Artificial Sequence: Synthetic coding sequence
atggccatcagacggaaccgtgtggccttaaaggggaacatagaaaccaatcacaacttacccccatctcacaagtctagaaacaacatactgcgaacatccctggacctgtacgcaaatgtaattcattgcaaaagcctgccaggtgtggtcactcgccataaggatattgacattttgatcgtgagggaaaacactgaaggagaatactcgtcacttgagcatgaaagcgtggccggagtagtggaaagtcttaaaatcattaccaaggccaagtccctgcggattgctgagtacgcgttcaagttagcgcaggagagcggtagaaaaaaggtgacagccgtgcataaggccaatatcatgaaactgggcgatggacttttcctgcagtgctgtcgcgaagtcgccgcaagataccctcagattacctttgagaatatgatagtggacaacacaaccatgcagcttgtatcccgaccccaacagttcgatgtgatggtgatgccaaacttgtatggaaacatagtcaataatgtgtgcgccggtctggtgggtggaccaggcttggtggcaggggctaactatggccacgtctatgcagtctttgagacagccacgcggaacacaggcaagtccatagcaaacaagaacatagccaaccctaccgctaccttgctggcatcgtgtatgatgcttgaccatttaaagctgcactcgtacgcgacctcaatccgcaaagccgtcctagctagcatggacaacgagaatggtttagtgtgtgccgagccggcttgcgtccttcagatgcacactccagacattgggggacagggcaccaccagcgaagctatccaggacgtaatccgccatatccgcgtcattaatggcagagcggtcgaggcttag

SEQ ID NO: 227429 - DNA, 1143 bp, Artificial Sequence
  Description of Artificial Sequence: Synthetic coding sequence
atggcgctaaaggtggccactgttgctgggagcgccgctaaagctgtgctaggcccagcactcctgtgccgaccgtgggaggtactgggggcacacgaggtgccgagtcgcaacatcttctctgagcaaacgatccctccttctgcaaaatacggcggtagacacaccgttacaatgattcctggggacgggattggcccagagttgatgttgcacgttaagagcgtttttcgtcacgcctgcgttccagtggactttgaggaagtacatgttagctcaaatgctgacgaagaggacataagaaacgcaattatggccattcgccgaaatagggtcgccctaaaaggaaacattgaaacaaatcataatctgccgccatctcacaaatccaggaataatatactgagaacttctctcgatctctacgcaaatgtgattcattgtaaatcactccccggagtggtgacccgtcacaaagacatagacatcctcatcgtgagagaaaacactgaaggcgaatactcttccctggaacatgagtcagtggctggggtagtggaatcactcaagatcattactaaggcaaaatccttgagaatagccgaatatgccttcaagttagcgcaagagtccgggcgaaagaaagtgactgccgtccataaggctaatattatgaagctgggcgatggcttatttttgcaatgctgtagggaggtggcagccaggtatccccagatcacatttgagaatatgatcgtcgacaataccacaatgcagcttgtatcacgtcctcagcagtttgacgtaatggtgatgcccaacctgtacggcaatattgtgaacaacgtatgtgccggtctcgtcgggggaccgggactcgttgccggtgcgaattatgggcacgtctacgcagtctttgagaccgcaactaggaataccggcaaaagtattgcaaacaaaaacattgctaacccaacagccacgctgctcgcgtcttgcatgatgcttgaccatctgaaactgcacagttacgcaacaagcatccgaaaggctgttctggcttccatggataatgaaaatgtacggttcccttcgcatccaaccctgctgcccaggcctgtttcgccttgttctctgctgtag

SEQ ID NO: 227430 - DNA, 525 bp, Artificial Sequence
  Description of Artificial Sequence: Synthetic coding sequence
atgtatactttcgaccaggccaccggcggaaccgctcagtttgaagcgcatagtgatgcccaggctctggtactgctcgatgtgacccccgaccagagtatggtcgacgaaggcatggcacgtgaggtgatcaaccggatccagaagctgcggaagaagtgcaatctggtgccaactgatgaaataactgtgtattataaagccaagagcgaaggcacctaccttaactctgtgatcgaatcgcacactgagttcatctttaccaccatcaaggcacccttgaagccatatcccgtcagtccgtcagacaaggtgctcatacaggaaaaaactcagttgaagggtagtgaactcgagatcacgttgacgcggggatctagcttgcccggacccgcatgcgcgtatgttaatctgaatatctgtgctaatggctccgaacagggcgaaatgcagtggataattcccgagatttaccacttctggaaacctcgatggagtatcgctcccggtaagagcaagcgatag

SEQ ID NO: 227431 - DNA, 525 bp, Artificial Sequence
  Description of Artificial Sequence: Synthetic coding sequence
atgtacacgttcgaccaagctactggcggaactgcacagttcgaggcccactctgacgcgcaggctctggtgttactggatgtaaccccagaccaaagcatggtcgatgagggcatggcaagagaagttattaatcgaattcagaagctgcgcaagaaatgtaaccttgtccccaccgatgagataactgtttactacaaggccaaatctgaaggcacatacttaaactccgtgatcgagagtcacaccgaattcatttttactactatcaaagcaccactgaagccctaccctgtctcgccatcagataaggtcctgattcaggaaaagactcagctgaagggctcagaattggaaattactctgacgcggggatctagtctgcccggacccgcatgtgcctacgttaacctcaacatctgcgccaacggcagtgaacagggggaaatgcagtggatcatacccgagatataccacttctggaagcccagatggtctatcgcacctggcaaatctaagaggtag

SEQ ID NO: 227432 - DNA, 3789 bp, Artificial Sequence
  Description of Artificial Sequence: Synthetic coding sequence
atgttgcaacaggtcccggagaatataaattttcccgctgaggaggagaagatcttggagttctggacggaattcaattgctttcaagaatgcctcaaacagagtaagcacaaacctaagttcacattctatgacggtcccccattcgccaccggcttgccccactacggccacatactggccggtaccatcaaggacattgtgaccaggtacgcccaccaatctggattccacgtggatcgcaggtttggatgggattgccatggactgcccgtggagtatgagattgacaagaccctgggaattcgcggtccagaagacgtggccaaaatgggcatcaccgagtacaacaaccagtgtcgggctatcgtcatgcgctattcagccgaatggaaatccacagtcagtcgcctggggagatggatcgatttcgataatgattataagacactctatccccagttcatggagtccgtgtggtgggtatttaagcagttatacgacaagggactcgtgtatcgtggggttaaggtgatgcctttctctacggcatgtaatacacccctgagcaatttcgagagccaccagaattataaagacgtgcaagacccctctgtcttcgtaacttttccactggaagaggatgaaaccgtctccctggtagcttggacaacgacgccctggactctgccgagtaatttggccgtttgcgtgaacccggagatgcaatatgtaaaaataaaggacgtggctagggggcgtctcctgattctgatggaagctaggcttagcgcactctataaactcgagtccgattacgaaatcctggaacggttcccaggagcctaccttaaggggaagaaatacaggcccttatttgattactttctgaagtgcaaagaaaacggcgcttttacggtgctggtggacaactatgtgaaagaagaagagggaacaggcgtcgtgcaccaagcaccatactttggagccgaagattaccgagtctgcatggactttaatattatcagaaaggactctctgccggtatgtcccgtcgacgcttctgggtgttttacaacggaagttaccgatttcgccggacagtatgtcaaagacgctgacaagagcattatccgcacactgaaagagcagggcagattgctagtggcaacaactttcacacacagctatcccttttgttggaggtccgacactccactgatttacaaggcagtcccgtcttggtttgtgagagtcgagaatatggtcgaccagttattgagaaataacgatctgtgctattgggtaccagagctggttagggagaagagattcggaaattggctgaaagatgcacgcgattggacgatttccaggaatcgatactggggaacacctattccgctgtgggtatccgatgacttcgaggaggttgtgtgtattggcagtgtggcagaactcgaggaattatctggagctaaaatatctgaccttcatcgagaatctgtcgaccatttgacaattcccagtagatgtggaaaaggctctttacaccgcattagtgaagtgttcgactgttggttcgagtcgggatctatgccctacgcacaggtgcattatcctttcgagaataagcgcgagttcgaggacgcctttcccgctgatttcatagctgaaggtatcgaccagacacgcggatggttttatactctgttggttctggcgaccgcactgttcggacagcctccttttaaaaatgtcatcgtgaacggcctcgtgcttgctagcgatggtcagaaaatgagcaaacgtaagaagaactatcccgacccagtgtccataatccagaaatacggcgctgatgcactgaggctgtatctcatcaattctcccgtggttcgcgctgagaacctgaggttcaaagaagaaggggtacgcgacgtccttaaagatgttctgctcccgtggtacaacgcttacaggttcctgatccagaacgtcctgcggctgcagaaagaggaggaaatcgaatttctgtataacgaaaacaccgtccgcgagagcccaaatattacagatcgctggatccttagtttcatgcagagcttgattggatttttcgagactgagatggcagcttacagactgtatactgtcgtgcccaggttggtgaagtttgtggacattcttaccaactggtacgtccgcatgaatcgacgaaggctgaagggcgagaacgggatggaagactgcgtgatggccttggaaacgctgttttccgtattactgagcttgtgtagattaatggccccatacaccccctttttgaccgagcttatgtaccagaacctaaaagtactcatagaccccgtttctgttcaggataaagacacactgtcaattcactacctgatgctgcccagagtccgggaggagttgattgataagaaaacagaatctgccgtgtcgcagatgcagagcgtgatcgagctaggcagggtcatccgggatcgtaagactattcccataaaatatccacttaaagaaatcgtggtgattcaccaggaccccgaggcactgaaggacatcaagagcctggagaagtacatcattgaagagctaaacgtgcgtaaggtcaccctctccaccgataaaaacaagtatggtattagactcagagcagagccagaccacatggtgctagggaagaggctgaagggggctttcaaagcagtgatgacgagtattaaacagctgtctagcgaggagttggagcagttccaaaaaactggtactattgtggtcgaggggcacgaactacatgacgaggacatccgactgatgtatacctttgaccaggccacgggcggtacagcgcagtttgaggctcattcggatgctcaggccctggtgttgttggatgtgacgcccgatcaaagcatggtcgatgagggaatggcacgagaggtaataaatagaatacaaaagctccggaagaaatgcaacttggtgcccactgacgagataaccgtatattacaaggccaaatctgaggggacttacctgaactctgtaatagagtcgcacaccgaatttatctttacgaccatcaaggcccctctgaagccataccctgtttccccctccgataaagtgctcatacaggaaaagacccagcttaaggggagcgaactggaaattaccctcaccagagggagcagtctacccggtccagcgtgtgcgtacgtgaaccttaatatatgtgcaaatggttctgaacagggtggagtactgcttcttgaaaaccccaaaggcgacaatagactggatctgctaaaacttaagtcagtcgtgacgtccatttttggcgtgaaaaataccgagttagccgtgttccacgatgagacagaaattcaaaatcaaacagacttactcagcctctccggcaagactctgtgtgtgacagcaggatcggccccttctctaattaattcctctagcaccctgctttgccagtacatcaatctgcagctgttgaacgccaaaccgcaggagtgcttgatgggcactgtggggacgctgctcctcgagaatcctctgggccaaaatgggctaacgcatcagggcctgctctacgaggcggcaaaggtgttcgggttgagaagccgcaaactcaaactctttctcaacgagacccaaactcaggaaataaccgaggacataccggtcaagacacttaacatgaagacggtttacgtgagtgtcttgccaaccaccgcggacttctag

SEQ ID NO: 227433 - DNA, 3729 bp, Artificial Sequence
  Description of Artificial Sequence: Synthetic coding sequence
atgctgcaacaggtgccagagaatatcaatttcccagcagaggaggaaaagatactcgagttctggacggaatttaactgcttccaagagtgcctcaagcagtcgaagcacaagccaaagtttacattctatgacggccctccttttgctactggcctgccccattatgggcatattctggccggaactataaaggacatcgtgacgcgatatgctcaccaatccggatttcatgtggaccggcgtttcggatgggactgccacggcctgcccgtggagtatgagatagacaaaaccctggggatccggggaccagaagacgtagcaaaaatgggcattacggaatacaataatcagtgtcgggctatcgtcatgcggtacagcgcggaatggaagagcaccgtcagccgacttggtaggtggatcgacttcgacaatgattataaaactctttaccctcaattcatggaaagcgtgtggtgggtcttcaagcagctgtacgacaagggcctggtatataggggcgtgaaggttatgcccttcagtactgcgtgtaataccccactcagtaacttcgaatcgcaccagaactacaaggatgtgcaggacccatccgtgtttgtgactttccccctggaagaggacgagacggtttccttggtggcttggaccactacaccctggaccctgccttctaatctggccgtgtgcgtgaaccccgaaatgcaatacgtcaagatcaaggatgttgccagaggacgactgttgattttaatggaagccaggctgagcgccctgtataaactagagtctgactacgaaatcttagaacgctttcccggagcctacctgaagggcaagaaatataggcccctctttgactacttcctcaaatgtaaggagaacggggcttttaccgttcttgtggataactatgtgaaggaagaggaaggaaccggtgtggttcatcaggcgccttacttcggagccgaggactatcgggtgtgcatggatttcaacattatccgtaaagattctctgccggtctgcccagtcgatgcgtctggctgcttcaccaccgaggtgactgattttgctggtcaatatgtcaaggatgccgacaagtccataattcgaacattaaaggaacaaggtcgattgttggtcgccaccacttttacccattcttacccattctgctggcgtagtgatacacctctcatctacaaagccgtcccttcctggtttgtccgcgtcgagaatatggttgaccagcttttgaggaataacgatctgtgttattgggtccccgagctggttcgggagaaaagattcggaaattggttgaaggatgcacgcgattggactatatctaggaaccggtactggggaactcccatccctttgtgggtgtccgacgacttcgaagaggtggtgtgtatcggttccgtggccgaactggaggaactctctggggctaaaataagcgatctgcatagggagtctgtcgatcatctgacaatccccagccggtgcggcaaagggtccttgcatagaatatctgaggtgtttgattgttggtttgagagcgggtcaatgccttatgctcaggttcactacccattcgagaacaaacgggagttcgaagatgcctttcccgcagactttatcgcagaaggcatcgaccagactcgcggttggttctacacactactcgtgttggcaaccgcgctattcggccaaccccctttcaaaaatgtcatcgtcaacgggcttgtattggctagcgatgggcaaaagatgtctaagagaaagaaaaactatcccgatccagtctccatcattcagaaatatggggctgacgccctgcgactgtatctgattaattctccggtggttagggccgaaaacttgcggttcaaagaggaaggcgttagggacgtgttgaaggacgtgctcctcccttggtacaacgcttatcgttttctcatccagaacgtgctgcgcctgcagaaggaggaggagatagagttcctctacaatgaaaataccgtgagagagtccccaaatattacagaccggtggattctgtcatttatgcagtctctgatcggattcttcgaaaccgaaatggctgcctaccggctttacaccgtggtccctcgcttagtaaagtttgtggacattctcaccaactggtacgttcgaatgaataggcgtcggctgaaaggagaaaacggtatggaggactgtgtgatggcattagaaacactgtttagtgtactcctctcactgtgtagactgatggccccatatacacctttcctcaccgagctcatgtaccagaacttgaaggtgctcatcgatcccgtgagtgtgcaagataaagatacactgtcaatccactatctgatgctgcccagagttcgagaagaactgatcgataagaagacggagtctgcagtttcccagatgcagagtgttatcgagctgggccgtgtgattagggacaggaaaacgattccaatcaagtaccctttaaaggagattgtggtgattcaccaggatcctgaggcactcaaagatatcaagagtctggaaaagtacattatagaagaactgaatgtaaggaaggtgaccctgtcgacagacaagaacaaatacgggatcagactgcgagccgaacctgaccatatggtgctagggaagcggcttaagggcgctttcaaggcggtgatgaccagtattaaacagctcagtagcgaggaattggagcagttccagaagacagggacaatcgtggtggagggccacgagctgcatgacgaggacattagactaatgtacacattcgatcaggccacaggtggtactgcccagtttgaagctcatagcgacgcgcaggccctagtgcttcttgatgtgacccccgaccagagcatggtggacgaaggaatggcgagggaggtaattaatcggatacaaaaactgcgcaagaagtgcaacctggtgcccacagacgagatcaccgtgtactataaggccaagtcagagggtacctaccttaactcggtgatcgaaagccacacagaatttattttcaccacaatcaaggcaccgttgaagccatatcccgtttctccgtctgacaaagtccttatccaggaaaagacacaacttaaggggtccgaactcgaaatcacactgacccggggaagctctcttccagggccagcgtgcgcttacgttaatcttaatatatgcgcaaatggctccgagcaaggcggtgtcctgctgctggaaaaccctaagggggacaatcggcttgatttgctcaaactgaaatcagtggtgacctctatttttggtgttaagaatacagagctggccgtgtttcacgatgagacggagattcagaatcagacagacctcctttctctgagtggtaagaccctatgtgtaaccgcaggctcagctccttctttgatcaattcctccagcacccttctgtgccagtacatcaacttacaactgcttaatgctaaaccacaagaatgcttaatgggcactgtgggcacgcttttgctggaaaatcccctcggacagaatgggctgactcatcagggtctcctgtacgaggccgctaaggtcttcggcttacgcagcaggaagctgaaattattcctgaatgaaacacagacacaggaaatcactgaagatatcccctag

SEQ ID NO: 227434 - DNA, 993 bp, Artificial Sequence
  Description of Artificial Sequence: Synthetic coding sequence
atgctccagcaggtgcccgagaacatcaactttcccgctgaggaggagaagatccttgagttctggaccgagtttaattgttttcaggagtgcctgaaacaaagcaagcacaagccaaaatttactttctacgatggaccaccctttgcaaccggcttgcctcattacggtcatattttggccggaaccattaaggacattgtcactaggtacgctcaccagagcggcttccacgtggaccggcgattcggttgggattgtcacggtctaccagtcgaatacgagatcgacaaaaccttgggtatccgcggtcctgaggatgttgcgaagatggggatcactgaatataataaccagtgtcgcgctattgtcatgcgctactcggccgagtggaagtcgaccgtgagcaggctaggacgctggatagacttcgataacgattacaagactttataccctcagttcatggagtctgtgtggtgggttttcaagcagctatacgacaaaggcttggtatacaggggagtgaaagtaatgcctttctccaccgcctgtaataccccgctgagcaattttgagagtcatcagaactataaagacgtccaggatccttccgtgtttgtaacgttccccctcgaggaagacgaaacggtgtcgctggttgcctggacaacaacaccttggaccctgccatcaaacctggccgtgtgcgtgaacccagagatgcagtacgtgaagattaaggacgtggctaggggcaggctacttatactgatggaggctaggttatcagcactgtacaagttggagtctgattatgaaatactcgagcgtttccctggggcttacctgaaaggaaagaagtaccgccctctatttgattactttctgaagtgtaaggaaaatggggcttttacagtcctggtggacaattatgtgaaagaggaagagggcacaggtgtggttcatcaggcgccatatttcggggcatag

SEQ ID NO: 227435 - DNA, 513 bp, Artificial Sequence
  Description of Artificial Sequence: Synthetic coding sequence
atggcaccctatacaccattcctcactgaactgatgtaccagaacttaaaagtcttaattgacccggtctccgtacaggacaaagacaccctgtctatacactatctaatgttgcctagagtgcgtgaagaactcatagataagaagacggagagcgctgtgagtcagatgcagtctgtcattgaactgggaagggtaatccgcgatagaaaaactatcccaatcaaactcaaagggagtgagctggagattaccttgacccgcggaagcagccttccaggccctgcctgcgcctatgtaaatctcaacatctgcgcaaatggaagtgagcagggcggagttctgctcctggagaaccccaagggagacaataggcttgatctcctgaaactcaagtctgtcgtcacatccatctttggcgtgaagaatactgagctcgccgtgttccacgacgagactgagatccaaaaccagacggatctgctgagcttatccggcaaaaccctttgctag

SEQ ID NO: 227436 - DNA, 3789 bp, Artificial Sequence
  Description of Artificial Sequence: Synthetic coding sequence
atgctgcagcaggtccctgaaaatatcaatttccccgcagaagaggaaaaaatcctggagttttggacagaatttaattgtttccaagagtgcttaaagcagagcaagcataagcccaaattcaccttctatgatgggcctccatttgcgactggcctcccgcactatgggcacatacttgcaggaaccattaaagatatcgtgaccaggtatgcccaccagtccggattccacgtggacaggaggtttggctgggattgccacgggcttccagttgagtatgaaatcgacaagacattaggaatacggggacctgaagacgtggccaaaatgggaataacagaatataataatcaatgcagagccattgtgatgcggtattcggccgagtggaagagtaccgtaagccgactcggaaggtggattgatttcgataacgattacaaaaccctgtaccctcaattcatggagtcggtctggtgggtgttcaagcagctatatgacaagggtctggtctacagaggagtgaaagtgatgccgttttcaacagcgtgcaatacccccctttccaacttcgagagccaccagaactataaggatgtgcaggatcccagcgtcttcgttacttttcccctcgaggaggacgaaacagtctctcttgttgcgtggacaaccacgccttggaccctgccgtccaacttagcggtctgcgtcaaccctgagatgcaatacgtgaaaatcaaggacgtcgctagaggcaggttgttgattttaatggaagctagactttccgctttgtacaagctcgagtctgactatgagattctggagcgatttcctggtgcgtatctgaagggaaaaaagtaccggccactgtttgattatttcctgaagtgcaaagagaacggagccttcaccgtgctggtggataattatgtgaaggaggaggaggggaccggggtggttcatcaggctccgtactttggagctgaggattatagagtgtgcatggattttaatattatccgcaaggactcccttcctgtgtgcccagtagatgcctccggctgtttcaccacagaagtcactgacttcgctggacaatatgttaaagacgccgacaaatctatcatcaggacattgaaggagcagggcaggctgttagtagcaacaaccttcacacactcctacccattctgttggcgctccgacactccactcatctacaaagccgtccccagttggtttgtgcgagttgaaaacatggtggatcaattgctcagaaataacgacctgtgctactgggttcccgagctggtgcgagagaaacggtttggcaattggttgaaagatgcaagagattggacgatctctagaaacagatactggggtacgcccattcctctttgggtcagcgatgacttcgaagaagttgtttgtatcggcagtgtcgccgagctggaagagctgtctggtgcaaagatttcagacctccatagggagtctgtggaccacctcacaatcccttcacgatgtggcaaaggaagcttgcaccgaataagtgaggtgtttgactgctggtttgagtccgggtctatgccctatgcccaggttcactatcccttcgagaacaaaagagagtttgaagacgcttttccagccgactttatcgccgaaggcattgaccaaactcgaggatggttttacactttgctggtgcttgccacagccctgttcgggcagccacccttcaagaacgtcattgtgaatggccttgttctggcttccgacggtcagaaaatgtccaagaggaaaaagaattatccggacccagtgtctattatccagaaatatggcgctgatgctctcaggctttatctgattaattcccccgtggtgcgcgctgagaatctaagattcaaagaggaaggagtgagggatgtcctcaaggatgtgctgctgccgtggtataatgcctaccggttcttgattcagaatgtgctaagactgcagaaagaggaggaaatcgagtttttgtataacgagaatactgtccgcgaaagcccgaacattacggatcggtggatcctctctttcatgcagagccttataggattttttgaaactgagatggcagcctatcgattgtacacggttgtccccaggctagttaagttcgtggatatcttgaccaattggtacgtcaggatgaatcgtcgcaggttgaagggtgagaacggcatggaagactgcgtaatggctctcgagacactcttctccgtcctgctgtcattgtgtcgtctgatggctccttacacaccctttctgaccgaactgatgtaccagaacttgaaggtcctaatagatccggtgtctgtccaagacaaggatacacttagtattcattacctgatgttgccgagagtccgggaagaactgatcgacaagaagacagaatcggcagtgtctcagatgcaatccgtgatcgagctgggcagagtgatccgggatcggaaaacaattccaattaagtatcctctaaaggaaattgtggtaatccaccaggacccagaagcactgaaggacatcaagtcccttgaaaaatatattatagaagagttgaacgtcaggaaggtgactctatccacagacaagaacaaatacgggatcagactgagagccgagcctgatcacatggttcttggaaaacggctcaaaggggctttcaaggctgttatgacatctatcaagcagctttcatccgaagaattagagcaattccagaagaccggcaccattgttgtggagggtcatgaactgcacgatgaggatattagactgatgtacacattcgaccaagcaacagggggaacagcccaatttgaagcacattctgacgctcaggcgctggtacttctggatgtcacccctgaccagtccatggttgatgagggaatggcccgtgaggtgattaaccggatccagaaactgagaaaaaaatgtaacctggtgcccaccgatgaaattaccgtctattacaaggccaagagcgaggggacctacctcaactctgtaatcgaatcccacactgaattcatcttcaccaccatcaaagcaccgctgaagccatacccggtgtctccgtctgataaggtgctgatccaggaaaaaacccagcttaagggttcggagttggagatcaccttaacaagagggagctccctgccaggccctgcttgcgcttatgtcaatttaaatatttgtgccaacgggtctgagcagggcggtgtactactgcttgagaatcccaagggcgataaccggctggacctgctcaagctaaaatcagtcgtgactagcatattcggagtgaagaacactgagctcgcggtgttccatgacgaaactgaaatccagaatcagacagacctcctttccttgtctggtaagacactgtgtgttactgctggatccgcccctagcctgatcaattcctcctcaaccctgttgtgccagtacatcaacctccaactgctcaatgccaaaccccaggagtgcctgatgggcaccgtggggacactccttctggagaatcccctcggccaaaatggactgacacatcaaggactgctctacgaagctgcaaaagtgttcgggctgaggagtcgcaaactgaagctattcctgaacgagacccaaacccaagagatcacagaagatattcctgtcaagacacttaatatgaagacagtctacgtctccgtgctcccgaccactgccgatttctag

SEQ ID NO: 227437 - DNA, 3459 bp, Artificial Sequence
  Description of Artificial Sequence: Synthetic coding sequence
atggggatcactgagtataacaaccaatgccgggcaatagtgatgcgatactctgctgagtggaaaagtaccgtcagcagactggggaggtggatcgacttcgacaatgattacaagacattgtacccgcaattcatggaatctgtgtggtgggtgtttaagcagttatatgataaagggctcgtctaccgcggagtgaaagtcatgcccttcagtacagcctgtaacacccctctgagcaactttgagtcccatcagaattacaaggatgtgcaggacccgagtgtctttgtcactttcccccttgaggaagacgagaccgtgtcactcgtggcttggaccacaacaccttggacactgccgagcaatctggccgtttgtgtcaacccagaaatgcagtatgtgaagatcaaggacgtggctaggggaagactcctcatcctcatggaggctcgactatcggccctgtataagttggagtctgattatgaaatcctggaaaggttcccaggagcctatttgaaaggcaaaaaatacaggcctctgtttgactactttttaaagtgtaaggaaaacggggcatttaccgtgttagtagataactacgtgaaagaagaggaaggcactggagtagttcaccaagcgccatacttcggcgcagaggattacagagtttgcatggattttaatatcatccgaaaggactctcttcccgtatgccctgtggacgcaagcgggtgctttactaccgaagttaccgacttcgccggacaatacgtaaaagatgctgacaagtccataattcgcacactgaaagagcagggcaggctgctcgttgccacgacctttacacattcttacccgttttgctggcgcagcgacactcctctgatatacaaagcagtgccctcctggttcgtgcgtgtggagaacatggtggaccagctgctgaggaataatgacctttgctactgggtacccgagctggtgcgggagaagcgatttggaaactggcttaaggatgctcgagattggactatctctcggaacagatactggggaactcctatcccgctctgggtgagtgacgacttcgaggaggtcgtttgtatcggtagcgtggcggaactcgaggagctgtcgggcgcaaagatctccgatcttcatagagagagtgtcgaccacttgacgattccatcgcgctgcgggaagggatctttacatcgaataagcgaggtgttcgactgctggtttgaaagtggctccatgccctacgcccaggtgcactatcctttcgagaacaaaagggagttcgaggatgcttttccagcagatttcatcgccgagggcatcgaccagacacgcggatggttctacaccctcttagtcttagccaccgccttgttcggacaaccacccttcaagaatgtgatcgtcaatggcctggtcctggcatccgacggccagaaaatgtcaaagcgcaaaaagaactaccccgaccctgtatcgatcattcagaaatacggcgctgacgcgctgagactatatttaatcaacagtccagtggtgcgggctgaaaacctcagattcaaggaggagggggtgagggatgttctgaaagatgttctgttaccatggtataatgcgtacaggttcctgatccagaacgtcttgcggcttcagaaggaggaggagatagaattcctgtataatgaaaacaccgtccgggaatcacctaacatcaccgaccggtggattctctctttcatgcaatccctaatcgggttcttcgagacagaaatggcggcttaccgtttgtacactgtagttccaagattagtcaaattcgttgacatcctgacaaactggtacgtgcggatgaaccgcaggaggctgaaaggagagaacggtatggaggattgtgttatggccctggaaactctgttctctgtactcctgagcctgtgccgcctgatggccccatatacccccttcctgactgagctgatgtatcagaacctgaaagtgttgatcgatcccgtctcagtccaggataaggacacccttagcatccactaccttatgctgcctcgagttcgtgaagagctcatcgacaagaagacagagtctgcggtgtcacaaatgcagagcgtcatcgaactaggcagggtcatacgagataggaaaactatccccattaaatatccactgaaggagatcgtggtcattcaccaggatcctgaagcactcaaagatatcaagagcttagagaagtatatcatcgaggagctgaatgttaggaaagtcacactttcaaccgataaaaataaatatgggatcaggctgagagcagagcctgaccacatggtgctcgggaaaaggcttaagggcgcttttaaggcagtgatgacgtcaatcaagcagttgagctccgaagagctagagcagttccagaagactgggaccattgtggtagaggggcatgagctgcacgacgaggacattcgcttaatgtatacattcgaccaggccactggtgggaccgcacagtttgaggctcacagcgatgcccaggccttggtcctcctggacgtaacacccgatcagtccatggtggacgaaggcatggccagggaggtgataaatcggatccagaagctgcgtaagaaatgcaacctcgtccctactgatgagatcacagtgtactacaaagcaaagagcgagggaacttacctaaattccgtgattgaatcccatactgaattcatctttactacgataaaagcaccactaaagccctacccagtgtccccttccgataaggttctgatccaggaaaagactcagctcaaagggtctgaattagaaatcacgctgactcgcggaagcagtctgcctgggccagcttgcgcctacgtgaacctcaacatctgcgcaaatggatcagaacagggcggagtgctcttgctggagaaccccaaaggcgacaataggctcgacctgttgaagctgaagagcgttgtgacctcaatttttggggtgaaaaacaccgagttggcggtatttcatgacgagactgaaattcagaatcagacagacctgctttctcttagcggcaagactctgtgcgtgacagcagggagcgccccatcacttatcaatagttctagcacactcttatgtcagtatatcaacctgcaacttttgaatgcgaaaccacaggaatgtctgatgggcactgtgggtacattgctgctggaaaaccccttaggccagaacgggctgacccaccaaggccttttatatgaagccgcaaaagtgttcgggctgcggtctcggaaacttaagcttttcctaaacgagacgcagacccaggaaataaccgaagacatcccagtcaaaaccctcaacatgaagactgtgtacgtttcagtgttacctacaaccgccgacttttag

SEQ ID NO: 227438 - DNA, 750 bp, Artificial Sequence
  Description of Artificial Sequence: Synthetic coding sequence
atggccccttataccccattcctgactgagttgatgtaccagaatctgaaggtgctcatagaccctgtgtccgtgcaggacaaagacacactaagcatccactacctcatgcttcctagggtgcgagaggaactaattgataagaaaaccgagagtgctgtgtcccagatgcagtcagtgatcgaactgggacgcgtgatcagggaccgcaaaactattcctattaaatacccactgaaagagatcgtggtcatccaccaggaccccgaagcattgaaagacattaagagcctggagaagtatataatcgaggaacttaacgttcgcaaagttacgctgagcaccgacaagaataagtacggaattagacttcgagccgaacctgaccacatggtgttggggaagcggctcaaaggtgcctttaaagcagtcatgacaagtatcaagcaacttagttccgaagagttggaacagtttcaaaagactggaactattgttgttgaggggcacgagttacatgacgaggacattaggctcatgtatacattcgaccaggccactggaggaacagctcaattcgaagcacacagcgatgcccaggctcttgtgctcctggacgtgacacccgaccagagtatggtagacgagggtatggccagggaggtgataaatcgaattcagaagctaagaaaaaagtgtaacctcgtccccactgacgaaattactgtatattataaggctaagtcgtag

SEQ ID NO: 227439 - DNA, 513 bp, Artificial Sequence
  Description of Artificial Sequence: Synthetic coding sequence
atggcaccctacacgccctttctgactgagctgatgtatcaaaacctgaaggtactgatcgaccctgtatctgtgcaagacaaggatacactgtcgatccattatctaatgttgccaagagtgagggaagagcttatagataaaaagaccgaaagtgcagtcagccaaatgcaatccgtgatcgagctgggcagagtgatcagggaccggaagacaatacccatcaagttgaaaggttcagagcttgaaatcacccttacaagggggagcagtctccctggccctgcctgcgcttatgtcaatctgaacatctgtgctaatggcagcgagcagggcggtgttctgcttctcgagaaccctaagggtgacaatcgactggatctacttaagctaaagagtgtagtgacctctatcttcggcgtcaaaaacactgagcttgccgtgtttcacgacgagactgagattcagaaccagaccgacctgctatctctgtctggcaagacactgtgttag

SEQ ID NO: 227440 - DNA, 816 bp, Artificial Sequence
  Description of Artificial Sequence: Synthetic coding sequence
atgatggtacttctgctccagctggattgcctcactatggacatttacctccgcgacaaggataccctgtccattcattatctcatgcttccacgagtgagggaagagctgatcgacaagaaaacagagagcgccgtttctcagatgcagtcagttatcgagttaggacgcgtgattcgcgataggaaaacaatccccattaagctgaaagggtcggaattggagatcacactgactagaggcagcagccttcccggaccagcttgcgcgtatgtaaacctcaacatctgtgccaatggctccgaacaggggggagtactgttactagagaatcctaagggagataacaggctcgacctcctcaagctgaaaagcgtcgtgacctccatatttggggttaagaatacggaactcgcagtgttccacgacgagaccgagatccagaaccagaccgatctactcagtttaagtgggaagactctctgcgtcaccgcgggttcagctccctctctcatcaacagcagctcaactcttctctgtcagtacatcaacctgcagctactcaatgccaagccgcaggagtgtctgatgggaacagtggggactcttttgttggaaaaccctctgggtcaaaacgggttgactcatcagggcctcctgtacgaggccgctaaagtgtttggcctacgtagccgcaagcttaaacttttcctgaatgaaacccagacacaagagatcacagaggacattcctgtgaagaccttgaatatgaaaactgtctacgttagcgtcctccccactactgcagatttctag

SEQ ID NO: 227441 - DNA, 3039 bp, Artificial Sequence
  Description of Artificial Sequence: Synthetic coding sequence
atgcgttgggggctgcggccacgcggacctggtgcagccgctctcgccactgcacgttctctgtgggggactcctaggcttccctgcagcccgggatggcaaggtgcaaccaagaggctccttgttcggtcagtgtccggagcatccaaccatcaacctaattccaatagcggtagatatagggataccgtccttttgccgcagacgtctttccccatgaagttgctggggaggcagcaaccagacacagagttggaaattcagcagaagtgcggcttctccgagctgtattcttggcagcgcgagagaaaagttaagactgagttttgtttgcacgacgggccaccatatgcaaatggagacccacacgtcggccacgcccttaacaagattctgaaggatattgcgaacaggtttcatatgatgaatggcagtaagattcattttgttcccggatgggactgccacggattgcccattgagataaaggtgttgtctgagttaggcagagaagcacagaatctgtctgcaatggagatacggaaaaaggcgagatctttcgctaaggctgctattgagaagcagaaatctgcctttatcaggtggggcatcatggcggattggaacaactgttattacacattcgatggaaagtacgaggctaaacaactcaggaccttctatcagatgtacgataaagggctggtttatcgaagctataaacccgtgttttggagtccgtcgtctcgcactgccctggccgaagctgagctggagtacaatccagagcatgtgagccgctccatctatgtgaagttcccgctgcttaagccaagcccgaaactggcatctctgattgacggtagttcccccgtgtctattctagtgtggacaactcaaccgtggactattcccgctaatgaggccgtttgttatatgcccgagagcaaatatgcggttgtcaaatgttcaaagtccggggacctctacgtcctagctgcagacaaggtcgcatcagttgcttccacactggagaccacattcgagaccatcagcactctgagcggcgttgacctggaaaatggcacatgttcccatccactaataccagataaggcttcaccattgctacctgccaaccatgtcaccatggctaagggaactggactcgtccacaccgccccagcacacggcatggaggattatggtgtggcctctcaacataatctacccatggactgcctggtcgacgaagacggcgtcttcaccgatgtcgctggtccagaactccagaacaaggccgtgctcgaggaagggaccgatgttgtgattaagatgctgcagactgctaaaaatctcctgaaggaggagaagcttgtgcatagctatccttacgattggagaacgaaaaaaccagtggttatccgcgcatccaagcagtggttcatcaacataaccgatattaagaccgccgctaaagaactattaaagaaagtgaagttcattcccggatccgcactcaacggtatggtggagatgatggacagaagaccgtattggtgtatttcaaggcaacgggtatggggtgtcccaattccagtcttccaccacaaaacaaaggatgagtacttgattaattctcagacaaccgagcacatagtgaagttggtggagcaacacgggtcggatatctggtggacattgccaccagagcagctcttgcctaaggaggtattaagtgaagtcggcggtccagatgccctggaatatgtgcctgggcaagatatactcgacatctggtttgattcaggaacctcctggagctacgtgctcccaggtcccgaccagcgggctgatctgtatctggaggggaaggatcagctgggcggttggtttcaaagtagcctgcttacatccgttgctgctcggaagcgagcaccttacaaaacagtaatagtacacgggtttactctcggcgagaagggcgaaaaaatgagcaaatccctggggaatgttattcatcccgatgtggtcgttaacggaggccaggatcagagcaaagaacccccttatggtgcagacgtgctcaggtggtgggtggcagactctaacgtgttcacggaggttgcgattggacccagtgttctcaacgctgcaagggatgacatttcgaaactgagaaatacactgcgatttctgctcgggaacgtcgcagatttcaaccctgagacagactccatccctgtcaacgacatgtacgtaatcgaccagtacatgctgcacctcctgcaggacctggctaacaaaatcacagagctgtataagcagtatgatttcggcaaggtcgttaggttgctgagaacgttttacactcgcgagctttctaacttttacttttcaatcattaaggatcgcctgtattgtgaaaaagaaaatgatcctaaaagacgtagctgccagaccgccctggtggagattctggacgtcatcgtgcgctcattcgcaccaatcctgcctcacctggcagaagaggtgttccagcatataccctacatcaaagagccaaagagcgtgttcagaacgggttggatttcaacttcttccatttggaagaagccaggcctcgaagaagccgtggaaagtgcttgcgctatgagagattcgttcctgggttccatacccggtaaaaatgctgcggagtataaagtcattacagtgatagaacctggtctcctcttcgagatcatcgagatgctccagtcagaagagacttcaagtactagtcagctgaacgagcttatgatggcctcagagagcactcttctcgcacaggagccacgtgaaatgacggccgatgttatcgaacttaaggggaaattcctcatcaatctggagggaggagatattcgcgaagaatcttcatataaggtgatcgtgatgccaactacgaaagaaaagtgtccacgctgttggaaatatacagccgagagcagtgacacattgtgccctcggtgtgcggaggtggtttcagggaagtag

SEQ ID NO: 227442 - DNA, 2823 bp, Artificial Sequence
  Description of Artificial Sequence: Synthetic coding sequence
atgaagttacttggtaggcagcagccagacaccgaactggagatccagcagaaatgcggctttagcgaactttatagctggcagagggagcgcaaagtgaagaccgagttttgtctgcacgatggcccaccatacgctaacggggacccacatgtggggcatgctttaaataagatattaaaagacatcgcgaaccgatttcacatgatgaacggctccaagatacacttcgtgcccggatgggattgccacggtctgcctattgagatcaaggtgctcagcgagctcggaagggaagcccagaatttatcggctatggagataaggaaaaaggcaagaagctttgccaaggcggctattgaaaagcaaaagtctgctttcattaggtggggaataatggcggattggaacaattgttactatacttttgacggaaagtacgaggcgaagcagttaagaactttctaccagatgtatgataagggcctggtgtatcgcagttacaagcctgtgttctggtctccatcaagcaggacagctctggctgaggcagaactggagtacaaccctgagcatgtgtcccgtagtatctatgttaagtttcccctgctcaaaccatccccaaagctggctagtctgatcgacggaagtagccctgtgtccattttagtgtggaccacccaaccttggaccatcccagcgaacgaagccgtatgctatatgcctgaaagcaagtatgccgttgttaagtgtagcaaatccggggacctgtacgtccttgctgcagataaagttgcctcagtggctagcactttagaaaccacttttgagacaatcagcactttgagtggcgtagatctggagaatgggacatgcagtcaccccttgatcccggacaaggcctcccctctgctgcccgctaaccacgtgacaatggcgaagggcaccgggttagtccacactgccccagctcatggcatggaggactatggcgtggctagccaacacaacctcccaatggattgcctggtcgatgaagatggtgtttttaccgatgttgcgggacctgaactgcagaacaaagcagttcttgaggaaggcaccgatgtcgtgataaagatgctccagaccgcaaaaaaccttctgaaggaggagaaattggtgcactcctatccctacgactggcgcaccaaaaagcctgtggttattcgggctagcaaacagtggttcatcaacattactgacatcaaaacagccgctaaagaactgctgaagaaggttaagtttatccccggatccgctctcaacggcatggtggaaatgatggatcgcaggccttattggtgcataagtagacagcgagtgtggggtgttcctatccccgtctttcatcataagactaaagacgagtacctgattaactctcaaacaactgagcatattgttaagcttgtagagcagcatggttcagacatatggtggactctccccccagagcaactattacctaaagaagtactgagcgaagtggggggtcctgatgccttagagtatgtaccaggacaggacatcctggacatctggttcgattctggcacgagctggtcgtacgtgctccccggacccgatcagcgcgcagacctctacctggaaggaaaggatcagctcggcggatggtttcagagcagtctcctgaccagcgtggctgctagaaaacgggctccgtacaagaccgttatcgtccacgggttcacgctgggcgagaaaggcgagaagatgagcaaatccctgggtaatgtgatacatcctgacgtagtggtcaacggtggtcaggaccaatctaaggagcctccatacggggcagacgtcttacgctggtgggtcgccgactcaaacgtctttacagaggtcgctataggacccagcgttctgaacgccgctcgcgacgacatctccaaacttaggaatacactccggtttctcctgggcaatgtcgcagactttaaccctgaaactgacagcatacctgtcaacgacatgtatgtgatcgaccagtacatgctgcatctcctgcaagacctggccaataaaatcaccgaactctacaaacagtacgatttcggcaaggtcgtccggctgctgagaaccttctacactagagagttatcaaacttctacttctccataatcaaggacaggttgtattgcgagaaagagaatgatcctaaacggagatcctgccagacggccctggtcgaaattctcgacgtgatagttaggtcgtttgctccaatccttccacacttggcagaggaggtttttcaacacatcccttatataaaagaacctaagagcgtctttaggacaggatggatctccactagtagcatctggaagaagcccggacttgaagaggccgtagagtcagcctgtgcgatgagagacagcttcctggggagcattcctggcaagaatgcagccgagtacaaggtgatcaccgtgatcgagcccggactgctgtttgagatcattgaaatgctccagtctgaagagactagtagtacctcccagttaaacgagctgatgatggcatcagagagcactctgctggcccaggagcctagggaaatgacagcagacgtgatcgagttaaagggtaaattcctcatcaaccttgagggcggtgacatccgcgaagagagctcttacaaggtcatcgtgatgcctactactaaagaaaaatgccctagatgttggaaatacacagccgagagcagcgacaccctgtgtccgcgatgtgcggaggtagtgtccgggaagtag

SEQ ID NO: 227443 - DNA, 855 bp, Artificial Sequence
  Description of Artificial Sequence: Synthetic coding sequence
atggctggctgcgccgctcgagcacccccaggctctgaggctcgcctatctctggcgacctttctgctgggcgcttcggtgctcgccctccccttattgacccgtgctgggttacagggtcgcactggcctggctctatatgtggcaggactgaacgccttactcctgctgctctaccgccctccccgttaccagatcgctatccgggcttgctttctggggttcgtcttcggatgcggaacactgcttagcttctcccagtccagttggagtcacttcggatggtacatgtgctctttatctctctttcattacagcgaatatctagtaacggctgtgaacaatccgaagagtctgtctctggactctttcctgctgaaccattcactggaatatactgtagctgcgttgtcgtcctggctggagtttactttagaaaacatcttctggcctgaactgaagcaaattacatggttgagtgtcacgggcctgctcatggtcgtgttcggagagtgtttgagaaaggccgcaatgttcaccgcaggaagcaactttaatcacgtggtccagaacgagaagagcgatacacatacactggtgacatccggagtgtacgcttggtttagacacccttcctacgtcggatggttctactggagcatcggtacccaagtaatgctgtgcaatcctatttgtggcgtgagttatgctctgactgtctggcggttctttcgtgacaggaccgaagaggaagagatctcactaatccactttttcggtgaagaatatctggaatataaaaagagagtccctactggcttacctttcataaagggcgttaaggtggacctctag

SEQ ID NO: 227444 - DNA, 351 bp, Artificial Sequence
  Description of Artificial Sequence: Synthetic coding sequence
atggctgggtgcgccgcaagggcacctccaggctccgaagcacggctcagcttggcgactttcctcttgggggctagtgtgctagctctacccttactaacacgcgctggactgcagggacgaaccggccttgcactgtacgtcgcgggactgaatgccttgctacttctgctttataggccacctaggtaccagatcgccataagggcttgcttcctaggcttcgtttttgggtgtgggactctcctcagtttctcacaaagcagttggtcccacttcggttggtcccatttggttcatccacatagccattgccggatttttccctataccatgatctctgtgccatag

SEQ ID NO: 227445 - DNA, 567 bp, Artificial Sequence
  Description of Artificial Sequence: Synthetic coding sequence
atgtgttctttgtcgttattccactattccgaatacttggttactgctgtcaataacccaaagtctctcagcctggactccttcttgctgaaccacagtctggagtacaccgtggcagccttatcctcctggttggaattcacactcgagaatatcttttggcccgaactgaagcagattacatggctctctgtgactgggctcctaatggtggtttttggcgaatgcctcaggaaggctgccatgttcactgcaggatccaacttcaaccacgtcgtccagaatgaaaaaagcgacactcacaccctggtgacttcaggagtctatgcctggttcaggcacccttcctatgtgggctggttctattggagtatagggacccaggtgatgctctgcaatcctatttgcggcgtttcctatgcactaactgtgtggcggttttttagagacaggactgaggaggaagagatcagcctcatccacttcttcggcgaggagtaccttgaatataagaaacgcgtccctactggcctgccattcatcaagggcgtgaaggttgacctctag

SEQ ID NO: 227446 - DNA, 1272 bp, Artificial Sequence
  Description of Artificial Sequence: Synthetic coding sequence
atggcaacagctacacgcctgttggggtggagagtcgcttcatggagactacgcccacctttggctggctttgtgtctcagcgtgcacacagccttcttcccgtggacgacgcgattaatggcttgtcagaagaacagcggcaactgagacagaccatggctaagttcctgcaggagcatctagctccgaaggctcaggaaatcgatcgatccaacgagtttaaaaatctgagggagttctggaaacagctcggtaatcttggagtgctgggaataacagctcccgtacaatatggcggttctggattagggtatctggaacacgtcttggtcatggaggaaatttcccgagcgagtggagcggttgggttgtcctacggtgcccatagcaatttgtgcatcaatcagctggtccggaacgggaatgaagcccagaaggagaaatacctaccaaaactgattagtggcgagtacataggcgcattagctatgtccgagcctaatgctggttccgatgttgtgagcatgaagttgaaagcagagaaaaaaggaaaccactacatcttgaacggcaataagttctggatcacaaacggtccagacgctgacgtgttgattgtttacgcaaaaacagacctcgcggctgtaccggcaagccgcggtatcacagcttttatagtggagaagggaatgcccggatttagcactagcaaaaaactggataagttaggtatgaggggatcgaacacatgcgagttgatttttgaagactgcaagatcccagcagctaatatccttgggcatgagaataagggagtttacgtgttaatgtccggtctggacctagagagattggtgttggctggtggcccactggggctgatgcaggcagtgttagaccacacgataccctatttgcacgtcagagaggcattcggacagaaaatcggtcactttcagctgatgcaggggaaaatggccgatatgtataccaggctcatggcctgccgccaatatgtctataacgttgctaaggcttgtgatgaggggcactgtaccgctaaagattgtgccggtgtaatattatacagcgccgaatgcgccacacaagtggccctagatggaatccagtgcttcggaggaaacggctacattaacgacttcccaatgggacgcttcctgcgcgacgccaagctatatgaaatcggagccggtacttcggaagtgcggaggcttgtgataggacgtgctttcaacgctgactttcattag

SEQ ID NO: 227447 - DNA, 1191 bp, Artificial Sequence
  Description of Artificial Sequence: Synthetic coding sequence
atggctgagatggctaccgctaccaggctgctgggatggcgggttgcttcgtggcgccttcgtccaccactcgccggatttgtgagccagcgggctcactctctgctgccggtagatgacgccattaacggtctgagcgaggagcagcgacaggagttctggaagcagctgggcaaccttggtgttctgggaatcactgcacccgtgcagtatggaggtagcggcctgggctatcttgagcacgtcctggtgatggaagagatcagcagagcctcgggtgccgtgggcctgtcatacggcgctcacagtaatctgtgtattaatcagctggtgcgaaatgggaacgaggctcagaaagaaaagtatctgccaaaactcatctccggggagtatattggcgctctggccatgtccgaacccaacgcaggcagcgatgtggtttctatgaaactgaaagccgagaagaagggcaatcattatatcctgaatggtaataagttttggataacaaacgggccagacgccgacgttctgatcgtgtatgctaagacggacctggcagccgtaccagcctcccgtggcatcactgcatttatagtggagaagggtatgccgggattctccacaagcaagaaactcgataagcttggcatgaggggctcaaatacgtgcgagttgatctttgaggactgcaagatcccagccgctaatatcctaggacatgagaataaaggcgtgtacgtcttaatgtcaggtctggatttggaacgacttgttctggccggagggccactgggtctgatgcaggcagtcctggatcatacgataccttatttgcacgtgagagaagcattcggtcagaagatcggacatttccaactaatgcaaggaaagatggccgatatgtatactaggctcatggcctgtcgtcagtacgtatataatgtggcgaaggcttgcgacgaaggtcattgcactgctaaggactgtgccggtgttatcctatatagcgccgaatgtgctactcaggtggccctagacggaatacagtgttttggaggcaacggatacattaatgattttcccatggggaggtttctgagagatgctaagctctatgagatcggggctggtacctctgaggtgcggcgactggtgattggacgcgctttcaacgctgattttcattag

SEQ ID NO: 227448 - DNA, 1281 bp, Artificial Sequence
  Description of Artificial Sequence: Synthetic coding sequence
atggcagagatggcaactgctacaagacttcttggatggagagtggccagttggagactgagacctcctcttgcaggtttcgtgagccagcgagctcatagtctcctccctgtagacgacgctataaatgggttgagtgaggaacagcggcagctgcgccagaccatggctaaattcctacaagaacacctggctccaaaagcccaggagatcgaccggagcaatgaattcaagaaccttagagagttttggaaacagcttgggaatctcggtgtgcttggcatcaccgcacctgtgcagtacggaggaagcggtctcggatacctggagcacgttctcgtgatggaggagatcagcagagcttccggggctgttggactatcttacggcgctcatagtaacttgtgcataaaccagctggtgaggaacggcaacgaggcccagaaagagaagtacctgccaaagttgatttcaggtgagtacataggcgcactcgccatgagtgaacctaacgccggaagcgatgtcgtctcaatgaagctcaaggctgagaaaaagggcaaccactacattttgaacggcaataagttctggatcactaacggtccggacgccgatgtcctcatcgtatacgctaagacagacctggcagctgttccagctagtagagggattaccgcttttatcgtcgagaaaggaatgccaggcttttcaacatctaaaaaactggataagctggggatgcgtggcagcaatacttgtgagctgatatttgaggactgcaaaataccagccgcaaacatcttgggacacgagaataaaggggtctatgtgttaatgagcggcctcgacctggagagacttgtgcttgctggaggccctcttggactcatgcaggccgttctggatcacaccattccatatctgcatgtgcgcgaggctttcggacaaaaaatcggtcattttcagcttatgcaggggaagatggcagacatgtacacacgacttatggcatgcaggcagtacgtgtataatgtggcgaaagcctgtgacgagggtcactgtactgcaaaagactgtgcaggcgtcatactttacagtgcggagtgtgccactcaagtggcccttgacgggattcagtgttttgggggaaatggctatattaatgacttccctatggggaggttccttagagatgctaaattatacgagattggagctgggactagcgaggtgcgaaggttggtaatcggccgtgcctttaatgctgacttccactag

SEQ ID NO: 227449 - DNA, 1716 bp, Artificial Sequence
  Description of Artificial Sequence: Synthetic coding sequence
atgagagccctgagggaccgagccggactgctcctgtgtgttctactgctggcggctctgctggaagccgctctcgggttgcccgtgaaaaagcctagactgagaggcccaagaccagggtccctcacaagactcgctgaagtttccgcaagtcctgatcctagacctttaaaggaggaggaagaggcaccacttctcccaaggacccatcttcaagctgaacctcaccaacacggctgttggaccgtaacagagccagccgctatgactcccggtaacgccaccccgcctaggactcctgaggtgactccactacgactagaactgcagaagctacccggactggctaacacaacactgagcacccctaatcctgatactcaggcatctgcatccccagatccgcgacctctcagggaagaagaagaagctcggctcctccccagaactcacttgcaagctgagcttcatcagcacggttgttggactgtcactgagcccgctgcgcttaccccaggcaacgcgactccaccgagaactcaggaagtgacaccattgctgctagagcttcaaaaactgcctgagctggtgcatgcgactctctcaaccccaaacccagacaaccaagtcacaattaaggtcgtcgaggacccccaagctgaggtatctatagacctcctggccgagccctctaatccaccccctcaggatactctgagttggcttccggcactgtggtcatttctgtggggcgactacaagggcgaggagaaagatcgggctccgggtgagaagggggaagaaaaagaggaggatgaggactacccttcagaagacatcgagggcgaggatcaggaggacaaggaggaggacgaagaagaacaagctctgtggtttaatggcactacagataactgggatcagggatggctggcacccggtgactgggtgttcaaagactctgtcagctacgactacgagccccagaaagaatggtctccctggagcccgtgttcgggcaattgctctactgggaagcagcagcggacaagaccctgtggttatggctgtacagccactgagacaagaacttgtgacttgccatcttgcccagggactgaggacaaggacaccctcggattgccctcagaagagtggaaactgttggccaggaacgctacagatatgcatgaccaagatgtggactcctgtgaaaagtggcttaactgcaaatccgattttctgatcaaatatttatctcagatgcttagagatctgcccagctgtccttgtgcgtacccactggaagctatggattctccagttagcctgcaggacgagcaccaagggcgaagcttccggtggcgagatgccagtggccctagagaaaggcttgatatctatcagcccacagctcgtttttgcctccgctccatgctctcgggagagtcaagcactcttgccgcacaacattgttgttacgacgaggactctcgccttctgactcggggaaaaggagccggtatgccaaacctaatttctacggatttttctcctaagttacattttaaattcgatactaccccgtggattctgtgtaagggcgactggtcgcgtctgcatgctgtcctcccaccgaacaatggcagggcgtgcacagataatcccctcgaggaggagtatttggctcagctacaagaggcaaaggaatactag

SEQ ID NO: 227450 - DNA, 1452 bp, Artificial Sequence
  Description of Artificial Sequence: Synthetic coding sequence
atgactcctggtaacgcaacccctccccgaacaccagaagtaacccccttgcggctggaactgcaaaagctgccaggactggccaacactacgttgtccacccccaatcccgatacccaggcctcagcctcccctgacccaaggcccctcagagaggaggaagaggccagactgctaccccgtactcacctccaagctgagttgcaccagcatggatgctggaccgttactgagccagccgcacttaccccgggaaatgctacaccgccacgaacccaagaggttactcctttgctgctcgaattgcaaaagctgcctgaactcgtgcacgccacactcagcacacccaacccagataaccaggtcacaataaaggtggtggaggatcctcaggccgaggtttcaatagatttactggcagaaccctccaaccctcccccacaggacactcttagctggctgccggctctgtggagcttcctatggggtgactataagggggaagaaaaggatcgggcaccgggtgagaaaggtgaagaaaaagaggaggacgaagactatccatctgaggacatcgagggtgaagaccaggaggacaaggaagaagacgaggaagagcaggctctctggttcaatggcactaccgacaactgggatcagggctggctcgcacctggggattgggtattcaaggatagcgtatcctatgattacgagccacagaaggagtggagcccatggtccccttgcagcggaaattgtagcactggcaaacagcagagaacaaggccatgtgggtatgggtgcacagctaccgagacccggacctgcgacctgccctcctgccctggcaccgaggataaagacacactgggtctaccttcagaagagtggaagttgctggcccgaaatgctaccgatatgcatgaccaagatgtagattcatgtgaaaagtggctaaattgcaaatcggactttcttatcaaatatctgtcccagatgttgcgcgatctgccttcttgcccgtgcgcgtacccattagaagctatggattcgcctgtgtctttacaagacgaacatcagggcaggtcctttaggtggcgggatgcatcggggccacgtgaacgtctcgacatctaccaaccgactgctagattttgcctgcgatcaatgctgtccggggaatcctctacactcgcagcccaacactgttgctatgatgaagactcccgcctcctgacacgcggtaaaggggcagggatgcctaacttgatctccactgattttagccctaaactgcattttaagtttgatactactccctggatcctatgcaaaggggattggtcacgcctccacgcagtgctacctcctaataacggcagggcctgcactgacaaccctctggaagaagagtacttagctcaactgcaggaggctaaggagtattag

SEQ ID NO: 227451 - DNA, 1473 bp, Artificial Sequence
  Description of Artificial Sequence: Synthetic coding sequence
atgagggctctgcgtgacagggctggcctgctcctttgtgtcctactgctcgctgctcttctggaggccgctctgggcctgcccgttaagaaacctcgccttcggggtccaagacccggttctctaaccagacttgccgaagtttctgcttcaccagaccccaggcctcttaaggaggaggaggaggctccactgctccccaggacccacctccaggccgagccccatcagcacggctgctggaccgtgacggagccagccgcaatgaccccagggaatgcgacaccacccagaacgccagaggtcacaccactacgccttgagctgcagaagctcccaggtctggccaatacaaccctatcaacgcccaaccccgatacgcaggtcaccataaaagtcgtggaggatccccaagccgaggtgtccatagaccttctggccgagccttctaaccccccacctcaggataccctgtcttggttgcccgctctctggagctttctatggggtgactataaaggagaggagaaggatagggctccaggcgagaaaggagaagagaaagaggaggacgaagactatccctccgaggatatagagggtgaggatcaagaggacaaagaagaagacgaagaggagcaagctctctggtttaacgggacgacggacaactgggatcaggggtggctcgcacctggagactgggtgttcaaggattctgtgtcatacgactacgagcctcagaaagagtggagcccatggagtccctgcagcgggaactgctctactggaaaacagcaacggaccaggccctgcggctacggttgtacggcaacggagacaagaacatgcgatttgccgtcatgccctggaactgaggataaagataccctgggcctgccttctgaagagtggaaattattggccaggaacgccaccgacatgcatgatcaggacgtagatagttgtgagaagtggctgaactgtaagtctgactttctcatcaaatatctatctcagatgttgagagaccttccatcttgtccgtgcgcctacccactggaagccatggactctccggtttccctccaagatgagcatcaggggaggagcttccgctggagggacgcatcaggcccacgcgaaaggttggatatctatcaaccaactgctcgattttgtctgagaagtatgctgtccggtgagagtagtacactcgccgctcaacattgctgctatgacgaagatagcagactgctgacgcgcggaaaaggagcaggcatgcccaatcttattagcacggacttttcccccaaactgcactttaaattcgatactaccccatggattctgtgtaaaggggattggagtcggctgcatgccgtcttaccacctaataacggcagggcttgtactgacaatcccctggaagaggagtatctcgcccagctgcaggaagccaaagagtattag

SEQ ID NO: 227452 - DNA, 1473 bp, Artificial Sequence
  Description of Artificial Sequence: Synthetic coding sequence
atgagagcactccgtgatcgggctggacttctgctgtgcgttttgttgctggcagcactcctggaggctgcgttaggcctgcccgtgaaaaagcctcggctccgtggaccacgcccaggcagcctaacaagactggctgaagctagcgcctcaccagaccctagaccgctgcgagaagaagaggaagccaggctgttacctaggacacatcttcaagccgaattgcaccagcacgggtgttggaccgttaccgaacctgcagccctgactcctgggaatgctacacccccacggacacaggaggtcacccctctcctattagaactgcaaaaactacccgagttggtgcatgccacgctgagcactcccaatccggacaaccaggtgacaatcaaagtcgtggaagatccacaggccgaggtgtctatagatctgctcgccgagccgtccaaccctcccccacaggataccctgtcatggctgccggcactgtggtcattcctatggggcgattacaagggcgaagagaaggacagagcacctggcgagaagggagaagagaaagaggaggatgaagattatcctagcgaggatatagagggcgaagatcaggaagataaagaggaagatgaggaggagcaggccctttggttcaacggaacgacagacaattgggaccaaggctggctcgcacctggcgattgggttttcaaggattcagtcagctatgactatgaaccacagaaggagtggtcaccttggtcaccctgttccggcaactgttcaaccgggaaacaacagcggactcggccttgcgggtacggctgcaccgctaccgagacacgaacctgcgatctcccttcttgtccaggcacggaggacaaggatacccttggtctgccttcggaggaatggaaattgctcgccaggaacgcgacggatatgcatgaccaggacgtagattcctgcgagaaatggctgaactgcaagtctgattttctcatcaaatacctcagtcagatgctaagggacctgccctcctgcccatgcgcttaccctctcgaggcaatggactctcctgtgtccttacaagatgagcaccagggaagatcctttcgctggagggacgcgagcggccctcgagagagattagacatataccagcccaccgccaggttctgcctgcgctccatgcttagcggagaaagctcaactctcgccgctcagcactgttgctatgacgaggacagccgacttctgactcggggtaaaggcgcagggatgcctaacctcatatccactgatttcagcccaaagctgcacttcaagttcgacaccacaccatggattctttgcaaaggggactggagcagactgcatgccgtgctacctccgaacaacgggagggcctgcaccgacaaccccctggaagaagagtacttggcacaactccaggaagcgaaagagtattag

SEQ ID NO: 227453 - DNA, 879 bp, Artificial Sequence
  Description of Artificial Sequence: Synthetic coding sequence
atgcgtgccctgagagatagggccggtctgctcctctgcgtgctgctcctcgcagcccttctcgaagcagccctggggcttccagttaagaagcccaggctacggggtcccaggcccggtagcctcactcggctggctgaggtcagcgccagtcccgacccaaggccgttaaaggaggaagaagaagccccactcctgccgaggacccatctgcaggctgagcctcatcagcacggctgctggactgttacagaaccagccgctatgactcccggtaacgcaacaccaccaagaacgcccgaggtgacacctctgcgtctagaactgcagaagctccctgggttagcgaatacgactttaagtacccctaacccagacacacaggcatcagcctctcctgatcctcgcccactgcgggaggaagaggaagcaagacttctgcctaggacccacctgcaggcggagctgcaccaacatggctgctggacggtgaccgagcccgcagcactgacccccggtaatgcaacgcccccacgcacacaggaggtcactcccctcctgctcgagctgcaaaaactgcctgagctggtgcatgccaccctcagcaccccaaaccctgacaatcagaccatgagccttaggcgttctggcgtgccaggactgccagcggtgggaacagctgctctggcttcctcacggggattagggcctgtcgctatggctgctctcccccctagacccgtccccgttacttgtcctcccgtcctggccctacgcacccgtaccccttgggcttccccagtgcggtcaggcagtagttggcccgcaatgcttagaacttgtatgattaagatgtggactgccgtgagaagtggatag

SEQ ID NO: 227454 - DNA, 924 bp, Artificial Sequence
  Description of Artificial Sequence: Synthetic coding sequence
atggcccgaaacgcagagaaagcaatgacggcacttgcccgattccgacaagcacagctcgaagaagggaaggtcaaagagcgtaggcctttcctggcctctgagtgcaccgaattgcccaaggccgagaaatggaggcgacagattatcggcgaaattagcaagaaagtagctcagatacagaacgcaggcctgggggagtttagaatccgggatctgaatgacgagattaacaagcttttaagagagaaagggcattgggaggtccgtattaaggaactaggcggacccgattatggtaaagtcggtcctaagatgttggaccatgagggaaaggaagtccccggtaatcggggatacaagtatttcggtgcagcaaaagacctcccaggcgtgcgggagttgtttgaaaaagaaagacaagttaggtggttaatgccagtgatccccgctctttgggaggcagaggcaggcggttcccaggccctgccccctcccagaaaaacacgcgctgaactgatgaaagccatagacttcgaatactatggctacctggacgaggatgatggggttattgtgccactggaacaggaatacgaaaaaaagctgcgagccgagctagtagaaaagtggaaggccgagcgcgaggccaggctagcacggggagagaaagaggaggaagaagaggaggaggaagagattaacatctatgccgtgaccgaggaggaaagcgatgaggaaggatcacaggagaagggcggagatgatagccagcagaaatttattgcccacgtcccagtcccgtcccagcaggagattgaggaggcactggtgagacgtaaaaagatggaactattacagaaatatgctagcgagacccttcaggcacagtcagaggaagctaggcgcctgctcggttactag

SEQ ID NO: 227455 - DNA, 858 bp, Artificial Sequence
  Description of Artificial Sequence: Synthetic coding sequence
atggcccgaaatgccgagaaagccatgacggccctggccagattcagacaagcacagctggaggaaggaaaggtgaaagaacgtagacctttcctcgcctcagagtgtactgaactgcccaaagcagagaagtggcggagacaaatcatcggcgagatctcaaaaaaagtagctcagatacagaacgctgggctgggcgagtttcgcatccgggatctgaacgacgaaatcaataagctcctcagggaaaagggacattgggaggtgcgcatcaaggagctggggggaccagactacggaaaagtggggccaaaaatgcttgaccacgagggcaaggaagttcccggaaatagagggtacaagtatttcggggctgcgaaagatctgcccggagtgagagagctctttgaaaaagagccactgcccccacccagaaaaacgagagcagagctaatgaaggccatcgatttcgaatattacgggtacttggacgaggatgacggggttatcgtaccactggagcaggagtatgaaaaaaaacttagggctgagctggtggagaaatggaaggccgagagagaagcaagacttgctcgcggtgagaaggaggaagaagaagaagaagaggaggagatcaatatttatgctgtaacagaggaagagagcgatgaggaagggtcccaggagaaagggggagacgatagccagcagaaatttattgcccacgttcctgtgccatcgcagcaagagattgaggaagcccttgtgcgtcgaaagaaaatggagctgcttcaaaagtatgccagtgaaacattacaggcacagagcgaggaggcccgacgactcctgggatactag

SEQ ID NO: 227456 - DNA, 2712 bp, Artificial Sequence
  Description of Artificial Sequence: Synthetic coding sequence
atgagcgatagcggcagtcagcttgggtctatggggagtctgaccatgaaaagtcagctgcagattactgtaattagcgcaaagttgaaggagaacaagaagaactggtttggtccttccccatatgtagaggtgacagtcgacgggcagtccaaaaaaactgagaagtgcaataatacgaattctcccaaatggaagcagcctctgaccgtaatcgttacgcccgtgtccaagctgcatttccgcgtttggagtcatcagactctcaaatctgatgttctgcttggcactgcagccctcgatatctatgagaccctgaaaagcaacaatatgaagctggaagaggtagtggtgacactgcaattgggcggtgacaaagaacctaccgaaactatcggagacctcagtatttgtctggacggccttcagcttgagtctgaagtcgtcacaaacggcgaaacgacctgtagtgagaatggggtcagcctctgcctcccgcgtttagagtgcaacagtgcgatttcagcgcactgcaatctgtgtctacctggactctctgattcgcctatttctgcatcacgtgtggccggtttcaccggcgcttcccagaatgacgacggttctcgtagcaaggacgagactcgagtcagcaccaatggcagtgatgacccagaagatgcgggtgctggggaaaaccgccgagttagtggaaacaacagcccctcactgtctaacgggggattcaaaccctccagaccccctaggccaagccggccacccccaccgacaccacgccgtccggctagcgtgaacggaagccctagcgccaccagtgaatctgacggaagtagtactggatctctcccacccactaacaccaatacaaacactagcgaaggcgcaacctccggccttatcatccctttgacaattagcggcggatctgggcctagaccattaaatcccgtcactcaggctcccctgccccctggttgggagcagcgagtggatcagcatggccgagtatactatgtggaccacgtggagaagaggaccacctgggaccggccagagcctctgccccctgggtgggaacggagagtggacaacatgggccgtatctattacgtggaccactttactcgcactaccacctggcagcgccctaccttggagtcggtgaggaattacgaacagtggcagctccagcgctctcagttgcagggagcaatgcagcaattcaaccagcgctttatttatggcaaccaggatctctttgctacctcccagtcaaaagaattcgatcctctgggcccactgccaccgggatgggagaagaggaccgatagcaacgggagggtttattttgtgaaccacaacacgagaatcactcaatgggaagaccctcgctctcaaggacagttgaatgaaaagccccttccagagggatgggagatgcgttttacagtggacggcatcccgtatttcgtcgaccataacagaaggacaactacatacattgaccccaggacggggaaaagcgcccttgataatggaccgcagatcgcctatgttcgcgacttcaaagccaaggtgcagtattttagattttggtgtcagcaactagccatgcctcagcacatcaaaatcacggttactagaaaaactttgtttgaagatagtttccagcaaatcatgtctttcagccctcaggacctgagacgacgactgtgggtcatcttccccggtgaagagggactggattatggcggagttgccagggagtggtttttcctgctcagccatgaggtgctgaaccccatgtattgcctttttgaatacgcagggaaggacaactattgcttgcaaatcaatcctgctagctacatcaatcccgaccacctgaaatactttagattcatagggcgattcatcgccatggcactgtttcatggaaagttcatcgacaccggcttcagtttgcctttttataagcggatactcaacaaacccgtgggattaaaggacctggagtccatcgacccagaattctataattccctgatctgggtgaaggaaaataatattgaggagtgcgacctggagatgtatttttccgtggacaaggagatcctaggcgagatcaaatctcacgacctgaagccaaacggtggtaacatcttagtgactgaagagaacaaggaggaatatatccgtatggtggccgagtggcgactatccaggggcgttgaggagcagacacaagccttcttcgagggattcaacgaaattctcccccagcagtatctgcaatatttcgacgctaaggagttggaagttctcctgtgcggtatgcaggaaattgacctcaatgactggcagcgccacgcaatctacagacactacgccagaacctctaagcaaatcatgtggttttggcagttcgtcaaagaaatagataacgagaaacgcatgcgtctgcttcaatttgtgaccggaacctgtagactgcccgtcggagggttcgctgatttaatgggatcaaatggtccacagaagttctgcatcgaaaaagtcggtaaggagaattggcttccccgaagtcacacgtgcttcaacagactagacctgcccccttataaatcctatgagcagttgaaggagaagttacttttcgcaatagaggagaccgaagggttcgggcaggagtag

SEQ ID NO: 227457 - DNA, 2589 bp, Artificial Sequence
  Description of Artificial Sequence: Synthetic coding sequence
atgagtgactccggcagtcagcttgggtctatgggatctctcacgatgaagtcccagttacaaataactgtgataagcgctaagttgaaggaaaataagaaaaactggttcggcccttcaccctatgtggaggtcaccgttgacggccagtccaagaaaactgaaaaatgtaacaacactaacagccccaaatggaagcaaccgttaaccgttatcgtgacacccgtaagtaaacttcactttcgggtctggtcccaccagaccctcaagtccgatgtgcttctggggaccgcggcactcgacatttatgagaccctcaagtccaacaacatgaaactagaggaggtcgtcgtcaccctgcagctgggtggtgataaagaacccaccgagaccattggtgacctaagcatctgcctcgatgggttgcagcttgagagcgaagtcgtcacgaatggagagactacgtgctccgagtccgcctcacagaatgatgacgggtcaaggagcaaggatgagactcgagtgtcaaccaatgggtcagacgatcctgaagatgctggcgcaggagaaaaccgccgtgtgtctgggaataattcccctagcctgagtaacggcggattcaaaccatcaaggccgcctcgccctagtcggcctccgccacccacaccacgacggcctgcaagcgtcaacggctcgcctagtgctaccagtgaaagcgatggtagttcaacggggtccttaccacccaccaacaccaacacgaatacttccgaaggtgctaccagcggccttataataccgcttacaatctctggcggatcgggaccccgaccattgaatcccgtgacccaggccccattgccgccaggatgggagcaacgggtagaccagcacggacgcgtctattacgttgatcatgttgagaaaaggacaacttgggatcggcctgagcccttacccccaggttgggaacggagagtggacaatatggggcgtatttactatgtggaccacttcactcgcacaaccacatggcaacgtccaactctcgaatccgtgcggaactacgaacagtggcagctccagcgctctcagcttcagggagccatgcagcagtttaatcagcgctttatttacggtaaccaggatctctttgctacttctcagagcaaggagtttgatccgctcggccctctccctcctgggtgggaaaagaggactgactctaacgggcgagtctacttcgtgaatcacaacacgcgcataacccagtgggaagaccctcggagtcagggacagctcaacgagaagcccctccctgagggctgggagatgaggtttacggtggatggcatcccttatttcgtcgaccacaatcggcgaactaccacctatattgacccgaggaccgggaagagcgctctggataacggacctcagatcgcctatgtgcgcgactttaaggccaaggttcagtatttcagattctggtgtcaacagttagctatgccacagcacattaagatcaccgtaacgaggaagaccctgtttgaagatagttttcagcaaatcatgtcattcagcccacaggacttgaggagacgtctgtgggtcattttccccggtgaagaaggtctcgactacggaggggtagctagggaatggttttttctgctctctcacgaggtcctgaacccaatgtattgcttgttcgaatatgcagggaaagacaactactgcttacaaattaacccggcaagctacatcaatcccgatcatctgaagtatttcaggttcattggacgcttcattgcgatggctctgtttcacggcaaatttatagataccggcttttccctgccattttacaagagaattttgaataagccagtggggctcaaggatctggagagcattgacccagagttttataattccctgatttgggtcaaagaaaacaatatcgaagaatgcgacctggaaatgtacttttccgtcgataaggagatcctgggtgagatcaagagtcacgacttgaaacccaacggcggaaacatactggtcactgaagagaacaaggaagagtatatccgaatggtagccgagtggcggctgagccggggagtggaagagcagacccaggctttttttgagggttttaacgagatcctgccccagcagtatctgcagtatttcgacgctaaggagctagaagtgctgctgtgcggaatgcaggaaattgatctgaatgactggcagcggcacgctatatatcgtcactatgctcggactagcaagcagatcatgtggttctggcaattcgtcaaagagattgacaatgagaagagaatgagactcttgcagtttgtgactggcacgtgccgcctccctgtcggtggattcgcagacctgatgggcagcaacggccctcagaagttctgcatcgaaaaagtcggcaaagaaaattggctgcctcgctcccacacgtgtttcaaccggttggatttgcctccctacaagtcctacgaacaactgaaggagaagctgctattcgcaattgaagagaccgagggcttcggccaggaatag

SEQ ID NO: 227458 - DNA, 2259 bp, Artificial Sequence
  Description of Artificial Sequence: Synthetic coding sequence
atgaagctcgaggaagtggtagttaccttgcagctcggtggtgacaaggaaccgacagagacaattggcgatctgagtatatgcttggacggtctgcagctggagagcgaggtcgttacaaatggagagactacttgctccgagtcagcttctcagaacgatgatgggagccgctctaaagacgaaacgcgcgtttctaccaacggaagcgatgatccagaggacgcaggggctggagagaatagaagggtctcagggaataatagtccatccctgtccaatggaggatttaagcctagtcggccaccgaggccatcaagacctcctcctccaacccctaggagacctgcttccgtcaacggcagtccgtccgccaccagtgagtctgatggatcaagtaccggatcactccctcccacaaacacgaacaccaatacaagcgaaggcgctacaagcggactgattatccctctgacaatctctggcggtagcggccctaggcctttaaacccggtgacccaggcccctctgccgcctgggtgggagcaaagggtggaccagcacggccgtgtgtactacgtggaccacgtggagaaacgaactacatgggatcgcccagaacctcttcccccaggctgggaacggagagtggacaatatgggccgtatctactatgtggaccatttcaccaggacaactacgtggcagcggcctactctggagagcgtcaggaattacgaacagtggcaactacagagaagccagctacagggggcaatgcagcagtttaaccagcgttttatttacggaaatcaagatctgttcgccacatcccagagtaaggaatttgaccctctgggccctctgccacctggatgggaaaaacggacggatagcaatggtagagtctacttcgtgaaccataacacacgtatcacccagtgggaggacccgcgttcccagggacaacttaatgaaaagccactcccagaaggctgggagatgaggtttacagttgacggaattccgtacttcgttgaccacaacagacgaactaccacctacattgacccaagaacagggaagtctgcacttgataatgggccacagatcgcttatgttagggactttaaagcaaaagtccagtacttccggttctggtgtcagcagctagccatgccccagcacattaagatcacagtgactagaaaaaccctgttcgaggactcgttccagcaaatcatgtcattttccccccaggacctcagacggaggctgtgggtcatctttccaggagaggagggactcgattacggaggggtcgcgcgtgaatggttttttttgctgtcccacgaggtcctcaaccccatgtactgccttttcgagtacgctggcaaagataactactgcctccagatcaaccccgctagctacattaatcctgatcacctgaaatactttcgatttataggcaggtttattgcaatggctttatttcacggtaaatttatcgacaccggcttctccttgccattctacaagcgtattttgaataagccggtaggtctgaaagacctagagtctatcgacccggagttctacaattctctaatttgggtcaaggaaaacaacatcgaggagtgcgatctggagatgtattttagtgtagataaagagattctgggcgaaatcaagagccatgacctcaaaccgaatgggggaaacatcctggtcacagaggagaacaaggaggaatatatccgtatggtggcagagtggagactttcgcgcggtgttgaggagcaaacgcaagctttcttcgaaggcttcaacgaaatccttccccagcagtatctgcagtatttcgatgccaaggaactggaggtcctgttgtgcggcatgcaggagatcgacctcaatgattggcagcggcatgccatctaccggcactacgcaagaactagcaagcagatcatgtggttctggcagtttgtcaaggagattgataatgagaagcggatgcgcctgctccagttcgtcacggggacatgccgcctgccagtggggggattcgccgatctgatgggctcaaacggaccacaaaagttttgcatcgaaaaggttggtaaggagaattggctcccaaggagccatacttgtttcaatcgactagacctacctccgtacaagtcttacgagcagcttaaagagaaactgttattcgctatagaggagaccgagggatttggtcaggagtag

SEQ ID NO: 227459 - DNA, 3717 bp, Artificial Sequence
  Description of Artificial Sequence: Synthetic coding sequence
atgcgggcacagggtcgcggtcgactgcccaggcgcctcctcctcctgttggcattgtgggttcaagccgcacggccaatgggttacttcgagttgcagttgagcgccctgcgcaatgtcaatggggaactattgagcggagcatgttgcgacggcgatggtaggacaacccgtgctggagggtgtgggcacgacgagtgcgatacatacgtgcgcgtctgcctgaaggaataccaagcgaaggtcacacccacgggcccttgtagttacggccacggcgcaacccctgtgctaggcggaaatagcttttatctgcctccagccggtgctgctggggatagagcacgggctagagccagggcaggaggagatcaggacccgggactggtcgtcataccttttcagtttgcatggcccaggagctttaccctcatagtggaagcgtgggattgggacaatgacacaacccccaacgaggaattgctcatcgaaagggtgtcccacgccggtatgataaacccagaagaccggtggaagagcctgcactttagcgggcacgtcgctcacctggagctgcagatccgagtcagatgcgacgaaaattattatagtgccacttgtaataagttctgtcggccaagaaatgatttttttggacattacacctgtgaccagtacggaaacaaggcttgtatggacggttggatgggaaaggaatgcaaagaggccgtttgcaagcagggctgcaacctgctccatgggggttgcacagtacccggagagtgccgctgctcgtacggttggcaggggaggttttgcgatgagtgcgtgccctaccctggctgtgtgcatgggtcatgcgtcgagccctggcagtgcaattgcgagactaattggggcggactcctgtgtgacaaagatctgaattactgcgggtctcaccatccgtgcaccaatggaggcacatgcatcaacgctgagcctgaccagtacagatgcacatgccccgatggctacagtggtagaaattgcgagaaagccgagcacgcctgtaccagtaacccttgcgccaatgggggaagctgccacgaagttccttctggcttcgaatgtcactgcccctcaggctggtccggccctacatgtgccctggacatagatgaatgcgcatccaatccttgtgcagcaggaggcacttgcgtggaccaggtcgatgggttcgagtgtatctgccccgaacagtgggtgggtgccacatgccagttggatgcaaatgagtgcgagggaaaaccctgtctgaacgctttttcctgtaagaacctgattggcggatactattgtgattgtatacccggttggaaaggcattaactgccacataaatgttaatgactgccgcggtcaatgtcagcacggtggaacctgcaaggatctcgtgaatgggtaccagtgtgtgtgccccagaggctttggtgggagacactgtgagctggagcgggacgagtgtgccagcagcccgtgccattccggaggtctgtgtgaagatctggccgatgggttccactgccactgtccgcagggcttttctggcccactctgcgaggtcgacgtagacctgtgcgagcctagcccctgccggaatggggctaggtgttacaacctggagggagactactattgcgcttgccctgacgatttcgggggtaaaaactgtagcgtgcctcgtgaaccatgtcctggcggagcatgtagagtcattgacgggtgtggtagcgatgctggcccagggatgcccggaacagccgcatcaggggtctgtggcccacatggtcgttgcgtatctcagccgggaggcaatttcagctgtatatgcgattcagggtttaccggcacatactgtcatgaaaacatagacgattgtctcggtcagccctgtaggaacgggggaacatgcatcgacgaggttgatgcgttcagatgtttttgccccagtggatgggaaggcgaactgtgtgacacaaaccccaacgactgcctcccagatccctgtcacagccgcggacgatgttacgatctggtcaatgacttctattgtgcatgcgatgacgggtggaagggcaagacctgtcacagtagggagttccagtgtgacgcttatacatgcagtaacggcggtacttgctacgactccggggacactttcaggtgtgcatgtccacccggatggaagggaagcacctgcgctgtggctaaaaactcaagctgcctccccaatccttgcgtgaatggtggaacatgcgtgggctccggtgcaagttttagttgcatttgtagagatggctgggaaggcaggacatgtactcacaacaccaacgactgtaacccactcccctgctacaacggcggtatctgtgtcgatggggtcaactggtttcggtgcgagtgcgcgccaggatttgccggtcccgactgtagaataaacatagacgaatgtcaatcaagtccctgcgcctacggcgcaacctgcgtggacgagattaacggctataggtgcagttgccctccaggcagggccggtcctagatgccaggaagtgatcggcttcgggaggtcatgctggagccgcggtacacccttcccgcacggtagctcatgggtggaagactgcaattcatgtcgttgcctagacgggaggcgggactgtagcaaggtgtggtgcgggtggaagccatgtctgctagcaggccagccagaagcactttctgcgcaatgccctttgggtcaaaggtgcctggaaaaagcgccaggacagtgcctgaggccaccttgcgaagcttggggggagtgtggagcagaagaacccccttctaccccctgcctgccaaggtccgggcatctggataacaattgcgcccgtctcaccctacattttaatcgggatcacgtgccccaagggaccaccgtcggtgccatttgcagtggaatccgctctcttcctgccacaagagcagtggccagagaccggttgttggttttactctgtgatagagctagctctggggctagcgcagtggaagtggcagtatccttcagtcccgctcgcgacctacctgactctagcctcatccagggcgctgctcacgcgattgttgcggcaatcacccagaggggcaacagtagcctactgttggccgttacggaagttaaggtcgagacagtggttactggaggctcctccacaggcctcctagtacctgtgctatgtggcgcatttagcgttctttggctggcgtgtgttgtcctgtgcgtgtggtggactagaaaaagacgaaaggagagagagagatcgcgcttgccccgagaagagtccgctaacaatcagtgggccccactgaatccgatccggaatccaatcgagcgtccgggagggcacaaggacgtgctgtatcagtgtaagaattttactcctccgcctcggagggcggatgaggctctaccaggacccgctggtcacgctgcagtccgagaggacgaggaggatgaagacttaggtcggggagaggaggactccctggaagctgagaagtttctgtcacataagttcactaaagatcccggtcggagcccgggaagacccgcacattgggcttcgggcccaaaggtcgataatcgcgcagtcagatccatcaacgaggctcggtatgcagggaaggaatag

SEQ ID NO: 227460 - DNA, 3603 bp, Artificial Sequence
  Description of Artificial Sequence: Synthetic coding sequence
atgagggcccagggacggggaagactcccaagaaggctgctgttgcttctggctctctgggtgcaggcagcgagaccaatgggatattttgagcttcaactatccgcattgcgtaatgtcaatggagaactgctttctggggcttgttgcgatggcgatggacgaactactcgtgctggcggttgtggacatgacgagtgcgatacatacgtgcgggtatgcctgaaggagtatcaggcaaaagtgacgcctacagggccttgtagctacggacatggggctaccccagtactgggaggaaatagtttttacctgccccctgcaggagccgcaggcgatcgcgctagggctagggctagagcgggaggtgaccaggatcccggtttggtcgtaatcccttttcaattcgcctggccacggagcttcactctgattgtggaggcttgggattgggacaacgataccaccccaaacgaggagctgcttattgaacgggtttctcacgctggcatgatcaaccccgaggaccgatggaaatctttacatttctctgggcacgttgcccacttggagcttcagatcagggtccggtgtgatgagaattattattctgccacatgcaataagttctgtagacctcggaatgacttctttggacactacacgtgtgaccagtatgggaataaggcctgtatggacgggtggatgggtaaagaatgcaaggaagctgtgtgcaaacagggttgtaatcttctgcacggaggctgcaccgtgcctggtgaatgccggtgtagttatggctggcagggaaggttttgtgatgaatgtgtgccatatcccggatgcgtgcacggttcctgtgtggaaccatggcagtgcaattgtgaaacaaactggggcggactgctttgcgacaaagatctgaactactgcggaagccatcatccctgcaccaatggcggaacatgcatcaatgcagagcctgatcagtatcggtgtacctgcccagatggctacagcggaaggaactgtgagaaggctgaacatgcatgcacttctaacccttgcgcaaacggagggtcatgtcacgaagtcccctcaggctttgagtgtcattgcccctcggggtggtccggtcccacttgtgctctggacatcgatgagtgtgcctccaatccctgcgcagccggagggacatgcgtcgaccaggtggatgggtttgagtgcatttgcccagagcaatgggtcggtgccacgtgccagcttgatgtgaacgattgccgcggacaatgccagcatgggggaacttgtaaggatcttgtgaatggatatcaatgcgtgtgccctcgcggttttggcggacggcattgcgagcttgagcgggacgaatgcgcttcatccccttgtcattcgggcggattgtgtgaagacctggcagatggatttcactgtcactgcccccaaggatttagcggtcctttgtgtgaggtggatgtggatctctgtgagccgagcccttgcaggaatggggctaggtgctataacttggagggagactactactgcgcttgtcctgacgattttggcggtaagaattgttctgtgccgagagagccatgtcctggtggtgcctgtcgtgttatcgacggatgtgggagcgacgcaggcccagggatgcccggtaccgctgcttccggcgtttgcggcccacacggccgttgcgtgagccagccagggggaaatttcagctgtatctgtgacagcgggttcactggtacctattgccacgagaatatagatgattgtcttggccagccctgcagaaatggtggcacttgtatcgatgaagtcgatgcctttagatgcttttgccctagtggatgggagggcgagctgtgcgatactaacccaaacgactgtctaccagatccatgccattcgcggggacggtgttatgatctggtgaatgatttttattgtgcctgtgacgatggctggaaaggcaagacttgccacagccgggagttccaatgtgacgcatatacttgctccaatggcggaacatgttacgactctggagatacatttcgctgcgcctgcccgcctggctggaagggaagcacttgcgcagtagccaagaactcctcctgcctgcccaatccgtgtgtgaacggaggtacctgtgttggctccggcgcttcgttctcttgcatctgtcgcgacggctgggaagggaggacatgtacgcataacactaatgactgcaatcccctcccctgctacaacggtggcatctgcgtcgacggcgttaactggttcaggtgcgagtgtgcgccagggttcgctgggccagactgccggatcaacatcgatgaatgccaaagcagcccatgcgcctatggcgcaacctgcgttgacgagatcaatggctaccggtgtagttgcccaccaggacgggctggccctcgctgccaagaggtgattggctttggcaggtcttgctggtcacggggaactccttttccacacggcagtagctgggttgaggattgcaacagttgtcgttgcctggacggacggagggactgtagcaaggtttggtgcggttggaagccctgcttactggctggtcaaccggaagcactaagcgcccagtgccccttgggacagcggtgtctggagaaggcgcctgggcagtgcctgcgccctccttgtgaggcctggggggagtgtggtgccgaggagcctccaagtaccccctgtctccctcggagcgggcatctagataacaattgtgcaaggttgactctgcactttaacagggaccatgttcctcagggcactacagtcggtgctatctgttcaggcattcgctcacttcccgctaccagagcagttgctagagatcggctgcttgtcctgctttgcgatagagcctcctcaggggcttccgcagtggaagtggccgtgtccttctcacctgctagagatctgcccgatagctccttgatccagggcgcagcacatgccattgtggctgcaatcactcagcgaggaaatagttcgcttttactcgccgttaccgaggtgaaagtggagacagtggtgacaggagggagttcgacagggcttttagtacctgtgctttgtggggcattcagcgtcttatggctggcatgtgttgttttgtgcgtgtggtggacacgtaaacgacgcaaagaaagagagagatcgcgacttcctagggaagagagtgccaacaatcagtgggcacctttgaatcctattagaaaccccatcgaacgacccggaggccacaaggacgtcctgtaccagtgtaagaacttcacaccacctcctcgtagggccgacgaggcactgcccggacccgctggccatgctgctgtgagagaagatgaagaggatgaggacttaggacgcggagaagaagactctctcgaggccgaaaaattcctgagccacaagtttactaaagaccctggcagaagccctgggagacctgcacattgggcctccggcccaaaagtcgacaacagggcggtcaggtccatcaatgaagcaaggtatgccggaaaggagtag

SEQ ID NO: 227461 - DNA, 3465 bp, Artificial Sequence
  Description of Artificial Sequence: Synthetic coding sequence
atgcaatacctcaacataaaagaggactgtaatgctatggctttctgtgcaaagatgaggagctcaaaaaaaactgaggtgaacctggaggctcccgagcctggtgtggaggttattttctatctctcggatagggagcccctgcggctcggaagcggagaatacaccgctgaggagctgtgtattcgcgcagctcaggcatgccgcatctcacccttatgtcacaacctctttgcgctgtatgatgaaaacacaaagctctggtacgctcctaacaggacaatcacggtggacgacaaaatgagcctgcgactccactaccgtatgcggttctactttacaaattggcacggtacaaatgacaatgaacagtccgtctggagacattcacctaaaaagcagaaaaatggttacgagaagaagaaaatccccgatgctacaccacttctggatgccagtagcctggagtatttattcgcacagggccagtatgacctcgtcaagtgtcttgcacctataagagaccctaaaactgaacaggacggacacgacatcgaaaacgaatgcttgggaatggctgtgttggccataagtcactacgccatgatgaagaagatgcagctccctgaactgccgaaagacattagctacaagagatacattccggaaactcttaataaatctatccggcagcgaaatctgcttacccgtatgagaattaataacgtgtttaaggacttcctcaaggagttcaacaacaagaccatctgcgactccagcgtctcaacacatgacctaaaagtgaagtaccttgccacattggaaacattgaccaagcactatggggctgaaatctttgaaacaagcatgttgctgatcagctcggaaaatgagatgaattggttccacagcaatgacggtgggaatgtcctgtactacgaggtgatggtaactgggaatttaggcattcaatggcggcacaaaccgaatgtggtttccgtggaaaaggagaaaaacaagctcaagcgcaagaagctcgagaacaaacacaaaaaggacgaagagaaaaacaagattcgggaagaatggaacaacttctcctattttcccgagatcactcatatagttattaaagagagcgtggtgtccattaataaacaggacaataaaaagatggagcttaagctctccagtcacgaggaggccctttcattcgtatccctggtggatggttacttcaggctgacagcagatgcccaccactacctgtgtaccgacgttgcacctccactcattgtgcataacatccagaatggatgtcacgggcctatttgtacagagtatgctatcaataaactgcggcaggaagggagtgaggaggggatgtatgtgttgaggtggtcctgcacagattttgacaacattctaatgacggtgacatgtttcgagaagtcagaacaggtccagggcgcacagaagcagtttaagaatttccagattgaagtacagaaagggcgatatagcctgcacggtagtgaccggtccttcccaagtctgggggatctgatgagccacctgaagaagcagatcttgcggacagacaatatctcattcatgcttaaacggtgctgccagccaaagcctagggagatatctaacttgctcgtggcaaccaagaaagcccaggagtggcagccagtttatccgatgtctcagctatctttcgacaggatactaaaaaaagacctggtccagggcgagcacttggggcgtggaaccagaacccatatttattctggaacactgatggattacaaggatgatgaagggacttcagaggagaaaaaaatcaaggttatcctcaaggttctggatccgagtcacagagacataagtcttgcattcttcgaagccgcttcaatgatgcgtcaagtgtctcacaagcatatcgtttacctgtacggtgtgtgtgtacgtgatgtggagaatatcatggtcgaagaattcgtcgaaggcggtccactggatctctttatgcacaggaaaagtgacgtcctcacgaccccatggaaatttaaggtggcaaaacagttagcgagtgctctgagctatctcgaggataaagatttagtgcatggaaacgtctgtaccaagaatcttctgctggctagggagggcatcgactcggaatgtgggccatttatcaaactgtctgatcctggcatcccaatcacagtgctttcaagacaggaatgtatagagagaatcccctggatagcacccgaatgcgtcgaagattcaaaaaacctcagtgtcgcagccgacaagtggtcattcggaaccactctgtgggagatctgctacaatggagaaattccactcaaagacaagaccctgattgagaaagaacggttttacgaatccaggtgcaggcctgtgacacccagctgcaaggagctggctgatctcatgactaggtgcatgaactatgacccaaatcagagaccttttttcagggcaatcatgcgcgatatcaacaaactcgaagaacagaatccagatatcgtgtctgagaaaaagccagctactgaagtagacccaacccatttcgagaagaggttcctgaagcgaatcagggatctgggcgaagggcatttcgggaaggtggagctttgccgatacgaccccgagggtgataataccggcgagcaggtggcggtgaaatccctcaagccagagagcggcggaaaccatattgccgacctcaagaaagaaattgaaatactaaggaatctgtaccatgagaatatcgtgaagtataagggaatctgcaccgaggacgggggaaatggcattaaactgattatggaatttttacctagcggaagccttaaggagtatctgccaaaaaacaaaaacaaaatcaacttaaagcaacaacttaaatacgctgtgcaaatctgcaaaggcatggactatcttggctctcgccagtacgtgcatagagatctggcggcacggaatgtactcgtggaaagcgagcaccaggtgaagatcggcgactttgggctgactaaagccatagagactgacaaggaatactatacagtaaaagatgatcgggatagtccagtcttctggtacgcacccgagtgcctgatgcagtccaagttctacatcgcctcggatgtgtggagcttcggagtcacattgcatgagctccttacttactgtgattccgactcatccccgatggcattgtttcttaagatgattgggccaacgcacgggcagatgaccgtgacccggttggtgaacaccctcaaggagggaaaacggctgccttgcccccctaattgccctgatgaggtgtaccagctgatgcggaagtgctgggaattccagccttccaataggaccagctttcagaacctcatcgaggggttcgaggccctcctgaagtag

SEQ ID NO: 227462 - DNA, 1860 bp, Artificial Sequence
  Description of Artificial Sequence: Synthetic coding sequence
atggcaccaccgtctgaagagaccccgttgattcctcagagatcctgttcactgctgtccactgaggccggtgctttacacgtgttgcttccagcccgtgggcctggccctccacagagactgtctttcagctttggcgaccacttagcagaagacctctgcgttcaagccgcaaaggctagcggaattttgcctgtttaccactcactctttgcactcgcaactgaagatctctcctgttggtttcctccatcacacatattctctgtagaagatgcaagcactcaagtgctgctttacagaataagattctacttccctaactggttcggattagagaagtgtcatcgctttggcctcaggaaagacctggctagtgctattcttgacctgcccgtgctggaacatctgttcgcccaacacagatccgacttagtcagtgggagactgccagtgggtctctctctgaaagagcagggcgagtgtctttctctcgccgtcctggacctggccaggatggccagagaacaggctcaacgaccgggagaactgctcaagactgttagctacaaggcgtgtttaccaccatctctgcgtgacctcatccagggtctgtctttcgtcaccagacggcgtatccgccgaaccgtccgaagagctttgcgacgagttgctgcctgtcaggccgaccggcactcactgatggccaaatatatcatggaccttgagcgtctggaccctgccggagccgctgaaacattccatgtgggtttgccaggagccctcggaggccacgacggcttgggacttctgagggtggcaggggacggcggtattgcctggacacagggggagcaggaggtgctgcagcccttctgcgacttcccagagattgtcgacatctcaatcaagcaggccccacgggtgggccctgccggagagcaccgacttgtcactgttactcgtactgacaaccaaatcctagaggccgagtttccaggcctacccgaggccctgtctttcgtggctttagtggacggatactttcggctcaccactgactctcagcatttcttctgcaaagaggtagcaccccctaggctgctcgaggaggtcgccgagcagtgccatggacccattaccctcgatttcgctattaacaagctaaagactggaggtagtaggccaggcagttacgtgctgagacggtccccccaggatttcgattcttttttactgacagtttgtgttcagaatccactgggtcctgactataaaggctgcttaatccgccgaagtcctactgggaccttcctgctggtgggtctgagtcggccacactcctcccttagagaactgttagcaacttgttgggatgggggactgcacgtcgacggcgtagccgtgaccctcacttcttgctgtattcccagaccaaaggagaagagtaacctgatagtggttcagcgcggacactcccctcctacgtcctcactggtgcagccgcagagtcagtaccagttgtcacaaatgacattccacaagattccggcagattctttggagtggcacgagaatctgggtcacgggagtttcacaaaaatataccgaggttgccgtcatgaggttgtggacggagaggcgagaaaaactgaggtactgctcaaggtaatggacgcaaaacacaaaaattgcatggaaagttttttggaggctgctagccttatgtcccaggtaagctataggcacctagtcttactccacggagtatgcatggcaggcgattctgagtcaccacctcccacccatcctacgccggcttctccgaagagccgattattttttccccctctgttttag

SEQ ID NO: 227463 - DNA, 3375 bp, Artificial Sequence
  Description of Artificial Sequence: Synthetic coding sequence
atggcccctcctagcgaggagacaccactcatacctcagaggtcatgtagtctgctttcaaccgaagcaggagctctccacgtgctgttgccagcacgcggtccaggccctccccagcggctcagtttctcttttggagatcatctagccgaagacctgtgcgtgcaggccgcaaaagcctctggaattctgcctgtctaccacagcctctttgcgctcgcaacagaggatctgagctgctggttcccacccagtcatattttctccgtcgaggacgcatccacacaagtgcttctgtacaggatacggttctactttcccaattggtttggactagaaaaatgtcataggttcggactgagaaaggacctggctagtgcgattctggacctgcccgtgttggagcacttgttcgctcaacacaggagtgacctagtctcaggcaggctcccggtcggcctgtcactaaaagaacagggggagtgtctgtctttagctgtactggacctcgctcgtatggcgagggaacaggctcagcgaccaggggaactcctgaaaacagtatcctacaaggcctgcctcccgccatccttgagagacttaatccagggactgtcctttgtgacgcgaagacgcatacgccgtactgtccggagggctcttaggagggtggctgcctgccaggctgatcgacactctcttatggcaaaatatatcatggacctggagagactggacccggctggtgccgcagagacctttcacgtcggcctgccaggcgcactcgggggacacgacggactcggattgctgcgcgtcgccggtgacggtggcatcgcctggacccagggtgagcaggaggttctgcagcccttttgtgattttccggagatcgtagatatcagcataaagcaagccccaagggtcggtcctgccggtgaacaccggcttgttacggtgactcgaactgataatcaaattctcgaggccgaatttcctggtcttcccgaagccctgtcattcgtggctctggtcgatgggtactttaggttgaccactgacagccagcacttcttctgcaaggaggtggcaccaccgcgactgctggaggaagtggccgaacagtgccacggtcccattactctggattttgctattaataaactgaagaccgggggttccaggcccggatcttatgttctgcggagatctccacaggacttcgacagcttcttgctgaccgtttgtgtccagaatcccctggggccagattacaagggatgcctcataaggaggagtcccactgggacatttctgctggtgggccttagtcgcccacattccagccttagggagcttcttgctacttgctgggacgggggactacacgtggacggtgtcgccgttaccctcaccagctgttgcatcccaaggccgaaagagaagagcaatttgatcgtggtgcaaaggggacactcaccgcctacctcttctctagttcagccccagagccagtaccagttgtctcaaatgacttttcataaaatcccggcagatagcctggagtggcacgagaacttggggcatggctcttttaccaagatctatcgaggctgcagacatgaggtggttgatggggaggccaggaagaccgaggtgctgctcaaggtgatggatgcaaagcacaagaactgcatggagagcttcctggaagccgctagcctaatgtctcaagtcagctatagacacctggtactgctccatggtgtatgcatggccggagactcaacaatggtgcaagagtttgtgcaccttggagcaattgatatgtaccttcgaaaaaggggtcacctggtaccagcaagctggaagctacaagtagtcaagcaactggcctacgccttgaattacctcgaagacaagggattaccacacggcaacgtgagtgcgagaaaagtattgttggcgagggaaggggctgacggctccccccctttcatcaagctttccgatcccggtgttagcccagctgtgctatcgctggaaatgttgactgatagaatcccctgggtggctcccgagtgtcttcgagaggctcaaaccctaagtctggaggcagacaagtggggttttggcgctaccgtctgggaggtgttctccggggtaacgatgcctatctccgctctggaccctgccaaaaagctgcagttttacgaagaccgtcagcaactacctgcacctaagtggactgagcttgctctcctgattcagcagtgcatggcatatgagccagtgcagaggccgtcattccgcgctgtgattcgagacctcaatagtttaatctcctcagactacgagttacttagcgaccctaccccaggcgctttagcaccccgagatggcctgtggaatggcgctcagttgtacgcgtgtcaagatccaaccatattcgaggaaagacaccttaagtatatctcccagctgggaaagggcaactttggctccgtggaactctgccgttacgaccccctgggggacaatactggggctctagttgcggtgaagcagttacagcattctggtcctgatcagcagcgcgatttccagagagagatccagattctcaaagcgctgcattcagacttcatcgttaagtacaggggggtgtcatatggcccaggacggcaatctctgcgtttagtcatggaatatcttccgtccggatgcttgagagatttcctgcagcggcatcgagctagactagatgctagcaggctgctgctttactcttcacagatatgtaagggcatggaatacctggggagccgacgttgcgtacaccgcgacctggccgcacggaatatccttgtggaatcagaagcccatgtgaagattgctgattttggactggccaaactgcttccactggacaaggactactatgtggtgcgagaaccaggtcaaagccccatcttctggtacgccccagagagtctctcagacaatatattttccagacagagcgatgtgtggagcttcggcgtggtgttgtatgaactttttacctactgtgataagtcctgttcgccctctgctgaatttctgagaatgatggggtgcgagagagatgtcccagctttatgtagactgcttgaactactcgaggaggggcagaggttaccagcgcctcctgcctgccctgccgaagtacacgagctaatgaagctgtgttgggcacccagtcctcaggatagacctagttttagcgccctgggccctcagctggacatgttatggagcgggtcaagaggctgcgaaactcacgccttcacagcccatcctgagggcaagcatcactcactgtccttctcatag

SEQ ID NO: 227464 - DNA, 3375 bp, Artificial Sequence
  Description of Artificial Sequence: Synthetic coding sequence
atggctccaccctcggaggagacacctctgattccacagcgatcttgtagtctcttaagcactgaagctggggcactccacgtgctgctccccgctagaggccctggccctccacagaggttgagtttttcattcggcgatcatctcgctgaggacctctgcgtgcaggccgctaaggctagcggtattctcccagtgtatcactcattgtttgcactcgctactgaggatctctcctgctggtttcctccaagccatattttttctgttgaagacgcatctacgcaggtgctcttgtatagaattcggttttattttcccaactggtttggtctcgaaaagtgccacaggtttggccttagaaaagatttagccagcgccatcctggatttgccagttctagagcatttgtttgcgcaacatagaagcgacttagtgagtggcagactccctgttggcctcagccttaaagagcagggggaatgcctgtctttggctgtgctggatctcgccagaatggctagggaacaagcgcagcgaccgggagagctgttgaaaacagtttcatataaagcctgcttaccaccctcgttgagggatttgattcagggcttgtctttcgttaccagacgcagaatcaggagaactgtgcggagggccctgagaagagtagccgcatgccaggccgatagacactccctgatggcaaaatacatcatggacctggagcggttagatcctgcaggggctgccgagacgtttcacgtggggcttccaggcgctctgggcggtcacgatggtctggggcttcttcgggttgccggagacggagggatcgcgtggacccagggcgagcaggaagtactgcaaccattttgtgatttccctgaaatcgtggacattagtataaaacaggcgccacgggttggccctgctggagagcaccgcctggtgacagtcacacgtacagacaaccagattcttgaagctgagttccccggactgccagaagctttaagcttcgtggccctggtggacggctactttaggttgaccacggacagccagcattttttctgcaaggaagtggctcctccaaggctgctcgaggaggtcgcggagcagtgtcacggtcccattaccttagatttcgcgatcaataaattaaagacagggggatctagacccggaagttatgtcttgagaaggagcccccaagactttgattcctttctgctgacagtatgcgtgcagaacccgttgggcccagactataagggctgccttattcgacggagccccacaggcacgtttttgttagtgggactctccagaccacactcctccctccgagagcttctcgctacatgctgggatgggggactgcacgttgatggcgtggccgtcaccctgacatcatgctgcataccaagaccaaaagagaaaagtaatcttatagtggtccaacggggtcactcaccaccaacatcctcccttgtccagccccaatctcagtatcaactgagccagatgactttccataaaattcctgccgattcccttgagtggcatgagaaccttggccacggatcgtttacaaagatttacagggggtgccgccacgaggttgtggacggtgaggccagaaaaactgaggtgttgctcaaggtgatggatgctaaacacaagaattgtatggagagttttttggaagccgctagtctgatgtcccaagtaagttatcgtcatctggtactgctacacggcgtgtgtatggccggtgactctaccatggtgcaagaattcgtacacttgggcgctattgatatgtacttaagaaagaggggccatctggtgcccgcatcatggaagttacaggtggttaagcagctggcctacgcacttaattatctggaggacaagggccttccacatgggaatgtctcagctcggaaggtcctgctggcacgggaaggggcagatggtagcccgccttttatcaagttatctgacccgggagtctctcctgctgtgcttagcctggagatgctcaccgaccgcatcccctgggtagcacccgagtgcctgcgggaagcccagacgctgagcctcgaagcagacaaatggggcttcggggcaacagtatgggaagtattttctggggtgacaatgcctatctcggctctggatcctgcgaagaaactgcagttctacgaagacaggcaacaacttccggcacctaagtggaccgagctggcacttttgatacagcagtgcatggcgtacgagcctgtgcagaggcccagctttcgcgcagttatacgagacctgaactctctcatctcctccgactatgagcttctctccgaccccacaccgggagctctggcccctcgggacgggctgtggaatggtgcccagttatacgcatgtcaggaccccaccatcttcgaggagagacacttgaagtatatttcacaactcgggaaagggaatttcggttctgtagagctctgtcgttacgatccccttggggacaatacaggcgctcttgtggccgtgaagcagctgcagcacagcgggccagatcaacagcgcgatttccagcgcgagattcagatcttaaaagcgctccacagcgactttattgtgaagtatcgaggggtgtcatatggcccaggcaggcagagcctgcggctggtcatggagtatttaccttcgggttgcctgagggacttccttcagagacacagggcgcgactggatgcaagccgcctcttgctgtatagctctcaaatatgtaaaggaatggagtatttggggtctcggaggtgtgtgcaccgggacttagcagcacggaatatactggtggaatcagaagcccatgtcaagatcgccgactttggactggctaagttattgccattggacaaggactattatgtcgtacgggagccaggccaatctccaatcttctggtatgccccagagtccctcagtgataatatttttagtcgccagagcgatgtttggagctttggtgtggtgttatatgagctctttacatattgcgataaatcctgctcccccagcgccgagtttctgcgcatgatgggatgcgagagagatgtgcctgctctgtgccgcctcctggaacttttagaggaaggacaaagattacccgctccacctgcatgtcccgctgaggtgcacgaactaatgaagttgtgctgggctccttccccccaagaccgacccagtttcagtgcacttggaccccagctggatatgctctggtctggctcaagggggtgcgagacacacgccttcaccgctcaccccgaggggaaacaccacagtctctccttctcatag

SEQ ID NO: 227465 - DNA, 3285 bp, Artificial Sequence
  Description of Artificial Sequence: Synthetic coding sequence
atggcacccccatctgaagaaacccctctcattccacagcggagctgttccctgttatctaccgaagccggtgcattgcatgtacttttgcctgcgcgaggcccaggaccacctcaacggctctccttctcatttggagaccatctggcagaggatctttgcgtccaggccgcaaaagccagtggcatcctgcctgtgtaccattctctcttcgccttggccacagaagaccttagctgctggtttccgccatcgcacatcttctctgtggaagatgctagcacccaggtgctattatacagaatccgtttctacttcccgaactggtttggcctggaaaaatgccatcgttttggacttcggaaggatctggcgagcgctatcctcgatttgcctgtattagaacacctcttcgcacagcacaggtcagacctagtcagcgggcgactcccagtcgggttgagcttaaaggaacagggagagtgcctgagccttgcggttctggatctggccaggatggcgagggagcaggcccagcgtccgggtgaactattaaagaccgtctcatacaaggcctgcttgcccccaagcttgcgggacctgatccaggggttgagcttcgtgacacgcaggagaattcgtagaacagtgagacgcgcactgaggcgcgtggctgcctgccaagctgacagacatagcttaatggcgaagtacatcatggaccttgagcgcctggaccccgcaggggctgctgagacgtttcacgtggggctgcccggagctcttggcggacacgatggccttggtctgctgagggtcgctggcgatggaggcatcgcctggacccagggggaacaagaggtgctgcaacctttctgtgacttcccagaaattgtggacatctcaattaagcaggcccctagagtgggcccagccggagagcataggctagtgacagtaacaagaacggacaaccaaatcctggaggcggagttcccaggactgccggaggctctgagttttgttgctctcgtggatggatactttaggcttaccaccgactcacagcattttttctgcaaggaagttgcaccacctcggctcctggaggaagtagctgagcagtgtcacggccctattacgctcgatttcgctatcaacaagttgaagaccggcggatcccgcccagggtcctacgtactgcgacggagccctcaagacttcgactcattcctgctgaccgtatgtgtccaaaaccccttagggccagattataaggggtgcctgattagaaggtctccgaccgggacattcctgctggtgggactgagtaggccccacagctccctcagagagctgttggctacctgttgggacggcggactgcatgtggacggagttgccgttacattaacctcgtgttgtattccacggcctaaagaaaaatcaaatttgattgtggtgcagcgcggacatagccctcccacctcaagcctggtccagccacaatcacaataccagttgtcacagatgacattccataagattccagctgacagtctggagtggcacgaaaatctcggccatgggtcctttacaaaaatctacaggggatgtagacacgaggtggttgatggcgaggcccgaaagaccgaggtactcttgaaggtgatggacgccaaacataaaaattgcatggagtccttcctggaagccgctagtcttatgagtcaggttagttataggcacctagtgcttctgcatggagtgtgtatggccggagatagcacaatggtgcaagagtttgtgcatttgggcgctattgacatgtacctcaggaagagaggacaccttgttccagccagctggaaactgcaagtagttaaacagcttgcctatgccttgaactatcttgaagacaagggactgccccacgggaacgtgtccgccaggaaagtactactggccagagaaggtgccgatggatcaccaccatttatcaaactgtctgacccaggagtgagtccagctgttctcagtctcgaaatgttgacagatcggataccttgggtggcacccgaatgcttgcgggaagcccagactctcagtctcgaagcagacaagtggggttttggcgctaccgtttgggaggttttttcaggagttaccatgccaatctccgctttggacccagctaaaaagctgcagttctacgaggaccgccaacagcttcctgcccctaagtggacagagctagccttactgatacagcagtgtatggcatacgagcccgtccagaggccttcatttcgggcagtgattagagaccttaattcactgatttcatccgattacgagctgctgagcgacccaacccccggagccctggccccacgggacgggctttggaatggtgcccagttatacgcctgccaggaccccacgatttttgaggaaagacacttaaaatacattagccaattaggaaaaggaaactttgggagcgttgagctctgtcgctatgaccccttaggagataacactggggcactggttgctgtgaagcagttgcagcacagtggacccgatcaacagcgggactttcagcgtgagatccagatccttaaggccctacatagtgactttatagttaagtacaggggagtgtcttacggacctgggaggcagtctctcaggctcgttatggagtatctgccatcggggtgcctgcgagatttcctgcagcgtcatcgggctcgcctggacgcctcccgcctgttgctgtattcatctcagatctgtaaaggcatggagtatcttggatcccggcgttgcgtgcatagggacctggctgcccgaaatatactggtggagtctgaggctcacgttaagatagctgacttcggcctggcaaaactgctccccttggacaaagactactatgttgtgagggagcctgggcagagcccgatcttctggtacgctcccgaatcactgtctgataacatcttttctaggcagagcgatgtctggtcctttggggtggtgctttacgaactctttacatactgtgataagtcttgctctccttccgccgagtttttacgcatgatgggctgcgagagggatgttccagctctttgtagattgctggagcttttagaagagggccagagacttcccgcaccgcctgcatgtcccgcagaagtatctgctgcaggcctggcaagcgtgagccaatctgtggattgggctggagtgtcgggcaagcccgcaggcgcttag

SEQ ID NO: 227466 - DNA, 1575 bp, Artificial Sequence
  Description of Artificial Sequence: Synthetic coding sequence
atgtcgggcaaaaggaaaagggttgtcctcaccattaaggataagctcgatattatcaaaaagctcgaggatggcggatcttcaaaacaactggccgtgatctatggcattggcgaaactaccgtcagggacattcgaaaaaataaggaaaaaatcattacttatgccagttcctctgatagcactagcctcctcgcaaagcggaaatccatgaaacccagtatgtatgaggagcttgatcgcgctatgcttgagtggttcaaccagcagagagccaaggggaaccctatttccggtcccatctgtgctaaaagagccgagttttttttctacgccctgggaatggatggtgactttaatcctagcgcgggatggctgacgagattcaaacaaaggcattcaatccgggagatcaacatcagaaatgaacgcctcaacggcgatgagactgccgtcgaagatttctgtaacaatttcagggacttcatagaacgtgagaatttgcagcctgagcagatctataatgcggacgagacaggacttttttggaaatgtctaccctcacgaatatccgtgattaaagggaaatgtacagtacccggacataagagtatcgaggagcgagtcacaataatgtgctgcgccaatgccaccggccttcataaactgaaattgtgtgtggtgggaaaagcgaagaagcccaggtctttcaaaagcacggacacattaaatctgccggtgtcctattttagccaaaaaggcgcttggatggatctatccatctttcgccagtggtttgacaagatctttgtgccacaggtgcgcgaatacctgagatccaagggtctgcaggagaaggctgtgcttttgctggataatagccccacacacccaaatgaaaacgtattaagatccgacgatggtcagattttcgccaagtacctgcctcccaacgtagctagcttgattcagccttcagaccaaggagtgatagccacgatgaaaaggaactaccgcgcaggcctcctccagaacaacctggaagagggtaatgacctgaagtccttttggaaaaaactgactttactagacgctctttatgagatcgccatggcatggaacctagtgaaaccagtgacgatttctcgggcttggaagaagatattgccaatggttgaggaaaaggaatcattagattttgatgtggaagacattagtgtggctaccgttgccgcaattcttcagcacactaaaggtctcgaaaatgtgaccaccgagaacctcgagaagtggctggaggtggactccaccgaaccaggttacgaggtcttgaccgattcagagataatcaggagagcgcagggccaggcagacgagtcgagtgaaaacgaggaggaggagattgaattaatcccggaaaaacatattaaccacgcggctgctttacagtggacagagaaccttctagattacctggagcaacagggagacatgattctccctgatcggttggttattagaaagctccgagcaacgattcgaaacaagcagaaaatgaccaagagtagtcagtag

SEQ ID NO: 227467 - DNA, 1575 bp, Artificial Sequence
  Description of Artificial Sequence: Synthetic coding sequence
atgtctggtaaacggaagcgggtagtgctcaccattaaagacaaattggatatcataaaaaaactggaggatggcggttcatcaaaacagctggcagttatttatggcattggcgaaacaactgttcgggatatccgtaagaataaagaaaagattattacttatgcttcaagctccgatagtaccagtctcctcgctaagcgcaaatctatgaagccttcaatgtacgaggagctggatcgggctatgttagagtggtttaatcaacagcgagcaaaagggaacccgatcagcgggccaatctgtgccaaacgcgcagagttctttttctatgccctgggcatggacggcgacttcaacccttccgctggatggctaacgcgtttcaaacaacggcacagtatccgggagattaatatccggaatgagaggctcaacggagacgagacagccgtggaggacttctgtaacaattttcgggatttcatagaacgggaaaatctgcaaccagaacagatatacaatgctgacgagaccggtctgttctggaaatgtctgccatccaggatttccgtgattaagggtaagtgtactgtccccggtcacaaaagtatcgaagagagagttaccatcatgtgttgcgccaacgccacagggttgcataagctgaagctctgcgtggtaggaaaggcgaagaagcctcgctctttcaagagtacggacaccttgaatttacctgtcagctacttcagccagaagggagcctggatggacctctctatattcaggcagtggttcgacaagatatttgtgccccaagtaagggaatacctccgcagcaagggtctccaggagaaggcggttttgctcctcgataactcccctacacatcctaacgaaaacgtgctccgttctgacgatgggcagatcttcgcaaagtacctgcccccaaatgttgcctccttgatacagccctcagaccagggcgtgatagccacaatgaagagaaattacagagctggactgttacagaataacctcgaggagggtaatgatttgaaaagcttttggaaaaagctgaccctactggacgcattgtacgagatcgcaatggcctggaatctggtgaagcctgtcacgatcagtagagcgtggaagaaaatcctgcctatggtagaggagaaagagtcccttgactttgacgttgaggacatctcagtcgccaccgtagcagccattctgcagcatacaaagggcctagagaatgtgaccaccgaaaatctggaaaagtggttggaagtggatagcacggagccaggatacgaagtgctgactgatagcgagattatcaggagggcccaaggtcaggctgatgaaagctcagaaaacgaggaagaagagatcgaactcatccccgaaaaacacatcaatcacgcggcagccttgcaatggaccgagaatctattagactatcttgagcagcaaggggatatgatactacccgacagactggtaatcagaaaactgagggccaccatacgcaataagcagaaaatgacaaagtcctctcagtag

SEQ ID NO: 227468 - DNA, 1251 bp, Artificial Sequence
  Description of Artificial Sequence: Synthetic coding sequence
atggccggtgacactcattgtccagcggaacctcttgcgagggaagggacactgtgggaggcccttagggcactgctgccacacagcaaggaggatctcaaactggatttgggggaaaaggtggaaagaagtgtggtcaccctgctgcaacgcgctacagagcttttttacgagggccgacgcgacgagtgtctgcagtccagcgaggtcattctggattactcgtgggagaagctaaacactgggacttggcaggatgtagacaaggactggaggcgggtgtatgccatcggttgcctgttaaaagccctatgcctctgccaggcccctgaggacgccaatactgtagcagctgcccttcgggtgtgtgacatgggtctgctgatgggagctgcgattctcggggatattttactcaaagtggccgcaatcttgcagactcacctgccgggaaagcggccagctaggggatctctgcctgaacaaccgtgcacaaaaaaagcacgcgctgatcatggcttgatacctgacgttaaacttgagaaaacagttccacggcttcaccgtccatccctccagcactttcgggagcagtttctggtgccaggccgtccggtgatactgaagggggtggcagaccactggccatgcatgcagaagtggtccttggagtacattcaagagattgccggatgtaggactgttcctgtggaggtcggttcccgctacaccgatgaagagtggagtcagacactgatgaccgtcaatgagtttataagcaagtatattgtgaatgagccccgtgatgtgggctacctagctcagcatcagctgttcgatcagatccctgaactcaaacaggatatctccatccccgattattgttcgcttggcgatggggaggaggaagagattactattaatgcttggttcgggccacaaggaaccatttcgcctctccaccaggatccacagcagaatttcttggtccaggtgatgggcaggaaatatattcgcttatactctccacaggagtccggtgcactctatcctcacgacactcatctgttgcacaacacttctcaagtggacgttgaaaaccctgacctcgagaaatttccgaagtttgccaaggcgcctttcctctcgtgtattctgtcccccggtgaaattttgttcatcccagtgaagtactggcactatgtgagggcactggacctgtcgttttcagtgtccttttggtggagctag

SEQ ID NO: 227469 - DNA, 663 bp, Artificial Sequence
  Description of Artificial Sequence: Synthetic coding sequence
atggccggtgatacccactgcccagccgaaccccttgcccgtgaaggcacattgtgggaagccctgcgggcactcctccctcattctaaagaggatctgaagctggacttgggagaaaaagtggaaagatccgttgtgaccttgcttcagcgggctaccgagctcttttatgagggacggagagatgaatgtctgcaatcgtcagaagtaatcctcgattactcatgggagaagttgaacaccgggacatggcaggatgtggacaaagattggagacgcgtctacgctattgggtgcctcctgaaagcactgtgtctctgccaagctcccgaggacgccaataccgtggccgctgctttaagagtgtgcgatatgggtttgctgatgggcgcagcaatactcggtgacattctcctcaaagtggccgcaattctacagacccacctcccaggaaagcggcctgcgcgtgggtcccttcccgaacaaccttgtaccaaagtcgacgtcgagaatccagatttggagaagtttccaaaatttgccaaagccccattcctaagctgcatcttgagccctggcgagatcttgttcatacccgtaaaatattggcactacgtgagagctctagacctgagtttctccgtgtctttctggtggagttag

SEQ ID NO: 227470 - DNA, 1365 bp, Artificial Sequence
  Description of Artificial Sequence: Synthetic coding sequence
atgagccgcgagaaatgctctcccggagagggggctgaagagggccgaggctccgaagcctccggactgaaggccagcgccggacacggaacagagccggcaggtggcggacctatggctggagatacccactgtccagccgaaccgctcgcacgggaaggcacgctgtgggaggcgctaagggctcttctaccccatagcaaagaggatctcaaattggatctgggcgagaaagtcgaacgctccgttgtaacactacttcagagagccacagagttattctatgagggccgtcgcgacgaatgcctccagtcctcggaggtgatcctggattacagttgggagaagctgaacacaggcacctggcaggacgtggataaggattggaggagagtgtacgccatcggatgcctcctgaaagcgttgtgtttgtgtcaggccccagaagatgcaaatactgtcgccgcagctttgcgggtctgtgacatgggactgctcatgggagcggctatcctgggtgacatcttgctgaaagtggctgccatcctccagactcacctgccaggcaagcggcctgcacggggatctctgccagaacagccctgcactaagaaggcccgtgccgaccatgggctgatccccgacgtcaagctggaaaagaccgtgcctaggctccaccgcccttccctgcagcactttcgggagcagttcctggtcccaggaaggccagtcatcttgaagggcgtggctgatcactggccttgcatgcaaaagtggtcgttggagtacatccaggagatcgccggatgtagaacggttcccgtagaagtggggtcgcgatatacagatgaagagtggtcgcaaacactgatgactgttaatgaatttatctcaaagtatatcgtgaacgagccccgagacgtgggatacttggcgcaacaccagctatttgatcagatcccggaactcaagcaggacattagcatacccgactattgttcattaggtgacggcgaagaggaggaaataacaattaacgcctggttcgggcctcagggaacgatcagcccgctccaccaggatccccagcagaacttcttggttcaggtcatgggcaggaaatatatccgactgtactcaccgcaagaatccggggcattatacccacatgacacacacctgcttcataatacctctcaggtggacgtggaaaacccagacctcgagaagttccctaagttcgccaaggccccattcctcagctgtatcctgagcccaggcgagattctattcattccagttaagtattggcattatgtgagagctcttgacctctccttctccgtttcattctggtggagctag

SEQ ID NO: 227471 - DNA, 441 bp, Artificial Sequence
  Description of Artificial Sequence: Synthetic coding sequence
atgacagttaacgagttcattagcaaatacattgtcaatgagcctagggatgtgggttacctggcccagcaccagctcttcgaccagatccccgagctcaaacaggatatctctatcccggattactgttcgctgggcgacggggaggaagaagagatcactatcaatgcttggttcggcccacagggaaccatcagcccgcttcaccaggacccacaacagaattttctcgtacaggtaatgggcagaaagtacattagattatacagcccacaggagtccggggcactatacccccacgatactcaccttctgcataacacatcccaggtggacgtggagaacccggacttggagaagtttcccaagtttgccaaggccccattcctttcctgtattctcagccccggagagatcctttttattcccgttaaatattag

SEQ ID NO: 227472 - DNA, 1119 bp, Artificial Sequence
  Description of Artificial Sequence: Synthetic coding sequence
atgaaccacaagtcaaaaaagcggattcgcgaagccaaaaggtcagccaggccggaattaaaggattctctagactggacacgccataattactatgaatctttttctctctctccggcagccgttgcagacaatgtcgaacgcgcagatgcattgcagctgagtgtggaggagttcgtagagcgatatgagaggccgtataaaccagttgttcttctcaatgcacaggaaggctggtcagcccaggagaagtggacactcgaacggctgaagcggaagtaccgaaaccaaaagtttaaatgcggcgaggacaacgacgggtactccgttaagatgaagatgaaatattatattgagtatatggagagcacccgcgacgactcccccttatatatttttgatagtagctatggagaacaccccaagcggcgaaagttgttagaagactataaggttcctaagttcttcacggacgacctgttccagtacgcgggagaaaaaaggagacccccttaccggtggttcgttatggggccacccagaagtgggaccggaatacatatagaccctctgggtacctctgcttggaacgccctggtgcagggtcacaagcgctggtgtctctttccaaccagcacacctagggagctgatcaaagtcaccagagatgagggtggaaaccagcaggacgaggccattacctggttcaatgtgatctaccctcggactcagttgcctacatggcctcccgaattcaagcctctggaaatactgcaaaaaccaggagaaacagtgtttgtgcctggagggtggtggcacgtggtgttaaacctggatactacgatcgcgatcacccagaacttcgctagctcaaccaattttccagtagtgtggcacaagacggtccggggaaggccaaaattgtcacgcaagtggtatcggatcttgaagcaggaacatcccgagttggcagtgttagcagacagcgttgacctccaggagtctacagggattgcatccgactcaagcagcgacagctcaagcagcagctctagctcatccagtgactctgactccgagagaatccgcgacacttgcgggggtagggcacatccctag

SEQ ID NO: 227473 - DNA, 1212 bp, Artificial Sequence
  Description of Artificial Sequence: Synthetic coding sequence
atgaaccacaaaagcaagaagaggatcagggaagctaaacgatcggcccgtcccgaattaaaagactcgctagactggacccgacacaactattatgagtccttcagcttaagccccgcagccgtcgctgacaacgtcgagagggctgatgccctccagctgagcgttgaggaattcgttgagcgttacgagagaccttataaacctgttgtgctgttgaatgcccaagaaggttggagcgcccaggagaagtggaccctggaaagactaaaaagaaagtacagaaaccagaagtttaaatgcggcgaggacaatgacggatattcagtcaagatgaagatgaagtactacattgagtatatggagtcaactagagatgactctccgttgtacatcttcgacagttcctacggcgagcacccaaaaagacgtaagctgctcgaagactacaaagtgcccaaattcttcacagacgacttgttccagtatgcgggtgagaagagacgtcctccttatcggtggttcgtgatggggcctcctaggagtggcacgggcatccatatcgacccactggggacaagcgcctggaacgctttagttcagggccataagagatggtgcctgtttcctacttcaacaccccgagagttgatcaaagtgacacgagacgaagggggaaaccaacaggacgaggcgattacctggttcaacgttatatatccgagaacccagcttccaacttggccacccgaattcaagcccctggagatcctgcagaagccaggagagaccgtgttcgttcctgggggttggtggcacgtggtgctgaacctggacacgactatcgcaatcacccaaaattttgcatcatccaccaatttccctgtggtatggcacaagactgtcaggggtcgccctaagttgagtcgaaagtggtaccgaatcttgaagcaggagcatcccgagctagcagtgctcgccgactctgtggacttacaggagagcaccgggatcgcctcggactcatcctccgactcctccagttcttctagttcctcctcgtctgatagtgatagtgagtgcgagagtggatccgagggggacggtactgtacaccgtagaaagaaaagaagaacatgttctatggtgggcaatggggataccacttcccaagacgattgtgtcagcaaagagcgaagttcttcaagatag

SEQ ID NO: 227474 - DNA, 1245 bp, Artificial Sequence
  Description of Artificial Sequence: Synthetic coding sequence
atgaatcacaagagcaaaaaacgaattcgcgaggccaagaggtcagcacgacctgagctgaaggattctcttgactggactagacataattactacgagagtttctccctctctcctgctgccgttgcagacaatgttgaacgagccgacgccctgcagctatcggtagaggaatttgttgagaggtacgagcggccatataaacccgtggtgttactgaatgcccaggaaggctggtcagcccaggaaaagtggaccctggagcggcttaagcgtaaataccggaaccagaagtttaaatgtggcgaggacaatgatgggtacagcgtaaagatgaagatgaaatactacatcgaatatatggagagcaccagagacgattctcctctatacatcttcgatagttcttacggcgaacaccccaagagacgcaagcttctcgaggattacaaggtacctaagttctttactgacgatctgtttcagtatgccggagagaagcgaaggcccccatatagatggtttgtaatgggacctccaaggtccggaacaggtattcatattgaccctttgggtacaagtgcttggaatgcactggtacaaggacacaagcgctggtgcctgttcccaacgtccacacctcgggagctcattaaagtgacacgggacgaagggggtaatcaacaagacgaggcgatcacctggttcaatgtgatctaccctcgaactcagcttcccacctggcctccagaatttaagccactggagattttgcagaaacctggagagaccgtgttcgtgccaggcggatggtggcatgtcgtgttgaacctcgacacaacaatcgctatcacacagaatttcgcttctagcacaaattttccagtggtttggcacaaaacggtccgagggcgaccaaagctgtctcgtaagtggtatcggattctgaaacaggaacatcccgaactggccgtcctggcagactccgttgatttgcaggagtcgactgggattgcatctgatagctcgagcgactcttctagctcatcgagctcatcctccagtgattctgatagcgagtgcgagagcggtagcgaaggtgatgggacggtgcacaggcgcaaaaagcgtcgaacctgtagcatggtcggtaatggtgacaccacgtcacaagatgactgtgtcagcaaggaacgctcctcatcaagaattcgggacacatgcggcggacgagctcacccctag

SEQ ID NO: 227475 - DNA, 441 bp, Artificial Sequence
  Description of Artificial Sequence: Synthetic coding sequence
atgctcgcaggagctggcagacccggactgccacaaggcaggcatctgtgttggctcctatgcgcgttcacactcaagctatgccaggccgaggctcccgtgcaggaggaaaaattaagtgcatcgacgtcgaacctaccctgctggttggttgaggaatttgtcgtggccgaggagtgcagcccgtgtagcaacttcagggccaagacgacgccagagtgtggaccaaccgggtatgtggaaaagattacttgttcttccagcaagagaaatgagtttaagtcttgccgaagtgcactgatggaacagcggctgttctggaaatttgagggggctgtggtttgtgtcgctttgatatttgcttgcctggtgattattcggcaacgccagctggacagaaaggctctcgaaaaagtgcggaaacagatcgagagtatctag

SEQ ID NO: 227476 - DNA, 354 bp, Artificial Sequence
  Description of Artificial Sequence: Synthetic coding sequence
atggcatgggggtggcaccttagttttctctccgcatctacgagcaacctgccctgctggcttgtcgaagaattcgttgtggccgaggagtgttcaccttgttccaacttcagggctaagacaactccggagtgcgggcctactggatatgtcgaaaagataacctgttcttcctctaagagaaacgaattcaaatcttgccggtctgccctgatggagcaacggctattctggaagtttgaaggcgcagtggtatgtgtggctcttatcttcgcttgtctggttatcatcagacagcgccagctggacagaaaggctctggaaaaagtgcgcaaacagatcgagtccatttag

SEQ ID NO: 227477 - DNA, 354 bp, Artificial Sequence
  Description of Artificial Sequence: Synthetic coding sequence
atggcgtggggttggcatctgagtttcctcagcgctagcacaagcaacttgccctgttggctagtcgaggagtttgtggttgcggaggaatgtagtccatgcagtaactttagggccaagacaacaccggagtgtggacccaccggatacgtggaaaagataacctgttcatcatccaagcgaaacgagtttaagagttgcaggtccgccctgatggagcagcggcttttctggaagtttgaaggcgctgtggtatgtgtcgcactcatctttgcttgcttggtgattattcgccagaggcagcttgatcggaaagctctcgagaaggttaggaagcagattgagagcatatag

SEQ ID NO: 227478 - DNA, 354 bp, Artificial Sequence
  Description of Artificial Sequence: Synthetic coding sequence
atggcctggggatggcacctgagttttctgagcgccagcactagcaacctgccatgttggttagtagaagagttcgttgtggccgaagagtgttcaccctgttcaaacttccgcgctaaaacgactcccgaatgtgggccaactgggtacgtcgaaaaaataacatgtagctcctcaaagcggaacgagtttaagtcatgcagatctgcacttatggaacaacggctgttctggaagttcgaaggggctgtagtgtgtgtagccctcatttttgcatgccttgtgatcatccgccaaaggcagctggaccgaaaagctttggaaaaggtccggaagcagatcgagagcatttag

SEQ ID NO: 227479 - DNA, 1044 bp, Artificial Sequence
  Description of Artificial Sequence: Synthetic coding sequence
atggaaaccccattctacggggatgaggccctgtcaggactcggtgggggtgcctcgggatcagggggatcatttgcgagtcccggtcggttgttcccaggagcacctccgaccgccgctgcgggatctatgatgaagaaggacgctctgaccctgagcttgagtgagcaggttgcagccgctcttaaacctgccgcagcgccaccaccaactcctctgcgggctgacggggcaccatccgccgcacctccagatggcctattggcctcccccgacttagggctcctgaagctggcctctccggagctagaacggctaatcatacagtcaaacggtctggttacgactacgcctacatcatcccaatttctgtaccctaaggtagcagcatccgaggaacaggagtttgctgaggggtttgttaaagccttggaagatctgcataagcagaatcagttgggagcaggtgctgccgcagccgctgccgcagctgccgcagggggtccaagcggcaccgccaccggcagtgctcctcctggcgaactcgcgcctgccgcagctgcccctgaggcccctgtgtacgctaatcttagttcctatgccggtggcgctgggggagctgggggagctgcgactgtagccttcgccgcagaacccgtgccattcccccctcctccaccccctggtgccttggggcctccacggcttgctgccctaaaggatgagccgcagaccgtgccagacgtgccctcgtttggggagtctcccccattgagtcccatcgatatggacactcaggaacggatcaaggccgagcggaaacgacttcgcaatcgcatcgcagcttcaaaatgtcggaagagaaaattggagagaatttcaaggctcgaggagaaagtcaagacactcaagtctcagaacacggaactggcgagcaccgctagcctgctgcgggaacaagtggcccagctgaaacagaaagttctgtcccatgtgaatagcggctgtcagttgttacctcagcatcaggttcctgcttattag

SEQ ID NO: 227480 - DNA, 2934 bp, Artificial Sequence
  Description of Artificial Sequence: Synthetic coding sequence
atgtctttcgctctggaagaaacactggaaagtgattgggtggccgtgcgcccacatgtgttcgatgagcgcgagaagcacaaattcgtcttcattgtggcgtggaacgaaattgaggggaagtttgccattacatgtcacaaccgaactgctcaacgccagcgaagcggtagtcgggagcaggccggtgcacggggaggcgctgaagctggcggtgccgcatccgacgggtctaggggtccagggagccccgctggaagaggcaggccagaagccacggcgtccgctacattagttagaagtccagggccacgtcggtccagcgcctgggctgaggggggttcaccgcgttccacaagaagtttgctgggcgatcctagactgaggtcccccggttccaaaggtgccgaatccagattaagaagccctgtccgggctaaacctatccctggacagaagaccagtgaggcagatgatgcagcaggagcagcggctgccgctgctagacctgctccaagggaggctcaagtaagctctgtgaggatcgtttcagccagcgggactgtttcagaggagattgaggtgctcgaaatggtgaaagaggacgaagcccctctcgccctgtcagacgccgagcagccgcctccagccacggagcttgaaagccctgccgaggaatgttcctgggcaggtctgttttcctttcaggaccttcgggcagtacaccaacagctttgctccgtaaatagtcagcttgagccatgtctgcctgtcttccccgaagagccatcaggcatgtggacagtcctcttcggaggcgctcctgagatgacagagcaggagattgacaccctctgttaccaactacaggtgtacctcggtcacggcttggacacctgcggctggaagattctgagccaggtgctatttactgaaactgatgacccagaggaatactatgagtcactgagcgagttgcggcagaaaggctacgaagaggttcttcaaagggctaggaaaagaatacaggagctgctcgataagcataaaaacaccgaaagcatggttgaactgctggatctgtatcaaatggaggacgaggcgtactcaagcttagcagaggccaccaccgagctgtaccaatacttgctgcagccctttagagacatgagagaactcgccatgcttcgccgacaacaaataaagatcagcatggagaatgactatctgggtccacgtcgtatcgagagcctgcaaaaggaagatgctgattggcaacggaaggcccacatggctgtgctgtcgatccaggatctaacagtaaagtacttcgaaataactgccaaggcccaaaaggcagtatacgatagaatgagggccgaccagaagaaattcggaaaagctagttgggccgcagccgctgaacgaatggagaagctgcagtacgctgtatctaaagagacccttcaaatgatgcgtgccaaagagatttgtcttgaacaacgcaagcacgccctaaaggaggaaatgcaatcactgaggggaggtacagaggccatcgccaggttagaccagctggaagcagactactatgaccttcagcttcagctgtacgaagtccagtttgagatattgaagtgtgaggagttgctgttgacagctcagctagagtcaattaagaggctcataagcgagaagcgggatgaggtagtttactacgatacctatgagtcaatggaggcgatgctggaaaaagaggagatggcggcttctgcctatctgcaacgcgaagagctgcagaagttgcaacagaaagcacggcaactggaagctaggcggggtcgcgtgtctgccaagaagagttacctgaggaacaagaaagaaatctgcatcgccaagcacaatgagaagatacagcagcggacacggatcgaagacgagtatcgtacacaccacacggtgcagctgaaacgcgaaaaactacacgatgaggaagaacgcaagtcagcctgggtgagccaggagaggcagcggaccttggacaggcttagaacttttaagcaacgctatcctggacaggtgatcctaaagtcgacgcgcctccgcctcgcccacgcccgacgtaagggcgctgcttcccccgtgctccaggaggaccactgcgactccctccccagcgttctgcaggtcgaggagaaaaccgaagaggtgggagagggtagggttaagcgcggaccatctcagacaaccgaaccgcagtcactagtgcagctggaagacacttctctgacccagctcgaggctacgtctttacccctaagcggggtgacctccgaattgcctccaacaatatcccttcctttgctaaataacaatctcgagccttgttccgtgactattaatcccctcccatcgccactcccacccaccccacccccacctctgcctgtagcaaaggactcaggtcccgagaccctggaaaaggacctgccccgtaaggagggcaacgagaaaagaatacctaagtccgcctccgccccatcagctcacttgttcgattccagccaactagtgtcggccaggaagaaactcagaaagacagctgaaggcctccaaaggaggcgtgtgagtagccccatggacgaggtgctcgcctccctgaagcgtgggtcatttcatctcaagaaggtggaacagagaaccctgccaccgttccctgacgaggatgactctaacaacatcctcgcacagatcaggaaaggggttaaactgaagaaagttcagaaggacgtgttgcgggagtcctttacgttgcttcctgatacggatccgctgactcggagcattcacgaggctctgcgcaggatcaaggaggcttccccagaaagtgaggacgaagaagaggcattaccgtgcaccgactgggaaaattag

SEQ ID NO: 227481 - DNA, 2967 bp, Artificial Sequence
  Description of Artificial Sequence: Synthetic coding sequence
atgtccttcgccctcgaagaaacattggagtccgactgggttgccgttcggccacacgtctttgatgagcgggaaaagcataagttcgtgtttatcgtcgcctggaacgaaatcgagggcaaattcgctataacgtgtcataatagaaccgctcaaagacaacggagtgggagcagagaacaggccggagctaggggcggagccgaagccggaggagctgcttccgacggaagtcgcggacctggttcccccgctggcagaggcagacccgaagccacagcgtctgctacgcttgttagatccccaggaccccgaagatctagcgcatgggctgaaggaggctctcctcgcagcacacggagcctgcttggagatccaaggttgaggtctcctggttctaagggtgcggagtctcggctgcggagcccagtacgggcaaagcctatacccggtcaaaagacaagcgaggccgacgacgctgcgggtgcagccgcagcagcagcacgtcctgcccctcgcgaagcccaggtttcatcagtgcgtatagtgagtgcttctgggaccgtttctgaggagatcgaggttttggaaatggtgaaggaagatgaggcccctcttgccctttcagatgccgagcagcctcctccagcgacagagctcgaatcacccgctgaggaatgctcttgggccggattgttcagttttcaggatttacgcgcagtgcaccagcagttgtgctctgtcaatagccagctggaaccatgtctcccagtcttccctgaggagcctagtgggatgtggaccgtgctgttcggcggagcacctgagatgacggagcaggagatcgacactttgtgttaccagctgcaggtatatctcgggcacggcttggacacctgcggttggaaaattctgagccaggtgctgttcactgaaaccgacgacccggaagagtattacgaatctcttagcgagctgagacaaaaaggatatgaagaggtgttacagagggccaggaagagaattcaagagctgttggacaagcacaaaaacacagagtcaatggtcgagctcctggatctctaccagatggaggacgaggcttatagcagcctggctgaggctaccaccgagctttaccagtatttgctgcaaccttttcgcgatatgcgagaacttgctatgcttagaagacagcagatcaagatttcgatggaaaacgactatctcgggccacgcaggattgagagtcttcagaaggaagacgcagactggcagagaaaagcccatatggccgttcttagtatacaggatctgactgttaagtactttgaaattactgctaaggctcagaaggcggtgtatgacagaatgcgcgctgaccagaagaagtttgggaaggcttcttgggccgctgccgcagagcgtatggagaaactgcagtacgctgtgagtaaagagacccttcagatgatgagagccaaggaaatctgcttggagcagagaaagcatgcgctgaaagaggaaatgcagtcactgcgcggaggcaccgaagccattgcccgtctggatcagcttgaggcggactactacgacctgcagttacaattatatgaggtacagtttgaaatcctgaagtgtgaagaactgctgttgaccgctcagcttgaatcaattaaacgcctgattagcgaaaagcgcgacgaagttgtgtattatgacacctatgagtcaatggaagctatgctcgagaaagaagagatggccgctagcgcctatctgcagagagaagagttgcagaagttgcagcagaaggctagacagctcgaggcaaggcggggacgcgtgagcgccaagaaatcttatttaaggaataagaaggaaatctgtatagcaaagcataatgagaagattcaacagcggactcgaattgaagacgagtacagaacgcaccacactgtccagctgaagagggagaagttacacgacgaggaggagaggaagtcagcctgggtcagtcaggaaagacaaagaacactcgatcgtctgagaaccttcaagcagcgatatcccggacaggttatcctgaaatccaccaggctgaggcttgcgcacgccagacgcaaaggcgcagctagccccgtcttgcaggaagaccactgtgattcactgccttccgttctgcaggtcgaggagaaaaccgaagaggttggagagggacgcgtaaagcgaggaccttctcaaactaccgagccccaaagcttggtgcagttagaggatacaagccttacacagctggaggcaaccagcctccctctgagtggtgtaacttctgagctcccacccactatttctctcccacttctgaataacaatcttgagccatgcagcgtcacgatcaatccactgccctctccattgccccctacccctccacctccaccacctcctcctccaccaccacctccccctcccctgcctgtggcaaaagactccggccctgagacactggagaaggacctgcctcgcaaagagggcaacgaaaagaggatacctaagtcggctagcgccccaagcgctcacctctttgattcaagccagctcgtgtccgctcgtaagaaactgagaaaaaccgctgaaggtctccaacgcaggagagtttccagccctatggacgaggtgctcgcctctctgaagcgtggaagtttccatctcaaaaaggtcgagcaacgcactctccctccctttccagacgaggacgatagcaataacatactggctcagataaggaaaggtgtgaagctcaagaaggtgcaaaaggacgtcctgcgggaatcttttacgttactccctgatacagacccattaactcgctcaattcacgaggcactgcgtaggattaaagaggcctcaccagagtctgaagatgaggaagaggctctaccctgtacagactgggaaaattag

SEQ ID NO: 227482 - DNA, 2238 bp, Artificial Sequence
  Description of Artificial Sequence: Synthetic coding sequence
atggaagtgatgaacctgatggagcagcctattaaagttaccgaatggcagcaaacctacacgtatgactcgggcattcatagtggtgccaatacttgtgttcccagcgtttccagcaaaggcatcatggaggaggatgaggcttgtgggagacaatacaccctgaagaagaccactacctacacgcaaggagttcctcccagccagggggatttggagtaccaaatgtccactacagctagggctaaacgcgtgcgagaagcaatgtgtccaggagtcagcggggaggattcctccctactcttagcaacacaagtcgagggccaagcaactaatctgcagcggctcgccgagccctcccagctgctgaaaagcgcaatcgtgcacttaattaactaccaggacgacgcagaacttgccacccgggcactccccgaactaactaaattgctgaatgatgaggatcccgtcgtggtgaccaaggcagccatgatcgttaaccagctcagtaagaaagaggcctcaagaagggcacttatgggaagcccacagctcgtggccgcagtggtgcggactatgcagaacacttccgatctggacacggcacgatgcactaccagcatactgcacaacctcagtcaccacagagagggcctgctggcaatttttaagtccggaggcatcccggctctagtgagaatgctgtccagcccagtcgagagcgttttattctatgccatcactacactccacaaccttctgttgtatcaagaaggtgccaaaatggctgtgcggctggctgacgggctccaaaaaatggtacccctgttgaacaaaaataaccccaaatttctggcgatcacgactgactgcctgcaacttctagcatacggaaatcaggagtccaaactcatcatactcgcaaatggtggcccacaggctctggtgcaaatcatgagaaactattcatatgaaaaactcctgtggacaacttcaagagttttaaaggtcctctctgtctgcccttctaacaaaccggcaatcgtggaagccggaggcatgcaggctcttggcaagcatctgacctcgaacagcccaaggctggttcagaactgtctatggacactcaggaatctgagcgatgtcgcaaccaagcaggagggactcgagagtgtgctgaaaattttagtgaaccaactctctgtagatgacgtcaatgtgctcacttgtgctacaggaacactctcaaacctgacgtgcaacaacagcaaaaacaagaccctggtgacgcaaaacagcggagttgaggcgctcatccacgcgattctgagggcgggagacaaggatgatatcaccgagcccgctgtttgcgcactgcggcacctcacttctcgacacccggaggcggaaatggcccaaaactcggttagactgaattacggcatccccgcaatcgttaagctacttaaccaacctaaccaatggccccttgttaaagccactatcgggctgattcgcaacctcgctttgtgtccagcaaatcacgcccctttacaggaggccgcagtcattccgagactggttcaacttctggtcaaggctcatcaagacgcacaacggcacgtggctgccggtacacagcagccatacactgacggtgtacgcatggaagaaattgtcgaaggttgcactggagctctgcatattctggccagagatcctatgaatagaatggagattttcagattgaacaccataccactgtttgtgcagctgctgtactcttcagtggagaacatccagagggttgccgctggcgttctgtgtgagctggcgcaggacaaggaggccgctgacgcgattgacgccgagggtgccagtgcccctttgatggagttgctgcattcacgaaatgagggaaccgctacctacgctgcggcagtgctgttcagaatctcagaggataagaatcccgactatagaaagagggtctccgtggagttgaccaattcattgtttaagcacgacccagctgcatgggaagccgctcagagcatgattcccatcaacgaaccgtacggggacgacatggacgcaacatataggcccatgtattcaagcgacgtgcctctggacccactagagatgcacatggacatggacggcgattaccccatagacacatactcagatggcctcaggcccccatatcctacagcggatcacatgctcgcatag

SEQ ID NO: 227483 - DNA, 2238 bp, Artificial Sequence
  Description of Artificial Sequence: Synthetic coding sequence
atggaagtgatgaacctgatggagcagccaattaaagtgacggaatggcagcaaacttacacatacgatagcggtattcattcgggcgctaatacatgcgtgccctcagtatcttccaagggcattatggaggaagatgaagcttgtggtcgtcaatataccttaaaaaagacgactacatatacacagggagtgccccctagtcagggagacctggaataccaaatgagtacaactgccagggcaaaaagagtacgcgaagcaatgtgccctggcgtgtctggagaagattcctcccttctgctcgcaactcaagtggagggtcaagccacaaatcttcagaggttggcagaaccttcgcagctgctgaaaagcgccatcgtgcacctgattaactatcaagacgatgccgaactggccactcgtgctctgcccgagctgacaaagctgttgaacgatgaggatccagttgtcgtaactaaggccgctatgatcgtgaaccagttgtctaagaaagaggcctctcggagggccctaatgggcagcccccaattggttgccgcagtggttcgcacaatgcagaatacatccgacctggatactgcaagatgtaccacttctattctacacaacctgagccaccatcgtgaggggctactggccatcttcaagagcgggggaatcccagccctggtcagaatgctctcaagcccagtggaaagcgtcctgttctacgccattacaacactgcacaacctacttttataccaggagggagcgaaaatggcagtcaggctggctgatggacttcagaagatggtcccgctgcttaataagaacaatccaaagttcctggcaatcactacagactgtcttcagctcctggcctatgggaaccaagaatcaaagctgataattttggccaatgggggtccccaggccttggtacagatcatgcgcaattacagctacgagaagttgctttggacaacctcccgggtgttgaaggtgctatctgtctgccctagcaacaaaccggctattgtggaagcagggggtatgcaggcacttggcaagcatttaacatctaattctccaaggttagtgcagaactgcctctggacattaaggaacctctccgatgtggccacaaagcaggaagggctggagtcggtcttaaaaattctggtgaaccagctgagcgtagatgacgtcaatgtcctaacttgcgctaccggaacccttagcaacctgacctgcaacaatagtaaaaacaagaccttggtgacgcagaactccggagtggaagcactcatacacgcgatcctccgcgctggggataaagatgacataacagagcctgcagtttgtgctcttcgacaccttacgtccagacaccctgaagccgaaatggcacagaactctgtccgactgaactatggtatccccgcaattgtgaagcttctcaaccagccaaatcagtggccattagttaaagctactataggcctcatacggaacctggcattgtgccccgcaaaccatgcccctctacaagaggcagcagttattcccaggcttgtccaactgttggttaaagctcatcaggacgcacagcggcacgtggcagcagggacacagcagccatatacagacggggttaggatggaggagatcgtggagggatgcactggcgctctgcacattctagcaagggatccaatgaatcggatggagatattccgactgaatacaattcccctgtttgtccagctcctttactcgtctgtggagaacattcaacgcgtggcagccggagtcttatgtgagttagcacaggacaaggaggcagcagatgcaatcgacgctgaaggcgcatctgcacctctgatggaactcctccactctaggaacgagggcacagccacttacgcagcggctgtgctcttcaggatctctgaggacaagaaccctgattacaggaaaagggtgtctgtcgaactgacaaattctctgttcaagcacgaccccgctgcttgggaagccgcacagtcaatgattccgatcaacgaaccttacggtgacgatatggatgccacctataggccgatgtacagcagcgacgtgccactggaccccctggagatgcacatggacatggacggggactatcccatcgacacttattccgacggcctgcgccctccttaccccacagctgatcatatgctcgcctag

SEQ ID NO: 227484 - DNA, 2238 bp, Artificial Sequence
  Description of Artificial Sequence: Synthetic coding sequence
atggaagtgatgaacctgatggaacagccaatcaaagttacagaatggcaacagacttacacctatgacagtggtatacatagcggtgctaacacttgtgtaccaagtgtgtcatccaagggaatcatggaagaggatgaggcatgcgggagacaatacaccctgaagaaaacaaccacctatacacagggggtcccaccatcacaaggggacctagagtaccagatgtctacaactgcccgtgcaaagcgggtgcgggaagcgatgtgccctggggtgtctggggaagattcctcgttgcttttagccactcaagtagaaggtcaggctaccaacttgcagcggctcgcggaacccagtcaactgctgaagagcgcaattgtgcacctgattaattaccaggatgatgcagaactcgcaacacgagccctgccagaacttactaaactccttaacgatgaagatccagtggtcgtcacgaaggccgcaatgatcgtgaatcagctttccaaaaaagaggcctcacggagggccctgatgggtagtccacagctggtggccgcagttgtcaggacaatgcagaatacgagcgaccttgataccgcccgatgtactacttcaatattacataatttaagccatcaccgagaagggctcctagccatctttaagagcggaggcatccccgcacttgtaagaatgctcagcagccccgtggaaagcgtcctgttttatgctattaccaccttgcacaacctgctattgtaccaggagggagccaaaatggccgtcaggcttgccgatggcctccagaagatggtgcccctattgaacaagaacaatccaaagttcctagccatcactaccgactgccttcagctcctagcatacggaaatcaagaaagcaagttgatcatcttggcaaacggaggccctcaggctctggtccagattatgcggaactattcctatgaaaaactgctatggaccacaagccgtgtgctcaaagtcctgagcgtttgtcccagcaacaagccagccattgtagaggcaggcggaatgcaggctttgggcaaacatctgacatccaactcccccagacttgtgcaaaactgtctgtggactcttaggaaccttagtgatgtggctactaagcaggagggcctagagtctgtcctgaagattctggtgaaccagctatccgtagacgacgtcaacgtcctcacatgcgcaaccggcaccctttctaacctcacttgcaacaactctaagaacaagaccctggtaacacagaattcaggagtcgaagccctgatccatgcaatcctccgtgctggagataaggacgatatcacagagccagcggtctgcgccttgcgccatttgacatcacgccatccagaagccgagatggcccaaaattccgtccggctgaactacggcattcccgctatcgtgaagctacttaatcaacccaaccaatggcctttggtaaaggccaccatcggcttaattagaaacttggccctctgtcccgctaatcacgcgccactgcaggaggccgctgtgatacccaggctcgtccagctactcgtcaaagctcaccaagacgctcagcggcacgtggccgcaggcacccaacagccctacaccgatggggtcagaatggaagagattgtagaaggttgtacaggggcattgcatatcctggctcgggacccaatgaatcgaatggaaatattccggctgaataccatacctttatttgtgcaacttctgtatagttccgtggagaatatacagagggtggccgcaggcgtcctttgtgaactcgcccaggataaggaggccgctgacgcaatcgacgccgagggcgcttctgctcctctgatggagctgctccattcccgcaatgaaggcacggcaacttatgcagcagctgtactgtttcggataagcgaagacaaaaatcctgactatcgaaaaagggtaagcgtcgagctcacaaacagtctgttcaagcacgatccagcagcatgggaggccgctcagtccatgatcccaattaatgagccatacggggatgacatggatgctacgtaccgcccaatgtattcttccgatgtgcctttagatcctctagagatgcacatggatatggatggtgattacccaatcgatacttatagtgacggcctgcggcctccttaccccaccgcagaccatatgctagcttag

SEQ ID NO: 227485 - DNA, 834 bp, Artificial Sequence
  Description of Artificial Sequence: Synthetic coding sequence
atggaggtcatgaatctcatggagcagcctattaaggttacggagtggcaacagacgtatacttatgacagcggtatccactctggagccaacacatgtgtgccttctgtgtctagcaaagggattatggaggaggacgaagcttgtggacggcagtacactctgaaaaaaactactacctacacgcagggcgtgcccccatcacagggagacctcgagtaccaaatgtccaccaccgcacgggctaagcgggttcgggaagcaatgtgcccaggcgtgtcaggggaggactcgtctttgctactggcaacccaagtggaggggcaggctacaaatctgcaaaggctagctgagccttcacagctgctgaaatcagccatagttcatcttatcaattatcaagacgacgccgaattagctacaagggcgctcccggaactgacgaagttgcttaatgatgaggatcctgtggttgtgacaaaagcagcaatgatagtaaaccagctcagcaaaaaggaggcctcccgcagggcacttatgggctctccccagctggtcgcagctgtagtaagaactatgcagaacacttctgatctggacacagctaggtgcaccacctccatcctccacaacctctcccaccatagagagggcctgctcgcgatcttcaagagtggagggatccctgccctggttaggatgttgtccagtccagttgaatctgtcctcttttacgctatcacaaccttgcacaatcttctcctttaccaggaaggggcaaagatggcagtaaggttagctgacggtctgcagaaaatggtgcctctgctctag

SEQ ID NO: 227486 - DNA, 708 bp, Artificial Sequence
  Description of Artificial Sequence: Synthetic coding sequence
atggaggtcatgaatttgatggagcaacccattaaagtgactgagtggcagcagacatatacgtacgacagtggaatccacagcggtgccaatacctgcgtcccatccgtatcatctaaagggataatggaagaggatgaggcttgcggccgacagtacactttaaagaagaccaccacttacactcagggagtgcctccaagccagggagacctggagtatcaaatgagcactacagcacgggctaagagggtgcgggaggccatgtgcccgggagtttccggcgaggattcttctctcctcctggctacacaagttgaaggacaggcaaccaacctccaacggctggctgaaccatctcaactgctgaagtccgccattgtgcatctcataaactaccaggatgacgctgagctagcaacaagggcgctgcccgagctcaccaaactccttaatgacgaggaccctgtggtcgtgacgaaagccgcaatgattgtcaaccaactgtcaaaaaaagaagcatcgaggcgtgcgcttatgggctcaccccaactcgtggcggcagtggtgcgcacaatgcagaatacatccgaccttgacacagccaggtgcactacctcgatcctccataatctctctcatcacagagaaggcctgctcgccattttcaaatctggtggtatccctgccttagtaaggatgctgtag

SEQ ID NO: 227487 - DNA, 891 bp, Artificial Sequence
  Description of Artificial Sequence: Synthetic coding sequence
atggaggtgatgaacttaatggagcagcccatcaaggttacggagtggcaacagacttatacttatgacagtgggatacattcaggagctaatacgtgcgtgccgtctgtctcttctaaaggtatcatggaggaagacgaagcttgcggcagacagtacacactgaaaaaaaccaccacatacacgcaaggagtcccccctagtcagggggacctggagtatcaaatgtccaccacggcccgagcaaagcgggtcagagaagcaatgtgtccaggcgttagcggcgaggactcttctctgcttctagcgacccaggtggaggggcaggccacaaatctccagcggttggctgagccgtctcagctgttgaaatctgccatcgtccacctcattaactaccaggatgatgccgagctggcaacgagggctcttcctgaattgacaaagctgttaaatgacgaggaccctgtcgttgtcaccaaagccgctatgatcgtcaatcagctgagcaagaaggaggcttcgcgcagggccctgatgggatccccgcagctcgttgcagctgtcgtgcggacgatgcagaatacaagcgatctcgacactgccagatgtaccacttcaatcctgcacaatttgagtcatcacagggaaggcctgttggcgattttcaaaagcggagggattccagcactagtaaggatgctttcaagccccgttgagtccgtgttgttctatgccatcacaacgttacacaacctactgctgtatcaggagggtgccaaaatggctgtgagactcgccgatggactccagaaaatggtccccctgctgaacaaaaataatcctaaattcctggccatcaccaccgattgtcttcagctgttggcatag

SEQ ID NO: 227488 - DNA, 261 bp, Artificial Sequence
  Description of Artificial Sequence: Synthetic coding sequence
atggaggtcatgaacttaatggaacagccgattaaggtgactgagtggcagcaaacgtatacatacgatagcgggatccacagcggcgcaaatacctgtgtcccatccgttagctcgaaggggatcatggaggaggatgaggcctgcgggcgacaatacacccttaagaaaacaaccacctatactcagggagtgcctccatcccaaggcgatcttgagtatcagatgagcactaccgctcgcgcaaagcgggtgcgctag

SEQ ID NO: 227489 - DNA, 897 bp, Artificial Sequence
  Description of Artificial Sequence: Synthetic coding sequence
atggaggttatgaacctgatggaacagcctataaaggtgaccgagtggcagcagacctatacgtatgattctggtatacattcgggcgcaaatacctgcgtcccatccgtgtcatccaagggcatcatggaagaggatgaagcctgcggacggcagtataccttgaaaaagaccacaacctatacccagggcgtgcccccttcccagggtgatctcgaatatcaaatgagtacaacagctagagcaaaaagagtgagggaagccatgtgtcctggcgtctccggggaggattcttcacttctgctcgccacccaggtcgagggtcaggccaccaacctccagagactggcagagcctagtcaactactcaagtcagcaattgtccacctgatcaattaccaggacgacgctgagttagccacccgtgctctaccagaactcacaaagttgctcaatgatgaggaccctgtggtagtgaccaaggcagccatgatagtgaaccagctgtccaagaaggaagcatcacgaagagcattgatgggatctccccaactggtggccgcagttgttaggactatgcagaatacatctgatctggatactgctcgctgtacgacgagcatactccataacttaagccatcaccgcgagggtctcctcgcaatctttaaaagcggcggaattccagccctggttagaatgctgtcgagcccagtcgaaagtgtcctgttttatgccatcactactttgcataatttactgctctatcaagaaggggcaaagatggcagtgagactggccgacgggttgcagaaaatggtgccactattgaataaaaataaccccaagttcctcgcaatcactaccgactgcctgcagctgcttgcctatggctag

SEQ ID NO: 227490 - DNA, 1776 bp, Artificial Sequence
  Description of Artificial Sequence: Synthetic coding sequence
atggaggtgatgaacctgatggaacagccaattaaggtgaccgagtggcagcagacctacacatacgacagtgggatacacagcggcgcaaatacctgcgtccccagcgtgagctctaagggcatcatggaagaggatgaggcttgtggtcggcaatatacattaaagaaaaccaccacctacacccagggcgtgccccctagtcagggggatctggagtaccagatgtctacaaccgcgagggctaagcgagtgcgcgaagcgatgtgtcctggcgtgtctggcgaggactcctcactcctcctggctacccaagttgagggccaggcgactaatttacaaaggctggctgagccatcccagctcctgaaaagcgctattgtgcacctgatcaattatcaagatgatgctgaactcgccacccgagctctgcctgagctcacaaagctattgaatgacgaggaccctgtggtggtgaccaaagctgcaatgatcgtgaatcagttatctaagaaagaggctagccgcagggccctgatgggatccccacaacttgtggcagccgtggtgaggacaatgcagaatacctctgatctggacaccgctcggtgtacgactagcattctgcacaatctctcccaccaccgggaaggcttattggcgattttcaagtccggtgggatccccgcactagttcgaatgttgagcagcccggtagagagcgttctgttctatgccataactactcttcacaaccttctcttataccaggaaggcgctaagatggctgtccgtctggccgacgggctgcagaagatggtccctctcctgaacaaaaacaatcctaaattcctggccataactaccgactgtctgcagttgcttgcgtatgggaaccaggaatctaaaatcttgaccgcaaccgtcgataacgccaacattctgttacagattgataacgcacggctggcagccgatgatttcagaacaaaattcgagacggaacaggcactgaggctctcggttgaggccgacataaacggcctgcgcagagtgttggacgagctcacattagcaagagcagatcttgagatgcagattgaaaacctgaaagaggagctcgcttatcttaagaaaaatcatgaggaagaaatgaacgcgctgcgaggacaggtcggcggtgagattaacgtggaaatggatgccgctccgggtgtcgatctgagccggattctcaacgaaatgagggatcagtacgagaagatggccgaaaaaaaccgcaaggatgcagaagactggttcttctcaaaaacagaggaactgaaccgcgaagttgctacaaattccgagcttgttcagtccggaaagtcggagattagtgaattgaggaggaccatgcaggccctcgagatcgagctgcagtctcaactaagcatgaaggcctccttggagggaaacctggctgaaacagaaaatcgttactgcgtgcaactctctcagatccagggcctcattggctccgtagaggagcagctggctcaattacggtgcgagatggagcagcagaatcaggagtataaaatcctgctagacgttaagacccgcctggagcaggagattgccacatatcgccgactgctcgagggggaggacgcccatttgactcagtataagaaggaaccggtcacaacccgacaagtccgaactatcgtcgaagaggttcaggacggtaaagtgattagctctcgggagcaggtacatcagacgaccagatag

SEQ ID NO: 227491 - DNA, 897 bp, Artificial Sequence
  Description of Artificial Sequence: Synthetic coding sequence
atggccagacgctcccgccaccgattgctgctcctgctattacgctatctggtggtcgcactcggataccacaaggcgtatggcttctccgctcctaaggaccaacaggtcgtcaccgccgtcgagtatcaggaagctatcctggcctgtaagacaccaaagaaaacagtttcctcacggctggaatggaaaaaactggggaggtcagtgagcttcgtctattaccagcagaccctccaaggcgattttaagaatcgcgctgaaatgatcgatttcaatatacggattaagaatgtgacccgatcggacgccggaaagtacaggtgcgaggtcagcgccccatcggagcaggggcagaacctagaggaggacactgttactcttgaggtgctagtggcccctgcggtcccttcttgtgaggtacctagcagcgccttaagcggcactgttgtggagctacgctgccaggacaaggagggcaatcctgccccagagtacacttggtttaaagatggtatccggttgttggaaaaccctcgacttggctctcagtccaccaactcctcctatacgatgaacacgaaaacaggaacactacagttcaacacagtgagtaagcttgacaccggggagtactcttgtgaagcccgaaattctgtgggctatcgccgttgccccggaaagagaatgcaggtcgatgacctgaatatttcagggattatcgctgctgtcgtggtcgtcgcacttgtgatcagcgtgtgcgggctcggggtttgttacgcccagcgcaagggttatttctcgtccaaatatatgtttatgaagtctaacagttccagtaaggctacgacaatgagcgaaaatgacttcaagcatactaaatcatttattatctag

SEQ ID NO: 227492 - DNA, 789 bp, Artificial Sequence
  Description of Artificial Sequence: Synthetic coding sequence
atggccagacggagcaggcataggctgttactgcttctccttaggtatttggtggttgcactcggctaccacaaagcttatggtttctcagctcccaaggaccagcaggtggtgaccgccgtagaatatcagggggactttaagaatagggctgaaatgatagatttcaacattaggatcaaaaacgtgacacgttctgacgcaggaaagtaccggtgtgaggtaagcgctccaagcgagcagggccagaatctagaagaggacaccgtgaccctagaggttctggtagcacctgcggtaccctcctgcgaagtcccaagtagcgctctcagtggcaccgtggtggaattacggtgccaggacaaagaaggcaatcccgctccagaatacacctggttcaaagacggaatacgcctgctggaaaatcccagactgggctcccagagcaccaattcgagctataccatgaacactaagacaggcacactccagttcaacaccgtctctaaactggacacgggtgagtactcctgcgaagcaagaaactcggtcggttacagacggtgtccaggcaagcgtatgcaagttgacgacctgaatatctcaggcatcattgctgcagtcgtggtggtggccctggtcatctctgtatgtggcttgggggtatgctacgcacagagaaagggctatttttctaaagaaacctcgttccagaagtctaactcatcaagcaaagccactaccatgtctgagaacgattttaaacatacgaaatcctttatcatctag

SEQ ID NO: 227493 - DNA, 897 bp, Artificial Sequence
  Description of Artificial Sequence: Synthetic coding sequence
atggccagaagatccaggcacaggctgctgctactgctcctgcgttatcttgtggtggcactgggctatcataaggcttacggatttagtgcccctaaggaccagcaggtcgtgaccgctgtcgagtatcaggaagcgatactggcctgtaagactcccaaaaaaacagtcagtagtcgcttggaatggaagaaactgggaagatccgtttccttcgtctattaccagcagaccctgcaaggagatttcaagaatcgagctgagatgatagatttcaatatcagaatcaagaacgttactcgctcagacgctgggaaatatagatgcgaagtgtcagccccatctgagcaggggcaaaatctggaggaagataccgtgaccctggaagtactggtggctccagctgtgccctcatgcgaggtgccctcgtccgctctctccgggactgtggtggaacttcggtgccaggataaggaagggaatcccgctcctgagtacacatggtttaaggatggcatccgactcctggagaacccaagactgggtagtcagagtacaaactcatcctatacgatgaataccaaaacagggacccttcaatttaatactgtgagcaagctcgacactggagaatacagctgcgaggcgaggaactccgtgggctatcggcgatgtcctgggaagaggatgcaggtggacgatctgaatatctctgggataattgctgccgttgttgttgtggcacttgtgatctcggtgtgtgggttgggagtctgctatgctcagcgcaagggatacttctctaaggaaacaagcttccagaagtcaaacagtagctcgaaagcaactacgatgtcggagaacgatttcaaacatacaaaatccttcattatctag

SEQ ID NO: 227494 - DNA, 939 bp, Artificial Sequence
  Description of Artificial Sequence: Synthetic coding sequence
atggcacgacggagccggcatcgcttattgcttttgctgctccgctatctggtggtggcgctcggatatcacaaggcctacggattctcagcccctaaggaccagcaggttgtcactgctgtggaataccaggaggccatcctggcctgtaaaacgcctaaaaagaccgtgtcatcacgcctcgaatggaaaaagttgggcaggtccgtctcttttgtgtattatcagcagactctgcagggagatttcaaaaatagggccgagatgatcgacttcaacattcggattaaaaacgtgactcgaagtgacgctggaaaatatcgctgcgaggtgagcgctccatcagagcagggacagaatttggaggaggatacggttacactcgaggtgctggtggcacctgccgttccttcctgcgaggtccctagctccgcgctgtccggcaccgtcgtggagctccggtgccaggataaggaggggaatcctgccccagagtacacttggttcaaggatggcataaggctccttgagaatcccagacttgggagtcagtcaacaaactctagttatacgatgaacacaaaaacagggacactgcaatttaataccgtgtccaaactggacacgggggagtacagctgcgaagcccgaaatagcgtgggctaccgccgatgccctggaaagcgcatgcaggtggacgatctgaacatttctgggatcattgccgctgtggtggtggtggctctggtgatctctgtgtgcggccttggcgtttgctatgcccagcgcaaaggctacttctctaaagagacctcttttcagaaatcaaactcttcgtctaaggccacaaccatgtcagagaatgtgcagtggctgacgcccgtcatccctgccttatggaaagcagccgcaggtgggagtagaggtcaggagttttag

SEQ ID NO: 227495 - DNA, 933 bp, Artificial Sequence
  Description of Artificial Sequence: Synthetic coding sequence
atggccctgcggcgtccacccaggcttagactttgcgccagattgcctgattttttcctgctgctgctgtttcggggatgtcttataggtgctgtgaatctcaagtcgtctaaccgtacccctgtggtccaggagttcgaatcggtagagctgtcatgcattatcactgacagccagacctctgacccacgtatcgaatggaaaaagatacaggacgagcagacgacctatgtgttttttgataataagatccagggggatctcgccggacgcgcagagatcttgggaaaaacctccctgaaaatctggaatgtgacaagacgcgacagcgctctctacagatgtgaggttgtggcgaggaacgaccgtaaggagatagatgagatcgtaattgaactgactgtccaagtgaagccggttaccccagtctgccgggtgcctaaggcggtcccggttgggaagatggccacgctgcactgccaagagtcggaggggcatcctcgccctcattatagctggtacaggaatgatgttcccctgcctacagacagtcgcgctaaccctcgattccggaattccagtttccacctcaactccgagactggcactctggtgttcaccgctgtccacaaggatgattctgggcagtattactgtattgcttcaaatgatgcgggtagtgctcgctgcgaggaacaggagatggaggtgtacgatttaaacatagggggtattattggcggagtcttggtcgtgcttgctgtgcttgctctgatcacgctaggcatctgttgcgcctatcgtcggggttacttcattaacaacaagcaggatggagagtcttataagaaccctggcaagcccgacggtgtaaactatatccgaactgatgaggaaggagactttaggcacaagagctcctttgttatttag

SEQ ID NO: 227496 - DNA, 780 bp, Artificial Sequence
  Description of Artificial Sequence: Synthetic coding sequence
atggctctcaggcgccctccgcgactgaggctctgtgccaggctgcctgatttcttcctgctgctccttttccgtgggtgcctcatcggggctgttaacttgaagagctctaatcgcacacccgtggtgcaagaattcgaatctgtagagctgagttgcatcatcacagattcccagacgtctgatcccagaatcgagtggaaaaagatccaggacgagcagacaacctatgtctttttcgacaacaaaatacaggtgaaaccagtgaccccagtgtgccgggtacctaaggcggtgcccgtcggtaagatggccacgctccactgccaggagagtgaagggcatccgcgaccccactactcctggtaccgcaatgacgtgccactccctaccgattcccgggctaaccctcggttccggaattccagcttccacctgaactccgaaaccgggacactggtgttcacagctgtgcataaggacgacagtggccagtactactgcatcgcatccaatgatgcgggatctgctagatgtgaagagcaagagatggaggtgtatgacctgaatatcggaggtataatcggcggagtgttggtagtccttgccgttctagccctaatcaccctgggtatctgttgcgcttaccggagagggtacttcatcaacaacaaacaggatggggaaagttacaagaaccccggtaagcccgacggggtgaactatattaggactgacgaggagggggattttagacacaagagttctttcgtgatttag

SEQ ID NO: 227497 - DNA, 1068 bp, Artificial Sequence
  Description of Artificial Sequence: Synthetic coding sequence
atggtccccgctcgcctcggccctgctgtcgccatggtgacaggcgctggcaggagggtcttggcgggatgggctcacgccaggggagattacaaaccaagaagagccgcagctggcccatctgcgaccctggacatggcccttcggcgtcccccacgactgaggttgtgcgccaggttacctgatttcttcctgctgctcctgtttagaggatgcctgattggcgcagtgaatctgaagagcagcaatagaacccccgtagtgcaggaattcgagtcggtggaacttagctgcattatcacagatagccaaacttctgaccctcgcattgagtggaagaagattcaggacgagcaaaccacctacgtctttttcgataacaagattcagggtgaccttgctggcagggccgagatcctgggcaagaccagtctcaagatttggaatgtcactcgacgagattcggctctgtaccggtgcgaagttgttgctcgaaatgatcgaaaggagatcgacgaaatagtcattgagctgactgttcaggtgaaacccgttacaccagtgtgccgggtgccaaaagctgtgcctgtgggaaaaatggccaccctacactgtcaagaaagcgagggacatccaaggccccactactcatggtatcggaacgacgttcccctccctaccgattccagagctaatccgcgtttcagaaactcatcctttcatctgaattccgaaaccgggaccttggtgtttactgccgttcataaagatgatagcggccagtactactgtatcgcctcaaatgacgcaggtagtgccagatgtgaagagcaggagatggaagtatacgatctgaatattgggggtattataggaggtgttttagtggtcctggcggtgttagcgcttatcacattggggatctgctgcgcgtaccgaagaggctatttcataaacaacaagcaggacggagagtcttacaagaatcccggtaagcctgatggcgtgaattatattcgaactgatgaggagggtgatttcaggcataagagctcttttgtgatttag

SEQ ID NO: 227498 - DNA, 1986 bp, Artificial Sequence
  Description of Artificial Sequence: Synthetic coding sequence
atgacagggggtcgtttcgacttcgatgacggcggaacgtactgtgggggatgggaagagggcaaagcacacggacatggtatttgtacagggccaaagggccaaggggaatattccggaagctggtctcatgggtttgaggtggtggggggatatacttggccatccggcaatacttatcagggctattgggcccagggcaagcggcacggattgggcgtggaaacaaaggggaagtggatgtatcgcggtgagtggtcccacggcttcaagggacgctacggcgtgaggcagtctctttgtacacctgctcggtacgagggaacctggtctaacggactgcaggatggctatggtgttgaaacatatggtgacggcggaacataccagggccagtgggccggtggcatgagacacggatacggagtgcgacagagtgttccatatgggatggccactgtcatcagatcccctctgcgcacatccctggcaagccttaggagtgagcagagcaacggatctgtcctgcacgacgccgcagctgctgccgacagtccagccggaacacggggtgggttcgttctgaactttcacgccgatgccgaacttgctgggaaaaagaagggcggattgttccggagggggagtctactagggtccatgaagttaaggaagtcagaatcgaagagttcaatttctagcaagcgttcaagcgtgcggtcagacgcagctatgtcacgtatcagcagctcagacgccaattctaccatttctttcggggatgttgactgcgatttttgccctgtggaggatcacgttgatgccacaacaaccgaaacctacatgggagaatggaagaacgacaagcgcaacggcttcggagtgtcagaacgaagtaatggcatgaagtatgaaggtgagtgggcgaacaacaagagacatggatacggctgtactgtgtttcccgatggcagcaaagaagagggtaagtataagaacaacattctggtgcgagggatccggaaacagttgattcctatcaggcatactaagaccagagaaaaggttgaccgagccatagagggagcccagagggccgcagcaatggcccgtactaaggtggaaatcgctaacagcagaacggcacatgcgagagccaaagccgacgctgcagatcaagctgcgctagcggctagacaggagtgcgacatagcaagggctgtggcaagggagctttccccagacttttatcagcctgggccagactacgtgaaacagaggtttcaagaaggagtggatgccaaagagaatcccgaagagaaggttccagagaagccccctacacccaaggagagtcctcatttttacagaaagggaacaactccacctagatccccggaagcctcgcccaagcattcgcatagccctgcgtcttctcctaagcccttgaaaaagcagaacccgtcttcgggggcaagactgaatcaggacaagcgatccgttgctgatgaacaagtcacagccatagttaataaacccctgatgtccaaggctccaacaaaggaagcaggtgccgtggtaccgcagtccaagtactccggacgccatcacatcccaaatccgtccaatggcgagcttcactcacagtaccacggctactatgtcaaacttaatgccccacagcaccctcccgtggacgtggaggacggagatggatcaagccagtcgtcatccgctctcgttcacaagccaagtgctaataaatggtcgccgtcaaaatccgtgacgaagcccgtagctaaagagagtaaggccgagcctaaggctaaaaaatctgagctggcaatccctaaaaacccggctagtaatgactcatgtccagctcttgagaaagaggctaacagtggcccaaacagcatcatgatcgtcctggtaatgttgttaaatatcgggttggcaattctgtttgtgcacttcctgacctag

SEQ ID NO: 227499 - DNA, 390 bp, Artificial Sequence
  Description of Artificial Sequence: Synthetic coding sequence
atgtctggcggtaggttcgactttgacgacggtggtgcttactgtggaggttgggaagggggaaaagctcatgggcacggtctgtgtaccggcccaaaaggtcaaggcgaatactccgggtcctggaacttcggatttgaggtcgcgggtgtgtacacatggccctctggtaatacttttgaaggctattggtcccagggtaaaaggcacggtctaggaattgagactaagggaagatggctgtataaaggtgagtggactcacggattcaagggtcgctatggtatacgacaatccagcagtagcggagcaaagtatgaagggacctggaacaatggactgcaggacgggtacgggactgaaacatacgccgacggaggtatgtgctag

SEQ ID NO: 227500 - DNA, 2091 bp, Artificial Sequence
  Description of Artificial Sequence: Synthetic coding sequence
atgagcggtggtcggtttgactttgacgacgggggtgcctattgcggaggttgggaaggcggaaaggcccatggccatggcctgtgcacagggccaaaaggacagggcgaatacagtggcagctggaacttcggttttgaagtggcaggtgtgtatacgtggccaagtggcaatactttcgagggttactggagccagggaaagcgtcacggattggggattgagaccaagggacgatggctctacaagggggaatggacccacggctttaagggccgttacggcatcagacaatcgtcaagtagcggcgctaaatatgaagggacatggaacaacggactgcaggatgggtatgggaccgaaacctatgccgacggagggacctaccagggtcagttcaccaacgggatgcgacatggctacggggtgagacagagcgtcccttatggcatggcagtcgttgtgagatcacctctgagaacctctctgtccagtctgcgcagcgagcacagtaacggaaccgtcgccccagacagccccgcttcccccgctagtgacgggcctgcactgcctagccccgctatcccacgcggtgggttcgctctaagcctcctggctaacgcagaggccgctgctcgcgctcccaaggggggtggcttatttcagcgcggtgctttgctcggcaagctcaggcgcgcagagagccgaacatctgtcggatcacagaggtctagagtctcctttctaaagtccgacctgtcgagcggtgcaagcgacgcagcgtccactgcttcgctgggtgaagccgctgaaggagctgacgaggccgctccctttgaagccgatattgatgccacaaccactgaaacatatatgggtgagtggaaaaacgacaaacgcagcggcttcggtgtctcagaacggtcctccggccttaggtatgaaggcgagtggttggacaaccttcgacatgggtacggctgtaccacactccccgacggccacagggaggaggggaagtatagacacaatgtgcttgtcaaagacactaaacggcgtatgctgcagctaaagtccaacaaagtgcggcagaaggtggagcactcagttgaaggcgctcagcgcgctgccgctatcgcaagacagaaggcagaaatcgctgcttcgcgtactagccatgccaaggcaaaggcagaagcggctgagcaggccgcactggctgccaatcaagaatctaacatagccagaacactggctagagaactcgctcccgacttttatcagcccggacccgaataccagaagagacgcctcttgcaggagatcctggagaattctgagagcctgctggagccacctgacaggggcgctggcgctgccggactaccccagccgcctcgtgagtccccacagcttcatgaaagggaaacacctagaccggagggcggatcaccatccccagccggaacaccaccccagccaaagcggccacgtccaggggtgagcaaagatggactgctgagtcccggagcatggaacggggagccctcgggcgagggatcgcggagcgtgaccccaagtgaaggcgctggacgcaggtcccctgccagacccgcaacggagaggatggcaatcgaggctctgcaggcccctcccgctccttctcgcgaacctgaagtagccctgtatcaagggtatcactcctacgcagtgaggaccacccctcccgagccacccccttttgaggatcagccagagcccgaagtctctggctctgagtctgccccatcctccccagcaactgctccactgcaggccccaaccttacgaggcccagagcccgctcgggagacgccagcgaaacttgagcctaaacccattatacccaaggccgagcccagggccaaagctcggaagactgaagctcgtggactgactaaggcaggagcaaaaaaaaaggcaaggaaagaggctgccttggctgccgaggcggaggtggaagtggaagaagtacccaataccatcttgatttgcatggtcatcctgttgaacatcggcctggctatcttgttcgtccatctcctgacttag

SEQ ID NO: 227501 - DNA, 2247 bp, Artificial Sequence
  Description of Artificial Sequence: Synthetic coding sequence
atgtccagtggaggcaggttcaattttgacgatggaggcagctattgcggcggatgggaggacgggaaagcacacggtcatggggtttgtacaggccctaagggtcaaggcgaatacaccggatcctggtctcacggcttcgaagtgttgggagtatatacatggccctcagggaacacttatcaggggacctgggctcaaggcaagcggcatgggattggcttggagtctaaaggaaaatgggtctataaaggggagtggacccacggcttcaaagggcgatacggagtgagagagtgtgctgggaatggagccaagtatgagggcacatggtctaacggactccaggacgggtacgggacagagacctacagtgatggcggtacctaccaaggtcagtgggtgggcggtatgaggcagggatatggagttaggcagtcggtcccctacggtatggccgctgtcataagaagtccccttcgaacgtccattaacagcctccggtccgaacatacgaacggaacagccctacatcccgacgccagtccagccgtggctgggtcgcctgcagtgagcagggggggatttgttctggttgcacactccgatagcgagatcttaaagtctaagaaaaaggggctgttccggcgtagcctgttgtcgggactgaagctgagaaaaagtgaatctaaatccagcctggcctctcagcggtctaagcagagcagtttccgctctgaggctgggatgtcaactgtatcgagtacagcctccgatatacatagcaccatttcgctgggcgaagcggaagcagagctggcggtcatagaggacgacatcgacgccaccactactgaaacatacgtgggcgaatggaagaacgataaacggtcagggttcggcgttagccagcggtcagacggcttgaaatacgagggcgagtgggccagcaatcggaggcacgggtacggttgtatgacatttcctgacggaacgaaagaagaagggaagtacaagcaaaacatcctcgtcgggggaaaacgtaagaacctaatcccactccgggcatctaagattcgggagaaagttgaccgggcagttgaagctgcagagagggccgcaaccatcgccaaacagaaagccgagatcgctgcttctcgaacctcccacagccgggcaaaagccgaggctgcactcacagccgcacagaaggctcaggaggaagccaggatagccagaataaccgccaaagagttctcaccctcatttcagcacagagaaaacgggttagaataccagcgacccaaacgccaaacatcatgcgacgacattgaggtcctgagcaccggtaccccactgcagcaagaatctccggagctctacagaaaaggcactacccctagtgatttgacccccgacgatagccccctgcaaagcttccctacttccccagctgccactcctccccctgccccagcagcaagaaataaagtagcccacttctctcggcaagtgagtgttgacgaggagagaggaggggacatccaaatgctgctggagggaagggcaggcgactgcgcacgctcatcatggggtgaagaacaagcagggggatctagaggtgtacgctccggtgcattgcgtggtggtttattggtggatgatttccgtacaagaggatctggacgtaaacaacccggaaatcctaaacctcgcgagcggcgaactgagtccccccctgtttttacatggactagccaccaccgcgctagtaaccactctcctgggggatcaaggttgcttgaactccaggaagagaaactctcaaattaccgtatggaaatgaaaccactgctccggatggagactcacccacagaagaggaggtacagcaagggcggagcctgtagaggcttgggcgacgaccaccggccagaggatcgaggtttcggcgtccagcgccttaggagcaaggctcaaaataaggaaaacttcaggccggctagctcagccgagcctgcagtgcagaagctggccagccttcgcctcggcggtgccgagcccagactcttgagatgggacctcactttctcaccccctcagaaatctctgcctgtcgcgctggaatcagacgaagaaaacggtgacgagctcaagtcttctactggctccgctcccatccttgtggtcatggtcatcctattaaacataggcgtggcaatattatttatcaacttcttcatatag

SEQ ID NO: 227502 - DNA, 561 bp, Artificial Sequence
  Description of Artificial Sequence: Synthetic coding sequence
atgtcttcaggaggcaggttcaattttgacgatggcggtagctattgcggcggatgggaagacgggaaagcccacggccacggtgtctgtactggcccaaagggccagggtgagtacactggctcctggagccatgggttcgaggtgctgggggtgtatacctggccaagcggtaacacttatcaggggacatgggcacaaggcaagagacacggaattggtctggaaagcaaaggaaaatgggtctataagggcgaatggacacacggctttaagggacgatacggggtgagggagtgtgctgggaacggcgcaaagtatgaggggacctggagcaatggtctgcaggacggttacggcacagaaacatattccgacggtgatgctacagcttttggcgctgagcccggtcccgaagctcgggagttacccgcagctgctgcggcagcagccgctgcagctgcagcagccgttagatggtttctctgtcgggaaccctggccagctttgcaactgcctgcctgcctggattctcctatctctaccccccaatgtacgtag

SEQ ID NO: 227503 - DNA, 96 bp, Artificial Sequence
  Description of Artificial Sequence: Synthetic coding sequence
atgccacctcacagcgggcagagtcgcggtagaaaacccggttcctgtctgctattgctactgcttcttctactcctcttgctgctcctgctgtag

SEQ ID NO: 227504 - DNA, 1836 bp, Artificial Sequence
  Description of Artificial Sequence: Synthetic coding sequence
atgagacagggctatggggtcagacagagcgtgccatacggcatggcagccgtgatacggagccctctgagaacctccattaactccttgcggagcgaacacacgaacgggaccgcactgcaccccgatgcttcccctgcagtggctggatccccagcggtgagccgtgggggattcgtactggttgcccactctgacagcgaaatcctcaagtctaagaaaaagggactgttccgcagatccctgctctctggcctgaagttgcgaaagtccgagtccaaaagctcactggcatcacagcgcagcaagcagtcctctttcaggtccgaggcgggaatgtcaactgtgagctccaccgcttctgacatccactccaccatcagcttaggcgaagcagaggccgagctcgcggtgattgaggatgatattgatgccacgacaacagagacatatgttggggaatggaagaacgacaaaagaagtggcttcggggtgtcccagagaagcgatggactcaagtacgagggagagtgggcttctaataggcggcatggctatgggtgtatgacatttcctgacgggactaaagaggagggaaaatacaagcaaaacatcctggtgggaggcaagcggaagaacctgatccctttacgagctagcaagattcgggagaaagtggatcgggcagtcgaagcagctgagcgcgctgctaccatagctaagcagaaggcagaaattgccgctagtcgcactagccattcaagggcgaaggctgaggcagcgcttaccgccgctcagaaggcacaggaagaggcaaggattgctcgcatcacggctaaggaattttcaccatcatttcagcacagggagaatggtctagagtaccagagaccaaagagacagacctcgtgcgatgacattgaggttttatcaacaggaacacctcttcagcaggagtctcccgaactttaccgtaagggcactacgccttcagacctcacacctgacgattcgcccttgcagtccttccccacgtctcccgctgccactcccccacccgctcccgcagccaggaacaaagttgctcactttagtagacaggtctctgtggatgaggagaggggcggagatatccagatgctactggaaggacgggctggtgactgcgccaggtcaagctggggggaggagcaagccggaggcagcagaggggtaagatcaggagcactgcgcggtggattgcttgttgacgacttccgtacgcggggttcgggcaggaagcagcccggaaaccccaaacctagggaacgcaggaccgaatctcctcccgtttttacatggactagccaccatcgagcgagcaaccactcaccaggtggtagcagactgctcgagctgcaagaagagaagctcagtaattatagaatggagatgaagccccttctacgcatggagacgcacccacaaaaacgcaggtatagtaagggcggtgcttgtcggggtctcggggatgaccatcggccagaggatcgcggtttcggagtgcagcgccttcggtctaaagcacagaacaaggagaattttaggccagccagcagcgccgaacccgcagttcagaaattggcctcgctgcggctaggtggggcagaacccaggctcctccgctgggaccttactttctccccccctcaaaaaagtttgcctgtagcgcttgaatccgatgaggagaacggcgatgaacttaagagttccaccgggtccgcccctattctggtggtaatggtgatactacttaatatcggtgttgctatcctcttcataaacttttttatttag

SEQ ID NO: 227505 - DNA, 1347 bp, Artificial Sequence
  Description of Artificial Sequence: Synthetic coding sequence
atgacaagctcttgctgtgtgaccaataacttgcaggcatccctgaagtcttgtccaaggccggcatctgtttgctcaagcggcgtgaactgcaggcccgagctttgcctgggctatgtttgtcagccgatggcatgtctcccttctgtatgtctgccaacaacatttcggcctgcttcctgtctgtcaaagacatatctttcttcatcgtgccaggcagccagcggcatcagtggcagcatgggcccaggatcatggtacagtgagggcgctttcaacgggaatgagaaagagaccatgcaatttctcaacgatcggctggcctcctacctgacgagggtgcgccaattagagcaggagaacgccgaattggagagtagaatccaagaggcctctcactcccaggttctcaccatgacacccgactaccagtctcatttcaggaccatcgaagagttgcagcagaagatcctctgcaccaaggctgagaacgcgaggatggttgtgaacattgataatgcgaagctggcagccgatgatttcagggctaagtatgaggctgagcttgccatgagacagctggtcgaagctgacatcaatggtctgagacggatcttggatgatctaactctgtgcaaggccgacctggaggcacaggtggagtctctgaaagaggaactgatgtgtctgaaaaagaaccatgaagaggaagtcggcagcttgagatgtcagctgggggaccgactaaacatcgaggtagacgccgcacctcccgttgacctgactcgcgtgctggaggaaatgcggtgtcaatacgaagctatggtcgaagccaatcgccgtgatgttgaggagtggtttaatatgcagatggaggagctgaaccagcaggtagctacatcctccgaacagctccagaactaccagtctgacattatcgacctgcgtcggactgtcaatacacttgaaattgaactgcaagcccagcatagcctgcgtgatagtttggaaaatactcttacggagagcgaagcgcgatactcctcacagctggcccaaatgcagtgcatgattacaaatgttgaagctcagctggccgaaatcagggctgacctcgagaggcaaaatcaggaatatcaggtgctgctcgacgtcagagcgcgacttgaaggagaaatcaatacatatcgctcactgcttgagaatgaagactgcaaattgccatgcaatccttgtagcactcccagctgcacgacctgtgtgccttccccctgtgtgcccaggacagtctgcgttccacggacggtcgggatgccatgctctccgtgtcctcaggggcgatactag

SEQ ID NO: 227506 - DNA, 1641 bp, Artificial Sequence
  Description of Artificial Sequence: Synthetic coding sequence
atggctgaggtcgtctcccccgtcccaggggctgggaggagagagccaggagaggtgggcagggccagaggcccacctgtagccgatcccggagttgcactgagcccccagggggagataattgaaggttgccgactccccgtcctccgccgtaaccaggataatgaagacgaatggcctctagcagaaatcctttccgtcaaggacatttctgggaggaaattgttctatgtgcattacattgactttaacaaacgtctggacgagtgggtcacccatgagcgactggacctgaagaaaattcagtttcctaaaaaggaggcgaaaacccccacaaagaatggactccctggctcaaggccaggctcaccggagagagaggtgcccgcatcagcccaagcatctggaaagaccttgcctattcctgtacagattactctcaggttcaatctgcctaaggagagagaggcgatcccgggaggcgagcctgatcaaccattaagtagtagctcttgtctccagcccaatcatcgaagcacaaagcgtaaggtggaagtggtgagccccgcaacacccgttccaagtgaaactgcaccagcatctgtgttcccacagaatggagccgctaggagagcagtagctgcacagccagggcgaaagcggaagtccaattgtttggggactgatgaagactcccaggactcatccgacggaataccatctgctcctagaatgacggggtcccttgttagtgataggtcccatgacgatatcgtaacccgtatgaagaacatcgaatgtatcgaactgggcagacaccgactaaagccgtggtacttctctccataccctcaggagctgaccacgctgcctgttctgtacctgtgcgagttctgtctgaagtacgggagatccctcaagtgtctgcagcgccatctgacaaaatgcgacttgcgccacccccctggaaatgaaatatataggaaaggcaccatcagcttctttgaaatagatggcaggaagaacaaaagttatagtcagaatctttgtctccttgctaagtgctttctggatcacaaaaccttgtattacgatactgacccttttctgttctacgtcatgactgagtatgactgcaaaggtttccatatcgtcggatacttttctaaggaaaaggaaagcactgaagactacaatgtggcctgtattctgaccttgcccccttaccagcgacgcggatatggcaagctgttaattgaattctcatacgagctcagcaaggttgaaggaaagaccggcactcccgaaaaaccgctgtcggacttggggttgctttcatacaggtcatattggtcacaaactatcctggagattctcatgggcttgaagagcgaaagtggagagaggccacagatcacgatcaatgaaatcagtgaaattaccagtatcaaaaaagaagatgtgatttcaacactgcagtacctgaatcttattaattattataagggacagtatatcctgaccctctcggaggatatcgtagacggccatgagcgcgctatgctgaaacgcttgcttaggattgacagcaaatgtcttcattttacaccgaaagactggtctaaacggggtaagtggtag

SEQ ID NO: 227507 - DNA, 1386 bp, Artificial Sequence
  Description of Artificial Sequence: Synthetic coding sequence
atggctgaggtgggagagatcattgagggctgtagactacccgtgctgaggcgcaaccaagataacgaggatgaatggcccctcgccgagatcctgtccgtaaaggatatctctgggagaaaattgttctatgtgcattacattgactttaataagagactcgacgagtgggtgacccacgaaagactggatctgaagaaaatccagtttccaaagaaagaggccaagacccctacaaaaaacggtctgccaggctctcgccctggttcccccgaacgcgaagttaagcgaaaggtcgaggttgtgagccctgccacaccagtgcccagcgagacggcgcctgcctctgtctttccccaaaatggcgcagcgagaagggcggtggccgcacagccgggacgaaagaggaagagtaattgcctgggtacagatgaagattcccaggattccagtgacgggattccttcggcgccacgaatgactggaagcctggtgagcgatcgctcccatgatgatatcgtaacccggatgaaaaacatcgagtgcatcgagcttgggcgtcaccgcctgaagccttggtatttttccccttatccccaggaactgactacgctcccagtactgtacctgtgtgagttttgcctgaaatatgggaggagcttgaaatgcctgcagcgccatttgacaaagtgcgacctccggcacccaccaggcaatgaaatctatagaaaaggaactatctccttctttgaaatcgatgggaggaagaacaaatcttacagtcagaatctgtgcctcctagccaaatgttttctggaccacaagactctctactacgacacggatccttttctcttttatgtaatgaccgaatacgactgcaagggttttcacattgtcggctacttttctaaggagaaagaatcaactgaggactacaacgtggcatgcattctgaccctgcccccttatcagcgccgtgggtacggcaagttattgatcgagtttagttacgaactctccaaagtcgaaggcaagaccggtacccccgagaaaccgctgtctgatcttggcctgctctcttataggagctattggtcccagactatcctcgaaatcttgatgggccttaagagtgagtccggtgagaggccccagataacaatcaacgagatcagcgaaatcaccagtattaaaaaggaagacgtgatttcaacactacagtacctgaatttaattaattattataaaggacagtatattctgacccttagcgaagacatcgtggatggtcacgaacgcgctatgctgaagcgacttctgaggattgactccaagtgcctgcattttacccccaaggactggtctaagaggggcaagtggtag

SEQ ID NO: 227508 - DNA, 1542 bp, Artificial Sequence
  Description of Artificial Sequence: Synthetic coding sequence
atggctgaggtcggcgaaatcatcgagggttgtcgcctacctgtgctgcgccgaaaccaagataacgaggatgagtggcctcttgctgaaatcctatccgtcaaagacatatccggacggaaacttttctacgtgcattacatcgattttaataagagactcgacgaatgggttacccacgaaaggctggatctcaagaaaatccagttccccaaaaaggaggcaaagacacccaccaaaaacggtctacctgggtcacgccctggatcccccgagagagaggttccagcttctgcacaggcatccggaaagaccttaccaatccctgtgcagattaccttgaggttcaatctgccaaaggagagagaggctatcccaggaggagagccagaccaaccactgtcgtcctcctcttgcctccagccaaatcacagaagtaccaagcgcaaagtggaggtcgtttcgccagctacccctgttccttctgaaacggccccagccagtgtatttccccaaaatggtgctgctagaagggctgtggcagcacagccgggtcgcaagcgaaagagtaactgccttggaacagacgaggacagccaggacagcagcgatggtattccaagcgcacctcgcatgacagggtctttagtatcagataggtcacatgacgatatcgtgacccggatgaagaacattgaatgcattgagctgggaaggcaccggctaaagccatggtacttcagcccctatccgcaggagctcactactctacctgtgttgtacctatgtgaattttgtcttaagtatggccgttcactgaaatgccttcagcgtcacttaaccaagtgtgatctgcgtcacccgcctgggaacgagatttataggaaagggacgataagcttttttgaaatcgacggcaggaagaataagagctacagtcaaaacctgtgtttactggcgaagtgctttctggatcataaaacattgtactacgacacagatccattcctcttttatgtcatgactgaatacgactgcaaggggtttcatatcgtgggatacttctctaaggaaaaggaaagcaccgaagactataacgttgcttgtatcctgacactgcctccttaccagcgacggggttacggtaaactcctcatcgagttcagctacgaactttccaaggtagaggggaaaactggaacgcccgaaaaaccgctgagcgacctgggcctgctcagttacaggagctactggagccagaccattctggagattctgatgggcctcaagagcgaatctggagaacgtccccaaattacaataaacgaaatctctgagatcacaagcataaagaaggaagatgttatctccaccctccagtacttgaacctgataaattattataaagggcagtacattcttactttgagtgaggatatagtcgatggccacgaacgggctatgttaaaacgactgctgcggattgactcaaagtgcctgcactttacccccaaagactggtctaagcggggtaagtggtag

SEQ ID NO: 227509 - DNA, 1485 bp, Artificial Sequence
  Description of Artificial Sequence: Synthetic coding sequence
atggccgaggtggtatcgccggtgcctggagccggacgacgggaacccggtgaagtcggcagagcaagggggccaccggtagcagatcccggagtggctctcagtcctcagggagagatcattgaaggctgtcgcctcccggtgcttagaagaaaccaggataacgaggacgagtggcctctcgccgagattctttccgtgaaggatatctccggcaggaagctgttctacgttcactacatcgatttcaataagcgtttagatgaatgggtcactcacgaacgattggacttaaagaaaatacagtttccaaagaaggaagccaagacccctactaagaacggactccctggctcccggccagggagccctgagcgggaggtgaaaaggaaggtagaggtggtgtcccctgccacacccgtgccatcagaaaccgcacccgcatccgtttttccccaaaacggcgctgcacgacgtgccgtggccgcacagccaggcaggaaaaggaagtcgaactgtctgggcacagatgaagactctcaagattcgagcgacgggattccttcagctccaagaatgactggctctctggtgagcgacagaagtcacgacgacatcgtaacccgaatgaaaaacatcgagtgcatcgagttgggaagacataggctgaagccatggtacttttcaccctacccacaggagctgactacattgcctgtgctctatctatgcgaattctgcctcaagtacgggcgtagcctgaagtgcctccagcgccatctgacgaagtgcgacctgaggcacccccctggaaatgaaatctatagaaaggggacgatttctttctttgagatcgacggtagaaaaaacaagtcatactcccagaatttgtgtcttctggccaagtgttttctcgatcacaagacactgtactatgacaccgatcctttcctgttttacgtgatgactgagtacgactgcaaggggttccatatcgtgggctacttctctaaagagaaggagtccaccgaggattacaacgtcgcgtgtatacttacattaccaccctaccagcgtaggggatacggcaagctcttgatcgagttcagctacgagttgagcaaggtcgagggcaagaccggtactccagaaaaacccctgagcgacctgggcttattgtcctatagaagctactggagccaaacgattctcgaaatcctgatgggcctcaagtctgaatcaggcgagagacctcagattaccatcaacgagatcagcgaaatcacatcaattaagaaagaagacgttatatccacactccaatacctgaacctcataaattattataagggccagtacattttaactctcagtgaggacatcgtggatggacatgagcgggcaatgctgaagagattgctgagaattgattccaaatgcttgcactttacacctaaggactggagcaaacgcggaaaatggtag

SEQ ID NO: 227510 - DNA, 6222 bp, Artificial Sequence
  Description of Artificial Sequence: Synthetic coding sequence
atggtcaaactggccaacccactctacactgaatggatcctggaagccatccaaaaaattaagaaacagaagcagaggccgtccgaggagagaatttgccacgccgtgagcaccagccacgggttggataagaagactgtatctgagcagttagaactgagcgtgcaagatggttccgtgctgaaagtgacaaataaggggctggcgtcgtacaaggacccagacaacccgggaagattttctagtgttaaacccggtaccttccctaaaagtgccaagggcagtagagggagttgcaacgacctgcgcaacgtggattggaataaacttctgagacgggcaattgaaggactggaggaaccgaatggtagcagcctgaagaacattgaaaagtatttgagatcccaaagcgatcttacaagtactacaaataacccggcattccaacagcggctccgactgggagccaaaagagcagtcaataacggcagactgctgaaggacggtccccagtacagggtcaattacggctccctcgatgggaagggggctccccagtatccttctgctttcccaagtagtttacccccagtgagtctgttgccacatgagaaagaccagccccgagctgaccccatccccatttgtagcttctgcttgggaacaaaggagtccaatcgggaaaagaagcctgaagaactactcagttgcgccgactgcgggagtagtggccaccctagctgcctcaaattttgtcccgagcttaccactaacgtgaaggcactgagatggcagtgcatagagtgcaagacgtgttccgcatgtcgggtgcaaggccgtaatgccgataacatgttattctgcgattcctgcgatcggggttttcatatggagtgctgtgacccacccttgtcacggatgcctaaaggaatgtggatctgtcaagtgtgtcgaccaaagaaaaaaggccgtaaacttctgcacgaaaaggctgctcagataaagcgaagatatgcaaaacccattggaaggcccaagaataagctgaaacagcgtttgctctcggtcacctctgatgaaggttccatgaatgcttttacaggtagaggctcaccagggaggggccagaagacaaaggtctgtaccacgcccagcagtggacatgccgctagtgggaaggacagttcttcccgcttggccgttaccgacccaaccagaccaggggcaaccaccaagatcaccactacctcaacgtacatcagcgccagcacactgaaggtgaataaaaagacaaaggggttgattgacgggttgaccaaattcttcactccctctccagacggtagaagatctcggggagaaattatcgacttctccaaacactacagacccaggaaaaaggtttcccagaagcagagctgtacgtcacatgtactggccactggcactacccagaagctgaagcctccacctagctcactccccccaccgactcctatttcgggccaatctccaagctcacagaaatcgtcaacagccacttccagccccagtccgcaatcttcctcaagccagtgttcagttccgagtctgtcaagtctaaccacaaattctcaactgaaggcactctttgatgggctgtcacacatatacaccacccaaggacagtcgcggaagaagggtcacccttcttatgcacccccaaaaaggatgcggaggaagacggagctgagcagcaccgctaagtccaaggcccactttttcggaaagagagacatccgctcacgatttatatctcactcttcttcctctagttggggaatggcaagaggctctatctttaaagccattgcccactttaagcggactacgtttcttaagaaacatcgcatgcttggcaggcttaagtacaaagtcacaccacagatgggtacgccgtcaccgggaaaaggaagcctgaccgatgggaggattaagccggaccaagacgatgataccgagatcaagataaacattaagcaggagtccgctgatgtcaatgtcatcggcaacaaagacgtcgtaactgaggaggaccttgacgtgtttaagcaggctcaggaactgagctgggagaagatagagtgtgaaagcggtgttgaggactgtggtaggtaccccagcgtgatagaattcggaaaatacgaaattcagacttggtacagctccccctacccacaggagtacgccagactacctaagctttatctctgcgaattctgtctcaaatacatgaaatcaaagaatatattattgcggcacagcaaaaaatgcggttggtttcatccacctgccaacgaaatctatagacgcaaggatctatccgtattcgaagtggatgggaacatgtccaagatatattgtcagaatctgtgcctgctcgctaagctgtttctcgaccataagaccctgtattatgatgtggaacccttcttattttacgtgctcactaagaatgatgaaaagggatgccatttggtcggctactttagcaaagagaagttatgccaacagaaatacaatgtttcatgtatcatgatcatgccccagcatcagagacagggatttggacgcttcctgatcgatttcagctacctgttaagcaggcgagagggacaggccggttcacccgaaaaaccattatctgacctcggaagattgtcttaccttgcgtattggaaaagcgtcattctggagtacctgtaccatcaccacgaacggcacataagcatcaaggctatttcaagggccacaggtatgtgtcctcatgacatcgccaccacacttcaacatctgcatatgattgataagcgtgatggacgctttgtcatcatcagacgtgaaaaactgatcctgtcacacatggagaaactcaagacatgttcccgagctaacgagctggatcctgatagcctgcgctggactcccattttgatcagtaatgcggcagtgtctgaggaggagcgcgaagctgaaaaagaggccgagcgcctcatggagcaggcttcctgctgggagaaggaagagcaggaaatcctttccacaagggcaaactccagacaaagtccggctaaggtgcagtcgaagaataagtatctccattcacctgagagcaggcccgtcacaggtgagcgtggacaattgctcgaattaagcaaagagtcatccgaagaagaggaggaagaggaagacgaagaggaggaagaggaggaagaggaggaagaggaggatgaagaagaagaagaggaggaggaggaagaagaggaagaagagaacatccagtcttcgccccctcggcttacaaagccacagtcagtcgcgattaagcggaaaaggccattcgtgcttaagaaaaagaggggacggaaaaggcggcgaatcaactctagcgtgaccaccgagacaatatcggaaaccaccgaggtgctgaacgaaccctttgataacagcgacgaagaaaggcctatgccacagttagagcctacttgtgaaattgaagtggaggaggacggacggaagccggtgctccgcaaagcattccagcaccagcctggcaaaaaacggcagaccgaggaagaggaagggaaagataatcactgctttaaaaacgccgacccgtgtcgaaacaatatgaatgacgattcgtcaaatctgaaagaggggtccaaggataacccagagcctctgaagtgtaaacaggtgtggcccaaaggcaccaagcggggactttccaaatggcggcagaataaggagcgcaagaccgggttcaaactgaacttgtacacccctcctgaaacacctatggagccggacgagcaggtgactgtcgaggagcagaaagagaccagtgaggggaagacttctccctcccctattcgtatcgaggaggaagtcaaggaaactggtgaggccctgcttccccaggaggaaaaccgaagggaggaaacttgcgcacccgtgagccctaacacgagccccggagaaaagcctgaagatgacctcattaagccggaggaggaagaagaggaggaggaagaggaagaggaggaggaagaggaggaggagggagaggaggaggagggaggcggtaacgttgaaaaagatcctgacggagccaagagccaggagaaagaggaacctgaaatcagtacagaaaaggaggactccgccaggctagatgaccacgaggaggaggaggaggaagatgaggagcccagtcataacgaagaccatgacgctgatgatgaagacgattcgcacatggaatccgctgaggtagaaaaggaagagctccctcgcgaatctttcaaggaggtgctggagaatcaggaaaccttcctggacttaaacgtgcagcccggacactcgaacccagaggtccttatggactgcggagttgacttgactgcatcgtgtaattcggagcccaaggaactagcaggtgatccagaggctgtgcccgaaagcgatgaagaacccccaccaggcgaacaggctcagaagcaggaccagaaaaatagcaaggaggttgataccgaattcaaagagggaaaccctgccacgatggaaattgattccgagactgtgcaggcagtgcagtctctgacgcaggagagctccgagcaagacgatacctttcaggattgcgcagagacccaggaggcatgcaggtcccttcagaactataccagggcagaccagtccccccagattgcgacaactctagacgattgtcagcaatcagaccacagttcccccgtgtcctcagtgcactcccaccccggtcagtccgtacgctccgtgaactctccgagtgtgccagccctggagaacagttacgcacagatcagtcccgatcagagtgccatctcagtcccctccctccagaatatggaaacaagccctatgatggacgtgccatctgtatctgatcacagtcaacaagtcgtggacagcggcttttcagatctgggctctattgaaagcacaacagagaactacgagaaccccagttcttacgattcaaccatggggggtagtatctgcggcaatggaagcagccaaaattcctgttcctattccaatctgacttcttcttccttgactcagtctagctgcgcggtcacgcagcagatgagcaacatctctgggtcttgctcaatgctgcaacagaccagtatttcaagcccccctacttgctccgttaagagcccacagggctgcgtggtagaaagacccccttcctctagccagcagctggcacagtgcagtatggccgctaattttacgccacccatgcagctcgcggaaatcccagaaacctctaatgccaacatcggcctgtacgagcgcatgggacagtccgactttggcgcaggccactacccccagccttccgcaacgtttagtcttgccaagctgcaacagctgactaacactctcatagaccactccctgccatactcccatagcgcggcagtcacatcttatgcaaacagcgcttcgttatcaaccccactcagcaatacagggttggtgcagttatcgcagtctcctcattctgttcctggtgggccacaagcccaggctacaatgacgccacccccaaaccttacacctccccctatgaacctccctccgcctctgctgcagcggaatatggccgcttctaacatagggatctcccactcacagagactccagacgcagatcgcctcaaaaggccacattagcatgcggaccaaaagcgcctctctgtctcccgctgccgcaacccatcagagccagatctacggccgaagtcaaaccgtcgccatgcaaggtccagctcggaccctgaccatgcagcgtggcatgaacatgtctgtcaaccttatgcccgcacctgcctataacgtgaattcagtaaacatgaacatgaacaccctgaacgctatgaacggatactcaatgtctcagccgatgatgaactctggctatcacagtaatcatggctatatgaaccagaccccccagtaccctatgcagatgcagatgggcatgatgggaactcaaccgtatgcacaacagccaatgcaaaccccacctcatggaaatatgatgtacactgcccctggtcaccacggttatatgaatacaggcatgagcaaacaaagcctcaacggcagctatatgagaaggtag

SEQ ID NO: 227511 - DNA, 5672 bp, Artificial Sequence
  Description of Artificial Sequence: Synthetic coding sequence
atggtgaagctagctaaccccctttatactgaatggatcttagaggctatacagaagattaaaaagcaaaaacagcgccctagtgaagagagaatttgtcacgcggtgtccacaagccacggcctcgataagaagaccgtatccgaacagctggagctgtcagtccaggacggctcagttctgaaagtgacaaataaagggctagcctcgtataaggatccagacaatcctggcagattctcctccgtgaaacctggcaccttcccaaaaagcgctaagggatcaaggggatcctgcaatgatttacgcaacgtggactggaataaacttttgagacgcgcaatagaagggttagaagagccaaatggctcaagtctgaagaacatagagaaatacctgagaagccaaagtgatttgaccagcaccacgaacaatcccgcatttcaacagaggttgcgcttgggtgccaagcgagccgttaataacggtagactccttaaagacggaccgcaataccgtgtgaattacgggagcctggacgggaagggcgcaccacagtatccatccgcgttccccagctctctgcccccagtgtccctcctcccccacgaaaaggatcaacctagagcggatcccatcccaatctgttctttttgcctaggcacaaaagaaagcaacagagagaagaagcctgaagaattgctgtcttgcgccgactgtggaagttcaggccatcccagctgtctgaaattttgccctgagcttacgactaacgttaaggccctgcggtggcagtgcatcgaatgtaaaacttgcagtgcctgtcgtgtccagggacgaaatgccgacaacatgcttttttgcgactcttgtgaccggggattccacatggagtgctgcgatccccctttgtcacgcatgcccaaaggcatgtggatctgccaagtttgtcggcctaagaaaaaaggtagaaagctcctgcacgagaaagccgctcagatcaagcgcagatacgcaaagccaatcggcaggcctaagaataagcttaaacagcgccttttgtccgtcacctctgatgagggctcaatgaatgcattcactggaagaggtagcccgggaaggggacaaaagaccaaagtctgtactaccccatccagcgggcacgccgcaagcgggaaagactcctcctctcggcttgccgtaaccgatccaacgcgaccgggagctacgaccaaaataactactaccagcacatatatatctgcatcaacgctgaaggtgaataaaaaaactaagggcctgatcgacggtctgacaaaatttttcactccgagcccagacggaagacgctcccggggtgagatcatcgattttagcaagcattaccggccaaggaagaaggtgagtcagaagcagagttgtaccagtcatgttcttgccaccgataccgagattaagatcaatatcaagcaggagtctgccgacgtcaatgtcattggtaacaaagacgtggtgaccgaggaagatctggacgtctttaagcaggctcaggagctgagctgggagaaaatagaatgcgagtcaggcgttgaggactgcggcaggtatccttccgtaattgagtttgggaagtacgagatacagacttggtattccagcccatacccacaggaatacgccaggctgcctaaactctatctctgtgagttctgcctgaagtatatgaaatcaaaaaatattctgctccggcattccaagaaatgtggctggttccacccacccgctaatgagatctaccgcaggaaagaccttagcgtgtttgaagtcgatggcaacatgtctaagatatattgtcagaacctgtgtttgctggccaaacttttcttagatcacaaaacactgtattatgacgtggagccttttctgttctatgtccttactaagaatgatgagaaagggtgccatctagtcgggtactttagcaaagaaaagctgtgccagcagaaatataatgtgtcttgcattatgatcatgccccaacaccaacgccaaggtttcggtcgtttcctaatcgattttagttatctgctgagtcggagagaaggacaagcagggtcaccagagaaacctctctcagacttgggacgtctgagctacctggcgtactggaagtcagtgatcctcgagtatttatatcaccaccacgaacggcatataagtattaaggcaatcagtagggccacgggcatgtgtccacatgacatcgctacgaccctgcaacatcttcacatgatcgacaagcgggacggtagatttgttataataagacgggaaaaattgatcctgagccacatggaaaaactgaaaacttgttcccgggcaaacgagctcgaccccgactccttaaggtggactcctatacttatcagtaacgctgcagttagcgaagaggagagagaggctgagaaagaggccgagcgattaatggagcaggcatcgtgctgggaaaaagaggagcaggagattctgtctaccagagccaattcacgtcaaagccccgctaaggtccagagcaaaaacaagtacctccactccccagaatcacggcctgtgaccggggagaggggccagcttctggaattaagcaaggaatcgtcagaggaggaggaagaagaggaggacgaggaagaagaggaggaagaggaggaggaagaggaggatgaagaagaggaagaagaggaggaagaggaggaggaggaggagaacattcagagctctcctccccgactgactaagcctcaatcagtggccataaagaggaagaggccatttgtcctgaaaaagaagcgcggtcggaagcggagacggatcaactccagtgtgactactgaaacaatctctgagactacagaagtcttgaatgagccttttgacaattccgatgaagagagaccgatgccacagttagagccgacttgtgagatcgaggtagaagaagacggtcgaaagccggtcctgagaaaggcgtttcagcaccagcccggtaagaaacggcagaccgaggaagaggagggaaaagacaatcactgttttaagaacgccgatccctgtagaaacaatatgaatgatgactccagtaacctgaaggagggcagcaaagacaatcctgagcctctgaaatgcaagcaggtttggccaaaggggaccaagaggggactgagcaagtggcggcagaataaggagcggaagaccggtttcaagctgaatctctacaccccccctgagacacctatggagcccgatgaacaggttacagttgaggaacagaaagagaccagcgaaggcaaaacatcgccgtcacccattcgcatcgaggaggaggttaaggagaccggggaagccttgctgccccaggaggagaacaggcgcgaagagacatgcgcccctgtgtccccgaatacatctccaggagaaaagcccgaggacgacctgatcaagcctgaggaagaagaggaagaggaagaggaagaggaggaggaggaagaggaggaggaaggcgaagaagaggaaggcggtggcaacgtcgagaaggacccagacggagccaagagtcaggagaaggaagagcccgagatctccacagagaaggaggacagcgctcgcctggacgatcatgaggaggaggaagaggaagacgaggagccctcacataacgaggaccacgatgctgacgacgaggacgatagccatatggaatctgcggaggtcgagaaagaggagctgcctagggaatcctttaaagaggtcctggaaaatcaagagaccttcctggacctcaacgtccagcccggacattcgaaccctgaagtcttgatggattgtggcgtggatttaactgcttcctgtaactccgagccaaaggagttggcaggagacccagaagccgtgcccgagagtgacgaagagccacccccaggagagcaggcacagaagcaagaccagaagaattcgaaagaagtggacacagaatttaaagagggaaatcctgccacaatggagatcgatagcgagaccgttcaagctgtccagtccctgacacaagaatcttcagagcaggatgataccttccaggattgcgctgagactcaagaggcttgtcgtagcctgcagaattatacccgcgcagatcagagccctcagatcgcgacgactctggacgattgccaacagtcagatcattctagtcctgtgagctccgtacatagccatccgggacagagtgttcgcagtgttaatagcccgagcgtgccagctctggagaactcgtatgcccagatctcccctgatcaaagtgcaatctctgtacccagcctgcaaaacatggagacttcccctatgatggatgtcccaagcgtgagcgatcacagtcagcaggtcgtagactccggattctccgatcttggcagtatcgagtcaactactgagaactatgaaaacccctcaagctatgattctactatgggcggaagcatttgcgggaacggatcatctcaaaactcttgtagttacagcaaccttacctcttcttctctgacgcagtcttcatgtgcagttacccagcagatgagcaatatttctggatcgtgcagcatgcttcagcagacgagtatttcctctccccctacttgcagcgtgaagagtcctcagggctgtgtagtggagagaccaccttcaagctcccagcaactggcacaatgcagtatggcagccaacttcacccctcctatgcagctggctgagattcctgaaacttcaaacgccaacattggcctgtacgagagaatggggcaaagtgatttcggagccggtcactacccacagccttcagctactttttcactggctaagcttcagcaactgactaatactctcattgaccactctctgccttatagccactcagccgctgtaacttcctatgccaactccgcctcactgagcacacccctgtcaaataccggcctggtgcaactatcccagagcccccacagcgtgcccggaggccctcaggcccaggctacaatgacacctcccccaaacctgacaccacccccaatgaatctgccaccaccgctcttgcagaggaacatggccgcttcaaatattggcataagtcactcccagcgcctgcagacgcagatcgcatccaaaggacatatctccatgcggacaaagtccgcatcactgtcccccgctgctgccacccatcagtctcagatttacggaagatcacagacagtcgccatgcaaggtcccgctagaacgctgaccatgcaaagggggatgaacatgtcagtcaatcttatgccggcaccagcctataatgtcaacagtgtgaacatgaatatgaacactctcaatgccatgaacggctattcaatgagtcagccaatgatgaattctggataccattcaaatcatggctatatgaaccaaacgccacagtaccctatgcagatgcagatgggaatgatgggtacacagccatatgcacagcagcccatgcaaaccccgcctcatggaaacatgatgtatacagctcccggacatcatgggtatatgaacacaggcatgtccaagcagtctctgaatggatcttatatgaggcggta

SEQ ID NO: 227512 - DNA, 5346 bp, Artificial Sequence
  Description of Artificial Sequence: Synthetic coding sequence
atggtaaaactcgcgaatcctctctacacagaatggattttggaggccatacaaaaaatcaaaaagcaaaagcagaggcctagtgaagagaggatttgtcacgcagtttccacctcacatgggctggacaagaagactgttagcgaacagctcgaactgagcgtccaggatggcagcgtccttaaggtcaccaataaaggactagcgtcttacaaagaccccgacaacccgggacgcttttcttcggtcaaaccaggcaccttcccaaagtccgccaagggctcccgtggaagttgtaacgatctgagaaatgtcgattggaacaaactcctgaggagagcgatagaagggctcgaggaacccaatggctcgtcactcaagaacattgaaaagtaccttaggtctcagtcagatctcactagcacgactaacaatcctgccttccaacagcgcctcaggcttggtgccaagagagctgttaacaatggtaggctgttaaaggatggaccccaatacagagttaactatgggtcactggacgggaaaggtgccccacagtatcccagcgccttcccctcatccctaccacccgtttccttgttgcctcatgagaaggatcagcctcgcgctgatcccataccgatatgctcgttctgtctcgggaccaaagagtctaatagagagaaaaaacccgaggagctactttcctgcgctgactgtgggagcagtgggcacccaagctgcctcaagttttgtccagagctgacaaccaacgtgaaggctctccgctggcagtgcatcgagtgtaagacctgtagtgcgtgccgagtgcagggacgtaatgcagacaatatgctcttctgcgatagttgcgacagaggcttccacatggagtgttgtgatccccctctgtctcgcatgccaaagggcatgtggatttgccaggtctgtagacccaagaaaaagggacgaaagctcctacatgagaaggctgcccagataaagagacggtacgcaaagccaatcggacgccctaagaacaaattgaagcagcggctactgagcgtgacatcggatgagggcagtatgaatgctttcaccggtagaggatcgccggatactgagataaaaatcaatattaagcaggaatccgccgatgtcaacgtgatcgggaacaaggacgttgttaccgaagaggacttggacgtgttcaagcaagcgcaggaactgagttgggagaaaattgaatgcgaatcaggagtggaagattgcggaaggtatccaagcgtgattgaattcggaaaatacgagatccagacctggtactctagtccttatccccaggagtatgcgagattgcccaaactgtatctgtgcgagttttgcttaaaatacatgaagagcaaaaatattctcctccggcactctaaaaaatgcgggtggtttcatcctcccgcaaacgaaatctatcggcgtaaagacctttcagtcttcgaagttgatggcaatatgtctaagatctattgccagaatttgtgtctcctggccaaactgttcctcgatcataagactctgtactatgacgtggagccttttctgttctacgtgctcacgaaaaatgatgaaaagggctgtcacttggtggggtattttagtaaagaaaaactttgtcagcagaaatacaatgtgagttgtatcatgattatgccacagcaccaaaggcaggggtttgggcgtttcctcattgacttctcctatctcttaagccgacgtgaggggcaggccggatcaccagaaaagcctctgtccgacctgggacggttgtcctatctggcctattggaaatctgtaatactcgaatacctgtatcaccaccacgaacggcacattagcatcaaggcaattagccgagccaccggtatgtgtccacacgatatcgccactacattacagcacctgcacatgatcgacaagcgggacgggaggtttgtgattatccggcgagaaaagctcatcctgtctcatatggagaaactgaagacatgttctagggctaacgaattggatcctgacagtctcaggtggacccctatcctgatcagtaatgcagcggtcagcgaggaagagagagaagcggagaaagaggccgaacgacttatggagcaggcttcctgctgggaaaaagaagagcaggaaatattgagtacgagagccaattcgcgtcagagcccggctaaagtccagtccaaaaataaatatctgcacagccctgagtcccggcctgtgactggcgaacgcggacagctcttagagctaagcaaagaatcaagcgaagaggaggaggaggaggaggatgaagaagaggaagaagaggaggaggaggaagaggaagacgaggaggaggaggaggaggaagaggaagaggaggaggaggaaaacattcagtcttccccgcctcggctcacaaagcctcagtccgttgccattaagagaaaacggccttttgtgctgaaaaaaaaaagagggaggaaacgcaggcggattaattcaagtgtaacgactgaaactatatctgaaacaaccgaagtgctaaacgaaccctttgacaacagcgacgaagaacgtcctatgccccagttggaacccacatgcgagattgaagtggaggaagatggcaggaaacctgttctccgcaaagcctttcagcatcaacctggaaaaaagaggcagacagaggaggaggaagggaaggataaccactgtttcaaaaacgctgatccttgtcgtaataacatgaacgatgatagttcaaatttaaaggaaggatccaaggacaaccccgaacccctcaaatgtaagcaagtttggccgaagggaacgaagcgaggcctgtctaaatggagacagaataaagaacggaaaactggatttaagcttaacctgtacaccccacccgagacgccaatggaacccgacgagcaagtgaccgtcgaggaacagaaagaaacctccgaggggaagacgtccccgagtccgatacgcatagaagaagaagtgaaagagactggcgaagcactgctgcctcaggaggagaatagacgggaagaaacttgcgcaccagtaagcccgaatacctcacctggagagaaaccagaagacgacctgatcaagccagaggaggaggaagaagaggaggaagaggaagaggaagaggaagaggaagaggagggggaagaggaggaaggaggaggcaatgtcgaaaaggatccggacggcgcaaaatcccaggaaaaggaagagcctgagatcagcactgaaaaagaggattccgctaggttggacgatcacgaggaagaggaggaagaggacgaggaaccaagccacaatgaagatcacgacgcggacgatgaggatgattcccacatggaatccgctgaggttgaaaaggaggaactccctagggaaagtttcaaagaggttttggaaaatcaggagacctttctggacctgaacgtgcagcccggacacagtaaccccgaagtgctgatggattgtggagtcgacctcaccgcttcgtgcaactctgagcccaaggaactggcaggagatcctgaggcagtgcccgaatccgacgaagagcctcctcctggcgaacaggcccaaaagcaggaccagaagaattcaaaagaggtggatacagagtttaaagagggtaatcctgcaaccatggaaatagacagcgagacagtgcaagctgtccagagcctcactcaggaaagctcagagcaggatgacacatttcaagactgcgctgaaacacaagaagcttgcagatctctgcagaactatactagggccgaccagtcaccacaaatagccacaaccctggatgattgtcaacaatcggaccacagctcgccggtgagttcagtgcactctcatcccggacaaagtgttagatccgtgaattctccttctgtaccggcacttgaaaattcatatgctcagatctcccccgaccaatctgcaattagcgtgcctagcctacaaaacatggaaaccagtccaatgatggatgtcccctcagtgtccgaccacagccaacaggttgtcgactctggattcagcgacctaggctcaattgagagcaccacagaaaactatgagaatcccagttcctatgactccaccatgggaggctctatttgcggtaatggaagtagccaaaacagttgtagctatagcaacctgacctctagttccctgacccaatcatcatgcgccgtgacacaacagatgagcaatattagtggctcatgctccatgcttcaacagactagcataagctctccgcctacgtgtagcgtcaaatcaccccaggggtgtgttgttgagcggcctccttcctcatcacagcagctggctcagtgcagcatggccgcaaattttaccccccctatgcagctggcggagatacccgaaacctcgaatgctaatatcggcctctacgaacgaatgggtcagtccgatttcggcgctggccactacccccaacctagcgccaccttttccttagccaagttgcaacaactgactaacactttgatagaccattctttgccctattcccattcagcagccgtgacctcctatgccaatagtgcatctctgtcaacacctctgagcaatacagggctcgttcagctctctcagagtcctcactcagtgcccggaggccctcaggcccaggctacaatgacccctccccctaacctcaccccacccccaatgaacctaccgcctcctctgctgcaaagaaacatggctgcctctaatatcggcataagtcattctcagaggctccagacacagatcgcctccaaaggccacatcagcatgcgcactaagtccgcttctctttctcccgcagctgcaacacaccaaagccaaatatacggccgatcacagacagtggctatgcaggggcctgcacgcacactgactatgcagaggggaatgaacatgtcagtcaatctgatgcccgctcctgcatacaacgtcaacagtgtgaacatgaacatgaacacactgaatgccatgaatggttatagtatgagccagccgatgatgaatagcggataccactccaaccacggctacatgaaccaaacgccacagtatcccatgcagatgcaaatgggaatgatgggtactcagccctacgcccagcagccaatgcagacgccaccccatggaaacatgatgtatactgcgcctgggcatcatgggtacatgaacacaggtatgtcgaagcagagccttaacggctcgtacatgaggcggtaa

SEQ ID NO: 227513 - DNA, 5345 bp, Artificial Sequence
  Description of Artificial Sequence: Synthetic coding sequence
atggttaaacttgctaatccactctatacagagtggatactggaagctatccaaaagattaagaaacagaagcaaaggcccagtgaagagaggatttgccacgctgtgagcaccagccatggtttggataagaaaacagtgagcgagcagctcgagttgagtgtgcaggacgggagtgtgctgaaagtcacaaataaaggacttgcttcgtataaggaccctgataaccctggcaggttttctagcgtcaaacctgggactttccccaagagcgccaagggatcacgagggtcctgtaatgaccttcggaatgtcgattggaacaagttactcaggagggccattgaaggtctggaagagcctaatggctcctctttgaaaaatatagaaaagtacctgcgttcacagtctgacctgacaagcaccaccaacaaccctgcattccaacagcggctgcgtctgggcgctaaaagagctgtgaacaatggcaggctgctcaaggacggcccacagtaccgcgttaattatggttccctggacggtaagggtgcgccacagtatccgtccgcctttcccagcagtctgccccctgtgtctctactcccccacgaaaaagaccaacccagggcggaccctatacccatttgctcattctgccttggtacaaaagagtccaaccgcgagaaaaagcctgaagaactcctttcatgtgctgactgtgggagtagcggccatccatcttgtttgaaattctgtcccgagttgacgaccaatgtgaaagcactgcgctggcaatgcattgagtgcaagacctgttcagcctgcagagtgcagggtagaaacgccgacaacatgctgttttgtgatagttgcgatagaggtttccatatggaatgttgcgatcccccattgtcaaggatgccaaagggcatgtggatatgtcaggtgtgccggccaaagaagaagggacggaaacttctgcacgaaaaagccgcacagattaaaaggagatatgccaagcccatcggtcgtccgaaaaataaactcaagcagcgtctgctatctgtgacatctgacgagggctcgatgaatgcatttaccggaaggggctcaccagataccgagattaagatcaacatcaagcaggagagcgcggacgtaaacgtgatcgggaataaagacgtggtcacagaggaggacctggatgtgtttaagcaagctcaagagttatcttgggagaagattgaatgcgaatcaggggtggaagactgtgggcgatacccaagtgttatagagttcggtaaatacgagatccaaacatggtacagttctccttacccgcaggagtacgctcgtctccccaaactttatttgtgtgaattctgtctaaagtatatgaagtctaagaatattttgctgaggcacagcaaaaagtgcggctggtttcaccctcccgcaaatgaaatctaccgaaggaaagacctgagcgtcttcgaagttgatgggaatatgagcaaaatttactgccagaatctttgtctgttggccaaactgttccttgaccataagacattatattacgacgttgaacccttcctcttctacgtgttgacaaagaacgacgagaaagggtgtcaccttgtgggctatttctctaaggagaagctctgtcagcagaagtacaatgtgagctgcattatgataatgcctcagcaccagagacaggggtttgggcgttttctgatagatttttcctacctcctgtcacgccgtgaggggcaggctggatcacccgagaagcccctgtccgacctcgggaggctgtcctaccttgcttactggaaatctgtgatcctggagtacctttatcaccaccacgaaagacacatcagcattaaagcaatctccagggcaaccggcatgtgccctcatgatattgccaccaccctccagcacctccatatgattgacaaaagggatggacgatttgtcattatccgcagggaaaagcttatcctgtcacacatggaaaagctgaagacatgttcgcgcgctaatgagctagacccagacagcctccgctggacacccattcttatctcaaacgctgccgtctctgaagaggagcgggaggccgagaaagaggccgaaaggctcatggaacaggcctcctgttgggagaaggaggaacaggagatactgagcacacgggctaattctcgacagtcacccgctaaggtgcagagtaagaataagtatctgcattcacctgaatcacgccctgtcaccggcgagagaggtcaactccttgagctgtccaaagagtctagcgaagaggaggaagaggaggaggacgaagaggaagaggaagaggaggaagaggaagaagaagatgaagaagaggaagaagaagaagaagaggaagaagaagaggagaacattcagagcagtccccctcgcttgaccaaaccccagtctgtcgccattaaacgcaaacgtccttttgtgcttaagaaaaagagaggcagaaagagacggcgtatcaattcaagcgtgacaaccgaaactataagcgaaacgaccgaagttctgaatgaaccttttgataatagcgatgaggaaagaccaatgccccaactcgagccaacctgcgagattgaagttgaagaggatggtcgtaagcccgtgcttcgcaaggcttttcagcatcagcccggaaaaaagcggcaaaccgaagaggaggaagggaaggataatcactgctttaaaaatgctgatccctgcagaaacaatatgaatgacgactcttcaaatctaaaagaaggcagcaaggataaccctgaacctctcaaatgtaagcaggtgtggcccaaagggaccaaacgcggtcttagtaagtggagacagaataaagaacgcaagactggtttcaagctgaatctgtataccccccctgaaacacctatggaaccagatgaacaagtgacggtcgaggaacagaaagagacttcagaggggaagactagcccttcgcctattagaattgaggaagaagtgaaagagactggtgaagccctgttaccccaggaggagaacaggcgggaagagacttgcgctcccgtgtctcccaatacttctcctggagaaaaacctgaggacgacctcataaaaccggaggaggaggaggaagaggaggaagaagaagaagaggaggaagaggaagaagaaggtgaagaggaagaagggggaggcaatgtggaaaaggatcctgacggtgctaaaagccaggaaaaggaggagcctgagattagcacagaaaaagaagactccgcacggctggacgaccacgaagaggaggaggaggaggatgaggagccaagccacaacgaggatcatgatgcggatgacgaagacgattcacacatggaatctgctgaggtagaaaaggaggaactgcctcgcgagtcgtttaaggaagtgcttgaaaatcaggagacttttctggatctgaatgtccaaccagggcattctaaccccgaagtgttgatggattgtggggtggacctaacagcaagttgcaacagtgagcccaaggagttggcaggagatcctgaggccgtccctgagtccgacgaggaacccccacccggtgaacaggcccagaagcaggatcaaaagaacagtaaagaagttgataccgagtttaaggaaggcaatccagccaccatggaaatagactctgaaacagtgcaggctgtccagtcattgacccaagagagctccgagcaggatgatacgttccaagactgtgccgagacccaggaagcatgccggtccctgcagaattatacaagggccgaccaaagtccacagatcgccaccacactagacgattgccagcagagcgaccactcctcaccggtctcatctgtgcacagccaccctgggcaaagtgtgcgctcagtcaattccccaagtgtccctgctttggagaatagttacgcccagatcagccctgaccaatctgccatctccgtgccaagcttgcagaatatggaaacgtctcctatgatggacgtgccttcggttagtgatcactctcagcaggtcgtggatagcggtttcagcgacctaggctccattgagtccacaacagagaattatgagaacccatcctcctatgatagcactatgggtgggtccatctgcggaaacggatcctcacaaaattcttgttcctattctaatctgacatctagctccttgacacagtcttcctgtgcagttacgcagcagatgtcaaatatatccggttcttgtagcatgcttcagcagacctccataagctcgccccctacctgctccgtgaagtccccccaggggtgcgttgtggagcgtccacccagttcatctcagcagctggcacaatgcagcatggccgctaacttcacacccccaatgcagctggccgaaattcctgaaactagcaatgccaacatcgggctgtatgagcgaatgggtcaatccgactttggagccggacactacccccagccatccgctaccttctccctggcaaaactccagcagctcacaaatactctcatagatcattctttaccttattctcatagcgcagctgtgactagttacgctaattctgctagtctctccacgccactcagcaatacagggctggtccagctctctcagagcccacacagcgtgcctggtgggcctcaagcccaggccactatgacaccgccacccaacctcacacctcctcctatgaacctccctccccctctgctacaaagaaatatggctgcaagtaacattgggataagccattcacagcgactgcagacgcagatagcaagtaaaggccatataagtatgagaactaagagcgctagtctgtcccccgcagcagctacacaccagagtcagatttacggaagatctcagacggtcgccatgcaaggccctgcaagaaccctcaccatgcagcggggaatgaacatgtctgtgaatctcatgcccgcacccgcatacaacgttaattcagtgaacatgaatatgaatacactgaatgctatgaatggctattcaatgtcccagcccatgatgaacagcgggtatcactccaatcatggctatatgaatcagacaccccagtacccgatgcagatgcaaatgggaatgatgggaacccagccttatgcacagcagccaatgcagaccccacctcatggcaatatgatgtatacagccccaggccaccatggctacatgaacaccggcatgtccaagcagagtttgaacggctcatatatgcggaggta

SEQ ID NO: 227514 - DNA, 5345 bp, Artificial Sequence
  Description of Artificial Sequence: Synthetic coding sequence
atggtgaagctcgccaaccccttgtatacagaatggatcctcgaagcaatccagaagatcaagaagcagaaacagcgaccttctgaagagagaatctgtcatgctgttagcaccagtcatgggctagacaagaagaccgtcagtgaacagctggagctgtctgtccaagacggttcagtactcaaagtcactaacaaggggctggcgagttataaggatcccgacaaccctggtcggttttccagtgtgaaacctggcacgttcccaaagtcagccaaggggtctaggggctcctgcaacgatctgaggaatgtcgactggaataaactgctcagaagagccattgaaggcttggaggaaccgaacggatccagtctcaagaatattgagaaatatctcagatcccagagcgatctgacgtctactactaacaatccggcatttcagcagagactgcggctcggagctaaacgcgcagtgaacaatggccgactactgaaggatgggccacaataccgcgttaattacgggtcactggacggaaaaggggctccccagtatccatccgccttcccctcatcgttgcctccagtcagtctgctaccccacgagaaggatcagcccagggcagatcctatccccatttgcagtttttgccttgggactaaagagtcgaatcgggagaagaaacctgaggagctgctgtcatgcgccgactgcgggagttctggacacccctcttgcctgaagttttgcccagaactgactactaatgtcaaggcccttaggtggcagtgcattgagtgtaaaacctgtagtgcctgcagggtgcaagggagaaacgctgacaatatgttattctgtgattcgtgtgatcgaggttttcacatggagtgctgtgatccgcctttgtccagaatgccaaagggcatgtggatctgccaggtctgccgtcccaagaaaaaaggcaggaaactgctccacgagaaggccgctcagataaaacggagatatgccaagcccatcggtcggccaaaaaacaagctgaaacagaggctgctgagtgtgactagcgatgaaggttccatgaacgcatttacaggaagggggtcccccgataccgagataaagattaatattaagcaggagtcggctgatgtgaatgtgataggcaataaggacgtcgtgacggaagaagatctggatgtgttcaaacaggctcaagaactatcatgggagaaaattgagtgcgagagcggggtggaggactgtgggagatacccaagtgttatcgagtttggtaagtatgagattcagacctggtactctagtccctaccctcaggagtacgcccgtttaccgaagctttacctgtgcgaattctgtctgaaatatatgaagtctaaaaacattctgctccgccacagcaaaaagtgtggctggtttcatccacccgctaatgagatctatcgtagaaaggacctgtccgtgtttgaggttgacggcaacatgtcaaagatctattgccagaatctttgtttgttggcaaagctgttccttgatcacaaaaccttgtactacgacgtggaaccttttcttttctacgtcttgacgaaaaacgacgagaaggggtgtcatctggttggatatttctccaaggaaaagctctgccagcagaaatacaacgtgtcatgtattatgattatgcctcagcaccagaggcaggggtttgggagatttctgatcgatttttcctacctactcagcagacgcgagggccaggccggatccccagagaaaccgctgagtgacttaggccgactgtcatacttagcgtactggaagagcgtgatacttgagtatttgtaccaccaccatgaacgacacatctcgattaaagcaatttctcgagcaacgggcatgtgtccacatgacatcgccaccacattacagcacctccatatgatcgataagagagacggcaggtttgtcataatccgccgtgagaagctcattctcagccacatggagaagttgaagacttgcagtagagcgaatgagctcgatccagactcgctcagatggacccctattcttatttccaacgctgcagttagcgaggaggaaagggaagctgagaaggaggcggaaaggctgatggaacaggcttcatgctgggaaaaagaggagcaggaaatcttaagtactcgagctaatagtcgtcagagtcctgctaaggtccaatccaagaacaagtacctccactcacccgaaagcagacccgttacaggggagagggggcagctgctcgagctatccaaggagagtagcgaagaggaagaagaggaggaggatgaagaggaggaagaggaagaggaggaagaggaggaagatgaagaagaagaagaggaggaagaagaagaggaggaagaggagaacattcagagctcgccaccaaggctaacgaaaccccagagtgtcgccattaaacgcaagcgtcctttcgtgctgaagaagaagcgaggacggaagcgaaggcggataaattcatcggtgaccaccgaaaccatcagcgagacaacagaggtgttgaatgagccatttgataatagcgatgaagagaggccaatgccccagcttgaacctacgtgcgaaatcgaggtggaggaggacggtagaaagcccgtgctccgcaaggcgtttcagcaccagcccggtaaaaaacgccagacagaggaagaagaagggaaagacaaccactgtttcaaaaacgccgatccttgccggaataatatgaatgatgacagcagcaacctgaaagaggggagcaaagacaaccctgagcctctcaagtgtaagcaggtgtggccaaaaggcacaaaacgcggactctccaagtggcgccagaataaagaaaggaagacaggattcaagctgaatctgtacaccccacccgagaccccgatggagcctgacgaacaagtcacagtggaagagcaaaaagaaacatccgaaggtaagacatcaccttccccgattcggatcgaggaggaggtcaaggagaccggggaggcccttctgccccaggaagaaaataggagagaagaaacctgcgcacccgtctcgcctaatactagtcctggcgaaaagcctgaagatgacctgataaaaccagaggaggaggaagaagaagaggaggaggaggaagaagaagaggaggaagaggaaggagaggaggaagagggcggtggcaatgtcgaaaaagaccctgacggagctaagtctcaggagaaggaggaaccggagattagtaccgagaaggaggatagtgcgcgtcttgatgatcacgaggaggaggaggaggaggacgaagagccatcacacaatgaggaccatgacgccgatgacgaagacgatagtcatatggagtctgcggaggtcgaaaaggaggagctgcccagggagtctttcaaggaagttctggagaaccaagagacgttcttggatttgaatgttcagcccggtcattccaatccggaggtgctgatggactgcggggtcgatctgactgcttcctgtaatagcgagcccaaagagctcgctggtgatccggaggcagtcccagagtctgacgaggagccgcctcctggggaacaggcccagaagcaggaccagaaaaactccaaggaagtggatactgaatttaaagaagggaacccagctaccatggaaattgactctgagacagtgcaagccgtgcaaagcctgacgcaggaaagcagcgaacaggatgacacttttcaggattgcgccgagactcaggaggcttgcagatctttgcagaactataccagggcggatcaatctccgcagatcgccacaaccctggacgactgccagcagagcgaccatagctcacctgtgtcctcggtccactcccaccccggacagtctgtaaggtctgtgaacagtccttcagtcccagccctggagaactcttacgcccaaatcagccccgaccaaagcgctatttccgtgccatccctacaaaatatggaaacatctccaatgatggacgtgccgtccgtgtccgaccattctcagcaggttgtggattcaggcttttctgatctgggctccatagaatcaacgaccgagaactatgaaaacccttccagttacgactccactatgggcggtagcatctgcggcaacggtagctcccagaatagctgctcttatagcaacctgactagcagctcactgacccagtctagttgcgctgtgactcagcagatgtcaaatatctcaggctcatgtagcatgctgcaacaaaccagcatatcttcccctcctacatgcagcgtaaagtcgccacagggttgtgttgtggagcgacccccatcttccagccagcagctcgcacagtgcagcatggccgctaactttaccccacccatgcagctcgcagagatacctgagacttccaacgcgaatataggactatacgagcgaatggggcagagtgacttcggggctgggcactatccccagccttctgctaccttttccctggctaaattgcagcagttgacgaacaccttaatagaccacagtctcccttactcccacagcgctgccgtgacaagctatgctaattccgcttcacttagcactccattatctaacactggactagtgcagctcagtcagtctccacattcggtgcccggagggcctcaggcccaggcaaccatgactcctcctcccaatttgactccccctcccatgaacctgcctccacccttgctacaaagaaatatggcggcaagcaatatcggcatctcccacagccagagactgcagacccagattgcctctaaggggcatattagtatgcggactaagtccgcctcactctcaccagcggctgccacacatcagtcacaaatctacggacggtcccagacagtggccatgcagggcccagccagaactctgaccatgcagcgagggatgaatatgagcgtgaacctaatgcccgctccggcatacaatgtgaacagtgttaatatgaacatgaacacgctgaatgcgatgaacggatactctatgtcacagccgatgatgaatagcggttatcacagtaaccatggctatatgaaccagacccctcagtatccaatgcagatgcaaatggggatgatgggcacccagccctacgcccagcagccaatgcagacaccccctcacggcaacatgatgtatacagccccaggacaccatgggtacatgaatacgggcatgtctaaacagtccctgaatgggtcatacatgcggaggta

SEQ ID NO: 227515 - DNA, 4992 bp, Artificial Sequence
  Description of Artificial Sequence: Synthetic coding sequence
atgactgaccgcttctgggaccaatggtatctctggtatctgcgcctcctcaggctgttggaccggggttccttccggaacgacggactcaaagcttccgatgtgttaccaattcttaaggagaaggtggcgttcgtgtccgggggaagggacaaacgtggcggacctatactgactttccccgctcgaagcaaccacgacagaattcgtcaggaagacctccgcaaactcgtgacgtatttggcctcagttccttccgaagacgtatgtaagcgcggatttactgtgataattgatatgcggggtagtaagtgggatttgattaagccgctgttgaagactttacaagaggctttccctgctgagattcacgtagccttgattatcaagccagacaatttctggcaaaaacaaaagacaaactttggatcttcaaagttcatttttgagacgtcaatggtctctgtggaagggcttacgaaactggtggacccatcccagctgaccgaagaattcgatggctctttagactacaatcacgaggaatggatcgagctgagactgtcattggaagagttctttaactccgctgtgcatctgctgtcccgtctggaagacctgcaggagatgttggcgcgaaaagaattccccgtggatgtggagggaagccggcgactgattgacgagcacacacagcttaagaaaaaggtgctcaaagcacctgtcgaggagctggatcgtgaggggcaacgtctgctccagtgtatccgctgtagcgacggattcagcgggaggaactgtattccagggtccgctgacttccaatcactggttccaaaaattacttctttgctggataagctgcactccaccagacagcatttgcatcagatgtggcatgtgagaaaactgaaattagatcagtgctttcaactacggctgtttgagcaggatgcagaaaagatgtttgattggatctcccataataaggaactcttcctacagtcccacactgagatcggcgttagttaccagtatgcccttgacttacaaacgcagcataatcactttgcaatgaactccatgaacgcctatgtaaatattaacagaatcatgtcggtcgcatctaggctgagcgaagccggtcactatgcctctcagcagataaaacaaatcagcacacagctggatcaagagtggaagagcttcgctgccgctctggacgaacggtcaaccatcctggcgatgtccgctgttttccaccagaaggccgaacaattcttatcgggggttgacgcctggtgcaaaatgtgcagtgagggcggattgccttctgagatgcaggatttggagctcgcaatccaccaccatcaaacattatacgagcaggttacacaggcgtacaccgaggtgtctcaagacggcaaggctctgttggacgtcctgcaacggccattgtctcccggaaatagcgaatcactgacagcgacagctaattattctaaagctgtccaccaggtactggatgtggtccacgaagtcctgcatcaccagcggagactagaaagtatttggcaacaccgaaaagtgcggttacatcagaggctccagctatgcgtcttccaacaggatgtccagcaagtcctggactggattgagaaccatggtgaggctttcttgtcaaagcacactggggtgggaaaaagcctgcacagagccagggcactgcaaaagagacacgatgactttgaggaggtagcccagaatacctacaccaatgccgacaagcttctcgaagcagccgagcagcttgcccagaccggcgaatgcgatccggaggaaatttacaaagctgccagacatcttgaagtacggatccaggattttgtgcgtagggttgagcagcgtaaactccttctcgatatgagcgtctccttccacacacataccaaggagttgtggacatggatggaggacctgcagaaggaaatgctggaggatgtgtgcgctgattctgttgacgccgtccaggaactaatcaagcaatttcagcaacaacagactgctaccttggatgctacactcaacgttattaaggagggcgaagacctgatacaacagctgagaagcgcccctccgagcttaggcgaaccatccgaggccagggactccgccgttagcaataataagactccacatagtagctctattagtcacattgagagcgtgcttcaacaactggatgatgcccaggtccagatggaagagctcttccacgaacgcaagataaagctcgatatctttttgcagcttcggatctttgagcagtatacgatcgaggtgaccgccgaacttgacgcctggaatgaggatctcctgcgccagatgaatgattttaataccgaggatctgacccttgccgagcaacgactccagcggcacactgagaggaaactagctatgaataatatgaccttcgaggtgatccagcaggggcaagacctccaccagtacattacagaggtccaggcgtcaggcatcgaactgatctgcgagaaggacatcgatctcgccgcacaggtgcaggagcttctggagtttctccacgaaaagcagcacgagctcgaactaaacgcggagcagactcacaagaggttggaacagtgcctccagttgcgacacctccaggcagaagtcaaacaggtcttggggtggatccgcaacggcgagagtatgctgaatgcatctctggtgaacgctagtagcctcagcgaagccgaacaactgcagagggagcacgaacagtttcaactggctattgaaagcctgttccatgcgacctctctgcagaagacccatcagagcgcattgcaagtgcagcagaaagctgaagtcctgttgcaggcgggacattacgacgcagatgccattcgcgagtgcgccgaaaaagtcgcattgcattggcagcaacttatgctcaaaatggaggataggctaaagctcgtcaacgcctccgtggcattctacaagacttctgaacaggtatgctcggtattggaatccctggagcaagagtatagacgagatgaagactggtgcggcggtagggacaaactaggcccagccgctgaaattgatcacgttatcccactgatttcaaagcatctggagcaaaaggaggcattcttgaaggcttgtacactcgctcggagaaacgccgaggtcttcttaaagtacatccacaggaataacgtgtccatgccaagcgtggcttctcacacacggggacccgaacagcaagtgaaggctatcttatctgagctgttgcagagggagaaccgggtccttcacttttggaccttgaaaaaaaggagactcgaccaatgtcagcaatatgtggtctttgaacgatccgccaaacaggcactggattggattcaggagacgggggagttctacttgtccacgcacacaagcactggcgaaacaaccgaggagacacaagaactgttgaaggaatatggggagttccgggttcctgcaaagcagacaaaagaaaaagtgaaactgctcattcagctggccgactctttcgtggaaaagggtcacatccacgctacagagatccgaaagtgggtgaccacggtggacaagcactatagagactttagtctcaggatgggcaagtacagatatagcctggagaaggcgctgggcgttaacactgaggacaacaaggacttggagcttgacattatccctgcctcactctcggaccgcgaagtgaagttaagagacgccaaccacgaagtgaacgaagagaaaagaaagtctgctagaaaaaaggagtttataatggccgagctgctccagaccgagaaagcttatgtccgggatctccacgaatgtctggagacatatctgtgggagatgacctcaggtgtggaagagatccccccaggaatcctgaataaggagcacatcatcttcggaaatattcaagagatctacgatttccacaacaacatttttctcaaggagttagaaaagtatgaacagctccccgaagacgtggggcattgcttcgtgacctgggccgataagtttcagatgtacgtcacctactgtaagaacaaacctgatagcaaccagctgatcctggaacacgccggaaccttctttgacgaaatacagcaacggcacggcctagctaatagtatcagttcctatctcatcaagcctgtgcaacggattactaaatatcaactccttctcaaagagctgctcacgtgttgcgaggaaggaaaaggagagctgaaggatggtctagaagtcatgctttccgtcccgaaaaaagctaacgatgctatgcacgtgtccatgttagaggggttcgacgagaatctcgacgtgcagggggaacttatcctccaggatgcttttcaagtgtgggaccctaagtccctgatccggaaaggcagagaacgccacctgtttctcttcgagattagcttggtgttttccaaagagatcaaggattcctctggccacacaaaatatgtctacaagaataaactactgacgtcagaactgggcgttacggaacacgttgagggggatccatgtaaatttgccctctggtctggcagaacaccttctagcgacaacaaaaccgtcctaaaggccagcaatattgaaactaagcaggaatggatcaagaacattcgtgaggtgattcaggagagaattatccacttgaagggcgctctgaaggaaccgctccagctccccaaaacacctgcaaagcagcgcaacaactcgaaacgagatggggtcgaagatatcgatagccaaggcgatgggtcgagtcagcccgataccatttctatcgcttccagaacgtctcagaacaccgtcgacagtgacaaggacggcaatctggtgcctagatggcatctgggcccaggcgaccctttctccacgtacgtttaa

SEQ ID NO: 227516 - DNA, 3870 bp, Artificial Sequence
  Description of Artificial Sequence: Synthetic coding sequence
atgaagggcggtgatcgagcctacacccgcggtccctccctcggctggctgttcgcaaaatgttgttgctgcttcccttgcagggatgcttacagccacagctcttccgagaacgggggtaagtccgagtccgttgcaaacctgcaggcccagcccagtttgaactctattcattcttctcccggacctaagcgtagcaccaacacactcaagaaatggctgacctcacccgtcaggagattgaactcaggaaaggcagatggcaacataaagaaacagaaaaaagtgagagatggacgaaagtccttcgacctgggaagcccaaaacccggtgatgaaactacaccacagggagatagtgctgatgagaagtccaagaaaggctggggcgaagacgaacctgacgaggagtcccatactccgttgccacctccaatgaagatcttcgataacgatcccacccaagacgagatgtcgtcatctttgcttgcggctcgccaggcctccactgaagtgccgacagccgctgatctggtcaatgcaatcgagaaactggtgaaaaacaaactgtctctagagggttcaagctatcgtggatcattgaaggatcctgccggttgcttaaacgagggaatggcaccccctactccacctaaaaatccagaagaggagcagaaggccaaagccctgcgcggtcggatgtttgtacttaacgagctggtccaaaccgagaaggattacgtcaaagacttgggaattgtcgtggaagggtttatgaaaaggattgaggaaaaaggggtccctgaagatatgcgaggcaaggacaagatagtcttcggcaacattcaccaaatctatgactggcacaaagatttcttcctggccgagcttgagaaatgtatacaggaacaggacagactggcccagctgttcatcaagcacgagcgcaagttgcatatctacgtctggtattgtcaaaacaagcctaggtctgaatatatagtggctgagtacgacgcctactttgaggaggtgaagcaagagattaaccagcgcctcactctctcagactttcttatcaaacccattcagcgcatcaccaaatatcagctcttgctaaaagattttctgcgatactccgaaaaggctggcttggagtgtagcgatattgagaaagccgtcgagctgatgtgtctggtgcccaaaagatgtaatgatatgatgaacctcggcagactgcagggcttcgaaggtaccctcactgcccaaggcaagctgctccaacaagatacattttacgtcatcgagctggacgccggtatgcagagcaggaccaaagaacggagggtttttcttttcgagcagattgtaatcttcagcgagctcttgagaaagggcagcttgacacctggctatatgtttaagcggtccattaagatgaattatcttgtcctggaggaaaacgtcgacaacgacccatgcaagtttgccctcatgaatcgagagacatctgaaagggttgtgctccaggctgcaaacgccgacatccagcaggcttgggtgcaggatataaaccaggtcctcgaaacacagagggattttcttaatgcacttcagtctccaatagaatatcagaggaaggaaagatctacagccgtaatgcggtcacagcctgctcgtcttccacaggccagcccccgaccctatagttcggtgccagctggctccgaaaagccacctaaaggcagctcttacaacccacccctgccccctctcaagatatcaacttctaatggcagccccggtttcgagtatcaccagccaggggacaaattcgaggctagcaaacagaatgaccttggtggctgtaacggcactagttctatggccgtcatcaaagactactatgcccttaaggagaacgagatctgcgtgtcgcaaggagaagtcgtgcaggttcttgcagtcaaccagcagaatatgtgtttggtgtatcagcccgcatctgaccattctcctgccgctgagggctgggttcccggttcaatcctggctcccctcacgaaggcgaccgcagcagaatcttctgatggctcaattaaaaaatcctgcagctggcacactctgaggatgcggaaaagagctgaggtcgagaacaccggaaagaacgaagcgaccggacctcgcaaacccaaggacatccttgggaacaaggtgtcagtgaaggagactaactctagcgaggagagcgaatgcgacgatctggatccaaatacctcgatggagattctgaatccgaactttatacaggaggtggcaccagagttcctcgtccccctggtggatgtcacatgtctcctgggcgatactgtgatcctgcagtgtaaggtatgcggccgtccgaagcccactatcacctggaagggccctgatcaaaatatactggataccgacaattcaagcgccacatacacagtgtcctcgtgcgactcaggcgagataaccctcaagatttgcaaccttatgccccaggactcaggaatatacacctgtatcgccactaatgatcacgggacaacttcaaccagtgccaccgttaaagtgcagggcgtgcccgctgccccaaatagaccaattgcccaggaacgctcctgcacttcagttatcctgaggtggctaccacctagtagcacaggcaattgcacaattagtggatatactgtggaatacagagaggagggatctcagatctggcaacagagcgtagccagcacacttgacacgtaccttgtcattgaggacctgtcccccggttgtccttaccagtttcgtgtctcggcgtcaaatccttggggcattagcctaccgtccgaaccttcggaatttgtcaggctacctgaatatgatgcagctgcagacggagctaccatctcatggaaagaaaattttgacagtgcctacacggagctaaacgaaattggacggggacgattctctattgtgaagaaatgtattcacaaagctacacggaaagatgtcgctgttaagttcgtcagcaagaagatgaagaagaaggaacaggccgctcatgaggccgcactgcttcagcacctgcaacatcctcagtatatcacgctacacgacacctacgaatcccccacttcgtatatcctgatattggaactgatggacgacggacgattgctcgactatttgatgaatcacgacgagttgatggaagaaaaagtagcgttctacatcagggacattatggaggctcttcagtatcttcacaattgccgagtggctcacctcgatatcaagccagaaaacctcttgattgacctgcggatccctgtgcccagggtgaagctgatcgatttagaggacgctgtgcagatcagcggccattttcatatacaccatttgctcggtaatcccgaatttgctgccccagaagtcatccagggcatccctgtctccttagggactgatatttggtcaataggagtgcttacctatgtaatgttgagcggagtgagcccatttttggacgagtccaaggaggaaacttgcataaacgtgtgtcgcgtagacttttccttcccgcatgaatacttttgcggggtgagtaatgccgcaagagactttatcaatgttattttgcaggaggatttcagacggcgacccaccgctgccacgtgcttacagcacccatggctccagccacataatggctcgtacagtaagatacccctcgacacttccagactggcctgctttatcgagagacgaaagcaccagaacgacgtcagacccataccaaatgtaaagagctacattgtgaatagagtgaatcagggtacctag

SEQ ID NO: 227517 - DNA, 8960 bp, Artificial Sequence
  Description of Artificial Sequence: Synthetic coding sequence
atgactgaccgattttgggatcagtggtatctttggtatttgaggctgctaaggctgctggatagaggcagctttcgtaacgatggcttgaaggcatcagatgtcctgccaatcctgaaggaaaaggtcgccttcgtgtccggcggtcgggacaagcgagggggtcctatactcacattccccgctcggtccaatcacgatcgtattcgacaggaagacctcaggaaactggtgacttacctggcttcagtgccatcggaggacgtgtgcaaacggggattcaccgtgattattgatatgaggggctccaaatgggacctgattaagcccctgctcaaaaccctccaggaggcattcccagcagagattcatgtggcgctgataatcaagcccgataatttttggcagaaacaaaagactaactttggctctagtaagttcattttcgagacatctatggtgagtgtggagggcttgacaaagctggtagacccgtctcaactgaccgaggaattcgacggctctttagattacaatcacgaggaatggattgagcttcgtttgtcattggaagagttcttcaattcagcagtgcatctgttgtctcgcctcgaagatctccaggaaatgttagcccgaaaggaattccctgtggatgtagaaggctctcgacgactgatcgacgagcacacacagctgaaaaagaaggtccttaaagcacctgtggaagaattggaccgggagggccaaagactgctgcagtgtatccggtgcagcgatgggttttccgggagaaactgcatccccggaagcgccgactttcagtccctggtgcctaaaataaccagcctgctcgacaagctgcacagcactcgacagcaccttcatcagatgtggcatgtaaggaagctgaagctggatcagtgttttcagctgaggctgtttgagcaagatgccgagaaaatgtttgattggatcagtcacaataaagagctttttctacagtctcatactgagataggtgtgtcttatcagtacgcgctcgatttgcagacgcagcacaaccactttgccatgaatagtatgaacgcctacgtcaacatcaatagaattatgtccgtggcttctcggctctctgaggcagggcattatgctagccagcagatcaagcagatttctactcaactggaccaggaatggaagagttttgccgctgctctggacgaaagatcaaccatcctcgctatgagtgccgttttccaccaaaaggccgagcagtttctgtccggagtagatgcctggtgcaagatgtgtagtgaaggtggacttcccagcgagatgcaggatctcgagctggctatccatcatcatcagacactgtacgagcaggtgacacaggcctacacagaagtatctcaggacgggaaggcattgctagacgtgctccaacgcccactgagtcccggtaacagtgagagcttgaccgccacggctaattactccaaggccgttcaccaggttctggatgttgtgcatgaagtgctccaccaccaacgtaggttggagtcgatctggcagcatcggaaagtgcgtctgcaccagcggctgcagctgtgtgtcttccagcaggacgtgcaacaagtgctggattggatagagaatcacggcgaagcgtttttatccaaacatactggagtggggaaatccctccaccgagcacgagccctacagaaaaggcacgatgacttcgaagaagtggctcagaacacctacaccaacgcggacaagctgttagaggcagccgaacaactggcacagaccggcgagtgcgacccagaggaaatctacaaagctgcacggcatctggaagttaggatacaggatttcgttcgtagggtggagcagcggaagctcctgctggacatgtctgtgtcctttcacacccacacaaaggaactgtggacttggatggaggatcttcagaaggagatgttagaggacgtctgcgcagacagtgtcgatgctgtgcaggagttgattaagcagtttcaacagcagcagactgccacactggacgccactctcaacgtgatcaaggagggcgaggatctcattcagcagctgaggtcagctccaccatcactgggggaaccctcagaggctagggattcggccgtgtctaacaacaagacgcctcactcctcttccatctcacacattgagtcagtcctgcaacaactagatgacgctcaagtacagatggaggaactttttcacgaacggaagataaagctggacatttttctacagctacgcatctttgagcagtacactatagaagtgaccgccgaactcgatgcctggaatgaagatctgctacgtcaaatgaatgattttaataccgaagatttaaccctggctgagcaaagactccaacggcacactgagcgcaagctagctatgaacaatatgactttcgaggttatacagcaaggacaggacctgcatcaatacattacagaagtccaagcctctggcatcgagctgatttgtgagaaggacattgacctcgctgcccaagtgcaagaattgctggagttcttgcatgagaaacagcacgagctggagttgaacgcagagcagactcataagcgcctggaacaatgtctgcagttgcggcatctccaggccgaagtgaaacaggtgctggggtggattagaaacggtgagtccatgctgaatgcctccctggtcaatgcttcgtcattgtctgaggcagaacaacttcaacgggaacacgagcaattccaactggccatcgagagcctattccacgccacttccctacaaaaaacccaccaatcagctcttcaagttcagcagaaggccgaagtgctgttacaggccggtcactacgacgcagatgctatccgcgaatgcgcagagaaagttgcgcttcattggcagcaactgatgcttaagatggaagataggcttaagctcgtgaacgccagcgttgccttctacaagactagcgagcaagtatgttcagttttggagtcgctcgaacaggaatatcgcagagacgaggattggtgtggcggacgggataagctgggtccagcagctgagatagatcatgtcattcctcttatttccaagcatttggaacaaaaagaggccttccttaaagcatgcacattagctcgacgaaacgccgaagtgttcctgaaatacatacatcgcaacaacgttagtatgccctcagttgccagccataccagaggaccagagcagcaggtgaaggcaattctgtctgagctgctgcagagagaaaacagagttctacacttttggacgttgaagaaacgcagactggatcagtgtcagcaatacgtggtcttcgagcgcagtgccaaacaagccctggattggattcaggaaactggcgagttctacctctctactcatacatctacgggcgagacaacagaggagacacaggagctgctgaaggaatacggagagtttcgcgtccccgctaagcagaccaaggagaaggtgaagctgttgatacagctggccgactcctttgtcgaaaagggccatatccatgccaccgaaatacggaagtgggtcacaaccgttgacaaacattaccgagacttttctctgaggatgggcaagtaccgctactccctagagaaagcgttaggggtgaatacggaagacaacaaggatctggagctggacattattcctgcctcattgtcggatcgtgaagtcaagctgcgggatgcaaatcacgaggtcaacgaagagaaaagaaagagcgccagaaaaaaggagtttattatggccgagctactgcagactgagaaagcctatgtccgcgacctgcacgagtgcctggaaacctatctttgggaaatgacatccggggtggaggaaatccctcctggcatacttaacaaggaacacatcatcttcgggaatattcaggagatttatgattttcacaacaacatctttctgaaagagctagagaagtacgaacagttacccgaagatgtggggcactgctttgttacttgggccgacaaattccagatgtacgtgacctattgcaagaataagccggattccaatcaactgatccttgaacatgcaggcacctttttcgatgaaattcaacagcggcacggactggcgaatagcatttctagctacctcatcaaacccgttcaaagaattacaaaatatcagctgctgctgaaggagctgctgacatgttgtgaagaaggaaaaggggaattaaaggatggcttagaagtcatgctgagcgttcctaagaaagccaacgatgccatgcacgtcagcatgctggaagggtttgatgaaaacctggacgtgcaaggcgaactgatcctgcaggatgcattccaagtttgggacccaaagtctcttataaggaaaggaagggaaaggcatttgttcctctttgagattagtctggtcttcagtaaagagatcaaagactcttcaggacatactaagtacgtgtacaaaaataagctgcttacaagcgaactgggggtgactgaacacgtagagggtgacccatgtaaatttgccctttggtctggacgtacccccagctctgacaacaagaccgtcctgaaagcctctaacatagaaacgaagcaggagtggatcaagaatattagagaggttatccaggagcgtatcatccatctgaaaggtgcattgaaagagccactacaattaccgaaaactccggctaaacagcgtaataacagcaagcgtgatggagtcgaagacatagactctcagggtgacggtagctcacaacctgatactattagcatcgcgtcaagaacaagccagaataccgtagattccgataagctgagtggcggatgcgagcttactgttgttctgcaagattttagcgctggacactctagtgagcttacgatccaggtgggtcagactgtagagctgctcgaacgtccctctgaacgacctgggtggtgcctagttcggactactgagcggtcccccccacttgaggggctggtgcctagctcagccctgtgcatctctcactcacgatctagcgtggagatggactgtttctttccccttgtcaaggatgcctacagccacagctcatcagagaacggaggaaaatctgaatctgttgctaatcttcaggcccagcccagtcttaattccatacactcctctcctgggccaaaaagaagcaccaatacactcaagaagtggctgacaagtcctgttcgacggttaaacagcggcaaggcagacggcaacataaagaagcagaagaaagtaagggacgggcgaaagagctttgatttgggctctcccaaaccaggtgatgaaaccacaccgcagggtgattcagccgatgagaaatccaaaaagggatggggtgaggacgaaccagacgaggaaagtcacacccccttgcctcctcccatgaagatctttgacaatgatcccacacaggacgaaatgagctccagcttgctggcggctagacaggccagcacagaagtgcccacagcggcagacctcgttaatgcaatcgaaaaacttgttaaaaacaagctgtccttggaaggaagtagttatcgcggaagccttaaggaccctgctggctgcctgaatgagggtatggctcccccaaccccaccaaaaaatcctgaagaggagcagaaagctaaggccctgcgtgggcgaatgttcgtcctgaacgaactggtgcagacggaaaaagattacgtgaaagacttgggaatagttgttgagggctttatgaagcggatcgaggagaagggtgtgcccgaggacatgcggggaaaagacaagatagtgttcggaaacatccatcaaatctacgattggcacaaggattttttcctcgccgaactcgaaaagtgcattcaagagcaagacaggttggctcagctctttattaaacacgagaggaaacttcacatatacgtatggtactgtcagaataagccccgatcagagtatatagtcgccgagtacgatgcatatttcgaggaagttaaacaggaaattaatcagcggctcactctctccgacttccttatcaagccgatccaacgcataacaaaatatcagctgctgctaaaggatttcctgcgctattctgagaaagcaggactggagtgttcggacatcgagaaggcagtcgaactgatgtgtcttgtaccaaagcggtgtaacgacatgatgaatcttggcagactccagggctttgagggcaccctgacagcccagggaaaactgctgcagcaggatacattttacgtaatagaactcgacgccggaatgcagagcaggaccaaagagcgcagggtttttctgtttgagcagatagtcatcttctctgagctcctacgcaagggttcactgactcctggctacatgttcaagcgatctattaaaatgaattatctcgtccttgaggaaaatgtcgataatgatccctgcaagttcgctctcatgaatagagagaccagcgaaagggtggttctgcaagccgctaacgctgatatccaacaggcctgggtccaagatatcaatcaggtgcttgagacccagcgtgactttctaaatgccttgcaaagtcccattgaatatcagcgcaaggagagatctacggctgtgatgagatcccagcccgcaaggctgccacaagcctctcccagaccttacagctccgtgcctgcgggaagtgaaaaacctccaaaggggtcctcatacaatccgcctcttcccccattaaagatcagcacctctaacggcagcccgggattcgaatatcaccagcctggtgataagttcgaagcatcaaagcaaaatgatttaggcggatgcaatggaacctccagcatggccgtgattaaggattattacgctctgaaagagaatgaaatttgcgtgtcccagggggaggtggttcaggttttagcagttaaccaacagaacatgtgtctcgtttatcaacccgcttcagaccattctcctgcagccgagggttgggtacctggatctatcttagctcccctcacaaaggccacagctgccgagtctagcgatggatcgataaaaaagtcttgcagctggcacaccctcaggatgcggaaaagagccgaagtggagaacactggaaaaaatgaagctactggccctcgcaagcccaaggacatcctgggcaacaaagtcagtgtaaaagaaacaaacagctccgaggaaagcgagtgtgatgacctcgacccaaacacatcaatggaaatcctcaaccctaacttcattcaagaagtggctcccgagttcctggtccccttggtcgacgtgacttgcctgttgggagataccgtgattttacagtgtaaagtttgcggcaggcctaaaccaacgatcacttggaaaggcccagatcagaacatcctagacacggacaacagctccgcaacctacaccgtgtcttcttgtgattccggcgagattacactgaagatatgtaatcttatgccccaggactcaggtatctacacctgcatcgccacaaacgaccatggaaccaccagtacttctgccacagtcaaagtacagggagtccctgcagcaccgaacaggccaattgcacaggagcggagctgcacttcagtcatcctcagatggttaccgccatcgagtactggtaactgcactattagcggctacactgtggaataccgggaagagggctcacagatctggcagcagagcgttgcatccacacttgatacgtacctcgtgattgaagatctgtccccaggctgtccgtatcaatttcgtgtttctgcctccaacccatggggcatctcccttccctcagagccatcagagttcgttcggttgcctgaatatgacgccgctgcggacggggctacgatttcttggaaggagaactttgattccgcctacaccgaactcaatgagatcggaaggggcagattttccatagtcaagaaatgtatacataaagccaccaggaaagacgtggccgtaaaatttgtgtcaaaaaagatgaagaagaaagagcaggccgcacatgaggccgctctgctgcagcatctgcagcacccccagtatataaccctgcacgacacatacgaatctcccacgtcatacatccttatcctggaactcatggacgacgggcgactcctagactatttgatgaatcacgacgaactgatggaagaaaaggttgcattttacattagagacatcatggaagccctgcagtacctccacaactgccgcgtcgcccacctggatataaaacccgaaaatctgcttatagatttgcgcatcccagttccacgcgtgaagctgattgatctggaagatgctgtacagattagcggtcactttcacatccatcatctgctggggaaccccgagtttgcggctccggaagtcatccagggcatacccgtcagcctcggcacagatatttggtccatcggcgtcctaacgtacgtcatgctgagcggcgtctcaccattcctagacgaatctaaggaggagacgtgtatcaatgtttgtcgggtcgatttcagcttcccccacgaatatttttgcggggtatcgaatgccgctcgggacttcattaatgtgatccttcaagaagacttcagacgtcggcctacagcggctacatgccttcagcatccttggttgcagccgcataacggctcttattccaagattccacttgatacgagtagattggcttgttttattgagcggcgtaaacaccagaatgacgttcgcccaatccctaatgttaagagctacatagtgaaccgtgtcaaccagggtactta

SEQ ID NO: 227518 - DNA, 3774 bp, Artificial Sequence
  Description of Artificial Sequence: Synthetic coding sequence
atgaagggaggcgacagagcttatacccgcggaccctcacttggttggttattcgccaaatgctgctgttgcttcccatgcagagatgcatatagccatagtagctccgagaacggcggaaaaagcgagtccgtcgctaatttgcaggcccaacctagtcttaactctatccatagttcccccggacctaagcggtcaaccaataccctcaagaaatggctcacttcccctgttagacggctgaactccggaaaggcagatggaaatattaagaaacagaagaaagttcgagatggtcgaaagtccttcgatctaggcagccctaaaccaggcgacgaaactactccccaaggagacagtgcggacgaaaagtctaaaaagggctggggagaggacgaacccgacgaggagtcacatacccctctgcctccaccgatgaaaatcttcgataatgatccgactcaggacgaaatgtccctcgaaggttccagctatagaggaagccttaaggatccagcaggttgtttaaatgagggcatggccccacccacaccccctaagaatcctgaagaggaacagaaggctaaggccctccggggaaggatgttcgttttgaatgagttggttcagacggaaaaggactacgtcaaggacctgggcatcgttgtagaaggcttcatgaagcggatagaagagaaaggcgttcctgaggatatgaggggaaaggacaaaattgtgttcggcaacattcaccaaatttacgattggcataaggacttctttttggcagagctggagaagtgtattcaggaacaggacaggcttgctcaactgttcatcaaacacgaaagaaaattacacatttacgtctggtactgccagaacaagcctcgttccgagtatatcgtggcggaatacgacgcatatttcgaggaagttaaacaagaaattaaccagcgtctgaccctaagcgatttcctgatcaagccaattcagagaataacaaaatatcagttgctcctgaaggattttctgaggtactccgagaaggcaggcctggaatgttccgatatcgagaaagctgtggaactgatgtgcctggttcctaagcggtgcaacgacatgatgaatctggggcgacttcaggggtttgaaggcaccttgaccgctcagggaaagctgttgcagcaggatacattctacgtcatagagctcgacgcgggaatgcagagccgcacgaaagagcgacgagtctttctttttgaacagatcgtgattttcagtgagttgctgagaaagggtagtctgacacccggttacatgtttaagcgctctatcaaaatgaactacctggtgctggaagagaatgtagataacgatccatgcaagttcgcgctgatgaaccgagaaacatccgagcgcgtggtgctgcaagcggcaaacgcggacattcagcaggcgtgggtgcaggacattaatcaagtattagagacacagcgggatttcttaaatgccctgcaatcaccaattgagtatcagcggaaagagaggtctaccgctgtcatgcggtctcagcctgctcgtctacctcaggcatccccacgaccatactcgtcagtacccgcagggtcagagaaacctcccaaaggttctagttataacccaccccttcccccacttaaaatctcaaccagcaacggcagtcccggatttgaatatcaccagcccggagacaagtttgaggctagtaagcaaaatgatctggggggttgtaacgggacgtcctctatggctgtgataaaagactactacgccctcaaagagaatgaaatctgcgtttctcagggcgaggtggtccaggtgctggcagtgaaccagcaaaacatgtgtctcgtgtatcaaccggcatcagatcacagtcctgcagccgagggatgggtgcccggatccatattagcccctctgactaaagctaccgcagccgaatcatctgatggtagtatcaaaaaaagctgttcctggcacacactgcggatgagaaaaagagcagaagtggagaacactggcaaaaatgaggccacagggccacggaagcctaaagacatccttggaaacaaggtaagcgttaaagaaactaattcttcagaagagtccgagtgtgacgacctcgatccaaataccagcatggaaattctcaaccctaatttcatccaggaagtcgcgccagagtttctggtgcctctcgtggacgtgacatgcctgctaggcgacacagtcattctgcaatgcaaggtatgcggccgtcccaaacctaccatcacatggaaaggaccagatcagaacatcctcgacacggacaatagctctgccacttacacagtgtctagctgcgacagcggggagattaccttgaaaatttgcaacctgatgcctcaggactctggaatttacacctgtatagccaccaacgaccatggtactacgtctacatccgcgaccgtgaaagtgcagggcgtcccagcagctcccaatcgccctatcgcacaagagcggtcatgtacgtctgtcatccttaggtggctgcccccaagctccaccggcaattgcacaatctctgggtatacagtcgagtaccgagaagagggaagtcagatctggcagcaatctgttgcctccacactggatacctatctggtaatcgaagatttgtccccaggttgcccttatcaatttagggtgtccgcatcaaatccatggggaataagtctgccatcagaaccatccgagttcgtccgattgcccgaatacgacgctgccgcagatggagccaccatctcctggaaggagaattttgatagcgcgtacacagaactgaacgagatcgggagggggcgatttagcattgttaagaaatgtatccataaggcaacccgcaaggatgtcgctgtcaagtttgtgtcgaaaaaaatgaaaaagaaggaacaggcagcccacgaggccgcattgttacaacatctgcagcatcctcagtatatcaccttgcacgatacctacgagagtccaacaagttacatcctaatcctggagctaatggacgacggaaggctcttagactatctcatgaaccacgatgagctgatggaggagaaggtcgctttctacatccgggacatcatggaggctttgcaataccttcacaattgtcgggtggcccatctcgacatcaaaccagagaatctgcttattgacctgcgtataccagtgcccagggttaagctgatcgacctcgaggacgcagtgcagatcagcggtcacttccacatccatcatctgctgggcaatccagagtttgccgctcccgaggtgattcaaggaatcccagtgagcctcggcaccgatatctggagcattggtgtgctgacttacgttatgctttccggtgtaagccctttcctagatgaaagcaaggaagaaacatgcatcaacgtttgtcgggtggattttagcttccctcatgagtacttttgcggcgtgtctaatgctgccagagatttcataaacgtgatccttcaagaggactttcgcaggaggcccaccgccgcaacatgtctgcagcacccttggttgcaaccacacaatgggtcctacagcaagataccacttgacacctcccgcctcgcatgtttcatcgagcggcgtaaacaccagaatgatgttcggccaatcccgaacgtcaaatcttacattgtgaatcgcgtcaaccagggaacctag

SEQ ID NO: 227519 - DNA, 4964 bp, Artificial Sequence
  Description of Artificial Sequence: Synthetic coding sequence
atgacagaccgattctgggatcagtggtatctgtggtatctgaggcttctgagactgcttgacagggggagtttccgcaatgatggcttgaaggcatccgacgtgcttcccattttgaaagagaaggtcgccttcgtgagcgggggtcgagataagagaggagggcctattctcacatttcctgcgaggagcaatcacgataggatccgccaggaagatttgcgcaaactggtgacttatcttgcctccgtcccatcggaggacgtgtgcaaaaggggctttaccgtgattattgatatgcggggaagcaagtgggacctgatcaaaccactcctgaaaactttacaggaggcttttcccgcagaaatccatgtggctctgatcataaagcccgacaacttctggcagaaacagaaaactaacttcgggtcatctaagtttatctttgaaactagcatggtctccgttgaaggactgacgaagcttgtcgatccaagtcaattgacagaggagtttgacggctccctggactataatcacgaggaatggattgagctgcgactgagcctagaagagttctttaactccgctgtgcacttgctgtcgaggctggaggacctgcaagaaatgctagctcggaaagaattccctgttgatgttgagggatctcgccgtctaattgatgaacacacccagctaaaaaagaaggtcctgaaggcccctgtagaggagctcgacagggaggggcagagacttcttcaatgtattcgatgctccgatggattttcggggaggaactgcatccctgggtctgccgactttcagtccctggtcccgaaaatcacctccctgcttgacaaactgcattccactcgccaacatctccatcagatgtggcacgtgcggaagctcaagcttgatcagtgcttccagcttaggttgtttgagcaggatgccgagaagatgttcgactggatttctcataataaggagctgtttctacagtcacacactgaaatcggcgtctcctatcaatacgccctcgacctccagacacagcataaccatttcgcgatgaatagcatgaatgcctacgtgaatattaatcgcattatgtctgtggcaagccggctgtctgaggccggtcattatgcctcccagcagatcaaacagatatccacacaactggatcaagaatggaagtcattcgctgctgctctggacgagcggtcaacaatcctggcaatgagtgcggtatttcaccagaaggctgagcagtttctgtctggcgtcgatgcatggtgcaaaatgtgcagtgaggggggactgcccagtgagatgcaggatctggagctcgctatccatcatcaccagaccctctatgaacaggtcactcaggcatacaccgaagtatcccaggacggaaaagcactcctggatgtgctccagaggcccctctccccaggcaactcagaaagcttgactgctaccgctaactacagcaaggcggtgcaccaggttctggacgtggttcacgaggtcctgcaccaccaacggcgattggagagcatctggcagcacaggaaagtgcggcttcatcagagactacagctgtgcgtgttccagcaagacgtgcaacaggtgcttgattggatcgagaaccatggagaggcctttttgagtaagcatactggcgtgggaaaaagcctgcatcgtgcccgtgccctgcagaagaggcatgatgactttgaagaagtcgcacagaatacctacaccaatgctgacaaactcctggaagccgcagaacagctcgcccaaactggggagtgtgacccagaagagatatataaggccgcaagacacctggaggttaggattcaggactttgtcagacgagtggagcagaggaagcttctgctggatatgtcggtaagctttcacacacataccaaggagctgtggacatggatggaagacttgcagaaagagatgctggaggatgtgtgcgctgacagcgtagatgctgtgcaagagctgataaaacagttccaacagcaacagaccgcaacactggacgctaccctaaacgttataaaggaaggggaagaccttatccagcagctgagatccgctccgccaagcctgggggaacccagtgaggcacgggacagtgccgttagtaataataagacaccacactcatccagcatctcccatattgaatccgttttacagcagctggatgacgcccaggttcagatggaagaactattccatgagcgcaagattaaattagacatttttctgcagctgcggatcttcgaacagtataccatagaggtcacggccgaactagacgcttggaatgaggatctcctgcggcaaatgaatgatttcaatactgaagaccttacattagctgaacagaggcttcagcgacacactgagcgcaaactggcaatgaacaacatgacatttgaagttatccagcagggccaagacctgcatcagtatataactgaggtacaggcctctgggatcgagctcatctgcgaaaaggatatagatcttgcagcacaggtccaggagctgctcgagttcttgcatgaaaaacagcatgagctcgaactgaatgctgagcagactcacaaacggctagagcaatgcctgcagctcaggcatctccaagctgaggttaagcaggttctagggtggattaggaacggcgagagcatgctgaacgcttctctggtgaacgctagttccctatccgaggccgaacaactgcaaagggaacatgagcagttccagctggccatcgagaaaactcaccagtccgccctgcaggtgcagcagaaggccgaggtgctgctgcaggccggtcactacgatgccgacgctatcagagaatgtgccgagaaggttgcactgcactggcagcaacttatgcttaaaatggaggacaggctaaagctggtgaacgcatccgtggctttttacaagacaagtgaacaggtctgtagcgtgctcgagagcttggagcaggagtaccggagagatgaagactggtgtggcggacgcgataaactcggcccagctgcagagatagatcatgtcattccactcattagcaaacacctggagcaaaaagaagcgttcttgaaggcttgcaccctcgcaagacgaaatgcggaagtttttttgaaatacatccaccgcaataatgtgtccatgccttcggtggcctctcacacccggggtcctgagcagcaggtgaaagccatcttatctgaactgctgcaaagggagaatcgtgtgcttcacttttggaccttgaagaagcgaagacttgaccagtgccagcagtacgtggtcttcgaacggtctgcaaagcaagctctggactggatacaggaaaccggtgagttttacctgagtacgcacacatcaacaggagagaccactgaagagacacaggagctgctcaaggagtacggagaatttcgggtcccagctaaacagactaaagaaaaagtgaagctgcttatccagcttgccgactcgttcgtggagaaagggcatatacatgctactgagattcgcaaatgggtgacgactgtggacaagcactacagagatttctccctaaggatgggaaaatatcgctatagcctggagaaggccctgggggtgaacaccgaagacaacaaggacctagagcttgacatcatcccagcgtccctcagcgaccgagaagtaaaactgagggacgcaaatcatgaagttaacgaggaaaagcgcaaatctgccagaaagaaagaatttattatggcagaactgctgcaaacagagaaagcctacgttagggatctccatgagtgtctggagacctatctttgggagatgacgtccggcgtggaagaaattccacctggaatcctcaataaggagcacatcatctttggtaatatccaggagatatatgacttccacaacaacattttcctcaaagaactggagaagtacgagcagctccccgaggacgtcgggcactgctttgtgacctgggctgacaagttccagatgtacgtcacgtattgcaagaacaagcccgattccaatcagctgatcctggaacatgcaggaacattttttgatgagattcagcagagacatggactagctaactctattagcagttacctcattaaaccggtccagcgtatcacaaagtaccaactgctgctcaaggagctcctgacatgttgcgaggaaggaaagggagaactaaaagatgggctcgaggtgatgctctccgtaccaaaaaaagccaacgatgccatgcacgtaagcatgctggagggatttgacgagaaccttgatgtgcagggtgaacttatcttgcaggacgccttccaggtgtgggaccccaagagcttgataagaaaaggtagggagaggcatctgtttctgtttgagatctcccttgtgtttagcaaggaaatcaaggactcctccgggcacacaaaatatgtatataaaaataaactgcttacctcagagctgggggtgactgagcacgtggaaggagatccctgtaagttcgccctgtggagcgggagaacaccatcctctgataacaagacagtcttgaaggcctccaatatcgaaacaaaacaggaatggatcaagaatattagggaagtcattcaagagaggataatccacctgaaaggcgcactgaaagagcccttgcaattgcccaagacaccggcaaagcaaagaaataattctaagcgcgacggcgtggaggatatcgacagccagggagacgggagttcgcagccagacactatctctattgcctctcgaacctcccaaaataccgttgattcagacaaggacgggaatctggtaccacgatggcacctggggccaggagacccctttagcacttatgtcta

SEQ ID NO: 227520 - DNA, 789 bp, Artificial Sequence
  Description of Artificial Sequence: Synthetic coding sequence
atgtggtttctggttctgtgtctagctctgtccttaggcggaaccggagccgctccacctattcagagtcgaatagtgggcggatgggaatgtgagcaacactcacagccttggcaggccgcattgtatcacttctccactttccagtgcggtgggattctcgtgcatagacagtgggtcctgaccgccgctcattgcatttcagataactaccagttgtggctgggaaggcacaacctcttcgacgatgaaaacacggcgcagttcgtccacgtgtcagagagttttccacacccaggatttaacatgtctctgctggaaaatcatacacgccaggccgacgaagattactcacatgatttgatgcttttgcgcctgacggagcctgccgataccattacggacgcagtgaaggtagtcgaactcccaacggaggaacccgaggtcggttcgacctgcctggctagtggatggggctcgatcgaacccgagaatttctcatttcccgacgacctgcagtgtgtggatctgaagatcttgccgaacgatgagtgtaagaaggctcatgtacagaaggtcactgattttatgttgtgtgtaggccacctcgagggtggaaaagacacctgcgtgggggactctgggggtcctctgatgtgcgatggggtactgcagggggtaacaagttggggatatgtcccttgtggaactccgaacaagcccagtgtggccgtccgggttctgtcctacgttaaatggattgaggatactattgccgaaaattcttag

SEQ ID NO: 227521 - DNA, 483 bp, Artificial Sequence
  Description of Artificial Sequence: Synthetic coding sequence
atgtccctccttgagaatcacaccagacaggctgacgaagactattcccacgatttaatgctgctacgcttgacagagcctgctgacaccatcacagatgctgtgaaggtggttgagctgccaactgaagagcccgaggtcggcagcacctgtttagcgtcaggatggggttccatagaacccgagaacttcagttttccggacgacttgcaatgcgtggacttgaaaattcttcctaacgacgaatgcaagaaggcacacgttcagaaggtgactgatttcatgctgtgcgttggtcaccttgagggaggcaaagatacctgcgttggcgattccggaggccctctgatgtgcgacggcgtgctccagggggttacttcatggggctatgtgccttgcgggacgccgaacaagccaagtgttgctgtacgggtgctgagttacgtcaagtggatcgaggatacaattgccgaaaactcctag

SEQ ID NO: 227522 - DNA, 1917 bp, Artificial Sequence
  Description of Artificial Sequence: Synthetic coding sequence
atgatcctattcaaacaggccacctactttatttcactgttcgccaccgttagctgtggctgcctaacccagttatacgaaaacgctttcttccgcggtggtgatgtggcctctatgtacacccccaatgcacagtattgccaaatgcgctgtacatttcatccaaggtgcctgttgttttcttttctgccggctagcagtatcaacgatatggaaaagcgctttggatgctttctgaaggacagcgtgacaggcacccttcccaaagtgcacagaacgggggctgtgtctggacactctctgaaacagtgcgggcaccagatctccgcctgtcaccgggatatctataaaggtgtcgacatgcgtggcgttaattttaacgtttctaaagtttcctctgtggaggaatgccagaaacggtgtactagcaacatacggtgtcaatttttttcatacgccacgcaaacgttccataaagcagagtaccgtaacaactgtctgctgaagtactctccaggcggaacaccaaccgctattaaagtattgtctaacgtcgagagcggcttctccctgaagccatgcgccttgtcagagatcgggtgccacatgaatatatttcagcatttagcattttctgacgtggacgtcgctagagtactcacaccagatgcctttgtgtgtcgaactatctgcacttatcacccaaattgtctgtttttcaccttttataccaatgtttggaaaatagaaagccagcgcaatgtttgtctgcttaagactagcgagtctggcactccatcatctagcactccccaagagaacacaatcagcggctatagcctcctgacctgtaagaggacactgcccgaaccatgccattccaaaatctatcctggtgtagacttcgggggagaagaactgaatgtaacgttcgtcaagggagtcaacgtctgtcaggagacctgtacgaagatgatcagatgtcaattcttcacgtacagcctacttcctgaagattgcaaagaggagaagtgtaagtgcttcctgcggctgtccatggatgggtcacctacaagaattgcttatggaacccaagggtcctccggctactctctgcgactgtgcaatacaggcgataatagcgtatgcaccaccaaaacctccactcgtatagtggggggaactaattcttcctggggggagtggccctggcaggttagcctacaggtgaaattaacagcacagaggcatttatgcggaggtagcctcattggacaccagtgggtgctgacagccgctcactgttttgatgggcttcccctgcaggacgtttggaggatctattcagggatcctgaatctctctgacataacaaaggacaccccattctcccaaattaaggagatcattatacaccagaactacaaagtgagcgagggcaaccacgacattgccttaattaaactgcaggcccctctgaactatactgagttccagaagcctatttgcctcccatctaagggagacacaagcaccatttacaccaattgctgggtgacaggctggggattctccaaagagaaaggggagatccagaatatcttacagaaagtgaatatccccctggttacgaacgaggagtgccaaaagcgctaccaggattataagatcacccaacgtatggtttgcgccggatacaaagaaggcggaaaggatgcttgtaagggggatagcgggggaccgcttgtttgcaaacacaacgggatgtggagactcgtgggcattacttcctggggcgagggatgtgcacgccgtgaacagcctggcgtctacacaaaggtggccgagtatatggactggattttggagaaaactcagagcagcgatggaaaagcccagatgcagtctcccgcttag

SEQ ID NO: 227523 - DNA, 1545 bp, Artificial Sequence
  Description of Artificial Sequence: Synthetic coding sequence
atgtatacaccgaacgctcaatactgccagatgcggtgtacattccaccctaggtgtcttctattttcctttttgccggctagctcaatcaatgacatggaaaagcgcttcgggtgcttcctgaaggattctgtgaccgggaccttacctaaggtacaccggactggtgcagttagcggtcactccctgaagcagtgcggacaccagatcagcgcctgccatagggacatttataagggtgtcgatatgaggggcgtaaattttaatgtgtcaaaggtgtcttcagtcgaagaatgtcagaagaggtgcacctccaatattaggtgccaatttttttcgtacgccacacagactttccacaaggctgaatacaggaacaactgcttactgaagtactcgcccggtggcactcctacagccataaaggtcctttccaacgtcgaaagtggcttcagtctaaagccttgcgccctttcagagatcggctgtcacatgaatatctttcagcatctcgctttttcagatgtcgatgtcgccagagtattgacaccagatgcctttgtgtgccgaacaatttgtacgtatcacccaaattgcttgttcttcacgttctataccaacgtctggaaaatcgagtcacagcgaaacgtttgtctgctcaagaccagcgaatctggtactccgagctccagcactccccaggagaacactatatccggttactccctactcacttgcaaaaggactctgcccgaaccatgtcacagcaagatttatccgggagtcgattttggcggagaggagttgaacgtcactttcgtgaagggcgtgaacgtttgccaggagacctgtactaagatgattaggtgtcaattctttacgtactcgctacttcctgaagattgcaaggaagagaagtgtaagtgttttctgcgtctgagtatggacgggtctccaactcgaatcgcgtatggcactcagggaagctccggttacagccttcggctgtgtaacactggcgataacagcgtgtgtaccaccaagacgtccacccgcattgtcggcggaactaactcatcatggggggagtggccatggcaggtatcattacaggttaaacttaccgcacagagacatctttgtggtggtagtctcatcgggcatcaatgggtgctcactgccgcacactgttttgacgggcttcctttacaggacgtgtggaggatttactccggtatactgaacctctcggacattactaaggatacaccgttttcccagattaaagaaatcatcatccaccagaactacaaggtatcagagggaaaccacgacatagcgctgattaagctgcaggcacctcttaactacacagagttccagaagccaatttgcctgccatctaagggcgatacaagcacaatatacactaattgttgggtaacggggtggggattctcgaaagagaaggggcgattccgatggtctctatccctccagacccaatggaacgttgctttcggcggtcaccaccagttgggttag

SEQ ID NO: 227524 - DNA, 447 bp, Artificial Sequence
  Description of Artificial Sequence: Synthetic coding sequence
atgattctcttcaagcaggcaacatattttatctcactctttgccaccgtaagctgcggctgcctgactcagctgtacgagaatgcctttttcaggggcggagacgtcgctagcatgtatacgcccaacgctcagtattgccagatgagatgcacatttcaccccagatgcctcttgttttcctttttaccggcaagtagcattaacgacatggagaagcgcttcggctgtttcctgaaggacagcgtgacagggacgctgcccaaggtgcataggacaggggctgtctctggccattcactgaaacagtgtggccatcaaatctccgcatgccacagagatatctacaaaggggtggacatgaggggcgtgaattttaatgtctcaaaggtgtcatcggtagaagagtgccagaaacgctgtacatctaacatccgctgtcagtag

SEQ ID NO: 227525 - DNA, 753 bp, Artificial Sequence
  Description of Artificial Sequence: Synthetic coding sequence
atgcggattctgcagctgattcttctagctctggcaacaggcctcgtcggtggggagaccaggattatcaaagggttcgagtgcaagcctcattcacagccatggcaggcggcactcttcgaaaagacccgtctgttgtgtggcgctacactcatagctccacggtggcttctgaccgccgctcactgtctcaagccacgttatatcgtccacctgggccaacataatttgcagaaagaagaaggatgcgagcagacccgcactgccaccgagtcttttccccatcccggattcaacaactccctgcctaacaaggaccatcgcaacgacatcatgctggtgaagatggcttctccggtgtccattacttgggccgtccggcctctaaccctctcaagtcggtgtgtcactgccggaaccagctgcctgatctctggctggggaagtacatcttctccacagctgcgactgccccatactctgagatgtgccaacattacgattatcgagcaccaaaagtgtgaaaatgcttatccaggcaacataaccgacaccatggtatgcgccagtgtacaggaaggagggaaagactcatgccagggggattctgggggacccctggtgtgcaatcagtcccttcaggggatcatatcatgggggcaggacccttgcgcaattacccgcaaacccggagtatacaccaaagtgtgcaagtatgtggattggattcaggagactatgaaaaacaactag

SEQ ID NO: 227526 - DNA, 849 bp, Artificial Sequence
  Description of Artificial Sequence: Synthetic coding sequence
atgcaacgactgagatggttacgcgactggaaaagttcgggcaggggtcttactgccgcaaaagaacccggagccaggagcagtccccttcaggccatgcgaatattgcaactgatcttgctggcgttagccactggcctggtggggggagaaacaagaatcataaaggggtttgagtgcaagccacacagccagccatggcaggccgctctgttcgagaagacacgtctgctgtgtggtgcaaccttgatcgccccacggtggctattgaccgctgcccattgcctgaagccacggtacattgtgcacctcggccagcacaatcttcaaaaggaagagggctgtgaacaaacgcggaccgctactgagtcttttcctcaccccggttttaacaactccctgccaaacaaggaccacaggaacgatattatgctggtcaaaatggcctcccccgtaagtataacctgggccgtccggcctctgacattgtcgagtagatgcgtgacagctgggactagctgtctgattagcggctggggatcgaccagctcaccgcagctaagattaccccacactcttagatgcgcgaatatcacgataattgaacatcagaagtgcgaaaacgcttaccccggaaacatcaccgacactatggtgtgtgcgtccgtgcaggaggggggaaaggattcttgtcagggggacagcggaggtccactagtgtgcaaccaatcactgcagggcatcattagctggggtcaggacccttgcgccatcacccgaaaaccaggcgtctatacgaaggtgtgcaaatacgttgattggatacaggaaaccatgaaaaataattag

SEQ ID NO: 227527 - DNA, 828 bp, Artificial Sequence
  Description of Artificial Sequence: Synthetic coding sequence
atgagaatcctgcagcttatcctgttggccctcgcaactggactggttgggggagagacacgaattattaaaggcttcgagtgcaagcctcactcacaaccctggcaggcagccctgtttgaaaaaacacgcctgctgtgcggagccacccttattgcaccccgatggttattgacagctgcacactgcctgaaaccttgggttagtctgacatccccaacacacgtgtccccagacttgtcctcctcaaattattgcctctcccatttgtctagatatatcgtgcatctgggacagcacaatctgcagaaggaagaggggtgcgaacagacgaggacagcaaccgagagctttccccatcccggattcaacaattcacttcctaacaaggaccataggaatgacatcatgcttgtgaaaatggctagccctgtcagcatcacatgggccgtcaggcccttaaccctcagctcaagatgcgtgaccgccggtacatcatgtttgatttctggttggggaagtaccagcagcccacagttaagattgccacatactttaaggtgcgccaacattactatcatcgaacatcagaaatgtgaaaatgcctatccaggcaacatcaccgacaccatggtctgtgctagcgtacaggaaggcggtaaggactcctgccaaggtgacagtggaggccctctggtctgcaatcagagcttgcaaggaatcattagctgggggcaggacccttgcgctatcactagaaaacccggagtgtataccaaagtttgcaagtacgtggattggatccaggagactatgaaaaacaactag

SEQ ID NO: 227528 - DNA, 753 bp, Artificial Sequence
  Description of Artificial Sequence: Synthetic coding sequence
atgcgaatccttcaactgatcctactggctctcgctacaggacttgtgggcggagagacccggatcatcaaaggcttcgaatgcaagccacatagccagccctggcaagccgcattgttcgagaagacgagacttctgtgcggcgcaacactcattgcaccacgttggttactgacagcagctcactgccttaagcccagatacatcgtccacttggggcagcacaacctccagaaggaggaggggtgtgagcagaccaggaccgccaccgagtcatttccccatccgggattcaacaacagcctgccaaacaaagatcaccgaaacgacatcatgctggtcaaaatggcctcccccgtgtcaatcacatgggccgtgcgacctctgaccttgtcatcccggtgcgtcactgctgggacatcttgcctgatttccgggtggggaagcacctcgtccccacagctgcgattaccccatactctgcgatgtgcaaacattacaataatcgagcatcaaaaatgcgagaatgcctaccctggaaacatcacggatacaatggtttgcgctagcgtgcaggaaggtggcaaagattcgtgccaaggagactctggtggccctctcgtgtgcaaccagagcttgcaaggcattatttcctggggccaggacccatgtgcgataaccaggaagcctggagtgtacacaaaagtgtgtaaatatgttgattggatccaggaaacaatgaaaaacaattag

SEQ ID NO: 227529 - DNA, 849 bp, Artificial Sequence
  Description of Artificial Sequence: Synthetic coding sequence
atgcaaaggctgaggtggctgcgggattggaaatcttccgggagggggttgaccgcagctaaagagcccggtgcccgatcgagccctctccaggcaatgaggatcctgcagctaattctcttagcgctggctactggactggttgggggtgagacacgcatcattaaggggtttgaatgcaagccacacagtcaaccatggcaggccgctttatttgagaagacgaggctcctctgtggcgctacattaatcgcacctcgctggcttctcactgccgctcactgcttgaaaccaagatatattgtgcatctgggacagcacaatctacagaaggaggaaggctgcgagcaaacccgtacggccacagagtccttcccccaccctgggttcaataattctctcccaaacaaggaccaccgcaacgatatcatgctggtcaaaatggccagccccgtgagcattacctgggcggtgcgtcccttgaccctttcttctcgctgcgtaaccgcgggtacaagctgcctgatttctgggtggggatcaacgtctagccctcaattacggctgccacacacattgagatgtgcaaatattacaatcattgaacaccaaaaatgtgagaatgcctatccaggtaatatcaccgataccatggtttgtgcctccgttcaggagggaggcaaggactcatgtcagggggattcaggaggccctctggtgtgcaaccagtccttgcagggcatcatttcctgggggcaagacccatgtgccattacccgcaaacccggtgtatacactaaagtttgcaaatacgtcgattggattcaggagacgatgaagaacaactag

SEQ ID NO: 227530 - DNA, 765 bp, Artificial Sequence
  Description of Artificial Sequence: Synthetic coding sequence
atggggttatcgatctttcttctcctttgtgtgcttggtctgagccaagcagccaccccaaagatcttcaacggcacagaatgcggccgaaactctcagccatggcaagttgggctgtttgagggcacatcactgcgttgcggtggtgtcctgatcgaccaccgttgggttttgactgcggcacattgttcgggcagccgatattgggttcgcctgggcgagcacagcctgtctcagttggattggactgaacagatccgccattcagggttctcggtgacccacccgggttatctcggtgccagtacctcccacgagcacgatctgagactgctgagactgagactgccagttcgcgtcacaagctccgttcagcctctgccgcttcccaatgattgtgccactgccggaactgagtgtcacgttagcggctggggtattaccaaccaccctaggaaccccttccccgacttgctgcagtgtctcaacctgtctattgtgagccacgcaacatgtcacggtgtctatcccggacgaattacatctaatatggtgtgcgcgggaggggtgcctgggcaagatgcctgccagggtgatagcggcggacctctagtctgtggaggcgtcctgcagggtctcgtgagttggggctctgtcggcccttgcgggcaggacggaatccccggagtgtacacttacatttgcaattcaactctggtggggttgggcacaagttggaactttaattcctgccagcccttctag

SEQ ID NO: 227531 - DNA, 435 bp, Artificial Sequence
  Description of Artificial Sequence: Synthetic coding sequence
atggccctttcagtgggcgttactcactctcgtggacgctggggctgtcttcgagcaccagcatgtgcagcgggagtgtcacttctgaccactggtggaagcagccagagactcacggcagccgcagatccgtttcctgacttgctgcagtgcctcaatctgtccattgtgtcacatgcaacctgtcacggcgtctaccctggtcgaatcaccagcaatatggtgtgcgcaggaggagtgcccggacaggacgcctgtcagggtgacagtggagggccactggtatgtggtggagtcctccagggtttggtgtcctgggggtccgtgggcccatgcggacaggacggcatacctggcgtatacacctacatttgcaatagcactctggtggggttgggaacttcctggaatttcaattcctgccaacccttttag

SEQ ID NO: 227532 - DNA, 747 bp, Artificial Sequence
  Description of Artificial Sequence: Synthetic coding sequence
atggggctgtccatcttcctgctgttgtgtgtgttgggcctctcgcaggcagccacgcccaaaatatttaatggaacagaatgcggcaggaactcgcaaccctggcaagtgggactgttcgaaggcacatccctccgttgcggtggtgtgctgatcgatcatcgctgggtgctgaccgctgcccactgttctggcagccggtactgggtgaggctcggcgaacactccctgtcccagttggattggaccgagcagattaggcattcagggttctcggttacacatccaggatatctgggagccagcacatcccacgagcatgacctgaggctgttgagattgcgccttcccgtgcgcgttacgtcatcagtgcagccactccctttaccaaatgactgcgcaacagctggaacggaatgtcatgtctcagggtggggcattaccaatcaccctcgaaatcctttccctgacctcctccagtgcctcaatttatcaatcgtgagtcacgctacttgtcatggcgtctacccaggcaggattacaagtaacatggtgtgcgccggaggtgtgcccggtcaggatgcctgtcaaggtgattccggtggtccattagtgtgtggtggtgttttacagggccttgtgagctgggggagcgtgggcccttgcggacaagatggaatccctggggtgtacacttatatttgcaaatacgtggactggatccggatgatcatgaggaataattag

SEQ ID NO: 227533 - DNA, 747 bp, Artificial Sequence
  Description of Artificial Sequence: Synthetic coding sequence
atgggactttctatctttctgttgctatgcgttcttggactgagtcaagccgctaccccaaagatatttaatggaacagaatgtggtcggaacagtcagccatggcaagtcggactgttcgaaggaaccagcctgcgctgtggaggggtgcttatcgatcacaggtgggttctgaccgctgcacattgttccggcagtcgctattgggtgcggctcggggagcattctctgagccagctggactggacggaacagatcaggcactctggtttttcggtgacgcatcccggatacctgggcgcttcgacttcgcacgaacacgatctgcgccttctcagattgcgactgcccgtccgagtgacgagttctgtgcagcctctccccctcccaaacgattgtgctaccgccggtacggaatgccacgtgtcaggatggggcataaccaatcaccctcgtaatccatttcctgatctgctgcagtgcctgaatctgagcatcgtatcccacgccacgtgccacggcgtctatccgggaagaattacctctaacatggtgtgcgcaggcggagtccctggccaagacgcttgccagggagacagcggaggcccattagtgtgcggcggagttctccagggccttgttagctggggctccgtgggcccatgcggccaagatggaattcctggagtatacacatatatttgtaaatacgtggactggataaggatgatcatgcgcaacaactag

SEQ ID NO: 227534 - DNA, 336 bp, Artificial Sequence
  Description of Artificial Sequence: Synthetic coding sequence
atgggattaagcatcttcctgctgctctgcgtcctgggtctgagtcaggcagcaaccccgaagatctttaacggtactgaatgtgggagaaattctcagccttggcaggtcggtttatttgagggaacctctttaagatgtggcggagtcctgatcgaccatcggtgggtgctcacagcagctcactgttccggcaggccaatccccggatctgccccagtcccccaaccgctccatcggctgccatgccacctcccctggtgcgtgtcacgggaaaaccatgaacagcacggagtttgtaggagaaggccgggagcagggtgccttcctggttag

SEQ ID NO: 227535 - DNA, 834 bp, Artificial Sequence
  Description of Artificial Sequence: Synthetic coding sequence
atgtggccattggccctggtgatcgcaagcctgaccctggcattgagcggtggcgtgagtcaggagtcgtccaaagtcctcaatacgaacggtacaagtgggtttctccccggaggctatacgtgcttcccacacagccagccctggcaagctgccctgcttgtgcagggccgactgctatgcgggggagtcctcgtgcaccctaagtgggtgctgacggcagcacattgcctgaaggaggggcttaaggtctacctcggaaaacatgcactgggcagagtagaagcaggcgaacaggtcagagaggttgtccacagcataccacatccagaatataggcggtcacccacacacctgaaccatgatcatgatatcatgctgctcgagttacagtcacctgttcaattgactggatatatccagacactgcccctcagtcacaacaatcgcctgaccccaggtacaacgtgcagagtatccggatggggaaccacgacttccccccaggtcaactatccgaaaacgctccagtgcgcaaatatccagttacgctctgatgaagagtgtcggcaggtatatcccggtaaaataacagacaacatgttgtgtgcaggaacgaaagagggcggaaaagacagctgcgagggagattcgggtggcccactggtttgcaacaggacactctacggcatcgtgtcttggggtgattttccctgcggtcagcctgaccgcccaggggtttatacaagggtgtctcggtatgtattatggatccgagagactatcagaaaatatgagacccaacaacagaagtggttgaagggcccacaatag

SEQ ID NO: 227536 - DNA, 378 bp, Artificial Sequence
  Description of Artificial Sequence: Synthetic coding sequence
atgtggccccttgcattggtcattgctagtctcacgctcgcgctgtctggcgttaactatccaaaaacgctgcagtgcgccaacatacagcttagatcagatgaggaatgccgtcaggtctacccaggaaaaattacagataacatgctctgcgccggaaccaaagaaggcggaaaggattcttgcgaaggcgattcagggggaccattagtgtgcaaccgcacattatacgggattgtcagctggggagacttcccttgcggacaacctgaccgaccaggggtgtatacccgagtgagtcggtatgtgctgtggatccgcgaaactatccgcaagtacgagacccagcaacagaagtggctaaagggccctcaatag

SEQ ID NO: 227537 - DNA, 297 bp, Artificial Sequence
  Description of Artificial Sequence: Synthetic coding sequence
atgggtttgatttacaagtgcctgcccgagaaggtcaccgttaacattgaaactaggtgcctgcccggtgtattccagggctcacagcaccagtgggaccaatgggttagtccaaggtggctacaccttcttccacctctgtctgcactggcaggctgccctacttccgcccgagcggcaacactttggggctcacctggtccaccccagatgggccctcattgccgcaccctaagcaaggggggagcccagtccctccctcggcaggcccgacctcgcgcttgtggttcttggtag

SEQ ID NO: 227538 - DNA, 282 bp, Artificial Sequence
  Description of Artificial Sequence: Synthetic coding sequence
atgtggcccctggcgctcgtaattgcctccttgaccctcgcattatccggcggtgaggactttaaggaaccatctcaaggccctcgggacgtgatggccgcttctcgaccagaggcgtttcctaagggtctaacactagagcctcggcctgaaaaagggggaatatgcggttgcctggccccaggtacaattctcggactgaaggttgggtggctgttttcctcaggtgatacaccatggatccacgccagagccacacccgagtgccacaccttaggctag

SEQ ID NO: 227539 - DNA, 834 bp, Artificial Sequence
  Description of Artificial Sequence: Synthetic coding sequence
atgtggcccctcgccctggttattgcctccctcaccctcgcattgtccggaggtgtgtcacaagaaagtagcaaagtattgaacactaatggaaccagtgggttcctcccaggtgggtacacgtgtttcccgcactctcagccttggcaggccgctctgctggtgcagggtcggctgctgtgtggtggtgtgctggtccaccctaagtgggtgctaaccgccgcacattgtctcaaggaaggacttaaggtgtacctgggcaagcacgctctggggcgagtcgaagcaggagagcaggtacgtgaggtggtccatagcatcccacaccccgaatacaggaggagccctacgcacctgaaccacgaccatgatatcatgctgctggagctgcagtcacctgtgcagcttacgggatatatacagacacttcccctgtctcacaataatcggttgactcctggcacaacttgtagggtatctggatggggcacaactacatcaccccaggtgaactaccctaagactttacaatgcgctaatatccaactccgatccgacgaggagtgtcgtcaggtgtaccctggcaaaatcacggacaacatgctttgcgccggaaccaaagaaggcggaaaagattcttgcgagggagactcaggcggacccttagtgtgtaaccggactttgtatgggattgttagttggggtgactttccctgtggtcagccagatcggcctggcgtgtatacaagagtctcaaggtacgtgttatggattagggaaaccatcagaaagtatgagacccagcagcaaaagtggctgaagggcccacagtag

SEQ ID NO: 227540 - DNA, 804 bp, Artificial Sequence
  Description of Artificial Sequence: Synthetic coding sequence
atgtctcttagggtcctgggcagcgggacatggccaagcgctcctaagatgtttttgctgctgacagctctgcaggtacttgcaatcgcaatgacccagtctcaggaagatgagaataaaattattgggggtcacacatgcactcgcagttctcagccatggcaggccgctctgctggccggaccacggaggcgatttctctgcggcggtgcactgctctctggccagtgggtaatcacggccgctcactgtggacgtcctatactgcaggtagctctggggaaacataacttgagaagatgggaggcgacacaacaggtgctgcgagtggtgcgccaggtgacacaccccaactacaacagtcgcacacacgacaacgatctgatgctcctacagttgcagcagccagccagaatcggaagagctgtgcgacctatcgaggtcactcaagcctgcgcttctcccggtacatcatgcagggtgtccggttggggcactatttcctcaccaatcgctcggtaccctgcctccctgcagtgcgtcaatattaacatcagccctgacgaggtgtgtcaaaaggcataccccagaaccattaccccagggatggtttgcgctggagtgccccagggcggtaaagactcttgccagggtgacagtggaggaccactggtgtgcagagggcaactacagggcctggtgtcctggggaatggaacgctgcgcactccccggataccctggggtatataccaacctgtgcaagtacagaagctggatagaggaaactatgagggataaatag

SEQ ID NO: 227541 - DNA, 804 bp, Artificial Sequence
  Description of Artificial Sequence: Synthetic coding sequence
atgtctctgagggtgctgggctctggcacctggccaagcgcccctaaaatgtttctgttgttgacggccttgcaagtgctcgcaatagctatgacacagtcccaggaggacgagaataagataatcggtggacacacctgtaccaggagctcacagccttggcaggctgcattattggcaggacctcgcaggagatttctgtgcggcggagccctgctgagtgggcagtgggtgataacagcagcacattgtggccgtcccatcctccaggtagcgctgggaaagcacaacttaagaagatgggaggcaacacagcaagtactgcgcgtggtacgtcaagttactcatcctaactacaattcccggacgcacgacaacgacctcatgcttctgcagttacagcagcctgccagaatcggtcgcgctgtgaggcccattgaggtcacccaggcctgcgccagtcccggaaccagttgccgggtcagtgggtggggtacaatcagcagtcctattgctcgctaccctgctagtctgcagtgcgttaacataaacatctctcctgacgaggtttgccaaaaagcatacccacggacgatcacgccgggaatggtatgtgctggggtgcctcaggggggtaaggattcgtgccagggggacagcggtggccctctggtttgtaggggacagcttcagggacttgttagctgggggatggagcggtgtgccctgccgggatatcccggagtgtacaccaacttatgcaaataccgcagttggattgaggagaccatgcgcgataagtag

SEQ ID NO: 227542 - DNA, 804 bp, Artificial Sequence
  Description of Artificial Sequence: Synthetic coding sequence
atgtctctgcgggttcttggttctggaacttggccctccgctcctaagatgtttctgctgcttacagcactgcaggtccttgccattgccatgacacagtcacaagaagacgaaaacaaaatcatcggaggccacacctgtactaggagctcccagccttggcaagccgctctccttgccggaccacgaaggcggtttctctgtgggggagcacttctctcaggccaatgggtgatcaccgcagctcattgtggcaggcctatcctccaggttgccctaggcaagcataacctgagaagatgggaagccacgcaacaggtgcttcgggtggtgcggcaagtgacacatcccaattataacagtaggacacatgataatgacctaatgctgcttcagctgcagcagcctgcacggatcggccgtgctgttcgcccaattgaagttacccaggcttgcgctagccccggtacctcctgccgggttagtggatgggggacaatctcgtcccctatcgccagatatcccgcttccctgcagtgcgtcaacatcaacatctctcccgatgaagtgtgtcagaaagcttatccacggactattacgcccggaatggtatgtgctggggtacctcagggcggtaaagattcttgtcagggcgatagcggagggcctcttgtgtgtagaggtcagcttcagggcttggtcagttggggaatggagcgatgcgccttgcccggataccctggagtctacactaatctgtgtaagtaccggtcttggattgaggaaacaatgcgggacaagtag

SEQ ID NO: 227543 - DNA, 486 bp, Artificial Sequence
  Description of Artificial Sequence: Synthetic coding sequence
atgtggcttcttcttaccctctccttcctgctggcaagtacggcagcacaggacggggataaactgctggaaggcgatgaatgcgccccacattctcagccatggcaggtcgccctgtacgaaagaggacgcttcaattgtggcgctagtctgatttccccacattgggtgctgtccgccgcacactgccaaagcaggttcatgcgcgtgcgactcggtgaacataaccttcgaaaaagagatgggcctgaacagctgaggacgaccagcagggtgataccacacccgagatacgaagctcgctcccacagaaacgatattatgctgctgaggctagtgcagccagctcgacttaatccacaagtgcggccagcagtgctcccaacaaggtgcccacatccgggtgaggcttgcgtcgtatccggctggggattggtgagtcacaatgaaccagggacagctggttctcctcgcagccaagggtag

SEQ ID NO: 227544 - DNA, 771 bp, Artificial Sequence
  Description of Artificial Sequence: Synthetic coding sequence
atgtggttgctactgaccctgtcatttctgctcgcatcaacagccgcacaggatggcgacaagctgctagaaggtgacgagtgtgctccacactcacagccatggcaggtcgccttgtacgagaggggaaggttcaattgtggcgcttctttaatctcacctcattgggtcctttctgcagctcattgccaatccagattcatgagagtgagactcggtgagcacaacttacggaaacgagatgggcctgagcaactccgaaccaccagtcgcgtgatccctcatccacggtacgaggctcgctctcaccgcaacgacatcatgctccttagattagtccaacccgctcgcctcaacccgcaggtcagacctgcggtcttacccactagatgtccacatcccggtgaagcttgcgtggtgtctggatggggcctggtcagccacaacgagccaggcaccgcaggatctccgcgaagtcaggtcagcctacccgatacccttcactgtgccaatatctctatcatcagcgacacctcttgcgataagtcctatcccggacgccttaccaacacaatggtatgcgctggagccgaaggacgcggagctgaatcctgtgagggagattctggcggacctctcgtctgcgggggaatactgcaagggatagtttcttggggcgacgtgccctgtgataacaccactaagcctggcgtttatacaaaggtgtgccattacctggagtggatacgggagaccatgaagcgcaattag

SEQ ID NO: 227545 - DNA, 516 bp, Artificial Sequence
  Description of Artificial Sequence: Synthetic coding sequence
atgtggctgttgctgactcttagcttccttctcgcttcaacggctgctcaggatggagataagctactggagggagatgaatgcgccccacatagccaaccctggcaggtggctctatacgagcggggtcggtttaactgtggggctagcttgatatccccccactgggtgctatccgccgcacactgccaaagccgctttatgagagtgcggttgggggaacacaacctcagaaaacgagacggcccagaacagctgcggacaacttcacgggtcattcctcacccacgatacgaggcacgctcacacagaaatgatatcatgctgctacggcttgtgcagccagcgaggcttaatcctcagggagactcagggggacctcttgtgtgcggcggtattttgcagggcatcgtctcatggggcgacgttccatgcgataacaccaccaagcccggagtgtacacaaaagtgtgccactacttggaatggataagggaaactatgaaacgcaattag

SEQ ID NO: 227546 - DNA, 489 bp, Artificial Sequence
  Description of Artificial Sequence: Synthetic coding sequence
atgtggctcttgctaaccctaagcttcctgctcgcctccaccgccgctcaggacggcgataagctgcttgagggtgatgaatgcgcccctcacagtcaaccctggcaggttgcactttacgagcgaggcaggtttaactgcggagcatctttaatctccccacattgggtactgagcgctgctcattgccagtccagattcatgcgagtgaggctgggggaacataatctgcgcaagagagacggcccagagcagctacgtacaactagtcgcgtgatcccacatccacgctacgaagccaggtctcatcgcaacgatataatgctgctgcggctcgtccagccagcaagactgaatcctcaggtgcgacctgctgtgcttcccacaagatgtccccaccctggggaagcgtgcgttgtgtccggctggggcctggtctcacacaatgaaccaggcactgccggttcccccaggtcacaaggcgcatag

SEQ ID NO: 227547 - DNA, 771 bp, Artificial Sequence
  Description of Artificial Sequence: Synthetic coding sequence
atgtggctgcttctgacgctttcttttctgttagcatcaaccgccgctcaagatggggataagctcctggagggagatgagtgcgccccacatagccagccttggcaggtcgcgctgtacgagcgcggtagatttaattgcggagcgtctctaatcagcccgcattgggtgctgtccgcagcccactgccagtcgcgctttatgagggtgcgtttgggtgaacataacttgagaaagcgggacggccctgaacagctacggaccactagccgagtaatcccccacccacggtacgaagccagaagccataggaatgacattatgctactgaggctggttcagccggctcgcctaaacccccaggtgcggcctgctgtactgcccaccagatgccctcatcccggagaggcctgtgtcgtgtccgggtggggactagtgtctcacaatgagcccggaacagccggatctccaaggagtcaggtgagcctgccagacaccctgcattgtgcaaacattagcattattagcgacacttcttgcgacaagtcctaccctgggagactgaccaataccatggtatgcgcaggggctgaagggcgtggagcggagtcctgtgagggggacagtgggggacctcttgtgtgtggtggcatactccagggcattgtctcttggggtgatgtaccgtgcgacaataccacaaagcctggcgtctacaccaaggtgtgtcattatcttgagtggatacgggaaactatgaaacggaattag

SEQ ID NO: 227548 - DNA, 786 bp, Artificial Sequence
  Description of Artificial Sequence: Synthetic coding sequence
atgtgggatctcgtactgagtatcgctctgagtgtgggatgcacaggcgcagtgcctcttatccaatctcgcatcgtcggcggttgggaatgcgagaaacattctcagccttggcaagtcgcggtatactcacacggatgggcccactgtgggggtgtcctagtgcacccacagtgggtgctcaccgcagcccactgcctgaagaaaaattcccaggtgtggttggggaggcacaacctgtttgaacctgaagatacaggacagcgtgtgcctgtgagtcacagcttcccccatcctctgtataatatgtccctactcaaacaccagtcattgcgccctgatgaagactctagccacgatctgatgctcctcaggctgtccgaaccagcaaagattacagatgtggtgaaggttttagggctgccaacccaggaaccagcccttggtaccacttgttacgcctctggttggggttctattgaaccggaggaatttctgcgcccacgatcactgcagtgcgtgtcactgcatctgctgagcaatgatatgtgcgccagggcctatagcgagaaggtgacagagtttatgctttgtgccggtctttggaccgggggtaaagatacctgcgggggagacagtggcggtcctctggtatgtaatggcgtgctccagggaattacctcatggggacccgaaccgtgcgcccttccagagaagcccgcagtctacaccaaagttgtgcactacagaaagtggataaaagatacgatcgctgcaaatccatag

SEQ ID NO: 227549 - DNA, 672 bp, Artificial Sequence
  Description of Artificial Sequence: Synthetic coding sequence
atgtgggacctagtgctgagcatcgcactgtcggttggatgtaccggtgcagtccccctgatccagagccggattgtgggcggatgggagtgtgagaagcactcccaaccctggcaggttgccgtctactcccacggttgggcccactgcggcggtgttctggtccaccctcagtgggtgctaaccgccgcacactgcttgaagaaaaattcccaagtttggctcggaagacacaatctttttgaacccgaagacacaggtcagcgggtccctgtcagccacagttttccccatccgctctataatatgagcctgctgaaacaccaatccctgcggccagatgaggacagctcccacgacttgatgctgctacggctgagtgaaccggctaagattacagacgtagttaaggtgctaggcctccctactcaggaacctgccctcggcactacatgctatgcatctgggtgggggagcattgaaccagaagagttccttcggcctcgctccttacaatgcgtgtccttgcatctgttatcaaacgatatgtgtgcccgtgcgtactctgagaaagttacagaattcatgctgtgcgcaggactctggaccggcggaaaagacacatgcggtgtttctcacccgtactcacagcatctcgaagggaaagggtag

SEQ ID NO: 227550 - DNA, 480 bp, Artificial Sequence
  Description of Artificial Sequence: Synthetic coding sequence
atgtctctgttgaagcatcagtctctccgccctgacgaagactcttctcacgatttgatgctccttagacttagtgagcctgctaaaatcacagacgtggtgaaggtgctgggcctgcctacgcaggagccggctctcggtaccacatgctacgcctctggctggggcagtatcgagcccgaagagtttctccggccaagatccttgcagtgtgtgtccttgcatctcctttccaatgacatgtgcgccagagcctattctgagaaagtaacagagttcatgttatgtgctggactttggaccggcggtaaggatacctgtggcggagattccggtggcccacttgtgtgtaacggagtgctccagggcataaccagttgggggccagagccttgtgcgctgccggagaaaccagctgtgtatactaaagtcgtgcattatcgcaagtggattaaagacaccatagcagccaacccatag

SEQ ID NO: 227551 - DNA, 786 bp, Artificial Sequence
  Description of Artificial Sequence: Synthetic coding sequence
atgtgggtgccagtggtctttttgaccttgtcggtcacgtggattggcgctgctccgctcatccttagccggatagtcggcggatgggaatgcgaaaaacactcccagccctggcaggttttagtggctagcaggggcagagcagtgtgcggcggtgtgctggtacacccgcagtgggtcctgaccgctgcccactgtattcggaacaagagcgtgatcctcctgggtcgccactcactatttcaccccgaggacacgggccaggtcttccaggtcagccatagttttccacacccgctttatgacatgagccttttaaagaatcgcttcctccgaccaggggatgacagcagtcacgacctcatgctgttgcgcttgagcgagccggctgaactcaccgacgccgtgaaagtcatggacctccctacacaggagccagccctcggcacaacttgctatgctagcgggtggggatcaatagagcctgaagaattcttgactcctaagaagcttcaatgcgtggacctgcacgtgatcagtaacgatgtctgtgcccaggtgcaccctcaaaaagtgaccaaatttatgctctgtgcgggtcgttggaccgggggaaagtccacctgctcaggcgattctggcggtcctttagtatgtaatggagtcctccagggcatcacctcatgggggtctgagccatgcgccctcccagagaggccttctctttacaccaaagtggttcactataggaaatggataaaggacaccatagtggctaacccttag

SEQ ID NO: 227552 - DNA, 663 bp, Artificial Sequence
  Description of Artificial Sequence: Synthetic coding sequence
atgtgggtgccagttgtgtttctgacgctcagcgtgacctggatcggcgctgccccactcatcctgtctcgcatcgtgggagggtgggaatgtgaaaaacacagtcagccatggcaagtactggttgcttcccggggacgtgctgtgtgtggcggagttcttgtccacccacagtgggtcctaacagctgcacactgcattagaaacaagagcgtgattctgctggggagacattccctgtttcatcctgaagatactggtcaggtcttccaggtcagccactccttccctcaccccttatacgatatgagccttctgaagaaccggttcctgcggcctggtgacgatagcagcatcgagccagaggaattcctgacgcctaagaaactgcagtgtgttgatctgcacgtgatcagcaacgatgtctgcgcccaggtccatccccagaaggtcaccaaattcatgctgtgcgctggtagatggaccgggggtaaatcaacatgctctggagatagtggagggccattagtttgcaatggtgtcctgcagggtatcacatcttggggttcggagccttgtgctctacccgaaaggccaagtttgtacacaaaagtcgtacattatcggaagtggataaaagacactatagtcgccaatccttag

SEQ ID NO: 227553 - DNA, 717 bp, Artificial Sequence
  Description of Artificial Sequence: Synthetic coding sequence
atgtgggtgccggtagtgtttttgaccttgagcgtaacatggatcggtgcagctcccctcattctgtcacgtatagtggggggatgggagtgcgaaaaacatagccagccgtggcaggtcctggttgccagccgtggaagggctgtgtgtggaggtgttctcgtgcacccacagtgggtcttgaccgccgctcattgtatacggaacaagagcgtcatactgctcggcagacactctctcttccacccagaggataccggtcaggtcttccaagtatcccacagcttcccccacccactttatgatatgagtctgttgaagaatcgcttcttgcggccaggcgacgattcgtctcacgaccttatgctattgaggctcagcgagccagccgagctgacggacgcagtcaaagtcatggatttgccaacccaggaaccagcactgggaaccacatgttacgcctctggatggggatcaatcgagcctgaagaatttcttacaccaaagaagctgcagtgtgtggatctccacgttattagtaacgatgtgtgcgcacaggtgcacccgcagaaggttaccaagttcatgttgtgcgccggacgatggaccggcggtaaatccacatgttcttgggtaattttaatcaccgagcttacaatgccggcacttcctatggtgctgcacggttccttggtgccctggaggggaggcgtatag

SEQ ID NO: 227554 - DNA, 657 bp, Artificial Sequence
  Description of Artificial Sequence: Synthetic coding sequence
atgtgggtgccggttgtgtttttaacactttccgttacgtggataggcgctgcgcctcttatcctgagcagaatagtcggcggttgggaatgcgaaaagcactcccagccatggcaggtgctggttgcaagtagaggacgggcagtttgcggaggggtcctggtgcacccccagtgggtgctgaccgcggctcattgcatccgcaagcctggagacgattctagtcacgatctgatgctcctgagattatcagagccagctgaactgacagacgccgtgaaggtgatggatcttccaacacaggaacccgctctgggtaccacgtgctatgccagcgggtggggatcgatagagccagaagaatttctgacaccgaaaaagctgcagtgcgtagatctgcacgtaatcagcaacgatgtgtgcgcccaggttcacccgcaaaaagtgacaaaattcatgttatgcgccggacgctggactgggggaaaatctacctgcagcggagactccggcggacccctggtgtgcaatggggtgcttcagggcattacgagttggggcagcgagccatgcgcactgccggagcggccatctctctacaccaaggtggtccattaccgcaagtggatcaaggacactatcgtggccaacccatag

SEQ ID NO: 227555 - DNA, 210 bp, Artificial Sequence
  Description of Artificial Sequence: Synthetic coding sequence
atgtgggtaccagttgtgtttctgacgctgtctgtcacttggatcggagccgctcccttgattctgtccagaatcgttggcggttgggagtgcgagaaacatagtcagccctggcaggtcctcgtcgcatcaaggggtagagcagtctgcggcggtgtgctcgtgcaccctcagtgggttctcaccgcagcccactgcatccggaagtag

SEQ ID NO: 227556 - DNA, 765 bp, Artificial Sequence
  Description of Artificial Sequence: Synthetic coding sequence
atggctaccgccggaaacccatggggctggtttttgggatatctaatcctgggagtcgctggctctctggtctccggaagctgttcccagatcatcaatggggaggactgcagccctcactctcagccctggcaggccgctctagtgatggagaacgaattgttctgttcaggcgtgctcgttcaccctcagtgggtcctatctgccgctcactgttttcagaactcttacacaatcggtttaggacttcattcacttgaggctgatcaggaaccaggttctcagatggtggaagccagcttgtcagtgcgccacccagagtacaataggcctcttctagcgaatgacctgatgctgataaaattggatgaaagtgtttccgagtccgacaccattaggagtatttccattgctagtcaatgtcccaccgcgggaaactcttgcttggtctctggctggggcctcttggccaacggcagaatgcctactgtcttgcaatgcgtcaatgttagtgtggtctcagaggaggtctgtagcaagctatacgatccactttaccaccctagcatgttttgtgccggaggtggacatgatcagaaggattcctgcaatggagactctggtggtccgctgatctgtaatggatacctccaggggctggtgagcttcggcaaagcaccctgcggccaggtgggggtgcccggtgtttacactaatctgtgtaagttcactgagtggatcgagaagaccgttcaggccagttag

SEQ ID NO: 227557 - DNA, 333 bp, Artificial Sequence
  Description of Artificial Sequence: Synthetic coding sequence
atggaaaacgagctgttttgcagtggcgtcttggtacatccccaatgggttttgtctgccgcacactgttttcagaatagttacacaatcgggctgggcctacattcccttgaagcagatcaggagccagggtcacagatggttgaggccagcctgtcagtaagacaccccgaatacaatagacctctgctcgccaatgaccttatgctgattaagctggacgaaagtgtcagcgagtctgataccatacgatccatttccatcgcttctcaatgccccacggctggcaattcctgtctggtgagcggttggggactgttggctaacggctag

SEQ ID NO: 227558 - DNA, 735 bp, Artificial Sequence
  Description of Artificial Sequence: Synthetic coding sequence
atgaaaaaattgatggtggtcctgtccctaatagcggctgcttgggcagaagagcagaacaagcttgttcacggaggcccttgcgacaagacaagccatccgtaccaggccgcattgtacacaagcggacatttgctgtgtgggggagtactgatccaccccctctgggtactcactgctgctcactgtaagaagccaaacttacaggtgttcctgggtaagcacaatctacggcaacgggaaagctctcaggagcagtcatctgtcgtgagggccgttattcacccagattacgacgcagcctcccatgatcaagacatcatgctcttacgtcttgcccgacctgctaagctgtccgagctgattcagcctcttccactggagagagactgttccgctaataccacttcatgtcatatcctgggctggggcaaaaccgctgacggcgatttccccgatacgatacagtgtgcctacattcatttagtatcccgggaagaatgcgagcatgcttacccaggtcagattactcagaatatgctctgtgcgggagacgagaaatatgggaaggatagctgccaaggggactcaggcggacccttagtttgtggagatcaccttcggggtctggtgtcgtgggggaacataccctgcggcagcaaagaaaagcccggtgtgtacacaaacgtgtgtaggtacacaaactggatccagaagaccatccaagccaagtag

SEQ ID NO: 227559 - DNA, 735 bp, Artificial Sequence
  Description of Artificial Sequence: Synthetic coding sequence
atgaagaagctgatggtggtacttagtctgatagcagccgcatgggccgaggaacaaaataagctggttcacggtggtccctgcgataagacaagccatccctatcaagctgctctgtacacttctggtcacctactgtgtggaggtgtactgatccaccccttatgggtgctcaccgcagcccactgcaagaagccgaacctccaagtgttcttaggaaaacacaacctgagacaaagagagtcctcacaggaacagtcatccgtcgtgcgcgcagtcattcaccctgattacgacgctgctagccacgaccaggacattatgctgcttcgcttagccaggcctgcaaaactcagcgagctgatccagccactgccgctcgagcgggattgtagcgccaataccacttcctgtcacatcttggggtggggcaagaccgcggatggggacttcccagacaccattcagtgcgcctatatccatctggtgtctagggaagaatgcgaacatgcataccccggtcaaattacccagaacatgctttgcgcaggcgatgagaaatacggcaaagatagctgtcagggagacagtggtggcccattagtctgcggtgaccatctgcgaggtctcgtgtcctggggtaacatcccttgcggctctaaggagaaacccggagtatacaccaatgtttgccggtataccaattggatacagaagacgattcaggccaaatag

SEQ ID NO: 227560 - DNA, 363 bp, Artificial Sequence
  Description of Artificial Sequence: Synthetic coding sequence
atgaagaagctgatggtggtcctctccctcattgccgctgcctgggccgaggagcagaacaagctcgtacatggcggaccctgtgataagacttcccacccctaccaagcagctttgtacacatcagggcacctgctgtgcggcggtgtgttgatccatcccctctgggtgctaacggccgctcattgtaaaaagcccgtcatcttgggcgtaaggtggtacgtggagacaacaagcgaggctctgtgtcacggcgtcacctctcccgtggatcagaggcggtcccaggagagcacccccacttctgctgacactcgtacaggttccaagaagccgttcaggccctctgatcccgatatgtag

SEQ ID NO: 227561 - DNA, 414 bp, Artificial Sequence
  Description of Artificial Sequence: Synthetic coding sequence
atgttgctgagactggcaaggccagcaaagctgagtgagttaatccagccactgccactggagcgtgactgtagcgccaacaccacaagctgccacattctaggctgggggaaaaccgctgatggagacttcccagatacgattcagtgcgcttacatccatcttgtcagccgggaagaatgtgagcatgcctaccctgggcagattacccaaaacatgctgtgtgccggagacgaaaagtacggcaaggatagctgtcagggggatagcggaggcccactcgtgtgcggcgatcacttgcgcggtctcgtgagctggggcaatattccctgcggatctaaagagaaaccgggtgtttatacaaatgtgtgtcgctatactaactggatccagaaaactattcaggcgaagtag

SEQ ID NO: 227562 - DNA, 123 bp, Artificial Sequence
  Description of Artificial Sequence: Synthetic coding sequence
atgaagaagctgatggtagtacttagtctgatcgctgccggtatcttccgctcgagctggggatctatcacgttcggaaaggggagagtccctcggtcacgcgttttgctgagtggtctgtag

SEQ ID NO: 227563 - DNA, 414 bp, Artificial Sequence
  Description of Artificial Sequence: Synthetic coding sequence
atgctgctgagactggccagaccagccaaattatccgaactgattcagccgctccctctggagagagactgcagcgccaacacaacctcctgccatatcctgggctggggtaaaacagccgatggggatttccccgataccattcaatgtgcttacatacacttggtgtcgcgcgaagagtgcgaacatgcctatcccggtcagattacgcaaaacatgctgtgcgcgggagacgagaaatacggcaaagatagttgtcaaggggattcaggaggtcccctggtttgtggtgaccacctacgcggactggttagttggggtaatatcccctgtggctcaaaagagaaaccaggagtatacacaaacgtgtgtcgctataccaactggattcagaagaccatccaggcaaaatag

SEQ ID NO: 227564 - DNA, 783 bp, Artificial Sequence
  Description of Artificial Sequence: Synthetic coding sequence
atggggcgtcctaggcccagggccgcaaaaacctggatgtttctcttgctacttggaggcgcttgggccggtcactctcgcgctcaagaagacaaggttctcgggggacacgagtgtcagccccattcacaaccatggcaagccgctctctttcagggccagcagttactttgtggaggggtgctcgtgggcggaaactgggtgctcactgctgcacattgcaaaaagcccaagtatacggtacgactcggcgaccactcattgcagaacaaggacggacccgagcaggagatcccagttgtgcagagcattccccacccctgctataattcttccgatgtagaagaccataaccacgacctgatgcttttgcagctgcgcgatcaggccagtctaggcagtaaagtaaaacccatctctctggccgatcactgcacccagccaggtcagaagtgtaccgtgtccggctgggggactgtcacgtccccgagagagaattttccagatactctcaattgcgcagaggtcaaaatcttcccacaaaaaaaatgcgaggacgcgtaccccggacagataacagacgggatggtgtgcgccggaagctctaagggcgctgacacatgccagggcgatagcggcggacctctcgtttgtgatggcgcactgcaaggcattacatcatggggctcggacccatgcgggagaagcgacaagcccggagtgtacactaatatctgccgatacctggactggatcaaaaaaattattggctccaagggctag

SEQ ID NO: 227565 - DNA, 99 bp, Artificial Sequence
  Description of Artificial Sequence: Synthetic coding sequence
atgggacgaccccgtcccagggcagccaagacatggatgtttctgctgctcctgggcggagcctgggccggtagattttggcggccaccaggcgtgtag

SEQ ID NO: 227566 - DNA, 360 bp, Artificial Sequence
  Description of Artificial Sequence: Synthetic coding sequence
atgggcaggccaaggcctcgcgcagctaagacttggatgttcctgttgttactgggtggggcttgggcggaaaactttcctgacactctaaactgcgcagaagttaagatcttcccgcagaagaagtgtgaggacgcataccccggtcagattacggacggaatggtgtgcgctggtagcagcaaaggagccgacacctgccagggagatagcggcggaccactggtctgtgatggtgcgctgcaggggatcaccagctggggctcggacccgtgcggtagaagcgacaagcctggagtttataccaacatatgtcgataccttgattggatcaaaaagattataggtagcaagggctag

SEQ ID NO: 227567 - DNA, 918 bp, Artificial Sequence
  Description of Artificial Sequence: Synthetic coding sequence
atgggacggcctcggcctagggctgccaaaacctggatgttcctgttactcctggggggagcgtgggccgcatgcggatccctggatctcttgacaaaattatatgctgagaatctgccttgcgtacacctgaatccacagtggcccagccagccgtctcattgccctcggggttggcgcagcaacccgttgcctccagctgccggtcattcgagagctcaagaggacaaagtcctcggagggcatgagtgtcagccccacagtcagccttggcaggccgcactgtttcagggccagcagttgctctgcggcggtgtgcttgttggcggaaattgggtcctgacggccgctcattgtaagaagccgaaatatactgtccgtctgggagatcatagtttacaaaataaagacggtcccgaacaggagatccctgtggttcaatcgattccgcacccttgctataactcttctgacgtcgaggaccacaaccatgatcttatgttgttacagctgcgagaccaagctagtctggggtcaaaggtcaagcccatcagcctggctgatcactgtacacagcccggtcagaagtgtactgttagcggttggggtacagtaacatcccccagggagaactttccagatactctcaattgtgctgaggtgaaaattttccctcagaaaaagtgcgaggacgcgtaccctggtcaaatcaccgacggaatggtttgtgctgggtcaagtaaaggcgctgatacctgccaaggcgatagcggcggacctctcgtgtgcgatggggctctacagggaatcacctcttggggaagcgacccatgcggcagatctgacaagcccggtgtgtacactaatatctgtcgctacctagactggattaaaaagatcatcggatcaaagggatag

SEQ ID NO: 227568 - DNA, 783 bp, Artificial Sequence
  Description of Artificial Sequence: Synthetic coding sequence
atgggtagacccagaccacgtgccgcaaagacatggatgttcttgctactattggggggagcctgggccggacattcgcgggctcaagaggacaaggtcctcggagggcacgaatgccagccccacagtcagccctggcaggcggctcttttccagggccaacaactgctctgcggcggtgttctcgtcggaggcaattgggtgctcaccgccgcacattgtaagaagccaaagtacacagtaaggctgggggatcacagtctccaaaataaagacgggcctgagcaggagattcctgtggtccagtccatcccccacccctgctataatagtagcgacgtggaagatcataaccatgacctgatgctgctacaactccgggatcaggctagcctcggaagcaaggtaaagcccattagtttagccgatcactgcactcagcctggtcagaagtgcaccgtctctggttggggcaccgtcacatctcctcgtgagaacttccccgacaccctgaattgcgcggaagttaagatcttccctcaaaaaaagtgcgaagatgcctatccgggtcagatcacagacggtatggtgtgcgccggttcatctaagggggcagatacctgtcaaggcgactccgggggacccttggtctgcgatggcgcattacagggtataacatcatgggggagcgacccatgtggtagatccgacaaacctggggtatatacaaacatttgccggtacctagattggataaaaaagatcatagggtctaagggctag

SEQ ID NO: 227569 - DNA, 753 bp, Artificial Sequence
  Description of Artificial Sequence: Synthetic coding sequence
atgaaactagggctgctatgcgcgttgctgagtcttctggctggccatggctgggctgacacacgcgcaattggggcagaagaatgccgccctaacagtcagccctggcaagccggactgttccacctgactaggctcttctgtggggctactctgattagtgatcgctggctcctcacagcagcacattgtcggaagccttatctgtgggttagattaggggagcatcatctctggaagtgggaaggcccagagcagctgttccgggtgacggattttttccctcatccgggttttaataaggatttaagcgccaatgaccacaatgacgatatcatgctcatccgacttcccagacaggctcgactgtcgcccgctgtacagcctttgaacctgtctcagacttgcgtgtctcctggcatgcagtgcctcatttctgggtggggagccgtcagcagtccaaaagccctcttccctgtgacgctgcagtgtgccaatattagcattctcgagaacaaattgtgtcattgggcataccccggacacatctccgatagtatgttatgtgccggtctgtgggaaggcggacggggatcgtgtcaaggcgattcagggggtccactggtctgcaatgggaccctggccggagtggtgtcgggcggtgcagagccttgtagtaggcccagacgtcctgcggtgtacacttccgtgtgtcactatctggactggattcaagaaattatggaaaattag

SEQ ID NO: 227570 - DNA, 753 bp, Artificial Sequence
  Description of Artificial Sequence: Synthetic coding sequence
atgaagctgggcttgctatgtgcgcttctctccctgcttgccggtcacggctgggccgataccagagcaatcggcgctgaggagtgcaggcctaatagccaaccatggcaggctggcctctttcatctgacccgcctgttctgcggcgctaccctcatctctgaccggtggcttctgaccgctgctcattgcagaaaaccgtatctttgggtccggctgggagaacaccatctgtggaaatgggagggaccagagcagctgtttagggtcacggattttttccctcaccccggtttcaacaaggatctcagcgcaaacgaccacaacgatgatatcatgttgattaggctcccccgacaagcaaggttgtctcctgcagttcagcctctgaatttgagccaaacatgcgtaagccctggaatgcagtgcctcatctccggttggggggctgtgtcctcaccaaaggccctctttccagtaactctgcagtgtgctaatataagcatattagaaaacaaactatgtcattgggcatacccaggacatatcagtgatagcatgttgtgtgctggcctgtgggaagggggaagaggttcgtgtcagggagacagtggcggtcctctcgtctgtaacgggacactcgccggtgtcgtgtcaggcggagccgagccgtgcagccggcctagacggcctgctgtttatacctctgtgtgccactacctggactggatacaggagattatggaaaactag

SEQ ID NO: 227571 - DNA, 186 bp, Artificial Sequence
  Description of Artificial Sequence: Synthetic coding sequence
atgaagctgggactgctgtgcgcactcttgtctctcctggctggaatctgcggctctgcgcttgagtcaaccactagcggcaatggacgcgtgcgttcatcctgttctggcttaagaacctctagccccacacttgcctcaacacggaccagcgccccaatgacaacaatgatgactagctgctag

SEQ ID NO: 227572 - DNA, 2043 bp, Artificial Sequence
  Description of Artificial Sequence: Synthetic coding sequence
atggtgcccggagtgccgggagccgtcctgactctgtgcctttggctcgcagccagctcgggctgtctggccgcaggtcccggagccgcagcagctaggcgactggatgaaagcctgtccgcagggtctgtccagagggctcgctgcgcctccaggtgcctctcactgcaaatcacccggatatctgctttcttccaacactttcaaaataacgggtccctggtttggtgtcagaaccataaacagtgctcaaaatgtctagagccctgtaaagaatcaggagatcttcgaaaacaccaatgccagtcattttgcgagcctctcttcccaaaaaagtcttacgagtgtttgacaagttgtgaattcctgaaatatattctgcttgtgaagcagggggactgcccagcgccagagaaagcaagcgggtttgctgctgcttgtgtagaatcctgtgaggtggacaatgagtgtagcggagtgaaaaagtgctgcagtaacggctgcggccatacatgccaagtcccaaaaacactctataagggcgtgccattgaagcctaggaaggaactgcgcttcaccgaactgcaaagcgggcagctggaggtcaagtggtcaagtaagtttaatatttcaatcgagcccgttatatatgtagttcagcggaggtggaactatggcatccatccatctgaggatgatgccacacattggcaaacggtcgctcaaacgactgatgaacgcgtccagctgaccgacatccggccaagtcggtggtatcaattccgagttgcagcagtgaatgtacacgggacgcgcggttttactgcaccaagcaagcactttcgatcttcaaaagacccgtccgctccccctgcacctgcgaatctgcgcctggctaactcaaccgtgaatagcgacggcagcgtgacagtcactatcgtgtgggacctgcccgaagagcctgacatccctgtgcatcattataaagtgttttggagctggatggtaagctctaagtctttggtgcctaccaaaaagaagcggcgaaaaactacagatgggtttcaaaactcagtgatccttgagaagctgcagcctgactgcgattatgtcgtggaattgcaggctattacctactgggggcagacacgcctgaagagtgccaaagtttccttacacttcacaagtacccacgctaccaataataaagagcagctcgttaagacccgtaaggggggtatccagacccagctgccttttcaaaggaggcgaccaactaggcccctggaggttggagctcccttttaccaggacggacagctccaggtcaaggtctattggaagaagacggaggatcccacagtaaatcgttaccacgtgcggtggttccctgaagcctgcgcccacaaccggacaacaggatcagaagctagctctggaatgacacacgagaactatataattctacaggatctgtcattctcttgtaaatacaaggtgactgttcagccaatcagacctaaatctcactctaaagccgaggccgtgtttttcaccaccccaccctgttccgcactgaaaggcaaatcccacaagccagttggctgtctgggggaggcaggtcacgtgctctccaaggtgttggcgaagcctgagaatctgtccgcctcattcatcgttcaggatgttaatattactgggcactttagctggaaaatggccaaggccaatctttatcagcctatgacgggatttcaagtcacctgggccgaggttactacagaatctaggcagaactccctccccaacagtatcattagccaatcacaaatcctgccttccgaccactatgtgttaacagtgcccaacctgagacccagtacgctgtacaggttggaagtacaggtccttacccctggcggtgaaggcccagccactatcaaaactttccgcactcctgaattgcccccatcatcagcacaccgaagccacctgaaacaccgacaccctcatcactataagccgtcccccgaacgatactag

SEQ ID NO: 227573 - DNA, 2631 bp, Artificial Sequence
  Description of Artificial Sequence: Synthetic coding sequence
atggagctgattactattctcgagaagaccgtgtcacctgacaggctggaacttgaggcggctcagaagttcctcgaaagggcggcagtggaaaacctgcctacatttctggtggagctctcccgcgttctcgctaatccgggaaattctcaagtcgccagagtagcagccggattgcaaatcaagaattctttgacttctaaagacccggacattaaggctcagtaccaacagagatggttggctatagatgccaacgccaggcgcgaagtcaaaaactacgtccttcagacactaggtaccgaaacctatcgtccaagctccgcaagccagtgtgtagctggcattgcctgtgccgagatcccagtaaaccagtggccggaactcatcccccaattagtggccaatgttactaatcctaactcgacggaacacatgaaggagagcactctggaagccatcggatatatatgccaggacattgacccagagcagctgcaggacaagtcgaatgagattcttacagccatcattcagggcatgaggaaagaggaaccgtccaacaacgtcaagcttgctgctacgaatgcacttcttaactctctcgaattcaccaaggctaacttcgacaaagagagcgagagacatttcatcatgcaggtggtgtgtgaggcaactcagtgcccggatacccgagtccgggtggccgcactgcaaaacttggtcaaaataatgagtctatactaccagtacatggaaacttacatgggacctgctctgttcgccattaccattgaggcgatgaagtccgacatcgatgaggttgcgctgcagggaattgagttttggtcaaacgtctgcgatgaagaaatggacttagctatcgaagcatccgaggccgctgaacaggggcgtcctccagaacatacatccaaattctacgctaaaggcgcactgcagtatttggtgcccatcctgacccagaccctcacgaagcaagacgagaacgatgatgatgatgactggaatccatgtaaagccgctggagtgtgcctgatgcttttagctacttgttgcgaggacgacatcgtgcctcatgtcttgccttttatcaaagagcacattaaaaaccctgactggcggtatagggacgctgctgtcatggctttcgggtgtattctggaaggtccggagccgtctcaactgaagcctctggtcattcaagccatgcccacactcattgaattaatgaaagacccttcagtggtagtcagagatacagcagcctggaccgtcggacgaatatgtgaactgttgcctgaggccgcaattaacgacgtctacttggccccactcctgcagtgtctcatcgaaggcctttcagcggagccccgagttgccagtaacgtgtgctgggctttcagttccctggcagaggccgcatatgaggcagcggatgttgccgacgatcaagaagagccagctacttattgcttaagttcctccttcgaactgatcgtgcagaagctacttgagacgacagacagacccgatggacaccagaacaacctgaggagctccgcttacgagtccctcatggagatcgttaagaattcagcaaaggattgctacccagcggtgcagaagaccaccctcgtgattatggagagattgcagcaggtactgcagatggaatcacacatacaatccacgtctgacagaatccagtttaatgacttgcagtcactgctgtgtgccacactgcagaacgtgttgaggaaggtgcagcaccaggacgcccttcagatcagcgatgtggtgatggctagtctgctccgaatgtttcaaagcaccgctggctccggcggagtccaagaggatgcgctcatggcagtatctacactcgtcgaggtgctgggaggagagttcttgaagtacatggaagcgttcaagccgttcctgggcatcggcctgaagaactacgctgaataccaagtatgcctggcggcagtggggctcgttggagatctttgtagggcactccagtcgaatatcattcctttctgtgatgaggtgatgcagctgctgttagagaatctcggcaatgagaatgtccataggtccgtgaaacctcaaatcctgagtgtttttggcgacatcgccttagcgatcgggggagagttcaaaaaatacctggaagtcgtgctgaatacgctgcagcaagcatcccaggcacaggttgataagagcgactacgatatggtcgactacctgaatgaattgagggaatcctgcttggaagcatacacaggtattgtacagggactcaagggagaccaggagaacgtgcatccggacgtgatgctggttcagcccagagtggaattcattctatccttcatcgatcacatagccggagacgaagaccacaccgatggcgtggtggcctgtgccgcaggattgattggtgatctgtgtaccgccttcggtaaagatgtgttgaagctggtggaagccaggccaatgatccacgagctgctcaccgagggacggagatctaagactaacaaggcaaagacattggcaacctgggcgactaaagaactgaggaaattaaagaatcaagcctag

SEQ ID NO: 227574 - DNA, 2196 bp, Artificial Sequence
  Description of Artificial Sequence: Synthetic coding sequence
atgaaggaatcgaccctggaagccattgggtacatatgccaggacatagatcccgaacagctccaggataaatccaacgagatcctgactgcgataattcaaggcatgaggaaagaggaaccttccaacaacgtaaagctggcagctacgaatgctctgctgaacagtcttgagttcactaaagctaacttcgataaagagtccgagcgacacttcatcatgcaggtcgtttgcgaagcaactcaatgccccgatacaagagtgagggtcgccgctttgcagaacctggtaaaaatcatgtcattgtattaccaatatatggaaacatatatgggacccgctttattcgctataactatcgaagccatgaagtccgacattgatgaggttgccctgcagggaatcgaattctggtcaaatgtgtgtgacgaagagatggatcttgccatagaggccagcgaggccgctgaacaaggccgaccacccgagcatacgtccaagttttacgcaaagggggcactgcagtacttggtgcccatcctgactcaaacactaactaagcaagacgaaaatgacgatgacgacgattggaacccgtgtaaggccgctggcgtgtgcttaatgctcctcgctacttgctgtgaggacgatatagtgccccatgttcttccgtttatcaaggagcatattaaaaaccccgattggagataccgagacgccgctgtgatggctttcgggtgtattctcgagggacctgaacccagccaactgaaaccgttagtcatccaagccatgcccaccctgatcgagcttatgaaggacccaagcgtggtagtccgggacactgctgcctggacggttggccgtatctgcgaactactgcccgaggcagcaatcaacgatgtctacctggccccactgctgcagtgccttattgagggactgtccgctgaacccagagtggccagtaacgtttgctgggcattctcatccctcgccgaagccgcttacgaggcagcggacgtagccgacgaccaggaagagccagctacctactgcttaagcagctccttcgaactcatcgtgcagaagcttcttgaaacaacagaccgccctgatggacaccagaacaatctccggtcaagcgcctatgaatctttgatggagatagtgaaaaacagcgccaaagattgctacccagcagtacaaaagaccacactcgttatcatggaaaggctgcagcaggtactgcaaatggaaagccatatacagagtacatcagatcggatccagttcaacgatttacaaagtctcctctgcgctacactccagaacgtactgaggaaggttcaacaccaggatgcgctccagatctctgatgtagtgatggcttcactcttgcgcatgttccagtcgacggccggaagcgggggagtgcaggaggacgccctaatggctgtgtccactctcgttgaagtgctgggcggtgagttcctgaagtacatggaagccttcaagccgttcctcggaataggcctaaaaaattacgctgagtaccaagtttgccttgccgctgtgggattggtgggagacctctgccgggcactgcagagcaatattatccctttttgtgacgaagtcatgcaactgctactcgaaaacctcggcaatgaaaatgttcatagaagtgtgaagccgcagattctctcagtttttggcgatatcgccttggcaattggcggagaatttaagaaatatctggaggtggtgctaaacactttgcagcaggcaagccaggctcaggtagacaagtcagactacgacatggttgactacctgaacgaattgcgcgagagctgtctggaggcatacacgggtatcgtgcagggattgaagggcgaccaggagaatgttcacccagacgtgatgttggtgcaaccgagggttgagttcattctgtcgttcatcgaccacatcgccggagacgaagaccatactgacggggtggtggcatgtgctgccggacttattggagacctgtgtactgccttcgggaaggacgtcctgaagttggtggaggccagacccatgattcatgaactgctgaccgagggcagaagatctaagacaaacaaagccaaaactctagcaacatgggccactaaggaactgcggaagttaaaaaatcaggcttag

SEQ ID NO: 227575 - DNA, 1983 bp, Artificial Sequence
  Description of Artificial Sequence: Synthetic coding sequence
atgaaggagtccactcttgaggcaatcggttacatctgtcaagatatcgatcctgagcagctgcaggacaaatccaacgagattcttaccgcaattatccaaggcatgcggaaagaagaaccctccaacaatgtcaaactcgccgctactaatgccttactcaactctctggagtttacgaaggctaattttgataaggaaagcgagaggcactttataatgcaagtcgtatgtgaggcaactcagtgccctgacacacgcgtgagagtggcggctcttcagaacctagtgaagatcatgagtctgtactaccagtatatggaaacatatatgggccctgccctgttcgctgacgagaacgacgacgacgacgactggaacccttgcaaggctgccggagtttgcctgatgctccttgcaacatgttgcgaggatgatatcgtaccccacgtgctcccgttcatcaaggagcacataaagaatcctgactggaggtatcgagacgccgcagtgatggcctttggctgcatcttggaaggtccagagccaagccagctgaagcctttggtgatacaggccatgcccacgctcattgagctgatgaaagatccgtccgtggtcgtgagagatacagccgcttggacggtaggccgtatttgcgagctgttacctgaagctgctattaacgacgtgtacctggccccactgcttcagtgcttaattgagggcttatcagcagagccccgagtagcctcaaacgtgtgctgggctttctcgtcattggcggaggctgcttacgaagcagctgacgtcgctgacgatcaagaggaaccagccacctactgtctgagctctagctttgaactgatcgtgcaaaaactcctcgaaaccactgaccgccctgatgggcatcagaacaatttgaggtcatctgcgtacgaatctctcatggagatcgtgaagaactctgctaaggattgttaccccgctgttcaaaaaacaaccttagtgattatggaaaggttgcagcaggtacttcaaatggagagccatatccaatccacgtctgaccgaatacaatttaacgatttgcagtccctcctgtgtgccaccctgcagaatgtactccggaaggtgcagcatcaggatgccctgcagattagcgacgtggtgatggcttcccttctgaggatgtttcagtctactgctggatccggaggggtgcaggaggatgccttaatggctgtgagtaccctggtggaggtgctcggaggagaatttctgaagtacatggaagcctttaagccatttcttgggattgggctgaaaaactatgcagaatatcaggtgtgcttagctgctgtggggttggtcggcgatctgtgtcgggctctgcagtcaaacatcatacctttctgcgatgaggttatgcagttgctgttggaaaacttgggaaacgaaaatgtccataggtcagtaaaaccacagatcctgagcgtttttggggatatcgctctggccattggaggtgaattcaagaagtatctggaggtggtgctcaacacactgcaacaggcctcacaagcccaggtcgataaatccgactatgatatggtggattacctgaatgagctgagggagagctgtcttgaggcctacacaggcattgtgcagggactcaagggggatcaagaaaacgttcatccagatgtcatgttagtccagcctagagtcgagttcatcctctccttcattgatcacatagccggagatgaggaccacaccgatggagtcgtggcttgtgcagcaggactgatcggggacctgtgcaccgcattcgggaaagacgtccttaagctcgtggaagctcgacctatgattcacgagctgctgacggagggcaggagatctaagaccaacaaggcaaagacactggccacgtgggcgactaaagagctcagaaaactcaagaaccaggcgtag

SEQ ID NO: 227576 - DNA, 2196 bp, Artificial Sequence
  Description of Artificial Sequence: Synthetic coding sequence
atgaaggagtctaccctagaagccatcgggtatatttgtcaggacatagatcctgagcaactacaagataagagtaatgagatcctcacggcgattatacagggcatgcgcaaggaagagcctagtaataatgtaaaactcgcggcaaccaatgccctgctgaactctttggagttcacgaaggccaactttgacaaggagagcgaacgccactttatcatgcaggtggtttgtgaggccactcagtgccctgatacacgcgtgcgcgtagctgccctgcagaacttagtcaagatcatgagcctgtactaccaatacatggagacttatatggggcctgccttgttcgccattacaatcgaagccatgaagagcgacatagatgaggtggcactgcagggcattgagttctggagtaatgtgtgtgatgaagagatggatctggcaattgaagctagcgaggctgctgagcagggccgacccccagagcatactagtaagttctacgcaaaaggcgctctgcagtacttggtgccaattcttacgcaaactctcacaaagcaggacgagaatgacgatgacgacgattggaatccatgcaaagccgctggggtgtgcctaatgctgctggccacctgctgcgaagatgacatcgtgccacacgtgctgcccttcataaaggaacacatcaaaaatccagactggaggtatcgggatgctgctgtaatggcattcggctgcattctggaagggcctgagccctcacaattgaaaccactggtcatccaggccatgccaaccctgatcgagttaatgaaagatcccagcgtagtggtgcgtgacactgctgcctggacggtcgggagaatttgtgagctcttgccagaggccgctattaatgacgtctatcttgcacctctactacagtgcttgatagaagggttgtccgccgagcctagagtggcaagtaacgtatgctgggcgtttagcagtctcgccgaggccgcttatgaggcggcagatgttgcagacgaccaggaggagccagctacatactgtctgtccagctccttcgagcttatagtccagaagcttcttgagaccaccgataggccagacggtcatcagaataacctgagaagctcagcgtacgagtccctgatggagatcgtgaagaatagcgcaaaagactgctacccggctgtgcagaagaccaccttggtgatcatggaaaggctccagcaagtgcttcaaatggaatctcatattcagtccacatctgatcgcattcagttcaacgaccttcaatctctgctctgtgccaccctccagaacgtgctaagaaaggtacagcaccaggatgctctgcagatttccgacgtggtgatggcctcgctattgagaatgttccagtccacggcgggaagcggcggagtgcaggaggatgcgctgatggctgtctctacattggtagaggtccttgggggtgagtttctgaaatacatggaagcatttaaaccctttcttggaattggccttaaaaattacgcggagtatcaggtctgcttggcggcagtgggcctggtgggagacctttgccgcgcactgcaatcaaacataatcccattctgcgatgaggttatgcaattattattagagaatctcggaaatgaaaacgttcatcgaagcgtgaaaccacaaatcctgagtgtgttcggcgacattgcgttagccattggtggagaatttaaaaaatatcttgaagtcgttctgaatactctgcagcaggcgtcacaggcccaggttgacaagagtgattatgacatggtggattacctgaacgagctgagggaatcctgccttgaggcgtataccgggatcgttcagggactaaaaggcgaccaggagaacgtgcaccccgacgtcatgctggttcagccccgtgtggaattcatcctgagcttcattgatcatatcgcaggcgatgaggatcacacggacggcgtagtagcgtgcgccgctggcctaattggagatttatgcacggccttcggcaaagacgtgctgaagctcgtcgaggctaggccaatgattcacgaattactgaccgaaggacgacggtctaagacgaacaaggccaagactctggccacttgggccacaaaggagctcagaaaactaaagaatcaggcctag

SEQ ID NO: 227577 - DNA, 1617 bp, Artificial Sequence
  Description of Artificial Sequence: Synthetic coding sequence
atgacaacccctggaaaagagaacttcagattgaagtcttataagaacaaatcactaaatcctgatgaaatgcggcgtagaagggaagaagagggccttcagctgaggaaacagaagagagaagaacaactgttcaagcgaagaaatgtggcgaccgcagaggaagaaaccgaggaggaggttatgtccgatgggggtttccatgaggcccagattagtaacatggagatggcccctggcggagttatcacaagcgacatgattgagatgattttctctaagagtccggaacagcaactgagtgccacccagaagttcaggaaactcctttctaaggagcccaaccctccaatagatgaggtgatctctacacccggagttgtcgcacgatttgtagagttcctgaagcgcaaagagaactgcacgctccaatttgagagcgcatgggtgcttactaacattgccagcggaaactcattgcaaactaggattgttattcaggccggagcggtccctatctttatcgaactgctcagttcagaatttgaggacgtgcaagagcaggctgtctgggctctgggaaacatcgccggagattcaaccatgtgcagagactatgtgcttgattgcaacatcctgccacctctgttacaactcttcagcaagcagaatagacttactatgactcggaacgcagtgtgggctctctcgaacctgtgtcgcggaaagagccccccaccagaatttgcaaaagtgtcgccttgcctaaatgtgctctcctggctcctctttgtctcagacacggatgtgctggctgacgcctgttgggcactgtcatatctgtctgatggccctaacgacaaaatccaggccgtgatcgacgcaggggtttgcagacgcttagttgaactactcatgcataatgattacaaagtggtctctccagccctccgggctgtcggaaatatcgtcactggtgatgacattcagacccaagtgatacttaactgctcggctcttcagtccctgctgcacctcctgtcctcacctaaggagtccattaagaaagaggcatgttggacgattagtaatatcactgccggaaatcgagcccagattcagaccgtgatagacgccaacatctttcctgctctgatctccatcctgcagacagcggagtttcggacacgaaaggaagcggcttgggccataacaaatgcaacatccggagggagcgctgaacagatcaagtacttggtggaactgggatgtattaagccactgtgtgatctcttgaccgtgatggattccaagatagttcaagtcgccttgaacggcctggagaacatcctcagactgggggaacaggaggctaaaagaaacggcactggcattaatccatactgcgcgctcatcgaagaagcatacggacttgataagatcgagttccttcagagccatgaaaatcaagaaatctatcagaaggcgtttgatctcattgaacattatttcgggacagaggatgaagactcgagcatcgcaccgcaagttgacctgaaccagcaacagtacatcttccaacagtgtgaggctcccatggaaggcttccagctctag

SEQ ID NO: 227578 - DNA, 987 bp, Artificial Sequence
  Description of Artificial Sequence: Synthetic coding sequence
atgacaacacctgggaaagagaattttaggctcaaatcttacaagaacaaatcccttaaccccgacgaaatgcggagacgacgagaggaggagggattgcaattgcgaaaacagaaacgtgaagaacaattgttcaagaggcgaaatgtggcaactgcagaagaggaaacagaggaagaggtgatgtctgacggcggatttcacgaggcacaaatttcgaatatggaaatggcccctggcggtgtaataacatcagacatgattgagatgattttctccaagtcacctgagcaacagctgtctgcgacacaaaagtttcggaaacttttaagcaaggaaccaaatcctcccatagacgaagtgatttctacacccggtgttgtggccagatttgtagaattcctgaagcgtaaggagaattgtacacttcagttcgaaagcgcctgggtactgacaaatatagcttccggtaacagtcttcaaacccggattgtgatccaagccggagcagtccctatctttatcgagttgctttccagtgaattcgaggatgtgcaggagcaggctgtgtgggcactgggcaacatcgccggagactcaaccatgtgccgtgactatgtcctcgactgtaacattcttccaccactccttcagctgttttccaagcagaacaggctcacaatgacgcgcaacgctgtttgggctttgagcaacctctgtcggggaaaaagcccacccccagaattcgctaaggtgagtccctgccttaacgtgctctcctggctcttgttcgtatccgataccgacgtgctcgcagacgcatgttgggcgctgtcttacctctccgatggccctaacgataaaatccaggcagtgattgatgctggagtttgtagaaggctggttgagctgctgatgcacaacgattacaaggtcgtctcccccgctctccgggctgtgggcaatatagttacgggggatgattag

SEQ ID NO: 227579 - DNA, 648 bp, Artificial Sequence
  Description of Artificial Sequence: Synthetic coding sequence
atgactacacccggtaaagagaattttcgtctgaagagttacaagaacaaaagtctgaatcctgacgagatgcggagacgtcgggaggaggagggactgcaattgcgcaagcagaagcgcgaggaacagttattcaaaagacgcaatgtcgccacggccgaggaagagacagaagaagaggtcatgtctgatgggggtttccatgaggcccaaatcagtaatatggagatggctcccggaggagtgataacctctgatatgattgagatgatattttctaagagccctgaacagcagctgagtgctacacagaagtttcgcaagttgttgtccaaggagcctaatccaccgatcgacgaggtgatcagcaccccaggtgtggtagcaaggtttgtcgaatttctgaaaaggaaggagaattgcactctgcagtttgaaagcgcctgggtactcaccaacatcgcttctgggaacagtcttcaaacacgcatcgtgattcaggccggagcagtgccaatctttattgagctcctgtcatccgaatttgaggacgtgcaggagcaggcagtctgggccctgggtaatattgcaggagacagtacaatgtgcagggactatgttctggattgcaacatacttcctccctag

SEQ ID NO: 227580 - DNA, 525 bp, Artificial Sequence
  Description of Artificial Sequence: Synthetic coding sequence
atgactacacccggtaaagaaaattttcggctgaagtcctataagaataagagtctcaaccccgacgaaatgcggcgtcgaagggaggaggaggggctgcagctgcgtaaacagaaacgcgaggaacaactattcaagaggcgcaatgtcgccactgcagaggaagagaccgaagaagaggtaatgagcgatggaggattccacgaagcacagataagcaatatggaaatggctcctggtggcgtgataacttcagatatgattgagatgatttttagcaagtcccctgaacaacagctgagcgctacacaaaagttccggaagctcctgtccaaagagccaaatccgcctattgacgaggtcatctcaacgccaggagtcgtagccaggttcgtggagtttctcaaaaggaaagagaactgtactttacagttcgagtcagcatgggtgctgactaacatcgcatccgggaactcccttcaaacccgcatagtgattcaggctggggctgttccaatcttctag

SEQ ID NO: 227581 - DNA, 1566 bp, Artificial Sequence
  Description of Artificial Sequence: Synthetic coding sequence
atggccgaaaatcctagcctcgaaaaccacagaatcaagagctttaagaacaaaggaagagatgtggagacaatgagacgtcaccgtaatgaggttacagtcgagctgaggaaaaacaaacgggatgaacatctcttgaagaaaaggaatgtcccacaagaggaatccctcgaagacagtgatgtagacgcagacttcaaggcccagaacgtgacgttagaggccattttgcaaaatgctactagcgataaccccgttgtccagttgtcggccgtgcaggcggctcggaaactgctgtcatcagaccgcaaccccccaattgacgatttgattaagtccggaattttgccgattctggtaaaatgtctagagcgagatgataatccctccctacagtttgaagctgcctgggcactgaccaacatcgcgagcggtactagcgcgcagacacaggcggtggtgcagagtaacgctgttcctcttttcctgcgacttctacgtagcccacaccagaacgtttgcgaacaggcagtatgggcgttgggcaacatcattggagacggtcctcagtgccgagactacgtcattagcctcggcgtggtaaagcctctgttatcatttatatcgccgtccattcccatcacctttctacggaacgttacatgggtgatcgttaacctctgtcggaacaaggacccacctccgccaatggaaacagtacaggaaatcctaccagcactgtgcgtgcttatctaccatacggatattaacatcttagtcgacactgtctgggcccttagctatctgactgacggaggaaacgagcagattcaaatggttattgactccggcgtcgtgccttttctggtacccctcctgtctcaccaagaagtgaaggtgcagacggcggctcttcgcgcagtcgggaacatcgtcaccgggactgatgagcagacgcaggtggtcctcaactgcgacgtgcttagccattttcccaacctcctgtctcacccaaaggaaaaaattaacaaggaggcagtgtggtttttgagcaacatcacagccggtaatcagcagcaggtgcaagccgtgatcgatgccggactaattccgatgattatccaccagctggcaaagggcgatttcggcactcagaaggaagccgcatgggccatctctaaccttactatctccggacgcaaagaccaggtcgaatatctggtgcaacagaacgtcatcccacctttttgtaatcttctctccgtcaaggattcccaggtcgtgcaggtcgtgctggatggcctaaaaaatatcctgatcatggcaggcgacgaagcctccacgattgccgagattatagaggaatgtggcggactcgagaaaatcgaagtcctgcaacagcacgaaaatgaggatatttataaacttgcctttgaaatcatcgatcagtatttctccggcgacgacatcgatgaggatccttgtttgatcccagaggcgacacaaggaggaacatataactttgatcctacggccaacctgcaaactaaagagtttaacttttag

SEQ ID NO: 227582 - DNA, 1566 bp, Artificial Sequence
  Description of Artificial Sequence: Synthetic coding sequence
atggccgacaacgagaaactagataatcagcgcctcaaaaacttcaagaacaaagggagagacctggagaccatgcgcaggcagcggaacgaagtggtggtggagctgcgaaagaataagagggatgaacacctgctgaagcgacgcaacgttccacatgaagatatctgcgaagacagtgacattgatggcgattatcgtgtgcagaacacatcattggaggctatcgtgcagaatgcatcctcggacaaccaaggaatacagctcagtgccgtgcaggccgcaaggaagctcctcagcagtgacagaaaccctcctatcgacgaccttataaaatctggaattttgcccattttggtccattgcttagagagggatgacaatcccagtctacagttcgaggccgcttgggccctcacgaatatcgctagcggcacttcggaacagacccaggctgtagttcagagcaacgccgtgcctctcttcctccggttactgcacagcccccatcagaacgtctgtgagcaggccgtttgggcactcggcaacattataggcgacggcccacaatgcagggactacgttatttcactaggtgtcgtgaaacccctgctttcttttatctcgccctccatcccaatcacattcctgcgcaatgtgacctgggtgatggtgaacctgtgtaggcacaaggacccccctccccctatggagactattcaggagatcctgccggcattatgcgtgctgatacaccacacagacgtcaatatattggtggacaccgtgtgggcgttgagttacttaaccgacgctggaaatgagcagatccagatggtcatagattcagggatcgtaccccatcttgtgccacttctgtcccaccaggaagtcaaagtccaaacggccgctctacgtgctgtaggcaacatagtaactggaacagatgagcagactcaggtagtgctgaactgcgacgccctgtcccatttcccagcacttctcacacacccaaaggagaagatcaataaagaggccgtgtggtttctctcgaatataacagcaggtaatcagcagcaagttcaggccgttatcgatgccaatctcgttcccatgataatacatctactggataagggagactttgggacacagaaagaggccgcttgggcaatttcgaaccttactatctctgggagaaaggatcaggtggcatatttgatccagcagaatgtgattcctcctttttgtaatctgctgaccgtgaaagacgcacaggtggtgcaggtggtgttggacggcctgagcaatatactgaaaatggcagaagatgaggccgagaccatcgggaatctgatagaagagtgcggcggtctggagaaaatagaacagttgcagaatcacgaaaatgaggacatttacaaactggcctatgagattatcgaccagttcttcagcagtgacgacatagacgaggacccgagcctggtgcccgaagctatccagggcggaacctttggctttaactctagtgctaacgtgcctaccgaggggtttcaattttag

SEQ ID NO: 227583 - DNA, 1551 bp, Artificial Sequence
  Description of Artificial Sequence: Synthetic coding sequence
atgccaactctcgatgcacctgaggaacggcgacggaagtttaaatatcgtggtaaggacgttagcttacgtcgccagcagcgcatggccgtgagccttgagctcagaaaggctaaaaaagacgagcagactctgaagcggaggaacatcacttctttttgcccagacacaccttcggagaaaacagccaaaggcgtggccgtgtcactgaccttaggcgaaattattaagggcgtgaatagctccgatcctgtgctttgtttccaggctactcaaaccgcaagaaaaatgcttagccaggaaaagaacccccctctgaaattggtgatcgaagccggtcttatccccaggatggttgaattcctgaagagctcactgtatccttgcctgcagtttgaagccgcatgggctctcacaaacatcgccagtggcaccagcgaacagactagagcagtggtagagggtggggctatacagccactgatagaattactttcctcttctaatgtggccgtttgtgaacaggccgtgtgggccctgggcaatatagccggagacggcccagagttccgtgataatgtgattacatccaacgccatcccccacctcttggcacttatctccccaaccctgccaataacctttctacggaacatcacatggacgctctcaaacctgtgcaggaataaaaatccatatccctgtgacacagccgtgaagcagatcctgccggcacttctgcacttactgcagcatcaggatagtgaggttttatctgatgcttgttgggctctgagctacctgaccgacggctcgaataaacggataggtcaggtggtgaacaccggggtgttgccccgattggtggtgctgatgacaagctctgaactgaacgtcctgacaccgagcctccgcaccgttggaaatatcgtgaccggcaccgatgagcagactcaaatggctatagacgctggtatgctgaatgttttaccccaactgctacagcacaacaagcccagtattcagaaagaagccgcttgggcgctcagtaatgtggctgcgggtccctgtcaccatatccaacagttgttggcttatgacgtgcttccacccttagtggcccttctaaagaatggcgagtttaaggtccagaaggaggctgtctggatggtggctaacttcgccactggcgcaaccatggatcagttgatccaattagtgcatagcggagtgctggaacccctagttaatctgctcactgcccctgatgttaagatagttctgatcatcttagacgtgattagttgtattctgcaggcggcagaaaaacgttccgaaaaggaaaatctgtgtttgctgattgaggaactgggaggtatcgacaggattgaagcactccagttgcacgaaaataggcagattggccagagtgcattaaacattatcgagaaacacttcggagaagaggaagacgaaagccagacactgttatcacaggtgatcgaccaggactatgaatttatcgattacgagtgtctggctaagaaatag

SEQ ID NO: 227584 - DNA, 3318 bp, Artificial Sequence
  Description of Artificial Sequence: Synthetic coding sequence
atggccgctatggccccagccctgactgatgccgctgcagaagctcaccacatccgctttaaactcgcacctccttccagtacactctctccgggttctgcagagaataacggcaacgcaaatattctcattgccgctaatggtactaaaaggaaagcgattgccgctgaagacccttccttggattttaggaataatcccactaaagaagaccttgggaagttacagccgctggtggcgtcttacttgtgctctgatgtgacctctgtcccctctaaagagagcctcaagctgcagggcgtattcagcaagcagactgttctgaagagtcatcctctgttaagccagtcttatgaactcagagctgaacttctcggaagacagcctgtgctagagtttagtctcgaaaatctgaggactatgaatacgtccgggcaaaccgcgctcccgcaagccccagtgaacgggctggccaagaagttgacaaaatcttcaacccattctgaccacgataatagcaccagcctgaatgggggaaagagggctctcacctcctctgccctgcatggtggagagatgggcggtagtgaatcaggtgatctcaagggcggtatgacaaactgtaccctgcctcaccgaagtcttgacgttgagcatacgacactctattctaataacagtacagcgaataaatcaagtgttaactcaatggagcagcccgctctccagggatcatctagactttctccaggtacagactcctcgtccaaccttgggggagtaaaactcgagggtaaaaaatcccccctgagctcaatcctttttagtgccctggactccgacacccgaataaccgcactcctgcgtcggcaggctgatatagagtccagggctcgtagacttcagaagcgcctgcaggtggtgcaagccaaacaggtcgaacgccacattcagcaccagctaggcggatttctggaaaagacactctctaaacttcctaatctggagtccctccggccacgtagtcagctcatgctgacaaggaaggctgaagcggcactgaggaaagctgcctccgagacaactaccagcgaaggactaagcaatttcctcaaatctaattcaatcagtgaggagctcgaacgcttcactgcatccgggattgccaacctgaggtgctccgaacaagcatttgactcagacgttacagatagttcaagtggaggtgaaagtgatattgaggaagaagaactaacccgagccgatccagaacagagacacgtccctctccgccgacgaagtgagtggaagtgggccgctgaccgagctgcgatcgtgtctagatggaactggcttcaggctcacgtgagtgatctggaataccgtattcgccagcagaccgatatttacaagcaaatcagagccaacaaaggcctcattgtactgggggaagtccctcctccagagcacaccactgacctgttcctgcccttgtcctctgaagtcaagaccgatcacggcacggacaagctgattgaaagcgtcagccaacccttggaaaaccacggagctcgaattataggacacatcagcgaaagcctgagcaccaagtcctgtggtgccctgcgacccgttaacggggtgattaatacactgcagcccgttctcgcggaccatatcccaggcgatagcagcgatgccgaggaacagctgcacaagaagcaaagactgaatttggtctcaagttcatcagacggcacttgcgtcgctgctcgcacaaggccagtcttgagttgcaagaagaggcggctggttcgccctaacagcattgtgccactctcaaaaaaagtgcaccggaatagcacgattagaccaggctgcgatgtgaatcccagttgcgctctttgtgggagcgggtctatcaacaccatgcctcctgagatccactatgaggccccactgctagagcgcctgagccagctggactcctgtgtgcaccctgtgctggcattccccgatgatgtgccaacaagtctccactttcaaagtatgcttaagagccagtggcagaacaagcccttcgataagataaaaccccctaaaaagctttcgctgaaacaccgtgcgccaatgcctggttctttacccgattctgctcggaaggatcgacacaaattggtttcatccttcttgacgaccgccaagttgagccaccaccaaactagaccggatagaacacacaggcagcatctcgacgacgtgggagcagttccaatggtggagcgagttacagcccctaaagcagaaaggctgcttaaccctccacctccggtgcacgaccctaaccacagtaagatgcgactgagagatcactcaagtgaacggtcagaggtgctcaagcaccacacagatatgtcttctagctcatatcttgccgctactcaccaccctccacactctccccttgttaggcagcttagcacatcaagtgattccccggctcccgcatcgtcctcatcacaggttacagcgtctacctcgcagcagccggtgcgcagacggaggggcgagtccagtttcgacataaacaatattgtgattcccatgtctgtggcagcaacaacccgcgtggagaaattacaatataaagaaatactcacgccgtcgtggcgtgaggtggatctccagtccctcaaggggtcccctgatgaagagaacgaggaaatcgaagacctgagtgacgccgcttttgccgcacttcatgctaagtgtgaggagatggagcgtgccagatggctgtggaccaccagcgtacctccccagagaaggggctctaggtcttatcgatcatcagacgggaggacaactccccaattaggctctgccaaccccagtacccctcagccagccagccctgatgtgtccagctctcactccttgtcagaatacagtcatgggcagtcacctagaagcccgatttcccccgaactgcattctgctcctctgactcctgtcgcacgcgacactcctcgccacctggccagtgaggatactcggtgcagcacacccgaattgggcctggatgagcaaagtgttcagccatgggagaggcgaacttttccactggcccatagccctcaagctgaatgcgaagatcaactggacgcccaggaacgcgctgcccgttgtacacgcagaaccagcgggtctaaaacaggtagagagactgaagccgcaccgacgtctcccccaatcgttcccctgaaaagccgccacttagtcgcagcggctacagcacagagaccaacacacaggtag

SEQ ID NO: 227585 - DNA, 1200 bp, Artificial Sequence
  Description of Artificial Sequence: Synthetic coding sequence
atgccgccagagatccactacgaagcgccactgctggaacgcctgtcccaactagattcatgtgtacacccagtgctggcctttccggacgatgtaccaacgtcccttcacttccaatccatgctgaaaagccagtggcagaacaagccattcgataagatcaaaccgccaaaaaaactgtcccttaagcaccgtgcccctatgcccggatctctgcctgacagcgcgcgtaaagaccgccacaaactggtgagctcctttctgactactgccatgctaaagcaccatacagacatgtcaagctcctcgtacctggctgctacccaccacccgcctcatagccctcttgtgcggcagctgtccacttccagtgatagcccggctccagcctcctccagcagccaggtgaccgcaagcacgtcccaacagcccgtgagaagacgcagaggagaaagctcatttgatatcaacaatatcgtgattcccatgtccgtggctgcaactaccagagtggagaagcttcagtataaagagatactgaccccgtcatggcgggaagtcgacctacagtcattgaaaggctccccagatgaggagaatgaggagattgaagatctttctgacgccgctttcgctgccctgcatgccaaatgcgaagaaatggagcgcgctcgttggttatggaccaccagcgtaccgcctcagagacggggtagccggagctacaggagctccgacggcagaactactccacagctgggcagcgccaatccaagcacgccacaacctgcctccccggatgtgagcagctcacactctctgtctgagtactcacatggtcaaagtcccagatctcccatctcaccagaactacacagtgcaccacttactccagtcgccagagacacacccagacatctggcctccgaggacactcgttgtagtacacccgagctgggtctggacgaacagtccgtacagccatgggagcggcgaacatttcccctggcccattctccacaagctgagtgcgaggatcagctggatgcacaggaacgggcagccagatgcacaaggcggacatctgggagtaagactggtagagagactgaggcagctcccacttcaccacctattgtccccctcaaaagccggcatttggtagccgcagccaccgcacagcgaccaacacacagatag

SEQ ID NO: 227586 - DNA, 3318 bp, Artificial Sequence
  Description of Artificial Sequence: Synthetic coding sequence
atggctgctatggcgcctgctctgactgatgctgccgcagaggctcaccacatacggtttaagttggcccctccctctagtactttgtcccccggatccgcagaaaataacggtaatgccaacatcctaattgccgctaacggtacgaagcgaaaggcaattgcagctgaggatccctcgttggatttccgcaacaacccaactaaggaggacctcggtaaactccagcccctggtggcctcgtatttgtgctcagacgtcacaagtgtacccagcaaagagtctttgaagcttcagggggtgttcagcaagcagactgtcctcaagtcccaccccctcctctcccagtcttacgagctacgtgcagagttactcggcagacagccagtgttagaatttagcctcgagaatcttagaacaatgaacaccagcgggcagacggcactgccccaagcccctgtgaacgggctcgcgaagaaacttacgaaatccagtacccattccgaccacgataactctacctccctcaatggtggcaaaagagcgttaacatcttccgccctccacggtggcgagatgggcggtagcgagagcggcgatttgaagggagggatgacaaactgtaccctcccacaccgtagtctggatgtggagcacactacattgtattcgaataacagtacagccaacaaatccagcgtgaatagcatggagcagcctgctttgcaaggctcatcacggttgtctcccggaactgactcgtcctctaatctgggaggcgtgaaactggagggtaaaaagtcccccctgtcttcgatcctgttctccgccctggatagtgatactcgcatcacggctttactgagaagacaggcagacattgagtccagggcacggagactccagaaaaggctacaggttgtgcaggcgaagcaggtagagcgccatatccagcaccagttaggaggcttcctggagaaaacgctgtcaaagctgccaaatctagagtctctgcgccctaggtcccagctaatgctcacaagaaaggcagaggcggcacttagaaaggctgcttccgagaccacaacttctgaggggctgtcaaacttcctgaaatccaactcaatctcagaggagctggaacgctttacagcttccggaatagccaacctgcggtgttcagagcaggctttcgactccgacgtgacagacagtagcagcgggggagagtccgatattgaggaagaggagctgaccagggccgatccggaacagcgacacgtgccgcttagaagaaggtctgagtggaaatgggccgcagacagagctgccatcgtgtcaagatggaattggctgcaggctcatgtctccgatctggagtacagaatcagacagcagactgatatctacaagcaaatcagagcaaataaaggcctgatagttctcggggaagtgccacctccggagcatacaaccgatctattccttccgctgtcttcagaagtaaagactgatcacggaaccgacaaattgatcgagagcgtgagccagcctctcgaaaaccacggtgcgaggattatcgggcacatttccgagagccttagcaccaaatcttgcggagcccttagaccagtaaatggtgtaattaatactctacagccggttttggcagatcacattcccggtgacagctccgacgctgaagaacagttgcataagaagcagcggttgaatctggttagttcgtcatctgacgggacctgcgtagccgctcggacaagacctgttttgtcatgcaagaaacgccgtctagtcaggcctaactctattgtgccgttatccaagaaggtgcatcgaaactcaacaataagacccggatgtgacgttaacccgagctgcgcactgtgcggttctggctcgataaatactatgcctccagaaatacattacgaggccccactgctcgaacgcctttcccagctggatagctgcgtgcatcccgtgctggcttttcctgacgacgtccctaccagtctacatttccagagcatgcttaagagtcagtggcagaataagccgtttgataaaattaagcctccaaaaaagctgtcattgaagcacagggcccctatgcctggaagcctgcctgattcagcccgaaaggacagacacaagctggtgagcagtttcctgaccacggcaaaactgagccatcatcagacaaggcccgaccggactcacaggcagcacttagatgacgtcggcgctgttccgatggtcgagagggttacagcccctaaggcagaaagactgctcaatcccccacccccagtccatgaccccaaccattccaagatgcggctgagagatcactcaagcgaaaggtctgaggtcctgaagcaccatacagacatgtcatctagctcctacctcgctgccacacatcatccccctcacagtccactggtgcgccagctctcgaccagtagcgactctccagccccagcatcatctagcagccaggtgacggcaagcactagtcagcagccagttcgccgacgaagaggcgagagcagcttcgacatcaacaacattgtcatccctatgagcgttgccgcaaccacccgcgtcgaaaagctgcaatacaaagaaattctgacacctagctggcgggaggttgatttacaatcattgaagggatcccccgacgaggaaaacgaggaaattgaagacctcagtgacgcggcttttgctgccttacatgcgaagtgcgaggagatggaacgggcaaggtggctgtggacaacttctgttccccctcagaggagaggaagcagaagctacagatcttccgacggtcgtactaccccccagctggggagcgccaacccatcaaccccacaaccagcttccccggacgtcagctcctctcattccttgtccgaatattcccatggacagtctccgcgtagcccgatcagccctgaattacactcagcacccctgactcctgtggcgagggatactccacgtcatcttgcctcagaagacacgcgctgcagtacgccagaattggggcttgatgaacagagcgtgcaaccttgggagcgcaggaccttccccctcgcccatagccctcaggcagaatgtgaagaccaactggacgcgcaggagcgggctgcacgctgtacgaggcggacctcgggtagcaagaccggcagggaaacagaggctgcacccacctccccccctatcgtgccacttaagtcaagacacctcgtcgccgcagcaaccgctcagcgcccaacccatagatag

SEQ ID NO: 227587 - DNA, 3318 bp, Artificial Sequence
  Description of Artificial Sequence: Synthetic coding sequence
atggccgcaatggccccagcattaactgatgctgcagccgaggcgcaccacatcagattcaaactggccccaccctcttcaactctctcccccggtagtgccgaaaataatggcaacgccaacattctcattgccgcaaatggcactaaaaggaaggcgatcgcagccgaagacccttcattagacttccgtaataatcctaccaaggaggaccttggcaaacttcagccattggtggccagttacctgtgcagtgatgtgacgtcagttccctccaaagagtcactcaagttgcagggtgtcttctctaagcaaaccgtgcttaagagccaccctttgttatcacaaagctacgagctgcgcgctgaacttctgggcagacaacctgtgttagagtttagcctggagaatctgcggactatgaatacctcgggccagaccgcccttccccaggctccggtgaacggcctggccaagaaactgactaaatctagtactcacagtgaccatgacaatagcacaagtctaaatgggggaaaaagggccctgacatcatccgcgctgcatggtggggagatggggggaagcgagtccggagaccttaaaggagggatgactaattgcacgctgcctcaccgaagtctggacgtcgaacacacaactctgtactccaacaactctactgcaaacaagagttccgtgaatagtatggagcagcccgctctgcaggggagctcaaggctgagtccagggaccgatagtagctcaaacctgggtggcgtgaagttagagggcaaaaaaagccccctctcctctatcctcttctctgcgctcgacagcgacacacgaatcacagctttacttaggcgtcaggcggacatagaatccagggcccgacgtcttcaaaaacggcttcaggtagttcaggcaaagcaggttgaaagacacatacagcaccagctcggtggatttttggagaagaccctctccaagcttcctaatctggagagcctacgcccaaggagtcagttgatgctgacccggaaagcagaggccgcactgcgcaaggctgcaagcgagactactactagcgagggcttgtcaaactttttgaagagtaattctatctccgaagagctggaacgttttacagcctccggcatcgcaaacctcagatgttctgaacaagcatttgatagtgatgtgactgatagctcaagcgggggagagagcgacattgaagaggaagaacttaccagggcggaccccgagcagaggcatgtacctctgcgccgacgtagcgagtggaagtgggccgcagaccgggctgcaattgtatcccggtggaactggctgcaagcccacgtatccgatctcgagtatcgtatccggcagcaaaccgacatttacaaacagatccgggcaaacaaaggtttgattgtgttgggcgaggtgcccccacctgaacatacaaccgacctctttttacccctgagtagtgaggtaaagacagatcacggtaccgacaaactgatcgagagcgtctctcagcccctcgaaaatcacggcgcacggattattgggcacatttctgagtctctgagcacgaaaagttgtggggctctgcgtcccgtaaatggcgtgatcaataccctccagcctgtcctcgcggatcatatccctggagattcatcagatgccgaggaacagctccacaagaagcagcggctcaatctcgtgagctcatcgagcgacggaacctgtgtggcagcccgaacgcggcctgtgctcagttgcaagaaaagaagactagtgcgacccaactccattgtacccctgagcaaaaaagtccacaggaatagcaccatcagacctgggtgcgatgttaacccttcatgcgccctatgcggatctggttccatcaacaccatgccacccgagatacattacgaggccccactccttgagagactgtcacaacttgactcttgcgtacatccggtacttgcctttcccgatgacgtgcctacaagccttcactttcagagcatgctcaagtctcaatggcagaataagccattcgataagataaaaccccctaaaaaactctccctgaaacaccgtgctccaatgcccggatccctgcctgattccgcgagaaaggaccgccacaagctggtgtcatcctttctcaccactgccaaactgagtcaccaccagacaagaccagataggacccataggcaacatctcgacgacgttggggctgtccccatggttgagcgggtgaccgcccctaaagcagagcggttgttaaacccacctccacccgtgcacgatcccaaccactctaagatgcgtctgagggatcactcctctgaaagatccgaggtgcttaaacatcacactgacatgagctctagcagctatctcgccgcaacgcaccaccctcctcattcgcccctggttcggcaattgagcaccagcagcgattctccggcaccagcctcctcctcctcacaggtaacggcctctaccagtcagcagccagtccggcgtcggcgaggtgagagcagcttcgatattaataatatagtcattccaatgtctgtagccgctacaacccgggtcgagaagctgcaatataaggagatcctcacacctagttggagagaagttgacctccaaagtctgaaaggatctcccgacgaagagaacgaggagattgaagatctcagtgacgcagcttttgccgctctgcatgctaagtgcgaagagatggagagggcccgttggctctggactacatctgttccgcctcagaggcggggatctcgttcctacaggtcgtctgatgggaggactactccccagctcggatccgccaacccaagcacgccacagcccgcttcacctgatgtctcaagctcccacagcctgtcggagtatagtcatggacagagcccccgatccccgatatcccctgaattgcacagtgctcccctcactccagttgctcgggatacccccagacatttggcctcagaagacacccgctgctcaacacctgaactgggtcttgacgaacaatccgtgcagccatgggaaagacgcactttccccttagctcattcccctcaggctgagtgtgaagatcaattagacgcacaggagagggcagcaagatgtacccggagaacttccggatcaaaaacagggcgtgaaaccgaagcagctcctacaagtccaccaatcgtacccctgaagtcacggcacctggtcgcagccgcaacagcgcaacgcccaacacatcgatag

SEQ ID NO: 227588 - DNA, 3318 bp, Artificial Sequence
  Description of Artificial Sequence: Synthetic coding sequence
atggccgctatggcacccgctttgacagacgctgcggctgaagcacaccatatccggttcaagctagcccctcctagctcaaccctttcaccaggaagcgccgagaacaacggcaatgctaatattctgattgcagccaatggaactaagagaaaagcaattgccgcagaggatcccagcctggacttcagaaataacccaactaaagaggacctgggcaaactacaacctcttgtcgcttcatacttgtgctccgacgtcacaagtgtcccgtccaaagaatccctgaagctgcaaggcgttttcagtaagcaaaccgttttgaaatcccacccattgctcagtcagagttatgaacttcgagctgagctcctaggtcggcagccagtcctggaattcagtctcgagaatcttaggaccatgaatacctcagggcagactgcactcccccaggcaccagtcaatggactggcaaaaaagttgaccaaatcctccactcacagcgatcacgataattcgacaagtctgaacggcggaaagcgcgctctgacaagcagcgccctgcacggcggtgagatgggaggatcagaaagcggcgatctcaaggggggaatgaccaactgtacccttcctcatcgaagccttgacgtggagcataccaccctgtatagtaacaactcaacagccaataagagctctgtcaactctatggagcaacccgctctgcagggcagcagtaggctgtctccgggaaccgatagtagttcaaatttagggggagttaaattggaggggaagaaatcgccgctgtctagcatcctattctctgctttagacagcgatactagaatcactgcgcttctcaggaggcaggctgatatcgaatcccgcgctcgtagactccaaaagcggctgcaagtcgttcaggctaagcaagttgagcggcacatccagcaccaattaggtggattcctagagaaaactttgtccaaacttcccaacctggagtccctccgccctcgctcccagctcatgctgacccgcaaggcagaggccgcactcagaaaggctgcgagcgagaccactacttccgagggactgtctaactttctcaaatccaactccattagcgaggaactggagagattcacggcctcaggaatcgccaatctgagatgtagcgagcaagcttttgactcggatgtgactgactctagctcgggcggtgagtcagacattgaagaagaggaactgactcgcgctgatcccgaacagaggcacgtgccactccgtaggcggtcagagtggaagtgggccgcagaccgggctgccattgtgtctcgatggaactggctccaggcccatgtgagtgatcttgaataccgcattcgtcaacagaccgatatctacaaacagatcagggctaataaaggcctgatcgtcctcggggaggtaccacctccagaacacactaccgacctatttcttcccctctcaagcgaagtgaagaccgaccatggaacagacaaactgattgaaagtgtgagccagccactggagaaccatggagcacgcattataggccacatttcagagtcacttagtactaagagttgcggcgctttgcgacccgttaacggggttataaacaccttacagccggttctggcggatcacattcctggggattcttctgacgccgaggaacagctgcataagaaacaacggctgaatctcgtatcatcttcaagtgacggaacatgcgtggccgctcggacccgccctgttctgtcatgcaagaagagacgcctggtgcgcccaaacagcatcgtcccactgtcgaaaaaggtacacagaaacagcactatccgcccaggctgtgacgtgaacccctcatgcgctctctgtgggtctgggagcataaacacgatgcctcctgaaatccactatgaagcaccgttgctggaaagattgagccagctagattcatgcgtgcatcccgtcttagcgtttcctgacgacgttcctacttccctgcactttcaatcaatgcttaaaagccaatggcaaaacaaaccattcgataagatcaagcctcccaaaaaactgtcgctgaaacatagggcccctatgcccggatccctccctgattcagcaaggaaggaccggcacaagcttgtgagctcttttctcaccacagccaagctgtcccatcatcagaccagacccgaccgcacacaccgtcaacaccttgatgacgttggagccgtgccaatggtagagagagtgaccgcaccgaaagctgaacgtctgttaaacccccctcctccagtacacgaccctaaccactctaagatgaggctccgcgatcatagttcagaaaggtctgaggtcctcaagcaccatacagatatgtccagttcatcctaccttgcggctactcaccacccaccacattcccctctcgtaaggcagcttagcacctccagtgactcgcctgctcccgcttcctcaagctctcaggtgacagccagtactagtcagcaacctgtaaggaggaggaggggggagtcatcattcgatataaataacatcgtcatacctatgagtgtagctgccacaacccgggtcgagaaactgcagtacaaagaaatcttaacaccatcctggagagaagtggatctccagtcattaaagggttcacccgatgaggagaatgaagagatcgaggacctcagtgatgctgcattcgcagccctacacgccaagtgcgaggaaatggaacgtgctaggtggctttggaccacatccgtcccacctcagcgcagggggtcaagatcctaccgctcatccgacggcaggacaacccctcagttagggagcgccaaccctagtactccgcagccggcaagtccggacgtgtcctcgtcgcattctctgagtgagtatagccacggccagtcaccacggtcaccaatttccccggagttacactcagctcctttaacaccagtcgcgcgagatacaccgagacatctagcatccgaggacacccgatgttccaccccagaactaggtcttgatgagcaaagtgtccagccgtgggagaggaggacctttccactcgcacactcccctcaagccgagtgcgaggatcaattagacgcacaggaaagggccgctcgctgcacacggaggacctccgggtcgaagacagggcgagagacggaggctgccccaacgagcccccctatagtcccccttaaaagccgccacttggttgccgctgcgactgcacagcgccctacccataggtag

SEQ ID NO: 227589 - DNA, 936 bp, Artificial Sequence
  Description of Artificial Sequence: Synthetic coding sequence
atgtccctccttatgattagtgaaaacgtgaagctagccagagaatacgctctgctcggtaactacgactcagccatggtgtactatcagggcgtgctggatcagatgaacaagtacctctatagcgtgaaggacacatatctccagcagaaatggcagcaggtgtggcaggagattaacgttgaagctaagcacgtgaaagatatcatgaaaactctggaatccttcaaactagacagcactccactcaaggcagcccagcatgacctgcccgcaagcgaaggagaggtctggagtatgccggtccctgttgagcggcgtccaagcccaggacctcggaaacggcagagttcccaatatagcgatccaaagtcccacggcaaccgaccaagtactactgttcgtgtacaccgatcttccgctcaaaatgtgcacaacgaccgcggaaaggcagtgaggtgtagagagaagaaggagcagaacaaaggtagagaggagaagggcgtcctgatggtcggccctccgggtactggtaaaacactcctggctaaagcggtggctactgagtgcaaaactacatttttcaacgtgtcttcttccactctgacctccaagtatagaggggaatctgagaaattggtgcgtcttctgttcgaaatggctcgattctacagtcccgcaacgatcttcatcgatgaaatcgactcaatttgctcacgccgtgggacatcagaggaacatgaagcaagcaggcgggttaaggccgaactcttggtgcagatggatggtgtaggtggcacatctgagaatgatgaccccagcaaaatggtgatggtgctggctgcaaccaactttccatgggacatcgatgaggccctacggcgacgactcgagaaaagaatttacatccctctccctagtggtatgcggccttag

SEQ ID NO: 227590 - DNA, 1476 bp, Artificial Sequence
  Description of Artificial Sequence: Synthetic coding sequence
atgtcactcctcatgatcagtgagaacgtgaagttagcccgtgagtatgcactgctcggcaactacgattcagccatggtatattatcaaggtgtcctggaccagatgaataagtacctgtattcagtcaaggatacatacctgcagcagaaatggcaacaggtctggcaggagataaacgtggaggccaagcacgtaaaagacattatgaaaactcttgagagctttaagcttgactctacacctctgaaggcagcccagcacgatctgcccgcttccgagggggaggtgtggtctatgccggttcccgtcgagagacgccctagccctgggccaagaaagcggcagtcatcacagtattccgatcctaagtcccacggcaacagaccatctacaaccgtgagagttcataggtcctccgcccagaatgtccacaacgatcggggtaaggcggtacgatgcagagaaaagaaggagcagaacaaaggccgtgaagaaaagaacaagtcgcctgcggctgttactgagccagagactaataagttcgattctactgggtacgataaggatctggtggaagccctagaacgcgacatcattagtcagaacccgaacgtgcggtgggacgacatcgctgatctggtggaggccaagaagctcctgaaggaggccgtagtgctgcctatgtggatgcccgagttctttaaaggaataaggcggccttggaagggagtgctcatggtcgggcctccgggaacaggtaagacactgctggcgaaagcagtggccactgagtgtaagacaacatttttcaacgtgtcgagcagcacactcacatccaaataccgcggtgagtctgaaaagcttgtgcgcctgctgtttgagatggctcggttctactcccctgcaacaatatttattgatgagatcgacagcatctgctcccgaaggggcacctccgaggagcatgaagcttctcgcagagtcaaggccgagctgcttgtgcaaatggacggtgtgggaggcacttctgagaatgacgatccttcaaaaatggtgatggtgctggcagcaacaaacttcccatgggacattgacgaggcgttgcggaggaggctcgagaaaaggatttacatcccccttcccagcgctaaggggagagaggaactcctcaggatttcactcagagaactggagctggctgacgacgtggacctggcttccattgctgagaacatggaaggctacagtggcgctgatattaccaacgtgtgtcgggacgcctcgctcatggctatgagaaggaggattgagggcctcacacccgaagagatccggaacttatcaaaagaggaaatgcatatgcccaccacaatggaggattttgaaatggcactgaaaaaggtgagtaaatccgtctcagcggctgacattgagcggtacgaaaaatggatctttgaattcggcagctgctag

SEQ ID NO: 227591 - DNA, 1476 bp, Artificial Sequence
  Description of Artificial Sequence: Synthetic coding sequence
atgagtctgttgatgatctcagaaaacgtgaagctggcgagggagtatgccttattgggaaactacgatagcgctatggtgtattatcagggtgttctggatcagatgaacaagtacctgtactcagtaaaagacacttacctgcagcagaagtggcagcaggtttggcaggagattaatgtagaagctaagcacgtaaaggacataatgaagaccctggagtcattcaaattggattccacacctcttaaggccgcacagcacgacttacccgcaagcgagggagaagtttggtccatgccagttccggtcgagcgaagaccttctcccggaccacgcaaaaggcagtcatcccagtattcagatcccaagagtcatggaaatagacctagtacaacagttagggtgcacaggtcatccgctcaaaacgtacataacgatcgcggtaaagcagtgcgctgcagagagaagaaagaacagaacaagggccgtgaggagaagaacaagtcgcccgcagccgtgaccgagcccgaaacaaataaatttgacagcactggttacgacaaagacttagttgaggccctcgaaagagacattatcagccagaaccctaacgtgcgctgggacgatatcgctgacctggtagaggcaaaaaaactgttaaaagaagccgtggtgcttcctatgtggatgccagagtttttcaaaggcatacggaggccatggaagggggtgttgatggtgggcccaccaggcacagggaagacattactcgctaaggcagtggctacagagtgtaagaccacattcttcaatgtgtctagcagtacactgacttctaaatacagaggtgaaagcgagaaattagtgcgattacttttcgaaatggcgcgattttacagccctgctaccatatttattgatgagatcgacagcatctgcagccgcagaggcaccagcgaagaacacgaggccagccgacgcgtgaaagccgagctgctcgtgcagatggacggagtcggaggaaccagcgagaacgacgaccccagtaagatggtgatggtacttgccgcaaccaatttcccctgggacatcgacgaggctctgagacgaagactcgaaaaacgcatctatatcccactgccaagcgccaaaggacgggaggagctgttgaggatcagtcttcgggagttggaattggctgacgacgtggatctcgcaagtatcgccgaaaatatggaaggctactccggcgctgacatcactaacgtctgccgcgatgcttcactaatggcaatgcggcgtcgcatcgaggggctcacacccgaggagatccgcaatctgagcaaagaggagatgcacatgccaaccaccatggaagatttcgagatggctcttaagaaagtcagcaaaagcgtcagcgcggctgatatcgaaaggtacgaaaagtggatttttgaatttggctcttgttag

SEQ ID NO: 227592 - DNA, 636 bp, Artificial Sequence
  Description of Artificial Sequence: Synthetic coding sequence
atgtctctcttaatgatctccgagaacgtcaagcttgccagagaatacgctttgctgggcaactatgactccgctatggtctactatcagggggtgctagaccagatgaataagtatctgtacagcgtcaaggatacctatctgcagcagaagtggcagcaggtctggcaagaaatcaacgttgaagccaagcatgttaaggacatcatgaagacactagaatctttcaaactcgatagcacccctctgaaagcagcacaacacgatttgcctgctagcgagggagaggtgtggtctatgcccgtgccagtggaaagaagaccctccccaggaccccgaaagcgccagagttctcaatattccgatccgaaatcgcacggcaatcgcccatccaccacagttcgggtccacaggtctagcgcacagaacgtgcacaatgacaggggaaaggcagtgcggtgtcgggagaaaaaggagcaaaataaggggagggaggagaagaacaagtcaccggcagctgtgacggaacctgaaaccaacaaatttgattcgaccggctacgacaaggacctcgtcgaagctctagaacgcgacattatctcccagaatccaaatgttcgttgggacgacatctag

SEQ ID NO: 227593 - DNA, 843 bp, Artificial Sequence
  Description of Artificial Sequence: Synthetic coding sequence
atgagtctattaatgattagcgagaacgttaaactcgctcgcgagtacgctctcttgggcaactacgactctgcaatggtctattaccaaggagttcttgaccagatgaacaagtacctctactcagtgaaagacacatatctgcagcagaagtggcagcaggtgtggcaggagatcaacgttgaggcgaagcacgttaaagatataatgaaaacactggaatcatttaagctggatagtacgcctctcaaggcggctcagcatgatctacctgctagcgaaggtgaggtatggagcatgcctgtgccagtggagaggcgtccgagccccggacctaggaaacgccagtcatcgcagtatagcgacccaaaatctcatggtaatagaccatctaccacggtacgagtccaccgcagctctgctcaaaacgttcataatgatagaggaaaagctgtgagatgtcgcgaaaagaaggaacagaacaaaggaagggaggaaaagaataagtcccccgctgctgtcaccgaacccgagaccaacaagttcgattctacagggtatgacaaagacctcgtcgaagctctcgagagggacatcatctcacagaatcctaacgtgcgatgggacgacatagcagatcttgtcgaagcgaagaaactactcaaagaagctgtcgtactcccgatgtggatgcccgaattctttaagggtataaggaggccatggaaaggcgtactaatggtcggccctccaggaacaggcaagacattgcttgctaaggcggtggccaccgaatgcaaaaccactttttttaacgtatcgtcatctaccctaacctcatag

SEQ ID NO: 227594 - DNA, 429 bp, Artificial Sequence
  Description of Artificial Sequence: Synthetic coding sequence
atgaattgcagtgagagccagcggttgcggacattattgagccgactcctcttggagttacaccacagagggaatgcctcaggactaggcgcaggacctcgaccatccatgggaatgggcgtcgtgcctgacccgttcgtgggtcgtgaagtaacaagcgcaaagggcgatgacgcttacctgtatatcctactcatcatgattttctacgcttgcctagctggagggctgatcttggcgtacaccaggtcaagaaagctcgtggaagctaaagacgagcctagccaggcctgtgccgaacatgaatgggcgccagggggagccctcaccgctgatgctgaagcggcagctgggtcacaggccgagggacggaggcagcttgcctctgagggactccccgctttagcccaaggcgctgagagggtgtag

SEQ ID NO: 227595 - DNA, 1509 bp, Artificial Sequence
  Description of Artificial Sequence: Synthetic coding sequence
atgtttgggacgctgctgttatactgcttcttcttggccacagttcccgcactagcagagaccggcggtgagcgccagctttcaccagagaagagcgagatctggggcccagggctgaaggcagacgtggtcctgccagcacgctacttttatattcaggcagttgatacttccggaaataagttcacgagtagcccgggagaaaaggtcttccaggtaaaagtatctgctcccgaagaacagttcactagagttggtgtgcaagtcctggacaggaaggatgggtccttcatcgtgcgctatcggatgtacgcgagctacaaaaaccttaaggttgaaattaagtttcaagggcaacatgttgctaagtctccatatatccttaagggaccggtttaccacgaaaattgtgattgtcccctgcaggacagtgcagcctggctgagagagatgaattgtccggagaccattgctcagattcaacgcgacctggcgcactttcccgctgtggaccccgagaagatcgcagtggagatccctaagcgctttggtcaacgccagtctctttgccattacaccctcaaagataacaaagtgtatatcaagactcatggggagcacgttggctttagaatttttatggacgccatacttctgagtctgaccagaaaggtaaagatgccggatgtagagttgttcgttaatttgggtgattggcctctggaaaagaagaagtctaactctaacatccatcctatcttcagctggtgcggttccactgacagtaaggatattgtgatgcccacttacgacttgactgattccgttctcgagactatgggcagggtgtcactcgatatgatgtcagtccaggccaacactgggccaccatgggagagtaaaaactctactgccgtgtggagaggtcgtgactctcgtaaagaacgtctcgagttggttaagctcagcagaaagcatccagaactaattgacgcggcattcaccaactttttcttttttaagcacgatgagaatttgtatggcccaatcgtgaagcacatcagtttttttgatttttttaaacacaaataccagatcaacattgatgggacagtggccgcttaccggctcccttatctcctggtgggcgacagcgtcgtactgaaacaagactcaatctactacgagcatttttataacgagctacagccatggaagcactacatccctgtgaagtcgaacctcagtgacctgctcgagaaactcaaatgggcgaaagaccacgatgaggaagccaagaagatcgcaaaagctggtcaggaattcgcacgcaacaatctaatgggcgacgacatcttttgttattactttaaactgtttcaggagtacgcaaatcttcaggtgagcgagccccagattcgtgaaggaatgaagcgggttgaaccccagactgaggatgaccttttcccatgcacgtgccacaggaaaaagacgaaggatgagttgtag

SEQ ID NO: 227596 - DNA, 1065 bp, Artificial Sequence
  Description of Artificial Sequence: Synthetic coding sequence
atgtccgccggaggaggcagggcctttgcatggcaggtatttccacctatgccgacttgcagagtatacgggacagttgctcatcaagacggccacctgctggtcctcgggggatgtgggcgagctggccttcccttggataccgcggagacactggatatggcatcacacacttggctagcattagctcctttgccaacagctcgtgccggagcagcagctgtggtgctgggtaaacaagtgctggtggtcggaggcgtggatgaagtgcaatcccccgtcgccgctgtcgaggccttccttatggatgaaggacgatgggagcgtagagcgactctgccacaggccgctatgggcgtggctactgtagagcgagacggaatggtgtacgcactgggcggaatgggtcctgatactgcaccacaggcacaggttcgggtttacgaacctcggagggactgctggctgagtctcccatccatgcccaccccctgttacggggctagcacctttcttcacggcaacaagatttacgtgcttggtggtaggcaaggcaaactgcccgtaactgcatttgaagcctttgatctagaggccaggacgtggacacggcacccttctctgccttctcgccgagcattcgctggctgcgccatggcagaaggaagcgttttcagtctggggggattgcagcagcccggaccccataacttttattcccgccctcatttcgttaacactgtggagatgttcgacctagagcacggtagttggaccaaattgcctaggtccctccgtatgagggataagagggctgactttgttgtgggatcgctgggcggacacatagtggccataggcggtctgggcaatcagccctgcccactggggtccgtggaaagcttcagcctcgccagacgaaggtgggaggccttaccggcaatgcccaccgcacggtgctcatgttcctcccttcaggccggtcccagactgttcgtcattgggggtgtcgctcagggaccctcacaagcagtggaggctttatgtctgagggatggcgtgtag

SEQ ID NO: 227597 - DNA, 417 bp, Artificial Sequence
  Description of Artificial Sequence: Synthetic coding sequence
atgtttgacctcgagcacggcagttggaccaaattgcctagaagtctgagaatgagagacaagcgagcggactttgtggtgggttccttaggcggtcatattgtcgcaatcggaggactagggaaccagccgtgccccctgggtagcgtggagagcttctcactagcaagaaggagatgggaagcactccctgcaatgcccaccgcaagatgcagctgttcaagcctgcaggcgggtcccagacttttcgttattgggggtgtagctcaggggccttcgcaggccgtggaggccctatgtttacgagatggggagggcttggtcggtgcagtgcattggagctcttcattgccagaagccgctatctctatggccccttttgctgccgaggacacccattgcggtagcgtcggatag

SEQ ID NO: 227598 - DNA, 1821 bp, Artificial Sequence
  Description of Artificial Sequence: Synthetic coding sequence
atggactctcagagagagctggctgaggagctgcggctgtaccaaagcactctccttcaggacggtctgaaagatctacttgacgaaaagaagttcatcgattgcactctaaaggcaggagacaaatccctcccatgtcatcggcttatactgtccgcttgctccccttactttagagaatatttcttatccgagattgatgaagcaaagaagaaggaggtggtcttggataatgtcgatcccgctatactagatttgattatcaagtatctctatagcgcctctatcgatcttaatgatgggaatgtgcaggacatttttgcattagcttcgaggttccagattccgagcgtgttcactgtctgcgtgagttacctgcagaaacggctggcacccggaaattgcttggccattctgcgacttggcctactgctcgactgcccccgactggcaatctctgcgagagaattcgtatccgataggttcgtacaaatatgcaaggaagaggactttatgcagctgtctccacaggaactcatttccgtcatatccaacgacagcctaaatgtcgaaaaagaagaggccgtgttcgaagccgtcatgaagtgggttagaaccgacaaggagaatcgagtgaaaaacctgagcgaggtcttcgactgtattcggttccgcctgatgaccgaaaaatatttcaaggaccacgtcgagaaggacgacatcatcaagagtaatccggacttgcaaaagaaaattaaagtgctcaaagacgcttttgccggaaaactgcccgaaccctccaaaaatgcagccaaaacaggcgcaggcgaagtcaacggtgatgttggagacgaagatctgctccctggctacctgaacgacatcccccgacacggaatgttcgttaaagacctgattctcttagtaaacgatactgccgctgtggcctacgacccgactgagaatgagtgctacctgaccgcgctggcagagcagatacctcgtaaccacagctcgattgttacacagcagaatcagatctacgtggtcgggggattgtatgtggacgaggagaataaggatcagcctctgcagagttacttctttcaactcgattctattgcttctgagtgggtaggattacctcccctgccgtcggcaaggtgcttgttcggattgggcgaggttgatgacaagatctacgtcgtggctggcaaggatctgcagaccgaagccagtctggacagcgtgctttgttacgaccctgtcgcagccaaatggaatgaagtcaaaaagctgcccattaaggtttatggtcataacgttatctcccacaagggaatgatctactgcttgggtggaaagactgacgacaagaaatgtaccaaccgtgtttttatatttaatcctaaaaaaggcgattggaaagacctggctccaatgaaaataccaagatcaatgttcggagtagccgtccataagggcaaaattgtcatcgcgggtggcgtcaccgaggatggactcagcgcatcagtcgaagccttcgacctgactacgaataagtgggacgtaatgacagagttccctcaagagaggtcgtccatcagccttgtatccctagcaggttcactgtacgctatcggaggattcgcaatgattcagttggagagtaaagaattcgcaccgactgaggtcaacgatatctggaaatatgaggacgacaagaaagaatgggcaggaatgctgaaagagatacgttacgctagtggtgcctcctgcctcgccactaggttaaatcttttcaagctgagtaaactctag

SEQ ID NO: 227599 - DNA, 1377 bp, Artificial Sequence
  Description of Artificial Sequence: Synthetic coding sequence
atggcgagaggaccacagaccttggtgcaagtgtgggtcggcggacagttgttccaggccgacagagccttgctggttgaacattgcggctttttcagaggattgttcaggtctgggatgcgcgagacccgggcagccgaggtccggttaggagtgctgtccgctggcggtttccgcgcaactctacaggtgctgagaggggatcgtccagcactggccgctgaagatgaactcctgcaggccgtggagtgtgccgcattcctccaggctcccgctttggctaggtttcttgagcataacctgacgtccgataactgtgcactactgtgtgatgccgctgccgcttttggcttacgagatgttttccactccgccgctctgttcatttgcgacggggaacgggaactggcagccgagctggcacttccggaggcccgagcatacgttgcggctctcaggcctagtagttatgccgcagtgagtacacatactcccgctcctggtttcctggaagatgccagtagaactctgtgttatttagatgaagaagaggatgcctggagaacgctcgctgccctgccattggaagcatcgaccctattagctggggtggcaaccctggggaataagctgtacattgttggcggagtgcgaggagcatcaaaagaagtggtggaactggggttctgttacgatccggacggaggcacctggcacgagttccccagtcctcatcagccccgatatgataccgctttagccggtttcgatggtagactctacgctataggcggagaattccaacgtactcccatttctagtgtggagcgttatgaccctgcagcaggttgctggtccttcgtagcggatctgcctcaacccgctgcaggtgtcccctgtgcacaggcttgcggcagattattcgtttgtctctggagacccgcagataccactgccgtggtggaatacgcagtccgaaccgacgcctggcttccagtcgccgagctccgaagacctcagtcatacggacattgcatggtggcccatagagactccctttatgtagtgcggaatgggccatcagatgattttctgcactgcgctatagactgccttaacctggctactggacagtggacagcacttccaggacagtttgtgaatagtaagggagctctgttcaccgctgtggtgcgaggggatacagtgtataccgtgaaccggatgttcactcttttgtatgctatcgaaggcggaacgtggagactgttaagggagaaggcagggttccctaggcctggtagcttacagacctttctgctcagactgcccccaggtgcgcctggtccagtgacctcaacaactgcggaattatag

SEQ ID NO: 227600 - DNA, 2247 bp, Artificial Sequence
  Description of Artificial Sequence: Synthetic coding sequence
atgtcggggagcggcagaaaggatttcgatgtaaagcacattctccgcctacgctggaaactgtttagccaccctagcccttccacgggaggccctgccggtggcggatgcttacagcaggacggctctgggagctttgagcactggggaccaagccagtctaggctccttaaatctcaggagagatctggagtgtctactttctggaagaaaccctcctccagttcatcgagctccagctctccgtctagctccagttctagttttaacccactcaatggaacattactaccagtggccactcggttacagcagggcgctcccggacagggcacccagcagcccgcaaggactcttttttatgttgaaagcttagaagaggaggttgtgcccggaatggatttcccaggtcctcatgagaagggcctggtgctgcaggaattaaaggtggagccggataactcctctcaggctaccggggaagggtgtggacaccggctgagttcaacgggccacagtatgaccccgcaatccgatctagactcctcatcaagtgaagagttctatcaggccgttcaccacgccgagcagaccttccggaaaatggagtcctaccttaagcagcaacagctgtgtgatgtaatccttatcgtgggtaatcgtaaaataccagctcatagactggtcctgtctagcgtcagtgactactttgccgctatgtttacctctgatgtttgtgaagcaaagcaagaagaaatcaagatggaaggcatagaccctaacgccctctgggacttggtgcagttcgcctatacgggatgcttggaacttaaggaagacaccattgaaaaccttctggcggctgcctgcctgctgcaactgccacaagtcgtggaggtgtgttgccactttctgatgaagctgctgcatccaagcaattgcctgggaatcagggctttcgcagacgcccaaggatgcatcgagcttatgaaggttgcgcactcatacactatggagaacattatggaggtgataagaaaccaagaatttctgcttctgccagctgaagagttgcacaagctgctggcaagtgatgacgtgaacgtcccggatgaagaaaccatttttcatgctttgatgatgtgggttaagtatgacatgcaaagccggtgtaatgatctgtctatgctgctcgccttcattagattacccctgctgcctcctcagatactggccgatctggagaaccatgcgctgttcaagaacgacttggaatgtcagaaactgatcctggaggccatgaaataccatctcctgccggagcgtcgtacccttatgcaatccccaaggacaaaacccagaaaatcaactgtgggcacgttgtacgccgtgggtggcatggacaacaataagggagctaccaccatcgaaaaatatgacctgaggaccaacctgtggatccaagctgggatgatgaatgggaggagactccagtttggagtcgcagtgattgacgataaattgttcgtcatcggaggtcgggacggacttaagaccttgaacactgtggaatgttacaacccgaagactaagacatggactgtgctgccaccgatgtcgactcacagacatgggctgggcgtaacagtgctggaaggccctatctatgccgtgggtggccacgacggatggtcctatctcaataccgttgaaagatgggatccccaaagccagcagtggacatttgtagctagtatgagcatcgcccgatccacagttggagttgccgctttgaatggaaaactctactcagtcggcggtagggacggaagttcatgtctcagttcaatggaatattatgatccccacacaaataagtggaatatgtgcgcacctatgtgcaagcgcagaggcggagttggagtcgctacatgtgacggatttctctacgccgtggggggacacgatgctccggcaagcaatcattgttccaggttgctggactacgtcgagcgttacgaccccaagaccgacacttggaccatggtggcacccctcagcatgcctagagacgccgtaggcgtctgtctgctcggcgacaggctttacgcagtggggggatacgacggacaaacctatcttaataccatggaatcctacgacccccagaccaacgagtggacccaaatggcctctttgaatattgggagagctggagcttgtgtggtggtgattaagcagccctag

SEQ ID NO: 227601 - DNA, 1668 bp, Artificial Sequence
  Description of Artificial Sequence: Synthetic coding sequence
atggatttcccaggaccccatgaaaaaggattggtactgcaagagcttaaagtcgaacccgataactcgagccaggcaactggcgagggatgcgggcaccggcttgttctctcctctgtgagtgactatttcgcagcgatgttcacgagtgatgtgtgcgaggctaaacaagaggaaatcaagatggaggggatcgaccccaacgcactgtgggatctcgtgcagtttgcctacactggctgcctggagctgaaggaagataccattgagaacttgcttgctgctgcttgtctgctgcagctgccccaggtggtggaggtctgctgtcatttcttgatgaagttgttgcacccttcgaactgcctgggcatacgcgcattcgctgacgcccagggatgcattgagcttatgaaagtagcccattcatataccatggaaaatatcatggaggtcattcgcaatcaagaattcttactgttgcctgctgaggaactgcataaactgctcgccagcgacgacgtaaacgttcctgatgaggaaacaattttccatgccctgatgatgtgggtaaagtatgatatgcagtctaggtgtaatgacctgtctatgctgctcgccttcatcaggctccccctcttaccccctcaaattttagctgacttggagaatcacgccctattcaaaaacgacttggagtgtcagaagcttattttagaagccatgaagtatcacctccttcccgagaggcggacccttatgcaatcgcccaggaccaagccgaggaagtccacagtcggaaccctctatgccgttggcggtatggataacaacaagggggcaaccaccatcgagaaatatgatttacgtacaaatctgtggatacaggccggtatgatgaatggccgtcgcctccagttcggagttgcagtgattgatgacaaactgttcgtgatcgggggtcgggatggactgaaaacacttaataccgtcgagtgctacaatcccaagacaaaaacatggaccgtgttaccccctatgtccactcatcggcacggtcttggagtgactgtcttggaaggcccaatctacgctgtgggaggccacgacggctggtcctacttgaacaccgtggagagatgggacccgcagtctcagcagtggacattcgtggccagtatgagtatagccaggtctactgtaggtgttgccgctctcaacgggaagttatattccgtgggaggacgcgatgggtcctcgtgcctcagctccatggaatactacgaccctcatacaaacaaatggaacatgtgtgcgccaatgtgtaagagaagaggaggcgtcggagtcgcaacctgcgatggtttcctgtatgccgtaggaggacacgacgctccggcatccaatcattgcagtagattacttgactacgtggagaggtacgatcccaagacagacacatggacaatggtggcgccactgagcatgcctcgcgatgccgtgggggtttgtctcctgggcgatcggctctatgccgtcggcggttacgatgggcagacatatctgaatactatggagagctatgatccacagaccaacgaatggacacaaatggcgagcctgaacatcggaagggcaggcgcatgtgtggtagtgataaaacagccatag

SEQ ID NO: 227602 - DNA, 1167 bp, Artificial Sequence
  Description of Artificial Sequence: Synthetic coding sequence
atgagcagatcaggcgatcgcacctccacctttgatcctagccattctgacaacctcctccacggcttaaatcttttgtggagaaaacagctgttctgtgacgtgactttaaccgcccaggggcagcaatttcactgccacaaagccgtgctggctagctgcagccagtactttcgctctctgtttagttcacatccccctctgggcggaggcgtagggggacaggacggtctcggagccccaaaagatcagcaacagcctccgcagcagcagcccagccagcagcagcagcctccaccgcaggaggaacccggtaccccatcgtccagccctgatgataaactgctgacctccccaagagccatcaacaacctcgtgttgcaaggatgctcatctattggcctccggctggtgctggaatatctgtacactgcaaacgtgacactctccctggatacagtcgaagaagtgttatccgtgtccaaaatactccacattcctcaggtcaccaagctttgtgtgcagtttctgaatgaccagatctccgtacaaaactataaacaggtctgtaagattgccgcactgcatgggttggaggagacaaagaagttggccaataaatacctggtagaagatgtcctgcttctcaactttgaagaaatgcgcgctttgctggattccctccccccaccggtagagtccgaattagcactgtttcagatgtctgtgttgtggcttgagcacgaccgtgagactcggatgcagtatgctccggacctaatgaaacggctacggttcgctctgatccccgcacctgaactggtagagcgcgtccaaagcgttgactttatgcgtactgacccggtgtgccaaaaattgctactggatgctatgaactatcacctgatgccattccgccaacactgtcggcaaagcttggcatcacgcatccgctctaataagaaaatgctcctgctcgtaggcggtctgcctcccggacccgacaggcttccttcaaatcttgtgcagtactatgatgatgagaagaagacttggaagattcttacaatcaccggcccacatccgatttcaggcaaacaggagtccgcgtctagccctgagtttagaaggcgtaagactcgcgagttcagcaacaatacaatgtag

SEQ ID NO: 227603 - DNA, 1887 bp, Artificial Sequence
  Description of Artificial Sequence: Synthetic coding sequence
atgagtcggagcggtgatcgtaccagcactttcgaccccagccactccgataatctgctgcatggattaaatctgctgtggcgcaagcagctgttctgtgacgtgacactgactgctcagggccaacaattccactgtcataaagccgttctggccagttgctctcagtatttcaggtccctgttctcatctcatccccctctgggtggcggagtggggggtcaggacggactcggtgctccgaaggatcagcagcagccgcctcagcagcagcccagtcagcaacaacaaccacctccccaagaagagccaggaacccctagttccagccccgacgataagcttctcacctctcctagggcaatcaataatctggtgctgcagggatgctcaagtatagggctgcgtctggtcctagaatacctgtatacagctaatgtcaccttgagcttggacaccgttgaggaggtcctctccgtaagcaagatcctgcacatcccgcaggtgacaaagctgtgcgtgcagttcctgaatgatcagatatccgtgcagaactacaagcaggtgtgtaagattgccgcattgcacggtcttgaggagacaaaaaaattagccaataagtatcttgtggaggatgtcctgctgctgaattttgaggagatgagagctctcttagattcactgccaccgccagtggaaagtgagcttgccctatttcagatgagtgtcctgtggttagagcacgatagggaaacacgaatgcagtacgctcccgacttaatgaaaagactgcggtttgccctgatccccgcaccggaactggtggagcgggtgcagtctgtcgactttatgagaaccgatcctgtgtgccagaagttactgcttgatgccatgaactaccaccttatgccctttagacagcactgtcgtcagtctctcgcgtccaggataagatctaacaagaaaatgttgctattggtagggggattgcctcctggtcccgacagactgccgtcaaaccttgtacagtattatgacgacgaaaagaagacttggaagatcctgacgatcatgccctacaattccgcacatcattgtgtggtggaagtcgagaattttttgttcgtgctgggtggcgaagatcagtggaaccctaacggtaagcattctactaattttgtgagcagatatgacccacggttcaatagctggattcagttaccccctatgcaggagaggagagcctcgttctacgcttgtcggttggacaagcacctttacgttattggcggaaggaatgagacaggctatctgtcttctgttgaatgttacaacctggagaccaacgaatggagatacgtcagttcactgccacagccattggcagcccacgcgggtgctgtgcacaatggtaaaatttatataagcggcggagtgcacaatggggagtacgttccctggctgtattgctacgatccagtcatggatgtgtgggctaggaagcaggatatgaatacaaaacgggcaatccacacattggcagtgatgaacgatcgactttatgcaattggcggtaatcacctgaaaggattttcgcatcttgacgtgatgctcgtcgagtgctatgacccaaagggagaccagtggaatatcctgcaaactcccatccttgaagggcgttctggacccggatgtgctgtgctggatgactcaatctatctcgtgggaggatattcttggtcaatgggagcttacaagtcatccaccatctgctattgcccagagaaaggcacctggacagaattggaaggcgatgtcgccgaaccgctggcaggtcccgcttgcgtgactgtgatcctgcctagctgcgtcccgtacaacaagtag

SEQ ID NO: 227604 - DNA, 1794 bp, Artificial Sequence
  Description of Artificial Sequence: Synthetic coding sequence
atggtctggctagaggccagaccacagatactcttcgtgtgtacaaaacagggccaccaaaaacccctggacagtaaggatgataataccgagaaacactgccccgtcacggttaatccgtggcacatgaaaaaagcgttcaaagtgatgaatgaattaagaagccagaatctactgtgtgatgtcacaatcgtcgcagaggacatggagatctctgctcatagggtggttctggcagcgtgttcaccatactttcatgccatgtttaccggcgaaatgagcgagtctcgggctaaacgcgtgcgcattaaggaagtggacggctggaccctcaggatgctaattgactatgtgtacacagccgaaattcaggtcaccgaggagaatgtgcaggttctactgccggctgccggtctcctgcagctgcaggacgtgaaaaagacctgctgcgagtttctcgagtcgcagctccatcctgtcaattgccttggcattcgggcttttgccgacatgcacgcctgcacagatctcctgaataaagctaacacctacgcagaacagcactttgcagacgtggtccttagcgaagagtttctgaaccttggcatcgagcaggtgtgttcactgatttccagtgataagctcacgatcagtagtgaggagaaagtattcgaggccgtgattgcttgggtgaaccacgacaaggatgtgaggcaggagttcatggccagacttatggagcatgttcgcctgcctctcctgcctagggaatatttggtgcagcgcgttgaagaagaagcactcgttaagaattccagcgcctgcaaggattacctgatcgaagcgatgaagtaccatctcttgcccactgaacaacggattttaatgaagtccgtcagaactaggctgcgaaccccgatgaatctgccaaaattaatggtcgttgtggggggacaggccccaaaggcgattagatccgtcgaatgctacgactttaaagaagagaggtggcatcaggttgctgaactgcctagcaggagatgcagggctggcatggtttacatggccggtctcgtgtttgcagtcgggggtttcaacggaagtctgagggtcaggactgtagacagctacgaccccgtcaaggatcaatggacctctgtggctaacatgcgtgaccgtcggagcactctcggcgcagctgtgctgaatggactcctctatgcagttggcggattcgacggtagcaccggtctctcatcagtggaggcttataatattaaaagcaacgagtggtttcatgttgctcctatgaacaccaggagatcaagtgtgggcgtcggcgttgtaggtgggctgttatacgccgttgggggttatgacggcgcttcccgccaatgtctatctactgtggagtgttacaacgcaacaacaaacgagtggacctatatcgccgaaatgtccacacgacgtagtggtgccggagtcggggtactcaataacctgctgtatgcagtgggcggtcacgatggtccactggtccgcaagtcggttgaagtgtacgatccaaccactaacgcctggaggcaggtagccgatatgaacatgtgtcgacggaatgctggcgtgtgtgccgttaacggactactgtacgtcgtgggcggagacgatggaagctgcaacctggcttctgttgagtactataacccgacaactgataaatggacggtggtttccagctgtatgagcacgggaagatcatatgcgggtgtcacagtgattgacaagcccttgtag

SEQ ID NO: 227605 - DNA, 2640 bp, Artificial Sequence
  Description of Artificial Sequence: Synthetic coding sequence
atgaggctgcacctgttattattgctggcactgtgtggagctggaactacggcggctgaactttcctactcactgagaggtaactggagcatctgtaatggtaacggcagcctggaattaccgggagctgtacccggttgcgttcactctgccctgtttcagcagggactcattcaagacagttactatcgctttaacgatctgaattatcggtgggtgtcattagacaactggacgtattcaaaggagtttaagatcccattcgagataagtaagtggcagaaagtgaacctcattctggagggcgtggacaccgtgagtaagattctcttcaacgaggtcacgataggagagactgacaacatgtttaacaggtatagtttcgatattaccaacgtggtacgggacgtgaattctatcgagttgagatttcagagcgccgttttgtatgcggctcagcagtccaaggcacacaccagataccaggtgccccctgactgtcccccactggttcagaaaggagaatgtcatgtgaatttcgttagaaaagagcaatgcagcttttcctgggactggggtccgagcttccccacccaggggatttggaaggacgttcggatcgaggcgtacaacatctgtcacctgaattatttcactttcagtccgatctacgataaaagcgcacaagagtggaacctagagattgagtcaacattcgatgtagttagctccaagccagtaggcggacaagtgatcgtggccattccaaaactccagactcagcaaacgtatagtatcgagcttcaacccggaaaacggatcgtcgagctgtttgtgaatatttccaaaaatattactgtggagacctggtggccacacggacacggtaaccagaccgggtacaatatgactgttctgtttgagttggacggaggactgaatattgagaaatctgccaaggtgtacttccgaacagtggaactgatcgaggagccaattaagggcagtcctgggctctctttctatttcaagattaatgggtttcccattttcctaaaagggagcaactggataccagccgattcattccaggacagggtgacttcagagttgttgcgtttgcttttgcaatctgtcgtcgacgcaaacatgaacacccttcgcgtgtggggcggaggtatctatgagcaggacgagttctatgagctgtgtgacgagctgggcatcatggtgtggcaggacttcatgtttgcctgcgcgttgtacccgactgatcaggggttcctagacagtgtcacggccgaggtggcctaccagatcaaaaggctcaagtcacacccatcgatcataatctggtctggaaacaatgagaacgaagaagcgctgatgatgaactggtaccatatctcgtttaccgaccgtccaatatacattaaagattatgtgaccctgtatgtgaagaacattcgcgagctcgttttggcaggcgataagtcccgcccatttatcacctcttccccgacaaacggcgcagaaaccgtggctgaagcttgggtgtcccaaaatccaaattcaaattactttggagacgtccatttttacgactacatatcggactgttggaactggaaggtgtttcccaaagctagatttgcctctgaatacggctatcaatcctggccctcattcagtaccctggagaaagtatctagtaccgaagactggtctttcaactcaaaattttccctccacaggcagcaccatgagggtgggaataagcaaatgctgtaccaggcagggttgcactttaagctgccacaatctaccgatcctcttaggacattcaaggatacgatatatctcacccaggtcatgcaagcgcagtgtgtcaaaacagagaccgaattctaccgcaggagccggtctgaaattgttgaccagcaggggcacacaatgggagcactatattggcaactgaatgatatttggcaggctcccagttgggcttccttggaatacggaggaaaatggaagatgctgcactattttgcgcaaaatttttttgccccacttctgccagtgggctttgagaatgagaatacgttttacatctatggagtctctgaccttcactcagattattctatgacactctctgtcagagtacacacatggagcagtttggagcccgtgtgcagtcgggtgacagaaagattcgttatgaaaggaggtgaggcggtctgtctgtacgaggagcccgtgtccgagcttctgagacgctgcggtaactgtacaagagaatcttgcgtggtaagtttttacctgagtgctgaccacgagttgctctcccccactaactaccactttctgagcagccctaaagaagcagtgggcctctgcaaggcccagatcaccgcaatcatctcgcagcagggtgacatctttgtctttgacttggaaacatctgcagtggctccattcgtgtggctggacgtaggcagcattccaggtcggtttagcgataacggattcctgatgactgagaagactcgtactatcttattctacccatgggaaccaacaagcaaaaatgaattagagcagagctttcatgtgaccagcctgacggacatctactag

SEQ ID NO: 227606 - DNA, 1518 bp, Artificial Sequence
  Description of Artificial Sequence: Synthetic coding sequence
atgagcgagtcgcgcgctaagcgggtacgaatcaaggaagtggacggatggacccttagaatgctgattgactacgtgtatacggctgaaattcaggttactgaggagaatgtccaggttctccttccagctgcagggttacttcagttacaggatgtgaaaaaaacctgttgcgagttcctcgagagtcagcttcaccctgtaaattgccttggaatacgagccttcgctgacatgcatgcatgtaccgatctcttaaacaaggctaacacatatgctgaacagcactttgccgacgtcgtcctttctgaggagtttctcaatctcggcatcgaacaggtgtgttcactgattagtagcgataagctaaccatcagctccgaggagaaggtctttgaagccgtaatcgcttgggtaaatcatgacaaggacgttaggcaagagtttatggcaaggctgatggaacacgtcagactgcccctgctaccacgcgagtatctcgtgcaaagggtggaagaggaagccctggttaagaacagcagcgcgtgcaaggactatttaattgaggccatgaagtaccaccttttacccactgagcaacgcattttaatgaagtcagttcgtaccaggctcagaactccaatgaacttgccaaaactcatggtggtggtggggggtcaggcaccgaaagccattcggagtgttgaatgctatgactttaaagaagagcggtggcaccaggtcgctgaattgccatccagacggtgtagagctggcatggtttatatggccggattggtttttgccgtggggggatttaacggctccctgcgtgtgcgcacagtggactcgtatgaccccgtcaaagatcagtggacaagcgtcgctaatatgcgggacagacgttctactctgggcgcagctgtgctcaatgggctgctgtatgccgtggggggtttcgacggaagtaccggcttgtcttccgttgaggcatacaatatcaaatctaacgaatggttccatgtggcaccgatgaacaccaggagaagctctgtgggcgtcggtgttgtcggcggtctgctgtatgctgtcggaggctacgatggggctagccgacagtgcctgtctaccgtggagtgttacaatgcaaccaccaacgagtggacgtacatcgcagaaatgtctacgcgtcgatcaggagccggtgtgggggtcctcaacaacctgctgtacgccgtgggagggcacgatgggcctctcgttcggaagagcgtggaagtctatgatccaacaaccaatgcatggcgtcaggtggcagatatgaacatgtgccggagaaatgcaggtgtttgtgccgttaacggtctgctatatgttgtcggtggtgacgacggatcttgcaacttggcgtccgttgagtactacaatccaacgaccgataagtggacagtagtatcctcatgcatgagtacagggcgttcctatgccggtgtgactgtgattgataaacccctctag

SEQ ID NO: 227607 - DNA, 1764 bp, Artificial Sequence
  Description of Artificial Sequence: Synthetic coding sequence
atggaaggcgagtccgtcaaactgtcatctcaaacactaatccaagcaggagacgacgagaagaaccaaagaaccatcactgtcaaccccgcacacatggggaaggcgtttaaggtcatgaacgagctcaggtctaaacagctcctttgcgacgtgatgatagtggccgaggatgttgaaattgaggcccacagagtcgtcctcgccgcatgcagcccttacttctgcgccatgtttactggcgacatgagtgaaagcaaggccaagaaaattgaaattaaggatgttgacggacagacactctccaaactgatcgactatatttacactgctgagatcgaggttactgaggaaaacgtgcaagtgttactaccagcagcctctctgctgcagttgatggacgtgaggcagaactgttgcgactttttgcagtcgcagctgcacccaacaaattgtctaggcatcagagcctttgccgacgtccacacttgcactgatctcctgcagcaggccaacgcttatgctgaacagcacttcccagaggtcatgttgggggaggaattcttgtctttgagcttggatcaggtgtgctccctgatcagttcagacaaactgactgtgagctccgaagaaaaagtgtttgaggcagtaatctcctggatcaactacgaaaaggagacaagacttgagcacatggcaaagctcatggaacatgtgagacttccattgctgcctagggattacttagttcagaccgtcgaagaagaggccctgataaagaacaataatacctgtaaagactttctaatcgaagccatgaagtatcacctgttgcccttagaccaacggctgttgatcaaaaacccacgaaccaaaccccgaactcctgttagtttgcccaaagtcatgatagtggttgggggacaggctcctaaggccatcagatctgtagaatgctatgattttgaagaagaccggtgggatcagatagcggagctccccagcaggcggtgcagggcaggcgtggtttttatggccggacatgtatacgcagtggggggatttaatgggagcttacgggtgaggacagtggatgtatatgacggcgtgaaagaccagtggacctctatcgctagcatgcaggagagacgatccactctgggggctgcagtcctgaatgatctcctgtacgctgtggggggttttgatgggtctacaggtctggccagcgttgaggcctactcttataagaccaatgaatggttttttgttgcccctatgaatacacgcagatccagtgtcggagtgggcgtggtcgaggggaagctgtatgctgtggggggttacgacggcgctagccggcagtgtctgtctactgtggaacaatataatccagccacaaacgaatggatctatgtcgcagacatgtccacacgtaggtcgggcgcaggtgtgggagtgctaagcggacagctctatgcaactgggggacatgatggcccactggtgagaaaatccgtagaagtatatgaccctggtactaatacatggaagcaagtcgctgacatgaatatgtgtcgacgtaacgctggggtttgcgcggtgaacggcctcttgtacgtggttgggggagacgatggttcttgtaatttggcatcagtcgagtactacaatcctgtcacagacaaatggacattgctgcccactaatatgagcacaggtagatcatatgccggagtcgcggttatccacaaatcactctag

SEQ ID NO: 227608 - DNA, 906 bp, Artificial Sequence
  Description of Artificial Sequence: Synthetic coding sequence
atggagggggagagcgtgaagctctcttcccaaacactgattcaagccggtgacgacgagaaaaaccagagaactattacggttaatccagcccacatgggaaaagccttcaaggtcatgaatgaattaagatctaaacagctgctgtgcgacgtcatgattgtcgcagaagacgtggaaattgaagcgcatcgagtggttttggcagcatgtagtccatacttctgcgccatgtttaccggggacatgagtgaatctaaggcaaagaagatcgagatcaaggacgtcgacggacagaccttatcaaagcttattgactacatatacactgccgaaatcgaagtgactgaagagaatgtgcaggtgctgcttcccgcagcgagtctgctccaactcatggacgtgaggcagaattgctgcgactttctgcagagccaactccatccgactaattgtctcggtatccgcgcattcgccgacgtacacacttgcaccgacctacttcagcaggcaaacgcctatgccgaacaacacttccctgaggtcatgctgggtgaggaattcctgagcctgagcctggatcaggtgtgctctttaatctccagcgacaagctcactgtatccagtgaagaaaaagttttcgaggctgtcatctcctggataaattacgagaaggaaacacggctggaacacatggccaagctgatggaacatgtccgcctgccactattaccacgtgactacttggtccagactgtggaagaagaagctctgatcaagaataacaacacttgcaaagattttctaatcgaggctatgaagtaccatctgttgccactcgatcagcggctgcttattaagaacccgaggacaaagccgcgaacaccagtgtcccttccaaagtag

SEQ ID NO: 227609 - DNA, 1518 bp, Artificial Sequence
  Description of Artificial Sequence: Synthetic coding sequence
atgtccgagtctaaggcaaaaaaaatcgagattaaagatgtggacggccagacattgagcaagctgatagactacatttataccgccgagatcgaggtgaccgaggagaatgtacaggtcctcttgccagccgcaagtctactacaactgatggacgtacggcaaaactgctgcgattttctccagtcacaacttcatccaaccaactgcctgggcatccgagcctttgccgatgtacatacatgcactgaccttctgcagcaggctaacgcttatgccgaacagcattttcccgaagtcatgttgggagaggaattcctgagcctgtccctcgaccaggtatgttcgctgatctccagtgacaaacttactgtatcttcagaggagaaggtattcgaagctgtaatatcctggatcaactatgagaaggagaccagactcgaacacatggccaagttgatggaacatgtacgactgcccttactcccaagggactatctggtacagactgttgaagaagaggctttaatcaagaacaacaacacttgcaaagactttctgatcgaggctatgaaatatcacctcttgcccctggatcaacgcctgctcatcaagaacccccgaactaaaccaagaactccagtcagtctgcctaaagtgatgattgtggtcggaggccaggctcctaaggctattcggtcggtggaatgttacgatttcgaagaggatagatgggaccagattgcagaactgcccagtaggaggtgtcgggctggtgtggtgtttatggccggtcacgtgtacgcagtgggtggattcaacggatccctgagagtgcgtacagtggacgtgtatgacggggtgaaagatcagtggacgagcattgctagcatgcaggaacgcagatccacactcggagctgcagtgctcaacgacctgctttacgccgtggggggtttcgatggaagcaccggcttagcaagtgtcgaggcttatagctataagaccaacgaatggttttttgtcgcaccaatgaacacgcgcaggagttctgtcggcgtgggcgtggtggagggtaaactctatgcagtggggggatacgacggcgcatcaaggcagtgtttaagtacagtcgagcagtacaaccctgctaccaatgagtggatctatgtggccgatatgtcaacaagacggtctggggctggagttggggttttgtccggccagctttatgcaacaggaggtcacgacgggccactggtgaggaagtccgtggaagtctatgatccaggaactaacacctggaagcaggtggctgacatgaatatgtgtagacgtaacgctggggtgtgcgctgttaacggcttgctttacgtggtcggcggagacgacggctcctgcaacctcgcatctgtggagtattataacccagtaacggataagtggactcttctccccactaatatgagtacagggaggtcctacgccggagtcgcagtaattcacaaatctctgtag

SEQ ID NO: 227610 - DNA, 603 bp, Artificial Sequence
  Description of Artificial Sequence: Synthetic coding sequence
atgtcaaggtgttgcagtcgccaacctgcctgttgtagctcttggatgttcggcagaactgcggttactagctgttctctgtcctgcatccctccaattgcatgggccagtgtgcacttgcagatgtacactccagccctgaccttctgcagccgtccaatgccaacacagcattttcccgaggtgatgttgggggaagagtttctgtcactttctctcgatcaggtgtgttctctcatcagctccgacaaactgaccgtcagctccgaagagaaagtttttgaggccgtgatatcctggatcaactatgaaaaagaaacccggctcgaacacatggccaaactgatggaacatgtgagactgccattgcttccaagagactacctcgtccagactgtcgaggaggaggccctgattaaaaataataatacttgtaaggattttctaattgaggcaatgaagtatcacctgctgcctctggatcagcggcttcttatcaagaacccccgaacgaagcccagaacccctgtcagcctcccgaagggcttggagtgtctggcggacagttgcactccacaggtgggaatgatggggctttggtag

SEQ ID NO: 227611 - DNA, 1668 bp, Artificial Sequence
  Description of Artificial Sequence: Synthetic coding sequence
atggggaaggcattcaaggtcatgaatgaactgagatccaagcagctactatgcgatgttatgattgttgccgaggatgtggaaatcgaagcacacagagtggtccttgctgcatgttccccgtacttttgcgctatgttcaccggggacatgagcgagtccaaggccaaaaaaatcgaaatcaaagacgtggacggccagactctgagcaaactaatcgactatatctatacagctgagatagaggtgacggaggagaatgtccaggtcctcctgcccgctgcgagcctcctacaattgatggacgtccggcagaattgctgtgattttctgcagtcccagcttcaccctacaaattgcctggggatccgagctttcgcggatgtgcatacctgtacggacctgttgcagcaggcaaatgcctacgccgaacagcacttcccggaggttatgcttggagaggagttcttgagcctgtccttggaccaggtctgtagcctgattagttctgataagctgaccgtaagctcagaggagaaggtgttcgaagcagtgatcagttggatcaactatgagaaggagaccaggttggagcatatggccaaactgatggagcatgttagattgcctttgttgccgagagattacctggtccaaactgtcgaggaggaggccctgatcaaaaacaacaatacttgtaaagacttcctgatcgaagccatgaaatatcatttactgcctttggaccagagactgctcatcaagaaccccagaacaaaacccagaactccagtcagtctgcctaaggtcatgattgtcgtcgggggacaggccccaaaggccatacgcagtgtcgaatgttacgattttgaggaagataggtgggatcaaattgcagagcttccgagtcgacgctgtcgcgctggtgtggtctttatggctggccacgtgtacgccgtgggcggatttaatgggtccctacgtgtgagaacagtggatgtgtatgacggagtgaaagaccagtggaccagtatagcttccatgcaggagaggcgatccactctgggcgcagccgtcctgaatgacctgttatacgcggtgggaggctttgacgggagtactgggcttgcatcggttgaggcctattcctataagacgaacgaatggtttttcgtcgcacctatgaatacgcggcgatccagtgttggagtcggcgtcgtagagggcaaactatatgcagtgggcggttatgacggcgctagtcgtcaatgtctcagtaccgtcgaacagtataaccctgctaccaatgaatggatttatgtcgcggacatgagtacaagaaggagtggcgctggtgttggagttttgagtgggcagctgtatgctacagggggacatgatggtcccctggttcggaagtctgtagaggtgtacgaccctggaactaatacctggaaacaggtggccgatatgaatatgtgcaggcggaatgccggtgtgtgcgcagtgaatggcctgctgtatgtggtcggaggcgacgacgggagctgtaatctggcaagcgttgaatactataaccccgtgaccgacaaatggactctgctccctaccaacatgtcgacgggccgtagctacgcaggcgtggccgtcatccataaatctttgtag

SEQ ID NO: 227612 - DNA, 1905 bp, Artificial Sequence
  Description of Artificial Sequence: Synthetic coding sequence
atggccccaaagaaaaagatcgtaaagaagaacaaaggagatattaacgagatgaccattatcgtggaggacagcccgctgaacaagttaaacgctctaaatggactgctggaagggggaaatgggttgtcttgcattagttccgagctgaccgatgccagttatggtccgaacctccttgaggggctctctaaaatgcgtcaagagaatttcctgtgtgacctagttatcgggaccaaaaccaagtcttttgacgtgcacaaatctgtgatggccagctgttctgaatatttctacaatatcctgaagaaggatccctccatccaacgcgttgatttaaacgacatatcccctcttggtctggccactgttattgcatatgcctacaccgggaaactgaccttgtcattatacaccattggatccatcatctctgctgctgtgtacctgcaaatacacactttggtcaagatgtgcagtgattttttgattcgggaaatgagcgtggagaattgcatgtacgtggtgaacatagctgagacctactctttgaaaaacgccaaggccgctgcgcaaaagttcatcagggataatttcctcgagtttgcagaaagcgatcagttcatgaaactgacttttgaacagatcaacgagctacttatcgacgatgacttgcagctaccctcagaaatcgtagccttccagatcgcgatgaaatggctcgagtttgatcagaagcgcgtcaagtatgccgctgatttgttgtctaacattcggtttgggacaatcagcgcacaagatctagtgaactatgtgcaatccgtgcccaggatgatgcaggacgcggactgccaccggttactcgtggatgccatgaattatcacctccttccctatcaccaaaatactttgcagtcacggcgaaccaggatccgtggcggatgccgggtactggtaactgttggaggcagaccagggcttaccgagaaatccctgagccgtgacatcctctatagagatccagaaaacgggtggtcaaaacttacagagatgcctgcaaaaagcttcaatcagtgtgtcgccgttatggacggctttctgtacgtagctggcggagaagaccagaatgacgcccgtaatcaggccaagcacgcagtctccaatttttgccgctatgacccgagatttaacacctggattcacttagccagtatgaatcaaaaaaggacccatttctcactgtccgtgttcaatgggctggtgtatgccgctggcggtcgtaatgccgaagggtccctggcttcgttagagtgctatgtacccagtaccaatcagtggcagcccaagaccccacttgaagttgctaggtgctgtcacgcaagcgccgtcgccgatggcagagtcctcgtgactggaggttacatcgccaacgcgtacagccggagcgtttgcgcttatgaccccgcatcagactcatggcaggaattgcctaatctcagtactcccagagggtggcactgtgctgttacactttcagatcgagtatacgtgatgggtggtagccaattgggtcctcggggagaacgggtggacgtgctcacagtggaatgttacagtcctgctaccggccagtggtcctacgcagctccactccaggtgggtgtgtccacagccggtgtgtcagcgctacacggaagggcctacttagtcggcggatggaatgagggggaaaaaaagtataaaaagtgcattcaatgcttttctcctgaactgaacgagtggactgaagatgatgagctgccagaggccactgtcggagtgtcttgctgtaccttgagcatgcctaacaacgttacacgcgaaagcagagccagcagtgtgtcttcagtccccgtgagtatttag

SEQ ID NO: 227613 - DNA, 1905 bp, Artificial Sequence
  Description of Artificial Sequence: Synthetic coding sequence
atggcacctaagaagaaaatcgttaaaaagaacaagggtgacataaatgaaatgacaatcatcgtagaagacagccccctgaacaaacttaacgccttgaacggcctgctagagggtggaaacgggttatcttgtattagcagtgaactgactgatgcctcttacggaccgaatctcctcgagggcctgagcaagatgcggcaggaaaatttcctctgcgatctggtgatcggtacaaagacaaaatcgtttgatgttcataaaagcgtcatggcttcttgcagtgagtatttttataacattctcaaaaaagacccctcaattcagcgagtagacctcaacgacattagcccactgggactcgctacagtcattgcctacgcttacacaggaaagctgacactgtctctttatacgattggctccattatatctgctgctgtctacttgcagatccacactctggtgaaaatgtgctctgactttcttattagagaaatgtctgtggaaaactgcatgtatgtggtcaatattgccgaaacttattcacttaagaacgctaaggccgctgcacaaaagtttattagagacaactttctggagttcgctgagtccgatcagttcatgaagctgactttcgagcagattaatgagctgttgattgatgatgacctccagctgccgtcggagatcgtcgctttccaaatcgcaatgaagtggctggaattcgatcaaaagcgcgttaagtacgctgcagatctcctgtcaaacatcaggtttggaacaataagtgcacaggaccttgtgaactacgtacagagtgttccgaggatgatgcaggacgccgattgtcaccggctgctagtggatgccatgaactaccacctgctgccctaccaccaaaacacattacagagccggcgtaccagaattaggggcggatgtcgtgtgctggtcaccgtggggggtaggccagggctcacagaaaagtccctctctcgtgacattctatatcgggacccagagaatggctggagcaagctgaccgaaatgcccgctaagtcctttaatcagtgcgtggcggtgatggacggattcctctatgtggctgggggagaggaccagaatgatgcaaggaaccaggccaagcatgctgtgtcgaatttctgccggtacgatcctagatttaatacttggatccatctggccagtatgaatcagaaacggacccacttctccctgtccgtgtttaacggcctggtatacgcggcaggtggcaggaatgccgagggtagcctggccagtctcgaatgctacgttccctccacgaatcagtggcaaccaaagaccccactggaagtggcaagatgctgtcacgcctccgccgtagctgacgggagagtgctagtcaccggtggctatattgccaatgcctactcccggagcgtatgtgcctatgatcctgcaagcgactcatggcaggaactgcctaacctctccaccccacgtggttggcactgtgccgttaccctgtcggaccgcgtgtacgttatgggcggttctcagctcggacctagaggagaacgcgtggatgtgctgactgtggaatgctactcacccgctaccgggcagtggtcttatgccgctcccttgcaggtaggagtttccaccgccggagtgtccgccctgcacggccgagcttacctcgtcgggggatggaatgagggagagaagaaatataaaaagtgtatccagtgtttttccccagagctgaatgaatggacagaggacgacgagctgccagaagcgaccgttggcgtgtcttgctgcaccctgtcaatgcccaataatgtgacaagagaatcaagagcctcttctgtttccagcgtgcccgtaagcatctag

SEQ ID NO: 227614 - DNA, 2313 bp, Artificial Sequence
  Description of Artificial Sequence: Synthetic coding sequence
atgaatgtcatctactttcctcttcacatctttgttgtgtactcccgggcttacacgtccctcgtgctggttgggtgtactaatctttgcgcagtactgtttgcaagatgcttagatgatcacctggtatctctgcgcatgagcggaagtcgcaaagaatttgatgtgaaacagattttgaagatcaggtggcgttggttcggacaccaagcctcaagtcccaactctacagtagactctcagcagggagagttctggaaccggggtcagacaggagctaatggagggaggaagttcctggatccctgctctctccagttacctctggcgagtattggctacaggcgatctagtcaactagattttcaaaacagcccctcgtggcctatggcttccaccagcgaagtacccgcattcgagttcacagcggaagattgtggcggagctcattggctcgacagacccgaggtggacgatggcacaagcgaggaagagaatgaaagtgattcttcctcatgccgtacttctaacagtagtcagacgctgagttcgtgtcatacaatggagccatgcacctcagacgagttctttcaggcactgaatcacgccgaacagacgttcaaaaagatggagaattacctcaggcacaaacagttgtgtgatgtgatcctggtcgccggtgatcggaggattcccgcacacagactcgtgctgtccagcgtatctgactattttgcagcaatgttcactaatgacgtgagggaagccaggcaggaggagataaagatggaaggcgtcgaaccaaacagcctgtggtcgctcattcagtatgcctacacaggacgtttagagctgaaggaagacaatattgagtgtttgctaagcacggcctgcctgctgcagctaagccaagtcgtggaggcatgctgcaagttcctcatgaagcagctgcacccctcaaactgtctggggatcaggtccttcgcagacgcccagggctgcaccgatctgcataaagtggcacataactatacaatggaacactttatggaggttattaggaatcaggaatttgtcctgctccccgcttctgagatcgccaagctgctggcttcagatgacatgaatattcccaacgaggagactattctgaatgctctgctgacctgggtcagacacgacctggaacagcgccgaaaggacctgtctaaactgctcgcctatattcgactgcccctcctggctcctcagttcctggccgacatggaaaacaatgtcctgtttagggatgatattgaatgtcagaaactcattatggaggccatgaaatatcatttgcttccagaacgacgaccaatgttgcaatccccgaggaccaagcccaggaagtcgacagtgggcactttattcgcagtgggcggaatggatagcactaaaggcgctactagtatcgaaaaatatgatctgaggaccaacatgtggaccccagtagccaatatgaatggacgcaggctgcagtttggcgtggcagtgctggacgacaagttatacgtggttggagggcgtgatggtcttaaaacattaaacacggtcgagtgttacaaccccaagacgaaaacgtggtcggtcatgcccccaatgagcacacatcgccatggactgggggtcgcggtattggaaggtcctatgtacgctgtggggggacacgatggttggtcctatctaaatacagttgaaaggtgggaccctcaggccaggcaatggaacttcgtcgccacgatgtcaacaccacgctcgaccgttggagtagccgtgcttagtggaaaactgtatgccgtgggtggcagggacgggtcctcctgtctaaagtccgttgagtgcttcgacccccacacaaacaagtggaccctttgtgctcagatgtcaaagagacggggaggcgtgggtgtgacaacttggaacggactcctgtatgccattggcggacatgatgctcctgcgagcaacttgacaagtaggctttccgactgtgtcgagaggtacgaccctaaaactgacatgtggacagcagtagcctcaatgagcatcagccgcgatgccgttggagtgtgcctgctcggtgacaagctatatgccgttggagggtacgacggacaggcttacctcaacaccgtggaggcctacgatcctcagactaacgagtggacccaagtcttctctcacacttttgaggattccaaagatcacctggtcgcgatcaaacagaccatttggcgccagaacagtctcagcgaggaattcagaagccattag

SEQ ID NO: 227615 - DNA, 2274 bp, Artificial Sequence
  Description of Artificial Sequence: Synthetic coding sequence
atgaacgtgatctatttccctcttcacatcttcgttgtttactctcgggcttacacctctcttgtcctggttggatgtacaaacctgtgcgcagtcctattcgctagatgtctcgacgatcacctagtaagtctaaggatgagcgggtctcgtaaggaattcgatgtgaaacagatactgaaaatccggtggaggtggtttggacaccaagcgagcagcccaaatagcactgtggatagtcagcagggagagttttggaatcggggacagaccggtgcaaacgggggtcggaaattcctggatccatgttcactgcagctgcccctagcatcaattggatacagaagatctagccaattggatttccagaattcccctagctggcctatggctagtacgtccgaggttcctgcgttcgaattcacagcagaggattgcggcggtgcccactggcttgacaggcccgaggtggacgacggaaccagtgaagaggagaacgagtccgactcctccagttgtagaacttctaactcctcccaaaccctcagtagttgccacaccatggaaccctgcacctctgatgagttctttcaggcgttgaaccacgctgaacagactttcaaaaagatggaaaactaccttcgccacaagcagttgtgtgacgtgatcctggtagccggtgatcggagaatccccgctcataggttagttctcagcagcgtctcagattacttcgctgcaatgtttaccaatgacgtccgcgaggcacgccaagaggagatcaagatggagggagtggagcccaacagcctctggagcctcatccagtatgcctataccggtaggctggaactcaaggaggataatatcgagtgcctcctttctactgcgtgtctgctccagctttcacaggttgttgaggcctgttgtaaattcctgatgaagcagctgcacccttccaattgtttaggcattcgtagcttcgctgacgcccagggatgcaccgaccttcacaaggtggcccacaactacactatggaacactttatggaggttatccggaaccaggagtttgtcctgctccccgcaagtgagatcgccaaactgttagcctctgatgatatgaacataccaaacgaggagaccatcctaaatgcattgctgacttgggtacgacacgatttggaacaacgaagaaaagatttgagcaagctcctagcttacattcgcttacccttactggcaccccagttcctcgcagacatggagaataacgtgctgtttagggacgacatagaatgccagaagcttataatggaggcgatgaaatatcatttgctccccgagcggcgaccaatgctgcaatctcctagaactaagcccaggaagtcgactgttggcactctgtttgccgtcggcggaatggatagcaccaagggagcaacatccatagaaaaatatgatttacgaaccaacatgtggaccccagttgctaatatgaacggtcggagactgcaatttggagtggcagtcctcgatgacaagttatatgtggttggcggacgggacggtctgaaaactctcaatactgtcgagtgctataatccaaaaactaagacatggagcgtaatgcccccaatgtcaactcatcgccacgggctcggtgtcgccgtcctcgagggccctatgtatgccgttggtggccacgatgggtggagctatctgaacacggtcgagagatgggacccccaggcccgtcaatggaattttgtcgcaaccatgtcaactcctcggtctaccgtgggagtcgccgtgttatctgggaagctgtacgcagtggggggaagggatggctctagctgtttaaagtccgttgagtgtttcgacccccacacgaacaaatggaccctgtgtgctcagatgtcaaagcgcagaggaggggtgggcgttaccacgtggaacgggctcctgtatgccatcggtggacatgacgcacccgcttcgaatcttacctcacggctgtctgattgcgtggagcggtatgaccctaagaccgacatgtggacagctgtcgctagtatgagcatttcccgggatgccgtgggggtctgcctgctcggagacaaattgtatgcagtgggcggatacgatggccaggcttacctgaatacagtggaggcctacgatccacagaccaatgaatggactcaggtctggcatagctgtttcattatcaccctgaccctgttcctgctcaagcagttcctatggtag

SEQ ID NO: 227616 - DNA, 2268 bp, Artificial Sequence
  Description of Artificial Sequence: Synthetic coding sequence
atgaatgttatctatttcccattgcatatctttgttgtatattccagagcgtacacatcgttagttctcgtgggatgtactaatttatgcgctgtattatttgccagatgccttgatgaccacctcgtgtcattaagaatgtctggtagcagaaaggagtttgacgttaaacagatcctgaagattcgctggcggtggttcggccaccaggccagctcacctaatagcactgttgatagccaacaaggggagttctggaatcggggacaaacgggggcaaacggcggtcggaaattccttgacccttgctctctgcaactgccgctggcttcaataggttaccggcgttcaagtcaacttgacttccagaactcgccctcctggccaatggcatccaccagcgaagtgcctgcattcgagtttaccgctgaggattgcggtggggcacactggctggatagaccagaagtggacgatggaactagcgaggaggagaacgaaagtgactcatctagctgcaggacttcaaatagctcccagactcttagcagttgtcacacgatggaaccttgcactagtgacgagttctttcaggcactgaatcacgctgaacaaacattcaagaagatggagaattatctccggcataagcagctgtgtgatgttatcctggtggccggagacagaaggattccggctcacaggttggtactgagctccgttagcgactactttgcagccatgttcaccaatgatgtgcgggaagctcgccaggaggagattaaaatggagggcgttgaaccaaattcattatggtctctgattcagtatgcctacactgggagactggagttgaaggaggacaatattgaatgcctgctctccactgcatgtcttcttcaattatcccaggtggtggaagcttgctgcaaatttttgatgaaacagctccatcctagcaactgtctgggaatcagatccttcgcagatgcgcaggggtgtacggacttgcataaggtcgcacataactacaccatggaacacttcatggaggtcatcaggaaccaagaatttgtcttgcttcctgcctcagagatcgccaaacttctcgccagtgacgacatgaacattcccaacgaggagacgattctcaacgctcttctcacctgggtgaggcatgatctcgaacagcgacgtaaggatctctcaaagttgctggcatatataagactgcctctgttggcccctcagttcttagccgatatggagaataatgttctcttcagggacgatattgagtgtcagaaacttatcatggaggccatgaagtatcatctcctaccagaacgcagacccatgctgcagagccctagaactaagcctaggaagtccacagttgggacactttttgccgtggggggaatggactccactaaaggagccaccagtattgagaagtacgacctccggacaaacatgtggacccctgtcgccaacatgaatggtaggcggctgcagttcggcgtcgccgtccttgacgacaagctgtacgtcgtgggtgggcgagatggactgaagactctgaatacggtggagtgttataacccaaaaacgaagacgtggtcagtcatgccccctatgtccacacacagacacggcttaggtgtggccgtgttggagggcccaatgtacgctgtcggcggtcacgacggatggtcctacctgaataccgtggaaaggtgggacccccaggcgagacaatggaacttcgtcgccaccatgtctactcctagaagcaccgtgggcgtggcggtcctgagtggcaaactgtatgccgttggcggacgggacggttcctcatgtctcaaatcggtagagtgctttgatcctcataccaataaatggaccttgtgtgcacagatgtctaagaggagaggaggcgtcggagtgacaacatggaatggcttgctctacgcaatcgggggacacgatgcgcctgcctccaacctgacgagccgattgtctgattgcgtggagagatacgacccaaaaacggacatgtggaccgctgtcgccagtatgtcaatttctcgtgatgctgtgggagtctgcctcctgggggacaagctttacgctgtgggaggatatgacgggcaggcataccttaatactgtggaggcatacgacccacagacaaacgagtggacccaagtggcacccctgtgccttggtcgggcaggagcatgtgtcgtaactgtaaagttatag

SEQ ID NO: 227617 - DNA, 849 bp, Artificial Sequence
  Description of Artificial Sequence: Synthetic coding sequence
tagaggacgaatatgtggacgcctgtggccaacatgaacggcagaaggttacagtttggggttgccgtgctcgacgacaaactgtacgtcgttggtggacgggacgggttgaaaacactaaatacagtggaatgttacaacccgaagacgaaaacttggagcgtgatgcctcctatgtcaacacaccgtcacggcctgggagttgcggtccttgaaggcccaatgtacgctgtcggaggacacgacggatggtcatacctcaatactgtcgagcgttgggatccgcaagccaggcagtggaattttgttgcaacaatgtcgacacccaggagcacagtgggagtcgcggtcctgtccggaaaactttacgccgtcggcggtcgggatggctcttcctgcctcaaaagtgtggagtgcttcgacccccacacaaataagtggaccttgtgtgcacagatgtccaaaaggagggggggtgtgggagtcactacctggaatggactcctatatgccatcggtggacacgatgccccagcaagtaatcttacatccaggttgtcggattgtgtcgagcgatacgatcctaaaacggatatgtggacagccgtcgccagtatgtccattagtcgagatgcagtcggagtctgtctcctcggcgataagctgtacgctgtggggggatatgacggtcaagcctatctgaatactgtcgaggcttacgatcctcaaacaaatgaatggacccaggtattttcccacacgttcgaggatagcaaagatcatctcgtcgccattaagcagactatctggaggcaaaactccctgtcagaggagttccgctcccactag

SEQ ID NO: 227618 - DNA, 2370 bp, Artificial Sequence
  Description of Artificial Sequence: Synthetic coding sequence
atgcgccttcccggacagggcctcggggctagggaggggccatctatccccctctcttccccagcccctgcaccagccagtcccgcaccccctgcatggcccccacggcctgccgtcactcacggaagacttcgttctccaacaaggcgagcctacacatctctggtgttggtggggtgtacgaatctgtgcgcagtgctgttcgctcggtgcctagacgaccatctggtgagcctgcgaatgagtgggtctagaaaggaattcgacgtaaagcaaatattaaaaatccgttggcgctggttcgggcatcaagcaagttcccctaacagcacggtggatagccagcagggtgaattctggaaccgcggacagacaggagctaatggagggagaaagtttttagacccatgttccctacaacttccccttgcctcaatcggctatagaagatccagccaattagattttcagaactctcccagctggcccatggcctctacttcagaagtgccagcttttgagtttacagccgaggattgtggcggagcacattggctagaccgccctgaagtcgatgacggcacaagtgaagaggaaaatgaaagcgacagcagcagctgccgcactagcaactcttcccagacactaagctcctgccacacaatggaaccgtgtactagcgatgaattttttcaagccttgaatcatgccgagcagacctttaaaaaaatggagaactacctccgacataaacaactgtgtgacgtgattcttgtggctggggaccgccgtatcccggcacacaggttggttctgagttctgtgagcgattacttcgcagccatgttcacgaacgacgttagagaggcacgccaggaggagatcaagatggagggggtagagcctaacagcctgtggagccttatccagtacgcctacacagggcgtcttgagctcaaagaggataacatagaatgtttgctgagcacagcctgtcttttacagctgagtcaggtagtggaggcctgttgcaagttcctgatgaaacagctgcacccttccaattgtctggggattcgctctttcgccgacgcccaaggctgcacagacctgcacaaagtagctcataactataccatggagcattttatggaagtcatccggaatcaggaatttgtactgctgcccgctagtgagatcgccaaactgttagcgtcagacgatatgaacattccaaatgaagaaacaattctcaacgctttgctgacatgggtgcggcacgatctcgagcagcggaggaaggatctatccaaacttctggcttacattcgactgcccctgctggcccctcagttcttggcagatatggagaacaacgtgctctttcgggacgacattgagtgtcaaaaacttattatggaggccatgaagtatcatctgctccctgagcgtcgtcctatgctccagagtccgcgaacaaagcctaggaagagcaccgtcgggacgctctttgccgtaggaggaatggacagcacaaaaggcgctacaagcattgaaaagtacgacctcagaaccaacatgtggacccctgtcgcgaacatgaatggacgtaggctacagtttggcgtggctgtgcttgacgataaactgtatgtcgtgggcggtcgcgacgggctaaaaaccctgaataccgtcgagtgctacaatcctaagaccaaaacatggtctgtcatgcctccaatgtctacgcaccggcatgggcttggtgtagctgttttggaaggccctatgtacgctgttgggggacatgacggctggtcatatctaaatactgtggaacggtgggatccccaagccagacagtggaactttgtggctacaatgtctacacccagatccaccgtcggtgtcgcggtgctatccggcaagttgtacgcagtaggcggacgcgacggttcatcctgtttgaaatccgtggagtgcttcgatccacatactaacaagtggactctctgcgcccagatgtccaagcggaggggcggagttggtgtgacaacctggaatgggctcttgtatgccatcgggggacacgatgcccctgcgtccaatctgacaagccgactaagcgactgtgtcgagcgctacgaccccaagaccgacatgtggactgccgtggcctcgatgagtatcagtcgggatgccgtgggagtttgtctactgggtgataagttgtatgccgtgggtggatacgacggccaagcttacttaaatactgtggaggcttacgatccccagaccaatgaatggacccaagtcgcacccctgtgtctggggcgagccggagcttgcgtggtaacagtgaagctttag

SEQ ID NO: 227619 - DNA, 1050 bp, Artificial Sequence
  Description of Artificial Sequence: Synthetic coding sequence
aaaaagcatccaagtaccgtgatggtgcctcagttcctggcagatatggagaataatgttctgttcagggatgacattgagtgtcagaagttaattatggaggctatgaagtatcacctgctccccgagaggaggccaatgctccagagtccccgaacgaaaccacgcaagagcaccgtcggtactttgtttgcagtgggcggaatggactcaaccaaaggcgcaacctctattgaaaaatatgatctgagaacaaacatgtggacacccgtggcgaatatgaatgggaggaggttgcagtttggtgttgccgtgcttgacgacaagttgtacgtggttgggggacgagacggactgaagaccctcaacactgttgagtgctacaatcctaaaaccaaaacatggtccgtaatgccgccaatgagcacgcacagacacgggctgggggtggctgtactggagggaccaatgtatgccgttgggggtcacgatgggtggtcgtaccttaataccgtggaaaggtgggaccctcaggcccgtcagtggaattttgtggcaaccatgtcaactcctagatcgacagtcggggtggccgtcctatctggtaagctttacgccgttggtggtcgcgacggcagcagctgtctaaaaagtgtagaatgtttcgacccacacacaaacaaatggactctctgcgcccaaatgtccaaacgacgagggggagtgggagttactacatggaatggccttctctacgctatcggtggtcatgacgctccagcatctaatctcacctcgagactcagcgattgtgtggaacgctacgatccaaaaaccgacatgtggactgcagtggcctcgatgagcatcagcagagacgccgtcggagtgtgtctgttgggcgacaagctctacgctgtaggcggatacgatggacaggcctatttaaacaccgtggaggcgtatgatccacagaccaacgagtggacgcaggtggcgcctctgtgtctgggccgagccggtgcatgcgtggtcaccgtaaaattgtag

SEQ ID NO: 227620 - DNA, 2130 bp, Artificial Sequence
  Description of Artificial Sequence: Synthetic coding sequence
atgtccggctcgcggaaagaatttgacgttaaacagatactcaaaattagatggcgttggttcgggcaccaggcgagtagtccaaactcgactgtggacagccagcaaggcgagttttggaaccgcggtcagacaggcgcaaacgggggaagaaaatttctggatccgtgctccctgcagcttcccttggcaagtatcggttaccgcagaagttcacagctagattttcagaactctcccagttggccgatggccagcactagtgaggtgcccgcattcgaatttactgcagaggattgtggcggagctcactggcttgaccgcccagaagtcgacgatggaacatctgaggaggaaaacgagtcagattcaagctcatgccgcacatccaacagtagccaaacactgagctcctgccacacgatggaaccatgtacctctgacgagttttttcaggcactgaatcatgctgaacagacattcaaaaagatggaaaactacctcagacataagcagctgtgcgatgtcattctcgtggcgggagacaggaggatccccgcacacagattggtgctgagcagcgtgtccgactactttgctgccatgttcacaaatgatgtcagagaggccaggcaggaggaaatcaagatggagggcgttgagcccaacagtctgtggagcttgatccagtacgcgtatacagggagactggagctgaaggaagataatattgaatgtctgctcagtaccgcttgtctattgcagctttctcaggtggtagaagcttgttgtaagtttctgatgaaacagcttcatcccagcaactgcttaggcattagatcctttgccgacgcccagggctgtaccgacttacacaaggtcgcccacaactatacgatggaacacttcatggaggttatcaggaatcaggaattcgtcttgctccccgcttctgagatagcaaaactgctcgcgtctgacgacatgaatattcctaatgaggaaacaatcctgaacgccctgctgacatgggtacgccacgatctggagcagagacggaaagatctatctaaactgttggcctatattagattgccattacttgctccgcaattcctggcggatatggaaaacaatgtgctgtttagggatgacatcgagtgccagaaactgatcatggaggcgatgaaataccatctcttgccagagcgcagacccatgcttcagtcgcctaggaccaagccccgaaaatctaccgtgggtacactgttcgcagttggtggtatggactcaaccaagggagctacttcaattgaaaaatatgatctccggactaatatgtggaccccagtggccaacatgaatggaaggcggctgcagtttggggtggctgtgctggatgacaagctgtatgtcgttggcggtcgtgatgggctgaagacgctgaacacagtcgagtgctacaacccgaaaactaagacgtggagtgtaatgccacctatgagtacgcataggcacggcctgggggtggccgttctcgaaggccctatgtatgctgttggagggcacgatggctggtcttacttgaacactgtcgagcggtgggacccccaagccagacagtggaattttgtggctaccatgagcacccctagatcaaccgtgggggtggcggtgctgagcggcaaactgtacgctgtcgggggacgggatggaagctcctgtctgaagtcagtagaatgctttgatcctcacacaaacaaatggacattgtgtgctcagatgtcgaaaagaaggggcggtgttggggttaccacctggaacggcctgctctacgccatcggcggacacgatgcaccagcatcaaacttaacttccagactctccgattgcgttgagcgttatgaccctaaaaccgacatgtggactgcggtcgcttcaatgtccatcagccgagacgccgtgggggtctgcttgctgggtgataaactgtacgcggtcggtgggtatgatgggcaagcttacttgaacactgtggaggcatacgatccgcaaaccaatgagtggacacaggtagcccctctctgtctggggagagcgggagcgtgtgttgtcactgtcaagctgtag

SEQ ID NO: 227621 - DNA, 2085 bp, Artificial Sequence
  Description of Artificial Sequence: Synthetic coding sequence
atgaatgtgatatatttccctcttcacattttcgttgtctactccagagcttatacctccctggttttggtcggctgcaccaatctctgtgccgtgctgtttgcaagatgcttggatgatcacctcgtgtcattgcggatgtccggctcgcgcaaagaatttgatgtcaagcagatactcaagattagatggaggtggttcggacaccaagcttcgtccccaaattctacagtcgatagtcaacagggcgaattctggaacaggggccagaccggggctaatggcggaagaaagttcctggacccatgcagcctgcagcttcctctcgcttcaattggttaccggaggtcatctcaacttgatttccagaatagcccctcctggcccatggcctctacctcagaggttccagccttcgagtttaccgctgaggactgtggtggcgctcactggctcgataggcctgaggtggacgatggcacatcagaggaggagaatgaaagcgacagcagcagttgcaggctggtgctttcgtcagtcagcgactacttcgccgcaatgttcaccaatgatgtgcgggaggcccgacaggaagaaattaagatggaaggagttgagccaaactccctgtggagccttatccagtacgcatatactgggaggctggagcttaaagaggataacattgaatgcttgttgtctaccgcttgtctccttcaattgtcccaagtggtcgaggcctgttgcaagtttctaatgaagcagctgcacccaagcaactgcttgggcataaggagcttcgctgatgcgcagggttgcacggatctacataaggttgcacataattacactatggagcacttcatggaagtgattaggaaccaagagttcgtactgctgcccgcatccgagattgcaaagcttctggcaagtgacgatatgaatatacctaatgaggaaaccatattaaatgccctcctcacctgggtccgtcacgatctcgagcagcggaggaaggacttgagcaaacttttggcctacatccggctgcctctccttgcaccgcagttcctagccgatatggaaaataatgttctgttccgtgacgacattgaatgtcagaaattaatcatggaagctatgaaatatcatctgctccccgaacgccgtcctatgctgcagtcaccaaggactaaacctcgcaagagcaccgtggggaccctgtttgcggtggggggaatggacagcaccaaaggagccactagcatagagaagtatgatctgagaacaaatatgtggacacccgtggcaaatatgaacggccgacgcctgcagtttggcgtcgcagtcttagatgacaagctgtatgtcgtcgggggaagagatggactgaagacactaaataccgtcgagtgctacaacccaaagaccaagacctggtcggtgatgcctcccatgagcacacatcgccacgggctgggtgtcgccgtcctggagggccctatgtatgctgtgggaggccacgacgggtggagctatctgaataccgtagagagatgggatccccaggctagacaatggaactttgtcgctactatgagcaccccgagatccactgtcggcgtggcggtgctaagcggcaagttgtatgccgtaggcggtagagacgggtcttcttgtctgaagtcagtagagtgttttgatcctcacacgaacaagtggaccctctgtgcgcagatgagcaaacggcgtgggggagtgggtgttactacatggaacggattattatacgctatcggagggcacgacgcccctgcaagtaacttgacctctcgactctctgattgtgtcgagaggtacgatcctaagacagacatgtggacagcagtcgcttcaatgtctataagccgcgatgctgtcggcgtttgtctgctgggagataagctatacgcggtaggaggctacgatgggcaggcttacctgaacactgtggaggcgtatgatccgcagacaaacgagtggacacaggtagccccactgtgtctggggagagcaggcgcatgtgtcgtgaccgtaaaactgtag

SEQ ID NO: 227622 - DNA, 1707 bp, Artificial Sequence
  Description of Artificial Sequence: Synthetic coding sequence
atggagccctgtacaagtgacgagtttttccaggctttgaatcatgcagagcagacattcaagaagatggagaactatctacggcataagcagttgtgcgacgtcattctcgttgccggagaccgacgcatccccgctcacaggttggtgctctccagtgtaagcgattattttgccgcaatgtttacaaatgacgttcgagaggcacgtcaggaggaaattaaaatggagggggttgaaccgaactccctctggagcctaatccagtacgcgtacacgggcaggcttgagctcaaagaggacaatatcgaatgccttctctccactgcttgtctgctgcagctgagccaagtggttgaagcttgttgtaaattcctgatgaaacagctccacccttcaaactgcttgggcatccggtctttcgccgatgcacagggttgtaccgatcttcataaagtagctcacaactacacaatggagcatttcatggaggttatccggaaccaggagtttgttctactgccagcatcagagattgccaagctcctggccagtgatgatatgaacatacctaatgaagaaacaatcctcaacgccctactaacttgggtaagacacgacctggaacagaggaggaaagaccttagcaagctgctggcctacattagattgccactcctcgccccacagttcctggctgacatggaaaataacgtgctctttcgcgatgatatcgaatgtcaaaagttaatcatggaagccatgaagtaccacctgctgccagagcgacgccctatgttgcagtcgccacgaactaaacctaggaagtctacggtcggaaccctgtttgcagtcgggggaatggatagtaccaaaggtgccacatccattgagaaatacgaccttagaactaacatgtggacgcctgtggctaatatgaacggtagacgcctccagtttggcgtggccgttttagacgacaaactgtatgttgtgggcggaagagatggcctcaagacactgaacactgtggagtgttataatccaaagaccaaaacatggtccgtgatgcccccaatgtccactcacaggcatggactcggagtagcagtgttggaaggtccaatgtacgcggtcggaggtcatgatgggtggtcctatctgaacacggtggagcgatgggatccgcaggcgagacagtggaattttgtggccactatgagtacccctagatctacagtgggagtggccgtgttatccggaaaactctacgccgtcggaggcagagatggaagctcttgcctcaaatccgtggagtgcttcgacccccacactaacaaatggaccctgtgcgctcagatgagcaagcggcgagggggagtaggggtcactacatggaatggattattgtatgccattggaggccacgacgcaccagcttccaatctgacgtccaggttgtctgactgtgtggaacggtatgaccccaagaccgatatgtggactgccgtggcctctatgtccatctctagagacgcagtgggagtgtgtctgttaggagataagttatacgctgtgggcggatatgatggtcaggcgtacttgaacacagtcgaagcatatgacccccagaccaacgaatggacacaagtggctcctctgtgtcttggccgagccggagcttgtgtggtgaccgtgaagttgtag

SEQ ID NO: 227623 - DNA, 1866 bp, Artificial Sequence
  Description of Artificial Sequence: Synthetic coding sequence
atgttaatggccggacagagaggcgcatggaccatgggggacgtagtagagaagtcactggagggacccctcgctccgtcaacagatgagccatcacagaaaacaggagatctggtagaaatcctcaatggagagaaggttaagtttgacgacgccggtctcagcctcatactacagaatgggctagagactctaagaatggagaacgctttgaccgatgttatcctctgtgtcgatatacaagaattctcttgccatcgcgtggtgctggccgctgcctccaattacttccgcgcaatgttttgtaatgatctgaaagaaaaatatgagaagcgaattatcattaaaggtgtggatgctgagacaatgcatacattgctcgactacacgtatacatcgaaagctctgatcactaagcagaatgtgcagcgggttctagaagccgctaatctcttccagttcctgcggatggttgatgcatgcgcgagctttctcaccgaagccctcaatcccgagaattgcgtgggcatcctgcgcctcgccgacacacactcattggattctcttaagaagcaggtgcagtcctacataattcaaaattttgtgcagattctgaactccgaagagttcctggatctgccggtcgataccttgcatcacattctgaagtctgacgacctgtatgttacggaagaggcacaggttttcgagactgtgatgagctgggtgaggcacaaaccaagcgaaaggttgtgtctgttaccatacgttctggagaatgtgcgactgcctctgttggacccctggtactttgtggagaccgtggaggccgaccctcttatccggcagtgccctgaagtattccctttgctacaggaggctcgcatgtaccatctcagcggtaacgagatcattagtgagcgcacgaaacctaggatgcacgagttccaaagtgaggtttttatgatcattggtggatgtactaaagacgagaggtttgtggcagaagtgacttgcctggacccactcaggagatctagactggaggttgcgaaactccctttgaccgagcatgagctggaatccgagaacaagaagtgggtggagttcgcctgcgtgactctcaaaaacgaggtctacatatctggaggaaaagagacccagcacgatgtgtggaagtataattccagcataaacaaatggatccaaatcgagtacctgaacattggcaggtggcgacataagatggttgtattgggcggaaaggtctacgtgatagggggattcgacgggctgcagcgcattaacaatgttgagacttacgacccatttcacaattgctggtctgaagcggctcctcttctggtccacgtgtcctccttcgccgctactagccataagaaaaagctgtatgtgatcggcggaggtcctaatggaaagctggccacagataaaacccaatgctatgacccctctacaaataaatggagtctcaaagcagccatgcctgtagaggccaaatgcatcaacgcagtttcatttcgcgataggatttatgtcgtcggaggagctatgcgggcactctacgcctatagccccttagaggactcttggtgtctggtcacacagctgtctcacgaacgggcatcctgcggaatcgctccttgtaataataggttgtacatcaccggcggacgggatgagaagaacgaggtgattgccacggtactttgttgggatcctgaagcccaaaagctaaccgaggaatgcgttctcccccgaggggttagccaccacggttctgtgactattcgtaaatcttatactcacattcggcgtatcgttccgggagcagtttctgtatag

SEQ ID NO: 227624 - DNA, 1695 bp, Artificial Sequence
  Description of Artificial Sequence: Synthetic coding sequence
atgctcggaggcacagattgtcggacattcctaacttcccatatcaacctgaaaaaaaccctttgtgacgtgatcctgatggtccaggaaaggaagatccccgctcacagagtcgttttggcagcagcatcgcatttttttaacttaatgtttaccacaaacatgctggagtctaagtccttcgaagtggagctgaaagacgctgaacccgacattatagagcagctggtggaatttgcctacaccgcccgaatttccgtgaactctaataacgtgcagagtctactggatgctgcaaaccagtaccaaatagagccggtgaaaaaaatgtgcgtcgacttcttgaaggagcaggttgacgcttcaaattgcctcggtatctccgtgctcgccgagtgtttagactgtcctgaactgaaggctacagcagacgactttattcaccagcacttcacagaggtgtacaagacagatgaatttctgcagttagacgtgaagagggtcacccacctactaaaccaggacacccttacggtccgcgctgaggaccaggtgtacgacgccgcagtccgctggttaaagtatgacgagcctaatcgccagccattcatggtggacatcttggcaaaagtgaggtttccactgatcagtaagaatttcctaagtaaaactgtacaggccgagccccttatccaggataacccagagtgcctaaagatggtgatctcagggatgaggtaccacctgctctctccagaagaccgagaagaacttgtcgacggaacccggccacggaggaaaaaacacgattacaggatcgccctgtttgggggatcgcagccacagtcctgccgatactttaatccaaaagattactcctggaccgatatccgctgccccttcgagaagcggagggatgcagcatgcgtgttttgggacaatgtggtatatatcctcggaggatcgcagctgttcccaattaaaagaatggactgctacaatgtcgtgaaagacagttggtacagtaagctgggacccccaacaccacgcgattcactggcagcttgcgccgctgaaggtaaaatctacacaagcggcggatcagaggttggtaatagcgcactgtacttattcgaatgctatgacactcggacagagtcctggcacaccaaaccaagcatgctcacacagcggtgcagccacggaatggtagaagccaatggcctgatctatgtttgcggcggttcattgggcaataatgtttccggaagagtgctgaactcgtgcgaggtgtatgaccctgccactgagacttggacagagctctgccctatgatcgaagcgcgtaagaatcacggactcgttttcgttaaagacaagatctttgcagtgggcggacagaacggcctggggggactggacaatgtggaatattacgatatcaaactcaacgagtggaagatggtttctcccatgccatggaaaggagtgaccgttaaatgcgccgctgtcggatcaatagtgtatgtgttagccggatttcagggcgtggggcgtttaggccacatccttgagtacaacacagaaacagataaatgggttgcaaacagcaaagttcgtgcattccccgtgaccagctgcctgatttgtgttgtggacacctgtggcgctaacgaggagacccttgagacctag

SEQ ID NO: 227625 - DNA, 1761 bp, Artificial Sequence
  Description of Artificial Sequence: Synthetic coding sequence
atggcagcctctggagtagagaaatcatcaaagaaaaaaacagagaagaagttagctgcccgagaggaagcgaagctgttggcgggatttatgggcgtgatgaacaacatgagaaagcagaaaacactgtgtgatgtaattttgatggttcaggaaaggaagattccagcccatagggttgtcctcgccgctgccagtcacttctttaacctgatgttcaccaccaatatgctggaatctaagagtttcgaagttgagcttaaagatgcggaacccgacattattgaacagctggtggagttcgcttatacagccagaatcagtgtgaatagtaataacgtgcagagcctactggatgctgccaatcaataccagatcgagccagtgaagaagatgtgtgtggactttctcaaggagcaagtcgacgcctctaattgtttagggatatccgtcctggcagagtgcctcgattgtccagaactcaaagccacagccgatgactttatccaccaacactttaccgaggtctataaaaccgatgagttcctacaattagatgtgaagcgggttacccatttactgaatcaggacacactgacagtgcgtgccgaggaccaggtctacgacgcagcagtccggtggttaaagtacgacgagccgaatagacagccatttatggtggatatactagctaaggtgagattccccctcataagcaagaattttctgtccaaaacagtgcaggccgaaccgttaatccaagataaccccgagtgtctgaaaatggtgatttccgggatgaggtaccacttgctgtcccctgaagacagggaagagcttgtggatggcactagacctaggcgtaaaaaacacgattaccgtatcgcattattcggcggatcccagcctcagtcatgccggtactttaatcctaaagactatagttggacagatatacgttgtccttttgaaaagaggagagatgctgcttgcgtgttctgggacaacgtcgtgtacattctgggcggatctcagctgttccctattaaaagaatggactgctataacgttgtcaaagattcatggtattccaagctgggtcctccaaccccccgtgactctctggctgcatgtgccgcagagggtaagatctacacgtccgggggatcggaagtcggtaattcagctctgtacctgttcgaatgttatgatacacgcaccgagtcgtggcacactaaaccctccatgctcacacaacggtgcagtcacggaatggtagaggcaaatggcttgatatacgtctgtggcggtagtctcggcaataatgtatccggacgcgttcttaatagttgcgaggtctacgatccagcaaccgaaacctggactgaactgtgcccgatgatagaggcacggaagaaccacggtttggtcttcgtgaaggacaagatcttcgcagtgggtggccagaacggtctaggcggactcgacaacgtggaatactacgacataaagctgaacgagtggaaaatggtgagtcctatgccgtggaaaggtgtgaccgtgaagtgcgcggcagtggggagcatcgtgtacgtgctcgccggttttcagggggtcggccgattgggacacatcctggaatacaatacagagacagataaatgggttgcgaatagtaaagtgcgagccttccccgtgacttcttgtctaatatgcgtggtagacacgtgtggcgcaaatgaggagactttggagacctag

SEQ ID NO: 227626 - DNA, 1617 bp, Artificial Sequence
  Description of Artificial Sequence: Synthetic coding sequence
atggtccaggagcgcaaaatacccgctcacagggtggtgctggctgcagcatctcatttttttaatctgatgtttactacaaatatgctcgaatccaaaagcttcgaggtggagctcaaagacgcagaacccgatattattgaacagcttgttgaatttgcatataccgcaagaataagcgtgaacagcaacaacgttcagtccttgctcgacgccgctaatcagtatcagatagaacctgtaaagaagatgtgcgtggactttctaaaggaacaggtcgatgcgtcaaactgtctaggcattagcgtgctggctgagtgtttggactgtcctgagctcaaagccactgctgacgattttatccaccagcattttaccgaggtgtataagacggacgagtttctgcagctagacgtgaagcgggtcacccacctgctaaaccaggatactctcacagtcagggccgaagatcaggtgtacgacgctgctgtgcgctggctcaagtatgacgaaccaaatcgccagccattcatggtggacatcctggctaaggtgcgattccccctgatctccaaaaatttcctgtcaaagaccgtccaggcagagccgctgattcaagacaaccccgagtgccttaaaatggtcatatccggaatgcgctatcacctgttgtcccccgaggaccgggaagaactggtagacggtactcgtcctcgacgaaaaaagcacgactacaggattgcactgtttggtgggagccaacctcagagctgccggtattttaatcccaaagattactcatggaccgacatcaggtgccctttcgaaaagagaagggacgccgcatgcgtgttctgggataatgtagtgtatattctgggtggctctcagttgtttcctattaagcgtatggactgctacaacgttgtaaaggactcctggtattccaagctcggccctcctactccccgtgactctctcgccgcatgtgctgccgaaggcaagatctacacctctggcggtagcgaagttgggaatagcgcactctatctcttcgagtgctatgatacacggactgaaagctggcacaccaagccatcaatgctcacccagaggtgctctcatggtatggtcgaagccaatggattgatttacgtttgcggaggctcactggggaataacgtgtccgggcgtgttctgaactcttgcgaagtgtacgacccagccaccgaaacttggaccgaactgtgtccgatgattgaggctcgcaagaatcatgggcttgtgtttgtgaaggataaaatcttcgctgtgggcggacaaaatggcctgggtggattggacaatgttgaatactacgacattaagctaaacgagtggaagatggtgagtccgatgccatggaaaggcgtaactgttaagtgcgcagctgtcggtagtatcgtttacgtgctggctggctttcagggcgttggtcggctcggccacattttggagtataacacagagaccgacaaatgggtcgccaactccaaggtcagagcctttcctgtcacctcatgtcttatttgtgtggtcgacacatgtggcgctaacgaggagacactagaaacatag

SEQ ID NO: 227627 - DNA, 1161 bp, Artificial Sequence
  Description of Artificial Sequence: Synthetic coding sequence
atggccgcatctggggtggagaaatcctctaagaagaagacagagaaaaagctcgccgctcgtgaagaagctaagctgcttgccggatttatgggggttatgaacaacatgcgaaaacagaaaactttatgcgacgttatactcatggtacaggaacggaaaatcccagctcacagagtggttctagccgctgcatcacattttttcaacttgatgttcacgacaaatatgttggaaagtaagtcgtttgaggtcgagctgaaggacgctgaacctgacatcatagagcagctgcttcactacaaatttttcaaaatgaaaaacagaaaggatggcagggtgtccgtctcctacgccatcctgatccaggggctcaaaatctacgaaatttatagcacgaattttccagaacactttacggaagtttataaaaccgatgaatttttacagttggatgtgaaacgggtcacccacctcctcaatcaggacacgttaacagtaagggcagaggaccaggtgtacgacgccgctgtgaggtggctcaagtatgacgaacctaaccggcagcctttcatggtcgacattctggcaaaggtgagatttccactgatcagcaagaactttctgagcaaaacagtgcaggcggagccacttattcaggacaaccctgaatgtttgaagatggtgatatctggcatgaggtatcatctgctgagcccagaggatcgggaggaactggtcgatgggacgaggccacggagaaagaagcatgactatcgaatcgctctcttcgggggatcccagccccaatcatgccgctacttcaatccaaaagactactcttggaccgatatacgctgtcccttcgagaagaggcgggacgccgcttgtgtgttttgggacaacgtggtgtatattctggggggaagccagctgtttcctatcaagcgtatggactgctacaacgtcgtcaaagatagctggtactctaaattaggacccccaacgcctcgagattcactggcagcctgtgccgcagagggcaagatctatacctccggcggttccgaagtggggaactctgctttgtatctgttctgcctgatccctgtgaagttcatgatcctgccacagaaacatggcttatcatgtgtgcagtag

SEQ ID NO: 227628 - DNA, 1284 bp, Artificial Sequence
  Description of Artificial Sequence: Synthetic coding sequence
atggccgcatctggagtggagaagagttcgaaaaaaaaaactgagaagaaactggctgccagggaagaggccaaactactggctggatttatgggcgtgatgaacaacatgcggaagcaaaagacgctttgtgatgttattctcatggttcaggaacggaagatcccagctcatcgagtggtgcttgccgctgcatctcactttttcaacctcatgtttactacaaatatgcttgagtctaagaatttcttaagcaaaaccgtacaagccgaacctctgattcaggataacccagaatgcctaaagatggtgataagtggcatgcgataccatctgctcagccctgaagacagggaagaattggtcgacggcaccaggcctagacgtaagaagcacgattacaggatagccctgttcggcggaagtcagcctcaaagttgtcggtacttcaaccccaaagattattcatggaccgacattcgttgcccattcgagaagcggagggacgccgcttgcgtcttctgggacaatgtcgtctacattctgggtggcagccagctgttccctattaaacgcatggactgctacaatgtcgtaaaagactcatggtattcaaagttgggacctcccacgcccagagactcactcgctgcatgtgccgctgagggcaaaatctataccagcggcggttccgaggtgggaaattccgcactatatctgttcgaatgctacgatacccggacggaatcatggcatacgaagccctctatgctaactcaaaggtgctcacacggaatggtcgaggcgaacggcctcatttatgtgtgtggcggtagcctgggaaataatgtgagcggcagagtactcaatagctgtgaggtatacgacccggctaccgaaacctggacagaactttgccctatgatcgaggccagaaaaaaccacggcctcgtcttcgtgaaggataagatctttgccgtggggggtcagaacggcttggggggtttggacaacgtggagtactatgacatcaagctgaatgagtggaaaatggtaagtcctatgccgtggaagggggtgaccgttaagtgtgccgctgtaggctctatcgtgtacgtcctcgctggttttcaaggggtcggccgactgggacacattttggaatacaacacagaaactgataaatgggtggcaaattcaaaggtgagagcgtttcctgtgacctcctgtctgatttgcgttgttgatacctgcggcgctaatgaggagactctggaaacatag

SEQ ID NO: 227629 - DNA, 1533 bp, Artificial Sequence
  Description of Artificial Sequence: Synthetic coding sequence
atgctcgaaagtaagagtttcgaggtcgagctcaaggacgcagagccagacatcatcgagcaacttgtggagttcgcctacaccgctcggatttcggtcaattctaataacgtacagagcctgctggatgccgctaaccaataccaaattgagccagtcaagaagatgtgtgttgactttctgaaagaacaggtcgacgcctctaattgtctgggcatatcggtactggctgagtgtttagactgccccgagctgaaagcaacagctgacgactttatccatcagcattttactgaggtctataagaccgatgaatttctgcagctcgatgttaagcgtgtcactcacctgcttaatcaggataccctgacggtcagagccgaggaccaggtttacgatgctgccgtacgatggttgaagtatgacgaacccaatcgccagccattcatggtggacattcttgccaaggtgcggttcccccttatctcaaagaacttcctgtcaaagacagtgcaagcagaacccctcatccaggataacccagagtgtttaaaaatggtcattagcgggatgcgataccatcttcttagccctgaagaccgtgaggagctcgtcgacggtaccaggccacgcagaaagaagcatgactatagaatcgctctgttcggaggctcgcagccgcagagctgtcgctatttcaacccaaaagactactcatggacagatatcagatgtcccttcgagaagaggcgagatgccgcttgcgtgttttgggataacgtggtgtacatcctgggtggtagccagctgtttcccatcaagcgtatggactgctacaacgtcgtgaaagattcctggtattcgaagttgggcccaccaacccctcgggattccttggcggcttgtgcggcagagggtaagatttacactagcgggggtagcgaggtgggaaactctgccttatatttgttcgaatgttacgacactaggacagaaagttggcacaccaaacctagcatgttaacccagcgatgctctcacgggatggtcgaggcgaatgggctgatttacgtctgcggcggatctctgggaaacaacgtttctggtagagtgttgaatagttgtgaggtttatgaccctgccaccgaaacgtggactgaactgtgcccaatgatcgaggctcgaaagaaccacgggctggtgtttgtgaaagacaaaatctttgccgtcggagggcaaaacggcttagggggattggataacgtagagtactacgatatcaagctcaacgagtggaagatggtgtcacctatgccttggaaaggagttaccgtgaaatgcgccgctgtgggatctattgtgtacgtgctcgcgggttttcagggtgtcggcaggttagggcacatcttggaatacaacacagaaaccgataagtgggttgctaactctaaggttagggcctttcctgtcacaagctgcctcatctgtgtagtggatacatgtggcgcaaatgaggagaccctcgaaacgtag

SEQ ID NO: 227630 - DNA, 1086 bp, Artificial Sequence
  Description of Artificial Sequence: Synthetic coding sequence
atggttgacattctggccaaagtgcgctttccactcatttctaaaaacttcctgagcaaaacagtgcaagccgagccgttaatacaagacaatcccgaatgcctgaaaatggtgatctctgggatgagatatcatctcctgagcccagaggacagagaggagctggtggacggcacccgtccccgacgcaagaaacatgactatcgcattgccctgttcggtggaagccagccgcagtcgtgtaggtactttaatcctaaggactatagctggaccgatatccggtgcccattcgaaaagaggcgagatgcggcttgtgtgttctgggacaacgtggtttacatcctggggggaagtcagctttttcccatcaagcggatggattgttacaacgtggtcaaggactcctggtattcaaagctgggtcctccgacccccagggactcgctggcggcttgtgctgccgaaggtaaaatatacacctctggcggaagtgaggtaggaaactctgccctctatctgtttgaatgttatgatacaagaaccgaatcttggcacacaaaaccttctatgctgacacagcgctgctcccatggaatggtggaggccaatggcctgatttacgtttgcggaggtagcctcggtaataacgtgagtggacgcgttctgaattcatgcgaggtgtatgatcccgctacagagacgtggacagagttatgtccaatgatagaggccagaaagaaccacggactagtgttcgtgaaggacaagatctttgctgttgggggacagaatggcctcggaggcctggataacgtcgagtattacgatatcaaattgaatgagtggaagatggtgagtcccatgccgtggaagggtgtgaccgtcaagtgcgcagctgttgggagtatcgtttacgtgttggctggcttccagggagtcggccgtctcggacacatccttgaatataatacagagactgataagtgggtggctaacagtaaagttagagccttcccggttacttcctgcctcatctgcgtggttgacacctgcggcgctaacgaagaaacactggagacgtag

SEQ ID NO: 227631 - DNA, 1695 bp, Artificial Sequence
  Description of Artificial Sequence: Synthetic coding sequence
atgctcggtggtactgattgtcggacttttctgacgagccacataaatctcaaaaaaactctgtgtgatgttatactgatggttcaggagcgcaagatccctgcccatcgtgtggttctggctgccgcatcccacttctttaatttaatgtttaccacgaacatgctagaatccaagagctttgaagtggagttgaaggacgctgaacctgacatcattgagcaactggtggaattcgcgtatacagcgaggatttcggtcaactcgaataatgtgcagagcctactggacgcggctaaccaataccagatcgaacccgtgaagaagatgtgcgtcgatttcctgaaggagcaggttgatgcgagcaactgcctcggaatctctgtactggcagaatgtctcgactgtcctgaactgaaggccaccgcagatgactttattcaccagcatttcaccgaggtctacaagactgatgaatttttacagctggacgtaaaacgcgtgacacaccttttgaatcaggacaccctgacagtcagagcagaagatcaagtctatgacgccgctgtgagatggctgaagtacgatgagccaaataggcagccgtttatggtggatatactggccaaggttagattccctctaattagcaagaattttctgtctaagaccgtgcaggccgagcctctcatccaggacaatccagaatgcttaaagatggtcatctccggcatgcggtaccacttgctgtctcctgaggatagggaagaactggttgatggtacgaggcccagaaggaagaagcatgattacaggatcgcgctgttcggaggcagccagccccagtcatgtaggtacttcaatcccaaagactacagctggacagatatcagatgtcccttcgagaagcgcagggatgccgcttgcgtgttctgggataacgtggtctacatactagggggaagtcagttattccccatcaagcgaatggactgttataacgtggttaaggactcatggtacagcaagctgggacccccaactccaagagattcgttagcagcatgcgcggcagagggaaaaatttatacgagcgggggaagcgaggtgggtaattccgccctatacctgtttgagtgctacgataccagaactgagtcttggcatacaaagcccagtatgcttacccagcgatgttcccatggaatggtcgaagccaatggcctcatttacgtgtgcggtggcagtcttggaaacaacgtgagcgggagggttttgaattcctgcgaggtgtacgacccggctaccgagacctggacggagttatgtccgatgattgaggctcgaaaaaaccatggcctcgtgtttgtaaaagacaagatctttgctgtgggcggacaaaatggacttggaggcctggataatgtggagtactacgatatcaaactgaacgaatggaaaatggtaagccccatgccatggaagggtgtgacagtaaaatgtgctgcggttggctcaatcgtctacgtgttggcaggatttcagggggtcggacgcctgggacacatcctcgaatataatactgagacagataagtgggtggcgaactctaaagtgcgcgcttttccagtgacctcatgtctgatctgtgtggtggatacctgtggcgctaatgaagaaaccctagaaacatag

SEQ ID NO: 227632 - DNA, 432 bp, Artificial Sequence
  Description of Artificial Sequence: Synthetic coding sequence
atgctggggggaacagactgtaggacatttcttacctcccatattaacctgaagaaaactctgtgtgatgtaatcctgatggttcaggaacggaagatccctgcccatcgcgttgtgctggccgctgcaagtcacttttttaacctcatgtttaccaccaacatgcttgaaagcaagtctttcgaggtcgagctcaaagatgctgagcccgacatcattgaacaactcgtggagttcgcatacacggcccgtatttcagtgaatagcaataacgtgcagtctctcctcgacgccgctaatcaataccagatagagccggtgaaaaaaatgtgtgtagactttctgaaggaacaggtggatgccagcaattgcttaggcaagaagtaccaaattccagtggtttgtctcttctgcttcattctctacttctag

SEQ ID NO: 227633 - DNA, 501 bp, Artificial Sequence
  Description of Artificial Sequence: Synthetic coding sequence
atggccgcatctggagtggagaagagctccaaaaagaagaccgagaagaagctcgccgctcgtgaggaggccaaactcctcgccggattcatgggtgttatgaacaatatgcgaaagcagaagaccctgtgtgatgttattctgatggttcaggagaggaagatccctgcgcatcgtgtggtcctggccgctgcatctcactttttcaatctgatgttcacaacaaacatgttggagtccaaatcattcgaggtcgagctgaaggacgcagaacctgatataatagaacagttggttgagtttgcatataccgctagaatctcagtaaattctaataacgttcagagcttgctggatgctgccaaccagtatcagattgaacctgtcaagaagatgtgtgtggacttcttgaaagaacaggtagacgcctccaattgcctcggtgaggccgaaaaggtggatcagtctctgcctgaatgcggtatgctgtttacggtgtag

SEQ ID NO: 227634 - DNA, 1863 bp, Artificial Sequence
  Description of Artificial Sequence: Synthetic coding sequence
atggcgtccgactctatgtcctcgaagcaggctcgcaatcacattacaaagggaaaaaggcagcagcaacaccagcagatcaagaacagaagctccataagcgacggcgatggcgaagactctttcattttcgaagctaatgaagcctggaaagattttcatggctctctgctgaggttttacgagaacggagaactctgcgacgtgacattaaaggttggcagtaagttaatctcttgccacaaactggtgctggcttgcgtgatcccatatttccgggcaatgttcctgagcgaaatggcagaggctaaacagactctgatcgagatccgcgatttcgatggtgacgcaatagaggacctggtgaaattcgtgtatagttcccgcctcacactgaccgtggataacgtgcaaccactgctttacgccgcttgtatcttgcaggtggagctcgtcgcacgcgcttgctgtgagtacatgaagctacacttccacccttccaactgcctggccgtcagggcctttgccgagtctcataatagaatagacctaatggacatggctgaccagtacgcatgtgaccactttaccgaggtggttgaatgcgaggactttgtatccgtgtcaccccaacacctgcataagctcttgtccagttctgacctcaacatagagaacgaaaagcaggtgtacaatgcagctattaagtggctcctggccaatccccaacatcactctaagtggctggatgagacactggcgcaggtgaggttgccactcttgcctgtagatttcctgatgggtgtggtggccaaagaacagatagtgaaacagaacctcaagtgcagagacttgctggatgaagccagaaattaccacctgcatctgtcatcccgcgcagtgccggattttgagtactccatacgcaccactccacgtaaacacactgccggagtgctattttgcgtgggcggtagagggggaagcggcgacccgtttaggagtattgagtgctattcaatcaataaaaactcttggttcttcggtccggaaatgaactctaggaggaggcacgtgggagtcatttcggttgaggggaaggtttatgccgtcggtggccatgacggcaatgagcacttaggctccatggagatgttcgatcctctaacaaacaagtggatgatgaaagcctctatgaacactaagaggcgaggcatagccctcgcctctctcggtgggccaatatatgcaattggtggcctggacgataatacttgctttaacgacgttgaacggtatgacattgaaagcgatcagtggtcaactgtggctcccatgaacacgccaaggggtggggtggggtccgtcgccctcgtcaatcacgtgtacgccgtgggagggaatgacggcatggcatccctgtcctcagtcgagcgctacgacccacatctcgataagtggattgaggtaaaggaaatgggacagaggcgggctggcaacggcgtgagtaagcttcatgggtgcctctacgttgtcggaggcttcgatgacaattctcctctgtcatctgtggaaagatacgaccccaggagtaacaaatgggactatgtcgccgcactgaccacccctcgcggaggagtgggcattgcaaccgtgatgggtaaaatcttcgcggtcggtggccacaacggtaacgcgtacctgaataccgtggaagctttcgatccagttctgaatcgctgggaactggtgggaagcgtgagccattgtagggccggtgcgggagtagccgtatgttcctgcctaacttcacagattagggatgtcggtcacggttccaacaacgtggtggactgtatgtag

SEQ ID NO: 227635 - DNA, 1863 bp, Artificial Sequence
  Description of Artificial Sequence: Synthetic coding sequence
atggcttcagattccatgagctccaagcaagctcgcaaccacatcacaaaaggaaaacgacaacagcagcaccagcagatcaagaacagatcatccatcagcgacggcgacggggaggacagctttatctttgaggccaatgaggcttggaaggactttcacgggtctctgctacgcttctacgagaacggcgagctgtgtgacgtgacactgaaggtcggatccaaactgatttcatgccacaaactcgtgctagcctgcgtgatcccgtatttcagagcaatgttcttatccgaaatggccgaggctaagcagaccctcatagaaatccgggattttgacggggatgcgattgaggacctggttaagttcgtgtacagtagccggctcacattaactgtggacaacgtccagccactcctctacgccgcatgcatcctgcaggtggaattagtggccagagcatgttgcgaatacatgaaacttcatttccatccatccaactgtttagcagtgagggcgtttgcggagtctcataatagaattgatctcatggatatggcagatcagtatgcctgcgaccattttactgaagtggtggaatgcgaagatttcgtgagtgtgagtccccagcacctgcataaactgctgtcaagtagtgacttgaacattgagaatgaaaagcaagtctacaatgcagcaattaaatggcttctggccaacccccaacaccactccaagtggctggatgagaccttggctcaggtgagattaccactgttacctgtggatttcctcatgggagtggtggctaaagaacagattgtcaaacagaaccttaaatgtagggatcttctggatgaggcaagaaactaccatcttcatctttcctctcgggctgtcccagacttcgagtattcaatccgcacaactccgcgaaagcacacagccggagtgcttttttgcgtgggagggaggggagggtcgggagatcctttcagatccattgagtgctacagcatcaacaaaaatagttggttcttcggacctgaaatgaattctcggaggcgtcacgtaggggtgatctctgtcgagggcaaggtgtacgccgtcggcggacatgacggcaacgagcacctcggaagcatggagatgttcgacccattgacgaataagtggatgatgaaggcttccatgaatactaagcgacggggaattgctctagcctcacttgggggtcctatctacgcaatcggtggcctcgatgacaatacttgtttcaacgatgtagagagatatgacatcgaaagcgaccaatggtctacggtagctcctatgaacacaccgcgtggaggtgtgggctcggtagccttagtgaatcatgtgtacgccgtgggcggaaacgacggaatggccagcttatcatccgtggaacgctacgacccgcatctggataagtggatagaggtgaaggagatggggcagcgtcgcgcaggtaatggagtctctaagctacacgggtgtctctacgtagtcggcggttttgatgataatagccccctcagttctgttgagaggtacgaccccagaagcaacaagtgggactacgttgcagctctgacaacaccaaggggcggtgtgggtatcgctacagtcatgggaaaaatctttgctgtgggagggcacaatggcaatgcttatctgaatacagtggaggcgttcgacccagtgctgaacaggtgggaactagtagggagcgtctcacactgccgtgccggagcgggtgtcgcggtgtgtagttgcctaacctcccagatcagagacgtcggacacggctcaaacaatgtagtcgattgcatgtag

SEQ ID NO: 227636 - DNA, 810 bp, Artificial Sequence
  Description of Artificial Sequence: Synthetic coding sequence
atgaattcccgtcgaaggcacgttggtgtcattagcgtggaaggcaaagtttacgcggtaggcggacacgatggtaatgagcacctaggctcaatggagatgttcgaccccctgacgaataaatggatgatgaaggcctccatgaacaccaaacggaggggtattgcgttggcatcactcggcggtccaatctacgccatcgggggactggacgataacacgtgttttaacgatgtagagcggtacgatattgagtccgaccaatggagtacggtggccccaatgaacactcctcggggaggcgtcgggtcagttgcgttggtaaatcacgtctatgcagtcgggggaaacgatggcatggccagtctgagttccgttgagagatacgaccctcatctcgataagtggatcgaagtcaaggaaatgggccagagaagggcgggaaatggcgtttctaagctgcacggttgtctttacgtcgtgggcggattcgacgacaactcaccactgtcctccgtcgagcgctacgaccctcgctcaaataagtgggactacgtggctgctctgaccacccccagggggggtgtgggtattgctaccgtaatgggcaaaatcttcgctgttgggggacacaatggcaacgcctaccttaacaccgtcgaggcctttgatcctgtgctgaacaggtgggagctggtcggctctgtctcccattgcagggctggcgcaggggtggcagtatgcagctgcttgacatctcagatccgcgatgtgggccacggttctaataacgtagtggattgtatgtag

SEQ ID NO: 227637 - DNA, 1875 bp, Artificial Sequence
  Description of Artificial Sequence: Synthetic coding sequence
atgcagcctgaccctagaccatcaggcgctggcgcttgctgtcggttcctccctctccagtcacaatgccccgagggcgctggcgatgcagtgatgtatgcctccaccgaatgcaaagccgaagttacaccttcacagcacgggaaccggacattcagctacaccctcgaggaccacacaaaacaggctttcggtataatgaacgagctgcggctgagtcaacagttgtgcgacgtaaccctgcaggtaaaatatcaggacgcaccagccgcacagttcatggcccataaagtggttctagcctcttccagccccgtctttaaggctatgtttaccaatggcctgagagaacagggaatggaggtggtgtcgattgagggcatccacccaaaagtcatggaacggctcatcgagtttgcatacactgccagtataagtatgggagaaaagtgtgtgctgcacgtgatgaacggcgcagtaatgtatcagattgacagcgtagtgagagcatgcagcgactttctcgttcagcagctcgatcctagcaacgctatcgggatcgcaaacttcgccgagcagatcggatgtgtggagctgcatcaacgcgctcgcgaatacatatatatgcacttcggcgaggtagccaaacaggaggaattctttaatctgtcccactgccagctcgtaacattgatctcgcgggacgacctgaatgtcagatgcgagtcagaggttttccatgcatgtattaattgggtgaaatacgactgcgagcagagacgattttatgtgcaagcgctcctgcgagccgtgaggtgccatagcctgacacccaacttccttcaaatgcagcttcagaaatgtgaaattctccagtccgactccagatgcaaggattatctggtgaagattttcgaggagttaacacttcacaagcctacccaagtgatgccttgccgggctccaaaggtgggtcgactgatctatactgccggaggctacttccgacagagcttgtcatatttggaagcttataatcctagtgacggaacctggctgcgcctggcggacctccaagtgccccgttctggattggcaggctgcgtagtagggggactgctttacgctgtggggggtcgcaacaatagtcccgacgggaacacagattcttctgccttagattgttataaccctatgacaaatcagtggagcccatgtgctccgatgagtgtgcctcgcaacagaatcggagtgggtgtaattgatggccacatctacgccgtggggggatcccatgggtgtatccatcacaattctgtggagcgatatgagcctgaaagggacgagtggcacttggttgctcccatgttaactcggagaataggcgtgggcgtggccgtgctgaaccgtctgctatatgccgtcgggggatttgacggcactaaccgcttaaactccgctgaatgttactatccggaaagaaacgagtggagaatgatcaccgctatgaatacaattcgatctggagcaggagtctgcgtgctgcacaattgcatctatgcggctggtggttacgacggccaggaccaactcaatagcgttgagagatacgatgtggagactgagacctggacctttgtggctcctatgaaacatcgtcgtagcgctttgggtatcactgtgcaccagggacggatctatgttctggggggatatgatggacacacctttttagactctgttgaatgctacgacccagatactgatacttggagcgaagtgacccggatgacaagcggcagatctggggtcggagtggccgtgaccatggagccatgtcggaagcagattgatcagcaaaattgcacttgctag

SEQ ID NO: 227638 - DNA, 1875 bp, Artificial Sequence
  Description of Artificial Sequence: Synthetic coding sequence
atgcagcccgacccaaggccaagcggggcaggtgcatgttgtaggtttttgcctctgcaaagccaatgtccagaaggcgctggagacgcagtaatgtacgcaagcacagagtgtaaggccgaggtaactccctcacagcatgggaacagaactttttcttatactctcgaggatcataccaaacaggcatttggaatcatgaatgaacttcgtcttagtcagcagttgtgtgacgtaaccctgcaggtcaaatatcaggatgcccctgccgctcagttcatggcccacaaggtcgtgctggcatcctcatctcccgtgtttaaagctatgttcaccaatggattgagggaacaagggatggaggtggtgtctattgaaggaattcaccccaaggtgatggagcggctgattgaatttgcttacacagcttctattagcatgggggagaaatgcgtcctacacgtcatgaacggggcagttatgtaccaaatcgacagtgtggttcgcgcatgtagcgatttcctggtccaacagctggatcccagcaacgcaatcgggattgctaattttgccgagcagatcggatgtgtagagctgcatcaaagagcgagggaatatatatatatgcactttggggaggtagccaagcaagaagaattttttaatctgtcccattgtcagctcgtaactctcattagccgagatgacctgaatgtccgatgcgagtctgaggtgtttcacgcatgtatcaattgggtgaaatatgattgcgagcagcgcagattttacgtgcaagctctcttgcgggcagttagatgtcacagtctgactcctaacttccttcagatgcagcttcagaagtgtgaaatcctccaatcggactctcgatgcaaagactacctggtaaagatttttgaagaactcaccctgcacaaacccacccaggtcatgccatgtagggcacccaaagtgggtagactcatatataccgccggaggctattttcgacagagtctgtcctatctggaggcctacaacccttctgatggaacctggctgcgcctggccgacctccaggttcctcggagcggccttgcagggtgtgtcgtaggaggactcctctatgccgtgggcggacgcaacaactctcctgatggaaacaccgacagctcggccctggactgttataaccctatgactaatcagtggtcaccatgcgctccaatgtccgtgcccaggaaccgcattggagtgggggtgatagacggccacatttacgccgtggggggaagccacggttgcattcatcataattctgtggaacgctacgagcctgaacgggatgaatggcatctggtagctcccatgctaactcggaggataggtgtgggggtggctgttttgaaccgcctgctatacgccgtaggtgggtttgatggcacaaatcgcctcaacagtgcagagtgctactatcctgagcggaacgagtggaggatgattacagctatgaatacaatacgcagcggtgccggtgtgtgcgtgttacacaattgtatttacgccgcagggggatatgacgggcaggaccaactcaacagtgttgagcggtacgacgtggagactgaaacttggacgttcgtggcaccgatgaagcacagacgtagtgccttgggaattacagtgcaccagggacggatatacgtgcttggcggatatgatgggcacacgttcctggactcagtagagtgttatgatcccgacaccgatacctggagcgaggttacacgcatgaccagcgggagatctggcgtcggcgtagccgtgacaatggagccctgtaggaagcagatcgatcagcagaactgcacctgttag

SEQ ID NO: 227639 - DNA, 2199 bp, Artificial Sequence
  Description of Artificial Sequence: Synthetic coding sequence
atggagggaggagatcagagtgaggaggagccccgagagagaagccaggccggaggaatgggtaccttgtggtctcaggaatcaacgccagaggaaagattgccagtggaagggtctcggccttgggcagtcgccaggcgcgtgctcacggcaattctaatcttgggccttcttctctgctttagcgtgttgttattctacaactttcagaattgcggtcctaggccctgcgagacgagtgtctgtctggaccttagagaccactatcttgcctcaggcaataccagcgtagcgccttgtacagactttttctcctttgcctgtggcagggccaaggaaactaacaatagctttcaagaactcgcaactaagaacaagaaccgcctgcggagaatcctggaagtgcaaaattcctggcaccctggctctggcgaagagaaggctttccagttctataacagctgcatggacactttggctattgaggccgctggaaccgggcctcttcgacaggttatcgaggagctgggtggttggcgcatctcaggaaaatggacatctctgaatttcaaccgaacactcaggctgctcatgtctcagtatggtcattttccgttctttagagcctacttgggcccacaccctgcctctccacatacaccagtcattcaaattgaccagccagagttcgatgtcccccttaaacaggaccaagagcagaaaatttatgcacaaattttcagggaatatcttacctacctgaaccagctcggcacactgctgggaggagatcccagcaaggtacaagagcatagctccttatctattagcattacctcacgcctgtttcagttccttcggcctctcgaacaaagaagagctcaggggaagttgttccaaatggtgaccattgatcagctgaaagagatggcccctgccatcgactggttgagctgtctgcaggcaacatttaccccaatgagtctctctccatctcagtccctcgtggtgcacgatgttgaatatctgaagaatatgtcccagctggtggaggaaatgttacttaaacaaagggatttcctgcaatcgcatatgattctcggcctagtggtgacgctttctccggcactcgactcacaattccaggaagcgaggaggaagctttctcagaaactccgtgagttaaccgagcagccacctatgcctgcaaggcccaggtggatgaagtgcgtcgaggagactggcacattcttcgaacctactttggccgcactgttcgttagggaagccttcggccctagtacacggagcgccgctatgaagcttttcacagcgatcagagacgcactgatcacacgtctgagaaacttaccatggatgaatgaggagacacagaacatggcccaggataaagtcgcccaattgcaagtggaaatgggggcttcagaatgggcgctcaaacccgagctagccagacaggaatataacgatattcagttaggatcttctttcctccagagtgttctgagctgtgtgcggagcctacgcgcacggatcgtccagtcatttctgcagccccaccctcagcacagatggaaagtctctccctgggacgtgaacgcatactatagcgtgagcgaccatgttgtcgtgttcccagctgggcttctgcagcctcccttcttccacccagggtaccctagggccgtgaactttggcgctgctggcagcataatggcccatgagttgctgcacattttctaccagttgctcctccccggtggttgtctagcatgcgataaccatgcactacaggaggcgcacctctgccttaagaggcactatgcagcctttcctctcccaagccggacctctttcaatgatagcctcacattcctggagaatgccgctgatgtgggcggactggcaatagccctgcaggcctattcaaaaaggctactgcgacatcatggggagaccgtgctgccaagcttagacctgtccccgcagcaaattttttttcgcagttacgcccaggtcatgtgccgcaaaccctctcctcaagactcgcacgacacccacagcccacctcatttgcgagtgcacggcccacttagcagcacccccgcatttgctcggtatttccgctgtgctcggggagctctgttgaacccctctagtagatgccaactttggtag

SEQ ID NO: 227640 - DNA, 1935 bp, Artificial Sequence
  Description of Artificial Sequence: Synthetic coding sequence
atgagtagacagttttcatcacgatcaggataccgctcaggcggaggtttttcttcggggtctgctggaattattaattaccagaggagaactacttcaagcagcacaaggcgttccggcggaggcggtgggagattctcttcttgtggagggggaggcggttcctttggggcaggcggaggattcggtagcaggagtctcgtcaacctcggtggatctaagagtattagcatctcagtggccagagggggtggccgagggtcaggtttcggaggcggatacgggggagggggtttcggcggagggggatttgggggaggcggtttcgggggtggcggaatcggtggcggagggtttggcggttttggatcaggaggagggggatttgggggagggggatttgggggtggaggttatggaggaggatatggacccgtttgcccacctgggggtatccaggaggtgaccataaatcagtctctcctgcagcctctgaacgtcgagattgaccctgaaattcaaaaggtgaaaagcagagaacgagaacagataaagtctctgaataatcagtttgcctcattcatcgataaggtcaggttcttggaacagcaaaaccaggtgctacagaccaaatgggagctcctgcagcaggtagacacctccactaggacacacaatctggagccctatttcgaatcctttataaataatctccgaaggcgggttgaccagctgaagagcgaccaatcaagattagacagtgagctgaaaaatatgcaggacatggtcgaggactaccggaacaaatacgaggacgaaatcaacaagagaactaatgccgaaaacgagtttgtgactataaaaaaggacgtagatggagcttatatgacaaaggtcgacctgcaagcaaagttggataaccttcagcaggaaatcgatttcctaaccgccctataccaggccgagttgagccagatgcagactcaaataagcgagactaatgtcattctgtcaatggacaacaataggtctctggacctggatagtataatcgcagaggtgaaggcccaatacgaagatatcgcacagaagagtaaagccgaggccgaaagtttgtaccagagtaagtatgaggaactgcagatcaccgccggacggcacggcgactcagttaggaactctaagatagagatcagcgagcttaatagggtcatccagagactgcgatctgagattgacaacgttaaaaaacagatctccaacctacagcaaagtattagcgacgcagagcagaggggcgagaatgcacttaaggacgcaaaaaacaaactgaacgatctcgaagacgcacttcagcaagccaaagaggacttagcccgattattgagagactaccaggaactcatgaacacaaagctcgcccttgacttagaaatcgctacttatcggaccttgttggagggggaggagtcgcgcatgtctggcgaatgcgcgcctaatgtttctgtaagcgtgtccaccagtcacacaaccatcagtggcggagggagccgcggaggcggtggcggtggatacggaagtggcggatctagctatggctcgggcggtgggagctatggtagcgggggaggcggtggagggggacgcggatcatacgggtcagggggtagttcttacggaagcggaggagggtcttatgggtcaggaggcggaggagggggtcacgggtcatatggcagtggctcatcctcgggcggttatcgtgggggaagtggcggtggcggtggtgggtcttccggcggtagaggcagtggcggtggatcatctggaggcagtatcggaggcaggggtagcagcagtgggggagtcaaaagttcgggcggtagctcttcggtcaagttcgtgagcaccacttatagtggcgtaacaaggtag

SEQ ID NO: 227641 - DNA, 1755 bp, Artificial Sequence
  Description of Artificial Sequence: Synthetic coding sequence
atgagtgtgcgctactcaagctcaaagcattactctagtagccgctctgggggtgggggtggaggcggaggctgcgggggaggcggaggggtcagcagtctgcggattagcagcagcaaggggtccctggggggtggcttctctagtgggggattttcagggggaagtttctcccggggaagctctggagggggttgttttggcggaagctccggagggtatggcggactgggtgggttcggtggcggttctttcaggggaagctacggaagctccagcttcggcggatcatatggaggcatttttggaggaggatcattcggtggcggatcattcggcggagggtcttttggcggaggtgggtttggagggggaggtttcggtggcggttttggaggcggattcggaggcgacggcggtctcttatcaggcaacgaaaaagtgactatgcagaacctcaatgatcgtctggcctcttacctggacaaagttcgggcattggaagagtctaattacgagctagaggggaagattaaggaatggtacgaaaaacacggtaacagtcatcagggcgaaccacgagattatagcaaatactacaagaccattgatgatctgaagaaccaaattctaaacctcactaccgacaacgcaaacatcttgctccaaattgataacgctcgactggcagctgacgacttcagactcaaatacgaaaatgaagtggctttgcgccagagtgtggaggcagatataaacgggcttcgccgtgttctcgatgaactcacattaactaaggccgatctggagatgcagatcgagtctctgaccgaggagctcgcctacctcaagaaaaaccacgaggaggaaatgaaagacctcagaaatgttagtaccggtgatgtgaatgtcgagatgaacgctgctccaggagttgacttgactcagcttctgaacaatatgaggagccaatatgaacagctggccgagcagaataggaaggatgcagaagcctggtttaatgagaagtccaaggagttgactactgagatagataacaacattgagcagatttcctcttataagagtgaaatcaccgaactgcggaggaacgtgcaagccttggagatcgagcttcagagtcagctagctctgaagcagtctcttgaagcctctctagcagaaacggaaggacgatactgtgtgcagcttagccagatccaggcacagatctccgctcttgaggagcagttgcagcagataagagctgagacagaatgccagaacacagaatatcagcaactcctggacattaagatccgcttagagaacgaaatccagacctacagatcactgttggagggagaggggtccagcggaggtggcggtagggggggaggctcttttggcggtggctatgggggtggatcaagcggcggaggatcgtccggaggaggccacggagggggtcatggaggctccagcggcggtggttacggcggagggtcaagcggaggaggtagttcaggcggagggtatggtggtggatctagtagtggaggacatggtgggtcctcttctggcggatacggcggtggcagctctggaggcggaggcggtgggtacggcggtggcagcagcgggggaggatcgagctcaggaggaggttacggcggtgggtccagttcaggcggacacaaatccagttcctccgggtcagttggcgagagtagtagtaagggcccacgctactag

SEQ ID NO: 227642 - DNA, 1485 bp, Artificial Sequence
  Description of Artificial Sequence: Synthetic coding sequence
atggatctctcaaataacactatgtctctatccgtacgcacacctggcctgagcagacgtctcagctcacagtctgtgatcggcaggccccgtggaatgtccgcttcgtcggttggctctggctacgggggttccgctttcggctttggagcctcatgtggcggaggtttttccgcggcttccatgttcggctccagctccggattcggtggcggatcgggctcgtcaatggccggaggcctcggcgctggatatggcagagccctggggggtggttcattcgggggactgggcatgggctttggtgggagccccggaggaggcagtctggggattctgagcggaaatgatggcggtctgttaagtgggtccgagaaagaaaccatgcaaaatttgaacgatagattagcaagttatctcgataaggtccgcgctctcgaggaggcaaacactgaactggagaataagatccgggaatggtatgagacccgaggtacaggtacagcagacgcctctcagtcagattactccaagtattatccactgattgaagatcttcgcaataaaataatttccgcctctattggcaatgcacagctactgcttcagatcgacaatgccaggctggccgctgaggatttcagaatgaaatacgagaacgagcttgctttgcgtcagggagttgaagctgacatcaacggcctccggagggtgctggatgagctcacgctgaccaggacggacctggagatgcagatcgaatctctgaacgaggaactggcatatatgaagaagaaccacgaggatgagctgcaaagcttccgagtcggcggacccggtgaggtgtcagttgaaatggatgccgctccaggagtagatcttactaggctgctcaatgacatgcgcgctcagtatgagacaatcgccgagcaaaatcgcaaagacgctgaggcatggtttattgagaaatcaggtgaattacgtaaggagataagtacaaatactgagcaactccagtcctcgaaaagtgaggttactgacttgcgacgggctttccagaacctcgaaatcgagcttcagtcacaactggccatgaagaaatccctagaggattcactggcggaagccgaaggggattactgtgcacaactcagccaggtgcagcagctgatatccaaccttgaggctcagttgcttcaggtacgggcagacgccgagcgacagaacgtagatcatcagcgattgctcaacgttaaggcccgtctcgaactggaaatcgaaacatacagacgtcttcttgacggagaagcacaaggggatggactggaagagagtttattcgtgactgacagcaagtctcaggcccaatctactgactcaagcaaggaccctactaagacgagaaaaatcaagaccgtggtgcaagaaatggtgaatggtgaagtggtaagttctcaagttcaggagattgaagagctcatgtag

SEQ ID NO: 227643 - DNA, 1068 bp, Artificial Sequence
  Description of Artificial Sequence: Synthetic coding sequence
atgtctctgcgccttcagagctcgtctgcgtcatacgggggagggtttggaggaggctcttgccagctgggaggcggtcgtggagtgtcaacctgcagcacgaggtttgtgtctggagggagcgccggtggatatgggggtggggtttcatgcgggttcggcggtggggcaggatcaggattcgggggtgggttggggggtggctttggtggcggatttgctggaggtttcgtggactttggagcttgcgatgggggattactcaccggcaacgagaagatcacaatgcagaacctgaatgacagactggcgagctacctcgagaaagtccgggctttggaagaagctaatgctgacctggaagtgaaaatccgagactggcacttgaagcaatccccagcaagtccagaaagagactacagtccctactataaaaccatcgaggaattacgggacaagattctcacagccacaatagagaacaatcgagttatcctggagattgacaacgctcgtctggcggcagacgacttccgactcaagtatgagaacgagttagccctcagacagagtgtggaggccgacatcaatggcctcagacgagtgctggacgagctgacactctctaagacagatctggaaatgcagattgagagcctgaatgaggagttggcctatatgaaaaaaaatcatgaggaggagatgaaagaattctctaatcaggtggtagggcaagtgaacgtagaaatggatgccaccccaggcattgacctcactcgggtgctggctgagatgagggagcagtacgaggcaatggccgagagaaatagaagagacgccgaagagtggttccataccaagtccgccgagctaaataaggaggtgtctacgaacacagctatgatacagacatcgaaaactgagattaccgagctgaggaggacactacagggactcgaaattgaacttcagtcgcagttatctatgaaggcgggacttgaaaacacagccgcagaccccggaacacaccagcagcaccgtggtcccgctgagcgtgcaccccagtag

SEQ ID NO: 227644 - DNA, 1377 bp, Artificial Sequence
  Description of Artificial Sequence: Synthetic coding sequence
atgtccctcaggcttcagagtagctctgcaagctacggtgggggatttggtggcggatcatgccagcttggagggggtcgtggtgtttctacatgctcaacccggttcgtgagcggcggatccgctggcggttatgggggaggcgtgtcatgtggctttggtgggggagctggctctggattcggcggaggatatggcggtggtcttggtgggggatatgggggaggactggggggagggtttgggggaggcttcgcaggaggtttcgtggatttcggtgcctgcgacgggggtcttctgacgggcaacgagaaaatcaccatgcagaatttaaatgaccgactcgcctcataccttgaaaaagtgagggccctggaggaggccaacgcggatctcgaggtaaaaatcagagattggcatctcaaacagagtcccgcttctcctgagcgtgactactccccttactataaaaccattgaggaactccgagacaagatccttaccgcaaccatcgagaataatagggtcattttggaaattgataatgcgagacttgccgcagacgactttcgtctcaaatatgaaaacgaactggctttgcgacagtctgtggaggccgatattaacggtcttcggagggttctggacgaactaactctttccaaaaccgatctcgagatgcagatagaaagtctgaatgaagaactggcatatatgaaaaagaaccacgaagaggagatgaaggagttctcaaatcaggttgtcggccaggtgaacgtggagatggatgccacacccggtatcgatctgacgcgagtcctcgccgagatgcgagagcagtatgaagcaatggccgaaaggaaccggcgagatgccgaagaatggttccatacgaaaagcgcggaactgaataaagaagtctccaccaacacggccatgatccagaccagcaagacagaaatcaccgagctgaggcgcaccctgcagggcctcgagatcgaactccagtcccaattgagtatgaaagcaggtcttgagaacacggtagctgagactgaatgcaggtacgcccttcagcttcagcagattcaagggctcatctccagcatagaagcccagctgagtgagctccgaagcgagatggaatgtcagaatcaggagtacaaaatgctcttagacattaaaaccagactggagcaggagatcgcaacttatagatcgttattagaaggtcaggacgctaagatgatcgggttccccagtagcgctgggagcgttagccctagaagcacgtctgttaccacaacatcttccgcatccgtgacaacaacaagcaatgcgtccgggagaaggacatcagacgtccgcagaccatag

SEQ ID NO: 227645 - DNA, 1263 bp, Artificial Sequence
  Description of Artificial Sequence: Synthetic coding sequence
atgagtctgcggcttcaatccagcagtgcctcttacggaggcggatttggtggcggaagttgccaactgggcggaggccgtggggtgagcacttgttctaccaggttcgtcagcggagggagcgctggtggctacggcggaggcgtgtcttgcgggtttgggggaggggctgggagcggcttcgggggtggttatgggggaggcctggggggagggtatggaggcggactcgggggaggattcggcggtggatttgccggagggttcgtcgactttggagcctgcgatggcggtcttctaacaggaaacgagaaaattaccatgcagaacctcaatgaccgacttgctagttatttagaaaaggtccgggctctggaagaagccaatgctgacctggaagtgaagatcagggattggcacctgaagcaaagtccggctagcccagaaagagactactccccatactacaagaccatcgaagagcttcgagacaaaatcctcacagcaactatcgagaataacagggtcatcctggagatcgacaacgcgaggctggcagccgacgatttccgactgaaatacgagaatgagcttgcgcttcgacagtcagtggaggcggacatcaacgggctgcggagagtacttgatgagttaaccctgtccaagacagatctggaaatgcagattgaatcactcaatgaggaactggcgtatatgaaaaagaaccatgaggaggagatgaaagagttctcaaaccaggtggtgggccaggtgaacgttgaaatggatgccactccgggaatcgacctcacccgcgtgctggcagagatgagagagcagtacgaagccatggcagagagaaatcgtcgggacgctgaggaatggttccatactaaatcagccgagctcaacaaagaggtttcaaccaacactgcaatgattcagactagcaaaaccgaaatcaccgaattgcggagaacattacagggcctggagatcgagttgcaaagccagctcagcatgaaagctggcttggagaacaccgtcgctgagactgagtgccggtatgcattgcagcttcagcaaattcagggcttaatatcttctatcgaggcccagctcagtgagctcagatcagagatggaatgccagaaccaggaatacaagatgctgcttgatattaaaaccaggctggaacaggaaatagccacctacagaagtctccttgaaggacaggacgctaagaagaggcaacctccatag

SEQ ID NO: 227646 - DNA, 1371 bp, Artificial Sequence
  Description of Artificial Sequence: Synthetic coding sequence
atgaccactacatttctccagacttcctcatctacctttggcggtggcagcacccgcggaggctccctattggccggaggcggaggctttgggggaggcagcctttccggaggagggggaagtcgcagtatctcggcgtcaagtgctcgtttcgtgtcttccgggtccggcggaggctatggcggtggaatgcgagtatgcggcttcggtgggggagccggttccgtcttcgggggagggtttgggggtggtgtaggtgggggatttggaggaggcttcgggggtggagacggcggacttctcagcgggaacgagaaaattacaatgcaaaatttgaacgatcggctggcatcctatttggacaaagttagagccctggaagaagccaatgccgaccttgaagtgaagattcacgactggtaccagaagcagacgccgacatctccagagtgtgactattcacagtacttcaagaccatcgaggaattaagggataaaatcatggcgacaaccatcgataactccagggtaattctcgagattgataatgctcgactcgccgctgatgacttcaggcttaaatatgagaatgagctggccctgagacaaggagtggaggccgatatcaacgggctccgtcgagtcttggacgaattgacactggctcgcacggacttagagatgcagatcgagggactaaatgaagagcttgcgtatctgaagaaaaatcacgaagaagaaatgaaagaattcagcagtcagctcgctgggcaggtcaacgtggagatggatgcggctcccggagtggacttaactcgagtgctggctgagatgcgcgagcagtatgaggccatggccgaaaagaaccgcagggacgtggaggcctggttcttcagcaaaacggaagaactgaacaaggaagtagcatcaaataccgagatgattcagactagtaaaacagagataacagacttgaggagaacaatgcaggaacttgaaatcgagctccaaagccagctatctatgaaagctggcttggagaactccctggcagaaacagaatgtcgctacgccacccagctgcagcagatccaaggattaatcggcggtctggaggcccagctctctgagctgagatgcgaaatggaagctcaaaaccaggagtataagatgctcctggatattaagacccgtctggaacaggaaattgctacataccgcagcctgttggagggccaagacgcaaaaatggctggcatcgcaatccgagaagctagcagcggaggcggtggcagttcctctaacttccacatcaacgtagaggagtccgtcgatggacaggtggtgagctctcataagcgcgagatttag

SEQ ID NO: 227647 - DNA, 876 bp, Artificial Sequence
  Description of Artificial Sequence: Synthetic coding sequence
atgaccggcaccaggtccagaccacaacctgcccaaaacgcaactaccgctaacacctcccgacccctcaaatcatccgggacacgatacgagaacgaattggccctcaggcagggggtggaagccgatatcaatggactgcggagggtcctcgatgaactgacactagcgagaacagatttggagatgcagatagagggcctaaatgaagagctggcctacctgaagaagaaccacgaagaggagatgaaagaattctccagccagctagcaggtcaagtgaatgtggagatggacgccgctcccggtgtggatctgaccagagttctggccgagatgcgagagcagtacgaagccatggccgaaaaaaatcggagggatgtggaggcatggttttttagtaagacggaggaactgaacaaagaggttgcttctaatacggagatgattcagacatccaaaaccgagataaccgatttacggaggacaatgcaggagctggagatagaacttcagtcacaacttagcatgaaggccggactcgagaactctctggctgaaaccgaatgtagatacgcaacccaacttcagcaaattcaaggacttattggagggcttgaggctcagttgtccgaactaagatgcgaaatggaggcccaaaatcaggagtacaagatgctgctggacatcaaaactagactggagcaagagattgcgacctaccggagcctgttggagggtcaggatgctaagatggctggcattgccattcgggaagcaagctcaggtggcggaggatcatccagcaacttccacatcaacgtcgaggaatccgtcgatggccaggtcgtgtcaagccataaaagggaaatctag

SEQ ID NO: 227648 - DNA, 1371 bp, Artificial Sequence
  Description of Artificial Sequence: Synthetic coding sequence
atgacaaccaccttcctgcagacttccagcagcacctttggtggcggaagcaccagaggaggatccctgctggccggagggggaggctttggaggaggctctctttctggagggggtgggagtcgctcaatatccgcatcatcagcaagattcgtttcatccgggtcaggaggagggtatggaggcggaatgcgggtttgcggatttggtgggggagctggaagcgtgttcggtgggggattcggaggtggcgtcggcggaggatttggcggagggtttggcggaggcgacggcggtcttctctcaggtaacgagaagattacaatgcagaatttgaatgatcgattggcctcttacctggataaagtcagagccctggaggaggccaacgccgacctggaagtgaagattcatgactggtaccagaaacaaaccccaacctcgcctgaatgtgactatagccaatatttcaaaactattgaggaactaagagacaagattatggccaccacaattgacaacagccgggttatactggaaatcgacaacgctcggctggctgctgatgactttcgccttaaatacgagaatgagctcgcactgagacagggagtggaggccgatatcaatggtctgaggagggtgttagatgaactaactcttgctaggactgaccttgagatgcaaatagaggggctcaatgaagagctggcatatctgaagaagaaccacgaagaggaaatgaaagaatttagctcacaattggctggacaagtgaacgtcgaaatggacgcggcaccaggagttgatctgacaagggtcctggcggagatgagggaacagtacgaggctatggccgagaagaataggcgagacgtggaggcctggttctttagtaagaccgaggagctgaacaaggaagtggcatccaacacagagatgatacagacatcgaagacagagatcaccgatctgcgccgaactatgcaggaattggagatcgaattgcagtctcaactgtcaatgaaggccggtctggaaaactctctggctgaaacggagtgccgttacgcgactcagctgcaacagatacagggattaatcggagggctggaggcccaactttctgaactgcgctgtgaaatggaagcacagaatcaggagtataagatgctgctggacatcaaaaccaggttggagcaggaaattgctacgtataggagccttttagaaggccaggacgccaaaatggcgggaattgcaattcgcgaagcttccagcggtggcggagggtcatcatccaatttccacatcaacgttgaagagtctgtggacgggcaggtcgtgtcatcccataaacgcgagatctag

SEQ ID NO: 227649 - DNA, 756 bp, Artificial Sequence
  Description of Artificial Sequence: Synthetic coding sequence
atgaccggaactcggagccgaccgcagcccgctcagaatgccaccactgccaatacgtccaggccactcaaaagttcagggacacggtatgaaaatgaactagccctgcggcagggcgtcgaggccgacatcaacggcctcaggagagtgctcgacgagctgaccttagctagaaccgacctcgagatgcagatcgaggggctgaacgaggaactcgcatacctgaaaaagaatcatgaggaagagatgaaggagttcagctctcagctcgccggtcaggtgaatgtggaaatggatgctgctcctggcgtcgacctcaccagggtgcttgccgagatgcgagagcagtatgaggccatggccgaaaaaaaccggcgagatgtcgaagcctggttcttttccaaaaccgaagagctgaacaaagaggttgcttctaataccgaaatgattcaaacctctaagacggagataacggacttgcggagaaccatgcaagaattagagatcgaacttcagagccagctgagcatgaaggcaggcctggagaactcgctggcggagacagaatgtagatatgccacgcagctgcaacagatacaggggctgattggcggactcgaggcccagctttctgagctgcgttgtgaaatggaagcacagaaccaggagtacaaaatgcttcttgatatcaaaacccgcttagagcaggaaatcgcaacatatcgctccttactagaaggccaggacgcaaaatag

SEQ ID NO: 227650 - DNA, 663 bp, Artificial Sequence
  Description of Artificial Sequence: Synthetic coding sequence
atgacgggcactagaagtagaccgcagcccgctcagaatgccaccaccgccaacacatcaagacccttaaagtccagcgggaccagatacgagaatgagcttgcactgcgccagggcgtggaggccgacataaacggcctgcgcagagttctcgatgaactgacgctcgcgagaacagaccttgagatgcagatcgaggggctaaacgaggaactcgcctatttgaagaagaaccacgaggaggaaatgaaggaattctctagtcaactagcaggccaagttaatgttgagatggatgctgctcccggtgtggacctcacgcgtgtgctggcggagatgcgggagcaatatgaggctatggcagagaagaacaggagggacgttgaggcatggtttttttctaagactgaggaactcaacaaagaggtagcctccaacacagaaatgattcagacaagtaagaccgaaattactgatttacggaggaccatgcaggagctggagatagaactgcagtcccagctgtctatgaaggccggactcgaaaactctctggcagagacggagtgccgatatgccacccaactgcagcagattcagggtcttatcgggggactggaagctcaattatctgagcttcggtgtgagatggaagcccaatag

SEQ ID NO: 227651 - DNA, 1422 bp, Artificial Sequence
  Description of Artificial Sequence: Synthetic coding sequence
atgacaacatgctcaaggcagttcactagctcgtcctctatgaaagggtcttgtggcattggcggaggcattggcggaggatccagccgcatctcctccgtcttggcgggagggagctgcagagcaccctccacttatggtggagggctgagtgttagttcccgcttttctagcggaggggcatgtggactaggcggaggatacggtggcggattcagctcaagcagcagtttcggatctgggttcggtgggggttatggtggtggcttgggagcaggttttggcggtggtcttggagccggatttgggggtggattcgctggaggggatggcttactcgttgggagtgaaaaagtaaccatgcagaacctcaacgatcggctcgcttcttatctggataaggtccgcgctctggaggaagccaatgctgaccttgaggtcaaaatccgagattggtatcagcggcagcggccatcagaaattaaggactattctccctacttcaagaccatcgaggatctgaggaataagataatcgcagccacaatcgaaaacgcacagcctatactgcagattgataatgcaaggctggctgcggacgacttccgcacaaagtatgagcacgagctggcactgcgccagacagtggaagcagacgtgaatgggctcagacgtgtgttagacgaactgacacttgcaagaaccgacctggagatgcaaatagaagggctcaaagaagagttggcctatctaagaaaaaaccatgaggaggaaatgctggcactcagaggtcaaactggaggagacgtcaatgtggagatggacgctgcaccaggcgtcgatttgagccgcatcttaaacgagatgcgagaccagtatgagcagatggcggaaaaaaaccgccgtgacgccgaaacgtggtttttaagtaaaacggaggagctcaacaaagaagtagcttcgaattcagagctcgtccaatcaagcaggtctgaagttactgagcttaggcgggtacttcaaggtctagagatagaactgcagtcacaactgagcatgaaagcttctctggagaactcattagaagaaaccaaaggtagatactgcatgcagctgagccaaatccagggtctcattgggtcggtggaggagcagttagcacagttgaggtgtgaaatggaacaacagagtcaggagtaccagattctgctcgatgtgaagacgcggctcgagcaggaaattgccacttatcgcaggctcctggagggtgaggatgctcatttatcctcacaacaggcctcaggccaatcatactcctcccgcgaagtgtttacgagttcttcctcttcctcttctcgacagacacgccctattctaaaagagcagagctcttcctccttttcacagggtcagagctcctag

SEQ ID NO: 227652 - DNA, 1299 bp, Artificial Sequence
  Description of Artificial Sequence: Synthetic coding sequence
atgaccacctcaataaggcagtttacctctagtagcagcattaaagggagttctggtctcggtggaggatcgagccggacatcttgtcggctgtccggaggactcggggcaggctcttgtagactcggctctgccggaggcttgggatccacattaggaggaagcagctacagcagctgttacagtttcgggagtggtggaggttacggaagctcattcggcggagtggacgggcttttggcgggaggcgaaaaagcgaccatgcagaacctcaacgaccgcttagcaagttacctggataaggtacgagccctggaagaagcaaataccgagctcgaagtgaaaatcagagattggtatcagaggcaggccccagggcctgctcgggactactctcagtattatcggactatcgaggagctccagaacaagatcctcactgccaccgtagacaacgcgaatatcctgttgcagatcgacaatgcgagacttgctgccgatgatttccgaacgaaatttgagaccgagcaggccctgaggctgtccgtggaagcggacatcaacggcctcaggcgtgttctagatgagctcactttggctagggctgatctggagatgcaaatagagaatctcaaagaagagctggcttaccttaaaaaaaaccatgaagaggagatgaatgctctccgcggacaggtcggtggggaaattaacgttgagatggacgctgctccaggcgttgatttatcgcgcatcttaaacgaaatgcgagaccagtatgagaaaatggccgagaagaatcgtaaagatgctgaggactggttcttcagtaaaaccgaagagttaaatagagaggtcgccactaactccgaactggtgcagtccggaaagagcgaaatttccgaacttaggcggactatgcaggccctcgaaatcgagcttcagtcccaattatccatgaaggcctcactggaagggaacctggccgaaacggaaaatcgctattgcgtccagttgagccagattcagggtttgatcgggtccgtcgaggaacagctggctcaactacgctgcgagatggaacagcagaaccaggaatataaaatacttctcgacgtgaaaactagactggaacaagagatagccacttaccgcaggctcctggaaggcgaagacgcacacctgacacaatacaagaaagaacctgtgaccacccggcaggttagaactattgtcgaggaggtacaggatggaaaagttattagttcacgcgagcaggtgcatcagactacccggtag

SEQ ID NO: 227653 - DNA, 1920 bp, Artificial Sequence
  Description of Artificial Sequence: Synthetic coding sequence
atgagctgtcagatcagctgcaaatcaaggggcaggggaggcggaggcggaggatttcggggattttccagcggatctgccgtggtctccggcggtagccgcagatcaactagctcattctcctgtttgagcagacacggagggggtggtggagggtttggtggagggggattcgggagccgttccttggtgggcttaggaggcaccaaatctatcagtatcagtgtggcaggaggagggggaggctttggggctgcagggggttttgggggtcgcggaggtggtttcggcggtggctctagttttgggggagggagtggtttctccgggggtgggtttgggggtggcggattcgggggaggtcgctttgggggtttcgggggtccgggtggtgtggggggacttggagggccaggcggtttcgggcctgggggttaccctgggggaatccacgaagtgagcgttaaccagtctttgctccagccacttaatgtgaaggtggatccggagatacagaacgtcaaagcacaggagcgagagcaaatcaagaccctcaataataagttcgcaagcttcatcgacaaagtgcggttcctggagcagcaaaatcaggtcctgcagaccaaatgggaactgctgcagcaaatgaacgtgggtacaagacccatcaacttggagcctatctttcagggctacatcgactcgctgaaaaggtatctggatgggcttacagcagagaggacgtcccagaactctgagctgaataacatgcaggatctcgtcgaggattataagaaaaagtacgaggacgagatcaataaacggaccgctgcggagaacgactttgtgacactgaagaaagacgtggataacgcctacatgattaaagttgagctgcaaagcaaagtggatttactcaaccaagagattgagtttctgaaagtgttgtacgatgcagaaattagccagattcatcagtctgtcacagacactaacgtgattctgtcaatggataattcgcgaaatctagatttagattccataattgcagaggtgaaggcgcagtatgaagagatagcccagagatcaaaagaggaagcggaagctctatatcactcaaaatacgaagagctgcaggtaaccgtaggtagacacggtgattcactgaaggagattaaaatcgagatcagtgagcttaacagggttatccagcgtttacaaggcgaaatagctcacgtcaagaagcaatgtaaaaatgtgcaagatgccatagccgacgccgaacagcgaggcgagcacgccttgaaagacgcccgtaataagctgaacgatctggaggaggccctacagcaggcgaaggaagatctggccaggctgctgagggactaccaggaattgatgaatgtcaaattggctttagacgtggaaatagctacatatcgtaaactgctggagggcgaggaatgtcgcatgtctggagacctctcctctaacgtcactgtgtccgtcacttcaagcacaattagctcaaacgttgcctcaaaggctgcattcggcggatcaggtggcagaggcagctcatcaggaggaggctacagcagtggatccagctcctatggctccgggggaagacaatcaggttcgcgagggggttctggaggaggcggatcaatcagcggaggtggctacggatccggaggaggcagtgggggaaggtatggctccggcggaggcagtaagggcggaagcatcagtggtggcggatatgggtcaggaggcggtaagcactccagtggagggggaagcagaggaggctctagtagcggaggcggatacggaagtggtgggggtggatcaagttccgtgaaggggtcctctggagaggcgttcgggtcttctgtgacattcagcttccggtag

SEQ ID NO: 227654 - DNA, 1275 bp, Artificial Sequence
  Description of Artificial Sequence: Synthetic coding sequence
atggatttctctaggaggtccttccaccgatcactgtcctcctccctgcaggctccagtggtcagcaccgtggggatgcaacgactgggtacaactccctctgtgtatggcggagccggtggcagaggtatcaggatctccaattcacggcacaccgtaaactatgggtcagacctgactggtggtggagatctgttcgtgggcaacgaaaaaatggcgatgcagaatcttaatgatcgtctcgcctcttaccttgagaaagtgagaaccttggaacagagcaattcaaaacttgaagtgcaaattaagcagtggtacgaaacaaatgcccctagggccggacgtgactactccgcctattacaggcaaatcgaagaattgagatctcagatcaaggacgctcagctgcaaaatgccaggtgtgtcctgcagatcgataatgccaagctcgccgctgaggatttccggctgaaatatgaaaccgaaaggggaatccgccttacagttgaggccgatctgcaggggttgaataaggtgtttgacgaccttacactgcacaagaccgaccttgaaatccagattgaagagctgaataaggacttggccctattgaaaaaggagcatcaggaggaagtggacgggctccataaacacctgggcaatactgtgaacgtggaagtagatgccgcacctggtcttaatctaggggtgataatgaatgaaatgcgacaaaaatatgaggtcatggctcagaaaaacttgcaagaagccaaagaacaatttgagcggcaaaccgccgtgctgcaacaacaggtgacagtgaacaccgaggagctgaagggaaccgaggtgcagctcactgaattaagacggacttctcagtctctcgaaatagagctgcagtcccacctgagcatgaaagagtccctggaacataccctggaggaaactaaggcacgctatagcagccagctggccaacttgcagtccttgctgtcgagcctggaagcacagctgatgcagatccggtcaaacatggaaaggcagaataatgagtaccatatcttactcgacatcaagacccgtttagagcaggagatagccacatatagaagactgctcgaaggggaagatgtgaagactaccgagtatcagcttagcaccctggaggaacgtgatatcaaaaaaactcgcaagataaagaccgtcgttcaggaggtcgttgatgggaaggttgtgtctagcgaagtcaaagaggtcgaagaaaatatctag

SEQ ID NO: 227655 - DNA, 1578 bp, Artificial Sequence
  Description of Artificial Sequence: Synthetic coding sequence
atgtcttgcagctctcgggcttcttcttcgagggcagggggatcctccagcgcccgtgtgtctgcaggagggagctcattcagcagcggaagtcgttgcggtctgggcggatccagtgctcagggcttccgcggtggcgcatcttcatgttccctgagcggtggctcatctggagccttcgggggaagctttggaggcggtttcggcagctgctcggtgggcggaggcttcggaggcgcttccgggtctggaacaggattcgggggtgggagctcttttggcggagttagcgggttcggtagggggagtggattttgtggcagttcccgcttctcttcaggcgcaaccggcggattctactcgtatggcggtggcatgggcggaggagtgggtgatggaggactcttcagcggcggtgagaaacaaacgatgcagaatctcaacgaccgcctggcaaactatctcgataaggtgcgagctctcgaagaggccaacacagacttagagaataagattaaagaatggtatgataagtacggtcccggaagcggtgacgggggatcgggtagagactattctaagtattactccatcattgaggatctacgaaatcagataattgctgcaacagtcgagaacgccggtatcatccttcatattgataacgcccgtctcgccgcagacgacttccgtctgaagtacgaaaatgagctttgtcttcgacagagcgtagaggccgacattaacggcctgagaaaagttctggacgacctaacgatgacacgaagtgacctggaaatgcaaatcgaatcatttactgaagaattagcatatctacggaaaaaccacgaagaggagatgaaaaatatgcaaggaagttctggcggtgaggtgaccgtggaaatgaacgctgcccctggaacagatttgacaaaactccttaatgatatgcgcgcacagtacgaagaactcgccgaacaaaatagacgggaggctgaggagagattcaataagcagtctgcctcacttcaggctcagatctctaccgacgctggcgcagcaactagtgcaaaaaacgaaatcactgaactgaagcggacactccaggcgttggaaattgaacttcagagccaactggccatgaaatcatccctagaggggaccctggccgacacggaagcgggatacgtggcccagctgtctgagattcagacccaaatctccgccttggaagaggaaatttgtcagatctggggagagaccaagtgtcagaacgctgaatacaagcagctgctagatatcaaaacacgcctggaagtggagatcgagacctatcgtcgcctgctggacggggagggcggaggcagcagctttgctgaattcggcggaaggaactctggttcagtgaacatgggaagtagggatctagtgagcggagactctcgaagcgggtcctgttccggccaaggtcgtgactcctccaaaactcgcgtcaccaaaactattgttgaggagttggttgacggcaaggttgtgagcagtcaggtctcgagcatttctgaagttaaagtaaagtag

SEQ ID NO: 227656 - DNA, 1890 bp, Artificial Sequence
  Description of Artificial Sequence: Synthetic coding sequence
atgtcaagacaggcgtctaagaccagcggaggaggatctcagggcttctccgggcgtagcgcagttgtgtccggttccagtaggatgagttgcgtggcccacagcggcggagccggtggcggagcgtacggattccgctcaggcgctggcggttttgggtcccgctctctgtacaatctgggcggtaacaaatcaatttccatcagcgtggccgctgggggatcacgcgctggcggatttggcggaggccgatcctcatgcgcattcgctggcggatatggcggaggatttggctcgggctacggcggtgggtttggagggggattcggcggaggccgtggaatgggtgggggattcggaggggcaggtggctttggcggagctggtggattcgggggagccggagggttcggaggtcctgggggattcggcggaagtggagggtttggcggaccgggtagcctcggcagtcctgggggatttggccctggaggctttccagggggaattcaagaagtgacgatcaatcaatctcttctacagcccctgaacgttgaaatcgacccccaaatcgggcaggttaaggcgcaggaaagagagcagataaaaacactcaacaacaaattcgcctctttcatcgataaagtgagatttctggagcagcagaacaaagtgctggagaccaaatggaatctgctgcaacaacaagggaccagttccatctctggtaccaacaacctggagcccctctttgaaaaccacataaattatctgcgcagttatctggacaacattctgggcgaacgcggtcgcctcgattctgaactgaagaatatggaggacctcgtggaggactttaagaaaaagtatgaggacgaaattaataagagaacagccgcagagaatgagtttgtcactttgaagaaggacgtggacagtgcctatatgaataaggtagaattgcaggcaaaagtggacgccctcatcgatgaaattgattttctaaggaccctttacgacgccgagttgtctcagatgcagtcgcacatcagcgataccagcgtcgtactgtcgatggataataaccggtctcttgatttggactctatcattgcggaggtgcgggcacagtacgaagatatcgcccagaggtctaaagccgaagctgaggctctgtaccagactaagcttggagaactgcagacaaccgccggacgacatggcgacgacctgagaaatactaagtcggagatcatcgaactgaacaggatgatccagcgcctcagggccgagatcgagggggtcaagaagcagaatgccaacttgcaaactgccatcgctgaagctgaacagcacggggagatggccctgaaagatgctaacgcaaaactgcaggaactgcaagcggctttgcaacaggccaaggatgatctcgcaaggctgctaagagattaccaggaattaatgaacgtgaaactcgcccttgacgtggaaatcgctacctatcgcaagcttctggaaggagaagagtacagtaggatgagcggggagtgccctagcgctgttagcataagtgtggtaagctcttctacaacctccgccagtgcaggaggctatggaggagggtacggcggtggtatgggcggagggctgggtgggggtttcagcgcaggtggtgggtctggctccggctttgggagagggggaggagggggtatcggtggcggattcggaggagggtcttccggtttcagtggagggtccgggttcggttcaatcagcggcgcacgctatggagtgagcgggggtggcttctcaagcgcaagcaatcggggaggctcaatcaagttctcccaatcgtcccagtcctcacagagatattcccggtag

SEQ ID NO: 227657 - DNA, 1887 bp, Artificial Sequence
  Description of Artificial Sequence: Synthetic coding sequence
atgagccgccaggcgtccaaaacatctgggggaggttctcagggtttcagtggacgaagcgccgtggtcagcgggagctccagaatgtcctgtgttgcccatagcgggggagcaggcggaggtgcatatggcttcagatccggtgccggagggttcggatctcggtccctgtacaaccttggaggaaacaagtcgatctctatcagcgtagccgcaggtggatctcgagcaggcggttttggcggaggtcgatcttcatgcgcgttcgccggtggctatggcggaggtttcggctccggttacgggggaggctttggtggaggttttggtggaggacggggtatggggggtggtttcggcggagcgggtgggttcgggggagctggtggattcggaggggcagggggatttggcggtcccggaggattcggtggctcaggaggctttggtggacccggatctctgggttcccctggtgggttcggacccggagggttccccggagggattcaggaggtgactatcaatcaatcactgctccagccactgaacgtggaaatcgacccacagatcggccaagtgaaggcacaggaacgcgagcagatcaaaacgcttaacaacaaatttgcaagcttcatcgataaagttaggtttttggagcagcaaaataaggttctggagacaaagtggaatttattgcagcagcaaggaacaagttcgatttcaggaactaacaatctggagccgctgttcgaaaatcacattaactacctgaggtcgtaccttgataacatcctcggagagagaggtcggctggatagtgagctcaaaaacatggaggatctggtggaagactttaagaagaaatacgaggatgagatcaacaaaaggacggcagcggagaatgagtttgtgacactcaagaaggatgttgatagcgcttatatgaataaggtggagctccaagctaaggttgatgccctgattgatgaaatcgacttcttaagaaccctgtacgatgctgaactgtcccagatgcagagccacatctcagacacatccgtggtgctgagcatggacaacaatcgatccctcgacctggattcgatcatcgctgaggtgcgtgctcagtacgaggacatagcccaacggagcaaggcagaggctgaagccctttaccagaccaaacttggcgaacttcagacaactgcgggtcgccacggcgacgaccttaggaatacaaagtctgagatcatagagctcaaccgtatgatccagcggcttagagccgagattgagggggtgaaaaagcaaaacgcgaacctgcaaacagctattgcagaggctgagcagcacggagaaatggctctgaaggatgctaatgccaagctgcaggagctgcaggctgcgctgcagcaggccaaagatgatctggctcggctgctcagagattatcaagagcttatgaacgtcaaattagccctcgacgtagagatagcgacgtaccgcaagctgctagagggcgaagaatacaggatgtccggcgagtgcccgtctgctgtcagcatctctgttgtgtccagtagcactacaagcgcctccgccggaggctacggtgggggatacgggggtggcatgggcggaggcctcggcggaggcttctccgcgggaggagggtccggaagcggctttggacgcggaggcggtggtggaatcggtggcggatttggcggaggctcttccggcttcagcgggggatctgggttcggatctatatctggcgcacggtatggcgtctccgggggagggttcagcagcgcttcgaatcgcggaggaagcattaagttttctcagagtagtcagtccagccagagatacagtcggtag

SEQ ID NO: 227658 - DNA, 1251 bp, Artificial Sequence
  Description of Artificial Sequence: Synthetic coding sequence
atgccctacaacttttgtcttccatcccttagctgtcgaacatcgtgcagctcccggccttgcgtaccgcctagttgtcatagctgcactctaccaggcgcttgcaacatacctgccaatgtgtctaattgtaattggttttgcgagggtagcttcaatggatccgaaaaagagactatgcaatttttgaatgacaggctggcaagttacctcgagaaggttagacagctagagcgggacaatgcggagctagaaaacctgatccgtgagagaagccagcagcaggagccactcctctgtccctcataccagagctatttcaagactattgaggaattgcagcagaaaattctctgtactaagagtgaaaacgccaggctcgtcgtccagatcgataatgcaaagttagctgccgatgatttccggaccaaatatcaaacagaactgagcctgcggcagctcgtcgagtcagatatcaatggtcttcggaggatattggatgaacttacactatgcaagtcagatctagaggcccaagttgaatctctgaaggaggagctgttatgcctgaagtccaaccacgagcaggaagtgaatactctccgctgccagctgggggacaggctcaatgtcgaggtcgacgccgcaccaacagtggacctaaatagagttcttaatgaaacccgtagtcagtacgaagccttggttgaaacaaatagaagagaagtcgagcagtggttcacaactcagaccgaggaactaaataagcaagtagtgtcatccagtgagcagctgcagtcctatcaagcagaaattattgagttacgtcggacagtcaatgccctcgagatcgaactgcaggcccagcataacctgcgggattcacttgaaaatacgcttacggaaagcgaggctcgttacagtagccagctgtcgcaggtacaatcactcataaccaatgtcgagtcccagctggctgaaattaggtccgacctagaacgccaaaatcaggaatatcaagtgctgttggatgtgcgggctcgattggaatgcgagataaatacttacaggtcattgttggagtcagaagactgtaatcttccttccaatccttgcgccaccacaaatgcttgcagcaaaccgataggcccttgcctgtctaatccctgcacaagttgcgtgccaccagctccttgtaccccttgcgccccacgtccaaggtgcgggccatgtaattcattcgtaagatag

SEQ ID NO: 227659 - DNA, 1674 bp, Artificial Sequence
  Description of Artificial Sequence: Synthetic coding sequence
atggtgtccaaactgacatctctgcagcaggaattactctctgcgctcctgagttccggtgtgaccaaagaagtgctcgtgcaagcacttgaagaactgctgccgtcgccaaatttcggagtcaaattagaaaccctgcctctgtctccgggaagcggtgctgagccagatacaaagcctgtcttccacacactcacaaatggccatgccaagggacggctgtcaggagatgaaggctcagaggacggagacgattacgacacacctcctattttaaaggagctgcaggccctgaatacagaggaagcagcagagcagagagccgaggtggatcggatgctgtccgaagatccctggcgagcagcgaaaatgattaaaggctatatgcaacaacataatatcccccagcgggaggtggtcgacgtgacaggacttaaccagtcccacctcagccagcacctgaataaagggactccaatgaagacacagaagcgcgctgctttgtacacctggtatgtccgcaagcagcgggagatcctaagacaattcaaccagactgtgcagagctccggtaacatgaccgacaagagcagccaggaccaactcctgtttctattccccgagttctcccagcagtcccacggaccaggacagagcgacgacgcctgttcagaacccaccaacaagaagatgcgtagaaaccggttcaagtgggggcctgccagccaacagattttgtaccaggcctacgatcggcagaaaaacccgagcaaggaggaacgggaagcactcgtggaagaatgcaatcgggcagagtgtcttcagagaggcgtgtcaccttcaaaggcacacgggctcgggagcaatttggtcaccgaggttagagtctacaactggtttgcaaaccggcgaaaagaggaagcctttcgccaaaagctcgcaatggacgcgtactccagtaatcaaactcacagtctcaatccattattgagccatgggagcccccaccatcagccttcctcttcaccccctaataagctgtctggggtgcgctactcacaacagggtaacaatgagatcacgagttcctcaactatctctcaccacgggaactctgcaatggtcacttcacaatccgtcctgcaacaggtgtctcccgctagtctggatcctggccataacctgctgtctccagatggaaaaatgatatcagtcagcggaggcggtctccctcccgtttccacactcactaatattcacagcctcagccaccacaacccgcagcagtcccagaacctcataatgactcctctgagcggcgttatggcaattgcacagtctctgaacacgagccaggcacaatctgtacctgtgattaacagcgttgcgggaagcctggccgcactccagcccgtgcagttctcacaacagctccacagcccgcaccaacagccattaatgcagcagtctccagggtcacatatggcccagcagcctttcatggcagccgtgactcaactgcagaactcccatatgtacgcccacaagcaggagccccctcaatacagtcacacatcccgcttcccctctgccatggtagtcaccgacacgagctccatttcaacacttactaacatgtcttcaagcaagcagtgccctttgcaagcatggtag

SEQ ID NO: 227660 - DNA, 1215 bp, Artificial Sequence
  Description of Artificial Sequence: Synthetic coding sequence
atgagctactcttgtgggctcccctcactgtcctgtcgcacctcgtgttcttccaggccatgtgtgccgccaagctgccacggttgtactctgccaggggcatgcaacattcccgcaaatgtttctaattgcaactggttctgcgaaggctccttcaacgggtcagagaaggagacgatgcaatttcttaacgaccgtctagcctcctatttggagaaggtccgccagctcgagcgggacaatgcggagctggagaacctgataagggagcgctcacagcagcaggagccactagtatgcgcgtcttatcagagttacttcaagactattgaggaactgcagcagaaaatcttatgttctaagagcgagaacgcccgacttgtggtgcagattgacaacgcaaaactcgcttctgatgacttccggacaaagtatgagaccgagctctctctgcgacagctcgtagagagcgacatcaacggcctgcggcgtatcctggacgagctgacactgtgccgttccgacttggaggcccaggtcgagtcactgaaggaggaactgctctgtttgaaacagaaccacgagcaggaggtgaataccctccggtgccagcttggagaccggttgaacgtggaggtcgacgccgcaccaactgttgacctaaatcaagtgctcaacgaaacaagaagccaatacgaggccctggtcgaaaccaacaggcgagaggttgagcagtggtttgcaacccagacggaggagctgaataagcaggtcgtgtctagttctgaacaactgcaatcttatcaggctgagatcatagagttgaggaggactgtgaacgcattggagatagaactgcaggcccagcataacttgcgcgattccctggaaaacacgctgaccgaatcggaagcccgatatagctcccaattgtctcaggtgcaaaggctgatcacaaacgtggagagccaattggccgaaattcgcagtgacctagaacgacagaaccaggaatatcaggtccttttggatgtgagggccagattggaatgcgaaataaacacatacaggtctctcctcgaaagcgaagattgtaagctgccgtctaacccttgcgccactaccaatgcttgtgataaaagcacgggtccttgtatctccaatccttgcggcctgagggcccgttgtggaccatgcaataccttcgggtactag

SEQ ID NO: 227661 - DNA, 1215 bp, Artificial Sequence
  Description of Artificial Sequence: Synthetic coding sequence
atgccttacaacttttgcctgccctcattatcatgccggacaagttgcagctcgagaccatgtgtgccgccaagttgccatggatacacactgcctggggcatgcaatattccggctaacgtgagcaactgcaattggttctgcgaagggagcttcaacggctccgagaaagagactatgcagttcctcaacgatcgactggcaagttatctggaaaaggtgcgacagctggagcgagacaatgcagaactcgaaaacctgatccgagaaagaagccaacagcaggagcccttactttgtccgagctatcagagctatttcaagaccatcgaggaattgcagcagaagattctttgctcaaaatctgaaaacgctcggcttgtggtccagatcgataacgccaagttagctgcagatgatttccgcacaaagtatcaaacagagcaatcgctgcgacaactcgtcgagtccgatatcaattctctgcggaggatactcgatgaactgaccctttgtcggtccgatctggaggcccagatggagtctctaaaggaggaactactctccctcaaacagaatcacgagcaggaagttaacacactccggtgccaactgggcgaccgccttaatgtcgaagttgatgccgcaccagcagtcgacctgaaccaggttctgaacgagactagaaatcagtatgaagccctcgtggagacaaaccggagggaagtggaacaatggttcgccacacagaccgaggagcttaacaaacaggtggtctctagctcagagcagctgcaatcgtaccaggccgagattatcgaactgagaagaactgtgaacgcgctcgaaatagaactgcaggctcagcataacctcaggtactctttagagaacaccctcacggagagcgaagcacgctactcatctcagctctcgcaggtccaatctctgattacaaacgtggagtcccagttggccgagatccgctctgatctggaacggcagaatcaagagtaccaggtgttgctggacgttcgtgccagacttgaatgtgagattaatacatacaggagcctgttagagagcgaagattgtaaactgcccagcaacccctgcgcgacaactaatgcctgcgagaagccaatcggttcttgcgtgaccaacccctgtggcccacgctcccggtgtgggccttgcaacaccttcggctattag

SEQ ID NO: 227662 - DNA, 1311 bp, Artificial Sequence
  Description of Artificial Sequence: Synthetic coding sequence
atgctgtatgcaaagccccctccaacaattaatgggatcaagggactgcagaggaaggagagattaaaacctgcccatatacacctgcagcagctgacctgtttctctattacctgcagctctacaatgagctactcctgttgtctgccttcccttggttgtagaacttcttgtagctctagaccttgtgttcctccctcctgccacggctatacacttcctggagcgtgcaacattcccgcaaacgtttctaactgtaattggttttgtgagggaagttttaatggcagcgagaaggaaactatgcagtttcttaatgacaggctggcctcctatctcgaaaaagtgcggcagttggagcgagacaacgctgaacttgagaagcttatacaggagaggtcacagcaacaggagcctctcctgtgcccatcctaccaatcatatttcaaaaccatcgaggaattgcaacagaaaattctgtgcgcaaaagccgagaatgctcggctagtggtaaatatcgacaacgcgaaactcgccagcgatgacttccgttctaagtatcagaccgagcagtcgctgagattgttggtcgagagtgacataaacagcatcaggcgtatcctcgacgaactcacattgtgtaaaagcgatctggagagccaggttgagtctctgagggaagaacttatctgccttaagaagaatcacgaagaggaggtgaacacattgagaagccagctgggagataggctgaacgtagaagtggatactgccccaacagtggacctgaaccaggtgctgaacgaaaccagatcccaatatgaggccctcgtcgagataaacaggagagaggttgaacaatggttcgccacccaaactgaggaactgaacaaacaggtggtgagctcatcagagcagctgcagagctgtcaggctgaaattattgagcttagacgtactgttaatgcccttgaaatcgagctgcaagctcagcacaatctcagagatagtctcgaaaacaccctgactgaaagtgaggctcattatagcagtcagctctcccaggtgcaatccctcattacaaacgtagagtcccaattggccgagatccgatgcgacctcgagcggcagaaccaggagtatcaggttctgctcgacgtccgcgcacggctggagtgcgagattaacacgtaccggagtctgctggagtcagaggactgtaagttgccatgcaatccgtgtgccaccactaatgctagcgggaattcatgtggaccgtgcgggacgtcgcaaaagggctgctgcaactag

SEQ ID NO: 227663 - DNA, 1185 bp, Artificial Sequence
  Description of Artificial Sequence: Synthetic coding sequence
atgtcatacagctgttgccttccttcactgggctgtcgaacatcatgcagttcacgaccctgcgttcctcccagctgccacgggtatacactccccggagcctgtaacatcccagccaacgtctctaattgcaattggttctgcgagggaagctttaatggaagtgaaaaggagacaatgcaattccttaatgaccgcctggcttcttacttggaaaaggtgcgccagttagaaagggacaacgccgagctggagaaactgatccaggagagatcccaacaacaagagccccttctgtgtccctcttatcagagttacttcaaaaccatcgaggaactgcagcagaaaatcctgtgcgccaaggctgaaaatgcaagactggtcgtgaacattgacaatgctaaactggcttcggacgacttccgcagcaaatatcagaccgagcaatctttgcggctgctggttgaatccgacatcaacagcatccgtcggatcctggacgagctgactctgtgtaagtcagatctggaatctcaggtagaatctctgagggaggagctgatctgcctgaaaaaaaaccatgaggaggaggtgaacacactgcgctcccagctgggcgatcgattgaatgttgaagtggatacagcccctacagttgatctcaaccaagtcctgaacgaaactcgctctcagtatgaagccctggtcgagattaaccgcagggaagttgaacagtggttcgccacacagactgaggaattaaataaacaagtggtctcatcctccgagcaactgcagtcttgtcaggctgagatcattgagttaagacgaacggtcaatgctttggaaatcgagctgcaggcgcaacacaacttgagagactcgctggaaaacactcttacagaaagcgaagcacattactcgtctcagttgtctcaggtgcaaagtttgatcactaatgttgagtctcagcttgccgaaattagatgtgacctcgagcgtcaaaaccaggagtaccaggtattacttgacgtgcgtgcccgactggagtgcgaaattaacacctaccggagtctactggagtctgaagactgtaagttaccttgcaacccatgtgccactaccaatgccagcggtaatagttgcggaccatgtggaaccagtcagaagggctgctgcaattag

SEQ ID NO: 227664 - DNA, 1278 bp, Artificial Sequence
  Description of Artificial Sequence: Synthetic coding sequence
atgtattccagcagcagctgcaagctgccttcattatcccccgtcgcaaggagttttagtgcgtgctctgttgggctaggccgaagcagctaccgagccacatcctgcttgccggcactttgcctgccagccggtggcttcgctacaagttattcaggaggaggcggatggttcggagaggggatcctcacaggcaatgaaaaagaaactatgcaaagtcttaacgaccgacttgctggctacttggagaaggtgcgccagctggagcaggagaacgctagtttggaatcaagaataagggaatggtgtgaacagcaggtgccttatatgtgccctgactaccagagctacttccggaccatagaggaacttcaaaagaagaccctctgttctaaagcagagaatgccaggctcgtcgtggagattgacaatgcgaaattagctgcagatgactttagaacaaagtatgaaactgaagttagtttgcgccagctagttgaaagcgacataaatggactgcggagaatactagacgatctaaccctatgtaagagtgacctcgaagcacaggtggagtccctgaaggaagagctgctctgcttgaagaagaaccacgaggaggaggtcaattcattaagatgtcaactgggtgacaggctaaatgttgaggttgacgccgcacccccagtggacctgaaccgggtgctcgaagagatgaggtgtcagtatgagaccctggtcgaaaataacagaagggacgctgaagattggttggatacacagtccgaggagcttaatcagcaggtggtcagcagcagcgaacaactgcaatcatgtcaggccgaaataatcgagctcagacggactgtcaacgctcttgagatagagcttcaggctcagcactcgatgagggacgcccttgagtccactttggctgaaacggaggccaggtactcgtcgcagctggcccaaatgcagtgtatgataaccaacgtggaggcccaattggctgaaattcgggctgatctggagcgacaaaaccaggagtatcaggtcctgctggatgtccgcgcacgcctggaatgcgaaatcaatacttatagaggactgctcgagagcgaggactctaaactgccgtgtaatccctgcgcgccagactactctcctagtaaaagctgtctgccttgtctccccgctgcctcttgtggtccttccgccgcaaggacaaattgttccccgaggccaatatgtgttccctgtccaggcggtcgattctag

SEQ ID NO: 227665 - DNA, 1368 bp, Artificial Sequence
  Description of Artificial Sequence: Synthetic coding sequence
atggccagtaaatgtctcaaggccggattctctagtggttccttaaaatcccccggaggcgcaagcgggggatctacaagagtctccgctatgtacagttccagcagttgtaaattaccatccctcagcccggtggctcgatcattctcagcttgtagcgttggacttgggaggtcatcctatcgggctacctcttgcctgcctgcactgtgtttacctgctgggggttttgccacatcttacagcggcggaggtggttggtttggcgaaggaatcctgaccgggaatgagaaagagacgatgcagagcctgaacgatcgattggccggttatcttgaaaaggtgcggcagttggaacaagagaatgctagtctcgagtctcgaatacgcgagtggtgtgagcaacaggtcccatacatgtgtccagactatcagtcttactttcgtaccatagaggagctacaaaaaaaaacactttgttcaaaagccgaaaacgccaggcttgtcgtggaaattgataacgctaagctcgcagccgatgattttagaaccaaatacgaaaccgaggtgagcctgaggcaattggtggaatcagatattaatggtctacgaagaatattggatgatctaacactgtgtaaatctgaccttgaggcccaggtggaatccctgaaggaagaattactatgcctgaagaagaaccatgaggaggaggtgaacagcctgagatgccagcttggcgataggctcaacgtggaggtggatgccgctccacctgtagacctcaatcgcgtcctggaagaaatgagatgtcagtatgagactcttgttgaaaataaccgaagagacgcggaagactggctggacacccagtcggaagagctcaatcagcaggtcgtcagctcttccgaacaactgcaaagctgccaggctgagataattgagctgcgcagaaccgttaacgctctggagattgagctccaggcgcaacacagcatgcgggatgcgctcgaaagcacacttgccgaaaccgaggcacgttattcgtcacagttagctcagatgcagtgcatgataaccaacgtcgaagcccaactcgcagaaatccgagctgacctggagcgccaaaatcaggagtatcaggtactattggatgtgcgggcaagattggaatgcgaaataaatacctaccgcggacttcttgagtccgaggacagcaagctgccatgcaatccttgtgcccctgattactcaccctcaaagtcttgtctgccttgcctgcccgcagcatcttgtgggccaagtgctgcacgtactaactgcagtcctcggcctatctgcgtgccttgtcccggtgggcgtttctag

SEQ ID NO: 227666 - DNA, 1404 bp, Artificial Sequence
  Description of Artificial Sequence: Synthetic coding sequence
atggcgacgcagacatgcacaccaactttttctaccggaagcatcaaaggcttatgcgggaccgccggaggcatctcccgcgtcagctccattcggagcgtcggctcctgtcgagtccctagtctggccggagccgcaggatacatctccagcgcccgaagtgggttgtccggcttgggcagctgcctgcccggttcctacctctcctcggagtgccacactagtggatttgtgggatctgggggttggttctgcgaaggatcgttcaatggttctgagaaagaaaccatgcagtttttaaatgataggctggccaattatttagaaaaagttaggcagttggaacgtgaaaatgcggagcttgaaagcaggattcaggagtggtacgagttccagattccttacatttgcccagattatcagagttattttaagacaattgaggacttccagcagaaaattctgttaaccaaatctgaaaacgccaggctcgtcctgcaaattgacaatgccaagcttgctgctgatgattttagaaccaagtatgagacagagcttagtcttcgccagctcgttgaggccgatattaacggactgcgcaggatccttgatgagttgaccctctgtaaagctgacctcgaagctcaagtggagagtctcaaggaagagctgatgtgcctgaaaaagaatcacgaagaggaggtgagtgtgttaaggtgtcagttaggagaccgtctgaacgtggaggttgatgctgctccccctgtcgacttgaacaagattttagaggacatgaggtgccagtacgaggctctggtggagaataatcggagagacgtggaggcctggttcaacacccaaacagaagaattaaaccagcaggtcgtgtcatcgagtgaacaacttcagtgctgccagacggagattatcgaactacggcgtactgttaatgcactggagattgaactgcaggctcagcactctatgcgcaattcccttgagtcaacattggctgagacagaggcaaggtattctagccagcttgcccagatgcagtgcttaatcagtaatgtggaggcccagctgtccgaaattcggtgcgatttggagagacagaatcaggagtatcaggtcctattggatgtgaaagcccgattagaaggagagatagccacataccggcacttgctagagggggaggattgcaaactccccccacaaccatgcgccacagcctgtaaaccagtgatcagggtgccatccgtacctcctgtcccttgtgtccccagcgtgccctgtacgcctgccccacaggtcggcactcagatcagaacgattacggaggagatacgcgatgggaaagtgatttcctctcgtgagcatgttcagtccagacctctgtag

SEQ ID NO: 227667 - DNA, 1254 bp, Artificial Sequence
  Description of Artificial Sequence: Synthetic coding sequence
atgctgcgttcaggcctttccggcctggggagctgccttcccggaagttacctgtcatcggagtgtcacacatccgggttcgttggatcgggcggatggttttgtgaaggaagcttcaatggcagcgaaaaggagacaatgcaattcctaaatgacagactggcaaactacttggaaaaggtacgtcagctggaacgggagaatgcggagctcgagtctcgcatccaggagtggtacgagttccagatcccctatatttgtcctgactatcagagctactttaaaaccattgaagacttccaacagaagattctactcaccaaatctgagaatgcccgactcgtactgcagattgacaatgcaaagctggcggcagacgattttcgaacgaagtacgagactgagctgagcctgagacagctcgtggaggctgatatcaacggccttagacggatcttggacgaactcaccttatgcaaggccgacctggaagcccaggtcgaatcactcaaagaggagctaatgtgccttaagaagaaccacgaggaggaggtttccgtgctgaggtgtcagctaggcgataggctgaacgtggaagtagacgccgctccaccggttgacctgaataaaatcctggaagatatgaggtgccagtatgaggctctcgtggagaacaacagacgcgacgtcgaggcctggtttaatactcagacggaagagctaaatcaacaggtcgtttcaagcagcgaacaactgcaatgctgccagacagagattatcgaacttcgcaggactgtgaatgccctggagattgagctccaggcacaacactccatgaggaacagcctggaaagtacacttgccgaaacggaggccagatattcttctcagctggcacaaatgcaatgtctgatcagcaacgtggaagcccagctctctgaaatcagatgcgacctggagagacagaaccaggagtaccaggtactgctggacgtgaaggccagactggaaggagaaattgcaacatatcgccatctgttagagggcgaagactgcaagttgcctccccagccatgtgccactgcctgcaaacccgtgattagagtgccctcagtgcccccagtcccctgcgtcccttcggtgccttgtacccccgcaccacaggtcggcacacaaatccgtacaatcaccgaggaaattagagacggcaaagttatcagcagtagagagcacgttcaatccaggcctttatag

SEQ ID NO: 227668 - DNA, 1200 bp, Artificial Sequence
  Description of Artificial Sequence: Synthetic coding sequence
atggccaggcggttccaggaggagctggccgcattccttttcgagtacgacactcctcgcatggttctggtcagaaacaaaaaagtgggcgtcatcttcagattgattcagctggtggttctggtttacgtcatcggttgggtgtttctctacgaaaagggttatcagacgtctagtggcttgatctcatccgtgagcgtgaagctcaaggggctcgccgtcactcagctgcctggcctggggccacaagtgtgggatgtggcagactacgtttttccagctcagggtgacaattccttcgtggtgatgacaaatttcatcgtcacacctaaacaaacccagggctactgtgctgagcatccggagggtggcatttgtaaggaggacagcggttgcactcctgggaaggcaaaaaggaaggcacaggggatccgaactgggaaatgcgtggcctttaatgatacggttaagacttgcgagatattcggttggtgtcccgtggaggtggacgacgacatcccgaggccagccctattgcgtgaagcagagaattttaccttatttatcaagaactcaatcagttttcccagattcaaggtaaatcgcagaaacttggttgaggaggtgaacgccgctcacatgaagacgtgcctgtttcacaaaacactccaccctctgtgtcccgtgttccaattaggatatgtggtgcaggagtcaggccagaacttctcgaccctcgccgaaaagggaggcgtcgtcggaatcactatcgactggcactgtgacctcgattggcatgtgaggcattgtaggcctatctacgagtttcatggtctttatgaggagaagaacctgtcaccgggattcaactttagattcgcgaggcattttgtggagaatggtaccaactacagacacctgttcaaggtctttgggattcgatttgatattctcgtggacgggaaggccggaaagttcgacattatccccactatgacaaccattggctccgggatcggtatcttcggggtcgctacggttctttgtgacctcctcctgctccacatcctccccaagagacactactataaacagaaaaagtttaaatacgcagaggacatgggccctggggctgcagagagggaccttgcagctacttcctctactttgggcctgcaggaaaatatgaggacaagctag

SEQ ID NO: 227669 - DNA, 1371 bp, Artificial Sequence
  Description of Artificial Sequence: Synthetic coding sequence
atgacaagcagctactcctcgtcatcatgccccctgggatgcaccatggccccaggcgcacgaaatgtgtcagtgtctcctattgacatcgggtgccaacccggagccgaggctaacatcgcgcctatgtgtctacttgctaatgtcgctcatgccaaccgtgtcagagtggggagcactcccctcgggaggcctagcctctgcctgccacccacatgccatactgcttgcccactccctggaacctgtcacattcctggcaacattgggatatgcggcgcatatggtgagaacaccctgaacggtcacgaaaaagagacaatgcagttcctcaacgacaggttggccaactatctggaaaaggttaggcagctcgaacaggaaaatgcagaacttgaagcaacacttctggaacgatccaaatgtcacgagtccactgtttgcccggattatcagagttactttcatacaatcgaggagttgcagcagaaaatactatgctccaaggctgaaaatgcccgtctcattgtgcagatcgacaatgcgaaactcgctgccgatgactttcgaatcaaactggaatcagagagatctctgaggcagctggtggaggccgacaaatgcggcactcagaagttgctcgacgatgctactctggcaaaggctgacctggaagcccagcaggaatctctgaaggaggagcagctgagcctgaagtccaaccacgaacaggaggtaaagattttgcggtcacagctgggcgagaagctgaggatcgaactggacatcgaacccacgattgatcttaatcgggtgctaggtgagatgagagcacagtatgaagcaatgctcgaaactaataggcaggacgtcgaacagtggttccaagcgcagagtgagggcatcagcttacaagatatgtcttgctcagaggaattgcaatgttgccagtccgagattctggaactgaggtgcacggtgaacgccctcgaggtcgagaggcaggcccagcacactcttaaggattgcctgcaaaattccctgtgcgaggccgaggatcgctttggaactgaactcgcccagatgcagtctctgattagcaatgtggaagagcagctttcagagatacgggcagatttggagcgacagaaccaggagtatcaggtgcttctggacgttaaaacaaggctcgaaaacgagatcgcgacataccgcaatctcctagagtccgaagattgtaaattgccttgcaacccctgttctacatctccgagctgtgtcactgccccatgcgcccctcgcccaagctgcggaccctgtaccacatgtggcccaacctgtggtgccagcacgactggctccaggttttag

SEQ ID NO: 227670 - DNA, 1785 bp, Artificial Sequence
  Description of Artificial Sequence: Synthetic coding sequence
atgactagcgtcggtgtcttcagtgatatgctcaatggctgtggcaaggacggtctggttcctcgggctaagccaagagacgtcagcgatttttccctttacgcccctgcaaccaaaccatgttgtagtcggacatataaacgaaggcgcctcagagctccagccctcacgggcctcggaccagttacgtctctgattgctccctcctccctgtcggcagcaatgatcgctaggcaacagtgtgtgaggggtgggccacgcggatttagttgcggatctgccattgtcggtggcggaaagcggggtgcttttagttccgtgtcaatgagcggaggcgcaggtcgatgcagctcaggcggtttcggatcacgcagcctatataacctgagaggcaacaagagtatctctatgagcgtggcgggttcacggcagggcgcttgtttcggcggagcgggagggttcggcacaggtgggtttggcggaggcttcggtggttcttttagtggcaagggagggcctggctttcccgtgtgcccagccggaggcatacaggaagtgacaatcaatcaaagtttactcacgccactgcacgttgagattgatccagagattcagaaggtcaggaccgaggagagggaacagatcaagctgcttaacaacaagtttgccagctttattgacaaagtacagttcctcgaacagcagaataaagtattggagaccaagtggaaccttctgcagcagcaaactaccaccacctcctcgaagaacttagagcccctgttcgaaacctacctgagcgttctgagaaagcagctggatacgttaggcaacgataagggtagattgcaaagcgagctgaagacgatgcaggattccgtggaggatttcaaaaccaaatatgaggaagaaatcaataaacgcacagcagcagaaaacgactttgtggtcttaaagaaggacgtcgatgccgcttaccttaacaaggtcgagctcgaggctaaggttgatagtttgaacgatgagattaattttctgaaggtgctctacgatgcagagctgtcccagatgcagacacatgtctcggatacaagcgtggtgctgtctatggataataatcgcaacctggatttggactcgattatcgccgaggttagagctcagtatgaggaaatcgcccaacgctccaaagccgaggccgaggccttgtaccagacaaaagtccagcagctgcagatttctgtggatcaacatggagacaatttgaagaacaccaagtctgaaattgcagagctaaacagaatgatccagcggctgcgagcagaaatcgaaaacatcaaaaaacagtgccagactttacaggtgtcggtggcagatgctgagcagcgcggtgaaaatgcactgaaggatgcccatagtaaaagagtcgagttagaagcagctctgcaacaggccaaagaagaattggccaggatgttgcgtgagtaccaggaactaatgagcgtgaaactggctctcgatatcgagattgctacttaccggaagctgctcgagggcgaagagtacaggatgtccggagagtgtcagagcgccgtaagcatctccgtggttagtggatctacgagcactggcggaatttccgggggactcggctccggttcaggcttcggactctcaagcggttttggatcaggttctggatccggctttgggtttggaggatctgtgagcggatccagttcttctaagatcatctctaccaccaccttgaacaagaggcgctag

SEQ ID NO: 227671 - DNA, 1503 bp, Artificial Sequence
  Description of Artificial Sequence: Synthetic coding sequence
atgatagccaggcagcagtgtgttagagggggtccccgaggcttcagttgtgggagtgctatcgtgggcggaggtaagagaggcgctttctcctccgtgtccatgagtggcggtgccggacgatgctcttcaggtgggtttgggtcaaagggagcctgcttcggaggcgcagggggttttggaacagggggattcgggggaggtttcggcggttcattctccggcaaaggtggccctggctttcctgtgtgcccggctggaggtattcaggaggttacaatcaatcagtcgttattgacaccacttcatgttgagatcgaccccgagatccaaaaggtgagaacagaagagcgagagcagattaagttgctcaacaacaaattcgcttcgttcatagacaaggttcagttcctggagcagcagaacaaggtgctcgaaacgaaatggaatctcctccaacagcagaccaccacaacctccagcaaaaacctcgaacccttatttgaaacctacctgtccgtactgagaaaacagttggataccctgggcaacgacaaaggtcgcctccagtcggagttaaaaacaatgcaggatagtgttgaggattttaagactaaatacgaggaggagattaacaagcggactgctgccgagaacgacttcgtagtcttaaaaaaggatgtggatgccgcttacctgaacaaagtggaacttgaggctaaagtcgatagcttgaatgacgaaataaacttcctgaaggttttgtatgatgctgagctctcccagatgcaaacacatgtgtctgacacttcggtggtgttgtcaatggataacaacaggaacctcgacctggactctatcatcgcagaagttagagcgcagtacgaagaaatagctcagaggagcaaagctgaggctgaggccctttaccagactaaagtgcagcagctccaaatttctgtggatcagcacggggataatctgaaaaatacaaaatctgaaatcgcagagctcaataggatgatacagcgcctcagagcagagatcgaaaacatcaaaaagcagtgccagaccctgcaggtgagcgttgccgatgccgaacaacgcggagaaaatgctctgaaggacgcccattccaaacgtgtagaactggaagcggcactgcagcaagctaaggaagagcttgccagaatgttgcgcgaatatcaggagctaatgtctgttaagctcgccctcgacattgagatcgctacatataggaagctgctggagggcgaagaataccgaatgtctggcgaatgccagtctgcggtgtcaatcagcgtagtttccggttccacctccacaggcggtattagtggaggcctcggctccggatctggatttggtttgagcagcgggtttggatcaggtagcggctccggcttcggctttggaggctcagtgtccggcagctccagcagcaagattatcagcaccaccacccttaacaaacgacgctag

SEQ ID NO: 227672 - DNA, 1563 bp, Artificial Sequence
  Description of Artificial Sequence: Synthetic coding sequence
atgattgcgcgtcaacagtgtgttagggggggaccgcgagggtttagctgtggctcagcaattgttggtggagggaaacgtggggcatttagtagtgtgtcgatgtccgggggagccggaagatgctcttcgggcggattcggcagtaggtccctgtacaaccttagaggcaacaagtctatttcaatgagtgtcgccggtagtcgccaaggtgcttgctttggaggagcgggaggattcggcaccggcggattcggaggtggttttggcggatcattctccgggaagggcggtcccggattcccagtatgtccagctggcggaatacaggaagttactattaatcagagtttacttacacccctccacgtagagatcgatcctgaaattcagaaggttaggaccgaagaaagagagcaaattaagctactgaataataaatttgctagcttcatcgacaaggtgcagtttcttgagcagcagaacaaggtgctggaaacgaagtggaacctgttacaacaacagactacaactacctcctcaaaaaacctggaacccttgtttgaaacctacctttcagtactcagaaagcaacttgatacattgggcaatgacaaaggacgcctccagtcagaactgaaaacaatgcaggactcagtcgaggactttaaaaccaagtatgaagaggagatcaacaaacggaccgccgcagaaaacgactttgtagtgttaaagaaggatgtggacgccgcttacctgaataaagtagagctcgaagctaaagtagactctctcaatgacgagatcaattttctgaaggtgttgtatgacgctgaactgagtcagatgcagacccatgtgtccgacacatctgttgtgttgtccatggacaataacaggaaccttgacttggattcaattatagcagaggttagagcacagtatgaggaaatagcacagcgatccaaggccgaagcagaagccctttaccagaccaaggtgcagcagcttcagataagtgtcgatcagcatggcgataacctgaaaaatactaaaagcgagatagctgaattaaatagaatgatccagcgtttaagggccgagattgaaaacatcaaaaagcagtgtcagaccctgcaggtgtccgtcgccgacgccgaacagagaggagaaaatgccttgaaggatgcccatagcaagcgggtggagctcgaagccgctctccagcaggccaaagaagaactggccagaatgttgcgggaataccaggagctaatgagtgtgaagctcgcacttgacatagagattgctacatataggaagttgctggagggcgaggaatatcgaatgtcgggggaatgccagtcggccgtaagcatttctgtcgtaagcggatccactagtacagggggtatcagcggcggactggggagcgggtcgggtttcggcttaagtagcggcttcggatcaggatctggctcaggctttggcttcgggggttctgtgtccgggtcttcctcgtcaaagattatatccacaaccaccctgaacaaaagaaggtag

SEQ ID NO: 227673 - DNA, 1695 bp, Artificial Sequence
  Description of Artificial Sequence: Synthetic coding sequence
atggcatcaaccagtactactatcagatctcacagcagcagcagacgcggttttagcgcgaattccgccaggctcccgggagttagcagatccggattcagttccgtctcagtgagccggtcacggggatccggtggtcttggcggagcctgtgggggagctggttttggatcccgttcgctgtacgggctgggaggctcgaagcgcatctctatcggcggtggcagctgcgccatctccggaggctatggcagccgcgctggcggatcttatggctttggcggagccggatcagggtttggatttggaggcggagcagggattggattcgggctgggtggtggggctggcctcgccggtggcttcgggggaccaggatttcctgtgtgtccacctggcggaatccaagaagtcacagtgaaccagtccttattgactccactcaatctacagattgacccaacgatccagagggtgcgcgcagaggagcgagaacagatcaagaccttaaacaataagttcgcgtcatttatagacaaggtcagatttctcgaacagcagaataaggtgctggaaaccaaatggacactgttgcaagaacagggaaccaagaccgtccgacagaacctggagccactcttcgagcagtacattaataatctgcgcaggcagctggatagtatcgtaggtgaaagggggagactggacagtgaattgagaggcatgcaggatctggtcgaagactttaagaataaatacgaggatgaaatcaataagcgtaccgccgctgaaaatgaatttgtcacgctgaagaaggacgttgacgctgcttacatgaataaggtggagctgcaagccaaagcagatactctgaccgacgagatcaactttctacgagccctgtacgatgctgagctctcacagatgcagacacacatcagcgatacaagcgtggttctttcaatggataacaatagaaacctcgatctggattcaatcattgccgaagtgaaagcccaatacgaggagatcgcgcagaggagccgagcggaagccgagtcatggtaccagaccaagtatgaagagcttcaggtgaccgctggacggcacggagatgatctacgcaacactaaacaggagatcgcagagatcaaccggatgatacaaaggttgcggtccgaaatcgatcatgttaagaagcaatgcgccaacctccaggctgcaattgctgatgcagaacagaggggtgaaatggccctgaaggatgcaaagaataaactcgagggcttggaggacgcgctccaaaaggcaaaacaggacttggcccgactgctgaaagagtaccaggagctcatgaacgtcaagttagctctggacgtggagattgcaacgtatcgcaaactgctcgagggggaggaatgtagattgaatggcgagggtgtgggccaggtaaacataagtgtggtgcagtccaccgtatcctcaggatacggaggtgcttcgggagtcggctccgggctgggcctcggcggaggaagttcttatagttacgggtcagggttgggcgtgggcggaggcttttcatccagtagtgggcgtgccataggcggaggtctgagtagcgtaggtggtgggagctcaaccattaagtatacaactactagcagtagctcccggaaatcgtataagcattag

SEQ ID NO: 227674 - DNA, 1563 bp, Artificial Sequence
  Description of Artificial Sequence: Synthetic coding sequence
atggcatcaacctcaaccaccattagatctcattcaggatccaggtccttatacgggctgggtggaagtaagcgcatctcaatcggcggaggatcttgcgccatatccggaggctacggctccagagcaggcggaagctacgggtttggaggcgcaggttctggattcggatttggcggaggggctggaatcggcttcggattgggcggaggagccggactagccggaggtttcggcggtccgggttttcccgtgtgtcctccagggggaatccaggaagtgactgttaaccaatccctgctgacccccctaaacctgcagatcgatccaacaattcagcgggtgcgggctgaagagagggaacagattaaaactctcaacaacaagtttgcctcatttatcgataaggtaaggtttctcgagcagcaaaacaaggtgctcgaaaccaaatggaccctgctacaagagcagggaacaaagactgtgaggcagaaccttgagcctttgtttgagcagtatatcaacaatctgcggagacaactggactcaatcgttggcgagcgaggacggttggatagcgaacttcgcggtatgcaagacctggtggaagatttcaagaacaaatacgaggatgaaattaataaacgaaccgctgccgagaatgagtttgtgaccctcaaaaaggatgtagacgccgcttatatgaataaggtggagctgcaggctaaagctgacactctgacagatgaaattaactttttacgtgcgctctacgacgcggaactgtcacagatgcagacccacataagtgatacctccgtggtgctttcaatggacaacaatcgtaatctcgatcttgacagcatcatcgccgaggttaaggctcagtatgaagaaattgctcagcggtctcgagcagaagccgaatcttggtaccaaactaaatatgaggagttacaggtgactgccggacgacatggggacgatctgagaaacaccaagcaggaaatagccgagatcaatcggatgatccagaggctcagaagcgaaattgaccatgtaaagaaacagtgtgcaaatttgcaggccgcaattgccgacgctgagcagcggggagagatggcactgaaagacgccaagaataaactcgaaggtctcgaggacgctctgcagaaggctaaacaggacctggctaggctgcttaaggaataccaggagctgatgaacgtgaagcttgctcttgatgtcgagatcgcaacatacaggaaactactggaaggtgaggagtgccggcttaatggagagggtgtgggccaggtgaacatatcagtggtccaatcgaccgtcagctccgggtatggtggggcttcaggggttggcagtggcttgggcttaggaggcggatcgtcctactcttatgggtccgggctgggagttggaggcggattttccagtagttcaggcagagcaatagggggagggcttagcagcgtggggggaggctcaagcaccataaagtacaccaccacttccagctctagccggaaaagctataagcattag

SEQ ID NO: 227675 - DNA, 1695 bp, Artificial Sequence
  Description of Artificial Sequence: Synthetic coding sequence
atggcttctacgtctacgacaattcgctctcatagcagtagcaggcggggattcagcgccaatagcgccaggctgccgggagtctcccgctcagggttctcgagcatatccgtatcgcggtcgagagggtcaggagggctaggaggagcatgtggtggagccggattcggcagtcgctccttatatggcctcggtggaagcaagagaattagcatcggagggggtagttgcgccatttccggaggatacggaagccgcgcaggaggaagctatgggtttgggggagcaggcagcggattcgggttcggaggaggggcaggcattgggtttgggttgggagggggtgccggactggctgggggattcggaggtccagggtttccagtgtgcccgccaggtggcattcaagaagtgacagttaatcagtccctgctcacaccactgaaccttcaaatcgaccccgctattcagcgcgtgagagccgaggaacgcgagcagataaagactttgaacaacaaattcgcgtcttttattgataaggttagattcttggagcagcagaataaggtcctggacactaaatggaccctgctgcaagagcaagggactaaaacggtcagacagaacctggagcctctattcgagcaatacatcaataatctgagacgtcagttagataacatcgtgggcgagaggggcagactggactctgagctgcggaatatgcaggatctcgtcgaggacctcaaaaataagtacgaagatgagataaacaagcggacagcggcagagaacgagtttgtcactctaaaaaaggacgttgatgcggcttacatgaataaggtggagttgcaagcaaaagccgatactctcactgatgagatcaacttcctgagagctctgtacgacgccgaactgagtcagatgcaaacacacatttctgatacatccgtggtgttgtccatggataacaatagaaatctggacctggattcaatcattgccgaagtgaaggcccaatatgaagaaattgcgcagaggtctcgcgctgaagccgaatcctggtatcagacaaagtatgaagagttacagattactgccggtcggcatggggacgacctgcggaacaccaagcaagagatagcagagataaaccggatgatccaaaggctgcgtagtgagattgaccatgttaagaagcagtgcgcaaatctacaggcggcaattgcagatgccgagcaaagaggcgaaatggctttgaaggacgccaagaacaagttagagggtctggaggatgcgctgcaaaaggcaaagcaggatctggcccgtctgttgaaggagtatcaagagctcatgaatgttaagctcgcactggatgtggagatcgccacttatcgaaagttgttggaaggcgaggagtgccgattgaacggggagggggtggggcaagtaaacatcagtgtcgtccagtcgacagtgagctcagggtacggcggtgcatctggcgttggaagcggtttagggctgggaggaggctcctcctacagctacgggtcaggcctcggggtaggtgggggattttcaagctcttctggtagagcaactggcggtgggctttcttccgtgggtggtggtagttcaacgatcaaatacacgactacaagttcatccagtcgtaaatcgtacaagcattag

SEQ ID NO: 227676 - DNA, 1575 bp, Artificial Sequence
  Description of Artificial Sequence: Synthetic coding sequence
atggcttcaacctccacaacaatcagatcccactccagtagccggagaggatttagtgccaactctgcaagactgcctggagtgtcgcgttccggtttcagctccattagcgttagcagatctagagggagtggcggattgggtggagcctgtggcggagcgggtttcggcagccggagtctctacggcctaggaggcagtaaaaggatttcgatcggcggaggctcctgtgccatcagcggcggttatggtagtagagcgggaggaagctacggattcgggggagctggatctgggttcgggttcggcggaggcgcaggaatcggcttcggcttgggaggtggcgctggtcttgcagggggttttggtggaccaggctttccagtttgtcccccaggtggaatccaagaggtaacagtgaatcagtcactccttaccccccttaacctccagattgaccccgcaattcagcgcgtgcgcgcagaggagagagaacagatcaagacgttaaataacaaatttgccagctttatcgataaggtccggttcctggagcagcagaataaggtgctggacacaaagtggaccttgttacaggagcaggggacgaaaaccgtccggcagaacttagaacccctctttgagcaatatatcaataacttgagacgccagctggataacattgtaggtgaaaggggacgacttgactcagaactccgaaacatgcaggacttggtggaggatcttaagaacaaggacgaaatcaatttcttacgagctttgtacgacgctgagctgagccagatgcagacccacatttcagatacgtctgtagtgctttcaatggataacaataggaatctagacctggattccatcatcgccgaggtcaaggcccagtatgaagaaattgcccaacgatctagggcagaagcagaatcttggtaccagaccaaatacgaagagctgcagatcaccgctggacggcacggcgacgatctgcgcaatactaaacaggaaatcgccgaaataaacaggatgatacagcggctgagatcggaaattgatcatgtcaagaagcagtgtgcaaatttgcaggcggcaattgcagatgctgagcagcgaggcgagatggcactgaaggatgccaagaataagctggagggcttggaggatgcactccagaaggcgaaacaagacctcgctaggctcctgaaagaatatcaggagctcatgaacgtcaagctggcgttggatgtcgaaatcgcaacatacagaaagcttcttgaaggtgaagagtgcaggcttaacggagagggggtcggccaagtgaacatcagcgtggtccagtctactgttagtagtggctacggcggagcatctggtgtaggcagcggtctcgggctggggggagggagttcatactcctacggaagtggactcggtgtcggcggaggtttcagtagctccagtgggcgtgcaacagggggagggctctcttcggtcgggggaggctcttccaccatcaagtatacaacgaccagcagtagtagtagaaaaagttacaaacactag

SEQ ID NO: 227677 - DNA, 1695 bp, Artificial Sequence
  Description of Artificial Sequence: Synthetic coding sequence
atggctagcacatccacaaccattcggagccattcttccagccgcagggggttctccgccaattccgcacgcttacccggtgtctcgaggtctggtttttcttcgatttcagttagcagatctcgcggtagcggcggattgggtggagcatgcggcggagccggattcggctcccgctctctgtacgggttgggaggatccaaacggattagtattgggggaggttcgtgcgctatttcaggaggctacggctccagggccggtggaagttacgggtttgggggagccggtagcggcttcgggttcggtggaggagcgggaatcgggtttggtctcgggggaggagctggtctggcgggaggatttggtggcccaggcttccccgtttgtcctcccggtggcattcaggaggtgacggtcaatcagtcgttacttacacccctgaacttgcagattgacccagccattcaacgagtgagagcggaggaaagggaacagattaagacattgaataacaaatttgcttcctttatcgacaaggtacgcttcctcgagcagcagaataaggtactagacacgaaatggacattgttacaggaacagggtactaagactgtcaggcaaaatttggaaccactcttcgaacaatatataaacaacctcaggcggcaactcgacagcatcgtgggcgaaagaggacgacttgatagcgagctgagaaatatgcaggatctcgtggaagatctgaaaaacaagtatgaggatgagatcaataaacgtacagcggctgagaacgaattcgtgactcttaaaaaggacgtagacgccgcttacatgaacaaagtcgagttgcaggctaaagctgatacacttaccgacgagattaatttcctgagggctctttacgacgcggagctgagtcagatgcaaacccacatctccgatacctccgtggtcctgagtatggacaacaatagaaacctggatttggacagtatcattgcagaggttaaggctcagtacgaagagattgcacaacgtagtcgggctgaagccgagtcatggtaccagacaaaatacgaagagctgcaagtcaccgcgggaaggcacggagatgatctcagaaacacgaagcaggaaattgcagagattaaccgcatgatccaacgtcttcgatccgagattgaccacgtgaaaaagcagtgcgccagcctccaagcagccattgccgacgctgaacagaggggggaaatggccctgaaagatgccaaaaataaactggaaggcctggaagatgccttacagaaggctaagcaggatctggcacggctcctgaaggagtaccaggaactgatgaatgtaaagctggcactcgatgtggagatagcaacctacagaaaactgctggagggggaagagtgcaggttgaatggggaaggagtagggcaggtcaacgtgagcgttgtgcaatcgacaatctcttcagggtacgggggagccagcggtgtgggatccggcctagggttaggaggcggatcatcttattcctacggcagcggcctgggaatcggcggaggattttccagcagttccgggcgtgcaatcgggggaggtctatctagcgttgggggtggttccagcaccatcaagtacaccaccaccagttcatcgagccggaagtcttacaaacactag

SEQ ID NO: 227678 - DNA, 1650 bp, Artificial Sequence
  Description of Artificial Sequence: Synthetic coding sequence
atggcatccacaagtactacaattcggtcacacagcagcagtaggtcgggcttctcttcaatctccgtgagtcgctcccgcggttctggagggctgggtggcgcttgtggtggagccggtttcggcagtagaagcctttatgggctcggcggttcaaagcgtatctccatcggtggcggtagctgcgccatatcagggggttacggaagcagagccggagggtcgtatgggttcggaggcgctggttccgggtttggttttggaggtggggctggaatcggctttggcttgggtgggggtgccggactcgccggtggatttggcggacctggatttcccgtgtgtccacccggtgggatccaggaggtgaccgtcaatcagtccctgctgacaccactgaatctacagattgacccagctatccagcgggttcgggcagaggagcgtgagcagatcaaaactcttaataacaaattcgcctccttcatcgacaaagtgaggtttttggagcagcagaacaaggtgctggacactaaatggacattactccaagaacaaggtacgaagacagtccgccagaacctcgagcctctgtttgaacagtatattaacaatcttaggcgccagctagactccatcgtgggagaacggggtcgactcgatagtgaactaagaaatatgcaagatctagtagaagatctgaagaataagtatgaagatgaaatcaataaacggacagccgctgagaatgaattcgtaactcttaagaaagatgttgacgcggcatatatgaataaggtggaactgcaagctaaggccgacaccctgactgatgaaatcaatttccttcgggcattatatgatgccgagttgtctcagatgcaaacccatatctccgatacaagcgttgtcctgtcgatggataataacagaaacctggacctggattcaattatcgcagaggtgaaggcccaatacgaggaaatcgcacagaggtcaagggccgaggcggaatcttggtaccagactaaatatgaggagctacaggtgactgctggtcgacacggtgacgatctgcggaacacgaaacaggaaatagcagagatcaatagaatgattcaaagactgaggagcgagatcgatcacgtgaagaagcagtgtgcctcgctacaggccgctatcgctgacgccgagcagagaggggagatggcactgaaggatgctaagaataagcttgaaggcttagaggatgcactgcagaaggcgaaacaggaccttgccaggctgcttaaagagtatcaggagctgatgaatgtcaagctcgcgcttgacgtggaaatcgcaacttaccgcaaacttttggagggtgaagaatgtcggttaaacggcgagggcgtgggccaggtcaatgtgagtgtggttcaatctacaattagctctggctacggaggtgcctcgggcgttggatccggtttggggttgggagggggatcatcctattcatatggaagcggcctcggaatcggcggtggtttctcctccagcagtggacgtgccatcggcggtggcctgagttctgtgggaggcggttcatctactattaaatatactactacctcatcaagcagcagaaaaagctataagcactag

SEQ ID NO: 227679 - DNA, 1572 bp, Artificial Sequence
  Description of Artificial Sequence: Synthetic coding sequence
atgtccagacagtttacctgtaagagtggcgcagctgctaaaggcggttttagcgggtgcagtgctgtcttatccgggggaagctcttcaagtttcagggctgggagtaaggggctgtccggcggttttggttctcgttccctgtactccttgggaggagtcaggagtttgaatgtggcctctggctcaggtaaaagcggaggctacgggttcggtagagggagggcctccggatttgcgggatccatgttcggcagtgtcgcactgggccctgtgtgcccaactgtgtgtcccccaggtggcatacaccaggtaacagttaatgagtccttactggctccacttaacgtcgaactcgatccagaaatccagaaggtgcgtgctcaggagcgcgagcagatcaaggcacttaacaataaatttgcctccttcattgataaggtgcggttcctggagcaacagaaccaagtgcttgagactaaatgggaactcctgcagcagcttgacctgaacaactgcaaaaataacctcgaaccgatacttgagggttacatcagtaatctcaggaagcagctcgaaactttgtcgggagatcgagtgcgcctggattccgaactgaggaacgtccgcgacgtggttgaggattataaaaagcggtacgaagaggaaatcaataagaggactgcggctgagaatgagtttgtccttctgaaaaaagacgttgacgccgcatacgctaataaagtggaacttcaggctaaggtggaaagcatggaccaggagattaaattctttcgatgtttattcgaggccgagatcacccagatacaatctcatatctcagatatgtctgtcatcctttctatggataacaaccgcaacctggacttggattctatcatcgacgaggtacgaactcagtatgaagaaatcgctctgaaaagcaaagccgaagccgaggccctctaccagacaaagttccaggaattgcaactggctgctgggaggcacggagacgacctcaaaaataccaaaaacgagattagtgaacttacaaggctgattcagcgaatccgcagtgagattgagaacgtgaagaagcaggctagtaacctcgagaccgccatcgcagatgctgagcagcgaggggataatgctcttaaggacgctcgggctaaactggatgaactcgaaggcgctctccatcaggcaaaggaggagctggctcggatgttgagagagtaccaggagctcatgtccctcaaactggcgctggatatggaaatcgcgacatatcgcaaattgctggaatctgaagaatgccggatgtcaggagagtttccctctcccgtgtctatcagtatcatatcaagtacctccggcggaagcgtttacggatttcgcccaagcatggtctcgggaggctatgtggcaaactcctcaaactgcatctccggtgtgtgttctgtccgaggcggagaggggaggagtcggggaagcgcaaatgactacaaggataccctggggaaagggagtagcctgtcagccccaagcaaaaaaactagcaggtag

SEQ ID NO: 227680 - DNA, 1536 bp, Artificial Sequence
  Description of Artificial Sequence: Synthetic coding sequence
atgagcaggcagctgacccacttccctcgcggagaacgcctcggattctctggttgcagcgcagtcctgtccggtggaatcggcagttcaagcgcatcctttagggcacgcgtgaagggttcagcctcattcggttccaaatcgctgagctgcttaggaggatcgcgctccctcgcactcagtgcagctgcaaggcgcggagggggacgcctcggaggattcgtaggaacggcatttggctccgccggactgggacccaagtgtcctagcgtgtgtccgcctggtgggatccctcaggtcactgtaaataagtccctattagcaccactcaatgtcgaaatggaccctgagatacagagagtcagggctcaggaaagagaacagataaaggccttgaacaacaagttcgcaagctttatagataaagtgcggttcctcgagcagcagaaccaggtgttggagacaaaatggaatctattgcaacaactcgatctgaacaactgccggaagaatctggaacccatttatgaaggctacatttcaaacttgcaaaagcagctggaaatgctgtcgggggatggggtacgattggacagtgagctacgcaatatgcaggatctggttgaggactacaagaagcgctatgaggtcgagatcaatagaagaaccgcagcggagaatgaatttgttgtcctgaaaaaagacgtggatgccgcttatatgaacaaagtggagcttcaggccaaggtggattctttgacagatgagattaaattcttcaagtgcctgtacgagggagagattacacagattcaaagccatattagtgacacttctattgtcctaagcatggataacaaccgggaccttgaccttgatagtataatagccgaggtcagggcccagtacgaagagatcgcgctgaagtccaaagcggaagccgagacgctgtatcagacaaagattcaggaactgcaggtcactgctggccaacatggcgatgacctgaagctgactaaagctgagatcagcgagttgaaccgcctgatccagcgaatcagatcggagataggcaatgttaagaagcagtgtgctgacctcgagactgctatcgctgacgctgaacagcgtggcgactgtgccctgaaggacgcaagagctaagctcgatgagcttgaaggagcactccatcaggcaaaagaggagcttgctagaatgctgagggagtaccaggaattagtgtccctgaagctggcactggacatggagatcgctacatacaggaaactgctagaaagcgaggaatgcaggatgtctggagagtacccaaacagcgtatcgatttcagtcatctcatccaccaacgcaggcgcaggaggcgctggattcagcatgggctttggtgctagctccagctacagttataagacagctgccgcagatgtcaaaacgaaaggctcttgtggcagcgaacttaaagatcctctggccaagacgagcggctcaagttgtgccaccaaaaaggcatctcgctag

SEQ ID NO: 227681 - DNA, 1410 bp, Artificial Sequence
  Description of Artificial Sequence: Synthetic coding sequence
atgtccaggcagcttacccactttcccagaggcgagagactgggatttagcggctgcagtgccgtgttgtctggcggaattggcagtagctcagccagcttccgcgctcgcgtcaaaggcagcgcttccttcggtagcaaatctttgtcatgcctgggcggtagtcgttctcttgccctgagtgccgcagcacggagggggggaggcaggttgggaggatttgttggaaccgccttcgggtcggccggattagggcctaaatgtccttcagtttgcccccctggcggtattcctcaagttacagttaataaaagtcttctggccccactgaacgttgaaatggaccccgagatccagcgcgttcgtgcacaggagagagaacagattaaagcgctcaacaataaattcgcgtcctttatcgacaaggttaggttcctcgaacagcagaatcaggtgcttgagacgaagtggaatctgttacaacagttggatttaaataactgtaggaagaacctcgaacccatctacgaagggtacatctcaaatctgcagaagcagctggaaatgctgtccggagacggcgtgcggctggactcagaattgaggaacatgcaggatctggtggaagactacaaaaagcgatacgaagtggaaattaaccgcaggacagccgcagaaaacgaattcgtggtcctgaaaaaggatgtggacgccgcttatatgaataaggttgagctgcaggctaaggtggactctctcacggatgagattaagtttttcaagtgcctttacgagggggagataacacagatacaaagccatattagtgatacgtcaatcgtgctcagcatggataacaatcgggatttggatttagacagtatcattgctgaggtgagggctcagtatgaggagatagcactcaaatccaaggccgaggcagagaccctctatcaaactaagtgcgcagacctggaaacggccatagctgatgccgaacagcggggagactgcgcactcaaagatgctagagccaagctagacgagctcgagggggctttgcatcaggccaaggaggaactggctcgtatgttacgggagtatcaggagctagtgagcctgaaactcgctttagatatggagatcgctacctaccggaagctcctggagtccgaagaatgtcggatgagcggagagtatccaaactccgtctccattagtgtcattagctcgacgaacgcgggtgcagggggagccggttttagtatgggattcggggcttcctccagctatagctacaagacggctgctgcagatgtgaaaactaagggatcctgtgggagcgaactaaaggatcctctcgcgaaaactagcggctcttcctgcgcgacgaagaaggccagcaggtag

SEQ ID NO: 227682 - DNA, 972 bp, Artificial Sequence
  Description of Artificial Sequence: Synthetic coding sequence
atgctatccggggacggggtaaggctagacagcgagttacggaacatgcaggaccttgtggaggattacaagaaacggtatgaagttgaaattaataggaggacagctgcagagaatgaattcgtggtccttaaaaaggatgtggatgcagcatatatgaacaaagttgaactgcaggccaaggtcgacagcttgactgacgaaatcaagttcttcaagtgcctatatgaaggcgaaattacccagatccagagtcatatcagtgatacctctattgtgttaagtatggacaataatagggatctcgatctggacagtatcatagccgaggtcagggcccagtatgaggaaattgcactcaagtccaaggccgaggcggagaccctctaccagacaaagattcaggaactccaagtgacagccggacagcacggtgacgaccttaagctcaccaaagcagaaatctccgaattaaaccgtctgattcagcgcattcgctctgaaataggaaacgtaaaaaagcagtgtgcggatcttgagactgctattgccgatgctgagcagaggggagactgcgctctgaaggatgccagagccaagctggacgaacttgaaggggctcttcatcaggccaaagaagagttagccaggatgctacgtgagtatcaagaattggtgagcctgaaattggctctggacatggaaattgccacgtaccgcaaactgttggagtctgaggagtgtaggatgtctggcgagtaccctaactccgtttcaatctccgtcatttcatcaaccaacgccggagccggaggcgcagggttctcaatgggttttggagcaagctctagttactcgtataagactgccgctgccgacgtgaaaactaagggtagttgcggatcagaactgaaggatcctcttgccaagacctctggttcgtcttgtgcaactaagaaagcatcccgctag

SEQ ID NO: 227683 - DNA, 1536 bp, Artificial Sequence
  Description of Artificial Sequence: Synthetic coding sequence
atgtcccgacagcttacccacttcccccgtggcgaacgactgggcttcagcggatgcagtgctgtgctatctggcggaataggctcctcctctgccagtttcagggctagagtgaagggctccgccagcttcggatccaaaagtctctcatgcctcggaggctcgcggagcctcgccctcagtgctgccgctagaaggggagggggacggctgggcggtttcgtaggcactgccttcggttccgcgggactcggtcctaagtgcccatctgtttgcccccctggcggaatcccccaggtcacagtgaataaatctttgttggccccattgaatgttgagatggacccagaaatccagcgcgtgagggcccaagagcgagaacagatcaaggctttgaacaacaagttcgcttcgttcatcgacaaggtgcgctttctagagcaacagaaccaggtcctggagactaaatggaacctactgcagcagctcgatctcaacaactgtcggaagaacctagagccaatctacgagggctatattagtaacctgcagaaacagctcgaaatgctgtccggagatggtgtccggctggacagtgaactacgcaatatgcaagacctagttgaggattacaagaaacggtatgaagtcgagatcaaccgtcgcaccgccgctgaaaatgaattcgttgtgcttaagaaagacgtcgacgctgcttacatgaataaggtcgagcttcaagccaaggtcgattccctgaccgacgagattaaatttttcaagtgcttatatgagggcgaaattacacagattcaatcccatatctcagatacctcgatcgtgctgagtatggacaataaccgggacttagacctggactccatcatcgccgaagtgagggcccagtacgaagagattgccctcaagagtaaagctgaggctgaaacattataccagacgaagattcaggaactacaggtaactgccggtcagcacggtgacgatctcaagctgactaaagccgaaatttctgagctgaatcgactcatccaacgcatccgcagcgaaatcgggaatgttaagaaacaatgcgccgacctggagactgcaatcgccgatgccgagcagcggggtgactgtgcactgaaagacgccagagcgaaactggacgagctggagggagctctccaccaagctaaggaagaactggctcgtatgctgcgtgagtaccaagagctggtatccttgaaactggccttggatatggaaattgctacttaccggaagctattagagtctgaagaatgccgtatgtccggagagtaccccaattctgtgagtattagtgtgatatctagcacgaatgcaggggctggcggagcagggttcagtatgggcttcggtgcttcttcctcttactcctataagacggctgcagccgatgttaagacaaagggatcatgcggatcagaactcaaggaccccctcgccaagacgagtgggagcagctgcgctaccaagaaggcttctcgctag

SEQ ID NO: 227684 - DNA, 1623 bp, Artificial Sequence
  Description of Artificial Sequence: Synthetic coding sequence
atgtctcggcaattcacttataaaagcggagcggcagccaaaggtgggttttctggctgcagcgccgttctgagcggagggtctagttctagttaccgggctggcggaaagggactgagtgggggattttcatcaaggtccctgtacagtctcggcggtgcacgctctatctcttttaatgttgccagcggcagcgggtgggcgggtgggtatgggtttggtcgcggacgcgcaagcgggttcgccggatccatgtttggaagcgttgccctgggatccgtgtgccccagtctttgccccccaggaggcatccatcaggtcaccattaacaagagcctcttggcaccactaaatgtggaactagacccagaaattcagaaagtacgggctcaggagagagagcagatcaaggtcctgaataacaaatttgcttcatttatcgataaggtccgtttcctagaacagcagaatcaggtattagaaacgaaatgggaactccttcagcagctagatctgaacaactgtaaaaataatctggagcctatcttggagggatacatctccaacctgcgaaaacaattggagaccctgtctggcgaccgtgtgagactggattcagaacttcggagcgtgcgcgaagtggtagaagactataaaaaacggtatgaggaggagattaacaaacggactaccgctgaaaacgaattcgtcgtgctgaaaaaggacgttgatgccgcatatacatctaaagtcgagttgcaggccaaggtggatgcactggacggagaaattaaattctttaagtgcttgtatgaaggcgaaactgcacagattcagtcacatatttcagatacttcgattatacttagcatggacaacaataggaaccttgacctcgatagtattattgccgaggtgagggcacagtacgaggagatcgccagaaaatcaaaggcggaagccgaagcgctgtatcagaccaaattccaggaattgcagctggccgcagggagacacggcgatgacctcaagcacacaaaaaatgagatatctgaattaactcgtctgatccagcgactgcgatcagagatcgaatctgttaagaagcagtgtgccaacctggagaccgccattgctgacgcggagcaacgtggcgactgtgctctgaaggatgctagggccaaactggatgaactggaaggggcacttcagcaggcgaaagaggagctggctcgcatgctgcgtgagtaccaggagctgctgtctgtgaaactgtcccttgacattgagatcgccacttatagaaaactgttggaaggcgaagaatgcaggatgagcggtgaatatacaaactcagtgagtataagcgtgattaattcaagcatggccggaatggctgggacaggagcaggcttcggtttctctaacgcaggtacgtacggatattggccgtccagcgtatctggcggatacagcatgcttccaggtgggtgtgttactggtagtggaaactgcagcccccgaggcgaggcgaggaccaggctgggatccgcgagtgagttcagagactcccagggcaagactctggccctgtccagccccactaagaagaccatgcggtag

SEQ ID NO: 227685 - DNA, 1590 bp, Artificial Sequence
  Description of Artificial Sequence: Synthetic coding sequence
atgtccaggcagttgaacattaaatcatcaggcgataagggcaatttcagtgtgcacagtgctgtcgtgcccaggaaagccgtgggatctttggcttcctactgtgctgctgggagaggggcaggagccggttttggctctcggagcctctacagcttgggcggtaacagacggattagcttcaacgttgctggcggaggagtgagggcagggggatatggcttccggcctggcagcggctatggcggaggaagagcttctggctttgccggttccatgtttggttctgttgcccttggtcctgcttgtttgtccgtttgccctcctggcggtatccatcaggtgactgttaacaagagtctgctggctccactaaatgtggagctggatccagaaatccagaaggtgcgcgctcaggagagggaacagatcaaggtgctgaatgacaagttcgccagcttcatagacaaagtaaggttcctggaacaacagaatcaggttctggaaactaagtgggagctcctgcaacaactggacctcaacaactgtaaaaaaaacctggaaccaattctcgaaggctatatttccaacctgcgaaagcaattagaaaccctgtctggcgatcgggtgagattggactccgaactgaggtcaatgagggacctcgtggaggactacaagaaacgatatgaggtggagatcaatcgcagaacaacagcagaaaacgaatttgtcgttctcaaaaaagatgccgacgcagcatatgccgtcaaggttgaactacaggcaaaggtggactccctcgacaaagaaatcaagttcctcaagtgtctgtatgatgcggagatcgcccaaatacagacccacgccagcgagacctcagttatcctgtcgatggataacaacagagacttggatctcgactccattatcgctgaagtaaggatgcattacgaagaaatcgccctgaaatccaaggctgaggcagaggcgctgtaccaaacaaaaattcaggagctgcaactggcagcctcaaggcatggagacgacctgaagcacacccgctccgaaatggtggagctgaataggctcattcagcgcatccgctgtgaaattgggaacgttaagaagcaacgcgcaagcttagagacagcaatcgccgacgcagagcaaaggggggataacgccctcaaggatgcacaagcaaaactggacgagctcgaaggagccctccaccaggctaaggaagaactggcccgaatgctcagagagtaccaagagcttatgtcgctgaaactggcattggatatggaaatcgccacttacaggaagctgctagagggtgaagaatgcagaatgtccggggagaatccctctagcgtgtctattagtgtcatttcaagcagcagctattcctatcaccacccatcaagcgcaggtgtcgatcttggggctagcgccgttgccggatcctcaggtagtacacagtctggtcaaacaaaaacaactgaagcaaggggcggagacctgaaagacacacagggaaagtctaccccagcgtctattcccgctagaaaagcgacgaggtag

SEQ ID NO: 227686 - DNA, 1656 bp, Artificial Sequence
  Description of Artificial Sequence: Synthetic coding sequence
atgtctagacagagctcaataactttccagtccggctctaggcgagggttttcgaccacgagcgcgataacgcctgcagccggaaggtctagattctctagtgtgagtgtggccaggtcagctgccggttcagggggtctcggacgcataagcagtgcaggcgctagtttcgggtcccgctcgctgtacaacctcggcggagcaaagcgggtgagcatcaatggctgcggtagcagctgccgttctggcttcggcggtagggcttcaaacagattcggcgtgaattccggatttgggtacggaggtggagtcggcggaggatttagcggtccatccttcccagtatgcccgccaggtggtattcaagaagtgaccgtgaatcagtcccttctcacacccctgcatctccagatcgatcccacaatccaaagagttagagccgaggaaagggagcagatcaagaccctgaataataaattcgcaagtttcatcgacaaggtccgttttctggaacagcaaaacaaggtgttagaaacgaagtgggctctactccaggaacaaggcagtcggacagtaagacaaaacctggagccgctgttcgactcttatacgtcggagctgagacggcagctagagtccataactactgagagggggcgtttagaggccgagctccggaacatgcaagacgtggtggaggacttcaaagtgcggtatgaggacgagattaataaacgcacagctgcggagaacgaattcgtagccctgaaaaaggatgttgacgccgcttacatgaacaaagtggagctggaggctaaagtgaagtctctgccggaggagatcaactttatccatagcgtctttgatgctgagctgtcacagctgcagacccaagtcggagatacatcagtggtgctcagcatggataataatagaaatctggacctggactctatcatcgctgaagtgaaagcacagtacgaagacatcgccaacaggtctcgagctgaagccgagagttggtaccaaaccaagtatgaggaactccaagtgactgcgggtaggcatggcgatgatctgagaaatactaaacaggaaatttctgagatgaataggatgatccagcgcttgagagccgagattgactccgtcaagaagcagtgctcttcccttcagaccgctatcgctgacgccgagcaacggggtgaacttgcgctcaaagatgccagggcaaaattggtggacctggaagaagccctccagaaagcaaagcaggatatggcccgactcttgagggaatatcaggagctgatgaacattaaattggcgctcgacgtggagatagccacctaccgcaagctgttagagggtgaagaatgtagattaagcggtgagggtgtgagcccggtcaatatctcagttgtcacgtcaacactgtcctctgggtacggctccgggagttccattggagggggtaatctcggtctgggaggagggtcgggctactcgttcaccacatctgggggtcatagcctcggcgctgggcttggaggctcaggcttcagtgcgaccagtaaccggggactgggtggcagcggctccagcgttaaatttgtgagcaccacctctagtagtcagaaatcttatacacattag

SEQ ID NO: 227687 - DNA, 1737 bp, Artificial Sequence
  Description of Artificial Sequence: Synthetic coding sequence
atgtcacaccaattcagcagccagagcgccttttcgagcatgtctcggagagtctactccaccagctcctccgctggctctggcggtggttccccagcagtgggctctgtttgttacgctagaggcaggtgtggagggggaggctatggcattcatgggagaggctttggaagccggtctctgtacaatctgggcggatccaggtccattagtattaacctaatgggcaggagcactagtggtttttgtcagggagggggtgtcggaggtttcggcggaggacgaggtttcggggtgggtagcaccggggcagggggattcggcggtgggggattcggtggggctggcttcgggactagcaactttggactaggcggattcggcccatactgtccacctggcggaattcaagaagtcacaattaatcaatctctcctcgagccccttcacctggaggtcgaccccgaaattcagaggatcaagacacaggagcgcgagcagattatggtcttgaacaataagttcgctagctttatcgataaggtcaggttcctcgagcagcaaaatcaggtcctccagaccaaatgggagctgttgcagcaggtgaacacctcaactggcaccaacaatctggagccattgcttgaaaactacattggagatctgcgcaggcaggtcgacctcttgtctgccgagcaaatgagacagaacgctgaagttcggagcatgcaagatgtagtcgaagactacaaatctaaatacgaggatgagattaataagagaacaggtagtgaaaatgacttcgtcgttctgaagaaagacgtggatgctgcatacgtttctaaggtcgacctagagtctagagtcgataccctgaccggtgaagtgaacttcctgaaatatctgttcctgaccgaactctcccaagtacagactcatatttctgatacaaatgttattttgtcgatggacaacaatcggtcccttgaccttgacagcattatagatgcagtccgcacacaatatgagctaattgcccaaagaagtaaagacgaggcagaagccctgtatcagacaaaatatcaggagttgcagatcacagctggcagacatggagacgatttgaagaactccaaaatggagattgctgagctgaacagaaccgtccaacgcctacaagccgagattagcaacgtcaagaaacagattgagcagatgcagtccctgatcagcgatgccgaggagcggggagaacaggcccttcaggatgcatggcagaagttgcaggacttagaggaagcgctccagcagagcaaggaggagttagctagactgttgagagactatcaagccatgctaggagttaaacttagtctcgatgttgaaatagccacatatagacaacttcttgaaggtgaggaatctagaatgagcggcgaacttcagtcccacgtgtcaatatcggttcagaatagccaagtaagcgtgaatggaggggctggaggtgggggaagctacggctcaggcggttatgggggaggaagcggcggtggctatggtggcggaaggtcgtacaggggaggcggagcacgcggacgatccggcggtgggtatggaagtgggtgtggaggaggaggaggctcctatggtgggtcaggcaggtctgggagaggtagctcccgagtccagattatccagacaagcaccaatacctcgcaccgtcggatattagaatag

SEQ ID NO: 227688 - DNA, 1038 bp, Artificial Sequence
  Description of Artificial Sequence: Synthetic coding sequence
atgcgacagaacgctgaggtaagatccatgcaggatgtggttgaggattacaagagcaaatacgaagacgaaataaacaagagaaccggctccgaaaacgacttcgtggttttgaaaaaggatgtggatgcggcatatgtgtccaaagtcgacctagaatctagggttgatacactgaccggggaagtcaatttcctgaaatacctgttcctgactgagctatcacaagtgcagacacatatttccgatacaaatgttatcctgtctatggacaacaaccggagtttggatctggattccatcatcgacgctgttcgtacacagtatgagctcattgcgcaacgctctaaagacgaggctgaggccctctaccaaacaaagtaccaggaactccagatcacagccggaagacacggagacgatctcaagaattctaagatggaaatcgccgagctgaaccggactgtacagagactgcaggccgaaataagtaacgtgaagaagcaaatcgagcagatgcagtcccttatcagtgatgcggaggaaaggggagagcaggcccttcaggacgcctggcagaagctccaggatctggaggaagcccttcagcagtcaaaagaggagttggccaggctgttacgggattaccaggccatgctaggagtgaaactgagcttggacgttgagattgcaacttacaggcagctcctggaaggggaagaaagcagaatgagcggcgagctgcagtcacacgtgtcgatatccgtgcagaattctcaggtgtctgttaacggcggtgccggtggaggtggttcctacggatcaggagggtatggcggaggatctggcggaggctacggaggcggtagaagctatcggggaggcggagcacgtgggcgttcgggtggcggatatggctcaggctgtggaggagggggaggctcatatggagggtctggacggtccggacgcggttcctctcgtgtccagattattcaaacctcgactaacacctcccatcggaggattctcgagtag

SEQ ID NO: 227689 - DNA, 1563 bp, Artificial Sequence
  Description of Artificial Sequence: Synthetic coding sequence
atgtccttgtcaccctgccgggcacaacgtggtttcagcgctcgatcggcctgcagtgcacgatcacgtggaaggagtagggggggattctcatcacgaggaggtttctccagccgttcactgaactctttcggcggatgcctggaaggctctcgcggatctacttggggctcgggagggcgtttaggcgtgcggttcggcgagtggtccggcggaccgggactgagcctgtgtcccccagggggaattcaggaggtcactatcaaccaaaacctcctgacccctcttaagattgaaatcgaccctcaattccaggtcgtcagaacgcaggaaactcaggaaatcaggactttaaataatcaattcgctagctttatagacaaagtcaggtttctggagcagcagaataaggtgctggagacgaaatggcaccttctccagcaacaggggctgtcgggctcccagcaaggcctcgaacccgtcttcgaggcttgtctggaccagctgagaaaacagcttgaacaactgcagggcgagagaggagccctagatgccgaattgaaggcatgtagggaccaggaggaggagtacaagtctaaatacgaagaagaggcgcacaggagggcaaccttagaaaacgacttcgtagtgcttaagaaggacgtcgatggagtcttcctgagcaaaatggagctggagggtaaactggaggccttgagggaatacctctactttctgaagcacttgaacgaggaagaactgggacagctgcagacgcaagcaagcgatacctctgtagtgttaagtatggataacaatcgttatttggacttttcttccataatcactgaggtgagggctcgatacgaagaaattgcaaggagctctaaggctgaggctgaggcgctgtaccagaccaaataccaggagttgcaggtgtccgctcaattgcacggggaccggatgcaggaaaccaaagtgcagatcagccaactgcaccaggagattcagcgtctgcagtctcaaacagaaaacctgaaaaagcagaacgcctctttacaggccgcaatcacagatgctgaacagaggggcgagttggcgttgaaagacgcccaggccaaagttgatgaactggaagccgctctccgcatggccaaacagaacctggcccgtctcctttgtgaataccaggagttaacctccacaaaattgtccctggacgtcgagatcgctacgtatcggagactgttggaaggcgaggaatgcagaatgagcggagagtgtacttctcaggttaccatctcatcagtcgggggaagtgcagttatgtccggcggagtgggcggagggctaggatcaacctgtggcttgggttctggaaaaggctcccccggttcatgttgtacctctattgtgactggcggaagcaacatcattctgggcagcggtaaggaccctgttctcgatagttgtagtgtatcaggctcctctgctggcagttcatgtcacactatcctgaaaaaaacagtcgagtcttccctaaagactagcataacttactag

SEQ ID NO: 227690 - DNA, 1233 bp, Artificial Sequence
  Description of Artificial Sequence: Synthetic coding sequence
atggaaggacatgaggcctctcccgcacaggtcggccagggggatcgtggtaaagtgcgtttcttggagcaacagaataaagtgctggagacaaagtggcatcttcttcaacagcaagggctcagcggcagtcaacagggtctggagccagtctttgaagcttgcctggaccagctgagaaagcaactcgagcagctccagggagagcgcggtgccctggatgctgagctaaaagcctgccgcgatcaggaggaagagtacaagtctaaatatgaagaggaggcccaccgcagggctacactggagaacgatttcgtggttctcaagaaagatgttgatggtgtcttccttagcaaaatggaattggagggtaaactagaggccttacgtgagtatctgtactttctgaagcaccttaatgaggaggagctgggacagctgcagactcaagccagcgacactagcgttgtactgagcatggacaataatagatatcttgacttctcctccattatcacagaggtgcgcgctcgctacgaagagattgctagaagtagtaaagccgaggctgaagcgctctatcaaaccaaataccaagaactgcaggtgtctgcccagttgcatggggaccggatgcaggagactaaggtgcagatttctcaacttcatcaggagatccaaaggttgcagagtcaaaccgagaacctgaagaaacagaacgcctctctgcaggccgctattacagacgccgaacagcggggtgaactggccttaaaggatgcacaggcaaaagtggacgaactagaagctgccctgaggatggctaagcagaatctagcacgattattgtgtgaatatcaggagctaacttctacaaagctttccctcgacgtggagattgccacataccgccgacttcttgagggtgaagaatgccgaatgagtggtgaatgtaccagccaggtgactatcagctcagtcgggggtagcgcggttatgtccggcggtgtggggggtgggctaggttccacgtgtgggctgggctccggaaagggttctcctgggagttgctgtacgtctatagtgacaggaggaagcaatatcatcctcggatccggaaaggaccccgtcctcgattcctgcagtgtatcgggtagctccgccggatcttcttgccatacaattctcaagaagaccgtggagtcaagtctaaagacctccatcacgtattag

SEQ ID NO: 227691 - DNA, 876 bp, Artificial Sequence
  Description of Artificial Sequence: Synthetic coding sequence
atggaattagagggcaagcttgaggctttacgggaatatttgtactttcttaaacacctgaacgaagaggagctcggacagctgcagactcaagcttcggatactagcgttgtactttctatggacaacaatcgatatctggacttttctagtatcatcaccgaagttagggccagatatgaggagatagccaggtcgagtaaggcagaggctgaagccctgtatcagacgaaataccaggaacttcaggtatcagctcagctgcacggagaccgcatgcaggaaacgaaggtgcagataagtcagctccaccaggaaatccaacgcctacagtctcagaccgaaaatctgaagaagcaaaatgcctccttacaggccgctattaccgacgccgaacaaagaggggagttggccctcaaagatgcccaagctaaagtcgacgaactggaagccgcattgaggatggctaagcagaacctcgccaggttgctgtgtgagtaccaagagttgacaagtacaaaactgtctcttgatgtcgaaattgcaacttacagaaggctccttgaaggcgaggaatgccggatgtctggtgaatgtacatcacaggtcacgatctctagcgtagggggatctgctgtgatgtccggcggagttggcggtggactgggcagtacctgcggactgggctccggaaaagggagccccggttcatgttgcacaagcattgtgacaggaggctcaaatattatcctgggctcggggaaggaccctgtgctcgactcttgctctgtgagcggctcttccgctggcagttcatgtcacaccattctgaaaaagacagtagagtcatcactgaagacgtcaattacgtattag

SEQ ID NO: 227692 - DNA, 1608 bp, Artificial Sequence
  Description of Artificial Sequence: Synthetic coding sequence
atgcgctccagtgtctctcggcagacatacagcacaaaaggtggcttttcctcaaacagcgcctctgggggaagtggctctcaggctcgaacaagtttctcatccgtgaccgtctctaggtcctccggctcaggaggcggtgcacactgcggaccagggaccgggggttttggatccaggtccctttataatctcgggggtcataagtcaatctctgtctccgttgccggtggggcactgttaggtagagccttgggcggattcggcttcggaagcagggcgttcatgggacagggcgcaggcagacagaccttcggacctgcctgtcctcctggagggatccaggaagttacggtgaatcagtcgctgctgaccccattgcatgtagaaatcgaccccgaaatacagcgcgtgcgtacccaagagcgagaacagatcaagactctaaacaataagttcgcatctttcatagataaagtgagatttctcgagcaacagaacaaagtgcttgaaacaaagtgggcactcttacaggaacagggccagaacctgggggttacacgaaacaacctcgaacccctgtttgaagcatacctcgggtccatgcggtccactctcgatagactacagtctgaaaggggcaggctcgattctgagctgcgcaatgtgcaagacttggtggaagatttcaagaacaagtacgaagatgagattaacaaacacaccgccgcagaaaatgagtttgtcgttctgaaaaaggatgttgatgcagcctacatgggccgaatggacctccacggcaaggtgggaacactgacccaggaaatcgattttttgcagcagctttatgagatggagctgagccaggtccagacccacgtgagcaacaccaacgtggtcctcagtatggataataaccggaatctggatctggactcgatcatcgcagaggttaaagcccagtacgagttgattgctcagcgatctcgcgctgaagccgaagcttggtaccagaccaagtatgaagagctgcaggtgactgctggtaaacacggcgataaccttagggatacgaagaatgagattgcagagctgacacgcacaattcaacgcctgcagggggaagcagacgcggctaaaaagcagtgtcagcagctccagaccgcaatcgccgaggccgaacagcgaggagagctcgcattaaaagatgctcagaaaaagctcggcgatttggatgtcgccctgcaccaagccaaggaagatctcacccgactgcttagagattatcaggaactgatgaacgtgaaattggcacttgatgtagaaatcgcgacttatcgcaagctgcttgagtccgaagagtctcgaatgagcggagaatgccccagcgccgtgagcatatctgtaacgggcaactctaccaccgtctgcgggggaggagccgcatcctttggaggcggaatcagtctcggaggatcggggggagccactaaaggcggtttttctactaacgttggttactctaccgtcaaaggagggcctgtctctgccggtacaagcattctaagaaaaaccaccactgtaaagacttcctctcagagatactag

SEQ ID NO: 227693 - DNA, 1269 bp, Artificial Sequence
  Description of Artificial Sequence: Synthetic coding sequence
atggcttgtcgctcatgcgtcgttggcttttcttcgctatcttcatgtgaagtgactcccgtgggcagtccgagacctggtaccagcggttgggacagctgtcgggcacccggtcccggattctctagcagatctctcaccggatgttggagcgccggaacaataagtaaggtgaccgtgaacccaggtcttctggtcccactggatgtcaagcttgacccagctgtgcaacagcttaagaatcaggaaaaggaagagatgaaggccctgaacgataagttcgcctccttgattggcaaagttcaggcgctcgagcagcgcaaccagctgctggaaactaggtggtccttcttacagggccaggactctgcaatctttgatttaggtcatttatacgaagagtatcagggcaggctacaagaagagctgaggaaggtgagccaggagcgcggacagctagaagccaatctacttcaggttttagaaaaggtggaagagtttcgcattcggtacgaggatgaaatttcgaagaggaccgacatggaatttacattcgtccaactaaaaaaggacttggatgccgagtgtcttcacaggaccgaacttgagacgaaattgaaaagccttgagagttttgtggagctcatgaagaccatctacgaacaggaactaaaggatctcgccgctcaggtgaaggacgtgagcgtgaccgtcggtatggatagtcggtgccacattgatctgtctggcatcgtcgaggaagtgaaggctcaatacgacgccgttgcagccagatctctggaggaagcagaggcctactcaaggagtcagctggaggaacaggcagcaagatcagctgagtatggcagcagtctacagtcctcccgatccgaaatcgcagatcttaacgtccgcatccagaaactccgctctcagatcctctcagtgaagagccactgtcttaaactggaggaaaacatcaagactgcagaggaacagggcgaactggcatttcaggacgctaaaacaaagttggcacagctggaagcggcactgcagcaggctaagcaggatatggcaaggcagctcagaaaatatcaggagctgatgaacgtaaagctggctcttgacatcgaaatcgcaacctatagaaagttagtggagggagaagaggggcgaatggattcccctagtgcaaccgtggtctccgcagttcagtcacgctgcaaaaccgcacctagccttccttatcccctgtgttccctatag

SEQ ID NO: 227694 - DNA, 1359 bp, Artificial Sequence
  Description of Artificial Sequence: Synthetic coding sequence
atggcctgccggagctgcgtggtggggttctctagtctgtctagttgcgaagttactcctgttggtagtcctcgacctggaacatccggatgggacagctgtcgagcaccagggcctggattcagctcacggtctctgacagggtgctggtcggccggtaccatatcaaaggtaaccgtaaacccaggactgctcgtgccactggatgtgaaactggatcccgctgtccagcagctgaagaatcaggagaaggaagaaatgaaggccctgaatgataagttcgcttccttgattgggaaagtccaggccttagagcagcgaaaccagctcctggaaactaggtggtctttcctgcagggtcaggacagcgccattttcgacctcggccacttatatgaggaatatcagggacggctacaggaggagctgagaaaggtttcgcaagaacgcggacagctggaggctaatctgcttcaggtgctggaaaaggtggaggaatttcggatccgatacgaagatgaaatttctaaaaggacggatatggagttcacatttgttcagttaaagaaagacctggacgcagagtgtctccatagaaccgagttagaaaccaagctgaagtctctcgagtctttcgttgaacttatgaaaaccatttacgaacaggagctgaaagacctagccgctcaagttaaggatgtttccgtgactgtaggcatggactctcgctgccacatcgaccttagcggaatcgttgaagaagtcaaggcgcaatacgatgctgtcgcggctagatccctggaggaggcggaggcttactccaggtcacaactagaagagcaagccgctagaagtgcggagtacgggtcaagtctccagtctagcagatctgaaattgcagatctgaacgtgagaattcagaagttgcgatcccagatattgagcgttaaaagtcactgcctgaaattggaggaaaacataaagaccgcagaggagcagggggagctcgcatttcaggacgcaaaaaccaagttagctcagctggaggccgctttgcagcaggctaagcaggatatggccagacagctgagaaagtatcaggagttgatgaacgtgaagctggcacttgacattgagatcgccacctaccgtaagcttgttgagggtgaggaaggaaggatggactctcctagcgcgacagttgtgtccgctgttcagtcacgctgtaaaaccgcagcctccaggtctgggctgtctaaggccccttccagaaaaaagaaaggatctaaaggacccgtcattaagatcaccgaaatgagcgagaagtattttagtcaggagtcagaggtgtccgagtag

SEQ ID NO: 227695 - DNA, 1518 bp, Artificial Sequence
  Description of Artificial Sequence: Synthetic coding sequence
atgacttgtggctctggattcggaggtcgcgctttcagctgtatctccgcatgtggccctcgccctggacgctgttgcataaccgcagctccatatcggggaatttcatgttaccgcggactgactggagggtttggatctcatagcgtttgtggcggttttcgagccggatcttgtggcaggtcatttgggtaccgcagcggaggggtgtgtggcccttctcctccctgtataaccacagtctccgtgaatgagtctttattgacaccactgaatctggaaatagaccctaacgcccagtgtgtcaaacaggaggagaaggagcagatcaaaagcctaaattctagatttgcagcctttatcgataaggtaagatttctcgagcaacagaacaaactgcttgaaactaagcttcagttttaccaaaacagagagtgctgtcagtcaaaccttgagccactgtttgaaggatatatagagaccctgcgacgcgaagctgaatgtgtggaagccgatagcggcagacttgcgagcgagctcaatcatgtgcaggaagttttggagggctataaaaaaaagtacgaggaggaagtgtcgttacgtgccacagctgagaacgaattcgtggccctgaagaaggacgtagactgcgcatatcttagaaagagcgacctggaggccaacgtcgaagccttaattcaagaaatcgacttcttacgacggctgtatgaggaagagattctgattctccaatctcatatctctgacacaagcgtagtagtcaagttggataattctagggatctgaatatggactgcatcatcgcggagataaaagcgcaatatgatgatatagttacaaggagtcgcgcagaggccgaaagctggtatcgctcaaaatgcgaagaaatgaaggccactgtcatccggcatggggagactttgagaagaactaaggaagaaatcaatgagttgaaccgaatgatccaacgattaactgcagaggtggaaaacgctaagtgccagaatagtaagctggaagcagcagttgctcagagcgaacaacagggggaagccgctttaagcgacgctagatgcaagcttgctgagttagagggagcgctccagaaggcaaagcaggatatggcctgtctgataagagagtatcaggaggtgatgaactccaagttagggctcgatattgagattgccacgtatcgaaggctcctggagggagaggagcagcgcctttgcgagggtattggcgctgtgaacgtgtgcgtttcctcctctaggggtggtgtggtatgtggtgacctgtgtgtgagtggaagtagacctgttactggatccgtctgttctgcaccgtgtaatggaaacgtcgccgtgtctaccggtttgtgcgccccatgtggccagctaaacacaacctgcgggggtggctcctgtggcgtcggctcttgtggtatctctagcctgggagtgggtagttgtgggtcaagttgtcgtaaatgttag

SEQ ID NO: 227696 - DNA, 1455 bp, Artificial Sequence
  Description of Artificial Sequence: Synthetic coding sequence
atgacctgcggcagtggctttggcggacgggctttctcatgtatatccgcctgcggccctagacccggacgatgttgtattactgcagcgccttatagggggatttcttgctaccgcggactcactggaggcttcggctcccactctgtatgtggcggttttcgcgcaggcagttgtggcaggtctttcgggtacagatccgggggtgtttgcgggccatcacctccttgcattacaactgtgtcagtcaatgagagtctgctgacacccctaaatctggagatcgacccaaatgctcagtgcgttaaacaggaggagaaggagcagataaagagccttaatagtagatttgccgctttcatcgacaaagtgaggttcttagagcagcaaaataagctgctggagactaagttgcagttttaccagaatagagaatgctgtcagtcaaacctggagccccttttcgaaggctatatcgaaactctcaggcgagaagccgagtgtgtggaggctgatagtggcagattggcttccgaactgaatcacgtgcaggaggtgttagagggctacaaaaagaagtacgaggaggaggtgtcccttagggcaactgcggagaatgaattcgtagccttgaaaaaagatgtagattgcgcttatctgcgaaagtctgacttggaagcaaacgtagaggcccttatacaggagatcgactttctgagacgcctgtacgaggaggagattcttatcctacaaagtcatatcagcgatacctccgtagtggtgaaacttgataactctcgggatctgaacatggactgcatcattgcagaaattaaggcccagtatgatgacatagtcaccaggagccgagccgaagcagagagttggtacagaagcaagtgcgaggagatgaaggctaccgtgatcaggcacggagagaccctgagacggaccaaagaggagattaatgagttgaaccggatgatccaacggttgactgcagaggtagagaacgcgaagtgccagaactccaaattagaagcagcggtagcgcagagcgagcagcagggggaggccgctctcagcgacgctcgatgcaaattagcggagctagagggcgcattacagaaggcaaaacaggatatggcctgcctcatccgggaataccaagaagtaatgaacagcaaattgggactcgatatcgaaattgccacctaccgccgactgcttgaaggagaagagcagaggctctgtgagggcatcggcgctgtgaatgtctgcgtttccagttcccggggtggagtggtctgtggggatctctgcgtgagtggctctaggcctgtgaccgggagcgtgtgtagtgccccttgcaacggaaatgtagcagtctctaccggcctgtgtgctccatgcggacaagtgggatcttgcggaagtagctgccggaagtgttag

SEQ ID NO: 227697 - DNA, 1482 bp, Artificial Sequence
  Description of Artificial Sequence: Synthetic coding sequence
atgacttgtgggtttaacagtattgggtgcgggttccgtcccggaaatttctcatgcgtgagtgcgtgtggtcccaggccctcacgttgttgcattacagctgccccatacagaggcattagttgctatcggggattgactggcggatttggttcccactccgtctgcggaggcttcagagcagggagctgcggtcgcagcttcgggtatcgtagcggtggcgtgtgcggaccctccccaccctgcattacaaccgtgagtgtaaacgagagcttgctcacacctttaaacctggagatcgaccctaatgcccagtgcgtgaagcaggaagaaaaggagcagatcaaatcgctgaactctcgattcgccgcattcatagataaggtgaggttcctggagcagcagaacaagctgctggagaccaaactccagttctatcaaaatcgtgaatgctgccagagcaacctcgagcctctgtttgccggttacatcgagacactccgacgcgaagcagagtgcgttgaagcggacagcggcaggctcgcttctgagctgaaccacgtgcaggaagtgctggaaggctacaagaagaagtacgaggaggaagtggcactgcgagctacagccgaaaatgagtttgtggcactaaagaaggacgtcgattgcgcctacctacggaaatccgatctcgaagcaaacgtcgaagccctgatacaagaaattgacttccttaggcgcctctacgaagaagagattagaatcctccaatcccacatatcagacacaagtgtggtggtcaagctggacaatagccgcgatctgaacatggactgcattgtcgcagagataaaggcccagtacgatgacatcgccacccgcagccgcgcagaggctgaatcttggtatagaagcaaatgtgaagagatgaaagcaacagtgattcgccatggcgagacacttaggcgaaccaaagaggaaattaatgagttaaatagaatgattcagcgtttgaccgcagaggtggaaaacgctaaatgtcagaattccaaactagaagctgccgtggcccagtctgaacagcagggggaagccgcactgagtgacgcccgatgtaaactcgccgaactggagggagcactgcagaaggcgaaacaagacatggcctgcctgataagggaataccaggaagtcatgaactccaagctgggccttgatatagaaattgcaacctataggcgcctgttagaaggcgaagaacagaggctttgtgagggtgtggaagccgtgaacgtgtgcgtgtcttcctctaggggaggggtcgtgtgcggggatctctgtgtttccggtagccggcctgtgactggctccgtctgctccgcaccttgtaacggaaatttagtggtctctactgggctttgcaagccatgtggccagctgaacaccacttgcggcggtgggtcctgcgggcagggccgacattag

SEQ ID NO: 227698 - DNA, 1524 bp, Artificial Sequence
  Description of Artificial Sequence: Synthetic coding sequence
atgagttgtcgcagctaccggatcagttccgggtgcggtgtcacacgaaatttttcctcctgctctgcagtggcacccaagaccggtaaccggtgttgcatatcagctgcaccctatagaggagtgagctgctatcgtggccttaccgggtttgggtcccggtcattatgtaacctcggctcatgcggtcctcggatcgctgtgggcggtttcagggctggctcttgcggcagatctttcggataccgaagtggtggtgtgtgtgggcctagcccaccttgcataacaactgtatccgtgaacgagtcgctgcttacccccctcaatcttgaaatcgaccctaatgcccaatgcgtcaaacaggaggagaaggaacagatcaaatccctgaacagcaggttcgctgcttttattgacaaggtgagattcctggaacagcagaacaaactgctagagaccaagtggcagttttaccaaaaccagcgctgttgtgagtccaaccttgaacccttgttctctggctacattgagactctcaggagggaggctgaatgtgtagaagctgattcgggcagactcgcctcagagctgaaccatgttcaagaggtcctcgaggggtacaaaaagaaatacgaagaggaggtcgcattgagagcaaccgctgaaaacgaattcgtagtgctcaagaaggacgtagattgtgcttacctgaggaaatctgacttggaagccaatgtcgaggccctggtcgaggagtcaagctttctaaggcggttatatgaggaggaaattcgcgtccttcaggcccatatttctgatacgtcggtcatcgtgaagatggataatagtcgggatctgaatatggactgcattatagccgaaattaaagcgcaatatgatgatgtcgcttctcgttctagagccgaggcagaaagttggtatcggtctaagtgtgaggagatgaaagctacggttatccgacatggcgagacgctgcgaaggacaaaggaggagatcaatgaacttaatcgtatgatccagaggctgactgcagaaatagagaacgcaaagtgccagagagccaagttagaagccgcagtggctgaggcagaacaacaaggcgaggcagccctttctgatgctaggtgcaagctggcagagctggagggtgccttacagaaggccaaacaggatatggcttgtttattaaaggaataccaagaagtgatgaactcaaaattggggcttgacattgaaattgcgacctaccggcgactactggaaggcgaggagcaccggctgtgtgaaggcgtggggtctgtgaatgtgtgcgtctctagcagcagagggggagtgtcatgtggtggcttgtcttactcgactactcctggcaggcagatcacgtccggaccatcagctatcggcggatccattaccgtagtcgcaccagactcctgtgctccctgccagcctcggtcatcttccttctcatgcgggagctccagatccgttcggtttgcttag

SEQ ID NO: 227699 - DNA, 888 bp, Artificial Sequence
  Description of Artificial Sequence: Synthetic coding sequence
atggtcttcaaggtgcagttcctgtcctctcggccaagcctgagccacacacaagacgtcgattgcgcttatctccgtaagagcgatttggaagctaacgttgaggcgctcgtggaggagtcgtcttttctccggaggttatacgaggaagagatccgcgtgctgcaggctcacatcagcgatacatctgtgatcgttaaaatggacaactcacgcgatctgaacatggattgtatcatcgccgaaataaaggcgcaatatgacgatgtcgcctctcgttcacgggctgaggctgaatcctggtaccgctccaagtgcgaagaaatgaaggctacagtgattcgtcatggggaaactctgaggcgcaccaaggaggaaattaatgagttgaacagaatgattcagagattgactgctgagatcgagaacgccaaatgtcagcgtgctaagttggaggccgcagtcgcggaagccgagcagcagggtgaagctgccctgtccgatgctaggtgcaaacttgccgagttggaaggcgctttgcaaaaagcgaagcaggacatggcatgcttactgaaggaatatcaagaggtgatgaactcaaagttgggactcgacatagagatcgcaacgtatcgcaggcttctggaaggtgaggagcatcgcctctgcgagggcgtcgggtccgtgaacgtctgtgtgagctcaagtagaggcggagtatcatgcggcggactgagctactctaccacccctggaagacagataacgtcaggacctagcgccattggtggctcaatcaccgtcgtcgcccctgactcctgtgccccttgccagcccaggagctcgtcctttagctgtgggagttccaggagtgtgagattcgcctag

SEQ ID NO: 227700 - DNA, 1461 bp, Artificial Sequence
  Description of Artificial Sequence: Synthetic coding sequence
atgacatgtggcagctattgtggcggaagggccttcagctgtatctctgcctgcggaccccgtcccggtcgatgttgtatcaccgcggcaccttacagaggcatcagctgctataggggtctgactgggggtttcgggtctcactccgtgtgcgggggtttccgggcaggctcttgcggtcggtcttttggttacaggagcggcggagtttgtggtccttcacccccatgcattaccactgtaagtgtgaatgaatctctcctgacaccactgaatctggaaattgatcccaacgcccagtgcgtgaagcaagaagagaaagagcagatcaaatcacttaactcccgattcgcggcattcatagataaggtcaggtttttggagcagcagaataagcttctggagacaaaacttcagttctaccaaaatagagagtgctgtcaaagcaatctcgagcccctgttcgaggggtacattgagacattaaggagagaggctgaatgtgtggaagctgacagtggcaggctggcttcagagctgaaccacgttcaagaggtcctagaaggctataagaagaaatacgaagaagaagtatctctaagagcaacagccgaaaacgaattcgtggccctcaagaaggacgtcgactgtgcttatctgcgaaagtctgatttagaggctaacgtggaggctctgatccaggaaatcgatttcctccgacgcttgtacgaggaggaaatccgggtgctgcagtctcacattagtgatacgtcggttgtggtcaagcttgataacagtagagatctcaacatggattgtataatcgccgagatcaaagcacagtacgatgacatcgtgaccagatcgcgagcggaggcagaatcatggtatcgcagcaaatgcgaggagatgaaggcaacggtgatcaggcacggggagactctccggagaactaaggaagagatcaatgaactgaacaggatgatccagagactcactgccgaggtagaaaacgcgaagtgccagaatagcaaactcgaggcggctgtggctcagtcggagcaacagggcgaagccgcactgtctgatgctaggtgtaaactcgctgagttagaaggcgcactacagaaggccaagcaggatatggcatgtctgattcgagaataccaggaggtgatgaacagtaagctagggctggatatcgagatagcaacatacagacgcttactcgagggggaggagcagagactgtgcgaaggagtcggctccgtgaatgtttgtgtatccagctctagagggggagttgtttgcggagatttatgcgcgagcacaacagcccctgttgtttccaccagagtctcctccgtaccatcaaattctaacgtagtggtaggcacaaccaacgcttgtgccccttccgcaagggtaggggtgtgcggcggaagttgcaagagatgctag

SEQ ID NO: 227701 - DNA, 1872 bp, Artificial Sequence
  Description of Artificial Sequence: Synthetic coding sequence
atgagctgtaggcagttctcttcttcatatctgtcaagatctggagggggtggaggtgggggtctcggctccggcggatccattcgaagcagctacagcagattttcgagttctggaggaggcggtggagggggtcggtttagctcatcctctggctacggaggaggttcaagtagggtgtgcggtaggggaggcggaggttcatttgggtattcctatggaggcggttcagggggaggatttagcgcatctagcttgggaggcggtttcgggggagggtccagaggcttcggcggagctagtggcggaggatactcgagtagcgggggttttggcggaggatttggcggaggtagcgggggaggctttgggggtgggtatggatcaggtttcggtgggttcggaggattcggcggtggtgcaggaggtggcgacggaggcattctgacggctaacgaaaaatctacaatgcaagaacttaatagccgccttgccagttatctggacaaggttcaggcccttgaagaggcaaataacgatctggaaaataaaattcaggattggtatgacaaaaaagggcctgcggctatccagaaaaactactccccatattacaacacgatcgacgatctgaaagaccagattgtggatttaaccgttggcaacaacaaaacgctgctcgatatagataatactagaatgactttggatgactttcggataaaattcgagatggagcaaaacctgcggcagggggtggatgctgacatcaacggcttgcggcaggtgctagacaacctgactatggaaaagagcgacctagaaatgcagtacgagacgctgcaagaggagctgatggctctgaagaaaaaccacaaggaagagatgtctcaattgactggacagaactccggggacgtgaatgtggagattaacgtagccccagggaaggatctcacaaagacgctgaatgatatgcgtcaagagtatgaacagctcatcgctaagaacagaaaggatattgaaaaccagtatgaaactcagatcacacagattgaacacgaagtgtctagttctgggcaggaggtgcagtccagtgccaaggaggttactcagttgagacacggagtccaggagctggagatcgaactgcagtctcagctgtctaagaaggccgctcttgaaaagagcttagaagatactaaaaatcgctactgcggccagctgcagatgatccaagaacagatatctaatctggaggcgcagattaccgacgtgcgtcaggagattgaatgccagaatcaggagtacagtctgcttcttagcattaagatgaggctggagaaagaaattgagacctaccataacctactagaggggggacaggaagactttgaatctagtggggctggtaaaattggcctgggtggtcggggtggttccggcggatcttacgggagggggagtcggggtgggtcaggaggttcttacggtgggggtgggtccgggggtggctatggcggagggtctgggtctcggggtggttcaggaggatcatatggtggcggaagcggaagcgggggaggcagtgggggtggctacggaggcggaagtggtggcggtcactcggggggatcggggggaggtcacagcggcggatctgggggaaactatgggggaggaagcggatcaggcggtggctccggaggcggatatggcggaggctccggcagtcgcggaggcagtgggggatcccacgggggaggtagtggcttcgggggtgaaagcggagggagctacggaggcggtgaagaggcttccggctccggagggggatacgggggaggcagcggaaagtcctcccatagctag

SEQ ID NO: 227702 - DNA, 534 bp, Artificial Sequence
  Description of Artificial Sequence: Synthetic coding sequence
atggcgtgctgtcagacaagtttttgcggattcccctcatgtagcacatctggaacctgtggttcttcttgttgccaaccatcatgttgcgaaaccagtagctgtcagcccagatgctgtgaaacgtcctgttgccagccctcctgctgccagacgtcgttctgcggattcccttctttctcaaccggaggaacttgtgactcaagctgctgccagccgtcctgctgtgagacaagctgctgccagcctagctgctaccagacgtcctcttgtggaaccggatgtggcatcggtggtggtatcggatatggtcaagaggggagttccggggctgtgagcaccaggatacgctggtgtaggcccgactgtcgagtcgaaggtacctgcctccctccctgctgcgtggtcagttgcacccctccgtcctgttgccagctacaccacgctgaagccagctgctgtcgaccgagttactgtggacagtcttgttgtcgtccggtttgttgctgctattgttcagaacctacatgctag

SEQ ID NO: 227703 - DNA, 504 bp, Artificial Sequence
  Description of Artificial Sequence: Synthetic coding sequence
atggcctgttgtcaaacatccttttgcggattcccgagctgcagtacctctggcacgtgtggcagtagctgttgccagccgcgttgttgtgaaacaagttgttgtcagccctcctgctgtcagacaagcttctgcgggtttccgtcattttccactggtggtacgtgtgatagctcgtgttgccaaccaagctgttgcgagacatcatgctgccagccatcttgttaccagactagctcttgcggtacaggctgtggaataggcggtggcatcggttacggacaggaagggtcatcaggcgcagtgagtacccgaattcgatggtgtcgccctgactgtagagtggaaggaacgtgcttacctccttgctgtgtcgtgagctgtaccccacccagttgctgtcagctgcaccacgctgaggcctcgtgttgtcggcctagttattgtggacagtcctgctgccgacccgtctgctgctgctactgctcggagccaacgtgctag

SEQ ID NO: 227704 - DNA, 492 bp, Artificial Sequence
  Description of Artificial Sequence: Synthetic coding sequence
atgtcatttaattgttccacgcgaaactgtagcagcaggcccatcggcggtcgatgcatagtcccagtggcccaggtgacaaccacaagcaccaccgatgccgactgcctaggcggaatatgccttcccagcagcttccagacaggctcttggcttctcgaccattgtcaggagacctgttgcgagccgaccgcttgtcagcctacatgttatcggcgaactagttgcgtgtccaacccctgtcaggtgacctgttcacgccagactacctgcatatccaacccctgcagtactacttactcaaggcccctgacatttgtgagctctgggtgtcagcccctgggaggtatctcttccgtctgccagcctgtcggtggaatcagtaccgtatgccagcccgtggggggagtctctacagtatgccagccagcttgcggcgtgagccgtacgtaccagcagtcttgcgtcagctcttgcaggagaacgtgctag

SEQ ID NO: 227705 - DNA, 504 bp, Artificial Sequence
  Description of Artificial Sequence: Synthetic coding sequence
atgacctgctgtcagacatcattttgtggctatccaagttgttcaacctcaggaacctgcgggtcctcctgctgccagcctagctgttgtgagacctcatgctgtcaaccatcctgctgccagacctcattctgtggattcccaagttttagcacttcaggcacgtgcagctccagctgttgccagccatcttgctgtgagacaagttgctgccagccaagttgttgccagaccagttcttgcggaactggatgcggtattgggggaggcatcggctacggtcaggaaggctcttccggtgccgtctctacccgtatccggtggtgccgtcccgactgtagagtcgaggggacctgcctcccgccttgctgtgtagtgtcttgtacaccccctacctgttgtcagctgcatcacgctgaagccagctgctgccgaccgtcctattgcgggcaatcatgttgccgcccagtttgctgctgttactcctgcgaacctacctgttag

SEQ ID NO: 227706 - DNA, 366 bp, Artificial Sequence
  Description of Artificial Sequence: Synthetic coding sequence
atggcatcctgttctacgtctggtacttgcggcagttcatgctgccagccatcctgctgtgaaacatcatgttgtcagccatcttgttgtcaaacatcatcttgtggcacaggctgcggaattgggggtggaattggttatggccaggaaggcagcggcggttccgtaagcacacgcatacgctggtgccaccccgattgtcacgtcgaggggacctgcctcccaccctgttacctggtgagttgtactccccctagctgctgccagctccaccacgccgaagcttcgtgctgccgcccatcgtactgtggacagagctgttgtaggccagcttgctgttgccactgttgtgagcctacctgctag

SEQ ID NO: 227707 - DNA, 837 bp, Artificial Sequence
  Description of Artificial Sequence: Synthetic coding sequence
atgggttgttgtggatgttcgggtggatgcgggtcaagctgcggcggttgcggctcagggtgcggaggatgcggctcaggttgtggaggctgcggttctggctgcggaggctctggttcctcatgttgcgtgcccgtgtgttgctgtaaaccagtgtgttgtagagtaccaacctgctcatgttcatcttgtggtaagggcggatgcggctcaagtggcggtagcaagggagggtgcggatcttgtggcggatgcaaaggaggatgtgggtcctgcggtggatccaaagggggatgcggtagctgtggagggtcgaagggcggatgtggctcatgtggaggttcaaagggagggtgcggctccggatgtggcggatgcgggagttcgtgctgcgtaccagtgtgctgctgtaagcccatgtgctgttgcgtgccagcctgctcctgttcaagttgtggcaaaggcggatgtgggagctgtggatgttcaaagggtgcctgcggaagctgtggcggttcaaaggggggatgcggctcttgtgggggatgtaagggtggctgcggctcgtgcgggggatcaaaaggcggttgtggcagcggatgcgggggttgcggttccggctgcggggtaccagtttgttgttgcagctgcagtagttgtggaagctgtgccggtagcaaggggggttgcgggagctcctgctcacagtgttcttgctgtaaaccgtgctgctgctcttcaggatgtgggtcctcttgttgtcaaagcagctgctgtaagccttgctgttctcaatcaagttgttgtgtcccagtgtgttgtcaatgtaaaatatag

SEQ ID NO: 227708 - DNA, 510 bp, Artificial Sequence
  Description of Artificial Sequence: Synthetic coding sequence
atgggctgttgcggctgttctggaggctgcggcagcagctgcggaggatgtgattcaagttgtggctcatgcggatcaggctgcagaggatgcggcccatcttgctgcgcccctgtgtactgttgtaaacccgtgtgttgttgcgtccccgcatgtagctgtagcagttgcggaaaacgcggatgcggttcttgcggaggctcgaagggcggttgtgggtcgtgcggctgctcccaatgttcatgctgcaagccctgttgctgctccagcgggtgcggcagctcttgttgccagtgttcctgttgtaagccttattgttcgcaatgcagctgttgcaaaccctgctgctcttcctccgggagaggttcatcatgttgccaatcttcttgttgtaagccttgttgtagcagttccggctgtggctcctcttgttgtcagtctagttgttgcaagccatgctgcagccagtcccgttgctgcgtcccagtttgctatcagtgcaaaatttag

SEQ ID NO: 227709 - DNA, 1740 bp, Artificial Sequence
  Description of Artificial Sequence: Synthetic coding sequence
atgtgtgatcagcagcagattcagtgtaggctcccactgcagcagtgttgtgtgaagggaccgagcttctgttcctcccagtccccgttcgctcagtcccaagtcgtggtgcaggccccttgtgagatgcagatagtggattgccccgcttcttgcccggtgcaggtttgccaagtgagtgatcaggccccatgtcagtctcagaccacacaggttaagtgccagagcaagaccaaacaagtcaagggccaggctcagtgtcagagtaagacaactcaggtcaaaggtcaagctgcatcgcagtctcagacctcttctgtacagtcccaagctccctgtcaatccgaggtgtcctacgtgcagtgcgaggcttcgcagcctgttcagacttgcttcgtcgagtgcgccccagtctgttatactgaaacctgctatgtggagtgcccggtgcagaactatgtcccctgtccagctcctcagcctgtccagatgtataggggccgaccagccgtgtgccagccgcagggtcgcttttctactcaatgccagtaccagggctcctactctagttgcgggcctcagtttcagagccgcgcaacctgcaacaactatacccctcagttccagctcaggccatcttatagctcctgcttccctcagtaccgctctcggacaagttttagcccttgcgtgcctcagtgtcagacccaaggctcatatggttctttcaccgagcagcatcggtcccggagcacgagccggtgcctacccccaccccgacgcttgcagttgttccccagatcctgttctccgcctcgtaggtttgaaccctgttcgtcttcttacctgcctctgaggcctagcgagggcttccccaattattgcactccccctcgcaggagtgagccgatttataacagcaggtgcccacggagacccatctcctcttgcagccagcggagaggcccaaaatgtaggatcgaaattagctctccatgttgccctagacaggtgcccccacagagatgccccgtggagattccgccaatcaggcgccgttcgcagtcctgtgggccacagccttcgtggggagccagctgccccgaactgagaccacacgtggagccgaggcccctgccgagcttttgtcctccaaggagattagatcagtgccctgagtctccacttcaacgttgtccacctccagcccctcgccctcgcctgcggcctgagccctgtatcagtttggagcccaggcctcgccctctaccccgtcagctctcggagccctgcctctaccctgaacccctgcccgctctgagaccgaccccacgccctgtgccgttacctcgtcctgggcagtgtgagatccccgagcctcggccatgtctacagccatgtgagcaccccgaaccgtgtccacggcctgagccaatcccacttccggcaccttgcccttctcctgaaccctgtagggagacctggaggagccccagtccctgctgggggccaaatcctgtgccctacccaggtgatctggggtgtcacgaatcttcaccacataggctggatactgaggccccttattgcggaccttcctcatacaatcaagggcaggaatccggtgctgggtgtgggcctggcgacgtctttcccgaacgccgtgggcaggacgggcacggcgaccaggggaatgcctttgctggagtgaagggagaagcaaagtccgcctacttctag

SEQ ID NO: 227710 - DNA, 1059 bp, Artificial Sequence
  Description of Artificial Sequence: Synthetic coding sequence
atggcgggaaccatttgtttcatcatgtgggtgttatttattacagataccgtgtggagtagatccgtaagacaggtgtatgaagtgcacgattcagacgattggactatccacgactttgagtgccctatggaatgcttttgtcccccatccttccctacagctctgtattgcgaaaatcggggactgaaggaaattccggcaataccctcccggatctggtatctctatctgcaaaacaatctgatcgagaccatacccgaaaaaccctttgaaaacgctacccaactgcgctggatcaacctaaataagaataagataaccaactatggcatcgaaaagggcgctttgtcacaactgaaaaaactgctgttcctatttctagaagacaacgagttggaggaggtcccaagcccactgcctcggtctctggagcagctgcagctggctcggaacaaagtctctcgcatcccgcagggcaccttcagcaatttggagaatctgacattgctcgatcttcaaaataataaattagtagataacgcctttcagagagacacctttaagggactcaagaacctcatgcagctcaacatggcaaaaaatgctttgcgaaacatgccacctagactccctgccaatactatgcagttattcctggataataactcgattgaaggtatacccgagaattacttcaatgtcattcccaaggtcgccttcctgaggctcaaccacaataagctctcagatgaagggctgccttcccgcggatttgatgttagctcaatattggatctccaactgagccataatcagctaacaaaggtgcccaggatcagcgcacacctccagcacctgcacttggatcacaataagatcaaaagtgtgaacgtgtccgtcatatgccccagccccagcatgcttcccgcagagcgggacagcttctcctatggaccccacctgcgttatctgcgtctggacggaaacgaaatcaaaccacctattcctatggccttaatgacgtgttttcgattgcttcaggctgtgataatttag

SEQ ID NO: 227711 - DNA, 897 bp, Artificial Sequence
  Description of Artificial Sequence: Synthetic coding sequence
atggaagaaaagcaaattctgtgcgttgggctggtagtgctcgatgtaataagcctggtagataagtaccccaaagaagatagtgaaattcggtgtctcagtcaaagatggcagcgagggggaaacgctagcaactcctgcacagtgctgtctctccttggtgcaccctgcgcctttatgggatccatggcccctggacatgtggctgattttcttgtggctgactttagaagacgcggtgttgacgtatcccaggttgcctggcagtccaagggagacacaccctcttcctgttgcattatcaataactctaatggaaaccggacaatcgtactacatgacacttcactcccagatgtaagcgctaccgatttcgagaaggtcgacttgactcagttcaaatggattcacatcgaggggaggaacgcttctgaacaagtgaaaatgctgcaaagaattgatgcccacaacacgaggcaacctccagaacagaagatcagagtgtctgtggaagtggagaagccacgtgaggaactttttcagctcttcggttatggggatgtggtgttcgtgagcaaagatgtggccaagcacctggggttccaaagtgctgaggaagctctgcggggattgtacggtagagtgcggaaaggggcagtgctggtgtgtgcctgggccgaagagggcgcagacgcactgggtccggacggcaaactgctgcactctgatgccttcccaccgcctcgcgtcgtggacaccttgggtgctggggatacctttaatgcctccgtgatcttcagcctgtctcagggccgaagcgtacaagaggctctgcgtttcgggtgtcaagtcgcaggaaagaagtgtggcctgcagggattcgacggaatagtatag

SEQ ID NO: 227712 - DNA, 897 bp, Artificial Sequence
  Description of Artificial Sequence: Synthetic coding sequence
atggaggagaaacagattttatgcgttggactggtggtgctggacgtgatcagcttggttgataagtaccctaaagaggatagcgaaatccgatgtctgtcccagaggtggcaacggggaggaaacgcatcgaacagctgcaccgtcctgtcactcttgggcgctccttgtgcttttatgggcagcatggctcccggacacgtggccgacttcgtcttagacgacctgcgcaggtacagtgtggaccttaggtatacggtgttccagacaaccggctctgttcctatcgctactgtgattataaacgaggctagcgggtcccgcaccattctgtattacgacaggtcattgccagatgtttccgctacagactttgagaaagtggacctcactcaattcaaatggatccatatcgagggtaggaatgcttccgaacaggtcaagatgttacaaaggatcgatgcccataacaccaggcagccgccagaacagaaaatcagagtgagtgtggaggtggaaaaaccccgagaggagctatttcaattatttggatacggagatgtggttttcgtatctaaggatgtcgccaaacacttgggcttccagagtgcagaggaggctctcaggggcctgtacgggagggttagaaaaggggctgtcctcgtctgcgcctgggccgaggaaggagcggacgcactgggtcccgatggcaaacttttgcattcggacgcttttccacctccgagagtagtcgacactctgggagccggagacacctttaacgcatcagttattttttctctctcccagggccgttcagtgcaggaggcacttcgatttgggtgtcaagtggccggaaaaaagtgtggcttgcagggtttcgacggcatcgtctag

SEQ ID NO: 227713 - DNA, 1041 bp, Artificial Sequence
  Description of Artificial Sequence: Synthetic coding sequence
atggaggaaaagtacctacctgagctgatggcggagaaggactccctagacccatcatttacccacgcattgaggcttgtgaatcaggagattgagaaattccaaaaaggagaggggaaggacgaagagaagtacattgacgtggtgattaacaaaaatatgaagctggggcaaaaagtcctgataccagtgaagcaatttcccaaatttaacttcgtgggcaagctccttgggccacggggaaatagtctaaagcggttgcaggaagagacacttacaaaaatgtcaatattgggtaaaggttccatgagggataaggccaaggaggaggagctgagaaaatcaggggaagccaagtatttccatctcaacgacgacttgcacgtgctgatcgaggtgtttgctccacctgcagaggcatacgctcgaatgggacatgctctggaggaaataaaaaaattcttgattcctgactacaacgatgagattcgccaagcacagctccaggagctgacctaccttaacggagggagtgagaacgctgacgtaccggtggtgagaggcaaaccaaccctccgcactcgaggggtgcccgcaccggcaatcacacgcggtagggggggtgtcactgctagaccagtcggcgtggttgtgccaagaggcacaccaacccccaggggcgtactgtcgacacgcggtcccgtgagccggggtcggggactcttgaccccacgggcacggggtgtgccccctaccggttatcgcccacctccgcctcctccaacccaggagacttacggggagtacgattacgacgacgggtacggtactgcttatgacgaacaatcgtacgactcatatgataattcttatagtacacccgcacagtccggcgcagactactacgattatgggcacggactgagtgaagagacttatgacagctatggccaggaggagtggacaaactcgcgtcacaaggctccctctgccaggactgcaaaaggtgtctatcgtgatcagccttacggacgctactag

SEQ ID NO: 227714 - DNA, 495 bp, Artificial Sequence
  Description of Artificial Sequence: Synthetic coding sequence
atggacatggggaccagcgcattgagcaagaagccatggtggactttgccccaaaacttccatgctcctatggtgtttcatatggaggaagatcaagaagagttaattttcggacatggcgatacctatctgcgttgtatagaagtccattcccacaccctgatccagctggaatcttggttcaccgccactggtcagaccagggtgacagtcgtggggccacatagagccaggcagtggcttctacacatgttttgctgtgtggggtctcaggactcctaccaccatgcgcgtggtttggagatgcttgaaagagtcagatcccagccccttaccaatgatgatctggttacttctataagtgtgccaccatataccggtgacttgtccttggccccacgtatctcaggcacagtgtgcctcagtgtccctcagccaagcccataccaggtgatcgggtgttctggctttcacctttccagtctttacccctag

SEQ ID NO: 227715 - DNA, 714 bp, Artificial Sequence
  Description of Artificial Sequence: Synthetic coding sequence
atgttgtccgctttccagcggctgtttagagtactctttgtgatcgagacagtttccgaatacggagtgctgattttcatttatggatggccattcttacaaactctcgccatgctgctgatcggcaccgtgtctttccatctgtggattcggaggaatagggaacgcaattcccggtctggaaagactcgatgtagatcgaagcgctctgaacagagcatggacatggggacatcggcccttagcaagaaaccctggtggacactgccgcaaaacttccacgccccaatggttttccacatggaggaggaccaggaggaactcatttttggccacggtgatacctacctgagatgtatagaggtgcactcacacactttgatacagttagaaagctggttcactgcgacaggtcagactcgggtgacagtagtagggccacatagggccagacagtggctgctccatatgttttgttgcgtgggatcgcaggatagttaccaccacgcgcgaggactggaaatgctggagcgggtaagaagccagcccctgacgaacgacgacctagtcaccagcatctctgtcccaccgtacaccggggacctcagtctagcgccaagaattagcggaaccgtgtgtcttagtgtgccccagcccagcccatatcaagttatcggctgtagcggttttcatctgagttctctttatccatag

SEQ ID NO: 227716 - DNA, 297 bp, Artificial Sequence
  Description of Artificial Sequence: Synthetic coding sequence
atggacatggggacatctgcactgagcaagaagccctggtggacactgccccagaattttcacgccccaatggtgttccatatggaagaagatcaggaggaattgatattcggtcacggagacacctatctcaggtgcattgaagttcattcccataccctgattcaactggaaagctggtttaccgccacaggacagacgcgggttaccgtggtggggccacatcgagctcgacagtggctgctgcacatgttttgctgcgtggggagccaggactcttaccaccacgctagatag

SEQ ID NO: 227717 - DNA, 2133 bp, Artificial Sequence
  Description of Artificial Sequence: Synthetic coding sequence
atgtccgactatagcaccggaggcccaccacctggcccacccccaccagccggtggcggaggaggagccggtggcgcagggggagggccaccacctggcccaccaggggctggggatagggggggtggtggcccaggcggtgggggaccagggggaggttccgccggaggaccctcccagcccccaggaggtggtggcccagggatccgcaaagacgcctttgctgacgccgttcagcgggctaggcagatcgctgctaaaatcggcggtgatgccgctaccacagtgaacaatagtacacccgacttcgggttcggcggtcagaaaaggcagctggaggacggagatcagcctgagagcaagaagctggctagtcagggagatagcatcagctcacaactggggcctattcatccacctccacgcacttcaatgaccgaggagtatcgggtgcctgatgggatggttggcctgatcatagggcgagggggagagcaaatcaacaagattcaacaggactcagggtgtaaggttcagataagcccagactctgggggtttacccgagagaagtgtgagtctcacaggggcacctgagtccgtgcagaaggcgaaaatgatgctagacgacattgtatcaagaggacgcggtggtcctcctggacaatttcatgataatgcgaacggcggtcagaacgggactgtgcaggaaataatgattccagccggtaaagcgggacttgtgatcggcaagggcggtgagactataaagcagcttcaggagagagccggagtcaagatgattctgatacaagacgggtcccagaacacaaacgtggataagccactaaggatcatcggagatccttacaaagtgcagcaggcttgcgaaatggttatggacattcttcgcgagcgggaccagggtggtttcggagatagaaacgaatacggatcaagaatcggcggtggcattgatgtgccagttccccgacatagtgtcggagtggtaattgggagatccggggagatgatcaaaaagattcagaacgatgccggtgtccgtattcaatttaaacaagatgatggcacggggccagaaaagattgctcacatcatggggcctcccgacaggtgcgagcacgcagctcggataattaacgacctcctgcagtccctccgttctgggcctcctggccctcccggtggacccggaatgccgccaggcggacggggaagaggaagggggcaaggtaactgggggccacctggcggagagatgacgttctccatacccacccacaagtgcggtctggtcattggtagggggggagagaacgtgaaggccatcaatcagcagacaggcgcattcgttgagatcagcaggcagttgccacctaatggagacccaaatttcaaactcttcatcatccgaggttcccctcagcagatcgaccatgccaagcaactgatcgaggaaaaaatagaagggcctctgtgtcccgttggaccaggaccagggggacccggtcccgctggccctatggggcctttcaatcccggaccgtttaatcagggcccacctggcgcaccccctcatgccggagggcctccacctcaccaatacccccctcagggctgggggaatacttaccctcagtggcagccccctgcgcctcacgatccttccaaggccgcagctgctgccgcagaccccaacgccgcttgggctgcctactactcccactattaccagcaacccccaggccctgtgcctgggccagcacctgcgcctgctgctccaccagcgcaaggcgagcctccacaacctccacctacgggtcagagcgactatactaaggcttgggaggaatactataaaaagattgggcaacagcctcagcagcctggcgctcctccacagcaggactacaccaaggcttgggaagaatactacaagaagcaagctcaagtggccactggcggaggtccaggcgcacccccagggtttctggcacccccaacggttttccagcctctcctcagttctgctctggcccagcttcccaggcctagaccttccccgcttcccggactggtttgctgcttgttcatctgtagccgcggagactag

SEQ ID NO: 227718 - DNA, 2136 bp, Artificial Sequence
  Description of Artificial Sequence: Synthetic coding sequence
atgtcagactatagcactggagggcctcccccaggaccaccgccacccgctggagggggaggtggagctggaggagctggcggaggaccaccacctggccctccaggagcaggcgacagggggggtgggggtccgggaggaggaggacccggaggaggatctgctggcggtccatctcaacctcctggaggaggcggaccagggattagaaaagacgctttcgcggatgcagtgcaacgagccagacaaattgcagctaagattggaggcgacgctgcaacaacagtgaataactcaacccctgatttcggctttgggggacagaaacggcaattagaggatggtgaccaaccagagagcaagaagttggcttctcaaggtgactccatttcaagccagttgggtccaattcaccctccccctcgaacgtcaatgacagaagagtatcgcgtccccgatgggatggtgggactgatcatcggtcggggaggcgagcaaataaataagattcagcaggactccggctgcaaagtccaaatatcccccgattcagggggactgcccgagagaagtgtgagtctcacaggagcaccagagtctgtgcagaaggcaaaaatgatgttggatgatattgtctctagaggtcgcggaggccctcccggtcagttccacgacaacgccaatggaggccagaacggcactgtgcaagaaataatgatccctgcaggaaaagctggacttgtaattggcaagggaggcgagaccatcaaacaactccaggagagagccggagtcaaaatgatcttaatacaggacggcagccagaacaccaacgttgacaaacccctccgcatcattggcgatccatataaagtccaacaggcatgtgaaatggtaatggatatactcagggagagggatcaaggaggctttggggacaggaatgaatacggctcacggattggcggtggtatcgatgtgcccgtgccccgacactcagtcggtgtcgtgatcgggagatctggcgaaatgatcaaaaaaatccagaacgacgcaggcgtccgcattcagtttaagcaagacgacgggaccggaccagaaaagattgctcatatcatggggccacccgaccggtgtgaacacgccgcacgaattattaacgatttacttcagtctctcaggtctggcccacctgggcctcctggcggtccgggaatgccgcctggtggcaggggccgtgggcgtggccagggtaattgggggcctccaggaggggaaatgaccttttcgatacccacacataaatgtgggctagtcatcggtcgcggaggagagaacgtgaaggcgattaatcagcagacaggggctttcgtggagattagcaggcagctgcctcctaacggggaccccaatttcaagctatttatcatccgaggctcaccacaacaaatagaccacgccaagcagcttatagaagaaaagatcgaggggccactttgcccagtgggtccaggccctgggggacctggacctgctggcccaatgggacctttcaaccccggaccgttcaaccagggtcctccaggggcacctccccatgccggaggccctccacctcatcaatacccacctcaggggtggggcaatacctaccctcaatggcagcccccagcaccgcacgacccctccaaggccgctgccgcagctgctgacccaaacgctgcttgggctgcttattactcccattattatcaacagcctcctggtccggtgcccggacccgcacctgctccagccgctcccccagcccagggagaacctccgcagccaccacccaccggacagagtgattacacaaaggcctgggaggagtactataagaagattggccagcagccccaacaacccggagcccctcctcaacaggactataccaaggcatgggaggagtactacaagaagcaagcgcaggtagctaccggtggcggaccgggagctcctccgggaagccagcccgattatagtgcggcttgggctgagtactaccggcagcaagctgcctactatggacagacacctgggccagggggaccacagccccctccaacacagcaaggccagcaacaagcccagtag

SEQ ID NO: 227719 - DNA, 1095 bp, Artificial Sequence
  Description of Artificial Sequence: Synthetic coding sequence
atgtccgactacagtcccggtgggggtagcgccggagggcctagccagccacccggaggcggaggcccaggaattagaaaagatgcgttcgccgatgccgttcagagggctaggcagatagctgccaagattggcggtgacgctgccactacagtgaataattcaactccggacttcggatttggtgggcagaaacgacagctggaggatggcgaccagcctgaatctaagaagcttgccagccaaggggactcaattagctctcagttaggcccaattcaccctccccctcgcacatcaatgaccgaggaatatagagttcccgacgggatggtcggcctgattatcggtcggggtggggaacagataaacaaaattcagcaggattctggatgcaaggtgcaaatcagccccgatagcggtggcctacctgagcggagcgttagccttaccggtgcacctgaatcagtccagaaggctaaaatgatgctcgatgacattgtgtcgaggggtcggggaggacctcccggacaatttcacgataatgcaaacggtggacaaaacggcaccgtgcaagaaattatgatccccgcagggaaagcaggcctcgtcattggtaaaggaggagagacaattaaacagttgcaagaacgagctggagtgaagatgatattgattcaggacggaagccaaaataccaatgtggataaacctttgcggataatcggcgatccttataaagtccagcaggcttgtgaaatggtgatggacattctcagagaaagagaccaggggggattcggtgatcgaaatgaatacgggtctagaatcggtgggggaatcgacgtgcctgttcccagacacagcgtaggcgtcgttattggaagaagtggagagatgataaagaaaattcagaacgacgctggagttagaatacagttcaagcaagatgacggcaccgggcctgagaagatagcccacataatggggcctccagacagatgtgaacacgccgctagaatcattaacgatccaagtagctctagctttcttctccccactccgggacatcgcccttcttgcctgtcaggatag

SEQ ID NO: 227720 - DNA, 255 bp, Artificial Sequence
  Description of Artificial Sequence: Synthetic coding sequence
atggatgacgatgccgcaccaagggttgagggagtcccggtcgccgtgcacaagcacgccctgcacgacggccttaggcaggtggccggtcccggagccgctgcagcccacttgcctaggtggccgccaccccagctggccgcatcaagacgcgaagctccaccgttaagtcaaaggccgcaccgaactcaaggcgcagggtctccgccagagaccaatgaaaagctgaccaaccctcaggtgaaggagaaatag

SEQ ID NO: 227721 - DNA, 822 bp, Artificial Sequence
  Description of Artificial Sequence: Synthetic coding sequence
atgagtatgagccctactgtgatcatcctggcttgtttgggcttcttcctggaccagtcggtttgggcccacgtaggtggccaagataagccgttttgctcggcctggccatctgccgtagttccccaaggtgggcatgtgacattgaggtgccactatcgaagaggattcaacatcttcacactctacaaaaaagatggggtgccggtaccggaattgtacaaccgaatcttttggaattcctttcttattagccccgtgacccccgcacatgccggaacatacagatgccgcggttttcaccctcactccccaacagagtggtccgccccttctaaccctctcgttattatggtcactgggctttacgaaaagccatctctgactgcacgaccagggcctactgttagagcgggtgaaaacgtgacactctcttgctctagccagtcctcgttcgacatttatcacttgagccgggagggagaggcacacgaactacgtttgccagctgtgccatcaatcaatggtacctttcaggcagatttcccactgggtccagctactcacggcgagacatatagatgcttcgggagcttccacggaagcccctatgaatggtcagacccgagcgatcctttacctgtaagcgtgactggaaatccatcaagcagctggccttctcctacagagcccagtttcaaaaccggtatcgcgcgacacttgcacgcagtcattcgttactcagttgctataattctgttcaccatattgcctttcttcctgctgcaccgatggtgctccaaaaaaaaaatgctcctgtag

SEQ ID NO: 227722 - DNA, 1269 bp, Artificial Sequence
  Description of Artificial Sequence: Synthetic coding sequence
atggggggtcaggataaacccttcctgtcggcttggccttctgcggttgtacctcgaggtggccacgtgactttgaggtgccattaccgacatcggtttaacaattttatgctgtataaagaggatagaattcatatcccgatctttcacggccgaattttccaggagtctttcaatatgagccctgtcacaactgctcatgctgggaattatacctgcaggggctcacatccgcactcccccacaggctggtctgcaccttctaaccctgtcgtgattatggtgaccgggaatcaccggaagccctccctgctggctcatccagggccactggtgaagtcaggggaaagagtaatcctgcagtgctggagcgatattatgttcgaacattttttcctgcataaagagggaattagtaaggatccatctaggctggtgggccagatccacgatggggtcagtaaggccaacttcagtatcgggcctatgatgctggccctggctggcacctaccggtgttacgggagcgtgacacataccccataccaactcagcgccccttcagaccccttagatatcgtcgtgactggaccatacgagaagccatcgcttagcgcacagccgggacccaaggttcaggccggagaatcagtcaccctctcctgttctagccgaagttcctacgacatgtaccatctgagcagggaaggaggtgcccacgaaaggaggctccctgcagtgaggaaagtcaatcgaactttccaagctgacttcccactcggcccagccacccacgggggaacttaccgatgtttcgggtcatttaggcatagtccctatgagtggtcagatccttcagaccccctcctggtgagcgtcacggggaatccctccagctcgtggccctccccgacagagccatcttctaagagtgggaacccgcgtcacctgcacattcttattggcacatcagtggttataatcctctttattctgttgctttttttcctcctgcacttgtggtgcagcaacaagaagaatgccgctgtgatggatcaggagccggctggcaataggacggctaatagcgaggactctgatgaacaggacccggaggaggtcacgtatgcgcagctcgatcattgcgtctttacacagaggaaaattacgcgcccttcccagcggccaaaaacaccaccaaccgacacgattctttacacagaactgcctaacgccaagcccagaagcaaggtggtgtcttgtccatag

SEQ ID NO: 227723 - DNA, 1050 bp, Artificial Sequence
  Description of Artificial Sequence: Synthetic coding sequence
atgtcacttatggtagtgagcatggcgtgcgtgggactgtttctcgtgcagagggccggtcctcacatgggaaatcatcgcaagccaagccttctggcacaccccggtcctcttgtcaaatcaggtgagagggtcatcctgcagtgctggtcggacatcatgtttgagcactttttcctgcataaggaaggtatcagcaaggaccccagccggctggtgggacagattcatgacggcgtcagtaaggcgaattttagcataggaccaatgatgctcgctctcgcaggcacataccggtgttatggttctgtcactcataccccgtaccagctctccgctcctagcgatccactagacatagtcgttacggggccatatgagaaaccttcactctccgcccagcctggcccaaaagtacaggctggagagtctgtgacgttgtcttgtagttcgcggtccagttacgatatgtaccatctgtccagggaaggaggagcacacgagcgacgcttgcccgcagtcaggaaggtgaatcggacttttcaggccgattttcctcttggaccggcaacgcatggaggaacctatcggtgctttggttccttcagacacagtccttacgaatggtcggatccaagcgacccactcctcgtgtccgtcacgggcaatcccagcagctcttggccaagcccaacagagccatcctctaagtctggcaatccacgacatctccacattctcatcggcacatccgtggtgatcatcctgttcatactactcctcttcttcttgttgcacctgtggtgctctaataaaaaaaacgccgcagttatggatcaggaaccagctgggaacagaacggccaattctgaggactcggacgagcaggatccagaggaggtgacgtatgcgcagctggatcactgtgtgtttactcaacgtaaaattacccgcccttcccagcgtcccaagactcccccaacagacacaattctgtataccgaactgccaaatgcaaagccgagatctaaagtggtttcatgtccatag

SEQ ID NO: 227724 - DNA, 1335 bp, Artificial Sequence
  Description of Artificial Sequence: Synthetic coding sequence
atgtccttgatggtggtttcgatggcttgcgttggactgtttttagtacaacgggctggaccgcacatgggaggacaggataagcccttcctgtccgcgtggccttctgcggtcgtacccagggggggacacgtcacactgagatgtcattatagacaccgctttaataacttcatgctgtataaagaggatcgcatacacatccctattttccatggcagaatatttcaggaatccttcaacatgtctcctgtgacgactgcccacgcaggcaactacacttgccgaggaagccacccccactcacccacaggctggagtgcgcctagtaacccggttgtgatcatggtaactggcaaccaccgcaagccatctctgctggctcacccaggtcccctcgtgaaaagtggggagagagtgatactgcagtgttggtcagacatcatgtttgagcacttttttctgcacaaggagggaattagcaaagacccatcaaggttggtaggacagatccacgacggggtctccaaggcgaattttagtattggcccaatgatgcttgctttggcagggacctacagatgttatggctctgttacccacaccccctaccaactgtctgctcccagcgaccctctggacatagtcgtgaccgggccatacgagaaaccctcgctctcagcacaacctggaccgaaagtccaggccggagagagtgtcacgctgagttgtagctctcgcagcagttatgacatgtaccacttgtcaagagaagggggtgctcatgaacgcagactacccgcagtacgcaaagtcaatagaacattccaggctgacttccccctaggacctgctactcatggcggtacttatcgctgttttggatcctttaggcactctccatacgagtggagcgaccctagcgacccgctgttggtgagtgtgacaggcaatcccagctcatcttggcccagtcctaccgaaccaagctctaagtctggcaacccaaggcatctgcatattcttattggtacaagtgtggtcattatactatttattcttttactgttttttctgctgcacttgtggtgctctaataagaagaacgcagctgtcatggatcaggagcccgcagggaataggacagccaacagcgaggattctgatgagcaggatccagaggaggtgacgtatgcccaactcgaccactgtgttttcacgcagcgcaagattacaagaccatcccagagacctaagacaccacctaccgacaccattctatataccgagttacccaacgcgaaacctcggtccaaggtggtcagctgtccgtag

SEQ ID NO: 227725 - DNA, 1368 bp, Artificial Sequence
  Description of Artificial Sequence: Synthetic coding sequence
atgagcctcatggtggtgagcatggcttgtgtcgggctctttctcgtgcagcgggctggaccccatatgggaggtcaggataagcccttcttgtctgcgtggccctcagctgttgttccacgtggaggccacgtgacccttcggtgtcattacaggcacagatttaacaactttatgctgtataaagaggaccgtattcacattcccattttccacgggaggatattccaagagtccttcaatatgagtccggtgaccacggcgcacgctggcaactacacttgtcgcggttcccatccccacagtccaactggatggagcgctccttctaatccagtagtgataatggtgacaggaaaccacaggaagccctccctgctggctcacccaggcccattggtcaagagcggagagagggttatactccagtgttggtccgacattatgtttgagcatttctttttacacaaagaagggatttcaaaggatccgtctcgactcgtagggcagatccatgacggggtgtccaaagccaacttcagcattggcccaatgatgcttgcgctggccggtacttacaggtgctacggttctgtgactcacaccccgtatcaactgagcgccccatctgaccctcttgacatcgtcgtgaccggaccatatgagaagccatcactcagtgcgcagcctggaccaaaggtgcaggccggtgaaagcgttactctgagctgctcttctcgctcatcctatgatatgtatcacctctctcgggagggcggagcccatgaacgtcgtcttccagcagtaaggaaggtcaatagaaccttccaagcagatttccctttggggcctgccacgcacggaggaacctaccgctgctttggttcttttcgtcacagcccttatgagtggagcgatccctcagaccctctgctggtatccgtcactgggaacccaagctcctcctggccgagtcctacggagcccagttccaaatccggtatctgccgtcatctgcacgttctgatcgggacgtctgtcgtgatcttcttgtttatcctgttactgtttttcctgttatacagatggtgctccaataagaagaatgccgcagtcatggaccaagaacccgcaggggatcggacagtgaatcggcaggattccgacgaacaagacccccaggaggtgacatacgcacagttggaccattgcgtgttcatccagagaaaaatctctcgaccgtctcagagacccaagacccccctgacggatacttcggtgtatactgaattgcccaatgccgagcctcgctctaaggttgtatcttgccctagagccccacagtcaggcctggagggcgtgttctag

SEQ ID NO: 227726 - DNA, 1335 bp, Artificial Sequence
  Description of Artificial Sequence: Synthetic coding sequence
atgagtctgatggtcgtttctatggcttgcgtaggcctgttcttagtacaaagggccggtcctcacatgggaggccaggataaaccattcttgtcagcctggcccagcgccgtggtgcctcgaggcggtcacgtgactcttaggtgccattaccgccacaggttcaataatttcatgctgtacaaagaggatcgtatccacatacctatctttcatggcaggatcttccaggagagtttcaatatgagcccagtgaccactgcacacgccggaaactacacttgtcgcggtagccatcctcacagccctactggctggtccgcaccctccaaccccgtggtcattatggtcactggaaaccacaggaagccaagccttctggcacaccctgggccattagttaaatctggagagcgggtaatcctgcagtgctggtcagacatcatgttcgagcacttctttctgcataaggaggggatctcaaaggatccgtctcgattagtgggacagattcatgatggagtgtcaaaggccaatttctctattggccctatgatgctggctctggccggtacgtaccgatgttatggaagcgttacacacactccgtaccagctatcagcaccatccgacccactggacatcgtggtgaccggcccttacgaaaagcccagtctaagcgcacagcccggacctaaagtgcaggctggcgagtccgttacattgtcttgctctagcagaagctcctacgacatgtaccatctaagccgcgagggcggtgctcatgagcgcaggttgcccgcagttcggaaagtgaatagaaccttccaggcagacttccccctgggccctgcaacacatgggggaacctacaggtgttttggctcattcaggcattcaccgtacgagtggagcgatccttccgatccattgcttgtcagcgtcaccggtaaccccagcagttcttggccctctcctactgagccatccagtaaatccggaaatcctcgtcacctacacattttaatcggcacctctgtagtgatcattttgttcattctcctcctttttttcttactccacctctggtgcagtaataagaagaatgcggcagtcatggatcaagagccagcaggcaatcggactgctaatagtgaagattctgacgaacaagatccagaggaagttacgtacgcccagctggaccactgtgtctttacacaaagaaagatcacaaggcctagtcagcgcccaaagacgccccctaccgatactattctctacaccgaactacctaacgccaaacctcgctccaaggtggtatcctgcccttag

SEQ ID NO: 227727 - DNA, 1284 bp, Artificial Sequence
  Description of Artificial Sequence: Synthetic coding sequence
atgagccttatggtggtttcaatggcctgtgtgggtttatttctggttcagcgggcagggccacatatgggtggccaggacaagcccttcctcagcgcatggccctcggcagtggtacctaggggagggcatgtgactctgcgatgtcactatcggcatcgtttcaataatttcatgttgtataaagaggatagaatacacattcccattttccacgggaggatttttcaggaatcatttaacatgtctcctgttaccacagcccatgctggcaactacacatgtagagggagccacccccattctcctaccgggtggtcagcgccttcgaaccctgttgttatcatggtgactggcaatcacaggaagccatcgttgctggcccatcctggaccactggttaagtcaggcgaacgggtgatcctccagtgctggagtgacataatgtttgagcacttcttccttcacaaagaagggatcagcaaggacccttctcgtctggtcggtcaaattcacgacggtgtgtctaaggccaatttctcaattgggccaatgatgctggccctggctggaacatatcgatgttacggatccgtcacacatactccttatcagctatcagcgccttcagaccctcttgacattgtggttactggcccttatgaaaaaccgtccctgtctgcccagcctggtcccaaagttcaggccggtgagagcgttaccctctcctgcagttcgcgttcatcatacgacatgtaccatctgagtcgtgaagggggagcacacgaaaggcgcctgcctgctgtaaggaaagtgaatcgtaccttccaggcagattttccactgggacccgctactcacggaggcacatacagatgttttggaagcttccgacatagcccatatgagtggtcggaccccagcgaccccctgctggtgtcagtaacaggcaatccgcgacacctccacatattgattgggacgagtgttgttattatcctgtttattttgctgttatttttcctcctccacttgtggtgctcgaacaagaaaaatgcagccgtgatggatcaggaaccagccggaaataggacagccaactccgaagactctgatgaacaggaccctgaagaggttacgtatgcccagctcgaccattgtgtgtttacccagcgtaagattactcgcccttctcagagacctaaaacaccaccaaccgacaccatcttatacacagagttgcccaacgccaagccacggagcaaggtggtgagctgtccctag

SEQ ID NO: 227728 - DNA, 1368 bp, Artificial Sequence
  Description of Artificial Sequence: Synthetic coding sequence
atgtccctcacagttgtgagcatggcctgtgtgggcttctttctcttacaaggagcctggccacttatgggcggacaggataagccgtttttatccgcccgaccatccacagtggtgcctcggggtgggcacgttgcgctacagtgtcactacagacgcggttttaacaactttatgctctacaaagaggacagatcccatgtgcccatcttccatgggcgaatttttcaggaaagtttcattatgggccctgtgacccctgcccatgccggtacctatcggtgcagaggctccaggcctcacagcctgaccgggtggtcagccccttctaaccccttggtaattatggtgactggcaaccataggaagcctagcttgctcgcacacccgggaccgcttttaaaatctggagagacggttatcttacagtgctggtccgatgtaatgttcgagcatttttttctccatcgcgaaggcatctcagaggatccctcccgactcgtcgggcagatccacgatggagtgagcaaagccaatttctctatcggacccttgatgcccgtgctcgcaggaacgtaccgttgttatggcagcgtacctcacagcccatatcagttatcagccccaagtgatccgctcgacattgtcattactggactctacgagaagcccagtttgagtgcccaaccaggacctactgtgcaggccggagaaaacgtgactttgagctgcagtagctggtcctcatatgatatctatcatctgagccgggaaggggaggcccacgaaaggcggttacgcgctgtgcctaaggtgaatcgaactttccaggcagactttcccctggggccagcaacacacggcggaacctatcgatgcttcggctcttttcgggcattgccatgcgtgtggtccaatagctcggacccactgttagtgtcagttactggcaatccttcctcttcttggccctcgccgaccgaaccctcctctaaatctgggatttgccggcatctccacgtcctgatcggcacatccgtggtgatcttcctattcatcctacttctattcttcttattataccgttggtgttctaataaaaagaacgctgcagttatggatcaggagcccgctggggaccggacagtgaaccggcaggactccgatgagcaggaccctcaggaggtgacctatgcccaactagatcactgcgttttcatccagcggaagatttcaagaccgtcacaaaggccgaagactcctctgacagatacgtctgtttacaccgagctccccaacgcggaacccaggtccaaggtggttagttgtcctagggctccccagagcggcctcgaaggagtcttttag

SEQ ID NO: 227729 - DNA, 1047 bp, Artificial Sequence
  Description of Artificial Sequence: Synthetic coding sequence
atgagtctgatggtggtgtccatggcatgtgttgggttcttcctcctgcagggggcttggcctcatgagggcgtgcaccggaaaccctcactgctggcgcaccccggaaggctggtgaagtccgaggaaactgtgatccttcaatgttggtcagatgtgcgattcgaacatttcctgctccaccgcgagggcaaatttaaggataccctccacctaatcggcgagcatcacgatggtgtctctaaggccaacttcagtattggcccaatgatgcaggacctggctggcacttatcgctgttatgggtccgttacacatagcccgtaccagttatccgccccaagcgaccccttagacattgtcattaccggcctgtatgagaagccctcactgagcgcccagcccggtcctaccgtgctggcaggagagtctgtgaccctgagctgttcatcaaggagtagttacgatatgtatcacctatcccgggagggcgaagcgcacgaatgtcgcttctccgcgggacccaaggtgaacggcacatttcaggctgacttccccttaggacccgcaacacatggcggaacctataggtgcttcggctcctttcgcgacagcccctacgagtggtcgaattctagcgatccccttttggtcagtgtcaccggcaatccgtctaacagctggccatcccccacagaacctagcagcaagacggggaatccaagacacctccatatcttgatcggcacatccgtggtgattatcctgttcatccttctcttcttcctgctgcaccggtggtgtagcaacaagaagaatgcggcagtaatggatcaggaatctgctgggaaccgtaccgccaatagcgaagatagcgacgaacaggaccctcaggaagtgacatacacacagttaaaccattgtgtttttacacagaggaaaataacccgtccctctcaacgccctaaaacccccccaacagatatcattgtgtacacagagctgcccaacgctgagagtcgctccaaagtagtctcctgcccgtag

SEQ ID NO: 227730 - DNA, 1128 bp, Artificial Sequence
  Description of Artificial Sequence: Synthetic coding sequence
atgtcactgatggtcgtgtcgatggcctgtgttggtttcttcctcctgcaaggagcctggcctcacgagggaggacaggataaaccgctgctctctgcctggccatcagcagtagtgcctcgagggggtcacgtaacactgctttgtcgttcgagattgggcttcacaatctttagcctgtataaggaggacggtgttccggtaccggaactttataacaagatcttctggaagagtatcctgatgggtccagttactccagcacacgcaggcacctatagatgcagagggtctcaccctcggagtccaatcgagtggtctgcgcctagcaatccactggtcattgttgttactgggctattcggaaaaccctccctgtcagcacagcctggaccgacagtgcggactggggagaatgtgacactgtcatgttcctccaggagttcttttgacatgtaccacctgtcccgcgaaggacgtgcgcacgagccgagactgcccgcagtaccaagtgtaaatggcaccttccaggccgactttccactcggaccggctacacatggcggaacctacacgtgtttcggatctctccatgattctccctacgaatggtcagacccaagtgaccctctgttagtgtcagtgacaggaaatagctccagttcaagcagttctcctacggaacctagcagcaaaaccggcattcgacgtcacctgcacatcctcatagggacatccgtggcgatcatcctgttcataattctcttttttttcctgctccattgttgctgcagcaataagaagaatgcggcagtcatggaccaggagccagctggcgacaggaccgtgaatagggaagattccgatgatcaggacccccaggaagtgacatacgcccagctcgaccattgtgtctttacccagacgaagattacatctccctctcaacggccaaagactccaccgacagacacaacaatgtacatggagttaccaaatgccaaaccccgatcgcttagccccgcacacaaacaccactcccaggctttgagaggatcctctagggaaacaactgctctgagccagaatagagtcgccagtagtcatgtcccagctgctggcatttag

SEQ ID NO: 227731 - DNA, 1128 bp, Artificial Sequence
  Description of Artificial Sequence: Synthetic coding sequence
atgagtctgatggttatttccatggcatgtgtgggtttttttctccttcagggagcctggactcatgagggagggcaggacaagcccctcttgtcagcgtggccatccgccgttgtgcccagaggaggacacgtgactctcctgtgtcgtagtagactgggattcacgattttttcgttgtataaagaggacggtgtcccagtgcccgaactctacaataagatcttctggaaaagcatcctcatgggcccagtgacccccgcacatgccggtacgtatcgctgccgcggttcccaccctcgcagccctatagagtggtctgcgccttccaatcccctggtcatcgttgtcacgggactcttcggtaagcccagtttatccgcccagcccggacccaccgtgcgcacaggcgagaacgtgactctgagctgctctagccgcagctcattcgatatgtaccacttaagccgagaggggagagctcatgagcctcggctcccggcagtcccttccgtgaatggcacctttcaggccgacttcccactgggtccagccactcatggtggtacgtacacatgtttcggctctctgcacgattcgccgtatgaatggagtgatccatctgatcccttgcttgtgtctgtgaccggaaacagtagctcaagttctagctcgcctacagagcctagcagcaaaacaggcataagaagacatctgcacattcttatcggaacatcggtggctattatactgtttattatactgtttttttttctcctgcactgctgttgttctaataagaagaatgcagcagtcatggatcaggaacccgctggagacaggacagtgaatcgtgaagacagcgacgatcaggaccctcaagaagttacctatgcccagcttgaccactgcgtctttacccaaaccaagattacttccccgtcccagcgacctaaaacccctcccactgacaccactatgtatatggagctgccgaacgctaaaccaagatccctctcaccggctcacaagcaccactcacaagccctccggggttccagccgagaaaccactgccctaagccagaaccgagtcgcctctagtcacgtgccagccgctggcatatag

SEQ ID NO: 227732 - DNA, 1164 bp, Artificial Sequence
  Description of Artificial Sequence: Synthetic coding sequence
atgtcccttatggtcgtgagcatggcatgtgttggcctgttcctcgtgcaacgcgcaggtcctcatatgggtggacaggacaagccctttctgtccgcctggccctcggcggtagtgccccgaggcggacacgtgactttgcgttgtcattatagacatcggtttaacaacttcatgttgtataaggaggacaggatacatgtgccaatttttcacggacgcatctttcaggaaggttttaacatgagccctgtcacaaccgcgcacgccggtaattatacctgccgcggatcgcacccgcactctccgaccgggtggtctgctccttcaaaccctatggtcattatggttaccggcaatcatcgaaagccctcactgctggcccatccaggccctcttgtgaagagtggagaaagagtaattctgcagtgttggtcagacatcatgttcgagcactttttcctgcacaaagagtggatcagcaaggacccctcccggctagtaggacagatccatgatggcgtttctaaggctaatttttcgatcgggtccatgatgcgtgcactcgccggaacttaccggtgctatggctctgtgacccacactccgtaccaactgtctgccccttctgatcccctggatatagtggtcacaggcctatacgaaaagccctccctcagcgcacagccgggacccaaggtacaggctggcgaatctgtgactctgagctgctcttcacggtcaagttatgacatgtatcatctgagtagggaaggcggtgcccatgagcgacggctccccgcagtgagaaaggtcaatcgaaccttccaggctgactttcctctcggccctgctactcatgggggaacataccgttgctttggctcgttccggcactcgccttatgagtggtcagatcctagcgacccactgctggtcagcgtgactggaaatccatcttcctcctggccatctccaactgagccatctagtaagagtggaaacctgcgccacttgcatatcctgatcggcactagtgtcgtgaagattcctttcactatactgctattcttcctgcttcatcgttggtgcagcaataaaaaaaatgcagcagtgatggaccaagaaccggcaggaaatcggtccgagcagcgcggattctag

SEQ ID NO: 227733 - DNA, 1149 bp, Artificial Sequence
  Description of Artificial Sequence: Synthetic coding sequence
atgctgctgatggtggtttccatggcgtgcgtggggcttttcctcgtgcagagagcgggtccgcacatggggggacaggacaaacctttcctttctgcttggccctcggccgtcgtgccccgaggcggacacgtgacactgagatgtcattataggcacagatttaacaacttcatgctctacaaagaggaccggatacatgttcctattttccacggccgaatcttccaggaagggtttaatatgagccccgtaaccacagctcacgctgggaactacacttgccgcggtagccacccccactcccctaccggatggagcgcaccaagcaaccccatggttatcatggtcactggcaatcacagaaaaccgtcactcttagctcacccaggcccactggtgaaaagtggcgaaagagtaatcttgcagtgctggagcgacatcatgttcgaacactttttcttgcacaaggagtggatttccaaggatccaagccggcttgttggtcagatccacgacggggtaagtaaagctaatttctctataggcagtatgatgcgggcattggctgggacctacagatgctacggttccgttactcacaccccatatcagctgtcagcgccatccgacccactggacatcgtggttaccggcctgtacgaaaagcccagtttgtcagcacaacccggtcctaaggtgcaggctggggagtctgtgaccttgagctgttcatcaagatctagctatgatatgtatcatttatccagagagggaggagcacatgaaagaaggttacctgccgtccggaaggtaaataggaccttccaggccgacttccccctcggtcctgctactcacgggggaacctaccgctgtttcggatccttccgccattctccttatgagtggtcagacccctcagaccctctgctagtttccgtgactgggaaccccagcagctcctggccaagcccaactgagcccagttccaagagtgggaatctcaggcacttacatatcttgataggaacgagcgtggttaaaatccctttcactatcctgcttttctttctgctgcacaggtggtgttccaataagaagaagtgttgctgtaatgggccacgcgcttgccgcgagcagaagtag

SEQ ID NO: 227734 - DNA, 1194 bp, Artificial Sequence
  Description of Artificial Sequence: Synthetic coding sequence
atgagtcttatggttgtctcaatggcatgtgtgggatttttcctggatcaaagcgtgtgggcccatgtgggcggacaggacaaacctttctgtagcgcgtggccgtctgccgtggttccccaggggggacacgtgaccttgcggtgccattgcaggaggggtttcaacatctttacactgtacaagaaagatggggtccctgtgcctgagctctacaaccggattttctggaattcattcctgatctctcctgtcacccccgctcatgccggaacgtaccggtgcagaggctttcaccctcattccccgactgagtggtccgcccctagcaatcctcttgtgattatggtgactgggctgtatgagaagcctagtctgaccgcgaggcccggaccaacggtgagagctggagagaacgtgacactgagctgcagctcgcagtcgagttttgacatttatcatctcagccgggagggcgaagcacacgagttaagactgcctgctgttccatccatcaatggaacatttcaagccgactttccgttgggacctgcaacacacggagagacttatcgctgtttcggatcattccatgggagtccatacgaatggtctgaccccagcgatccactaccagtgtccgtcaccgggaatccatcgtcttcctggccatctccgaccgaaccctccttcaagacgggcatcgctagacatttgcatgcggttatcaggtactcagtcgcaataatcctctttacaattctcccgttttttttgctgcatcggtggtgcagtaagaaaaaagtttcactgaccaagcagcggcctgaaaatagtggtccttgcgccgaagctgggtgggagcacgccgacgccgctgtgatgaatcaggaaccagcaggccaccgcaccgttaaccgagaggattccgatgaacaggaccctcaggaggttacttatgcccaactggatcactgcattttcacgcagcgcaaaatcacaggacccagccagcgcagtaagcggcctagcacagacacgagtgtttgcattgagctcccgaacgcagagccacgcgctctgtctcccgcacatgaacaccacagccaagccctcatggggtcatcacgggagactacagccctgagccaaacacagctggcaagttccaacgttcctgcggctgggatctag

SEQ ID NO: 227735 - DNA, 1029 bp, Artificial Sequence
  Description of Artificial Sequence: Synthetic coding sequence
atgtcaatgtcacctaccgtgattattctggcttgcctgggttttttcttagatcagagtgtctgggcccacgtgggtgggcaggataaacctttttgctccgcttggccctcagccgttgtgcctcaaggaggccatgtgaccctcaggtgtcattgccggaggggctttaacatattcacattgtacaagaaagacggagtgcccgtgcccgagctgtacaatagaattttctggaatagctttctgatcagccccgtaacacctgcacacgcgggaacctataggtgcaggggcttccacccgcacagccctaccgaatggagtgctccaagtaatcccttggtgatcatggtgactgggctttatgagaaaccatcactgacagcgaggccagggccaaccgtgagagccggagaaaacgtgaccctaagctgcagctcgcaatcctccttcgatatctaccacctgagtagggaaggggaagctcacgaactcaggcttcctgcagttccatcaatcaacggcacattccaggcagattttcccttgggccctgcaactcacggcgagacatatcgatgtttcggatcatttcacggttctccttatgagtggtctgatcctagcgatccgttacccgtttctgtcacagggaacccctcgtcaagttggcccagtcccactgaaccgtctttcaagacagatgcagcggttatgaatcaggagcccgctggccaccgtaccgtgaatagggaggactccgacgaacaagatccccaggaggtgacatacgcacagctcgatcattgcatatttacgcagcggaaaataacagggccatctcagcgcagcaagcgtccttcaaccgatacatcagtatgcattgagttaccaaacgcagaaccgagggccctgtcccctgcccatgagcaccattcgcaagccttgatgggatcctcccgggagaccacagcgttgtctcagacgcagctcgccagctcaaacgtccctgccgctggcatctag

SEQ ID NO: 227736 - DNA, 1083 bp, Artificial Sequence
  Description of Artificial Sequence: Synthetic coding sequence
atgtctatgtccccgacggtgatcatactggcttgcttagggttcttcctggatcaatccgtgtgggcgcatgtgggaggacaggataagccattttgttccgcctggcccagcgccgttgtgccgcagggaggacacgtaacgctgaggtgccactgcagaagagggttcaacatctttaccctgtacaagaaagatggagtgcccgttcctgagctgtataataggatcttctggaattcttttcttattagtccagttactcccgctcacgccggaacttaccgctgtcgcggattccatccccactcgcctacagagtggagcgctcccagcaatcccttagtaatcatggtgactggcttatacgaaaagccaagcctcacagccagacccggacctacagtgcgcgcaggggaaaatgtgacgctctcctgcagcagccagagtagtttcgacatttaccatctcagcagggaaggggaagcccacgaattaaggctgccagctgtccctagcatcaatggtacctttcaggctgacttccccctgggacccgcaactcacggcgagacgtacaggtgttttggatcttttcatggtagtccctatgagtggtctgacccatcagaccccttgccagtgagtgtgacaggtatagcgaggcatttacacgcagtcattcgatactccgttgcaatcattttgtttactatcttacccttttttctgcttcaccgctggtgtagcaaaaagaaaaatgccgctgtcatgaaccaagagcccgctggacatcggaccgtgaatagagaggactccgacgagcaggacccacaagaggtaacttacgcgcagctcgaccattgtatattcactcagaggaaaataactggtccaagccagcgctcaaagcgaccctcaaccgatactagtgtatgtattgagctgcccaatgcagagcccagggcactgagtcctgcccacgagcatcatagccaggccctcatgggctcctctcgagaaacgacagccctgagccagacccagctcgctagctctaacgttcctgctgcaggcatctag

SEQ ID NO: 227737 - DNA, 1134 bp, Artificial Sequence
  Description of Artificial Sequence: Synthetic coding sequence
atgtccatgagtccaacggtaattatcctggcctgcctgggatttttcctggaccagtctgtgtgggcacatgtaggaggccaggataaaccattttgttcggcctggccgagcgccgttgtgccgcagggtggacacgttaccctgagatgtcattgccggcgaggattcaatatctttacactgtacaaaaaggacggcgtcccagtaccggagctgtataaccgaattttctggaattcctttctcatatctcctgtgacccctgctcacgctggtacctacaggtgccgagggttccacccgcatagtcccacagaatggagcgctccgagcaacccactggtgatcatggtcaccgggctgtatgaaaagccctcccttactgccaggccgggacctacagtgcgcgcaggcgagaacgttacactgtcctgcagttctcagtcttcttttgacatttaccatctgtctcgagaaggtgaggcacacgagctccgattgcctgctgtgccctctatcaacggcacctttcaggcagactttccgctgggtccagctacacacggtgagacgtatcgctgctttggcagcttccacggcagcccctacgagtggtctgaccccagtgatccactgcctgtttctgtaacaggcaatccctcctcctcatggccgagtcctaccgagccctccttcaagaccggcatagcacgccatcttcacgcggtgattagatattcagtcgcgattatcctgttcacaatacttccatttttcctgctgcacagatggtgttccaagaagaagaacgctgccgtgatgaaccaggagccagcgggacatcgcacagttaaccgcgaggattccgacgagcaggacccacaagaggttacctacgcccagctcgaccactgtatattcactcagcgaaagattacaggacctagccagcggtcaaagagaccatcaacagacacgagcgtttgtatcgagttaccaaacgccgagcccagggccttaagcccagctcacgagcaccatagtcaagctctgatgggttcatccagggaaacaaccgctctgagccagacacagctcgcgtccagcaacgtgccagccgcaggcatctag

SEQ ID NO: 227738 - DNA, 1233 bp, Artificial Sequence
  Description of Artificial Sequence: Synthetic coding sequence
atgtctctgatggtggtgtccatggcatgtgtaggattcttccttcttgaaggaccatggcctcacgtcggagggcaggacaagccctttctgtctgcttggcccggaaccgtggtgagcgagggacagcacgtgaccctacagtgtcggagccgcctggggtttaatgagttctcactgtctaaggaggatgggatgcctgtgcccgaattatataatcgtatatttcggaatagcttcctgatggggcctgtcacgccagcccacgccggaacataccgttgttgctctagccacccacattcacctacgggctggagtgccccaagcaaccctgtggtgatcatggtgactggagtgcatcgcaagccatcgctgctggcgcaccctggtcccctggtgaagtcgggcgagacagtgatcctgcagtgctggagtgacgtcaggttcgagcgtttcctgctgcatagagagggcatcaccgaggatccgcttcgcctgattgggcagctgcacgatgctggcagtcaggttaattatagtatgggaccaatgacaccggcactggcaggaacctaccgctgttttggctcagtaacccacttgccctacgagcttagcgccccaagtgaccccttggatatagtggtggtgggactgtacggaaagccttccctgtcggcacagccaggacctacggttcaagccggagaaaatgttacactatcttgcagctccaggtcccttttcgatatatatcacctgtctagggaggccgaggcaggggaattgagactgaccgcagttctgagagtcaacgggacattccaagctaatttccccctcggaccagtgacccacggtgggaattaccgctgttttggcagcttcagggcgttacctcatgcctggtctgatccaagcgaccctctaccagttagcgtgacgggaaactctcgctacttgcatgcccttatcggcacctccgtcgttattattccatttgctatcctactcttcttcctactccatagatggtgcgccaataaaaaaaatgccgtggtcatggatcaagagcctgccggtaaccggaccgtgaatagggaggactctgatgaacaggacccccaggaagtaacctacgcccagctgaaccattgcgttttcactcagcgcaagattacccgcccaagccagcggcctaaaacgcctcccacagacacctcggtgtag

SEQ ID NO: 227739 - DNA, 1047 bp, Artificial Sequence
  Description of Artificial Sequence: Synthetic coding sequence
atgagcctgctcgtcgttagcatggcctgtgttgggttttttctgctccagggagcatggcctcacgagggcgtccacagaaagccttcactgcttgcacacccagggaggctggtgaaaagtgaagagacagtgatcctgcagtgttggtcagatgtcatgttcgagcactttcttctgcatcgtgaaggcatgtttaacgatactttaagactgataggtgagcaccacgatggcgtgagcaaggccaacttctcaatctccaggatgacgcaggacctggccggaacgtatcgctgttatgggtcggtaacgcatagcccttaccaggtcagtgccccatcagaccccctggatattgtgattatcggattatacgaaaagccatccttgtctgctcaactaggcccaaccgtcttggctggagagaatgtgacactgagctgttcaagccgctcgagctatgatatgtatcacctgagccgagagggggaagcacatgagcggaggcttcccgctgggcctaaagtgaacggcacctttcaggctgactttccacttgggcctgccacccatggcggaacgtaccgatgctttggaagcttccatgactccccttacgaatggtctaagtcttcagatccacttctggtgagtgttaccgggaacccctcaaattcttggccctctcccaccgagcccagtagtaagactggtaacccccgtcatctgcacatcttgattggcactagcgtagttataatactgttcattctcctcttcttccttcttcacagatggtgttctaacaagaagaatgccgctgtgatggatcaagagagtgcgggtaacagaaccgccaatagcgaggattctgatgagcaagacccccaagaggtaacttacacacagctcaaccattgtgtgttcactcagagaaagatcactaggccgagtcagcgacccaagaccccacccacagacatcatagtttacacagaactccccaacgcagaatctagaagtaaggtggtttcatgtccgtag

SEQ ID NO: 227740 - DNA, 1026 bp, Artificial Sequence
  Description of Artificial Sequence: Synthetic coding sequence
atgtctctgatggttgtgagcatggtttgcgtgggcttttttctgctgcaaggtgcttggccccatgagggtgttcaccgcaagccctctctactggcccatccagggcctctggtaaaatcagaagagaccgttatactgcagtgctggtccgacgtccgttttcaacattttctactgcatcgggaaggcaaattcaaggacacactccatttgattggtgagcaccacgatggagtgtcaaaggcgaatttctctatcggtccaatgatgcaagatctcgctggcacctatcggtgttacggcagtgtcacccattctccataccaactctccgccccatcagatcctttggatatcgtgattaccggattgtatgagaagccaagcctgagtgcccagcccggtccaaccgttcttgctggcgagtccgtgaccctgagttgctcatcaaggagttcctacgatatgtatcatctgtcccgtgaaggggaggctcacgagcggaggttcagcgctgggccaaaagttaacgggacatttcaggccgacttcccgctgggacctgcaacacacgggggtacatacaggtgtttcggctctttcagggactccccatacgaatggtccaattcttccgatccattgttggtatctgtcactggcaatccctctaactcctggccaagtccgaccgagccctcatccgaaacaggcaatcctaggcatctccacgtgctgatagggacaagcgtggttatcatactgttcatcctcctgctcttttttctgcttcatcggtggtgctgcaacaaaaagaatgcagtcgtgatggatcaagaaccagccggaaaccgcactgtcaacagggaagactccgatgagcaggacccacaggaggtaacttatgcccagctaaatcactgcgtgtttacgcagagaaaaattacaagaccctcacagcgtcctaagaccccccctaccgatatcatcgtatacactgagctgccgaacgcggaaccctag

SEQ ID NO: 227741 - DNA, 1047 bp, Artificial Sequence
  Description of Artificial Sequence: Synthetic coding sequence
atgtccctcatggtggtgagcatggtatgcgtcggcttctttttactgcagggggcatggccccacgagggcgtccacagaaaaccaagcctgttggcccaccccggacctttggttaagtcagaggaaactgtaatattacagtgctggagcgacgtccgctttcagcactttctcctccatcgggaaggtaaatttaaagacacactacacctgatcggggagcaccatgacggggtatctaaagccaatttctccatcggacctatgatgcaagacttggcaggtacttaccgctgttatggaagtgttactcattcaccataccagttaagcgcaccatccgacccgctggacatcgttatcactggcctatacgaaaagccctctttatccgcccagccaggcccaacagtcctggccggagaatccgttacgttatcatgttcctcccggtcatcctacgatatgtatcacctgtcacgagagggagaagcccatgagcggaggtttagtgccggtccgaaagtcaacggtacatttcaggccgacttcccgctgggccctgccactcacggcggtacctacagatgttttggctccttccgggactccccatatgaatggagcaattctagcgatccattgcttgtgtcagtaacaggcaacccctcaaattcctggcccagtccaactgaaccaagctccaagacaggcaatccccgacatctgcatatcctgatcggcacgagcgtggtaattatactatttatcctgctttttttcttacttcatagatggtgctcaaacaaaaaaaatgccgcagtgatggaccaggagtccgccggaaaccggacagcgaattccgaagattccgatgagcaggacccacaggaagtcacgtatacccaactcaatcattgtgtttttacccagaggaagattacaaggccatcccagaggcctaagacccccccaacggatattattgtatacaccgagctgccgaatgctgagtccaggtctaaagtcgtgtcgtgtccatag

SEQ ID NO: 227742 - DNA, 1029 bp, Artificial Sequence
  Description of Artificial Sequence: Synthetic coding sequence
atgtcaatgagccccaccgtgatcatcctagcatgcctaggctttttcttggaccaaagcgtgtgggctcatgtcgggggacaagacaaacccttctgctcagcttggccctcagctgtcgtgccccagggaggccacgtaactctcaggtgccattacaggagaggatttaatatctttaccctgtacaaaaaggacggagttcctgttcctgaactctacaaccggatcttctggaactcttttctgatttcaccggtgactccggcacacgcgggaacgtataggtgcagaggctttcatccgcacagtccgactgagtggagcgctccgtcaaatcccttggttataatggtgacaggtttatacgagaagccctcacttaccgcacggcctggtccgacggtgcgggctggtgagaacgtgaccctgtcctgttcttctcagagcagcttcgacatctaccatctgagcagggagggggaagctcatgaactccggctgcctgccgtgccttcaattaacggaactttccaagccgattttcccctggggccagccacacatggagagacatacagatgctttggttccttccatggttcaccgtatgaatggtctgacccctctgaccctctgcctgtcagcgtgaccggaaaccctagcagctcttggcctagtccaaccgagccttctttcaagaccgacgcagccgttatgaaccaggaacccgcaggtcacaggacagttaatagagaggactcagacgaacaggaccctcaggaggtgacatatgcccagctggaccactgcattttcacacagcggaaaattactgggccttcccagagaagtaaaaggcctagcacagatacttctgtttgtatagaactccccaatgcagaacccagggctctgtctccagctcacgagcatcattcacaggccttgatggggtcttcccgagagacaacagccctgtcccagacacagttggctagttctaatgttcctgcagctggcatttag

SEQ ID NO: 227743 - DNA, 978 bp, Artificial Sequence
  Description of Artificial Sequence: Synthetic coding sequence
atgagcatgtctcccactgtgatcatactggcgtgcttggggttcttcctggatcagagtgtgtgggcccatgtgggtggccaagacaagcccttttgctctgcttggccttctgctgtcgtccctcagggcggacatgtgaccctacggtgccactatcgtcggggattcaatatctttactctctataagaaagacggtgtcccagtacctgagctctacaataggattttttggaattctttcctgatcagcccagtaacacccgctcacgccggaacatacagatgcaggggctttcaccctcactcccctacagaatggtccgccccttccaacccacttgtgatcatggtgactgggttgtatgagaagccctcgctgactgcacgtcccggtcctacggtgcgagcgggtgagaacgtcacgttgtcttgcagcagtcaatcctcttttgacatataccatttatctagggagggggaggctcatgagctcaggctcccagccgtaccgtcgattaacggcacctttcaggcagactttccactgggcccagctacgcacggggaaacgtaccgctgctttggcagcttccacggtagtccttacgaatggagtgacccatcagatccgctcccggtgtcagtaaccgatgccgctgtgatgaatcaggagccagccggtcaccggacagtgaatcgagaagattcagatgaacaggaccctcaggaggtgacttatgcgcagctggaccactgcatttttacccagagaaaaattacgggtcccagtcagcgctccaagagaccttcaacggacacatctgtgtgcattgagctgcccaatgcagaaccgagagcgctctctccagcccacgagcatcattcacaagctctaatggggtcatcccgcgaaacaaccgctctgtcacaaacacaactcgcctcaagtaacgtgcccgcagcagggatttag

SEQ ID NO: 227744 - DNA, 1194 bp, Artificial Sequence
  Description of Artificial Sequence: Synthetic coding sequence
atgagtctcatggtggtgtcaatggcctgcgtagggtttttcctagatcagtcagtgtgggcccacgtcggtggccaggacaaacctttttgttcagcttggccgtctgctgtggtaccacagggaggccatgtgaccctgcggtgtcattacaggcgcggatttaacatttttacactctataaaaaggacggcgtgccagtccccgagctatacaaccgtatcttctggaacagcttcttgatttcccccgtgacccctgctcacgccggaacatatagatgtcggggttttcatccccactctccaaccgagtggtccgctccctccaaccccctcgtgatcatggtcacaggcctgtacgaaaagccctccttaaccgcccgtccaggtcccacagtgcgagctggggaaaatgtcacattgtcctgcagctcacagtcctcgttcgacatataccatctgtctcgagaaggcgaggcccatgagctgcggctcccggctgtgccatccattaatggaacctttcaagcagattttcctttagggccagctacgcatggggaaacctaccgttgctttggctcatttcatggctccccgtatgagtggtccgacccctccgaccctctgccagtgtctgtgaccggaaatccgagctccagctggcctagccccacagagccttcttttaagacaggcatcgcgaggcacctccatgctgtgatcaggtactctgtcgccatcatcctgttcacaatcttgccatttttcctgcttcacagatggtgctcgaagaagaaagtgagcttgactaagcaacggcctgaaaattctggcccatgcgctgaggccggatgggagcacgctgacgccgctgtgatgaatcaggaaccagcaggccaccgcactgtgaatcgggaagacagcgatgagcaggatccccaggaggtgacgtatgctcagctggaccactgcattttcacccagcgcaagattacaggcccatctcaaagaagtaagcgaccctcgacagacaccagtgtgtgtatcgagttaccaaatgctgaaccacgagcactgagccccgcacacgaacaccatagtcaagcattgatgggatcatcccgggaaaccaccgctctttcccagactcagttggcatcctccaatgttccggctgccggtatttag

SEQ ID NO: 227745 - DNA, 693 bp, Artificial Sequence
  Description of Artificial Sequence: Synthetic coding sequence
atgtcaatgagccccacagtgattattctggcatgcctgggattctttctggatcagagcgtgtgggctcatgttggcctgtatgagaaaccttccttgacggccagacctggccctactgtgcgggcaggggaaaacgtcacccttagctgctcgtcccagagcagcttcgatatctatcatctatcccgtgaaggagaggctcacgagctacgactgcctgccgtaccgtccatcaacggcacgttccaggctgattttccactggggccagcaacgcacggggagacttataggtgtttcggttcttttcacggtagtccttatgagtggtccgaccccagcgacccactgcccgtgtctgtaacagatgcagccgtgatgaatcaagagcctgccggacaccgaactgttaatcgagaagactcagatgagcaggatcctcaagaagtgacatatgcacagctggatcactgcatttttacccagcgcaagattacaggaccgagccagaggagtaagcggccaagcactgacaccagcgtgtgcatcgagctgccgaacgccgagcccagagctttatcacctgcccacgagcaccactcccaggctttgatgggttccagtagagaaacaacggccctgtcacagacacaacttgcatctagtaatgtccccgcagctggcatctag

SEQ ID NO: 227746 - DNA, 762 bp, Artificial Sequence
  Description of Artificial Sequence: Synthetic coding sequence
atgagttgtactatcgagaaggctttggccgacgccaaggccctggtggagcggttgagggaccatgacgacgccgcagaatccctgatcgagcagacaacagcgctcaacaaacgagtggaggccatgaagcagtaccaagaagaaattcaggaactcaacgaagtcgcccgtcaccggcctagaagtactctggtgatgggcatccagcaggagaatcgccagatacgggagctgcaacaggagaacaaggagctccgtacctccctcgaggagcatcaatctgctctggaactgattatgtccaagtacagggagcagatgttcagactactgatggcgagcaaaaaggacgaccctgggatcataatgaaattgaaggagcagcattcaaagattgatatggtccacagaaacaagagcgaggggtttttccttgacgcttctaggcatatactggaggcgccacagcacggcttggaacgtcggcacttggaagcaaaccagaacgaattacaggcccacgtggaccagataacagagatggccgcagtcatgaggaaggccattgaaatcgacgagcaacaggggtgcaaggaacaggaaagaatcttccagcttgaacaggagaataaagggcttcgcgaaatactacagattacaagagaatctttcctgaatctgaggaaagacgacgcctctgagtccaccagtctcagcgcgctggttactaactctgatctgagcctgagaaagtcttag

SEQ ID NO: 227747 - DNA, 648 bp, Artificial Sequence
  Description of Artificial Sequence: Synthetic coding sequence
atggacaaccagggtgtgatctatagcgacctgaacctgcctcccaatcccaaaagacagcagcgcaaaccaaaagggaataagaattccatcttagccactgaacaggaaatcacctacgcggaactcaatctccagaaagcctcacaggatttccaggggaacgacaagacctaccactgtaaagacctgccttcagccccagagaagctcatcgtgggaatactgggaattatctgcttaatcttgatggcctctgtggtaacaatagtagtcattccgtccagacattgtgggcattgccccgaagaatggatcacctacagcaacagctgttattatattgggaaagaacgcagaacctgggaggaatccctgcttgcgtgtacctccaagaattcatctttattaagcattgataacgaagaagaaatgaaattcctttccattattagccctagttcatggatcggagtgttcaggaactcttcccaccacccgtgggtgactatgaatggcctggcatttaagcacgagatcaaggattcagacaacgccgagttaaattgtgctgtgctccaagtgaatagactaaagagtgcacagtgtggcagctcaatcatttaccactgtaagcataagctgtag

SEQ ID NO: 227748 - DNA, 702 bp, Artificial Sequence
  Description of Artificial Sequence: Synthetic coding sequence
atggataaccagggcgtgatctattcggacttgaacctccctccgaaccctaaaaggcaacagcggaaacccaagggaaataagaacagcattttggcaacagaacaggagatcacatatgctgagctcaaccttcaaaaggcgtcccaagactttcagggtaatgacaagacttatcattgcaaagatctgccaagtgccccagagaagttaatcgtgggcattttaggaatcatctgtttgattcttatggcaagtgtggtgaccatcgtagttatcccaagcacactaatccaacggcacaacaacagttccctgaatactcggacacagaaagccagacattgtggacattgtccagaggaatggatcacctattcaaattcctgttactatataggtaaggagaggcggacatgggaagagtcactgctcgcttgtacgtcaaagaattcctcactcctgagcatcgataacgaggaagaaatgaagttcctgtccatcatctctcccagctcctggatcggagtgttccggaatagctcccatcatccctgggtgactatgaacgggctggcatttaagcatgagatcaaggactctgacaatgccgagctcaattgtgcagtgctacaggtgaatcggctcaagagcgcgcagtgcggctccagcattatctatcattgcaaacacaaactttag

SEQ ID NO: 227749 - DNA, 648 bp, Artificial Sequence
  Description of Artificial Sequence: Synthetic coding sequence
atggataaccagggagtgatttattcagatctgaacctgcctcctaatccaaagcggcaacagagaaaacccaaaggcaacaagaacagtattcttgcaactgagcaagagataacgtacgcggaactgaaccttcaaaaagccagtcaggatttccagggcaatgataagacttaccattgtaaggatctcccatcggccccagagaagctcatagtgggaattctgggaattatctgtctgatcctgatggcgtccgttgtcacaatcgtggttataccctcaagacactgcggtcactgccccgaagaatggattacctattccaacagttgttactatatcggtaaggagcggagaacgtgggaggaatccctcctcgcctgtacctccaagaactctagtctgctttcaattgacaatgaggaagagatgaagttcctgtccatcatcagcccaagcagctggattggcgtcttccggaacagctcccaccatccttgggttaccatgaatggactggcctttaaacacgagatcaaggacagtgacaatgctgaactaaactgtgccgttctccaggtcaataggctgaagtccgcccagtgtggaagtagtatcatttatcattgtaaacacaaactgtag

SEQ ID NO: 227750 - DNA, 702 bp, Artificial Sequence
  Description of Artificial Sequence: Synthetic coding sequence
atggacaaccagggcgtgatttactccgacctgaatctcccgccaaatcctaagaggcagcagagaaaacctaaagggaataagaatagcatcctggctaccgaacaggagatcacctatgcggagctaaacctgcagaaggcctcccaagattttcagggcaacgacaagacgtatcattgcaaggaccttccctcagcgcctgaaaagctgatagtaggaatcctgggaattatctgcctaatactcatggcatctgtggtgacgattgtggtcatcccatccacattaatccaaaggcataacaacagctccctcaacacccggactcagaaggctagacactgtgggcactgtccggaagaatggataacgtattcaaattcctgttactacattggcaaagaaagaaggacttgggaagagtctctgctggcctgcacaagcaagaactcaagccttctgtcaatcgataatgaggaggagatgaagtttcttagcatcatctcccccagttcttggatcggggtgttcaggaattcatctcatcacccatgggtaacaatgaatggcctggcattcaagcacgagattaaggactccgataacgcggagcttaattgtgccgtgctgcaggtgaaccgactgaagtccgcccagtgtggatcctctatcatttatcattgtaaacataagctgtag

SEQ ID NO: 227751 - DNA, 696 bp, Artificial Sequence
  Description of Artificial Sequence: Synthetic coding sequence
atgaataagcagcgagggaccttttctgaggtgtcactggcccaggatccaaagcggcagcagcgcaagcccaaggggaacaaatctagtattagcggcaccgagcaggagatatttcaagtggagctcaacctgcagaatccgagcttaaaccaccaaggtatcgacaaaatctatgattgtcaaggattactgccaccaccagagaagctgactgctgaagtgcttggaattatttgcatcgttctaatggcaacagtgctgaaaactattgtgctgattcccttcctagagcagaacaactcaagcccgaacactcgaacccaaaagacgcggcactgtggacactgcccggaggagtggatcacctacagcaattcatgttactacatcgggaaggagagacggacctgggaggagtcactgttagcatgtactagcaaaaatagtagcctcctgagtattgacaatgaggaagaaatgaagtttttagcttcgattttaccaagctcctggatcggggtgttccggaactcaagtcatcacccttgggtgaccatcaacgggctcgcattcaagcacaagatcaaagatagcgataatgcagagctgaactgcgccgtgctccaggtgaatagacttaaatctgctcagtgcgggtctagcatgatataccactgcaaacataaactctag

SEQ ID NO: 227752 - DNA, 696 bp, Artificial Sequence
  Description of Artificial Sequence: Synthetic coding sequence
atgaataagcaaaggggtactttctcagaggttagcctggcacaggaccctaagagacagcagagaaagccgaaggggaacaaatcctccatcagtgggacagagcaggaaattttccaggtggagctcaatctgcagaacccatctctcaaccatcaaggcatcgacaagatctacgactgtcagggccttcttccaccacccgagaagctgaccgccgaggtgctggggattatctgcatcgtgctgatggcgaccgtgcttaagacaatcgtcctcatcccattcctcgagcaaaataattttagcccaaacacacggacccaaaaggcacgacactgcggacactgccctgaggaatggataacgtatagcaactcctgctattacattgggaaggagcggagaacctgggaagagtccctcttagcgtgcacttccaagaattcgtcattgctctctatagataacgaagaagaaatgaagttccttgcctccatcctgccctctagttggatcggtgtattccgcaactcatctcaccatccctgggtgaccatcaatggactcgctttcaaacacaagatcaaagatagcgacaatgcagaactgaattgcgctgtcctgcaggttaaccggctaaagtccgctcaatgcggctcttccatgatataccattgtaaacacaagttgtag

SEQ ID NO: 227753 - DNA, 375 bp, Artificial Sequence
  Description of Artificial Sequence: Synthetic coding sequence
atgataccgacgaggcattgtggacactgtcctgaagagtggattacttactctaactcttgttactatatcggcaaggaaaggcgaacatgggaagaatccctcctcgcatgcacctcaaaaaactcaagcctgctgagcattgataacgaggaggagatgaaattcttggcctctattctccctagttcttggataggtgtttttcgcaattcttcacatcatccctgggtaaccatcaatggactcgctttcaaacataaaataaaggattccgacaatgcggaactgaactgcgctgtcctgcaagtgaatcgcctcaaaagtgcccagtgtggctctagcatgatttaccactgcaagcataaattatag

SEQ ID NO: 227754 - DNA, 774 bp, Artificial Sequence
  Description of Artificial Sequence: Synthetic coding sequence
atgagtaaacagagaggcaccttctctgaagtgagtttggctcaagaccccaaatggcagcagcgcaaacctaaaggaaataaaagttcgataagcggaaccgaacaggagatctttcaggtagaactgaaccttcagaatgctagcctgaatcatcagggaattgacaagatatacgattgccagggactcctgccccctcccgaaaaactgaccgcagaggtactgggtatcatctgcatcgttctcatggcaacggttctgaagactattgtactcattcctttcctggaacagaacaactcaagccccaacgcacgaacccagaaagccagacattgtggacactgtcctgaagagtggattacttacagcaactcttgctactatatcggtaaagagaggaggacttgggaagagtcgcttcaggcctgtgctagcaagaattcaagctcattgctctgcatagacaatgaggaagagatgaagttcttagcaagcatactcccgagtagctggattggggtattccgcaactcctcccatcatccttgggtgaccattaatgggctggcatttaagcacgaaatcaaagatagcgatcacgctgaacgcaattgcgctatgctacacgtgaggggcctgatcagcgatcagtgcggaagttcccgaattatcgtgtcaatttcatttagaattaaagccttagagcttgccgtccatcaaattaagttttatatttgcagcaaccggaacgacatcatgatcgcctag

SEQ ID NO: 227755 - DNA, 723 bp, Artificial Sequence
  Description of Artificial Sequence: Synthetic coding sequence
atgtcaaaacagaggggtactttcagtgaggtatccctggctcaagatcctaagtggcaacaacgcaagccgaaaggcaataaatcaagcatatctggcacagagcaggagatctttcaggttgagctcaacctccagaatgcaagcctcaaccatcagggcattgacaagatctacgactgtcaaggtttgctgccgccacccgagaaactcacggctgaggtcctggggattatttgtatcgttctcatggccacagtcctgaagactatcgtcttgattcctttcctagaacagaataacagctccccaaatacccgcacacagaagacgcgacattgcggacattgtcccgaggagtggatcacgtactcaaactcatgttactatataggaaaagagagaaggacgtgggaggagtctcttcaagcctgcgcctctaagaattcatcaagtctcttgtgtatcgacaatgaagaggagatgaaattcttggcgtccatcctgccgtcgtcatggataggcgtctttcgcaacagctctcaccacccctgggtaaccatcaatggtctcgcatttaagcacgagatcaaggactcggaccatgccgagcggaactgtgccatgttacacgtccgaggacttatatccgaccaatgtggctcatccaggatcatccgtagagggttcatcatgcttactagactcgttttgaattcatag

SEQ ID NO: 227756 - DNA, 723 bp, Artificial Sequence
  Description of Artificial Sequence: Synthetic coding sequence
atgagcaagcagcgtgggacattttccgaagtctcacttgcacaagacccaaagtggcaacagcggaaacctaagggtaataagtccagcatttcaggcacagagcaagaaatattccaagtcgaattgaatcttcagaatgccagcctgaaccatcagggcattgacaagatttacgactgtcagggtttgttgccgcctcctgagaaacttacggctgaggtgctcggtattatttgtattgtactgatggcgacagtgctgaagaccatcgtgctgatcccatttttagaacaaaacaacagcagtccaaacgcacggacacagaaggctagacattgcggacattgtccagaggaatggattacttattctaattcttgttactacattggcaaagagagaagaacgtgggaagagagcctccaagcgtgcgcaagcaagaacagctcatctcttctgtgcattgacaacgaagaggaaatgaagttcctagcttccatattgccgagttcttggataggagtattccgcaacagttctcatcatccttgggtaaccattaacggcctggcattcaaacatgaaatcaaggacagcgaccatgccgagaggaactgcgcaatgctgcacgttcggggtctaatatccgaccagtgcggatcctcccgtattattaggaggggtttcatcatgctgacccggttagtgcttaattcttag

SEQ ID NO: 227757 - DNA, 477 bp, Artificial Sequence
  Description of Artificial Sequence: Synthetic coding sequence
atgaacaagcagcgaggtacatacagcgaggttagtttggcacaggaccccaagaggcaacaaaggaaattaaagggtaacaaaatctcaatctcagggactaagcaggagatcttccaggtggagctgaaccttcagaacgccagttctgaccatcaagggaacgataagacgtatcattgcaagggactcttgccccctcctgaaaagcttacagccgaggtactggggatcatttgcatcgttttaatggctactgttctgaagaccatcgtactgattccctgcatcggagtgttggagcagaacaacttttctcttaatagaagaatgcagaaagcccgtcattgcggccactgtcccgaagaatggataacgtacagtaactcttgctactacattggaaaggaacgccgtacatgggaggaaagagtgtgctggccagttctgaggagaaccttaatatgctttctttag

SEQ ID NO: 227758 - DNA, 540 bp, Artificial Sequence
  Description of Artificial Sequence: Synthetic coding sequence
atggcagtgttcaagacgaccctctggaggctcatcagtggcacactcggaataatttgcctgtcactaatgagcaccttgggaattttgctgaaaaatagcttcaccaaattgagcattgaacccgctttcacccctggcccaaatattgagcttcagaaagacagcgattgttgtagctgtcaagagaaatgggttgggtatcgctgcaattgctattttatcagttcagaacaaaagacttggaatgagtctcgccacctgtgtgcttctcaaaagtcttccctgctccaactgcaaaacacagatgagctcgacttcatgtcgagctcccagcaattctattggattggcctgagttatagcgaagaacacactgcctggctatgggagaacgggtccgctctctcccagtatcttttccccagctttgaaaccttcaacacgaagaactgcatagcctataaccctaatggcaacgcactggacgaaagctgcgaagacaaaaaccggtacatttgcaaacagcagctgatttag

SEQ ID NO: 227759 - DNA, 447 bp, Artificial Sequence
  Description of Artificial Sequence: Synthetic coding sequence
atggcagcctttacaaagctttctatagaacctgcctttaccccgggtcccaatatcgagctgcaaaaggattccgattgttgctcctgccaggaaaagtgggttggataccgctgtaattgttatttcatctcctccgagcagaagacctggaatgaatccagacacctgtgcgcctcacagaaaagtagtctcttgcagttgcagaatacagacgaattggatttcatgtcgtcatcacaacaattctactggattggactctcctactcagaagaacacaccgcctggctctgggaaaacgggtccgccctaagccagtacctgtttccctcattcgaaaccttcaacacgaaaaactgcatcgcatataaccctaacggcaacgccctcgacgaatcttgtgaggacaagaaccgctatatctgcaagcagcaactcatctag

SEQ ID NO: 227760 - DNA, 540 bp, Artificial Sequence
  Description of Artificial Sequence: Synthetic coding sequence
atggccgtttttaagactacgctgtggcgacttatctccgggacactggggatcatttgcctgtctctgatgagcaccctgggtatactactgaagaactccttcaccaaattgtcaattgagcccgctttcacccctggaccaaatattgaactacagaaggactccgattgctgttcctgccaggaaaagtgggtgggctatcgttgcaattgctacttcatatcttcagagcaaaaaacttggaatgagtctaggcatctgtgcgcttcccagaaatcaagtctgctgcagcttcagaatacagacgaactggacttcatgagctccagtcaacagttctattggattggattgagctactccgaggaacacaccgcgtggttgtgggagaacggatccgccctctcccagtacttgttccctagcttcgagacttttaataccaaaaactgcatcgcttataatccaaatgggaatgcactggatgaatcttgcgaggataagaaccggtacatctgtaagcagcagctgatctag

SEQ ID NO: 227761 - DNA, 543 bp, Artificial Sequence
  Description of Artificial Sequence: Synthetic coding sequence
atggcagttttcaaaactactttgtggcggttaatttcaggaacactgggaataatttgcctgagcctgatgagcacactgggtattctgttaaaaaattcctttacaaagctgagcatcgaacctgcgtttaccccagggcctaatatagagctccaaaaagacagtgactgttgtagttgtcaagagaaatgggtcgggtaccgttgtaattgctactttatcagcagtgagcagaagacctggaatgaatcccggcacctgtgcgcttctcagaaatctagtttactccagctgcagaacaccgacgagcttcaggatttcatgagctcatctcagcagttctactggatcgggctttcatactcagaggagcacacggcatggctatgggagaacgggagtgccttgtcccagtacttgtttcctagcttcgaaacattcaacacaaagaactgtattgcctacaatcctaatggaaacgctctcgatgaatcatgtgaagacaaaaaccgttacatctgtaagcagcaactgatatag

SEQ ID NO: 227762 - DNA, 156 bp, Artificial Sequence
  Description of Artificial Sequence: Synthetic coding sequence
tccgcattgtcacagtacctcttcccgtctttcgagacatttaacacaaagaactgtatcgcttataaccccaatgggaatgctctggacgagtcctgtgaggataagaaccgctatatctacaaagtgctgctgtgctgccccggatggtcgtag

SEQ ID NO: 227763 - DNA, 420 bp, Artificial Sequence
  Description of Artificial Sequence: Synthetic coding sequence
atggccgcatttacgaagctatctatcgaacccgcattcactcccggtcccaacatcgagctgcagaaggatagcgattgttgtagctgtcaggaaaagtgggtgggctatcgctgtaattgctactttatttctagcgagcaaaagacctggaacgagtctaggcatctgtgtgcatcccaaaagagcagccttttgcagcttcaaaacactgacgagctggactttatgagctccagccaacagttctactggatcgggctgtcttacagcgaagagcatacagcatggctgtgggaaaacgggtccgcactttcgcagtacctcttcccatcttttgaaacttttaacactaaaaattgtatcgcctacaatcctaatggcaacgcgctggatgagtcctgcgaggacaaaaattag

SEQ ID NO: 227764 - DNA, 699 bp, Artificial Sequence
  Description of Artificial Sequence: Synthetic coding sequence
atgcaggatgaggaacggtatatgacccttaacgtgcagtccaagaagagatcatctgcacagacttctcagcttacctttaaggattatagcgttaccctgcattggtacaagatcctgttagggattagtggcaccgtgaacggcattctgaccctgacccttattagcctaatcctgctggtgtcccagggcgtgctgctgaagtgccagaaggggagctgcagtaatgccactcagtacgaagacactggcgatctgaaggtcaacaacgggacccgcaggaatatttccaacaaggatttgtgtgcttccagaagtgcggaccagacagtactttgtcaaagtgagtggttaaagtatcagggaaaatgttgctactggttctctaacgagatgaagagctggtccgatagttacgtgtactgtctggagcgcaagagccatttactgattattcatgatcaactggaaatggccttcatccagaagaatctgcggcagctgaattacgtttggatcggtctgaatttcacttcgctaaaaatgacttggacatgggttgatggatccccaattgattctaaaatcttctttattaagggcccagccaaagaaaatagctgtgctgctattaaagaaagtaaaatcttttccgagacctgcagctccgtgttcaagtggatatgtcagtattag

SEQ ID NO: 227765 - DNA, 549 bp, Artificial Sequence
  Description of Artificial Sequence: Synthetic coding sequence
atgcaggatgaggagcgttatatgacgctgaatgttcaatctaagaagcgatcatccgctcaaacctcccaattgacctttaaggattattcagtgacattacactggtacaaaatactccttggaatctccggaactgtgaatgggatcttgacactgaccctgatatccttgattctgctcgtgctgtgtcagagtgagtggctgaagtaccaggggaagtgctgttactggttctctaatgaaatgaaaagttggtccgactcatacgtgtattgcctggaaaggaaaagccacttgctgattattcacgaccaactggaaatggccttcatccaaaaaaaccttcggcagttaaattacgtttggattggcctgaacttcacatcacttaagatgacctggacctgggtggatggctcacccatcgattcgaaaatcttcttcatcaaaggtcctgcgaaggaaaactcgtgtgcagctatcaaagagtccaagatctttagcgagacctgcagcagtgtcttcaagtggatctgccagtactag

SEQ ID NO: 227766 - DNA, 195 bp, Artificial Sequence
  Description of Artificial Sequence: Synthetic coding sequence
atgcaggatgaggaaaggtacatgactctgaatgtccaaagcaagaaaaggagtagcgcgcagaccagtcagctgacgttcaaagactatagcgtcaccctgcattggtacaaaatcttgctgggaatcagcggcaccgtcaatggcatactgacacttactctgatctcactcattctgttagattcctcttag

SEQ ID NO: 227767 - DNA, 588 bp, Artificial Sequence
  Description of Artificial Sequence: Synthetic coding sequence
atgaccgatagcgtgatctactccatgctcgaactgccaacagcgactcaggcccagaatgattacggccctcaacagaagtcatcgtcttccaggccctcctgttcttgcttagtggctatcgccttaggtctgctgaccgctgtcttattgagtgtcctactataccagtggattctgtgtcaaggctcaaattacagcacatgtgccagctgcccaagttgccccgaccgctggatgaaatatggcaatcactgttattacttctccgtggaggagaaggactggaattctagtctcgagttttgtctagcacgggatagtcacctcttggtgatcacagacaaccaggagatgtctctgctccaggtcttcctgtctgaggccttctgctggatcggcttacggaacaactccgggtggaggtgggaagacggttcccccctgaacttcagcaggattagctctaactcttttgtgcagacatgcggtgccattaataagaatggcctacaggcttccagttgcgaggtgccgctgcattgggtctgcaagaagtgtccctttgccgatcaggccttgttttag

SEQ ID NO: 227768 - DNA, 570 bp, Artificial Sequence
  Description of Artificial Sequence: Synthetic coding sequence
atgaccgatagcgtcatttattccatgttagagctgccaaccgcgacacaggctcagaacgactacggaccgcagcagaaaagctccagctcacggccaagctgttcctgcttggtggctattgctctgggtctgttgactgccgttcttctatctgtcctgctttatcaatggattctgtgccagggctccaactacagcacatgcgcctcatgtccatcctgtcccgatcgctggatgaaatacggtaatcactgttactatttcagcgtggaggaaaaagactggaattcatcactggagttctgtctagccagggacagtcatctcctggttatcaccgataaccaggagatgagccttcttcaggttttcctgtccgaagccttctgctggatcgggctgcggaacaattccggctggaggtgggaggatggcagccctcttaatttttcgcgtatcagcagcaattcctttgtgcagacatgcggagcaattaataaaaacggcttgcaagcgagttcctgcgaggtgccactgcactgggtgtgcaagaaggtccggctgtag

SEQ ID NO: 227769 - DNA, 651 bp, Artificial Sequence
  Description of Artificial Sequence: Synthetic coding sequence
atgggttggatccgagggaggcgatcccggcactcctgggagatgagtgagttccataactacaatctggacttgaagaagtctgacttttcaacacggtggcagaagcagcgttgtccggtggtgaagagcaagtgccgcgaaaacgcctctccattttttttctgttgcttcattgctgtagcgatgggcattcgcttcatcataatggtgaccatatggtcagccgtcttcctcaattccctcttcaaccaggaggtgcagatcccacttactgagtcctattgcggcccatgtcccaaaaattggatctgttacaagaataactgttatcaattttttgatgaaagcaaaaactggtacgagtcccaggcttcatgtatgagtcagaacgcatctctcctgaaagtgtatagcaaggaggatcaggatctcctaaagctcgtcaaaagctaccactggatgggcctcgtgcacattccaaccaatgggtcttggcagtgggaggacggaagtatcctgtcgcccaatctgctgaccattatcgagatgcagaaaggcgactgtgccttgtatgccagctcgttcaagggttatatcgaaaattgtagcacccctaacacgtacatatgcatgcaacggaccgtgtag

SEQ ID NO: 227770 - DNA, 243 bp, Artificial Sequence
  Description of Artificial Sequence: Synthetic coding sequence
atgggctggatacggggacgcagatctcgtcattcgtgggagatgagcgagttccacaattacaacttggatctgaaaaagtccgacttctccaccaggtggcagaagcagaggtgccctgtcgtgaagagtaaatgcagagaaaatgccagccccttttttttctgttgcttcattgctgtagccatgggcattagattcatcatcatggtaaccatttggagtgctgtgtttctcaactag

SEQ ID NO: 227771 - DNA, 651 bp, Artificial Sequence
  Description of Artificial Sequence: Synthetic coding sequence
atgggttggatccggggaaggcgtagcaggcacagctgggaaatgagcgagtttcataattacaatttagatctgaaaaagtctgacttttccacaagatggcagaagcagagatgccccgttgtgaagtcaaagtgccgggaaaacgcttcgccatttttcttctgttgttttatcgctgtcgccatgggaatccggtttattatcatggtgaccatctggtcagctgtgttcttgaactctctgttcaatcaggaagtccagatccccctcaccgagagctattgtgggccttgccccaagaattggatctgttacaagaacaactgctaccagttttttgacgagtccaagaattggtacgaatctcaagcaagctgcatgtctcagaacgcgtctctgctgaaggtctactctaaggaagaccaagatcttctgaagcttgtcaaatcataccactggatggggcttgtgcacattccaacaaatggttcctggcaatgggaagacgggagtatactgtcacctaatcttctgacgatcattgagatgcagaagggggattgcgccctgtacgccagtagcttcaagggttacatcgagaactgctcaacaccgaatacatacatctgtatgcaaagaacggtttag

SEQ ID NO: 227772 - DNA, 537 bp, Artificial Sequence
  Description of Artificial Sequence: Synthetic coding sequence
atggaccgcccagggcctggcagcgccagaccagggaggaccgtgcacgtatgggggtaccgcgtggagtggaaggtcagaaatggacgaaaactgcagccctcagaatgggccggaagaggggatctgggaggctttaagcgcaggtggaaggacacaagggcaactgtggggactacttttaggagacgctctcgtgtgtcactggttggtgagctgagtaaattccccctgccaagcgactccagcggaggaaaatcaagctcttcttttgcccgaggcgctcttgcttggtgccgacaaaggaacccaaacccgtcatgtgccgctgctgaaaccggcgctcggacatctctgcctaaggagcggtgcaggggatggagactagggaactggctccacaagcacccacatccaaacacttgccccaggctgccggcatgttggttaccgccaatattaacagaacgcggagagcgggtgcccaaactggtgccattattggcctgctaccctaagtctaagcctaaagactag

SEQ ID NO: 227773 - DNA, 1902 bp, Artificial Sequence
  Description of Artificial Sequence: Synthetic coding sequence
atgctgcggatgagagtgcccgctctgctcgtgttgctgttctgttttcggggtcgcgcagggccatctccacactttctgcagcagcccgaagatctggttgtgctgttaggcgaggaagcgaggcttccatgtgctctgggcgcttattggggacttgtccagtggactaagagcggcctcgccctggggggacagcgggatctaccagggtggagccgctattggatctccgggaacgcagctaatggccagcacgatctccacatacggcctgtcgaactggaggacgaggcgagctatgaatgccaggctacccaggcaggtttgagatcaaggcctgcacagttgcacgtgctggttccccctgaagctcctcaggtgctgggcggaccttcggtgtcactggtggccggtgtgccagcgaatctgacctgtaggtccagaggcgatgctcgtccaacacctgagctgctgtggtttagggatggagtcctgttagacggggcaactttccaccagactctcctcaaagagggcacgccaggcagcgtggagagtacactgaccctcacaccatttagccacgacgatggtgccaccttcgtatgccgggctcgaagccaagcactgccaaccggacgggatactgccatcaccctgagcctacaatacccacctgaggtgactctatcggccagcccccacacagttcaggaaggcgagaaggttattttcctgtgccaggccacagcccagcctccagtaacggggtaccggtgggccaaaggaggatcccccgtgcttggagcaaggggtccaaggttggaagtggtagccgatgcctccttcctgaccgaaccggtgagctgtgaagtgtccaacgctgtgggatctgccaataggagtaccgcccttgacgtcctgttcggccctatcttgcaggctaagcctgaacccgtatctgtcgacgtgggagaagatgccagcttctcctgcgcgtggagaggaaacccccttccgagggtgacctggacccgtcggggaggggcacaggttctgggtagcggcgctactctgaggcttccatccgtgggccctgaagacgccggtgattacgtttgtcgcgcagaggcaggtctgagcggcctccggggaggcgcagccgaagctcgcctgacagttaatgctcccccagttgtgactgcactacatagcgctccagcttttttgagaggcccagctcgcctgcaatgtctcgtgtttgcatcccctgctcctgacgccgtggtgtggagctgggacgaggggttcctggaagctgggtcacagggccgattcctggtcgagaccttccccgcacccgaaagccggggaggcctgggacccggtttaatctccgtcctgcacataagcggaacacaggaatccgatttttccagaagcttcaactgtagcgcgcgtaatagactcggagaggggggtgcccaggcctctctaggtcgccgagatttgctaccaacagtgagaatcgttgccggtgtcgccgctgcaacgaccacactgctgatggtgatcacaggagtggccctttgctgctggcgccactccaaggcctcagctagctttagtgaacagaagaatctgatgcgcattcccggatcttccgacggatccagttccagaggacctgaagaggaagaaacaggctctagagaagaccggggtcccatagttcacaccgaccacagcgatctggtgctagaagagaagggcactttggaaaccaaagaccccaccaacggttactacaaggttagaggagtcagtcctcctgcttcccctgattcacgcgtgacctctttccagtggaagtcccctggcattagcaatctcccctag

SEQ ID NO: 227774 - DNA, 660 bp, Artificial Sequence
  Description of Artificial Sequence: Synthetic coding sequence
atgctgcgaatgcgcgttcctgcattactggtgctcctgttctgcttccgaggtcgcgctggcccatccccccacttcctgcagcagcctgaggacctggtggtgctccttggagagggcggtgctcaggctagtctcggaaggagggctagcgccagctttagtgagcagaaaaatctaatgaggattccaggatctagcgacggctcctcaagccgaggacccgaggaggaggaaacgggttctcgagaggatcgcggacctattgtccatacagatcatagcgacttggtactggaagagaagggcactctcgagacaaaagaccccactaacggatattacaaggttcggggtgtgagcgtttctctctccctaggcgaggccccaggaggtggcctctttttgccccctcccagtcccctgggacccccaggaacaccaacattctacgacttcaaccctcaccttggcatggtgccaccttgccggctttaccgagctagggccggttacctgacgaccccgcatcctcgagctttcacatcttatatcaaaccaacatcctttggacccccagatctggctcccggaacacccccatttccctacgccgcattcccaaccccctcccatcctcgattgcagacacacgtgtag

SEQ ID NO: 227775 - DNA, 2067 bp, Artificial Sequence
  Description of Artificial Sequence: Synthetic coding sequence
atgctacgcatgagagtccctgccctgctggtgctgcttttttgtttccgtgggagggccggaccttctccacatttcttgcagcagccagaggacttagtggtgctgctgggagaagaggctaggctgccgtgcgccctgggcgcttattggggactcgtccagtggacaaaatcagggctcgcgctcggcggacaaagggacctgcccggatggagccgatattggattagcggcaatgcagccaatggccaacacgacctgcacatacgtcccgtagaacttgaggatgaggcaagctatgagtgtcaggctacccaggccggactgcgtagtcgacccgcacaacttcacgtgttggtgccgccagaagcaccacaggtcctagggggaccttccgtttcactcgtggctggcgtccctgcaaatctcacatgccggtctcgaggcgacgccaggccaacaccagagctcttatggttccgcgacggagtgctgctggacggagccacattccaccaaactctgctcaaagagggaacccccggaagcgtcgagtctaccctgacccttcccaccgggcgagataccgcgatcaccctatccctgcaatatccacccgaggtgaccttgtcagcctccccacataccgttcaagagggagagaaggtcatcttcctttgtcaagcgactgcgcagccgcctgtgactggctatcgatgggccaagggcggatctcccgtgctcggagcccgtggcccaaggcttgaagttgtcgcggatgcttcattcctcacagaacccgtttcatgtgaggtctccaatgcggtgggcagcgccaatcgctccaccgcattagacgtcctgttcggccctattctgcaggcaaagcctgaacccgtaagcgtggacgtcggcgaggacgcatcgttttcttgcgcctggagaggaaatcctctgcctcgagttacatggaccaggcggggaggggcacaagtgctgggcagtggggcaactcttcgcctgccttctgttggcccagaggatgctggagactacgtgtgtcgtgcagaagcgggactgtccggtctgagggggggtgccgctgaggcccgtctaaccgtgaatgccccacccgtcgtgactgcacttcacagtgccccagcatttcttagaggacctgcaaggttacagtgcctggtcttcgccagcccagcgccagacgctgtggtatggtcttgggacgagggatttctggaggctgggtcacaggggaggtttctggtggagacgtttccggcaccagaatctaggggaggactcgggccagggctaatttctgtattacatataagtgggacgcaggagagcgactttagcaggtccttcaactgttcggctaggaaccgcctgggggaaggtggggctcaggccagtctaggcaggagagatcttctccccactgtgagaatcgtcgctggggtggcagccgctactactaccctgctgatggtcattacaggcgtggcattatgctgctggagacactcaaaagcgtcagcctccttctcagaacagaagaatctgatgaggattccagggagctctgacggaagttcctccagggggccagaagaagaggagaccggtagtagggaggatagggggccaattgtgcatactgatcactctgacctggtccttgaagaaaaaggcacccttgagaccaaagatcctacaaacggatactataaagtgcgcggagtgtcagtcagcttgtcattgggtgaagcgcctggcggaggactgtttctcccacccccttcgcctctgggcccacccggaacccctactttctacgattttaacccacacctgggaatggttcccccttgtaggttgtatagagctagagccggttacctgactacaccacatcctcgggcattcacctcttacatcaagcctacgtccttcgggccacctgatctggcccctggcacgcccccttttccgtatgccgcatttcctaccccatcacaccctcggttacagacccacgtatag

SEQ ID NO: 227776 - DNA, 1752 bp, Artificial Sequence
  Description of Artificial Sequence: Synthetic coding sequence
atgttacggatgagggtgccagccctcctggtcttgctcttctgcttccggggacgagctggctggtctcgctactggatcagtgggaacgctgccaacggccagcacgatcttcacatccggccagtggagcttgaggatgaagcatcctacgaatgtcaggcgacacaggcaggactccggagccggcctgcccagttacatgtgctggtacccccagaagcccctcaagtcctaggcggaccgtcagtgtccctcgtggcaggagtacctgccaaccttacctgtaggtcgcggggtgatgctagaccgacgcccgagctgctttggtttagagatggggtgctcctggatggcgctacctttcaccagactttgctcaaggagggaacacccggatctgtggagagcacattgacactcactccatttagccatgacgacggtgcgacattcgtgtgcagggcacgctctcaggccctgccaacaggcagggacaccgccatcaccctgtctcttcagtatcccccagaggtgactctcagcgcttcaccacatacggtccaggagggcgaaaaggtgatctttctatgccaggccaccgcacagccccctgttaccggataccgatgggcaaagggaggatcaccggtgctcggggcacgcggacctagactggaagtggtggccgatgccagttttctgacagagcccgtatcttgcgaggtgagcaatgccgttggcagtgctaacagatcaacggctctcgatgtcttgtttgggcctatccttcaggccaagcccgaacctgtgagcgtggatgtgggcgaagatgcttcattctcatgcgcctggcgcggaaatcccctcccccgagtgacttggacgagacgagggggagcacaggtgctggggtctggcgctactcttcggctgccatcagtaggacccgaagacgctggtgactatgtatgtcgagccgaagcgggtttgagcggcctacggggtggcgctgccgaggcacgtctaacagtaaatgcccctccagtcgtcaccgcccttcatagcgctccagccttcctgaggggaccggctcgtttgcaatgcctagtatttgcctcaccagcgcctgacgccgtggtctggagttgggacgaaggttttctggaggcagggtctcaaggaaggttcctggtagagacatttccagccccagagtctcgcggagggttgggacccggtctgatttccgtccttcatatctcagggactcaggagtccgatttcagtcgctcattcaattgcagcgcccgaaatcgactgggtgagggaggtgcacaggcctcactggggaggagggacttgctccctactgtgcggatcgtggcaggcgtcgcagcagccacgacaactcttctgatggtgattaccggcgtcgcactatgctgctggaggcactccaaggccagtgcctcattttcagaacagaagaacttaatgcgtatcccgggatcttcggatggaagtagttctagagggccagaggaggaagagacaggcagcagggaggatcgtggacctatcgtgcataccgatcattcagaccttgtgctcgaagaaaagggcacactggaaacaaaagatcccaccaatgggtactacaaggttagaggagtgagcccacccgcatctcctgatagcagagtgacctcttttcagtggaagtcgcccggtatttctaacctcccatag

SEQ ID NO: 227777 - DNA, 2127 bp, Artificial Sequence
  Description of Artificial Sequence: Synthetic coding sequence
atgctccgcatgagagtgccggcacttcttgtccttcttttctgttttagggggagagctggcccttcccctcactttctccagcagcctgaagacctagtagtcctgctgggagaggaggctcgcctgccctgtgccctcggagcttattgggggctggtgcagtggaccaaatccggacttgctctgggcggacagcgcgaccttcctggttggtctcgctactggatttcaggaaacgcagccaatggacagcatgatctccacattagacccgtcgagctggaggatgaggcatcatatgagtgccaggctacccaggcgggtttgcgctcgagacctgctcagctccatgtgttagttcctcctgaagcccctcaggtattgggcggaccaagcgtatctttggtcgctggagtgcccgcaaacctcacttgcaggtcccgaggcgacgctagacctacccctgaactcttatggttccgagacggagtgctgctcgatggagccactttccatcaaactttactgaaggaaggcacgccaggatccgtggagtcaactctgactttgactccctttagccacgatgacggcgctacattcgtctgtcgggcaagaagccaggctctgcctactggtagagataccgccataaccctctctttgcaatatcccccagaggtgaccttatctgcctccccacatacagtgcaggagggtgaaaaggtcattttcctttgccaggccaccgctcaaccccctgtgactgggtatagatgggcgaagggcggaagccccgtcttgggcgctagggggcctcgactggaggtcgtggctgacgcctcgttcctgaccgaacctgtctcttgcgaggtgagcaacgccgttggcagtgccaaccggtccaccgcgctcgacgttctgttcggtccaattctccaggcaaaacctgaaccagtgagcgtggatgtcggcgaggatgcaagcttctcctgtgcgtggcgagggaatcccttgccaagggtgacatggacccggagaggcggtgcacaggtgctgggatcaggagctactttaagacttccaagcgtagggccagaggacgccggtgactacgtctgtcgggcagaagccggattatcaggtctgagaggaggtgcagccgaagccaggttgaccgtcaatgcccctcccgtggtcaccgccttgcacagcgctcccgcttttctgaggggacctgccaggctgcagtgcttggtgttcgcaagccctgcaccagacgcagttgtgtggtcttgggatgaaggattcttggaagcaggttctcagggacgtttcttagtggaaacattccccgctccagagtccagaggagggttaggcccaggtctgatatccgtgttacatatttctgggacgcaggagtccgattttagcaggagctttaattgctctgcccgaaatagactgggggagggaggcgcacaagcaagcctgggacgcagggatctgttacctacggtccggatcgtcgcaggggtggctgcggctactacgaccctccttatggtgataacaggtgttgccctctgctgctggcggcactctaaagcctctgcaagtttttcagagcagaaaaacctgatgcggattcctggaagtagtgacggaagctccagcagggggcctgaggaggaggaaacaggcagtagagaagaccgcggacccattgtgcacacagatcatagtgacctggttctggaggagaaagggacattagagactaaggatcctacaaatggctactacaaggttcgaggcgtgtcagtgtctctgagcttgggagaggctccaggcggtggcttgtttttaccacccccaagccctttgggcccacccggtactccaactttttatgacttcaatccccaccttggcatggtgcctccctgtaggctatatcgtgccagagcaggttacctgactaccccgcaccctcgcgctttcacaagctacatcaaacccacttcctttggacccccagacctggccccaggtactcctcccttcccgtacgcggcatttcctaccccaagccaccccaggctccagacgcacgtttag

SEQ ID NO: 227778 - DNA, 738 bp, Artificial Sequence
  Description of Artificial Sequence: Synthetic coding sequence
atggcggtgatcataggcgtggctgtgggggctggtgtagcctttctcgtgctcatggccacgatcgtcgctttctgctgtgctaggtctcagcgaaatcttaaaggggttgtcagtgcgaaaaatgatatcagggttgagattgtgcataaggaaccagcctcaggacgggagggtgaagagcactcaacaataaaacagctgatgatggaccgtggagaattccaacaagattcggttctgaagcaactcgaggttcttaaggaggaggaaaaagaattccagaatttgaaggatccaactaatggctattactctgtgaatacattcaaagagcaccattcaacacctaccattagcttgtcctcctgccagcccgaccttcggccagcagggaagcaacgcgtccccaccggtatgagcttcactaacatttactctactttgagtggtcagggcagactttacgactacggccagcggttcgtcctcggaatgggctctagctccatcgaactttgtgaaagagagtttcagcgcggaagcttatccgattcaagctcctttctcgatactcagtgtgattcatccgtcagtagttcgggaaagcaggatggttatgtacagtttgataaggcctccaaagcctccgctagcagtagccaccactctcagtcatccagccagaattcagacccatccaggccactgcagagaagaatgcaaacccatgtgtag

SEQ ID NO: 227779 - DNA, 2337 bp, Artificial Sequence
  Description of Artificial Sequence: Synthetic coding sequence
atgaagcctttccagctggatctcctgtttgtgtgcttcttcctgttctcacaggagctgggcctgcaaaagcggggttgctgcctggtgctgggatatatggcaaaggacaagttcagacgcatgaatgaggggcaggtgtacagtttttctcagcagcctcaggatcaggtcgtggtttctggacagccagtcaccctcctgtgcgccatccctgagtatgatgggtttgtgttgtggattaaagatggactcgcacttggtgttggacgtgacttaagcagctatccccaatacttggttgtgggcaaccacctgtccggggagcaccacctgaagattctgcgcgctgagctgcaggacgacgcagtgtatgagtgtcaagcgatccaggccgctatccgcagtcgacccgctcggttgaccgtgctggttcctccagatgatccagtcatcttgggaggcccagtcatctcccttcgagcaggggaccccttgaatctcacatgtcacgcagataatgctaagcctgcagcgtcaatcatatggctccgtaagggcgaagtcataaacggagcgacatactctaaaacactgctccgcgacggtaaacgggagagtatcgtcagcaccttgttcatatctcccggagatgtagagaacggacagtcaattgtatgcagggcaactaacaaagccattcctggaggaaaggagacctcagtgacaattgacatccagcatcctccactggtgaatctgtcagtggagccgcagcccgtcctcgaggacaatgtggttacttttcactgctctgccaaagccaatcctgctgtgacccagtaccggtgggccaaaagagggcaaatcatcaaagaggccagcggcgaagtctatagaaccactgtcgactatacttacttctctgaacctgtctcgtgcgaggtgactaacgccctggggagcactaacctgtctcgcacagttgatgtctacttcgggccacggatgacaacggagcctcagtctttgcttgtcgacctgggcagtgacgcaatcttcagttgcgcgtggacagggaatcctagtcttaccattgtttggatgaagcgaggaagcggcgtggtgttatctaacgagaaaacacttactttgaagtctgtcagacaggaagacgccggaaagtatgtatgtcgcgctgttgtacccagggtgggggctggggaacgcgaagtaactctcacagtcaatggtcctcccatcatatcaagcactcagactcagcatgctctccacggcgagaaagggcaaattaaatgttttatcagatcgaccccccctcccgatcgtatcgcctggtcatggaaggagaatgtcttggagagtggaacctctggtcgttatacagtcgagactatcagcactgaagaaggggtaatcagcacactgacaatctcgaacattgtccgcgcagactttcaaaccatttataactgtactgcatggaatagctttggctctgacactgagattattagattaaaagagcaaggatctgagatgaagagcggtgcaggactggaagccgagtctgtgcccatggcagtcattatcggcgtcgcagttggggctggtgtcgccttcctggtgctaatggccacaatcgtagctttttgttgtgcccgaagccaacgtaatttgaagggggtggtgtccgccaaaaatgatataagagtcgaaattgtacacaaggaacccgctagtggcagggagggagaggaacactcgactatcaagcaactcatgatggaccgcggagagttccaacaagacagcgtgctcaaacaactcgaagtcctcaaggaagaggaaaaggagttccagaacctaaaggatccgactaatggatattacagtgtgaacacttttaaagaacaccactccacgcccacaatctccctgtcctcttgccagcccgacctaagaccagccggtaagcagagagtccctacgggaatgagcttcaccaatatctacagtacactcagtggacaaggtcggctttatgattacggccagcggttcgtgttggggatgggttcctcctctatcgagctgtgcgaacgagaattccaacgaggttcactgagcgatagcagctctttcctggacacgcaatgtgacagttcggtgagctcaagtgggaagcaggacggatacgttcaattcgataaggcgtcaaaagcgtctgcgagctcatcgcatcactctcagtcttccagccagaattccgatcctagtcggccactgcagcggcgtatgcagacacatgtttag

SEQ ID NO: 227780 - DNA, 1803 bp, Artificial Sequence
  Description of Artificial Sequence: Synthetic coding sequence
atgaagccctttcagctcgatctcttgtttgtgtgtttctttctcttcagccaagaactggggttgcagaaaaggggctgttgcttagtgctggggtatatggctaaagacaaatttcgacgaatgaatgagggacaagtctactctttctcgcaacagccgcaggaccaggtggtcgtgtcaggccagccagtcaccctgctatgcgcaatacctgagtatgacggatttgtgttatggatcaaggacggactcgccctaggtgtgggacgcgatctcagcagttacccacagtatttggtggtcggcaaccatctttccggtgagcatcacctgaagatattacgcgcagaactgcaggatgacgctgtatacgagtgccaggcaattcaggctgccattaggagcagacccgctcggctcaccgttctggtgccccctgacgatccggtgatcctcggcggacccgtcatttctttacgagcgggagatcccttgaacttaacatgtcacgccgataatgcgaagcccgctgctagcataatttggctgcggaaaggagaggtgataaatggcgcaacctattcaaagactctgctgagggatggcaaacgggaaagcattgtgtcgaccctcttcatcagccccggagacgtcgaaaatggccaatctatcgtatgtcgggcaaccaataaggcgatcccaggcggtaaggagacaagcgtgaccattgacatccagcaccccccactggtcaacctgagcgtcgaaccccagcctgtgctggaggataatgttgtgacattccactgttcggccaaagcaaacccagccgtaactcagtatcgctgggctaaaagaggtcaaattatcaaagaagcatccggggaggtgtatagaacaactgtggattacacttatttcagtgaaccagtgagctgcgaggtgaccaacgccctgggcagcacaaacctgagtcggactgtcgacgtttattttggcccaagaatgactacggagccacagagcctcctcgtggatttaggaagtgatgccattttttcctgcgcctggaccggcaatccttctctgactatcgtgtggatgaagcgcggtagtggcgtcgtgctgtcaaacgagaaaacacttacactcaagagcgtcaggcaggaggatgcaggcaaatatgtctgccgggctgttgtgccacgggtcggagccggtgagcgggaggtcactctgactgtcaatggtccccctatcatctccagtacacagactcagcacgctctccacggtgagaaaggacagataaaatgcttcatacgttctaccccccctcccgataggatcgcctggagctggaaagaaaatgtactcgaaagtggaacctcggggaggtacacagtggaaacgatttctactgaagagggggtgatctcaaccttgactatctcgaatattgtgagagccgacttccaaacgatctacaactgcaccgcctggaattcgtttggaagcgatactgagattatcagattaaaagagcaagggtcagagatgaaatccggagctggtctcgaggctgagagcgtgcccatggccgttataattggtgtggcggttggggcaggggtcgctttcctcgtgctaatggccactatcgttgcattttgttgtgctcgctcccagagaagcactggcggtaggagcgggatcagcggcagaggtaccgaaaaaaaagctcgtctgcgcctcccgaggagagcctcgaagcaggagtgtaatgaacaaggatcctag

SEQ ID NO: 227781 - DNA, 2301 bp, Artificial Sequence
  Description of Artificial Sequence: Synthetic coding sequence
atgaagccctttcagttagatctccttttcgtgtgttttttcctcttttcgcaggagctgggtcttcaaaagagaggatgctgtctggtgctgggttacatggcgaaggacaagttccgtagaatgaatgaaggccaggtgtattcctttagtcaacagccccaggaccaggtggtcgtgagcgggcaacctgtgactttactctgcgcaatccctgaatacgatggcttcgtgctttggatcaaagacggtcttgctctgggggtaggtagagacctatcctcttatccgcagtacctcgtggttggtaaccacctatctggagaacaccacctgaaaattttaagagccgaactgcaggacgacgcagtgtatgagtgtcaggctattcaggctgctattaggtcccgcccagcgaggctgacagtgctcgtgccaccagatgatcctgtgatactcggaggcccagttattagcctgcgggcaggagatccgttaaacctcacatgtcatgctgacaatgctaagcccgctgctagcattatctggctgaggaaaggtgaggtcatcaacggtgcaacctatagcaagacactcctcagagacggcaagagagaatccatagtctctactctgttcataagtccaggtgacgtggagaatgggcagtcaatagtctgtagggctacaaataaggctatacccggaggaaaagagactagcgtcacaatcgatattcaacatcccccactggttaatctgagcgtggagccccagcccgtactcgaggataacgtggtgacattccattgtagtgcaaaagctaaccccgctgtgacacagtatcgatgggccaagcgaggacagatcatcaaagaggcttcaggggaggtctatcggaccacagttgactacacatatttctctgaaccagtgagctgtgaagttaccaacgcactgggctcaaccaacctgagccgaacagtggatgtctactttgggcctcggatgacaactgagccccagtctttgcttgtcgatctgggctctgacgccattttctcctgcgcctggactggaaacccatctttgacaatcgtgtggatgaagaggggcagcggggtcgtgctatccaatgagaagactctgactctgaagtcagtgcggcaggaggacgctggcaagtatgtctgcagggcagtagttccccgtgtcggcgcaggagaaagagaggttaccctaacagtaaacggtccacccattatatcctctactcaaacacagcacgcattgcatggcgagaagggccagattaaatgttttattcgctccacccctcctccagacagaatcgcatggagctggaaggagaatgtactggagagcgggaccagcggaagatacacagtcgaaaccattagcaccgaagagggcgtgatctcaacgctgaccataagcaatattgtgcgggcagattttcagacaatctacaattgcaccgcatggaatagctttggatccgatacagagatcattcgtctcaaagaacaggagtctgtcccaatggcagtgataatcggggtggccgtaggggcaggcgtggccttcctcgtgctcatggcgaccatcgtcgcattctgctgtgccaggtcccaaagaaatcttaagggggtggtgagcgcaaaaaacgatattcgggtcgagatagtccacaaggagccagcgtccggtagagaaggcgaagagcacagcaccattaagcaacttatgatggaccgaggagaatttcagcaggacagcgtgcttaagcagctggaggttctgaaggaagaggagaaggaattccagaaccttaaagatccaaccaatggatattactctgtgaatacatttaaagagcatcacagtactccaaccattagtttgtcatcctgccagcctgatctgcgccctgccggaaagcagcgggtccccacaggcatgtcatttaccaacatctactccacgctctccggacaggggaggctctatgactacggacagcgctttgtgctcggcatggggtcctcctcaatcgaattatgcgagagggaatttcagagaggctccctgtcggactcttcctcttttctggatacacaatgtgacagtagcgtgagctcctccggaaaacaagatggatatgtgcagtttgacaaagccagcaaggcatccgcatcctcaagccatcattcccaatcaagtagccaaaattcagaccccagccggcctctccagcgtcggatgcagactcatgtttag

SEQ ID NO: 227782 - DNA, 1182 bp, Artificial Sequence
  Description of Artificial Sequence: Synthetic coding sequence
atggggaaaagcgactttctgacccctaaggccatcgctaacaggattaagtcgaaaggattgcagaagctgcgctggtactgccagatgtgtcagaaacagtgcagggacgagaacggtttcaagtgtcactgcatgagcgaaagccaccagcggcaactccttttggcgagcgaaaaccctcagcaatttatggactatttttcagaagaattccggaatgattttctggaattactgagaaggcggttcggtactaaaagggttcataacaacattgtgtataacgaatatatctcccaccgggaacatattcacatgaatgccacacaatgggagactctcaccgactttaccaaatggttgggaagagaaggactgtgcaaagtggatgagaccccgaagggttggtatatccagtacattgacagggaccctgaaaccatccgcagacaactggagttggagaagaagaaaaagcaagaccttgacgatgaggagaagactgctaagttcattgaagaacaagtgagacgcggtctcgaagggaaagaacaggaagttcccacatttaccgaattgtcacgcgaaaatgatgaggagaaggtcacctttaacctgtctaagggtgcatgctcatccagcggtgccacctcttctaagtcttctacactcggccctagcgccctgaagacaatcggaagtagcgccagtgtgaagagaaaggagtcttcgcaatctagtacccaaagcaaggagaagaagaaaaaaaaaagcgcactcgatgagattatggagatagaggaagagaagaagagaacagccaggacagattattggttgcaacccgagatcatcgtgaaaatcatcaccaaaaagctgggcgagaaatatcacaagaaaaaagctatcgtgaaagaggtgattgataagtacacagctgtggtaaaaatgattgactccggcgacaagctaaaactcgaccaaacacacctggagacagtgattcccgcacctgggaagagaatcctggttctaaatgggggttatcgaggcaatgagggaacactagagagcatcaatgagaaaacctttagcgccacaatagtgatcgagaccggcccacttaaggggaggcgcgtggagggcatccagtacgaggatattagcaagctggcctag

SEQ ID NO: 227783 - DNA, 1125 bp, Artificial Sequence
  Description of Artificial Sequence: Synthetic coding sequence
atgggaaagagtgactttctcacacccaaggccattgctaaccgaatcaaaagtaagggcctccaaaaacttcgttggtactgtcagatgtgccagaagcaatgtcgtgatgagaatggctttaaatgccactgtatgagtgaaagtcatcagcgacagctcctgttggcatccgagaacccacagcagtttatggattacttctctgaagagttccgtaatgattttctcgaactgcttaggcgaaggtttggtacaaaacgtgttcacaataacatcgtgtataatgagtacatttctcaccgtgaacatatacatatgaatgctacacaatgggagacactgaccgacttcactaagtggcttggtagagaggggttgtgcaaggtggatgaaacaccgaaaggatggtacatccagtacatagacagagaccctgaaaccatcagacgtcaactcgaactcgagaagaagaaaaaacaagacctggacgacgaggagaaaacagcaaagttcattgaggaacaggtgcgcaggggtcttgagggcaaggagcaggaagtaccaacctttacagagctttctagagaaaatgacgaggagaaagtgacctttaacctgtccaaaggagcttgtagcagcagcggggcaacatcgagcaagtctagtacactcggaccctcagccttgaaaactatcggatcgtccgcctctgtgaagcgcaaagagtcatcacagtcctccacacaaagcaaggagaagaaaaaaaagaagtccgctcttgacgagatcatggaaattgaagaagaaaaaaagagaaccgccaggaccgattactggctccagcctgaaatcattgtaaagatcattacgaagaaactcggagagaaatatcacaagaaaaaagccattgtgaaggaagtgatagacaagtatactgcggtcgttaagatgatcgactcaggggataagctcaaattggaccaaacccatctggagacagtaatccctgccccaggaaaacgaatcttggtactaaacgggggttatcgaggaaatgagggcacattagaatcgataaacgagaaaactttttcggccacaatcgtgattgagactgtttag

SEQ ID NO: 227784 - DNA, 867 bp, Artificial Sequence
  Description of Artificial Sequence: Synthetic coding sequence
atgaacgcaacgcaatgggaaacgctgaccgacttcacaaaatggctcggtcgcgagggactgtgcaaagtagatgaaacccctaaaggctggtacatacagtacatcgacagagacccggagacaatccgacgccagttggaactagagaaaaagaagaagcaggacttagatgatgaggagaagactgccaagttcatcgaggagcaggtacgacgaggactcgaaggcaaagagcaggaagtccctacctttacggaattatcacgggaaaatgacgaagaaaaagtgactttcaatttgtccaaaggggcttgctcttcctctggagcaaccagtagcaaaagttctaccctggggccaagtgctctgaaaactattggttcctcagcttccgtgaaaaggaaggaaagtagccagtcctcaacccagtccaaggagaagaagaagaagaagtctgctctggatgagatcatggagattgaggaggaaaaaaaaagaaccgcccgaacagactattggcttcagcccgaaattattgtcaaaattattaccaaaaagctgggagaaaaatatcacaagaaaaaggccatcgtgaaagaggtgatcgacaagtataccgccgtggttaagatgattgacagcggcgataagctgaagctggaccagactcacctagagaccgttatccctgctccagggaaacgaatactggtgcttaatggaggctataggggtaacgagggtacactggagtcgattaatgaaaagacattttctgcaactatagttatcgagaccgtcagcctgttcacacagcggcagaaattccaaaatgccctgaaaatgtgtcactctttcttttag

SEQ ID NO: 227785 - DNA, 2361 bp, Artificial Sequence
  Description of Artificial Sequence: Synthetic coding sequence
atgaatgaagcaaaagtcaaagaaacgctacgacgttgcggggctagtggggatgaatgcggaagactccaatacgccctgacctgcctgcggaaggtcactggcctgggaggggagcataaggaggacagctcttggtccagtttggacgcgcgaagagaaagcggctctgggccttcgactgataccctatctgctgctagtttgccctggccacccggaagtagccagctgggaagagcaggcaactctgcgcagggccctcgctctatatccgtaagtgctttaccggcatccgactctcctaccccgagtttttcagagggactgagcgatacatgtatcccgctgcatgctagcggaagactgacccctagggctttgcatagtttcatcacacctcctaccaccccccagctccgcaggcatacgaaattgaaaccacccagaacgcctcctccgccatctagaaaggtctttcagttgctccctagcttccctacgctcactaggtctaaatcgcatgagtcacaattggggaacaggatcgatgacgtgtcttcaatgagattcgatctctcccatggtagtccgcagatggttcgacgggatattgggctgtcagtgactcatcgcttcagcactaaatcatggctgagccaggtgtgccatgtgtgtcagaaatctatgatattcggggtaaaatgtaagcactgtcgccttaagtgtcacaataaatgcaccaaggaggccccagcgtgtagaattagctttctccccttaacccgccttcgacgtaccgagtcggtaccgtctgacatcaataaccctgtcgaccgcgcagcagaaccgcacttcggcaccctgcccaaggccctgactaaaaaagagcaccctcccgctatgaatcacctagatagcagctcaaacccatcctccacaacatccagcacaccatcaagccctgccccattcccaacaagctctaaccctagctcggccaccactccgcctaacccgtcccccggacagcgggactcccggtttaactttcccgcagcatatttcatccaccacagacagcagtttatcttcccggtgcctagtgcaggtcattgttggaaatgcctgctgatcgctgagagcctgaaggagaacgccttcaacatttccgcatttgcccatgctgcacctctcccagaggctgcggacgggactagattggacgaccagccaaaggcggacgtcctcgaagctcacgaggctgaagctgaggagcctgaggccggaaagtcagaagccgaagacgacgaagacgaggttgacgacctgccttctagccggagaccctggcgtgggcctatctccagaaaagcctcacagacctcagtgtacttacaggagtgggacatcccctttgagcaggtagaactgggcgaacccatagggcagggcagatgggggagagtgcaccggggtcgttggcatggtgaggtggcgattcggcttctggaaatggacgggcataaccaagatcaccttaagctgtttaaaaaggaagtaatgaactatcggcaaactaggcacgaaaatgtagtcttgtttatgggagcatgtatgaatcccccacacctggccatcataacctctttttgcaaaggcaggactttgcactctttcgtccgcgacccaaaaacaagtctggacatcaataaaaccaggcagatcgcccaagaaatcatcaaaggcatgggctatctccacgcgaagggaattgtccacaaagacttaaaatccaagaatgtgttttatgacaatggcaaagttgtgatcaccgattttggcctattcggcatctcaggtgtcgtgagagagggtcgaagagaaaaccagctgaaactgtcgcacgattggttatgctatctcgcgcctgagatcgttcgagagatgacacctggcaaagacgaggaccaactgcccttctctaaggctgccgacgtttacgcgttcggaacggtgtggtacgaactccaagctagagattggccccttaagaaccaagctgcagaggcttccatatggcagattgggagtggggaagggatgaagcgggtgcttacctcggtgagcctgggaaaagaggtcagcgagatcctgtcagcttgctgggccttcgaccttcaggagagaccgagcttcagtctgctgatggacatgctggagaagctccccaaactgaacagacgtctgtcccatcccggtcacttctggaagagcgctgacattaattcatctaaagtggtcccacgctttgagagatttggtctgggcgtgctcgaaagcagcaaccccaaaatgtag

SEQ ID NO: 227786 - DNA, 2772 bp, Artificial Sequence
  Description of Artificial Sequence: Synthetic coding sequence
atggacagagcggctctacgcgcagcagccatgggggaaaagaaagaaggaggcggaggaggtgatgcagccgcagccgaggggggtgccggagcagcggcaagcagggcgcttcaacaatgtggacagctgcagaagctcattgacatttcaatcggttccttgagaggcctcaggactaagtgcgcagtttccaacgatttgacccagcaagaaatcaggaccctggaagcaaagctcgtacgatacatctgcaagcagaggcaatgtaaactctcagtggctcccggtgagaggacccctgaactcaattcatatccgcgtttcagcgattggttgtacaccttcaacgttcggccagaagttgtgcaggaaatccccagagacctcactcttgatgcgctgctcgagatgaacgaagctaaggttaaggagacactacgtagatgtggtgctagtggtgacgaatgcggacggctgcaatacgcactcacttgcctacgaaaggtgacaggcctcggcggagagcataaggaggatagctcatggtcctcactggacgctcggagagaatcaggctccggcccaagcactgacacattgtccgccgcatcgctcccttggcccccaggctccagccagctggggcgagccggtaactcagctcaaggaccacgcagcataagcgtgtcggcactgccagcctccgattccccgaccccgtctttcagtgagggactgtctgatacgtgcatccctctccatgcctctggaagactgacgcctcgcgcactccactcttttatcactcccccaacaacaccccagctcagacgccacacaaaacttaaaccacccagaactccgcctcccccttctaggaaggttttccaattgcttccaagttttccaaccctgaccaggtccaagagtcatgaatctcaattgggcaatcggatcgacgacgtaagttccatgcgctttgacctgtctcatggcagtccacagatggtccggagggatattggactgtcagtgacccataggtttagtacaaaaagctggctttctcaggtgtgtcacgtttgccagaaatccatgatttttggggtgaaatgcaagcactgtcgactgaagtgtcataataagtgcaccaaagaggccccagcttgccgcatcagcttcctgcctctgacgcggctgcgtcgcactgaatcggttccctccgacattaataatcccgtagacagagccgcagaaccccactttggaaccctgcccaaggccttgacaaagaaagagcacccaccagctatgaatcacttggactcaagttctaacccaagtagcacgacctcttcaaccccctccagccctgccccattccccacaagtagcaatccctcatccgccactactccacctaacccatctccgggacagagagacagccgattcaacttccccgctgcctatttcatacaccaccgacaacagttcatctttcccgtgccttcggctggccattgttggaaatgcctgcttatagccgagtcactgaaagagaatgccttcaatatatctgcctttgctcatgcagctcccttacccgaggccgctgatggcacccggttggacgaccaaccaaaggccgacgtgctggaggcccatgaggcggaagccgaggaaccggaagctgggaagtctgaggccgaagatgatgaggatgaggtggatgacctgccctcgagccggcgtccctggcgtggcccaattagtcgcaaagcttcccagacgtccgtgtatctgcaggaatgggacatacccttcgagcaggtagagttgggggaaccaatcgggcagggacgctggggaagagttcacagaggtcgctggcatggcgaagtcgcgatccgcctcctggaaatggacgggcacaatcaggaccacctcaagctttttaaaaaagaagtcatgaactataggcaaacccgccatgaaaatgtcgtgctgtttatgggagcttgcatgaatccacctcatctggcaattatcacttctttttgtaaggggaggactctgcattcattcgtccgagatccgaagactagtctcgatattaacaagacaagacaaatcgcacaagagatcatcaagggaatgggctacctgcacgctaaaggaatcgttcacaaggatctgaaatctaagaacgtgttttatgataacggaaaagtagttattaccgacttcggtctgttcgggatcagtggtgtagtgcgtgaaggccgacgagaaaaccaacttaaactgagtcacgactggctctgctatctggccccagaaatagttagagagatgactcctggaaaagatgaggatcagctgcccttttccaaagccgctgatgtgtatgcgttcggcaccgtgtggtatgagctccaggccagagattggcccctgaaaaaccaggccgcagaggcctcaatctggcagattggtagcggagaggggatgaagcgcgtgctaacatctgtcagtctcggaaaggaagtctccgagatcctctccgcatgctgggcattcgatttgcaggagaggccatccttctccctgctcatggatatgctcgaaaagcttccaaaactaaataggagacttagccatccaggccacttctggaagagtgccgacatcaactcaagcaaggtcgtcccccgatttgagagattcggtctcggggtgttggaatccagtaatccaaaaatgtag

SEQ ID NO: 227787 - DNA, 2289 bp, Artificial Sequence
  Description of Artificial Sequence: Synthetic coding sequence
atgaatgaagccaaggtaaaggagaccctgaggaggtgcggcgcatcaggagacgagtgcggaagattgcagtacgccctcacgtgtctccggaaggttaccgggctgggcggtgagcacaaggaggactcgtcttggagcagtttagacgccagacgtgagtctgggagtgggccatcaactgatacactatctgccgcaagtctcccttggccaccaggttcatcccagctaggtagggccggaaattccgcccaggggcctcggtccatttccgtctccgccctgcccgcttctgatagtccgaccccttcattctctgaggggctcagcgatacttgtatccctctccacgcatctggccgattgacacccagggctctccactctttcattacccctcctacaacacctcagcttcgccgacatacgaagcttaagccgccacgtacgccaccaccccctagcaggaaagtcttccagttgttacctagcttcccaactctcactagaagcaagtcgcatgagtctcagctgggcaaccgcattgacgacgtcagcagcatgcgatttgacctcagccacgggagccctcagatggtcagaagagacattggactgagtgtcacacatagattttccacgaagtcttggttgtctcaggtgtgccacgtgtgccaaaaatccatgatcttcggagtgaagtgcaaacattgccgactgaaatgccacaataaatgcacaaaagaggctcccgcttgtcgcataagctttctgccactgaccaggctccggaggaccgaatccgttccatccgacatcaataaccctgtcgatcgagctgctgagccgcatttcggcacactcccgaaagcgctcacgaagaaggagcacccgccagctatgaaccacttggactcaagctcaaatccatcgtccaccacctcgagtacgccatcttcacctgcaccgtttcccacctccagtaacccatccagtgctacaacaccaccaaacccttcacctggccaacgtgacagcagatttaacttccctgccgcatattttattcaccacaggcagcaattcattttcccagtaccgtcagccggacactgttggaaatgtttgctgatcgcggaatccctaaaagagaatgctttcaacatcagtgccttcgcgcatgccgctcctctacccgaggcagccgatggaacacgtctagatgaccagcccaaggcagacgtgctggaggctcacgaagcggaagctgaggaacccgaggcgggtaagagcgaagcggaggacgatgaggacgaggtcgacgatctcccttcatcccgcagaccttggcgagggccaatctccaggaaggcatcgcaaactagcgtgtacctgcaggaatgggatatccctttcgagcaggttgaactcggagaaccaattggacagggtaggtgggggagggtgcaccgcggacggtggcacggggaggtggcaataaggcttctggagatggacgggcataaccaggaccatcttaagctgtttaaaaaagaagtcatgaattatcggcagactcgacatgaaaatgtagttctttttatgggtgcctgtatgaatcccccacacttagcgatcataacaagcttttgtaaagggcgaactctgcactctttcgtgcgtgatcctaagacatcccttgatattaataaaacccgccagattgcacaggagattattaaagggatggggtacctgcacgctaagggcattgtccacaaggaccttaagtccaagaacgtattctacgacaacggcaaagttgtgatcaccgatttcgggttgtttggaattagcggtgtggtgagagaagggaggcgcgagaatcagctgaagctcagccatgactggttgtgctacctggccccagagatcgttagggaaatgactcccggaaaggacgaggaccaactgccattctccaaggccgctgacgtgtatgcgttcggcacggtttggtatgagctgcaagccagggactggcccttaaaaaatcaggctgccgaggccagtatttggcaaatcggcagcggagagggcatgaagagggtgttgacgagtgttagcctcggtaaagaagtgtctgagattctgtctgcctgttgggcctttgatctccaggagcggcctagtttttctcttcttatggacatgttagagaagcttcctaagttgaacagacgtttgtcccaccctggccatttttggaaaagcgctgagctatag

SEQ ID NO: 227788 - DNA, 375 bp, Artificial Sequence
  Description of Artificial Sequence: Synthetic coding sequence
atgcaagcggatctcgaaatcccacgcgatttaacgcttgatgctctgctcgaaatgaatgaggccaaggtcaaggaaacactgcggaggtgtggagcgtccggggatgaatgtgggagactccagtatgccttaacctgtcttcggaaggtgacaggacttgggacatgggggctcccaccctccccactgccagggctggttccactgggcttatggcccagcctgtggtgggtcatggagcgagggaagagaggacctgggttcttaggccagccaggaaaagctcgggttgggtgctcccagcctcctgagaaactgagtcagggccctcagggcagcggatcctggtgggtgtggcctggccgtatatag

SEQ ID NO: 227789 - DNA, 1842 bp, Artificial Sequence
  Description of Artificial Sequence: Synthetic coding sequence
tgacacagtttcattacgcccccaacaaccccacagctgagaaggcatactaagttaaaacctcctcgaacccctcctcctccctctcgcaaagtgtttcaactgctgcctagctttcccaccctgacacgaagtaaatctcatgagtcccagttggggaaccgaatagatgatgtgtcctctatgcggttcgatctctcacacggctccccccaaatggtgcggagagacattggcctttctgtgacccaccggttctcaacaaaatcatggcttagccaggtttgccacgtttgtcagaaatcaatgatctttggcgtgaaatgcaagcactgtaggctgaaatgtcacaataagtgcactaaggaagccccagcatgccgaattagtttcttacccttgaccaggctccgcagaaccgaatctgtgccaagtgatatcaataaccccgtcgacagggctgccgagccacatttcggaacactgcccaaggcgcttactaaaaaggaacacccacctgccatgaaccacctggactcgtctagtaatcctagctctacgaccagctctaccccatcaagcccagcaccctttccgaccagtagcaatccctcatcagccacgactccccctaatcccagcccaggccagcgcgattctaggttcaacttcccagccgcttactttatccaccacagacaacaattcatcttccctgacatttccgcctttgcccacgccgcaccactgccggaagccgctgatggcacgagactggacgaccagccaaaggccgatgtgcttgaagcccacgaggccgaggccgaggagcctgaggcaggaaaatctgaagctgaagacgacgaggacgaagtggatgatctgccttctagcagaaggccatggaggggacctatatcccgcaaggcctcccagaccagtgtctacctccaggagtgggacatccctttcgagcaggtggagcttggcgagccaattggccaaggcaggtgggggcgagtccatcgaggacggtggcacggggaggtcgcgattaggctgctggaaatggatggacataatcaggatcatttgaagcttttcaaaaaagaagttatgaattacaggcagaccagacacgagaacgtagttctatttatgggagcttgcatgaatccccctcatctggcaattattacatctttttgcaaaggtaggaccctccattctttcgtacgcgaccccaagacgagtctcgatattaacaagacacggcagatcgcccaggagataatcaaagggatgggctacctgcacgctaaggggattgttcacaaagacctgaagagcaagaacgttttctacgataatggtaaggtggttatcacagatttcggcctgttcggcatcagtggtgttgtccgcgaaggtaggcgtgagaatcagctcaaactgtcgcacgattggctctgttatctagcccctgagattgtgagggaaatgactcccggaaaagatgaagatcaactgccattctctaaggctgctgacgtgtatgcttttggtaccgtgtggtatgagctccaggctcgggactggccacttaaaaaccaggccgctgaggctagtatatggcaaatcggatccggggaagggatgaagagagtgttgacctctgtgagtttggggaaggaggtctctgaaattctgtccgcctgctgggccttcgatctccaagagcgaccctcttttagtctgctgatggacatgctggagaagcttcccaaacttaataggcgtcttagccatcccggacatttctggaaaagcgcggagctgtag

SEQ ID NO: 227790 - DNA, 2634 bp, Artificial Sequence
  Description of Artificial Sequence: Synthetic coding sequence
atggaccgggctgccctgcgcgctgccgcaatgggagagaaaaaggaaggaggcggaggcggagatgcagccgcagccgagggcggtgccggagccgctgcaagccgcgctctccagcagtgtggtcagctccagaagctgatcgacatcagcattggaagtctgcggggtctgagaacaaagtgcgctgtttccaacgatctcactcaacaggagatacgtacactggaggctaagctcgtgaggtacatctgtaaacagcgccagtgcaagttgagtgtcgctcctggcgaacgaacccccgagctcaacagctaccccagattcagcgattggctgtacacctttaacgtgcgtcctgaggtggtacaggaaatccctagagacctcacgttggacgcactactagaaatgaatgaggccaaagttaaggaaacactgcgccgttgcggtgcctctggcgatgagtgcgggaggctgcagtacgcacttacctgtctgcgtaaagtgacaggcctgggcggagaacacaaggaggattccagctggtcatctcttgatgccaggagggaaagcggatccggccctagcaccgacactctgtctgctgccagcctgccttggcccccaggctctagccagctgggcagggccggaaactctgctcaagggcctagatcaatatcagtgtctgcccttcctgcaagcgacagccctactcctagcttttcggagggtttgtctgatacctgcatacccttgcacgcttccgggcgtctgaccccaagagccctccactctttcattacacctccaactaccccgcaacttcggaggcacacgaaattgaaacctcctaggacaccgcctccaccatctcgcaaagtcttccagctcctgccttcttttcctactctgactagatccaagtcacatgaatcccagctcggtaaccgtatagatgatgtcagttccatgagatttgatctgtcacatggaagcccacaaatggtcaggagagatatcggccttagtgttacgcatcggttcagtaccaagagctggcttagccaggtgtgtcacgtctgccagaagtccatgatattcggagtcaaatgtaagcattgtcgtctcaaatgccacaataaatgtactaaggaggcacccgcatgcagaatctctttcttgccattgacccgattgcgccgaacggagtccgtcccttcagatatcaataacccagtggatagagctgctgaaccccactttggaaccctccctaaggctttgactaagaaagagcatccacccgctatgaaccacctggattcttccagtaacccgagctccaccacgagctctacgccctctagcccagctccctttcctacttcctcaaaccccagtagcgccacaaccccacctaacccctcccccggtcaacgagactcaaggtttaattttcctgcagcatacttcattcatcatcgtcagcagtttatctttcctgatatcagtgcgtttgcccacgctgccccactacccgaggcagctgatggaacccggctagatgaccagcccaaagctgacgttttggaagcgcacgaagcagaggccgaagaaccagaggccggaaagagcgaagccgaggatgacgaggatgaggtagacgacctaccctcctcacgcagaccctggcggggtcctatctcaagaaaggcaagccagactagtgtgtacctgcaggaatgggacatcccattcgaacaagtggaactgggcgagccaatcggccaaggacgttgggggcgagttcaccgcggtaggtggcatggcgaggtggcgatccgactgctggagatggacggccacaatcaggatcatctgaaactgtttaagaaagaggtaatgaactacaggcagacaagacatgagaacgttgtgctctttatgggggcatgcatgaatccaccccacctcgctattatcacaagcttttgcaaaggaaggacactgcacagcttcgtcagggatccgaagacaagtttggacatcaataagacgaggcagatcgcccaggagataatcaagggaatgggatacctccacgccaaaggcatcgttcacaaagacctgaagtcaaaaaacgtgttttatgacaacgggaaggtggtcatcactgatttcgggctgtttggcattagtggggtcgtacgcgagggtagacgagagaaccaactgaaactgtcccacgattggctgtgttatctggctcctgaaatagtccgcgaaatgacacctggtaaggacgaagatcagctcccattctctaaggccgctgacgtgtacgcctttggcaccgtgtggtatgagctgcaggctcgtgattggcccttaaaaaaccaagccgctgaggccagcatatggcaaataggcagtggagagggtatgaagcgagtgctgacctccgtgagtctggggaaggaagtctcagagatactgtctgcttgttgggccttcgatctgcaggagcgcccatcatttagtctattgatggatatgctggagaagcttcctaaactgaacagaagactgagtcatcccggacacttctggaagtctgctgagctgtag

SEQ ID NO: 227791 - DNA, 1311 bp, Artificial Sequence
  Description of Artificial Sequence: Synthetic coding sequence
atgtacaacaagaaagccaagatggagcctaacgccagtgagagtgctattcctgccagaagacaaaggcaaccgagagcaaagaaaaagagtaagcctttgaacttaaagatccacagtagcgtgggaagttgtgaaaacattccctcccagcagcgtagccctcttttaagtgagagaagcttgcgcagttttttcgtgggacatgccccatttcttccctccacccctcctgtccacacagaggccaacttcagcgcgaacacactgagtgtccccaggtggagtccccagattcccaggcgtgacctgggcaattccatcaagcaccgattcagcactaaatactggatgtcccagacgtgtacagtttgcggcaaaggaatgttgttcggactgaagtgcaagaactgcaagctcaaatgtcacaacaagtgtacaaaagaagctcctccgtgccacctattgatcatccaccggggtgaccccgctcggcttgtacgtaccgaatccgtcccttgtgatatcaataaccctctcagaaagccccctcgttactccgaccttcacatttcgcagacccttcctaaaaccaacaaaatcaataaagatcacattcccgtaccctaccaacctgacagctctagcaaccccagcagcactacctccagcacacctagctctccagccccacccctgcccccaagtgccacccctcccagcccgttacatccctcacctcagtgcactcgccagcagaaaaattttaacctgccagcaagtcactactacaagtacaaacaacagttcatctttcccgatgttgtgcccgtaccagagacgcctacccgcgctcctcaggtaatcctacatccagttactagcaaccctattctcgaggggaatccgctgctccaaatagaggttgagcctacctcagaaaatgaagaggtccacgacgaagcagaggagtcagaagatgatttcgaagaaatgaacttgagcctcctgtccgccagatcattccctaggaaggcctcacagacaagcatattcttacaggagtgggatatcccctttgaacagctggagatcggcgagctgattggtaaaggacggttcggccaggtataccacgggagatggcacggcgaagtcgccattcgtcttattgatatcgagagggacaacgaggatcaactgaaggcttttaaacgtgaggtgatggcctacagacagacacgccacgaaaatgttgtgctgtttatgggcgcatgtatgtcccctccccatctagctatcatcacctag

SEQ ID NO: 227792 - DNA, 2853 bp, Artificial Sequence
  Description of Artificial Sequence: Synthetic coding sequence
atggacgaggaaaatatgaccaagagtgaagaacagcagcccctgagtttacagaaagccctacagcagtgcgaacttgtgcagaatatgatcgatctgtctatctcaaacctggaaggcctcaggacaaagtgcgccacttccaatgacctgacccaaaaagaaatccggacactggagagtaagctggtgaagtattttagccgccaactttcctgcaaaaagaaggtggccctgcaagagcgaaatgctgaactggacgggttcccccagcttcgtcactggttccggatcgtggacgtcagaaaagaagttctcgaggaaatcagccctggtcagttgagtctggaagatctactggagatgaccgacgagcaggtgtgtgaaacagtcgaaaaatacggcgctaatcgggaggagtgcgccagactgaatgcttcccttagctgcctcagaaatgttcacatgtcaggaggaaatctgtccaagcaagattggacaattcagtggccaaccacggaaaccggcaaagagaataacccagtttgtcccccagaaccgactccatggattagaacccatctgtcgcaatcccctcgcgtgccatcaaagtgcgtgcagcactattgccacacgtctcccactcctggggcacccgtgtatacgcatgtcgatcggctaaccgtggacgcctatcccggactgtgtccccctcctccactggagtccggacatcggtccctgcccccatcgcccaggcagaggcatgcggtccggacacctcctcgcacccctaatattgtgactaccgtgactcctcctggaaccccccctatgcggaagaaaaataagctcaaaccgcctggcactcccccaccatcctccaggaaactcatccatctcattcctggattcaccgccttacataggagtaaatcacatgaatttcaattgggacaccgtgtggatgaggcccacaccccgaaagcgaaaaagaagagcaagccacttaatctgaagattcattcaagtgttggatcctgtgaaaatatcccttctcagcagagaagcccattgttaagtgagaggtctctgagaagtttcttcgtgggtcatgcgccttttctgccaagtaccccgcctgtgcataccgaagctaacttttctgcgaacaccctgagcgttcctagatggtcccctcagattcctcgccgagacctagggaacagtattaagcatagattcagtaccaaatattggatgagccaaacctgtacagtttgcgggaaaggaatgctgttcggtttgaaatgcaagaactgcaagctgaaatgccacaacaagtgtaccaaggaagctccgccatgccatctactcatcatccatcgtggagaccccgctcgcctggtccggaccgagtccgttccctgcgatataaataaccccctccgaaagccccctcggtattcagatctgcatatctcccaaaccttgcccaagactaacaagatcaacaaggatcacattccagtcccttaccaacccgactcatcttcgaatccctcgtcgaccacatcctctacaccatcctctccggctccacccttaccaccatcggcaacccctccgagcccactccatccttcaccacagtgtacccggcaacaaaaaaacttcaacttaccggcatcacactactataagtataagcagcagtttatttttcctgatgtggtgcccgtccctgaaactcctacgagggcaccacaggtcatccttcatcccgtcacctccaacccaatcctggaaggcaatcccctcctgcagatcgaagtggaaccgacgagtgagaacgaggaggtgcacgatgaagccgaggagagcgaggacgactttgaggagatgaatctgtctctgctgtccgcacgttcgttcccgaggaaagcatcccagacttctattttcttacaagagtgggacataccattcgagcagttggagattggtgaattgatcggtaagggccgatttgggcaggtctatcacggtcgttggcacggtgaagtggcgattcgcttgatcgacatagagcgagataacgaggatcagctaaaggctttcaagcgggaagtaatggcgtaccgtcaaacacggcatgaaaacgtggtcctgttcatgggagcttgtatgtcccccccacatctggcaattatcacaagcctctgcaagggcagaaccttatacagcgtggtgagagatgcaaaaatagtcttggatgtcaacaagactcgacagatcgcacaggaaatagtgaagggcatgggctacctccacgcaaaggggattctccataaggatttgaagagtaagaacgttttttacgacaatggcaaagttgtcatcacagactttggtttgttctctatttcaggagttctgcaagccggaagacgggaagacaagctacgtatccagaacggctggttgtgtcatctggccccagagatcattcgccagctgtcccccgataccgaggaggataagctccctttttctaaacattcagatgtattcgccctgggtaccatctggtatgagctgcacgcgagagaatggccctttaagacacagccggctgaggcaatcatctggcagatggggactggcatgaaacccaacttgtcccagattgggatgggtaaagaaatctccgatattctgctgttctgctgggcttttgagcaagaggagcgaccgacatttactaaactgatggatatgctggaaaaactgcccaagaggaatcggcgactctcgcacccgggtcacttttggaagtctgctgaactgtag

SEQ ID NO: 227793 - DNA, 2766 bp, Artificial Sequence
  Description of Artificial Sequence: Synthetic coding sequence
atgatcgacctgtcaataagtaatctcgagggactcaggacaaagtgcgccaccagtaatgatcttacacagaaggagattcggaccctggagtctaaactggttaaatacttctcccgccagctaagttgcaagaaaaaagtggctctccaggagaggaacgccgaactggatgggttcccgcagttgcggcattggttccggatcgtggatgtgcgcaaagaggttctggaggagatttccccaggtcaactgagtcttgaagatctgctggaaatgacagacgagcaagtatgcgagacagttgaaaaatacggcgctaacagggaggagtgcgctcgactaaacgccagtctctcgtgccttagaaacgttcacatgagtggcggaaacctatcaaaacaagattggactatccagtggcccactacagagaccggtaaggaaaataaccccgtctgtcctcctgagcctactccgtggatcagaacacatcttagtcaatctcctcgcgtgcctagcaaatgtgtccagcactactgccacacttctcctactccaggcgctcctgtgtacactcacgtggatagactgacagttgacgcgtatcccggactttgtccccctcctcctctggagtcgggacatcgatcccttccccctagcccgaggcaacggcacgctgtaaggactccaccaagaacgcccaacattgtgacgactgttaccccacctggtacgccccctatgagaaagaaaaataagctgaagccacctggcactccgcctccaagctccaggaaactgatccacttgatacctggtttcacagccctgcaccgttctaaatcccatgaattccaactgggccaccgcgtagacgaagcccacacacccaaggccaagaaaaagtctaaacctttgaacttgaaaatccactccagtgtgggatcttgtgaaaacatcccctcacagcagcgcagcccccttctctccgagcgcagtcttcgctccttcttcgtcggccacgctcctttcttgccatctacacctccagtccatactgaagctaatttctccgccaacaccctgtccgtcccccgatggtccccccagattcccaggcgcgacctgggtaacagcatcaagcaccggttttccaccaagtactggatgtctcagacctgtaccgtatgtggaaagggcatgctgttcggattaaaatgtaagaactgcaagcttaagtgtcacaacaagtgtacaaaagaggcccctccatgccacctgctgattatacacagaggggaccccgcaaggttggtgcgcactgagtctgtgccctgtgatattaataatcctttgaggaaacctccaaggtactccgacttgcacatttcccaaaccttgcccaagacaaacaagatcaataaagatcatatacccgtgccctatcaaccagattcctcatccaatccatccagtacgacaagctccactcctagcagccccgcaccacccctccctccatctgctaccccacctagtccactccatccatccccacagtgtaccagacagcaaaagaattttaaccttcccgcaagccactactacaagtacaagcaacagtttatctttcctgatgtggtgcctgtccctgagaccccaacacgtgctccacaggtgatattgcaccctgtgaccagtaaccccatcctcgagggcaacccactcctccagatcgaggtcgagcctacctccgagaatgaggaggtgcatgatgaggcagaggagagtgaagacgactttgaggaaatgaacctgagcctgttaagcgccagaagctttccacgcaaggcttcccagacaagcatctttcttcaggagtgggatatcccatttgagcaactcgaaatcggcgagttgatcggcaaaggcagatttgggcaggtgtaccatggcagatggcacggcgaggttgctattcggttgatcgacatagagcgcgacaacgaagaccagctgaaggccttcaagagggaagtgatggcatataggcagacacgacatgagaacgtggtgctctttatgggcgcttgcatgtcaccccctcacttggccatcatcacaagcctgtgtaaagggcgtacactctactccgtggtgagggacgctaaaattgtgctggatgtgaataagacccggcaaattgcacaggaaatcgtgaagggaatgggctacctccacgcaaaaggcattctgcacaaggatctgaagagtaagaacgtcttctacgataacggcaaagtcgttattactgactttggactgttctctatcagtggggtattgcaagctggcagaagagaagataaactgcgaattcagaacggttggctgtgtcatctcgcacccgagataatccgacagctgagccctgacactgaagaggataagctgccgttttcaaagcactcagacgtgttcgcccttggaacaatttggtacgagctgcacgcccgagaatggcccttcaagacacaaccagccgaggctataatttggcagatgggcaccgggatgaagccaaacctttcccagatagggatgggcaaggagatctccgatatcctgctgttctgctgggccttcgagcaggaggagcgccctacgtttactaagctcatggacatgctcgaaaagcttccaaagcggaaccgacgcttatcacaccctgggcacttctggaaatccgccgaattgtag

SEQ ID NO: 227794 - DNA, 1245 bp, Artificial Sequence
  Description of Artificial Sequence: Synthetic coding sequence
cgcgcaaaaaagaaatcaaagcctctaaatttgaaaatccatagctctgtgggctcttgtgaaaacattccctcacagcagcgatcccctctactttcggaacgatccctgaggagttttttcgttggccacgcaccattcctaccaagtaccccacccgttcataccgaggcgaatttctcagccaatactctcagcgttccgcgttggagcccccaaattccaaggagggacctggggaactccatcaagcatagattctcaacgaagtactggatgtcccagacatgtaccgtatgtggtaagggtatgctcttcggtctgaaatgcaagaattgcaaactgaaatgtcacaataagtgcacaaaggaggcgcctccatgccatctgctgattatccatcgcggtgatcccgctcgcctcgtgcgcaccgagagtgttccttgcgacattaacaaccctctccgaaaacctccgcgatacagcgacttacacatctcccaaactctgcctaagacaaataaaattaacaaagatcatattcccgtgccctatcaaccggattcctcatctaatccctcttctacaacatcctctactccaagtagcccggcacctccactgcctccaagtgcaaccccacctagcccactgcacccaagtccacagtgtaccaggcaacaaaagaacttcaacctgccagcgtcacactactataaatataagcagcaatttatcttccctgatgtggtacctgttcctgaaaccccaactcgggcaccccaggtaatacttcatcccgttacgtcgaaccctattctggagggaaaccccttgctgcagatcgaggtcgaaccgacttccgaaaacgaggaggtccatgacgaggcagaagagtccgaggatgacttcgaagagatgaatttatctctgttaagcgcacgtagtttcccaaggaaggcctcgcagacttccatcttcctgcaggagtgggatattccctttgagcagttggagatcggagagctcataggaaagggcagattcgggcaggtgtatcacgggcgatggcacggtgaggtcgctatcagactcatcgacatcgagagagacaatgaagatcagctaaaagcgtttaagcgagaggtgatggcttaccgccagaccaggcatgagaatgtggtcttattcatgggagcatgcatgagtccccctcatctcgctatcattaccagacccgtttag

SEQ ID NO: 227795 - DNA, 3921 bp, Artificial Sequence
  Description of Artificial Sequence: Synthetic coding sequence
atggagttctatgaatccgcctatttcattgtcctcatcccttctatagtgataaccgttatttttctgttcttttggctcttcatgaaggaaacattatacgacgaagtccttgccaaacagaagcgggaacagaagcttattcctacaaagaccgataagaaaaaggctgagaagaaaaaaaacaaaaaaaaagagatccagaatggaaatttacatgaatcggattctgagagcgtgccccgtgattttaaattatccgacgccctggctgtcgaagacgaccaagtggctccagtgcctttaaacgtggttgagacgtcctcctctgtcagagaaagaaagaaaaaggagaagaaacagaaacccgtgcttgaagaacaggttatcaaagaatccgatgccagtaaaatcccaggaaaaaaagttgagcctgtcccagttacaaaacaacccacccccccaagcgaagcagcggcatctaagaaaaaaccaggccagaagaaatcaaaaaatggctccgacgatcaggataagaaggttgagacccttatggtcccatctaagcggcaggaagccttacctctgcaccaggagacaaaacaggagtccggctctgggaaaaagaaagccagttcaaagaagcagaaaaccgagaacgtatttgtagacgagcctcttatccatgccacgacctatattccactgatggacaacgcagacagtagtcctgtggtcgacaagagagaagtgatagatctgctcaaacccgatcaggtcgagggaatacaaaaatctggaacgaagaaattaaagactgaaacagataaggaaaacgccgaagtgaagttcaaggattttttactctctttgaagacgatgatgttttcggaagatgaagcactgtgtgtcgttgatctccttaaagagaagtcaggtgtaatacaggacgcactaaagaaaagctcaaaaggggaactgaccaccctgatacatcagttgcaggagaaagacaagctgctggctgcagtcaaggaagatgccgcagccactaaagatcgatgcaagcaactgacccaggagatgatgacagagaaagaacgctcaaacgttgtaatcactcgtatgaaggataggatcgggacactagagaaggaacataacgtgttccagaacaaaatacatgtttcataccaggagacacagcagatgcagatgaagtttcagcaggtgcgcgaacagatggaggcagagattgcacatttgaagcaggaaaatgggatccttcgcgacgcagtcagtaataccaccaaccaactagagagtaagcaatctgcagagcttaataaactgcggcaggattacgccaggctagtgaatgagctgactgaaaaaactgggaagttgcaacaggaagaagtccagaaaaagaatgcagaacaagccgctacccagctaaaggtccagctccaggaagccgagcggcgttgggaggaagtacagtcctacatacggaaaaggacggccgaacacgaagcagctcagcaagatctgcaatccaagttcgtggcaaaagagaacgaggtgcagagcctgcacagtaagctgacagacacactcgtttcgaagcagcaattagaacagcggctcatgcagcttatggagtctgagcagaagagggtgaataaggaagagtctttgcagatgcaggtccaggacattctggagcaaaatgaagcgctgaaagcccagattcaacaattccacagtcagattgccgctcagacttcggcgtccgtgctggctgaagagttgcacaaagtgattgctgagaaggacaaacaaatcaaacagactgaggacagtctggcttccgaacgggataggctgacatccaaagaggaggaactgaaggacattcagaacatgaactttctgctaaaggcagaggtgcagaaactccaggccttggctaatgaacaagcagccgctgctcacgagcttgagaaaatgcagcagtctgtttatgttaaggatgataagatacgcctgcttgaggagcaactgcagcacgagatcagcaacaagatggaagaatttaaaatcctcaatgatcagaataaggctcttaaatccgaggtgcagaagctgcagactctggtctccgaacagccaaacaaggatgttgtggaacagatggagaagtgtatccaggagaaggacgaaaaactgaagacagtcgaagaattgcttgaaacaggtctgatccaggtcgccacaaaggaagaggagttgaatgcgatccgaactgaaaactccagcctgaccaaagaagtccaggacctcaaggccaagcaaaacgatcaggtcagtttcgccagcctcgtggaagaactaaaaaaggtcatccacgaaaaggacggcaaaatcaaatcagtcgaggagctactcgaggctgaattgttgaaagtggcaaataaagagaagacagtccagctctctatcacatccaaagtgcaggagctgcagaatctgctgaagggcaaggaagagcagatgaacacaatgaaggcggtactggaggagaaggagaaggatctcgccaatacgggtaagtggttacaggacctccaggaagagaacgaaagcctcaaggcacatgtccaggaagtggcccagcacaacctcaaggaggcatcttcggctagccagtttgaggaacttgagattgtgctcaaggagaaagaaaatgagctgaagcgactcgaggccatgctgaaggaacgagaatccgatctaagctctaaaacacagctactgcaggacgtccaggacgagaataagctgtttaagagccagattgagcagctcaaacaacagaattaccaacaggcaagctcgtttccaccacacgaagaattactcaaagtcatcagcgaacgcgaaaaggaaatctctgggttgtggaacgaacttgatagtcttaaagacgccgtcgagcaccaaagaaagaaaaacaatgacctgagagagaaaaactgggaggccatggaggccctagctagcaccgagaagatgttacaggacaaggtgaataagacaagtaaggaacggcaacagcaggttgaagctgtggagctggaagccaaggaggtgttgaagaaactcttcccaaaggtgtccgtaccctccaatctatcctatggcgagtggctgcatggctttgaaaagaaggccaaagagtgtatggcaggaactagtgggagtgaggaggtcaaagtgctggagcacaagttgaaagaggcggatgaaatgcatacgttgctgcagcttgagtgcgaaaaatataagagcgtgctggctgaaactgaggggatcctgcagaagctccagaggtccgtcgagcaggaagagaacaagtggaaagtgaaagtcgacgagtcacacaagaccatcaagcagatgcagagctcgttcacttcaagcgaacaggagctggagcgcttgcgaagcgaaaacaaagacattgaaaacttgcgcagagagagagagcatttagaaatggaattggaaaaggcagagatggagagatccacttacgttacagaagtgagagaactgaaggcacaactgaacgagactctcacaaaactgagaacggagcagaacgagcgccaaaaagtcgccggtgatctgcataaggctcagcagagcctggaactgattcaaagcaagatagttaaggccgctggagacacaaccgtcatcgaaaatagtgatgtcagccctgaaaccgagtcaagcgaaaaggaaacaatgagcgtatctctgaaccaaactgtgacccagctgcagcagcttctgcaggctgtcaaccaacagttgaccaaggagaaagagcactaccaggtactggaatag

SEQ ID NO: 227796 - DNA, 4074 bp, Artificial Sequence
  Description of Artificial Sequence: Synthetic coding sequence
atggagttctatgagagcgcttactttattgttctgattccatcaatcgttatcacagtgatcttcctgtttttctggctctttatgaaggaaaccttgtatgacgaagtgctggccaaacaaaagagggagcagaaactgattcctactaagaccgacaagaagaaagctgagaaaaagaaaaataaaaaaaaagaaatccagaatggcaatctccacgaatccgattccgagagcgtgcccagggatttcaaactgagcgatgcactggcagtggaagatgaccaggtggccccagtgcctttgaatgttgtggaaacgagttccagtgttagggaacggaagaagaaagaaaaaaagcagaaacccgtccttgaggaacaggtcataaaagaatcggacgcatcgaagatacccggaaaaaaagtagagcctgtgcccgtgactaagcagcccacaccacccagcgaagccgctgcatcaaagaagaagccaggccagaaaaagtcaaagaatggctcagacgatcaggacaaaaaagtggaaaccctgatggttccatccaagagacaggaggctttaccactgcaccaggaaacaaagcaagaatctggctccggaaagaagaaggctagcagcaaaaaacagaagactgagaatgtgttcgtcgacgagcctctgattcacgcaaccacatatatccccctgatggataatgcggatagttcgcctgttgtggataagcgagaagtgatagatctgctcaagccggaccaggtggagggcattcagaaatccggcacaaagaagttaaagaccgagacagacaaagaaaatgccgaggtgaaattcaaggatttcctgctctctctgaagaccatgatgttcagcgaggatgaggctctttgtgtggtggacctcctgaaggagaaaagtggagtgattcaggacgctctcaaaaaatccagtaaaggggaattgacaactcttattcatcagctgcaagagaaggacaagctcctcgctgccgtcaaagaggacgcggcagctaccaaagacagatgcaagcagttgactcaggagatgatgaccgaaaaggaaagatctaatgttgtaattactcgaatgaaagacagaattggtacccttgagaaggaacacaacgtatttcaaaacaaaattcatgtctcttatcaggaaactcagcagatgcagatgaaatttcagcaggttcgtgaacagatggaggccgagatcgcacatctaaagcaggagaacgggattcttcgagatgccgtgtccaacaccactaatcaattagagagcaaacagtccgcggaactgaataaacttagacaggactatgccagattggtaaacgagcttacagagaagaccggcaaactacagcaggaggaagtgcaaaaaaagaacgctgagcaggcggctactcagctgaaagtacaattgcaagaggcagagcggagatgggaggaggttcagtcgtacattcggaagcgcaccgctgaacacgaggccgcacagcaggatctacagtctaaatttgtagccaaagaaaatgaggtgcagtctctccactctaagctaactgatactctagtgtctaaacagcagctagagcagcggttaatgcaactaatggaatctgagcagaaacgggtgaataaggaagaaagtctacagatgcaggtacaggacatccttgaacagaatgaggcactaaaggcacagatccagcagttccattcacagatcgccgcacaaacctccgcctcagtgctggcagaagagctgcacaaagtgatcgctgaaaaagacaagcagatcaagcagacagaggattccctggcgagtgaacgagaccgactcacgtccaaggaggaggaactcaaagacattcagaatatgaacttcttactgaaagccgaggtacagaaactgcaagctcttgccaatgaacaggccgctgctgctcatgaactggagaaaatgcagcagagcgtgtacgtcaaagatgataaaatccgtctgttagaggagcagctgcagcacgagatctctaacaagatggaagaatttaagatcttaaacgaccagaataaggccctaaagagcgaggtgcagaaactccagaccttggtctctgagcagccaaacaaagacgtggtcgaacagatggaaaaatgtattcaagagaaagacgaaaagctgaaaacggttgaggaactgcttgagacaggactcatccaggtggccaccaaggaggaggaactgaacgcaataaggacggagaactcaagcctgaccaaggaggtccaggacctgaaggccaaacagaatgaccaagtgagcttcgcctctttggttgaagagctgaagaaagtgattcatgaaaaggatggcaaaatcaaatccgtggaggagctgttggaagctgagctcctgaaagtggccaacaaggagaaaaccgttcaagatttgaagcaggaaatcaaggcgcttaaagaggaaattggcaatgtacagctcgagaaagcacaacagctctcgataactagcaaggtgcaagagctgcagaacctgctaaagggcaaggaggaacagatgaacacaatgaaagcagttcttgaggagaaagagaaagacttagctaatacaggcaaatggctccaggatctgcaggaggagaatgagtccctgaaagcccatgttcaggaggtagcacagcacaacctgaaggaggcaagtagcgcttcacaattcgaggagctagagatcgttttgaaggaaaaagagaatgaactgaagaggttagaagccatgctcaaggagcgagaatcagatctgtcctctaagactcaactcctgcaggatgtgcaggacgaaaataagctttttaaaagtcaaatcgagcagctcaaacagcaaaattaccagcaagcatcgagtttcccgccacatgaggagctgctgaaagtgatttcggaaagagagaaagagattagtggactctggaacgagctagacagcctgaaagacgcagtggagcaccagcgaaaaaagaacaatgacctccgagagaagaactgggaagcaatggaggctctggcctccacagaaaagatgctacaagataaggttaacaaaaccagcaaagagaggcagcagcaggtcgaggccgtcgaactggaagccaaagaggtgttgaagaaattgttccctaaggtgagtgtgccttccaatcttagctacggcgagtggcttcatggtttcgagaagaaagccaaagagtgtatggcagggacaagcgggtctgaagaggtgaaggttctggagcacaagctcaaagaagctgatgaaatgcacacactgctgcagcttgagtgtgagaagtacaaatccgtgcttgccgagacagaagggatcttacagaaactgcagcgaagtgtcgagcaggaagaaaataagtggaaggtcaaggtggacgagtcacacaagaccattaagcaaatgcagagtagtttcacctcctctgaacaggagctcgagcggcttcgttcagagaataaggatattgagaacttacggagagaaagagagcacctggagatggaattggagaaagccgagatggaaaggtctacctacgtgaccgaagttcgagagcttaaagacctgctgaccgaattgcaaaaaaagttagacgatagttatagcgaagctgtgcgacagaacgaggagctcaacctgctgaaagcccagctgaatgaaacgctcactaaactaaggaccgagcagaacgaacgccagaaggtggccggtgatctacacaaagcccagcaatctctcgaactcattcagtccaaaatcgtgaaagcggctggagatacaaccgtcattgagaattcagacgtgtccccagagacagagagctccgagaaggagaccatgtcagtatccctgaatcagacagtgacgcagctccagcagttactccaggccgtgaaccaacagcttactaaggaaaaagaacactatcaagtccttgaatag

SEQ ID NO: 227797 - DNA, 3921 bp, Artificial Sequence
  Description of Artificial Sequence: Synthetic coding sequence
atggagttctatgagtccgcttactttatcgtcctcataccgagcatcgtgattactgtgatattcttatttttctggttattcatgaaggaaactctgtatgacgaggtcttggcgaaacaaaagcgcgagcagaagctgattcccactaagaccgataaaaagaaagctgagaagaaaaagaacaagaagaaggagattcagaacggcaatctacacgaaagcgatagcgaatccgtacctagggatttcaaactgtctgatgccttagcagtggaggacgaccaagtggctccagtgcctctaaacgtcgtggagacgagcagctctgtgcgggagcgaaaaaagaaggagaaaaaacaaaagcctgtcctggaggagcaggtgatcaaggagtctgatgcaagtaagatcccaggcaaaaaggtcgaacctgttcccgttaccaagcagcctacaccaccatctgaggctgcagcctcaaagaaaaagccgggacagaagaagagtaagaacggttcagacgaccaggacaaaaaagtcgaaaccctcatggtacccagcaagaggcaggaggctctgcccctgcaccaggagacaaagcaggagagcggatctggcaaaaagaaggcctcctccaagaagcagaagaccgaaaacgtatttgttgacgagcccctgatccatgccacgacctacattccattgatggataatgcagatagttcgcccgtggttgacaagagggaagttatcgacttgttgaagccagatcaagtggaaggcatccagaaaagcggcactaaaaagctgaagactgaaacggataaggagaatgccgaagtgaagttcaaagactttctcctgagcctgaagactatgatgttttccgaggacgaggccctgtgtgtggtggatttgctgaaggaaaagtccggcgttatccaggatgccctgaagaagagctccaagggtgagctcacgacattaattcatcaactgcaggagaaggacaaattgctcgctgctgttaaggaggacgccgcagcaactaaggatcgatgtaaacagctgacccaggagatgatgacagaaaaggagagatctaatgttgttatcaccaggatgaaagatagaattggaactctggaaaaggagcacaatgtgttccagaataaaattcacgtgagttatcaggagacccagcaaatgcaaatgaaatttcagcaggtgcgcgagcagatggaagctgaaatcgcccacttaaagcaagaaaacggcatcctgcgcgacgctgtcagcaacacgaccaatcaactggagagcaagcagagcgctgagctaaacaagcttcgtcaggactacgccaggctggtcaatgagcttactgaaaaaaccggtaaactacagcaggaggaggtccagaaaaagaacgccgaacaagctgccacgcagcttaaggttcagctgcaggaagcggagaggaggtgggaggaagtgcaatcctatatcaggaaacggacggcggaacacgaggcagcgcagcaggacttgcagtccaagtttgtagcaaaggagaacgaggtgcaatcacttcacagcaagctaactgacacactggtctccaaacagcaactagaacagcgactgatgcagctcatggagagtgaacagaagcgggtgaacaaagaggagtcgctgcagatgcaggtgcaagatatccttgaacaaaatgaagcattaaaagcgcaaatccagcaattccactctcaaattgctgcccaaactagtgccagtgtcctggcagaggaactccacaaggtgattgctgagaaagataaacagattaagcagactgaggatagccttgcttcagagagagatcgcctgacgtcaaaagaagaggaactgaaagacatccagaatatgaactttctcctgaaagcagaggttcagaaactgcaggcattggccaacgagcaggcagccgctgcccatgaactcgagaaaatgcagcagtccgtgtacgtcaaggacgacaagattcgcctcctggaggaacagcttcaacacgagatctctaataaaatggaggaattcaagattctcaatgatcagaataaggcattaaaatctgaagtccagaaactgcagacacttgtaagcgaacagccaaacaaggatgtcgtcgaacagatggagaagtgtatccaggaaaaagatgaaaaactaaaaacggtggaagaactgctggaaacaggtttaattcaggtggctacaaaagaggaggagttaaatgccatccgaacagaaaactcttctctgaccaaggaggtacaagatctgaaggccaaacagaatgatcaggtctcttttgcatctcttgtcgaagagctcaagaaagtaattcatgaaaaggatggcaaaattaaaagtgtcgaggagctgctggaagctgagctcctaaaggtagcaaacaaagaaaaaacagtgcagctgtcaattacttccaaggttcaggagctgcagaacctgctgaaggggaaagaggaacagatgaacacaatgaaagcagtccttgaagaaaaggaaaaagacctggccaacactggtaagtggttgcaggatctgcaggaagagaatgagtcgctgaaggcccatgtgcaggaggtggctcaacacaacctgaaagaggcgagcagcgctagccaattcgaagagctggagatagtactcaaagaaaaagagaatgagctaaagaggctcgaggctatgctcaaggaaagagaatccgatctatcctccaaaacgcagttattgcaggacgtccaagatgaaaataaacttttcaagtcccagatcgaacagctcaagcagcagaactaccaacaggcgagttctttcccaccgcacgaggaactcctgaaggtgattagcgagagagagaaggaaataagcgggctgtggaatgaactggactccctgaaggacgctgtggagcatcagaggaagaagaacaatgatctgagagagaagaactgggaagccatggaggcactggccagcaccgagaaaatgctacaagacaaagtcaacaaaacctctaaagagcgacagcagcaggtagaggccgtcgagctcgaagctaaggaggtgctgaagaaattgttcccaaaagtaagtgtgccatctaacctgtcttacggtgagtggctgcacggcttcgagaagaaggcaaaagagtgtatggctggtaccagcggatctgaagaagtcaaagtgttggagcataagctcaaagaagcagacgagatgcatacacttctccagctagaatgcgagaagtacaagtcagtgctggccgaaacggagggcattttacagaaactgcaacggagtgtagagcaggaggagaataagtggaaggtgaaagttgacgagtctcataagaccataaaacaaatgcagagctccttcacatcttctgagcaggagcttgagagactccggtcagagaataaagacattgaaaatttgcgcagggagagagaacatctggaaatggaactggaaaaggccgagatggagcgctcaacgtacgtgaccgaagtgagagaactgaaagctcaactcaacgaaactctaaccaagctacgcaccgaacagaacgagagacagaaggttgctggggatttgcacaaggcacagcagtctctcgagcttattcagtcaaagatcgtcaaagctgccggtgacaccactgttatcgagaattccgacgtgagcccagaaacagaatcctccgagaaggagactatgtccgtgagtctcaatcaaaccgttacccaactgcagcagctgctccaggcagttaatcaacagctcaccaaggagaaggaacactatcaagtgctcgagtag

SEQ ID NO: 227798 - DNA, 4074 bp, Artificial Sequence
  Description of Artificial Sequence: Synthetic coding sequence
atggagttctacgaaagtgcctacttcatcgtgcttattccatccatcgtgatcacagttatttttttgtttttctggctcttcatgaaggaaactctgtacgatgaggtgctagcaaagcagaagagagagcagaagctcatccctacaaaaactgataagaaaaaagccgagaaaaaaaaaaacaaaaagaaagaaatccagaatgggaacttgcacgaatctgattcagagtctgtccccagagacttcaagttatctgatgcgttggccgtggaagacgaccaggtcgctcctgtcccactcaacgtagtggaaacctctagctcggttcgggagcggaaaaagaaggaaaagaagcaaaagcccgtcttagaagagcaagtgattaaggaatcggacgccagtaagattcccggaaagaaggttgagcctgtgcctgtgacaaaacaacctacccctccctccgaggccgctgctagtaagaagaaacctggccagaaaaagagcaagaatgggtccgatgaccaggataagaaggtcgaaacactcatggtgccatccaagaggcaggaagctctccctctgcatcaggaaaccaagcaggagtcggggagcggaaagaagaaggccagtagcaagaaacagaaaactgaaaacgtttttgtggacgagcccttgatccacgccactacgtatatcccacttatggacaatgcagacagtagtccggtggtagataaaagggaagttattgacctccttaagcccgatcaagtagaaggaattcagaagtccggcaccaagaaattaaaaaccgagactgacaaagagaacgccgaagtgaagtttaaggactttctgctgtcactaaagacgatgatgttttccgaagatgaagccctgtgtgtggtagacctgctgaaagaaaaatctggggtgatccaggacgctctgaagaagagttctaagggcgagctgacaacactgattcatcagctgcaagaaaaggacaaattgcttgctgcagtgaaagaagatgccgcagctactaaagataggtgcaagcagctgacccaggaaatgatgaccgagaaggaaaggtcaaacgttgtgattactagaatgaaagaccgcatagggacactggaaaaggaacacaacgtgttccagaacaaaatccacgtgtcatatcaagaaacccagcaaatgcagatgaagtttcagcaggtccgcgaacagatggaagccgagatcgctcacctcaagcaggagaacggcatcctccgggacgcagtttccaacacaaccaaccagctcgaatccaagcagtcagccgagctcaacaaacttcgtcaggattacgcacgcctggtcaacgaactgacagagaagaccgggaagctgcagcaagaggaggttcaaaaaaaaaatgctgagcaggccgctacccaactcaaagtccagctgcaggaggcggagagacgctgggaggaagtccagtcttatatcaggaagagaactgcagagcacgaagccgcacagcaggatctccagtccaaattcgtggctaaagagaacgaagtccagagcttgcatagcaagctaaccgatacgcttgtgtcaaaacagcagcttgagcagcgcctcatgcagctgatggaatcagagcagaagcgtgtaaacaaggaggagagtctccagatgcaggtgcaggatatcctcgagcagaatgaggccttgaaagcccaaatccagcagttccatagtcaaatcgctgctcaaacctctgcgtctgttctggctgaagagctgcataaagttattgccgaaaaagacaagcagattaaacagaccgaagatagcttggcgagcgagcgcgatcgactgacgtctaaggaggaggagctcaaggatattcagaatatgaattttcttctgaaggctgaagtccagaaattgcaggccctggcaaatgaacaggctgccgctgctcacgagctggagaagatgcagcaatccgtctatgtcaaagacgataagattcgattactagaagagcagttgcagcatgaaatcagtaacaagatggaagaattcaagattttgaacgaccagaacaaagcgctgaagtctgaagtgcaaaaattgcaaacccttgtcagtgaacagcccaataaagacgtcgtagaacagatggagaagtgcatccaggagaaagatgagaaactgaagacagtcgaggagctgcttgagactggcttaatccaggttgccaccaaggaggaagaactcaacgccattagaaccgaaaacagtagcctgaccaaggaagttcaggatttgaaagcaaaacagaatgatcaggtgagctttgcctcgcttgtggaagaattgaagaaagttattcacgagaaagatggaaagattaagagtgtagaggagctccttgaggctgagttactcaaagtagcaaataaagagaagacagttcaggaccttaagcaagagatcaaagctttgaaagaagagatcggcaatgttcaattggaaaaggcccagcagctgagcatcacaagcaaggttcaggaactgcaaaacctgttgaaggggaaagaagaacagatgaataccatgaaggccgttttggaagaaaaagaaaaggacctcgcgaatactggaaaatggctgcaagatctacaagaggagaacgaatcactgaaggcgcatgtgcaggaagtggctcagcataatctgaaagaagcatccagcgcaagtcagttcgaagaactggagatcgttctgaaggagaaggagaatgagttgaaacgactggaagccatgctgaaagaaagagaaagcgacctttcatccaagacccagcttttacaggatgtgcaagatgagaacaagctgttcaaaagtcagattgaacaactcaagcagcagaactatcaacaggctagttcatttccccctcatgaagaactgctgaaagtgattagcgaacgagagaaagagatttctggcctctggaacgaacttgactctttgaaagacgccgtggagcaccagcgcaaaaagaataacgacttgagggagaaaaattgggaggctatggaagccctggcatccacggagaagatgttgcaagacaaggtgaacaagacatctaaagagcgccagcagcaggtggaagcggtggagctggaggccaaagaggtgctgaaaaaactgtttcctaaagtgtcggtcccttccaatctgagttatggagagtggctgcacggatttgagaaaaaggctaaggaatgtatggctggtacctcaggaagtgaagaggtcaaagttttagaacacaaactgaaagaggcagacgagatgcataccctcctgcagcttgagtgcgagaagtataaatccgttctggctgaaaccgagggtattcttcaaaagcttcaacggtctgtagagcaggaagaaaataaatggaaagtcaaagttgacgagtcacacaaaacaattaaacaaatgcagtcgagcttcacttctagcgagcaggagttggagaggctgcgctccgaaaacaaagacatcgagaacctgcgtcgagaacgagagcacctggaaatggaactggagaaggccgagatggagcggtctacctatgtgaccgaagtccgtgaactgaaggacctcctcaccgagcttcagaaaaaactggatgattcgtattctgaggccgtccggcagaacgaggagttaaacctccttaaagcacagcttaatgaaaccctgactaaactgcggaccgaacaaaatgagcgccagaaggttgcaggtgacctgcataaagctcagcagtctctggaactgattcagtccaagattgtcaaagccgcaggggacactacagtcatcgaaaactccgatgtcagtcctgagacagaatctagtgaaaaggaaacgatgagtgtttcactgaatcagaccgtaactcagctacagcagctcctgcaggccgtcaaccagcagcttacgaaagagaaggaacactaccaggtgctggagtag

SEQ ID NO: 227799 - DNA, 3921 bp, Artificial Sequence
  Description of Artificial Sequence: Synthetic coding sequence
atggaattttacgaatctgcttactttattgtgctcattccaagcatcgtgataacagtgatctttctgtttttctggctgtttatgaaggaaacactatatgatgaggtgcttgcaaaacagaagagggagcaaaaattgatacctacgaagacggacaagaaaaaagcagagaaaaaaaagaacaaaaagaaagagatccaaaatggtaatctgcacgaatctgacagtgagtcagtgcctcgcgatttcaagttatccgatgccttagcagtggaagacgatcaggttgcacctgtgcctctgaacgtggttgagaccagttcgtccgttcgtgagcgcaaaaagaaggagaaaaaacagaagcctgtcctcgaggaacaagtgattaaggagtcagatgccagcaagataccaggtaagaaggtcgaaccagtgcctgtgacgaagcagcccacccctcctagcgaggctgccgcaagcaagaaaaagccaggccaaaagaagagtaaaaacgggtctgacgaccaggataagaaggtcgagacactgatggtgccatcaaagagacaggaggctctgcctctgcaccaagagaccaagcaagaatctggctctgggaagaagaaagcctccagtaagaagcaaaagacggagaacgtcttcgttgacgagcctctcatccacgccaccacctatatccccttgatggataatgccgacagttccccggtagttgataaacgtgaggttatagatctgcttaagccagaccaggtagaaggaatccaaaaaagcggcaccaaaaaacttaagaccgagacagataaagagaatgccgaagtaaagttcaaagactttctgctgtcactaaaaacaatgatgtttagtgaggacgaggccctgtgtgtggtcgatcttcttaaggagaagtcaggggttatccaggacgcccttaagaagtctagcaaaggcgagcttaccactctgatccatcagcttcaggaaaaggataaacttttggccgcagttaaagaagacgccgctgcaactaaagatcgttgcaagcaattgactcaggaaatgatgactgagaaggagcggagtaatgtggtgatcacccggatgaaggacagaattggaacgctagagaaagagcataatgtattccaaaacaagatccatgtgagttatcaggaaacgcaacagatgcagatgaagttccagcaggtccgggaacagatggaagccgaaatcgcacatctcaaacaagagaacggaatcctgagagacgccgtgtcaaacactactaaccagctggaatctaaacagtctgcggaacttaataaattgagacaggattacgccaggttggtgaacgaactcactgaaaaaactggcaagctacagcaggaagaggtccagaaaaaaaatgccgaacaggctgctacccaactcaaggtccagctgcaagaagccgagcgtcggtgggaagaagtccaaagttatatcaggaagaggactgccgaacatgaggcggctcagcaggacctgcagtccaaattcgtagcaaaggaaaacgaagtacaatcattgcactccaaactcacagacacactggtatctaagcagcaattggagcagagactcatgcagctcatggagtccgaacagaaacgggtaaacaaggaggaaagcctacagatgcaggtgcaggacatcttggaacaaaacgaagcactcaaggctcagattcagcagttccacagtcagattgcagcccagacttccgcgtccgtgctcgcagaggaattgcataaggtcatcgccgagaaggacaagcagatcaagcagacagaagacagccttgcctcagaaagggatagattgacttccaaagaggaggaacttaaagacattcaaaacatgaattttcttctgaaggcagaagtccaaaaacttcaggccttggccaacgagcaggccgctgctgcacatgaattagaaaaaatgcagcagagcgtctacgtgaaggacgataagatccggctgcttgaagaacagcttcagcacgagatctcaaacaagatggaagaattcaagatcctcaatgaccagaacaaggctctgaagtctgaggtccaaaagctgcagaccctcgtctctgaacagcctaacaaggacgtcgttgagcagatggaaaaatgtatccaggaaaaggacgagaagctaaaaactgtagaggaattgctggaaacaggcctgatccaggtggcgacaaaagaagaggagctaaacgcaatccgcaccgagaactcgtccttaaccaaggaagttcaggatctgaaggccaaacagaacgaccaggtaagctttgcctccctggtcgaggagttgaaaaaagttatccatgagaaggacggtaaaatcaagtcagtggaggaattactggaagcagagctcctcaaagtggcaaacaaggaaaaaaccgttcagctgagcattactagcaaagtccaggaactgcagaatctgctcaaaggaaaggaggagcagatgaacactatgaaggccgtattggaagagaaagaaaaggacctggccaataccgggaagtggcttcaagatttgcaggaagaaaatgaatccctgaaggcccatgtgcaagaagtggcgcaacataacctcaaggaagcatcttcagccagccaattcgaggagctagaaatcgtcctgaaggagaaagaaaacgaactaaagcgattagaggccatgcttaaagaacgcgaaagcgacttatcatcaaaaacacagctgctgcaagacgtgcaagacgagaacaagctatttaagtctcaaatcgaacagctaaaacaacagaattaccaacaagcatcttccttcccccctcacgaggagctcctcaaagtgatttcggaacgtgagaaagagatatcaggattgtggaatgagttggactcacttaaggacgctgtcgagcaccagcggaagaagaataatgatttgcgcgaaaaaaattgggaggccatggaggccttggcatctactgaaaagatgctgcaggacaaggtcaataagacaagtaaagagcgacagcagcaggtcgaagcagtggaactggaggccaaagaagtgctaaagaaactgttccctaaggtttcagtgccatccaatctatcttacggcgaatggctgcacggattcgaaaagaaagctaaggaatgcatggcgggaacatctggctcagaagaggtcaaggtcctagagcataaacttaaggaggctgacgaaatgcatacactgcttcagctggagtgcgagaaatacaagtcagtgctcgctgaaactgaggggatcctacaaaagctgcagcgctcagtggaacaggaagagaacaagtggaaagtaaaggtggacgagtcacacaagacaataaaacagatgcaaagcagcttcactagctcagaacaggagctggagcgacttcggagtgagaataaggatatcgaaaacctacggagagagagggagcacctggagatggagctggagaaggcggaaatggagagaagcacatatgtcactgaggtgagagaacttaaggcgcaactgaacgagacgcttaccaaattgaggaccgaacagaacgagaggcagaaagttgcaggcgacttgcacaaggctcagcagtctctagaactcatccagtcaaagatcgtgaaggcagcaggggacacaaccgtcattgaaaacagtgacgtgtcacctgagaccgagtctagcgaaaaggagaccatgagtgtctcgttaaaccagaccgttactcagctgcaacagttgctgcaggctgtcaatcagcagctcacgaaggagaaagagcattatcaggtactggagtag

SEQ ID NO: 227800 - DNA, 4074 bp, Artificial Sequence
  Description of Artificial Sequence: Synthetic coding sequence
atggagttctacgagagcgcctatttcattgtgctgatccctagcattgtgattacagtgattttcctctttttttggctgtttatgaaggagaccctctacgatgaagtgctggccaaacagaaaagggaacagaagctgatcccaacgaagaccgataagaaaaaagcagagaaaaaaaagaataagaaaaaagaaatccagaacggaaacttgcacgaatccgattctgagtccgtgccccgagatttcaagctgagcgatgccctggcagttgaggacgaccaggtggcccctgtccccctgaacgtagtcgaaactagctcaagcgtgcgcgagcgcaaaaaaaaggaaaaaaaacaaaaaccagttctcgaggagcaagttataaaggagagtgacgcaagtaaaatccccggtaagaaggtggaaccagtgcctgtgaccaaacagccaactccaccttccgaggccgcagcgtccaagaaaaaacctggtcaaaaaaaaagcaaaaacggatctgacgaccaggacaagaaagttgaaactctcatggtgccaagtaagcggcaggaggctcttcccctgcatcaggaaactaaacaggaaagtgggtctggaaagaaaaaagccagctcaaaaaaacagaaaacagagaatgtatttgtggacgaaccacttatacatgcaactacctacatcccacttatggacaacgcggacagcagccctgtggtggacaagagagaagtgattgatcttctgaagcctgatcaggtggagggtatccaaaaatctggcactaagaaacttaagacagagaccgacaaggagaacgctgaggtgaagttcaaggattttttgctgtccctcaaaaccatgatgttctctgaggatgaggccctttgtgtggttgacctgctgaaggagaagtctggagtgatacaggacgccctgaaaaagtcaagcaagggagaacttactaccctcatccaccagctgcaggaaaaggataagctcttagcggctgtaaaggaggacgccgcagccacgaaggacagatgcaagcagcttacccaggaaatgatgacagaaaaagaaagatcaaatgttgtgatcacccgcatgaaagaccggatcggaaccttagagaaggagcacaatgtctttcagaacaagattcatgtctcttaccaggagacgcagcagatgcagatgaagttccagcaggttcgcgagcagatggaggccgaaatcgctcatttgaaacaggagaatggcatattgagggacgccgtgtctaatactaccaaccagcttgaatcgaagcaatcagcggaattaaataagctgcggcaggactatgcgcgactggtgaatgagctgaccgaaaagaccgggaagctgcaacaagaggaggtccagaaaaaaaatgctgagcaggccgcaactcagttgaaggtgcagctccaggaggccgagcggcgatgggaggaagttcagtcttacatcagaaagcggaccgccgagcacgaggctgcgcagcaggatcttcagagcaaattcgttgctaaagagaacgaggtgcaatcgcttcactcgaaactcactgatactctcgtcagcaagcagcaacttgagcagaggctgatgcaattaatggagagcgaacagaagcgagtcaacaaagaggagagcctgcagatgcaggttcaggatatcctcgaacagaacgaagcactgaaggcccagatccagcaattccacagccagattgcagcacagactagtgcatccgtcctcgcagaagagctgcataaggtgattgctgagaaggataaacagatcaaacagacagaggactccctggcttccgagagagatagattaacttcaaaggaagaggagctgaaggacatccagaacatgaacttcctcctaaaggcagaggtgcagaagctgcaggctctcgctaacgaacaggcagccgcagcccacgagttggaaaagatgcagcagtccgtgtatgtcaaggatgacaagattcgacttttggaggagcagctacagcacgaaatttccaataagatggaggaattcaaaattctcaatgaccagaataaggctctcaaatcggaggtccagaagctgcagactctcgtttccgaacagccgaataaagacgtggttgagcagatggagaagtgtatccaagaaaaagatgaaaaattgaaaactgtggaggaattgctggaaaccggcctgatccaggtcgccactaaggaggaggagctcaacgctattcgcaccgagaattcaagcctcacaaaggaagtacaggatctgaaagctaaacagaacgaccaggtttcgtttgcctcactggttgaagaactcaaaaaggtgatacatgagaaggacggcaagatcaaaagcgttgaggagctgttagaagccgagctgctgaaagtggccaataaagagaaaacagtgcaggatctaaaacaagagattaaagccctgaaagaagaaattgggaacgtgcagcttgagaaggcacagcagctgagcatcaccagcaaggtgcaggaactgcagaacctcctgaagggtaaggaagagcagatgaacacaatgaaggcagtccttgaagagaaggagaaggacctggcgaacacggggaagtggctacaagacctgcaggaagagaatgagtccctgaaagcccacgttcaggaagtggcccaacacaacttgaaggaggctagttctgcatcacagtttgaggaattagaaatcgttctgaaagagaaggaaaacgagttgaagaggctcgaagcaatgctcaaagaacgggagtcagacctgagctccaaaacccaacttctgcaggatgtgcaagacgaaaataaattgtttaaatctcagatcgagcaactcaagcaacagaattatcagcaggcctcatcctttccccctcacgaggaactcctgaaagtcatatctgaaagggagaaagagatctccggtctctggaatgagctcgatagcctgaaagatgcagtggagcaccagcgcaaaaaaaacaatgacctgcgggagaagaactgggaggccatggaggccctcgctagtaccgagaagatgctgcaagataaagtgaacaaaacatccaaggagaggcagcagcaggtggaggccgtggagcttgaggccaaggaggtcttaaagaaactgtttcctaaggtgtccgtgccctctaatctatcctacggagagtggctccacggctttgagaagaaggcaaaggaatgcatggccggtacgagtgggagcgaagaagtcaaggtcctggaacataagctgaaggaggcagatgaaatgcataccctcctccagcttgagtgtgaaaaatataaatctgtcctggcagaaacagaaggtattctacaaaaactccagcgtagcgttgagcaagaagagaataaatggaaggtcaaggtcgacgaatcccataaaactatcaaacagatgcagagcagctttacttcctcagagcaagagttggagcggctgcggtcggagaacaaggacatcgagaacctgcggcgagaaagggagcacctcgagatggaacttgaaaaagccgagatggaacgttccacctacgtcactgaggttcgcgagttgaaagacctcctcaccgagctccaaaagaagttggacgattcttattccgaagccgtgagacagaatgaggaacttaacctactcaaggcccagctgaacgaaacactcactaagctcagaaccgaacaaaatgaacggcagaaagttgctggagatctgcacaaggctcagcagagtctcgagttgatacagtcgaagattgtgaaagccgctggggatactacggtgattgagaactccgacgtgtcacctgagaccgaatcctcggaaaaggagacaatgtcggtgagcctgaatcagacagtcacccagctgcagcagttgctccaggcagttaaccagcagctgacaaaagaaaaggaacattaccaggttctggagtag

SEQ ID NO: 227801 - DNA, 3903 bp, Artificial Sequence
  Description of Artificial Sequence: Synthetic coding sequence
atggagttctatgagtcagcttacttcatcgtgttaatcccctctatcgtaattactgttattttcctttttttctggctgtttatgaaggaaaccctgtacgacgaggttttagccaaacagaagcgagagcagaagctgatcccaacgaagacagataagaaaaaagccgagaaaaaaaaaaataaaaaaaaagagattcaaaacgggaacttgcatgaatccgattccgaatccgtgccaagagattttaagctctcagatgcactggccgtcgaagatgatcaggtggcacctgtgcccctgaatgtcgtagagacttcatcaagcgtacgggaacgcaagaagaaggagaagaaacagaagcccgttttggaggagcaggtgattaaagaaagcgacgcatctaagatccccggaaaaaaagttgagcccgtaccagtgacgaaacagcccaccccaccatctgaggctgccgctagcaagaagaaaccaggacagaaaaagtcgaaaaatggcagcgatgatcaggacaaaaaggtggagactctgatggttccatctaaacggcaggaagccttgccactgcaccaggaaaccaagcaggagtctggaagcggaaaaaaaaaagcatcctctaagaagcagaaaactgaaaacgttttcgttgatgaacctctgatccatgccacaacctacattcccctcatggacaacgcagattcctctcccgttgtcgataagcgagaggttatagatctgcttaagccagaccaggtcgagggaatccaaaaaagcggtaccaagaagctcaagacggaaaccgataaagaaaacgctgaggttaaatttaaggatttcctcctctccctgaaaacgatgatgttcagcgaggacgaggccctgtgtgttgtcgacctgctgaaagagaagtcaggcgtgattcaagatgcgctcaagaaatcctcaaagggggagctgaccacgcttatccaccagttacaggagaaagacaagctgctcgccgctgtgaaggaggacgcagccgctactaaggaccggtgcaaacagctgacccaggaaatgatgaccgagaaggagcgaagtaacgttgtgattacgcggatgaaggatcgaattggaaccttggagaaggaacacaatgtgtttcaaaacaaaattcatgtgtcctatcaggagacgcaacagatgcagatgaagtttcagcaagttcgcgagcaaatggaggcagagatcgcacaccttaaacaggagaacggcatcctgcgggacgccgttagtaatactactaaccagctggagtctaaacagtccgctgaactgaacaagctgcgtcaagactacgcgaggttagttaatgaactcactgaaaaaaccggtaaacttcagcaggaggaagtacaaaaaaaaaatgccgaacaagccgcaacgcagctgaaggtgcaattgcaggaagcagagaggcgatgggaggaagtgcagtcttacataagaaagaggactgcggaacatgaggccgctcagcaagatctgcagtccaagtttgtggccaaggaaaacgaggtgcagtctttgcattccaagcttacggacactctggtgagtaaacagcagttggagcagaggctgatgcaactgatggaatccgaacaaaagcgtgtcaataaggaggagtccctacagatgcaggtgcaggacattctggaacaaaatgaggctctcaaagcccagatccagcagttccacagtcagatcgcagctcagactagtgcaagtgttctagcagaggaactccacaaggtgatagccgagaaagataaacagattaagcagacagaggattcgctggcgtctgagcgggatcgattaacctctaaggaggaagagctcaaggacatacagaacatgaattttttgctgaaagccgaagtgcaaaaattgcaggccctagccaatgagcaggctgccgcagcccatgagttggagaaaatgcaacagagcgtgtacgttaaggatgacaaaattcggctgcttgaggagcagcttcagcatgagattagtaataagatggaagagtttaagattctgaacgatcagaataaagccctcaagagtgaagttcaaaagctccagactctggtcagtgaacagccgaataaggacgttgtcgagcagatggagaagtgcattcaggagaaggacgaaaaactcaagactgtggaagaactcctggaaacagggctcatccaggtggccacgaaagaagaagaattaaatgcaattcggacagagaactcgtccctcaccaaggaggtgcaagatctgaaagccaaacagaacgaccaagtctctttcgccagccttgttgaggaattgaagaaggtgattcacgagaaagacggtaagattaaaagcgtcgaagaactactggaggcagaacttctgaaagtggccaataaagagaaaaccgtgcaggacctgaaacaggagataaaggcgcttaaggaggagatcgggaacgtgcagttggagaaggcacagcagctttccatcacctctaaagtgcaagagctgcagaatctcctgaagggaaaagaggaacagatgaacacaatgaaggccgtccttgaggaaaaggaaaaagatctggccaataccgggaaatggctgcaggatctgcaagaagaaaatgaatcactcaaggcacatgtccaggaagtggctcaacataatctgaaagaggcatcatctgcatcacagtttgaagaacttgaaatagtgcttaaagagaaagagaacgagctgaagaggctcgaggccatgcttaaagaacgcgagtctgatttgtcttcaaaaacacagctgctacaggacgtgcaggatgaaaacaagctcttcaagagccaaatcgaacaactcaagcagcaaaattaccagcaagccagctcctttccacctcacgaagaactcctgaaagtgatatctgagagagaaaaggagatcagtgggctctggaacgagctggactccctgaaggacgccgtggagcaccagagaaaaaagaacaacgaacgtcagcagcaggtcgaggcagtcgaactggaagccaaggaagttttgaagaaactattcccaaaagtttctgttccaagcaatctgtcatacggtgagtggctccacgggttcgaaaagaaggccaaggagtgcatggctggtacatcgggatcagaagaagtgaaggtgctagagcataagcttaaagaagctgacgaaatgcacactctgttgcagctggaatgcgaaaagtacaaaagcgttctggcggagactgaggggatcttacagaagttgcaacggtcagttgagcaggaggagaataaatggaaggtgaaagtggatgaatcccataagacgatcaaacagatgcaatcaagctttacctctagcgagcaggaactcgagaggctgcgcagcgaaaacaaagacattgagaatctgcgcagagaaagagagcatctggaaatggaattagagaaggctgagatggagcggtctacttacgtgacagaagtcagggaactcaaggctcaactcaacgaaaccttaacaaaactgcggactgagcagaacgagcgccagaaggtggcgggagacctgcacaaggcacagcaatccttagaactgattcaaagtaaaattgtaaaggctgcaggcgatacaactgttatcgagaactctgatgtgtctccagagaccgaatcgtctgagaaggagaccatgtctgtttccctgaatcaaacggtgacccagctccagcagctactgcaggctgtgaatcagcagcttaccaaagagaaggaacactatcaagtgctggaatag

SEQ ID NO: 227802 - DNA, 4074 bp, Artificial Sequence
  Description of Artificial Sequence: Synthetic coding sequence
atggagttctacgagtcagcatattttatcgtgctgattccttcgatagttataaccgtaatattccttttcttctggctgttcatgaaggaaacactgtacgacgaagtcctggccaaacagaagcgggaacagaagctaatcccaacaaagacagataagaaaaaggctgaaaaaaagaagaataaaaagaaggaaatccagaacggaaatctgcatgagagcgattccgaatccgtgccccgtgacttcaagctgagtgacgcattggctgtggaggatgaccaggtggctccggtcccactgaatgtcgtagaaaccagtagctcagtgagggaacgcaagaagaaggaaaagaagcagaaacctgtccttgaggagcaggtcataaaggaatctgatgcctccaagatccccggaaaaaaggtagaacctgtgccagtgacaaaacagcccacccctcctagcgaggccgctgctagcaaaaagaaacccggtcaaaagaaaagcaaaaacggatccgacgatcaggacaaaaaggtggaaactctgatggtcccgtcaaaacgccaggaggcactccccctccatcaggaaacaaagcaagagagcgggtctggcaagaagaaagctagcagcaagaagcaaaagacagagaacgtttttgtggatgaacccctgattcacgccacaacttacatacctctgatggataacgccgactcctctcctgtagttgacaagcgcgaagtgattgatctgcttaaaccagatcaggttgaaggaatccagaagtccggtaccaaaaaactcaaaaccgaaacagacaaggagaacgccgaggttaaattcaaggattttcttctgtcgctaaaaacaatgatgttcagcgaggacgaagccctgtgcgtcgtcgacttgctgaaggaaaaatccggggtaattcaagatgccctgaaaaaatccagtaagggagagctcacaacattgatccaccagctccaggaaaaagataagctgctggccgctgttaaggaagatgctgcagcaaccaaagatagatgcaagcagttaacacaggaaatgatgacagagaaggaacggtctaacgtggttattaccagaatgaaagataggatcggcacgctagagaaagagcacaacgtctttcagaataagatccacgtatcgtaccaggagacgcaacaaatgcaaatgaaattccagcaggttagggagcaaatggaagccgagatcgcccatctcaaacaggaaaacgggatcctgagagatgcagtctctaacaccacaaatcagctcgaaagcaagcaatccgctgagctcaacaaactccggcaggattatgctcggttagtcaacgagctcacagagaaaacaggcaaactgcagcaggaggaagttcagaagaagaacgccgaacaggcggctacccagctcaaggttcaacttcaggaagcagagcggcgttgggaggaggtccagtcttacatcagaaagcgaaccgcagaacacgaggccgctcagcaggacttgcaatcaaagttcgtggctaaagaaaatgaggttcagtcactacattccaagctaaccgataccttggtctcaaaacagcagctcgagcagaggctaatgcaactgatggaaagcgaacagaagcgggttaataaggaagagagtctacagatgcaagtgcaggacatcctggagcagaatgaggctctcaaagcacagatccaacaattccatagtcagatcgcagctcaaactagcgccagtgtcttggccgaagagctccacaaggtgattgccgaaaaggacaagcagataaagcagactgaggacagtctggccagtgagcgagatagattgacctccaaggaagaagaactgaaggatatccagaatatgaattttttgcttaaagctgaggtgcagaagttacaggcactggcaaatgaacaagccgcagccgctcatgagctagagaagatgcagcagagcgtatacgttaaggacgataaaatccgcctcctggaggagcaactgcagcatgagattagcaacaaaatggaggagtttaagatccttaatgaccagaacaaggcactgaaaagtgaggtccaaaagcttcagactctcgtgagcgagcaacctaacaaggacgttgttgaacaaatggagaagtgcattcaggagaaagatgaaaagttgaagaccgtcgaagagctgctggagaccggcctgattcaagtcgccaccaaggaggaggaattaaacgcaatcaggaccgagaacagcagccttaccaaagaagtccaggacctgaaggccaaacagaatgaccaggtgtccttcgctagtttagtagaggaactgaaaaaggtgattcatgagaaagacggcaagattaagtctgttgaggaactcctggaagccgagttgctgaaggtggcaaacaaggaaaaaacagtccaggatctgaagcaagagatcaaggcccttaaagaagaaatcggcaacgttcagcttgagaaggcacagcagctgtccatcacctccaaggtgcaggagctgcagaatttgttaaaggggaaagaagaacagatgaatactatgaaagctgtgctggaagagaaagaaaaagacctggccaacaccggcaaatggctacaagacctgcaggaggagaatgaatcacttaaagcccacgtgcaagaagtcgctcaacacaatctcaaggaggcatccagtgccagccagtttgaggaacttgagatcgtactgaaggaaaaagaaaacgagctcaagcgcctcgaagctatgctaaaagaacgcgagagtgacctcagctccaaaacccagctattgcaggacgtgcaagacgagaacaagctgtttaaaagccagattgagcaactcaagcagcagaactatcagcaggcctcatcatttccccctcacgaggagctgctgaaggtcatttcggagagggagaaggagatcagcggcctttggaacgaactcgatagcctgaaggatgccgtcgagcatcagcggaagaagaacaacgacctgagggagaaaaattgggaggcgatggaagccctggctagcaccgagaagatgctacaggacaaggtcaataagacttccaaagagaggcagcagcaggtggaggctgtcgagctcgaagccaaggaagtactgaagaaactctttccgaaggtcagcgtcccaagtaacctgagttatggggagtggctacatggctttgagaaaaaagccaaggagtgcatggctggtacctcaggtagtgaggaagtgaaggtgttagaacataaactgaaggaggccgatgaaatgcacaccctgctgcagctagaatgtgagaaatataaatccgttctagcggaaacagagggcatactgcagaaactacagcggtctgttgagcaagaagagaacaagtggaaggtgaaggtggatgagtcgcacaagaccatcaaacagatgcagtccagcttcacctctagtgagcaagagctggaacgtcttcgttccgagaataaagacatagaaaatcttcgtcgcgagcgagaacatttagagatggaactggaaaaggctgagatggagagaagtacttatgttacggaagtgcgggaactcaaggacctgctgactgagcttcaaaaaaagctagatgattcctattctgaggctgtccgtcaaaacgaagaactgaatttgctgaaagcacagttaaacgagactctgaccaaactgcgcacagagcagaatgagcgccagaaagtggcaggagatttgcacaaagcacagcagagcctcgaattgattcaatccaaaatcgtaaaggctgctggtgatacaaccgttattgaaaattccgatgtgagccccgagactgaatcatctgagaaggaaaccatgagtgtgtcattaaatcagactgtcacgcagctgcagcagctcttgcaagccgtgaatcagcagttgaccaaagagaaggaacactaccaggttctagagtag

SEQ ID NO: 227803 - DNA, 228 bp, Artificial Sequence
  Description of Artificial Sequence: Synthetic coding sequence
atggaattttacgagtctgcttactttattgtgctgattccatcaatcgtgatcacagttatctttctgtttttttggttgttcatgaaagagaccctgtacgacgaggttctggccaagcagaaacgagagcagaaactaattcccacaaaaaccgacaagaaaaaggccgagaagaagaagaataaaaagaaagagatccagaacgggaacctgcacgagtcctag

SEQ ID NO: 227804 - DNA, 183 bp, Artificial Sequence
  Description of Artificial Sequence: Synthetic coding sequence
atggagttctacgaaagcgcctactttatcgtcctgattccatcaattgtgatcaccgtgatatttcttttcttctggttgtttatgaaggagaccctgtatgatgaggtgcttgccaaacaaaaacgagaacagaagcttatcccaaccaagacagataaaaaaaaggcagagaagaagtag

SEQ ID NO: 227805 - DNA, 3171 bp, Artificial Sequence
  Description of Artificial Sequence: Synthetic coding sequence
atggctagccagccaaactcttctgcaaagaagaaagaggagaagggaaaaaacatccaggtggtggtcaggtgtcggccatttaacctggcagaacgtaaagcaagcgcacacagcattgtggaatgtgacccggtgaggaaggaggtgtccgtgagaaccgggggtttagcggataagtcgtccagaaaaacttacacatttgatatggtgttcggggctagtactaaacagatagacgtgtataggtcagtcgtgtgtcccattttggacgaagtcattatgggatataattgcaccatatttgcctatggccagaccggcaccggcaaaactttcactatggagggagagagatctcctaatgaagaatatacctgggaggaggatccgctcgctggcataattccaagaacccttcaccaaatttttgagaaactgaccgacaatggtaccgaatttagtgtgaaggttagtctgctcgagatctacaatgaggaactctttgatctcctgaatccaagttccgacgtgtctgaacggcttcagatgttcgatgatccacgcaataagaggggagtcattattaagggtttggaggagattaccgttcacaacaaggatgaggtatatcagatactggagaaaggtgctgccaaaaggacaaccgcagccacactgatgaatgcctatagctcccgtagccatagtgtgttcagtgttacaattcacatgaaagagactacgatcgacggggaggagctcgtaaaaattggcaaattgaatctggtcgacctggccggaagtgaaaacatcggacggagtggagccgtagacaagcgagcgagagaggccggaaacataaaccagtccctgctgaccctcggcagagtcattactgcacttgtggaacgtacacctcacgttccatatagagagagcaagcttactcgcatactgcaagattccctgggtggtcggacaaggaccagcattatcgcaaccattagtccagcttcactgaatctagaggaaactctgtccactctcgaatatgcccaccgggctaaaaacatactgaacaagccggaagtcaatcagaaactgactaagaaggccctgatcaaagaatatacagaagagatcgaacggttaaagagggatctggcagccgcacgcgaaaaaaacggcgtatatattagcgaggaaaacttcagagtgatgagtggcaagctgacagtccaggaagagcagatcgtggagttgatcgaaaaaattggcgcagttgaagaggaactgaaccgagtgactgaattgttcatggacaacaagaatgaactcgatcagtgcaagtctgacctgcagaataaaacccaggagctcgagaccacacagaaacatttgcaggaaactaaactgcagcttgtgaaggaggaatatatcacatccgctttagagagcactgaggagaagctacacgacgccgctagcaaactgttaaatacggttgaggaaacaacgaaggatgtgtccggcctgcactctaagctggatagaaagaaggccgtggaccaacataacgctgaagctcaggatatattcggaaagaaccttaacagcctgtttaataacatggaagagcttatcaaggatggtagctccaagcagaaggccatgcttgaggtccataagacactctttggcaatttgctctcgtcgtccgtgtcggcattggacaccatcacaacggtggcactgggctcccttactagcattcctgaaaatgtgtctactcatgtttctcagatattcaacatgatcctaaaagagcaatcacttgccgcagagagcaaaaccgtcttacaggagctgattaacgtcctgaaaaccgacctgctttcgtccctagagatgatactctcacctaccgtggtcagtatcttgaaaatcaactctcagctaaagcatatcttcaaaacctcgctgaccgtggccgacaagattgaggaccagaaaaaagagttggacgggtttctgtctattttgtgtaacaacctgcatgagctgcaggagaacaccatttgttctcttgtggaaagtcagaagcagtgcgggaatctgaccgaagacctgaagacgataaagcaaacacatagtcaggaactctgcaagcttatgaacctgtggacagagcgcttttgcgctttagaagagaagtgtgagaacatccagaagcccctgtcatccgtgcaggagaatattcagcaaaagtccaaagatatagtaaacaagatgactttccatagccagaaattctgcgcagattccgatgggttctcccaggaattgcgaaatttcaatcaggaagggacaaaactggtagaagaatctgtgaagcacagcgataaacttaacggcaaccttgaaaagataagccaagaaacagagcagaggtgcgaaagcctgaatacgagaacggtgtacttcagcgaacagtgggtgagttcactcaatgagcgcgaacaggagctacataatttgctggaggtggttagtcaatgctgtgaggcctcctccagtgacattaccgaaaagtctgatgggcgaaaggccgcacatgagaagcagcataacattttcctggaccaaatgacaatcgacgaagacaagctgatagcccaaaatctggagctcaacgagactatcaagattggtctcacaaagctgaattgcttcctggaacaagacctgaagctggacatcccgaccggtaccacacctcagagaaaatcatacttgtatcccagcaccctggtccgaaccgaacctcgggagcatctcctggaccagcttaagagaaaacagcccgaattgctgatgatgctcaactgcagtgaaaacaataaggaagagaccattcctgacgttgacgtcgaggaagcagtcttggggcagtacaccgaggaaccactgtcccaggagccgtcggtcgacgccggagtggactgctctagcattgggggtgtaccattctttcagcacaagaagtcacatgggaaagacaaagagaatagaggtataaataccctcgagcgaagcaaagtggaggagacgacagaacatctcgtgaccaagtcccgactgccactgcgtgcccagattaacctttag

SEQ ID NO: 227806 - DNA, 5418 bp, Artificial Sequence
  Description of Artificial Sequence: Synthetic coding sequence
atgtctgatactaaagttaaggttgcagttagagtgaggccaatgaatcgccgagagttggagctgaacaccaagtgcgttgttgaaatggagggcaatcagacagtgctccatccacctccaagtaatactaagcagggcgagcgcaagcctccaaaagtttttgcattcgattactgcttctggtctatggacgagtccaacactaccaagtacgccggtcaggaggtcgttttcaagtgcttaggggaaggcatactggagaaggccttccagggctacaatgcctgtatttttgcctacggacagaccgggagcgggaagtcatttagtatgatgggccatgctgaacagctggggcttataccacgtctatgctgtgccttgttcaagagaatcagtctcgaacagaatgagtcccagacatttaaagttgaagtgtcttacatggaaatttataatgaaaaagtgcgggacttgctagacccaaaaggaagccgccaatctctgaaagtgagagaacataaagtgctaggcccatacgttgacggactgtcgcagctcgctgtgacttcgttcgaagatatcgaaagtctgatgtcagagggaaacaagtccagaacagtggccgcaaccaatatgaatgaggagtctagccggagccatgccgtttttaacatcattatcacgcagaccttatacgatctccagtccggcaatagcggggaaaaagtgtcaaaagtcagtttagtggatctggctgggagcgagcgggtgtccaaaacaggagccgcaggtgaacggctgaaggaaggttctaatatcaataagtccctcaccaccttaggacttgttatcagcagcctggccgaccaggccgctggtaaaggaaagtcaaagttcgtcccgtaccgggacagcgtacttacatggttactgaaagacaacttaggtggtaattcccagacgtccatgatagcaacaatctcaccagcagccgacaattacgaggagaccttatctacactgagatacgctgaccgcgcaaagcggatcgtaaaccatgccgtggtgaatgaagaccccaacgcaaaagtaattcgtgaactgcgagaggaggtcgaaaaactgcgcgaacaactgtcccaagccgaagccatgaaggctccggaactgaaggaaaagctggaggagtccgagaaactcattaaggagctgacagtgacgtgggaagagaagttgaggaaaacagaggaaatagctcaggaacgacaacggcaactggaaagcatgggcattagcttagagatgtcagggattaaggtgggagacgacaaatgttacctggtgaacctgaacgcagatcctgcactgaatgagcttctcgtttactacctcaaagatcatacccgggtgggagccgacacaagccaggatatacagctcttcggcattgggattcaacctcaacactgcgaaatcgacatcgcttctgacggagacgtgacactcactccaaaagagaacgctcggtcttgcgtaaacggcacattggtgtgttcaacaacacaactgtggcacggagaccgcattctgtggggcaacaaccatttttttcgtatcaacctgcccaaacggaaacggagggattggctgaaagattttgaaaaagagaccggcccacccgagcacgatcttgacgctgcctccgaagcttctagcgaacctgactataactacgagtttgctcagatggaggtcatcatgaaaaccctaaacagcaacgacccagttcagaacgtggtgcaagtattggagaagcagtatctagaagagaagagatcagcacttgaggaacaacgccttatgtacgagcgcgagctggagcagctgagacagcaactgtctccagaccgtcagccccagagtagcggacctgatcggctagcttacagttcccagaccgcccagcaaaaggtcacccaatgggccgaggaacgagatgagctgtttcgtcagagtctggctaaactccgggagcagctggtcaaagcaaataccttggttagagaggctaatttcctcgcagaggaaatgtctaagctgacagattaccaggtgactcttcaaatccccgctgctaatctgagcgcaaacagaaagagaggggcaatcgtttctgagccagccattcaggtaaggagaaagggcaagtctacgcaggtatggacaatcgagaaacttgagaacaaactcattgatatgcgtgatctatatcaggaatggaaggagaaggtgcctgaggctaaacgtttgtacggaaaacgcggagacccattctatgaggctcaggagaatcataacctcatcggcgtagccaatgtttttcttgagtgtctgttctgtgacgtcaagctgcagtacgctgtaccaattatctctcagcagggtgaggtcgcaggtaggctgcatgttgaagtcatgcgggtcacgggggcagtgcccgagcgggtagttgaggatgactccagcgaaaactcttctgagagcgggtccttggaagtcgtggacagttccggggaaatcattcatagggtgaagaagctcacatgcagagtgaagataaaagaggcaactgggttacccctgaacctgtccaacttcgtgttttgccagtacactttctgggaccaatgcgagtctaccgttgccgctccagtggtcgatccagaggtcccgtcaccacagagcaaagatgcccagtacaccgtgactttcagccattgtaaagattatgtcgtgaacgtcaccgaagagttcttggagttcatctctgatggggctttggccatcgaggtgtggggtcacagatgtgccggaaacggcagtagcatctgggaggtggacagtctccacgccaagactagaactctgcatgacagatggaacgaagtgacccggcgaattgagatgtggatcagcattcttgaattaaacgagcttggcgagtatgcagctgtagagctgcatcaggcaaaagacgtcaacaccggcggtatcttccaattgcgccagggccattctcgtagagtacaggtcaccgtgaagcctgtgcagcactcaggtacactcccattgatggtagaggcaatcctgagcgtctccataggatgcgttaccgcccgatccaccaaactccagagaggactggactcataccagcgagacgacgaggatggcgatgacatggatagttaccaggaagaagatctgaactgcgtgcgtgagcggtggtctgatgcacttatcaaacgacgggaatacctggatgagcaaattaagaaggtgtccaataagaccgaaaagaccgaagacgatgttgagagagaagctcagttggtggaacagtgggtggggctgactgaagagagaaacgccgtcttagtgcccgctcccggaagtggaatcccaggagcccctgccgattggatccccccacctggcatggaaacccacatccctgtcctgtttctggatctgaacgccgacgacctgtccgccaacgagcaactcgtgggccctcatgcctcaggggttaactccatcctcccgaaagagcacggatctcagtttttctatctccccataattaaacactcagacgatgaggtttcggccaccgccagttgggatagctccgtgcatgactcggtacatttgaatagggtcacacctcagaacgagaggatttatctcattgtcaagacgaccgttcagctcagccatcccgcagccatggaattggtattgcgcaaaagaattgccgcaaatatttataataagcagtcattcacacaatccctgaagaggcggattagcctgaagaatattttctatagttgtggggtgacctatgagatcgtttccaacatcccaaaggccactgaggagatagaagacagggaaaccctcgctctattggcagctagatcggagaacgaaggtaccagcgacggagagacttacatagagaaatacacaagaggcgtcctgcaggtggagaatattctgagcttagaaaggttacggcaggctgtcaccgtgaaagaggccctcagcaccaaggcaaggcacataagacgttctctgagcactcctaacgtccacaacgtatcaagtagtagacctgacttgagcgggtttgatgaggacgacaaaggatggccggaaaaccagctagacatgagcgactattcatcatcgtatcaggacgtcgcttgctacggtactctgcctagagattcgcccagaagaaacaaggaaggttgcactagcgagacaccacacgcattaaccgtgtcccccttcaaggcattcagcccccagccgcctaagttcttcaaacctctgatgccagtgaaggaagagcataaaaagaggatagcactagaagcccgaccactcctttcccaggagagcatgccaccacctcaagcccacaatcccggatgcatagtgcctagcggcagcaacgggagtagtatgccagtcgaacacaacagtaaaagggaaaagaagatcgactctgaggaagaggaaaacgaactagaggccataaatcggaaactcatttcttctcagccctacgtgccagtggaattcgcagactttagcgtatacaatgcctcactggaaaaccgggagtggttcagcagcaaagtcgacctgtctaattctcgtgtcctggagaaggaagtgtccaggagccctactactagttctatcaccagcggatatttctcacactcagcatctaatgcaacacttagcgatatggtcgtcccaagtagcgactcctccgaccagctggctatccagacgaaggatgccgattccaccgagcattcaactcctagcttggtccatgactttcggccttcctctaacaaggagttgaccgaagtggagaaaggtcttgtaaaggacaaaattattgtggtgcctctaaaagagaatagtgcccttgctaagggcagcccatcctctcagtcaattcccgagaaaaattccaagtctctgtgccggaccggttcctgctctgagctggatgcctgcccaagcaagatttctcagccggcaagggggttttgccctcgtgaggtgacggtggaacatacaaccaacatcctcgaggaccacagctttaccgaatttatgggggtcagtgagggcaaggacttcgacggtctgacggactccagcgctggcgagctgtcttcccgcaggagtctccccaacaaaactggcggaaagacagtgtctgatggcttgcaccatccatcccagctgcactccaagctagagaatgatcaggtaatcatcccagaggcagcattttgggtgctgtgctgtcagtaa

SEQ ID NO: 227807 - DNA, 5249 bp, Artificial Sequence
  Description of Artificial Sequence: Synthetic coding sequence
atgtctgataccaaagttaaggtagcagtgcgcgtgcgacctatgaacagaagggagctggagctgaacaccaaatgtgtagtcgaaatggagggcaatcagaccgtcctacacccacctccctctaacacgaagcaaggagaaagaaagcctcctaaggtgttcgcattcgactattgtttttggtccatggacgagtcgaatacaaccaagtacgccggacaggaggtagttttcaagtgtctgggagagggcattctggaaaaagctttccagggatacaacgcgtgcattttcgcttatggccagacaggctctggcaaatccttctctatgatgggacacgcagagcaactgggactaataccgcgattgtgctgcgcactgttcaagcgcattagcctcgagcagaacgagtcccagaccttcaaggtggaggtttcttatatggagatctataacgagaaagtccgtgaccttctcgacccaaagggcagcagacagtcactaaaagtgcgggagcataaggttctgggtccgtacgttgacggactgtcccaactggctgttaccagcttcgaagatatcgagtcactaatgtctgaagggaataaaagtagaacggtagccgcaactaatatgaatgaggagtcctcaagatctcatgcagtgttcaatatcatcattactcagacactgtacgatcttcagtccgggaacagtggggagaaagtgtccaaggtgtctctggtcgatttggccggatctgagagagtttccaagaccggcgcagcaggagaaaggttgaaggaggggagcaacatcaataaatccttgaccactcttggtcttgtaatctcgagtcttgcggaccaggctgctggcaaggggaagagtaaattcgtgccctatcgcgacagtgtcctgacctggctgctgaaagataatcttgggggtaatagccagacttctatgatcgcaaccatctcgcccgcagccgacaattacgaggagacgctgtccacactccggtatgcggaccgcgcaaagcggattgtcaaccatgctgtggtgaacgaggaccccaacgctaaagttattcgggaactgcgtgaggaggtcgagaaactcagggaacaattatctcaggccgaagctatgaaggcgccagagctgaaggaaaaacttgaggagtccgaaaaactgattaaggagttgactgtgacctgggaggaaaaacttaggaagactgaggagatcgcacaggagcgacagcggcaattggagtctatgggcatctcactggagatgtcaggtataaaggtaggcgatgacaagtgctatctggtgaatttgaacgctgacccagccctcaacgagctattggtgtattatctgaaggaccacaccagggtgggtgcagatacgtctcaagacatccagctgttcggcattggaatacagccccagcactgtgagatcgacatcgctagtgatggagacgttacacttactccgaaggagaatgctcgctcttgcgttaacggtactctggtgtgctctaccacacagctatggcacggcgataggatactgtggggaaataaccacttctttaggattaacctacccaagcgtaagcgcagggactggctcaaggattttgaaaaggagacaggcccaccagagcatgatctggatgcagcctcagaagcctcttccgaacctgactacaattatgaattcgcccagatggaagtgatcatgaaaacactgaacagcaacgaccccgtgcagaacgtcgtccaggtccttgaaaaacagtacttagaggagaagcgtagtgcgctggaagaacagagactgatgtacgagagggaacttgagcagctccggcagcagctgagcccagatcggcaaccccagagtagcggcccagatcgactggcttacagttcccagactgctcagcaaaaggtcacccagtgggcggaagagcgggacgaactgtttaggcaatcgctggcaaagcttcgtgaacaacttgtgaaagctaataccctggtgagagaggctaattttcttgccgaggagatgtccaaactgacagattatcaagtgaccctccaaatccctgccgctaatctgtctgctaaccggaagaggggggcaattgtgagcgaacccgctattcaggtgcggcgaaagggaaaatctactcaagtgtggacgatcgaaaaactggaaaataaattaatcgatatgcgtgatttgtaccaggaatggaaggaaaaggttcctgaagctaaacgtctgtacgggaaaaggggcgaccctttttatgaagcccaggaaaatcataatcttatcggggtcgcaaatgtgttcttagaatgcctattttgcgacgtgaagcttcaatacgcagtgcccattatctcccagcaaggggaagtggccggtcgtctgcatgtcgaagttatgagagtgacaggagccgtgcccgaacgggtggtggaagacgacagtagtgagaactcctctgagagcgggtccctagaggtagtggactcaagtggcgagatcatccaccgcgttaaaaaactgacgtgtcgggtgaagattaaggaggcaacaggcctgccgcttaacttatccaactttgttttctgccagtacaccttctgggatcagtgtgaatccacggttgcagctcccgttgtggacccagaggtgccctccccgcagtccaaagacgctcagtatactgtgacatttagccactgcaaagattatgtcgtgaatgttacagaagagttcctagaattcatcagcgacggtgccctggcaattgaggtctggggccaccggtgtgctggcaacggctccagtatctgggaggtggactccctacacgcaaaaacgaggacactgcacgaccggtggaatgaggtgacgcgccgaattgaaatgtggattagcattctcgagctcaatgaactgggcgagtatgccgcagtggaattgcatcaggccaaagacgtcaacaccggcggaatcttccagcttaggcagggccacagcagacgtgtgcaagtaaccgtgaaacccgtgcagcattccgggacactgccgcttatggttgaggccattctgagtgtctctattgggtgtgtcactgccagaagcactaaactgcaacgcggacttgattcttaccaggaggaagatttgaattgtgtccgagaacgatggtcagatgcacttattaagagacgggagtacctcgacgaacagatcaaaaaagtgtctaataagaccgaaaaaacagaagacgatgttgagagagaagctcaacttgtcgaacagtgggtgggtctcacggaggaacgcaatgccgttctcgttcctgccccaggcagtgggatccccggtgcaccagctgactggattcccccaccagggatggagacgcatatcccagtccttttcttggatctgaacgctgacgacctgtctgcgaatgagcagctggtgggacctcacgcaagtggtgtcaacagcatcctacctaaagaacacggatcacaattcttttacctcccaatcattaaacacagtgatgacgaggtgtctgctactgcaagctgggattccagtgtccacgacagtgttcatctcaacagagtaactccccaaaacgaaaggatttatctgatcgtaaagacaaccgttcagctttcccatcccgcagccatggaattggtgctccgcaagcggatcgccgctaacatttataataagcagtctttcacacagagtttgaagcgcaggatcagcctgaagaacatcttttatagttgcggtgtcacctacgagattgtgagtaacattcctaaagctaccgaagaaatcgaggacagagagactcttgccttgctggctgccaggtccgagaacgaagggacaagtgatggggagacgtacatagaaaaatataccagaggagtcctacaggtggaaaacatcctttctctggagcgccttcgccaggcagttactgtgaaagaggccctgtccactaaggcgagacacattcggagatctctgtccacgcccaacgtgcacaacgtgagttctagtaggcctgatctttccggtttcgatgaagacgacaaggggtggcctgaaaaccaacttgacatgtccgattactcttcatcatatcaagacgtggcctgctatgggacgctcccgagggattcaccgaggagaaataaggaaggctgcacttccgaaacaccccacgccctcaccgtaagcccttttaaggctttttctcctcagccacccaagttttttaagccactgatgccagtcaaggaggagcacaagaagcgcattgctctggaagctagacctctcctttctcaggaagacagcgaagaggaggagaacgagctggaagctataaacaggaagctgatctcctcgcagccctacgtgcctgtggagtttgctgatttctcagtctataatgcctccttggaaaaccgagagtggttttctagcaaggtggacctgtccaatagccgcgtcctggagaaggaagtaagtaggtcgccaactacctcttccataacgagtggatatttctctcacagtgcctccaatgctaccctctccgacatggtggtgccgtcaagcgattccagtgaccaactggcgattcagactaaggatgccgactccacggaacattcaacgcctagcctagtgcatgatttccgcccttcttctaataaagagctcaccgaggtggaaaaaggccttgttaaggataagattatagtcgtgcctttaaaggagaactccgctctggccaaaggaagcccctcaagccagtccatccccgaaaaaaacagtaagagtttgtgtaggacaggatcgtgctcagagttggatgcctgcccctctaagatcagtcagcccgcaaggggcttttgccctagagaggtaaccgtggagcacaccaccaacattctggaagatcatagcttcaccgagttcatgggtgtgtcagaaggaaaagattttgatgggttgaccgattccagtgccggagagttgagctctcgcaggagtctgcctaacaaaactggcggtaagaccgttagtgatggactgcatcatccctctcagcttcactcgaagttagagaacgaccagggagggaccacaagtcgata

SEQ ID NO: 227808 - DNA, 5312 bp, Artificial Sequence
  Description of Artificial Sequence: Synthetic coding sequence
atgtccgatacaaaagtgaaggttgcggtccgcgtgcgtcccatgaatcggagagagctggaactcaatacaaagtgtgtcgtggagatggaagggaaccagacagtacttcatccacccccaagtaacacgaaacaaggtgaacgcaggccaagtcaggtcttcgcctttgactactgcttttggagtatggacgagtcaaataccacaaagtacgccggacaggaagtggtttttaaatgcctaggcgaggggatcctcgagaaggcgttccaaggctacaacgcttgcattttcgcgtacggacagacaggaagcgggaagtccttttcgatgatgggtcatgctgagcaattagggttaatcccacggctctgctgtgctctgttcaagcgcatctccctagagcagaatgagtcacagacatttaaggtggaagtgtcatatatggagatctacaacgaaaaggtacgcgacctgctggatcccaaggggtccagacagagcctcaaggtgagggagcataaggtgttaggaccatatgtggacggactcagtcagctggcagtgacaagtttcgaagacattgagtcacttatgtctgaaggaaacaaaagccgcacagttgctgccacgaacatgaacgaagaatcctctcggagtcatgctgtattcaatattataattactcagaccctttatgacctccagtccggcaacagtggggaaaaggtctctaaagtcagtctggtggatcttgcgggatcagaacgagtcagtaagactggggctgcaggcgaaagactgaaagaaggttccaatatcaacaagtcactcacaactctgggtctggtcatctctagtcttgctgaccaggctgctggaaagggaaagtcaaagttcgtcccctacagggacagcgttctgacgtggctgcttaaagataatctgggcggaaatagccagactagtatgattgctaccatatctcccgcagctgataattatgaggagaccctttcgaccttacgttatgcagatcgcgcaaagcgtatagtgaatcacgccgttgtgaatgaggatcccaacgcaaaagttattcgcgagctccgcgaggaagtggagaagttacgggagcaactttcacaggcagaagctatgaaggccccagagctgaaggaaaaactagaggagtccgagaagctcataaaggaattaaccgtcacatgggaggaaaaattaagaaagacagaggagatcgcccaagagagacaaaggcagcttgagtccatgggcatctccctcgagatgagcggcattaaggtgggagacgacaagtgctatctggtcaaccttaacgccgaccccgctctgaacgaattgctcgtgtattacctgaaggaccatactcgtgtgggggcagacacaagtcaggatatccagctctttggaattggcatccaaccccagcactgcgagatcgatatcgcaagcgatggtgatgtaacgttgactccaaaagagaacgcacgctcttgtgtgaatggaactctggtctgcagtacaacccagctgtggcatggcgacaggattttgtggggaaacaaccacttcttcagaatcaatctacccaaacgtaagagaagggactggctgaaagatttcgaaaaggagacagggcctcccgagcatgatctggacgctgcttccgaggcatctagcgaaccggattataattatgaatttgctcagatggaagtgatcatgaagaccctgaatagtaacgacccagttcagaatgttgtgcaagtcttggagaaacagtatctagaggaaaaacggagtgcactagaggagcagaggcttatgtacgagcgggagcttgagcaattgcggcagcagctgagtcctgaccgacagccccagtccagcgggccagacagactggcttactccagccagactgctcagcagaaggtaactcagtgggctgaagagagagacgaattgtttcggcagtcactcgctaagctccgcgagcagttggtgaaggcgaacacactggttcgagaagctaacttcctggctgaagaaatgagtaagctcaccgattatcaggttacactgcagataccggcagctaacttgagcgccaaccgaaagcggggagctatagtgtccgagcccgctatccaggtgcgacgtaagggcaagtccacccaggtgtggacaatcgagaagttggaaaacaagcttatcgatatgagggatctttatcaggaatggaaagaaaaggttccagaggctaagcgcctttacggaaagagaggggaccctttttatgaggctcaagagaaccacaacttgatcggagtggccaacgttttcctcgagtgcctcttctgcgatgttaagcttcagtatgccgtccccatcatctcgcagcaaggggaggtggcgggtagactgcacgttgaagtcatgagggtgacaggtgccgttcctgaacgggtggtggaggacgactcctctgagaacagttcagagtccgggtcattggaggtggtggactcatctggtgaaataatccaccgggtgaaaaagctgacatgccgggtcaagatcaaggaagcaactggtctgccgctgaacttgtccaacttcgtcttttgtcagtacacgttttgggatcagtgtgaatcaaccgtggccgcacctgtcgtggaccctgaggtgcctagtcctcagtcgaaggatgcccaatacacagtgactttttcgcattgtaaggactatgttgtgaatgtcaccgaagagttccttgagttcatttccgacggcgcattggccatcgaggtatggggacatcgctgcgctggcaacgggtcctctatctgggaggtcgatagcctgcatgctaagactaggactctgcatgaccgctggaatgaggttactaggcggatcgagatgtggatttccatccttgagctgaacgaactgggagaatatgccgctgtggagctccaccaggccaaggacgttaacacaggcggtatcttccaacttcggcagggccattcaagacgagtgcaagtcaccgtaaaacccgtgcagcattcggggactctcccgcttatggtggaagctatcctgtctgtgtctatcggctgcgtgacagcacgtagcactaagctgcagaggggtctggactcttatcaaagggatgacgaagacggcgatgacatggactcttaccaagaggaggacctgaattgtgttagagaaagatggagtgacgctctgatcaaaaggcgcgaatatctggatgagcagattaagaaggtgagcaacaagaccgagaagaccgaggatgacgtcgagagagaggcccagctagttgagcagtgggttggactgacagaggaacggaatgctgtacttgtgcctgcaccaggaagcggcattccaggggctcccgcagattggatcccgcctcccggtatggagacccacatacccgtcctgttcctggatcttaacgccgacgacctgtccgccaatgagcagctggtcggcccacacgcatctggggtgaattctattctacccaaagagcacgggagtcagttcttttatctgcccattattaagcattccgatgatgaggtatccgcaacagcaagctgggactcgtctgtccacgattccgtacatctgaaccgcgtcacaccccagaatgagcggatttatctgattgtgaaaacaactgtccagctttcacacccagcggcaatggaattggtcctccgcaaacgcatcgcagccaacatatacaacaagcaatcctttacccaatcccttaaaagaaggatcagcctcaagaacattttctattcatgtggagtgacctacgaaatcgtttcaaacatccctaaggcgactgaggaaattgaggacagagagaccctcgcccttctcgctgcaaggtccgaaaatgagggaacgagcgatggggaaacttatatcgaaaagtacacccgaggcgtgctgcaggtggagaacatcttgtcactggagaggttgcgccaggctgtcaccgtaaaagaggccctgtcgacgaaggccagacacatccgcagatctctgagcaccccgaatgtgcacaacgtgagcagcagcagacctgacttgtctgggttcgatgaggatgacaaggggtggccggaaaaccaactagatatgagcgactatagcagttcataccaggatgtagcctgttacggaaccctaccgagggatagcccacgcaggaataaagagggctgcacaagcgaaacaccccatgcactgacagtcagcccttttaaagccttttccccccagccccctaaattctttaagcccctaatgccagtcaaagaggaacacaagaaacgtattgccctcgaggcacggccattactcagccaggaggattccgaagaggaggagaatgaactcgaagctatcaatcgcaagcttatctcttctcagccgtatgtgcctgtggagtttgccgatttctcagtgtacaacgcttccctggaaaatagagaatggtttagcagtaaggtggacctgagcaatagcagggtgctggagaaggaggtgagccgatctccaacgacaagcagtattacgtcaggctacttctcccacagcgcgtctaacgctacactgtcagacatggtagtgccttcctctgacagctccgatcagctcgcaattcagacgaaggatgcagactctacagagcactctacaccatcactggtccacgactttcgaccaagctcaaataaagaactaaccgaggtcgaaaaagggctcgtgaaagacaaaataatagtcgttccactgaaagagaactccgctttagctaaaggctcaccaagtagtcaatcaatacctgagaaaaactccaaaagcctgtgccgtacaggatcatgcagtgaactcgacgcgtgtccatcaaagatctcccagcccgcacggggattctgcccgcgtgaggtcaccgttgagcacacaacaaacatactggaggaccatagctttaccgagttcatgggggttagtgaggggaaggactttgacggcctaacggattcttcagcaggcgagctgtcttcacgaaggtctctcccgaacaaaaccgggggaaaaacggttagtgatgggctgcaccacccatcccagctgcactctaaactggagaatgatcaggtgattatccccgaagctgcattctgggtactgtgttgtcagta

SEQ ID NO: 227809 - DNA, 5312 bp, Artificial Sequence
  Description of Artificial Sequence: Synthetic coding sequence
atgagcgataccaaagtcaaagtagcagttcgggtaaggccgatgaaccgcagagagctggaactcaatacaaagtgcgtcgttgagatggaaggaaaccaaactgtcctgcatcccccaccctccaatactaaacagggggagcgaaagccccctaaagtgttcgcctttgactactgcttctggtccatggacgagtcaaacacaacaaaatacgcaggacaggaggtggtattcaagtgcctcggggagggcatcctggaaaaagccttccaaggctacaatgcatgcatctttgcttatgggcagactggatctgggaagtcattctccatgatgggccatgctgaacagctcggtttgattcctcgtctgtgttgcgcactgttcaaacgcatttcgctggagcagaacgagtctcagacattcaaggtggaagtgtcctacatggagatttacaatgagaaggtgcgagacctgctggatccaaaaggctcacgccagagcctgaaagtgagagagcacaaagttctgggtccatatgtagatggactctcacagctggccgtgaccagcttcgaagacatcgagagcttgatgtccgaagggaataaatctagaacagttgctgcaacaaacatgaatgaagagtcctcaagatctcacgcagtgtttaatatcatcatcacacagaccctctatgacctgcagtcgggcaattccggcgagaaagtctccaaggtatccctggttgacctcgcagggtctgagagggtttcaaaaaccggcgcagccggagagagactcaaagaggggtctaacataaataaaagtcttaccactcttggactggttatctccagcctagccgatcaagcagccggaaaggggaagtctaagtttgtcccttaccgggattccgttttaacatggcttctgaaggataatctcggaggcaattcccagacatcaatgattgcaacaattagtcctgcagctgacaattatgaggaaacattatcgaccctgcgttatgctgaccgcgcaaagaggatcgtaaaccatgcagtggttaacgaggatccgaacgccaaggtaatccgcgagctccgggaagaggtagagaaactgagagaacagctctcgcaggcagaggcaatgaaagcccctgagctgaaagaaaaattagaggagagcgagaagctcatcaaggaactcacagttacatgggaggagaagctccgtaaaaccgaggaaatcgcgcaggagcgtcagcggcaattggaaagcatggggatttctcttgagatgagtggcattaaggtcggagacgataagtgctatcttgtgaatcttaatgcagatccagccctgaacgagttgttggtgtactaccttaaggatcacacgagagttggggctgacaccagccaggatatccagctgtttggcattggcattcagccccaacactgcgaaatagatattgcttctgacggagacgtaaccctgacacccaaagagaatgccagatcgtgtgtcaatggcacactggtttgcagcactacacagttgtggcatggcgacaggattctgtggggcaataaccactttttccggatcaatctgccaaaaagaaaacgcagggactggctaaaggacttcgaaaaagagaccggaccgcctgaacatgaccttgatgccgctagcgaagcgagttccgagcccgactacaattatgagtttgcgcaaatggaagtgatcatgaagacactgaatagtaacgatcccgtacagaacgttgtacaggtcttggaaaagcaataccttgaggaaaagcgctctgcactggaggagcagcggcttatgtacgaacgcgaattagaacagttacgtcagcagctgtctcctgaccgccagcctcagtcatccgggcctgatcggctggcttacagcagccagactgcccagcagaaagtcactcagtgggctgaagagcgggacgaactgttcaggcaatccctcgcaaagctgagagagcagctggtgaaagccaacacccttgtgcgcgaggccaattttttggccgaggagatgtcgaagctgacggattatcaagtgacactccagatacctgccgctaatctgtcagccaatagaaagagaggcgcaattgtgagtgaacccgctatccaggtgcgcagaaagggcaaaagcacccaagtttggacaattgaaaaattagaaaacaaacttatagacatgcgcgatttatatcaggagtggaaggagaaggttcccgaggccaaaaggctctatgggaaacgaggcgatcctttttacgaggcccaggaaaaccacaatctgatcggcgtagcaaatgtcttcctggagtgtctcttttgtgacgtgaagctgcaatacgcagtaccgattatctcccagcagggagaggtggccggacggctgcacgtggaggtgatgcgggtcacaggggcagtgcccgagcgggtggtagaagacgactcttctgaaaactcgagcgagagtgggtctttagaggtcgtggacagctcaggtgagattatccatagggttaagaaattgacgtgccgtgttaaaataaaggaggccaccggactgcccctgaacctgagcaacttcgtgttttgtcagtacacattttgggaccaatgtgagtcgaccgtggccgctcccgtcgtggaccctgaggtccctagtcctcagagcaaggatgctcagtacactgtgacattttcccactgcaaagattacgtagtgaacgttacggaggaatttctggaatttatttctgatggggctcttgcgattgaggtttggggtcatcgatgtgctgggaacgggtcatctatatgggaggttgatagcttacatgctaagacaaggacactccatgatagatggaacgaagtgacgcggcgtatagaaatgtggatctccatccttgagctcaacgagctcggcgagtatgctgcagtggagctgcaccaagctaaggatgtcaatacgggcggaatcttccaactcaggcagggacattcccgccgagtgcaagtgaccgtaaaaccagtccagcacagtggcaccctgcccctgatggtagaagccatcctctcagtatctatcggatgtgtcacagcgagatcaaccaaacttcagagaggcctagactcataccaaagagatgatgaggatggtgacgacatggatagctatcaggaggaggatcttaactgcgtgcgcgagagatggtccgacgctctgataaagcgcagagagtatctggatgagcaaatcaagaaggtctcaaataaaaccgaaaagacagaagacgacgtggaaagagaggcccagctggtcgaacagtgggttgggctcaccgaggagcgtaacgctgtcttggtgcccgcacctggcagtggaataccaggggcaccagccgactggattccacctccaggcatggagacccacatccctgtgctttttctggatttaaatgctgacgatctgtccgctaatgaacagttggtggggccacacgccagcggcgtcaactccattctgccaaaagaacacgggtctcagttcttttacctgccaatcatcaagcactcagacgatgaggtatctgccaccgcatcctgggactcttctgtccatgattcagtgcaccttaaccgagtgactcctcaaaacgaaaggatctaccttatagttaaaacgaccgtgcagctctctcaccccgcagcgatggagctggtgctccggaagaggattgccgcaaatatttataataaacaaagctttacccagtctcttaaaagacgcatctctctgaaaaatatcttttacagctgcggagtcacttatgagatagtttcaaatataccaaaggcgacagaagagatagaagatagggaaacccttgcactcttggctgctcgctctgagaatgaaggtaccagcgacggcgaaacttatatcgagaagtacactaggggggtgctgcaggtcgagaatatcctttctcttgagaggctgcgccaggccgtgaccgtcaaggaagcgctgagcactaaggcgaggcatattcgacgatctctgtctacccctaacgttcacaatgtttcttcctcacgtccggacctcagtggattcgacgaggatgacaaaggctggcccgagaatcagttagatatgtcagattattccagctcctaccaagacgttgcttgttacggcaccctgccaagggactcaccaaggcgaaacaaagaggggtgtacaagcgaaactcctcacgctctgacggtctcccccttcaaggctttctctccccagccccctaaattctttaaacccctgatgcccgtgaaggaagaacataaaaagagaattgccctggaggccaggcccctgctttctcaagaagactctgaagaagaagagaatgaattggaggctatcaatagaaaactaatcagctctcagccttatgttccggtggaattcgccgacttttccgtttacaatgcttctctggagaacagggaatggttctcctctaaggttgatctctctaacagcagggttcttgaaaaagaggtgagcaggtcacctaccacatcttcaattacttccggttacttctcacacagcgcctccaacgccaccttgtctgatatggtggtcccatccagtgattccagcgaccagcttgccatacagaccaaagacgcagatagcactgagcatagtacaccttcactggtgcacgatttcagacccagcagcaacaaggagctgacagaggtagagaaggggctcgtcaaagacaagattattgtggtgcctctgaaagagaattccgctctggccaaagggagtccctcttcacagagcatccccgagaaaaatagcaaatctttatgccgaacggggtcctgtagtgaactggacgcatgccctagtaagataagccagccagccaggggcttttgcccaagagaggtaacagtagagcacaccacaaatatcctagaagatcacagcttcactgagttcatgggcgtgtctgaaggtaaggatttcgacgggctcactgactcctcagctggggagctctccagccggcgttcccttcccaataagacgggtggcaagaccgtctcagatggccttcatcacccatctcagctgcacagcaaattagaaaatgatcaggtgatcatccctgaggctgctttctgggtgttgtgttgccagta

SEQ ID NO: 227810 - DNA, 5273 bp, Artificial Sequence
  Description of Artificial Sequence: Synthetic coding sequence
atgagcgacaccaaggtgaaggtcgcggttagagtcaggccaatgaatcgcagggagctagaactgaataccaagtgcgtcgtcgagatggaaggcaatcagacagtcctgcatccacctccctcgaatacaaaacagggggaacgcaaaccgcctaaggtgtttgcctttgactactgtttctggtctatggacgaatctaatacaacgaaatacgccggacaggaagtcgtatttaagtgcctcggagagggcatcctggagaaagcctttcagggctacaatgcatgtatcttcgcctatggccagacgggctcggggaagtcgttttcaatgatgggccacgctgaacagctcgggctgattccgcgtctgtgttgtgccctgttcaagcgcatttctttggaacagaacgagtcccaaacattcaaggtcgaagtaagttacatggaaatctacaacgagaaagtgcgggacctgctggacccaaaggggtctaggcaatcattaaaggtaagggagcacaaagtcctcggaccttacgtagatgggctgtcccaattggccgtgacctccttcgaggacatcgagagcctgatgtcagaaggtaataagtcccggactgtcgccgcaacgaatatgaacgaggagtcttcccgttcacatgcggtgttcaacattatcatcacacagactctgtatgatctgcagtccgggaactcaggtgagaaggtaagtaaggtttccctggtcgatctggccggaagcgagcgcgttagcaaaaccggcgcagccggtgagcggctcaaggagggatctaatatcaacaaatcgctgaccacactcggtctcgttatctcctctctggcagaccaggccgctggtaaaggaaagagtaagttcgtgccctaccgcgacagtgttctaacctggctgctcaaggacaacctcggagggaacagccagacatcgatgatagccactatcagtcccgcagcagataactatgaagagactctgagtactctccggtatgcagatagagctaagaggatcgtcaaccacgcagtggtgaatgaagacccaaacgccaaagtgatcagggagctgagggaggaggtggagaagctgcgggagcagctgtcccaggccgaagcaatgaaagctcccgaacttaaagagaagctggaagagtctgaaaagcttatcaaggagctaaccgtgacctgggaagagaagctgaggaagaccgaggaaatcgctcaggaacgccaaagacaactagagagcatgggcatcagtctagaaatgagcggcatcaaggtgggggatgacaagtgttatctagttaatctaaacgccgacccggctctgaacgaactgttagtatattacctcaaggatcacaccagggtcggcgcagatacatcccaggatatccagctttttggtatcggtatacagcctcagcactgtgaaatcgacatcgcttctgacggtgatgtgaccttgacccctaaagagaatgcgaggagctgcgttaacggtactctggtctgctccacaactcaactctggcatggtgaccgaatcctatggggcaacaatcacttcttccgaatcaacctgcctaaaaggaagcgtcgcgactggttaaaagactttgagaaggaaaccggacctccggagcacgatctcgatgcagcaagcgaggcctcaagtgaacccgactacaattacgaatttgcccagatggaggtaatcatgaagacactaaactctaacgatcctgtccaaaatgtagttcaggtactcgagaagcagtacctcgaggagaaaagaagcgccctagaagaacagagactgatgtacgagcgagaattagagcagttgagacagcagttaagccctgatagacagccacagagttcaggaccagatagactggcctatagcagccaaacggctcagcagaaagtgactcagtgggcagaagagagggatgagctattccgccagagcctcgctaaattgcgggaacagctggtcaaggccaataccctcgtcagagaggccaatttcctggcagaagagatgtcaaagttaacagattatcaagtgacactccaaatccccgcagccaacctctcagccaacaggaagagaggtgcgattgtgagtgagccagcaatccaggtccgcaggaagggcaagtcaacacaggtctggaccatcgagaagctggagaacaagttgatcgatatgcgagacctgtaccaggagtggaaagagaaagtgcccgaggctaagagactctacggaaaacggggagaccctttttatgaggcccaggaaaatcacaacctgattggagtagccaacgtatttctggagtgcctcttctgcgatgtcaagcttcaatatgcagtccccatcatctcccaacagggcgaggtagccggaaggctgcacgtggaagtgatgcgggtcacgggtgccgtgccagaacgggtggtagaggacgatagttcagagaatagctctgagtcgggctccttggaggtcgtcgatagttccggagaaatcatccatcgcgtaaaaaagcttacatgtcgggtcaagatcaaagaagcaaccgggctgcccctgaatttatcaaactttgttttttgccagtatactttttgggaccagtgcgaatccaccgtagccgctccagtggtggatccggaagtaccgagcccacagtcgaaggatgcccagtatacggtcaccttttctcactgtaaggactatgtagtgaacgtgacagaagagtttctggagtttataagcgacggagcactcgccattgaggtgtggggccatcggtgtgccggaaacgggagctccatatgggaggtcgactccttgcatgctaagacaaggaccttgcatgatagatggaacgaagtaacacggaggatcgagatgtggatatctatcctggagctcaacgaactgggcgagtacgctgccgtggagctgcaccaggctaaagacgttaataccggtggaatttttcagctccgacagggacatagtcgaagggtacaggttaccgtaaagcctgttcagcacagtggcactcttcctcttatggtggaagccatcctctccgtctcaattgggtgtgtcacagccaggtcaactaagctacagcgtgggctggactcttatcaagaggaagacctgaactgtgtgcgggagaggtggtcagatgctctgattaagcgaagggaatacctggatgaacaaatcaagaaagtgtcgaataagaccgaaaagactgaggacgacgtggaacgcgaggcacagctggtggagcagtgggtgggtttgacggaagaacgcaacgctgtactagttcccgcaccaggttccgggatcccgggagccccagcagactggatacctccacctggcatggaaactcacatccccgtgctattcttggacctgaacgcagatgaccttagtgctaacgagcagctggtcggcccacatgcgtctggcgtaaattctattctccccaaagagcacggttcgcagttcttctaccttcccattatcaaacactccgatgatgaggtgtctgccactgcctcgtgggattcatccgtgcacgattcggtccacctaaaccgagtaacaccccagaatgagaggatctacttgatcgtaaaaacaactgtgcagttaagtcacccagctgccatggaactggtgctaagaaaacgtatcgctgccaatatctataacaaacagtcgttcacccaatctcttaagcgacggatctctctcaagaatattttttactcgtgtggggtgacctatgagatagtgtcaaacattccaaaagcaacagaggagatagaagaccgggaaacactagcactgcttgccgctaggagcgaaaacgaaggaacatcagacggcgaaacatacatagaaaaatatacaaggggggtcttacaggtagagaacattttgtccctggaaaggcttcgccaagccgtcaccgttaaggaggctttgagtaccaaggccaggcatatcagaagatcactgtccacgcctaatgttcacaatgtgtcttcatcacggcctgatctgagcggcttcgatgaagacgacaagggttggcctgagaaccagttggatatgagcgattatagctctagttaccaggacgtggcctgctacggtacactgccaagggacagcccccgaagaaacaaagagggctgcacttccgaaactccccacgccctgacggtgagcccattcaaggccttttcaccccagcctcctaagttctttaaacccttgatgcctgtgaaggaagagcataagaagcgcattgctctggaggctagacccctgttaagtcaagaggattccgaagaggaggagaacgagttagaggcaataaataggaaactcatctcttcccagccatacgtcccggtggaatttgcagattttagtgtgtataacgcatcgctcgagaaccgtgaatggtttagctctaaggttgacttgtctaattctcgcgtcctcgagaaggaggtctcaaggagtccaaccacttcctccattacctccggatatttctcacactctgcctctaacgctaccctgtctgacatggttgtcccatctagcgatagcagtgaccaactggctatccagactaaagatgccgactcaacagagcacagtacaccaagtctggtgcatgatttccggccaagctcaaacaaggagctgaccgaggtggaaaaaggccttgtgaaggacaagattatcgtggtccccctaaaggaaaacagcgcattagcaaaaggaagcccctctagtcagagcatccccgagaagaattccaaatcgttatgtcggaccggctcatgcagcgagctggacgcgtgtccatccaaaatcagccagcccgctaggggtttctgccctcgcgaggtgacagtagagcataccaccaatattctggaggaccacagtttcactgagtttatgggtgtctctgaaggaaaggactttgacggcctcaccgactcctccgccggtgagctgtcatcaaggcgttctctacccaacaaaacggggggtaagaccgtgagtgatggcctgcaccatccgtctcagctacacagtaagctcgagaacgatcaggttattattccagaagcagccttctgggtcctctgttgccagta

SEQ ID NO: 227811 - DNA, 213 bp, Artificial Sequence
  Description of Artificial Sequence: Synthetic coding sequence
atgtccgatacaaaggtaaaggtagctgttagagtgagacctatgaacagaagggagcttgagctgaatacgaagtgcgtggtggagatggaaggcaaccaaaccgtgctccaccctccacccagtaacaccaagcagggggagagacttgtcaccgtcgcccatatatctaattcaagcaccctcggcggtcagggcaaacggatcacctag

SEQ ID NO: 227812 - DNA, 1038 bp, Artificial Sequence
  Description of Artificial Sequence: Synthetic coding sequence
atgccaaaactcctgaagtcactgttcccagtaagggatgagaaacgcggaaaaagaccgtcaccactggctcaccaggcacagccggaaatgggcccagacgtgctcgtgcagactatgggcgctcccgcactcaagatttgtgataagccagcaaaggtgccatcccctcctcccgtcatcgccgtcacagctgtcacccccgctcctgaggcccaagacggccctccgagtccactgtcagaagcctcatctggatacttcagtcattctgtgtctacggcgaccctgtcggacgcactaggaccaggactggatgccgcagccccacccggtagcatgcccaccgctcctgaagccgagcctgaggcaccgatcagtcatccccctcctcctactgctgtgcccgctgaggaaccacccggaccacagcagctcgtgtcgcccggaagggaaagacctgatctagaggcaccagcacccggttctcccttcagagttaggagggtccgcgcaagcgaactaaggagcttctcccggatgctcgcaggggatccaggctgttcaccaggagcggaggggaacgccccagcccctggagcgggtggacaagccttggcgtcagacagtgaggaagctgacgaggtgccagaatggctccgcgaaggagaatttgtgacagttggcgctcacaagacgggcgtggtccggtatgttggccctgccgatttccaagaggggacctgggtcggcgtcgagctggacctgccctctggcaaaaacgacgggtccattggaggcaagcagtacttccgttgtaaccccggttacggattactggtccggccatccagagtccgccgagccacagggccagtgcgcaggagatctaccgggctcaggcttggggctcctgaggccaggcgctcagcaacattgtccggatctgccaccaacttggcctcactaaccgctgcgttggccaaagccgataggtcacacaagaacccagaaaacaggaagagctgggcgtcatag

SEQ ID NO: 227813 - DNA, 5480 bp, Artificial Sequence
  Description of Artificial Sequence: Synthetic coding sequence
atgggtgacagtaaagtgaaggttgcggtgcggatcagaccaatgaatcgaagggaaactgatcttcatacaaagtgtgtcgttgacgtcgacgctaacaaagtgattttgaatcccgtcaatacaaatttgtccaaaggagacgcccgtgggcagcccaaagtgttcgcctacgatcattgtttttggtcaatggatgagagtgtgaaggaaaaatatgcaggacaggacattgtgtttaagtgtctcggtgagaatatcctgcagaatgcgttcgacggttacaacgcttgtatatttgcgtatggccagaccgggagcgggaaaagctacaccatgatggggaccgccgaccagcctgggttaatcccacgcctatgttctggactgtttgaacggacacagaaggaggagaacgaggagcaatcattcaaggtggaggtgagttacatggagatatacaacgagaaagtgagggatctgttggacccgaaagggagtaggcagactctcaaggtacgcgagcactcagtgctgggaccctatgtggatggcctgtcgaaactggctgtcacgagctataaggatattgagtctctgatgtccgaaggtaataagtccaggactgtggccgcaacgaatatgaatgaagagtcctccagaagtcatgccgtgttcaaaattacccttacacatactctgtatgacgttaaaagtggcacctccggcgagaaagtgggtaagttatcactagttgatctggctggtagtgaacgcgctaccaaaacaggagccgcaggcgaccgcctgaaggagggttcaaacattaacaaatctctgacaactctagggcttgtcattagtgcactcgcagaccagtctgctgggaaaaacaaaaataaattcgttccttacagagatagtgtgcttacatggctgctgaaggactctctcggaggcaatagcaaaaccgcgatggttgctactgtgagtccagctgctgataactatgatgagaccttgtccactctgcgttatgccgatcgcgctaaacatattgtgaaccacgccgtggttaacgaagatccaaatgcaagaattattagggacttgagggaggaagttgagaaattacgcgaacaacttactaaagcggaggccatgaagagcccagagttgaaggatcgcctggaggaaagcgagaagctaatacaggaaatgaccgtcacttgggaagagaaactgcgtaagaccgaggagattgctcaggagagacagaagcagctggagtcactaggaattagtctccaatcatctgggatcaaggtcggggatgacaaatgcttcctcgtgaacctcaatgccgatccagcactcaacgagctcctcgtgtattatctcaaagaacacacgctcataggtagcgcgaactctcaagatattcagttatgtgggatggggattctaccagagcattgtattatcgatatcacctctgagggtcaggtgatgctcaccccccagaaaaatacgaggacctttgtcaacgggtctagcgtgtcctccccgatccagttgcatcacggtgatcgcatcctctggggcaataatcatttttttcgactgaacctcccgaagaaaaaaaagaaagcggaaagagaagatgaagaccaggacccctctatgaagaatgaaaacagcagtgagcagctcgatgtggatggagactcgagctcagaagttagcagcgaagtgaattttaactatgaatatgcccagatggaggttacaatgaaggccctggggtctaatgaccccatgcagtctatactgaatagcctagagcagcagcacgaagaggagaaacgctcagccttggagcgccaaagattgatgtatgaacacgagctcgagcagctgcggagaaggctaagtcctgagaagcaaaactgccggtcaatggatcgcttctcattccacagtccttccgctcagcaacgtctgcgccagtgggctgaggagcgcgaggccacattaaacaattccctcatgagattgcgagagcaaatcgtgaaggctaatctgctagttagagaggccaactacattgctgaagagctcgacaaaagaaccgaatataaggtcactttgcagatacccgcaagcagcttagatgcgaaccggaagcgaggcagcttgctgtcagagcctgctatacaggtgcgtaggaagggcaagggtaagcagatatggtcactggagaaacttgacaacaggctcctggatatgcgggacttataccaggagtggaaggaatgcgaagaagacaatcctgtgatccgcagttactttaaacgtgccgaccccttctacgatgaacaggaaaaccacagtctgatcggagtcgccaacgtgtttctagagtctctcttctatgatgttaagttgcagtatgcagtgccaattatcaatcaaaaaggtgaggtcgcaggcaggttacatgtggaagttatgagactgagtggggacgtaggagagaggatcgcaggcggtgacgaagtcgcagaggtttccttcgagaaagaaacccaggaaaacaagctcgtgtgtatggttaaaatcctgcaagcaacgggcctgccccagcacctgagtcacttcgtgttctgtaaatatagcttttgggatcaacaggagcccgtcatcgtggctccagaagtggatacctcctctagttccgtttccaaggagcctcattgcatggtggtctttgatcactgcaatgagttcagtgtcaatattacagaggactttatcgagcacctgtctgaaggggctcttgcaatcgaggtgtacggtcacaagatcaatgaccctcggaaaaacccagccttgtgggacctaggtatcatacaagccaagacccgttctctcagggaccggtggtcggaggttacccggaagctggaattctgggtccagatactcgagcagaatgagaacggcgaatattgccctgtggaagtgattagcgcgaaagatgtcccgacagggggaatattccaactgagacagggccaaagcaggcgcgttcaagtcgaggtaaagtccgtgcaggagtctggaactttgcctctcatggaagaatgcatactctctgtgggcatcggctgcgtaaaggtgagaccgctacgggcacctcgcacacacgaaacatttcacgaagaagaggaggacatggatagttatcaggacagggatctggagagactgcgaaggaagtggctgaatgctctgaccaaacggcaggaatacctggaccagcaactgcaaaaactagtgtccaaaagggataaaactgaggatgacgcagacagagaggcgcagctgctggagatgcgtttgaccctgacagaggagaggaacgcggtgatggtgccttccgcgggatccggcatccccggagccccagctgagtggactcccgtgccaggcatggagactcacataccagttatctttctagaccttaatgccgatgactttagctcgcaggacaacttggatgaccccgaggcaggcggatgggacgctacactgaccggcgaagaggaggaggaattttttgagctccagatcgtgaaacagcatgacggcgaggtaaaagcggaagctagctgggattcggccgtacacggatgcccacagctgagcagaggcacacctgtggacgagcggctgttcttaattgtcagagtgactgtccagctgagtcacccagctgacatgcaactcgtcctcagaaagcggatttgtgtgaacgtacacggacggcagggattcgcgcagtcccttcttaagaagatgtcccatcggagctctattcccggatgcggggtgactttcgagatcgtctccaacatacctgaagatgcccagggcgtcgaggagcgggaagccctggccagaatggcggctaacgtagagaatcctgcttcagcggacagtgaagcttatattgaaaagtacctcaggagtgtcttggccgttgagaatttgctgacgctggaccggctccgtcaggaagtggccgtaaaggagcagctgacaggcaaaggaaagctcagtaggagaagcatttcatctcccaatgtgaacaggctctcagggagtcgacaggacttaataccatcatacagcttagggtccaataaaggacggtgggaaagccagcaggatgtgtcccaaactaccgtgagccggggaattgcaccagctcctgcactgtcagtcagccctcagaacaaccactctcccgatcctggtttatctaatctggccgcatcttacctcaacccagtgaaatcattcgtcccgcaaatgcctaagctgctgaagtccctcttcccagtgcgggacgaaaagaggggcaagcgacctagtccgctggctcatcagcctgtgcccagaatcatggtgcagtcagcatcgcccgatatcagagtcacacgaatggaggaagcccagcctgaaatgggcccagatgttcttgttcagaccatgggtgcgccagcactgaaaatctgcgacaaacccgcaaaggtgccaagtccaccacccgtaatcgcagttacagcagttaccccggctccagaggcccaggacggaccgccatcacccctctctgaagcttcctcggggtatttcagccattctgtgagcaccgcaaccctgagcgacgctttgggaccaggcttggacgctgcagctccacccggatccatgccgaccgcgcctgaggccgagcctgaagccccaatttcacacccaccccctcccacagccgtgcccgcagaggagcctcctgggcctcagcagctagtgtcccccggaagggagcggccagacctggaggcacctgccccagggtcacccttcagggtgcgacgggtccgggcaagtgaactgcgctcattcagccgaatgctggcaggtgaccccggttgctcgcctggcgctgaggggaacgcacccgcacccggtgcaggcggtcaggccctggctagtgactcagaggaggccgacgaagtgcccgagtggctgcgggagggcgagttcgtgaccgtcggtgctcacaaaacaggagtggtacgatacgtggggcctgcggattttcaggaaggtacatgggttggtgtggagctggatctgccaagcggcaaaaatgatggttcaatagggggtaagcaatactttcgctgtaaccctggctacggattgcttgttagaccatctcgtgtacggagagccaccggtcctgtaaggcgacggtccacaggcctcagactgggcgctcccgaggctcgcaggtctgccactctatctggttcagcaactaacttagcatctttgaccgccgctttggctaaggcggacaggtcgcacaaaaacccagaaaatcgcaagtcttgggctagcta

SEQ ID NO: 227814 - DNA, 4946 bp, Artificial Sequence
  Description of Artificial Sequence: Synthetic coding sequence
atgagcttgcactctacgcacaataggaacaatagtggcgacatcctggacattccctcatctcagaacagctcatcgctaaacgcactcacacacagctcccgcctcaagttacatttaaaatccgacatgtctgagtgcgagaatgatgacccgctgttgcgctctgctgggaaggtgcgggacataaacagaacatatgtgatcagcgccagccggaagacggccgatatgccccttactccaaaccctgttggacgcttggccctgcagcgtcgaactacacggaataaggagtcatccctattagtatcagagttagaagacaccacagagaagaccgcggagacgcgacttacgctgcagaggcgagcgaaaaccgattccgctgagaaatggaaaacggccgagatcgatagtgttaaaatgactctgaatgtcgggggtgaaacggagaataacggagtgagtaaagagagtcggaccaacgtgaggattgtgaataatgccaagaattcgttcgtggcctcctcagttcccttagacgaggaccctcaagttatagaaatgatggcagataagaagtacaaagaaacattttctgccccaagtagagcgaatgagaatgtggctctcaagtatagcagtaataggccaccgattgcaagcttaagccagacagaagtagtgaggagtgggcacctgaccaccaaaccaacgcagagcaagcttgacattaaagttcttgggacaggtaatttgtaccaccggagcatagggaaggaaattgcaaagacctcaaacaaatttggtagtctcgaaaagaggaccccaaccaaatgcactacagagcacaaactgactaccaaatgcagcttgcctcagctcaagtctcctgccccttccattctgaagaacaggatgagcaatctgcaggtaaaacaaagacccaagagcagcttcctcgccaacaaacaggaacggtcagctgaaaacactattcttcccgaagaggaaactgtcgtgcaaaacacatctgccggaaaagatcccttgaaggtggaaaactcacaggttacagtggctgtacgcgtgcgtcccttcacaaaacgcgagaagattgaaaaagcttctcaggtagtgttcatgtctggcaaagagatcacagtggagcacccagacaccaagcaggtatacaactttatctacgacgtgtccttttggagcttcgatgagtgccatccccattatgcttctcaaacgactgtatacgaaaagttagctgcacctctcctggagagagctttcgagggctttaatacttgtctctttgcatatggacaaacagggagtggcaagtcgtatacaatgatgggatttagtgaggagcccggaataatccccaggttctgcgaagatctgttctctcaggtcgcccgtaagcaaacgcaagaagtctcataccacatcgaaatgagcttcttcgaagtctacaatgaaaagatccatgatctcctggtgtgcaaggatgaaaacggacagaggaaacaacctctcagagtgcgagaacatcccgtctatggcccttatgtagaagccctctccatgaacattgtgagctcttacgctgacatccagtcatggttggaacttggaaataagcaacgagccacggccgcaaccgggatgaacgacaagagctccagaagccactccgtcttcaccctggtcatgacacaaacaaagacagagtttgtggagggggaagagcatgaccatagaattactagccgaataaatcttatagacttagccggatccgagagatgctccaccgcacataccaatggtgaccgtctaaaggagggtgttagtattaataaatcattattgacactaggaaaagtaatctccgcactgtctgagcaggccaatcagcgcagcgtattcattccttaccgggagtcggtccttacgtggctgttgaaagagtctcttggaggtaactcaaaaaccgctatgatcgcaaccatttcccctgccgcatctaatattgaggaaacattgtctaccctccggtatgccaaccaggcccgactgatcgttaatattgcgaaggttaacgaggatatgaatgccaaactgattagggaactcaaagccgagattgcaaagctcaaagccgctcaaaggaactcacgaaatatcgatccagaacgctataggctatgtagacaggagattacgagtctccggatgaagctccatcagcaagagagagacatggctgaaatgcagagagtgtggaaggagaaatttgaacaagcagagaagaggaaattacaggagaccaaggagctgcaaaaagctgggatcatgttccaaatggacaatcacctgccgaatctcgtgaatctgaacgaggatccacagttgagtgagatgctgctgtacatgattaaggaggggaccacgactgtaggcaagtacaagcctaactcatcgcacgacatccaactgagcggcgtgctgattgcagacgaccattgcactatcaagaacttcgggggtaccgtgtccataatcccagtgggggaggctaaaacttatgtcaatggtaagcatatcctggaaatcactgtgctgaggcatggggacagggtgatcttgggtggtgatcactacttcaggtttaatcaccccgtggaggtacaaaagggaaaacgtccctcaggaagggacacaccaatcagtgagggaccaaaagatttcgaattcgcgaaaaacgagctcttgatggcccagcggtctcaacttgaagctgagatcaaggaggcccagctcaaagcgaaggaggagatgatgcaggggattcagatagctaaggaaatggcccagcaggaactgtcatcacagaaagccgcatacgagagcaaaatcaaagctctcgaggccgaactgagagaggaaagccagcgcaagaaaatgcaggagatcaacaatcagaaagcgaaccacaagatcgaggagttagagaaggctaaacaacatctggagcaggaaatctacgtaaataaaaagagactggagatggaaacactcgctactaagcaggccctggaggatcactcaatcaggcacgccaggatcctggaggcattagagacagagaagcagaagattgcaaaagaagtccagattttacagcagaaccgtaacaatagagacaagacatttactgtgcagaccacttggagctccatgaaactcagtatgatgattcaggaggcaaacgctatctctagtaagttaaagacatactacgtttttgggagacatgatatttccgacaagtcgagtagcgacacttccattcgagtccgcaacctgaagctgggcatttcaacattttggtctctggaaaagttcgaaagcaagctggcagccatgaaagagttgtacgaatctaatggaagcaaccggggagaggatgcattttgcgatcccgaggatgaatgggagcctgacattaccgatgcccctgtgagctcactttccagaaggcgatctcgatccctcatgaagaatagaaggataagcggttgcctgcatgacattcaggttcaccctatcaagaatttgcatagtagtcactcctccgggctgatggacaagagcagcaccatatatagcaatagcgctgaaagctttctgcccggtatttgcaaagagctcattggaagctcccttgatttttttggacagtcgtacgatgaggaacgaaccattgctgattcactcatcaattctttcctgaagatttataacggcctctttgcaataagtaaggcccatgaagagcaggatgaagagtcgcaggataacctgttttccagcgatcgggcaatccaatccctcaccatccagacggcctgcgctttcgaacagctggtcgtcctgatgaagcactggctgtctgatcttctgccatgtaccaacattgcccgacttgaggacgagctgaggcaggaagtcaaaaaactcgggggatatttgcaactattccttcagggatgctgtctcgatattagttctatgatcaaggaggcacaaaaaaatgcaattcagatagtgcagcaggcagtgaaatacgtgggccagctcgcagtcctgaaaggatccaagcttcacttcctggaaaacgggaataacaaggccgcttcagttcaagaggagttcatggatgcagtctgtgacggggtcggcctagggatgaagatcctattggattccgggttggaaaaggccaaagaacttcagcacgaacttttccggcagtgcaccaaaaatgaggttactaaggagatgaaaaccaacgccatggggctaatccgctctctggaaaacatcttcgccgagagtaaaattaagtcatttcggcgacaagtccaggaagaaaattttgagtaccaggatttcaagagaatggttaacagagcacctgagttcctgaagcttaagcactgcttggaaaaggccattgagataataatttcagcactcaaggggtgccactctgacattaacctgctgcaaacgtgcgtggagagcatacgcaatctggcgagcgacttctacagcgacttctccgtgccaagcacttccgtgggcagttatgaatctcgggtgactcacattgttcatcaagagctggagagcctggccaagagtctgcttttctgctttgaatcagaagaaagccctgacctgcttaagccgtgggagacttacaaccaaaatactaaggaggaacatcagcagtccaagtcaagcggaatcgatggctctaaaaataaaggcgtacctaagagagtctacgagctgcacggaagtagtcctgccgtatcatccgaggagtgtaccccatctcggattcaatgggttta

SEQ ID NO: 227815 - DNA, 5072 bp, Artificial Sequence
  Description of Artificial Sequence: Synthetic coding sequence
atggctggagctagcgtgaaagttgccgtgagggtgcggccatttaatagtcgtgaaatgtcgagggactccaaatgtattattcagatgagtgggagcaccaccaccatcgtcaacccaaaacagcccaaagagactcccaaaagtttctcttttgactactcttactggtctcatacctcccccgaggatattaattacgctagccagaagcaggtttatagagatatcggcgaggagatgctccagcacgcctttgaaggatataatgtctgcatcttcgcgtacggccagaccggtgccggaaagtcatacacaatgatgggcaaacaggagaaggaccagcaggggatcataccccagttgtgtgaggacttgttctcaaggatcaatgacactacgaatgataatatgagctatagcgtagaagtgtcgtatatggagatatactgtgaaagagtccgagatctcctcaatcccaagaataagggaaaccttcgggtgcgagaacaccctttgctgggaccctacgtggaggatttgtccaaactggctgttaccagctataatgatatccaggatttgatggactccggtaacaaggccaggacagtggccgcaacaaatatgaatgagactagtagccgctctcacgcagtttttaacatcattttcacgcagaagagacacgatgccgaaactaacatcactaccgaaaaggtgtccaagatctcccttgtcgacctggctggaagcgagagggcagattcaacaggagccaaaggtacaaggctgaaggagggcgctaacattaacaagagcctgacaaccttggggaaagtcatctcggcattggctgagatggattccggccctaacaagaataaaaagaaaaagaaaactgatttcatcccttatagagattccgtcctcacatggctgcttagagagaatctggggggtaacagtaggaccgccatggtggcggctcttagcccagctgacatcaattacgacgaaaccttgtccactctgcgctatgcagacagggccaaacaaataagatgtaacgccgtaataaacgaggaccccaacaacaaattgattcgagagttgaaagatgaggtaaccagattacgcgaccttctttatgctcaggggctgggtgatatcacagacatgaccaatgctcttgtcggaatgagcccctcatcatccttgtctgctctgagctctcgcgctgcgagcgtctcttccctgcacgagagaatattatttgccccaggctctgaggaagccatcgaacggctgaaggagacagaaaagattatagcagagttgaacgagacctgggaggaaaaactgagaaggacagaggccatcagaatggagcgcgaggcattgctggctgaaatgggtgtggcgatgcgagaggacggaggaactctgggagtgtttagccctaaaaaaactccccacctggttaacctgaatgaggatcccctgatgagtgagtgccttctttattacattaaagatggcataacccgtgtcggacgagaggatggagagcgacggcaggacatcgtgctttccggacattttattaaagaggagcactgcgtgtttagaagcgactcaagagggggaagtgaggccgtcgttacgctggagccctgcgagggagcagacacctatgtcaacggaaagaaggttaccgaaccatccatccttcgctcaggcaaccgcatcatcatggggaaatcacatgtttttcgattcaaccatcctgagcaggctagacaagaaagggagcgtaccccatgcgccgaaacacccgctgaacccgtggactgggcatttgctcaaagggaactgctagaaaaacagggtatcgacatgaaacaagaaatggagcagcgactccaggagctcgaagatcagtataggagggaacgcgaggaggccacctatctactggaacagcagagactggattacgagagtaaattagaggctctgcagaaacagatggacagccgttattatcctgaagttaacgaggaagaagaggagccggaggacgaggtccagtggaccgaaagagagtgtgagctggcactgtgggccttccggaagtggaagtggtaccaattcacgtctttgcgggatctcctctggggcaatgccatttttcttaaggaagccaacgccataagcgtggaattgaagaaaaaagtccaattccaattcgtactgctcacagacacactgtattctcccctccctcccgatctgcttccacctgaggccgctaaagaccgagagactcggccattcccccgaaccatagtcgcagttgaagtccaggaccaaaagaacggagccactcactattggacactcgagaaattacgacaacgcttagaccttatgcgtgagatgtacgatagagccgcagaggtgccgtctagcgtgatcgaggactgcgataatgtggtgaccgggggagaccccttttatgacaggttcccatggtttcggttagtcggccgtgccttcgtatacttgtccaatcttctgtaccctgtgcccctggtgcaccgagtggccattgtgtctgaaaagggggaagtaaaaggattcctacgggtagccgtgcaagctatatccgcagacgaggaggccccagattacggatccggtgtacgtcaaagtggaaccgctaaaatctctttcgacgaccaacactttgagaagttccagtcagagagctgccccgtggttggtatgtcccgctctggaacgtcccaagaggagctgaggatcgttgaggggcaaggtcaaggggcagacgtgggcccaagcgccgatgaggttaacaataatacctgtagcgcggtcccgcctgagggtctgctgctggattccagcgagaaagcagccctggatggcccactagacgctgcacttgatcatctgcggctggggaatacattcaccttcagggtaaccgtgttgcaggctagcagcatttctgccgagtatgcagatatcttctgtcagtttaatttcatccacagacacgatgaggccttttcaacggaacccctcaaaaacactggacgcggacctcccctaggcttctatcatgtccagaatattgcagtcgaagtgaccaaaagtttcattgagtatattaaaagtcagccaattgtctttgaagtgtttggacactaccagcaacatcctttcccaccgctgtgcaaagacgttctaagcccactcaggccttcacgaaggcatttccctcgggtgatgccactgagcaaaccagttcccgcaacgaaattatccacattgactcggccttgccccggaccatgtcattgcaagtacgacctgttggtctacttcgagatatgcgagctggaagctaacggcgattacatccccgcagtggtggaccatagaggaggtatgccatgtatggggacgtttctgttacaccaaggaatacagcgaaggataaccgtgaccttgctccatgaaacagggagtcatataaggtggaaggaagtgagagagctcgtggtcggccgaattcgcaacacccccgaaactgacgagagtcttatagaccccaacattctctccctgaatatcctgtcttctgggtacatacaccccgctcaggatgataggacgttctatcagttcgaggctgcatgggacagtagcatgcataacagcttattgctgaatcgcgtaacgccctatcgggaaaagatttacatgaccctctccgcctacattgagatggagaactgcacccaacctgccgtcgtaacgaaggatttttgtatggtgttctatagtagagatgccaagctacccgctagccgttcaatacgaaatctcttcggcagtgggtctcttcgggcatcagaaagtaatcgcgtgaccggagtgtacgagctcagcctgtgccacgtggccgacgccggatcccccggaatgcaacgtcggagacggcgagttttagatacatccgttgcttacgtcagaggagaagagaatttggcaggatggcgccctcgcagcgacagccttattctggatcaccagtgggagctggagaagttaagcctcctgcaggaggtggaaaaaacgaggcactatcttctccttcgggaaaagttggagactgcccaacgacccgtcccggaagctctttcaccagccttttccgaagacagtgagtcccacggtagttccagcgcctccagccccctgtcagccgaagggcgacccagcccactggaagcaccaaatgagcggcagagggaactggcagttaagtgtttgcggcttctcacacacacattcaatcgcgagtatacccactctcacgtctgtgtgtccgcttccgagagtaaattatccgaaatgagtgtcactctgctgcgggatccatccatgtccccacttggtgtggccaccctgactcctagttccacctgcccaagtctggtcgaagggaggtacggagcaaccgatctgcgcacaccccagccctgctcacgcccagctagccctgagcccgaattgctccccgaggccgactctaaaaagctgcccagcccagctcgagcaaccgaaaccgacaaagagcctcagcgactcttagtgcccgacatccaagaaattcgcgtgtcaccaatcgtgtccaagaaaggttacttacattttttggagccgcatacctctggctgggcccgacggttcgtagtcgtccgccgtccctacgcctatatgtacaatagcgataaagatactgttgagcgattcgtgcttaaccttgctaccgcacaggttgagtactccgaagatcaacaagctatgctcaaaacacccaataccttcgccgtttgcacagaacacaggggcatcctgttgcaggcggcaagcgacaaggacatgcacgattggttgtacgcctttaacccactgctcgccggtaccatccggtctaaactctcaaggcgacggtctgcccagatgcgcgtata

SEQ ID NO: 227816 - DNA, 5399 bp, Artificial Sequence
  Description of Artificial Sequence: Synthetic coding sequence
atggccggagcatccgtcaaggtggccgtgcgagtaaggccatttaactccagagaaatgtccagagatagtaagtgcataatccagatgtcgggtagcactaccactatcgtaaaccctaaacagcccaaggagaccccaaaaagtttcagctttgattattcttactggagtcacacgagccctgaggatataaattatgcctctcagaaacaggtatacagagatattggtgaagagatgctgcagcatgctttcgaaggctacaacgtgtgtatttttgcgtacgggcagaccggggctggaaaaagctacaccatgatggggaaacaagagaaagatcagcaaggcataatcccacagctgtgcgaagatttattttcacgaattaatgatactactaacgacaatatgtcttatagtgtcgaggtaagctacatggaaatttactgtgagagagtgcgtgaccttctgaatcctaaaaacaaaggcaatttaagagtcagggaacacccgctcctcggtccctacgttgaggatcttagcaaattggccgtgacaagttacaacgatatccaagatttgatggatagtggtaacaaggcacgtactgtggctgcaactaacatgaatgagacgtcctcccgaagccacgccgtgtttaacattattttcactcagaagaggcacgatgccgagactaatataactactgaaaaggtgtctaagatttccctagtagatttagccggttccgagagggcagattcaaccggagcgaaaggcacaagactcaaagagggggcaaatatcaataaaagtctcaccaccctgggaaaagtaatctccgctctggcagaaatggtgagcggaccggctagaaacaaaaaaaaaaagaagacagatttcatcccttacagagatagcgtcctgacttggctgctgagagaaaacttaggcggaaactctcgcactgcaatggtagccgctctcagccctgcagacataaactacgatgagacattatcaacccttagatatgcggaccgggcaaaacagatccggtgcaatgccgtgattaacgaagatccaaacaataaactgatccgggagcttaaggacgaggtgacacgactgcgtgatctcctctacgcccaggggctcggggacattaccgacaccaatactgtccctgggggacccaagcttacgaacgctctggtcggaatgtctccatccagctctctctcagcactgtccagtcgagcggctagcgtctcttccctacacgaacgaatactgttcgctcctgggagtgaagaagccatagagcggctcaaggagacggagaagatcatagctgagctaaacgagacctgggaggagaagctgcgaaggacagaagccatcaggatggagagggaagcccttctcgctgaaatgggcgtagccatgagagaggacgggggaacattaggtgtgttcagccccaaaaagacaccccatctggtgaacttgaatgaagatcccctcatgagtgaatgcctcctctattatataaaggatggcattacgagggtcggcagagaggatggcgaacgccgtcaggatatagtgttatccggccacttcatcaaagaagagcattgcgtgttcagatccgactctagaggtggatcagaggccgttgtcacccttgagccctgcgaaggtgccgacacatacgtcaatggcaagaaagtaacagagccctccatactacgctctgggaataggattattatgggtaagtcccatgtatttcgcttcaaccacccagagcaggctaggcaagaacgcgaacgcacaccttgcgctgagaccccagccgagcctgtcgactgggcatttgcccagcgtgagttgctcgagaaacaggggatcgatatgaaacaggaaatggaacaacggctgcaagaactggaggatcagtatagaagagagcgcgaggaagccacttacctgctggaacagcaacgcctggattatgagagtaagctggaggcactgcagaagcagatggatagtcgctactaccctgaggtgaatgaggaagaggaagagcccgaggatgaagtgcagtggactgagagggaatgcgaattagccctgtgggctttcagaaagtggaaatggtatcagttcacgagcctgcgggacctgctctggggcaacgcaatcttcctaaaagaagctaacgctatctctgttgaattgaagaaaaaggtgcagtttcagtttgtactgttgaccgataccttgtattcccccctcccacccgatttgttaccccctgaggccgctaaggatcgcgagactcgcccttttcctcgcaccattgtagctgtggaagtccaagaccagaagaacggagcaacccattattggacactcgagaagctgcgccaaagactggacctaatgcgcgagatgtatgatagagctgcagaggtgccatcatccgtcattgaggattgcgataacgtcgtgaccgggggagaccctttttacgatcgattcccatggttccggctggttggttctagcgctataagtggttgcaactcttacccactattgaatacatgcatgagtgagcgcatggccgcactaacgccatctccgacattcagctcgcccgactccgatgcgaccgagcccgcagaagaacaatcggttggcgaagaagaggaggaggaagaagaagaagaggatgaagaggaagaagatttggaggacgacgtcttccccgaacacgcactttgtgacggacgggatccattctatgatagaccaccgctcttctcactcgttgggagagctttcgtctacttatcaaacctgctttatcccgtccctttggtacacagagttgcgatcgtgtctgaaaaaggtgaagtaaagggtttcctcagagtggccgtgcaggcaatctccgccgatgaggaagccccagactacggaagtggagtccgccaatcgggaaccgctaaaataagcttcgatgatcagcactttgaaaaattccagagtgaatcatgtccggtggtgggcatgagccgcagcggaacgtctcaggaggaactgcggattgtcgaggggcaggggcagggggctgacgtggggccatcagcagacgaggtgaataataacacgtgttctgccgtcccaccggagggattgttgcttgacagctcggagaaggctgctctggacggaccactggatgccgcactcgaccatctgaggttgggcaatacattcacttttcgagtaaccgtgctgcaggcaagctccatctccgcggagtatgccgacatcttttgccagttcaactttattcatcggcacgacgaagccttttcaactgagcctctgaaaaacacaggtcgcggtccgcctctcggcttttaccacgtccagaatattgccgtcgaagtcaccaagtcttttatcgaatacatcaagtcccagccaatagtatttgaggtcttcggccactatcagcagcacccctttccaccactgtgcaaagacgtgctcagcccactgaggccttcccggaggcatttcccacgtgtgatgcccctaagcaaaccagtgcccgcaactaagctctcgacacttacccgaccctgcccaggcccatgccactgtaaatacgacctcctggtgtacttcgagatctgcgagctggaggccaatggcgactatattccggctgtagttgaccatcggggaggcatgccttgtatggggacattcctcctccatcaaggaatccaacggcgaatcacagtgactctactgcatgagaccggctctcacatacgatggaaggaggtacgcgagctggtcgttggtagaattaggaacaccccagaaacagacgaatcccttatcgatccaaacattttgagcctgaacatcttgtcatccggatacatccaccccgctcaggacgacagggttagtctgggcaacgacactcgaactttctaccaattcgaggctgcttgggactcttctatgcacaattccttgctgctgaatagagtaaccccataccgggaaaagatttacatgaccctttcagcctatattgagatggaaaattgcactcagcccgctgtggtcaccaaagacttttgtatggttttttacagccgcgacgccaaactgcccgcttcgagaagcatacgcaacttgtttggcagtggcagcctccgggcatctgaatcgaacagggtaaccggagtgtacgaactcagcctctgccacgtggcagatgctggctctcctgggatgcagcggagaaggcggagggtactggacactagtgtcgcttacgttcgcggagaagaaaatctggcagggtggagacctcgctctgatagcctgatcctcgatcaccagtgggagctagaaaagttgagcctgctccaggaagttgagaagacaaggcattacctgctgttaagggaaaagctggagacagcacaaagacctgttcctgaggctttaagtcctgcgttctccgaggactctgagagccacgggtcttcgagtgcctcgagccccctgagtgctgaggggagaccatcaccactggaggcgcctaacgagagacaacgcgagctggcggttaagtgtcttcgcctattaactcatacctttaatcgggagtacacgcacagtcacgtctgcgtttctgcaagtgaatctaagctgagcgaaatgagcgtcacccttttgcgcgacccttctatgtccccactcggagtggcaaccttgacaccttccagcacatgcccttcactggttgagggcaggtacggcgcaactgatctgcggacccctcaaccctgttccagaccagcttctcctgaacccgaattgctgccagaggccgattccaaaaagctcccaagtccagcacgagccaccgagaccgacaaggaaccccagcgactactcgtgccagatatacaggagataagagtttctccaatagtctcaaagaaggggtacctacacttcctggagcctcataccagcgggtgggcccgtcgattcgtcgtcgttcgacgtccctatgcctatatgtataatagcgacaaagacaccgtggaacgttttgttttgaacctggccacagcccaggtggagtacagtgaggatcaacaggccatgttgaaaacccctaacacatttgctgtatgcaccgagcaccggggtattctcttacaggcagccagcgacaaagacatgcatgactggttatatgcctttaaccccttgctggccggaactattaggtctaagctgagcaggagacggtccgcgcagatgagagttta

SEQ ID NO: 227817 - DNA, 117 bp, Artificial Sequence
  Description of Artificial Sequence: Synthetic coding sequence
atggctggggcatctgtgaaggttgccgtgcgggtgagaccattcaactccagggaaatgtccagggattcaaagtgcattattcagatgagcggatccacgaccactatcgtttag

SEQ ID NO: 227818 - DNA, 5375 bp, Artificial Sequence
  Description of Artificial Sequence: Synthetic coding sequence
atggctggtgctagtgttaaggtcgcagttcgtgtacgtccatttaactcacgtgaaatgagccgggacagcaagtgcataatccagatgtcagggagtaccacaaccatcgtcaacccaaagcagcctaaggagacccctaaatctttctcatttgactacagctactggtctcatacgagccctgaggacataaattatgcctcccagaaacaagtctatcgggacattggcgaggaaatgcttcagcatgcctttgaaggctacaatgtgtgtatctttgcctatggtcaaaccggagctggcaagtcttataccatgatgggcaagcaggaaaaggaccagcaggggatcatcccacaattgtgcgaggatctgttcagcaggatcaacgacacgacaaatgacaacatgagctactccgtcgaggtgtcctacatggagatatactgcgagcgggttagggatctattaaacccaaagaacaaaggcaatttaagggtccgagaacaccccttgctgggcccatacgtggaggacctgtccaaattggcggtgacatcttacaatgatattcaagatctgatggattcaggtaacaaggctagaacagttgctgccaccaatatgaacgagactagtagcaggtcccacgccgtgtttaacatcatttttacccaaaagcgccatgacgcagagaccaatattaccactgaaaaggtgtccaagatcagtctggttgacctggcaggatctgagcgcgctgattcaaccggcgcaaagggcacacgcctgaaggagggggcaaacataaacaagtcactgaccaccctgggcaaagttatctccgcactggctgagatggattccggaccgaataagaataagaagaagaagaagactgacttcatcccctacagagactctgtcctcacctggctgctcagggagaacctgggaggcaacagtagaacagctatggttgccgctctgagccctgcagacatcaattacgacgagactctatccacattgcgctatgccgatagggctaagcaaattagatgcaacgccgtaatcaacgaggatccaaacaataagcttattcgtgaactgaaagacgaagtgacccgccttcgagacctcctttatgctcagggcctgggagacattaccgacaccaacaccgtgcccggaggcccaaagctgacgaacgccctggttggcatgagcccttctagctccctaagcgctctctcgagcagggcagcctcagtctcctctctgcacgagagaatcttatttgctcctggttcggaggaggctatcgaaagattaaaagagactgaaaagattatagccgagctcaatgaaacttgggaggagaaacttcgcagaaccgaagctattagaatggaacgtgaagctttacttgctgagatgggagttgccatgcgcgaggacggtggcaccctcggagtgtttagccctaagaagaccccccacctggtaaacctgaatgaagatccgctgatgtccgagtgcctgctgtactatatcaaggacgggattactcgagtcgggagagaggatggggagcgtaggcaggacattgttctatctgggcactttataaaagaggagcactgtgtctttcggagtgactctagaggaggcagcgaagccgtggtaacactggagccctgcgagggtgctgacacttatgtcaatggcaaaaaagttaccgagccatcaatcctacgttctgggaacagaatcattatgggcaagtcccacgtgttccgtttcaatcatcccgaacaggccaggcaggagcgggagagaactccatgtgctgagacaccggcagagcccgtggactgggcattcgcccaacgggaactcttggaaaagcagggaatcgacatgaaacaggaaatggagcaaaggctgcaggaactcgaggatcaatataggagagagcgcgaggaagctacgtatctgctggaacagcagagactcgactatgaaagcaaattggaagcacttcagaagcagatggactcccgctactatccagaggttaacgaagaagaagaggagcccgaagatgaggtgcagtggacagaacgggagtgtgaactggcgctgtgggcttttcgaaaatggaagtggtaccagtttacgagcctgagagaccttctgtggggcaatgccatcttcctcaaggaggctaacgccatctctgtagaactcaagaagaaagtgcagttccagttcgtgctgcttaccgacaccttgtactcaccgctcccgcctgacctgctgcctccagaggcagcaaaggaccgggagacccgaccctttccgaggacaatcgtcgcggtggaggttcaagatcagaagaacggcgcaacgcactattggaccttggagaagcttaggcaacggcttgacctgatgcgcgaaatgtatgacagagccgcagaagtccccagttcagtcatcgaagactgcgacaacgtcgtgaccgggggtgatcctttttacgatcggtttccatggttcaggttagtgggctcttccgcaataagcggctgcaatagttatccattgctcaatacctgtatgagtgagagaatggctgctctgacccctagcccaacattctcctcccccgattctgacgccactgagcctgccgaggaacagagcgtcggtgaagaagaggaggaggaagaggaggaggaggatgaggaggaagaagatttggaggacgatgtgttccctgaacacgccctgtgcgacggcagagaccctttctacgatcgtccccctctgttctccttggttggtagggctttcgtctacctcagtaacttactctaccctgtaccactcgtgcatagagtggccattgtatccgaaaagggcgaagtgaagggctttttgagagtcgcagtgcaggccattagtgcagacgaagaagctcccgactacggctccggcgtccggcaaagcgggactgctaagatatcctttgacgatcagcatttcgagaagtttcaatcagaatcctgtcccgttgtgggaatgagtagaagtggcacaagtcaggaggagctgcggattgttgagggacagggtcagggggcagacgtaggtcctagcgcagacgaggtcaacaataatacatgcagcgctgttccaccggagggtttgttacttgatagctccgaaaaggcagccctagacggaccattggacgccgcactggaccatttgcgtctggggaacacctttaccttccgggtcacggtgctgcaggccagttcaatctccgcggagtatgccgatatcttttgccaattcaatttcattcaccgccacgacgaagctttctccaccgagccactcaaaaatactgggagagggccacctttggggttctaccatgtccaaaatatcgcggtagaagtgaccaaaagctttatagagtatattaaaagccagcctatcgtgtttgaggtgttcggtcattatcaacagcacccatttcctcctctgtgcaaagacgtgctgagtccacttaggccatctcggaggcattttcccagggtgatgcccctttcaaagcccgtacctgcaaccaagctctccacactgactcggccatgccctggcccttgtcactgcaaatatgacctgctggtgtactttgaaatttgcgagttagaagccaacggtgactatattccggcagtcgtcgatcatcgaggtggtatgccttgcatgggtacttttctgctgcaccaaggcatccagaggcgtattacagtgacattactacatgagaccggaagccatattcggtggaaggaagtccgtgagctcgtggtggggagaattaggaacacgcccgaaacagatgagtctcttatcgatcccaacattctatcacttaatatactgagcagcgggtacatccaccctgctcaggatgataggaccttttatcagttcgaagcggcttgggactctagcatgcacaatagtctcctcttgaatagggtgaccccatacagagaaaaaatctatatgactttgtccgcatatatcgaaatggaaaactgcacacaaccagctgtagttacaaaggacttctgcatggtgttctactcaagagacgccaaattgcccgcaagccgcagcatcaggaacctctttgggtctggctccctacgggcttccgaatccaaccgggtgacaggagtctacgagctcagcctgtgccacgtagctgatgctggaagccctgggatgcaacggagacgcaggcgcgtgctagacacatcggtggcctacgtaaggggcgaggagaacctcgcgggatggcgacccaggagtgactcgctgatacttgatcaccagtgggagctagagaaactgagtctcctgcaagaggtcgaaaagactaggcactatttactgttaagagaaaaactggaaacagcccagcgacctgtgccagaagctctgagtcctgctttcagcgaagacagcgagtcacacggatctagctccgcatcatcccccctgtccgccgagggcagacccagccccctggaggccccaaatgagaggcaacgcgaactggccgtaaagtgcttgcgccttttaacccacacctttaacagagagtatactcatagccacgtatgtgtcagcgccagcgaatccaagttgagcgagatgtctgtgaccttgttgcgagatcctagcatgtctcctctgggcgtggccaccctgaccccatccagcacatgtccaagcctggtcgaaggcagatatggcgctacagacctgcggaccccccagccctgctcacgcccagcttctcccgagccagagctgttacccgaggcagacagtaagaaactgcctagccctgcacgggcaaccgagaccgacaaggagccacaacggcttctggtgcctgatattcaggaaattcgcgtgtccccaatcgtatcaaaaaaaggctatttgcattttctggagccccacacgagtggatgggcacgcagattcgtggtcgtgagacgcccttacgcatacatgtataactccgataaagataccgtggaaagattcgtgttaaatttggccaccgcgcaagttgagtattctgaagaccagcaggccatgctgaagacccctaacacttttgcagtgtgtaccgagcaccgcggaattctcttacaggccgcatctgacaaggacatgcacgattggctgtatgctttcaaccccttgctggcgggaaccattcggagcaagctttcccgcaggagatccgcgcagatgagagtcta

SEQ ID NO: 227819 - DNA, 5312 bp, Artificial Sequence
  Description of Artificial Sequence: Synthetic coding sequence
atgtctggcgctagcgtcaaagtggctgtgagagtgagaccatttaattcaagagagacgagcaaagaaagcaaatgcatcatccagatgcaggggaattccacgtctataatcaatcctaaaaaccccaaggaagccccaaaaagtttctccttcgactactcgtactggtcccacactagccctgaagacccttgcttcgccagccagaaccgggtgtataatgatatcgggaaggagatgcttcttcacgcctttgagggttacaacgtgtgtattttcgcctacgggcaaaccggtgccggaaaaagctatacaatgatgggaaagcaggaggaatctcaggccggtatcataccgcagctctgtgaggaactcttcgaaaagatcaatgacaattgtaatgaggaaatgtcctacagcgtggaggtcagttatatggaaatttactgtgaacgcgtgcgggatctcttgaaccccaaaaacaaaggcaacctgcgcgtcagggagcatcctctgctgggaccctacgtcgaggacctaagcaagttggccgtgacatcttatacggacattgcagatttaatggatgccggaaataaggccagaactgtcgcagcaactaatatgaacgagacaagttccagaagccatgcggtgtttaccatcgtcttcactcagaagaagcacgacaatgagactaatctgtctaccgagaaagtgagtaagataagtctcgttgacctggccggatctgagagggccgattcaacaggtgccaaaggaaccaggttgaaagaaggcgctaatattaacaagtctctaaccacattaggaaaggtgatttcagcactcgccgaggtctccaagaagaaaaaaaagaccgatttcattccttaccgggactccgtgcttacgtggctgttgagggagaacctcggcggaaactctcgcacggcgatggtcgctgctctcagccctgccgacatcaactatgatgagaccctgtccactctgaggtacgccgatcgggctaaacagatcaaatgcaatgctgtgatcaacgaagaccctaacgccaagctagtgcgcgagctaaaagaggaggtaactcggctcaaagacctcctgagagcccaggggctgggagacataattgacacatcgatgggtagtctgacctcatctccatccagctgctccctgtcttcccaggtcgggctgactagcgtcaccagtatccaggagcgcatcatgagcacacccggaggcgaagaggctattgagaggctgaaagaaagcgagaagatcatcgcagagcttaacgagacctgggaagaaaagttgcggaaaactgaggccatccgaatggaacgggaggccctgctcgccgagatgggtgtggcgatcagagaggatggtggaactctgggcgtcttttctcccaagaagactccacatctggtgaacctgaatgaggatcctttaatgtctgaatgcctgctttactatatcaaggatggaattaccagagtcggtcaggcggacgccgaacgacgccaggacatagtgcttagcggcgctcatattaaggaggagcattgtatcttccgctcggaaaggagtaacagcggggaagtgatcgtaacccttgagccctgcgaaagatccgagacctacgtgaacggaaagagggtgtcgcaacctgttcagctgagaagcggcaataggattatcatgggaaaaaatcacgtgtttcggttcaatcaccctgagcaggcgcgtgccgaaagggaaaagaccccttctgctgagaccccatcggaacctgttgattggacgttcgctcagagagagctgctggaaaaacagggcattgatatgaaacaggagatggagaagagactccaggagatggagattctctacaagaaagagaaggaggaggccgatttgctcctcgagcaacaacgtctggattatgagagtaagcttcaggcgcttcaaaaacaagttgagacacgatcgttggccgctgagacaaccgaggaagaagaggaagaggaggaagtgccctggactcagcacgaattcgagctggcacagtgggcgtttcgcaaatggaagtcgcaccaattcacgagcctgagggacttgttgtggggaaatgcagtctatctgaaggaagctaatgcaatctcagtggaactgaaaaaaaaagttcaattccagtttgtcctgcttacggatacgctgtatagtcccttgccaccggagcttctacccacggagatggaaaagactcatgaggatagaccatttcctcgtactgttgtcgccgtggaggtgcaggacctaaagaatggcgctacccactactggtccttggagaagttgaaacaacggcttgatttaatgcgagagatgtatgatcgcgctggcgaaatggcaagtagcgcccaggatgagagtgaaaccactgtcacaggctcagatcctttttatgaccggttccactggtttaagctggtcgggagctcccccatctttcacggatgcgttaatgaaagactggcagacaggactcctagccctaccttctccactgcggattcggacattacggaattggccgacgaacaacaggacgaaatggaagatttcgatgacgaggcctttgtcgatgacgccggttctgatgctggcactgaggagggaagcgacctctttagcgacggtcacgatcctttctatgaccgatccccctggtttatcttggtcgggagggcattcgtctacctctctaatctgctctatcccgttcccctcattcaccgggtcgcgattgtatcagaaaagggcgaggtgagagggttccttagggtggccgtccaggcaatagccgcagacgaagaggcaccggattatggatctggcatccgacaaagcggtacggccaaaatctctttcgataatgaatacttcaaccagtctgatttctccagtgtggctatgacccggagtggccttagtctggaggagcttagaatcgttgaaggacaaggccagagcagcgaggtcattactccgcctgaggagatctcccggatcaacgacctggacttaaaatcttccacactgttagacgggaaaatggtcatggagggtttttcagaagaaattggcaaccatctcaaactggggagcgcgttcacatttagagtcacagtacttcaagcctctggaatcctcccagagtatgccgacatcttctgtcaatttaacttcctgcaccgccacgacgaggcttttagtactgagccactgaaaaacaacgggagggggtcccctctggcattttaccacgtgcagaacatagccgtagaaatcactgaaagctttgtggactacatcaagactaagccaattgtttttgaggtctttggccactaccaacagcatccgctgcatttgcagggccaggaactgaattctccaccccagccgtgtagaagattcttcccgccaccgatgcctctgtcaaaacctgtgccagctacaaagctcaatacgatgagtaaaaccagtttgggccaaagcatgagtaaatacgatctgttggtgtggttcgagatctctgaactagaacccacaggcgaatacatccctgcggtggtggaccatacagctggactcccatgccagggtaccttcctactccaccaagggatccaaaggaggatcaccgttaccattatacatgaaaagggatcagagctgcattggaaggatgtgagagagctggtagtggggagaatccggaacaaacccgaggtcgatgaggcggcagtggacgcaattttatctctgaacatcatctcggccaagtacctcaaaagctctcataatagcagtaggactttctacagatttgaggctgtgtgggattcctctctgcataactccctcctgctaaatcgggtgacgccctacggggagaaaatttacatgaccctcagtgcctacctcgagctggatcactgtatccagccggcagtgatcactaaggatgtgtgcatggtcttctatagccgtgatgcaaaaatcagtccgccaagatctctccgctctctgttcggctcaggttattccaagagccccgatagcaatagagtaaccggcatctatgagttgtctctctgcaaaatgagcgacaccgggtctccaggaatgcaaaggagacgcaggaaaattctggatacctcggtcgcctacgttagaggcgaggaaaacttggccggttggaggccgaggggggattcactgatccttgaacaccagtgggaactggagaagttggaactgctgcacgaggtggagaagacacgccattttctgctactgagagaaagattaggagatagcatccccaagagcctttccgattctctgagtccctccctgtcttctggaaccctgtccacttccacttctatttcatcccagatctccacgacaacatttgaatcagccatcacaccttccgaaagcagtggctacgatagtggcgacattgagtcactcgtggacagagaaaaggaactcgccaccaaatgtttgcagctccttacgcacacctttaatcgcgagttttctcaagttcacgggagcgtcagcgactgtaaattaagtgacatcagccctatcgggagggatccgtcagaatccagtttttccagcgcaacccttaccccaagctcaacctgcccaagcttggtggattcacgcagtaattctctggatcagaaaactcccgaggcaaatagcagggcatccagcccatgcccggagtttgagcagtttcagatcgtcccagccgtagaaacaccttacttagcccgagccggaaaaaatgaattccttaacctagttcccgacattgaggagattaggccatctagtgtagtgtctaagaaaggctacctccattttaaggaaccactgtattcaaactgggcaaaacacttcgtggttgtaaggcgaccctacgtgttcatctacaattccgataaggatcctgtggaacgaggtatcattaatctcagtactgcccaggttgagtattctgaggatcagcaggctatggtgaagacccccaatacttttgccgtctgtacaaagcacaggggggtgctgctgcaagcattaaatgacaaggacatgaatgattggctgtatgcattcaacccgctgctcgccggtaccattcggtccaaattatctaggaggtgcccatcccagtctaagtacta

SEQ ID NO: 227820 - DNA, 5471 bp, Artificial Sequence
  Description of Artificial Sequence: Synthetic coding sequence
atgagcggggcatccgtaaaagtggcagtgagagtgcggcctttcaattcccgggaaaccagcaaagaatctaagtgcatcatccaaatgcaggggaattccacgtcaatcatcaaccctaaaaatcctaaagaagctcccaaaagcttcagctttgattactcatactggtcccacacgtccccagaagacccatgttttgccagccagaatcgtgtgtataatgacatcggaaaggagatgcttctgcatgcgttcgagggatacaatgtgtgcatatttgcttatggtcagactggcgcaggcaaatcttatactatgatgggcaaacaggaggaatcacaagccggaataataccccagctgtgtgaagagttgttcgagaagataaacgacaactgtaacgaggagatgagctattctgttgaagtaagctacatggaaatctattgcgaacgagtgagggacctgttgaatcctaagaataaggggaacttgagagtcagagagcatcccttgctaggaccctacgtcgaggatctgtcaaaactcgctgtgaccagctacacagacatcgcggatcttatggatgcgggaaataaggccaggactgtagccgctacaaatatgaatgaaaccagcagccgcagccacgctgtatttacaattgtgtttacccaaaagaagcatgacaatgaaacaaacctgtccaccgagaaggtgagcaagatctcactagtggacttggccggtagcgaaagggccgactcaacaggcgcaaagggcacccgtctcaaggaaggagcaaatatcaataagtccctcactacgctgggcaaggttatctccgcactggcagaagtagatacctcaaaaaaaaaatcgaagaaaaaaaagaagaccgacttcattccgtacagggattcagttttgacctggcttctgagggaaaatttgggagggaattcccgtaccgcgatggttgccgcactgtcgccagcagatattaactatgacgaaacgttatctaccttgagatacgccgatcgggctaaacagatcaagtgcaacgctgttatcaatgaggaccccaacgcaaaacttgtgcgggaactgaaggaggaagttactcgacttaaggatttactgcgtgcccaaggactgggagacattattgacatcgatccgttgatcgacgactattctgggtctggaagcaagtacttgaaggactttcagaacaacaagcaccgctacctgctggctagtgaaaatcagagacccggtcatttctccactgcaagcatgggctctctgacctctagcccatcgtcctgctcactttctagtcaggtagggctgacctctgtaaccagcattcaggagcggatcatgtccacacccggaggcgaggaggctattgagcgcttaaaggagtccgagaaaatcatagccgagctcaatgagacctgggaagagaaactacggaagacagaggccatccggatggagcgggaggcactgctggccgagatgggagtggccataagagaagacggtggcacactaggtgtgttctcaccaaaaaagacaccccatctggttaatctgaacgaagatccgttgatgagcgagtgtctgttgtattatataaaggatgggataacccgggtaggtcaggcagatgccgaacgccgacaggatatagtcctctccggcgctcatatcaaagaggagcattgtatttttagaagtgaacggagtaattcaggggaagtgattgttaccctcgaaccgtgcgagagatccgagacctacgttaacggcaaacgcgtgtcccagcctgtgcaactccggtccggtaaccgtattattatgggcaaaaatcacgtgttccgtttcaaccaccctgagcaggctagggccgagcgcgagaagacaccctccgccgaaacaccttccgaaccagtcgattggactttcgctcagcgggaactgctggaaaagcagggaattgatatgaagcaggagatggagaaaaggcttcaagagatggaaattctttacaaaaaggagaaagaggaggccgacctgctcctggagcagcagagattggattacgaaagcaaactacaggccctgcagaagcaggtcgaaacgcggagtctcgccgcagagaccaccgaagaagaggaggaggaagaggaggtcccctggacacagcacgagtttgaactggcccaatgggctttccgtaaatggaagtctcaccaatttacctcgttaagggacttgttatggggtaatgccgtctaccttaaggaagccaatgccatcagcgtcgagctgaaaaaaaaggtgcagttccaatttgtcctgctcacagataccctttatagcccgctgccccctgagcttctccccacagagatggagaagactcatgaggacaggccctttccacgaacggtagtggccgttgaggtgcaggatcttaaaaatggcgcaactcactactggagtttggaaaagctgaagcaacggcttgatctgatgcgggagatgtatgatcgagctggcgagatggcatcctcagcccaggacgagagcgagactactgtgactggatcagatcccttctacgaccggttccactggttcaagctagtcggtagttcccctatcttccacgggtgtgttaacgagcgcctggctgatcggaccccttccccgacctttagtaccgccgatagcgatatcactgagttggcggacgaacagcaggacgagatggaagacttcgacgatgaggcattcgtagatgacgctggcagcgatgcaggcacggaagagggatctgacctgttctcggatgggcacgacccattttatgacagatccccatggtttatcttggtgggcagagcctttgtttatctgagtaaccttctgtatcctgttcctctcatacacagagtggctatcgtgtccgagaaaggtgaggtgcgcggtttcttacgtgtggccgtacaagccatcgccgcagacgaagaggccccagattacggttctggcatccggcaatcaggaaccgcaaagatatcgtttgataatgaatacttcaatcagtccgatttttctagtgttgcaatgactcgcagcggactgagtctggaggagctgaggattgttgagggacaaggccagtctagcgaggtaataaccccacccgaggaaatatcaaggataaatgacctcgacctcaagtcatccacactgctggacgggaagatggtcatggaaggctttagcgaagagataggcaaccatctaaagctcggctctgcattcactttcagagtgaccgtgctgcaagcctccggcatattgccggaatacgcagatatattctgccaatttaacttcctgcaccgacacgatgaggcgttttctactgagccgttaaagaataacggacgcggttcacctctcgccttctaccacgtgcagaacatcgcagttgaaatcaccgaaagcttcgtggattatattaaaacgaagcccatagtgttcgaggtgtttgggcattaccagcaacatccattgcatctccagggacaagaactgaattcccccccacagccctgtcggaggttcttccctcctcccatgcctctcagcaagcccgtgcctgcaacgaagctcaacacaatgtcaaaaaccagcctgggccagagtatgtcgaaatatgacctcctggtgtggttcgagattagcgaactcgagcctaccggcgagtatattcccgctgttgtcgatcacaccgcgggtctgccgtgccaaggaaccttcctgctgcatcaagggatacagaggcgaattactgtcaccattatccatgaaaagggttccgaattacattggaaggatgtaagagaactagtggttggaagaattcggaataaacctgaggtggacgaggccgcagtcgatgctattttatcactaaacatcataagcgcaaaatatctcaagtcctctcacaacagttcaaggacattctaccgctttgaggcagtatgggatagtagtttacataattcccttcttttaaaccgcgtaaccccttatggggaaaaaatttacatgacgctgtcagcttacctggagcttgaccattgcatccagccggcagttattacaaaggacgtctgcatggtgttttacagtcgcgacgcaaaaatctcacctccccgatccctccgctcccttttcggaagtggatacagtaaatcacccgacagtaatagagtgactgggatctacgagctcagtctctgcaagatgtctgacactggaagcccagggatgcagagacggagacgtaagatattagataccagcgtggcctatgtgaggggcgaggaaaatcttgctggatggcgaccacggggagactcgctcattctggagcatcagtgggaactggagaagctggagctactccacgaggtcgaaaagacgcgtcactttcttctcctacgggagcggcttggcgactctattcctaagagcttgagcgactcactctctccaagcctgagttccgggacactgtccacctcaacctcaattagctctcaaatctccacaactacattcgaatcagccattacaccttcagagtcatctggatacgattccggcgacattgagtcgttagtggaccgagagaaggaactggccactaagtgtctacagctcttaacgcataccttcaacagagagttcagtcaggtccatggctccgtgtccgattgtaagctgagcgatatcagtcccatcggtcgcgacccctccgagagcagtttcagcagtgccacattgaccccttctagtacctgtcctagcctcgtggattctcgaagcaactccctggaccaaaaaacccccgaggccaactcccgagcttcttctccgtgccctgagtttgagcagtttcagattgtacctgcggttgagaccccatatctagccagagcgggaaagaacgagtttctgaatctggtgcccgatatcgaggagatacggccatccagcgttgtgtcaaagaagggctacctacactttaaggagcccctgtacagtaattgggcaaagcatttcgtggtcgtgagaagaccatacgttttcatttataattctgacaaggaccccgtggaacgagggatcatcaatttgagcactgctcaggtggagtacagtgaggatcagcaagcaatggttaagacgcctaacactttcgctgtctgcacaaagcacaggggggttttactgcaagccctgaacgacaaggatatgaacgactggctttatgcattcaacccgctcctcgcgggtactattaggcctggtcacctggcttctgagataatccgggaagacaaatcagtgagtttttcatgccaata

SEQ ID NO: 227821 - DNA, 5471 bp, Artificial Sequence
  Description of Artificial Sequence: Synthetic coding sequence
atgagcggagctagcgtgaaagtggcagtgcgagtgcgaccgtttaattctagggagacaagcaaagagtccaaatgcatcattcagatgcaaggcaactcgacatccatcattaaccctaagaacccaaaggaagcacccaagtcttttagcttcgactattcttattggtcgcatactagtcccgaagatccctgtttcgcttcacaaaaccgggtatacaatgatatcggcaaggagatgcttctgcatgcgttcgaagggtacaacgtttgcatttttgcttacggccagacaggagctggcaagagttatacaatgatgggaaaacaggaggaaagccaggctggtatcataccacagctgtgtgaagaactatttgaaaagatcaatgataattgcaatgaggagatgtcctattcagtagaggtgtcttatatggagatctactgtgagagagtgcgggacctgcttaaccctaaaaacaaggggaacttgcgcgtgcgcgagcatccgctccttggtccttatgtcgaagatcttagtaaattggccgtgacttcttacacagacatcgcagacttaatggatgctggcaataaggctcgcactgtcgctgctacgaacatgaacgagactagctcccgcagtcacgcagtgttcaccatcgtgttcacgcagaaaaagcacgataacgagactaacctttcgaccgaaaaggtctccaagatctctctggttgatctggctggcagtgagcgtgcagatagcactggagccaaaggaacccggctcaaggaaggagcaaacattaacaagagcctgacaactctgggcaaggtgatttcagctcttgctgaagtggacaactgtacctcaaagagtaagaagaagaagaagaccgactttattccttatcgagattctgttctcacatggctgctgcgcgaaaatctgggaggcaattctcggactgcgatggtggccgctcttagccccgcagatattaattacgatgagactctatcaactcttcgctatgccgacagagctaagcagataaagtgtaacgctgtgatcaatgaggaccccaatgccaagttggtccgtgaattgaaagaggaagtgactcgtctaaaggacctgctccgcgcacaggggcttggggatatcatcgatatcgaccccctgatcgacgactactctgggagcgggtctaagtatttgaaagactttcagaacaacaagcatagatacctccttgcctctgagaaccagcgccctggccatttctcaacagcttccatgggtagccttacctctagtccttctagttgtagcctgagctcccaggttgggttgacctcggtgacgagcatacaagaacgtataatgtccacccccggtggggaagaggccatagagagattaaaggagagtgagaaaatcatcgcagagctgaacgaaacttgggaggaaaagttgcgaaaaacagaagctatccgcatggagagggaagcactccttgctgagatgggggtagcgattcgagaagatggcggtacccttggcgtttttagcccaaagaagacaccccatctagtgaatctcaacgaagatccactgatgagcgaatgcctgctttattacattaaggacggcataacacgggtgggccaggcggacgctgagcgacgacaggatattgtacttagcggcgctcacatcaaggaggagcattgcatatttagatctgaacgttcgaactctggagaggtgatagtgaccctcgagccctgtgagcgctctgaaacatatgtgaatggaaagagagtctcgcagcccgtccagctccggtccggaaaccggattatcatgggtaaaaaccatgtgttcagatttaaccaccccgagcaagctcgggctgagagagagaagacaccgtcagcagagacccccagtgagcccgtggactggacctttgctcagcgcgaattgctcgagaaacagggcattgatatgaaacaggagatggaaaaacgattgcaggagatggaaattctgtacaagaaagagaaggaggaggctgatctgctactggagcaacagagattggattacgaatctaagctccaggcgctccagaagcaggtcgagactagaagccttgccgctgagacaactgaagaagaggaggaagaagaggaagtgccatggacacagcatgaattcgaactggcccagtgggccttccggaaatggaaaagccaccagttcaccagcttgcgcgatctgctgtggggcaatgccgtttatctaaaggaagccaatgcaatatctgtggagctaaagaagaaggtccagttccaattcgtcctgttgacagacactctgtattcccccttgccccctgagctcttgccaactgagatggaaaagacacacgaagatcgcccattcccgaggaccgtggtcgcagtcgaggtacaggacctgaaaaacggcgctacacactactggtccctggagaaactaaaacagagactcgatctgatgcgggaaatgtacgaccgcgctggtgagatggcctcttccgcacaggacgaaagcgagacaacggtgacaggtagtgatcctttctacgatcgatttcactggttcaagctagtaggatcgtcccccatatttcacggctgtgtcaatgagcgattagccgacaggactccaagcccgaccttcagtacagctgactctgacattactgagctggcagacgaacagcaggatgaaatggaggactttgatgatgaggccttcgtcgacgacgccggttctgacgctggtaccgaagagggctctgacctattctccgacgggcacgacccattctacgacaggtccccatggttcattctggtgggacgtgcctttgtctacctgtccaacttgttgtatcctgtcccactaatacaccgcgtggcgatcgtctctgagaagggagaggtacggggttttcttagagtagctgtgcaggccatcgctgcggatgaagaggcccctgactacgggagcggtattcgccagagtggcaccgctaagatttcctttgataatgaatacttcaaccaatcagatttttctagcgtagctatgactcggtccggcctgtctctcgaggaactgcggatcgtggagggacagggccagagttctgaggtcatcacgccccctgaggagataagcagaatcaatgacctggacttgaaatctagcactctgcttgacggtaagatggtcatggaggggtttagtgaggagattggcaaccatttaaaacttgggtccgctttcaccttccgcgtcacggtgttacaggccagtgggattttgccggaatatgctgatattttctgtcagttcaatttcctccataggcatgatgaagccttttcaacggagcctttgaaaaataacggacgaggatcgccactcgccttctatcatgtgcagaacatcgccgttgaaatcaccgaatctttcgtcgactatatcaaaactaagcctattgtgtttgaagtgtttggccattaccagcagcaccctctccacctgcagggccaagagcttaattcccctccgcagccctgtcgcagattctttccgccaccaatgcctctgagcaagcctgtgccggcaaccaagttgaacactatgagcaagaccagtttgggccaatctatgtcgaagtatgatctgttggtgtggttcgaaatatctgagctggagccaactggtgaatatatcccggcagtggtggaccacaccgcagggttaccatgtcagggcacatttttgctacaccaaggtattcagagaagaataacagtcactataatccacgagaaaggatccgagctccactggaaagacgtccgggagctggtggtcggtcgcattcgtaataaacccgaggtggacgaagccgcagtggacgctattctgtcactcaacattattagcgctaaatacctgaagtccagtcataattcgtcaagaacattttacagatttgaggcagtatgggactcctcattacacaactccctgctactgaatagggttactccctatggagaaaagatctacatgaccctctccgcctatctggagctggatcattgcatacagcctgctgtgataacaaaggacgtctgcatggtattctattcacgagacgccaaaatttctcctcctcgctcgctgcgctctttgtttggaagcggatattccaagagtccagactcaaaccgggtgaccggtatctacgagcttagcctgtgtaagatgagcgacacgggttcgcccggaatgcagaggcgcaggaggaagattctagatacttctgtcgcgtacgttagaggcgaggagaatttggccggatggaggccacggggagatagcctcattcttgagcaccagtgggaattagagaagttagagcttttgcacgaggtcgaaaaaaccaggcatttcctattacttagggagcggctcggtgattcaattccaaaaagtctgtctgattctctgtcaccatctctgagctctggcactctctcaacctctactagtatttcctcccagatctctaccacaacgtttgagagcgctattacaccatctgagtcgagtggctatgacagtggagacatagagtcattagtcgacagagaaaaggagttggcaaccaagtgtttgcaactccttacgcacacctttaaccgggagttttctcaagttcacgggtctgtaagtgactgcaagctctcagacattagtccaatcggccgagatccaagcgaaagctccttttcctcagccacgcttacaccctcaagcacctgcccttcgcttgtcgattctagatcaaacagtctggaccagaagacccctgaagcaaattctagggcatccagcccttgccccgaattcgagcagttccaaattgtgcctgctgtggaaacaccctatctggctcgggctggaaaaaatgagtttctcaatctggtacccgatatcgaagaaatcagaccgtcctcagtggtcagcaagaagggctacctgcactttaaagagcctctgtactctaactgggcaaaacattttgtcgtggtgaggaggccctatgtgttcatctataattccgataaggaccccgtggagagaggcattatcaatctgagcacagcacaggtagagtactctgaggatcaacaggccatggtcaaaaccccgaataccttcgccgtttgtacaaaacatagaggcgtgctcctccaagcccttaacgataaggatatgaacgactggctctatgctttcaatcctctgcttgctggaacgattcgcccaggacacctagcctccgagatcatcagggaggacaaaagtgttagtttcagctgccagta

SEQ ID NO: 227822 - DNA, 3462 bp, Artificial Sequence
  Description of Artificial Sequence: Synthetic coding sequence
atgagcggtgcgagcgtgaaagttgctgtgagagtgcgacctttcaattcccgagaaactagcaaggaatcgaagtgcatcattcagatgcaaggcaactcaacgagtatcattaaccccaaaaatcccaaggaagccccaaagagcttcagctttgactacagttactggtcacatacaagccctgaggatccctgtttcgcttcacagaatagggtatataacgacataggtaaggagatgctcctgcacgcgtttgagggctataatgtatgcatctttgcctatgggcagactggagccggtaagtcatatactatgatgggcaagcaggaagagtcgcaagcaggtataatcccccagttatgtgaggaactctttgagaagattaacgataactgcaatgaagagatgagctattctgtagaagtgtcttacatggagatctattgtgaacgggtgcgcgatttgctgaatcccaagaataaaggcaacttgagagtgagagagcatcccctgctgggtccttacgtcgaagacttgtccaaactagcagttacatcttacacagatatcgccgacctgatggatgcgggtaacaaggcacggacggtcgctgccactaacatgaacgaaacatcctctcgaagccacgccgtcttcaccattgtgttcacacagaagaagcacgacaatgaaacaaacctaagcaccgagaaagtaagcaaaatttccttggttgatctggctggaagcgaacgggctgattccacaggcgcaaaagggacaagactgaaagagggggcaaatatcaacaaatcgctcaccacattaggcaaggttatttcagcactggcagaggttagtaagaaaaagaagaaaacggattttatcccctacagagattccgtgctgacctggttactgcgggagaatcttgggggaaatagcaggaccgctatggtggctgccctttctcctgccgacatcaactatgatgaaaccctcagtaccctgcgatacgctgatcgcgctaagcaaatcaaatgtaacgcagttatcaatgaagacccaaatgccaaactggtcagagagctgaaagaggaggtaaccaggcttaaggatctgctgcgagcacaaggtttgggcgatataatagatacctcaatgggtagtctgacttcatccccctcatcatgctccctcagttcacaagtgggcctcacgagcgtcacctccatccaagagaggatcatgtccacgcccggtggggaggaagcaatcgaacgcctgaaggagagcgaaaagatcatcgccgagttgaacgaaacatgggaggagaagttacgcaaaactgaagccataaggatggagagggaggccctgcttgctgagatgggggtggctattagggaagacggagggacactgggggtgttctcaccaaaaaaaaccccacatttagttaatctgaatgaggatcccctgatgagcgagtgtttactgtattatattaaggatgggatcactagagtcggtcaggcagacgcagagaggcgccaggatattgtgctgagcggagcccatatcaaggaagagcactgtatatttagatcagagcggagcaattctggggaagtgattgtgacccttgagccttgtgagcggagtgagacatacgtgaacgggaagagagtgtctcaacctgtgcagctgagatccggcaacagaatcataatgggaaagaaccacgtcttccggttcaaccaccccgagcaggccagagctgagagggaaaaaacgcccagtgctgaaactcccagcgagcctgtggactggaccttcgctcagcgagaactgctggagaagcaaggcattgatatgaaacaggagatggaaaagcgccttcaagaaatggagatcctttataaaaaggagaaggaagaagccgacctgttgctggagcagcagcggcttgatgccgatagtgactccggtgatgacagcgacaagcgatcctgcgaggagtcttggaagttgatcacatcactcagggagaagctgcccccatcaaagctgcagacaatcgtaaagaaatgcgggctcccatcatcggggaaaaaacgtgagccaataaaaatgtaccaaatcccccagaggaggcgcctctcaaaggattcaaaatgggtgactatttcagatttgaaaatccaggcggtgaaggaaatctgctacgaagtggccctaaacgacttccgtcactctcgccaggagatagaagcactcgccatagtcaaaatgaaagagttgtgcgccatgtacgggaaaaaagacccaaatgagagagacagttggagggcagtcgctcgtgacgtgtgggacacagtcggagtgggggatgagaaaattgaagacgtcatggctaccggaaagggctctactgacgtcgacgatcttaaggtccacattgacaaactggaggacattctccaggaagtgaagaaacagaacaatatgaaggacgaagagattaaggtgctgaggaataagatgctgaaaatggagaaagttctgccgcttatcggcagccaggaacagaaatcacccggatctcataaggccaaagagcccgtgggagccggtgtgtcctccaccagcgagaacaacgtgtccaagggcgataacggggagctcgcaaaagaggaacgcgtgtcccaactcatgaacggtgaccccgcatttcgaaggggacggttgcggtggatgcggcaggagcaaatcaggtttaaaaacctccagcagcaggagattacaaagcagctgagaaggcagaacgtgccccaccggtttatcccaccagaaaatcggaagcctcgcttccccttcaagtcaaacccaaaacacagaaactcctggtcacccggaactcacataatcatcaccgaagacgaagtcatagagctgcgcatccccaaggatgatgaagccaggaaggggaacaaggaggagagccaggagaagggagggaaaggagcctttaaagacccacagttcccttggggatcacaaggcatgcggtcccaggatcacatccaagtctccaagcagcacatcaacaaccagcaacagccccctcagcttagatggcgttcaaacagccttaacaacgggcagcctaagtcgacaagatgccaggccagcgcatccgccgagtctctgaacagccactcagggcacccaacagccgacgtgcagaccttccaggccaagaggcatattcaccaacatagacagtcctactgcaattataatacaggtggacagctagagggcaatgctgccacgagttatcagaagcaaacagataagccttcacattgcagtcaattcgtcactccacctcggatgcggagacagtttagcgccccaaatctgaaggcaggtcgcgaaactacggtgtag

SEQ ID NO: 227823 - DNA, 5450 bp, Artificial Sequence
  Description of Artificial Sequence: Synthetic coding sequence
atgtctggcgcatccgtaaaggtggcagtgagagtgagacccttcaatagtcgcgaaacttccaaggaaagtaagtgtatcatccagatgcagggtaatagcacgtcgatcatcaaccccaaaaatccaaaagaggccccaaagagttttagtttcgactattcatactggagccatacatctccagaggacccatgcttcgccagccagaatagagtctataatgatataggaaaagaaatgctgctccatgcctttgagggatacaatgtatgcatctttgcctacggacagaccggggctgggaaatcctacaccatgatgggaaagcaggaagagtcccaagccggaataatcccacagctgtgcgaggagctgttcgagaagatcaacgataattgcaacgaagaaatgagctactctgtggaggtgagttacatggaaatctactgcgagcgggtaagggacctgctgaatcctaaaaacaaaggtaacctgcgggtccgggaacatccactgctgggtccatacgtagaggacctcagcaaattggctgtcacttcttatacagacatagcagatctgatggatgcgggaaataaagctagaacggttgccgctaccaatatgaacgaaacctcatcaagatcccatgccgtctttaccatcgtctttactcaaaaaaagcacgataatgaaactaacctttctactgaaaaggtgtccaagatctctttggtggatcttgccggatctgaacgagccgacagtaccggcgctaaagggacccgccttaaggagggggcaaatattaacaagagtctgacaaccctgggcaaagtgatctccgctcttgccgaggtggacaactgcacctccaagagcaagaagaagaagaaaacagattttataccttaccgcgattccgtccttacgtggctgctacgtgaaaacctcggcggtaattccaggacggccatggtagcagctctgtctccagctgatatcaattacgatgagaccctgtcaactctgcgttacgccgacagggccaagcaaatcaagtgtaatgccgtcattaatgaggaccccaatgcaaaactcgtgagggagctgaaggaagaagttactcggctcaaagacctgctgagggcccagggactgggcgatatcattgatatagatccattaattgatgactactccggaagcggaagtaaatacttaaaggactttcaaaacaacaaacatagatacttgctggcatctgagaaccaacgcccaggacacttttcaaccgcatctatgggtagcttgacatcttcacccagttcatgtagtctcagctctcaagtggggctcacttcagtcacctccatccaagagcggataatgagcacacctggtggcgaggaagccattgagcgacttaaagagtcagaaaaaatcattgctgagctgaacgaaacttgggaagagaaactgagaaagaccgaggcgatacgcatggaacgtgaagccttgctggccgaaatgggcgtggctattagggaggatgggggtacacttggtgtgtttagtccgaagaagactccccacctcgttaacctcaatgaggacccactgatgagtgagtgtctgctgtactatattaaggacgggattacccgggtgggccaggcggatgcagagcgcagacaggacattgtcctgtcaggcgcacatattaaagaagagcattgtatattcagaagcgaacgaagcaattccggggaggtcattgtgaccctggaaccttgtgagagatccgaaacttacgtgaacggtaagagggttagccagcctgtgcagcttaggtctggcaataggattattatggggaagaaccacgtgtttagatttaaccatccggagcaagcccgtgctgagagagaaaagaccccctccgctgaaaccccgagcgaacccgtcgattggacatttgctcagcgggaactactggagaagcaaggaattgatatgaagcaggagatggagaagaggctgcaggaaatggaaatcctgtacaaaaaggagaaagaggaagccgacctgctcttggagcagcaacggctcgactacgaatccaagctgcaagctttgcagaagcaggtagagacccgatctctcgccgctgagactactgaggaagaagaagaggaagaagaggtgccctggactcagcatgaatttgagctggcgcagtgggcatttcggaagtggaagtcacatcagtttacttccctgcgagatctgctgtgggggaatgccgtgtaccttaaagaagccaatgccatctccgttgaactgaaaaaaaaagtacaattccagttcgtgctgctaacagacaccctgtatagcccgttgccccctgagctgctccctacggagatggagaaaacacatgaggatcggcctttcccaagaaccgtggtagccgtagaggtacaggatctcaaaaacggagcaactcactattggagcttagagaagctgaagcaacggctcgatttaatgcgtgaaatgtatgatagggcgggtgagatggcctcctcagcacaggacgagtccgagaccaccgtgaccggctccgaccctttttatgatcggttccattggtttaagctggtcggctccagcccgatcttccatgggtgcgttaacgagagactggcggatcgaacaccaagccccaccttctctaccgctgactccgatattaccgagttggcagatgaacaacaagacgaaatggaagattttgatgatgaagcatttgtggacgatgcaggatctgacgcaggcacagaagaagggtcagacctgttctctgacggacacgaccccttttacgaccgcagcccatggttcatcctggtcggacgggcattcgtctacctgagcaacctgctgtacccagtgccgctcatacaccgtgtggctattgtgtcagagaaaggtgaagtcagggggttcttacgagttgccgttcaggcaatagcggctgacgaggaggctcccgactacggctcaggaattagacagagcgggaccgcgaaaatttcttttgacaatgaatatttcaaccagagtgacttttcctctgttgctatgacaaggtctggactgagcctcgaagagctgagaatcgttgaggggcagggtcagtccagtgaagtaattactcctcctgaggagatttccagaattaacgatctggatctcaagtcatctacactcctggatgggaaaatggtgatggagggcttctccgaggagattggcaaccacctgaaactgggctctgccttcacgttccgggttactgtgctgcaggcctccggcattctgccagagtacgccgacattttttgtcagttcaactttctccatcgccatgatgaggcttttagcaccgagccactgaagaataatgggagagggtcccctctggctttctatcatgtacagaacatcgcagtagagataaccgaatcctttgtggattacataaagaccaagcctatcgtctttgaggtcttcggccattatcagcaacacccactgcacctgcaggggcaggaactgaacagccccccacagccatgtcgtcgattttttcccccacctatgcctttgagcaaacccgtgccggctaccaaactgaataccatgtcgaagaccagcctcggccagtccatgagcaagtacgacctactcgtgtggttcgaaatctctgagctggagcctaccggcgagtatatcccagccgtggtcgatcacacagctgggctcccgtgtcagggtacttttttgttacatcaaggaattcaacggcgaataacagtgactatcattcacgaaaaggggagcgaactgcattggaaagacgtgagggaactggtcgttggtcgcattcgcaataagcctgaagttgatgaagctgcagtcgatgctatattgtcactgaatataatctctgctaagtacctcaagagttcgcacaacagctcacgaacgttctatcgattcgaggccgtttgggattctagtctgcacaacagtctgctcctgaacagagttaccccttacggcgagaaaatttacatgacactttccgcttatctcgagttagatcactgcattcaaccagccgtcatcacgaaggacgtatgcatggttttctactctcgtgatgcaaaaatttcaccaccaaggtcattaaggagcctgtttggctcagggtactccaaatccccagactctaatcgggtcacggggatttacgaactgtcactctgcaaaatgagcgacacaggaagtccaggcatgcaaagacggagaagaaaaatcctagacacttctgttgcatacgtaaggggggaagaaaacttggcaggatggcggccacgaggtgactctctcatcctcgagcatcagtgggaactcgagaagttagaattactgcacgaggtggagaagacccgacatttccttctcttgcgggaacgcttgggagatagcatacctaagtcactcagtgattccctcagtccttctctttccagcgggacgctcagcacgtctacatctatatcctcccagatctccaccaccaccttcgagtccgcaattactccttccgagtcatcgggatatgactcgggggacatagagtcactggtggatagagagaaagagctcgcaactaagtgcctgcagctgttaacccatacatttaatcgcgagtttagtcaggtccatgggtctgtgtcagattgtaaattgtctgacatttcccccattggtcgagaccccagcgaaagcagtttctcctcagcgacactgacaccctcttctacatgcccatccttggtagactcccggtccaattcgcttgatcagaagacaccagaggctaacagtcgagccagctccccgtgtcccgagttcgagcagtttcagatagtcccagccgttgagaccccatacctggctagagctggtaaaaacgaattcctgaacttagtgccagacattgaggaaattcgccctagcagtgtagtttcaaaaaagggctacctgcatttcaaagaaccgctgtacagcaattgggctaagcactttgttgtggttcgtcggccatatgtgttcatttataactccgacaaagatcctgtggagcgtgggattatcaatctgtccactgcccaggtagagtacagcgaggatcagcaggcaatggtgaagacacccaataccttcgccgtgtgtacaaaacaccgaggcgttctgctgcaggcactgaatgacaaagatatgaacgattggctgtacgcttttaaccccctgctggccggtaccatccgctccaagttgtcaaggagatgcccgagccagagtaagtatta

SEQ ID NO: 227824 - DNA, 3462 bp, Artificial Sequence
  Description of Artificial Sequence: Synthetic coding sequence
atgagtggagccagtgtcaaagtcgcggtccgcgtcagacccttcaacagtagagagacttctaaagaatcgaagtgcataattcagatgcaaggaaattctacctcaattatcaatcccaaaaatcccaaggaagcacccaagtctttcagcttcgattacagctactggtctcatacctccccggaggatccttgtttcgcttcccagaacagggtatacaacgacatcggaaaagagatgctactgcatgctttcgaggggtacaacgtgtgtatctttgcatacggtcagaccggcgcaggaaagagttacaccatgatgggcaaacaggaggagtctcaggccggaatcattccgcagttgtgcgaggagctgttcgagaaaatcaacgacaactgcaacgaagagatgtcatattctgtcgaggtctcatacatggagatctactgtgaaagagtgcgagacttgttaaaccctaaaaataaaggtaacctcagggtacgcgagcatccactgcttggtccttatgttgaagatttatcaaagctcgctgtgaccagctacaccgatatcgctgatttgatggatgcgggaaataaggcccgaacagtcgcagccaccaatatgaacgagacctcatctagatcccacgcagtgttcacaatagttttcacccaaaaaaaacacgacaacgagactaatctgagtaccgagaaggttagtaagataagtttggtggatcttgctggatccgagcgcgctgactcaaccggcgctaagggaacccgccttaaagaaggggctaacatcaataagtctctgaccacactcggtaaagtgattagcgcgctcgccgaggtgagcaagaaaaagaaaaagacggacttcatcccctaccgcgactcagtgcttacctggcttctgcgcgaaaacctcgggggaaatagtcgcacagctatggtggcagcactgagccccgcagacatcaactatgatgagacactgtcaaccttgagatatgcggatcgcgcaaagcagatcaaatgcaacgccgtgattaacgaggaccccaacgcaaaactggtaagggagttgaaggaggaagtgaccagattgaaagacctgctgcgggctcagggacttggagatattatagacacctccatggggagcctgacatcttctccttctagctgctcgctgtctagccaagtgggactgacaagcgtgacatccatacaggagaggattatgtccactcctggaggggaggaggctatcgagcgattgaaggaaagcgagaagattatcgcggagctgaacgaaacttgggaggagaaactccgcaaaaccgaggccattcgcatggagagagaagctttgctggccgagatgggagtcgctatccgggaagatggtggtaccttgggcgtgttcagtccaaaaaagacaccacacctggtgaatcttaacgaagatccactgatgtctgaatgcttgctgtactacattaaggatggcattaccagggttgggcaggccgacgccgaacgccgacaagacatcgtgctctctggagcccacattaaagaagaacactgcatattccggtccgagcggagcaactcgggagaggtgattgtcactctggaaccgtgcgaacgatcggagacctatgttaatggcaaaagagtcagccagcctgttcagctccggagtggcaaccggataataatgggcaagaatcatgtttttagattcaaccaccctgagcaggccagagccgaacgtgagaaaacgccatctgccgagacgcctagtgaacctgtcgactggacgtttgctcaacgggaacttcttgagaagcagggtattgacatgaagcaagagatggagaagaggctgcaagaaatggaaattctctacaaaaaggagaaggaggaggcagatctgctgttagagcaacagcgtttggacgctgactccgattcaggggatgactctgataagcgcagttgtgaagagtcttggaaactgatcacctcactgcgggagaagctgccccctagcaaactgcagaccatcgttaagaaatgcggcctccccagctcaggcaaaaagcgtgagcccataaagatgtatcaaattccccagcggcgacgcctgagtaaagactcaaagtgggtgactatcagtgacctgaaaattcaagcggtaaaagagatctgttatgaggtagctttaaatgatttccgtcatagccggcaggagatcgaggcgctggccattgtgaagatgaaggagctgtgcgcgatgtacggcaaaaaagaccccaatgaacgagattcttggcgcgctgtagctagagatgtgtgggatacggttggcgtcggagatgagaagatcgaggacgtgatggccacaggaaagggttctacagacgtcgacgaccttaaagttcacattgataagctggaggacatcctccaagaggtcaaaaagcagaacaatatgaaggacgaagaaattaaggtgctgcggaataagatgctcaagatggaaaaggttcttcctttaataggctcacaggagcagaagtccccgggaagccacaaggccaaggaaccggtaggagctggtgtctcttcaacctccgaaaataacgttagcaagggtgataacggtgaattggctaaagaagagagggtgagtcagctcatgaatggcgatcccgctttcagacgtgggaggcttaggtggatgagacaggagcagatcagatttaagaatctgcagcagcaggagatcacgaagcaactcagaaggcagaatgtgccccaccgctttatcccccctgaaaatcggaaacccaggtttcctttcaagtcaaatcccaagcaccgtaactcctggtccccgggaacgcatattataatcaccgaagacgaggtgatcgagcttagaatccccaaggatgacgaggcccgaaaaggaaacaaagaggagtcgcaggaaaaaggcggaaaaggggctttcaaagatccccagtttccatggggttcccaggggatgcggtctcaggaccatattcaggtaagcaagcagcacattaataaccagcagcagcctccccagctgagatggaggtccaactctctcaacaacgggcagcccaagtccactcggtgtcaggctagtgccagcgctgaaagcctcaactcccactctggccatccaaccgctgatgtccaaactttccaggccaaacgccacatccaccaacaccgtcagtcgtactgtaattacaacaccggtgggcagcttgagggtaacgccgcaacttcgtaccagaagcaaactgataagccgagccattgctcccagttcgttacgcccccacgcatgcggagacaattttccgccccaaatctaaaggccggacgggagacaacagtgtag

SEQ ID NO: 227825 - DNA, 2673 bp, Artificial Sequence
  Description of Artificial Sequence: Synthetic coding sequence
atgagccaaggcatcctgagcccacccgctggcctgctgagtgacgatgatgtagtcgtctctcccatgtttgagtcaacggcagctgacctgggatcagtggtgcggaaaaatctgctttcggactgttccgtggtaagcaccagtctggaggacaagcagcaggtacctagcgaagacagtatggaaaaggtaaaggtgtatctccgggtgagacctctcctgcccagcgagctggagcgccaggaagaccaaggatgtgtgcggattgagaacgttgagacattagtcctgcaggctcccaaggacagcttcgcactgaagtcgaacgagagaggaataggccaagccacacatcgcttcacattcagtcagatcttcggcccagaagtgggccaggcttccttcttcaacctgacagtgaaagagatggttaaggacgttttgaaggggcagaattggctgatttacacctatggagtaacgaattcaggaaagacgcacactatacagggaacaattaaggatggaggaatccttcctcgttcgctcgccctgatctttaactcattacaaggccagctccatcctacccctgacctgaagcctctcttgtcaaacgaagttatctggttagattcaaaacaaattcgacaggaggagatgaaaaagctttcattgctaaatgggggattgcaggaagaggaactgtcaacctctctgaaacgtagcgtgtatattgagtctcggattggaacatcgaccagctttgatagtgggatcgcagggttgtcctccatctcccagtgcacatcaagttcgcagttagacgagaccagtcatcggtgggctcaacccgatacagctccccttccagtgcccgcaaacatccgattttccatctggatttcttttttcgagatatataatgagctcctgtacgaccttcttgagcccccaagccagcagaggaaaaggcagactctgcggctttgcgaagaccagaacggaaatccatatgtcaaggacctgaattggattcatgtgcaagacgccgaggaggcctggaaactgcttaaagttggaagaaagaaccaaagttttgcctcaacacacctaaatcagaattccagccgttctcacagcattttctcgattaggatcttgcacctccagggcgagggcgacattgtccccaagattagcgaactttcactgtgcgacctggcaggtagtgaacgctgcaaagaccaaaaatcgggagaaaggctaaaggaagctggaaacatcaatacatcactgcatacactggggaggtgcatcgccgcacttcgacagaatcagcagaatcggagcaagcagaatctagtgcccttcagggactctaaacttacacgcgtatttcagggattttttacaggaagagggaggtcctgtatgattgttaacgtgaacccctgcgcctccacttatgacgagacattgcacgtcgctaagtttagtgcaattgcatctcagctggtacatgcgccacctatgcagttaggtttcccgtccctgcattccttcattaaggaacactcacttcaggtgtccccaagccttgagaagggagcaaaagcggacacaggattagatgatgacatcgagaacgaggcggatatcagcatgtatggcaaagaggagttactccaggtggttgaggctatgaaaaccctcctgctgaaggaacgccaggagaagctgcagctcgaaatgcacctgcgtgacgagatttgtaacgaaatggtcgagcagatgcaacagcgggagcagtggtgctctgagcacctcgatacccagaaagagctcctcgaggagatgtacgaggaaaagcttaacatacttaaagagagcttaacttctttctaccaggaagagatccaggaacgggacgagaaaatagaggaattggaggcactcctccaggaagcccgacagcagagtgtggcacaccagcagtctggtagtgagctggccttgagaagatctcagcggctggcagcctccgcgagcactcagcagctacaagaagtgaaggcaaagctgcagcaatgtaaggcagaacttaattctaccactgaggaactccataaataccaaaagatgctcgagcccccaccctcagccaaaccattcacgatcgatgtcgataaaaagctggaggagggacaaaaaaacatccggttgctgcgaactgaattgcagaagctgggcgagtcgcttcagtccgcggagcgggcatgttgtcatagtacgggggctggtaaacttcgacaggctctgaccacctgtgacgacatcctgatcaaacaagaccagacactcgccgaactccaaaataatatggtgcttgtaaagcttgacttgcggaagaaagcagcctgcattgccgagcagtaccataccgtgcttaagctgcaaggccaagtgtccgccaaaaaaagactcgggactaatcaggagaatcagcagcccaatcagcagccgccaggcaagaagcccttcctcaggaatctcctaccgaggacaccgacttgccagagttctactgattgttccccttatgcaagaatcctccgttcccgcaggagtcctctcctcaaatccggaccttttggcaagaagtactag

SEQ ID NO: 227826 - DNA, 678 bp, Artificial Sequence
  Description of Artificial Sequence: Synthetic coding sequence
atgtctcaaggcatactgagtcctcctgcgggactgctcagcgatgacgacgtcgtcgtcagtcccatgtttgaatccactgccgcagacctaggaagcgtcgttcgcaagaatctgttgtctgattgctccgtggtgagtaccagcctagaggataagcaacaggtcccttccgaagattccatggagaaggtgaaggtctacctccgcgtgcgccctctcctgcctagtgagttggaacgacaggaagatcaaggttgcgtgcgtatcgaaaatgttgagacccttgtccttcaggccccaaaggacagcttcgcattgaagtcaaacgaaagagggattggccaggccacccacaggttcaccttttcacagatttttggtccagaggttggtcaagcttcgttcttcaaccttaccgttaaggaaatggtcaaggacgtcctgaaaggacagaactggctgatctacacctatggcgtgacaaacagcggcaaaacccacaccatccaggggactattaaggacggtgggatcctgccacgaagcttagccctgattttcaattctctgcagggtcagctccacccaacccccgatctaaagccactgctcagcaatgaggtcatctggttggactcaaagcagattagacaagaagagatgaagaagttatag

SEQ ID NO: 227827 - DNA, 2619 bp, Artificial Sequence
  Description of Artificial Sequence: Synthetic coding sequence
atgagccaaggtatcttatccccccctgcaggcctgttgtctgacgacgacgttgtggtgtcacctatgtttgagagtactgctgcagacctcgggtcggtggtcaggaagaatctcttaagcgactgctccgttgttagtaccagcctggaagataagcagcaagttccatctgaggactctatggaaaaagaagaccaaggttgcgtacgaatagaaaatgtggagacacttgttttgcaggcacccaaggattcttttgccttgaagtccaatgaacgaggtattgggcaagctacacaccgttttacattttcacagattttcggtccagaggtcggccaggcctcattcttcaacctgactgtgaaggagatggtcaaagacgtactaaaaggccagaattggttaatatacacgtacggggtgacgaattctgggaaaacccatacaatccagggaaccatcaaggatggcggtatcttaccaagatcgctggccctcatcttcaactctctgcagggccagctgcacccaaccccagacctgaagccactgctgtccaacgaggtgatttggctagattctaagcagatccgtcaagaagaaatgaaaaaactcagtctgttgaatgggggactccaggaggaggagctgtctacaagcttgaaacggtccgtgtacatcgagagccggatcggcacgagcacgagcttcgacagcggcatcgccggtctttcctccatttcacagtgcacctcaagctcccagttggacgagacttctcaccgctgggcacagcctgatactgctcccctcccagtgcccgctaacatccgtttttctatttggattagcttttttgaaatctataatgaactcttatacgacctgctagaacccccttcccagcagcgaaaaaggcaaacactgcgactatgcgaagatcagaatggcaatccgtacgtaaaggacctgaactggatccacgtgcaggacgcggaagaggcgtggaagctgttaaaggtggggagaaagaatcagagctttgcatctacccatctgaatcagaacagtagccgatcccactccattttttcaatccgcatacttcatctgcagggggaaggcgacattgttcctaagatttctgagctgtccttgtgcgatttggcgggatccgagcggtgcaaggatcagaagagtggagagaggttgaaagaggcaggcaacattaataccagtttacacaccctggggcgttgtattgcagctcttagacagaaccagcagaatcggtccaaacaaaacctggtaccatttcgcgactctaagctaacccgtgtcttccagggcttctttaccgggagaggacggagctgcatgatcgttaacgtgaacccatgtgcctcaacctatgatgagacattacatgtcgcaaagttctcggctatcgcctctcagctggtgcatgctccccctatgcagttaggatttccatccctacattcttttataaaggagcactccctgcaagtgagtcccagcttggagaagggggctaaggctgataccggacttgacgatgacatcgaaaatgaagcggatatttccatgtacgggaaggaggagcttcttcaagtcgtcgaggctatgaaaactctgcttctgaaagaacgccaggaaaagctccagctcgagatgcacttgcgagatgaaatttgtaacgagatggttgagcagatgcagcagcgggaacagtggtgcagcgagcacttggacacacaaaaggagctactcgaggagatgtacgaagaaaaactcaatattctgaaagaatcacttacatccttttaccaggaagaaatacaggagcgagacgagaagatcgaggagttagaagcactgctgcaggaagcacgccagcagagcgtggcgcatcagcagagtggttcagagctcgccctgcggaggtcacagcgcctggctgcatcggctagtactcagcaactccaggaagttaaggcaaaattgcagcagtgcaaagccgagctgaactcaactacggaggagcttcataagtatcagaaaatgttggagcccccaccgagcgcgaagcctttcacgatcgacgttgataagaagctggaagaaggacaaaagaatatccgcttactgcgtaccgagcttcagaaacttggcgagagtctgcaaagtgccgaaagagcctgttgtcacagtaccggagcagggaaactcaggcaagctcttacaacgtgtgacgacattcttataaagcaggatcagaccttggccgaattacaaaataatatggtgctcgtcaagctggatctgcggaagaaggcggcttgtatcgccgagcagtaccataccgtgctcaaactccagggccaggtgagtgccaaaaagcgtctaggaacaaatcaggagaatcaacagccgaatcagcagcctcccggtaaaaaaccgtttttacgtaacctccttccgagaacacctacatgccagagcagcaccgattgctccccatacgcgcgaatactgaggagtcgcaggtctccactactgaagagtggtccctttggcaaaaagtattag

SEQ ID NO: 227828 - DNA, 480 bp, Artificial Sequence
  Description of Artificial Sequence: Synthetic coding sequence
atgtcacaaggcatcctgtcaccgcctgccggtctactgtcagatgacgacgtagtagtgagtcctatgtttgagtccaccgctgccgacctgggtagcgtcgtgagaaaaaacctcttgagcgattgctcagtagtgagcacttctcttgaggataagcagcaggtgcctagcgaggacagtatggagaaggtaaaggtgtaccttcgggtgagacctttactgcctagcgagctcgagcggcaggaagaccagggttgtgtgcggatcgagaacgtggagaccctggtgctccaggcacctaaggactccttcgcgttgaaatccaacgagagagggatcggacaggcgacacatagatttacatttagtcagatctttggacctgaagtcggacaggcaagcttctttaatctgactgttaaggagatggttaaggacgtgctgaaagggcagaattggctaatatacacttattag

SEQ ID NO: 227829 - DNA, 4884 bp, Artificial Sequence
  Description of Artificial Sequence: Synthetic coding sequence
atgctcggtgcccctgacgagtcctcagtccgcgtggctgtcaggattagacctcaattggcaaaagaaaagattgaaggctgtcatatctgcacgtcagtgacccccggagagccccaggttttcctgggcaaagacaaggccttcacatttgattatgtgtttgacattgatagtcagcaagagcagatctatatccagtgcatcgagaaactgatagaggggtgcttcgagggatataatgccactgtgtttgcctatggtcaaactggcgctgggaaaacctataccatgggaacagggtttgacgtgaatatcgtggaggaagagctaggcatcatttcacgagctgtcaagcaccttttcaaatccattgaagaaaaaaaacacatcgccatcaagaatggactccccgctcctgacttcaaggtgaatgctcagttcctcgagctgtacaatgaggaggtcttggacttgtttgacaccaccagagatattgatgctaagtctaaaaagtccaacattcggatccatgaggactccaccggaggaatctacactgtgggcgtcacgacccgtaccgttaatacggaatcggagatgatgcagtgcctgaaactgggcgcactgtctaggacgacagcctcaacccagatgaacgtgcaatccagcagatcccacgcgattttcactattcacgtgtgtcagacgcgtgtgtgccctcaaatagatgccgataatgcgacggataacaaaatcatttcagagagcgctcaaatgaacgagttcgagaccctcaccgcaaagtttcattttgtggacctcgctggcagcgaacgccttaagcgcactggggcaacaggggagagggccaaggagggcatcagcatcaactgcgggctgctcgcccttggtaacgttatcagcgcgctaggcgataagagcaagagggccacccacgtaccttatcgagacagcaagcttaccaggctactgcaagattccctgggtggaaactcccaaactataatgattgcatgcgtcagtccgtcagaccgagactttatggagactttgaacacgcttaaatacgccaacagagccaggaatattaaaaacaaagtgatggtgaatcaggatagagccagccagcaaattaatgccctgcggtcagagataaccagattacagatggaactcatggaatacaagactgggaagcgcataattgatgaggagggggtagaatcaatcaatgatatgttccacgagaatgctatgcttcagaccgaaaacaacaacctgcgggtgcggatcaaggccatgcaagaaaccgttgatgcactgcggtccaggataacacagcttgtttccgatcaagccaatcatgtccttgccagggcaggcgaaggaaacgaggaaatttccaatatgatccactcctatatcaaggaaatagaagatctcagggccaagttgctggagtcggaagccgtaaatgaaaatctgagaaagaacctgaccagagctaccgcgagagccccttactttagcggctccagcacgttctcgccaaccattttatcctcagacaaggaaaccatcgagattatagatctggccaagaaggatctggagaagctcaagcgaaaggagaaacggaagaagaagcgcttgcaaaaactagaggaatctaacagggaagagagatccgtcgcaggtaaagaggacaacacagatacagaccaggagaagaaagaggaaaagggagtaagcgaaagggagaataacgagctcgaggtggaagagagtcaggaggtatccgaccatgaagatgaagaagaagaggaagaggaagaggaggacgacattgatggtggcgaatcaagcgatgagtcagattccgaaagcgacgagaaggcgaattatcaagccgaccttgctaacattacctgtgagatcgcgattaaacaaaaactgatagatgagcttgagaatagccagaagaggctgcaaaccctgaagaagcagtatgaagagaagctcatgatgctgcagcataaaattcgagacactcagttagagagggatcaagtgctccagaatctgggatccgtggagtcgtattccgaagaaaaggccaaaaaggttagaagcgaatatgagaaaaagctccaggctatgaacaaagaattacagaggttgcaggccgctcaaaaagagcatgccagactactaaaaaaccagtcccagtacgagaaacagttgaagaagctccagcaggatgtgatggagatgaaaaagactaaggttcgtcttatgaagcaaatgaaggaggaacaagagaaggcacgactgaccgagagccgcaggaatcgagaaattgctcaactgaaaaaagatcagcggaaacgcgatcaccagctgagactgctggaggctcagaaacgcaatcaggaggtggtgctccgaagaaaaacagaggaggtgacggccctgaggaggcaggtccgtcctatgtctgataaagttgccggaaaggtgactcggaaactcagttcaagcgacgcccctgcccaggacacaggctcatccgccgcagcagtggagacggacgcctctcgaacaggcgctcaacaaaaaatgcgaattcccgttgcaagagtgcaagccttgcccacaccagcaactaatgggaaccgtaagaaataccagagaaagggtttaacgggaagagtgttcatatcaaagacagctcggatgaagtggcagctgctggagaggagagttactgacattataatgcagaagatgactattagtaatatggaagccgatatgaatagactgctcaagcagcgagaggagctgactaaaaggagggagaagttgtccaaacggcgtgagaaaattgtgaaagagaacggagagggcgacaaaaacgtggccaacataaatgaggagatggaaagcttgaccgcaaacattgactatataaacgactctatctctgattgccaggccaacataatgcaaatggaagaggctaaagaggaaggggaaacgctggatgtaacagccgtgattaacgcatgcaccctgactgaggcacgctatctgctcgatcattttctgtccatgggaattaataaaggtctccaggccgctcagaaagaggcacagatcaaggttctcgaaggcaggctgaaacaaactgagattacatcggcaacacaaaaccaattactgttccacatgctgaaagaaaaggccgagctgaacccggagctcgacgccttgcttgggcatgcactccaggattttaaacactttttcgtggagaatgtagaagatagcactgatgaggatgcaccccttaacagtcccggtagcgagggttcgacccttagttccgacctcatgaagctttgcggtgaggtgaaacctaaaaacaaggcacggagacggactacaactcagatggagctgttatatgcggactccagtgagcttgcatctgacactagcaccggtgacgcatctctgcccggacctctgactcccgtggctgaggggcaggaaatcggtatgaacactgaaactagcggaacatcggcacgtgagaaggaattgagccctccgccaggcctgccctctaagatcgggtcaatctctcgccagagttccctaagtgaaaaaaagatccccgagccctcccccgtcaccaggcgcaaggcatatgagaaagccgaaaaaagcaaagcaaaggagcagaaacaatctgatgagagcgactcttccctgtcggaggtgcaccgcggaatcattaaccccttccccgcttccaaggggatccgcgcatttcctctacagtgcatccacatcgccgaggggcatactaaggcagtgctgtgcgtggattcaacagatgatctcttgttcacggggtctaaagatagaacttgcaaagtttggaatttggttactggccaggagatcatgtccttgggcggacatccgaataacgtggtctcagttaaatactgtaactacacttccttagtctttaccgtttcaacctcctatatcaaggtatgggacatccgcgatagcgcaaaatgcataagaaccctcacaagctcgggtcaggtaacattaggagacgcttgttccgcttccacctccaggaccgtggccatcccgtccggagaaaatcagatcaaccagattgccttaaaccccacaggcacgttcctatatgccgctagcggaaatgcagtgaggatgtgggatctaaaaaggtttcagagcacaggcaaactaaccggacatctcggccctgtcatgtgcttaaccgtagaccagatttcctctggacaggacctgataatcacaggcagcaaagaccactacatcaaaatgttcgatgtgaccgagggggctctcggaaccgtgagccctactcacaacttcgaaccaccccactacgatggaattgaagccttgaccatccaaggagacaatctcttcagtggtagtcgcgacaatgggattaagaaatgggacttaactcagaaggacctcctgcagcaagtcccaaatgcccacaaggactgggtgtgcgctctgggcgtcgtccccgaccatcctgtgctgctgagcggatgtcgcggaggaattttgaaggtgtggaacatggacacatttatgccggtgggagaaatgaaagggcacgattcacctatcaacgctatttgtgttaactctacccacatattcacagcagcggacgatcggaccgtcagaatctggaaagcccgtaatctacaggacggacagatttctgacacaggagatcttggagaggatatcgcctctaattag

SEQ ID NO: 227830 - DNA, 5025 bp, Artificial Sequence
  Description of Artificial Sequence: Synthetic coding sequence
atgttgggagctccagacgaatcctcggttagagtcgcggtcaggattcggccacagctggctaaggagaagatcgaaggctgtcatatctgcacctctgtgacgcccggagaaccccaggttttcctggggaaagataaagcatttacattcgactacgtgtttgatatagattcacagcaggaacagatctatatacaatgcatcgaaaagcttattgagggctgcttcgagggctacaacgcaactgtcttcgcttatggacagaccggagcgggtaaaacttacaccatggggacaggctttgacgtcaacatcgtggaggaggaattgggtattatttctagggctgtgaagcatctgttcaagagcatcgaagagaagaagcatatcgcgattaaaaatggactccccgctcctgatttcaaggtgaacgcccaatttttagagctttataacgaagaggttctggatctcttcgacaccacccgggacatcgatgcaaagtccaaaaaaagcaatatccggatccatgaggattccaccggcggaatttacacggttggcgtgacaacacgaacggttaatactgaatcagagatgatgcagtgtctgaagcttggagctctgagcaggacaaccgcgagtacgcaaatgaacgttcagtcatcacggagccatgcaatctttactattcacgtctgtcagactagggtctgtcctcagattgatgcagacaacgccacggataacaagatcattagtgagagtgcacaaatgaacgagtttgagaccctgacagcaaaatttcacttcgtagacctcgcagggagcgaacgcctgaagcgcaccggcgctacaggcgagagggctaaagaaggaatcagtattaactgcggcctgctggctctgggaaacgtaattagcgctttaggcgataagtctaaaagggcaacccacgtaccatatcgtgacagcaagttaactagattactgcaggattccctgggtggaaactcccagactatcatgattgcgtgtgtcagtccttcagaccgtgattttatggagaccctcaatactttgaagtatgccaatagggcgagaaacattaaaaataaagtcatggtgaatcaggatagagcttcgcagcagatcaacgccctgcgcagcgagattacgaggctgcagatggagctcatggaatataaaaccgggaagcgaattattgacgaagaaggtgtcgaatcaatcaacgacatgtttcatgaaaacgcgatgctgcagaccgagaataataacctccgcgtcaggatcaaggctatgcaggagacagtagatgcgttacgatcaagaattacacaactggtgagtgatcaggcgaatcacgtactggctcgcgcaggcgagggcaatgaagaaatcagtaacatgatccactcatatattaaggagatagaggacctgcgtgcaaagctgttggaatccgaggccgtgaacgagaatctgagaaagaacctgacccgtgcaacagcacgagccccttacttttcaggaagtagcactttctcaccaactattctttctagtgacaaagagacgattgagattatagatctggccaaaaaagacttagagaagctgaagcgcaaagaaaaacggaaaaaaaagcgactgcagaaactggaggagagtaatcgcgaggagcgaagcgtcgccggtaaagaagacaacaccgatactgatcaggagaagaaggaggaaaagggagttagcgaaagggagaataacgaactcgaggttgaggaatcccaggaggtgagcgatcacgaggacgaagaggaggaggaagaagaggaggaagacgatatagatggtggagaaagcagcgatgaaagcgacagtgagagtgatgaaaaggccaactaccaggctgacctggctaatattacctgtgaaatcgctattaaacagaagttaatcgacgaactcgaaaattcacaaaagaggctccagaccctcaagaagcagtacgaggagaagctgatgatgttgcaacataaaatcagagacactcagctggagcgcgaccaggtgctgcagaacctaggatctgttgaaagctactctgaagaaaaggccaaaaaggttcgttccgaatacgagaagaaacttcaggctatgaacaaagaactgcaaaggctgcaggccgcacaaaaagagcatgctcggttgctgaagaatcagagccagtacgagaagcagctgaaaaagttacaacaagatgttatggagatgaaaaaaacaaaggttagactgatgaaacagatgaaggaggaacaggagaaagctcggcttaccgagtcgcgcagaaatagggagatagctcagcttaagaaggatcagaggaagagggaccaccagctcagactcctcgaagcacagaaaagaaaccaggaggtcgttttacgtcgtaaaacggaagaagtcacggccctgagaaggcaggtgcggcctatgtcggataaggtagcaggaaaagtaactcggaagctttcctcatccgacgctcctgcccaggacacaggtagcagcgccgcagcagttgagaccgatgcttcccgtactggagcacaacaaaaaatgcgcatccccgtggccagagtgcaggccctgccgacccctgcgacaaatggaaaccgtaagaagtatcagagaaagggtctgacaggccgagtatttatctccaaaacagctcgaatgaagtggcagctgctggaacgcagggtgaccgacataataatgcagaaaatgacgatcagcaatatggaggctgatatgaatcggctactaaagcaacgcgaagagctgaccaaaagacgagagaagctgtccaagcgtcgtgagaaaatagtgaaggagaacggtgagggcgacaaaaacgttgccaacatcaacgaggagatggaatccttgacagctaacatcgattatatcaatgacagcatttcagactgtcaggctaacatcatgcagatggaggaggccaaagaggagggcgagacacttgatgtgactgccgtaataaatgcctgtactctgaccgaggcacggtatctcctggaccactttttgtcaatgggtataaataagggcctccaggccgctcaaaaggaggctcagattaaggtccttgagggccgacttaagcaaactgagatcacgagcgccactcagaaccagctgcttttccacatgttaaaggaaaaggcagagctgaatccggaactggatgcgctgctgggccatgccctgcaggatctggactcagttccactggaaaacgtggaggattctacggacgaggatgctcctcttaattctcccggatctgaaggatcaacacttagttccgacttaatgaagctctgtggagaggtaaagcctaagaacaaggcgaggcggagaacaacgactcagatggaactcttgtacgcggattcttccgaattagcctctgatacatccactggagatgctagtctgcccggaccactgacacccgtcgcagaggggcaggagattggaatgaacactgaaacctccggtacaagtgcgcgagaaaaggagttgtctcctccaccagggttgcccagtaaaattggtagtatttcccgccagtcctccctctccgaaaagaagattcctgaaccctccccagtcacccgcaggaaggcctacgagaaagccgaaaagtccaaagctaaggaacagaagcactctgattcaggaacctctgaggcatctctgagccccccaagttctcctcccagtaggccacggaacgaacttaacgtttttaaccgattgaccgtcagtcagggaaatacttcggtccagcaggacaagtccgatgagagcgattcctctctgtctgaggtgcataggtcctccaggaggggtattatcaatccctttccggctagtaaagggataagggcttttcctttacagtgcatccacatcgctgaaggccacaccaaggcagtgctgtgcgtcgactcaactgacgatctgctgtttactggatccaaggataggacgtgcaaggtgtggaacctggtgacaggccaggaaataatgtctctaggtggtcacccaaataacgtggtatccgtcaaatactgcaattacacatcattagtgttcaccgtgagcacctcctatattaaggtgtgggacattcgagacagtgcgaaatgcatccggacactcacgtcaagtggtcaggtgactttgggcgacgcttgcagcgcatctaccagcaggaccgtcgctattcctagcggagagaaccagatcaaccaaattgctctcaatcctacaggcacctttctgtacgcagcctctggaaacgccgttcgaatgtgggacctcaaacggttccagagtactggcaaactgactggtcaccttgggcctgtgatgtgcctgactgttgatcagatcagcagcggtcaggacttgataattactggaagcaaggatcactatattaagatgtttgacgtgaccgagggagcacttggtactgttagccctacacataactttgaaccaccccattatgatgggattgaggctctcactatccagggtgataacctgttctctggaagccgcgataacggaataaagaaatgggatctgacccagaaggaccttttacaacaagttccaaacgctcataaagactgggtgtgcgctctgggcgtcgtgcccgatcaccccgtgttgttatcagggtgcagaggcggtatccttaaggtctggaatatggacacatttatgccagtgggggaaatgaaggggcatgactcccccataaatgccatttgtgtaaatagtactcacatatttactgccgcagatgatcggacagtccggatttggaaagccagaaatctccaggatggccagatttccgatactggggatctgggggaggacatcgccagcaactag

SEQ ID NO: 227831 - DNA, 4985 bp, Artificial Sequence
  Description of Artificial Sequence: Synthetic coding sequence
atgctgggagccccagatgagagctctgttagggtcgcagtccgcattcggcctcagctggccaaagaaaagatcgaagggtgccatatttgcaccagcgtcaccccgggtgaaccccaagtgtttttgggaaaggataaggcctttactttcgactacgtgtttgacatcgattcacagcaggagcagatatacattcagtgtatcgaaaaacttatagaggggtgcttcgaaggttacaacgctaccgtcttcgcctacggacagacaggcgctggaaagacctatacaatgggtaccgggtttgacgtgaatattgtggaagaagaattggggatcatctcacgcgcagtgaagcacctctttaagtccattgaggagaaaaaacatattgccatcaagaatggccttcctgcgccagactttaaagtaaacgcgcagttcctagagctgtacaacgaggaggtcttggacctgtttgataccactagggacatcgatgcaaaaagcaagaagtcgaatatcagaattcacgaggactccactggaggaatttacaccgtcggagtcacgactaggacagtgaacacagagtctgaaatgatgcaatgcctcaagctgggggcactctctcgaaccactgcatcgacacagatgaacgtgcagagttctcgctctcacgctatctttactattcacgtgtgtcagacacgggtttgccctcagattgacgctgataacgcaaccgataataagattatttctgaaagcgcacagatgaatgaattcgaaacattgactgctaagtttcatttcgtcgatctagccggaagcgaacgactgaagagaactggagccactggcgagcgggctaaagaggggattagcatcaactgcggcttgctggccctgggaaacgtcatatccgccctcggagacaaatctaaacgtgccacccacgtgccttatcgagatagcaaactgacacggttgttgcaggacagtctcggtggcaacagccagacaatcatgattgcctgcgtctccccttccgacagggacttcatggagacactcaatacgctgaagtatgctaaccgcgcacgcaacattaagaataaggttatggtgaaccaggaccgggcttcccagcagataaatgctctccggtctgaaattactcgcctccaaatggaactgatggagtataagactggcaagcgaatcatcgacgaagagggcgttgaatcaattaacgatatgtttcatgagaacgccatgctgcaaacagaaaacaataacctgcgagtgaggattaaggcaatgcaggagaccgtggacgcccttcggagtagaatcacacaattagtaagtgaccaagcaaaccacgtgctggcacgcgcaggcgagggaaatgaagagatctcaaacatgattcatagttacatcaaagagatcgaagacctcagagccaaattattagagtcagaagccgtcaacgagaacttgcgcaagaacctgacaagggcaacagccagggcaccctatttctcaggaagtagcacattctctccaactattctcagtagcgataaggagacaatagaaatcatcgatcttgccaaaaaggatctggagaaactgaagcggaaggagaagcgtaagaagaagtctgtggctggtaaggaggataacacagataccgatcaggagaaaaaggaggaaaagggtgtttcagagcgcgaaaataatgagctggaggtggaagaaagtcaggaggtgtctgaccacgaggacgaggaggaagaggaggaagaggaggaagacgacatagacggaggtgaatcttctgatgagagcgacagtgaatccgacgaaaaggctaactatcaggcagatctcgctaatatcacatgtgaaatcgctattaagcaaaagctgatagatgaactggagaactctcagaaacgcctgcagacactcaagaagcagtacgaggagaagctgatgatgttgcaacataaaatccgggatacgcagctcgaacgcgaccaagtgttgcaaaaccttggaagcgtggagtcatactcagaggagaaggccaaaaaagtgaggagcgagtacgaaaagaagcttcaagccatgaataaagaattacagaggttgcaggccgctcagaaggagcatgccaggctgctgaagaaccagtcccagtacgagaagcagcttaagaagctccagcaggatgtgatggaaatgaaaaagacaaaggtgagattgatgaaacaaatgaaagaggagcaggagaaggccaggctcacagaatcacggaggaaccgcgaaatagctcagctcaagaaagatcaacgtaaacgtgatcatcaactgcgtctgctggaagcccagaagcgaaatcaggaagtcgtgctcagacggaaaactgaagaagtgactgcattacgaaggcaggtacggcctatgtccgataaagtcgccggtaaagtgacgcggaagctgtcgagtagtgacgcgccagcccaagacacgggcagcagtgctgcggctgtcgagaccgatgcgtccagaacaggcgctcagcaaaagatgcgtatcccagtggcacgggtgcaagccctacccactccagccaccaacgggaacaggaagaagtatcagagaaaaggactgaccggtagagtgttcatctctaaaacagctcggatgaaatggcagcttctggagcggagagtgaccgacattataatgcaaaaaatgacgataagtaacatggaagccgatatgaaccggctcctgaagcagcgcgaagagttaaccaagcgtagggagaaactgtcaaagcgcagggaaaaaatagtgaaggagaacggtgagggcgacaaaaatgttgctaacatcaacgaggaaatggagtcactgactgcgaacatcgattacataaacgactccatcagcgattgtcaggctaacatcatgcagatggaggaagccaaagaagagggcgagacactggatgtgacagctgtgataaatgcgtgtactctgactgaggccagatatctgctggaccacttcctctctatgggaattaacaagggcctccaggctgcccagaaagaggcccagatcaaggtgctcgagggacggctgaaacagactgaaattacgtctgctacccaaaatcaactcttgttccacatgctgaaagagaaagccgaactaaatccagagctcgatgctctgctggggcacgctttacaagacctggatagcgtgccactggaaaacgtggaagattcaaccgatgaagatgccccattaaactcccctggatccgaagggtcgaccttaagctcggacctcatgaaactgtgcggcgaggttaagcctaagaataaggcccgacggaggactacgacgcagatggaattgctttacgccgacagtagtgagctggcgtctgacacgagcacaggagacgcatctcttccgggtccattgactccagttgcagagggccaggagataggaatgaatacagagacaagtgggacgtctgctcgggaaaaggaattgagccctcccccaggtcttcccagtaaaatcggatcaatcagtaggcagagctccctgtccgaaaaaaagatcccggaaccttcccccgtgacccggagaaaggcctatgagaaagctgaaaaaagtaaagctaaagaacagaaacactctgactctgggaccagcgaggccagcctgtcacccccatccagccctcccagccgccctaggaatgaattaaatgttttcaacaggttaacagtgtctcaaggcaacactagtgtgcagcaagacaagtcagacgagagtgactcgtccctcagcgaggttcatcgttccagtcgcaggggcataatcaatccgtttcccgctagcaaaggcattagagcctttccgctgcagtgtatccacattgctgaaggccacaccaaagcagtcctgtgtgtggactcaaccgacgatctactctttaccggcagtaaagatagaacttgtaaggtctggaacctggttacaggccaggagataatgtcgctgggaggccaccctaacaatgtggtgtctgttaagtactgtaattacacaagccttgtgttcactgtttccacctcctacattaaggtttgggatattcgggactccgctaagtgcattcgtactctgacttcttccggacaggtcacattgggggacgcctgttctgccagcacatccagaactgttgccattccctccggagagaaccaaatcaaccaaattgccttaaaccctaccggcactttcctgtatgccgcaagcggtaacgctgtgagaatgtgggatctgaagcgcttccagagcactggcaagttaacaggccatcttggcccagttatgtgcctaaccgtcgaccagatcagctcagggcaggacctgatcatcacaggctccaaagatcattatattaaaatgttcgacgtgactgagggagcacttggaacagtgagtcccacccataactttgagccaccacactatgatgggatcgaagcgctcactatccagggtgataatctcttctctggctcaagagataatggaatcaagaaatgggatctcacacaaaaagacctcctgcaacaggtccccaacgcgcacaaagattgggtttgcgctttgggagtcgtgccggaccacccagtactgctgagcggatgtcgtggagggatcttgaaggtgtggaatatggatacgtttatgccggtaggtgaaatgaaaggccacgattcccccattaatgccatctgtgtcaactccacacatatcttcactgccgctgacgatcgaacagtcagaatttggaaggcgcgaaaccttcaggacggccaaatctcagacacaggggatttaggagaggacattgccagtaacta

SEQ ID NO: 227832 - DNA, 5027 bp, Artificial Sequence
  Description of Artificial Sequence: Synthetic coding sequence
atgctgggcgcaccagatgagtcttctgtgcgggtagcggtgagaattcgcccacagcttgccaaggagaagattgagggctgtcatatatgtacctcggtgacccctggggagccacaggtgtttcttggtaaagataaagcatttacgttcgactatgtgttcgacatcgactctcagcaggagcagatctacatccagtgtattgagaaactcattgagggatgctttgagggatacaacgccacagtttttgcctacgggcagaccggtgccggtaagacctacaccatgggaaccgggttcgatgtgaatattgtggaagaagagctgggtatcatctcccgtgccgtgaagcacctctttaagagcatcgaggagaaaaaacatatcgccatcaagaatgggctgcccgctcccgactttaaagtcaacgcccagtttttggagttgtacaatgaggaggttctggatctgtttgatacaacaagggacatagacgcgaaaagtaaaaagtcaaatatacggatccacgaggattctactgggggtatctataccgtgggcgttacgacgcgaactgttaatacagaaagcgagatgatgcagtgcttgaagttaggggctctttctagaaccactgcttccacgcaaatgaatgttcaatccagtcgatcccatgccattttcacgatacacgtgtgccaaactcgggtttgtcctcagatcgacgcagacaatgcaaccgacaataaaataatatccgaaagcgcacagatgaacgagtttgaaacactcaccgctaagttccatttcgtggatctagctggcagcgaacggctgaaaaggacaggtgctaccggcgagagagctaaagaaggaatctcgatcaactgcgggttgctggccctgggtaatgtgataagcgcactaggggataagagtaaaagggccacacatgtcccatacagggactccaaacttacgcgtctcctccaagactctcttgggggtaattcccaaaccatcatgatcgcttgcgtcagcccctccgatagagactttatggaaactttgaatactctgaagtatgcgaaccgtgccaggaatattaagaataaggtgatggtgaatcaggacagagcatcccagcaaataaatgccttgcggtctgagataacaagactgcaaatggaactcatggaatataagaccgggaagcgcattatcgatgaggaaggtgtggagtccataaatgacatgttccacgaaaacgctatgctacagacagaaaacaacaatctgcgggtgagaataaaagcaatgcaggagactgtcgatgctctgagatcaaggatcactcaactggtgtcggatcaagctaaccatgtgttggccagggcgggtgagggtaacgaggagatctccaacatgatacatagttacatcaaggagattgaagatttgagggccaagttgcttgagagtgaggccgtcaatgagaacctgcggaagaacctgactagggccactgctcgtgcaccttatttctctggtagtagtacattctcaccgaccatactatcatcagataaggagaccattgagatcattgacttggcgaaaaaggacctcgagaagctgaaacgaaaagagaagaggaagaagaaacggctgcagaaactggaggaaagcaatagggaggagcggagcgtggcagggaaggaggataatacagacaccgatcaagagaaaaaagaagaaaaaggcgtttctgaacgtgagaataacgaacttgaggtcgaagagtcccaagaggtgtcggaccacgaagacgaggaagaggaggaggaagaagaggaggatgatatcgatggcggagaaagttcggatgagtctgattcggaatccgacgagaaggctaactatcaggcagatctcgccaacatcacctgcgagatcgccatcaagcaaaagctcatagacgagctggagaatagtcagaaacgcctccagacgctcaaaaagcagtacgaggaaaaactgatgatgctgcaacacaaaatacgggatacccagttggaaagagatcaggttctacagaacctgggctcggtcgagtcatattctgaagagaaagccaaaaaagtgcgctccgagtacgaaaagaagctccaggccatgaataaagagttgcagagactgcaagcagcacagaaggaacacgcgaggctgctgaagaatcagtctcaatacgaaaaacagttgaagaagttgcagcaggatgtgatggaaatgaaaaaaaccaaagtccgtttgatgaaacagatgaaagaggaacaggaaaaagccaggcttacagagtccagacggaatcgagagattgcacagctcaagaaggaccagcgtaaacgcgatcatcagctcaggctgctagaggctcaaaagcgcaaccaagaagtagtcttgcggagaaagacggaggaggtgaccgcactgagacggcaggtgaggccgatgtccgataaagtcgccggaaaagtcacgaggaagctgagttcttccgacgcccctgctcaggacactggcagctccgctgctgcagtggaaaccgatgctagccggacaggcgctcagcaaaagatgaggatcccggtggccagagtgcaggccctgccaacaccagccaccaatggcaacaggaagaagtatcagagaaaaggcctcaccggcagggtgtttatcagtaagaccgccaggatgaaatggcagctcctagagcgtcgcgtaaccgatattataatgcagaagatgaccatcagcaacatggaagctgacatgaaccgcctcttgaaacagcgcgaagagttgactaaaagacgcgagaaactgagtaaacggagggagaagatagttaaggagaacggcgagggggataaaaacgtggccaatataaacgaggagatggagtcattgacagcgaatattgattacatcaatgattcaatctccgactgtcaggccaacatcatgcagatggaggaggccaaagaagaaggcgaaacactggatgttacagccgtgatcaatgcttgcaccctcacagaagccaggtatctactcgaccacttcctgagtatggggattaataaaggcctgcaagcagcgcagaaagaagcccagattaaggtgctcgagggacggttaaagcagactgagatcactagcgcgactcagaatcagctactctttcatatgctgaaagagaaggcggaacttaacccagagcttgacgcactgctcggccacgctttgcaggatttcaagcatttttttgtggagaacgttgaagactcgactgacgaagatgcacctctgaacagtcccggatctgaggggagcaccctctcatcggatttaatgaagctatgtggtgaagtgaagcctaagaataaggccagacgccgaactaccactcagatggaactcctgtatgcagattcttcagagttggcgtctgatacaagtactggggacgcgtcacttcctggccctctcaccccagttgcggaaggacaagaaattggcatgaacacagaaacgtcaggaaccagtgccagagagaaggaactgtctcccccacccggacttccatcaaagattggctctatctcaaggcaaagttccttgtccgagaagaaaatcccagagccgtcccccgttacaagacgtaaggcctacgagaaggcggagaagagcaaggcgaaggagcagaaacattcagactcggggactagcgaagcaagcttatcccctccttcctctcccccaagcagacccagaaatgagttaaatgtgttcaatagactgacagtgagccagggcaacacttcagtgcagcaggataaaagcgatgaatcagactcatccctcagcgaagtacaccgcaactcaaatctaaggggtatcattaatcccttcccggcatcaaaggggatccgggctttccctctccagtgcattcacatagcggaaggtcacacaaaggccgtgctgtgtgtggactcaaccgacgatctgcttttcacggggtccaaagataggacatgcaaagtttggaatctggtcactggccaggagattatgagcctcggcggacaccctaacaacgtggtgagtgtaaagtattgtaactacacaagtttggtgtttacggtgagtacatcctacatcaaggtgtgggacattagagacagcgctaaatgtatccgtaccctcacttcatccggacaggtcacgctgggtgatgcctgttccgcttctacctcgcggaccgtagcgatcccttctggggagaatcaaattaaccagatcgccttaaacccgaccggtacattcctctatgccgctagtggaaacgctgtccgcatgtgggatttaaagaggttccagtccacaggaaaactaacaggacaccttggcccagtcatgtgtctgaccgtggatcagatcagctctggacaggatttgattatcaccggcagcaaagaccactacatcaagatgttcgacgtgactgaaggagccttggggacagtttctcccactcacaatttcgagcccccacattacgatgggatcgaagcattaacgatacagggggataacctcttttccggctcccgagacaacggcattaagaagtgggatttgacccagaaggaccttctccaacaggttccgaatgcccacaaggattgggtgtgcgcccttggggtggtccctgaccatccagtcctcctatccggatgccgtggcggtatactgaaagtgtggaatatggacacattcatgcctgtcggggagatgaaaggacacgacagcccaatcaatgccatttgcgtcaactccacccacattttcactgccgctgatgacaggaccgtcaggatctggaaggcaaggaatttgcaagatgggcagatcagcgacaccggcgacttaggtgaagatatcgcaagcaatta

SEQ ID NO: 227833 - DNA, 4866 bp, Artificial Sequence
  Description of Artificial Sequence: Synthetic coding sequence
atgctcggcgctcccgacgagagctctgttagagtggccgtgcgtatccgaccccagctggccaaagagaaaatcgaggggtgccacatctgtaccagcgttacacctggggaaccccaagtatttctagggaaagataaggcattcacatttgactatgtgtttgacatagatagtcagcaggagcaaatttatatacaatgcattgagaagctgatcgaaggatgctttgaaggctacaacgctactgtgttcgcgtacgggcagaccggggctggcaagacctacaccatgggaaccggattcgacgttaatatcgtcgaagaggagctgggaattattagtagagcggtgaaacacctttttaaaagtatcgaagagaaaaagcacattgcaatcaagaatgggctccctgcccctgattttaaggtgaacgctcaatttctggagttgtacaatgaggaagtccttgatttattcgacacaacccgagatattgatgcaaagagtaagaagagcaacattaggatccacgaggattcaactggcggaatctacaccgtaggggtgacgacaagaactgtgaacaccgagagcgagatgatgcagtgtctgaaactaggcgcactctcccgcaccactgcgtctacccagatgaacgtccagagttccagaagtcacgctatctttacaatccacgtttgtcaaactagggtttgtcctcagatagacgccgacaatgccaccgataataagattattagcgaatcagcccagatgaacgagttcgaaaccctgacagccaagttccacttcgtggacctagctggaagcgagaggttgaagcggacaggcgctacgggcgaaagggcgaaagaaggaatttccatcaattgtgggctgctagcgctgggcaatgtcatatctgctttgggggacaaatctaagagagcaacccacgtgccctacagagacagcaagctgacaagattgctgcaggactcattgggtggcaattctcagaccataatgatcgcttgtgtaagtccctcagatagggattttatggagaccctgaacacattgaagtatgctaatcgtgcacggaatatcaaaaataaggtgatggtgaaccaggatcgagcatctcagcagattaatgccctgaggagtgagatcacccgcttgcaaatggagctcatggagtacaagaccggaaagaggatcattgacgaagaaggagttgagagtataaacgacatgttccacgagaatgcgatgctacagaccgagaataataacctgcgcgtccggataaaagctatgcaggagacggtggacgccttacggtccagaatcacccagctcgtgagcgaccaagctaatcacgtgttagctcgcgctggtgagggaaatgaagagatcagcaacatgatccactcctacatcaaagaaattgaggatcttagagctaaactgctggaatccgaggcggtaaacgagaaccttagaaaaaacctcactcgtgcgaccgcgagggcaccctatttcagtggctccagtacattttctcctacgatactctccagcgacaaagaaactatagaaattattgacctggcgaagaaagatttggaaaagctaaagcgaaaggagaagagaaagaagaaatcagttgccggtaaggaagataatactgataccgatcaggagaaaaaagaggaaaaaggggtgtctgaacgggagaataatgaattggaggtcgaagagagccaggaagtttcggatcacgaggatgaagaggaggaggaggaagaggaagaagatgatatcgatggcggtgagtcttccgatgagagtgactcagaaagtgacgaaaaggcgaactatcaagctgacctagccaacataacctgtgagattgctattaaacagaagctgattgacgagctcgagaactcgcagaagcggcttcagactcttaagaagcagtatgaggagaaattaatgatgctgcaacataagatcagagacacccaactcgagcgggaccaggtactccagaaccttgggagcgtggagtcctattctgaagaaaaagctaagaaagtgcgatcagagtacgaaaagaaactccaggctatgaacaaagaactccaacgcctgcaagccgcacagaaggagcatgcacgcctgcttaaaaaccagagtcagtatgagaagcaactgaaaaagctgcagcaggatgttatggaaatgaagaagacaaaggtccgtctgatgaaacagatgaaggaagagcaggaaaaggctcgtcttaccgagtcccgccgtaacagggagattgcgcaacttaagaaagatcagcgcaagcgggatgtgaccgctcttcgcaggcaggtgagacccatgtcagacaaggttgctgggaaagtgacacgaaagctatcctcttcggatgcacctgcccaggacacagggagcagcgcggcagcagtggagactgatgccagtaggacaggcgctcagcagaagatgcggatccctgtggctcgggtccaggccttgccgacccctgcaacaaacggcaaccgtaaaaaataccaaaggaaggggcttacgggtcgagtctttatttccaaaaccgcgcgtatgaaatggcagctgctcgagaggagagttactgatataataatgcaaaaaatgacaatcagcaacatggaggcagacatgaatcgactgctgaaacaacgtgaggaactcacaaaaaggagagagaagctctcaaagcgacgcgagaagatcgtgaaagagaatggagagggcgataagaacgtggccaatataaatgaggaaatggaatcacttacagctaatattgattacatcaacgattcaatcagcgactgccaggcaaatattatgcagatggaggaagctaaagaagagggtgagaccctagacgtaactgccgtgatcaacgcctgtacactaaccgaggctaggtatctgctcgaccatttcctgtctatgggaatcaataagggcctgcaggcggctcagaaggaagcccaaattaaggtcctggaaggtcggctaaaacagaccgaaatcacatcagcaacgcagaatcagctccttttccacatgctaaaagaaaaggcggagctgaaccctgaacttgacgctctgcttggtcacgctctgcaggatctggattccgttcccctcgagaacgtggaggacagcactgatgaagacgcaccactcaactcacctggtagcgaagggagcaccctctcctctgacttaatgaaactgtgcggggaagtgaaacctaaaaataaagccagacgtagaaccaccacacagatggagttgctgtatgcggattcatctgaactagcttccgatacctcgaccggcgatgccagcctcccaggtccgctaacaccagtcgcagaaggtcaggaaataggaatgaacacggaaaccagcggaacttcagccagggaaaaggagctctcccctccacctgggcttccatccaaaatcggaagtatctcccgccaatccagcctgtcagagaaaaaaatcccagagccaagcccagtgacacgcaggaaggcctatgagaaagccgagaagagcaaagcaaaagagcaaaaacattcagacagcggaacctcagaggccagcctcagcccgccatcatcaccgccttcccggccaagaaatgagctaaatgtcttcaaccgcctaacggtgtctcaggggaatacctctgtgcagcaggacaaaggaatcatcaacccatttcctgcctcaaaagggatcagagccttccctttgcaatgtatccatatcgcggagggacacactaaggctgtcctgtgcgtagattcaactgatgatctgctgtttactgggagtaaggataggacatgtaaagtctggaatctcgttactggacaggagatcatgagtctcggcggtcacccgaataatgtggtgtccgtaaagtattgtaactacacttccctggtgttcactgtttcaacttcctacatcaaggtctgggatatcagggacagcgccaagtgtattcggactctgaccagcagcgggcaagtcactctaggagacgcatgctctgcatctacgagtcgcacagtggctatacccagcggggagaatcaaatcaaccaaattgccttgaacccaaccggaacctttctgtatgccgctagtggcaatgcggtgagaatgtgggatctcaaaaggtttcagagcacgggtaaacttaccggtcatttgggtccagtgatgtgtctgactgttgatcagatctccagtgggcaggatcttataataacaggtagtaaggaccactatatcaaaatgtttgatgtgactgagggggctctgggtacagtttctccaacacacaatttcgagcctcctcactacgatggaatagaagcattaactatccaaggggacaatctgttttctggctcgcgagacaatgggattaagaaatgggacttgacgcagaaagacctactgcagcaagtccccaatgcgcacaaagactgggtgtgtgctttgggggtggtgccggaccaccctgtgttgctgtcaggctgccgcggaggcatactgaaagtgtggaatatggacacatttatgcctgtgggagaaatgaagggacatgattctcccatcaatgctatttgcgtgaattctacccacatcttcacagcggctgacgacagaacagtacgtatttggaaggccagaaatttgcaggacgggcagatttcagacaccggcgatctgggtgaggatatcgctagcaactag

SEQ ID NO: 227834 - DNA, 4914 bp, Artificial Sequence
  Description of Artificial Sequence: Synthetic coding sequence
atgttgggcgcaccggatgagtctagcgttcgtgtggcagttagaatccgacctcagcttgccaaagaaaaaatcgagggatgccatatttgtacctccgtaacacccggtgagccacaggttttcctgggcaaagacaaggccttcacttttgattatgtgttcgatatcgacagccagcaggagcaaatctatatacagtgcattgagaaacttatcgagggctgctttgagggttataacgcaaccgtcttcgcctacggccaaactggcgcaggcaagacgtacaccatgggaactggtttcgatgtcaacatcgttgaggaggaactcgggatcatttctcgggctgttaaacacttgttcaagtccatagaggagaagaagcacattgctattaagaacggcctgcccgcaccagacttcaaagtaaacgcccagtttctggagttgtacaacgaagaggtgctcgacctgtttgacactactcgggatatcgatgcgaaatccaagaaatctaacattcgaatacacgaggacagcactggcggtatctacactgtaggagtgaccacccgtactgtcaataccgagtctgagatgatgcaatgccttaaacttggtgccctgagccgcacaaccgccagtactcagatgaatgttcagagcagccggtcccacgccatctttaccatccacgtttgtcagacccgggtctgcccccagatcgacgccgacaacgctactgacaataaaataatcagcgaaagcgctcagatgaacgagtttgagacattaacagctaaattccatttcgtagacctggctgggtccgaacggctgaagagaaccggcgctactggcgagcgcgctaaggaaggaatctctataaactgcggactcttggccctggggaatgtcatctctgctctcggcgacaagagcaagcgcgcaacgcacgtgccctatcgcgattctaaactcacaaggctgctccaggacagtctaggcggtaactcacaaacgatcatgatcgcctgcgtttcacccagcgatcgggacttcatggaaacattaaatactctgaagtacgccaatcgagccagaaacattaagaataaggttatggtcaaccaggatcgcgcaagccagcagataaacgccctgagatcagagataaccagactgcagatggagttgatggaatataagacaggaaagagaatcatcgatgaggagggagtggaatccataaacgacatgttccatgaaaatgcaatgttgcagaccgagaataataatttgagggttcgaattaaggcaatgcaagaaaccgtcgatgcactgaggtcaaggatcactcagcttgtgagcgaccaggctaaccacgttctggctagagccggtgaaggaaatgaggagatttccaacatgatacactcctacattaaagagattgaggatctgagagctaagcttttggaatcagaggccgtcaatgagaatctgagaaagaacctgacccgcgctactgccagagccccatacttttcggggtccagtacatttagtccaacgatcctgtccagcgataaggagacaatcgagattatcgatctcgcaaaaaaagatctggagaagctcaagcggaaggagaagcgaaagaaaaagtccgtggccggaaaggaagacaatactgacactgatcaggagaaaaaggaagagaagggggtctctgagcgagagaacaatgaacttgaggtggaagaaagtcaggaggtgtccgaccacgaggacgaagaggaagaagaagaggaggaggaggacgatattgacggcggagagtcatctgatgaaagtgacagtgagtctgatgaaaaagccaactaccaagctgacctggcaaatatcacatgtgaaattgctatcaaacagaagctcatcgatgagctggagaacagccagaaacgccttcagaccttgaagaagcagtacgaagagaaactgatgatgttgcagcacaagataagagacacacaattagaaagggaccaggtgctgcagaatcttgggagcgtggagagctacagcgaagagaaagcgaaaaaagtccgcagtgagtacgagaagaaactccaggcaatgaacaaagagttgcaacgactccaggccgctcagaaagagcatgctagactgcttaaaaatcagtcacaatacgagaaacaactgaaaaaactccagcaggacgtgatggagatgaagaaaacaaaggtgcggctgatgaagcagatgaaagaagaacaagagaaggcaaggctcaccgagtccaggagaaaccgggaaatagcacaattgaaaaaggatcagagaaaacgtgatcaccagctaagactccttgaggcacagaagagaaaccaggaggtggttctgaggagaaagacagaggaagttactgctctccggagacaggttcgtcctatgtccgataaagtggcaggcaaagttacccggaagctgtccagctccgatgcccctgcccaagatacaggttcgtcagcagcagccgtagaaacagacgcctctagaactggagcccaacaaaaaatgcggatccctgtggcgagagtgcaggcccttcctacaccagctactaacggtaaccgaaagaagtaccaacgaaagggcctaactggccgtgtgtttatatctaaaacagccagaatgaaatggcagctgctggaaagacgggttaccgatattataatgcagaaaatgacaatctctaacatggaggccgatatgaataggcttcttaagcagcgagaagagcttaccaagaggagagagaaactatcgaagcgcagggagaaaattgtaaaagaaaacggggaaggcgataagaacgtggccaacattaacgaagaaatggaaagcctcacagccaatattgactacattaatgacagtatttccgattgtcaggccaacattatgcagatggaggaagccaaggaggaaggagagaccctagacgtaactgcagtaatcaatgcatgtacactgaccgaggctcggtatctgctggaccacttcctgtccatgggtattaacaaaggtctacaggctgctcagaaggaggcccagatcaaggtgctggaggggaggctcaaacaaaccgagatcacatctgcaactcagaatcagttgctttttcacatgctgaaggagaaggccgaactcaaccccgagctggacgccttacttggccacgctctccaggaaaatgtggaggactctactgatgaagatgcccctttgaacagtcccggatcagaagggtccactctgtcgtcagacctgatgaagctgtgcggggaggtgaagcctaagaataaggccaggcgacggacgactacacagatggaattgctgtatgccgattcaagcgagttagccagcgatacctctacaggggatgcctctctcccaggtcctctcacgccagttgctgagggtcaggagattgggatgaacaccgagacaagcggcaccagcgccagggagaaagagctttctccgcctccaggcctgccaagcaaaattgggtctatctcccgccagtcaagcctgtcggagaagaaaattcctgagcccagtccggtcacacgcagaaaggcctacgagaaggctgaaaagagtaaggccaaagaacaaaaacacagtgacagcgggacatcagaggcctccctctctcccccatccagtccacctagcaggccgcgaaacgagctgaatgtgttcaacaggctcaccgtgagtcagggaaatacgagtgtgcagcaagacaaaggaataattaacccttttcccgctagcaagggaatccgagcctttcccctgcagtgtattcatatagccgaaggacacactaaggcggtcctctgtgtggacagtactgacgacctattattcacaggctcaaaggacaggacgtgcaaggtgtggaacctggtcactggacaggagatcatgagcctgggcggacaccccaacaacgtggtgagcgtgaaatactgtaactatacctcactcgtgttcactgtctctacaagctatataaaagtgtgggacattcgggactcagccaagtgtatccggaccctgacttcatcaggccaggtgacacttggcgacgcctgctccgcatcaacctctcgcactgtggcaatcccctctggggagaaccaaataaaccaaatagccttgaaccctacgggcacttttctgtacgcggcaagcgggaacgccgtgcgaatgtgggacttgaaaaggtttcagtctacaggtaagcttacgggtcacttaggtcctgtgatgtgcctgactgttgatcagatatctagcggccaggacttgatcattactggtagcaaagatcactatatcaaaatgttcgacgtcacagagggtgcactaggcacagtctccccaacacacaacttcgaaccccctcactacgatggtatcgaagcactgacgattcagggggataacctgttttcaggctcacgagacaacggtatcaagaaatgggatctcacacagaaagacctcctgcagcaggtccctaacgcccacaaagactgggtgtgtgccctgggcgtggtgccggaccatccggttttgctcagcggatgccgtgggggtattctaaaggtttggaatatggataccttcatgcccgttggagaaatgaagggccacgatagccccattaatgccatatgtgtgaattcaacgcacatcttcacagcggctgatgatagaacggttcgcatctggaaagctcgcaatctacaggatggccagatcagcgacacaggcgatctgggagaggatattgcctcgaactag

SEQ ID NO: 227835 - DNA, 1986 bp, Artificial Sequence
  Description of Artificial Sequence: Synthetic coding sequence
atgaatcgcctgttgaaacagagagaggagctgacaaagcggagagaaaaactgtccaagcggagggaaaagatagtgaaagaaaacggcgagggggacaaaaacgttgcgaacataaacgaggaaatggagagtctaacagctaatatcgattatatcaacgattctatttccgattgccaggccaacataatgcagatggaggaggcaaaggaagagggtgagacactagatgtgacggcagtcataaacgcctgtactcttacagaggcacgctacctcctcgaccatttcctttccatgggaattaataaaggactgcaggcagcccagaaggaggcgcagataaaggtattggaaggtcgattaaaacaaacagaaatcacctccgcaacccaaaaccagttgctgttccatatgcttaaggaaaaagccgagttgaaccccgagctggacgccttactgggtcacgccctccaggaaaatgtggaggactctactgacgaggatgctccccttaacagccccggttccgaggggagcactttgtcttcagatttgatgaagttgtgtggagaagtgaaaccgaagaacaaagcacgtcgccgaacaacaacacagatggaattgttgtatgcagactcatccgagttagcaagtgacacctccactggcgatgcctccctgcctgggcctctgacacccgtggctgaagggcaggagattggcatgaacaccgaaacctcagggacctctgcaagagagaaggaactgagcccacccccagggcttccctcaaagattggatcgatttcaaggcaatcatctctgtcagaaaagaaaattccagaacccagccctgtcactcggcgaaaagcctacgagaaggctgaaaaatctaaggccaaggaacagaagcaagggattattaatccattccccgcttctaaaggtattagggcttttcccttgcagtgtattcacatagccgaagggcatactaaagctgtgctgtgcgtggattcaactgacgacttgctgtttaccggctccaaagatcgaacatgcaaggtgtggaatttggttactggacaagagatcatgtcccttggcggacatcctaacaacgtcgtgtcggtgaagtactgtaactacacctccctcgtgttcacagtgtctacgtcctacattaaggtatgggacatccgagactccgcaaaatgtatacgtaccctgacttcttctgggcaggtgactcttggcgacgcctgtagtgcgagtacttctagaacagtcgcaattccgtctggtgaaaatcaaatcaatcagattgcgctcaacccaaccggcacctttctctatgccgctagtggcaacgcggtgagaatgtgggatcttaagcgatttcagtcaaccggaaagctgacaggccacctgggcccagttatgtgtctgactgtggaccagatcagcagtggtcaggacctgatcattaccgggtcgaaggaccattatattaaaatgttcgacgtgactgagggtgctttaggcacagtgtcccctacccacaatttcgagcctccccactatgacggtatagaagctcttacaattcaaggcgacaacttattttcgggctcaagagataacggcatcaagaaatgggatctcacccagaaggacctgcttcagcaggtgccaaacgcccacaaagactgggtgtgcgctctcggggtggtgccagatcaccctgtgctgctgtcggggtgtcgcggtgggatcctgaaggtgtggaatatggatactttcatgcccgtgggcgagatgaaggggcacgactcgcccatcaatgcaatctgtgtcaactccacacacattttcaccgctgcagacgaccggaccgtgcggatctggaaagcccgaaacctgcaggacggacagatttctgacacaggagacctcggcgaggacattgcaagcaattag

SEQ ID NO: 227836 - DNA, 4874 bp, Artificial Sequence
  Description of Artificial Sequence: Synthetic coding sequence
atggctggccagggtgactgctgtgtcaaagtggcggtgcggatcagacctcagctgtccaaggagaagatcgagggctgccacatttgcacctctgtcacccctggcgaaccccaggtgttgttgggtaaggacaaagcctttacatatgactttgtgttcgatcttgacacatggcaggaacagatttacagcacgtgcgtttccaagctcattgaaggatgcttcgagggctacaacgccaccgtcctcgcgtacggtcaaaccggcgcaggaaaaacgtacacaatgggaaccggattcgatatggccacttcagaggaggaacagggaatcattccgagagccatagcccatctcttcggcggaatcgcagaacgcaagcgcagagcgcaggaacagggcgttgctggcccagagttcaaggtgagtgcccagttcctggagctgtataatgaggagattctggacctgtttgacagtacaagagacccggacacaaggcaccgcagaagtaacattaagatccacgaggacgcaaatggtggcatctacactactggtgtaactagtcgcttgatccattctcaggaggaattgattcagtgtttaaagcaaggcgctctctcccgaaccacagctagcactcagatgaatgtgcagagctctaggtctcatgcgatcttcacgatccacctttgccagatgaggatgtgcacccaacccgacctggtcaacgaagccgtgaccggccttcctgatggcacgcctcctagtagtgagtacgagaccttgaccgccaagttccatttcgtggatctggccggatcagaaagactcaaaaggactggtgctacaggggaaagggctaaagagggaattagcatcaattgtgggctgcttgccctgggtaacgtgatctccgcactgggagatcagagcaaaaaagtcgtccatgtgccgtaccgcgattctaaactgacgagattacttcaagattccctgggaggcaacagccagactatcatgatagcgtgcgtgtctccaagtgaccgggatttcatggagactttaaacaccctgaagtatgctaatcgagcaaggaacataaaaaataaggtcgtcgttaatcaggacaagacctcccagcagatcagcgcccttcgcgcagaaatcgctagactccagatggaactcatggagtataaggccggaaagcgtgtaattggcgaagatggagcggaggggtattcggacctctttagggaaaacgccatgctgcaaaaggagaacggagcgctgagactgagggttaaagcaatgcaggaggccatcgacgccataaacaatcgggtgacacagctcatgtcacaggaagcaaacctgttactggccaaagcaggggacggaaacgaagcaataggtgccttgattcaaaactatattagagagatcgaggaactgcgcaccaagttgcttgagtcagaggcaatgaacgagtctctcaggcgctctctttcccgggcaagtgcaagatcaccatacagtttgggcgctagtccagctgccccagcctttgggggatctcctgcatcaagcatggaagatgcgtccgaagtgattaggagggcgaaacaggatctagagaggttgaagaagaaagaagttcgccagcgaagaaagtccccagaaaaggaggccttcaagaagcgagccaaacttcagcaggagaactctgaagaaactgatgagaacgaagcagaagaagaggaggaagaaagagatgaaagcgggtgcgaagaggaggagggaagggaggatgaggacgaggactccgggagcgaggaaagtttggtcgacagtgattccgacccagaagagaaagaggtcaactttcaggcagacctcgctgatctgacgtgtgaaatcgagattaagcagaagttgatcgacgaactggaaaattctcaaaggcgactccagacgttgaaacaccaatatgaggagaagcttattctgctccagaacaaaattcgggatactcaattagaacgggaccgcgtgctacagaacctgagcaccatggaatgttatacggaagaaaaagccaacaaaatcaaggcagattatgagaaacgactgagggagatgaatagggacttgcagaaactgcaagctgctcaaaaggagcacgctaggctgctgaagaaccaatcccgatacgagcgtgagttgaaaaaactgcaggcagaggtggccgagatgaaaaaggctaaagtggccctgatgaagcagatgcgggaggaacaacagcgaaggagattggtggagacaaagaggaacagagagattgcgcagttgaagaaagaacagaggaggcaagaatttcagatcagggcgctggagagccagaagcgccagcaagaaatggtgctgcgcagaaagacccaagaggtcagcgcccttaggaggctcgctaaaccgatgagcgaacgcgtggcagggagggccggactgaagccacctatgcttgactccggtgccgaagtcagtgcttccactacttcatcggaagccgagagcggcgcacgctctgtgagctctattgtaagacagtggaaccgaaaaatcaatcatttcctcggcgatcatccagcccctacagtaaacggcaccaggccagctcgaaagaagttccagaagaagggtgcctcccagtcttttagtaaagcagcacgcctcaagtggcagtctctggagagacggatcattgacatagtaatgcagcgcatgacaatcgttaacctggaggcagacatggagagacttatcaagaaacgggaggaactgtttcttctccaggaagctctcaggagaaaaagagagaggctgcaagccgaaagtcctgaagaagagaagggcctgcaggaactggccgaggaaatcgaggttctcgctgctaacatagattatattaacgacggaatcaccgattgccaggccaccattgtgcagctggaggagacaaaggaggagctggattccacagataccagcgtggtgatctcatcatgctctttggctgaggcgagactgctgctggacaacttccttaaagcatcaattgacaaaggtttacaggtagcacaaaaagaagctcagattcgcctgcttgagggacgcctacgacagaccgatatggcaggcagcagccagaaccacttactcttggacgccctacgcgagaaggcagaggcgcatccagaactacaggccttgatttacaacgttcaacaggaaaacggatatgcctctacggatgaagagatcagcgagttctccgagggctccttctcccaatcatttactatgaaaggaagcacctcacacgatgactttaaatttaagagcgagcctaagttgtctgcgcagatgaaggcagtcagcgctgaatgcctggggccacccttggacatctctacaaagaacataacaaaatccctagcaagtttagtggagatcaaagaggacggcgtaggattttccgtgagggacccatactacagagacagagtgtctaggacggtgtctctgcctaccagaggaagcacttttcccagacagtctcgtgcaactgaaacgtccccgctgacccgcaggaagagctacgaccgtggccaaccaatccgctctacagacgtgggcttcacaccgccttcttcacctcccactagaccaaggaacgacaggaatgtgttcagccgccttaccagtaatcagtctcaaggctctgcattggacaaaggcattatctcgcccgtagggggtgccaagggggctagaaccgcaccactccagtgtgtgtctatggctgaaggacatacgaaacccatactgtgtcttgacgcaactgatgagctattgttcaccggcagtaaagataggagttgtaaaatgtggaacttagtcacgggccaggaaatagccgctttgaaaggtcaccctaacaatgtggtgtcaataaagtactgtagtcactccggactggtcttctctgtgagcaccagctacattaaggtatgggatatccgcgatagcgcgaagtgtatcaggaccctaacatctagcggccaggtgatatcaggtgacgcatgcgcagccacatccaccagagctataaccagcgctcagggggaacaccagattaatcaaatagccctgtctcctagcggcaccatgctctatgcggcttcaggaaacgcagtgcgaatatgggaactatccaggttccagccggtgggtaagcttacaggccacattggaccagtgatgtgcctcaccgtgacacagactgcctcgcagcacgacctggtggtcacaggttccaaagaccactacgtgaaaatgttcgagctgggcgaatgcgtgacaggtaccataggtcctactcataattttgaaccaccacactatgatgggatagaatgcctggctattcaaggggacattctgttttcggggtcacgtgacaacggaataaaaaagtgggatcttgatcagcaggagttgatacagcagattccaaacgcccacaaagactgggtatgtgccctcgcatttattcccggtcgtccgatgttactgtccgcctgccgagctggggtgatcaaagtgtggaatgtggataatttcacccccattggcgagataaagggacatgacagcccaatcaacgccatctgtaccaacgctaaacatatttttaccgcgtcaagcgactgccgggtcaaactgtggaattacgtgcccggattgactccttgtttgcctcgacgtgtgctggcaatcaaaggacgcgcaactaccctacccta

SEQ ID NO: 227837 - DNA, 4833 bp, Artificial Sequence
  Description of Artificial Sequence: Synthetic coding sequence
atggccggtcaaggagactgctgtgttaaggtggccgttcgaatccgccctcaacttagcaaggaaaaaatcgaaggatgccacatttgcacttctgtgacccccggtgaaccgcaggtgctcctgggcaaggacaaagctttcacctacgatttcgtcttcgacttggatacttggcaggagcagatctatagcacttgtgtgtctaagctgatcgagggctgctttgaaggttacaatgcaactgtgctcgcttatggtcagacaggagccggtaagacctatacgatgggcacaggatttgacatggcaactagcgaggaggaacagggcatcattcctagagcaatcgcgcacttgtttggtggcatcgcagagaggaagcggcgtgctcaggagcagggcgttgctggacccgagttcaaggtgtcggcccagtttctcgagctgtacaatgaagagatattggatttatttgactccactcgcgaccctgacacgcggcatcgcagatcaaacataaagattcatgaggatgctaacggaggcatctacactactggcgttacctctcggcttatccacagccaggaggaactcattcaatgcctaaagcagggcgctttaagcagaactacagcatctactcagatgaacgtccagagctctcggtctcacgcaattttcactatacacttgtgccagatgcgcatgtgcacccagccagatctcgtgaacgaggccgtcactggcctgccagacgggacgccaccgtcctcagagtatgagaccctgacagccaaattccattttgttgatctagcaggttccgagcggctcaaaaggacgggcgcaacaggcgagagagccaaagagggaatttccattaattgtggcttgctggcactcgggaacgtgatctcagcattgggagatcagtccaaaaaagtggtccacgtgccatatcgagattctaaactgacgcgcctgctccaagactcacttggtggaaactcccaaacaattatgatagcctgtgtgagcccctcagatcgggattttatggagactctgaacactctaaagtacgcaaatcgagcgaggaacattaaaaacaaagtggtagtgaatcaggataagacctcgcaacagattagcgcgctgcgggctgagatagccagactccagatggaactgatggagtataaggccggtaagcgcgtaataggcgaggacggggcagaggggtactcggacctcttcagagagaatgcgatgttgcaaaaggagaacggcgctctgcggttgcgggtgaaggctatgcaggaagcaattgacgccatcaacaatagggtcacccaactcatgagtcaggaagctaacttgctactggccaaggcgggtgacggcaacgaggcaattggcgcactgattcagaactatattcgcgaaattgaagaactgagaactaaactgttagagtctgaggccatgaacgagtctctcaggcggtccctctcccgtgcttccgctcgcagcccctatagtctcggagcttctccagccgcacccgcttttggtggatctcccgcttcctccatggaggacgccagcgaagtgattcgccgagctaagcaagaccttgaaagactaaagaaaaaggaggtcaggcagaggcgcaagagtccagagaaggaagctttcaaaaagagagccaagcttcagcaagagaactcagaggaaacagacgagaacgaggctgaggaggaggaagaggaacgcgatgaatctggctgcgaggaagaagaagggagggaggatgaagacgaagactcggggtctgaagagtcactcgtagactcagactctgacccggaggaaaaggaagttaactttcaggctgacctggccgacttaacatgtgagatcgagatcaaacagaaactgatcgatgagctggagaacagtcagagaaggctgcagaccctgaagcaccagtatgaggaaaagctgatcctattgcagaacaaaatccgcgacacccagctggaaagagatagggtgctgcagaatttatcaactatggagtgttataccgaagagaaagccaacaagatcaaagctgactatgagaagcggcttagggagatgaaccgggatttacagaaactccaggctgcccagaaggagcacgcacgactcttgaaaaaccagtccagatatgagcgggagctcaagaagctgcaagctgaagtggcagagatgaagaaggccaaagtcgccctaatgaagcagatgagagaagagcaacagcggagacgcctggtggagaccaagaggaatagagaaatcgctcagctgaagaaagagcaaagaaggcaggagtttcaaatccgagcattagaatcccagaagagacagcaagagatggtgctacgccgaaaaacccaagaagtttcagcactccggagactcgcaaagcctatgtcagaaagagtggccggaagggcaggcttaaagcccccaatgctcgattccggcgctgaagtgagtgcttcaacaacgtcttctgaagctgagtccggggcacgcagcgtgtctagcatcgtacgccagtggaaccgcaaaatcaatcatttccttggcgatcacccagccccaaccgtcaacggaacaagacccgctcgaaagaagttccagaaaaagggcgcaagtcagtcctttagtaaggctgctcgactgaaatggcaatcactcgaacggaggatcatcgatatcgtcatgcagagaatgactatcgtgaaccttgaggccgacatggagcgcctgatcaagaagagggaggaactgtttctcctccaagaagcactccgacgaaaacgggagagacttcaggcagagagcccagaggaggaaaaaggcctccaggagctggccgaagagattgaagtgctggctgccaatattgactacatcaacgatggcatcaccgactgtcaggcaacaatcgtgcagctcgaagaaaccaaggaggaactggatagtacagacacaagcgtcgtgattagtagctgcagcttggccgaagcccgtcttctcctcgataattttctgaaagcttccattgataagggcctgcaggttgcacaaaaggaggctcaaatccgcctgctggaaggccgactgagacaaacggacatggccggatccagtcagaaccatctactcctagatgccctaagagaaaaggcagaagcacaccccgagctccaggctctcatctataatgtgcaacaggaaaacgggtatgcttcaactgacgaagaaatttcagaattcagcgaaggatccttctctcaatcgtttacgatgaaaggaagcacttcacacgatgattttaagttcaagagcgagccaaagttgtcggcacaaatgaaggcagtctcagccgagtgtctcggaccaccgctggacataagcacgaagaatatcaccaagtccttggccagcttggttgagataaaggaggacggcgtgggcttctctgtgcgcgatccctattacagggaccgtgtgagccggactgtgagcctccccacccgtgggtcaaccttccctcggcagagccgggctacagagacttccccactgacccgtcggaagagctatgatcgcggtcagcccatccgaagcactgatgtcggctttacacctccgagcagtcctccaactcgccctcggaatgatagaaacgtcttttcccggttgacttcaaaccagagccagggctctgcccttgacaagggcatcattagccccgtggggggagccaagggtgccagaactgcccctctgcagtgcgtatcaatggcagagggtcacaccaagccaatcttgtgtcttgacgctaccgatgaactcttatttactggttctaaggaccggagctgtaaaatgtggaatttggtgacgggccaggagattgccgcattaaaaggccacccaaataatgtggtttccatcaagtactgctcccattccggacttgtgttttcagtttccaccagttatatcaaagtgtgggatattcgcgattctgctaagtgcatacgcaccctgacgagttcaggccaagtgatatccggggacgcgtgcgcagcaaccagtaccagagcaatcacctcagcacagggtgaacatcagatcaaccagatcgcccttagcccctcgggcactatgctgtatgctgcatcaggcaacgcagtgcggatctgggagcttagtcgctttcagcccgtgggcaagctcactggccacatcggtccagtgatgtgcctaacagtgactcagactgctagtcagcatgatctagtcgttactggttccaaggaccattatgtcaagatgttcgaactgggagaatgcgtcaccgggaccataggccctactcataactttgaacccccacattacgatggaatcgagtgtctggctatacagggcgacatcttgttctcggggtccagggacaatggaattaagaaatgggatctcgaccaacaggagctgattcagcaaattcccaacgcccataaggattgggtctgcgccctcgctttcattcctgggagacctatgttactctccgcatgcagggcaggtgtcatcaaagtgtggaacgtcgataacttcacccctattggggagatcaaaggccacgactcccctatcaatgcgatctgcaccaacgcaaagcacatcttcaccgcatcctccgatctaaccgtgaagttctggtctgttcggcgactgccacactctggcccaccatag

SEQ ID NO: 227838 - DNA, 4914 bp, Artificial Sequence
  Description of Artificial Sequence: Synthetic coding sequence
atggccggtcagggggactgctgcgtaaaagtcgcggtacgcatcaggcctcaactgtctaaagagaagattgaaggctgtcatatctgcacgtctgtcacccccggagaaccccaggtcctgctcggtaaagacaaagcctttacctacgatttcgtgtttgacctggacacctggcaggagcagatctactctacctgtgttagcaagctaatagagggatgttttgaaggttataatgcgaccgtccttgcatatggtcaaactggggctggcaagacctacaccatggggacaggttttgacatggcaacgagcgaggaggaacagggcattatcccccgagcaatagcacacctgttcggaggtatcgccgagagaaagcgccgagcgcaggagcagggcgttgccggtcccgaattcaaggtgagcgctcagtttttagagctctacaacgaggaaattctagatcttttcgatagcacacgagacccagacacgcgccacagaaggtccaacatcaaaatccacgaggacgctaatggcggaatttatacaacaggagttacctctaggctcatccactcacaggaagagctgatccagtgccttaaacaaggcgcattatcacggaccaccgcctcaacacagatgaatgtacagagcagccggtcacatgctatctttaccatccacttgtgtcagatgcgcatgtgcacccagcccgacctcgtcaacgaagccgtgacgggcttgcctgacggaacaccaccaagttctgagtatgagaccctgacggctaaattccatttcgtggatctcgcaggttccgaaagacttaagcgaacaggagctaccggagagcgggctaaagagggaatttccattaactgcgggcttttagcccttgggaacgttatttccgctttgggtgaccagagcaaaaaggttgtgcatgtcccgtatcgcgattcaaaattgactcggctgttacaggatagtctgggtgggaattcccagactattatgatcgcttgcgtgtcaccgtccgacagggatttcatggaaacactgaacaccctcaagtatgcaaatagggcacgtaatataaagaataaagtggttgtcaatcaggataagacttcacaacagatctcagcccttcgtgccgagatcgccaggttgcagatggagctgatggaatataaggcagggaagcgcgtaatcggggaggacggcgcagagggatattcggatctgttccgcgagaacgctatgctgcagaaagagaatggagctttacgcctaagggttaaagccatgcaagaagctattgatgcaatcaataacagagtcacgcaactgatgagccaagaggccaacctgctactggccaaagccggtgatggcaatgaagctatcggcgctctaatacagaactacattagagagatcgaggagctcagaaccaagttactggaatcagaggccatgaacgagagcctcagacgctcactttcaagagcctccgccaggagcccttattccctgggtgcttcgcctgctgcacccgctttcggaggatccccggctagctccatggaggatgcctcagaagtgatccgcagagccaaacaggatctggagcgccttaaaaagaaggaagttcgacagcgacggaagagccccgaaaaagaagcttttaaaaagagggcaaaactccagcaggaaaactccgaggaaacagacgaaaatgaggctgaggaagaggaggaagagagggatgagagtggttgtgaagaggaggagggacgagaagacgaagatgaagattcaggctctgaggaatccctggtggattccgatagcgatccagaggagaaggaggtgaacttccaagccgatctcgctgatctgacctgcgagatcgagatcaaacagaaactgatcgacgaacttgagaatagccaacggcgacttcagaccctcaaacaccagtatgaagagaaactgattcttctgcagaacaaaatccgggatactcagctggagagagatcgcgtgcttcagaacctcagtacaatggaatgctatactgaagaaaaggccaacaaaattaaggctgactatgaaaagcgtctgcgagagatgaaccgcgatctacagaagttgcaagccgctcaaaaggagcatgctcggctgctcaagaatcaatcacggtacgagcgggagctcaagaagctgcaggccgaagtggcagagatgaaaaaagccaaagtggcgctgatgaaacaaatgcgcgaagagcagcagaggcgccgactggtggaaacgaaacggaacagggaaatagcccagttaaagaaggaacagagaagacaggagtttcagattcgcgctcttgaaagccaaaagcggcagcaagaaatggtactgcggaggaaaacccaggaagtgagcgcattaagaagactggccaagcccatgtccgaaagggtcgctggcagggccggtttgaagccaccgatgctggattccggggctgaagtgtcggctagtacaaccagctccgaggccgagtctggcgcacggtccgtgagttcaattgtgagacagtggaacagaaaaattaatcattttttgggcgatcatccagccccaactgttaatggaactcggccagctaggaagaagtttcagaagaagggagcaagccagagtttctctaaggccgctagacttaagtggcagtccctcgaaagaagaatcattgacatcgttatgcaacggatgaccatcgtgaatctggaagctgacatggaacggctgattaagaaacgagaagaactgttcctgcttcaggaggctttacggcgaaagagagaacggctgcaagccgaatcaccagaggaagagaaaggcttacaagagttggctgaggagattgaagtccttgccgctaatatagattatatcaacgatgggattaccgactgccaagcgactattgtgcagctggaagagacgaaggaggagttagattccactgacacaagtgttgtgatttcgtcatgctcgctagccgaggcacgcctgcttctggacaactttctgaaggctagtatcgacaaaggtctgcaagtcgcccagaaggaggcccagattcgcctgctggaaggaagactgcgccaaactgacatggctgggtcatctcagaatcaccttcttctcgacgccctacgcgagaaagcagaggcccaccccgagctacaggctctgatctacaacgttcagcaagagaacggatatgcttccacagatgaagagatctctgagttctctgagggatcctttagccagagctttactatgaaggggtcaacatcccacgacgatttcaagttcaagtctgagccaaagttatcggcccagatgaaggccgtctccgctgagtgtctgggacctcctctcgatatcagcacaaagaacataaccaaaagcctagcaagcttagtggagatcaaagaggacggcgtcgggttttctgtcagggatccttactatcgagatagggtttctaggacagtttcactaccaactagaggatctacgtttcctcgccaaagccgcgcaactgagacgtccccccttacaaggaggaaatcatatgaccgcggtcagcctatcaggagcaccgacgttggattcacacctcctagctctcccccaacacgacccagaaatgatcggaatgttttcagtagactgacctctaaccagtcccaggggagtgcgctagataaaagtgacgactcagactcatcactctcggaggtgctgcggggtattatttccccagtcggaggagctaagggggctcgcactgctcctcttcaatgcgtctccatggctgaaggacacacaaagcctatcctgtgcttggacgcaacagacgagcttttgtttaccggttctaaggaccggagctgtaagatgtggaacctggttactggccaggagattgccgcactcaagggtcacccaaacaacgtcgtgagtattaagtactgcagtcacagcggccttgtattcagcgtcagcacttcatacatcaaagtgtgggacatccgcgactcagccaagtgtattaggaccctgacgtcaagcgggcaggtaatatctggagatgcctgcgctgctacttccacccgggctataactagcgctcagggagagcaccaaatcaaccagatagcactgagcccgtccggaacaatgctgtacgctgcaagcggtaatgctgtgagaatatgggaactgagcaggtttcagcccgtcggaaaactgacaggacatattggacccgtaatgtgcctgaccgtgacccaaactgccagccagcacgatctggtcgttactggttcaaaggatcattatgtgaagatgttcgaactgggcgagtgtgttacgggaacaatcggccctactcacaattttgagccaccccattacgatgggatcgaatgcttggctatccagggggacatcctctttagcggctctcgtgataacggtatcaaaaagtgggatctcgatcagcaggagctgattcagcagattcctaacgctcacaaagattgggtatgcgctctggctttcattccgggaaggccgatgttactgagcgcgtgtagagctggggtgatcaaagtttggaatgtagataatttcactcctattggcgaaatcaaggggcacgactccccaatcaacgcgatctgcacaaacgctaagcacatattcacagcatcaagcgactgccgtgtcaaactatggaattatgtaccagggcttaccccgtgcctacctagacgagtgctggccatcaaaggaagagcgaccactctcccatag

SEQ ID NO: 227839 - DNA, 4872 bp, Artificial Sequence
  Description of Artificial Sequence: Synthetic coding sequence
atggcagggcaaggggactgttgcgtcaaagtggctgtgcggattcgccctcaactgtcaaaggagaagattgaaggatgtcatatctgtacatccgtgacacccggagagccacaagtgctgttaggcaaggacaaggcctttacttacgatttcgtgtttgatttggacacctggcaggaacagatatattcaacctgtgtttctaagcttattgagggctgcttcgagggctacaatgctactgtgctcgcgtacggtcaaaccggcgcaggcaaaacctatactatgggcacagggttcgacatggctaccagcgaggaggaacaaggcatcatcccacgagctatcgctcatttgtttggcggaatcgcagagcggaagcgcagagcgcaggagcaaggtgttgcaggacctgaattcaaagtgtctgcacaattcctcgagctatataacgaggagatcctggacctcttcgactcaacacgagaccccgacacacgacaccgcaggtccaacattaaaattcacgaggacgccaatgggggaatctataccaccggtgtcactagtagactcattcacagtcaagaggagctcattcaatgcctcaagcagggcgctttgtcacgtaccacagccagcactcaaatgaatgttcagagttcacggtcacatgcaatttttactattcatctgtgccagatgcgcatgtgcacccagcctgatctggtgaacgaagcagttaccgggctgccggacggtacccctccatcttccgagtacgaaactctgacggctaaattccacttcgtggacttagccggaagcgagcgcctgaagcgcaccggtgctacgggcgagagggcaaaagaaggaatctccatcaactgtggattgctggccttagggaacgtcattagcgctctgggggaccagtccaaaaaagtggtccatgtgccataccgggactcaaaactcacccggctgctccaagattcgcttggcggtaactcccagaccatcatgatcgcttgtgtgagtccctccgacagagactttatggagaccttaaatactcttaaatacgcgaaccgcgcacgtaacataaagaataaggtagtcgtgaatcaggacaagaccagtcagcagattagtgccctgcgagccgagatcgccaggttgcagatggaattgatggagtacaaggcaggaaagagggttataggcgaggatggagccgaaggatattccgacctatttagagagaatgccatgcttcagaaggagaacggagcactgaggctgcgagtcaaagctatgcaggaggccatcgacgccataaacaatagggttacccagctcatgtcccaggaggccaatctgctgctggcgaaagcgggagacgggaatgaggccatcggagcactgatacagaactatatccgagagattgaagagcttcggaccaaactgctggagagtgaagctatgaacgagtcacttcggcgtagcctgtcaagagcgagcgcacgcagtccgtactccctgggcgcttcccctgcagcgccagcattcgggggaagtccagcctcctcaatggaagacgcttcggaggtcattagaagggccaaacaggacttagaaaggctgaagaagaaggaagtacgccagcggaggaagtcgccggagaaagaagcttttaaaaagcgggctaagctgcaacaggaaaattctgaggaaactgacgaaaacgaggctgaagaagaggaggaggagcgggacgaatctggatgtgaggaagaagagggcagagaggatgaagatgaggattcaggatctgaggagagcttggtggacagcgactcggatccagaggagaaggaagtcaatttccaggctgatctggccgacctgacatgcgagattgagatcaagcagaagctcatagatgaattagagaactctcagaggcggctccagacgctgaaacatcagtacgaggagaagctaatcttactccagaacaaaattcgcgacacccagttagaaagggatcgggtactgcagaatctgagcacaatggagtgttatactgaagaaaaagctaacaaaattaaagctgactatgaaaagaggttgagggagatgaatagggacttgcaaaaactccaggccgctcagaaagaacacgcaaggctgctaaagaaccagtcgcgctacgagagggaattgaagaaattgcaggcagaagtggcggagatgaaaaaagctaaggtcgctctgatgaaacaaatgagggaggagcagcagagaaggcgtctagtggaaaccaaacggaatagggagatcgcccaacttaagaaagagcagcgaaggcaagagttccagatccgtgccttggaatcccagaaacgccagcaggaaatggttttacgacggaagactcaggaagtctccgctttgcgtagacttgccaaaccgatgtctgaacgggtggcaggcagagccggactgaaacctccaatgttggacagtggcgctgaggttagcgcaagtaccacaagctcagaggccgagtccggtgccagatctgtgtccagtatcgttcgccaatggaatagaaagatcaaccactttctgggggatcacccagctcccacagtcaacgggactcgacccgctcggaagaagttccagaaaaagggagcgagtcagtctttctctaaagcagctaggctgaaatggcaatctctggagcggcgtataatcgacatcgtgatgcaacgcatgacaatcgtgaatctcgaggcagacatggaacgcttaatcaagaagagagaagaactcttcttgctccaagaagctcttagacggaaaagggaaaggcttcaggctgagtctcccgaggaggaaaaggggctccaggagctcgccgaagagattgaagtgttggccgcaaacattgactacatcaacgacgggattaccgattgccaagccaccatcgttcagttggaagagaccaaggaggagttggatagtacagataccagtgtcgtcatttcttcttgtagccttgcagaagccagactgctgttagacaacttcctaaaagcaagcatagataaaggcttacaggttgcccagaaggaggctcagattcggttgctcgaagggaggctgagacagaccgacatggcgggtagcagccaaaaccatctgctactggatgcacttcgtgagaaagcagaggctcatcccgagctccaggctctcatatataatgtgcaacaggagaatggctacgctagcaccgatgaggaaatctccgaattcagcgagggtagcttcagtcagagtttcaccatgaaaggcagtactagtcacgacgatttcaagttcaaatcagaaccgaagctgtcggcacagatgaaggcagtatccgctgagtgcctcgggccacccctggacattagcaccaagaacatcaccaagtcccttgcgtcactggtggaaataaaagaggatggcgtgggcttttctgtgagagatccctactaccgtgaccgcgtttctcggacagtgagcctccccaccagagggtcaaccttccccagacagagtagggcaactgagaccagcccgctcacccgtcgcaaaagttatgatagaggacagccgattcgcagtaccgacgtcggtttcactcccccttccagtccgccaacccggccacggaacgaccggaacgtgttttccaggctgacatctaatcagagccaaggctccgccctcgataaaagtgacgactccgactcctcactgagtgaagtgcttcggggtattatcagtccggtgggcggtgctaagggcgctcgcactgcacctctgcagtgcgtgtccatggctgagggacatacaaaaccgatactgtgtctagacgccacggacgaactgctttttacaggcagcaaagacagatcatgtaaaatgtggaatctagttactggccaggagatagccgctctgaaggggcatcctaataacgtagtatctatcaagtactgtagtcattcaggcctggttttcagcgtcagtacctcctacattaaggtgtgggacatcagagattctgccaagtgcatacgaacccttacaagcagtggtcaggtgatctccggcgacgcttgcgcagcaacttctactcgggctatcacatctgctcaaggcgagcaccagatcaaccaaatcgcactttccccatcaggcacaatgctatatgctgcaagtggtaacgccgtgcgtatttgggagctgagccgcttccagccagtgggaaaacttaccggtcatatcggacccgtaatgtgtctgactgtgacacagaccgcctcccagcacgacctggtggtgaccgggtccaaggatcattatgtcaagatgttcgaactcggtgagtgtgtgacgggaacgatcggacccacacataacttcgaacctccccactatgacggtatcgagtgcctggccatccagggcgacattttgttctccggatctcgcgacaatggtattaaaaaatgggacctcgatcagcaggaactgatccagcagattccaaatgcccacaaagattgggtttgcgctttggccttcatcccaggaagaccaatgcttctttcagcctgccgtgctggagttatcaaggtctggaacgtagacaacttcaccccaatcggcgagataaaaggtcacgacagcccaatcaacgcaatttgtactaatgctaagcatattttcactgcgtcctctgacctgacggtgaagttttggagcgttagacgactgccacattccggtccaccctag

SEQ ID NO: 227840 - DNA, 5007 bp, Artificial Sequence
  Description of Artificial Sequence: Synthetic coding sequence
atggctgggcaaggagactgctgtgttaaagtcgctgtaaggatcaggcctcagctcagtaaggagaagatagaagggtgtcatatctgtacatcagtgacacccggagagccccaggtgctgcttgggaaggacaaggcgttcacatatgattttgtgttcgaccttgacacctggcaggagcagatatacagtacatgtgtgtctaagctgatcgagggctgttttgaggggtacaacgctacggtgcttgcatacggtcagactggtgccggaaaaacatacaccatgggcaccggcttcgacatggctaccagtgaagaggaacagggcatcattccacgtgcaatagcacacttgtttgggggtatcgccgaaaggaaacggagggcccaagagcagggcgtagccggacctgaatttaaggtgagcgcacagttcctcgagctttataacgaggagattttagatctcttcgattctactcgagaccctgatacccggcatcggaggtccaacatcaagatccatgaggatgctaatggtggcatctatactacaggagtgacttcccgtctgatccatagccaggaggagctcatccaatgtttgaaacagggcgcattatcacgaactacagccagtacccaaatgaatgtgcagagctcccgcagtcacgccatcttcacgattcatctgtgtcagatgcgcatgtgcacccagcccgacctcgtcaatgaggcagtgactggcctgccagatggtacccctccttcctccgaatacgaaacgttgacagctaaatttcattttgtagacctcgcagggtccgagcggctcaagaggaccggggctaccggcgagagagctaaagaaggcatctctatcaattgtgggctattggctctggggaacgtgatttctgcactgggggatcagagcaagaaagtggtgcatgtaccatatcgggactcaaagttgacccggctgctgcaggatagccttgggggaaactctcagactatcatgatcgcttgcgtaagccctagtgaccgggacttcatggaaaccctcaacaccctgaagtacgccaatagagccagaaatatcaagaataaggtggtggtgaaccaggataagacctcccaacagatctccgcattgcgggctgagatcgcccgactccagatggaactgatggagtataaggccggtaaaagagttatcggtgaggatggcgctgaggggtactcggatctgttccgggaaaatgcgatgttgcagaaagaaaacggggctctgagacttcgcgtcaaggccatgcaggaagctatcgacgccatcaataatcgggttacgcagctgatgagccaggaggctaacctcctcctcgctaaggctggagatggtaatgaggccatcggcgcactaatccagaactacatccgagagattgaggaactgcggaccaaactgctcgaatctgaagcaatgaatgaatcactccgtagaagcctgtctcgggcttcagctcgtagtccttactccctgggcgcttcccctgccgctcctgcattcggcggttctcccgcatccagcatggaggatgcatcagaggtcatcagaagagctaaacaggatcttgaacggcttaagaagaaggaggtcagacagagaagaaaaagccctgaaaaggaagcattcaagaaaagggccaagctgcaacaggagaactctgaagagaccgatgagaacgaagctgaggaagaggaggaggaaagggatgaatccggctgcgaggaggaagaaggccgtgaagatgaggacgaagactctggctccgaggagtctcttgttgacagtgatagtgatccagaagaaaaagaagttaactttcaggccgatttggcagatctcacctgcgagatagagatcaagcaaaaattgatcgacgaactggaaaactcacaaaggagactgcagacattaaagcaccagtatgaggagaagctgatcctactccagaacaagatccgcgatacacagttggagcgagatcgtgttctacaaaacttgagtactatggaatgttataccgaagagaaggccaacaagattaaagcggattatgagaagagattacgcgagatgaaccgagatctccaaaaacttcaagccgctcaaaaggagcacgcacggctcttaaagaatcagtcccggtatgagcgcgaactaaagaagctgcaggcagaagtggctgaaatgaaaaaggccaaagtcgccctgatgaaacagatgagagaagagcagcagcgcagaagactcgtggagaccaagcgcaaccgtgaaatcgctcagctgaagaaggaacagcggagacaggaattccaaatcagggccctggagtcccagaagaggcaacaggagatggtgctgagaagaaaaacccaggaggtctccgccctgcgtcgtttggctaaacccatgagcgagcgcgtggctggacgtgcgggactgaagccacccatgctagactccggcgctgaggtgtccgccagcaccaccagctctgaggctgaatctggcgctcgaagtgtctcaagtatagtccgacagtggaacagaaagattaaccatttcctcggggatcatcctgctccgacagtgaacgggacaaggcccgctaggaagaagttccagaagaaaggggcatctcagtctttctcaaaggcggctcgcctgaagtggcagtcactggaacggcgaatcatagacatcgtgatgcagagaatgacgatcgttaatctggaagcagatatggagcggttaatcaagaagcgtgaagagcttttcctgctgcaggaagcccttcgcaggaaaagagaaagactacaagcagaaagtcctgaagaagaaaagggcttgcaagagcttgccgaagagatcgaagtacttgccgctaacatcgactatattaacgatggaataaccgactgtcaggctactatcgtgcagctagaagagacaaaggaagaactggactctaccgacacatcggtggtaataagctcttgcagcctagccgaagcccgactcctcctggataacttcctcaaggcgagcattgacaagggattgcaagtcgcgcagaaagaggcccagatcaggctgctggagggcagactgcggcaaactgacatggccggaagctcacagaaccatctgctgctggacgcactccgggaaaaggcggaagcacaccccgaactccaagcactgatctacaatgttcagcaggagaacgggtatgcatccaccgatgaggagatctccgagttcagcgagggtagtttcagccagagttttacgatgaagggctcgacctcacacgatgattttaaattcaagagcgaacccaaactgagtgctcaaatgaaagccgtgagcgccgaatgtctggggccacctctcgatatcagtacgaaaaacattacgaaatcactggctagtcttgtggagatcaaggaagatggtgtgggattctccgttcgggatccctattatcgcgatagggtcagccggactgtgtccctgcctactcgtgggagcacatttccgaggcagagtagagcgacagagacctccccccttacccgcagaaaatcctatgataggggccagcctatccggtccactgacgtgggatttactcctcccagtagtccgcctactcgtccacgcaacgaccggaacgttttttcaagactgactagtaaccaaagtcaaggatcagcgctggataagtctgacgatagtgattcatccttgtccgaggtgttacgcggtatcattagcccagtgggaggcgctaaaggcgctcgaacagccccacttcagtgcgtgtcaatggctgaaggccacacaaagcctatcctgtgtctggacgcaacagatgaactgctatttaccggctccaaggacagatcctgtaaaatgtggaatttggtcacgggccaggagatcgccgctttgaaggggcaccccaataacgtggtctctatcaagtactgtagtcactccggtctggtgtttagcgtatccaccagttatattaaagtctgggatattcgtgattctgctaagtgtatccggactttaactagcagcggacaggtgattagcggcgacgcatgtgctgcaacaagtacccgcgcaattacttcagcgcagggagagcatcaaatcaaccagatcgcactgtcacctagcgggacaatgctgtacgccgcttctggaaatgctgtccggatctgggaactcagccgtttccaacccgttgggaaactcacgggacatattggcccagtgatgtgcttgacggtcacacaaaccgcatcacagcacgatctcgtggtcacaggctcaaaagaccactatgtcaaaatgttcgaactgggagagtgtgtgacaggcactatcggacctacacataatttcgaacctccacactatgatggaatcgaatgcctcgcgattcaaggggacattctgttttctggcagcagggataatgggatcaaaaaatgggaccttgatcagcaggaactgatccaacagatcccaaatgcgcataaagactgggtgtgtgctcttgcctttatcccagggcgaccaatgctgctgtccgcctgtcgggcaggcgtcatcaaggtctggaacgtggataatttcacccctattggcgaaattaagggacatgacagccccattaatgccatttgcacaaacgcaaagcatatatttactgcgagctccgattgccgagtcaaactttggaactacgtacccggattaactccctgcttacccagaagagttttggctatcaagggcagggccactacatgtcccgatccgccacagctgagcttatcaccattgagcttctttccctccttcctttttcctctgttcccccactttgatctctcctgttttctgacttag

SEQ ID NO: 227841 - DNA, 1998 bp, Artificial Sequence
  Description of Artificial Sequence: Synthetic coding sequence
atggcggcaggcggaagcacccagcagcgacgtcgggagatggctgccgcttccgctgctgccatctcgggggcagggaggtgccgcctatctaaaattggcgcaacccggaggccacctcccgcaagagttcgggtagcggtgaggttgcggccattcgtagatggaaccgccggtgcctctgaccctccatgcgttcgcggtatggatagttgctccctggagatcgcaaactggaggaaccatcaggagaccttaaaatatcaattcgacgctttttacggggagaggagtactcaacaagacatttatgccggttctgtacagccaattctccgccacttactcgaaggccagaatgcctccgtcctggcttacggaccaacgggcgcaggcaagactcataccatgctgggaagccctgagcagcctggcgtgatacccagggcactgatggatctgttgcagctgactcgggaggagggcgctgaggggagaccctgggctctatctgtgacaatgtcttatttagagatataccaggaaaaagtgctggatctcttagaccctgcttcgggcgatttagtgatcagagaagattgcagaggcaacatcctaataccaggactgagtcagaagcctatctcatcctttgcagacttcgagcgccacttcttaccggcatcccgtaatcggactgttggcgctacacgtctgaatcagcggtcttctcgaagccatgccgtgctgttggtgaaggtggatcagcgtgaaaggctcgctccatttcggcagagagagggtaaactctacctgatcgatctcgccggatcagaggacaatcgtagaactggcaacaaaggcctacgattgaaggaaagtggcgcaatcaatacttcactgttcgtccttggaaaagtcgtggacgccctgaaccagggacttccacgcgtgccctaccgggattccaagcttacccgccttctgcaggactctcttggcggatccgctcactcaatcctgatcgcgaacatcgcccctgaacggaggttctacctggatacggtctccgctctgaactttgccgcaagatctaaagaagtgattaatcgaccctttacaaacgaaagcctgcagccacatgctctgggccctgtaaagctgagccaaaaggaactgctcggtccaccagaagcgaaacgcgcacggggtccagaggaagaggagatcgggtcgcccgagcccatggccgctccggcatccgcttctcagaaattatcccctcttcagaagctcagctctatggaccccgcaatgctcgagaggttactgtccctggatcggctgctcgcctctcagggctcacagggcgctcctctcctctccacgccaaagagggaaagaatggtactcatgaagacagtggaagagaaggacctcgaaattgaacgcttgaagaccaaacaaaaggagctggaggcaaaaatgctggcccagaaagccgaagaaaaggaaaatcattgtccgacaatgcttcgtcccctttcccaccgaaccgtcacgggggctaagcctctcaaaaaagctgtggtgatgcctctgcagttgatccaggaacaggccgcttctccgaatgcggagattcacatccttaagaacaaggggcgaaaacgcaagctcgagtcattggatgccctggagccagaggagaaagccgaggattgttgggagcttcagatctcccctgaattgcttgcccatggacgacagaaaattttagacctcctgaacgaaggctccgcccgagacttgagaagcttgcagcgcattggacccaaaaaggcccagctgatcgtcggatggagagagcttcatgggccattctcccaggttgaggatctcgagagggttgagggcatcaccggtaaacagatggaatccttcctaaaagcaaacatacttggcctggccgcagggcagcgatgtggggcttcttag

SEQ ID NO: 227842 - DNA, 219 bp, Artificial Sequence
  Description of Artificial Sequence: Synthetic coding sequence
atgctggcccaaaaggctgaggagaaggaaaaccattgccctactatgcttagaccactaagtcacaggaccgtgaccggtgcgaagcctctcaagaaggctgtcgtgatgccccttcagttgatacaggaacaggccgcaagccccaacgcagaaattcacatcctcaagaataaagggaggaaaagaaagggcgcaaacataacaactggctattag

SEQ ID NO: 227843 - DNA, 1794 bp, Artificial Sequence
  Description of Artificial Sequence: Synthetic coding sequence
atggacagctgcagcttggagatagccaactggagaaaccaccaggagactctgaagtatcagttcgatgccttctacggggagaggtctactcagcaggatatttatgcgggaagtgtgcagccaatcctgcgacaccttctggaggggcaaaacgcaagcgtgttggcctacggcccaaccggggctggcaagacccacactatgcttggcagccctgagcagcccggagtcattcctcgcgcactcatggacctactccagctgaccagagaggaaggagccgagggcagaccctgggcactgtccgtgaccatgtcctatttggagatttaccaagagaaggtgctcgatctacttgaccctgcctctggcgatttggtcatacgcgaggattgcaggggcaacatcctgatccccggactgtcccagaagccgattagttcattcgctgattttgaacgtcacttcctcccagcaagtagaaaccggacggtgggagctacccgtctgaatcagcgaagctccaggagtcatgccgttctcttggttaaggtcgatcaacgcgaaaggttagcaccatttcgccagagagagggaaagctttatctgatcgatctagctgggagcgaggacaacaggagaacaggcaataaaggtctgcgactaaaggagtctggcgcaattaatacatctctgtttgtgttggggaaagtcgtcgatgccctgaatcaggggctcccaagagtgccctaccgcgattccaagctgactcggctgctgcaggatagcttaggagggtccgcccattcaatcctgatcgccaatatcgcaccggaaaggcggttctatttggatactgttagtgccctgaacttcgccgctcgatcaaaagaagttatcaatcgcccatttacgaacgaatcgttacagccacacgcactcggccctgtaaaacttagtcagaaggaattgctcggcccaccagaggccaaaagggcaagggggcctgaggaggaggaaatcggtagtcccgaacccatggcagccccagcttcagcctctcagaaactaagtccattgcagaagctgtcttctatggacccggctatgctggaaagactgttgagcttggatcgcctgcttgctagccagggttctcaaggtgctccactgctttctacccccaagagggagagaatggtattaatgaagactgttgaagagaaggacttagaaattgagaggttaaagaccaagcaaaaggagctggaggcaaagatgctggcgcagaaggccgaggagaaagagaaccactgccctactatgttacgccctttgtctcaccgcacggttacgggtgccaagcctctgaaaaaggctgttgtcatgccactgcaactgattcaggagcaagccgcaagccctaacgccgaaatccacatattgaagaataaagggcgtaagagaaagctcgagtcactggacgccctagaaccagaggaaaaggctgaagactgctgggagctgcagatttcccccgaactgttggcgcatggcagacagaaaatccttgatttgttgaacgagggcagcgccagggacctcaggagcctgcaacgtatcggacccaaaaaggcccagctcatcgtgggatggcgtgagttgcatggaccgtttagtcaggtagaggacctggagcgggttgaggggataacaggcaagcaaatggagtccttcctgaaggctaacatcctggggttggcggcagggcagcgatgcggcgcatcctag

SEQ ID NO: 227844 - DNA, 1794 bp, Artificial Sequence
  Description of Artificial Sequence: Synthetic coding sequence
atggacagctgcagccttgaaatcgccaattggaggaaccatcaagagacactgaagtaccagttcgatgccttctacggcgaacgctccacacagcaagatatttatgccggatccgtgcagccaatactgcgacatctgctggagggccagaatgcttcagtcctcgcatacggcccaactggagcaggcaagactcataccatgctgggatctccggaacagcccggagtgattcctcgggcactcatggacctactgcagctcactcgcgaagagggcgctgaaggacggccatgggctctgtccgttacaatgagctacctagagatctaccaggaaaaagtactcgatcttctcgacccagctagcggcgacctggtgatccgcgaggactgccgaggtaacatacttattccgggtttaagccagaaacccatttctagcttcgcagacttcgaacgccactttctgccagccagccggaatcgcaccgtgggagctacccgtctgaaccagcgctcctcccgcagccacgcagtactcttagtcaaggtggaccagagggaacgcttggccccattccggcagagggaaggtaaactctatcttatagacctggctggcagtgaggacaacaggcgtactggaaacaaagggctgcgactcaaagagtcaggcgcaatcaatacttcacttttcgtgctcgggaaagttgtggacgctcttaaccaagggcttcccagggtgccttatcgggatagcaaactgactaggctgctgcaggactcactgggcggaagcgcacactctatactgatcgccaatatcgctcctgagaggaggttctaccttgatactgtttccgccctaaacttcgcagctagatcaaaagaggttataaatcggccttttactaatgagtcgttacaaccccatgcgttaggtccagttaagctgtctcaaaaggagctgctgggaccgccagaagccaaaagggctaggggccctgaagaggaagaaattgggtccccagagcccatggcggctcctgcgtctgcctcccagaagcttagcccgcttcaaaagttgtctagcatggaccccgctatgctggagcggttactttccctcgatagactgctggccagccaaggaagtcagggagctccactactgagcacgcccaagcgggaaagaatggtattgatgaaaaccgtcgaggagaaggacttggagatcgagagactgaagacaaaacagaaagaactggaggcaaaaatgctggcccagaaggcggaagagaaagagaaccactgccccacaatgttgaggccccttagtcaccggaccgttaccggggcaaagcccctgaaaaaggccgtcgtcatgccgcttcagctcattcaggaacaggctgcatctcctaatgctgagattcacattctgaaaaacaagggacggaagcggaaactggagtcgctggacgccctcgaaccagaggagaaggctgaggattgctgggagttacaaatttcacctgaactgctcgcacatggcaggcagaagattcttgacttacttaacgaagggtctgcaagagacctcaggtcactgcagcgaatcggacctaagaaggctcagctgatcgtggggtggagggagcttcatggcccatttagccaggttgaagatctagagcgcgttgagggaatcacaggtaagcagatggagagctttctgaaggccaacatcctgggcctggctgccggtcagcgctgcggagcatcctag

SEQ ID NO: 227845 - DNA, 2883 bp, Artificial Sequence
  Description of Artificial Sequence: Synthetic coding sequence
atgaagtcagctagagccaagactcctcgaaaacctacggtgaaaaaaggatctcagacgaacttaaaggacccggttggtgtatattgccgcgtgcggccacttgggttccctgatcaagaatgctgtatcgaggttattaataataccacagtccagctccacacacccgagggctatagactgaatcggaacggagactacaaagaaacgcagtacagttttaaacaggtgtttggaacccacacgacccaaaaggagctttttgacgtggtcgccaacccactcgtgaatgatctgattcatggcaaaaatggtctgttgttcacctatggagtcaccggaagcggaaaaacccatacaatgacaggttctcccggtgaaggcggactcctgccacgttgtttggatatgattttcaacagcatcggaagttttcaagcgaagaggtatgtgttcaagtccaacgaccggaactccatggacatccaatgcgaggtcgatgccctgttggagcgccaaaaacgagaagcgatgccaaaccccaagacatcatctagcaaacggcaggtcgacccagaattcgctgacatgatcaccgtacaggagttttgcaaagcagaggaggtggatgaagactcagtgtatggggtctttgtgtcctatatagaaatttataacaactacatctacgatttgctagaagaagtgccattcgacccaataaagcccaaacccccacagagcaagctgctaagggaggacaagaaccataacatgtatgtggccggatgcacagaagtggaagtcaaaagcacagaagaggcttttgaggtgttctggagaggacagaaaaagcggagaattgcaaatactcatttgaacagggaatcatcgcggtcgcatagtgtctttaacatcaagctcgtgcaggctcctctggacgccgacggagataacgtgctccaggaaaaggaacagataaccatctcccagttaagcctagtcgacctggcgggatcagagcgaactaataggacgcgagcggagggcaatagactgcgagaggcaggcaacattaaccagagtctgatgaccctgaggacctgcatggatgtcctccgtgagaatcagatgtacggcacaaataagatggtcccgtatcgcgacagcaaactgacccacctcttcaagaattattttgatggggaagggaaggtgcgcatgatcgtctgcgttaatcccaaggctgaagactatgaggagaatctgcaggtgatgagatttgccgaggttactcaggaggtggaagtggccaggcctgtggataaggcaatctgcgggctgacccccggacgacgataccgtaaccagccaagggggcctgtgggaaacgaaccacttgtcactgatgttgtgctgcaaagcttcccacctcttccctcctgcgaaattctggacatcaacgatgaacagactcttcccagattgatcgaagccctggagaaacgccacaatctgcgccaaatgatgatcgacgagtttaacaaacaaagcaatgctttcaaggcactgctacaagagtttgacaatgccgtgctatccaaggagaatcatatgcagggcaaactgaatgagaaagaaaagatgatttcaggccagaagctcgagatcgagcggctagaaaaaaagaataaaactttggagtataaaatcgaaatcttagagaagacaaccacaatttatgaggaagataaacgaaacctgcaacaggaactcgaaacgcagaatcagaaactgcagagacagttttccgacaagcggagactggaagctagactgcaaggtatggtcaccgaaaccaccatgaaatgggagaaggaatgcgagcgacgggtagccgcaaaacaactcgaaatgcagaataagctttgggtcaaggacgagaagctcaagcagttgaaagcaattgtgacagaacccaaaactgaaaaacctgagcgcccttcgagggaaagagatcgcgagaaggtgactcagcgctctgtgagccccagtccagtacctctcagcagtaactatatcgctcagatttctaacggacagcagctgatgtctcaacctcagctccaccgcagatctaactcatgtagctctatctctgtggccagctgcatctccgagtgggaacagaaaatccccacatacaatacacctcttaaggtaacctctattgcaagaagacgacagcaggagcctgggcagagcaagacttgcattgtaagtgatcggagacggggtatgtactggaccgagggtagggaggtggtgccgaccttcagaaatgagattgagattgaggaggatcactgcggaaggctcctgttccagcctgaccaaaatgcgcctcccatcagactacggcatcgcagatcaaggagcgcaggagatagatgggtggaccataagcctgcatctaatatgcagaccgaaaccgttatgcagccgcatgttccacacgccataacagtgtccgtggctaacgaaaaagctctggccaagtgtgagaagtacatgctgactcatcaggaattggcgtccgatggcgaaatcgagacgaagctcatcaaaggggacatctacaagacacgtggaggaggacagagcgtgcaatttactgatatcgaaaccctgaagcaggaatcaccaaatggttctcgtaagcggcgaagttccacagtggctcctgctcagcccgacggagccgaaagcgaatggaccgacgttgaaacccggtgttccgtcgctgtggagatgcgagcaggatcccagttgggaccaggctaccagcatcatgcccaaccaaagagaaagaagccatag

SEQ ID NO: 227846 - DNA, 2022 bp, Artificial Sequence
  Description of Artificial Sequence: Synthetic coding sequence
atgatcacggtccaggagttttgcaaggctgaggaggttgatgaagatagcgtgtatggcgtttttgtctcctatattgagatttacaataactacatttacgacctcttggaagaagtcccattcgatccaattaaacccaagtggaacagctgctcaacacccatgagaaacaccgatttcgtgccccctcagtcaaagctcttacgagaggataaaaaccataatatgtacgtggccggatgtacagaggttgaagtgaagagcactgaggaggcgttcgaagtgttctggaggggccagaagaagcgcaggatagcaaacactcacctgaaccgagagagctccagatcacatagtgtgttcaacatcaaactcgtgcaagctccactcgacgctgatggtgacaacgttcttcaggaaaaggagcagattaccatttcgcaactgagcctggtggacctggccggaagcgaacgaactaatcgcacccgtgccgaaggcaataggctgcgggaggcaggcaacataaaccagagtttgatgacgctgcggacatgtatggacgtcctacgtgaaaatcagatgtacggcaccaataaaatggtaccatacagagatagcaaacttactcatctctttaagaactacttcgacggtgagggtaaggtgcgcatgattgtatgcgttaaccccaaggccgaagactatgaagagaacctgcaggttatgcgcttcgccgaggtgacacaagaagtggaggtggccaggcccgtggataaagcaatctgtggcttaactcctggacgtcggtaccggaatcagccccgtgggcctgtgggcaatgagccactggtaactgacgttgtcctgcaatcgttcccgcctctgcccagctgcgagattctcgacattaatgatgagcagacactccccaggcttatcgaggcacttgagaaacgccacaacttaagacagatgatgatcgatgaattcaataagcagtccaatgcatttaaagccctgctgcaggagtttgacaacgccgtgcttagcaaagaaaaccacatgcagggcaagttgaacgagaaggagaaaatgatcagcggccagaagctagagatcgaacgtctcgagaagaagaacaagacactggagtacaagatagagatccttgaaaagaccacaactatctacgaagaggacaaaaggaatctgcaacaggaactcgagactcagaatcaaaagctgcagcgccaattttccgacaagcgtaggttggaggcacggcttcagggcatggttaccgagacaaccatgaagtgggaaaaggagtgcgaaaggagggtggctgctaagcagctggagatgcagaacaagctgtgggtgaaggatgaaaagctgaagcagttaaaggcaatcgttaccgagcccaaaactgaaaagcctgaaaggccttcacgcgaaagagatagggaaaaggtcacacaacggagtgtgtccccatcacctgtccctctgttatttcaaccagatcagaatgcacccccaattagactgagacaccggagatccagatccgccggtgatcggtgggtcgatcataagccagcaagcaacatgcagacagaaacggtgatgcaaccccacgttccgcatgccattacagtgtctgttgctaacgagaaggcactcgccaaatgtgagaaatacatgctcacacaccaagaattggcgagcgatggggaaatcgaaacaaaattaatcaagggcgatatctacaaaacgcgcggtggcggacaaagtgttcagttcaccgatattgagactctgaagcaggaatctccgaacggcagtaggaagcgaaggtcctccacggtggcacccgctcagcctgatggagccgagtcagagtggactgacgtagagacccgatgttcggtggctgtggagatgagagccggatcacagctgggtccaggttaccagcatcatgcacagcccaagcgcaagaagccttag

SEQ ID NO: 227847 - DNA, 2022 bp, Artificial Sequence
  Description of Artificial Sequence: Synthetic coding sequence
atgatcacagtgcaggaattctgtaaagccgaggaggttgacgaggacagcgtgtatggggtctttgtgagctatatcgagatttacaataattatatatatgacttactggaagaagttccttttgaccccataaaacccaagtggaattcttgtagtacacccatgcggaatacggactttgtgcctccccagtccaagcttcttcgtgaggacaagaaccataacatgtacgtggccggttgtaccgaggttgaggtgaagtccactgaggaggcctttgaggtattttggcgaggtcaaaaaaaacggagaatcgcaaatacacacctgaatagggaaagctcccgaagtcactccgtattcaatatcaagctggtgcaggcccctctggatgccgatggggataatgtactgcaggagaaggagcagattacaatcagccagttaagtctcgtggatctcgcgggttcggagcggaccaaccgcacaagggccgagggcaaccgtttacgcgaggccggaaatatcaaccaatccctaatgacattacggacatgcatggatgttttgcgggaaaaccagatgtatggcaccaacaagatggtcccctatcgagactctaaacttacccacctctttaaaaactacttcgacggagaaggaaaagttaggatgattgtgtgcgttaacccaaaggccgaggactacgaggagaacctgcaagtgatgaggtttgcagaggtgacacaggaagtcgaggttgccaggcccgtcgataaggccatctgcgggttgacacccggacggaggtatcgaaaccagcccagaggccctgtcggtaatgagcctctggtgacggatgttgtcctccaatccttccctcctctcccgagctgtgagatcctagatatcaatgatgaacagacactccctcgactcatagaggcactggagaagcgccataatctccggcaaatgatgatcgatgaattcaacaagcaatccaatgcatttaaagccctgctccaggagtttgacaatgccgttctatccaaagagaaccatatgcaggggaaattgaatgaaaaggagaaaatgatcagcggccagaagctggagatcgagcggctggagaagaagaataagacactggagtataaaatcgaaatattagagaaaactaccacaatctacgaggaggacaaaaggaatcttcaacaggagcttgagactcaaaaccaaaaattgcagcgccaattctctgataaaagacggttagaggctaggctgcagggaatggtcactgagactacaatgaagtgggaaaaggagtgtgagcggagggtggccgctaaacaacttgagatgcaaaataagttgtgggtcaaagatgaaaaactcaagcagctgaaggctattgtgaccgaaccaaaaacagaaaaacccgaaagaccatcgcgcgagcgcgacagagagaaagtgactcagcgctccgtgagcccatctccggtgccactccttttccaacctgatcagaatgctccacccatcagactaaggcaccgtcggtcccggtcagcaggtgaccgctgggtggatcacaagcctgcgagtaacatgcagactgaaacagtgatgcagcctcacgttcctcatgcaatcacagtatcagtcgcgaacgaaaaagccttggccaaatgcgaaaagtacatgctgacgcaccaggagctagcatctgacggcgaaattgagacgaaactgattaagggagatatctataagacaaggggaggaggacagagcgtccagtttacagatattgaaacgctgaaacaggaaagtcccaatggaagcagaaagcggagatccagcaccgtggcacccgcacagcccgacggcgctgagtccgaatggacagatgttgaaactcgatgctcagtggcagtggaaatgagagccggatcgcaattggggccagggtaccagcaccacgctcaaccgaagaggaagaagccttag

SEQ ID NO: 227848 - DNA, 2571 bp, Artificial Sequence
  Description of Artificial Sequence: Synthetic coding sequence
atgaaaagtgcccgagctaagacgccgaggaagcccacggtcaagaaaggaagccagactaacctaaaagacccggttggcgtctattgccgggtaagaccacttggatttcccgaccaggagtgttgtatcgaggtaattaacaacaccacagttcagctgcacacacccgaggggtataggctgaacaggaacggcgattataaagagacccagtactcattcaagcaggtgttcggcacgcatacaacccagaaggaactgttcgatgtcgtcgcaaatccactggtcaatgatctgattcatggcaagaacggcctcttgttcacctacggtgttactggctccggaaaaacacacacaatgaccggatcaccgggtgaaggcggactgctcccgcgttgcctggatatgattttcaatagcataggttcatttcaagctaaaaggtatgtctttaagtccaacgaccggaactccatggacatacaatgcgaagtggacgcgctgctggaaagacaaaaacgggaagccatgccaaaccctaaaaccagttcttccaagcgccaagtggatccagaattcgctgacatgatcaccgtgcaagaattctgtaaggcagaggaagtggacgaggattccgtttatggcgtgttcgtgtcatacattgaaatttacaacaactatatatacgacctccttgaggaagtcccgtttgaccctattaaacccaagccaccccagtctaagctcttgagagaagataagaatcataacatgtacgtggccggatgtaccgaagtcgaagtcaagtccaccgaagaggcctttgaggtgttttggcgaggccagaaaaagaggcgaattgccaacactcaccttaaccgagagagttctcgctcccacagcgttttcaacatcaagctggtgcaggcccctctggacgctgacggtgataatgtactacaggaaaaggagcagatcactatttctcagctttccctagtggacctagcgggtagtgagcggacaaatcgcaccagggccgagggaaatcggctgagggaggccggtaacatcaaccagagcctgatgacactgaggacatgcatggatgtgctaagagaaaaccagatgtatggtactaacaagatggtgccatacagggactctaaattaacccacctgtttaaaaactacttcgatggggaggggaaagttagaatgatcgtttgcgtgaacccaaaggctgaggattacgaggaaaatctccaggtgatgcgctttgctgaggtaactcaagaggtagaagtggcaagaccagtggacaaggctatttgcggtctgactcctggcagacgctacagaaaccaaccccgaggtcccgtgggaaacgagccactggtgactgacgtggttctccagtcattccctcccttgcctagctgtgaaatcctagacatcaatgatgaacagacgctgccgaggctcatcgaggcactggagaaacgacataacctacgacagatgatgattgacgagttcaataaacagtcaaatgcctttaaggctttgctccaggagtttgacaatgcagttctttcaaaggagaatcacatgcagggcaaattgaatgaaaaggaaaaaatgatctccggccaaaaactggagatcgagagactggagaagaaaaacaagactctcgagtacaagatcgagatcctcgagaagacaaccactatctatgaggaagataaaagaaacctccagcaggagctagagacccaaaaccagaagctccagagacagttctctgacaagaggcgcctggaggcgaggctgcaaggaatggtcactgagaccactatgaagtgggagaaagagtgtgagaggcgagttgccgctaaacagttagaaatgcaaaataaactgtgggtgaaggatgagaaacttaagcaactgaaggccattgtgacggaacccaaaaccgaaaagcctgaaaggccatctcgtgagcgggacagagaaaaggtgacgcagcggtcagtgagcccctcacccgtgcctctgctgtttcagcctgaccagaatgcaccccctatacgcttaaggcataggcgctcccgctcggctggcgacaggtgggtagatcacaaacctgcctcaaacatgcagacagaaaccgtgatgcagcctcacgtaccacatgccattacagtgtctgtggccaacgagaaggctctagctaagtgcgaaaagtatatgctgacccatcaagaactcgcctctgacggtgagatcgagaccaagctgattaaaggtgacatttataaaacaaggggcggaggccagtcagttcagtttaccgatatcgagaccctaaaacaggagtctccaaacggctcccgtaagaggcggagctcaaccgtcgcccctgcccaaccagacggcgctgaaagtgagtggaccgacgtcgaaacaaggtgtagcgtggctgtcgagatgcgggcagggagccagcttggaccgggttaccagcaccatgcccagcccaaaagaaagaagccttag

SEQ ID NO: 227849 - DNA, 2520 bp, Artificial Sequence
  Description of Artificial Sequence: Synthetic coding sequence
atgaccggtagtcccggtgaaggaggccttttgccgaggtgtctcgacatgatctttaactccatcggcagtttccaggccaaacggtacgtgttcaagtcaaacgaccgtaattccatggatatccagtgcgaggtggacgccttgctggaaaggcaaaagcgggaggccatgccgaatcccaagacgagtagctcaaagcgccaggtcgaccctgagttcgcagacatgatcaccgttcaagagttttgtaaggccgaagaagtagacgaggactccgtgtacggcgtattcgtcagctatatagaaatttataataattacatctatgacctactcgaggaggtgcctttcgacccaataaagcccaagcccccacaaagtaagctgctgagagaggacaaaaatcataatatgtatgtcgcagggtgcaccgaggtcgaggtgaaatctacagaagaagcctttgaggtgttttggcgtggtcagaagaagcggcgtatcgcaaacactcatctgaatcgggagagttccagatcgcactccgtgttcaatattaagcttgtgcaagctccactggacgccgacggcgataatgtgctgcaggaaaaggagcagatcactatctctcaactctcattggtcgacctggcagggtccgagcgcactaatcggacgcgtgcagagggtaacaggctgcgggaggctgggaatattaatcagtccctgatgacacttcgtacttgtatggacgtcctcagggagaaccagatgtatgggaccaataagatggtaccttacagggacagcaaactgacccacctcttcaagaactacttcgacggagagggcaaagtgcgcatgatcgtatgtgtaaatcccaaggctgaggattatgaagagaacctccaggtgatgcgatttgcagaggttacgcaggaagttgaggtggcaagacccgtggataaggccatctgtggcctcactccagggagaagatacaggaatcaacctcggggacccgtggggaacgagcctcttgtaactgacgtagtgttgcagagttttccaccgctccctagttgcgagatcttggacattaacgacgagcagactctgcctcggctaattgaagctctcgaaaagcgccacaacttacggcagatgatgatagacgaatttaataaacaaagcaacgccttcaaggccctgttacaggagttcgacaatgcggtgctgagtaaggagaaccatatgcagggaaaactgaacgagaaagagaaaatgatctcggggcagaaactggagattgagcggctggagaaaaaaaataaaaccttagagtacaagatagaaatactcgaaaagactacgactatctatgaagaggacaagcggaacctgcaacaggagctagaaacccagaatcagaagctccagaggcagttctctgataaacggagactggaagcccgtctgcagggcatggtgacagagaccactatgaagtgggaaaaggagtgtgaacgccgtgtcgcggcaaaacagttagagatgcaaaacaaactgtgggttaaagatgagaaactcaaacagctgaaggcgatcgtgaccgaacccaagacagaaaaaccagagcggccatcaagagaaagggaccgggaaaaggtgactcagaggtctgtctctccttcccccgtgcccctctcgtctaattatattgcccagattagcaacggccagcagctgatgtcacaaccacagttgcatcgcaggtcaaactcctgctctagcatttccgttgcctcttgcatctctgagtgggagcagaagatccccacatacaacacacccttgaaagttacctctatcgcccgacggaggcaacaggaacccggacagtcaaaaacatgcattgtgtccgatcggagacgcggaatgtactggaccgagggacgtgaagtggttccaacctttagaaacgaaatcgagatcgaagaggatcactgtggtcggcttctcttccaaccggaccagaacgcgcctcccattcgcctgaggcatcgacgctctaggtccgccggagacagatgggttgatcacaaacccgctagtaatatgcaaaccgagacagtaatgcagcctcacgtgccacacgctattaccgtgtctgtggcgaatgagaaagccttggctaaatgcgagaaatatatgcttacccatcaagaacttgcatccgatggagagattgagacgaagctcatcaaaggcgacatctacaagaccagaggcggaggccaatcggtgcaattcacagatattgagaccctgaagcaagaatcccctaacggcagcaggaagcgaaggtcctcaacagtcgcgccagcccaacctgatggagccgaatctgagtggactgacgtagaaaccagatgtagcgtggccgtggaaatgcgtgccggttcccagctcgggccagggtaccagcaccacgcacagccaaagagaaagaagccatag

SEQ ID NO: 227850 - DNA, 3705 bp, Artificial Sequence
  Description of Artificial Sequence: Synthetic coding sequence
atggcatcatggctgtacgagtgtctctgtgaggccgagctcgctcaatactattcccacttcacagccctcgggctgcagaaaattgacgaactggctaagatcacaatgaaagactactctaaactcggggtgcatgacatgaacgatagaaagcgactgtttcaactgattaaaatcattaaaattatgcaggaggaagacaaagccgtgagtatccctgagcgccacttgcagacatcgagcttgcggattaaaagtcaggaactgcgctccggtccaaggaggcaactcaatttcgacagccctgccgacaataaggatcgaaacgcatcaaacgacgggttcgagatgtgcagtctcagcgatttcagcgccaacgaacagaagtcgacgtatctaaaagtgcttgaacatatgttgcctgacgactcgcagtaccacaccaagactgggatcctcaatgctaccgctggcgattcctacgtccagactgagatcagcacaagccttttcagtcctaattacctctctgccatcctgggcgactgcgacattcctattatccagcggatctcccacgtgagcggatacaattatggtattccccatagctgcatccgccagaacactagcgaaaaacaaaacccatggactgagatggagaaaattagggtgtgcgtccgcaagcgccctttgggcatgcgcgaggttcgtcgaggggaaataaacatcataacagtggaggataaggaaactctgttggttcatgagaagaaagaggccgtggatctgactcaatacatcctgcaggtcattctcaaagggagcaaagagcggagcactggtgcaactggcgtgaacgccgatagctcccgaagccatgcagtgattcaaattcagattaaagactcagcaaagcgtacgtttggcaggatctctttcattgacctcgccggatccgaaagagcggctgacgcgcgagactcagaccgtcaaaccaaaatggaaggcgctgagatcaaccagtctctgctcgccctaaaggaatgtattcgagcactggaccaagagcatactcataccccctttcgtcagtccaagttgacacaggtactgaaagactcgttcataggcaacgccaaaacctgcatgattgctaatatttcaccctcccacgtagccacagagcatactctcaacactcttcgctatgccgaccgggtgaaggagctcaaaaaaggcatcaagtgctgcacatctgtgactagccgcaacaggacttctggtaacagtagcccaaagcgcattcaatcatcaccgggtgcactgagcgaggataaatgcagccccaagaaagtgaaactggggttccagcagagcttgaccgtggctgcccctggcagcacaagagggaaggttcacccgttaactagtcacccacctaacattccgttcacatccgccccaaaggtgagcggcaagcgcggtggatctaggggctcaccctctcaggaatgggttatacacgcatcccccgtcaaaggcactgtccggagtggacacgtggctaaaaagaaacccgaggagtctgctcctctgtgctcagagaaaaaccggatgggaaacaaaaccgttctggggtgggaaagcagagcatctggccctggggagggacttgttcggggaaagctatctacaaaatgtaaaaaggtgcagactgttcagcctgtgcaaaagcaactggtgtccagggtggagctttctttcgggaacgcgcaccaccgcgctgagtatagtcaagacagccagagaggcacaccagcccgacctgcatccgaggcatggacaaacataccaccacaccaaaaagaacgggaagaacatcttagattctaccatcagcagtttcagcagccccctctgctgcaacagaaactgaagtaccaacctttaaaacggtctttacgacaatacaggccacccgaaggccaactcaccaatgaaaccccccctctgtttcactcttattctgaaaatcacgacggggctcaagtagaagagctggacgattctgatttctcagaggacagctttagtcatatttcctctcagagggctaccaaacaacgtaatacactggaaaactcagaggattctttctttctgcaccaaacatgggggcagggccctgagaagcaggttgccgagcggcagcagtctctgttttctagcccccgaactggggataagaaggatctcaccaaatcgtgggttgattcaagagacccgatcaatcatagacgcgctgcactggatcacagttgtagtcccagcaagggtcctgtcgactggagtagagaaaactccacttcttccggaccttcacctcgggactcgctggctgagaagccttactgctcacaggtggacttcatttacagacaggaaaggggaggtggaagcagcttcgacctgagaaaagatgcctctcagagcgaagtaagtggcgaaaatgagggcaatctgccatccccagaggaggacggctttaccattagcctttcacatgtggccgtgccaggaagcccagaccagagggacaccgtgactacacccttgagggaggtgtccgccgacgggccaatccaggtgacctcaaccgtgaagaacggccatgccgtcccaggagaggaccctcggggacagctgggcacccacgcggagtatgcatccggccttatgtctcctctgacaatgtcattgttggagaatcctgacaacgaaggatcgccccctagcgaacagcttgtgcaggacggtgcgacacatagcctcgtggccgaatctacaggcggtccagtcgtgagccacactgttcctagcggtgaccaagaggcggctctaccagtgagctctgcgacgaggcacttatggctgtcctcaagcccacccgataataaaccaggtggggacctccctgcattatctccctctcctattcggcagcatcctgcggacaagctgcctagtagagaggccgacctcggagaggcgtgtcagtctcgagagaccgttttgttctctcacgagcacatgggatccgaacagtatgatgccgacgcagaggaaacaggattggacggatcatggggttttcccggaaagccttttacaaccattcatatgggcgtgccacactcgggtccaacactcaccccccgaacgggaagttccgacgtggcagatcagctgtgggcccaggagagaaaacatcctaccagactaggttggcaggaattcggcttgagcacagatccgattaaacttccctgtaactcagaaaacgtgacctggctcaagccacgcccaatctcgagatgtctggcccgaccttcgtcacctctcgtgccaagttgctctcctaagaccgccggaactctccggcagcccacattggaacaggctcagcaagtggtgattagggctcatcaggagcagctggacgagatggcggagctgggcttcaaggaggaaactctgatgagccagctggcatccaacgatttcgaagactttgttacccagctggatgagattatggttttgaagtccaagtgtatccagagccttcggagccagctccagctctacctcacctgccatggaccgacggctgctcctgagggcaccgtgccttcctag

SEQ ID NO: 227851 - DNA, 4107 bp, Artificial Sequence
  Description of Artificial Sequence: Synthetic coding sequence
atggccagctggctttacgagtgcttgtgtgaggctgaactcgcccaatactactctcacttcaccgcactggggctccagaaaattgacgaactcgccaaaataaccatgaaagattattctaaactgggggttcatgatatgaatgatcgaaaacgtctatttcaattaattaagatcattaaaattatgcaagaggaagataaagccgtgtcgatccctgagaggcatctgcaaacctcctccctgaggattaaatcgcaggagctccggagtggtccgagaaggcaactcaactttgactcccccgcagacaataaggatcggaatgcaagcaatgatgggttcgaaatgtgttcattgtctgatttctccgctaatgagcaaaaaagcacttacttgaaggtgctggagcatatgctgccggatgactcacagtatcacacaaagactggaattttaaacgccaccgcaggcgacagttacgttcagacagagatcagcaccagtctgtttagccccaactatctgagtgctatcctcggcgattgcgacattcccattatccagaggattagccacgtcagtgggtacaattacggcattccacattcttgtatacgccagaacacaagtgaaaagcagaatccttggacagaaatggaaaaaatccgcgtgtgtgtccgcaaaaggcctctcgggatgcgagaagtacgcaggggcgagatcaacatcatcaccgtggaggacaaggaaaccctcctagttcatgagaagaaggaggctgtggacctcacacagtacattcttcagcatgtgttttactttgatgaagtgttcggcgaggcttgtaccaaccaagatgtatacatgaagacgactcaccctctgatccagcacatcttcaacggaggaaacgcaacatgtttcgcttatggccaaaccggtgctgggaaaacctataccatgatcggcacccatgaaaatcccggactctatgcactcgccgctaaggatatcttcagacagttggaggtgtctcagccccgtaagcatttgtttgtgtggatttctttctacgagatctactgtggccagctgtatgatctgctaaatcgacggaaacgtctattcgctcgggaggattccaagcacatggtacagatcgtcggactgcaagagctgcaggtagactccgtggagttgttacttgaagtgatcctgaaaggttccaaagagcggtcaacaggggcaacgggtgtgaatgcggacagttcccgatcccacgcggtgattcagattcagatcaaggattctgccaagcgcacttttggcagaatttcatttattgacctggcaggatcagaacgggcagcggacgccagggatagcgatagacagaccaaaatggagggcgcagaaattaatcagagcttacttgctcttaaagagtgtataagggctctcgatcaggagcacacccacactccattcagacaaagtaagctaacacaggttctgaaggactccttcattgggaacgctaaaacctgtatgattgccaatattagccccagtcatgtggcgactgaacacacgcttaacactcttcgctacgccgatcgagttaaagaactcaagaaaggaatcaagtgttgcacctccgtcacttctcgcaaccgaacttctggaaattcctcccccaagcggattcagagctcccccggagccttgtccgaggataagtgttcaccaaaaaaggttaaactgggatttcaacagtcactgaccgttgcagcgccaggttcaacgcggggaaaggtgcaccctctgacctctcatccccctaacataccctttacgtccgctccaaaagtatcggggaagagaggcggaagccgcggatctccgtcacaggaatgggtgatacatgcctcccctgtgaagggaacggtgaggagcggtcacgtggctaagaagaaacccgaggagagtgccccactgtgctccgaaaaaaaccgaatggggaacaaaactgtgctcggatgggagagccgggcatccggacccggagagggattggttcggggaaagctctccactaagtgcaaaaaagtacagaccgtgcagcccgtccagaagcagttggtgtcacgcgtggaattgtcattcggcaatgcccatcacagagccgagtattcacaagactcccaacgaggtactccggcaagacccgcttccgaggcatggaccaatattcctccccatcagaaggaaagagaagaacacttgagattttaccaccaacagtttcagcaaccacccttgcttcagcaaaagctgaagtaccagccgctaaagaggtcgttacgtcaataccgtccaccagaagggcaattgactaatgaaaccccacctctgtttcactcttacagcgagaatcacgatggagcacaggtcgaagagctcgacgactctgattttagcgaggatagtttttcccacatttctagtcagcgtgccacaaaacagcgtaatacactcgagaattctgaggacagcttttttctccatcagacctggggtcaggggcctgagaagcaggttgctgagaggcagcagagtctgttttcttctccacgaacgggagataaaaaggaccttactaaatcttgggttgattctagagacccaatcaatcaccgcagggctgcactggaccactcctgcagtccctctaaaggacctgtcgattggtctcgggagaattccacgtcatccgggccatcacccagggactcgctggccgaaaaaccttattgttcccaggtggacttcatttatcgccaggagagagggggaggtagttccttcgacctgcggaaggacgcctctcagagcgaggtaagcggcgagaatgagggcaacctgccgtcccccgaagaggacggcttcacaatctctttgtcacatgtggcagtgccgggatccccagaccagcgcgacaccgttactacccccttgcgcgaagtttcagccgacggacctatccaggtaacgagcaccgtcaaaaatgggcatgccgtgccaggggaggaccctaggggacaattgggaacgcatgctgaatatgcctctggtctaatgtcacccctcaccatgtcgctgctggagaatcctgacaacgaaggatctccaccaagcgagcagttggtccaggacggcgctacccactccctggtagctgaatccacgggtggccctgtggtatctcacacagtgccgtccggagaccaggaggcagcccttccagtgtcttctgcaacaaggcatctatggctttcttctagcccgcctgataataaacccggaggagacctcccagccttaagcccctctcctatcaggcaacatccagcagacaagctcccctcaagagaagcagacctgggcgaagcttgtcagtctagagagacggtgctgttctcacatgagcatatgggcagcgaacagtacgatgccgatgcagaggaaaccggcctggacgggagctggggtttccccggtaagccattcaccaccatccacatgggcgtgccacactccgggcctaccctcacaccaagaactggatcttctgatgtcgctgatcagctgtgggcacaggagcgcaaacaccccactcggctgggatggcaggaattcgggctgagtaccgacccaatcaaactaccctgtaacagtgagaatgtcacctggttgaagcctcgcccaattagccggtgtttagcacgaccctcttctcctctcgtgccttcttgcagccccaaaacagctggtacactccggcagccaaccctcgagcaagctcagcaggtggttataagggcccatcaagagcagctggatgaaatggctgagcttggattcaaggaggagaccttgatgtcacagctcgcttccaatgactttgaggatttcgttactcaattggatgagattatggttttaaaatccaagtgcattcagagtctccgcagccaattgcagctttatctgacatgccatggacccactgctgcgcctgagggtactgtaccaagctag

SEQ ID NO: 227852 - DNA, 4107 bp, Artificial Sequence
  Description of Artificial Sequence: Synthetic coding sequence
atggcctcttggttgtacgagtgcttgtgcgaagccgagctggcccagtactatagccatttcacagctctggggctccagaagattgatgagctagctaagattactatgaaagattacagcaagttaggagttcatgacatgaatgaccggaagagactttttcagctcattaagattatcaagatcatgcaggaggaggataaggccgtcagcattcccgagcgtcaccttcagacctcctccctgcggataaagagtcaggagctcaggtcggggccacggcgacagctgaattttgatagccccgcagataacaaagatagaaacgcctccaatgatggattcgagatgtgttctttgtccgatttttctgctaatgagcagaagtccacttacctcaaagtgctagaacatatgctgcctgacgattcccagtaccataccaagacgggcatacttaatgccacggccggtgacagttacgttcaaacagagatttctactagcctctttagccctaactatctttctgccatattgggggattgcgacattccgataatccagcggatatctcatgttagcggttataattacggcatccctcactcttgcattcgccagaacacatcagagaagcagaacccgtggactgagatggagaagatccgggtctgcgtgcgcaagcggccattgggtatgcgcgaggttaggaggggcgaaatcaacatcattaccgtggaagataaagagactctacttgttcatgaaaagaaggaagcggtggatctcactcagtacattctgcagcacgtgttctacttcgatgaagtgtttggcgaagcttgcacgaatcaggatgtgtatatgaagaccacgcatcctttgattcagcacatattcaatggtgggaacgctacatgcttcgcctacggccagaccggcgctggcaagacgtataccatgatcggcacccacgagaatcccggactgtacgcactcgctgccaaggatatcttccgtcagcttgaggtgtctcagcctagaaagcatctctttgtatggatctccttctacgagatttattgcggtcagctgtacgatctcctcaacagacgcaagcggctcttcgcccgagaggactccaaacacatggtccagatagtgggcctccaggagctgcaagtagatagtgtagagttgttactcgaagtcatactgaaaggctccaaagagagaagtactggcgcaacaggggtcaacgccgactctagcaggtctcacgctgtgatccagatccagatcaaagacagtgccaagcggacatttggtcgaatctctttcatcgacctggccggatcagaaagagcagcagatgccagggattcagaccgccagacaaagatggagggcgcagaaattaatcaaagtctactcgcattgaaggaatgtattcgcgcattggaccaggagcatactcacacccctttcaggcaaagtaagcttactcaggttctcaaagattcttttattggcaatgcaaaaacgtgtatgatcgctaacatttctccctcacacgtagctacagaacatacactgaataccctcagatatgctgaccgggtcaaggaacttaagaaaggaatcaagtgctgtacgagcgtgacctccaggaaccggacgtccggaaacagcagtcccaaaagaattcaatcatctccaggtgctttgtctgaggacaagtgcagccctaaaaaggtgaagttgggatttcagcaatctttgacggttgcagcacctggcagcacccgaggcaaggtacatcctttgaccagccaccccccaaacattccgtttacctccgcgccaaaggtctcagggaagcgcggtgggagccggggaagtccaagccaagagtgggtaatccatgcaagtcccgtgaagggcacggtccgctccggacatgtggctaaaaaaaagccagaggagtccgcacccctttgctcagaaaagaatcgcatgggcaacaaaactgttcttggctgggagtcacgcgcatccggaccaggggaggggctcgtacggggaaagttgagcaccaagtgtaagaaggtccagacagtacaacctgtacagaagcagctagtgtctcgcgttgagctctcctttggaaacgctcatcatcgggctgaatactctcaggactctcagaggggaacgcctgcacgtccagcgtctgaagcatggacaaatatccctcctcaccagaaagagagggaagaacacctgcgcttttaccaccagcagttccaacagcccccactgctccaacagaaactgaaataccagcccctaaagcgcagtctgagacagtacaggcccccagagggccagctcactaatgagacgcctccactttttcatagctactccgaaaaccacgacggagctcaggtcgaggagcttgacgacagtgatttcagtgaggactcgttctctcatatatcaagccagagggcaactaagcaacgcaatacactagagaatagtgaagacagcttctttctccaccaaacttggggacaggggccagagaagcaggtcgccgaaagacaacagagcttgttctctagcccaaggaccggagataagaaggacttaacgaaaagctgggtcgattcaagagatccgattaaccaccgcagagcggctcttgaccattcctgtagcccgagcaagggtcctgtggattggagtcgcgaaaatagcaccagctcgggcccatctccaagggactcactggccgaaaagccctattgttcccaggtcgactttatttatcggcaggagcgcggaggtggctcctcattcgatctcagaaaagacgcttcacaatccgaggtgtcaggcgaaaatgagggaaaccttccttcacctgaagaagatggcttcacaatttctctgtctcacgtggcggtgcccggaagcccggaccagcgcgacactgttactacccctctgagggaagtgagtgcagacggaccgatccaagtaacttcaaccgtcaaaaatggccatgccgtacccggtgaggacccacggggacagctcgggactcacgcagaatacgcttcaggtctgatgtcacccctcactatgagcttgctggaaaatcccgataacgaaggcagccctcccagtgaacagctggtacaggatggcgcaacgcatagcctagtggctgagagtactgggggtccggtcgtgtcacacactgtgcctagcggtgaccaggaagcggcactaccagtgtctagtgcgacccgccacctgtggctgagtagctcaccacctgacaacaaacccggtggagatctaccggctcttagccccagtcccatcaggcagcatcccgcagacaagctgcccagccgggaggccgacttgggcgaggcttgtcagtccagggagacggtactgtttagccacgaacacatgggaagcgagcagtacgatgcagatgctgaggagaccggcctcgacggctcttggggattcccaggtaagcccttcactaccatccacatgggtgttcctcactccgggccaactctgacccctcggacgggatcctctgacgttgcggatcagctgtgggcccaggagcgcaaacatcccacccgcctgggatggcaagagttcggactgagcacggatcccatcaaactgccatgtaactcagagaatgtcacttggctaaagcccagacctatcagccgctgcctggccagaccttccagccctctagttccttcttgcagtcctaaaactgccggaaccttaagacagcctacactggaacaggcacaacaggttgtcatccgagcccaccaggagcagctggatgaaatggccgaactcggttttaaggaagaaactcttatgtcacagctcgcatcaaatgattttgaggatttcgtgacccagctggatgagatcatggtccttaaatccaagtgcatccaatctttgcgttctcagttacagctttacctgacttgtcatgggccaacagccgctcccgaggggacagtgccctcttag

SEQ ID NO: 227853 - DNA, 3477 bp, Artificial Sequence
  Description of Artificial Sequence: Synthetic coding sequence
atggcatcatggctgtacgagtgtctctgcgaggccgagttagctcaatattattcacatttcactgccctgggactgcaaaaaatcgacgaactggcaaaaattactatgaaagattactccaaacttggagtgcacgacatgaacgatcgcaaaaggctattccagttaatcaagatcattaagattatgcaggaagaggacaaagcagtttccatccctgagcggcatttacagacatctagcctgagaattaaaagtcaggagctgcgtagtggccctcgaagacagttgaatttcgacagtccagctgacaacaaagaccgtaatgcttcgaacgacggcttcgaaatgtgtagtctcagcgatttttcagcaaacgaacagaagtccacatacctgaaggtccttgagcatatgctgccggacgattctcagtaccatacgaagactggcatccttaacgccaccgccggagactcctatgtccagactgagataagtacatccctgttcagccccaattatttgtcggccattcttggcgattgtgacatcccgattatccagagaatctcacatgtctccggctataattacgggataccgcactcttgtatacgccagaacaccagcgagaagcagaatccatggactgagatggaaaagatacgagtatgcgtgaggaaaaggcccctcgggatgcgggaggttaggagaggtgagattaacatcattaccgttgaggataaggagactctattggtgcacgaaaagaaggaggccgttgacctgactcaatacatcctacagcacgttttttacttcgacgaggtgtttggtgaggcatgtaccaaccaagatgtctatatgaagaccactcacccactaattcagcatatctttaatggcggaaacgcaacatgtttcgcctacggacagacaggggcaggcaagacatacacgatgattggcactcatgagaacccgggtctatatgccctggccgcaaaggatatatttcgtcagctcgaggtgagccagcccagaaaacacttgtttgtctggatcagcttctatgaaatttactgcggtcagctctacgacttgttaaaccgtcgcaaacgacttttcgcgagagaagacagcaagcacatggtccaaatcgtcggcctccaagaacttcaggttgatagtgttgaactattactggaagtaattttaaagggcagcaaagagcgatccactggggcaacaggagtgaatgcggacagcagccgctcccatgccgtcattcaaatccagatcaaggattccgcgaagcggaccttcgggcgaatcagctttatcgatttggcaggtagcgaacgagccgctgatgcccgagactccgatcgacagactaagatggaaggtgctgagatcaatcagtccctgttagcgctgaaggagtgcatacgcgctctggaccaagagcacacccatactccttttagacagagtaaacttacccaggtacttaaagacagctttataggaaatgccaagacatgcatgatagcaaatatttctcctagtcatgtggccactgaacacacccttaatactctgaggtacgccgatcgagttaaagaactgaaaaaggggattaaatgctgcacatctgtgacctcgcggaaccggacaagtgggaacagcagtcctaagagaatacagtcatcgccgggtgctctgagtgaagataagtgttcgccaaagaaagttaagctcggctttcagcaaagcctgaccgtggccgcaccaggcagcaccaggggaaaggtccatccgttaacgagtcaccctcctaacatcccatttacttcagctcccaaagtgtccggcaaaaggggcggttctcgaggttcccccagccaggagtgggttattcacgcaagcccagtgaaaggaacagtgcgctctggacatgtggctaaaaagaagcccgaggaatcagccccactatgcagcgagaagaacagaatgggcaacaaaacggtgctgggttgggagtccagggcctcaggtccaggcgagggcctggtgcgcggaaagttgagtacgaaatgcaaaaaagtccagacggtccagcctgtccagaaacagttggtgtcgagggttgaactctccttcgggaacgcccatcaccgggctgagtacagccaggactcgcagcggggtacacctgcgagacctgcaagtgaagcctggacgaacatcccccctcaccagaaggagcgggaggaacatcttaggttctatcaccaacagttccagcaaccccctctgcttcagcagaaattaaagtatcagcccctaaagaggagcctcagacagtatcggccacccgaggggcagctgactaatgagaccccgccactgttccactcctattcagagaaccatgatggagcgcaagttgaagaattggacgattctgatttcagcgaagatagcttttcacacattagcagccaaagggcaactaagcagcggaatacactggagaactctgaggattctttcttcctgcaccagacttggggccaaggcccagaaaaacaggtggccgaacgacagcagtccctgttctcaagtcctcggacaggcgacaagaaagatcttaccaagtcctgggttgattctcgtgacccaatcaaccataggcgggctgctctggaccattcctgttctccaagcaagggcccagtcgattggagcagagagaactcaacctctagcggaccaagcccgcgtgactctctcgccgagaaaccctactgtagccaagtggattttatctacaggcaggagcggggaggaggcagtagctttgatctgcgcaaggatgcaagccagagtgaagtatccggggagaacgaaggtaatcttcccagtcctgaagaagacggattcactattagcctatctcacgtggcggtgcccggttcgccggatcagcgtgacactgtcactacacccctgcgcgaggtctcagcggatggacccatccaggtcacctccaccgtgaagaacggccacgccgtccccggagaggacccgagaggccagcttggtactcacgctgagtatgctagtggactgatgagccctttaactatgagcttgctagagaacccggataacgaagggagcccaccctccgaacaactggtccaggacggcgctacgcattctttggtcgcagagagcaccggtggacctgtcgtgtcacacactgtgccaagcggcgatcaagaggcggctctccctgtgtcttctgccaccaggcatctgtggctgtctagcagtcctccggataacaagccaggtggcgatctgccagctctgggcccaggcgaaaaaacttcttataaggcttggctggcaggcgtgtggttcgtacatcgtcctcatcaggtggcgctccagcagtag

SEQ ID NO: 227854 - DNA, 999 bp, Artificial Sequence
  Description of Artificial Sequence: Synthetic coding sequence
atgacatggacttctgggcagctgcaacgcgaaaagcaggcacgtcccggttctggtgcggtgttagcgttccccgatgataaggacctacgggtgtacggtcctgcagaatcccagagcgctgtctttggcgatgtctgcccactgctcacaagcctcctggatggctataatgtatgtgtcatggcttatgggcagacaggctctgggaaatcatacactatgctaggaaggcactccgatgacgggcctgtcttaccccttgacccccagtccgatctgggcatcattccacgcgtcgctgaggaattatttcgcttgatcctggagaacaccagtcgctccccaaaagtagaggtgtcaatcgttgaggtgtataataacgacatttttgatctcctagccaaggattctatcgctgcggtttctggagttaaacgggaggtagtcacagcaaaagacggacgcacagaggtagctctgctagcaagtgaagccgttggatcagcctccaagttaatggagctcgtgcacgggggtttacaattgcgggctaaacatcccacgctggtgcatgccgacagctctcgatctcacctgattatcacagtgacattgaccacggctagttgctctgatagcacggccgaccaggcgtgctctgcgacactgccaagagagcagacggaagcaggtagagccggaaggtctcggagagcttctcaaggagcactagcaccccaactcgtgcccggaaatccagcgggtcacgcagagcaggtgcaggccaggctgcagctggtagatagtgccggtagcgaatgtgttggtggcgacgccaaattactggtcatcctgtgcatctctccatcgcagcggcatctggcccaaacattacagggactcggtttcggcattcgggcaaggcaggttcagcgaggcccagcaaggaagaaacccccatccagccagactgaagggaagaggagaccggactag

SEQ ID NO: 227855 - DNA, 1155 bp, Artificial Sequence
  Description of Artificial Sequence: Synthetic coding sequence
atgacatggacctctgggcagctgcagagggagaaacaggctcggccagggtcgggcgcagtcctcgcatttccagacgataaggatttgcgggtttacgggccagccgaatcccagagtgctgtgtttggggatgtctgccctcttttaacaagtctgttggacggctacaatgtgtgcgtaatggcctatgggcaaacaggctcaggcaaatcctataccatgctcgggaggcactccgacgatggaccggttcttcctctcgacccccagtccgacctgggcatcatccccagagtcgctgaagagctgtttagactgatactggagaacaccagcagatctcctaaggtcgaggtttccatcgtcgaggtgtacaataacgacatcttcgatttgttggccaaggatagcattgctgcggtgtcaggagtgaagcgcgaggtggtgaccgctaaagatggcaggaccgaagtggcgctgctagcctccgaggccgtgggcagcgcatcgaagcttatggaactggtacatggaggccttcagctcagggcgaaacaccccacgctagtccatgccgattctagccgatctcacctgattattaccgttaccctgacgaccgcctcctgtagtgactcaacagctgaccaggcctgctccgcaaccctgccaagagagcagaccgaagccggaagggcgggtagaagccgcagagctagtcagggcgctcttgcaccacagctggtacctggcaaccccgctggacacgctgaacaggtccaagccaggctgcagctggtagattccgccggaagcgaatgtgtgggcgtatccggtgttactgggctggccctccgcgagatggcatgcatcagcagaagtctggcggcattggccggagttctgggagctctcctggagcatagggggcacgcaccctaccggaatagtcggctcacccatctgctgcaggactgcctgggcggagatgcaaagttactggtgatcctgtgcattagccccagccagcgacatctggctcagaccttacaagggttgggatttggcattagagcacgtcaagttcaacgaggccctgcccgtaagaaaccaccttcctcacagacagaaggtaagagaaggccggattag

SEQ ID NO: 227856 - DNA, 1155 bp, Artificial Sequence
  Description of Artificial Sequence: Synthetic coding sequence
atgacctggacaagcggtcagctgcagagagaaaaacaggctagaccaggttctggggcagtcctggcttttcccgacgacaaagacttgcgcgtttacggacctgctgagtcacaatcagcagtttttggagatgtttgtcctttgctgacatctctgctggacgggtataacgtctgtgtgatggcatatggtcagactggaagtgggaagagttataccatgttaggcagacactcagatgacgggcctgtgttgcccctcgatcctcagtctgacctcggaattattccacgggtggctgaggaactgttccgactcattcttgagaatacttctcgaagtcctaaagtggaagtctccatcgttgaggtgtacaataatgatattttcgatctactggcaaaggactccatcgctgcagtctcaggcgttaaaagagaagtggtcactgctaaagacgggaggacagaggtcgccctcctggcctctgaggccgtggggtctgcatccaagctcatggaactcgtccacgggggtttgcagctacgagccaagcaccccaccctggtccatgccgatagttccagaagtcacctgatcataacggttacgttgaccacagcctcttgttccgacagcaccgccgaccaggcatgtagcgcgacattgcctcgcgaacagactgaggctgggcgagcaggccgttccagaagagcgtctcagggagctctggcacctcagctggtacctggaaatcccgcaggacacgcagagcaggttcaagctaggcttcagttggttgattcggccggaagcgagtgcgtgggcgtgtcgggagtgaccgggctggccctccgcgagatggcttgcataagccgatctctggctgctttagcgggtgtccttggggctttactggaacaccggggtcatgctccttacagaaactcccgtttaacacatttacttcaggattgcttgggcggagatgcgaagctcctggtgatcttgtgtataagccccagccaacggcacctcgcgcaaacactccaggggctcggattcggcatccgggctcgccaggtacagagggggcctgctcgtaagaagcccccttcgtcccagacggagggtaaaagaaggccagactag

SEQ ID NO: 227857 - DNA, 5648 bp, Artificial Sequence
  Description of Artificial Sequence: Synthetic coding sequence
atggtcgggagaggagtcccactctgcgccgctcagccggctgttgctgagggcggtccagctagggagccccctcctttactcgaggtgagtccaaggaaacgcttaccggctggtcccgaccaggacccctgcggctcacgcccagccccagagggcgctggagcgggaccagagcagggccactcagcgggaggtggcggatggtgcaggcattgtcatacaaagctcgttgagttaaaaagacaagcttggaagctggtctctggacccggaacaacactgagggatccctgcttatcagcgttgcttttggacaaactgcccgctcccggtgctttaccagcctgcaggccagaggccgaaagacggtgcgacgtgtgtgctacccacctgcagcagctcactagggaggctatgcatctgctgcaggccccagcatcccatgaagatttggacgcaccacatgggggtccctcccttgctcccccttccactacgacctccagcagggacactccaggccctgccggacctgccggtcggcagccagggcgagccggtcctgatcggaccaaaggtctggcttggtcccctggccctagcgtgcaggtgagcgtcgccccagctggtttagggggagcactgagtacggtcacaatccaggctcaacagtgtcttgaaggcatgtggtcggtgtctagggttaatagcttcttgcccccagcttgtttggccgaagctgcggtcgccgctgtagcagtggccgacactgtcagggagtgtccgcctgtcgccggtcctgatggcctttccaaggcatggggaaggggcggagtttgcactagtgctctcgtgacgccaacacccggatccgtcgggggaagcactggaccctcagctgccgctagtttctttatccgcgcaatgcaaaagctgagtctcgcctctaagcgcaagaaaccccaccctcctcctccacctgcgactagagggacttctacataccctacagactttagtggcgtccttcagctgtggccaccgcctgcacccccttgcctattgagggcggctagtaaaacaaaagacaatcctggatcaattgggaaagttaaggtcatgttgaggatctggcccgcacagggcgcacagagatcagccgaggctatgtctttcttgaaggtcgatcctagaaaaaagcaggtgatcctgtacgatcctgcagccggaccccctgggtcagccggtcccagacgcgctgccacagccgcagtgccaaagatgtttgcgtttgatgccgtgtttccacaggactccgaacaggcagaagtatgctctgggaccgttgcggacgttctccagtcagtggtgtcaggagccgatggctgcatcttctccttcggccacatgtccttgggtaaatcctacacaatgatagggaaagacagttctccacagtcacttgggatcgtgccttgtgctattagttggttatttcgcctcatcgaagaacgtagggaacggacgggtaccagattcagcgtcagggtgtcagcagtggaagtttgtggtcgtgatcagagtctgcgcgatcttttagccgaagtggcccctggatctctgcaagacacccagagcccgggtgtgtacctaagggaggatccagtatgtggtgctcagctgcaaaaccagagcgaactgagagcgccaactgcggaaaaagccgcattttatctagacgctgcccttgccgcaagatccacgtcacgcgctggctgtggcgaagacgcgagacgcagctcccacatgctttttacactccacgtgtaccagtacaggatggaaaagtgcggacggggaggcatgagcggtggccgatcccgcctccacctcattgacttgggttcttgtgaggcagctgccggtagggctggggaagctgccggtggcccattatgtttgtcactgtccgcattgggcagtgtcatccttgccctggttaatggcgctaagcacgtgccctaccgcgatcacaggctaactatgctcctgcgggaatccctcgccactgccggatgtcgaaccactatgatcgcccacgtgagtgacgctcctgcccaacatgccgagaccttgagtactgtccagcttgctgctagaattcaccgtctccgaaggaaaaaagccaagtacgcatcgagcagttctggtggggaatcatcttgtgaagaaggtagagctaggcgccctcctcacttgcgcccattccacccaaggacagtcgcattagacccggataggactccaccgtgtctgcccggagatcccgattactcttccagctcagaacagagctgcgacaccgtgatctatgttggtcctggcggagctgccctctcagacagggagctgacagataacgagggcccaccagatttcgtgcccataatccccgcactgagcagacacagaccgtctaagggtcctagagacgccgaccatttcaggtgttctacctttgccgagctgcaggaacggctggagtgtatggatggaaatgagggaccaagtggagggccaggcggaacagatggcgcacaggcatctcctgctcggggtggcagaaaaccatccccccctgaagcagcctcccctcgcaaagccgtgggcacacctatggctgcttccaccccaagaggaagttcaggtccggatactcaccagggtacgcctgaaccctgcaaagccatcgtgtggggcgaccagagggaagactcaagcgcctggcccgagctcctcgtgccagaaaaagccgcagtgagcgggggtcggagacccctcccttctcctgctcctcctccgccacagcttctggaggcttgtcgggctccggaggagcccggaggcggtgggactgatggcgtggcacggactccacccgtgggtatgagcggacaggtggcaggaagccccatgctgccaggagcgacttgccccagacttgcagcaggtagccggtgccctgagcggggtctgcttaccaccactgtcacactgcagcgcccagtcgagctcaatggcgaggacgagctcgtattcacggtggtcgaagaactctccctaggcgctttggcaggagcaggccgtcccactagcctcgcaagtttcgactcagactgcagtcttagagcgctcgcctctggcagcagaccggtgtcaattattagcagcattaatgacgagtttgatgcttataccagtcaggctccagaggggggtcccctcgagggggctgcatgggcgggatcaagccatggatccagtatcagcagctggctctctgaggtctctgtctgcaccgctgattccagggatccaacaccccagcctaggttttcacccgacagcctcgcaggcctggatccagggggacctcccgctttagatggatcattgggcgatggaagctcagggttcttggggccagataggcccgactctccaggacccacatggggcccttgcccgggtgaggtcgccgctgtagcaccatcccgccctgggagagagccgcaagcaggcccatccaggtgggcatccgccgcacagacgatccacagtagcttaccgagaaaaccgagaactgcaagtgctaccaccagagtcgggtgcgccaggttgggacagtctccaccaggcagaggcggattgttcgaagatccatggctgctacgcgtgggcgagtgtgacacccaagcggcaagcgcaggacgtgctccctctcctactttgggcagtcctcgactgccagaggctcaagtaatgttggcttgtgctcagagggtggtggatgggtgtgaggttgctgccagggccgcaagaagacccgaggcagtcgctagaatcccgccactgcggagaggagccaccaccctgggagtgaccacccccgcagtctcttggggggacgccccaacagaagtggtggcatgtagtgggagcctgaaagcgtcccctaccagcaaaaaaggactggcaccgaaagctggcttcctcccaagaccaagtggggcagcaccccctgctccccctacaaggaaatcaagccttgagcagcggtcatctccagcaagtgcccctcctcacgctgtgaatcccgcaagggtcggggctgccgcagttctgcgcggtgaagaagagccacgcccttcaagtcgcgctgatcattcagttcctcgagccacaagctctctaaaggccagagcatccaaggtggaagcagcacaccgcctcgcaggccacgccagcctggaacggtacgagggcctcgctcatagtagttctaaaggcagggaggcacctggcaggccccctagagccgtccctaaattgggcgttcctccctcctcgccgacacacgggcctgctcctgcctgcaggtccggtgccgctaaggcagtgggagctcccaagcccccagtgggcggaggaaagggtcgtgggctcgtggctgggggttctagggcactgggcccttcagttaaactttctactgcttccgtgactgggcgatctcctgggggtccggttgctggcccaagggcagcccctcgggcagggccaagcgtaggggcaaaagccggtcggggaacagttatgggtactaagcaggcactgcgggcagcccattcgcgcgttcacgaactgtctgccagtggagcaccgggtcgtggcggatcttcgtggggctcggcggattcagatagtggacatgactcgggagtaaacgtgggagaagaaaggccaccgacggggcctgcgctaccaagtccctactctaaggtgaccgcacccaggaggccccaacgctactctagcggacacggctcggacaatagttccgtactctcaggtgagttacccccagccatgggacggactgcactgttccatcattctggtggatctagcggctacgaatccttgaggagagattcggaggctaccgggagtgcctcatccgctccagatagtatgtctgaatcgggcgcagcaagcccaggggctcggactagaagccttaagtctccaaaaaagcgggctaccggactacaacgcagacgcctgatcccagcacctctaccagataccactgcactcggcaggaagccatcgctgcccggacagtgggtcgacttacccccaccattagcaggatccttaaaggagccattcgagattaaagtctatgagattgacgatgttgaaagacttcagaggcccagaccaaccccgagggaggcacctacccaggggctcgcgtgcgtgagtaccaggctcaggctggcagaacgtagacaacagagactccgtgaggtccaggcaaaacacaagcatctatgtgaggaactcgcagagactcagggtaggctgatgctggagccgggtcgatggctggagcagtttgaagtggatcctgaactggagccagagtccgcagagtacctggccgcactcgagcgcgctaccgctgcactcgagcagtgcgtcaatttgtgcaaagctcatgtgatgatggttacgtgtttcgacatctcagtcgcagctagcgccgcaattccgggaccccaggaggttgatgtgta

SEQ ID NO: 227858 - DNA, 5183 bp, Artificial Sequence
  Description of Artificial Sequence: Synthetic coding sequence
atgatgatggactggaaagcagtcgccgcacagaaactgaacctatcctccaaaaagaaaaagcacagaccatctacctccagcgctgcagagccacccctctttgcaaccagcttttccgggattcttcagacatcaccaccaccagctcccccttgtctccttcgggctgtgaataaggtgaaggacacccctggtttgggcaaggttaaagttatgcttaggatatgctcgactttggctagagacacatcggagtcctccagctttttaaaagtcgatccacgcaagaaacaaatcacactctatgaccccctgacctgcggtggccaaaacgccttccagaaacgcggaaaccaagtgccccctaaaatgttcgcctttgatgccgtgttccctcaggacgcatcgcaagccgaagtctgtgctggtaccgtggcagaggtcatccagtcagtggtgaacggcgcagacggctgtgtgttctgtttcggacatgctaaactggggaaaagttacaccatgattggcaaagatgacagcatgcaaaaccttggcatcataccgtgtgcaattagttggttgttcaaactgataaacgaacggaaggagaaaacaggcgctcgattcagcgtgcgtgtgtcggccgtggaagtctgggggaaagaggaaaatctgagagatttgctgtctgaggtggcaacaggcagccttcaggatggccaaagtcctggcgtgtacctctgtgaggatccaatttgtggtacccaactgcagaaccagagcgaactccgcgcacctacagcagagaaggccgcattcttccttgatgctgccatcgcctccaggcgttcccaccagcaggattgcgatgaggacgatcatagaaactcccatgtctttttcactttacacatttaccagtaccgcatggaaaaatcgggcaaagggggaatgtctggcggtaggagcagactgcaccttatcgacctggggtcatgcgtgaaagccctttcaaaaaatcgggagggaggatccggtctgtgcctaagtctgtcggcactggggaatgtgatcctggctttggtcaacggctcaaagcacatcccctacaaggagagtaagctggcaatgctgctccgggaatcactggggaacatgaactgtaggacaaccatgattgctcacatcagtgccgctgtcggcagctacgccgaaaccctgtcaaccatccagatcgcctccagggtgctgcgtatgaagaagaagaagaccaaatacacgagttccagcagtgggggtgagagcagctgcgaggagggcagaatgaggagaccgacccagctaaggcccttccacacaagggccaccgttgatccagacttcccaatcgctcacttgtcctctgaccctgattacagcagcagttctgaacagtcatgcgacacagtaatctatattggtcctaatggaactgctctgtcagataaagagttaacagacaatgagggcccacctgattttgttcctattgtcccagctctgcaaaaaacacgcggtgattctcgtccagcagaggccggtgaagctgctgcagggaaaagcgaaagggattgcctgaaatgcaacaccttcgctgagctgcaagagcgtctcgattgcattgatggatctgaggaacccagttcattcccatttgaggaattgcctgctcaattcgggccagaacaggcttctcggggtccacgactgtcccaggccgctggcgctagcccattgtcagagagcgacaaagaagataacggctctgaaggacaacttactaatcgcgagggacctgaactcccagcctccaagatgcagcgttcacattccccagttccagctgctgcccctgcccattctccctctcctgcttcgcctaggtccgtccctggcagcagcagtcagcactctgcatcacctctggtgcagagcccttctctccagtcaagccgtgaaagccttaatagctgtggctttgtggagggaaagcctaggccaatgggtagtccacgtctcgggattgcctctctgagtaaaaccagcgagtacaagccaccttcatctccaagtcaaagatgtaaggtgtatacccaaaaaggggtgctcccgtcgcctgccccactccctccttctagcaaagacagcggtgttgcatcccgcgagtcgctgctgcagcctgaggtgcggacgccaccagttgggatgagcccgcaagtgctcaagaagagcatgtccgcgggaagcgagggtttccccgagaccccagtggacgatgagcagcaggccgcaaccccatccgagtccaagaaggagatcctgagcacaactatggtaacagtgcaacagcctttggagctgaacggggaagacgaactcgtttttactttggtcgaagaactgacaatctctggcgttcttgatagcgggaggcctactagtattattagttttaactcggattgctcagcgcgagccctggcctctggatctcgacccgtgtctatcatttcttccatcagcgaggatctggagtgttatagttccacggcgcctgtatctgaagtatccatcacgcagtttctccctctgcctaagatgtcattggacgagaaggcacaggacgcaggctctcggagatcctccatttcctcctggctgtctgagatgtcagccggatcagagggtgaacagagctgccatagctttatcgcacagacatgtttcggtcatggtgaagctatggccgagcccgttgcctctgagttcgttagctccttgcagaacaccgctgtggtgtgcagggaaaagcccaaagctagcccagataacttgttaatcttgagcgagatgggagatgatagtttcaacaaggctgcacccatcaagggctgcaaaataagtacagtgagtaaagcaatggtgaccatctccaacactgcaaacctgagcagttgtgaaggctacatccccatgaagactaacattacagtatatccttgcatcgccatgtcacctcgcaatattcaggagccagaggccccaacggcaacacctaaagctggccctactctggcccagagtcgggagagcaaagagaactcagctaaaaaggagatgaaattcgaggacccctggctgaagcgtgaggaagaggtgaagaaagagacagcccatcctaatgaggaaggcatgatgaggtgcgagactgccaccgggccttccaatgcagaaacccgggcagaacaagaacaggacgggaagccctcgcccggagaccgactctcgagtagtagtggagaagtatccgcttcgcctgtgaccgataattttagaagagtagttgacggttgcgagatggcactgccaggcttggccacccaatcaccagtgcaccccaataaatcagttaaatctagctctctgcccagagcctttcaaaaggcttcccgccaggaagagccggattcgctgtcttactattgtgcagccgaaactaacggtgtaggcgcagcttcaggtacacccccatccaaggctacacttgagggaaaagtggcaagtcctaaacactgcgtgttggctcgtcccaaaggcaccccccctctgcccccagtgcgcaagagttcacttgatcaaaagaatcgtgcaagcccacagcattctgcctccgggtctggcacaagcagtccacttaaccaacccgcagcctttcccgcaggactccccgacgaaccctcagggaaaacgaaggatgccagctcctcatcaaagctattctcagccaaactggagcagctggcctcacgaagcaatagcctcggcagggcaacggtctcacattatgaatgtctatctctggaaagagccgaaagcttaagctccgtctcctctaggttacacgccggaaaagatggcactatgccaagagcgggaaggtctcttggccgatcagcaggcaccagtccgcctagctcaggagcttcccctaaggcgggacaaagcaagatttccgccgtttctaggctgcttcttgcatctcccagggcccgagggccttcagcctccactaccaagactttgtcattttcaactaaaagcttgccgcaggctgtgggccagggtagctccagcccccctgggggtaaacataccccctggtccactcaatctctgagtaggaatagatcgagtggactggccagtaagctaccactgcgagcagtgagcggtaggattagtgaattgcttcagggaggcgcaggggctcgcggactgcaactgcgggctggtccggaagcggaggcccgaggaggcgctctggcagaggatgagccagcagctgctcacctgctgccttcgccctacagtaagatcacaccacccagacgaccgcatcgttgctcaagtggacatggttccgataattcctccgtgttgtccggggaactgccccctgccatggggaagacagcattgttttaccacagtggaggtagcagcggctacgagtcggtgatgcgcgactcagaggctacagggagcgcatcatccgcccaggattccacgtcggagaactcatcctcagtgggtggtaggtgcaggtccctcaaaacccccaagaaacggtctaatcccggatcgcagcggagacggcttatccccgctctgagcctcgatacctccagtcctgttaggaagccacccaactcaacgggggtccgctgggtcgatggtcccctacgaagttccccacggggactaggcgagccttttgagatcaaagtctatgagattgatgacgtcgaaaggctgcagcggcgacggggaggagccagcaaggaagcaatgtgcttcaatgctaaattaaagatcctggaacatcgacagcagcgtatcgcggaggtccgggctaaatacgaatggttgatgaaggaactggaagcaaccaagcaatacctgatgttggaccctaacaagtggttgagcgagttcgacctggaacaggtctgggagctcgattctcttgagtacctagaagctctggagtgcgtgacagagcggttagagagcagggtcaatttttgtaaggcacacctaatgatgatcacctgcttcgacattacgtcaaggcgcaggta

SEQ ID NO: 227859 - DNA, 6326 bp, Artificial Sequence
  Description of Artificial Sequence: Synthetic coding sequence
atgaactctgtggctggcaacaaggaacgcctggcagttagcactcgaggcaagaaatacggagtcaatgaagtttgtagtcctaccaaacccgctgcacccttctccccagagtcttggtaccggaaggcctacgaggaatcccgggctggcagtagacctaccccggagggagcaggaagtgccttgggatcttccggcaccccatcaccaggtagcggaacgagctctccttctagtttcactggaagcccaggacccgcatcgccaggcatcggcacgtcctctcctggtagcctcgggggttcccccggattcggaaccggttcacccggaagcggctccggtgggggatcctctcctggaagcgatcgaggggtgtggtgcgaaaactgcaatgcccgactcgtggagctgaagcggcaggcgctcaggctgctcctgccgggaccttttcccggaaaggatccggctttttccgccgtgatccatgataagcttcaggtcccgaacactattagaaaagcctggaatgaccgagacaacaggtgcgatatctgcgctacccatctaaaccaactgaagcaggaggcaatacagatggtgctgaccctagaacaagcagccggaagtgaacactacgatgctagcccatgcagcccccctcccctgtcgaacattcctaccctggttggaagcagacacgtaggagggctgcaacaacctcgcgattgggcctttgtgcctgcaccatgcgccacttctaactataccggatttgctaataaacacggaagcaagccttcttcacttggggtgagcaatggggcagaaaagaaaagcgggtcgccgacacatcaggccaaggtgtccctccaaatggccaccagtccttctaacggaaacattctcaactctgtcgctatccaggcacaccagtatctagacggcacatggtctctcagccggacaaacggcgtcacgctctacccgtatcagatttcccagctgatgactgagagctcccgcgaggggctgaccgaggcagtgctgaaccggtacaacgctgataaacccagcgcttgttctgtccctgcgtcacaggggagttgcgtggccagtgagaccagcacgggaaccagcgttgccgcatccttcttcgcacgcgcagcacaaaaactcaatctttccagtaagaaaaaaaagcaccgccctagcacaagtagcgccgcagaaccccctctttttgcaacaagcttcagcggtatccttcagacaagtcccccacccgcacccccatgtctgcttcgagcggtgaacaaagtgaaagacactcccggattaggcaaagtaaaggtcatgcttaggatatgttcgacgctcgctagggacaccagtgaatcttcttcttttctgaaggtcgaccctcggaaaaagcagatcaccttatatgaccctctcacatgcgggggacagaacgctttccagaagaggggaaatcaggtgccaccgaagatgttcgccttcgatgccgtgttcccacaagacgcctcacaggccgaagtgtgtgcaggtaccgtggctgaggtcatccagtcagtggtaaatggtgctgatggctgtgtgttctgctttggccacgccaaactcgggaagagctataccatgatagggaaggacgacagtatgcagaacctcgggatcatcccatgtgcgatctcatggctgttcaagcttatcaatgagcgtaaggagaagacgggagccagattttctgtccgcgtgtctgcagtcgaggtgtggggaaaggaggaaaatctcagggacttgctgtcagaggtggccacgggcagtctgcaagacgggcagtctccgggagtctacctgtgcgaggatcctatatgcggtacgcagcttcaaaaccagtccgaattacgagcccctaccgcggagaaagctgcatttttccttgacgcagccatagcatctcgcaggagccatcaacaggattgcgatgaggatgatcacaggaacagccatgtgttttttactttgcatatctaccagtatagaatggagaaaagcgggaagggcggtatgtcaggcggtcgctctcgtctgcacctcatcgacctcggctcttgcgttaaggccctgtccaagaaccgcgagggaggaagtggtctatgtctgtctttgagtgcactgggcaacgtgatccttgccctggtgaacgggagtaagcatattccatacaaagagagcaagctggcaatgcttctcagagagtccctgggtaacatgaactgtcgcaccaccatgattgcacacatatcagctgccgtgggcagctatgctgagaccttatccactatacagatagcatcaagagtactaagaatgaagaagaaaaaaaccaagtacacatcgtcttcctcgggcggagagtcttcatgcgaggagggacgaatgaggcgtcctacgcaattgcgcccatttcatactcgagccacagtggacccagatttccctattgcccacctctcatcagatccagactactcttcttcaagcgagcagtcctgcgacactgtaatttacatcgggccaaacggcactgccttgtctgataaggaactgacagataatgagggaccaccagattttgttccgatagtacctgcacttcagaaaactcggggtgatagtcgtcccgctgaggccggagaggctgcggcaggaaaatctgaacgcgactgtctgaaatgtaatacatttgcagagctccaggagaggctggactgcatcgatggctcagaggagccatccagcttcccatttgaggaactgccggctcagtttggccctgaacaagcatctaggggcccacgtctgtcccaggccgctggcgcttctccactgtcagagtccgacaaagaagataacggaagcgagggccagctaacgaacagagagggtccggaactgccagcctcgaaaatgcagagatcccacagcccagtgcccgcagccgctccagctcattccccctcccctgcctctcccaggtcagtgcccggaagctcttcccagcactcagcctcccccctggttcagagcccaagcctgcagagctcaagggaatctctcaattcatgtgggttcgtggaggggaaacccaggccaatgggcagccccagactcggcatcgcaagtttatcaaagacgtctgaatataaaccccctagctcaccgtctcaaagatgcaaggtttatacacagaaaggtgtccttccttcccccgcaccactgccaccaagttcaaaggactcgggggtcgcttctagagagagcctccttcagcccgaagtgagaactcccccagtagggatgagcccccaggttctgaagaagtcaatgtctgctggaagtgaaggattccctgagacccctgtggatgatgaacaacaagcagccactccttcagagtcaaagaaggaaatcctaagtactacgatggttacagtgcagcagcctctggaactgaatggcgaggatgaactcgtgttcaccttggtggaggaactaaccatatcaggagtgctcgattctggcaggcccaccagcatcattagtttcaactctgactgttccgccagagcactggcctccgggagccgaccagtgtcgattatctcctcaatatcagaagacctggaatgctactcatctactgcacccgtgagcgaggtatccatcacccagtttctgccactgcctaagatgtcactggatgagaaagcccaggacgcaggctccaggagatcctcaatttcttcatggctcagcgagatgtccgccggatcagaaggggaacagtcgtgccattcctttatcgcgcagacatgctttggacacggagaggctatggccgaacccgtggctagcgagtttgtgtccagcctccaaaacacggccgttgtgtgtagggagaagcccaaagctagcccagataacctgctgatcctgagtgagatgggagacgactctttcaataaggctgctccaattaaaggttgtaagatatcaaccgtaagcaaggcaatggttacaattagcaatacagctaacctgtccagctgcgaaggatatatcccgatgaagaccaatatcactgtctacccttgtatcgcaatgtcaccacgaaacattcaggaacctgaagcacctacagccaccccaaaagctgggccaactctagcccagtctcgggaatcaaaagaaaattctgcaaaaaaagagatgaagttcgaggatccctggctgaagcgggaggaagaggtaaaaaaggaaactgcccatccaaacgaggaaggcatgatgcgctgcgagaccgcgactggccctagcaatgccgagaccagggcggagcaagaacaggatggaaaacctagcccaggggatcgcctttcctccagctctggtgaagtgagtgcatcaccggtgacagacaacttccgccgtgtggtggacgggtgcgagatggctctccccggtctggcaacacagtctccagtccaccccaataaaagcgtcaaatcctcatccctcccaagagccttccagaaagcatctaggcaggaggaacccgactccctctcctactactgtgcagcagaaactaatggcgttggagccgcatccggaacgccacccagcaaggcaacgctcgagggcaaggtggctagccctaaacattgcgtcctcgccaggcccaagggtacccccccactcccgcctgttcgcaagagctcactggatcagaagaatcgcgcatcgccacagcacagcgcgtctggttccggcacatcctctcctcttaaccaacctgcagcctttcccgcaggcctcccagatgagccatctggcaagaccaaggatgcatcttcatcatccaaactgtttagtgccaagttggagcagctggcatccagatcgaattctctggggagggctactgtgtcccactacgaatgcctgtctcttgagagagccgagagcctgagttctgtaagttcaaggctacacgccggaaaggatggaactatgcctcgagccggacgcagtctcggcaggtccgctgggacatctcctccaagcagtggcgctagccccaaggccggacagtctaaaattagcgccgtctctcgtctccttctggccagcccacgggctcggggaccaagtgcttctacaactaagactttatctttttccacgaaatctctcccgcaagctgttggacaagggagtagctctccgccaggcggtaaacacaccccctggtctacccaatcactaagcaggaatcgcagctcaggtctagcatccaagctccccctccgggcagtctccggccgaatttccgaactgctgcaggggggtgcaggcgctcggggtcttcagctgcgggcaggcccagaggctgaagcgcgtgggggagcacttgctgaggacgaacccgcagctgcacatctgctgccctccccttactccaaaatcacgcctcctcgacgcccacacagatgctctagtggacatggcagtgataacagctcagtgctgtccggagagctgcccccagccatgggtaagactgccctcttctatcactccgggggaagcagcggctatgaaagtgtaatgagggatagcgaagccaccgggagcgcctctagcgctcaggactccacctcggagaactcttcaagtgtgggtgggagatgtcggagcctgaagactcccaagaagcgcagtaaccccggaagtcagaggaggcgtctcattccagccctatctctagacacgtccagtcccgttcgcaaaccaccgaattccacaggcgtgcggtgggttgacgggccactgagatcgagccctcggggactcggcgaacctttcgagatcaaggtgtacgagattgatgatgtagagcgcctccaaagacggagggggggagcatctaaggaagctatgtgcttcaatgcaaaattgaaaattctggagcatagacagcagagaatcgctgaggtgagagccaagtacgaatggctgatgaaggaactcgaagcgacaaagcagtatcttatgctggacccaaataaatggctctccgagttcgacctcgaacaggtatgggagctcgatagcttggaatatctcgaggctctagaatgtgtgaccgaacgcctggagtctcgggtgaatttctgtaaggcacacttgatgatgatcacatgtttcgacataaccagcaggcgaagata

SEQ ID NO: 227860 - DNA, 5174 bp, Artificial Sequence
  Description of Artificial Sequence: Synthetic coding sequence
gactggaagacaaaggcagctcagaagctaaacctgagctctaagaaaaagaagcatcgcccaagcacaagctccgccgctgagccccctctgtttgctacaagcttctctgggattctccagacctcaccaccgccagccccaccgtgcctgctgagggctgtaaacaaagttaaagacactccaggcttgggcaaggtgaaggtgatgcttaggatttgttctactctggccagggacacctctgaatctagcagctttctcaaggtggaccccagaaaaaagcagatcaccctgtacgatcctctgacatgtggaggccagaacgcatttcagaagcggggtaatcaggttccccctaagatgttcgctttcgacgcagtgttccctcaagatgcttcgcaggcagaagtgtgtgccggtaccgtggctgaggtcatccaatccgtggtgaatggcgctgatgggtgcgtcttctgttttggtcacgccaagctgggcaaaagctacacgatgataggcaaggatgactccatgcagaatttgggaatcattccttgtgctatctcgtggcttttcaagctgatcaatgaacggaaagagaagactggggctcgattttctgtcagagtctccgctgtggaggtgtggggtaaagaggagaatctgcgggatttgctgtccgaggtcgccacagggtccctccaggacggccagagccccggagtctatctatgcgaggaccctatttgtggtacacagttgcagaatcagagcgagttgagagcccctacggctgagaaagccgcattttttctggacgccgctattgcttccaggcggtcacaccaacaggactgcgatgaggatgatcatcggaactcccatgtgtttttcacactgcatatctaccagtaccgcatggagaaatctggcaagggtggaatgtccggaggcaggagtaggctccacctaatagatctcggatcgtgtgtaaaggccctgagcaaaaaccgggaaggagggtcaggtctgtgcctttctctgagtgctctgggaaatgtgatacttgccctggtcaatggctcgaaacacattccctacaaggagtccaaactggcaatgctgctgcgcgaatcacttgggaatatgaactgccgcacaactatgattgcacacatcagtgccgcagtgggctcctacgctgagacactgagcactatccagatcgccagccgggtgcttcgaatgaagaagaagaaaactaaatatacaagttcaagctcaggaggcgaatcttcgtgtgaagagggaaggatgcgcaggcctacccagttgcggccattccacacccgtgccacagtcgatccggattttcccatcgctcatctgtccagtgatccagattatagctcttcttcagagcagtcctgtgacacggtaatctacatcggtccaaacgggaccgccctgtcagacaaggaacttactgacaacgaagggccaccggacttcgttccaattgtgccagccctgcagaagacccgcggagattctaggcccgcagaggctggcgaagccgctgctggaaaatcggaaagggattgcctgaagtgcaacaccttcgcagaactgcaggagcggctggattgtatcgatggcagcgaagagcccagctcgttcccttttgaagagctgcccgctcaattcggtcccgaacaggcatcccgaggacctagacttagccaggccgctggtgccagccccctgtctgagagcgataaggaggataatggttctgaggggcagcttactaatcgagaaggaccagagttacctgcatcgaagatgcagagatcccatagtccagtgcccgcagccgctccagcccatagtcctagtcctgccagtcccagaagtgttcccggtagcagcagccagcattcagccagcccccttgtgcagtcaccctcgttgcagagctctagagagagtttgaattcctgtgggtttgtggaaggaaagccacgtcctatgggcagcccgcgtctgggtatcgccagcctgagtaaaacctctgagtacaaacccccatcgtctccttcacagcggtgtaaggtgtatactcagaagggcgtgctcccctctcctgcacctttgcccccatcgtccaaggattcaggtgtggctagccgagagagcctcctccagcctgaagtgaggacccctccggtcggcatgtctccacaagtactcaaaaagagtatgagtgcagggtctgaaggctttcccgaaacacctgtggacgacgagcagcaggccgctactccaagcgagtccaagaaggaaatcctcagcacgaccatggtgacagttcagcagcccttggagctcaatggggaagacgaactggtatttacattggtagaggagctgactatctctggggtgcttgattctggaaggccgacgagtatcatctctttcaactcagactgttcagctagagccctcgccagtggcagtaggcccgtttccattatctcaagcatcagcgaagatcttgagtgttacagttctactgccccagtttccgaagtctccatcacacagtttctgcccctgccaaaaatgagcttagatgagaaggcacaggacgccggaagcaggcgtagttccatttcttcctggctctccgaaatgagcgccggatcagaaggcgagcaaagttgtcactcattcatcgcccagacgtgttttggacacggcgaggccatggcagagccagttgcctccgaatttgtatccagccttcagaatacggccgtggtatgtcgtgagaagccaaaggctagcccggataacttgctaatactcagcgaaatgggcgatgattcttttaacaaggcagcccctatcaagggttgtaagattagtacggttagcaaagctatggtgaccatatccaatacagcgaatttaagttcttgtgagggatatatccccatgaagactaacatcaccgtttatccttgcatagcaatgtcccctagaaacattcaggagcccgaggcacctactgctacacccaaagccggacccacacttgcacagtctcgtgaatctaaggagaactccgccaagaaagaaatgaaattcgaagacccgtggctgaaaagggaggaggaggtaaagaaagaaactgcacatcccaatgaagaggggatgatgaggtgtgaaacagcgaccggcccatctaacgccgaaacccgcgctgagcaggaacaggacggcaagccaagccctggcgaccggctcagctcatcctcaggcgaagtgagcgcgtctccggtgacagataactttaggagggtggtcgacggttgcgaaatggcactgccaggtctcgccacccaatctcccgtgcatcctaataagagcgtgaagtcctcttctctgcctagagcgttccagaaggcctctaggcaggaggaaccagacagcctctcctactattgcgccgcagagacaaatggtgtgggtgctgcatctgggacgccaccatctaaagcgacgctcgagggcaaggtggccagtcctaaacattgcgttttggcacgacctaagggcactccccctcttccccctgtgagaaaaagctccctggaccagaaaaatcgagcctcaccccagcacagcgcctccggatctggaacaagctcgcccttgaaccagcctgcggctttccccgcaggccttcccgatgagccctccggcaaaaccaaggacgcttcgtcaagctctaaacttttctctgccaagctggaacagctggcctcaaggtctaattccctgggacgggctaccgtgtcacactatgaatgtctcagtctggaacgggctgagtcgctcagcagcgtttcctcccgcctgcacgcaggcaaggacggcactatgccacgcgctggacggtcactggggaggtccgccggaacttccccgccaagcagcggcgcttcaccgaaagccggacaatcaaaaatctctgctgtctcaagattgctccttgctagccctagagccaggggtccatccgcctccacgactaagactctcagcttttccaccaagtctctgccccaggctgtgggccaagggtcatcaagcccgcctggaggaaagcataccccatggtccactcagtctctcagccgtaataggtcttccgggctcgctagcaaactgcctttaagagccgtatccggacgcatctctgaattgcttcagggtggggcaggagcaaggggactgcagctgcgagcaggaccagaggccgaagccaggggcggtgccctggccgaggacgaacccgcagccgcacacttgcttccttctccctacagtaagatcactcctcccaggcgaccccataggtgttcttcaggacacggctctgacaatagttctgtgcttagcggcgagctccccccagccatgggaaagactgctctgttctatcatagtggcggatcaagcggttatgaatcagtgatgagggacagcgaagcaacaggaagcgccagttccgcacaggattcaacttcggagaactcatcaagcgtaggcggaaggtgtcgtagtctgaaaacaccaaagaaaaggtcgaatccaggctcccagcgcagaaggctgattcctgctctgtctcttgacacgagtagcccagtgcggaagccaccaaactctactggagttagatgggtggacggccctttgcgatcatctccacggggacttggagagcccttcgagataaaggtttatgagattgatgatgtggaaaggctccagcgacggcgtggtggagcctcgaaagaggccatgtgttttaacgctaagctcaaaattctcgagcaccggcagcagagaatcgctgaggtgagagcaaaatatgaatggttgatgaaagagttggaagccaccaagcagtacttaatgctggaccctaataaatggctgagcgaattcgatctggagcaggtgtgggagttggactcacttgagtacctcgaggctcttgagtgtgttaccgagcggctcgagagccgggtcaacttctgtaaagcccatttgatgatgatcacgtgttttgacatcacttcacgcaggagata

SEQ ID NO: 227861 - DNA, 2016 bp, Artificial Sequence
  Description of Artificial Sequence: Synthetic coding sequence
atgatagacttcgacgacgtcgccgcaatcaatccagagctattgcagctcctacccctgcaccctaaagataacttgccccttcaggagaacgtcactattcagaaacagaagcgcagatcagtgaactccaagatccctgctccaaaagagtctctccgtagcagaagtaccagaatgtcaacggtaagtgagttgagaatcaccgcacaggaaaatgacatggaagtcgaactgcctgctgcagctaactcccgcaagcaattctccgtccctccggctcccacgcgtcctagctgccctgctgtggctgagataccactgcgtatggttagcgaggagatggaggagcaagtacactcgattcgcggatcaagttcagctaatcccgtgaatagcgtccgcaggaaatcctgtttagtgaaggaggtcgaaaaaatgaagaataaaagggaggagaaaaaagcacaaaactctgagatgcgcatgaagagggctcaggaatacgatagctcattccctaactgggagttcgctcggatgattaaggaatttcgtgccaccttggaatgccaccctctaacaatgactgacccaatcgaagaacaccgcatctgcgtttgcgtgcggaagcgtcctttgaataaacaggaactggccaaaaaggagatcgacgtaattagtatcccgtctaaatgccttctactggtgcatgagccaaaacttaaggttgacttaaccaaatatttggaaaatcaggcattctgcttcgatttcgcctttgatgaaacagccagtaacgaggtcgtgtaccgtttcaccgcccgtcctctggtccagactatatttgagggcggaaaggccacctgctttgcttacgggcagaccggcagcggaaagacccacactatgggaggggatttgtccggaaaggcacaaaatgcctccaagggtatttatgcgatggcttcaagggatgtcttcctgttgaaaaatcaaccttgctatcgtaaactggggctggaggtttatgttactttctttgagatttataatggcaagctttttgacctattaaataagaaagctaaactaagagtgttagaggacggcaaacaacaggtacaggtggtaggcctgcaggaacacctggttaattctgcagacgatgtgattaagatgatcgacatggggtctgcatgtaggacatccgggcaaacatttgctaatagcaacagcagtcggtctcacgcttgtttccagattatccttagggctaaggggagaatgcacgggaaatttagtttggtggatctggcaggtaatgagcgcggagccgataccagtagcgcagacaggcaaacgcgtatggagggtgctgagataaacaagtctctactggcattgaaggaatgtatccgagctcttgggcagaacaaagcacatacacctttccgggaatccaagctcacccaggtgctgagggacagtttcatcggtgagaatagccgaacctgtatgattgctaccatcagtcccggaataagcagctgcgaatataccctcaacacactcagatacgccgatcgcgtgaaagagctgtctcctcacagtggtccctcaggagagcagctgatacagatggagaccgaagagatggaagcatgttctaacggagccttaatacccggtaatctatcgaaggaagaggaagaactgtcttcccagatgtcttcctttaacgaagcgatgacccagataagggagctggaagagaaggcaatggaggagctgaaagagattattcagcaggggcctgactggttagagctatcagagatgaccgagcagcccgactacgatctcgagacttttgtgaacaaagcagagagtgctctggcacaacaggccaagcacttttctgccctgagggacgtgatcaaagcacttaggctggcgatgcagctcgaggaacaggccagtcgacagataagctccaaaaagcgccctcagtag

SEQ ID NO: 227862 - DNA, 2055 bp, Artificial Sequence
  Description of Artificial Sequence: Synthetic coding sequence
atggccatggattccagcctccaggcaaggctgttccctggtctggccatcaagatccagaggagtaatgggctgattcactctgctaacgtaaggactgttaatctcgaaaagtcatgcgtttcagtggagtgggcagagggcggtgctacaaaggggaaggagattgacttcgacgatgtggctgctattaatcccgaactcttacagctcctccccttgcacccaaaagacaacctgcccctgcaggaaaatgtcaccattcagaagcagaagagacgttctgtgaatagtaagatccccgctcccaaagaaagcttacgctcaagatcgacaaggatgagcacggttagcgaacttcgcataactgctcaggaaaatgatatggaggtggagctgccagccgctgcaaacagccgcaagcagttttctgtgccgctgcggaggaaaagctgcctggtgaaagaggtcgagaaaatgaagaacaaaagggaggagaagaaggcgcagaattctgaaatgaggatgaaacgggctcaagaatatgattccagttttcctaactgggagttcgcaaggatgattaaagagtttagggcaactctggaatgtcaccccttgacgatgaccgaccccattgaggagcataggatctgtgtttgtgtcagaaaacgccctctgaacaagcaggaattggccaaaaaagagatagatgtgatttcaataccaagcaagtgtctcctcctcgtccatgagcctaagctgaaggtggatctgactaagtatctagagaaccaggcattttgcttcgattttgccttcgacgagacagctagtaacgaggtggtatacaggttcacagccaggccactggtgcagacgatcttcgaaggaggaaaggctacgtgcttcgcatacgggcagacaggcagtggcaagacacacaccatgggcggagacctgtcaggcaaggctcagaacgctagcaagggcatttatgccatggcaagccgcgacgtcttcttgctcaagaatcaaccatgctaccgaaagctggggctggaggtgtatgttactttttttgaaatctacaatggcaagctgttcgatcttcttaacaaaaaagctaaactgcgtgtgctggaagatgggaaacagcaggttcaggtagtgggcctgcaggagcatctggttaactccgccgacgatgtgatcaaaatgattgacatggggtcagcctgtaggacttccgggcagactttcgctaacagtaacagttccaggagtcacgcctgctttcagatcattctgagagcgaagggcagaatgcatggcaagttcagtctggttgacctggccggaaacgaaaggggagcagataccagctcagctgataggcaaacgcggatggaaggagccgagattaataagagcctgctggcgctgaaggagtgtatacgagccttaggccaaaacaaagcccacacgccattccgtgagtctaaactcacgcaggtcttgagagattcttttataggtgagaacagcaggacctgtatgatcgccaccatctcacccggtatttcaagctgtgaatacactctgaatactctgcgctacgccgaccgggttaaggagctgagcccccactcagggccaagcggcgaacagctaattcagatggagactgaggagatggaggcctgttcaaacggcgcacttataccaggcaacctctctaaagaggaagaggaactgagctctcaaatgtcttctttcaatgaagccatgacgcaaatccgtgagttagaagaaaaagcaatggaagaactcaaagagatcatccaacaggggcctgattggctggagctttctgaaatgactgagcagccggactacgacctcgaaactttcgtgaacaaagccgagagcgcgttggcacagcaggctaagcatttctcagctctgcgcgacgttatcaaggcgcttagattagcgatgcaacttgaggagcaggctagcagacagattagcagcaagaaacggccacaatag

SEQ ID NO: 227863 - DNA, 1839 bp, Artificial Sequence
  Description of Artificial Sequence: Synthetic coding sequence
atgtcaactgtttcggagttacggatcacagcccaggaaaacgatatggaggtggagcttcctgccgcagccaatagccggaaacagttcagcgtccccccagcccctacccgaccctcctgtccagccgtcgccgagattcctttgcgaatggtgagtgaggagatggaggaacaggtccacagtattcgcggatcctcttccgccaatcccgtgaactctgtgaggcgcaaaagttgtcttgtcaaagaggtagagaagatgaaaaataagagggaagagaagaaggctcaaaacagcgagatgagaatgaaacgggcacaggaatacgacagcagctttcctaattgggaattcgctcggatgatcaaggaattccgcgcaacattggagtgccaccctttgaccatgaccgaccctatagaagagcatagaatctgcgtctgcgtgagaaagcgtcctctgaataaacaggaactggccaagaaggagatcgatgtgatcagcatcccctctaagtgtctgttgctagtgcacgagcccaagctgaaggttgaccttaccaagtacctggagaaccaggctttttgctttgactttgcatttgacgagacagcttcaaatgaggtggtgtacagatttacggcccgacctcttgtccagaccattttcgagggcggaaaggcgacatgttttgcttacggccagaccggttctgggaaaacccacaccatggggggagatctgagcggaaaggctcagaacgccagtaaaggaatctatgcaatggctagtcgggatgttttccttctgaaaaatcaaccttgttaccgaaagctggggctggaggtgtacgttaccttcttcgaaatttataatggtaaactctttgatttgctcaacaaaaaggctaaactgcgagtgctggaggatggcaagcagcaagtgcaggtagttggtctacaggagcatctggtgaactcggcagacgacgtgattaagatgattgacatggggtccgcctgtagaacctcaggccagactttcgctaacagcaactcttcgcggtcccacgcatgctttcagattatccttcgtgcgaagggacgcatgcatggcaaatttagtctcgttgacctggcagggaatgaacgaggtgctgacacaagttctgcagatcggcagacccgcatggaaggcgctgaaattaacaaatcactgctggccttgaaggagtgcatacgcgctctcggacagaacaaggcccataccccctttagagagtccaagctgacacaggtgctgcgggatagctttatcggggagaactcgagaacctgtatgattgcgactatctcccctggcatctcgagctgcgagtacactctgaacaccctccgctacgcagaccgcgtcaaggagttgtctccccactctggcccttctggcgaacagctcattcagatggaaacagaagagatggaggcgtgttcgaacggggctctgattcctggaaacctatccaaggaagaggaggagctgtccagtcagatgtcaagttttaacgaggctatgactcaaatccgggagctggaggagaaagctatggaagagttgaaggagatcattcagcagggacccgactggctggaactctccgagatgaccgaacaacccgactacgacctagaaacgttcgtgaacaaagccgagtcagccctcgcccagcaggctaaacactttagcgctctgcgggatgttattaaggccctgagactggctatgcaactggaagaacaggcctccaggcagataagcagcaaaaagcgcccacagtag

SEQ ID NO: 227864 - DNA, 2178 bp, Artificial Sequence
  Description of Artificial Sequence: Synthetic coding sequence
atggccatggattcctccctgcaagcacggctgtttccgggtctggctattaaaatacagcgatcaaatggtctgatacacagtgctaacgtgagaacagtcaatttagagaaatcatgcgtctccgtcgaatgggctgagggaggtgccacaaaaggcaaagagatcgacttcgacgatgtggctgctataaatcctgaactgctccagctgcttccccttcaccctaaagataacttacctctccaggagaacgttactatccaaaaacagaagcgtcgttcagttaactccaaaattcctgccccaaaagagtccctacgctctaggtcaaccagaatgtccaccgtgtctgaactaaggattacagctcaggaaaatgatatggaggtggagctccctgccgcagcgaattcaaggaagcagttctccgtccctcccgctccaacacggccaagttgtcctgctgtagctgaaattcccctcagaatggtgagcgaggagatggaggaacaggtgcactctattaggggttcctcgtctgccaatccggtgaattccgtcagaagaaagtcgtgcctggtgaaagaagtcgaaaagatgaaaaataaacgcgaggagaagaaggctcagaactctgagatgcgtatgaagagagcacaggagtatgactcctctttcccaaattgggaattcgcacgaatgatcaaagaattcagggctaccctggagtgtcaccctctgaccatgacagaccctattgaggagcatcggatctgtgtttgtgtacggaagagacccctgaacaagcaggagctcgctaagaaagagatcgatgtcattagcatcccctcaaagtgcctgcttctagtgcatgagcctaagttgaaggtcgatctgacaaagtacctcgagaaccaagctttttgctttgatttcgctttcgatgagaccgcatctaacgaggtcgtctaccgctttacagcaagacctttggttcagacaatcttcgaggggggaaaggcaacatgtttcgcctacgggcagacaggctccggcaaaacacatacaatgggaggtgatcttagcggaaaggctcagaacgcctctaagggcatctacgccatggctagtcgggatgtgttcctgctcaagaatcaaccatgctatcggaagttaggtcttgaggtgtacgtaacatttttcgaaatttacaacggcaaactcttcgacctgttgaacaagaaagcgaaactgcgggtacttgaagacggtaaacagcaagttcaggtagtcggtcttcaggagcacctcgttaactcggctgacgatgtaattaagatgatagatatgggctctgcctgccgaacatctggacagacatttgcaaacagcaattctagtcggtcacatgcctgtttccagattattcttagagccaaaggccgaatgcacggcaaatttagcctggtcgatcttgcgggtaatgagcgcggtgctgacactagttctgctgacaggcagactcggatggaaggtgctgaaatcaataagtcccttttagcgctgaaggaatgcatcagagcactgggacagaacaaggcacataccccctttcgcgaatccaagctcacccaggttctgcgcgacagtttcattggagagaattctcggacgtgtatgatcgccactatcagccccggaatctcctcatgtgagtacactctaaacacacttcgctacgctgaccgagtgaaagagttaagcccccacagcggtccgagcggggaacagcttattcagatggaaacggaggagatggaagcctgttctaacggcgctcttatcccgggtaacttgtccaaagaggaggaagagttatccagccagatgtctagtttcaatgaggccatgactcaaattcgcgaactggaggaaaaggctatggaagaattgaaggagatcattcagcaaggccctgattggcttgaactgagtgagatgactgagcagcccgattacgacttggagacgttcgtgaataaggctgagagtgccctggcgcagcaggcgaaacatttcagtgcattgcgagatgtgatcaaggcgctgcgactggccatgcaactcgaggagcaggcctccagacagatctcctccaagaagcgacctcagtag

SEQ ID NO: 227865 - DNA, 324 bp, Artificial Sequence
  Description of Artificial Sequence: Synthetic coding sequence
tgaaaggagtgtatacgagccctaggccagaacaaagctcataccccgttccgtgagtctaaactgacccaagttctccgagactcattcatcggtgagaattcgaggacatgtatgattgcgactatttctccgggaatctcgtcatgtgaatatactcttaacactctcagatacgcagacaggcagggctgtcattcgataccgctggagccacaggcatctaaacccggtaggtgccatatccctctgctgagcaaggaggaggaggaacttagcagccagatgagctcctttaatgaggcaatgacccagatccgctag

SEQ ID NO: 227866 - DNA, 1011 bp, Artificial Sequence
  Description of Artificial Sequence: Synthetic coding sequence
atggccatggactcaagtcttcaggcccgactgtttccagggcttgctataaagatccagcggtctaatggcctcattcacagcgcaaatgtcagaaccgtgaatttagaaaagtcatgtgtcagcgttgagtgggctgagggtggggcaaccaaaggaaaagagattgatttcgacgatgtcgccgctattaatcctgagttacttcagcttctgccactgcatcctaaggataacctacctctgcaggagaacgtcactatacagaaacagaagaggcgctccgtcaactccaagattccagctcccaaggaaagtctcaggtctcggtcaacgagaatgtccaccgtgagtgagctgagaattacagcccaggaaaacgatatggaagttgaactgccagccgcagcaaactcaagaaagcagttctccgttcctctccgaagaaagagctgcctggtaaaagaggtggaaaagatgaaaaataaacgcgaagaaaagaaggcacagaattccgagatgaggatgaaacgagcccaggaatacgattctagctttcctaactgggaattcgccaggatgataaaagagttcagggctacacttgagtgccaccctcttacaatgacagatcccattgaggagcatcgaatttgtgtttgcgtaagaaagaggccgctcaataaacaggaactggccaaaaaggagatcgatgttatcagtatccccagcaaatgccttctcttggttcatgaacctaagcttaaggtggatctgaccaagtacttggagaatcaggccttttgctttgactttgcctttgatgagactgcaagcaacgaagtggtgtacaggttcactgcgagacctctggtgcagaccatatttgagggtggtaaggctacatgtttcgcctacggacaaactggcagcggcaagactcatacaatggggggagatttatccggtaaagcacagaacgcatccaaaggtatctatgccatggcgtag

SEQ ID NO: 227867 - DNA, 864 bp, Artificial Sequence
  Description of Artificial Sequence: Synthetic coding sequence
atggtacggtctggcgtgcccagaagcagagggctcgtgtcagggctgatccacagcgccaatgtcaggaccgtcaatctcgaaaagtcttgcgtatctgtagagtgggccgagggaggagcaaccaaaggcaaggagattgattttgacgatgtcgctgccataaatccagagttattacaactcctccccctccatcccaaggacaacctccctctgcaggagaatgtgactatccagaagcagaaacgaagatctgtgaatagtaagatccccgctccaaaagagtccttaagatctcggtcgacacggatgtctacggtctccgaactccgcatcacggctcaagaaaatgatatggaggtggaactccctgctgcagcaaattctaggaaacaattttccgtgcctcccgctcctacaaggcctagctgccctgccgtcgctgaaatccccttacgcatggtgtcagaggagatggaggaacaggtgcattcaattagagggagctctagcgcaaatcccgtgaactcggttcggcgtaaaagctgcctggttaaagaggtggagaaaatgaaaaataaacgggaggagaagaaagcccaaaacagcgagatgcgcatgaagagggcacaggagtatgattcctcgtttcctaactgggaattcgccagaatgattaaggagtttagagcaactctggagtgccatcccctcaccatgactgacccgattgaagagcatagaatctgtgtatgtgtacggaaacggcctctgaataaacaggagctggctaagaaggagatcgacgttatttcaatccccagcaagtgcctgctgctggtgcacgagcctaagctctag

SEQ ID NO: 227868 - DNA, 2244 bp, Artificial Sequence
  Description of Artificial Sequence: Synthetic coding sequence
atgagcaagctgaagagtagcgagtccgtgcgagtggtggttcggtgcaggccaatgaacggcaaggaaaaggccgcttcctatgataaagtagtggacgtagatgtaaaactgggccaggttagcgtgaaaaacccaaaaggcactgctcacgaaatgcccaagaccttcaccttcgatgcagtgtatgattggaatgcgaaacagttcgaactgtatgatgagacttttaggcctttggtcgattccgttttgcagggattcaatggcactatcttcgcctacgggcagaccgggacgggcaagacatatacaatggaggggatcagaggagacccagaaaagcgaggagttattcccaacagctttgaccacatcttcactcacatctccaggagtcaaaaccagcaatatctggtaagggcatcttatttggaaatataccaggaggaaatacgcgacctgctctccaaagaccagaccaaacgtttggaactgaaagagagaccggacacgggcgtctatgtgaaggacttatcatccttcgtgaccaagtctgtgaaggagattgaacatgtgatgaatgtcgggaaccaaaacagaagcgtaggggcaactaatatgaacgaacactcatcacgaagtcatgctatttttgtgatcactatcgagtgctcagaggtcggactggatggagagaaccatatccgcgtgggcaagcttaatctagtggacctggccggatccgagagacaggccaaaaccggagcacagggggagcgcttaaaggaggccactaagattaatctcagtttgagcgccctgggtaacgtgatctctgccctggttgacggcaagagcacccatattccttatcgcgattctaaactcaccaggctgctccaagacagcctggggggaaacgcaaagactgtaatggttgctaatgtggggcctgcctcgtataatgtcgaggagacccttactactttaagatatgctaacagggcaaaaaatatcaaaaataagcctagagtgaatgaagacccaaaggacgccttattacgagagttccaagaagagatcgctagactgaaagctcagctagagaagaggagtattggtcgacgaaaacggagagaaaagcgcagggagggcggaggaagtggaggaggcggtgaggaggaggaagaagagggtgaggaaggagaggaggaaggcgacgataaagacgactattggcgagaacagcaggaaaaactagagattgagaagagggccattgtggaggaccatagtttggttgccgaagaaaaaatgcggctgctgaaggaaaaggagaagaagatggaggatctacggagagaaaaggacgcagccgaaatgcttggcgcaaaaatcaaagccatggagagcaagctcctggtgggcggtaagaacatcgtcgaccacacaaatgaacagcagaagattctcgagcagaagcgccaggagatcgcagaacagaagagacgcgagagggagatacagcagcagatggaaagcagagacgaagaaacactggaactgaaggagacatattcctccttacagcaggaggtcgacattaagaccaaaaagctgaagaagctgtttagcaagctacaggctgtcaaggcagagatccatgacctgcaggaagagcatatcaaagaacggcaagagctcgaacagactcagaacgagttgactagggaattgaaattaaagcatctgatcatcgagaattttatcccactggaggaaaaatctaagatcatgaacagagctttttttgacgaagaagaggaccattggaagctccatcccataacacgactagaaaatcagcagatgatgaagcggccagtgtccgctgtgggctacaagaggcccctctcccagcacgccagaatgtcaatgatgattagaccagaggccagatacagggccgagaatatagttttgctcgagttggacatgccatctcggacgaccagggattatgagggtcccgcaatcgcaccaaaggttcaggctgccttagatgctgcattacaggacgaagacgaaatccaggtagacgcttcctccttcgagtccacagctaataagaaatctaaggcaaggcctaagtctgggagaaagtccgggagttcgagctccagctcaggcacaccagcatcccagttatatccccagtctcgcggactggttccaaaatag

SEQ ID NO: 227869 - DNA, 1122 bp, Artificial Sequence
  Description of Artificial Sequence: Synthetic coding sequence
atggtggccaatgtgggcccagcaagttataacgtggaggaaactttgaccacgctacgatacgccaaccgcgcaaaaaatattaagaataagccaagggtgaatgaagaccctaaagatgctttgctgagggaatttcaagaggagatcgccagactgaaggcccagctggagaaacgttcaatagaagagaagatgaggttgctaaaagagaaggagaagaagatggaagatcttcgcagggaaaaggacgccgcagaaatgctcggggctaaaattaaagccatggaatccaagctgctagtcggaggtaagaacatcgtggaccacactaatgaacagcagaaaattttggagcaaaagcgtcaggagattgctgaacagaaacgccgtgaaagagagatacagcagcagatggagtcccgcgatgaggaaacactggagttaaaggagacctattcctccttgcagcaagaagtcgacatcaaaacgaagaaacttaagaagctctttagcaaattgcaggccgtaaaagccgagatccatgatctgcaggaggagcacataaaagagcgacaggaactcgaacagacgcagaacgagctgacccgcgaactaaaactcaagcacctgataatcgagaattttattcccctcgaagagaagtctaaaattatgaaccgcgcttttttcgatgaggaggaagaccactggaagctgcacccgattacacgtctcgagaaccagcagatgatgaagcgtcccgtgtctgcagtgggctacaaacgcccactgagccagcatgcccgaatgtccatgatgatccgacccgaggccagatacagagccgagaacattgtcttgctggagcttgacatgccctcgagaaccacaagggactatgaggggccagctatagctcctaaggtgcaggctgcactggacgccgcattacaagacgaggatgagatccaggtggatgcctcttcttttgagtctaccgccaacaagaaaagcaaggccaggccaaaatccgggaggaaatcagggtcctcaagcagctctagcggaaccccagcctcacagctgtatccacagagccgcggtcttgttcccaaatag

SEQ ID NO: 227870 - DNA, 2382 bp, Artificial Sequence
  Description of Artificial Sequence: Synthetic coding sequence
atggcctctaagaccaaggcaagtgaggctctcaaggtggtggccagatgtcgacctctgtctcgaaaggaggaagcagccggacatgagcagattcttaccatggatgtaaaattaggacaggtcacccttaggaatcctcgggctgctccaggcgaattacctaagacttttacatttgacgcagtgtacgacgcaagcagtaagcaggccgacctttacgacgaaacagtgcgacccctgatcgatagcgtacttcaaggatttaacgggactgtgttcgcgtatggccagaccggaacaggcaaaacctatacgatgcagggtacctgggtagagccagaactcaggggggtgatacccaatgcgttcgaacatatatttacacacatcagcaggtctcaaaaccagcaatacttggttcgagcctcatatcttgaaatttaccaggaagagattagggacttacttagtaaggagcctggtaagaggctagagcttaaagaaaatcctgaaaccggcgtgtacatcaaagacttgagtagcttcgtcaccaagaacgtgaaagaaattgaacatgtcatgaacctggggaatcagactagggccgtcggctctacacacatgaacgaggtctccagccgcagtcatgcaatattcatcatcactgtcgagtgttcagagagaggaagcgacgggcaggaccacatccgtgtgggaaagcttaacttggtggacctggccggatctgagcgacaaaacaaggcaggtccgaatacagccggtggcgctgcaaccccgtcctctggtggtggtggaggcggaggcggttccggaggaggcgcagggggagaacgaccaaaagaggctagtaagataaatttgagcctatccgccctggggaacgtgattgcagctctggccggtaatcggagcacccatattccctaccgggactcaaagttgactcgactgttgcaggactctctcggtggcaatgcaaagacaatcatggtggctactctgggtcccgcatcgcattcatacgatgaatctctttccacgctgaggtttgcaaacagggctaagaacattaagaacaaaccacaggtaaacgaagaccccaaagatacactgctgcgagaattccaagaggagattgcaaggttgaaggctcagctcgagaagcgcggtatgttgggaaaaaggccacgtagaaagagttccaggagaaaaaaggcagtctcagcccctcccggttacccggagggccctgtcattgaagcttgggtcgccgaagaggaagacgataacaacaacaaccaccggccaccacagccaatcctcgaatctgctcttgagaagaacatggaaaactatctgcaggagcagaaagaacggttggaggaagagaaagccgcaatccaggacgatagatccttagtgagcgaggaaaagcagaagttgctagaggagaaggaaaagatgctggaagacctgcgcagggaacagcaggcaacggagctcctcgctgcgaaatataaagctatggagagcaaactcctcattggcggtcgcaacatcatggaccacacaaacgaacagcagaagatgctcgagttgaagcgccaggaaatcgccgagcagaagcgcagggagcgggaaatgcagcaagaaatgatgctgcgagatgaggaaactatggaactacgcggtacgtacacatcccttcaacaggaagtggaagtaaaaacaaagaagttaaagaagctctatgccaaactgcaggccgttaaagccgagattcaagaccaacatgatgaatatatcagagtccggcaggatttagaggaagcccagaacgagcagacacgggaactgaaacttaaatatctaattattgagaattttattcctccagaagagaaaaataagatcatgaaccggctctttcttgattgtgaggaggagcagtggaaatttcaaccactagtccctgcgggagtcagttctagccagatgaaaaaacggccaacaagcgctgtcggttataagcggccaatttctcagtacgccagagttgcaatggcaatgggctcccaccctcggtatagagcagagaatataatgttcttggaactggacgtcagcccaccggcagtgtttgagatggaatttagccatgaccaggagcaggatcccagagcactccatatggaaaggctaatgcgcctggatagctttctggaaagaccctccacgagcaaagtaaggaagagcaggagctggtgtcagtctccccagcgccctccaccatcaactacccacgccagcctggcttctgcctcccttcgcccagcaaccgttgctgaccatgagtag

SEQ ID NO: 227871 - DNA, 2382 bp, Artificial Sequence
  Description of Artificial Sequence: Synthetic coding sequence
atggcttccaagactaaagcctctgaggccctcaaggtggttgctcgatgtcgcccattgtcaagaaaggaagaggcagctggccatgaacagatcctaaccatggatgttaagctgggccaggtcacattgcggaatccacgggctgcacctggagagctgcccaagacctttacgttcgacgctgtctacgacgcgtcatccaaacaggcggacctgtatgatgagacagttaggcccttaattgatagcgtgttgcagggtttcaacggcactgtcttcgcttatggacagactggcactggaaagacttatacaatgcaaggaacttgggtagagcccgagctgagaggggtaattcctaatgcctttgagcatattttcactcacatcagccggtctcagaatcagcagtatctggtcagggcgagttacctagagatatatcaggaggagatccgcgacctcttgagtaaagagccaggcaagcggcttgagttgaaagagaatccagagaccggcgtttacatcaaggatctgagctcgttcgtcaccaaaaacgtgaaagagatcgaacacgttatgaatctgggaaaccaaacccgggcagtcggatcaacgcatatgaacgaagtgagctctcggtctcatgctattttcatcataacggtagaatgcagcgaacggggatccgatgggcaggatcacatccgcgtgggcaaactgaacctggtcgacctcgcgggatctgaacggcagaacaaggccggaccgaacactgctggcggagccgctacccctagttcggggggtgggggtggcggaggtggctcaggcggaggagccggtggcgagcggccaaaggaggcaagtaaaatcaacttatccctgtccgccctcggcaatgtgatagctgcgctcgcgggaaacagaagcacccacatcccatacagggacagcaagttgactagactccttcaagattctcttggaggtaacgcgaagacgattatggtggccaccctgggtccagcttcccattcgtacgatgaatctctgagtacacttaggtttgcgaaccgggctaagaacatcaagaataagccccaggtaaatgaggatccaaaagacacgttgctccgagaattccaagaagaaatcgctcggctcaaggcgcagctggaaaaacgagggatgctggggaaaagacccagaagaaagtcatctcgcagaaagaaagctgtgtccgccccaccaggctatcctgagggacctgtcatcgaagcctgggtggctgaggaggaggacgacaacaacaataatcacagaccgccacagcccatccttgaatctgccttagaaaaaaacatggagaattatctgcaagaacagaaggagaggcttgaggaagaaaaggccgctatccaagacgaccggagcctggtgtccgaggagaagcaaaagctgctggaggaaaaggagaagatgctcgaagacctgaggcgagaacaacaggctacagaattgctggcagcaaagtacaaagcgatggaatccaaattactgatcggcggaaggaacattatggatcatactaatgaacagcaaaagatgttggaactgaagcggcaggaaatagcagagcagaagaggagagagcgggagatgcagcaagaaatgatgttgagagacgaagaaacaatggagctgagaggaacatacacctccctgcaacaagaggtcgaagttaagaccaaaaaactgaaaaaactttatgctaagctccaggcagtgaaagctgaaatccaggaccagcatgatgagtatataagggtgcgccaggacttagaagaggcacagaatgagcagacaagagagctcaaactgaagtacttgatcatcgagaactttattccaccggaggaaaagaataagatcatgaaccgactgttcctcgactgcgaggaagagcagtggaaattccagccattggtccccgctggcgtgagttcatcgcaaatgaaaaagagacctacctctgccgtaggatataagcgacccatatctcaatacgcacgcgtcgcaatggccatggggtcccacccacggtacagggccgagaatattatgttccttgagcttgacgtatcccctcctgcggtgttcgagatggagttctctcatgaccaggagcaagatccgagggcactccatatggagcgcttgatgcgtctggactcttttctggagcggccatctacctctaaggttcgcaagagcaggagctggtgccagtcccctcagcgccctccaccgtccacaacccatgcctctctggcatctgcctcgctgcgtcctgccactgtcgccgatcacgaatag

SEQ ID NO: 227872 - DNA, 1800 bp, Artificial Sequence
  Description of Artificial Sequence: Synthetic coding sequence
atgaatctcgggaatcaaacacgcgctgtcggctctacccatatgaatgaggtgagcagcaggagccacgcaatctttattatcacagtggaatgttctgagcgtgggtcagatggacaggatcacattcgggttggcaagctcaacctcgtcgatctcgccggatcagagaggcagaataaggcgggacccaacacggcaggcggagcagcaaccccttcatctgggggtggaggtggagggggtggcagcggcggaggtgcaggtggcgagcggcctaaagaggcctcaaagataaacttatcgctctccgctctgggaaacgtgatagctgctcttgcaggcaacaggtcaacccacataccttatcgggatagcaagctgactcgcctactacaggacagcttaggcggaaacgctaaaactatcatggtcgcaactttggggcctgcatcccattcctacgatgagtcgctgagtactctgcgttttgcaaatcgggcaaaaaatatcaagaacaagccacaggtgaatgaagacccgaaagacacacttctgcgcgagtttcaggaagagattgctaggctgaaagctcagctcgagaaacgtgggatgctggggaagaggcctaggcgaaagagctcccgcagaaaaaaggcggttagcgcccctcccggatatcctgaaggcccagtaatcgaggcttgggtagccgaagaggaggatgataataacaacaaccatcgacctccacagcccatcctcgaaagcgcgcttgaaaagaatatggagaactatctgcaggaacagaaagagagactcgaagaagagaaggctgccattcaggacgacagatcactagtgagtgaagaaaaacagaagttgctcgaggaaaaggagaaaatgttggaggacctgagacgcgaacaacaagccacggagctgctcgctgcaaagtacaaagcgatggaatccaagcttttaataggaggcaggaacatcatggatcataccaatgagcagcagaagatgctggagctgaagcggcaagaaattgccgagcagaagagaagggagagggaaatgcagcaggagatgatgctccgtgatgaggaaactatggagctgagaggcacctatacttcgctgcagcaggaagtggaggtgaaaacgaaaaagttgaagaagctgtatgccaagctgcaagccgtcaaagccgagatacaggaccagcacgacgagtacatcagggttcgccaggatctggaggaggcccagaacgagcagaccagagaactgaagcttaagtatttaatcatagagaacttcatcccaccggaggagaaaaataagataatgaatcgcctcttcttggactgcgaggaggagcagtggaaattccaacctcttgtaccagctggggtctccagctcccaaatgaagaagcgaccaaccagcgcggtcggttacaaaaggcccattagccagtatgcaagggtggccatggctatggggtcccacccaagatacagagccgagaacatcatgttcctggaactggatgtgagcccgccagcagtatttgagatggagttctcccacgatcaggaacaagatccccgagctttgcacatggagcgccttatgcggcttgattcgttcctggagagacccagtaccagtaaggtgagaaagtcacgctcgtggtgccaatccccccagcggcctccgccaagcactacccacgcctcattagcgtctgccagcctccgaccagcaactgtcgctgaccatgaatag

SEQ ID NO: 227873 - DNA, 3384 bp, Artificial Sequence
  Description of Artificial Sequence: Synthetic coding sequence
atgaaagaggaggtaaaaggcatccccgtgcgtgtggccttgcgctgtcggccactggtgcccaaagagattagcgaaggctgccagatgtgtctctcttttgtgcctggggagccgcaggtcgtagtcgggaccgataagtccttcacatacgattttgtgttcgacccctctactgagcaggaggaggtgttcaatacggctgtggccccactcataaaaggagttttcaaagggtataacgcaacagtgcttgcttacggccagacaggctcaggcaagacatacagcatggggggagcgtatacagctgagcaggaaaacgagcctactgttggagtgataccccgagtgatacagttgttattcaaagagattgataaaaagtcagattttgagtttactttgaaagtgtcatacttggaaatctacaacgaggagattctggacctgctgtgtcccagccgcgagaaagcgcaaatcaatatcagggaagaccctaaagaggggattaaaatcgtgggtctgacggagaagactgtcttagtcgcattggacactgtgtcctgtcttgagcagggaaataattctaggacagtagcgtctacagctatgaatagtcagtcatcccgcagccatgctattttcactatatcactggaacagcgtaagaagagcgacaagaacagctccttccggagcaaactacatctggtcgacctggcaggctctgaaaggcagaaaaagaccaaagccgagggtgatcggctgaaggaagggatcaatatcaaccgcggacttttatgcctgggcaacgtcataagcgccctgggcgacgataagaagggcggttttgtcccttatagagacagcaaattaacccggcttctccaggatagcttaggtgggaatagccatacattaatgatcgcctgtgtgagccctgcagatagcaatctagaggagaccctcaacacactacgttatgccgaccgggctcgaaaaataaagaacaaacctatagtgaacattgatccacagaccgccgaattgaaccacctcaaacagcaggttcagcagctgcaggtcctcctgctgcaggcgcatgggggaactctccctggtagcattaccgtggagccatccgagaacttgcagagcttgatggaaaagaatcagagtctcgtggaagagaacgagaaactgagccgcggtttaagcgaagccgctgggcagaccgcccagatgttggaaaggattatcctgaccgaacaggcaaatgagaagatgaatgcaaaacttgaggaacttagacagcacgctgcatgcaagctggacctgcagaagctggtggagactctggaagaccaagagctaaaggaaaacgttgaaattatctgtaacctccagcaactgatcacgcagttgagcgatgaaaccgtggcttgcatggccgctgcgatagatactgccgtggagcaggaggcccaggtcgagacctctcccgagacctccagatcgtccgatgccttcacgacgcagcatgctctaaggcaggcgcagatgagcaaggagctcgttgaactgaacaaggccctcgctttgaaggaggccttagcgcgaaaaatgactcaaaacgatagtcaactccaaccaatccagtatcagtaccaggacaacattaaggaattggagctggaggtgatcaatttgcagaaagagaaggaagaactggttctggagctgcagacagccaagaaggatgccaaccaggccaagctaagcgaaagaagacgcaaaagactccaggaattggaaggccaaattgcagacttgaaaaaaaagctgaatgaacaatcaaaactactcaaactcaaggagtccacggagcgtacagtttcaaagttaaaccaggagatcaggatgatgaaaaatcagagagtgcaattaatgcgacaaatgaaggaagacgctgaaaagtttaggcagtggaaacagaagaaagataaggaggtgatccaactcaaagaaagagacagaaagaggcagtacgagctcttgaagcttgagcgcaacttccagaaacagtccaacgtcctgagacgtaaaacagaggaggctgcggcagccaataaacggctgaaggatgccctccagaaacaacgcgaggtcgccgataagcgcaaggaaactcaatcgcgcggaatggagggcacggctgctcgagttaaaaactggttgggtaatgagattgaggtgatggtttcaacagaggaagccaagagacaccttaacgatctattagaagatcggaaaatactggctcaggacgtggcgcagttaaaggaaaaaaaagagtcgggggagaaccctcctcctaagctgagacgaaggacattctcccttacagaggtgagggggcaggtgtcagaaagcgaagatagtattaccaaacagatcgagtctttagaaaccgagatggaattcaggagcgctcagattgccgatctccagcaaaagttgttggacgcagaatccgaggaccgtccaaagcagcggtgggaaaacatcgcaaccatcctggaagcaaagtgtgccctgaagtatttaattggcgagctagtttcctctaagattcaggtttcgaaactggaaagctcactgaagcagtccaagacctcttgcgccgacatgcagaaaatgctcttcgaggagagaaaccactttgcagaaattgagacagaactgcaagctgaattggtgcgaatggagcagcagcaccaggagaaggtgctctatctcctctcacagttgcagcagtctcagatggcagagaagcagttggaggagtctgtgtcggaaaaagagcagcagcttctcagtacgttaaagtgccaggatgaagagttggaaaagatgcgagaggtgtgcgagcagaatcagcagctgctgagggagaacgaaatcatcaaacagaaactgaccttgctccaggttgcctctcgccagaaacatctgcccaaagacactttgctcagtcctgactccagctttgaatatgtacctcctaaaccaaaaccctctcgcgtcaaagagaaattcttggagcaatctatggatattgaagatctaaaatactgctctgagcattctgtaaacgagcatgaagacggcgatggtgatgacgatgaaggagacgatgaagagtggaaacctactaaactggtgaaggtgtcccgtaagaatatccaaggagtactgctcctgacacctgtcatttcagccttgtgggaggccgaagcacgaggtttgctcgaggcacggagcagccgacccgcatgggcaacatggagagatcctgtatcaaccaagcccaagaattag

SEQ ID NO: 227874 - DNA, 3699 bp, Artificial Sequence
  Description of Artificial Sequence: Synthetic coding sequence
atgaaggaagaagtgaagggaatccccgtacgcgtggcgctacggtgcagaccactggtgcctaaggagattagtgagggctgccaaatgtgcctgagcttcgtgcctggagagccccaggtggttgtagggaccgacaaatcctttacgtacgatttcgtgtttgatccaagtaccgagcaggaggaggtatttaataccgctgtggcaccgctgatcaagggcgtgtttaaaggctacaacgccactgtgctcgcctatggtcagaccggaagcgggaaaacttactcaatgggcggtgcctacaccgcagagcaggaaaacgaacctaccgtgggggtgatccccagagtgatccagttgcttttcaaagagatcgataagaagtcagacttcgagtttacgttgaaggtaagctatctggagatctataatgaggagattctggatctcctttgccccagccgagagaaagcccaaatcaacattcgagaagatccgaaagaagggatcaaaattgttgggctgactgagaaaaccgtgctggtggctttggacaccgtatcgtgcctcgaacagggcaataacagtcgaacggttgcttctactgccatgaattcccagtcatcaagaagccatgccatattcactatttccctggaacagagaaaaaaaagtgacaaaaattcttcattccggtctaaattgcacctcgtggacctcgcaggatccgagaggcaaaagaaaaccaaagccgagggagaccgactcaaagaagggattaatatcaatcggggattactgtgcctcgggaacgtgattagcgctctcggcgacgacaagaagggaggctttgtgccataccgggattccaaactgacaagattgctacaggattcattgggcggaaacagtcacaccctgatgatcgcttgcgtttctcccgcagactcaaacctggaagaaaccctgaatacactgagatacgctgatagagctcgtaagatcaagaataagcccattgtgaatattgacccacaaacagctgagctcaatcacctgaagcagcaggtgcagcagctgcaggtcctgctgctccaggcccacggaggcactttgccaggttctatcaccgtcgagccgagtgaaaacctgcaaagcttgatggagaaaaatcagagcttagtcgaggaaaacgagaagctctcccgaggactgagtgaagctgcaggtcagaccgctcagatgcttgaacgtatcattttaactgagcaagcgaacgagaagatgaatgccaagctcgaagagctgcgacagcatgccgcatgtaagctggatctgcaaaaattggtcgagactctcgaagaccaggagttgaaagagaatgtggagatcatctgtaacctccagcagttgatcactcagctgagcgacgaaaccgtagcttgtatggcagccgcaattgataccgcagtcgaacaagaggctcaggtggaaacctcgcctgagacctcccgctcttctgatgccttcacaactcagcacgccttaagacaggcccaaatgtccaaggagctcgtggagttgaataaggcactggccctcaaggaagcactcgcgagaaaaatgacacagaatgattcccagctgcaaccgatccagtatcagtaccaagacaatattaaggaactggaactggaggtgattaacctgcagaaagaaaaagaggaactagtcctggaactccaaactgcaaagaaggatgccaaccaggccaaacttagcgagcggcgtaggaagaggctccaggaactggaaggtcagatcgccgatttgaagaagaagcttaacgagcagtctaagcttctcaaactcaaggagtctacggagcgcacggtgtccaaacttaatcaggagatccgtatgatgaaaaaccaacgcgtccaattgatgcgccagatgaaagaagatgcggagaaatttcgtcagtggaagcaaaagaaggataaagaggtgattcaattgaaagaacgcgaccgcaagaggcagtacgagctgctaaaactggagcgaaactttcagaaacagagcaatgtgttaagaagaaagacagaagaggcagccgctgcaaacaagcgattgaaggatgctcttcagaagcagagggaggtggctgacaaaagaaaagagactcagtccagaggtatggagggcaccgctgccagggtgaaaaattggctgggcaacgagattgaggtcatggtatccaccgaggaagcaaaacgccacctcaacgatctgctggaagatcgaaagattttggcccaagatgtagcccagctaaaagagaaaaaggagtcgggggagaaccctccaccgaagctgagacggcgaacattctctctgaccgaagtaagggggcaggttagtgagagtgaggacagcattaccaagcagattgagagcctggagacagaaatggagttcaggagtgctcaaatcgccgacctgcagcagaagctgctggacgctgaaagcgaggaccggccaaagcagagatgggagaacattgcaaccatcctcgaggcaaagtgtgctcttaagtatttgataggggagttagtgtcatccaagattcaggtaagcaagctggaatcctctctcaagcaaagcaaaaccagctgtgccgacatgcagaagatgctgttcgaagagaggaatcactttgctgagattgaaaccgagcttcaggctgagctcgtccgaatggaacagcagcaccaggagaaggttctttatcttctttctcaattacaacaaagtcaaatggctgagaaacagcttgaagagtccgtttctgagaaagaacagcagttactatccacacttaaatgtcaggatgaagaactagaaaagatgagagaggtgtgcgagcaaaaccaacagctattgcgggaaaacgagatcatcaaacagaagctaacactgttacaagtggcttcccgacaaaaacatcttcccaaggacacgctcctgtcccccgattcgagttttgagtatgttccccctaagcctaagcccagcagggtcaaggagaaattccttgagcagtccatggacatagaggacctgaaatattgttcggaacactccgtcaacgagcatgaggacggggatggagacgatgacgaaggagatgatgaagaatggaagcccactaagttagttaaggttagccggaagaacatacagggttgttcatgtaagggatggtgcgggaacaaacagtgtggttgccggaaacagaagtccgattgtggtgtggactgctgttgcgacccaactaaatgtaggaaccggcagcagggtaaagattctctcggtactgtagagagaacccaggatagcgaaggctccttcaaactggaagacccgaccgaggtgaccccagggctgagcttctttaaccctgtctgcgctacccctaatagtaagatcctgaaggaaatgtgtgacgtggaacaggtcctgtcaaaaaaaacgccaccggctccaagcccattcgatcttccggaactgaagcacgtagccacggagtaccaggaaaataaggctccgggaaaaaaaaaaaagagagctctggcctcaaacacatcattcttcagcgggtgtagtcctatcgaagaagaagcgcattag

SEQ ID NO: 227875 - DNA, 1605 bp, Artificial Sequence
  Description of Artificial Sequence: Synthetic coding sequence
atgtgcagtgatgtaaagcgcgaggcggcagctgctaataagcggctcaaggacgcgctacaaaagcagagggaagtggccgataaacgcaaagaaactcaatcccgcggaatggaagggaccgctgccagagtcaagaactggctgggcaacgaaatagaggtcatggtatctacggaggaagcgaaaagacatctgaacgatttgctggaggacaggaaaatcttggcccaggatgtagcccagctcaaagagaaaaaagagagtggtgaaaacccgccacccaagctgcgccgaaggacattctctctgactgaagttcgcggacaggtatccgagagcgaagacagcattactaagcagatcgagtcattggagactgaaatggagtttagatctgctcagatcgcagatcttcaacagaagctgttggacgcagagtccgaagatcgaccaaaacagagatgggagaacatagccacaattctcgaagcaaaatgcgccctgaagtacctgattggcgagctcgtcagctccaaaatccaggtgagtaagctggaatcgagtctgaagcagagcaagacctcatgcgcagacatgcaaaaaatgcttttcgaagagagaaatcattttgcagaaatagaaaccgaattgcaagccgagctggtgcggatggagcaacagcaccaggagaaggttctgtacttactttcccagcttcaacagtcacagatggccgaaaagcagctagaagagtccgtatccgagaaggaacagcagctcttgagcacacttaaatgtcaggacgaagagctagagaaaatgagggaggtctgcgagcagaatcagcagctactgagggagaacgagataatcaagcagaaactgactcttctgcaggtggcatcccgccaaaaacatctgccgaaagacacactgctgtctcccgattcaagctttgagtacgtgccccctaaaccgaaaccatcacgagtgaaggagaagtttctggagcaatccatggacatcgaggacctgaaatattgttctgagcactccgtgaatgaacacgaagatggcgatggcgacgacgacgaaggagatgatgaggaatggaagcctactaaactcgtcaaagtctctcggaagaacatccagggctgctcctgtaaaggatggtgcgggaataaacagtgtggttgccgaaaacagaaatcagactgtggcgtggactgttgttgtgatccgactaagtgccggaaccggcaacaggggaaagactcgctcgggactgtcgagaggacccaagattcggagggctctttcaagctcgaagatccaactgaagtcactcccggtctgtcattttttaaccctgtgtgtgcaacacccaactctaaaattcttaaagaaatgtgcgacgtggagcaagtgttgtcaaagaagactcccccagccccttctccctttgacctccctgaacttaaacacgtggccactgagtatcaagagaataaagctcccggaaaaaagaagaaaagggcactcgcgtccaacacctccttcttctctggctgctcccccatagaggaggaagctcactag

SEQ ID NO: 227876 - DNA, 3705 bp, Artificial Sequence
  Description of Artificial Sequence: Synthetic coding sequence
atgaaagaagaggtgaagggcattcctgttcgcgtggccttgaggtgccggccactcgtgcccaaagagattagtgagggctgtcagatgtgcctgtcattcgtgccaggggagactcaggtggtagtcgggaccgacaagtcattcacctatgatttcgtgtttgatccctgtacagaacaggaagaggtctttaacaaggcagtggcacctctcatcaagggaatttttaaaggctacaatgctaccgtgctggcatatggtcagaccggcagcggcaagacttacagcatgggcggtgcctacacagcagagcaggaaaacgagccaaccgtgggtatcatccccagagttattcagctcttatttaaagagatagacaaaaagtccgactttgagtttacgttaaaggtatcttacctagagatatataatgaagagatactggatctgttatgtccatctcgcgagaaggcacagatcaacatccgcgaggaccccaaagaaggcattaagatagtgggtctgaccgagaagaccgtgctggttgcccttgatactgtatcttgcctggagcagggcaacaatagtagaaccgtggccagtaccgcaatgaactctcagtcttctcggagtcatgccatttttaccatttctattgaacaacgtaaaaaatcagacaagaactgcagcttcaggagcaagcttcacctggttgatctggctgggtcggagcggcaaaaaaagaccaaagctgagggagatcgattgaaggagggcatcaacattaaccgaggactcctctgcttggggaatgtgatttctgctttgggcgatgataaaaaaggctcctttgtgccctacagggactctaaactgactcgtctcctgcaggacagtctggggggtaactctcatacactcatgatcgcctgcgtgtcacctgcagacagcaaccttgaggagaccctgagtactttacggtacgccgatcgggcaagaaaaatcaagaacaagcccattgtaaatattgatcctcatacagctgagctgaatcatctcaagcagcaggtccagcagctccaagtgctcctgctgcaggcccacggaggcactctgcccggatccataaacgccgagccatcagagaacctgcagtcattaatggaaaaaaaccagtcattagtagaggaaaacgagaagctttcaaggtgcctttctaaagctgccggtcagacggctcaaatgctcgaacgaatcattttgaccgagcaggtgaacgaaaaattaaatgctaaactcgaagagctcagacagcatgtcgcctgcaaactggatctccagaagcttgtcgagaccctggaggatcaggaattgaaggaaaacgtggaaatcatctgtaacctccaacagctcatcacccagcttagcgatgagactgtggcatgcaccgcagccgcaattgatacagcggtcgaggaggaggcacaggtggagacctcccctgaaacgtctagatcaagcgatgccttcaccacacagcacgccctccatcaggcgcaaatgagcaaggaggtggtggaactgaacaatgcactcgctctgaaagaggcactggtccgaaagatgacccagaacgataaccagcttcagcctatccaattccagtaccaggacaatatcaagaatctcgagttagaagtgatcaacctgcagaaggagaaggaagagttggtgcgggagttgcagacggccaagaagaacgtcaaccaggcgaagctgagtgagcacaggcataaactcctgcaggagctggagggacagatcgctgacctcaagaagaaactgaatgagcaatcaaaactgctgaaacttaaggagtcaaccgagcggactgtgagcaaattgaatcaggaaatctggatgatgaaaaatcagcgggtccagctgatgaggcaaatgaaagaagatgccgagaagttcagacagtggaagcagaagaaagataaggaggttatacagctgaaggagcgggaccggaagcgccagtacgagttgctgaagttagaacggaatttccagaaacaatctagtgttctgcgcagaaaaactgaggaagccgcagccgctaacaaaagacttaaggatgcacttcagaaacagagggaagtgaccgataagcgaaaggaaacacaaagccatggtaaggaaggcattgccgctagagtcaggaattggcttggaaatgagattgaagtcatggtctccaccgaagaggctaaacgtcacctgaacgatctattggaagatcgtaagatcctggctcaggatgtggtccagcttaaggaaaaaaaagagtcaagggaaaacccccctcccaagctccgtaaatgcacgttctcattgtcagaagtacatggtcaagttttggaatccgaagactgcattacaaagcaaatcgaatctctggagacggaaatggagctaaggagcgctcagattgccgacctgcaacagaaactgttggatgcagagagtgaggatcgcccaaagcagtgctgggaaaatattgccacaattttagaggctaaatgcgccctgaagtacctgataggcgaattggtttccagtaagatccatgtgacgaagctggaaaattccctaagacagagcaaagcctcttgtgctgacatgcagaaaatgctgttcgaggagcagaaccacttttccgagatagagaccgaattacaggctgagctggtacgcatggaacagcaacatcaggaaaaagtgctctacttggtttctcagttacaggagagccaaatggctgaaaagcaacttgagaagtccgctagcgagaaggaacagcagctggtatccaccctgcagtgtcaggacgaggaactcgaaaagatgagagaggtgtgcgaacagaaccaacaactgctgcaggagaacgagataatcaagcagaaactaatcctgctgcaggtcgcaagccgtcaaaagcatctaccaaatgatactctgttgtcaccagactctagcttcgagtatataccaccaaagcctaagccttctagagtgaaggagaaattcttggagcagagtatggatattgaggaccttaagtactgctccgagcacagcgtaaacgagcatgaggatggagacggggatggagattcagatgaaggagacgacgaagaatggaagcctacaaagctggtcaaagttagccggaaaaatattcaggggtgttcttgtaaaggctggtgcgggaataaacaatgtgggtgcagaaagcaaaagagcgactgcggagttgactgctcctgtgatcctaccaagtgtcgcaacagacagcagggcaaggacagcctgggcacagttgagcagacacaggactctgaaggatctttcaagcttgaggatcctaccgaggtgacaccaggcctctccttctttaatccagtttgcgccacgcctaatagtaagatattaaaagagatgtgtgacatggaacaggtattgtccaaaaaaactgctcccgctccgtcccctttcgaccttccagagagcaaacacggggctacagagtaccaacagaataagcctcctgggaaaaaaaagaagcgcgctttagcgtcaaacactagtttcttttctgggtgtagtcccattgaagaagaggcacattag

SEQ ID NO: 227877 - DNA, 3099 bp, Artificial Sequence
  Description of Artificial Sequence: Synthetic coding sequence
atggcagagaccaataacgagtgctccataaaggtgctgtgcagattccgcccattaaaccaggcagagatccttagaggtgacaaatttattccaatcttccagggcgacgactcagttgtgattggcggaaagccatacgtgttcgatagggtctttccacccaacacaacccaggagcaggtgtaccacgcctgtgcaatgcagatagttaaggatgtcctggctggctacaacggtaccatcttcgcttacggacagacgtcaagtgggaaaacacatactatggaggggaaactccacgaccctcagctcatggggataataccccgtatcgccagggacatattcaatcacatctacagtatggacgaaaatctggagtttcacattaaggtgtcctacttcgagatatacctggacaagattagggacctgctggacgtgaccaagactaacctgtccgtgcacgaagacaaaaatcgagttcccttcgtcaaaggatgcaccgagcgattcgtttcgagccccgaagaaatcttagacgttattgatgaggggaaatctaaccgccacgtagcagtgactaatatgaatgaacatagctctagatcccactccattttcctgatcaacattaagcaggaaaacatggaaaccgaacaaaaactgtccgggaagttgtatctggtggacctggccggttccgaaaaagtgagcaagacaggggctgaaggagcagttctggacgaggctaaaaatattaacaagtcattgagcgcccttggaaacgtgatcagtgcgctggcagagggaacaaaaagctatgtcccataccgagatagtaaaatgacacggatcctgcaggacagcctgggcggaaattgtcggacgacaatgttcatctgctgtagtccttccagttacaacgatgccgaaactaaaagtactctgatgtttggccagcgtgctaaaaccatcaaaaatacagcctccgtcaatctggaactcacagctgaacaatggaagaagaagtacgagaaagaaaaagagaagacaaaggcccagaaagaaaccatagctaagctcgaagcggagctgtctcggtggagaaacggtgagaatgtccccgaaactgagcgcctggccggagaggaggccgcactgggagcggaactgtgtgaggagactcccgttaacgacaactcaagtattgttgttagaattgcgcctgaagaaaggcagaagtacgaagaagagattcgtaggctctataagcagctggacgacaaagacgatgaaattaatcagcagtcacagctcatcgaaaaactgaagcagcaaatgctcgaccaggaagagctgctggtcagcaccaggggggataatgagaaagtgcaaagggagcttagtcaccttcagagcgagaacgacgcggcaaaggatgaagtcaaggaggtgctgcaggccctggaggagctggctgttaattacgaccagaaatcacaggaggtggaggagaaaagtcagcagaaccaactgctcgtggacgaactcagccaaaaggtagctacaatgctttctctggagtcagagttgcagaggctgcaggaggtgtccggccatcagcgtaaaagaattgcagaggtgctgaacggactgatgaaggatctgagtgaattttctgtcatcgtcgggaacggagaaattaagctaccggtcgaaatttcaggcgctattgaggaggagtttaccgttgccaggctctacatcagcaagattaaatcagaagtgaagtcagtggtgaaacggtgcaggcagctggaaaacctgcaggttgaatgtcaccgcaaaatggaggtaaccgggcgagagctcagctcctgtcagctgctcatctctcagcacgaggccaagattagatccttaaccgaatacatgcaatcagtagaacttaagaagcgtcacttggaagaatcttacgattcactgagcgatgaactggctaagctgcaggcgcaagagactgtgcatgaagtggccttaaaagacaaggaacccgacacgcaggatgccgatgaggttaagaaggctctcgagctgcaaatggagtcgcatcgagaagcccaccaccggcagcttgccaggctacgagacgaaataaacgagaagcagaagacaattgacgagctgaaggacctcaatcaaaagcttcaactcgaactagaaaaactgcaggcagattacgagaaactaaaatccgaagaacacgaaaagtcaacaaaacttcaggaactgaccttcctgtatgaacgccatgagcaatctaaacaggatttaaaaggccttgaagagaccgtcgcccgagaactccaaaccctccacaatctgcgcaaattgttcgttcaggacgttacaactagggttaaaaaaagcgcagagatggaacctgaggatagcggcggaatccactctcagaaacagaagatttctttcctggagaataatctggaacagctgactaaggtgcataaacagttggtacgcgataacgcggacctcaggtgcgagttaccaaagctcgagaagcggcttagagcaaccgctgagagggtgaaagccttagaaggtgccctcaaagaagccaaggagggtgcaatgaaggacaagcgaaggtatcagcaggaagtagaccgaatcaaagaagctgtgcggtataaatcctccggcaagcgcggacacagcgcccagattgccaaacctgttcgaccaggacattacccagcgtccagtcccaccaacccttatggaacgagaagcccggagtgcattagctatacaaactctctgttccaaaactaccagaacctctatttgcaggccaccccatcgagcacaagcgatatgtattttgccaatagttgcacatcatcgggtgctacttcgagcgggggaccgctcgcgtcctatcaaaaagccaatatggataacggaaacgctacagacataaatgacaataggtccgacttgccttgtggctatgaagccgaagatcaggctaagctgtttcctctgcaccaagaaacggctgcgtcctag

SEQ ID NO: 227878 - DNA, 381 bp, Artificial Sequence
  Description of Artificial Sequence: Synthetic coding sequence
aagagcagcggaaaaagaggtcactctgcccaaattgccaaacctgtcagacccggtcactatcccgcttcttctccaacaaatccctacgggacccgatcccccgagtgcatatcatacactaatagtttgttccaaaattaccaaaacctgtaccttcaagcaaccccatcttctacctccgacatgtacttcgccaattcttgcactagctccggggcaacttcgagcggcggacctctagccagctaccaaaaagcaaacatggacaacggcaatgcaaccgacattaatgacaatcggagtgacctgccatgcgggtacgaggccgaagatcaggcgaaacttttcccgctccatcaagaaaccgccgcatcatag

SEQ ID NO: 227879 - DNA, 2892 bp, Artificial Sequence
  Description of Artificial Sequence: Synthetic coding sequence
atggccgaccttgctgagtgtaatatcaaggtcatgtgcagattcaggcctctgaacgaaagtgaggtgaacagaggggataagtatatcgccaagttccagggggaggacaccgtggtcatagcctctaagccatacgcctttgacagagtttttcagtcctctactagccaggaacaagtatataatgactgcgctaagaaaatcgtgaaggatgtgttggaagggtataatgggacaatcttcgcatacggacagaccagtagcgggaaaactcacacgatggagggcaagctgcatgaccctgaagggatggggattattccacgcattgttcaggatatttttaactacatttacagcatggatgagaatcttgagttccatattaaggtctcctacttcgagatctaccttgataagatcagggacctcttagatgtgagcaaaaccaacctgtcagtgcatgaagataagaatcgtgtcccttacgtgaaaggctgtacagagaggttcgtctgtagtcctgacgaagtaatggatactatcgacgagggaaaatctaatcgtcacgtggcagtaaccaacatgaacgagcattcttcccgtagccacagtatattcctgataaatgtcaagcaagaaaacactcagacagagcaaaagctgagtggaaaactctacctggtggatctggccggttctgaaaaagtgtctaagaccggggctgagggcgcagtgctggatgaggcaaaaaacatcaataaatccctttcagctctgggcaacgtgatctcagctctggccgagggatccacatatgtcccttacagggacagcaagatgacacggattctacaggactcactgggcggtaactgccgtactacgattgttatatgttgtagccccagttcctacaacgaaagcgagacaaaatctacactcctcttcggtcagagggcgaaaacgataaagaataccgtgtgtgtgaacgtggagcttacagccgaacagtggaagaagaagtacgaaaaggaaaaggagaaaaataagattcttagaaatacaatacagtggctggaaaacgaactgaataggtggaggaatggtgagacggtcccaattgatgagcaattcgataaggagaaggccaacctcgaggccttcactgtagataaggacatcacactaactaacgacaagccagcgacggcaattggggttataggtaatttcactgacgccgagaggaggaaatgtgaggaggaaattgccaaattatacaagcagctggacgataaggatgaagagattaatcagcaatcacagctagttgaaaaactcaagacccagatgctcgaccaggaggagctgctggcttctactaggagggaccaagacaatatgcaagctgagttaaaccgcctgcaggcagaaaatgacgccagcaaagaagaggtgaaagaggtgttacaagccctcgaagagttggcagttaattacgaccagaagtcacaagaggtggaagataagacaaaggagtatgagctgctgtcagacgagctcaaccagaaatcagctactttggcgagtatcgatgcggagctgcagaaactcaaggaaatgactaaccaccagaagaaacgcgcagccgaaatgatggctagcttattgaaggacctcgccgaaattggtattgccgtggggaataacgatgtgaaacaacccgagggtacaggaatgatcgatgaagagtttactgtggcccgtctttatatttctaaaatgaagagcgaggtgaaaactatggtcaaacggtgtaagcaactcgaatcgacacagaccgagtcaaataagaagatggaggagaacgaaaaagagctggcggcttgccagttgcgtattagtcaacatgaggccaagatcaagagccttacagagtacctgcagaatgtggagcaaaaaaagcgccaactggaagagtctgtcgacgctctgtccgaggagttggttcagttaagagcccaagagaaagtccacgagatggaaaaagaacatcttaacaaagtgcagaccgcgaacgaagtgaaacaagcagtggaacagcagattcagagccaccgcgagactcatcagaagcagatttctagcctgcgcgacgaggtggaagcaaaagcgaagttgatcacagatctgcaggatcagaaccagaagatgatgctagaacaggaacggctaagggtcgagcacgagaaacttaaggccacagaccaggaaaagtcacgcaaacttcacgagctcactgtgatgcaagatagaagagaacaagccagacaggacctcaaaggcctcgaggaaacggtggccaaggagttgcagaccctgcacaatcttaggaaactcttcgttcaggacttggcaacacgggtgaaaaaatctgcagaaatcgacagtgacgataccggcggttccgccgctcaaaagcagaagatctccttcctagaaaataacctggagcagctaactaaggtgcacaaacagctagtcagagacaatgccgacctgagatgcgaattgccaaagctggaaaaacgcctaagagcaacagcagagagagtcaaggccttggaatctgcattaaaagaggctaaggagaacgcctcaagagatagaaaacgttaccaacaggaggttgataggatcaaagaggccgtgcgatccaagaacatggcgaggagaggccattccgctcaaatcgctaaacctatacgacccggacagcaccccgctgccagtcccacccacccttctgccattcgcggtggcggtgccttcgtacagaactcacagccagttgcggttcgaggcggtggcggtaagcaggtgtag

SEQ ID NO: 227880 - DNA, 2583 bp, Artificial Sequence
  Description of Artificial Sequence: Synthetic coding sequence
ggcaaattgcatgatccacagctgatgggcattatccccagaattgcacatgacatcttcgaccacatctattcaatggatgaaaatttagaattccatatcaaggtctcatacttcgaaatttatctcgataaaattcgagatttgttggacgtgtccaaaacaaatctcgcagttcacgaagacaagaacagggtaccatatgttaaaggctgtactgagcgctttgtcagttcccccgaagaggtgatggacgttattgacgaaggtaaagccaaccgacacgttgccgtcacaaacatgaatgagcacagcagtaggtcacatagcatattcttgattaatattaaacaggagaatgtggagactgagaagaagctgtcagggaaactgtacctggtggaccttgccggttcagaaaaggtcagtaagacgggtgcggagggtgccgtgctggacgaagccaaaaacatcaataaaagtctgtcagccctgggcaacgtcataagcgcgcttgctgaaggtactaagacccatgttccatatcgcgactcgaaaatgaccagaatactccaggacagtttaggcggaaactgccggaccactatagttatctgctgctcaccaagcgtattcaacgaagctgaaactaaatcaaccctcatgtttgggcagagagctaaaaccatcaagaatactgtgtcagtgaatctggaactaacggctgaggaatggaaaaaaaagtatgagaaggaaaaggagaagaacaagacgctgaaaaatgtaattcagcacttggaaatggagcttaatcgctggaggaatggcgaggctgttcccgaggacgaacaaataagcgctaaggaccagaaaaacttagagccttgtgacaacactcccattatcgacaacatcgccccagtggttgccggaatctccacagaggagaaggagaaatacgacgaagagatctcaagcctgtacagacagctggacgataaagacgacgaaattaaccaacagagccagctggctgagaagctgaagcagcagatgctagatcaggatgagctgctagccagcacccggcgagactacgagaagatacaggaggaactaacccgcctccaaattgagaacgaggccgcaaaagatgaagttaaggaagttctacaggctctcgaagagctggccgtgaattatgaccagaagagccaggaagtcgaggataagacccgggctaatgaacagcttaccgacgagctcgctcaaaagaccaccaccctgacaaccacacagagggagctgtcccagctccaagagctcagtaatcaccaaaaaaagcgtgctacagaaattctgaatctgctacttaaggatctcggtgagatcgggggtatcattggaacaaatgatgtgaaaacactggcagacgttaacggcgtgattgaagaggaatttaccatggcacggctctatatctcaaagatgaaaagtgaagttaagagtctggtcaataggtctaagcagctagagagcgctcagatggattcaaaccgaaaaatgaatgcatccgagagagaactggctgcttgccagttactcatttcacagcatgaggccaaaataaagagcctgaccgactatatgcagaatatggagcagaagagacgccagctcgaagaatctcaagacagtctgagcgaagagctggctaagctgagggcacaggaaaaaatgcacgaagttagcttccaggacaaggagaaagaacacctgacgagactgcaggacgccgaggagatgaagaaggcgttggagcagcagatggaatcacatcgcgaagcacatcaaaagcagttgtcccgcttgcgcgacgaaatcgaggagaaacagaaaatcattgacgaaattcgtgacctgaatcagaagctgcagcttgaacaggagaaactgagtagtgactacaacaagttgaagatcgaggaccaggagcgcgaaatgaagctggaaaagctcttgctcctcaacgataaaagagaacaagctcgcgaggacctcaaggggctggaggagaccgtgagcagggaattgcagaccttgcacaacctgcgcaagctctttgtccaagatctaactacacgggtgaaaaaaagcgtggagctggataatgacgacggtggtggttctgcagctcagaagcagaagatatccttccttgagaataatctcgaacagttaaccaaagtgcacaagcagcttgtaagggataacgctgatttgcgttgtgaactgcccaagctagaaaagcgactgcgagccaccgccgagcgggtcaaagccctagagtctgcactgaaggaggcaaaggaaaatgcaatgcgggaccgaaagcgatatcagcaggaagttgataggataaaagaggcagtgagagctaaaaacatggctcggagggctcatagtgcccagattgccaagcccatccggcctggacattacccagcctcatcgcctaccgcagtacacgccattaggggaggaggcggttcaagctctaactcaactcattatcagaaatag

SEQ ID NO: 227881 - DNA, 2178 bp, Artificial Sequence
  Description of Artificial Sequence: Synthetic coding sequence
atggccacctacatacatgtctcaaagaccggtgctgaaggagcggtgctggatgaggcaaagaacataaataagtccctgagcgctctaggcaacgtcatctccgcacttgccgaagggacaaaaacacatgtgccttatcgagactcaaaaatgacacgcattttacaggatagtctaggcggtaactgtagaacaactatcgtgatctgttgctcgccttcggtattcaacgaagcagagacgaaaagtaccttgatgtttggacagcgtgcgaaaactattaagaatactgtatcagtcaatttagaattaacggccgaggaatggaagaagaagtacgagaaagaaaaagaaaagaataagacgctcaagaacgtaatccagcacttggagatggaacttaatagatggagaaatggggaagcagtgcccgaggacgaacagatttcagcgaaggaccagaagaatctagagccttgcgataacaccccgatcatagacaatattgccccagtggtagccggaatctcaactgaggagaaagaaaaatacgacgaggagattagttctctgtaccgtcaactggatgataaggacgacgagattaatcagcaatctcaactcgccgagaagttgaagcaacagatgctcgatcaggatgagttgttggccagtactcgtcgtgactacgaaaagattcaggaggaactcacccggctgcaaattgaaaacgaggctgccaaggacgaggtgaaggaagtgctccaggctctggaagagctggccgttaattatgatcaaaagtcccaagaagtggaggacaaaacccgggcaaacgaacagctcacagacgaattggcacagaagacgaccaccctgaccactacacagcgagagctatctcagctgcaagagcttagcaaccaccagaaaaaacgggctactgagatcctgaacctcttgctgaaagacctgggagaaattggtggcataataggaacaaacgatgttaagactttagccgacgtaaacggcgtgatcgaagaggagttcaccatggccaggctttacatcagtaagatgaagagcgaggtgaaatctctcgtcaatagaagcaagcagctcgagtccgcgcagatggactcaaacagaaagatgaacgcaagtgaaagagagctcgccgcttgccagctgctaatctctcagcatgaagccaaaattaaaagcctgaccgactatatgcagaacatggagcagaagagaaggcagctggaggagtcccaggatagtctgagcgaagagctcgccaaacttagagcccaagaaaaaatgcacgaagtcagttttcaagataaggaaaaggaacaccttaccagactccaggatgcagaggaaatgaagaaggcactggagcagcagatggaaagccacagggaggcccaccaaaagcaattgtctcgcctgagagacgagatagaggagaagcagaaaattatagatgagatcagggatcttaaccaaaaattacagcttgagcaggagaaactgtctagtgactacaataaactgaaaatcgaagatcaggagagagaaatgaaattggaaaaactgcttttattaaacgataaacgggaacaggcacgggaggacctgaaaggactagaggagacagtctccagagaactgcagaccctccataatctcagaaagctttttgtacaggacctgacgacaagagtaaaaaaaagcgtggagttggataatgacgatggaggcggttccgccgcacaaaaacaaaaaatcagttttcttgaaaataatctggaacaactcacaaaagttcacaagcagctggtgcgcgataacgccgatttacggtgtgagcttccaaaacttgagaaaagactgcgggctaccgcagagcgcgtgaaggccctggagtccgccctaaaagaggctaaggagaacgctatgcgggatagaaaacggtatcagcaggaagtcgaccgtattaaagaagcagtcagagccaaaaatatggctagacgcgctcacagcgcccagatcgccaaacccatcaggcccggtcactaccctgccagttctccaacggccgttcatgccatacggggaggcggaggaagtagcagcaactcaacccactatcagaagtag

SEQ ID NO: 227882 - DNA, 2589 bp, Artificial Sequence
  Description of Artificial Sequence: Synthetic coding sequence
atgtgggggaaactgcacgacccccaactgatgggaattatccccagaatagcacacgatatattcgaccatatctacagcatggacgagaaccttgagtttcacatcaaggtgagctactttgaaatctatctggataagatcagagatctcctcgacgtctctaaaaccaatctcgccgtgcacgaggataagaaccgagtgccctatgtgaaaggatgcactgagaggtttgtgtcttcgcctgaagaagtcatggatgtgatcgatgagggaaaagccaatcggcacgtcgccgttacaaacatgaatgaacattcttccaggtctcattcaattttccttatcaacataaagcaggagaacgtagagacagaaaagaagctaagcggaaaactctatctcgtggatctcgctggaagcgagaaagtttctaaaacaggcgctgagggtgccgtgttggacgaggcaaagaacatcaacaaatcactgtctgcactgggaaacgtgatcagcgccctggcagaaggaactaaaacacatgttccctatcgggacagcaaaatgacacggatcctccaagatagccttggtggtaactgtagaacaaccatcgtgatttgctgctcacctagtgtcttcaacgaagccgagaccaagagcacgcttatgttcggacaacgtgcaaaaaccattaaaaatacagtctcagtcaatttagagctgaccgcagaagaatggaagaagaagtacgaaaaagagaaagagaagaacaagacactgaagaatgttattcagcacctcgagatggagctcaatcggtggcgaaacggcgaggctgtgcccgaagacgagcagatttccgcgaaagatcagaaaaaccttgagccatgcgataacacccctatcattgataatatcgccccagtggtggctggaatcagtactgaggagaaagagaagtacgatgaggagataagtagcctgtatcgccagctagatgacaaggatgacgagataaatcaacaaagccagcttgccgagaagctgaagcagcagatgttggaccaagacgagctgctggctagtacgcgcagagactatgagaaaattcaggaggaactcacgaggcttcagattgaaaatgaggctgccaaagatgaggtcaaggaggtgctccaagcactagaggagctggcagtgaactatgaccagaagagccaggaagtcgaggataagactagggccaacgagcaattaaccgacgagttggcgcagaagacaactactctgactacgacccaaagagagttgagccaacttcaagagttaagcaaccaccagaagaaaagggctactgagatactaaacctgctcctgaaggatctgggggagatcggcggtattataggaaccaacgacgtaaaaactctggctgacgtgaatggtgtcatcgaagaggaatttacaatggctcgcctgtacatcagtaaaatgaaatctgaggtaaagtcgctagtaaacaggtcaaaacagttggaaagtgcccaaatggattctaaccggaagatgaatgcctccgaacgagagctggcagcttgtcagctgttaattagccaacacgaggctaaaatcaagtccctgacggattatatgcagaatatggaacagaagcggaggcaattggaggaaagtcaggatagcttgtctgaagaacttgctaagctgagggcccaggaaaagatgcatgaagtttcatttcaagataaggaaaaagagcatttgaccaggctgcaggatgcagaggaaatgaagaaggcccttgaacagcagatggagtctcacagggaggcgcaccagaagcagctctccagactaagagacgagattgaagaaaagcagaagataatagatgagattagggacctgaatcagaaactgcagcttgagcaagaaaaactgtcatcagattataacaagctgaagatcgaggaccaggaaagggagatgaagttagagaaactcctgctcctgaatgataagcgggagcaagctagggaagacctgaaaggacttgaggaaacagtcagccgagagctgcaaaccctccataacttacggaagttgtttgtacaggacctgaccactcgggtgaagaagtcagtggagctggacaacgacgatggagggggttcagcagcccagaagcagaaaatttcattcctagagaataacctcgaacaactgaccaaagtccacaaacaactcgtgagggacaacgctgatcttcgatgtgaactcccaaagctcgaaaaacgccttcgtgccacagcagagagggtcaaagctctcgaatcagcgctgaaagaagccaaggagaacgccatgcgcgatcggaaaagataccagcaagaggtggatcgtatcaaggaggccgtgcgcgcaaaaaacatggcacgccgtgctcactcagcacagatcgccaaaccaatcagaccagggcactatccagccagcagtcctactgcggttcatgccattcgaggaggcggaggaagtagctcaaacagcacgcactatcagaaatag

SEQ ID NO: 227883 - DNA, 2874 bp, Artificial Sequence
  Description of Artificial Sequence: Synthetic coding sequence
atggccgatcccgctgagtgcagcattaaggttatgtgtcgatttaggcccctgaatgaggccgaaatactgcgtggcgataagtttatccctaaattcaagggcgacgaaacagtggtgataggccaaggcaagccttatgtgttcgaccgtgtcctgccgcctaacactacccaggaacaagtgtataatgcctgcgccaaacagattgtgaaggacgtgttggagggctataatggaactatctttgcctatggacagacctcgtctgggaaaactcacactatggagggaaagctacacgatccccagctcatggggattatcccaagaatcgctcatgacatatttgaccacatttacagtatggacgaaaacctcgagttccatatcaaagtctcctacttcgaaatatacctggacaagattcgagatctgctagacgtgtccaaaactaacctcgctgtacatgaagacaaaaaccgtgtgccctatgtgaagggatgtaccgagcgttttgtgagcagcccagaagaggttatggacgttatcgacgaggggaaagccaataggcacgtagccgttaccaacatgaacgagcacagcagtcgcagccatagcatcttcctcattaacatcaagcaggaaaacgtcgaaaccgaaaaaaagctaagcgggaaactgtatctagttgacctggccggatccgagaaggtgagcaagactggagccgaaggagcagtactggatgaggccaagaacatcaacaaatccctttcagccctcggtaacgtgattagcgcactcgctgaaggaacgaaaacccatgttccttacagggattctaaaatgactcgaatcctgcaagactctctgggcggaaattgtcgcacgacaattgtgatttgctgtagccccagtgttttcaatgaggccgagactaagagcacgctcatgttcgggcagagagccaaaactataaaaaatactgtgtctgtaaacctggaactcacggcagaggagtggaaaaaaaaatatgaaaaagaaaaagagaaaaataaaacactgaaaaacgtgatccagcacctcgaaatggaactgaataggtggagaaacggcgaagccgtccccgaggatgagcagatcagtgccaaagatcagaagaatttagaaccctgtgataacacacccataatcgataatatcgccccagtggttgccggaatctccacagaggaaaaagaaaagtatgacgaagagatttcctccctgtaccggcagctagacgacaaggacgacgagatcaatcagcaatctcagctggctgagaaactgaagcagcagatgctggatcaggacgagttgctcgcttctaccaggcgggattacgaaaaaatccaggaagagctcactcggctgcagatcgagaacgaagctgcaaaggacgaggttaaggaggtactgcaggccctggaggaacttgctgtcaattacgatcagaagtcccaggaagtggaagacaaaactcgagctaacgagcaactcaccgacgaactggcccagaagaccaccactctcaccacgacacagcgcgaattgtcacagctccaggagctcagcaatcaccaaaagaagcgtgcaactgagatcttgaaccttcttctgaaagatctgggggagataggaggaattataggaacgaatgatgtgaagacactcgcggacgtaaacggagtgatcgaggaagaattcacgatggcaagactgtatatctccaagatgaagagcgaagtgaagtcgctggtgaaccggtcgaagcaactggaaagcgcccagatggattcaaatcggaaaatgaatgcctcagagcgtgagttagccgcatgtcagttgctcatcagtcagcacgaagccaaaattaagagcctgacagactacatgcagaacatggaacagaagcggcgtcagctcgaagagtcccaagatagcctctctgaagagttggccaagctccgcgcacaggagaagatgcatgaagtgagttttcaggataaggaaaaggagcacttaacacgccttcaggacgccgaggagatgaagaaggcccttgagcagcagatggagtcacaccgtgaggctcaccagaagcagctatcgcgactacgggatgaaatagaggagaagcagaagatcatcgacgaaatacgggatctgaaccagaagctgcagctcgagcaggaaaagctgagcagcgactataataaactgaaaatcgaggaccaggagagagagatgaaactagagaaactgctcctgctgaacgacaagcgggagcaggctagagaggatctgaaggggcttgaggagactgtttctagggagctccagacccttcataacctcagaaagctcttcgtccaagacctgactactcgcgtgaagaagtcagtcgagctggacaatgacgacggtggaggctctgccgctcagaagcagaaaatttcttttcttgaaaacaacttggagcagttgaccaaggtacataaacagctggtgcgcgataatgcagatctcagatgtgagctgccaaaactcgaaaagcgtctgcgcgcaaccgccgagcgcgttaaagccctggaatctgctctgaaggaggccaaagaaaacgcaatgagagataggaagcgctaccagcaggaagtggatagaattaaggaagcggtccgtgcaaaaaatatggctaggcgggcacacagcgcccaaattgcaaagccaatcaggcctggacattaccccgcttccagccccaccgctgtacacgcgattcgaggaggcggagggagctctagcaactccacccactatcagaagtag

SEQ ID NO: 227884 - DNA, 219 bp, Artificial Sequence
  Description of Artificial Sequence: Synthetic coding sequence
atggccgatcccgcagagtgtagcattaaagtgatgtgtcggttccgcccactgaatgaggctgaaatactccgtggtgataaattcattccaaaatttaagggcgatgaaactgtggtaataggacagggaaaaccatatgttttcgacagggtgctcccccctaatacaacccaagaacaggtctataatgcatgtgctaaacagattgtgaagtag

SEQ ID NO: 227885 - DNA, 552 bp, Artificial Sequence
  Description of Artificial Sequence: Synthetic coding sequence
atggagcagaggctggccgagtttcgcgcagccaggaaacgcgctggactcgcggctcagcctcccgcagccagccagggggcacagactccaggggagaaagcagaagctgccgcaaccctaaaagccgcaccaggctggctcaagcgatttcttgtgtggaagcccaggccggctagtgcaagagcgcaacccggactagtgcaggaagctgcccaaccacagggctccacatctgagactccatggaacaccgccatacccctcccttcgtgctgggatcagtctttccttactaatatcaccttcttaaaggttctgctgtggctagtgttactgggcttattcgtggaactggaattcggcctggcctactttgtgctctctttattctactggatgtatgtaggaacccggggtcctgaggagaaaaaggagggagagaaaagtgcctactctgtctttaacccgggatgtgaggccatccaaggaacgctgacagccgagcagctggagcgcgagctgcagctccgtccccttgccggacggtag

SEQ ID NO: 227886 - DNA, 2445 bp, Artificial Sequence
  Description of Artificial Sequence: Synthetic coding sequence
atggtcaagcagacaatccagatattcgctcgcgtgaagcccccagttcgaaaacatcaacagggaatttatagcatcgatgaagatgaaaaactcatccccagcctcgagatcattttaccaagggacctggcagacggctttgtaaataataagagagagagctacaagttcaagttccagcgaatctttgaccaagacgcaaaccaggagacagtcttcgagaacatcgcgaagcctgtggctgggtctgtgctggccggttataatgggacgattttcgcctatggacagactggcagcgggaaaacttttacaatcaccggtggggctgagcgatacagcgatcggggaatcattccccgtacgttgtcttacattttcgagcaactgcaaaaggactcctccaagatttataccacccacataagttacctggagatttacaatgagtgtgggtatgaccttcttgacccgagacatgaggcttcgtctctggaggatctgcccaaggtgaccatattggaagacccagatcagaacatccatctgaaaaatcttacgttgcaccaggccaccacagaggaggaagccttgaatctgctgtttctcggagacacaaatcgtatgatcgcagaaacacctatgaaccaggcctcaactcggtcccattgtatcttcactatccacctgtcatcaaaggaacccggatcggcaaccgttcgtcacgctaagctgcacctggtcgaccttgccggatctgaaagagtggccaagacaggagtgggaggccacctcctgacagaggctaaatatatcaatctcagcctacattacctggagcaggtgataatagcactgtcagagaaacatagaagccacatcccataccggaactcaatgatgacctctgttttaagggatagtctcggaggtaactgcatgacgactatgatcgcaacactcagcctagagaaacggaatctggatgaatccatatctacctgcagatttgcacagagggtggcgctcatcaagaacgaggccgtgctgaacgaagagattaacccccgactggtgatcaaacggctccagaaggagattcaggaattaaaggatgagttagccatggtcactggcgaacaacgcacagaggccttaactgaagcagagctgctgcagctggaaaagctgattacatcatttctggaggatcaagatagcgattctcgactggaagttggagctgacatgcggaaggtgcatcactgtttccatcatcttaagaagttgctcaacgataagaagattctggagaacaataccgtaagcagcgaaagtaaagatcaagattgccaagagccactcaaggaggaggagtatagaaagttaagagatatattgaagcagagggacaacgaaataaacatcctcgtcaatatgctaaagaaggagaaaaagaaggcacaggaggcactacatcttgctggcatggatagacgcgagttcaggcagtcacaaagtcccccttttaggctcgggaacccagaagagggtcagcgcatgagattgtcctctgctccatcccaggcccaggatttcagcattctgggcaagcgatctagcctgctccacaagaaaatcgggatgcgtgaagaaatgtctttaggatgccaggaggcctttgagattttcaaacgcgaccacgctgactccgtgacaatcgatgataataaacagatcctcaagcagcgcttctccgaagccaaagccctgggcgagtcaatcaatgaagcacgaagcaagatcggacacctgaaagaagaaatcacacagagacatatacagcaggtagcgctggggatctctgagaatatggccgtgcccttaatgcccgatcagcaggaggagaagcttagaagtcaactcgaggaggagaagcgtaggtataaaaccatgttcacacgtctaaaggccctgaaggtggagatcgaacatttgcagcttcttatggacaaagccaaggttaaactgcagaaggaattcgaagtttggtgggcagaggaggccacaaatttacaagttaactcccctgcagtgaactctttggaccataccaagccttttctgcagacgtccgactcacagcatgagtggtctcaactcctctccaacaaatcgtctggcggatgggaggtccaggaccaggggaccggcagattcgacgtttgcgatgttaacgcacgcaagattttaccaagtccctgtccatccccgcacagccagaaacagtcctccaccagtactcctctggaggactctatacccaagcgaccagtatccagcattcctttgactggtgacagccagactgactctgatatcatcgccttcatcaaggccagacagtccatactgcagaagcagtgcctgggaagtaactag

SEQ ID NO: 227887 - DNA, 498 bp, Artificial Sequence
  Description of Artificial Sequence: Synthetic coding sequence
atgattgcagaaacccccatgaaccaggcaagcacgcggtcccactgcatattcacaattcatctatcctccaaggagcccggatcagcaaccgtgcgccacgctaagttgcatctagttgatctcgccggatccgagagagtagccaaaaccggagtgggcggacaccttctcaccgaagcaaaatacatcaacctgtcactacactatctggagcaagtgatcatcgcgctgagcgaaaaacaccggagtcacattccatacagaaacagcatgatgaccagcgtcctgagggacagcctgggagggaattgcatgactaccatgattgccaccctgagcctcgagaagaggaacctggacgagtcaatctctacatgtcggttcgcccagagggttgctttgataaaaaacgaagccgtattgaacgaggaaatcaatccacgccttaaagctccgagtagttctgatggtgtactcttttgtcggaaccagtag

SEQ ID NO: 227888 - DNA, 1962 bp, Artificial Sequence
  Description of Artificial Sequence: Synthetic coding sequence
atggccagcagtttgtatgacttaaaaaaagttacgatcctggaggatcccgatcagaacatccatctgaagaatctgactctgcaccaagcgacaaccgaggaagaagccctcaatctgctgttcttaggtgacaccaatagaatgattgctgagacaccgatgaaccaggcgagcacgagatctcattgcatcttcaccatccaccttagttccaaagaaccaggatccgccaccgtgaggcatgctaagctgcatctcgttgatctggcgggaagcgagagggtggccaagacaggtgtcggcggtcatctgctaacagaggcgaaatacataaatctgagtctgcattatttagaacaggtgatcatcgcgctaagcgagaagcacagatcccatatcccgtatcgcaacagtatgatgacaagtgtcctgcgggattcactcggaggaaattgcatgaccactatgatagctaccctctccctggagaaacggaatttggatgaatcgatctctacatgtcgatttgcccaacgagtggccctcatcaagaacgaggctgtgcttaatgaggagatcaatcctcgactcgtaatcaaaagacttcagaaagaaatccaagagttgaaggacgaactggccatggtgacaggagaacagcggaccgaagcacttacagaggccgaattgctgcagctcgagaagctgattacttcttttctggaagatcaggactcggactccaggctcgaggtcggggctgatatgcgaaaagtgcatcactgttttcatcacctcaagaagttgctaaatgataagaagatactggagaacaataccgtttcgtctgagtctaaagatcaggattgtcaggagcctttgaaagaggaggaataccgaaagctgagggatatcttaaaacagagagacaatgaaattaatatcttggtgaacatgttgaagaaggagaagaagaaggcccaggaagccctgcacctggcgggtatggaccggcgtgagtttcggcagtcacagagccccccttttaggctgggcaacccagaggaggggcagcggatgagactatcttcggctccatcccaagcccaggacttttctattcttggtaagaggtccagcctgctacataagaagatcggaatgagggaagaaatgagtctcggatgccaggaagcctttgagattttcaagagagatcacgctgacagtgttacgatcgacgacaataaacagatcctcaaacaaagattcagcgaggccaaggcgctgggcgaaagcataaacgaagccaggagtaagataggccatctgaaagaagaaatcactcagcgccacatccagcaggtggcattgggaatatccgagaacatggctgtgccacttatgcctgatcagcaggaagaaaagcttagaagccagctcgaggaagagaaaagacgttataaaactatgttcaccagattgaaggctctgaaggtcgaaatcgagcacttacagctcttgatggataaagccaaagttaagttgcagaaagagttcgaggtgtggtgggccgaggaggctactaacctgcaggttaacagtcctgcagtgaactcgcttgaccacactaagcctttccttcagacaagtgacagccagcatgaatggtcgcaattgctgagcaataaaagtagtggaggctgggaagtgcaagatcaggggactggaaggttcgacgtctgtgatgtgaatgcacggaagatccttccgtcaccctgcccgtcaccacactcgcagaaacaaagtagtaccagtacacccctggaggatagtataccgaagaggccggtctctagcattccacttaccggcgactctcagacagacagcgatatcatcgcttttatcaaggcacggcaaagcattttacagaaacagtgtctgggttctaactag

SEQ ID NO: 227889 - DNA, 2394 bp, Artificial Sequence
  Description of Artificial Sequence: Synthetic coding sequence
atggtgaaacagactatacagatctttgcgagagtcaaaccacccgtacgaaagcaccagcaggggatttattccatcgatgaagacgagaaactcataccttctctggagattatcttgccgagggacctggccgatggatttgtaaacaataaaagggagtcgtacaaattcaagtttcagaggatattcgatcaggatgcgaatcaggagaccgtcttcgaaaacatagcaaagccagttgccggttccgttctggccggttacaacgggaccattttcgcctatgggcagaccggaagtggaaaaacttttactattaccggaggggctgagcgatactcagataggggtatcattcctagaactttaagctatatttttgaacaactccaaaaggatagttctaaaatctatacaacccacataagctacttggagatttataacgaatgcggctacgatctgttggaccctaggcatgaagcctcaagcctcgaggacctgcccaaggtgacgattttggaagaccccgatcagaatatccacttaaagaacttgaccctccaccaggcgactaccgaagaggaagctctcaacctgctcttcttaggagatacgaatcggatgatcgcagagactccgatgaaccaggcgtcaactaggtcacactgcatttttaccatccacctgtctagcaaagaaccgggatcagcaacagtgaggcacgctaaactacacctcgtggatctggctggcagcgagcgtgtggccaagacaggggtgggcggacacctcctgaccgaagctaagtacatcaacctgagcctgcactacctggaacaagtgatcattgccttgagcgaaaaacatcgctcccacattccgtatcgaaattcaatgatgacttctgtcctaagagatagcctcggaggaaattgtatgactacgatgattgccacactctccttagagaaacgtaatttagatgaaagcatatcgacgtgcaggttcgcccagcgggtggcgctgataaagaacgaagcggtcttaaatgaggagatcaaccctcgactggtgatcaaacgcctgcagaaggagatacaagaactcaaggatgagcttgccatggtcaccggcgaacaacgcacagaggcacttaccgaggcagagctcttgcagctcgagaaactaatcacctcttttctggaagaccaggacagcgattcacgattggaggtgggggcagacatgcgaaaagtgcatcactgtttccatcacctgaagaaattgctcaacgataagaagatcctcgagaacaacacagtgtccagcgagtccaaggaccaggactgtcaggagccgcttaaggaggaagagtaccggaagctgagggacatcctgaaacagagggataatgaaattaacattctggtgaacatgctaaaaaaagagaaaaaaaaagctcaggaggccctgcatctggccggaatggacaggagagagtttcgccagtcccagtccccgccttttcgacttggcaaccccgaggaaggccagcggatgcggctgagcagcgcgccatctcaggcgcaggacttctcgattctcggcaagaggagttctctgctgcacaagaagattggtatgcgagaggaaatgagcctgggttgtcaggaagcttttgaaattttcaaaagagaccatgcggattctgtcacaattgacgataataagcagattctgaaacagcgcttttccgaggccaaggcactcggagaatcaattaacgaagcgaggtctaagatcggcatatctgaaaatatggccgtccccctgatgcctgatcagcaggaggagaaacttcgatcccagctggaagaggagaaacggcgttataaaaccatgtttacacgtctgaaggctctcaaagtcgagatcgagcacctccagctgcttatggataaggcaaaggtgaaactccagaaggagtttgaagtctggtgggcggaggaggctacgaacctccaggtgaactccccagccgtgaatagcttagaccacactaagccatttctgcagacaagcgacagccaacacgaatggtctcagctgctgagcaataaatcaagcggcggttgggaagtgcaggatcagggcaccggacgcttcgatgtgtgtgacgttaacgcgagaaaaatacttccctcaccttgtccatcccctcacagccaaaagcagtcaagcacctcgacacccttagaagactccatccctaaaaggccggtctcttccattcccttgaccggggacagtcagaccgactcggacatcatagcattcatcaaggccaggcagtcaatactgcaaaaacagtgcttgggctcaaactag

SEQ ID NO: 227890 - DNA, 2394 bp, Artificial Sequence
  Description of Artificial Sequence: Synthetic coding sequence
atggttaagcaaaccattcagatctttgcgagggttaagcctcccgtccgaaaacaccagcaggggatttactctatagatgaggatgaaaagttgatcccttccctcgagatcattctccctagggatctggccgacggcttcgtcaataacaagagggaatcctacaaatttaagtttcaacgtatattcgatcaagatgctaatcaggagaccgttttcgaaaatatagcaaaacccgtggctggatccgtgctagccggttataacggcaccattttcgcctatggccagactgggagcggcaaaacctttacaatcaccggaggtgcggagcggtactcagatcggggtattattccacgcaccttgtcttatatcttcgagcagctgcagaaggactccagcaaaatatacaccactcacatttcttatcttgagatctataatgaatgtggctacgatctactggatccgaggcacgaggcttcttccttagaagatcttcccaaagtcaccatcctggaggaccccgatcaaaacatccacctgaagaacctgacgctgcatcaggccaccactgaagaagaagctttaaacctgctgtttctcggtgatacgaaccggatgattgctgaaacccctatgaaccaggcatccacaaggtctcactgcattttcactatacacctgagtagcaaggagcccggttccgctacggtcaggcacgctaaactacatcttgtcgatctggctgggagtgaaagggtggccaagacaggcgtaggaggccaccttctgacggaagctaaatacataaatctgagtctccactatctggaacaggttattattgccctgtccgagaaacaccggagtcacatcccgtaccgcaactcgatgatgaccagtgtgctgagagacagtcttggcggaaattgtatgaccacaatgatcgcaaccttatcgcttgagaagcgcaacttagacgaatcaatcagtacctgccgattcgcccagcgggtggccctcattaaaaacgaagctgtgcttaacgaggagatcaaccctcgcttagtgattaagaggctgcagaaagagatccaggagctcaaggacgagctggccatggtgactggggagcaaagaacagaggctcttacagaggccgaactgctgcagctggaaaaactgattacttcttttctcgaggatcaggacagcgactcccggctggaagtcggggcagatatgcgcaaagtccaccattgctttcaccacttaaagaagctcctgaacgataagaagatattggagaacaacaccgtgtcttccgaatccaaagaccaggactgtcaggagcctttgaaggaagaagagtacaggaagcttagagacatccttaagcagagggataacgaaatcaacattctagtgaatatgctgaaaaaagagaaaaaaaaagctcaggaggccctccacttggccggaatggaccgtcgggagttcagacaatctcagtctccccctttccgcctgggaaacccagaagaaggccaacgcatgcgtttgagcagcgcgccaagccaggcacaggacttttctattttaggcaaacggtctagcctgttgcacaagaagatcggtatgcgagaagagatgtcactcggctgccaggaggcctttgaaatctttaagcgtgatcatgctgactcggtgacgatagacgacaataaacagattctgaaacagcgcttttctgaggccaaggcactgggagaaagcataaatgaggcccgaagcaagatcggacacctgaaggaggagattactcaacggcatatccaacaggtcgcgcttgggatatctgagaacatggcagtgccgctgatgcccgaccagcaggaggagaagctgcggtcacagctcgaagaggagaagaggcggtacaagaccatgttcacgcgtcttaaagccctcaaggtagagatcgaacacctccagctgctgatggacaaagccaaggtaaaactgcagaaggagttcgaggtatggtgggccgaggaggccaccaatttgcaggttaacagccccgctgtcaactcccttgatcatacaaaacctttcttgcagacgtcagactcccagcacgagtggagccaattgctcagtaacaagagcgatgtgaatgccaggaaaattctgccgagcccgtgccccagcccacactcgcaaaagcagtctagcacgtctaccccgttagaggatagtatacctaaaagacctgtctcctccattccactgactggtgatagccagactgacagtgacattatcgcatttatcaaagcgaggcaatcgattttacagaagcaatgtctcgggtctaattag

SEQ ID NO: 227891 - DNA, 747 bp, Artificial Sequence
  Description of Artificial Sequence: Synthetic coding sequence
atgcgcgaggagatgagcctagggtgtcaggaggcctttgaaatctttaagcgggatcacgccgactccgtcactattgacgacaataagcagatcctaaaacaaagattcagtgaggcgaaagccttaggggagtccatcaacgaggcgaggtcgaagatcgggcatctgaaggaggaaatcacccaaagacacatacagcaggtcgccctcggaatatccgaaaatatggccgtccccctaatgcctgatcagcaggaggagaagctgcgcagccaactggaggaggagaaaagaaggtataagactatgttcaccaggttgaaggcactcaaagtggagatcgagcacctgcagctcctgatggacaaagcgaaggtgaagctccaaaaggaattcgaggtgtggtgggctgaagaagcaacaaatctgcaagtcaactcccctgcggtaaatagtcttgatcatactaagccattcctccagaccagtgattctcagcacgaatggagccaactactgtctaacaagagcgacgtgaacgcgcgaaagattctgccaagcccatgtccatccccacactcgcagaaacaatcgtctacctcgacccccctggaagactctattcctaagcggccagtgtcgtctattccgcttaccggggatagtcagacagattccgacatcatagcctttatcaaagctagacagagcattctgcaaaagcagtgcctgggttctaactag

SEQ ID NO: 227892 - DNA, 486 bp, Artificial Sequence
  Description of Artificial Sequence: Synthetic coding sequence
acccctatgaaccaggcctccacccgcagccactgtatattcactatacacttgtcatcaaaggagcctggctccgcaaccgtgcgacatgcgaagctacatctggtcgacctagcgggaagcgagcgagttgctaaaaccggcgtgggcggtcacctcctgaccgaagcgaagtacatcaatctctccttacactatctagagcaggtgatcatcgccctctccgagaagcacagatcccatataccttatcgcaacagcatgatgacgtccgtgcttagggatagtcttgggggaaattgtatgacgaccatgattgcgactcttagcctggagaagaggaatctggacgaaagcatcagcacttgtaggttcgcacagcgcgtcgccctcatcaagaacgaggcagttctcaacgaggagatcaatccccgactcaaagccccttcttcttctgacggggtgttgttttgccgcaatcagtag

SEQ ID NO: 227893 - DNA, 2070 bp, Artificial Sequence
  Description of Artificial Sequence: Synthetic coding sequence
tgaggagcagaacgctactccgatagaggaatcatccctcggaccttgtcctatatctttgagcagctccagaaggatagttccaagatctataccactcacatatcctatctcgaaatttacaacgagtgtggttatgatttactggacccccgacacgaggcgtcctcactggaagaccttccaaaagtgacaatcctcgaagaccccgatcagaatatccatttaaagaaccttacccttcaccaagcaacaacggaagaggaggcactcaatctgctttttctgggagatactaataggatgatcgccgaaacccccatgaatcaggcctcaaccaggagccactgtatctttaccattcacttgagttcaaaggagcccggtagcgcaactgtgcggcacgccaaactgcatctagttgacttggcaggttctgagcgtgtcgcgaaaaccggtgtgggcggacacctcttgacagaggcaaagtacatcaatctgtcactccactacctggagcaggtgattatcgccctttcagagaagcaccgaagccatattccctaccgcaattccatgatgacatccgtgcttcgagacagtctcggcggaaattgcatgaccacaatgatcgctacactgagcctcgaaaagagaaacctcgatgaatccatatccacttgtagatttgcccagcgggtggctctgatcaagaacgaggccgtgctcaatgaggaaattaatccacgtctcgttatcaaaaggctgcagaaagagatccaggagctcaaggatgagttggccatggtgacgggtgagcagcgtacagaggctcttacagaggccgagctcttgcagctggaaaagctgatcacttctttccttgaagaccaggacagtgacagccgccttgaggtgggagccgatatgcggaaagtccatcattgtttccatcacctgaagaagcttctgaatgacaagaaaattttggagaataacacggtgtcttccgagtctaaagaccaggattgtcaagaaccactcaaggaggaggagtacaggaaactgcgagacatcctgaaacagagagataatgaaattaacattctcgtgaacatgctgaaaaaagaaaaaaaaaaggctcaggaagcactacacctggctggtatggaccgacgcgagttcagacaatcccagtctcccccattccgactgggcaatccggaggaggggcaacggatgcgattaagcagcgcccctagtcaggcccaggacttttctatcttgggaaagagatcttcattactgcacaagaaaatcgggatgcgggaggagatgtcgctggggtgtcaggaggcctttgaaatcttcaagagggaccatgctgactctgtgacaatcgacgataataagcagattctgaaacagcgtttctccgaggcgaaggctctcggggagagtatcaacgaggccaggagtaagatcgggcatctgaaagaggagattacccagcgtcatattcagcaagtggctttaggcataagcgaaaacatggctgtgcccctaatgccagaccagcaggaggagaaactccggtcacagctggaggaagagaaacgcagatacaagaccatgttcacgaggctgaaagccttgaaagtggagatcgaacaccttcagctgttgatggacaaggctaaggtcaaattgcagaaagagtttgaagtgtggtgggccgaagaggccactaatctgcaggtcaacagtcctgcggtgaattctctcgatcacaccaagccattcctccagacctccgattcacagcatgagtggtcccagctcctctcgaataaatcggacgttaatgcacgaaagatccttccatcgccatgcccttcgccccattcacagaagcagtcctctaccagtactcccctggaagactcaatcccaaaacggccagtttcatccatccctctgacgggcgattcacaaaccgattcagatatcatcgcgttcatcaaagcgaggcagagcatcttgcagaaacagtgtctcggcagcaattag

SEQ ID NO: 227894 - DNA, 2277 bp, Artificial Sequence
  Description of Artificial Sequence: Synthetic coding sequence
atggtgaaacagaccattcagatctttgccagggtcaagccacccgtgaggaaacatcagcagggaatatatagtatagacgaagacgaaaaattgattccatctttagaaatcatccttcccagggacttggctgacgggtttgttaacaataaaagggaatcatacaaattcaagtttcagcgcattttcgaccaagacgcgaaccaagaaaccgtgtttgagaacattgcaaagcctgtggcgggttctgtgcttgctggatataatggaaccattttcgcatatggtcagactgggagtggtaaaacttttactataactggcggtgctgagagatacagtgatagaggcatcattccgcgtaccctgtcatatattttcgaacagctgcagaaggattcatcgaagatctacaccacccacatttcttatctcgagatctacaacgaatgtggatatgatctgctggatccccgtcatgaggccagctcattggaagacctgcctaaagtgacgatattggaggaccctgatcagaacattcacctgaagaatctgacattgcatcaagccacaactgaggaggaggcgctcaacctgctcttcctgggtgatactaaccggatgatcgcagagactcccatgaatcaggcatccacacgaagccactgcatcttcaccatccatttaagcagtaaggagccgggttccgccacggtgaggcacgctaagttacacctggtagatctagctgggtccgagagggtggccaagactggggtaggcggacatctccttactgaggccaagtatatcaacttgtcactgcactacctcgagcaagtgattatcgctttaagtgagaagcacaggagtcacattccatacagaaactccatgatgacctcagtgttgcgagactcactcggagggaattgcatgaccaccatgatcgctaccctgtccctggaaaagaggaatctggacgagagcatcagcacttgtcgattcgcccaaagagtagcgctgattaagaacgaggccgtgcttaatgaagaaattaatccgaggcttgtcataaaaaggctgcaaaaagaaatccaggagctgaaagacgagctcgcaatggtgactggcgagcaacggacggaagccctgaccgaagctgagctgctgcagcttgagaagctgattacctcctttctggaggatcaggatagcgatagtcggctggaggttggggctgatatgcgtaaagtccaccattgttttcaccacttgaaaaagcttttaaacgataagaagatcctggaaaacaacaccgtaagttccgagtccaaggaccaggactgccaagagcctctgaaggaggaagagtaccgaaagctccgcgatatcctgaaacagcgtgacaatgaaatctcgatcctgagcgaagtcatgaagaagctgccactgagttggttcgaaagaggtatgagagaggagatgtctctggggtgccaagaagccttcgagatttttaagcgggaccatgctgatagcgtgacaatagatgacaataaacagatccttaagcagcgcttctcggaagcaaaagccttaggggagtctattaatgaggccagaagcaagatcggacacctgaaggaggagatcacccaacgacatatacagcaagtcgctctgggcatatccgagaacatggccgtgcccttgatgcccgaccaacaggaggagaaacttcgctcccagttggaagaggaaaagagaaggtacaaaacgatgtttacacggcttaaagcactcaaggttgaaatcgagcaccttcagttgttaatggacaaagccaaggtgaaacttcaaaaggagtttgaggtgtggtgggccgaggaggctacaaatctgcaggtaaatagccccgctgtgaactcactcgatcacaccaagccctttctccaaacatccgattcccaacatgagtggagccagcttctgtcaaacaagagttcaggcggatgggaggtccaggaccaaggcaccgggagattcgacgtgtgtgacgtgaacgcgagaaaaatcctccctagcccgtgcccctcaccacatagccaaaagcagtccagcacttctacccccctggaggactccatcccgaaacgcccagtcagttccattccactgacaggagactcacagacagacagcgatatcattgcttttataaaggccagacagtcgatcctgcagaaacagtgcctgggttctaactag

SEQ ID NO: 227895 - DNA, 516 bp, Artificial Sequence
  Description of Artificial Sequence: Synthetic coding sequence
atgcgcgaagaaatgagtctcggctgccaggaggccttcgagatcttcaagagggaccacgccgactctgtcacaatcgacgataataagcagattttgaaacagcgattcagcgaagcaaaggcactgggcgagtccatcaacgaagcgaggtccaagatcggccacttgaaagaggagataactcagagacacattcagcaggtggcactcggcatttctgagaacatggccgtcccactcatgcccgatcagcaagaggaaaaactgagatcccagctggaagaggaaaaaaggaggtataagactatgtttacacgcttgaaggcattgaaggtggagatcgagcatctccagcttttgatggacaaggcaaaggtcaagctccaaaaagagtttgaggtgtggtgggctgaggaagccaccaacctacaggtgaactcaccagccgtgaatagtctcgaccacactaaatcgaagatcaaggctctggccgattccatgagcggcctgtag

SEQ ID NO: 227896 - DNA, 882 bp, Artificial Sequence
  Description of Artificial Sequence: Synthetic coding sequence
atgcgagaggaaatgagcttgggctgccaagaagcctttgagatattcaagagggatcacgcagattctgtgaccatcgacgataacaagcaaatcctaaagcagcgttttagcgaggcaaaagcactgggggaatctataaatgaagcaaggtccaaaatcggtcatctgaaggaagagattacacaacggcatattcagcaggttgcactgggcatatccgaaaatatggcggtgcccttgatgcccgatcagcaggaggagaagcttaggagtcagttagaggaggagaaacggcgttacaaaaccatgttcactcggctcaaagctctcaaggtggagatcgaacaccttcagctgctcatggacaaggccaaagtgaagctgcagaaggagttcgaagtatggtgggcagaggaggctacaaatctccaagtcaattctcccgcagtgaatagcctggaccacaccaagccattcctgcagacttccgatagccagcacgaatggtcccagctgctaagtaataaatccagtggcggatgggaagtacaggatcaggggacggggcgtttcgatgtatgtgacgttaatgccaggaagatccttccaagcccttgtccatctccacatagtcagaaacagtcctccacctctacccctttagaggattcgatccctaaaaggcctgtatcctctatcccacttaccggggattcccagactgactcggacatcatcgcattcattaaagccaggcaatcaatcctccagaaacagtacttgcaacttttatgcagtctgttcccaaagtccgcggtgtccagcgcacaggcctcaaccaatagaaagggcttgtcagacgtattagtgacacgttag

SEQ ID NO: 227897 - DNA, 4032 bp, Artificial Sequence
  Description of Artificial Sequence: Synthetic coding sequence
atgggcttagaggcccagagactaccgggtgctgaggaggcccctgtgcgggtcgctctgcgtgtaagacctctcctgccaaaggagctcctccacggccatcaaagttgcctgcaggtcgagccaggacttggacgggtgacactgggcagagatagacattttggtttccacgtggtgctagctgaggacgcagggcaggaggcggtgtaccaggcctgtgttcagcctctgcttgaggccttcttcgagggtttcaacgccaccgtgtttgcttatggccagacagggagcggtaagacttatacgatgggggaggccagtgtggcgtccctgttggaagacgaacaaggcattgtgcctcgggctatggcagaagccttcaagctgattgatgagaacgacttattggattgtctcgtgcatgtgtcgtatcttgaggtgtacaaagaagagtttagggatcttttggaggtgggtacagcctcccgcgatatccagctccgcgaggatgagagggggaatgtggtactgtgcggcgtgaaggaagtcgatgtggagggactcgatgaagtgttgtccctgctggagatgggaaatgctgctagacacaccggcgcaactcatttaaaccacctgtcatcccgcagtcacacggtcttcactgtcacattagaacagcgcggacgcgctccctctagactgcccaggcccgctccgggacaactccttgtgtccaaattccactttgtggacctagctggcagcgagcgcgttctcaaaactggttccactggagagaggctgaaagagagcattcaaatcaatagctccctcctggcccttggtaatgtgatttcggccctgggggacccccagagacggggtagccacataccttatcgagattctaaaatcacacggattctgaaagacagtctaggaggaaacgcgaagaccgtgatgattgcttgtgtgtctcccagctcaagtgattttgacgagactctgaatacgcttaactatgccagccgggcacagaatatccggaaccgagctactgttaactggcgtccggaggcggaacgcccaccagaggaaacagccagtggggctagaggacctccccgacaccggtccgagaccagaattatacaccgcggaagacgggcacctggcccagccacagccagcgccgctgcagctatgcgactcggggcagagtgcgcacggtatcgagcctgcacggatgctgcctattctcttctccgggaactgcaggccgagcccggactccctggcgctgccgctcgtaaggtgcgggactggctgtgcgccgtggagggcgagaggagcgcactgagtagtgcatcagggccagacagcggcatagagagcgcgagtgtcgaggaccaagctgcacaaggcgctggcggtagaaaagaggacgagggtgctcaacagctgctgaccctacagaatcaggtggcacggctggaggaagaaaatagggattttctggccgcactcgaggacgcgatggagcagtataagctccagtcagacagactcagagaacagcaggaggagatggtggagttgcgacttagactcgaactcgtgcggccagggtggggcggacccagactgctgaacgggctgccgcctggctcctttgtgccccgaccccacacagctccactcggcggagcccacgcccacgtgcttggcatggtgcctccagcttgcttgccaggtgatgaagttggctccgaacagagaggcgagcaggtgactaacggccgtgaagcaggggcagagctgttgacagaggtcaaccggctaggttctgggagcagtgccgcttctgaggaagaggaagaagaagaggagccccctcgaaggacgcttcatctgaggcgtaatcgaatcagcaactgctctcagagagcaggagccagacccggtagcctgccagagaggaagggtcctgaactgtgtttagaggaattggatgctgccattcctggcagcagagcagtcggtggatccaaggccagggtgcaggccagacaggtaccacccgcaacggcaagcgaatggcgcctcgcacaggctcagcaaaagatcagggagctcgctatcaacatccgaatgaaagaggagctgattggggaactggttcgtacggggaaggccgctcaggctctgaatagacagcactcccagcggatcagagaactcgagcaggaagcagagcaggtgagggccgaactctctgaagggcagcgccagctgcgcgagcttgagggaaaagagctacaagacgccggtgagagaagccggctgcaggaattccgccgacgggtagccgctgcccagtcccaggtacaggtgttaaaagagaaaaagcaggcaactgagagactggtatccctctctgctcagtcggaaaaacggctgcaggagctggagcgcaacgttcagctgatgcgtcaacagcagggacagctgcagcgacgactgcgcgaggaaactgagcaaaaaagacgtttggaagccgaaatgagcaagcggcagcacagagtcaaagagctagaactgaagcatgagcagcagcaaaaaatccttaagattaaaacagaggaaattgcagccttccagcgtaagcgcaggagtgggtccaacggaagtgtcgtgtctctagagcagcaacaaaagatcgaggagcagaagaaatggttagaccaggaaatggaaaaagtactgcagcaaagacgcgcacttgaggaactgggagaggaactgcacaaacgtgaggccatcctcgctaagaaggaagccctgatgcaggaaaagaccggcctggagtccaaacgccttcggtcctcacaagcactgaacgaggacattgtgcgcgtgtcatcccggctagaacacctggaaaaggaactgtcagagaaaagtggccagctccgccaggggtccgcccagagccagcaacagattcggggagagatagacagtcttcggcaggagaaggattctctcctgaaacaaagactggagattgatgggaagctacggcaggggagtcttctcagtccagaagaggaacgcacactgttccagttagacgaggcgattgaggccctcgacgcagcgatcgaatataagaacgaggccatcacttgccggcagcgggtgcttcgcgctagcgctagccttctgtctcagtgtgagatgaatctgatggccaagctgtcctacctgtcatcctctgaaactagagccctcttgtgtaagtacttcgataaggtagtcaccctcagagaggagcagcaccaacagcagattgcttttagtgagttggaaatgcagttggaggagcaacaacgcctagtgtactggttagaagtcgcactggagcggcagcgtctggagatggacagacagctgaccctgcagcagaaagaacacgagcagaatatgcagctgctgcttcagcaaagccgagaccacttaggagaaggcctggctgacagcagaagacagtacgaagccaggatccaggccttggaaaaagaacttggaaggtatatgtggattaaccaagagttaaagcaaaagctgggaggggtaaatgctgtgggacactcaaggggaggtgagaagcgcagtttatgcagtgaaggacgccaggcgccaggtaatgaggacgagctacacctcgctccagagctgctttggctctctcctctgacagagggcgcacccaggacaagggaggagactcgagacctggtgcatgccccattgccactgacttggaagcgtagtagcctgtgtggggaagagcaggggtcccccgaggaactccgccaaagggaggcagccgagcccctggttggtcgggtgttgcctgtgggagaggctggcctcccctggaacttcgggcctctctctaaacccagaagagagctgaggcgggcttcacctggaatgatcgacgtgcggaaaaacccactgtag

SEQ ID NO: 227898 - DNA, 2022 bp, Artificial Sequence
  Description of Artificial Sequence: Synthetic coding sequence
atggatccccaacgctccccgttgttggaagtcaagggcaacattgaattaaagagaccactgattaaagcaccgagtcagcttccgctatccggttcgagactgaagaggcgtccagaccagatggaggatgggttggagcctgaaaaaaagaggacaagaggcctgggcgctaccacaaagattaccacaagccatccaagagtgcccagcctcactaccgtcccccagacacagggccagacaacggcacagaaagtgtccaagaagacagggcctcggtgttctacagcaatcgccaccggtctcaagaatcagaaaccagtcccggctgtgcccgtccaaaaatccggaacaagtggcgtgcccccaatggccggaggtaagaaaccctcaaaaaggccagcttgggacctgaagggacaattatgcgatctcaatgccgagctgaaaaggtgtagggaacgaacccaaactctggaccaggaaaaccagcagctgcaggatcaattacgcgacgctcagcagcaagttaaggccctggggacagagcgaaccaccctagagggccatctggccaaggtgcaggcgcaagccgaacagggacagcaggaactcaaaaatttacgggcatgtgtcctggagctggaagagaggctctctactcaagaagggctcgttcaggagttgcagaaaaagcaagtggaacttcaagaagaaagaagaggattgatgagccagttggaagaaaaggaacgcaggctgcagacctcagaggccgctctgagctcttctcaggcggaggtggccagcctccgccaagaaacggtggcccaagctgcactgcttaccgagcgtgaggaacggttacatggcctcgagatggaacggagaagactgcacaatcaacttcaggagctcaaagggaacattagggtgttctgccgggtccgcccagtacttccaggcgagccaaccccccctcccggtctcctgctcttccctagcggtcctgggggtccaagcgacccacctaccaggcttagtctctcaagatcagacgagcgacgaggaactttgagcggggcacctgcccctccaacaagacatgatttctcttttgaccgcgtcttccctccaggctccggacaggacgaagtgtttgaggaaatcgctatgctggtgcagtcagcactggatggatatcccgtttgcatctttgcttatgggcaaaccgggtccggtaagacctttacaatggagggcggacctggaggagatcctcagctcgaaggcctgataccacgcgcactgcggcacttgttttctgtggcgcaggagctttccgggcaaggatggacctacagctttgtggcaagttacgtggagatctacaacgagaccgtgagggacttgttagcgacaggaacgagaaagggtcaggggggagagtgtgagataaggagggccggtcccggtagtgaagagcttaccgtcactaacgccagatacgtgcctgtgtcatgtgaaaaggaagtggacgccctcctgcacctcgcaaggcagaatcgagcggtcgcccgaacagcccagaatgaaaggagttccaggtcacactccgtgttccagcttcagatctctggggaacacagctcccgaggcttgcagtgcggggctcccctgtcactcgtggacttggcgggttctgagcgactggacccagggttggccctcggaccgggtgagagggaacgtctgcgagagacacaggctattaactcgtccctcagtactctcggcctggtcatcatggccctgtcaaacaaagaaagccacgtcccatacagaaactccaaattgacctatcttttacagaatagcctcggcggatccgctaagatgttgatgtttgtaaatatctcccctcttgaagaaaatgtcagcgaatccctgaatagcctgcgctttgccagtaaggtaaaccaatgcgtcattggcactgctcaggctaatcggaaatag

SEQ ID NO: 227899 - DNA, 612 bp, Artificial Sequence
  Description of Artificial Sequence: Synthetic coding sequence
atggaccctcaacggtctccgctgttagaggtcaaggggaatatcgaactcaagcgccctctaatcaaggcgcctagccaactccccttgagcggttctcggctcaagcggagaccagaccagatggaagacggcctcgaaccagagaaaaagagaaccaggggactcggcgcaactaccaagattaccaccagccaccctcgtgtcccaagcctgacaaccgtccctcagacacaggggcaaaccacagggccttcctcacacccactgccttggcaatgccaccatcaaccattcctagtgacagaccctggagggagatcgtggggtccaggccagaagtggcataggttacacctctggtgtacaagtgcgcaaaaagtcagcaaaaaaactggtccccgatgttctacggccattgctacaggcctgaagaaccaaaagccagtccccgctgtgcctgtccagaaatcgggaaccagcggagttccacccatggccggtggaaagaagcctagcaagcggcctgcgtgggacctcaaaggacagctttgcgacctcaatgcagagctcaagcggtgccgggaacgcacacaaacactggaccagtag

SEQ ID NO: 227900 - DNA, 612 bp, Artificial Sequence
  Description of Artificial Sequence: Synthetic coding sequence
atggacccccagcgctctcctcttctggaggtaaaaggaaatatagaactgaaacgaccacttataaaggcacctagccaactgcccctgagcggaagccgcctcaaacggcgtccagaccagatggaggatggtctggaaccagagaaaaaacgaactcggggactaggcgctactaccaagatcactaccagtcatcctagagtgcccagccttaccaccgttccacagacccaggggcagacaactggcccaagctcccatccactgccttggcagtgccatcaccagccatttctcgagactgatcccggtggcagatcttggggccctggacagaagtggcatcgtcttcacctgtggtgcaccagcgcacagaaggtgtcaaagaagacaggcccacgatgctcaacagccattgcaactgggctcaaaaaccagaagcctgtgcccgctgtaccagtgcagaaaagcggtacttcaggtgttcctcccatggctggagggaagaagcccagcaaaagacctgcatgggacctcaagggtcagttgtgcgacctgaacgcagagctcaagaggtgtagggaacgaacccaaactctggaccagtag

SEQ ID NO: 227901 - DNA, 2022 bp, Artificial Sequence
  Description of Artificial Sequence: Synthetic coding sequence
atggacccgcaacgttccccactattggaggtcaaagggaatatcgaactcaaaaggcctctcattaaggcgccatctcagcttccactgtctggatccagactgaaaaggcggccagaccagatggaagacggtctcgaacccgaaaaaaaacgcacaagaggactgggagccacgaccaagatcacaacatcccaccctagagtaccttcacttacgacagtcccccagacacagggccagacaacggcacagaaggtcagcaaaaagacaggaccacgatgcagcactgctattgccactggactgaaaaatcagaagcccgttcctgcagtgccggttcagaagagcgggacctctggggtgccccctatggcgggaggaaagaaacccagtaaaagaccggcttgggacctgaaggggcaactttgcgaccttaacgctgaactgaaaaggtgccgggagagaacccagaccctagatcaggagaaccagcagctgcaggatcagcttagagatgcccagcagcaggtgaaggctctgggaaccgaacgaacaacactagagggccaccttgccaaggtgcaggcccaggcagagcaaggccagcaggagctcaagaacctcagagcttgcgttctggaactggaagaacgactctctacacaggaggggttggtgcaggagcttcagaagaagcaggtcgaactgcaggaggaaagacgcggtttgatgtctcagctggaagagaaggagcgcaggttgcagacttctgaagcagctctgagctcttctcaagcggaggtagcttcccttaggcaggaaacagtagcacaggccgctctgctgacagagagggaagagcgactgcacggactggaaatggaacgcaggcgactgcacaatcagcttcaggagctgaagggtaacattagagtgttttgtagggtcaggcccgtgcttccaggtgaacccactccaccaccgggtttactcttgttcccatcgggcccaggtggaccaagcgaccctcccacaagactctcactcagtcgctccgacgaaaggcgcggtacgctaagtggggcacccgctcccccaacgcgccatgacttcagcttcgaccgtgtcttcccacccggatccggacaggacgaagtgttcgaagagatagcgatgctggtacaatcagctctggacggttaccccgtctgcattttcgcttacggacagaccggtagcggtaagacctttaccatggaaggtggccctggcggagatcctcagctcgagggtttgattccacgcgcacttcgccatctgttttcagtagctcaggagctcagtggtcagggatggacatactccttcgtcgcttcttacgtggagatttataacgagacagtgcgggacctgctggccactgggactagaaaggggcagggaggcgaatgcgagataagacgggctggcccagggtcagaagaactcactgttacgaatgcaaggtacgttcccgtctcttgcgagaaagaagtggatgcccttctgcacctcgctaggcagaatagagcggttgcccgaacagctcaaaatgagcggtcctcccggtcccacagtgtgttccagttgcagatctctggcgagcactccagcagaggccttcagtgcggagctcctctgtcactggtggatttggctggatctgagaggctggatcctggcctggctctcggcccaggcgaaagagagcgtttaagagagactcaggccatcaatagctcactaagcacactaggcctggtgatcatggcacttagtaacaaggaatcacacgtgccataccggaattctaaacttacttacctactgcagaacagcctcggcggatctgcaaaaatgctgatgtttgtgaacatttcaccattggaagaaaatgtatccgaatctcttaactccctgcgcttcgcatccaaggtgaatcagtgcgtaatcgggacagcccaggccaatcgtaaatag

SEQ ID NO: 227902 - DNA, 2022 bp, Artificial Sequence
  Description of Artificial Sequence: Synthetic coding sequence
atggatcctcagcggtcacctctgctagaggtgaaggggaatatcgagttaaagagacccctcataaaggctccgtcacagctgcctttgtcagggagcaggctcaagcggaggccagaccagatggaggacgggctcgaacctgagaaaaaaagaacccggggtttgggggctacaactaagatcacgacttcccacccaagggttccaagtctcaccactgtcccccagacccagggacagaccactgctcagaaagtaagtaagaagacagggccaaggtgcagtactgccatcgcgaccggactcaagaaccagaaacccgttcccgcagttccagtgcagaagagtggtaccagtggggtcccccctatggctggaggcaaaaagccttctaagcgaccagcctgggacctgaagggacagctgtgcgacctcaatgccgagcttaaacgttgtagagaaagaacccagacacttgaccaggaaaaccagcagctgcaagaccaacttcgcgatgctcaacagcaggttaaggcactaggcaccgaacggaccactttagaagggcatttggcaaaggttcaagctcaagccgaacagggccagcaggagctgaagaacttacgtgcttgcgttctagagctggaagagaggttatcaacccaggaagggcttgtgcaggagctgcagaagaagcaggtggagctgcaggaagaaaggaggggacttatgagccagcttgaagagaaagagcgaagactacagacaagtgaagccgctctctcgtccagtcaggctgaggtcgcgtctctgcggcaggagacagtggcccaggctgcgctgctaaccgagagggaagagcggttgcatggcctggagatggagaggcggagattgcacaaccagctgcaggagctgaagggcaatatccgggtgttctgccgggttagaccagtgctgcctggcgaaccaaccccacctccaggcctgctcctgtttccaagtgggccaggaggacctagtgacccccctaccaggctgtcactctcacggtcggacgagcggagaggcacactctctggggctcctgctcccccaaccaggcacgatttttcattcgacagagttttcccccctggctccgggcaggatgaggtctttgaggagattgcaatgcttgtacagtccgccttggatgggtatcccgtgtgtatcttcgcttatggacagacagggagtggtaaaacttttaccatggaaggaggtcccggaggagatccgcagctggaaggccttattccgcgtgccctgcgtcatcttttctcagtggctcaggagctctccggtcagggctggacgtatagctttgtcgcttcatacgtggagatctacaacgaaaccgtgagagacttactggctaccgggaccaggaagggacagggtggggagtgtgaaatcagacgggcaggacctggcagcgaggaactgacggtgaccaatgctagatacgtccctgtttcttgcgagaaagaagtggacgccttactccacctcgcaaggcagaatcgggctgttgctagaacggcacaaaatgagcgatcatcaagatcgcacagcgtttttcagcttcagatttcaggggaacactcatcccggggactgcagtgcggtgccccattgtctctagtagatctagccggatccgagcggcttgacccaggcctcgctcttggaccaggggaacgtgagaggttacgggagacacaggctattaattctagcctgtcaactctggggctggtgattatggcccttagtaacaaagagtcacatgtgccctacagaaactccaagttaacatacttgctccagaattctttgggtggttcagctaaaatgctgatgtttgtgaacatctctccgcttgaagagaacgtcagtgagtcactcaatagtctgcgttttgccagcaaagtcaatcagtgtgtgataggtactgcacaggctaatagaaagtag

SEQ ID NO: 227903 - DNA, 612 bp, Artificial Sequence
  Description of Artificial Sequence: Synthetic coding sequence
atggaccctcagcggtcaccccttctcgaagttaagggcaacattgagctgaagcggccactgatcaaggcccctagtcagctcccattatccggttcacgccttaagcggcgacctgaccagatggaggacggcctagagccagagaagaagcgcacgcgagggctcggagcaaccacaaaaatcactactagtcacccgagggtgcccagtctcactacagtcccccagacgcagggccagacaaccggcccttccagtcatccattaccttggcaatgccaccaccagcccttcctagaaacagatcctgggggacgcagctggggacccggacagaagtggcataggctgcacctgtggtgtacctccgcccaaaaggtgtctaagaagactgggccaaggtgctctacagccatcgcgaccggactgaagaatcagaaaccggtgccggctgtgcccgtgcaaaaatccgggacgagtggagtgcccccaatggcagggggtaagaagccatctaagagacccgcatgggacctgaagggccagctgtgtgatctgaacgctgaactgaaacgatgtcgggaaagaacccagactctggatcagtag

SEQ ID NO: 227904 - DNA, 2502 bp, Artificial Sequence
  Description of Artificial Sequence: Synthetic coding sequence
atggttccttcacgcaggacttggaatttgggtgccacccccagcttgcgcggactgtggagagtgggtagggcaccggaacccgaaccaggtatggccagacccgctccagcgcctgcctctcccgcagcccgtccatttccccataccggtccgggacggctgagaacaggccgtggcaaggatacccctgtgtgcggagacgaagacagctcggcgcgttctgccgctcgacctgccctggcacaatgtcgtgccctttctgtcgactgggcaggccctggaagcccccacggactgtacttaaccctgcaggtcgagcaccttaaagaaaaactaatatctcaggcccaggaggtaagccgtctacgatccgagttgggaggtacagatctggaaaaacacagagacttgctgatggtggagaacgagcggttgcgccaggaaatgcggagatgtgaagccgagctccaagagttgcggactaaaccagcgggtccgtgtccagggtgtgaacattcgcaagagtccgcccagctccgggacaagttaagtcaactccagctcgagatggcagagtccaagggcatgttgtctgagctaaacctcgaagtgcaacagaagaccgatagactggcagaggtcgagctcaggttgaaggactgtttagctgagaaagctcaagaagaagagcggctctctcgtcggctgcgtgatagccacgagacaatcgcctctctacgggcacagagcccacccgttaagtacgtgatcaaaaccgttgaggtcgagagctctaaaactaagcaggccctttctgagagccaggctcggaatcaacacttacaagaacaagtggccatgcaacgccaggtcctgaaggaaatggaacagcagcttcaaagctcacaccagctgacggccaggctgcgcgctcagattgccatgtatgaatctgagctggagcgcgctcatggacagatgctggaagagatgcagagcctggaagaagataagaatcgcgcaatcgaagaggcattcgcacgagcccaggtagaaatgaaggcagtacacgagaacctcgccggagtgcgtacgaacctattgactttgcagcctgctttgcgtaccctcaccaatgattacaacggtctcaagagacaagtacgtggtttccctctcctgctgcaggaagccctccggtctgttaaggccgagatagggcaggccattgaagaggtaaacagcaataaccaagagctactgcgcaaatacaggagggaacttcagttgcgtaagaagtgccacaacgagttggtccggctgaaagggaacattcgagtgatagcgcgagtgaggccagttacaaaggaggacggagagggacccgaagcaacaaatgctgtgacatttgacgcggatgatgattcaattatccatctgctgcataaggggaaaccagtaagcttcgagctcgacaaggtgttctcgccccaagccagccaacaggacgtgttccaggaggtgcaggcactggtgacctcgtgcatcgacggtttcaacgtgtgtatctttgcctacggccagacaggcgctgggaagacatacacgatggaaggcaccgcggaaaaccctggcatcaatcagcgcgcactccagcttcttttcagtgaagtccaggagaaagctagcgattgggaatacacaatcacggttagtgccgctgagatttataatgaggtgctgagagatctcctgggcaaagagccacaagaaaaacttgagatccggctgtgcccagacgggagtggccaactgtacgttcccggactgacagagtttcaagttcagtctgttgatgacatcaataaggtgttcgaatttggccacacaaatcgcaccaccgagttcacaaatctcaatgagcacagctctcggagccatgccctgctgatcgtgacggttcggggtgtcgactgtagcaccggattaaggaccacgggcaagctgaatctagtagatcttgccggaagcgaacgggtcggaaaaagtggggcagaaggttcccggctgagagaagcccaacatattaataaatctctctccgccctgggggatgtcatcgccgctctgagaagtagacaagggcacgtcccttttagaaattccaagctgacctacctgctgcaggactccctgagtggagactccaaaacattgatggtcgttcaagtgtctcctgtggagaaaaacacaagcgaaacattgtacagtctcaaattcgcagaacgggtgagatcagtggagttaggccctggtctgcgcagggccgagctcggatcttggagttcacaggagcaccttgagtgggagcccgcttgtcagacacctcagccaagcgctcgcgctcacagcgctccaagtagtggcacgtcttcccggccaggcagcatccgtcggaaattgcagccatctgggaaatctaggccactgccagtgtag

SEQ ID NO: 227905 - DNA, 2064 bp, Artificial Sequence
  Description of Artificial Sequence: Synthetic coding sequence
atggtggagaatgaacgcctgcgccaagagatgcgtagatgtgaggctgaactgcaggaactgcgtacaaagccagccggaccatgcccaggctgtgagcattctcaggaatccgcccaactgagggacaagttatcccagctgcagttagaaatggccgagagcaagggaatgctgagcgaactgaacctcgaagtccaacagaaaaccgaccgactagccgaggtggagcttaggcttaaggactgcctggctgagaaagcccaagaggaggaaagattgtcccggagattacgggatagtcatgagacaatcgcctccctacgcgcacagagtccacccgttaagtatgttattaagaccgttgaagtcgagtcatccaagaccaagcaagccctgtcggagagtcaagcacgaaaccagcaccttcaagagcaggtggccatgcaacggcaagtcctgaaggaaatggagcagcagttgcaaagttcccatcagctgacggcaagactccgagcccagattgccatgtacgagtcggagttagagcgcgcacacggacagatgctggaggaaatgcagtctctggaggaggacaagaacagagcaatcgaagaggctttcgctagggctcaggtagagatgaaagccgtgcacgagaacttagcgggagttcggactaatcttttgacactgcaacccgctttgagaacactcaccaatgattataatggcctgaagcggcaggtacgaggcttcccactactcctgcaggaagccttaaggagcgttaaggctgaaatcgggcaggctattgaggaagtgaatagcaataatcaggaattacttagaaagtacagacgcgagctgcaactcagaaaaaagtgccataatgagctggtgaggttaaaaggcaacatcagggttatcgcccgtgttaggccagttacaaaagaagatggcgaaggacctgaggcaacgaacgctgtcacatttgacgccgatgatgatagcatcatacatctgctgcacaaaggaaagccagtgtcttttgaactggataaggtgttttcacctcaggcgtctcagcaggatgtgttccaggaggtgcaggcactggtgacaagctgtatcgacggctttaacgtttgcatattcgcatatggacaaacgggagccggaaagacttataccatggaaggcacggcggagaatcccggtatcaatcagagagctctgcaacttcttttctccgaggtgcaggaaaaggctagcgactgggaatacacaatcacggtttcagctgcagaaatctacaatgaagtactgagggatctgctggggaaggaaccacaggaaaaattggagatcagattgtgtcccgacggctccggacagttatacgtccctggtctgacagagtttcaagtgcagtccgtggacgacattaataaggtctttgagtttggacacacaaaccgaactacagaatttaccaacctcaacgagcattcaagtagatcacacgcgctattgatcgttaccgtcaggggcgtagactgcagcaccggcctgagaaccacaggcaaactcaatctcgtcgacctggcgggttctgaaagggtaggaaaaagcggggctgagggttcgagactccgcgaggcccagcatatcaacaaaagcctctcagcactcggggatgtcattgccgcacttagatcacgacagggccacgtgccattccgcaactccaagttaacatatttactgcaggacagcctgagtggcgacagcaaaactctgatggtcgtacaggtgagtcccgtggagaaaaatacaagtgagacactatatagcctgaagttcgcagagcgggttcgcagcgtggagctcggtcctggcctgagaagggccgaactgggctcttggtcctcgcaggaacacctggaatgggaaccggcatgccaaaccccccaaccctcagccagggcccattctgcacctagttctggcacctctagtcgaccgggaagcattcgcagaaagctccagccctcggcctag

SEQ ID NO: 227906 - DNA, 2481 bp, Artificial Sequence
  Description of Artificial Sequence: Synthetic coding sequence
atggtaccttcccggagaacctggaatctgggggctaccccaagcctgaggggattgtggcgggttggacgtgcccctgaacccgagcccggaatggcccgtccagctcctgctccagccagccctgcagctagacctttccctcacaccggccctggaaggctccgcaccggccgaggtaaagatactcctgtgtgcggcgatgaggattcaagcgcacgttccgctgccagaccagccctggctcagtgtcgggcactcagcgtcgactgggctggtcccggttctcctcacggcttgtatctaacactccaagtcgagcaccttaaggaaaagctgatcagccaagcacaggaagtctctaggctccggtccgaactaggagggactgatttagaaaaacaccgcgatctgttgatggttgagaatgaaagactgagacaggagatgagaagatgtgaggcagaactgcaggagctgcggaccaaacccgctggtccttgccccggatgtgaacactcacaagagtctgcccaactgcgggacaagctctcacagttgcaactggagatggccgagagcaaagggatgttgtccgagctgaacctggaggtgcaacaaaagacagatcgcctggctgaagtggagttgcggctaaaggattgtctcgccgaaaaggcccaggaggaagaacgattgtctaggcgcctgcgtgactcacatgaaacaatcgcatccctcagggctcagtcacctccagtgaaatacgtcatcaaaaccgtggaggtggaatccagcaaaaccaagcaggctctgagcgaaagccaggcgagaaatcaacatctgcaagagcaggtggcaatgcaaaggcaggtattaaaggaaatggagcagcaacttcaaagttcccaccagctgacggccaggctgagagcgcagatcgcaatgtacgaaagtgaattggagcgagctcatggccagatgctggaagagatgcagagcctggaggaggacaagaatagagccattgaagaagcgttcgctagggcccaggtagagatgaaagcagtccatgagaacctcgccggagtccgaactaacctcctcacacttcaacctgctttgcgaaccctgaccaatgactataatggcctgaagcgccaggtgcgcggtttccctctgcttctgcaggaagccttgcgcagtgttaaagctgaaatcggccaggccatcgaggaggtgaactccaacaaccaggagctgctcagaaagtaccgcagggaattacagttacgcaagaagtgccacaatgaactggtgagactgaagggtaatatcagggtgatcgctagagtgcgccctgtaacgaaggaagatggggagggaccagaggcaactaatgctgtcacattcgatgccgatgacgactccatcatccatctgttgcacaaggggaagcctgtgtccttcgagctggacaaggttttcagcccccaggcaagccagcaggatgtattccaggaggtgcaggccctggtcacaagctgcatcgacgggtttaacgtgtgtatattcgcctacgggcaaactggcgctggaaaaacatatactatggaaggtactgccgaaaaccctggaataaaccaaagagcgctgcagctactgttttccgaggtgcaggaaaaggcaagtgattgggaatacaccattacggtgtcagcagcagagatatataatgaggtgctgcgggatctgcttggaaaggaaccgcaggaaaaactcgaaattcggttgtgtcccgacggcagcggtcaattatatgtgccgggactgacagaattccaggtccagagcgtggatgacataaacaaagtatttgagtttggtcataccaaccgtacaacagaatttactaaccttaatgagcactcatcccggtcacacgccttgcttatcgtgacagttagaggtgtggactgcagtaccgggctacggactacgggaaaattaaacctggtggatctcgccggatcagagcgcgtgggaaagtctggtgccgagggatcccggctcagagaggctcagcacataaataaatccctttcagccctgggagacgtgattgccgcactccgatctcggcaagggcacgtgccctttagaaacagtaaactcacgtacctcctccaggacagcctctctggagatagtaagaccctcatggtggtccaagtgagtcctgtggagaagaatacctccgagacgctctacagtttgaagtttgccgagcgggtgagatccgtcgaactggggcctggcctgaggcgagctgagctgggaagctggtcatctcaggaacacctggagtgggaacccgcttgccagaccccacagccctctgcaagagctcactctgccccatccagcgggacatccagccggccagggtcaattcgcagaaaactgcaaccatctgcctag

SEQ ID NO: 227907 - DNA, 2307 bp, Artificial Sequence
  Description of Artificial Sequence: Synthetic coding sequence
atggttctgcggatggtggaggctatgtctcaactgcaggatgaaaagacacagttacaggaggaacttgttgttctgcaggagcgtcttgctctgcgagactccgatcagcaagccacctcaactcagttgcagaatcaggtggagcatctgaaggagaagctgatctcacaggcacaggaagtgtcacggttgaggagcgagctgggcggaacagacttagagaaacatcgggacctcttaatggttgagaacgaaagactgcgccaagagatgaggaggtgcgaggcggagctgcaggagctgcgaacaaagccggcaggaccctgtccaggatgtgagcactcccaggagagtgcccagttgagggataaactgtctcaactgcagctcgagatggctgagagcaaggggatgctgtcagagttgaacctggaggttcaacaaaaaaccgatagactggcagaagttgaactcagactgaaggattgcctcgcagaaaaggcccaggaggaagagcggctgtcccgtaggctcagggactcgcacgagactattgcctccctgagggcccagagccctccagtgaagtacgtgattaaaacagtggaggttgaatcatcaaagaccaaacaagcactgtccgagtcccaggccagaaaccagcacctacaggaacaggtggctatgcagcgtcaggtactgaaggagatggaacagcaactgcagtctagccaccagctgactgctcggttacgggcacaaatcgccatgtacgagtcagagctggagcgggcacacgggcagatgctcgaagaaatgcagtccctcgaggaggacaagaacagagcaatagaagaggccttcgctcgagcccaggttgagatgaaagctgtgcatgaaaacctcgctggagtcagaaccaacctgcttaccctgcagccagcgctgcgaacccttacaaacgactataacggacttaaaaggcaagttcgaggttttcctctattgttgcaggaggcactcaggtctgttaaggcagagattggtcaagcgatcgaagaagtaaactctaacaaccaggaattgctgagaaaatatcgacgtgaactgcagctgcggaagaagtgccacaacgaactggtaagattaaaaggaaatattagggtaattgcccgagtgcggccagttacaaaggaggacggtgagggacctgaggccactaatgcagtgacttttgacgccgacgacgattctataattcacctgctgcacaaagggaagccggtttctttcgagctggataaggtgttctcaccccaagccagtcaacaggatgtttttcaggaggtgcaagcactggtgacatcttgcattgacgggttcaacgtttgtatcttcgcgtatggccagactggggctggaaagacgtatacaatggagggcactgccgagaatccaggaattaaccagcgggcactgcagctactgttcagtgaggtgcaggaaaaagccagcgactgggagtacacgattacagtatccgcagctgagatctacaatgaagtgctgcgggatctactgggaaaggaaccacaggaaaaactagagatccggctgtgccccgacgggtccggccagttatacgtcccagggctgacggagttccaagtgcagtcggtggacgacataaacaaggtcttcgagttcggacacactaatcggactacagaattcaccaatctcaacgaacatagctcacggtctcatgccttgctgatcgtcaccgtcagaggcgtagactgcagcaccggattgcgcaccacgggaaaactcaacctggtggatttagccggttcggagcgggtgggaaagtctggcgctgagggctctcgactgagagaagcgcaacacattaataaaagtctcagcgcactcggcgatgtgatcgcagctctccgctcacgccagggccatgtaccgttccgcaacagtaaacttacgtatcttttgcaagacagcctgtccggcgactccaaaaccctgatggttgtgcaggtgagcccagtagagaaaaacacttcagagacattatactctctgaaatttgccgagagagttaggtccgtggagctcggtccaggactgcggagggcggagctggggagttggtccagtcaggagcacctcgagtgggagcctgcgtgccagacaccacagccttccgctagagctcacagcgccccatcctccggaacctcatccaggcccggaagcatcaggagaaagttgcagcccagcgcttag

SEQ ID NO: 227908 - DNA, 2175 bp, Artificial Sequence
  Description of Artificial Sequence: Synthetic coding sequence
atgatcaaagttgagcatctgaaagaaaagctaataagtcaggcccaggaagtctctcgccttaggtcagaactgggaggaactgatctggagaagcatagggacctcctcatggtagaaaacgaaagattacggcaagaaatgagacgatgtgaagccgaactacaggaactgcgaacgaagccggctggtccctgccctgggtgtgaacactcgcaagaatcagctcaactccgggacaagctatcccagctgcaattggaaatggccgagagcaaggggatgctgtctgagttgaacctagaagttcagcagaaaacagaccgtctcgccgaggtggagttgcgcctgaaggattgtttggcggaaaaagcccaggaggaggaacggctaagtaggaggttgcgggactcacatgagacaatagcatcacttcgtgcccagtccccacctgtgaaatatgtgatcaagactgtggaagtggaaagctcaaaaacgaagcaggcgctgtcggagtctcaggcaaggaatcagcacttacaagagcaggtagccatgcagcgacaagtgctgaaagagatggagcagcagctacaatcctcccaccagcttaccgccaggcttagagcgcagattgcaatgtatgagagcgagctggagagagcccatgggcagatgctggaggaaatgcagtccctggaggaggacaagaaccgagcgatcgaagaggcattcgccagagcccaggtggagatgaaggctgtacatgaaaatcttgcaggcgtgagaaccaacctcctgactctgcagccggctctgcgcacactaaccaacgattacaatggcctgaagcgccaggtgcggggattcccattacttcttcaagaagccctccggtcagtgaaagccgaaattggacaggctatagaagaagtgaatagcaataatcaggaactgctccggaagtatcgccgagagctgcagctcaggaaaaagtgtcataatgaactcgtaagactgaaagggaatattcgcgtcatcgccagggtgcgccctgtcactaaggaggacggtgagggccctgaagccactaatgccgtgacgttcgatgccgacgatgattcaataatccatctcctgcataagggcaaaccagtatctttcgagcttgacaaagtgttcagcccacaggcttcccagcaggatgtatttcaggaggtccaggcattagttacctcgtgtattgatggctttaacgtttgtatcttcgcatatggtcaaaccggtgccggtaagacctacacaatggaggggacagcggaaaatcctggtatcaatcagcgcgctctacagttgttgttctccgaggtccaggagaaggcttccgattgggagtatactataaccgttagcgccgcagagatctataacgaggtgctacgcgaccttctggggaaggaaccacaggaaaaattggaaattaggctttgtcccgacggatcagggcagctctatgtccctggattaacagaatttcaggtgcaatctgtggatgacattaataaagtgttcgagtttggccacacgaaccgcacaactgaattcactaatttaaacgagcactccagccgctctcatgccctgctgatagtgacagttcgcggagtggactgttctacaggccttagaacgactggcaagctgaacctggtggacctagctggaagtgagcgggtgggcaaaagcggggcagagggatccagactccgggaagcacagcacatcaacaagagtctgagcgccctcggcgatgtcattgctgcattgcgctcgcgccaagggcacgttccatttaggaacagcaaactcacatatctgttgcaggactccttgtcaggtgattccaaaacgctcatggtggtgcaggtgtcccctgttgaaaagaacaccagcgagaccctctatagtctaaagttcgccgaacgagtcagatctgtggaactgggacccggactaagaagagcagaacttggaagctggagtagtcaagagcaccttgaatgggaaccagcgtgccagactcctcaaccaagcgccagggcccacagtgctccatcgtctggaacatcatcccggcctggaagtattcggcgaaaacttcagccctccgcctag

SEQ ID NO: 227909 - DNA, 2547 bp, Artificial Sequence
  Description of Artificial Sequence: Synthetic coding sequence
atgtgtgcgtccgcgtgcaaagacactgcagcttggtgtcccgaggaagctgctgagccacaggccatggttccgtcccgccgaacctggaacctgggggctacaccatccctgaggggcttatggagagttgggagagctcccgaacccgaacctggaatggccagacctgcccctgccccagcaagccccgctgctcgccctttccctcatacaggccctggacggttgagaaccgggcgtgggaaggatactccagtgtgtggagacgaagacagttcggccagatcagcagccagaccagccctagctcaatgtagggccctgtcagtggattgggcaggacccggatcaccgcacggactctatctaactctccaggtggaacatctgaaagaaaaattaataagccaagcgcaggaagtcagcagactccgttccgagctaggagggacagatctcgagaaacatagagacttactgatggtggaaaatgagcgcctgcggcaagagatgcggcgttgtgaagccgaattgcaggagctgcgaacgaaacccgctgggccttgcccgggatgcgagcattcccaggagagcgcacagctgcgtgacaagttgagtcagctacagctggagatggcggagtccaaaggcatgctgtccgaactcaatctggaagttcagcagaaaaccgatcggctggcagaagtggaacttcggttgaaggactgtttagctgaaaaagcgcaggaagaggaacggctgagccgtcggctgcgggacagtcacgagacgatcgcctctctgagggctcagagcccgccagttaaatacgtgatcaagacggtggaggtggaatcgtctaaaacaaagcaggcgttgtctgagagtcaagcgcgaaatcagcacctgcaggaacaggttgctatgcagcggcaggtgctgaaggaaatggagcaacaactgcagtctagccatcagctcacggcacgactgcgtgctcagatcgccatgtatgaaagtgaactggagcgagcccatggtcagatgcttgaagaaatgcaatctcttgaggaggataaaaatagagccattgaagaagcgtttgccagagctcaggtggagatgaaggcggtacatgagaatctggctggtgtacggacgaacctattgactctccagccggctctcagaacccttacgaacgactacaatggcctgaaaaggcaggttcgcggtttcccactgctgctccaagaagcattaaggtcagtcaaagccgaaataggacaagccatagaagaagtgaattccaataaccaggagttgctccgaaagtacagacgcgagctgcagctgcgcaagaagtgccacaacgaattggtacggctgaaaggtaacatccgggtgatagctcgcgtgcggccagtcaccaaagaggatggagagggtccggaagccaccaacgctgtcacattcgacgcggacgatgacagcattatccacctacttcataaggggaaacctgtgagctttgagctggataaggtgttcagccctcaggcgtctcaacaggacgtattccaggaagttcaggcactcgtcacctcctgtatcgatggctttaacgtgtgcatttttgcctatggacagacaggcgcaggtaagacctatactatggaaggcaccgccgagaaccccggaatcaatcaaagagctctgcagctcttgttttcagaagtgcaggagaaagcatcagattgggagtatacaattacagtgtccgcggctgagatctacaatgaggtgctacgcgacctgctcggcaaggaacctcaggaaaagcttgagatacgcctctgtccagatggctccggccaactctacgtgccaggtctcaccgagtttcaggtgcagagcgttgatgatatcaataaagtgttcgaattcggacatacgaataggacgacagagtttactaacttgaatgaacacagctcccggtctcacgctctgctgattgttaccgtccgcggtgtcgactgctccaccggcctgaggaccacagggaagctgaatctggtggacctagccggaagcgagcgagtgggcaagtcaggcgcagaaggctcacgcctacgtgaggcgcaacacatcaataagagcctgagcgcgctcggcgacgtcatcgccgcactccgttccaggcagggtcatgtaccctttcggaattctaagcttacctatcttctgcaggactctttgtctggagactctaaaacccttatggtggtccaggtgtcccctgttgagaaaaacacatcagagacactgtatagtctgaagtttgcagaaagggtccgatcggtggaattgggccctggcctgcgaagggccgagcttggtagctggtctagccaggagcacctagagtgggagcccgcatgccagacaccgcagccatctgccagggctcatagcgctccttcatctggcacgtcctccagaccaggctcaatccggaggaaacttcaacccagcgcctag

SEQ ID NO: 227910 - DNA, 2055 bp, Artificial Sequence
  Description of Artificial Sequence: Synthetic coding sequence
atggtcgaaaacgagcgcttgagacaagagatgcggaggtgcgaggcagaactgcaagagcttcggacaaaacctgcaggaccctgccctgggtgtgagcactcacaggaatctgcccagcttagagataagttatctcagttgcagctggaaatggccgagtcgaaagggatgctgtccgaactgaatcttgaggtccagcaaaagactgacagattggcagaagtggaattaaggctgaaagattgccttgcagagaaggctcaggaggaagaaaggctttcccgcaggttgcgagatagccatgaaacaatcgcctctctgcgggctcagagtccccctgtcaagtatgtcatcaaaacggtggaggtcgaaagtagcaagacaaaacaagcattatccgaaagccaagccagaaatcagcatttgcaggagcaggtggccatgcagcggcaggtgctcaaagagatggagcaacagttgcagtccagccaccagctgacggcgaggcttcgagcacagatcgcaatgtacgagtccgagcttgagagggcacatggccagatgctcgaggaaatgcagagtttagaggaagacaaaaaccgcgcaattgaggaagcatttgccagggcccaggtggagatgaaggccgtccacgaaaacctggccggtgtgcggacaaatctgctgacattgcagccagcattgaggaccttaacaaacgactataatggtcttaagcggcaagtgcgtggcttccccctacttctccaagaggccctgcgatcagttaaggctgagattggccaggcaatcgaagaagtgaactccaataatcaggagctgctgcgaaagtatcgcagagagttgcagctgaggaaaaagtgtcataacgagcttgtgcgcctgaagggcaacataagagtgatagccagggtgagacctgtcacgaaggaagacggcgaagggccagaggctacgaacgcagtgacgtttgatgccgatgatgattccattatccatctgttgcacaaaggtaaaccagtcagcttcgaactggataaagtctttagccctcaagcctcccagcaggatgaggtccaggcactggttacgtcctgtattgatgggttcaacgtgtgtatttttgcgtacggccagactggagcgggaaaaacctacacgatggaagggaccgcggagaacccaggcatcaaccagcgagcactccaactcctcttctccgaggtccaggaaaaggcaagtgactgggaatacaccataacagtctctgcagccgaaatctacaacgaggttctcagggacctgctgggaaaagagccacaggaaaagctggagatccgactttgcccggacggttccgggcagctctacgtgccaggtctgactgagtttcaggtacagtcagttgacgatatcaataaggtgttcgagtttggacacacaaaccgcacaacagagtttaccaacctgaacgagcattcgagtcgttcccacgccttactcatcgtcactgtgcgcggagtggactgctctactggactgcggacgaccggcaagctgaatctcgtggacctcgccggttcagaacgtgtgggcaagtccggagccgagggttcccgcctgcgggaagctcaacacatcaataagagccttagcgccctgggcgacgtgatcgctgctctcagatcacgacagggccacgtacctttcagaaacagtaagctcacttatctgttgcaagacagtctctctggagactctaaaacactcatggtcgtccaggtgtcccccgtggagaagaacacctctgagacgctctattcgctgaagtttgctgagcgggtgcgaagcgtggagcttggccctgggctacgcagggcggaactcggctcctggagcagccaagagcacctggaatgggagccggcatgtcaaacgccacaaccttccgcaagggcacactccgcgccttccagcggaacttcttcacggcctgggtccatccgaagaaagctacagccttccgcttag

SEQ ID NO: 227911 - DNA, 1914 bp, Artificial Sequence
  Description of Artificial Sequence: Synthetic coding sequence
atgtatgacaacatgtccaccatggtgtatatcaaggaagacaagctcgagaaactcactcaggacgaaattatcagtaaaacaaaacaggtgattcagggactcgaagccctaaaaaacgaacataatagcatcctgcagagtctgctggaaacacttaaatgtctgaaaaaagacgacgaatcaaacttggtagaggagaagtcgaacatgattcgcaagtcattggaaatgctggagcttggactgagcgaagctcaggtgatgatggccctgtctaaccatctaaacgcagtcgagtcagagaagcagaaattgcgagctcaggtaagaagattatgccaagagaatcagtggctgagggacgagctggctaatacccagcagaagctccagaagtctgagcagagcgtcgcccagctggaggaggagaagaaacacttggaattcatgaaccagctgaaaaaatacgatgacgacatttctccctctgaggacaaagacactgacagtactaaggagcccctggatgatctctttccgaacgacgaagatgaccccggacagggaatccagcagcagcattcgtctgcagccgcagccgctcaacaggggggttatgagatccccgcaagacttcgcacactgcataatctggttatccagtacgcaagtcaagggagatatgaagttgctgtgcctctgtgcaagcaagcactggaggatctcgagaagacatcaggtcacgatcacccagacgttgccacaatgttgaacatcctggccttagtgtatagagatcaaaataaatacaaagatgctgccaatctgctcaatgatgccctagccattcgggaaaagacactgggcaaggatcatcccgcagtagcagccaccttgaacaacttagcggtcctgtacggcaaaagggggaagtacaaagaggctgagcccctttgcaagagagcgctcgaaattcgcgaaaaggtgctggggaaagaccaccccgatgttgcaaagcaactgaacaatttggctttactatgccagaatcagggcaagtatgaggaagttgaatactactaccagagggcccttgagatctaccagaccaagctggggcctgatgaccccaacgtcgctaagaccaaaaataacctggcatcgtgttacttgaagcagggcaaatttaagcaggcagagaccctatataaggaaatcctgactcgggctcacgaacgcgagtttgggagcgtggacgacgagaacaaaccaatatggatgcatgcagaggagagagaagagtgcaagggtaagcaaaaagatggtacttccttcggcgaatatgggggttggtacaaggcctgtaaggtggactcccctacagtgactacgacacttaaaaacctcggggcactgtatcgcaggcagggcaagttcgaggctgccgaaaccctggaggaggccgctatgcgcagcagaaagcagggcctagacaacgtccacaagcagagggtcgccgaggtactgaacgaccccgaaaatatggagaagcgtcgcagccgtgagagcctgaacgttgacgttgtgaaatacgagtctggccctgatgggggagaggaagtgagtatgtccgtagagtggaacggcgatgggactggaagcctgaagcggagtgggtcgttcagcaaactgagagcttctatccgacgcagtagcgagaaattagttcgcaagctcaaagggggttctagccgggaaagtgagcccaagaatcctggtatgaaacgggcttccagcctcaacgtccttaacgtgggcggaaaggccgctgaggataggtttcaagaaagaaataactgcctggccgacagtagagcactgtccgccagccataccgatctcgcgcattag

SEQ ID NO: 227912 - DNA, 1920 bp, Artificial Sequence
  Description of Artificial Sequence: Synthetic coding sequence
atgtatgataacatgagcaccatggtctatattaaagaagataagctggagaaactgactcaggacgaaattattagcaagacaaagcaggtaatccaggggttagaggctctgaaaaacgagcacaatagtattctgcagtccctgctggaaactctgaaatgtcttaagaaagacgacgagagcaacttggtcgaagaaaaatcaaacatgatccgcaagtcacttgagatgcttgagctgggtctatccgaagcccaagtcatgatggctctgtctaaccacctgaatgctgttgaatccgaaaagcagaaactgagggcccaggttcgtaggctctgccaggaaaaccagtggttgcgtgacgagctggcaaatacgcagcaaaagttacagaaatccgagcaaagtgtggctcaactcgaggaggaaaaaaaacacctggagttcatgaaccaattaaagaaatacgatgacgacatttcccctagcgaggacaaggatacagattccacaaaggaacccctggacgatctgttccccaacgacgaagacgatcccggtcagggtatccagcagcaacacagctcagccgcagcagccgcacagcagggaggctacgagattcccgctaggttgagaaccctgcataacctggtgattcaatacgcttctcaggggagatatgaggttgctgttcccttgtgtaagcaagctctggaggatctggaaaagaccagcggacacgatcaccccgatgttgccaccatgctcaacattctagccctggtgtaccgagatcagaataagtacaaggatgccgctaatcttctgaacgacgctctggcaattagagagaaaacacttggaaaggatcatccggctgttgcagctacccttaacaatctcgccgtcctgtacggaaaaagagggaagtacaaagaggccgaacctctctgcaaacgcgctttagaaatccgggagaaggtgctgggaaaagaccacccagatgtcgccaagcagcttaataacctggctttgctctgccagaatcagggaaagtatgaggaggtagaatactactatcagcgggctctggaaatttatcagaccaagttaggacccgacgacccaaacgtggccaagacaaaaaataatctggccagctgttacctcaaacaggggaagtttaagcaggccgagacactgtataaggaaatcttgacccgagctcacgagagagaatttggcagtgtggatgacgagaacaagccaatctggatgcacgccgaggagcgggaggagtgcaaaggaaagcaaaaggatggaacttcttttggcgagtacgggggttggtacaaggcatgcaaggtcgactctccaacggtaaccaccaccttaaagaacctgggggcactgtatcgacgacaagggaagtttgaggcagcagagactctcgaggaggccgctatgcgatcacgcaaacagggccttgacaatgtacacaagcagagggtcgcggaggtgcttaatgaccccgagaatatggagaaacgtaggtctagagaatcactcaatgtggacgtggtgaagtacgagtctgggcctgacgggggagaggaagtgtcaatgtccgtggagtggaacggcgacggaaccggaagtttgaagcgctcagggtccttttctaaacttagagcctccatacgcagatcttccgaaaaattggtgcgaaagctgaaagggggtagcagtcgggagtccgaaccaaaaaatccaggtatgaaaagggcctccagtctaaatgtgctgaacgtgggaggcaaagctgccgaggatcggtttcagggtgtgtccggacgcgcttcattttgcggaaagagacagcagcagcagtggcctgggcgacgacacagatag

SEQ ID NO: 227913 - DNA, 1887 bp, Artificial Sequence
  Description of Artificial Sequence: Synthetic coding sequence
atgtacgataacatgagcaccatggtctacatcaaagaagataagttagaaaagctgacacaggatgaaataatcagtaagacaaaacaagtgattcagggtctggaagccctcaaaaatgagcataacagcattttgcagtctctgttggagaccctcaagtgtctgaagaaggacgacgagtcaaatctcgtcgaggagaaaagcaatatgatccgcaagtccctggagatgcttgagctcggtctcagtgaagcgcaggttatgatggcgctctctaaccacctgaatgcagtggaatctgagaagcagaagctacgagcccaggtgagaaggctgtgtcaagagaatcagtggctacgagatgagcttgcaaatacccagcaaaaacttcagaaaagtgaacagtcagtcgctcagctcgaagaggagaagaaacatctggagttcatgaaccagctcaagaagtacgacgacgatattagtccatcggaagataaggacaccgattctaccaaagaaccactagacgatttgttccccaacgatgaggatgaccctgggcaagggattcagcaacagcacagctctgcggctgcagctgcacagcaggggggttatgaaattcctgccaggctgagaacactgcacaatctggtcattcagtacgcctctcaaggtcggtacgaggtggcagtcccgctgtgtaagcaggcccttgaagacctggagaagacatctggtcatgaccatccggacgtcgccacaatgctgaacatcctggcattagtataccgcgaccagaacaaatacaaggacgccgcaaatttgctgaacgacgcactggcgatccgggaaaagaccctgggcaaagatcacccagccgttgcagctaccctgaacaatctagccgttctgtacggcaagcggggaaaatataaggaagctgaaccactgtgtaagcgcgcactggaaattagagagaaagttctggggaaggaccacccagatgttgccaaacaactcaacaatttggcgctgttatgccaaaatcagggaaagtacgaggaggtagagtattactaccagagagctctcgagatctatcagactaaactggggcctgatgacccgaacgtcgccaagaccaaaaacaacctcgcgagctgctacttgaagcagggcaaatttaaacaggccgaaacactgtacaaagagattctcacccgggcacacgagcgggaatttgggtccgtggacgatgagaataaaccaatctggatgcacgccgaagagcgggaagagtgtaagggaaaacagaaagacggcacctctttcggggagtacggcggttggtacaaagcctgtaaggtggactcccccactgtgacaacaacactgaagaacctgggcgctctgtataggcgccagggaaagttcgaggcagccgagactcttgaagaagcggcaatgcgctctcggaagcaaggtctggacaacgtgcacaaacagcgcgtcgcagaggttctgaacgatcccgagaacatggagaaacgacgttcccgtgagtcactgaatgtggatgtggttaagtacgaatcgggacccgatggcggagaagaggacgggaccggaagccttaagagatcaggatctttctccaagttgagagcgtccattagaaggtcctccgagaaactcgtgagaaagttaaagggcggatcgagtcgtgagtccgagcccaagaatcctggtatgaaacgcgctagcagtctgaatgtgcttaacgtggggggaaaagccgctgaggatagatttcaggaacggaataattgtcttgcggatagtcgagccctatcggccagccatacagacctcgctcattag

SEQ ID NO: 227914 - DNA, 1722 bp, Artificial Sequence
  Description of Artificial Sequence: Synthetic coding sequence
atgtatgacaacatgtccacgatggtctacattaaggaggataagctggagaagttaacccaggatgagatcatatcaaagaccaagcaggtaatccaaggcctcgaggcactgaagaacgaacacaactccattctgcagtccttgttggaaactctcaagtgtttgaagaaggacgacgagtcaaatttggtagaagagaagagcaatatgattagaaagagcctcgagatgctggaactgggacttagcgaagcccaagtgatgatggcactgtcaaatcatctgaatgccgttgaatcagaaaaacagaagctgagggctcaagttcgcaggctgtgtcaggaaaatcagtggttacgggatgagcttgcgaatacacagcagaaactccaaaagtccgagcagtctgtggcccagttagaagaagagaagaagcacttagagtttatgaatcagctgaagaaatatgacgatgacatcagtccgagtgaggataaggataccgactcaaccaaggaaccattagatgacctctttcctaacgacgaggatgacccaggccagggcatccagcagcagcacagttcagccgctgccgcagcccaacaaggaggatacgagattcctgccaggctgcggaccctccacaatttggttatccagtacgcttcccagggccgatacgaggtcgctgttccactctgcaaacaggctttagaagatttggagaagaccagcggccacgatcaccccgatgtggctacgatgcttaacatcctggcccttgtttacagagaccagaataagtataaggacgctgccaacttgctgaacgatgcgcttgctattcgagaaaagaccttgggcaaggaccatcccgctgtcgcagcgactttgaacaatctggctgtcctgtacggcaaaagaggcaaatataaagaagccgaacccctgtgtaaacgggctctggaaatcagagaaaaggtgctaggaaaagaccacccagacgtcgctaaacaacttaacaacctggccctgttatgccagaatcagggaaagtatgaagaagtggaatattattaccagagggctcttgagatctaccagacaaaattaggcccagatgatccgaacgtggcgaagactaagaataacttggcctcatgttatctgaagcaaggcaagttcaagcaagccgaaactctgtataaagaaattttgactagggctcacgagcgagagttcgggtcagtggatgatgagaataagcccatatggatgcacgcggaggagcgagaggagtgtaaaggaaaacagaaggatggaaccagctttggcgagtatgggggttggtacaaagcctgtaaagtggactctcccacagtgaccaccaccctcaaaaatttaggcgctctgtatcggaggcagggaaagttcgaggccgctgagaccctggaggaggcggctatgcggagccgcaagcaggggttagacaacgttcacaagcagagggtcgccgaagtactgaatgaccctgagaatatggagaaacggcgatcacgcgaaagcctcaacgtagatgtcgttaagtatgaaagcggtccagatggcggagaggaagtgtctatgtctgttgaatggaacggcggagtaagcgggcgagccagtttttgcggcaagcgtcagcagcagcaatggcccggtcgacgacatagatag

SEQ ID NO: 227915 - DNA, 1731 bp, Artificial Sequence
  Description of Artificial Sequence: Synthetic coding sequence
atgtacgacaacatgagcaccatggtgtacatcaaagaagacaagctggagaaattgacacaagatgagattattagtaaaacaaagcaggtcattcagggactggaggccttaaaaaacgagcacaactccatcttacagtccctgctcgagaccctcaagtgcctgaagaaggacgatgagtctaaccttgtggaagagaaaagcaacatgattcggaagtctcttgagatgctcgagctggggctgtcagaggctcaagtgatgatggcgttatccaatcacttgaatgcagtggagagtgagaagcagaagctgagagcccaggtccgacggctctgccaagaaaatcaatggctccgcgatgaattggctaatacccagcagaagttgcaaaagagcgagcagagcgtggcgcagttagaagaagagaagaaacacctggagttcatgaaccaactgaaaaaatacgacgacgatattagtccctctgaggataaagataccgactctaccaaggagcctctggatgacttatttccgaatgatgaagacgatcccggacaggggatccagcaacagcactcatcagcagccgctgccgctcaacaaggcggatatgagattcctgcaaggctgcggacactacacaatttggtgatccagtatgcatcccagggcaggtacgaagtggctgtccctttgtgcaaacaggcactggaagacctcgagaaaacatcgggtcacgatcacccggatgttgcaaccatgctgaatatcttggctctggtgtatcgcgatcagaacaaatacaaggatgccgctaatcttctcaacgatgccctcgcaattcgcgaaaagactttgggcaaagatcaccctgctgtcgctgctacgctgaacaacctcgccgtcctgtacggaaagaggggcaaatacaaagaggctgagccactctgtaagcgggctttggaaatcagagagaaagtgctgggcaaggatcatccagacgtcgcaaaacaactgaataatctggctctcttatgtcaaaaccagggcaaatatgaagaggtggaatactattaccagcgcgcactggagatttatcagacaaaattaggccctgacgatccgaacgttgcgaagaccaagaataacctcgcgtcatgctacctgaaacaaggtaagttcaaacaggccgagaccctatacaaggagatcctgactagagcacacgagcgggagttcggatctgttgacgacgaaaacaagccaatctggatgcatgcagaggaaagggaagaatgtaagggcaagcaaaaggacggcacaagtttcggggaatacggcggttggtataaggcctgtaaagtggatagtcctactgtgaccactacactgaaaaatctgggggctctttacaggcggcagggaaaatttgaggcagccgagaccctggaagaggcggctatgagaagccgcaagcagaggagtatatccgagattccaaagaagatcctctcggcaaatgggagcaaccacttccctctgcctgggagccaaggtctagataacgttcacaaacagagagtagccgaggtcttaaatgacccggagaatatggaaaagcggaggtcccgggagtctttgaatgtcgatgtggtcaagtacgaaagcggtcctgatggtggagaagagatgcggaagatgaaactaggcctcgttaattag

SEQ ID NO: 227916 - DNA, 1683 bp, Artificial Sequence
  Description of Artificial Sequence: Synthetic coding sequence
atgtatgacaacatgtccacgatggtctacataaaggaggataaactcgaaaagctgacacaggacgagattatatctaaaacaaagcaggtgatccaggggctggaggcactgaaaaacgaacataatagcatactgcagtctctgctagagacactgaagtgcttaaagaaagatgacgaatccaacttagtcgaagagaagtctaatatgatacgaaagtcactggaaatgctggagctggggttgagcgaagcccaagtcatgatggccctatctaatcacttgaatgcagtggaatctgagaagcaaaaactgcgcgcacaggtgcgacgactctgtcaagagaaccagtggctcagggacgaattggcaaacacccagcaaaagttgcagaagagcgaacaatccgttgcccaacttgaggaagaaaaaaagcatcttgagttcatgaatcagctgaagaagtatgatgacgatatttccccttcagaagacaaagacacggattctaccaaggaacccctggacgacctgtttcccaatgatgaggatgatcccggacaggggatccaacagcagcactcctcagccgctgccgcagcacagcaaggaggatatgaaataccagcccgtctgcgaaccctgcataatctggtgatacagtacgcctcccaaggtagatatgaggtggcagtgcccctttgcaaacaggcgctggaggatctggaaaaaacaagcgggcacgatcacccagatgtggccacaatgctgaatattcttgccttggtttaccgggaccaaaataagtacaaagatgctgcaaacttgctcaacgatgcactcgctataagagaaaagaccctggggaaagatcaccctgccgttgcagctacattgaataacctggccgtcctgtatggcaagagaggcaagtataaggaggcagagcctctgtgcaaaagagctctggaaatccgcgagaaggttcttgggaaggatcatccagacgtcgcaaagcagctgaacaatctggccctgttgtgccagaaccaaggaaaatatgaggaagtggagtattattatcagagggccctggagatataccagaccaagttaggtcccgacgacccaaacgtggctaagaccaagaacaacctggcgagctgctatctcaagcaagggaagtttaaacaggcggaaactctgtacaaggagatccttacacgagcacatgagcgcgagtttgggtcagtcgacgatgaaaacaaacctatctggatgcatgcagaggagagagaggagtgtaagggtaagcagaaggacgggactagcttcggtgagtacggcggttggtacaaagcctgcaaggtggactctccaacggttactacaaccttgaagaatctgggagcgctgtatagaagacagggcaaattcgaagctgctgagaccctcgaggaggctgcaatgcgctcacgaaagcaggggctcgacaatgtgcacaagcaacgagtggccgaagtacttaacgatcctgagaatatggagaagaggagatcaagagagtccctgaatgtggacgtagtgaagtatgagtctggtcccgacgggggtgaggaggtgtctatgtccgtggaatggaacgggatgaggaaaatgaagcttggcttggttaactag

SEQ ID NO: 227917 - DNA, 1755 bp, Artificial Sequence
  Description of Artificial Sequence: Synthetic coding sequence
atgtacgataatatgagtaccatggtctacatcaaggaagacaagctggagaaactgactcaagatgaaattatttccaaaactaagcaagtgatccagggtctggaagctctgaaaaacgagcataacagcatcctgcaaagtctgttggaaacattaaagtgtcttaaaaaagatgatgagtccaacttagtggaggagaagagcaacatgattcgaaaatcactagagatgctcgaactggggttgagcgaagctcaggttatgatggcattaagcaaccacctgaacgcagtggaatccgagaaacagaagctgcgggctcaggtgcgccgactgtgtcaggagaatcaatggctcagggatgaactcgcaaacacccagcaaaagttgcagaaatctgaacagtcagtggcgcagttagaagaagaaaagaagcatctggagtttatgaaccagttgaagaagtacgacgatgatatctctccatccgaagataaagatacagacagtaccaaggaacccctcgacgatctctttccaaatgacgaagatgaccctggccaaggtattcagcagcagcattcttctgcggcagccgctgctcagcaaggaggctacgaaatcccggctcgcttacgaaccttacataatctagtgatccaatacgccagccaggggagatatgaggtcgcagtgccattatgcaagcaggcgctggaagacttagagaaaacatctggccacgatcatcccgatgtcgccaccatgttaaatatccttgcacttgtctaccgtgatcagaacaagtataaagacgctgccaatttgctgaatgatgccttagccatccgggaaaaaactttaggaaaggaccaccccgctgtggcagccaccttaaacaacctggctgtcctgtatggaaaacgcggtaagtacaaggaggccgagccactctgcaagcgagctctggaaatccgtgaaaaagtgctggggaaagatcaccctgatgtggccaagcagctcaacaatttagcattactctgtcagaatcaagggaaatacgaagaagtcgagtattactatcagcgcgcactggagatttaccaaaccaagctcgggcctgacgatccaaatgtggccaagactaaaaataacttggcatcttgctatctcaaacagggtaagtttaaacaagccgagaccctgtataaggaaatccttacaagggctcatgagcgcgagttcgggagcgtcgacgacgagaataagccgatttggatgcacgcagaggagagggaggaatgcaaaggtaagcaaaaagatggcacatcttttggagaatatggaggctggtataaggcctgcaaggtggattctcctactgtgacaaccaccctaaaaaatctgggtgccctgtaccggagacagggcaaatttgaggcagccgaaacactagaggaagcggcaatgcggagccgcaaacaggggctggataatgtccacaaacagcgtgtcgccgaggtcctcaatgacccagagaacatggagaaacgacggagccgggagtctctgaacgtggacgttgtcaagtacgagtccggtcctgacggtggggaggagatgaaaagggcatcctcgcttaatgtgctcaatgtgggcggaaaggcggctgaggacaggttccaagagcggaataactgtctcgcagacagccgcgcactgagcgcctcacataccgatcttgctcattag

SEQ ID NO: 227918 - DNA, 1857 bp, Artificial Sequence
  Description of Artificial Sequence: Synthetic coding sequence
atgtacgataatatgtcaacgatggtatacattaaagaggataaactcgaaaagctgacacaagatgaaattatctctaagacaaagcaggtgatccaaggcttggaagccctgaagaacgagcacaattcaatactgcagagcctcctggaaacattaaagtgccttaagaaagatgacgaatccaatttggtagaggagaagtcaaatatgatcagaaagtcattggaaatgctcgaactgggcctttctgaggcccaggtgatgatggccctatccaaccaccttaatgcagtagaatcggaaaaacagaagttacgcgctcaggtcagacgactgtgtcaagagaatcagtggctgcgggatgaacttgccaacactcagcagaagctgcagaaaagtgagcagtccgtcgcccagttggaagaggaaaaaaaacacttggagtttatgaaccagctcaaaaagtatgatgatgatatttccccatccgaagacaaggacaccgacagcacaaaggaacccctggacgacttgtttccaaacgacgaggacgaccctgggcagggtattcagcagcagcactccagcgctgctgcagctgctcagcagggcggatacgaaatcccagcaaggctcagaactctgcacaatctcgttatccaatatgccagccaaggcagatacgaagtggccgttccactatgcaaacaggctctggaggatctcgaaaaaacttcaggacacgatcaccccgatgtggcgacgatgctcaatattttggcccttgtctacagagatcagaataagtacaaggatgcagccaacctcctcaacgacgcactggcaattcgcgagaaaactctaggaaaagatcaccctgctgtcgcagcaactctgaacaaccttgccgtgctttacggcaagcgcggtaagtacaaggaggcagagccactttgcaagcgagccctcgagatcagggaaaaggtgctgggtaaggaccaccctgacgtggctaaacagctgaacaatctagctctgttgtgccagaaccaggggaaatacgaggaagtggaatactactaccagagagccctcgaaatataccaaaccaagttgggtcctgatgacccgaatgtggccaagaccaaaaacaacctcgccagctgctatttgaaacaggggaaattcaaacaggccgaaaccctgtacaaagaaatattgacacgcgcacacgaaagagaattcggatcagtcgacgacgagaacaagccaatatggatgcacgccgaggagcgtgaggagtgtaaaggcaagcagaaggatggaacgagctttggcgagtacgggggttggtataaggcttgtaaggtcgattcccccaccgtcacgaccactctaaagaatctgggcgctctatacaggaggcagggtaaatttgaagcagcagagactcttgaagaggccgcaatgagaagccggaagcagggattagataatgtgcacaagcagcgagttgcagaggttctgaacgatcctgaaaacatggaaaaacggcgatcgcgtgaaagtctcaatgtggatgtagtgaagtacgagagcggacctgacggtggagaggaagtgtccatgagcgtggaatggaacggagacgggactggatccctcaagaggtctgggagcttctccaagctgcgtgcctcaatccggaggtcatctgagaaactggttagaaagctcaaaggagggtcaagccgggagtcagagcctaagaaccccggagcatcgctggcagaaccactcttcgtggaaaacgattcatcatcatccggtctggaagacgctaccgctaattag

SEQ ID NO: 227919 - DNA, 1683 bp, Artificial Sequence
  Description of Artificial Sequence: Synthetic coding sequence
atgtacgacaatatgtccacgatggtgtacataaaggaagataagctcgagaagctgacacaggatgagattatatcaaagactaaacaggtgatccagggtctggaggctcttaagaacgaacataatagcatcttacagtcactgctggaaaccctgaaatgcctgaaaaaagatgacgaaagcaacctggtggaagaaaagtccaatatgatacgaaaatctctggaaatgctagaactgggcctgtctgaggcccaggtgatgatggcactttcgaatcacttgaacgcggtcgagagtgaaaagcagaaacttcgcgctcaggtaaggcgactgtgccaggaaaaccagtggctccgagatgaactcgcaaacacccagcaaaagcttcagaaatctgagcaaagtgtggcccagctcgaggaagagaaaaagcacttagagttcatgaatcaactcaaaaaatacgatgatgatatctccccctccgaggacaaggacactgattctacgaaagagccattggacgatctgttccccaacgatgaggacgatcccggacagggcatccaacaacagcacagttctgccgctgcagctgcacaacagggagggtacgaaattccagctcgcctccggaccctgcacaatttggtcatccagtatgcatctcaaggccgatacgaagtggctgtgccactctgtaagcaagccttggaagacctggagaagacttctgggcacgaccacccagatgtcgccacgatgctgaacattctggccctggtctatagggatcagaataagtacaaggatgccgctaacttgctgaacgatgcactggccattcgcgagaaaactttggggaaagatcacccagcggtggccgctaccctgaacaatcttgccgtgctttatggcaagaggggaaagtacaaggaggccgaacccctgtgtaagagggccctcgagatacgtgagaaagtcctcggaaaggaccatcccgatgtggccaagcagctgaacaatctggcccttctctgccagaaccagggcaaatatgaggaagtggaatactattatcagagagcgcttgagatctaccaaaccaagctgggcccagacgacccgaacgtggctaaaacgaagaacaacctagcgagttgttatctgaaacaaggcaaatttaagcaggccgagacactgtacaaggagatccttactagggcacacgaaagggagttcgggtccgtggatgacgagaataaaccaatttggatgcatgccgaggaaagggaggagtgcaaggggaaacagaaagatggtacctcttttggcgagtatggtggatggtacaaggcttgtaaggtggactcaccaacggtgacaacaactctgaagaaccttggcgcactatacaggcggcagggcaagttcgaagcggcagagacactggaagaagccgctatgcgtagtcgcaagcagggactggataacgtgcacaaacagagagttgcggaggtgttgaacgatcccgaaaacatggagaagaggcgctcacgagagagtctcaatgtggatgtggtcaagtacgaaagcggtcctgacggtggcgaagaagtttccatgtctgttgaatggaacggcatgagaaagatgaaactgggtctcgtcaattag

SEQ ID NO: 227920 - DNA, 396 bp, Artificial Sequence
  Description of Artificial Sequence: Synthetic coding sequence
taggagaataaaccgatctggatgcacgcagaagagagagaagaatgtaaagggaaacagaaggacgggacatcatttggagagtatgggggatggtataaagcgtgtaaagtggactctccaactgttacaaccacccttaagaaccttggtgccctgtatagaaggcaggggaaattcgaggcggctgagacattagaggaagcggcaatgcggtcccggaaacagggtctggataatgtgcacaagcagcgggtggctgaggttcttaatgatccagagaatatggagaagcgaaggtctagggaatctctgaacgttgacgtggtgaagtacgaatcgggaccggacggcggtgaggaaatgagaaagatgaagttgggtcttgtcaattag

SEQ ID NO: 227921 - DNA, 1893 bp, Artificial Sequence
  Description of Artificial Sequence: Synthetic coding sequence
atgtatgataatatgagcacaatggtgtacattaaggaagataagctggaaaaactgacccaagatgagatcattagcaagacaaagcaggtcatccaggggttagaggctttaaaaaacgagcataatagcattcttcagagccttctggagacccttaaatgtctgaaaaaagatgatgagagcaacctggtcgaggaaaagtcgaacatgatacggaaaagccttgaaatgctggagctgggcttatctgaagctcaggtgatgatggcactgagcaatcacttgaatgccgttgaaagcgagaaacagaagctgcgcgcacaggttagaaggctatgtcaggagaatcagtggctccgcgacgagctcgccaacacccagcagaagttacagaaatctgaacagtccgttgcacagcttgaggaagaaaaaaaacacctagagtttatgaaccagctgaagaaatatgatgatgacatctctcccagtgaggacaaagataccgattcaaccaaggaacccctggacgatctgtttcctaacgacgaagatgacccagggcagggcatccaacagcaacatagcagcgccgcagcagctgctcagcagggcggatatgagatcccagccaggcttcgaactcttcacaatctggtgatacagtatgcttcccagggcaggtacgaagtggcggtgcccctttgtaaacaggcactcgaggatctggaaaaaacgagcggacacgatcaccccgatgtggccactatgctcaatatcctggcccttgtgtaccgggaccagaataagtataaggatgccgctaatcttctgaacgatgccctcgcaattcgggagaagacactgggtaaggatcacccagccgtagccgctactctgaacaacctggccgttctttacggaaagagaggaaaatataaggaggctgaacctctgtgcaagagagcactggaaatcagggaaaaagtccttggtaaagaccatcctgacgttgccaaacagctgaacaatctggctttactgtgtcagaaccagggcaagtacgaggaggtcgagtattactaccaacgagctcttgagatatatcaaaccaagctgggccctgatgaccctaatgtagctaagaccaagaacaatcttgcaagctgttaccttaagcaaggcaagtttaagcaagccgagactttatataaggagatccttacaagagcacatgagcgggagtttgggtcagtggatgatgagaacaaaccgatttggatgcacgcagaagagagggaggagtgcaagggcaaacaaaaagacgggacaagcttcggagagtatgggggttggtacaaggcctgcaaggtcgactcacccacggtgacgaccaccctgaagaatctgggcgcattgtataggagacagggcaaatttgaggctgcagagaccctcgaagaagccgctatgcgcagcaggaagcaggggctcgataacgtgcacaaacagagagtcgccgaggtgcttaatgatccggaaaacatggaaaaaagaaggtcccgcgagagcctgaatgtcgatgtggtgaagtatgagagtggacctgatggaggtgaagaagatggcactggcagcttgaaacgttccgggtccttctcaaaacttcgggcatccattcgaagatcttcagaaaagcttgtcaggaagttaaaaggcggtagctcaagggaaagcgagccaaagaatcccggaatgaagagagcgtcatccttaaatgtcctgaacgtagggggaaaagccgcagaagatcgattccaaggtgtctcaggacgggcatctttttgtggcaaaaggcaacagcagcaatggcccggtagaagacacaggtag

SEQ ID NO: 227922 - DNA, 453 bp, Artificial Sequence
  Description of Artificial Sequence: Synthetic coding sequence
atgtatgataacatgagtactatggtctacatcaaggaagataagttggaaaaactgacccaggatgagatcattagcaagaccaagcaagttatccagggtttagaagctttaaaaaatgagcataattccattttgcaatcactcttggagactttgaaatgtctcaaaaaagatgatgagtctaatttggtggaggaaaaatcaaatatgatccgcaaatcattggagatgttggagctgggtttgagcgaagcacaggtcatgatggcacttagtaatcacttgaatgcggttgagagcgagaaacagaaactgagagcccaagtgaggaggctgtgtcaggaaaaccaatggctccgggatgagctggccaatactcagcagaaattacagaagtcagaacagtccgtagcccaattggaggaggagaagaagcatttggaattctag

SEQ ID NO: 227923 - DNA, 1695 bp, Artificial Sequence
  Description of Artificial Sequence: Synthetic coding sequence
atgtatgataatatgagtactatggtttatatcaaggaggataaactggagaagctaacacaggacgagattatctccaaaaccaaacaagtgatccaaggtcttgaggcactcaaaaacgagcataactcaattcttcagagcttactggagaccctcaaatgcctcaagaaggacgacgaatccaacctagtggaggagaagtccaacatgattagaaaaagtctggagatgttagagttaggccttagtgaagcacaagtgatgatggcactgtcaaaccatttaaacgcggtggagtcagagaagcaaaaactcagggcacaggtgagacgattatgtcaggaaaaccagtggctgagagacgaattggcaaacacgcagcagaagctccagaaatccgaacagtccgtcgcccagctcgaggaagagaagaagcatctggagtttatgaaccagcttaagaagtacgacgatgacataagcccttcggaggacaaagatactgacagcaccaaagaacctttggacgacttgttcccaaatgatgaggacgatcccggacagggcatccagcagcaacacagcagtgcggcagcagccgctcagcaaggtggctacgagatccctgcgaggctgcgcaccctccacaacctggttatacagtatgctagccagggcaggtatgaagtggcagtgcccctgtgtaaacaggccctcgaggatttggaaaagacttctggacacgatcatcctgacgtcgctacaatgttaaatattctcgcgttggtctaccgggatcagaataagtacaaagatgccgcaaacctgcttaacgatgcccttgctatcagagagaaaactctgggtaaggaccatcccgctgtggctgccacgttgaataacctcgccgtattgtatgggaagaggggaaaatacaaggaggcggaacctctatgcaagcgcgcattagagatcagggaaaaggtcctaggtaaggaccaccccgatgtcgcaaaacagctcaataacctcgcattgctctgccaaaatcagggaaaatatgaggaagtggagtattattatcagagggccctggagatttatcagaccaaactgggccctgatgaccccaacgtggccaagacaaaaaataatcttgcctcttgctatctcaaacagggtaagtttaaacaagctgagaccctgtacaaggaaatcctgactcgcgcacatgaacgggaattcggttcagtagatgatgagaataagcccatatggatgcatgcagaggagcgtgaagagtgcaagggaaagcagaaggatggcactagtttcggcgagtatggcggttggtacaaggcttgcaaagtggattcaccgactgttacaacaacccttaaaaaccttggagccttatatcgaaggcaggggaaatttgaggcagctgagactcttgaagaagcagctatgcgatctagaaagcaaggccttgataacgtacataaacagagggttgcagaggtactcaacgaccctgaaaatatggaaaagagacgttcgcgggagtcgctgaatgtggatgtcgtcaagtatgagagcgggcctgacggaggagaagagggtgtaagcggccgtgcaagcttctgtggcaagcggcagcaacagcagtggccgggacgtcgccatagatag

SEQ ID NO: 227924 - DNA, 1869 bp, Artificial Sequence
  Description of Artificial Sequence: Synthetic coding sequence
atggccatgatggtgtttcccagggaggagaaactgagccaagacgaaatcgttttgggaaccaaggcagttatccagggtttagaaacactgcgcggagaacaccgggcactcctggccccactcgtggcccctgaggcaggcgaggctgagccaggaagtcaggaaaggtgcattctgctgagacgctccctggaagctatcgaattgggcctcggggaggcacaggtgatccttgccctgagcagccatttaggagccgtggaatctgaaaaacagaagctccgcgctcaagtacggcgtcttgtgcaggaaaatcaatggctgcgagaagagctggccggtactcaacagaagcttcaaaggtctgaacaagctgtggcccagctcgaggaggagaaacagcaccttctatttatgtcacagatcagaaagctggacgaggatgccagcccaaacgaagaaaagggagacgtgcccaaggacacactcgatgatttatttccaaatgaagatgaacagagcccagccccaagcccaggtggcggagatgtgagtggtcagcatggcggttatgaaatccccgcacgactaaggactctgcataacttggtgattcaatacgcttctcaaggacgctacgaagtggccgtgcccctgtgcaaacaggctctggaggacttggaaaagacgtccggtcatgatcacccagacgtggctaccatgcttaatattctcgctttggtgtatagagatcaaaacaagtataaggaagcggctcacctccttaacgatgccttagcaattagagaaaagacactgggaaaggatcatccagcagtcgccgctacgctgaacaatctggctgttttatacggtaaaagagggaagtataaagaggcggagcccttgtgcaagcgcgctttggaaattagagaaaaagtacttggaaagttccaccctgacgtggcgaaacagctttccaatctcgcgttgctgtgtcagaaccaggggaaagcagaggaggtagagtattactaccgacgggctctggagatatatgccactcgcttgggacccgatgatccaaacgtcgctaaaactaagaataatctagccagttgctatctgaaacagggcaaatatcaggacgcagaaacattgtataaggagattctgacacgcgcacatgaaaaggaatttgggagcgtgaacggggataacaagccgatttggatgcacgctgaggaaagggaggaaagcaaggataagcgaagagatagtgctccttatggcgagtacggtagttggtataaagcttgtaaagtggactctcctacagtgaataccacattacggtcactcggtgcgctataccgtcggcagggaaagctcgaggcagcccacactctggaggattgcgcttctaggaacaggaagcaggggctagacccggcttcccagacaaaggtggtcgagctcctcaaggatggcagcggcagacgcggtgataggagaagtagcagagatatggctggcggagctggcccacgctcagagtctgatctcgaagatgttgggccaacggccgaatggaacggagatgggtctgggagcttgcgacgctctgggtcgtttggaaaactaagagatgctcttagaaggagttcggagatgttagttaagaaattgcaggggggtacgccccaggaaccaccaaaccccaggatgaagagagccagctcgttgaacttcttaaacaagtctgttgaggaacccactcagccgggtgggacaggtttgagtgattcccgtaccctgtccagtagttccatggatctgagccggagaagtagtctggtggggtag

SEQ ID NO: 227925 - DNA, 1638 bp, Artificial Sequence
  Description of Artificial Sequence: Synthetic coding sequence
atggctatgatggtttttcccagagaggagaagctctcccaggacgaaatagttctcggaaccaaagccgtgatacaagggctcgagactctgcgcggtgaacatagagctctgttggctcccctcgtggctcccgaggccggtgaggccgagccaggttcccaggagcgctgtatcctgctgcggagatctctggaggccatagagctcgggttaggggaggcccaggaggagaagggcgatgtgcctaaagatacactcgacgatctctttcctaatgaggacgagcagtccccggcaccaagccctggaggaggagacgtatcaggacaacatggcggttacgaaatacctgcccgtcttaggactcttcacaacctggtcattcagtacgcgtcccaaggtagatatgaggttgccgttccactgtgcaagcaagcgctagaggacttagaaaaaacatcaggacacgatcacccggacgtggctaccatgctgaatatccttgcactggtttaccgagatcagaataaatacaaggaggccgcacaccttcttaatgatgcgctagccatacgcgaaaagactttgggtaaggaccacccagccgtggctgcaacattaaataacctggcggtcttgtacggcaagcgcggtaagtataaagaagccgaaccactgtgcaagcgggcactggagattcgggaaaaggtcttagggaaattccaccccgatgtggcaaaacagctgagtaatctggctctgctatgccaaaatcaaggcaaggccgaggaggttgagtattattatcgacgagccttagaaatttacgccaccagactgggtcccgatgatccgaacgtggcaaagacaaagaacaaccttgcatcatgctacctaaagcaagggaaataccaagatgctgagacgctatataaagaaatcctgaccagagcacacgagaaggaatttggctctgtgaacggcgataataagcccatctggatgcatgctgaggagcgcgaggagagcaaggataaaaggcgggatagcgctccgtacggagagtacggctcatggtataaagcttgtaaggtggattcgcctaccgtgaatacaacactacgttccctgggggctctataccgccgtcagggtaaactagaggcggcacacacgctggaagattgtgcttcccgtaaccgcaagcagggactggacccagcttcccagaccaaagttgtggagctcctcaaggatggttcaggcaggaggggggatcgccgttcctccagggacatggcaggcggagccggaccacgtagcgaatctgatctcgaggacgtgggccctacggccgagtggaacggtgatggtagtggctcgctgaggaggagcggcagcttcgggaaactaagagacgccttgcggcgatccagcgagatgctggtcaagaaacttcaaggaggtacaccacaggagcctcctaaccccagaatgaaaagggcctcatcacttaactttttaaataaaagcgttgaggagcccacccagcccggtggtactggattaagcgattcgaggaccctcagttcatcgtctatggacctaagtcgcaggagctcgttagtggggtag

SEQ ID NO: 227926 - DNA, 1869 bp, Artificial Sequence
  Description of Artificial Sequence: Synthetic coding sequence
atggccatgatggtgtttccccgtgaggaaaagttatcacaagacgagatcgttctgggaaccaaggcagtcatacagggtttagaaacccttcgcggtgagcatagagcgctactggcgcctttagtagccccagaggcaggcgaggcggaacctggcagccaggagcgctgtattctcctccgacgctcactcgaggcaatcgagctcggcctcggggaagcacaggtcatccttgcactaagctctcacctgggggctgtcgagtctgagaaacagaaactgagagcccaggttcggagactcgtgcaggagaaccagtggctgagagaggagttggccggtacccagcagaagctccaaagaagtgagcaagcagtggcccagttggaagaagaaaaacaacatctgctttttatgtctcagattcgcaagctcgacgaggacgcctcgccgaatgaggaaaagggtgatgtccccaaagatacactggacgacctgttcccaaatgaagacgaacagtccccagcaccatcaccagggggaggggacgtgtccggccagcatggcggatacgagattccagcccgtttgcgtaccctgcataatttagtgatacagtacgcttcccagggaagatatgaggtcgctgtccccttgtgcaagcaggccctggaggacctcgaaaagaccagcggacacgaccatccggatgtggctactatgctgaatatcttagccctggtttaccgcgatcagaataaatataaggaagcagctcatctgttaaacgatgctctggctattcgagagaagactctcggtaaagaccaccctgcggtcgccgctacattaaataatctagcagttctgtatggcaagcgcggaaaatataaagaggccgagcctttgtgtaaaagagcccttgaaattcgagagaaggtgctcggcaaattccaccccgatgtcgctaagcagttgtccaacctggcccttctttgccaaaatcagggcaaggcggaggaagtggagtattattataggagggcccttgagatttacgccacccgcctggggccagatgaccccaacgtggcgaagacgaagaataacctggctagttgttatctgaagcagggaaagtaccaagacgctgagacactatataaagagatcctgacccgcgctcacgagaaagaatttggcagcgtgaatggagataataagccaatttggatgcacgccgaagaacgcgaagagagtaaggataagaggcgagattcggcaccctacggagagtacggaagttggtataaagcctgcaaggtcgatagccctaccgtaaatactacgttaaggtccctgggtgcgctttaccgccgtcagggtaagctggaggcagctcataccctggaagactgtgcttcaaggaatcggaagcagggattggatccggcatcccagacaaaggtggtggaactcctgaaggacgggagtggccgtcgcggagaccgcaggagcagtcgcgatatggcagggggtgccggtcccagatccgagtccgacctggaggacgtaggacccactgcagagtggaacggtgatggttctggtagtctgcggagatcagggtctttcgggaaactcagagatgccctgcggaggtcttctgagatgctcgtgaaaaagctccaggggggaactccacaggagcctcctaaccccaggatgaagagggccagctctttgaacttcctaaataagagcgttgaggaaccgactcaacctggagggacgggtctgtcagactcccgcaccctgtcatccagcagcatggatctttccagaagatctagcctggttgggtag

SEQ ID NO: 227927 - DNA, 1869 bp, Artificial Sequence
  Description of Artificial Sequence: Synthetic coding sequence
atggcgatgatggtgttcccaagagaggagaaactgtctcaagacgagattgtgctgggcacaaaagcagtcatccagggattggagactctgcgcggagagcacagggctctgttggcacctctggttgctccggaggccggtgaagcagagcccggaagtcaagagcggtgtattcttctgagaaggagcctggaagcaatcgaactgggactgggcgaggctcaggtaattctagcccttagttcccatctaggggcagtagaatccgagaaacagaagctcagagcacaggtgagaaggctggtccaagaaaatcagtggttaagggaggaactcgccggaacacagcagaagctccagaggtcagagcaggcagtcgcccaactcgaagaggagaagcagcacctgctgttcatgtcacagattcgaaagctcgacgaagatgcgagcccaaatgaagagaagggagacgtcccaaaggacaccctggacgacctgttccctaatgaggacgagcagtctcctgcgccatcccctggcggtggggacgtctctggacagcacgggggatacgagatccccgcaagactcagaaccctgcacaatctagttatacagtacgccagccaagggaggtacgaggtggctgtacccctgtgcaaacaggcgctcgaggatctagagaaaacaagtgggcatgatcatccagacgtcgctaccatgctgaatatcttggccttggtctaccgcgatcaaaataaatacaaggaggcagcacacctgctgaatgatgctctcgccattagagaaaaaacactaggtaaggatcatccggctgtggctgccactctaaataatcttgccgtactgtacggtaagcggggtaagtataaggaggcagaacccctctgcaaaagggctttagagatacgcgagaaggtgcttggaaagtttcaccctgacgttgccaaacaactttccaatttagcactgctgtgccaaaaccaggggaaggcagaagaggttgaatactattatcgacgtgcacttgaaatctacgcaacaaggctcggtcccgacgacccaaatgtagccaaaactaaaaacaatctggccagctgctatctgaaacagggaaagtatcaggacgcggagacactgtacaaggaaattctcacgcgcgcacacgaaaaagaattcggatccgtcaatggtgataacaaacccatctggatgcacgctgaggagagagaagaaagcaaggacaagcgacgggacagtgcaccctatggcgagtacgggtcgtggtacaaggcctgtaaagtggattcaccaacggtgaatacgactttaagatccctgggcgcactgtaccgccgacagggaaaattggaagctgcacacaccctcgaggattgcgcaagtaggaacaggaagcagggcctggaccccgcttcccagacaaaagtagtagagcttctgaaggatgggtcgggacgaagaggcgatcggcgatcctcgcgtgacatggctgggggagccggacccaggtcggaatctgacctggaagatgtgggacccacagcagagtggaatggggacggatccggcagtcttcgccgttctggatcattcggtaagctccgtgacgcattaaggagaagcagcgagatgctggtgaagaaattgcaggggggaacaccccaagagcctcctaaccctcggatgaagcgcgctagtagcctcaactttctgaacaagagcgttgaggaacccactcaaccaggcggaacaggactgtcagactccaggacactttcaagcagctccatggacctgtctagacgaagtagcctggtcggctag

SEQ ID NO: 227928 - DNA, 1638 bp, Artificial Sequence
  Description of Artificial Sequence: Synthetic coding sequence
atggccatgatggtgttcccaagggaggagaagttgtcacaggacgaaattgtactagggactaaggcagtgatccaaggcctggagactctgaggggtgaacacagagcgctgcttgcccctcttgttgccccagaggccggtgaagctgagccgggatcgcaggagagatgtatattgctgagaaggtccctggaagccatagagctcgggctgggggaggcgcaggaggagaagggcgacgtgcctaaagacacgctggatgacttgttccctaacgaagatgagcagagtccagccccttcacctgggggaggcgacgtcagcggccagcacggcggatatgaaatccctgcccgacttagaacactccataatctggttattcagtacgcctctcaggggcgatacgaggtggcggtgccactgtgcaaacaggccctggaagacctggagaagacatcagggcatgatcaccctgatgtcgccaccatgctgaacatactggccttagtgtaccgggatcagaacaagtacaaggaagccgctcacctcctgaatgatgcactcgccattcgggagaagacactgggaaaggatcaccctgcagtggctgcaacactgaacaatctagccgtgctttatggcaagcggggaaaatacaaggaggccgaacccctgtgcaaacgcgctctggagatccgggaaaaagtcctaggcaagtttcacccagacgttgcaaaacagttgagtaacttggccctcctttgtcagaatcagggcaaggcggaagaagttgaatactactacaggcgcgctctggagatatatgccacgcgtctgggtcccgacgatccaaacgtggctaaaaccaaaaataatcttgctagctgctatttaaagcagggaaaataccaggatgctgagaccttgtacaaagagatcttaacaagagcccatgagaaagaatttggcagcgtcaacggagacaacaaacctatttggatgcatgccgaagagcgcgaggaatctaaagacaagcgaagagacagcgctccttacggcgagtacggcagttggtacaaggcttgcaaggtcgattctccgaccgtgaacacgacactgcggtcccttggcgctctgtaccggaggcaagggaaactggaggcggctcatacactggaggattgcgctagcagaaacaggaagcaggggctggatccggcttctcagacaaaggtagtcgagcttctaaaggacggctcgggcagaagaggcgacaggcgaagttccagggatatggcgggaggcgctgggcctcgttccgagagtgatctcgaagacgtaggccctaccgccgagtggaatggtgatggatctggatccctgcgcagaagcggctcatttggaaagctgcgcgatgctctgagacggtcctctgagatgctagtgaagaaactgcagggcggtaccccccaggaacccccaaacccaagaatgaagcgagcttctagcctcaattttctcaacaaatccgttgaggagcctacgcaacccggtggtaccgggctgagcgacagtcgaacactttcttcgtcgtccatggatctttcccgcaggtctagcctggttggctag

SEQ ID NO: 227929 - DNA, 501 bp, Artificial Sequence
  Description of Artificial Sequence: Synthetic coding sequence
atggcaatgatggtgttcccacgcgaggagaagctaagtcaggatgagatcgtgctagggaccaaggccgtaatccaaggccttgaaacacttaggggcgagcaccgtgctctgctcgcacctctcgtggcacctgaagctggggaagctgaacccggaagtcaggagagatgcatccttttgagaagatctttagaggccatcgaactcggcttgggagaagcacaggtgattctggctctgagcagccatcttggagctgttgagtcagagaagcagaagttgcgggctcaggtccgacgactcgtacaggaaaaccagtggctgcgcgaggagcttgccggaactcagcagaagttgcaacggagcgaacaggccgtggcgcagctggaagaggagaagcagcacctgctgtttatgtcacagatcagaaaactagatgaggatgcatctcccaatgaggagaagggcgatgtccccaaagacacattggacgattag

SEQ ID NO: 227930 - DNA, 570 bp, Artificial Sequence
  Description of Artificial Sequence: Synthetic coding sequence
atggccatgatggtgtttcccagggaggaaaaactctcacaggatgaaattgtcctcggtactaaagctgtcatccaaggtttagagaccctgaggggggagcacagggctctcctggcccctcttgtggcacctgaagccggagaagcagagccaggttctcaagagcgatgcatccttctacggcgttcactggaagcaatcgagctcggccttggtgaagctcaggaggagaagggagatgtgcctaaggacacattggatgacctgttcccgaatgaagacgagcagagcccggcaccctctcctgggggtggggatgtcagcggtcagcacggtggttacgagattccggctaggttgcgaactttgcacaatctggtgattcagtatgcttcccaggggcgttacgaggtggctgtcccactctgcaagcaagccttagaggatctcgaaaaaacatctggtcatgaccatcctgacgtggcgacaatgctgaatattctggctctggtgtatcgggatcagaataaatataaggaggccgctcatctgctcaatgacgcttag

SEQ ID NO: 227931 - DNA, 516 bp, Artificial Sequence
  Description of Artificial Sequence: Synthetic coding sequence
atggccatgatggtcttccccagagaagagaagctctcccaagacgagatagttctgggaacgaaggccgtgatacagggtctggagactctccgcggtgaacatagggcactcttggctcccctggtggccccagaagcaggggaggccgaaccaggctcccaagagcgctgtattctgctccggcgtagtcttgaagcaatcgagctcggactgggtgaagcccaggtgatcttagctctgtcttcgcatcttggcgctgtggaaagcgaaaaacagaagctgcgtgcccaggtgcgaagactcgtgcaagaaaaccaatggctcagggaggaattggccggaacgcaacaaaaactacagcggtccgaacaagctgttgcacagctagaagaggagaagcagcacctgctcttcatgagccagatcagaaaacttgatgaggacgcctcaccaaacgaagaaaaaggggatgtacccaaggacactctggacgatctattccctaatgaatag

SEQ ID NO: 227932 - DNA, 438 bp, Artificial Sequence
  Description of Artificial Sequence: Synthetic coding sequence
atggcaatgatggtttttccacgtgaggagaagctaagccaggatgagatcgtgctcgggaccaaggcggtcattcagggcttggaaacactccgcggagaacacagggccctcctcgctccgctagtggctcctgaggctggagaggccgagcctggctctcaggagaggtgcattctgctccggaggagtctggaagctatagaactgggcctcggggaggcacaggtcatcctggcactgtccagccacctgggtgccgtcgaaagcgaaaaacagaaactcagagcccaggtgcggcgactggtacaagagaatcagtggctccgggaggaactggccggaactcagcagaaactgcagaggtccgagcaggcagtcgctcagctcgaggaagaaaagcagcatctgctgtttatgtcacagatacgaaagtag

SEQ ID NO: 227933 - DNA, 318 bp, Artificial Sequence
  Description of Artificial Sequence: Synthetic coding sequence
atggcgatgatggtcttccctcgcgaggagaaactgtctcaggatgaaattgtgttagggaccaaggccgtaatccaggggttggagaccctccgtggcgagcatcgggctctccttgctccattagtagccccagaggccggtgaagctgagcccggttctcaagagcgctgtattttactgagaagatcacttgaagccatcgaactgggacttggagaagcccaggtgatcttggccctcagctctcacctaggcgctgtggaatccgagaagcagaaactgcgcgctcaggtgcggagattagtccaagaatag

SEQ ID NO: 227934 - DNA, 1515 bp, Artificial Sequence
  Description of Artificial Sequence: Synthetic coding sequence
atgagcgtgcaggttgccgcacccggatcagccggtctgggccctgaaagactttcccccgaggagctggtgaggcagacaagacaggtcgtacagggcctcgaagcgctccgcgctgagcaccatgggctggccggacatttagccgaggccctcgcgggacagggcccagccgctggtctcgagatgcttgaggagaagcagcaggtcgtatctcacagtttagaagccatcgagctgggccttggggaggcacaggtacttcttgctctcagcgctcacgtgggggctctggaggcagaaaagcagcgcctcagatctcaggcccgtagactcgcccaggagaacgtgtggctccgggaggagttggaggagacccaacgccgtctgagggctagcgaagagtcggtcgctcaactggaagaggaaaagcggcatcttgaatttctgggacagctgagacagtacgatccccctgctgagtcacagcagtccgaatcgccccctcgacgcgactccctcgctagcttgttccccagcgaggaggaggagcggaaaggccctgaggcagccggagcggcagccgcacagcaaggcggttatgaaattccagctcgactgagaaccctgcataacttagttattcaatacgctggtcagggccgttacgaggtagctgtgcccttgtgtagacaggcccttgaggatcttgagcggtcttccggtcattgtcatccggatgtggccactatgttgaatattctggccctcgtgtatagagaccagaataagtacaaagaagccaccgatctgttgcatgacgcattgcagatcagggagcaaacccttggccctgagcatcctgccgtggcagccacccttaacaatttggctgtgctctatggcaagagaggaagatatagggaagctgagcctctatgccaacgagccctcgagatacgggagaaggtgctcggagccgatcatccagatgtggctaagcagctcaataatttagcactgctgtgtcagaaccagggtaagttcgaggatgtggaacgacactacgcaagggcactctcaatttatgaggcattaggcggaccccatgaccctaatgtagccaaaactaagaataatttagcttccgcatacctgaaacagaacaaataccaacaggctgaagagctttacaaggagatacttcataaggaggaccttcccgctccactcggagcccctaacacgggtaccgcaggagacgctgagcaggccctcaggagaagttcttccttgtctaaaatcagagaatcgatcagacggggtagcgagaagttggtttcccggcttcgaggggaggctgccgcaggcgctgccggaatgaagcgtgcaatgagcctgaacaccctgaatgttgacgcccctcgcgcacccggtacacagttcccaagctggcacctcgacaaggctccaagaacattgtctgccagcacccaagatctgagtccacattag

SEQ ID NO: 227935 - DNA, 1557 bp, Artificial Sequence
  Description of Artificial Sequence: Synthetic coding sequence
atgatcccccagacaccccaccactgttctcccggtgctgcgatgagcgtgcaagtggccgctccaggcagcgccggtctgggcccagagagactatctcctgaggaactggtcagacagacaaggcaggtcgtgcagggtctcgaggcactccgggcagaacaccacggcctcgccggacatctagcggaggccctcgccggacagggccctgctgccggactggaaatgctggaggagaaacaacaggttgtgagtcacagccttgaggcaattgaactcggcttaggtgaagcccaggttctgctagccctgtccgcgcacgtgggagcgctcgaggctgagaagcaaagactgagaagccaggcgagaaggcttgcacaggaaaacgtgtggctccgtgaagaattggaggaaacacagaggagacttagggcctccgaggaatccgtggcgcaactcgaggaggagaagcgccatctggaattcttgggccagctcagacagtatgaccctccagcggagtcccagcagagcgagtcccctcccagacgtgactcactggcgagcctgttcccatccgaagaggaggaaaggaaaggacctgaagccgcaggagcagcggcagcgcagcaggggggttacgagatccctgctaggctgagaactctgcataaccttgtgattcagtatgcgggtcagggccgttacgaggttgcggtgcccttgtgtcggcaggcactcgaggacctggaaagaagtagtggccattgccatcccgacgtggctactatgttaaatattctcgctctcgtctacagagatcaaaataagtacaaggaggccactgacctactccacgatgccctccagatccgcgaacagacgctggggccagagcatcccgctgttgcagcaaccctgaataatctcgcggtcctgtacggaaaaagaggacgttaccgcgaagccgagcccctttgccaaagggctctagaaattcgggagaaagttctcggcgctgaccatccagatgtggctaagcaactgaacaatctcgcgctcttgtgccagaaccaggggaagtttgaagacgttgagagacattatgccagggccctgtccatctatgaagcccttggcggacctcatgatccaaatgtggcaaagacaaagaacaacttagcaagcgcctacttgaaacagaacaagtaccagcaagccgaagagctctacaaagagattctgcacaaagaagatttgccagcgcctctaggagcccctaacacaggcactgccggtgatgcggaacaggccttacgacgaagcagctctctatcaaagattcgggagagcattaggcgcggatctgaaaagttagtgtctcgccttagaggtgaagcagcagccggtgctgcagggatgaagcgagccatgtctcttaatactctgaacgtggatgctccccgtgcccctggcacgcaatttccaagctggcatctcgataaagcccctaggaccctgagcgcgtcgacgcaagatcttagcccacattag

SEQ ID NO: 227936 - DNA, 2379 bp, Artificial Sequence
  Description of Artificial Sequence: Synthetic coding sequence
atgcaaggggaggatgccaggtatttgaaaaggaaagtgaaaggcggtaacatagacgttcacccctctgagaaggcactgatcgtgcattatgaagtagaagccaccatcctgggagaaatgggggacccaatgctgggtgagaggaaggagtgtcagaagatcatcaggctcaagagcttgaacgctaatacagatatcacatctttagcccgaaaggtcgtggaagaatgcaagctcatccatccatctaagcttaacgaggtcgagcagctactatactacctccagaaccgtcgcgattcccttagtggcaaagagaagaaggagaagtcttcaaaaccgaaagacccgccaccattcgaggggatggaaatcgatgaggtggctaacattaacgacatggatgaatatatcgaacttctgtacgaagacatccctgacaaggtcagaggtagcgcattgatactccagctcgcacggaaccctgataatctggaagaactgcttctcaatgagacagccctgggggctcttgctcgtgtgctaagggaggattggaagcagagcgtggagctggccacaaatatcatttatatatttttctgcttctcctcgtttagccagttccatgggttaattacacactacaagatcggtgctctttgtatgaacatcatcgaccacgagttgaagcgccacgaactgtggcaggaagagctgagcaaaaagaagaaagctgtggacgaggaccccgagaatcagaccctgagaaaggattatgagaaaacattcaaaaagtatcagggtctggtggtgaaacaggaacaactattacgggtcgcactttacctcctactcaacctggccgaggatacacgcacggagctgaagatgcgcaacaagaacatcgttcacatgcttgtgaaagcattagatcgtgataactttgagttgttaattctggttgtcagcttcttgaaaaagctgtctatctttatggaaaataagaatgacatggttgagatggacattgttgaaaaactcgtgaagatgattccctgtgaacatgaggatctgcttaacatcacattacgcctcctactaaatctgtcatttgatactgggttgcgaaacaagatggtgcaggtcggacttctgcctaaacttacagccctcctgggtaatgacaattacaagcagatcgctatgtgtgtgctttaccacatctcaatggacgacagattcaagagcatgtttgcatatacagactgtataccgcaactgatgaagatgctgtttgaatgtagcgacgaacgtattgatctggagctgataagcttttgtatcaacctggcggctaataaacgaaacgttcaactgatttgcgagggtaacggactgaaaatgctgatgaagagggctctgaaattcaaggatcctctacttatgaaaatgattaggaacattagccaacatgatggcccaaccaaaaatctctttatagattacgtgggggatctcgccgcacaaatcagtaacgatgaagaggaagagttcgtaatcgagtgcttggggaccttagccaatctgaccatccctgatctagactgggaattagtccttaaagagtataagctggttccctatttgaaggacaagctcaaaccaggcgctgccgaagatgatttagtgctggaagtcgttatcatgattgggaccgtatcgatggatgactcttgcgccgcattactggcaaaatctgggatcattcccgctctgatcgaactactgaatgcgcaacaggaagatgacgagttcgtgtgccagatcatttacgtgttttaccaaatggtttttcaccaggcaacgcgggacgtcatcatcaaggagacccaggctcccgcatacctaattgatttaatgcacgataagaataatgagatacgcaaagtgtgcgacaacacgcttgacatcatagctgaatacgacgaggaatgggccaaaaagatccagagcgaaaagtttaggtggcacaatagtcagtggctggaaatggtggagtctcgacagatggacgaatcagaacaatacctctatggcgacgatcgaattgagccatacattcacgaaggagacatcctcgaacgtcccgacctcttttataatagtgatggtctgatcgccagtgaaggagccatttctcccgatttctttaatgattaccatctgcaaaatggagacgttgtcgggcagcacagctttcctgggtctctaggcatggatggcttcggacagcccgtcggaatactggggcgaccggcaaccgcttacggattccgacccgacgaaccctattactacggctacggctcatag

SEQ ID NO: 227937 - DNA, 2259 bp, Artificial Sequence
  Description of Artificial Sequence: Synthetic coding sequence
atgggggacccaatgcttggcgagcgtaaagaatgtcaaaaaatcattaggctaaaatcgttaaacgccaacacagacatcacatccttggctaggaaggtcgtggaagaatgtaaactcatccacccttctaagctcaatgaggtcgaacagctcctatattatctccagaaccgacgcgactctctctcaggaaaagagaagaaggagaagtcctccaagccaaaggaccctcctccttttgaaggcatggagatcgacgaagtagccaacattaacgacatggatgaatatatcgaactcttgtatgaggatataccagacaaagtgaggggtagcgccctgatcctccagctggctcgaaatccggacaatttggaggagctgctgctcaacgagactgccctgggtgccctcgctcgagtacttcgggaggactggaagcaatcagtggagctggccacaaacatcatctacatatttttctgttttagcagcttctcccagtttcacggactgatcacgcattacaaaatcggggctctgtgtatgaatatcatagaccatgagttaaagcggcatgagctctggcaagaggagctatctaagaagaagaaagcagttgatgaagaccctgagaatcaaacacttcgcaaagattatgagaaaacttttaagaaataccagggcctggtggtgaagcaggaacagctgctgagggtggctctgtaccttttgctgaacctagcagaggatactcgcactgaactcaaaatgaggaataaaaatatcgtgcacatgttagtgaaagcgctggaccgagataatttcgagctcctgatcctcgtggtctctttcctaaaaaagctttccatttttatggaaaacaaaaacgacatggtggaaatggatatagtcgagaagctggtcaagatgattccctgcgaacacgaggaccttcttaacattactctgcgcctgttattgaatctttcattcgacactgggcttagaaataagatggtgcaggttggtctgttgccgaagctcaccgccctgctaggaaacgataattataaacagattgcgatgtgcgtgctgtatcatattagtatggacgacaggttcaaaagtatgttcgcctacaccgattgcatccctcaactgatgaaaatgttattcgaatgttccgatgagaggattgacttggagctgatctccttttgtatcaacctggcggctaacaaacggaacgtgcaactgatctgtgaaggcaatggactaaagatgctgatgaagcgagccctgaaattcaaggacccactgctcatgaagatgattcgcaatatatctcagcatgatggcccaacaaaaaatctgttcatagattacgtgggcgacctcgcagcacagatctccaacgacgaagaggaagaatttgtcatagaatgtttgggaacattagccaatctgacaatccccgacttagattgggagctcgtcctgaaagaatataagctggtgccatacttaaaagacaaactaaagccgggagcggctgaggacgatttggtgcttgaagtggttataatgatcggtactgtgtcaatggatgactcctgcgcagccctgctcgcaaagtccggcatcatcccggctcttatcgagttgctgaatgcacagcaggaagacgacgagttcgtatgccaaattatctatgtgttctatcagatggtgtttcaccaggccacaagagatgtgatcataaaggaaacccaggcgccagcttatcttatagacctgatgcacgacaaaaataacgagatccggaaagtatgcgacaacactctggatataatcgccgagtacgacgaggagtgggctaagaaaattcagtccgagaagttcaggtggcacaactctcagtggcttgaaatggtggagtcaagacaaatggacgagtccgagcaatatctgtatggcgatgatcggatcgagccatatatacatgagggagacatcctcgagcgacccgacctcttttataatagcgacgggcttatcgcgtcagaaggtgccatctctcccgacttcttcaatgactaccatcttcagaacggggacgtcgtcggccagcactccttccctggcagccttgggatggatggcttcggccagcctgtgggcatcctgggacgccctgctacagcctatgggttcagacctgacgaaccatattattacgggtacggtagctag

SEQ ID NO: 227938 - DNA, 2247 bp, Artificial Sequence
  Description of Artificial Sequence: Synthetic coding sequence
atgcaaggggaggatgcccgatacctgaaaagtattagactgaaatctttgaacgcaaataccgacatcacgagcctggcccgtaaggtggtggaagaatgtaagctgattcatccctccaagctgaacgaggttgaacagctcttatactatttgcagaatcgacgggacagtctctcaggaaaagagaagaaagagaagagctccaaaccaaaggatcctcccccttttgagggcatggaaattgacgaggtcgctaacatcaacgacatggacgagtacatcgagctgctctatgaagatattcctgacaaggtgcgcggtagcgcgctgatcttgcaactcgcaagaaacccagacaacttagaagaactgttgctgaatgagaccgcgttgggagcactggccagggtcctcagagaagactggaaacaatctgtcgagctcgctaccaacatcatttacatcttcttttgtttctcttcgttttcccagttccatggtttaataacgcactacaagatcggagcattatgcatgaatatcatagaccacgagttgaagcgtcatgagctgtggcaggaagaattgtctaaaaagaaaaaagccgttgatgaggaccctgaaaaccaaacacttcgtaaagattacgaaaagacattcaagaaatatcagggcctggtggtcaaacaggagcagttactgagggtggcattgtatctgctgttgaacttagccgaggacacacggacggaactgaagatgaggaataagaatatagttcacatgctcgtgaaggctctggaccgtgacaacttcgagctgctgattctggttgtgtcattccttaagaagttgagcatctttatggaaaataagaacgatatggtcgagatggacattgtggagaagctagtcaaaatgattccgtgcgaacatgaagatctgttgaatataaccctgagactcctgctgaacttgtccttcgacaccggactcaggaataagatggttcaggttggattgctgcctaagctcaccgccttgctggggaacgacaactacaagcaaatcgcaatgtgcgttctgtaccacatctcgatggatgaccgcttcaagagcatgtttgcttataccgactgcattcctcagctgatgaagatgttgttcgagtgttctgatgaaagaatcgatctagagctgatcagtttttgcatcaaccttgccgcaaacaagcggaacgttcagttgatctgtgagggcaacggcttgaaaatgcttatgaaaagggcgttgaaattcaaggacccccttttaatgaaaatgattagaaatattagtcagcacgatggtccaaccaaaaatctgtttatagactatgtgggagacttggcggctcaaatttcaaacgacgaggaagaggagttcgttatagagtgcttaggcacattggcgaacttgacaatacctgacctagattgggaactggtgctcaaggagtacaagctggtgccgtatctgaaggacaagctgaaacccggagcagccgaggatgacctggtgctcgaggtggtaattatgattggtaccgtttccatggacgatagctgcgctgcactgctggccaaatcaggcatcattccagccctcattgaactgctcaatgctcagcaggaagacgatgagttcgtatgccagataatctacgtcttctaccagatggtgttccatcaggctacacgggacgtgattattaaagagactcaggccccagcttatctcattgatctcatgcacgacaagaacaatgagattagaaaggtgtgtgacaatacacttgacatcatcgcggagtacgatgaggagtgggccaaaaaaatacagagcgagaagtttagatggcacaactcacagtggctggagatggtggagagtagacaaatggatgaaagcgaacaatatctgtacggagatgatcgaatcgaaccttacatacatgagggggacatccttgaaagaccggatctcttttacaacagtgacggcctcatcgcatctgagggcgcaatttctcccgatttcttcaatgattatcatcttcagaacggtgatgtagtcggccagcattctttcccaggctcactgggcatggacggctttggtcagcctgtggggattctcgggagaccagccaccgcatatgggtttcgtcccgatgagccttactattacggctacggatcctag

SEQ ID NO: 227939 - DNA, 2145 bp, Artificial Sequence
  Description of Artificial Sequence: Synthetic coding sequence
atgtctatagctttgggaaacacttaccgcaggagtctcagcgactctgagacagtatctgtgctgcaggcatccctgtgcgaggagaaaaaagagaaatctagcaaacccaaggatcctcctccattcgaaggcatggagatcgacgaagtcgccaacattaacgacatggacgaatatatcgaactcctatatgaggatatccctgacaaggtacgcggttctgcattgattttgcaacttgccaggaatcccgacaatctggaggagcttttgctgaatgaaactgcactcggtgcactggctcgcgtgctccgcgaggattggaagcagtcggtagaactggcgactaacattatttacatttttttttgcttctcgagcttctcccagttccatgggctgatcacccactataaaatcggagctctctgtatgaatataattgatcatgaactgaaaagacacgagctatggcaggaggagctgtctaaaaaaaagaaggcagtggacgaagaccctgaaaatcagacactgcgcaaggactatgagaagacctttaaaaaataccagggtctcgtcgtgaagcaagaacagctccttagggtcgctttgtacctcctcctcaatctcgcagaggatacccgaaccgaactgaagatgcggaacaaaaacattgtgcatatgctggtgaaagctctggatcgtgacaacttcgagctgctgatcctggtcgtgtcctttttgaagaagctgagcatattcatggagaataagaatgacatggtggaaatggacattgtcgaaaagctcgtgaagatgataccgtgtgaacacgaagacctgttgaatatcacactgcgcttgctgctgaatctgtcctttgacacgggacttcgcaacaagatggtgcaggtcggactgcttcccaaactgaccgctctgctggggaatgataattacaagcagatcgcaatgtgcgtgctttatcatatttcaatggacgacaggttcaaatccatgttcgcatataccgattgtatcccgcaactcatgaaaatgctgtttgagtgttcagacgagcggatagatttagagcttatctctttttgcatcaatcttgccgctaataagaggaacgtgcagctgatctgtgaaggaaatggattgaagatgctgatgaagcgcgctctgaagtttaaggaccctttactcatgaagatgataaggaacatttcgcaacacgacggcccaactaaaaacttgtttatcgactatgtaggggatctggcagcccagatctcgaacgatgaagaagaggaatttgtcatcgagtgtttaggtacattagcaaatctcaccataccagacttagattgggaactggttctcaaggagtacaagttagtgccttatctgaaggacaagctaaaaccaggagcagctgaagatgatctggtactggaggtggtaatcatgattggcaccgttagtatggacgattcctgtgccgcactgctggctaaaagcggcatcatcccagcactgatagagctgctcaatgcccagcaagaggatgatgagttcgtctgccagatcatttacgtcttctaccaaatggtgttccaccaagccacccgggatgttataataaaagaaacccaggcccctgcctacctgatcgatctcatgcacgacaaaaacaatgagatacggaaggtgtgcgataacaccctggacattatcgctgagtacgatgaagagtgggccaagaagatacagtcagaaaaattcagatggcacaactcccaatggcttgaaatggtggagtcacgtcagatggatgagtcggagcaatacctctacggtgacgatagaattgaaccgtacatccacgagggagatatcctggagaggccagacctcttctacaacagtgacgggctgatcgctagcgaaggggcaatcagccctgacttctttaacgattaccacctgcagaatggggacgtggtcggccagcactccttccctggaagcttaggaatggacggttttggacagcccgttggaattctaggccgacccgcaaccgcttatggattccggcctgacgagccatactattatggctacggctcgtag

SEQ ID NO: 227940 - DNA, 1485 bp, Artificial Sequence
  Description of Artificial Sequence: Synthetic coding sequence
atgcggaataagaatattgtccatatgctggttaaagccctcgacagggacaactttgagcttctaatcttagtcgtctctttcctgaagaagctctctatcttcatggaaaacaagaacgatatggttgagatggatatagtcgagaagctcgtcaagatgattccctgcgaacacgaggatttactgaacattacgctgagactcctgctcaatttatccttcgataccggtctcagaaacaagatggtgcaagtgggtctgctcccaaagctcaccgcacttttgggcaacgataattacaaacagattgctatgtgcgtgttgtaccatatttctatggatgatcggttcaagagcatgtttgcttatactgattgtataccacagcttatgaagatgctgtttgagtgttccgatgagcggatcgacttggagctaatcagcttctgcatcaatctggcagcaaataaacggaatgtgcaactgatatgtgagggcaatgggttgaagatgctgatgaaaagagcactgaagtttaaagatcccctgctgatgaaaatgattagaaatatttcgcagcatgacgggcctacaaagaacctgtttatagattacgtcggggacttggcagcccagatctccaatgatgaagaggaggagttcgtgatcgaatgcctcgggacgttggccaacttgactatccctgacctcgactgggaactagttctgaaagaatacaagcttgtgccctacctaaaagacaagctgaagcccggtgctgccgaggatgacctcgttctagaggtggtgatcatgataggaacagtgtccatggacgactcatgtgcggctctgttggccaagtctgggatcatccctgccctgattgagttattgaatgcccagcaggaagacgatgaatttgtctgtcagatcatttacgtattctatcagatggtttttcaccaggccactcgggacgtaattattaaggagacgcaggccccagcctaccttattgacttaatgcatgacaaaaacaacgagattcgtaaggtttgcgacaacacactcgacataatcgctgagtacgacgaggagtgggctaaaaagatacaatctgagaaatttcggtggcataatagtcaatggctcgaaatggtggagagcagacagatggacgagtcagagcagtacctttatggtgacgatcggatagaaccttatatccacgaaggagacatcttggaacgacccgacctgttctacaatagcgatggcttaatcgccagcgagggcgctatatcacctgattttttcaatgactaccatcttcagaatggggacgtcgtcggtcagcacagcttccctggctcccttgggatggacggctttgggcagccagtaggcatcctgggacggcctgctaccgcatatggcttcaggcccgacgaaccctattactacggatacggcagttag

SEQ ID NO: 227941 - DNA, 1935 bp, Artificial Sequence
  Description of Artificial Sequence: Synthetic coding sequence
atgaagctgatcaccatactctttctgtgcagtcgcctgctgcttagcctcacgcaggagagccaatctgaagaaattgactgcaacgataaggacctttttaaggcagtcgatgccgctcttaaaaagtataattcgcagaatcagtccaataaccagtttgtcctatatagaattaccgaggccacaaagacggtcggatcagatacgttttactcattcaagtatgagattaaggaaggtgactgccctgtgcagtctggcaagacttggcaggactgcgagtacaaggacgccgcaaaggccgcaactggggaatgtaccgccaccgtggggaaacgatcctctacaaagtttagtgtggctactcagacctgtcagatcactccagccgagggacccgtggtgacagcccagtatgactgtcttggttgtgttcaccccatatccacccaaagcccagacctggaacccattctccgccacgggatacagtacttcaataataacactcaacattcctcactgtttatgttaaatgaagtcaagcgcgctcagagacaggtagttgctggattaaacttcagaatcacctattcaattgtgcagacaaattgctccaaagagaactttcttttcctcacgccagattgcaaatctctgtggaacggtgacaccggggagtgtactgataatgcatatatagatatccaactgcgaatcgccagcttcagccagaattgtgacatctaccccggaaaagacttcgttcagcctcctacgaaaatatgtgtgggctgtcctagagatattccaaccaactcccccgaactggaggaaacactgacccatacgattaccaagctcaacgctgaaaataacgccaccttctactttaagatcgataacgttaaaaaggctagagtgcaggtggttgccggtaagaaatactttatagattttgttgcaagagaaacaacttgctctaaagagtcaaatgaggagctgacagagagctgtgagaccaagaaactggggcagagccttgattgtaatgctgaagtgtacgtggtgccttgggagaagaaaatttacccaaccgtcaactgccagcctctgggaatgatttctctgatgaaaagaccaccaggtttctctccctttaggagctctcggataggggaaataaaagaagagaccaccgtcagtccacctcatacctcaatggcgccagcacaggacgaggaaagggactcaggcaaagagcagggccatacgcgaagacatgactgggggcacgaaaagcaacgtaaacacaatctggggcacgggcacaagcacgagcgggatcagggtcatggccaccagcgtgggcacggactgggacatggccatgaacagcagcatggtttgggacacggccacaagtttaagctagacgacgacctggagcatcaaggtggacatgtgctggatcatggtcacaagcacaagcatggtcatgggcatggtaagcacaagaataaggggaagaagaacggaaagcacaatgggtggaagaccgagcacctggcatcgtcctctgaagatagcacaactccttctgcacagacccaagaaaagaccgagggccctactcctatcccttcactcgcaaaaccgggtgttaccgtgacatttagcgatttccaggattccgacctgatcgccaccatgatgccgccaataagccctgctcccatccaatccgacgacgactggattcctgatatccaaattgaccccaatggtctgtcatttaatccaattagtgacttcccagatacgacgtcccccaagtgcccagggagaccatggaaatccgtgagcgaaatcaatcccactacacaaatgaaggagagctactattttgaccttaccgacggtctctcatag

SEQ ID NO: 227942 - DNA, 1284 bp, Artificial Sequence
  Description of Artificial Sequence: Synthetic coding sequence
atgaaactgattactatcctgtttctatgttctcgtttattgttaagcttgactcaggagtcacagtccgaggaaattgattgtaacgataaagatctattcaaggcagttgacgccgcacttaagaaatataactcccagaaccaatccaataatcagttcgtgctgtatcggataaccgaggccacgaagaccgtcggctccgataccttctattcgtttaaatacgagattaaggagggcgactgcccagtacaaagtggaaagacgtggcaggactgtgaatataaagacgctgccaaagccgctaccggagaatgtaccgctactgtgggcaaacgttctagcacaaagttcagcgtcgccacacagacatgccagataacacccgctgaaggcccagtggtaacagcccagtacgactgcttgggctgtgtccaccctatcagcacacagtcgcccgatcttgagcccatactccgacacggaattcaatactttaataacaatactcagcacagctctctattcatgctcaatgaagtgaaaagagcccagcgacaggtagtggccggtcttaactttcgaataacttactctatcgtccagactaactgtagcaaagagaatttcctgttcttgacacccgattgcaaatcactatggaatggggacacgggggaatgcactgacaatgcatatatagacattcagttgaggatcgcctccttttctcagaactgcgacatatatccgggaaaagatttcgttcagcccccaacaaagatttgcgtcggatgcccgcgtgacatccccacaaactcccccgagttagaagagaccctgacccacacaattacgaaactgaatgcagaaaataatgccaccttttatttcaagatagacaatgtgaagaaagccagagtacaggttgttgccggtaagaaatacttcattgacttcgtggcgcgagagacaacatgctctaaggaatcaaacgaggagctgaccgagagctgtgagactaaaaaactcggacagagcctcgactgtaacgcggaagtctatgtggtgccttgggagaagaaaatatatcctacagtcaactgccagcctttgggcatgattagcctgatgaaaaggccacctgggttctcccccttccggtctagccgcatcggcgagatcaaggaggaaacgacgtctcatctgagaagctgtgagtataaaggacgccctccgaaggctggcgcagaaccagcttccgaacgcgaagtaagctag

SEQ ID NO: 227943 - DNA, 1248 bp, Artificial Sequence
  Description of Artificial Sequence: Synthetic coding sequence
atgaaactgtcactgacccaagagtcacagtctgaggagattgattgtaacgataaagatctgtttaaagctgtcgatgccgcattgaagaagtataatagccagaaccagtcgaataatcagtttgtgttgtatcgcattacggaggccacaaagaccgttggcagcgacactttctacagcttcaaatatgaaatcaaagaaggcgactgccctgtacagtccggcaagacctggcaggattgcgaatacaaagacgctgccaaagcagccaccggagaatgcaccgcgaccgtgggtaagcggagctccactaagttctctgtggcgacacaaacatgccagattaccccagccgagggcccagtcgtgaccgcacagtacgattgtctcgggtgtgtccaccctataagtactcagagtccagacctggagcccatcctacgtcatggaatccaatacttcaataataatactcagcacagctctctctttatgctcaatgaagtaaagcgggcacaaaggcaggtggtggcagggcttaatttcagaatcacttattccattgtacaaactaattgcagtaaagaaaatttccttttcctcacaccagattgcaagagcctttggaatggcgataccggtgaatgtacagacaacgcctacattgacatccaacttcgtattgcatccttctcacaaaattgcgatatttatcccggaaaggatttcgtacagccaccaactaagatttgtgtggggtgcccaagggatattcctaccaattcaccagagctcgaagagaccctgacgcatactatcaccaagctgaacgctgagaataacgcgacgttctacttcaaaatcgacaacgttaaaaaagcgcgtgtccaggtggtggcgggaaagaagtactttatcgactttgtggcaagagaaacaacttgttccaaagaatctaatgaggaacttaccgagtcctgcgagactaagaagctcgggcaaagcttggattgcaatgcggaggtttacgtcgtgccctgggaaaaaaagatatatccgaccgtaaattgtcagcctttggggatgatttcactgatgaagcgacccccaggcttcagccctttccgatcttctaggattggcgagatcaaagaggagactacatctcatctacggagttgcgaatataaaggcaggccacccaaagcaggcgcagaacccgctagtgaacgggaggtatcctag

SEQ ID NO: 227944 - DNA, 1176 bp, Artificial Sequence
  Description of Artificial Sequence: Synthetic coding sequence
atgaaactaattacaattttattcttatgtagtcgactcctcttgtcattgacccaggagagtcagtcagaagaaatcgattgtaacgacaaagatctgttcaaagcggtggacgcagccttaaagaagtacaattcccagaaccaatcaaacaaccagttcgtgctgtaccgaatcacagaggctactaaaacagtgggctcagacacattctactcatttaagtacgaaattaaggaaggcgattgccccgtccagagcgggaaaacatggcaggattgcgagtacaaagacgcagcaaaagctgccacgggggaatgtacagcgactgttggtaaacgctcaagtacaaaattttcagtagccacccagacttgtcagataacacctgcggagggacccgtggtgaccgcccagtacgactgcttgggctgcgtacatccgatctctactcagtcacccgacctcgaacctatactgcggcacggcatacagtacttcaataataatacccagcatagctccctgtttatgctcaatgaagtgaagagggcacagaggcaggacaccggcgagtgcactgataatgcttatattgatatccagctccgaatcgcttcattttcacagaactgtgacatttaccccggaaaagactttgtgcaaccaccaacaaaaatctgcgtgggatgtcctcgagatattcccacaaattcccccgaacttgaggagacattaacacatactatcactaagctcaacgctgagaataacgccaccttttatttcaagatcgataatgttaagaaagcacgtgtgcaggtggttgctggcaagaaatattttattgacttcgtggcacgggagacaacatgtagtaaagaatcaaatgaggagctgaccgagtcctgtgaaacaaagaagttgggtcagagtctcgactgcaacgccgaagtatacgtggtgccgtgggagaaaaagatttaccctaccgtcaattgccaacccctgggtatgatcagcctgatgaaacggccaccaggatttagccctttccgatcatctcggataggcgagatcaaggaagaaaccaccagccacctgcgcagctgtgagtataaagggaggccccctaaggccggagcggagccagcctcagaaagagaggtgtcctag

SEQ ID NO: 227945 - DNA, 306 bp, Artificial Sequence
  Description of Artificial Sequence: Synthetic coding sequence
atggacattcccatctctagtcgagattttcgcggtctccagctggcctgtgtcgcactgggactggtcgccggtagtattatcatcggcatctctgtgtctaaagccgcagctgccatgggaggtgttttcataggcgctgcggtcctgggaagcctcaggatccatccccatccaggggcagaccatggcgagggcaggtcttcgactaatgggaataaggaaggcgcacgttcttctttgtctactgtttctagaaccctggagaaactgaagcctggtactcgcggagccgaagagtgttag

SEQ ID NO: 227946 - DNA, 375 bp, Artificial Sequence
  Description of Artificial Sequence: Synthetic coding sequence
atggacatccctatctcgtccagggatttccgaggactgcaattagcatgtgtggctctgggcctagttgctggttcaataattattggaattagcgtatccaaagccgcagccgcaatgggaggcgtgtttattggtgccgcagtgttaggcttgctgattctcgcatatccctttctgaaagcccgatttaatctcgatcacattcttcccacgatcggaagcctgaggatacacccacacccgggtgccgaccatggggaaggtcggagtagcacaaacgggaataaggaaggcgcaagatccagcctctcaaccgtgtctagaaccttggagaagcttaaacccggtacccgtggcgctgaagagtgctag

SEQ ID NO: 227947 - DNA, 3135 bp, Artificial Sequence
  Description of Artificial Sequence: Synthetic coding sequence
atgaagccgggatgtgccgcagggtcacccggaaatgagtggattttctttagtacggacgagataactacacgctaccgtaatacaatgtccaatggtggactacaacgtagcgtcatactgtccgccctgattctcttacgggctgttactggtttttccggggacgggcgagcaatttggagcaagaacccaaattttactcctgttaatgagtctcaacttttcctatacgacacattccccaaaaactttttctgggggataggcactggcgcactgcaagtggagggatcgtggaaaaaagacggtaagggtcctagtatctgggatcacttcatacatacacatctgaaaaacgtctcctccacaaacggatcaagtgactcctatatctttctagagaaggatctgagtgctcttgactttattggagtgtccttttaccagttcagtatttcatggcctcggcttttccctgacggaatagtcactgtggcaaacgctaaagggctccagtattacagtaccctgctggacgcactggtgcttagaaatatcgaaccaatcgtcaccttataccactgggacttacccctggccctgcaagaaaaatacggagggtggaagaacgacaccatcatagatatcttcaatgactacgcaacgtactgcttccagatgtttggagacagagtgaaatattggataaccatccacaacccctatctggtggcgtggcatggttacggaactgggatgcatgcgcctggcgaaaaagggaatctggccgctgtctataccgttggacataatctcattaaagcccatagtaaggtgtggcacaattacaacacacatttcaggccccaccagaagggctggctctccattaccctcggctcacattggattgagcctaatcggtctgaaaacactatggacatattcaagtgtcaacagagtatggtctcagtcctggggtggttcgctaatcccattcatggcgatggtgactacccagaaggtatgagaaagaagctgttctctgtactgccaatatttagtgaagccgagaaacacgaaatgcgtggtactgcagatttttttgcattctcatttgggcctaacaatttcaagcccctgaacacgatggccaagatgggtcagaatgtgtctctgaatttgcgagaagcccttaactggatcaaactggagtacaataatcctcggatactgatcgccgaaaacgggtggtttacggactcccgagttaaaactgaggatacaacggccatttacatgatgaagaactttctgagccaggtcctccaggcgattcgtcttgatgaaattagagtgtttgggtacaccgcatggagcctcctcgacggctttgaatggcaggacgcctacacgataaggcgtggactcttttatgtcgatttcaacagcaagcagaaagagcggaagccaaagagctctgctcactattataagcagatcattcgggaaaacggtttctccctcaaggagtctactcccgacgtccaaggacagtttccatgtgattttagctggggagtcaccgagagtgtcctgaaacctgagtccgtagcaagctcgccacagtttagcgatcctcacctatacgtgtggaacgccactggtaacaggctcttgcaccgggttgaaggcgtaagactcaagacacgacccgctcagtgcaccgactttgtcaatattaagaaacagctcgagatgctggcccgaatgaaagtgacacattaccgttttgccctcgactgggctagcgtgctgccaacaggaaacttgtcagccgtgaatcgacaggcattaaggtattatagatgtgtggtttccgaagggctgaagctcggaatctcagcgatggtgacactttattacccaactcacgcccacctcgggttacctgaacccctgctacacgcagacgggtggctcaatccctccaccgctgaagcctttcaggcctatgctggcctgtgtttccaggagttgggcgaccttgtgaaactctggatcaccattaatgaacccaaccgcctatccgacatctacaataggtctgggaatgatacatacggcgctgctcacaacctgttagttgcacacgcccttgcgtggcgcctgtacgacagacagttcagacccagtcagagaggggctgtgtcactttcccttcatgccgactgggcagaacccgctaacccatacgccgacagccattggcgcgctgcggagcgcttcctgcaattcgaaatcgcctggttcgcagagccccttttcaagaccggcgactatcccgcagcaatgagagagtatattgcctccaagcatcgtagaggcctttcatccagtgccctcccgaggctcactgaggcagaaagaaggttgctgaagggcaccgtagatttttgtgccctgaaccactttaccacacgcttcgtcatgcacgagcagttggcgggaagccgctatgactctgatagggatatacagttcctgcaggatattacaaggctcagctcaccgaccaggctggcagtcattccttggggagtcaggaagcttctacgctgggttcgccgaaattacggagatatggatatctacatcaccgcctcaggcattgacgaccaggcactggaagacgatcgcctcagaaagtattacctcggaaaatatctgcaggaagtccttaaggcctacctaatcgataaggtcagaatcaaagggtattacgccttcaagttagccgaagaaaagagcaaaccgagattcggtttcttcacttccgactttaaagccaaaagctctatacagttctacaacaaggttataagctcacggggttttcccttcgagaactcctccagtcggtgcagtcagacccaagaaaacactgaatgcaccgtgtgtctgttcctagtccagaagaagcctctgatcttcttgggctgctgtttcttttccactctcgtgctgctcctgtctattgctattttccagcgacagaagagaaggaagttttggaaagccaagaatttgcagcatatccccctgaaaaaggggaagcgagtggtatcatag

SEQ ID NO: 227948 - DNA, 1389 bp, Artificial Sequence
  Description of Artificial Sequence: Synthetic coding sequence
atgggaacacaggcgctacagggttttctgttcctgcttttcctgccgctgctgcagcccaggggagcttccgcgggttccctgcattcacccggactgtcagagtgtttccaagtaaatggcgcagactacaggggtcaccagaaccgaacaggcccaagaggagctgggagaccttgcttgttctgggaccagacacagcagcatagttattcttccgcatccgaccctcacggccgttgggggctcggcgctcacaatttttgtagaaatcccgacggggatgtgcagccttggtgctacgttgcagaaacggaagaggggatctactggcgatactgcgacatccctagttgccacatgccgggttatttgggctgttttgtcgactctggagcccctccagcattgtccggaccttctggcactagcaccaaattaactgtgcaagtctgcttaagattttgcagaatgaagggataccagcttgcgggagtggaggccggttatgcctgcttctgcggatctgagagtgatctggctaggggcagactcgcccctgcaactgactgtgaccagatttgcttcggccacccagggcaactctgcggcggagatggtagactgggcgtctatgaagtgagcgtaggcagctgccagggcaactggactgcccctcaaggtgtgatctacagcccagacttccccgacgaatacggaccagatcgcaactgctcttgggcgctgggacctcctggagcagctctggagttaacattccgtctattcgaactagctgaccctcgcgatcgcctggagcttcgagatgctgccagcggcagtttgctcagggcctttgatggtgctaggcctcctccttcagggcctcttcggctcgggacagctgctctgctactgacgttccgaagcgacgcacggggtcacgcccaaggctttgcgctgacttatcggggtttgcaggacgcggctgaagatcccgaggcacccgaaggttcagctcagactccagcagccccactggacggcgctaatgtgtcatgctcacctagaccaggagctcctcctgccgcaataggtgcacgggtattcagcacggtgactgcagtatctgttctgctcctgttactgttagggctgctgcgcccactacgccgtcgctcttgccttctggccccaggaaaggggcctcccgctcttggagccagccgaggacccaggagaagctgggcggtctggtaccagcagccacggggagtcgccctgccgtgttccccaggtgaccctcaggcagaggggtcagctgcgggatacaggccactgtccgcaagctcccagagcagcctgaggtcactgattagcgccctctag

SEQ ID NO: 227949 - DNA, 1263 bp, Artificial Sequence
  Description of Artificial Sequence: Synthetic coding sequence
atgggcacacaggcgctccagggttttttatttctgctgtttcttccactgctgcagccacgtggggcatcagcaggctccctgcatagtcccggacttagcgagtgttttcaggtgaatggagccgactacagagggcaccagaaccggaccggaccgaggggcgctggcagaccctgtctattctgggaccaaacccagcagcatagttattcatccgccagcgatccgcacggcaggtggggactgggcgcacacaatttctgccggaatccggacggagatgtccagccatggtgttacgtcgccgaaacggaggagggaatttactggaggtactgcgatatcccaagctgccatatgcccggatatctcgggtgtttcgtggactccggggctcctccggcactttcgggtcctagcgggacttctacgaagctcaccgtgcaggtctgtctgcgcttttgtagaatgaaaggctaccaactcgccggtgttgaggcaggctacgcctgcttctgtggctccgaaagtgacctggcccgagggcgacttgcccctgctaccgattgcgaccagatatgttttggacatccgggacaactctgtgggggagatgggaggctcggcgtgtacgaggttagtgtaggatcctgccagggcaactggactgccccacaaggagtcatttactctccagatttccccgatgaatatgggccagataggaattgttcctgggccctgggtccaccaggggcagccctggaacttacgttcaggttgttcgagctggctgacccacgagacagattagagctgagggacgcggctagcgggtcactgcttcgggcatttgacggagcacgacccccaccctcaggccctctgcgcctggggacagcagctctgctcttgacctttcgctccgacgctcgtggacatgctcaggggttcgctctgacgtacagaggtctgcaggacgcggcagaggacccagaggcccctgagggctccgctcagacgcccgctgcaccgctcgatggggcaaatgtgtcatgctcccctcgcccaggggctcccccagcagctattgggggagccgtctgctggctgagagagaagggccctagaaggtggggactgcctggggctcccggagaagccggtctctgcggaacaaactctccagaaggatggccatgtcctgcgcctccaggcacaccccgactaagagtcctccccagggcaacaggactctag

SEQ ID NO: 227950 - DNA, 1272 bp, Artificial Sequence
  Description of Artificial Sequence: Synthetic coding sequence
atgggaactcaggcactgcaggggtttctgtttttgcttttcttgcccctgctgcagcccagaggggcttctgctggtagcctgcattccccagggttgagcgaatgctttcaggtgaatggggctgactacaggggccatcagaacagaaccggccctcggggtgcgggaaggccatgtctgttttgggatcaaacccaacagcattcctactcttccgctagcgacccacatggtcgttggggactgggcgcacataacttttgtcggaacccagacggtgacgtccaaccctggtgttatgtcgcagagaccgaagaaggaatttactggaggtactgcgatataccctcatgccacatgcccggatacctgggatgcttcgtcgacagcggcgcacctccggctctatccggtccttctggcactagtaccaaactcactgtgcaagtgtgtctcaggttctgtcgcatgaagggttatcaactgtgcggtggagacggtcgattgggtgtctatgaagtaagcgtaggctcatgccaaggaaactggaccgcacctcagggcgtgatatatagtcctgatttcccagacgaatatggtcccgatcgaaattgctcttgggccctgggaccccctggggcagcactggaacttacttttagactgttcgagttggcggaccctcgagatcgcctcgagttgcgcgacgctgcttccggttctttgcttcgggctttcgacggtgctagacctccaccttctgggcctctgagactgggcaccgccgctctgttgctgacctttcgctcggacgccagaggtcatgctcaagggttcgcactcacgtatagaggattgcaggacgcagctgaagaccccgaggcaccagaggggagcgctcaaacaccagccgctcctttagacggcgctaatgtttcctgctcacccaggccaggtgcacccccagcagccatcggagctcgggtgttctccaccgtgactgcggtttcagtgctgttgttgctgctcctgggtttgctccgtccgctgaggagacgatcctgcctcctagcacccggaaaaggtccccctgcacttggagcctctagagggcctaggcgctcctgggcagtctggtatcagcaacccaggggcgtagcgttgccatgcagcccgggagatccccaagcagagggcagcgcagccggatacaggccactgtccgcctccagtcagagctcattaagatcactgatatcagccttatag

SEQ ID NO: 227951 - DNA, 1146 bp, Artificial Sequence
  Description of Artificial Sequence: Synthetic coding sequence
atggggacccaggccctccaaggatttctcttcctcctatttttgcccctcctgcaaccgcgtggggcttcagccggatcactacactctccgggactgagcgagtgttttcaggtcaatggcgctgactaccggggacaccagaaccggaccgggccacgcggagccggaagaccttgcctcttttgggaccagactcaacagcatagctactcatccgctagcgatccacacgggcgatggggtttaggcgctcacaacttttgtcgcaacccagatggtgacgtccagccttggtgctacgtggctgaaacagaggaaggaatctactggcgttattgcgatattcctagctgccacatgccgggatatttagggtgtttcgttgactctggagctccaccagccttgagtggaccaagcgggacatccactaagttaaccgtgcaggtttgtttgcgcttttgccggatgaagggataccagctatgtggaggagacggccgacttggggtttacgaggtttctgtcgggagctgccaaggaaactggactgctccccaaggcgtaatatactctcctgatttccctgacgaatatggtcccgataggaactgttcttgggccctgggtccaccaggtgctgccctggagcttacgtttagactgtttgagcttgctgacccaagggaccgtttagagctcagagatgccgcttctggctcacttttgcgggcttttgacggggctaggccgccacccagcggaccgttgcgcctcggcaccgccgctttgctattaacctttcgctcggacgccagagggcacgctcaaggttttgctctgacctacagagggctgcaggacgcagctgaggaccctgaggccccagaggggtccgcccagactcccgcagcccctctggatggggctaacgtgagctgcagccccagacctggggcaccaccggcagccataggaggggcagtgtgctggctcagagagaaaggccctaggagatggggcttgccaggcgcacctggggaggccggactctgtggaactaattcacccgagggctggccatgtccagcacctcccggaacgcctcggctgagagtcctgccccgtgctacagggctgtag

SEQ ID NO: 227952 - DNA, 2211 bp, Artificial Sequence
  Description of Artificial Sequence: Synthetic coding sequence
atgggcaacccagagaatattgaggacgcttatgtggcggtcatcaggcctaagaacacagccagcctgaactccagagagtatcgcgcaaaaagttatgaaatcttgttgcacgaggttcctatcgagggtcagaaaaaaaaaaggaagaaagtgttgcttgagaccaaactgcaggggaactctgagatcacacaaggtatacttgactacgtggtagaaactaccaagccaatcagcccagcaaatcagggtattagaggaaagcgggtggtcctgatgaagaagtttccactcgacggagagaagatgggaagagaggcatccctgtttattgttccctccgtggtcaaggacaacacaaaatatacctatactcccggatgcccaatcttctattgcctccaggatatcatgagggtttgctctgagagttcaactcatttcgctaccctgactgcacgcatgttgattgcgctggacaagtggctcgatgagaggcacgctcagtcccactttatcccggctttatttagaccttctcctttggaaaggatcaagacaaacgttatcaatcccgcatacgctactgaatccggacagaccgaaaactccctacatatgggatacagtgcactggagattaaaagtaagatgctcgcactggagaaagctgatacctgcatatacaatcccctgtttgggtctgacctacaatatactaatcgggttgacaaagtcgtcatcaacccctacttcggcctgggagcgccagattacagtaagattcagatcccgaagcaggagaaatggcaaagatccatgtcttcagtgacagaagataaggagagacagtgggtggacgactttccactgcaccgctctgcttgtgagggggactccgaactgctcagtcggttattgagcgagcggttttcggtcaaccagctggattctgaccactgggcccctatccactacgcatgctggtacgggaaagtagaagccactagaatactgttagaaaagggaaaatgcaatccgaatctgttaaatggacagctctcctcgccattgcacttcgcagccggtggcggacatgcagaaatagtgcagatactcctcaatcacccagagacggatcggcacataaccgatcagcaggggcgaagccccctgaacatctgcgaggagaacaaacagaataattgggaggaagctgccaagctactaaaggaagcaatcaacaagccatatgaaaaagtgagaatttaccggatggacggtagctacaggtctgtagagctgaagcacggcaacaataccaccgtccagcagattatggagggcatgcgtctgtcacaggagacacagcagtattttactatctggatctgtagcgagaacttatcactgcagctcaaaccttatcacaagccgcttcagcacgtgagagactggccagagattctggccgagctcaccaacctggacccacagagggagacacctcagctattcctgcggagggatgtccgcctgcccctggaggtagagaaacaaattgaggatcccttagccatcctaatcctgttcgatgaggccagatataacctattaaagggattctacaccgcacccgacgccaagcttataacactggcgtctcttcttctgcaaattgtctatggtaactacgagagtaagaaacacaagcagggatttctgaacgaagagaatcttaaatccatagttccagtgaccaagctgaagagtaaggcaccccactggactaatcggatcctgcacgagtacaagaatctctctaccagcgagggcgtgtcaaaggagatgcatcacctgcagcggatgtttctgcaaaattgctgggaaattccaacgtacggcgcagccttctttacagggcagatattcaccaaagcctcacctagcaatcacaaggtgatccccgtctacgtgggtgtgaacatcaaaggactgcacctccttaatatggaaaccaaagcattgctcatatcactgaagtacgggtgcttcatgtggcagctcggggacactgatacatgttttcaaatacactcaatggagaacaagatgagctttatcgtccacacaaagcaggccggactggtggtgaaactcctgatgaagctgaacgggcagttaatgcctacggagcggaacagctag

SEQ ID NO: 227953 - DNA, 3624 bp, Artificial Sequence
  Description of Artificial Sequence: Synthetic coding sequence
atggacctacacatgatgaactgcgagctgcttgccacatgcagcgcccttgggtatcttgagggagacacttaccacaaggagccagattgtctcgagtccgtgaaggacctgattcgatacttgcgccacgaggatgaaacccgggatgtgcgccagcagcttggcgctgcacagattctgcagtcagacctgctgccaatcctgactcagcaccaccaggataagcctctgtttgacgctgtgattcgactgatggtgaacctcactcaacccgctctactctgcttcgggaacttacccaaagagccaagctttcggcaccactttttgcaagtcctgacctacctgcaggcatataaggaagcattcgcctcagagaaggccttcggggtgcttagtgaaaccctgtacgagcttctacagctgggttgggaagagcggcaggaagaggacaacctgttgatcgagcggatcctgctgcttgtaaggaatatactgcatgttccagctgatctggatcaggagaagattgatgatgatgcaagtgcccacgaccagctgctctgggccatccatctgagcggtttggatgatctcttgttattcctggcaagcagcagcgcagaagagcagtggtccttacacgtgttagaaatagtttccttgatgtttagggatcagaatcccgaacaacttgcaggggtgggacagggccgactggcccaggaacgcagcgcagacttcgccgagctggaagttctgcggcaaagggagatggccgagaagaagacgcgagcacttcagcgaggtaataggcatagcagattcggagggtcctacattgtgcagggcctcaagtctatcggtgagagagacctgattttccataaaggactgcacaatctgcggaactattcttccgatctcgggaagcagcctaaaaaagtccccaaacgtcgacaggcggcacgcgaactgtctattcagagacgctcggcgctgaacgtgcgtctcttccttagggatttctgctctgagtttctggaaaattgctacaacaggctgatgggcagcgtgaaagatcatctactcagggaaaaggctcagcagcacgacgaaacgtattatatgtgggcattggccttcttcatggcgttcaatagagccgcatctttccgcccaggattagttagcgaaaccctgagcgtgcgaacttttcattttatcgagcagaatcttacaaattattacgaaatgatgttgacggacagaaaggaagccgctagttgggctcgcagaatgcatctagctctgaaggcgtaccaagagctgctcgcaacggtgaacgaaatggatattagtccagacgaagcagttcgtgagagttcaaggatcattaagaataatattttttatgtgatggagtaccgagaactattccttgcactgttcagaaagtttgatgagagatgtcaacctcgcagtttccttcgcgatctggtggagaccacccacctgttcctgaaaatgctggagagattctgtcggagccgcggtaatctcgtggtgcagaacaagcaaaaaaagcgtcgcaagaaaaagaaaaaggtacttgaccaggcgattgtttcgggaaatgtgccatccagccccgaggaggtggaagccgtgtggcctgccctggctgaacagctgcagtgctgtgcgcagaatagcgagctctcaatggattccgttgttccattcgatgccgcatccgaggttccggttgaagaacagagagcggaggccatggtgagaatccaggactgcctacttgccggacaggcaccccaagccctgacgctgctgcgttctgcccgagaggtttggccagaaggcgatgtctttggttcccaggacattagccccgaggaagagatacagctcctgaaacagatattaagcgcacccctgcctcgacagcagggtccagaagagcgaggcgcagaggaagaggaggaggaagaggaggaagaagaagaagagctccaggtggtacaggtgtcagaaaaagagttcaatttccttgactatctgaagagattcgcttgttctacagtggtgagagcttatgtgctgctcctgaggagctatcagcagaactctgctcacacgaatcactgcatagtaaaaatgctccacagactggctcatgacctcaaaatggaagccctattgtttcagctgtcagttttttgcttgttcaacagactgttgtctgaccctgccgctggggcttataaagaactggtgacattcgctaaatatattctaggaaagttctttgccctggccgcagtaaatcagaaggctttcgtggaactgctgttttggaaaaacaccgctgtggtaagggagatgaccgaaggatacggcagcttggacgatcgcagctcttctcggagggcccctacgtggagcccagaggaggaggcgcatttgcgcgaactgtacctcgcaaataaggacgtcgagggtcaagatgtggtggaggccattctggcccatctgaatacggtgcctcggaccagaaaacagattatccatcatttagtacagatgggattggctgacagtgttaaagattttcagcgtaaaggtacccatatcgtgctgtggaccggagaccaggagctggaattgcaaagactttttgaagagtttcgcgattcagatgacgtgttgggacatattatgaagaatattactgcaaaacgaagcagggctcgtatcgtagataaactgctggctttgggcctagtcgccgaaagacgcgaactgtataaaaaacggcagaaaaagctggcttcttccattctgcctaatggagctgaatctcttaaggatttttgtcaggaggacctagaggaagaggagaatctccccgaagaggatagtgaggaagaggaggagggcggatcggaagctgagcaagtgcagggctccctcgttctgagtaatgaaaacctggggcagtccctacatcaggaagggttcagcattccgctcctgtggttacaaaactgtctgatccgggctgcagatgatagagaggaggacgggtgctctcaggccgtcccattggtaccactgacagaagagaatgaagaagctatggaaaatgaacagttccagcagcttctaaggaaactaggggtccggcctccagcgagcggacaggaaacattctggcgcattccagcgaaattgagccccacgcagctgagacgcgcagcagcttcattaagtcaaccggaagaggaacaaaagcttcaacccgagttgcagcctaaggtgcctggcgaacagggcagcgatgaggagcattgtaaggagcatagggcccaggccttgcgagccttgctgttggcccataagaagaaggcaggacttgcctctcccgaagaggaggatgcagttggcaaagagccattaaaagccgctcctaagaaacggcagttattagattccgacgaggaacaagaagaagatgaaggacggaatcgagccccagaactcggggcaccaggaatccagaagaagaaaagataccaaattgaggacgatgaagatgactag

SEQ ID NO: 227954 - DNA, 1539 bp, Artificial Sequence
  Description of Artificial Sequence: Synthetic coding sequence
atgcacacacctgatttcgctggtccggacgacgcccgtgccgtagatatcatggatatctgcgaatcaattctcgagcgcaaaaggcacgattctgagaggagtacgtgctccatactcgaacagaccgacatggaagccgtggaggcacttgtgtgcatgagctcctggggccagcgctcacagaaaggcgacttactaagaattcgcccattaacacccgtctcggacagtggtgatgtgactaccactgtccatatggatgctgccacccccgagctaccgaaggatttccactcactttccacactgtgtatcactcctccacagtccccggatctggtagagccgtctaccaggaccccagtctctcctcaggtgaccgatagcaaagcctgtactgctacggatgtgctgcagtcctccgctgtggtggcacgcgctctgtccgggggagctgagcgaggcttactcggcttggagccagtgcccagcagtccatgcagagctaagggcacaagtgtaatccgccacacgggcgaatcccccgcagcctgctttccaacaatacagactccggactgccgtttgtccgactccagggaaggggaagaacagctgttaggccattttgagacgctccaggacactcacctcactgactcacttctcagcactaacctggtgtcttgccagccttgtcttcacaagagcggaggactcctgttgacagataagggtcagcaggctggttggcctggggctgttcaaacatgttcccccaagaattacgagaacgatctgcctagaaagacaacaccgttgatatctgtgagcgttcccgctccccctgttctgtgccagatgattccagttaccggtcagtcctctatgctgcccgcttttctcaaaccccctcctcagctgtctgtgggcaccgtgagacccatcctcgctcaggcggcacctgctccccaacctgtgttcgtcgggccagcagttccacagggggctgtgatgttagtgctgcctcaaggcgcactcccccctcccgcaccatgtgccgcaaatgtgatggctgcgggaaataccaaactactccctttggcaccagcacctgtctttatcactagctcacagaactgtgtgccgcaagttgatttttcaaggagacgcaattacgtgtgttccttccccggttgtagaaagacctattttaagagttcccatttgaaggcacatctaagaactcacactggggagaagcccttcaactgttcatgggatggttgtgacaagaagttcgctcgatcggacgagctctctcgccaccgcaggacacacacaggcgagaaaaagttcgtttgtcccgtgtgcgatcgcaggttcatgcgttcggaccatttgacaaagcatgcccgaaggcacatgacaacaaagaagatcccgggttggcaggctgaagtgggaaagctaaacaggattgcaagcgccgaaagtcccggttcccccctggtgagtatgccagccagtgcttag

SEQ ID NO: 227955 - DNA, 1488 bp, Artificial Sequence
  Description of Artificial Sequence: Synthetic coding sequence
atggacatctgcgaaagcatacttgagagaaaaagacatgattccgaaaggtctacttgctccatcctggaacagactgacatggaagcggtggaggcactggtttgcatgagctcatggggccagagatctcagaaaggtgacttgctgcggatcaggcccttgaccccggtttccgactccggagacgtcactaccactgtgcatatggacgcagctacacctgaactgcccaaggacttccatagccttagtactctatgtatcacgccccctcagtcccctgatttagtggagccatcaacaaggacaccagtgtcccctcaggtgaccgattccaaagcatgcaccgctacagacgtgttgcaaagctccgccgtagtagctcgggctctgagcggtggagcagaacgtggtctcctaggattggagcctgttcccagcagcccttgccgggcaaagggcacatcggtaataaggcacactggcgagtccccggctgcctgttttcctaccattcaaactcccgactgtcgccttagtgattctagagaaggtgaggaacagcttctagggcacttcgagaccctgcaggatactcacctgactgatagtctgctcagtaccaacctcgtgtcatgtcagccatgcttacacaagagtggcggactactgttaacagacaagggccagcaggcgggttggccaggagccgtgcagacctgcagccctaaaaactacgagaacgacctgcccagaaaaacaacaccacttatctccgtgtctgtgcctgcgccacccgtactgtgtcagatgattccagtgaccgggcaaagtagcatgctgccggctttcctcaagcccccacctcagttgagcgtgggtaccgtgcgacccatactggcccaggcagcacctgccccacagccagtcttcgtgggcccagccgtgccacagggagccgtgatgctggttctcccacagggcgcacttccaccacctgcaccctgcgccgctaatgttatggctgcagggaatacaaaactcctgcctctggcgcctgcgcctgtgtttatcacctcttctcaaaattgtgtccctcaggtggatttcagtcgacggaggaattacgtctgctccttcccagggtgccgcaagacctatttcaagagctcccacttgaaggcacatctgagaacacacactggagagaagccatttaattgttcttgggatggctgcgacaagaagttcgctagaagtgacgagttgtcccgccacagacgaactcacaccggggagaaaaagttcgtgtgccctgtatgcgatagaaggtttatgaggtctgatcatctaacaaaacacgcgagaaggcacatgaccacaaaaaaaatacctggctggcaggcggaagtaggtaaactgaatcgtatcgctagcgctgagagtccaggctcccccctcgtatccatgcccgctagcgcttag

SEQ ID NO: 227956 - DNA, 1488 bp, Artificial Sequence
  Description of Artificial Sequence: Synthetic coding sequence
atggacatttgtgaaagcatcttggagcgcaaaaggcacgactctgagagatcgacttgtagcattctggaacagaccgacatggaggccgtggaagcacttgtgtgcatgagctcctggggccagcggtcacagaagggagatttattaagaattcgacctctgacccccgtcagtgactcaggcgatgttaccacaacagtacacatggatgccgcaacaccggagcttcccaaggattttcattctttatccaccctgtgtattaccccacctcagagtcctgatctggtggagcctagcactcggactcctgtgtctccgcaggtcacggactcaaaagcctgcacagcaacagatgtactgcagtcctccgccgttgtggctcgggcactttccggcggagcggagagaggcctcttgggattggaacctgtcccatcaagcccttgtagggccaaggggaccagcgttattagacacacaggcgagagtccggctgcctgcttccccacgatacaaacccccgactgcaggctgtccgattcccgggagggggaggagcagctgctgggacacttcgaaacccttcaagatacacatcttaccgattccctgttgtccacaaacctagtaagttgccaaccctgtcttcataaaagtggtggactcctcctaaccgataaggggcagcaggcgggatggccgggagctgttcagacatgcagtcctaagaattacgaaaatgatttgcctcgtaagaccactcccctcatttcagtgtccgtacctgcacctcccgtgctatgtcaaatgattccagtgacagggcaatccagtatgctcccggcattcctgaagccaccgccacagctgtcagtggggaccgtgcgtcccatcctggcacaggctgcacccgcaccccagcctgtatttgtcggcccagcagtgccgcagggggcagtaatgctggtcctacctcagggggcactgccccctccagctccttgtgctgccaacgtaatggctgctggcaacactaagctgctgccattagcccctgcgcctgtgtttataacaagctctcaaaattgtgtaccacaagtggattttagtcgcaggagaaattacgtgtgtagctttcctggctgccggaagacctactttaaaagtagtcacctgaaggcccatctccgcacccataccggcgaaaaaccgtttaattgtagctgggacggctgcgacaaaaaattcgccaggtcagatgagctatctaggcatcgacgtacacacactggcgagaagaaatttgtgtgccccgtgtgtgacaggcgcttcatgcgtagcgaccacctgacaaagcacgctcgcaggcacatgacaacaaaaaagattcctgggtggcaggcagaagtgggtaagctaaaccgcatcgcttcagccgagtcacctggctcgcctctagtgagtatgcctgcctctgcttag

SEQ ID NO: 227957 - DNA, 1209 bp, Artificial Sequence
  Description of Artificial Sequence: Synthetic coding sequence
atttccgtgcatcttatgcgaaagcatgtgaaaaatattaacactttcgaaaaccgcatgttaatgctcgatggtatgcccgcagttcgagtcaaaacagagctgcttgaaagcgagcagggatcccccaatgtgcataactaccctgatatggaagccgttccactcctcttaaataatgtcaagggggagccccctgaggactcattgtccgtagaccatttccaaactcagaccgaacccgtggacttgagtatcaataaggcccgtactagcccaacagctgtatctagctccccagtcagcatgacagccagtgcctcttccccatccagcacaagcacctcttctagctcatcgagcaggttggccagctcgccaaccgttatcacatctgttagttctgcatcctcctcctccaccgttctgacgcctggacctctggtggctagcgcctccggtgtcgggggacagcaattcttgcacattattcacccagtgccaccctccagccctatgaacctgcagtctaacaagctctctcacgtccatcgaattccggtcgtagtgcaatctgtgcccgttgtgtacacggctgtgagatcacctggcaacgtgaacaatacaattgtcgtgccacttctggaggatggtcgcggacatggtaaggctcagatggacccgagaggtctgagccccaggcagtcaaagagcgattccgacgacgacgatttgccgaacgtcaccttagactctgtgaacgagacgggaagtaccgccctgtctatagccagggctgttcaggaggttcacccatcccccgtctctcgggtgcggggaaaccgaatgaataatcaaaagtttccttgtagtataagccccttctcgatcgagtctacacgtcggcagcgtaggtccgagtccccagacagcaggaagcggagaattcacagatgcgattttgagggatgtaataaagtctacacaaaatctagtcatctgaaggcacatcgtcgcactcacacgggtgagaaaccctacaaatgtacatgggaaggttgcacttggaagtttgctagatcagatgaactaactcgtcattaccgcaagcacaccggggtcaagccatttaaatgtgcagattgcgatcggagctttagcagatctgatcatcttgccctccatcgcagaagacatatgctggtttag

SEQ ID NO: 227958 - DNA, 1209 bp, Artificial Sequence
  Description of Artificial Sequence: Synthetic coding sequence
atgaatatacacatgaagcggaaaacaattaaaaacatcaacacgttcgagaaccgtatgctgatgttagatggtatgcccgctgtgcgggtaaaaacggaattgctggaaagcgaacagggttctcccaacgttcataactaccccgacatggaagccgtgcctttgcttctcaacaatgtgaagggcgagcctccagaggacagcctgtctgttgatcatttccaaacacagacagaacccgtcgatctgagcatcaataaggcacgcacttcacccacagctgtctcctcttccccagtgtctatgacagcgtctgcttctagtcctagtagcacctcaacttcttccagctcctcgtcaagactggcatcaagcccaactgttatcacatctgtgtccagtgcatctagttcatccactgtcttgactccgggaccacttgtcgctagtgcctcgggggtgggaggtcagcaatttctgcacattatccaccccgtacccccaagcagcccaatgaatcttcagtcgaataagctgagtcacgtacaccggattcctgtagtggttcagtcagttcccgtcgtgtacaccgcggtacgttcaccaggtaacgttaataacacaattgtagtgccactgctggaggatggcaggggccacggaaaggcacaaatggaccccagaggactgagtcccagacagagtaagtccgattccgacgatgatgatctgcccaacgtgacccttgactccgtgaatgaaaccggaagtactgctctgtctatcgccagagcagtccaggaggtacacccatcaccagtgtcccgagtgcgcggaaatcgtatgaacaaccagaaatttccgtgctcgatatctcccttctcaatagagagtacgaggagacaacggcgaagcgaatctccagactcgcggaagagaaggattcatcgctgtgacttcgaagggtgcaacaaggtgtacaccaagtcgtcccacttgaaggctcacaggaggacacacacaggagagaaaccctacaagtgcacatgggaaggctgcacatggaagttcgcacgtagcgacgaactgaccaggcattacagaaagcacaccggggtcaagccattcaaatgcgctgactgcgacaggtctttttcgcggagtgatcatcttgctttgcacagacggcgacacatgctggtttag

SEQ ID NO: 227959 - DNA, 1209 bp, Artificial Sequence
  Description of Artificial Sequence: Synthetic coding sequence
atgaacatccatatgaagaggaagacaatcaaaaatattaataccttcgaaaacagaatgctgatgctggatgggatgcctgccgtacgcgttaaaaccgagcttctggagagcgagcaggggagtccgaatgtccataattatcctgatatggaggctgtgccattgctactgaacaacgtcaaaggagagccgcctgaagactccctgtcagtggaccactttcaaacacagacagagccagtggacctgagcattaacaaggctaggaccagtccaactgcagtgtcctcctctccggtgagtatgaccgcatctgcttcttctccatcctcaactagcaccagctcctccagttcctccaggctcgctagttctccaaccgtcatcacatccgtatcttccgccagtagctccagcaccgtcttaactcccggaccgctggtcgcttcagcctctggcgtgggaggccagcagttcctgcatataattcatcctgtgccaccatcgtccccaatgaacctgcaatctaacaaacttagccacgtgcatcggatacccgtggtcgtgcagtctgtgccggtcgtgtatactgccgtacgatccccagggaacgtgaacaacaccatagttgttcctctcctcgaggatggcagaggccatggtaaagcacaaatggatcccagaggattgtctcctcggcaaagcaagtctgattccgatgatgacgatctacccaatgttactctggacagtgtcaatgagacgggtagtaccgccttgagtatcgcaagggccgtccaagaggtgcacccctcaccggtcagccgcgtgcggggaaatcggatgaacaaccagaagttcccctgttctatctctcccttttctatcgagtcaacgcgccgacagaggcgaagtgaatcacctgactcacgcaagagacgcattcatcgctgtgacttcgaaggctgcaataaggtgtatacaaagagcagtcacctgaaggcacatcgcagaacccacacgggcgaaaaaccctacaaatgtacctgggagggctgtacatggaagttcgcccgaagcgatgagctgaccagacactatcggaaacacactggcgtcaagccttttaagtgtgcagattgcgacagatccttctctcggagcgaccatctcgcattgcatagaagaagacacatgttggtatag

SEQ ID NO: 227960 - DNA, 867 bp, Artificial Sequence
  Description of Artificial Sequence: Synthetic coding sequence
atggcggctgccgcatatgttgaccacttcgccgctgagtgcctggtctcgatgtcctcacgcgcagtagtccacggtcctcgggaaggaccggagtcaaggcctgagggcgcagcagtcgctgccactccgacacttcccagagtggaggaacggcgagatggcaaagatagcgctagcctgtttgtcgtcgcaagaatcttagccgacctcaatcagcaagccccagcccctgctcctgccgaacgacgggagggagctgccgcacgcaaagcccgaacaccttgtaggcttccaccgccagctccagaaccaacgtccccgggtgccgagggagctgcggctgcaccaccatccccggcatggagtgagcctgagccagaggccggactggagcctgaaagggagcctggtccagctggctcaggtgagcctgggctgcgacagcgcgtcaggcggggacgctctagagcggatctcgaatcccctcagcgaaagcataaatgtcattatgctggatgtgagaaagtctacggcaagtcatcccatctgaaagctcacctgcggacccacacaggagaacgcccttttgcatgcagctggcaggactgtaataagaaattcgctcgcagtgacgagttagcccgacattacagaactcacactggggaaaagaagttttcctgtcctatctgcgagaaacgatttatgcgttcagaccaccttaccaagcatgccagacggcatgcgaactttcaccctgggatgctgcaaagacgcggaggcggatcccggaccggaagtcttagtgattacagccggagcgatgcctcgagccccacaatatcgcctgcctcgagcccctag

SEQ ID NO: 227961 - DNA, 1251 bp, Artificial Sequence
  Description of Artificial Sequence: Synthetic coding sequence
atggtagaccacctcctgcccgtggacgagaatttctcttctcctaaatgtcctgtggggtacttaggagaccggttagtggggagaagggcataccacatgctgccatcccccgtttcggaagatgacagcgacgcctcttctccttgcagttgttccagtccagattctcaggccctttgctcatgctatggcggtggactgggaaccgagtcgcaagattcgatcctggactttctgctgagccaggcgaccctgggaagcggtggaggatctgggtcatctatcggagcgtcaagcggaccagttgcttggggcccatggcggcgagccgcagcccctgttaagggggagcacttttgcctgcccgagtttccgctcggggaccctgatgacgtcccccgaccatttcagccgaccttggaggaaatcgaagagtttttggaagaaaacatggaacccggagtgaaggaggtgccggaaggaaattctaaggacttggatgcatgcagtcagctctcggctggtccacacaagtctcacctgcacccgggtagctctggacgggagcgctgcagccctcctccaggcggagctagcgcaggcggagcgcagggtccgggtggcggtcccacgcctgacggacctatacccgtactgcttcagatccagcccgtccctgtgaaacaagagagtggaacaggcccagcatctccgggacaagcacctgagaacgtgaaagttgctcaactcctggtgaacatacaaggtcaaacatttgccctggtgcctcaggttgttccaagctctaatttgaacctgcccagcaagtttgtacggattgctcccgtgcctatcgccgctaaaccggtaggatccggcccactaggccctggccctgcaggtctgcttatggggcagaagtttcctaaaaatcccgcagcggagttaatcaagatgcacaaatgtacattccctggctgttcaaaaatgtatacaaagagctcacatctgaaagcacacctccggcgtcacactggtgaaaagccatttgcttgcacctggccaggttgcggctggagattttcgagaagtgacgagctaagtcgccatcgacgctcccactcgggagtgaagccgtatcagtgcccggtctgtgaaaaaaaatttgctaggtcggaccacctctccaagcacatcaaagttcatcggttcccgcgttcgtcccgctcggtgagatccgtaaactag

SEQ ID NO: 227962 - DNA, 1068 bp, Artificial Sequence
  Description of Artificial Sequence: Synthetic coding sequence
atggcgctctcagaacctattctgccttctttctctaccttcgcgtcaccttgtagggaacgtggtctccaagaaagatggcctagggcagagcctgagtcaggtgggactgatgacgaccttaactctgttttggacttcatcctctctatgggtctcgacggtctgggagccgaagctgccccagaaccccctcctcctcccccacctccagccttctattatcctgaaccaggagctccaccaccctactccgcccctgccggtggactcgtatccgagctgctgcgaccagaactggatgcaccactgggacccgcactacacggtagattcctcttagccccaccaggtcgccttgtgaaagctgagccaccagaagctgacggtgggggtggttacggttgtgcacctggtctcacccggggtccccgtggactcaaaagggagggtgcgccaggtccagcagcgagttgtatgcgcggaccaggtgggcgtccgccacctccacctgatactcctcctctgtcccccgacggtcccgcaagactccccgctcccggaccacgagcttctttcccccctccttttgggggaccaggctttggcgcacctggccctggtcttcactacgcaccccctgctcccccagccttcggacttttcgacgatgctgcggctgccgctgctgccctaggactcgccccaccggcagccagaggcttgcttactccccctgcctctccactagaattactagaggccaaaccaaagcggggacggaggtcctggcccaggaagcgtaccgccacccacacttgttcttatgctggatgcggtaaaacgtatactaagagtagccacctgaaagctcatctgaggacacacaccggagaaaagccttatcattgcaactgggatgggtgcggctggaaatttgccagatccgacgaattaaccagacactatcgtaaacataccggtcatagaccctttcagtgccacctttgcgaccgggctttttctaggtcagaccatcttgcccttcacatgaaacgccacatgtag

SEQ ID NO: 227963 - DNA, 234 bp, Artificial Sequence
  Description of Artificial Sequence: Synthetic coding sequence
atggacgtgttgccaatgtgctccatttttcaagagctccagattgtgcacgaaaccggctactttagcgcgctgccatccttagaggagtattggcagcaaacatgcctggaactcgaacgatatcttcagtcagagccatgttacgtgagcgcaagcgagataaagtttgattcccaggagagcgttgatcagaaccattggttggggagaaaaaggagaaacccgaactag

SEQ ID NO: 227964 - DNA, 846 bp, Artificial Sequence
  Description of Artificial Sequence: Synthetic coding sequence
atggacgttctgccaatgtgctctatattccaagaattacaaatcgtgcatgaaacaggctatttttcggcccttcccagtctggaagagtattggcaacagacctgcctggagctggaacgttatctccagtcagaaccgtgctatgtctctgctagcgaaatcaaattcgacagtcaagaagatctgtggaccaaaatcattctcgcgagggagaagaaggaggaaagcgaacttaaaataagttcttctccacctgaagatactctgatcagccccagcttctgttataacttagagacaaacagtttgaatagcgacgtgtccagtgagtctagtgattctagcgaagagctgtccccgacggctaaatttacttctgatcccataggagaagtgctggtgtcgtccggcaaactcagttcatccgtgacatccactccaccttcttcccctgaacttagtcgggagccttcacagttgtggggatgtgtgcctggagaactgccatctccaggaaaggtaaggtcaggaacaagcgggaaacccggagacaagggtaacggtgacgctagtcccgacgggcgaaggcgggtccaccggtgccatttcaatgggtgcaggaaagtatacacaaagtcctcccacttgaaggcacaccagcggacacatacaggccaatgcccgcgtgggccaagacgcgcagctgcagggggacgacactgcatagcaccagccctcgagggagccggacccggatgcacaggatgcggacagggtcggcaaattctgacttccagcgatgtctttcatcagagcatacgcagcttttggagcagtgagtag

SEQ ID NO: 227965 - DNA, 852 bp, Artificial Sequence
  Description of Artificial Sequence: Synthetic coding sequence
atggatgtgttgccaatgtgttccatcttccaggaactccaaattgtccacgaaactggctacttttcagcactgcctagtttagaggaatattggcagcaaacatgcctggagctagagcgctatcttcagagcgagccttgctacgtgtcggcctccgagattaagtttgactcacaagaggacctctggaccaaaataattttggcaagggagaaaaaggaggaatccgagttaaaaatcagctctagccctcccgaggatactttaatatccccaagtttctgctacaacctggagacgaactctctgaacagtgatgtttcatccgagtcatccgacagcagtgaggaactcagtcctactgccaaatttacctcagaccctataggcgaagtgctggtgagcagtgggaagctgtcttcctcggtgacctcaacccccccttcgtctcctgaactttctagggaaccctcacagctttggggttgcgtgcctggtgagctgccatcccctgggaaggtgcggtcggggacaagcggcaaaccaggtgacaagggcaatggagatgctagtcctgacggaaggagacgagtgcaccgctgccatttcaacggttgcagaaaagtctataccaagagtagtcacctgaaggcacatcagcggacccacaccggtgaaaagccttacaggtgtagttgggaaggatgcgagtggcggtttgcaaggtccgacgaattgaccaggcacttccgcaagcatacgggagcaaagccttttaagtgttcccactgcgaccgctgcttctccagatctgaccaccttgccctgcacatgaagaggcacttgtag

SEQ ID NO: 227966 - DNA, 714 bp, Artificial Sequence
  Description of Artificial Sequence: Synthetic coding sequence
atggatgtccttcctatgtgcagcatattccaagaactgcagatcgtccatgaaacaggctatttctcggcgcttccctccctggaggagtactggcagcagacatgtctggaactggagcgctatctgcaaagtgagccctgctatgttagtgccagcgaaatcaagtttgattcccaagaggacctgtggacgaaaatcattctggccagggagaagaaagaggaatctgagttaaaaatcagttcttcaccacccgaggacacactgatctcccccagtttctgttataacttagagaccaactctctgaactccgacgtgtccagtgaatcatcagacagctctgaggaattgtccccgacggctaaatttaccagtgatccaatcggcgaagtgcttgtatcgtccgggaagctttcttcttccgtgacttctacaccaccttcttccccagagctgtcccgcgagccatctcagttgtggggatgtgtccccggagagctgccctcacccggtaaagtgagatccggaactagtggtaagccaggcgataaggggaacggggatgcaagcccagatggaaggaggcgcgtgcacaggtgccatttcaatggctgtcgcaaagtctacacgaagtcaagtcatctgaaagcccaccaaagaacgcatacgggagttttccccggtctgactacttggccctgcacttag

SEQ ID NO: 227967 - DNA, 909 bp, Artificial Sequence
  Description of Artificial Sequence: Synthetic coding sequence
atggatgttttggcatcctactcgatttttcaggaacttcagctggtgcacgatactggctacttttctgcactgccctcattggaggagacatggcagcagacctgtttagagctggagcgttatttgcagaccgaaccgcgacgcatctcggagacgttcggagaggatcttgattgtttccttcacgcatcacctcccccatgcattgaagaaagctttagaagactggaccctttactgctccccgttgaggccgctatctgcgaaaaatcaagtgccgttgatattcttcttagtagggacaagctgctgagtgagacatgcctgtccctccaacctgccagttccagcctggacagttacacagcagtgaaccaggcacagttgaacgcggtaacctctctcactccgccatcttctccagagctgagccgtcacctcgtcaagactagccagactcttagtgcagtggacggaaccgtgacccttaagctcgtggccaagaaggcagcactttcaagtgtcaaggtcggcggagtggctacagctgccgctgctgtcactgccgcaggggcagtcaaaagcggccagtccgacagtgatcaggggggtctcggtgcagaggcctgtcctgagaacaagaaaagggttcatcgttgccagtttaatggctgtcgaaaggtgtacacaaagtcaagccacctgaaggcccaccaacggactcatactggagaaaagccctacaaatgcagctgggagggctgcgagtggcggttcgcacggtctgacgaactgacccgccattacaggaaacacaccggtgccaaaccatttaaatgcaaccattgcgatcgctgcttctcccggagcgatcaccttgccctccacatgaagcgccatatttag

SEQ ID NO: 227968 - DNA, 825 bp, Artificial Sequence
  Description of Artificial Sequence: Synthetic coding sequence
atgttcccttcttggcccacatgtctggagctagaaagatacctacagaccgaaccgaggcggatcagcgagacattcggagaagacctagactgctttctacacgcctccccccctccgtgcatcgaggaatccttccgcaggctggatccgctattgcttccagtggaggctgcaatatgtgagaagtcaagcgccgtagatattcttctgagcagagacaagctactttcggagacctgcctgagtttgcaacctgcttcttccagcttggactcctacactgctgtgaatcaggctcaactgaatgcagtgactagtttaaccccgcctagtagccccgaactctcacgtcacttggtcaaaactagccaaactctaagtgcagtggacgggaccgtgacactcaaactcgtcgcaaagaaggccgctctcagtagcgtgaaagtcggcggagtcgccacggcagccgctgctgtgaccgccgctggggctgtgaaaagcggtcagagcgactccgatcagggcggtctaggcgcagaggcttgtccagaaaataagaagcgggtgcaccgctgccagtttaatggctgccgaaaagtgtataccaaatccagccatctcaaagcccaccaacgcacacacaccggtgagaaaccttacaaatgctcctgggaaggatgcgaatggagattcgccaggagcgatgagttgaccaggcactaccgcaagcataccggggctaaacctttcaagtgcaaccactgcgacaggtgtttttccagatccgatcacctggcgttgcatatgaaacgtcatatctag

SEQ ID NO: 227969 - DNA, 810 bp, Artificial Sequence
  Description of Artificial Sequence: Synthetic coding sequence
atgacatgcctggaactcgaacggtacctgcaaactgagcccaggcgtattagcgagacatttggggaggacttagattgtttcctgcacgcctcgccaccaccgtgcattgaagaatccttcaggagactcgatccgctcctcctgcctgtggaagcagccatctgtgagaagtcctctgcagttgacatactgctttctcgagacaagctgttgagtgaaacttgcttgtctctgcagccagcctcctcctccctggactcgtataccgcagttaatcaagcgcagctcaacgcggtcactagtcttacgccgccatccagtcccgaactgtctagacatttagtcaaaacctcacagacgctttctgccgtcgacgggaccgtaaccctgaagctcgtcgcgaagaaagcagccctctcctctgtgaaagtgggcggagtggccacagccgcagctgctgtcaccgccgctggagctgtcaaaagtggtcaatcggactctgatcaggggggacttggggctgaggcatgccccgaaaacaagaagcgggtgcaccggtgccagtttaatgggtgccggaaggtgtacacaaaatcttcacatttaaaggcccaccaaagaacccacactggagagaagccatacaaatgcagctgggaggggtgcgaatggcggttcgcacgtagtgatgagctcacccgccactaccgcaagcatacaggagccaagccctttaagtgcaaccattgtgacaggtgcttctccagaagcgaccaccttgctctgcacatgaagagacatatatag

SEQ ID NO: 227970 - DNA, 339 bp, Artificial Sequence
  Description of Artificial Sequence: Synthetic coding sequence
atggacgtcttagccagctatagcatattccaggaactgcaactggtgcatgacaccggatatttctctgctctcccgagtctggaagagacatggcagcagacatgtctggagctggagaggtatctgcagaccgagccccgaagaatcagcgaaacgtttggggaggacctggactgctttctccacgcctccccacccccatgcatcgaggaaagtttcagacggctagacccgttattgctcccggtcgaagccgctatttgcgaaaagagctctgctgtggacatacttctctcgcgggacaaactcttgtctgaaacatgtctgagcttatag

SEQ ID NO: 227971 - DNA, 183 bp, Artificial Sequence
  Description of Artificial Sequence: Synthetic coding sequence
atggacgtactggcttcttattccatattccaggaacttcaattagttcatgatactggatattttagcgccctcccctctcttgaggaaacctggcagcagacttgtctcgagctcgagcgctacttacagactgaaccacggagaattagcgagacttttggcgaggacctcgattgttag

SEQ ID NO: 227972 - DNA, 339 bp, Artificial Sequence
  Description of Artificial Sequence: Synthetic coding sequence
atggacgtgttggcgtcttattccatattccaggaacttcaactggtccacgacactggctatttttccgccctcccatcactcgaggagacctggcagcagacgtgcctagagttggaaagatacctgcagacagagcctcgaagaatctctgagacgtttggtgaaaaaccgtataagtgctcctgggaaggatgcgaatggcgttttgcgaggtccgacgaacttacacgacattaccggaaacacacaggcgctaaacccttcaagtgtaaccactgtgataggtgtttcagtaggagtgaccatctggcgctgcacatgaagaggcacatttag

SEQ ID NO: 227973 - DNA, 774 bp, Artificial Sequence
  Description of Artificial Sequence: Synthetic coding sequence
atggtcgacatggataaattgattaacaaccttgaagttcagctcaatagcgagggcggatctatgcaggtctttaagcaggtgacagcctctgtgcggaaccgcgatcctccagaaatcgaatatagatctaatatgacctccccaacactactggatgcaaatccaatggaaaatccggcactcttcaatgatatcaagatcgagccaccagaggagctattggcgtccgattttagcctgccccaggtcgaaccagtagacctcagctttcataagccgaaagcccctcttcagccggcatcaatgctgcaggctcccattaggccaccaaagccacagtcatctccccagaccctcgtggtttccacttccacatcagatatgagcacctccgcaaatatccctaccgtgctgaccccaggcagcgtactgacttcttcgcagtccacgggctcccagcagatcctacacgtgatacacacaatcccctccgttagcctgcccaacaagatgggcggactgaaaaccattcctgtggtcgttcagtctctgcctatggtatacaccactttaccggcagatggaggaccggctgcaatcacagtgcctctgatcggcggagatggtaagaacgctggttctgtgaaggtcgaccctacgagcatgtcacctctagaaatcccctcggacagcgaggagtcgaccatcgagtcaggttcctccgctttgcaatccctccaggggcttcaacaggaaagggaagctttgtag

SEQ ID NO: 227974 - DNA, 1080 bp, Artificial Sequence
  Description of Artificial Sequence: Synthetic coding sequence
atggtcgacatggacaaactaattaacaacctggaggtccagctgaacagcgagggcggtagcatgcaggtgttcaaacaggtcaccgcttcggtgaggaatagggatccacccgagatagaatacagatcaaatatgacgtctccaacactcctagatgccaatcccatggagaacccggctctgtttaacgacataaagatcgagccccctgaagagctgctggcatccgacttttcactgccccaggtcgagcctgtagatctctcttttcacaagccaaaggcccctctgcagccagccagcatgctgcaagctcctatccgtccccctaagccacagtcatcacctcagactttggtagtgagcacatccaccagtgatatgagcacctcagcaaatattccaacggtcttaactccaggctctgttctcaccagttctcaaagcaccgggtcccagcagattttacatgtcatccacaccattccctctgttagcctacctaataagatgggtggactcaagacaatccccgttgtggtgcagagcctgccaatggtatacacaacactcccagctgatggtggccctgccgcaattacggtacctttgataggtggtgatggaaagaatgccggatccgtgaaagtcgatccaaccagcatgagcccactcgagatcccttctgactccgaggaaagcacaatagaatccggcagtagtgcactccagagtttgcagggtcttcagcaggagcctgcagcaatggcacaaatgcaaggggaggagtcattggacctgaagcggagacggattcatcaatgtgacttcgcgggatgctccaaggtgtatacaaaaagtagtcacctgaaggcgcacaggcggatacacaccggggaaaaaccttacaagtgcacctgggacggttgttcatggaagttcgccaggtcagacgagctaacaagacactttcgcaagcatacaggaattaaaccttttcgttgcacggattgcaacaggtcattttcacggtcggaccacctgtcactgcatagaagaagacacgacaccatgtag

SEQ ID NO: 227975 - DNA, 771 bp, Artificial Sequence
  Description of Artificial Sequence: Synthetic coding sequence
atgcagccagccaaggaagtgactaaggcttccgacggctctctgctgggcgaccttggacacactccgctcagcaagaaagaagggatcaaatggcaaagacccaggttatctagacaggcgctgatgcgctgttgcctggtgaagtggatactgagtagcaccgcccctcaagggtcagatagttcagatagcgagctggagttatcaacggtcagacaccagccagaaggtttggaccagctccaggcccaaactaagttcacaaaaaaggagctccagtccttgtatcgtggcttcaaaaatgaatgtccaactggcctggttgatgaagacacattcaaactcatttatgcccagttctttccgcagggtgatgccacaacttatgcccactttttatttaatgcgttcgacgctgatggaaacggagctattcacttcgaagacttcgtcgtgggactctccatcttgctcaggggaacagtccacgaaaagctgaagtgggccttcaatctgtatgacatcaacaaggacggctatatcacaaaggaggaaatgctggcaataatgaaaagcatctacgatatgatgggccgtcacacatacccaatcctaagggaggatgcaccggctgagcacgttgagcgtttttttgagaaaatggaccgcaatcaggacggagttgtgactattgaggaattccttgaggcatgccagaaggatgaaaacatcatgtcatccatgcagctttttgagaacgtcatctag

SEQ ID NO: 227976 - DNA, 705 bp, Artificial Sequence
  Description of Artificial Sequence: Synthetic coding sequence
atgcaacccagaaaggaggttacgaaggccagcgatgggagcctgctcggggacctgggccacacccccctgtcaaaaaaagaggggattaagtggcagcgtccacgtttgagccgacaggccctaatgcgatgctgccttgtcaagtggatactctccagtaccgccccacaggggagtgactccagcgattctgagctcgaactttcaaccgtgaggcaccagcctgaaggcttggatcagctccaggctcagacaaaattcaccaagaaagagctccagtctctttatcgcggatttaaaaatggcgacgcgactacatatgcccattttctctttaacgcatttgacgcagatggaaatggagctatccactttgaggatttcgtggtgggtttgagtatcttactacgcggaaccgttcacgaaaagctgaagtgggcctttaatctgtatgatattaacaaagacggctatattacgaaagaagagatgctggccattatgaagtctatctacgatatgatgggtagacacacttaccccatcctgcgagaagatgctcctgcagaacacgtagagaggtttttcgagaaaatggacaggaaccaggacggcgtggtgactatcgaagaatttctggaagcgtgccagaaggacgaaaacattatgtcctccatgcagctgtttgagaatgtgatctag

SEQ ID NO: 227977 - DNA, 693 bp, Artificial Sequence
  Description of Artificial Sequence: Synthetic coding sequence
atgggtattcaggggatggagctgtgcgccatggctgtggtcgtacttctgttcatagctgtgctcaaacagtttggaatcctggagccaattagtatggaagattctagtgactccgagctggagttgagtaccgtgagacaccagccggaaggcctcgatcagctccaagcccagacaaaattcaccaaaaaggaattgcagtccctgtatcgaggtttcaaaaacgaatgtccaacaggattggtggatgaggatacttttaaactgatttatgcacagttttttccgcagggggatgccaccacatacgcccacttcttgttcaacgccttcgatgcggacggcaatggtgccattcattttgaagatttcgtagttggcctgagcattctcctgcgcggaactgtccacgagaagttgaagtgggctttcaacctttacgatatcaataaggatggctacatcacaaaggaagaaatgctggctataatgaaaagcatatacgatatgatggggcgtcatacctatccgatattgcgagaagatgcccctgccgagcatgtggagagattttttgagaagatggacaggaatcaagacggtgtggtcaccatcgaagaattcctggaagcttgccagaaggacgagaacatcatgtcatccatgcagctctttgagaatgtcatctag

SEQ ID NO: 227978 - DNA, 567 bp, Artificial Sequence
  Description of Artificial Sequence: Synthetic coding sequence
atggccacagttcgacacaggcccgaggctctggaactcctcgaagcgcaatctaagttcactaagaaagagctacaaattctgtaccgagggttcaaaaacgagtgcccttcaggcgtggttaacgaggagacatttaaggagatttactcccaattttttccgcagggcgatagcaccacgtatgcacacttcttattcaatgcattcgacacagaccacaatggggctgtgtctttcgaggactttattaaggggctaagcattctgctgcgaggaacggttcaggagaaactcaattgggcttttaacttatatgacattaataaagacggatacatcaccaaggaggaaatgctggacattatgaaagccatttacgatatgatgggcaagtgcacgtatccggttctgaaggaggatgctcctaggcagcatgtcgaaactttcttccagaagatggacaagaacaaagatggagtggtgacgatcgatgaattcatcgaatcttgccagaaggatgagaacataatgagatctatgcagctgtttgaaaatgtgatctag

SEQ ID NO: 227979 - DNA, 678 bp, Artificial Sequence
  Description of Artificial Sequence: Synthetic coding sequence
atgtccgggtgccgaaaacgatgtaagagggagatcttgaagttcgcacagtaccttttgcgcctgctaacaggcagcctccacaccgacagtgttgaggatgagttagagatggctaccgtaaggcacaggccagaagctcttgagctcctggaagctcagtcaaaattcaccaagaaggaactacagatcctgtataggggttttaagaatgaatgtcctagcggcgtagtcaacgaggagaccttcaaagagatttactctcagtttttcccacaaggagacagtacgacatatgcccacttcctgttcaacgcattcgatacagatcacaatggagccgtcagtttcgaagatttcataaaggggcttagtatcctgctccgagggaccgtgcaggagaagctgaattgggcattcaatctgtacgacataaataaggacggctacatcacgaaggaggagatgctagacattatgaaagctatctatgacatgatgggcaaatgtacataccccgtgctgaaggaagatgcgcctaggcagcacgtcgagacgtttttccagaaaatggacaagaataaagacggtgtcgttactatcgacgagttcatcgaatcctgtcaaaaggacgagaacatcatgcgtagcatgcagctgttcgaaaacgttatatag

SEQ ID NO: 227980 - DNA, 690 bp, Artificial Sequence
  Description of Artificial Sequence: Synthetic coding sequence
atgaatctagagggtttggaaatgatagccgtcctcatagttatcgtcctgttcgtgaagctgctggagcaatttggactgatcgaggctgggttagaagattccgtggaggacgagctggagatggctacggtgcggcatcgtccggaggctcttgagctgcttgaagcgcaaagcaagttcaccaaaaaggagctgcagattctgtaccggggtttcaagaacgagtgtcctagtggcgtggtcaacgaggaaacattcaaagagatttactcccagttcttcccccagggggatagtaccacgtacgcccattttctgttcaatgcttttgatactgatcataacggagccgtcagcttcgaagatttcatcaagggattatcaattttactaagggggacagttcaggagaagctgaactgggcctttaacttatatgacatcaacaaggacgggtacattaccaaggaagaaatgctggacatcatgaaagccatctatgatatgatgggtaagtgtacataccccgtactgaaggaggacgctccccgtcagcacgtcgagacgtttttccagaaaatggataaaaataaagatggcgttgtgactattgacgagttcatcgaatcttgtcagaaggacgagaatatcatgcgaagtatgcagctgttcgagaacgtgatatag

SEQ ID NO: 227981 - DNA, 753 bp, Artificial Sequence
  Description of Artificial Sequence: Synthetic coding sequence
atgaatgtacggcgagtcgagagcattagcgctcagctcgaggaagctagttcaacaggtggctttttatatgcacaaaatagcaccaagcgctccattaaggaacgcttgatgaaactcttaccatgcagtgccgcaaagacttcaagtcccgctattcagaatagcgtagaagatgaactcgagatggccacagtgagacaccgccctgaggccctggaactacttgaggcccagtctaagtttaccaagaaggaacttcagatattgtatcgcggtttcaaaaacgagtgcccgtccggcgtggtgaatgaggagaccttcaaagaaatctactctcagttttttccccagggggacagtacaacctatgcccattttttgttcaatgccttcgacactgatcataacggcgctgtgagcttcgaagattttatcaaggggttgtccatattgcttcggggaaccgtgcaagaaaagctgaattgggccttcaacctgtatgacattaacaaggatggttatataactaaagaagagatgctggacattatgaaagccatttacgacatgatgggtaagtgtacctatcccgtcctaaaagaggatgcaccccgacagcatgtcgagaccttttttcagaagatggacaaaaataaggacggagttgtcacaatcgacgagttcatcgaaagctgccagaaggatgaaaacattatgcgcagtatgcaattgtttgagaacgtcatttag

SEQ ID NO: 227982 - DNA, 567 bp, Artificial Sequence
  Description of Artificial Sequence: Synthetic coding sequence
atggccaccgtgcggcaccggcctgaagctttagaactgctggaggcacagtcgaagttcaccaaaaaggaacttcaaattctgtaccgcggtttcaagaacgagtgtcccagcggagtggtgaacgaagagaccttcaaggagatttactctcagttctttcctcagggagactccacaacttacgcacatttcctcttcaatgcctttgacactgaccataatggcgctgtttcctttgaggatttcattaagggcctgtcaattcttctgcgaggcacagttcaggagaagctgaactgggcctttaatctctacgacatcaacaaggacggctatattacaaaggaagagatgttagacataatgaaggccatttacgatatgatgggaaagtgtacttaccccgttcttaaagaggatgcacccaggcaacatgtggagacgtttttccagaaaatggacaagaacaaggacggtgtggtgacaattgatgagtttattgaatcttgccagaaggacgaaaatataatgcggtccatgcagctgtttgagaatgtgatctag

SEQ ID NO: 227983 - DNA, 651 bp, Artificial Sequence
  Description of Artificial Sequence: Synthetic coding sequence
atgaacgtcaggcgcgtagaaagtatcagcgcccagttagaggaggccagctccacgggggacagcgtcgaggacgagctcgagatggccacagttaggcacaggccagaagccctcgagttactcgaggcacagtccaagtttaccaagaaggaactgcagatcctgtatagaggctttaaaaacgaatgccccagcggggtcgtaaatgaggagacgttcaaggaaatctattctcagtttttcccacagggtgattccaccacttatgcgcactttcttttcaacgcgttcgataccgaccacaatggggctgtctcttttgaggacttcattaagggactgtctatccttctgaggggcactgtccaggaaaagctcaactgggcttttaacctctacgacataaacaaggatggctatattactaaagaggaaatgctagacattatgaaggcgatctacgacatgatgggtaaatgtacctaccccgtgttaaaagaggatgccccacgtcagcatgtggagactttcttccagaagatggacaaaaataaagacggcgtggtgactatagatgagtttatcgagagttgccagaaggatgaaaatattatgaggagcatgcagctgtttgaaaatgtcatttag

SEQ ID NO: 227984 - DNA, 567 bp, Artificial Sequence
  Description of Artificial Sequence: Synthetic coding sequence
atggcgacggtgcggcacaggccagaagccctggagttgcttgaagcacagtcgaagtttactaagaaagagctgcagattttataccgcggatttaaaaacgaatgcccgagcggtgtggttaacgaggagacctttaaggagatatactctcaattctttccccagggggattccacaacctatgctcacttcctctttaacgctttcgataccgaccacaacggcgctgtttctttcgaagatttcattaagggactgagcatcctgctccgtggcacggtgcaggagaagttaaattgggcgttcaacctatacgatataaacaaggatgggtatatcaccaaagaggagatgctcgatattatgaaggccatctatgatatgatggggaagtgtacataccccgtcctcaaggaggacgctccaaggcaacatgtagaaacctttttccagaagatggacaaaaataaggacggcgtggtgacaatcgatgagttcattgaaagttgtcaaaaggatgaaaacatcatgcgaagcatgcagctgttcgaaaatgttatctag

SEQ ID NO: 227985 - DNA, 549 bp, Artificial Sequence
  Description of Artificial Sequence: Synthetic coding sequence
tagggaatgaacgcgggtttcgaggactgcctagtctttgacgagcttatggacaagttcagcaatgacctgagcctgtgtcttccggtgttcagtcgtctgcgcatacccgacgaccacgctatctcagacctttcaatgtataattatattgaaatgagggcccacgtcaatagctcatggttcatcttccagaaaaatatggagcgttttttacacgccatcatgccaagtacctttattccactgtacaccatggttacttttagtaggattagatatcatgaggccgtgcaaaggtggcattggcagaagaaggtcatcaacaagggtctcttctttctgggaagcctcatcgcgattagttctacgtatctgctgattcactatatgtctccccgttccttcctgcgcctgcgcagaccctggaactggattgcccacttccgcaacacaacctgtttccctgctaaggctgttgactccctggagcagatcagcaaccttatttcacgcttgcttagccattctgaaatcctgcagacctag

SEQ ID NO: 227986 - DNA, 1359 bp, Artificial Sequence
  Description of Artificial Sequence: Synthetic coding sequence
atggattcctctgtgatccaacgaaagaaagttgccgtaatcggaggaggccttgttggctccctgcaggcatgttttctcgctaaaaggaatttccagattgatgtctacgaggctcgggaggatactagggtggccaccttcacacggggacgcagtattaacctggctttgtcccacaggggcaggcaggcacttaaggccgtgggtctggaggaccagatcgtttctcaggggattcccatgcgggctcgaatgattcatagcctcagtggcaagaaaagcgctattccctatggcacgaagagccaatacatcctgagcgtcagccgcgaaaaccttaataaggacctacttacggccgcagagaagtaccccaatgtcaaaatgcatttcaatcatcgtcttcttaagtgtaatccagaggaagggatgattactgtgctggggtccgacaaagtccccaaggacgtgacctgtgatctcattgtgggctgcgatggcgcatactccaccgtgagatcacacctgatgaagaagccgcgatttgattattcacagcagtatattcctcacggatacatggaattgactatccctcctaaaaatggggattacgccatggagccgaactatttgcacatatggccgcgtaacacattcatgatgattgcgcttcccaatatgaataaaagcttcacttgcaccctgtttatgccctttgaggagttcgaaaagctactcacgtcgaacgacgtcgtggacttttttcaaaagtacttccctgatgccataccactcattggggaaaagctgctggtccaggatttcttcctgctgccagcgcagccgatgatcagcgtgaagtgctccagtttccattttaagagccattgcgtgttgctgggcgatgcagcccacgctatcgtgccgttctttggacaaggcatgaacgccggtttcgaagactgcctcgtgtttgacgagctgatggataaatttagtaatgaccttagcttatgcctcccagtcttttccaggctcagaatccctgatgatcatgccatcagcgatctgtctatgtacaattacatcgaggtgaccttttccagaatccgctaccacgaggcagtgcagagatggcactggcagaagaaagttatcaataagggcctgttcttcttaggaagccttattgcgatttcttccacctacttactgatacattacatgtcgccacgttctttcctcagactcagacggccttggaattggattgcacatttcaggaacactacctgctttccagcaaaagccgtagacagtttagaacagatttccaatctgatatcacgatag

SEQ ID NO: 227987 - DNA, 1422 bp, Artificial Sequence
  Description of Artificial Sequence: Synthetic coding sequence
atggactcttccgtgatccagaggaagaaagtggccgtcatcggcggaggacttgttggcagcctccaggcctgctttctggccaaacgaaatttccaaattgacgtgtatgaggcgagggaggataccagagtggcaacgtttacacgcggacgatccattaacctggcactgtcccaccgaggaaggcaggctctaaaggccgtgggactcgaggatcagatagtctcccagggaatcccaatgcgggctcgtatgattcatagtttgtccgggaagaaaagcgcgataccctacggcactaagagtcagtatatactgtccgtctcaagagagaacctcaacaaggacctcttgactgcagccgagaaatatcccaatgtgaagatgcactttaaccatcggctgctgaaatgtaatcctgaagaggggatgatcactgtgctcgggtcagacaaagtcccgaaggatgtcacctgcgacctcatagtaggatgtgatggtgcctatagcaccgtcagatcacacttaatgaagaagccacgatttgactacagccagcagtacattccacacgggtacatggaactgacgatacccccaaaaaacggtgactacgccatggaaccgaactacctccacatctggccaaggaatacctttatgatgatcgcactacctaacatgaataaatcctttacctgtacgctcttcatgcctttcgaggagtttgaaaagctgctcaccagcaacgacgtagtggactttttccagaagtacttcccggacgcgattccactcatcggagagaagttgctggtgcaggatttcttcctcctcccggctcaacctatgatcagtgtcaaatgctcctccttccactttaagtctcactgtgttttactgggagacgctgcccatgccattgtacccttcttcggacaggggatgaacgctggatttgaagactgcctggtgttcgacgagctgatggacaagttttcaaacgacctgagcctttgtttgccagtctttagccggctaagaatccccgatgaccacgcgattagcgacctaagtatgtacaattacatcgaaaaaaacatggagaggttcctgcatgccatcatgccatctacatttattccactgtacacgatggtcaccttttccaggatcagataccatgaagctgtgcagcgctggcactggcaaaagaaggtgataaacaagggattattcttcctgggctcactgatcgctattagctccacatatctgctcattcattacatgagcccccgtagcttcctcagactgagaagaccgtggaactggattgctcactttcgtaacactacttgtttcccagccaaagctgtggattccctcgagcagatatcgaatcttatctcacgttag

SEQ ID NO: 227988 - DNA, 1461 bp, Artificial Sequence
  Description of Artificial Sequence: Synthetic coding sequence
atggactcctccgtcattcagcgaaaaaaggtggctgtgataggcggtgggctggttggcagtctgcaggcctgttttttggccaagcgcaacttccagattgacgtgtatgaggcgcgtgaagacacccgcgtggccacgtttacacgaggacgatcaatcaatctggccctgagccatagaggacggcaagcacttaaggcagtagggttggaagaccagatagtctcccagggtattccaatgcgcgctaggatgattcacagtctttccggtaagaaatctgccataccgtatggtactaaatcccagtatatcctttctgtgtccagagagaacctgaataaggacttgctgaccgcagccgaaaaatatcccaacgtgaaaatgcacttcaatcacaggctccttaaatgcaatcccgaagagggaatgatcacagtccttggatccgataaggttcccaaggacgtgacatgtgacctgattgttggttgcgacggggcatacagcactgtgcgcagccatctgatgaagaaacctcgctttgattactctcagcagtacattccacacggttacatggaactgaccatccccccaaagaacggcgactacgctatggaacccaactacctgcatatctggccacgcaacacgttcatgatgatcgccctgcccaacatgaataagtcttttacttgtacactcttcatgccatttgaggagttcgagaaactgctgacatctaacgatgtggtagatttttttcaaaagtattttcctgatgccatccctctgattggcgaaaagcttctcgtacaggacttcttcttgctgccagcccagccaatgatctctgtcaaatgttctagctttcactttaaaagccactgcgttctattgggtgacgccgcacacgccatcgtcccgtttttcgggcaaggaatgaatgcgggattcgaagattgccttgtatttgacgaacttatggacaaattcagcaatgacctaagcttatgtttgcctgtgttctcccgacttcgcattccagacgaccatgccatttcagatctctccatgtacaattacattgagatgagagcccacgtgaacagctcttggtttatcttccaaaaaaacatggaacgctttctgcatgctattatgcccagcacgtttatcccactatacacaatggtgacattttcccgaattagatatcacgaagccgtgcagcggtggcattggcaaaagaaggtgattaacaagggtcttttctttctaggctctcttattgctatatcatctacctacctcctaatccattacatgtcccctagatcattcctgaggctgcggaggccttggaattggatcgcccatttccgcaatactacttgtttcccggcaaaggccgtcgatagcttagaacaaatctccaatctaatctctcgctag

SEQ ID NO: 227989 - DNA, 1689 bp, Artificial Sequence
  Description of Artificial Sequence: Synthetic coding sequence
atggagctcaagaaggacattaacgcagtgtctattgacatgctgttaattgtgcactcagagaagcgtagggctgctcaggggaccttgagcgaccagcaggcgaatccttcttctttactgcagcgaggcggaggttttcagggcgtcgggaatggcgtccggagatggcagaaattggagggcaatgattttcacgagaatctggtcgaaaaacagcacccgcagcagccccaagttatcacttcttacaacagtcaaggcacacagctcaccgttgaggtgcaccctagggacgcgatgccccagctcctgaaaaagtttagcttagccaaacggctgcagggggataaaaatggcaacacacgaccgagacaaccagggggaaaggacgcccacgcatacccctgggataggagtagcttgaagtcgatgtctttggatctacagcaatttgagaagttggacatctatgcctctcaggtgactgccaaatcgggcttagatgaactagtctcagacctgcttcaggaggcacacaccgatttggagagggtgcgcgcaatttggatatggatctgtcaccacattgagtacgacattgcggcagcccaagaaaaggacagacaagcatttaagcccactgacattctccgcactcagaagaccaattgtgacggctatgccggactgttcgaaaggatgtgtaggctcgctggcgtgcagtgtatgacagtgcctggatattccaaaggattcggctaccaaaccggccagtccttcagcggcgaattcgaccatgcttggaacgctgtctatctggaaggcaggtggcaccttgtagattcgacctggggtagcgggctcgtggacacaattacgtccaaatttaccttcctgtacaacgagttttacttcctaactcatcccgctttgttcattgaggaccactttcccgacaacaaaaattggcagctgctaaaacctcctcagagtcttaggcagttcgaaaataatatgtatcataaatcagagttctacaataaggggatgctgtccgctcacccagaaactagcatgattcggaccgtcaatgggaaggcgacagtgacaattgaatcatgtgcacccaccttgtttatgttcatgttaaatggaaaacaagaacatgggctcctcagcctgagaaagaatggcatgaagctcgaagtgtatcctcccaccatgggaacccacaagctccaaatttttgctaagggtaatagtgacatctactcaagtgtgctggagtatacactcaagtgcaattacgtcgatatgggtgtgcagctcccagccgagctgcaccagcctgtcgggcctagctggtttagcgagcagatgggtattatgaaaccatctcatccagacccaatcatacacactagcgacgggcgttgctcaatatcattttccgtcgaggaggggatcaacgtgctcgcaagtctccacggcgatgacggccctattactgaggagacacaaagaagatatattttccagttgcatagggagaagcagacagagctgaaggtgcaactgccgcacgccggtaagttcgcactgaaagaggtctatgtgatggttttggagaatgccaatcataacttttattcatatattttgaagtataaagtaaatgcgcagtag

SEQ ID NO: 227990 - DNA, 1986 bp, Artificial Sequence
  Description of Artificial Sequence: Synthetic coding sequence
atggagctcaaaaaggacattaacgccgtgagcatcgacatgctccttattgtccattccgaaaagagacgggcagctcaaggaactctctccgaccagcaagcaaatcctagctcccttctccagcgcggaggtggctttcagggcgtggggaacggggtccgaaggtggcagaaattagaggggaacgacttccatgaaaacctggtggagaagcaacacccccagcagccgcaggtgatcacttcatacaactcccagggaacacaattgacagtagaggtacacccaagggatgccatgcctcaacttctcaaaaagttcagcctggccaaacgcctacagggagacaagaatggcaatactcggcctcgtcagcccggtggaaaagatgcacatgcatacccttgggaccgatcctccttaaaatccatgagccttgatctccagcagtttgagaagctggacatctatgcaagccaagtgacagcaaagtctgggctggatgagttggtttccgacctgctgcaggaggcccacacagacctggagagagttcgggctatctggatatggatttgtcatcacattgagtacgacatagccgctgcgcaggaaaaggatagacaggccttcaaaccaacagacatactgcgcactcaaaaaacaaactgtgatggatatgcaggtctcttcgagaggatgtgcagactggccggagttcagtgtatgactgtgcccggttactctaaaggctttggttaccagactggccagtcctttagtggtgagttcgatcacgcttggaatgcggtctatctcgagggacggtggcacctggttgatagtacctggggcagcggcttggtcgacaccataacatctaaattcaccttcctgtacaacgaattttactttctgactcaccccgcactctttattgaggaccactttccagataataagaattggcagctgctgaagccgcctcagtctctgagacaatttgagaataacatgtaccataagtctgagttttataataaagggatgttatcggcccaccccgagacaagcatgatccggacagtcaacggtaaggcgaccgttacgatcgaatcttgtgctcctacgttgtttatgtttatgttaaacggcaagcaagagcacggcttactgtcactgaggaagaacgggatgaagctggaagtttatcccccaacgatgggaactcacaaacttcagattttcgcaaaggggaattccgatatatactcttctgtccttgagtacactctgaagtgtaattatgtcgatatgggcgttcagctcccagccgagctgcatcaacctgtgggtccatcatggttttctgagcagatgggcattatgaaaccttcgcatccagatcctattatccatacttctgatggcagatgctccattagtttttccgtggaagagggtattaatgtgcttgcctccctccatggtgacgatgggccaataactgaggaaacccagaggagatatatcttccaactccaccgagaaaagcagacggagttgaaagtgcagctgccccacgcgggaaaatttgccctgaagatcttcgtcaaaaagcggcaggagcctggcaactacattttcgtgttcaactacctcgtgtgttgcgctaacactaaggtgaactggcccatgttccccgaatcctttgggaactgggggcaggacaacgaattactggaacctttatctggggtcctgcccgctaacaggaatgtcccgttcaagttaaaactgcatgggatcgcaaaggtgcttgtcaaagggcaggatacatggcccctgaccctgaatcacgaggggtactgggagggaagctgcagcacagctggctgccaggaggtctatgtgatggtactggagaatgctaatcataatttctattcttatatacttaagtacaaggtgaatgcccagtag

SEQ ID NO: 227991 - DNA, 1173 bp, Artificial Sequence
  Description of Artificial Sequence: Synthetic coding sequence
atgaaattagaggcagtggacagaatgaatccatccctggtctgtgtggcaagcgtgacagacgtggtcgactctcgcttcctggtgcactttgataattgggacgatacctatgactattggtgcgatccatcatctccatacattcatcccgttgggtggtgtcagaagcaaggtaagcccttaactcccccacaggattacccggacccagacaatttctgttgggaaaaatacttggaggagaccggagcaagcgccgtacctacctgggcgtttaaagtgcggcctccacactctttcttggtgaatatgaaacttgaggcagtggaccgcaggaatccagctctcatacgggtggccagtgttgaagacgtggaagatcaccggatcaaaattcactttgacggatggtctcacggctacgatttctggatagacgcagatcatccagatatccatcccgcaggatggtgcagcaagactggacacccactgcagccccctctaggcccaagggagccatcatccgcctcaccagggggatgcccgccactgagctaccgaagtttgccccacaccagaacatcgaaatactcttttcaccatcggaaatgcccgacacccggatgcgacgggagtggacatgtgaccggcaagttcacagcccaccactgtttgagcggctgccctttagccgagcggaaccaaagtaggctgaaggctgagctttctgattcagaagcgtcagcacgaaaaaaaaacctgagcgggttcagccccagaaaaaagcctcgtcaccacggccgtatcggacgcccacctaaatacaggaagattccacaagaagactttcaaactcttacacccgacgtggtgcaccagtccctcttcatgtctgcattgtctgcacatccagaccgcagcctcagcgtgtgctgggagcaacattgtaaactgctgccaggggtcgcagggattagcgccagtaccgtcgctaagtggaccatcgatgaggtgttcggatttgttcagacgctgactggttgcgaagaccaggcaagactttttaaggatgaggttaggtgcaaatgtcgggttggagatagggctggcgtcaccgtgctcaaaacggctggaagtcggtgccccccacagcgacatttctgttag

SEQ ID NO: 227992 - DNA, 2232 bp, Artificial Sequence
  Description of Artificial Sequence: Synthetic coding sequence
atgagacgtagggaagggcacgggaccgactccgagatgggccaagggccagtccgggaaagtcagtcctcagaccctcccgctttgcagtttaggattagtgaatacaaacctctgaatatggccggagtggagcagccacctagccccgagttgcgtcaggagggggtgacagagtacgaggatgggggtgcacctgcaggcgatggggaagctgggcctcagcaggcagaggaccatccgcaaaaccctccagaggatcctaaccaagaccctcctgaggacgatagtacatgccaatgtcaggcctgcgggccacaccaagcagcaggccctgatctcgggtccagcaacgatggctgtccacagctgttccaggaaagatctgtcatcgtcgagaactcatccgggtccacatccgcatcagaactgttaaaacctatgaagaaacgcaagaggagagaataccaatccccttcagaggaagaatccgagcctgaagcaatggaaaagcaagaagagggcaaggaccccgagggtcaaccgaccgcatcaacaccagaatcagaagagtggtcctcgagccagcccgctaccggggaaaagaaggaatgctggtcttgggaaagttaccttgaggagcagaaagccataacagccccagtgtccctgttccaggatagtcaggctgtcacacataacaaaaacggctttaagctaggaatgaaactcgaaggtatcgaccctcaacatccgagcatgtacttcatcttaactgtggcagaagtgtgtggataccggctgcgactccactttgatggatacagcgaatgccatgatttttgggtgaatgcaaactcccccgatatccatcccgctgggtggttcgagaaaaccggccataagttgcagccgcctaagggctataaagaggaagaattctcgtggagccagtacctaagatccacccgagcccaggccgctcctaagcacttgtttgtatcccagtcccactcgccaccacccctgggattccaggtgggaatgaaacttgaagccgttgataggatgaaccctagcttggtgtgcgtggcctccgtgaccgacgtggtggatagcagatttctggtgcacttcgataactgggatgacacgtatgactactggtgtgacccctctagtccctatatccaccctgtgggctggtgtcagaagcagggaaagcccctgactccaccccaggactatccagatccagataatttctgctgggagaagtacttagaagaaactggcgcttccgctgtgcccacctgggcttttaaagtacgccctccccattcatttctggtgaatatgaagttggaggctgtcgatcgcagaaacccagctctaatccgagtcgcctctgtggaagacgtggaggatcaccggattaaaatacattttgatgggtggagccatgggtatgatttctggatcgatgcagaccatcctgatatccatccagccggatggtgttccaagacaggccacccgctgcagccccctctgggacctcgggagccgtcatccgcctctccaggtggctgccccccactctcgtaccgctcattaccccacacccgcacctctaagtacagtttccaccaccggctgttcttcccaagaaaatgcccgaccccgggatgtgacgggtctggacacgtgaccggtaaattcacagctcatcactgcctgagtggctgtcctctggccgagagaaatcaaagtaggctgaaagccgagctttccgactccgaggccagtgcccgaaagaaaaatctctctggtttcagccccagaaaaaaacctcgacaccacgggaggataggaaggcccccaaaatacagaaagatcccccaggaggacttccagacactgacacctgatgtcgtccatcagtcactctttatgtctgccttatctgcgcatcccgaccgttcgttgagtgtttgctgggagcagcactgtaaactgctgccaggcgttgccggtatatcagcatccaccgttgcgaagtggactatagatgaggtattcgggtttgtgcagacgcttaccggttgcgaggaccaggccaggctattcaaagatgaggtacgatgcaagtgtcgcgtgggcgaccgagctggggtgaccgtgctgaaaacagcaggttcacgatgcccacctcagaggcatttctgctag

SEQ ID NO: 227993 - DNA, 2319 bp, Artificial Sequence
  Description of Artificial Sequence: Synthetic coding sequence
atgaggagacgcgaaggccatggtaccgatagcgaaatggggcaaggcccagtccgcgaatctcagagcagcgaccctccggctcttcagtttagaatcagcgaatacaaacccctcaacatggcaggggtggaacaacccccttcaccagagctgcggcaggagggtgtcactgagtatgaggatggcggtgcccctgccggtgatggcgaggctggcccacagcaagccgaggaccaccctcagaatcccccagaggatccgaaccaagacccaccggaggacgattcgacctgtcagtgccaagcctgcgggccacaccaggcagcgggtcccgacctggggtcctctaacgacggttgtcctcaactattccaggagagaagtgtgattgtagagaacagctcaggctctacttccgcatccgaactcctaaagcccatgaaaaaaagaaagaggcgggagtaccagagcccatccgaagaggaatcagaaccggaagcaatggagaaacaagaggaggggaaagaccccgaggggcaacctaccgccagcacccctgagtccgaagaatggtcctccagccagcccgctactggcgagaaaaaagagtgctggtcctgggaaagctacctcgaagagcagaaggccatcacagccccagtgtccctgttccaggatagccaggccgtgactcataataagaacggtttcaagttgggaatgaagctggaaggaatcgacccacaacaccccagcatgtacttcattctgaccgttgccgaggtgtgcgggtacagactcagactgcacttcgatggatatagcgaatgtcacgacttctgggtgaatgccaatagtcctgatatccatccggcaggctggtttgagaagaccgggcacaagttgcagcccccaaagggctacaaagaggaagagttcagttggagccagtatctacgatctacgcgggctcaggccgcacctaagcacctgttcgtctcacagtcacattccccgccacctctcgggtttcaggtcggcatgaaacttgaggccgttgaccgtatgaaccccagcctagtgtgcgtcgcgagcgttacagatgtagtcgatagccgattcctggtccactttgacaactgggacgacacatatgactactggtgtgacccatcctctccctatatccaccctgtggggtggtgccagaaacaggggaagcctcttacacctccacaagattatccggatcctgataacttctgttgggagaaataccttgaggaaaccggggcaagtgcagtccctacctgggcattcaaggtgcggccacctcacagcttcctggtcaatatgaagctggaggctgtagatagacggaatcccgcacttattagggtggcctcagtggaggacgtcgaggaccatcggatcaagatacacttcgatgggtggtcccatgggtatgacttctggattgacgctgaccatccggacatacaccccgcaggatggtgctctaaaacaggccacccattgcagccgccacttggaccaagggaacccagttccgcttctcccggagggtgtccacccctgagctatagatccctgcctcatacccgcacaagtaagtacagctttcaccatcgcaaatgcccaacacccggttgtgacgggtcgggccacgtcacaggcaaattcaccgcccaccattgcctatccggctgccctctggctgagaggaaccagagcaggctcaaggccgagttaagtgatagcgaggcctccgcccgaaaaaaaaacctttctggcttttctcctcggaaaaagcccagacaccacggtaggattggaaggccgcctaagtatcgtaagatccctcaggaggatttccaaactcttactcccgatgtcgtgcaccagtctcttttcatgtctgccttgagcgcacaccctgacagatccctttccgtgtgctgggaacagcattgcaaactgttaccaggcgtggcgggaataagtgcctccaccgttgctaagtggacaattgacgaggtgttcgggtttgtccaaactcttaccggttgcgaggatcaggcccgactcttcaaagacgaagcccgtatagtgcgcgttacccacgtttcaggcaaaacactggtctggaccgttgcacaactgggtgatttggtttgctctgaccatctccaggagggtaagggaatcttagaaactggggttcactccctcctctgttcgctgccgacccacctgctggcaaagctttccttcgcctcggatagtcagtattag

SEQ ID NO: 227994 - DNA, 2523 bp, Artificial Sequence
  Description of Artificial Sequence: Synthetic coding sequence
atgcacctcgtcgcgggagactctcccggtagcggtccccatctccctgctacagctttcataatcccagcttcatctgccacattgggccttccatcgtccgcgctggatgtttcttgctttccccgagagcccatccacgtcggcgcacccgagcaggtggctgggtgtgaaccagtgtccgccaccgtgctgccccagctttccgccggtcctgcttcttcctcaacctcgaccgtgcgcctattggaatggacagaagccgcagcacccccaccagggggaggcctgcggtttcggatatctgagtataagccactgaatatggccggagtggagcaacccccatcacccgagttgcggcaggagggcgttaccgaatatgaagacggaggcgctcctgccggtgacggagaagcaggaccacagcaagctgaggaccaccctcagaaccccccagaggatccaaaccaggaccctcctgaggatgattccacatgccagtgccaggcctgcggaccccatcaggccgcaggcccagatctgggatcttccaatgacgggtgcccacagctcttccaggaaaggtcggtaatcgtagaaaatagcagcggctccaccagcgcctcggagctgctcaaacctatgaaaaagcgtaagcgtcgcgagtaccagtcacccagtgaggaagagagtgagccagaggccatggagaaacaggaggagggcaaggacccagaaggccagcccaccgccagcactccggaatccgaagaatggagcagctctcaaccagccaccggggaaaagaaagaatgttggagctgggagtcctatctcgaagagcagaaggctattacagctcctgtatctctatttcaggacagccaggccgtcactcataacaagaacgggtttaagctcggcatgaaactagagggtatcgatcctcagcacccgtcaatgtactttatcttaactgtcgcggaagtgtgcggctataggctccggcttcactttgacgggtattctgaatgtcacgatttctgggtgaatgcgaatagccctgatatacatcctgccggttggttcgaaaaaaccggtcataagttacagccacccaaggggtataaggaggaagagttcagttggagccagtacctgcgctctacacgggcacaagctgctccaaaacacctgttcgtttctcagtcccactcacctcctcctttggggttccaagttggcatgaaactcgaggccgtggatcggatgaacccctctctcgtgtgtgtggcatcagtgacggacgttgtggattcaaggttcctggtccacttcgacaattgggacgacacatacgattattggtgcgatccctcctccccttatatccaccccgtcggctggtgccagaagcagggtaaacccttaaccccccctcaggactatcccgacccagacaacttctgttgggagaaatatctcgaggaaaccggagcctctgcagtcccaacctgggcgttcaaggtgcgccctccccattcttttcttgttaacatgaaactggaggccgtggacaggagaaacccggcactcatccgtgttgcaagtgttgaagacgtcgaagaccatagaatcaaaatccatttcgatggctggtcccacgggtacgacttctggatcgatgccgaccaccctgatatacacccagcgggttggtgttccaaaacaggccatcccctgcagccgccactgggacctcgcgaaccatctagcgcaagtcctgggggttgtcctcctctttcttacaggagcttaccccatacccggactagcaagtattcatttcaccaccgaaagtgccccactccaggatgcgatgggtcaggccatgttaccggaaagtttactgctcatcactgcctgagcggatgcccactggccgagaggaatcagtccagactgaaagctgagttgagcgattccgaggcttcagcccgaaagaagaacctgtctggtttctcgcctaggaagaagccccgtcatcatggtaggatcggccgtcccccaaaataccggaagatccctcaggaggatttccagacactgactccggacgtcgtccatcagagcctatttatgtccgccctgagtgcccacccagaccgctcactatctgtctgttgggagcagcattgcaaactgctgcctggcgtcgccggtatttccgccagcaccgtggctaagtggaccatcgacgaagtgtttggtttcgtgcagactctgaccgggtgtgaagatcaggccagactttttaaagatgaggcccgtatcgtccgggttacccacgtaagcggcaaaaccctggtttggaccgtggcccagctaggtgatctagtctgttctgaccatctccaggagggtaaaggaattctagaaaccggcgtgcacagtctcctttgctccctgcctacgcacttactcgctaagctgagcttcgccagtgactctcagtattag

SEQ ID NO: 227995 - DNA, 1617 bp, Artificial Sequence
  Description of Artificial Sequence: Synthetic coding sequence
caaaaggctataacagctcctgtttcactttttcaggactcgcaggccgtgacgcacaataagaatggatttaagctgggaatgaaacttgagggaatcgacccacagcatccaagtatgtattttattctgaccgtcgcggaggtatgtggatacagactgcggttgcattttgatggatattccgagtgtcacgacttttgggtcaacgcaaatagtccagatattcacccggcaggatggtttgagaaaactggacacaaattgcaacctcccaagggatataaagaggaggagttttcctggtcccagtatctcagaagcacccgggctcaggcagcacccaagcatctgttcgtttcccaatcacattctcccccaccattggggtttcaggttgggatgaagcttgaagccgtcgacagaatgaacccgtcgttggtgtgcgtcgcttccgtcacagatgttgttgactcaagatttctggtacactttgacaactgggacgacacatatgattattggtgcgacccctctagcccatatatacaccccgttggatggtgccagaagcaaggaaaacctttaaccccaccacaggactaccccgatcccgacaacttctgttgggagaagtaccttgaagaaacaggggcatctgccgtgccaacttgggcattcaaggtgagaccacctcactcatttttggttaatatgaaattagaagccgtcgatcggagaaatcccgcattaattcgggtggcttccgtggaggatgtcgaggatcaccgaattaaaattcatttcgacggctggagccatggatacgatttttggatagacgccgaccatcccgatatccaccccgctggttggtgttcgaaaacaggtcacccactccagccgccactgggaccgagagaaccctcttcagccagtccaggagggtgcccgccactctcctaccggtctctgccccataccaggacctccaagtactctttccatcaccgtaagtgtcctactccagggtgtgacggatctgggcatgtgactggtaagtttactgctcatcattgtctgtctggctgccccctcgcggaaaggaatcaaagtcggctgaaagcagagctttccgactccgaggcctccgcccgaaagaagaatttgagtgggttcagtcctagaaaaaaacctagacatcacggccgtatcggacgcccaccaaagtacagaaaaattccacaggaggatttccaaactctcacacctgacgttgtgcatcagagtttattcatgagcgccctgagcgcccatccagacaggtcgctgtctgtgtgttgggagcagcactgcaaactgctccccggtgtggctggcatctctgcctctaccgttgccaagtggaccatcgacgaggtgttcgggttcgtccagacgctcacgggatgcgaagaccaagcccgattatttaaagatgagatgattgatggtgaggcttttcttttactaacccaggccgacattgtgaagatcatgagcgtcaagctggggcctgctctgaagatttacaatgcaattctgatgttcaagaatgccgacgacaccctgaagtag

SEQ ID NO: 227996 - DNA, 2523 bp, Artificial Sequence
  Description of Artificial Sequence: Synthetic coding sequence
atgcacctcgttgccggagattccccaggctcgggaccccacctacccgcaaccgcattcattatacccgctagttccgcaaccctgggcttgccatctagcgctctggacgtgtcttgctttcccagagagcccattcacgttggggcacctgaacaggtggcgggatgtgaacctgtctcagcgactgtgctgcctcagctgtctgcgggacccgcatctagtagtacttcaacagtacgactgctggagtggaccgaggcggcagcgcctcccccaggcggaggattgaggttccgtatttccgaatacaagcctctgaacatggccggagtcgaacagcctccgtctccagagttaaggcaagagggtgtgactgaatacgaagacggtggagcaccggcaggcgacggggaggccggtcctcagcaagctgaggaccacccacaaaatccaccagaagaccccaaccaggatccacccgaggacgattccacctgccaatgccaggcctgtggtccccaccaggccgctggtcccgacctcggcagttccaatgatggatgcccccagctgtttcaggaacgctctgtaattgtggaaaattccagtggaagtacctccgccagtgaactgctgaagccgatgaagaaacgcaaacgacgggagtatcagtctccatccgaagaggagtccgagcccgaagccatggaaaagcaggaagaagggaaggaccccgagggccagccgaccgcttcaacaccagaatcagaagagtggagtagctcccagcctgccacaggcgaaaagaaggagtgttggtcttgggaatcctacctcgaggaacaaaaagccatcaccgccccagttagcctgttccaggatagtcaggccgtcacacacaacaagaatggttttaagctcggaatgaagctggaaggcatcgacccccagcacccaagtatgtattttattctcaccgtggcagaggtctgtggctatagactcaggcttcattttgatggctacagcgaatgtcacgacttctgggtaaacgcaaattctccagacattcatcctgcagggtggttcgaaaagaccggacacaaactgcaaccccctaaaggctacaaagaggaggaattcagctggtcgcagtacctacgcagtaccagggcccaagctgcgcctaagcacctgttcgtaagccagtcccactcacccccacctttaggtttccaggtgggaatgaaactggaggctgtagatcggatgaatccgtccctggtgtgcgtggccagtgtgaccgatgtggttgattcacgcttcctggttcactttgataattgggacgacacttatgattactggtgtgacccctccagtccatatatccaccctgtgggttggtgtcaaaaacaagggaaacccctgactcctccgcaggactatcctgacccagacaatttttgttgggagaagtaccttgaggaaaccggggcttcggcagtcccgacctgggcattcaaggttagaccaccacactccttcctcgtcaatatgaagctggaggccgtagaccgtagaaacccggctctaattcgggtcgcttccgtggaagatgtcgaggatcataggattaagattcacttcgacggctggtcccacgggtatgatttttggatagatgcagaccaccctgatatccacccagccggatggtgtagtaaaaccggccatccactacagcctcccctaggccctcgcgagcccagcagtgccagccccggaggctgcccccctttgtcctaccgcagcctcccacataccagaacttctaagtattcattccatcaccgcaaatgtcctactcccggatgcgacggcagtggccatgtaaccggcaagttcaccgcacaccactgtctctcggggtgtcccctcgcagaacggaatcaaagtcggttgaaagcagagttgtcagattctgaagcgtccgccagaaagaagaacctgtcgggattcagtcctcggaagaaaccaagacaccacggcaggatcggacgcccacctaaatatcggaaaatcccccaggaggactttcagaccctgacccccgacgtcgtgcatcagtctctttttatgagcgctttgtcggcccatcccgataggagtctgagtgtgtgttgggagcagcactgtaagctgctcccaggggtggccggaatctccgcaagtacagtcgccaaatggaccatcgacgaagtctttgggtttgtgcagacactgaccggatgcgaggaccaggcacgtctgttcaaggacgaagctcgcatcgttagagttacgcacgtttccggcaagactctcgtgtggacagtggcgcaattgggcgatttggtctgttccgaccacctccaggagggtaagggcatactcgaaaccggcgtccattcactcctgtgtagtctacctacgcacctgctggccaagctgtcttttgcatccgatagccagtattag

SEQ ID NO: 227997 - DNA, 255 bp, Artificial Sequence
  Description of Artificial Sequence: Synthetic coding sequence
atggcgggtgtcgaacaaccaccttcaccagagctgagacaggaaggcgtgactgagtatgaagatggcggagctccagccggtgacggtgaggccggacctcagcaggccgaggaccacccgcaaaacccaccagaggatcccaaccaggatccaccagaagatgactcaacgtgccagtgccaggcatgcgggcctcatcaggcagccggtcccgacctgggatcgtcgaatgacggttgccctcagctatag

SEQ ID NO: 227998 - DNA, 417 bp, Artificial Sequence
  Description of Artificial Sequence: Synthetic coding sequence
atgcatctggttgctggtgactctccagggtccggacctcatctccccgcaacagcattcatcattccggcaagcagtgcaaccctgggcctgcctagctctgcccttgacgtttcttgttttcccagagagcccatccatgttggggctcccgagcaagtggcaggctgcgagcctgtatccgccaccgttttaccgcagctgagcgccggtccagcaagcagcagtacctcgacagtcagacttcttgaatggactgaagctgcggctccccctccaggcggtggcctgcgctttcgcatctcagagtacaaacccctgaacatggctggggtggaacagccaccctcccccgagctgagacaggagggtgtcaccgagtacgaggacggaggggctcctgccggagacggatag

SEQ ID NO: 227999 - DNA, 2217 bp, Artificial Sequence
  Description of Artificial Sequence: Synthetic coding sequence
atgcgacggcgtgaaggacatggtacagacagcgagatgggccagggtccagtccgggagagccaatcatccgaccctccagctttgcagtttagaattagtgaatataaaccattgaacatggccggagtagaacagcccccaagtcctgaactgcgtcaggagggcgtgaccgaatacgaggatggcggagcaccagcaggagacggagaggccggacctcagcaggccgaggaccaccctcaaaatcctccggaggatccgaatcaggatcctccagaggatgattccacgtgccagtgccaggcctgtgggccacatcaggcagccggtccggatctcggcagcagtaacgatggctgtccacagctgttccaagagcgcagcgtcattgtggagaacagctctggcagtacgagcgcatctgaactgctcaaacccatgaagaaaagaaaaagacgagaatatcagtcaccttctgaggaggagtctgaacctgaggctatggagaagcaggaggagggtaaagacccagaaggacagcccaccgctagcactcctgaaagcgaggaatggagtagcagccaaccagcaaccggcgaaaaaaaggagtgctggtcgtgggagagttatttggaggagcagaaggctataaccgcgccagtgagcctctttcaagatagtcaagccgtgactcacaataagaacggctttaaattgggcatgaagcttgaggggatcgacccacagcatccttcaatgtacttcattctgacagttgccgaagtatgcggatatcggctacgcctgcattttgatggctatagtgagtgtcatgatttttgggtaaacgcaaacagccctgacatacaccctgcaggctggttcgagaagacaggccataaattacagccacccaaagggtacaaagaggaggagttctcctggtctcagtatcttcggtcaactagggctcaggccgcaccaaagcatctctttgtgagtcagtctcacagtcctcccccactcgggtttcaggtggggatgaagctggaggcagtggacaggatgaacccctctctggtctgcgtcgctagtgtaaccgatgttgtggatagtaggtttctggtccacttcgataattgggacgatacctatgattattggtgcgacccttcttcaccatacatccatcctgtggggtggtgtcaaaagcagggaaagcccctgacccctccccaagactatccagaccctgacaacttttgctgggagaagtacctcgaggagactggggcttcagcggtgcctacctgggccttcaaagtccggccacctcactcttttctggtcaacatgaagttggaggcggtagacaggagaaatcctgccctgattagagtggctagcgtcgaagacgtggaggaccaccgtatcaagatccattttgacgggtggtcccatggatatgatttctggatcgacgccgatcaccccgatattcatcctgctggctggtgctcgaaaaccggccatccccttcaaccacccctcggaccgcgagagccttcctcagcttcacccggagggtgtcctcctctgtcctatcggtctctccctcacaccagaactagtaagtactcttttcaccacagaaagtgtcctactccaggatgcgacgggagtggccacgtgacaggcaagtttaccgcccatcattgcctatccgggtgtcctctagcagaacggaaccaatcccgattaaaagctgagctatcagacagcgaagcctcggctcggaagaagaaccttagtgggttcagcccccgaaaaaaacctagacaccacggaaggatcggaaggccacctaaatatagaaagatccctcaggaggacttccagaccctcacccccgatgtggtgcaccagtcattgtttatgtctgctctcagtgctcatccagatcggtcactgtccgtctgctgggaacagcattgtaaactgcttcctggggtggcgggaatcagtgcaagcaccgttgcaaagtggactattgatgaagtgtttgggttcgtgcagaccctgaccggctgtgaagatcaagctcggcttttcaaggatgaggtcaggtgcaagtgcagggtgggggatcgtgcaggagtaacagtgcttaagacagccggatccaggtgccccccacaaagacacttctgctag

SEQ ID NO: 228000 - DNA, 870 bp, Artificial Sequence
  Description of Artificial Sequence: Synthetic coding sequence
tgaacgtctggtagtatgccaactccattgaccttcacactcttagccggtagcagacgacgtgccacctcatgctctctgcccaaatccccacctccactgggattccaggtaggcatgaagttggaggccgtagacaggatgaacccctctctggtctgtgtggccagtgtcaccgacgtagtagattcccgctttcttgttcactttgacaattgggatgacacctacgattactggtgcgacccgtcttcaccctacatacatcctgtcgggtggtgtcagaagcagggcaagccattgactcctcctcaagattacccagaccctgataatttctgttgggaaaaatatctggaggaaaccggagcaagcgccgtcccgacatgggcctttaaagtccgacctccacattcctttctcgttaacatgaaacttgaagcggttgatagaaggaaccctgccctaattagagttgcctcagttgaggacgtggaagaccacaggatcaagatccatttcgacggctggagccatgggtatgacttttggattgacgcagatcatcccgacatccatcctgccggatggtgcagtaagaccgggcaccccttgcagccgcctctcggcccaagagagccatcttccgcctccccagggggatgtccccctctctcataccggtctctgccacatactaggacaagcaagtacagctttcaccataggaagtgccccacacctggctgcgatggatctggccacgtgactggcaaattcactgcgcaccactgcctctcaggttgccccttggcagagaggaaccagagtagattgaaggcagagttgagcgactcagaggcttcctag

SEQ ID NO: 228001 - DNA, 327 bp, Artificial Sequence
  Description of Artificial Sequence: Synthetic coding sequence
atggccgcagccatggatgtagatactccttctggcactaacagtggagccggaaaaaagcgttttgaagtgaaaaaatggaatgctgtggcactttgggcatgggacatcgtggtggataattgtgcaatctgcaggaaccatattatggacctctgtattgaatgtcaagccaaccaagcctccgccacaagcgaagaatgtactgtagcctggggtgtttgtaatcatgctttccattttcactgtataagccgatggctcaagacaaggcaggtgtgtcctctagataatagggagtgggagttccagaagtatggacattag

SEQ ID NO: 228002 - DNA, 867 bp, Artificial Sequence
  Description of Artificial Sequence: Synthetic coding sequence
tgacggccacatctgcagaatcagtggcgcaaaaggaagatgaccacttggtcatgtctcgtagctatgattgtgagcggtgtcatcaccgccgtttgggcagtccgtgcggcaccaatttggcgcagccaggtcaaacagaagatgcggatcggaaaacaggggaattgtcggcctccacgatgcatctgttccgctctcggactgctcgcaccatggatggccgttgtcctgtcccaggggaagccccctactaagaaggctaaggtgctgcacaaggccgcttggagcgccaagatcggggctttcctgcacagtcagggcacagggcagctagctgacggaacccccacgggtcaggatgccctggttctaggcttcgactggggtaaattcttaaaggaccattcatacaaagccgcacccgtgtcttgttttaagcatgtcccgctgtacgaccagtgggaggacgtgatgaagggcatgaaggttgaagtactgaacagcgacgctgtgttaccatcccgcgtgtactggatagcatctgtcattcagaccgctgggtaccgggttctgctgaggtacgaaggctttgagaacgacgcttcccatgatttctggtgtaaccttggaacagtagacgtgcaccctattggctggtgcgccatcaattctaagattctcgtgccccctcgtactattcacgccaagtttacagactggaagggatatctgatgaaacggctggttggaagcagaactctgcccgtggattttcatataaaggtgggatccgaaccactaaccgacgtgccgccaagcgccctcccatttttctgcatcctgcacgccacacactggagctag

SEQ ID NO: 228003 - DNA, 3762 bp, Artificial Sequence
  Description of Artificial Sequence: Synthetic coding sequence
atggtagtggcactaagatacgtgtggcccctgcttctatgctcaccctgcctacttattcagatccccgaagaatatgagggacatcatgtgatggaaccgcctgttatcacagagcaatcccccagaaggctcgtggtgttcccgacagacgatatcagcctgaagtgtgaggcctccggtaagcctgaagtccagttcagatggactcgagatggcgtgcattttaagcccaaagaagagctgggggttaccgtctaccagagcccccactccgggagctttactatcaccgggaataactccaatttcgctcagcggttccagggcatctaccgctgcttcgcttctaataagctggggaccgccatgtcacacgagatacgcctgatggcagagggcgctccaaagtggcccaaagagaccgtgaagcctgtggaagtcgaggagggcgaatcagtggttctgccctgcaaccctcccccaagtgccgaaccactgcgcatttactggatgaatagcaagatcttgcacatcaaacaagatgagcgggtcactatgggtcagaatggtaacctgtattttgctaatgtactgacctcagataaccactcggactacatttgtcacgcccatttcccgggtacccggaccatcatccagaaggaacccatcgacctgcgcgtgaaggccacaaactcaatgattgatcgaaagccacgtcttttgtttcctaccaatagtagttcccatctggtggctctccaggggcaacctctcgtactggaatgcatagccgagggctttccaacacccactatcaaatggctgcgaccatccggaccgatgccagctgatcgtgttacttaccagaaccataacaagacattgcaactccttaaggtgggagaggaggatgacggggagtaccggtgcttggccgaaaacagcctgggctcagcgaggcatgcctactacgtgacagtcgaagctgcaccatattggttacataaaccacagagtcacctgtatggaccaggggaaaccgcgagactggattgtcaggtgcagggccgacctcagcccgaggtaacctggcggatcaacggcattccagtcgaggagctcgcaaaggatcagaagtatagaattcagcggggagccctgatcctctcaaatgtacagccctctgatacaatggttacacagtgcgaagcgcgaaacagacacggtctgttactggccaacgcctatatttacgttgtgcagctgccagccaaaattctcaccgcagacaaccagacctatatggccgtgcagggaagcactgcttatctcttatgcaaagccttcggcgctcctgttccctcagtgcaatggctggatgaggatggaacaacagttctgcaggatgaaagattcttcccatatgccaatgggacgcttggcatccgggatctgcaagctaatgacacgggcagatacttctgcttggctgctaacgaccagaacaacgtaactattatggcgaacctcaaggtcaaggacgccactcagataactcagggcccacggtccacgatagagaaaaaaggctccagagtcacattcacgtgtcaggcctcctttgacccttccttacagcctagcattacctggcgcggtgatgggcgtgacctccaggaattaggagattctgacaagtatttcatagaggatgggagactggtgattcacagcctggactattccgaccaggggaactattcatgtgttgctagtactgagctggatgtcgtcgagagccgagcacagcttctggtggtagggtcacctggacccgtccctaggctcgtgttatcagacctgcatctgctcactcaatcccaggtgagagtttcctggtctcccgctgaggatcataatgcgccaatcgagaagtacgatatagaattcgaggacaaagagatggccccagaaaagtggtactcactggggaaagttcctggtaaccagactagtacaactcttaagctcagcccatacgtgcactataccttcagagtgacagctatcaataagtatggtccaggtgaacccagtccagtatccgagacggttgtgacacctgaagccgcaccagaaaagaatccggtggacgtgaaaggggaaggcaatgagaccaccaatatggtgataacctggaagccacttcggtggatggactggaacgctccccaggtgcagtatcgggtgcagtggcgtccccagggtacgcggggtccctggcaggagcagatcgtttccgacccatttctggtagtgtcaaatacaagcacttttgtcccctacgagatcaaggttcaggctgtaaatagccagggtaagggtcccgagccacaggtgaccattgggtattctggcgaagattacccacaggccattcctgaactcgaaggtattgagattcttaacagttccgccgtgctggtgaaatggcgaccagtcgacctggcccaggtcaagggccacctgaggggctataacgtcacttattggcgggagggttcacaacgtaaacatagtaaaagacatattcacaaggatcacgtggttgtgccagctaacacaactagcgtgatcctttcaggactgcggccatacagttcttatcacctggaagtgcaggcctttaacggcagagggagcgggccagcatctgagttcactttttccactcctgagggcgtccctggccaccccgaggcactccatttggagtgtcagtccaataccagtctgctgctgaggtggcagccccctcttagccacaatggggtgctgaccggttatgtgctgtcataccatcctctagacgagggcggtaagggccagctcagctttaacctcagagacccagaactccgaacccataatctgactgacctgtcccctcacctgcgctaccggttccagctccaggcaacgacaaaagagggtccaggagaagctattgtgcgagaggggggaaccatggccttaagcggcatttccgattttggcaatatctcagctactgcaggagagaattattccgtcgtttcttgggtcccaaaagaaggccagtgcaatttcagattccatatcctgttcaaggccctgggggaagaaaaggggggagcttccctgagcccacagtacgtctcatataatcagagtagctatacacagtgggacctccaacccgataccgattacgagatccatctgttcaaggaacgcatgtttagacatcaaatggccgtgaagacgaacgggaccggcagggtgcggttgcctcccgcaggattcgctacggaggggtggttcatcgggtttgtgagcgccatcatcctactgctcctggtgttgctgatcttgtgtttcatcaagcggtctaaaggcggaaagtacagcgtgaaggataaagaggacacccaggtggattccgaagcaagaccgatgaaggacgagacatttggagaatattctgacaacgaggagaaggcatttggatcctctcaaccatctctaaacggcgatatcaagccattgggcagcgatgactcactggcagactatggcggatcggtggatgtgcagtttaatgaagatgggagcttcataggtcagtactccggcaaaaaagaaaaagaagccgctggagggaacgactcatctggcgctaccagtccaatcaacccagctgtggcgttagagtag

SEQ ID NO: 228004 - DNA, 3747 bp, Artificial Sequence
  Description of Artificial Sequence: Synthetic coding sequence
atggtggtggcactgagatatgtgtggcctctgttactgtgttctccatgtctacttattcagatcccggaggagctaatggaacccccagtgattactgagcagtccccgcgacgcctagtcgtcttccctaccgatgacataagcctgaagtgcgaggctagcggcaaacccgaagtacagttcagatggacaagagacggggtgcattttaaacccaaggaggaactcggtgtgaccgtgtaccagtccccccatagcggctccttcactatcacaggcaataattcaaactttgcacagcggtttcagggtatctacaggtgcttcgcgagcaataaattgggaactgcgatgagccacgaaatccgattaatggcagagggcgctccaaaatggcctaaagaaaccgtgaaaccagtcgaggttgaggaaggcgagtctgtggtgttaccatgcaacccccctccaagcgccgaaccccttcggatctactggatgaactccaaaatactccatattaagcaagacgaacgggttaccatgggccagaacgggaacctgtactttgcaaacgtcctcacttccgacaatcattccgactacatttgccacgcccactttcccggtaccagaactattatccagaaagagcccatcgatctcagggtaaaggcaacgaactccatgattgatcgcaagcccagacttttattccccacaaatagttcaagccatctggtcgctcttcaggggcaacccctggtactggagtgcatcgccgaaggcttccctacacccaccatcaagtggttacgcccaagtggccctatgcccgcagaccgtgtgacttaccagaaccataacaaaactctccagctgcttaaggtgggcgaggaggatgatggtgagtaccgctgcctcgctgagaactcactggggtctgctcgccatgcatactacgttacagtcgaagccgctccttattggctgcataaaccgcagagtcacctatacggccctggggagaccgccaggctggattgtcaggtccaaggccgaccccagcctgaagtgacctggcgcattaacggaataccagttgaggaacttgctaaggatcagaaatataggatacagaggggagctcttatcctgtccaacgttcagccctccgacaccatggtaactcagtgcgaggcccgtaacaggcatggcctgctgctcgcaaatgcatacatctacgtggtgcagctgcccgcaaaaattctaacagcagacaaccagacttacatggccgttcagggtagtacggcctaccttctctgcaaagcatttggcgcaccggtcccatccgtccagtggttagacgaagatgggacaaccgtcctccaggatgaacgcttcttcccctacgcaaatggcaccctcggcataagggatctgcaggcgaacgatacaggcagatatttctgtctggctgccaacgatcagaacaatgtcacaataatggctaacctgaaagtgaaggacgcgacacagatcacacaaggcccacgaagcacgatcgaaaaaaagggctcaagggtcaccttcacatgccaggcttcatttgacccaagcctccagccgagcatcacctggcgcggagacggccgtgatctgcaggaactgggcgactctgataaatactttattgaggatggtagacttgtgatccacagtttggactactcggaccagggaaattactcctgtgttgcatccacagagctggacgtggtcgagtcccgggctcagctgctggtggtgggatcccctggacccgtgccgcgtctggtgctttctgacctccacctcctcacccaatctcaagtgcgcgtgagttggtcacccgctgaagatcacaatgcccctatcgagaagtatgatatcgaatttgaggacaaagaaatggcccctgagaaatggtatagccttggcaaagtgcccggtaatcagacaagtaccaccctcaagttgtcgccttacgtacattacacttttcgggtgaccgccataaacaaatacgggccaggagagccgagtcctgtatccgaaaccgttgtgactcccgaggccgctccagagaagaatcccgtggatgttaaaggcgagggtaacgaaactaccaacatggttattacctggaagcctttacgttggatggactggaatgccccacaggtacagtatagggtgcagtggaggccacaaggcacgcggggaccatggcaggagcagattgtgagcgaccccttccttgtagtgtctaacacctcaacattcgtaccatacgagatcaaagtacaggcagttaactcacaaggcaagggccctgagccccaggtgacaatcgggtacagtggagaggattaccctcaggcgatcccagaattggagggaatagagatactcaactcatctgccgtgctggtcaaatggcgaccagtcgacctggcacaggttaagggtcacttgagggggtacaacgttacttattggcgggagggttcgcagcggaaacattcgaagcggcatatccataaggatcacgtagtagtcccagcaaatacgaccagtgtgatcctgtctggtctgcgcccatactcaagttatcatttggaggttcaggcttttaacggtagggggagcggccctgcatccgaattcaccttttctacacccgagggagtccccggacatcctgaggccctgcacctggagtgtcaaagtaacacttccctgctgcttcggtggcagccacctctctcccacaatggggtgcttaccggttacgtgttaagttaccaccccctggacgaggggggtaaggggcagctcagtttcaatctgcgggatccagaattgaggactcacaacctgactgacctttccccccacctgcgctaccgcttccagttgcaggctaccacaaaggagggccctggtgaagccattgttcgcgagggtgggactatggcactatcgggaatcagtgactttggcaacatcagcgcaaccgcaggagagaactactctgtggtcagttgggtgcctaaggagggtcagtgcaacttccgcttccacatacttttcaaagcactgggtgaggagaaaggaggagcttccctgtcaccacaatatgtgtcctataatcagtcatcttacacccaatgggatctgcagcccgacacggattatgagattcacctcttcaaggagaggatgtttcgacaccaaatggccgtgaaaacaaatgggactggacgtgtccgactgccacccgctggctttgcaaccgagggatggttcatcgggttcgtgagtgcaattatcctgttgctgctggttctgctgattctatgtttcatcaagagaagtaagggcggaaagtactctgtgaaagataaggaggacactcaagttgattccgaggctagaccaatgaaggatgaaacgtttggagagtactccgataatgaggagaaagcattcgggagcagccagccttcgctgaatggagatatcaaaccccttgggtccgacgactcactggctgactatggcggatcagttgatgtacagtttaatgaagatgggagcttcatcgggcaatactctgggaagaaggagaaggaggctgctggaggcaatgattcatcaggggctacctctcctattaatccagcggtcgccctggagtag

SEQ ID NO: 228005 - DNA, 3747 bp, Artificial Sequence
  Description of Artificial Sequence: Synthetic coding sequence
atggtggtcgctttgagatacgtgtggcccctcctactctgctccccctgcttgctcattcagattcccgaggagctcatggaacccccagtaattacagagcaatcccctagacgcttggttgtattccctacagacgatattagtttgaagtgcgaagcctcggggaagccggaggtccagttccggtggaccagggatggggtccactttaagcccaaggaggagctcggggtgacagtataccagtctccacactccggctctttcactataaccggaaacaactccaacttcgcccagaggttccagggcatctatagatgttttgcgtctaacaagctcggtaccgctatgtctcacgaaattcgactcatggctgagggcgcacctaaatggccaaaagaaacggtgaaaccggttgaggtggaagagggcgagtccgtggtccttccctgtaacccacctccaagcgccgagccactgcggatatattggatgaattctaaaattttacacataaagcaggatgaacgggtgacaatggggcaaaacgggaacctgtactttgctaatgttctcacatccgacaaccactctgattacatctgccacgctcattttccaggtacccgtaccataatacagaaagaacccatcgatctgcgcgtgaaggccaccaatagtatgatagatagaaagccgagattgctctttcccacaaacagttcctcccacctggttgccctgcagggacagcctctagtgctggagtgtatcgctgagggattccctaccccaactatcaaatggttgagaccatcaggcccaatgcccgcagatcgtgtaacataccagaatcataacaagacactgcagctattgaaggttggcgaggaggatgatggcgaatacagatgtctggctgaaaattctctgggctcagccaggcatgcctattatgtgaccgtcgaagcagccccttactggttgcataaacctcagtcccatctgtacggccctggagaaaccgcccgactggattgtcaagtccagggcaggccacagcctgaggtcacatggcgaatcaatggaattcccgtggaagagctagccaaggaccagaagtaccgtattcagcgcggtgccctgatcttatccaatgtccaaccaagcgacactatggttactcagtgtgaggcgaggaaccggcacggcttgctgctggccaacgcttacatttacgtggttcagctccctgctaaaattctgactgccgataaccagacatatatggccgtccagggcagcactgcttatctcctgtgcaaagcttttggggcaccagtcccaagtgtccagtggctcgacgaagatggaactaccgtcctacaggacgaacgattttttccttatgcaaacggcactctggggatccgagacctgcaggcgaacgacacgggtcgctacttctgtctcgcagccaacgaccagaacaacgtgaccatcatggcaaatttgaaggtgaaagacgctactcaaatcacccaaggaccgaggtctacaatcgagaagaagggctccagggtgacctttacatgccaggcgtcatttgatccaagcctgcagccatcaatcacctggcggggagatggccgagacctgcaggaactcggggacagtgacaaatactttatcgaagatggcagactggtaattcattccctcgactactccgaccagggtaactactcctgcgtggcaagcaccgagctcgatgtagtggagtcccgggctcagcttctggtcgttggttctccagggcctgtgccaaggctggtcctaagcgacctgcatctactgacccaatcccaggttcgtgtaagttggtcaccagcagaagaccataacgctcctatcgagaagtatgatatcgaattcgaggataaagagatggccccagagaaatggtactcactgggtaaagtgcccggaaaccagacctctacgacactgaaattgtctccatatgtgcactataccttcagggtcacagcgattaacaagtacggtcctggcgaaccaagccccgtctcagaaactgtggtcacccccgaagctgcgcctgagaaaaatcccgtcgacgtgaaaggagaggggaacgagacaacaaacatggtcattacctggaaacccttgcggtggatggattggaacgcaccgcaggtccagtaccgggtgcagtggcgtccccagggtacaaggggcccttggcaggaacagattgttagtgacccatttctggtcgtaagtaacactagcacatttgtgccctacgaaataaaagtccaagcggtgaacagtcagggaaagggccctgaaccccaggtcactatcgggtattctggggaagactatcctcaagccattccagagctcgaaggaatagagatcctcaactctagtgcagttttggtgaaatggagacccgtggatctggctcaggttaaggggcatttaagaggctacaatgtgacatactggcgcgaagggtcccagcgtaagcatagcaaacgccatatccacaaggatcacgtcgttgtccccgcaaacactactagtgtcattctatccggacttcggccttactcttcctatcacctagaggtgcaggccttcaatggtcgcggatctggcccagcctcagagtttacgttctctactcccgaaggtgtgccgggtcatcccgaagctttgcacctcgaatgccaaagcaataccagcctcttactgcgctggcagccacctctgtcacacaacggcgtgctgacagggtatgtgctgtcgtaccacccgctagacgaaggcggaaaaggtcaattgtcctttaatttacgcgatccagagcttagaacgcacaatcttaccgatctgagccctcacctccgttatcgcttccaattgcaggcgaccaccaaagaaggcccaggagaggccatcgttagggaggggggaactatggcgctgagcggtattagtgattttgggaacatctcagccactgctggagagaattatagcgtggtgagctgggtgccaaaagagggccagtgcaacttccgttttcacattctctttaaagccctcggagaggaaaaaggcggagctagtctgtcaccacaatatgtcagttacaaccaatcttcctatacacagtgggatctgcagccggacacagactacgagatccacctgtttaaggagcggatgttccggcaccaaatggcagtcaaaaccaatgggacggggagagtgcggctccctcctgcagggtttgctactgagggatggttcataggattcgtgagtgcaatcatactccttctgctggttctgttgattctgtgttttattaaaaggtccaaaggcggaaagtacagcgtgaaagacaaagaggatacgcaagtagattccgaggctcgcccaatgaaagacgagaccttcggagaatactcggacaacgaggagaaggccttcggaagctcgcagcccagtttgaacggcgatatcaagcccctaggctccgacgactccttggcagattatggcggatccgttgacgtgcaatttaacgaagatggatcattcataggccagtactccggcaaaaaagagaaggaggcagctgggggtaacgactcatccggggctacatccccaatcaatcctgctgtcgcgctcgagtag

SEQ ID NO: 228006 - DNA, 3774 bp, Artificial Sequence
  Description of Artificial Sequence: Synthetic coding sequence
atggtagtggcattacgatacgtgtggccgctacttttgtgctcaccatgtctgctgattcagatacctgaagagtacgaaggccatcatgtgatggaaccccctgtcattactgagcaatcaccacgcagactcgtcgtttttcctacagatgacatttcactcaagtgtgaggccagcgggaagcccgaggtacagttccgatggaccagggacggggtacatttcaaacctaaagaagagttgggtgtgaccgtgtaccagtccccacattccggcagtttcacaattacaggaaataactccaatttcgcccagcgctttcaaggcatataccgttgctttgcttccaataaacttggcacagctatgtctcatgaaatccggctgatggcggaaggcgctcctaagtggccaaaggaaacggtgaagccagtggaggtggaagaaggggagtctgtagtcctgccctgcaatccccctccaagcgcagaacccctgcggatatattggatgaactcaaaaattttgcatattaagcaggatgagagagtgacaatgggccagaacgggaacctttatttcgccaatgtgctgacctccgacaaccacagcgattacatatgccacgcgcatttccctggcactcggaccattatccagaaagagcctatcgacctgcgcgtgaaagctaccaattccatgatcgatcgaaagcctcgcctactgtttcctactaattcatcctcgcatctcgtcgctctgcagggacagccgctggtgttggagtgcatcgccgagggttttcctacaccgaccatcaaatggcttcgcccatctggtcccatgcctgctgatcgcgtaacgtaccagaaccacaataagactttgcaactccttaaagtcggtgaggaagatgatggcgagtacagatgcctggcagaaaactctctaggcagtgcacgccatgcatactacgttaccgtagaggccgctccctactggctgcataagccccaaagtcatctctacggccctggtgaaaccgcccgtcttgattgtcaggtacagggcagacctcaacctgaggtcacatggagaattaacgggattcctgtggaagaactggctaaggaccagaagtaccgaattcaacgcggtgctctgatccttagcaacgtgcaaccgtctgacaccatggtgacccaatgtgaggcacgaaaccgccatggtctgttactcgctaacgcatatatctacgtggtgcaactgcctgccaaaatcctcactgccgataatcagacatacatggcagtccagggatccacagcctatctgttgtgcaaggcctttggcgcacccgtgccatccgtgcaatggttggacgaggacggcactaccgttctccaagacgagagatttttcccatatgccaatggcacactagggattcgagacctccaggcaaatgatacaggcaggtacttctgcttggcagccaatgaccagaacaatgtaacgataatggccaacttaaaggttaaggacgcaacgcagataacccagggcccacgctctacgatcgaaaaaaagggtagcagagtcaccttcacctgtcaagccagcttcgatcccagcctacagccaagcattacctggcgtggtgatggcagggatctgcaagagttgggtgattcagataaatactttatcgaagacggcagactagtcattcattccttggactatagtgaccaaggaaactactcatgtgtggctagcaccgagttggatgtcgtcgagtcacgtgcccagctgctggtggtagggtcccccggacctgtgcctaggttggtactttctgacctgcacctactaacccaatcccaggtgagagtgtcctggagtcccgcagaagatcacaacgcccctatcgagaagtatgatatcgagtttgaagataaagaaatggcccctgagaagtggtatagtctcggtaaagtacctgggaatcagacatctaccacacttaaactgtcgccatacgtgcattacacctttcgcgtgaccgcaatcaacaaatacggacctggagagccgagccccgtgagtgagacagttgtgacacccgaggcggcaccggagaagaatccagtcgacgtgaaaggggaaggaaatgagaccactaacatggtgattacgtggaaacctttgcgctggatggattggaatgcccctcaggttcaatatagagtacaatggagaccgcaagggaccaggggaccatggcaggaacagatcgtgtcagatccatttctggtggtgtccaatacctcaacctttgtgccatatgaaatcaaggttcaggctgttaacagtcagggcaaaggcccagaaccacaggtgaccattggttacagcggcgaagactacccccaggctattcccgaattggagggaatcgagattcttaattcctccgctgtgctggtaaaatggaggcccgtcgacctcgcccaggtgaaggggcatctccggggttacaatgtgacctactggcgagagggcagtcagcgcaagcattccaagcgtcacatccacaaggaccacgtggtggtgcccgcaaataccaccagtgtgattctgagtggactccggccatacagctcgtaccatctggaagtgcaagccttcaatgggcgtggtagtgggcctgcctccgagttcaccttctctaccccagagggggttccgggacaccctgaggcactccacctggaatgccagtctaatacatcactattgttacggtggcagcccccactgtcccataacggcgttctcaccgggtacgtcttatcttatcatcccctcgacgaggggggtaagggccagttgtccttcaaccttagagaccctgagctgcgcacccacaatctgactgatctcagcccccacttgaggtaccggtttcaacttcaggccacaacaaaagaaggaccgggagaggccatcgtgcgggagggcggtacaatggccctctcaggcattagtgattttggcaacatttcagctaccgctggggagaattacagcgttgtgagctgggtgcccaaagagggccaatgcaactttaggtttcatattctgtttaaagcgctcggggaggaaaagggcggagctagcctgagtccgcaatatgtatcatacaatcaatcttcttacacacagtgggatctgcagcccgatacagactatgagatccacctttttaaagagcgtatgttccgccaccaaatggccgtcaagacaaacggaacagggagggtacgtcttcctcctgcaggtttcgccactgaagggtggtttattggcttcgtgagcgcaattattcttcttctcctcgtccttctcatattatgctttattaagcgctctaagggtggcaagtattcagtgaaggacaaggaggatacccaggtcgactccgaagcccgtcccatgaaagatgagactttcggggagtaccgaagccttgagtcagacaacgaggagaaggccttcggaagctctcagccctcgctgaacggtgacattaagcccttggggtctgacgacagcttagccgactatgggggatcagtggacgtgcagttcaatgaggatggatcctttattggccagtatagcgggaaaaaagaaaaggaagcagccggtggtaacgatagctcgggcgctacctcccctataaatccggcagttgctcttgaatag

SEQ ID NO: 228007 - DNA, 3774 bp, Artificial Sequence
  Description of Artificial Sequence: Synthetic coding sequence
atggtggtagccctgaggtacgtatggcccttgttactctgctcaccgtgtctactgatccagattcccgaggaatatgagggacatcacgtcatggagcctcctgtgattaccgaacagtcacccagacggctggtggtattcccaacagatgacatttccttgaagtgcgaggcctccggaaagccagaggtacaattccgctggacccgggatggagtccacttcaaaccaaaagaggagctgggggtgacggtgtaccagagcccccattctggttcattcacaattacaggcaataactccaactttgcccagaggtttcagggtatctataggtgctttgcctctaacaaattgggtacagcaatgagtcacgagattaggctgatggccgagggcgcaccaaaatggcctaaagagacagtcaagcctgttgaggtggaggaaggtgaaagcgtggttctcccatgtaatcctccccctagcgccgaacccctccgaatctactggatgaattcaaagatcctgcacatcaagcaggacgaacgtgtgacaatgggtcagaacgggaacttatatttcgccaacgtccttaccagcgacaatcattcagattacatttgtcatgctcacttccctgggacaaggactattatccagaaagagcctatcgacctgagagtgaaggccaccaatagtatgattgatagaaagcctcgcctcctgttccctacaaacagctcttcgcatctggtggctctgcagggtcagcctctcgtgctagaatgtatcgcagaaggtttccctacccccactatcaagtggctgagacccagtggccctatgcccgcagatcgcgtcacttaccagaaccataataaaacactccagttgttaaaggtgggtgaggaggacgatggagaatatagatgcctcgcagagaactccctaggttctgctaggcacgcttattatgtaaccgttgaagcggcaccctactggctgcacaagcctcagtctcacctttatggccctggtgagactgccagacttgattgccaggtgcagggacgccctcagcccgaggtgacctggcggatcaatggtattccagtggaggaactcgctaaggaccagaagtaccgtatacagcggggagccctgatcctatcaaacgtccagccgtctgacacaatggtcacccagtgcgaagctagaaaccgccatgggctgttactcgcgaatgcatatatctatgttgtgcaactgcccgcaaagattctcactgctgacaatcagacttatatggctgttcagggctcaacggcctacctgctatgcaaagcgttcggtgcccctgtgccaagcgttcagtggttggacgaggacggcactactgtcttgcaggacgagcgttttttcccatatgccaatggtaccctcgggatcagggacctccaagcaaacgacactggacgatatttctgcctggccgctaacgaccaaaacaacgtgacaattatggccaacttgaaagtcaaagacgccacgcagatcacacagggacctagatccactatcgaaaagaaaggcagccgagtcacttttacctgtcaagctagtttcgatccaagtctgcaaccttcgattacttggcggggtgatgggagggatctgcaggaactgggggattcagacaaatacttcattgaagacggccgtctcgtgatccacagtctcgactatagcgatcagggtaactattcctgtgtggcttccaccgaactagatgtagttgagagtagagcacaactgctggtcgtcggctcccctggcccagtcccgagattggtgttgtctgacctccacctgcttacgcagtctcaggttagagtgagttggagccccgctgaagaccataacgcacctattgagaagtacgatatcgaatttgaggacaaggaaatggcacccgagaagtggtatagtctgggcaaggttcccggaaatcaaacctctaccaccctcaagttgtcaccatatgttcactatacattcagagtgacagctatcaacaaatacgggccaggagagccttcccccgtgtcggagaccgtggtgacccctgaggccgcacccgagaagaaccctgttgacgttaagggagaggggaacgaaaccacgaacatggtcatcacatggaagcccctgaggtggatggactggaatgcaccacaggtgcagtacagggtgcagtggcggccacagggaacgagaggaccctggcaggagcagatcgtgagcgatccgttcttggtggttagcaatacgtctacattcgtcccttacgagatcaaagtccaagctgtgaacagtcagggcaaaggcccagagccccaggttaccataggatacagcggtgaagattacccgcaggccattccagaactcgagggcattgagatattaaatagctctgctgtgctagtgaaatggcgcccagtggatctagcccaggtaaaggggcatttgaggggctacaatgtaacgtactggagggaggggtctcaaagaaagcacagtaagagacatatccacaaagatcacgtcgtcgtgcccgcaaacaccacaagcgtaatcctgtcaggtttaagaccttacagttcctatcatctcgaggtgcaggcttttaacggtcgcggttcaggacccgctagtgagtttaccttctccacccccgagggggtcccaggccatccagaagctcttcacctggaatgccagagcaacacctcactgctgttgcggtggcaacccccactgtcccataatggcgtgctgactggctacgtactgtcgtatcaccctcttgacgaggggggaaaagggcaactaagctttaatctgagagatccagagctccggacccataatctgaccgatctcagcccccacttgaggtacaggtttcaactgcaggccacaacgaaagagggccctggggaagcgatcgtgcgcgaagggggaacaatggcgctttcaggaattagtgacttcgggaatatatcagcaactgctggcgagaattacagtgtggtatcttgggtcccaaaggagggccaatgcaactttcggttccacatcttgttcaaggccctgggggaagagaaaggaggggcatcattatccccacaatatgtctcatataatcaatcctcctacacccagtgggatctccagcccgacacagactatgagattcacttgttcaaggagagaatgttccgtcaccagatggccgtgaagaccaatggtactgggcgtgtgagactgccgccagccggattcgcaaccgagggctggttcataggattcgtgtctgccatcatcctgttgctcttggtgctgctgatactgtgcttcatcaaacggagtaagggtggcaaatactcggtcaaggacaaggaagacactcaggtggactccgaggctcggcctatgaaagacgaaacatttggtgaatatcggtctttggaatcagacaacgaagaaaaggctttcggtagttcgcaacccagccttaacggcgacattaagccactcggatccgacgacagcttagcggattatggcggatctgttgatgtgcaattcaatgaagacgggtctttcatcgggcagtactcaggtaaaaaggagaaagaggccgctggtggaaacgacagctccggcgcaacctcaccgattaatcccgcagtggccttagaatag

SEQ ID NO: 228008 - DNA, 456 bp, Artificial Sequence
  Description of Artificial Sequence: Synthetic coding sequence
atggtcgttgccctgaggtacgtgtggcccttgctgctttgtagcccttgcctactaatacagattcctgaagagtacgaaggtcatcacgtcatggaacccccagtgatcaccgaacaaagtccacgcagacttgtagtatttcctaccgacgatattagtctgaagtgcgaggcgagcggcaagccagaggtgcaatttcggtggacacgtgacggggtgcactttaaaccaaaggaggagttaggagtcaccgtgtaccagagcccacactcgggatcgttcaccatcaccgggaataactccaactttgctcagagattccaaggtatctatcgctgcttcgcatcaaacaaactcggaaccgcgatgtctcacgagattaggctgatggctgagggtgcaccaaaatggcctaaggaaactgtcaagcccgtcgaagtggaggaggggtag

SEQ ID NO: 228009 - DNA, 255 bp, Artificial Sequence
  Description of Artificial Sequence: Synthetic coding sequence
atggtcgttgccctgcgttacgtttggccactattgctctgcagcccatgccttctgatccagatccctgaagaatatgagggccaccacgtaatggagccaccagtgatcaccgagcagtcccctagacgtcttgtggtgttccctaccgacgacatctctctcaaatgcgaggctagtggcaaaccagaagtgcagttcaggtggacacgggacggtgtgcacttcaaacctaaggaagagctgggggtttag

SEQ ID NO: 228010 - DNA, 3768 bp, Artificial Sequence
  Description of Artificial Sequence: Synthetic coding sequence
atggtggtggctcttaggtacgtctggcctctgctgctgtgcagtccgtgtctgctaatccagatcccagaagagtctttccctggacatcgcgttgttatggagcctcccgtgatcactgagcaatcacctaggcgactggtggtttttcctaccgacgacatttcgctgaagtgcgaagcctctgggaagcctgaggtccagttcagatggactagagacggtgtgcattttaagccaaaggaagagttaggagtcaccgtgtaccagagtccccatagtggcagtttcactattactggaaacaatagtaatttcgcccagcgattccagggaatctataggtgtttcgccagcaacaaactgggcacggccatgtcacacgaaatacgcttgatggctgaaggggctcccaagtggccgaaggaaaccgttaaaccagtagaggtggaagagggagagagtgttgtgctgccctgtaatcccccacccagcgccgagccactgcggatctactggatgaactccaagatcctgcatattaagcaggatgagagagtgaccatggggcagaatgggaacctgtattttgctaatgttctcacttccgataatcatagtgactacatttgtcatgcacactttcctggtactagaaccataatccagaaggagcctattgatctgagagtgaaggctacgaattcaatgattgataggaagccccgactgctgtttcccacaaattcatcaagccacctcgtggcgctccaaggccagcctctcgtgctggagtgtatcgctgaagggttcccaacacctacaatcaagtggctgaggcctagtggaccgatgcccgctgacagagtaacctaccagaaccacaacaagacactgcagcttctgaaagtgggagaagaagatgacggggaatatcgatgtcttgccgaaaattcactgggctctgcacggcacgcctactatgtcactgtcgaagcagcaccttactggctgcacaaacctcagagccacctttacggaccaggcgagacagccagacttgactgccaagtgcaaggtagacctcagcctgaggtcacctggcggataaatggtattcctgtcgaggaattagctaaagaccagaagtatagaatccagagaggggctctgattcttagtaatgtccagcccagcgacaccatggtaacccagtgcgaggcgagaaatagacacggcctgttgttggccaatgcgtacatctacgtagtgcagctgcctgccaaaattctcaccgccgacaatcagacatatatggctgtccaagggtctacagcttacctactgtgcaaggctttcggagcccctgtgccctcagtacagtggcttgatgaggatgggacaactgtgctgcaggacgagcgcttctttccttacgcaaacgggactctgggaattcgagatctgcaagctaatgataccggccgatacttttgcctcgctgcgaacgaccagaacaacgtaactattatggctaatttgaaagtcaaggacgccacgcagattactcagggcccaagatctacaatagaaaaaaaaggctcgcgagttactttcacctgtcaggcaagcttcgacccctctctgcagccaagcatcacctggcggggagacggaagggacctccaagagctgggcgattccgataaatacttcatcgaagatggcaggctcgttatccacagcctggactatagcgatcagggtaactactcttgtgtggcttctacagaacttgatgtcgttgagtctcgtgcccagcttttggtcgtgggctcccccggtccggtcccgcgtctggtcctcagtgaccttcatcttctcacacaaagtcaggtgcgggtatcttggtctcctgctgaggaccacaatgcccctatcgaaaagtacgacatcgaattcgaggataaagagatggcgccagaaaagtggtattcgctcggcaaggttcctggaaaccaaaccagcaccacactgaagctctccccttatgtgcattatacctttcgagtgaccgctataaataagtacggcccaggcgaacctagccccgtgtccgagacagtggtaactccagaagccgcacccgagaagaatcccgtagacgttaagggcgaaggcaatgagaccaccaatatggtgatcacctggaaacctcttagatggatggactggaatgcccctcaggtacagtatcgcgtccaatggaggccacagggaacacgagggccttggcaggaacagattgtgtctgatcctttcctggtggtcagcaataccagtacttttgtgccttatgagataaaggtgcaggccgtgaacagtcaaggcaaagggcctgagccacaggtcaccattgggtacagcggcgaagattacccccaggccatcccagaattagaaggtattgaaatccttaattcttccgcggttctggtcaagtggaggccggtcgacctggcccaagtgaaaggccacctgcggggatataacgtgacttattggcgggaggggagccagagaaagcacagcaagcgacatatccacaaagaccatgtcgtggtgcccgcaaacaccacctctgtgatactgtctggcttacggccatatagcagttatcacttggaggtccaggcctttaatggcagaggatcaggcccagcctctgagttcacattcagcaccccagaaggtgttccagggcacccggaggctctgcacctcgagtgtcaaagtaacacctctctcttactgcgctggcagcctcccctgagtcacaatggtgtgctaacaggatacgtcctgagctaccacccattagatgaggggggaaaaggccagctatccttcaacctgcgcgaccccgagcttaggacgcataatctgaccgacttgagcccgcacctgaggtatcggtttcaacttcaagccacaaccaaggagggaccgggagaggcgatcgtcagagagggaggaactatggctctatccgggatctctgattttggaaacattagtgccacggctggggagaactatagcgtcgtctcttgggttcctaaggaggggcagtgcaactttcgctttcatattctgtttaaagcgttaggggaagaaaaggggggtgccagcctctcaccccaatacgtctcttacaaccaaagtagctacacacaatgggacctgcaacccgatacagattatgagatccacctattcaaggaacgcatgttccgacaccagatggcagtgaaaacaaatggtaccggtagggtgcgcctgccccctgcaggattcgcaaccgaggggtggtttatcgggttcgtgtcagccatcatacttctactactcgtcctcctgatcctttgctttattaaacggagcaaggggggaaagtatagcgtgaaggataaagaggacactcaggtggatagcgaagccagacctatgaaagatgagacgtttggagagtactccgataatgaagagaaggccttcgggagtagtcaaccttctctgaatggtgatatcaaacccctggggagtgatgacagccttgctgattacgggggaagcgtggatgtccagttcaacgaagatggatcatttattggtcaatactccggaaaaaaagagaaggaagccgctggaggaaatgactcaagcggggctacctccccaattaatcccgctgtggctctcgaatag

SEQ ID NO: 228011 - DNA, 351 bp, Artificial Sequence
  Description of Artificial Sequence: Synthetic coding sequence
atggcagaaggggctcctaagtggcctaaagagactgttaagcctgtagaagttgaggaaggcgaatctgtcgtccttccctgtaatcccccaccttcggccgaacctctgcggatctactggatgaattccaaaattctacacattaagcaagacgagcgcgtgaccatgggccagaacggtaacctgtatttcgccaatgtcctcactagtgacaatcatagtgattacatttgtcatgcacacttccccggtacaaggacaataatccaaaaggaacctattgatctccgcgttaaggctacgaacagtatgatcgatcgcaagcctcggcttctcttcccgacgtag

SEQ ID NO: 228012 - DNA, 3780 bp, Artificial Sequence
  Description of Artificial Sequence: Synthetic coding sequence
atggttgtggccctccggtacgtctggccgctgctgctgtgctctccatgcctgctgatccagattccggaagaaagcttcccaggccatagagtggtgatggagccaccagtaatcacggaacagtctcctagacgtctggtggttttcccaacagacgacatctccctgaagtgcgaagcttcggggaagcctgaagtgcagttcagatggacacgagatggggtccacttcaagccaaaagaggaactgggagtgaccgtataccagtcgccccactcaggttcattcacaattacgggcaataacagcaactttgcgcagcgattccaaggaatctaccgatgctttgcttccaacaaactgggtacagcaatgtcgcatgagatccgcctgatggccgagggggctcctaagtggcccaaggaaaccgtgaaaccagttgaagttgaggagggagaaagcgtcgtgctgccctgtaacccaccgccaagcgccgagccgctgcgcatttactggatgaactcaaagatcctgcatataaaacaagacgagcgtgtgacgatgggccagaacggcaacctctattttgcaaacgtattgaccagcgacaatcactcagactacatatgtcacgctcacttccccggaacgcgaactatcattcagaaagagccaattgatctgcgcgtgaaagccacaaattctatgatcgatagaaaacccagactcctgttcccaacaaattcctcgtcacatctcgtcgcattgcagggccagccgcttgtcctcgaatgtatcgcagagggatttcccaccccaacaatcaaatggttgcgcccatctgggccaatgcccgcagatagagtgacctatcaaaaccacaacaagactctgcagctgttgaaggtgggcgaagaggatgatggagagtaccgctgcttggccgaaaactcgctgggctcggcccgacacgcgtattatgtgactgtggaagcagcaccttattggttgcataaaccgcagtcacatttgtatgggccaggagaaactgctcggctcgactgtcaggtccaaggcaggccacagccggaagttacctggagaataaacggaattcctgtggaagagttggctaaggaccagaagtacagaatccagcggggtgccctcatcttgtctaacgtccagccaagcgacaccatggtcacccagtgcgaggccagaaatcgccacggccttctacttgctaacgcttacatctacgtcgtccagcttccagctaaaatcctgacagcagataaccagacatacatggccgtacagggcagcacagcataccttctgtgtaaagcgttcggagctccggtcccgtccgttcagtggctcgatgaagatgggaccactgtcctgcaggacgagagatttttcccctatgccaacggcacactggggattagagacctgcaggccaatgacactggacgatacttctgcctggccgcaaacgaccaaaacaatgtgaccattatggcaaatcttaaagtgaaggatgcaactcagatcactcaggggccacgctctacaattgagaaaaaaggttcacgcgtcacgtttacctgccaggcatcatttgacccaagcctccagccatccattacatggaggggggatggacgggatctacaggagctgggcgacagcgacaaatatttcatcgaggacggccgattggtgatccactcattggactacagtgatcagggtaactactcctgtgttgcttccaccgagctcgatgtggtcgagtccagggctcaactgctggtcgtcggttcaccgggtccagtaccgagactggtgttgagcgatctgcacctgctgacccagtcacaagtgcgtgtcagttggtctcccgctgaggaccacaacgctccaatcgaaaaatacgatattgagtttgaggacaaggagatggctccggaaaagtggtactcgctcggaaaagtgcctgggaaccagacaagcaccaccctgaaactttcgccctatgtgcattatacattccgagtgaccgcaattaacaaatacggtccaggcgaaccctcaccagtctcagaaacagtggtcactcctgaagccgcaccggaaaagaaccctgtggacgtgaaaggcgagggcaatgaaacaaccaatatggtgatcacctggaagcctcttcgatggatggattggaacgcccctcaggttcagtacagagtgcaatggcggcctcagggcacccgaggtccctggcaggagcagatcgtgtcagacccatttctagtagtcagcaacacttctaccttcgttccctatgaaattaaagtgcaggccgtcaactcccaaggcaaaggccctgagcctcaggtgaccattgggtacagcggtgaagactatccgcaagctattccagagctagaaggcatagaaattctcaatagtagcgcggtcctcgtgaagtggaggcccgtcgatctggcccaggtaaagggccatctgcggggatataacgtgacatattggagagaaggctcgcaacgaaaacatagtaagaggcatatccacaaggatcacgtcgtggtcccagccaatacaaccagcgtgattctgtcaggactccgaccatacagctcttaccaccttgaagtccaggcattcaatggacgcggaagtgggcctgcttctgagttcacgttctcgacacctgaaggagtgcccggtcatccagaggctctgcacttggaatgtcagtccaatacaagcctgctgctacgttggcaacctcctctttctcacaatggggtgctcactggatatgtcctttcttaccaccccctggacgaaggtggaaaggggcagctgtcctttaatctcagggatcccgaactgcggacgcataacctgactgacttgagcccacatctgcggtaccgctttcagttgcaggcgacaaccaaggagggtccgggtgaggctatagttcgcgaggggggtactatggcactcagcgggatctctgacttcggaaacattagtgcaaccgctggagaaaactattccgtggtctcttgggttccaaaagaggggcagtgcaatttccgatttcacatactcttcaaggcactaggtgaggaaaaggggggagcttcactgtccccacagtatgtttcttacaatcaatcttcctacacccagtgggacctacagcctgatactgattatgaaatacacttgttcaaggaaagaatgtttcggcatcagatggccgtgaagaccaatggcactgggagggtgcgcctgccccctgcagggtttgcaaccgagggctggtttattgggttcgtgtccgccatcatactgcttctgctagtccttctgattctttgctttattaagcgctcgaagggcggaaagtactctgtcaaagataaagaggacacccaggttgactctgaggccaggcccatgaaggacgagaccttcggagaataccgatctctcgaatcagacaacgaggagaaagcttttgggtcgtcccagccctccctcaatggggatattaaacctcttggatctgacgatagtctcgcagactatggaggctcagtcgatgtgcagttcaatgaggacggatcattcataggtcaatattctggaaagaaagagaaggaggcagctggtgggaacgactctagcggggctacatcccctataaaccccgctgtggcgctggagtag

SEQ ID NO: 228013 - DNA, 1326 bp, Artificial Sequence
  Description of Artificial Sequence: Synthetic coding sequence
atggtgcctgctttaaggtaccttgtgggggcatgcgggcgagcaaggggtctgtttgcaggtgggagtcctggagcatgtggctttgccagtggacgccctcgcccactgtgtgggggatcgcggagcgcttctacaagttcttttgatatagttatcgtaggaggtggcatcgtaggcctcgcctctgccagggctttgatcctccggcacccctcgctctctatcggggtgctcgagaaagagaaagacctggcagtgcaccagacgggccataacagcggagttattcacagcggtatttattataagcctgagagcttaaaggctaagctgtgcgtccagggagcagcattactgtacgaatactgtcagcagaaaggaatctcttataaacaatgcggcaagctgattgttgcagtggagcaggaggagattcctcgactgcaggccctgtatgagaagggcttgcagaatggtgtccccggactacgactgattcaacaggaggatatcaaaaagaaagagccatactgccggggacttatggcgatcgattgcccgcatacgggaatcgttgactataggcaggtagcattgagcttcgcacaggatttccaggaggctggcggaagcgtgctaacgaacttcgaagtcaagggaatcgagatggccaaggagtcaccttctaggtcaattgacggaatgcagtacccaattgtgatcaagaacaccaaaggggaggagattcggtgtcagtatgtcgtcacctgtgccggactgtattcagacaggatctcagagctttccggctgcacacctgatccacgcattgtgcccttcaggggcgactacttactattgaagcccgagaagtgctatctagtgaaaggcaacatttaccctgtgccagactcccggttccctttcctaggggtccactttacccctcgaatggatgggtctatctggctcgggcctaacgcggtgctagcattcaaaagagagggatatcgacccttcgatttttcagccactgatgtcatggacatcatcataaattcgggcttgattaaactggcgtctcagaatttctcctatggggttactgaaatgtacaaggcttgcttcttgggtgccactgtgaagtatctccagaaattcatccccgaaatcaccatcagtgatatactccgacaggtggccgtgaggggccctagttggctgtggcagcagcccatgaaagttagcgacaataatatatattgctttctgtggagatgcttcgcactgctgctaaccggatcagcttgcagctttaagtag

SEQ ID NO: 228014 - DNA, 1392 bp, Artificial Sequence
  Description of Artificial Sequence: Synthetic coding sequence
atggttcctgcactgaggtacctagtgggtgcctgcgggagggctcgaggtctttttgcaggaggaagtcctggagcttgcggattcgcaagtggacggcctcgcccactgtgcggcggttccaggtcagcctcgacctctagcttcgacatcgtgattgtcgggggtggaatcgtcggactagcttctgcaagggctctgatcctgcggcacccaagcctaagcatcggtgtcctagagaaagagaaggatctggctgttcatcagaccgggcacaactctggtgtgatccactctggtatttattacaaaccagaaagcctgaaagccaaactctgcgtgcaaggggctgcgctcttatacgagtactgtcagcaaaagggcataagctacaagcagtgcggcaagctgatcgtggctgttgaacaagaggagattccaagactacaagccctatatgagaagggcctccaaaatggggtgcccggattgaggctgatacagcaggaggatattaaaaagaaggagccctattgccggggacttatggctatcgactgtccccatactggcattgtggattaccggcaggtggccctgtcttttgcccaagattttcaggaggccggtgggagcgtgctgactaatttcgaggtcaagggcattgaaatggccaaagaaagccccagcaggtcaattgacggtatgcagtacccaatcgtaattaaaaatacgaaaggagaggaaattagatgtcagtacgttgtgacatgtgctggtctttacagcgaccgaatatctgaattgtccgggtgcacaccggacccacgcattgtgccattcaggggagactatctacttctaaagccagaaaagtgttacctcgttaaagggaatatctatccagtccctgattctcgttttccctttctgggcgtgcacttcacacccagaatggatgggtcgatttggctaggtcctaacgccgtgctggcatttaagcgcgaaggttacaggcccttcgatttcagtgccacagacgtgatggacatcataattaattccggcttaattaagctggccagtcaaaattttagctatggggtgaccgaaatgtataaggcctgtttcctcggagcaacagtgaagtatctccagaagttcatcccagagataactatcagtgatatactgagagggccagcaggagtcagagctcaggcgctggaccgcgacggcaatttagtggaagatttcgttttcgacgcaggcgttggagacatcgggaacagaatcctccacgtgaggaacgcaccttcccctgccgctacttccagcatcgcgatttctggtatgatcgctgatgaggtgcagcaacgcttcgaactgtag

SEQ ID NO: 228015 - DNA, 1392 bp, Artificial Sequence
  Description of Artificial Sequence: Synthetic coding sequence
atggtgcccgcactccgataccttgtaggggcatgtggccgagcacgcggactatttgcagggggttctcccggagcttgtggatttgccagtggaaggcctcggccactctgcggcggatcacgctcagcgtcgacgtcaagtttcgatattgtcatcgtgggtggcggaattgtgggcctggcaagcgcaagggcactcatcctgcggcacccctctctttcaataggcgtactcgagaaagaaaaagatctcgccgtacaccagacaggacacaattcaggagtcattcatagcggaatctactataagcccgagtccctgaaagcaaagctgtgtgtccagggagccgcactgttatacgagtactgtcagcagaaggggatctcatacaaacagtgtgggaaacttattgtggccgtggagcaggaggagattcctagattgcaggcactgtacgagaagggccttcaaaatggcgtcccagggctgcggcttattcagcaggaagatattaagaagaaggagccttattgtaggggcctgatggccattgactgcccccacacgggtattgtagattatagacaggtggccttatcctttgcccaggacttccaagaagccggaggaagcgttctgactaattttgaagttaaaggaatcgaaatggctaaggagtcgccatctcgttcaatagatgggatgcagtaccccattgtgatcaaaaatactaaaggagaagagatccgctgccagtacgtcgtcacctgcgccggtctttacagtgaccgcatcagcgaattaagcggctgtaccccagacccacggattgtaccattcaggggagactacctgttgttaaaaccggaaaagtgttatctcgtgaagggcaacatctatccagttcccgactcccggttcccctttttgggtgtacacttcacaccgaggatggacggcagtatctggctggggcctaacgctgtgttagctttcaagagagaaggatatcgtcctttcgatttcagtgctacggatgtgatggatattattatcaattcaggcttgattaaactggcaagtcaaaacttcagttatggtgtgaccgaaatgtacaaggcttgcttcctgggggctaccgttaagtaccttcagaagttcattccagagatcactatctccgacattctgcggggaccagccggagtgagagcccaggccttggaccgggacggtaacctggtggaggatttcgtgttcgacgccggagtgggcgacatcgggaaccggatcttgcacgtgcgcaacgcaccaagcccagcagctactagcagcatcgcgattagcgggatgatagccgacgaagtgcagcagcggtttgaattatag

SEQ ID NO: 228016 - DNA, 3060 bp, Artificial Sequence
  Description of Artificial Sequence: Synthetic coding sequence
atgctgtggcgagtcctgctgagcaaaaggccgccattcccgcacccggagcttgatttccaggaggccccaattccaagctgtcccggtaggctcccagggcgtaagaactcagtcgccctggccgctgctcctagaaaggagccgactggcgatcgagagaagccactgccctttccagtcctggctccattctctaaccctgagcattcggctcccgcaaaggtggtccgcgcagcggtgccgaagcaaagaaaagggtcgaaggtgggcgatttcggcgacgcaattaactggcccacccccggtgagatcgctcacaaatctgtgcaaccacaaagccacaagcctcagcctactcgcaagctccctccaaagaaggatatgaaggagcaggagaagggcgagggcagcgattcaaaggagagtccaaagacaaagagcgacgagtccggtgaagagaaaaatggtgacgaggattgccagagaggaggacagaaaaagaagggaaacaaacataagtgggtccccctgcagatcgatatgaagccagaggttcctagggagaagcttgcatctcggcctacacggccaccagagccacgccacattccagctaaccgcggagagatcaaagggtcagagagcgctacatacgtccctgtcgccccacctacccccgcttggcagccagagataaaaccggaacccgcatggcacgatcaagatgagacgtcctccgtgaaatctgatggggctggcggtgctagggcttcatttcggggacgagggcgtgggaggggacggggaaggggcagggggcgtggcggaaccagaacacactttgactaccagttcggttataggaagttcgacggggttgaagggcctcggaccccaaagtacatgaataacattacctattacttcgataatgtctctagcactgagctgtattccgtcgatcaagaactcctcaaagactatataaaaaggcaaattgaatactatttttcagttgataacctggagcgggatttttttttgcgacgtaaaatggatgccgacggctttctgccaattacacttatcgctagctttcacagagtgcaggcactgaccacagacattagcctgatctttgcggcactgaaggacagcaaagtcgtggaaatagttgatgagaaagttaggcgccgtgaggagcccgagaagtggcccctccccccaatcgtcgactattcgcagaccgactttagccaactgctgaactgccctgaatttgtgccccgacaacattaccagaaggagactgaaagcgcaccgggaagcccgcgtgctgttaccccagtccctactaaaaccgaagaggtatctaatctgaagaccttacccaaaggattgagcgcttccctgcccgatctggactcagaaaactggattgaggtgaagaaaagaccacgtccctcccctgccagacctaagaagagtgaagagagtagattttcacacttgacttctctaccccagcagcttcccagccagcagctaatgtcaaaggatcaggatgaacaagaagagcttgacttcctgtttgatgaagagatggaacagatggacggcagaaaaaacaccttcactgcctggagcgatgaagaatcagattacgaaatcgacgatagagatgttaacaagattctcattgtcacacagactcctcattatatgcggaggcaccccggtggtgatagaacagggaaccacacctcaagggcgaaaatgtctgcagaattagctaaggtgatcaacgacggccttttttactacgagcaagatctttgggccgaaaagtttgagcccgagtacagccagatcaagcaggaggtcgaaaactttaagaaagtgaatatgatatccagagaacaatttgacactctgactcccgagcccccagtcgaccctaaccaggaggtgcctccaggcccaccacgttttcagcaagttccaaccgacgccctcgccaataaattgtttggagcccctgaaccatcaacaatcgccagatccctgcctaccacagttcccgagagcccaaactaccgaaatacacgtacaccacgaacccctagaaccccccagttaaaggactcctcccagacatctaggttttatcctgtcgtgaaggaggggaggacgttagacgctaaaatgccacgcaagcggaaaacaagacactcatcaaatccaccactagaatctcatgtcggctgggtaatggactcgcgagaacatcgtccgagaactgcctccatctcctcttcccccagtgagggcaccccaactgtaggcagctatggttgtaccccccagagcctcccaaagttccagcatcccagccacgaactcctcaaggagaacggattcacacagcatgtctaccataaataccgaagaagatgtctgaacgaacggaagcgactaggcataggtcagtcccaggaaatgaataccctgttccggttctggtctttcttccttcgggaccatttcaataaaaaaatgtatgaggagtttaaacaacttgcattggaggatgctaaggagggttacaggtatgggctcgagtgtctcttcaggtattacagttacggccttgagaaaaagttcaggttggacattttcaaggattttcaggaggagaccgtaaaggattatgaggccggacagctgtatggacttgaaaaattctgggcatttttaaaatatagtaaagccaaaaacctcgacatcgacccaaagctacaggaatacctcggcaaatttcgcaggttagaagatttcagggtcgatcccccaatgggcgaggaaggcaaccacaagagacattcagttgtggccggaggaggtggtggagagggccgaaagaggtgtccttcccagagctcctcacgcccagcagccatgatcagtcagccaccgacccctcctaccggacagccagtcagagaagacgcgaagtggacctcacagcactcaaatacacagactctaggtaaatag

SEQ ID NO: 228017 - DNA, 2451 bp, Artificial Sequence
  Description of Artificial Sequence: Synthetic coding sequence
atggccacacaggtcgagcctctcttgcctggcggagccaccctgctgcaggccgaggagcacggcggactcgtgcggaagaaaccaccccctgccccagaaggaaagggagagccaggtcccaatgacgtgaggggcggtgagcctgatggtagcgcacgacggccacgacccccttgtgccaaaccccacaaagaaggaaccggccaacaggaaagggaaagccccagacctctccagctgcccggagccgaaggccctgccatttccgacggggaggaggggggaggagagcctggagctggcggaggggctgccggtgctgcaggcgcaggacgcagggacttcgttgaggccccacccccaaaggtgaacccatggaccaagaatgctctcccacccgtgttaacaactgtaaatgggcagagccctcccgaacattctgccccagctaaagtggtgcgggcagccgtacctaagcagcgcaaaggaagtaaggtaggcgatttcggagacgcaattaactggccgacacctggagagattgcccataagagtgtgcaaccgcagagtcataagccacaacctaccagaaagcttcccccaaaaaaggatatgaaggaacaggagaagggcgagggctcagatagcaaggaatccccaaagactaagtccgacgaatctggagaggagaagaatggggatgaagattgtcagagaggaggccagaaaaagaagggcaacaaacataagtgggtgccgctgcagattgacatgaagccggaggtcccgagagagaagctggcctctaggcccacaaggccgcctgaacctaggcacatccctgccaacagaggggagataaagggcagtgaaagcgcaacctacgtgcctgtggcccctcctacccccgcatggcaacccgagatcaagccggagcccgcatggcacgatcaagatgaaacatccagcgtaaagtcagacggcgcagggggagccagagcttcgtttcggggtcggggacggggaagagggagagggagaggcagaggcagaggaggcactcgtacccactttgactatcagttcggttaccggaaatttgatggcgtagaaggaccccgtactcccaagtacatgaacaatataacttattattttgataatgtttcctctaccgaactatatagcgtcgatcaggaactgctcaaggattacatcaagcgtcagatcgaatactactttagcgtggataacctggagagagacttcttcttaagaagaaagatggacgctgacgggtttcttcccataactctgatcgcaagttttcatagagtgcaagcactgaccactgacatctctctaattttcgccgcactgaaagacagcaaggttgtcgaaatcgtagacgaaaaggtgcgacgtagagaggaacctgaaaaatggcccctcccaccaatcgtggattatagccagaccgattttagccagctgctgaactgcccagagttcgttccgcgacagcattaccagaaagagaccgagagtgccccagggtcacctcgagccgtgactcccgtacctacgaaaacagaagaagtgagcaacctgaagaccttacccaaggggttatcggcctctctccccgacctggattccgagaactggatagaagttaagaagcgtcccaggccatcccccgctagaccgaagaagtccgaagagtctcgattttcccacctcacaagcttacctcagcaactgccttcacagcagctaatgtcaaaggatcaggatgaacaagaggaactcgatttcctgttcgacgaagaaatggagcagatggatggacgcaaaaacactttcacagcatggtccgatgaagaaagtgattacgaaatcgatgaccgggatgtgaataagatcttgattgttacacagaccccccattatatgcgcagacatcctggaggcgaccgcactggtaatcacactagtagagcaaagatgagcgcagaactagccaaagtcatcaacgacggcctgttctattacgagcaggatctgtgggcggagaagtttgaaccagagtactcacagatcaagcaggaggtcgaaaactttaagaaagtgaacatgatctcccgagagcagtttgacacattgaccccagaaccccctgtggatcctaatcaggaagtcccaccaggaccacctcgatttcagcaggtgccaactgatgcactggcaaataaactgtttggcgcaccagaaccctccacaatcgcacgatccttgccaactactgtccctgagtcccccaattaccgaaatacgcgcacaccccgaaccccacgcacaccgcagcttaaagatagtagtcagacatctcgcttctatccagtggtgaaggaagggaggacacttgacgctaaaatgccacggtag

SEQ ID NO: 228018 - DNA, 282 bp, Artificial Sequence
  Description of Artificial Sequence: Synthetic coding sequence
atgaaggagcaggaaaagggggagggttccgactcaaaggagtccccgaagaccaagtcagatgagagcggcgaggagaaaaatggggacgaggactgtcagagagggggtcagaaaaagaagggaaacaaacataaatgggtgcccctgcaaatcgacatgaagccagaagttcccagagagaagctggccagtcgcccaactaggcctcccgaacctaggcatatccccgctaacaggggtgaaattaaaggcagcgagtctgctacctatgtgccttag

SEQ ID NO: 228019 - DNA, 1836 bp, Artificial Sequence
  Description of Artificial Sequence: Synthetic coding sequence
atgaaggagcaggaaaagggggaaggctctgactcaaaggagagccccaagacaaagagtgatgaaagcggcgaggagaaaaatggcgacgaagactgtcagagagggggacaaaagaaaaaggggaacaaacacaaatgggttccactgcagatcgatatgaaacctgaggtacctagggagaagctggcgtcccgtcctactcgtcctccagaaccccgacacattcccgctaacagaggggagattaagggctccgagtcagccacatatgttcctgttgcccctcctaccccagcctggcagccagaaattaagcccgagcccgcatggcatgaccaggacgaaacttcctccgttaagagcgacggggcaggaggcgctcgggcttcattcaggggacggggaagaggacgagggaggggccgtggacgtggccgaggcggaactcgtacccatttcgattatcaattcggctatcgtaagtttgatggtgttgagggcccacgaacccctaaatatatgaacaacatcacgtactatttcgacaacgtttccagtactgaactgtactctgtagaccaggagctgttgaaggattatattaagcgtcaaatcgagtattacttcagtgttgataacctggaaagagattttttcctgcgcaggaagatggacgctgatggattcttacctataacattgatcgccagcttccatcgcgttcaagccttgacgaccgatatttccctcatttttgccgctttgaaggatagcaaggtggtggaaatcgtggacgagaaggtgcgccgtcgtgaggaaccagagaagtggccacttccccctattgtggactactcacagactgacttttcacagctgctgaactgtccagagttcgtgcctcgacagcactatcagaaggaaacggaatccgcacccggtagcccgagagctgtcacccctgtccccaccaaaaccgaggaagtctcaaacctgaagaccttgcctaaaggactcagtgcctcacttccagatctggatagcgagaactggatcgaggtcaaaaagcgcccaagaccttctcctgcacgccctaaaaagagtgaggaaagtcgattcagccatctaacaagcttgccccaacagctcccaagccagcagctgatgagtaaagatcaggatgagcaggaagaacttgacttcctctttgacgaggaaatggagcagatggacggacgcaagaacacttttaccgcttggagcgatgaggaatccgactacgaaatcgatgatcgggacgtgaataaaatcttaatagtaacgcagacaccccattatatgcggcgacaccctggaggggatagaactggcaatcatactagcagagcgaaaatgagtgcagagctcgctaaagtgatcaatgatggcctgttttactacgagcaagacttgtgggctgagaagttcgaacccgagtactcacagatcaaacaggaagtggaaaacttcaagaaggtgaatatgatctctcgtgaacagtttgacaccctgactcccgagccccctgttgaccccaatcaggaagtccctccaggccctcctagatttcagcaggtgccaactgacgctttagccaacaagctcttcggtgcacctgagccgagtaccattgcacgcagcttacctaccacggttcctgagagtcccaactatcgcaacacacgcacccccagaacacctaggacacctcaactgaaagactcctctcagacatcacgtttctatcccgtggtgaaagagggcaggactctagacgccaaaatgccgcgttag

SEQ ID NO: 228020 - DNA, 1749 bp, Artificial Sequence
  Description of Artificial Sequence: Synthetic coding sequence
atggagaccgagtcgggcaaccaagaaaaagtcatggaggaggagtccacagagaaaaagaaagaggtcgagaagaagaaacggtcgagggtgaaacaagtcctggccgatatcgctaagcaagtcgatttctggtttggcgacgcaaatttacacaaagaccgttttctccgcgagcaaatagagaagtcacgagacgggtatgtcgacatcagtctgcttgtttcattcaataagatgaagaagctcaccactgacgggaaactgatcgctagagcgctgaggtcctccgcagtggtggaattagatctggaaggcacccggatccggagaaagaagccgctgggcgaacggccaaaagacgaagatgaacgcacagtatacgtggaactgttgccaaagaacgtgaaccacagctggatcgagcgagtttttggtaagtgtggcaacgtcgtgtatattagtatacctcattacaagtcaaccggagaccctaagggattcgcattcgtcgagtttgagactaaagagcaggccgctaaagcaatcgagtttctcaacaaccctcccgaagaggcacctaggaagcctggcatctttccaaagacggtgaagaacaaacctatccctgccctcagagtggtggaggagaaaaaaaagaaaaagaaaaagaaagggcgaatgaaaaaagaagataatatccaggctaaagaggagaacatggacacctccaatacatctattagcaaaatgaagagaagtcggccaacatccgaaggttccgacatcgagtcgacagagccccagaagcagtgctcaaagaaaaagaagaagagagatcgcgtggaggcttcaagcctccccgaggtcaggaccggtaaaagaaagcggtcatccagcgaagatgccgaatcgctcgccccacgctcgaaagtcaaaaaaatcatccagaaggacatcataaaagaagccagcgaggcttctaaagagaaccgcgacattgaaattagcacggaagaggagaaggatacaggagaccttaaagatagctccttactcaaaactaagcggaagcacaagaagaagcacaaggagcggcacaaaatgggcgaggaagttattcccctcagggtcttaagtaaatccgagtggatggacctgaagaaggagtatctggctttgcaaaaggcctctatggcttctcttaaaaagaccattagccagataaagtcggagtcagaaatggagacggactcgggcgtcccacagaacacagggatgaagaacgagaagaccgctaatcgggaggaatgtaggacccaagagaaggtgaacgcgaccgggccacaattcgtgagcggggtcatcgtaaagataatttccacagagccgttacccggtagaaaacaggtcagagacaccttggccgctatttcggaggtactatacgttgacctgctggaaggcgacaccgagtgccatgccaggttcaagacaccagaggacgcgcaggcagtgatcaacgcctacaccgagattaataagaaacattgttggaagttggaaattctgtccggcgaccatgagcagcgatattggcagaagatcctggtggatcgccaagcgaagttaaaccagcccagagagaagaagcggggaacagaaaagctgatcacaaaagcagagaaaatcaggctggcgaaaacgcagcaggcttcaaaacatattcgattcagtgagtacgactag

SEQ ID NO: 228021 - DNA, 1749 bp, Artificial Sequence
  Description of Artificial Sequence: Synthetic coding sequence
atggagactgaatctgggaatcaggagaaggttatggaggaggagagtacagagaaaaaaaaggaagtggaaaaaaagaagagaagtagggttaaacaggtgttggctgatatcgcgaaacaggtggacttttggtttggtgacgctaatctgcacaaggacaggttcctgcgcgagcagatagagaaatcaagggatggttatgtggatatatcactgctggtgagcttcaacaaaatgaagaaactgactacagacggtaagttgatcgcaagggccctccggtcatcagcagtggttgaactggacctagaagggacccgaattcgcagaaaaaaacccttgggcgaacgcccaaaggatgaggacgaaaggacagtgtatgtcgaattgctcccaaagaacgtgaatcattcatggatcgaacgagtctttgggaagtgtgggaatgtcgtgtacatctccattccccactacaagagcactggagatcctaagggatttgcattcgtggagtttgagactaaagagcaggcagcaaaagccatcgagtttctgaataacccacctgaagaagctcctaggaagccagggatctttccaaaaaccgtgaaaaataaaccaatacctgcattgcgtgtggtcgaggagaaaaagaagaagaagaagaaaaagggcaggatgaaaaaggaggataatattcaagcgaaagaggaaaatatggacacctctaatactagcataagtaagatgaagagaagtcggccaacctccgaagggtccgatattgaatccacagaaccccagaagcagtgcagtaagaaaaagaaaaagagagaccgtgtggaagcctccagcctgcctgaggtgaggactgggaagcggaagcgcagttcctcagaggacgctgagtccctggccccaagaagcaaggtgaaaaagatcattcagaaagatatcatcaaggaggcctcggaagccagcaaggagaatcgcgatatcgagatttccacagaggaggaaaaagatacgggggacctgaaggacagttctttgcttaagacaaaacgtaagcataaaaagaaacataaagaacggcacaagatgggcgaagaagtcatacctctcagggtgctttccaaatccgaatggatggatctcaagaaagaatacctcgctctgcagaaagcttccatggcctctttaaagaagaccatctcacagataaagagcgaatccgagatggagacagactccggtgtaccccaaaatacaggcatgaagaatgagaagaccgcaaaccgcgaggagtgccgtacccaggagaaggtgaatgctactggtcctcagtttgtgtctggtgtgattgtcaaaattatcagtacagagcccctccccggaaggaagcaggtccgagacactctggctgccatctctgaagtgctgtacgtagacctcctggagggagataccgaatgccatgcacgctttaaaacccccgaggacgcccaggccgtgatcaatgcgtacactgaaattaacaagaagcactgttggaagttagaaattctttcgggagaccatgaacagagatactggcaaaagatcctagtcgaccgtcaggcgaagttgaaccagccacgtgagaagaagcggggaacagaaaagctcattactaaagcggaaaaaatccgcttagccaaaacgcagcaggcttcaaagcatattcgcttcagcgagtacgactag

SEQ ID NO: 228022 - DNA, 900 bp, Artificial Sequence
  Description of Artificial Sequence: Synthetic coding sequence
atggaaacagagagcggtaaccaggagaaagttatggaggaagagtccaccgaaaaaaaaaaggaggtggagaagaaaaaaagaagccgggtaaagcaggtcctggcagatatcgcgaagcaggtcgatttttggtttggcgacgccaaccttcataaggatcgtttcttaagggaacagatcgaaaaatctagggatggctacgtggacatatcactgttggtgtctttcaataagatgaaaaagctaacaacagacggtaaattaattgccagggccctcagatcatcagcagtggtggaacttgaccttgagggaacacgcatccggaggaagaagcctctcggggagaggcctaaagatgaagacgaacggacagtctatgtggagctgcttccaaaaaatgttaatcactcctggatcgaaagggtgtttggaaagtgtggcaacgtagtgtacatttctatcccacactacaaatctacaggagaccctaaagggtttgcctttgttgaatttgaaaccaaagaacaggccgcaaaagccatcgaattcttaaacaaccccccagaggaggccccacgcaagcccggaatctttccgaagacggtcaaaaacaagcccatccctgctctgagggtggtcgaagagaagaagaaaaaaaaaaagaaaaagggaagaatgaagaaagaagataacatccaggcaaaggaggaaaacatggatacgtcaaatacgagcatcagtaagatgaagcgctcgagaccaactagcgagggcagcgatatagagtcgaccgagccgcagaaacagtgctccaagaagaagaaaaaaagggatcgggttgaggcatcttccctacctgaggtcaggactggaaaacgtaagagatcttcttag

SEQ ID NO: 228023 - DNA, 390 bp, Artificial Sequence
  Description of Artificial Sequence: Synthetic coding sequence
atggagaccgagtcagggaaccaggaaaaagtaatggaagaggagagcacagaaaagaaaaaagaggtcgaaaaaaagaagagaagcagagttaagcaagtcctggctgacattgccaagcaagtcgacttttggttcggtgacgccaatctccataaggacagatttttacgggaacaaatagaaaaaagtcgcgatggctacgtagacatctcactactggtctcctttaataaaatgaagaagcttacgactgatggcaagctgatcgccagagcccttcgttccagtgcggtggtggaattggacctcgaaggcacgaggatccgtcggaaaaagcctctgggggagcggcctaaggacgaagacgagagaaccgtatacgtctag

SEQ ID NO: 228024 - DNA, 360 bp, Artificial Sequence
  Description of Artificial Sequence: Synthetic coding sequence
atggagaccgagtccggtaaccaggaaaaagttatggaagaggagtcaaccgaaaagaaaaaagaggtggagaaaaaaaagagatctcgagttaagcaggtgctggcggatatagctaaacaggtagatttttggtttggagacgcaaacctgcacaaagacaggtttctgagggagcagatcgagaaaagccgggacgggtatgtggacattagcctgctggtgtccttcaacaaaatgaagaaactgacaacagacgggaaattaattgcaagggctctgcgctcctccgcagtggtcgaactggatctcgagggaacccgtataagacgaaaaaagcccctgggagagcgcccatag

SEQ ID NO: 228025 - DNA, 1770 bp, Artificial Sequence
  Description of Artificial Sequence: Synthetic coding sequence
atgattcccaatatagaaggcatggagaccgagagcggaaaccaggaaaaagtcatggaggaagagagtacagagaagaaaaaggaggtggaaaaaaagaagcgatctcgggtgaaacaggtgttggcggacatagctaagcaggtagatttctggtttggcgacgcaaacctgcacaaggacaggtttctgagggaacaaatcgagaaaagtcgcgacggatacgttgatatctcgctgctggtgtcctttaataagatgaagaaacttaccaccgacggtaaactcattgctcgagcgcttcggtcatccgctgtggtggagctcgacctcgagggcacccgcattcgccgaaagaagcccctgggagaaagaccaaaagatgaagatgagaggactgtctatgtggagctactgcctaagaatgtgaatcactcctggatagaaagagtttttggaaagtgcggaaatgtggtctatatttcaatcccgcactataaatccaccggagacccaaagggatttgcttttgtggagttcgaaaccaaggagcaggccgcaaaagctatcgagtttcttaataacccgcctgaggaggccccacgtaaacctggaattttccccaagaccgtaaagaacaaacctatcccagctctgcgggtggtggaagagaaaaagaaaaagaagaaaaagaaggggcgtatgaaaaaggaagacaatatccaagcgaaggaggagaatatggatacctcaaacacttccatctccaagatgaaacgatcgagacccacctctgaaggttctgatatcgagagcaccgagccacagaagcaatgttccaagaagaaaaaaaaaagggatcgggttgaggccagcagcttaccagaggtgaggactggaaaacgtaaaagatcaagtagcgaggacgccgaatcgctggcccctaggtctaaggtaaagaaaattatacagaaggacataatcaaggaagcctctgaagcaagtaaagagaaccgcgatatcgaaattagcacagaggaggagaaggacactggagacctgaaagactcatcgttactcaagacaaagcgtaagcacaagaaaaagcataaagagagacataaaatgggggaggaagtaataccattaagagtcctgtctaaatctgagtggatggacttgaagaaggagtacctggccctgcaaaaggcctccatggcctcacttaaaaagactataagtcaaattaagtcagagagtgagatggaaaccgactccggcgtgcctcaaaacacaggaatgaaaaatgagaaaaccgccaaccgggaggagtgccggacccaggagaaggtgaatgccacaggaccgcagtttgtctccggagttattgttaagatcattagcaccgaacctcttcctgggaggaagcaagttagggatacccttgccgctatctctgaggtgttgtacgtcgatctattggaaggagacactgaatgtcacgctcgctttaagacgccggaagacgcccaggcggtgatcaatgcctacacggagataaacaagaagcactgttggaagctcgagattctcagcggcgatcacgaacaacgttactggcagaaaatcctcgttgaccgccaagccaaattgaatcaaccacgcgagaaaaaaaggggcactgaaaagctgatcaccaaagcggagaagatacgactggctaaaacgcagcaggcttctaagcatatccgattctccgaatacgactag

SEQ ID NO: 228026 - DNA, 417 bp, Artificial Sequence
  Description of Artificial Sequence: Synthetic coding sequence
atgaagttcacgactctgctgttcttggccgcagtcgccggtgccttggtgtatgcagaagacgcgtcatctgattccactggagctgacccggctcaagaggcgggaacctccaagcccaatgaagagatttctggccctgcagaacctgcgtccccgccagagactacgaccacggcacaggaaacttctgccgctgccgttcaaggcactgctaaggtgaccagctcacgccaggagcttaatcccctcaaatccatcgtcgaaaagagcatccttttaaccgagcaggcactggccaaagctggcaaaggtatgcacggcggagtgcctggcggaaaacagttcatcgaaaacggcagtgaatttgcacagaaactgctgaagaagttttccctgttaaagccatgggcctag

SEQ ID NO: 228027 - DNA, 429 bp, Artificial Sequence
  Description of Artificial Sequence: Synthetic coding sequence
atgcgcttctttgtgccgctgttcttggtgggcattctcttccctgccattttagcaaaacaatttacaaaatgtgagctgagccagctccttaaagacatcgacgggtacggcggtatcgccctccctgagttaatttgcacaatgttccacacttccggatatgatacccaggctatagtggagaacaacgagagcaccgaatatggcctgtttcagataagcaacaagctgtggtgtaagagcagccaggtccctcagtctcgcaatatatgcgatatttcctgcgacaagttcctcgacgacgacatcaccgatgatataatgtgtgcgaaaaaaattctcgatattaagggcatcgactactggctcgcacacaaggctctgtgcaccgaaaaactcgagcagtggctatgtgagaagctttag

SEQ ID NO: 228028 - DNA, 1644 bp, Artificial Sequence
  Description of Artificial Sequence: Synthetic coding sequence
atgtatcgtctgatgtccgctgtgacagccagggctgctgcccctggcggtctggcttcatcttgcggcagaaggggagtccaccagagagcgggacttcctccactcgggcacggatgggtcggcggactcgggctgggtctgggactagcccttggcgttaaattggcaggtggactcagaggagcggcacccgcacagagtcccgctgcccctgacccagaggccagtcctttggccgagccccctcaggaacaaagtctcgctccatggtccccccagacaccagctccaccttgcagccgctgcttcgccagggccattgaaagctctcgggatttattgcaccggattaaggacgaggtgggcgcacccggaatcgtggtcggggtatctgtggacgggaaggaggtgtggtccgagggtttggggtacgcagatgtggagaatcgtgtcccatgcaaacctgagaccgttatgcggatcgctagcattagcaaatccctgacaatggtagccctggccaaactttgggaagcaggcaaacttgatctagacatccctgtccagcactacgtgcctgaatttccagagaaggagtatgagggagagaaagtttccgtgacgacacgcctcctcatcagccacttaagtggcattcgccattatgaaaaggatatcaaaaaggttaaggaggaaaaagcctataaggcattaaagatgatgaaagagaacgtggccttcgagcaagagaaggagggcaaaagtaacgaaaagaatgatttcactaaattcaaaacagaacaggagaacgaggccaagtgtaggaattcgaaaccagggaaaaagaaaaacgactttgaacagggagaactgtacctcagggaaaagttcgagaacagtatcgaatctttaaggctgtttaagaatgacccactgttctttaaaccgggaagccagtttctctacagcacttttgggtacacactcctggcggctattgtcgagagagccagcggctgtaagtatctcgattatatgcagaagatttttcatgacttggatatgcttactacggtgcaggaagaaaatgagcccgtgatatacaaccgggcacgcttctacgtctacaacaagaaaaagcgtctggtgaacactccttatgtcgacaactcctacaaatgggcaggcggagggttcttgtccacagtgggcgacctccttaagttcggaaacgcaatgttgtatggttatcaggtcggtttgtttaaaaactctaacgagaatctccttcctggatacttgaagcccgagacaatggtgatgatgtggacaccagtgcccaacaccgagatgagctgggataaagagggtaagtacgccatggcttggggcgtggtcgagcgaaaacagacatacggtagctgtcgtaagcaacgccactatgcctctcacactggtggggcagtcggagccagttcggtgctgctggttctccctgaagagctggacacagagaccatcaataataaagtaccccctcgcggaattatagtatctatcatttgtaatatgcagagtgttgggcttaactcaacagctttgaagattgcgttggaattcgacaaagatcgctcagattag

SEQ ID NO: 228029 - DNA, 1122 bp, Artificial Sequence
  Description of Artificial Sequence: Synthetic coding sequence
atgtatagattaatgagtgccgtcaccgcgagggcggctgcgcctgggggactcgcaagcagctgtgggagacgcggagtgcaccagcgggcagggcttccaccactgggacacggctgggttgggggactcggtttaggtctgggtttggcactgggggtaaagctagcagggggactcaggggagccgcacccgcacaatccccagccgcaccagatccggaggcctccccactggctgagccaccccaagaacagagtctggcaccttggagcccgcaaactcccgctccaccatgttctcgatgctttgcacgagccatcgaatcgtcccgtgatttgctacatcgcatcaaagatgaggtcggcgcaccgggtatagtggtgggggtctccgtggatggaaaagaagtgtggtcagaggggctgggatacgccgacgtggagaatcgagtaccctgcaagcccgagacagtcatgcgcattgcgagcatttccaagagcctaacgatggttgcccttgccaaactttgggaagcagggaaattagacctagacattccagtgcagcattacgtgcctgagtttcctgaaaaggagtatgagggggaaaaagtgagcgtgaccacgaggttgctgatcagccatctctcgggcatccgccactatgagaaggatattaagaaggtgaaagaggagaaagcttacaaagcactgaaaatgatgaaagagaacgtcgcttttgagcaggagaaagaggggaaatcaaatgaaaagaacgacttcactaaatttaagacagagcaggaaaatgaggcgaaatgtcggaatagcaaaccaggtaaaaaaaagaacgactttgagcagggggagctgtacctacgggaaaaatttgaaaatagcatcgagtccctgaggttgttcaaaaatgaccctctgtttttcaagcccggatctcagttcctctactctacattcggatatacattactagccgcaattgttgaaagagcttctgggtgtaagtacctggattacatgcagaagatcttccacgacctggatatgctgactactgttcaagaagaaaatgagcctgtcatatacaatagagctaggtag

SEQ ID NO: 228030 - DNA, 5784 bp, Artificial Sequence
  Description of Artificial Sequence: Synthetic coding sequence
atggagctctcttggcatgtggtgtttatcgctcttttgtcattcagctgctggggatcagactgggagagtgataggaatttcatatctactgctggaccactgacaaatgatttattgcataaccttagtggcttactgggagatcagtcctccaactttgttgcaggggacaaggacatgtacgtgtgccatcagcctctgccaacgtttcttcctgagtacttttcatctcttcacgcatctcagatcacccactacaaagtattcttgtcctgggcacagctgctgcccgctggaagcactcagaatcctgatgagaaaaccgtgcaatgctacagaagactgctgaaggccttaaaaacggcaaggctgcaacccatggtgatcctgcaccaccagacactccccgcatctaccctgagaaggacagaggcttttgctgacctcttcgctgattacgcaaccttcgcttttcattcatttggcgacctggtgggaatctggtttacattcagtgacttggaggaggtgattaaggagctgcctcatcaggaatcacgtgcctctcaattacagactcttagcgacgcacatagaaaagcctacgagatatatcacgaatcctacgctttccagggcggaaaactcagtgttgtgctgagagcagaggacatccctgaactgctgctggaaccacccattagcgctctggcccaagatactgtagatttcctgtccctggacctgagctatgagtgtcagaacgaggcttctctgcggcaaaagctgtcgaagttacagacaatcgagcctaaagttaaggttttcatctttaatctgaagctgccagactgcccaagtactatgaagaaccccgctagcctgttatttagcctgttcgaggccatcaacaaggaccaagtgttaactattggtttcgatataaatgagttcctctcttgcagttcatcatcgaagaagagcatgagctgctccctgacagggtctctggcactccagcccgatcaacagcaagatcacgaaacaactgacagtagccccgcatccgcctatcagcgcatctgggaagcgttcgccaaccagagccgcgcagagagagacgcattcctgcaggataccttccccgagggattcttatggggggctagcaccggagccttcaatgtggagggcggatgggccgaaggaggcagaggggtgagtatctgggacccccgtcggcctttgaatacgaccgaaggccaagctacgcttgaagtggcttcggattcctatcacaaagtggccagcgacgtggcactcctctgcggactgcgcgctcaggtgtataagttctccatctcatggtcacgcatttttcccatggggcatggctcttctcccagcttacctggcgtagcctactacaataagctgatcgacagattgcaggacgcaggaatcgagccaatggccactctgtttcactgggacctcccccaggccctccaggaccacgggggatggcagaatgaatctgtagtcgacgccttcctcgactacgctgcgttttgctttagcaccttcggcgaccgggtgaaactctgggtgacattccacgagccctgggtgatgagttatgccggatatggcaccggtcagcacccacccggaatatccgatcctggagtggcctcctttaaagttgcacacctcgtgctgaaggcacacgcacgtacttggcatcattataactcccatcaccggcctcagcaacaggggcatgtgggaatcgtactaaattccgattgggcggagccactgtcccccgagaggccagaagacctcagagctagtgagaggtttttgcattttatgctgggctggttcgcccacccagtttttgtggatggcgactaccctgctactcttcggacacagattcaacagatgaaccgccaatgcagtcatccggttgcccagttgcctgagttcacagaggccgaaaagcagctcctgaaaggctcagccgattttctcggactttctcattatacatcgcggctcattagtaatgcccctcaaaatacctgcatcccttcttatgacactatcgggggttttagccagcatgtcaatcacgtgtggccgcaaacgtcctctagttggatccgggtggtaccctggggcatccgtcgcctcctgcagttcgtgtcgttagaatacaccaggggcaaagtgcctatatatctggcaggcaacgggatgccaattggagagtcagagaaccttttcgacgattccttaagagttgattactttaatcagtatataaatgaggttctgaaggccattaaggaagattcggtcgatgtccggtcctatatagcgagatccctcatcgacggcttcgaaggcccatcaggctattcccagcgcttcggtctgcatcacgtgaacttctcggactcttcaaaatctagaacaccgaggaagtctgcatattttttcacatccatcatcgaaaaaaatgggttcctaaccaagggagcgaagaggctgctgcctccaaacacagtaaacctgccctccaaggtgagggcctttacctttccgagtgaggttccaagcaaggccaaagtggtgtgggagaagttcagctcgcagcctaaatttgagagagacctcttctaccacggcacgtttcgggatgacttcctgtggggtgtgagtagctccgcctatcagatcgaaggtgcgtgggacgcggatggaaagggaccgtcaatctgggataattttactcacaccccaggatccaatgtgaaggacaatgcaaccggcgacatcgcatgcgacagctatcatcagctggacgctgatctcaacatgctgcgcgcactcaaggttaaggcatacagattctctatcagctggagccgtatcttcccaactggtcgaaactctagcatcaattcacacggtgtggactattacaatcgcctgatcaacggactagtggctagtaatatcttcccaatggtcaccttgttccattgggatctgccccaggcacttcaggatatcgggggatgggagaacccagcactaattgacctgttcgatagttacgcagacttctgctttcaaaccttcggcgatcgcgtgaagttctggatgaccttcaacgagccgatgtatctcgcctggctgggctatggcagcggtgagttcccgcctggagtgaaggatcccggttgggcaccatacagaattgctcacgcggtcatcaaggctcacgcgagggtgtaccacacatacgacgagaagtacaggcaggagcagaaaggcgtcatctcactctcattgtccacacactgggccgagcccaagtctcccggtgtgcccagagacgtcgaggccgcagacagaatgctgcagttttcgctgggctggtttgcccaccccatcttccgaaatggggactatcctgacactatgaaatggaaggtggggaacagatccgagctgcagcaccttgcaacctcccgcctaccctcctttaccgaggaggaaaagaggtttatcagggctaccgccgatgtcttttgtttgaatacttactactctagaatcgtgcaacacaagacaccccgtctgaatcccccaagttatgaggacgatcaggaaatggctgaggaagaggatccttcctggccatccaccgcaatgaaccgggctgccccatggggcactcgaagattgctgaattggattaaggaagaatacggcgacatacccatctacattacagaaaatggggtagggttaaccaatccaaatacagaggatacggacagaatattttaccacaagacatatatcaatgaagcccttaaagcatatagactcgacgggatcgatctgcgcggatacgtcgcttggtccttgatggacaattttgaatggctgaatggatatacagtgaaatttggattgtatcatgtagattttaacaacacaaacaggcccagaacggccagggcttcagcgcgatactacacagaggttattaccaacaacggaatgccccttgctcgggaagatgagttcctatacggaaggttcccagaaggattcatttggagcgcagcttctgccgcataccagatcgagggcgcatggcgtgccgatgggaaaggcctcagtatctgggatacattttcacacacgccacttagggtagaaaacgacgctatcggtgacgtggcttgtgacagctaccacaaaattgcagaggacttagtgacactgcagaacttgggcgtttcccactataggttttctatcagttggagcagaattctgcctgacggtactacacggtacattaatgaggcaggattaaactactatgtccggctgatcgacaccttgttggccgcaagcattcaaccccaggtgactatctaccactgggacctgccccagaccctacaggatgttggaggctgggagaacgaaaccatcgttcagagattcaaggaatatgcagacgtcctgttccagcgactgggcgataaggtgaagttttggatcactttaaatgaaccatttgtgattgcatatcagggatatggttacggtaccgccgcacccggtgttagcaatcggcctggcactgccccttacatcgttgggcataacttaatcaaggcccacgccgaggcctggcacttgtacaacgacgtctaccgcgcttctcaggggggtgttatctcaatcaccattagcagcgactgggccgagccacgggatccttctaaccaggaggacgtagaagccgcaagacgctatgtgcaatttatgggcggatggttcgctcaccctatattcaagaacggggactacaatgaagtcatgaaaacaagaattcgtgaccggtcactggccgctggccttaacaaaagtcgccttcctgagttcacagagtcagagaagcggagaatcaacggtacatacgatttttttgggtttaatcactacacaaccgtcctggcgtataatctcaattacgctaccgccatcagttcatttgatgcagaccgaggagtggcaagcatagccgaccgctcttggccagactccggctctttttggttaaagatgaccccttttgggtttaggcggatcctcaactggctgaaagaagagtataatgatccaccaatttatgttacagaaaatggagtgagtcagagggaggagacagacttgaatgacactgctcgcatctactatctgcggacatatatcaatgaggccctgaaggccgtgcaggacaaggtcgacctcagggggtataccgtctggtctgccatggataactttgagtgggctactggattctccgagcgtttcggactgcatttcgtgaattattctgatccttctcttcctcgcattccaaaagcatcagcaaaattttatgcaagtgtggtcagatgcaacggttttcccgacccagctactggtcctcacgcctgcctgcaccaacccgatgcaggaccaaccataagccctgttcgtcaagaagaggtgcagttccttggtctgatgctgggcaccaccgaagcacagacggccctatatgtcctgtttagtctggtcctgttaggtgtgtgtggcttggcatttttgagctataaatactgtaagcgttccaaacagggcaagacacaacgcagtcaacaggagctgtcacccgtgtctagtttctag

SEQ ID NO: 228031 - DNA, 3012 bp, Artificial Sequence
  Description of Artificial Sequence: Synthetic coding sequence
aaagtcgcccacctggtgctgaaggcccacgcaagaacttggcaccattacaacagccaccaccggcctcaacagcaagggcacgtggggatcgtgctcaatagcgactgggccgaaccactatctcccgagagaccagaagacctgcgcgcttccgagcggttcctgcactttatgttgggctggttcgcacatcctgtctttgtcgatggggactatcctgctaccctgagaactcagatccagcagatgaaccggcagtgtagccatcccgtcgcccagttaccggaatttactgaggccgagaagcagctgttgaaagggtctgcggatttcctaggcctttctcattacacttcacgtctgatctcaaatgcccctcagaacacctgtattccatcttacgataccatcgggggtttttctcagcacgtgaatcatgtgtggcctcaaacctcgtcatcgtggattagggtggtgccctggggcatccggagacttctgcaattcgttagcctcgaatacactcgcggtaaagtgcccatttatttagcagggaacgggatgcctattggagaatccgagaacctgtttgacgattctctccgcgtggactattttaatcagtacatcaacgaagtcctgaaagctatcaaagaagattccgtagatgtacgctcttatatcgctaggtctctgatcgacggctttgaggggccaagcgggtacagccagaggtttggactccaccacgtgaatttttccgattcctccaagtctcggaccccgagaaagtccgcatacttcttcacctctatcattgagaagaacggatttctgacaaagggcgctaaacgcttattacctcctaatacagtcaatctgccgagtaaggtgagggcctttacatttccctccgaagtgccgtcaaaggccaaagttgtgtgggaaaaattttccagtcagccaaagttcgagagagatctcttctaccacggaaccttcagagatgactttttatggggagtcagctcctcggcctaccaaatcgagggcgcatgggacgccgatggcaaagggccaagcatatgggacaattttacacatactcctggtagcaatgtgaaggacaacgccactggcgatattgcttgcgattcctaccaccagctggatgcagacttgaacatgctacgggctctcaaggtgaaagcctaccggttttcaataagctggtcccggatcttcccaaccggtagaaactcttcaattaacagtcacggcgtggattactacaatcgtctaatcaatgggttagtggcatcaaatatctttcctatggtgaccctatttcactgggatctcccgcaggccttgcaggacataggcggatgggaaaaccctgcgctaattgacctctttgatagttatgcagacttttgctttcagacattcggcgaccgagtgaagttctggatgaccttcaatgaacccatgtaccttgcttggctcgggtacgggagtggagagttccctccgggagtgaaagatccgggttgggcgccatatcgaatcgcccacgctgtgataaaggcccacgcaagagtataccatacttacgacgaaaagtaccgtcaggaacagaagggggtcatctctctcagcctgagtactcactgggcggagccaaaatcgccaggtgtgcctcgcgatgtagaggcggctgacagaatgctgcagttctccttaggatggtttgcccatcccatatttcgcaatggggattatccagacactatgaaatggaaggtgggaaataggagcgaactccaacacctggcaacaagcaggctgccatccttcaccgaggaagagaagcggtttatccgggctacagcggacgttttttgtctcaatacatattatagcagaattgtgcagcataagacacccaggcttaatccaccatcctatgaggacgatcaagaaatggccgaagaagaggacccctcttggccctctaccgctatgaacagagccgcaccttggggcactcggaggctactaaactggatcaaagaagagtacggagacatacccatatacattactgagaacggtgtgggccttaccaaccccaacacggaggatacagaccggatcttctatcataaaacgtatattaacgaagcactgaaggcataccgcttagatggcatcgatttgcgcggttacgttgcatggtccctcatggacaactttgagtggctgaatggctacaccgtcaagttcggcctctaccatgttgacttcaacaatacgaatcggcctaggacagcaagggcctcggccagatattatacagaggttattactaataatggcatgccactggctcgcgaggacgagttcctgtacgggagatttccagaagggttcatctggtccgccgcatccgccgcataccaaattgagggagcatggcgggctgatggcaagggcttatctatctgggacacgttcagccataccccactccgcgttgagaacgacgccataggcgacgtcgcttgtgacagctaccataaaatcgctgaggatttggtaacattgcagaaccttggagtgagccactacaggttcagcatcagttggtccaggatactaccggatggaactaccagatatatcaatgaggctggacttaactattatgttcgcctgattgatacgctcttggccgcaagtattcaacctcaggtgactatctaccactgggatttgccgcagactctccaggacgtcggaggctgggagaacgagacaatagtgcaaagattcaaagaatacgccgacgtgttatttcaaagactgggagataaggtcaagttctggataacgctgaatgagcctttcgttatcgcttatcaaggatatggctacggcactgctgcgccagtgcacggtagattggtgtgcacatcttatttccaggagtggagacttcagtag

SEQ ID NO: 228032 - DNA, 1005 bp, Artificial Sequence
  Description of Artificial Sequence: Synthetic coding sequence
atggccactctgaaggaaaagcttattgcacccgtggcagaagaagaagcaaccgtgcccaacaacaagatcaccgtcgtaggagtgggacaggtcggcatggcttgtgctatctccatcctgggaaaatctctagcagatgagctagctttagtggatgtcctggaggacaagctaaaaggcgaaatgatggacctgcaacatgggagcttgtttcttcagactccgaaaatagtggctgataaagactattctgttaccgccaacagcaagatcgtggtggtcacagctggggtgagacagcaggagggagagtcccggctgaatctcgtacagcggaatgtcaatgtgttcaagttcattatcccacagatagtgaagtactcacctgactgcatcattatcgtggtatccaatccagtggacatcctcacctatgttacctggaagctttccggtcttcccaaacacagggttatcggatcagggtgcaatttggacagtgctcgtttccgctatcttatggcggagaagttgggcattcacccctctagctgccatggctggatcttaggagagcatggggactcctccgtggctgtgtggtctggcgttaatgtcgctggcgtatctctccaggagttgaaccccgagatggggacagataatgactctgaaaattggaaagaggtgcacaagatggttgtggagtccgcctatgaagtgatcaagctgaagggttatactaactgggccattggtcttagcgtggccgacctgatagagagcatgctgaaaaatctcagccgaatccacccagtgagcactatggtgaaggggatgtatggcattgagaacgaggtgttcttatctctcccctgcatcttgaacgccaggggcctgacttcggtcatcaatcagaagttgaaggacgacgaggtggctcagcttaagaagtccgctgatacactgtgggatatccagaaagacctcaaggacctgtag

SEQ ID NO: 228033 - DNA, 699 bp, Artificial Sequence
  Description of Artificial Sequence: Synthetic coding sequence
atggccacattaaaggagaaactgatcgctcccgtcgcagaagaagaagcgacggttcccaataataagataaccgtggttggcgtgggacaggtcggaatggcttgtgccatttccatccttgggaaatcactcgctgatgagctcgctctggtggacgttctggaggacaagcttaagggtgaaatgatggatttacagcacgggtccttgttcctccagacacctaaaatagtggctgacaaagattatagcgtgaccgccaatagtaaaattgtggtggtgactgctggggttcgtcagcaggagggcgagagccgcctgaatctggtgcagagaaatgtgaacgtatttaagtttatcattccacagatcgtaaaatatagtccagattgcattattatcgtcgtaagtaaccccgtggatatcctgacttatgttacgtggaagctgtccggcctacctaagcacagagtgattgggagcggatgtaatctagattcagcacggttcagatatttaatggcagaaaagctgggcatccatccctctagctgccacggctggatcctcggcgaacatggggactcatcagtagcagtgtggtcaggtgtgaatgtggctggagtgtctcttcaggagttgaaccctgagatgggcacagacaatgattctgaaaattggaaggaggtgcactag

SEQ ID NO: 228034 - DNA, 1005 bp, Artificial Sequence
  Description of Artificial Sequence: Synthetic coding sequence
atggccaccttaaaggaaaagctgattgcgccagtcgccgaagaagaagctactgttcctaacaacaagattactgtcgtgggtgttggacaggtgggtatggcgtgcgccatttccatcctgggcaagtcgctcgccgacgagcttgctttagtagatgtgctggaagacaaactgaaaggcgagatgatggacttacagcacggcagcttgtttctccagactcccaagattgtcgccgataaagactatagcgtgaccgcaaatagcaaaattgtggttgtcacggcgggagtgcgccagcaggaaggcgaaagccggttaaacctggtgcagcgcaacgtgaatgttttcaaatttatcattccccagatcgtgaaatactctcctgactgcatcatcattgttgtgtccaaccccgttgacattctgacatatgttacttggaagctcagcggccttcccaaacatagggtgatagggagcgggtgcaatctggactccgctcggtttcgttatctgatggctgaaaaacttggaatccacccctctagttgtcacggatggatccttggggagcacggggatagttccgtggccgtgtggagcggcgtgaatgtggcgggagtctctctacaggagctgaaccctgagatgggtacggataatgactccgagaactggaaagaggtccataagatggttgtagaatctgcatacgaggttatcaagttgaagggatacaccaactgggctatcggtttgagtgtggccgacttaattgagtctatgctgaagaacctgagtaggatacaccctgtttccacaatggtaaagggaatgtacggcattgaaaatgaagtgtttttgtcccttccgtgtatcctgaatgctcgcggtctaacaagcgtgattaatcagaaattaaaggacgacgaagttgcacaactgaaaaaaagcgctgatactctgtgggatattcagaaggacttaaaggacctgtag

SEQ ID NO: 228035 - DNA, 414 bp, Artificial Sequence
  Description of Artificial Sequence: Synthetic coding sequence
atggcgacactcaaggaaaaactgattgcacctgtggctgaagaggaagcgaccgtgcctaacaataaaatcaccgttgtcggggtcgggcaggtcggcatggcctgcgccatctcaattcttgggaaatctctggcggatgaactcgctctggtggacgtgctggaagacaagctgaaaggggaaatgatggatctgcaacatggatctctcttcctccagacgccaaaaatagtggccgacaaagattatagtgttactgctaactcaaaaatcgtcgtcgtcacggcaggtgtgcgccagcaggaaggggaatctaggctgaatctcgtacagcgcaatgtcaacgtgtttaaattcatcatcccccaaatcgtcaagtattcgccagactgtatcataatcgtagtgtag

SEQ ID NO: 228036 - DNA, 309 bp, Artificial Sequence
  Description of Artificial Sequence: Synthetic coding sequence
atggcaacgctgaaggagaagctcatcgcccctgtggcagaggaggaagccacggtcccgaacaacaaaataaccgttgtgggtgtgggccaggtggggatggcctgcgccatttcaatcctcggcaagtccttggcagatgagctagctttggtggatgtgttggaagataaactgaagggggagatgatggacctgcagcacggatcgctgttcctgcagacacctaaaattgtcgctgacaaggactattctgtgaccgcaaacagcaagatagtggtcgtcacagccggagtgcggcagcagtag

SEQ ID NO: 228037 - DNA, 999 bp, Artificial Sequence
  Description of Artificial Sequence: Synthetic coding sequence
atgtcaactgtcaaagagcagctcatcgagaagctgatcgaggacgacgaaaactcccagtgcaaaataactattgtggggaccggcgctgtgggaatggcttgtgcgattagcattctgctgaaggaccttgcagatgagcttgccctggtcgatgtcgctctggacaagctgaagggtgaaatgatggatctgcaacacggctccctgttctttagcactagcaaaatcacatcagggaaggattatagtgtcagcgccaattctcggatagtcattgtgacagcgggtgctcgccaacaggagggcgaaacccgattggccctcgttcagaggaatgttgccattatgaaatccatcatcccggcaattgtccattactcccccgattgtaaaatcttagtggtgtctaaccctgtggatatcttgacctacattgtttggaaaatctctgggctgccagtcactagagtgatcggctctggctgtaacctcgactcagcacggtttcgttatctgatcggggaaaaattaggcgtgcatccaacgtcctgccacggatggatcattggagagcatggggattcaagcgtacccctttggagcggggtcaatgtcgccggtgtagccttaaaaacccttgatcccaagctcggaacagattctgacaaagaacattggaagaatatacataaacaagttattcagtcagcctatgaaattattaagctgaaagggtacacaagctgggccatcggtttgagtgtcatggacctggtaggcagcatcctcaaaaacttgaggagggtgcatcccgtcagtacaatggtcaaagggctgtatggaatcaaagaagagcttttcctgtcgattccgtgcgtgctcggaagaaatggtgtcagcgacgttgtcaaaattaacctcaatagtgaggaagaagcattattcaaaaaaagtgcagaaaccctctggaatattcagaaagatctgattttctag

SEQ ID NO: 228038 - DNA, 999 bp, Artificial Sequence
  Description of Artificial Sequence: Synthetic coding sequence
atgtcaaccgtcaaggaacagctgattgaaaagcttattgaggacgacgaaaacagccagtgcaaaattacgatcgtggggacaggagcagtgggaatggcctgtgctatctctatccttcttaaagacttagccgacgagcttgcactcgttgacgttgctttagataagctgaaaggagagatgatggacctacaacatggatctctcttcttttccacatcgaagatcacgtctggtaaagactattctgtgtccgcaaactcacgcatagtcatcgtgacggccggagccagacagcaggagggagagactcggctggctctggtccagcgaaatgtcgcaataatgaaaagcatcatacccgctattgtgcactacagtccagattgcaaaatcctggttgtttcaaatccagtggatatactaacgtacatcgtgtggaaaatttctggcctccccgtgactcgcgtcattggaagcgggtgtaatctcgattccgcccgattccggtatttgattggagaaaaacttggcgtccaccctacctcttgtcacggttggatcattggcgagcatggggattctagtgtacctctgtggtcgggcgtcaacgtggccggtgtagcccttaagaccctggatcccaagttggggaccgatagcgataaagaacactggaagaacatccacaagcaggtcatccagtccgcctatgaaatcattaagctgaagggttacacatcatgggccattggtctgtcggtgatggatttggtcggcagtatcctgaaaaatctacgccgtgtgcaccccgtctccaccatggtgaagggcttatacgggataaaggaagagctgttcctgagtatcccatgcgtgctgggcaggaacggggtgtcagatgtcgtgaaaataaatctcaattccgaggaggaagccctctttaagaagtccgccgagacgctctggaatatccagaaggacctgattttctag

SEQ ID NO: 228039 - DNA, 1524 bp, Artificial Sequence
  Description of Artificial Sequence: Synthetic coding sequence
atggctaggctcttgcgatcagccacctgggaactctttccctggcgtggttattgttctcagaaggccaagggagaactttgtcgggatttcgttgaagcattgaaagcagtggtcgggggaagtcatgtttccaccgccgctgtagttagagaacagcacggcagagatgaatccgtgcacaggtgtgagcccccagacgccgtggtgtggcctcagaacgtggagcaggtctcccgtcttgcagcattatgctatcgccagggtgtgcctataattccctttgggaccggcacaggactcgagggaggggtgtgcgccgtgcagggaggcgtgtgtgtgaacctaacccacatggacaggattctcgagctcaaccaggaagacttcagcgtcgtggttgaaccgggagttacacggaaagcacttaacgctcacttacgcgattcaggattgtggtttcctgtggacccgggtgcagacgccagtctctgcgggatggcggcaactggggctagcggcactaacgccgtgcgatacggcacgatgagggataatgtgctgaacttggaggtggtcctgccggatggtaggctcctccacaccgcgggtagaggcaggcattttcgctttggattttggcccgagatcccccatcatacggcttggtatagcccatgcgtcagtctcggtcgacgaaagagtgccgctggctataatcttaccggcctgttcgtcggatccgaaggaaccttaggactaattacagctactacactgcggctacaccccgctcccgaggcgaccgtggccgctacttgcgcttttccttccgtccaggcggcagtagatagtacagttcacattctccaagccgcagtgcccgtggctagaatcgaatttctcgatgaggtcatgatggacgcttgtaacagatatagcaaactgaattgcttggtggcccctacattatttctggagttccatggatcccaacaggccctggaagaacagcttcagaggaccgaagaaatcgtgcagcagaacggcgcatctgacttttcatgggctaaggaagcagaggaacggtcaagactttggaccgccagacataatgcatggtatgcagccctcgccaccaggcccggatgcaagggatacagcaccgatgtctgtgtgcccattagccgccttccagaaattgtcgtgcagactaaggaagatctgaacgcttcagggctcacaggtagcatcgtgggacatgtgggtgatggtaacttccattgcattcttctagtaaatcctgatgacgcagaagagttgggacgggtcaaggcttttgcggagcagctgggcaggcgcgctctggccttgcacggaacctgcacgggagagcacggtattggcatgggcaagcggcagctgctgcaagaagaagtaggcgcagtgggcgtagaaaccatgaggcagctgaaggctgtgctcgacccccaggggctgatgaaccctggtaaagtcctatag

SEQ ID NO: 228040 - DNA, 1455 bp, Artificial Sequence
  Description of Artificial Sequence: Synthetic coding sequence
atggcaaggttacttcggagcgcgacatgggaattgtttccatggaggggttactgtagccaaaaagcgaagggcgaattgtgtcgcgacttcgttgaggcccttaaagctgttgtggggggttcacacgtttcaacagccgcagtggtgagagaacagcatgggagagatgagtcggtccacaggtgcgagcctcccgatgctgtcgtgtggccccagaatgttgagcaggtttctcggctcgccgctctctgttaccgccagggcgtccctatcatcccattcgggaccggcaccggactagaagggggtgtctgcgccgtgcaggggggtgtgtgcgttaacctgacgcacatggatcggattctcgaactgaatcaggaagatttcagcgtggtcgttgagcccggtgtgacacgaaaggccctgaacgcccacctgagagacagcggtttgtggtttcccgtggaccccggtgccgatgcttcactgtgtggaatggccgctaccggggcatcagggacaaacgctgtcagatatggtacaatgcgagacaatgtgctgaatctggaagttgtcctcccagacgggcgacttttgcacactgccggtaggggcagacacttccgcaagagtgccgctgggtacaacctcactggcctatttgttggaagtgagggtaccctcgggttgataaccgccaccacgctgcgtcttcaccccgcaccagaggccacagtggcggcaacctgcgcttttccctctgtgcaggcagcggttgatagcactgtgcacattctccaggccgcagtccccgtagcacggattgagtttctggacgaagtcatgatggacgcctgtaacagatacagcaagcttaattgtcttgtggctccaacactttttttggaatttcacggcagccagcaagccctcgaggagcagcttcagcggactgaggagatagtccagcaaaacggtgcatcagatttcagttgggccaaagaggcagaggaacgttcacgactctggacagccagacacaacgcgtggtatgctgctcttgccactcggcctggctgcaaaggctattctaccgatgtctgtgtacccatctcaaggcttcccgaaatcgttgtccaaacaaaggaggacctaaacgcgtcaggactcactggcagcatagtgggccatgtcggcgatggcaactttcactgcatactgttggtcaacccggatgatgctgaagaactggggagggttaaggcattcgcagagcaactcggcaggagggccctcgcattgcacggcacctgtacaggagagcacggaattgggatgggaaagagacagctcttacaggaggaagtcggtgccgtcggagttgagactatgcgccagctcaaagctgtactggacccccagggtcttatgaatcctgggaaggtgctgtag

SEQ ID NO: 228041 - DNA, 2139 bp, Artificial Sequence
  Description of Artificial Sequence: Synthetic coding sequence
atgcgcgttttgctgcacctaccggctcttctggcttctctgatcctgctgcaagctgcagcaagtaccactagggctcagaccacgagaacatctgccattagtgacacagtgtcccaggccaaggtccaggtgaacaaggcctttcttgatagccgtacccggttaaagacagctatgagtagcgagacacccacctcgcgtcagctgagcgagtacttaaaacacgctaagggtcggaccagaactgccatccgtaacggacaggtgtgggaagagagcttaaaacgcctgcgtcaaaaagccagtctgaccaacgtaactgacccttcactcgacctcacgagcctgagcctggaagtagggtgtggggctccagcgccagtagtccgctgcgatccctgcagtccatatcgaaccatcactggtgactgcaataaccggagaaagccagctctcggagctgccaatagggctctggcccgatggctcccagccgagtacgaggacggacttagcttgccttttggctggacacccggaaagacccggaatggatttcctttgcctctcgcccgtgaggtgagcaacaaaatagtggggtacctaaacgaggagggcgtgttagaccaaaaccggagcctgctctttatgcaatggggccagattgtcgaccacgatctggattttgcccctgataccgagcttggctcaagtgaatatagtaaggcccagtgtgatgaatactgtatccaaggagacaactgttttccgatcatgtttccaccaaacgaccctaaagcagggacccagggtaaatgtatgccttttttccgcgctggcttcgtttgtccgacgcccccttataagagtctcgcaagagagcaaattaacgcactcaccagtttcctggacgcttcatttgtatactctagcgagccatctcttgcttctcgcctcaggaatttaagctctccactcggactcatggcagtgaaccaggaagtgtctgaccatggccttccatatctgccttacgattccaaaaagccaagtccctgtgagtttatcaatactaccgcacgcgtcccttgttttctggcaggtgattccagggcctccgaacacatcctgctcgcgacctcacataccctgttcctccgggagcacaatcgcctcgctagagaactgaaacgcctcaacccccagtgggacggagagaagctttaccaggaggcacgtaaaatcctgggggcatttgtccagataatcacgttccgggactatctgcccattttactgggcgatcacatgcaaaagtggataccaccttatcagggctatagcgagtctgttgatcccagaatatctaatgtgtttacgtttgctttccgattcggccacctggaagtgccaagctccatgttcaggctggatgagaattatcagccatgggggcctgagcctgagctgccgctgcacaccttgttctttaacacttggcggatggtgaaggatggtggaatcgacccattagtaagagggctgctggcaaagaagtcgaagttgatgaaacagaacaaaatgatgacaggagagctgcggaacaaactgttccagccaacacatcgtatccacggtttcgatctcgcagccatcaacactcagcgctgtagagatcatggtcagccaggctacaattcctggcgggctttttgtgacctgtctcagccccaaaccctagaggaactgaataccgtgctgaagtcgaagatgcttgctaagaagctcctgggcctgtatggaactccagacaacatcgacatatggataggagccatcgctgagcctctggttgagcggggtcgcgtcggccctctcctcgcctgtctgctgggcaaacagttccaacagatacgcgacggtgacagattctggtgggagaacccaggcgttttcacaaatgagcagaaggacagcctgcaaaaaatgtccttcagcaggctcgtctgcgacaacacccggataaccaaggtaccaagggatcccttttgggcaaattcgtatccatatgacttcgttgattgttccgccattgacaagctggatctcagcccatgggccagtgtgaaaaactag

SEQ ID NO: 228042 - DNA, 1374 bp, Artificial Sequence
  Description of Artificial Sequence: Synthetic coding sequence
tgttttccggtacagttcccgcctaacgaccccaaagcagggactcagggcaagtgtatgcccttttttcgagccggattcgtgtgccctactcccccatacaagagtctagcgcgtgaacagatcaatgccctcacttcgtttctggatgcatcttttgtgtactcctcagaaccttccctggctagccggcttcggaatctctccagtcccctcggcttaatggccgttaaccaagaagtgtccgaccacgggttgccctatctgccttatgactcaaagaaacccagcccttgtgagtttattaacaccacagctagagtaccttgcttcctcgccggagattcacgagcaagcgaacacatcttgctagcaaccagccatactctgttcctgagagaacacaacagactggcacgcgaacttaagaggttaaacccacaatgggacggagagaaattataccaggaagcaagaaagatcctgggggctttcgtccagattataaccttcagggactatttgcccattctcctgggggatcatatgcagaagtggatcccaccctaccaaggctattccgagtccgtggaccccaggatttcaaatgtgttcaccttcgctttcagatttggtcatctggaggtgccttcatcaatgtttcgcctggacgaaaattatcagccatggggtcccgagcccgagctccccctccacacgctatttttcaacacttggaggatggtgaaagatggtggaattgatccactcgttcggggacttctggcaaagaaatcaaagttgatgaagcagaacaagatgatgaccggggaactgaggaacaagctgttccaacccacacatcggatccatggatttgacctggcagctatcaatactcagcgttgtcgggatcatggccagcccggatataacagctggagggctttttgtgatttgagtcagccacagacacttgaagagctgaacaccgtgctgaagagcaagatgctcgctaagaaactgctggggttgtacggaacccccgacaacatcgatatatggatcggcgcaattgcggagcccttagtcgagcgcggaagggtaggtccactgcttgcttgtctcttaggcaagcaattccagcagattagagacggagacaggttttggtgggagaaccctggggtgtttaccaacgaacaaaaggactctctgcagaagatgagcttctcccggctggtttgcgataatacccggatcaccaaagtgccacgcgaccccttctgggccaacagttacccttatgacttcgtggattgttccgctatcgataagctcgatctgtctccttgggcctcagttaagaattag

SEQ ID NO: 228043 - DNA, 1890 bp, Artificial Sequence
  Description of Artificial Sequence: Synthetic coding sequence
atgcgggtcttgctccatctgccggcattactagcatccttgatccttctgcaggctgctgcctctaccacaagagacccttccctggacctgacttccttgtccctcgaggttggctgtggagcccctgcacccgtggtccggtgcgatccttgctccccttataggaccattactggggactgtaacaacagaaggaagcctgcccttggagccgctaatagagcattggccagatggctacccgctgaatatgaagacgggctaagcttgcctttcgggtggacccctggcaaaacacgcaatggtttcccattgccccttgctagggaagtgtctaataaaattgttgggtatcttaacgaggagggtgtgctggatcagaatcggagccttttgtttatgcaatggggccagattgtggaccatgacctggatttcgcaccagacaccgagctgggctcctccgaatattctaaagcccagtgtgacgaatattgtatccagggcgacaattgcttccctattatgttcccaccaaatgatccaaaggcaggtacccagggcaagtgtatgccttttttccgtgccggattcgtgtgccctacccctccttacaagtctcttgctagagaacagatcaacgcgctgacttctttccttgatgcctcttttgtgtattcgagcgagccttcactggcatctcggctgcgcaacctcagctcccccttaggcctgatggcagttaaccaggaggtcagcgatcatgggttgccctatctcccatacgactccaagaagcctagcccttgcgagttcatcaacacaacggctagggtgccctgctttttggctggggactctagggcttcggaacatatcttactggctacttcccacacactgttccttcgcgaacacaatcgtctggcaagggaattgaagagattgaatccacagtgggatggtgagaaactgtatcaagaggcacgaaagatcctgggtgcattcgtccagatcataaccttccgagactacttgcccattttgctgggcgaccatatgcaaaagtggatccccccttaccaggggtattcagagtccgtggatcccagaattagcaatgtgtttacattcgcttttagatttggccatctggaggtgccctcctcaatgtttcggctcgacgagaattaccagccctggggccctgagcctgagctcccgctacacaccttgttctttaatacatggcgcatggtgaaggacggcggaatcgatcctttagtgagggggctgctcgccaagaagtccaagttgatgaaacagaacaagatgatgacaggtgaactgagaaataaactgtttcaaccaacacataggattcatggctttgatctggctgccatcaacacccagcgttgcagagaccacggtcagcccggatacaactcctggcgagctttctgcgacctcagtcagccccagacgctggaggaactgaatacggtgctgaaaagcaagatgctcgccaagaagttgctaggattatatggaacgcctgataatattgatatttggatcggtgccatcgccgagccccttgtggagcggggtagggtgggccctctgctggcgtgccttctcggaaaacagtttcaacagattcgagatggggatagattctggtgggaaaaccctggggtatttactaatgagcagaaggactccttgcagaaaatgtccttttccagactggtatgtgataataccagaatcaccaaagttccccgagaccccttctgggctaacagctacccctatgactttgtggattgttctgccatagataaattggacctgagcccgtgggcctcggtaaagaactag

SEQ ID NO: 228044 - DNA, 1962 bp, Artificial Sequence
  Description of Artificial Sequence: Synthetic coding sequence
atgagtagcgagaccccaacctctagacaacttagtgaatatctcaaacatgcgaagggtcggactagaaccgcaatccggaacgggcaggtctgggaggagtccctcaaaaggctccgccagaaggcgtctttgactaacgtcaccgacccctctctggacctaaccagtctgagtttggaagtgggatgcggtgccccagctcccgtcgtgcggtgcgatccttgctcaccttaccgcaccattactggcgattgcaacaatagacgaaagccggctcttggggctgctaatagagccctggctcgctggctgcccgctgaatacgaggatggattgtccctaccattcggctggacccctggaaagacccgaaacggatttccattgccgctggcacgcgaggtcagtaacaaaatcgtgggttatctgaacgaggagggggtactggatcagaatagaagtttgctgtttatgcaatggggccaaatcgtggatcatgacctggacttcgcccctgacacagagctgggcagttctgaatacagtaaggcccagtgtgatgaatattgtattcagggggacaactgcttccctattatgttccccccaaacgaccccaaagccggtacccaggggaaatgcatgcccttttttcgggctggatttgtgtgtcccacccctccatataagagcctggccagggagcagatcaacgcactgacatcctttctggatgcatcattcgtttacagcagtgaaccaagtctcgcgagtaggcttcgcaacctatccagcccactcggcctcatggccgtgaaccaggaggtcagtgatcacggcctgccgtaccttccctacgattcaaaaaagccgtccccatgcgaatttataaatactacagctagagtgccctgttttttggcgggagactcgagggccagtgagcatatcctcctggccacctctcataccttgtttctccgggagcacaacaggctcgcgcgagaactgaagaggttgaatccccagtgggacggggagaagctttaccaggaggccagaaagattctcggggctttcgtccagattatcactttccgggattatctgcccattttactgggggaccacatgcagaaatggattcctccataccaggggtactcagagtccgtagatccccgaattagtaacgtatttacatttgcattccggttcggccatctggaggtgcctagttccatgtttagactagacgagaactatcaaccatggggccctgaacccgagcttccattgcataccctgttctttaacacttggagaatggtcaaagacggcggaattgatcccctggtcaggggactcttggcaaagaagtctaaactaatgaagcaaaataaaatgatgaccggtgaactgcgcaataaactgtttcaaccaactcaccgaattcacggcttcgaccttgctgcgattaacacacaaaggtgcagagatcacgggcagcccggttacaactcatggcgggcattctgtgatctgtctcaacctcagactctggaagaacttaatacagtgctgaagtccaaaatgctggccaagaaattactgggattgtacggcaccccagataacatagatatttggatcggtgcaatcgctgagcccctcgtcgaaagaggccgtgtcgggccactcttggcttgtctgttgggcaagcaattccaacagatccgggatggtgataggttttggtgggagaatccaggtgtcttcacaaacgagcagaaagattctctgcagaagatgtccttctccagactagtgtgtgacaacacaagaatcacaaaagtccccagagatccattctgggcaaattcttacccctacgacttcgtagactgcagcgccattgataagctggatctctccccatgggcatccgtcaagaactag

SEQ ID NO: 228045 - DNA, 1323 bp, Artificial Sequence
  Description of Artificial Sequence: Synthetic coding sequence
atgggagatctggaacttcttctgccaggtgaagctgaagttctcgtcaggggcttgcgctcttttcccttgcgcgaaatgggctccgaaggctggaaccagcagcacgagaatctggagaagctcaacatgcaggctatcctggacgccaccgtgtctcagggcgagcccatacaagaactgttagtaacccatggcaaggtacctaccctggtggaggagctgatcgctgtagagatgtggaaacagaaggtcttccccgtgttctgccgcgtcgaggacttcaagccacagaatacctttcctatctatatggtggtccatcacgaagcgtccatcatcaacctgctggagaccgttttcttccataaggaagtatgcgaaagcgccgaggacacagttcttgatttggtagactactgtcataggaaactgaccttactggtagcccaatctggatgtggtggtcctcccgaaggcgaaggttctcaagacagcaacccaatgcaggaactccagaagcaagcggagttaatggagtttgaaatcgcccttaaagctctttccgttcttaggtacattacagactgcgtggactcacttagcctgtcgacattaagcaggatgctctcgacacataacttgccttgcctgctggtagaacttcttgaacacagcccctggtcccgcagggagggagggaagctgcagcagtttgaaggcagtcgctggcatacagtggccccttccgagcaacaaaagctctcgaaattggatggtcaggtatggatcgctttatacaacctgctgttaagccctgaagcccaggcaaggtactgtctcacatcgtttgcaaagggccgactccttaagttgcgcgcatttctcaccgacactcttttggaccagctgcccaatctagcacacctccagtcatttctcgcccatcttacgctgaccgagacgcagcccccaaaaaaggatctcgttctcgaacagattcctgaaatttgggagaggcttgagagagagaatagaggaaaatggcaagcgatcgccaaacaccaactgcagcatgtcttttcaccaagcgagcaggatctacgtctgcaggccagacggtgggcagagacgtaccgcctcgacgtgctggaagccgtggcccctgagcgcccacggtgcgcctactgtagcgccgaggccagcaaaagatgcagccgatgtcagaacgaatggtattgctgcagagagtgtcaggtcaagcattgggagaaacacggtaagacatgcgtccttgcagcacaaggtgatcgagctaagtag

SEQ ID NO: 228046 - DNA, 2001 bp, Artificial Sequence
  Description of Artificial Sequence: Synthetic coding sequence
atgcgtaaggttaggggccctcccgttagctgcattaagcgcgactctccaattcagtgcatccaagccatcgcagaaaacagggctgatgctgtgacgctagacggtggctttatctacgaggcaggactcgccccttacaaattgcggccagtcgccgctgaggtgtacggtactgagcgtcagcccagaacacattactacgcagttgcagtcgtcaaaaaggggggttctttccagctgaacgagttacagggtctaaagtcctgccatactggtcttaggcgcacagcaggctggaacgtccccataggaaccctgagaccctttctgaattggactgggcctcccgagcccatcgaagccgctgtcgccagattcttttctgcaagctgcgtgccaggtgccgataagggccagttccctaacctttgcagactttgcgcaggaaccggcgaaaacaaatgcgctttctcttcgcaggagccatacttcagttacagcggcgctttcaaatgtctcagggatggagcaggcgatgtggcattcatcagggaatcaacggtgttcgaggatctttctgatgaggcggagagagacgaatatgagcttctttgcccagacaacacccgcaaacccgtggataagtttaaagactgtcacttggccagggtcccgtcacatgctgtcgtggcaaggtctgttaacggtaaagaggacgccatctggaacctcctccggcaggcccaggagaagttcgggaaagataagtccccaaagtttcaactgttcggctcgccatcagggcaaaaggatttgctattcaaggatagtgcaatcggattttcacgtgtacccccacgcatcgactccggcttataccttggctccggatacttcactgctatacagaatttacggaaatctgaagaggaagttgcggctagaagagctcgcgtggtgtggtgcgcagtgggagaacaagagctccgtaagtgtaatcaatggtccgggctgagcgagggctcagtaacctgttcaagcgcttcaaccacggaagactgtatcgccctggtccttaaaggcgaggctgatgctatgtccttagacggcggttatgtctacaccgctggtaagtgtggactggttcctgtcttagctgagaactacaagagccaacagtcaagtgacccagacccaaattgtgttgatcggcctgttgaaggatatctagctgttgcagtggtgagacgatcagacaccagcttgacctggaatagcgtcaaaggcaagaaaagctgtcatacagccgtcgatagaaccgctggatggaatatccctatgggtctgctatttaaccagaccggctcctgcaaattcgacgagtacttttcccagtcttgcgcccctggttctgatcccagatcaaatctgtgcgcgctgtgcatcggggatgagcagggggagaataaatgcgtgccaaacagtaatgagcgctattatgggtacacgggggcttttaggtgtctggccgagaatgccggagacgtggctttcgttaaagacgtcaccgtgctgcaaaacactgacggcaacaataacgaagcctgggccaaagacttgaaactcgcagatttcgccttgctctgcctggatggcaagagaaaaccagtgacagaggctaggtcttgtcacttggccatggcaccaaatcatgcagttgtttcccggatggacaaagtggagcgacttaagcaggtactgctacatcagcaggcaaagtttggacgcaatggatctgattgtcctgacaaattttgcctctttcagtctgagacaaagaacctgctttttaatgacaacaccgagtgcttagccaggctgcacggcaaaaccacatacgagaagtatctaggaccccagtatgtagcagggatcacgaatttgaaaaaatgctctacctcaccgctgctcgaggcctgtgagttcctgcggaaatag

SEQ ID NO: 228047 - DNA, 453 bp, Artificial Sequence
  Description of Artificial Sequence: Synthetic coding sequence
atgaaactagtctttctggtgctgcttttcctgggggctctgggattatgcctggcgggaaggcgccgatcagtacaatggtgcgcagtttcacagcctgaagcaacaaagtgctttcagtggcaacgaaacatgcgaaaagtgcggggaccacctgtgtcttgcattaagagggatagcccaattcagtgtattcaggcaatcgccgaaaaccgggctgacgccgtgacactggatggtggatttatctacgaggcgggactggcaccctacaagttgaggcctgtggcagcagaggtgtacggtacggagagacagcctgccgtcttcccagtccagattaaagattccagtcctacttgcgtcgcatgcgtgagaggacagggaaagacaaatgtaccatctccaccaagaaacagaacctcggccacactcgttcccagctccgtgtag

SEQ ID NO: 228048 - DNA, 846 bp, Artificial Sequence
  Description of Artificial Sequence: Synthetic coding sequence
atgaccagtaaggaagatggcaaagcagcaccaggcgaagagcggcgaagaagccctttggatcatcttcctcccccagcaaattccaataagccactgacccccttctcaattgaggacatcctcaataagccctccgtgcgacggtcatattcactctgtggggcagcccatctcctcgccgctgccgataagcacgcccagggagggctgccactcgctggcagagcccttttgtcacagacatccccattgtgtgcccttgaagagctggcgagcaaaacatttaaagggctggaagtaagcgtccttcaggccgctgaaggtcgtgacggaatgaccattttcggccaaagacagactccaaagaagaggagaaaatctagaactgctttcaccaaccatcagatttacgagctcgagaagcgctttctgtaccagaaatacctgagccctgcagaccgcgatcagattgcccagcaattagggcttactaatgcacaggtcattacatggttccagaatcgtcgggcaaagctcaaacgagatttagaagagatgaaggccgacgtggaatctgcgaagaagctcggaccatctggccaaatggatatcgtcgctctggcagagctggagcagaacagcgaagcaactgccggaggcggtggcggatgcggcagagctaagagcaggcccggatcgcccgtacttcccccaggagcccctaaggcacccggtgctggggctctacaactatcccctgcaagcccactgacggaccagccggctagtagccaggactgctccgaggatgaggaggacgaagagattgatgttgacgattag

SEQ ID NO: 228049 - DNA, 597 bp, Artificial Sequence
  Description of Artificial Sequence: Synthetic coding sequence
atgaattccggtcgcgaacctaggacacccagaactcttctttccattgcagacatcctggccccaaggatggttccacgagctccatctgccccacagctgcccgaatcaggacccggacccacatcccctctgtgcgccctagaagaactaacttcaaagaccttcagaggcttagatgccagagcgcttcagccgtcagagggcagggccggacccgacgccctaggtccaggcccattcggacgcaagagacgcaagagcaggaccgcattcacggcccagcaagtcttggaactggaaaggagattcgtctttcagaagtatctggctccctccgagcgtgacgggctggcaacaagactggggctcgcgaatgcacaggtggtgacttggtttcagaataggcgcgcaaagctgaagcgagatgtcgaggagatgcgagcagatgtggcatctttgagggccctctctcccgaagtgctctgctcccttgctcttcccgagggtgcccctgaccccggtctgtgcctggggcctgccggaccagattcacgacctcacctgtctgacgaggagattcaggtggatgactag

SEQ ID NO: 228050 - DNA, 585 bp, Artificial Sequence
  Description of Artificial Sequence: Synthetic coding sequence
atgggaaaaaggacgtcacttgaagtttccttaggggagctcggcggtgagaaatgtcgaggtggccgaaggtccttccctcccttagccgcatctcgacccgcaagaccgggaggctggagatgggcacggcgagacctctgtaagacagcttccagggctgaaaacaatagtcaggcttgtcgtccgcagcgccgagctgggcctgacgccctcggacctggaccctttggacggaagcgtcggaaatctcgaaccgcattcactgcccagcaggtcctcgaactcgaacgacgtttcgtctttcagaaatatcttgctccctccgagagagacggcctcgcaaccagactgggacttgccaacgcccaagtcgttacctggtttcaaaataggcgcgcaaagttaaagagagacgtcgaggagatgcgagcggacgtggctagcctgcgagcactgagccccgaagttctgtgctcattggctttacctgaaggtgcccctgatccgggactctgtcttgggcctgcaggcccagattcaaggccacacctaagcgacgaggaaattcaggtagacgattag

SEQ ID NO: 228051 - DNA, 1398 bp, Artificial Sequence
  Description of Artificial Sequence: Synthetic coding sequence
atggagactccttctcaaaggcgggcaacaagatctggcgcacaggcctcttccaccccgctctcccccaccaggatcacacggcttcaggagaaggaggacctgcaggagctgaacgatagacttgccgtgtacatcgaccgagtcaggagcctggagacggagaatgccggtttgcggctgcgaatcaccgagagtgaggaagtggtttcgagggaggtgtctggcatcaaagctgcttatgaggccgagctgggagacgccaggaagacactggactctgttgcaaaagagcgggcaaggctgcagctggaactgagtaaagtcagagaagaattcaaggagctcaaggcaaggaacacgaagaaggagggagacctcatcgccgcacaggctaggctgaaagatcttgaggccctgctcaattccaaggaggctgctctctcgacagccctttctgagaaaagaacactcgagggggagcttcacgatctgcgagggcaggtagcaaagctggaagccgctctcggggaagctaagaaacagctgcaggatgagatgttacggcgtgtggatgccgaaaaccgcctacagacaatgaaggaggaattggactttcagaaaaacatttatagtgaggagttgcgggaaactaaacgcagacatgagactagactagtcgaaatagataacgggaaacagcgcgagttcgaatcaagactggccgacgcactccaggaactgcgagcccagcatgaagaccaggtggaacaatacaaaaaagaacttgagaaaacctacagtgcaaagcttgacaacgctaggcaatctgccgaaagaaattctaacttggtaggcgctgcccatgaggagctccagcagagccggatccgcattgactcactctcagcacagctgtcccaattacagaaacagcttgccgctaaagaggccaaactccgggaccttgaagacagcctggcaagagagcgggatacatctcgaaggcttctcgccgagaaggaacgggaaatggccgagatgcgagccaggatgcagcagcagctggatgagtatcaggagttgctggacattaagttagccctggatatggagatccatgcataccggaagctactcgaaggcgaggaggaaaggctgagactcagcccttcccccacttcccagcgttcaagggggagggcgagctcccacagttctcagacccagggagggggaagcgtgacaaaaaagagaaaactggagagcacggagtccaggtcctctttttcgcaacacgctagaaccagcggaagagtcgcagtcgaggaggtcgatgaggatgaggatggggacgacttgctacatcaccatcacgtcagtggttcacgacggtag

SEQ ID NO: 228052 - DNA, 1905 bp, Artificial Sequence
  Description of Artificial Sequence: Synthetic coding sequence
atggagacgccatctcaaaggcgcgcaacgagaagtggggctcaagccagcagcacaccactaagccccacccgcatcacccgacttcaggaaaaggaggacctgcaagaactaaacgatcgtctggctgtgtacatcgacagagtaagaagtcttgagaccgaaaatgccggtttgcgcctgcgcattacagaaagtgaggaggttgtgtcccgggaggtgtctggaatcaaagccgcttacgaggcagaactcggggacgcgcgtaagaccctagatagtgtggccaaggagagagctcggctgcaactggaactctctaaagtgcgagaggaatttaaagagttgaaggcaagaaacaccaaaaaggaaggggatctgatagccgctcaagcccgtttgaaagacctcgaggccttactaaactctaaagaggccgctctgagtacagcactaagcgaaaagaggaccctggaaggagaactgcacgacctacggggacaagtcgcgaaattggaggcggcattgggtgaagctaaaaagcagctccaagacgaaatgcttaggcgggttgatgcggaaaatcgattacaaactatgaaggaagaactggacttccaaaagaacatatacagtgaagaactgcgggaaacaaagagacgtcatgagactcggctggtcgaaatcgataatggaaagcaacgagaatttgaaagcaggctcgcggacgccctgcaagagctgcgcgctcaacacgaggaccaggtcgaacaatacaagaaggagcttgagaaaacctacagcgccaagttggataacgcgaggcagagcgctgaaaggaattccaacctggttggagctgcacacgaagagttgcaacagagcagaatcagaatcgatagcctcagtgctcagctctcacagctgcagaagcaactggccgctaaggaagctaaactgagagatctagaagactctctagctcgtgagagagacacttcccgaaggctactggcggagaaggaaagggaaatggccgagatgagggccagaatgcaacagcagctggatgagtaccaagagctccttgatatcaagcttgctctggacatggagatacatgcttaccgcaagcttttggaaggggaggaagaacgtctgcgcctgtctccatctcccaccagccagcgaagcaggggcagggccagcagccacagttctcagacccagggcggtggttctgtgaccaagaaaagaaagctggagtctaccgaatcacgctctagtttctcacaacatgcccgaacctccgggagggtggctgtggaggaggtagatgaagagggcaaatttgtaagacttagaaacaaatctaacgaggatcaaagcatgggtaattggcaaattaagagacagaatggggatgaccctcttcttacttatcgcttccccccaaagtttactctcaaggctgggcaggtggttacgatttgggccgctggcgcaggggctactcactctcccccaacagatcttgtctggaaggcccaaaatacctggggatgtgggaacagcctccggacggcgctgattaactctactggcgaggggtcccactgttcatccagcggcgatccagctgaatacaatttaagatcccgtacagtgctttgtggcacttgcggacagccagcagacaaggcgagtgctagcggcagcggagcgcaggttggaggtcccatctcaagcggctcttcagccagttccgtgaccgtgacacggtcatatcggtccgtcggcggaagcggcggaggatctttcggtgataacctggttaccaggagctatctgctggggaactcatcaccccgaacacagtcacctcagaactgtagcattatgtag

SEQ ID NO: 228053 - DNA, 1719 bp, Artificial Sequence
  Description of Artificial Sequence: Synthetic coding sequence
atggagacccctagccagagaagagcaactcgttccggtgcgcaagccagctctactccgctatctcctacccggattacaaggctgcaggaaaaggaggatctccaggagttgaatgacaggctggcagtttatattgaccgcgtgaggtcactggaaaccgaaaacgcgggattgaggcttcggattactgaatccgaggaagtggtatcacgggaggtctccggcatcaaagctgcttatgaagcggaacttggcgatgcgagaaaaaccctggattccgtcgccaaagaaagagcacggctccaactcgagctgtcaaaggtcagggaagagtttaaggagctaaaggcacgaaacacaaagaaagagggcgatttgatcgcggcacaggctcgtttgaaagacctggaagcattactgaactccaaggaggctgccctaagtaccgctctgtctgaaaagagaaccctggagggtgaactgcatgacctgagagggcaggtagccaagctggaagccgctctaggtgaggcaaaaaagcaactgcaggacgagatgctcaggcgcgttgatgccgaaaaccggctgcagaccatgaaggaggaactcgacttccaaaaaaacatttatagtgaggaactacgcgagaccaaacgacggcacgaaactcgtttggttgagatagataatggcaagcagcgggagttcgaatctaggctggcagacgcactgcaggagcttcgagcccagcatgaagaccaggttgaacagtacaaaaaggagctggagaagacatactccgccaaactcgacaacgcaaggcaatcggcggagaggaactccaacctggtcggtgccgctcacgaggaactccagcaaagccgtatccgcatagactccttatctgcccagttgtcccagctgcagaaacagttggctgccaaggaggccaaacttcgtgatcttgaagacagccttgcgcgagagcgcgatactagcagacgactgctggccgagaaagagagggagatggctgaaatgagggcccgaatgcagcagcaacttgatgagtatcaagagctgctagacattaaactggcccttgatatggagatacacgcctatagaaagcttctggagggggaagaggagaggctacgactgagtccttctccaacatcgcagcgcagcagagggcgagcctcttcacactccagccagacccaggggggaggctcagtgacaaagaaaagaaaactggaatccacggagtcacgatcctctttcagccagcatgctcggacttcagggagagtggcggtggaggaggtcgatgaggaaggaaagttcgtgcgtttaaggaacaaatccaacgaagatcagagtatgggcaactggcagataaagaggcaaaatggggacgaccctctgttgacttatcgatttccacctaagttcacacttaaggctggacaggttgtgacaatttgggccgcaggggcaggcgcaacgcactcccctcccacggacttagtctggaaagctcagaacacctggggctgtggaaacagcctgcgcaccgccctgatcaattccaccggtgaagaggttgcaatgcgaaagttagtgagatcagtgaccgtggttgaagacgacgaggacgaggatggggacgacctgcttcaccatcatcatgtgtccggaagcaggcgctag

SEQ ID NO: 228054 - DNA, 1476 bp, Artificial Sequence
  Description of Artificial Sequence: Synthetic coding sequence
atgcagcccttactgtgtctcggcaatcttgaagacgccagagagagaacagggaccttattggcgcagcaccccgcatggggccgtactcgcgctaagccaggctctcctcttaacacgaagaaggagggagatctgattgccgctcaggccaggctgaaggatctggaggcgctgttgaatagcaaggaggctgccctcagtaccgcactaagtgagaaaaggactctggaaggtgaattgcatgacctgaggggacaggtcgccaaactggaagctgctctgggcgaggccaaaaaacagctgcaggacgaaatgcttagacgtgtggatgcagagaatcggttgcagaccatgaaagaggaactagacttccagaaaaacatatactcggaggagcttagagagacaaagagacgtcacgagacacgattagttgaaattgacaacgggaagcaaagggagttcgagtctcgactcgcagacgcactgcaggaattgcgagcacaacacgaggaccaggtcgaacagtataagaaggagctggagaagacttacagcgcaaagctcgataacgctagacagtccgcagagagaaatagcaaccttgtcggcgcagctcacgaagagttgcagcagagccgtattagaatcgactcccttagcgctcagctgtcacaactccagaaacagctggccgctaaggaggctaaactgcgcgaccttgaggattccctggctagggaacgcgatacaagtcgacgcctcttggctgagaaggagcgcgagatggccgagatgcgagcccgaatgcagcagcaacttgatgaataccaggaactgctggatattaaactggctctggatatggagatccatgcctaccgcaagttattggaaggagaagaggagagactcaggttgtcgccaagccctacctcccaacgttcccgtggaagagcatcctcccatagttcgcagactcagggcggaggcagcgttactaaaaagagaaagttagaaagcacggagagtcggtccagcttctcacagcatgccagaacctccggcagagtggcagtagaggaggtggacgaagagggcaagttcgtgagactgcgaaacaagagtaacgaagaccaatcgatgggaaactggcagattaagcgccagaatggtgacgatcctttgttaacttacaggttccctcccaaattcaccctgaaggccggacaggtggttaccatttgggccgcaggagcgggagccacccattcccctccaacggaccttgtatggaaggcccagaacacttgggggtgcgggaactcactgcgcacagctctgatcaactcaacgggcgaggaagtggcaatgaggaaactggtgaggtcagtcacagtggtcgaggatgatgaggacgaagacggagacgaccttctgcatcatcaccacgtgtccgggagcaggcgctag

SEQ ID NO: 228055 - DNA, 1845 bp, Artificial Sequence
  Description of Artificial Sequence: Synthetic coding sequence
atggagactccttcacagcgtcgagctacccgatcaggtgcccaggcttcatccactcccctgagccccactagaataacgcgcctgcaggagaaggaagatttacaggaactgaacgaccgactggctgtctatatcgaccgagtgcgctcgctggagaccgagaatgccggactgagactgagaattaccgaatccgaagaggtagtaagccgggaagtgtctggaataaaagccgcttacgaagctgaacttggagacgctagaaagaccctggactcggtggcgaaggagcgagctaggctgcagctcgaactgtccaaagtgagggaggagttcaaggagttgaaagccaggaacaccaagaaggagggcgaccttatcgctgcgcaggccaggctgaaggacttggaagcgctcctcaactcaaaggaggccgcactcagcaccgcactgagcgagaaaaggacactagagggcgagctccatgacctgagaggccaggtggccaagttagaagccgctcttggcgaggcgaaaaagcagctacaagacgagatgctgcgtcgcgtggacgcagagaacaggctccagaccatgaaggaggagctggactttcagaagaacatctactccgaagaactccgggaaaccaagcgcagacacgagaccagattggtggaaatagacaacggaaaacagagggaatttgaatctaggctggccgatgcactacaggagctaagagcccagcacgaggaccaagtcgagcaatataagaaggagttggaaaaaacctacagtgcgaagctagacaacgccagacagtctgccgagcgtaattccaacctcgttggcgctgctcatgaggaactccaacaaagtaggatccgcattgattctctatctgcccaactcagtcagctgcagaaacagttagctgcgaaagaggccaagctccgcgacctcgaagactcactcgctcgggagcgggatacctcaagaagactgctggcagaaaaggagcgcgagatggccgaaatgcgcgctaggatgcagcaacaactggatgaatatcaggagttgctggatatcaagctagctctcgatatggagatacacgcttatcgtaagctgttggagggcgaggaggaaagacttcgattgagcccatcccccacgtcacagcgttccaggggtagagcaagctcccactcctctcaaactcagggaggcggtagcgtgaccaagaaacgcaagctggaaagcactgaatccagatcaagctttagccagcacgccaggacctcgggacgggtcgcggttgaggaagtcgacgaagaaggcaagttcgtaagactgcgcaataaatcgaacgaagatcagtccatgggaaactggcagattaaacgacagaacggagacgatcctctgctaacctatcggtttccacctaagttcaccctcaaggcaggacaagtggtcactatatgggcggcaggcgctggcgctacccactcaccccctacggacttggtgtggaaggcccagaatacatgggggtgcggcaattcccttcgcaccgctctcattaactccactggagaggaggtggctatgaggaagctcgtcagaagtgtgacagtggtggaggatgacgaagatgaagacggcgacgacctgctgcaccatcatcacggatctcactgcagctcatctggggatcctgcggaatacaatctgagatctcgaacagtcctatgcgggacttgcggacagccagccgataaggctagcgcatcaggctctggggctcaatcacctcaaaactgtagcatcatgtag

SEQ ID NO: 228056 - DNA, 1995 bp, Artificial Sequence
  Description of Artificial Sequence: Synthetic coding sequence
atggagacaccatctcagcgcagggccacccgatcaggcgcacaggcgtccagtacccctctcagcccaacgcgaatcactaggctgcaagaaaaggaggaccttcaggaactgaatgacagacttgcagtgtatattgacagggtccgtagtctcgaaactgagaacgccggacttcggttgcggattaccgagtctgaggaagtggttagcagggaggtttcaggcataaaagccgcttacgaagccgagctgggagatgctagaaaaaccctcgatagcgtagccaaagagcgcgcaagactgcagctggagttgtccaaggtccgcgaggagtttaaggaactgaaggcccgtaatacaaaaaaggagggggacctgatcgccgctcaagctaggctcaaggatctcgaagccttattgaatagcaaagaggccgctctgagcacggctctgtcagaaaagcggacgctggaaggagaactccatgatttacgcggacaggtggctaaactcgaggccgctttaggcgaagctaagaagcagttgcaggatgaaatgttgagaagagtcgacgccgaaaataggttgcagacgatgaaagaagaactcgatttccagaaaaacatttattctgaggagttacgtgaaacgaagagacggcatgagacacggctagtggagattgataatggaaaacagcgcgagttcgagtctagattggccgacgcccttcaagagctgcgcgctcagcatgaggatcaagtggaacaatacaaaaaggaactggaaaagacatacagcgctaagctggacaacgcccgacaatccgccgagaggaattctaatctggttggagctgcccatgaggaattgcagcaaagtaggatcagaatagactccctgtctgctcaactcagtcaattgcagaaacagctcgccgcaaaggaggccaaactccgggatctcgaagactctctggcacgagaacgggatacaagcagacggttacttgctgagaaagagcgagaaatggctgagatgagagcacgaatgcagcagcagctggatgagtaccaggagttgcttgacatcaagttggcccttgacatggagatccacgcatatcgtaagctgctggagggtgaggaggagagactgcgactgtcaccctctcccaccagccagcggagcagaggccgtgcctcttcccactcttcccaaacccagggagggggtagtgtgaccaaaaagcgcaagttggagtctacagagtcacgcagctcttttagtcaacatgcacgcaccagtggaagagtggccgtggaagaggtggacgaggaaggcaaatttgttcgtctgaggaacaagtcaaatgaagatcagtccatgggaaactggcagattaagcggcagaatggcgatgacccactgctcacttacaggttccctccaaagtttaccttgaaagctgggcaggttgtaacaatttgggctgccggtgctggtgccacccatagccctccaactgatctcgtgtggaaagcccaaaacacctggggatgcggcaacagtctgaggaccgccctaataaatagtaccggggaggaggttgccatgagaaagctcgtgcgcagtgtgaccgttgtagaagacgatgaggacgaagatggagatgacctgttgcaccatcaccacgggtcccattgtagctccagtggagacccagcagaatataatctccgatcccggacagttctgtgcggaacatgcggccagcctgctgacaaagcttccgctagcggatccggcgcacaggtgggaggccctattagctccggctcgagcgcgtcctctgtcactgtcactcggagctaccgctcagtcggcggttccggtggaggatcatttggagacaacctggtcaccagaagttacctgctgggaaattcctcgcctaggactcaaagccctcagaactgctcaatcatgtag

SEQ ID NO: 228057 - DNA, 1719 bp, Artificial Sequence
  Description of Artificial Sequence: Synthetic coding sequence
atggagacgcctagccagcggcgagccacccgttctggagcccaagctagtagcaccccactttctccaacccggataactcgactgcaagagaaggaggatctacaggagctgaacgaccggttggctgtctatatcgatcgggtcaggagcttagaaacagagaatgctggccttcgactgcgcattactgagtccgaagaggtcgtgtcccgcgaagtgagtgggatcaaagccgcttacgaagctgaactgggtgatgccagaaaaactttagattctgttgcaaaagagagggcccgactccagctggagttgagtaaggtgcgtgaggagttcaaggaacttaaggcacggaatacaaagaaggaaggtgacctgattgctgcccaggcacggctgaaggacttggaggctctgctgaatagcaaggaggccgctctcagcacagccctgtcagagaagcggactctggaaggcgagcttcacgacttgcgcggacaggttgccaagcttgaagcagccctaggcgaagcaaagaaacagttgcaggatgagatgctgagacgagtggacgcagagaacaggttacagacaatgaaggaagaactggattttcagaagaatatttacagtgaagagctgcgtgagacaaaacggaggcacgaaacaagactggttgaaattgacaacggcaagcagcgggaattcgaatctcgcctggccgacgctcttcaggaactgagagcacagcacgaagatcaggtggaacagtacaagaaggagctggaaaagacatacagtgctaaacttgacaacgctcgtcagtctgccgagcgaaactctaacctagtcggggctgcccatgaagagctccagcaaagtcgtattcgcattgacagtctttccgctcagctcagccagctgcaaaagcagttggccgctaaagaggctaagcttcgggatctggaggattccctcgctcgagaaagggatacaagtcggagactcctggccgagaaggagcgcgaaatggctgagatgagagcaagaatgcagcagcaactggatgaatatcaggaactgctcgacatcaaactggcactcgacatggagattcatgcttatcggaagcttctagaaggggaggaggagagattgcggttgtctccctctccgacttctcagcggtcccgagggagggcttccagccacagttcccagacacaggggggtggcagcgtgactaaaaagaggaagctggagagcacagagtcacggtcttctttctcccagcatgcacgaaccagcggcagggtggccgtggaggaggtagacgaagaaggcaaatttgtacgcctgcggaataaatctaatgaagaccagtcgatggggaattggcaaattaaacgtcagaacggcgacgaccctctgttgacctatcgctttccccctaagttcactctaaaagctggacaggtggtaacaatttgggcggctggcgctggtgcaacacactctcctccaaccgatctggtgtggaaggcacagaatacatggggatgtggaaatagcctccgcaccgccttgattaatagcacgggagaagaggttgccatgcggaagctggtgcggagcgtgaccgtcgtggaggatgatgaagacgaggatggagatgatcttctgcaccaccatcatgtttcaggcagtcgcaggtag

SEQ ID NO: 228058 - DNA, 1476 bp, Artificial Sequence
  Description of Artificial Sequence: Synthetic coding sequence
atgcaacctctcctgtgtctcgggaacttggaagatgctcgcgaaagaacgggcacattacttgcccagcacccggcatggggaaggacacgcgcaaaacctggaagccctctgaataccaagaaagaaggagacctgattgcagcccaagccagactcaaagacttggaagccctccttaactctaaagaggctgcccttagtacggccctgtcagaaaaaaggaccctggagggagaactgcacgacctcagggggcaggtggcgaagctcgaggccgctctgggggaagctaagaaacagctgcaggatgaaatgttgcggcgagtggacgcagaaaaccgccttcagaccatgaaagaggaactggatttccagaagaacatatattccgaggagctgcgtgagacaaagagacgtcacgagacacgcctggttgaaatcgacaacggaaagcaacgggagtttgagtcacgcctcgccgatgccctgcaggagttgagggcacagcacgaggaccaagtggagcagtacaagaaagaactggagaaaacatattcagccaagttagacaacgcccgtcagagtgctgagcgcaactccaatctggtgggcgctgcacacgaagaactgcagcaaagccgaattcgcatcgattccctctccgcccaactgtcccagctccagaagcagttagcggcaaaggaagcgaagctgcgggacctcgaggactcactggcccgtgaacgggatacaagtcgcagacttctggcagaaaaggagcgcgagatggctgagatgcgcgcacgtatgcaacagcaactggatgagtaccaagagctcctggatatcaaattggctcttgacatggagatacacgcctacaggaagcttctggaaggcgaggaagagcgactgagactgagtccttcaccaacatctcagcgctctcggggacgcgcttcaagccacagttcgcagacccagggaggtggatccgtcacaaaaaagagaaaactggagagcaccgaatcaagatcatcattttcccagcacgcgcgaacctccggtcgggtggccgtcgaagaggtcgacgaggagggcaagtttgttcggcttcggaacaaatccaacgaggatcagagtatggggaactggcagattaagcgccaaaacggcgacgatcccctgctcacctatcgttttcctcccaagttcacgctgaaggcaggtcaggtggtaactatctgggcagccggtgccggagctacacatagtcctcccacagacctggtgtggaaagctcagaatacatggggctgcggcaactctttgaggacagccctgattaatagtactggcgaagaggtggccatgcgcaaattggtccgttctgtcacggttgttgaggatgacgaagacgaagacggtgacgacctcctgcatcaccaccatgtgagcggttccaggcgatag

SEQ ID NO: 228059 - DNA, 1464 bp, Artificial Sequence
  Description of Artificial Sequence: Synthetic coding sequence
atggagacaccaagccagcggagagccacacggtcgggggcacaagcatcctctactccgttaagccccactcgaattaccagactgcaggaaaaagaggacctacaggagcttaatgaccgattggctgtgtacattgaccgtgtaagaagcttggaaaccgaaaatgcaggtctacggttaaggattacggagtctgaggaggtcgtttcaagagaggtgagcggaataaaggccgcttatgaagcagagctcggcgatgccaggaagactcttgacagcgtggccaaggaaagagctagattgcaactggagctttccaaagtgagggaagagtttaaagagctgaaggcgcgaaatactaagaaggaaggcgacttgatcgctgcacaggccaggctcaaggacttggaagcactgcttaactctaaggaggccgcactcagtactgccctttccgaaaagcggactctggagggagaattacatgacctccgaggacaagtggcaaaactggaggcagctttgggcgaggcgaagaagcaattgcaggacgagatgctgcgtagagtagatgctgagaacaggttacagaccatgaaggaggagctcgatttccagaaaaatatctattctgaagaactccgcgagacgaaacgacgacacgagactagactggtcgagatcgataacgggaagcagcgggaattcgagagccgcttggccgacgccctgcaagagctaagggcccaacacgaggaccaggtggagcagtacaagaaagagcttgagaagacatatagtgcaaagctggataatgccagacaaagcgcagagcgcaactcaaatttagtcggagccgctcatgaagagcttcagcagtctagaataagaatcgactctctgtctgcccagctgtcccagctgcagaaacaattggctgctaaggaagccaaactgagggaccttgaggactctctcgctagggaaagggacacaagcagacgcctgctggctgaaaaggaaagggaaatggcagagatgcgcgcaaggatgcagcaacagctggacgagtaccaagaacttcttgatatcaaactggccctcgacatggagatccatgcgtacaggaagttgttggagggggaagaggagcgcttacgactaagtccttctcctacctctcagaggtcccggggtagggcttcttcccattccagccagacacagggcggaggctctgtgaccaagaaacggaagctcgaatctacagaaagtcgcagcagcttctcgcagcacgctcgaacttcaggaaactccctgcgcaccgcactcattaattccactggggaggaagtggccatgcggaagttggttagatctgtcacggtcgtcgaagatgacgaagacgaagacggagacgatctgctgcatcatcatcacgtaagtggatctagacgttag

SEQ ID NO: 228060 - DNA, 1725 bp, Artificial Sequence
  Description of Artificial Sequence: Synthetic coding sequence
atgggcaatagcgagggttgtaacactaagaaggagggggatctcattgccgctcaagcacggttgaaggatttagaggcactgctcaactctaaggaagctgcgttaagtaccgcactgagtgagaaacgaactctggagggcgagttgcacgatctgagaggacaagttgcaaaactggaagcggctcttggagaggccaagaagcagctgcaggacgagatgcttcgcagagtcgacgccgaaaatcgcctccagaccatgaaggaggaactggactttcagaaaaatatttattcggaagaactgcgtgagaccaaacgcagacatgaaactcgcctggtggagattgacaacgggaaacagagagagttcgagagcaggctggccgacgcactgcaagaactacgtgcccagcacgaagaccaagtggagcagtacaagaaagagctcgaaaaaacttattccgcaaaactcgacaatgccagacagagcgccgagagaaacagcaacctggttggtgccgcacatgaggagttgcaacagtcccgtattagaatcgactccctatcagcccagctctcacagctgcagaaacagctggcagccaaagaggctaagttacgcgacctggaggactctctggccagggagagagacacctccagaagactattggcagagaaggaacgggagatggccgaaatgcgtgcacgcatgcagcagcagctcgacgaatatcaggaacttctagatattaaacttgctttggacatggagattcacgcttatcggaaactcctggaaggtgaggaggagcgccttcggctgagtccttcaccaacttctcagcgttcacgaggtcgcgcaagttctcacagcagccaaacccagggtggcggttcagttacaaagaaaaggaagctagaaagcaccgagagccgttcctctttttctcagcatgccagaacatctggcagggtcgcagttgaggaggtcgatgaagagggcaaatttgtgcggttgaggaataagtctaatgaggatcagagcatggggaactggcagattaaacgccaaaacggcgacgatcctctgttgacatatcgtttccccccaaaattcaccctcaaagccggtcaggtggtgaccatttgggcggcaggggctggcgcaacgcactccccacctacagatctggtctggaaagcccagaatacctggggatgtggaaactccctgagaacagctctcattaattccacaggcgaagaagtggccatgaggaaactggttagaagcgttaccgtggtagaggatgacgaggacgaggacggtgacgacctgctgcaccaccatcatgggtcccactgctccagcagtggagacccagcggagtataacctgaggtctaggactgtgctatgcggcacatgtggacagcctgctgataaagcaagtgcatcagggtcaggggctcaagtcgggggtcctatcagttcaggatcctcagctagctccgtcacggtcactcgcagttacaggtcagtgggcggatctggcggaggatcatttggagataatctcgttacaagatcttacttattagggaattcctcgcccaggacacagagtcctcagaattgttcgataattcaggagatgggtatgcgttgggaagtcgaagagggacgcagaaaggtgtcccttagctgccttccttag

SEQ ID NO: 228061 - DNA, 1848 bp, Artificial Sequence
  Description of Artificial Sequence: Synthetic coding sequence
atgccgagtagaaagtttgccgatggggaggtggtccgcggacgctggcctggaagttctctttattacgaagtcgaaattctcagccacgacagcaccagtcagctatataccgttaaatacaaggatggcacagagctggagctgaaggaaaacgatatcaaacctttaacttccttccgtcagcgaaaaggtgggtccacctcctcctcaccttccagacggagaggtagcaggtcgcgctcacgctcccgcagccccggtaggcctcccaaatccgcacggaggagcgcctctgccagtcatcaagccgatatcaaggaagctagacgcgaggtggaggtcaaactcacaccccttattttgaagccttttgggaacagcattagtagatataacggagagcccgaacatatagaacgcaatgatgcccctcataagaatacccaagaaaaatttagtctctcccaggagagctcttacatcgcaactcagtactctctccgccctagacgcgaagaggtgaagctcaaagagattgactccaaggaagagaaatatgtggccaaggaactcgctgtgaggaccttcgaagtgacgcctatccgcgcaaaggatctggaatttggaggagtgccgggtgtgttcctcatcatgttcgggctccctgtctttctgtttttgctgctgctgatgtgtaagcagaaggacccatctctgctgaatttcccgccacctctgccagccctttatgagttgtgggaaactcgtgtatttggagtttatctgctgtggttcttaatacaggtgctcttttatctgctccccataggaaaggtggtggagggtacgccactgatcgacggccgacggctgaagtacaggttgaacggattctacgccttcatcctgacttccgctgtcattgggacctctctatttcaaggtgtggaattccactatgtctactcgcatttcctgcagttcgccctggctgccactgttttttgcgttgtgctctctgtgtacttatatatgcgctctttaaaggccccaaggaacgatctttcaccagcctcatctggcaacgctgtgtacgatttttttattggaagagagttgaaccccagaattggcacattcgatttgaagtacttttgcgagctccgacctggtctgatcgggtgggtcgttataaacctggtcatgttactcgccgagatgaagatccaagatcgagccgtcccatccttagctatgattctggtaaactcatttcagctcttgtatgtagtggatgccctgtggaatgaggaggccctactcacaactatggacatcattcatgacgggtttggttttatgctggccttcggggacctcgtgtgggtgccatttatctactccttccaggcattctatctggtgagtcaccctaacgaagtgagctggcccatggcttctctgattattgttcttaaattatgcggctatgtcatctttcgtggagcaaattcccaaaaaaatgccttccgtaaaaatccctcagacccaaagctggcacacctcaagactatccacacgtccaccgggaaaaaccttttagtgtccggttggtgggggttcgtgcgacaccctaactatctgggggatctcattatggcattggcctggtctttgccctgcggctttaatcatatcctgccatatttttacataatctacttcactatgctgctggtgcaccgcgaggcacgggatgagtaccattgcaagaaaaagtatggcgtagcttgggaaaaatactgccagagggtgccataccgaatctttccttacatttactag

SEQ ID NO: 228062 - DNA, 1848 bp, Artificial Sequence
  Description of Artificial Sequence: Synthetic coding sequence
atgccgtcccgaaagttcgcggatggtgaagtggtccggggaaggtggccaggcagttcgttgtattatgaggtagagattctctctcatgatagcacctctcagctctacaccgtcaagtataaagatgggactgagctggagctaaaggagaacgacatcaaaccactcacatcattccgccagcgaaaaggaggctcgaccagctctagtccgtctagacgtcggggaagccgctctaggagccggagtcgatctcccggaagacccccaaagtccgccaggcggagtgcctctgcctcacaccaggcagacatcaaagaggccagaagagaggtcgaagttaaactgacgcctctgattctgaagccatttggtaattctatttcccggtacaatggcgagcccgagcacatcgaacgtaacgacgcccctcataagaatacccaagagaagttcagcctctctcaggagtcgagttacatcgctacacagtacagccttagacctcggagagaggaggtgaagttgaaagagattgatagcaaggaagaaaaatatgtagccaaggagttggcagtgcggacattcgaagtcacgcccataagagccaaggacttagagtttgggggtgtgccaggagtgtttctcattatgtttgggctgccagtctttctgttcttgttgttgttgatgtgtaagcaaaaggacccatctctcctcaacttcccacctcccttacctgcactttacgagctctgggagacacgagtgttcggggtttacctcctctggttcttgatccaggttctgttctacctcctcccaattggcaaggtggtcgagggaaccccccttatcgacggtagacgactgaagtaccgtctaaatggattctacgcttttatccttacgagtgccgtcattggtaccagcttgttccagggcgttgagttccactacgtatattcacactttctccagttcgcactggccgcaactgtgttttgcgtcgttctgtcggtttacctgtacatgcgcagcctgaaagcccctaggaatgatctgtcacctgccagctcaggtaatgcagtgtatgatttctttattgggagggaactgaaccctaggatcggcacttttgatctgaagtacttttgtgagcttcggccaggcctaatcgggtgggtggtgattaacctggtcatgttgttagccgagatgaagatccaggaccgcgctgtgccctccttggcaatgatcctggtgaactccttccagttgctatatgttgtagacgcgttatggaatgaggaagcgctgcttaccaccatggatatcatccacgatggtttcggctttatgctggcattcggtgacctggtctgggtacctttcatatactcatttcaggctttctacctcgtctcacaccccaacgaggtgtcttggccaatggcttctctcattatcgtgctgaagctatgcgggtatgtgatcttcagaggcgcaaattctcagaagaacgcattccggaaaaacccgtccgaccccaagctggcccacctgaagactatacacacaagcactggcaagaacctgttagtgagcggctggtgggggttcgtcagacacccaaactatcttggagacctgataatggctttggcttggtccctgccctgcggattcaaccatatcctgccctatttctacattatctattttaccatgctcctggttcatagagaagcccgagacgagtatcattgcaagaagaaatatggtgtcgcgtgggaaaagtactgccagcgagtcccttaccgtatttttccttacatctactag

SEQ ID NO: 228063 - DNA, 156 bp, Artificial Sequence
  Description of Artificial Sequence: Synthetic coding sequence
atgcctagtcggaagttcgccgatggtgaggtggtgagaggccgatggccaggttcaagtctgtactacgaggtcgagatcctcagtcatgactcaacctctcaactgtatactgtaaagtacaaggacggcacggaactggagcttaaggaatag

SEQ ID NO: 228064 - DNA, 387 bp, Artificial Sequence
  Description of Artificial Sequence: Synthetic coding sequence
atcggcagggagctcaacccaaggattggcacgttcgacctgaaatacttctgcgaacttcggccaggtttgatcggctgggtcgtcatcaacctggtgatgctcttggctgagatgaaaattcaggacagagccgtcccgtccttagccatgatcttggttaatagttttcagcttctgtatgttgtagatgccctgtggaacgaggaagctctcctaaccactatggatatcatccatgacggatttgggttcatgctggctttcggagatcttgtatgggtgccattcatatattcgtttcaggctttttatctggtaagccacccgaatgaagtgtcttggcccatggcatccctcatcatcgttttgaaaagagaatactag

SEQ ID NO: 228065 - DNA, 642 bp, Artificial Sequence
  Description of Artificial Sequence: Synthetic coding sequence
atgccatcaaggaaattcgccgacggtgaagtcgtgcggggtcgctggcccggaagtagtctgtattatgaagttgagattctgtcccacgacagtacatcacagctgtataccgttaaatacaaggatggcactgagctcgaactcaaggaaaatgacatcaagccgctcacttcttttcgccagcgcaaaggaggttccacctcctcctccccttcccggaggaggggctctaggagcaggtccaggagccggtctccaggacgaccccctaaatctgcaagacgatcagcctctgcctctcatcaggccgatattaaggaagctcgtagggaggttgaagtgaaactgacacccctgatcctcaaaccctttggaaactccattagccggtacaacggggaacccgagcacatcgaacgcaatgacgctcctcataaaaatacacaggaaaagtttagtctatctcaggagtccagctacattgccacgcagtactccctgagacctcgcagagaggaggtcaagcttaaggagattgacagtaaagaagagaagtatgtggcaaaagagctggccgtgagaacttttgaagttacaccgatacgtgccaaggacctggagtttggcggagtgccatag

SEQ ID NO: 228066 - DNA, 324 bp, Artificial Sequence
  Description of Artificial Sequence: Synthetic coding sequence
taaagcaccagtctgaagatgtatttctatttctatatcgaccttaagacaatccacacaagcacaggaaaaaacctgctagtgtccggctggtggggctttgtgaggcaccccaactacctcggtgacctaatcatggcactagcttggtctcttccgtgtggcttcaatcatatcttgccttacttttacattatctacttcactatgctgctggttcaccgcgaggccagggacgaatatcactgtaaaaagaagtatggtgtggcctgggagaaatattgtcagagagtaccctatcgaatcttcccctacatttactag

SEQ ID NO: 228067 - DNA, 1761 bp, Artificial Sequence
  Description of Artificial Sequence: Synthetic coding sequence
atggccactgcaacacccgtgccgccacgcatgggctcacgggctggcggtcccacgactccactatccccaacaaggctcagcaggctccaagagaaggaggagcttcgggaactgaacgataggttggcggtctacatcgacaaagtgagaagtttggagacagagaactccgcattgcagctccaggtgaccgaacgggaagaagtgcgtggtcgtgaactgaccggcctgaaggctttgtatgagacagaacttgctgacgcacggagagctttggatgatacagcgcgagagcgcgctaagctgcagattgagctaggtaaatgtaaagcagagcatgaccaattattacttaactatgcaaagaaggagagtgatctgaacggagcacaaatcaagctgcgagaatatgaggccgctctcaattcaaaggatgcggctcttgcgaccgccctgggcgataaaaagtcgctcgagggagatctcgaggacctgaaagatcagattgcgcaattggaggccagtctcgcggctgccaaaaagcagctcgccgacgaaaccctccttaaagtggacctagagaaccggtgccagagcctgacagaggatctggagttccgtaagtccatgtatgaggaagagataaatgaaactaggcgcaaacacgagaccagactcgtggaggttgactctggacgccagattgagtatgaatataaactggcccaggctctgcacgaaatgcgggaacagcacgatgcacaggttcgactgtacaaagaagagttagagcagacctatcacgccaagctggaaaacgcacgcctgtccagcgagatgaatacaagtacagtgaactcagcacgcgaggaattaatggagtcccggatgcgaattgagtccctctcatcgcagctgtccaaccttcagaaagagtctcgcgcatgcctggagcgaatccaggaacttgaagacctgctcgcgaaggagaaagataatagcagacggatgcttaccgataaagaaagggagatggcagagattcgtgatcagatgcagcagcaacttaacgactacgagcaactgctagatgttaagttggcgctggatatggagatcagtgcgtaccgcaagctgctggaaggggaggaagagaggctgaaattatccccgtccccctccagccgggtaaccgtcagccgggcttcttcctcccgaagtgttagaactacgaggggcaaaagaaagcgcgtcgatgtggaagaaagtgaggcatcctctagcgtctccatctcacactccgctagcgcaaccggaaacgtctgtatcgaggagattgacgttgacggaaagtttatccggcttaaaaatactagcgagcaggaccagcctatgggcggatgggagatgattcgcaaaattggtgatacctcggtttcatacaagtacacatctcgttacgtgcttaaggcaggccaaaccgttactatctgggccgctaacgccggagtgacagcctccccccctaccgatctcatatggaaaaatcagaatagctggggtacaggagaggatgtgaaggtcatcctcaagaattcacaaggagaggaggtcgctcagagatctactgtgttcaaaacgactatcccggaagaagaggaggaggaggaggaggccgctggagtcgttgtcgaggaagagcttttccatcagcagggaacacccagggcctctaatcgtagctgtgcaataatgtag

SEQ ID NO: 228068 - DNA, 1803 bp, Artificial Sequence
  Description of Artificial Sequence: Synthetic coding sequence
atggccactccactccctggcagagctgggggaccagccacgccactgtctccaacgagactatctcggttacaagagaaagaggaactgagagagttgaacgaccgcctggcacactacatcgatcgagtacgcgctctcgaattggaaaatgatagactactgttgaagatcagcgagaaggaagaagtaactacaagggaggtgtccggcattaaggcactctacgagtctgagttagctgacgctcgcagagtgctggatgagactgctcgggagcgcgcacgcctgcagatcgagattggtaagttaagagccgagctggatgaggtgaataagtcggccaaaaaaagggagggggagctaaccgttgcccagggtcgcgtgaaggatttagaatcgctctttcaccgctcagaagtggaactcgctgccgcactctcagataaacgcggtctggagtcagacgtggctgaactgcgagctcagttagccaaagccgaggacggacacgcagttgctaaaaagcagctggagaaagagactttaatgcgggtggacctcgagaaccggtgtcagtcactgcaggaggagctggacttcaggaagtcagtgttcgaagaggaggtcagggagacccgtaggagacacgagcgtaggctggtggaagtggacagctcgaggcagcaggaatacgactttaaaatggcacaggcactagaagagctgcggtctcagcacgatgaacaagtgagactttataaactagaactcgaacaaacctaccaagcgaagttggactccgccaagctctccagtgatcaaaatgataaagctgccagtgccgctcgagaagagcttaaagaagccaggatgagactcgagagcctgagctaccagctgtcaggccttcagaagcaggccagtgcggctgaagatagaatccgcgaattggaggaggcaatggcaggtgaacgcgacaagttcagaaagatgttagacgctaaggagcaggaaatgactgagatgcgggacgtcatgcaacagcagcttgcggagtatcaggagcttctggatgttaagcttgcccttgacatggagataaatgcttatcgaaaactgcttgagggcgaggaggagcgtctgaaactgagcccaagcccatcgagcagggtaacagtgagtagggctacctcctcatctagtgggagcttgagcgccacaggtcggctgggacgttctaagagaaaacgcctagaagtggaggaacctcttggctctggtcccagtgtgctgggtaccgggactgggggttccgggggattccacctcgcccaacaagcatctgcttccggaagtgtgtccatcgaagaaatagacttggagggtaaattcgtgcagcttaagaacaattcggacaaagaccagagtctgggcaactggcgcattaagaggcaggtactggagggggaggagatcgcttataagttcactcctaagtacattctgcgggcaggccaaatggtgacagtttgggccgcaggagccggagtagctcacagtccccctagcactctggtgtggaaggggcagtcaagctggggaactggcgagagtttccgaacggtcctcgttaatgccgatggggaagaggttgccatgagaactgtcaagaagagcagtgtaatgagggagaatgaaaatggcgaggaagaggaggaggaagctgaattcggcgaggaggatttgttccaccagcagggtgacccaagaaccacctctcgaggttgttatgtgatgtag

SEQ ID NO: 228069 - DNA, 1803 bp, Artificial Sequence
  Description of Artificial Sequence: Synthetic coding sequence
atggcaacccctctacccggacgagccggaggacctgctacccctttatccccaacgcggctgagtcgcctgcaggaaaaggaagagctgagggagctgaacgataggcttgctcattatattgaccgggtgagagctttagaactcgagaacgataggctgctgctcaaaatctccgaaaaggaagaagttactacaagggaagtcagtggcattaaggcgctgtatgagtccgagctggcggacgcgaggcgggtgctcgatgagactgccagggagagggctagactgcagatagagataggaaagctccgtgccgaattggacgaggttaataagagcgcgaaaaaacgggaaggggagctcaccgttgctcagggtagagtaaaggatctcgagtccttgttccaccggagcgaagtagaactggctgctgcactgagtgataagcgtggtctggaatctgacgtggcggaactgcgggcacaactggcaaaagccgaggatggacatgcagtggccaaaaaacaactggagaaagaaactctgatgagagtggatctggaaaatagatgccagtctctgcaggaggaactcgattttcgaaagtccgtgttcgaagaggaagtccgtgaaacgagacgcagacacgagcgcagacttgtggaggttgactcatcaaggcagcaagagtatgatttcaagatggcccaggcactcgaggagctaagatctcaacacgatgagcaagtgcgtctgtacaagttagaactcgagcagacatatcaggccaaactcgattccgctaaattgtcttcagaccagaatgataaagccgcttccgccgctcgggaggagttgaaagaagcacggatgcgactcgagtccctgtcataccaactgagtggcttacagaaacaggccagtgctgcagaagatcgaatccgagagctggaggaggccatggccggagagcgggacaaatttagaaaaatgctggacgccaaggagcaggagatgactgagatgagggacgtgatgcagcagcagctcgcagagtaccaagagcttcttgatgtcaaactggcactggacatggagattaatgcctaccgcaagttgttggagggggaagaagaacgactgaagctctctccgagtccaagctctcgggtcacggtttcgcgcgcaacaagttcttctagtggctccctgagcgcaactgggagactgggaagaagcaagcggaagaggctggaggtggaggagcctttggggagtgggccaagcgtgctcggcactgggacaggtggcagcggcggttttcatctagcgcagcaggcatctgcttctgggtctgtgtcaattgaagaaattgatctcgagggaaagttcgtgcagctaaagaacaactcagataaggaccagtccctgggaaattggcgcattaagcgacaagtgcttgaaggtgaagagatagcgtacaagtttaccccaaaatatattctgcgcgcagggcaaatggtgactgtttgggcagcaggcgcaggcgttgcccacagcccaccgagtacccttgtgtggaaaggccagtccagttggggtactggcgagtcttttcggacagtgctggtgaatgctgacggcgaagaggtcgcaatgaggacggtgaaaaagtcatccgttatgcgggagaacgagaacggggaggaagaggaggaggaggccgaatttggcgaagaggacctgtttcatcaacagggcgatcctcgtacgacatcccgcggatgttatgtgatgtag

SEQ ID NO: 228070 - DNA, 651 bp, Artificial Sequence
  Description of Artificial Sequence: Synthetic coding sequence
atgttaattggaggcaacattgaggtccacgtaaaccccggtgatggtaccggactgagaaaggcccttttgcatgcccctaccggtacatgttctgacggccaggctcactcaattagtttagtacggaatcggcgaattatcactgttcagctcgacgagaacaaccccgtcgagatgaagctggggactcttgtggagagccgcacaatcaacgtgagcaacctctacgtgggcggaatcccagaaggggaaggcacttctctgcttacgatgcgccgatcctttcacggttgcatcaaaaacctcatcttcaatctcgagctgctcgattttaattcggcggttatgagcaagagcacatggacacctgcgggttgtcagaaggggcttagttggctgcccatgcagcgtacaaaacttcttccagaaccacgcgcattcccagttggagccgcaagcttcactatctcccaggttcaatctgcaaaggagggcctaggccagagggaattgaagtggggcctggctgtgaaggtgccagccaaagcgggagccggagccggagccggtgccgttctgaagattcgggcaggaacgggcagggagcgcgtcccccaggccactcagatgacccgaccaaacccctag

SEQ ID NO: 228071 - DNA, 9227 bp, Artificial Sequence
  Description of Artificial Sequence: Synthetic coding sequence
atgcgaggcggagttcttctcgtgctgctcctgtgtgttgccgcacaatgcagacagcgcggtctgtttcccgctattctcaacctggctagtaacgcccacatctccactaatgctacgtgtggtgagaagggacctgaaatgttttgtaagttggttgagcacgttccgggaagacctgtccgcaatccacagtgtcgcatttgtgatggcaattcggctaatcctcgggagcggcacccaatttctcacgcgatcgacggcactaataattggtggcaaagcccgtctattcagaacgggagggagtaccattgggtgaccatcaccctggaccttcgtcaggtgtttcaggtagcgtacgtgattatcaaggcagctaacgctccccgaccgggaaactggatcctggagagaagtctcgatggcacaacttttagcccctggcagtactatgctgtttcagactctgaatgcctgagccggtacaatataacgccacgtcgaggtccaccaacataccgcgctgacgacgaagtgatctgtactagttactactccaggctggtgccattggaacacggtgaaatccatacttccctaattaatggcagaccatcagctgacgatctgagtcccaaactcttggaattcacatccgcccgttatattagactgagactccagcgcatcagaaccctcaacgcagatttgatgaccttaagtcatagagagcccaaggagttggaccctatagttacccgacggtactattattcgataaaagacatctcggttgggggaatgtgcatctgttacggccatgcctcatcgtgcccctgggacgaaaccacgaaaaagctgcaatgccagtgtgagcataatacttgtggagagtcgtgcaaccgctgttgccccggataccaccaacaaccctggcggccaggcactgtgtcaagtggtaacacgtgcgaagcttgcaattgccataacaaggccaaggattgttattatgacgaatcagtcgctaaacagaaaaaatctctcaatacagccggacaattcaggggtggtggcgtgtgtatcaattgtctccagaatactatgggtatcaactgcgaaacgtgtatcgatggatattacagacctcacaaggtgtctccatacgaagatgagccctgtcgcccttgcaactgcgatcctgttggttcgctcagttccgtgtgtatcaaagacgatctgcatagcgacttgcataacggtaaacagcctggacagtgcccctgcaaggaaggttatacaggggagaagtgcgatagatgccagcttgggtacaaggattaccccacatgcgtgtcgtgcggctgtaacccagttgggagtgccagtgacgaaccctgcacaggcccatgcgtgtgcaaagagaacgttgagggcaaagcctgcgatcgatgtaaacccggattctacaacctcaaggagaagaatcctcggggttgctcagagtgcttttgcttcggggtcagtgacgtgtgtagctccctaagctggcccgttggacaggtgaactctatgtcaggatggctggtcacggatctaatctctccccgaaaaatcccctcgcagcaagatgctcttggtgggagacatcaggtctccatcaataataccgcagtcatgcaaagactcgcccctaagtattattgggcagccccagaggcatatcttggcaacaagctgacagcatttggaggctttctgaagtacactgtaagctatgacatacccgtggagacagtggactctaacttaatgtcccacgccgatgtcatcatcaaaggcaatgggctgacactcagcactcaagctgaagggttgtcccttcagccctatgaggagtatcttaacgtggttaggttggttccagagaactttcaagactttcactctaaacgacagatcgaccgggatcaacttatgacagtactggccaatgtcacccacctacttattagggcgaattacaacagtgccaaaatggctctttaccgtctagaaagcgtgtcgctcgatattgcctcaagcaacgctatcgatttggtggtagccgctgacgtggaacattgcgaatgcccacaggggtatactggcactagctgcgaaagttgcctatcaggatactacagggtggatggcatcctcttcgggggaatttgtcagccttgtgaatgtcatggccacgctgctgagtgcaacgtacacggggtttgcatcgcttgcgcacacaacactacaggagtgcactgcgaacagtgcttgcccggattctacggtgaaccctcaagggggacccccggagactgtcaaccctgtgcttgtcccctaacaatcgcgtcaaataacttctctccaacttgtcacctcaacgatggagatgaggtggtctgtgactggtgtgcccctggttactcgggggcttggtgcgaacgctgtgccgacggctactacggaaaccccacagtgccgggagagagctgcgtcccctgcgactgctccggaaatgtggatccctctgaggcaggacattgcgactctgttaccggcgagtgcctcaagtgtctgggcaacacggacggagcccactgtgagaggtgcgccgacggattctacggggatgccgtgaccgcgaaaaactgtcgtgcgtgcgaatgccacgtgaagggcagccactccgctgtctgtcaccttgagacagggctctgcgactgtaaacccaacgtaacagggcagcagtgtgaccagtgtctccatggttactacggtctagactccgggcatggctgccgcccatgtaactgcagcgtggcaggaagtgtgtcagacggctgtacagatgaagggcagtgtcactgcgtccccggtgtagccggtaaacgatgcgatcggtgcgctcatggcttttacgcttaccaggacggtagttgcactccttgtgattgcccccatacccagaacacgtgtgatccagagaccggcgaatgcgtgtgccctccccacacccaaggagttaagtgcgaagaatgcgaggatggacattggggatacgacgctgaggtgggctgccaggcatgcaactgctccctggtcgggagcacccatcaccgctgtgatgtagtgacaggccactgtcaatgcaaaagcaagtttggcggacgggcttgtgatcagtgcagcttggggtatagagacttccccgactgtgttccctgcgattgcgatctgcgcggtacgagcggcgacgcctgcaaccttgagcaaggtttgtgcggatgcgtcgaagaaactggggcttgcccctgtaaggaaaatgtcttcggaccacagtgcaacgagtgtagagagggcacattcgcattacgggcagacaaccctctgggttgttctccctgtttttgttccggactctcacatctgtgctccgagctcgaggactatgtgcgcacacctgtcacattaggcagcgatcagcctctcctcagggttgtgtcccaaagcaacttgcgtggcacgactgaaggcgtatactaccaggcacctgatttcctcttagacgctgcaaccgtgaggcagcatattcgagccgagccattttattggcgcctgccacaacaattccaaggcgatcaactcatggcctatggagggaaactgaaatactccgtcgcattttactccttggacggggtcggcacctcgaatttcgaaccccaggttctcataaaagggggaaggattcgaaaacaggttatatatatggatgccccagcccctgagaacggggtgcgtcaggagcaagaggtggccatgcgggagaatttttggaagtactttaacagcgttagcgaaaagcctgttacccgcgaggacttcatgtctgtcctatcagatatcgagtatatcctgatcaaagcaagctacgggcagggcctccagcagtcgagaatcagcgacatttctatggaggtggggaggaaagccgagaaactgcatccagaagaggaggtggcaagcctgctggaaaattgtgtgtgcccccctggaacagtggggttttcttgtcaagactgtgctcctggataccaccgcggtaagctgcccgcaggatcagatcgcggaccacgccctttggttgctccctgcgtcccgtgctcatgtaacaaccacagtgacacttgcgatcctaacaccgggaagtgtctgaactgtggggacaacactgcaggtgaccactgtgacgtgtgcacatcagggtattacggcaaggttactggcagcgcttccgattgcgcactttgcgcctgcccacatagtcctccggctagcttcagtccaacctgcgtgcttgaaggcgaccacgatttcaggtgcgatgcctgtttgctgggttatgagggtaaacattgtgaacgctgctcctccagctattatggaaacccacagacgccgggaggttcctgccagaaatgcgactgtaacccacatggctctgtccatggagactgcgaccgcacatctggccagtgtgtctgtcgcctgggagcctcaggccttcggtgcgacgagtgtgagcctagacacatcctcatggagacagactgcgtgtcttgtgacgacgaatgcgtgggtgtgttgctgaatgacctggatgaaatcggggacgcagtgctatctctcaatcttacaggtattattcccgtgccgtatggcatattgtccaatctggaaaataccaccaaatacctccaggaatcccttctcaaagagaacatgcagaaagatttgggcaagattaagctcgagggagtcgccgaggagacagataatctccagaaaaagctgacaaggatgctggccagtacgcagaaggtgaatagggcaaccgaacgaattttcaaagagagccaggacctggctattgcaatcgaacgcctacagatgtccatcactgaaataatggaaaagacaacactcaaccagaccctggacgaagatttcctgctgccgaactccacattacagaatatgcagcaaaacggcacttccctgctggaaatcatgcaaatccgcgatttcacccagctgcaccaaaacgccaccctcgaactgaaggctgccgaggacctcctttctcagatccaggagaattaccaaaagccattagaagaactggaggtcctgaaagaagccgcaagccatgtcctcagcaagcataacaacgagcttaaagctgccgaggccctggtgcgagaagccgaggctaagatgcaggagtctaatcacctgctgctgatggtcaatgcgaatcttcgggagttttctgacaaaaagcttcacgttcaggaggagcagaatctcacatctgaacttatcgtccagggccgtgggttgatcgatgcggctgccgctcaaactgatgccgttcaagacgcactcgagcacctggaggaccatcaagacaaactcctgctctggagtgccaaaatccggcaccatatagatgatctcgttatgcatatgagccagcggaacgcggtcgacctcgtatatagagcagaggaccatgctgccgagtttcaacgactcgcggatgttctgtattccggtctggaaaacattaggaacgtatctttaaacgcaacttcagcagcatatgtgcattacaacatccagtccctgatcgaggaatccgaagagctggcccgtgacgcccatcggaccgtcaccgagacctcactgctttccgagtcgttagtgagtaatgggaaggctgctgtccaacggtcatcacgatttctgaaggagggcaacaacctgtcccggaaattgccaggcatcgcactggaactgtccgagctgagaaataagacgaatagatttcaagaaaacgccgttgaaattactcgccagaccaacgagtctctgctgatactgcgggcaattcccaagggaatcagggacaagggcgctaagaccaaggaactcgcaacctctgcgagtcagtctgctgtaagcacactgcgggatgtagctggcttatcacaggagctcctgaacacatccgctagcctgagtcgagtcaacactaccttgcgagagactcatcaactgttacaagactcaaccatggccaccttactggcaggtcgaaaggtgaaggatgtcgagatccaggccaatctgctgttcgaccgcctgaagcccctgaaaatgctcgaagagaacctgtcacgcaatcttagtgaaatcaaactgttgatttcacaggctcgaaagcaggctgcgagtattaaagtcgccgtctcagccgatagagactgtattcgtgcataccagccccagatcagcagtactaattataatacccttactcttaatgtcaaaacccaagagccagacaacttacttttctacctgggcagcagcaccgcgtcggactttctggcagttgagatgagacggggaagggtcgcatttctgtgggacctaggctcaggctcgaccaggctggaatttcccgatttcccgatcgatgataaccgatggcactccatccacgttgctcgatttggcaacatcggttctctcagtgtgaaagagatgtcatccaaccaaaagtcacccaccaaaacttccaagtcacccggaaccgcaaatgtgttagacgtcaacaactctacgctgatgtttgtcgggggtctggggggacagatcaagaagagccccgctgtgaaagtcacccactttaaaggctgcttaggagaagcctttctaaacggaaagtccataggcttgtggaattacattgagcgcgaaggaaagtgtcgaggctgtttcgggagttcccaaaatgaggacccgtctttccactttgatggctccgggtactcagtcgtggaaaagtctctgccggctacggtgacccagatcattatgttattcaacacatttagccccaacggcctgctcctgtaccttggctcttacggcacaaaggacttcttgtctatagagctttttcggggacgtgtgaaggtgatgactgacctcggctccggtccaataactctacttacagaccggaggtataataacggcacttggtataaaatcgcgtttcagcgcaatcggaagcagggagtcctggctgtgattgacgcttacaatacaagtaacaaagaaaccaaacagggagaaaccccaggcgcttcttcagatttgaatcggctggacaaagatcctatttatgtgggcggtctgccccgaagccgcgttgtccgacgaggggtgactacaaaatcctttgtggggtgtattaagaacctggagatcagcaggtccacattcgatctgctgcggaattcatatggggtcaggaaaggatgccttctcgaacccatccggtccgtctcgtttctcaagggaggctacatagagttaccaccaaaatccttaagcccagagtcagagtggctcgtgaccttcgccactacaaactcatctggcatcattctggccgctctgggaggcgacgtggaaaaaaggggcgatcgcgaggaggcccatgttccctttttcagcgtgatgctaatcggagggaacatcgaagtgcacgttaatcctggcgatggaacagggctgcgcaaggcactactacacgcacccacaggcacatgtagcgacggacaggcccactctatcagtctggtcaggaatcggaggattatcaccgtgcaacttgacgaaaataatcccgtggaaatgaagctgggaactttggtcgagtccaggacaatcaatgtgagcaacctgtacgtggggggtatcccggagggggagggtacctccctcctaacgatgcggagatccttccacggctgcattaaaaacctgatcttcaacctcgagttgctggactttaacagcgctgttggtcacgagcaagtggacctggatacatgctggctgtccgagaggcccaagcttgcccctgatgccgaggactccaagctcctaccggagccaagagcattccctgagcagtgcgtggtggacgccgcattggagtacgtgcctggcgcacatcagttcggtctgacccaaaatagccatttcatcctgccttttaatcaatccgctgtgcgcaaaaagctctccgtagagctgtcaattagaacctttgcctcaagcgggctcatttactacatggcacatcagaaccaggccgactacgcagtgctgcagttacatggcggtcgactccactttatgtttgatttaggcaagggacgaaccaaggtatcgcaccccgctctattaagcgatggcaaatggcatacagtcaagactgactacgttaagaggaaaggatttattactgtggatggtagggagagtcccatggtgacggttgtgggggacggcactatgctggatgtggaaggactgttttacctgggcggtttaccaagccagtaccaagctagaaagatcggaaacattacacactctataccagcctgcattggcgacgtgacagtcaattctaagcagttggacaaagattctcccgtgtccgcatttactgtgaatcgctgctacgccgttgcccaggagggtacatacttcgacggctccggatatgccgctctcgtcaaagaggggtacaaggttcagtccgacgtgaacatcacactagagttccgcacgagcagccagaacggcgttctgttaggcatttcaactgccaaagtggatgcaattggcctggagctggtggatggaaaggttctgtttcatgttaacaacggtgctggacgcattaccgccgcttatgaacctaaaacagcaacggtgctttgcgacggtaagtggcacaccctccaagctaataaatcaaagcacaggatcacacttattgtcgatggcaacgctgtcggggctgagagtccccacacgcaatccacatcagtggacacaaacaaccccatttatgtgggcggttatcccgctggcgtgaaacaaaagtgccttcgcagtcagaccagcttcaggggttgcctgcgcaaactggcactgattaaaagcccccaggtccagagtttcgacttctctcgggcattcgagttgcatggcgtctttctgcattcctgccccggtaccgagtccta

SEQ ID NO: 228072 - DNA, 9365 bp, Artificial Sequence
  Description of Artificial Sequence: Synthetic coding sequence
atgcccggagcagcaggtgtgctgctgctgcttctgttgagtggcggtttgggtggagttcaggctcaacggcctcaacagcagcgccagtctcaggcccaccaacagagaggcctttttcctgctgtgttaaacctcgcttccaacgctctcattacaacgaacgctacctgcggggaaaagggccctgaaatgtactgcaagcttgtcgagcatgtgccaggccagcccgtgcgtaaccctcagtgtcgcatctgtaatcaaaactcgagtaatccaaaccagcgacaccccatcacgaatgccattgatggaaagaacacatggtggcaatcaccgagcattaagaatggaatcgaataccattacgttaccataaccttagacctgcagcaagtctttcagatcgcctacgtgatagtcaaagctgccaattcccccagacccggtaattggatcctcgaaagatccttggacgacgtggagtataagccatggcagtatcatgccgtaacagatacagagtgcctcacactgtacaatatttatcccaggactggtccaccatcttacgctaaagatgatgaagtaatctgtacctcattctactcgaagatccaccccctcgagaacggcgaaatccacattagtctcattaatgggagacccagtgctgacgatccgtcccctgaactgctcgagtttactagcgcacgatacatcagattgcgctttcaaagaatacggactctcaatgctgacttaatgatgtttgcacataaggaccccagagagatagatcccatagtcacccggaggtactattactctgttaaagatatctctgtcggtgggatgtgcatctgttatggacatgcccgagcatgcccacttgaccctgcgacaaacaagagtaggtgcgaatgcgagcacaatacgtgcggggatagctgtgatcagtgttgccctgggttccaccaaaagccatggcgcgcaggcacttttctgaccaagacggagtgcgaggcgtgtaattgccatggtaaagcagaggagtgttactatgatgagaacgttgcaagacgcaacttgtctctgaatatccgcggaaagtatataggaggcggagtctgcattaattgcacacagaacaccgcaggaatcaactgcgagacttgcacagatggcttcttcaggcctaaaggagtgagtccaaactacccacgtccatgtcagccttgtcactgtgatcctatcggctcccttaatgaagtatgtgtcaaagacgaaaagcatgccagacgcggactggctcccggtagttgtcattgcaaaactggctttggaggagtcagttgcgaccggtgtgcccgtggttatacaggttatccagactgcaaggcctgtaactgttcaggtttggggtcaaaaaatgaggatccgtgttttggaccatgcatatgcaaggagaatgtggagggcggagactgcagtagatgcaaatccgggttttttaacctccaagaggacaactggaaaggttgtgacgaatgcttttgcagtggagtgtctaataggtgtcagagctcatattggacctatggaaaaattcaggacatgagcgggtggtacctgactgatctgcccggtaggatcagggtggcaccacagcaagacgatctggactcccctcagcagatctctatatcaaacgccgaggcaagacaggcactaccacatagttactactggtcagctcccgctccataccttggaaacaaactgccagcagtggggggacaattgacttttaccatctcatacgatctggaagaggaggaagaagataccgaacgggtcctgcagttaatgatcattcttgaggggaacgacttgtctattagcactgcacaggatgaagtataccttcatccttccgaggagcatactaatgtgctgttgctgaaagaagaaagcttcacaattcacggaactcatttcccggtgaggaggaaggagttcatgactgttctggcaaacctgaaaagggtgcttctgcagattacctatagttttggtatggatgcaatctttcgcctgtcatcagtcaacctggagagcgctgttagttaccctaccgacggaagcatcgcagctgccgttgaagtctgccaatgcccgccaggatataccggctcatcctgcgaatcgtgttggcctaggcacagacgggtgaacggcactatcttcggcggaatctgtgaaccgtgccagtgtttcggacacgccgaatcctgcgacgatgtcaccggagaatgtctcaattgtaaggaccatacggggggtccctattgcgataaatgcttacctggcttttatggtgagcccacaaaaggtacaagtgaggattgtcagccctgtgcttgcccacttaacattccttcaaataacttttctcctacctgccatctggaccgaagccttggacttatctgcgacggatgccccgtcggatacactggcccacgttgtgagcgctgtgccgaaggatattttggccaaccctctgtacccggagggagctgccagccatgccagtgcaacgataacttggatttcagcatccccggatcttgcgacagccttagcgggtcctgcctcatatgtaagcctggaactacaggcaggtattgtgagttatgcgctgacgggtattttggagacgcagtcgacgctaagaattgtcagccatgtcggtgcaatgcaggtggtagcttctcagaggtctgccacagccagaccggacagtgtgagtgcagagcgaacgtacaggggcagcgttgcgataaatgtaaagccggaacttttggccttcagtccgcacgagggtgtgtgccttgcaactgcaacagttttggctctaaatcttttgactgtgaagaaagcggccaatgttggtgccagccaggggtgaccggaaaaaagtgcgacaggtgtgcgcacggttacttcaattttcaggaaggaggttgcacagcatgtgaatgctctcaccttggcaataattgtgaccctaagacggggaggtgcatatgccctccaaacaccattggtgagaaatgttctaaatgtgctcccaatacttggggtcacagcattactaccgggtgtaaggcctgcaactgctcaacggtgggatccctggatttccagtgtaacgttaataccggtcagtgcaactgccaccctaagttctcaggtgctaagtgcacagaatgttcccggggtcattggaattacccacgatgcaacctgtgcgactgcttcctgcctggcactgacgcaacaacttgtgattcggaaacgaagaaatgtagttgctcagatcagacagggcaatgcacatgtaaagtcaacgtcgagggcatacactgtgatcgctgcaggcctggcaaatttgggttggatgcgaagaaccccctcggttgcagcagctgttattgttttggcacaacaacccagtgctccgaggcaaaggggctgatacgaacctgggtgacactcaaggccgaacagaccattctgcccttggtcgacgaagctctgcagcatacaaccacgaagggcatcgtctttcagcaccccgagatcgttgcacacatggatctgatgcgagaggatcttcatctggagcccttctattggaaactccccgaacagttcgaaggcaaaaagctgatggcttatggcggaaaactgaagtatgccatttactttgaggctcgagaagagaccggattttctacatataatcctcaggtgatcattagaggaggcacaccaacccatgccaggatcatcgtgcgccacatggccgctcctcttattggccagctcacacgtcatgaaatcgagatgactgaaaaggaatggaagtattatggggacgacccgcgtgtccaccgcactgtgactcgagaggacttcctggatatcctgtatgacatccactacattctgatcaaagccacctacggaaattttatgcgtcagtctcgcattagtgagatttctatggaggttgcggaacaaggtcgcggtacgaccatgactccccctgcggacttgatagagaaatgtgattgtccgctgggctactctggtctgtcatgtgaagcgtgcctgcctgggttttacagactaaggtcccaacctggaggaaggactcctgggccaacgttgggcacctgtgtgccctgtcaatgcaacggacacagcagcctgtgcgaccctgaaacttctatctgtcagaattgccagcaccacacagctggggatttctgcgaaagatgtgcgctcggctactatggaatcgtcaagggtttgccaaatgactgccagcagtgtgcgtgcccattgatctcgtcctctaataacttctccccttcttgcgtggccgagggcctagacgactatagatgtactgcctgcccgagaggctatgagggccaatactgcgaacgctgcgccccaggttacactggaagccctgggaacccaggcggatcttgtcaggaatgcgaatgtgacccctatggttccctcccagtgccctgtgatcctgtcaccggtttttgcacatgccggcctggtgcaaccggccgaaaatgcgacgggtgcaagcactggcatgcccgagagggttgggagtgcgtattttgcggcgacgagtgcacaggcctgcttctcggggaccttgctaggctcgagcagatggttatgtctatcaacctgactggaccacttccagctccgtacaagatgttgtacggcctcgagaacatgactcaggaactcaagcatctcctctcgccacaacgggcacccgagcgactgattcaattagccgaggggaatctgaatacgctggtcacggagatgaatgagctactcacccgcgctacgaaggtcaccgctgatggagaacagacaggccaggacgccgagaggaccaatactcgtgccaaaagcttgggagaattcatcaaggaattagcgcgtgatgccgaagctgtgaatgagaaggccataaagctcaatgagaccttgggtactagggatgaggcctttgagcggaaccttgagggactacagaaggagatcgatcaaatgatcaaagaacttcggcgaaagaatcttgagactcagaaggagatcgccgaggatgaacttgtcgctgcagaggctctactgaagaaggtgaaaaaactgttcggggaatctcggggagaaaatgaagagatggagaaagatctaagggagaagctcgcagactacaagaacaaagttgatgacgcctgggacttgcttagggaagcgaccgacaaaatcagagaggccaatcggctttttgccgtgaaccagaagaacatgaccgctttagagaaaaagaaagaagctgttgagtccggcaagcgacagatcgagaacactcttaaagaagggaacgacatcctggacgaagcaaaccggctggccgatgagatcaattccatcattgattacgtggaggacatccagacgaagcttcccccaatgtctgaggagctgaacgacaagattgacgatctgagtcaggaaattaaagaccgaaaacttgccgagaaggtttcccaggctgaatcccacgcagcccagctcaatgattcctccgcagttctggatggaattttggacgaagcaaagaatatctctttcaatgccacagctgccttcaaggcatacagcaacataaaagactatatcgacgaagctgaaaaggtggccaaagaggcaaaagatctggcccacgaagccacaaaattggccaccggtccacgaggactgctaaaagaggacgccaagggatgcctgcagaagtcctttaggatcttgaatgaagccaagaaactggccaatgatgtgaaggagaacgaggaccatctgaacggattaaagacccgaattgaaaatgcagacgctaggaatggagatctccttcgcacactaaacgatacgcttgggaaactgtccgctattccaaatgatactgccgctaaactgcaggccgtcaaggacaaggcgaggcaggccaacgacacggcaaaggacgtcctcgcacagatcacggaactgcaccagaatctcgacgggttaaaaaaaaactataataagctcgcagacagcgttgccaagacgaacgctgtagtgaaggatccctctaagaatacggttgcggatgctgatgctaccgtgaagaacctagagcaggaggcggaccgactgattgataagcttaagcctattaaggaattagaggacaatctgaagaaaaatatttctgaaatcaaggaacttatcaaccaggcgcgaaaacaggctaatagcattaaggtgtcggttagtagcgggggagattgcataaggacctacaagcctgaaataaagaagggcagctataacaacattgttgtgaacgtgaagaccgcagtggccgataacctacttttttacctgggaagcgccaaatttatcgattttttggcaattgaaatgcggaaaggcaaggtgtcatttttgtgggacgtgggatcaggcgtcgggagggtggagtatccagacctcaccatcgatgattcttattggtacaggattgttgccagcaggactggcaggaacgggaccatctcagtgagggctctcgacggtccaaaagcttccattgtgccttcaactcatcactccacctcacctccgggttacacgatactcgatgtcgacgctaatgccatgctgtttgtcgggggactcaccggcaagcttaaaaaagcagacgcggttcgagtgatcacgtttacaggctgcatgggtgagacgtattttgacaacaaacccatcggactgtggaattttcgcgagaaagagggggactgcaagggatgcacagtgtcacctcaggtggaagactctgagggaacaatacagtttgacggtgagggttatgccctggtgtcccgccctattcgatggtacccaaacatcagtacggtgatgttcaaattcagaacttttagctccagtgctctactgatgtacctggcaacccgtgatctgcgcgatttcatgagtgttgagctgactgatggacatatcaaggtctcctatgacctggggtctggcatggccagcgtggtctctaatcaaaatcacaatgacggcaagtggaagagtttcacactcagtcgcattcagaagcaagctaacatctctattgtggacatcgacactaatcaagaggagaacattgccacatctagcagcggtaataactttggcctggatctgaaagccgatgacaaaatttacttcggtgggctgccaactctcaggaacctgagcatgaaggcacgtccggaagtaaacctgaagaagtactccggttgtcttaaggacattgagatatcaagaaccccatataatattctctcttcaccggactatgtgggggtaacaaaaggatgcagcctcgaaaacgtgtataccgtgtcctttcctaagcctgggtttgtagaactttctcccgtgccaattgatgtgggaaccgagataaatctgtctttctcaactaagaacgagtccgggatcatcttattgggcagcgggggaactccagcaccacctcgcaggaagcgccgacaaactggacaggcatactacgcgatcctattaaatcgtggtaggcttgaagttcacctttccaccggagccagaaccatgcggaaaatagtaatcaggcctgaacccaatctatttcatgacggccgtgaacacagcgtccatgtggagcgcactcggggaatcttcaccgtgcaggtcgatgagaatcgcaggtacatgcaaaatttgaccgtggaacagccaatagaggtgaagaagctgttcgttgggggagcccctcctgagttccagccgagccccctgcgtaacatcccaccattcgagggttgtatttggaacttggtgattaactcagtgcctatggatttcgcccgacccgtctcctttaaaaacgccgatataggcaggtgtgcacaccaaaagcttagggaagatgaagacggagccgctcccgcagagattgtcattcaaccagagccagtgcccacacctgcgtttcctactcctacaccagtcctgactcatggtccctgcgccgctgagtccgaacccgctctgctaatagggtctaagcagtttgggcttagcagaaactcccatattgctatcgccttcgacgacacgaaggtgaagaataggctcacaattgagctggaagtgcgcaccgaggcggaaagcgggcttttgttttacatggcccgaataaaccatgcagatttcgccacagtgcagctccgcaatggcctgccgtacttttcatatgatttgggatccggagacacccacactatgataccaaccaaaatcaatgacggtcagtggcataagattaagatcatgcgctcaaagcaagagggcatcctctatgtagacggggctagtaatcgcacaatttcccctaagaaagccgatattttggacgtggtcgggatgctgtacgtcggaggccttcctattaattatacgacgcggcgaattggtcctgtgacttattctatcgacgggtgcgtccgaaacctgcacatggccgaggctccggctgatctagagcagcctacatcttctttccacgtggggacatgttttgcgaacgcacagagaggtacttattttgacggcaccgggttcgcaaaagccgtcggcggattcaaggtaggtctggacctgttagtcgaattcgagttcaggactactacaacaaccggcgtgttactgggcattagtagtcaaaaaatggatggcatgggcattgagatgatagatgaaaaactgatgttccatgtggacaatggcgcaggaagattcaccgctgtatatgatgctggtgtgccaggacacctctgtgacggtcagtggcacaaggttaccgctaataagattaaacaccgcatcgagctgaccgtggacggtaatcaggtggaagctcagtcccctaaccccgctagcacctcagccgacactaatgatccggtgtttgtgggaggatttccagatgatctcaaacagtttggactgaccacctccatcccttttcgaggttgcatccggtctcttaagctcacaaaagggacaggaaagcctctggaggtcaatttcgctaaagccctggaactgagaggcgtgcagccagtgtcctgccccgcaaatta

SEQ ID NO: 228073 - DNA, 9368 bp, Artificial Sequence
  Description of Artificial Sequence: Synthetic coding sequence
atgccaggcgctgccggagtgctgctgttgctgctgttatccgggggattaggaggcgtgcaggctcagcgccctcaacagcagcgccagtcccaggctcatcagcagaggggtttatttcctgccgtgctaaacctcgccagtaacgctctgataacaacaaacgccacttgcggagaaaagggccctgaaatgtactgcaagctcgtagaacatgtgcccggacagcccgtcagaaatccacaatgtcggatctgtaatcagaactcgagtaacccaaatcagagacaccctattacaaatgcaatagatggcaaaaacacttggtggcagtccccatcaatcaaaaacggcatcgaataccattacgttacaataaccctggacctacagcaggtctttcaaatcgcctacgtaattgttaaggccgcaaatagccctagaccgggaaattggattctggaacggtcactggatgacgtggagtacaagccatggcagtaccatgcagtaaccgatacagaatgtctcacattgtataacatctatcctcgtactgggcctccatcatacgccaaggacgacgaagttatctgtaccagcttttattctaaaatccacccattggagaatggggagattcacatctcattaattaatggtagacccagtgccgatgatccatcacccgagcttctggagttcacatccgcccgatacattcgcctgagattccaaaggatccgcacactaaacgccgacctcatgatgtttgcacacaaggacccaagagaaatcgaccccatagtcacccggcgatattactattcagtgaaagacatctctgttggagggatgtgtatttgctacggccacgcgagagcatgcccactggatcccgctacgaacaaatcccggtgcgaatgtgagcataatacatgtggtgacagttgtgaccagtgttgccccggattccatcaaaagccgtggcgcgcagggactttcctcaccaagacagagtgcgaggcctgcaactgtcacggcaaggctgaagagtgctattatgatgaaaatgtggcacgtcgtaacttgagcctgaatattcgagggaagtatattggcggaggcgtttgtattaactgtacacagaatacagccggtataaactgcgaaacgtgcaccgacgggttttttcggcctaagggggtcagcccaaattacccacggccttgccagccttgccactgtgatccgattggatccctaaatgaggtatgcgtcaaggatgagaagcacgctaggagaggcctggcgccaggttcttgccactgcaagacaggctttggtggggttagttgtgatcgctgtgctagaggttatactggctaccccgactgcaaggcgtgcaactgttctggtctgggtagtaagaatgaagacccatgcttcggtccttgcatctgtaaagaaaacgttgaggggggtgattgtagccggtgcaaaagtggcttcttcaatctgcaggaggataattggaaaggatgcgatgagtgcttttgctcaggagtgtcaaataggtgtcagtccagctactggacttacggaaaaatccaagacatgtctggatggtacctgaccgatctacctggtcgtataagagtggcacctcagcaggatgacctggattctccgcagcagatcagcatcagcaatgcggaagcaaggcaggcactgccgcattcttactactggagcgccccagcaccttacttggggaataagctcccagcagttggtgggcagcttactttcactattagttacgatctagaggaggaagaggaggataccgaacgagtgctgcagctgatgattatccttgagggaaatgatctgtccatctccacagcacaggatgaagtgtaccttcatccatctgaagagcacaccaacgtgctattgttgaaggaggagagtttcaccattcacgggacacattttccagtgcgcagaaaagagttcatgacagttctagcaaaccttaagagagtactgcttcagataacttattcattcgggatggatgctatctttaggcttagtagcgtcaacctggaatccgcggtcagttatccaacagatggatcaatcgccgcagcagtcgaagtatgtcagtgtccgcctggttatactgggtcctcctgcgaatcatgttggccacggcataggcgagtgaacggaactatctttggcggtatctgtgaaccctgtcagtgtttcggtcacgcagagtcttgtgatgatgtaaccggcgagtgcctgaattgtaaggatcatactggcggaccttattgtgataaatgtctcccaggtttctacggcgagccaaccaaaggtaccagcgaggattgccaaccctgtgcttgtcctctgaatatcccttctaataatttcagcccaacatgccacttagaccgaagcctgggcctaatttgcgacgggtgcccagtgggatataccggtcccagatgcgaacgttgcgctgaaggctattttggccagccctctgtgccaggagggtcatgccagccctgccagtgtaacgataacctagacttttccattccaggatcttgcgactcattgtcaggatcctgcctgatatgcaagccgggaaccacagggagatattgtgaactgtgcgctgacggatatttcggcgacgccgtagatgccaaaaattgtcagccatgtcgctgtaacgccggaggctccttcagcgaggtctgccactctcagaccgggcaatgtgagtgtagagccaatgtacagggtcaacgatgcgacaagtgcaaagcaggaacatttggactgcagtcagcccgaggctgcgtgccctgtaattgcaacagtttcgggagcaaatcctttgattgcgaggagagcgggcaatgttggtgccagcctggggttactgggaagaagtgcgatcgctgcgcacatggctacttcaatttccaagaaggaggatgtaccgcatgcgaatgttctcatctggggaataactgcgacccaaagacgggtcgctgcatctgccccccaaatacaattggtgagaagtgcagcaagtgcgcaccaaatacctgggggcattccataactacaggatgtaaggcttgcaattgctcgacggttgggagcctggatttccagtgtaacgtgaacactggccaatgtaactgtcaccctaagttttcgggagctaaatgcaccgaatgctccagaggccattggaactaccctagatgcaacctgtgcgattgtttcctcccaggcaccgacgccacaacatgcgacagcgaaacaaagaagtgtagctgtagtgaccagaccggccaatgtacttgcaaagtgaacgtggaggggattcattgtgaccgctgcagaccgggaaagtttggcctggatgccaaaaatcccctcggctgctcgagttgctattgcttcggtaccactacgcagtgtagcgaagccaagggattgataaggacttgggtgacccttaaggccgaacaaactatcttgcccctggtggacgaggccctccaacatacaaccactaaaggaatcgtcttccaacatcctgagatagtggctcacatggatttgatgagagaagatttacacttggagcctttttattggaaattgcccgaacaatttgagggaaagaagcttatggcctatgggggaaagttaaagtacgctatttactttgaggccagggaagaaacagggttctccacctataatcctcaagtgatcatcaggggaggcactcccactcacgctcgtattattgtcaggcatatggcggcacccctgatcggccagcttacccgtcatgagatcgagatgaccgaaaaggagtggaaatactatggagatgatccacgggttcatcgaaccgtgacccgcgaagactttctggatattctctatgacattcactacatcttgattaaggctacctacggaaacttcatgcgtcagtcccgcatttccgaaataagtatggaagtggctgagcagggtcgaggtactactatgactcctcctgcagatttgatcgaaaagtgcgattgtccgctgggatacagtggtctttcatgtgaagcttgtcttccgggattttaccgacttagaagtcagcccggaggacgcactccgggacccacactcgggacctgcgttccttgtcagtgtaatggtcacagttccctctgcgacccagagactagtatctgccagaattgccagcatcacactgcgggtgacttctgcgagcgctgtgctttgggctattacggaattgtgaaggggcttcccaatgattgtcagcagtgcgcatgccccctgatatcctcgtcaaacaatttttctccaagttgtgtcgccgaaggcctggatgactaccgttgtactgcttgccctaggggatacgagggtcagtactgcgagaggtgcgccccaggctataccggctctccgggtaaccccggaggatcatgccaggaatgcgagtgcgacccatacggtagcttacccgtgccctgcgaccctgtgactggattctgcacctgcagacccggagctaccggcaggaaatgtgacggctgtaagcattggcacgccagagagggatgggagtgtgttttctgcggtgacgaatgcactggcctgctacttggcgacctcgcgagactggaacagatggtgatgtctattaatttgacggggccactaccagccccatataaaatgctgtatggcctggagaacatgactcaggaactgaagcacctgttgtctccacagagggcgccagagcgcttaatccaacttgctgagggaaatcttaacacgctcgtcacagagatgaacgaactgctgactcgcgcaacaaaagttacggcggacggtgagcagacaggccaggacgccgaacgtaccaatacgagggccaagtccctcggagaattcataaaggagcttgccagagatgccgaggccgtcaacgagaaagctatcaaattgaacgaaacactcggaacccgtgacgaggcattcgagcgtaatttagagggtctccaaaaagagattgatcagatgataaaggaattgaggcggaagaatcttgaaacacagaaagagatagccgaggatgaattagtcgccgcagaggccttgctgaagaaggttaagaaattgtttggcgagtcacgaggggaaaatgaagagatggagaaggacctgagggagaaactcgccgattacaagaacaaggtggatgatgcctgggacctgctccgagaagctactgataaaattcgagaagcaaaccgcctctttgcggtcaatcagaagaacatgaccgccctagagaaaaagaaggaagccgtggagagtggcaaacggcaaattgaaaacacactgaaggaaggcaacgatattctggacgaagccaatcgcctcgccgatgaaatcaacagtatcattgattatgtggaggatatccaaacgaagctgccccctatgagtgaggagctcaatgataagattgatgacctctcgcaggagatcaaagatcggaagctcgctgaaaaggttagccaggccgagagccacgccgctcagctgaacgacagttccgctgtgctcgatggaatcctcgatgaagccaagaatatttctttcaatgcaaccgctgcgttcaaggcttattctaacatcaaagattatattgatgaggctgagaaagtcgcgaaagaggctaaagaccttgcccatgaggctacgaagctcgctacaggtcccaggggattgctgaaggaagacgccaaagggtgcctccagaaatccttccggattctgaacgaggccaagaagctcgccaacgatgtgaaggaaaacgaagatcatctgaacggactaaagacccggatcgagaatgctgacgcacggaatggagacttgctcagaaccttgaatgacaccctgggcaagctcagcgcgatccccaacgatacggcagccaagctgcaggcagtgaaggacaaagctcgacaggcaaatgacacagccaaggatgtactggcacaaataaccgagctgcaccagaatctagacggcttgaagaagaactacaacaagctagccgactctgttgccaagactaacgccgtggtcaaagatccctcaaagaacaaaatcgtggcagacgccgacgcaactgtgaaaaatctggaacaggaagcagacagacttatcgataaactcaagcctatcaaggagctagaggacaacttaaaaaaaaacatctccgaaattaaggaactgattaaccaggccagaaagcaggctaacagcattaaagtcagtgtaagctctggcggagattgtataagaacctataagcccgagatcaaaaaaggctcctataacaacattgtagttaacgtgaaaactgcagtggctgacaacctgctgttttacttaggcagtgctaaattcatcgatttcctcgcaatcgagatgaggaagggaaaggtcagtttcctctgggacgtggggtccggtgttggcagagtggagtatccagatttgacaatcgatgattcttattggtatcggattgtggcctccaggaccggccgaaacggcacaatcagtgtgcgtgctctcgatggacctaaggcaagtatcgtgccatctacacaccacagcacttccccacctggatataccatcttagacgtagatgccaatgccatgctcttcgtagggggattgacaggcaaattaaaaaaggcagacgcagtccgggtaataacatttaccggctgtatgggcgagacatatttcgacaataagcctattgggctgtggaattttcgtgagaaagagggcgactgtaaaggatgtacagtgtcgcctcaagtcgaagatagcgaggggactattcaatttgatggtgaggggtatgccctcgttagtcggccaatcaggtggtacccaaacatttctacagtgatgtttaagttcagaaccttcagctcgtccgcacttcttatgtaccttgcaacaagggatttgcgcgactttatgtccgtggagctgacggatggccacattaaggtatcctacgatcttggatccggcatggccagtgtggtgtctaaccagaatcacaatgacggcaaatggaagtcttttaccttatctcggatccagaaacaggctaatatctcgatcgtcgatatcgacacaaatcaggaagaaaacatcgccacctccagttccggaaataatttcggactggacctgaaggcagatgacaaaatctactttggagggctgcctaccttgcgaaatcttagattattcaacaggccagaggtgaatctgaagaagtatagcggctgcttaaaagacattgagatatcccggacaccctacaacatcctttcgtcccctgactatgtcggagttactaagggatgctctctcgagaacgtgtataccgtgagtttccccaaaccagggtttgtcgagttatccccggttccaatcgatgtgggcacagaaatcaacctgagcttttcaaccaagaacgagtctggcattatcttgctgggcagcggaggcaccccagccccacccagacggaagcggcgacagacaggtcaagcctattatgcaatactgctcaatcggggaaggctcgaggtgcacctgagtacgggcgctcgaaccatgcggaaaatcgtgattaggcccgaacccaatctgttccacgacggtcgcgaacattcagtacatgtcgagcggacacggggaattttcactgttcaggtggatgaaaacaggaggtatatgcaaaatttgacagtagagcagccaattgaggtaaaaaagctctttgtggggggagcaccaccagagttccagccgtccccacttcggaacattccaccctttgagggctgcatatggaatctagttatcaattctgtgccgatggattttgcacgcccagtgagcttcaaaaatgctgatatcgggcgatgcgctcaccagaaacttcgggaagacgaagacggcgcagcccctgccgagattgtgatccagcccgaacccgtgcctaccccagccttcccgactccaactccggttctgactcatgggccatgtgctgctgagagcgaacctgccctgcttattggcagtaagcagttcgggctgtctcggaactcccatattgctattgcctttgacgatactaaagttaagaaccggctcacgattgagcttgaggtccgcactgaggcagaaagcggcttactcttttatatggccaggatcaaccacgcagacttcgcgacagtccaactcaggaacggattgccatatttttcttatgatctgggatccggcgacacccacaccatgatacccactaagatcaatgacggccagtggcataaaatcaagattatgcggagcaagcaggaggggatcctgtatgtggacggggcttcgaatcgcaccatcagcccgaaaaaagctgacattctggacgtggtaggcatgctctatgtcggcggacttccaattaactatacaacacgtcgaatcggaccggtgacttactcgattgacggatgcgttcggaacctgcatatggcggaagctcccgcagaccttgaacaacccacttctagctttcacgtgggtacgtgcttcgcaaacgcccagcggggtacatacttcgatggtacagggttcgctaaggccgtggggggattcaaagtggggctcgatctgcttgtcgagttcgagtttcggaccacgactacaaccggagtgctgttaggcatcagcagccagaagatggacggaatggggattgaaatgatcgatgagaagcttatgttccatgtggataacggggctggcaggtttaccgctgtctacgacgccggagtgccagggcacctttgtgacgggcagtggcataaagtcacagctaacaagatcaaacatagaattgagctcacagtggacggaaatcaggtggaggcccagagtccaaatccggcatctacctccgcagacacgaacgaccctgtgttcgtggggggttttcctgatgatctaaagcaattcgggctgacaacaagcattcccttccgaggctgtattcggtccctgaagctgaccaagggcacggggaaaccattggaagtgaactttgctaaggccctggagctccgtggcgtccagccagtgtcctgtccggctaatta

SEQ ID NO: 228074 - DNA, 9368 bp, Artificial Sequence
  Description of Artificial Sequence: Synthetic coding sequence
atgcctggagccgctggcgtgctgttacttctgctcctttccggcggactcgggggtgtgcaagcccagcggcctcaacagcaaagacagagccaagcacatcagcaaagagggctgttccccgctgtgctcaacctggcttctaacgccctgatcacaacaaacgccacttgtggggaaaaagggccagaaatgtactgtaagttagtggagcacgttcccggacagccggtgaggaatccccaatgcaggatatgtaaccagaatagctccaatccgaatcagcggcatcccattacaaatgctatcgacggaaaaaatacatggtggcagtctccgtctatcaagaacggcatagagtaccactatgtcactattacgcttgatctacagcaggttttccaaatcgcttacgtgatagtgaaggctgccaactctccaagacccggaaattggattctggaacggtcactggacgacgtcgagtacaagccatggcagtatcatgctgtgacggacactgagtgcctgacactgtataatatatatcccaggaccgggcctccatcctatgcgaaagatgacgaagtcatatgcacatccttttatagtaaaatacacccactggaaaatggggaaatccacatctcactgatcaatggacgacccagcgccgacgatccatcccctgagctcctggagttcaccagtgcgcgatacataaggctgcgcttccagaggatccgcacattgaacgccgaccttatgatgtttgcacacaaagacccaagagaaatagatcctattgtaacccggcgttactattactcagtcaaggacataagcgttggaggtatgtgtatttgttacgggcacgcaagggcatgccccctggatcccgcaactaacaagtcccggtgtgaatgcgagcataacacctgtggggactcctgtgaccagtgctgccctggatttcatcagaaaccatggcgcgcaggcacatttctcactaagacggaatgtgaggcctgtaattgccatggtaaagcggaggaatgctattatgatgagaacgtggcccgaagaaatctatccctgaatatcagaggaaagtacataggaggtggcgtgtgtattaactgcactcaaaacactgcgggtatcaactgcgagacctgtactgacggattctttagacctaaaggagtgtcccccaactacccaaggccgtgtcagccatgccactgtgatccgatcggtagtctcaacgaagtgtgtgtgaaagacgaaaaacatgctcgtagaggtcttgccccagggtcctgtcactgcaagaccggatttggaggcgtgtcctgcgatcggtgcgcgcgtggatacacgggctatcctgattgcaaggcttgcaactgttcagggcttgggtctaaaaatgaggacccatgttttggtccttgcatttgcaaggagaacgttgagggcggagactgctcacggtgtaagagcgggtttttcaatctccaggaggacaactggaaaggctgtgatgagtgtttttgtagcggtgtatctaaccgatgccagagctcttactggacttatggaaagattcaagacatgtccggatggtatttgacagatctgcctggtcgaatacgggtggctccccagcaagacgacttggatagtccacagcagatctcaattagcaacgcagaggccaggcaggctctgccccactcatattactggtccgcccctgccccatatctcggcaataagcttccagctgttggaggccaacttacgtttactatctcctacgacctggaagaagaagaggaggacacagaaagggtgctacagctgatgattatactcgagggaaacgatctgtccatttctactgcgcaggatgaggtctatctgcacccctctgaggaacacacgaatgtgctcctcctgaaagaggagtcattcacaattcatgggacacacttccccgtaaggcggaaggagttcatgaccgtgttggcaaacctaaagcgggttctcctgcagattacgtacagctttggaatggacgcaatcttccgcctaagcagcgttaatttagagtcagcagtatcctatccaactgacggttctattgcggctgctgtggaggtctgccagtgccctcccggatatactggctcttcttgcgaatcttgttggcctcggcacagacgcgtgaatggtacaatattcggtgggatttgcgagccctgtcagtgctttggccatgccgagagctgcgacgatgtgaccggggagtgtctgaactgtaaggaccacaccgggggaccgtattgtgacaagtgccttcctggattttatggtgagcctactaaaggcacatcagaggactgtcagccctgcgcgtgtcccctgaacattcctagtaacaactttagcccaacatgccatctcgatcggtcattaggactgatttgtgacggctgccctgtgggatatacggggccacggtgcgagcggtgcgctgaaggttacttcggccagccttctgtaccgggagggagttgccagccatgtcagtgcaacgataacttagacttctctatcccaggctcttgtgactccttatccggcagctgcttgatctgtaagcccggaacaaccggaaggtactgtgagctatgcgcagatggttacttcggcgatgccgtggatgcgaagaattgccagccttgtcggtgcaatgcaggcggttcgttcagcgaggtgtgccacagccagacgggtcaatgtgagtgccgagcaaatgtgcagggccagcggtgtgataaatgcaaagcaggcacatttgggctgcagagtgcgaggggctgcgttccttgtaactgtaattcctttggatcaaagagcttcgactgtgaagagagcggccagtgctggtgtcagcccggtgtgaccgggaagaaatgcgatagatgcgctcacgggtactttaactttcaagaagggggttgcacagcttgcgagtgcagtcacctgggaaacaactgtgatcctaagaccggaagatgcatttgccccccaaatacaatcggcgagaaatgtagcaaatgtgcgcctaatacctgggggcacagcatcacaactggttgtaaagcctgcaactgttccacagtgggatctcttgattttcagtgcaacgtgaatactggtcagtgtaactgtcacccaaaatttagcggggcaaaatgcaccgaatgtagccgcggacactggaactaccccaggtgtaacctgtgtgattgctttcttcctggaacggacgccacaacatgtgattctgaaacgaagaaatgctcttgcagcgaccagaccgggcagtgtacctgcaaggtcaacgtcgaggggatacactgcgacaggtgcaggccaggtaaattcgggctggacgccaagaaccctctgggctgttcatcctgctactgcttcggcacgactacgcagtgtagtgaagcgaaaggcctcattcggacatgggtgaccctgaaggccgaacagactatcctcccgctggttgacgaggcattacagcacacaacgacgaaggggatcgtgttccagcaccctgagattgttgctcacatggacctcatgcgcgaggacctccacctagaaccattttactggaagctgcctgaacaatttgaggggaagaaacttatggcctatggaggcaaacttaaatacgcaatttattttgaggcgagagaggagacaggcttttctacttacaaccctcaagtgatcatcagaggcggtacacccacccacgcccgaataattgtgcgtcacatggcagcacctttgataggacagcttactaggcacgaaattgaaatgacggaaaaagaatggaagtactacggggatgatccgagagtgcacagaactgtcacaagggaggattttcttgacatcttatacgatattcattatatcttgatcaaggcaacctacggaaattttatgcggcagtcgcgcatttcagaaataagtatggaggtggctgaacaggggcgaggaaccactatgacaccgccagcagatttgattgagaagtgtgactgccccctcggctacagcgggctgtcttgtgaggcctgcctgccgggtttctaccgactgcgaagccagccaggcggacggactcccggtcctacattggggacctgtgtcccctgccagtgcaatggccattcctctctttgcgacccagagacaagcatttgtcagaactgccaacatcatacagccggtgatttctgtgaacgatgcgccctaggctactatgggatcgttaaaggcctgcctaatgattgccagcagtgtgcatgtccccttatctcaagcagtaataacttcagcccgagctgtgttgccgagggactggatgactatcgctgtaccgcttgccctcgtgggtatgaaggacagtactgtgagcgctgcgcacctggctacactggctcccccggaaatcccggtggatcatgccaagagtgtgaatgcgatccctatggctccctaccagtaccctgcgatccggtgacaggattttgcacctgtcggcctggcgctaccgggcgaaagtgtgacgggtgcaaacattggcacgctagagaaggctgggagtgcgtcttctgcggggatgagtgcacagggctcttgcttggcgacttggctcggctcgagcagatggtgatgagcatcaatctgacaggtcccttgccagctccctataagatgctttacggcttggaaaatatgactcaggagttaaaacacctgctctccccgcagagagcccctgaaaggctgatccagctagcggagggcaatctgaatacgcttgttaccgagatgaatgagttgctgacacgggcaacaaaggtcacggccgacggagagcagaccggccaggatgccgagcgaaccaacacacgggctaaatcattgggggagtttataaaggaactagcaagagatgccgaagctgttaacgagaaagctatcaagctgaacgaaactcttgggactagggacgaggcttttgaaaggaacctggaaggactgcagaaagaaatagatcagatgatcaaagaactgagacgaaaaaatttggaaacccaaaaggagattgcagaggacgagcttgtcgccgcagaggcccttctgaaaaaagtgaagaaactatttggggagtcccggggtgaaaacgaggagatggagaaagatcttcgggagaagttggcagattacaagaacaaagtcgatgacgcttgggacctgcttcgtgaggctacagataagatcagagaggccaatcggctttttgcggttaatcagaagaacatgaccgcacttgaaaagaagaaagaggcggtggagagcggcaagcgccagattgaaaataccctgaaggaaggtaatgacattctcgacgaagcgaacagattggcagacgaaatcaattcaataatcgattacgttgaagatattcagacaaaactgcctccgatgtcggaagaattgaacgataaaatcgacgacctgtctcaagagatcaaggataggaagctggctgaaaaggtgtctcaggccgagagccatgcggctcagcttaacgatagctctgctgttttggacggcattttagacgaagctaagaatatctcctttaacgctacagcagctttcaaggcctactcaaacatcaaagactatatcgacgaagccgaaaaagtggcaaaagaggcaaaagatttagcccacgaagcaactaagcttgctaccggcccacggggacttctgaaggaggatgccaaagggtgcctccagaaatcgttccgaatcctgaatgaagccaaaaaactggctaatgacgtcaaggagaatgaggatcacctgaacggtctgaaaaccagaatcgagaatgctgacgcaagaaacggtgatcttctgaggaccctcaacgacactttgggaaagctttcggctatcccgaacgacactgcagctaagctccaggcagtcaaggacaaagcccgtcaagccaacgatacagctaaagacgtgttagcccagatcactgagctgcatcagaacctggacggactcaaaaagaattataataagctggcagattcagtcgccaagacaaacgcagtggtgaaagatcctagtaaaaataaaattatcgctgacgctgacgcgactgttaagaatctcgaacaagaggctgatcgcttgatcgacaagctaaagccaattaaggaactcgaggataacctcaagaaaaacatcagtgaaattaaagagttaattaaccaggctcggaagcaggccaacagtatcaaggtctccgtctctagtggcggtgactgcattagaacatataagcctgagatcaaaaaaggctcatataacaatatcgttgtgaatgtgaaaacggctgttgctgacaatctgcttttctatctgggatccgctaaattcatcgatttccttgccattgaaatgcggaaagggaaagtttcgttcctgtgggacgtaggttctggggtgggacgggttgagtatcccgatttgactattgacgacagctattggtatagaattgtggccagcaggactggccgaaatgggactatttcagtgcgcgctctggacgggcctaaagcctccatcgtgccttctactcaccactccacgtcgcctccaggctacaccatcctggacgttgatgccaacgccatgttatttgtgggcggactgacaggcaaactgaaaaaggctgacgccgtgagagtgattacatttacaggctgtatgggggaaacctacttcgacaataaaccaatcgggctgtggaacttccgagaaaaagagggcgactgcaaggggtgtacagtgagcccccaggtggaggattctgaaggaaccatccagttcgatggggagggatatgctctggtcagtcggcctatcagatggtacccaaacattagcacagtgatgttcaagttccggactttttcttcttcagcattgctcatgtatctggcgaccagagatttaagagattttatgtctgtcgagctgacggacggacatatcaaagtgtcctacgatctggggtcgggaatggcatcagtcgtatcaaaccaaaaccacaatgatgggaaatggaaaagcttcaccctttccagaatccagaagcaagctaacattagcatagtggatatcgatacaaatcaggaggaaaacatcgcaacatcctctagtggcaacaatttcggcctggatctcaaagccgatgataaaatatacttcggtggactccccacgctccgaaatttgtcaatgaaagccaggcctgaagtgaacctcaagaaatatagtggatgtttgaaggacattgaaatctctcgtacaccgtataacattctatcatcacccgattacgtgggtgtaaccaagggctgctctttggaaaatgtatacactgtctctttcccaaaacctggtttcgtggaactctccccagtccccatagatgtgggcacggagatcaacctaagcttttccacaaaaaacgagtccggtatcatcctgttggggtctggagggactccagcacctcctcgaaggaaaaggcggcagaccgggcaggcgtattacgctattcttctgaatcgcggacgcctcgaagtacacctgagtacaggcgcacggacaatgcgcaaaattgtgatccgtcccgaacccaatctgtttcacgatggaagagagcactcagtccacgtcgaaagaacgcgagggatcttcaccgtgcaggttgacgagaaccggaggtacatgcaaaatctcactgtcgagcagcccatagaggtaaaaaagctatttgtgggcggtgcaccccctgagttccagcctagtccattgcgcaacatacccccattcgaaggatgtatctggaatctggtgataaattctgttccaatggattttgcacggccagtgtctttcaaaaacgcagacataggcaggtgcgctcaccagaagctgcgtgaagacgaagatggcgcagcccctgctgagattgtcatacaaccagagccagtgccaacaccagccttccccacccccacgccggttctgacccatgggccatgtgctgcggagagcgaacccgcactgttgatcgggtctaaacagtttggtttgagcagaaatagtcatatcgctattgcattcgatgacacaaaagtcaagaatcgcctgactattgagttggaggtgcgcaccgaggcagaaagcggtctgcttttttatatggcacggatcaatcatgccgacttcgctaccgtgcagctccggaatggtctgccttatttcagctatgacctgggatcaggtgatacacacaccatgattcctacaaagattaacgacggacagtggcataaaataaagatcatgagaagcaaacaggagggtatattgtatgtggatggggcaagtaatagaaccattagtccaaaaaaggcggatattctggacgtggtgggcatgctatatgtggggggactccctatcaattacacaactagacggattggaccagttacctatagtatagatgggtgcgtaaggaacctacatatggctgaagcccctgccgacctggagcagccaacatcttccttccacgtaggcacatgttttgctaatgctcaacgcggaacctatttcgacggtactggctttgcaaaagcagttggcggattcaaagtgggtctcgatctattagtggaatttgagtttagaaccacaaccaccaccggagttctcttgggcatctcttctcagaagatggatggcatgggaatcgagatgattgacgagaaactgatgttccatgttgacaacggggctggccgttttacagcagtgtacgatgcaggcgtgcccggacatttgtgtgacggacagtggcataaggtcactgctaataagataaaacacaggatcgaattaacagtggatggaaatcaggttgaagcacagtccccaaatcctgccagtaccagcgcagacactaatgatcccgtatttgtcgggggtttcccagacgatctgaagcaatttgggcttaccacctctatcccatttcgcggatgtattcggagcctgaaattgacaaagggtacaggcaagcccctggaggtgaatttcgctaaagcgctggaactgcgcggtgtgcagccggtgagctgccccgctaacta

SEQ ID NO: 228075 - DNA, 3387 bp, Artificial Sequence
  Description of Artificial Sequence: Synthetic coding sequence
aaaaaactggctaatgacgtaaaagaaaacgaagaccacctgaacgggttaaaaacgcgcattgagaacgccgatgctcgcaatggtgaccttcttcgtaccctgaacgacacattgggcaagttatctgcaattcctaacgacaccgcggctaagctgcaagccgtgaaggacaaagcacggcaagccaacgatacagcaaaggatgttctagcacagatcaccgaactccaccagaacctggatggcttgaaaaaaaattacaataagctggcggacagcgtggcaaaaaccaacgctgtggtcaaggacccatccaaaaataccgttgctgacgctgacgctaccgtcaaaaatctggaacaggaagcagacagactcattgacaaacttaagcccatcaaggagttagaggataatctgaaaaaaaatatttctgagatcaaagagctaattaatcaggcacgcaaacaggcaaacagtatcaaagtgtctgttagttctgggggtgactgcatcaggacgtacaagccagagataaagaagggatcatataataatattgtcgtaaatgttaagacagccgtcgctgacaatttgctgttctacctgggttccgccaagtttattgatttcctggccatcgagatgagaaaagggaaggtgagttttctgtgggatgtggggagcggtgttgggagagtggaatatccagacctgacgatagacgactcctactggtaccgtattgttgcatccagaactggacgtaatgggacaatttccgtacgggctttggacggtcccaaggcgagcattgtccccagcacccatcatagcacctcacccccagggtatacgattctggacgttgatgctaacgcaatgttatttgtgggcggtctgaccggtaagctcaaaaaagcagacgccgttagggtgatcacttttacagggtgcatgggcgagacctatttcgacaacaaaccaatcggcctttggaactttcgagagaaagagggcgattgcaaggggtgtacagtgagccctcaagtggaggacagcgagggaaccatacagttcgacggtgaagggtatgcacttgtgagccgtcctatcagatggtatcccaatattagcactgtgatgtttaagttccgaaccttcagttccagtgctttgctgatgtacctggcaaccagggacctccgggacttcatgtctgtagagctgacggatgggcacataaaggtttcatacgatctgggaagcgggatggcgtctgtcgtgtctaaccaaaatcacaacgatggtaagtggaagtcatttacccttagcagaatacagaagcaggccaatatttccatcgtagacattgacacgaatcaagaagagaacattgccacctccagctcgggcaataactttggcttggatctcaaggcagatgataagatttactttgggggtctgcctacccttaggaatctcagcatgaaggccaggcccgaagtgaatcttaagaagtattctggttgtctgaaggatatcgaaatctccagaactccctataatatcctctccagccccgactatgtaggtgtgaccaaagggtgttcccttgagaatgtctacactgtgagcttccccaagcccggttttgtagagctgtccccggtcccaatagatgttgggacagagatcaacctgtccttcagcaccaagaacgagtccggaattatcctcctgggctccggcggaacacccgctccacctagacggaaacgacggcagaccggacaggcatactacgccattctacttaatcggggacgcctggaagtccacctgtcaaccggcgctcggacgatgagaaagattgtgattcggcctgaacctaacttattccatgatggaagagagcatagtgtccatgtcgagcggactcgaggaatctttacagtccaggttgatgagaatcggagatatatgcaaaatttaaccgtcgagcaacccatcgaagtgaagaagctattcgttggtggcgcacccccagagttccaacccagtccactgcggaacatacccccattcgaaggatgcatctggaacctggtcatcaacagtgtgcccatggactttgctcgcccagtatcttttaaaaacgcagacatcggacggtgtgcccaccagaagctgagggaagacgaggatggcgctgctcccgctgagatagtgatccaacctgagccagtgccaacccctgccttcccaacgcccactcctgtgttgacccacggcccttgcgcagccgagagtgagcccgcactcttaattggttccaagcagtttgggctgtcgcgcaattctcacattgccatagctttcgacgacacaaaagtaaagaacagattgaccatcgagcttgaagttcgcactgaagctgagtccggcctgctattctacatggcccgtattaaccacgccgacttcgcaacggtacagttgcgaaacgggttgccttactttagctatgatttgggtagcggagacactcatacaatgataccaaccaaaattaacgatggtcaatggcataaaatcaaaataatgcgctctaagcaggagggaatattgtacgttgatggagcgagcaataggaccatttcacccaagaaagctgatattcttgatgtagtcggaatgttgtatgtcggcggactgcccatcaactacacaacccggagaatagggccagtcacgtactccattgacggatgcgtgcgtaatttacatatggccgaagcgcctgccgatctggaacagcctacaagtagctttcatgtgggcacctgcttcgccaatgcacagcggggaacgtatttcgatggtacaggtttcgctaaggccgttggaggattcaaggttggactggatttactggttgagttcgagttcaggaccactactactaccggagtgcttctggggatctctagccagaagatggatggtatgggcattgagatgatagatgagaaactgatgtttcacgtggataacggcgctgggaggtttacagcagtgtacgatgccggagttccaggccacttatgcgacggtcagtggcacaaagtgactgccaataagatcaaacatcgtatcgaactgactgtggatggaaatcaggttgaggctcaaagccccaaccccgcttcgactagtgccgacacaaatgatccagtttttgtgggcggtttccccgacgaccttaagcagtttggcttgacaacatctatcccatttcggggttgtatacgttcgctgaaactcactaaaggcacagcctcacattggcgactgattctgcctcgtccctggaactag

SEQ ID NO: 228076 - DNA, 5174 bp, Artificial Sequence
  Description of Artificial Sequence: Synthetic coding sequence
atgccccctgcagtcaggaggtctgcatgttctatgggatggctttggatcttcggcgcagcgttagggcagtgtctcggctacagctcacagcagcagagggtaccttttctgcaacctcccggacagtctcaactgcaggccagctatgtggaattccggcctagccaggggtgtagtcctggttactacagggatcataaaggcttatatactggacggtgcgttccctgtaactgcaatggccactcgaatcagtgtcaggacggttcgggcatctgcgtcaattgtcaacacaacacagcaggggaacattgtgagcgatgccaggagggatattatggcaacgcagtgcacggcagttgccgtgcgtgcccgtgcccacacacgaactcgttcgccaccggctgcgtcgtgaacggtggagacgtgcggtgttcttgcaaagcagggtatacaggtactcagtgtgaacgctgcgcccctggatactttggtaatccgcagaaattcggcggttcatgccagccttgctcctgtaattcaaatggccagctcgggtcttgccacccactaacgggcgattgtattaaccaggaaccgaaggactcatcacccgctgaggaatgcgacgactgcgactcttgcgtgatgacacttttgaatgacttggcaaccatgggtgagcagttgcggcttgttaagagtcagctgcagggcctgagcgccagcgctggactgctggagcagatgaggcacatggagactcaggcaaaagacctgcgcaatcagttgcttaactataggtctgccatttcaaatcacggatcaaagatagagggcttagagcgcgaactgaccgacctgaaccaggagtttgagacccttcaggagaaagcccaggtaaacagtcgcaaggcgcagaccctcaataacaacgtgaacagggccacgcaatctgcaaaagaattagacgttaagatcaaaaacgttattcggaacgtgcacattctgcttaagcaaataagcggcaccgatggggaggggaataatgtgcccagcggagatttctccagggagtgggcagaagcccaaagaatgatgagggaattaaggaaccgcaacttcggcaagcatcttcgggaagccgaggctgataagcgcgagagccagctcctccttaatagaatcaggacctggcagaagacacatcagggagagaataacggactggccaactcaattcgggattccctaaatgagtatgaggcgaaattgtcagacctacgagctcgcctccaagaggctgctgctcaggccaagcaggccaatggactcaatcaggagaatgagcgagccctgggggcaatccagcgtcaggttaaggaaattaacagtctgcagagtgatttcactaaatacctgactacagccgatagtagtctgctgcagacgaatatagccctgcagcttatggagaagagtcaaaaggagtacgaaaaactagctgcaagtttgaacgaggctcgtcaggagttgtcggataaagtccgcgaacttagccgcagtgcaggaaaaaccagtctggtggaggaagcagagaaacacgctagaagtttgcaggagctggcgaaacagctggaggaaattaaacggaacgcctccggcgacgaattggtgcgatgtgcagttgacgcagcaacagcctacgaaaacatcctgaacgcaataaaagctgcggaagatgcagcaaatcgagcagcctcagcatccgaaagcgcactgcaaactgtcattaaagaagacctgcctaggaaagctaagacactgtcaagcaacagcgataagttgctgaatgaagcaaaaatgacgcagaagaaattgaaacaagaggtttctccagccctcaataacctgcaacagacgctgaatatagttaccgtgcagaaggaggtcatcgataccaatctgacaacccttagggatggactacatggcattcaaaggggcgatattgatgcaatgatctcttctgctaaaagcatggtgcgcaaagccaatgacattaccgacgaagtcctggatgggcttaatccgatccagactgacgtcgaaagaatcaaggatacctatggacgaacccagaacgaggactttaagaaggcgttgacagatgcggataactctgtgaacaaattaactaacaaactgcctgatctttggcgaaagatcgagagcattaaccaacagctgctgcctttgggtaacatttccgataacatggaccgcatccgggagcttattcaacaggccagagacgcagccagtaaggtggctgtgcctatgcggttcaacggcaagtccggagtcgaagttcgactccccaacgacctggaagacttgaaaggctatacttccctgtccctgttccttcagcgccctaactccagagagaatggagggacagaaaatatgttcgtgatgtacctggggaacaaagacgcatcacgcgactacattggaatggccgtggtggacgggcagctgacatgcgtttacaacctgggagatcgcgaggcagagcttcaagtggaccagatccttactaagtctgaaactaaagaggccgtcatggacagagtgaagttccagagaatctaccagtttgcaaggctcaactacactaaaggtgccacctcaagtaagccagagacgcctggggtttacgacatggatgggcgaaactccaacacgctgttgaaccttgacccagagaacgtggttttctacgtggggggttatcccccagactttaaactaccttcgaggctctcttttcccccatacaagggctgtatcgagcttgacgacttgaacgaaaatgtgctctccctttataatttcaagaaaacatttaatcttaacaccacagaggtggaaccgtgcaggcggcgtaaagaggagagtgataagaattacttcgaggggacaggttacgctagagtgccaacacagccgcacgcgccaattccaaccttcggccaaacgattcaaactactgtcgataggggcctgctattctttgctgagaacggagacagattcatcagcctgaatatagaggatggcaagcttatggtgcgctataagttgaacagtgagctacccaaggagcgcggagtaggggatgctataaataatggacgagaccacagcatccagattaagatcggaaagctgcagaagaggatgtggataaatgttgatgtgcagaatacgatcattgacggggaggtgttcgattttagcacttattaccttgggggtatccctattgctattagggagcgttttaacatttctactcccgcatttcgcggttgcatgaaaaaccttaaaaagacatcaggtgtggtgcgactcaatgataccgtgggtgttacaaagaagtgcagcgaagactggaaattagtgaggtccgctagcttttcacgtggtggtcagctctcctttactgacttgggactcccaccaaccgaccaccttcaggcctctttcggattccagacattccaaccaagcggaatactcctcgatcaccagacatggacacgcaatctgcaggtgacccttgaggacggatacatcgagttaagtacaagcgactccggctcaccgatctttaagtcgccacagacgtatatggacggactgctccattacgtgtctgtaattagtgacaatagtggattacgattgctgatcgatgaccagctccttcgtaattctaagcgacttaagcatatttcatcctcccgccagtccctcagactggggggatctaacttcgagggatgcatttctaatgttttcgtccagagactctccttgtccccagaagttctggatctgacttccaacagcttaaagcgggacgtctctctggggggatgtagcctcaataaacccccatttctgatgttgctgaagggatccacccggtttaataagactaagacctttagaattaaccagctgctccaggatacgccagtcgccagtccacggagcgttaaggtctggcaagacgcctgctcaccgctcccgaagacacaggcgaaccatggagccctgcagtttggggatatcccaactagtcatctgttatttaagctcccacaagagttgcttaagcctagatctcagtttgccgttgatatgcagactacctccagccgaggactggtgtttcacactgggaccaagaattctttcatggcactgtatctctctaagggcaggcttgtgttcgcactcgggactgacggcaagaagttgcgcatcaaatccaaggagaagtgtaacgatggcaagtggcacactgtggtctttggccacgacggagaaaagggaagactggtggtggatggtcttagggctcgggaaggcagcttgccaggtaactcaactatctcaatccgagccccagtttacttgggcagcccaccgtctggtaaacccaagagcctccctacaaacagtttcgtcgggtgcctgaaaaacttccagctcgactcaaaacctctctatactccctcttctagctttggcgtgagctcgtgcctggggggacctctcgagaagggaatctattttagtgaggaggggggacatgtggtgttagcgcattccgtgctgctgggcccagagttcaaactagtttttagcatacgaccgaggagcctgaccggcattctaatccacatagggagtcagcccggaaaacatctgtgcgtgtatttagaagctggcaaggtgacggcatctatggattctggcgcaggtggaacatctactagcgtgacaccaaaacagagcttgtgcgacggccagtggcattccgttgcagtcactatcaaacagcacatcttacaccttgagctggatacggactcctcctacactgccggacaaatccctttccctcctgcctctactcaagaacctctccatcttggcggagcaccagccaacctcacgactctgcgcatacccgtgtggaagagtttctttggatgcctgaggaatatccatgtgaatcatatccccgtccctgtgacagaagccctggaggtccagggccctgtcagcctcaacggttgtcctgatcaata

SEQ ID NO: 228077 - DNA, 10001 bp, Artificial Sequence
  Description of Artificial Sequence: Synthetic coding sequence
atggccgctgccgcaaggcccaggggtagagcactgggaccagtcctaccacctacacctttgctactgctggtgctgagggtactccccgcatgcggtgcaacggccagggatcctggagctgccgctggtctgagcctccaccccacctatttcaatttggccgaggctgcacggatttgggctaccgctacctgcggcgaaagggggcctggcgagggcaggccccagccggaactgtactgtaaattggtgggaggccctaccgcccctgggtccgggcatactattcaggggcagttctgcgactactgcaattccgaagacccgcgtaaagcccatcctgtgaccaatgcaattgatggctccgagcggtggtggcagagcccacccctcagctccggcacacaatataaccgggtcaacctcactctggacttgggacaactgttccacgtggcatatatcttaatcaagttcgccaactcacctcggccagacttatgggtactcgaaagatccgtggacttcgggagcacatactccccgtggcagtacttcgcccattcaaaagtagattgtcttaaagagtttgggcgagaggccaatatggctgtgacacgcgacgacgatgtgctctgcgttactgagtatagcaggatcgtccccctggaaaatggcgaggtggtggtcagcctgataaacggaagaccaggagcaaagaactttacattctctcataccttacgcgagtttaccaaggcaactaatatccgactgcggttcctccggactaatactcttctcggacatctgatcagcaaagcacaacgggacccaaccgtgacccgacggtactactattctatcaaagatatttctatcggcggtcaatgcgtctgtaacggacatgccgaagtgtgcaatataaacaaccccgagaagttgtttcgttgcgagtgtcagcaccacacctgcggcgaaacatgcgacagatgctgtaccggttacaaccagcggagatggcggccagcagcttgggaacagagccatgagtgcgaagcctgtaattgtcatggccacgcctccaactgctactacgatcccgacgttgaacgacagcaggccagtctgaatactcagggtatttatgcaggaggaggagtgtgcatcaactgccaacacaacaccgccggtgtcaactgcgagcagtgtgccaagggctattatcgcccttacggagtgccagtggatgctcccgatggatgtataccatgttcttgtgaccctgagcacgccgacggctgcgagcagggcagtggacgctgccattgcaagccgaacttccacggtgacaattgcgagaagtgcgctattgggtattacaattttcctttctgcctgcgaatcccaatcttccctgttagcacaccttcaagcgaagacccagtggcaggggatataaaagggtgtgattgcaacctcgagggagtgttgcccgagatctgcgatgcccacggacggtgtctgtgtcgcccaggtgtcgagggtccgagatgtgatacctgccgctctggcttctactcctttcctatttgtcaggcgtgctggtgttccgccctcggcagttatcagatgccctgctcttcggtgactggccaatgtgaatgccgaccaggcgtgactgggcagagatgcgatcggtgtctgagcggagcctacgatttcccccactgtcagggctccagcagtgcatgtgaccctgccggtaccataaactctaacctgggctattgtcagtgcaaactccacgtcgaagggcctacttgtagcagatgtaagctgctttattggaacttagacaaggagaatccctccgggtgtagtgagtgtaagtgtcacaaagctgggactgtctccggcacaggcgagtgtcggcagggcgatggcgactgccattgtaagagccacgtgggcggtgactcttgtgacacttgcgaggacgggtactttgcattggaaaaatctaactacttcggatgccagggctgtcaatgcgacatcggaggcgctctctcatccatgtgttcgggaccctcaggcgtgtgtcagtgccgggaacatgttgtaggtaaggtgtgtcagaggcccgagaacaattactacttccccgacctacatcatatgaagtatgaaatcgaggatggcagcacgccaaacggcagagatctgcggtttggattcgacccactggcctttcctgagttttcttggagaggatacgctcagatgacatccgtgcagaacgacgtaaggatcaccctcaacgtcggaaaatcctctggatctctctttcgcgtcatcctacgctatgtgaacccgggaactgaggcagtgtctggacatatcaccatctacccaagctggggtgcagcccagtcaaaagagattatttttctgccctccaaagaaccagcatttgtaacagtacccggaaacggattcgcggaccctttctctatcacccccggaatctgggtcgcttgtattaaagctgaaggtgtgctgctggactatctcgtcctgttgcctcgagattactatgaggcctctgtcctgcagttgccagttaccgaaccttgcgcctacgccggtccccctcaggagaattgccttctgtaccagcatttacctgtgacaaggttcccatgtaccctggcttgcgaagccaggcactttcttctggatggagagcccaggcccgtggcagtccgacagcctaccccagctcacccagtgatggtggatctcagcggaagggaggtagaacttcacctccggcttcggattccacaggtgggccactacgtcgtggtcgttgaatatagcactgaggccgctcagctcttcgtagtggacgtcaatgtgaagtccagcggaagcgtgttggccggtcaggtaaatatctattcttgtaactactccgtgctttgtcgttcagctgtaattgatcatatgagccgcatagcaatgtatgagttactcgccgacgccgacatacagctgaaaggtcacatggctcgctttcttcttcaccaagtgtgtattatcccgattgaagaattttctgccgaatacgtcaggcctcaggtgcactgcatagcatcttacggacgcttcgttaaccaatctgccacatgtgtcagcctggcccatgaaaccccgccaacagccttgattctggacgtactcagcggacggccatttccacacctgccacagcagtccagccctagcgttgatgtcttaccgggtgttactctgaaagccccacagaatcaggtgacgctgagaggccgagtgcctcacctgggcagatatgtgtttgtgatccacttttatcaggccgctcacccgacatttcctgcccaggtcagcgtggatggcggatggccacgggcagggagctttcatgccagtttttgtccccatgtgttgggctgtcgggaccaggtgatcgccgagggacaaattgaattcgacatttccgagcccgaagtggcagccactgtgaaagtccccgaaggtaagtcactcgtccttgtcagggtgctggttgtgcccgctgagaactacgactatcagattctgcacaagaagtccatggacaaaagcctggagtttatcaccaattgcggaaagaattccttttatctggatccgcagaccgccagtaggttctgcaagaactccgcacgcagtctggttgctttctaccacaagggggctctgccctgtgagtgtcatccaactggagcaactgggccacattgttcaccggagggaggacagtgtccctgccagcctaatgtcatcggtcgccagtgcacaagatgcgcaacaggccattacggctttcctagatgtaaaccttgcagctgcggcagacgactgtgtgaggagatgaccgggcagtgcagatgtccccctcgtaccgtgcggcctcagtgcgaggtgtgcgaaacacattctttttctttccatcctatggcaggctgcgaagggtgcaattgttctcggagggggacaatcgaagccgcaatgcccgaatgcgacagggacagtggacagtgtcgttgcaagcccagaatcacaggcaggcagtgtgataggtgcgcctccggcttttaccggttccccgagtgcgtcccttgcaactgtaacagagacggtaccgaaccgggagtttgtgacccgggtaccggcgcttgtctgtgcaaagaaaatgtggaaggcaccgagtgcaacgtgtgccgggagggcagtttccaccttgaccccgcaaacctgaagggctgcacttcttgcttctgcttcggtgtgaacaatcagtgccatagtagtcacaagcggagaaccaaattcgtggacatgctgggatggcacttggagacagcagatagagttgatatccccgtgagttttaaccccggatccaattctatggttgctgatcttcaggagctccccgctaccattcattccgcgagctgggttgctccgacatcctatctcggtgataaggtgtcttcctacggcggatatctgacataccaggctaaatccttcgggctgccaggagacatggtgctcctcgagaaaaagcccgacgtacagctgaccgggcagcacatgtcaatcatttacgaggagaccaatacccctagacctgatcgcctccatcacgggcgtgtccacgtcgtggaaggcaacttccggcacgcttcttcccgggctcccgtctcacgggaggaactcatgacagttttgagcaggctggcggacgttcgtatccaggggctgtacttcaccgagacacagagactgactctttcagaagtgggtctcgaagaagcctcagacacaggcagtggccgaatcgcactggctgtcgagatttgcgcctgccctcctgcttacgccggtgacagctgtcagggatgcagccctggttactacagggaccacaagggcctttataccggaagatgtgtcccttgcaactgtaacggccacagtaatcagtgtcaggacgggtcaggcatctgtgtaaattgtcagcacaataccgcaggagagcattgtgagagatgccaggaaggctactacggaaacgccgtacatggtagctgtcgggcatgcccttgtcctcacaccaactcattcgccaccggatgtgtggtgaacggaggagatgtgcgctgtagttgcaaagcaggatacaccggtacacagtgtgagaggtgtgctccaggttactttggaaacccacaaaagttcggcggatcatgtcagccttgctcatgtaacagtaatggccagctgggcagctgccatccacttactggggattgtattaaccaagaaccaaaagattctagccctgcggaggagtgcgatgattgcgattcttgcgttatgacactgcttaacgacctcgctacaatgggagagcagctcaggttggtgaaaagtcagctccaggggctatctgcctcagcgggtctgctggagcaaatgaggcatatggaaacacaggctaaggatctgcgcaatcagctcctcaactacagaagcgcaatatcgaaccatggctctaaaatagaaggtcttgaacgggaactaaccgacctaaatcaggagtttgaaaccctccaggaaaaggctcaagtgaattctcgcaaggcccagacgcttaacaataacgtcaatcgcgctactcaatctgcaaaggagctggacgtgaaaatcaaaaacgtgattagaaacgtccacattttgctgaagcagatttctggcaccgatggcgaaggaaataatgtgcctagcggagacttttcccgcgagtgggcagaagctcagaggatgatgagagaattgaggaacaggaatttcggaaagcacctgcgtgaggccgaagccgataagcgagagtctcagcttctcctgaacaggatacggacgtggcagaagactcaccagggcgagaacaatggcctggccaactcaatccgcgacagcttaaacgagtacgaggctaaactgtcagacttaagggcgcgtcttcaggaagcggctgctcaggccaagcaggctaacggcctgaatcaggaaaacgaaagagcactgggagcgatacagcgacaggtcaaggagatcaactcactccagtccgatttcactaaatacctgacaaccgcagattccagcttgctccagactaacatcgccctgcagctgatggagaaaagccaaaaggagtatgagaaactggctgcctccctaaacgaagctcggcaagagttgtcagataaggtaagggagctgtcccgatccgcgggtaaaacctcgctggtcgaagaggccgagaaacatgcaagatctcttcaggagcttgctaagcagctggaagaaattaagaggaatgcaagcggggatgagctcgtgcggtgtgctgtagacgctgccaccgcgtatgagaacattctgaacgctatcaaggccgctgaagacgccgcaaatagggctgcctcggcctcagagagcgccctgcagactgtaatcaaggaagatcttccaaggaaggctaagacgctaagctctaacagtgacaagcttctgaatgaggcgaaaatgacgcagaagaagctgaagcaggaagtgtctccagcgctcaataatttacagcagactctaaatatcgttacagtacagaaagaggtcatcgataccaatttgactacactccgagacgggcttcacgggatccaaagaggggatatcgatgccatgatatcatctgccaaatccatggttaggaaggctaatgacatcactgatgaggtgctggatggcctgaacccaatccagactgacgtggagcgcatcaaagatacatatgggcgaactcaaaacgaggatttcaaaaaagctcttacagatgccgacaactctgtcaataaactgaccaataagctccctgatttgtggcgcaagatcgaatcaattaaccagcagttgctccccctgggcaacatcagtgataacatggacagaattcgtgaactaatccagcaggcaagagacgccgcttctaaagtggccgtgccaatgcgcttcaacggcaagagcggcgttgaggtgagactgccgaacgatcttgaagacttgaagggttacacctctctaagccttttcctgcagcgacccaactctcgcgaaaatggcggaaccgaaaatatgttcgtcatgtaccttggaaataaggacgcaagtcgcgattacatcggcatggccgtcgtagatggacagctcacttgtgtttacaacctgggcgatagagaagccgaactgcaggtcgatcagatcctaacgaaatccgagacgaaggaagctgtgatggaccgcgtcaaattccagcgaatctatcaatttgcaaggctgaactatactaaaggcgctacaagtagtaagcccgaaactcctggcgtctatgatatggacggccgaaactcaaacacactccttaatctggatcccgagaatgtagtgttttacgtcggtggatacccccctgacttcaagctcccgagcaggctttcctttcctccctacaagggatgcatcgagctggacgatctgaacgaaaacgtcctctccctgtataactttaagaagacgtttaacctcaatactactgaggttgagccttgtaggagaaggaaggaggagtccgataaaaattactttgaaggtaccgggtacgcacgggtacccacgcagccacacgcccctatccccactttcggccagacgatacagacgactgtcgaccgaggactgctgttttttgccgaaaacggggatcggttcataagtctcaatatagaggacggaaagctcatggtgcgctacaaattaaacagtgagttacccaaggaacgcggtgtcggagatgccatcaacaacggacgggaccacagcatccagatcaagattgggaaactccagaagcgaatgtggatcaatgtggatgtgcagaataccataattgacggcgaggtgttcgatttcagcacctattatttggggggaattccaatcgctatcagagagagatttaacatctcaactcctgcctttcggggttgcatgaaaaacctcaagaagacgtcgggcgtagtgagactcaatgacaccgttggcgtcacaaaaaagtgcagtgaagactggaaactggtcaggtctgcctcatttagtagagggggtcagctcagcttcacagacctgggtttacctccaacagatcacttgcaggcctctttcggttttcagacctttcaaccctctgggatactgttggaccaccagacctggaccagaaacctgcaagtgactcttgaagacggctacatcgaactgagcacatctgacagtggcagccctattttcaaatctcctcaaacctacatggacggactgctgcattatgtctctgtgatcagtgacaactccggtctgaggttgctgattgatgatcagctgttgcgtaattcgaagcgcctgaagcacatttcaagtagtcgacagtccttgcgactgggtggcagcaactttgaggggtgcattagcaatgtatttgtccagcggctctccctgagtccggaggtgttggacctcacttctaattccctgaagcgagatgtgtctcttggcggatgctctctgaataaaccgccattcctgatgttgctgaaaggttccacacgatttaacaagaccaaaactttcagaattaaccaactgctgcaagacacaccagtggccagtcccaggagcgtgaaagtctggcaggatgcctgctctccactgccgaaaactcaggctaaccatggcgctctgcagtttggggacattccaacatcccatctcctattcaagctgcctcaggaactcttaaaaccacggtctcagttcgccgtcgacatgcaaaccacaagctcccgcggtctggtattccacaccggcaccaagaatagcttcatggcactgtatcttagcaaaggcagattggtatttgctctcgggacggatggcaagaagctgcgaatcaagagtaaggagaaatgtaatgacggcaagtggcataccgtggtgtttgggcacgatggcgaaaagggcagactagtggttgatgggctgcgcgcacgcgagggcagtctgccaggtaattctaccataagcattagggcccctgtgtatctgggctccccacccagcgggaaacctaaatccctacccaccaattccttcgtgggctgccttaagaacttccagctcgactccaagcccctttacacacctagctccagtttcggggtttcgagctgcctggggggtcccctggagaagggtatctacttctccgaggaagggggacacgtggtcttagcacactcagtcctcttaggacctgagttcaagcttgtcttttctatccggccacggtccctcaccggtatcctgatccacatcggctcccagcctggcaaacatctgtgtgtgtatttagaggcgggtaaggtgactgcctctatggatagcggcgctggtggcacaagcacgagcgtgaccccaaagcaaagtctgtgcgatggtcaatggcacagcgtggctgtcaccattaaacagcatattttgcacctggagctcgataccgacagcagctacacagctgggcagattcctttccctcctgctagcacacaagaaccgctacacctggggggagccccagctaatttgaccactctgcggatcccggtgtggaagagcttctttggttgcctccggaacattcacgttaatcacatccccgtgccagtcacagaagctctggaggttcaagggcctgtgtcattgaacggatgtccggaccagta

SEQ ID NO: 228078 - DNA, 9833 bp, Artificial Sequence
  Description of Artificial Sequence: Synthetic coding sequence
atggcagccgcagccagacccagaggtagagcactgggcccagtgctgccacctacacccctcctgctgctagtactccgagtgctccccgcatgcggtgccacagccagggaccctggagcagccgctgggctgtctctccaccctacctattttaatctagcagaggctgcccgaatctgggccactgccacctgcggggagagaggtcccggtgaaggacgtccacagcccgaactgtactgtaagttagtggggggacccacggccccaggtagcggccacacgatccagggacagttctgtgattactgtaactcggaggaccctcggaaagctcaccccgtgactaacgcaatcgacgggagtgagcgctggtggcaatctccaccactgagctcaggaacacaatataatcgcgtgaatctcacgctcgatctgggccagctgtttcatgtagcatacatcttgatcaaattcgctaattcacccaggccagacctgtgggtgctggaacggagtgtcgatttcggcagcacttacagcccctggcagtattttgcacattctaaagtggactgtcttaaagagttcggcagggaggctaacatggccgtgactagggatgacgatgtcttgtgcgtgacagaatatagtcgcattgttcccctcgagaacggagaagtcgtcgtgtcactgataaacgggagaccaggtgccaaaaactttactttctctcacacactccgcgagttcacaaaggccacaaacatccgccttagatttctccgcaccaatacgttactggggcaccttatcagcaaagcacagcgggaccctaccgtgactcgcaggtattactactcgatcaaggatatttctattggcggacagtgtgtgtgcaacggacatgcggaggtatgtaacatcaacaatccagagaagctctttagatgcgagtgtcagcaccacacttgcggagagacctgtgaccggtgctgcacgggatataatcagcgccgatggcgcccagctgcctgggagcagtctcacgagtgtgaagcctgtaactgtcacggccacgcgtcaaattgctattacgatccggatgtagagcgacaacaggctagcttgaacacgcagggaatctatgcagggggaggggtgtgcatcaactgccagcacaatacagctggggttaactgtgaacagtgtgctaaaggatactatcggccttatggagtgccagttgacgcaccagacggctgtatcccatgttcctgtgacccagagcatgccgacggctgtgagcagggcagcggtaggtgccattgtaagccaaacttccacggggacaactgcgaaaagtgtgcaattggatactataattttccattttgtcttcggatcccaattttccctgtgtccactccttccagtgaggacccggttgcaggggatatcaagggatgcgattgtaatcttgagggcgtgctgcctgaaatctgtgacgcccatggacgctgcctgtgcagacctggcgttgagggaccacgatgcgacacctgcagaagcggcttctactccttcccaatctgccaggcttgttggtgttctgccctggggtcttatcagatgccctgttccagcgtgactgggcagtgcgaatgtcgtccgggtgttacagggcagcgctgtgatcggtgcttgtcaggagcttacgactttccccattgccaagggagctctagtgcttgcgacccagccggaacaataaactctaaccttggatactgccagtgtaaactgcacgtcgaggggccaacatgttctaggtgcaaactgctttattggaatcttgacaaagagaatccttcaggctgttcggaatgcaaatgccataaagctggaactgtgtccggcacaggcgagtgccgacagggggacggcgattgccactgcaaatcccatgtgggaggggatagttgcgacacctgcgaggatgggtatttcgctcttgaaaaaagcaattacttcggatgtcagggatgtcagtgtgacattgggggtgccctgtcctctatgtgctccggccctagcggcgtctgccaatgcagagagcacgtcgtcggaaaggtgtgccagcgcccagaaaataattactattttcctgatctacaccatatgaagtacgaaatcgaggacggctcaacaccaaatggtcgggatctgagattcggctttgacccactagcattcccagaattcagttggagagggtacgctcaaatgacatctgttcaaaatgacgtaagaataactctgaatgtcgggaaaagctccgggtctctgttccgggtgatccttagatacgtgaacccgggaacagaggctgtgtctggccacataacaatctaccctagctggggagccgcacaaagtaaagagattatatttctgccctccaaagaacccgcttttgtgaccgtgccagggaatgggtttgctgaccccttcagcattacaccaggaatctgggtggcatgtataaaagccgaaggcgtcctgttggattacctggtgctcctgcctcgggactattacgaagcctcagtgctgcagctccccgttaccgagccttgtgcttacgctggtcccccacaggaaaactgcttgctctaccaacaccttccagtgacccgattcccgtgtactctagcatgcgaggcaagacattttttgttggacggggagccccgtcccgtggccgtgcgccagcctacccccgcacacccagtcatggtggatttgtcgggcagggaagtcgagcttcacctccgccttcgaattccccaggtcgggcactatgtggtggtggtcgagtatagcacagaagccgcacagctgtttgtggtggacgtaaacgtaaaatcttcgggttccgtacttgcaggacaggtgaatatatatagctgtaattactccgtcctgtgcaggagcgctgtgattgatcacatgtccaggatagcaatgtacgagctgctggctgacgccgatatccagctgaagggccacatggcaagatttttgctgcaccaggtgtgcattatcccaattgaggagttcagcgccgagtacgtcagaccccaggtccattgcatcgcttcgtacgggagatttgttaatcaatccgcgacttgcgtgtccctggcccatgagaccccacctactgccctgattctcgacgttctgtccggtcgcccttttccccacctgccacagcagtcctcaccttcagtggacgtccttcccggtgtcacactaaaggctccccagaaccaagtgacgctgaggggtcgtgttccccacctggggagatatgttttcgttattcacttttatcaggcagcccacccgacattccccgctcaagtgagcgtcgatgggggttggcctcgagcgggaagcttccatgccagtttttgtcctcatgtactcggctgccgagatcaggtaatcgccgaaggccagatcgagtttgacatatcagagcctgaagtggcagccacggtgaaagtacctgagggcaaaagccttgtgcttgtccgggtgctcgttgtgcctgctgagaactacgattaccagatactgcataaaaaaagcatggataagtcactggagtttataactaactgtggaaagaacagcttctatttagacccccagactgcctcacggttctgcaagaattctgcccgatccctggtcgcattttatcataagggtgccctcccatgcgaatgtcatcctacaggcgcaaccgggccacattgttctcctgagggcggtcagtgtccttgccagccaaatgtcatcggtcggcagtgcactaggtgcgccactggacattacggattccctcgctgtaagccatgtagctgcgggcgtcgcctttgcgaggagatgactgggcagtgtcgctgtccacccaggaccgttcgtccccagtgcgaagtttgcgagacccacagctttagtttccatccgatggccggttgtgaaggatgcaattgctcccgcagagggactattgaagcagcgatgcccgagtgcgatagagattcagggcagtgtaggtgtaagccacggattactggcaggcaatgcgataggtgtgcttctggcttctaccgatttcctgagtgcgtaccgtgtaactgcaatcgtgacggcacagagccaggcgtctgtgatcccggtaccggcgcttgcctttgtaaggagaatgtggagggcaccgaatgcaatgtctgccgggagggaagcttccacctcgaccccgctaacctgaaggggtgtacgtcctgtttttgtttcggcgtcaataaccagtgccatagcagccacaaaaggagaaccaaattcgtagacatgcttggatggcacctcgagactgccgacagggttgacattcctgtatcgttcaatcccggttctaattctatggttgccgatctgcaggaactccctgctacaatccacagcgcgagctgggtagccccaactagttacttgggagataaggtttcaagctatggcggttacctcacttaccaggccaagagctttggactgccaggagacatggtcctcttggaaaaaaagcctgatgtccagctgacaggacaacatatgagcataatctatgaagaaaccaatacacccaggcctgaccgtcttcaccatgggagggtgcacgtggttgagggaaatttccgacatgcaagcagcagagctcccgtttcacgggaagagctgatgacagtgctttcacgattggctgatgtgcgcattcagggcctgtactttactgagacacagaggttaacactaagcgaagtcggactggaagaagcatcggacacaggcagcggacgcattgcccttgcagtcgaaatctgtgcatgcccacccgcttacgcaggggatagctgtcagggatgctctccagggtattatcgagatcacaaaggactgtataccggccgttgcgtcccctgcaactgcaatgggcatagcaaccagtgtcaggacggctccgggatctgtgtgaattgtcaacacaatacagccggagagcactgtgaaagatgtcaggagggctattacggtaatgccgtccacgggagctgccgcgcatgcccatgcccacatacaaactctttcgccacagggtgcgtcgtcaacggcggagacgtgaggtgcagctgcaaggcagggtataccggcacacagtgcgagagatgtgcaccgggttatttcgggaacccacagaagttcggcggtagctgtcagccatgcagttgtaactcaaacggacagctcgggagttgccatccactcaccggcgactgtatcaaccaggaaccgaaagactcatcccccgctgaggagtgcgatgactgtgacagctgtgttatgacactgttgaatgatctcgctacgatgggagaacagcttcgcctggtgaaatctcagttgcaaggactgagcgcctctgctggactcctggagcagatgcggcacatggagactcaggccaaagacctgcgaaatcagctgctgaattaccgaagtgcaatatccaatcacggcagcaaaatcgagggactggagagagaacttaccgacctcaaccaggagtttgagaccctgcaggaaaaagcccaggttaacagcagaaaagcccagacgttaaacaacaacgtcaatcgtgcaacccagtccgccaaggaacttgacgtcaagatcaaaaatgtcataaggaacgtccacatgctgaataggattaggacttggcagaaaacccaccagggggagaacaacggactcgccaactcaattcgtgacagtctgaacgagtacgaggctaagttgtctgacctgagggccagattgcaggaggccgctgcccaggcaaagcaggccaacggattgaatcaggaaaatgagagggccctcggagccatacagaggcaggtgaaggaaatcaactccctgcaatccgattttacgaaatacctgacaacagccgatagcagcctcttgcagaccaacatagcccttcagcttatggagaagagccagaaggaatatgagaaactggctgccagcctgaatgaagccaggcaggagttgtccgataaagttagagaactgtctcggtccgccggtaagaccagcttggtggaggaagcagagaagcatgcacgcagtctgcaagagttggcgaagcagttagaggaaatcaaacggaacgcaagcggggacgagcttgttcggtgtgctgtggacgcagccacagcatatgagaatattctgaacgccattaaagccgcagaggacgctgctaatagagctgccagcgcgagcgagtccgccttgcagacagttattaaggaggacctgcccagaaaagctaagactctcagctcgaacagtgataaattgctgaatgaggctaagatgacacagaaaaagcttaagcaggaggtgtcacctgcactgaataatctccagcagacactgaatatcgtaacagtgcagaaagaagtgatcgacacaaatctgacgaccttgcgtgatggcctgcatggaattcagagaggagacatcgacgcgatgatctcatccgccaagagtatggtacgaaaagctaacgatattacggatgaggtgttagacggactgaaccctatccagacagacgtagagagaattaaggatacctacggcagaacgcagaacgaggattttaagaaggcccttactgatgcggacaattcagtgaataagctgaccaataaactcccggatctgtggaggaagattgagtctattaatcaacaactccttcccctcggtaatatctccgataatatggataggatccgtgaattaatacagcaggcaagagacgccgcaagcaaagtcgccgtgccgatgaggttcaacgggaagagtggggtggaggtaaggttgcctaatgacctggaggatcttaaggggtatacaagcctctccctgttcttgcagagaccaaatagtcgagagaacggtgggactgaaaatatgttcgtgatgtatctgggcaacaaggacgccagcagagattacataggcatggccgtggtggatggccagctgacatgcgtgtataaccttggcgatcgcgaagccgaactacaggttgaccagatcctgaccaagagtgagacgaaggaggcagttatggatcgggtgaaattccagcgaatctatcagttcgccaggctcaactatactaaaggggcaacgtccagcaaacctgaaaccccaggcgtgtatgatatggacggaagaaactctaatactcttctgaatctggatcccgagaatgtggtattctacgtgggtggatacccacccgattttaagcttccaagccgcctctcttttcccccatacaaggggtgcatcgagctggacgacttaaatgaaaacgtgctttctctttacaacttcaagaagacatttaacctgaacacaaccgaggttgagccatgccgacgaagaaaggaggaatccgacaagaattactttgaaggtaccggctacgccagggtgccgactcaaccccacgcacccattcctacctttggtcagactattcagacaactgtggaccggggactgcttttcttcgcagagaatggagaccgattcatctcacttaatattgaggacggcaaattgatggtacgatacaaactgaattccgagcttcctaaagagaggggcgtcggagacgctatcaacaacggcagggaccactccatccagatcaaaattggcaagctgcagaaacggatgtggatcaatgtggacgtgcagaacaccattattgatggagaggtgtttgacttttccacgtattatttggggggtattccgatcgctattagagaacgatttaatatctccacacccgcatttcgagggtgtatgaaaaacctaaagaagacatccggagtggtgcgattaaacgacactgttggcgtgacaaagaaatgtagcgaggactggaagctcgtgcggtccgcatcattcagcaggggcggtcaactgtcctttacagaccttggcctgccccctacagaccatctgcaggcctctttcggcttccagacttttcaaccctcaggtatcctgctggaccatcagacctggacccgcaacctacaggtgacattggaagacggatatatcgagctgagcacctcagattccgggtctcctatatttaagtctcctcaaacctacatggacggtctgctacactacgttagtgtcatcagtgataactctggcctccgcttgctgatcgacgaccaactgttgaggaattctaagcgcctaaagcacattagctcctctcgccagagcttacgcctgggtgggtctaacttcgaggggtgtatttctaatgtgtttgtacagaggctgtccctgtcacctgaagttctcgatctgacgagcaactctctaaagagagatgtatccctgggtggatgttcccttaataaaccaccctttctcatgcttttgaaggggtccaccaggttcaacaagaccaagaccttccgcataaatcagctattacaggatacacccgtggcctccccccgatctgtgaaagtgtggcaggacgcatgttcccctctcccaaagactcaggccaatcacggcgcactacagttcggtgatatcccgacatcccacttgctgttcaagcttccacaggagctactgaagccaaggagccagtttgcagtggacatgcagacgacatcctcaagaggactggtatttcatacaggcaccaaaaacagctttatggccttgtatctgtctaaaggccgactcgttttcgccctagggaccgatggcaagaagctgcgcatcaagagcaaagagaagtgcaacgatggcaaatggcacaccgtggtctttgggcacgatggggaaaaaggccgactggtggtagacgggcttagggcacgagagggatccctgcctggaaactccactatatccatcagagcccctgtgtatctgggcagtcctcccagcggcaaacccaagagtctgccgactaattccttcgtgggttgcctgaagaattttcagctggattctaagcctctgtacactccttctagctccttcggcgtttcctcctgcctgggaggacccctagaaaaaggcatctacttcagtgaggagggtggccatgtggtgctagcccactccgtcctcctgggccctgagttcaaactcgtcttttccatacgacctcgctcgttgaccgggattcttatccacatcggttctcagcctggaaagcatttgtgtgtgtatcttgaagcgggtaaagtaaccgccagcatggactctggtgctggaggcacatccacgagcgtcactcccaagcagtccctatgcgatggacagtggcactcagtggcagtgaccatcaagcagcacattcttcacctggaactcgatactgacagctcatataccgctggacagatccctttcccaccagcctcaacccaggaacctctccacctgggcggagctccagcaaatctcactaccctgcggattcctgtatggaagagtttcttcggctgcctgcgtaacattcacgtaaaccatatacccgtaccagtcaccgaagccctcgaggtacagggcccagtgagcctgaatggatgcccagaccagta

SEQ ID NO: 228079 - DNA, 4559 bp, Artificial Sequence
  Description of Artificial Sequence: Synthetic coding sequence
atggccgcagcggcaagaccacggggacgggctttgggcccagtcttgcctccaacgccactcctgcttctggtgcttagggtgctgcccgcatgtggtgccaccgctcgggatccgggagccgctgccggactcagcctgcaccccacatacttcaacctagccgaagcagcccgaatctgggcgaccgctacttgtggagaacggggaccaggtgagggaaggccccagccagaactgtattgtaaacttgtagggggtccgaccgcgccaggatctggccacactatacagggtcagttctgtgattattgtaattccgaggacccccgaaaggctcaccctgtcacaaatgctattgacgggtcagagaggtggtggcagagccctcccttgagcagcggtactcagtataaccgggtgaacctcacccttgatctcggccagctgttccatgtggcttacattctgataaagttcgccaatagcccccgacctgacctgtgggtgttagagaggagtgtggactttggatctacctactctccatggcagtattttgcccacagcaaagtcgactgtcttaaagaatttggccgagaggcaaatatggccgtgacccgggacgatgatgtgctctgcgttaccgagtatagtcgcatcgtcccactggaaaatggagaagtggttgttagtctgattaatggcagacctggcgctaaaaactttaccttctcccacactctgcgagtgtatcagggtaacaaacatccgctgtttctcagaacgaatacactgctgggtcacctgatttccaaagctcagagagatccaactgttacacgtagatattattatagcatcaaggatatctccatcggtggtcagtgtgtgtgtaatgggcacgcagaggtgtgtaatattaacaatcccgagaagttgttccggtgtgaatgccagcaccatacttgtggcgaaacatgtgaccggtgctgcacaggctacaaccagcgcagatggcgacccgctgcttgggagcaaagccacgagtgcgaggcctgtaattgccatgggcatgcctccaactgttattatgaccccgatgtggaaagacagcaggcaagcctgaacacacaggggatctacgcgggtggcggtgtctgtattaattgtcagcataatactgccggtgttaattgtgagcagtgcgctaaggggtattacagaccttacggtgtgcctgtagacgcccctgacggttgtataccttgctcttgtgaccccgagcacgcggatggctgcgagcaaggaagtgggagatgccactgcaaacctaatttccacggtgataattgtgaaaaatgtgcaatcgggtattacaactttccgttctgccttcgtattcctatctttccggtgtccaccccctccagtgaagacccagtggcgggagacatcaagggatgtgactgtaatctggaaggagtcttgccggagatctgtgacgctcatggtcgatgcttatgtaggcctggagttgaggggcctagatgcgatacatgtcgctccggattctacagctttcctatctgccaggcctgttggtgcagcgccttgggtagctaccagatgccatgctcctcagtcaccggccagtgcgaatgcagacccggagtaacagggcagaggtgtgatcgctgtctgagtggggcatatgactttccccactgccagggtagcagcagcgcctgcgatccagcaggaaccattaattctaacctgggatactgccagtgtaagctgcatgtcgaggggcctacgtgcagccggtgtaaactgctgtactggaatctcgataaagagaaccccagcggctgttcagagtgcaagtgccataaggcgggtactgtcagcgggactggagaatgcagacaaggagacggtgactgccactgtaagtctcacgttgggggagattcatgcgacacctgcgaggacggctacttcgccctggagaagagtaattacttcgggtgccaggggtgtcagtgtgatatagggggtgcccttagctctatgtgctccggtccctctggcgtgtgtcagtgtagggaacacgtcgtgggcaaggtctgtcaaaggcccgaaaataattattatttcccagatctccaccacatgaagtacgagattgaggacggctctaccccaaatgggagggatctccgattcgggttcgatcctctcgcttttcccgaattcagttggcggggatatgcacaaatgacatcagttcaaaacgatgtcagaattacattgaacgtcggaaagtcaagtggcagtctgttccgtgttattttgaggtacgtcaatcctggtaccgaagccgtgtccggacacattacaatttacccgtcctggggagcagcacagtccaaagagataatcttccttccctcaaaagaacctgcctttgtaaccgtacccggtaacggattcgcagaccctttttctattacacccggaatttgggtcgcttgtattaaagcagagggggtactgctagactatctcgtcctgctccctcgagattattacgaggcctcagtactgcagctccccgtgacagaaccgtgtgcttatgccggtcccccacaagaaaattgcctcctctatcagcacctacccgtgactcgcttcccttgtacgctggcatgtgaagctcgacactttctactggacggggaaccacgacccgtcgcagtccggcagccgacccctgcccatccggtaatggttgatttgtctggtagagaggtggaactccacctccgtcttcggattccacaggtgggccactatgtggtcgtggtcgaatatagtactgaagccgcacaattgttcgtagtggatgtgaacgtaaagtcaagcggctcagttctggctgggcaggtgaacatatacagctgtaattactccgttctgtgtcgcagcgccgtcatcgaccatatgagccgcatcgcgatgtacgagttactggcggatgccgatatccagctcaaaggccatatggctaggttcttattgcaccaggtctgcataattcccatcgaagagttctcagcagagtacgtgcgcccacaggtacattgtattgcatcgtatggcagatttgtaaatcagtcagccacatgtgtttccctggcccatgaaactcccccaactgcgctgattctggacgtcttgagcggcaggccgtttccacacttgcctcaacagagttccccaagtgtggacgtattacctggcgtaacactaaaggcccctcagaaccaggtcactctgcgtggccgagtcccgcacctcggcaggtatgttttcgtgatccacttctaccaggctgcccatccgaccttccctgcgcaggtcagcgtggacggcggatggcctagagcaggctcttttcacgcttcattttgcccacatgttctcgggtgccgcgaccaggtgattgcagagggacagatagagtttgatatcagcgagcccgaagttgctgctacagttaaagttcccgagggcaagtccctggtgttggtacgggtccttgtggtacccgctgaaaactacgattaccagatcctgcacaaaaaatcaatggacaagtccctggagtttattacaaactgtggcaaaaactcgttttatttggaccctcagaccgcatcaaggttctgtaagaattccgccagatcactggtcgctttttaccataagggtgctctcccgtgcgaatgtcacccgactggtgctaccggcccacactgcagtccagagggaggggcacatgcttctcctaccagctccggtggatctgccccagctgtccagcaagcctatggcttccccagatgcaagcgaaagtcctgcagttgtggccgtagactctgcgaggaaatgacaggccagtgccgctgtcctcctcgcactgtacgccctcagtgcgaagtttgcgagacacatagcttctcctttcaccccatggctgggtgcgaggggtgcaattgctccaggagagggactatcgaggccgctatgcctgagtgcgacagagacagtggccagtgccgctgcaaaccgcgaatcactgggcgacaatgtgaccgatgcgcaagtgggttctacaggtttccggagtgcgtgccctgcaactgcaacagggacggaactgagccgggtgtgtgcgaccccggaactggcgcttgcctgtgtaaggaaaacgtggaaggcacagagtgcaatgtatgcagggaaggcagttttcacttagatcctgctaacctcaagggatgcaccagttgcttttgctttggcgtcaataatcagtgccactctagccataaaaggcgtactaaattcgttgatatgctcggttggcacctggaaaccgccgaccgggtggacatacccgtgtcttttaaccctgggtctaactccatggtggctgatctgcaggagctccctgccactatccatagcgccagctgggtggcgccata

SEQ ID NO: 228080 - DNA, 1743 bp, Artificial Sequence
  Description of Artificial Sequence: Synthetic coding sequence
atggccgcagccgcacgacccagaggcagagcgcttggtcccgtattgcccccaacaccattgctattactagtgttgagggttctccccgcttgtggcgcaaccgctcgggatcctggcgcagcagcaggtctgagcctgcaccccacttactttaaccttgcagaagccgcaaggatttgggcaacggccacttgtggcgagcgcggacccggagaaggaagaccccaacccgaactctattgtaagcttgtcggcggaccgacggcgcctggttccggccacactatccagggacagttctgcgactattgtaactcagaggatccaaggaaggcacatccagtgaccaacgccattgacggttccgaaagatggtggcagagccctcccctctcatctgggacccaatacaaccgggtgaacctcaccctagatctaggccagctgttccacgtggcctatatcttgattaagtttgccaatagtcccaggccagatctgtgggtcctcgaaaggtctgtggactttggaagtacatatagcccctggcagtactttgcgcactctaaagtggactgcctcaaagagtttggtcgcgaggccaacatggccgtgactagagatgacgacgtgctctgtgtgaccgaatattctcgcattgtacctctagaaaacggcgaagttgtggtctcgcttatcaatggcagacctggtgccaagaactttacattttctcatacactccgagagttcaccaaggcaaccaatatacgtctccggtttctgcggactaatacactgctcggccatctcatttcgaaggctcagcgggaccccaccgtcacacgcagatactattattccatcaaggatatctcaattggcggtcagtgcgtctgtaacggccatgccgaggtgtgtaacatcaataatcctgagaagttgttccgctgcgaatgtcagcatcacacctgcggggaaacctgcgatcgctgttgtaccggttataaccagcgaaggtggcgtcccgctgcctgggaacagagccatgagtgtgaagcatgcaactgccacggccacgcttctaactgttactatgaccccgatgtcgaacggcagcaggcgagtctcaatactcagggcatctacgccggtggcggtgtatgcattaactgccagcataatacggctggggtcaactgcgagcagtgtgcaaagggatactacagaccctacggggtgccggtggatgcacctgatggctgcatcccctgtagttgcgacccagagcacgccgatggctgtgaacaaggaagcggcaggtgtcactgcaagccgaattttcacggcgacaattgcgagaagtgcgctattgggtactacaacttccctttttgcctacggatccctatctttcctgtcagcacaccttcctctgaggaccctgtggccggagatatcaaaggcaactggtgtgattgcaacctcgaaggggtgttgcctgaaatctgcgacgctcatggaaggtgcctatgccggccaggtgtagagggccctagatgcgacacatgcagatctggattctatagcttccctatctgtcagggccctagcgagaaggtggccatttacaaacccgagtcccgccctagtgccgagaccgagccagcctcaacctggattttggactttcccgcatccagaaccggcgagataaatttttattgtctatcgccctag

SEQ ID NO: 228081 - DNA, 5007 bp, Artificial Sequence
  Description of Artificial Sequence: Synthetic coding sequence
atgccaccggcagttcgccgatctgcgtgttctatggggtggctgtggattttcggcgctgcccttgggcaatgtttgggttactccagtcagcagcaacgtgttccgttcttgcagccgcctggccagtcacagttacaggccagctatgtcgagttccgtcctagccagggttgctcacctgggtattaccgtgaccacaaagggctgtatacaggaaggtgcgtgccctgcaactgcaacggacacagcaaccagtgtcaggatggctctgggatatgcgttaactgtcagcataataccgcaggggagcattgtgagcggtgccaggaggggtactacggcaacgcagtccacggatcatgtagggcgtgcccttgtcctcacacaaattctttcgcaaccgggtgcgtggtgaacggcggagacgttcggtgttcctgtaaagcgggatacactgggacccagtgcgaaagatgtgctccaggctattttggaaacccacagaagttcggaggaagctgccaaccatgctcatgtaattcaaatggccaactggggtcctgccatcccctcaccggagattgtattaaccaggagcccaaggactcttcccctgctgaagaatgcgatgattgtgattcctgcgttatgacacttctgaacgacctcgccaccatgggggaacagctccgcctggtcaagtcccagctgcaagggctgtcggcctctgccggactgctggagcagatgagacatatggagactcaggccaaggacctaagaaaccagctgcttaactaccggagcgcgataagtaaccatggtagtaaaattgagggcctggaaagagagctgaccgacctcaaccaggagttcgagaccctccaagaaaaggcacaagtgaactctcgaaaggctcagaccttaaacaacaacgtcaatagggcaacacagtccgccaaagagctcgatgtcaagataaagaatgtcatcagaaatgttcatatgctgaatcgcattcgcacatggcaaaagacacaccaaggggagaacaatggcttagccaacagcatcagggatagcctgaacgaatacgaagctaagctctccgacctacgagctcgactgcaagaagccgctgctcaggctaaacaggctaatggcttgaaccaagagaacgaacgcgcactgggggcaattcaacgccaggtgaaggaaattaattctttgcaatcggacttcaccaagtatttgactactgccgacagctccctgctccagaccaacattgcactgcagctgatggagaaatcccagaaggaatatgagaaattggctgcttcacttaacgaggctcgccaagaactgtctgataaggtgagagagttaagccgtagtgcaggaaagacctccctcgtcgaagaagccgagaaacacgccagatcactacaggaacttgcaaagcaactggaagagataaagcggaatgcatctggcgacgagttggtgagatgcgctgtggacgccgctacagcttacgagaatattttaaatgctatcaaggccgcagaggatgcagccaatagagcggcttcagcatctgaatccgcactccagaccgttataaaagaggacttgccacgaaaagcgaaaactctgagctcaaattctgataagcttctgaacgaggctaaaatgacccagaaaaaactcaaacaggaggttagtcctgcgctcaataacttacagcaaacgctgaatatcgttaccgtgcagaaagaagtcatcgacacaaatcttaccaccctacgtgatgggctgcatggaatacaacggggagacattgacgccatgatctcatccgctaaatcaatggtccggaaagctaacgacattactgatgaagtgctggatgggctgaaccctattcagacagatgtggagcggatcaaagacacttacggccgtacccagaacgaagactttaagaaggccctcaccgacgctgataactctgtgaataaactcaccaacaaattaccagatctgtggaggaaaatcgaatcaatcaaccagcagctcctccccctagggaacatttccgataatatggatcgaatccgtgaattaatccagcaggccagggacgctgcttccaaggtagctgtgcctatgagatttaacggaaaaagcggcgtggaagtacgactcccaaatgatctggaggacctgaagggctatactagcctgtccctgttccttcagagaccaaattcacgcgagaatggcggaacagaaaacatgttcgtaatgtacctaggaaacaaggatgcctctagggattatatcgggatggctgtggttgacggtcagttgacgtgtgtgtacaacctcggcgacagggaggctgagttgcaagtggaccagatcctcaccaagtccgaaaccaaggaagctgtcatggatcgcgtgaaattccagagaatttatcagttcgctcgattgaattacaccaagggggcaacttcgagcaaacctgaaacgccgggagtgtacgatatggatggccgtaattctaacaccctgctgaacctagaccccgagaatgtcgtgttctatgtcggagggtatccacccgactttaaactgccttcacgtctgagtttccctccttataaggggtgtatagaactagacgacctgaacgaaaacgtgctctccctgtacaattttaaaaaaacattcaatctgaacacaactgaggttgagccttgtagaaggcgtaaagaagaaagcgacaagaactatttcgagggcacaggatatgctcgggttcctacccagcctcacgccccaatcccgacatttggacaaaccattcagacaacagtagatcgaggcttactcttctttgcggagaatggcgatcgttttattagtctgaatattgaagatggcaaactcatggtgcggtacaaacttaattccgagttgccaaaagaacgcggagtaggggatgcaattaacaacgggagggatcatagtatccagattaaaataggaaagctgcagaaacgaatgtggataaacgtagacgttcagaacaccataatcgacggcgaggtcttcgacttttcaacatactacctcggcggaattcccattgcgatccgggaacgcttcaacataagcaccccagccttcagaggatgcatgaagaacctgaagaagacaagtggcgtggtgcggttgaacgataccgtcggtgtaaccaagaagtgctcagaagactggaagctggtgcgaagtgcctcgttttcacgaggcggtcagctgtccttcaccgatttggggctcccgccaactgatcacttgcaggcatcatttggcttccagacatttcaaccttccggaattcttttggatcatcagacatggacgaggaatctgcaggtcaccctggaagacggctacattgaactgagcacatccgattctggctcccccattttcaaatctccacagacttatatggacggcctcttgcactatgtcagcgtgatcagtgacaattcaggtctgcggctgctaatcgatgatcaactcttgaggaattccaagcggctgaagcacatctcgtcgagtcggcagtcactgaggctcgggggttcaaactttgaggggtgcatttccaacgtcttcgtgcaaaggctgagtttgagcccggaggtcctggacctgacttccaactctttgaagcgcgacgtatcactcgggggatgctccttaaataaaccaccattcctgatgctactgaagggctccacccggttcaataaaacgaaaaccttccgcataaaccaacttctccaggatacccccgtagcttccccaaggtcagtgaaagtctggcaagatgcctgctccccccttcctaaaacccaagccaaccatggagcactgcagttcggagatatccccaccagccacctcctgttcaagctgccccaagaattgctgaagccacgatctcagtttgccgtcgatatgcagaccaccagctccaggggcctcgttttccatacaggcacaaagaatagctttatggctttgtacctctctaaagggcgtcttgtttttgcccttggcaccgatggcaagaaattgaggatcaagtcaaaggagaagtgcaatgacgggaagtggcacacggtagttttcggacacgacggcgagaaagggcgtctggtggtcgatggcctgcgcgctcgggagggctccttgcccggaaacagcactatatcaattcgtgccccagtgtacctaggaagccctccctccggcaagcctaaatccctgcctacaaactctttcgtaggctgcttgaagaactttcagttggatagtaagcccctatacacacccagtagttcattcggagtctcctcctgtctgggcggtccgttggagaaaggaatatatttctctgaagagggcggtcacgtcgtcttggcccatagtgtgcttcttggcccagagttcaagttggtcttctcaatcaggccacggagcctgactggcattctcattcacattggttcccagccaggaaagcacctttgtgtgtatctagaagcaggcaaagtcaccgcatctatggattctggtgccggagggacatccacaagcgtaactcctaagcaatctttgtgtgacggacaatggcatagtgtagcggtaacaattaagcagcatatattacatctggaactcgataccgatagttcctatacggccggtcaaattccgtttccccctgcatcaacccaggagcccctacacctcgggggagccccagcgaatttgacaacccttagaatcccagtgtggaagtcctttttcggatgcctcagaaatattcatgtgaatcacatcccagtgcctgtgacagaggccctggaagtgcagggacccgtgtctctgaatggatgcccagaccagtag

SEQ ID NO: 228082 - DNA, 1065 bp, Artificial Sequence
  Description of Artificial Sequence: Synthetic coding sequence
atgcaagggctgctgttctctacccttctcctcgccggactagcacagttttgttgtcgcgtgcaaggcaccgggcctctggacaccacacccgaggggcgacccggtgaagtcagcgacgcccctcagcgcaaacaattctgtcactggccttgtaaatgtccccaacaaaagccaaggtgccctccaggcgtttccttggtccgggatgggtgcgggtgttgcaaaatttgcgccaagcagcccggagagatctgcaatgaagcggatctgtgcgatcctcacaagggcctctattgtgattatagtgtcgaccgtccaagatacgagacaggcgtgtgtgcctatctggtggctgtcggctgcgagttcaaccaggtacactatcacaacggacaggtgttccagccgaacccgctgttttcatgtctatgtgtgtctggggcaattgggtgtacccctttgtttattcctaagctcgccggatcccattgtagcggtgcgaaggggggaaagaagtccgatcagtccaattgttctctggaaccactgctgcagcagttaagtactagttacaagacgatgccggcttatcgtaatctcccattaatttggaagaagaagtgcttagtccaggccaccaaatggacaccctgttcgaggacctgcggcatgggaatctcaaatagggtcactaacgagaattcaaattgcgaaatgcggaaagagaaacggctgtgttatattcagccgtgtgacagcaatatcttaaagacaatcaagattcccaaggggaagacatgtcagcctacgtttcagctgtccaaggctgagaagttcgtgttttcaggctgttcttctacccaaagctataaaccaacattctgtggtatatgtctcgacaagaggtgttgcatccctaataagagcaagatgattacgatccagtttgactgccctaatgaaggctcctttaagtggaagatgctctggattacttcttgcgtctgtcagcggaactgtcgcgaacccggtgacatcttttctgagttgaaaatcttatag

SEQ ID NO: 228083 - DNA, 267 bp, Artificial Sequence
  Description of Artificial Sequence: Synthetic coding sequence
atggcactatcttcagcctggaggagtgtgctaccattgtggctcttatggtccgcagcttgtagcagagccgcaagtggcgacgacaacgcttttccttttgacattgagggatctagcgcggtgggtaggcaagacccccctgagactagcgagccacgcgtcgcactcgggaggctgccgccagctgctgaaaagtgcaatgccggtttcttccatactctgtctggagaatgcgtgccctgcgattgtaatgggaactcctag

SEQ ID NO: 228084 - DNA, 363 bp, Artificial Sequence
  Description of Artificial Sequence: Synthetic coding sequence
atggcactctctagtgcctggcggagcgtcttacccctgtggttactttggtcggcagcgtgcagcagagctgcctccggagatgacaacgcgtttccattcgacattgaagggtcaagtgccgtaggacgacaggatcctccagagacttctgagccaagggttgcattgggaaggctccctccggcagccgaggtgcagtgcccctgtcactgccatcctgcaggagccccagcacctcctcgggcagtaccgcatagctctttttctctctctcctcccttatcatctccccagtgtctcgagagctttacttgggcccgtagcgttagaaagttagaaattaaatcgttccctctctag

SEQ ID NO: 228085 - DNA, 549 bp, Artificial Sequence
  Description of Artificial Sequence: Synthetic coding sequence
atggcgctatccagtgcgtggcggagcgttctgcctctctggctcctgtggtctgccgcttgtagtcgggctgcttctggtgacgacaatgcttttccttttgacatcgagggctcctccgccgtaggacgtcaggacccacccgaaaccagtgaaccccgagtcgcactcggacggctaccaccagccgctgagaaatgtaacgcaggttttttccataccctgagtggggaatgcgttccctgtgactgcaacggtaatagtaacgaatgcctggacggatctggttactgtgtacattgtcagaggaacacgacaggtgagcactgtgagaagtgcctcgacggctacataggtgatagcatccgcggagcgcctcagttctgccagccctgcccctgtccgctcccgcacctagcgaatttcgccgagagttgctatagaaaaaatggggcagtcaggtgtatatgtaatgagaattacgccggtcccaattgcgaacggccttccccacagagtaccagaggatttccactgaacgattcttag

SEQ ID NO: 228086 - DNA, 537 bp, Artificial Sequence
  Description of Artificial Sequence: Synthetic coding sequence
tagattttcgaagactgtgatgaagtcactggccagtgtcgtaactgcctacggaataccactgggtttaagtgtgaacgctgcgcccctggctactacggagacgcacgaatcgcgaaaaactgtgcggtatgtaactgcggtggagggccatgtgacagcgtgacaggagaatgtctcgaggaaggcttcgaaccaccaacaggaatggactgccctaccattagctgtgataaatgcgtgtgggacttaaccgacgccctgcggttggcggcactgtcaattgaagagggcaaatctggcgtgctcagcgtgagctctggagctgctgcccaccgtcacgtgaacgagattaatgctactatttacctcctgaagaccaagctctcagagagagagaatcaatatgctttacgcaaaatccagattaacaacgcggagaacaccatgaagagcctgctctctgacgttgaggagttagtggaaaagcattggaataaaccacggaggcgactggagctgcaggagggggtctag

SEQ ID NO: 228087 - DNA, 5450 bp, Artificial Sequence
  Description of Artificial Sequence: Synthetic coding sequence
atggcattatcctccgcttggcggagcgtcctaccactctggttgctgtggtctgcggcatgtagcagggcagcaagcggcgacgataatgcttttcccttcgatatcgagggcagcagcgcagttgggaggcaggatccccctgagacctctgaaccaagggtggccttgggacgcctacctccggcagccgaaaaatgtaacgctggcttttttcacaccttatccggagagtgcgttccatgcgattgtaacggcaattcaaatgaatgtctggacgggtccggctactgcgttcattgccaacggaacacgactggagaacactgtgaaaaatgtctggatggatatattggcgattccatccgcggtgcaccacagttctgccaaccttgcccttgccccttaccacatctggctaactttgccgagagttgctaccgtaaaaacggggctgttaggtgcatctgtaacgaaaactatgccggacctaactgtgagcgttgcgcaccagggtactatggcaatccactgctcatcgggagcacttgcaagaagtgcgactgctctggcaactccgacccaaatctgatctttgaggattgtgatgaggtcactggccaatgcagaaattgtctccggaatacaaccgggttcaaatgcgagagatgcgcccctgggtattatggcgatgcccgtattgccaagaactgtgctgtttgtaattgtggaggagggccatgtgactctgtcaccggggaatgcctggaggaggggttcgagccaccgaccggctgcgacaagtgtgtctgggacctgactgatgcactgcgtcttgctgccctgtctattgaagagggcaagagcggtgtcctgtccgtgagcagcggtgctgcagcacaccgacacgtcaacgagattaacgccacaatctacctgcttaagacgaagctctctgagagagaaaaccagtatgctttacgtaaaatccaaattaataatgctgagaacaccatgaaatccctgctgagcgacgtcgaggagctggtggaaaaggaaaatcaggcatccagaaaaggccaactagtccagaaagagtcgatggatacaatcaaccatgcaagccagctggtggaacaggcccacgatatgcgggataagatccaggaaatcaacaataaaatgctatactacggcgaggaacacgaactgtcacccaaggagattagcgagaaattggtcttagctcagaagatgctcgaagagattaggagccgccagccgttctttacacagcgggaattagtggacgaggaagccgatgaggcttatgagctgcttagccaagccgagtcttggcagagactgcataatgagaccaggacgctcttcccagtggtcctggagcagctggacgattataacgccaagctgtccgatcttcaggaggcactggaccaggcactaaattacgtaagagacgcagaagacatgaaccgcgctaccgcagccagacagagagatcacgaaaaacagcaggaacgggtgagggagcaaatggaagtggtgaacatgtccttgtccaccagtgccgactccttaacgacccccaggctcactttgagcgaactcgacgacatcataaagaacgcgtctgggatatacgccgagatcgatggcgctaagagtgaactccaagtgaaattgagtaacttgtcaaatctgtctcacgatcttgttcaggaagccattgaccatgcccaggacctacagcaggaggccaacgagctgtcacgcaaattacattctagcgacatgaacggactggtgcagaaagcactggatgcatccaacgtatatgaaaatattgtaaactacgtatctgaggctaatgagacggccgaatttgccctcaatactactgatcggatctacgatgccgtcagtggcatcgacacccagataatctaccacaaagacgagagcgaaaatctgcttaaccaggctcgtgaattgcaggcaaaggctgagagctccagtgatgaagcggtggccgacactagccggagagttggcggtgccttggcaagaaagagcgcactgaagacgagactgtcagatgccgtcaagcagttgcaagccgctgagcgcggagacgcacaacaaagattgggacaatcccgactgataactgaagaagcaaataggaccacaatggaagtgcagcaggccacagcaccgatggccaacaacctaacgaattggtctcagaatctacagcactttgatagctctgcgtacaatactgccgttaacagcgcgcgagatgctgtgcgaaatctgacagaagttgtcccccagttactcgaccagctgcgcaccgtagagcaaaaaaggccagcgagcaacgtgagtgcctccattcaacggatcagggagctgatagcccagacacgctctgtcgcttctaagattcaggtatcaatgatgtttgatgggcaaagcgcggtagaggtacactctagaactagcatggacgacctgaaagccttcacaagtttgagcttgtacatgaaacccccagtcaaacggccagagctgaccgagaccgcagatcaattcatcctgtatctcggcagtaaaaacgcgaaaaaagagtacatgggtctggccatcaaaaacgacaacttggtttatgtgtacaacctggggactaaggacgtggaaatccctctggattcaaagccagtctcaagttggcccgcttatttctctatcgttaagattgaacgcgtgggtaagcacggcaaggtttttctgacggtaccgtcactcagctctactgccgaggagaaatttattaaaaagggcgagttctcaggcgatgactctctcctcgacctggaccctgaagacacagtattctatgtggggggagtgcctagcaatttcaagctccctacttccttgaacctaccgggatttgtgggctgcctcgaattggccactttgaacaatgatgtaatctccctttataacttcaagcacatttacaacatggacccatccacctccgttccatgcgccagagataagcttgccttcacacaatcacgagctgcctcgtatttctttgatggatcgggttatgctgtggtgcgtgatattactcgcaggggcaaatttgggcaagtcacaaggttcgatattgaagtgcgcacacctgcagataacgggctcatcctcctgatggtgaacggtagtatgttctttcggcttgagatgaggaacggctatctccacgtattttacgatttcggtttttctggcggtccggtgcatttagaggacactctaaaaaaggcacaaattaacgatgccaagtaccatgaaatctctatcatctaccataatgataaaaagatgatcctagtcgtggataggaggcacgtcaaatctatggacaacgagaagatgaagatcccattcacagacatttacatcggaggggctccccctgaaatcctccagtcaagggcgctgcgggcacacctgccactggacatcaactttcgcggatgcatgaagggtttccaatttcagaagaaggatttcaatttactggaacagacagagacattaggggtggggtacggttgcccggaggactctctgatatcgaggcgggcttatttcaatgggcaatcgtttatcgcctcaattcagaaaatctcctttttcgatggcttcgaggggggttttaattttcggacgctccagcctaacggcctgctgttttactatgctagcggctccgatgttttcagcatttcactcgacaacggaactgtgatcatggatgtgaaaggaataaaagttcagagtgtcgacaaacaatacaatgatgggctctcccacttcgtgatctctagtgtgtcgcccacacgctacgagttgattgtggacaaaagtcgtgtggggagtaagaatccgacgaagggcaaaatcgaacagacccaggccagtgagaaaaagttttattttgggggaagtcctatctctgctcagtatgctaatttcacaggctgtatctcgaatgcatattttacgagagtagaccgagatgtggaggtagaagatttccagcggtatacagaaaaggtccacaccagcctatatgagtgccccatcgagtccagccctctcttcctcttgcacaaaaagggaaaaaatctgtccaaacccaaggcgtcacagaataaaaaaggtggcaagtcaaaggatgcgccatcctgggaccctgtagccctgaaactgccagagcggaatactcctcggaactctcattgtcacttgtcgaacagccctcgagccatcgagcacgcataccagtatggcggtacggccaacagtcgccaggaatttgagcatctcaagggtgattttggagctaagtcccagttctcaattaggctacgaacgcggtcttctcatggcatgattttctatgttagtgatcaggaagagaacgattttatgaccttattcctagcccacggtcggctggtatatatgttcaacgttggccacaaaaagctcaaaatccgatctcaggaaaaatataatgacggactctggcatgacgtaatttttattcgggaacgcagctccggcaggctagttatagatggactgagagtcttggaggagtcgctgcccccaaccgaggccacctggaagattaaggggccaatatacttgggcggagtggccccaggtaaggccgtgaagaatgtacagataaacagcatatactctttctcaggatgcctcagcaacctccagctaaacggcgcaagcatcaccagcgcgagccaaacgttcagcgttacgccttgctttgaaggacccatggaaaccggaacatatttctccactgaggggggatatgtagtgctcgacgagtccttcaacatcggtctcaaattcgaaatcgcatttgaggtccgtcccagatcttcttcaggtactcttgtccacggtcattccgtgaacggagaatatctcaacgtgcacatgaagaacggacaggtcatagtgaaagttaacaatggaataagagacttctcgacctccgtgacgcccaagcaaagcctgtgcgatggccgttggcaccgaatcacagttatacgagattcaaatgtcgtgcagctcgatgtagactcagaggtcaaccatgtcgttggacccctgaaccctaaacccatagatcacagggagcccgtctttgtgggaggcgttccggagagcctcttgactccgaggttagcaccaagtaaacctttcactggatgcatccgccacttcgttatcgatggtcaccccgttagcttctcaaaagccgctcttgtctccggagctgtaagcatcaacagctgcccagccgcata

SEQ ID NO: 228088 - DNA, 5451 bp, Artificial Sequence
  Description of Artificial Sequence: Synthetic coding sequence
atggctttgtcttccgcttggcgctctgtgctgcccttatggctcctctggtcagccgcttgcagtagagcggcatctggagacgacaatgccttcccatttgacatcgagggctccagtgcggtgggacggcaggacccaccagaaactagtgagccacgcgtggctctgggaagactaccaccagcagctgagaagtgtaatgcagggtttttccacacgttaagcggtgaatgtgtcccatgcgattgtaacgggaatagcaacgaatgcctagatggtagtggatattgtgttcattgtcagagaaataccaccggagagcactgtgaaaaatgtttagatggctacataggcgattccatcaggggagcaccacagttttgccagccctgcccttgccccctgccccatctcgcaaattttgccgaaagctgctatcgaaaaaatggggctgtgcgctgtatctgcaacgagaactacgctggtcccaactgcgaacgttgcgctcccggatattacggtaatccactgctgattggctctacatgcaagaagtgtgattgtagtggaaacagcgatcctaacttgatctttgaggactgtgacgaagtcaccggacagtgccgcaattgtctccgcaacacgacaggcttcaagtgtgaacggtgcgcccctggctattatggggacgccaggattgctaagaactgtgcagtgtgtaactgtggaggcggtccctgcgactctgtgaccggggaatgcttggaggagggttttgagccccctacagggtgtgataagtgtgtctgggacttaaccgatgccttgagacttgcagccctcagtatcgaagagggaaaaagtggggttctctccgtgtcttcaggagccgcagcccaccgccacgtcaacgagatcaacgccacaatctacctgttaaaaacaaagctgtcggaacgtgagaatcagtacgccctccggaagatacagattaacaacgcggagaacacaatgaaatcgctgctttcagatgtagaagagctggtcgagaaggaaaatcaagccagccggaaagggcagctggtgcagaaagagagcatggatacaattaatcacgcttctcagctagtggaacaggcccacgacatgcgggacaagattcaggagatcaacaataaaatgctgtattacggcgaggagcatgagctctcgcccaaagaaatttccgagaaactcgttctcgcacagaaaatgctggaggagatccgctcccgccagcctttcttcactcagagagagcttgttgacgaggaggccgacgaagcctacgagctcctgtctcaggccgagagctggcaacggctgcacaacgagacccgcacgttatttccagtagttctggaacagctggatgattataatgccaagctatccgatctccaggaagcgctagatcaggccttgaattatgtccgggacgcggaagatatgaaccgcgcaaccgcagcgaggcagcgagatcatgagaagcagcaagaacgggttagggagcagatggaagtcgttaatatgagtttaagcacttctgcggacagcctgactaccccacgtttgacccttagcgagttagacgatattatcaagaacgcatcgggcatctatgccgagatcgatggggctaagtctgagctacaagtcaagctttccaatctatccaacctgagtcacgacctagtgcaggaggccattgaccacgctcaggaccttcagcaggaggctaacgaactcagtcgcaagctgcatagcagcgacatgaacggcctcgtccagaaagcactggacgccagcaatgtctacgaaaatatcgttaactatgtgtctgaggccaatgagaccgccgagttcgcgttaaatactactgaccggatctacgacgctgtcagcggcattgatacccagataatttaccataaggatgagtccgaaaatcttctgaatcaggccagagagttacaggctaaggctgaatcctcatctgacgaggccgtcgctgataccagtaggcgagtcggtggcgctctcgctagaaagagtgccctcaagacccggcttagtgatgccgttaagcagctgcaggccgctgagcggggagacgcccagcagaggctgggccaaagcagattaatcaccgaggaagcaaatcgcactacgatggaggtacagcaagccaccgcccctatggcaaataatctgaccaactggtcccagaacctacagcattttgactccagcgcttataacaccgctgtcaattctgcacgagatgccgtacgcaatttgactgaggttgtgccccaacttctcgaccagcttcgcaccgtagaacagaagcggcctgccagcaacgtctccgccagcatacaaagaatccgcgagctcattgctcaaaccaggtcagtcgcatctaaaattcaagtgagtatgatgttcgatggacaatcagctgttgaagttcatagccgaacatctatggatgatctaaaggcttttactagcctgagtctttacatgaagccgcctgttaagagacctgagctgaccgaaacagcagatcaattcatcctttacttaggctcaaaaaatgccaagaaagagtacatgggtctcgccatcaagaatgataacctggtttatgtatacaacctaggaactaaggacgtggagattcctctcgactccaaacctgtgtcgtcctggccagcttatttttctatcgtaaaaatcgagagagttggaaagcacggcaaggtcttcctgacagtgccgtccctcagctcgaccgccgaggagaagttcataaagaaaggggagttcagtggcgatgactccttgctcgaccttgatccggaggacaccgtgttctacgtcggcggtgtaccctcaaacttcaagctacccacctcgctcaatctccccggattcgtgggatgcttggaacttgcaactctgaacaatgacgtcatctccctttacaacttcaagcacatctataacatggatccttctacctccgtgccctgtgcccgtgacaaactcgcatttacccagagcagagcggcttcttatttctttgatggctctggttacgccgttgtgcgcgatatcactcgtcgaggtaaattcggccaggttactcggttcgatatcgaagtcaggactcctgcggacaacgggcttattctgcttatggtcaatgggagtatgttttttagactcgaaatgcggaatggatatctacatgttttctacgacttcggcttctctggcggaccggtacacctcgaggacaccctgaagaaagcgcagatcaatgacgccaagtaccatgagatcagcatcatctatcacaatgataagaaaatgatcctggtagtagatagaaggcatgtcaagtcaatggataacgaaaaaatgaagatacccttcacagacatctacatcggtggagcacctcctgagatcttgcagtccagggccttacgggcacacctaccactcgatattaacttcaggggttgtatgaaaggctttcagttccagaaaaaggactttaatctgctggagcagactgagacactcggggtcggctacgggtgcccggaggattcacttatttcacggagagcctattttaatggtcagtccttcattgccagcatacagaaaattagttttttcgatggctttgagggcggattcaatttccggacgctccagcccaatggcctgcttttctattacgcgagcggcagcgatgtcttctccattagcctggataacggaacagtgattatggacgtgaagggtatcaaagtacagagcgtagacaaacagtacaacgacggcctgtcccacttcgtgattagttctgtttcacccacgagatacgaacttatagttgataagagcagagtcggcagtaagaatccaacaaagggcaagatagaacaaactcaagctagcgagaagaagttttatttcggtggatccccaattagcgcgcaatacgcgaatttcacaggttgtatatctaacgcatactttaccagggtggacagggatgtcgaagtggaggactttcaaagatatacagaaaaggtgcacactagcctgtacgagtgtcccattgagagctccccgctgttcctgctccacaaaaagggaaaaaacctgtctaagccaaaggccagccagaacaagaagggaggaaagtctaaagatgcaccttcctgggacccagtagccctgaagctccctgagaggaataccccacgtaattcacactgccacctaagtaattctccgagggctatagaacatgcataccagtatggaggcaccgcaaattctcgacaagaattcgagcacttgaagggcgactttggcgcaaagagccaattttccattaggctccggactcgctcctcacatggtatgattttctacgtttccgaccaagaggaaaatgactttatgactctcttcctggcgcacggtagactggtttatatgtttaacgtggggcataagaagctcaagatccgctcccaagagaagtacaacgacgggctgtggcacgacgtgatattcattagggaacggagtagcggccgactggtgattgatgggcttagagtgctggaggagagtctcccacccacagaagccacctggaaaattaaaggccctatttatttggggggagtcgctcccggaaaagccgtcaagaacgtgcagataaatagtatttactctttctctggttgcctctctaacctgcagctcaacggcgcttccatcacctcagcttcacagacctttagcgtgacaccctgtttcgaaggcccaatggagaccggcacgtactttagcaccgaagggggatatgtggttcttgatgaaagcttcaacattggattgaaattcgaaatcgcgttcgaggtcagacctcgcagctcctccgggaccttggttcatggccattccgtgaatggagagtatctgaatgtgcatatgaaaaacggtcaggtgattgtaaaggtcaataacggcattagggatttctccacgtctgtcactccaaagcagtctctctgcgatggccgatggcaccggataacagtgattcgggacagtaacgtggtccagctcgatgtggatagcgaagtgaatcatgtggtgggccctctcaatccaaaacctattgaccaccgtgagcctgtttttgtggggggagttcccgagtcactcctcaccccaagactagccccaagtaagccatttacgggctgtattaggcacttcgtcattgacgggcatcctgttagcttttctaaagccgcactcgtgagcggggcagtctccatcaatagttgtccagccgcatag

SEQ ID NO: 228089 - DNA, 390 bp, Artificial Sequence
  Description of Artificial Sequence: Synthetic coding sequence
atggctttaagcagcgcatggcgtagcgtgcttcccttgtggctgctgtggagtgcggcatgctctcgtgccgcatcaggggacgacaacgcctttcctttcgacattgaggggtccagcgcagtgggacggcaggaccccccagaaacatcagagccccgtgtagctcttgggagactcccacccgctgccgaaaagtgtaacgctggattctttcacaccctgagtggagaatgcgtgccttgcgattgcaatgggaactcaaacgaatgtctggatggctctggctactgtgtgactacagacggggaggaccctggtttttcagcttctgcactgagcttcattttatcttcacaaggcgcaagagaagcccgagcgccaacatag

SEQ ID NO: 228090 - DNA, 363 bp, Artificial Sequence
  Description of Artificial Sequence: Synthetic coding sequence
atggcgctgtcgagtgcctggcgctcagttctgcctttgtggctgctgtggtctgcagcgtgcagtcgcgctgcatcgggcgatgataacgcctttcctttcgacatcgaaggtagcagcgctgtcggcaggcaggatcccccagagacttccgagcccagagtggccctgggcaggttacctccagccgcagaggttcagtgtccatgccactgccatcctgccggagcccctgcccctccacgagcggtaccccactcgtcttttagcttgtcccctcccctgtcatcaccccagtgtctggagagctttacttgggctcgttctgtgaggaagctggagatcaagtcattccccctgtag

SEQ ID NO: 228091 - DNA, 1125 bp, Artificial Sequence
  Description of Artificial Sequence: Synthetic coding sequence
atggctttgtcctccgcctggcgtagcgttctccctctttggcttctctggagtgcggcatgctctcgggcagccagtggcgatgacaatgccttccctttcgatatagaggggtctagcgccgtcggaagacaggatccgcctgagactagcgagcctcgagtggcgctcggcagattaccccctgcagcagaaaagtgtaacgccggtttcttccacaccctgagtggcgagtgcgtgccgtgtgactgtaatggaaactcgaatgagtgcctcgacggcagtggctattgcgtacactgccagcgcaacaccacaggcgaacactgcgaaaagtgtttagatggctatataggagactcgatccggggagctccgcaattttgtcagccttgcccatgcccactgccccacttggcaaacttcgcagaatcttgctatcggaagaatggagcggtgcgctgtatttgcaatgagaactacgctggaccaaactgcgagagatgcgcgcctggatactacgggaatccattactgattgggtctacatgtaagaagtgtgattgctcgggaaacagtgacccaaacctgatttttgaggattgcgatgaggtaaccgggcagtgtcgcaactgcttaagaaacactacgggattcaagtgcgagcgatgtgcccctggctactatggcgacgctaggatcgccaaaaattgcgctgtgtgtaactgcggcggaggtccttgtgacagcgtcaccggggagtgcttggaagagggatttgaaccaccgactgggatggactgcccgaccatcagctgcgacaagtgtgtttgggaccttaccgatgcactcaggctagccgcactgagcatcgaagaggggaagagcggcgtgctaagtgtttccagcggggcagctgcccaccgtcacgtgaatgagatcaatgccaccatttatctgcttaaaactaagttatctgaaagggagaatcagtatgcactccgcaaaatacagatcaataacgccgaaaacactatgaaatctcttttgagcgacgtagaagagctggtcgaaaagcattggaataagcccaggcgcagactcgaattgcaggagggggtttag

SEQ ID NO: 228092 - DNA, 363 bp, Artificial Sequence
  Description of Artificial Sequence: Synthetic coding sequence
atggccctgagctccgcttggaggtccgtcctgccgctctggttgttgtggtcagccgcttgttccagggccgcttctggcgacgataacgcatttccattcgatatcgaagggtcatcagcggtcggcaggcaggatcccccagaaacgagtgagcctcgggtcgccctcggaagacttccccctgcagcggaggttcagtgcccatgtcattgccaccctgctggcgctcctgcgcctccccgagccgtacctcacagctcattttctctctctccgccattgtcttcgcctcagtgtctggaatcctttacctgggcccgaagtgtcaggaaactggagataaaaagctttcccctttag

SEQ ID NO: 228093 - DNA, 324 bp, Artificial Sequence
  Description of Artificial Sequence: Synthetic coding sequence
atggcccttagtagcgcctggagaagtgtgctgcctctctggctcctgtggagcgccgcatgtagtcgcgctgcatcaggagatgacaacgcttttccgtttgatatcgagggctccagtgctgtggggagacaagaccctccagaaacctcagagcctcgtgtggctttgggtcggctaccacccgctgcagagaagtgcaatgcagggttcttccacaccctcagcggggagtgcgtcccgtgtgactgcaatgggaacagtaacgagtgtctcgatggctctgggtactgcgtccactgtcagcgcaacacaaccggctag

SEQ ID NO: 228094 - DNA, 996 bp, Artificial Sequence
  Description of Artificial Sequence: Synthetic coding sequence
atggccctgagcagcgcctggcgatccgtactgccattgtggcttctctggtctgcggcatgcagccgcgcagcttccggtgacgacaatgcatttcccttcgacatcgaaggctcaagcgcagtaggcagacaggacccccctgaaacttccgaacctcgtgtggccctggggaggctcccacctgccgcagagaaatgcaacgccggtttcttccacaccttgagtggcgagtgtgttccctgtgattgtaacgggaactcaaacgaatgtctagatgggtccggctactgcgtgcattgccagcggaacacgaccggagagcactgtgaaaagtgcctcgatgggtacattggcgatagtattaggggcgcaccccagttctgtcagccatgtccttgccccctcccccatctcgcaaattttgccgaatcatgctaccgtaagaacggcgcagtaaggtgcatctgcaacgagaactatgcaggccctaactgtgaaaggtgcgccccaggttattacggcaatccgctactcattggctcgacctgtaagaaatgcgactgcagcgggaattccgatccaaatctcatcttcgaagactgcgacgaggttactggacagtgcaggaattgcttgaggaataccaccggttttaagtgtgaacgatgtgcgcctgggtactacggagacgccagaattgccaaaaattgcgctgtgtgtaactgcggcggaggcccatgtgactccgtgaccggcgagtgcctcgaggagggctttgagcctcccaccggcatggactgtccaaccatctcatgcgacaaatgcgtgtgggatcttaccgatgctctgagactggcagctctatccattgaagaggggaagagcggtgttttgtccgtctcttccggcgcagcagcacatcgacatgttaatgaaataaacgcaactatatatcttctaaagactaaattgtccgagcgagagaatcagtag

SEQ ID NO: 228095 - DNA, 246 bp, Artificial Sequence
  Description of Artificial Sequence: Synthetic coding sequence
atggccctatcctctgcgtggcggtctgtgctgccactttggctgctgtggagtgcagcatgctcaagggctgcgtcaggggatgataatgccttcccctttgacatcgaaggctcttccgccgtggggcgtcaagacccacctgaaactagtgagccacgcgtcgccctgggtcgcttgccccctgccgcagagaagtgcaatgctgggttctttcatacactcagcggtgagtgcgtcccatag

SEQ ID NO: 228096 - DNA, 5450 bp, Artificial Sequence
  Description of Artificial Sequence: Synthetic coding sequence
atggcactatcatcagcttggagaagcgtgttaccactgtggttactgtggtccgcggcttgttcccgcgctgcttctggggatgacaacgctttccccttcgatattgaagggagcagcgcagtaggtagacaagatcctcccgaaacgtccgagcctcgcgtggctctggggagactgcctccagcggctgaaaagtgtaacgcaggtttttttcacactctttcaggcgaatgcgtgccctgcgactgtaacggtaattccaacgaatgcctggacgggagcggctattgcgtgcactgccagcggaacacgaccggggagcattgcgaaaagtgccttgatggttatattggcgactcaatccgcggagccccacagttttgccagccctgtccgtgtcctctgccccacctggctaacttcgcagagtcttgctaccgcaaaaatggcgctgtcagatgcatttgtaatgagaactatgccggtccaaactgcgagagatgcgcccctggttactatggaaaccctttgctgattggaagcacttgtaagaagtgcgactgctcaggaaactcggaccctaatcttatatttgaggactgcgatgaggtgacaggtcaatgtcgcaactgtctgcgaaataccacaggttttaagtgtgagcggtgtgccccaggatattacggggatgctcggattgccaaaaattgcgctgtctgcaattgtggtggaggaccctgcgactctgttactggcgagtgtctggaggagggatttgaacccccaaccggctgtgacaagtgtgtctgggacctaactgacgccctccggctggcggctctaagcatcgaggagggtaagtcaggtgtcttgtccgtcagtagcggcgcagccgcacacaggcacgtcaatgagattaacgccaccatttatctgttaaagacaaaactgagcgaaagggaaaatcagtacgctctgcggaagatccagatcaacaacgcagagaatacaatgaagtcgttactcagtgatgttgaagagctggtggagaaggaaaatcaggctagccggaagggccagcttgtgcaaaaggaaagtatggatacaatcaaccacgccagtcagcttgtcgagcaggcccacgatatgagggataagatacaggagattaacaataaaatgctgtactatggcgaggaacatgaactttcaccaaaagagatctccgagaagctcgtactggcccagaagatgctggaggaaatacgatccaggcagccattttttacccaaagggaactagtggatgaggaagctgatgaagcctacgaactgctcagccaagcagagagttggcagaggctgcacaacgaaaccaggactctgtttcctgtggtgctggaacagcttgatgactacaatgcaaagctcagcgacctacaggaagccttggatcaggccctgaactatgttcgcgacgctgaggatatgaacagggcaactgccgcacgtcagagagatcacgaaaaacaacaagagagagttcgcgaacaaatggaggtggttaacatgtccctgagcactagtgccgactcccttacaacgccaagactgacgctcagcgaacttgacgatattatcaaaaacgcctcaggtatatatgcagagattgacggggctaagtcggagctccaggtgaaacttagcaacctttctaacctgtcacacgatctcgttcaggaggctatcgatcacgcacaagatctgcagcaggaggccaacgagctgtctcggaaacttcacagctcggacatgaacgggctggtgcagaaggctcttgacgcgtcaaatgtgtatgagaatatcgtaaactatgttagcgaagccaatgagaccgccgaatttgcattaaacacaacggataggatctatgacgctgtgagtgggattgacacgcagattatctaccacaaggacgagagtgagaacctgctgaatcaggctagagagctacaagcgaaggccgaaagcagcagcgatgaggcagtggcggacacctcaaggcgggtgggcggtgctctggccagaaagtcagcacttaaaacccgcctgtctgacgccgtcaagcaactgcaggccgcagagcgaggtgacgcccagcaacggttgggccaatcccgactgatcactgaagaagcgaatagaaccacgatggaagtgcagcaggccaccgcaccgatggctaataacctgactaattggtcacaaaaccttcagcactttgacagctctgcatacaacaccgccgttaattccgcgagagatgcagtccggaacctgactgaagttgttccccagctgttggatcagttgcggaccgtggagcagaagcggccagccagtaatgtcagtgcaagcatacagaggattagggagctgatcgcccagacccgtagcgtggcgtcaaagatacaggtcagtatgatgttcgatggacagagtgcggtcgaggtccactcccggacgtctatggatgacctgaaagcctttacatcgctttctttgtatatgaagcccccagtaaaaagaccagaactaactgagacagcggaccaattcatactctatttggggtcaaagaacgctaagaaggagtacatgggactggctattaagaacgataacctggtgtacgtgtacaatcttggcacgaaggacgtggagatcccacttgatagcaagccggttagttcatggccggcttacttcagcattgttaagatagagagagttggtaagcacggaaaggtcttcctcaccgtccccagcctgagttccacggctgaagaaaaattcattaagaaaggggagttctcaggggacgactccctcctggatctggaccctgaggataccgtgttctatgtgggcggagttccaagcaacttcaaactcccaaccagcttgaatttgccaggtttcgtaggatgcctcgagctcgccaccttaaataatgatgtaatcagcctttacaacttcaagcacatctacaacatggatcccagcaccagcgtgccatgtgcgagagataagctcgccttcacacagtccagagctgcatcctatttctttgacggatccggttatgcagtggtgcgagatatcacccgcagagggaagttcgggcaggtaacaagatttgacatcgaagtcagaacaccagccgacaacggccttatactgctaatggttaatggtagtatgtttttccgcctggagatgcggaatgggtacctccacgtcttttacgattttggattttcaggcggtccggttcacctggaggacacccttaaaaaagcccagatcaacgatgcaaagtatcatgagatttccattatctaccacaacgataaaaaaatgatccttgttgtcgatcggcgtcatgtgaagtccatggataacgaaaaaatgaaaatcccgttcactgatatatatatcggcggtgctccgccagaaatcctgcaatcacgggcactgagggcccacttgcccctggacatcaatttcagaggttgcatgaaggggttccagttccagaaaaaagacttcaaccttctggaacagacagaaaccttgggggttggatatggttgccctgaagactctctgatttcaagacgcgcttacttcaatggccagagttttattgcgagcatccagaagatcagtttcttcgacggattcgagggcggttttaatttcagaactctccagcctaacgggctgttgttctactatgcgtcagggagtgatgtcttttctatcagcctggataatggcactgtcattatggatgtgaaagggatcaaggtgcagtcagtggacaagcagtataacgatggactgtcacactttgtgatctctagtgtgtcccctacaagatacgagctcattgtcgacaagtcccgcgtgggaagcaaaaatcccacaaaaggtaagatcgagcagacccaggcatccgaaaagaaattttatttcgggggttcgccgatctcagctcagtacgccaatttcactggttgcatctccaatgcctattttactcgcgttgatcgcgatgtggaagtcgaagacttccagcggtatacagaaaaggtgcacacctctctgtatgagtgtccaattgaatcttccccattgttcctgctccacaaaaagggcaagaacctgtccaagccaaaagccagccaaaacaagaagggcggaaaatccaaagatgctccttcatgggatcctgtggctctaaagctccccgaacgcaacactcccagaaattcacattgccacctcagcaacagccctcgggcaatcgagcacgcttatcagtatggcggaactgccaacagtagacaggagttcgagcacctgaaaggggattttggcgctaaatctcagttttccatacgactcaggactagatcttcacacgggatgattttctacgtgagcgatcaggaggagaacgactttatgacgctcttcttagcgcatggccgacttgtctatatgtttaatgtggggcacaaaaaactgaaaatcagaagccaagaaaagtacaatgatggtctatggcacgatgttatctttattagggaacgatcatcaggtcgcctggtcatcgacgggctccgggttctcgaggaatcgctgccgccaaccgaagccacttggaaaattaaaggacccatttatctgggaggagtggctccaggcaaagcggtgaagaacgtgcagattaactccatctattctttttcgggatgtctgtctaacctgcagctgaatggcgcaagtattacttcggccagtcagactttctccgtgacaccctgctttgaaggtccaatggaaaccggaacttacttttctactgaaggaggatatgttgttcttgacgagagttttaatatcggtttgaaatttgaaatcgccttcgaggtccgcccacggtcatcttccggtaccctggtccacggccactcagttaacggtgagtatctcaatgtccatatgaagaacggccaggttattgtcaaagtgaacaacggaatacgggatttttctacttccgtgacacccaaacagagtctctgcgacgggcgatggcatagaattacagtgatacgagactccaacgttgtccaactagatgtagacagcgaggtaaatcatgtggttggcccactaaacccaaagcctatcgatcatagggaacccgtcttcgtaggtggcgtgcctgagtccctgcttacccccaggctggctccttcgaaaccgttcactggctgtattcgacactttgtgattgatggccatccagtcagtttctcaaaggctgcactagtttctggggcagtcagcatcaactcttgccctgctgcata

SEQ ID NO: 228097 - DNA, 975 bp, Artificial Sequence
  Description of Artificial Sequence: Synthetic coding sequence
atggcactttctagcgcttggcggtcagtgttgcctctgtggctattatggagcgccgcatgctcccgggcagcctccggcgatgacaacgctttccctttcgacatcgaagggtcctccgctgtgggcaggcaggaccctcctgaaacttcggagccaagagtggcattggggaggcttccacctgcggcagagaaatgtaacgcaggattctttcacacgttgtctggggagtgtgtgccttgcgactgtaacggcaactcaaacgagtgtctagatggttcaggttactgtgtgcactgccaacgcaacacaactggggagcactgtgagaaatgtttagatggatacatcggcgactccattcgcggagcgccacagttttgccaaccgtgcccatgcccactcccccacctcgccaattttgctgaatcctgctatcgcaagaacggcgcagtacgctgcatctgcaatgagaactatgctggtccgaattgtgaacgctgcgctcctgggtactatggaaatcccctcttgataggctccacttgcaaaaagtgcgattgtagtggcaatagcgacccaaatctaatttttgaggactgcgacgaagtgaccggccagtgccgtaactgcctgagaaacaccactggcttcaagtgcgagagatgcgctcccggatattacggcgacgccaggattgctaagaattgtgcagtgtgcaattgcggcggtggtccttgcgactcagtcacgggggagtgcctggaagaaggattcgaacctccgacagggtgcgataaatgcgtatgggatctcacggatgcactccggctcgccgctctgagtattgaggaaggcaagtcaggcgtgttgtcggtttcttccggagccgctgcccatcggcatgtcaatgaaattaatgccacaatctatttgctgaaaaagacaaagcaaaagaataacaaaaaatag

SEQ ID NO: 228098 - DNA, 11088 bp, Artificial Sequence
  Description of Artificial Sequence: Synthetic coding sequence
atggcaaaacgattatgcgccggaagcgccttgtgcgtgcgagggccacggggtccggctccactcctcctggttggcctcgctttgcttggcgctgcccgagccagagaggaggcaggcggagggttctccttacatcccccatactttaatcttgctgaaggtgccagaatagcagcatcagcgacatgcggggaggaggcgccagcccgtggatcccctaggcctacggaagacctctattgtaaattagtcggagggccagtggcagggggagaccccaatcagactattcggggacaatactgcgacatctgtactgcagcaaattctaataaggcacatcctgcttcaaacgccatcgacgggaccgaacgatggtggcagtcaccgccactgtcacggggtctggaatacaacgaggtgaacgtgacacttgacttaggacaggtgtttcacgtggcctacgtccttattaaatttgctaatagcccgaggcctgacctatgggtgctggagagatctatggactttggacgcacttatcaaccatggcaattttttgcgtccagcaagagagattgtctcgagaggtttggtcctcagacacttgagcgcataactagagatgacgcagccatctgcaccactgaatacagtagaatcgtcccactcgaaaatggagaaatagttgtgagcctggttaatggacggcctggcgcaatgaattttagctacagcccgctgctacgagagtttacaaaagcaacaaatgtcaggctgcgtttcttgagaaccaataccttgctgggtcatctgatgggcaaagctcttcgtgaccctactgtaactagacgctactattatagcataaaagacatctccatcggaggcagatgcgtctgccatggtcatgcggacgcctgtgatgctaaggacccgacagaccctttcagactgcaatgtacctgccaacacaatacgtgcgggggaacatgcgatagatgctgccctggcttcaaccaacaaccatggaaaccagccactgccaattctgctaatgaatgtcagtcctgtaactgttacggacatgcaactgattgttactatgaccccgaggtggataggcgacgcgcatcccagagtctggacggtacgtaccaagggggtggcgtgtgtatagactgtcaacaccataccactggcgtgaattgcgagaggtgcctccctggcttttataggagcccaaatcatcctcttgactcacctcacgtctgtagacggtgcaattgcgagtcagactttacagacgggacctgcgaggatctcaccggaagatgctactgtcgtccgaatttcagtggcgaaaggtgcgacgtttgcgcggaaggtttcactgggtttcctagttgctatccaaccccttcatcatccaacgacactcgggaacaggttttacccgcaggacaaatagtgaactgcgattgctccgctgcgggtacccaaggcaacgcctgccggaaagatccccgtgtgggcagatgcctgtgtaaaccgaatttccagggcacccattgcgaattgtgtgcgcctgggttctatggccctggctgtcagccatgtcaatgtagctctcctggtgttgctgatgacagatgtgaccccgacacaggtcaatgcaggtgccgtgtcggttttgaaggagccacatgcgaccgttgtgctccgggatatttccatttccccctttgtcaactgtgtggatgttcacctgccggaactcttccagagggatgtgatgaagctggtcgatgtctgtgccagccagagttcgctggaccgcactgcgatcggtgtagacccggataccacgggttcccaaattgtcaggcctgcacctgtgaccctaggggagctcttgaccagctgtgcggcgctgggggactctgcaggtgccgcccaggatacactggaactgcctgtcaggagtgcagtcccggttttcatgggtttccctcttgtgtgccctgtcactgtagcgcagaaggttctctgcacgcagcttgtgatccacgatctggacagtgttcttgtagaccacgggtgaccggtcttaggtgtgacacatgcgtgcccggagcgtacaacttcccatactgcgaggccggttcctgtcaccccgcaggattggcccctgttgacccggcactgccagaggcccaagtcccatgcatgtgtcgggctcacgtggagggcccttcctgtgaccgctgcaagcccggattttgggggctctctccctctaatccggaagggtgcacacgttgctcctgcgacctacgcggaacacttggcggtgtggccgagtgccagcctgggaccgggcagtgcttctgcaaaccccatgtgtgcggacaggcgtgtgcatcgtgtaaggacggtttcttcgggctcgatcaggccgattacttcgggtgtaggagctgtcgctgtgacattggaggggctctgggacaatcttgcgagccaagaaccggcgtatgcaggtgtcgccctaacactcagggcccaacctgctccgaacccgcaagagaccattacctgcccgacctgcaccacttaagactagagctcgaggaagcagctaccccggagggccacgccgttaggtttgggttcaaccccttagaatttgagaacttcagctggcggggatacgcccagatggctccggtacagcctaggatcgtagccaggctcaacctgacttcccccgatttgttttggctggtgttccggtacgtgaatcgcggagccatgtccgtgagtgggcgagtgagtgttagggaagaggggagatcggctacctgtgctaactgcacagctcagtctcagcccgtggcttttccccctagtacggaacccgctttcatcacggtaccccaaagggggttcggcgagccttttgtgttgaatccgggtacatgggctctgcgcgtggaggctgagggcgtcctccttgactacgttgtgttgcttccgtccgcgtattacgaggctgcacttctccagcttcgagtgactgaagcctgcacctacaggccaagcgcccaacagagtggggataactgcctcttatatactcacctgcctcttgatggtttccccagtgccgcaggtctggaagccctctgtaggcaggacaattcactgccccgtccatgccccacagaacaactcagcccttcacatcccccactgatcacatgtacaggcagcgatgtcgatgtgcaactccaggtcgccgtgccccaacccggacgatatgctttagtcgttgagtacgccaatgaagacgcaagacaggaagttggcgtggctgtacacacgccacagagggctccacagcaaggactcctttccctgcatccctgcctgtattcaacactctgtcgcggtaccgcgagggatacacaggaccacttggctgtgtttcatttggatagcgaagcctcagtgagattaacagctgaacaggcccgtttctttctccacggcgttaccttggttcccatcgaggaattttcacctgagttcgtggaacctagagtctcctgtatttctagccacggcgcttttggacctaacagtgcagcatgtctgcctagccgcttccccaagcctcctcagcctataattcttcgggattgccaggtgattcccctgcctcctggactcccactaactcatgcccaagatctcacccccgcaatgtcacccgctggaccacgcccacgcccacccactgctgtagacccagacgccgagcctacacttctacgcgagccacaggctacagttgtttttacaacccacgtgccaacgttgggacgttacgcttttctgctgcatggataccagccagcccatccgacttttccagtggaggtcctgatcaacgccggacgcgtgtggcaaggtcacgccaacgcttccttctgtccacatggttacggctgcagaactttggtggtttgtgagggacaggctctgcttgacgtgactcattccgaactgacagtgacagtcagggtccctaaaggaagatggctctggctcgattacgtcttagtggtccccgagaatgtgtactctttcggctatctcagggaggagcctctcgataagtcctacgacttcatctcgcactgcgccgctcaaggttaccatataagtccatcctccagttcgttgttttgccgcaacgcagctgcctctttatcactattctacaataacggcgcacgaccctgtggttgccacgaggtcggcgctacagggcctacatgcgaaccattcgggggacagtgcccctgtcacgcccatgttataggccgtgactgtagtaggtgtgccacaggatattggggtttcccaaactgccggccttgcgactgcggcgcacgcctgtgtgacgagttgactggtcagtgcatctgtcccccacgtacaatcccaccagactgcctcctgtgccagccccaaaccttcggctgtcaccctctggttggctgtgaagaatgtaactgttccggccctgggattcaggaattaacagaccctacgtgtgatactgactctggacagtgtaaatgtcggccaaatgtgactgggaggagatgcgatacttgttctcctggattccacgggtacccgcgatgtcgcccttgtgactgtcatgaggcaggaacggccccaggagtatgcgacccgctgacgggccagtgctactgcaaggaaaatgtgcagggtccaaaatgtgaccagtgtagcctgggcaccttctcacttgatgccgcaaatccgaaggggtgcacgagatgcttctgtttcggggcaacagaacgctgtcgctcaagctcttatacccgccaggaattcgtggatatggagggatgggttctcctctcaactgacaggcaggtggtgcctcatgagagacagcctggtactgagatgctacgcgctgatctcaggcacgtgcctgaagccgtgccagaggcttttcccgaactctattggcaagctccaccaagctacctcggtgaccgagtgtcatcgtatggaggaacactccggtatgagctgcattccgaaacccagaggggcgacgtgtttgtgcctatggaaagtcggccagacgtggtgctgcagggaaatcagatgtccatcaccttcctcgagcccgcttaccccacaccaggacacgtccatcgcggacaattgcaactcgtggagggaaacttccggcacacggaaactaggaacaccgtgtccagagaggagctaatgatggtgctcgcttccctagagcaactccaaatccgcgcattgttctcacagatctcatctgccgtgttcctcaggagggttgctcttgaagtcgcctcaccagctgggcagggagccctggccagcaatgtggagttatgtctgtgtccagcctcttaccgcggagattcctgccaggagtgcgctccaggcttctacagagatgtgaaaggattgttcctggggaggtgtgtgccttgccagtgccatggacacagcgaccgttgtctgccagggtctggggtgtgtgtggactgtcagcataacacagagggagcccattgtgagagatgtcaagccggttttgtgagctccagagatgatccatccgccccttgcgtctcctgtccttgtccattaagtgtgcctagtaataattttgcagaaggttgtgtactgaggggaggacgcacccagtgtttgtgcaagccagggtatgccggagccagctgcgaacgatgcgcacctggcttttttggaaaccctctggtgctgggaagctcctgtcagccctgcgactgcagcggcaatggcgatcccaacttactgttcagcgattgtgatcccctaacgggcgcttgccgaggatgtctgagacacacgacgggcccacggtgcgaaatctgcgctccgggtttctacggcaatgcgttgctacccggaaattgcacccgttgcgactgcactccatgtggcaccgaggcttgcgatccacatagcggccactgtctgtgcaaggctggtgtcacgggtcggaggtgcgataggtgtcaggaaggtcacttcggtttcgatggttgcggtggatgtcgaccttgcgcttgcggcccagcagccgaagggtccgagtgccacccgcaatcgggccagtgtcactgcaggcctggaactatggggcctcagtgccgcgagtgcgctcctggctactggggcctcccagaacagggatgcagacgatgtcagtgtcccggtgggagatgcgacccccacaccgggcgatgcaactgtccaccaggcctgtctggagaaagatgcgatacttgttctcaacaacatcaggtccctgttcccggtgggcctgttggtcacagcatacattgcgaagtatgtgaccactgtgttgttctgctgttggatgacctcgaaagggctggcgcactgctccccgctattcatgagcaactgcgcggtatcaacgccagctctatggcctgggcccgtctccacaggctcaacgcttccatcgccgacctgcagagccagctccgatctccacttggacctagacatgagaccgcccaacagcttgaggtgctggagcaacaatcaacaagtcttgggcaggatgcccgacgactgggtggtcaggccgtcggtacccgggaccaggcgtcacagctgctcgccggaacagaggctacactggggcatgcaaagacgctgcttgctgccattagagccgtagacaggacactatccgagctgatgagccagaccggccacctcggattggccaatgcttccgctccgtccggggagcaactgcttagaacgcttgcagaagtggagcgcctgctgtgggaaatgagggcccgtgacctcggagctccgcaggcggcagccgaggccgaattggctgcggctcagcgattgctcgcccgagttcaggagcagctatcgagtctgtgggaggaaaaccaagcactcgccactcaaacgcgagaccgcctcgcccaacatgaggccggtttaatggatctcagggaggccctgaatagggccgtggatgcaacaagggaggcacaggaactcaactcgcggaatcaagagcgcttggaagaggccttgcaaagaaagcaggagctgtctcgcgataacgcgacgctgcaggcgacactgcacgccgctagagataccctggccagtgtattccggctactccactctcttgaccaagccaaagaggagttggaaaggttggcggcttcactagatggggcacgcaccccgctactacagaggatgcaaacattcagccccgctggttccaaactgagacttgtggaagctgctgaggcccacgcccagcagctcggacagctcgcgctgaacctgtcatccatcattctggatgtcaaccaggacaggctgacgcagcgcgctatagaggcgtctaacgcatacagtcgaatcctgcaggctgtgcaggccgctgaagatgctgctgggcaggcgctgcagcaggctgaccacacttgggcaaccgttgtccggcaggggctggtggatcgcgcacagcagctgctggctaatagcactgccctggaggaggccatgctgcaagagcaacagaggttaggcttagtctgggccgctctccagggtgcaaggacccagctacgcgacgtacgtgctaagaaggaccagctcgaagctcacatacaggctgcacaagctatgcttgctatggatacagacgaaaccagcaaaaagattgcccacgcaaaggcggtggcagccgaggcacaggatacagcgacaagggtgcaatcacagctgcaggccatgcaggagaatgttgagagatggcaagggcaatatgaaggcctcagaggccaagacctgggccaggctgtgctggatgcaggccatagcgtgagcacactggaaaagactcttcctcaactgctagcaaagctgtccatcttagaaaacaggggtgtccacaacgccagtctggccctgtccgcttccatcggccgtgtgagggagctcatcgcccaggccaggggtgcagccagcaaggtgaaggtacccatgaaattcaatggcaggagcggggtgcaactgaggacaccaagggacttggccgacctggctgcttacaccgcactaaagttctatcttcagggtcctgagcctgagcctggacagggcactgaggaccgatttgtgatgtatatgggctcacgccaggctacaggggactacatgggagtgagcttgcgggacaagaaagtgcattgggtgtatcagctcggagaggctggccctgctgtgttgagcattgacgaggacatcggtgaacagtttgcggcagtgagccttgatcgcacgctccagtttggtcatatgtccgttaccgtcgagagacagatgatacaggagacgaagggcgacacagtggcccctggagcagaagggctgttaaaccttaggcccgacgattttgtattctatgtgggtggatatcccagcacttttacccctcctcccttgcttcgtttcccgggttacaggggctgtatcgagatggatacactgaatgaagaagtggtctccctgtataactttgagaggacctttcagctggacacagccgtcgaccgaccatgtgctcgctctaagagcactggagatccctggctgaccgatggcagctatttagatgggactggctttgccaggatttccttcgactcccagatttcaacaaccaaaagatttgaacaagagctgaggctggtttcatacagtggagtactgttttttctgaaacagcagagccaattcctgtgtctggcagtgcaggagggctctttagtccttctgtacgactttggagccggactgaagaaggccgtcccacttcagcctcctcccccactgacctcagccagcaaggctatacaggttttcttattagggggtagtaggaagagggtgctggtcagagtagagcgagcaacagtttactcggtcgaacaggacaacgatcttgaactcgcggacgcctattatctgggaggagtgccccctgaccagctacccccttctctgcgccgtctcttccccaccggaggatctgtccggggatgcgttaaaggtataaaggcgctggggaaatatgttgacctgaaacgcctcaatactacaggagtgtccgccggatgtaccgcagacctcctggttggcagagctatgacctttcacggacatggatttttgcgcctggcactgtccaatgtggcacctctgaccggtaacgtgtattcaggctttggatttcattctgcacaggatagtgccttactctactatagggcttccccagatgggctgtgtcaggtgagccttcagcagggtcgggtgtcactgcagctgctgcgtacggaggttaagacacaagccggtttcgcagacggggcacctcactacgttgccttctattctaacgcaaccggggtgtggttgtacgtggatgaccagctccagcagatgaaacctcaccgaggaccacctcccgaacttcagcctcagcccgaagggccacctcgactgttattaggaggactaccggagtccggaaccatttataatttcagcggatgcatatccaacgtgtttgtgcagaggctgttaggccctcagcgggtcttcgacttgcagcagaacctgggaagtgtcaacgtatccacaggatgcgctcccgctctccaggctcagaccccgggactggggcctcggggactacaggccacggccaggaaagcctcgcgacgctcacgccagcctgccagacaccctgcctgcatgctgccgccacatctgaggacaacccgcgatagctaccagttcggcggaagcttatctagtcacttggagtttgttggaatacttgcacgccatagaaactggcctagcctctccatgcacgtcctgcccagaagctcccgtggccttcttctgtttactgctcggttgagaccgggatctccgagcctggccctgtttctgagcaacggccatttcgtggctcagatggaaggactggggaccaggctgagggcccagtctagacaacgatcgcgccctgggcgttggcacaaagtgtccgttagatgggagaagaatagaatcctgctggtgacagatggggcacgagcttggagccaggaaggacctcaccgtcagcatcaaggcgctgaacaccctcagccacacacattgtttgttggtgggctgcctgcttcttcccacagtagcaaactcccagtcaccgttggattttccggttgtgtcaaacgtctgagactgcatgggaggcctctgggagcacctacaaggatggcaggcgttacaccttgcatcctggggccactggaagcagggttgttcttcccaggcagcggcggagtgattacgctggacctgcccggagccactctgcccgacgtggggctagagctcgaagttcgcccacttgctgtgaccgggcttatcttccatctcggccaagcacgaacccccccatacctgcagctccaagtcacggagaagcaggtgctgctccgcgctgacgatggggctggagaattctcaaccagtgtgaccagaccttccgtcttatgtgacggccagtggcatcgactagctgttatgaagagcggcaacgtcttacgactggaggtcgatgctcagtctaatcacaccgttggccctctgctcgcggcagcagccggagccccagctcctctgtacctaggcggactgcccgagcccatggcagtgcagccatggcctcccgcatactgtggctgcatgcgcaggctggccgtcaaccgatctcctgtcgcaatgaccagaagtgtagaggtacatggcgcagtgggggcttcaggctgccccgcagcttag

SEQ ID NO: 228099 - DNA, 1503 bp, Artificial Sequence
  Description of Artificial Sequence: Synthetic coding sequence
atggcaaagaggttatgtgcaggctccgccctctgcgttcgcggaccccgaggtcctgcgccactgctcttagtggggttggccctgctgggcgctgcacgcgcacgagaggaggccggtggaggcttcagtttacaccccccatattttaacctggccgaaggcgcaaggattgcagccagcgccacctgcggggaagaagctccagccagaggcagcccacgcccaaccgaagacctgtactgtaagctagtcggagggcctgtagcaggaggagaccccaatcagactatccggggtcaatattgtgatatatgtacagcagcaaacagcaataaagcacatccagcgtcgaacgccattgatggtaccgagaggtggtggcaatcacctcccttatcccggggacttgagtataacgaagtcaatgtgacgctcgatctcgggcaagtgttccatgtggcttacgtcctcattaaatttgccaattcaccaaggccagacctttgggtgctcgagcgcagcatggactttggccgtacttaccagccgtggcagtttttcgcttcctcaaaaagagactgtctggaacgattcggtcctcaaaccctcgagcgtatcactcgggatgatgccgctatttgcaccacggaatattctcgcatcgtacccctggagaatggtgagatcgtggtcagtctcgttaatgggaggccgggagccatgaacttcagttactctcccctcctgcgtgagttcacaaaggccaccaacgttcgcctgagatttctgcgtacaaacactctgctgggccaccttatgggcaaagcactgagagaccccaccgtgactcggagatattattactcgataaaagatattagcatcggtgggcgttgtgtgtgtcatggtcacgctgacgcctgtgacgccaaggaccctaccgatccgttcaggctccagtgcacctgccagcacaatacatgcgggggtacctgcgaccgctgttgccctggctttaaccaacagccatggaagcccgcaacagcaaactcagccaatgaatgtcagtcttgcaattgttacgggcacgctaccgattgctactacgaccccgaggtcgacagaaggcgcgcatcccagagcttggacggcacctaccagggagggggagtctgcattgactgtcagcaccatacgaccggcgtgaattgtgagcgatgccttcccggtttctatagatctccgaatcatcccctggattcaccccacgtgtgccgacgctgtaactgtgaaagtgattttaccgacggcacgtgtgaggatctcactgggagatgctactgtaggcccaacttcagcggcgagcggtgcgacgtatgcgccgaaggcttcaccggttttccgtcatgctaccccaccccctcctcgtcaaatgatacgcgggagcaagttctaccagccggacagattgtcacaaacacaaagatctcatgggtttag

SEQ ID NO: 228100 - DNA, 1587 bp, Artificial Sequence
  Description of Artificial Sequence: Synthetic coding sequence
atggccaagagactctgcgctggatcggccctctgtgttcggggacctcgagggccagctcctctactcctggtcggactagccctgttaggcgcagcacgggcaagagaggaagcagggggtggcttctcactccacccgccatattttaacctggctgaaggtgccagaattgctgcctctgcaacgtgtggtgaagaagcccctgcgagaggatcgccccgacctactgaagacctctattgtaagcttgtgggaggaccagtcgcaggcggagatccaaatcagacaattcgcggtcaatattgtgatatttgcactgctgccaattctaataaagctcacccggcttccaacgccatagacgggaccgaaagatggtggcagagcccccctttgagtaggggtttagagtataacgaagtgaacgtgactcttgacctcggccaggttttccatgtggcctacgtattaattaagttcgccaatagccctcgcccagacctatgggttttagagagatccatggatttcggcagaacataccagccgtggcaatttttcgcttcatcaaaacgcgattgtctggaacggtttggtccccagactctggagcggattacccgcgacgatgctgccatatgcacaacagagtacagcagaatagttcccctagagaacggtgagatcgtggtatctctggttaacggtagacctggagccatgaacttttcttatagtcccttgctcagggagtttactaaggccaccaatgttaggcttcgattccttagaaccaatacgctgctgggccatctgatgggcaaggcgcttcgggacccgaccgtgactaggcggtattattactctatcaaggacattagcatcggtggacggtgtgtatgtcacggacacgccgacgcgtgcgatgctaaggatcccacagacccgttccggttacaatgcacgtgtcaacacaacacatgcggcggaacctgcgaccggtgctgccccggtttcaatcagcagccttggaagcctgctaccgcgaattcggccaacgagtgccagtcctgtaattgttacggtcacgcgactgactgttactacgatccggaggtggacagacggagagcttctcagagcctggacggcacataccaggggggaggcgtgtgtattgactgccagcatcacactacaggcgtcaattgcgagcgctgcctccctggcttttatagaagtccaaatcaccccttagacagcccccacgtttgcagacggtgtaattgcgagagcgattttacggacgggacatgtgaagatctcaccggccgatgttactgtcggccaaattttagtggggagcggtgtgacgtctgtgccgaaggcttcactggcttcccttcctgttaccctaccccaagtagctctaatgatacacgggaacaagtgttgccggcaggccagattgttaacggcgttagcctttgcaggcctggctggtcagctgttgcacgatcccgccttacctccacgtctgccagttgggtgcaggcgattttgctgccgcagtcaccggagtag

SEQ ID NO: 228101 - DNA, 2187 bp, Artificial Sequence
  Description of Artificial Sequence: Synthetic coding sequence
atgtgggttacgaaattgctgcccgctctgctcctccagcatgtcttgttacacttgttgttgttgcccattgccattccctacgccgaaggccaacgcaagcggaggaacacaatacatgagttcaaaaaatctgctaagaccacgctaattaaaattgatcccgcactcaagattaagactaagaaagtaaataccgcagaccaatgcgccaatcgttgtaccagaaataagggcctgccattcacctgtaaagcctttgtatttgacaaagcacgaaaacagtgcctttggttcccgttcaattccatgagcagtggagtgaaaaaagagttcggtcacgaatttgatctgtatgagaacaaggattatatccggaactgtatcatcggcaaaggaagaagttataaggggacagtgtccattacaaagtcaggtatcaaatgtcaaccgtggtcaagtatgattccgcacgagcattcttttcttccaagtagctacagagggaaagacctgcaggaaaactattgccgcaaccccaggggtgaggaaggcggtccctggtgttttaccagcaaccccgaagtcaggtatgaggtgtgcgacatccctcaatgttcagaggtagaatgcatgacatgcaatggcgaatcataccgcggtctcatggaccataccgaatccggcaagatctgtcagagatgggaccatcagacaccccacaggcataaattccttccggaaaggtatccagataagggattcgacgacaactattgtagaaaccctgacggacagccgcgtccatggtgctacaccctggatccccacaccaggtgggagtactgtgcaatcaaaacgtgcgctgacaatacaatgaacgataccgatgttcccctggaaacaactgagtgtatccagggccaaggagaggggtacagaggaactgtcaatactatttggaacggaatcccatgtcagagatgggactctcaatacccgcatgagcatgatatgacacccgaaaattttaagtgtaaagacctccgggaaaactattgcaggaacccagacggatcagaaagcccctggtgtttcacaacagaccctaacatacgagtcggatactgcagtcagattccgaattgcgacatgagccatggtcaggactgttataggggtaatgggaaaaattatatgggaaatctgtcgcagaccagatctggcctgacttgcagtatgtgggataagaacatggaggatttgcaccggcacatcttttgggagcccgatgccagtaagctcaatgagaactattgtcggaatccagacgacgacgctcatggaccctggtgttacactggaaatccattgattccgtgggattactgccctattagtagatgcgagggcgataccactcctaccattgtgaacctggatcatcccgtaattagctgcgcgaaaacaaagcagctaagggtcgttaacgggatccccacccgtacaaacatcggctggatggttagcctgagatataggaacaaacatatctgtggcggtagtttgattaaggagagctgggtgctcaccgccaggcaatgcttcccgtctagagatctcaaagactatgaggcctggttagggatccatgatgtgcatgggcgaggcgacgaaaagtgcaaacaggtcttgaacgtgtctcagctggtatacggccctgagggcagtgatctcgtacttatgaaactggccagaccagctgtcttagatgacttcgtctcaactatcgaccttcccaactacggttgtacaatcccggagaagacttcatgcagcgtatacggttggggctatacgggccttatcaattatgacggacttctcagagtggcacacttgtacatcatgggtaacgagaaatgttcacagcaccaccgaggaaaggttactcttaatgagtcggaaatttgcgctggcgctgagaaaatcgggagcggcccatgtgaaggcgattacggcggtcctttggtgtgcgaacagcacaagatgcggatggtgctcggggtgatcgtccctggtagaggatgcgccattcctaacaggcccggaatctttgtgcgagtggcctattacgccaagtggatccacaagattatcctgacatacaaagtgccacaatcctag

SEQ ID NO: 228102 - DNA, 276 bp, Artificial Sequence
  Description of Artificial Sequence: Synthetic coding sequence
atgggtctactccaacttcttgcgttctccttcctggccctctgccgtgctcgcgtccgggcacaggagccggaattttcatacggctgcgcggagggctcatgctacccggctactggagatctcctgattggacgagcgcaaaaattgtcggtgacgtctacgtgtgggttacataaacccgagccctattgtatcgtatcgcacctgcaggaggataaaaagtgctttatctgtaatagccaggacccttatcacgagactttgaacccttag

SEQ ID NO: 228103 - DNA, 2553 bp, Artificial Sequence
  Description of Artificial Sequence: Synthetic coding sequence
atggggctgctgcagctcctggcatttagctttctggctttatgtcgggctcgcgtcagagctcaggaacccgagttcagctacgggtgtgcagaggggtcttgttatcccgcaacaggagatctactcataggcagggctcaaaagctgtcagtcacaagtacctgcggcctgcataagcctgagccttattgtatagtttcacatctgcaggaggacaagaaatgtttcatttgtaattcacaggatccatatcatgaaacactgaaccctgattcacatctgattgaaaacgtggtcaccacctttgctcccaacaggttaaaaatttggtggcagtccgagaacggcgttgagaatgtaactattcaactggatttagaggctgagttccattttacgcatctcatcatgacattcaaaacttttcgacccgcagccatgttgatcgagaggtcatctgattttggaaagacgtggggcgtttaccggtactttgcctatgactgcgaagcctcttttcctgggatctcaactggaccgatgaaaaaggtggacgacatcatctgtgacagcagatactccgacatcgagccttcgaccgagggggaagtgatcttccgggctctcgaccccgctttcaaaattgaggacccttacagccccagaatccagaatctgcttaaaataacaaatttgcggattaagttcgtaaagcttcatacattaggtgataacctgctcgatagtcggatggagatacgagaaaaatattactacgccgtgtatgatatggtcgttcgaggaaattgcttctgttacggacacgccagcgagtgtgcacccgtggatggcttcaacgaggaagtagaaggcatggtccacggccactgcatgtgcagacacaacaccaaaggcctgaactgcgagctttgcatggacttttaccacgaccttccatggagaccagccgaggggcgtaattcaaatgcatgtaagaaatgtaactgcaacgagcactctattagctgccactttgacatggcggtgtacctggcaaccggtaacgtctctgggggtgtttgcgacgattgccagcacaataccatgggcaggaattgtgagcagtgtaaacccttctattaccaacaccccgaacgtgacattcgcgatcccaatttttgcgagagatgcacatgtgatccagcaggctcccaaaacgaagggatttgtgattcgtacactgacttcagcacgggtctgatagcagggcagtgcaggtgcaagctcaacgtcgagggagaacattgtgatgtgtgtaaggagggcttctacgatttgagctcagaagatccattcggttgcaagtcatgcgcatgtaatccgctgggaacgattccagggggaaatccctgcgactccgaaacgggccactgttattgcaagcgactggtcacgggacagcactgtgaccagtgcctgccggagcactggggcctgtctaacgacctggatgggtgtagaccatgtgactgtgatttagggggagcgcttaataattcttgctttgcggaatcgggacagtgctcctgcagaccacatatgatcgggaggcagtgtaatgaagtggaaccaggttattatttcgcaacattggaccactatttgtacgaagccgaagaggcaaatttgggcccaggagtgtcaatagtggagagacagtacatacaggacagaataccttcttggaccggcgctggttttgtgcgggtccccgaaggtgcctaccttgagttcttcattgacaatattccctattctatggaatacgacattctgattcgatatgagccacagctacccgatcattgggagaaagcagttatcaccgtgcagaggcctggtcgcatacccacatcatcccggtgcggaaatacaatcccagatgacgacaatcaggtggtatcactgagtcccggatctaggtacgtggttctgccacgacccgtgtgctttgagaagggcactaactatacagtcagactggaactgccacagtacacttccagtgacagcgatgtggagtctccttacaccctgattgactcccttgtgctgatgccttattgtaagagcttggatatattcactgtcgggggaagcggcgacggagtggttaccaatagtgcatgggagacctttcaaagataccgctgtctggagaacagcaggtccgtggtgaagaccccaatgaccgacgtgtgtcgcaatattatatttagtatctctgccctcctccatcagaccggcttggcatgcgagtgcgacccacaaggaagcctgtcttctgtgtgcgaccccaatgggggtcaatgtcagtgccgcccaaatgtcgtgggtaggacttgcaataggtgcgccccaggcacattcggttttggaccctctggatgcaaaagacggttcctcaaatccatcgtgatgcacagcttcagacttacccaacccttgtggcaaggctctatcgcggctgaacccatgctgcctagctag

SEQ ID NO: 228104 - DNA, 5396 bp, Artificial Sequence
  Description of Artificial Sequence: Synthetic coding sequence
atggagctgaccagtcgggagaggggacgcggtcaacctctcccttgggagctccgcctggggctacttctgtcagtgcttgcagctactctcgcccaggccccagctcccgacgtgccaggatgcagcagaggaagttgctaccccgctaccggggatcttctggtggggcgagcagacagactcaccgcttcttccacgtgcggacttaacggccctcagccctattgtattgtgtcccacctccaggacgagaaaaagtgcttcctgtgcgactcaagacgaccattttctgctagggacaaccctcattcccacaggatccaaaatgtggtgacttcctttgcaccccagcgccgagccgcatggtggcaatcagaaaatggaatccctgccgttactatccagctggacctcgaagctgagttccatttcacacatttgatcatgacattcaaaacatttcggcctgccgctatgctggttgagaggtccgctgactttggacgtacttggcacgtataccgctactttagctacgattgtggtgccgatttccctggcgtccccctggcccctcctagacactgggacgatgtggtttgtgagtcccggtactctgagattgaaccatcgactgaaggagaagttatctaccgggtgctcgatcccgcaattccaattccggacccttacagtagcagaatccagaacctgttgaagataaccaaccttcgggtcaatctcaccagactgcacaccctcggcgataacctgctggaccctcgcagagaaatcagagagaagtactactacgccctttacgagcttgttgttcggggtaactgtttttgctacggccatgcaagcgagtgcgcccctgcgccaggggctccagcccatgctgaaggtatggttcacggggcatgtatctgcaagcataacacacgcggactgaactgcgagcagtgtcaagacttctacagagatctcccttggcgcccagccgaagatgggcacagtcacgcctgccgcaaatgtgaatgtcacggacacactcatagctgccattttgatatggccgtgtatctggcctccggcaacgtatctgggggagtatgtgacggctgtcaacacaatactgcaggccgtcattgtgaactctgccgaccattcttctacagggacccaactaaagatcttcgtgatcccgcagtttgcaggagctgcgattgtgaccctatggggtctcaggatggtggacgctgtgacagccacgacgacccggcactgggactagtgtctggccagtgtagatgtaaagagcacgtggtgggtactagatgccagcaatgtagggatggtttcttcggcctcagtattagtgaccggttaggatgccggcgttgccagtgtaatgcacgtggcacagtaccagggagtacaccctgtgaccccaattccggatcatgttattgcaagaggcttgtgaccgggaggggctgcgacagatgcttacctggacattgggggctcagccacgacttactgggctgcagaccatgtgattgtgacgttggcggagccttggatcctcagtgcgacgaaggcacaggccagtgtcactgtagacagcatatggtcggtcggcgttgtgagcaagtgcagcctggctacttccggcctttcctcgaccacttaatctgggaggcagaagatacacggggacaggtccttgatgttgtagaacggctcgtgacacccggagaaaccccatcttggactggcagtggcttcgtgcggttgcaagaaggccaaaccttggagttcctggtcgccagcgtaccaaaggcaatggattacgacctgttgctcagattagagccacaggtgcctgagcaatgggcagagcttgagctgatagtccagcgcccaggccctgtgcccgctcacagtctctgcgggcacctcgtgccaaaagatgatcgaatccagggtaccttgcagccacacgctcgctatctgatctttcctaatcctgtctgtttggagcccggaatttcctacaagttgcacttgaagctggtgcgcaccggtgggtcagctcagccagaaacaccttactccggaccaggactgcttatcgactccctggttctgctgcccagggtgctggtgctggaaatgtttagcgggggagacgccgctgccctggaacggcaggccaccttcgagagataccagtgccatgaagagggactcgtgcctagcaaaacctctccaagtgaggcctgtgctcccttgcttatctctctcagcaccctcatatacaacggagcgctcccgtgtcagtgtaacccacagggcagtctatcatccgagtgcaacccccacgggggacagtgtctgtgtaaaccaggcgttgttggacggcgatgcgatttatgcgctccagggtactatgggttcgggccaaccggctgtcaggcatgtcagtgcagtcatgagggggcactctcaagcctgtgcgaaaagacaagcggacaatgcctgtgtaggacaggtgccttcggattgcggtgcgatagatgtcagcgaggacagtggggctttccatcatgtagaccttgtgtgtgtaatggccacgctgatgaatgtaacacgcacactggggcatgtctcggttgccgagaccacactggcggtgagcactgcgaaagatgcatagccggattccatggagaccccaggctcccatacggtgggcagtgcagaccctgcccctgccccgaaggacccggtagtcagcgccattttgctacctcctgccaccaggacgaatattctcagcagatcgtgtgtcattgcagagctggctacacagggttgcgctgcgaagcctgtgctcccggacatttcggagacccctctagaccaggtggaaggtgtcagctgtgcgagtgtagcggcaacatcgatcccatggatcccgatgcttgtgatccacacacaggccagtgccttaggtgtttacaccatacggaggggcctcactgtgcgcattgtaaaccaggattccatggacaggccgctaggcagtcctgccacagatgcacttgtaatcttctgggaacgaacccacagcagtgtccgtcgccagaccagtgccactgtgaccccagctcaggccagtgcccctgtctgcctaatgtgcagggtccttcgtgtgacagatgcgcacccaatttttggaatctgaccagcgggcatgggtgccagccttgtgcctgccacccatccagagctcggggacccacctgtaatgaattcacaggccagtgccattgtcgcgcaggatttggaggtaggacctgtagcgagtgtcaggagttgcactggggcgaccccggtttgcaatgccatgcttgcgactgcgactctcgaggtattgacactccccagtgtcataggtttacaggacactgttcttgccgacctggagtgtctggagtgcgctgcgatcagtgcgccagaggcttctctggtatcttcccagcctgccacccatgccacgcttgctttggcgactgggatcgggtcgtgcaagacctggcagcccgaactcagagactggaacagcgggcacaggagttgcagcagactggagtgctaggcgctttcgaaagcagcttttggcacatgcaggaaaagctggggatagtgcagggcatagtgggcgctcgcaacacctctgcggcatccaccgcacagctggtagaagcaaccgaagaactccgacgcgagatcggtgaggccacagagcacctgactcagctagaggctgatctgacggacgtgcaagatgagaattttaatgcaaaccacgcactgagtggcctggagcgggatcggctcgcactaaacctgacgctcaggcagctggatcaacatttagacctgttgaaacacagtaattttctaggggcatacgactccattcgacatgcccatagccagagcgccgaggctgaacgtcgagcgaacactagcgcactggccgtgcccagcccagtcagtaattcagcctccgctcgacatcgcacagaggctctaatggatgcgcagaaagaagatttcaattctaaacatatggccaatcagcgcgcactggggaagctttctgcccatacacacaccttatcactgacagatatcaatgaactggtttgtggagcaccgggagacgccccttgcgcaacctccccatgtggcggagcgggatgtcgggatgaggatggccagccacggtgcgggggtctctcttgtaacggcgcagccgcaaccgcagacctggccctgggacgcgctcgacacactcaagcggaactgcagagggccctcgccgagggcggttctatattgtctcgggtcgctgagacccgcaggcaggcttctgaggcacaacagagggctcaggctgcgctcgataaagccaatgcatccagaggccaggtggagcaggctaatcaggagctgcaggagctgatacagtcagtcaaggatttccttaaccaagagggcgctgaccctgactccattgaaatggttgcaactcgggtactggagctgtcgattcccgcttccgcagagcagattcaacacctcgctggcgcaatcgcggagagggtacgtagtcttgcagatgtggatgccatcctcgccaggacggtaggtgacgtcagacgggcagagcagcttctgcaggatgcccgaagggccagaagctgggccgaggatgagaagcagaaggctgaaaccgtacaggcagcactggaagaggctcagcgcgcacagggcatagcgcagggcgcaataagaggagctgtcgccgacactcgtgacaccgaacaaaccttatatcaagtacaagaaagaatggccggagcagagcgcgctttgagttcagccggtgaaagagcgcgacagttagacgccttgttggaggctctgaaactcaagagggctggcaacagtctggccgctagcaccgctgaggaaactgccggatctgctcaaggtcgagcccaggaagcagagcagttactccggggacctttaggggaccagtatcagactgtcaaagcactggccgagaggaaagcgcaaggcgtactggccgctcaggcacgggcagaacagctgagagatgaggctagggacctgcttcaagccgctcaggacaagcttcagagactccaggaactggaggggacatatgaagagaatgagcgcgctctggaatccaaggcagcccagctagatggactagaagcgagaatgcggtctgttctgcaggcaataaatctgcaggtgcaaatttataatacttgccagta

SEQ ID NO: 228105 - DNA, 1143 bp, Artificial Sequence
  Description of Artificial Sequence: Synthetic coding sequence
atgcaggaaaaactggggattgtccaaggcattgttggggcacggaatacgtccgccgcttcaactgcgcagctggtcgaggctacagaagaattgcgcagagaaatcggtgaagcaacagagcacctgacgcagctagaggccgatttgaccgatgtgcaggacgaaaattttaacgcgaaccatgcacttagcggcctagaacgggatcgcctcgccctgaatctcactttgcgtcaactggaccagcatctggacttgctgaagcactcaaacttcctgggcgcatacgactctattcgtcacgcacattcccagagtgcggaagccgagcgaagagcaaacacttcagcacttgcagttccttctcccgttagtaacagcgcttcggctagacatcgcacagaagccctgatggatgctcagaaagaggacttcaattcgaagcacatggctaatcagcgcgcactaggcaagctttctgcacacactcacaccctgtccttaacagacattaacgagttggtctgcggcgcacctggcgacgcaccatgcgccaccagcccatgcggaggcgcagggtgtcgtgatgaggacggacaaccacgctgtgggggactcagctgtaacggagccgctgctaccgccgaccttgccctgggacgcgctaggcatacccaggccgagctgcaaagggcactcgcggagggaggctccattcttagcagagtggcggagaccaggagacaggcgtctgaggcccagcagagggctcaagctgcacttgataaggccaatgcttcccggggtcaagttgaacaggctaatcaggagctgcaggagcttatacagtccgtaaaggacttccttaatcaggagggcgctgatcctgactctattgagatggtcgcgacacgggtactcgagctgtctatcccagcctctgccgaacagatccagcatctggccggtgctatagctgagcgtgtcagaagcctggcagacgtggacgccattttagcccaaggaattgcccagggggctattagaggagcagtagccgacacccgagacacagaacagccagtgcccggaactggagaagacgggcgttgtagagcaggaactgagttgtgtagatag

SEQ ID NO: 228106 - DNA, 5396 bp, Artificial Sequence
  Description of Artificial Sequence: Synthetic coding sequence
atggagctgacatctagggagaggggacgtggccagcccctgccatgggaactccgcttggggttgttgctttctgtgctcgcagccaccctcgcccaggcacccgcaccagacgtgcctggatgtagccgcggtagctgttatccggcaacaggtgatctgcttgtgggacgggctgaccgactcacggcatcatccacctgcgggctaaacggaccgcagccctattgcatagtcagtcacctgcaggatgaaaaaaaatgtttcctgtgtgatagcaggcggccattcagcgcaagggataacccccatagccatagaattcaaaacgtggtcacatcctttgcaccgcaacggagagctgcttggtggcagagtgagaatggcattccagcagtcaccattcagttggatctcgaggcggagttccattttacccatctcataatgaccttcaagacatttagacctgccgctatgctggtggagaggagtgctgactttggaaggacctggcacgtctataggtattttagttacgattgcggcgctgattttcccggagtccctcttgcacctcctcgacattgggacgacgtcgtctgtgaaagtcgttattccgaaatcgagcccagcactgagggtgaagtcatctatagagtgctagatcccgctataccaatccccgacccatacagtagcagaatccaaaatttacttaagatcacaaatcttcgcgtgaaccttacacggttgcacacactgggcgataatctactggatcccaggagagaaatcagagagaagtactactatgcgctgtacgagttggttgtgagagggaattgcttttgttacggacatgcctcggaatgcgctcctgcaccgggtgcccctgcacacgcagagggaatggttcacggagcatgcatctgcaaacacaatacgcggggattgaactgcgagcagtgtcaggacttttatcgggatctaccgtggcgtcccgctgaagatgggcactcacatgcttgtcgtaagtgcgaatgtcatggccacactcactcctgtcactttgatatggcagtatacctggccagtgggaacgtgtctggcggtgtgtgcgacggctgtcaacacaacacggcagggaggcactgcgagctttgtcggccatttttctaccgcgatcctacgaaagatctgagagatccagcagtatgcaggtcttgcgactgtgaccctatggggagtcaggatgggggtcgctgtgatagccatgatgatcccgcactcggcctggtaagcggccagtgccgctgtaaggagcatgtggtggggacccggtgtcagcaatgccgcgatgggtttttcggtcttagcattagcgatcgcctgggctgccggagatgtcaatgtaacgcacggggtacagtgcctggtagcactccttgcgaccccaattccggctcctgttattgcaaaaggttggtgacagggcgtggctgcgatcggtgcttacccggtcactggggactctcacacgacctgctgggttgcagaccttgcgattgcgacgtcggcggagctctggaccctcagtgtgacgaagggacagggcaatgccactgtcgtcagcacatggtgggacgtcggtgcgagcaggttcaacctggctatttcagaccattcctcgaccacctgatatgggaagcagaggacaccaggggacaagtgctggatgtggtggaacgcctcgttacgccgggtgagacgccaagttggaccggctcaggtttcgttcgtctccaggaggggcaaaccctggaatttctagtggcctccgtgccaaaggccatggattatgatttattgctccgtctcgagccacaagtgcctgagcagtgggcagagctcgagctcatagtgcaaaggccaggtccagtgccagcacatagtctgtgcggacatctggtccccaaagacgaccgaatccagggaaccctccagccgcacgcaagataccttatcttcccaaatccagtgtgcctcgagccgggtatttcatataagctccatctgaagctggtgaggacgggaggatctgcacagccagaaactccgtattcaggcccaggcctgctgatcgactccctggtcttactccccagggtattagtcttagagatgttctctgggggagacgcagctgcgctcgaacgccaggctacttttgaacggtaccaatgtcacgaggaagggctcgtacccagtaagacatctccaagtgaagcgtgtgccccactcctcatcagcctgtccacgcttatctacaatggagccctgccttgtcagtgtaaccctcagggttccctgtcttcagagtgtaatccgcacggcggacaatgtctctgcaaaccaggggtagtggggcgaagatgcgacctgtgtgcacctggctactatgggtttggacctacaggctgccaggcttgccagtgctcccatgagggagcccttagcagcctgtgcgaaaaaacatcaggacaatgcctgtgtcgcacgggtgctttcggcctgagatgtgatagatgtcagcgagggcagtggggcttcccgtcttgccgcccatgcgtgtgtaatgggcacgcagacgaatgcaatacacatactggagcctgcctaggatgtagagatcatactggcggagagcattgtgaaaggtgcattgcaggctttcacggcgaccctaggctgccctatggcggacaatgcaggccatgcccatgtccagagggtcctggatcccagagacacttcgccacatcttgccaccaggatgaatactctcaacagatcgtgtgccactgcagagctggctataccggcctgaggtgtgaggcttgtgccccaggccatttcggggatccgagtaggccaggtgggaggtgccaactgtgcgaatgctccggcaacatcgatcctatggaccccgacgcctgtgatccccacacaggccaatgtctaagatgccttcatcacactgaggggcctcactgtgcccactgtaaacctggttttcatggacaggcagctcgacaatcttgtcacaggtgtacatgtaacctcctgggcaccaaccctcagcagtgtccatccccagaccagtgtcactgcgacccatccagcggacagtgtccatgtcttcccaacgtgcagggaccaagctgcgatagatgcgccccaaacttctggaatctaacatcgggacatgggtgtcagccttgcgcttgccacccaagccgagcacgcggaccaacatgtaatgagtttaccgggcaatgtcactgccgggcaggattcgggggaagaacctgttctgagtgtcaagaactgcactggggcgaccctgggttgcagtgccatgcatgtgactgtgatagtcggggaatcgacacacctcagtgccacagatttaccggccactgctcatgtcgaccaggagtctctggagttcgatgcgaccagtgtgcgagaggatttagcggcatattcccggcttgtcatccatgtcatgcttgcttcggcgactgggatagggtggtccaagacctcgccgctcgaacccagcggctggagcagagggcacaggagcttcagcaaaccggcgtgctgggtgcgttcgagtcctccttttggcatatgcaggagaagctgggtatcgtgcagggaattgttggcgcaaggaacaccagtgccgcaagcactgcccagctggttgaggccactgaggagttaagacgcgagattggagaggccaccgagcacctgacgcagctggaagccgacttgaccgatgtgcaggatgagaacttcaacgccaatcacgccttaagtggtctggagcgtgatcgactggccctcaacctgacacttaggcaactcgaccagcacctggacctgctgaaacattcaaacttcctcggagcatatgacagcatccggcacgctcactcccagtccgccgaagcggagcgtagagccaatacatctgcactggcagtgccctctcctgtatcaaattccgcttctgctaggcaccgaaccgaggccttgatggacgcgcagaaagaggacttcaatagcaagcacatggccaaccagagagcgctcgggaagttatccgcccacacccatactctgagcctcaccgacatcaacgagctggtgtgcggagctccaggtgatgcgccttgtgccactagtccctgtggcggagctggttgccgggacgaagatggccaaccccgttgtggcggattaagctgcaacggggctgcggcaactgctgatctcgcccttgggagagccaggcacactcaggccgagctccagcgagccttggccgaaggagggagtatcttgagcagggtggcagagacccgcaggcaagcatcggaagcacagcagcgtgcccaggctgcactcgataaggccaatgcaagtcgcggacaggtcgaacaagccaaccaggaactgcaagaactcattcagtctgtcaaggattttcttaaccaagagggggctgaccccgattcaatcgagatggtggccacaagggtactggaactgagcatcccggcttctgcagagcagattcagcatttggccggagctatagcagaacgggttcgctccctggcagacgtagacgcaatcctcgccaggaccgttggggacgtgagacgcgctgagcagctgctgcaggatgctaggcgagcacggtcttgggcggaggacgaaaagcagaaggccgaaactgtgcaggccgctttggaggaggcccagagagcgcaaggtatagctcagggggcaatccgcggagcagtggccgatactcgggacacagagcaaacgctttatcaggtgcaagagcgaatggccggtgctgaacgggctctgagctcagctggcgagcgagctcggcaactggacgcgctgctggaagccctgaaactcaaaagagccggtaatagcttggccgcttctaccgccgaagaaaccgcgggatccgcccaaggacgggcacaggaggcagagcagcttttgcgcggtcctctgggggaccagtaccaaacagtcaaagcgctcgccgagagaaaggcgcagggggtcctcgccgcacaggcccgtgcggagcaacttcgcgacgaggcgagagacctgctccaggccgctcaggacaaattgcagcgcctgcaggaactggaaggcacttatgaggaaaacgagcgtgccctggagtcgaaggctgcccagctggacggtcttgaggctcggatgcggtcagtactgcaagcgatcaatctgcaggtccagatttataacacctgccagta

SEQ ID NO: 228107 - DNA, 3519 bp, Artificial Sequence
  Description of Artificial Sequence: Synthetic coding sequence
atgaggcctttttttctgctgtgttttgctctgcccggactccttcatgcacagcaagcgtgcagtagaggagcgtgctatccgcctgtcggcgatctgctggtgggccgaaccaggtttttgcgcgcaagcagtacctgcggactaacaaagcccgaaacgtactgcacccagtacggggagtggcagatgaaatgctgcaagtgcgactcccgccagccacacaactactattcccacagggtggagaatgtggcttctagctcaggcccaatgaggtggtggcagtctcagaacgatgtcaatcccgtatcattacagttggatctcgacaggcgatttcagcttcaggaggtgatgatggaattccaggggccaatgccggctggcatgctgattgagagatcttccgatttcggcaaaacctggcgggtgtatcagtatctagccgctgattgtacctccaccttccccagggtgagacaggggcgtcctcaatcatggcaggacgttcgttgccagtcactcccgcaacgcccaaatgccagactgaatggcggaaaagtccagctgaatctgatggacctggtgagtggcatacctgcaacacagtcccagaaaattcaggaagtcggggaaatcaccaatctgagagtgaactttactaggctggcccctgtgccccaacggggttaccaccccccttctgcctattatgccgtgtcccagctgcggcttcagggtagctgtttttgtcacgggcatgctgaccggtgcgctcctaagccaggggcaagcgcaggcccttcaactgctgttcaggtgcatgacgtgtgtgtgtgtcagcacaatactgccggaccaaactgtgaacgttgtgcaccattctataataacagaccatggagaccagcagaaggccaagatgcccatgagtgccagcgttgcgactgtaatggccactctgaaacctgccattttgacccggcagtgttcgccgcatcgcagggtgcctatggcggagtgtgtgacaactgccgagaccacacagaaggaaagaattgtgagagatgccagttgcactactttaggaaccgtagacctggggcatctatccaagagacatgcatctcttgtgagtgcgatccagacggagctgtcccaggagctccctgcgaccccgtcacgggacagtgcgtgtgcaaggaacatgtgcagggagagcggtgcgacctctgcaagccaggatttaccggcttaacttatgccaacccccagggttgtcatcgctgtgattgcaatattctcggcagtagaagagacatgccatgtgatgaggagtcaggcaggtgtctgtgcctccccaatgtggttgggccaaagtgtgatcaatgtgctccttaccactggaaactcgcttccggacagggttgtgagccctgcgcctgcgatcctcacaattcattgtccccccagtgtaatcaattcaccggacagtgcccctgtcgcgaaggctttgggggtctaatgtgttccgccgctgcgattcgtcagtgccccgaccgcacgtacggcgacgtggcgacgggctgtcgagcttgtgactgtgactttcggggaactgagggccctggatgtgataaggcgtcggggcgatgtttgtgcaggcctggccttaccggccctcgctgcgaccagtgtcagagaggatattgcaaccggtatccagtgtgcgtagcttgtcacccatgctttcagacctacgatgcggatctgagagagcaggctttaaggttcggacgtcttcggaatgccactgccagcctgtggtctggtcccggtttggaagacagaggactggcctcgcgcattttggatgccaaaagtaaaatcgagcagattagagctgtcctttcgtctccagcggtgacggaacaggaagtcgcccaggtggcctccgccatactgtcactgcgaaggacgctgcagggtcttcaactcgatttaccacttgaagaggaaaccttaagtttgccccgagacctggagagcctcgaccgctccttcaacggccttcttaccatgtatcagcgtaagagagagcaattcgagaagatttcttccgctgacccgagcggtgcctttagaatgctgtcaaccgcttacgagcagtccgctcaggctgctcagcaggtctcagacagctcccggctactcgaccaactccgggattccaggagggaggccgaaagactggtgagacaggcagggggtggtggcggtaccggctctcccaagctggtggccctgcgcctggaaatgtctagcttgccggatcttactccgaccttcaacaaattatgtggcaatagtagacaaatggcatgtactcccattagttgccctggcgagctgtgtccccaagacaacggcacggcctgcggaagccgatgtagaggggtactccccagggcagggggtgcttttctgatggcaggtcaggtggcagagcagttacgaggctttaatgcccagctacagaggacacgccagatgatccgtgctgccgaggagagcgcttcccaaatacagagtagcgcacagcggctcgaaacacaagttagcgcttccagaagccagatggaagaggatgtcaggcgcacaaggctgctgatacagcaggtgcgtgacttcttaacagacccagataccgacgctgctacgatccaggaagtttctgaggcggtgctcgcgctctggctgccgacagactccgcaaccgtgctgcagaagatgaatgagattcaggcaattgcagccaggctgccgaatgtagacctggtgctatcccagaccaagcaggatattgcccgtgcacgaaggctgcaggccgaagccgaagaggccaggagcagagcgcacgccgtggaagggcaggtcgaggatgtggttggcaatttgaggcagggaaccgtggcgcttcaagaagctcaagacaccatgcaggggacatcccgctccttacgactcatacaggatagagtggccgaagtacaacaggtacttcgccctgctgagaaattagtcacatcaatgaccaaacagctgggtgatttctggacaaggatggaagagcttagacatcaggcacggcagcaaggagcggaggctgtccaggcacaacagctggctgagggggcttctgagcaggccctttcggcccaggaaggatttgagagaatcaagcaaaaatacgcggagctgaaggacaggctggggcagagctccatgctgggtgagcaaggtgccagaattcaatccgtgaagactgaagccgaagagcttttcggagaaacaatggaaatgatggataggatgaaagacatggagttggaacttctgcgtggtagtcaggctattatgctgcgttcagccgacctgaccggactggagaaaagggtggaacagataagggaccatataaatggcagagtgctctactatgctacatgtaagtag

SEQ ID NO: 228108 - DNA, 3519 bp, Artificial Sequence
  Description of Artificial Sequence: Synthetic coding sequence
atgcggccattttttttattgtgtttcgccctgccaggcctcctgcatgcacagcaagcttgctcaagaggagcatgctaccccccagtgggcgacttgctggtcggcaggacacgatttttgagggcctctagtacatgcggcctgaccaaaccggaaacgtactgtacacagtacggcgaatggcagatgaagtgctgtaagtgcgactctcgacagcctcacaactactactcgcacagagtggaaaacgtcgcgtcgtcctctggaccaatgcggtggtggcagtctcagaacgacgtgaacccggtgagcctgcagctggatctcgaccgcagattccagcttcaagaggtgatgatggaattccaaggcccaatgcccgctgggatgttaattgagcgaagctcggatttcggaaagacttggcgagtctaccagtacctcgcggcagattgcacctctacattcccccgtgtgcgacaggggagacctcagtcatggcaagacgtgagatgtcagtcacttccacagcgccctaacgccaggctgaacggcggaaaggttcagctgaacttgatggatctggtctctgggataccggcaactcagtcacaaaagattcaggaggtgggagagataacaaatcttcgggtcaattttactcggttggccccagttccacagcgcggataccatccaccaagcgcatattacgctgtgtcccagctacgcctgcagggctcctgcttctgtcacggccatgccgatcggtgcgccccaaagcctggtgcctccgcaggccctagcactgccgtgcaggtgcacgacgtgtgcgtgtgccagcataacaccgctggcccaaactgtgagcgttgtgctcctttctataacaacagaccctggcggccagcggaaggacaggatgctcatgagtgtcagcggtgcgactgcaatggccactcagaaacttgtcactttgaccccgctgtatttgccgcttcacaaggcgcatacggcggagtctgcgacaattgtcgtgatcacacagaagggaagaactgtgaacgctgccaattgcactacttccgtaaccgaaggcctggggcatctatccaggagacttgcatatcttgtgaatgtgatccagatggcgcagtgccaggtgcaccctgtgacccagtgacaggccagtgtgtatgtaaagagcatgtgcagggggaacgctgtgacctgtgcaaacccggattcacgggcctgacctatgccaaccctcagggatgtcaccggtgcgactgcaacatcttgggaagcagacgggacatgccttgcgacgaggaatcaggccgatgtttgtgtctgcccaatgtcgtgggccctaaatgtgaccaatgcgctccgtatcattggaagctcgccagtgggcagggatgtgagccgtgcgcgtgcgatccccacaattccctttctcctcagtgcaaccagttcacagggcagtgcccatgccgcgaagggttcggcggtctgatgtgcagtgccgcagctattcgccaatgtccagaccgtacatatggagatgtcgccaccggctgccgtgcctgtgattgcgatttccggggaactgaggggccaggctgcgacaaagccagtggccgatgcctctgtcgacccggacttactggccctcggtgtgatcagtgccagcgcggttattgcaatcggtacccagtttgcgtggcatgccacccctgctttcaaacctatgacgcagatttgagagagcaggcgctgagatttggccgactccggaatgctacagccagtctgtggtcaggccctggactggaagacagaggccttgcaagtcgaattctggatgcgaagagcaaaatcgagcaaattagggctgttctatctagtccagcagtaaccgaacaggaagtcgcccaggtggctagcgcaatcctgtcgctgcggagaaccttgcagggactgcagttagacctgcccctggaggaagagacgctaagtctacccagggatctggagagcttagatcggagcttcaacgggctgttaacaatgtaccagaggaagcgcgagcaattcgaaaagatctccagcgccgatccaagtggcgcatttagaatgctgagtacggcttatgagcaatccgcccaggccgctcaacaggtttcagattcttcacggctcctggaccagctcagggattccaggcgcgaagctgaaaggcttgtgagacaggctggagggggtgggggaacagggagtccgaaactggtggctctcaggctggagatgagctcattacctgaccttactcctacctttaataagctgtgcggcaactcccggcagatggcctgcactcccatttcttgtcctggggaattgtgcccccaagacaatggaaccgcctgcggcagccgatgcaggggagtgctccctcgagccggaggggctttccttatggcaggccaggttgctgaacagttgagagggttcaatgctcaattgcaacggacccgacagatgattagggccgcagaggagtcagcgtctcagatccagtcttctgctcaacggctggagacccaggtgagtgcatcacggagtcaaatggaagaggacgtcaggcgaactaggctcctcatccagcaggtgagggattttcttacggatccagataccgacgctgccactatccaggaagtgtccgaagcagtactggccctgtggctccccacggacagcgcaacggtactccaaaaaatgaacgaaatccaagcaatcgccgcacggttacctaatgtcgacttagtgctgtcacagactaagcaagatatagcaagagccaggaggttgcaagccgaggccgaggaggcgcgatctcgcgctcacgccgtagaaggacaggtggaagatgttgtgggcaacctccgacaaggtaccgttgctctacaggaggctcaggataccatgcagggcacatccagatctttgcgactgatccaagatcgtgtggcagaggtacagcaggtgctgcgacctgcagagaagctcgtaacttcaatgaccaaacagctgggcgacttttggacacgcatggaagagttgcggcatcaggctcgccagcagggggcagaggctgtgcaggctcaacaactcgctgagggagcttccgagcaggccctgtctgcccaagagggttttgagcggataaaacagaaatacgccgaactgaaagatcgcctggggcagtcaagtatgttaggagaacagggcgctagaattcagtccgtaaagactgaagctgaagagctgttcggggagaccatggaaatgatggaccgaatgaaggacatggagctcgagcttctgcggggatctcaggccattatgctcaggagcgcagacctcactggccttgagaaacgagtcgaacaaatcagagaccacatcaacggtcgagtcctgtactatgccacgtgcaaatag

SEQ ID NO: 228109 - DNA, 3519 bp, Artificial Sequence
  Description of Artificial Sequence: Synthetic coding sequence
atgcgcccatttttcctcctttgttttgccctaccaggcctcttgcatgctcagcaagcttgctcccgcggagcttgttacccccctgtaggcgacctactggtgggaagaacaagattcctccgggcatcctctacctgtgggctgactaaaccggaaacatattgtactcagtatggagaatggcagatgaagtgctgtaagtgtgactccaggcagcctcataactactattctcaccgggtggagaatgtcgcatcgagtagtggccctatgcgctggtggcagtcccagaatgatgtgaaccctgtcagtcttcagctcgacttggatcggcgatttcagctgcaggaggtgatgatggagttccaaggtccaatgcctgcagggatgttgatcgaacgctcgtccgacttcggcaagacctggagagtgtaccagtaccttgccgctgactgtacatccaccttccccagagtgcgccaaggtcgccctcagagttggcaggatgtccggtgccagagcttgccccaaagaccaaatgccaggctgaacggaggaaaagtacaactcaatttgatggacctcgtaagcggaattccagccactcaatcccagaaaatccaagaggtgggcgagatcactaatctaagggtaaatttcacaaggctggcccctgtgccgcagagagggtaccatccaccaagcgcttattatgcagtatctcagctgcggctgcagggctcttgcttttgtcacggtcacgcagaccgttgtgcaccgaagcccggagcctcggccggtccgtctacggcagtgcaggtgcatgacgtgtgtgtgtgtcagcacaataccgcaggaccaaattgtgaacggtgtgcaccgttttacaataatcgcccttggagacctgcggaggggcaggatgcccacgagtgccaaagatgcgactgtaatggacatagcgagacctgtcactttgatcctgcagtgttcgccgcatctcagggcgcttatggaggcgtttgtgataactgccgcgaccacacagagggcaaaaactgtgagaggtgccagcttcattactttcgaaatcggaggcctggggcttccattcaggagacctgcatatcctgcgaatgcgatcctgacggggcagttccaggtgcgccttgcgacccggtgaccggacagtgtgtctgcaaggagcatgtgcagggggaaaggtgtgatctctgtaagcccggtttcactggactgacgtatgcgaatcctcaagggtgtcacaggtgcgattgcaacatactgggctccagacgtgatatgccttgtgatgaagagtccggaaggtgtctctgcctgccaaacgtggtgggccctaaatgcgatcagtgcgcaccgtatcactggaaactcgccagcggccaggggtgcgaaccttgtgcctgcgacccccacaatagcttatctcctcaatgtaatcagtttaccggccaatgcccatgtcgggaaggcttcggcggtctcatgtgtagtgcagccgcaatcaggcagtgtccagatcgcacctacggtgacgtggccaccggatgcagagcctgcgactgtgatttcagagggaccgaaggtcctggatgcgataaggccagcggaaggtgcctgtgtagaccagggctgacgggacccagatgcgatcagtgtcagcggggttattgcaatcgttaccctgtatgcgttgcatgtcacccatgcttccagacctacgatgcagacctgagggagcaagctctccggtttggtagattacggaatgccaccgcaagcctttggtcaggtcccggactcgaggaccgcggtcttgcttcacggatcctggacgccaagtctaagattgagcagatcagggctgtgctatcaagcccagctgtgactgaacaggaggtggcacaggtagcctctgctatcctgtcacttcgtcgaaccttgcagggcctgcagctggacctgcccctggaggaagaaaccctgtcgttaccgagagacctcgagtccttggacaggagtttcaacggtttgcttacgatgtatcagcgtaagagggaacagtttgagaagatcagctctgctgacccatcaggtgcgtttcgtatgctaagcaccgcttatgaacaaagtgctcaggcagcgcagcaagtcagcgattcttctcgattattagaccagctcagggacagtcgcagggaggccgaacgactagtgcgtcaagccggaggaggaggaggtaccggcagtccaaagctggtggcattgcgactggagatgagtagcctgcctgatctcacccctactttcaacaaattatgtgggaattcccggcagatggcttgtacccccataagttgcccgggagagctttgtccccaggacaatgggacggcttgtggatctaggtgccgcggagtgcttccccgtgccggaggtgcgtttctcatggctggccaagttgccgagcagctgaggggcttcaatgcccagctgcagcgcactcgccaaatgatacgcgctgctgaggaatctgctagccagatccagtcttccgcccagaggctcgagacacaggtgtcagcctctagatctcagatggaagaagatgttcgcagaacccggttgcttatccagcaggtccgggattttctaacagacccagataccgacgccgcaactattcaggaagtgtccgaggctgttctagctctttggctgcctacagattccgccactgtgctgcaaaaaatgaatgagattcaggccattgccgctcgcctgcccaacgtggatctggttctgagccaaacgaagcaggatattgctagggctcgcagactgcaggccgaggcagaagaggctaggagccgtgcacatgctgtggagggtcaagttgaagatgtggtagggaacctgcgacagggaactgtggccctgcaggaggcccaagatactatgcagggcacttcacggtcactgcgccttatccaagacagggtggctgaggttcagcaagtcctgaggcctgccgagaagctggtgacttctatgactaaacagcttggcgatttttggacaaggatggaggagcttaggcaccaggccaggcagcagggggcagaggcggtgcaggctcagcaactggcagagggcgctagtgagcaggccctttcggcccaggagggattcgagcggatcaaacagaagtacgccgagctgaaagatcgtttaggacagtcctctatgcttggggaacagggtgcccgaatccaaagtgtgaagaccgaggctgaggagctgttcggtgagacaatggaaatgatggatcgaatgaaggatatggagcttgagctgctgagaggatctcaagccatcatgctgaggtccgcagacctgactgggctggagaaacgcgtagagcagataagagaccacatcaacggcagagtgctctactatgcgacttgtaaatag

SEQ ID NO: 228110 - DNA, 567 bp, Artificial Sequence
  Description of Artificial Sequence: Synthetic coding sequence
atgaggcccttcttcctcttgtgctttgccctcccgggtctgcttcacgctcaacaggcctgcagtcgcggtgcctgctacccaccggtgggagacctgctcgttggaagaactaggtttctccgcgcttcctccacatgcggattgactaaacccgagacctattgcactcagtatggcgagtggcagatgaagtgttgcaaatgtgatagtcgacaaccgcacaattattacagtcacagagtggaaaacgtggcctcttcttctggacctatgagatggtggcagtcacagaacgacgtgaatcccgtgtccctgcagctggacctagataggcgcttccagttgcaagaggtaatgatggaattccagggccctatgcctgctggtatgctgatagaacggtctagtgattttggcaagacgtggcgggtctatcaatatctagccgcagattgcacttcaacattcccaagagtccggcaggggaggcctcaatcttggcaggatgtgcgatgccagagtttaccgcagcggccaaacgcgagacttaacgggggaaagtag

SEQ ID NO: 228111 - DNA, 483 bp, Artificial Sequence
  Description of Artificial Sequence: Synthetic coding sequence
atgaacgaaatccaggcgatagcagccagattaccaaacgtcgatctggtgctctctcagacaaagcaagacatcgctcgcgctaggcgcctgcaggcagaggccgaagaagccagatctagagcccacgccgtcgaaggccaggtggaggacgtcgttggcaacctcaggcagggtaccgttgccctacaggaagctcaggacacgatgcagggaacaagtaggagcctccgcctcatacaagaccgggtcgctgaagtgcagcaagtgttacgccctgccgaaaaactggtcacctctatgaccaagcagctgggagacttttggactagaatggaagagttaagacaccaggccaggcaacagggggcagaggccgtgcaggctcaacagttggccgagggcgcttctgaacaggccctatccgcccaggaagggttcgaaaggatcaaacaaaaatacgccgaactgaaggaccgttag

SEQ ID NO: 228112 - DNA, 4830 bp, Artificial Sequence
  Description of Artificial Sequence: Synthetic coding sequence
atgcggggaagccaccgtgcggcacccgcactgcggcctcgaggtcgtctctggccggtgctcgctgtgctcgcagccgctgcagccgcaggatgtgcccaggcggctatggacgagtgcaccgacgagggaggacggccacagcggtgcatgccagaatttgtgaatgctgcctttaatgtcaccgtcgttgcgactaatacctgtggcactcctcccgaagagtattgtgtccagaccggagttacaggagtgaccaagtcctgccacctgtgtgacgctggccagccccacctgcagcacggcgctgcctttctaacggactataataatcaggccgataccacctggtggcagagccagaccatgttggcgggtgtgcagtacccgtcatcaattaacctcactctccacctcgggaaggcattcgacattacctacgtgagattgaaattccatacctccagaccagagtcatttgctatttataagcgcactcgggaagacggtccctggattccctaccagtattattcaggctcttgtgagaatacctactctaaggcaaacagaggattcattcggactggcggagacgagcaacaggccctctgcacagatgagtttagcgacatcagccccctcaccggcggaaatgtagcattttcgactctggaaggacggccttcagcctacaactttgacaattcgcccgtgctacaagaatgggtgacggccactgacattcgcgtgactctgaaccgcctaaatacttttggcgacgaagtgttcaatgatccaaaggtgctcaaatcttattattacgctatcagcgatttcgcagtgggcggtcggtgcaagtgtaacggccatgcctccgagtgtatgaaaaatgaatttgataaactcgtatgtaactgtaaacacaatacctatggagtcgactgcgagaagtgtctcccattcttcaatgaccgcccttggagaagggctaccgccgaaagtgcatctgagtgcttgccatgcgactgtaatggaaggtcccaggagtgttacttcgacccggagttgtaccgatctacaggccatggcggacattgcacgaattgtcaggataacactgatggagctcattgtgaaaggtgtcgcgaaaactttttccggcttggaaacaacgaagcgtgttccagctgtcactgttcacctgttggaagcttgagtacccagtgtgactcttatggacggtgctcctgtaaacccggagtgatgggggataagtgcgaccgctgccagccagggttccactccctgacagaggccggttgccgaccctgcagttgcgaccctagtggcagtatcgatgagtgcaacattgagactggtagatgcgtgtgcaaggacaatgtggagggattcaattgtgaacgatgtaagcctggtttcttcaatctggagtcaagtaacccgagggggtgtactccatgcttttgtttcggtcattcctccgtgtgcacaaatgccgtaggttatagtgtgtactcaatctcgtccactttccagattgacgaggatggctggcgagccgagcagcgcgacggaagcgaggcgtccctggaatggagctctgaaaggcaggacatagctgtgattagcgatagctacttccctcggtactttatcgccccagctaagttcctaggaaaacaagtgttgtcatatggacagaacctgagttttagtttcagggttgatagaagagatacgagactgagcgctgaagatctcgtcctggaaggcgctgggttgcgcgtgtcagtgccattgatagcccagggaaactcttatccatccgaaaccactgtaaaatacgtcttccgtctgcacgaggctaccgattatccgtggcgaccagccctcactccgtttgaatttcagaagctgcttaacaacctgactagcattaagattcgaggaacatactccgaaaggtccgctgggtacctggacgacgttacactggcatctgctcgcccagggccaggtgtgcccgctacttgggtggagtcttgtacatgtcccgtcggctacgggggacaattctgcgagatgtgcctatcaggctatcggcgagaaacaccaaatctcggaccgtattcaccgtgtgtcctctgcgcctgtaacgggcacagcgagacatgcgaccccgaaacgggagtgtgcaactgtcgagataacaccgctggtccccactgcgagaagtgtagtgatggctattatggcgacagcaccgccggtacatcgtccgattgccagccctgcccatgtccaggaggttctagttgcgccgtggtgcctaaaactaaagaagttgtgtgtacaaattgtccgaccgggactaccgggaagcgttgtgaactgtgtgacgacggatattttggagaccccctgggaaggaacggcccagtgcgtctctgtcgattatgccagtgtagcgacaatattgatccaaatgcagtaggcaattgcaaccgcctcacaggtgaatgtctgaaatgtatctacaataccgccggtttttactgtgacagatgtaaggatggcttttttggaaaccctttggcacctaatccggctgataagtgtaaggcttgcaattgcaacctttatggcacaatgaaacagcagtcatcctgcaatcctgtgaccgggcagtgcgagtgcctgccccatgttacaggccaggactgcggcgcatgtgacccagggttctacaacctccaaagcgggcagggctgcgagcgctgcgattgtcacgccctgggttcgacaaacggacaatgcgacattaggacagggcaatgcgagtgccaacccggaatcactgggcagcactgcgaacgctgcgaggttaatcacttcggcttcggccctgaggggtgtaagccctgtgactgccatcccgaaggctcgctgagcctccagtgtaaggatgacggaaggtgcgagtgcagggagggctttgtcggcaacaggtgcgatcaatgcgaggagaactacttctacaaccgttcctggcctgggtgtcaggaatgccccgcatgctatcgtttggtgaaggataaggtggccgaccatcgtgtgaagctccaggagcttgagtcactgattgctaatctggggaccggggacgaaatggtgaccgaccaggcatttgaggaccggctgaaggaagccgaacgagaggttatggatttgctgcgggaggcccaggacgtcaaggatgtggaccagaaccttatggaccggctgcagcgtgtgaataacacactgtcttcccaaatatcccgcttgcagaacattcgaaataccatagaggaaaccggaaacctggctgaacaggctagagcacacgtcgaaaacactgagcgcttgattgagatcgccagcagggagctcgagaaggctaaagtggctgccgctaacgtctccgtcactcagccggagtcaaccggggaccccaataatatgacgcttctcgccgaggaggcaagaaagttggctgagcgacataaacaggaggccgacgacattgtgcgcgtcgctaaaaccgcaaacgacacatccacggaggcttacaatctattgcttaggacattggctggggagaaccagaccgctttcgaaattgaggaactgaatcggaagtacgaacaggcgaagaacatttcacaggacctggagaagcaggccgctcgcgttcacgaggaggcaaaacgggctggtgataaagcagtggagatctatgctagtgtggcacaactatcccccctggatagcgaaacgctcgagaacgaggccaataacattaaaatggaagcggaaaacctcgagcagttgatcgatcagaaactcaaggattacgaggacttacgggaggacatgcgcggtaaggagcttgaagtgaaaaatctcttggaaaagggcaagacagagcagcagacagcagatcagctcctcgccagggcagacgctgccaaggcccttgctgaggaagcagcaaaaaaagggagggatacactgcaggaggcaaatgatatactcaataacctgaaggacttcgacaggagagtaaacgataacaaaaccgcagcagaggaggcgctgcgaaaaattccagcaattaaccagacaatcacggaggccaatgaaaaaaccagggaagcacagcaagcactggggagtgcggcagctgatgctaccgaggcaaaaaataaagctcatgaggccgagcggattgcgagtgccgtgcagaagaacgccacctcaaccaaagccgaggctgagagaacttttgcagaagtgacagatttggacaatgaagtgaataatatgctcaagcaacttcaggaggccgagaaagagctgaagaggaagcaagacgatgccgatcaggacatgatgatggccggtatggcatcacaggccgcacaggaggccgagatcaatgctcgtaaggctaaaaactctgttacttcactgctgtcgatcatcaacgacctgttagagcagcttggccagcttgacaccgtcgatttaaataagcttaacgaaatagaggggactctgaacaaggccaaagatgagatgaaggtctctgacctggacaggaaagtttcagatctggagaatgaggccaaaaaacaggaggctgctatcatggattataaccgggacatcgaagagattatgaaagatattaggaacctggaagacatccggaaaactctaccttccgggtgttttaacacccccagcatagagaagccttag

SEQ ID NO: 228113 - DNA, 3582 bp, Artificial Sequence
  Description of Artificial Sequence: Synthetic coding sequence
atgcccgctctctggcttggatgttgcttatgcttttccctgttgctgccagcagccagggccaccagtaggagggaagtatgtgactgtaacggaaagtctagacaatgtattttcgacagagaacttcatagacagactggtaacggttttaggtgcctgaactgtaatgacaacactgatggcatccattgtgaaaaatgcaagaacgggttttacaggcatcgagaacgagatagatgtttaccatgcaactgtaactcaaaaggctctctgtctgctcggtgcgacaacagcggacgctgttcgtgcaagccaggtgttacaggtgcccgttgcgatcggtgcctgcctggatttcacatgctcactgacgccggatgcactcaggatcagagactgctggattccaaatgcgattgcgaccccgcaggcatcgccggaccttgtgatgctggtaggtgcgtgtgtaagcccgctgtgactggcgaacggtgcgaccgctgcagaagcggatattacaatctggacgggggaaaccccgagggatgtactcagtgtttctgttatgggcacagtgcctcttgccgcagctctgccgaatattccgtgcacaagattacctccacttttcaccaagatgtcgacggttggaaggcagtgcagcgcaacgggagtccagccaagctgcaatggtctcagaggcaccaagatgtgttttcttctgcgcagagattggatcccgtgtactttgttgctcccgctaaatttctggggaatcagcaagttagctacggacagtcactgtcattcgactaccgcgtcgaccgcggagggcgacacccgtctgctcatgacgtgattctggaaggagctggtcttaggattactgcccctttgatgcccctcggcaagactttgccctgcggacttactaagacctacacatttcggttgaatgaacatccaagtaataattggtcacctcagcttagttactttgagtatcggagactgttacgcaacctcactgcgctcagaatcagagctacttacggtgagtactcaactgggtatatagacaatgtgactctgatttcagccagaccggtttccggcgctcccgctccctgggtagagcagtgtatatgccccgtaggctataagggacaattctgccaagactgtgcctcgggctataagcgagattccgcgagacttgggccattcggtacctgtatcccttgcaattgccagggcggaggcgcttgcgatcccgacactggggattgttatagtggagatgaaaaccctgatatcgagtgtgcggactgccccattggattctataacgacccccatgatcccaggagttgcaaaccttgcccatgtcataatggctttagctgttccgtgatgccagaaaccgaggaagtggtttgcaataactgtccccctggggtgaccggcgctagatgcgagctctgcgccgacggctactttggagatcccttcggtgagcacggccctgttcgtccctgtcagccatgtcagtgcaacaacaatgtggaccccagtgcgtccggtaactgtgataggctgaccggaaggtgcctaaagtgtattcacaataccgcaggtatttattgtgaccagtgtaaggccggatactttggggacccacttgctcccaaccccgcagacaagtgtagggcatgcaactgtaaccccatggggtccgaacctgtggggtgcagatccgacggtacgtgcgtatgcaagcccggttttggtggtcctaattgtgagcacggtgcctttagctgtcccgcatgctataatcaggtgaaaattcagatggatcagtttatgcagcagttgcaacgcatggaagccctgatcagcaaggctcaaggaggagacggggtcgttcccgataccgagttagagggcaggatgcagcaagcagaacaagccctgcaggacattcttagggatgcacagatctccgagggagcatcgcgatccttaggcttgcagctagccaaggtgaggagtcaagaaaacagctaccagtcaaggctggatgacctcaaaatgactgtggagagggtgcgtgcgcttggttcccagtatcaaaacagagtcagagatactcacagactgatcacacagatgcagctgtctctggctgagagcgaggcaagcctggggaacactaacataccagcgagcgatcactacgtgggcccaaacggtttcaaaagcctcgcacaggaagcaacccgactcgcagagagccatgtcgagagtgcttcaaacatggagcagctcacccgagagactgaagattactcgaagcaggccctaagcctcgtgaggaaggctttgcacgagggggttggttctggatcaggctcgccagatggcgcagtggtgcagggattggttgaaaagctcgaaaaaactaaaagtcttgcacagcagctgacccgcgaggccacccaagctgagatcgaggccgatcgaagctatcaacacagcctccggcttctggattccgtgtccagactccaaggcgtgagtgatcagagcttccaagtagaagaagcgaagcgaattaagcagaaggccgacagcttaagctctttagtcacacggcatatggacgagtttaagcgtacacagaaaaatcttggcaattggaaggaagaagcgcagcagctcctacaaaatggcaaaagcggccgagagaaatcagatcagcttctgagcagggctaacctggctaagtcacgggctcaagaagccctgtctatgggcaatgccaccttctacgaggtggagagcattctgaagaatctgcgggaattcgacttgcaggtagacaacaggaaggctgaggccgaagaagcaatgaaaaggctttcgtatataagccagaaggtgtcagacgcatccgataagactcagcaagccgaacgtgcgctgggatcagccgcagcagatgctcaacgcgctaagaacggtgcaggcgaggccctggagatatccagtgagattgaacaggagatagggtctctgaatctggaagctaatgtcacagccgacggagcactggctatggagaaaggattagcctcactgaaatctgagatgcgggaggttgagggtgagctggaaaggaaggagttggagttcgatactaatatggacgcggtacagatggtgatcacagaagcccagaaggtagacactcgtgccaagaacgccggtgtcacgatccaggatactctaaacaccctggacggactcctgcacttaatggatcagccattatctgttgacgaggaaggcctcgtgctgttagagcagaagttgagtcgcgctaagacacagattaatagccagctccgaccgatgatgagcgaactggaggaacgtgcacgccagcagcgcggtcaccttcacctgctcgaaacctctatcgatggaatcctggcagacgtaaagaatctggagaatatcagagacaacctcccccctggctgctacaatacccaagccttagaacagcagtag

SEQ ID NO: 228114 - DNA, 3336 bp, Artificial Sequence
  Description of Artificial Sequence: Synthetic coding sequence
atgccagccttatggctgggctgttgtttatgtttcagcttactgctgcccgcagcgagggccaccagcaggagggaagtctgtgactgtaacgggaagtcaagacagtgtattttcgacagagagctgcatcggcaaacgggtaatggtttccgctgcctgaactgcaacgacaacactgatgggatccactgtgagaaatgtaagaatgggttctaccgccacagagaaagagataggtgtctgccgtgtaattgtaactctaagggatccctctccgcacggtgtgataactccggtagatgttcttgtaagccaggtgtgacaggagcaaggtgcgataggtgccttccgggtttccatatgctgaccgatgccggatgtacacaagaccagagactgcttgatagcaagtgtgactgcgatccagccggaatcgcgggtccttgcgacgcgggaaggtgtgtgtgtaagcccgcagtcactggcgagcggtgcgatcgatgccggtctggctactacaaccttgatggcggtaaccccgaaggctgtactcaatgcttctgttacggtcattcagcgagctgtcgctcctctgcagagtattctgtgcacaagattacctcaacatttcaccaggatgtagatgggtggaaggccgttcagagaaatggtagcccagctaagctgcagtggagtcaaaggcaccaggatgtattctcaagcgcgcaaaggctcgaccccgtttactttgttgccccagccaagttcttgggcaatcagcaggtttcctacggccaaagtctgagttttgattaccgagtggaccggggaggcagacaccccagcgcacacgacgtgatactggagggcgcaggtctgcggatcaccgcaccactcatgcctctcggaaaaaccctcccctgcggattaacgaaaacatatacttttcgcctgaatgagcacccctcaaataattggtccccgcagttgagctattttgagtatcgcaggctgttacgcaatctcaccgcgcttcggatccgggctacttacggcgagtacagcacagggtacattgacaacgtgacacttatcagtgccaggcctgtttctggggctcctgctccatgggtcgaacagtgtatttgcccggtgggatacaaaggccagttctgccaggactgcgcgtccggctacaaaagggatagtgcccgactgggaccttttggaacctgcatcccctgcaattgtcaggggggtggcgcatgtgaccccgacacaggagattgttatagtggggatgagaaccctgacatagaatgtgcagactgcccgattgggttctacaacgacccccacgatccacgatcctgcaaaccctgtccctgccataatggcttcagctgctctgtgatgcctgaaaccgaagaggtggtgtgcaataattgtccaccaggggtgaccggcgcacgttgcgagttgtgtgccgatggctattttggcgatccctttggggagcacggacccgtgcgcccttgccagccgtgtcagtgtaacaacaatgttgatccaagtgcatctggcaactgcgatagactgaccgggaggtgcctgaagtgcatccacaatactgcaggtatctactgcgatcaatgcaaggctggttattttggtgacccactcgctccaaatccagcagacaaatgtcgtgcatgtaactgtaaccccatgggctccgagcctgttggctgtcgaagtgacgggacctgtgtttgtaagccagggttcggcggacctaactgcgagcacggtgctttctcctgtccagcatgttacaaccaggtgaaaattcaaatggatcagtttatgcaacaacttcagcgaatggaggctcttatttccaaggctcagggcggagacggggttgtgcctgacacggagctggagggccgtatgcagcaggctgaacaggccctgcaggatattctacgcgacgcgcagatctctgagggcgcaagccgcagcctaggcctccagcttgctaaggtccggagccaagaaaactcatatcaatcacgcctggatgatctgaagatgacagtggagcgagtgcgtgccctggggagtcagtaccaaaacagagtaagggatacacacaggcttatcactcagatgcagttgagtctagccgagtccgaggcgagtctggggaatacgaacatccccgcttctgatcactacgtcggtcccaacggattcaaatcactggcccaggaggcgacacgattagctgagagccatgtcgaaagcgcctctaacatggaacagctaacccgggagactgaagactacagcaagcaggctctgagtctggtccgcaaggccctgcatgaaggagtgggatcagggagtggtagtcccgatggtgccgttgtccaggggttggttgagaagcttgagaaaacaaaatctctggcgcagcagctcactagggaggcaacccaggccgagatagaagccgaccgctcctatcaacatagcctacggttgctggattcagtctcccgcctccaaggggtgtctgaccagtctttccaagtcgaggaggccaagcggatcaagcagaaagctgattcacttagtagcctcgtcacacgccacatggatgagttcaagcggactcagaaaaacctgggaaattggaaagaggaggctcagcagctactccaaaatgggaaaagtggcagggaaaagagtgaccagctgctgtcaagggcaaatctcgccaaaagtagggcccaggaggcgttgagtatgggaaacgccactttctatgaggtggagtccattttgaaaaacctgagagagttcgatttgcaggtggataacagaaaggcggaggctgaagaagctatgaagaggctctcttacatctctcagaaggtcagtgacgcgagcgataaaacccagcaagcggaacgggcactcggatcagctgcggctgatgcccagcgcgctaaaaacggcgcaggagaggccctggaaatctcaagtgagatagagcaggagataggctccctgaacctggaggccaacgtgactgcagacggggcattggccatggagaagggcctggcttctctgaaaagcgagatgagagaggtggagggggagctcgaacgaaaagaactggaattcgataccaatatggacgctgttcagatggtcattactgaggcacagaaggtggacacccgcgcaaagaacgcaggcgtgaccatacaggacaccctgaataccctggacgggctcctacaccttatgggtatgtag

SEQ ID NO: 228115 - DNA, 3033 bp, Artificial Sequence
  Description of Artificial Sequence: Synthetic coding sequence
atgccggcactatggctcgggtgttgcctctgcttctcgctgttgttgcccgctgctagagccactagcaggagagaggtatgcgattgtaatggcaagagccgtcagtgtatcttcgatagggaactgcatcgacaaaccggcaacggctttaggtgtctaaattgtaatgataacacagacggcatacactgcgaaaagtgcaagaatggtttctatcgacaccgcgagagggacaggtgtcttccttgtaactgcaacagcaagggaagtctatccgccaggtgcgacaactccggcaggtgttcatgcaaaccaggcgtgacgggcgcacggtgcgaccgctgcttgcctggcttccatatgctcactgatgccggatgtacacaagaccagaggcttctcgattcaaaatgcgactgtgacccagcagggatcgccggaccatgcgacgccggaaggtgcgtgtgtaaaccagcagtgacaggcgaacggtgtgaccggtgccggtccggctactataacttggacggtggcaaccccgaggggtgcacccagtgcttctgctatggacactcagcctcctgccggtcgagcgcagaatactccgtgcataaaattacatccactttccatcaggatgttgacggttggaaggctgtacaaagaaatggatcacccgcaaaattgcaatggtcccagcggcaccaggacgtcttttctagcgcccagcgcctcgacccagtgtatttcgtcgcccctgccaagttcctcggaaaccagcaggtatcctatggtcaatctctttccttcgattaccgcgtagatcggggtggccgtcacccaagcgcccacgatgtgattttggagggagcgggactgaggattacagcacctcttatgccactcggcaagaccctgccgtgcgggttgacaaaaacgtataccttccggcttaatgagcacccgagcaacaattggtcaccccaattgtcatacttcgagtataggagactactgaggaacctgactgcgctgcgaatcagggctacttatggtgagtacagcacgggatacattgataacgtgacactcattagcgcgcgacccgtgagcggagccccagcaccttgggtcgagcagtgtatctgtcccgtcggatacaaggggcagttttgccaggattgcgcatctggttacaagagagactctgcgcgtctcggcccattcggcacctgtatcccatgtaattgccagggcggaggagcctgcgatcctgatacaggtgattgctacagtggcgacgaaaaccctgacatcgagtgtgctgattgccccatcggcttctacaatgacccgcacgaccccaggagctgcaagccatgcccctgtcataatgggttcagctgcagtgttatgcccgagacggaggaggttgtttgcaacaattgtccccctggtgtgaccggcgctcgatgcgagctttgcgctgacggatactttggcgacccttttggtgaacatggtcctgtgcggccatgtcagccatgtcaatgtaataataacgttgatcctagtgcatcagggaactgcgaccggctgaccggcaggtgccttaagtgcatccataatacagctggcatatactgtgatcagtgtaaagccggttatttcggcgacccactggctcctaacccggcagataaatgtcgcgcatgtaactgtaatcccatgggatccgagccagtcgggtgtcgaagcgatgggacgtgtgtgtgcaaacctggttttgggggacctaactgtgaacacggtgctttctcttgtcccgcatgttacaaccaggttaaaattcaaatggaccagtttatgcagcagctgcagagaatggaggccctcatttccaaagcccagggcggagacggagtagtccctgacactgagttggaaggtcggatgcagcaggctgaacaagccttacaagatatcctcagggacgcgcaaatttctgaaggggcttctcggtcactcgggctgcagctcgcaaaagtgaggagccaagagaatagctaccaatccaggctggacgacctaaagatgactgtggagcgggtgagggcactgggctcacagtatcaaaatcgtgtgagggatacacatcgcctgattacacagatgcagctgtctctggcggagtccgaagctagcctgggcaacacaaatattccagctagcgatcactacgtgggcccaaacggattcaaaagcttagctcaggaagctacaaggctagcggagtctcacgttgagagcgccagcaacatggaacagctcactcgggagaccgaagactattcgaagcaggcactctccctcgttagaaaagcgctccatgagggtgtgggtagcggctctggaagtccagacggcgctgtagtgcaaggactggttgagaaactggagaaaaccaagagcctggcccagcagctcacgcgggaagctacccaggccgaaattgaagcagatcggtcttaccagcacagccttcgacttctggactccgtaagccggctgcagggcgtttccgatcaatctttccaggtggaggaagctaaacggatcaagcaaaaggccgacagcctgtctagcctggtcaccagacacatggatgagttcaagaggacacagaaaaacctcggcaattggaaagaagaggcccagcaactgctgcagaatggaaagagcgggagagaaaagtcagaccagctgctcagtcgggctaacttggcaaaatctcgggcacaggaggccctctcgatggggaacgcgactttctacgaggttgagtcaatccttaaaaacctccgggagttcgacctgcaggtagataaccgaaaagccgaagccttccctagtcaggacccagatcagcagcctaccgcagcccacgacgtcagagccggtcgcgaaggaactagcgccgagggccctcccccattcgcaggggataagcacaggtgggactcgggatag

SEQ ID NO: 228116 - DNA, 1590 bp, Artificial Sequence
  Description of Artificial Sequence: Synthetic coding sequence
atggctgccgcagccttgctgctggggctggccttattggcacccagagctgctggagcaggcatgggcgcttgctacgatggagcaggtcgtcctcagcggtgtcttccggtgttcgaaaacgccgcatttgggagactggcgcaggcctcacatacatgcggctcccccccagaggacttctgccctcatgtgggggcagcaggcgcaggcgcacattgccagaggtgcgacgctgccgaccctcaacgccaccacaatgcctcatacttaaccgattttcactcacaggatgagtcaacttggtggcagtcaccctcgatggccttcggtgtccagtaccccactagcgttaatatcacactcaggcttgggaaagcgtacgaaattacctacgttcgtctaaaatttcacacctcgcgtcctgagtctttcgcaatttataaaagaagcagggccgacggcccttgggaaccctatcaattttactccgcatcctgccagaagacgtacggacgaccagaaggccagtatctcagaccaggtgaggatgagcgagtcgccttctgtaccagtgaattttctgacattagccccctctccggcggaaacgtggcattttctaccctcgaaggcagaccgagtgcttataatttcgaggagtcgcctggcctgcaggagtgggtcacatctactgagctgctgatcagtctcgaccgcctcaacaccttcggtgatgacatttttaaagaccctaaggtcctgcaatcgtactactacgccgtgtctgatttcagtgtgggcggacgttgtaaatgtaacggccacgcctccgagtgcggtccagacgtggccggacagctcgcctgcaggtgccagcacaacaccacaggcaccgattgcgaaagatgtctacccttttttcaggaccgaccctgggctcgcggaaccgctgaggccgctcacgagtgtctgccttgcaattgctccggacgaagcgaggagtgcacatttgatcgagagctgttccggtccaccggtcacggcggaagatgccaccattgtagggaccatacggctggtcctcactgtgagagatgtcaggagaatttctaccactgggatcctcggatgccttgccagccatgtgactgtcagtcagccggttctctgcacctgcagtgtgacgatacaggtacatgcgcctgcaaacctaccgtcactggctggaagtgcgatagatgtctgccaggctttcatagcctctcggaaggtggctgtaggccgtgcacctgcaatcctgccggaagcctggatacctgtgatccgagaagcggaagatgtccctgtaaagagaatgtagaaggaaacttgtgtgaccgctgccggcctggcacctttaacttacaaccccacaatcctgccggtcgttcctgtagatcaagggcttctagagtgaccagtcccaggtcagctccaactaatcgcacgtggagacccttctgcacagcctgccccagaactgtgcccgctggtagcgagggttgccctgatccacggcataccctgccgcaccttctcttcacgtag

SEQ ID NO: 228117 - DNA, 4728 bp, Artificial Sequence
  Description of Artificial Sequence: Synthetic coding sequence
atggccgctgccgcactgctccttggccttgctctgctggctccacgggcagcgggagctggcatgggggcttgttacgatggagcaggacggccacagcgttgtttgcctgtgtttgagaacgcagcatttggcaggctagcacaggccagccatacgtgcggatcacctcccgaggatttttgtcctcacgtgggagctgccggtgcgggagctcactgccagcgttgcgacgcagccgaccctcaaaggcaccacaatgctagctatttgactgactttcattcgcaagatgagtctacttggtggcagtctccaagcatggcctttggcgtccaataccccacaagcgtgaacatcactctccgtttgggcaaggcgtatgagattacatacgtgcggctgaagttccatacttcccggcctgagtcctttgccatctacaaaagaagtcgcgcagatgggccatgggaaccctatcagttctactctgcttcctgccaaaaaacctacggacggcctgaaggccagtatctgcgacctggggaggacgagcgcgtcgccttctgtacaagcgagttttcagatatctctcccctgtccgggggaaacgtggcgttctccacgctagaggggagaccatcagcctataattttgaagaaagccctggtctgcaggagtgggtgacatccacagaactgcttatctctctggaccggctgaacacatttggagacgacatatttaaggatcctaaagtgctgcagtcatattactacgctgtatccgacttcagcgtcgggggtcgatgtaaatgtaatggacatgccagcgagtgtggacccgacgttgccggacagctggcttgccggtgtcagcacaacactacagggaccgactgtgagcgctgcctgccgttcttccaagatagaccctgggcaaggggcacagccgaagctgcacatgagtgtctgccatgtaactgtagcgggagatccgaagaatgtacctttgaccgtgagctcttccgctccacagggcatggcggacgctgccaccactgcagagaccacacagccggaccacattgcgagagatgccaagaaaatttttaccactgggatcctcggatgccatgccaaccttgcgactgccagagcgctggatcgttgcatctgcagtgtgatgataccggtacgtgcgcctgcaaaccaacagttaccggctggaaatgtgacaggtgcctgcccggattccatagtctgtccgaaggtgggtgtcggccttgtacctgtaatcccgcaggctcactggatacctgcgatcctaggtccgggcgatgtccttgtaaggaaaacgttgagggaaatctgtgtgatcggtgccgccctgggacttttaatctgcaaccacacaaccctgcgggatgcagtagttgcttctgctatggtcactctaaggtctgcgcatcaactgctcagttccaagtccaccatattctgagcgactttcatcagggcgctgaagggtggtgggcaaggagcgtaggcggtagtgagcatcctccacaatggtctcccaacggggtgctgctgagcccagaggacgaggaagagctgactgcccctgagaaattcttgggagatcagaggttcagttacggccagccactcatcttgacttttcgagttcccccaggcgactccccactccctgtacagctgagactagaaggaaccgggttggctttaagcctgagacactctagcctttctggaccacaggatgcgggacacccaagagaagtcgaactacgcttccatctacaagagacgtcggaggacgtggcaccccctctgccgcctttccactttcagcggctcctcgctaatctaaccagtttaaggctgagggtctctcccggtcccagccccgcaggcccagttttccttactgaggtgcgcctgacctcggcacggcctggtctatctccccctgcgtcctgggtggaaatttgttcctgtccaacaggatacaccggacagttttgcgaaagttgcgcacccggttacaagagagagatgcctcagggaggcccatacgccagctgtgtgccctgcacatgcaaccagcatggaacctgcgatcccaacaccggaatttgcgtttgttcacaccacactgagggccctagttgtgaacgctgcctgccaggattttatgggaaccccttcgcaggccaggcagatgattgccagccctgtccctgtcccggacagagtgcctgcacaaccattccagagtctcgtgaagtcgtgtgtacacattgtccgcctggccagcgcggaaggcggtgcgaggtatgcgacgatggattcttcggagatcccctgggcctcttcggccatccccagccctgccatcagtgtcagtgcagcggaaacgtcgatccaaatgcagttggaaactgcgatccgctgtctggccactgcctcagatgtttgcacaataccaccggggatcactgcgaacactgccaggagggcttctacggcagcgcccttgcgcctcgcccagcggacaagtgtatgccatgtagctgtcatcctcagggttcagtgagcgaacaaatgccttgtgatccagtgactggacagtgttcatgcctcccccacgtcactgccagagactgtagccgttgctatccgggattctttgacctccagcccggacggggatgtcggtcatgcaagtgtcaccctctggggtcccaggaggatcagtgccacccaaaaaccggccaatgcacttgtaggccgggagttaccgggcaagcttgcgacaggtgccaattgggtttttttggatttagcatcaagggatgcagggcatgtcgatgctcaccgctcggggcagcctccgcccaatgtcacgagaatggtacctgcgtgtgtcgacccggatttgagggctacaaatgcgataggtgtcatgataatttttttctcacggctgacgggacacattgtcagcagtgtccttcttgttacgctctcgtgaaggaagaagctgctaagctgaaagctagactgaccctgacagaaggttggcttcaaggttcagattgcgggtcaccttggggcccactggatatcttgctgggcgaagctcctcgaggagacgtgtatcaaggacatcatctcctgcctggtgcacgggaggcctttctggaacagatgatgagtctggagggtgctgtcaaggccgctcgggagcagctgcagaggctgaacaagggtgccagatgtgctcaagctgggagccagaaaacttgcacacaattagccgatttagaagctgtgctggagtcttctgaagaggagatattacacgccgcagccatactggcctctttggaaatcccccaggagggcccaagccagcctacaaagtggtcccacctcgctacagaagctcgcgctctggctcggtctcatcgcgacaccgctaccaagattgccgctaccgcttggcgcgctttgttggcttccaatacctcttatgcccttttatggaacctgctcgagggccgagtcgctctggaaacccagagagatctggaagaccgataccaggaggttcaggctgcccagaaggcgctgcgaacggctgtagctgaagtgcttccagaggctgagtctgtccttgccacagtccagcaggtgggcgcagacactgcaccttatctggcactgctggccagccccggagctcttccgcagaaaagtcgcgcagaggatttaggactgaaggccaaggctctcgaaaagactgtggccagctggcagcatatggcaaccgaggccgctcgcaccctccagaccgcggctcaggccactctccgacagacagagcctcttacaaagctccaccaggaagctcgagcagccctcacacaggcttccagtagcgtgcaggcagctacggtgaccgtgatgggtgctcgcacgctgctggcagatctcgagggtatgaaattgcagttccccaggcccaaggatcaggctgccttacagagaaaggccgacagcgtgagcgaccggctgctggccgacaccagaaagaagacaaaacaggcggaacgaatgctgggaaacgccgcaccactaagttcctcggctaaaaagaaaggacgggaggcggaagtgctagccaaggatagcgccaaactggcaaaggcgcttctgagagaacgcaagcaggctcatagacgtgcatcaaggctaacatctcagacccaggccacgctccaacaggcttctcagcaggttctggcgtcggaggctaggaggcaagagctggaggaggctgagcgcgtgggtgccggtctgtccgaaatggagcaacaaatccgggaatctcggatatcattggaaaaggacattgaaacactaagcgagctcctcgcgagactcggtagcttagatacacatcaggctcctgcccaggctctgaacgagacgcagtgggccctcgagcgcttacgactccaactgggaagtccaggcagtctccagaggaagctgagcttactcgaacaagagtcacagcagcaggagctgcagattcaggggtttgagtcggacctggccgagatccgagccgataagcagaatctcgaggctattctgcactctctccccgagaattgtgcgtcgtggcagtag

SEQ ID NO: 228118 - DNA, 459 bp, Artificial Sequence
  Description of Artificial Sequence: Synthetic coding sequence
atgcggctgccattgtcacattcacccgaacacgtcgagatggcacttttgagcaacattttggctgcctattcctttgtcagcgagaatcctgagcgcgcagcgctctactttgtgagcggggtgtgcatcgggctggtgctaaccctcgccgctctggtgatcaggatttcctgccacactgactgcaggagacgaccgggaaagaagttcctccaagatcgtgagtcctctagtgactcatcggactctgaagatggaagcgaggacacggtctcagatctctccgtcagaaggcataggaggtttgagcgcacacttaacaagaatgtgtttacatccgcagaagagttagaaagagcacagcgcctggaggaaagggagaggattataagagagatatggatgaacggtcagcccgaagtgcctggcacgcggtctttgaatagatactactag

SEQ ID NO: 228119 - DNA, 1200 bp, Artificial Sequence
  Description of Artificial Sequence: Synthetic coding sequence
atggctcaacgcgctttcccaaacccttacgcagattataacaagagcctggccgaaggctatttcgatgctgccggtagactgactccagaattctctcagaggttaacaaacaaaattagagaactgctgcagcagatggagcgcggactgaaaagcgccgaccctagggatgggacaggatacactgggtgggcaggtattgcagtcttgtatcttcacctgtatgatgtgttcggggaccctgcttatcttcagctggcccatggctacgttaagcaatcactgaactgcttaacaaaacgctctattacctttctgtgtggagacgcaggcccacttgcggtcgcagccgtgctgtaccacaagatgaacaatgaaaaacaagcggaggattgcatcacccgtctgatacatttgaataagatagatccacatgcacccaatgaaatgctctacggtcgaattggctatatctatgccctacttttcgtgaataagaattttggcgtggagaaaatcccgcagtctcatatacagcagatctgtgaaaccattctgactagcggtgaaaacctggctcgcaagagaaatttcaccgccaagagtcccctgatgtatgagtggtatcaggaatactacgttggcgcagcacacggactcgcaggcatctactactacctgatgcaaccctctcttcaggtgagtcaggggaaacttcactcgttagttaaaccgagcgtggactacgtgtgccaattgaagttcccctccggtaattaccccccatgcattggcgacaatagagatctactagtccactggtgccacggagcccctggcgttatttatatgcttatccaggcgtacaaggtattccgggaggaaaaatatctgtgtgatgcatatcagtgcgcggatgtgatctggcagtatggcttgttgaaaaagggttacggattgtgccacggatctgccggtaatgcctatgcgtttttgaccctttacaatctcacccaggatatgaaatacttatatagagcctgtaagttcgcagagtggtgcctggagtatggagaacatggctgcagaacccctgatacccccttttctctcttcgaaggcatggcgggtactatctactttctggccgatttgctcgtgcccaccaaggcgcgttttccagccttcgaactctag

SEQ ID NO: 228120 - DNA, 1200 bp, Artificial Sequence
  Description of Artificial Sequence: Synthetic coding sequence
atggcccagcgcgcatttcctaatccatacgctgattacaataagtcactggctgagggatacttcgacgcggctggtaggctcaccccagagttctcacagaggctgaccaacaagatccgagaattactgcagcagatggagcgcggtctcaagtctgccgatcctcgggatgggacagggtacaccggatgggctgggatcgccgtgctatatcttcacctgtacgacgtgttcggcgatcctgcctacctacaactcgcccacgggtatgtcaagcagtcgctcaattgcctaactaagagatcaattactttcctatgtggagacgctggccctctggcagtagcagctgtgctttatcacaaaatgaataacgaaaagcaggcagaagactgcataacaaggcttatccatctcaataagatagacccgcacgccccaaacgagatgctgtacggcagaatcgggtatatctatgctctgttgtttgtgaataaaaatttcggggttgaaaaaattcctcaaagccatatccagcagatctgcgaaacgatactcacctcaggagagaacctggcacgtaaacgaaattttactgccaagagcccgcttatgtacgaatggtaccaagagtattacgtcggcgctgcccacggactggctggaatttactattacctgatgcagccctctctgcaggtcagccaggggaagcttcactcactcgttaaaccatctgtcgattatgtatgccaattaaagtttccctctgggaactatcctccatgcattggggacaatagagatctcctggtccactggtgtcatggcgcaccaggtgttatttacatgcttatccaggcgtacaaagtgttcagagaagaaaagtacctctgtgatgcctaccagtgcgccgatgttatctggcagtatggccttcttaaaaaagggtatggtctctgccatggcagcgccggaaatgcttacgcctttctgacattgtataatctaactcaagatatgaagtatttgtaccgtgcatgcaagttcgcagagtggtgtctggaatatggcgagcatggttgcagaactcctgataccccattctcactgtttgaggggatggccggtacgatttatttcttagcagacctgttggtcccaaccaaagctagatttccagcattcgagctctag

SEQ ID NO: 228121 - DNA, 1200 bp, Artificial Sequence
  Description of Artificial Sequence: Synthetic coding sequence
atggcgcagagagcctttcctaacccgtacgccgactacaacaagtcgctcgctgagggttacttcgacgccgctgggaggctgacacccgagttttcacagcggctgacgaacaaaattagggagctcttgcagcaaatggagcgaggactgaaatctgccgatcctagggatgggactgggtatacgggttgggcgggaattgctgtactctatttgcacttgtacgacgtgttcggcgaccctgcctatctgcagcttgctcatgggtatgttaagcagagccttaattgcctgacaaagcggagcatcacatttctctgcggggacgctggccctttggccgtcgccgcagtgctttatcacaaaatgaataatgagaagcaggccgaggactgtattacacggctgattcacctgaacaagattgacccacatgcgccaaatgaaatgctctacggtagaatcgggtatatttacgccctactctttgtaaataagaacttcggcgtggagaaaattccacagtcgcacattcaacagatctgtgaaacaatactgactagtggggagaacctcgcaaggaaaagaaacttcacagccaaaagtcccctgatgtatgaatggtaccaggagtattacgttggagctgcgcacggtctggctgggatttactactacttgatgcaacccagtctgcaggtttctcagggcaaactgcatagtcttgttaaacccagtgtcgattatgtttgccagctgaagttcccttctgggaactacccgccatgcattggtgacaacagggacctgcttgtgcactggtgccacggggctcctggcgtaatctatatgctgattcaggcatataaggtcttcagagaagagaaatacctgtgtgacgcctaccaatgtgcagacgtgatctggcagtacggcctgctgaaaaaggggtacggactgtgccacggcagtgcaggtaacgcctacgcctttttgactctttacaatctgactcaggatatgaaatatctgtatcgagcatgcaagtttgctgagtggtgtctcgagtatggagagcacggatgtagaacacccgatacaccattttccctcttcgagggcatggctggcactatttattttctggccgacctgcttgtgccaaccaaggccaggtttcctgccttcgaactctag

SEQ ID NO: 228122 - DNA, 591 bp, Artificial Sequence
  Description of Artificial Sequence: Synthetic coding sequence
atggcgcagagagcattccctaacccgtacgccgattacaataagtctcttgctgagggttactttgatgcggctggaaggctgacccccgaattctcacaacggctcaccaataagatacgcgagctactgcagcagatggagcggggtctaaagtctgcggacccacgtgacgggaccgggtacacggggtgggccggaatcgctgtgctttatttgcacctttacgatgttttcggggatccagcttatttgcagctcgcccatggttacgtcaagcagagcctcaactgtctgaccaagaggtctataacgtttttgtgcggtgatgctggaccactcgctgtagcagctgtgttatatcataagatgaataacgagaagcaagccgaggattgtatcacgcgattaatccatcttaacaagatcgaccctcacgcccctaatgaaatgttgtacggcagaatcggctatatctacgcattgttattcgttaataagaatttcggcgtagagaagatcccccagagccatatccaacagatatgtgagacgattctgacgagcggcgagaatctggccaggaagtag

SEQ ID NO: 228123 - DNA, 1200 bp, Artificial Sequence
  Description of Artificial Sequence: Synthetic coding sequence
atggcccagagggcatttcccaacccctacgccgattataataagtcgctcgccgaaggctatttcgacgccgctggtaggctgaccccggaattttcgcagcggctgaccaacaagattcgggagttgctgcagcagatggagcgagggttgaagagcgctgacccacgcgatgggactggctacaccggatgggcaggcatcgctgtgctgtatctacacctgtacgacgtcttcggagaccctgcatacctgcaacttgctcatggctatgttaaacaatcactgaattgtctcacaaaaagatcaatcactttcctgtgtggcgatgccggacccctcgccgttgccgctgtgctctaccataaaatgaacaatgagaagcaggccgaagattgcataaccaggttaattcacctgaataagatcgatcctcacgcacccaatgagatgctgtacggtcggatcgggtacatttatgccttgctgttcgtcaataagaatttcggtgttgaaaagatccctcagtctcacattcaacaaatctgcgagactatactcacgtcaggggagaacctggccagaaagcgcaacttcaccgcaaaatcccccttaatgtacgaatggtatcaggagtattacgtcggggcagctcacggactcgctggcatatattactatctgatgcagccctctttgcaggtcagtcaggggaaactgcattccctggtgaaaccttccgtggattatgtgtgccagctgaaatttccgtccggcaattacccaccttgtattggggacaatagagatttgctggtgcattggtgtcacggggcacctggcgtgatatatatgctcattcaggcctacaaagtcttcagagaggagaaatacctgtgtgacgcatatcagtgcgctgatgtcatctggcagtacggtctgcttaagaaaggctacggtctctgccacgggagcgctggtaatgcctatgccttcctcaccttgtacaacctgactcaggatatgaagtatttgtatagagcatgcaaatttgcagaatggtgcctcgagtacggcgagcatggttgccgtacgcccgacactcccttcagcctgtttgaaggcatggctggaaccatttactttctggccgacctcctggttcctactaaggccagattcccagcattcgagctgtag

SEQ ID NO: 228124 - DNA, 1353 bp, Artificial Sequence
  Description of Artificial Sequence: Synthetic coding sequence
atgggcgaaacaatgagtaagcggctgaagctgcacttgggaggggaggctgaaatggaggaacgcgcatttgtgaacccttttccggattatgaggcagccgctggcgctctacttgcttcaggcgctgcagaggagacagggtgcgtgaggcctccagccacaacggacgagcctggcctgccttttcatcaagatggaaagatcatccacaactttatccggaggattcagactaaaataaaggacctgctacagcaaatggaggagggactgaaaaccgcggacccacacgattgctccgcttatactggatggactggtattgctctgctttatctgcagctgtaccgagtgacttgtgatcagacatacctgctgaggtccctagactacgtcaagcgaactttacgtaatctcaacggaagaagagtcaccttcctctgcggagatgctgggccactggccgtcggggcagtgatttatcataagctcagatccgattgcgaaagtcaagaatgtgtgacgaagctgctgcagcttcaacggtccgtcgtttgccaggaatccgacctgcctgatgagctgctgtatggccgagctggttacctttacgcactcttatatttgaatactgaaattgggccagggaccgtttgtgagtcagctatcaaagaggtggtgaatgcaatcattgaatctgggaagaccctttctcgagaagagaggaaaactgagagatgcccactgttgtatcaatggcataggaagcagtacgtcggcgctgcacatggcatggctgggatctactatatgctgatgcagccggctgccaaagttgaccaggaaacacttaccgaaatggtgaaaccgtccatcgactatgtgagacataagaaattccgaagcggcaactacccatcctccctgagcaacgaaaccgaccggctggttcactggtgtcacggcgctccaggagttatacatatgctcatgcaggcctacaaagtgtttaaagaagagaagtacttaaaagaggcgatggagtgctcggatgtgatatggcagcgcggtcttctgcgcaagggatatggtatctgtcacgggactgcaggcaacggatatagtttcctgtccctgtatcgcctgacacaggacaagaaatacttatatagagcctgtaaattcgccgagtggtgcctggactatggcgctcacggctgcagaatcccagacaggccgtacagcctgtttgaaggtatggctggcgcaatacatttcctgagtgatgtgctgggtccagagacctcaaggtttccggctttcgagctggactcttccaagagagattag

SEQ ID NO: 228125 - DNA, 2199 bp, Artificial Sequence
  Description of Artificial Sequence: Synthetic coding sequence
atgacggagggcacatgtttgcgcaggcgtggaggcccttacaaaacagaacccgctactgacctgggcaggtggaggctgaactgcgagagaggtcgacaaacatggacatacctccaggacgagagagctggaagggaacaaacagggctggaggcctatgccctggggctcgatacaaagaactattttaaggacctcccaaaggcacataccgcgttcgaaggagccctaaacggaatgactttctatgtgggactgcaggcagaagacggacactggacaggagactacggcggacctttgttcctgctccccggtctgctcattacttgtcacgttgccaggattcccctccctgccggatatcgggaagagatagtcagataccttcgctccgtgcagttacccgacggcggatggggactacatattgaggacaagagcacggtattcggcactgccctaaactatgtaagtctaaggatcctgggggtgggccctgacgatcctgatctcgtgcgggcacggaacatcctgcacaaaaaagggggtgcagttgctatccctagctggggcaaattctggttggctgtgctgaacgtatatagttgggaggggcttaatactttgttcccagagatgtggctgtttcctgattgggcccctgcccacccgtccactctgtggtgtcactgcaggcaggtctaccttccaatgagctattgttatgctgtgcgtttaagtgcagcagaagacccgttggtacaaagcctgcgtcaggaactgtatgtggaggacttcgccagcatcgattggcttgcccagcggaacaatgttgcaccagacgagctgtatacccctcatagctggctcctacgggtggtatatgccttgctgaatctatacgaacaccatcactcagctcacctaagacaaagggctgtccagaaactatacgaacacatcgtggcggacgataggtttaccaagtctatcagcatcggtcccatttcaaagacaatcaacatgcttgtgaggtggtatgtggacgggcctgcctccactgcgtttcaagaacacgtgtccagaattcccgactacctttggatggggttagacgggatgaaaatgcaagggaccaacggcagccagatttgggatactgcgtttgctatccaagcccttctggaggcgggtggacaccatagaccagaattttcatcttgcctgcagaaggcacatgaattcttgcgtttaagccaggtccctgacaaccctccagattatcagaaatattacagacaaatgagaaagggcggtttctcatttagtacgctcgactgtggctggatcgttagcgactgcaccgcagaggcgctaaaagcagtgttgttgctgcaagagaaatgtcctcatgtgactgaacacataccaagagaacggctatgcgatgccgtggcggtcctcctgaatatgagaaaccctgacggcggatttgcaacttacgagacaaaacggggtggacatttacttgagttgttgaatccctccgaagtgttcggggatatcatgatcgattatacctacgtggagtgtacatcagcggtgatgcaggcgttaaagtatttccacaagcgctttccagaacaccgtgctgcagaaatacgcgaaacgctgacccagggtctggagttctgccgtaggcaacagcgggctgacggtagctgggagggctcgtggggtgtctgcttcacatacggtacgtggtttgggctggaggctttcgcttgtatgggccagacctaccgagatggcaccgcatgtgctgaagtttcccgtgcgtgtgactttcttctttcgcggcagatggctgacggcggatggggagaggatttcgagtcatgtgaggaaagacgctacctgcaatccgcccagagccagatccataatacctgctgggccatgatgggcctcatggccgtccgacaccctgacatcgaggcacaagagcgcggtgtaagatgtcttcttgagaaacagctgccaaacggtgattggccgcaggagaacatcgccggagtctttaataagagttgtgcaataagttacacatcgtacagaaacatatttcctatatgggctcttgggagattttctcaactctatcccgaacgcgctctcgcgggacacccgtag

SEQ ID NO: 228126 - DNA, 2199 bp, Artificial Sequence
  Description of Artificial Sequence: Synthetic coding sequence
atgaccgagggaacatgcctcaggagaaggggcggtccctacaagaccgaacctgctactgatctgggaaggtggagactaaattgtgaaaggggaaggcagacatggacctacttgcaagatgaacgtgccggtcgggagcagaccggcctggaggcttacgccctgggtctcgataccaagaactatttcaaagacctgccgaaggcccataccgcattcgaaggcgctctcaatggtatgacattctacgtaggcttgcaggccgaagacgggcactggacaggcgattatggaggccctcttttcctcctcccaggcctgctgatcacatgccatgttgccaggattcctctgcccgctgggtaccgggaggagattgtccggtatctgcgtagcgttcagttgccagatggagggtgggggctgcacatcgaagacaaaagcaccgtgttcggcacagcactgaactacgtcagtctgagaatcctgggagtggggccagacgacccagacctggtccgcgcacgcaacatcctccacaaaaagggcggtgctgttgctatcccgagctggggcaaattttggctggccgtgctgaatgtgtattcctgggagggacttaatactctcttccccgagatgtggctctttccagattgggctccagctcaccccagcactctgtggtgccattgcaggcaggtgtatcttcccatgtcttattgctacgcggtcagactgagtgccgcagaagatcccctggtgcagagcctcagacaggaattatacgtggaagactttgcaagcattgactggcttgcacaacgtaataacgtggcaccagatgaattgtacacgccacactcctggctgctccgcgtggtgtatgctcttctgaatctgtatgagcaccatcactccgcccatcttcgtcaaagggccgtgcagaagttgtacgagcacattgtggcggatgacaggttcacaaaatcgatctcaatcggccctatcagtaaaaccattaacatgcttgtccggtggtacgttgatggtccggcaagtacagctttccaggagcatgtgtctcgcataccagattatctctggatgggcttggacgggatgaagatgcaaggaaccaatggcagtcagatctgggatactgcatttgccatccaggcgttgctggaggctggtggccaccatcggcctgagttcagttcctgcttgcagaaggcccatgagttcctccgcctgtcccaggtgcccgacaacccccctgattaccagaaatactaccggcagatgcggaaaggcggattctctttcagtacgcttgattgcggctggatcgtgagtgattgcacagcagaagcgctgaaagccgtcctactgctccaggagaagtgtccccatgtaaccgagcacattccgagagagcgcctttgcgacgcagtggctgtgcttctgaatatgagaaatcccgatggagggttcgctacttatgaaaccaaaaggggaggacacctgctggagctactgaacccctccgaggtgttcggagacattatgattgactacacgtatgtggagtgcacatccgcagttatgcaggccctgaaatatttccataagcgatttcctgagcatcgggcagcagagattcgcgagactctgacacagggcttggaattctgccgaaggcagcagcgagccgatgggtcttgggaagggagctggggcgtgtgctttacatatggaacctggtttggcctggaagcctttgcctgcatggggcagacatacagggatggaactgcttgcgctgaggtatctagggcctgcgattttctgcttagccgccagatggctgacggaggatggggggaggacttcgagtcgtgcgaagagcgacgttacctgcagtccgcccagagtcagatacataacacctgctgggccatgatggggcttatggctgtacgccacccagatatcgaagcccaagagaggggtgtaaggtgcctccttgagaagcaactgcccaacggtgattggccccaagagaatatcgctggcgtgttcaataagtcctgtgctatcagctatacatcgtacagaaatatctttccgatttgggcattgggcagattctctcaactgtatcccgaaagggcgctcgccggacacccatag

SEQ ID NO: 228127 - DNA, 1959 bp, Artificial Sequence
  Description of Artificial Sequence: Synthetic coding sequence
atgactttctatgtcggattacaggcggaagacgggcactggaccggggattatggagggccattgttcctgttacccggactcttaatcacatgccacgtagcgaggattcccttgcctgccggataccgcgaggagattgtgcgttatctgcggtccgtgcagcttccagacggaggatggggattgcatattgaagacaagtccactgtctttgggaccgcgttaaactacgtgtctctgaggatcttgggagtgggcccagatgatccggacttggtgcgggctcggaatatactgcacaagaagggaggcgcagtggccattccttcatggggcaagttctggttggcagtcttgaacgtgtacagttgggagggcctgaacaccctgttccccgaaatgtggctatttccggattgggcacccgctcatccctcgaccctgtggtgtcattgccgtcaggtctacctgccgatgtcctattgctacgccgttcgtttatccgcagcagaagaccctcttgttcagtctttgagacaagagctttatgtggaggatttcgcatccatcgattggttagctcagcgaaacaacgtggcaccagacgaattgtacaccccacacagttggctactgagggttgtttatgcccttctgaacctgtacgagcaccaccattctgcccatctccgacagcgggctgtgcagaagctgtacgaacacattgttgcagatgatcggttcactaagagtatcagtatcggccctattagtaaaactatcaacatgcttgtgaggtggtacgtggatggaccggctagcacagctttccaggagcatgtgtcgcgcatccccgactacctctggatgggattggacgggatgaagatgcaaggaaccaacgggagtcagatctgggacaccgcttttgcgattcaagccctgctggaggccggtggccatcatcggcctgagtttagctcctgcttacagaaagcacatgagttcctgcggctaagtcaggtacccgataaccccccagactaccagaaatactatcgccagatgcgcaagggagggttttccttcagcacacttgactgcggctggatcgtatccgactgcaccgccgaagccctgaaggccgtcttactcctgcaggagaagtgcccccatgttacagaacatatcccaagagaaaggctgtgcgacgctgtggcggtcctgcttaatatgcgcaaccctgacggaggattcgctacctacgagactaagcggggtggccacctgctggagctgctcaacccatcagaggttttcggcgatattatgattgattacacttatgtggaatgtactagcgcagtgatgcaagccttgaaatactttcacaagcgctttcctgagcatcgcgctgcggaaattcgggagacgctaacccagggcttagagttctgtagacggcagcaacgggcagatgggagctgggaggggagttggggggtttgcttcacgtatggaacatggtttggactcgaggcatttgcttgtatggggcaaacctaccgggatgggactgcgtgcgccgaggtttcacgggcttgtgactttctgttatcgaggcagatggcagacggtgggtggggcgaggacttcgagtcctgtgaagaacgtagatatctgcagagcgcacaaagtcagatccacaacacctgttgggcgatgatgggtctcatggccgttcgccaccccgacatcgaagcgcaggagcggggtgttcgatgcttactggagaaacagctgcccaacggtgactggcctcaagagaatatcgcaggagtgtttaacaaatcttgcgccattagttatacctcttaccgcaacatcttccctatttgggccctgggccgtttcagtcaactctaccccgaacgggctctagcgggacacccatag

SEQ ID NO: 228128 - DNA, 2166 bp, Artificial Sequence
  Description of Artificial Sequence: Synthetic coding sequence
atgacagagggcacctgcttaaggcgcagaggcggtccttacaaaaccgaaccagccaccgacctggggagatggcggttgaattgtgaaagaggacggcaaacatggacctatctccaagatgagagggccggaagagagcaaactggcctggaagcttacgccctgggacttgataccaaaaactactttaaggacctgccaaaagcccacaccgcctttgaaggcgcactcaacgggatgacattttacgtcggtctgcaggccgaggacggtcattggacgggggattacgggggacccctcttcctgctaccaggcctgctgataacttgccacgtagcgagaattccactacctgccggatacagggaggagatagtgcgatacctgcggcacatcgaagacaaatcaacagtcttcgggacagccttaaattacgtttcccttagaatcctgggcgttggccctgatgacccagatttggtgcgggctcggaacatccttcacaagaaaggcggtgctgtagcaatcccctcttggggcaaattttggctcgccgtgctaaatgtatattcttgggagggcctcaacacgctgtttcccgaaatgtggctgttccctgattgggccccagcccatcccagcactctctggtgccattgtcggcaggtctatctgcccatgtcctactgctacgccgtgcgtctaagcgccgctgaggaccctctggttcaaagtttgagacaggaattgtacgtcgaagacttcgctagtatcgactggctcgctcagcgcaacaacgttgctccagacgagttgtataccccccactcatggctgctgcgcgtggtgtatgccctgcttaatctttacgagcatcaccacagcgcgcatctgagacagagggctgttcagaaactctacgaacacatcgtcgctgacgaccgcttcactaagagcataagtatagggcctatctctaagactataaatatgctggtgagatggtacgttgacggcccagcaagcactgcctttcaagaacacgttagcaggatccctgactacttgtggatgggcctggacggtatgaagatgcaggggactaatggatcccagatctgggataccgcatttgcaatacaggcgcttcttgaagcgggaggccaccaccggcctgagttcagctcatgtctgcagaaggcccatgagtttcttcggctgagccaggttcctgataatccgccagactaccagaagtactaccgtcagatgagaaagggcggtttctctttttccacccttgactgtggttggatcgtctcagactgcacagccgaagcgctgaaggccgtcctcctgctgcaggaaaaatgtccgcatgtgaccgaacacattcccagggagcgtctgtgtgacgccgtcgccgtgctgcttaacatgagaaatccggacggtggcttcgccacgtatgagacaaagcgtggaggccacttactcgaattgctgaacccatctgaagtgtttggcgacatcatgatagattatacttacgtggagtgcaccagcgccgtcatgcaggccctcaagtactttcataagcgattcccggagcatagggctgctgaaatccgcgagacactcacccaaggattggagttttgcagacgtcagcagcgcgcagatggcagctgggagggctcctggggggtgtgctttacatacggcacctggtttgggctggaggcgtttgcgtgtatggggcagacttatagagatgggacagcctgcgctgaagttagccgtgcgtgtgatttcctgttgtcccggcagatggcagacgggggttggggagaagattttgagtcctgtgaggagcggcgatacctccagagcgcacaaagccagattcataatacatgttgggccatgatggggctgatggctgttcgacatcctgatattgaggcccaagaacgcggtgtgcggtgtctgttggagaaacaactgccgaacggagactggcctcaggagaatatcgctggggtgttcaataaatcgtgcgctatcagctacacatcttaccggaatatttttcctatctgggccctcggcagattcagtcagctgtaccctgaacgggcactcgccggacatccttag

SEQ ID NO: 228129 - DNA, 1977 bp, Artificial Sequence
  Description of Artificial Sequence: Synthetic coding sequence
atggggagaaggagggctcctgcaggtggaagtttaggtcgggcacttatgagacaccagactcaaaggtcgagatcacaccgtcacaccgattcatggctgcacacatcggagctcaacgacggctacgattgggggaggctcaaccttcagagtgtgacggagcagtcaagccttgatgactttttggcgacggccgagctggctggaacggaattcgtagccgagaagctgaatatcaagtttgtgcctgcggaggcccgtaccggcttgctgtccttcgaggaatcccaaaggattaaaaagcttcacgaagaaaataagcagttcctgtgcattcctagacgccctaactggaatcagaacaccacccctgaggagctcaagcaggctgagaaggacaattttctcgagtggcgacgccagctagttcggctggaagaggaacagaagctgatccttaccccctttgaaagaaacctcgatttctggcgacaactttggagagtgatagagcggtcagatatcgttgtccagattgtcgacgcacgcaatccactgctgtttagatgcgaagatctggaatgctacgtaaaggaaatggatgcgaataaagagaatgtgattttgatcaacaaggccgacctgctaactgctgaacagcgaagcgcctgggcaatgtacttcgaaaaggaggatgtcaaggttatcttctggtccgccttagccggagccattcccctcaacggagactctgaggaagaagcaaatcgggacgaccgtcagtcaaataccacaaagtttgggcactcaagtttcgaccaggccgaaattagtcactctgagtcagagcatctcccagcccgagattccccatctttgtcagagaaccctacaaccgatgaggacgatagtgagtatgaggattgtcccgaagaggaggaagatgattggcagacctgttccgaagaagatggccctaaggaagaggactgcagtcaggactggaaggaatcttcgaccgccgatagcgaagcacgcagccgaaagaccccacagaagaggcagatccataatttctcgcacctcgtcagcaagcaggaactgctggaactattcaaggaactccatactggcaggaaagtcaaggatggccaactgaccgtcggccttgtagggtatcctaacgttggtaagtccagtactatcaacacaatcatgggaaacaaaaaagtgtcagtgtccgcaacccccggacacactaaacactttcagacgctatacgtggagcccggattgtgtctttgtgattgccctggcctggtcatgccatccttcgtaagcaccaaggcggaaatgacctgcagcggcattcttcctattgatcaaatgagggaccatgtgccgccagtgagcctggtgtgtcagaatatccctaggcacgttttggaagctacctatggcattaatataattacccctagagaagatgaggatcctcaccgaccgcctaccagcgaggagctcctcacagcatacggatacatgcgcggtttcatgaccgcccacggacagccggatcagcctcggtccgcccgttatattcttaaggactacgtcagcggcaagctcttgtactgccatccaccccctggccgtgacccagtgaccttccagcaccaacaccagcgtttactggaaaataaaatgaactcggacgagattaagatgcagctcggccgaaacaaaaaagccaagcagattgagaacatcgtcgacaaaacattctttcaccaggaaaatgtccgcgctctgacgaaaggcgtccaggctgtaatggggtataagcctggatccggagtggtgactgcgtctaccgcctccagcgagaatggagccggaaaaccttggaaaaagcatggtaatagaaataagaaggagaagtctaggaggttgtataagcaccttgatatgtag

SEQ ID NO: 228130 - DNA, 333 bp, Artificial Sequence
  Description of Artificial Sequence: Synthetic coding sequence
atgagctgtcagcagtcccagcagcaatgtcaaccccctcccaagtgtacgccgaagtgccctccaaaatgtcccactccaaagtgcccacccaagtgtcctccaaagtgcccgcctgtatccagctgctgctctgtgtcgtctggtggttgttgtgggtcttcctccggcggagggtgtagctctggtggcggaggctgttgtctgtctcatcatagacgacacaggtcccaccggcacagactccagtctagtgggtgctgcagtcagccgagcgggggatcatcttgttgtggcggtgactccgggcagcattccggaggatgctgctag

SEQ ID NO: 228131 - DNA, 333 bp, Artificial Sequence
  Description of Artificial Sequence: Synthetic coding sequence
atgtcctgtcaacagtcacagcagcagtgtcagccgcctccaaagtgcacacccaaatgccctcccaaatgccctacgccaaagtgcccacccaagtgtccgccaaaatgccctcccgtctcatcctgctgcagcgtgagtagtggcggatgctgcggttcatcatctgggggagggtgctcaagcggcggtggcggatgctgtttgtctcaccatcggagacaccgctcgcaccgccaccgcctccaatctagcggatgttgctcccagccgtccggcggtagcagttgttgtggaggtgactccgggcagcacagcggtggctgttgttag

SEQ ID NO: 228132 - DNA, 357 bp, Artificial Sequence
  Description of Artificial Sequence: Synthetic coding sequence
atgtcttgtcagcaaaatcaacagcagtgtcagcccccacccaaatgcattcctaagtgcccccctaagtgtttgaccccacggtgtcctccaaagtgtccgcctaaatgtccgccagtatccagctgttgcagcgtttcttccgggggatgttgcggttcatcctctggcggaagctgtgggagctcatcaggcggttgttgttcctctggaggcggaggttgctgtctgtctcaccatcggcgtcgtagatcccattgccaccggccacagagctctggctgttgcagtcagccttccgggggaagtagttgttgcgggggtggttcaggacagcactctggtggctgctgttag

SEQ ID NO: 228133 - DNA, 333 bp, Artificial Sequence
  Description of Artificial Sequence: Synthetic coding sequence
atgtcttgtcaacaaaatcagcagcaatgccagcctccccctaaatgtatcccaaagtgtccgcctaaatgcctgactccgaggtgcccgcctaaatgtccgcctaagtgtcctccggtctcttcttgctgctccgtctcaagtggcggatgttgcggaagctcctcagggggttgttgttctagtggaggtggcggttgctgcctctcccaccataggagacgacgcagtcattgtcacaggccccaatcttctggctgttgcagtcagccttccgggggatcaagttgctgtgggggaggaagcggtcaacatagcggagggtgctgctag

SEQ ID NO: 228134 - DNA, 357 bp, Artificial Sequence
  Description of Artificial Sequence: Synthetic coding sequence
atgtcctgtcagcaatcacagcaacagtgtcagcctcctcccaaatgtacacccaaatgtcctccgaagtgccccacacccaaatgcccccctaaatgcccaccgaagtgtccaccagtgtctagttgctgtagtgtcagctccggaggatgctgtggtagttcatcaggaggttcttgcgggtccagctcaggaggctgctgctcaagcggcggaggtggatgttgtctcagccaccaccggagaaggcggtcacattgtcaccgtccccaaagctcgggctgctgttctcagccctcaggaggttcatcttgctgcgggggaggctccggtcagcactcaggcggatgttgttag

SEQ ID NO: 228135 - DNA, 345 bp, Artificial Sequence
  Description of Artificial Sequence: Synthetic coding sequence
atgtcctgtcagcagtcacaacagcaatgtcagccaccccctaagtgcacacctaagtgcactcctaaatgcccagcaccaaaatgtcccccaaaatgccctcccgtgtcgtcttgttgcagtgtatcgtccggaggttgctgtggatctagctctggcggaggctgcgggagtaatagtgggggatgttgctcctccggcggagggggatgttgccttagtcaccaccgaagacatagaagccacaggagaaggccacagagctccgactgctgcagtcagccctctggcggatcaagctgttgtggcggtgggtcttcacagcactccggtgggtgctgctag

SEQ ID NO: 228136 - DNA, 357 bp, Artificial Sequence
  Description of Artificial Sequence: Synthetic coding sequence
atgagctgccagcagtcccagcagcagtgtcagccacctcctaaatgcactcctaaatgccctcctaaatgtccaacaccaaaatgccctccgaagtgtccccctaagtgtccgcctgtgagttcttgttgcagcgtcagctctggtggctgctgtggctcctcaagtgggggaagctgtggttcctccagtggtggatgttgttctagtggagggggagggtgttgtctgtctcaccacagacaccaccgttctcaccggcatcgccctcaatcttccgattgctgtagccagccctctggcggatcttcctgttgcgggggtggctcaggtcaacactccggcggatgctgttag

SEQ ID NO: 228137 - DNA, 357 bp, Artificial Sequence
  Description of Artificial Sequence: Synthetic coding sequence
atgtcatgccaacagtcacaacaacaatgccagccccctccaaaatgcactccaaaatgcccacctaaatgtcccacaccaaaatgtcctccgaagtgcccacctaaatgtccacccgtctctagctgttgcagcgtgtccagcggaggatgttgcggctcttcatcagggggatcatgcggcagttccagcggtggctgctgttccagcggtggaggcggatgttgtctctcccatcatcgtcatcatcggtcacacagacaccgtcctcagagctccgactgctgttcccagcccagcggaggatcctcctgttgtggtggcggttccggtcagcactcagggggatgttgctag

SEQ ID NO: 228138 - DNA, 357 bp, Artificial Sequence
  Description of Artificial Sequence: Synthetic coding sequence
atgtcctgtcagcagagccagcaacagtgtcagccccctccaaaatgtaccccaaagtgcccaccaaagtgtccaacaccgaaatgtcctcctaagtgccctcctaagtgccccccagtgagtagttgctgttcagtgtcatctggaggatgctgcggctcgtctagtggcggatgctgtagttcggggggtggagggtgctgtagttcaggaggcggtgggtgttgcctttcgcatcatcgtaggcgccgatcacataggcacaggccacagagctccgattgttgctcccaaccctccgccggatcttcctgctgtggcggaggatctggccagcacagtggcggatgttgttag

SEQ ID NO: 228139 - DNA, 321 bp, Artificial Sequence
  Description of Artificial Sequence: Synthetic coding sequence
atgtcctgccagcagaatcagcagcaatgtcagccccctcccaagtgtccgcctaagtgcccacccaagtgcccaccaaagtgtcgaccacaatgccccgctccatgtccccctcctgtctcctcctgctgcggccctagttcagggggatgttgtggctctagcagcggcggatgttgtagttcggggggtgggggatgctgtctctcacaccatagacctcgtctgttccaccggcaccgtcaccagtcaccagactgctgcgaatgtgagcccagcggcggtagtggatgctgccatagtagtggtgactgttgctag

SEQ ID NO: 228140 - DNA, 333 bp, Artificial Sequence
  Description of Artificial Sequence: Synthetic coding sequence
atgagctgtcagcaaaaccagcagcagtgtcagccccctcctaaatgtccccctaagtgcactccgaagtgtcctcctaagtgtcctcccaaatgccttccacagtgcccagccccatgctcccctgccgtgtcttcatgttgcgggccaatttccggcggatgctgcgggcctagctctggcggatgttgcaattcgggcgcaggcggttgttgtctgagtcaccaccggccaagactgttccacaggaggagacatcagagcccggactgttgcgaatcagagccttctgggggttctgggtgttgccatagttctggtggctgttgctag

SEQ ID NO: 228141 - DNA, 333 bp, Artificial Sequence
  Description of Artificial Sequence: Synthetic coding sequence
atgtcctgtcagcagaaccaacaacagtgccagccgcctccaaagtgtcctccgaagtgtacaccgaagtgcccgccaaaatgcccgccaaaatgtctcccgcagtgccctgcaccctgttcgcctgccgtatcaagttgttgtggccctatcagcggcggttgctgcggcccaagtagcgggggatgttgtaattctggggctgggggatgttgtctgagccatcataggcctcgccttttccaccggagaagacatcagtcccctgattgttgcgagtctgaaccatccggagggtctggctgctgccatagctccggcggatgttgttag

SEQ ID NO: 228142 - DNA, 333 bp, Artificial Sequence
  Description of Artificial Sequence: Synthetic coding sequence
atgtcctgtcagcagaaccagcagcagtgccagccgcctcccaaatgcccccctaagtgtactccaaagtgccccccaaagtgtcctccaaaatgtcctccacagtgccctgcaccatgtttccctgccgtatcttcatgctgcggcccatcatccggctcctgctgcggaccctcctcaggtggatgctgctcttcgggcgctggaggttgcagtctgtcacatcatcgcccacgtctctttcaccgcaggaggcatcagtctcctgactgttgtgagagcgagccatctggcggttcgggctgttgtcactcatcgggcggttgctgttag

SEQ ID NO: 228143 - DNA, 333 bp, Artificial Sequence
  Description of Artificial Sequence: Synthetic coding sequence
atgtcatgccagcagaatcaacagcagtgccagccccctcccaaatgtcctcccaagtgtacccctaaatgccctcccaagtgtccgcctaaatgtcctccccagtgccctgctccctgtagccctgcagtgtccagctgctgtgggccatcctccgggtcctgttgcggcccaagcagtgggggatgttgttccagcgggggaggcggttgttgcctgtctcaccacagacctagactgttccaccgaaggcgccaccagagtcccgactgctgcgaatctgaaccaagcggcgcttcaggctgttgtcactcttcaggtgggtgttgttag

SEQ ID NO: 228144 - DNA, 270 bp, Artificial Sequence
  Description of Artificial Sequence: Synthetic coding sequence
atgagctgccagcagaatcaacagcagtgtcagccccctcccaaatgtcccgctaagtctcctgcccagtgtctgcccccagcgtcaagctcatgcgcaccaagctcaggaggttgcgggccaagcagcgaacggagctgctgcctgagccaccaccgctgtcggcgatctcatcggtgtcgctgccagtccagcaattcttgcgacagggggagtgggcagcagggaggttccagtagctgcggccactcttcagccggttgttgctag

SEQ ID NO: 228145 - DNA, 288 bp, Artificial Sequence
  Description of Artificial Sequence: Synthetic coding sequence
atgagctgtcagcagaatcagcaacaatgccagccgctaccaaaatgcccaagccctaagtgcccaccgaagtcatctgcccagtgcctgcctccagctagctcatgttgcgcccctaggccaggctgctgtgggggacccagctccgaagggggatgttgcctctcccaccaccgctgttgcaggagccacagatgccgacgccagtcatccaactcatgtgacagagggagcgggcaacaggacggagccagcgattgtggttatggcagcggtggttgctgctag

SEQ ID NO: 228146 - DNA, 285 bp, Artificial Sequence
  Description of Artificial Sequence: Synthetic coding sequence
atgagctgccagcagaatcagcagcagtgccaacctcccccttcttgccctagccctaagtgccctcccaagagccccgcacaatgtctgccacccccttccagcgactgcgctttatcctcgggcggatgcggcccaagctccgagtccggttgctgtctgagccatcaccggcattttcggagccaccaatgcagaaggcagcgaagcaattcttgcgaccggggaagtggtcagcagggcggaggttcatgtagggggcatggatcaggcggatgctgttag

SEQ ID NO: 228147 - DNA, 279 bp, Artificial Sequence
  Description of Artificial Sequence: Synthetic coding sequence
atgagctgtcagcagaatcagcagcagtgccagcccccacccaaatgtccaagtccaaaatgtccacctaaatccccggtccagtgcctccctcccgcaagcagtggctgcgcgcctagttctgggggatgcgggccatcgtctgaaggaggctgcttcctgaaccaccataggcgtcatcaccgatgccgcaggcagcgacctaactcctgtgaccgcggtagcggacagcaagggggaggtagtggatgtggccacggctcaggcggttgttgttag

SEQ ID NO: 228148 - DNA, 279 bp, Artificial Sequence
  Description of Artificial Sequence: Synthetic coding sequence
atgtcttgccagcagaaccaaaagcaatgccagccgcctccaaagtgcccgagtcctaagtgcccaccaaaaaatccggtccaatgccttcctcctgccagctcgggctgcgcaccaagttctggcggatgtgggccaagttccgaaggtggctgcttcttgaaccatcatcgaagacatcaccgttgccgccgacagaggtccaatagttgcgacagagggtcaggccagcagggcggaggctctggctgttgccacggtagtgggggttgctgctag

SEQ ID NO: 228149 - DNA, 300 bp, Artificial Sequence
  Description of Artificial Sequence: Synthetic coding sequence
atgtcctgccagcaaaatcagcaacagtgccaaccacctcctaagtgcccgatcccaaagtaccctcccaagtgcccttccaaatgcgcttcaagttgtcctccaccaatatcgtcttgttgcggcagttcatctggcggatgcggatgctgttcatctgaggggggaggctgctgcttgtcacaccatcggcaccataggagtcactgtcacagacccaaaagctctaactgctatggtagcgggagcgggcagcaaagtggcggatccggatgttgttccggaggcggatgctgttag

SEQ ID NO: 228150 - DNA, 300 bp, Artificial Sequence
  Description of Artificial Sequence: Synthetic coding sequence
atgtcctgtcaacaaaaccagcaacagtgccaaccaccccctaagtgccctatccctaaatacccccctaaatgtccttccaagtgcgccagtagctgtcctcctccgatatcgtcatgttgtgggtcctcctctggtgggtgtggatgctgcagcagcgaaggcggagggtgctgcttaagccaccaccgccatcacagatctcactgtcatagacctaagtcaagtaattgttacggatcagggtcgggtcaacagtctggaggcagcggctgttgttcaggcggaggctgctgttag

SEQ ID NO: 228151 - DNA, 357 bp, Artificial Sequence
  Description of Artificial Sequence: Synthetic coding sequence
atgtcctgtcagcagtcccaacagcagtgtcagcccccacctaagtgcacaccaaagtgtccgccaaagtgcacacctaagtgtccacctaaatgcccccctaagtgtcctcctcagtgtagcgctccttgtccgccacccgtctcatcttgctgcggatcctcatcgggaggatgctgctcttctgaaggcggaggatgctgtctgagtcaccatcgcccaaggcaatccctgcggagacgacctcagagcagctcctgctgtgggtccggctcgggtcagcagtccggcggtagtagctgttgccacagcagcggtggcagtggatgttgccatagtagcggtggttgctgttag

SEQ ID NO: 228152 - DNA, 297 bp, Artificial Sequence
  Description of Artificial Sequence: Synthetic coding sequence
atgtccagtgacgataaatctaagagcaatgacccgaagactgagcctaaaaactgcgaccctaagtgtgaacagaagtgtgaaagcaagtgccagcccagctgtctgaaaaagctcctgcagcgatgtttcgaaaagtgtccatgggaaaaatgtcccgcaccgcctaagtgcctgccttgtcctagtcagtcaccctcaagttgtccaccgcagccctgcaccaagccatgtccacctaagtgccccagctcatgtccacatgcctgtccccctccatgccccccaccagaatag

SEQ ID NO: 228153 - DNA, 1860 bp, Artificial Sequence
  Description of Artificial Sequence: Synthetic coding sequence
atgtgcagctgccacaaaggatatactcgcaccccagatcataagcattgtagagatatcgacgagtgtcagcaaggaaatctctgtgtgaatgggcaatgcaagaatacagaaggaagctttcgctgcacctgtggccaagggtatcagctgagtgccgcaaaggaccagtgcgaggacatagacgagtgtcagcaccgacatctctgtgcacacggacagtgcaggaatacagaaggtagttttcagtgcgtttgcgaccaaggataccgcgctagcggcctgggggatcactgcgaggacatcaatgaatgcctggaggacaagagtgtctgtcaaagaggtgactgcataaacaccgccggttcttacgactgcacttgtcctgacggattccagctcgatgacaataaaacctgtcaggacattaatgaatgtgagcaccctggactctgtggccctcagggcgagtgcctgaacaccgaaggtagctttcattgtgtgtgccagcaaggcttttccatcagcgcggatggaagaacctgcgaagacgtgaacgagtgtgagctcctaagcggtgtgtgcggtgaggccttttgcgaaaacgtcgaaggatctttcctgtgcgtttgcgcagatgagaatcaggagtattcacccatgacgggacagtgcaggagcaggactagtaccgatttagatgtggacgtggatcagcctaaagaggaaaaaaaggaatgttattataatctgaacgacgctagcctttgtgacaatgtactcgcgccaaacgtgacaaagcaggagtgctgttgcacctccggggtcgggtggggcgataactgtgaaattttcccctgccccgtactgggaaccgccgaattcacagaaatgtgccctaaaggcaaaggattcgtgcccgctggcgagagcagttccgaggctgggggagagaattacaaagacgctgacgagtgcctactttttggacaggaaatctgcaaaaacggcttttgtctgaatacgcgtccaggctatgagtgctattgcaaacaaggcacctactacgatccagtaaagctgcaatgcttcgacatggacgaatgccaggacccgagcagttgtatcgatgggcaatgcgttaacaccgaagggagttacaactgtttctgtacacatcctatggtgttggacgctagcgagaagcgctgtattagacctgccgaaagcaacgaacagatagaagagacagacgtttatcaggacctgtgttgggaacatctgtcagacgagtacgtgtgttctaggcccctagtagggaagcaaacgacgtatactgaatgttgctgcctgtacggagaagcctggggaatgcagtgtgctttgtgtccacttaaagattctgacgactacgcccagctctgcaatatccctgtgacggggagacgccagccctatggtcgagatgccctggtggacttctcagaacagtacactccggaagccgacccctacttcattcaggatcgcttcctgaactcttttgaggaattgcaggcggaagagtgcggtatcttgaacgggtgcgaaaatgggagatgtgtgagagtacaagaggggtacacttgcgattgcttcgacggctaccacctagataccgccaagatgacctgtgtggatgttaacgagtgtgatgagctcaacaaccgcatgtccctatgtaaaaatgctaagtgtattaataccgacggcagctataaatgcctgtgcctgcctggttacgtgccttccgacaagccgaactattgtacacccttgaacacagcgttaaatctggaaaaggactcagacctggaatag

SEQ ID NO: 228154 - DNA, 5168 bp, Artificial Sequence
  Description of Artificial Sequence: Synthetic coding sequence
atggccggagcatggctcaggtggggacttcttttgtgggctggcctattggcttctagtgctcacgggagactgagaagaataacttacgtggtgcacccaggcccaggattagccgcaggtgccctaccactcagcggtccgccaaggagccgaacgttcaatgtagccctgaatgccaggtattcccggagctctgctgccgcaggcgcaccttccagagcttccccaggcgtaccctccgaacgcacgcgcaggacgtccaaacctggcggagcagcactgcagggcttaagacctcccccaccgccacctcccgaaccagcccgacccgctgttcccggaggccagctgcatcctaacccaggtggtcaccctgccgctgcgccttttacaaagcaggggagacaagtcgtccgcagcaaagtgccgcaggagacccaaagcggtggcggaagccgcttacaggtacaccagaaacagcagctccagggagtcaacgtctgtggtggcagatgctgtcacggatggagtaaggctcccggttcacagcgctgtacaaagccatcttgcgtgcctccttgtcaaaatggtgggatgtgtctacgacctcagttgtgtgtatgcaagcccggaacaaaaggcaaagcttgtgagactatcgctgcccaggacacttcctcccccgtctttggagggcagagtcctggagcagcaagctcctggggcccacccgagcaggcggctaagcacacctccagcaagaaagctgacactttgcccagagtgagccccgtcgcacagatgaccttaacactgaagccaaagccatcagtgggactcccacagcagatccacagtcaggtcacacccctctccagtcagagcgtggtaatccatcacggacagacccaggagtatgtcctgaaaccaaagtattttcccgcacagaagggcatctccggtgagcagtccactgaaggctcctttccgttgcggtacgtgcaagaccaggtggccgctcctttccagctttctaaccacaccggacgcatcaaagtggtgtttacaccttctatctgtaaggttacgtgcaccaaaggtagctgccaaaactcatgcgagaagggaaacacaaccacactgatttccgaaaacggacatgctgcagacaccttaacagctacaaacttccgcgtcgtgatctgccacctgccttgcatgaatggaggacaatgttcaagccgcgacaaatgtcagtgcccaccgaatttcaccggtaagttgtgtcagattcccgtgcatggagcttcagttcctaaactgtaccagcactctcagcagccaggaaaagcactaggaacacacgtgatccacagtacccatactcttcctctgaccgtgacgtcacaacagggtgttaaggtaaagtttcctcccaacatagtaaacattcacgtgaaacacccccctgaggcctcagtccaaatccatcaggtgtctcggatcgatggaccaaccgggcagaagactaaggaggctcaacccggacaaagtcaagtgtcctatcagggacttcccgtgcagaagacacaaacgattcattcaacctatagccaccaacaggtcatccctcatgtctatccagtcgctgctaaaacccaactaggccgttgcttccaagagactattgggtcccagtgcggtaaggctttaccaggtctgtccaaacaggaggactgctgcggcactgtggggacaagttggggcttcaacaaatgccagaaatgccctaagaaaccttcttatcacggatacaaccagatgatggagtgtctgccaggatataagagggtgaataacacattctgtcaagatattaacgaatgtcagcttcagggcgtgtgccctaacggggaatgccttaacacaatgggatcctatcggtgtacttgcaaaattggattcggtcctgaccccaccttttcctcgtgtgtgcccgacccaccggtgatcagtgaggagaaaggcccttgctatcgtctggtttcctcaggtaggcaatgcatgcatccgttgagcgtacacttgactaagcagttatgctgctgctccgtggggaaagcgtggggaccgcactgtgagaagtgcccgcttcccggtaccgctgcatttaaagaaatctgcccagggggaatgggatatactgtcagtggtgttcaccgaaggcgccctatacaccaccacgtgggcaaaggcccagtgtttgtgaagcccaaaaatactcagccagttgctaagtctacccaccccccaccgctgcccgcaaaggaagagccagtggaagcactcaccttcagtcgagagcatggccctggtgtggccgagcctgaagttgcaaccgctccacccgaaaaagaaatcccaagtttggatcaggagaaaacgaaactcgagcctggccagccgcagttgtcaccgggtatcagcaccatccacttgcacccacaattcccaggcatagtgatcgagaaaacatccccccctgtccccgtcgaggttgcacctgaggccagtacaagctctgcaagccaggttattgctcccacacaggtaactgaaattaacgagtgcactgtgaatcctgacatctgcggtgctgggcattgtatcaatttgcccgtcagatacacatgtatctgctatgaaggatatcgtttctcagaacagcagaggaagtgcgtagacatcgacgagtgcacacaagttcagcacctgtgtagccaggggcgttgtgaaaatacagagggatccttcctgtgcatttgtcccgctggctttatggccagtgaggaggggaccaactgtattgatgtggatgagtgtcttcgtcccgacgtctgcggagagggacattgtgtgaataccgtgggagcattcaggtgcgagtactgcgattcaggctaccggatgacccagagaggcaggtgtgaggatatagacgaatgcctaaacccatccacttgcccagatgagcaatgcgtcaacagtcccggtagctatcaatgtgtgccatgtacagagggctttagaggttggaatggccagtgcctggacgtcgacgagtgcctggagccaaacgtatgcgcaaacggcgactgctcgaatctggagggctcttatatgtgctcatgccacaaaggttataccaggacgcctgaccataagcattgtcgggatatcgacgaatgtcaacaaggcaacctgtgcgtcaatggacagtgcaaaaacacagagggctcttttaggtgtacctgtggacaaggttatcaactttccgcggctaaggatcagtgtgaggacatcgacgagtgccaacaccgtcatctgtgcgcccacgggcagtgccgcaacacagagggctcttttcaatgtgtctgtgaccagggctatcgcgcttctggtcttggggaccactgtgaggacatcaacgagtgtttagaggataagtcagtttgccaaagaggcgattgcataaacaccgccggtagctacgactgcacttgcccagacggattccaacttgacgacaacaagacttgccaggatataaatgagtgtgagcaccccggtctctgcggccctcagggcgaatgcctcaacaccgaaggctcatttcactgtgtgtgccagcagggtttttccatcagcgctgacgggaggacatgtgaggatatagacgagtgcgtcaacaacaccgtgtgtgactcccacgggttctgtgacaatactgctggcagcttcagatgcctgtgttatcaggggtttcaggcgccacaggatggacaaggctgtgtggatgtgaacgagtgcgaactgctatctggcgtgtgcggggaagcattttgcgagaatgtggaaggatctttcttgtgtgtgtgtgctgacgaaaaccaggagtactctccaatgacaggacagtgccgtagcagaacatccaccgatttggatgtggacgtggaccagcctaaagaggaaaagaaagagtgttactataacctgaatgatgccagtctatgtgacaatgttctggctcctaatgtgacgaagcaagaatgctgctgtacaagtggcgtgggttggggcgacaattgcgaaatctttccttgccctgtcctgggaaccgccgagttcactgagatgtgccccaaaggcaaaggatttgttccagcgggagagtcatcatccgaagccggaggagaaaattataaggacgccgatgaatgtctcttattcgggcaggagatctgcaaaaatggcttctgccttaatacgcgccctgggtatgagtgctactgcaagcaaggcacgtactacgatcccgtgaaactgcagtgttttgacatggatgagtgtcaggatcctagctcctgtattgacggtcagtgcgttaacactgaaggaagttacaactgcttttgcacacatcctatggttctggatgcttctgaaaagcggtgcatccgccctgcagaatctaatgaacaaattgaggagacagatgtgtaccaggatctgtgttgggaacacctctccgacgaatatgtatgtagccgaccactggtaggtaagcagacaacttatacggagtgctgttgcctgtacggcgaagcctgggggatgcagtgtgcattatgccccctcaaggacagtgatgattatgctcagctgtgcaacatcccggtaacgggccgacggcaaccgtatggccgagacgcattggtggatttctcagaacaatacacgcctgaagcggacccttactttattcaagataggttcttaaattcatttgaagaactgcaggctgaggagtgcggtattctcaacggctgtgagaacggccgatgcgtacgcgtgcaggagggctatacatgcgactgtttcgatggataccatttagataccgcaaagatgacatgcgtggatgtgaatgagtgtgatgagctgaataatcgtatgtcattgtgcaagaatgcaaaatgtattaataccgatgggtcttataagtgtctgtgcttgcccggatatgttccatcggataagcccaattactgtacccccctgaacactgctctgaacctcgaaaaggacagcgacctggagta

SEQ ID NO: 228155 - DNA, 4191 bp, Artificial Sequence
  Description of Artificial Sequence: Synthetic coding sequence
atggacaccaaattgatgtgccttttgtttttcttcagcctgccccctttgctggtaagtaatcacacaggccgaatcaaagtggtgtttacaccctcaatttgtaaagtcacctgtactaagggatcgtgccagaattcttgcgagaaaggaaacaccacaacactgattagcgagaatggacatgccgctgatacgctgaccgcaaccaattttagggtggtgatttgtcacctgccatgcatgaacggcggtcaatgcagttcaagggacaaatgtcagtgcccacccaacttcaccggaaagctctgccagattcccgttcacggggcaagtgtaccgaaactgtaccagcacagccagcagccagggaaggccctagggactcacgtaatccattcaactcacacgctgcccctcaccgtcacctcccagcagggggtgaaagtcaagtttccgcctaatatcgtgaacatacatgtcaaacaccccccagaagcctcggtgcagatccatcaggtatcaagaattgacggacctaccgggcagaaaacaaaggaagcccagccagggcagtcgcaagtgagctatcagggccttcccgttcagaaaactcagaccatacattctacgtatagccatcagcaggtcatcccccatgtgtatccggtggccgctaagacgcaactaggtaggtgcttccaagagaccatcggttcacagtgcggcaaggcactgcccggactgtcgaaacaagaagactgctgtggcacagtgggcacatcttggggcttcaataaatgccagaagtgtcccaagaaaccatcatatcatggctataatcagatgatggaatgtctgcccggatacaaacgagtaaataacaccttttgtcaggatattaacgaatgtcagctgcagggcgtgtgtcccaacggcgaatgcctcaataccatggggtcttatcgatgtacctgcaagattggctttggacctgacccaacttttagctcctgcgttcccgacccccctgtaatctctgaggaaaaaggaccttgctatcgcctagtcagtagtggcagacagtgtatgcatcctctgtctgtccacctgacaaagcagctgtgctgttgtagtgtgggcaaggcttggggaccgcactgcgaaaaatgtcctctacccggtacagcagcctttaaagaaatatgcccagggggtatgggctacaccgtgagcggagttcacagaagacggccaatccatcaccatgtaggcaagggcccagtgttcgtcaaacctaaaaatacacagccagtagctaaatccactcacccaccaccgctgcctgccaaagaggagcccgtggaggccctcacattctcaagagagcatgggccaggcgtggcagagcctgaagttgccacggcccctcccgaaaaagagatacctagtctcgaccaggagaagacgaagttagaacccggacaaccgcagttatcccctggaatcagcacaatccatctgcatcctcagttccctggtatagtgatagaaaagacttcaccgcctgtcccagtggaggtggctcctgaggccagtacatcttcagccagccaggtgatcgctcccacccaagttaccgagatcaatgagtgtactgttaacccagacatttgcggagccggtcattgcatcaaccttccagttagatacacctgcatctgctacgaagggtatcgcttttccgagcagcagagaaagtgtgtcgacattgacgagtgcacacaggtgcagcacctctgcagccagggaagatgcgagaacacagaaggaagcttcttgtgcatttgccccgctggattcatggccagcgaggagggcaccaactgcattgacgttgatgaatgcctgaggcccgatgtgtgcggcgagggacactgtgtaaacacggtgggcgctttcaggtgcgaatactgtgactcaggatataggatgacacagcgtggacgctgcgaagatatcgacgaatgcctcaaccctagcacgtgcccggatgagcagtgcgtgaattccccaggctcgtatcagtgcgtaccttgtactgagggatttagaggatggaatggccagtgtcttgacgtggatgagtgtcttgaaccaaacgtatgcgctaacggtgactgctccaatctggaaggctcctacatgtgcagctgtcacaaaggttatacaaggacaccagatcacaaacactgccgggatatcgatgagtgtcagcaggggaatctgtgcgtgaacggacagtgcaagaacacagagggttcctttcggtgcacatgcgggcaaggctaccagctgagtgctgctaaggaccagtgtgaggatatcgatgagtgccagcatcgacacttatgcgcacatgggcagtgtagaaacaccgagggatcatttcaatgcgtctgcgaccagggttatcgggcatccggccttggcgaccactgcgaggatatcaatgagtgtcttgaagataagtccgtttgccaaagaggcgactgcataaacactgctggctcctacgattgtacctgtcccgacggctttcaacttgacgacaacaaaacctgtcaagacattaatgagtgtgagcaccctggcttgtgtggaccacagggagaatgcctgaataccgagggctctttccattgcgtatgccagcagggattcagtataagtgcagacggccgtacatgcgaggatatagatgaatgtgtcaacaatacagtgtgtgacagccacggcttctgtgataacaccgcgggttccttcaggtgcctgtgttaccagggttttcaagctcctcaagacggccaagggtgtgtggatgttaatgaatgtgaattgctgtctggtgtctgtggtgaggccttttgcgagaatgtggaaggcagcttcctttgcgtgtgtgcggacgagaatcaggagtactcccccatgacagggcagtgtcgcagcaggacgagtacggatctcgatgttgacgtggatcagcctaaggaagagaagaaagaatgttactacaacctgaacgatgctagcctttgcgacaacgtcctcgcaccaaacgtaaccaaacaggagtgctgctgtacgtccggagtgggttggggcgataactgtgagatcttcccctgcccagtccttggcaccgcggaattcaccgaaatgtgcccaaaaggcaagggcttcgtacccgcaggggagtcaagtagtgaagccggaggtgagaactacaaggatgccgacgagtgcctcctattcgggcaggaaatttgcaagaacggcttctgcctcaacacaaggcctggctatgaatgctattgcaaacagggaacatactacgatccggtgaagctacaatgcttcgacatggacgagtgtcaggacccttcctcatgcattgatgggcaatgcgtgaatacagagggaagctacaactgcttttgcacccatcctatggtgttggatgcctcggagaaacgctgcatcagaccagccgagtccaatgaacaaattgaagagaccgacgtgtaccaggatctttgttgggaacatttgtccgatgagtacgtgtgttcacgaccccttgtaggcaagcaaactacgtacaccgagtgttgctgtctgtatggcgaggcctggggaatgcagtgcgctctgtgtccattgaaagatagtgacgattacgcccagctttgcaatattccagtgaccggaagaagacaaccctacgggagagacgccctggttgacttctccgagcagtatacccccgaggcagacccatactttatccaggatcggttcctgaactctttcgaggagttacaagcggaagaatgtgggattttgaatggatgcgaaaacggcaggtgcgtacgagtgcaggaaggctacacatgcgattgtttcgacgggtatcacctggataccgccaagatgacctgcgtggacgtgaatgaatgtgacgagttgaataacagaatgagcttgtgtaagaacgcaaagtgcattaacactgacggatcttataagtgcctctgcctgccaggatacgttcccagcgacaagccaaattactgcacacctctcaacacggctctaaatctcgaaaaagactctgatctggagtag

SEQ ID NO: 228156 - DNA, 5165 bp, Artificial Sequence
  Description of Artificial Sequence: Synthetic coding sequence
atggccggagcctggctgagatgggggctcctgctatgggccggtttgttggcctcttccgcccacggtcggttgcgacggatcacatacgtggtccatccaggcccaggcctggccgcaggcgctctgccgcttagtgggcctccacgctcgaggaccttcaatgtggccctgaatgcacgatactccagatcctcggccgctgccggagccccttcccgcgcatcacctggcgtaccaagcgaacgtacccgtagaacttcaaagcctggaggggctgccctccaaggcctgcgacctccacctccacccccaccggagccagccaggccagcagtccctggcggtcaacttcatccaaatcccggaggccacccggctgcggctcccttcacaaaacagggtaggcaggtggtacgatcaaaggtgccccaggagacccaatctggagggggaagtcggctgcaagtgcaccaaaaacagcaattacagggagtgaacgtatgcggcggacgctgttgtcacggttggtcaaaagccccagggtcacagagatgtacgaagccaagctgtgtgcctccgtgtcaaaacggcggaatgtgtctcaggccacagctctgtgtttgtaagcccggtacaaagggaaaggcatgcgaaaccatcgctgcgcaagatacctcttcccctgtctttggcggacaatcccctggcgcagctagctcgtggggaccacctgagcaggcagcaaaacatacttccagtaagaaggctgataccctgcctcgcgtgtcgccagttgctcaaatgacacttacactgaaacctaagccatcagtgggtctacctcagcaaatccatagccaagtaacccccctgtcttcccagtctgtcgtcatccaccatggtcagacacaggaatacgtgctgaaaccgaagtacttccccgctcagaaaggcatcagcggtgaacagtccaccgaaggatctttccccctaaggtatgttcaggatcaggtcgctgcacccttccagttgagcaatcatactggtcgaatcaaggtagtcttcacgccctcaatctgtaaagtcacatgcacaaagggctcctgtcagaattcttgcgaaaaaggcaataccactacactgatctcggagaatggccacgccgctgacactctgaccgccacaaatttccgcgtggtcatttgccacctgccctgtatgaatggtgggcagtgctcatcacgcgacaaatgtcagtgtccacccaactttaccgggaagctctgccaaatccctgtccatggggcttcggtaccgaagctgtaccaacactctcaacagccagggaaagcactcggtacacacgtgatccattccacacataccctgccccttacagttacgtcacagcagggcgtgaaagtgaaatttcctcccaatatcgtgaatatccatgtgaagcatccacctgaggccagcgtacagatccatcaggtctcccgcatcgacggcccaaccggccaaaaaaccaaggaggcccagcctggccagtcccaggtatcgtatcaaggtctgcctgtgcagaaaacacagaccatacattcaacctacagtcaccagcaggtgatacctcacgtgtaccccgtcgccgctaagactcagctcggtcgctgctttcaggagactatcggcagtcagtgcggaaaagcccttccaggcttgagcaaacaggaggattgttgcgggacagttggtacctcctgggggttcaataaatgccagaagtgcccgaaaaagccgagctaccacggatacaaccagatgatggaatgcctcccagggtataaaagagtgaataataccttctgtcaggatatcaatgagtgccagcttcagggagtgtgcccaaacggtgagtgtctgaatactatgggtagctaccgctgtacctgtaagatcggtttcggccctgatcctacattttcaagctgtgtgcctgatcctcccgttattagcgaggagaaagggccttgttacagactggtgtcttcaggaaggcagtgcatgcacccactttcagtccacctcaccaaacagttatgctgttgcagtgtcgggaaagcctggggtccccattgcgagaaatgcccattgcctgggaccgctgcgtttaaagagatttgtccaggcggtatgggctataccgtcagtggtgtccataggcgtagaccaatacaccatcatgtgggcaagggcccagtttttgtgaaacctaaaaatacgcagcccgtggcgaagtctacccatcctccacctctgccagcaaaagaagagcctgttgaagccctgacgttctcgcgggagcacggcccaggggtggcagaaccagaggtcgcgactgctccccctgagaaggaaataccatccctcgatcaggagaaaacaaagctggaaccgggacagccccagcttagcccgggtatatccacaatccatttacatcctcaatttcctgttgtgattgaaaaaacctcaccacccgtgcctgtcgaagtggccccagaagcttccacgagttcagcatcacaggtgatcgcccctacgcaggtcacagaaattaacgagtgcactgtgaacccagatatttgcggggctggacactgtatcaacctccctgtaagatacacttgcatctgttatgaaggataccgcttctcagagcaacagcggaagtgtgtggatattgatgagtgcacacaagttcagcatctatgctcccagggcagatgcgagaatacggaaggtagctttctttgcatttgccccgcaggattcatggccagcgaagaaggcacaaactgcattgacgtggacgagtgtctacggcctgatgtctgcggagaaggacactgcgtaaacactgtgggcgcttttagatgtgagtactgtgattctggctacaggatgactcagcgcggtaggtgtgaggacatcgatgagtgcctgaaccccagcacatgtcctgacgagcagtgcgtgaactcaccaggctcctaccagtgcgtcccctgtaccgagggtttcagaggctggaatggacagtgcttagacgtggacgaatgcctggaacccaacgtctgtgctaatggcgattgtagcaatttggaaggaagctatatgtgtagctgccacaagggatacactcgcacgcccgaccacaagcactgcagagatattgacgagtgccagcaaggcaacctgtgtgtgaacggccagtgtaaaaatactgaaggctcttttagatgtacgtgtggtcagggataccagctgagtgccgcaaaagatcaatgcgaggacattgatgaatgtcagcatagacacctgtgtgcccacggccaatgtcggaataccgagggatcctttcagtgcgtatgtgatcagggctatcgggcttccggtctgggagaccattgcgaagacatcaacgagtgtctcgaagataagtccgtgtgccaacgaggtgactgcataaatacagcgggatcctatgattgcacctgccctgatgggttccagctggacgacaacaagacgtgtcaggatatcaacgagtgtgagcaccccggactgtgtggaccccagggggaatgcctcaacacggaaggatctttccactgtgtgtgccagcaggggttttcaatctccgccgacggtcgcacatgcgaagacatcgatgaatgtgttaataatactgtgtgtgactcccacggattctgcgataacaccgctgggtcttttcgatgtctctgctatcagggttttcaggcccctcaagatggtcaggggtgtgtggatgtgaatgaatgtgagttattgtccggcgtgtgcggggaggctttctgtgagaacgtagagggcagctttctgtgcgtgtgtgccgacgaaaaccaggaatatagccccatgactggccagtgtcgaagtcgaactagcacggacctggacgttgacgtcgatcaacctaaagaggagaagaaggagtgttattataacctgaacgatgccagcctctgtgataatgttttagcccctaacgtaaccaaacaggaatgctgctgtactagcggcgtgggatggggagacaactgtgaaatttttccttgccctgtactgggcactgccgagttcacagagatgtgtcccaaggggaaaggattcgtccccgcaggggaaagctctagcgaggcgggaggcgaaaactacaaggacgccgatgagtgcttactgtttggccaggagatctgcaaaaatggtttttgtctgaataccaggccgggttacgaatgttattgtaagcagggaacctattacgaccccgtgaaacttcagtgctttgacatggatgagtgccaggacccttcctcctgcatcgacgggcaatgtgtgaacaccgagggctcctataattgcttctgcacccatcccatggttttggatgcgtcggaaaagcgatgcatacggcctgcagaaagtaacgagcagatcgaagaaacagatgtctaccaggatctgtgttgggaacacctttccgatgaatacgtgtgcagccgtccactggtgggtaagcaaaccacttacaccgaatgttgctgcctctacggtgaggcttggggaatgcagtgcgccctgtgtcctcttaaggactcagacgattatgctcagctatgtaacatacccgtaactggccgacgacagccgtatggcagagatgccctcgtggacttctccgagcagtacacccctgaagctgatccctacttcatacaagaccggttcctcaacagctttgaggagctccaagcagaggagtgcgggattctgaatggatgcgagaacggcaggtgcgtccgcgttcaggaaggatacacatgcgactgtttcgatgggtatcacttggatacagccaagatgacatgcgtcgacgttaacgagtgtgacgagctgaataacagaatgtctttgtgcaagaatgcaaagtgcattaataccgacggcagttacaagtgcctgtgtctgcctggctacgtacccagcgataagccgaactactgtacaccacttaatactgctctgaatttagaaaaagatagcgatctcgagta

SEQ ID NO: 228157 - DNA, 4188 bp, Artificial Sequence
  Description of Artificial Sequence: Synthetic coding sequence
atggatacaaaactgatgtgcctgctctttttctttagcctgccccctctgctggtgtccaatcataccgggaggatcaaagtggtttttacacctagcatttgtaaggtgacgtgcactaaggggagttgccaaaacagttgtgaaaaggggaataccaccacactcatctcagaaaacggccacgctgctgatacgctaaccgccacaaacttcagagttgtcatctgccacttaccttgcatgaacgggggacaatgcagcagccgggacaaatgccaatgcccgcctaatttcacaggtaaactctgtcaaatcccagtccatggggcatctgtgcccaaactgtaccagcattcgcagcagccgggaaaggctctaggcacacatgtaattcactccacccacacattgccccttaccgtgaccagccagcaaggggttaaggttaagtttccccctaatatcgtgaacattcacgtgaaacatccacctgaggcctctgttcagatccaccaggtgtcacgcattgacggtccgaccggacagaaaactaaggaggcccagccaggccagtcacaggtctcttatcagggcttgcccgttcagaagacacagacaatacactcgacttactcgcaccagcaggttatacctcatgtctatcccgtggctgctaagacacagctgggccgttgtttccaagagacgatcggctcccaatgcgggaaagccctgcctggcctatcaaagcaggaagactgttgcgggaccgtgggcacctcctggggcttcaacaagtgtcagaagtgtcccaagaaaccttcataccacggatacaaccaaatgatggaatgcctgccgggatacaaaagggtgaataacaccttttgtcaggatatcaacgaatgtcagctgcaaggagtatgccccaacggtgaatgtctcaacaccatgggcagttacagatgcacatgtaagattggattcggcccagatcccactttttcaagttgcgttcccgatccgccagtgatctctgaggaaaagggtccgtgctaccgcctggtgagtagtggacgtcaatgcatgcaccctctgtctgttcacttgactaaacagttgtgttgttgttcagtagggaaggcctggggccctcactgcgagaagtgccccctgccaggtaccgctgcattcaaggagatatgcccaggaggcatgggctatacggtcagcggagtgcacagacgacggcctatccaccatcacgttggcaaggggcctgtgtttgtaaaacctaaaaatacgcaacccgtggcaaagtccacacacccccctcccctgcccgcaaaggaagagccagtcgaagcccttactttctcaagagaacatggtccaggggtggctgagccggaggtagcaacggccccacccgagaaagagattccgtcactggaccaggaaaagactaagttggaaccgggacaacctcagttaagcccgggaatttccacaatccatcttcatccacagttccctgtcgtcatagagaagacctctcccccagtgcccgttgaggttgcacccgaagcttccacatcaagcgcctcacaggtgattgccccaacccaggtcactgaaatcaatgaatgcacagtaaaccctgatatctgtggggctggccattgtattaatttgcccgttcggtacacctgtatttgctatgaaggctaccgtttctctgaacagcagcgtaagtgtgttgatatagacgagtgtactcaggtccagcacctgtgttcccaggggaggtgtgaaaacacggagggttcattcctgtgcatttgtccagcaggatttatggcaagtgaggagggcaccaattgcattgacgtcgacgagtgtctgaggcctgacgtctgtggcgaaggacattgcgtgaacacagtgggcgcttttagatgcgagtattgcgatagcggatatcggatgacccagcgagggcgatgcgaggatatagacgagtgcctgaacccatccacctgccctgatgagcaatgtgtcaacagtcccggatcgtaccagtgcgtgccgtgtacagagggcttccgaggttggaacgggcagtgcctcgatgtggacgagtgcctggaacctaatgtgtgcgctaacggcgattgttccaacctcgaggggtcttacatgtgctcatgtcacaaaggatatacgagaacaccggaccacaaacattgcagagatatagacgaatgtcagcaaggaaatttgtgtgtgaacggccaatgtaagaatacagagggttccttccgttgtacctgcggacagggctaccagttgtccgcggctaaagaccaatgtgaggatatcgacgagtgtcaacaccgccatctttgcgcgcatggccagtgcagaaatactgaaggctcgttccagtgtgtctgcgatcagggctatcgggcttccggcctcggagaccattgtgaagatatcaatgaatgcttggaggacaaatcagtgtgccaacgcggagattgcataaacaccgccggtagctacgactgcacatgcccggacggattccagctggacgataacaaaacctgtcaggacattaatgaatgtgaacaccccggactgtgcggtcctcaaggggaatgtctgaatacagaaggaagttttcactgtgtatgccagcagggtttctctattagtgcggatggacggacctgcgaagacatagatgagtgcgtgaataacaccgtatgtgactcccacgggttctgtgataataccgccggaagcttccgttgtctgtgctaccaaggcttccaggctcctcaggatggtcaaggctgcgtcgatgtgaacgagtgcgagctcttgtccggcgtctgcggagaagccttctgtgagaatgttgagggcagtttcctttgtgtgtgcgccgatgaaaatcaggagtattcccctatgaccggccagtgccggtctaggacaagcaccgatctggacgtcgatgtggatcaacctaaggaagagaagaaagagtgttattacaatctcaatgacgcttctctgtgtgataacgtgctcgcccctaatgttaccaaacaggaatgttgttgcacatccggggtgggctggggagataattgtgagatctttccctgtccagtactcggaactgctgaatttacagaaatgtgcccaaagggaaagggcttcgtgccggctggcgagagctcctccgaggccggaggagaaaattacaaggatgctgacgaatgcctcctgtttggacaggaaatatgcaagaatggtttttgtttaaacactcggccagggtacgagtgctattgcaagcagggcacctactatgaccctgtgaagctgcagtgctttgatatggatgagtgccaggatccatccagttgcatcgatggccagtgtgtcaacacggagggtagttataactgtttttgcacccacccaatggttttggacgccagtgagaagcgctgtatccgacccgctgagagtaacgagcaaatagaggagactgatgtctatcaagacttatgttgggaacacctgagcgatgagtatgtatgttcgcgcccactggtcggcaaacagacaacttacacagagtgttgttgtctgtatggcgaagcctggggtatgcagtgtgctctgtgcccccttaaagacagcgatgactacgctcaattgtgcaacatacccgttaccggtaggcggcagccctatgggagggatgctcttgttgacttctcagagcaatacacacccgaagcggacccatactttatacaagacagatttctgaacagttttgaggagctccaggccgaagaatgcggaattttgaacggctgtgagaacggaaggtgcgtgcgggtgcaagaggggtacacttgtgactgttttgatggttatcacctggacacagcaaaaatgacctgcgtcgatgtaaacgagtgtgatgaactcaataatagaatgtccctatgcaagaacgcaaaatgcatcaacaccgacggaagctataagtgtctctgcttacctggatacgtcccctcagacaagcctaattactgcacacctttgaatacagccctgaacctagagaaggacagcgacttagagtag

SEQ ID NO: 228158 - DNA, 4062 bp, Artificial Sequence
  Description of Artificial Sequence: Synthetic coding sequence
atggatacgaagctgatgtgtctactgttcttcttcagtttaccacccttgctggtctcgaaccacaccggcaggattaaagtggtgttcacccccagtatttgcaaagtcacatgtaccaagggatcttgtcagaactcttgcgagaaggggaatactacaactttgattagcgaaaatggacatgctgcagataccctaacagccactaactttagggtagttatttgccacctgccttgcatgaatgggggtcagtgttcctcacgtgacaagtgtcagtgtccacctaatttcaccgggaagttgtgtcaaattcccgtgcatggcgcttcagtgcccaagctctatcagcactcgcaacaacccggaaaagctctggggactcacgtcatccactccacccatacactgccgttgactgtgacgtcacaacaaggggtgaaggttaagtttccccctaacattgtgaacatccacgtcaagcatccaccagaagcaagcgtgcagatccatcaggtgtcacggatcgacgggccaacgggccagaaaaccaaggaggcacagcccggacagtcacaggtcagctatcaggggcttcctgtgcagaagacccagactatacattctacctattctcaccagcaggtgataccccatgtatatcccgttgcagctaaaacccagctgggcaggtgctttcaggaaaccattgggtctcagtgtggcaaggcactcccagggctcagcaaacaggaagactgctgcggaacagtgggaactagttgggggttcaacaaatgccagaaatgccctaaaaaaccatcataccacggttataaccagatgatggaatgtttgcctgggtataaacgcgttaacaacacattctgtcaggacatcaatgagtgtcagctgcagggtgtgtgcccaaatggggaatgcctgaacacgatgggcagctatcggtgtacttgtaagatcggattcggccctgatccgacattttcctcctgcgtccctgacccccctgttatatctgaagagaaagggccttgttaccggctggtgtcctccgggaggcagtgtatgcacccccttagtgtgcatctgactaagcagctgtgctgttgctccgttggtaaagcatggggaccccactgcgagaagtgtccactgcctggcaccgccgcattcaaggagatttgtcccggaggcatgggatacacggtcagcggcgtgcatcggagaaggcctatacaccatcatgtaggcaaggggcctgttttcgtgaagcccaaaaatactcaaccggtggccaaatctacccacccccctcccctgcccgcaaaggaggagcctgttgaggccctgactttctctcgcgaacacggtcccggagtggccgagcccgaagtagccactgctcctcccgaaaaagagatcccatctctggaccaagagaaaactaaattagaaccaggccagcctcaactcagtcctggaatctccacgatacatctgcacccgcagtttccagtggtgatcgagaagacctcccctcccgtaccagtggaggtggctccagaagccagcactagctccgcatctcaagtcatcgccccaactcaggtcaccgagattaatgaatgcacagtgaaccccgacatatgtggggctggacactgtataaacctgcctgttcgatatacctgtatttgttacgaaggttaccgcttctccgagcagcagcgcaaatgtgttgacatcgacgaatgcactcaggtacagcacctgtgtagccagggtagatgtgaaaacaccgaaggtagcttcctgtgtatttgtccagctggcttcatggcctcagaagagggaactaactgcatcgatgtggacgaatgtctcagaccagatgtttgcggggaaggccactgcgtgaatactgtcggggcatttcggtgcgagtactgtgacagcggataccggatgacccaacgcggacggtgcgaggacattgacgagtgcttgaacccttctacctgtccagatgaacagtgtgtcaactcaccgggatcctaccagtgcgtgccatgcacagagggtttccggggttggaatggacagtgtcttgatgtcgatgagtgcctggaacccaacgtctgcgctaatggcgattgctccaatcttgaaggaagttacatgtgttcttgtcataagggatacacccggacccccgaccataagcattgtagagatattgacgagtgccagcaaggtaacctgtgtgtgaacggacaatgtaaaaacaccgaaggctccttcagatgcacctgtggccaaggttatcaactctctgcagctaaggaccagtgcgaagatatcgacgaatgtcagcatcggcatctctgtgcccatggccagtgtagaaatacagaggggagcttccagtgcgtgtgcgaccaggggtaccgagcatcaggactaggcgaccactgcgaggacataaacgagtgtctagaagataagtctgtttgtcagaggggggattgtatcaatactgctgggagctacgactgtacatgccctgacgggttccagctcgatgacaataaaacatgtcaggatattaacgaatgtgagcacccaggcctgtgcgggccacagggcgaatgtctgaatacagaggggtcatttcactgtgtgtgccagcaaggcttctccataagtgcagatggaagaacttgcgaagatgtgaacgaatgcgagctgctgagcggcgtgtgcggtgaagcattctgcgagaacgttgagggtagttttttgtgtgtctgcgccgacgagaaccaagaatattcccctatgaccgggcagtgccgaagccggacctccaccgacctggacgtagatgtggaccagccgaaggaggaaaaaaaagaatgttactacaacctgaatgatgctagtctgtgcgacaacgtcctggccccaaacgtaacaaaacaggagtgctgttgtacatccggagttgggtggggagataattgtgaaatttttccttgccctgtcctgggaactgcagagttcacagagatgtgcccaaaggggaagggctttgtgcccgctggagagtcaagttcagaggcgggtggcgaaaactacaaggacgcggacgaatgccttctgttcggtcaggagatctgtaagaacggcttctgtctgaacacccggccaggatacgaatgctactgcaagcaagggacctattacgatcctgttaagctgcagtgtttcgacatggacgaatgtcaggaccctagctcttgcatcgacgggcagtgtgtcaatacggagggcagttacaactgtttttgcacgcatccaatggtcttggacgcttccgaaaaacggtgcattcggcctgctgagagcaacgagcagattgaggagaccgatgtgtaccaggatttgtgttgggagcacctgtcggatgaatacgtttgttcccgccctctggtgggcaaacagacaacttataccgagtgctgctgcctgtacggcgaagcttggggtatgcagtgtgcactgtgccctctcaaggatagtgacgattatgctcagctgtgcaatattccagttaccggtcgacgacagccctacggtcgcgatgcgctggtagacttctcagagcagtacacacccgaggctgacccctattttattcaggaccgctttcttaatagctttgaagaactgcaggcagaggaatgcggcatcctgaatggctgcgaaaatgggaggtgcgtgcgagtgcaagaaggctatacctgtgactgctttgatggctatcatttggacactgccaaaatgacctgcgtagacgtgaacgagtgcgacgagctaaacaaccgcatgagcctgtgtaagaacgcaaaatgtattaacacagacgggtcctacaagtgtctgtgtctccctggttatgttccttccgataaacccaactattgtacacctttgaatactgcacttaatctggaaaaggattcagatctggagtag

SEQ ID NO: 228159 - DNA, 4029 bp, Artificial Sequence
  Description of Artificial Sequence: Synthetic coding sequence
atggataccaagcttatgtgtctgctgttttttttcagtttacctcctttgctggtgagcaaccatactggacgaatcaaagtggtgtttactccttccatttgcaaggtgacatgtacaaaggggagttgccagaactcatgcgagaaggggaatacgactacactaattagtgagaacggccatgctgccgacacactgactgcaacaaactttagggtagtcatttgtcatctcccctgcatgaacggcggtcagtgctccagcagagacaagtgccagtgcccacctaatttcactggcaagttgtgccaaatcccggtgcacggcgcatctgtgcccaagctctaccagcattcccagcaacccggtaaggccctggggacacatgtcattcacagtactcacacactgcccctaaccgtgacttcacagcagggcgttaaggtgaagttcccgcctaatatcgtaaacatccacgtcaaacatcctcccgaagctagtgttcagattcatcaagtgagtcgcatcgatggccctactggacagaaaactaaggaggcgcagccaggacagtctcaggtatcatatcagggactcccggttcagaaaacccagacaatccattctacctattcccatcaacaggttattccgcatgtgtatcctgtcgcagctaaaacacagcttggtagatgcttccaggaaacaatcggatcccaatgcgggaaagctcttccaggtttgtccaaacaggaagattgttgtggaactgtgggtactagttggggctttaacaagtgccagaagtgcccaaagaagcccagttaccacggctataaccagatgatggagtgtctgcccggatacaaacgcgtcaacaacactttttgtcaagatatcaatgagtgtcagttgcagggagtctgtcccaacggagaatgcctgaacacaatgggatcgtatagatgtacctgtaaaatcggcttcggaccggatcccaccttctcttcttgcgtcccggaccctcccgtgatctcagaggaaaagggcccatgctaccgactcgtttccagcgggaggcagtgcatgcatcctctgtcagtgcacctgaccaaacaactgtgttgctgttccgttggaaaagcctgggggcctcactgtgaaaagtgtccactgcctggtactgctaaggaggaacctgtggaggccctgacattcagtcgagagcatggacctggcgttgctgagcctgaagtagcaaccgcacctccagaaaaggaaattccctctctcgatcaggaaaaaacaaaactggagccagggcaaccccagctctctcctggcatcagtaccatccacctgcatcctcagttcccagtggtaattgaaaaaacatcacctccagtgcccgttgaggtggcaccggaggcctctacctcttctgcatcacaggtcatcgccccaacacaggtcaccgaaatcaacgagtgtaccgtaaatcccgacatatgtggggcagggcactgcatcaatctaccagtcagatacacctgcatctgctacgaaggctatcgattttctgagcaacagcgaaagtgtgtggatattgatgaatgtactcaggtccagcacctctgttcccagggcagatgtgagaacaccgagggttccttcctatgcatttgccctgctggcttcatggcctcagaggaagggactaattgcatcgacgtggacgagtgcctcagaccagacgtgtgtggtgagggacactgcgttaataccgtcggcgcttttcgatgcgagtactgtgatagcggctacaggatgacacagagaggccgatgtgaagatatcgacgagtgcttaaatccctccacatgtcccgacgagcagtgtgtcaatagtccaggcagctatcagtgcgtaccgtgcacagagggctttcggggatggaacggccaatgtcttgacgttgacgagtgccttgagccaaatgtttgcgccaacggtgattgctccaacctcgagggctcttatatgtgctcatgtcacaagggatacacacggacgcccgaccataaacactgccgcgacatcgatgagtgccaacagggtaatctgtgcgtaaacggccagtgcaaaaacacagaaggctctttccgctgcacatgcggacagggttaccagttaagcgcagccaaggaccagtgtgaagacatcgatgaatgccagcacaggcatctctgcgcgcacggccagtgcagaaacaccgagggttcattccagtgtgtgtgtgaccaggggtatagggcaagcgggttaggcgatcattgcgaggacattaatgaatgcctagaagacaaatccgtgtgtcagaggggggattgtataaatactgcagggagctatgactgcacttgtcctgacggcttccaactggatgataataaaacttgccaggacatcaacgaatgcgaacacccaggcctgtgcggcccacagggggagtgcctcaacaccgaggggtccttccactgtgtttgccagcagggcttttccatctccgcggacggtaggacctgcgaggatatcgatgagtgtgtcaacaatacagtctgcgacagccacgggttttgcgacaatactgccggtagtttccgctgcttgtgctatcaagggttccaggccccacaggatggccaaggctgtgtcgacgtaaatgagtgcgagctgctgagcggggtatgtggcgaagctttctgcgaaaatgtagaaggatcctttctttgcgtgtgtgcagatgagaaccaggaatactctccaatgactggtcagtgtcggagtagaacatcaacagatctggacgtggacgtagaccagcctaaagaggaaaaaaaggaatgctactataatctcaacgatgcgtcactctgcgacaatgtgctggcccctaatgttaccaagcaggagtgctgttgcacctcaggcgtgggctggggcgataattgtgagattttcccttgcccagtgctgggtaccgccgagttcaccgagatgtgtcccaaggggaagggctttgttcctgctggcgaaagctcctccgaagcaggcggagaaaactacaaagacgccgatgagtgtctactgtttggacaagaaatttgcaaaaacggcttttgcctgaatacccgacccggttacgagtgctattgtaagcaaggaacatactacgaccccgtcaagctgcagtgtttcgacatggatgaatgccaggacccatcttcctgcatcgatggacagtgcgtgaataccgagggatcgtacaactgcttttgcacccaccctatggtgcttgacgctagtgaaaagcggtgtatacggccagcagagagtaacgagcagattgaagaaaccgatgtgtaccaagatctgtgttgggagcatctgagcgacgagtacgtttgttcacggccacttgtgggtaaacagactacttatactgaatgttgttgcctgtatggggaagcctggggtatgcaatgcgcattatgccctctgaaggattccgatgactacgcccaattgtgtaacattccagtgactgggaggcggcagccttatgggagggatgcattagtggatttttccgagcagtacacgccagaggctgacccgtatttcattcaggataggtttctgaatagctttgaagagctgcaggctgaggagtgcggcatcctgaatggatgcgaaaatggccgatgcgttcgggtgcaggaaggatacacctgcgactgcttcgatggatatcatctggacaccgccaagatgacttgcgtggacgtgaatgagtgcgatgaactgaataatagaatgtcactatgtaagaatgcaaagtgtataaatactgacgggtcctataagtgcttgtgtctaccaggctatgtcccctcagataaacctaattactgcacgccactcaacacagccctgaacctcgagaaggacagtgatctggagtag

SEQ ID NO: 228160 - DNA, 5466 bp, Artificial Sequence
  Description of Artificial Sequence: Synthetic coding sequence
atgaggcctaggactaaagcccgaagcccaggtagagccttaaggaatccatggcggggattcctccccctgacactcgcgctgtttgtcggcgctggccatgctcaacgagaccccgtgggccgttatgagcccgctggcggagacgcgaacagacttcgcagacctggaggatcttacccagctgcagcggcagctaaggtctattccttatttcgcgaacaggatgcccctgtcgcaggactccagcctgtggagcgcgcacagccaggctgggggtccccaaggcgacccaccgaggccgaggcccgaagaccctcacgggcacaacaatcacgcagggtgcaacccccagctcagacgagacggagcacccctctgggtcaacagcagcccgcacccaggactagagcggctcccgctttacctaggttggggacaccacagagatcaggagctgcacctcctaccccaccgcgaggtcgtcttaccggccgaaacgtgtgtggcggacagtgttgtccaggatggaccactgccaactccaccaaccactgcatcaaacctgtgtgtgaacccccttgtcagaacagaggatcttgtagcaggcctcagttatgcgtgtgtcggagtggcttcagaggagcacgttgcgaagaggttatacccgacgaagagttcgacccccagaactctcgcttagcacccaggagatgggccgagaggtctccaaacctcaggagaagcagcgccgcaggagaggggaccttagcacgagcacagccaccagccccacaatccccacctgcgcctcagagccccccagccggaaccttaagtggcctatcccaaacacatccttctcaacaacacgtcgggctctccaggactgtacgattacaccccaccgccaccgcatcatcccagctgtcatcaaacgccttgcctcccggacccggactggagcagagagatggtactcagcaggccgtgcctctggagcatccctcctcaccttggggcctgaacctgacagagaagatcaagaaaatcaaaattgtgtttactcccacaatttgcaagcagacatgtgcgagagggcactgtgcaaattcgtgtgaacggggagatacaacgaccttatatagtcaggggggacacggccatgacccgaagtctggcttccgtatctacttttgtcagattccctgcctgaacggagggaggtgtatcgggagggatgagtgctggtgtccagccaactccaccggcaagttttgccacctccccatccctcaaccagatagagagccacccggtaggggatcccgccctcgcgcactgctcgaagcccctctgaaacagagcacctttacgctgccactgagcaatcaactggcaagcgtgaacccctcactggtcaaagttcatatacatcatccccctgaagcttccgttcaaattcaccaggtcgcgcaggttcgcggtggggtcgaggaagccctcgtggaaaacagcgtcgagacaaggccccctccatggttacccgcttctcccggacattccctctgggactctaacaacatccctgccagatctggagagccacccaggcccctgcctccggcagcccctagaccgcgaggcttacttggcaggtgctatctgaacaccgtgaacggccaatgtgcgaatcccctgcttgagctcaccactcaggaagattgctgcggctccgtaggagccttttggggggtgactctgtgtgccccttgcccgccaaggcccgcatccccggtgatcgaaaacggacaactggaatgtccacagggctacaagcgactgaatttaacacattgccaagacatcaatgagtgtcttacactcgggctctgtaaagatgcagagtgcgtgaatactcgcggttcttacctgtgtacgtgccggccaggcctgatgctagacccatctcgatcacggtgtgtgtctgacaaagccatctccatgctgcagggattgtgttacaggtccctgggcccaggcacctgtaccctccctctggctcaaagaatcaccaaacagatctgttgttgcagtagggtgggaaaagcctgggggagcgaatgtgagaagtgtcccctcccgggtaccgaggcctttcgggagatctgccccgcagggcacggctatacctacgctagctcagacatcagactgagcatgcgtaaggctgaggaagaagagctcgctcgacctcccagggagcagggacaaagaagctccggagctctgcctggaccagcggagcgccagcccctgcgagtggtcaccgacacctggctggaagccggtaccattccagataagggcgatagccaggccggacaggtaacaacatccgtgacacatgcgcctgcctgggtcactggcaacgccaccacacctccaatgccagagcagggcatcgctgagattcaagaagagcaggtgacaccaagcactgacgtactggtgaccctttctacccccggaatagacaggtgcgccgcaggggctactaacgtgtgcggacctggcacctgcgtaaatctccccgacggctatcgctgtgtgtgttcccctggttatcagctgcatccatcccaggcatactgcactgacgacaatgagtgtctccgggacccatgtaaagggaagggcagatgtatcaacagggtggggtcctacagctgcttttgttacccaggctatactctcgcaaccagcggcgctacgcaggagtgtcaagacatcaatgaatgtgagcagcccggtgtttgctcaggtggtcaatgtacaaataccgagggtagctaccattgcgagtgtgatcaagggtacatcatggtgcggaaggggcactgccaagatattaatgagtgccggcacccaggaacatgccctgacggtagatgcgtcaattcgcccggatcttacacgtgccttgcctgcgaggagggttaccggggacagtccggttcctgcgttgacgtgaacgaatgtctcacccccggtgtgtgtgcacatggcaagtgtacaaacctggaaggcagctttcggtgtagttgcgagcaggggtatgaggtcacctcagacgaaaaaggatgtcaggacgtggatgaatgtgcttctcgcgcatcttgccctacgggcttgtgcttgaacactgagggtagtttcgcctgctctgcctgtgagaacggatattgggtgaatgaggatggaacagcttgtgaagatctcgatgaatgcgccttcccgggagtgtgtcccagcggagtctgtaccaataccgcaggctcctttagctgtaaagactgtgacggaggatacagaccctctcctctcggcgattcatgtgaggatgtcgatgaatgtgaggaccctcagagcagttgcctaggcggagagtgcaagaatactgtcggttcctaccagtgtttgtgcccccagggttttcagctagcaaacggaaccgtgtgtgaggatgtgaacgagtgcatgggcgaagagcactgcgcgcctcacggcgagtgcctgaacagtcacgggagtttcttttgtctgtgtgctcccggatttgtcagtgctgaggggggaacctcctgccaagatgtagacgagtgcgccaccacagatccttgtgtggggggacactgcgtcaacacggaaggcagtttcaattgtctgtgtgaaaccggcttccagccctcccccgaatctggcgaatgcgtcgatattgacgaatgcgaggactacggcgatccagtgtgcggaacttggaaatgcgaaaattctccaggttcataccgatgtgtcttgggctgccaacccggatttcatatggcaccgaacggcgattgcatagacattgacgagtgtgcaaacgacacaatgtgtggatcccatggtttctgtgacaatacagacggctccttccggtgcttgtgtgaccagggattcgagatttctccgtccggctgggattgtgtggatgtgaatgaatgtgaactcatgcttgccgtctgcggggcagcactatgtgaaaacgttgaggggagttttttatgcctgtgcgcctccgacctggaagagtacgacgcacaggaaggacattgccgaccccgaggagctggtggacagagcatgagtgaggctcccacaggagatcacgccccagcccctacaagaatggactgctactcggggcagaaagggcacgcaccctgttcctctgttctggggaggaataccacacaggccgagtgctgctgtactcagggagcttcctggggcgatgcgtgcgacctctgtccttcggaagacagcgccgagttctcagagatctgcccaagcggcaaaggctacattccagtagaaggcgcttggacattcggccagacaatgtacactgacgctgacgagtgtgtgattttcggacccggtctgtgtcccaatggcagatgcctaaacactgtacccggatacgtctgcctctgtaatcctggcttccactatgatgcatcacacaagaaatgtgaggaccacgacgagtgccaggaccttgcttgtgagaacggtgagtgtgtgaacaccgagggatccttccactgcttttgttccccacccctcaccctggatctgtcccagcagcgctgtatgaatagcaccagtagtaccgaagacttgcccgatcatgacatccacatggatatctgttggaagaaagtcacaaacgacgtctgttctgagccccttcgcggacacaggacaacatacactgaatgttgctgccaagacggcgaggcctggtcgcagcaatgtgccctgtgcccccctcgtagttccgaagtgtacgcccagctgtgcaatgtggctcggatcgaagctgagcgcgaagcgggagtgcatttcagaccaggatatgaatacgggccaggtcccgacgatctgcactatagcatttatggacccgatggagcacctttttacaactacttaggacctgaagacaccgtgcccgaacccgcttttcccaacacggccggtcatagtgccgacaggacccccatcttggagagtcctttgcagcccagcgagctgcaaccacattatgtggcatcccaccccgagcccccagctggttttgaaggtctgcaagcagaggagtgtggaatcttgaacgggtgtgagaatggtaggtgtgtgagggtgagggagggctacacctgtgactgcttcgagggattccagctggatgccgcacatatggcatgtgtcgatgtgaacgaatgcgatgacctgaatggccctgccgtcttgtgtgtgcatggctactgcgaaaatacagaaggctcttaccgatgtcattgtagtcctggttatgtcgcagaagccggaccacctcactgtaccgcaaaggaatag

SEQ ID NO: 228161 - DNA, 3912 bp, Artificial Sequence
  Description of Artificial Sequence: Synthetic coding sequence
atgccaggacccagaggcgctgctgggggactcgctcccgaaatgcgcggtgctggagcggcagggttgcttgctcttctactcttgttgctgctgctgttgcttggcctgggcggacgtgtggagggcggacccgctggcgagaggggggcaggtggtggaggcgcattggccagggaacgctttaaagttgtctttgcacccgttatatgcaaacggacatgtctcaagggacagtgccgggattcttgtcagcaggggtccaacatgacactcataggtgaaaatgggcatagtaccgacaccttaaccggaagtgggtttcgcgtcgtggtttgccctctgccatgtatgaacggcggtcagtgttcgtccaggaatcaatgtctctgccctccagacttcaccgggaggttctgccaagtgccggcagggggagcaggcggagggacggggggatccggacctggactgtctcgcactggggctctctcaactggtgctttacctcctctggccccagaaggcgacagtgtagcctctaaacacgccatttacgccgtccaagttattgccgatccccctggcccaggcgagggaccacctgcacagcatgctgcctttctagtcccactaggcccaggccagatatccgccgaggtgcaggcacctcctcccgtagtgaatgtccgggtgcatcatccacccgaagcaagcgtgcaggtacaccgcatcgagtctagcaacgctgaatccgccgctcctagtcagcacctactaccgcatcccaagcctagccatcccagaccacccactcagaaaccactggggaggtgctttcaggacacactaccaaagcagccctgcggctccaaccctctacctggactgactaagcaggaggattgctgcggttcgattggtactgcttggggccagtccaaatgtcataagtgccctcaactccagtataccggagtacaaaagccgggtcccgtgagaggagaagtaggggctgattgcccacagggatacaagcgattaaatagtacccattgtcaggacatcaacgaatgtgccatgccgggtgtatgtcggcatggggattgcctgaataacccgggttcgtatagatgcgtctgtcctcccggacattccctgggacccagtagaactcagtgcattgccgataagccagaggaaaaatctctctgctttcgtctcgtgtcacctgagcatcaatgtcaacatccccttactacacgtcttacgcgccaattgtgctgctgcagcgtgggaaaagcatggggtgcacggtgtcagcgatgccctacagatggaacagcagcattcaaggagatctgcccagccggtaagggataccatatacttaccagccaccagaccctgacaattcaaggcgagtccgacttctcgctgtttttgcatccggatgggcctcccaagccccagcaattacctgagagcccctctcaggccccaccaccagaagacaccgaagaggagcgaggcgtgacaaccgacagccccgttagcgaagagaggagcgtgcagcagagtcatcccacggctaccaccacacccgctcggccttatcctgagcttatctctcggcctagccctcctactatgcgatggttcctacctgacctgccgccatccaggtccgcagtagaaatcgcaccaacccaggttaccgagacagatgaatgtaggttgaatcagaatatctgtggccacggcgaatgtgttccaggcccaccggattatagttgtcactgcaatccgggttatcggtctcacccacaacacaggtactgtgtggacgtaaacgaatgcgaagctgaaccttgtgggccaggcagaggtatctgcatgaatacaggaggttcctacaactgccactgtaataggggctacagattgcatgtgggcgctggaggcaggtcctgtgtcgacctgaacgagtgcgccaaaccacacctgtgtggcgacggtggattctgcatcaactttccaggacactacaagtgtaactgctatcccggataccggctgaaagcttctcgccctccagtctgcgaggatattgatgaatgtagagatccaagttcctgtcctgatggtaagtgcgagaacaagcccggatcttttaagtgcattgcctgtcagccaggttatagaagccaaggcggaggtgcttgcagagacgttaatgagtgtgcagaaggctctccctgctcaccgggatggtgcgaaaatctgcctggctcattcaggtgcacatgtgcccagggctacgctcctgctcccgatggcagatcttgccttgatgttgacgagtgcgaggctggcgacgtatgcgacaacgggatttgcagtaatacgcctggttccttccagtgtcaatgcttatccggatatcacctgagtcgagatagatcccattgcgaggacatcgacgaatgcgatttccccgctgcctgtatcggaggggactgtattaacaccaatggttcttataggtgtctgtgtccacagggtcatcgcctggtcggtggtagaaaatgccaggacatcgatgagtgttcacaggacccatcattgtgcctccctcacggagcatgtaagaatctgcagggatcctacgtttgtgtctgcgatgagggcttcactccaactcaggaccagcacggatgcgaggaggtggaacagccccatcacaaaaaggagtgctacctcaacttcgatgacacagtgttctgtgattcagtgctcgccaccaacgtgacccagcaggaatgctgctgctcgttaggggctgggtggggggatcattgtgaaatctacccatgtcctgtttacagctctgccgaatttcacagcctgtgccctgatggcaaaggctacacgcaggataacaacatcgtcaattatggaatcccagctcaccgggacatagatgagtgtatgcttttcggtagcgagatatgcaaggaaggcaagtgtgtgaatactcagcctggctacgaatgctactgtaaacagggtttctactatgacggaaatttacttgaatgcgtagacgtcgacgaatgtctggatgaatcaaactgccgaaatggagtgtgtgagaacacacgtggaggataccggtgtgcatgtaccccacccgctgagtacagcccagctcagcgccagtgtctgagtccagaggagatggatgtggatgagtgccaggacccggctgcttgtagaccgggacgctgcgtgaacctcccgggatcgtatcgatgcgagtgccggcctccctgggtgccgggaccgagtggcagagattgccaattgcctgagagtcccgcagaaagggcgccagaacgcagggacgtttgctggtcacagcgaggggaagatggaatgtgcgccggtcccctcgcagggcctgctctcaccttcgacgactgttgttgccggcaagggagaggatggggagctcaatgccgcccttgtcctcccagaggcgctggcagccattgccctacttcacagtctgagtccaacagcttttgggacaccagcccgttactcctgggcaaacccccacgggacgaggattcatctgaggaagacagtgatgaatgccggtgtgttagcgggagatgcgtgcccaggccaggcggagctgtgtgcgaatgtcccggtggctttcagctggatgcctcacgagccaggtgtgttgacatcgatgaatgcagagagttgaatcagagaggcctgttatgcaaatccgaaaggtgtgtgaatacaagtgggagcttcaggtgtgtttgcaaagcaggattcgccagatctcgccctcacggagcctgcgtgccccagcgccgtcgatag

SEQ ID NO: 228162 - DNA, 792 bp, Artificial Sequence
  Description of Artificial Sequence: Synthetic coding sequence
atgcttttcggatcggagatctgcaaagagggaaaatgtgtaaatactcagcctgggtacgaatgctactgcaaacagggattctattatgatggaaatttacttgagtgcgttgacgtggatgagtgtctggatgagagcaattgcaggaatggggtgtgtgaaaacacaaggggcggatacaggtgcgcctgcaccccacccgctgagtactctcctgcacagcggcagtgcttgagtccggaagaaatggacgtggacgagtgccaggatcctgcagcctgtcgccctgggcgttgtgttaacttgccaggttcttaccgctgcgagtgccgccctccatgggttcctggcccttcaggccgagattgtcagttgccagagtctccagctgaacgcgcaccagagcggagagacgtgtgttggtcccaaagaggcgaagacgggatgtgtgcaggcccactggcaggacccgctctgactttcgatgattgttgttgccgacagggcagaggttggggcgcacagtgccggccatgccccccacggggtgctggcagtcactgcccgacaagtcagagtgaatctaactcgttttgggacacttctccactattgcttgggaaacccccacgagatgaagatagctccgaggaagacagcgatgagtgccggtgcgtatccgcagcagcatgccgaggcagggctgctccctgcgcatccgtccccgctgccagctcatccacaccaccagcccctgcggcttggatctccaccagcgcagagagctag

SEQ ID NO: 228163 - DNA, 3771 bp, Artificial Sequence
  Description of Artificial Sequence: Synthetic coding sequence
atgccaggacccaggggcgcagcaggcggtttggcccctgaaatgcggggagctggcgctgctggcctcctggccctgttgttgcttctgctgctgctcctgctcggccttggtgggcgtgtcgagggcggaccagccggtgagcgaggagcaggaggaggcggtgccttggccagggaacgattcaaggtagtcttcgcacccgtgatttgcaagagaacctgcctcaaaggccagtgtagagactcatgtcaacagggctctaacatgactctcatcggggaaaatggccactccacagacactcttaccggttccgggttcagagtggtcgtttgccctctcccctgtatgaatgggggacagtgtagttcccgcaatcagtgcctgtgccccccagatttcactggacgtttctgccaggttccagcaggaggagcaggagggggtacaggcggtagtggtcccggactgtcccggaccggcgcattatccaccggagccctccctcccctggctcctgagggcgacagtgttgcctccaagcacgcaatttacgccgtccaggtgatcgccgacccgcctgggcctggagaggggccacccgcacaacatgcggctttcctagtgccactgggaccaggtcagatttcagcagaggttcaggcccctccacccgtggtgaacgtgagggtccatcacccaccagaagcctctgtccaagttcatcgcattgagtcttcgaatgccgagagtgccgctccctcccagcatttgctgccgcaccccaaaccatctcatcctcgccctccaacgcagaagccacttggcagatgttttcaggacactctgccaaagcagccctgtggcagcaatcccctgccaggcctgactaaacaggaggactgctgcggttctatcgggactgcctgggggcagtctaagtgccacaagtgcccgcagctgcagtacactggtgtgcagaaacccggaccagtgcgtggtgaagtgggcgctgactgcccccaagggtataaacgacttaacagcactcactgtcaggacatcaatgagtgcgctatgcccggagtgtgcagacacggagactgtcttaacaatcccggatcgtacaggtgtgtttgcccccctggacactccttgggacccagccggacccagtgcattgcagacaagccagaggagaagtcgctttgtttcagactggtctctcccgagcaccagtgccaacacccccttaccacacggctcactcgccagctgtgttgctgttctgtgggtaaagcttggggcgctcgatgccagagatgcccgaccgacggtaccgccgcatttaaagagatatgtcccgcaggtaaaggctaccatattttgacatcacatcagacactcacaatccagggtgagtccgatttcagtcttttccttcatcctgatgggcctcccaaaccacagcagctacccgagagcccctcacaggcgccaccccctgaagacacagaagaggaaaggggagtgacaacggacagccctgtgagcgaagagaggtccgtgcagcagtcacaccctaccgcgactaccacccccgcaagaccctatcccgaactgatatcgagacctagccccccaaccatgcgttggttcctgccagatctgccaccaagcagatctgctgtggagatagccccaacgcaggtgaccgaaaccgacgagtgccgacttaaccaaaacatctgcggacatggcgagtgtgtcccaggacctccagactatagttgtcactgcaatcctgggtacagatcacaccctcagcacaggtactgcgtagatgttaacgaatgtgaggccgaaccttgcggcccaggaagagggatctgcatgaacacgggcggatcatacaattgccattgtaacagagggtacaggctgcatgtaggggctgggggtaggtcatgcgttgacctgaatgagtgcgctaaaccccacctctgtggagacggcggattttgcatcaattttcccggtcattataagtgtaattgctatccaggctaccgcctgaaggcgtccagacctcccgtgtgcgaagatatagatgagtgtcgtgatccatcaagctgcccagacggcaagtgcgaaaacaaaccagggagttttaagtgtatcgcctgtcagccagggtacagatcccagggaggcggagcatgcagggatgtcaatgagtgcgcagagggcagtccctgttcccctggttggtgcgagaacctgccaggcagtttcaggtgtacttgtgcccaaggctacgctccagctcccgatggtcgatcctgcttggacgtagatgagtgcgaagcgggtgacgtgtgcgacaatggcatctgttcaaatacaccgggttccttccaatgtcaatgtttatccgggtaccacttaagcagggacaggtcacattgcgaggacatcgacgagtgcgactttccagccgcatgcatcggcggagactgcatcaacaccaatgggtcctaccgctgtctgtgcccacaaggacaccggctggtgggcggacgtaaatgtcaggacattgacgaatgcagccaggatccatctctctgtctccctcatggagcatgcaaaaacctgcaggggagttacgtttgtgtttgtgatgagggatttacccccacacaggatcaacacggctgtgaagaggtagagcagccacaccataaaaaagaatgttatctaaattttgatgacacggtcttctgcgattctgtgctggcaacgaatgtgactcagcaagaatgctgctgttccctgggagccggatggggggaccattgcgaaatctatccatgtcccgtctattcatcagccgagttccattcactgtgccctgatggaaagggctacacacaagataataatattgtaaattacggtattccagcgcatcgggacattgatgaatgtatgctctttgggagtgagatttgcaaagagggaaagtgtgtcaacactcagccaggatacgagtgctattgcaaacagggcttttattacgacggcaatcttttagagtgcgtggacgtggacgagtgccttgatgaatcgaattgtcggaatggagtctgtgagaatacccgagggggataccgttgtgcttgtacccctcccgctgagtattcacctgctcagcgccagtgcctctcacccgaggagatggagcgggcacctgaacggagggatgtgtgctggtctcagcgaggtgaagatggaatgtgcgccggtccacttgctgggcctgccctgacatttgacgactgctgctgtcggcagggtagggggtggggcgctcagtgcagaccctgtccccctcgcggtgcaggcagccactgccctacctcccagtctgaaagcaatagcttttgggataccagtccattgcttctcggaaaacccccaagggacgaggacagttcagaagaggactccgatgaatgccgttgtgtgagcggtcgctgtgtacccagacccggtggtgctgtttgtgagtgtcctggcggttttcagctcgatgcctcccgcgcacgctgcgtggatatagacgagtgcagagaacttaatcagcgcggactactctgcaagagtgaaagatgtgttaacacctccggcagctttcggtgtgtttgcaaagcgggtttcgcacggtcccggccacatggcgcatgcgtgccacagcgaaggagatag

SEQ ID NO: 228164 - DNA, 921 bp, Artificial Sequence
  Description of Artificial Sequence: Synthetic coding sequence
atgctcttcggttcggaaatatgtaaggaggggaaatgcgttaacacccagcctggatatgagtgttactgtaagcagggtttttattatgatggaaaccttctcgagtgtgtcgatgtggacgaatgtctggatgaatccaattgtagaaatggggtgtgtgaaaataccagaggtgggtacaggtgcgcctgcactccacccgctgaatacagccctgcacagagacaatgcctctcacctgaggagatggatgttgacgaatgtcaggatcccgctgcctgtcgcccaggaagatgcgttaacctgcctggctcctatagatgcgagtgcagacccccttgggtaccgggaccttccgggcgagattgccagctgccagaaagccctgctgagagagctcccgagagacgggacgtttgttggtcccagcgaggcgaagatggcatgtgtgctggcccattagccggaccagccctgacattcgatgactgctgctgccggcaaggacgtggctggggcgcacagtgtcgcccttgccccccaagaggagccggaagccattgccccactagtcagtcagagagtaatagcttctgggacacctcgcccctcctgctgggcaagcccccacgcgacgaagactcctccgaggaggatagtgatgagtgtcggtgtgtctctggcagatgcgttcctcgcccaggcggtgccgtctgcgagtgcccaggaggcttccaactggatgcttctcgtgctaggtgcgtcgatattgatgaatgcagggagctcaaccagaggggcctactgtgtaaatccgagcggtgcgttaatacaagcggctctttcaggtgcgtctgtaaagctggcttcgcgcgatcccgtccacacggtgcttgcgttccccagagaaggaggtag

SEQ ID NO: 228165 - DNA, 3414 bp, Artificial Sequence
  Description of Artificial Sequence: Synthetic coding sequence
atgacactgattggtgagaacgggcacagcacagacacgctgacagggtctggcttcagggttgtagtgtgcccactcccatgtatgaacggagggcagtgttcatccaggaaccagtgtctgtgccccccagatttcaccggacgcttttgccaggtgcctgctgggggagccggaggaggcactggtggaagtggacctgggctgtcacggacaggagcactgagcacgggggcacttccacccttagcaccagagggagacagcgttgcttctaagcacgctatttatgccgtgcaggtgattgctgacccccctggtccaggcgagggccctccagctcaacatgcggctttcctcgtgcccctgggtccaggccagatatctgccgaagtccaggcaccaccgcctgttgtcaacgtccgggtccatcatcctccagaggcctctgtacaggtgcaccggatcgagtctagcaacgcagagagcgcagcgcctagccagcacctcctgcctcaccccaaaccctcccacccgagaccccctacgcagaagccactcggtcgttgtttccaggatacactgccaaagcagccatgcggaagtaatccactgcctggtctgaccaagcaggaggattgctgtgggtcaattggcacggcctggggtcagtctaaatgccacaagtgcccacagctccagtacactggagttcagaaaccaggaccggtgcggggagaagtcggggcagactgtccacaagggtataagcgcctcaatagcacacactgtcaggatatcaacgagtgcgccatgcccggtgtatgccgccacggcgactgtcttaataatccaggctcctaccgctgtgtgtgcccgccaggacactccctgggtcctagccggactcaatgcatagcggataaacctgaggaaaagagtctttgtttcaggttagtcagcccagaacaccagtgtcagcacccattgacgactagattaacaaggcagctctgctgttgctcagtcggtaaagcctggggagcgagatgtcagcgatgtccaactgatggcaccgctgctttcaaagaaatctgccccgcaggaaaaggttaccacatacttacaagtcatcagacgctaacaattcagggcgagtccgatttcagtttatttctacacccagacggccctccaaagccgcagcaactcccagagagccccagtcaggcccctccaccggaagatactgaagaggaaaggggggttactacggattcccccgtgagcgaggagcggtcagtgcagcagtcccacccgactgctactacgacccctgcaagaccataccccgaattaattagtaggccctctccgccaacaatgaggtggttccttcccgatcttccaccaagtcgaagtgccgttgagatcgcacccacccaggtgactgagaccgatgaatgcaggctgaatcagaacatatgcggacacggagagtgcgtgcctggtcctcctgactactcatgccattgcaaccccggatatcggtctcacccgcagcatagatattgcgttgacgtcaacgagtgtgaggctgaaccttgcggaccgggacggggaatctgcatgaataccggcggttcctacaactgccattgcaacagaggctacaggctccatgtgggggcaggcggacgttcgtgtgtcgatttgaacgagtgcgctaagccccatttgtgcggggatggcggtttttgtatcaattttccgggacactataagtgcaactgctatcccggataccggctgaaggcttctcgcccacctgtctgtgaagacatagatgaatgcagagacccaagttcctgtcccgacggaaaatgtgagaataaaccgggaagcttcaaatgtatcgcctgccagccaggataccgtagtcaaggaggtggggcttgcagggatgtcaacgagtgtgccgaagggtccccctgtagcccagggtggtgcgagaatctgcctggaagcttccgatgtacatgcgctcagggctatgcccctgcaccagatggcaggtcttgcttggacgttgatgaatgcgaagccggagacgtgtgcgacaatggtatctgctccaatacaccaggatcattccagtgtcagtgtctatctgggtaccacctttcacgggatagatctcactgtgaggatatcgatgagtgcgactttccagccgcatgtattggcggagactgtatcaacactaatggcagttacagatgcctctgccctcagggccacaggttggtgggcggtagaaagtgccaggatattgatgaatgttctcaggacccatctctgtgcctgccacatggcgcttgcaagaatctccaagggtcctatgtgtgtgtgtgtgacgagggcttcacgcccactcaggaccaacatggctgtgaggaggtcgagcagccacaccacaagaaggagtgctatctgaactttgacgacaccgtgttctgtgattcggtcttggcgactaacgttactcaacaggaatgctgctgctctctgggggctggctggggagaccactgtgaaatctatccgtgccccgtctatagtagcgccgaattccactccctctgccctgatggcaaaggatacacacaggataataacatcgttaactacgggatccccgctcatcgcgatatcgacgagtgtatgctctttggttcggagatctgcaaagagggcaagtgcgtcaacactcagcctggatacgaatgttattgcaagcaaggattttactacgacggaaaccttctggaatgcgtcgacgtggatgagtgtctggacgaaagcaactgccgcaacggtgtgtgtgaaaacacaaggggaggctatcgctgtgcttgcaccccgcctgctgagtactctccggctcaacgacagtgtttgtctcccgaagaaatggatgtcgatgaatgtcaggatccggcagcttgccgtcctggtcggtgcgtaaatctgccagggtcgtacaggtgcgagtgtcgcccaccatgggtgcctggcccatccggcagggattgtcaactgcctgagtctccagccgagagagcacccgaacgacgcgatgtctgttggagccagagaggtgaggacggaatgtgtgccggacctctggccggaccagcactgacatttgatgactgctgttgtcgccagggccgaggctggggcgcacagtgtagaccttgtccaccgagaggcgcaggatcccactgccccaccagccagagcgagtccaattctttctgggataccagcccactgctattgggtaaacctccacgcgacgaggactcttccgaagaagacagcgacgagtgccgatgtgtatccgggtag

SEQ ID NO: 228166 - DNA, 2202 bp, Artificial Sequence
  Description of Artificial Sequence: Synthetic coding sequence
atgcctgctgagacggacgaatgcagactgaatcagaatatatgcggccacggtgagtgcgtaccagggccacccgactatagctgccactgcaatcccggttaccggtcccaccctcagcacaggtattgtgtggacgtgaacgaatgcgaggccgaaccctgtgggccaggtagaggaatttgtatgaataccggagggtcatacaactgtcactgcaaccggggatatcgcctgcatgtcggcgcaggagggaggtcctgcgtggaccttaacgaatgtgctaagccgcacctctgcggggacggcggattctgcatcaatttccccggacactacaaatgcaactgctatcctggatacagacttaaagcctccagacccccagtgtgtgaagatatcgacgaatgtagagatccatcgagctgtcccgatggaaagtgcgaaaacaagcctggcagctttaaatgtattgcctgccaaccaggctacaggagccagggcggaggagcctgtagagacgttaacgagtgtgccgagggctccccgtgctctccaggatggtgcgagaatctacccggttcctttcgctgtacatgtgctcaagggtatgcgcctgcccctgacggccgtagctgtctggatgtagatgagtgcgaagcaggcgacgtgtgtgataacggaatctgcagcaacactcccggatccttccaatgtcagtgcctcagcggatatcacctgagccgcgatcggtcccactgcgaggacattgatgaatgcgacttcccagccgcttgcatcggcggagattgcatcaatactaatggcagttacagatgcctgtgcccacagggtcaccgactcgtgggaggcaggaagtgtcaggacatcgatgaatgcagccaggatccttcgctctgtttgccccatggagcctgcaaaaaccttcaaggctcctatgtctgtgtgtgtgatgaggggtttacaccaacgcaggaccagcatggatgcgaggaagtcgagcagccacaccataagaaggaatgctacctaaactttgatgatacagtgttctgcgacagcgtgctggcaacaaatgtcacacagcaggaatgctgctgttcactgggagcgggatggggggaccactgtgagatctacccgtgtcctgtgtattcttctgctgaatttcacagcctgtgcccagatggaaagggctacacccaggataacaatatagttaactatggtatcccagctcacagagacatcgacgagtgtatgctgttcggatcagagatctgcaaagaaggcaagtgtgttaacacccagcctggctatgagtgctattgcaaacaaggattttactatgacggcaatctgctcgaatgcgtggacgtagacgaatgcttagatgagagtaactgtcggaatggcgtgtgtgaaaatacgcggggtgggtaccgctgcgcttgcaccccgccagccgaatattcgcccgctcagcgccagtgcctgtctcctgaggagatggacgttgacgaatgtcaggatcctgccgcttgccgccctggcagatgtgtgaacctgccgggaagctaccggtgtgagtgccgcccaccttgggtgcccggtccttccggtcgggactgccagctaccagaatcacctgctgagcgtgcccctgaaaggcgggacgtgtgttggagtcagagaggagaagacgggatgtgtgccggtccgctcgccggaccagcccttaccttcgacgactgttgttgccgtcaaggcagagggtggggggcacagtgccgaccttgtcctcccagaggggctgggagccactgccccacctctcagtcagagagcaattccttttgggacacttctccattacttctcgggaagccccctcgggacgaggattcaagcgaggaggattctgacgaatgccgctgtgtttcagggaggtgcgtgcccaggcccggaggggctgtgtgtgaatgcccgggtgggtttcagctggatgcaagccgcgctcgatgcgtcgatattgatgaatgtagagagctgaaccagcgcggactcctgtgtaaaagtgaacggtgcgtgaacacgagcggatcctttagatgcgtatgcaaggctgggttcgcacgttcaaggccccacggcgcatgcgtcccacagcggagacggtag

SEQ ID NO: 228167 - DNA, 2649 bp, Artificial Sequence
  Description of Artificial Sequence: Synthetic coding sequence
atgaccctgattggcgagaacggacactctaccgacaccctgacaggatccggattccgggtcgcggataaacccgaggagaaatctctgtgctttagactcgtcagtccggaacatcagtgtcagcaccctctcacgaccagactgacacgccagctatgctgctgctcagttgggaaggcctggggtgcacggtgtcagcgctgtccaacagacggtaccgccgctttcaaggaaatatgtcccgctgggaagggttatcatattctcaccagccaccaaactcttaccattcagggtgaatcagattttagcctcttcttgcatcctgacggccctcccaagcctcaacagctcccagagtccccatcccaggcccctcctccagaagacactgaggaagagcggggtgtgaccactgattcccctgtgagcgaggaacggtctgtgcagcagtcccaccctacggcaaccacgactcccgcacggccttatcctgagctgatctccagaccatctcccccaactatgcggtggttcttaccagacctgccaccctccaggtccgccgtcgaaatcgccccaacacaggtcactgagaccgatgagtgccggctcaatcagaacatttgcggccacggagaatgtgttcctgggcctcccgactacagctgccattgtaacccaggatatcggtctcacccccagcacagatattgtgtggatgtgaatgagtgcgaggcagaaccctgtggccctgggagaggtatctgtatgaatactgggggtagctacaattgtcattgcaatcgaggttaccgcctgcacgtcggcgcaggtggcagatcatgcgttgacctgaacgagtgcgcgaaaccccatctgtgcggagatgggggtttttgcattaactttccgggacattataaatgcaattgctatcctgggtatcgactaaaggcaagccgccctcccgtatgtgaagacatcgacgaatgccgtgatcctagttcatgccccgacggcaagtgtgagaacaagcctggaagcttcaaatgcattgcctgccagccgggttatcgctcccaggggggtggggcttgccgggacgtcaatgagtgtgccgagggctccccttgctctcccggatggtgcgaaaacctcccaggctcatttcgttgtacctgtgcccaaggatatgcccctgccccagacggcagatcctgccttgatgtggacgagtgtgaagctggagacgtatgcgacaacgggatttgcagtaacaccccaggcagcttccaatgccagtgcctttctggctatcatctttccagggatcgctcacattgcgaagatatcgatgagtgcgacttcccggcagcttgcatcgggggtgactgcatcaacaccaacggatcctatcggtgcttgtgccctcaaggccataggttggttggaggcagaaaatgtcaggatattgatgaatgcagccaggacccctctctgtgtctgcctcatggagcttgtaaaaatttgcagggctcttacgtgtgcgtgtgtgacgagggatttacacctacccaggaccagcatggctgtgaagaggtggagcaaccccaccataaaaaagaatgttacctcaatttcgacgacacagtcttctgtgattctgtgctggctacaaatgtcacccagcaggagtgttgctgctctctcggcgctggatggggagaccactgcgagatatacccttgcccagtatactctagtgctgagtttcatagcctgtgccctgacggcaaaggctacacccaggacaataacatagtgaattacggtatcccggctcaccgggacatcgatgaatgcatgcttttcggctccgagatttgcaaggagggtaaatgcgtgaacacgcagcctggctatgaatgctactgcaaacaaggattctactacgatggcaatcttcttgagtgtgtcgacgtggatgagtgtcttgacgagagcaactgtaggaatggcgtctgtgagaacactcgcggtggttaccgctgcgcctgcactccacctgccgagtatagcccagcgcagagacagtgtctctctcctgaggagatggagcgtgcgcctgaaaggcgcgacgtgtgctggtctcagagaggcgaagacggcatgtgtgccggtcccctagcaggaccagcccttacttttgacgactgttgctgcagacaaggcagaggatggggcgcacagtgcagaccctgcccccctcgtggtgcgggttctcattgtcctaccagccaaagtgaaagcaatagtttttgggacactagccctctcctgctgggaaagcctcccagagacgaggatagttccgaagaggatagcgacgaatgccggtgtgtctcaggaagatgtgtgcccaggcccggtggcgctgtgtgcgaatgcccaggaggtttccagctggatgcttccagagctcggtgcgttgatattgatgagtgcagagagttgaaccagagggggcttctttgcaagagcgaaaggtgtgtgaacacttcgggttcgttcagatgtgtatgcaaagctggattcgcgaggagtcgacctcacggagcatgcgtcccccaaagacgaagatag

SEQ ID NO: 228168 - DNA, 4761 bp, Artificial Sequence
  Description of Artificial Sequence: Synthetic coding sequence
atgggcgacgtgaaggccctgttgtttgtcgcggcagctcgcgctcgccgattgggaggtgctgcggcttctgagtctctggccgtgtctgaggcattttgcagggttcgctcctgccagccaaaaaagtgcgcgggaccacagaggtgcctgaatcccgtgcccgcagtgccttccccttccccctccgtaaggaagcgtcaggtttccttgaactggcagcccttgacactgcaggaagcccgtgccctactaaagagaaggcggcctcgtgggccagggggaaggggactcttgagacggagaccacctcagagagcgcctgcaggaaaggcaccggtgctgtgcccactgatctgtcataacggtggtgtgtgcgttaaacccgatcgttgtctgtgccccccagacttcgctggaaaattctgccaactgcacagttctggagccaggcctcctgccccagcagtccctggcctcacacggagcgtgtacacaatgccactcgctaaccacagagacgatgagcacggggttgccagtatggtttccgtacacgtagaacaccctcaggaagcatccgtggtggtgcaccaggtcgagcgcgtgagtggaccctgggaagaggccgacgcagaagccgttgctcgcgctgaggccgctgcaagggcagaagccgctgccccttacacagtgttagcacagagtgcgcctcgcgaagatggatacagtgatgcgtccgggtttggttattgttttagggagcttagaggcggagaatgtgcgtccccgctccccggactacggactcaagaggtttgctgcagaggggcaggccttgcctggggggtgcatgattgtcagctctgttcagagcgactgggtaacagtgagcgcgtatcagccccagacgggccttgccccacaggtttcgaaagggttaatggctcctgtgaagatgttgatgaatgtgcgactggaggccgttgccaacatggtgagtgcgcaaatacccgagggggttacacatgtgtctgtccggacgggtttctgctggactcgtctcgatccagttgtatttctcagcatgtgatttctgaggcaaaaggtccttgttttagggttctccgagatggcggatgtagtctccccatactgcgcaatattactaaacagatctgttgctgtagccgcgtaggcaaagcctggggccgaggatgtcagctttgtccgcctttcggttcagaaggtttcagggagatttgtcctgccggtccaggctatcactatagcgcttcggatctgcggtataatacccgtccattgggacaggaaccaccacgagtctcactcagtcagccgcgaacattgcccgcaaccagtcgcccatccgctgggttcctcccgacacacaggctggagcctcggcctgagcctcggcctgatccccgtcccggaccagagctccctctgcctagtatcccagcatggacaggtcccgaaattcccgagtccgggccatcatccggcatgtgccaacgaaaccctcaagtgtgtggcccaggacggtgcattagtagaccctcaggatatacttgcgcctgcgacagtggattccgccttagcccacaggggacccggtgcatcgatgtcgacgagtgcaggagggtaccccctccgtgcgcacctggacgatgtgaaaattctcccggttcttttagatgcgtctgcggaccgggattccgggcaggtcccagggctgcagaatgtctcgacgtagacgagtgccacagggtaccccctccatgtgatttaggtagatgcgagaatacaccgggatccttcctgtgtgtgtgccctgccggttaccaggccgcaccccacggggcttcttgtcaggacgtcgacgagtgcacacaaagccccggtctctgcgggaggggagcctgtaaaaacctccccggatcattccgatgcgtgtgcccagcagggttcaggggatccgcttgcgaggaggacgtagatgagtgtgcccaggagccaccaccatgcggccctggccgatgcgacaatacagccggttccttccactgtgcctgtccagccggatttcgttcccggggaccaggcgcaccctgtcaggacgtggacgagtgtgctaggtctccaccgccttgtacgtacgggagatgcgagaacaccgaaggctctttccaatgtgtctgtcccatgggattccagcccaatacagctggctccgagtgtgaagacgtggacgaatgtgagaaccatctggcatgccccggtcaggagtgcgtcaactctcccggttccttccagtgtaggacctgccccagcggtcatcacttgcatagagggagatgcactgatgtggatgagtgctccagtggggcacccccatgtgggcctcatggccattgtacaaacacagaaggttcatttaggtgctcctgcgcgccaggatacagagccccttcagggcgacccggtccctgcgctgacgtgaatgagtgcctagagggcgacttctgtttcccacatggtgaatgcctcaataccgacggctcctttgcttgcacctgcgctcccggataccgtcctgggccaagaggtgcctcttgcctcgacgtggacgagtgctcagaagaggacctctgccagtccggcatttgcacaaataccgacggatcttttgaatgtatttgcccccctggccaccgtgccggacctgatctggccagctgcttagacgtagatgaatgtcgcgaacggggacctgcgctctgcgggtcccagcgatgcgagaacagcccgggatcttaccgttgcgtcagggactgtgatccaggataccacgcgggaccagaaggcacgtgtgacgatgtggacgagtgtcaggaatatggccctgagatttgcggcgctcagcgctgcgagaatacccctggatcctataggtgcactccagcttgtgatcccggataccagccgactcctggcggaggctgccaggatgtcgacgaatgccggaaccgcagtttctgtggcgctcacgccgtatgccagaacttgcccggatcttttcagtgtttgtgcgaccagtatgagggcgctcgcgacggaagacactgtgtcgacgtgaacgaatgcgaaactctccagggagtatgcggagcagccctgtgcgagaatgtggaaggatcattcttatgcgtgtgcccaaatagccctgaagagtttgacccaatgaccggtcgttgcgtgccacctcgcacatcggctggaactttccccggatctcagccacaggcgcctgccagcccagtgctgccggctagaccaccgcctcctccactgcccagacgtccctccacaccacgacagggcccagtgggatccggcaggcgagaatgctactttgataccgctgctcccgatgcatgcgacaacattctcgctcgcaacgttacctggcaagaatgttgctgcacagtgggtgaggggtggggcagtgggtgcagaattcagcagtgtcccggaaccgagacagccgaataccagagtctgtgtccccacggcagaggctacctggcaccttcaggagacctctccctgaggcgggatgtggacgagtgtcagctgtttcgagaccaggtgtgcaagtcaggtgtttgtgtgaacaccgcccctgggtacagctgctactgtagcaacggctattattaccacacccagagattggagtgcatcgacaatgacgagtgcgctgatgaggagccagcgtgtgaaggaggaaggtgtgttaatacagtgggaagttatcactgtacgtgtgagccacctttagtcctggacggcagccagagacgctgcgtaagcaacgaatcgcagagcctggatgacaatctgggtgtctgctggcaggaagtgggagccgatctggtttgctctcaccccaggcttgacaggcaggccacatacaccgaatgttgctgtctgtatggcgaggcttggggtatggactgcgcactttgtccggcacaggactctgacgactttgaggccttatgtaacgttctgagacccccagcctactctccgccaaggcctggaggttttggtctgccttatgagtacggccctgaccttgggcctccctatcagggactcccatatggtccggaattgtacccacctccagcgcttccatatgacccttatcctcccccacctgggccatttgcgaggcgcgaagctccctatggggctccacggtttgacatgcctgactttgaggatgatggaggaccctatggggaatctgaggcacctgcccctccaggccctggaacacgatggccttacaggagccgcgacacacgacgctctttcccagagcccgaggagccgcctgagggaggaagttacgctgggtctctcgccgaaccctatgaggaactggaggcggaggagtgcgggattttagacggttgtaccaatggtcgctgcgtgcgcgttcccgaaggattcacctgccggtgctttgatgggtatcggctggatatgactcggatggcctgtgtggatattaatgaatgcgacgaggcagaggccgcttctcccttatgtgtaaacgctcggtgtttaaacaccgacggttcttttcggtgcatctgtcggccaggctttgctcctacccaccagccccaccattgcgctccagcaagaccacgtgcgtag

SEQ ID NO: 228169 - DNA, 561 bp, Artificial Sequence
  Description of Artificial Sequence: Synthetic coding sequence
atgttggggggagccggaggcggacctggacttcgaacaccttgtcctgccgatgtcgatgaatgttccgaggaggacctttgccaatcaggtatctgcaccaatactgatggtagcttcgagtgcatctgtccccctggtcacagggccggtcccgacctggctagctgcctggacgtggatgaatgtagagaaagaggaccggctctgtgcggcagccagcggtgcgagaactctcccggatcatatcggtgcgttcgcgattgtgatcctggttatcatgcagggccagaggggacttgcgatgacgtagatgagtgcaggaataggtcattctgtggggcacacgcggtctgtcagaacttgcccggatcctttcaatgcctgtgcgatcagtacgaaggggctcgagacggacgccattgtgtcgatgtgaatgaatgtgagaccctacagggagtgtgtggagctgccctctgcgaaaacgtggaagggtcttttttgtgtgtgtgccccaattctcccgaagagttcgatcctatgactggacggtgtgtgtag

SEQ ID NO: 228170 - DNA, 4872 bp, Artificial Sequence
  Description of Artificial Sequence: Synthetic coding sequence
atgcctcggcctgggacctctggaaggcgccctctgctgctggtcctccttttgcctttgtttgcggcagccacttcggctgcatcaccttctccttctccttctcaggtagttgaagtgccaggggtcccttctcgtccagcgtcagtggcggtgtgccggtgctgcccgggacagactagcaggaggtctcgctgtatacgagcgttctgcagggttcggtcatgccaaccgaaaaaatgtgccggaccccagaggtgtttaaacccggtccctgcagtaccaagcccttctcccagtgtgaggaagcgccaagttagtctcaattggcagccgctgactctgcaggaagccagagccttgttaaagcgccgaaggcctcggggaccaggcggtcggggactcttaagaaggaggccaccccagcgcgcaccagctgggaaagccccagtcctgtgtccattaatctgccacaacgggggagtgtgcgttaagcccgatcggtgcctgtgtccacctgactttgctggaaagttctgccaactgcattctagcggagccaggcctcctgcccctgccgtgcccggactgacgaggtcagtgtatactatgcccctggcaaaccaccgtgacgacgagcacggggtggcttctatggtttcagtgcacgtggagcacccgcaagaggccagcgtcgtggttcaccaggttgagcgcgtcagtggcccatgggaggaggccgacgctgaggctgtcgccagggcagaagccgctgcacgagccgaggctgccgctccatataccgtcctggctcagagtgccccacgggaagatggctactcagacgcttccgggtttggttactgctttagagaactgcggggaggagagtgtgcctcgcctctccccggacttaggacgcaggaggtgtgttgcagaggagcaggactcgcttggggggttcacgactgccagctgtgctccgaacgcctgggtaacagtgagcgcgtgtcagcccctgacggaccttgtccgactggcttcgagagagtgaacggtagttgcgaagatgtcgacgagtgtgccactggcggaaggtgccaacatggcgagtgcgctaatactaggggcggttacacatgtgtttgtcccgacggatttctgcttgacagcagtcgcagctcctgtataagccagcacgtcatctctgaggccaaaggtccttgtttccgggtcttacgtgatggcggatgctcactaccaattctgcgtaatattacgaagcagatctgctgttgcagccgtgtgggaaaggcctggggtcgcggttgtcagctgtgtcctccgtttgggagtgaaggatttagagagatctgtccagccggtcctgggtaccattactcggccagcgacctacgctacaacactagaccccttgggcaggagcctcctagggtcagcttatcccagccaagaacccttccagccacatcccgcccatctgccggtttcctccccacgcaccggcttgaacctcgccctgaaccgagaccagaccctagaccgggacctgaacttccacttcctagcatccctgcttggactggccctgagatccccgaatctggtccgagcagcggcatgtgccagaggaacccacaggtgtgtggccctgggcgatgcatttcaagacctagtggctacacctgtgcatgtgatagcggctttcgacttagtccgcagggaactagatgtatcgatgtcgatgagtgccggcgagttcctccaccatgcgcccctgggcgttgtgagaattctccgggtagcttcagatgcgtatgtggccctggatttagggcaggtcccagggccgcagaatgtctggacgtggatgagtgccaccgggtccctccaccatgcgacttagggcgatgtgagaataccccaggcagctttttgtgtgtgtgtccagctgggtatcaggccgcaccacatggggcttcatgtcaggacgtggatgagtgtactcagtcccccggactgtgtggtaggggcgcatgcaagaatcttcctggatccttccgctgtgtttgcccggcaggattcagaggatccgcctgtgaagaggacgttgacgagtgcgctcaggagccacctccttgcggccctggacgctgtgataatacagccggtagttttcactgtgcttgtcctgctggctttagaagtcgaggccctggggctccttgtcaggatgtcgatgagtgtgctaggtccccacccccatgtacttatggcagatgtgagaataccgagggcagttttcaatgtgtctgcccaatgggattccaaccgaacactgccggaagtgagtgtgaagacgtcgacgagtgcgagaatcatttagcttgtccaggccaggagtgtgtcaattcacccggtagctttcagtgccggacttgtcccagcggccaccacttgcacaggggaagatgcacagatgtggatgagtgctccagcggcgcaccaccatgcggtcctcatggccattgtaccaacaccgagggttccttcagatgctcttgtgctcccggatacagggccccatcgggccgacccggaccctgcgcagatgtgaacgagtgtctcgaaggagacttctgctttcctcacggcgagtgtcttaatactgatggctcctttgcttgtacgtgcgcacccggatacaggcctggcccaagaggggcttcttgtctggacgtggatgaatgctccgaagaggacctgtgccaaagtgggatttgcacgaatacggacggatctttcgagtgcatctgcccacctggccatcgagctggaccggacctcgccagctgcttggacgtcgatgaatgtcgggagagaggtcctgccttatgtgggtcacaacgttgcgagaattccccgggatcctaccgctgcgtgagagattgcgaccccggttaccatgctggcccagagggcacctgcgacgacgtcgatgagtgccaggagtatgggccagagatctgtggggctcagcgatgtgagaatactccaggctcgtacaggtgcacccccgcttgtgatcctggatatcagcccacccctgggggaggttgtcaggatgtggatgagtgtcggaataggtctttttgtggcgctcatgcagtctgtcaaaacctgcccggatctttccagtgtctctgcgaccagtacgagggcgctcgagatggcagacattgtgttgatgtgaacgaatgtgagacactacagggcgtgtgcggagctgctctgtgtgagaacgtcgagggctctttcctgtgtgtctgcccaaactctcctgaggaatttgatccgatgaccggcagatgcgtacccccaaggacctctgcagggacctttcccggttcgcagccacaggccccagcatctcccgtcctaccagctaggcctcccccacctccactccccaggcgcccaagtacaccaaggcaaggacccgtgggctcagggaggagggagtgctactttgacacagccgcaccagacgcctgtgacaatatcctggctaggaacgtcacctggcaggaatgctgctgcaccgtaggagaggggtggggctctgggtgcagaatccaacagtgtccaggcacggaaacagctgaataccagagcttatgcccgcacggccgaggttacttagcgcctagtggtgacctctctttgcgcagggatgtggacgagtgtcagctcttccgcgaccaggtgtgtaaaagcggcgtatgcgtgaacacggcaccagggtattcatgctactgctccaacggctactattaccacacccagagactagaatgcatcgataatgacgaatgtgccgatgaagagcctgcctgcgagggaggcagatgcgttaatacagtaggatcctaccattgcacatgcgaaccaccattagtactggatggatctcagcggcgatgtgtgtccaatgaaagccaaagccttgatgacaatctcggagtgtgctggcaggaggtaggcgcagaccttgtctgctctcacccaagactcgatcggcaagcaacctataccgagtgttgttgtctgtatggggaggcctggggcatggattgtgcactctgccccgctcaagatagtgatgatttcgaagcactgtgcaacgtcctacgtccaccagcatatagtccacccagacctggcggatttgggctaccttatgaatatggccctgacttaggccctccatatcaggggcttccttatggccctgagctgtacccgcctcccgcactaccgtatgacccctatccacctcccccaggcccttttgccagaagagaggcaccctacggggctcctcgatttgatatgcctgacttcgaggatgatgggggtccttatggggagagtgaggccccagctccccctggcccaggcacccggtggccttaccgatcaagagacacccggaggtcctttcctgagccagaagaacccccagaaggtgggagctatgcagggtccctggccgagccctacgaagagctagaggccgaagaatgcggtatcctcgatggctgtactaatggaagatgtgtccgggtgcccgaggggtttacatgcaggtgcttcgatgggtaccgccttgatatgacccggatggcatgcgtggatattaacgaatgtgacgaagcagaagccgcttctccactgtgcgtgaacgcgaggtgtctcaacactgatgggagcttccgatgcatctgcagaccgggtttcgccccaacacatcagcctcatcattgcgccccagccaggcctagagcttag

SEQ ID NO: 228171 - DNA, 1155 bp, Artificial Sequence
  Description of Artificial Sequence: Synthetic coding sequence
atgacgggaaggtgtgtgccaccaagaacgtcggcagatgtcgatgagtgccagctgttccgagaccaggtgtgtaagagtggggtctgcgtgaatacggctccgggatatagttgctactgtagtaacggatactattatcacacacagcggctggagtgtattgacaacgatgagtgcgccgatgaagaacccgcatgtgagggtggacggtgcgtgaacactgtggggagctatcactgtacctgtgagcccccacttgttctcgatggcagtcagcgaaggtgtgtttctaatgagtcccagagcctcgacgacaacttgggagtatgttggcaggaggtcggcgctgatttggtttgctcacaccccagactcgacagacaagcgacatatacagagtgctgttgtctttacggcgaagcctggggtatggattgtgcgctgtgccccgctcaagacagtgacgattttgaggccctttgcaatgtcctcagacctccggcttacagcccccctcgtccagggggattcggcctgccgtatgagtatggtccagatttgggccctccttaccaaggtctcccctatggcccagagctgtatcccccaccagccctcccctacgacccatacccccctccaccgggaccattcgccagacgggaggctccttatggcgcaccccgtttcgatatgcctgatttcgaagatgacggcggaccgtacggcgaatcagaagcgcctgccccacccggtcccggaaccaggtggccatatcggagtcgagacaccaggaggtctttccctgaaccagaagagccccctgaagggggttcttacgccggatctctggcggagccgtatgaggagctggaggccgaggaatgcgggattctggacggttgtaccaatgggaggtgtgtgcgcgtgcctgaagggtttacatgccggtgcttcgatgggtaccggctggacatgacgcggatggcctgcgtagatatcaacgaatgcgacgaagctgaagctgcatcccccctgtgcgtaaacgccagatgtttaaatacggacgggtcattcaggtgcatctgtaggccaggattcgccccaacacaccaaccacaccactgcgctccagctaggccacgggcatag

SEQ ID NO: 228172 - DNA, 4671 bp, Artificial Sequence
  Description of Artificial Sequence: Synthetic coding sequence
atggccggaggagtccgcctgctgtgggtttccctgcttgtgctcctggctcaactcggaccccagccgggtctggggaggctgggagagaggctgagggtacggttcacacctgtggtgtgcggacttcggtgtgttcacgggccaacagggagtagatgtacacccacgtgtgcacccaggaacgccacttcggttgacagtggtgccccaggcggagctgctcccggagggcctgggtttagagccttcctgtgccccctgatctgtcacaatggcggtgtctgtgtgaaacccgaccgatgcttatgccctccggactttgcaggcaagttttgtcagcttcacagttcaggagcccgtcccccagctcccgctgttcctggactgaccaggtcagtgtataccatgcctctagccaaccatagagacgacgagcacggcgtggcctccatggtgagtgtgcatgtcgagcatccgcaagaggccagcgttgtcgtgcatcaggtagagcgggtgagtggcccatgggaagaagcagacgcggaagcagtagccagggctgaagcggctgcaagagcagaggccgctgcaccttatacagtgctggcgcagtctgccccacgagaggacggctatagcgatgcatctggatttgggtattgtttcagggagttgcggggaggggagtgcgcctctccgctcccaggcctgcggacgcaggaagtatgttgtaggggagctggactagcgtggggtgttcacgactgtcagctctgctcagagcggttgggtaacagtgaaagggtttctgctcccgacggaccgtgtcccactggctttgaacgcgttaacggctcttgcgaggatgtagacgagtgcgcaacgggaggacgttgccagcatggcgaatgcgcgaatacccgaggtgggtacacctgcgtctgcccagatggcttcctgctcgactcatccagaagtagttgcatcagccagcatgtcatatccgaagcgaaaggcccatgcttcagagtgctgcgggacggcggttgttccctgcctatcctccgcaatatcacaaaacagatatgttgctgcagccgtgtgggaaaggcttggggacgcggatgccagctatgcccccctttcggttccgagggatttcgcgaaatctgcccagccggacccggatatcactacagtgcgtctgatctccgctacaatacgaggcctctaggccaggagccccctcgtgtaagcctgtctcagccacgtaccttacccgctaccagcaggccctcggcaggtttcctccccactcatcgcctggagccgaggcccgaaccacgccctgatccacgacccggtccagaattgcctctgccttccatccctgcttggaccggaccagagatcccggagtctgggccatcctccggcatgtgccaacgcaatccacaggtgtgcggaccagggaggtgtatctcacggccaagtggctacacctgcgcctgcgatagcggtttccgcctgtccccccaggggacgcggtgtattgatgttgatgagtgtagacgcgttcctcccccatgtgccccaggacgatgtgaaaactcaccagggtctttcaggtgtgtttgcgggcctgggtttcgtgccggacctcgggctgcagaatgcctggatgtcgacgagtgccatcgggtgccccctccatgtgacctgggccgatgcgagaacacaccgggatcttttctgtgtgtgtgtcctgcaggctaccaagctgccccacatggtgccagctgtcaggacgttgacgaatgtacacagtctcccggactctgtggcaggggggcttgcaagaacttacccggttcttttcgctgcgtttgccctgcgggatttagaggatccgcttgtgaggaggacgtagatgagtgcgcacaggagccgccaccctgtggtcccggtcgatgcgataataccgccggatctttccactgtgcttgccccgctgggtttcggtctcgcggaccaggcgctccctgccaggacgttgatgaatgtgccaggagcccaccaccttgtacctacggaagatgtgaaaatactgagggaagcttccagtgcgtttgtcctatgggctttcagccaaatactgccggatctgagtgtgaggatgtggacgagtgtgagaatcatctggcgtgtcccggtcaggagtgtgttaattcgccgggatccttccaatgccgaacctgtcccagcgggcatcacctgcatcggggaaggtgtacagatgtcgatgagtgcagttcaggcgcaccaccttgtggacctcacggccactgtactaacacagagggctcctttagatgctcctgcgcacctggctacagggcaccctccgggagaccaggcccatgcgctgacgtgaacgagtgccttgaaggtgacttttgttttccccatggtgagtgcttgaacactgacggctcttttgcttgcacatgcgcccctggctacagaccgggtcctaggggggcatcctgtctcgatgttgatgaatgcagcgaagaggacctctgccaaagcgggatctgcactaatactgatggttccttcgaatgtatatgcccaccgggacaccgtgccggaccggacctggcttcctgcctggacgtggatgaatgcagagaacgcggacccgctctgtgtggctcacagcggtgcgagaactctccgggaagctaccgctgcgtgcgcgactgtgatcctgggtatcatgccggacccgaaggcacctgcgatgacgtggacgaatgccaagagtatgggcctgaaatatgtggtgcacaacgctgtgagaatacgcctggctcttacaggtgcacacctgcttgcgaccctggatatcagccgacgccagggggtggatgccaagacgtagacgagtgtagaaacaggtccttctgcggcgcacacgcagtctgtcagaacctgccaggcagcttccagtgcctctgtgaccaatacgaaggtgcacgggatgggaggcactgtgtcgacgtgaatgagtgcgagactctgcaaggtgtgtgcggcgctgccctgtgtgagaacgtcgagggctctttcctgtgcgtctgccccaacagtccggaagaattcgaccctatgactgggagatgcgttccaccacggaccagcgccggaacctttcccggtagtcagccccaagctcctgcctcgccagtgctgcccgcaaggcctccgcctccgccactcccaaggcggcctagcacaccccgtcaggggcctgttggttcaggaagaagagagtgctattttgacactgctgctcctgacgcttgtgataatattcttgccagaaacgtgacttggcaagagtgttgttgtactgttggcgagggctggggcagcgggtgtcggattcagcagtgtcctggcacagagactgcagagtaccagtcactgtgcccccatgggagaggatacttggcaccctcaggcgatctgagtctgcggagggacgtcgacgaatgtcagctgttcagagatcaggtgtgcaagtccggcgtttgtgtgaacacagcccctggatactcttgctactgctcaaatgggtactactaccatacgcagcgactcgagtgcatcgacaacgacgagtgcgcagacgaggaacccgcatgtgagggaggcaggtgcgtcaacactgtcggctcataccattgtacatgtgaacccccactggtgctcgatggttctcagagacgatgcgtgtccaacgagagccaatccctggatgataacctaggggtgtgctggcaggaggtgggtgcagacctggtgtgctcccatccaaggctggatcgtcaggcgacctatactgagtgctgttgcttgtatggagaggcttggggcatggactgtgccctttgtcccgcacaagactctgatgactttgaagcactgtgcaacgtccttcggcctcccgcttactctccccctcgaccgggtggttttggtctgccctatgaatatggtcccgacttgggcccaccataccagggtctcccctatgggcctgagctatatcccccacccgctcttccctatgacccttacccaccgcctcccggtccattcgcacggcgtgaggctccctatggagccccacgattcgatatgccagatttcgaagacgatggcggtccgtacggggagtccgaggcacctgcgcctccaggacctggcacaaggtggccatataggtctcgggacacaaggcgctcctttcccgagcccgaggaaccaccggaagggggaagttatgctggatctctcgcagagccttatgaggaacttgaagctgaggagtgcggcattctggacgggtgcactaatggcaggtgtgtcagagtgcctgaaggattcacctgtagatgttttgatggctaccggctggacatgactcggatggcctgtgtggatatcaatgaatgcgacgaagcggaagccgcttctcccctctgtgtgaatgccaggtgcctcaacactgacggcagcttccggtgtatctgtagacccggattcgccccaacccaccaaccacaccattgcgcaccagcgaggccacgagcctag

SEQ ID NO: 228173 - DNA, 2700 bp, Artificial Sequence
  Description of Artificial Sequence: Synthetic coding sequence
atgtgccagcgcaatcctcaggtgtgtggacccggtaggtgcatcagccgcccatctggatatacttgtgcttgtgatagtggctttcgactgtcacctcagggaacacgctgcatcgacgtcgacgaatgccgcagagtccccccaccctgcgccccaggcaggtgcgaaaactcacctggaagctttaggtgtgtgtgcgggcctggtttccgcgctggacccagagcagcagaatgtctggacgtagatgagtgccatcgggtgcccccaccctgtgatcttgggaggtgtgaaaacactcccggttccttcctgtgtgtgtgtccagctggataccaggcagcacctcacggggcatcatgtcaggatgttgacgagtgtacgcagagcccaggtctttgcggacggggagcctgcaagaatcttcctggtagctttagatgcgtgtgccccgctgggtttagagggtccgcatgtgaggaggacgtggacgagtgcgcccaggagcctccaccttgtggtcccggacgttgtgacaacaccgccggttcgtttcactgcgcttgccctgcgggtttcagatccagaggtcccggagcgccatgccaggacgtagacgaatgcgctaggtctccgcctccgtgtacgtacggcaggtgtgagaacaccgagggaagtttccaatgcgtttgtccaatggggttccagccaaacactgcagggtctgagtgcgaggacgtggacgagtgcgagaaccacctcgcctgcccaggtcaggaatgtgtgaactcccctggctcctttcaatgcagaacctgcccctcagggcatcacttgcacaggggacgttgtaccgatgtcgacgagtgttcgtctggggctcctccatgcgggccacatgggcactgcacaaatacggagggaagcttcaggtgctcctgcgccccaggttaccgagccccaagtgggcgaccgggaccttgtgctgacgttaatgagtgcctggaaggcgatttctgtttcccccacggggaatgcctgaacacagatggatcgttcgcctgcacctgtgcacccggatatcggcctggccctcgcggagccagttgcctggacgttgatgagtgcagcgaggaagatctctgtcagtcgggaatctgtaccaacactgacggcagttttgaatgcatatgtcccccagggcaccgggctggccctgatctggcgagttgtcttgacgtggacgagtgccgagaacgagggcctgccttgtgtggatcccaaagatgtgagaattcaccaggaagttaccggtgcgtcagagattgcgacccaggctaccacgctggtccagaaggtacgtgtgatgacgttaatgagtgtgagacactgcagggcgtgtgcggcgctgcactgtgcgagaacgtggaaggatcatttctctgcgtgtgcccaaactctcctgaagagttcgacccgatgacagggaggtgcgtgcccccacgaacgtccgccggtactttccctggtagccaaccccaggcgcctgcctcccccgttctacctgcacggccaccccctccacccttaccaagacggccaagcactcctaggcagggccctgtcggaagtgggagacgagaatgctactttgacacagctgctcctgatgcatgcgataatatcctggccagaaatgtaacttggcaggagtgctgctgcacagttggagaagggtgggggtccggatgtagaattcaacagtgtccaggaaccgaaacagcagagtaccagagtctctgcccacacggccgaggatacctggctccaagcggtgatttgtcactgcgcagggatgtggacgagtgccaactctttagagaccaggtgtgtaaatccggtgtttgtgtgaacaccgcacctggttattcctgttactgctctaatggctactactaccatacacagcgcttagaatgtatagacaatgacgagtgcgctgatgaggaacccgcttgtgaggggggtcgctgtgtgaatacagtcggatcctaccactgcacctgcgagcctcctcttgtactcgatggatctcagaggcgctgtgtgagtaacgagtcccaatccctggacgacaatttgggagtatgctggcaagaggtcggcgctgatctcgtttgttcacatccgaggctggaccggcaggcgacttatactgagtgctgttgcctgtacggggaggcatggggtatggactgcgccctgtgccccgctcaggactccgacgatttcgaggccctgtgtaatgtgctgcggcctcctgcctactccccgcctcggcctggcggattcggcctgccttatgaatatggccctgatctgggcccaccttaccaggggcttccctacggaccagaactttaccctccacctgcattgccctatgacccttacccacctcctcctggcccttttgcgcgtcgagaagctccttacggcgctcctagattcgacatgcccgactttgaagacgacgggggaccttacggtgaaagcgaagccccagctccacccggaccaggtacgcggtggccctacagaagtcgggataccaggcgatcctttccagagcctgaggagccccctgagggtgggtcttatgcaggctcactggctgaaccttatgaagaactctag

SEQ ID NO: 228174 - DNA, 639 bp, Artificial Sequence
  Description of Artificial Sequence: Synthetic coding sequence
atgtggacctcagctacagcttgtcgaagaagggtgaccagtggcgcagccaggacccgtcaggcagcctcctgcgcttgcgccccaccaggcaccaggctgcaccggactgagcccgctgcgaggatgtggatgtcagtaccagaagcccctcaccctgctcctactgcgggtgtgaggacacaaaaggcagcctcaagcgtttctgctccctgggctagcaatcctacgctgctggctccaaatgtggacgagtgtgaaaatcacctggcgtgccccggacaagagtgcgtcaacagccccggatcattccaatgcagaacttgcccaagtgggcatcacctacaccgaggcagatgcacagatgtggacgagtgctctagcggcgcacccccatgtggtccgcatgggcattgcaccaatacggaaggcagttttcggtgctcctgcgcacccggttatagagctccatctgggagaccaggtccatgcgccgacgtaaacgagtgcctggaaggtgacttctgtttcccacacggcgagtgtctgaacactgatggtagctttgcctgcacttgcgccccaggctatagacccggacctaggggcgcaagttgcctcggctcttatccaggttag

SEQ ID NO: 228175 - DNA, 669 bp, Artificial Sequence
  Description of Artificial Sequence: Synthetic coding sequence
atggagatcccccctaccaactatcccgcttctagggccgcactggttgcccagaactatatcaactatcagcaggggacacctcaccgggtgttcgaggtgcagaaggtgaaacaagcctcgatggaagatattcccggaagaggccataaataccacctgaaatttgcagttgaggaaattatacagaaacaagttaaagtgaactgtacagcagaagtgctgtacccatccacaggtcaggagacagcacccgaggtcaatttcacctttgagggcgagacaggtaaaaaccccgatgaagaggacaataccttttatcagcggctgaagtctatgaaggaacctctggaagcccagaatattccagacaactttggaaatgtgagccccgagatgacgctcgtgctccatctcgcctgggtggcatgtggatatatcatctggcagaacagcactgaggacacatggtataaaatggttaaaattcaaaccgtgaaacaagtgcaacgcaacgacgatttcattgagttggattatacaattctactgcacaatattgccagtcaggaaatcattccctggcagatgcaggtgttgtggcatccgcagtacggaacaaaggtcaaacataatagtagacttcccaaggaggtgcagcttgagtag

SEQ ID NO: 228176 - DNA, 888 bp, Artificial Sequence
  Description of Artificial Sequence: Synthetic coding sequence
atgggccttcccgtgagctgggctccaccagccctctgggtgctgggatgctgtgctctgctcctgtctctttgggccctgtgtactgcatgccgcaggcctgaggacgccgttgcacccaggaagcgggcaagacgacagagggcgagattacaaggcagcgccacagctgcagaagcttctctgcttcggaggactcatctgtgtagtctgtccaaatccgacacaagactacatgaactgcatcgtggcccaaggtccagccgcgcactgcgccctgcctccatggacttactaaggccccattggctggaggtgagtcgagatattacagggccacaagcggctccctccgcttttcctcaccaggaattgccacgtgcactgcccgctgctgctgcaacagccggatgcgcgggacttgaggctacatatagtaatgtgggcctggctgctcttcccggagttagcctagctgcctcgccagtcgtggcggagtacgcaagggtacagaagcggaaaggaactcatagatctcctcaggaacctcagcaaggtaagactgaagtgactcccgctgctcaggtagacgtgctgtattccagggtttgtaaacctaaaaggcgtgatccaggcccaactaccgacccactggatcccaagggccagggtgccatcctcgccctggcaggcgatcttgcttaccagacattgcccttgcgcgcacttgacgttgactcaggacctctggaaaatgtctatgagagcatccgagagctcggagacccagccggaagaagctccacatgcggtgccggaacccctccagcctcttcttgcccatctctcggacggggttggaggccgttgcctgcctcacttccatag

SEQ ID NO: 228177 - DNA, 324 bp, Artificial Sequence
  Description of Artificial Sequence: Synthetic coding sequence
atgggtttgcccgtcagctgggctccccctgctctctgggtgctcggttgctgcgccctgctcctctcactttgggctctatgtactgcctgccggcgacccgaagatgccgtcgcaccgagaaagcgggctagacggcagagagcccgtctgcagggctcagccaccgccgctgaggcaagtcttctacgtcgtacccatctgtgctcactgtctaaatctgatacccggctccatgagttgcacagaggccctcgaagctcccgggctcttcgcccagcctctatggatctgctgaggccacactggctggaggtgagttag

SEQ ID NO: 228178 - DNA, 2094 bp, Artificial Sequence
  Description of Artificial Sequence: Synthetic coding sequence
atgggcgaacgggctgggtctcctgggactgatcaagagcgaaaggcgggtaaacatcactactcttacctgagtgacttcgagaccccacagagcagcggacgtagttccttagtgtctagtagccctgcctctgtgcgtcgcaagaatccgaagcgacagacaagcgacggacaagtgcaccatcaggcccctagaaagccctctcctaaaggccttcctaatcgcaagggggtaagagtagggttccgctcacagtctctgaatagggagccacttcggaaggacaccgacctggtgaccaagcggatcctctcagcccgactgctgaaaatcaatgaactgcagaacgaggttagcgagctccaggtcaagctggcagagcttctgaaggagaacaaatcactgaaacgactgcagtaccggcaggaaaaagccctgaataagttcgaggacgctgaaaatgaaattagtcaattgatcttccggcacaataatgagataaccgcattaaaagagcgactgcgcaaatcccaggaaaaagagcgcgctacagagaagagggttaaggatactgagtccgaattattcaggaccaaattcagccttcagaaactaaaggaaatctctgaagcccgtcaccttcctgaacgcgacgacttggccaagaagttggtgagtgcggagttaaagctggacgacacggagcgacgcataaaggagctttctaaaaatctggaattaagcactaacagctttcaacggcagctgctcgcagagagaaagcgggcatatgaggcccatgacgagaacaaagtgcttcagaaggaagtgcaacgcctgtaccataaactgaaagagaaagagcgagagctcgatattaaaaacatatattccaaccgtctgcccaaaagctccccgaacaaagaaaaagagctcgccctccgtaaaaacgccgcatgccagtcagacttcgctgacctctgtaccaaaggtgtgcagacgatggaagacttcaaacctgaggaatatccactgacacctgaaaccatcatgtgctacgagaataaatgggaagaacctggacatcttacactcgacctgcagagccaaaagcaagacagacatggtgaagcaggcatcttgaatcccataatggagagagaggaaaaattcgtgactgatgaggagttgcatgttgtgaagcaggaggttgaaaaactcgaggatgaatgggagagagaggagcttgataagaaacagaaagagaaagccagtcttctcgagagagaggagaagcctgagtgggaaactgggcgataccagttgggaatgtatcccatccagaatatggataagctccagggcgaggaagaggaaagacttaagcgggagatgctgctggcaaagctgaatgaaatcgacagagagctccaagactcgagaaacttgaagtaccccgtgctccccctcctccccgatttcgagtctaagctgcacagccccgaaaggagccctaagacctatagatttagtgagtccagtgaacgacttttcaacgggcaccacctccaggatatctctttttccacgcctaaaggggaggggcagaactctggtaatgtgcggagtcccgcttcacccaacgagtttgccttcggctcctatgtcccctctttcgccaaaacttcagaacgtagcaatcctttctcccagaagtctagctttctggacttccagagaaacagcatggagaagctgagcaaagatggagttgatctcataacccgcaaagagaagaaagcaaatctcatggagcagctattcggcgcaagcgggtcctccactatcagtagcaagagttctgaccccaattctgtggcaagtagtaaaggcgatatagaccccctgaactttctgccaggcaataagggatctcgagaccaggaacacgatgaggatgagggcttcttcctgtccgaaggtcggtccttcaacccaaaccgtcaccggctgaagcatgccgacgacaagcctgcagttaaagcagctgactcagtagaagacgagatagaagaagtggctctgcgttag

SEQ ID NO: 228179 - DNA, 2094 bp, Artificial Sequence
  Description of Artificial Sequence: Synthetic coding sequence
atgggcgaacgtgctggctctccaggcacagaccaggagagaaaggcgggaaaacaccactacagctacctttctgattttgaaacccctcaatcatccggcagatcctcactggtcagcagcagcccggcatccgtacggcgtaagaatccaaaaaggcagaccagtgacggacaggtgcaccaccaagcccctagaaaaccatcgccaaaggggctacctaatcgcaagggagtccgcgtcggctttcgatcacagtccttgaaccgtgaacccttgcgaaaggacactgacctcgtcacaaaacgaatcctcagtgctagactgctcaagatcaatgagctgcagaacgaggtgtccgaattgcaggtcaagctggcagaactcctcaaagagaacaagtctttgaaacggctgcagtacagacaggaaaaggcactgaacaagttcgaggacgccgaaaatgagatcagccaattgatctttcgccacaacaatgagattacagctctaaaggaacgacttcggaagagtcaggaaaaggagagagccactgagaaacgagtgaaagatacagagtccgaactgttccgaacaaagttcagccttcagaaactaaaggagatatcagaggccagacacttacctgagcgggacgacctcgctaagaagctggtctccgctgagctgaagcttgatgacaccgaaaggagaattaaagagctttccaagaatctggaattgtcgaccaactctttccagcggcaactgcttgccgagcggaaaagggcctacgaagcacacgatgaaaataaagtattgcagaaagaggttcagcgattataccacaagctgaaggagaaggagcgggaactggatataaagaacatatacagcaacagactgcctaagtcatcgccgaacaaggagaaggaattggctctcagaaagaatgcagcctgtcaatcagattttgcggatttatgtacaaaaggagtacagacaatggaggacttcaagccagaagaataccccctcaccccggaaaccattatgtgctacgagaataagtgggaggagccaggccacctgaccttagacctccaaagccaaaaacaagaccgccacggggaggccggtattttgaaccccatcatggagcgtgaggagaagtttgtgacagacgaggaattgcatgttgtgaaacaggaggtggagaagcttgaagacgaatgggagagggaggagctggataaaaaacagaaagagaaggcttccttgctggaaagggaggaaaagcctgaatgggagacagggaggtaccagctgggcatgtatccaatacagaacatggacaagctccaaggagaggaggaagaacgactcaagcgcgagatgctgcttgccaagctaaacgaaatcgacagagagttgcaagattccagaaatctcaagtaccccgtgttgcctcttcttcctgattttgagagtaagctgcactcacccgagcgctcccctaaaacataccgattctccgagtcctcagagagacttttcaatggtcaccatctgcaggatattagtttctccaccccaaagggtgagggtcagaactcaggcaatgtgcgatcaccagcgagcccgaatgaattcgccttcggttcctacgtcccgtcctttgccaaaacctctgagcgatccaatccctttagtcagaagagcagcttccttgattttcagaggaatagtatggagaagctgtccaaagacggggtagacttaataacccgaaaggaaaaaaaagctaacctcatggaacagctgttcggggctagtgggtcctccacaatcagttctaagtcctcggaccccaacagtgtagcttcttccaagggagacattgacccgctgaattttctacctggaaacaagggatccagagaccaggagcatgatgaagatgagggtttctttctgtccgaaggaaggtcctttaaccccaatagacaccgcctaaaacatgcagacgataagcccgcagtaaaagccgctgattcagtggaggacgagattgaggaggtggccttgcgatag

SEQ ID NO: 228180 - DNA, 693 bp, Artificial Sequence
  Description of Artificial Sequence: Synthetic coding sequence
atgaaaaaccctatgctcgaggtcgtctcgctgcttttggaaaagctacttctgatttctaactttacactgttcagcagtggtgccgcaggcgaggacaagggccgaaatagtttttacgaaacttcaagctttcacagaggcgatgttcttgaggtccctaggacccatctgactcactacggcatttatttaggagataatcgggtggctcacatgatgccggatattctcttagccttgactgatgacatgggaagaacgcagaaagtcgtgtctaataaacgcctgatcctcggagttattgtaaaagtggcctcaatccgcgttgataccgtcgaggatttcgcatacggggctaatatcctggtaaatcatctggacgaaagcttgcaaaagaaggctctgctgaatgaggaggtggcgaggcgcgctgagaagctgctgggttttactccatacagtctgctctggaataactgcgaacactttgtgacctactgtaggtatggcaccccaatctcaccccagagtgacaagttctgcgagaccgtcaaaattatcattcgcgatcaaaggagcgtcttagcatcagccgtcttagggttggcctctatcgtgtgcactggtctcgtgagctacacaactctgcctgccatatttataccattctttctgtggatggccggatag

SEQ ID NO: 228181 - DNA, 210 bp, Artificial Sequence
  Description of Artificial Sequence: Synthetic coding sequence
atgaaaaacccaatgctggaggttgtcagtctgctcttggagaagcttctgctgatttctaattttactctgttttcttctggcgcagccggtgaggataagggaagaaatagcttttacgagacttcctctttccatagaggggatgtgcttgaagtcccgcgtacgcatttgacccactatgggatttacctcggtgacaacagatag

SEQ ID NO: 228182 - DNA, 693 bp, Artificial Sequence
  Description of Artificial Sequence: Synthetic coding sequence
atgaagaaccccatgctcgaggtggtgagcctgctgctggagaagcttctactcattagtaatttcactctttttagctccggagccgcaggcgaagataagggccgtaattcgttctacgaaacatctagctttcacaggggggacgttctcgaagttccacggactcacctcacgcattacggtatttaccttggagacaaccgtgtcgcccacatgatgccagacattctactggcgctgactgacgacatggggaggacccagaaggttgtgtcgaacaaacgcctgatcttaggggtcatcgtgaaggttgcttccattagggtagacactgtggaggacttcgcctacggcgctaacatcttggtcaaccatctggacgaaagtctccagaagaaagcacttctgaatgaggaggtcgctagaagggccgaaaaacttttaggcttcacaccatacagcctcctatggaataactgtgagcattttgtaacatactgccgctacgggacccccatctctccacaaagcgacaaattctgtgagactgtcaaaatcatcattagggatcagcggagcgtgttggcgagcgccgttttgggtctggcttccatcgtgtgtactggactggtttcgtataccacattacctgccatttttatcccgttttttttgtggatggccggatag

SEQ ID NO: 228183 - DNA, 1110 bp, Artificial Sequence
  Description of Artificial Sequence: Synthetic coding sequence
atggtttgggcaccactcggacctccacggacagactgcttgaccctgctccatactccaagcaaggattcccccaaaatgagcttggaatggctcgtcgcttggtcctggtctctcgacggactccgcgactgcatcgctacagggatccagtcagtcagagactgcgataccacagcagttatcacagtcgcctgccttctggtcctctttgtgtggtattgttaccacgtgggcagggaacagccgagaccttacgtctctgtgaacagtctcatgcaggctgctgacgcaaacggcctacagaatggctacgtctactgtcagtcgcccgagtgcgtgcgatgtactcacaatgagggactgaaccaaaagttgtaccacaacttgcaagagtacgccaagaggtactcctggtccggcatgggcaggatccacaagggcattcgggaacaggggagatacctgaattctcgcccatccatccagaaacccgaggttttctttctgcctgacctgcctaccacaccatatttttcccgggacgcccagaaacacgatgtcgaggtactggagcgcaactttcagaccatcctgtgcgagttcgagaccctctacaaagcattctccaattgtagtctccctcaggggtggaaaatgaattctacaccctcgggcgagtggtttacattttatttagttaaccagggggtctgcgttccacggaactgtagaaaatgtccacgcacgtaccgactgcttggctcgctgcgcacttgtatcgggaataatgtgtttgggaatgcatgcatcagtgtccttagcccgggtacagtgatcacagagcattacggaccgacaaacatccggatccggtgtcacctggggctgaaaacaccaaacggctgcgaactagtagttggaggagaaccacaatgttgggccgaaggccgatgcctgttatttgacgattcgtttctgcacgccgcatttcacgagggctccgctgaggatgggcctcgggtggtgtttatggtggatctctggcaccccaacgtggctgctgcagaacgacaagctctcgattttatctttgcccctggtagatag

SEQ ID NO: 228184 - DNA, 984 bp, Artificial Sequence
  Description of Artificial Sequence: Synthetic coding sequence
atgtcacaaccctcggggggacgcgcacccggaacacgcatctattcctggagctgccctaccgttatgtcccccggagagaaactggaccccatcccagactcgtttattctgcagcccccagtgttccacccagttgtgccgtacgtgactacgatttttggcggactccacgcgggaaagatggttatgttacagggtgtagtgcccctggacgcgcatagattccaggtcgattttcaatgcggctgttcgctttgtcctcgccctgatattgcgttccactttaacccacgattccacaccacgaagcctcacgtgatctgcaacaccctgcatggaggcagatggcagagggaggcgagatggccacacctggcactgaggcgcggaagctcctttttaattctgtttctgtttggcaatgaggaagtcaaagtgagcgtgaatgggcagcacttcttacacttcagatacaggctccctctgagccacgtagacacattgggcattttcggagatatcctcgttgaggcagtgggattcctgaacataaacccctttgtggagggaagtagggaatacccagccggtcacgaggtgccctgttcccacgccttaccccaggggctgagtcccggacaggtgatcatcgttagagggttggtcctgcaggaacctaaacactttacagtatccctcagggatcaggctgcccacgccccagtgactctgcgagcctcgtttgcggaccgtacattggcctggataagcaggtggggacagaaaaagctgatttcagccccatttcttttctatccacagaggttctttgaggtgctgctgctgttccaagagggcggtctaaagttggctctgaatggccaggggctgggggctacgtccatgaaccaacaagccctggaacaactgagagagctgaggatcagtggcagcgtccagttatactgcgtgcactcatag

SEQ ID NO: 228185 - DNA, 1014 bp, Artificial Sequence
  Description of Artificial Sequence: Synthetic coding sequence
atgtcccagccttctggcggaagggctccaggtaccaggatctactcctggtcctgcccaaccgttatgtctccaggggagaagctggaccccatccccgactccttcattctgcagcctccagtgtttcatcctgttgtgccctacgtgacaacaattttcgggggattgcacgccggaaagatggtgatgttgcaaggtgtggtgcctctggatgctcacagtcgttttcaggtggacttccagtgcggctgttccttgtgtccaaggcccgatatcgctttccacttcaatcctcgcttccataccacaaagccccatgtgatctgtaataccctgcacggtgggcgatggcagcgcgaagctcggtggcctcatctggccctgagaaggggctcaagttttcttatcctgtttctgttcgggaacgaagaggtgaaggtaagtgtgaatgggcagcatttcctccactttaggtaccgcctcccactcagtcacgtcgacactctaggcatcttcggcgatatacttgtcgaagctgtgggcttcttaaacataaatcccttcgtggaaggcagcagagaatatcccgctggccacccctttcttctgatgtctccacgactagaggtgccctgttcccatgccctgcctcaggggctctcaccgggtcaagtaatcatcgtccgtgggttggttcttcaggagccgaagcactttaccgtttcattgcgagatcaggcggctcatgctcccgttacgctccgggcatcttttgctgatcgcacgctggcatggatctctcgttggggtcaaaagaagttaatctctgcacccttccttttttatcctcaaaggttcttcgaagtgttgcttctgtttcaggagggtggattgaaactggccctcaatggccaggggctcggggctacgagcatgaaccagcaggccctggagcagcttcgagaactgagaatctcgggaagtgttcagttgtattgcgtccactcctag

SEQ ID NO: 228186 - DNA, 1011 bp, Artificial Sequence
  Description of Artificial Sequence: Synthetic coding sequence
atgtctcagccttccgggggtcgcgcaccaggcactcggatttacagctggagctgtcccaccgttatgtctccaggcgagaagcttgaccccattcctgattcttttatcctgcaaccaccagtgtttcaccctgttgtcccttacgtgactacaatcttcggcggtctgcacgctggcaagatggtcatgctgcaaggcgtggttcctttggacgcacatagatttcaagtagactttcagtgcggatgcagtctgtgccctcggccagacattgccttccacttcaacccgcgattccataccacaaagccccacgttatctgcaacaccctccacgggggacgctggcagcgggaagcccgttggccacatctggcactgcgaaggggcagtagctttctgatactgttcttgtttggaaatgaggaggtaaaagtatcagtgaatggtcagcactttttgcatttccggtataggttacccctaagtcatgtggatacactgggaatcttcggggacattctggttgaggccgttgggtttctaaacatcaatcccttcgtcgagggatctcgagagtacccagcgggtcatccctttctgctcatgtccccccgtcttgaagttccctgctcacacgctctgcctcagggcttaagccccggacaggtgattatcgttagaggtctagttctgcaggaacctaaacacttcaccgtgtccttgcgcgaccaggcagcgcatgctcccgtcacacttcgagcttcattcgccgacagaaccctcgcgtggatttcccggtggggtcagaaaaagctgatctcagccccattcttattctacccacagagattctttgaggtgttgctactgttccaggaagggggacttaaactggcgctaaatggtcaaggcctcggcgcaacctcaatgaatcagcaggcccttgagcaactgcgtgagctgcggatctcaggctctgtccagttatattgcgttcatagttag

SEQ ID NO: 228187 - DNA, 828 bp, Artificial Sequence
  Description of Artificial Sequence: Synthetic coding sequence
atggtgatgctgcagggggttgttccactggacgctcaccgttttcaggttgattttcagtgcgggtgctctctgtgtcccagacccgatatagcatttcacttcaaccccagatttcacaccaccaaaccgcacgtgatctgcaacacattgcatggcggaaggtggcagcgagaggcacggtggccccacctggccctacggagggggagttcctttctgatcctctttttatttgggaatgaggaagtcaaagtgtcagtgaatggtcagcatttcctgcacttcaggtaccggctgccactctctcatgtagacacccttggaatcttcggggatatcctcgtcgaagcagttggcttcctaaatattaatccttttgtcgaagggtcacgggaatatcctgctggacatcctttcctgttaatgagtcccagacttgaagtgccttgcagccacgccctcccacaggggctgtcgccaggccaggtgatcattgtccgtgggctggtgctccaggagcctaagcactttaccgtgtcacttagagatcaagctgcccacgccccagtgaccctcagggccagtttcgccgaccggactctggcttggatctccagatgggggcagaaaaaactgatatcagcaccattcttattttacccacagagatttttcgaggttctgctcctgttccaggaggggggactaaagctggctttgaacgggcaggggctaggagccacgagtatgaaccagcaggccctggagcagcttagagaactgagaatcagcggttccgtgcagctgtactgcgtgcactcctag

SEQ ID NO: 228188 - DNA, 801 bp, Artificial Sequence
  Description of Artificial Sequence: Synthetic coding sequence
atggtgatgctgcagggagtggtgccccttgatgcacaccgatttcaggtcgattttcagtgcggctgtagcctctgtccaagaccggacatcgccttccacttcaatccacggtttcacacgactaagccccacgtcatctgcaacactttgcatggcggaagatggcaacgcgaggcaagatggccgcatctggcccttcgaagagggtcgtcctttctgattctgtttctttttgggaatgaggaggtaaaggtaagcgtgaacggccagcattttctgcattttagataccgtctcccactgagtcacgtggacacacttggtattttcggcgacatcctggtcgaggccgttggcttccttaacattaacccctttgtggaaggatctagggaatatccggctggtcatgaggtgccatgctctcatgcacttcctcaggggctgtctcccggacaggtgataattgttcggggattggtgctccaggagccgaaacatttcactgtaagtctgagggaccaggctgcccacgcacccgtaaccctccgagccagcttcgccgaccggactctcgcctggatctctagatggggccagaaaaaactgatttcggcccctttcctgttttatcctcagcgtttttttgaggtcttgcttttgttccaggaaggagggctgaagcttgccctgaacggtcagggcctaggggctacgtctatgaaccagcaggctctcgagcaactgcgcgagctgcgcatcagtggcagcgtgcaactttactgcgtacatagttag

SEQ ID NO: 228189 - DNA, 378 bp, Artificial Sequence
  Description of Artificial Sequence: Synthetic coding sequence
atggctgatgaagaacttgaggctttacgaagacagcggctggccgaactacaggccaagcacggagatcctggagatgcagcccaacaggaagctaagcatagggaggccgagatgagaaatagcatactcgcccaggtgctggatcagtcagccagggcacggttgtctaatttagccctcgtcaaacctgaaaaaaccaaagcggtggagaattacctgatacagatggcccgatacggacagctttccgagaaagtttccgagcaaggcttgatagaaatcttgaagaaggtcagccaacagactgagaagacgacaactgtgaagtttaatcgcagaaaggttatggacagcgacgaagacgacgactactag

SEQ ID NO: 228190 - DNA, 1530 bp, Artificial Sequence
  Description of Artificial Sequence: Synthetic coding sequence
atgggcgtccaagccggactgtttggtatgctggggttcctgggtgtcgccctaggaggctcacctgcccttaggtggtaccgaacaagttgccacttaacaaaggcagtgcccggtaatcccctgggatacctctcatttcttgcaaaggacgcccaaggactggctctgatccatgctcgatgggatgcccacagaagactccagagctgttcttgggaggatgaacccgagctgaccgcggcatacggggcattatgcgcccatgaaacggcctggggatcattcatccataccccgggtccggagctgcaacgggctctggccacactgcagtcccaatgggaagcctgcagggctctcgaagaaagtccagccggagctcgcaagaaacgagctgccggacagagtggcgttcccggtgggggtcatcaacgtgagaagaggggctggaccatgcctgggaccctatggtgtggtgtaggagattctgcaggcaactccagcgagctgggagtgtttcagggtcccgacctttgttgcagagagcatgatagatgtccgcaaaacatatctcccttacaatataactacggtatacggaactatcggtttcacactatcagccactgcgactgcgacacaagatttcagcagtgccttcagaatcaacacgatagtatctccgatatcgttggagtggctttcttcaatgtgttggagattccttgctttgtgttggaggagcaagaagcgtgcgtggcttggtactggtgggggggatgccggatgtatgggaccgtccccctggccaggctgcagcccaggacgttttataatgctagttggtcgtctcgagctacaagtccgacgccaagctcccggagcccagcgccaccaaagcctcggcagaagcaacacttacggaaaggacctccacaccagaaagggagcaagcggcctagcaaggccaacacaactgctctgcaagaccccatggtcagccccaggcttgatgtcgccccaacaggattgcagggccctcaaggagggctcaagccccaaggggctaggtgggtgtgccgatccttcaggcgtcacctggatcagtgcgagcatcagattggtccaagggagattgagttccagctattaaactctgcgcaagagcctctctttcactgtaactgtacccgcaggctagcaaggttcctgagactgcacagcccccctgaggttacaaacatgctgtgggagttacttggcacaacctgtttcaagctagccccaccacttgattgcgttgagggtaaaaactgcagtcgagatccacgagccattagagtaagcgctagacacctgagaagactgcagcagcggaggcaccagctgcaggataaaggaaccgatgagaggcaaccttggccctccgagcctctcaggggaccaatgtcgttctataatcagtgcttgcaactgacccaggctgctcgaaggccggataggcagcagaaatcctggtcccagtag

SEQ ID NO: 228191 - DNA, 93 bp, Artificial Sequence
  Description of Artificial Sequence: Synthetic coding sequence
atgaccggggagctggaggtgaagaatatggacatgaaacctggcagcacattgaaaatcaccggcagtatagcggatggcaccgacggctag

SEQ ID NO: 228192 - DNA, 1758 bp, Artificial Sequence
  Description of Artificial Sequence: Synthetic coding sequence
atgaccccaccgcgtctgttctgggtgtggctcctggtcgcagggactcagggcgtgaacgatggcgacatgcggctcgccgacggaggagcaactaaccaggggagagtcgaaatcttttacaggggtcagtggggtactgtgtgtgacaatttgtgggatctgacagatgcctcagtcgtctgccgcgcacttggttttgagaatgccacccaagcactgggcagggccgcattcgggcagggctcaggcccaatcatgctggatgaagtgcagtgtaccgggaccgaggcatccttggctgactgcaagtcacttggctggctcaagagtaattgtagacacgagagggatgccggagtcgtgtgtactaatgaaactaggtccacgcataccctggatctgagccgcgaattatctgaagccctgggacagattttcgacagccaaagaggatgcgacttgtccatcagcgttaatgttcagggtgaagatgcgcttgggttctgcggacacaccgtgatattaacggccaatctagaggcccaagctctatggaaggagcctggctccaatgtgacaatgagtgttgacgccgagtgcgtgcctatggttcgggatctattgagatatttttactcacgccgaattgatattacgttgagttcagttaagtgttttcacaaacttgcctcggcttacggcgctaggcagttgcagggttattgtgcaagtttgtttgccattctgctgccacaggatcccagctttcaaatgcctctggacctatacgcctacgcagtagcaacaggagacgccttgctggagaaactctgtctgcaattcttagcctggaactttgaggctctgacacaagcagaggcatggccctctgtgccgacagacctgttgcaactgctgctgccacggagcgacctggctgtgccaagcgagcttgccctgctcaaggccgtggacacatggagctggggagaacgagcaagccacgaggaagtcgagggcctggtcgaaaaaatccgatttcccatgatgctgccagaggagctgtttgaactccagtttaacttgtccctctattggtcccatgaagcattgtttcagaagaaaactctgcaggctctagagtttcacactgttccctttcaactgttagctaggtacaagggtctgaaccttactgaagacacatataagcctaggatctacacaagccctacttggtcggcattcgtcacagatagttcctggagcgcacgtaaaagccagctggtgtaccagtcacgcagagggcctctggtgaagtattcctccgactacttccaagctccctcggattaccgctactacccgtatcaatcttttcagaccccacaacacccgtcatttctatttcaggacaagagagtgtcctggagcctggtctatctacccactatacagtcttgttggaactatgggttcagctgttcctcggatgagcttccagttctggggctgacaaagtctggtggctcagaccgcacaattgcatacgaaaacaaagccttgatgctgtgcgaaggtctcttcgtcgctgacgtcacagacttcgaggggtggaaggcagcaataccaagcgctcttgataccaactctagcaagagtacatcctcatttccatgtccagccggtcattttaatggttttaggacagtgatccgccctttttatctcaccaattcctcaggagtggactag

SEQ ID NO: 228193 - DNA, 1722 bp, Artificial Sequence
  Description of Artificial Sequence: Synthetic coding sequence
atgactccaccacgcctattctgggtatggcttctggttgctgggacccagggggttaatgatggggacatgcgactagccgatgggggtgctaccaaccaagggagagtagaaattttttatagggggcagtggggcaccgtatgtgacaatctttgggatctgacagacgcttccgtggtctgccgagctctcgggtttgaaaacgccacacaggccctggggagggcggcattcggacagggtagtggccctattatgctcgctgattgcaaatcgttaggttggctcaagagtaactgtcggcacgaacgtgatgctggggtggtctgcactaatgagaccagaagcacccacactctcgatctctctcgagagctcagcgaggctctcggccagatcttcgattctcaacggggttgtgacctgtccatcagtgtcaacgtccagggtgaagatgcccttggattctgcggacatacagtgatattgactgctaaccttgaagcccaggccctgtggaaagaacccggatccaacgtgacaatgagcgtggacgcagaatgcgtgccaatggtgcgtgacttgcttaggtatttctactccaggcgaattgacatcactttaagctcagtaaaatgtttccataaactcgcaagtgcatacggcgcaaggcagctgcaaggttactgcgcttccctgttcgcaatccttctcccccaggatccgtcatttcaaatgccactggacctgtacgcctacgctgtggcaactggcgatgccctgctggagaagttgtgtttgcaattcctagcgtggaactttgaggctctcacccaagcagaggcatggccaagcgtccctactgatctgctgcaactgctgctgcccagatcggatcttgcagtcccatcggaactggcattactcaaggccgttgatacctggtcatggggcgaaagggcctcccatgaggaagtggaaggacttgtcgagaagattagatttcctatgatgctgccagaggagttattcgagctccagttcaacttgtcattgtactggtcgcacgaggctctgttccaaaaaaagacactgcaagcattagagttccacacagtaccatttcagctgctcgcacgatataaaggcctgaaccttacagaagacacctacaaaccgaggatttacacaagccctacttggtccgcctttgtcaccgattcctcttggtcggcgagaaagagccagttggtgtaccagagcaggcgaggtccactcgtgaagtattctagcgattatttccaggctccgagcgattatcgttactatccataccagtccttccaaacaccgcagcatccctcatttctgttccaggataagagggtgagctggagcctcgtttacttaccaactattcagtcctgttggaactacggattctcctgctcaagcgatgagcttccggtactgggcttaacaaaaagcggcggatcagacagaactatcgcatacgaaaacaaggcgctgatgctctgtgagggtctgttcgtggcagacgtaacagatttcgagggttggaaagccgcaatcccatcagcgttagatactaactccagcaagtccacttcatcattcccttgccccgctggacacttcaatggctttcggactgtgatcagacccttttacctgactaactcaagcggggttgattag

SEQ ID NO: 228194 - DNA, 411 bp, Artificial Sequence
  Description of Artificial Sequence: Synthetic coding sequence
atgtcaaatgtcccacataagagtagtttaccagagggcattcgccctggtactgtgctcaggattaggggccttgtccctcctaacgcatcacggtttcatgtgaaccttctgtgcggtgaggagcaaggttcagacgctgcactgcacttcaatccacgcctcgatacgtccgaggtggtgtttaatagtaaggagcagggaagttggggcagagaagagcgcggaccaggagtgccctttcagagggggcaaccattcgaggtgctgattattgcaagcgatgatggcttcaaagcagtcgtcggcgatgcacagtatcatcacttccgtcacaggctgcctctggctcgtgtgaggttagtggaggtcggcggagatgtgcagctggactcagtccggattttctag

SEQ ID NO: 228195 - DNA, 954 bp, Artificial Sequence
  Description of Artificial Sequence: Synthetic coding sequence
atgatgctttccctaaataatttgcagaacataatttataacccggtcatcccgtttgtcgggaccatccccgatcagctggatccaggaactttaatagtcatccgtggtcacgtcccaagtgacgcagatcgcttccaggtcgacttacagaatggcagttctatgaagcctagggcggatgtggcttttcattttaatcctcgcttcaaacgggcaggctgtatcgtttgcaacacacttatcaatgagaagtggggaagggaggagatcacctatgatacccccttcaagagggaaaagtctttcgaaatcgtgatcatggtactgaaagacaaatttcaggtcgccgttaacggcaaacacactcttctctatggccacaggataggacctgagaaaattgatactctaggtatatacggtaaagttaacattcactccatcgggttttccttctccagcgacctgcaatctacccaagcttcatcccttgagctgaccgaaatcagccgggagaacgtgcccaagtctggtacaccccagctgcgactcccctttgctgcgagattgaacactcctatgggtcctggaaggactgtggttgtcaaaggagaggtcaatgcaaatgctaaatctttcaacgtggacctcctggcaggcaagagtaaggacatcgcgctgcatctaaatccacgtcttaacattaaggcctttgtgagaaatagtttcctgcaggagtcttggggcgaagaggaacggaatataacttcatttccattcagtcctggaatgtattttgaaatgatcatctattgcgatgtcagagagttcaaggttgccgtgaacggggtccactcactggaatataagcatcggtttaaagagctgagctccatcgacactctggagatcaacggcgacatccaccttctagaggtgaggtcgtggtag

SEQ ID NO: 228196 - DNA, 1080 bp, Artificial Sequence
  Description of Artificial Sequence: Synthetic coding sequence
atgatgctgtctctgaacaatttgcagaacatcatctacaaccccgttattccgtttgtaggcacaatcccagaccaactcgaccctggtacgctgatagtgattagagggcacgtgccttccgatgcagaccgcttccaggtggatttgcagaatggctccagcatgaaaccaagggccgatgttgctttccatttcaaccccaggttcaaacgagctgggtgcatcgtgtgtaacactctcattaatgagaaatgggggagagaggagatcacatatgacactcccttcaagcgcgagaagagcttcgagatcgtgattatggtactgaaagacaaatttcaggtagcggtgaatggcaaacacactctgctttacggacaccgtattggcccagagaaaatcgatacccttggaatttatggcaaggtgaatatacactccatcgggttttccttctcttctgatctgcagagtacacaggctagttccctcgaactgaccgaaatctcacgcgagaatgtgccaaaatctggaacacctcagctgccttcaaacagaggcggtgatatatcaaagatagcacctcgcacagtgtacactaaatctaaggacagtaccgtaaatcataccttaacctgtactaagatcccccctatgaattatgtgagtaaacgcctgccctttgccgcacggctgaacaccccaatggggcctggcaggaccgtagtcgtaaaaggtgaggtgaatgcgaatgcaaaatcattcaacgtggacctgctagccggtaagagcaaggacatcgccttgcacctgaaccctcgcctgaatatcaaggccttcgtgcgcaactcctttctacaggagagctggggcgaggaagaaaggaatattaccagttttccgttctctccaggcatgtactttgagatgatcatttattgcgacgtgagggagttcaaagtagcagttaatggcgtgcacagtttggaatataaacatagattcaaagaactgagtagtattgacacattagagatcaatggggacatacacctgctagaagtgaggtcttggtag

SEQ ID NO: 228197 - DNA, 1077 bp, Artificial Sequence
  Description of Artificial Sequence: Synthetic coding sequence
atgatgcttagtctgaacaatcttcaaaacataatctacaatcctgtgattcccttcgtgggcaccattcctgaccagctcgacccgggaacccttattgtgataagaggccatgtgcccagcgacgccgaccgatttcaagtcgatctgcagaatggaagctcgatgaagccaagagcggacgtcgcctttcacttcaatcctagatttaagcgagcaggctgtattgtgtgcaataccctgatcaacgaaaaatggggtagagaggaaattacatatgacactcccttcaaacgagagaaatccttcgagatcgttatcatggtactgaaagacaaatttcaagtggcagtcaacggcaaacatacactgctctacggtcaccggatcggacccgagaagattgataccctggggatctatgggaaggtgaatatacactctatcggattttctttcagttccgatctccaatccacccaggcttcttcactggaattaaccgagatatctcgggagaacgtcccaaagagcggaactccccagctgcgtctctctctgccttcatgggacctacagggccatggttctgagacattcaggtctgtactttggaccagagtctttgagatcgctttttgcagaccactgggtacagtggccagcttccagcgccttcccttcgctgctcgactgaatacccctatgggtccgggtcgtactgtggtggtgaagggcgaggtcaacgctaacgccaagtcctttaacgtggacctgctcgcgggaaagtcgaaagatatcgcactccatttgaaccctcgattgaatataaaagcctttgtccggaactctttcctccaagagtcctggggtgaagaggagaggaacatcacctccttccctttctctccaggaatgtatttcgagatgattatctattgcgatgtgcgagagttcaaggtggccgtgaatggggtccattctcttgaatataaacataggttcaaggaactgtcttctatcgacacactggaaattaatggggacatccatctgctggaagttcggagttggtag

SEQ ID NO: 228198 - DNA, 954 bp, Artificial Sequence
  Description of Artificial Sequence: Synthetic coding sequence
atgatgttgagtttgaataacctgcagaatattatttataatcccgtcatcccctttgtgggaaccattcctgatcaattggatccagggactctgatcgtgattaggggccatgttccgtccgatgctgaccgctttcaggtcgacctccaaaacggcagttccatgaaacccagggcagacgtcgcatttcactttaaccctaggttcaaacgcgctggctgtatcgtgtgcaataccctcatcaatgagaagtgggggagagaggaaattacttacgatacaccttttaaacgagagaagagttttgagattgtgataatggtgctgaaagacaaattccaggtggccgtgaacggcaaacacaccctgctttatggccaccggattggacctgaaaaaatagatacgctaggaatctacggcaaagttaacatccatagcatcggattcagcttcagctccgatttacagtctactcaggcatcttcattagagctgaccgaaatctcccgcgagaacgtgccaaagagtggaacaccccagctgaggctgccttttgcagcacggctcaatacccctatgggacctggtagaacggtggtggttaaaggtgaggttaatgctaatgcgaaatcctttaatgtggacttgctggcaggaaagtctaaagacattgccttgcatttgaaccccagactgaacatcaaggcgttcgtccggaacagttttctgcaggaaagctggggtgaggaagagcggaatatcactagctttccgttctccccaggaatgtatttcgagatgattatatattgcgatgtgagggagtttaaggtggccgtcaacggggtgcatagcttagaatataaacatcgatttaaggaactctcgtctattgacacactagaaattaacggagatatacatttactagaagttcgcagttggtag

SEQ ID NO: 228199 - DNA, 627 bp, Artificial Sequence
  Description of Artificial Sequence: Synthetic coding sequence
atgatgctatccctgaacaatctacagaacattatctataaccccgtgatcccttttgtcggtacgatcccagaccagctggaccctggaactctgattgtgatacgcggacacgtgccatcagacgccgatagatttcaggtcgacctgcagaacgggagttcgatgaagccacgggcagacgtggcttttcatttcaacccacgctttaagcgggctggatgtatcgtgtgtaacactctaatcaacgagaagtggggcagggaggaaatcacctatgataccccgttcaaacgtgagaaatcgtttgaaattgtcatcatggttttgaaggataagttccaggtagctgttaacggcaagcacacattattgtacggacacagaattggtcccgagaagatcgacactctgggtatctacggcaaggtgaatattcattctatcggattcagcttttccagcgatctgcagtctacacaagcaagtagtctcgagctgaccgaaatcagtcgggaaaatgtacccaagtctggcacccctcaactccctagtaacagagggggagacatctcaaagatcgccccacgcacggtttatactaaatccaaagatagcaccgtgtag

SEQ ID NO: 228200 - DNA, 903 bp, Artificial Sequence
  Description of Artificial Sequence: Synthetic coding sequence
atgatgctgagcctgaataacctgcagaacatcatctataaccctgtgataccctttgtcggaaccattcccgatcagttggacccaggtactttaatcgtcattcgaggacacgttccatccgatgccgaccgcttccaggtggacttgcaaaatggtagctcgatgaagccaagggctgacgtggcatttcattttaatccaaggttcaagagagcaggctgcatcgtttgtaacacactgatcaatgaaaagtgggggagggaggagatcacctatgatacaccattcaagagagagaaaagtttcgaaatagtgatcatggtcctgaaggacaaattccaggtgccaaagtctgggacaccccagctgccctccaataggggcggtgatattagcaaaattgccccacggaccgtttataccaagagcaaggactctactgtgaaccacacattgacctgtactaagattcctcctatgaactacgtcagcaaacggctgccttttgcagcacggctgaacacccccatgggacccggtcgaacagtggttgtgaagggtgaagtgaacgcaaatgccaagtctttcaacgtcgacttattggccggaaagtccaaggatatagccctccacctgaaccccaggcttaatatcaaagcgttcgtgcgcaattcttttctccaggagagctggggcgaggaagagcgaaacataacaagcttcccattcagccctggtatgtactttgagatgattatttactgtgacgtgagggagttcaaggtggctgttaatggagtccattcgctcgagtacaagcacagatttaaggagctgtcatccatcgataccctggaaataaacggtgacattcatctgcttgaggtccggagttggtag

SEQ ID NO: 228201 - DNA, 1080 bp, Artificial Sequence
  Description of Artificial Sequence: Synthetic coding sequence
atgatgcttagcttgaataaccttcagaatatcatatacaaccctgtgattccctttgtgggcactattcctgatcaacttgatcccggaactttaatcgtgatcaggggacacgtgcccagcgacgctgacagattccaagtggacctccaaaatggaagctccatgaaaccaagggcagacgtggcttttcacttcaaccctcgctttaagagggctggttgtattgtatgcaacactttgattaacgaaaagtggggacgggaagagataacatatgacacgccttttaagcgggagaaatcattcgagatcgtgatcatggtgctgaaggacaagtttcaggtggcagtcaacggcaagcatacattgctgtatggccacaggatcggcccagagaagatcgacacactcggcatctatgggaaggtcaacattcatagcatcggcttttctttcagttccgacttgcaaagtacccaggcatcctcccttgagctcaccgagatctctagagagaatgtcccaaaatctgggacaccacaactgcccagcaaccgcggtggagacatctcaaaaatcgccccacggacggtgtacaccaaatctaaagactctactgtcaaccacacgttaacatgtacaaagattccccctatgaactatgtctccaaaaggttgcccttcgccgctaggttgaacactcctatgggacctggacggaccgtggttgtcaaaggcgaggtgaacgccaacgccaagtcctttaatgttgatctcctggccggaaaaagcaaagacattgcactgcacctgaatcctcggcttaacattaaagctttcgttaggaactcattcctgcaagagtcttggggtgaggaggagagaaacatcacttcctttccattttccccaggcatgtacttcgaaatgatcatatactgcgatgtgagggaatttaaggtggctgtcaacggtgttcacagcctggaatacaaacacagattcaaggagctttcaagcatcgatactctcgaaatcaacggtgacattcatctactagaggtacgttcttggtag

SEQ ID NO: 228202 - DNA, 507 bp, Artificial Sequence
  Description of Artificial Sequence: Synthetic coding sequence
atgatgctcagccttaataatctgcaaaatatcatatataacccagtaatcccttttgttggaaccatcccagatcagttggatcccggaaccttaatcgttatcagggggcacgtccccagcgatgcagatagatttcaggtggacctccagaacggttcatcgatgaagcccagagctgacgtcgcctttcattttaatcccaggtttaagcgtgccggatgcatcgtttgcaacacactgattaacgagaagtggggtcgggaagagatcacttacgacaccccattcaagagagaaaagagttttgagatcgtcatcatggtactgaaggacaaatttcaggtcgcagtgaacgggaagcatacgctcctttacggacacagaatcggcccagagaagatcgatacccttggtatttacggtaaagtgaatatacatagtatcggattctcgttctcctcagaccttcagtcaacacaggcatcttcacttgagctgacctag

SEQ ID NO: 228203 - DNA, 321 bp, Artificial Sequence
  Description of Artificial Sequence: Synthetic coding sequence
atgatgcttagtctcaataatctgcagaatattatctacaaccctgttatcccattcgtaggtaccattccagaccaactggatcccggaacgttaattgtgattcggggacatgttccctctgatgccgaccgattccaagtggaccttcagaacggatcctccatgaagcccagagctgatgttgcctttcactttaacccccgtttcaagagggccggatgcatcgtgtgtaacaccctgattaatgagaagtggggtcgtgaggagatcacctatgacacaccctttaaaagggaaaagtcgttcgagatcgtctag

SEQ ID NO: 228204 - DNA, 1080 bp, Artificial Sequence
  Description of Artificial Sequence: Synthetic coding sequence
atgatgctatcactcaataatctgcaaaatataatctacaacccagtcatcccatttgtgggtactattcccgatcagctcgaccccggaaccctcatcgtcatccgagggcacgtgccaagtgacgcagatcgctttcaggtggacctgcagaatggctcctctatgaagccaagggctgatgtggctttccacttcaatccgagatttaagagggctggatgtatcgtgtgcaacacattaatcaacgaaaaatggggcagagaagagattacatacgatacccctttcaagcgtgagaagagttttgagatcgtgatcatggttttgaaagacaagttccaggttgccgtgaacggcaaacataccctgttgtatggtcacagaatcggccctgaaaaaattgataccctcggcatctacggaaaagtgaatattcatagtatagggttttccttctcatctgacctgcagagcactcaagcctctagcctagagcttaccgaaatttcccgggaaaacgtccccaagagcggtacaccacagctgccctctaatcgcggaggagacatatctaagatcgccccacgtaccgtttacacgaagagcaaggacagtactgtgaatcacacattgacatgtaccaaaattcctccgatgaactacgtctccaagcgactcccgttcgcagctagactcaacacccccatgggaccagggaggaccgtggtggtcaagggggaagtgaacgcaaacgccaagtctttcaacgtggacttgctcgcaggcaagtccaaagatatagctttacacttgaacccaaggctcaatattaaggctttcgtccgaaatagttttctgcaagaatcctggggggaagaagaacggaatatcacatcgttcccattctcgcccggaatgtacttcgagatgatcatctattgcgatgtccgggaattcaaggtcgccgttaacggtgttcacagcctggagtacaaacacaggttcaaggaactaagtagcatcgatacacttgaaatcaacggagacatccacctcctggaggttcgcagttggtag

SEQ ID NO: 228205 - DNA, 954 bp, Artificial Sequence
  Description of Artificial Sequence: Synthetic coding sequence
atgatgctgagtctgaataacctgcagaacattatatataatccggtgatccccttcgtcgggaccattcccgaccagctagatccgggtaccttgatagttatcaggggacacgtgccgagcgacgctgatcgattccaggtcgatctacagaacggctcctctatgaaaccaagagctgatgtggccttccacttcaaccccagattcaagagggccggttgtattgtttgcaacacccttatcaatgaaaaatggggtagagaggagatcacttacgacaccccattcaaaagagagaagtcttttgagatcgtgattatggtgttgaaggataagtttcaggtggccgtaaacggcaagcacaccctgctctacgggcaccgcattggtccagaaaaaattgacactcttggcatctacggcaaagtgaacatccatagtatcggtttttcattctcatccgacttacaatcgacccaagcgagcagtttggaactgaccgaaatctcccgggaaaatgtccctaaaagcgggaccccgcagctgcggctccccttcgccgcacggcttaatactccgatgggccctggtcgaacagtagtggttaagggggaggtcaacgcaaacgcaaagagcttcaatgtggatttgctcgccggtaaatccaaggatatcgccttacacctcaatcctcggctgaatatcaaagcttttgtccgaaatagcttcttgcaggaatcttggggggaggaagagcgaaatatcacatcatttccattttccccaggcatgtatttcgaaatgatcatttattgtgatgtccgggagttcaaggtagctgtaaacggagtgcattcgttagaatacaagcatcgctttaaggagctgtcttccatagacaccctggaaatcaacggagatatccatctcctggaggttcgtagctggtag

SEQ ID NO: 228206 - DNA, 1080 bp, Artificial Sequence
  Description of Artificial Sequence: Synthetic coding sequence
atgatgctctcactgaataacttacagaacataatctacaatcccgtcattccctttgtgggaactatcccagatcagctagaccccggtactctgatagtcatcagaggtcacgttccttctgacgccgatcggttccaggtggacctacagaatggatcgtctatgaagcccagggcagatgtggccttccacttcaacccacggttcaagcgcgcaggatgtatcgtttgcaacaccctaatcaatgaaaagtggggaagggaggaaatcacatatgatacacccttcaaaagggagaagagctttgaaattgtaataatggtactgaaagacaaattccaggttgcggttaacggaaagcatacgctgctttatggccacagaattgggccagagaagattgacacgctagggatttacggcaaggtgaacatccacagtatagggttctctttcagctcagatttacagtctacccaggccagttctctcgagctgaccgagatctctcgggagaacgtaccgaaatccgggactccccagttacccagcaaccgcggaggagatatctctaaaatcgcacccagaactgtgtataccaagtccaaggactctactgtgaatcataccctgacgtgtacaaaaattccccctatgaattacgtcagtaaacggctcccctttgctgcaaggttgaatacaccgatgggccctggacgtacggtggtcgtgaaaggcgaggtgaacgccaatgcaaagagctttaatgtggatctgttagcgggaaaatcaaaggatatagcattacatctgaatcccaggcttaacattaaggcctttgtgagaaatagctttctccaggaatcatggggagaggaagagagaaacattacttcgtttcctttctctcctggaatgtatttcgaaatgattatttactgtgatgttcgagaattcaaggttgccgtgaacggagtacactcacttgagtataagcataggtttaaggagttaagctcaatcgataccctggagatcaatggcgatattcacctgctggaagtccgcagttggtag

SEQ ID NO: 228207 - DNA, 132 bp, Artificial Sequence
  Description of Artificial Sequence: Synthetic coding sequence
atgatgctcagtcttaacaacctccagaatatcatctataaccccgtcatccccttcgtgggaacaatcccggaccagctggatcctgggacgctgatcgtaatcagagggcacgtaccatccgatgcatag

SEQ ID NO: 228208 - DNA, 972 bp, Artificial Sequence
  Description of Artificial Sequence: Synthetic coding sequence
atggctttctcaggctctcaggccccttatctctcccctgctgtgccattttcagggactatacagggcggactccaagatggactacagatcacagttaatgggacagttctctcgagtagcgggacccgctttgcagtgaacttccagacaggattcagcggtaacgacattgccttccactttaaccctaggtttgaagacggcggatatgtggtttgcaacactcgacagaacggtagctggggccctgaggagcggaaaacacatatgccctttcagaagggcatgccttttgacttgtgcttcctggtgcaatcatctgatttcaaagtgatggtgaacggaattctgtttgtgcaatacttccatcgggtgccttttcaccgggtggatacaatctccgttaatggcagtgtccagctgagctatatctcattccagccaccaggggtttggcccgctaatcctgcaccaattacacaaacagtgatccatactgtgcaatccgcccctggccagatgttctctacgcctgccattcctcccatgatgtatccgcaccctgcgtacccaatgccattcataactaccatcctcggtggtttgtatccaagcaagtccatacttctttcaggtaccgtactgcccagcgcgcagcgttttcacataaacctctgctctggcaaccacatcgcatttcatctgaatcctcgatttgatgaaaacgcagtcgttagaaatacgcagatcgataacagttggggttctgaggagcggagtctgccacgcaagatgcccttcgtccgcggacagagcttttccgtctggatactctgcgaggcccactgtctgaaggttgctgtggacgggcagcacctgtttgagtattatcatcggttgcggaacctgccaaccataaaccgcctggaggtgggcggtgacatccaactcacacacgtgcagacctag

SEQ ID NO: 228209 - DNA, 936 bp, Artificial Sequence
  Description of Artificial Sequence: Synthetic coding sequence
atggcgttctccggttcccaggccccatacctctccccagcagtgcccttctcaggaaccattcagggcggtctccaagacgggttacagatcaccgtcaatgggacagtactctcctcaagcggaactaggttcgccgtgaacttccagaccggtttctccggaaacgatattgcctttcactttaaccctagattcgaggatggcggttacgtcgtctgcaacactcgtcagaacggcagctggggacctgaggaacgcaaaacccacatgccttttcaaaaaggaatgcctttcgatctgtgttttctggtgcaatcttctgacttcaaagtcatggtgaatgggatcctgtttgtgcaatactttcaccgagtgccttttcaccgcgtcgacactatttccgttaatggatctgtacagctttcttacatctcctttcagacacagactgtaatacacacagtgcagtccgcccctggacagatgttctctacccccgctatcccacctatgatgtacccccaccctgcttaccccatgcccttcatcaccacaatcctcggagggctgtacccttctaaaagcattctgctatcaggcaccgttctgccgtccgcccaacggtttcacattaacctgtgcagtggcaaccacatcgcatttcaccttaatccacgctttgatgagaatgcggtcgtcaggaatacgcaaattgacaatagttggggcagcgaggaacgatcactgcccaggaagatgccgtttgttcgcggacaatccttcagcgtgtggatcctgtgcgaggcccattgtcttaaggttgcagtcgacgggcaacacttgttcgaatactaccaccgcctcaggaatctgcctacgattaataggctggaggtgggtggcgacatccagctgacccatgtgcaaacctag

SEQ ID NO: 228210 - DNA, 741 bp, Artificial Sequence
  Description of Artificial Sequence: Synthetic coding sequence
atggcctttagtggatctcaggcgccatacctgtcccccgcagtccccttcagcggaaccattcagggcggtctacaggacggccttcagatcacagtgaatggcacagtcctctcctcttccggcacgcggttcgcagtaaattttcagactggattcagcggcaacgatatcgcctttcacttcaaccccagattcgaggatgggggatacgtggtgtgtaacacaagacagaatggaagctggggtcccgaggagcgaaagacgcatatgcccttccagaaggggatgcccttcgatctctgctttttggtacagagctcagacttcaaggtcatggttaacgggatcctgttcgtgcaatacttccacagagtgcctttccatagagtggatacaatttcggttaacggatctgtgcaactctcctacatttccttccagcctcccggtgtctggcctgcaaatcccgctccaatcacgcagactgtaatacataccgtgcaatctgctcctgggcaaatgtttagcacccctgctatcccgccaatgatgtaccctcaccccgcttacccaatgccattcattaccaccatcctggggggtctttacccatcaaagagcattctgctcagtgggaccgtgctcccatcagcccaacggtgtgggagctgcgtaaaactgaccgctagcagatggccatggatggtttcaacatgcctgaatacgacaatagcctag

SEQ ID NO: 228211 - DNA, 1068 bp, Artificial Sequence
  Description of Artificial Sequence: Synthetic coding sequence
atggccttctctggatcacaggctccgtatcttagtccagccgttccttttagcgggaccatccagggcggtctacaggacggattacagataaccgtcaacggcacagtgctcagtagcagtggaactcgcttcgccgtgaactttcagactggattttccgggaatgatattgctttccattttaatcctcgctttgaagatgggggatacgttgtgtgcaacacaaggcagaatgggtcctggggacctgaagaacgtaagacacatatgcctttccaaaagggcatgccattcgatctctgttttttggtacagtcctccgactttaaggtgatggtcaacgggatccttttcgttcaatatttccaccgtgtcccctttcaccgggtggacacaatcagcgtgaatggaagcgtacaattgtcatacatctccttccaaaacccgaggaccgttcctgtgcaacctgccttctctactgtgcccttttctcagcccgtctgtttcccccctaggccaagagggcgacgtcagaagccccctggggtgtggccagccaatcctgcacccattacccagactgtcattcacacagtgcagagcgccccaggtcagatgttctccacccccgctatcccacctatgatgtacccccatccggcatacccgatgccctttattaccactattctggggggactttatcctagtaagtcaattctactgtctggcaccgtcttgccttccgcgcagcgatttcacatcaatttgtgtagtggtaaccacattgcatttcacctcaacccacgctttgatgaaaacgctgtggtgagaaacacccagatcgacaactcttgggggagtgaagagcgttcactaccaaggaaaatgccattcgtgcgcggtcagtccttctcggtatggatcttgtgtgaggcacactgcctaaaagtagctgtggatggacaacatctatttgaatactaccaccgcctccgaaacctgcccacaataaacaggctggaagtcgggggagacattcagcttacccacgtccagacttag

SEQ ID NO: 228212 - DNA, 666 bp, Artificial Sequence
  Description of Artificial Sequence: Synthetic coding sequence
atgggcccattctccgctcctgttgagcccgatggaggatatgtcgtttgcaacactaggcagaacggctcgtggggacctgaggagcgcaagacacacatgccgttccagaaaggtatgcccttcgatctttgtttccttgtgcagtccagtgatttcaaggtaatggtgaacggaatcttattcgtgcagtatttccatcgcgtgccatttcatcgggttgataccatctcagtgaacggctcagtacaattatcctacattagctttcagaaccccaggactgtgccagtccagcccgcattttcaacagttcctttttcacagccagtgtgcttcccgccaagacctaggggccgtcgccagaagcctcctggcgtctggcctgcaaatcccgctcctataactcagaccgttatccacacagtgcagtccgccccaggccagatgttctctacccctgctattccccctatgatgtacccccatcctgcttatcccatgccttttatcactacaatcttggggggactttaccccagcaagagtatattgttgagcggcacagtgctcccttctgcccaacgatgtggctcatgcgtcaaattaaccgcctctcgctggccctggatggtgagtacttgtctgaacaccaccatcgcatag

SEQ ID NO: 228213 - DNA, 360 bp, Artificial Sequence
  Description of Artificial Sequence: Synthetic coding sequence
atggccttttccggtagtcaggctccatacctctctcctgcagtcccattttcagggacgatacaaggcggactacaggacggactccagatcacagtaaacggaaccgtgttgtcatcgtctggtacgcgcttcgccgtcaattttcagacaggcttttcgggcaacgatatcgcttttcattttaatcctcggtttgaagatggtggatacgtcgtatgtaacacccgccagaatggctcttggggcccagaagaacgcaaaactcatatgccgttccagaagggcatgcctttcgacctgtgttttctcgtacaatcatctgacttcaaagtgcacctgcttcttctactactctag

SEQ ID NO: 228214 - DNA, 1533 bp, Artificial Sequence
  Description of Artificial Sequence: Synthetic coding sequence
atggctggatcgaggcagagaggcctgagggccagagtgcggccactgttctgtgctctgttgctttccttgggccgtttcgtgagaggagacggtgttgggggagacccagcagtggcactcccacatcgcagatttgagtataagtactccttcaaaggaccacatctcgttcaatctgacggcaccgtacccttctgggcccacgcaggcaacgcgatcccgtcttctgaccagatacgtgtggccccttccctgaaatcacagcggggtagcgtttggaccaagaccaaagccgcattcgagaactgggaagtggaggtgacttttagggtgactgggagggggaggatcggcgcagatgggcttgccatttggtacgccgagaaccagggacttgagggaccagtctttggatcggctgacctgtggaatggcgtgggaattttctttgattccttcgacaacgacgggaaaaagaataatccagcaatcgtaatcatcgggaataacggccagattcactacgatcaccagaacgatggtgctagccaggccctagcatcctgtcagcgggattttcgtaacaaaccgtatcctgtgcgggcaaagataacttattatcaaaacaccctgactgttatgataaacaacggcttcacgcctgataagaacgactacgagttctgtgccaaagtggagaacatgattattccagcccagggacactttgggatctcagcagcaaccggtggactggctgacgatcacgacgtcttatccttcctcacattccagctgactgaacctggtaaggagcctccaactcccgacaaagaaatatccgagaaagaaaaggagaagtaccaggaggaatttgagcactttcaacaggaactggataaaaagaaggaagagtttcagaaggggcatcccgaccttcagggccagcctgcggaagaaattttcgaaagcgtgggagaccgagagctgaggcaggtattcgaggggcaaaacaggatacaccttgaaatcaagcagctgaacaggcaactggatatgatactggacgagcagcgacgctatgtgagttccctgacggaagaaatatctaaaagaggggctgggatgccgggacagcacgggcagatcacacagcaggagcttgataccgtcgtgaaaacccagcacgaaatcctgcgacaggtgaatgagatgaaaaacagcatgtctgaaactgtgcgactggtatccggtatgcagcaccccggttctgcagggggagtgtatgagaccactcagcacttcattgacatcaaggagcacttacatatcgtaaagcgggacattgacaatttagtccagagaaacatgcccagcaatgagaagcctaaatgccccgaactgcctccatttccaagctgcctttcaaccgtccatttcattatcttcgtagtagtccagactgtactatttatcggctatataatgtaccgctcacaacaagaagccgctgccaagaagtttttctag

SEQ ID NO: 228215 - DNA, 1101 bp, Artificial Sequence
  Description of Artificial Sequence: Synthetic coding sequence
atgcaaccactgtggctgtgttgggccctgtgggtgttacccctggcctcaccaggagcggctcttaccggtgagcagttgctggggtccctgttgcgacaactacagctgaaggaagtccctacgttggatcgcgctgacatggaggaacttgtgattccgacgcatgtcagggctcagtacgttgctctcctgcagagaagccacggcgataggtctagaggaaaaaggttcagccagtcattccgggaagtagcaggccgtttcctggcccttgaagcatccacccatcttcttgtgtttggcatggaacagcgactgcccccaaacagcgaacttgtgcaggcagtcttgcgactgtttcaggagcctgtacccaaagctgcactgcaccggcatggtagactgagccctcgcagcgctcgcgctagagtcacagttgagtggctccgggtacgtgacgacgggagcaatagaacctccctgatcgattcccgcctggtctctgtccacgaatcagggtggaaagcctttgacgtgactgaagctgtgaatttttggcaacagctgtcacgcccacgccagcctctcctcttgcaagtgtcggtgcagagagaacatctcggaccattagcctcaggtgcacacaaattggtgaggtttgcatctcagggtgccccagccggactgggcgaaccccagctggagctgcataccctcgacctgggagactacggggctcaaggggattgcgaccctgaggcaccgatgactgaggggaccaggtgctgccgccaagaaatgtatatcgaccttcaagggatgaaatgggctgagaactgggtgctggagcctcccggattcctggcttatgagtgcgtgggcacgtgtcggcagccgccagaggcccttgccttcaagtggccatttctgggcccaagacagtgtatcgcttccgaaacagactccctccctatgattgtgagtatcaaagagggcggacgaacaagaccccaggtggtgagtctgcctaacatgcgtgttcagaaatgttcatgtgcaagcgacggcgctttggtgccaaggcgtctgcaaccctag

SEQ ID NO: 228216 - DNA, 1101 bp, Artificial Sequence
  Description of Artificial Sequence: Synthetic coding sequence
atgtggccgctgtggctgtgctgggccttatgggtgctcccattggcaggcccaggcgctgcactgactgaagagcagctcctcggaagcctcttaagacagcttcagttgtccgaggtgccagtgttagacagggctgacatggaaaagcttgtcataccagcccacgtgagagcgcaatatgtggtgctcttgcgaagaagccatggcgatcggtcccgcggaaaacgcttcagccaaagctttcgagaagtggctggccgattcctcgctagtgaggcaagcactcacctgttggtctttgggatggagcaacgcttacccccaaactccgagttggtacaggcagtgctgcgactgttccaggagccagtgcccaaggcggctttgcaccgtcacggcagactcagccccaggtctgcccaggccagagtgactgtggagtggctgcgagttcgggatgatggttccaatcggacatctctgatcgatagtcgcctagtgtctgtccacgaatcagggtggaaggcgtttgatgttacagaggccgtcaacttttggcagcagctgtctcgacctagacagcccctcctcctacaggtgagcgttcagagggagcacctcggcccacttgcgagtggtgcccacaaactggttcgatttgcaagccagggagcgccagccggtctcggcgaacctcagcttgagctgcacacactggatttacgggactatggcgctcaaggggactgtgatccagaggccccaatgactgaaggaacaaggtgctgcaggcaggagatgtacatcgacctccaggggatgaagtgggccaagaattgggttctcgagccccctggattcctcgcatacgaatgtgtcggcacttgtcagcaacctccggaggcgctggcattcaattggccatttcttggcccacggcagtgcatcgcctcagagactgcttccctgcctatgatcgtgtccattaaagaagggggacggacaaggccacaggttgtgtcattgcccaacatgcgcgttcaaaaatgctcatgtgcctctgacggcgctctggtgccgaggaggcttcagccttag

SEQ ID NO: 228217 - DNA, 999 bp, Artificial Sequence
  Description of Artificial Sequence: Synthetic coding sequence
atgtggcctctgtggctgtgctgggcactctgggtattacccctcgccggtcctggcgctgctttaacagaagagcagctcctgggcagccttctgagacaactacagttgtctgaggtcccggttctcgaccgagcagacatggagaaacttgtcataccagcccatgtccgggctcaatacgtggtgctgctgagacgaagccacggcgacaggtcgagggggaagcggttttctcagtcatttagggaggtcgccggacggtttttagcgagcgaggccgcactgcacaggcacggcagattgtcccctcgctctgcacaagcccgagtgaccgtcgagtggctgcgggtcagggatgacggatccaatcgaacatctctaattgactcaagattggtttctgtgcatgaatctggctggaaggctttcgacgtcactgaggctgtcaacttttggcaacagctctccagaccaagacagcctcttctgttgcaggtgtctgtgcagcgagagcatctgggacctctcgcatccggagctcataaactggtgcggttcgcgtcccagggagccccagctggattgggcgagcctcagctcgagctccataccctagatctgcgtgactatggagcgcagggggattgcgaccccgaggcacctatgacagagggaacccggtgctgtcgacaggagatgtacatcgacctccaagggatgaagtgggctaaaaactgggtacttgaacccccaggcttcctggcatatgaatgcgttggaacatgtcagcagccacccgaagctcttgcatttaattggccatttctgggaccacggcagtgtattgccagcgaaacagcctccctgcctatgatcgtgtccatcaaggaaggcggaaggacaagaccccaagtggtttccctgccaaacatgagagttcaaaagtgttcatgtgcgtctgatggggcactggtgcctaggcggctgcagccttag

SEQ ID NO: 228218 - DNA, 1131 bp, Artificial Sequence
  Description of Artificial Sequence: Synthetic coding sequence
atggtctggaaggtagctgtgttcctgtcagtggcgctaggtattggcgcagtcccaatcgacgatcctgaggatgggggaaagcattgggtggttatcgtcgcaggaagcaatggctggtacaactaccgtcaccaagcagatgcctgccatgcttaccagattatccataggaacgggataccagatgagcagattgtggtaatgatgtatgacgatatcgcttactccgaggataacccaacgccaggcatagtgattaaccgccctaatggaaccgacgtttaccagggcgtccctaaagattacaccggggaagatgtgacaccccagaattttctggcagttctacggggagacgcagaagcggtcaaaggcatcggcagtggcaaggtgcttaaatcaggaccacaggatcatgtgtttatttactttaccgatcatggtagcacaggtattctggtctttcctaacgaggacctgcacgtgaaagaccttaacgagaccatccactacatgtacaaacataaaatgtatagaaaaatggtgttctatattgaagcctgcgaaagcggctcaatgatgaatcacctacccgataacatcaacgtgtatgccaccactgccgctaacccacgggagagtagctacgcgtgctattacgatgagaaacgtagtacatacctgggcgactggtattcggttaattggatggaagactcagatgtagaggaccttactaaggagactctgcacaaacagtatcacctcgtcaagtcccataccaacacttcccacgtgatgcagtacggcaacaagacaatctccacaatgaaggtcatgcagtttcaaggaatgaaaagaaaggcttccagccctgtgcctttgcctcctgttacacaccttgatcttacaccttcccctgatgttcccctgactattatgaaacgcaaactgatgaacactaacgatctggaagagagcaggcagttaacagaggagattcagagacatttggattacgagtacgctttacggcatttatatgtactggtaaacctctgcgagaaaccctacccgctgcacaggattaaactcagcatggatcatgtctgtctcgggcactactag

SEQ ID NO: 228219 - DNA, 1119 bp, Artificial Sequence
  Description of Artificial Sequence: Synthetic coding sequence
atggtgtggaaggtcgcagttttcctctctgttgccctcggtataggtgccgtccctattgatgaccctgaagatggcggaaaacactgggttgtaatcgtggccggatctaacggctggtacaattaccgccaccaggccgacgcatgccatgcttaccaaattatccaccggaacgggatccccgacgagcaaattgtagtgatgatgtacgatgacatcgcatactcagaggacaatccaacgccgggaatcgtcatcaacagacctaacggcaccgacgtgtaccagggggtgccaaaagattataccggcgaggatgtcacgccccaaaacttcctcgctgtgctgaggggcgacgctgaggccgttaagggtattggaagcggaaaggtgctaaagtctggtccacaggatcatgtgttcatttattttacggatcatggaagtacaggaatcctcgtatttcctaatgaagatctacacgtgaaggatctcaatgagaccattcattacatgtacaaacataagatgtaccgcaagatggtcttctacattgaggcatgcgaatcaggatcaatgatgaatcacctgcccgacaacatcaatgtatatgccactacagcagccaaccccagggagagcagctacgcatgttactacgacgagaaaagatctacctatctgggcgattggtatagcgtgaactggatggaagacagcgatgtcgaagatctgaccaaagagacgctccacaagcaatatcacctggtgaagtcccataccaacacctcccatgtgatgcagtacggcaacaagaccatttccaccatgaaagtcatgcagtttcagggcatgaagcgaaaggcgtcgtcacctgttccattgccgcctgtgacccatctggacttaacaccatctccagatgtgcctctgaccattatgaagaggaaattaatgaacacaaatgaccttgaggagtccaggcagctgaccgaagagattcagcggcatctcgacgataagatagtgcacgggccacgagtgccatggtccctgcttaagagctgtcttctggaggcctttcctagcgtctcagcacctcccaccgtctgttag

SEQ ID NO: 228220 - DNA, 1302 bp, Artificial Sequence
  Description of Artificial Sequence: Synthetic coding sequence
atggtgtggaaggtcgcggtgttcctgtcggtagctctggggattggggcagtcccaatcgatgatcccgaagacggcggtaagcactgggtcgtgattgtcgcaggcagcaatgggtggtataattatcgccatcaggctgatgcttgccatgcctatcagatcatacatagaaatgggatccccgacgagcagatcgtcgttatgatgtatgacgatatcgcttatagcgaggacaacccaacaccagggatcgtcatcaacaggcctaacggcactgatgtgtatcaaggtgtgcctaaagattataccggtgaggatgtaaccccgcagaactttttagccgtgctgcggggtgacgccgaagctgtcaaaggaatcgggtcaggcaaggtcctcaagagtgggccacaggaccacgtgtttatttacttcaccgatcatggttccacaggtattttggtgttcccaaacgaggatttgcacgtgaaagacctgaacgagacaattcactacatgtacaagcacaagatgtacaggaagatggtcttttacatcgaagcgtgcgaaagtggctccatgatgaaccacttacctgataatataaacgtctacgcgaccacagccgctaatcccagagagtcttcctacgcctgctattacgatgaaaagcgctcaacctatctaggggactggtacagtgtaaactggatggaggatagtgacgtggaggatctcaccaaggagacattacacaagcagtaccatctagtaaagtctcatacaaataccagccacgtgatgcaatacggaaacaagaccatttctacaatgaaagttatgcagtttcagggcatgaagagaaaggcgagttctccagtgcctctgcctcccgtcacgcacctggatctcactccttcaccagatgtccctctgactataatgaaaagaaaactgatgaacacaaatgatttggaggagtctcgacagctgacagaagaaatccaaagacatctcgatgccaggcatctcatcgagaagtctgttaggaagatcgtgtccctgctcgcagcgagcgaagccgaagtggaacagttgctgtctgaaagagcgcctcttactggacatagttgttatccggaagcgctgttgcacttccgcacgcactgtttcaactggcactcaccgacctacgaatacgctctgcgtcacttatatgtgttagttaacctctgcgagaagccctacccattacatcgcattaagctgtctatggatcacgtgtgcttaggtcattactag

SEQ ID NO: 228221 - DNA, 1302 bp, Artificial Sequence
  Description of Artificial Sequence: Synthetic coding sequence
atggtgtggaaggtggcagtttttctctccgtggccctgggcattggtgccgtcccgatcgacgatcctgaggacgggggtaaacactgggtggttattgtggcaggctcaaacggttggtataattatcgacaccaggcggacgcttgtcatgcttaccagatcattcaccggaatggaatccctgatgagcagatagtggtgatgatgtacgacgacatcgcttactctgaagacaaccctacccccggtatcgtgatcaataggcccaatggcacagatgtataccagggcgtccccaaggattatactggtgaagacgttacaccccagaatttcctagccgtcttgcggggtgacgccgaagccgtgaaaggtattgggagtgggaaggtccttaagagtgggcctcaggatcatgtgttcatctactttacagatcatgggtctacaggcatccttgtcttcccaaacgaggacttacatgtgaaagacctgaacgagactatacactatatgtacaaacataagatgtatagaaagatggtgttctacatcgaggcctgcgaatccggctctatgatgaatcacctgcctgacaatattaacgtttacgccactaccgctgcaaacccccgagagagttcctacgcctgctactatgacgaaaagaggtccacatacctcggggattggtatagtgtgaactggatggaggactcggacgtggaggatctcaccaaagaaacgcttcacaagcagtaccatcttgtgaagagtcatacaaataccagtcatgtgatgcaatacgggaataaaactatctctactatgaaggttatgcagttccaggggatgaagcggaaggccagttcaccagtgccccttcccccagtaacccacctcgacctgacccccagtcctgatgtccctcttaccattatgaagagaaagctgatgaacaccaatgatctcgaggagagcagacaattaaccgaagaaatacagcgccatcttgatgcacgtcatttgatagagaagtccgtgagaaagatcgttagtttgcttgcagcaagcgaagcagaagtggaacaactgctgtcagagagagctccattaactggtcatagttgctatcctgaagctctgcttcacttccgcacccattgcttcaattggcatagcccaacttatgagtatgccctgcggcatctgtacgtattggtgaacctctgtgagaagccatatcccttgcatcgcattaagctgtctatggaccatgtttgcttggggcactactag

SEQ ID NO: 228222 - DNA, 1197 bp, Artificial Sequence
  Description of Artificial Sequence: Synthetic coding sequence
atggtttggaaggtggctgttttcctctctgtcgctctgggaattggtgccgtaccgatcgacgacccagaagacggaggaaagcactgggtcgtgatagttgccggtagtaacgggtggtataattatagacaccaggcagacgcatgtcatgcataccagatcattcaccggaacggcatacccgatgagcagattgtggtgatgatgtacgacgtgacgcctcagaatttcctggctgtcttaaggggagatgctgaggcagttaagggaataggcagcgggaaggtgctcaagtccggtcctcaagaccacgtcttcatctatttcacagaccacggctcaaccggaatcctcgtgtttcctaacgaagacctacacgttaaggatctgaatgaaacaatacattatatgtataagcataaaatgtatagaaagatggtgttttatattgaggcatgtgaatctgggtccatgatgaatcacttgccagataatatcaatgtctatgctaccacggctgccaacccacgcgagtcctcttatgcttgctactatgacgagaagcggtccacttaccttggggactggtatagcgtgaattggatggaggatagcgatgtcgaggatctgactaaggagactctgcacaaacagtatcatctggttaagagtcatacgaatacttctcacgtgatgcagtatgggaacaagacaataagtacaatgaaagtgatgcaatttcaggggatgaaacggaaggcctcctcgcccgtgccactgccacctgtcactcacctggacctgaccccatctcccgatgtgcctcttaccattatgaagagaaagctgatgaacacgaatgacctcgaagaaagccgtcaactgaccgaggaaattcagcgccacctggacgcaagacacctaattgagaaatccgtgagaaagattgtgtcactcttggccgcatctgaggctgaggtcgaacagctcttgtctgagagagccccacttaccggacatagctgttatcccgaggccctgttgcatttcagaacccattgtttcaactggcactcacccacatacgagtacgcactgagacacctctacgtgctggtgaatctgtgtgagaaaccttatcctctacaccggattaagctgtccatggaccacgtttgcctcggtcattactag

SEQ ID NO: 228223 - DNA, 1233 bp, Artificial Sequence
  Description of Artificial Sequence: Synthetic coding sequence
atggtgtggaaagtggcggtgttcctgtctgtggcgggatcaaatggctggtacaattacagacaccaggccgatgcatgtcacgcgtatcaaatcatccatcggaatggtattccagatgaacagatcgtagttatgatgtacgatgacattgcttattctgaggacaaccctacgccgggaatcgttatcaatcgccctaacggcaccgacgtttatcagggcgtgcctaaggactacaccggagaagatgttacaccccagaacttccttgcggtgctacgaggcgacgcggaggccgtgaaaggcatcggctcgggaaaagtgcttaagagcggaccacaggaccacgtgtttatttactttaccgaccatggctcaaccggcattctcgtgtttccaaacgaggacctgcacgtgaaagatcttaacgaaactatacactacatgtataaacacaagatgtacaggaagatggttttttacattgaggcctgtgagtctggaagcatgatgaaccatctgccagacaatatcaacgtgtatgcgactaccgccgctaatcccagagagtccagctacgcttgttattatgatgaaaaacgcagtacttatctgggagactggtacagcgtgaactggatggaagattctgatgtagaagatctgactaaggagactctccataaacaataccatttggtgaagtcacataccaatacatcccatgtaatgcagtacggaaataagaccatcagcaccatgaaggtgatgcagtttcagggtatgaagcggaaagcatcctctccagtgcctctcccccctgtgactcacttggacttgacaccatcccccgacgtgccactgactatcatgaaaaggaaactgatgaacacaaacgacctggaagagtccagacagctgacagaagaaatccagcggcatttagacgccagacatctgatcgaaaagagcgtgcggaaaatcgtcagcctgctggcagcgagtgaggccgaggtagaacagttgctgtccgagcgtgctccccttactggtcattcatgctaccccgaagcattattgcacttccgaactcattgttttaactggcactcacccacatacgaatatgcgctacgccatctgtacgtcctcgtcaacctgtgcgagaaaccttatcctttacatagaatcaagctttcaatggaccatgtgtgtctaggccattattag

SEQ ID NO: 228224 - DNA, 174 bp, Artificial Sequence
  Description of Artificial Sequence: Synthetic coding sequence
atggtgtggaaggtggccgtgttcctgagcgtggccctgggaataggagccgtccccatcgacgacccagaggatggaggcaaacactgggtcgtaatcgtggccggttccaatggatggtataattacaggcatcaagctgatgcttgtcacgcctaccagatcatacattag

SEQ ID NO: 228225 - DNA, 60 bp, Artificial Sequence
  Description of Artificial Sequence: Synthetic coding sequence
atggtttggaaggtagccgtctttctgtccgtggctctgggtattggggctgtcccctag

SEQ ID NO: 228226 - DNA, 177 bp, Artificial Sequence
  Description of Artificial Sequence: Synthetic coding sequence
atggtgtggaaggtggctgttttcctgtcagtcgcccttgggatcggagctgtcccaattgacgatcccgaggacggaggcaaacattgggtagtcatcgttgcgggtagcaatgggtggtacaattatcgacaccaggcggatgcttgccatgcctatcaaatcatccaccgctag

SEQ ID NO: 228227 - DNA, 237 bp, Artificial Sequence
  Description of Artificial Sequence: Synthetic coding sequence
atggtttggaaggttgcggtctttctgtccgttgccctgggcattggagcagttcctatcgatgatcccgaagacggcggaaaacattgggttgtcatcgtcgccggtagtaacggttggtataactacaggcaccaggcagatgcctgtcacgcgtatcagattatccaccggaacggtattcctgacgagcagattgtggtgatgatgtatgacgatattgcctactctgaatag

SEQ ID NO: 228228 - DNA, 237 bp, Artificial Sequence
  Description of Artificial Sequence: Synthetic coding sequence
atggtttggaaggtggcagtgttcttgtctgtggcactcggcattggagcagttcctattgacgacccggaggacgggggaaagcattgggtcgttatcgttgcgggaagcaacggctggtacaattaccggcaccaggccgacgcttgccatgcttaccagatcattcatcgtaacggaatcccggacgagcaaatcgtagtcatgatgtacgacgacatagcatactctgaatag

SEQ ID NO: 228229 - DNA, 2736 bp, Artificial Sequence
  Description of Artificial Sequence: Synthetic coding sequence
atggcagccgcagctgcttcggcaccccagcagctgagtgacgaggagctcttctcccagcttcgcaggtatggcctgtcaccgggtcctgtcactgaatctacccggcctgtttatctgaagaaactgaagaaactccgagaggaagaacagcagcaacatcgaagtggaggcaggggcaataagacacggaacagcaataacaacaacaccgccgctgccacagtggcagccgctggccctgctgccgctgcagctgcaggaatgggtgtgcgaccagtgtcgggcgatctgtcttatctccgcactcctggcggactgtgtcgcatctccgcatccggtccggaatcactccttggcggaccaggtggcgcatccgcggcacccgctgccggtagcaaagtgctgcttgggttcagtagcgacgagtccgacgttgaggcctccccgagggatcaggccggagggggaggacgcaaggatcgggcatctcttcagtaccgaggcctgaaagcacccccagctccattggcagctagtgaggtgactaactccaacagtgccgaaaggcggaaacctcactcgtggtggggtgctagaaggccagcaggcccagagctccagacacctcccggtaaggatggagccgtcgaggacgaagagggcgagggggaggatggtgaggagcgcgaccctgaaacagaagagccattgtgggcaagccggaccgtaaatggctctagattggtaccatattcctgccgtgaaaactatagtgattccgaagaagaagacgatgatgatgttgccagtagtcgccaggttctgaaagacgactcacttagtcgacaccggccacggagaacccacagtaaaccactgccccctctgaccgctaaaagtgcaggtggtcgcctcgaaacttccgtgcagggaggtggaggcctcgcaatgaatgatagggccgcagctgcgggatctctggacagatcgaggaacctcgaggaggcggcagcagctgagcagggtggcggatgcgaccaagtggatagtagccccgtaccgagatatagggtaaatgctaagaagctgacaccgctgcttcctccaccactcacggatatggattccacacttgacagctcgaccggctctctgctgaaaactaataaccacatcggagggggtgccttttccgtggattcccctcggatttacagtaactctctgccaccatcggcggctgttgccgcttcctctagtctgcgtatcaaccacgccaatcacactggctcaaatcatacatatctgaaaaacacctataacaagccaaagctatcagagcccgaagaagagcttcttcagcagttcaaaagggaggaggtttctcctactggatccttcagtgctcattacttgtcaatgtttctgctgaccgccgcatgtctgttctttttgattctggggttgacctacctaggaatgaggggcactggggtcagcgaggatggagagttgtccattgaaaatcctttcggggagacatttggaaagatccaggagagcgaaaagactctgatgatgaataccttgtataagctccatgacagactggcccagctagccggtgaccatgagtgtggcagcagctctcagcgtactctttcagtgcaggaagcagcagcatacctgaaggacctgggaccggaatacgaaggcatttttaacacctcgcttcaatggatcctggaaaacggtaaagatgtgggcattcggtgtgttggctttggtccagaagaggaactgacaaacatcacggacgtccagttccttcagagcaccagaccacttatgtccttctggtgtcggtttaggcgtgcgttcgtgactgttacccatagactgctgctcctgtgcctcggcgtggtgatggtgtgcgttgtgctccgatatatgaaataccgctggaccaaagaagaagaagaaaccaggcaaatgtacgatatggtggtgaagatcattgatgtgttgcggagtcacaatgaggcatgccaggagaataaggacctgcagccatacatgccaataccccatgtgagggactcccttatacaacctcatgacagaaaaaagatgaagaaggtctgggacagggctgtagacttcctggccgctaatgaatcacgggtcaggacagaaacccgcaggatagggggtgcagatttcttggtctggagatggatccagccatccgcatcttgtgacaaaatattggtcatccctagtaaggtctggcagggccaggctttccatctggatcggagaaacagtccaccgaacagcctcaccccatgccttaagatccgaaacatgttcgatccggtgatggagatcggcgatcagtggcacctggctattcaggaggcaattcttgagaagtgctccgataatgacgggatcgtccacatcgccgtggataagaacagcagagaaggctgtgtgtatgtcaagtgcctctctccagaatacgccggaaaggccttcaaggccctgcatgggtcatggttcgacggcaagctagtcactgtcaaatatctcaggttggatcgctatcaccatcgatttcctcaggcactgacctccaatacccctctgaaaccgtccaacaagcacatgaacagtatgtcacacctccgactgaggaccggtctgaccaactctcaaggttcgtcctag

SEQ ID NO: 228230 - DNA, 4512 bp, Artificial Sequence
  Description of Artificial Sequence: Synthetic coding sequence
atgccgggtccacccgctctgcgtcgacgactcctgctccttctgctcgtgctgcttatcgccggttccgcaggagcagctccacttccacagactggagcgggagaggccccacctgccgctgaagtcagctccagtttcgtgatcctttgcgtgtgctctctgattatcctgattgttctgatcgcaaattgtgttagctgctgtaaggacccagagatagacttcaaagagtttgaggataatttcgatgacgaaattgacttcactcctcccgcagaggacacccctagtgtacagtcaccagctgaggtgttcaccctgtctgtcccaaacattagtctgccagccccatcacagtttcagccgagcgtcgagggcctgaaatcccaagtggctcgtcattctcttaactatattcaagaaatcggtaacggatggttcgggaaggttctactcggtgagatctataccggcacctccgtagcccgtgttattgtgaaagagctgaaagcctccgccaaccccaaggagcaggacactttccttaaaaacggcgagccctattatattctgcagcaccctaacattctgcaatgtgtggggcagtgtgttgaggccatcccttatttgctggtgtttgagttttgcgacttgggggatcttaaagcttaccttagaagcgaacaggagcacatgcgtggcgattcgcagacaatgctgctccaaagaatggcttgtgaggtcgccgctgggctggccgctatgcacaaactgcactttttgcattcggatttagccctccggaattgttttcttacctcagatttgaatgttaaagtgggagactacggaatcggatttagtcgttataaggaggattacattgagaccgacgacaagaaggtgttccccctaaggtggacagccccagagctcgtgacttccttccaggatcgtttgctgactgcagatcagacaaaatatagcaatatttggtccctcggagtaactctctgggagctgtttgacaacgccgcacaaccatactctaacctgagcaacttggacgtcctgaatcaggtgatccgcgaaagagacaccaagctcccaaagccacaactcgagcaaccatattccgaccgctggtatgaagtgctccaattttgttggttgtctccagaaaaacgcccagccgcagaggatgttcatcgactcctgacgtacctgagattgcaaagccagcgtgattccgaagtggactttgaacaacagtggaacgctctgaagccaaacaccaattctagagattcaagcaataacgcggctttccctatccttgatcacttcgccagagatcggctgggaagagaaatggaagaggtcctgactgttacagaaacttctcagggcctgagcttcgaatacgtgtgggaggccgctaaacacgaccacttcgacgagagatcaagaggtcacctggatgagggcctaagctacacctccatcttttaccccgtcgaggtgtttgaatcatccctctccgacccaggcccagggaagcaggacgactccggccaggatgttccccttcgtgtgccaggagtggttcccgtcttcgacgctcacaacttgagcgtgggatctgactactacatccagcttgaagagaagtccgggagtaatctggagctggattatccgcctgcactgttgactaccgatatggataacccagagaggaccggccctgaactgagccagctcaccgccctgcgttctgtggagttagaggagtccagcacagacgaggattttttccaaagttcaacagaccctaaagacagctccttacccggtgacctccatgtgactagtgggccagagtctcccttcaataatatcttcaacgatgtcgacaagagtgaggaccttcctagccatcagaagatcttcgatttaatggagcttaatggagttcaggcggactttaaaccagccacactgtcttcgagtctggataatcctaaggagtccgtgattaccggccattttgaaaaggaaaagcctcgtaaaatcttcgacagcgagcctttgtgtctctccgacaacttgatgcatcaggataattttgatccacttaacgtgcaggaacttagtgaaaatttcctattcctgcaggagaaaaatcttttgaaaggcagcctgagttccaaagagcacattaacgatctgcagactgagctgaagaatgctggctttacagaggctatgttggaaacgtcgtgccgcaattccctggatacagagctgcagttcgccgagaataaaccgggactgtcacttcttcaggaaaacgtaagcaccaaaggagatgataccgacgtgatgcttacaggcgacactctcagcacatccctgcagagctcgcccgaagtccaagttccacccacaagtttcgaaactgaggaaacccccagaagggtgcccccagattcgctccctacccagggcgagactcaaccaacgtgcttagatgtgatcgtgcctgaggattgcctgcatcaggacatttcccctgatgccgtgactgtgcccgtcgaaatactgagcactgatgctcgcacacattcgctagataaccggtcccaggacagtccaggcgagagcgaagaaacgcttagactaaccgaatccgacagcgtcctggctgacgatatcctcgctagccgcgtgtccgtgggaagctctctgcctgaactgggccaggaactccacaataagcccttcagcgaggaccaccactcccacaggcgcctggaaaagaatctggaagctgtcgaaacgctgaaccagcttaactccaaggacgccgctaaggaggctgggctggtcagcgctcttagctccgactcaacaagccaggactccctgctggaggactcactgtctgctccttttcctgcatccgagccaagtctcgagacaccagactcactagagagcgtggacgttcacgaagccttgctagattctctgggatctcatacacctcagaagctagtgcctcctgataagcctgctgactccggctacgaaaccgaaaatctggaaagcccggagtggactctgcatccagcaccagaaggaaccgctgactccgagccagctactactggtgatgggggacactctggtttgcctccgaaccctgtcatcgttatctcagacgcaggcgacggacacagaggaacagaggtcacaccagaaacatttaccgcgggttcccagggtagctaccgcgactccgcatacttctcggataacgactcagagcctgagaaaaggagcgaagaagttcctgggaccagcccgagcgcgctggtcctggtgcaggaacagccactacctgaacctgttctgccagagcaaagccctgctgcacaggactcctgcttagaggcacggaagtcccaaccagacgaaagctgccttagtgctctgcataacagttccgatttggaactgcgcgctactcccgagccagctcagaccggagtgccccaacaagtgcatcctacagaggacgaggcgtcaagcccttggtccgtactgaacgccgaactgagcagtggggatgacttcgagacccaggacgatcgtccatgcacattggccagcactgggaccaacacaaacgagctcttggcatacacaaatagtgccttggataaatccctctcctcgcattctgaggggccaaagctgaaagaaccagacattgagggtaagtacctcgggaagctcggcgttagcggtatgctagatctgtctgaggacggtatggatgcagatgaggaagatgaaaactcagatgattcagatgaggacctccgcgcttttaatttgcactctttatcatctgagtctgaggacgagactgagcatcccgtgcccattatactttccaacgaggacggacggcatctgcgcagcctgctgaagcccaccgctgctaacgcccctgatcctctgcccgaggactggaaaaaggagaagaaggcagtgactttttttgacgacgtgaccgtttatctcttcgatcaggagacgccaacaaaagagttgggcccatgtggaggcgaagcctgtggccctgatttgtcgggccctgcccctgcctctggcagtccctatctctccaggtgtatcaacagtgagtcaagcacggatgaagaggggggtggctttgaatgggatgacgattttagccccgatccctttatgagcaaaacgacctctaacttactgtcctctaagccttccctgcaaacatctaagtacttctctccgccaccaccggcaaggagtaccgagcagtcgtggccacattcagccccttactcgagattctccatatcccccgcaaacatcgcctccttctcgctgacccatttaaccgattccgacatagagcagggaggttccagcgaggacggtgaaaaagattac

SEQ ID NO: 228231 - DNA, 186 bp, Artificial Sequence
  Description of Artificial Sequence: Synthetic coding sequence
atgcaaccacgaactcagccactggcgcagactctccctttctttctcggcggagcaccgagagacaccggactacgtgtacccgttataaagatgggaaccgggtgggaaggctttcagcgcacccttaaggaggtggcctatatcctgttatgctgctggtgcatcaaagagttgctagactag

SEQ ID NO: 228232 - DNA, 186 bp, Artificial Sequence
  Description of Artificial Sequence: Synthetic coding sequence
atgcagccccgaacccagcccctcgcacagaccctgccattcttcttgggcggagcccctcgagatacaggcctaagagtgcccgtgataaaaatggggacaggatgggagggttttcagcgcactctaaaggaggtcgcttacatactgttatgctgctggtgtattaaagaattattagactag

SEQ ID NO: 228233 - DNA, 522 bp, Artificial Sequence
  Description of Artificial Sequence: Synthetic coding sequence
atgtatagcttcatggggggtggactcttttgtgcatgggtcggtaccatcctgctggtggtggccatggctaccgatcactggatgcagtatcggctgagcggctctttcgcacaccagggactctggaggtattgtctcggaaataagtgttatcttcagactgactctattgcttattggaatgccacacgggctttcatgatcctcagcgcactctgtgcgatctctgggataatcatgggaatcatggcattcgctcaccagccaactttcagcagaataagcagacccttctcagctggcatcatgttcttcagctccacactctttgtcgtgctcgctctagccatctatacaggcgtcacggtgagctttctcgggagaaggttcggtgattggcgtttctcttggtcttacatcctgggctgggtcgccgtgctaatgaccttcttcgccggaattttttacatgtgtgcctatcgcgtgcatgagtgtcgtcggctcagcacccctagatag

SEQ ID NO: 228234 - DNA, 681 bp, Artificial Sequence
  Description of Artificial Sequence: Synthetic coding sequence
atgcctggcggtcctggggtgcttcaggctctgccagctaccatctttttactcttcctgttgagcgccgtgtacctcggcccagggtgccaagccctatggatgcataaggtgcctgcctcactgatggtgagccttggcgaggacgcccactttcaatgcccccacaatagcagcaacaacgctaacgtgacctggtggagggtgctgcacggtaactatacatggccccctgagtttctgggccctggggaagatcccaacggcacactaatcatccagaacgttaacaaatcacacggcggtatctacgtatgtcgggtgcaggagggcaacgagtcctaccaacagagttgcggcacttatttgcgggtgaggcaacctccccctagacccttcctcgatatgggggaagggactaagaatcggattatcacagcggaggggatcattctactcttttgcgctgtggtccccggaacactgctgctgtttagaaagcgctggcagaatgagaagctgggcctggatgcaggggacgaatatgaagacgaaaacctctacgaaggtctgaacttagatgactgttcaatgtatgaggacatcagccgaggtctacaggggacataccaggacgtggggtcactgaacattggagatgtgcagctggagaaaccatag

SEQ ID NO: 228235 - DNA, 2001 bp, Artificial Sequence
  Description of Artificial Sequence: Synthetic coding sequence
atggccgacatggaagatctctttggctccgatgcagattctgaagctgaacgcaaggattccgattccggctctgattccgactcagaccaagagaacgccgcatcaggctccaacgctagtgggtctgagtctgaccaagacgaacgtggcgactccggacagccctctaataaagagttattcggcgatgatagcgaggacgaaggtgcatcccaccacagcgggtctgacaaccacagtgaaaggagtgataacaggtcagaggcttccgagagatccgaccacgaagataacgatccctctgacgtcgaccaacatagcggtagcgaggccccaaatgacgacgaggatgaggggcataggagcgatgggggatcacatcacagtgaagctgaaggatcagagaaggcccattccgatgacgaaaaatggggccgagaagacaaatcagaccagagtgatgacgaaaagatacagaactcggatgacgaggaaagagcccagggctctgacgaagataagctgcagaactcagacgatgatgaaaagatgcaaaatactgatgatgaagaacgacctcaattgtctgatgacgagcggcagcagctgtcagaagaagagaaggcaaactccgacgacgaacggccagtggcgtcagacaatgacgatgaaaagcagaactccgacgacgaagagcaaccccagcttagcgacgaagagaagatgcagaactcagacgacgaaaggccacaagctagcgacgaggaacatagacatagcgacgacgaggaggagcaggatcataagtcagagagtgcacgtgggtccgactcagaggacgaggtgctaaggatgaaacgtaaaaacgctattgcctcggactccgaggctgacagtgataccgaagtccctaaagataattcaggaaccatggaccttttcggcggtgccgacgacatttcttccggcagcgacggcgaagataagcccccaacacccggacagcctgtggacgagaacggactccctcaggatcagcaggaggaggagccaattcctgaaacccggatcgaggtggaaatccctaaagtcaatacagacttgggtaacgacctctattttgtcaagctccccaacttcctgtcggtagaacctcggccatttgacccacagtattacgaagacgagtttgaggatgaggagatgcttgatgaagaagggcgtactaggctaaaacttaaggtagaaaacaccataaggtggagaatccgtcgggatgaagagggtaatgaaataaaggagagcaacgcccgtattgtgaagtggtccgatggaagcatgtccctgcacctgggcaacgaggtgtttgatgtgtataaggccccactccagggggatcacaaccatctgtttatacgacagggaaccggcctacagggtcaggccgtctttaaaacaaagttgacttttaggcctcattcaacggactccgctacccaccgaaagatgaccctgagcctggctgataggtgtagcaaaacacagaaaatcagaatcctgcctatggctggcagagatccagagtgccaaaggactgagatgatcaaaaaagaggaagaacgactgagagcaagcattaggagagaatctcaacagaggagaatgagggaaaagcaacaccaacgaggattgagtgcaagctaccttgaacctgaccggtacgacgaggaagaagaaggagaggagtcgatctccctggcggcaatcaaaaataggtacaaaggcggtatccgcgaggaacgtgctagaatatacagctctgatagtgacgaaggatccgaagaagacaaagctcaacggctccttaaggctaaaaagcttaccagcgatgaagagggagagccatccgggaagagaaaggctgaggatgatgataaagcaaacaaaaagcacaaaaagtacgtcatctctgacgaagaagaggaggacgacgattag

SEQ ID NO: 228236 - DNA, 1821 bp, Artificial Sequence
  Description of Artificial Sequence: Synthetic coding sequence
atggccgacatggaagacctgttcggaagcgacgctgactcagaagcagagcggaaggattctgacagcggctccgacagcgattctgatcaggaaaacgcggcatccgggtccaatgcctctggctccgagtctgaccaagatgagagaggcgattccggtcagccgtcaaacaaagaattgtttggcgatgattctgaggacgaaggcgcttcccatcactccggctctgataatcactctgaaaggtctgataaccgatcagaggcttcagaacggtcggatcatgaagataatgacccctccgacgtggatcaacatagtggctcagaggccccaaacgatgacgaggatgaagggcacagatctgatgggggaagtcaccacagtgaggcagaaggatcggagaaggcgcattcagatgacgaaaagtggggcagggaggacaaaagcgatcagagcgatgatgagaaaatccaaaacagtgatgacgaggaaagggcccaggggagtgacgaagacaaactgcaaaattctgatgacgacgagaagatgcagaatacggacgacgaggaaagacctcagctctctgacgatgagcggcaacagctgtctgaggaagagaaagccaacagtgacgatgagaggcccgttgcgtccgacaacgatgacgagaaacagaattccgacgacgaggagcaaccacagttgagtgacgaagaaaaaatgcaaaattccgacgatgagcgtcctcaggcatccgacgaagagcaccggcacagtgacgatgaggaggagcaggatcacaaatctgagtcggcccgaggtagcgacagcgaagacgaggttctccgcatgaaaaggaagaatgctatcgcctcagactcagaggctgacagcgataccgaggtaccaaaggataattctggaacgatggacctgtttgggggagccgacgacatttcttcagggtctgacggagaagacaaaccaccaacacctggccagcccgtggatgagaatgggctgcctcaggatcaacaggaagaggagccaattccggagacccgtattgaagtggaaataccaaaggtgaataccgatctggggaacgatctttacttcgtcaagctgcccaactttctttccgtagaaccatccatgtctctccaccttggaaatgaagtcttcgatgtgtacaaggccccactgcaaggtgatcataaccatctctttatacgacagggaaccggattacaaggacaggctgtgtttaagactaagctgacattccgcccacactcgaccgactcagctacacatcggaagatgaccctgagccttgcggatcgttgctcaaagacacagaaaattcggattctacctatggccggacgtgacccggaatgccaaagaaccgagatgattaagaaggaggaagagaggcttcgcgcttccatcagaagggagtcccagcaacgcagaatgcgggagaagcagcaccagcgcggtctgagtgccagctatcttgagcccgacaggtacgatgaggaggaagagggggaagaaagcatttcgcttgcagcaattaaaaaccggtataaaggcggtattcgggaggaaagagccaggatctatagttccgactctgacgaaggaagtgaggaagataaggctcagagactgctaaaagctaagaagcttacttctgacgaggagggggaaccctcaggaaagcgtaaagccgaagatgacgacaaagcaaataagaaacataaaaagtacgtaatcagcgacgaagaagaggaggatgatgattag

SEQ ID NO: 228237 - DNA, 1935 bp, Artificial Sequence
  Description of Artificial Sequence: Synthetic coding sequence
atggctgatatggaggacctgttcggctccgacgccgattcagaggctgagcgtaaagactctgacagcgggagcgattccgattccgaccaagagaatgccgcaagcgggtcaaacgcgagtgggtccgagtcggaccaggatgagagaggagatagtggtcagcccagcaataaggagctcttcggagacgatagtgaggacgaaggagctagccatcacagcggttcagacaatcacagtgagcggtccgacaacagatcggaagcaagtgagcgaagtgatcatgaggacaacgatccctcagacgtggaccaacactccggatctgaggctcctaacgatgacgaagacgaaggccacagatctgatggtggatcacatcattccgaggctgaggggtccgaaaaggcccacagtgacgacgaaaagtgggggcgtgaagacaagtcggatcagtcagatgacgagaagattcaaaacagtgacgacgaagaaagggcccagggatcagacgaagataaactccaaaatagtgacgacgacgagaaaatgcaaaatacagatgacgaggaaaggcctcagctgagcgatgatgagcgacagcagttaagcgaagaggagaaggcaaacagtgatgatgaaagaccagtggcctctgataatgatgatgacgatgagcggccacaggcatccgatgaagagcacagacactctgacgacgaagaggaacaagatcataagtcagaatccgcgagagggtccgactccgaagatgaggtgctcaggatgaaaaggaagaacgcaatcgcctcagatagtgaagcagatagtgacaccgaggtgcccaaagacaacagcggcacgatggatctgtttggtggcgctgatgatatttctagtggctcggacggagaggataagcctcctacacctggacagcccgtagatgaaaatggcttacctcaggatcagcaggaggaggaacccattcccgagactcgcattgaagtggagattccaaaagtgaacacggacctcggaaacgacctttactttgtgaaattgccaaatttcctcagcgtggagccacgtcccttcgacccgcagtactatgaagatgaatttgaagacgaagaaatgctggatgaggagggcaggacgagactcaagctgaaggtggagaataccattcggtggcgaatcagaagagacgaggagggcaacgaaataaaggaatcaaacgccagaatagtgaagtggagcgatgggtcaatgtctctccatctcgggaacgaggtttttgatgtctacaaggctccgctgcagggtgaccataatcacctctttatccgtcaaggcaccggattgcagggccaggccgtttttaaaacaaagcttacctttagacctcactcgacggattccgccacacacaggaagatgaccttgtctttagctgaccgctgctctaagacccagaagatcaggatactaccaatggccggtcgggaccctgaatgccaacggactgaaatgattaaaaaggaggaagaaaggctgcgagcatcaattcgtcgagagtctcagcagagacgcatgcgggagaaacaacatcagagaggtctctccgccagctacctcgaaccagaccggtacgatgaagaagaagagggtgaggagagcattagcctcgccgctataaagaatcggtataagggagggatccgggaggaaagggctcggatttacagcagcgattccgacgaagggtccgaggaggacaaagcgcagcgcttacttaaggccaaaaaactgacctctgatgaggagggcgaaccttcgggtaagcgcaaggccgaagatgacgacaaagccaataaaaagcataaaaaatatgtgatctccgacgaagaggaagaggacgatgactag

SEQ ID NO: 228238 - DNA, 2127 bp, Artificial Sequence
  Description of Artificial Sequence: Synthetic coding sequence
atgcgtgagcgtatttgggcaccccctctcctgctgctgctgccactgctcttacccccaccactgtggggtggccctcctgattctccgagacgtgaactcgagctcgaaccaggccctctccagccattcgaccttctgtacgcctccggagcggctgcctattactccggcgactatgagagagccgtgcgcgacctcgaagcagccctccgaagccatagacgattgcgggaaatacggacacgttgtgcgcgacactgcgctgcgagacaccctctgcccccacctcctcccggtgaaggccctggtgcggaactcccactgttccgctccctgctgggcagggccagatgctatcgctcctgcgaaacacagaggctaggcggaccagcatcaagacatagggtcagcgaagatgttcgctcagatttccagcgcagggtgccatacaactacttgcagagagcctatataaaattaaatcagctggagaaggccgtggaggccgcacacaccttctttgttgccaaccccgagcatatggagatgcagcagaatattgagaattaccgcgcaacagcaggagtggaggccctgcaacttgtagaccgcgaggcgaaaccacacatggagagttataacgcaggcgtcaaacactacgaagctgacgattttgagatggccattaggcactttgaacaggcattacgggagtatttcgtagaagataccgaatgtcggactctttgtgagggaccccagagatttgaggagtatgaatacctgggatataaggcgggtctgtacgaggccatcgcggatcactacatgcaggtcctggtctgtcagcacgaatgcgtgagagagctagcgacacgccctggcaggctgtcccccattgaaaacttcctaccacttcattacgattatctccagtttgcttattatagggttggagaatacgtgaaggctcttgagtgtgccaaggcatacctgctgtgccaccctgatgacgaagacgtgctagataacgtggactattacgagtcactcctggatgattctattgaccctgccagtatcgaagcccgtgaggatctaacaatgttcgtaaagaggcacaagctcgagtctgaacttatcaagtctgcggctgaagggcttggtttctcatacaccgaacctaattactggatcaggtacggcggaagacaggatgagaacagagtcccttcaggtgtcaatgtcgaaggcgcagaagtccatggattcagcatgggaaagaaactgtctccaaaaattgaccgggacctgcgagagggcggtcccctgctatatgagaatatcacattcgtttataattccgagcagctcaacggcacccagcgggttctgttagacaacgttcttagtgaggaacagtgtagggagttacacagtgtcgcctctggaattatgttggtgggagacggctatagaggcaagacatctccgcacaccccaaacgagaaatttgagggcgctacagtgctgaaagccctcaaatctggctacgaggggagagtgccgttaaagagtgcgaggctgttctatgatatctccgagaaggcgaggagaatcgtcgaaagctactttatgctgaatagcacactatacttttcctacacgcacatggtatgtcgaaccgccctctccggacagcaggacagacggaacgatctgtcccacccaattcacgccgacaactgtttgttggacccagaagctaacgaatgctggaaagaacctccagcctacactttccgtgactacagcgctcttctgtacatgaacgacgactttgagggcggagagtttatattcactgagatggatgcgaagactgtgacagcatccatcaagcctaaatgtggcaggatgatatcattctcttccggtggggagaacccacacggcgtcaaagctgtgaccaaaggcaagcgatgcgcagtcgctctgtggtttacgctcgaccctctctacagagaactggagcggattcaggccgacgaggtgatcgccattcttgatcaggagcagcagggaaaacacgaattgaacatcaatcctaaagacgaactctag

SEQ ID NO: 228239 - DNA, 1584 bp, Artificial Sequence
  Description of Artificial Sequence: Synthetic coding sequence
atggagatgcaacagaatatagagaactatagagcaacagctggcgtcgaagcactccagttggtcgatagagaggccaaaccacacatggagtcatacaatgctggcgtgaagcactacgaggcagatgactttgaaatggcaattcgacatttcgaacaagctctgcgtgaatactttgttgaagatacagaatgccgaactctatgtgagggccctcagagatttgaagagtatgagtatctgggctacaaagctggactgtatgaagcgatagcggatcactacatgcaagtgttggtatgtcagcatgagtgcgtcagggaactggcaacccggcctgggcgtctcagcccgatcgagaacttcctccccctccattatgattacttacagttcgcttattacagggtgggagagtacgtgaaggctctggagtgcgccaaagcctaccttctttgccaccctgatgatgaagacgtcctggataatgtggactactatgagtccttactggacgactctatagatccagcatccatagaggctcgagaagatctgactatgttcgtgaaacggcacaaattagaatcagagctaatcaaatcagccgctgagggactgggcttctcttacacggagccaaactattggatcagatatggaggcagacaggacgagaaccgggttccaagtggcgtgaacgtggagggagctgaggtgcatggctttagcatgggtaaaaagttatctcctaagatcgatcgcgaccttcgggaaggcggacctctcttgtacgagaatatcacattcgtgtacaacagtgagcagctaaatgggacacaaagagtgcttttagataatgtcctttctgaagaacagtgtcgggaactccactctgtggcttctggaatcatgctggtgggcgatgggtacaggggaaagaccagtccacacacgccaaacgagaagttcgagggggctaccgttctgaaggcacttaaatccgggtacgaaggcagagtacccctgaaatccgccagacttttctatgacatcagtgagaaggccagacgtatcgtcgagagctactttatgctgaattccacgttatacttctcatacacgcacatggtgtgtcggacagctttgagcggtcaacaggatagaaggaacgatttatctcaccccatccatgccgacaactgcctcctggacccagaggccaacgaatgctggaaggaaccaccagcatacaccttccgggattatagcgctttgttatacatgaacgatgacttcgagggtggagagttcatctttacagaaatggacgcgaaaacagtgaccgcgagcataaaacctaagtgtggcaggatgataagtttctcctccggaggagaaaatccccacggggtaaaagctgttactaagggaaaacgatgcgccgttgcgttatggttcacgttggaccccttgtaccgcgaactggagagaattcaggccgatgaggtgatcgccatccttgaccaggagcaacaagggaaacatgagctaaatatcaacccaaaggatgagctctag

SEQ ID NO: 228240 - DNA, 2721 bp, Artificial Sequence
  Description of Artificial Sequence: Synthetic coding sequence
atgatttgtcagaagttctgtgtcgtgctcctccattgggagttcatctacgtcatcaccgccttcaatctgagctacccgattacaccttggcgattcaagctgtcgtgcatgcctcccaactcaacgtacgactactttctactgccagccggactgagcaagaatactagtaactccaacgggcattacgagaccgccgtggaacctaaatttaacagttcaggtacgcacttcagcaacctgtctaaaactacatttcactgctgtttccggtccgaacaagaccggaattgctccctttgcgcggacaatatcgagggcaagaccttcgtaagcactgtaaacagcctggtctttcaacaaattgacgccaactggaacattcagtgttggctaaagggagacctgaagctgttcatttgctacgtggaaagtctcttcaagaatctgtttcgcaattataattataaggtccacctcctgtacgttctcccagaggtgctggaagactcccccctcgtgcctcagaagggtagcttccagatggtacattgcaactgctctgtgcatgagtgttgcgaatgtctggtacctgttcctactgcaaaactgaacgacaccttactgatgtgcctgaaaatcacgtccggcggtgtcattttccagtcccccttgatgtccgtgcaacccattaatatggtcaagccagacccacctctcgggctgcacatggagattactgacgatggtaacctcaaaatctcttggtcgtcgccacccctggtcccctttccactgcagtaccaggtgaagtactctgaaaactccaccaccgttatcagggaggctgacaagatcgtaagcgccacatctttgctggtagattcaatcctgcctggatcttcttatgaggtgcaggtaagaggcaaaagacttgacggacctgggatatggtctgattggtccacacccagagtgttcactacccaggatgtgatttacttcccacctaaaatattgacttctgtgggctcaaacgtatctttccactgtatctacaaaaaagagaacaagatcgtgccttccaaggaaattgtttggtggatgaacctggctgagaagattccccaaagccagtacgatgtagtgtctgatcatgtttccaaggtcactttcttcaatttgaacgaaacaaagcctagaggtaagtttacatacgatgctgtgtattgttgtaatgagcacgaatgtcatcatagatacgcagagttgtacgtcattgacgtgaacattaatatttcttgtgagacagatggctatttgactaaaatgacctgtcgctggagcacctccacaattcagagtttagctgaatccactctgcagcttagataccatcgttcctcactgtactgttctgatattcccagcatccacccaatttcagagccaaaggactgttacctccaaagcgatggtttctatgaatgcatctttcagcctatctttctactcagcggttacacaatgtggattcgcattaatcattccttgggatctttagatagtcctcctacctgtgtgctgccagattcggtcgtgaagcccctcccaccaagtagcgtgaaagccgagataaccattaacatcggtctactgaagatatcttgggaaaaaccagtgttcccagagaacaacctgcaatttcagattcggtatggtttatcgggcaaagaggttcagtggaaaatgtatgaggtctacgacgccaaatcaaaatccgtgagcctgccagtgccagacctttgcgcagtatacgcagtccaggtgcggtgtaaacgcctagacgggctcggatattggtctaattggagcaatcccgcttataccgtcgttatggatatcaaggtgcctatgcgaggtccagaattctggagaatcatcaacggagataccatgaaaaaggagaaaaacgtgaccctcttgtggaagccgctgatgaaaaacgattcgctgtgctctgttcagcgttacgtaattaaccatcacaccagctgtaacggcacctggagtgaggatgtagggaatcacacgaagttcaccttcttgtggaccgagcaagcccacactgtgacagtgctggcgattaattccatcggagcatcagtggccaacttcaatttgacttttagttggcccatgtccaaggtgaatatagtccagtccctttctgcctacccactgaattcctcatgcgttatcgtgagctggatcctgtctccctccgattacaaactgatgtacttcattattgaatggaaaaacctgaatgaggacggagagataaagtggcttcggatttccagttcagtcaagaaatattacatccatgatcacttcattccaatcgaaaaataccagttctccctgtaccccatcttcatggagggcgtggggaagcccaagataattaattcattcacccaagatgacatcgaaaagcaccagtccgatgctgggctttacgtaatcgttcctgtgatcataagcagctctatccttcttctgggaaccttgctgattagtcaccaacggatgaagaaactgttctgggaggatgtgcctaacccgaaaaattgttcgtgggcgcagggcctgaattttcagaaaaagatgccaggaactaaggaattgctcggcggaggctggttgacctag

SEQ ID NO: 228241 - DNA, 3498 bp, Artificial Sequence
  Description of Artificial Sequence: Synthetic coding sequence
atgatctgccagaagttttgcgtcgtcctgttacactgggaatttatatacgtaataactgcatttaacctgagctaccctataacgccatggcgatttaaactcagctgcatgcctcccaactcaacctacgattactttctgctccccgcagggttgtcgaaaaatacgtccaactcaaatggtcattacgaaaccgcagtggagcctaagttcaattcatccggcactcactttagcaatttatctaaaacgacctttcattgttgcttccggagcgaacaggaccggaactgttccctatgtgctgacaatatagaaggaaagaccttcgtgagcacggttaacagccttgtgttccaacagattgatgctaattggaacatccagtgttggctgaagggggatcttaagctgtttatttgttacgttgagtccctgtttaaaaatttgttcagaaattataattataaagtccacctgctgtatgtcctgccagaggtgcttgaggacagccccttggtacctcaaaaaggtagctttcaaatggttcattgcaactgtagcgtccacgaatgctgtgaatgcctggtgccggtcccgactgctaagcttaatgataccctactcatgtgccttaaaataacttccggaggggtcatcttccagagccctctgatgtcggtccaaccgattaacatggtcaagcctgatccccctcttggactgcatatggaaattaccgatgacggcaacttaaagatctcctggtcctcaccacctctagtccccttccctctgcaataccaggtgaagtacagtgagaacagtacaacggttattcgcgaggccgataaaatcgtttctgccactagcctgctggtagatagtatcttgcctggatcctcctacgaggtgcaggttcgcggaaagcgactcgacggcccagggatctggtccgattggagcacccctcgcgtgtttacaacccaggatgtgatctactttcctccaaagatccttactagtgtaggatccaacgtgagcttccactgcatctacaagaaagagaataaaatcgtgccgtctaaagagatcgtatggtggatgaatctcgctgaaaagatccctcagagccaatacgatgtagtttcagatcacgtgtccaaggttaccttcttcaatctgaacgaaacaaaacctcgtggcaagtttacttatgacgcggtgtattgttgcaacgagcatgagtgtcaccaccgctatgctgaactgtacgttatcgatgtcaatatcaacatcagctgcgagacagacgggtacctcactaagatgacatgcaggtggagtacatcgacaatccagagcctggcggagtccacactgcaacttaggtatcaccgttccagcctctattgcagcgatatcccctctatccatcctatctccgagcctaaggattgctatttacaatcagacgggttctacgagtgcatctttcagcccatattcttgctgagcggctacaccatgtggattagaattaaccattctctgggatctcttgactcgccaccgacatgcgtgctgcctgacagtgtggtaaagccactccctcccagctctgttaaagccgaaattaccattaatatcggccttctgaagataagttgggagaagcccgtcttcccagagaacaatttacaatttcagattcgctacggactgagcggcaaggaggtgcaatggaagatgtatgaggtctacgatgctaagagcaaatctgtgtctctcccggtgccagatttgtgtgctgtttacgcagttcaggtccgatgcaagcgtcttgacggattgggttactggagcaattggagcaacccagcctacactgtagtcatggacatcaaggtaccaatgcgcggacccgaattctggcggattatcaatggtgacactatgaagaaagaaaagaacgtgaccctgctttggaaacccttaatgaaaaacgacagcctatgcagcgttcaaaggtacgtcattaaccatcacacttcttgcaacgggacctggagtgaagacgtgggcaaccacactaagttcactttcctgtggaccgagcaagcccataccgtcaccgtcctagccataaattcaattggagcctccgtggccaacttcaatctgactttttcctggccaatgtctaaggtgaacattgtgcagtctctgtccgcttaccctctgaattcaagctgcgtgattgtcagttggattctgtcccctagcgactacaagttgatgtacttcataattgaatggaagaacctcaatgaggatggggaaatcaaatggctgaggatctcttccagcgtcaaaaagtattatatccacgatcattttatcccgattgaaaagtatcaattcagcctttaccccattttcatggaaggggtcggaaagccgaagattattaatagctttacgcaggacgacattgaaaaacatcagtcagatgctggtttatatgtgatagtgcctgttattatctccagttcaatcctcctcttgggtacgctccttatttctcatcagcgcatgaaaaaacttttttgggaagacgtgcccaaccccaagaattgtagttgggcacaagggttgaatttccaaaagcctgaaacatttgaacatctgttcatcaaacacaccgcgtccgtgacttgcggtcccctgcttctcgaacctgagaccatcagcgaggacatcagtgtcgacaccagttggaagaacaaggatgagatgatgcctactaccgtcgtgagcctgctgtccaccacagatctggaaaagggcagcgtgtgtatctcagaccagttcaactctgttaactttagcgaagctgaggggactgaggttacatacgaagatgagtcgcagaggcagccatttgtcaagtacgccacactgatctctaattccaaaccttctgagaccggcgaagaacaagggctgataaacagttctgtgaccaagtgtttttcaagcaaaaacagtcccttaaaggatagcttctccaacagtagctgggagatcgaggctcaggcttttttcattctgtctgatcagcaccccaacatcatctctcctcatctcacttttagcgaaggactcgatgaacttctgaagctagaaggtaactttccagaagagaataacgacaaaaagagcatctactacctgggagtcacaagtatcaaaaagcgcgaaagcggtgtgttactgactgataaaagtagagttagttgtccgttcccagccccatgtcttttcacagacattcgtgtcttacaagactcttgtagccattttgtggagaataacattaaccttggtacgtcgtcgaagaagacctttgccagttacatgccccagtttcagacctgctccactcagacccacaagatcatggaaaataagatgtgtgacctgactgtgtag

SEQ ID NO: 228242 - DNA, 2721 bp, Artificial Sequence
  Description of Artificial Sequence: Synthetic coding sequence
atgatctgtcagaaattttgtgtggtgctcctgcactgggaattcatctatgtcatcactgctttcaatctttcttaccccatcacaccttggaggttcaaactgtcctgcatgccccctaactcaacttatgattattttctcttgcctgcgggtttgagcaaaaacacttccaattctaacgggcactacgaaactgccgttgaacccaagtttaactcctccggcacccacttttcgaacttgtccaaaacaacatttcattgctgcttccgcagcgaacaggaccgcaattgttctctttgcgcggacaatattgaaggcaaaactttcgtcagcacggtgaattccctggtatttcaacagatcgatgcaaactggaacatccagtgttggctgaagggtgacctgaaactgttcatttgctacgttgagtcgcttttcaaaaatctttttagaaattataattacaaagtccacctcctctatgtactgccagaagtgctagaggactctccccttgtgccacagaaagggtcctttcagatggtgcattgtaattgtagcgtacacgagtgttgcgagtgtttggtacccgtgccaaccgcaaagcttaatgataccctccttatgtgtcttaaaatcaccagtgggggagtgatctttcaatccccgctgatgtccgttcagcctattaacatggttaaaccagacccgccactcggcctgcatatggagatcactgacgacggcaacttgaagatatcttggagtagcccgcctctggtgccctttcccctgcagtatcaagtgaagtatagcgagaatagcaccaccgtcatccgggaggctgacaaaatagtctctgccacctcactactagtcgactctattctgccaggcagttcatacgaagtccaggtgagaggcaaacgtctagacgggccagggatctggtcagattggagcaccccgagagtcttcaccactcaggacgtcatttacttccctccaaaaattcttaccagcgtgggatccaatgtgtccttccactgtatctacaagaaggaaaataagattgtgccgtctaaagagatagtttggtggatgaatctggccgaaaaaataccccaaagccagtacgacgtagtgagcgatcatgtatcgaaggtgacattttttaatctcaacgagacaaagcccagaggcaagttcacatatgacgccgtgtactgttgcaatgaacatgaatgtcaccatagatacgctgaactgtacgtcattgatgttaatatcaacattagttgcgagaccgatggatatcttacaaagatgacatgcagatggtcaacctcaaccatccaaagcttagccgaatctaccctgcagctgcgctaccatcgaagctccctgtattgtagtgacatcccgagcattcatcccatttccgaaccaaaggattgctatttacagtcagatggattctacgagtgtatctttcagccgatttttctcctgtctggctatacaatgtggatcagaataaatcactcgcttggaagcctggattcccccccaacgtgcgtgctaccggattctgtggttaagccactaccgccatcgagcgttaaggcagagatcaccattaatatagggctgctgaaaatatcctgggagaaaccagtctttccggagaataacttacaattccagatccgctatggcttatcaggcaaggaagtgcagtggaagatgtacgaggtctacgacgccaagtcaaaatccgtcagcctccccgtccccgacctatgtgccgtttatgccgttcaagtgcgatgtaagcgcttggacggcctcggctactggagtaattggagcaatccggcttacactgtcgtaatggatataaaagtccccatgcgcggacctgagttctggaggataatcaatggcgacactatgaagaaggaaaaaaacgtgaccctgttatggaaacctcttatgaaaaatgattccctctgttccgttcagcgctacgttatcaaccatcacacctcttgtaatggcacgtggagcgaagacgtcggcaaccataccaaattcacgttcttatggaccgagcaggctcacacagtcacagttctggccatcaattccatcggggcatctgtagcaaactttaatctgacattttcctggcctatgagtaaagtgaacattgtccagagtctgtccgcttaccccctgaattcaagctgtgttatagtgagttggattctgtcacccagtgactacaagttaatgtacttcattatcgagtggaaaaaccttaacgaagacggagaaattaagtggcttcggatcagcagcagcgtgaaaaaatactacatccacgaccacttcataccaattgaaaaataccagtttagtctgtatccgatctttatggaaggagtgggcaagcccaagatcattaattccttcacccaggacgatatcgagaagcatcagagcgacgcgggtctctacgtgattgtccctgtaattatctccagtagtattctgttgttgggtactcttctgatctctcatcagcggatgaagaagctgttctgggaagatgtgcctaatccgaagaactgctcttgggcgcaaggactcaatttccagaagaaaatgcccggtacaaaggaactgctgggtgggggttggctgacttag

SEQ ID NO: 228243 - DNA, 2877 bp, Artificial Sequence
  Description of Artificial Sequence: Synthetic coding sequence
atgatctgccagaagttttgtgtcgtcctactgcattgggagtttatttacgttattactgcgtttaatttgtcctatcccatcacaccctggcggttcaagctaagttgcatgccaccaaactcaacctatgattattttttgcttccagcaggattgagcaagaacacttcaaactccaacggtcattatgagacagctgttgagccgaagttcaactcatctggcacgcattttagcaatctgtcgaaaaccacctttcactgctgtttcaggtctgagcaagatagaaattgttctctttgtgcagacaatatcgaggggaagaccttcgtaagtaccgtcaattccctggtgttccagcagatcgatgctaattggaacatccagtgttggctgaagggcgacctgaagctctttatttgctacgtggagtcccttttcaaaaatctgttcaggaattataattataaggtgcatctgctctatgtcctgccagaggtcctggaggactctccactggtgcctcagaaagggtccttccagatggtacactgtaattgctctgtgcacgagtgttgtgaatgcctggtccccgtcccaactgctaagctcaatgacacattacttatgtgtctgaagatcacatcgggaggtgtgatcttccagtcccccctgatgagcgtacagcctataaacatggtcaagcccgatccacctcttgggcttcatatggagattacagacgatggtaaccttaagatcagttggtcctcaccacccctcgtaccgttccccctgcagtatcaggtcaagtattctgaaaattccactaccgttatacgagaagctgacaaaatcgtttccgcgacatcccttttggtggactccattcttccgggatctagctatgaggtgcaggtccggggaaagagactggatggtcctggtatctggtcagactggtcgacacctagagttttcacgacgcaggatgttatatattttcccccaaagatcctgacctctgttggttccaacgtttccttccactgtatttacaagaaagaaaataagattgtcccatcgaaggagatcgtgtggtggatgaatctggccgagaagataccgcagagccagtatgacgtcgtaagtgatcacgtttctaaggtgacatttttcaacctgaacgaaactaaaccaagaggcaaatttacctacgacgccgtgtactgttgtaatgagcatgaatgtcatcatcggtatgctgagctgtacgtgatcgacgtgaacataaatatcagctgtgagacagacggctacttgaccaagatgacttgccgatggtcgacctccaccattcaatcattggccgaatctaccttgcagctcaggtatcaccgatccagtctctactgttctgatatcccctcaattcatccaatatcagaaccgaaggactgctatttgcagagtgatggcttctatgagtgcatatttcaacccatctttctcttaagcggttacaccatgtggattcgtatcaatcacagtctaggatccctggattcccctccaacctgcgtcctccccgatagtgtggtgaagccacttccgccaagtagcgtcaaagctgagattacaatcaacatcggcctcctcaaaatttcctgggaaaaacctgtttttccagaaaataacctccagtttcaaatcagatatggcctgagcggcaaggaggtgcagtggaagatgtatgaggtgtatgacgcaaagtcaaagtctgtgtctttgccggtccccgatctgtgcgccgtgtacgctgtgcaggttcggtgtaaaaggcttgatggactgggctactggagtaattggagtaaccctgcatataccgtggtgatggacataaaagtgcctatgcggggaccagaattctggagaatcattaacggcgatacaatgaaaaaggagaaaaacgtgacgctgctgtggaaacccctgatgaagaatgactccctttgctccgtccagcgctatgtcatcaaccatcacacgtcgtgtaatgggacatggtcagaggatgttggtaatcatactaaattcacctttttatggaccgagcaagcccataccgtaacagtgctagccatcaactctataggagcctcggtggctaattttaatctgacatttagttggcctatgagcaaagttaatatcgtgcaatcacttagcgcatacccactcaactcctcatgcgtaattgtgtcatggatccttagtccttcagactacaaactcatgtatttcattatagaatggaaaaacctgaacgaggatggcgagattaaatggctgcgtatatcgtcgagcgtgaagaaatactatattcacgaccatttcattcctatagaaaaatatcagttttctctctatccaatttttatggaaggagtggggaagccaaagatcatcaactcgtttacgcaagatgacattgagaaacaccagtcagacgccggtctctacgtgatcgtgcccgtcatcatttcatccagcattctcctcctgggtacactgctgatttctcaccaaaggatgaagaaactgttttgggaagacgtcccaaacccaaaaaactgcagctgggcacaggggctaaatttccagaagatgttggagggcagtatgttcgttaagtctcatcaccattccttaatctcctcaacccagggacacaaacattgcggcagaccacaggggcctctacatcggaaaacacgcgacctgtgcagtttagtttacctgcttactctcccgccattactgagctacgatcccgctaagagcccttcagttagaaatacccaagagtag

SEQ ID NO: 228244 - DNA, 2691 bp, Artificial Sequence
  Description of Artificial Sequence: Synthetic coding sequence
atgatttgtcagaagttctgtgtcgtgctgctgcattgggagtttatctatgttataactgctttcaacctctcttacccgattactccctggagattcaaactgagctgtatgcctccgaattctacctatgactacttcctacttcctgccggattgtccaaaaatacttccaattctaacggccattatgagacagcagtggagccgaagtttaactctagtggaacccacttcagcaacctgagcaaaactaccttccattgttgttttaggtcggagcaggacaggaattgctcactgtgtgcagataatatcgagggtaaaaccttcgttagcaccgtgaattccttggtcttccaacagatcgatgcaaactggaatatacagtgttggttgaaaggcgacctgaagttgtttatctgttatgtggagtccctatttaagaatctttttcgcaattacaattacaaagtgcacctgttgtatgttctgcccgaggtactggaagacagcccactggtgccacagaagggatcttttcagatggttcactgcaattgcagcgtgcatgaatgctgtgagtgcttagtgcccgtgcctaccgcaaagttgaatgatacactgttaatgtgtctcaagatcacttctggcggagtgatttttcaaagcccccttatgtccgtccagcctataaatatggtcaagccagatcctcctctgggactgcatatggaaatcaccgacgacggtaatctgaagatctcatggtcatccccaccactggtgccatttcctcttcaatatcaggtgaagtatagtgaaaactccacaaccgtgatcagagaggcagataagatcgtcagcgctacctctctgctggtggattctatccttcctggatcttcctacgaggttcaggtgcgcggaaagcggctggacggccctggtatatggtccgactggagcacaccaagggtgttcaccacacaggacgtaatttacttcccacccaaaattctcacaagcgtgggttctaatgtctcctttcactgtatctataagaaagagaacaagatcgtgccaagcaaggaaatcgtctggtggatgaacctagccgaaaagataccacaatcccagtatgacgttgtgagcgaccatgtttccaaggttacattttttaacctgaacgagactaagccacgtggaaaatttacatacgacgctgtctactgctgtaacgaacacgagtgccaccaccgatatgcagagctgtacgtgatcgacgtgaacataaacatctcttgtgagacagacgggtatttgaccaagatgacatgtcggtggtctacttccacgattcagtcactggctgagtccactctgcagctccgctaccaccgctcaagcctgtattgtagcgatatcccctctatccacccaatctctgagccaaaagactgctatttgcagtctgatggtttctacgaatgtattttccagcccattttcctcctgtcgggatatacaatgtggatacgaatcaaccacagtttgggatcactggatagtccaccaacctgtgtacttccagactccgtcgtgaaaccactgcccccatccagcgttaaagcagaaatcaccatcaacattgggctgctgaagatttcatgggagaaaccagttttccccgagaacaacctacagtttcagatccgatacggtctatcagggaaggaggtgcaatggaaaatgtatgaggtatatgacgcaaagtcaaaatctgtttcactaccagtgcccgacctgtgtgcagtctacgctgtgcaggtaagatgtaagcggttagacggcctaggctactggtctaattggagcaatccagcgtacaccgtagttatggacataaaggtgcccatgcgcggtccagaattctggcggattattaatggcgatactatgaagaaggaaaagaacgtcactctactttggaagccactgatgaaaaacgactctctgtgttctgtgcaacgctatgtcatcaatcaccacacctcctgtaatggtacctggagcgaggacgttgggaatcacacgaaatttacattcctgtggaccgagcaggcacataccgtgactgtgctggcaataaatagcatcggcgctagcgtggctaacttcaacttaacattcagctggcccatgtcaaaggtgaatatcgttcaaagcctgtccgcttatcccctgaatagcagctgtgttatcgtcagctggattctgtcgccctccgactataagctgatgtactttatcattgaatggaagaaccttaacgaggatggagaaattaaatggcttagaatctcaagttccgtgaagaaatactacatccacgatcattttattcctatcgagaaataccaattctccctgtacccaatctttatggaaggtgtcggcaagcccaagattattaactcgttcacccaggacgatattgagaagcaccagtctgacgccggtctttacgtgatagttcctgtcataatctcaagtagcatcttgctgctcgggaccttgctcatatcccaccaacgcatgaagaagttattttgggaggacgtgcccaaccccaaaaattgttcatgggctcagggactgaactttcagaagcgcacggacatcctgtag

SEQ ID NO: 228245 - DNA, 699 bp, Artificial Sequence
  Description of Artificial Sequence: Synthetic coding sequence
atgatgcctactacagttgtgtctttgttgagcactaccgaccttgaaaaaggttctgtctgtatcagtgaccaatttaacagtgtgaatttttcggaggccgaggggactgaagttacgtacgaggatgagtcacagaggcagccatttgtgaaatatgccacattgatatctaactccaagccaagcgaaactggcgaggaacaaggactgattaactcctcagtgaccaaatgtttcagtagtaaaaatagtcccttgaaggattccttttctaacagtagttgggagatcgaggcgcaggcttttttcattctgagcgatcagcaccctaacattatcagtccacatctgactttttcggaagggctggacgagctgctgaaactggaaggaaacttcccagaggaaaacaacgacaagaagtccatctactacctgggcgtcacatctatcaagaagcgggagtcaggagtgctcctgaccgataaatcaagagtctcctgccccttccctgcaccttgccttttcacggacatcagagtcctgcaggacagctgtagtcactttgtagaaaataacattaaccttggcacttcgagcaaaaagaccttcgcgtcatacatgccccagttccagacttgctcaactcaaacccacaagattatggagaacaagatgtgcgacctgacagtgtag

SEQ ID NO: 228246 - DNA, 396 bp, Artificial Sequence
  Description of Artificial Sequence: Synthetic coding sequence
atggctggggttaaggcactggtcgccctcagctttagtggagcaatcggactgaccttcctgatgctcggctgcgccttggaggactacggtgtgtactggcccctgtttgtgctgatattccacgcgatctcacctatcccacacttcattgccaagagggtgacttacgactctgacgcaacaagttcggcctgcagagagttggcatatttttttactactgggatcgtcgtatcagcttttggcttccctgtaattttggcacgggtggctgtcatcaagtggggcgcatgcggattggtcctggctggcaatgctgttatcttcttgacaatccagggttttttcctgattttcggacggggagatgactttagctgggaacagtggtag

SEQ ID NO: 228247 - DNA, 396 bp, Artificial Sequence
  Description of Artificial Sequence: Synthetic coding sequence
atggcagggatcaaggcactgattagtctgtccttcgggggtgctattgggctgatgttcctcatgctggggtgtgcccttcctatctacaacaagtattggccactgttcgtgctgttcttttatatcctttccccaatcccttattgtatcgccaggagactggtggacgataccgatgcaatgtccaacgcgtgcaaggagctcgcaatttttctcaccactggcattgtcgtgtccgctttcggcctgcctatagtgtttgctagggcgcaccttatcgaatggggggcatgcgctctggtactgaccggaaataccgtaattttcgcaaccatcctgggctttttcctggtcttcgggagtaacgacgacttctcatggcaacagtggtag

SEQ ID NO: 228248 - DNA, 510 bp, Artificial Sequence
  Description of Artificial Sequence: Synthetic coding sequence
atggctgggatcaaggccctgataagcctgagcttcgggggagcgatcgggctgatgttccttatgctgggctgcgccctgcccatttacaataaatactggccccttttcgttctcttcttctatatcctctccccgataccttactgcatcgccaggcgcctcgtagatgacactgacgctatgtctaacgcctgtaaggagttagctatctttctcaccacaggcattgttgtttccgcattcggcctgccaatagtcttcgctcgcgctcatcttatgggtagacttcctttttttagcaagatggggaccgccgaatccgaaggacgggaaaccctgacacagcaactgcctctcccagcagccgcaatgagaaggcttctgcccgcatcccgcgtaagcacccagccagtcttgcggctggcagattcagccgagtccctgctgggaaggcccgcactgtgggcgctgggtttcctcttgtgtcccccatcccaggctcagtag

SEQ ID NO: 228249 - DNA, 3195 bp, Artificial Sequence
  Description of Artificial Sequence: Synthetic coding sequence
atgatgaagttcaggttcagacgacagggcgctgatccccagagggagaaactgaaacaggagttgtttgctttcaataaaactgtggagcatggatttccaaatcagccaagcgcactggcctttgatcctgaattacgcattatggccatcggaactcggtctggagccgtgaaaatctacggcgctcctggggtggagttcacaggacttcaccgggacgctgctaccgttactcagatgcatttcctaacaggccaagggagactgttatctctcctcgatgatagcagtctgcacctttgggaaatagtccaccataacggctgtgcccaccttgaagaggctttgagttttcagctgcctagcagaccaggatttgatggagccagtgcaccgttgtctctaactcgggtgacagttgtactcttagtggccgcttctgacatagcagccctgggaacagaaggttctagtgtattctttctggacgttacaacccttacactgcttgagggtcagacactggcccctggcgaagttctaaggagcgtgcccgacgattacaggtgcggcaaagccctgggccctgttgaatcgttgcagggccatctgcgcgaccccactaaaatcctcatcgggtactctagagggctactggtcatctggaatcaggcatcccagtgtgtggaccatatatttttggggaaccagcagctggaatcactctgctggggcagagattctagtaccgtcgtgagcagccatagtgacggctcatacgctgtgtggagcgttgacgctggttcattcccaacactgcagccgaccgtggccaccaccccctacggcccattcccatgtaaagccattaacaagattctttggaggaattgtgaatctggtggtcacttcataatcttctcagggggaatgcctcgcgcatcctacggggacagacattgtgttagcgtgctgcgtgcggaaaccttggtcaccctggattttaccagcagaattattgactttttcacagtccactcgactcgcccagaagatgagttcgatgaccctcaggctctggcagtccttctggaagaggaactggtcgtcctggatctgcaaactcccggttggcctgccgttcctgcaccttatctcgctccattgcactccagcgccattacatgttcagcgcatgtcgcaagtgtcccagccaagctctgggcacgtattgtttccgccggtgagcaacagagccctcaaccagttagcagcgccctgagttggcctattaccgggggtcgcaatttagctcaggagccctctcaaagaggtctgctcctgaccggtcacgaggacggaactgttcggttctgggacgcttctggggtggccctgcgcccactctataaattgtctactgcaggattgttccaaactgattgtgagcacgcagactctctcgctcaggccgctgaggacgattggcccccttttcggaaggtgggatgtttcgacccatactccgacgatccccgattaggtgtgcagaaggtggcactgtgcaaatacaccgctcagatggttgtggctgggaccgctggccaggtgctggtgttagaactcagcgatgtgcccgtggaacaggccgtgagtgttgcaataattgacctcctgcaggacagagaaggcttcacttggaaaggtcacgaaagactgtccccgcgaaccggaccactgccctggcctgccggatttcagccacgcgtattagtccagtgtctgccacctgctgccgtgactgcggtgactctccataccgaatggagcctggtggcgttcggaacatctcacggtttcggcctgtttgactaccagcgcaaaagcccggtactggccaggtgcaccttacatcctaacgacagccttgccatggaagggccactaagtcgcgttaagtctctcaaaaagtcactgcgccagagctttaggcgaatccgaaaatcccgggtctccggcaaaaagcgcgcagcgaacgcttcctctaagttacaggaggcaaatgcccagctggccgagcaggcctgccctcatgacgtggaaatgacaccagtgcaaaggagaattgagcctcgctcagctgatgatagtctgagtggtgtcgttagatgcctgtattttgccgacacgttcctcagggacggcgctcaccatggcccaacaatgtgggccggaactaattctggcagcgttttcgcctacgctttggaggtgcccgcagcagccgtcggcggtgagaaaagacctgaacaggccgtggaagccgttttgggcaaggaagtgcagctgatgcacagggcaccggtcgtggccatcgcggtattagatggacggggaaggcccttgcctgaaccttacgaggctagccgggatctggcccaggctcccgacatgcaagggggtcatgcggtcttgattgccagcgaggagcagttcaaagtgtttactctgcctaaagtctctgccaagaccaaatttaagctgactgctcacgagggctgtcgagtccgcaaagttgccctggctacgtttgcctcggtggcctgcgaagattacgctgagacctgtctagcgtgtcttactaatctgggcgacgtccatgttttctcagtgcccggactccgcccacaggttcactattcctgtatcaggaaagaggacatatcaggcatcgccagttgtgttttcaccagacacgggcagggtttctatttgatatccccttcagaattcgaaaggttttcgctttctgctagaaatattaccgagcccttgtgcagcctcgacatcaattggccacgagatgccacccaagcttcttaccgaattcgtgaaagccccaagctgtcccaggcaaatggtaccccaagcatcctgctggctcctcaatcactggatggatcaccagatccagcccattcaatgggcccagacacccccgagcctcccgaggcagcattgtctcctatgtcgatcgacagcgcaacctccgccgacacaaccctggatacaactggcgacgtcacggtagaggacgtaaaggatttcctcggatcttctgaagaaagcgagaaaaatctgcgcaacctggcggaggacgaggcccatgcttgcgcaattctcatcaagtag

SEQ ID NO: 228250 - DNA, 1056 bp, Artificial Sequence
  Description of Artificial Sequence: Synthetic coding sequence
gaactgccctcagccgcaccagacagcaccttactactgaccgcccagcactgggtcgcaaacctgttcatccttgcaaccctgattggttggaccgtgcgatcattcttcctgggccgaatggagacgtgttgcagccatcttggtctccgatcaggacggaggtttgccgtgtcaattgggtattggcacgatccttatattcaacattttgttaggctcagtaaagagcggaaagcgccagaaattaatagagggtacttcgcacgggtacatggcgttagccagttgataaaggcatttctgcgtaaaaccgaatgtcactgtcagatagtgaacttgggcgcaggcatggacaccacgttctggcggcttaaggatgaggacctcctcccctccaagtacttcgaggtggattttccgatgatagtcaccagaaagctgcactctatcaaatgtaagccgccactgtcctctcccatcctggaactccactccgaagacactctgcagatggatggacacatactcgactctaaacggtacgcagtgataggagcagacttacgagacctgagcgagttggaggaaaaattgaaaaaatgcaatatgaacacacagcttcccaccctgctgatcgccgagtgcgtgttggtttatatgacaccggagcagtcagccaacttgcttaagtgggccgctaatagctttgaaagagcaatgtttatcaattatgagcaggttaacatgggggacagatttggtcagatcatgatcgaaaatctgagacggcgtcagtgcgatcttgcaggagttgagacatgtaaatcattggagtcgcagaaggagaggcttctctcaaacgggtgggagacggcatcggccgttgatatgatggaattatacaatagactgccaagggctgaagttagtcggattgagtcactagagtttctcgatgagatggaactgctggaacagctcatgcgccactattgtttatgttgggcaaccaaaggagggaatgagctgggactcaaagaaatcacgtactag

SEQ ID NO: 228251 - DNA, 840 bp, Artificial Sequence
  Description of Artificial Sequence: Synthetic coding sequence
atggccacgaggcagagagagtcttccataacgagctgttgcagtacgtcttcttgtgacgccgatgacgagggcgtgagggggacatgcgaggacgcttccctatgtaaacgttttgccgtgagtatcgggtattggcacgacccctacatccagcatttcgtgcggctgtcgaaggagagaaaggccccagaaatcaaccgcggatacttcgcaagggtacatggcgtctcacagctaataaaagcattcctacgcaaaacagagtgccattgccagatcgtgaacctcggggcaggaatggatactactttttggagactaaaagacgaagacctcctgccgtccaaatatttcgaagtcgatttccctatgatcgtgacccggaagctgcatagcattaagctgccaacccttcttattgccgaatgtgtcctggtgtacatgactcccgaacagtctgctaatctgttgaagtgggctgcaaactcattcgaaagggccatgttcattaactacgagcaggtgaacatgggcgaccggttcggccagattatgatcgaaaacctccgccgaagacaatgtgacctggctggcgtcgaaacctgtaaaagccttgagtcgcaaaaagaacggttgttgtccaatggatgggaaacagcctctgctgttgatatgatggaattgtacaaccgcctgccgagagctgaagtcagcagaattgagtccttggaattcctggatgagatggagctcctcgaacaactcatgcgacattactgcctttgctgggcgacaaagggtgggaatgaactaggtcttaaggagatcacgtactag

SEQ ID NO: 228252 - DNA, 1005 bp, Artificial Sequence
  Description of Artificial Sequence: Synthetic coding sequence
atggctacccggcagcgagagagcagtatcacctcttgttgctctacttccagttgcgacgccgatgatgaaggggttcggggtacctgcgaagacgcctccctctgtaagcggtttgccgtatctatcgggtactggcatgatccatatatacagcactttgtgcggctgagcaaggagcggaaagctcccgagattaaccgaggatactttgccagggtccacggagttagccagctgatcaaggctttcctgaggaaaaccgaatgccactgccagatcgtcaatctcggtgccggaatggacaccacattctggaggctcaaagacgaggacctgctccccagcaagtactttgaggtggattttccgatgatcgtcacacgcaaactgcactcaattaaatgtaagcccccactcagttctccaattctggagttgcattcagaagatacactccagatggacggtcatattctggactctaaaaggtacgccgtgatcggcgcagacctgcgcgatctctctgagttggaagaaaaactcaaaaagtgcaatatgaatacgcagcttccgacgctcctgatcgccgagtgcgtgttggtctacatgacaccagagcagtcagcaaacttactgaagtgggcggctaatagcttcgagagagcaatgttcattaactatgagcaggtgaacatgggcgatcggttcggccagatcatgattgaaaacctccggagacgccagtgtgatctcgccggagtggagacctgcaaatcgctggagagccagaaagaaaggcttctgagcaacggatgggagaccgcgtccgcagtggatatgatggagctctacaatcgtttgcctagggcggaagttagccgcattgagtctctagagttcttggacgagatggagctgttagaacaactcatgcgccactactgtctgtgttgggcaactaaagggggtaatgagctcggccttaaagaaatcacttactag

SEQ ID NO: 228253 - DNA, 2415 bp, Artificial Sequence
  Description of Artificial Sequence: Synthetic coding sequence
atggcagtgagggcgctgaagctcctgacaactctgctggccgtggtggccgcagcgtcgcaggctgaagttgagagcgaagcgggttggggcatggtgacacctgacctgctgttcgccgagggtacggcggcatacgcacgcggagattggccaggcgtagtgctgagcatggaaagggcccttaggtcccgcgctgcactgcgggcactgcgactgcggtgccggacgcagtgtgcagctgactttccttgggagttggacccagattggtcgccctctcccgcacaggcctctggcgcagccgcattacgtgacctgtccttctttgggggtcttctccgcagagcagcctgtctcagaagatgcctgggcccacctgcagctcattcactcagcgaagagatggagctggaatttagaaagagaagtccctacaactacttgcaggttgcctactttaaaatcaacaaacttgagaaagccgtggctgcggcacacaccttctttgtggggaatcctgaacatatggagatgcagcagaatctcgactattatcaaaccatgtctggagttaaggaagccgattttaaagacttagaaacacagccacacatgcaggagttccggctgggcgttcggctatatagcgaggagcagccccaggaggccgtcccacatctggaggccgctttgcaggagtacttcgtggcctacgaagagtgccgggcactctgcgagggtccctacgattacgatggctacaactatctagaatacaatgcagacctctttcaagccattacagaccactacatccaggttctgaactgcaaacagaattgcgtgaccgagctggcatcccacccatcccgcgagaaacctttcgaggacttccttccctcacactacaattaccttcagttcgcctattacaatatcgggaattacactcaggctgtggaatgcgcgaaaacgtatctcctctttttcccgaacgatgaggtgatgaatcaaaatctagcttattatgccgctatgctcggggaggaacacaccaggagtattggtcctcgcgagtcagccaaagaatacaggcagaggtccctgctggagaaggagcttttgtttttcgcatatgacgtgtttggaatcccgttcgtcgatccagacagttggacacccgaggaagttatcccaaagcgattacaggaaaaacagaaatccgagcgcgaaacagccgtccgaatatctcaggagataggaaacttgatgaaagagattgaaactttggtcgaagagaaaacgaaagaatctctcgacgtcagcagactgaccagagaaggcggtcctttattatacgagggaatctctctcacaatgaacagcaaactgcttaatggatcccagcgggtggtgatggatggggtcatctccgatcacgaatgtcaagagctgcagagactgaccaacgtagccgctacctcgggcgatggctatcgaggccaaacatctccgcacacaccaaatgaaaagttctatggagtgaccgtgttcaaggccctgaaattagggcaggaggggaaggtgcccttacagagtgcccacctgtactacaatgtgacagaaaaagtcaggaggataatggaatcctactttagactggacacccccctgtatttctcatacagccacctagtgtgcagaactgctatcgaggaagtgcaggcagagaggaaagacgattcccaccccgttcacgtggataactgtattctgaacgctgagaccctggtctgtgttaaggaacctcctgcctatacatttcgagactatagcgctattctgtaccttaatggggatttcgacgggggtaatttttatttcacagaactggacgctaaaactgttacagccgaggtgcagccccagtgcgggagagctgtgggcttctcaagcggcacagagaatcctcatggtgtaaaagcagttactcgcggtcagagatgtgctatagcattatggtttaccctggacccacgacactccgaaagggtgagagctgccagagccggagaatcatcctggtgctgcggcgaccccttccctgagcgcccatggttcgcgttcctcttccctaaaagccattgtcagtggctgaggcatgaacggtccacttgggacactagcagcaacgctctatcactgtggagccattgcctggtcctgcccggaccagccgtcaatggaattcaggtggggaaagaggtcaagactgggagtgatgccgagttcttagttccgtccttgggaccgacatccgccgtgctttttcaaagagtggggccagcaggaaaagagatgagcctaggaccattacgaaacctgccgtgccccctaggctcctcctcctag

SEQ ID NO: 228254 - DNA, 2211 bp, Artificial Sequence
  Description of Artificial Sequence: Synthetic coding sequence
atggctgtgagggccctcaagcttctaaccactttgctagccgtggttgcagctgcctcccaggccgaagtggagtcagaagccggatggggcatggttacacccgatctgctgtttgccgaggggacagcagcttatgcccgtggagactggcctggggtggtgttgtccatggagcgcgcactgcgctctcgggcagccctgcgcgctcttaggctgagatgcaggacccaatgcgccgctgattttccatgggagttggatccggactggagtccttcgcctgctcaggcatcaggtgctgcagctctgagagacctgtcctttttcggaggcctgctccggagggcagcgtgcctgaggagatgcctgggcccacctgccgcacatagtttatcagaggaaatggagctcgagttccgtaagcgatctccatataattacctgcaggtggcttacttcaaaatcaataaactggagaaagctgttgctgcagcacataccttttttgtggggaatccagaacacatggagatgcagcagaacctggactattaccagaccatgagcggtgttaaagaggctgactttaaggatctggaaacacaaccgcacatgcaggagttccggctcggggtgcggctctactctgaggaacagcctcaggaggcagttcctcacctcgaagctgccctccaggagtatttcgtagcatacgaggaatgcagggccctgtgcgaggggccttacgattatgatggctacaactatttagagtataacgccgacctgttccaagctatcacggatcattatatccaggtgctaaattgtaaacagaattgtgtgaccgagctggcttcccatccttctagagagaaaccatttgaagatttcctcccaagtcattataactacctgcagttcgcttattataacatcggcaattacactcaggcagttgagtgtgccaaaacatatcttctgttctttcccaacgacgaagtcatgaaccaaaacctggcctattacgccgctatgctgggagaggaacatacacggtccatcgggccacgggagtcagcaaaggagtacaggcagcgctcgcttctggaaaaagaactactcttttttgcttatgacgtgtttgggattccctttgtcgatcctgactcttggactcccgaggaagtcatacctaagcggctgcaagagaaacagaaatctgaaagagagactgctgtgcgcatctctcaggagatcgggaacctcatgaaggagatcgaaaccctagtggaggaaaaaaccaaggaaagtctggacgtcagccgcctgacgcgagaagggggacccctactgtatgaaggcatctccctcaccatgaattctaagttgctgaacggaagtcagcgtgttgtcatggacggtgtgatttctgaccatgagtgtcaggagctgcagcgcctcaccaacgtggccgcaaccagtggcgatgggtatcggggacagacttcacctcatactccaaacgagaagttctacggggtcacagtgttcaaggcactgaaactcggacaagaggggaaggtgcccctgcagtcagcgcacctgtactataacgtaacggagaaggtgaggaggatcatggagagctacttccggctcgacacccctctctacttttcatacagccatcttgtttgtcgtaccgctattgaagaagtgcaggcagaaagaaaggacgacagccatcccgtgcacgtggataactgcatactgaatgcggagaccttggtgtgtgtgaaggaacctccagcctatacatttagagactacagtgcgatcctctatctcaacggagactttgacggaggcaatttttattttaccgagctggatgcaaagactgtcacggccgaggtgcagccacagtgtggacgcgcagtcggattttcctccggaaccgagaatccacatggggtaaaggctgtgacaagagggcagagatgcgccattgcactctggtttaccctggacccaaggcatagtgagcgcgatcgagtgcaggcagatgatttggtgaagatgctgttcagcccagaggagatggatctgagccaagaacaacctctggacgcccagcaaggcccaccagaacccgcacaggaatcactctctgggtccgagtctaagcccaaggatgaactctag

SEQ ID NO: 228255 - DNA, 2094 bp, Artificial Sequence
  Description of Artificial Sequence: Synthetic coding sequence
atggcagttagagctctgaagctactgaccaccctgcttgctgtggttgccgctgcatcccaggcggaagttgagtctgaggcagggtggggcatggtcacacccgatctcctgttcgccgagggaacagccgcatatgcgaggggagattggcctggggttgtcctgagcatggagagagcgctgagatcacgcgcagcgctgagagctttacgtctgcgatgccgcactcagtgtgcagcagacttcccatgggagctggatccagattggagtccatctcctgcacaagcctccggggctgctgcgctacgcgacttatctttcttcgggggacttctccgacgggctgcttgtcttagaagatgcctgggtcctcctgccgctcacagtctctcagaggaaatggaattggaattccggaagaggtccccctacaattacctccaggtggcgtattttaagatcaacaaattggaaaaggcagtcgccgcagcccacactttttttgtgggaaatcccgaacacatggagatgcaacagaacttggactattatcagaccatgtctggagttaaggaggctgatttcaaggacctggagacccaacctcatatgcaggagttcagactgggcgttagactctactcagaggagcagccacaggaggcggtcccccatctcgaggccgcactgcaggagtatttcgtcgcatatgaagagtgccgcgcattgtgtgaggggccatacgattatgacgggtataattacttggagtataacgctgacctgttccaggccatcacagaccactacattcaagtcttaaattgcaaacagaactgtgtaaccgaacttgcttcccacccttctcgtgagaagcccttcgaagattttctcccgagccattataactacctgcagttcgcctactacaacatcggcaactacactcaggctgttgagtgcgcaaaaacttaccttttgttctttccaaatgacgaagtaatgaatcagaatcttgcatactatgcggctatgctcggcgaggagcacacaaggagcattgggcctagagagtccgctaaggagtatcgtcagcgatcactgctggagaaagagcttcttttttttgcttacgacgtgttcggcattcccttcgtagatcctgattcttggactcccgaggaagtgatccccaaaagacttcaggaaaaacagaaatcagagcgtgagacagcggtgcggataagccaggagataggcaatctgatgaaagagattgaaaccttggtcgaggagaaaaccaaagagtctctggatgtgtccagactgaccagagaaggtggtccgctcttatacgaagggatcagccttactatgaactctaaactgctgaacggatcacagagagtcgttatggatggagtgattagcgaccacgagtgccaagaacttcagcgcctcactaacgttgccgcaactagcggagatggataccggggacagacatcgcctcatacacccaatgagaagttttatggggtgaccgtctttaaggcactcaagctgggtcaagagggtaaagtccctttacagtcagcacatctttattacaacgtgactgagaaggtcaggcggattatggaatcctacttccgcctggacacaccgctctacttctcctattcccatctggtctgtcgcaccgccattgaggaagtgcaggctgaacgcaaggacgacagtcatcccgtgcacgtcgataactgcattctgaacgctgagacactcgtgtgcgtaaaggaacctcccgcttacactttccgggactatagcgcaatactgtatcttaacggagactttgacggaggcaacttctattttactgaactggatgcaaagactgtaactgcagaagtgcagccgcagtgcggccgtgcagtagggttctcgtctggcacggagaacccgcacggagtcaaggcggttacaagaggacagcgctgtgcaatcgctctatggttcactctggacccaaggcattccgaaagggtccgcgcagctcgggctggtcagggagcaggcaggtag

SEQ ID NO: 228256 - DNA, 459 bp, Artificial Sequence
  Description of Artificial Sequence: Synthetic coding sequence
tgagaaagggagactgccgttcggattagtcaggaaatcgggaatttgatgaaagaaatcgaaactctggtagaggaaaaaacaaaggagtctttagatgttagcaggcttaccagggaggggggaccgctgctgtatgagggcatctctctgaccatgaatagcaagctcctaaacggctcacagcgcgttgtcatggacggggtcatctctgaccacgaatgccaggagctgcagcgactgaccaatgtggcagcaaccagcggggacggatatcgcggtcagacatctccccacacacctaacgagaagttttatggcgtgactgtgttcaaggctttaaaaagaggcgtcgtgctagtgcgctttcacacagcggataaagacgtccccgagaccggccaattcactaaggaacgaggtttgctcggtcttacagtgccgtgcggctgggggtag

SEQ ID NO: 228257 - DNA, 1806 bp, Artificial Sequence
  Description of Artificial Sequence: Synthetic coding sequence
atggagttggaattccgaaaaagatcgccatacaactatctgcaagtcgcttacttcaaaatcaacaagctcgagaaggccgtggccgctgcgcataccttcttcgtcggcaaccccgaacacatggaaatgcaacagaacctggactactatcagacaatgtctggcgttaaggaggctgactttaaggatctggaaacacagccacatatgcaggaattccgcctcggtgtgaggctgtacagcgaggagcagccccaggaggccgttccgcacctcgaagctgcgctgcaggagtattttgtcgcttatgaggagtgccgggctctatgtgaaggcccttatgattatgacggctataactacctcgagtacaatgccgacctgtttcaggctatcaccgatcattatatccaagtgctaaactgtaagcagaattgtgtaaccgaattggcgtctcacccttcgcgcgagaaaccatttgaagattttctgccatcacactacaactatctccagtttgcatactataatataggcaactatacccaggccgtagaatgcgccaaaacgtatttactgttctttcccaatgacgaagtgatgaaccaaaatctggcttactacgctgcaatgctcggagaggagcacacccgtagcataggccctagagaatctgccaaggagtatcggcagagatctttgctcgaaaaggagctgctgttcttcgcctacgacgtttttgggattccgtttgttgatccggattcttggacaccggaggaagtgatcccaaaaagattacaggaaaagcagaagtccgagagggaaactgcggtgcggatcagtcaggaaattggtaacctgatgaaggaaatcgagaccctggtcgaggaaaagaccaaggaaagcttggatgtatctaggctgacccgggaggggggaccactcctttatgagggcatctccctcacaatgaattccaagctcctcaacggatcgcagagagtggtaatggatggcgtcattagcgatcacgaatgccaggagttgcagcgcctgacaaacgtggccgctaccagcggcgatggataccgcggacagaccagtcctcacacaccaaatgaaaaattctatggcgtcaccgtctttaaagctctgaagctgggccaagaaggcaaagtccccctccagtccgcccatctttattataatgtgacagaaaaggtccgacgcatcatggagtcgtactttaggctggacaccccactttatttctcatattcacacctcgtctgtaggaccgcaatcgaggaggtacaagcggaaagaaaggacgatagtcatcccgtgcatgtggataactgtatcttaaatgccgagacactcgtgtgtgtcaaagaacctccggcatatactttccgagattattcagccatcttatacctcaacggggattttgacgggggaaatttctactttaccgaactggatgctaaaacggttactgcggaggtgcagccccagtgcggaagagctgtggggtttagtagtgggacagaaaacccccacggcgtgaaagccgtgacacggggacaacggtgcgccattgctttatggtttaccctggatccacgacattcagaacgggatcgggttcaggctgacgacttagtgaagatgctcttcagcccagaggaaatggacttgtcacaagagcaacccctggacgcccaacagggccctcccgagccagcacaggagtcactaagcggctcagaatcaaaacccaaggacgagctatag

SEQ ID NO: 228258 - DNA, 2355 bp, Artificial Sequence
  Description of Artificial Sequence: Synthetic coding sequence
atgacgtcgccagccgcagcccagtccagagagatcgattgtctgtctcccgaagcccagaaactggctgaagctagactggcggcaaagagagccgcaagggccgaagcgagggaaatcaggatgaaagagctggagaggcaacagaaggaggaagactccgagagatactcaaggcgaagtcggcgaaatacatctgcctcagatgaggacgagcgaatgagcgtcgggtctcggggttcgctccgcgtcgaagagcgtccagagaaagattttaccgaaaaggggagcagaaatatgccaggcctgtcagctgccacactagcctctctggggggaacaagctctcgacgcggtagcggggatacttccatcagtattgacactgaagcttccatcagagagattaaggacagcctcgctgaagtggaggaaaaatacaaaaaggctatggtgagtaacgcccagctagacaatgaaaaaactaactttatgtaccaagtggacacattaaaggacatgctcctggaactggaggagcagctggccgagtctcgcaggcagtacgaggagaaaaataaagagtttgagcgggaaaaacatgcacatagtatattgcagtttcagttcgctgaagtcaaggaagcactcaaacaacgggaggaaatgctggaaaagcacgggatcatactcaatagtgagattgctacaaatggggagacaagcgacacactgaacaatgtcggttaccagggacccactaagatgacaaaggaagagctcaacgctctgaaatctactggagacggcacactgggacgcgcttctgaggtggaggtgaaaaacgagattgttgctaatgtggggaagagagagattctgcataatacagagaaggaacagcacactgaggacacggtcaaagattgcgtggacattgaagtgttccccgctggggagaatacagaggaccaaaaatccagtgaggacacggctccctttctcgggacactggccggtgccacttacgaagagcaggtacagtctcagatcctggagagctctagcctaccagagaatacagtccaggtggagtcaaacgaggtgatgggggcacctgacgacagaactcgaacgccccttgaaccgtcgaattgctggtccgatctggacggcggaaatcataccgagaacgtaggggaggcagctgtgactcaagtggaggagcaggccggaactgtagccagctgccccctgggacactctgatgacaccgtgtatcacgacgacaagtgcatggtcgaagttccccaagagctggaaacgtcaaccggccacagcctggaaaaagaatttaccaaccaagaagccgctgagcccaaggaggtgccagctcacagcacagaggtgggccgtgaccacaacgaggaggaaggagaagaaacaggattgagagatgagaaacctataaagaccgaggtgcccggatcacccgcagggactgaaggcaactgccaggaggccaccggcccttcaaccgtggacacccagaacgagcccttggacatgaaagagcctgatgaggagaagagcgaccaacagggtgaagccctcgattcctcccagaaaaaaaccaagaacaaaaagaagaaaaacaagaagaaaaaatccccagtgcctgtggagactctgaaggacgtgaaaaaagaactaacatatcaaaacacagatctgagcgagatcaaagaggaggagcaggttaaaagcaccgacagaaagtcagcagtggaggcacagaacgaggtgacggaaaaccccaaacagaaaatcgcagccgaaagcagcgaaaatgttgactgtccagagaacccgaagataaaattggatggcaagttggaccaggagggagatgatgtgcagaccgccgcagaagaggtgcttgcggatggcgatacactggacttcgaagacgacacggtgcaaagtagcgggccacgggcaggcggagaagaactcgacgagggggtggccaaggacaatgctaaaatcgatggtgctacacagtcgagtccagccgagcctaaaagcgaggacgccgaccgctgcacactgcccgaacacgaaagcccatcacaggatatcagcgacgcctgtgaggccgagtcaaccgagaggtgcgagatgtccgaacacccgagccaaaccgtaaggaaggcactagactccaacagcttggaaaacgatgatctgtccgcccctggtcgtgagcccggacatttcaatcccgagagccgagaagacacgagagggggtaacgagaagggaaagtcaaaggaggattgtaccatgtcatag

SEQ ID NO: 228259 - DNA, 2259 bp, Artificial Sequence
  Description of Artificial Sequence: Synthetic coding sequence
atgacaagtcccgcagccgcacagtccagggaaatcgactgcctgagcccggaagcccagaagcttgccgaggctagactggctgcaaagcgggcagcacgtgcagaggctcgcgaaattaggatgaaggagctcgagcgccagcagaaggaagtggaggaaaggccagagaaagattttactgagaaaggttctaggaatatgcctggcctctccgcagcaactctcgccagcctaggcggaacctcctccagaaggggatccggcgacacaagtatatcaattgatacagaagctagcatccgcgagatcaaagactccctggctgaagttgaagagaaatataaaaaagcgatggtgtcaaacgctcaactggacaacgaaaagactaactttatgtaccaagtggacacattaaaggatatgctgctggagctggaagaacagctagccgaatctagaaggcagtacgaggaaaagaacaaagaattcgagcgggagaagcacgcccatagtattctgcagtttcagttcgccgaagtgaaagaggcccttaagcagagagaggaaatgctggaaaaacatggcattattttaaacagcgagattgccactaacggggaaacatcggacacgttaaataacgtgggctaccagggtccaaccaagatgacaaaggaagaactgaacgcactgaagtcaactggagatggcaccttgggacgcgcaagcgaggttgaggtgaagaacgagattgtggcgaacgtagggaaaagggagatcttacataataccgagaaggagcagcacacagaggacacagtcaaagactgcgttgatattgaggtgttcccagctggagaaaatactgaagatcagaaaagttctgaggacaccgccccttttctcggcacccttgctggcgctacttatgaggaacaagtgcaatcacagattcttgagagctctagtttgcccgaaaataccgtacaggtcgagtccaatgaggtgatgggcgctcccgacgaccgaacacgaacaccgcttgaaccttctaattgctggagcgacctcgacgggggtaaccacacagagaatgtgggcgaggctgccgttacgcaggtggaggagcaggccggaaccgtggcgtcctgtccactggggcactctgacgataccgtgtaccacgatgacaagtgtatggtagaagtaccacaggagctcgagacctctacagggcacagtctggagaaggaatttacgaatcaggaagcggctgagcccaaggaggtgccagctcacagcacagaggtcgggagagaccataacgaggaggaaggggaggagactggcctacgtgacgagaaacctattaaaaccgaagtacccggaagccctgcaggcactgaaggcaactgtcaagaagccaccggacccagtactgtcgacacccagaacgagcctctcgacatgaaagaacctgatgaggaaaagagtgaccagcagggggaagcactggactcaagccagaagaagacgaaaaacaaaaaaaagaaaaataagaaaaagaagagccccgtccctgtcgaaactctgaaggacgttaagaaggagttgacctaccaaaatacggacctgtccgagatcaaagaggaggaacaggtcaaaagtaccgacagaaagagcgccgtggaggcgcaaaacgaagtcactgagaaccccaagcagaagatagccgctgaatcatctgaaaatgtcgattgcccagagaatccgaagatcaaacttgacgggaaactcgaccaagagggggatgacgtccagactgccgctgaggaggtgttggccgacggggataccctcgacttcgaggatgacaccgtgcagtcctccggacctagggcgggtggggaggagcttgacgaaggcgtggcgaaagacaatgccaaaattgacggagccactcagagcagtcccgcagaacccaaatctgaggatgcagaccgctgtacactgcccgagcatgagagtccctcccaggatatcagcgatgcatgtgaggcggaatcaacagagcggtgtgaaatgagcgagcacccgtcacaaaccgtaagaaaggcattagattcaaattctttggagaacgacgatttatcggctcctgggagggaaccaggccattttaacccagaatccagagaggacactcgtggagggaatgagaagggcaagagtaaagaggactgcacgatgagctag

SEQ ID NO: 228260 - DNA, 1893 bp, Artificial Sequence
  Description of Artificial Sequence: Synthetic coding sequence
atgacctcccctgcagcagcacagtctcgggaaattgactgtctgagccccgaggctcagaaacttgctgaagctaggcttgcagctaagcgagccgcacgcgcagaggctagagagattagaatgaaagagctagaacggcagcagaaggaggtgaccagtgcgcaagagaagtactacggcctagacacaaaatggggcgatattgaacagtggatggaggatagcgagcgatattccaggaggagtaggcggaacaccagtgcaagcgatgaagacgagagaatgagcgtcggctcaagggggagcctgcgcagtcaacccgacttggagtatggtggcccttacgcatggaccaacggatatgacggcgagctgtacggcagccagagtctaaatcgcagaagcggcagacctagttgtctctactctgccgcacgtccctccggaagctaccgggcttccgtgctggatgagggctccttcgggggtacccgcagaggatccacatctgggtcacgtgctccttccgaatactccggccacttgaactctagctcgagggcaagttcgagagcatcaagcgccagagcctcccccgtcgtagaagaacgtcccgaaaaggactttactgaaaaaggctccaggaatatgccaggcctgagcgctgccactttggcctccctcggaggcacctcgtccagaagagggtctggcgacacctccatttctatcgacacagaagcaagcattagggaaataaaggagctgaatgaactgaaagatcaaatccaagacgtcgagggcaagtacatgcagggacttaaggaaatgaaagattctcttgctgaggtggaagagaaatataaaaaagctatggtctctaacgcccagctggacaacgagaagaccaactttatgtaccaagtggacacactgaaggatatgttgctggaactagaggagcaactcgccgagagtcgcaggcaatacgaggaaaaaaataaagagttcgagcgtgagaagcatgctcacagcattctccaattccagtttgctgaggtgaaagaggcacttaagcagagggaggaaatgctggaagagatccgtcagttgcagcagaaacaagcgagtagtattagagagatatccgatctgcaggagaccatcgaatggaaggacaaaaaaatcggtgcactggagcgccagaaagagtttttcgatagtgtgaggtccgagcgcgacgacttgagggaagaggtagttatgctgaaggaggagctcaaaaagcatgggataattctcaactcagagatcgccaccaacggagagacaagtgacaccctgaacaatgtaggataccaaggccctaccaagatgaccaaggaggagttaaacgctctgaaatccacaggggatggcacacttgacattcggctgaagaagctggtagatgagagagagtgcttactagaacagattaagaaactcaaagggcaactggaggagcgccaaaaaataggaaaacttgacaacctaaggtctgaggatgacgtcctcgagaacggtacagacatgcacgtcatggatctgcagagagacgccaaccggcagatctcagatctgaaatttaaactggctaagtccgaacaggagataactgcattggaacagaatgtcattcgcctcgagtcccaggtttcgcgatataaaagcgcggcagagaacgctgagaagattgaggacgagcttaaagcagagaagaggaagcttcagcgcgagctgaggagcgctttagataaaactgaggaactggaggtctcaaacgggcaccttgtgaagcgtctggagaaaatgaaagcaaatcgctcggctttactttcccaacagtag

SEQ ID NO: 228261 - DNA, 2427 bp, Artificial Sequence
  Description of Artificial Sequence: Synthetic coding sequence
atgacctcaccagccgctgctcagtcacgagagatcgattgtctttcccccgaggctcagaagctcgctgaagcacggctcgccgctaagcgtgcagccagggctgaggcgcgagagattcgcatgaaggagctggagcgccaacaaaaagaagaggactccgagagatactctaggcgttctcgcaggaacacaagcgcatctgatgaggatgaacggatgagcgtgggctccagagggtccttacgcgtcgaggagagacctgaaaaggactttactgagaaaggatcaagaaacatgccaggcctgtctgcagctactcttgctagtcttgggggaaccagtagccgcaggggcagtggggacacctctatttcaatagacaccgaggccagcattagggaaatcaaagagctgaacgagctcaaggaccagattcaggacgtggaaggaaaatacatgcagggcttaaaagaaatgaaagattccttagcggaggtcgaagagaaatataagaaggcaatggtgagcaacgcacagctggacaacgagaagactaatttcatgtaccaggtggacacacttaaggacatgcttttggaactggaagagcagttagcagaatcgcgtaggcagtacgaagagaaaaataaggaattcgagagagaaaagcatgcccactccatcctgcagtttcagtttgccgaggtcaaggaggccctgaaacagcgtgaggagatgctcgaaaaacacggcatcatcctaaactcagaaatagccactaatggagagacatcagatactttgaataacgtgggttaccaaggccctacaaagatgactaaggaggaactaaacgcgctcaaaagcaccggcgatggaactctggggagagccagtgaggtggaggtcaagaacgagatcgtggcaaacgtagggaagagggagatactccacaacacagaaaaggagcagcacaccgaagataccgtgaaggactgtgttgatatagaggtttttcctgctggagaaaatacagaagatcagaagtcaagcgaggacactgccccttttttaggtacgctggccggagccacttacgaggagcaggtccagagccagattttggagtcctcctcactgcccgaaaacactgtccaggttgaatctaatgaagttatgggagcccctgacgataggacaaggactcctcttgagccatccaattgttggtccgacctggacggagggaatcataccgagaatgtgggcgaggctgctgtgactcaagtggaagaacaggcaggaacagttgcctcatgtcctcttggacattcggacgacaccgtgtaccatgatgataaatgcatggtagaagtccctcaagaactggagaccagtaccggacacagccttgaaaaagagtttacaaaccaagaagcggcagaacctaaggaagtgccagctcacagtaccgaggtgggtcgagaccataacgaggaggagggcgaagagactggtctcagagacgaaaaaccaataaaaacagaagtgcccggaagtccagcgggaacagaaggcaactgccaggaggcaaccggcccttccacagtggatacgcaaaatgaacctctggatatgaaagaaccagacgaggaaaaatccgatcaacagggggaagcgctggattcctcccagaagaagaccaagaacaaaaagaaaaaaaacaagaaaaagaaatctccagtccccgtggaaacactaaaggacgtgaaaaaagaattgacatatcaaaacactgatctgagtgagattaaagaagaggaacaggtcaaaagcactgacagaaagtctgcggtggaggcacagaacgaggtgaccgagaatccaaagcagaagatcgcggctgagtccagcgagaacgtagattgccccgaaaatccgaaaattaagctagacggaaagcttgaccaggagggcgatgatgtgcaaaccgcagctgaagaagttttggcagacggtgataccctcgattttgaggatgatacggttcagtcttccgggcctcgtgctggtggggaggagctggatgaaggcgtcgcaaaagacaatgctaagattgacggcgctacgcagtcatctccagctgagcctaaaagtgaggatgcagaccggtgtaccctgccagaacacgaatcccctagccaagacatttccgacgcatgtgaagcagaatctacagagcgttgtgagatgtccgagcacccctcacaaacagtcagaaaagctctggactcaaactcactggaaaacgacgatttgagcgcgccagggcgagagccaggccacttcaatcccgagtccagggaggatacacgtggcggaaatgagaaggggaaatccaaagaggactgtactatgagctag

SEQ ID NO: 228262 - DNA, 1923 bp, Artificial Sequence
  Description of Artificial Sequence: Synthetic coding sequence
atggatatgggcacccaggggtccgggaggaagagactccctaacagggaacggctgactgctgaagacgatgccctaaatcagattgctcgcgaggccgaagcaaggctagctgcaaagagagccgcacgtgccgaggctcgcgagatccgaatgaaagagctcgagcggcaacagaaagagatttaccaggtgcagaagaagtattatgggctagataccaaatggggggacattgagcagtggatggaggatagcgagaggtacagcaggcgctcccgacggaacacctcagccagcgacgaagacgagaggatgtcagtggggtcccggggatccctcaggtcccaacccgacctggaatacggcggaccctatgcctggactaatggctatgatggggaactttacggttcccaatctctgaacagaaggagcggccgtccctcctgcctctacagcgccgctaggcctagtgggagttatcgcgcaagtgttctggatgagggctctttcggcggtacccggagagggtctacatccggctcccgggctccgtcagaatacagtggacatttgaactcaagtagtcgggcaagctcacgagcttcttctgcccgagcttctccggtggtggaggagcgacctgagaaagacttcactgagaagggctcgaggaacatgccgggtctgtctgctgctaccctggcttcgctgggcggaactagttcccgtagggggagcggggataccagcatcagtattgacaccgaggcctctatccgcgaaatcaaggagttgaatgagctcaaagaccagatccaagatgtggaaggtaaatacatgcagggactcaaggagatgaaggatagtcttgccgaagtcgaggagaaatataagaaagccatggtctctaacgcgcagttagataatgaaaaaactaattttatgtatcaggtcgacaccttgaaagacatgcttctagagctagaggagcagctcgcagagtctagaaggcagtacgaggagaagaacaaggagttcgagcgagaaaaacatgcccacagtattctgcagtttcagtttgcagaagtcaaagaggcgcttaaacagagagaggaaatgctggaagaaattcgacagttgcagcaaaagcaggcgtcgtccattagggagatcagtgacctccaagagacaatcgagtggaaagataagaaaattggggctttggagcggcagaaggagttcttcgattcggtgagatctgagcgcgacgatctacgtgaggaagtcgtcatgctcaaagaggaactcaagaagcatggcattatcttgaactcagagattgccactaatggagaaacgtccgacactctaaacaacgtcgggtatcaaggtcccacaaaaatgaccaaagaggaactgaatgcactgaaatctaccggcgacggcaccctggacattcgactaaagaagctcgtagatgagcgagagtgccttttagagcaaatcaaaaagcttaagggtcaacttgaagagcggcaaaagatcgggaagcttgacaacctgcgctccgaggacgacgtactggaaaacggtactgacatgcatgtgatggaccttcagagggacgctaatcgacaaattagcgatcttaagttcaagttggctaaaagtgagcaggagatcacagctctcgagcaaaatgttattagactcgaaagtcaggttagcaggtataaatctgcggcagagaacgctgagaagatagaggacgagttgaaagcagaaaaaaggaagctccaacgcgaattgaggtcagcacttgacaagaccgaagagctggaagtctcaaacgggcaccttgtgaagagactggagaagatgaaggctaataggtccgcgctgcttagccagcaatag

SEQ ID NO: 228263 - DNA, 2166 bp, Artificial Sequence
  Description of Artificial Sequence: Synthetic coding sequence
atgggcacccccgctagcggaagaaaaaggacacctgtgaaggacagattttccgccgaggacgaagcactgagcaatatcgcccgagaggccgaggcacgattggcagctaagagggcggcacgcgcagaagccagggatataagaatgcgagagctcgaaaggcagcagaaagagtattcgctgcactcttttgatcgcaagtgggggcaaattcagaaatggctggaggattcagagcgggctcgatatagtcaccggtcatcccatcataggccttacctaggagtggaagacgctctgagcattcgcagcgttggctctcaccggtacgacatgtttaaggataggagctctcgtcttagctccctcaaccattcatacagccatagtcatggcatgaaaaagaggtctagtgactctcataaagacctgctgtctggcctttacttcgaccagcggaactactctagtttgcggcatagcaaaccgacatctgcatattacactcgacagagcagcagtctatactctgaccctctggctacttacaagtcagatcgcgcttcccctacagcaaacagtgggctgctcagatctgccagcttagcctccttatataacggcggtctgtacaatccctacggcccaagaacaccgtcagagtgctcctactacagcagccgtatctcttctgccagatctagtcctggctttacgaatgatgataccgcgtctatcgtctcttccgatagggcttccaggggaaggcgtgagagtgttgtgtctgcggcagattatttctctcggtccaatagaagaggctctgttgtgtctgaagtcgacgacatttcaatccctgacctatctagcctagatgaaaagtctgacaagcagtatgctgagaactacacccgaccctccagccgtaactccgcctccgcaacgacacccctgtcgggcaattcttctcgccgaggctctggggatacttcctctctcattgatcctgatacctcgctcagcgagctgagggacatatacgacctaaaagaccagatccaggacgtggagggaaggtacatgcaggggctaaaggagttgaaagaaagtcttagcgaagtagaggaaaaatacaagaaagctatggtatcaaacgcacagctggacaacgaaaaaaacaaccttatctaccaggtggacaccctgaaggacgtcatcgaggagcaggaggagcagatggcggaattctacagagagaacgaggaaaagtctaaagaactggagcgccaaaagcacatgtgttccgtcttgcagcacaagatggaggagttgaaagagggtctgagacagcgcgatgagcttatcgaagaaaagcagagaatgcagcagaaaatagacaccatgacaaaagaagttttcgatctgcaggagaccctcctctggaaggacaaaaagatcggggctttggagaagcagaaggaatacatagcttgtttgcggaacgagcgggatatgctgagagaagagcttgcagatctccaggagactgtcaagactggggaaaagcacggtcttgtgattattcctgatggcacgccaaacggggacgtgtctcacgaacctgtggccggagccatcaccgtggtgtctcaggaagctgcccaagtcctggagagtgccggagaaggcccactcgatgtgcgccttcggaagctggccggtgagaaggaagagcttctcagccaaatccgcaagctgaagcttcaactggaggaggagcgacagaagtgctctagaaatgatggcacagttggagacctggctggactacaaaacgggagcgatctacaatttatcgaaatgcagagagatgcaaatcggcagatatcggagtataaattcaagctctcgaaggcggagcaggacatcactacactcgagcagagcatctcccggctggaaggtcaagtgctaaggtacaagactgcagctgagaatgcggaaaaggtggaggacgaactcaaggccgaaaagcggaaactgcagagggagctgcggacagcattggacaaaattgaggaaatggagatgactaactcccatcttgcgaagaggctcgaaaaaatgaaagctaataggacggccctactcgcacagcaatag

SEQ ID NO: 228264 - DNA, 1203 bp, Artificial Sequence
  Description of Artificial Sequence: Synthetic coding sequence
atgggaacccctgcttcaggtaggaagcggacacctgtgaaggaccgattcagtgcggaggacgaagcgctgagcaatatagcccgagaggcagaagccaggctcgcagcaaagagagcggcacgagcagaagcacgggatatccgcatgcgcgagctcgagcggcagcagaaggaactggacgaaaagagcgataagcaatacgcagagaactataccaggccatcctcgcggaatagcgcttctgcaaccacaccactgagcggcaattcaagccgtcgtggttctggcgacacttcgtccctgatcgatcccgacacatccctgtccgagctcagggagtccctgtccgaagtggaagagaagtacaagaaagccatggtgagcaacgctcaactggacaacgagaaaaacaatctgatttaccaggtggatacattgaaagacgtgattgaggaacaggaggaacaaatggcagagttctacagagagaatgaggagaagagcaaggaactggagaggcaaaaacacatgtgttccgtcctgcaacataagatggaagagctgaaggagggtctcaggcaacgagacgagctcatcgagaaacatggactcgtgatcatccccgacggtaccccaaacggcgacgtgagtcatgaaccagtcgcaggagctattacagtggtgtctcaagaggcagctcaggtccttgagagcgctggcgagggacccttggacgtaaggctacgcaaacttgctggcgagaaggaagagctgctcagtcagatccggaaactcaagcttcagttggaggaggagaggcaaaaatgctccaggaatgatggcacagtgggcgacctcgcaggactccaaaatggctccgacctgcaatttatcgagatgcaacgtgacgccaataggcagatctctgaatataagttcaagttgtctaaagctgagcaggacatcactacccttgagcagagcatttcgagactcgaagggcaggttctcaggtataaaacagctgccgagaatgcagagaaggttgaagatgagcttaaggcagagaaacgtaaactacaacgggaactgcggaccgccctcgataagatcgaggaaatggaaatgaccaattcccatctcgccaagcgccttgagaagatgaaggccaaccgtacagcgttgcttgcccagcagtag

SEQ ID NO: 228265 - DNA, 2166 bp, Artificial Sequence
  Description of Artificial Sequence: Synthetic coding sequence
atgggcacaccagcctctggaagaaagcgcactccagtgaaagatcgattctcagccgaagacgaggctttgagtaacattgccagggaggcggaagcaagactggcagctaagagggccgctagggccgaagccagagatatccgtatgagagagctggaacggcagcagaaggagtatagcctgcattcctttgatcgtaagtggggacagattcagaaatggctggaggacagcgagagagctcggtactcccacaggagctcccatcataggccttacttaggggtggaagacgccctcagcatccggtcggttggttcccacaggtatgatatgtttaaggataggagttcccgcctgagctccctgaaccattcttatagtcatagccacggaatgaagaagcgttcatccgacagccacaaggatcttttgtctgggctgtatttcgaccaacgaaactactcgtccctgcgccacagcaagccaacgagcgcatattacactcgccagtcatcgtccctctatagtgaccctctagctacctataagtctgatcgggcatctcccaccgccaactctggcttattgcggtccgcctctttggcttcactttacaatgggggactgtacaacccctacgggcctcggaccccctcagagtgctcatactactcttcacgaattagttctgcaagaagctcaccagggtttactaatgacgacacggcttccattgtctcctctgacagagcctctcgtggaaggagagagtccgtcgtgtccgcggctgattacttcagccgttcaaacaggagaggctccgttgtgagtgaggttgacgatattagtatccctgacctgtctagtctggacgaaaagagcgacaagcagtatgctgaaaattatacccgtcccagtagtcggaattccgccagcgcaaccacccccctgtccgggaattcatccaggcggggaagtggtgatacttcctccctgattgaccccgatacctctttgtctgaactccgcgacatctacgatctaaaggaccagatccaggatgtggaagggagatacatgcaggggttgaaggaattaaaggaatctctatccgaggtggaagaaaaatacaagaaagccatggtttccaacgctcaactggacaatgagaagaacaacctgatctatcaagtggacactcttaaggatgttattgaagaacaggaggaacagatggccgaattctatagagagaatgaggagaagtcaaaagaactggagcggcagaagcacatgtgttctgtgcttcaacataagatggaggagctgaaggaaggcttacggcaaagggacgaactcattgaagagaagcagagaatgcagcaaaagatcgacacaatgacaaaggaagtgttcgacctccaggagactcttttgtggaaagataagaaaatcggagccctagagaaacagaaggaatacattgcgtgtttgagaaacgagcgcgacatgctcagggaagagcttgccgatctccaagagactgtaaagaccggagagaaacatggacttgtgataatccccgacggaaccccgaacggtgatgtctctcatgagccagtggcgggagctattaccgtggtttcgcaggaagcagcacaagtgctcgaaagcgccggagagggaccgctggacgtgcgactccgaaaactcgcaggtgagaaggaggagttgctgagccagatccggaagctgaagttgcagctcgaggaggaaagacaaaagtgctcccggaatgatggaaccgtgggggacctcgcaggattacagaacggttcagacctgcagttcatcgaaatgcagagagatgccaatagacaaatcagcgagtacaagtttaagctctctaaagctgagcaggacatcacaacactggagcagagtattagtagactagagggacaggttctgaggtacaagactgctgccgagaatgcggagaaggttgaggacgagctgaaagcagagaaaagaaaactccagagagagcttaggaccgcgctggataaaatcgaggaaatggagatgaccaacagccacctggctaagagactggagaagatgaaagcgaaccgcacagccttgctggcccagcagtag

SEQ ID NO: 228266 - DNA, 180 bp, Artificial Sequence
  Description of Artificial Sequence: Synthetic coding sequence
atgggtacaccagcatctggacgcaaaagaacccctgtgaaagataggtttagtgcggaggatgaggccctgagtaatattgcaagggaagcagaagcgaggttggccgcaaagagggctgccagggctgaagcccgagacatccgaatgcgggaattagaacgacagcagaaagagtag

SEQ ID NO: 228267 - DNA, 180 bp, Artificial Sequence
  Description of Artificial Sequence: Synthetic coding sequence
atgggaaccccagcgagcgggagaaagcgcacaccagtaaaggataggtttagcgccgaagacgaggccctctctaacattgcccgagaggcagaggcccgactcgcagctaagcgcgcagcccgagccgaagctcgtgatatccggatgagggagcttgagaggcagcagaaagaatag

SEQ ID NO: 228268 - DNA, 180 bp, Artificial Sequence
  Description of Artificial Sequence: Synthetic coding sequence
atgggcactccagcctcgggtagaaagaggacacctgtcaaagatagatttagcgccgaggacgaggccttgagcaatatagcccgtgaagccgaagcacgtcttgctgcaaaacgggcagcccgagccgaagcccgagatattagaatgcgagaactggaacgacagcagaaagagtag

SEQ ID NO: 228269 - DNA, 1275 bp, Artificial Sequence
  Description of Artificial Sequence: Synthetic coding sequence
atgggcaccccggcatctggtcgaaaaaggactcccgttaaggaccggttcagtgcagaagacgaggctttatccaacatcgctagagaggccgaagcccgtctcgcagcgaaacgggcagccagagcggaggctagagacatccggatgcgtgagttggagcgccagcagaaagagctggacgagaagtctgacaagcagtatgccgagaactacacccgcccatccagtcgtaactcagcatccgctactactcctctgagcggcaattcaagccgcagaggcagcggagatacctcctctctcatcgacccggatacctcccttagtgaactgcgcgatatttacgatttaaaggatcagattcaggacgtggagggcaggtacatgcagggtctgaaggaactgaaagaatctctgagcgaggtagaagagaagtataagaaggccatggtgtccaacgctcagttggataacgagaaaaacaatctcatctatcaagttgatactctgaaggatgtgatagaagagcaagaagaacagatggccgagttttaccgggagaatgaggaaaaatcgaaagaactggaacggcagaagcacatgtgtagcgttctgcaacacaaaatggaggagctgaaggaaggcctacgtcagcgggacgagctaatcgagaagcatggattggtcatcatccctgatggcacgccaaatggagacgtgagtcacgaacccgtcgctggggctatcacagtagttagccaggaggcagcgcaggtgctcgaatctgcaggggaagggcctctcgatgtgcggctccggaagctcgccggagagaaagaggagctgttgtcacagattcgcaagcttaagctccagctggaggaagaacgacagaagtgctcgcgcaacgatggtaccgtcggagacctggcaggcttgcagaacggaagcgatctccaattcattgagatgcaacgggacgccaacaggcagatatcagagtataagttcaagctgtcaaaggcagagcaagacattaccaccctggagcagtcaatcagtagactcgagggccaggtactgcgatacaagacagcagcagagaatgccgaaaaagttgaagatgagcttaaggccgaaaagagaaaattgcagagggagttacgtactgccctagataagatagaagagatggaaatgacaaactcgcacctcgctaaacgtctggagaaaatgaaagcaaatcgcacagcccttctggcccaacagtag

SEQ ID NO: 228270 - DNA, 2316 bp, Artificial Sequence
  Description of Artificial Sequence: Synthetic coding sequence
atggctccaggtccctttagctccgccctgctctctcctccacctgccgctctccctttcctgcttctcctctgggccggagcatcgaggggccagccctgtcctggcaggtgtatctgccagaatgtagctccgaccctaacgatgttgtgcgcaaagacgggactgctgttcgtgccacctgccatagatcgaagagtagtcgagctgcgcctcacggacaatttcattgctgccgttcggagaagggactttgcaaacatgaccagcctagtccaccttacactatctcggaacaccatagggcaagtggctgcaggggcattcgccgacctgcgggctctccgcgctctccaccttgactctaatcgtctcgccgaagtgagaggcgaccaacttcgagggcttggaaatctgagacacctaattctgggcaataatcaaattagacgtgtcgagagcgccgctttcgacgctttcctgtccactgttgaagacctcgacttgtcgtacaataatcttgaggccttgccctgggaagccgtcggacagatggtgaacctgaacacccttacacttgatcataacctcatcgaccacattgcggaggggacctttgtccaactacataagttggtaagacttgatatgaccagtaacagactgcacaagctgcccccagacggtctcttccttagaagtcagggcactggacccaaacctccaacgcctttgaccgtgtcttttgggggtaacccacttcactgtaactgcgagctgctttggttgcgcagattgacaagggaagacgatctcgagacatgtgccacgcccgagcacctcacagaccgctacttttggtctatccctgaagaagagtttctttgcgaacctccactaatcacacggcaggcaggcggacgagcgctcgtggtcgagggacaggccgtatcgctccgatgtcgagctgtcggcgatcccgaaccagtcgtacactgggtggcaccagacggcagactcttgggaaatagctcccgaacccgggtgcgaggagatggaaccctggacgtgactattaccaccttgcgggacagtggaacttttacctgcattgcctcgaatgccgctggggaggctaccgcacccgtggaagtgtgcgttgttcctctgccactcatggctccgcctcccgctgcacccccaccattaaccgagcctggcagctccgacattgccacaccgggacggccaggagccaacgatagtgcagccgagcgaaggcttgtggctgccgaattgaccagcaacagtgtccttattcggtggccggctcaacgacctgtcccaggaatccgtatgtaccaggtccagtacaactccagcgtggacgactccctagtatacagaatgatcccttccactagccagacttttttggtgaacgacctcgccgctggcagggcctatgatctttgcgtcctcgccgtatacgatgacggagccaccgccctgccggctacaagagttgtgggttgcgttcaattcaccaccgccggtgatcccgcaccgtgtagacccttacgggctcacttcctcggaggtacaatgatcattgccatcggcggagttatcgtggctagtgtgctcgtatttattgtgctcttaatgattagatacaaggtgtatggggatggcgattcaaggcgagttaagggatcgcggagcctgcctagggtgtcccatgtgtgttcgcagacaaacggtgccggtacaggtgctgcgcaggcccctgcactgcccgcacaggaccactacgaagccctgcgggaggttgagagccaagccgctcctgccgtagccgttgaggcgaaggcaatggaagctgagactgccagtgccgaacctgaggtcgtcctgggaagatctctgggcggaagtgccacctccctctgcctgcttccttcagaagagacatccggcgaggagtcacgcgctgcggtggggcctagacgatcacgctccggggcacttgagccacctacaagcgcccctccgaccctcgccttggtgccgggtggcgcagcagcccgtccccgacctcaacagcgttactcatttgacggtgattatggcgctctttttcagagtcactcctatccgaggcgggcaagacggactaagcgacatcggtcgaccccacatttagacggagcaggcggaggggctgcaggcgaggatggggacctgggtctcggttctgcccgagcgtgtctggccttcactagcactgaatggatgctggaaagcacggtgtag

SEQ ID NO: 228271 - DNA, 2370 bp, Artificial Sequence
  Description of Artificial Sequence: Synthetic coding sequence
atggagacacttttgggcggattgctagcttttggcatggccttcgccgtcgtggatgcgtgtcccaaatactgcgtgtgccagaacttgtccgagagcttagggaccctatgcccaagtaaaggtctactcttcgtcccccctgatattgaccggcgaaccgtggagttgagactgggagggaacttcataatccacatcagcaggcaggatttcgctaatatgacaggtctggttgacctgaccctgtccaggaataccataagccatattcaaccgttttccttcctagacctggagagcctgaggtcactgcaccttgacagtaatcggcttccttcccttggggaagatacactgcgagggctagtgaatttgcagcaccttatcgtaaataacaaccaattaggaggcattgctgacgaagccttcgaagattttctgcttaccttggaggaccttgacctgtcgtataataacctgcatggtctcccctgggactctgtgcgcagaatggtcaacttacaccaactatcgctggatcataatttactcgatcacatcgctgaagggactttcgcggatctccagaagttggcccgtctggacctaacgtcaaatagactgcagaagctcccaccagacccaatcttcgcacgatcccaggcttcggccctcaccgccacccctttcgcaccaccattatcttttagtttcggaggcaacccactccactgtaactgcgaactactatggctacggcgactggaacgcgatgatgaccttgagacatgtggcagcccaggaggactgaaggggagatacttctggcatgtacgcgaagaagagttcgtctgcgaacctcccctgattacccagcacacgcataagctcctcgtactggagggccaggccgcaacacttaagtgtaaagccataggtgatccttcacccctgatacactgggttgcccctgatgatcgcttggtagggaactcctctaggactgcagtctacgataatggcacgttagatatcttcataacgacctctcaagactcaggcgctttcacatgtatagcagctaacgccgctggcgaggcaacagccatggtggaagtgtcaatcgttcagctgcctcacctgtctaattccaccagcaggacagctccacctaaaagtcgactatcagacatcaccggcagttctaagacttcccgaggaggtggcggtagcggtggaggggaacctccgaagtcacccccagaacgcgctgtactagtgtctgaagtcaccacgacttctgcccttgtgaaatggagcgtgagcaaatcggcgccaagggtgaaaatgtatcagctacaatacaactgctccgacgatgaggtgttgatataccggatgattcctgcttcaaataaggctttcgtcgtaaataaccttgtgtcggggacaggctacgacctgtgcgttctcgctatgtgggatgacaccgcgaccactcttaccgctaccaacatcgtcggttgcgctcagtttttcacaaaagccgattaccctcagtgccagtctatgcattcacagatcctggggggaactatgattctggttatagggggtattattgtcgcaacattactcgttttcatcgtgatcctcatggtcaggtacaaagtgtgcaatcacgaggctccatctaagatggcagccgcagtgtctaatgtttattcgcagaccaatggagcccagccccctccaccatcttctgctcctgctggggctcccccacaggggcctccgaaggtggtggtgcgaaatgagttactggacttcacagccagtctggcacgcgctagcgactcaagtagctcgtcaagtctcgggagtggggaggccgcaggcctcggcagagcgccttggcggattccacctagcgcacctagacctaagccttcactggatcgcttgatgggcgcatttgcaagtctcgacctgaagagtcagcgcaaggaggaattgttggactctcgcacgcccgctgggagaggagccggaacctctgcccgagggcatcatagcgatcgagaacccctcttgggcccacctgccgcacgagctcggtccctgctccccctccctttggagggcaaggccaaacgaagccactccttcgatatgggcgacttcgcagctgcagctgcgggtggagttgtccctgggggttatagtcctcccaggaaggtcagcaatatctggaccaaacgaagcctgagcgtgaacggtatgctgttacctttcgaagagagtgacctggtgggggcacgtggaactttcggtagttccgagtgggtgatggaatctacagtatag

SEQ ID NO: 228272 - DNA, 1887 bp, Artificial Sequence
  Description of Artificial Sequence: Synthetic coding sequence
atggcaatactgccactcttgctctgcctcttgcctctggctcctgcttcatctcctccacagtctgctaccccatctccatgtccgcgtcgctgtagatgccagacacagagcctgccgctaagcgtgctttgccccggagctggactcctctttgtacccccttcccttgacaggagagcagccgagctgagactcgctgacaattttatagcttcagtcagacgcagagacctggccaatatgacaggtttgctccacctgagtctttcgaggaacacaattcgacatgtcgccgctggtgcatttgcagacttgagggcacttcgggctctgcacctggacggcaataggcttacctctctcggagagggccagttaagagggttggttaaccttcgtcatctaatcttatctaataaccagctggccgcactggctgccggagcactcgatgactgtgcagagaccctcgaagaccttgacttatcctacaacaatttggagcaacttccctgggaggctctgggcaggcttgggaacgtaaacactctgggtctcgaccacaatctgcttgcctcagtgccggcaggcgcatttagcaggctacataagctggctaggctggatatgacatctaaccggttgactaccataccccctgatcctttattctcaaggcttccactcttggcacgcccaagggggagtccagcttccgctctggttctagcttttggcggtaatccgctgcactgcaattgtgagttggtctggctgcggaggctggctcgggaagatgatttggaggcctgtgcctccccccctgctttaggtggaaggtatttctgggcagtcggtgaggaggaatttgtctgcgaacctccagtggtgacccatcgctctcccccacttgctgtgccagcaggacgccctgctgctcttcggtgtcgcgctgtgggcgatccggaacctcgggttagatgggtatcaccccagggtaggctactgggaaactcctctcgcgcacgagccttcccaaacggcacgctggagctcctagtgacagagcctggcgacgggggaatcttcacttgcatcgccgctaacgccgctggagaagctaccgccgctgtagagctcactgtggggccacctcctcccccacaattggcaaactccacatcgtgtgaccctccacgggatggggacccagacgcactgacaccgcctagcgcagcttctgcatctgccaaggttgctgacacaggtcctcccacggatcggggtgttcaggtaactgagcacggggctaccgcagcgttagttcagtggcctgaccaacgccctatcccaggcatccgtatgtatcagattcagtacaactcgagcgccgatgacatactggtctaccggatgatccccgctgagagtaggtcttttctgctgaccgacctggccagcggcaggacatatgatctctgcgtgctggccgtctatgaagattctgccactgggctcacagcaactaggcccgtaggctgtgccaggttttcaacagaacccgcacttagaccgtgtggtgctcctcacgctccttttctcgggggaaccatgattatcgcattgggtggcgttattgtagcctctgtactcgtcttcatctttgtgctcttaatgagatacaaggtccatggcggtcagccccctggtaaggcaaaaatacctgctcccgtatcttccgtctgtagccagactaatggggcactgggccctaccccaacaccagctccccctgctccggagcccgctgctctgagggctcacaccgttgtccagctagactgcgaaccctgggggcctgggcatgagccagtcggtccttag

SEQ ID NO: 228273 - DNA, 1887 bp, Artificial Sequence
  Description of Artificial Sequence: Synthetic coding sequence
atggcgattctgcctctccttttgtgtttgctgcccttggcacccgcatcctcacccccacaatctgccacccccagcccatgccccaggcggtgccgctgtcaaacacaatccctgcctctgtcagtgctgtgtccaggagccggactgctgttcgtgccaccgagccttgatcgccgtgcagcagagcttaggttggctgacaattttatcgccagcgtgagaagaagggatctggcaaatatgaccggacttttgcacctgagtctcagcaggaatactattcggcatgtagcagccggagcattcgccgatctgcgtgcactgcgcgcactccaccttgacggaaaccgactgacctcccttggcgagggccagttaaggggacttgttaacttgcgacatctgatcttgtctaacaaccaactggccgcactggcagcaggagctctcgatgactgcgctgaaaccctggaagacctagacctgagctacaataacctcgagcagctgccttgggaggcactcggaaggctcgggaacgtcaatacgcttgggctggaccacaaccttcttgcatccgtgccagccggagccttcagcagactgcataagctggcaagactggatatgacgtcaaacaggctaactaccatccctcctgatcccttattctccagactgcccctactagcaagaccaagaggttctccagcatccgctctcgtgctggcattcggaggtaaccctctgcactgtaattgtgagttagtgtggctgagacggttggcaagggaggatgatctggaggcctgcgcctctcccccagcactcgggggacgatacttttgggcagttggggaggaagagttcgtctgtgagccacctgttgttacccacaggtctcctccactggctgtgcctgcgggacggcctgcggcactccggtgccgggctgtaggagacccagaaccaagggtgcgctgggtgtctcctcagggacgtctgctcgggaatagctcacgagctagagcattcccgaacgggacgctggagctcctcgtcactgagcctggtgatggcggaatctttacatgcattgctgcaaacgcagccggagaagcgacagcggctgttgaactgacggtcggcccaccccctcctcctcagctggccaatagtaccagctgcgatccccctagagacggagaccctgatgcattgactcctccctctgctgcttccgcatccgccaaggtggccgacacagggccaccaaccgaccgaggcgtgcaggttaccgaacacggcgctacggcggcactcgtgcaatggcccgatcagagacctataccaggcatcagaatgtaccaaatccagtacaactccagcgctgacgacatcctcgtttaccgcatgattccagcagagtctagatcctttctacttaccgatctggcaagcgggaggacatatgatttatgcgtgctcgccgtgtatgaggactccgccactggccttaccgccacacgtccagttggttgtgcgagatttagcactgaacccgcattgcggccttgcggggctccacacgcaccatttttaggaggcactatgatcattgctctgggaggggtgatcgtcgccagcgtcctcgtgtttatcttcgtgctgctgatgcgttataaggtgcacgggggtcagcctcctggtaaagcaaagatacctgcccctgtctcatccgtgtgctcccagacaaatggggcattgggcccaactcccacaccggctccacccgcaccagaaccagctgcactgcgcgctcataccgtcgtgcagctggactgcgaaccctggggccctgggcacgagcctgtggggccatag

SEQ ID NO: 228274 - DNA, 1908 bp, Artificial Sequence
  Description of Artificial Sequence: Synthetic coding sequence
atggctccccctctgttgctgctccttctggccagcggggcagccgcttgcccactgccatgtgtgtgtcagaatctttctgagtcgctgtcaactctgtgcgcgcaccgtggcctgcttttcgtcccacccaatgtggatcgcaggactgttgagttgcggctagccgataattttatccaggcccttgggccaccagattttagaaacatgactggcctggtcgatctgactctgtctcggaacgccataacaaggatcggcgcaagagcgttcggcgatctggaatctttacgttctcttcatctcgatggtaatagactcgtggagctcggaacaggaagcctgagagggcctgtgaatctccagcatttgatccttagcgggaatcagctgggcaggatagccccaggcgcattcgatgactttctggagtctctcgaggaccttgacttgtcctataacaatctccgacaggtaccctgggccggtattggagcaatgccggctctccatacgctcaatctagaccacaatctgatcgacgcactgccaccaggtgcctttgcccagctgggacaactgtctcggctggacctcacatccaaccggctggctaccctcgcgccagatcccctgttcagccgaggacgggacgctgaagctagtcctgctcctctggttctctcgttctctggaaatcccctccactgcaattgtgagctcctgtggctacgcagacttgcccgtcccgatgatctcgagacttgtgcatctcctccgggtctggccggtcgctacttctgggcagtgccagaaggggagttctcctgcgaacctcccctaatcgcccgtcacactcagaggctgtgggtactggagggccaacgcgctaccttaaggtgtcgagccctgggcgacccagctcctacgatgcattgggtgggcccagacgaccggctggtgggcaacagctcacgagccagggcctttccaaacgggaccttggagataggggttacaggggcaggggacgcgggaggatatacatgtatagcaactaatcccgcaggagaagcaaccgcccgtgtcgaactgcgagttctcgccctgcctcatggaggcaattcatcagctgaaggtgggagacctggcccttctgacatcgccgcatctgcccgtaccgcagcggagggtgagggaacactggagtcggaacccgctgttcaagtgacagaggtgacggccactagtggattagtgagttgggggcctggacggcctgccgaccccgtttggatgttccaaattcaatacaacagtagtgaagatgagactctgatctaccgcattgtccccgcaagctcccatcactttctgctcaaacacctggtgccgggtgccgattatgatctttgcctgctcgctttgagccccgctgccggtccatccgacctcacagctacccggctgttaggatgcgctcatttctctaccctgcctgcctcccctttgtgccatgctttacaggcccatgtgctgggcggaacactgaccgtagcagtgggaggcgtgctggtggccgctctcctggtattcacagtagccttgctggtgagaggcaggggcgctggaaatggcaggctgcctcttaaacttagtcacgtgcagtcccagacaaacgggggaccatcacctactccaaaagcccacccccctagaagtcctcccccaagaccacagaggtcatgttctctggacctaggcgacgctggatgctacggctacgcccgtcgcttaggcggagcctgggcacgcaggtctcacagcgtgcacggcggtctgctgggtgcagggtgccgcggagttgggggtagcgccgagagactggaggaatcagtggtgtag

SEQ ID NO: 228275 - DNA, 2160 bp, Artificial Sequence
  Description of Artificial Sequence: Synthetic coding sequence
atggaaaaaattttgttctacctttttctgattggcattgccgtaaaagcacagatttgccctaaacgatgcgtgtgccaaattctgtcccctaatttggccaccttatgtgctaagaagggcttactgttcgtgcctccgaatatcgatcgaaggactgtggagttgcggctggcagataacttcgtaaccaatattaaacgcaaagactttgccaatatgacctcgttggtcgacctgactctgagcaggaacaccatctcttttattaccccacacgcatttgcggatctgcggaacctcagagcacttcacctgaacagcaataggctcacaaaaatcaccaatgacatgttctccggactgagtaacctgcatcacttgatcctgaacaacaaccaactgacactgatctcatcaactgccttcgacgacgtgttcgcccttgaagaattggatctctcttacaacaacttagaaaccattccttgggacgccgtggaaaaaatggtcagcctgcacaccctttctctcgaccacaacatgatcgataacatacctaaaggcactttttcccatttacacaaaatgaccaggctggatgtcacaagcaataagctgcagaagctgcccccagacccactgtttcagcgggctcaagtgctggccactagcggtatcatatcacctagcactttcgccctgtcctttggcggtaacccactgcactgcaattgcgagcttctttggcttcgtcgcctgtcacgcgaggatgacctcgagacatgcgcatcccctcctttgctcacagggaggtatttttggtccatcccagaagaagagtttctgtgtgaaccgcctctgatcacccgccacacacatgaaatgagggtgctagaagggcagcgcgctaccctgcggtgtaaggcccgaggggatcccgaacctgccatccactggatctccccagaaggcaagctgatttctaatgcgacccgctccctcgtctatgacaacggtaccctggacattctcattactactgtgaaggacaccggcgctttcacttgtatcgcgtccaatcccgctggcgaggccacccaaattgtggacctgcatatcatcaaactgcctcatttgcttaactctactaaccacatccacgagcccgaccccggtagctccgacattagcacctccactaaatctggatccaacaccagtagcagcaatggggacacgaagctttcccaggataaaatcgtggtagccgaagctacctcatctacagcattgctaaaatttaactttcagcgcaatattcctggaattaggatgtttcagatccaatacaatggaacatatgacgacacactggtgtaccgcatgatacccccaacatccaagacattcctggtgaacaatctggcagccggaactatgtatgatttatgtgtgctggccatttatgatgacggaatcacctctttaaccgcaacgcgtgtggtaggatgcattcagtttaccacggagcaggactacgtgcgatgtcactttatgcagtctcagttcctcgggggaactatgataattatcatcggagggattatcgtcgcctcagtactggtctttatcattattctcatgatccgttacaaggtgtgtaacaacaacgggcagcacaaagtcactaaggtctcaaatgtttactcccagacaaatggcgcacagatccagggctgctccgttacccttccacaatccgtcagcaagcaggccgtgggtcacgaagagaacgctcaatgttgcaaggccacgtccgataatgtgatccagagctctgagacctgtagctctcaggatagtagcacgaccactagcgcactgccaccaagctggacgtcatctacaagcgtgagccagaagcagaagaggaagacaggaactaagccaagcacggaacctcaaaacgaagctgttactaacgtggagtcccagaataccaatagaaataattccactgctctgcaactggcctcacgacctccagacagcgtgaccgagggaccgacaagcaaacgcgctcatatcaagccaaacgccctattgaccaacgtggatcagatcgtccaagagacccagcggctagaactgatctag

SEQ ID NO: 228276 - DNA, 1863 bp, Artificial Sequence
  Description of Artificial Sequence: Synthetic coding sequence
atgcaggtaagcaagaggatgttggcagggggagtgaggtccatgccatcacctctgctggcctgctggcagcccatcctgctcctggtgctgggctccgtcctctcgggtagcgctaccgggtgtcctcctagatgcgagtgttctgcccaagaccgcgcagtgctgtgccaccgcaaaaggttcgtggccgtgccagaaggcatccccacagagactcgccttttggacttaggtaaaaatagaatcaaaactctgaatcaggacgaattcgcatcctttccacacctggaggaattggaacttaatgagaatatcgtgtccgctgtagagcctggggctttcaataacctgtttaatctaagaacactcggcctgcgctccaacagactgaaactgatcccgttgggggtctttactggactgtctaacttgaccaagcttgacattagcgagaataaaatagtcatccttctggactacatgtttcaggatctgtataacctcaaatctctggaggtgggcgataacgatctggtgtacatcagccaccgagccttcagcggtctcaatagccttgagcaactcacactggagaaatgcaacttaacgtctatacccacagaggccctgagccatctacatggtctcatcgtcctgcgtctgcgccacctgaacatcaacgccattcgcgactacagctttaaaagactttatcgcctgaaggtcttggagatttcacactggccctacctggacactatgactccaaattgcctctatggactaaacttgacctcgctgtccattactcactgcaacctcaccgccgtgccctacttggccgtccgccacttggtttacctgaggttcttaaatctatcctacaaccctatttccacaatagagggctcaatgctgcacgagctcctcaggttgcaggagatccagctggtcggtggccaattggcagtggtggagccctacgcatttaggggacttaattacttgagggtactgaacgtatccggaaatcagctgacaacattggaggagtccgtcttccactcagtcggcaacctggagactcttatcttagattcaaaccctctggcctgtgactgcaggctgctgtgggtcttccgcaggaggtggcgtctgaactttaaccgtcaacagcccacatgcgctacccccgaattcgtacaagggaaggagtttaaagactttcctgacgtgctcctgccaaattacttcacatgccgtagggcacgcattcgcgatcggaaggcccaacaggtgtttgtggatgagggtcacacggtgcagtttgtgtgccgggctgatggtgacccccctccagctatcttgtggttaagtcctaggaaacacttggtgtccgctaaaagtaacgggaggttgactgtcttccccgatggtacgcttgaagtgcgctatgcgcaggtccaggataacggtacatatttgtgtatagcggctaatgccggaggcaacgacagtatgcccgctcacttgcatgtgcggagttacagtccggattggccgcatcagccaaataaaacattcgcttttatctctaatcagcccggtgagggtgaggctaatagcaccagggccacagtcccatttcctttcgatattaagactctcatcattgctaccacgatggggttcatctcctttctcggagtcgtgctcttttgtcttgttctcctcttcctgtggagccggggaaaggggaatacaaaacataacatcgagatcgagtatgtgccacgcaagagtgacgcagggatttcttcagccgatgcacctcgcaaattcaatatgaaaatgatttag

SEQ ID NO: 228277 - DNA, 168 bp, Artificial Sequence
  Description of Artificial Sequence: Synthetic coding sequence
atgctcgcaggcggagttaggagcatgccctccccattgctcgcctgttggcagcccatactgctacttgtactcggatcagtgctaagcgggtccgccacggggtgcccacccagatgcgagtgttcagctcaggacagggccgtgctttgtcatcggaagcgttag

SEQ ID NO: 228278 - DNA, 1845 bp, Artificial Sequence
  Description of Artificial Sequence: Synthetic coding sequence
atgctggctggtggggtaaggtccatgcctagccctctcttagcttgttggcagccgatactgcttctcgtcctgggatctgtactgtcaggatctgccacgggctgtccccctaggtgtgagtgtagcgctcaggatagagccgtactttgtcaccggaagcggtttgtggcggttcccgagggaatccccaccgagaccaggctccttgacctagggaagaatcgaatcaagactctcaatcaggatgagtttgctagctttcctcatctggaggagctcgagctaaatgaaaatattgtgagcgccgtggagcctggcgcttttaataatctcttcaaccttcgaactttaggtttaaggtcaaacagactcaagcttattccccttggggtattcactggcctgagcaacttgacaaagttggacatctctgaaaacaagatagtgatattgcttgactacatgttccaggacctctataatcttaaatccctcgaagtcggggataacgacctcgtgtatattagtcatcgggcttttagtggactgaacagtttggagcaactcaccttggagaaatgtaacctgacttctatcccaaccgaggctctgtctcatctgcatggacttatagttctcaggcttaggcacctgaatattaacgcaatccgggactattcattcaaacgcttataccgcctcaaggtcttggaaatatctcactggccatatctggatactatgacccccaattgcttatacgggctgaatctgacgtcactatccataacacactgcaacctcaccgccgttccatatctggccgtccggcacctggtttatctgcggtttctgaacttaagctataaccccatttctacaatcgaagggagcatgctgcatgagctcttacgcctgcaagaaatacagctggtggggggacaactggcagtggtggaaccctacgcctttagagggctgaactacctgcgcgttctgaacgtgagcggaaaccagctgaccaccctcgaggagtcagtgtttcattctgtggggaacctggagacactcatccttgattcaaaccctctcgcctgcgactgtaggcttctttgggtgtttcggcgacgctggcggctaaatttcaaccggcagcagcccacttgtgccactcccgagtttgtacaaggcaaggagtttaaagactttcctgatgttctgctgcctaattatttcacatgcaggcgcgcacgcatcagagataggaaagcccagcaagtgtttgttgatgaaggacataccgttcagttcgtgtgcagagcagatggcgatcctcctcctgctattctgtggcttagcccaagaaaacatctggtttctgccaagtccaacggacgtctgacagtgttcccagatggaacactggaggtgcggtatgcccaggtgcaggataatggcacttacttgtgtattgccgcaaatgctggcggtaatgacagtatgcctgcccacttgcacgtgaggagctactcacccgattggcctcaccagcccaataaaaccttcgctttcatatccaaccagccaggggagggtgaggcaaatagtactagagctactgtaccatttcctttcgacatcaaaacgctgatcatcgcaacaactatggggttcatcagtttccttggcgtcgtgctcttctgtcttgtgctcctgttcttgtggagccggggaaaaggcaatactaagcataacatcgaaatcgagtatgtccctagaaaatctgacgccggtatctcctccgctgatgctcctcggaagtttaatatgaagatgatctag

SEQ ID NO: 228279 - DNA, 1821 bp, Artificial Sequence
  Description of Artificial Sequence: Synthetic coding sequence
atgctgcacactgctatttcctgctggcagccttttctcgggctcgcggttgtgctgatcttcatgggtagtaccattggatgtccagcgagatgtgagtgcagcgctcagaacaagagcgtgtcatgtcatagacggagactcattgctatacccgaaggtatcccaatagagactaagatcctggacttgtcaaagaacaggctgaaaagcgtaaatcctgaagaattcatctcatatcccctcctggaagagattgacttatctgataatataatcgccaacgtggaacccggagcgtttaataatctattcaatttgcgatctctgcgcttgaaggggaacagacttaagttagtgcccctcggggttttcacagggctgagtaatctcacaaagctggatatttccgagaataaaattgtgatcctgttggactacatgtttcaggatctgcataacctgaaaagtttggaggtgggggacaacgacctggtctatatcagccatcgcgctttttctgggctgcttagcctcgaacagctgaccctggagaaatgtaacttgaccgccgttccgacagaagccctgagccacttgcgatccttgatttcactgcacctaaagcacctgaacatcaacaatatgccggtgtatgcttttaagcgcctgttccatctcaaacacctcgagatagattactggccactactcgacatgatgcccgctaactctttatacggcctgaatctcacctctctgagcgttacgaacacgaacctgtctactgtgccttttttggcgttcaaacaccttgtctatctgacgcatcttaatttatcttacaatcccataagcaccatcgaagctgggatgttttctgacctcattcggttgcaggagctgcacattgttggggcacaactgcggaccatagaacctcattcctttcaaggcctccgcttcctgagggtgctgaacgtgtcccagaacctcttggagacactcgaggagaacgtgttcagcagcccacgagctctggaggtgctgtcaatcaataacaaccctctcgcgtgcgattgcaggctgttgtggattctccagaggcaacctaccctgcaatttggtggtcaacagccaatgtgtgcaggaccagacactataagagaacggtcgttcaaggactttcattctactgccctgagcttctacttcacttgtaagaaacctaagatccgtgagaagaagctgcagcacctgctggtcgacgagggtcaaactgtgcagctcgaatgcagcgccgacggcgacccccagcctgtcattagttgggtgaccccaaggcgtcggtttattacaaccaagtccaatggcagagctacagtgttgggcgacggcactttggaaatcagatttgcgcaggaccaggacagcgggatgtacgtctgcattgcctcgaacgccgctggcaatgatacgttcacagctagtctgacagtcaaaggatttgcaagcgacagatttctctacgccaaccggacgccaatgtacatgactgattcgaatgatacaattagcaacggaacaaacgctaacacctttagcctggatttaaaaaccatcctggtttctaccgccatggggtgcttcacattcctgggggtggtcctgttttgcttcctgctgttgtttgtttggtccagagggaaagggaagcataaaaatagcatcgatctggaatacgtaccgcgtaagaacaacggtgccgtggtggaaggggaagtggcgggacccaggagattcaacatgaaaatgatttag

SEQ ID NO: 228280 - DNA, 1821 bp, Artificial Sequence
  Description of Artificial Sequence: Synthetic coding sequence
atgctccatactgccatttcgtgctggcaaccttttttaggacttgcagtagttttgatttttatggggtcaaccattggttgccccgctaggtgtgagtgcagcgctcagaacaaaagcgtttcctgtcacagacgcagactgatcgcaattcctgagggtatacccatagagacgaagatcttggatctctccaaaaaccgtttaaaatctgtgaaccccgaagaatttatcagctaccctttgttggaggagattgacttgtcagacaacataattgctaacgtggaacctggcgcatttaacaatctcttcaacctgagaagtcttcggctgaaaggtaaccggttaaaactcgtgccgcttggcgtgttcaccgggctgagcaatctcacgaagctggacataagcgagaataagatagtgatcctcctggactatatgttccaggacttgcacaacctcaagagtcttgaagtaggcgacaatgatctggtatatatctcacatcgagcgttttccggcttgctttccttggagcagctgactcttgagaaatgcaatctgactgccgtgccaactgaagccctgagccatctgaggagtctcatcagccttcacctgaaacacctgaatatcaacaacatgcccgtctatgcttttaaaaggctgttccacctcaagcatcttgagattgactactggcctctgctagatatgatgcccgcaaattccctgtacgggctgaacctcacttctctctcagtgacgaataccaatctgtccaccgtccctttcttggccttcaagcatttggtttatcttacacatctgaatttatcttacaaccccatttctactatcgaggccggtatgttcagtgaccttataaggctgcaggaactccatattgttggtgcccagcttcgcaccatcgagccccacagctttcagggactacggttcctccgtgtgttaaacgtgtcacagaacttattagagacactcgaggagaatgtcttttcgtctccccgagccctggaggtactgtcaatcaataataatccactggcgtgcgactgtcggctgctttggatcctgcagagacagccaaccctgcagtttggagggcagcaacctatgtgcgcaggcccagacaccatccgggaaaggtcatttaaggatttccactcgaccgcacttagcttctactttacatgtaagaagccgaagattagagaaaaaaaactccagcacctgctcgtcgacgaggggcaaacagttcagctggaatgtagtgccgatggcgatccccagcctgtgatttcttgggtaacacctcgcaggcgcttcattaccacaaagtcgaatgggagagctacagtcctgggagacgggacactggagattagatttgcccaggatcaggattccggcatgtacgtgtgcatcgcaagcaacgcggcaggcaacgacacgtttacggcctccctcacagtcaagggattcgcgtccgatcggtttctatatgccaaccgcacacccatgtacatgacagactccaacgatacaatctccaacggaaccaacgccaacacattctctttagacctgaagacaattctggtttccaccgctatgggatgtttcacatttctgggggtcgtgctcttttgcttcctgcttctgtttgtgtggagccggggaaaagggaaacacaaaaattccatagacctggaatatgtccccagaaagaacaatggggctgtcgttgaaggagaggtggccggtcccagaaggttcaacatgaaaatgatttag

SEQ ID NO: 228281 - DNA, 1779 bp, Artificial Sequence
  Description of Artificial Sequence: Synthetic coding sequence
atgacttgttggctgtgtgtgctctcactcccactgctgctgctcccagcagcacctccacccgctgggggttgcccagctcgctgtgagtgtactgtgcaaacaagagcagtggcttgcactagacggagactgaccgcagtgcctgacggtataccagccgagacacgcctgctggaactctctaggaacagaataagatgcctgaaccccggagacttagccgcattacctgctcttgaggagctggatctgtccgaaaacgccatcgcacacgtcgagccaggtgcctttgcaaatttgcctcgcctacgcgtactgaggctgaggggcaaccagcttaaactgatcccacccggtgttttcactcgtcttgataatctcacactcctggacctttctgaaaataagctagtgattctgctggattacacatttcaggacctgcatagcttacggagactggaagtgggggacaacgatctggtatttgtgtcgagacgcgctttcgccggactgctggcactggaggagctcacgctggagcggtgtaatctgacagccttgtctggggaatcattggggcacctgagatcgcttggggcactgcgcctccgccacctcgccatcgcaagcctggaagatcaaaattttagacggttgcccggactgcttcacctggagatcgataattggcctttacttgaagaagtggccgctggtagcctgaggggtttgaatctgacttcactcagtgtgactcatactaacatcacagcagtccctgccgcagcactgcgacatcaggcccacctcacgtgtctcaaccttagccacaatcctatcagcactgtgcctaggggctcctttagagatctcgtaagactgcgtgaacttcatctagctggagccctgctcgctgtggtggaaccccaggcctttcttgggttacgccagatccgcctgttgaacctcagcaacaacctattgtcaacactcgaggagtcaaccttccatagtgtgaacacccttgaaacacttcgagtcgatggtaatcctctggcttgtgactgtcggcttctgtggattgtgcagcggcgtaagacgctcaacttcgatggaaggctgccagcttgtgccactcctgcagaggtaagaggcgatgccctgcggaacctgcctgatagcgtgttatttgaatatttcgtatgccgtaagccaaagattcgcgagcgacgcctccaaagggtaacagccaccgccggagaagacgtgcgtttcttatgtagggccgagggagaacctgcacctactgtagcctgggtgaccccacaacaccggcctgtgacagctacatctgcaggtagggcccgtgttctacctggtggcacactggagatccaggatgccaggccccaggattctgggacctatacctgtgtggcatcgaatgccggagggaatgacacttacttcgccaccctcaccgttaggcccgagcctgcggcaaataggactcccggtgaagctcataacgagacgcttgccgcactcagggcacccttggatctcaccaccatcctcgtatcaacagctatgggatgtattactttcctgggcgtggttttattctgctttgtgctgcttttcgtctggtcccgcggacggggacagcataagaacaatttcagcgtagaatactctttccgcaaagtggacggacccgcagcagcggctgggcagggaggagcacggaagttcaacatgaaaatgatttag

SEQ ID NO: 228282 - DNA, 2172 bp, Artificial Sequence
  Description of Artificial Sequence: Synthetic coding sequence
atgccactcttctttcggaaacggaaaccgtctgaggaagcaaggaaacggcttgaataccagatgtgtctggcaaaagaagccggtgcggacgatatactcgatatttctaagtgcgagttgtctgaaattccttttggcgctttcgcgacctgcaaagtgctgcagaagaaggtgcttattgtccacaccaatcacctgactagcctgttacccaagagctgcagcctgctatctctcgccacaatcaaggttctcgacttgcacgacaaccagctgacggcccttcctgatgatttagggcaactcacagcccttcaagtgctcaatgttgagagaaatcaactcatgcagcttccacgttccataggcaacctgacccaattgcagaccctgaacgttaaagacaataaactgaaggagctgcccgacactgttggcgaactgagatctttaaggacacttaatatctcgggaaacgaaatccagaggctgccacagatgttagcacacgttagaaccctggaaatgctgagccttgacgccagcgctatggtgtacccccctcgggaggtgtgcggcgcaggcacggccgctattctacagttcctttgtaaggagtccggcctagaatattaccctccgtcccagtacctcctccccattctagaacaggatggaatagagaattcacgggatagccccgatggccctacagatcgtttttcacgagaggagttagagtggcagaaccgtttttctgactacgagaagagaaaggagcagaagatgctggagaagctggaatttgaaaggcgtctcgagcttggtcagagggaacatacgcagttgctgcaacagagtagctcccagaaggatgaaattctccagacagtcaaggaagagcagagcaggttagagcagggactctccgaacaccagcgccacttgaacgccgaaaggcaaagactgcaggaacagcttaaacagaccgagcagaacatcagctcccggatccaaaagctactgcaagacaatcagaggcagaaaaaatcttctgagatcctaaaatcgttggaaaacgagagaattcggatggaacagctaatgtcaataactcaggaggaaactgaatccttgcgcaggcgagacgttgcatccgctatgcagcagatgctcaccgaaagctgtaagaatcggctcattcagatggcttacgagtcccagcggcagaacctcgtgcaacaagcttgttcgtcaatggccgagatggatgaacgctttcagcagatcttatcatggcagcaaatggatcagaataaggcaattagccagatcctgcaggaatcggccatgcaaaaggctgccttcgaggcactccaggtaaaaaaagatctcatgcataggcagatacgatcacagattaagttaatagagacagagctcctccaactgacccagctcgagctcaagagaaaaagtctggacactgaaagcttgcaggagatgatcagtgagcagaggtgggccttatcttcccttctgcagcaattactaaaggaaaaacagcagcgcgaggaagagctgcgagagatcctcacagaactggaagccaagagcgagactagacaggagaactattggttaatccaatatcagaggctgctgaatcagaagccactgagcttgaaactgcaagaggaaggtatggagaggcagctggtggcgctcctggaagagttgagcgccgaacactatttacctattttcgcgcaccaccgcctgagcttggatttgctgtctcagatgagtccaggcgatcttgccaaggttggagtgagcgaagccggactgcaacacgaaatcttgcgacgagtgcaggagttgctcgacgccgctcgaatccagcccgaactgaagccacctatgggggaagtcgtgaccccaactgcacctcaggaacctccggagtcggttcggcctagcgcgcctcctgcagaacttgaggtgcaggcaagcgaatgcgttgtgtgcctcgaacgcgaagcacaaatgatcttccttaactgcggacatgtgtgttgctgccaacagtgttgccagcctttaaggacatgcccactgtgccggcaggatattgcccagagactgaggatctaccattcctcctag

SEQ ID NO: 228283 - DNA, 2172 bp, Artificial Sequence
  Description of Artificial Sequence: Synthetic coding sequence
atgccactgtttttcagaaagcgcaaacccagcgaggaggccaggaagagactagagtatcagatgtgccttgccaaggaggccggtgccgacgatatcctggatattagcaaatgtgaacttagtgagatcccatttggggctttcgctacttgtaaggtcctccaaaagaaagtcttaattgtgcacaccaatcacctgactagtctcctgcccaagagctgcagcctcctgtctctggccaccataaaggtgttggacttgcatgataaccaactgactgccctcccagacgatctgggccaacttaccgcccttcaggttctcaacgtggagcgcaaccaactgatgcagctcccacgcagcatcggaaacttgacccagctgcagactttgaatgtgaaagataataagcttaaagagctgcctgacacagtcggcgagctcaggagcttgagaaccttgaacatttctggcaacgagatccaacggctgccccagatgttggctcatgtgaggaccctagaaatgctgagcctggacgcctccgccatggtctatccaccccgagaagtgtgcggagcgggaaccgccgcaatcttgcagtttctgtgcaaggagtctggcctggagtattacccccctagccagtaccttttgccaatactcgagcaggacggtatcgaaaattctagagatagtcccgacgggcctaccgaccggttcagccgcgaggagctggaatggcagaataggttttctgattacgagaaacgaaaggagcagaagatgctcgaaaaactcgaattcgagcgacgacttgagcttggccagagggaacacacgcagcttcttcagcagtcaagctctcagaaggacgaaatcttgcagacagtgaaggaggaacaaagtcgcctggaacagggcctctctgaacaccagcgccatctgaatgccgagcgccagcgcctgcaagagcagctgaagcagaccgaacagaatatctccagccggattcaaaaactcttgcaggacaatcaaagacagaagaaatcctcagaaatactgaagtccctcgagaatgagcgcatacgtatggagcagttaatgtctattacacaggaggagaccgaaagcctcagacgccgagacgtggcatccgcaatgcagcagatgctgactgagtcctgtaagaaccgcctgatccagatggcgtatgagtcacagcgacagaatctggtgcagcaggcctgtagctctatggccgagatggatgagcgttttcaacagattctctcatggcagcagatggaccagaataaagcaataagtcaaatattacaggaaagcgctatgcagaaagctgcgttcgaggcattacaagtgaaaaaggatctgatgcatagacaaatcagaagccagatcaaattgattgaaaccgagctgttacagctcacccagctagaactgaaacgcaaatctctggacacagagtctctacaggagatgatatctgagcaacgctgggccctctcctctctgctccagcagctcctcaaggagaaacagcaaagagaagaagagctgcgagaaatcttgactgagttagaggctaaatcagagactagacaggagaattactggctgattcaatatcagagactgctgaaccagaagccgctgtctctgaagctacaggaggagggcatggagcgacagctggtcgcgctcctggaagaattgagcgccgagcactacctgcccattttcgcccaccacaggctgagcctcgacctcctgtcacagatgtccccaggcgacctagcaaaagtgggagtgtcagaggccggattgcaacatgagatccttcgcagggtacaagaactcttagacgcggctagaattcagcccgaattaaagccaccgatgggcgaggtggtgacaccaaccgccccacaggagcctcctgagagtgtgcggccaagcgcccctccagctgagttagaggtgcaggcttctgagtgtgtggtgtgcttggaacgggaagcacagatgatctttctcaattgcggccacgtatgttgttgtcagcagtgttgtcagccacttaggacttgtcctctgtgccggcaggatattgcgcaacggctgaggatctaccattcatcttag

SEQ ID NO: 228284 - DNA, 2172 bp, Artificial Sequence
  Description of Artificial Sequence: Synthetic coding sequence
atgcccttgtttttcaggaagaggaaacccagtgaggaggcccgtaagaggttagagtatcagatgtgcctcgctaaggaagctggagccgacgacatccttgatatctctaaatgcgaactctccgaaattccgtttggggcattcgccacatgtaaggttctccagaagaaagtgcttatcgtacacacgaaccacctcacatcactgctgcctaagtcatgtagtctcttaagcttggcaactatcaaggtgcttgacctgcatgacaatcagttgacagcccttcccgatgatctggggcagcttactgctctccaggtgttaaatgttgagaggaaccagcttatgcagttgccgcgaagcattggaaatcttacgcagctgcagacgctgaacgtgaaggacaacaaactgaaagagctccctgatactgtaggggaactccgcagtttgcggacacttaatatttcgggtaacgaaattcagcggttgccgcagatgctcgcacacgtgcggactcttgaaatgctctcactggatgcatccgccatggtttatccaccacgggaggtgtgcggcgcaggtacggctgctattctccaattcctctgtaaagaatctggtctcgagtattaccctcctagtcaatacctcctccccattctggagcaggacggcattgaaaactcccgggactccccggatggtcctaccgatcgattttcaagagaggagttggaatggcagaaccggttcagcgactacgaaaagcggaaagagcaaaagatgctggaaaagttagaattcgagcgccgactggagctgggtcagcgggagcacactcagctcttacagcagtcatctagtcagaaagacgagatcctccagactgtaaaagaggaacagtcacggctggaacagggactttcggagcatcagagacatctcaacgccgagcggcagagactgcaggaacagctgaaacagactgaacagaatatttctagcaggattcaaaaactgctccaggacaatcaacgccaaaaaaagtcctccgaaattctgaaaagtttggaaaacgaacgaatccgaatggagcagctgatgtccattacccaggaggaaaccgaatcgctcaggcgaagagatgtagccagcgccatgcagcagatgttgactgagagttgtaaaaacaggttgatccagatggcttatgagtctcagcgacagaacctggtccagcaagcttgtagcagcatggccgaaatggatgagcggttccagcagattctgagttggcagcagatggaccagaataaagcaatctcccaaatactccaggagagtgctatgcagaaagcagccttcgaggctctccaggtgaaaaaggacctgatgcaccgccagattagatcacagatcaaactgatagagaccgagcttttgcagctgacacagcttgaactgaagaggaagagcttggatacagaatcgctgcaagagatgattagcgagcagagatgggccctgagctccctactgcagcaacttcttaaagaaaaacagcagcgggaagaagaactgcgcgagattttgacagagctggaagcaaagagcgagacacgacaggaaaattactggctgattcagtatcagagactgctgaaccagaagcctttatctttgaagctccaggaagagggaatggaaaggcagctcgtggcactccttgaggagctgtcagctgagcactatctgcccatttttgcccatcaccgtctctctcttgacctgttgtcccaaatgtctcccggagacctggccaaagtgggtgtctctgaggccggattgcagcacgaaatcttacgccgtgtgcaggaattactggatgcagctagaattcaaccagaattaaagccacctatgggtgaagttgtaacccccaccgcgcctcaggaacccccagaatccgtccgaccctccgcgccacctgctgagctcgaggtgcaggcatctgaatgtgtggtctgcctagaacgagaagcacagatgatcttcctaaactgcggccacgtgtgctgttgtcagcaatgctgtcagccactccgaacatgccccctgtgcaggcaggacatcgctcagagactcaggatctatcatagcagctag

SEQ ID NO: 228285 - DNA, 2091 bp, Artificial Sequence
  Description of Artificial Sequence: Synthetic coding sequence
atgccactcttctttagaaagcgaaaaccttcagaagaggctaggaagaggctggaatatcagatgtgtctcgcgaaggaagccggtgcagatgacatccttgatatttccaagtgtgagctgtctgagattccatttggtgcttttgctacctgtaaagttttacagaaaaaagttttgatagtgcataccaatcacctcacttcactactgcctaaaagctgctctctgctttccctggcgactattaaggtgctcgatcttcatgacaaccaactgaccgctctgcccgatgacctcgggcaactgactgccctgcaggtgttgaatgttgaacgtaaccagctcatgcagttgccacggtctatcgggaacctgacgcaactccaaaccctcaacgtgaaggataacaaattgaaagagctgcctgacaccgtaggcgagttgagatcactccgcactcttaatatctccggcaacgagatccaacggctgccgcagatgctggctcacgtcagaacactggagatgctaagcttagatgctagcgctatggtctacccaccacgagaggtatgcggggctggaacggccgctatcctgcagtttctctgtaaagagagcgggctggaatactatcccccatcccaatatctactacccattttagagcaggatggaatcgagaattcacgagattccccagacggacccaccgaccgcttctctagggaggagcttgaatggcaaaatcgcttcagtgattatgaaaaaaggaaagaacagaaaatgctggagaaattagaattcgaacggagattagaacttggacagcgggaacacacacagctgttacaacagtcttctagccagaaagacgaaatcttgcagaccgtgaaggaggagcaaagcagactggaacagggactgagcgagcatcaacgccatctaaacgctgagcgacaacgcctacaagagcagctaaaacagaccgagcagaacatttcgagtagaatccagaaactgttacaggacaaccagcggcagaagaaatcctcagagatcctgaaatcactggagaacgaacggattagaatggagcagctgatgagtattacacaggaggaaacagagagcctgagaaggagagatgtggcttctgcgatgcaacagatgttgacagaaagctgcaaaaatcggctgatccagatggcatacgaatctcagcgccaaaacctggtgcagcaggcttgcagcagcatggccgagatggacgaacgctttcagcagatcctcagctggcaacagatggatcagaataaggcgatatcgcagatcctgcaagagtctgcgatgcagaaggccgcattcgaagcgcttcaggtcaaaaaagacctgatgcaccgacagattagaagccaggagatgatatctgaacaacggtgggcactaagctccttattgcagcagcttctcaaggagaaacagcagcgagaagaagagcttcgggaaattctgactgagctggaggcaaagtcagaaacccggcaggagaactactggctaattcagtaccagcgtttacttaaccagaaaccactgtctctgaaactgcaggaggagggcatggaaaggcagcttgtggctctcctcgaggagctgtctgccgaacattatttgcctatttttgctcatcatagactcagtctggacttgctctcccagatgtctcctggcgatctggcaaaggtgggcgtctccgaggcaggactccagcatgagattctccgacgggtacaggaactccttgatgccgctcgtatccagcctgagctcaagccccctatgggagaagtggtgaccccaactgcccctcaggaaccaccagaaagcgtacgcccatcagcgccaccagctgaattggaggtgcaggcctccgagtgtgttgtgtgcctggaacgcgaagctcaaatgatttttctgaattgtggccatgtatgttgctgccagcagtgctgtcagccccttaggacctgtcccctgtgcagacaggacatcgctcagaggctccggatttaccattccagttag

SEQ ID NO: 228286 - DNA, 465 bp, Artificial Sequence
  Description of Artificial Sequence: Synthetic coding sequence
atgttccactgcatcccactgtggcgctgcaatcggcatgttgaatccatagacaagcgacactgttccctggtttacgtgcccgaggaaatctaccggtatgcaagaagcctggaggagctgctcctagatgctaaccagcttagagaactcccagaacagtttttccagctagtaaagcttcgaaagctgggactgagcgacaatgagatacagcgcctgccgccagagatcgcgaacttcatgcagttagtggaactggatgtcagccgcaatgagatcccagagatccctgagtctattagcttctgcaaagcgttacaagtcgctgatttcagtggaaatcctctgactaggctgccagagagtttcccagaattgcaaaacctgacctgtttatccgtgaatgatattagtttgcaaagcctgcccgagaacattggcaagcagaaaacgacaagttag

SEQ ID NO: 228287 - DNA, 1575 bp, Artificial Sequence
  Description of Artificial Sequence: Synthetic coding sequence
atgttccattgcattcccttgtggaggtgcaacaggcacgtggagagtatagataagcgacattgcagtctagtgtatgtgcctgaagagatctatcgttacgcacggagcctagaagagctcctcctggatgcgaatcaactgagagaactgcccgaacaatttttccagctggtgaaactgagaaagttagggttatcagataacgaaattcagagactcccccctgagattgcaaatttcatgcagcttgttgaattggatgtttcccggaacgagattccagaaattcctgagtccatttccttctgtaaagctttacaggtggctgatttctcaggtaaccctcttacacggcttccagagtccttccctgaactccaaaacctcacgtgtctgagtgtaaacgacataagcctgcagagcctccccgaaaatattggaaatttgtacaacttggcatctctggagctgcgagaaaatcttctgacctatcttccagattcacttacccagctccgtagactggaggagctggatcttggaaacaatgaaatttacaatctccctgagtccatcggagccctactccatcttaaagacctctggcttgacggtaatcagctgtcagagctgccacaggagataggcaacctcaaaaatctgctgtgccttgatgtctcagaaaaccgccttgagagacttccagaagaaatcagcggtctgaccagcctgaccgaccttgtgatcagccaaaatcttctggagacaataccagatgggatagggaagctgaagaagttaagtattttaaaagtggaccagaatcggctgactcagttgcctgaggccgtcggtgagtgcgagagcttaacggagctggtgttaactgaaaaccagttgctcactttgccaaaatctataggcaagctcaagaaactctctaacctgaacgcagaccgcaataagctcgtgagcctgcccaaggagatcggcggatgttgctccctcactgtcttttgcgtcagggacaacagactaacaaggatacccgctgaggtgagccaagcaactgaactacatgtcttagacgtagccggtaaccgactcctccacttaccgctgagcttgactgccttgaagctcaaggctctgtggctgagtgacaaccaatcacagcccctgctaaccttccagacagataccgattatacaaccggtgaaaagatcctgacatgcgtcctgctaccccagctgcccagcgaaccaacttgccaagaaaatctgccacgctgtggcgctcttgagaatctagttaatgacgtgagcgacgaggcctggaatgaaagagcggtcaaccgcgtctctgccatacggttcgtcgaggacgaaaaggatgaggaggataacgagacccgaaccctactgagacgggcaaccccacatcccggagagcttaagcatatgaagaaaacagtggagaacttgcgtaatgatatgaacgcagctaaggggctggacagcaacaaaaacgaagttaaccatgctatagaccgggttaccaccagcgtctag

SEQ ID NO: 228288 - DNA, 834 bp, Artificial Sequence
  Description of Artificial Sequence: Synthetic coding sequence
atggggaacacaatacgcgcactggtagcgtttattccagcagaccggtgtcagaactacgttgttcgcgatctgagggaaatgccactggacaaaatggtcgatctctccggtagccagcttagacggtttcctttgcatgtttgctcatttagagagctggtgaagctgtacctttctgacaaccacctcaattcactgcctccagagctaggacagttgcagaatttgcagattctggccctcgacttcaacaattttaaggcactgccgcaggtcgtttgcacactgaaacagttgtgcatcctgtatctaggtaacaacaagctgtgtgacctcccgagtgagctgtctctgctgcagaatctgaggacactgtggatagaggcgaactgtcttactcagttgcccgacgttgtgtgcgagctctctcttctgaagacccttcacgccggtagcaacgctctccggctactgcctggtcagcttaggcgcctgcaggagctgcggacgatctggctgtcgggaaacagattgaccgatttcccaaccgtgctcctgcacatgccttttctggaggtgatcgatgtcgactggaatagtatcagatactttcctagcctcgctcatctctctagcctcaaactggtcatttacgatcacaacccctgtagaaacgcaccgaaggtcgcgaagggagtacggcgagtcggccgttgggctgaggagaccccagagcctgatccccgtaaagcccgacgctatgcgctggtgcgggaagagtctcaggagttgcaggcccctgtcccactactgccccctactaactcctag

SEQ ID NO: 228289 - DNA, 4116 bp, Artificial Sequence
  Description of Artificial Sequence: Synthetic coding sequence
atgaccgaagagtcgtctgatgtccccagggagcttattgagagtatcaaagacgtcattggcaggaaaattaagatatctgtaaaaaagaaagtaaagttggaagtgaagggcgataaagtcgaaaataaagtgttggtactaactagctgtagggctttcctggtgaccgcacgcataccaaccaaactggaacttaccttctcctaccttgagattcacggcgttgtgtgctcaaaatccgctcagatgatcgtagaaactgagaaatgcagcatctctatgaaaatggcctctcctgaggatgtgtccgaggtgttggcacacattggtacatgtctaagaaagatctttccagggttgtccccagtccggattatgaagaaggtctcaatggagccgtccgagagactagcctcactccaggcattgtgggactctcagacagtggcagagcaaggcccttgcggcggattctcccagatgtatgcctgcgtgtgcgactggctcggattttcataccgcgaagaggtgcagtgggacgtcgataccatatatttaacacaggatacgcgtgagcttaatctgcaggatttctctcatctggaccatcgcgatctgattcctatcattgccgcattggagtataaccagtggttcacaaagctgtctagcaaggacttgaagctttctactgacgtctgcgagcaaattctgcgcgtggtgagccggtccaacagactggaggaactcgtgcttgagaatgctggcctacgcaccgactttgctcaaaaactggcctctgcgctggcccataaccctaactcaggtctacacacgatcaatctcgccggtaatccacttgaggaccgcggtgtgtcttcactttcgattcagttcgccaaactgcccaagggactaaaacacctcaacctgtccaagacgtcattgtcacccaaaggggtgaatagcctgtcccagtcgctgagtgctaacccgctaactgcatccaccctggtgcacctcgatttgagcggcaatgtgttgcggggtgacgacttatctcacatgtataactttctggctcagcctaacgccatagtgcatctcgatctcagcaacacagagtgctctcttgacatggtgtgcggggcactcttaaggggttgtctgcaatacttggcggtgctcaacctgtcccgcaccgtgtttagtcatcgaaaaggaaaagaggtgccaccctcctttaaacaattcttttctagcagcctggccctcatgcatatcaatttgtccggtacaaaattatctccagagccactcaaggccctactgctgggactggcgtgcaaccataacctaaaaggagtctccttggatctgtctaactgtgaactgcggtccggcggtgcccaggttctggaaggatgtattgccgagatacacaacattacctctctggacatcagcgataatggcctggaatccgacttaagtactctgattgtatggctgtcaaagaataggagtattcaacatttagctctgggtaagaacttcaacaatatgaaaagtaaaaatctgaccccagtcttggataacctggtgcagatgattcaagatgaggagtcacctctgcaaagcctctccctcgccgatagtaagctcaaaacagaggtaaccataattataaatgctcttggcagtaatacctctctgacaaaggtggacatcagcggcaatggaatgggggacatgggagccaagatgctagcaaaggctctccaaattaacacaaaactgaggacagtgatctgggacaaaaataacattacagcacagggtttccaggatatagctgtcgctatggaaaagaactatacactgcgcttcatgcctatcccaatgtacgatgcatcgcaggctctcaaaactaacccggagaagaccgaagacgccctgcagaaaattgaaaattacttactgagaaaccacgaaactcgaaaatatctgcaagagcaggcctacagacttcagcaagggatcgtaacgagtaccacacagcaaatgatcgatcggatctgcgtaaaagtgcaagaccaccttaactctctgcgcaattgcggtggcgatgctatccaagaggatttgaaatcagccgagaggctgatgcgtgacgctaagaatagcaaaaccctactccctaacctgtaccatgtcggcggtgcttcttgggcaggggcttcaggactgctctccagccccatacaggagactctggagtccatggccggagaggtgacacgggtggttgacgagcaattgaaggccctgctggagtccatggtggacgcagctgagaatctctgcccaaacgtgatgaaaaaggcacatatacgacaagacctgatccatgcatctacagagaagatttccattcccaggaccttcgttaagaatgtgttacttgagcaatccggaattgacattttgaacaaaattagcgaagtgaaactgacggttgctagtttcctgagtgatcggatcgttgacgaaattcttgacgcacttagtcactgccatcataagctagctgaccacttctcaagaagagggaagactttaccacagcaggaaagccttgaaattgagctagccgaggagaaaccagtgaagcggagtataattacagtcgaggagctgaccgaaatcgaacggctggaagatctcgacacatgtatgatgacacccaagagtaaacgaaagagcatccacagtagaatgctgcgccctgttagcagagcgtttgagatggagtttgatctggacaaggctcttgaggaggtgccaatccatattgaagatccaccatttccctcgctgcggcaagagaaaagatcctccggatttatttctgagttgccttccgaggagggtaaaaaacttgagcatttcaccaagttgcggcctaagaggaacaaaaagcaacaacccacgcaagctgcggtgtgcgccgctaacattgtgagtcaggacggggaacagaatggattgatgggacgggtggacgaaggcgtcgacgagtttttcacaaaaaaagtgacaaaaatggactctaagaagtggagcacccggggttcagagtcgcacgagttaaacgagggcggagacgaaaagaaaaagcgggactctcggaagtcttccggctttctcaatctgatcaaaagccgcagtaaatcggaacgtccacctacgattcttatgaccgaagagccaagcagccctaaaggggcagtgcggagtcctcccgtcgattgtccaaggaaggacaccaaagctgccgagcacaatggaaatagcgaaagaatcgaggaaatcaagacccctgacagttttgaggaatctcaaggcgaagaaatcggtaaagtggagaggtctgacagcaagtcatccccccaggcaggaaggcgttatggcgtccaggttatgggatctggactgctggccgagatgaaagccaagcaagagaaaagggccgcttgtgcccaaaagaaactcggtaatgatgctgtatcccaagacagcagcagccccgcacttagcggcgtggaaaggagtgacggaggcggtgcagtccctaaactgcaccccggactacctgagaaccgattcggcctgggaacccccgaaaaaaatactaaagccgagccaaaggcagaagctggctccagatccagaagctctagtagcacacccacttcacccaagcctctgctgcagtccccaaagccatcacttgctgctcggcctgttatcccacagaagcccaggacagcatcccgcccagatgacattcctgacagtcctagcagccccaaggttgccctacttccacccgtgcttaaaaaagtcccaagcgataaggagagggacggtcagtcctcaccacaacctagtccccgtaccttttcccaggaggtgagtcgcagatcatggggtcagcaggcacaggaataccaggagcagaaacaacggagtagcagcaaagacggtcatcaggggtcgaagtccaacgactcgggtgaagaggccgaaaaggagttcatttttgtatag

SEQ ID NO: 228290 - DNA, 531 bp, Artificial Sequence
  Description of Artificial Sequence: Synthetic coding sequence
atgtacgcatgtgtttgtgattggctgggattttcatacagagaagaggtgcagtgggacgtggatacgatatacctgacgcaggacacccgcgaactgaacctgcaggacttctcacacctggatcatcgggatctgattcctatcattgccgctctggagtacaatcagtggtttaccaaactgtctagtaaggacctgaagttgtctacggatgtatgcgaacagattctgcgcgttgtctcacgaagtaaccggctggaggagttggtgctcgagaacgcagggctgcggaccgattttgctcagaaattggcgagtgccctggcacataacccgaatagcggcctgcataccattaacctcgcgggaaacccactcgaagatagagaaacaaccactaagatcaaacgccagaacgtacccaccgtgctccagacttatctagtggtttgcccctcagattatcagccatgtcctctcccattgggcaaggataattactactcagactttagtcacgacggatag

SEQ ID NO: 228291 - DNA, 3981 bp, Artificial Sequence
  Description of Artificial Sequence: Synthetic coding sequence
atgacagaggaatcaagcgatgttcctagagagctgatcgagtccatcaaggatgtgatcggtcggaaaatcaagatctcagtgaaaaaaaaggtgaagctcgaggtcaagggagataaggtagagaacaaagttctcgtgctaactagttgtcgcgctttcttggttactgcacggattccgactaagctcgaactgacgttcagctacctcgagattcacggcgtggtgtgtagtaagagcgctcagatgatcgtggaaaccgaaaagtgctccatttccatgaaaatggcgagtccagaggacgtgtccgaagtgctggcccacataggaacatgtctgcgcaagattttccccggattgagtcctgttagaattatgaaaaaggtatctatggaaccatcagagcggctggcttccctccaagccctttgggattcgcagactgtggcagagcagggcccatgcgggggattctctcaaatgtatgcttgcgtatgcgattggctcggctttagctatcgagaggaggtgcagtgggacgtggatacaatctacctgacacaggacactcgcgaactgaatctacaggatttctcacacctagatcacagagatttgatccccatcatagcagccctggaatataaccaatggtttactaaattatcgtcgaaagatctgaagctgtccactgacgtgtgcgagcagattcttagagtcgtgagcagatccaataggctggaggagctggtactggagaacgcgggattgcgtactgatttcgcccaaaaacttgcatcagccctcgctcacaatcctaacagtggactgcatacaatcaacctggctgggaacccacttgaggatcgcggagtcagttctctttccattcagttcgctaaactgcccaaggggctcaagcacttaaacttgtctaagacctcactgtctcctaagggcgtaaattcactgtcccagtcactgagtgcgaaccccctgaccgcaagcacgctggttcatcttgatctgtctgggaatgtgctgcgcggagacgatttgagccacatgtacaacttcctggctcagcccaatgccatcgtccatctggacctttctaatactgagtgttctcttgacatggtctgtggcgcactcctgcggggatgcctccaataccttgccgtgctcaatctgtcccgtaccgttttctcccatagaaagggaaaggaggtgcctcccagtttcaaacagtttttttcgtcctcgctggccttgatgcatataaatctcagcgggaccaaattatcaccagaacccctgaaagccctgctgttggggctggcatgtaaccacaacttgaagggtgtgagcctagacctgtctaactgtgaactcagatctggcggagctcaagtgttggaaggatgcatcgcagaaatccataacatcacctccttggatatcagtgacaacggcctcgaatcagacctgtcgacactgatcgtgtggctgagcaagaaccgctccatccaacacttagccctaggcaagaacttcaacaacatgaagtctaagaatctgacaccagtactggataatctagtacagatgatacaggacgaggagagcccgctgcagagcctgagcttggccgatagcaagttgaagacagaggtaacaatcataataaatgccctcgggtccaacacgagccttactaaggtagacattagtggcaacggaatgggtgatatgggagccaagatgttggcaaaggctctgcagattaatactaagttaaggactgtcatatgggacaaaaataatataaccgcccagggattccaggatattgcggtcgcaatggaaaaaaattacacactgcgctttatgccaatccctatgtacgatgccagtcaggcgctgaagaccaaccctgagaagacggaggacgctctacagaagattgagaactacctactgcgcaaccacgagaccaggaaatatttgcaggagcaggcctaccggctgcagcaggggatcgttacttcgactacccagcagatgatcgatagaatatgtgtgaaggttcaggatcatttaaattctcttcgaaattgtggaggtgacgccatccaggaagacttaaagtccgcggaacggctgatgcgggacgcgaagaactctaagacccttttacctaacctttaccatgtcggcggagcgtcatgggcaggagcttctggcctcctgtccagcccaatccaggagactctggaatcaatggctggggaagttacccgggttgtagatgagcagcttaaggcactgctcgagtctatggtagatgctgcagagaatctctgccctaatgtgatgaagaaggctcatatacgacaggacctcatccacgcctcaactgagaaaattagcattccaagaaccttcgtcaagaatgtactgctggagcaaagtgggatcgatatccttaacaagatcagtgaggttaagctgacagtggccagtttcctgagtgaccgcatcgtggacgagatattggatgcactgtctcactgtcatcacaagctggccgatcacttttcccgaagggggaagactttaccccagcaagaaagtttggaaatcgagcttgcagaagaaaaacccgtcaagagatccatcattactgtggaagaactgactgagatcgaacggctcgaagatctggatacctgtatgatgacgcctaagagtaagaggaaatcaatccactcacgcatgttgcgacctgtaagcagggccttcgagatggaattcgatttggacaaggcccttgaagaggttccaatccatatcgaggaccccccattccccagcctgaggcaggagaaacggagctcgggctttatttcagagctgcccagcgaggaggggaaaaagctagagcacttcaccaaactccgccctaaacgaaacaagaagcagcaacctacacaggctgccgtgtgtgcggctaacattgtcagtcaggacggggagcagaatgggttgatgggcagagtcgatgagggcgtggatgaatttttcacaaagaaagtgaccaagatggatagcaagaagtggtccacaaggggaagtgagagccatgaactgaatgaagggggtgatgagaagaagaaacgagactcccgcaagagtagtgggttccttaacctgattaagagtcgctctaaatccgaaaggcctccaactatcctgatgaccgaagaaccttcttccccaaagggcgctgtgagatccccaccggtggattgtccccgtaaggacactaaagctgctgagcacaacgggaactctgagagaatcgaggagatcaagacgccagatagctttgaagagtcccagggagaggagattgggaaagtggaacggtcagatagtaagtctagcccccaggctggacggcgttatggcgtgcaggtgatggggtctggacttttggcagaaatgaaggcaaagcaggaaaatagatttgggctgggaacaccagagaagaatacgaaggcagagcctaaggccgaggcagggtccagatcacgctcttctagtagcaccccgacctctccaaagccactactacaatcaccaaagccttccctagccgctcgtccggtcatcccccagaagcccagaactgcgtctagaccagacgatattcctgactcaccaagctctcccaaagtggccctgctgcctccagtgctgaagaaggtccctagtgacaaggaaagggacggacaaagttcacctcagcctagccccagaacgttttctcaggaggtctctcgcagaagttggggacagcaagcccaggagtaccaggaacagaagcaaaggagttcttcaaaagatggacatcagggcagcaaatctaacgactcaggggaagaggctgaaaaggagttcatcttcgtctag

SEQ ID NO: 228292 - DNA, 1116 bp, Artificial Sequence
  Description of Artificial Sequence: Synthetic coding sequence
atgggacacaaggtcgttgtgttcgacatatctgtcattcgggctctgtgggagactcgggtcaaaaagcataaggcttggcagaagaaggaagtcgagcgcctggaaaagagcgcgctcgagaagatcaaggaggaatggaattttgtcgctgagtgtaggcgcaaagggattcctcaggctgtctattgcaagaatggcttcattgacacctcagtgcgactgctagacaaaatcgagcgcaatactctaactcggcagtcatccttaccaaaggaccgaggcaaacgttcatctgcattcgtgttcgagctttccggagagcattggacagagttaccagacagccttaaagaacagacccacctgcgcgagtggtatatctccaacactttgattcagattattcctacctacatccaactcttccaggctatgagaattctcgatcttccaaagaatcaaatctctcacttgcccgctgagattgggtgtcttaaaaatctaaaagaacttaatgttggcttcaactatctcaagagtatcccccctgagctgggagactgtgagaatctcgagaggctggactgttccggtaatctagaattgatggagctgcctttcgagctctctaacctgaagcaggtaactttcgtggacatttcagccaacaagttcagctccgtgccaatttgtgtcctccgaatgtctaatctgcagtggcttgatatttcatctaacaacctgaccgatctgccccaggatatcgacagattagaggagctgcagtccttcctgctttataagaataagctgacctacctgccttatagtatgctgaacctgaagaagctgaccttgttagtggtcagtggcgaccatctggttgaacttcccacggccctctgcgactcctccactccccttaaattcgtaagcctcatggacaatccaattgataacgcccaatgtgaagacgggaacgaaattatggaatccgagcgggatcgccaacactttgataaagaggttatgaaggcgtacatagaagacctcaaggagagggagtcagtgcccagctatacaaccaaggtgagcttcagcctccagctgtag

SEQ ID NO: 228293 - DNA, 1116 bp, Artificial Sequence
  Description of Artificial Sequence: Synthetic coding sequence
atgggacataaggtcgtggtcttcgacatttctgtcatcagagccctatgggaaacgcgggtgaagaagcacaaggcctggcaaaaaaaagaggtggagcgcctggagaagtcagcccttgagaaaattaaggaagagtggaattttgttgcagaatgtcgtagaaagggaatcccccaggctgtgtattgtaaaaacggatttattgacaccagcgtacgactactggacaaaattgaaaggaacactttaaccagacagagcagcctgcccaaagaccgtggcaaacgcagctcagcttttgtgttcgaactgtctggagagcattggactgagctgcctgacagcctgaaagagcagacccacctgcgggagtggtatatttctaacacattgatacagataattccaacctacatccaactgttccaggccatgcggatcttagatttgccaaaaaatcagattagtcacctgccggctgaaataggctgcctgaaaaatctgaaagagctcaatgtgggcttcaattatctgaagagcatcccaccggagctcggagactgcgagaacctagaacgcctggattgtagcggaaatctcgaacttatggagttacccttcgaactgagcaaccttaagcaggttacttttgtggacatatctgccaataagttctcttctgtgcctatctgtgttcttcgcatgagcaacctgcagtggcttgacatttccagcaacaatttaactgacttgcctcaggacatagatcgcttggaagagctgcagtctttcctactgtataagaataagttaacatacctcccctacagtatgctgaatctaaagaagctgaccctgctggttgtcagcggtgatcacctggtggaattgccaaccgcgttgtgcgattcctccacacccctcaagtttgtcagcctgatggacaatccgatcgacaacgcacagtgcgaggacggaaatgagatcatggaaagcgagcgggatcgccagcacttcgacaaggaagtaatgaaggcttatatcgaggaccttaaagagagggagagcgtaccctcttacactaccaaggtttcattcagcttgcagctttag

SEQ ID NO: 228294 - DNA, 918 bp, Artificial Sequence
  Description of Artificial Sequence: Synthetic coding sequence
atggggggtaccttagcctggaccctcctccttcctctgctgctgcgtgagtcagatagcctggaaccatcatgtacagtgtcctccgccgatgtggattggaacgccgagttcagtgcaacctgcctcaacttctccggtctgtcactctctcttccccacaaccagtccctgagggcgagcaatgtgattctcctggatctctccgggaacggcctccgtgagctgccagttacatttttcgcacacctgcaaaaactggaggtgcttaacgtcctgcggaacccactgagtcgcgtggatggggcactcgctgcgcgatgcgatctcgacctgcaggcagactgcaattgtgctttagagagctggcacgacatcagacgagacaactgctccggtcagaagcccttgctttgttgggacacaaccagttctcagcataacctgtcagccttcctcgaagtgtcatgcgctccaggtctggccagtgctactatcggggctgttgtagtatccgggtgcctgctactgggtttggccatcgccggtccggtactggcttggcgtctttggagatgtcgcgttgcgaggtccagagagctgaacaagccttgggctgctcaggatggccctaagcctggactcggcctgcagccaaggtacggctcacgcagcgcgccaaaacctcaggtcgccgtgccctcttgcccctctacccctgactacgagaatatgtttgttggccagcccgctgcagaacaccagtgggatgagcaaggggcacatccttcggaagacaatgatttctacattaactataaagacatcgatcttgctagccagccagtctattgcaacctccaatcccttggacaggccccaatggacgaagaagaatatgtaatcccaggacactag

SEQ ID NO: 228295 - DNA, 1005 bp, Artificial Sequence
  Description of Artificial Sequence: Synthetic coding sequence
atgagagggccatcttggagcagaccgagaccactgctgttactgctcttactgctgtctccctggcccgtctgggcccaggtatccgccaccgcctctccttcaggctccctgggggctcccgactgccctgaagtgtgtacatgtgtaccaggtgggctggcttcatgctccgctctgtccttgcctgccgttccccctggactctcactgcgcctgagggcgctgctgctcgaccataatagagtaagggctctccccccaggagcatttgccggtgcaggagctctgcagaggcttgacctccgggagaatggcctccattccgtgcacgtaagggccttctgggggctgggtgcactacagctgctggaccttagtgctaaccagctggaagctttggccccagggacttttgccccattgcgggcattgcgaaacctttcgctcgcagggaaccgccttgcccgactcgaaccagcagcactgggcgctctcccattgctgcggagcctctccttgcaggacaacgaactcgccgctcttgcacctggtctgctgggcagattgcctgcactcgacgcgctgcacctaaggggcaatccttgggggtgtgggtgcgctctgaggccattgtgtgcctggctccgaagacacccccttcctgccagcgaagcagaaacagtgctgtgcgtctggcccggacgtctcaccttgtcacccttaaccgctttttctgatgctgccttctctcattgcgctcagcctttggccttgagggaccttgcagtggtatacacactgggtcctgcctccttccttgtttctctggcatcctgtctggctctggggagcggcctgacagcatgcagggcccgacgtaggcggctgaggaccgcggcattgcgtccacctcgacctcctgatccaaatccagaccctgatccccacggctgcgcctcaccagccgatcctggcagcccggcagctgcggctcaggcctag

SEQ ID NO: 228296 - DNA, 1923 bp, Artificial Sequence
  Description of Artificial Sequence: Synthetic coding sequence
atgctaaataagatgacactgcatccccaacaaatcatgattggacccagatttaatcgtgccctgttcgacccattactggttgtcctgctggcactgcagttactcgtggtggccggacttgtccgcgcacaaacatgcccctctgtttgctcatgttccaatcaattctcaaaggtgatctgcgtgcgcaagaatttacgggaggtgccagacggaatttccacaaatactcgactgctgaacttgcacgaaaaccagatacagattataaaagtcaattcgtttaaacacctgaggcatctggaaatactccaactcagtcgtaaccacatccgcacaatcgagatcggcgctttcaatggcctcgccaacctcaatacccttgagcttttcgacaatcggcttaccaccatcccgaatggcgcatttgtctatttgtctaagcttaaggaactttggctgcgcaacaaccctatcgagagtataccatcatacgcttttaacaggataccaagcctgaggagactggatctgggcgagttgaagaggctgagctacatttcagaaggcgctttcgagggactgtcaaacctgagatatctgaacctagccatgtgtaacctcagggagatcccgaatttgacccccctgatcaagctggacgaacttgatttgtccggtaaccatttgtctgcaatacggcctggcagctttcagggactgatgcacctgcagaagctctggatgattcagtcgcagattcaggtcattgagcgcaatgccttcgacaatttgcagtcattggtggagatcaatctggcgcacaataacctcactctcctgccccacgacttattcaccccccttcatcatctggaaagaattcacctgcaccataacccttggaactgcaattgtgacattctctggctctcttggtggattaaggacatggccccttctaatacagcatgctgcgctcggtgtaacacaccacctaatttgaaaggtcggtatataggagaactggaccaaaattacttcacctgctacgccccagtcatagttgaaccacctgcagatcttaacgtgacagagggaatggccgcagaattaaaatgtcgcgcaagtacctccttgacaagcgtaagctggataactccaaacggcactgtgatgactcacggggcttataaggtgaggatcgcagtgttatccgacggaaccctcaacttcaccaacgtgaccgtgcaggacaccgggatgtatacctgtatggtcagtaattcagtggggaacactactgcaagtgcaacactaaatgtaaccgcagctacgactacgccttttagctacttctcaaccgtgactgtcgaaactatggagccttcccaggacgaggcccgaaccaccgacaataatgttggcccaacaccagtagtcgactgggaaacaactaatgtaaccactagcctgactccacagtcgactaggagtaccgagaaaacttttacgatcccagttactgatataaactcaggaatcccaggtatagatgaggtgatgaagaccactaagatcattattgggtgtttcgtcgctatcaccctgatggccgcagtcatgctggtgatattttacaagatgagaaagcagcaccaccgccagaaccaccatgcgcctactcggaccgtggaaattatcaatgtggatgatgaaatcacaggagatacaccaatggaatcccatttgccgatgccagcaattgaacatgagcatctgaaccactataatagctataaatctccattcaaccatacaacaacagtaaacacaatcaacagcatccattcctcagttcacgagcccctgttaatcagaatgaatagcaaggataatgtccaggaaactcagatttag

SEQ ID NO: 228297 - DNA, 1923 bp, Artificial Sequence
  Description of Artificial Sequence: Synthetic coding sequence
atgttgaataagatgaccctgcaccctcagcagatcatgatcggccctcggtttaatcgcgcactcttcgatcctctgctggtcgttctcctggccctccagctgctggtggtggccggactcgtgagagcccaaacatgtcctagcgtctgttcttgttctaatcagttttcaaaggtaatttgtgtacgcaaaaatttgcgggaggtgcccgacggaatttctacaaacacacgcctgctgaacctgcacgaaaatcagatacagataatcaaggtgaacagctttaagcacctgcggcacctggagatcctgcagctgtccagaaatcatatcagaactattgagatcggtgcctttaacgggctcgctaatttgaataccctggagctgttcgacaaccgcctgaccactatcccaaacggtgcatttgtgtatttgtccaagctgaaggaattatggctccgcaataatcctatcgagagcatcccgtcgtacgccttcaatagaatccctagcctcagaagactcgacctcggcgaactgaagcggctctcatacatttcggaaggagcattcgaaggcttgtcaaatctacggtatctgaacttggccatgtgcaacctccgcgaaattcccaaccttacacctttaattaagctggatgagcttgatctatcaggaaatcatctgtccgctatcaggcctggctctttccagggtctcatgcacctgcagaagttatggatgatccaatcccagatccaggtcattgaaaggaacgccttcgataacttacagtcactggtggaaattaatctggcccacaacaatctcactctacttccccacgacctgttcaccccccttcaccacctggagcgtatccaccttcaccacaacccctggaattgcaattgcgacatcctatggctgagttggtggatcaaggacatggccccatccaataccgcctgctgcgcgagatgcaacacaccaccgaatctgaagggtcgctatatcggcgagctggatcagaattatttcacctgttacgcacctgtgattgttgaaccacccgctgatctcaatgtgaccgagggaatggcagcagaactgaaatgcagagcttctacctcactcacatctgtctcctggattacccctaatggaactgtcatgactcatggtgcttataaagtccggatagccgtgttgtccgatggaacccttaacttcacaaacgtgactgtgcaagatactggcatgtacacgtgtatggtgtcaaactccgtggggaacacaaccgccagtgctaccctgaacgttaccgccgctaccacgactccattctcttatttctctaccgtcacagtcgaaactatggaaccctcccaggacgaggcacgaaccacagacaacaatgtcggacccactccggtggtcgactgggagacaacgaatgtgactacctccctgactccccagtctacccgaagcactgaaaaaacatttactatcccggtgacagatattaactccgggattcctggcatcgacgaggtcatgaagaccaccaagatcatcataggttgttttgtcgccatcactctgatggcagccgtgatgcttgtgattttttacaagatgaggaaacaacatcatcgccaaaatcatcacgccccaacaagaactgtggagatcattaacgtggatgatgagatcacaggggataccccaatggagagccatcttccaatgcccgcaattgaacatgagcacctcaaccactataactcctataagtcaccctttaaccatacaacaaccgttaacactatcaactcaatccatagcagcgtgcatgagccactgctaataaggatgaattctaaggacaacgtccaggagactcagatttag

SEQ ID NO: 228298 - DNA, 1923 bp, Artificial Sequence
  Description of Artificial Sequence: Synthetic coding sequence
atgttgaataaaatgacattacatccccaacagattatgatcggacctaggtttaaccgggcactattcgaccctcttttggtcgtgctcctagctctccagctactggtggtggccggtctggtgagggctcagacctgccccagtgtgtgctcatgctcaaatcagtttagcaaagtcatctgtgtgagaaaaaacctaagagaagtccctgacgggatctcaaccaatacccggctgttgaacctccacgagaaccagatacagatcatcaaagttaactccttcaagcacctgagacatctcgaaatattgcaactatctcgcaatcacatccggacaattgagataggagctttcaatggactggccaacctgaacacccttgagttgttcgacaaccgattgactaccatccccaatggggcattcgtctatctctccaagcttaaggagctctggttgaggaataatcctattgagagcatccctagctacgcgttcaaccggatcccatctttaagaaggctggacctgggagagctcaagagactctcctacatcagcgaaggcgcatttgagggtctgagtaacctgagatatcttaacctggctatgtgtaatcttagggaaattcctaatctcaccccactgatcaagctggatgagcttgatctgtccgggaatcacctgtccgccattagacctggtagttttcagggacttatgcatctgcagaagctttggatgatccagagccaaattcaggtgatcgagagaaatgccttcgacaatcttcagtcactggtggaaatcaacttggcccacaacaaccttactctgctaccacatgatctgttcactcctttacaccatcttgagcgcatccacctccaccacaacccatggaattgcaattgtgatatactctggctttcctggtggattaaagacatggcaccatctaatactgcctgttgtgcccgttgtaacactccacccaacctaaaaggcagatatattggtgaactcgaccagaattactttacttgctatgcaccagttatagtggagcctcctgccgatctcaacgtgaccgaagggatggctgcagagctcaagtgccgggctagcacttcactgacctccgtctcctggattacgcccaatgggactgtcatgacgcatggagcttataaggtcagaatcgcagtgcttagcgatggtacattaaattttaccaacgtgaccgtccaggatacagggatgtatacttgtatggtgtcaaacagtgtgggaaacactacagcctccgccaccttaaatgtgactgctgctaccacaactcccttttcatatttctcgaccgtgactgttgagaccatggagcccagccaagacgaggccaggacgacagataacaatgtgggtcctacaccagttgtggattgggagaccacgaacgtgaccacttcccttacacctcagtctacgcgaagtacagagaagaccttcacaatccctgtgaccgatatcaacagtgggatcccaggaattgatgaagtgatgaaaaccacgaagatcattataggatgtttcgtggccattactctcatggccgctgtaatgctggtcattttttacaagatgcggaagcagcaccaccgccaaaaccaccatgcccctactcgcacagtggaaattataaatgtagacgatgagattacaggggatacacctatggagtctcacctccccatgccagctatcgaacacgaacatctgaaccattacaactcctacaaaagtcctttcaaccacacaactaccgttaataccataaatagcatccacagcagcgtgcacgaaccattgctcattcgcatgaactcaaaagataacgtgcaagagacccagatctag

SEQ ID NO: 228299 - DNA, 1923 bp, Artificial Sequence
  Description of Artificial Sequence: Synthetic coding sequence
atgctgaataagatgactcttcaccctcaacagattatgattggacctcggttcaatagagccctttttgatccgctgcttgttgttctgctcgccctgcagctcctggttgtcgccggactggtacgagctcaaacgtgcccgtctgtgtgcagctgttccaatcagttcagcaaagtgatttgcgttcgtaaaaacctgcgcgaggtcccggacggaatatcaaccaatacgcgactgctcaacttgcacgagaaccagatccagattattaaagtaaatagttttaagcatctgagacacctcgaaattctgcagctgtctcggaaccacattaggacgatcgaaatcggggcttttaacgggcttgctaatctcaacaccttggagctcttcgataaccgccttacgacaatcccaaacggcgcttttgtgtatctttcgaaacttaaggagctttggcttcgaaacaacccaattgagtccatcccctcctatgcctttaaccggattccatcactccgcaggctggacctcggtgagctcaagcggttatcctacatttctgaaggggcatttgagggattgtctaacctgcggtaccttaacctggccatgtgtaacctccgtgagatccctaatctgacaccactgataaaactggatgagctcgacctgagcggaaaccatctgtctgcgattcggccaggatcctttcagggactgatgcacctccagaaactttggatgatacagagccagatccaagtaatcgaaagaaacgccttcgataatctgcagtccctcgttgagatcaacctggctcataataatctgaccctgctgcctcatgacctgttcactcccttacaccacctggagcggatccacctccatcataacccttggaattgtaactgcgacatactgtggctgagctggtggataaaggacatggccccatctaatacagcctgctgtgctcgatgcaatacccctccaaatctgaaaggacgctatatcggtgaactggatcagaactactttacatgttatgcgcctgtgattgttgaacccccagcagacctgaacgttacagaggggatggcagctgagttgaagtgcagagcctccacatcgctcacctctgtaagttggatcaccccgaacgggaccgtgatgactcacggcgcttataaggtcaggatcgcagttctgagtgacgggacactgaacttcacgaacgtcacagttcaggacacggggatgtatacatgcatggttagtaattccgtcgggaacacgacggcatctgctaccctcaacgtcacagctgccaccaccactccattttcctattttagtacagtcacggtagagactatggagccttcacaggacgaagcgaggacaactgataacaatgtgggtcctacgcctgtggtggactgggagacaactaacgtgactacctccctgacaccccaaagtacacgatcaaccgaaaagacattcaccatcccagtgactgatattaacagtgggattccgggaatcgacgaagtgatgaaaacaacaaagattataattggatgtttcgtcgccatcaccttgatggcagctgttatgcttgtaattttttataagatgcgcaagcagcaccaccgacagaatcatcacgccccaacccggactgtggaaatcattaatgtagacgacgagatcaccggagataccccaatggaatcccacctgccaatgccagccatcgaacatgaacacctgaaccactacaacagctacaagtcccccttcaaccatacaaccacagtcaacacaatcaattctattcactcctccgttcatgaacctctgctgataagaatgaatagcaaagacaatgttcaggagacccagatttag

SEQ ID NO: 228300 - DNA, 126 bp, Artificial Sequence
  Description of Artificial Sequence: Synthetic coding sequence
atgctgaataaaatgaccttgcatccccagcagattatgattgggcctcgttttaaccgagccctgtttgatcccctactcgtggtcctcctagctttacaacttttggtcgtagcaggcttatag

SEQ ID NO: 228301 - DNA, 4614 bp, Artificial Sequence
  Description of Artificial Sequence: Synthetic coding sequence
atgaccacaaaacggaagatcatcgggaggcttgtgccatgcaggtgtttccggggtgaagaggagatcataagtgtactcgattacagccattgctccctgcagcaggtgcccaaagaagtgtttaacttcgagagaaccctggaggagctgtacctggacgcaaatcaaatagaagaattgcctaagcagctattcaactgccaggcactgagaaagctgtcaatccctgataatgacttaagcaatctacctaccaccatagcctctttagtgaatctgaaagaactggacatatctaaaaatggcgtgcaagagtttccggagaatattaaatgctgcaaatgtctgactatcatagaagcatcagttaacccaatttccaagctgcccgacggatttacccagcttttaaacctaacccaactgtacttgaacgacgcttttctcgaattccttcccgcaaacttcggccgactcgtcaagcttcggatccttgagctgcgcgaaaaccacttaaaaacattacccaagagcatgcacaaactcgctcagctggagagattggacctggggaataacgagtttggggagctgcctgaggtcttagatcagattcaaaatcttcgagaattatggatggacaataacgcactacaagtacttcctggtagcatcggaaagcttaaaatgttggtttatctagatatgagtaagaaccgcattgaaactgtagacatggatatctcgggatgtgaagctctagaggacctactgctctcgagcaacatgctgcagcagctgcccgactcaatcggactcctgaagaagctgaccacactgaaagtggatgacaaccagttgactatgcttcccaacaccattggaaatctcagtctgctggaggagttcgactgctcatgcaacgagcttgaatccctcccctctaccataggctacctgcactccctaagaacgctcgcagttgacgaaaatttcctgcctgaactgcctagggaaattggtagctgcaagaatgtgaccgtcatgagccttaggagcaacaaactggaattcctgcctgaagagatcgggcaaatgcaaaagctcagagtgttaaatttaagtgacaaccgcttgaaaaacctgccattcagctttaccaagcttaaagaacttgcagccctttggctttccgataaccaaagcaaagcgttaattccgctgcagactgaggctcacccagagaccaagcagcgagtactgaccaactacatgtttccccaacagccacgcggtgatgaggactttcagtctgatagtgactccttcaatcccactttgtgggaggaacagcggcaacagcggatgaccgtcgcatttgagtttgaagataaaaaggaagatgacgaaaatgccggtaaggtcaaggatctttcttgccaggccccatgggagcggggtcagagaggaataaccctccagccagccagactgagcggcgattgttgtacgccatgggccaggtgtgatcaacaaatacaggacatgcctgtgccacagaatgacccccagctggcatggggctgcatctctggccttcagcaggagagatctatgtgtacacccttgcctgtggccgcacaaagtaccaccctgcctagcctgtccgggcgacaggtggagattaatctgaagcggtacccgactccctatcctgaggatctgaagaacatggtgaaaagcgtgcagaacttagtcggtaagccgagccacggtgttcgtgtcgaaaactcaaatccaaccgcgaataccgaacagaccgtgaaagaaaaatacgagcacaagtggccagtggccccaaaagagatcaccgtcgaggacagctttgttcaccctgccaatgagatgaggatcggcgagctgcatcctagcctggctgagactcccctctatccccctaagttggttctgcttggaaaggacaagaaggagtcaaccgacgaaagcgaagtagataagacacattgtttgaacaattccgtcagctctgggacctattcagattatagcccttcacaagcctctagcgggagctctaacactcgggttaaggtggggtcacttcagactaccgcaaaagatgctgtgcacaatagcctgtggggcaaccgtattgcgcctagcttcccccaacctcttgactctaaaccgctcctttctcagagagaagccgtgccacccggtaacatcccacagagaccggaccgactaccaatgtctgacacgttcactgacaactggaccgacggctcgcattacgacaataccgggtttgtggccgaggagaccaccgccgagaatgctaactctaatccactgctgtcttcaaagtcccggtccacgtctagtcatggcagacgacccttaatccgtcaggacaggattgtcggcgtcccgctggaactggagcagtccacccaccggcatacacctgagaccgaggtgcctcccagcaacccttggcagaactggactaggacaccttcccctttcgaggacaggacagcttttccatcaaaactggagacaacgccaacaactagccccttacctgagaggaaggagcatatcaaagaaagcaccgaaattcccagtcctttctcacccggagtaccatgggaatatcacgatagtaatcctaataggtctctgtccaatgttttttcacagattcattgtcgccctgagagctccaaaggtgtgatctccattagcaagagtaccgagagactaagtcctctcatgaaggatataaagagcaacaagttcaagaaaagccagtctattgatgaaatagatattggtacttacaaggtgtataacatcccactggagaattatgcatccggatccgaccatcttggaagtcacgagagacccgataagatgctcgggcctgaacatggaatgtcaagtatgagtagaagtcagtctgtgcctatgctcgatgacgaaatgctcacctacggctcatccaagggacctcagcagcagaaagcctccatgacaaaaaaggtgtaccaatttgaccagtcgttcaatccacagggcagcgtcgaagtgaaggctgagaagcgcattcccccaccttttcagcacaaccccgaatacgtgcagcaggcaagcaagaacattgcaaaagaccttatcagtccgagagcttaccgtggctaccctcctatggagcagatgttctccttttctcagccctcagttaacgaggatgcggtggtgaatgctcagtttgcatctcagggggcacgggcaggctttctgagacgtgccgattcactggtgtcagccacggaaatggctatgttcaggagggtgaacgagccacacgaattgcctcctaccgaccggtacggcaggcccccttaccgagggggtcttgataggcagagtagcgtcacagtcactgagagtcagttcctcaagcggaatggacggtatgaggatgaacatcccagctaccaggaggtgaaggcccaagccggaagctttcctgtaaagaacctgactcagcggaggccactgagcgccagaagttactccaccgagtcttatggcgctagccagacacgtcccgtgtcagcacggccaaccatggctgcgctgctcgaaaagataccttcagattacaacctgggtaattacggggacaaaccatccgataactctgacctcaagacaaggcccaccccagtcaagggcgaggaaagttgtggcaagatgccagcggactggcgccagcagctgttgagacacatcgaagcaaggcggcttgacaggaacgctgcttataaacacaataccgttaacctcgggatgctgccctatggagggatctcggcaatgcatgccggtcgcagcatgaccctgaatcttcagacgaaaagcaagttcgatcaccaggagcttccactgcagaagaccccgtcccaacaatctaacattctcgacaacggtcaggaagatgtgtcgccaagtggtcagtggaacccttatccgctgggacggagggacgttccaccagacacaattacaaaaaaagcgggatcgcacatccagactctcatgggatcacagtcgctccagcaccgcagccgcgaacagcaaccctatgaggggaacattaacaaagtgacaatacagcagttccaatcaccactgcccattcaaattcccagctcacaggctaccagaggcccacagcccggaaggtgtctgatccagaccaaggggcaacggtccatggatgggtaccccgaacagttttgcgtgagaattgagaagaatccgggattgggtttcagtattagcggcggaatctctggccaggggaatccgtttaaaccttctgataagggaatctttgtgactcgtgtccagcccgacggtccagcctctaatctgctccagcctggggacaaaatcctgcaggctaatggacactccttcgtacatatggaacatgagaaggccgtgttgctgttaaagagtttccagaatacagtcgacctagtgatacagcgtgagctcacagtgtag

SEQ ID NO: 228302 - DNA, 4488 bp, Artificial Sequence
  Description of Artificial Sequence: Synthetic coding sequence
atgcaatgtctggaaatgaccaccaaaaggaaaatcatcgggagattagtgccatgtaggtgtttcaggggggaggaggagatcatctcagtgctggattattcacattgttcccttcagcaagtgccaaaggaagtgttcaactttgaacgcaccctagaggagttatacctggacgcaaaccaaattgaggagttgccaaaacagctcttcaattgccaggcgcttcgtaaactaagtattcccgacaatgatctgagcaatctgccgacaactatcgcttcactggtcaatctcaaggagctggacatcagcaagaacggcgtccaggaattccctgagaatataaaatgctgcaaatgtcttactattatcgaagcgagtgttaatcccatctcaaaattaccggacgggtttactcaacttctcaatcttacccagctctacctcaacgacgccttcctcgaatttctgcccgctaactttggtcgcctggtgaagctccggattctggagctgagggagaatcacctgaagactctccccaaatcaatgcacaagttagctcaactcgagcggttggatttagggaacaatgaattcggcgaacttcctgaggtgctcgatcaaattcaaaacctacgcgagctctggatggataataacgccttgcaagtactgcccggaagcatcggcaagctgaaaatgttggtgtacctggatatgtccaaaaatagaatagagaccgtcgacatggacatcagcgggtgtgaagctctagaggacctgctgctgagctctaacatgcttcaacagctcccagattccatcgggctccttaagaagctgaccacactcaaggtagatgacaatcagctgactatgcttcccaataccatcggtaatttgagcctcctggaagaattcgattgtagctgtaatgagctcgaatccctaccaagcaccattgggtacctccactcactgcggactcttgccgtcgacgagaattttctgccggaactcccacgggagattggatcctgtaagaatgtgaccgtgatgagtctaagatccaataagcttgagttcttgcctgaagagattggccagatgcaaaagttaagggtcctcaacctgtcagacaatcggctgaagaacctcccattctcgtttaccaagctgaaggaactcgccgcactgtggttgtccgacaaccagagcaaggctttgattccactgcagacggaggcccacccagaaaccaaacagcgggtgctcacgaattacatgttcccgcagcagcccaggggtgatgaggacttccagtcagacagcgacagcttcaaccccactctgtgggaggaacagcgacagcaacgcatgacagtcgcctttgagttcgaagacaaaaaggaagacgatgagaacgctggaaaggtaaaagacttgtcctgccaggcaccatgggagcgaggacagcgtggcattacactgcagccagcccgattaagcggcgattgttgtaccccctgggcaaggtgtgatcaacagatacaggatatgcccgtaccccagaacgacccccagcttgcttggggctgcattagtggtctgcaacaggagcggagtatgtgcaccccacttcccgtcgcagcccaatccacaacccttccgtccttgtctggccgtcaggtcgagataaacttaaaaaggtatccgaccccttacccggaagacttgaaaaacatggtgaaaagtgttcagaacttggtcggtaagccttcccacggggtccgtgtcgagaacagcaatcctacagcaaacacagaacagaccgtaaaggaaaagtatgagcacaagtggcccgtggccccaaaagagatcacagtagaggattcttttgtgcaccccgctaatgagatgcgaattggggagcttcacccctcattagctgagacacccctgtaccctccaaaacttgtactgcttggcaaagacaaaaaagaatctacagacgaatctgaagtggataagacccactgtctgaataactccgttagcagtggaacatatagtgattatagcccaagccaggcctctagtggatccagcaatacccgagttaaggtgggctctctgcagactaccgccaaagacgcggtccacaacagcttgtggggcaataggatcgcgcctagcttcccccaacccctcgacagtaagccgttgttatctcagcgcgaagcggtcccacccggaaacattcctcagagaccagaccgcctccccatgtcagataccttcacagacaattggaccgacggatctcattatgataacaccggcttcgttgcagaggagacaacagctgagaacgctaattctaatcccctgttatcttccaaaagccggtctacctcctcacacgggagaagaccgctcataagacaagatcgcatcgtgggggtgccacttgagctcgagcagtccacacatagacatacacccgagactgaggtcccacctagcaatccttggcagaattggacacggaccccgtctcccttcgaggatcggaccgcttttccgtctaagctggaaaccaccccaacgacgagccccctcccagagcgcaaggaacacattaaggagagcacagaaataccatctccatttagccccggtgtgccttgggagtaccatgactccaaccctaaccgaagcttgagcaatgtgttttcacaaatccactgccggcctgagagttcaaaaggagtgatcagcatcagcaaatccactgaaagactgtcccctctgatgaaggatattaagtctaataaatttaagaagtcacagtctattgatgagatcgatatagggacatacaaggtttacaacatccccctggaaaattatgcctccggttcagatcacctaggttcccacgagagacccgacaaaatgttggggcctgaacatgggatgtcatctatgtcccggagccagagtgttcccatgttggacgacgagatgctgacttatggttctagtaaagggccacagcaacagaaggcctctatgaccaagaaagtgtatcagttcgaccagtcattcaaccctcaaggatccgtggaggtgaaggctgagaagaggatccccccacctttccagcacaatcctgagtacgtacaacaggcgagcaaaaatatcgccaaggacctcatttctcctcgcgcttataggggttatccacctatggagcagatgttctccttttcccagcccagcgtcaacgaggacgccgttgtgaatgcgcagttcgctagtcagggcgcaagagcagggttcctgagacgcgcagatagtcttgtgagcgctaccgaaatggccatgtttaggcgcgtgaacgaaccccatgagcttccacccactgatagatatggtaggcctccttatagaggcggacttgatcggcagagcagtgtgactgtgaccgagagccagttcctgaagcgcaatggccgttacgaggacgagcacccttcgtaccaggaagtgaaggcccaagctggctctttccccgtgaaaaaccttacgcagcgaaggcctctgtcagccagatcgtatagcacagaaagttatggagcgtcccagactcgcccagtaagcgctagacccaccatggccgctctgttggaaaaaatcccaagcgactacaacctgggtaactatggagacaagccaagtgataactcagatctgaagacaaggcccactcctgtgaaaggggaagaatcatgtggcaagatgcccgctgactggcgccaacagctgctgcgacacatcgaagcgagacggctcgatcgcacaccttctcagcagagcaatatactggacaatgggcaggaagatgtgtcccctagcggacagtggaacccgtaccctctcggcagaagagacgtccctcctgacaccatcactaaaaaggcgggtagtcacatacagactctgatgggctctcagagcctgcagcataggagcagagaacagcagccatacgagggcaatatcaacaaggtgactatccaacagttccaaagtcccctgccgattcagattccctcttcccaggctacccggggaccgcaacccggtcggtgtctcattcaaacgaaagggcagcggagcatggacggatacccagaacagttctgcgtacgcattgaaaagaatccagggcttggattctccatctccggtggaattagcggccaggggaacccttttaaaccttcggacaagggcatcttcgtgaccagagtgcagcccgacggacctgctagcaatttgttgcaaccgggagataagatcttgcaggctaacggccactctttcgtgcacatggagcatgagaaggccgtgttgctgttaaagtctttccaaaatactgttgacctggtcattcaaagagagctaaccgtgtag

SEQ ID NO: 228303 - DNA, 540 bp, Artificial Sequence
  Description of Artificial Sequence: Synthetic coding sequence
atgaccacaaagagaaaaatcatcgggagactggtcccctgcagatgtttccgcggagaggaggagattattagtgtactggactatagccattgctctttacagcaagtgccaaaagaggtgtttaattttgaacgtaccctggaggagctgtatcttgatgccaaccaaattgaagagctgcctaaacagttgttcaattgccaggcactgagaaagctctccatccctgacaatgatctctcgaatttaccgacgacaatagcaagcctggtgaatttgaaagaacttgacatttctaagaatggcgtccaggaattccctgaaaacattaaatgctgtaaatgcctgactattatagaggcgtccgttaaccctatcagcaagctcccagacgggtttacccagctactgaacctgacgcagctgtacctcaatgatgccttcctggagttcctgcctgccaacttcgggagactagtgaagctaagaatactggagcttagagagaaccatttaaagacactgcctaaaatctag

SEQ ID NO: 228304 - DNA, 3942 bp, Artificial Sequence
  Description of Artificial Sequence: Synthetic coding sequence
aggtcaatgcataaactggcccaattggaacggctcgatcttgggaacaatgaatttggcgagctccctgaggtcctggatcagattcaaaacctgagagaactctggatggataacaacgcacttcaggttcttcctgggtctattggaaaattgaagatgttggtgtacctggacatgtctaagaatcgcattgagactgtcgatatggacataagtgggtgtgaggcactagaggatcttttgctttcctcaaatatgttacaacagttgccggattccatcggactcctcaaaaaactaacaaccttgaaggtggacgacaatcaattgacaatgctacccaataccatcggcaacctcagcctcctggaagagtttgattgctcctgcaatgagctcgagtctctgccttcgaccattggatacctgcactccctgcgaacactggcggttgatgaaaactttttgcctgagttgccacgcgagatcgggtcctgtaagaatgttacggttatgagtttgcgcagcaataagctggagttcttgcccgaggagatcggccaaatgcagaaattaagagtgctaaacctctcagataacaggctgaaaaaccttcccttcagctttaccaaacttaaagagcttgccgcactctggcttagcgataaccagtccaaggccctcatccccctccagactgaggcacatcccgaaaccaaacaacgagtgctcacgaattacatgttcccccaacaaccacggggtgatgaagactttcagagcgactccgattccttcaatcctacgctgtgggaggagcagaggcagcagagaatgactgtggcttttgagttcgaagataagaaagaggacgacgaaaatgccggaaaggtaaaagatttgtcgtgtcaggcgccttgggagcggggtcagcggggaattaccctgcagcccgctaggctgtctggagattgctgcaccccttgggcacgatgcgaccaacagattcaagacatgccagttccacagaatgaccctcagctcgcctggggctgtatctctggtctgcagcaagagcgctcaatgtgcactcccctgccggtggccgcacaatcaaccaccttaccttcactatccggacggcaggttgaaatcaatttgaagcggtatccgacaccctatcccgaggacctgaagaatatggtgaaaagtgtccagaacctcgtaggtaaacctagccacggcgtgcgggtggagaactctaaccccaccgctaatacggagcagaccgtgaaggaaaagtacgaacacaaatggcctgtggcccctaaagagataacggttgaagatagctttgtgcatcccgcaaatgagatgcgcattggcgagttacacccttccctggccgaaaccccactatatcctccaaaactcgttttactgggcaaagacaagaaggagtccactgacgagagcgaagttgataaaacacactgcctcaacaactcggtctcttccggtacttactctgactatagccctagtcaagccagctccggaagctcaaataccagggtgaaagtggggtcactgcagactacagcaaaagacgccgtgcacaacagtctttggggaaatcgcatcgccccatcgtttccacagccattagatagtaaacctctcctcagtcagagggaagcggtgcccccaggcaatataccccagcgcccagaccgtttgccaatgtcggatacgttcacggataactggacggacgggagtcattacgataacaccgggtttgtcgcagaagagaccacagccgagaatgcaaactcaaatccacttctgagctctaagtcgcgatcaacatccagccatgggcgtaggcctctgatacgccaagaccgtatagtcggggttccactggagctggagcagtctacccatcgccatacaccagagaccgaggttcccccatccaacccatggcaaaattggaccagaacaccttctccctttgaagaccgcactgcctttcccagtaagctggagaccacgccaactacttcacctctacccgagagaaaagaacacatcaaagaatccacagagatcccatcccctttcagccctggggtcccttgggaatatcacgacagcaacccaaatcgcagcctgtccaacgtcttttctcagattcactgccgtcccgagagtagtaaaggagtgatatccatctcaaagagcacagaacgattatccccactgatgaaagacatcaagagcaacaagttcaagaagtcgcaatccattgacgagatagatatcggtacctacaaggtgtataatatccccctggaaaattatgcaagcggaagcgatcatttggggagccatgagcggccagacaaaatgttgggtcccgagcacggcatgtctagtatgagccgctctcaatcagtccctatgctggacgatgaaatgctcacatatggatcatcaaaaggtcctcagcagcaaaaagcatcaatgactaaaaaggtctaccagttcgaccagtcctttaacccacagggttccgttgaggttaaggcagagaagcggattcccccaccctttcaacacaatcccgagtacgtgcagcaggcctcgaagaacatcgccaaagatttgatctctccacgcgcatataggggctatcctccaatggagcagatgttttctttttcacagccctcagtgaacgaggatgccgtcgtgaacgcccaattcgcttcacagggagccagggctggattcttgaggagggcagactcccttgtcagcgccaccgagatggctatgttcaggcgcgtcaacgaacctcacgaattgccgccaacagaccgatacggacggcctccctataggggcggacttgaccgccagagttccgtgaccgttacggaaagccagtttctgaaaaggaacggacgctacgaggacgagcacccctcttaccaagaggtcaaggcacaagctggatcttttcccgtcaagaatctcacacagcgccgacctctttccgctagatcctactctactgagtcctatggagcctctcagaccaggcccgtgtctgcaagacccacgatggcagctctgttggagaagattccttcagattataaccttggaaattatggggacaagccatccgataattccgacttgaagacccgccctacgcccgtgaagggggaggagtcctgtggtaagatgcccgcagattggagacagcagctgctaagacacatcgaggctagacggctcgatcggacgccctcccagcagtcaaacattctggacaacggacaagaagatgtcagcccatccggtcaatggaatccttaccctcttggacggagggatgtgcccccagatactatcacgaagaaagccggatctcacattcaaaccctcatgggctctcagagtttgcaacaccggagccgagagcagcagccgtacgaaggcaatatcaacaaagtaaccatacagcaatttcagtccccactgcctatccaaatcccatccagccaggcaactagaggccctcagcccggtagatgcctgattcaaactaagggacagcggagcatggatggctatcctgaacagttttgtgtaagaattgaaaagaaccccggactgggttttagcatcagcggcggaatctccggacagggaaatccatttaagcccagcgataagggtatttttgtcaccagagtccagcctgacggccctgcatcgaaccttcttcaacctggggataagatcctgcaagccaatggccactcattcgtacacatggagcacgagaaggcggtgctgctgctcaagagcttccaaaacactgtggacctggtcattcagcgggagttgacagtgtag

SEQ ID NO: 228305 - DNA, 654 bp, Artificial Sequence
  Description of Artificial Sequence: Synthetic coding sequence
atgatggagaatctcattagagggagaaatcccccacagtaccagagaagtccttgcaaggaggtgcgcgcagccctccgcaaaagacctgaggaggagctccagtgtctggaaatgacaaccaaaaggaagattataggacggttggtcccatgtaggtgtttcaggggagaagaggaaataatctcggtgctcgattattcccattgcagcctccagcaagtgccaaaagaagtgttcaatttcgaacggaccttggaagaactgtatctcgatgccaatcagatcgaggagctccccaagcagctgtttaactgtcaagccttgcggaagctgagcattcccgacaacgacctgtctaatctgccgacgactatagcatccctcgtaaacttgaaagagctagatatctctaaaaatggagtccaggaatttcctgagaacattaaatgctgcaagtgtctgacaatcattgaagcatctgtcaacccaatcagcaaactccctgacgggttcacccaactgctcaatctcacccagctctaccttaacgacgcctttctggaattcctccctgcgaacttcggccgactagttaagttacgtatacttgagctccgcgaaaaccatttaaagacactgcctaatatctag

SEQ ID NO: 228306 - DNA, 2466 bp, Artificial Sequence
  Description of Artificial Sequence: Synthetic coding sequence
atgaccaagatgttgggaaaactgagaattgctccttcttttccgcagcccctggactcgaaaccattgctgagccagcgggaggccgtaccccctggtaatattccccaaaggcccgataggctgcctatgagcgatacctttaccgataactggacagatggatcacactacgacaacacaggtttcgtcgccgaggagactaccgccgagaacgcaaactctaatccgcttctgagcagcaagagtagatccacctcttcccatggccgtcgccctcttatccgtcaagacagaattgtgggggttcctctggagctagagcagtccacccatagacatacaccagagacagaggtgccaccaagtaacccgtggcagaactggactcggacaccttcaccctttgaggaccgcacagcatttcctagcaaactcgagacaacccccacgacttcgccgttgcccgagcgcaaagaacacattaaggagtctaccgagatccccagtcctttctcaccaggcgtcccctgggagtaccatgatagcaatcctaatcggtcgctcagcaatgtgtttagccagatacattgtagaccagagagcagcaaaggagtgataagtatatcaaaaagtaccgaacgcctaagcccactgatgaaagacattaagtccaacaaattcaagaagtctcagtccattgacgaaatcgatattggcacatacaaagtgtataacatccctctggaaaactatgctagtgggagcgatcacttgggctcacacgagaggccagacaagatgctgggaccagaacacggcatgagcagtatgtccaggtcccagtccgttcccatgctggatgatgaaatgctgacctatgggtcgagtaaaggacctcagcaacagaaagcaagcatgacaaagaaagtgtatcaatttgatcagtccttcaatccccagggatccgtggaagtgaaagccgaaaaaagaatccccccaccattccagcacaaccccgagtacgtacagcaggccagtaagaatatagctaaggacctgatttcccccagagcttatagaggatacccccctatggagcagatgtttagtttcagtcagcccagtgtgaatgaagacgccgttgtgaatgctcagtttgcatctcagggcgcacgagctgggttcctccgcagggccgactcactcgtgtcggcaaccgaaatggctatgttcaggagggtgaacgagccccatgaactgcctccaactgatcggtatggccgacccccttacagagggggactggatagacagtcgtccgtaactgtgacagagtctcagtttctcaagagaaacggacgctatgaggatgaacaccccagctatcaggaggtgaaggcacaggccggatcttttcccgtcaagaacctgactcaaaggcgtcccctgagcgcgaggtcctattcaaccgaatcatacggcgcaagccagacccggccagtttccgccaggcctactatggcggcacttctcgaaaaaattccatctgattacaatctaggaaactacggcgacaaaccgtccgacaactcagatctgaagactaggccaacaccagttaagggggaagaatcctgcggcaagatgccggcagattggcggcagcagctcctgaggcacattgaagccaggagattggatcggaacgccgcatacaagcacaacaccgtgaacctcggcatgctcccgtatggaggaatctcggcaatgcacgccggacgatcaatgaccctgaatctgcagacgaaatccaagtttgaccaccaggagctgccactgcaaaaaaccccctcacagcagtccaacatcctcgacaacggtcaggaagacgtcagtcctagtgggcagtggaatccttacccgttgggaaggagagacgtgccacctgacactattaccaaaaaggctggaagccacatccagaccctgatggggtcccaatcacttcagcaccggtctcgggaacagcagccctacgaaggcaatatcaacaaggttacaatccaacagtttcaaagccccctcccaatccagataccttcaagccaggccactcgcggtccgcaaccgggtcgatgtctcattcagacaaaggggcaacggagtatggacggctacccggaacagttctgcgtccggatcgaaaagaatcccggtctggggttctcaataagcggtggaatctccggacaaggcaatccctttaaaccaagtgacaaaggcatctttgtgaccagagtccagcccgacgggccagcgagtaatctccttcaacctggagataaaatcctacaggcgaatgggcattcttttgtgcatatggagcatgaaaaagcggtgttactgctcaagtccttccaaaacaccgttgatctcgtaatacagcgcgaactgaccgtctag

SEQ ID NO: 228307 - DNA, 2433 bp, Artificial Sequence
  Description of Artificial Sequence: Synthetic coding sequence
atgattccagttacagaattacgctatttcgctgatacacagcccgcttaccggattctcaaaccctggtgggatgttttcactgattacatatccattgtgatgttgatgatcgcagtgtttggcggaacactacaggtgacccaggacaagatgatctgtctgccctgtaagtgggtgacgaaggattcttgcaacgatagttttagagggtgggccgctcctggaccggagcccacttaccctaattctaccattctgcccacccccgacacgggacccacaggcatcaagtacgatctggatagacatcaatataattacgtggatgctgtgtgctatgagaataggttgcattggtttgccaagtatttcccgtatctggtcctgctgcacacactcatcttccttgcttgcagcaacttttggtttaagttcccgaggacatcctcgaagctagaacacttcgtcagtatccttctcaaatgctttgacagcccatggaccacacgcgctctgtcagaaactgtggtagaggagagtgacccgaaacccgcattctccaaaatgaatgggagcatggacaagaaatccagtacggtgagcgaggacgttgaagctactgttccgatgctgcaaaggacgaaaagtcggattgaacaggggattgtggaccgctcggagaccggcgtgctggataaaaaagaaggcgaacaggccaaagccctgttcgagaaggtgaaaaagttcagaacccacgttgaggaaggagatatcgtgtaccgattatacatgagacaaaccatcatcaaggtgattaaatttattcttatcatctgttacactgtatactacgtgcacaacattaagtttgacgtggattgcacggtcgacatcgaatctctaacaggctatcgtacatatcggtgcgctcatccactggccaccctttttaagatccttgcaagtttttacatctctctggtgattttctatgggctgatttgcatgtacaccttgtggtggatgctcaggcggtccctgaaaaagtacagttttgagtctatccgggaggagtcctcttattccgacattccggatgtgaagaacgatttcgcctttatgctccacctgatagatcagtacgacccactttatagtaaacgctttgccgtattcctcagtgaggttagtgaaaataagctgagacagctgaatctaaataatgaatggaccttggacaaattacgccagagactgactaaaaatgcacaggataagctggaactgcatctctttatgttgtcaggtattccggatactgtctttgatctggtggagctggaagtgctgaaactcgaacttatccctgacgtgacaatacccccttcgatcgctcagctcacaggactaaaggagttatggttgtatcatactgcggctaaaattgaggctcccgcactagcatttctcagggaaaacctgagagcattgcacattaaattcactgatatcaaagaaatccccctatggatctactcgttaaaaaccctcgaagaactgcacctgaccggcaatctcagcgctgagaataacagatacatcgtaatcgacggccttagagaacttaaacggttaaaagtgcttaggctcaagagcaatctgtcaaagctcccccaggtcgtcaccgacgtcggggtgcatctgcaaaagctgtcaatcaacaatgaaggaacaaagctgatcgttctcaattccctgaagaagatggccaaccttaccgagctggaactaattcgctgcgatctggaacgcatcccccactctatcttctccctgcataatctgcaggagatcgatcttaaggataacaatctgaaaactatcgaggagattatttcatttcagcacctgcaccgtctgacatgcctgaaattatggtataatcatatcgcatacatacccatccaaattggtaatcttacgaatttggagaggttatacttgaaccggaataagatcgagaaaatacctacccagctgttttactgccgcaaattacgttatctggatctaagccataacaaccttactttcctgccagccgacatcggtttgctgcaaaatctacagaacttggcgattaccgcgaatcgaattgagacacttcctccggaactcttccagtgtcgtaagctccgagcactccacttgggtaataatgtactgcagagtctgcctagcagagttggcgagctgacaaacctaacacagattgagctgagagggaatagactggagtgcctgcccgtggagctgggtgagtgtcccctacttaaacgctcaggactggtggtagaggaagacctgtttaacactctgccccctgaagtgaaagaacgcctgtggagagctgataaggaacaggcatag

SEQ ID NO: 228308 - DNA, 2433 bp, Artificial Sequence
  Description of Artificial Sequence: Synthetic coding sequence
atgattccagttaccgagctcagatatttcgccgatacccagccggcatatcgcatccttaagccctggtgggatgtattcacagactatatatccatcgtaatgctcatgatcgcagtgttcggagggactctgcaggtgacgcaagataagatgatttgtctgccttgtaagtgggtgactaaagacagctgcaacgacagctttcggggatgggccgctccgggtcctgagcccacgtatccgaacagcactatcctgcctacccctgataccgggcctaccgggattaagtacgacctggatagacatcagtacaactacgtcgatgccgtgtgctacgaaaacaggcttcattggttcgcaaagtacttcccctacctggttcttctgcacacgctgatcttcctggcgtgctccaatttttggtttaagtttcctcggacgtcaagcaagctcgagcattttgtgtcaattctgctgaagtgcttcgattctccctggaccacacgcgcattgtccgagactgtagtggaggagagcgaccctaaacctgcgtttagcaagatgaacggatcaatggacaagaaatctagtactgtgtctgaagatgttgaggcaaccgtgcctatgttgcagcggactaagtctagaatagaacaaggcatcgtggatagatccgaaacaggggtgctggataaaaaagaaggagaacaggcaaaagcactgttcgaaaaagtgaagaagtttaggacacatgtcgaggagggagacatcgtgtatcgtctatatatgaggcagacgattataaaggtgatcaaatttatcttgatcatttgttacacagtgtactatgtgcataatatcaagttcgatgtggattgtaccgtggacatcgaaagccttacaggatacaggacttaccgctgcgcacatccccttgcaaccttattcaaaatcttggcatcgttctacatctcattggtgatcttctacggcctgatctgcatgtatactctctggtggatgctgagaagaagcctgaaaaaatatagcttcgaatccattagggaggagtcctcctactctgatatccccgacgtaaagaatgattttgccttcatgctgcacttgatagaccaatacgatcccctgtatagcaagcggttcgcagtctttttaagcgaggtcagcgagaacaaattacgccagttaaatttgaacaatgagtggacactggataagctgaggcagagactcaccaaaaacgcacaggacaaactagaactgcacctgtttatgctgtccggcatccccgacactgtctttgacttggtcgagttggaagtccttaagctcgaactgattccagacgtgaccatccccccttcaattgctcagctgactgggcttaaggagctttggctttaccataccgcggcaaaaattgaggctcctgctctggctttcctccgcgagaatcttcgcgcactgcatattaaatttactgatattaaggagataccactttggatctattcccttaagacgcttgaagagttgcatctcacaggcaatctgagcgcggagaataataggtatattgtgatcgacgggctgagggagctgaaacgtctgaaagtcctacggcttaagtcgaacctctctaagctgccacaggtggtgacggacgtgggcgtgcatctgcaaaaattgagcataaataatgaaggtactaagttaatcgtgctgaacagtctgaagaaaatggctaacctgaccgaactggaactcatccgatgtgacctggaacgaatcccacacagtatcttctcccttcacaatctgcaggagatagatctgaaagataacaacctcaagacgatagaggaaattatatctttccagcacctgcatcgacttacttgtctgaaattatggtacaaccatattgcctacattcctattcaaattggtaatctgaccaacttggagcgactctacttgaacaggaataaaatcgaaaaaatcccaacccagctgttttactgccgaaaactccggtacctggacctctcccataataacctgactttcctgcccgcagacattggccttctgcagaatctccagaatctcgccatcactgccaaccgaattgagaccctcccacccgagctcttccagtgtagaaagctcagagcactgcacttgggaaataacgtacttcagtcactgccctccagagtgggagaactgacgaatctgacacaaattgagcttagaggcaatagacttgagtgcctccccgtcgagcttggagagtgcccacttctgaagcgcagtggcctggtggtggaggaagatctgttcaacaccctgcccccagaagtgaaggagcgcctgtggcgtgccgataaggagcaagcctag

SEQ ID NO: 228309 - DNA, 2433 bp, Artificial Sequence
  Description of Artificial Sequence: Synthetic coding sequence
atgattcctgttaccgagctgagatatttcgcagacacacagccagcctaccggattttgaaaccatggtgggatgtattcactgactatattagcatcgttatgctgatgattgccgtgtttggtggaactctgcaggtgacccaggataagatgatatgcctgccgtgcaagtgggttacgaaggacagttgcaatgactcttttcgtggctgggcggcaccaggcccagagccaacctatcccaatagtacaatcctccccacaccagacacaggccctacgggaattaaatacgatttggacagacatcaatataactacgtagacgccgtctgttacgaaaaccggctacattggttcgccaagtactttccttacctggtgctgttgcatacacttatcttccttgcctgcagtaatttctggttcaagttcccaagaacatcttccaagctagaacactttgtcagcattctgttgaaatgcttcgactccccctggacaactcgagccctgtccgagaccgtcgtggaggaaagtgaccctaagccagcctttagtaaaatgaacggcagcatggacaagaaaagtagtactgtgtctgaagacgtcgaagccacagtcccgatgctgcagcgtactaaatcaagaatcgagcaggggattgtggaccggtccgagacaggcgtgctagataagaaagaaggggagcaagccaaagccctcttcgagaaagtcaagaaattccggactcacgtggaggagggcgatatcgtgtaccgcttatatatgagacagactatcatcaaggtgattaaattcatcctgattatctgttatacagtttactatgttcataacattaagtttgatgtcgactgcaccgtggacatcgagtctctgaccggctaccgcacgtaccggtgcgcccaccctcttgctactctttttaaaatactcgcctctttttacatttctcttgttatcttttatggtctgatttgcatgtacactctgtggtggatgctgcgtcgaagcctaaaaaaatattcattcgaatctatcagggaagaatcttcatattctgacattcccgatgttaagaacgattttgcctttatgctgcacctgatagatcagtacgatccactgtactcaaaaagatttgccgtgttcctctccgaggtttctgaaaacaagcttagacagctgaacctgaataacgaatggaccttggataagctgcgccagcgcctgaccaagaatgcgcaggacaagctggagctgcacttgttcatgctgagtggaatacccgatacagtgtttgacttggtagagctggaagtgctcaaactggagctcatcccggatgtcactattcccccatcaattgctcaacttactggcctgaaggaactctggctgtaccatacagcagctaaaattgaggcccctgcactcgccttcttgcgggaaaacctccgggcattgcacattaaatttactgatatcaaggagatccctctgtggatatactcacttaagactctggaggaactccacctgacaggcaacctgtcagctgagaacaaccgatacattgtcattgatgggctgcgggaactgaagcggctgaaggtgctgaggctgaagagcaatttgagtaagcttccacaagtggtaacagacgtgggtgtgcacctgcaaaagctcagcatcaacaatgagggcactaagctgattgtgctgaactcactgaagaagatggccaacttgacggaactggagctcattagatgtgacctcgagcgcattccacactccatttttagtttgcacaacctgcaggagatcgacctcaaggataataatctgaagaccattgaggagatcataagtttccagcacctccacagactgacatgcttaaaactctggtataaccatattgcatacattcccattcaaatcggcaatttgacaaacctggagcgactgtatctgaatagaaataaaatagagaaaattcctacacaacttttttattgcagaaagctgaggtacttggacttaagccataacaatttaaccttcctgccggctgacatcggcttactgcaaaatctgcagaacctggccatcaccgctaatcgaattgaaacactcccaccagaattgttccagtgccggaaactcagagcgctgcacttgggaaacaatgtgctgcagtctctgccatcccgggttggagagttaacaaacttgactcagattgaacttagaggcaaccggcttgagtgtctgccagtcgaattgggcgaatgccccctcttgaaacggtctggactagtcgtcgaagaggacctctttaacaccttgccgcctgaagtcaaggaacgtttgtggcgcgctgacaaggaacaggcatag

SEQ ID NO: 228310 - DNA, 2412 bp, Artificial Sequence
  Description of Artificial Sequence: Synthetic coding sequence
atgatcactctgacagagttgaagtgcttggccgacgcccagtctagctaccacatcttaaaaccttggtgggatgtgttctggtattatatcaccctgattatgctgctcgtggcagtactggctggcgctttgcagctcactcaatctcgtgtgctgtgctgcctgccatgcaaagtcgaattcgataaccactgcgccgttccctgggatatcctaaaggcatctatgaataccagtagcaatccaggcactccgcttcctctcccactgcgcatccagaacgaccttcatcggcaacagtatagttatatagacgcagtgtgttacgaaaagcagctccattggtttgcaaagtttttcccctatctggtgcttcttcacaccctgattttcgcggcatgcagtaatttttggctccactatccaagcacctcttctcggctggaacactttgtcgctatcctacacaagtgcttcgactcaccctggaccacacgagcattatccgaaaccgtggcggagcaatctgttcgaccattgaaactctccaaatccaaaatcttactgtcctcttcgggatgctcggccgacattgattctgggaagcagagcctgccttatccacaacctggtcttgagtcagccggaatcgaaagcccgacttctagcgtattggacaaaaaggaaggcgagcaggctaaagccattttcgagaaggttaagaggttccgcatgcacgtggaacagaaagacataatctatagagtctacctaaagcagatcattgtgaaagtgattctattcgttcttattataacttacgttccctactttcttacgcatattacactggagatcgattgcagcgtagacgttcaggcttttacgggctacaaacgctaccaatgcgtttacagtcttgctgagatcttcaaagtgctggccagtttctacgtgatcctggtgattttgtacggcctgactagttcttactcactgtggtggatgctgagaagcagtttaaaacagtacagctttgaggcgctacgcgagaaatcaaattactctgatatcccagacgtgaaaaatgactttgcatttatcctgcatctggccgatcagtatgatcctctctattcaaagaggttcagcatattcctctcagaggtgtcagaaaacaagctcaaacaaatcaatcttaacaacgagtggactgttgaaaagctcaaatcaaaactggttaaaaacgcacaggacaagattgaactacatctcttcatgcttaacggacttcctgacaacgtctttgagttgacggaaatggaagtgttatcccttgagctcattcccgaggttaaactcccatctgccgtgagccagttggtgaatctaaaggagctacgtgtgtaccactcgagtcttgtggttgaccacccggcattggctttcctggaggagaatctcaaaattttgaggttaaaatttaccgaaatgggtaaaattcctagatgggtgttccatctgaagaatcttaaagagttgtatttgtctgggtgcgtgctccctgagcaattgtccacgatgcagttggagggctttcaggacttgaagaacctccgtactctctatctgaagtctagtctgagcagaatacctcaggtcgttacagaccttctgccgtccctgcagaaactgagcctcgacaacgagggttccaagctggtggtcctgaacaatcttaagaaaatggttaaccttaagtctttggaattaatctcctgtgacttggagagaatcccccatagcatcttcagcctgaacaaccttcacgagctggacctgcgcgaaaacaacctcaagactgtggaggagataataagctttcagcatctccagaatctctcctgccttaaactgtggcacaacaacattgcctacatcccagcccagattggggcactgtcaaacctggaacagctatccctagaccataataatattgaaaacctgcctcttcagctgttcttgtgtacaaagctgcattacctcgacctcagctacaaccacctcacattcattccagaagagatccagtacctgtcaaatttgcaatacttcgccgtgactaacaataacatcgaaatgttacctgacggtttgttccaatgcaagaagctccaatgcctgcttctgggcaaaaactccctgatgaatctgtccccacacgtgggagagctctccaatctgacacacctggagctcatcggcaactacctcgagacgctcccgccagaactggaaggttgccagagcctgaaacggaactgcctgatagttgaggagaacctgctcaataccttgccacttccagtgacagagcgccttcagacatgccttgacaagtgctag

SEQ ID NO: 228311 - DNA, 2412 bp, Artificial Sequence
  Description of Artificial Sequence: Synthetic coding sequence
atgatcactctgaccgagctgaagtgtctcgcagacgcgcaatcttcctatcacattcttaaaccttggtgggacgtgttctggtactacattacacttataatgctgcttgtggccgtgctggctggagcgttgcagctgacccaatctcgagtcctgtgctgcctcccttgcaaagttgagttcgataaccactgtgccgtcccctgggatatcttgaaggctagcatgaacacgagcagtaacccgggaaccccattgccccttcccctgcgcatccagaatgatcttcaccgacagcaatacagttacatcgacgccgtgtgctacgagaaacaactccattggttcgccaagttctttccatacctagtgcttctgcatacactgatcttcgctgcgtgtagcaatttctggctgcattaccccagtacttcctcccgtctagagcatttcgtggctatcctgcataaatgtttcgacagcccctggacaaccagggccctgtctgagactgtagcagagcagagcgtaaggccattgaagcttagcaagtccaagatcctcctgtcctcatccggctgtagtgcggacatcgacagcggcaaacagagcctgccttatccccagcccggtctcgagtctgcgggaatcgagtccccaacctcttcggtgctcgacaaaaaggagggggaacaggccaaagcaatattcgagaaggttaaaagattcaggatgcatgtcgagcagaaggacattatttatagggtgtatttgaagcagatcatagttaaggttatcctctttgtgctcattatcacctatgttccatattttctcactcacatcacactggaaatcgactgcagtgtggacgtgcaggcctttaccggctacaaaagataccagtgcgtgtactcactggcagaaatcttcaaggtcctcgcctccttctacgtcattctcgtcattttgtacggcctcactagtagttactcactgtggtggatgctacggtctagcctgaaacagtactcgttcgaggcacttagagagaaatctaattactctgacatccctgatgtcaagaatgatttcgcattcatactccatctggcagaccaatacgatcccctgtacagtaaacggttcagtatctttttgtcagaagttagcgaaaacaaattgaaacagatcaatctgaacaacgagtggaccgtggagaaactcaagagtaagctggtgaaaaatgcgcaggacaaaatagagcttcacctgtttatgctcaacggattgcctgataatgttttcgagctaactgagatggaagtcctgtccctggagctgatccccgaagttaagctgcccagtgccgtgtcgcagctggtgaatctgaaggaactgcgggtgtatcactcatccttagtggtggatcaccccgcactggctttcctggaggagaatcttaaaatcttgaggcttaaattcactgaaatgggaaagatcccacgctgggtctttcatctgaaaaacctcaaggagctttatctcagtggttgtgttttgccagagcagctgtctaccatgcagctcgaagggttccaggaccttaagaatcttcgtactctatacttaaagtcatcgctgtctagaatcccacaggtggtcacagatctgttgccttcgctgcaaaaactgagcctggataacgaggggagcaagttggtggtactcaataacctgaagaagatggtgaatctgaagtcgctggaactcattagttgtgacctggagcgcattcctcattctatattttcactgaacaacttgcacgagctggatctacgggagaacaacctcaaaactgttgaagagatcatcagttttcaacacctgcagaatctgtcgtgcttgaaattatggcacaacaatattgcttacatcccagcccaaattggggctctgagtaatcttgaacagctgtctctcgatcacaacaatatcgagaatctgcctctccagttgtttctctgcaccaagttgcactaccttgaccttagctacaaccatctcaccttcattccagaagaaattcagtacctgagcaacctacagtattttgcagtcacaaacaacaatatcgaaatgctgccggatggcctatttcagtgcaagaagctgcagtgcctccttctgggcaagaactctcttatgaacctgtctccccacgtcggtgagctatccaacctgacgcatctcgagctgatcggcaactacttggagactttaccgcctgagctagaaggctgtcagtccttgaaaaggaactgtttgattgtcgaggaaaatctgctgaatacgctgccacttcccgtcacagagcgcctgcagacatgcctggataaatgttag

SEQ ID NO: 228312 - DNA, 2412 bp, Artificial Sequence
  Description of Artificial Sequence: Synthetic coding sequence
atgataactcttaccgagctcaaatgcctggcagatgcccaatcctcctatcacatacttaagccctggtgggacgtgttttggtattacattaccctgatcatgctgcttgtggctgtgttagccggagccctccagttaacccagtctagagtattgtgctgcttgccctgcaaagtagaatttgataaccactgtgcggttccctgggacatcctgaaagccagcatgaatacttcgtccaatcctggaactcccctccccctgccgttgagaattcagaatgacctgcatcgccaacagtattcatacatcgatgcagtctgctacgagaagcagcttcactggttcgcgaaattttttccttaccttgtcctgctgcacacactgatctttgccgcttgttccaacttctggctgcattatccatccactagctcacggctggaacattttgtcgccattctacacaagtgcttcgacagtccctggacaaccagagctcttagcgagacggtggcagaacaaagcgtccgacctctcaaattgagcaagtccaaaattctgttgtcttcaagtggatgcagcgccgatatcgatagcggcaagcaatctctcccctatccccaaccgggtctcgagtccgcagggatcgagagtccaacctcgtcagtcctcgacaaaaaggaaggcgaacaagccaaagccatttttgagaaagtcaagcggtttaggatgcacgttgagcaaaaagacatcatctatagagtttatctcaagcagatcatagtaaaagttattctttttgtgctgatcattacttatgtgccttattttctaacacatatcacactggagatcgactgctcggtagacgtgcaggccttcactggctataagagataccaatgcgtctactcgctggccgagatctttaaggtgcttgcttcattctacgtcattctagtgattctatatggactcacatcctcttattcgctctggtggatgcttagatctagtttgaaacaatacagctttgaagctttgagagagaagagcaattactcagacattccagatgttaagaatgatttcgcctttatcttacatctggcagatcaatacgaccccctgtacagcaagcgtttttctatcttcctgtcagaggtgtccgagaataagctgaagcagattaatctcaataatgaatggactgtggaaaaattgaaatccaaactggtaaaaaacgctcaagacaagatcgagctgcatctgtttatgcttaatgggctgcctgataacgtgttcgaactgacagagatggaggtgctgtcactggagctgataccagaggtcaaactgccgtccgccgtgtctcagctagtgaatctgaaggagctgagagtttatcactccagtctggtcgtcgaccatccggcactggcctttctcgaggagaatctcaagattctgcgactgaaattcactgagatgggcaaaatccccagatgggtttttcacttaaagaacctcaaggagctgtacctgtcaggatgtgtactgcccgagcagctgagtacaatgcagctcgaaggtttccaggacctcaagaatcttaggaccctttatctgaagagcagcctcagtcgcattccccaggtggtgactgatctacttccaagcctgcaaaagttgtcactggacaatgaaggaagtaagctggtagtcctgaacaatctgaaaaaaatggtgaatctgaagtctcttgagctgatctcatgcgatctggagcggataccacactccatcttctccctgaacaacctccatgaattggacctgcgggagaataacctgaaaaccgtggaggagattataagctttcagcatctgcagaacctcagctgcctgaagttatggcataataacatcgcatacatccccgctcaaatcggtgcgctttctaatttggagcagctgtcactggaccacaataatattgaaaatctccccctgcagctgttcctgtgcaccaagcttcattacctcgacttatcctacaatcaccttaccttcatacctgaggaaatccagtatctgagcaacctccagtatttcgcagtgaccaataataacatagagatgctgccagatggcctgttccagtgcaagaaactgcagtgcctgcttctcggcaaaaattctctgatgaatctttccccgcacgtcggggagctttccaatctgacccaccttgaactgattggaaattatctggaaacacttccacccgaactagagggatgccagtccctgaagcgtaattgtctgattgtggaagagaacctgctaaacacgcttcctctgcccgtcaccgagagactgcagacatgtcttgataagtgttag

SEQ ID NO: 228313 - DNA, 312 bp, Artificial Sequence
  Description of Artificial Sequence: Synthetic coding sequence
atgattacgctaacggaactgaagtgcctcgccgatgcacagtcgagttaccatatacttaagccctggtgggacgtgttctggtactacattactttgattatgttactggttgctgtccttgctggagccctccagcttacccagtctcgcgtgttgtgttgtctgccctgcaaggtggagtttgacaatcactgcgcggtgccttgggacatcctgaaagcatcgatgaacacttcttccaacccagggactcctctcccactgcctctgcggattcaaaatgatctccacaggcagcagtattcctag

SEQ ID NO: 228314 - DNA, 693 bp, Artificial Sequence
  Description of Artificial Sequence: Synthetic coding sequence
atgatcactttaaccgaacttaagtgcttagccgatgcacagtcatcgtatcacatccttaagccttggtgggatgtcttttggtattacataacgttgattatgttgctggtggctgtgcttgccggagccctgcaattgacccagtcacgcgtcctgtgttgcttaccatgtaaggttgaatttgacaatcattgtgcggttccatgggatatcttgaaggcaagcatgaatactagcagcaaccctggcacgccactacccttgccacttagaatccagaatgaccttcaccgtcagcaatacagttacatagacgctgtgtgctacgaaaaacagcttcactggtttgctaaatttttcccgtatttggtgcttctacatacactgatctttgctgcgtgcagcaatttctggctgcactatccttctacttccagtagactggaacactttgtggccatcctacacaagtgcttcgacagtccatggacaactagagctctttccgagacagttgcggagcagagtgtgcggccactcaaactgtcaaagtcaaagattctgttatcttctagcggatgtagcgcagatatcgactctggcaagcagtctttaccatacccacagcccggtctggagagcgctgggatcgaatctccgacttccagcgtgcttaccgaggggggatag

SEQ ID NO: 228315 - DNA, 2412 bp, Artificial Sequence
  Description of Artificial Sequence: Synthetic coding sequence
atgatccctgtcacggaatttaggcagtttagcgagcaacagcctgcctttcgggtgctcaagccatggtgggatgtcttcaccgactatctttctgtggccatgctgatgataggcgtctttggctgtacactgcaggtgatgcaagataagataatttgtttgcccaaacgcgtccagccggcacagaaccactcctccctctcaaacgtaagccaggctgtggcctccacaaccccactgcctcccccaaaaccatcccctgccaatcccattaccgttgagatgaagggactgaagactgatctagacctccagcagtattctttcatcaatcagatgtgctacgaaagagccctgcactggtacgctaagtattttccttacctcgtcctgatccacactctggtctttatgctatgcagcaatttctggttcaaatttcccggtagctctagtaagatcgaacattttatcagcatcttagggaagtgctttgatagcccttggacaacacgggcattgtcggaggtgtcaggggaagatagcgaggagaaggataaccggaagaacaatatgaaccgctctaacacaatccaatctggtcctgaggatagtttagtaaatagccaaagcctgaaatctatcccagaaaagtttgtggtggataaatccaccgcgggtgcattggataaaaaggagggcgaacaggcaaaggccctctttgagaaagtgaagaaattcaggctgcatgttgaagagggcgacattctgtatgcaatgtacgtccgacagactgttctcaaagtgatcaaattcctcatcatcatcgcatataatagcgctttagtctcgaaagtgcagtttactgtggactgtaatgttgacatccaagacatgacagggtacaaaaacttttcttgtaaccatactatggctcatctgttttcaaagctgtccttctgctacctgtgttttgtgagtatttacggtttgacttgtctgtacacactttattggctgttctatagaagtttgcgggaatactcctttgagtatgtgaggcaggagaccgggatcgacgacatcccagacgtcaagaacgacttcgctttcatgttgcatatgatcgatcagtatgacccactgtactccaaacgttttgcagtttttctgtctgaggtctctgaaaacaagcttaagcaactaaacctcaacaatgaatggacaccagacaagctgcgccagaaactccagacaaacgctcataacaggctggagctcccgctcataatgctctccgggctgcctgataccgtatttgagattaccgagcttcagtcccttaaacttgaaatcattaagaacgtcatgatccctgccaccatcgcccaactcgataacctgcaagaattatctttgcaccaatgctcagtgaaaatccactcagcggctttaagttttctgaaagagaatttaaaggtcctgtcagtgaagtttgatgacatgagggaactgcccccttggatgtacggtcttcggaacctcgaagagctgtacctggtgggctctttgtcacatgacattagtcgtaacgttactcttgaaagcttgcgcgaccttaagagcctcaaaatcctctcgataaagagtaatgtcagcaaaatcccgcaagctgtagtggacgtgagtagtcacctgcaaaaaatgtgtatacacaatgacggaacaaaactcgtcatgctgaataatttgaaaaagatgactaacctgactgaattggagctggtgcactgcgaccttgagagaattccacacgccgtgttttccctcctgagcctccaggaattggacctcaaagagaacaacctgaaaagcattgaggagatagtgtccttccagcatctgagaaagcttacagtgctgaaactatggcacaattccattacttacatacccgagcatatcaaaaaactgacaagccttgagagattaagcttctcccacaacaaaatcgaggtcctccctagccacttgttcctctgcaataagatcaggtacttggatctctcctacaacgatatccgattcatcccaccagaaatcggcgtacttcagtccctgcagtattttagcatcacctgtaataaggtggaatcattgccagatgagctctatttttgtaagaagcttaaaaccttgaagatcggcaagaactcccttagcgtcctgagtcctaaaattgggaatctcctcttcctgagctacctggacgtgaagggaaatcactttgaaatcctgcctcctgagctgggcgactgtagagcgctcaagcgggcaggccttgtggtggaggatgcactgtttgaaactttgccatctgacgtcagggaacaaatgaagactgagtag

SEQ ID NO: 228316 - DNA, 2577 bp, Artificial Sequence
  Description of Artificial Sequence: Synthetic coding sequence
atgttcactctcgccgaagtcgcatctctgaatgacattcaaccgacctataggattctgaaaccttggtgggatgttttcatggattatctcgctgtggtcatgctgatggtcgctatttttgccggaaccatgcagctaaccaaggaccaggttgtgtgcctccccgtgctgccatctcccgtgaacagtaaagcccataccccccctggtaatgccgaggtaacaacgaatattccaaagatggaggcagcaaccaatcaagaccaggacgggagaactacaaatgatattagctttggaacaagcgccgtgacccccgacattccacttagggccacatatcctcggactgacttcgcattgcccaatcaggaggcgaaaaaggaaaaaaaagacccaactggtcgaaagacgaacttggacttccagcagtatgtgttcatcaatcagatgtgctatcatctggccttgccctggtatagcaagtattttccttacttggccctgattcataccatcatcctgatggtgagtagcaacttctggtttaaataccctaaaacctgttcaaaggttgagcactttgtgtccattcttgggaagtgcttcgagtccccctggacaaccaaagcactttccgagaccgcctgcgaggattctgaagagaacaagcaacgtatcacaggagcccagacactgccaaaacatgtgagcacttcgagtgatgagggaagtcctagcgcaagcacgcctatgataaacaaaacgggtttcaaattctccgctgaaaagccagtgatagaagtgccaagcatgaccatactggacaagaaggatggagagcaggccaaggctctgtttgagaaggtccggaagtttcgggcacacgtggaagactcagacctgatctacaaattatacgtggtgcaaacagtgatcaagacggctaaattcatatttattctgtgctacacagctaattttgttaacgccattagctttgagcatgtgtgtaaaccgaaagtcgagcaccttatcggatacgaagttttcgaatgtactcataatatggcctacatgctgaaaaagttgctgatatcatacatatccattatatgtgtatacggttttatctgcctgtacacactattctggctgttccgcattcctctgaaggagtatagctttgagaaggtgcgagaagagagtagcttttccgacatcccagacgtcaagaatgacttcgcgtttctgctgcacatggttgaccagtatgaccaactttattctaaacggtttggggtgttcctgtccgaggtcagtgagaacaagcttagggaaatatccctaaaccatgagtggacattcgaaaagcttagacagcacattagtcgaaacgcacaagacaagcaagagctgcacctgttcatgctgtctggagtgccggacgcggtcttcgatttgacggatcttgacgttctgaaattggaactcatccctgaagcgaaaatccccgcaaaaattagtcagatgacgaacctacaggagctgcacctgtgccattgcccagcaaaggtggaacagaccgccttctctttcctgcgggaccatctgcgctgtctgcatgtaaagttcactgatgtggccgaaatccccgcatgggtgtatctgctcaaaaatcttagagagctgtacctgatcggtaacttgaatagcgaaaataataaaatgattggcctagaatctttaagggagctccgccatctcaagattctgcatgttaagagcaatctgactaaagtgccttcaaatattacggacgtggctccccatttgacaaagctggtgattcacaacgatggcaccaagctccttgtcttaaacagtctgaaaaagatgatgaatgtggcagagctggagttacaaaactgcgagctagagaggattccccatgccattttcagcctcagtaatctgcaagagcttgatctcaagtcaaacaatattcgcaccatagaggagataattagcttccagcatttgaaacgcctaacatgcctgaagctctggcataacaagattgtgaccattcctcccagcataacgcacgttaaaaaccttgagtctctgtacttctccaataacaagctcgagagcctccccgtggctgtcttctcattgcaaaagctgaggtgcttggatgtcagctataacaatatcagcatgattcctatcgagatcggtttactccagaacctgcagcacctccatattaccggtaacaaggtcgatatccttcccaaacagctcttcaagtgtatcaagcttcgaacattgaatttgggacaaaactgcattacaagtctccctgaaaaggtagggcaactctcacagctgacccagctggagctgaagggcaattgtctggacaggctcccagcgcaactgggtcagtgcaggatgcttaagaaatcagggctggtcgttgaggatcacctattcgacacgcttcccctggaggtgaaagaagctcttaaccaggatatcaatattccctttgcaaatggcatttag

SEQ ID NO: 228317 - DNA, 2577 bp, Artificial Sequence
  Description of Artificial Sequence: Synthetic coding sequence
atgttcactcttgcagaagtcgctagtctgaacgacatccagcccacctacagaattctcaaaccttggtgggacgtctttatggattatttagcagtggtgatgctaatggtcgccatttttgctggtacgatgcaattgaccaaagaccaggtcgtctgcctgccggtattgccatcccccgttaatagtaaggctcacacacctcccggaaatgccgaagtgacaacaaacatcccaaaaatggaagcggctaccaatcaggatcaggacggacggactaccaacgatatctcttttggtacctcagctgtcaccccagatatcccactcagagccacttacccccgaacagactttgctcttcccaaccaggaggcaaagaaagagaagaaggacccaactggacggaaaacgaacttggattttcaacagtacgtgttcatcaaccagatgtgctaccacctggccctgccatggtattccaaatattttccatatctggcgctaattcatactatcattctcatggtgtcatccaatttctggtttaagtaccctaaaacctgttccaaggtggaacacttcgtcagcattttggggaagtgttttgagagtccctggaccaccaaagcactgagcgagacagcctgcgaagactccgaggaaaataaacagcggattaccggcgctcagacccttcccaagcacgtgtctacaagctccgatgaaggaagcccttcagcctccactcccatgattaataagacaggttttaaattctccgcagaaaagcctgtgatagaagtgccttcgatgacaatcttggataaaaaagatggcgaacaggccaaggccttattcgaaaaagttagaaagtttagggcccacgtcgaggactcagatttgatttataaactgtacgtggttcagacagtgatcaagaccgctaagtttatctttatcctgtgctatactgctaactttgttaacgcaattagtttcgaacatgtgtgtaagccgaaggttgaacaccttattggctacgaggtgttcgagtgtacccacaatatggcatacatgcttaaaaagctcctgataagttacatttctatcatctgcgtttatggctttatctgcttgtacactctgttttggttgtttagaatccctctgaaggagtatagtttcgaaaaagtaagggaagagagtagcttttcggacatccctgatgtaaaaaacgacttcgccttcctactacatatggtcgatcagtacgatcagctctactctaaacgcttcggggttttcctctccgaagtctcggagaataaattgcgggagatctctctaaatcacgaatggacattcgagaaactgcgacaacacatttccagaaatgcccaggataagcaagagcttcacctctttatgctatccggcgtccctgacgccgtgttcgacttgactgacctggatgtgctcaaattggagctaatcccggaagccaagatccctgccaaaatcagccagatgacaaatctgcaggaacttcatttatgccactgtcctgcgaaggtggagcagactgcctttagtttcctgcgggaccatctgcgttgtctgcacgtgaaatttaccgacgtggccgagatcccggcatgggtctacctgctcaagaatctgagggaactgtatttgatcgggaacttgaattccgaaaataataaaatgataggcctcgagtctctccgcgagcttcgccacttgaaaatccttcacgtgaagagcaacctgacaaaagtgccctctaacattacagacgtcgctcctcaccttacaaagttagtgattcataatgacggcacaaagctgctggtgctaaacagtcttaagaagatgatgaacgtagctgaactagaattacagaactgcgagctggagagaatcccccacgctatatttagtctttctaatctccaggaactggacttgaagtcaaataacattcgcacaatagaagaaataattagctttcagcatttaaaacgcctcacctgcctcaaattgtggcacaacaaaattgtgactattccaccctccattacccacgtcaaaaatcttgagagcctgtatttttctaataacaaattggagtcccttcctgtggctgttttttccctgcagaagctcaggtgtctggatgtctcttataacaacatcagtatgattccaattgagatcggattgctgcagaacctgcaacacctgcacattaccggaaataaggtagacatacttcccaagcagctcttcaagtgtatcaagttgcggacgctgaatttagggcagaactgtataaccagtctgcctgagaaagtcggccagttgagccagctcacacagctggaactgaaaggcaactgtctcgatcgtctcccagctcagctcggacagtgccgcatgctcaagaagagtggtctcgtggtggaggaccatctgtttgacactctgcccctcgaagtgaaagaagccctgaaccaggacattaacatcccattcgctaacggaatatag

SEQ ID NO: 228318 - DNA, 354 bp, Artificial Sequence
  Description of Artificial Sequence: Synthetic coding sequence
atgttcaccttagccgaagtggcaagcctgaatgatattcagccaacttacaggatcctcaaaccatggtgggatgtctttatggactatctagccgtggtaatgctgatggtggcgattttcgcgggtacaatgcaactgactaaagaccaggtggtgtgcctgcccgttctgccaagccccgtaaattctaaggcacacacccccccagggaacgccgaggtaacgacaaacattcctaagatggaggcggcaaccaaccaggatcaggatggacgaacaacaaacgacatatcctttgggacatctgccgtaacacctgacatacctctgagggccacctatccaagatag

SEQ ID NO: 228319 - DNA, 825 bp, Artificial Sequence
  Description of Artificial Sequence: Synthetic coding sequence
atgttcaccttggcagaagtggcaagcctcaatgacatccaacccacctatcgaatcctgaaaccttggtgggacgtatttatggattacttagcagtggtgatgctcatggtggccatctttgcagggacaatgcagctcactaaagatcaggtagtgtgcctgccagttttgcccagtcctgttaacagcaaagcacacacacctcctggtaacgcagaggtaactaccaacattcccaagatggaggctgcaacgaaccaggaccaagatgggcgaacaacgaacgacataagcttcgggacgtcggcggtgacgccagacatacccctacgagccacctacccaaggacagacttcgccctgcctaatcaggaggctaagaaggagaagaaggacccgacggggagaaagaccaacctcgacttccagcagtacgtcttcattaatcagatgtgttatcacctggcactgccttggtatagcaagtacttcccatacctcgccctcattcatactattattctaatggtctcttcaaatttctggtttaaataccccaaaacctgcagcaaagtggagcactttgtgtccattctcgggaaatgtttcgagtccccctggacgactaaagcactgtctgaaactgcatgcgaggacagcgaagaaaacaagcagcggattaccggcgctcaaaccctacctaaacacgtctccacatccagtgacgaggggagtccatccgcctccaccccaatgattaataagaccgggtttaaatttagtgcagagaagccggtcattgaggtccccagcatgacctag

SEQ ID NO: 228320 - DNA, 96 bp, Artificial Sequence
  Description of Artificial Sequence: Synthetic coding sequence
atgttcactctggctgaggtcgcaagcctcaacgacattcagcctacataccgcatattgaagccatggtgggacgtgtttatggattacttatag

SEQ ID NO: 228321 - DNA, 564 bp, Artificial Sequence
  Description of Artificial Sequence: Synthetic coding sequence
atgttcaccctagcggaggtcgcatccctgaatgatatccaacccacataccgcatcctgaagccttggtgggatgtcttcatggactatctagctgtcgtaatgctcatggtggccatctttgccggaactatgcaactcacaaaagatcaggtcgtgtgtctgcctgtgctgcccagccccgtgaactccaaggcgcacacccctccaggcaatgcagaggtgactactaatatcccgaaaatggaggcagccacaaatcaggatcaggacggcagaaccacaaatgatatatcatttggaacctcagccgtgacccctgatattcctctgagggcaacgtaccctcggactgacttcgccttgcctaaccaggaagctaagaaggagaagaaggaccctacaggtagaaaaaccaacctggacttccagcagtacgtgtttattaatcagatgtgctaccacctggcactgccatggtacagcaaatatttcccctatctcgccctcattcataccataatcctgatggtatcctcaaacttttggttcaagtacccttag

SEQ ID NO: 228322 - DNA, 369 bp, Artificial Sequence
  Description of Artificial Sequence: Synthetic coding sequence
atgttcaccctggctgaagtggcgtccctaaacgatatacagcctacctaccggattctcaagccctggtgggacgtcttcatggactacctcgcagtggttatgttgatggtggccatctttgcgggtacaatgcagcttacgaaggaccaagtcgtctgcctgcccgttctgccatcacctgtgaacagcaaggcccacactccacccggtaatgctgaggttaccaccaatatccccaaaatggaagcggcaaccaatcaggatcaggacggccgaaccactaacgatatttctttcggtacctccgcagtgactcccgatatcccactgcgcgcaacctatccccgtacagacttcgcgctatag

SEQ ID NO: 228323 - DNA, 2391 bp, Artificial Sequence
  Description of Artificial Sequence: Synthetic coding sequence
atgatacccgtggccgaatttaaacagttcaccgagcagcagccagccttcaaggtcctgaagccatggtgggacgtgctggcagagtatctgactgtcgcaatgttaatgatcggcgtgttcggctgtaccctgcaagtgacgcaggataagataatctgccttcctaaccatgagcttcaggaaaatttgagcgaagctccgtgtcagcagctgctcccccgtggaatcccagagcaaatcggtgcccttcaggaggtgaaaggcttgaaaaacaacctggaccttcagcagtatagcttcattaaccagctgtgttatgagaccgctctgcattggtatgcaaaatattttccctacctggtggttattcacactctcatatttatggtgtgcacaagcttctggtttaagttccccggaacttcgagtaaaatcgagcactttatctcaatcttgggtaaatgcttcgactccccgtggaccacacgcgcactgagcgaagtttctggtgagaaccaaaaagggcctgctgcaacagagcgagccgcagccaccatcgtcgcaatggcaggaacaggacctggaaaagcaggggagggggagaaggagaaggtgttggcggaacctgagaaggtggtcaccgagcctcccgtcgtgacattgctcgacaagaaggagggagagcaggctaaagcgctgtttgagaaggtcaaaaagttcagaatgcacgttgaagaaggcgatatcctgtacaccatgtatatcagacagaccgtgctgaaggtgtgcaaatttcttgcaatactggtctacaatctggtgtatgtcgaaaagatttctttcctggtggcttgccgagtagagacaagcgaggtgaccgggtacgcctctttctgctgcaaccatacaaaggcgcacttattttctaagctggccttctgctacattagctttgtttgtatctatggtttaacgtgcatctacaccctatactggctattccaccgtcctctgaaggagtactctttcaggagcgtgcgcgaggagactggcatgggggacatacccgacgtcaagaacgacttcgccttcatgctgcatctgattgaccagtatgactctctttattccaagcgctttgcagtctttttgtccgaggttagtgagagtcgactcaagcagcttaacttaaaccacgaatggacacccgagaaactgcggcagaaactacagagaaacgccgctgggagactagagcttgcactgtgtatgctgcccggtctgcccgatactgtgttcgaactgtcagaagttgagtctctcagactagaggctatttgcgatatcaccttcccccctggattatcccaactggttcacctgcaggagttgtcactgctgcacagcccggcaagactgcccttcagtcttcaagtgtttctcagagatcacttgaaggtgatgcgggtcaagtgtgaggagctacgcgaggttcctttgtgggtatttgggctaaggggtttggaggaactgcacttggaagggctatttcctcaggaattagctcgggcagcgactcttgagagcttacgagagctcaaacagttgaaagttttgtccctcagatcaaacgccggtaaggtgcccgctagtgtcacagacgtcgccggacacttgcagcgcttgtccctgcataatgacggcgctagattggtggcacttaactccttaaaaaagctggccgctctacgcgaattagaactggtcgcctgtggcctagagaggattccccatgccgtgttcagcctgggcgctctgcaggagcttgatctcaaagataaccatttaagatcaattgaagaaatattgagttttcagcattgtaggaaattggtgactctgcggctgtggcacaatcaaatcgcatatgtgccggagcatgttaggaagctacgctctctggaacagttatacctgagttataacaaattggaaaccttgccttcccagctgggcctctgctcgggtctgcgcttgctcgatgtttcgcataatggcctccattcactgccacccgaggtgggactccttcagaacctgcagcatttggcactgtcctacaatgccttagaagctttaccagaggagttgttcttctgccgaaaactgcgcaccctgctgttgggagacaatcagcttagtcaactgagccctcacgtgggggctctgagagctctcagccgcttagagctgaagggtaatcggctggaggcattgccagaagagctggggaactgtggcggattgaagaaagccggactgctggttgaggatactctttaccaggggcttcctgccgaggttcgggataaaatggaagaggaatag

SEQ ID NO: 228324 - DNA, 1569 bp, Artificial Sequence
  Description of Artificial Sequence: Synthetic coding sequence
atggatttcctgctgttaggtctgtgcctctactggctgttgcgcagaccgtccggagtggtgctatgcctgctgggtgcgtgttttcaaatgctacccgctgccccatctggctgtccccagctgtgcagatgcgaaggtagactcttgtactgtgaagcgctgaatctcaccgaagcaccgcacaacctgagcggccttctggggctgtctctgaggtacaattctttatcagagctgcgggcaggccagtttactggcctcatgcagctcacttggttgtatttggatcacaaccacatttgttcagtacagggggatgcttttcaaaaacttcgccgagtaaaagagctgactctgtcatctaatcagatcactcagctgcccaacaccacctttagacccatgcccaatcttcggtccgtggacctgtcttacaataaactgcaggctttggcccctgacttgtttcatggactgcggaagctcaccacacttcatatgagagctaacgccatacagttcgtcccagtgcggatctttcaggactgtagatctttgaagttcctcgatattggttataatcagttaaaaagcctcgcccgaaatagctttgccggtctgtttaagctcaccgagctccatctagagcataatgatctcgtgaaagttaatttcgcccatttccccaggttaattagtctgcactcactgtgtcttcgcagaaataaagtggccatcgtggtaagctccctggactgggtgtggaaccttgaaaagatggatctttccggcaacgaaattgaatatatggagcctcatgtttttgagacggtgccccacttgcagagcctgcagttagattctaatagattaacctacattgagcctaggatcctcaactcttggaagtcactgacgtcgatcacgttagctggcaatctctgggactgtggacggaacgtctgcgctctggctagctggctgaataacttccaaggtcgctatgacggcaatctccaatgtgccagcccagaatatgcacaaggggaggacgttcttgatgctgtgtatgcattccatctctgcgaggacggagcggagcctacctcaggccatcttttaagtgccgtgactaacagaagcgatctcggcccacccgcaagcagtgctacaaccctcgccgatggtggagagggacagcacgatggaaccttcgagcctgctacagtggctctgccagggggagagcatgccgagaatgcggtccagatccacaaggtagtgaccggcacaatggccctgatatttagcttcctgatcgtggtgttggtattgtatgttagctggaaatgtttcccagcttcactgaggcagcttcggcagtgcttcgtgacacagcggagaaagcagaaacagaaacaaaccatgcaccaaatggctgccatgtccgcccaggagtattatgtcgattataagccaaatcatattgagggcgctctcgtgatcatcaacgaatacggcagctgcacatgtcaccagcagcccgcacgggagtgcgaagtttag

SEQ ID NO: 228325 - DNA, 1569 bp, Artificial Sequence
  Description of Artificial Sequence: Synthetic coding sequence
atggacttcctgctgctcggtctttgtctgtactggcttttgaggcgaccttccggtgttgtcctatgtcttctgggggcatgttttcaaatgctccccgcagcgccatcaggctgccctcagctgtgccggtgcgaaggacgactactgtattgtgaggcgctgaacttgactgaggcaccacacaatctgagcggcctgctgggactctctctgcggtataacagcctgagcgagttacgggctggacagtttaccggtctgatgcaattgacctggctgtatctggatcataaccatatctgctctgtgcaaggcgacgctttccagaagctccggcgagtgaaggagcttaccctttcaagcaaccagataacacaactgcccaacaccacatttcgaccaatgccgaatctgagatcagtcgacctatcttacaacaagcttcaggccctggcaccagacctcttccacggattaagaaaacttactacccttcacatgcgtgctaacgccattcaatttgtgccggtaaggatttttcaggattgtaggtccctgaaattcctagacatcgggtataaccagctgaagagcctcgcacgaaattcttttgccggtttattcaaactaacagaactccatttggagcacaacgaccttgtaaaagttaactttgcccacttccctcgattgattagtctgcattccctttgccttcggagaaacaaagtggccatagtggtgtcatctctggactgggtgtggaacctggagaagatggatctgtcaggtaacgaaattgagtacatggaaccacacgtgtttgagactgtaccacatctgcaaagcctacagttggacagcaataggctcacttacatcgagccacgcatactcaattcttggaaaagtctgactagcattaccctggccggaaacctatgggactgtgggaggaatgtctgcgcgctggcaagctggctcaataacttccagggtcggtacgacggaaacctccaatgtgcttcgcccgaatatgctcaaggcgaggacgttctggatgcggtctacgcctttcatctttgcgaggatggtgccgagcctacgtcaggtcacctactctcagccgtcactaaccggtcagacctgggcccacctgcatccagtgcaactactttggcagatgggggagagggtcagcatgatggaactttcgaacccgcaacagtggccctcccaggtggggagcacgccgaaaatgcagtgcagatccacaaggtggttactggaaccatggctctcatcttctcattcctaattgtcgttctggtgttgtatgtaagctggaaatgcttcccagcaagcttgcgccagctgaggcagtgttttgtgactcagcggaggaagcagaaacagaagcagaccatgcaccagatggccgcaatgtctgcacaggaatattatgtggactataaaccaaaccacattgagggagctctcgtcatcatcaatgagtacggctcctgcacctgtcaccaacaacccgcaagagagtgtgaggtctag

SEQ ID NO: 228326 - DNA, 330 bp, Artificial Sequence
  Description of Artificial Sequence: Synthetic coding sequence
atggatttcctcctcctgggactctgtctttattggctgctccggcgaccttctggagtggtactttgcctactgggggcttgtttccagatgctgccagccgctccatctggctgcccccaactctgccgatgcgaagggagattgctctactgtgaggcactgaacctgacagaagcaccccacaatctgtccggactgttagggctaagtctccggtataattcactgagcgaactacgcgcaggccagtttacaggactgatgcagttaacttggttgtatctagaccataaccatatctgttcggtccaaggcgacgccttctag

SEQ ID NO: 228327 - DNA, 672 bp, Artificial Sequence
  Description of Artificial Sequence: Synthetic coding sequence
atggacttcttgctattgggcctgtgtctgtactggctgctccgcagacccagcggtgtcgtactgtgtctgttaggcgcttgttttcagatgctgcccgctgcacccagcggctgccctcagttatgtcggtgtgagggaagactgctatattgtgaggcgctgaatcttactgaggccccacacaatctgagcggactgctcggcttatcgctgcgctataatagcctgtcggagctccgcgctgggcagtttacagggttgatgcagctaacttggctgtatctggaccataatcacatttgtagcgtacagggtgacgcttttcagaaacttcgaagagtgaaggagctgacactcagctccaaccagatcacacagttacctaatactacattcagacctatgccaaatcttaggagtgttgacctgtcttataacaaattgcaagcgttagctcccgaccttttccacggacttagaaaacttactacactccatatgagagccaatgccatccagttcgtgcccgtgcgcatcttccaggattgtagatcattaaagtttttggacatcggatataaccaattgaagtccctggcacgaaacagcttcgcgggattgttcaagctcactgagttgcacctcgaacacaacgatctggttaagtag

SEQ ID NO: 228328 - DNA, 1569 bp, Artificial Sequence
  Description of Artificial Sequence: Synthetic coding sequence
atggatttccttctcctgggtctctgtctgtactggctgcttcgacggccttccggagtagtgctgtgcctactcggagcctgttttcagatgctgcctgctgccccatcaggatgtccacagctctgtcgctgcgagggccgtctcctttactgtgaagcgctgaatcttacagaggcgcctcacaacctaagcggtttgctcggcttaagtctgcgctacaactcactgagcgagctaagggctggccagtttaccggactgatgcagctcacatggctgtacctcgaccacaaccatatctgtagtgtccaaggagacgccttccagaagcttcggcgtgtgaaggaattaaccctctctagtaaccagattacgcagctgccgaacactacctttcgcccaatgccaaatcttcgcagcgtggacctttcctataacaagctgcaggctctcgccccagacctgttccacggactgagaaaactaacaaccctccacatgagagcgaacgccattcagtttgtcccagttcgtatttttcaagattgtcggtctttgaaattccttgatatcggatataaccagctgaaatctctcgctcgcaacagcttcgcgggtttgtttaagctgacggagctgcacctcgagcataacgacctcgtcaaggttaacttcgcccactttcctcgcctgatttctcttcatagcctgtgtctgcgcagaaacaaggtagctatagtcgtttcttcactggattgggtatggaacttggagaagatggacctaagcggaaacgaaattgaatatatggaaccccacgtgttcgaaacggtaccccacttgcaatctctccagctggactctaacaggctgacgtacattgagcctcgcatactcaactcttggaaaagcctgaccagcatcactttggctgggaatctctgggactgtggacgaaacgtctgtgccttggcgtcctggcttaataactttcagggtagatatgatggaaatctgcaatgcgcatctcccgaatacgctcaaggggaagatgtcctggacgctgtatatgcatttcacttatgcgaagacggggctgagcccacgagtggccatctgctgagtgctgtcacgaatcgctctgacttggggcctccggctagcagcgccactacgctggccgatggaggagagggccagcacgacggcactttcgagcctgccacagttgctcttccgggtggcgagcatgcagaaaatgcggtccaaattcacaaggtcgtgactggcactatggccctcatcttcagctttcttatcgtagttctggttctctacgtatcctggaaatgttttcccgctagtctgcgacagctgcgacaatgctttgtcactcaacgtcggaagcagaagcagaagcagaccatgcatcagatggctgccatgtccgcccaagagtactatgttgattacaaacccaatcacattgagggagcgctcgtgataatcaatgaatacggcagctgcacatgccaccagcagcccgcaagagagtgcgaggtgtag

SEQ ID NO: 228329 - DNA, 1569 bp, Artificial Sequence
  Description of Artificial Sequence: Synthetic coding sequence
atggacttcttgttgcttggtctctgcctttattggctgcttcgacgtcctagtggcgtggtgttgtgcctccttggtgcctgctttcagatgctgccagctgctccctctggatgcccccagctgtgtaggtgtgaaggccgtctgttgtactgcgaagctttgaacctgacagaggctccccataacctgagtggactgctgggtctgtcgctgcggtataactccttatcagagttgagagcaggtcagtttaccggcctcatgcagctgacatggctgtatttggatcataaccacatctgcagcgtgcaaggcgacgcatttcaaaagctccgaagggtaaaggaacttacgctgagcagtaatcaaatcactcaactaccaaacactacctttagacccatgcctaatcttcggagcgtggacttgagctataataaactgcaggccctcgctccagacctcttccatggactcagaaaattgacaactctccatatgagagcgaatgccatccagttcgtccccgtgaggatctttcaggactgtaggagcctcaagttcctcgatataggctacaaccagctgaagtcacttgctagaaatagtttcgccggacttttcaaactgacagaactgcaccttgaacacaacgacctggtcaaagtgaattttgcacactttcctcggcttatctccctgcactccctctgcctgagaagaaacaaagtagcgatcgttgtgtcctctctggattgggtttggaacctggagaagatggatctgagtggaaacgaaatcgagtacatggagccccacgtgttcgagaccgtcccccatctgcaatctctgcaacttgattcaaacagactgacctacatcgagccgaggatactcaacagctggaagtcgctgacctcaattacacttgccggtaacttatgggactgcggcaggaacgtgtgcgccctcgccagctggttgaacaactttcaggggcgatacgatggcaatctacagtgtgcttcgccggaatacgcgcagggcgaggatgtccttgatgcagtgtacgcctttcatctttgtgaagacggtgccgagccaacctccgggcacttgctcagcgcagtgacaaatcggtctgatctcggccctcctgcctcgtcggccacaactctggccgatggcggagagggtcagcacgacggcacatttgaacccgctactgttgctctgcccggaggcgaacacgccgagaacgctgttcagattcacaaggtggttactgggaccatggccctgattttctcgttcttaattgtggtgctggtgctttacgtctcatggaaatgcttccctgcttcactgagacagcttaggcagtgctttgtgactcagcgaagaaagcaaaaacagaagcagacaatgcatcagatggcagccatgagcgcccaggagtattacgttgattacaaaccgaatcacatcgaaggcgcactggtgataatcaatgaatacgggtcttgtacctgccaccagcaaccggctcgcgaatgtgaagtgtag

SEQ ID NO: 228330 - DNA, 552 bp, Artificial Sequence
  Description of Artificial Sequence: Synthetic coding sequence
atggactttctcctcctggggctgtgtctttactggttgctacgcagaccctctggagtggtgctctgcctcctgggagcgtgctttcagatgctgcccgctgctccttcgggttgtccgcagttgtgtaggtgtgaaggacggctgctgtactgcgaggcactcaacctgaccgaggcccctcacaacctatcaggccttcttggtctctcattaagatataacagcctgagcgaactccgagccggtcagtttaccggtctgatgcagctgacgtggctgtatttagaccataaccacatatgcagcgtccaaggcgacgctttccagaaactcagacgcgtgaaagaactgaccctctcctcaaaccaaatcactcagcttcccaacactactttcagacctatgcccaatctgcgctctgtggatctgtcctataacaagcttcaggcactagcccctgacctgtttcatggacttcgcaagcttacaacattgcacatgagagcaaatgcaatccagttcgtccccgtgaggattttccaggattag

SEQ ID NO: 228331 - DNA, 1551 bp, Artificial Sequence
  Description of Artificial Sequence: Synthetic coding sequence
atgggcttgcactttaaatggccgctcggtgcccctatgctagccgcaatctatgctatgtccatggtgctgaaaatgttgcccgcactgggaatggcttgtccccctaagtgtcggtgtgaaaagctgcttttttactgcgacagtcagggcttccacagcgtgcccaatgcgaccgataagggcagtcttgggctcagcctgagacacaaccatatcactgagcttgagagagaccagtttgcttctttctctcaactgacttggttacacctggatcacaaccagatcagtaccgtcaaggaagacgcgttccaaggcctatataaactgaaagaacttatattgtccagcaacaagattttttatttgcccaataccactttcacccaactgattaatttgcagaaccttgatctctccttcaatcagttgtcaagcctgcacccagaactcttttacggtcttcggaagctccagactttacacctgcgcagcaatagccttaggaccattccggtgagactgttctgggactgccgctccttggaattcttagatctgtctacgaacaggctgagatccctggcacggaatggattcgcgggactcattaaactccgcgaacttcacctcgagcacaaccagctgaccaagatcaattttgcccactttttacgcctgtcaagtttgcacactctcttcctgcagtggaacaagatttccaatctgacatgtggcatggaatggacttggggaacattggaaaaactcgatctgacgggaaacgagatcaaggcgatagatctcactgtgtttgaaaccatgccaaatctcaaaattttactcatggataataacaaattgaattcactcgactccaaaatcctcaattccctcaggagcctgacgactgtcggcctgtcaggtaatctatgggagtgctccgcaagaatctgtgcgctcgctagctggctggggtctttccagggacgctgggagcacagcatcctctgtcattcgcctgatcacacccagggcgaggacattctggatgcagtgcacggctttcagctttgttggaacttgtccaccaccgtgacagtaatggccaccacctatagagaccctactactgaatataccaaaagaataagttcttcttcttatcacgtcggggataaggaaattcccacaacagctggaatcgccgtcacaacagaggaacactttcccgagccggacaacgccatttttacccaacgggtgatcacggggaccatggcccttttattcagtttttttttcatcatcttcatcgtgttcatctctcggaaatgctgtcctccaacacttagaaggatacgtcaatgtagcatggtccagaaccacaggcagcttcgcagccagaccaggctgcatatgtccaatatgagtgatcagggtccttataatgagtatgaaccaactcacgagggtcctttcattataattaacgggtatggtcagtgtaaatgccagcagctcccttataaggaatgcgaagtgtag

SEQ ID NO: 228332 - DNA, 1746 bp, Artificial Sequence
  Description of Artificial Sequence: Synthetic coding sequence
atgggttttaacgtgataagattactgagcggatccgccgtggcgctcgtcatcgcgccaacagtcttgctaacaatgctcagttcagcggaacgtggctgccccaagggatgtcgatgtgaggggaagatggtgtactgcgaatcacagaagctgcaggaaattcctagtagtatcagcgccggttgtctgggattgtcgcttcgctacaattctctacagaagctgaaatataaccagttcaagggccttaatcagctcacatggctatatttggatcataaccacatctcaaatatcgatgaaaacgctttcaatggaatccgcagacttaaggaactcattctgtcatcaaatcgcatctcctattttctaaacaatacatttaggcccgtcacaaacctgcggaatcttgatctgtcatacaaccagctgcattcccttggctccgaacagttcagggggctgaggaagctcctcagtctacacctgaggtccaatagtctccggaccatcccggtcaggatttttcaggactgccggaatctggagcttcttgacctgggatataaccggataagatctctggctagaaatgtatttgctggcatgataagactaaaggaactacacttggagcacaatcagttcagtaagttgaatctggccttattcccgagactggtgtcccttcaaaacctgtacctacagtggaacaagatctctgtcataggccagaccatgagttggacgtggagctccctccagaggttggatctgtctgggaatgagatcgaagcattctctggtccctctgttttccagtgtgtgccaaatctccaacgcttaaatttggactccaataaactgacattcatcgggcaggagatccttgactcttggatctcattaaacgatataagcctggcaggtaatatctgggagtgctcacgaaacatctgctccctggtcaactggctgaagtctttcaagggcttgcgcgagaatactattatttgcgcatccccaaaagagttgcaaggcgttaacgtaattgacgccgtcaagaactactctatttgcggtaaaagcaccacagagcgcttcgacttagcgagagcattacctaaaccaaccttcaagcccaaactgccacggccaaaacacgagtctaagccaccgttgccccctaccgtgggcgcaaccgaacccggacccgagacggacgccgatgcagaacatatctcctttcacaaaataattgctggttcagttgccctgtttctatctgtgctcgttatactacttgttatttacgtgtcctggaaaagatatccagcatccatgaaacagctacaacagcgctcactgatgagaagacaccgcaagaagaaacgtcagagcctgaaacagatgactccaagtacacaggaattttatgtggattacaaacctactaatacggagacctccgagatgctgctgaacggaacggggccttgcacatataacaagtcaggctccagggagtgtgagatccctctgtctatgaacgtttcgaccttcctggcctacgaccagcccactatcagttattgcggtgtccatcacgagttgctttcacacaaaagcttcgagactaacgcccaggaggataccatggagacgcaccttgagaccgagctcgacctgagtacgatcaccaccgccggacggatttctgaccacaaacagcagttagcatag

SEQ ID NO: 228333 - DNA, 1746 bp, Artificial Sequence
  Description of Artificial Sequence: Synthetic coding sequence
atgggctttaacgtcatccgactcctaagtggcagcgctgtggccctagtgattgctcctactgtattgcttactatgctctcctcagctgagcgcggatgtcctaagggatgtcgatgcgagggcaagatggtatattgtgaaagtcaaaaactgcaggagattccatcaagtatctctgccggatgccttggactgtctttgaggtataactctttgcaaaaattgaagtacaaccagttcaaggggctaaatcagctaacatggctttaccttgatcacaatcatatcagcaatatcgacgagaatgcgtttaatggcattcgtaggctgaaagaactgattctgtcgtccaaccgcatcagttacttcctgaataacacctttcgcccagtgacaaacctgcggaacctggatctcagctacaaccagttgcattcactgggttccgaacaatttcgtggcctaaggaagctgttatccttgcacctgagaagcaacagtctgcgcaccatccccgtaaggatattccaggactgcaggaacttggagctcttagatctcggatataatagaatcaggtccttggcacgcaacgtatttgcaggaatgatccggctgaaagagctgcacctggagcataatcagttctccaaactaaacttagctttgtttcccagacttgtgtcactgcagaacctgtatttgcagtggaataagatctctgttattgggcagaccatgagctggacctggagttcactgcaaagactggatctcagtggcaatgaaatagaagccttctccggcccatccgtgtttcaatgcgtgccaaatttgcaaaggcttaatctggattccaacaaattgaccttcatcggccaagaaatcctggattcctggataagcttgaatgatatcagcctcgcaggtaatatttgggagtgttcccggaacatctgttcactggtaaattggctgaagagtttcaaaggcttgcgggagaatactataatatgtgcctcacccaaggagcttcagggagtgaatgtaattgatgccgtgaagaattactccatctgcggtaaatccactacagagcggtttgatcttgcgagggcccttcctaagccaactttcaagcccaagctccccagacccaagcacgaaagcaaacccccattgccccctaccgtcggagcaacagaacccggacctgaaacagatgctgatgcagaacacatctcatttcataaaatcatagcgggatctgtggcccttttcctttcagtgcttgttatcctcctggttatctatgtttcttggaagagatatccggcttctatgaaacagcttcaacagcgctcactgatgagacggcacagaaaaaaaaagagacaaagccttaaacagatgacaccaagcacccaggaattttacgtggactacaaaccgacaaacactgaaacatcagagatgctccttaatggcactggaccctgcacctacaataaaagcgggtctcgagagtgtgagatcccgttatcgatgaacgtcagcacctttctggcatacgaccaaccgactatctcttattgtggagtgcaccatgaactgctcagtcataagtcctttgaaaccaatgcacaagaggatactatggaaacgcacctggagacagagctcgatctaagcaccatcactactgccggtcggatatctgatcacaaacagcagctagcgtag

SEQ ID NO: 228334 - DNA, 1557 bp, Artificial Sequence
  Description of Artificial Sequence: Synthetic coding sequence
atgggctttcacttaatcacccagctgaaagggatgagtgtggtgctggtactgcttcctactcttcttctggtcatgttgacaggcgctcagcgcgcatgccccaaaaattgccggtgcgatggcaagatcgtctattgtgagtcccatgccttcgctgatataccagagaacatttccgggggaagtcaggggttgtcactgaggtttaactcaatccagaagttaaagagtaaccagtttgccggtctgaatcagctgatctggctatacctggaccacaattatattagctccgtcgacgaagatgcctttcagggcatccggcgactcaaggaactgattttatcaagtaataagatcacctatctgcacaacaaaacgtttcatccagttcccaacctgagaaacctagacctgtcttataacaagttgcaaactcttcagagcgagcaattcaagggacttaggaagctgatcattctccacctccgtagcaattcccttaaaacagtgcccatccgcgtgtttcaagattgcagaaatctggattttctggacctgggttataatcggctcagatcattgtctaggaacgctttcgcagggctgctcaagctgaaggaactgcatctcgaacataaccagttttctaaaataaattttgctcattttccacgattgtttaatctgcgaagcatctatctccagtggaaccgcatacgatccatcagccaaggattaacatggacttggtcctccttgcacaatttagatctgtcaggtaacgacattcagggaatcgaaccaggcacctttaaatgcttgccaaacctgcagaagttaaaccttgacagtaacaagctgactaacatctcccaggagacagtcaatgcttggatctctctgatatcgattactctctccggaaatatgtgggaatgcagccgttccatctgtcccctgttttattggctcaaaaacttcaaagggaataaagagagcacaatgatttgcgcagggccaaagcatattcagggagaaaaagtgagtgacgcggtcgaaacctataatatatgcagtgaagtgcaagttgtgaatacggaacggagtcatctggtaccacaaactccccagaaacctcttatcatccccagaccgactattttcaaaccagacgtcacacaaagtacctttgaaacccctagcccatccccaggatttcagataccgggagcagagcaggagtacgaacatgtgagttttcataaaatcatcgcaggctctgtggccctcttcctctctgtagccatgatattgcttgtgatctacgtgagttggaagcggtacccggcttccatgaaacagctacagcagcactctctcatgaaacgtagaaggaagaaggcgagagagtcagaacgccagatgaattccccacttcaggagtactacgtggactacaagcctactaactctgaaaccatggatattagtgtgaacggatcaggcccatgtacatacacaatcagcggaagcagagagtgtgaggtttag

SEQ ID NO: 228335 - DNA, 1773 bp, Artificial Sequence
  Description of Artificial Sequence: Synthetic coding sequence
atgggcttccatctgatcacccagcttaaagggatgtccgtggtgttggtgctactgccaacgctcctcctggtcatgctgactggcgctcaacgggcttgtcccaagaactgccgatgtgacggaaagattgtttactgcgagtcccatgcctttgcagacattcctgagaacatctcaggcggaagccaggggctctccctaaggttcaatagtatccagaagctaaagtctaatcaatttgccggactcaaccagttaatttggctgtacttggatcacaattacatcagcagcgtggacgaggatgccttccagggcatccggaggctcaaagagcttattctttccagcaacaagattacctacctccataacaaaacgtttcaccccgtgcctaatctcaggaacttggaccttagttataacaagctgcagactctccagtcagagcagtttaaggggctgcgaaagttaatcatccttcaccttcgcagcaactcgctgaagaccgtgcccattcgcgtgttccaggactgcaggaacctggactttttggacttgggttacaacaggctgcgatcgttaagcagaaatgctttcgcaggtctgctcaagctaaaagaattacacctggaacataaccagttctccaagatcaacttcgcccattttccgaggcttttcaatctgaggtcgatctatctgcagtggaaccgaattcgatcaatcagccagggactgacatggacctggtcgagtctgcacaatctggacctgtccggcaacgacatccagggcatagaacccggaaccttcaagtgtttaccgaatctccaaaagctgaatctggactctaacaagctgactaacatctcccaggagaccgtgaacgcctggatttcactgatcagcattacactttctgggaacatgtgggagtgctctcgtagtatctgccccctgttttattggctgaagaatttcaagggcaacaaagaatctaccatgatatgcgctggccctaagcacatacaaggagagaaagtatcagacgctgtggagacttacaacatctgctctgaggttcaagttgttaacacagaaaggtctcatctagtgccgcaaactccacagaaacctctcataattcccagacctactatcttcaagccggatgtgactcaatccacctttgagactccctcaccaagtccaggtttccaaattccgggagctgaacaggaatacgaacacgtcagtttccataagataattgcaggatcagtagcattattccttagtgttgccatgatcctactggtgatatatgtgagctggaaacgttatccagcttccatgaagcagttacagcagcattcacttatgaagaggagacgaaaaaaggcaagggagtccgagagacaaatgaacagtcccctgcaagagtattatgtggactacaagcctacaaatagcgaaacaatggatatttctgtaaacggttctggtccctgtacatatactatctcaggcagccgcgagtgcgagatgccccatcatatgaagccactgccctattatagttacgaccaaccagtcatcggctactgccaagcacatcagccactgcatgtgaccaagggctatgagaccgtgtcaccagagcaggacgaaagccctgggttggagctaggacgagaccatagtttcattgcaactatcgctcggtcagcggcaccagccatctacctggaacgtatcgccaattag

SEQ ID NO: 228336 - DNA, 1773 bp, Artificial Sequence
  Description of Artificial Sequence: Synthetic coding sequence
atgggctttcaccttatcacccagctcaaaggaatgtcagtggttctggtcctcctccccactctgcttctggtcatgttgacaggtgcccaaagggcatgccccaaaaattgcagatgtgacggtaagatcgtgtactgtgaatctcacgccttcgctgacattcccgagaacatcagcggcggaagtcagggattaagtttgcggtttaactctattcaaaaactcaagtcaaaccagttcgccggtctgaatcagctgatatggctttacctggatcacaactacatttcgtctgtcgatgaggacgcatttcaaggaatccggcgtctgaaagaactcattctttcatcgaataagattacctacttgcataacaaaactttccatcctgtgccaaacttaagaaacttggatctcagctataacaagcttcagaccctccagtccgaacagttcaaaggcctccgtaaactgatcattcttcatctgcggtctaattccctgaaaacggtgccaatcagggtgtttcaagattgtcgcaatctggactttctcgatctgggttacaataggctccgcagtctttcacgaaatgctttcgctggactactaaagttgaaggagctccatctcgaacacaaccagttctctaaaatcaacttcgcccattttcctaggttgtttaacctccgcagtatctacctgcagtggaacagaattaggtccatcagtcagggcctgacatggacttggagctctctccacaatctggatttgtctggaaacgacatacagggcatcgagccagggacatttaagtgcctccctaatctccagaagctcaacctggactccaataagttaacaaacatttctcaggagaccgtgaacgcatggattagtctcatcagcatcaccctgtcagggaatatgtgggagtgtagtcggagcatttgtcccttgttctactggttgaagaactttaagggtaacaaagaatccacaatgatttgtgccggaccaaagcatatccagggggagaaggtgtccgacgcggttgaaacttataacatttgctcagaagttcaggtggtgaataccgagaggtctcatctggtgccacagactccccagaagcctctgataattcccaggcccaccatcttcaaacccgacgtaacacagtcaacatttgagactccctccccttctccaggattccagattccaggggcagaacaagaatatgagcatgtgagttttcacaagatcatcgctggaagcgtggccctgttcctgtctgtggcgatgatcctactagtcatttacgtctcatggaagagataccccgcatccatgaagcagctacagcaacattccctgatgaaacgcagaagaaagaaggcacgcgaaagcgagcgtcagatgaactcgccactgcaggaatactatgttgactacaaacccacaaatagtgaaacgatggacatctctgttaacgggtctgggccttgtacctacactatttctggatcgcgagagtgtgaaatgccacaccacatgaagcccctgccttattactcgtatgatcagccagtgattgggtactgccaggcccaccagcccctgcacgtcacaaaggggtacgagacagtgagcccagaacaggacgagagccccggattggaactcgggcgtgaccatagcttcatcgcaaccattgccaggagtgcagctcccgctatctatttggaacgaatcgctaactag

SEQ ID NO: 228337 - DNA, 1776 bp, Artificial Sequence
  Description of Artificial Sequence: Synthetic coding sequence
atgcctgggtttcacctgataactcagttgaagggtatgtccgtcgtcctcgtcttactgccaacattactgctggtgatgctgactggagcccagcgggcatgccccaagaactgtcgatgcgatggcaagatcgtttactgcgaatcacacgcctttgcagatattccggaaaatataagcggaggatcacagggtttgtcgctgcgatttaattccatacagaaactgaaaagcaaccaatttgctggactgaatcagctcatctggctatatttagaccacaattatattagcagcgtggacgaggacgccttccagggcattcggcgtctcaaagagctgatactcagtagcaacaagatcacctacctgcataacaagacttttcatccggtgcctaatctaagaaacctggacctgagctacaataagttacagacactgcagtccgagcagtttaaaggccttaggaaactcattatcctgcatctccggtctaactccttaaaaaccgttccaataagagtgtttcaggactgcaggaatctggatttcctggatttgggctataataggctccgctcactgtcacgcaacgctttcgcagggctgctgaaactcaaggagttacacttggagcacaaccagttttcaaagatcaacttcgcacactttcctcgcctatttaatttacggagcatttatttgcagtggaatagaatcagatccataagtcagggcttgacatggacctggagtagcctgcacaacctggatttaagcgggaatgacatccagggaatcgaaccgggaacattcaaatgtctgcctaaccttcagaagctcaacctcgactccaataagctcacgaatatcagccaggagacggtgaacgcatggatctccttgatcagcataacactgtccgggaatatgtgggagtgtagtagatccatctgcccgctgttttattggctgaagaattttaagggcaataaagaaagtactatgatctgcgcaggtcctaaacatatccagggggaaaaggtgtccgatgccgtggaaacttacaatatttgcagtgaggtgcaggtggtgaatacggaaaggtcccacctcgtgccacaaacaccacagaagcctttgatcatcccccgaccaacaatctttaaaccggacgtgacacagagcaccttcgaaacccccagccctagcccaggctttcagattcctggagctgaacaggaatatgaacacgtgtcattccataaaatcatcgcaggttctgtggccctgttcctctctgtggcgatgattcttctggtcatctacgtctcttggaagagatatcccgcatcgatgaagcagctgcagcagcactccttgatgaagagacgccgaaaaaaagcccgtgagagcgagcgacagatgaacagcccactgcaggagtattatgtagactataagcctacaaacagtgagacaatggatatctcagtgaacgggtctggcccatgcacttatactatctccggcagccgggagtgcgagatgccgcatcacatgaaacccctcccctattatagctatgatcaacctgtcattggctactgccaggctcaccagccgctgcatgttaccaagggctatgagacggttagccccgaacaagatgaatctccaggactggaactggggagagatcacagcttcattgccaccatcgctcgcagcgcagctcccgcaatatacttggagcggatagcaaactag

SEQ ID NO: 228338 - DNA, 579 bp, Artificial Sequence
  Description of Artificial Sequence: Synthetic coding sequence
atgaacaaaagagattacatgaacacctcagtgcaagaaccaccattagactacagcttccgcagtattcacgttattcaggatctggtaaacgaggagccacggacaggcctgaggcccctgaagcgcagcaaaagtggaaagtctctaactcagagtctttggctaaacaataatgtcctgaacgatctgagagattttaatcaggttgccagtcagctgctggagcacccagagaatttggcttggattgacctgtcttttaacgacctgacctcgatcgatcccgtgctcacaaccttcttcaacttgtctgtgttgtacctgcatgggaacagcattcagagactaggagaggtcaataaactggccgtgcttcctaggcttaggagcttgacccttcacgggaacccaatggaggaggaaaaaggatatcggcagtatgtgctttgcacgttgtcgaggatcactacattcgattttagcggagtgacaaaagctgaccgaacaacagccgaggtgtggaagaggatgaatatcaagccaaagaaggcatggacgaaacagaataccttatag

SEQ ID NO: 228339 - DNA, 876 bp, Artificial Sequence
  Description of Artificial Sequence: Synthetic coding sequence
atggggactccatggcggaaaaggaagggcatcgctggtcccggattgccggacttaagctgtgcactggtgctgcagcctagggcccaagtaggcaccatgtcccctgcgatcgccttggctttcttgccacttgtcgtaacgcttctggtacgctatagacattacttccgcctgctagttcgcacagtgttactgagaagccttagagactgcctttctggactacggatcgaagagagggctttctcttatgttttaacgcacgcacttcctggagatccaggacatattctaactacactggatcactggtccagtcggtgtgagtatctgagccacatgggccctgtgaaggggcagatcctaatgcgattagtagaggagaaggcgcctgcctgcgtcctcgaattagggacctattgcggatactcaaccctactgattgcacgcgctctgccccctgggggtcgtctactgactgtggagcgtgacccacgtacggctgcagtggccgaaaagctcatccggctcgcaggcttcgacgaacacatggtcgaacttattgtgggcagctcagaagacgtgattccttgcctgagaacacagtatcagttaagtagggccgatctggtgttactcgctcaccgtcctcggtgttacttgagagacctccaattgttggaagcccatgcgttactgccagccggagctaccgtgcttgctgatcatgtattatttccaggggctcccagatttctgcaatatgccaagtcctgcggcaggtaccgctgccgactccatcatacgggcctgccagacttcccagcaatcaaagacggtatcgcccagctgacttatgcaggccctggttag

SEQ ID NO: 228340 - DNA, 441 bp, Artificial Sequence
  Description of Artificial Sequence: Synthetic coding sequence
atgaacaagagggactatatgaatacatcggtgcaggaacccccattagactattcatttcgcagcatccacgtcatccaagatctcgtgaacgaggaaccacggactggcctgcgcccactgaagcgctccaagtctggaaaatccttgacccagagcctgtggctcaacaataacgttctgaacgatctgagagactttaatcaagttgcatcccaactgcttgagcatccagagaacctggcatggatcgatctaagcttcaacgatctgacgtctattgacccagtgctgaccaccttctttaatctgagcgtgctgtatctgcacggcaattcaatacaaaggctcggtgaagtaaataagttggcagtgctgcctagattgaggagtctgacccttcatggcaacccaatggaggaggagaagggatatcggtag

SEQ ID NO: 228341 - DNA, 756 bp, Artificial Sequence
  Description of Artificial Sequence: Synthetic coding sequence
atgggcaccccctggagaaagcggaaggggattgccggaccaggcctaccagacctgagctgtgcacttgtactccaaccatccctgcgggactgccttagcggtcttcggattgaagagcgtgccttctcttatgtgctgacacacgccctgccaggcgaccctggtcatattcttaccacccttgaccattggagctcgcgatgtgagtatctgtcccacatgggcccagtcaagggccaaatacttatgcggttggtggaggagaaagctccagcatgtgtgcttgaactcggaacgtactgcggctactcgaccctgcttatcgccagggccctgcccccaggaggccgtcttctgacagtggaaagagatcccagaacagcggcagtcgctgagaaactgattagactcgctgggtttgacgagcatatggtggagttgattgtggggtccagcgaagacgtaattccgtgtcttcgcacgcagtaccaactgtctcgcgctgatctagtcttgctggcccatagacccagatgctatctgcgtgacctccagctgctggaggcacacgccttgctgccagccggagctactgtgctagcagatcatgttttattcccaggtgctcctcggtttcttcagtatgcaaagtcctgcggtcgctaccggtgcaggctgcaccatacaggactgcccgacttcccggctataaaggatgggattgcccagctgacctatgctggtcccggatag

SEQ ID NO: 228342 - DNA, 876 bp, Artificial Sequence
  Description of Artificial Sequence: Synthetic coding sequence
atgggcacaccgtggcggaagagaaagggcatcgccggtcccggattgcctgatctgagctgtgccctggtgctccagcctagagctcaagtgggtaccatgtcgcctgctatcgctttggccttcctgcctctagtggtcacccttcttgtccgctataggcattatttccgccttttggtgcgcaccgtcctcttaaggtccctgagggattgcttgtctggattgcgtatcgaggaacgcgcattctcctatgtcctcacgcacgcgctgcccggtgaccctggacatattctcacgaccctcgatcactggagctctaggtgtgagtatctctcgcacatgggccctgtaaaggggcaaatcttaatgcggctcgttgaggaaaaggctccagcttgtgtgctggaactgggaacttactgtggctacagtacactcctgatcgccagggctcttcctcctggaggacggcttttgacagtggaacgcgacccacgaactgcagcagttgcagagaaattgatacgccttgcgggttttgatgagcatatggtcgaactgatcgtggggtcatctgaggatgtaataccatgcctccgtacacagtatcagctgtcccgcgctgacctcgtgctgctggcccaccgtccaagatgttacctgagagacctgcagctcctggaagcccatgctctcttacctgcaggagctacagtgttggcggatcatgtcctttttccaggcgcaccgaggttcctgcagtacgcgaagagctgtggacgctacagatgccgcctgcatcacacgggcctgcccgattttcctgctatcaaagatggcatagctcagcttacatatgccggacccggatag

SEQ ID NO: 228343 - DNA, 477 bp, Artificial Sequence
  Description of Artificial Sequence: Synthetic coding sequence
atgaataaacgcgactacatgaacacgtccgtgcaggagcccccactggattattcttttcggagtattcatgtaattcaagatctggtaaacgaagaaccccgaactggactccgacccctgaaacggagcaaatccggcaaatcactcacccagtccctgtggctaaataacaacgtgctgaatgatctgcgggactttaaccaggtggcatcacaactgttggaacatcccgaaaatttggcgtggatagacctgagttttaatgacctgacttcgattgaccctgtgttgacaacattctttaacctgagtgtgctgtatctgcatggcaactccattcagcgcctgggcgaggtgaataagctcgcagtgcttccacgcttgagatctctgacactccatggcaatcccatggaggaagagaagggctaccgcgtcccaggctccgtggagatgccccaccgacccccatag

SEQ ID NO: 228344 - DNA, 279 bp, Artificial Sequence
  Description of Artificial Sequence: Synthetic coding sequence
atgaataagcgcgattacatgaatactagcgtgcaggaaccgcctctggactatagttttcgatccatccacgttatccaggatctagtgaatgaggaacctagaactgggttacggccactcaagagaagcaaaagcggaaagagtctcacgcaatcgttatggctcaacaataatgtgctgaatgatttaagggactttaatcaggtagcgagccaactactggagcatccggaaaacctcgcgtggatcgacctgtcctttaacgatttaacttag

SEQ ID NO: 228345 - DNA, 579 bp, Artificial Sequence
  Description of Artificial Sequence: Synthetic coding sequence
atgaacaagcgtgattacatgaacacatcagttcaggaaccccctctagattattccttccggtccattcacgtcatccaagatctggttaatgaagaacccagaaccggcctgaggccactcaagcggagtaagtcaggcaaatctctgactcagagcttgtggctcaataacaatgtgctgaacgacctgcgggacttcaatcaggtagcctcacagcttctggaacatcccgaaaatctcgcttggatagatctgtccttcaatgatttgaccagtatcgaccctgtcttgactactttcttcaacctgtcggtgctgtacttacacgggaattctatccaaaggcttggggaggtgaacaaactggctgtgctgccacgcctgcgctcactgaccctgcatgggaatccgatggaggaggagaaaggttaccggcagtatgttttatgcaccttgagcagaatcacgactttcgacttctcaggggttacaaaggctgataggaccactgccgaagtatggaagagaatgaatattaagcccaaaaaagcctggacaaagcagaatacactctag

SEQ ID NO: 228346 - DNA, 477 bp, Artificial Sequence
  Description of Artificial Sequence: Synthetic coding sequence
atgaacaaacgcgattatatgaacacttcagtgcaagagccccctctggattattccttccgttcaatccacgttatccaggaccttgttaacgaagagcctcgcacaggactgcgcccattaaaaaggtctaagtccggaaaatcgttgactcagagtttgtggctgaacaacaacgtcctcaatgacctcagggattttaatcaggttgcctcccagctgctagagcacccggaaaatctggcttggatagatctcagcttcaacgatttaacctctattgaccctgtgctcactacgtttttcaatctgtcagtgctgtatctccacgggaatagtatccagagactgggcgaagttaataagctcgccgtcctgcccaggcttcggtccctcactctacatggcaatccaatggaggaggagaaaggctacagggtacccggttccgtggagatgccccatagacctccatag

SEQ ID NO: 228347 - DNA, 315 bp, Artificial Sequence
  Description of Artificial Sequence: Synthetic coding sequence
atgaataaaagggactacatgaatacgagcgtccaggaaccacccctcgattattcctttagatccattcatgtgatacaggatctagttaatgaggagcctagaaccggcctgcgccctttaaagagatccaaaagcggcaaaagtcttacccagtccctctggctgaacaataatgttctcaatgatctacgtgactttaaccaggtagcgtcacagttactcgagcacccagaaaatttagcctggattgacctatctttcaacgatttgacctctattgacccagtgctgactactttctttaatctttag

SEQ ID NO: 228348 - DNA, 525 bp, Artificial Sequence
  Description of Artificial Sequence: Synthetic coding sequence
atggttgagttccagcctagtgtcacagaccttgtgaacgaggagcctagaaccggcttgcgaccattaaagcggtccaagagtgggaagtctctgactcaaagcctatggctcaacaacaacgtactcaacgacctgagagacttcaatcaggttgcctcgcagttgttggagcaccctgagaatctggcttggattgatttgtccttcaacgacctgacttctatcgatcccgttctcactactttctttaatctgtccgtgctgtatctgcatggcaatagtatacagcgactgggggaggtgaacaagctcgccgtcctcccaagattacgctccctgaccctacatgggaacccgatggaagaggagaagggctatcgccagtatgttctttgtacgctgtctaggataacaacatttgatttcagcggggtgacgaaggcagaccgcactacagccgaggtatggaagcgcatgaacatcaagcccaagaaggcatggaccaaacaaaatactctgtag

SEQ ID NO: 228349 - DNA, 3231 bp, Artificial Sequence
  Description of Artificial Sequence: Synthetic coding sequence
atggcagagtttacttcctacaaggaaacagcaagctccaggcacttgagattcaagttgcaaagtctatctcgtcgactggatgagcttgaagaggctacaaagaacctgcagaaagccgaggatgagctacttgaccttcaggataaagtaattcaggccgaaggatccaattcctccatgctggccgagatcgaggtgctccggcaacgggtcctgcgaattgagggcaaggacgaggaaatcaaaagagctgaggatctgtgccgtctcatgaaggagaagctcgaggaggaagagaatctgactcgggagctcaagagcgagattgagaggctacagaagagaatggccgaactggaaaaactggaagaggcgttcagccgatctaagaatgactgcactcaactttgcttgtcgctgaatgaagagcgcaatcttactaaaaagatttcttctgagctggaaatgctgagggtgaaagtgaaagaattagaatcaagcgaggataggttggacaagacggaacagagcctggctagtgagctggaaaagttgaagtctttgacgttgagctttgtgagtgagcgtaagtacctgaacgagaaggagaaggagaacgagaagctcatcaaagagctaacccagaagctggagcaaaacaaaaagatgaatcgcgactacactcgcaatgcctcgaatttagaaaggaacgacttacgcattgaagatgggatcagctccaccctgccttcgaaggagtcccggaggaaagggggattagactacctcaaacaggtggaaaatgagaccaggaataagtcagagaatgagaaaaaccggaatcaggaggataacaaggtgaaggacctgaaccaggagatcgagaaactgaaaacccaaattaaacatttcgagagtctggaggaagagttgaaaaagatgaagtccaaaaataacgacttgcaagataactatctgagtgagcagaataagaataaacttctcgcgtcacagcttgaggaaattaagctccaaattaagaagcagaaagagctggagaacggggaagttgagggggaggacgcattcctgtcctcaaaggggagacatgagaggactaaattccggggacacggcagcgaggcatccgtttccaagcacacagcccgtgagcttagtcctcagcacaaacgggaaagattgaggaacagagaattcgcccttaacaatgagaattattcactgagtaaccggcaggtgagtagtccctcttttaccaatagacgcgcagccaaggcatcccatatgggcgtgtctacagattccggaacacaggaaaccaagaagactgaagatcgcttcgtacccggttccagccagtccgaggggaaaaagagccgagaacagccttccgtgctgtccagatacccacccgcagctcaggagcactccaaggcatggaagggaacgtctaaacccggtaccgagtcaggtctgaaaggcaaggtcgagaagacaactcggacatttagcgatacaactcacgggtcagttcccagtgaccccctcgggagggcagataaagctagcgatacatcaagtgaaacagtattcgggaagcgtgggcacgtgctgggcaatggctcccaggtcacacaagcagcgaattctggatgctcaaaggccatcggcgctctggccagcagcaggcgtagcagttccgaaggactgagcaaagggaaaaaagccgcaaatgggctcgaggctgataattcgtgtcctaactccaaagccccagtgctttcaaaatacccgtactcctgccggtcgcaggaaaacattctgcaggggttctcaacatcacataaggagggtgtaaatcagcctgcagctgtcgtgatggaggattccagtccccacgaagctctcaggtgtagggtgataaagtcgagtgggagagaaaagcccgattctgacgacgatctggacatagccagtttggtgactgctaaactggtgaatacaacaatcacaccggaaccagaacctaagccccagcctaactcacgggaaaaggctaaaacccgtggcgctccgaggacttcactcttcgagaacgataaagacgccggaatggagaacgaaagcgtaaaaagtgtgagagcttccactaacacaatggaacttccagacacaaatggggctggagtgaaatcccagagacccttctcccccagggaagccctgcggagccgggcaattattaaacctgtgattgttgataaagatgtgaagaaaatcatgggcggttccggcaccgagactacacttgagaaacagaagcctgtgtcaaaacctggacctaacaaggtaaccagctccatcaccatttacccctcggacagctcttcgcccagagccgcacctggcgaggccctgcgggagcgtcatacaagcacatctaatatccaagtggggctggccgaactcacttctgtgtcgaaccatgtctcttccccttttgagctttctatccataagcatgacatcacgttgcagctggcggaagctgaacgcatggcagatggtccactgaaggaccgaccggaaacagtcgtctcccggtccagcataatcatcaagccctccgacccagtggagcgaaatagccatgcaccccctgcagagactattagatggaagtctcatagcgctcccagcgaggtcggattcagcgacgcccgacacgtgactgtgcgtaatgcttggaaatcacggagggaccttaaaagtttggaggatcctccgacgagaatcggtaagaatgtagagagtacaaactctaacgcctacacccagcggagttccactgactttagtgagctcgagcagccgaggtcttgtctttttgagcaggggactagacgagtgggcccaagtagtggggacgctcccgagcccagtagtaggcggacccaatcttcactcactgtctctgaggtgctgaccagaaggaatcgagtgggagatactattacagttgctgcctggaatcattccgcatccatggaagaggagggagaggactgtactcttagtgtctacagacagctccataactctctcgacccgtcagaactgccgggtaaacaggggctgccagaaagtgggagagtgcgcgcagaggagaggctgagacccaccaggccttgcgccgaagagaattag

SEQ ID NO: 228350 - DNA, 3081 bp, Artificial Sequence
  Description of Artificial Sequence: Synthetic coding sequence
atggcagagttcacgtcatacaaagaaacagcctccagtcggcacctgcggtttaaactccagagcctaagccgaagactggatgaactggaggaagccaccaagaacttgcaaaaggcggaagacgagcttctagatcttcaggacaaggtcatccaagccgagggctcgaattcctcaatgttggccgagatcgaggtgctgcgccagagagtgctccgaatcgagggcaaagatgaggagattaagcgtgcagaggacctatgccggttgatgaaagaaaagctggaagaggaagagaatttgacccgcgaactgaaaagcgaaatcgagcggttgcagaaacgtatggccgaacttgagaagctggaagaagctttctcccggagcaaaaacgattgtacccaattatgcctgagcctgaatgaggagagaaacctgactaagaaaatcagttctgagctggaaatgctgagagtgaaggtgaaggaactcgaatctagtgaggatcgcctcgataagactgagcaaagcctggcaagcgagttggaaaagttgaagtcgctgaccctgagtttcgtgtccgaaaggaaatatctcaacgagaaggagaaggaaaacgagaagcttatcaaggaactgacccagaaactggagcagaacaagaaaatgaatcgcgactatacaagaaacgcgagcaacctcgaacgtaatgacctcagaattgaggatggtatcagcagtacacttccatcaaaagagtcccgaaggaaaggcggtctggactacctgaaacaagttgaaaatgagaccagaaataaatcagagaatgagaaaaacagaaatcaggaagataacaaagtgaaagacctcaaccaggagatagagaaactaaaaacacaaataaagcactttgaatctcttgaagaggagcttaaaaagatgaaatccaaaaataacgacctgcaggacaactacctaagcgagcaaaacaagaataagctcctggcctcccagctggaggagataaagcttcagatcaagaagcaaaaagagctggagaatggcgaagtcgaaggggaagatgcattcctgagctccaagggcaggcatgaacgaactaagttcagaggccatggatcagaggcctccgtcagtaaacatacagccagagaactctctccacagcataagagggaacgcttaaggaatagagagttcgcattgaacaacgagaactactctctgagtaataggcaggtatcttccccctcgttcaccaacagacgcgctgcaaaagcaagccatatgggcgtgtctacagacagcggcacacaggaaacaaaaaagacagaggatcgcttcgtaccgggaagttctcaaagcgaaggaaagaagtctcgcgagcagcccagcgtactgtctcgatatcctccggcagcacaggagcattccaaggcctggaagggaacaagtaaaccaggtaccgagagcggccttaagggcaaagtggaaaagaccacccggacattctctgatactactcatgggtcagttcctagcgaccccctcgggcgagccgacaaggccagtgatacatcttccgaaacagtgtttggcaaaagggggcatgtgctaggaaacggcagccaagtgacacaagccgctaacagcggatgctcaaaggcaatcggggctctggcctcgtctaggcgcagtagcagcgaggggctctctaaaggcaagaaagccgctaacggtcttgaggcagataattcatgtccgaattctaaggctcccgtcctcagtaagtacccatactcatgccggagccaagagaacattctgcagggcttcagcacttcgcataaagagggagtgaaccaaccagccgcagtggtgatggaggactcgtccccacatgaggctctgaggtgtcgtgtcattaaatcgtctggcagagagaagccagattccgatgacgaccttgacatcgcctccctggttacagccaaactcgtcaacacaaccattacacccgaaccggagcccaaacctcagcccaactcccgcgaaaaagcaaagactcggggtgcgcctaggacatccctgttcgagaatgataaggatgccggaatggaaaatgaatctgtgaagagcgtgagagccagtacaaatactatggaactccccgatacgaatggggcaggggtgaaatcacagcgcccatttagccccagagaggctttaaggagccgagccattattaaacctgtcattgtggataaagacgtgaagaaaattatggggggatccggcaccgagacaaccctggagaagcagaagcctgtgagcaagccaggacccaataaagttacatcgagtatcactatctacccctcagacagctctagtcctagggccgcacctggagaggcactgagagagaggcatactagtaccagtaatattcaggtcggtctggcagagctcactagtgtaagcaaccacgtcagctctccatttgagctctctattcataagcacgatattacactgcagctcgccgaggccgagcgaatggccgacgggcctctgaaagaccgccctgagaccgtggtttccaggtcctccatcattataaagccatccgaccctgtggagcggaactcacatgccccacccgctgagacaatcagatggaagtcccacagcgctccttccgaggtgggtttcagcgacgcccgacatgtgactgtacgaaacgcatggaagagccgcagggacctcaaaagtctagaggacccgcctacccggattggcaagaatgtggagtccactaattcaaatgcatatacccagcgaagcagtactgacttttctgaactggaacagcctcgcagctgtctatttgagcagggcactcgtcgggtcgggccaagcagcggcgatgctccggagccttcctcaagacgtacacagtccagtctgacggtaagtgaggtgctgactagacggaatcgggtcggcgataccattacagtagccgcatggaatcacagcgcgagcatgagctcttag

SEQ ID NO: 228351 - DNA, 3231 bp, Artificial Sequence
  Description of Artificial Sequence: Synthetic coding sequence
atggctgagttcaccagttacaaagagaccgcctcttccagacatctgcgattcaaacttcagagtctttcaagacgactggatgaactggaagaggcaacgaagaacctccagaaagcggaggatgagctgctggacctgcaggataaggtaatacaggctgagggatccaacagtagcatgctagccgaaattgaggtgctaagacaaagagtgctgagaatcgaaggaaaggacgaagaaattaagagagctgaggatctctgccgactgatgaaggaaaagctggaggaggaggaaaacctaacgagagaattgaaaagcgagattgaacgactgcagaagcgcatggctgaactcgaaaaactggaggaggccttctccaggagtaaaaatgactgtacccagttgtgtctttcactgaacgaggaacggaacctcacaaagaaaatcagctcagaactcgagatgctacgagtgaaggttaaagaactggagtcgtccgaagatagactcgataagaccgagcagtcattggctagcgaattagagaaactgaagtcacttacactctccttcgtcagtgaaagaaaatacctcaacgaaaaggagaaggagaatgagaagctgatcaaggagctcacccagaagcttgaacagaacaaaaagatgaaccgagattacacccgaaacgccagtaatctggaaaggaacgatctcaggattgaagacggcattagctcaacgttgccaagcaaagagtcccgtcggaagggcggattagattatctcaagcaagtcgagaatgagacacgtaataagtccgaaaatgagaagaaccggaaccaggaggataacaaggtcaaagatctgaaccaggagatcgaaaaactgaagacccagatcaagcactttgaatctctggaggaggaattaaagaagatgaagtcaaagaataatgacttacaggacaattacctttctgaacagaataaaaataagctactcgcatcacagctagaggagataaaactccagatcaaaaaacagaaggagttggagaatggagaggtcgaaggggaggacgcctttctgtcaagtaagggcaggcatgaacggacaaagttccgcggacacggcagcgaggctagcgtgagcaagcacacagctagagaactgagtccgcaacataagcgagaaaggttgcgaaatagggagtttgccttaaataacgaaaattattcactgtcaaatcggcaggtgtcctccccaagtttcaccaaccggcgagcggcaaaggcatcccacatgggcgtgtctacagactccgggactcaagagaccaagaaaaccgaggaccggttcgtgccaggcagcagccagtcagagggcaaaaagtccagggagcagcctagcgtgttgtctcggtatccccctgccgcacaggagcattccaaggcatggaagggtacgtcaaaaccaggaaccgaaagcggcctgaaagggaaagtggaaaagactacacgcactttttctgatactacacacggctccgttccatccgaccctctgggaagagctgacaaagcgtccgatacgagttcggaaacagttttcggcaagcgtggacacgttctgggtaatggctcccaggtgacacaggcggcaaatagcggatgcagcaaggccattggagcactcgcctcctctcggaggagctcctctgagggccttagtaagggcaagaaggccgctaatggcctcgaggccgataattcatgccctaatagtaaagcacccgtattatccaagtatccttactcttgtaggagccaagaaaacattctgcagggctttagtacctcacataaggaaggagtgaaccaaccagccgctgtcgtcatggaggattccagcccgcatgaggctctgaggtgtagagtaattaagtctagcggcagggaaaaacccgatagcgatgatgatttggatattgcttccttagtcacagctaagctggtgaataccacaatcacaccagagcctgagcccaaaccacaaccaaactctcgggagaaagccaagacccggggtgctcctagaacaagtttgtttgaaaatgacaaagacgctggaatggagaacgagtccgttaaatctgtccgggcaagcaccaatacaatggaattgccagacaccaacggcgctggggtcaagtcccaacggcctttcagccctagggaagcgctccgcagcagagccattatcaaacctgttatcgtggacaaagatgtgaagaagatcatggggggatccggaaccgaaaccacactggaaaagcaaaagcccgtttcaaagccgggacccaacaaggtcacctctagcatcaccatctatcctagtgactcatcctctcccagagctgcacccggtgaagctctgagggaacggcatacatcgacatctaacatccaggtcggactagcagaactgaccagcgtatccaatcacgtctcctctcccttcgaattgtctattcacaagcacgatatcaccctccagctcgcagaagccgaaaggatggcagatggccctctgaaggacagacccgagaccgtggtcagccgaagttctatcatcattaagccatctgatccagttgaacgcaattcacatgctcctccagctgaaactattaggtggaagtcccacagtgccccaagcgaggtgggtttttccgatgctaggcacgtcacagtccggaatgcctggaagtccaggagagatctcaaaagcttagaggacccccctacaaggatcggtaaaaatgtcgagtctactaactccaacgcctacacccaacggagtagcacggacttttccgaattagagcaacccaggagctgcctgttcgagcaaggaactaggcgggtgggccctagctccggagacgcgcctgaaccctcctctcggaggacccagagttcactgaccgtgtctgaggtcctgacccggcgtaatagagtgggagataccatcactgtagccgcatggaaccactctgcttctatggaagaggaaggagaggactgcactctgagcgtgtaccgtcagcttcacaattccctcgatccttcagaactaccgggaaaacaaggacttccggaaagcggacgcgtgagggccgaggagaggctgaggcccacgaggccatgcgccgaggagaactag

SEQ ID NO: 228352 - DNA, 3231 bp, Artificial Sequence
  Description of Artificial Sequence: Synthetic coding sequence
atggctgaatttacgtcatacaaagaaaccgcatcttctaggcacctgcgattcaaactgcagtcactgagccgtagacttgacgagttggaagaggccacgaaaaacctgcaaaaggccgaagacgagctgctggacctgcaggataaggttatccaggcagagggttccaacagctctatgctcgcagagatcgaggtccttcgccagcgagtcttacgcatagaaggcaaggacgaggagataaaaagggcggaggatctgtgtcgtctcatgaaggaaaaactagaggaagaggagaacctgacccgggagctcaaaagcgaaatagaaagactgcaaaagcgtatggccgagttagagaagctcgaggaagccttttcaagaagcaagaatgactgcacacaactctgtctcagcctcaacgaggagcggaacctgacaaagaagattagttccgagctagagatgctccgagtgaaggtcaaagaattggaatcatcagaggataggctggataagaccgaacaaagtcttgcttcagaactggagaaacttaagagcctgactctatcatttgtcagtgagcggaaatatctgaacgaaaaagagaaagaaaatgaaaaactaatcaaggagctaacgcagaagctggagcaaaataagaagatgaatagagactatactcgcaacgctagcaatctcgagcggaacgatctccgaatcgaggacggcatttccagcacactgccctccaaggaatcccgcaggaaagggggattagactacttaaagcaggtggagaatgagactcgcaataagtccgagaacgaaaagaatcggaatcaggaagacaacaaggtgaaggaccttaatcaagaaatcgaaaagctaaagacccagataaagcatttcgagtctttggaagaggagctgaaaaaaatgaagtctaaaaataacgacctgcaagacaattatctgagcgaacagaataaaaacaaattacttgccagccagctggaggagataaagctccaaatcaagaaacagaaggaactcgaaaatggcgaagtagaaggtgaagacgccttcctcagctccaagggcagacacgaacgaaccaagtttcgaggccacggctctgaggcttctgtctccaaacacacagccagagagttgagcccacagcacaaaagggagcgcctccgcaatcgcgagtttgcactgaataacgagaattacagcctctctaaccgccaagtgagcagccctagttttactaaccggcgtgctgccaaggctagccacatgggagtgagcacagacagtggaacccaggaaactaaaaagacagaggacagatttgttcccggttcctcccagtcagagggcaagaaaagcagggagcagccatccgttctctcccgctatcctcctgccgctcaggagcattctaaggcttggaagggaacaagcaagcccggaaccgaaagcggactgaaaggaaaggtcgaaaagaccaccaggactttctcagatacgacccacgggagcgtgccaagcgatccactgggtcgagccgacaaggcctccgacacctctagtgagacagtgttcggcaagcggggacacgtgctagggaacggatctcaagttactcaggccgcaaactccggatgcagcaaagccatcggcgcactcgcttcttcaaggcgctcgagcagcgaaggtctgagcaaagggaaaaaagctgctaacggtttagaggcagacaactcatgtccgaattcaaaggctccagtgctgagcaagtatccttatagctgtcggagtcaggaaaacatcctgcaaggattttccacatcccataaagagggagtgaatcaaccggcagcagtggtgatggaggactcaagcccccacgaggctctccgctgcagagtgatcaaaagcagcgggagagagaagcctgactccgatgacgatctggatatcgcctccttggtgactgctaagttggttaacaccaccattacccccgaacccgaacccaaacctcagccaaattcccgagagaaagccaagactcgtggcgctccacggaccagcctcttcgaaaacgataaggacgccggaatggaaaatgagagtgtcaaaagtgtcagggcctcaaccaacaccatggagctgccagataccaacggagccggagttaagagccaacgccctttctcccccagagaggcgttgcgctcacgggcaatcataaagcccgttatcgtggacaaagatgttaagaagatcatgggtggttctggaactgaaactactctggagaagcagaagccagtgtctaagccgggaccgaacaaagtgacgtcctccatcaccatctacccttccgactcgagcagcccacgagctgcccctggggaggccctcagggagagacatactagcacctcaaatatccaggtcggtctcgcagaacttacctcggtgtcaaaccatgtctcttcccctttcgaattgtctatccataagcacgatatcaccctgcaacttgctgaggccgagagaatggccgacggcccactaaaggacaggccggagacggtcgtgagtagaagctccatcataatcaaaccgtccgaccctgtcgagaggaactcccacgccccaccagctgagaccatccggtggaagtcacacagcgcccctagtgaggtgggcttctctgacgccaggcacgtgacagtcaggaatgcatggaagtccaggagagatctcaagtctttggaagacccccctacaaggatcgggaagaacgtagagtctaccaactcaaacgcgtatactcagcgcagttctacagatttcagtgagttggagcaaccacggtcctgtttgtttgagcaaggaacacgtcgggtgggaccatcctccggggatgccccagaaccgagcagtaggcgaactcagtctagcctgactgtgagcgaggtcctgacacgtcgcaaccgtgtcggggacacgattaccgtggccgcttggaatcacagcgcgagtatggaagaagaaggcgaggactgcacgcttagcgtctataggcagctccataactcgctggacccatctgagctacccggaaaacagggactccctgaatccggtcgcgtcagagccgaggagcgacttagacccacacgcccttgcgcggaggagaactag

SEQ ID NO: 228353 - DNA, 822 bp, Artificial Sequence
  Description of Artificial Sequence: Synthetic coding sequence
atggccgaatttacttcttacaaggaaacggctagctcacggcaccttcggttcaagctgcagtctctgtcaagacgtctggatgagttagaggaagctacaaaaaacttgcagaaagccgaggatgaactcttggacctacaggacaaggtgatacaagccgagggcagtaactcgtcaatgctcgcagagatcgaggtgctacgccagcgcgtgctgagaattgagggaaaggatgaagaaattaaacgggctgaggacctttgccgcctgatgaaggagaaattagaagaggaggagaacttgactagagagctgaaatctgaaattgaacggctacagaagcgaatggccgagctagagaaactggaagaagcgttcagtcgatcaaaaaatgattgtacgcagctgtgcttgtcactgaatgaagaaaggaatctgaccaaaaaaatcagctctgaattagagatgctgcgcgtgaaagttaaggaattggagtcctccgaagaccggcttgacaagaccgagcagagcctagcttccgaactggaaaagctcaaaagcctgactctgtcctttgtctcagaaaggaagtacctcaatgagaaggaaaaagagaatgaaaaactcattaaagagttaacacaaaagttggagcagaacaagaagatgaacagagattacacccgcaatgcctccaatcttgaacgcaacgatcttagaatagaggatggtatctcgtcaacactgccctcaaaggaaagccgacgcaaaggaggtctggactatctgaaacaggtggaaaatgaaactagaaactag

SEQ ID NO: 228354 - DNA, 108 bp, Artificial Sequence
  Description of Artificial Sequence: Synthetic coding sequence
atggccgagttcacatcttataaggaaaccgccagctctcggcatcttcggttcaagcttcagagcctttcgcgccgtctggatgagcttgaagaggccaccaagtag

SEQ ID NO: 228355 - DNA, 1041 bp, Artificial Sequence
  Description of Artificial Sequence: Synthetic coding sequence
atgaagttttccccagcacattatctgctgccactcctgccggctctcgtcctgtcaactcgccaggattatgaggaactcgaaaaacaactgaaagaagtttttaaagaacggagtacgatcctccggcaacttaccaagacctctcgggagcttgacgggatcaaagtcaacctccagtcactgaaaaacgatgagcagtctgctaaaactgatgtgcaaaaactgctggagctgggccagaagcagagggaggagatgaagtcactgcaggaggccctgcagaaccaattaaaagagaccagcgaaaaggcagaaaagcatcaggctaccataaacttcctcaaaacggaggtagaaaggaagtcaaagatgatcagagacctacagaatgaaaacaaaagcctgaagaacaagttgttgtccggaaacaaattgtgcggaatccacgccgaggagtcgaagaaaatacaggcccagcttaaagagctccggtatggcaaaaaagacctgctgttcaaggcccagcagctgacggacttggaacagaagttagctgtcgctaagaacgagttagagaaggcagccctcgaccgtgaatcccagatgaaggccatgaaggagacagttcagctttgtctgacaagcgtttttcgcgatcagcctccacccccactgtcactgattacctccaatccaacacgaatgctgctccctcctagaaatattgcgagcaagctgcctgacgctgctgcgaagtccaaaccccagcagagtgccagcgggaataatgagagttcccaagtggaatctacaaaggagggcaatccctcaaccacagcctgtgactctcaggatgagggtaggccttgttcgatgaagcacaaagaatcacctccttcgaatgccaccgctgaaactgaacccatcccacaaaagcttcaaatgccaccgtgttccgagtgcgaagtcaagaaggcccctgagaagcccctgacatcatttgaagggatggccgcacgtgaggagaaaattctgtag

SEQ ID NO: 228356 - DNA, 783 bp, Artificial Sequence
  Description of Artificial Sequence: Synthetic coding sequence
atgaaatcactccaggaggctcttcagaaccagctcaaagaaacaagtgaaaaagcggagaaacaccaagccactatcaacttccttaaaactgaagtagagcggaaatccaagatgattcgggacctccagaacgagaacaaatcactgaagaataaactcctctccggtaataaactatgcggcatacatgccgaagagagcaaaaaaatccaggcccagttgaaggagctgcgctacgggaaaaaagacctgctgtttaaggcccagcagttgaccgatctcgagcagaagctggcagtggccaaaaacgagctggaaaaggcagcactcgacagagagtcccagatgaaggcgatgaaagagaccgttcagctctgcctaacaagcgtcttccgagatcagccaccaccccctctgtctctcataactagcaatcccacgagaatgcttctcccaccaagaaacatagcctctaagttaccagatgccgcagcaaaaagtaagccccagcagtctgcttctggcaacaatgaaagttcccaggtggagtccactaaagaaggaaatccatctaccaccgcctgcgactcacaggatgagggtcgcccttgctctatgaaacataaagaaagcccgccatctaacgccaccgccgagacggagcccattccgcagaagcttcagatgcccccttgtagcgagtgtgaggtaaagaaggccccagaaaagccactgacaagtttcgagggcatggcagcgagggaggagaagatcctgtag

SEQ ID NO: 228357 - DNA, 900 bp, Artificial Sequence
  Description of Artificial Sequence: Synthetic coding sequence
atggcagagctgggcctgaacgagcatcaccagaatgaggttatcaactacatgcggttcgccaggtcaaagagaggactgcggctgaagaccgttgactcctgctttcaggatctgaaagaatcccgcttagtggaggacacctttacaatcgacgaggtgagtgaggtattaaatggcttacaggctgtggttcattccgaggtggagagcgagctaattaacacagcgtacaccaacgtcctgcttctgcgtcagttgttcgcccaagctgagaaatggtatctaaaactccaaaccgatatctccgagctcgaaaatagggagcttctggagcaagtggctgaattcgaaaaagctgagatcacgtccagtaataagaagccaattctcgacgttacaaagcccaagttggctcccctgaatgaaggcggtaccgctgagctgctgaacaaggagattctacggctacaagaagagaacgagaagctcaaaagtcgattgaagactattgaaattcaggccactaacgccttagatgaaaaatccaagctggagaaagctctccaggatcttcaacttgaccagggaaaccagaaggattttattaaggcacaggatctgagcaatctggaaaacacagtcgccgcattgaagtcggagttccagaagactttgaatgacaaaaccgagaaccagaaatctctcgaagaaaacctggcgaccgctaaacacgatctgctgagggtgcaagaacagctgcacatggccgaaaaggagctggagaaaaaatttcagcagaccgctgcctaccgcaacatgaaagagatattgacaaaaaaaaatgatcagatcaaggatctgagaaaacgccttgcccagtatgagcctgaagactag

SEQ ID NO: 228358 - DNA, 849 bp, Artificial Sequence
  Description of Artificial Sequence: Synthetic coding sequence
atgcggttcgcacgttcaaaaaggggattaaggctgaaaacggtcgactcatgctttcaggatctaaaagagagcagactcgtggaagatacttttacaattgatgaagtctccgaggtgctcaatggcctgcaagccgtggttcactcggaggtcgagagcgaactaattaataccgcctacacaaatgttctcctcctgaggcaactattcgcccaggccgagaagtggtatctcaagctacagacagatatttcagaactggaaaaccgagagctgctagaacaggtcgccgaattcgaaaaagcagaaatcacatctagtaataagaagccaattttggacgtgacaaaacccaagcttgccccactgaatgagggcggaactgcagagctcttgaacaaggaaattctgaggcttcaagaagaaaacgaaaagctgaaatctcggttgaagacaattgaaattcaggccacaaacgcactggacgagaaatctaaactggaaaaagcgctccaggacctacagctggaccagggtaatcagaaggattttattaaagcacaggatctatcaaatctggagaacacggtggctgctctgaaatccgagttccagaagactctgaacgataagactgaaaaccagaaatccctggaggaaaacctggctaccgccaagcacgacctgctccgtgtgcaggagcagctgcacatggcagagaaggaactggaaaagaaatttcagcagacagcggcataccgtaatatgaaggaaattcttacaaaaaaaaacgaccaaatcaaagacctgcgcaagcgcctggcccaatacgaaccggaggactag

SEQ ID NO: 228359 - DNA, 771 bp, Artificial Sequence
  Description of Artificial Sequence: Synthetic coding sequence
atgcggaatcaagaccctggaaaaatgggcagacagaggaaatccatcaaactgtatcctacccaccctttggtgacttttccgaggagctgggcaaaatttcaggaaaaagctcttctggtggaagacaccttcaccatcgatgaggtaagtgaggttctcaacgggctgcaggccgtggtgcacagcgaggttgagtcagagctaattaatacggcgtacaccaacgtgctcctgttaaggcagctgtttgcccaggcggaaaagtggtacctcaaactgcaaaccgatatctcagagctggagaacagggagctactggagcaggtggcagaattcgagaaggctgagatcacctcctcaaacaagaagcctattctcgatgtcactaaaccaaaattggcacctctaaacgaaggagggaccgctgagttgttaaataaagagatactgcgacttcaggaagagaacgagaaactcaaaagtcgcctgaagaccattgagatccaggctacaaatgccctggatgagaaatccaagctggagaaggctctgcaagacctgcagctggaccaaggcaaccagaaagactttataaaagcccaggatctgtccaacctggaaaatactgtggctgcccttaagtcagagtttcagaagacactcaacgacaaaacagaaaatcagaagtcactggaggagaatctcgccactgccaagcatgacctgcttcgcgtgcaagaacagctgcacatggctgagaaaatatag

SEQ ID NO: 228360 - DNA, 441 bp, Artificial Sequence
  Description of Artificial Sequence: Synthetic coding sequence
atggttgacgagctcgtgctgctcctgcacgcgttgttgatgagacacagggcgctgagcattgaaaacagccaattaatggagcaactgagactactggtttgtgaacgcgcatccctccttaggcaggtaaggcccccaagctgccctgtcccttttcccgaaacattcaatggggagtcctcgcgcctccctgaatttatcgttcaaacagcctcttatatgctggtgaatgaaaacagattctgtaacgacgcgatgaaggttgcttttctgatctccctactgactggcgaagccgaggagtgggtggtgccgtatatcgagatggattccccaatcctgggagattacagagctttccttgacgagatgaagcagtgtttcggctgggatgatgatgaagacgatgacgatgaagaagaagaagacgactattag

SEQ ID NO: 228361 - DNA, 2220 bp, Artificial Sequence
  Description of Artificial Sequence: Synthetic coding sequence
atggcctctatactgctgaggtcgtgcagagggcgtgccccagccaggttaccccctcctccaagatataccgtccctagaggtagccccggtgacccagctcatctaagttgtgcttctactctgggattgcgtaattgcttgaacgtgccctttggttgttgcacccccattcatccagtgtatactagttctcggggagaccatcttgggtgttgggcccttcgcccagagtgtcttagaatagtgagtagagccccatggacctctacaagtgttggttttgtagcggtgggaccgcagtgcttgcctgtgcgcggttggcactcttcaaggcctgtgcgcgacgactccgttgtcgagaagtccctaaaaagcttaaaggacaaaaataaaaagctggaagaggggggaccagtctacagcccgccagctgaagtcgtcgtgaagaagtccctcggtcagcgcgtgttagacgaacttaaacattattatcatggatttcgcctgttgtggattgacacgaagattgccgctcgcatgctgtggagaatcctgaatggacattccctcacacggagagagcggagacagttcctacgcatctgcgcagacctctttcgcttggtcccatttctcgtatttgtggtggttcccttcatggagttcctcctccctgtggctgtgaagctgttccccaacatgttgcccagtactttcgaaacccaaagcttgaaagaggaacggcttaaaaaggagctgcgtgtcaagcttgagctggctaaatttctccaggatactattgaggaaatggctctaaagaacaaagctgccaaggggtctgcaacaaaagacttctctgttttctttcaaaaaatcagggagacaggagagaggccgagtaatgaggagatcatgcggttcagcaaactgtttgaggatgagctgaccctggataacttgactcgccctcagctggtcgcactgtgcaagcttctggaactgcaatcaatcgggacaaataacttcttgcgcttccagttaaccatgagactcaggagcataaaggccgacgataaattgatagccgaggaaggcgtggattctctgaacgtgaaagagctccaggcagcttgtcgcgctcgaggcatgagagcgctaggagttacggaggaccggctgagagggcagctcaagcagtggctcgacttacacttgcaccaggagattcctactagcctcctcattttatcgcgcgcaatgtacctccccgacaccctgagcccggcagaccagctcaagtcaacgttgcaaaccctgcccgaaatagtggcaaaagaggcccaggtgaaagtggcggaggtggaaggcgagcaggtagataacaaggccaaactggaagccacgctgcaggaagaggctgctatccagcaagaacaccgggaaaaggaactgcaaaaacggagcgaagttgcaaaagacttcgagcctgagcgggtggtggcggctcctcagagacccggtaccgagccgcaaccagagatgcctgacaccgtgctccagagcgaaacgctcaaggacaccgcgcctgtccttgagggtttgaaggaggaggaaattaccaaagaggaaatcgacatcctgagcgacgcctgctccaagttacaggagcagaagaagtccctcaccaaagagaaagaagagttggagctactgaaagaggacgtgcaggactatagtgaagacctgcaggaaatcaagaaggagctctccaagacaggggaggagaagtacgttgaggagtctaaagcttctaagaggttaaccaagagagtgcagcagatgattggccagattgatgggttaatcagccagctcgagatggaccaacaggccggaaaactagctccagccaatggtatgcctacaggtgagaacgtgatctccgtagctgagctgattaacgcgatgaaacaggttaaacatatcccggagtctaaacttacctccctagcggctgccctcgacgagaacaaagacgggaaagtgaatattgatgacctagtcaaggtcattgaactcgtcgataaagaggacgtgcatattagcacatcgcaggtcgcagagatagtcgccaccttagaaaaggaagaaaaggtggaagaaaaagaaaaagctaaagaaaaggctgagaaagaagtcgccgaggtcaaaagctag

SEQ ID NO: 228362 - DNA, 759 bp, Artificial Sequence
  Description of Artificial Sequence: Synthetic coding sequence
atgcggcatacttggccttttcggaacgtaccctttgggtgttgcactcccatacatccagtctatacgtcatctcgaggcgaccacctggggtgctgggcattgaggcctgagtgccttagaattgtcagcagggctccctggacaagcactagtgttggctttgtggcggtcgggcctcaatgccttcccgttcgtgggtggcactccagccgccctgtacgggatgacagcgtcgtcgagaagtcgctcaaaagcctgaaggataagaataaaaaactcgaggagggtggaccagtgtattccccccctgccgaggtcgttgtcaagaaatcgctgggccaaagggtcctggatgagcttaagcattattatcatggtttccgcctactctggattgacactaagattgccgctcgcatgttgtggaggatcttgaacggacattccttgacgagacgcgagcgtaggcagttcctcagaatttgtgcggatctgtttcggctagtgccatttctggtattcgtggtcgtgccctttatggagttccttcttcccgtcgctgtgaagttgtttccaaatatgctcccttctacctttgaaacccaatctcttaaggaggagcgcctcaaaaaggagctgcgggtcaaactcgaactcgccaaattcttgcaggatactatagaggagatggcgctgaagaataaagctgcaaagggcagcgccactaaagattttagcgttttctttcaaaaatag

SEQ ID NO: 228363 - DNA, 4185 bp, Artificial Sequence
  Description of Artificial Sequence: Synthetic coding sequence
atggccgcattacttaggagcgctagatggcttctcagagccggagctgccccaagattgcctctgtccctgagacttttacctgggggtcccggacggctgcatgcggcaagttacctacccgctgctcgcgcaggccctgtagctggcggactgttgagccctgcacgactgtatgcaattgctgccaaggagaaggatatccaggaagaatccactttcagctccaggaagattagtaatcaattcgactgggcactgatgcggctggacctgtccgtgcgacgcacgggcagaatcccgaagaagttactgcaaaaagtgtttaacgacacatgcaggtcaggcggactcgggggtagtcatgctttgctgcttctccggagctgcggaagtttacttcccgagttgaagctcgaggagcggacagaattcgcgcatcgaatttgggataccctgcagaagctgggcgctgtgtacgatgtatcccactataacgccctgctcaaagtatacctgcaaaacgagtacaagttttccccgacagattttctcgcaaaaatggaggaagcgaacatccagccaaacagggtaacataccagcggctcatcgccagttactgcaacgttggagacatcgagggtgccagcaagatccttggctttatgaagacaaaggatttgccggtgacagaggctgtgttttcagctttggtgacgggtcacgctagggcgggagacatggagaatgctgagaatattctgacagtcatgcgagatgcaggtatcgagcccggaccagatacttatctcgcactgcttaacgcctacgccgagaagggagatatcgatcatgttaagcagaccctggagaaggttgaaaagtctgagctccacttgatggaccgggacctgctccagataatcttctccttctccaaggcagggtatccacaatacgtctctgaaatcctcgagaaagtgacttgtgaacggcgttacatccccgatgccatgaacctgatactactcctggtcactgaaaaactggaagacgtggccttgcagatacttctagcgtgccccgtgtctaaggaggacgggccatccgtgttcggttcctttttccttcaacattgcgtgactatgaacactccagttgaaaagctcacagattactgtaaaaaattgaaggaggtgcagatgcatagcttcccactgcagtttaccctccactgtgccttgctggccaataaaaccgatctggccaaggccctgatgaaggccgttaaggaggagggtttcccgattaggccccactatttctggccattgctggtgggccgtcgaaaggagaagaatgtgcaggggattattgagattctcaaggggatgcaggaacttggagtccaccccgaccaggaaacctacactgattacgtgatcccctgctttgatagcgtcaactcggctcgggctatcctacaggaaaacgggtgccttagcgattctgacatgttcagccaagccggattgcgcagcgaggcagctaatggtaacctcgatttcgttttaagtttcctaaaaagtaatacacttccgatctccttgcagtccatcagaagcagtctgcttctgggctttcgacgtagcatgaatattaacctgtggtctgaaatcaccgaactgctgtataaggacggccgatattgccaggaaccaagaggaccaaccgaggccgtgggctactttctttacaatctgatcgactccatgtcagattccgaagtccaagctaaggaggaacacttacgccagtactttcaccagctcgaaaaaatgaacgtaaaaatcccggaaaatatttaccggggtattaggaacttactggagagttatcacgtgccagaactgattaaagacgcccacctccttgtcgaatccaaaaacctagactttcagaaaacagtgcagctaacctccagcgagctggagtcgacccttgaaacactgaaagcagaaaaccagccaatcagggatgtgctcaaacagctcattctggtgctctgcagcgaggaaaacatgcaaaaagctctggagttaaaagccaaatacgaaagcgatatggtcacaggcggatacgccgcactaataaatttgtgttgtagacacgacaaagtcgaagacgcgctgaacttaaaagaagagtttgatcgactggactcctcagccgtcctggacaccgggaaatacgtcggactcgtgagggtgcttgctaagcatgggaaacttcaagatgccataaacatccttaaagagatgaaggagaaggatgtattaataaaggataccacggcacttagcttctttcacatgctgaatggcgctgccctgcgtggcgagatcgagactgtgaagcagctccatgaggcgatcgtgaccctagggctcgctgagccctctacaaatatcagctttcctctggtcaccgtacacctggagaagggagatctctccacggcactcgaagttgccattgactgctatgagaaatacaaggtactgcccaggattcatgacgtcctttgcaagctggtggagaagggagagacggacctcattcagaaggctatggatttcgtgagccaagagcagggggagatggtgatgctgtatgacctattctttgctttcctgcaaacggggaattataaagaggccaagaagatcattgagacacccggtatcagggccaggagtgctcgcttgcaatggttttgcgatagatgcgtggctaacaatcaggtggagactctggagaagctcgtagagttgacacaaaagctgttcgagtgtgaccgggatcaaatgtactacaacctcctaaagctctacaaaattaatggcgactggcagcgtgccgacgctgtgtggaataaaatccaggaggagaacgtaattccgagagaaaaaaccctccgcctgttggcggagatcctgcgagagggaaatcaggaggttccgttcgacgtccctgagctatggtacgaggacgaaaagcactccctgaacagcagttctgcctctactaccgagccagatttccaaaaggacattctcatcgcgtgtagattgaaccagaagaagggagcctatgatatatttctgaatgctaaggaacagaatattgtttttaacgccgagacctattctaatcttatcaaactgctgatgtctgaagattactttactcaggctatggaagtcaaagcttttgcagagacacacatcaaaggctttacgcttaatgatgccgctaactcgagactgataatcacccaggtgcgcagagattatctgaaggaagctgttaccactctcaagaccgtgttggaccaacagcagaccccatcccgactggcagttaccagagtgatccaggccctcgccatgaaaggggacgtggagaacatcgaggtggtgcagaagatgctgaacggattggaggattcgattgggttatccaagatggtgttcatcaacaatatcgctctggcacaaattaaaaacaacaatattgacgccgctatcgagaacattgaaaacatgctaacatccgaaaataaagttatcgagccgcagtattttgggttggcctacctgtttagaaaggtcatcgaggagcaattggagccagctgtcgagaaaatctcaattatggccgagaggcttgctaaccagtttgctatatataaacccgtgacagatttcttcttgcaacttgtggatgccggtaaggtcgacgatgcccgagctctactccaacgatgcggggctatagccgaacagactcccattttgctgctgtttttgctgcgtaactctaggaagcaaggcaaagctagcacggtgaagagcgtcctcgaactaattccagagctgaatgaaaaagaggaggcctacaactcgttaatgaaatcatacgtgtctgagaaggacgtcacgtcagccaaagccctgtatgaacatctgacagccaaaaacactaagctggatgacctatttctcaagagatacgcctcactgctcaaatatgccggagagcccgttccctttatagagcccccagagtctttcgagttttatgcacaacaactgaggaagctgcgggaaaactcatcctag

SEQ ID NO: 228364 - DNA, 3264 bp, Artificial Sequence
  Description of Artificial Sequence: Synthetic coding sequence
atgccacctccaatatgtcccccactggctccaggaccttggcccggagggcttggaggaagtcacgcactgctgctccttcgctcgtgcgggtcactcctcccagaacttaagctcgaggagcgtaccgaatttgcccacagaatttgggacaccttgcagaaactcggagccgtctacgacgtgagtcactataacgcactcctaaaggtttacctccaaaacgagtataagttctcacctaccgacttcctggccaagatggaggaggccaacatacagcccaacagggtcacctaccagcgacttatagcatcatattgtaacgtgggtgacattgaaggtgcatctaaaattctaggttttatgaaaactaaggaccttccagttaccgaggccgtctttagtgccctggtgaccggacacgccagagcaggtgacatggaaaatgcggagaatatcctgaccgtaatgcgcgatgccggtatagagcccggacccgacacatacttagccctgttaaatgcatacgccgagaagggagacatagaccacgtcaagcagacactggaaaaagttgaaaagtctgagcttcatttaatggatcgcgacttgctgcaaatcatcttctctttctctaaggccggttacccccagtacgtgtctgaaatcctcgagaaggtaacttgtgagcgtcgttatattccagacgcaatgaacctcattcttctgctggtcacagagaagttggaagatgttgccctacagattcttctcgcgtgcccagtgtctaaagaggacgggccatcggttttcggctcttttttcttacagcactgtgtcaccatgaatacacccgttgaaaaattaacggattactgcaagaagctgaaggaggtccaaatgcactctttcccattacagttcacactgcactgcgcactgctagccaataaaactgatctggccaaggcgctcatgaaggctgtcaaagaggaggggttccctattcggcctcattatttctggccgctgctggtcgggaggcgcaaggaaaagaatgtgcagggcatcattgagatcctgaaagggatgcaggagctcggggtacatcctgaccaagagacttatacagattacgttatcccttgcttcgactcagtgaactcggctcgcgcaatcctccaggaaaacggttgccttagcgattcagacatgttctcacaggcagggctccggtcagaagccgcaaacgggaatttggatttcgtgctgtcattccttaaaagcaatactttgccaatttccctgcaaagcatcaggtcgagtctcttgttagggttccgccgtagcatgaacattaacctgtggagtgaaataactgaattgctctacaaagacggaaggtactgccaggagcccagaggcccaacggaagcagtcggctacttcctatataacctcatcgattcaatgtctgacagtgaggtccaggccaaagaagaacatctgcgccaatattttcatcagctggaaaagatgaatgtaaaaatcccggaaaacatttacagaggaatccggaatctgctggaaagctatcatgtgccggaactcatcaaggacgcgcaccttctggtcgaaagcaagaacctcgactttcagaagactgtgcaactaacttcctcggaactggagtctactttagagacactgaaagccgagaaccagcctatacgagatgtgctgaagcagctcatactagtcttgtgctcggaagagaacatgcagaaggcgctagaacttaaagcaaaatacgaatccgacatggtgactgggggttatgcagccctgatcaacctttgctgcaggcacgacaaggttgaggatgcattaaacctcaaggaggagttcgaccgactggattccagcgcggttctcgataccggaaagtacgttggactggttagggtattggccaagcatgggaaactgcaagacgctatcaacattcttaaggagatgaaggagaaggatgtgctcattaaagataccacagctctatctttctttcatatgcttaacggggcagcattgaggggtgaaattgagaccgtgaaacaactgcatgaggcaatagtaactctgggacttgctgagccctctacgaatatcagttttcccctggtaactgtccacctcgagaaaggtgatctcagcaccgcactggaggtggctatcgactgctacgagaaatataaagttctcccacggatacacgatgtcctctgtaagctggtagaaaagggcgagaccgatctgatccaaaaagcgatggacttcgtgagccaggagcagggggaaatggtgatgctgtatgacctgtttttcgctttccttcagactggtaattacaaggaggccaagaagatcattgagaccccaggcatccgtgccaggtccgcccgtctgcagtggttttgtgaccgctgtgttgccaacaatcaagtggagaccctggaaaagcttgttgaactgacccagaagctttttgagtgcgatagggatcagatgtactacaatcttctgaaactgtataaaatcaacggagattggcaacgggctgacgccgtctggaacaagatccaagaagagaatgtaattcctagggagaaaacccttagactgctggctgaaattctcagagaggggaatcaggaggtgcctttcgatgtgccagagctgtggtatgaggatgagaagcacagtttgaattctagctccgcttcaacaacagaaccagactttcagaaggacatattgattgcctgcaggttgaaccaaaaaaaaggcgcttatgatatcttcctgaacgcgaaggagcagaatatagtgttcaacgcagaaacctattccaatctcataaaactactcatgagcgaggattacttcacacaggctatggaggtgaaggccttcgccgagacgcatattaagggctttacccttaacgatgccgctaactctcggctgattataactcaggttcggagagattatctgaaagaggccgtgacaactctgaaaacagtgctggaccagcagcagaccccgtcccgcttagcagtgacacgggtaatccaggcactcgctatgaaaggagatgtggaaaacatcgaggtggtgcagaagatgctcaacggtctggaggattcaataggcctcagtaagatggtgtttattaacaatatcgccctcgcccagtag

SEQ ID NO: 228365 - DNA, 2856 bp, Artificial Sequence
  Description of Artificial Sequence: Synthetic coding sequence
atgcctggtccactggggctgctttgctttctggctctggggctcctgggttcagccggtccgagtggcgctgcgccaccgttgtgcgcagccccatgctcctgtgacggtgatcgcagagtggactgtagcggaaaaggcctgaccgcagtgccagaaggcttgtctgctttcacacaggccctggatatcagtatgaataacatcacacaattgcctgaagacgctttcaagaatttcccattcctcgaggaattacagctcgctgggaacgacctgtccttcattcatcccaaagctctcagtggactcaaagagttaaaggtcctgaccctgcaaaacaatcagctaaaaaccgtgccatcagaagcaattcgagggctcagtgccttgcagagcttaaggctcgacgcgaaccacattacgtcagtgccggaagattcttttgaaggactagtccagctaagacacttgtggctggatgacaactcccttacggaggtgcccgttcaccccttgtccaatttgcccaccctacaggcgctcaccttggccctaaacaagatatcatccatcccggatttcgcattcactaacctgtcatctttggtggtgttgcatcttcataataataagatccgatctctgtcccaacactgtttcgatggactagataacctggaaacattggatctgaactacaataacctgggggaatttccccaggcgattaaagccctgccctcactcaaggagctcgggttccacagtaattctatcagtgtgatccccgacggggcatttgatggaaatcccctgttaaggacaattcatctctatgataatccactgtcattcgtgggaaattctgcctttcacaacctgagtgacttgcacagcctcgttatcagaggtgccagtatggtacagcagtttcctaacctgactggtaccgtgcatttagaaagcctcaccttgaccggcaccaagatcagcagtatcccaaacaacttatgccaggagcaaaagatgttaagaacattggatctttcatataataacatacgggacctgccaagtttcaacgggtgtcacgctttagaggagattagcttgcaacgaaaccagatctaccagatcaaagaagggactttccagggtctgatttccttgcgcatcttagatctgtcaaggaatttaatccatgaaatccatagccgagcatttgccacactaggcccaatcaccaatttagacgtgagcttcaatgaactaacgagtttccccaccgaagggctcaatggactgaaccaactgaaactggtcggtaactttaagttgaaggaagccctggccgcaaaggactttgtgaacctgcgctcgctgtctgttccctacgcctaccaatgctgtgcattctggggctgcgatagttacgcgaacttgaacacggaggacaactctctgcaggaccacagcgttgctcaagagaaggggacagcagatgcagccaacgtaacatccaccctcgagaacgaagagcacagtcagattataatacactgcacaccctcaaccggtgcattcaagccttgcgagtacttgctggggtcctggatgatccgtctcacggtctggtttatctttctggtcgctctgttcttcaacctgctggtgatactcaccacctttgcttcgtgcacttcgcttccctctagcaagctgttcataggactcatcagcgtctccaatctgtttatgggtatctacacgggtattctcaccttcctcgatgcagttagctggggcagattcgctgaatttgggatatggtgggagacagggtcaggctgtaaggtggctgggttcctagctgtgttctcctccgaatccgcaatctttctgttgatgctggcaacagtagaacgctccctgtccgctaaagatatcatgaaaaacggcaagtcaaaccatctcaaacagttccgggttgcagctttgctagccttcctgggggcaactgtggccggttgtttccctctgtttcacaggggcgaatactccgcctccccgctttgtctcccatttcctacaggcgagactccctcactgggtttcactgtgaccttagtcctcctcaacagccttgcttttctgctgatggcagtgatttataccaagctatactgcaatcttgagaaggaagacttatctgaaaacagccagtcctctatgattaaacacgtggcgtggctcattttcacaaactgtatctttttttgtcccgttgcgtttttcagcttcgccccactcattaccgccatcagtataagcccagagataatgaagtcagtgaccttgatcttctttcctctgcccgcatgtttaaaccccgtgctctacgtgttcttcaaccctaagtttaaagaagattggaagctacttaagcgtagagtcactaagaaaagcgggtccgtgtccgtaagcatctcatctcaaggcggatgcctggaacaggacttctattacgactgcggaatgtattcgcatttacagggcaatctcacggtctgcgactgttgcgagtctttcctgctcacaaagcccgtgagttgtaagcatctcatcaagagccactcatgtccagctctggccgtggcctcgtgtcaaagacccgaagggtactggtctgattgtgggacccagtcagcacattcggattatgcagatgaagaagatagttttgtgtccgacagtagtgaccaagtgcaggcatgtgggagggcatgcttctatcagagccgcggtttccctctcgtccgctatgcttacaatctcccacgagtgaaagactag

SEQ ID NO: 228366 - DNA, 2724 bp, Artificial Sequence
  Description of Artificial Sequence: Synthetic coding sequence
atggacacatctagattgggggtgctgctctctctgcctgttctgttgcagctggcgacaggcggaagctctcccagatcaggggtcctgctgagaggttgccccacacactgccattgcgaaccagatgggaggatgcttctccgagtcgattgttctgacttaggcctcagtgaattacccagtaatctgtcagttttcaccagctacctcgacctttctatgaataacatttctcagctgctccccaatccactgcccagcctcagatttcttgaagagctcagactggccggaaacgcactgacttatatccctaagggggcatttacaggactgtacagtctgaaggttttaatgctccaaaacaatcaattaagacacgtcccgaccgaagcgctacagaacctaaggagcctccagtctttgagactggatgctaaccacatctcttacgtgcctccgtcttgtttctccggcctccattccctgaggcatctctggctggacgacaacgcacttaccgaaattcccgtccaggcttttcgcagcctgtcggcactgcaggctatgaccctggccctcaataaaattcatcacattcctgattacgcatttggtaatctgtcttcgttggtagtgctgcacctacacaataaccggatacattctcttgggaagaaatgttttgacggactgcattctctcgagacactggatttgaattacaataacctcgatgaattccctactgccataaggaccctgtctaacctgaaggaactgggtttccactccaataacattcgtagtattcctgagaaggctttcgtcgggaaccctagcctgatcactatacacttttacgacaatccaattcagttcgtagggagatccgcattccaacatctgccagagttgagaacactgacgctcaacggcgcttcacagattactgaatttccagacttaacaggcacagccaacctggaatctctcacccttaccggagcacaaatttctagcctgccacagacagtgtgcaaccagctacccaacctccaagttcttgacctctcgtacaacctgctcgaggacctgccttcgttttctgtttgtcagaaacttcagaagatcgaccttagacacaacgaaatctatgagattaaagtcgacacttttcagcagctgctctcactgcggagcctcaacctggcctggaataaaattgctatcatacatccaaacgcatttagcactctgccatcactgattaaactcgatttgagttccaatcttctatcctctttccctattacgggcctgcacggcctgacacacttgaagcttacaggaaatcatgctctgcaatccctcatctccagcgaaaacttccccgagcttaaagttatagaaatgccctacgcatatcagtgctgtgctttcggcgtctgcgaaaacgcgtataagatcagtaatcaatggaataaaggggacaattcttcaatggacgatctccataagaaggatgctgggatgtttcaggcgcaggatgagcgagacctggaggatttcctactggacttcgaagaggaccttaaagccctgcacagcgtgcagtgttcaccttcgcctggaccctttaagccatgcgaacatctcctggatggctggctgattcgcatcggggtgtggaccatcgccgtgctggccctgacatgtaacgcccttgttaccagcacagtgttccggtccccgctctatattagtccgataaaactgctgatcggagttatcgccgctgtcaatatgttgaccggtgtcagcagcgctgttctggccggtgtcgatgcttttacctttggttcattcgcgcgacacggcgcatggtgggagaatggagtcgggtgtcacgtgattggatttttgagcatcttcgcctccgagtcctccgtcttcctcctgaccctggccgctctcgagagaggcttctccgtgaaatacagtgccaaattcgagactaaggctccattttctagtcttaaggtgataatactgctgtgtgccctgctagccttgactatggcagcagtgcctctgctcggcggaagtaaatatggtgcctccccactgtgcctccctttacccttcggcgaaccgtccaccatgggttatatggtggcactgattctgttgaactcactctgtttcctaatgatgacgattgcatacacgaagctgtattgtaacttggataaaggtgatctggagaacatctgggattgcagtatggtgaagcacattgcattgctgctgttcactaactgcatcctgaattgccccgttgcattccttagctttagcagcctcattaatctgacgttcattagcccagaagtgataaagttcattctgctggtcgtagtgccacttcccgcttgtttgaatcccttgctttacatcctatttaatccccatttcaaagaagacctcgtgtccctccgtaaacaaacttacgtctggaccaggtcaaaacacccttcactgatgtccataaatagtgatgatgtcgaaaagcagtcttgcgattcaacacaagccctggtgacgtttactagcagctccatcacctatgatctgccgccaagttcagtcccttcaccggcttacccagtgacggagtcttgccatctgtctagtgttgctttcgtgccctgcttatag

SEQ ID NO: 228367 - DNA, 2334 bp, Artificial Sequence
  Description of Artificial Sequence: Synthetic coding sequence
atggatacgtccagacttggggtcctgctgtccttaccggtgttactccagcttgcaaccggcggttctagccctagatctggcgtgttgctcagaggatgccctacccattgccactgcgaaccagacggaagaatgctgttgcgtgtagactgttccgatctcggtctctctgaactcccttcaaatttatccgttttcactagttatctggatctcagcatgaacaatatctcacagctgctacctaaccctctcccatctttgcgcttcctggaggaactgcgactggctgggaatgccctgacctacatccccaaaggcgcttttacggggctgtattctctgaaggttctgatgcttcagaacaaccaactgcgacacgtgccaaccgaggcccttcagaaccttcgcagtcttcaatccctgcgtctggacgccaaccacatctcctatgtcccaccttcatgcttttctggactgcattccctccgtcatctctggttggatgataacgccctgactgaaatccctgtccaggctttcaggagcctgtccgccctgcaggctatgaccctggccctcaacaaaatccatcatattccagactatgctttcggaaatctttcatccctggtggtcctgcacctgcataacaatagaatccactcgctggggaaaaagtgcttcgatgggctgcacagcttggaaacactagatctgaactataataacctggacgaatttccaacggcaatccgaacattatcaaatctcaaagagttaggatttcattctaacaacattcgcagtattcctgaaaaggcgtttgtgggaaacccatccttgattaccatccacttctatgataatccaatccagttcgtgggacgaagcgctttccagcacctccctgagcttcgtaccctgactctgaatggggctagtcaaattaccgagttccctgatctcaccggcaccgccaatcttgaaagccttactctgactggcgcacagatctcgtccctgcctcagaccgtctgtaaccaactgcccaacttacaagtcctggacctctcatacaacttgctggaggacctgccttcgttcagcgtttgccagaaactccagaaaattgatcttcgtcacaacgaaatttacgaaatcaaagtggatacatttcaacagctgctctctttgcgctcgctcaacctagcgtggaacaaaattgcgattatacaccctaacgccttttccacccttccatcgcttatcaagctggatctcagctccaacctcctgtccagcttccccatcaccggattgcacggactcactcatttgaaactgacaggcaaccatgccctgcagtcattgatttcaagcgagaattttcccgagctcaaagtgatcgagatgccttatgcttatcaatgttgcgcttttggcgtgtgcgaaaacgcctacaagatcagtaaccaatggaataagggagacaactctagcatggacgatctccataagaaagatgccggaatgttccaagcccaagacgaaagggacctggaggactttctgttagactttgaagaggacctcaaggcacttcatagcgtgcagtgttccccaagtccagggccattcaagccttgtgaacacttattggatggctggcttatccgtataggtgtatggacgatcgctgtcctggccctcacttgtaacgctctcgtgacctcaaccgtttttcgcagccccctatatatttctcctatcaaactgctgattggcgttatcgccgcagttaatatgctgaccggggtgtcttcagcagtgctcgccggagttgatgcctttactttcggatcattcgctagacatggggcttggtgggagaatggggtgggttgtcacgtgattggcttcctctcaattttcgcctcagagtcttctgtgttcctgctgacactggctgctttagagcgtggcttttccgtaaagtacagcgccaagttcgagacgaaggcaccattttcgtctctaaaggttatcattctgctctgtgccctgttagccttaactatggcagcagtgccactactcggtggctcaaagtatggagcctcccccctctgtcttcccctactgccacatgacgatcactgtctccaccaggccctgcttcagtttggacaggggcgaccaggcgaatatcttgggctgttatacggaaagacacattgcccggtcgccctgcatcaacttcatcccaaattgccctgcggttttctggtgttattgctgtttaataagccttatatctaccaatcatag

SEQ ID NO: 228368 - DNA, 2508 bp, Artificial Sequence
  Description of Artificial Sequence: Synthetic coding sequence
atggacacctcaagactgggagtgttgttgtctctgcctgtgctgctgcagcttgcaacaggaggctctagccccagatctggcgttttactgaggggctgccccactcactgtcactgtgagcctgatggtcgcatgctgctccgcgtggactgcagcgatttgggtctgagcgagttgccatctaacttgagtgttttcacatcctacctggatctctccatgaacaatattagtcagctgctcccaaatccactcccctcccttcgttttctggaggagctcaggcttgcgggaaatgcgcttacatatattcccaagggagctttcaccggcttatactctctgaaggtgctcatgcttcagaataatcagctgaggcatgtgcctactgaggctttacaaaacctccgcagcttacaatccctgcacctgcacaacaataggatccactctctgggcaaaaagtgtttcgacgggctgcactcactggagacccttgacctaaactacaataacctggatgaatttcctacagccattaggaccctgagtaatttgaaggagctcgggtttcatagtaacaacattagatccatccccgagaaggccttcgtgggaaaccctagtctcataactatccacttttacgataatcccatccagttcgtcggtcgatccgcattccagcacctcccagagctgagaaccctgactctgaacggtgcaagccagattactgagtttcccgatctcacaggtaccgctaacctggagtctttgaccctcaccggtgcccaaatatcttctctgccacaaacagtctgtaaccagctcccaaacctgcaagtccttgatttgtcctataacctgctcgaagacctgccttccttttcggtttgccaaaagctgcagaagatagacctgcgtcacaatgagatttatgaaattaaggtcgacacattccaacaattattgtccttaaggagcctgaaccttgcctggaacaaaatagctattatccacccgaatgctttctctacactgccctcactaattaaacttgacctgtcgtcgaatttgctctctagcttccctataacaggccttcatgggctgacgcacctgaaactgacaggcaaccatgccctacaaagcctcatcagctctgagaattttcctgaactcaaagtgatcgaaatgccatatgcttaccagtgctgtgccttcggcgtgtgcgaaaatgcgtataaaatcagcaaccagtggaacaaaggcgacaactcaagtatggatgacttgcacaaaaaagacgctggcatgttccaggcccaggatgagcgtgacctcgaagacttcttgttggattttgaggaagatttaaaagccctccactcagttcagtgtagccctagcccaggtccgttcaaaccttgcgaacatctgctcgacggatggctgattagaatcggggtgtggactattgcagtactggctttgacatgcaatgccctggtaacctccaccgtattccggtcacctttgtatatctcacctataaagctgctcataggcgtcatcgcggctgttaacatgctgaccggcgtgtcatcagcggttttggccggagttgacgccttcactttcggatccttcgccaggcatggcgcatggtgggagaacggtgtcgggtgtcacgtgatcggttttctgagcattttcgcttctgagtcatcagtatttttgttaacattggccgctctggagcggggattcagcgtcaaatacagcgccaagttcgaaactaaggctccgttcagttcacttaaggtgattatcctgctatgcgcattgcttgcgctcacgatggctgctgtgccccttctggggggatcaaaatacggagccagccctctgtgcctccccctacctttcggtgaaccctcgacaatgggttacatggtggctcttatattactgaattcgttgtgctttctcatgatgacgattgcatacaccaaactgtattgcaatctggacaagggagacctggagaatatttgggattgtagcatggtcaaacatattgctttgcttctctttactaattgtattttgaattgtcctgttgctttcctctccttcagctccctcattaatctcacttttatatcccccgaggtgattaagtttattttattggtcgtcgtgccactgccagcctgtctgaatcctctgctttatattctgttcaatccccactttaaagaggatttggtttcactcaggaaacaaacttatgtttggacaagatctaaacatccatctctgatgtccataaattctgacgacgtggagaagcagtcatgcgactcaactcaggccttagttaccttcacctccagcagtattacctatgacctgccaccatccagcgtcccaagtcctgcttatcctgtcacagaatcctgccacttgagctctgtggcattcgtgccttgtctctag

SEQ ID NO: 228369 - DNA, 2652 bp, Artificial Sequence
  Description of Artificial Sequence: Synthetic coding sequence
atggatacatccaggctcggagtgctgctgagcttgcccgttttgctgcagcttgcaacaggcggtagtagcccaagaagtggagtgctgctccggggatgtccgacacactgtcattgcgagcctgatgggaggatgctccttcgagtggattgttctgacctgggattaagcgaactgccaagtaatctgagcgtttttacttcatacctcgatctgtccatgaacaacatctcccagctgctcccaaatcccctgccgtccctgcggttcctcgaagaactgcgcctggcagggaacgctctgacttatattcccaagggggcatttactggtctttacagtttgaaggtgctgatgttacaaaataatcagttgcggcatgttcctacagaggctttgcagaatctgcggtcactgcaaagcctacggttagacgccaatcatatctcttatgtacctccttcttgcttctcaggtctccattctctgagacacttatggcttgatgataatgcactgaccgaaatacccgtgcaggcatttcggtctcttagtgccctccaggctatgacactcgctcttaataagatccatcacatccccgactacgctttcggaaacttgtcctctctcgttgtgcttcacttacacaataaccgcatccattccttgggaaagaaatgcttcgatggcctccactctttagaaacactagatctgaactataataacctggatgaatttccaaccgccatccgcacgctgtccaatctcaaagagttgcatttttacgataaccccatccagttcgtgggcagatccgccttccagcatctacccgaacttcgaacgctcactctaaatggggcttcacagatcaccgaattccccgatttgaccggcactgcaaacctcgagtctcttacccttactggagctcagatctcaagcctgccccaaaccgtctgcaatcagctccccaaccttcaggtactggacctaagctacaatctattagaagacctcccttccttcagcgtgtgtcagaaactgcagaagatagacttacgccataatgaaatctatgaaataaaagttgacactttccagcaattgctatcactgcgatccctcaatctggcctggaacaagattgcgataatccaccccaacgcgttctctacactgccttcactgattaagcttgacctttctagcaatttgttatcctcattcccgatcaccggcctgcacggcttaacccacctgaagttaaccggaaaccacgctttgcagagcctgatatctagcgagaattttccggaattgaaggtgattgaaatgccctatgcataccaatgctgcgcttttggcgtgtgtgagaacgcctacaagattagtaatcagtggaataaaggagacaattcatcgatggacgaccttcacaagaaagacgctggcatgttccaggctcaggacgaaagagatctcgaggatttcctgctcgacttcgaagaggatctaaaggccctacacagcgtccagtgctcacccagcccaggcccattcaagccatgtgagcatctcctcgacggctggttgattcgcatcggcgtttggactatcgcagtactcgcccttacatgcaacgcgctggtgacctcaaccgtatttcggagccccctttatatcagcccaatcaagctcctaataggcgtgatcgctgcagtgaatatgttgacaggcgtctccagcgccgtgttagccggtgtggacgccttcaccttcggatcctttgcaaggcatggagcctggtgggagaacggtgtaggctgccatgtcatcggtttcctgagtatcttcgcctcagaatcaagtgtatttttgcttaccctagccgcactggaacgagggtttagcgtgaaatactcagccaaattcgagaccaaagccccattttcatctctgaaggtgatcatcttgctttgcgcattactggccttgacgatggctgccgtgcctctgctcggcggatctaagtacggtgccagtcctctgtgcctgcctctaccttttggtgaaccttctacaatgggttacatggtggccctgatcctgctaaacagcctgtgcttcctaatgatgaccatcgcctatacgaagctctattgtaacctcgataaaggcgacctcgagaacatttgggattgttccatggtgaagcatatcgccttgcttttgtttactaactgcatcctgaactgtccagtcgccttcctctctttcagcagcctgattaacctgaccttcattagccctgaggttattaaatttatcctcctggtggtggtacctctcccggcatgcctgaatccgttactgtatatcctgtttaaccctcatttcaaggaggacctggtgagcctgcggaagcagacctatgtatggacccggagcaaacaccccagcctaatgtccatcaacagtgacgatgtggagaagcagtcatgtgattctacacaggctctcgtcaccttcacatcttcttcgattacctacgatcttccaccttcctcagtaccgagcccggcatacccagtgaccgaaagctgccacttatcctctgttgcattcgtgccctgcctctag

SEQ ID NO: 228370 - DNA, 2748 bp, Artificial Sequence
  Description of Artificial Sequence: Synthetic coding sequence
atgggacggccaaggctcactctggtgtgccaggtttccattattattagtgccagggatttatctatgaacaacctgaccgaactccagccagggttgttccatcacctacgctttttggaggaactcaggttgagtggcaatcatctctcccacatcccaggccaggcctttagtggtctgtactcattaaagatcttaatgctccaaaacaaccagcttgggggtatccctgctgaagcactatgggaacttccctccctgcagtctctgcgtctcgacgcgaacctgattagtcttgttccggaacgcagctttgagggcttaagcagccttcggcatctttggctcgatgacaatgccctgaccgaaatccctgttagagcattgaacaatctcccggcactacaggccatgacgctggcactgaacaggataagccacatcccagactacgcattccagaatctaaccagcctggtcgtcctgcacctgcacaataatagaatccagcatctggggactcattcttttgagggcctccacaaccttgagacactggacttaaactataacaagctgcaggaatttcccgtagccattcgtacacttggcagattacaggagctcggctttcataacaacaacattaaagccattcccgagaaggcgttcatgggtaatcctctactacagacgatccacttttatgacaatccaattcagtttgttggacgatccgccttccagtatttgccgaagctgcatactctttcgttgaacggcgctatggatatccaggaatttcccgacctgaaggggactacgtctttggaaatcttgactctgacacgcgcaggcatccgcctgttgccctcgggtatgtgccagcagctgccccgtctgcgcgtgctggaactgtcgcacaaccagattgaagagcttccatccttacacagatgccagaagctagaagaaatcgggctacagcacaacagaatttgggagatcggggctgacactttctctcaactgtccagtctgcaagccctggatctgagctggaacgctatcaggagcatccatcccgaagctttcagcactctgcacagtctggtcaagctggacctcaccgataaccaacttaccacgctgccccttgcgggactgggcggtttgatgcatctgaaattaaagggtaacctagccctgtcccaggcgttcagtaaagactctttcccaaagctgaggatcctagaagtgccttacgcctaccaatgttgtccttacggaatgtgtgcctccttctttaaggccagtggtcagtgggaggcagaagacctgcatctagacgacgaggaaagctccaaacggcctctgggcctccttgcccgtcaagccgaaaatcactatgatcaggacttagacgaactgcaactggaaatggaggacagtaaaccccacccgtcagtgcagtgttccccaacgccaggccctttcaagccctgcgaatacctgttcgaaagctggggaatccggctggcagtatgggcaatcgttctcctgtccgtgctgtgtaacgggctcgtactactcaccgtcttcgcaggcggtcccgttccactgcctccagttaaattcgtcgtcggtgcaatcgcaggggcaaacacactgacagggatctcctgtggcctccttgcgtctgtagacgccctaacattcggtcagttctccgagtacggtgccagatgggaaacaggcttggggtgtcgcgcaacaggtttcctagcagtattggggtctgaggcaagcgtgttgctgcttacactcgccgctgtgcaatgctccgtatccgtgtcgtgtgtacgagcatatggtaaatcacctagcctcggctccgtcagagccggtgtgcttgggtgtctagctctggcaggcctagctgccgcactaccactggcgagcgtaggcgagtatggagctagccccctgtgcctgccgtacgcgccaccagagggacagccagctgcccttggctttactgtcgcactggtgatgatgaattcattctgtttccttgtggtcgccggagcgtacatcaagctttattgtgacctccccaggggagacttcgaggctgtttgggattgcgcaatggttaggcacgttgcttggttgatatttgcagacggacttttgtattgtccggtcgcatttctttcattcgctagcatgctgggcctattcccagtgaccccagaggctgtgaagtctgtcttgctggtggtgctacccctgccggcttgtctcaacccattattgtacttgctgtttaacccgcattttcgagacgatctgaggcgcctacgccctcgggcaggggattccgggccacttgcatatgccgctgcaggagaacttgaaaaatcttcatgcgactcaactcaagctcttgtggccttctcagatgtagacctgatcctcgaggcatctgaagcgggtaggcccccaggcctagagacctacggcttcccatccgtgacgttgattagttgccagcagccaggtgctccgagattagagggctcccattgcgtggaacccgagggcaaccatttcggcaatcctcaacctagcatggacggtgagcttctgctgcgggctgaaggcagcacgcctgcaggcggaggtctgagtggcggaggcggattccagccatccggactcgccttcgctagccatgtgtag

SEQ ID NO: 228371 - DNA, 699 bp, Artificial Sequence
  Description of Artificial Sequence: Synthetic coding sequence
atgaataatctgacagagctacagccagggctgttccaccacctcaggttcctcgaagaacttcggctgagtgggaatcatctaagtcacatacctggtcaggctttttccgggttgtacagtctgaagattctgatgttgcagaacaaccaattaggcggaattcccgctgaggcactgtgggagctaccctcattgcaatctctgaggttggacgccaaccttatctctttggttcccgaacgcagttttgagggactgtcaagcctgaggcatctttggctggacgacaatgctctgactgaaatccctgtgcgggctctgaacaacctccccgcactgcaggcaatgaccctcgccctaaatcgaattagccacatccctgactatgccttccagaacctcaccagtctggtggtgctcgacctgaattataacaaactgcaagagttcccagtggccatccgcaccctcggcagactgcaggagctctccctgaacggtgctatggacattcaggaatttccagatcttaagggcaccacttcactcgagatcctcaccctgactcgggctggaatccgtctcctccccagcggtatgtgccagcagctgcctagactccgcgtcttggaactgtcccataatcagattgaagagctgccatcactgcaccggtgccagaagctggaggagtag

SEQ ID NO: 228372 - DNA, 2904 bp, Artificial Sequence
  Description of Artificial Sequence: Synthetic coding sequence
atgccttcccctccagggctgagagcgttatggctctgcgccgcactttgcgcttcgcgcagagccggaggtgcaccgcagccaggacccggaccgaccgcctgtcccgctccatgccactgtcaggaagatggcattatgctgagtgctgattgcagtgaactgggcttaagcgcagttccaggagatctcgacccactgactgcatacctcgatctctcaatgaataaccttactgagcttcaacccggactcttccaccacctgcggttcctggaagaactcaggctgtctggtaaccatctgtcccatatacctgggcaggctttctcaggtctctactccctaaagatactgatgcttcagaacaaccaacttggaggcatcccagcagaagctctgtgggaactgccttcactgcagtccctccggctggatgctaatctgatcagcctggtaccggagaggtcctttgaaggcctctcttccttgagacatctgtggttagatgacaatgctcttaccgagattcccgtccgcgctcttaataacctgccagctctgcaggccatgacactggcgctgaaccgcatttcccatattccagattatgccttccaaaatctgaccagcctggtggtcttgcacctgcacaacaatcggattcagcatctcggaacacactctttcgagggcctgcacaacctggagacactcgatttgaattacaataagctgcaggagttccccgtggcaatccggactctgggcaggcttcaggagttgggcttccacaacaacaatatcaaagccatccccgaaaaggcatttatgggtaatcctctgctacagacaatacacttctacgataacccaatccagtttgtggggcgttcagcatttcaatatctcccaaaacttcacaccctctccttgaatggcgcaatggacattcaggagttccccgacctgaaggggacgacatctctcgagatcctgaccctgactcgggctggcattagactgctgccgagtggcatgtgtcaacagttgccacgcctcagggtgctggaattaagtcacaaccagatagaagagctgccaagcctgcatcgctgtcaaaaattggaagaaatcgggttgcagcacaatcgcatctgggaaattggggcagatactttttcgcagctgagctcactgcaagccctcgacctctcatggaatgcgatccgttcaatccatcctgaggccttctctaccctgcactcattggtcaagctcgatcttaccgataatcaactaactacattgccactggcaggtcttgggggactgatgcatctaaagctgaagggcaacctggccctgagccaagcattttccaaagatagttttcctaaacttaggatcctagaggtgccttacgcctatcaatgctgtccttacggtatgtgcgccagctttttcaaggcttccggtcagtgggaagccgaggacctccacttggatgacgaggaaagtagcaaaaggcctctgggcctactggccaggcaggctgaaaatcattatgatcaggatttggacgaactgcagcttgagatggaggactccaagccccacccctccgtgcagtgctctccaaccccagggccttttaaaccatgtgagtacctgttcgagagctgggggattagattggcagtatgggccatcgtcctgctgagtgtgctttgcaatggcctcgtattattaacggtgttcgcaggcggacctgtacccctacccccagttaagttcgtagttggggctattgcaggcgctaatactctcaccggcatttcatgcggcctcctggcgtccgtggatgcacttacatttgggcagttctccgagtatggagcaagatgggaaaccgggctcggctgtcgcgctacgggcttcttggcagtgctggggagcgaggcaagcgtgctgcttttaaccttggccgctgtccagtgttccgtgtccgtgtcctgcgttagagcttacggaaaaagcccgagtttggggtccgttagggcaggcgtgttaggttgtctggcactggcaggcctagctgctgcattgccactggcctccgtaggtgaatacggggcttcccccctgtgccttccctatgcacctccagaggggcagcccgcagctctgggcttcaccgtcgccctggtgatgatgaacagtttttgctttctggtcgttgcaggagcctacattaagctctactgtgatctccctaggggagattttgaggcagtgtgggactgcgcgatggtgaggcacgtcgcctggctgatcttcgcagacggtctgctctattgtcctgtggccttcctcagttttgccagtatgctggggctcttccctgtgacgcccgaggcagtcaagtccgtgctgctggttgtgctgcctctgcccgcatgcctgaatcccctcctgtacctgctatttaacccgcactttcgggacgatctccgacgcctccgtccgagggccggagactccggaccgcttgcctatgccgctgctggtgagctggaaaagagctcttgtgactccacccaggcactggtggcgttctcagacgtggacctaatcctggaggcttccgaggctggacgaccgccaggattagagacatacggattccctagcgtcacgctaatcagttgtcagcaacctggcgctccaaggctcgagggttcccattgcgtggagcctgaaggcaatcactttggcaacccccagccttctatggacggggaactcctcttaagggctgagggcagcactccggcaggcggaggtctcagtgggggtgggggattccagccctccggattagcctttgcgtctcatgtgtag

SEQ ID NO: 228373 - DNA, 228 bp, Artificial Sequence
  Description of Artificial Sequence: Synthetic coding sequence
atgttgtctgctgactgcagcgaacttggccttagcgcggtccctggtgacctcgatcctttgacggcctatcttgcagtgcccggaatggtggccgaaggtaaagcggatagaaccgggggaggagggtcaagccgacccgaaaaaacccggcgtagcctcgaagaagccatcgaccgaaccattggcggtgcgcaggagctgtgggcccctgaagtctcgagctag

SEQ ID NO: 228374 - DNA, 2487 bp, Artificial Sequence
  Description of Artificial Sequence: Synthetic coding sequence
atgaggctggaaggggagggaagaagcgcccgagccggtcagaacttgtcaagggctggctcagccagaaggggggcaccacgggacctgtcaatgaacaacctgacagagctccagccgggactgtttcaccatttacgctttcttgaagaacttagacttagcggtaaccatctcagccatattccaggtcaagcatttagtggcctgtactctctgaagatcctgatgcttcagaataatcaactgggaggaatccccgctgaggctctgtgggaactgcctagtctgcagagtctggacctgaattacaacaaactgcaagaattccccgtggcaatccgaaccctcggccgtctacaggaactgggctttcacaataacaatattaaagccatccccgaaaaagcctttatgggtaaccctctgctgcagacaattcatttctacgataatccaattcaattcgttgggagatccgcctttcagtatcttccaaaacttcatactttatcattaaatggcgctatggatatccaagagttccccgacctgaagggcacaacctccctggaaattctgacccttaccagggccggaatccgccttctgcccagcggcatgtgccagcaactgcccaggttgcgagtgctcgaactgtctcataatcagattgaggagcttccatcactccacaggtgccagaagctggaagagattgggctacagcacaacagaatctgggaaattggcgctgacaccttctcccagctgtctagcctgcaggccctggacttatcctggaatgctattaggtcgattcaccccgaagcttttagcacattgcattcgctcgtaaaactagacttaaccgacaatcagctgacgactttacctttggctggcctcggcggtctgatgcacctgaagttgaaagggaatctggccctgagtcaggcattctccaaggacagttttccaaagctcagaattttagaggtgccctatgcctatcagtgctgcccatacggaatgtgcgccagttttttcaaggcctccgggcagtgggaagccgaggacctgcacttagacgatgaggagtcatccaagaggccgctgggcctcttggctaggcaagctgaaaaccattacgaccaggatttggatgagctccaacttgagatggaagactctaagcctcacccatccgtgcaatgcagtccgacccccggtcccttcaaaccttgtgaatatcttttcgagtcctggggcatccggcttgccgtgtgggcaatcgtactcctcagcgttttgtgcaatggactggttttgctgacagtgtttgctggcggaccagtgcctctgcctccagtcaaatttgttgtcggcgcaatcgccggtgccaatactctaactggtattagctgtgggctcttggctagtgttgacgccctcacatttgggcagtttagtgagtacggggcacgttgggagactggccttgggtgcagagccaccggtttcttggccgtcttgggtagcgaagcctccgtactgttgcttaccttagctgcagtccagtgcagcgtctccgtttcatgcgtcagagcgtacggtaagtcgccgagcctgggatctgttcgggctggtgtactgggatgtctggcattggctggcctggcagccgctctgcccctggcatctgtcggggagtacggggcatcaccgctatgcctcccatacgcacccccagaggggcagccagcagctttgggattcacagtggccctggttatgatgaatagcttctgcttcttggttgtagcaggcgcttacattaagctttattgtgacctaccacgaggggatttcgaggctgtctgggattgtgcaatggtgcgacatgtggcatggcttatcttcgccgatggcctactctactgtccggtcgcgtttttaagcttcgccagcatgttggggctgttccctgtgactcccgaggccgtgaaatccgtgcttcttgtcgtgcttcccttgcccgcttgtctaaaccctctgctttatctcctgttcaatccccacttcagagacgatttgcgcagactcagaccacgagccggtgactccggccctctcgcgtatgccgcagctggggaacttgaaaagtcttcctgcgactctactcaggcattggtggctttttccgacgtggacctgattctggaggcatcggaggccggacggcctcccggactggagacctatgggtttccttccgtgacgttaattagttgccaacaacccggagccccacgtttagaaggatctcactgcgtcgagcctgaggggaatcactttggtaaccctcagcccagtatggacggcgagctgctgttgagggccgaaggatctaccccagctggcggtggcctgtccggtggtgggggtttccagccctcaggtctggccttcgcaagccatgtgtag

SEQ ID NO: 228375 - DNA, 6039 bp, Artificial Sequence
  Description of Artificial Sequence: Synthetic coding sequence
atggaaacacttaacggagccggagatacagggggaaagccatctactaggggaggtgaccccgcagccaggtcccggaggaccgaaggcatacgtgccgcatacagacggggagaccggggaggcgctcgcgatctgctcgaggaggcctgcgatcagtgtgcctcacagctggagaagggccaactattgtctatacccgctgcgtacggagatttagagatggttagataccttctaagcaagcgcctggtggagttgccaacggagccaaccgacgataacccagccgtcgtcgccgcttattttgggcacaccgcagtggtgcaggaactgctagagcccttgacaccgaaacagactgaatgggagcaaactgccccatttagtggaaccttccccctgtcctgccatcttttgcccggtccatgctctcctcagcggttactgaattggatgttggcactggcctgccagcgaggacacctgggtgttgtgaagctgctcgtcctcacccatggcgcagaccccgaaagttatgccgtgaggaagaacgaatttccagtaattgttagactgcctctatatgccgctatcaaatctgggaatgaggatatcgcaatatttctgcttaggcacggggcatacttctgctcttatattctgctcgattctccggatccttccaagcacctgctgagaaaatacttcattgaagcgtctccgctgccaagcagttatcccggaaagaccgctcttcgtgttaaatggtctcatctacggctaccatgggtggacctggactggctcattgacatttcgtgccaaatcacagagctcgacttgtccgcgaactgcctcgcgactctgccaagcgtaatcccatggggcttaatcaatctgcgcaagttaaatttgtccgataaccacctgggcgagttgccaggagtccagtccagtgatgaaatcatatgtagtaggctgctggagattgacatatcatccaacaaactgtcccacttgcctccgggatttctgcacctctccaagttacaaaaactaactgcgagcaagaactgtttagagaagctcttcgaggaggagaatgccactaactggattggactgcggaagttgcaggaattagatattagtgacaacaagctgaccgagcttcccgctttattcctccacagttttaaatcactcaacagcttgaacgtgtcccgcaacaatctcaaggtgttcccagacccctgggcgtgtcccctgaagtgttgcaaagcaagtagaaatgccttagagtgtctccccgacaagatggccgttttttggaagaatcatttaaaagatgtggacttttcagagaacgccctgaaggaagtgcctctcgggttgtttcagttagacgccctgatgttcctgcgtctccagggtaatcagttagccgctctgccaccccaggaaaaatggacatgcaggcagctgaagaccttggatctgtcgaggaaccagctggggaaaaacgaagacggtctgaaaacaaagcggatcgcattttttacgacacgaggaagacagagaagcggtacagaagcagctagcgtcctggaattccctgccttcctgagcgaatctctcgaagtcctgtgcctgaatgataatcacctcgacacagtacctcctagtgtgtgtctcctaaagagtctttccgagttgtacctgggcaataacccaggattacgggagcttcctcctgagctcggacagctcggtaacctgtggcagctggacacagaggacctgactataagtaatgtgccagctgagatccaaaaagagggccctaaggcaatgctgtcttacctcagggcacaactgcgcaaggctgagaagtgcaaattaatgaaaatgatcattgtggggcctcctaggcagggtaagagcaccctactggagattcttcagacaggacgggcaccacaggtggttcacggagaggcaactattcggaccacaaagtgggaactgcagcgtcctgctggtagcagagcaaaagtcgagagcgttgagtttaacgtttgggatattgggggaccagctagcatggcaacagtgaaccagtgcttttttacagacaaagctctctacgtcgtggtctggaatctcgcccttggagaggaggccgttgctaatttgcaattctggctgctaaacatcgaagcgaaagcccctaatgcggtggtattagtcgtgggcacccacctggacctgatcgaggccaagtttcgagtggagcggattgccactctccgtgcatacgtcctggctctgtgtcgctcaccttctggcagtcgcgctacaggattccccgacataaccttcaagcacttacacgaaatatcatgcaagagtctggaagggcaagagggactcaggcagttgatctttcacgttacctgttccatgaaggatgttggtagcacaataggctgccagaggctggccggacggctgattcctcgcagttacctcagcctgcaggaagctgttctggccgagcagcagagacgatcaagagacgacgatgtgcaatatctcactgatcgacagctggagcagttagttgaacagacgcccgataatgacatcaaagactacgaggatctgcagagtgccataagcttccttatagagaccggaacactgctgcactttcccgatacttctcacggtctccgaaacctgtacttcttggatcctatatggctgagcgagtgtctacagagaatctttaacatcaagggatccagatccgtggcaaaaaacggagtaattcgggcagaagacttgcgaatgcttctcgtaggtaccgggtttacccagcaaacagaagagcagtactttcagtttttggctaaattcgaaattgcactgccagtggccaacgactcctacttattgcctcacctcctgcctagcaagcccggactggacactcacggaatgcgccaccccaccgctaacactattcagagagttttcaagatgtcattcgtccctgtcggattctggcaaaggtttatcgccaggatgcttatctctctagccgagatggacttgcagcttttcgagaataagaagaatactaaatcccgtaacagaaaggtgacaatttactcattcactggtaatcagcgaaaccggtgtagcacatttcgtgttaaaagaaatcaaaccatatattggcaggaaggactgctagttacctttgatggtgggtacctgtctgtagagagctcagatgtaaactggaaaaagaagaagtccggcggtatgaagatcgtctgtcagtctgaagtgcgcgattttagcgcgatggcttttatcacggaccacgtgaacagtctgatcgaccagtggtttcctgcactcactgccacggaaagcgacggaactcctctgatggaacagtacgtgccatgccccgtatgtgagacagcatgggcacagcacacagatcctagtgagaagtcagaggacgtgcagtacttcgacatggaagattgtgtcctgacagctatcgagagggacttcatcagttgtccccgtcacccagacctgcccgttcctcttcaggagctcgtgcctgaactttttatgactgatttccctgcaaggcttttccttgaaaatagcaagcttgagcactcggaggacgaagggtccgtgcttggtcaaggaggctcaggcacggtaatttatcgggctcgttatcagggtcaacccgtggcagtgaaaaggtttcacatcaagaaattcaagaatttcgctaacgtccccgcagatacaatgctgaggcaccttcgggcaaccgacgccatgaaaaacttttcggaatttcgccaggaagcttcaatgctgcacgctctgcaacacccttgcatcgtagccctcatcggcatttctatccaccccctgtgtttcgccctcgagctggccccactcagcagcctcaacacagtgttgtctgagaatgcgagagacagttctttcattccactgggccatatgctgacacagaagattgcctaccaaatagcctccggcttagcatatttgcataagaagaatataattttctgcgacttgaagtctgacaatattctcgtgtggtccctcgatgtgaaagagcacattaacatcaaactaagcgactatggaatctccaggcagagctttcatgaaggcgctctaggggtcgaaggcacacctggctaccaggccccagaaatcaggcccaggattgtgtatgatgaaaaagtcgacatgttttcgtacggtatggtgctgtacgaattgttgtcaggccagcggcctgcgttgggacaccaccaactgcagatcgccaagaaattaagtaaaggtatccgaccagtgttgggacaacctgaggaagtgcagtttaggcggctgcaggctctaatgatggagtgctgggacacgaaacccgaaaagcgcccattagccctgagcgttgtttctcagatgaaggaccccaccttcgcaactttcatgtatgagctgtgctgtggcaaacaaaccgcctttttctcctcccaggggcaggagtacacagttgttttttgggacgggaaggaggagtctcggaattataccgtcgtgaatacagagaagggactcatggaggtacaacggatgtgctgtcccggtatgaaagtgagttgtcagttacaggtgcaaagatctctctggacggccaccgaggaccaaaagatttatatctacacgctgaaggggatgtgccccttgaacaccccacagcaggcgctggacactccagccgtcgtgacgtgctttctcgccgtgcctgtgattaaaaagaactcatatttggttctggctggcctggctgacgggcttgttgccgtctttcccgtagttcgagggaccccgaaggacagctgctcttatctgtgtagccataccgcgaaccgcagtaaattttcgattgcagacgaggacgctcgtcagaacccctaccctgtcaaggcaatggaggtcgtgaactcgggctctgaagtctggtacagtaatggacctggcctcctggtcattgactgtgcaagcctcgaaatctgtcgaagactggagccttatatggcaccaagcatggtcacatcagttgtttgttcttcagaaggacggggagaggaagttgtgtggtgccttgatgataaagcaaattcgttggtcatgtaccactccaccacctaccagctttgtgcccgttatttctgcggagtacccagtccactacgcgatatgttccctgtccggcctttggacacagaacccccagcagccagccataccgccaatccgaaggtccccgaaggcgatagtattgccgacgtgtcgattatgtattccgaggaattaggaactcaaattctaattcaccaggaaagcctgacagactactgcagcatgagttcctactcctcttccccgccacgacaggccgctaggtcacctagcagtctgccctcatcaccagcctcttcttcctccgtcccttttagtactgactgcgaagattctgacatgttacatactcccggtgccgcatccgaccggagcgagcatgatttgactcccatggacggtgagaccttttctcagcacctgcaggccgtgaaaatcttagccgtgcgggatctcatctgggtgccaagaagagggggagacgtgatcgtaattggcctggagaaggatagcggcgctcagcgcggaagggtgatagctgtactaaaggctcgggagctgacaccccacggtgtactagtggatgcggctgttgtggccaaagatactgtcgtctgtacctttgagaacgagaacaccgagtggtgtttggctgtctggagaggatggggggctagggagttcgacattttttatcagtcatacgaggagttaggcagactggaggcctgtacacgcaagaggcggtac

SEQ ID NO: 228376 - DNA, 6047 bp, Artificial Sequence
  Description of Artificial Sequence: Synthetic coding sequence
atggccggaatgagtcaacgaccgcctagcatgtactggtgcgtggggcctgaggagtccgcagtttgtcccgagcgtgccatggagaccctcaatggtgctggggatacagggggaaaaccctccacacggggaggtgaccctgcggcacggagcagacgaacagagggtatcagggcggcatatcgacgtggggataggggtggggctcgcgacctgctggaggaagcctgcgatcagtgcgcaagccagctggagaaagggcagctgctgagtatcccggctgcctatggggacctcgaaatggtacggtatctgctcagtaagcggctcgtagagcttcctacagagcccaccgacgataaccccgcagtggtggcagcctatttcggccacacagctgtggtccaggaactgctggagagcctacctgggccttgctcaccgcagcggctcttgaactggatgcttgcgcttgcatgccagcgtggccatctcggggtagtgaagctgctcgttctgacgcacggcgctgatcctgagtcttacgcggtgcgaaagaacgagtttccagtgatcgttcggttaccactgtatgctgctataaagagtggcaatgaggatatcgctatctttctgcttcgtcacggggcttacttctgctcatacatattgctcgattcgccagacccgtctaagcatctgctgcggaaatactttattgaagccagcccactgccctcatcctaccctggtaaaacagccttacgtgtgaagtggtcgcaccttaggctaccatgggtggatttggattggttaatcgacatctcatgccagataactgaactggacctaagtgccaattgcctggctacccttcctagtgtgatcccttggggactgatcaacttgcgcaaattgaatctgagcgacaaccacctgggcgaactacctggtgttcagagcagcgatgaaattatttgctccagactccttgaaatcgatatatcgagcaataaactgagccaccttccgccaggattcttgcatctgtctaaattgcaaaagctcacagcaagtaaaaattgcctggaaaagctttttgaggaggaaaatgccaccaattggattggcctgcgcaaacttcaagaactggacattagcgataataaattgaccgaattacctgccttgtttcttcacagtttcaaaagtttgaactctctgaacgtgtcacgcaataacctcaaggtatttcccgacccgtgggcttgtccattgaagtgttgtaaggcctcgcggaacgccctggaatgtctccctgacaagatggccgtgttctggaaaaaccatctgaaggatgtcgatttttccgagaatgccctcaaggaagtgcctctcggtctgttccagctggacgcactgatgttcctaagactgcagggcaatcagctagcagcgctgcctccacaggaaaagtggacctgtaggcagctcaagactctagatttgtctcggaaccagttgggcaagaacgaagatgggctcaaaaccaaacgaatcgccttttttaccacccgcggacggcaacgtagcggcaccgaggcagccagcgttctggagtttcctgctttcctaagcgaatcactcgaagttctctgcctgaacgataaccacctcgacacggttcccccttccgtgtgtctgctgaagtctctgagcgagctctatcttggaaacaatccgggactaagagagctcccacctgagcttggtcagttgggtaatttgtggcagctggatacagaggacctgacaatcagcaatgtgcctgcagaaatccagaaggagggtcctaaagctatgctgtcttatttgcgggctcaactccgtaaggccgagaaatgtaaacttatgaaaatgattatcgtggggccaccacgccagggaaaatccaccctcttagaaattcttcaaacaggccgtgcccctcaagttgtccatggagaggccaccatccgtactacaaagtgggagttgcagcggcctgcaggctctcgcgcaaaagtcgagagcgtagagttcaacgtatgggacattgggggacccgcttccatggccaccgttaatcagtgcttcttcaccgacaaggcgttgtatgtagtggtgtggaacctggccctcggtgaagaagccgtggctaaccttcagttttggctgttgaacatcgaagctaaggcacccaatgcagtggttctggtagtcgggactcacctggaccttatagaggccaagtttcgtgtggagaggattgccactctgagagcgtatgtccttgctctttgtcgatcgccatcaggcagccgggctaccggtttccccgacatcactttcaaacaccttcacgagattagctgtaaatccttagagggccaagagggattgcggcagctcatatttcacgtgacttgttcaatgaaggacgtgggttcaaccattggttgtcagcgcctcgccggacgtctaattccaagatcctacctttctctccaagaagccgttcttgccgagcagcaaaggcgttccagagatgacgacgtccagtacctcacagatagacagctcgaacaactggtcgagcaaactcccgataacgatattaaagactacgaggacctgcagagcgcaatcagctttctgatcgagactggcacacttctgcacttccccgacactagtcacgggcttagaaacctctactttcttgatcctatctggctgagcgagtgtttgcagcgcatttttaacataaagggctcccgcagtgtggctaagaacggcgtgatccgtgctgaagatctgcgcatgttgctggtcggaacagggtttacccagcaaactgaggaacagtacttccagtttttggctaaattcgaaatcgccttacccgtggcaaatgatagctacctgttaccccatctcttaccctccaagcctggtctcgacacgcatgggatgcgccaccccacggcaaacacgattcagcgcgtttttaaaatgtcattcgtacccgtggggttctggcagcgcttcatcgcgagaatgctgataagtctcgccgagatggatctccagctatttgagaataagaagaatacgaagagtaggaatcgcaaggtcactatctatagtttcacagggaaccagcgcaatcggtgttcaacttttagggtcaagaggaatcagacaatctactggcaggaaggcctgcttgtgacattcgatggcggttatctgagtgttgagagtagtgatgtgaattggaaaaaaaagaagtctggtgggatgaagatcgtctgccagtccgaggtcagagactttagcgctatggcctttatcactgatcacgtcaacagcctcatcgaccagtggttcccggctttgacagccactgagagcgacggaacacccctaatggagcaatacgtgccgtgcccagtctgcgagactgcttgggcccagcacactgaccccagtgagaagagtgaagacgtgcagtattttgatatggaagattgcgtcttgaccgcaattgaacgcgatttcatttcttgccctagacacccagatcttccagtgccattgcaggaactcgtgcctgagttgtttatgactgatttccccgctcggctctttctcgagaatagcaaacttgagcactccgaagacgaaggatcagtcctggggcaaggtggatcaggaacagtgatatatcgcgctcggtatcaggggcaacctgtggccgtcaaaagatttcatatcaaaaagtttaagaattttgccaacgtgccagctgacacaatgttgagacacctgagggctaccgatgccatgaaaaacttttccgagttcaggcaagaggcctcaatgctgcacgccttacagcacccctgcatagtggccttgatcggcatctccattcacccactgtgctttgccctagaacttgcaccgctctctagtctgaacaccgtgctgtccgagaacgctcgggacagcagctttatccccctcgggcatatgcttacgcaaaaaattgcatatcagatcgcgtctggacttgcatatctgcataaaaaaaatatcatcttctgcgacttgaagtcagataatatcctggtgtggagtcttgatgtcaaagagcatatcaacattaaactctccgactacggtatcagccgccagtcattccacgaaggtgctctgggagtggaaggtaccccgggataccaggcccctgagattcgcccacgcattgtatatgacgaaaaggtcgacatgttttcctatggcatggtgttgtacgaacttctttcaggacaacggcctgctctgggtcatcaccagttacagatcgctaagaaattgagtaagggcattaggcccgtgctagggcagccagaggaagtgcaatttcgcagactacaggcactcatgatggaatgttgggacacgaagccagaaaagcgcccactagccctgtctgtggtgtcccagatgaaggatcctacatttgcaacatttatgtacgaactgtgctgtggcaagcagaccgccttcttctcatcccagggccaggaatacaccgtcgtgttctgggatggtaaggaagagagtcgtaattacactgtagtcaacactgagaaaggcctcatggaagttcaaaggatgtgctgccccggaatgaaagtgagctgtcaattgcaggtgcagagatctctgtggaccgccaccgaagaccagaagatttatatctacacgctcaaaggcatgtgtcctctgaacaccccacagcaagcacttgatacaccagcagttgtgacatgtttcctggccgttcctgtgataaagaaaaattcatacctggtcctggccggtctggctgatggcctggtggcggtctttcctgtagtacgcggtacacccaaggactcatgttcctatttgtgctcccacacagcaaacagatctaaattctccatcgctgatgaggatgctaggcaaaatccttaccctgttaaggcaatggaggtggtgaacagtggcagtgaggtgtggtattccaacggacccggactcctagtgatcgattgtgcttctcttgaaatttgtcgcaggctggagccatacatggctccctccatggtcacaagtgtcgtttgcagtagcgaaggaagaggggaggaagtggtgtggtgtctcgatgataaagctaacagccttgtgatgtatcatagtactacctaccaactgtgtgcccgttatttctgcggggtacccagccctctgcgggatatgtttcctgtgcggccacttgatacagagcccccagcagcctcccacacagccaaccccaaagtgcccgaaggagacagcattgcagatgtctctattatgtactctgaggaactgggaactcaaatactgatccaccaggaatcactgacagactattgttcaatgagctcgtattcaagctcccctcccaggcaggctgctcgatctccaagttcattaccttcatcacctgcttcatcttcatccgtcccatttagcacagactgcgaggactcagacatgcttcacacccctggggcagcctctgaccggtcagaacacgacctcacccccatggacggtgagacctttagccaacatctgcaggctgtcaagattttagcagtaagagatctgatatgggttcctcgacgaggcggagatgtcattgtaattggattggagaaagacagtggggctcagagagggcgtgtcattgctgtgcttaaggcccgagagctgactccgcatggcgttcttgtcgatgcagcagtcgttgccaaggacacagtggtgtgtacctttgagaacgaaaacactgagtggtgtctggccgtgtggcggggatggggtgcccgagaattcgacatattctatcaatcctatgaagagctggggagactagaagcttgcactcgaaagaggcggta

SEQ ID NO: 228377 - DNA, 2025 bp, Artificial Sequence
  Description of Artificial Sequence: Synthetic coding sequence
atgcttcacgctctccagcacccatgtattgtcgcactaataggaataagtattcaccccctgtgctttgcactggagttagcaccactctcaagtcttaataccgtgttgtccgagaacgctcgcgattcatcattcatccctctcggccacatgctgacacagaagatcgcataccagatagccagcggcctcgcttatcttcacaaaaagaacatcattttctgcgatctgaaaagcgacaacattctggtgtggtcactggatgtgaaggaacacattaacattaaactgtcagattacgggatttcacgacagagcttccacgagggtgctctgggggtggagggcaccccgggataccaggccccagagatcagacctagaatcgtctatgacgagaaagtggatatgtttagctacgggatggtcctatatgaactgctgagcggacagcgaccagcactgggccaccaccagctccagatagccaagaaattgtcaaagggaatccgcccagttcttgggcagcctgaggaggtgcagtttagacgacttcaagcccttatgatggaatgctgggacactaagccagagaagaggcccctggcactgagcgtagtgtcccagatgaaggatcctactttcgccacttttatgtatgagctgtgctgcggaaaacagactgcatttttctcttcccagggccaggagtataccgtggtgttttgggacggcaaagaagagtcgcgcaactatacggtggtaaataccgaaaagggcctgatggaggtccaaaggatgtgttgccccggaatgaaagtgagctgtcagctccaagtgcagaggtccctttggactgctacagaggaccagaaaatctacatctacacactgaaagggatgtgcccgctcaacactccccagcaagctctcgatacacccgcagtcgtgacttgcttcttggccgtgcctgtgattaaaaaaaacagctatcttgtgcttgcaggtttggccgatgggctcgtggccgttttccccgtggtccggggaacacccaaagacagctgttcatacctgtgtagccataccgcaaaccggagtaaatttagcatagccgatgaggatgcacggcagaacccctaccccgtgaaggccatggaagttgtcaattccggctcagaggtatggtatagcaatggcccaggcctcctggtcattgattgcgcctcacttgaaatctgtcggcgactggagccctacatggcaccaagcatggtcaccagcgttgtttgcagctcagagggacgcggagaggaggtcgtatggtgcctggatgacaaggcaaactctctggtgatgtaccactctaccacataccaactgtgtgcaagatacttttgtggtgtcccctcacccctcagggacatgtttccggtgcgcccactggacactgagccccctgcagccagccacaccgcgaatcctaaggttcccgagggagacagtattgcagacgtgtccattatgtactccgaagagctaggcacccagatcctgattcatcaggagtctctcaccgattactgctctatgtcctcctacagcagctccccgcctaggcaagctgcacgtagcccttcttcattgccaagctctccagcctcatccagtagcgtcccctttagcaccgactgcgaggatagtgacatgctgcatacacctggtgcagcttctgaccgtagcgaacacgatttgacaccaatggacggggagacattctcacaacatttgcaagctgttaagatcctggctgtgagggatttgatttgggtccctaggaggggcggagacgtcatagtcattggcctcgagaaagactcaggtgcacagcggggtagagtgattgctgttctcaaagccagggagctgaccccccatggtattatgccagtctcgtctgtaaaggtatgctgggctggatggcccgttagagacatggtctacatggttgccgttatgtag

SEQ ID NO: 228378 - DNA, 99 bp, Artificial Sequence
  Description of Artificial Sequence: Synthetic coding sequence
atggcaggaatgtctcagagacccccttcaatgtactggtgcgttggccctgaggaaagtgccgtgtgtcccgagagggcgatggagaccctgaactag

SEQ ID NO: 228379 - DNA, 1506 bp, Artificial Sequence
  Description of Artificial Sequence: Synthetic coding sequence
atgttttcctacggtatggtcttatacgagcttctcagcggacagcggccagcattaggacaccatcagctccagatagcgaagaaactcagtaaagggattagaccagtcttgggtcagcccgaggaagtccaatttcgcagacttcaagccttgatgatggagtgttgggacaccaaacctgaaaagcgtcctttggcactgagtgtcgtctctcaaatgaaagaccctacatttgcaacattcatgtacgagctctgctgtggcaagcaaacagccttctttagcagccaggggcaggagtacaccgttgtgttctgggacggcaaagaggagtctcgaaattacaccgtagtcaataccgagaagggtctgatggaggtgcagcggatgtgttgccctggaatgaaggtgtcgtgccagctgcaggtgcagcggagtctgtggaccgcaaccgaagatcagaagatttacatttatactctcaaaggtatgtgccctctcaacacgccacagcaagcgctagatacccccgcagtggtcacctgttttctagccgtgccagtgatcaagaaaaatagttatctcgtgctggctggtttagctgacggacttgtggcagtgttccccgttgtgcggggaacgcctaaagactcttgttcctatctatgctctcacactgctaaccgttctaagttttctatcgccgacgaagacgccaggcagaacccataccccgtgaaggccatggaggtggttaactctggtagtgaggtgtggtacagcaacgggccaggactgctggtgattgactgcgcctcccttgaaatttgcagacgcttagagccttacatggctccttccatggtcacatcagtggtctgttcttcagagggcagaggagaggaggttgtgtggtgcctggacgataaagccaactctctggtaatgtatcactctacgacatatcagctgtgtgctaggtatttttgcggagtgcctagccctttgcgggacatgtttcctgtgaggccactggacactgagcctcccgcagcctcccacaccgcaaatcctaaagtcccagaaggcgattcaatcgcggacgtttcgataatgtactctgaggaactggggacacaaattctgattcaccaggaatcgcttactgactactgctccatgtctagctattccagttcacctccaaggcaggctgcccgaagtccgtccagcctgccaagctctccagcatcctccagtagcgtcccatttagtacagactgcgaggattcagacatgctgcatacaccaggcgcagcttccgatcggagcgagcatgacctgacaccaatggatggcgagacattcagccagcatctacaggctgtaaaaatcctggctgtgcgcgacttaatttgggtaccgcgtagggtcgagatgctctcatcactggcctggcggaggatactggccccaagtggggcagaaagcctgccctcatag

SEQ ID NO: 228380 - DNA, 7583 bp, Artificial Sequence
  Description of Artificial Sequence: Synthetic coding sequence
atggcaagcggaagctgccaagggtgcgaggaggacgaggaaacattaaaaaaacttatcgttcggcttaataacgtgcaagagggaaagcaaatcgagaccctggttcagatcctagaggacttgctcgttttcacatattctgaaagagccagcaagctgtttcaagggaagaacatccatgtccccctattgatagtgctggatagctacatgcgagtggcgagtgttcaacaagtcggttggtcactgttgtgtaaattgatagaagtctgccccggtacgatgcaaagtctcatgggcccacaggatgtaggaaacgattgggaagtgctgggcgtgcaccagctgatattaaaaatgcttactgtgcataacgcctccgttaacttatctgtaatcggactcaaaactctagatcttctactgacctctgggaagatcaccctgctgatcctagacgaggagagcgatatttttatgttgattttcgatgcgatgcactcttttcccgctaacgacgaggtgcagaagctcgggtgtaaggctctccacgtattgtttgagcgcgtgtccgaagagcaactgacggagttcgtggaaaacaaagactatatgattttgctgtccgctttgactaatttcaaggatgaggaggaaattgtcttgcacgttcttcactgcctgcactctctggccatcccctgtaacaatgtagaagtcctaatgagtggtaacgtacggtgttataacattgtagtcgaagccatgaaagcgtttccaatgtctgaacgaatccaggaagtgtcatgttgcctgctacaccgccttaccctgggtaatttcttcaacattctggtccttaatgaggtgcacgagttcgtggtgaaggctgtccagcagtaccctgaaaatgctgccctgcagatttccgccttgagctgcctagcactgctgaccgaaacaatcttcctcaatcaggacctggaagagaagaatgaaaatcaggagaacgacgatgaaggagaagaagataagctgttctggttggaagcatgttacaaagcacttacctggcataggaaaaacaagcacgtgcaggaggccgcttgttgggctttgaataatctccttatgtaccagaattcactccatgagaagattggcgacgaggatggacactttcctgctcatcgcgaagtaatgttgagtatgctgatgcatagcagttcaaaggaggtgttccaagccagcgccaacgccctttcaactctgttagagcaaaatgttaactttaggaagatcctcctgtccaaagggattcatctgaacgttctggagcttatgcagaaacacatccactcccccgaagtggccgagtccgggtgtaagatgctcaaccatctgtttgaaggttcaaatacatcactggacataatggctgccgtggtcccaaagatcctgaccgtgatgaaaagacacgagacatccttgcctgtacagctagaggcgctaagggcgatactccatttcatcgtgccaggtatgccagaggaatctcgtgaggacacagagtttcaccataaactgaacatggttaaaaagcaatgcttcaagaatgatattcacaagctcgtgttagccgctctcaacagattcattggtaatccaggcattcagaagtgcggcctgaaagttatcagcagcatagtgcactttccagatgctctcgagatgctctcattagaaggggctatggacagcgtgctgcacactctgcagatgtatccagacgaccaggaaatccagtgtctgggactgtccctcatcggatatctcataaccaaaaaaaacgtctttatcggaaccggccatctactggccaagatcctagtcagttctttgtacagattcaaagacgtggctgaaatccagactaaagggtttcagactatcctagccattcttaaattaagcgcatccttttccaaactgcttgtgcaccactctttcgatctggtgatttttcaccaaatgtctagcaacatcatggaacagaaagaccagcaattcttaaacctgtgctgtaagtgtttcgctaaggtggctatggatgactacctgaagaacgtcatgctggaaagggcttgtgaccagaacaactcaataatggtggagtgccttcttctgctcggggctgacgctaaccaggcaaaggagggtagttcactgatctgtcaggtgtgcgagaaggaaagctctccaaagctcgtagaactcctgttgaattcagggagcagagagcaggatgttagaaaggccctgactatctctatcggcaaaggggattcccaaattatcagcctattgttgagacgcttagccctggatgtcgccaataattctatctgtctgggtggattctgcattggaaaagtcgagcctagctggctgggcccactgtttccagataaaacgtcgaacctcaggaaacaaactaatattgcaagcaccctggcccgtatggtcattcggtaccagatgaagtctgcggtcgaggagggcactgcaagcggaagtgacggtaatttttctgaagacgtactctctaagtttgatgagtggacttttatacccgactcctccatggattccgtattcgcccaatctgatgaccttgacagcgaggggagtgaagggtccttcctcgtgaagaagaaaagcaacagtatcagcgtgggtgaattttatcgggacgctgttctccagaggtgctccccaaacctgcagcggcatagtaacagtttgggaccaatcttcgaccatgaggacctgctgaaacgaaagcgaaagatcctaagctcagatgactccctgcgcagctctaagttgcagtcacacatgcgccattcagattcaatttcctccctggcttctgaacgcgagtacattaccagtttagacctgtcagcaaatgaactgagagatattgacgccctgtcccagaaatgctgcatttcagtgcacctggaacatctcgagaagctggagttgcatcagaatgccctgaccagcttcccccaacagttatgtgaaaccttgaagtcactgacccatcttgatttgcactccaacaaattcacatctttcccatcttatcttctgaagatgtcatgtattgcaaatctagacgtctccagaaacgacatagggcctagtgtggtgctggatccaacggtcaagtgtcccaccttgaagcagttcaacctctcttacaatcagctatcatttgtgcccgaaaatctcaccgacgtggtggagaagttggagcaacttattctagagggtaacaagatctccggaatctgcagtccactgaggctgaaggagttgaagattttgaatctgagcaaaaaccacatttcatcgctaagtgaaaatttcttggaagcctgtccaaaggtagaaagtttctcagctagaatgaattttctggcagcgatgcctttcctcccaccttccatgactatcttaaagttgtctcaaaacaaattttcgtgcatccccgaagctatattaaacttgcctcacctccgatccttggatatgtcctctaacgacattcaatacctcccaggcccagcccactggaaaagtcttaatctgagggagctgctcttcagccacaaccagatttcaatattagacctgtcagaaaaagcctacctgtggtccagagttgaaaaactgcatttgtcccataataaactgaaagagatcccgccagagattgggtgtctggagaatctgacatccctcgacgttagttacaatctcgaattgaggagttttcccaatgagatgggaaagctgtctaaaatttgggatctgccgctcgatgagctgcatctcaatttcgactttaagcacatcggatgcaaagcaaaggatataatccgatttctgcagcagcgcctgaaaaaagcagttccttataaccggatgaagcttatgatagtgggcaatacaggctcaggtaagactacgcttctgcaacagttgatgaaaacaaaaaagtccgatttgggaatgcagtcagctaccgtaggtatcgacgtcaaagactggcccatccaaattcgagacaaaagaaaaagagacttggtcctgaacgtttgggactttgctggtagggaggagttttactctacccaccctcatttcatgacccagagagcgctctacctggccgtttatgacctgagtaaaggccaggccgaggtggacgctatgaaaccgtggctctttaacatcaaagcgcgagcaagttctagccctgtcatactcgtcggcacccacctggacgtgtcagatgagaagcagcgcaaagcctgcatgtccaaaataaccaaagagttgctgaacaagagaggcttccccgcaattcgggactatcattttgtaaatgcaaccgaggagtcagatgcactcgccaagctgaggaagacgattatcaacgaaagcctgaacttcaaaatccgagatcagttggtggtggggcaactcattccagactgttacgtggaactagagaaaattatcctgagcgagagaaaaaatgtacctatcgagttccctgtgatcgaccggaagaggctcctccagctggtcagagaaaaccagctgcaacttgacgagaatgagcttccacatgccgttcactttcttaacgagtctggggtgctgctgcatttccaggaccccgctctccagctctccgatctgtacttcgtggaacctaagtggctatgtaaaatcatggcccagattctgaccgtaaaggtggaaggctgtccaaagcatccaaagggcattattagcagaagagacgtagagaaatttctttctaagaaaagaaaattccccaaaaactacatgtcccaatactttaaacttctcgaaaagtttcaaatcgcccttcctattggggaggagtaccttcttgtcccttcatccttgtccgatcatcgcccagtgatcgagctgccacattgtgaaaactcagagatcattattcgcctgtacgagatgccatacttccctatgggcttctggagtcggctgattaatagactgttggagatcagtccctacatgttatcgggcagagagagagcgctgcggcctaataggatgtactggcgccagggtatttacctcaattggagtcccgaggcatactgcctggtgggcagtgaagtgttggataatcaccccgaaagcttcctgaaaattactgtcccctcttgtcgcaaagggtgtatcttactggggcaggttgtggatcatatcgactctctaatggaggaatggttcccaggattgctcgagattgacatctgtggcgagggtgagacgctgctgaaaaagtgggctctctactccttcaatgacggggaggagcatcagaagattctgctcgatgatctgatgaaaaaagccgaggaaggcgacttgctagtgaacccagatcagccaaggctgactattccgatttcccaaatagccccagacctgatcttggccgacctgcccagaaacatcatgctcaacaacgatgagctggagttcgaacaggctcccgagtttctgcttggcgatgggagttttggtagtgtttatcgggcagcttatgagggtgaagaggttgccgtcaagatctttaacaaacacacttcactacgcctccttaggcaggagctggtggtgctgtgtcatctccaccatccctccctcatttccttactggctgctggaatccgacccagaatgttagtaatggagctggcatcaaaaggctctctggacagacttctccagcaggacaaagcctccctgacgcgcactcttcaacacagaattgccctgcacgttgcggatggacttcgttatctgcactccgcgatgattatataccgggatctcaaaccacacaatgtgctcctgttcactctgtacccaaacgctgccattatagctaaaatagccgattacgggattgcccagtattgttgccggatgggtatcaagaccagtgagggcactcccggtttcagagctcccgaagtggcccgtggcaacgtgatttacaaccagcaggccgatgtttacagcttcggcctccttctgtatgatattctgacgactggcggtcgaattgtcgagggcctgaagttccctaatgaattcgatgaattagagatacaagggaaactacccgatcctgtgaaggagtacggatgtgcgccatggcccatggtggaaaagctcatcaaacaatgcctgaaggagaacccacaggagaggccgacctcagcacaagtgtttgatatactcaactccgcagaactggtctgcctgacacgacgaattcttctcccgaagaacgtcatcgtggagtgtatggtcgctacgcatcataacagtcggaatgcatctatctggctcggctgtgggcacaccgatagagggcagctctcattccttgatctgaatacggagggttatacttctgaagaggtcgcggacagccgaattttgtgcctggccctggtacatcttccggtagaaaaggagtcctggatcgtgtctggcacccaaagtggaaccctccttgtcattaatactgaggacggtaaaaagaggcacactttagagaagatgacagattcagtgacgtgtttgtactgcaatagctttagcaaacagagcaagcagaagaactttttactggtcgggacagccgacgggaaactggccatctttgaggacaagaccgtgaagctcaaaggggcagctccccttaagatccttaacataggcaatgtgtctactcccctcatgtgtctatctgaatcgaccaattctaccgagcgcaatgtgatgtggggcggatgcgggaccaagatcttttcgttctcaaatgacttcactattcagaagctaatcgaaactaggacctcccaactgttttcatacgctgcattttctgacagtaatattattacagtagttgtggatacagccctgtatatcgcaaaacagaactcgcccgtggtggaggtttgggataagaaaacagagaaactatgcggacttatcgattgtgtgcatttccttagggaagtcatggttaaagagaataaggaaagtaagcacaagatgagctatagtgggagggtcaagacactttgcctgcaaaagaacacagctctgtggattggcaccggtggtgggcatatcctgctcctagatctttcgacccggcgacttattcgagtgatttataatttctgcaatagcgtaagggtaatgatgaccgcacagctcggctccctgaagaatgttatgctggtgctcggctacaacagaaagaacaccgagggaactcagaagcaaaaggaaatccagagctgcctaaccgtgtgggacatcaacctgccccacgaagtacaaaatctggagaaacacattgaggttcgaaaagagttggccgagaagatgcggagaacctcggtggaata

SEQ ID NO: 228381 - DNA, 582 bp, Artificial Sequence
  Description of Artificial Sequence: Synthetic coding sequence
atgacaagctcatgcttccgcagtaccacaagacggtctctgagcagtcagacagcacagaggctggtctgcccgcagttcattaacggaacagcgaaagactctatcctaacatctaggtcccaggtcccaataatcctccagtggaacaaaagctcaaagaaattcgtgccacacggggacattcccaatatggaggacgtactagccgttaagtcctttcgcatgcagaacacactgtacctatcactgacccggttcattggagactctagggtgatgcggtggaactccaaacagtttgtggagattcaggctctcccatctcgaggcgcaatgaccctccagccattctcttttaaagataatcactacttggcactagggtcggattataccttttcccagatttaccagtgggacaaggagaaacaactattcaaaaagttcaaggagatctatgtccaggccccacgcagctttacagcagtgagtacagataggcgcgattttttcttcgccagctcattcaaaggtaaaaccaagatcttcgagcacatcattgtggacctgagcttatag

SEQ ID NO: 228382 - DNA, 1638 bp, Artificial Sequence
  Description of Artificial Sequence: Synthetic coding sequence
atggcgctgcgacgcggtggctgtggggcactggggttactactcctgctgttaggtgcagcgtgccttatacccaggagcgcccaggttaggcgtctggcgaggtgccctgctacctgttcttgtaccaaagagagtattatctgtgtgggttcctcatgggtgccacggattgtgcctggggatatcagtagcctgtcactggtaaacgggactttctcggagattaaggacagaatgttctctcatctgccatcactgcaactcctgctgctgaactccaactccttcaccatcattcgagatgacgcctttgccggattatttcacctcgagtacctgtttatcgaaggaaataaaatcgagacgataagcagaaacgccttcagaggcttgcgagacctcacgcatctgtccctggccaacaaccacattaaggctcttcctcgagacgtatttagcgatttagattccctcatagagttggatcttagaggtaacaaattcgagtgcgactgcaaagccaagtggttatatctgtggctgaaaatgacaaactcaacggtcagcgatgttttgtgtatagggcctcccgagtaccaagaaaaaaagctgaatgacgttacatcgttcgattatgagtgcaccacaacagacttcgtggtccatcagaccctcccgtatcaaagcgtgagcgttgacacattcaattcgaagaatgacgtgtatgtggcaatcgcacagccctcgatggaaaactgcatggtgctcgaatgggaccatatagaaatgaattttcggtcatatgacaacataacagggcagtctattgtcgggtgtaaggccatcttaatagacgatcaggtgttcgttgtggtcgcgcagctgttcggagggagtcacatctacaagtacgatgaatcttggaccaagttcgttaagttccaagatattgaggtgtctcgaatttccaagcccaatgacattgaattgttccagatcgatgacgagaccttcttcgtgatcgcagactcctcaaaagccggactgtctactgtgtacaaatggaacagtaagggtttctattcctaccagagtctgcacgagtggtttagagataccgatgctgagtttgtcgatatagacgggaaaagccatctgatcctctcgagtagatcccaggtgccaattatactgcagtggaacaagtcttctaagaagttcgtaccacacggtgatatcccaaatatggaggacgtgctggccgttaaaagcttccggatgcaaaatactctgtatctgtccctcacacggttcatcggtgactcacgggttatgagatggaacagcaagcaattcgtggaaattcaggccctaccgtcacggggtgccatgacgctacaaccgttcagttttaaggacaatcattatctcgccctcggatctgattatacatttagtcaaatttaccagtgggacaaggaaaaacagctatttaaaaagtttaaggagatctatgtacaggcccctcgtagcttcacggcagttagcaccgatcggagagacttcttcttcgcgagttccttcaaaggcaaaacaaagatctttgagcacataattgtagatctcagcctttag

SEQ ID NO: 228383 - DNA, 1647 bp, Artificial Sequence
  Description of Artificial Sequence: Synthetic coding sequence
atggcaggtctgagggcaagagggggaccagggccaggccttctggctctgagcgccctcgggttctgtctcatgctccaggtcagcgcgaagcgccctcccaagacaccaccgtgccctccctcatgttcctgtacacgcgacacagcattctgcgtggattcgaaagccgtgcccaggaacctcccatcggaggtgatcagcctaactttggtgaatgctgccttctctgaaatccaagacggcgctttctcccacttgccactgctgcaattcctcctcttaaacagcaacaaatttacccttatcggagataacgcctttacgggcctaagccatcttcaatatttgttcatagagaataatgatatctgggccctgtcaaagttcactttcaggggactcaagtcactcacccacctttctctggccaataacaatctacagaccttgccccgagatatttttcggcctctggatattctgaacgatttggatctcagggggaacagtctgaattgcgactgcaaggtaaagtggctcgtggaatggctggcacacacaaacactactgtagctcctatctactgtgcctctcctccacggttccaagaacacaaagtgcaggacttaccgctgagagagttcgactgcatcaccacagacttcgtcctgtatcagaccttggccttccctgctgtctctgccgagccgttcctctacagcagcgatctatacttggccttggcccagcccggagtatcagcctgtaccattctgaagtgggattatgtggagagacaactgagggactatgacaggatcccagccccatctgccgtacattgcaagcccatggtggtagactctcagctttacgtggtagtcgcacaactctttggcggtagttacatctaccattgggacccaaacaccaccagattcacacgtctgcaggatatcgatccccagcgggtgcggaagccaaacgacctggaggcctttcgcatagacggcgattggtacttcgcggttgcagacagcagcaaggcgggagcaacttctctgtatcgttggcaccagaatggcttctactcccaccaggccttacacccttggcacagagacaccgaccttgagtttgtggatggagaaggaaaaccaaggctgatcgtctcctcatcctcacaggcccctgtcatataccagtggagcagaacacagaagcagttcgttgcccagggcgaagtgacacaggtgccagatgcccaagccgtgaaacatttcagagcaggacgcgatagctatttgtgcctctcgcgatatatcggtgacagcaagatcctgaggtgggagggaacaagattctctgaggtgcaagccttaccatcccgcggttctctggcgctccagccgttcctagtggggggacgacgatatctggccctcggttctgatttttcatttacccagatataccagtgggatgaagggagacaaaagttcgtccggttccaggaactagcggtccaggccccaagagccttctgttacatgcccgctggagatgctcaactgctgcttgccccttcttttaagggccagaccctcgtttaccgtcatatcgtagtcgacttgtcggcctag

SEQ ID NO: 228384 - DNA, 1614 bp, Artificial Sequence
  Description of Artificial Sequence: Synthetic coding sequence
atggggggtgccggaatcctgctgctgctactagccggtgccggagtggtggtggcttggcggccaccgaagggaaaatgccctctgagatgcagttgtagcaaagattctgccctgtgcgagggctcccccgacttacccgtgagcttcagcccaaccctgctttcattaagcctagtgcggacgggtgtaacccagctcaaagccggttccttcctgcgcatacctagcctccacttgcttctttttactagcaacagcttttcagtcatcgaagatgacgctttcgccggactctcccatctgcagtatctcttcattgaagacaatgaaattggttcaatatccaaaaacgcccttcgaggtctacgctctctcacccacctgtctctcgcaaataaccatttggaaacactgccacgtttcctgttccgcggtctggacacacttacccacgtggatcttcgaggtaatccctttcagtgcgactgcagggttctgtggctgttacagtggatgccgacagtcaacgctagcgtggggactggcgcatgcgcaggaccagcatcgttgagccacatgcagcttcatcaccttgatccgaagacgttcaagtgtagagcaatcgaactgtcatggttccagactgtgggcgagagcgccctgtcggtggagcctttcagctaccagggcgagccgcacatcgttctcgcgcagccctttgctgggagatgtctcatccttagttgggactattcactccagcgctttcggcctgaagaagagttgccagcagcctccgtggtgtcttgcaaacccctcgtgctcggtccttccctgttcgtactggcagcccgtctgtggggagggagtcagctgtgggcccgtccttcccctggacttcggctggcacccacccagactctcgcacccagaaggctgctgaggccaaacgacgcggagttgctatggctggaggggcaaccatgtttcgttgtcgctgacgcaagtaaagcgggaagcaccacactgctgtgccgagatgggcctgggttttatcctcatcagagccttcacgcgtggcacagagacacagacgctgaggctctcgagttagacggcagaccccacttgttgctggcatcagcctcccagagacctgtactgtttcattggacagggggacggtttgagaggcgcacggacattcccgaggctgaagacgtttatgcaacgcgacacttccaagccggaggggacgtcttcctatgccttacccgctatatcggcgacagtatggtgatgcggtgggatggcagcatgtttcgactcctccagcagctgccttcaagaggagctcatgtctttcagccccttttgatcgcccgtgaccagctggccatcctagggtcagatttcgcattttctcaggttctacggctggagccagacaagggattactggagccgcttcaggaactgggtccaccggctctggtggcacctcgtgcgttcgctcacatcacaatggctggacggagatttctctttgcagcatgtttcaagggacctacacagatttatcagcatcacgaaattgacctcagtgcctag

SEQ ID NO: 228385 - DNA, 1485 bp, Artificial Sequence
  Description of Artificial Sequence: Synthetic coding sequence
atgggcggagccggtatcctcctgctgctgctggccggagccggtgtcgtcgtggcatggaggcctccaaaaggtaaatgtccactcagatgtagctgcagtaaagatagcgcactgtgcgagggatctccagacctgccggtcagcttctccccgactcttttgtccctcagtctcgtgagaactggcgtgacacagctgaaggcgggaagttttttgcgaatcccctcgctgcatctgctcctcttcacaagcaacagctttagtgtgattgaggatgatgccttcgcaggcctctcccacttacagtatctgttcattgaagacaatgagattggatccatttctaaaaatgccctgcgcggtctgcggtcactgacacacctgtctctcgccaataaccatttggagacactgccaagatttctcttcagaggcctggacacactaacccacgtagaccttagggggaaccctttccaatgtgattgccgcgttttgtggttactgcagtggatgccgactgtaaatgcctcggtgggcaccggcgcatgtgcgggaccggctagtcttagtcatatgcaactccaccatctggaccctaaaaccttcaaatgtcgtgctatcgagctctcttggttccagacagtgggagagtctgctctcagtgtcgaaccatttagttaccagggagagccacacattgtactagctcaacctttcgccggacgatgcctcattctctcttgggattacagccttcagcgctttaggccagaggaagagttacctggcgaacctccccctaggccgtcagcgtgtccagcagcctgtctcgctgggctgacctgccttcccacgagcccccagcgcccaccttggtgtcctgcctcccactggtgctgggcgagggctagctcctgctggctgccagcttgcggcggagctcatagttgcggcccaggacctgtgccagcgtgcgcttggcctcaaagaaggccttggccaagaggaggatgttgcggccctatgacaccctcctcgtgtggttggaagggtaacccagcatcctggtggccaatgccccctcgcagggcagctcccaggtgctgcgcagcaacaggtccggcttttactcgtactcgagcctgtaccccaggcacaggtaccaggaccctccgtccatggtcttggaccgctggccctacttgctgctggccccgattgccaagcggcccttgttcctcgacagggcctgtcgccgctagcagagacgctcagacatccccgaggccacgaatgagcatgccccacgctaccagtcgccttgtgggtacatgttcgtgcgcaagccacgccaccctgggaaccccatggtcttgcgcaggaaccgccccatgtttcgtgtgctgcagtaacttcccgagggccgtacctacctcatcatcgcactgtagtagccctggcaccagctggccaagctag

SEQ ID NO: 228386 - DNA, 1617 bp, Artificial Sequence
  Description of Artificial Sequence: Synthetic coding sequence
atggggggtgccggaatactgctcttactgcttgccggagcaggagttgttgtcgcttggaggccacccaagggcaaatgtcccctcagatgctcttgctctaaagacagcgcattgtgtgaaggttcccccgatctgcccgtgtcgttcagccccactttgctcagcttgagcctggtacgaactggggtgacccagttgaaggccggaagctttctgcgcatcccttcactccatctattactctttacatcgaattccttcagtgtaatcgaggacgatgcattcgccggattgtctcatctccagtatctcttcattgaggacaacgagatcggatcgattagcaagaatgccctgcgcggtcttcgctccctgacacatctgtctttggctaataaccacctcgaaaccttgcctcggtttctgtttcgcggattggataccctcacacacgtagatctgagagggaacccattccagtgcgactgccgcgtattgtggctactgcagtggatgcccaccgtcaatgcctcagttgggactggcgcttgcgcaggtcccgcttccctgagccacatgcagctgcaccatctggaccctaagacatttaagtgtcgggctatcgagctgtcttggttccaaacagttggggagagtgcactctcagtggagccattcagttaccagggggaaccacacatagtcctggcccagccctttgcaggccgatgcttgatcctctcctgggattactctctgcagcggtttcgtcctgaggaagagcttcctgcagcctctgtggtgtcctgtaagccgctcgtactgggtcccagcttgtttgtcctggctgcgaggttatggggagggagccagttatgggcgaggccatcacccggacttaggctcgctcccactcagacacttgctcctagacggcttctcaggcctaatgatgccgagcttctatggctggaggggcaaccatgctttgtggtagccgacgcgagcaaagcaggctccactacccttctgtgtagggacggacctggattttatccacaccagtccttacacgcatggcaccgtgacactgatgccgaggccttggagttggacggaagaccacatctgctcctggccagtgcttcacagaggccagtcctcttccactggacaggagggcgtttcgaacgtcgcaccgatattcccgaggcagaggatgtttatgccacacgccattttcaggccggaggagatgtttttttgtgcctgacgcgctatataggggatagtatggtggtgatgcgctgggatggctcaatgttcaggctgttgcagcagctcccgagccgaggagcacacgtgtttcagccactgctgattgcccgagaccagttagctatcctagggtcagattttgcttttagccaggtgctgcgcctggagcccgacaagggcctgctcgagccattgcaggagctcggcccaccagctcttgtggcgccacgggcatttgcgcacataaccatggctggacgacgcttcctcttcgcagcttgctttaaaggccctacccagatttaccagcatcacgaaatcgatctgagtgcttag

SEQ ID NO: 228387 - DNA, 2091 bp, Artificial Sequence
  Description of Artificial Sequence: Synthetic coding sequence
atggccacacctggatccgagccacagccttttgtccctgcactgagcgtggctactctccaccctctgcaccacccccaccatcaccaccaccatcaccaacaccacggaggcacaggcgctccaggcggagcgggaggcggtggcggtggcagcgggggatttaacttgcctctgaacagaggcctggagagggcactggaagaagcggctaatagtgggggtctgaatctgtcagcgagaaagctcaaggagttccctcggactgctgctccaggacacgacctgtcagatactgtgcaggctgacctgtccaaaaacaggttggtggaggtccctatggaactatgtcattttgtgtcacttgaaatcctcaatctttatcacaattgtataagagtgattccagaggccatcgtgaacctacagatgcttacctacctaaatctctctcgaaatcaactgtccgctctgcccgcttgcttatgcgggctacccctcaaagtcctgatcgcgagcaataataagttgggctccttgcccgaggaaattggacagcttaagcagctgatggagctggatgttagctgtaacgagatcacggcactgccgcagcagattgggcagctgaaaagcctgcgagagctgaatgttagacgcaactatttaaaggtgcttccgcaggagctggtggatctaagcctggtcaaatttgatttttcatgcaataaggtactggtgattcccatctgttttcgggaaatgaagcagcttcaggtcctcctgctggagaacaatcccctgcaatcccctcccgctcagatttgcaccaagggaaaagttcacatcttcaaatatttgtcaatccaagcttgtcagattaagacggctgatagtctgtaccttcacaccatggaaagaccacaccttcaccagcacgtcgaggatggaaagaaggactccgactctggagtgggatcagacaatggcgataagagattgtccgcaacggagccctccgacgaagatacggtctccctgaacgtcccaatgagtaatattatggaagaagagcagatcattaaagaagattcctgccatcggttgagccctgtcaagggggagtttcaccaggagtttcaacccgagcccagcctcctcggagattccaccaacagcggagaggagagggatcaattcacggatagggccgatggtctccattctgaattcatgaattataaagctagggccgaagattgtgaggagctactgcggatagaggaagatgtccattggcaaacagagggtataatcagcagctccaaagatcaagacatggatattgccatgatcgaacagcttagggaagctgtggacctcctccaggaccctaacggactgagcacggacatcactgaaagaagcgtgttgaacctgtaccctatgggcagcgccgaggccttagaactccaggattctgctctgaacggccagattcagttggaaacctcccctgtgtgcgaggtgcagtcagacctgacattgcagagcaacgggtcacaatattcccctaacgaaattcgcgaaaactcacccgctgtctcaccgactaccaactctaccgcaccattcggactaaagcccagatccgttttcctaaggccacagaggaacctggagtctatcgatccccaattcacaatcagaagaaaaatggaacagatgcgtgaggagaaggaactggttgagcagctgcgcgagtctattgaaatgcgtttaaaagtgagcctgcacgaagacttaggcgctgctttgatggacggcgtggttttgtgccatttagttaatcacattaggcccagatcggtggcttcaattcatgtcccaagtccagccgtccccaagctgtctatggcaaaatgccgcaggaacgtcgaaaattttctggaagcctgtagaaagctgggggtccccgaagagaagctgtgcctgccccatcacatcctggaggagaaggggctggtgaaggtgggcatcacaatacaggcactcttggacatcacagtgactaaggcgctcttcacttag

SEQ ID NO: 228388 - DNA, 2187 bp, Artificial Sequence
  Description of Artificial Sequence: Synthetic coding sequence
atggccactcctggctcagaaccacagcctttcgtcccagctctgtccgttgcaaccttgcacccgctgcaccacccacaccaccaccaccaccaccatcagcatcatggagggaccggggcacccggaggggctggtggaggcggtggcggatcagggggattcaatctgccattgaaccgcggactggaacgtgccctggaagaggcggcaaactctggaggcctcaatctgagcgcaaggaagcttaaggaattcccgcgaactgctgcacctggtcacgacttgtcagacaccgtgcaggcagacttgagcaaaaaccgcttggtcgaagtgcccatggagctgtgccatttcgtctcgctagagatcctgaacttgtaccacaattgtatccgggtcattcccgaagccatagttaatctacagatgttaacctacctgaacctgagtcgcaatcagcttagcgcgctgccagcctgcctgtgtgggctccctctgaaggtgctgatcgccagcaacaataagcttgggtcccttcctgaggagattgggcagctgaagcagcttatggaacttgacgtgtcctgcaatgagattactgcactgccccagcagattggacaactcaaatcgcttagggaacttaacgtgcgccgtaactatctgaaggtgctcccccaggagctcgtggatttgtctcttgtgaagttcgacttctcctgtaataaggtcctggtgattccaatttgctttagggagatgaaacagctccaagtcctgctactcgagaataaccctcttcagtcccctcccgctcagatctgtactaaggggaaggtgcacatattcaaatatctgtctatccaagcctgtcagatcaaaacagccgattctctttatctgcatacaatggagcggcctcatctgcatcagcatgtggaagacggaaaaaaggactcagattctggcgtgggcagcgataatggagataagcgcctttctgcaacagagccaagcgacgaggacactgtatctctaaacgttccaatgtccaacatcatggaggaggaacagattatcaaggaggattcttgccaccgcctctctcctgtgaagggcgaatttcatcaagagtttcaacccgagccgagtctgctgggcgattcgacgaactccggagaagaacgtgaccagtttacggatcgcgctgacggccttcactccgagttcatgaattataaggctcgggctgaggattgcgaggaactgctgcgaatcgaggaggacgtgcactggcagaccgagggcatcatcagctccagtaaggaccaggatatggacatcgccatgatagagcaactgagagaggctgtggacctcttacaggatcctaacgggctttcaacagacataacagaaaggtccgtgctaaacctttaccctatgggcagcgccgaagcacttgagctgcaggattccgccttgaacggccaaattcagctagagacctctccagtctgcgaggtgcaaagcgatcttactctgcagtccaatggcagtcagtactctcctaacgaaattcgggagaatagccccgctgtatcaccgaccaccaactccaccgccccattcgggctgaaacccaggagcgttttcctgaggcctcagagaaacctagaatcaatagacccgcagttcactatcaggcggaagatggagcagatgagagaagagaaagagctggtcgagcagctgagagagtcaatcgagatgcgtttgaaggtgtcattgcacgaggacttaggtgctgccttaatggatggggttgtactgtgtcatctcgttaaccacatcagaccacgcagtgtcgccagcatccatgtgccctcgcccgctgttcctaagctcagcatggctaaatgcaggaggaatgtagagaattttctggaagcttgtcgaaagttgggcgtgccggaggccgatctctgcagcccatgtgacatccttcagctggatttcagacatattcggaagactgtagatacactgctagctctgggcgagaaggcgcctccacccactagcgcactgcggtcccgagatctgatcgggttctgcctggttcacatcctgttcatagtgcttgtctatatcacgtatcactggaacgctctcagtgcttag

SEQ ID NO: 228389 - DNA, 2292 bp, Artificial Sequence
  Description of Artificial Sequence: Synthetic coding sequence
atggccacacccggaagcgagcctcagccctttgtcccagcccttagtgtggccacactgcaccctctgcatcacccccatcaccatcaccaccaccatcagcaccatggcggaacaggggctcccggtggggcaggcggtggcggagggggtagcggtggctttaatttgcctttgaatcgaggcctggaacgtgccctcgaggaggccgctaattcaggaggcctgaatctgagcgcgcgaaagctgaaggaattccctcgcacagccgctccgggtcacgatttgtcagacaccgtccaagcagacctctctaaaaatcggctggtcgaggtgccaatggaactctgtcatttcgtctcactcgaaattctcaacctatatcacaattgcattcgggtcatcccagaggccattgtcaatcttcagatgctgacttatctgaatctctctcgaaaccagctctcagccctgcccgcatgcctatgcggcctgcccttaaaggtcctgatcgcctcaaataataaacttggcagtctgccagaagagatagggcagctcaagcagttgatggaactggacgtgagctgcaacgaaataactgccttaccccaacaaataggccagctgaaatctctgcgcgagctgaacgtccgcagaaattatctaaaggtgctaccgcaggagcttgtggacctctctctggtgaagtttgatttttcttgcaataaggtgcttgtcattccaatatgcttccgcgaaatgaagcagctgcaggtgttgctgctcgagaataaccctttgcaatcacccccagctcagatctgcacaaagggtaaggtgcacattttcaagtacctgtcgattcaggcttgtcaaattaagacggccgacagtctgtatctccataccatggagaggccacacctccaccagcacgttgaagatggaaaaaaagattcagattccggcgtcggttcagacaacggtgataagcgcttgtccgcaactgaaccgtccgatgaggacacagtgagcctaaacgtgcctatgtccaatattatggaggaggaacagattatcaaagaagactcttgtcatcgattgagcccagtcaagggcgaattccaccaagagttccagccggaacccagcctgctgggcgattccactaacagcggggaggagcgcgaccagtttactgaccgggctgacgggctgcactccgagtttatgaattataaagctagagctgaggactgcgaagaactgctcagaattgaggaggacgtgcactggcagaccgaaggaatcatctcaagtagcaaggaccaggatatggacatagctatgatagaacagctgagagaggcggtggacctgctgcaggaccctaacggcttatccactgacataacagagaggtccgtcctgaacctatatcctatgggctcagccgaagcgttggaactgcaggatagtgccttaaatggacaaattcagctggagacatccccagtctgtgaagtccaaagtgatttgactctgcagagtaacggaagccaatactcaccgaacgaaatccgcgagaacagcccagccgtgtctccaacaacaaattctacggcaccttttggcttaaagcccaggtctgaccccgcattaatcctgccacctatctctttcaacactctcacccaggcccagacctgggattctagctcatatagcgtgcctagtgaaggagactccgacaatgtgttcctcagaccgcagcggaacctggaatctatagacccccagttcaccattcgcagaaaaatggaacaaatgcgggaggagaaggagctggtggagcagctgcgagagtcaatcgaaatgcgactcaaagtgtcgctacatgaggacctcggggcagcattgatggacggcgtggtcttgtgtcacctggtgaatcatatcagaccacggtcagtggcaagcatccacgtgccaagccccgcagtgcccaagttaagcatggctaaatgccgtaggaacgtggaaaactttctggaagcatgccggaagttaggtgtgcctgaggccgatttgtgttctccgtgcgatatcctgcagctggatttcaggcatatccgaaagacagtcgacactctgcttgccctcggcgagaaagcacctcccccaacatcagcccttagatcacgagatcttatcgggttttgcttagtgcacattctatttatagtactcgtatatattacctatcattggaatgctctgtcggcatag

SEQ ID NO: 228390 - DNA, 3282 bp, Artificial Sequence
  Description of Artificial Sequence: Synthetic coding sequence
atggctaggcctgtccgagggggtctaggcgctccaagacgcagcccctgcttgctgctattatggcttctgctcttgagattggagcctgtgaccgctgccgcaggccctagggctccctgtgctgctgcctgcacttgcgccggtgatagcctcgattgcgggggtaggggtctggctgctttacccggtgacctccccagctggacccggagcctgaatctcagctacaataagctgtcagagattgatcctgcaggcttcgaagatctgcctaatttgcaggaggtctacctcaataacaacgagctcacggccgttccaagcctcggcgctgcgtcttcgcacgtggttagcctctttctccaacataacaagattcggtccgtggaggggagtcagctgaaagcttacttgtccctggaggtactggacctcagcctcaataatattacagaagtgcggaacacctgcttcccccatggccctcccatcaaagagctgaatcttgcgggtaaccggattggaacgctggaacttggcgctttcgacgggctgtctagatcactgctcacactgcggttgagtaagaacaggatcacccagctcccagtccgagccttcaagctgcccagactgacacagctcgatctgaatcgtaacagaatccgtctgattgagggtcttacatttcaaggactgaactctctcgaggtgctgaaactccagcggaacaatatatctaagctgacagatggtgcattttggggcctaagcaagatgcatgtgctccatttggaatacaactccctagtcgaggtgaactcaggttccctctacggcctgacagcactccaccagctgcacctgtcaaataactccatcgctcgtatccaccgcaaaggctggagtttctgccagaagctgcacgaactcgtgctttcgttcaacaacctgacacgattggatgaagagtccctggccgagctgtctagcctctctgtgttacggctgtctcacaactcaatttcccatattgctgaaggcgcattcaaaggtctgagatctttgcgagtgctggacctcgatcataatgagatatcgggcacgatcgaggatacatccggggcattctcaggactcgatagcctgtcaaagctaacattgttcggcaacaagattaagtcagtggccaagcgggctttttcagggcttgagggtctagagcatctgaatctgggtggtaacgccattcgctctgttcagttcgatgccttcgtcaagatgaagaacctgaaggaactgcatatcagcagtgacagcttcttgtgtgactgtcagctgaagtggttacccccatggcttataggtagaatgttacaagctttcgtaaccgccacctgcgctcatcccgaatccttgaaaggccagtctatcttcagtgtccccccagaatccttcgtgtgcgatgactttctgaagcctcaaatcattacccaaccagaaactactatggctatggtcgggaaagacatacgctttacctgctcagcagcctcttcatcttcctctcctatgacgtttgcatggaaaaaggacaatgaggtccttacgaacgcggacatggagaattttgttcacgtccacgctcaggacggagaggttatggaatatactaccatcctccacctcaggcaggtcacattcggccacgaggggagataccagtgcgtcatcaccaatcacttcggctctacttattctcacaaagctcgactgaccgttaatgtcctgccaagtttcactaaaaccccgcatgacattactataaggacgacgacgatggccagacttgaatgcgctgccaccgggcacccgaatccccagattgcctggcagaaggatggcggaaccgattttcctgccgctagagaaagacgaatgcacgtgatgccagatgacgacgttttcttcattacagacgtaaaaatcgacgatgcgggagtgtacagttgtaccgctcaaaacagcgccggttcaatcagcgctaacgcaactctgactgttcttgagacgccctctttggtcgtgcccctggaggacagggtggtttctgttggggagacagttgctttgcagtgcaaggccactggtaatcccccacctaggatcacatggtttaagggtgatcgccctttaagtttaaccgagaggcaccaccttacaccagacaaccagttgctagtagtgcagaatgttgtggcagaagatgctgggcgatatacttgcgaaatgagtaataccctgggaactgaaagggcccactcccagctgtcggtcttacccgcagctgggtgccgaaaggacggaaccaccgtcggaatatttactatagcggtcgtgtcatctatagttttgactagcctcgtttgggtgtgtattatctaccagaccaggaaaaagagcgaggaatactcagtgacaaacactgacgaaaccgtcgttcccccagacgttccttcctacctgtctagccaggggactcttagcgacaggcaggaaacagttgtacgcacagaaggtggtccccaagccaatggtcatatcgagagcaatggcgtttgtccgagagatgcctcacatttccccgagcctgatacccactcagtggcctgtagacagcctaagctgtgcgccggttccgcatatcacaaggagccctggaaagctatggagaaggccgagggcaccccaggaccacataagatggagcatggcggtcgagtcgtgtgctctgactgcaacaccgaggtggactgctacagtcggggacaagctttccaccctcagcccgtgagtagagattcagctcagccttctgcaccaaatggtccagagcctggcggttcggaccaggagcactccccacaccatcagtgctccagaacggccgcaggctcatgcccagaatgccaggggtccctgtatccctccaaccacgatcggatgctcacagcggtgaagaagaagcctatggcttccttggatggaaaaggagactctagctggaccttggcgcgattatatcaccctgacagcaccgaattgcaaccagcttcgtcccttacatcgggaagcccagagcgtgcggaagcccaatacctgctcgtatccaacggacatcttccaaaggcgtgtgacgccagtccagagagtacaccactcacagggcagcttcccggaaaacagcgcgtgcctctcttgttggcacccaagagctag

SEQ ID NO: 228391 - DNA, 2991 bp, Artificial Sequence
  Description of Artificial Sequence: Synthetic coding sequence
aacctgagctacaataaactgtcagagatagaccctgccggattcgaggatctgcccaatctgcaggaagtgtatctgaacaataacgagctaaccgccgttcccagcctcggcgcagctagttcacatgtggtaagccttttcctgcagcacaacaaaattcgctctgtggaaggaagccagcttaaagcgtacttgagcctggaagtactggacctttctttaaacaacataactgaagtacgcaatacctgttttcctcacggacctcctataaaggagttgaatcttgcgggaaatcgaatcggtactctggagcttggagccttcgacggactttcacggtcactgctcacactacggctgtcaaagaatcgtataactcagttgcccgtgcgggctttcaaactacctagactgacacagctcgatctcaatcgaaatcgaatccgccttattgaaggcctaacgttccagggcctgaattcactcgaggttctgaaactgcagcgaaacaacatcagcaaactcaccgacggcgctttttggggcctgagcaaaatgcacgtgctccacctcgagtacaacagcctggttgaggtgaatagcggctcgttatacggtctcacagctctgcatcaactacacctttcgaacaattctatagcaaggatccatcgcaaagggtggagcttctgccagaagctccatgaacttgtgctaagttttaataacctcacccgactagatgaagagtccctggcagagctgtcgtccctcagcgtgctgcggctgagtcataattccatctctcatatagccgagggcgcttttaaaggtctccgttccctgcgagtgcttgacttggaccacaacgaaatctccgggacgatcgaagatacaagtggggctttctcaggattagacagcttaagtaaacttaacctcgggggtaacgctatacgcagtgtccagttcgacgcctttgtgaagatgaagaacttaaaagaactccacataagttcagattctttcctatgcgattgtcagctgaagtggctgccaccatggcttatcgggaggatgctgcaggctttcgtgaccgcaacctgtgcacatcctgagtctctaaagggtcaatccatcttctctgtcccgcctgaatcattcgtctgtgacgactttttaaagcctcagatcattactcaacccgaaaccaccatggctatggttggcaaagacattcggtttacctgttccgcagccagcagttcctcctctccaatgacatttgcttggaagaaggataacgaggttctgacgaatgctgatatggagaactttgtccacgtccacgcgcaggatggggaggtcatggagtataccaccatcctgcatttgaggcaggtcaccttcgggcatgaaggccgataccagtgtgtaatcactaatcactttgggagtacgtacagtcacaaggcaaggctaactgtgaatgtgctcccatcattcactaagaccccccacgatattacaattcggaccacaacgatggctaggctggaatgtgctgccaccggccaccccaatccccagatcgcatggcagaaagacggcggaaccgatttccctgcggcacgggagaggaggatgcatgtaatgcccgatgatgacgtgttttttatcactgacgtcaagattgacgacgcgggtgtgtacagctgcaccgcgcaaaattccgcaggcagcattagtgccaatgcgacgttgactgtcttggagacacctagtctggtggtgccacttgaggacagggtcgtatccgtgggcgaaacagtggccctgcagtgcaaggccacaggcaacccacccccacgaatcacttggtttaaaggcgacaggcccctgagtcttacagaacgacaccatctgacccctgataatcaactgcttgtggtgcaaaatgtggtggcggaggatgcaggacgctacacatgtgaaatgtccaataccctgggaactgagcgggctcacagccagctgtctgtgcttccagcagcgggatgcagaaaggatggcaccacggttggcatatttacaatcgccgtcgtcagcagtatcgtgctgaccagcttggtctgggtgtgtattatttaccagacgaggaaaaagtctgaggaatattccgtcacaaatactgatgagactgtcgttcccccagacgtaccaagctatctctcttcccaggggacgctaagcgacaggcaggagaccgtcgtgcggactgagggaggcccacaagctaatggccacattgaatccaatggagtgtgtcctcgggacgcttcccactttccagagccagatacacatagtgtcgcgtgtaggcagcccaagctgtgtgccggatccgcctatcacaaagaaccatggaaggccatggaaaaggccgaggggacacctggacctcacaagatggagcacggaggcagagtggtgtgcagcgattgcaacactgaggtggactgttatagccggggacaggcctttcacccgcagccagtgagtagagactcagcacagcccagtgcaccaaatggaccggaacccggaggtagtgaccaggagcactccccacatcatcagtgctcaagaaccgcagccggttcctgtccagagtgtcaaggttcactttaccctagcaatcacgatcgcatgctcaccgccgtcaagaaaaaacctatggccagtctggatgggaaaggagacagttcatggacccttgcccgactataccaccccgatagcactgagctacagcccgcttccagcttgacaagcggatctccagaaagagcggaggctcaataccttctcgtatcaaacgggcatctgccgaaggcatgcgatgcaagccccgagtccactcccttgacgggccaattgcccggaaagcagcgagtgccgctcctgcttgccccaaaatcatag

SEQ ID NO: 228392 - DNA, 3213 bp, Artificial Sequence
  Description of Artificial Sequence: Synthetic coding sequence
atggcccgacccgtcagaggaggtctcggggctcctaggagaagtccctgcctgttgctcctctggctgcttctcctacggttggagcctgtgactgcagccgcaggccctcgcgctccttgtgccgctgcctgcacttgtgcgggtgattccctggattgtggaggtcgcggtttagccgcactgccaggtgatctgccaagttggacacgtagccttaacctcagctataacaaactgagcgagattgaccctgctggctttgaagatcttcctaatctgcaggaggtctatctgaataataatgagctgaccgccgtgccatccttgggcgctgcgagctctcatgttgtaagtctcttccttcagcacaacaaaattagatctgtcgagggatcacagctgaaggcctatctcagtctggaggtgcttgacctctctctcaacaatattactgaggttcgaaatacatgctttccccacgggccacccattaaagaactgaatctggctggcaacagaatcggcactctagaattgggtgcattcgatggtctgagccgatccctgctgacccttcgtctctcaaaaaatcggataacacagctgccagtccgggcattcaagcttcctcggttaacacaactggacctgaaccgcaataggatccggctcattgaggggctcacattccagggactcaattccctggaagtgctgaagctccagaggaataacatttccaaactgactgacggcgctttctggggtctcagcaagatgcacgtgctccatctggagtacaactccttggtcgaagttaattctggatcattgtacgggctgaccgccctgcaccaactacacctctctaataattctatagccaggatccaccggaaggggtggtctttttgccaaaagctgcacgaactggttctcagctttaataatctcactaggctcgacgaagaatccttggcagaactttcctcactttcggtgctccggctttcacataacagtattagccacattgctgaaggcgcatttaagggtcttaggtccttgcgagtccttgacctcgaccacaacgagataagtggaacgatcgaggatacttcaggggctttcagcggcttagactctctgtcaaaactgctgttgctcgagccatctcaaagcgccggttgctcttctccatcacagccccacatgtcagctggtggccgtacactgtttgggaacaagattaaatctgtggcgaaacgtgcattcagtggtttggaaggcttggaacatcttaatcttggtgggaatgccattcggtctgtgcagttcgatgccttcgtgaaaatgaaaaacctgaaggagctccatatctcctccgatagctttctttgcgattgtcaattaaagtggctacctccctggctgattgggcgaatgctacaagctttcgtgacagccacctgcgctcaccccgaatctctgaagggtcagtccatatttagcgttccgccagagtcctttgtatgcgatgacttcctgaaaccacagatcatcacacagccagaaaccacaatggcgatggtcgggaaggacatccgctttacgtgtagcgcagcttcttcctcaagcagtccaatgaccttcgcatggaagaaagataatgaggtgctgactaatgctgatatggaaaatttcgtgcatgtgcatgcccaggatggagaggtgatggagtacacaacaatcctccaccttagacaggtgaccttcggccacgaagggcgatatcagtgtgtcattaccaatcacttcgggtctacttacagccacaaggccagactcaccgttaacgtgttaccttcttttacaaagactccccacgatattactattcggaccaccactatggctagactggagtgcgctgcaacggggcatcccaacccgcagattgcctggcagaaggacggcggaacagattttcccgcagcgcagacgcctagccttgtggtgccactcgaagaccgggtcgtaagcgtgggcgagactgtcgctctacagtgcaaggcaaccggcaatccgcctcctagaataacatggttcaagggcgatcgccctctgtccttaacggaacgccatcacctgacacctgataaccaattgcttgtagtgcagaacgtggtcgccgaagatgccggtaggtacacctgcgaaatgtcaaacacacttggaaccgagagagcacacagtcagttaagtgtgctgcctgccgcaggctgtcggaaggacggtacaactgtcgggatattcactattgcagtggtttcaagcatcgttctgacgagcctcgtctgggtgtgtattatttatcagacccggaagaagagcgaagagtactcagttaccaatacagacgagaccgtggttccgccagatgtgccctcctacctctcaagtcaaggcaccctgagcgatcgacaggaaactgtcgtgcgaaccgaaggaggcccacaggccaatggccatatcgagagcaatggcgtttgccccagagacgcttcacacttcccagaaccagatacccattctgtggcatgccgccagcccaaactgtgcgctggctccgcttaccataaagagccatggaaggctatggaaaaagcagagggcaccccagggcctcataagatggagcacggcggacgcgtcgtgtgcagcgactgcaatactgaggtcgactgctactcgcgcggacaggctttccacccgcaacccgtttcacgcgacagtgcccaaccctctgcaccaaacggccctgaaccaggaggcagcgatcaggagcactctccccaccatcagtgcagtaggacagccgctggatcctgccctgaatgtcaaggtagcctttatcctagcaatcacgatcgcatgttgacagctgtgaaaaaaaaaccaatggcatcactggacggcaaaggagactcttcatggactctggcacgactgtatcacccagacagtacagaactgcaaccagcatcttccttgacctcagggagcccagagcgcgctgaagcccaatacctcctggtatcaaacgggcatctgcctaaggcctgtgacgcctctccagaatcaacaccgctcactgggcagctgccgggtaagcagagagtgccattacttctggccccaaagtcctag

SEQ ID NO: 228393 - DNA, 3198 bp, Artificial Sequence
  Description of Artificial Sequence: Synthetic coding sequence
atggccccagcaccactcggtgtgccagaagaacaactgcttgggtgcagaagcagagtgctttctagattattgttcatcgcacagaccgcactcctgctgctccctgctgctggcgctggcttgtgtccagccccatgttcatgtcgaatacccttacttgattgctcccgccgaaagcttccagctccaagctggcgggcacttagcgggctgctaccccctgacacagctatcctcgatttcagccacaataggctgtccaactggaacatctcactcgagtcccagaccctacaagaggtgaaaatgaattataacgagcttactgaaatcccttactttggagaacccacttcgaatattactctcctgtccctggtccacaatatcataccagagattaacgcccaagccctgcagttctatccggcattggaaagtctggacttgtcgagcaatatcatcagcgaaataaaaacgtctagcttccctagaatgcagctcaagtatctgaatctgtctaacaatcgtattacaacactggaagccggatgttttgacaaccttagcagctcactccttgtagtgaaactgaaccgaaaccggatgtccatgattcctccaaaaatttttaaactccctcacctccaattcctcgaactcaagagaaataggatcaaaatcgtagagggactcacatttcaggggctggactctctgcgctctctcaagatgcagcggaacggcattagcaagttgaaggatggcgcattttttggattaaacaacatggaggaactggaactagaacataataatctgacccgcgtgaacaaggggtggctgtatggactgagaatgctacagcagctgtacgtgagccaaaacgcgattgaaagaatctctcctgacgcatgggagttctgccaaaggctgtctgaactagacctgtcctacaatcagctgactcggctggacgaatcggcgtttgtagggcttagtctgctggaaaggctcaatctgggagataatcgcgtaactcacattgctgacggcgtgtttcgctttcttagtaacttgcagaccttagatctgagaaataacgagattagctgggctattgaggatgcatctgaagccttcgcaggactgacctccttgacgaagttaattctgcagggcaaccaaataaaatcgataacaaaaaaggcctttattggactggaaagtctggaacacctggatctcaataacaacgcaattatgtccatacaagaaaacgctttctcccagacgcatctcaaggaactcatccttaatacatcctctctgctctgcgactgtcaccttaaatggctgctgcagtggctcgtggacaacaatttccagcattcagtcaacgtaagctgtgcccacccagaatggctggctggtcagagtattctgaatgtggatctgaaggacttcgtgtgcgacgactttcttaagccacagattcgaacacacccggaaacaattatcgctctaagaggtatgaatgtcaccctgacttgtactgccgtgtcatcttccgactcacccatgtctacggtctggagaaaagactcagaaattctgtacgacgtggatactgaaaatttcgtgagatactggcagcaggctggtgaggcacttgagtataccagcatcctgcacctgttcaacgtcaactttacggatgaaggcaagtatcagtgtatcgtaaccaatcatttcggctcaaattacagtcagaaggcaaaactgactgtaaatgagatgccatcctttctcaagaccccgatggatcttacgattaggacaggtgctatggccaggttagaatgtgcagccgaaggtcaccctgcaccccagatatcctggcagaaagatgggggaaccgacttccccgctgccagagagaggaggatgcacgttatgccggaggacgacgtgtttttcatcgccaatgtgaaaattgaagatatgggaatctacagttgtatggcccagaacactgctggcggtttgtccgccaatgccagccttacggtcctcgaaaccccatccttcattaggccactcgaggacaaaacagtaacccgcggtgagactgcggttctgcagtgcatcgctggagggtcccctgcaccgaggctgaactggaccaaagatgacgggcctctcctggtgacagagaggcacttctttgcagctgcgaaccaactgctgattattgtggacgcgggactggaagacgccggtaaatacacctgcataatgtctaacactttggggacagagcgcggacacatttacctgaacgtcatctcatcaccaaattgtgacagtagccaatccagcataggtcacgaggacgacggttggaccacggtgggcatcgtgatcattgtggtggtgtgttgcgtcgtgggcacatccctgatttgggttatcgtcatttaccacatgagacgtaaaaacgaggactactctattacgaatacggaggaactgaatttacccgctgatatcccttcttacttatcctctcaggggaccttgagcgaaccccaggaaggttactctaattccgaagccggttcacatcagcagcttatgccccctgcgaacggatacatccacaagggtacagacggcggtaccgggacaagagttatttgtagcgattgttatgataatgcaaatatttactcaagaacaagggagtactgcccatatacctacatagcagaagaggatgtgctagaccagacgctgtctagtctgatggtacagatgcctaaggagacctacttagtgcacccccctcaggacaccaccgcactggaatcactcataccctcagccaatagagaaccttctgcctttccaaccaaccacgaacgaatatcagaaaaaaagctcccgtctacccaaatgagcggggaaactctccagcgtccagtgtggaacattaacagagaactgggccttcctcatcctccattttcccagcaaccggtccacgaatcaccgcaactccatcagaatgagggactggctggccgagagccagattgcagtgctagcagtatgtcatgccatcgtctgcaagaccacgcttttgacttctcccggactagaaacatccaggatggctccgaaggcacatag

SEQ ID NO: 228394 - DNA, 876 bp, Artificial Sequence
  Description of Artificial Sequence: Synthetic coding sequence
atggaaagtgagcggtcgaagcggatgggcaacgcatgcatcccactgaagagaattgcctacttcctatgcttgctgagtgccctgctcctgaccgaaggtaagaagcccgcaaagccgaagtgccccgcagtgtgtacgtgtacaaaggataacgcactatgtgagaatgcaaggagcatccctcgtacagtgccaccagacgtgatcagtctgtcctttgtccggagtgggtttacagaaattagtgagggatctttcctgttcacacctagtctgcagctgcttctcttcacatcaaattcttttgatgtaattagtgacgacgcattcatcggattaccccacctggagtatctattcatcgagaataataacatcaaatcaatcagtcgtcacacattccgcggactgaaaagcctgatacatctgtctttggcaaacaataatttgcagactcttccgaaagatatttttaaggggctggatagtctcaccaatgttgacctgaggggcaattctttcaactgcgattgtaaacttaaatggttagtcgaatggctggggcacaccaacgcgacagttgaggacatctactgtgagggaccgcctgagtataaaaaaagaaaaataaacagtctgtccagcaaggacttcgattgcataattacggagttcgccaagtcacaggacctgccataccagagtctgtccatcgatacttttagttacctgaatgatgaatatgtggtgatcgctcagcccttcaccggcaaatgtatattcctggaatgggatcacgtcgagaagactttccggaattacgataatatcacagtgctgcgggagattcaccgcttcacgaacatgtcatag

SEQ ID NO: 228395 - DNA, 1674 bp, Artificial Sequence
  Description of Artificial Sequence: Synthetic coding sequence
atggaaagcgagcgttctaagcgcatgggcaacgcttgtatcccactgaagcgaatagcgtattttttatgcctgttgagcgccctcctgttaacagagggcaaaaagcctgccaagcctaagtgcccagcagtttgtacttgcacgaaggataacgccctgtgcgagaacgccagaagtatccctcggaccgtccccccagacgtgatttccctttcctttgtgcgttctggcttcaccgagatcagtgaaggaagcttcctttttactccctcactgcaactgctgctttttacctcaaatagctttgacgtcatctcagatgatgcctttatcggattgccccacctagaatacctgtttattgaaaataacaacattaagtccatctctcgacacacctttcgcggtctgaaaagtctgatccacctcagcttggcgaataataacctgcagaccctgcctaaggacatattcaagggacttgacagcctgacgaacgtcgacctcaggggcaattcattcaattgcgattgtaaactgaaatggctggtggagtggctagggcacaccaatgccaccgttgaggatatctattgcgaaggtcctcccgaatataagaaaagaaagatcaatagtctttcctcaaaggattttgattgcatcattaccgaatttgctaagtcccaggatctgccctatcagtcactgtcaatcgatacattttcttatctcaatgatgaatatgttgtgatcgctcagccattcactggtaagtgcattttcctagagtgggaccatgtggagaaaaccttccggaattatgataatattacggggacaagcacagttgtgtgtaagccaattgtcatcgaaacccaactgtatgtgatcgtggcccagctcttcggaggatctcatatctataaacgtgattcctttgcaaacaaattcatcaagatacaggatatcgagattctgaaaatccgaaaacctaatgatatcgagacttttaagattgagaataactggtatttcgttgttgcggatagttctaaggccggatttacaactatatataaatggaatgggaatggcttctatagccaccagagcctgcatgcttggtacagggataccgacgtcgagtatctggagatcgtcaggacgccacagacacttcgtactcctcatttaatcctgagctcaagttctcagaggccagtgatctatcaatggaacaaggcgacccagttatttactaaccaaacagatattccaaatatggaggatgtgtatgccgtgaaacatttctctgtgaagggggatgtctatatttgtctaactcgattcattggtgactctaaagtaatgaaatggggtgggagttctttccaagatatccaacgcatgcccagccgaggttcaatggtgttccagcccctgcagatcaacaactaccagtacgccatcctggggtcagactactcatttacacaggtctacaactgggacgctgagaaggctaagttcgtaaagttccaggagctcaatgtgcaggcacctcgcagttttacacacgtttccatcaataaacggaattttttgttcgcttcctccttcaaagggaacacccaaatttacaagcatgttattgttgacctctcagcatag

SEQ ID NO: 228396 - DNA, 1530 bp, Artificial Sequence
  Description of Artificial Sequence: Synthetic coding sequence
atggaaagtgaaagatcaaagagaatggggaacgcgtgcatccccctaaagcgaatcgcttattttctctgtctgttatctgccctcctgctgaccgaaggtaagaagcccgcaaagcccaagtgccctgcagtgtgtacctgcaccaaggataatgccctatgcgagaacgctcgctcaatcccgcgaacagtgccacccgatgtcatatcattgtcatttgtgaggagcggttttaccgaaatctcagagggatctttcctttttacaccttccctccagctcctcagtctggctaacaataaccttcagacactgccaaaagacatctttaaggggctcgactcactcacaaatgtggaccttaggggaaacagctttaattgcgactgtaagctgaaatggctggtagaatggctgggacacacgaatgctacggtggaagatatctactgtgaggggccaccagagtacaaaaagcgcaaaatcaattcattatcctctaaggactttgactgtatcattacagagttcgccaagtctcaggatctaccatatcagtccctctcgatagataccttctcctatttaaacgatgaatacgtcgtgatagcccagcccttcacaggcaaatgtattttcctggagtgggaccatgtggagaagacatttcggaattacgacaatatcaccggcacgagcacagtggtctgcaagcctatcgtgattgaaacccagctgtacgtaatcgtcgcccagctgtttggtggcagtcacatttataaacgagatagctttgctaacaagttcataaagatccaggatatcgaaatcctcaaaattcgaaaaccaaacgacatagagacattcaagattgagaataactggtactttgtcgtggcagacagctctaaagccggatttacaacaatttacaagtggaacggtaacgggttctactcacaccagtcattgcacgcctggtatagagacacggatgtagaatatctagagatagtccgcaccccccagaccctccggacaccacacttgattctaagctcgtccagtcagaggcctgttatttatcagtggaacaaggccacccaattgtttacaaatcagaccgatatacctaacatggaggacgtatatgctgtgaagcatttttccgtaaagggtgatgtgtacatatgtttgacccgctttatcggcgattccaaggtcatgaaatggggcggttcttcattccaggatatccagcgcatgccttcaagaggatctatggtcttccagcctcttcagatcaacaactatcagtacgcaatccttggaagcgattactctttcacgcaggtgtacaattgggatgccgagaaggcaaagtttgtgaaattccaggagcttaacgtccaagccccaaggagcttcacgcatgttagcataaataaaagaaactttctgttcgcatctagcttcaaaggcaatacgcagatctacaaacacgtaatcgtcgacttatccgcctag

SEQ ID NO: 228397 - DNA, 777 bp, Artificial Sequence
  Description of Artificial Sequence: Synthetic coding sequence
atgtctgcctacccgaaaagctataaccccttcgacgacgatggcgaggatgagggagccaggccagccccatggcgagacgcacgcgatctgcccgacgggcctgatgctcctgcagaccggcagcaatacctccgtcaggaagtcctgcggagagcagaagccactgcagccagcacatcacggtcattggctttgatgtatgagagcgagaaggtcggcgttgctagtagtgaggagctagccaggcagcgcggagttctcgagagaacagaaaagatggtcgataagatggatcaggacttgaagatcagccagaagcatattaattctattaaatccgtctttgggggactggtcaactacttcaaatctaaaccagtggagacgcctcccgaacagaacggaaccctgacaagccaacccaacaacagattaaaggaggccatctccacatctaaagagcaggaggccaaataccaggcaagccatcctaatcttcgaaagctggacgataccgacccagtgccgaggggagcaggctccgccatgtcaactgacgcttacccaaagaatccacatcttagggcgtatcatcaaaaaatcgacagcaatctggacgagctcagtatgggccttggacgccttaaggatatcgccctgggcatgcagactgagattgaggagcaggatgacatcttggatcggctgaccacaaaagtagacaagttggatgtgaacattaagtctacggaacggaaagtaagacagctgtag

SEQ ID NO: 228398 - DNA, 2466 bp, Artificial Sequence
  Description of Artificial Sequence: Synthetic coding sequence
atggcaggcccagggtcaacgggcggtcagatcggagcggctgcgctggctggaggagctcgctctaaagtagcccctagtgtggatttcgaccactcatgctctgatagcgtcgaatatctcacactgaactttggaccttttgagacagtgcaccgctggagacgactccccccttgtgacgagttcgttggagcacggaggtcgaaacatacagtcgtggcctacaaagacgccatatatgtgtttggcggagacaacggtgcatttacaacaggaaccccccctgcccctcggtaccaccactccgccgtcgtgtacggatcctccatgtttgtattcggcggatacaccggcgacatttattcaaactcaaatctcaagaataaaaacgatctgttcgagtataagttcgccaccggacagtggactgagtggaaaatagagggccgattaccggtcgccaggtctgcacatggcgctacagtttattcagataagctttggatattcgccggatacgatggcaacgctcggttgaatgacatgtggactatcggattgcaggaccgcgagcttacatgttgggaggaagtcgctcagtctggggagattcccccatcttgctgtaacttccccgtggcagtgtgcagggataaaatgttcgtgttcagcggccaaagtggggctaagatcacaaacaacctttttcaattcgagtttaaggataaaacatggacccggattcccacagagcatctcttgagaggctctccacctccgcctcagcgtcggtatggccacacaatggttgcgtttgaccgccacctgtacgtatttggtggcgctgccgataacactctccctaacgaattacattgctatgatgtggatttccagacttgggaagtggtccaacccagctcggattcagaggttggaggcgcagaggtgccagagcgagcatgtgctagcgaggaggtgcccacgctcacttacgaggaacgggtcgggtttaaaaagtcgcgtgatgtctttggactcgattttggaacaaccagcgctaaacagccgacccaacctgcgtcggaactgcctagcgggagactgttccacgccgctgcagtcattagcgatgccatgtatatctttggagggaccgtggataacaacatacgttcgggcgagatgtaccggtttcagttttcatgctaccctaaatgcacactccacgaggattatgggagactttgggagtctagacagttctgtgacgttgagtttgtgctgggagagaaagaagagtgtgttcagggtcacgttgcaattgttactgcaagaagtcggtggctcaggcggaagatcacacaagcacgcgagaggctggctcagaaactggaacaggaggccgctcctgtgcccagggaggccccaggagtcgccgcaggtggggctcgccctcctctgttacatgttgccatccgggaagctgaggccaggccctttgaggtactgatgcaatttctgtacactgataagattaagtatccccgaaaaggccatgtagaggacgtgttactcatcatggacgtctacaagcttgcgctcagcttccagttgtgccgccttgagcagttgtgtcggcagtacatcgaggcctcggtagatttgcagaacgtgctagtggtgtgtgagagcgccgctcggctgcaattgagccagttgaaagagcactgtttgaacttcgtggttaaggagtcgcacttcaaccaggttatcatgatgaaagaatttgagcggctgtcttctccactgattgtggagatagttcggagaaaacagcaacctccgcctcgcacacctttggaccagcccgtggacatcggtacttcgttgatccaggatatgaaggcgtatctggaaggggctggggctgagttctgtgacatcaccctgttgctggatggtcatccgcgtcccgctcataaggctattttggcagcccgatcctcctacttcgaggctatgttccgaagctttatgcctgaggatggacaggtgaacataagcatcggagaaatggtgccttctcgacaagcatttgagagcatgctacgttacatttactatggggaagtgaacatgcctccagaagatagcctgtatctgttcgcagccccatattattatggcttctataataaccgactccaggcctactgcaaacagaatctggagatgaatgtgactgtgcaaaatgtactgcagattcttgaggctgcagataaaacccaggcgctggatatgaagcggcactgcttacatattattgtccaccagtttactaaagtgtccaagctcccaacactacggtcactcagccagcaactactcctggacattatcgacagcttggccagtcacatctccgacaagcaatgtgctgaactgggcgctgatatttag

SEQ ID NO: 228399 - DNA, 2400 bp, Artificial Sequence
  Description of Artificial Sequence: Synthetic coding sequence
atgaattacgaccccatcgtctccaaggtggcagaagtgctagcaagcggcagagccattcgcaagcgcgaggttgagaggagtaagcacactgttgtagcttataaggacgccatctatgtgtttggcggagacaatgggaaaacaatgctgaacgatcttctcaggttcgacgtaaaggactgcagctggtgccgggcatttaccacaggcactcctccggctccaagataccatcattctgcggtcgtatacggaagttctatgttcgtgttcggcggatatacgggagacatctatagcaacagcaacttgaaaaataagaacgatctgttcgagtataaattcgccactggacagtggacagagtggaaaattgaaggcaggttgccagtcgccagaagcgctcatggcgcaaccgtgtacagtgataagctgtggatcttcgcgggatatgatggcaacgctcgtctgaatgacatgtggacgatcggtctgcaagatcgtgaactcacgtgttgggaagaggttgctcaatctggtgagattcccccatcgtgttgtaacttcccagtggccgtctgccgagacaagatgttcgtgttctctggccagtcaggagccaagattaccaacaatctcttccaatttgagtttaaggacaaaacctggacacggattcccaccgagcacctgctgaggggtagtccaccccctccacagcggaggtatggacatacgatggtggcctttgacagacacctctatgtgtttggcggtgccgcagataacacactgcctaacgagctgcattgctacgatgtggatttccagacttgggaagtcgtccagccgtccagcgatagcgaggttggcggagcagaggtgccagagcgcgcatgcgcctccgaagaggttcctacgttaacctatgaggaaagggtcgggttcaagaaaagtagggatgtgttcggattagactttggcaccacgagcgccaaacaaccgacacagcccgcatccgaattaccctctggcagactcttccacgctgcggctgtgatctccgacgccatgtacatctttggagggactgtcgacaacaacattagatctggggagatgtatcgatttcagttcagctgctaccccaaatgtacccttcacgaggactacgggagattgtgggaatcccgtcagttttgtgatgttgagtttgtcctcggcgagaaagaggagtgcgtacagggtcacgtggcaatcgtcaccgctcgatctagatggctccggcgtaaaataactcaggcccgtgaaaggctggcacagaagctggagcaggaagccgcaccggtaccccgagaagcgcctggggtggcggcaggaggcgcacggccaccgctgcttcatgtcgctattcgagaggcggaagccaggcccttcgaggtgctgatgcagtttctctatacagacaaaattaagtatcctaggaagggtcacgtggaggacgtgctacttatcatggacgtatataaattagcactgtcattccagctgtgtcggctggagcagctttgccgccagtacattgaagccagcgtcgacttacaaaacgtgctggtcgtgtgcgaatccgctgcccgactccagctctctcagctgaaagaacattgcctgaactttgtggtgaaggagagtcattttaatcaagttattatgatgaaggagttcgagcggttgagtagtcctctgatcgtggagattgtgcgacgtaaacaacaaccacctccgaggacccctttggatcagccagtggacattggtacctcactgattcaggatatgaaggcctatttagagggcgctggcgctgaattttgtgacattacgctcctcttggacggacatcctaggccagctcataaggctatcctcgcggctaggtccagctattttgaagcgatgtttcggtcattcatgcccgaggacggccaggtaaacatcagtattggtgagatggtgccttcccggcaggccttcgagtctatgctccgatacatctattatggagaagttaacatgcctcccgaggacagcctctacctgttcgccgctccttattactacggcttctacaacaacagattgcaagcctactgcaaacagaaccttgagatgaatgtcactgtccagaatgttttacagatattagaagctgctgataaaacacaggcgctcgatatgaagaggcactgtctgcacatcattgtgcaccagtttacaaaagtgagcaagctgcccacgctgcgatctttgtctcagcagctcttactggacatcattgattcgctggcctctcacatctcagacaaacaatgtgcggagctgggggctgatatctag

SEQ ID NO: 228400 - DNA, 1560 bp, Artificial Sequence
  Description of Artificial Sequence: Synthetic coding sequence
atgtcttatccacagttcggctatccttatagttccgctccccagttcttgatggctacaaattcgctgtctacatgctgtgagagcgggggacggactcttgccgacagtggaccagctgcaagcgcccaggccccagtttactgccccgtttatgaatccaggctgcttgcaactgctcgccatgaactgaacagcgccgcagctctcggtgtgtatggcggaccctatggtggctcccaggggtatggcaactacgtcacatatggatctgaagccagcgcgttctattctctgaatagctttgacagtaaggatggaagcgggagcgcccatggtgggttggcgcctgccgcagcagcttactacccatacgagcccgctctgggccagtatccctatgaccgatacggcacaatggacagcgggactcggagaaaaaatgccacccgggagaccacgagtacactcaaagcatggctacaggaacacagaaagaacccgtaccccactaagggggagaaaattatgctggccatcatcacaaaaatgacactgacccaagtgtcaacctggttcgcaaatgccagaaggcgtctcaagaaggaaaacaaaatgacttggccgccacgtaataagtgtgcagacgagaaaaggccctacgctgaaggcgaggaggaggaaggaggagaggaggaagccagggaagagccacttaaatcatctaagaacgctgagcctgtaggaaaggaggaaaaggagttagaactttctgatctcgacgattttgaccctctcgaggctgaaccccctgcctgcgagctcaaacccccatttcactcactcgatgggggtctggagcgtgtcccagctgcacccgacggacctgtgaaagaagcatcaggcgctctacgcatgtcattggccgctggcggaggcgctgcgcttgatgaggacttggagcgcgcaagatcctgtttacgcagcgccgctgcaggtcctgaaccactcccaggtgctgagggaggtccgcaggtgtgcgaggccaagctgggctttgttccagccggtgctagcgccggattggaggctaagcctcgcatctggtctctcgctcacaccgctactgccgcagccgctgcagcaacgtcacttagccagaccgagttcccatcatgcatgcttaaacgtcaggggcctgctgccccagctgctgtctcatctgcgccagcaaccagcccttccgtcgctttaccccacagtggggctctcgataggcaccaggattcccctgttacttccttgaggaactgggtggatggtgtgtttcacgatcccatcttgcgccattccactttaaatcaggcatgggctacagccaaaggcgctcttttagaccctggccctttgggcaggtctttaggcgctggcgctaatgtcctcacggccccattggcaagggccttccctccggctgtcccccaggacgccccagctgccggagctgccagagaacttcttgccctgcctaaagcaggcggaaaaccattttgcgcatag

SEQ ID NO: 228401 - DNA, 3036 bp, Artificial Sequence
  Description of Artificial Sequence: Synthetic coding sequence
atgatcgagaacagcatgttcgaagaagagcccgatgtggtggatctggccaaggagccttgtttgcacccacttgaacccgatgaagtggaatatgaaccaagggggtcgcgactcctcgtgcggggactcggagaacacgagatggaagaggacgaagaggactacgagagctctgcaaagctactcgggatgtctttcatgaatcgctcctctggattacggaattcagccactgggtaccgacagagtcccgatggcgcttgctcagttccctcagcccgaaccatggtggtctgtgcctttgtaatcgtcgtggcggtttctgtgattatggtcatttacctgttgccgcgttgcacttttacaaaggaggggtgtcataagaagaaccaatcgatcggcttaattcagcccttcgctacaaatgggaaactatttccttgggcccagataaggctccctactgccgtagtgccacttcgttatgagctgtccctccatcccaacctgacctcgatgaccttcagaggctcggttactatatccgtgcaggcccttcaggtgacgtggaacataatactccatagtaccggccataatatttccagagtgacgttcatgagcgcagtttcctctcaggagaagcaggccgagattctggagtatgcatatcacgggcagatagcaattgttgcccctgaggctctacttgccggacacaactacacccttaaaatagaatatagcgcgaacatcagtagttcctactatggcttttatggcttctcttacactgacgaatcaaacgaaaaaaaatatttcgcggcaacgcagtttgagccattggccgctcggagcgctttcccctgctttgatgagccagcctttaaggccacattcatcattaaaatcataagggacgagcagtacacggccttgagcaacatgccaaaaaaaagcagtgtcgttcttgacgatggtctggtgcaggatgagtttagcgagtcagttaagatgagcacatacttagtagcatttatcgtgggcgagatgaaaaacctttcccaagatgtgaacggaacactcgtgagcatctacgctgtacctgaaaaaattggccaggtgcattatgcactggagactactgtgaaactacttgaattcttccagaactattttgagatccagtaccctctgaagaagttggaccttgtggccattcccgacttcgaagccggagccatggaaaattggggcctgcttacattccgggaggaaaccctgctgtacgacagtaatacatcttcaatggccgacaggaaactggtgaccaagatcatagcccacgagcttgcacatcaatggtttggaaaccttgtcaccatgaagtggtggaacgacttatggctgaatgagggcttcgccacatttatggaatatttcagcctggagaagatatttaaggagctgtcctcttacgaagactttctagacgctagatttaaaactatgaagaaagatagccttaacagcagccacccaatttcttcttccgtacagtcaagcgaacagatcgaagagatgtttgacagcctctcctacttcaaaggttcgtcacttttactcatgcttaaaacatatctgagcgaagacgtgtttcaacacgcagttgtcctttatcttcataaccatagctatgctagcatacagtcagatgatctctgggatagcttcaatgaagtgacgaatcaaacactggacgtaaaacgaatgatgaagacatggacactccaaaagggattccccttggtgacagttcagaagaaggggaaggaactctttatacagcaggaaaggtttttcttaaatatgaagccagaaatacaaccgagcgacacgagttacttgtggcatatcccacttagctacgtgacagagggcagaaactactctaagtaccagagcgtcagtcttctcgataaaaagagtggcgtgattaacctgaccgaggaagtgctgtgggtgaaggttaatattaacatgaatggctattatatagtccattacgcggacgatgattgggaagctctcatccatcagttgaagataaatccatacgtattgagcgacaaggaccgggcaaatcttattaacaacatattcgaactagctgggctgggtaaggttcccctgaagcgggcattcgatctgattaattatttaggcaatgagaaccatacagccccaatcaccgaggccctgttccaaaccgacttaatatataacctcctcgagaaacttggatacatggacctcgcctctaggctggtaacccgtgtgttcaagcttctccagaaccaaatacagcagcagacctggaccgacgaaggtaccccatctatgagagaactgaggagcgctctcctcgagtttgcttgtacgcacaacctggggaattgtagtaccactgccatgaaactctttgacgactggatggcttctaatggaacccagtccctgcccaccgacgtaatgacgaccgtgttcaaagtgggggcaaagacagacaagggttggtcgtttttactggggaaatacatttcgatcggttctgaagccgagaaaaataagatccttgaggccctagcgagctctgaagacgtccggaagttgtactggctgatgaagagtagccttaatggggacaatttccgtacccagaaactgagcttcataattcggaccgtgggcaggcactttccaggtcatctgctggcatgggactttgttaaggaaaactggaacaaacttgtacagaagttccctctgggctcgtacaccattcagaatatcgtggccggaagcacatacctgtttagtaccaaaacccacctgtctgaggtacaggccttttttgagaatcagtccgaggctacgtttcgactgcgatgcgtgcaagaagctctggaggttatacaattgaacatacagtggatggagaaaaacctgaaatccctgacatggtggctctag

SEQ ID NO: 228402 - DNA, 3450 bp, Artificial Sequence
  Description of Artificial Sequence: Synthetic coding sequence
atggctgagcgtaagggtaccgcaaaagttgatttcctgaagaaaatcgaaaaagaaattcagcagaaatgggatacagaaagagtattcgaggtcaacgcaagtaatcttgagaaacagactagcaaagggaagtacttcgtcacctttccttacccttacatgaacggcagactccacctggggcacactttcagtctctctaaatgcgaggcttgtgccgataaactcaagcgggaaattgaactctacggatgccctcctgacttccctgatgaggaggaggaagaggaggaaactagtgtcaaaactgaagacataataatcaaagacaaagcaaaggggaagaagagcaaagctgctgctaaggctggtagtagtaaataccagtggggcataatgaaaagcctgggccttagcgacgaggagattgtgaagtttagtgaggctgaacactggctggactacttcccgcctctggccatccaggacctgaaaagaatgggcctgaaggtggattggcgccgtagctttatcaccaccgacgtgaatccttactacgactcctttgtgagatggcaattcttaacgctccgggagcggaataagatcaaatttggcaagaggtacaccatttatagccccaaggacgggcagccgtgcatggatcacgatcgacaaacaggcgagggagtagggccacaagaatacactctgttgaagctgaaggtgttggaaccgtacccgtcgaagttgtccggtctcaaagggaagaatattttcttagttgccgctaccctgcgacctgaaaccatgttcgggcagacgaactgctgggtgagaccagacatgaagtacataggattcgagacggtcaacggagatatcttcatttgcacccagaaagcggctcggaatatgagttaccagggcttcacgaaggacaacggtgtcgtaccagttgtgaaagagcttatgggggaggaaatcctcggagctagtttatctgccccactcacaagttataaggtcatctatgttctgcctatgctgacgatcaaggaggacaaggggaccggtgtggtgacttctgtaccatcagacagtcccgatgatattgccgctctccgtgatctgaagaagaagcaggctctaagagctaaatacggtattcgcgatgatatggtgctccctttcgagccggtacccgtgattgagatacctggattcggcaacctgagcgccgtgaccatatgcgatgagttgaaaattcagagccaaaatgacagggagaaattggccgaagccaaagagaagatttacctgaaaggattctatgagggcattatgctggtcgacgggttcaaaggccaaaaggtgcaggacgtcaaaaagactatacagaagaagatgatcgacgccggagatgccctcatctacatggagcccgagaagcaggttatgtctaggagttctgatgagtgcgttgtggcactgtgcgaccagtggtacctggactatggcgaggagaactggaagaagcagacaagccagtgtctcaaaaatctggaaacattctgtgaagagaccaggcgcaacttcgaggccactctcggttggctccaggagcacgcctgcagcagaacatatggactaggtactcatctgccatgggacgagcagtggctgattgaaagcctgagcgattccactatctacatggccttttataccgtagcgcacctgctgcaagggggaaacctgcacgggcaggctgagagcccactgggcatccgccctcagcagatgactaaagaggtgtgggactacgtgttctttaaggaagcccctttccccaaaacacagatcgccaaggagaaactcgatcaactgaaacaggagttcgaattttggtatcctgtagacttgagggtttctgggaaagacctagttcctaatcatctgtcttactacctatacaaccatgtagcaatgtggcctgaacagagtgacaagtggccaacagctgttagggccaacggacatctgctgctcaacagcgaaaaaatgtccaagagcaccggtaattttctgacgctgacacaagccatcgacaaattctcagccgacgggatgcggctggccctcgctgacgccggtgacaccgtggaagatgccaacttcgtcgaggctatggccgacgcgggaatcctaaggctctacacttgggtggaatgggtaaaggagatggtggcaaactgggattccctgagatctggccctgcttctacatttaacgatcgggtgttcgcctccgaattgaacgccggaattatcaaaacggatcagaactacgagaagatgatgtttaaagaggcccttaagaccggatttttcgaattccaagctgcaaaagacaaataccgcgagctcgctgtggaaggcatgcaccgtgaattggttttccgctttatcgaagttcagactctgctgctggccccattttgtccccacctttgcgagcatatctggactctgctaggaaaaccggatagcatcatgaacgcgagctggcccgtggcgggacccgtgaatgaagtgctgatacactcatcacagtatctgatggaagtcactcatgatttgaggcttaggcttaaaaattacatgatgcctgccaaaggtaaaaaaaccgacaagcagccgctccagaagccaagtcactgtactatttatgtggccaagaactaccctccttggcaacacacaacactgtctgtccttaggaagcacttcgaggcgaacaacgggaaattgcccgacaataaggtgatcgcatcggagctggggagcatgcccgagctgaaaaagtacatgaaaaaggtgatgcccttcgtagccatgataaaagaaaatctggagaaaatggggccacgaatcctagacttgcagctggagtttgatgagaaagcggttctcatggagaatatcgtctacctgacaaatagtcttgagctcgagcatattgaagtgaagtttgcatccgaagccgaggataagatccgggaggattgctgtcctggaaaaccattgaacgtattcagaatcgaaccaggggtgtcagtgagcttggtgaaccctcagccatcaaacggtcatttttctacaaagatcgagatccggcagggtgataactgcgactccatcattcggaggcttatgaaaatgaaccgcggtatcaaagacctgagcaaagtgaagctcatgcggtttgacgatcccttgcttgggcctaggcgcgttcccgtgctcggaaaggaatatacagagaagaccccaatcagtgaacacgctgtgttcaacgtcgacttaatgtccaagaagattcatctcaccgagaacggtatcagagtggacataggggacacaattatctacctggtgcactag

SEQ ID NO: 228403 - DNA, 480 bp, Artificial Sequence
  Description of Artificial Sequence: Synthetic coding sequence
atggcagaacgaaagggtacagccaaggtggactttctcaaaaagattgagaaggagattcagcagaaatgggatacggagagggtatttgaagtcaatgcctcgaatcttgagaagcagacatctaaaggaaagtactttgtcacctttccctacccgtatatgaacggcaggttgcatctgggccatactttctcactgtctaaatgcgaatttgccgtgggctatcagcggttaaagggtaagtgttgtctcttcccttttggactgcactgcaccggaatgccaatcaaggcttgcgccgacaagctcaagagagaaattgaattgtacggatgccccccagattttcctgacgaggaggaagaggaagaggagacttcagtgaagacggaggatatcatcatcaaggacaaagctaagggtaagaaatcaaaggccgctaaactggacctgctgaatacatctggagcactgtag

SEQ ID NO: 228404 - DNA, 3531 bp, Artificial Sequence
  Description of Artificial Sequence: Synthetic coding sequence
atggccgagcggaagggtactgccaaggtcgatttcctaaagaaaattgagaaggagatccagcagaagtgggatactgagagggtgttcgaggttaatgcttcgaacttggagaagcagacatctaagggtaaatactttgtaacattcccttacccatatatgaatggcaggctgcacctggggcacaccttttccctttcaaaatgtgaatttgctgtggggtaccaacgcctcaagggaaaatgttgccttttcccttttggcctgcattgcaccgggatgcctatcaaggcctgcgctgacaaacttaaacgagagattgagttatacggctgtccccctgattttcctgacgaagaggaagaagaggaggagacgagcgtgaaaacagaggacatcatcattaaagacaaggcaaagggaaaaaagagcaaggcagcagcaaaggcaggtagctctaagtatcagtggggtatcatgaagtctcttggcctctctgacgaagaaattgtaaagttcagcgaggctgaacattggttagattacttccctcctcttgccatccaagatctaaagcggatgggactgaaggtcgactggcggcgtagttttattacaacggacgtgaacccctactacgactcctttgtgcggtggcagttcctgactctacgagaacggaataaaatcaagtttggcaagcggtacacaatctatagccctaaggacggccagccttgtatggaccacgataggcagaccggggaaggcgtaggtcctcaggagtatacccttttaaagttgaaagtgctggagccctacccttccaaactcagcggacttaaggggaagaacatttttctcgtcgccgcaaccctgaggcctgagaccatgtttggacagacgaactgttgggtacggcctgacatgaaatacataggcttcgaaactgtgaacggggacatatttatatgtactcagaaagctgctcgcaatatgtcttatcagggctttacaaaggataacggggtagtcccagtcgtcaaggagctgatgggtgaggagatcctcggagcctctctgtcagcgccattgacttcttataaagtcatctatgtcttaccaatgctgacaataaaggaagacaagggaaccggtgtcgttacttcagtgccctctgattctcctgatgatattgcagctctccgcgacctcaagaaaaagcaggccctgagggcaaaatacggcatccgggatgatatggtacttccctttgaaccagtgccagttatcgagatcccagggttcgggaatttgtctgctgttactatatgcgatgagttgaaaatacagtcacagaacgatcgcgagaagctggcagaggccaaagagaagatatacttaaaaggcttttatgaaggcattatgttggtggatggttttaagggacagaaggttcaggacgtaaagaagaccattcaaaagaaaatgatcgacgctggcgatgcactcatctatatggaacccgaaaagcaagtgatgagcaggagttcagatgagtgtgttgtcgctctgtgcgatcagtggtacttagactatggtgaagagaactggaaaaagcagacatcgcaatgcctaaaaaatctcgaaactttttgcgaagaaaccaggcgaaactttgaagcgaccctcgggtggcttcaagaacacgcctgttcacgaacctatggattaggaacccaccttccatgggacgagcaatggctgatcgagtcactgtcggactccacaatctacatggccttttatactgtagctcacctgctccagggcggtaacctacatggtcaagccgagtctcccctaggcatcaggccccagcaaatgacgaaagaggtgtgggattacgtcttttttaaagaagcacccttcccaaagacacagattgccaaggagaagctggaccagcttaagcaggaatttgagttctggtacccagtggacctgagggttagcggaaaagacttggtcccgaaccatcttagctactacctctacaatcatgtggctatgtggcctgaacaaagtgataagtggccgactgccgtgcgcgctaatgggcatttactgctcaattcagaaaaaatgagcaagtcaaccggtaacttcctgacccttacccaagccatcgataagttttctgccgatgggatgagattagccctggccgacgctggcgacaccgttgaggatgctaatttcgtggaggccatggcggacgcaggaattctgcggctgtacacatgggtggaatgggtgaaagaaatggtcgccaactgggactctttacgctccggaccggcaagtaccttcaatgatcgagtgtttgcctccgagttgaacgccggtataataaaaacagaccagaactacgaaaagatgatgttcaaagaggcgctgaagactggcttctttgagttccaggctgcgaaggacaagtacagagagctggctgtagagggcatgcatcgagagctggtgtttcgctttatagaggtgcagaccctattactggcacctttctgtccccatctctgtgagcacatctggacactcctggggaaacccgactctataatgaacgcctcgtggcccgtggcgggacccgttaacgaggtcttgatccacagctcccagtatcttatggaggtgacccatgatctgagacttagactgaaaaattatatgatgcccgctaagggcaaaaaaaccgacaagcagccgctccaaaaaccctctcactgcactatctacgtggctaaaaactacccaccgtggcagcatactacacttagtgtcttgaggaagcacttcgaggcaaacaacggaaaactgcccgataacaaggttattgcctcagagttgggctccatgccagaactgaagaaatacatgaaaaaggtgatgccttttgtcgcgatgataaaggaaaatctcgaaaagatgggccctaggattttggatctccagttagagtttgacgagaaggccgtgctgatggaaaacatcgtatatctcaccaacagtctggaactggagcacatagaggtaaagttcgcttccgaagcagaggataagatccgagaggattgctgtcctggtaagccattgaacgtgtttaggattgagcccggagtctccgtttccctcgttaacccacagccctctaacggccacttctctactaagatagagatcaggcaaggagataattgcgactcgatcattcgcaggctgatgaaaatgaatcggggtattaaggacctgtctaaagtcaaattgatgaggttcgacgatcccttgctcggcccacgaagggtgccagtgcttggcaaggagtataccgagaaaacgcccataagcgagcacgctgtgtttaacgtagatctgatgtcgaagaaaatccatctgaccgaaaatggtattcgcgtggacataggagataccattatctacttagtgcactag

SEQ ID NO: 228405 - DNA, 3369 bp, Artificial Sequence
  Description of Artificial Sequence: Synthetic coding sequence
atgaacggacggctacatctcggtcacacatttagcctgagcaagtgcgagttcgcagtgggctatcagcggctcaaggggaaatgttgtctttttccattcgggctccattgtactggaatgccaattaaggcctgcgctgataaattgaagagagagattgaactttatggatgccccccagactttcccgacgaggaggaggaggaggaggaaacaagcgtgaagaccgaggatattatcataaaggacaaggcaaaggggaaaaagtctaaggccgctgccaaggccggtagctccaagtatcagtggggaattatgaaaagtctggggctgtcagatgaagagattgtcaagttttccgaggccgagcattggctggactactttccaccgctggcaatccaggatctcaagcgaatgggattgaaggtggattggagacggtctttcatcactactgacgtgaacccatattacgacagcttcgtccgctggcagttcttgactctccgtgagcggaacaaaatcaaattcggaaagagatataccatctacagtcccaaagacgggcagccatgcatggatcatgaccggcaaaccggagaaggggtcggaccccaagagtacactctcttgaagttgaaggttctggagccttacccctctaagttaagcggcctgaaaggcaagaatatctttttagtggctgcaaccctgagaccagaaacgatgtttgggcaaactaactgttgggtgagacccgatatgaaatacatcggatttgagaccgtgaatggagatatttttatttgtactcagaaagccgctaggaacatgagctaccaagggttcaccaaggataatggcgtggtcccggttgtcaaggagctgatgggggaggagatcttaggtgcctccctaagcgccccactcactagttataaagtgatttatgttttgcctatgttaaccattaaagaggataaaggcacaggcgtggtaacttctgttccctcagattctccagatgacatagctgctctgcgagacctaaagaaaaagcaggcgctgcgggcaaaatacgggatcagggacgatatggtgctcccttttgagcccgtgcccgtgatcgaaattcccggattcgggaacctgagtgccgtcaccatctgcgacgaactaaagattcaatcacagaacgaccgggagaagctagctgaggctaaagagaagatctatttgaagggcttctacgaaggtattatgttagtggacggatttaaaggtcagaaggtccaggatgttaagaagacgatacagaagaagatgatagatgctggcgatgccctgatctacatggaaccagaaaaacaagtcatgagcagatccagtgacgaatgcgtggtagccttatgcgatcaatggtacctagactatggggaggaaaactggaagaaacagacatctcagtgccttaagaacttggagaccttttgcgaagaaaccagacgcaactttgaggcgaccctcggctggctgcaggaacatgcctgctccagaacatatggcttaggtactcatctgccatgggatgagcagtggcttatcgagtccctatcagactccaccatatacatggctttttataccgtcgcccacctcctgcagggcggaaacctccatgggcaggctgagtccccactcggaatccgaccacaacagatgaccaaggaagtttgggattacgtgtttttcaaagaggcccctttccccaaaacacagatagccaaggagaaactcgaccaattgaagcaggagtttgagttttggtatccagtcgacctgagagtctccgggaaggatctggtccccaaccatctgtcctactacctttataatcacgtggcgatgtggcccgagcaatcagacaagtggccaacggctgtgagagccaacgggcacctcctgcttaactctgagaaaatgtccaagtccaccggcaacttcctgaccctgactcaggccatcgacaagttctccgccgatggtatgcgattagctctggccgatgccggagacactgtagaagatgcgaactttgtggaagcgatggcggacgccggtattctccggttgtatacatgggtagaatgggttaaggaaatggttgcaaactgggactccctgcgctccgggccagcctccactttcaatgaccgggtgttcgcgagtgagctcaatgcgggaatcataaaaacagaccagaactatgagaagatgatgttcaaggaagccctgaagacaggcttctttgaattccaggctgctaaagacaaatacagggagctggccgttgagggtatgcacagagaactggtgttccgttttatcgaagttcaaactctgctcctggcccctttctgcccccatctttgtgagcacatctggacgttgcttggaaaacctgatagcatcatgaatgccagctggccagttgctgggccagtgaatgaggttcttatccacagcagccagtacctgatggaggtaacacacgacctgcgcctccgactcaaaaactacatgatgcccgctaagggcaaaaaaaccgacaagcagcctttgcagaaaccgagccattgtaccatatacgtagccaaaaactatccaccatggcagcatactaccctgtctgtattgcgcaagcattttgaggcaaacaacggcaaacttcccgataataaggtgattgcgtcagaactgggcagtatgcctgagttgaagaagtatatgaaaaaagtaatgcccttcgtggccatgattaaggagaatctcgagaaaatggggcctcggatcctggaccttcagttggagttcgacgagaaggccgttttgatggaaaatatcgtatatctcaccaacagcttggagcttgagcacatcgaagtaaagtttgcgtctgaagctgaagacaagattagagaggattgttgtcccggtaagccactaaatgttttcaggattgagcctggtgtgagcgtgagtctagtcaacccccagcccagcaatggccatttcagtactaaaattgaaatccgccagggagacaactgtgactccatcatccgcagactaatgaagatgaaccgcggaatcaaagacctctctaaggtgaagctgatgcggttcgatgatccactgcttggtcctaggagagtgccagttctcggcaaggagtataccgaaaaaacgcctatctctgaacacgctgtatttaatgtcgaccttatgtctaaaaaaatccacctgacggaaaatggtatcagggtggacatcggcgatactattatttatcttgtgcactag

SEQ ID NO: 228406 - DNA, 372 bp, Artificial Sequence
  Description of Artificial Sequence: Synthetic coding sequence
atgtggcccgagcagtctgataaatggcctacagcggtgcgggctaatgggcacttattgctcaactccgaaaagatgtcaaagtcaaccggcaacttcctaacgctaacgcaagctatagacaagttcagcgctgacggaatgagactggccctcgcagatgccggagacaccgtagaggacgcaaattttgtggaggctatggccgacgcaggaatcctccgtctctatacttgggtggagtgggtcaaggaaatggttgcaaattgggatagtttaagatccggtcccgctagcaccttcaacgacagagttttcgcgagcgagttgaatgcaggcatcatcaagacggaccagaccatgaaacggtag

SEQ ID NO: 228407 - DNA, 1458 bp, Artificial Sequence
  Description of Artificial Sequence: Synthetic coding sequence
atgtggccggaacagtcagacaagtggccaaccgctgtgcgagcaaatggtcacttgctcctgaatagcgaaaagatgagcaagtccaccgggaatttcctaacactgactcaggctatcgataagtttagcgcagacggcatgcggctggctctcgccgatgcaggagacactgttgaggacgctaactttgtggaggccatggctgatgcagggattctgcgactgtatacttgggttgagtgggtgaaggagatggtggccaactgggattctctacgtagcggacctgcatcaacctttaacgatcgtgtatttgcttcagagcttaacgccggaattatcaagacggaccagaactacgagaaaatgatgtttaaagaagctctgaagacgggattcttcgaatttcaagccgctaaagataagtatcgtgagttagctgtggagggaatgcatagggaattggtgttcagatttattgaagtacagacccttctgctggcacccttctgtcctcatctttgcgaacacatctggacactgctggggaagcccgacagcatcatgaatgcgtcatggccagtggcaggtcctgtcaacgaggtgctcatccactctagtcagtatctgatggaagtgacacatgacctgcgcctcagactgaaaaactacatgatgccagccaaaggcaagaagaccgacaagcagcccctccagaagccctcacactgtacaatttatgtggccaagaattaccctccctggcagcatactacacttagcgtactgcgcaagcacttcgaagccaacaatggtaagctgccagataataaggtaatagcttccgaacttggcagtatgccggagctgaaaaaatatatgaaaaaggtgatgcctttcgtggcgatgattaaagagaacctggagaagatggggcctcggattctggatctgcagttggagttcgacgagaaggccgtgttaatggaaaatatcgtttacttaaccaactcgctggaactggagcatatcgaagtgaagtttgctagtgaagcggaggataaaatccgggaagattgctgtcctggcaaacctttgaatgtcttccgcatcgaaccaggcgtcagtgttagcttagtcaacccccaaccctctaacgggcacttttctacgaaaatcgaaatccgtcaaggcgacaattgtgattctatcatcagacgtttaatgaagatgaacagaggtatcaaggacttgtcaaaggttaaactcatgcgattcgacgaccccttgttgggacctcgcagagtccccgttcttgggaaagagtatactgaaaaaacacctatatcagaacatgcggtcttcaacgtcgacctcatgagcaagaagatacacctgaccgaaaatgggatccgggtggacattggggataccataatctacctggtgcattag

SEQ ID NO: 228408 - DNA, 3393 bp, Artificial Sequence
  Description of Artificial Sequence: Synthetic coding sequence
atggctgagagaaagggcacggcaaaagtggacttcctaaaaaaaatcgaaaaggagattcagcagaagtgggacaccgaaagagttttcgaggtaaacgcctctaatctggagaagcagacttctaagggaaagtatttcgtgacgttcccctacccatacatgaacggacggctgcatttaggtcacaccttctctctgagcaagtgtgaatttgccgttggttatcagcggttgaaagggaagtgctgcctttttccctttgggctccactgcacggggatgccaatcaaaagcaaagcagcagcaaaggcaggctcttccaagtaccagtggggtattatgaagtccctcggactgtctgatgaagagatcgtcaaattctcagaggcagagcactggcttgattactttcctcctctcgccatccaggacctaaagcgtatgggtctgaaggtagactggcgaagatccttcattacaaccgacgtaaatccatattacgactctttcgtgcgttggcagttccttactctgcgggagcggaacaagattaagttcggcaagcgctatacaatctactccccgaaggatggccaaccttgtatggatcatgatagacagacgggggaaggggtcggtccacaggaatataccctcctgaagcttaaagtgcttgaaccatatccgtccaagttgtccggcctgaaaggcaaaaatattttcctggtggccgcaacgttacgtccagaaactatgttcggacagacaaactgctgggtgcggccagacatgaaatacatagggtttgaaacagtgaatggtgatatattcatctgcacacagaaggccgcacggaacatgagttaccagggctttactaaggataatggggtggtgcctgtcgtgaaggagctgatgggagaggagatcctgggagcatcacttagtgctccactgacaagctacaaggttatctacgtcctgcccatgctgactatcaaggaggacaaaggcaccggggtagtcacaagtgtgccgtcagattccccagatgacattgcagccctgcgggacctcaagaagaaacaggcgctgcgagctaagtatggcatccgggacgacatggtgctgccatttgaaccagtcccggtgattgaaattcctggctttggcaacctgtctgctgtgactatttgcgacgaactcaaaatccaaagtcagaatgaccgggagaagctggccgaagccaaggaaaagatctatttgaaaggattttatgaaggtattatgctggttgatggttttaagggtcagaaagtccaggacgtgaagaagacaattcagaagaaaatgattgatgccggtgacgccctgatatacatggaaccagagaagcaggttatgtcaagatcttccgatgagtgtgtcgtcgccctatgcgatcagtggtatctggactatggcgaagaaaactggaagaagcagacaagccagtgcctgaagaatcttgaaacattttgcgaggagaccaggcgcaacttcgaagcaaccctgggctggctacaggagcacgcttgttcccgaacttacggccttgggactcacctgccttgggacgagcagtggctgatagaaagtctttcagattctaccatatatatggctttctatacagtcgcccacttacttcagggcggtaatctgcacgggcaggccgaatcacctttgggtatcaggcctcagcagatgacaaaagaggtgtgggactacgtgttctttaaggaagccccttttcccaagacacaaattgccaaggagaagcttgatcaacttaagcaagaattcgagttttggtaccctgtggatttgcgagtctccgggaaggacttggtccctaaccatctgagctattatctgtataatcacgtggccatgtggcccgagcaaagcgacaaatggccaacagccgtacgtgctaacggtcaccttcttctgaacagcgaaaaaatgtctaaatcgactgggaattttctcaccctgacgcaggcaatcgataagttcagcgccgatggcatgaggcttgctctggccgacgccggagatactgtagaggatgccaactttgtggaagcaatggcagatgctgggattcttagactgtatacgtgggtggaatgggtcaaggagatggtggcaaattgggactccttgcgttctgggcctgcctctacctttaacgacagagtgtttgcctccgaattgaatgccggaatcattaagacagaccagaattatgagaaaatgatgttcaaggaggctctgaagacggggtttttcgagtttcaggcagctaaggataagtatcgggaattggccgttgagggaatgcatagagagcttgtctttcgtttcatcgaggtccagactctcctgctggctcctttctgtccacatctttgtgagcatatttggaccctgctaggtaagcctgattcaattatgaacgcatcttggcctgtggcaggccctgtgaatgaagtccttattcattctagtcaatatctgatggaggtaacacacgacctcagacttagactgaagaactacatgatgcctgccaagggtaaaaagaccgacaaacagcccttacagaaaccaagccactgtacaatttatgtggcgaagaactaccctccctggcagcacacaaccctgtcagtcctgaggaagcacttcgaagcgaacaacggaaagctccctgacaacaaagtgatcgccagcgagcttgggtccatgcccgaactgaagaagtatatgaagaaggttatgcccttcgtcgccatgatcaaagagaaccttgaaaagatgggtccgagaatcctcgacctccaactagaattcgatgaaaaggctgtgctgatggagaatatagtgtaccttacaaactctctggaactagaacacatagaagtgaaatttgccagcgaagcagaggacaagatccgggaagattgttgtccgggtaagccactgaatgtgtttcgaattgagcctggggtctccgtgtcccttgttaatccacagccttctaatggccatttttctaccaaaatcgaaatcaggcagggggacaattgcgactcaatcatccgacgtctgatgaaaatgaataggggcattaaagacctgtccaaagttaagctcatgagatttgatgatcccttactgggccctagaagggtgcccgtcctgggcaaagagtacaccgagaaaactcctatctcagaacacgcagtgtttaacgtggatctgatgtctaagaaaatccaccttactgaaaacggcatccgagtggacataggcgacaccattatttacctggtgcactag

SEQ ID NO: 228409 - DNA, 2712 bp, Artificial Sequence
  Description of Artificial Sequence: Synthetic coding sequence
atggcgtcagtgtggcaacggctaggtttctacgcttccctcctgaagaggcagttaaacggcggtcctgacgtcataaaatgggagcggagggtcatccctgggtgcacacgttccatatacagcgccaccggaaagtggaccaaagagtacacgctgcaaaccaggaaggatgtggagaagtggtggcatcagcgcattaaggaacaggcctccaaaatctccgaagctgacaaatcaaagcccaagttttacgttctctctatgttcccctatcccagcgggaaactacacatgggccacgttagggtatatacgatctctgataccatcgctagatttcagaaaatgcggggtatgcaagtaatcaatcctatgggatgggacgccttcggcctgccagcagaaaatgccgctgtcgaaagaaatctccacccccagtcctggacacagagcaacatcaaacatatgcggaaacagttagaccggttaggactgtgtttcagttgggatagagaaattaccacttgtctccccgactattacaaatggacacaatatctgtttataaagctttatgaagccggactagcttaccagaaagaggctcttgtgaactgggatcccgttgatcagacagtgctggcaaacgagcaagtggatgagcacggctgcagctggcggagcggcgctaaagtcgaacagaaatatctccgccagtggttcattaagaccacggcttacgcaaaggccatgcaggacgcgttggcggacctccctgaatggtacgggataaaaggcatgcaggcccactggattggcgattgtgtaggctgccatcttgacttcacgcttaaggtgcatgggcaggctaccggagagaaactgacagcctacaccgcaacccctgaggcaatctacggaacctctcacgtggcgatctcaccttcacataggctgcttcacgggcactcctccctgaaggaagcccttcggatggcgttggtgccgggtaaagattgcctgacccctgtgatggccgttaacatgctcacccagcaggaagtgcccgtcgttattctggcgaaagccgacctcgagggctcattggatagcaaaattggcattccttctacttccagcgaagacaccatcctggcacagaccctgggacttgcctacagcgaagtgatcgaaacattacccgacggcaccgaacggctgtcctcttcagctgaattcaccgggatgaccaggcaggatgcctttctggccttgacacagaaggctcgcggtaagcgtgtgggtggcgacgtaacaagtgacaaactaaaggactggctgatcagccgacagcgatactgggggactccaattcccatcgtgcattgtcccgtgtgtgggccaacccccgtgcctctggaggacctcccagttacactcccaaacatcgcttcatttacaggtaaaggtggcccacccttagctatggcatccgagtgggtgaattgtagttgcccccgttgcaagggggctgcgaagcgcgaaacagataccatggacaccttcgttgactctgcctggtactactttagatacaccgacccacacaatccgcatagcccattcaatactgctgtggcggattattggatgccagtggatctgtatattggaggtaaagaacatgccgtgatgcatttgttctacgcacgatttttctcgcacttctgccacgatcagaagatggtcaaacatcgcgaaccgttccataagctcctcgctcagggtctcatcaaaggacagaccttcagactcccttccgggcaatacctgcagcgagaagaggtagacctgacaggaagcgtacccgtgcacgccaagacaaaagagaagcttgaagttacctgggaaaaaatgagtaagtctaagcataacggcgtggaccccgaagaagtggtggaacagtacggaattgatacgatacggctgtatatcctttttgcagcaccccctgagaaggatattctgtgggatgtgaagacagacgcattaccaggagtcctgcggtggcagcagcggctttggacactaacgacgcgctttatcgaggctcgagcaagcgggaaaagtccacagccccagctgctctccaataaggagaaagccgaggctagaaaactctgggaatataagaatagcgtcatttctcaggtgactacgcactttactgaggatttcagcctcaattcagctattagtcagttgatgggcctctccaatgccctgtcccaggcgtcccaatccgtgatcctgcatagtccggagtttgaagatgcactttgcgcccttatggtcatggccgcacccctggctccacacgtgacctccgaaatctgggcaggacttgcgcttgtcccgaggaaactgtgcgcacactacacttgggatgcttcagtcctccttcaggcatggccagccgtcgatccagagtttctccaacagccagaagtggtgcagatggcagtcctgatcaataataaggcatgcggaaagattcccgtcccacaacaggtggctcgggaccaagataaagtccacgaatttgtgttacagagcgagttgggggttagactactacaaggaaggtcaattaagaagagcttcctgtccccaagaaccgcactgattaattttctagtccaggactag

SEQ ID NO: 228410 - DNA, 2583 bp, Artificial Sequence
  Description of Artificial Sequence: Synthetic coding sequence
atggcttcagtctggcagagacttggcttttatgcttctctgctcaagcggcaactgaatggaggcccagacgttatcaagtgggaaagacgcgtgatccctggatgtactcggtcaatctactctgccacaggcaaatggacaaaggagtacacacttcagactcggaaagatgtcgagaagtggtggcaccagcggatcaaagaacaggcttcaaagatttcggaggcggatgtgatcaatcccatgggatgggatgcatttgggctgcctgccgaaaacgcagccgtagagcgtaacctgcaccctcaatcctggactcaatcgaacatcaaacacatgcggaagcagctcgatcggcttggcctgtgtttctcctgggaccgggaaatcactacctgcctgccagactattacaagtggacacagtatctttttatcaaactttacgaagcaggattggcataccagaaggaggccctcgtgaactgggaccccgtggaccagaccgtgctcgcgaatgagcaggtcgatgaacatggctgcagctggagaagcggcgctaaggtggagcagaaatacttgcgccaatggttcataaagaccacagcatacgccaaggcgatgcaggacgccttggccgacctgccagaatggtacggtatcaagggcatgcaggctcactggatcggcgattgcgtcgggtgccacctggactttacactgaaggttcacggccaggctacaggagagaaactgaccgcctataccgccacaccagaggcaatttacggcacctcccatgtcgccatctctccttcacatcgcctgctccacgggcactcatcactgaaggaagccttacgcatggcgctggtgcctgggaaagattgtctgacacctgtaatggctgtaaacatgctgactcaacaagaggtgcccgtggtcattctggccaaggcagatctggaaggaagcctggattctaagatagggatcccctccacatctagcgaagacacgatcctggcccaaacgttagggctggcctattctgaagtcattgagaccctgccagatgggacagagcgactctcaagctccgcggagttcacaggaatgacaaggcaggacgcgtttctcgccctgacacagaaggccaggggtaaacgcgtggggggtgatgtaacatcagataaactcaaggattggctgatctcccgtcagagatactggggaaccccaattcccatcgtgcactgccctgtctgcggacccacaccagttccccttgaagacctgcccgtgaccttgccaaatatcgcttcgttcacaggaaagggaggcccacccttggcaatggcgagtgaatgggtaaactgcagctgccccagatgcaaaggcgctgcaaagcgagaaactgatacaatggacaccttcgtggacagtgcctggtactactttagatacacagatcctcacaaccctcatagtccctttaataccgccgtagctgattattggatgcctgttgacctgtatatcggtggaaaggaacacgccgtgatgcacctgttctatgctcgctttttctctcacttttgccacgaccagaagatggtgaaacatcgtgaacccttccataaactcttagcccagggactgattaaaggccagacctttcgcctgccaagcggccaatacctccagagagaggaagttgatcttactgggtccgtaccagtgcacgcaaagaccaaggagaagctggaagtgacgtgggagaagatgtctaaatccaaacataacggcgtagacccggaagaggttgtcgaacaatacggcatcgacaccatcaggttatatattctgttcgccgcaccacctgagaaagatatcctctgggatgtgaagacggatgcactaccgggagtcctgaggtggcagcaacgactgtggactctgactactaggttcatcgaagcaagggcatctggtaaatctccccagcctcagctactgagcaataaagaaaaggcagaggcaaggaaattatgggaatataagaacagtgtcatcagtcaagtcactacccacttcacagaggacttctctttgaatagcgcaattagccagctgatgggtctgtccaacgccttgagtcaggctagtcagagcgtcatactccactcacccgaattcgaagacgccctgtgcgcgctgatggtgatggctgctccactagcaccgcacgtgacctcggagatttgggctggactggcgctagtgcccagaaagttgtgcgcccattacacctgggatgccagcgtcctattacaggcatggcccgcagtggatcctgagtttctgcagcaaccggaggtggttcagatggccgtattgatcaataataaggcatgtggaaagatccctgtgccacagcaggttgcacgcgaccaagacaaagtgcacgaatttgtgctccaatccgagttgggagttaggctgttgcaagggcgaagcattaagaagagctttcttagtcctcgaacggctttgattaatttcctggtgcaggactag

SEQ ID NO: 228411 - DNA, 2712 bp, Artificial Sequence
  Description of Artificial Sequence: Synthetic coding sequence
atggccagcgtgtggcaaaggctcggcttctacgcatctttgctgaagaggcagctgaatggagggcctgacgtaattaaatgggaaagacgggttatcccgggttgcacacgtagcatttattctgccacggggaaatggaccaaagagtataccctccagactaggaaggacgtggagaagtggtggcatcagaggattaaggaacaggcctccaagatctccgaagccgacaaatccaaacctaagttctatgtgctgagtatgtttccttatccctctgggaagttgcacatggggcacgttcgggtctacactatttccgatacaattgccaggttccagaaaatgcgcggaatgcaggtcatcaatccgatgggttgggatgccttcggcctccccgcagaaaacgctgctgtggagcggaatcttcaccctcagagctggacacagtctaatatcaagcatatgcgaaagcagctggatagactgggcctgtgtttcagctgggatcgggaaatcactacatgcctgcccgactattacaaatggactcaatacctgtttataaagctgtacgaagccggactggcctatcagaaggaggccttagtcaactgggatccagtggaccagacggtgctagcaaacgagcaagttgacgaacacggctgtagctggagaagtggagcaaaggtagaacagaaatatttaaggcaatggttcattaaaacaacggcttatgccaaggccatgcaagacgcactggccgacttgcctgaatggtatgggattaagggcatgcaggcgcattggataggcgactgtgtgggatgtcatctcgattttacgctgaaggtacacggacaggccacaggcgagaagctgaccgcttacacagctaccccagaggccatttacggaacttcccatgtggccatcagcccatctcatcgcttgctgcatggtcatagctccctcaaagaggccctgagaatggctttggtccccggtaaggactgcctgacccccgtcatggccgtcaacatgttgactcagcaggaagtaccggtggtgatcctagcgaaggccgacctggagggaagcttggatagtaagatcgggatcccgtcaacctcttctgaggacacaatattggcccagactcttggcctggcctacagtgaggtcattgagactttgccagatggaaccgaacgcctgtctagctctgctgagtttacaggcatgactaggcaggatgcattcttggctttgactcagaaggccaggggaaagcgggtcggcggtgatgttacgagcgacaagcttaaggactggctgatttctcgacagaggtactggggcacacctatcccaatagttcactgtcccgtgtgcggtccgacccccgtccctctcgaagacttaccagtgactttgcccaacatagcaagctttacaggcaagggtggaccccctctagcgatggcctctgagtgggtgaattgttcatgcccccgttgtaagggtgccgcaaaacgggagactgacactatggacacttttgtggactcagcttggtactacttcaggtacactgacccccataatccccattccccttttaataccgctgtcgctgattattggatgcctgtggatctatacattgggggaaaagagcacgcagtgatgcacctcttctacgccaggttcttcagccacttttgtcatgatcaaaagatggtgaagcaccgtgaacccttccacaagctcctggcccagggactcatcaaggggcagactttccggcttccctccggccaatatctccagagagaagaagtcgatctgaccgggtccgtgccagtccatgctaagactaaagaaaaactcgaggtgacttgggaaaaaatgagcaagtccaagcacaatggcgtcgatccggaggaagttgtggagcagtatgggatcgataccatccgcctctatattttgttcgccgctcctcccgagaaagatatcctctgggatgtgaagacggatgcactgcccggagtgcttaggtggcaacaacggctgtggacacttacaactcgtttcattgaagccagagcatcgggtaagagcccacaacctcaacttctgagtaataaagaaaaggccgaagccagaaagctctgggagtataaaaactccgtgatttctcaggtcactactcacttcacagaggattttagtcttaactcagcgatttctcagctgatgggcctgtcgaacgctttatcccaggcaagccagtctgttattctgcactctccagaattcgaggatgccctgtgcgcactcatggtgatggctgcgcctctggcgcctcacgtgactagcgaaatatgggcaggactagccctcgtgccaaggaagttgtgcgcacactatacgtgggacgccagcgtgctcctccaggcatggcccgctgtcgatccagagtttctgcagcagcctgaggtggttcaaatggcagtgctaatcaataacaaagcctgtggcaaaatccctgtgccgcaacaagtcgcgagagaccaagataaggtgcatgagttcgtgcttcaatctgagctgggcgtaagactgctgcaggggcgatccatcaagaaatcctttttgagtcccagaactgccctgataaatttcttagttcaagattag

SEQ ID NO: 228412 - DNA, 345 bp, Artificial Sequence
  Description of Artificial Sequence: Synthetic coding sequence
atggcgtctgtctggcagcgattggggttctacgcttcgctgctaaagaggcagctgaacggcggaccagatgttatcaaatgggaacggagagtaattccaggttgcactagaagtatctatagcgctactgggaagtggaccaaagagtacaccttgcagacaagaaaagatgttgaaaaatggtggcaccaacggattaaagagcaggcttcaaagatttcggaggccgataagagtaaaccgaagttctatgtactttccatgttcccttatccttccgggaagctgcacatgggacacgtgcgtgtctacacgatcagcgacacaatcgccaggttctag

SEQ ID NO: 228413 - DNA, 609 bp, Artificial Sequence
  Description of Artificial Sequence: Synthetic coding sequence
atgaaggtgttggcagctggagtggtgccgttactgcttgtcctacactggaaacatggcgctgggtcacctctgcccataaccccagtcaatgccacttgtgccatccgccatccttgtcacaacaacctgatgaatcaaatcagaagccaactagcccagctgaatgggtccgccaatgcactcttcatcttatactatacagcacagggagaaccctttccgaataacctggacaagctctgtggccctaacgtgaccgactttcccccattccatgcaaatggcaccgagaaggctaaactggtcgaactgtatcgcatagtggtctacctgggaacaagccttgggaacatcacgcgggaccaaaagattctcaatccttcagccctgagtttgcattcaaagctgaacgccacagctgacattctgcgcggactactgtccaacgtgctatgcaggctgtgttctaaataccatgtgggtcacgttgacgtgacttacgggcctgatacgtcgggcaaggacgtattccaaaaaaaaaaactggggtgccagttgctggggaaatacaaacagatcatcgcagtcctggcccaagccttttag

SEQ ID NO: 228414 - DNA, 3294 bp, Artificial Sequence
  Description of Artificial Sequence: Synthetic coding sequence
atgatggacatatacgtgtgtctcaaacgtccatcctggatggtagataacaagcgaatgcggaccgcaagcaatttccaatggctcctatctacattcatcttgttgtacttaatgaatcaagtgaattctcaaaagaaaggagcccctcatgatctgaagtgcgtcaccaacaacctgcaggtgtggaactgttcttggaaggcgccatccggtactggcaggggcactgattacgaagtttgtatagagaaccgaagtcggtcttgttatcaacttgagaaaacttccataaagatccccgctctatctcatggggattatgagataactataaatagtctacatgatttcggctcctccactagcaaatttacgcttaacgagcagaacgtgagtctcattcccgacacacctgagatactgaacctctctgcagacttctccacatcaaccttatacctgaagtggaacgatcgcggaagcgtgttcccacatcgatccaacgtcatatgggagattaaggttcttagaaaagaatccatggaacttgtgaagctcgttacacataacaccacccttaatggtaaagataccctgcatcattggtcctgggctagtgatatgccccttgagtgcgcgatacattttgtggaaatccgttgttatatcgacaacttacatttctccgggcttgaggagtggagtgattggtccccagtcaagaatatttcatggatccctgatagtcagacaaaggtcttcccccaagataaggtgattctggtgggcagtgatattacattctgttgcgtctcgcaggagaaggtcctgtctgcccttatcgggcacacgaattgccccttgatacacctagacggagagaacgttgcaatcaagatcaggaatatctctgtgagtgcttcttcaggcaccaacgtagtgttcactactgaagacaacatcttcggtaccgtgatcttcgcaggctaccctccagatacaccacagcagttgaactgcgagactcatgatctgaaggaaatcatctgctcctggaatccaggcagggtgaccgccctggttgggcctcgagccactagttatacgcttgttgagtcatttagcggcaaatacgttcgacttaagagagccgaggccccaaccaacgaatcttaccaattgctctttcaaatgctgcccaatcaggaaatctacaacttcacgctgaatgcgcacaaccctcttggcagatcccagtctaccattctagtgaacatcaccgagaaggtctacccacacactcccacttcattcaaagtcaaggatattaactctacagctgtgaaactgtcatggcatttacccggaaatttcgccaagatcaactttttgtgcgaaatcgagatcaagaagagtaattccgtacaggagcagcgcaacgtaaccataaaaggcgtagaaaactcttcctacctcgtggcactagacaaactaaacccttatactctctatacgttccgcatacgttgctctacagagaccttctggaagtggtctaagtggagcaacaagaagcagcatctcaccaccgaagctagcccaagcaaggggccagatacttggcgggagtggtcttctgatgggaaaaatctgattatttattggaagccccttcccatcaatgaagcgaacggaaagattttaagttacaacgtgtcatgttcctccgacgaggagacacagtccttgtctgagatccctgatccgcagcacaaggcagagatcaggttggataagaacgattacataatcagcgtagtggcgaagaactctgttggctcttccccaccctccaagattgcgtcaatggaaatcccaaatgacgatctgaaaatcgagcaggtcgtcggaatgggcaaaggaatcctcttgacatggcattatgaccccaatatgacatgtgactatgtgatcaaatggtgtaattcttcacgcagtgaaccttgcttgatggactggcgtaaggttccatcaaattccaccgagactgtgatagagtccgacgagtttagaccaggcataaggtacaacttctttttgtatggctgtcgcaatcagggttatcaactgctgaggtcgatgatcggctatattgaggagctcgcgccaatcgtcgcccctaacttcactgtcgaagatacatccgcagactcaatcctggtgaagtgggaggacattcctgttgaagaactaaggggattcctccgcggttacctcttctatttcggaaagggtgaaagagataccagtaaaatgcgagttctggaatcaggcagatccgatatcaaggttaaaaatattactgatatttcccagaaaacgctacgtatcgcagacctccagggcaaaacctcataccatctggtattacgcgcttacacagacgggggagtgggtcccgagaagagcatgtatgtagttaccaaggagaactcggtgggtctcataatcgcaatcctaatcccagtggcggtcgcagttatcgttggtgtcgtcacaagtattctgtgctataggaagcgcgaatggatcaaagaaactttctatcctgacatccctaaccctgaaaattgcaaagccttgcagttccagaagtcggtgtgtgaaggatcaagcgccctgaaaactctggaaatgaacccgtgcacaccaaataatgtcgaagtcctcgaaactaggagtgcctttccaaagatcgaagataccgaaatcatatctcctgtcgcagaaagacctgaagataggagcgacgcagaacccgaaaaccacgtagttgtttcatattgtcctccgattatagaggaagagatccccaatccagcagcagatgaagcgggtggaaccgcgcaggtgatctatatcgacgttcagtccatgtatcagccccaggcaaagccagaagaggaacaggaaaacgacccagtgggtggagccggatacaagcctcagatgcacctgccgatcaattccacagtcgaggacatagctgcagaggaagacttggacaaaacagccggttacagaccccaggcgaacgtgaatacatggaacctggtgagtccagacagcccccgatcaatcgactctaacagtgagatagttagctttgggagcccatgttctatcaactcacgacagttcctcataccgcctaaggacgaagacagccctaaaagcaacgggggagggtggtcctttacaaatttttttcagaacaagcccaacgattag

SEQ ID NO: 228415 - DNA, 3294 bp, Artificial Sequence
  Description of Artificial Sequence: Synthetic coding sequence
atgatggacatatatgtgtgcctcaagcgcccatcatggatggttgataacaagaggatgagaacagcttctaatttccagtggctcctatcgactttcatactgctctatttaatgaaccaggttaactctcaaaaaaagggagcccctcatgacctgaaatgcgtaacgaataacctccaggtgtggaactgctcctggaaggcccctagtggaacgggcaggggaaccgattacgaggtatgcattgagaataggagcaggagctgctaccagctcgaaaaaactagcattaagatcccagcgcttagccatggggactacgagattaccattaacagtctgcatgattttggctcttcgacatcaaaatttacacttaacgaacagaatgtgtcgctgattcctgacacaccagaaattctgaacctgagtgccgatttcagtactagtaccctttacctcaaatggaacgatagagggtcggtgttccctcaccggtcaaacgtgatctgggagataaaagtgctgcgcaaagaaagtatggaactagtcaaactagtcacacacaacacaaccctgaatggcaaagacactctccatcattggtcttgggcatccgacatgcccctagaatgcgcgatccactttgtagagatccgttgctatattgacaacctccatttttccggtctggaggaatggtctgactggtcccccgttaagaatatctcctggatacctgactcccagacgaaggtgttcccccaggacaaggtcatcctggtgggcagcgatatcaccttttgttgtgtaagtcaggaaaaggtgctgagcgccctgatcggtcatacgaattgtccattgattcatcttgatggtgagaacgttgccataaaaattcgcaacatttccgtgagcgccagctccggtacaaacgtcgtctttacgaccgaagacaacatttttgggacggtcatcttcgcgggttaccctcccgacacgccccagcagttaaattgcgagacacacgatctgaaggaaatcatctgcagttggaatccaggtcgagtgactgcgctggtggggccacgcgctacaagctatacgctggtagagagttttagtggaaaatacgttagactaaagcgcgctgaggctcctaccaatgagagctaccaactgttattccaaatgcttccgaatcaggagatctacaactttactctgaacgcccataatcctctgggaagatctcagtccacaatattagtaaatatcactgaaaaggtgtacccccatacccctacatcctttaaagtgaaagacattaactctacagctgtgaaactgtcctggcacctgcctggcaacttcgcaaagattaacttcctgtgtgaaatcgagattaaaaagtctaactctgtgcaggagcagagaaatgtgactattaaaggtgtagaaaattcgtcttatctcgtggccttggacaagttaaatccttataccttgtatacatttaggatccggtgtagcactgaaacattctggaaatggtcaaagtggtctaacaagaagcagcacctgaccaccgaggcctcgcctagtaaagggccagatacatggcgggagtggagctctgacggcaagaatttaatcatctactggaagccactgccaataaatgaagcgaatgggaagatcctatcctataacgtttcttgctctagcgatgaggaaacccagtcactttccgaaatccctgatcctcagcataaagctgagattcgcctggataagaacgactacattattagcgtcgtcgccaagaattctgtgggcagctcacctcccagcaagattgcatctatggaaattcccaatgatgaccttaagatcgaacaggtggtgggtatgggaaaaggtattctgcttacttggcattacgatcctaatatgacatgtgattacgtgattaagtggtgtaattctagccgcagtgaaccatgtttgatggattggcgcaaagtaccctccaactctaccgagaccgttattgaaagcgatgagtttcgacccggaatacgatacaatttcttcttgtacggctgtcgcaatcagggttatcagctactccggtcaatgatcggctacattgaagaacttgcccctattgtggcacccaactttacagtggaagatacatctgccgattctatcctggttaagtgggaggatatacccgttgaggaattaagggggttcctgcgaggttatctgttttattttggaaagggtgagagagatactagtaagatgcgtgtcctcgagtccggtcggtccgacatcaaggtgaagaacataacggatatctcccagaaaaccctgcgaatcgcggacctgcagggaaagacatcttaccacctggtgttgcgcgcatacaccgatgggggagttggccctgagaaaagcatgtacgtcgtcactaaagaaaattccgtcggactcattattgctattctgatccctgttgctgtggccgtcattgtaggagtcgtgacgtctattctgtgttataggaagcgtgagtggatcaaagaaacattttacccggatatacccaacccagagaattgtaaagctctccagtttcagaagtccgtgtgtgagggctcttccgctctgaagactttagagatgaacccctgtacccccaacaatgtagaggtgctggagactcgtagtgcctttcctaagattgaggatactgaaatcatatcccctgtggcggaaagacctgaggataggagcgacgctgagcccgaaaatcacgtggtagtctcatactgtccccctatcatagaagaagagatccccaatccagctgcagatgaagcgggaggtacggcccaggtcatttatatcgacgtacagtcgatgtaccagccccaggccaagcccgaagaagaacaggaaaatgacccagttgggggagccggatacaaaccacagatgcacctgccaataaattcgacagttgaggatatcgcagccgaggaagacttagacaagacagcgggatacaggccacaggccaacgtgaacacctggaacttggtctcacctgacagtcctcgatctatcgattcaaattcagagattgtgagttttgggtctccttgctccattaattccaggcagtttttaatcccacccaaagatgaggattctcctaagtcgaacggcggtggttggagttttacaaattttttccagaacaaacccaatgactag

SEQ ID NO: 228416 - DNA, 381 bp, Artificial Sequence
  Description of Artificial Sequence: Synthetic coding sequence
atgatggacatttacgtgtgtcttaagagacctagctggatggttgacaacaagcggatgcgaaccgcatcaaacttccagtggttgctttcgacattcatcctgctctacttaatgaatcaggtgaacagtcagaaaaaaggtgcaccccatgacctcaaatgcgtgactaataacctgcaggtgtggaactgtagctggaaggccccatctgggacagggagaggcacggactacgaggtgtgcatcgaaaacaggtcacggtcctgttatcagcttgagaagacttcaataaaaattccagctttatctcacggcgattacgaaatcaccatcaattcccttcatgattttggatcctcgactagcaagtttacctag

SEQ ID NO: 228417 - DNA, 228 bp, Artificial Sequence
  Description of Artificial Sequence: Synthetic coding sequence
atgatggatatttacgtgtgtcttaaacgcccatcttggatggtagacaacaagagaatgcggacggcaagcaattttcaatggctgctcagcacgttcatactactctacttaatgaaccaggtcaacagtcagaagaaaggtgccccacacgacctaaagtgtgttacaaacaatctccaggtgtggaactgttcctggaaagctcctagtggcacaggtcgttag

SEQ ID NO: 228418 - DNA, 456 bp, Artificial Sequence
  Description of Artificial Sequence: Synthetic coding sequence
atgttttccaccaaagctcttcttctagccggactaatctccactgctctggcgggaccttgggccaatatttgtgctggtaagagctcaaatgaaatcagaacttgcgatagacacgggtgtggacagtactcagcccagaggagtcagcgtccgcatcagggcgttgatatcctgtgttccgcgggatctacggtctacgccccattcacaggtatgatagtaggtcaagagaaaccttatcagaacaagaatgcaattaataacggagttcgcatttcaggacggggattttgcgtgaagatgttttacattaagcctatcaagtataaggggcctataaagaagggtgagaagctcgggactctgctcccactgcagaaagtatacccgggtatccagagccacgtgcatattgagaactgcgatagttcagaccctaccgcgtacctttag

SEQ ID NO: 228419 - DNA, 1128 bp, Artificial Sequence
  Description of Artificial Sequence: Synthetic coding sequence
atgacccctatcctgacggtcctgatctgtcttggtctcagtctggatcctcgtacgcatgtgcaagctggcccactgcctaagcctaccctatgggccgaaccgggttccgtgattacccagggttcacccgtgaccctccgctgccagggatcgcttgaaactcaagagtatcacctgtacagagaaaagaagaccgctctgtggattactcgaatcccccaggagctggtgaaaaagggacaatttcctatcctaagtattacatgggaacacgcgggaaggtactgctgtatctatggctcacatactgcgggtctgtctgagtctagcgatccactggaactcgtggtgaccggcgcttacagcaagcccaccctgagtgccttaccgagcccggtggtcacatcagggggaaacgttaccatccagtgtgattcccaagtagccttcgatggcttcatactctgcgtgtccaagaaaccgtcacttagtgtgcagcctgggccagtggtggctcctggcgaaaagttaaccttccagtgtggtagcgacgctggttacgaccgcttcgtcctttacaaggaatggggcagagactttctccagaggcccggacggcagcctcaggcgggtctttcccaagctaacttcacccttggtcccgtctcgaggtcctacggaggacagtatacctgcagcggcgcttataacctcagctcggaatggtcggctccctctgatccattagatatcctgattaccgggcagatcagagcgagaccattccttagtgtgcgccctggaccaactgtagctagtggggagaatgtcacgctgctatgtcagagtcaggggggtatgcatacatttctccttactaaggagggagccgctgattctcctctgagattgaaatctaagaggcagtcccacaagtaccaggccgagtttcccatgtctcctgtcacatcagcccatgcagggacctatcgttgctatgggagcctgtcttccaacccctatctcctgactcatccctccgaccccctggaactggttgttagcggcgcagctgaaacattgtctccaccacagaacaagtcagactccaaggcaggagaatag

SEQ ID NO: 228420 - DNA, 1956 bp, Artificial Sequence
  Description of Artificial Sequence: Synthetic coding sequence
atgacaccgatactgactgtactcatatgtttgggactttccttagggccacggacccatgttcaagccggtcaccttcctaaacctacgctatgggctgaaccaggaagcgtgattacgcaaggatcccccgtgaccctgaggtgccagggagggcaggagactcaggagtatcggctttacagagaaaagaagaccgctctgtggatcacacggattcctcaagaactggtgaagaaggggcaattcccaatcccgagcattacctgggagcacgccggaagatatcgttgttattacggtagtgacaccgccggaagatccgagagttctgaccctctggaattagtggtgactggagcatatattaaaccgactctaagcgctcagccttctcctgtggtaaacagcggaggaaacgtgatactgcaatgtgacagccaggtggccttcgacggattttctctttgtaaagaaggtgaggatgaacacccccagtgtctgaactcccagcctcatgcacgtgggtcatcacgtgccatcttcagtgttgggcctgtaagcccgagtcgcaggtggtggtaccggtgttatgcatatgatagtaatagcccttatgagtggtctctgccttccgacctacttgagctgctagtgttgggagtttcgaagaaaccatctctgagtgtccaaccaggacctatagtggcgccagaggaaacattaactctgcagtgcggaagcgacgctggctacaaccgctttgtactgtacaaagatggcgaaagagacttcctgcagctggccggagctcagccccaagctggcctgtctcaggcaaatttcacgcttggcccagtgtcacgcagctatggaggacaatacaggtgttatggcgcacataatctttctagtgaatggtccgctccttctgatcccctggacattctgattgccggacagttttacgatcgggtgtccttgagcgtgcagcccggtcccacagtagcgtccggggagaacgtgaccctcttgtgtcagagtcagggctggatgcagacgttcctgcttaccaaagagggagcagctgacgacccatggcggctgagatcaacgtatcagagccagaagtaccaagccgagtttcctatgggcccagtcacctcagcccatgctggcacctaccgctgctatggatcccagtccagcaagccataccttctgacccatccctcggaccccttggagttggtggtctcaggtccttccggagggccaagcagtcccactaccggacctacaagtactagcgctggtccagaagaccaaccactgactcccactggctcagatccccagagtggacttggacggcatttgggggtcgtcatcggcattctggttgcagtcatattgctgctgctgctcctgctgctgctatttctcatactgcgccacaggcgacagggcaagcactggaccagcactcagagaaaggccgatttccaacaccctgctggcgctgtgggaccagagccaactgatcgagggttgcagtggcgttcgtcccccgctgctgatgcccaggaagagaacctgtatgctgcagtgaagcacacccaacctgaggatggcgtagaaatggatacgcgatctcctcacgacgaagacccccaggctgttacttacgctgaggtgaagcattcacgcccacgccgagagatggcttccccgccttcccctctctctggggaatttttggacaccaaagatcggcaggcggaagaagataggcagatggatactgaggccgctgcatccgaggcaccacaggacgtaacatatgctcagctgcattccctgacattacgacgggaggctactgaaccgcctcctagccaggagggtccgtctccagctgtgccctctatatacgcgacactcgccattcactag

SEQ ID NO: 228421 - DNA, 1956 bp, Artificial Sequence
  Description of Artificial Sequence: Synthetic coding sequence
atgactcccatcttgacggtcttgatttgtctcggccttagtctcgggccacgcacccacgtccaagctggccacctgccaaaaccgacactctgggcagagccaggctcagtgatcacccagggaagtcctgtgacgctacggtgccagggtggacaggagacccaggagtaccggctctatcgcgagaaaaaaaccgctctgtggattacccggatccctcaggagctggtgaagaaggggcagtttccgatccctagtatcacatgggagcacgccggtcgatatcgctgctactatggctctgatactgccggaagaagcgaatcttcagacccactcgaactggttgtcactggcgcttatattaagcccaccctgtccgctcagcccagtcctgttgtgaattccggtgggaacgtcattcttcagtgcgattctcaggtcgcctttgatggcttttcactgtgcaaagaaggagaggatgagcatccacagtgcctgaacagccagcctcatgctaggggatctagccgtgccatattctccgtcggaccagtgtcccccagtcggagatggtggtaccgctgctacgcatatgactctaacagcccttacgagtggagtctccctagtgacctgctggaactgctggtgttaggagtaagtaaaaaaccttctttgtcagtgcaaccgggacccatcgttgcgccagaggagacactgactctgcagtgtggaagcgacgcaggctacaacaggtttgtcctctacaaagatggagagcgggatttcctgcagctcgccggagctcagcctcaggccggactaagccaggccaatttcacactcgggccagtgtcacgatcatacgggggacagtaccgctgctatggagcacataatctgagctccgagtggagcgccccttctgaccccctggatattctcatcgccggacaattctacgatcgagtgtctctgtctgtccaacccggacccacagtcgcctccggggaaaatgtaactctattgtgccagtcacagggttggatgcagaccttcttgcttaccaaggagggggctgcagacgacccatggcggcttcggagcacctaccagagccagaaatatcaagccgagttccctatggggcctgtaacaagcgctcatgctggaacttataggtgctacggaagtcagtctagtaaaccttacttgctgactcacccgtctgatcctctagaactggtcgtctctggcccaagcgggggtccctcttctccgacgacgggcccaacttctacatctggtcccgaggatcagcctctgacgccgacggggtccgatccacagagcggcctaggacggcatctcggtgtcgttatcgggatcctagttgctgtgattctgcttctgttgctgctcttacttctctttctgattctgcgtcacagaaggcagggaaagcattggactagcactcagcggaaggcagatttccagcatcctgctggggctgtcggtcccgagccaacggatcgaggccttcaatggcgctcatcccccgcagcggacgcccaggaagaaaatctgtatgccgctgtaaagcatacccagccagaggatggggtagagatggacaccagacaatcaccccacgacgaagaccctcaagccgtaacatatgccgaggttaagcactcgcggcctcgtcgcgagatggcaagcccaccttcacctctgtccggcgaattcctggacaccaaggacaggcaagcggaggaggacaggcaaatggatacggaggccgcagcctctgaggctccacaggatgtcacatacgctcaactacacagtctgactttgcgcagagaagccaccgagccccctcctagccaggagggcccaagccctgctgttccttctatctacgcaaccctggctattcactag

SEQ ID NO: 228422 - DNA, 1794 bp, Artificial Sequence
  Description of Artificial Sequence: Synthetic coding sequence
atgaccccaattgtgacggtgctcatatgtctggggctgagtctgggaccacgaacccatgtgcagacgggtacgattccaaaaccgactctctgggctgaaccagacagcgtgattactcagggctcgccagtcactttatcatgccagggttctcttgaggcacaggaataccgattatacagggaaaagaaatcggcatcctggattacccggattcgccctgagcttgtgaagaacgggcagttccatattcccagtattacctgggagcataccggccgttatggctgccagtactactccagagctcggtggtctgagctgagcgatcccttagtactggtcatgaccggcgcttatcctaagcccaccttgagtgcccagccttctccagtagtgacaagcggtggcagagtgactttacagtgcgagtcccaagtcgccttcgggggattcattttgtgcaaggagggggaggaggagcatccccagtgtctcaatagccagccccatgcccgtggatcgagccgagccatcttcagcgtgggacctgtgtctcctaatcgcaggtggagtcataggtgttatggttacgatcttaactccccctacgtctggtcctcacccagcgacttactggagttgctggtgcctggggtctccaagaagccttccttgtcagtccagccaggccctgtagtggcccctggcgaatccctgacattgcagtgcgtctctgatgtcggctatgaccgatttgtcctgtataaggagggagagagagatctgaggcagctgcctggcagacagccacaagcgggactctcacaggcaaactttacgcttggcccagtaagtcgttcctacggcggtcaatataggtgctatggcgctcataacttaagtagcgagtgctctgcaccttccgatcccctggacatccttattacaggacagatccggggtacgccctttatcagcgtgcagcctggccctacggtcgcttccggagaaaatgtgaccttattatgtcagagttggcggcaatttcataccttcctcctaaccaaggcgggagcagcagacgctcccttgcgcctccggagcattcacgagtatccaaagtaccaggcagaattccctatgtcccctgtgacatccgcccacgccggaacgtatcgctgctacgggtcactcaactctgatccttaccttctcagccaccccagcgaaccattggagctggtagtgtccggaccatcaatgggctctagcccaccacctaccgggcctatctcgacgccaggtcccgaggaccaacctttgaccccaactggatccgaccctcaaagcggattgggcaggcacttgggcgtggtgatcggcatcttagtcgcggtggtcttgctcttgttgcttctactgctgctgttcctgattcttcgacaccgtcgacagggcaagcactggacttctacacagcgaaaagccgattttcagcaccccgctggagccgtggggccagaaccaaccgatcgcggtcttcagtggagatcgtccccggcagcagatgcacaggaagagaacctgtacgcggcagtgaaagacacgcaacccgaagatggggtcgagatggataccagagctgcagcaagcgaagcacctcaagatgtcacctacgctcagcttcattcgctgacactgcggcgaaaggcaactgaacctccgccttctcaggagcgtgaaccacctgcagaaccctcaatatacgccacattagcgattcactag

SEQ ID NO: 228423 - DNA, 1899 bp, Artificial Sequence
  Description of Artificial Sequence: Synthetic coding sequence
atgacacccgcactgacggcccttctgtgcctgggtctgtctctggggccaaggactagagtacaagcaggtccatttccaaagcccaccctgtgggccgagccaggctctgtgataagttggggttctcccgtaactatatggtgccagggctcacaggaggctcaggaatacaggctgcacaaggaaggtagtcctgagcctctggaccgcaataaccctctggagccgaagaacaaagcacgcttttctatccccagcatgactgaacaccacgcaggcaggtaccggtgtcactattattcgtctgctgggtggtccgaaccctccgacccacttgagatggtgatgactggtgcttacagtaaacctacactcagcgctctcccctcacctgtcgtcgcttcgggagggaacatgacgctgaggtgtggttctcagaaagggtaccatcactttgtcctgatgaaggaaggggagcatcagttacccaggactcttgactctcagcagctccatagcaggggctttcaagctctgttccctgtgggtcccgtgacgcccagtcatcggtggaggttcacttgctactattactacaccaacacgccctgggtttggagtcatccttctgatccacttgaaattctgccctcaggagtgtctagaaagccaagtctgttaaccctgcaggggccagtgctggcccctgggcagtccctgactctgcaatgcggatcggacgtgggatacaacaggtttgtgctgtacaaagaaggggagagggactttctgcagaggcctgggcagcagcctcaagccggtctctctcaggcaaattttacactcggtccagtcagcccctcgaatggcggacagtatcggtgttatggcgctcacaatttatcctccgagtggtccgctccttcagatcctctgaatattttaatggctgggcagatctacgacaccgtttccctcagcgcccagccagggcctactgtggcaagtggtgagaatgtcaccttgctctgtcagtcttggtggcagtttgatacgtttcttcttactaaagagggcgctgcccaccctccactgagactcaggtcgatgtatggcgcacataaatatcaggcggaatttccaatgtcccccgttacatccgcccacgcaggcacctaccgatgttacggatcgtacagctctaacccacatctgctgtctcatccctctgagccactggaacttgttgtgtctggccatagcggtggatctagcctccctcccaccgggcctccctcaactcccggtctgggcaggtacttggaagtgttaataggtgtgtcagtggcatttgtgctgcttctgttcctgctcttatttctactgctaagacgacagagacattccaaacatcgaacctctgatcagcgtaagactgacttccagaggccagccggagcagcggagactgagcctaaggatagaggactcctgcgacgctcaagccccgctgccgacgtgcaagaagaaaacctttacgccgcagtgaaggatacacagagtgaggatagggtggaacttgatagccaacagtcccctcacgatgaagaccctcaagcagttacttacgcccctgtaaagcattctagtcccaggagagagatggcctccccgccatcatctttgtcaggtgaatttctagacaccaaggaccggcaggtcgaggaggacagacagatggacaccgaggctgccgctagtgaggccagtcaagatgtcacctacgcacaacttcactctctcacccttaggcggaaggcgaccgaacctccgcctagccaggaaggcgagccaccagccgagcccagcatttatgcaaccttggcaatacattag

SEQ ID NO: 228424 - DNA, 1344 bp, Artificial Sequence
  Description of Artificial Sequence: Synthetic coding sequence
atgattccaacattcacagctctgttgtgcctgggtctgtctctcggccctcggacccacatgcaggccggtccactcccaaaacccaccctgtgggccgaacccggatccgtgatttcttgggggaacagcgtcaccatctggtgccaggggaccctcgaagcacgcgagtatagactcgataaggaagagagccccgcaccatgggaccggcagaacccgctggagccaaaaaataaagccagattctctataccttccatgactgaggactacgccggaaggtacaggtgctattaccgttctccagtgggctggagccagcccagcgacccattagagctcgtgatgacgggtgcgtacagtaagccgaccctatcagcattaccgagccccctggtgaccagtgggaagagtgtgactctcctctgtcaaagcagaagccctatggacacgtttctgcttatcaaagaaagagcagcccaccccctcctgcatctgcgtagcgagcacggagcacaacagcaccaggccgaatttcccatgtctcctgtgacaagcgtgcatggaggaacgtatcggtgcttctccagccacggcttcagtcattacttactgtcccatccctcagaccccctcgagttaattgtttccggatccctagaggacccaagaccatcccccacacgatctgtctctacggccgctggccctgaggatcagcctctgatgccgaccgggtccgtgccccactccggcctccgaagacactgggaagtgctcattggggtccttgtggtgtccatactgctcctgagtctgctcttgtttctcctgctacaacactggcggcaagggaaacaccgaactctagctcagcgacaagcagacttccaacgccctccaggagcagccgagccagaacccaaggacggaggcctccagagacggtcatcccccgcagctgacgtgcagggcgaaaacttctgcgccgctgtgaagaatacacagccagaagacggcgtggaaatggacacacgctccccacacgatgaagaccctcaggctgttacatatgccaaggtaaagcacagccgcccacgccgagaaatggcctccccaccctccccgctgagcggagaatttctggacactaaagataggcaagcagaagaggatagacagatggacactgaggcagccgcatcagaagcgccacaagacgtgacctacgctcagctgcatagttttacccttaggcagaaagctacagaaccgcctccgtctcaagaaggtgcctctccagctgagccctctgtgtatgccaccctggcaatccattag

SEQ ID NO: 228425 - DNA, 1476 bp, Artificial Sequence
  Description of Artificial Sequence: Synthetic coding sequence
atgacactgactttatctgtgctgatctgccttggactcagcgtcgggccacggacctgcgtccaggccggaacactgcccaagcccactctgtgggccgagcctgcttctgtgattgctcggggtaagcctgtaacactatggtgtcaaggaccattggaaaccgaggagtacaggttggataaggagggcttaccctgggctcgaaagcgccagaatccgcttgagcccggagccaaagccaaatttcatataccatccaccgtctatgattcagctggcagatatcgatgctactacgagacccctgcaggatggtctgaaccctcagatcccttggagttggtggcgaccggagtgtctagaaaaccctctctgctgatcccacaaggctcagtcgtagccagaggcggaagcctgacattacagtgccgatccgatgtcggttacgatattttcgtgctctacaaggaaggtgagcacgacctagtgcagggaagtggacagcagccccaggccggtttatcccaagccaacttcacattgggccctgtgagcagatcccacggaggacaatatagatgctatggtgctcataatctgtcaccaaggtggtccgcaccaagcgacccccttgacatcctcatcgctgggcttataccagatatccccgcactgtcagtgcagccagggcctaaggtggcatcaggggaaaatgtgacactcctttgtcaatcctggcaccagattgataccttcttcctgacaaaggaaggagcagcacacccccctctgtgcctgaaatccaagtaccagtcataccgacaccaggcagaattctccatgtcgccagtgacttcggctcagggcggaacttaccgttgctacagcgctataaggtcctatccttatctgctttcgtcccccagctatcctcaagaactggtcgtaagcgggccttctggcgatccatcccttagcccaactgggagcactcccacacctgcgggacccgaagatcagcccctcactcccacgggcctcgacccccagtcaggactggggagacacctgggggtggttacaggggtgagcgtcgctttcgtgcttctgcttttcctcctcttgtttcttctgctccggcatcgtcatcagtccaaacataggacctctgcccacttttacagacctgctggcgcagcaggtcccgagccaaaagatcagggtctacagaagcgcgcttcgccggtagccgacatccaggaagagattttgaacgcagcggttaaggacacacagccaaaggacggggttgagatggacgcaagagccgctgcttccgaggcccctcaggacgtaacgtatgctcaattacattccctcacccttagacgcgaagccaccgagccccctccgagtcaagagagagaacctccagctgaacctagcatctacgcacccctggccatacattag

SEQ ID NO: 228426 - DNA, 1470 bp, Artificial Sequence
  Description of Artificial Sequence: Synthetic coding sequence
atgactccaatcgttaccgtgctgatctgcctgaggctctctctggggcctaggacacatgtgcaggccggtaccctccccaaacccactctgtgggccgagcccggtagtgtgatcacacagggatcaccagtgacactgtggtgtcaagggatcctggagactcaggaatatcgactctaccgagaaaaaaagacagccccttggattacacgaataccccaggaaattgtaaaaaagggacagtttccaataccatcgattacttgggagcacacaggccgttacagatgcttctacggtagccataccgcgggttggagtgaacctagcgatcccctggaactggtggtcacgggtgcgtacatcaagccaacgctcagcgcgctcccttctcctgtggttacaagcggaggcaacgtcactttacattgtgtctcacaggtggcttttggtagttttatcctatgtaaggagggtgaggacgaacacccacaatgcctgaacagtcagcccaggactcatgggtggtcgcgagctattttttctgtggggcctgtgtcacccagtagacgctggagctaccgatgctacgcttacgacagcaacagccctcatgtatggtctctaccttctgaccttctggagctcttggtcttgggggtctccaaaaagccctccctgtcagtgcaacccggaccaatagtcgcccctggcgagtccctcacattgcagtgtgtatccgacgtgtcttacgaccgatttgtgctatacaaggaaggagagagagatttcctgcagctgcccggacctcaacctcaagccggtctatctcaagcaaacttcacacttggacctgtgagcagaagttacgggggacaataccgctgttccggggcatacaatctgtcgtccgaatggagcgccccttcagatcccctggatatcctgatcgctggccagtttcgtggcaggcctttcatttcagtgcacccgggacctaccgttgcgagcggcgagaacgtaactctcttatgtcaaagctggggcccttttcacaccttcctgttaaccaaggcaggggctgccgacgccccattgcgactgagatccatccatgagtatccgaagtaccaggctgagttccccatgagccccgtcacttccgctcattctggcacgtatagatgctatggttctctgtcgtcaaacccatatctgctgtcgcatcctagcgattcactagagcttatggtgtctggtgcggcagaaacactatctcctccgcagaataagtccgattctaaggctggcgctgcgaacacactctcgccgagtcaaaacaaaaccgcctcacacccccaggactacaccgtagagaacttaatccggatgggaatcgctgggcttgttctggtggtgttgggtattctgctattcgaagcccagcatagtcagagaagcttgtag

SEQ ID NO: 228427 - DNA, 1401 bp, Artificial Sequence
  Description of Artificial Sequence: Synthetic coding sequence
atgacacctattttaaccgtgctgatatgtctgggtctgtcgttgggaccacggacacacgtccaggccggacacctgcctaagcctactctgtgggcagagccaggttccgtaataattcagggttcccccgtgaccctcagatgtcaaggctcactgcaggccgaagagtaccacctgtatcgtgagaataagagcgcttcgtgggtccgcaggatccaggagccaggcaagaatgggcagttccccattccatcaataacttgggagcacgccggacgttatcattgccagtactactctcacaatcactcttcagaatacagcgaccctctcgagctcgtagtcacaggcgcatatagcaaacctacgctctcggcactcccgtccccggtcgtgacactggggggaaacgtcaccttacagtgcgtatcacaggtggcatttgatggcttcatcctttgcaaagaaggtgaagatgagcacccccagagactgaacagccactctcacgctagaggctggtcttgggcaatcttctccgtgggacctgtgtctccttctaggcgctggtcttatcgctgctacgcctacgacagcaactcaccttacgtttggtcactccccagcgatctcctggaacttctggttcccggagtctccaagaagccctctttgagtgtgcagccaggacccatggtagccccaggagaaagcctgactcttcagtgtgtatcagatgtgggatatgatagatttgttctctataaagagggagagcgcgacttcctgcagagacctggatggcaacctcaagccggtctgtcccaggcaaattttacactcggaccagtctctccctctcacggtggtcagtatcggtgctactcagcccataatttgagctccgaatggtcagcaccatctgatccactggacattctcatcactggtcaattctatgataggcctagtttgagtgtgcagcccgtccctacggtcgctccgggaaagaacgtgaccctgctgtgtcagagcaggggccagtttcatacttttctccttacaaaagagggggctggccacccacccctgcacctccggtcagaacaccaggctcagcagaatcaggcagagtttaggatgggccctgtcactagcgctcacgtagggacgtaccgatgttatagctccctgtcgagcaatccctacttgctctccctcccctccgaccccctcgaactcgtcgtctctgccagccttggtcaacaccctcaggattacacagtagaaaaccttatccgcatgggcgtcgccggtttggttctggttgtcctgggtattctgctgttcgaggcccaacattcgcaacgctcgctacaggacgcagctggaaggtag

SEQ ID NO: 228428 - DNA, 1452 bp, Artificial Sequence
  Description of Artificial Sequence: Synthetic coding sequence
atgactcccattttgaccgtcctcatctgcttaggcctttcattgggcccacggacgcacgtgcaagcgggacatctgcccaaacctacgctgtgggcagagccgggaagcgttatcattcaaggatcacccgtgacgctgagatgtcagggtagcctgcaggccgaggagtaccatctgtatagggagaacaagtccgcgagctgggtgcgaaggattcaggaacctggtaagaatggtcagtttcctattccgtctattacttgggagcacgctggccgatatcactgccaatattatagccacaatcactcctcggaatatagcgatcccttagagctcgtggtgaccggggcttattccaagccgaccttgtctgccttacccagcccggtagtgaccctgggtggcaacgtcaccctgcagtgcgtatcacaggtggccttcgacggcttcattctgtgtaaggagggcgaagatgagcacccgcaacgtctcaactctcatagccatgccaggggctggtcctgggcaattttctcagtgggccctgtgtcaccaagcagaagatggtcctatcgctgctacgcatacgattcgaattctccctacgtatggtctcttccatccgatttgctcgagctcttggtacccggagtgtctaaaaaaccgagtttaagcgttcagcccggacctatggttgcccctggcgagagtctgaccctccagtgtgtttcggatgtgggatacgaccggtttgtgctgtacaaggaaggggagagagacttcttgcagagacctgggtggcaacctcaggctggcctgtcccaggctaactttactctgggcccagttagtccatcccacggcggacaataccggtgctatagtgctcataacctgagctctgaatggtcagctccatcagatccattggacattcttatcactggccagttctacgataggccttccctcagcgttcaaccagttccgacagtggcccctggtaaaaatgtaacattgctgtgccagtctcgaggccagttccataccttcctgcttaccaaggagggggctggccacccccctcttcacttgcggtcggaacaccaggcgcagcagaaccaggccgaatttaggatgggccctgtgaccagcgctcacgtggggacatatagatgttacagcagtttgtcaagcaatccttacctcctttccctgccctctgacccgctggaattggtagtgtccgaggctgcagagacattgagccccagccagaacaagactgacagcactactacctctctcggccagcatccacaggattataccgttgagaacctcatccggatgggggtggccggtcttgtccttgtggttttaggaattctcctcttcgaagctcagcactcacagaggagcctgcaggatgccgctgggagatag

SEQ ID NO: 228429 - DNA, 1452 bp, Artificial Sequence
  Description of Artificial Sequence: Synthetic coding sequence
atgacccccattcttactgttctcatatgtttgggcctgtctctcggaccgaggacccacgttcaagccggtcacctacctaagccgacactgtgggccgaacccggttctgtgattattcagggtagcccagtaaccttgcggtgccaaggatcactccaggccgaggaataccacctttaccgggagaacaaatcggcctcctgggtcaggcgtatccaagagccagggaaaaatgggcagtttccaattccctcaatcacatgggagcatgccggaagatatcattgtcagtattattcgcacaaccattctagcgaatactccgatcctctggagctagtggtgaccggcgcatattctaagcctacactgagtgcgctgcccagcccagtggtgaccttgggcggaaacgttactttgcaatgtgtctcgcaagtggctttcgacggatttatactctgcaaggagggagaagacgaacatccacaaagactgaacagtcactctcacgccagagggtggtcctgggcaatctttagtgttggacctgtgtccccgtcgcgcaggtggtcttatcgctgttatgcttatgatagcaactccccctacgtatggtctttaccctcggacttacttgaactcttggtgcctggagtctccaaaaaaccctcgctgtccgtgcagccgggacccatggttgcccctggggagtcgctcaccctgcagtgtgtcagcgacgttggatacgataggtttgtattgtacaaagaaggtgagcgggatttcctacagagacctggctggcagccccaggcaggcctgagccaggccaattttacgctagggcctgtcagtccctcccatggtggccagtatcgctgctactcagcacacaatctcagctctgagtggtcagccccaagcgaccctctcgacattctgattactggtcagttttacgatagaccctctctctcagtacagccagtgcctaccgtggccccaggaaaaaatgttaccctgctatgtcagtctcgaggccagtttcacacctttctgctgacgaaggaaggtgcaggacacccaccccttcacctgaggtccgagcatcaggcacagcagaatcaagctgagttccggatgggccctgtgacctccgcccacgtcggaacatacagatgctacagcagtctgagttcaaacccttatttgttaagccttccctccgatcccctggagcttgtcgtttccgaagctgcagagaccctgtcaccctcgcagaacaagaccgatagtacgacaactagccttggtcaacatccacaggattacaccgtggaaaatctaataagaatgggggtcgccggactggtcctagtggtgctgggcattctgttgtttgaggctcaacattcccagaggtctttgcaggatgccgcaggccgatag

SEQ ID NO: 228430 - DNA, 984 bp, Artificial Sequence
  Description of Artificial Sequence: Synthetic coding sequence
atgacacccatcctcacagtactaatctgcctcggcctgtctctgggcccaagaacccacgtgcaggcaggccacctgcctaagcccaccctgtgggccgaacctggaagcgtgataatccagggtagtccagtaactcttagatgccaaggatcactgcaagctgaggagtaccacctgtatagagagaacaaatctgcttcatgggttagacgtatccaggagccgggaaagaatggacaattcccaataccttcgattacctgggaacatgcagggcgttatcactgtcagtactattcacacaaccactcttcagaatatagcgatccgctcgaactcgtagtcacgggggcatacagcaagcccaccctctccgctttgccaagccccgtagtgaccctgggcggaaacgtgacgcttcagtgcgtctctcaggttgcttttgacggttttatcctgtgtaaagagggagaagacgaacatccacagcgcctgaatagtcattctcacgccagaggttggtcttgggcaatatttagcgttggcccagtgtccccatcccggagatggtcgtaccgctgctatgcctacgactctaatagtccctatgtctggagtctgccttccgatctccttgagctgctggtgcccggtgtcagtaaaaagccatctctctccgttcaacctgggcctatggtggcccctggagaatctttgacactgcaatgtgtgagtgatgtgggctacgacagatttgtactgtacaaggaaggggaaagggactttctccagcgcccaggctggcagccacaggccggattgtctcaggcaaactttactcttgggcctgtttcgccctcccatggcggacaataccgatgctattctgcgcataacctatcaagtgaatggtctgctccctccgatcccctggacatccttatcacggggcagttctatgatcggccaagcctgtcctag

SEQ ID NO: 228431 - DNA, 1320 bp, Artificial Sequence
  Description of Artificial Sequence: Synthetic coding sequence
atgacgcctatcttaaccgtgctcatttgtctgggactatccctcgacccacggacacacgtgcaagccggtcccttgccaaaaccaaccctctgggcagagcctggctctgtgatcacacagggttctcccgttacactgcgatgccagggttcgctggagacccaggagtatcacttgtatcgcgagaagaagactgccctgtggatcacccgcatccctcaagagcttgtgaaaaagggtcaatttcctatccttagcattacctgggagcacgcagggaggtactgctgcatctacggaagccatacagcgggactgtccgagtccagcgacccgctggaacttgtggtgaccggcgcttatagcaaaccaacactcagcgcactgccttcccctgtagtcaccagcggcggaaatgtaactattcagtgcgatagccaggttgctttcgacggttttatcctttgtaaagaaggcgaggatgagcaccctcaatgccttaattctcacagccacgcgcgaggcagctctcgtgcgattttctcggtgggccctgttagcccctctcgtaggtggtcctaccggtgctacggctacgactcccgagcgccatacgtgtggtcacttccatctgacctactaggcctgctggtgcctggcgtctcgaaaaaaccgagcctttccgtgcagcccggtcccgtggttgctcccggagagaaattaacttttcagtgcggctctgacgccggatatgacaggttcgtactatataaagaatggggtagagattttctgcaacggcctggacggcaaccgcaggccggtctgtcccaggctaactttacactggggccagtgagccgtagctacggcggacagtacacctgttctggcgcatacaacctgtcgagtgaatggtctgcacccagcgatccactcgacatcctgattactggccagattagagccagaccttttctcagtgtgcgtcccggaccaaccgtcgccagtggtgaaaacgtgacactcttatgtcagagtcaagggggtatgcacacgtttttgctcaccaaagaaggcgcagcggattctcctctcagattgaaaagcaagagacagagtcataaataccaagccgagttccctatgtctcccgttacttccgcacacgccggaacctataggtgttatggctccctgtcatccaacccctacctgctaactcacccatccgaccctctggaactggttgtcagcggagccgctgagacgttgtcacctcctcagaataagagcgattctaaggccggtgagtag

SEQ ID NO: 228432 - DNA, 1371 bp, Artificial Sequence
  Description of Artificial Sequence: Synthetic coding sequence
atgcatcgcggactgattcatccccagagttcagcagttggcggtgatgccatgactcctatactcacagtgttgatttgcctggggctgagcctggacccaagaactcatgtgcaggcagggccactcccaaaaccgaccctgtgggctgaacccggaagtgtgattacccaggggtctcccgtgacattacggtgccaaggtagtctggagactcaagagtatcacctctaccgcgagaaaaagaccgccctttggattacacggataccccaggaactagtgaaaaaggggcagtttcccatcctctcaattacctgggagcacgccggaaggtactgctgcatttacggtagccatacagctggactgtccgaatcttcagacccccttgaacttgtggtcacaggagcttatagcaagcctaccttgtcggctctgccgtctccagtggttactagcggcggtaacgtgaccatccaatgtgacagccaggttgcattcgacggattcatcctgtgtaaagagggtgaggatgagcacccccaatgccttaacagtcacagtcatgcgcgaggatcctcaagagccatattctctgtagggcctgtgtcaccctctcgcagatggtcataccgctgctatggctacgactctcgggcaccctacgtttggagtctcccttctgacttgcttggtctgcttgtgccaggagtgtccaaaaaaccttccctttcggtgcaaccaggcccagttgtggcaccaggagagaaactgacattccagtgcggctcggacgctggctacgataggttcgttctgtacaaggaatggggaagagacttccttcagcggccaggcaggcagccccaggctgggctgagccaggccaatttcacactggggcctgtgagcaggtcatacgggggtcagtatacatgttcaggggcatataatctaagttccgaatggagcgcccctagtgatccgctagatattctgattactggtcaaataagagcacgaccttttctgagcgtcagaccaggccctacagtcgcttcgggtgagaatgtgacgctcctgtgccaatcccaaggtgggatgcatacttttctgctaactaaagaaggggcagctgattctcctctacggctgaaaagcaagcggcagtcgcataaataccaggccgaattccccatgtcacccgttacatctgctcacgctgggacctaccggtgttacggcagtttaagtagcaacccttacctgctaacccacccctctgatccacttgagcttgtggtctccggagccgctgagacactttctccaccgcagaacaaatccgactccaaggcgggagagtag

SEQ ID NO: 228433 - DNA, 1959 bp, Artificial Sequence
  Description of Artificial Sequence: Synthetic coding sequence
atgacacctatattgacggttctgatatgtctcggcctgagcctcgggccaagaacccatgtccaggctggtcacctgccgaagccaaccctttgggccgaaccaggctcagtgatcacgcaaggatctccagttacattgcgctgccaaggaggccaggaaactcaggaataccggctctatcgggagaaaaaaaccgcgctgtggatcacccgaataccccaggaattagtgaagaaaggccaattccccatacctagtattacctgggagcacgctggccgttaccgctgttattacgggagcgatacagccggaaggagcgagagttcggatcccttggagctggtggtcacaggcgcttacatcaagccaactctgagcgcccaaccttctcccgtcgtgaattccggcggaaatgtcattctgcagtgtgactcgcaggtagcgttcgatggcttcagcctgtgcaaggagggtgaggatgagcatccacagtgcctcaactcccagccccatgcccgtggaagctccagggctatcttctcagtgggacccgtgtctccatcccgacgctggtggtaccgttgctacgcctatgacagtaacagtccttacgaatggtccctcccatctgatcttttagagttactggtactgggcgtatctaagaaacctagcctttctgtccagccgggaccaatcgtggcccctgaagagacccttaccttacaatgcgggtctgacgccggatataacagattcgtcctgtacaaggacggagagagagattttttgcagttagcaggtgctcagccacaggctgggttatctcaagcgaactttactctgggacctgtgagtaggtcctacggaggccagtacaggtgctacggagcccacaacttaagctcagagtggtcagctccctctgatcccctagatatcctgatcgccggacaattttatgatagggtttctctgagtgtccagcctggccctacagtggcttcaggggaaaatgttaccctcctttgccaatcacagggctggatgcagactttcctccttaccaaggaaggtgccgctgatgacccctggcgcctgcgaagtacataccaatcacagaaatatcaggccgaatttcctatgggcccagtgacctccgctcacgcaggaacgtataggtgttacggcagccagagctctaagccatacctgttgacgcacccttccgaccctctcgaactcgtggtgtcaggtccgagcgggggtccttcatcccccacaacaggtcccaccagtacatctgcaggtcctgaggatcagcctcttacccccaccgggtcggaccctcagtcaggcctcggcagacacctgggagtcgtgataggtattctggtggctgtaatcctcctcctgctcctgttactgctcctgttcctgattctcagacaccggaggcagggaaagcactggacgtctacgcagaggaaggccgatttccaacatcccgctggtgcagtgggccctgagccaactgatcggggtctacaatggcgatccagtcccgctgctgatgctcaggaagagaacctttacgccgctgtgaagcacacccagcccgaggacggggtggaaatggatacaagacagagtccacacgacgaggatccacaggctgtgacctatgccgaggtgaagcattctaggcccagacgagagatggcctcccctccatccccgttgtccggtgagtttttggataccaaggaccgccaggccgaagaggacagacaaatggacacagaggcggcagcatccgaggcgcctcaggacgtgacatacgctcagctccacagtctgactctcagacgcgaggcgactgagcctcctccgtcacaggaaggcccatctccggcagttccttcgatctatgcgaccctggccattcactag

SEQ ID NO: 228434 - DNA, 1953 bp, Artificial Sequence
  Description of Artificial Sequence: Synthetic coding sequence
atgacacccattttaacggttctcatctgcctggggctctcactgggcccacggacccacgtgcaggctggccatttgccgaagcctaccctctgggcagagcctggatcagtcataacgcaggggagccccgtgacactgcggtgccaggggggacaggagactcaggaatatagactgtatagagagaagaaaactgctctgtggataacgagaatcccacaggagctcgtcaagaaggggcaatttccaatcccatctatcacatgggagcatgccggaaggtacagatgctactatgggtcggacacggctggaaggagcgaaagttcagatccactggaattggtggtcacaggtgcctacatcaaacccactttatccgcccagcccagccccgtggtgaactccgggggtaatgttattcttcagtgtgactcacaagtggcttttgacggcttttccctgtgtaaggagggggaggacgaacatcctcagtgccttaactcccagccacacgccagggggagcagtagggctatatttagcgtcggacctgtcagtccttcccggaggtggtggtacagatgttatgcatacgactcaaacagcccgtacgagtggtccctgccgtccgacttgctagaactgctcgttttaggcgtgtctaagaagccctctctctccgtgcagcccggaccaatcgtcgctccagaggagacattgaccttgcagtgcggctctgacgccggttacaatcgctttgtcctgtataaagacggagagcgagattttttacagcttgccggagcccagcctcaggctgggctgagtcaggcaaatttcactctggggccagtgtcacgcagttacgggggacagtaccgatgttacggtgcccacaatctgagctccgaatggagcgcccctagtgatcccctggatattctaatcgctggccagttctatgatagagtctccctctctgtgcagcctggaccaaccgtggcctccggcgagaacgtgacacttctatgccagtcacaaggatggatgcaaaccttcctgctcacaaaagagggagcagccgacgatccctggagactgaggtctacataccagagtcagaaatatcaagctgaattcccaatgggcccagtgacctctgcccatgccggtacctacagatgttacggaagtcaaagtagcaaaccttacctgctgacccatccatccgatcctctggagctagtggtctcaggccctagcgggggtcctagttctccgacaacaggccctacgtccacttctggccctgaggaccagccactgaccccaacaggaagcgacccccagtcagggctggggcgacatcttggtgtagtcattgggatcctcgtggcagtgatcctgctacttttactgctgttgctgctgttcctgatattgcgccatcgcagacaggggaagcactggacatcaactcagcgaaaagccgactttcagcatccagctggcgcagtcgggccagagcctactgatcgcggtctgcagtggcgctcttcaccagctgctgacgcccaagaggaaaacctttatgcagctgtcaaacatacccagcctgaagatggggtggagatggatacacgctctcctcacgacgaagatccacaagccgtcacatatgctgaggtaaagcatagtcgccctcggcgagaaatggcgtccccaccttcaccacttagcggcgaattcctagacaccaaagacagacaggccgaggaagatcggcagatggatacggaggccgcagcgtcagaagcaccccaggacgtaacctatgcacagctgcattcacttaccctgcgtcgggaggccactgagcctcccccaagtcaagagggcccttctcctgcggtgccgtcaatctacgccaccctcgctatccactag

SEQ ID NO: 228435 - DNA, 1953 bp, Artificial Sequence
  Description of Artificial Sequence: Synthetic coding sequence
atgaccccgatactaaccgtactgatctgtttagggctctctctggggcctcgcacacatgtccaagccggacacctgcccaaacccacactgtgggccgagccgggtagcgtcattactcagggatcccccgtgactctgagatgtcaaggtggacaagaaacccaggagtatcgtttgtatcgagagaaaaagaccgcactgtggatcaccagaatcccacaggagcttgtgaagaaaggacagttccccattccttcaattacttgggagcacgccggaaggtataggtgctattacgggtcagacacggctggtaggtccgaatcaagtgatcccctggaactggtagttaccggagcatatattaaaccgactctgagcgctcaacccagcccagtggttaattccggtggcaatgttatattgcaatgtgactctcaggttgctttcgacgggtttagcttgtgtaaggaaggagaggatgagcatccccagtgtctgaattctcaaccccacgcccgaggttcgtctagagccatctttagcgtggggcctgtctcgccttcccgacggtggtggtaccgctgttacgcctatgatagcaattccccctatgaatggagtctgccttccgatctgctggagctcctggtcctgggagtgagcaaaaaaccaagcctctcagttcagcccggtccaattgtggctcctgaggagactctgactttacaatgcggaagcgatgcagggtacaataggtttgtgctctacaaagacggagaacgggattttctgcagctggccggagcacaaccccaagctggcttgagccaagccaacttcaccctcgggcctgtctccagaagctacgggggacagtatcggtgttacggagcccataacctttctagcgagtggagcgcaccctccgaccctttggatattttgatagccggacaattctacgaccgggtgagtctgagcgtgcaaccaggcccaacagttgcaagtggggagaatgtgacccttctgtgccagtctcagggatggatgcaaacatttctcctcaccaaagagggcgctgccgacgatccatggaggctcaggtcaacctatcagagtcagaaatatcaagccgaatttccgatgggacctgtcacctccgctcacgctgggacataccggtgttacggctcacagagcagcaaaccatacttactcacacatccttctgatcccctggagctggtggtcagcggcccatccggagggccatcttcacctaccactgggccaacatccacaagcggcccagaggaccaaccgttgactccaacaggatccgacccccagtcaggtctgggccgacacctgggggtggtgatcgggattcttgtggctgtcattcttctcttactgctgttgttgctactgttcctgattctcaggcacaggcggcaaggaaagcactggacaagcacccagcgcaaagctgacttccaacatcccgctggggctgtcgggcctgaacctactgatcgcggactgcaatggagatctagcccagccgctgacgcccaagaagaaaacttatacgccgctgtgaagcacacacaacccgaggacggagtggagatggacactcgatcaccccacgatgaagaccctcaagccgtgacctacgcggaggtgaagcattcccgcccaagacgcgaaatggcctcacctccctcccctctgtcgggtgaatttttggatactaaggatagacaggctgaggaggaccgccagatggacaccgaagcggcagcatcagaggcccctcaagatgtgacatacgcccaactgcattccttgacgctgagaagggaagccacagagccaccaccgagccaggaggggccttctcccgcagtgcccagcatttacgcgacactggctattcattag

SEQ ID NO: 228436 - DNA, 1905 bp, Artificial Sequence
  Description of Artificial Sequence: Synthetic coding sequence
atgacacctatactgactgtgctgatatgtttgggactaagcctgggcccaaggacccatgttcaggccggacacttacctaagcccacattgtgggcggagccgggttcggtgataacccaaggttcccccgtaacccttagatgtcagggaggtcaggagacgcaggaataccgcctgtacagagaaaagaagactgccctgtggatcacacgcattccgcaggagctagtgaagaagggtcaatttccaatcccctcaatcacctgggaacacgccggacgttatcggtgctactatggatccgacacggccggaagaagcgaaagtagcgacccactggagctggtcgtcacgggtgcatatataaagcctacacttagcgcacagccttcccctgtggtgaactcaggcggtaatgtgattctgcagtgtgattcccaggtcgcttttgatggattcagtctgtgtaaagagggagaggacgagcatccccagtgcctcaatagccagccccacgccagagggagctcccgtgccatcttcagtgtaggacccgtctcaccctctcgcagatggtggtatcgatgttacgcttacgacagtaacagcccctacgagtggtcactaccatctgatctgctggagctccttgtcctcggagtgtccaagaagcccagtctgagtgttcaacccggaccaatcgttgctccggaagagaccctgaccctgcagtgcggctccgatgccggatataatcgctttgtgctgtacaaagacggtgagcgagattttctgcagctcgcgggtgcccaaccacaggccggtctgagccaggcaaatttcacactcggccctgtctctagatcctatggtggtcagtacagatgctatggcgcacataatctgtcgtcagagtggtcagcccctagtgacccattagacattctcatcgccggacagttctatgatcgagtttctctttctgtgcaaccaggccctacagtggccagcggagagaacgtaacactgctctgtcagtcacagggttggatgcaaactttcctgttgacaaaagagggggcagcagatgatccatggaggcttcgtagcacataccagagccagaagtaccaggcagaatttccaatgggacctgtgacgtccgctcacgcaggcacctaccgctgttatgggtcccagtcttctaagccttacctgctgactcatccatccgatcctttggagttggtagtgagcgccggaccagaggaccaacctctcaccccgacgggctccgatccccagtcagggttggggcgtcatctcggcgtggtcatcggcatcttggtagcggtgatcctgctgctactgcttttgctgctgctgttcctcattctgcggcaccgcaggcagggcaaacactggaccagtactcaacgaaaggctgactttcagcatcctgccggtgccgtcggcccagagcctacggatcgtggcctgcagtggcgcagttccccggctgctgacgcccaagaggaaaacctgtatgcagctgtcaagcacactcagcccgaagacggggttgaaatggataccaggagtccccacgatgaagaccctcaagctgtgacttacgcagaagtaaagcacagcagaccacggagagagatggccagtcctccctcgcccctgtctggtgaatttttggacaccaaagatcgtcaggccgaggaggatagacagatggatactgaagcagccgcttcagaggcgccacaggacgtcacatacgcacagctgcactctctgactcttaggcgcgaagcaactgaaccacccccatcacaagagggcccttcccctgccgtgcccagtatttacgcaaccctggcaattcattag

SEQ ID NO: 228437 - DNA, 1953 bp, Artificial Sequence
  Description of Artificial Sequence: Synthetic coding sequence
atgaccccaatcctgaccgtcttaatctgtctgggcctcagcctgggtcctcgcacacacgtccaggctggacatctcccaaagccaaccctctgggcggagccaggctctgtcatcacgcaaggctccccagtgaccttgagatgtcaggggggacaggagacacaggagtataggctttacagggaaaagaagacagcactgtggatcacaagaatccctcaagagctggttaagaagggccaattccccatcccatctatcacttgggagcatgctgggaggtacagatgctattacggctcagacaccgctgggcgatccgagtcctccgatcccctagaactcgtggttaccggcgcatacatcaagcccacactgtccgcacaacctagtcctgtcgtgaacagcgggggaaatgtgatcctccagtgcgatagccaggtggcctttgacggcttcagcctgtgtaaagagggggaagatgagcatccgcagtgcttaaactcacagccccacgcccgtggctcctcaagagctatcttctccgtgggaccggtttctccatccagaagatggtggtacagatgctacgcctatgattccaactcaccgtatgaatggtccctgccttcagacctgctcgagctgttggtcctgggcgtgagtaagaagccgagcctatctgtccagccagggcctatagtagctccagaagagactctaactttgcaatgtgggagcgacgcaggatataacagatttgtactctataaggacggcgagcgggatttcttacagcttgccggtgctcagccccaggctggcctgtcccaggctaatttcactctggggcctgtgtccagaagctacgggggacagtatcgttgttacggcgcacacaaccttagcagtgagtggtccgcgccatcggacccccttgatatcctcattgctgggcagttttacgatagagttagtctgtctgtgcaaccaggacctaccgtggcctctggggaaaatgtgaccctgctgtgccagagccaggggtggatgcagaccttcctgctgacaaaggagggggctgccgacgacccctggcggctgaggagcacttatcagtcacaaaagtaccaagccgaatttcccatgggtccagtaacctcagctcacgcaggaacgtatagatgttatggttcccaatcctctaaaccatacctccttacgcacccctccgatcccctggaacttgtcgtgtccgggccttcaggaggcccatcatcacctacgacaggcccaacttccacatccggccctgaggatcagcccctgactccgaccggctcagatcctcagtccgggctggggaggcatcttggggtggtgataggaattcttgtcgccgttattctgttgctactgctgctgctactactctttctgatcttacgccatcgtaggcaggggaagcattggaccagcacccaaagaaaggcagattttcagcacccagctggcgctgtagggccagaacctaccgatagaggccttcagtggagatcctccccggctgccgacgctcaggaagagaacctgtacgctgcagtgaaacatactcagccagaagacggcgttgaaatggatactagatcgcctcatgacgaagatcctcaggccgtgacgtacgcggaggtgaaacactctagaccgcgacgggaaatggcctcccccccaagcccactttcgggcgaattcctggacactaaggaccggcaggctgaggaagaccgacagatggacaccgaagccgcagctagcgaggcccctcaggacgtgacgtatgctcagcttcactccttaacattgcggagagaagccaccgagccgcctccaagccaagagggtcctagtcctgcagttccaagcatatacgccacactggctatccattag

SEQ ID NO: 228438 - DNA, 1533 bp, Artificial Sequence
  Description of Artificial Sequence: Synthetic coding sequence
atgacaccgattttgaccgttctgatatgcttagggttgagtttaggaccacgcacccatgtccaggccggacacctgcctaagcctactctttgggcagagccaggatccgtgataacccaaggaagtcctgtgaccctcagatgccaaggaggccaagaaacccaggagtacaggttatatcgggagaagaagaccgcactctggatcactcgcatcccccaggaactcgtgaagaagggccagtttccgattccctccatcacgtgggagcatgccggtcggtaccgatgttattatggatcagatacagctgggagatcagaatcctcggacccactcgaactagtggttacaggggcttatataaagcctacactttccgcacaaccatcgcctgtcgtaaattccggcggaaatgttattctccaatgcgactcacaggttgcttttgacgggttttcactttgcaaggagggtgaggatgagcacccccagtgcctaaattcgcagccccatgccagggggtccagtagggcaatttttagtgtggggccagtgtccccatcacgccgatggtggtaccgatgctacgcatatgacagtaacagcccatacgaatggtctctgcccagcgacttgctggagctcctcgttcttggggtgtcaaagaagccttctttgtccgttcaacccggtccaatcgttgcccctgaagaaacgctgaccttgcagtgcgggagcgatgccggatacaatcggttcgttctttacaaggacggtgagagagacttcctgcagctggcgggagcccagccacaggctggactatctcaggctaacttcacccttggcccagtgtctcgcagttatgggggacagtacaggtgttatggggcacacaacctgtcatcagaatggagcgcgccttctgatcccctcgacattctgatagccggacaattctatgatcgcgtctcattgagcgtgcagccaggtcccaccgtcgccagcggcgaaaatgtgactttgctgtgccagagccagggttggatgcagacatttctcctcacaaaagaaggcgcagctgacgacccatggcgcttacgttccacatatcagtcacaaaagtatcaggcggaattcccaatggggcctgtcacctcagcccacgctgggacgtacaggtgttacggctctcaaagttcaaagccttatttgctgactcatccatccgaccccttagagctggttgtttcgggcccatcaggaggcccttccagcccaaccacaggacccaccagtacgagcggccctgaggatcaacctctgacgcccaccggcagtgacccgcagtctggtctgggtcggcacctgggtgttgtcatcggaatactggtcgcggtaattctgctgctcttgctgcttctcttgctttttcttatcctgcgccatcgcaggcaggggaaacactggacctcaagccctgcacaacttccaatgcctaggaaaaagacctccatgctcccctag

SEQ ID NO: 228439 - DNA, 1797 bp, Artificial Sequence
  Description of Artificial Sequence: Synthetic coding sequence
atgactccaattgtgacagtacttatctgtcttggactgtctctggggccaaggactcatgtccagaccgggacgatcccgaagccaaccttgtgggccgagccagactcagtcatcacccagggcagcccggtgactctgagctgccagggatctttagaagcgcaggagtaccgactttacagggaaaaaaagtccgctagctggatcacccgcatcagacctgagctggtgaaaaatggtcaatttcacatcccaagcatcacctgggaacacacagggagatacggatgtcagtattactctcgcgcacggtggagcgagctgagcgatcctctcgtattggtcatgactggcgcttacccaaaacccacccttagcgctcagccttctccagtcgtgacatctgggggacgtgttactctgcaatgtgagtcccaggtggccttcgggggttttatcttgtgcaaagaaggtgaggaagaacacccgcagtgtttgaatagtcagccccacgccaggggctcgagtagagcaatatttagtgtcggaccggtctcccctaataggagatggagccatcggtgctatggatatgacctgaacagcccctacgtgtggtcttctccatccgacctcctagaactgttagtccccggagtttcaaagaagccgagcctctcggtgcagccagggccagttgtagccccaggcgaaagcctcacactgcaatgcgtgagtgatgtgggctatgatcggtttgttctgtataaggaaggcgaaagggacctgaggcagcttcctggacggcaaccacaagcagggctatcacaggccaacttcaccctcggccctgtcagtcggagttacggcggacagtatcggtgttacggggctcataacctgtcaagcgagtgtagtgcccctagcgatccccttgacatcttaatcactggccagatccgtggaactccctttatctctgtccagccgggaccgaccgtggcttctggcgagaacgtcaccttactttgccaaagttggagacagtttcatacatttctcctgacaaaagccggtgccgcagacgcacccctgcgactcaggtccattcatgaataccccaagtaccaggctgagttccctatgtcaccagtgacatcagcacacgcgggaacatacaggtgctatggctccctgaactcagacccctacttactcagccatccttctgaaccgttagagctggtggtcagtggacccagtatggggtcctctccacccccaactgggcctatctcaacgccggctgggccagaagaccaacctctgacaccaaccgggagcgacccccagagcggtctcggtagacatttgggagtcgtcataggcatcttggtcgctgtcgtgctgttgctgctgctgcttctgctgctgtttttaattttgcgacatcgcagacaaggtaaacattggacctccacccagcgcaaggccgacttccaacatcctgccggtgcggttggtccggagccaactgacagaggattgcagtggagaagctcacccgctgcagatgcccaggaagagaacctgtacgctgcagtgaaggacacacagcccgaagacggcgtagagatggacacacgcgcagctgccagcgaagctccacaagacgtgacctacgcccagttgcatagcctgaccctgcgaagaaaggctactgagccacctccatcacaggaacgcgagcctcccgctgaaccttcgatctatgccaccctagccatccattag

SEQ ID NO: 228440 - DNA, 1449 bp, Artificial Sequence
  Description of Artificial Sequence: Synthetic coding sequence
atgacaggagcttacccaaaacccacactttctgcccagccgagcccagtggttacctccggcggacgcgtgacactccaatgcgagtcccaggtcgcctttggcggattcatcctctgcaaagagggggaggaagagcaccctcaatgcctcaacagtcagcctcatgcaaggggttcatcgcgcgctatcttcagcgtcgggccagtgagtcccaatagaaggtggagccatagatgctacggatacgacctgaactccccctacgtttggtcctctccctcagacctgctggagctgctggttcctggtgtatctaagaagccctcgttgtctgtgcagccaggtcccgtggtcgctccgggagaatctttaacgctccagtgcgtgagcgacgttggttacgaccgcttcgtgctgtacaaagaaggcgagagggatctacgtcagctccctggacggcagccacaagctggtttatcacaggcaaacttcaccttggggcctgtgagtaggagttatggagggcagtatcggtgttacggagcgcacaatctgagttctgaatgctccgccccatctgaccccctggatatcctgataaccggccagattaggggtacaccgttcatctcagtccagcccggacctacagtcgcctccggagagaatgtcactctgctgtgtcagagttggagacaatttcacacttttctgttaaccaaagcaggagccgctgatgcacctctgagactgcgatcgatccacgagtaccctaaatatcaagcggagttccccatgagtccagtgacatcagcccatgccggtacataccggtgttacggctctctgaacagcgatccctaccttctctcgcacccctcagaaccgttggagctagtggttagcggcccaagcatgggctcttcgccacccccaacagggcctatttccacaccagccggtcctgaggaccagcctttgacgcccacaggcagtgatcctcagagcggattaggcagacatctaggcgtggtaatcgggatactcgtggccgtcgtactcctgttactgctcctgctgctgctatttctgatacttcgccatagaagacaaggcaagcactggacctcaactcagcggaaggctgactttcaacatccagcaggagctgtcggacctgagccgaccgatcgcggattgcagtggcggtcttctccagccgctgatgctcaagaagagaatctgtatgccgctgtcaaggatacccaaccagaggatggcgtggagatggatactagagccgcagcttccgaggcaccacaggatgtcacttacgcgcagttacactcgctgactttacgcagaaaggccaccgagcctcccccatctcaggagagagagcctccagccgaaccttcaatctacgccactctcgccattcattag

SEQ ID NO: 228441 - DNA, 1932 bp, Artificial Sequence
  Description of Artificial Sequence: Synthetic coding sequence
atgacccccgctctcaccgcattactctgtctggggctgagcttgggcccaagaacacgagttcaagctggcccatttcctaagcccacgctttgggccgagcccggtagcgtgatatcatggggctcccctgtcaccatctggtgtcagggtagtcaggaagcccaggagtaccgcctgcacaaagaaggcagtcctgaacccctcgatcggaataatcctctcgaacctaagaataaagccaggttcagcatcccttccatgaccgagcaccatgcaggaaggtatagatgccactattattcctcagcaggctggtccgagccctcagacccactagagatggtgatgacaggtgcatattctaaacccaccttgagcgctttgcccagccctgtcgtggcctctgggggtaacatgacgttgcgatgcggtagccagaaagggtatcatcattttgtcctaatgaaggagggcgaacaccagcttccacgcacacttgatagccaacaactgcacagccggggttttcaagctctgtttccagtcggccctgtgacaccaagtcaccgctggcgattcacgtgctactactattacaccaatacaccatgggtgtggtcacacccatctgaccctctggaaatcctcccatcaggagttagccggaaaccctccctgctgacactgcagggtcctgttctagcgccaggccaatcccttacacttcagtgtgggagcgacgttggatataaccgtttcgtgctctacaaggaaggagaaagggactttctgcaaagacccggtcagcaacctcaggcaggactcagtcaggctaatttcacactgggacccgtatccccctccaacggaggtcagtatcgttgctacggggcacacaatctgtccagtgagtggtcggcgccttcagatccgctcaacatccttatggcgggacagatctacgacactgtgtcactcagcgctcagcctggcccaacggttgcctccggagagaacgttaccctgctgtgccagagttggtggcaatttgatacttttcttctgaccaaagaaggagctgcccatcctccactccgcctgcggtcaatgtatggcgcacacaagtatcaggctgaatttccaatgtcacctgtgacaagcgcacatgcaggtacctatcgctgctatggctcttactcaagcaacccacacctattaagccaccctagcgagcctctggagctggtagtctctgggccagaggatcagcctctgaaccccccaggctccggtcctcagaaccccccaggtctcgggtccggtgcgggtacacgggcagcagggctgggccgttatctggaggtgctcattggcgtgagcgtggcatttgtgctgctcttgtttctcctgctgtttctgctccttagacgacagcgccattcgaaacaccgtacctctgatcagagaaagacagatttccaaaggccggcaggcgctgccgagactgagcccaaagatagagggctgctccgacggtcatctcccgcagctgatgtccaggaggaaaacctttacgccgctgtgaaagatacgcaaagcgaggatagggtggagcttgacagtcagtcaccccatgacgaggacccacaagctgtgacttacgcccctgtgaaacacagttcccccaggagagaaatggctagtcctccatcctctctttctggcgaattccttgacaccaaggatcgacaagtcgaagaggatcgacagatggataccgaagcagcagcatcagaagcgtcacaggatgtgacttatgcacagctgcacagcctaaccctgcgcaggaaggccactgaacctccccctagtcaggaaggtgaaccacctgccgagcccagcatctatgccaccctggccatccactag

SEQ ID NO: 228442 - DNA, 1896 bp, Artificial Sequence
  Description of Artificial Sequence: Synthetic coding sequence
atgacacccgcactcacggccctgctctgtctgggtctgtccttaggccctcggaccagagtccaggctggaccattcccaaaaccgactctgtgggcagaacccggttcggtcattagttggggttcccccgtcacaatatggtgccagggttcgcaggaggctcaggagtaccgtctgcacaaggagggtagtcccgagccattagacagaaataatcctctggaaccaaaaaataaggccagatttagcattccttctatgacagagcaccacgcagggagatatcggtgccactactactcatctgccggttggtcagagccatccgatccattagagatggtgatgacgggcgcatactccaagcccaccctgtccgcacttcctagcccggtagtggcgtctggcggaaatatgactctacgctgtggatcccaaaagggatatcaccattttgtcctaatgaaagagggcgaacatcagctcccaaggaccctggattctcagcagctacactcacggggttttcaggccctgttcccggttggacctgtgaccccctcacaccggtggcgctttacatgctattattattacaccaacacaccctgggtgtggtcccacccatctgaccctctggagatacttccaagcggtgtgtcccggaagccgagcctgctgactctccaagggcctgtactcgcccctggacagagcttgactctgcagtgcggctccgacgtaggatacaacagattcgtgttgtacaaggaaggcgagagggactttctgcagcgccctggacaacaaccacaagctggcctgtctcaagctaatttcactctaggacccgtcagtccatctaacggcggacagtacaggtgctatggagcccataatctctcatcagaatggtctgccccatccgaccccctgaatattctgatggctggacagatctatgacaccgtctccctgagcgcacagcccggacccacagttgccagcggcgaaaacgtgacactgctgtgtcagtcatggtggcaatttgatacattcctgctcacaaaagaaggcgcagctcacccacccctaagacttcggtccatgtacggagcgcataagtaccaggcggaattccctatgagccccgtgaccagcgctcacgctgggacatacaggtgctacggaagttactcctccaacccgcacttactatctcaccccagcgagcccttagagctggtggtcagcgggcattctgggggatcatccttgccaccaactgggccaccatccaccccagggcttggtaggtacctggaggttctgattggagtgtctgtggcctttgtcttgctgctgtttctgttgttgtttctgttactgcgaagacagcgccacagtaagcataggacctccgatcagaggaagactgatttccaacgccctgccggagctgccgagactgagccaaaggacagggggctgctgcggaggagcagtccggcagccgacgtgcaggaggaaaacctgtacgccgctgttaaagacacacaatcggaggacagggtggagctggatagccaaagccctcacgacgaggaccctcaggcggtgacctacgccccagtgaagcactccagtcccaggcgagaaatggcctccccaccaagtagtctgtcgggagagttcctagatacaaaggacagacaggtagaagaggatcgacagatggacactgaggccgcagcgtctgaggcttcacaagatgtgacttacgctcagctccacagcttgacattaagaaggaaggctacagaaccccctccttcccaagagggggagcccccagcagaaccctccatctatgctaccttggcgatccattag

SEQ ID NO: 228443 - DNA, 1947 bp, Artificial Sequence
  Description of Artificial Sequence: Synthetic coding sequence
atgacacctgccctgacggcgctcttgtgtctcggactgagtttgggccctagaactcgagttcaagcgggtccattccccaagcctactttgtgggctgaacccggaagcgtgatctcttggggatcccccgtcacaatctggtgccagggcagcctggaagcacaggaataccagctggacaaggagggctctcccgagcctctggacagaaacaacccgctggagcccaagaacaaggccagattcagtatcccttccatgacccagcaccacgccggtcgatacagatgccattattactcctctgctggatggagtgaaccaagtgatcccttggaactggtgatgacgggagcatattccaagcctactctgtccgcccttccaagtccagtggtagctagcggcggtaatatgactctgaggtgcggaagtcagaagggatatcaccattttgtgctcatgaaagagggcgaacaccagctgcctcggaccctggactcccagcagctgcatagccgcggtttccaggctctgttcccagtgggaccagttaccccatcacatagatggcgatttacctgttactactattacaccaatactccctgggtctggtcgcacccctcagaccctttggagatcctccccagcggtgtaagtcggaaaccatctcttctgaccctccaggggccagtgttggcgccaggccagagcctcaccttgcaatgcggctcagatgtggggtataaccggttcgtgctctacaaggaaggggagagggatttccttcagagacccggtcaacagccacaggctggactctcacaggcgaatttcacattggggccagtaagcccttccaacggtggtcaatatcggtgttacggcgctcacaatctgtcaagtgaatggtcggccccttcagaccctctcaacatcctcatggcaggccagatttatgacacagtttcgctctctgcccagccgggtcctacagtggccagtggtgagaacgtaactctgttgtgccagagctggtggcagttcgacaccttcttactaaccaaagaaggggcagcacatccgccactccggctccggtccatgtacggcgcacacaaataccaggccgaatttcccatgtctccagtgacgtcagctcatgccggtacatacagatgttatggatcatacagtagtaaccctcatctgctgtctcacccgagcgagcctctagaacttgtggtgtcgggacacagtggcggtagcagcctgcctccaacaggacccccaagcacccctgggggtccagaagaccagccgctgaaccctcccggttcaggtcctcaaaatagactgggccgttatttagaggtgctgatcggtgtgagcgttgccttcgttctcttgttattcctactgctctttctgcttcttcggagacagaggcactctaaacatcggaccagcgaccaaaggaaaaccgactttcagcgaccagcgggagcggcagaaaccgagccaaaagacaggggtcttctgcggaggagttctccagcagcagatgtccaggaggagaatctctatgctgctgtcaaagacacccagtccgaggatagggtggagctcgatagtcaatcccctcacgatgaggacccgcaagccgtaacttacgctccagtaaaacatagctctccgcgtcgggagatggcctcccctccttcgtctctgtcgggggaattcttggataccaaggatcggcaggtcgaggaagacaggcagatggatacggaggcagccgcaagtgaagcatcacaggatgtgacttacgcacaacttcactccctcaccctgcggagaaaggccacagagccacccccttcccaggaaggcgaacctcctgctgagccatccatctatgctaccctcgccatacactag

SEQ ID NO: 228444 - DNA, 1896 bp, Artificial Sequence
  Description of Artificial Sequence: Synthetic coding sequence
atgacgcccgctctgactgctctgctgtgtctggggttatctctgggcccacgaaccagagtgcaagcagggccattcccaaagccaaccctgtgggccgaaccagggagcgtcatcagttggggctcacccgtaacaatttggtgccagggttctcaggaggcccaggagtaccggcttcataaagagggaagtccagaacccctcgaccgcaataatccattggaaccaaagaataaagctagattctctattccatccatgaccgaacatcacgccggacggtacaggtgtcattactactccagcgcaggctggtcagagcccagcgaccccctcgaaatggtgatgaccggagcctattctaagcctacacttagcgccctgccatctccagtggtggccagtggtgggaacatgaccctgcgctgcggaagccaaaaaggctaccaccatttcgtgttaatgaaggaaggcgagcaccagttgccgagaacactggactcccagcaactacattccagaggcttccaggccctcttcccagtaggtccagtaacaccatctcatcgttggaggttcacatgttactactactacaccaacaccccatgggtgtggtcccaccctagcgatccccttgaaattctgcccagcggcgtctctagaaagccgtccctgctcacactccagggaccggtgcttgcgcctggacagagtctgacactgcagtgtgggtcggatgtaggatataatcggtttgtgctatacaaagagggagaacgagattttttgcaacgcccaggacaacaacctcaagccggactgtcacaggccaactttacactagggcctgtgagcccgagtaatggtggacaataccggtgctacggcgcacacaacctcagttctgagtggtccgcgccatccgatcccctgaacatattgatggccggtcagatctacgataccgtgtctttgagcgctcaacccggtcctaccgtggcaagtggcgagaatgtgaccttactctgtcagagctggtggcagtttgacaccttccttctgacaaaagaaggagccgcacacccacctttaagactccgaagcatgtacggagctcacaaataccaggcggaattccccatgagccccgtgacatcggcacatgccggaacttaccggtgttatggctcctattcatcaaacccgcacctgctttctcatccgagtgagccactcgagcttgtcgtttctgggcacagtggtggctccagcctgcccccaacgggcccaccgagcacaccaggtctggggcgatatttggaggtgctcattggggtttctgttgctttcgtgctcttactctttctgctcctattcttacttctgcggagacaacggcactctaagcacaggacctcagaccagcggaaaactgattttcagcgtcccgctggcgctgccgaaacggagcctaaagaccgcggtctgttaagacggtcaagtcctgcggcagatgtacaagaggagaatctgtatgctgctgtgaaagacactcagtcagaggatcgggtggagctggattctcaatcaccacatgatgaggatcctcaggctgtgacctacgccccagttaagcactcctcacctcgtcgggagatggcctcccccccttcgtcactatccggggagtttttggacaccaaggatcgtcaggtggaggaggacagacagatggatacggaggccgctgcctccgaggcctcacaggacgtgacttatgcgcagctgcattctcttaccctccgaagaaaggccacggagccgcctccgtctcaggaaggcgagccacctgctgagccctcaatctatgcaactctcgcaatccattag

SEQ ID NO: 228445 - DNA, 477 bp, Artificial Sequence
  Description of Artificial Sequence: Synthetic coding sequence
atgacccccgcattgaccgcccttctgtgtctggggttatccctgggacctaggacccgagtgcaagccggaccttttcctaaaccaacgctgtgggccgaacctggttccgtgatctcgtggggctcaccggtgaccatctggtgccaggggagccaggaagctcaggagtataggctgcacaaggagggctctcccgaaccccttgaccgcaacaacccattggaacctaaaaataaggcaaggttttctattccgtccatgactgagcatcacgcgggacgatacagatgccactactacagttctgctggctggagcgagcccagtgaccctttggagatggtcatgacgggcgcttatagcaaacctactttatctgcccttccctcacccgtcgttgcctccggcggtaatatgaccctgaggtgtggaagccaaaagggctatcatcactttgtgcttatgaaagagtag

SEQ ID NO: 228446 - DNA, 1347 bp, Artificial Sequence
  Description of Artificial Sequence: Synthetic coding sequence
atgatccccaccttcacggcccttttgtgtcttggcctctctctgggtccgaggacccacatgcaggctggcccattgcccaaacccaccctttgggctgagccaggttccgtcattagctggggaaattctgtgaccatctggtgccagggcactctggaggcaagggagtacaggcttgacaaggaggagtcaccagccccttgggataggcaaaatcccttggagcctaagaacaaggccagattttctattccatctatgacggaagattatgcaggccgataccgatgttactacaggtcgcccgtggggtggtcccaacctagtgatcctcttgagcttgtcatgacgggggcttacagtaagccgaccctttctgcccttccatcccctctagtgacgtctggtaagtccgtgaccctattgtgtcagagtcgctcccccatggacacgtttctgctgattaaggagagagctgcacatcctcttctgcatttgagaagcgagcatggtgcacagcaacaccaggccgagtttcctatgagccccgttacttcagttcacggaggtacctatcgatgcttcagttcacatgggttctcccattatctgctgtcccaccctagcgacccactcgagttaatcgtgtcaggctcactcgaagatccacggccatctcccacaagaagcgtgtccaccgctgccggtcccgaagaccagccactcatgcctaccggctctgttcctcatagcgggctcaggcggcattgggaagtgttgatcggagtcctcgtggttagcatcctcctgctgtccctactgctgtttctcttgctgcagcactggaggcagggcaaacacagaacccttgcccagcggcaggccgattttcagagaccaccaggcgcagcagagcccgagccgaaagacggcggactccagagacgatcctcacctgccgcagatgtccagggggaaaacttctgcgcggctgtgaagaacactcaacccgaggatggtgtagaaatggacaccagacaatcaccccatgacgaggatccccaggccgtcacctacgcgaaggtgaagcatagtagacccagaagagagatggccagtcccccttctcccctgtctggggagttcctggataccaaggacagacaggccgaggaggaccggcagatggacactgaggcagctgcaagtgaggctccgcaggatgtaacatatgcccagttacactctttcacactccggcagaaagcaactgagccacccccatcccaggagggcgcttccccggcagagccctcagtgtacgccacacttgctatccattag

SEQ ID NO: 228447 - DNA, 1347 bp, Artificial Sequence
  Description of Artificial Sequence: Synthetic coding sequence
atgatcccgacgtttaccgcactgctttgcttaggtctgagccttggaccacggacacacatgcaagctgggccactgcctaagccaaccctgtgggctgagccaggaagcgtcatttcctggggtaactctgttacgatctggtgtcaggggactctggaggcaagggaataccggttggacaaggaggaatcccccgctccctgggaccgtcagaaccctcttgaacccaaaaacaaggctcgattttctattccttcaatgacggaagattacgccggtcggtatcggtgctactacaggagtcctgtcggctggtcccagccctccgatcccctggaactggtcatgactggtgcgtactctaaacccactttgtccgcattaccctcccccctcgtcacgtcaggtaagagcgtaaccctgctctgccagagtaggagtccgatggatacattcctgttgataaaggagcgcgcagcacacccattactgcatctccgcagcgaacacggggctcagcagcatcaggccgagttcccaatgtctcctgtgacatccgtccacggaggtacctatagatgtttcagctcccatggtttttcccactacctcctatcacacccttctgatcctttagaactcatcgttagcggcagtttggaggaccctagaccttcaccaacaaggtccgtgagcaccgccgctggcccagaggaccagccgctgatgcccaccggttccgtgccacactccggcctccggagacactgggaggtgctgataggggtgctagtagtgtccattctgctgctttctttgctgctgttcctcctgttgcagcactggcgccagggaaagcaccgaactttggcccaaagacaggcagattttcagaggccccctggggctgcggaacccgaaccaaaggacggaggcctacagcgaaggtctagccctgccgctgacgtgcagggggagaacttctgtgcagctgtcaagaacactcagccagaggatggagtggagatggatacacggcagtccccacacgacgaagatccacaggccgtgacatatgccaaggtaaaacactctcgcccacggagagaaatggctagtcccccttcccccttgtccggcgaattcttagacacaaaagaccgacaagccgaggaagataggcaaatggatacagaggctgcagccagcgaggctccacaggatgttacatatgcccagctccactccttcactctgaggcagaaagcaactgagccacccccaagccaggagggcgctagtccagccgagcctagtgtttatgcaaccctggctatacattag

SEQ ID NO: 228448 - DNA, 1773 bp, Artificial Sequence
  Description of Artificial Sequence: Synthetic coding sequence
atgaccttgacactgagcgtgctgatctgcctcgggctttctgttggtccaagaacgtgtgttcaggctggaaccctgccaaagcccaccttgtgggcagagccggcatcagtaatcgcccgtgggaagcccgtgacactgtggtgccaaggtcctttggaaactgaggaatatcgcttggacaaagaggggctcccttgggccagaaaacgtcagaatccactggaacctggggcaaaagccaagtttcatataccatctaccgtttacgacagcgcaggtcggtacaggtgttactatgaaacccctgccggatggtccgaaccatccgatccactggagctggtcgccacagggttttacgctgagcccacgttgttggcactaccgtcaccagttgtggcgtccggaggcaacgtcaccctgcaatgcgacactctcgacggtctgctgacattcgtcttggtggaggaggaacagaagcttcccaggaccctctactctcagaagctcccgaaagggccatctcaggcgttatttcctgttggacctgtgactccatcctgtcgatggcggtttaggtgttattattattatagaaagaatcctcaagtgtggtcaaacccatccgaccttctggagattcttgtgccaggcgtttccagaaaacccagcttgctcattcctcaaggaagcgtggtggcccgaggaggttcccttactttgcagtgccgaagcgacgtagggtacgatatattcgtgctgtataaagagggtgagcacgacctcgtccagggaagtgggcagcagccgcaggcaggactgagccaggccaactttaccctgggacccgtttccagaagtcacggaggtcaatacagatgttatggcgctcataatctgtcaccaaggtggagtgccccatctgatcctctcgacattctgatcgcaggtctgattcccgacatcccggctttgtcagtacagcccggtcctaaagtcgcgtcaggtgagaacgttacgttactctgccaatcctggcaccagatcgatacattctttctgaccaaggagggcgctgcccaccctccactgtgtctcaagagcaaatatcagtcctatcgccaccaagctgaatttagcatgtcaccggtgacatctgcccagggtggtacctatcgatgctattctgctatccggtcttacccatatctgctctcaagtccatcctatccacaggaattggtagtttccgggccttccggtgatccttccctatctcctactggctccacccctaccccagggccagaagatcagccactgaccccaaccggtctggatccgcagagcggcctcggcaggcacttgggcgtagttacaggggtctctgttgcgtttgtgttgctgctgttcctgctcctcttcttgctcctgaggcatcggcaccaatccaagcaccgaacgtccgcacatttctaccgcccagccggagccgcagggcctgagcctaaagatcagggactgcaaaagagggctagtcctgtggcagatatccaggaagagattctcaatgctgcagtgaaggatacacagcctaaagacggtgtggagatggacgcccgagctgccgctagcgaggcccctcaggatgtgacctacgctcagctccattccctgacactccgcagggaggcgactgaaccccctccttcacaggaacgcgaaccacctgctgaaccctcaatttacgctcccctggctattcactag

SEQ ID NO: 228449 - DNA, 1776 bp, Artificial Sequence
  Description of Artificial Sequence: Synthetic coding sequence
atgactctgacactctccgtgctgatttgtctggggctctccgttgggcctcgaacatgcgtacaagctgggacactgccaaagccgactctgtgggccgaaccagctagcgtgatcgcaagaggtaagccagtgactctgtggtgccagggacccctagagaccgaagagtatcgcttagacaaggaaggcttgccttgggccaggaagaggcagaatccgcttgagcccggagctaaagccaagttccacattcccagcacagtgtatgactccgccggaaggtatcggtgctattatgagaccccagcaggatggtctgagccctcagaccccttggagcttgtcgctaccggcttctacgcagagcctacacttctggcactgcccagtcctgtcgtagcgagtgggggaaatgtgacactgcagtgcgacacactggatggcctgcttaccttcgtgttggtagaagaagaacaaaaactgccccgaaccctgtatagtcagaaactgccaaagggtccatcccaggctctgtttcccgtgggccctgtgaccccatcctgcagatggaggtttaggtgttattattattaccgcaagaacccgcaggtgtggtccaacccttcagatttactcgagattctggtgcccggagtgtctaggaagccttcacttcttattcctcaggggagcgttgtggcccgaggtggatcacttaccctgcagtgtagatccgatgtgggctacgatatcttcgtcctctacaaggagggggagcacgatttagtacagggctccgggcagcagcctcaggccggactgtcacaggccaattttaccctgggaccggtgtcacgaagtcacggaggacagtaccgttgctacggggctcataatctttctcctcgctggtccgccccttcggatcctctagatatcctgatagctggccttatcccagatattcccgctctctctgtacagccaggccctaaggttgcttctggggagaatgtgactctgctatgccagtcgtggcatcagatagatactttttttctcacaaaggaaggtgccgcacacccacccctgtgtcttaagtctaagtaccagagttaccgccatcaggcagagttttctatgtcccccgtgacatcggcccagggtggcacttataggtgctactccgccattagaagttacccatatttgctctcctccccctcctatccccaggagttagtggtctctggcccatccggagacccaagcctgtctcctacggggtccacccctacccctgcaggccctgaggatcaacccctaacccctactgggctcgatccacagtcaggattgggaagacacctaggggtggttaccggtgtgtctgtagcttttgtgcttttgttgtttctcctgctgttccttctacttcgccatagacaccagagcaaacaccggaccagcgcacatttttacaggccggcaggagcagcaggcccagaacctaaggaccaagggttgcagaagagagcctctcccgtggccgacatccaggaggaaatattaaatgccgcagtcaaagacacccaacctaaggatggcgtcgaaatggatgcacgcgcagcggctagcgaggcccctcaagacgttacgtacgcacagctgcattctctcaccctacgcagggaagccaccgagcctcctccaagtcaggagagggagccacctgcggagccgagcatatatgcgccactggctatccattag

SEQ ID NO: 228450 - DNA, 1869 bp, Artificial Sequence
  Description of Artificial Sequence: Synthetic coding sequence
atgacactcactctgagcgtgctcatctgcctgggcttaagcgtgggtccacgcacatgtgtgcaggctggaacactccccaaacccactttgtgggcagagccagcctccgttatcgccagggggaagcccgtgactctgtggtgccagggaccactggagactgaagaataccggctggacaaggagggtctgccctgggctcggaagagacagaatccccttgagccgggtgccaaggccaagtttcacatcccgtcaactgtatacgacagtgccggaaggtacaggtgttactacgagacacccgcaggctggtcagagcccagcgacccactggaactggtagctactgccctgccctccccagtagttgctagcgggggaaatgttactctacagtgtgacacactggacggtcttcttacttttgtccttgttgaggaggagcagaagcttcctaggacgctttattcccagaaactgcctaagggccctagtcaagcactctttccagtgggtcctgtcaccccctcttgccggtggcggttcagatgctactattactatcggaaaaatccacaggtttggagtaaccccagtgacctgcttgagattctggtccccggagtcagtcggaagccaagtttgttaatcccccaggggtcggtggttgcccgaggcggaagtctgacgctgcagtgtcggagcgacgttggttacgacatcttcgtgctgtataaggaaggagagcacgatttggtgcaagggtctggtcagcaaccacaggccggtctctctcaggccaattttactctcgggccagtaagcaggagccatggtgggcaatatcgctgctacggtgcgcacaatctgtctcccagatggtccgcaccatctgaccccctcgacattctgattgcgggtcttatccctgatataccagccttatcagttcagcccggacctaaggttgcttctggtgagaatgttacgctgctgtgtcaatcttggcaccagattgacaccttctttctaactaaggagggcgctgcccaccctcccttgtgcctgaagagcaaataccagtcctacagacaccaggccgaattctcaatgtcaccggttacctctgcacagggcggtacgtacagatgttattccgctatccgcagttacccctatctgctgtcttccccatcctaccctcaggaactggtggtgagcggacccagcggagacccatccctgagccctaccgggtctactcctactccggctggaccagaagaccagcctcttacccctacaggactcgacccacaatcagggcttggtcgccacctaggcgtagtcaccggagtctccgtcgcttttgtcctgctcctcttcttgctactcttcctcctgctgcggcataggcaccaatcgaagcacagaactagtgcccacttttatcgaccagccggtgctgcagggccagaaccaaaggatcagggcctccagaagcgggcatcccccgttgcagacattcaggaggaaatcttaaatgccgcagtgaaggatactcagcccaaggatggagtcgaaatggacgcccgacagtccccacacgatgaggaccctcaggccgtaacatatgccgaggtgaaacattcaagacctcgcagagagatggcctccccccctagcccactgtcaggtgaattccttgacactaaagaccggcaggcagaggaggacagacagatggataccgagagagtcctcagctcacctggcccacaggcctcacctcccccacctagatctctgccgttgacgcttcctcggtgccggctcctgcatctgaagccgccacgcatgtag

SEQ ID NO: 228451 - DNA, 2595 bp, Artificial Sequence
  Description of Artificial Sequence: Synthetic coding sequence
atgggatgttggggccagctgttggtgtggttcggtgcagcaggtgccattctgtgctcctcgccaggctcccaagaaacatttctgcgaagctcccctctgccactcgcctccccctctcccagagacccaaaggtatccgccccaccctcaatcctggaacccgcatctccgcttaatagtcccggaacagagggatcctggctgttttctacttgcggcgcatcaggtaggcacgggccaacacagacccaatgcgacggagcttacgctggaaccagcgtagttgtgactgtgggcgcagccggacaactgagaggagttcagttgtggagggtccctggtcccggtcagtacttaattagtgcttacggggctgctgggggaaagggtgcgaagaaccacctgtctagagcacacggcgtgttcgtgtcagctatattctccctgggactgggcgaatctctgtacatcttggtgggacagcagggcgaggatgcatgtcccggaggaagccccgaatcccagctcgtttgcttgggcgaaagtcgcgcagtagaggaacacgccgcaatggatggcagtgaaggagttcccggttcacgtcggtgggccggagggggtggaggtgggggtggtgcgacctatgtatttcgcgtgcgcgcaggcgagctggaacctttactagttgccgctggcggagggggacgagcttacttgaggcccagagatcgcggaagaactcaagcctcgcctgaaaagctggagaaccggtcagaggcccctggctctggagggcgaggtggggctgcaggagggggaggcggttggacatctagggccccttcgccacaagcaggccgttcactgcaagaaggagctgaagggggacagggatgttctgaagcatgggctaccctcgggtgggctgcagccggagggttcggaggaggaggcggtgcttgtactgctggagggggaggcggaggatacaggggcggagacgcttctgaaacagacaacttgtgggcagacggagaggacggcgtgtcctttattcatccaagctcagagttatttttgcagcctctcgctgtgaccgagaaccacggcgaggttgagatacgcagacacctgaactgcagccactgcccactgagggattgccagtggcaggcagaactccagctggccgagtgtttatgtccagaagggatggagctcgctgtggacaacgtgacttgtatggatcttcacaagcccccaggtcccctcgtcttgatggttgccgtcgtggccactagtactttatcgttgctcatggtgtgcggtgttctgatcctggtcaagcagaagaagtggcaaggccttcaggaaatgcgattgccctccccagagctggaactgtctaaactgcggaccagtgctattcggacggcaccaaatccatactattgccaggtggggctgggccctgctcaatcctggcccttaccacccggtgtgacagaagttagtccagcgaatgtgacactcctgagggccctcgggcacggtgcattcggggaagtgtacgagggcctggttatcggattaccaggcgactcgtctccactgcaggtggcgattaagactctgccagagctgtgcagcccgcaggatgaactggatttcttaatggaggctctcattatctctaaatttagacaccagaacatcgttaggtgcgtcgggcttagcctaagggcgaccccccgactcatcctgcttgaactaatgtctggtggggacatgaaatcattcctgagacatagccggccacacttgggccagccctcacctctggtaatgcgggatttgcttcagcttgctcaggacatcgcccagggttgccactatctggaggaaaatcacttcatccatagggatattgccgctcggaattgcctgctttcctgtgctggcccaagccgagtagcaaaaatcggcgacttcggtatggcgagggacatttatagggcctcgtattacagacggggagaccgcgcactattgcctgtcaagtggatgccaccagaagccttcttggaggggattttcactagcaagaccgattcttggagtttcggcgtcttgctgtgggaaatcttcagcctggggtacatgccctaccctggaaggacaaaccaagaagtactggacttcgtggttgggggtggtcggatggacccgcctagaggatgcccagggcctgtctacagaatcatgacgcaatgttggcaacatgaaccagagttgagacccagcttcgcatctattctggaacggctgcaatactgtacacaggaccccgacgtgctcaactctttactgccgatggagctggggccaacacctgaggaggagggtacttcaggacttgggaaccggagtctcgaatgtctcaggcctccacagcctcaggagctctcacctgagaaacttaagtcatggggcggttcccccctgggaccatggttatcctctggcttgaagccactcaagtcgagagggcttcaaccgcaaaacttgtggaaccccacatatagatcttag

SEQ ID NO: 228452 - DNA, 2412 bp, Artificial Sequence
  Description of Artificial Sequence: Synthetic coding sequence
atgggttgctggggtcaattactcgtgtggttcggtgcggcaggagccatcctatgtagctccccgggttcccaggagacctttctgcggagctcacccctccccctggcatcaccgtcaccaagagatcccaaggtctcagcccctccttcaattcttgagccagcctcaccactcaattcacccggaacagaaggatcttggctgttttccacatgcggcgcaagtggcaggcacggcccaacccagacacaatgcgatggagcatatgcgggaacaagcgtcgttgtgacagtgggcgctgccggacaacttagaggcgtccagctctggcgcgtacccggtcctggccagtacctcatctcagcatatggcgctgctggtggcaaaggggcaaaaaatcatctgtctcgcgctcacggagtgttcgtgtctgccatcttctccctgggtctgggagagagcctctatatactggtggggcagcagggcgaagatgcctgtccgggagggagccccgagtctcagctcgtttgcttgggtgagagccgagccgtggaggaacacgcagctatggacggcagtgaaggagtgccagggagtagacgatgggcgggtggtggcggagggggagggggagccacgtacgtgttcagagtgagagcaggcgaactcgagcccctactcgttgcggctggaggtggcggacgggcatatttgcgcccaagggatcggggaagaactcaggccagccctgagaagttggaaaaccggtccgaagcgcctggatcagggggacgaggcggtgctgctggcggagatgcttctgagacggacaatctctgggcggacggggaagatggtgtctctttcatacatccatcttccgaattatttctccagccactggcagtaacggagaatcatggagaagtcgaaattcgcagacaccttaattgttcccactgtccgttaagggattgtcaatggcaagctgaactccaactggccgaatgtctctgcccagagggcatggagttggctgtggataatgtgacgtgcatggacctccacaaacctcctggtccactcgttttgatggttgccgttgtggcaacatctacactgagcctgctcatggtctgcggagttctgatcctagttaaacagaaaaagtggcaaggtctacaggaaatgaggctgccttcccccgagctggagctcagtaagctacgcacgagtgctattcgcacagccccaaacccttattattgtcaggtgggtctgggcccagctcagtcatggcccctgccacccggtgtgacggaggtgtctccagcaaatgttactcttctgagggcactgggccacggggcattcggggaggtctatgagggacttgttataggacttccaggagattcatcaccactgcaggttgcaatcaaaaccttgccagaactctgctcgccgcaggatgaacttgactttctgatggaggctctgatcatctctaaattccgccaccaaaatattgtaagatgtgtgggtctctcactccgtgcgacaccccgactgatactcttagagctgatgtctggaggtgatatgaagagcttccttaggcactctaggcctcatcttggtcagcccagtcccctggtgatgcgcgacctacttcagttggcccaagacatagctcaggggtgccattacctcgaagagaaccatttcattcaccgagatattgccgcaagaaactgtctcctgtcttgcgccggtccaagtcgtgtcgcgaagatcggcgactttggcatggccagagatatctaccgggctagctactacagaagaggcgaccgggctctcttaccggtaaagtggatgcccccagaagcctttttggaggggatctttaccagcaagactgattcatggagtttcggcgtgctgctttgggaaattttcagtctgggctacatgccatacccgggaagaacgaatcaggaggtgctggactttgtcgtagggggtggacgaatggatccacccagaggatgcccaggccctgtttatcgaataatgacccagtgctggcaacatgagcctgagctgcggccatccttcgccagtatacttgagcggctgcaatattgcactcaggatccggacgtcttaaactcattgctacctatggaactgggtccaaccccagaagaagagggaacttctggacttggtaataggagcctggagtgcctgcggcctccccagccacaggaactttcgcctgagaaactgaagagctggggtgggtcacccctcggcccttggctctctagcgggctgaagccattgaagtctagagggctccagccccagaacctttggaacccaacctatcgaagttag

SEQ ID NO: 228453 - DNA, 1437 bp, Artificial Sequence
  Description of Artificial Sequence: Synthetic coding sequence
atgggatgttggggccagctgttggtgtggttcggcgctgccggagctattttgtgctcaagcccgggatcacaggagacattcctcagatccagccctcttccgctggcgtccccatcccctcgggacccaaaggtgagcgcccctccaagtatccttgagcccgcttcacccctaaactcacctggtaccgaaggatcatggctgttttccacatgtggtgccagcgggaggcacggcccaacccagacacagtgcgacggagcctatgccggaacttccgttgtggttaccgtgggtgctgccggtcaactcaggggtgtacaactttggagagtcccaggcccaggacagtatttgatcagcgcttacggtgctgcaggcggaaaaggcgcaaagaaccacctctcccgggcacatggcgtcttcgtcagcgcaattttctctcttggtctgggagaatccttgtacattttggtggggcaacaaggagaggatgcctgcccgggaggcagtccggagtctcagctggtgtgcctgggagaaagccgggcagtggaagagcatgctgccatggatggaagcgagggcgtgcccggatccagacgttgggcgggtggcggaggaggcggtggcggtgccacctatgtgttccgagtgcgcgctggggaacttgagcctctgttggtcgctgctggtgggggaggacgcgcttatctgaggcctagagatcggggtagaacccaggcatctccggaaaagctcgagaacagaagtgaggccccagggtctggtgggagaggcggagccgctggaggtggcggtggctggaccagccgggcaccgtctcctcaggctggccgtagtcttcaggaaggcgctgagggaggccaaggatgttctgaggcttgggccacattggggtgggccgctgcaggagggttcgggggagggggtggcgcttgtaccgctggaggtggagggggtggctacagggggggagacgcgtccgaaacggacaacctctgggccgacggggaggacggggtgtcattcatccacccctcaagtgagttatttctccagcctttagctgtcaccgagaatcacggagaagtggagatacgtcggcacctaaattgctcacattgtccactccgggactgccagtggcaggccgagttgcagcttgctgaatgcctttgtcctgagggaatggaactggctgtagataacgtcacatgtatggatctccacaaacccccagggccactcgttctgatggtggcggtggtggccacttctaccttgagtctgcttatggtctgcggcgtgctaatcctcggaaccaagcgcttggctggtaccgtggatagtcgccttctcttgagctccgagctgggttgggtgtctgccggaggaggcagaaggcgttag

SEQ ID NO: 228454 - DNA, 2205 bp, Artificial Sequence
  Description of Artificial Sequence: Synthetic coding sequence
atgggttgttggggacaactcctagtctggttcggcgctgctggagctatcttatgttcaagtccaggctctcaggaaacctttttaagaagcagccctttaccccttgcctctcctagccctagagatccaaaagtgtctgcacccccatctattctagagcctgcttccccacttaatagccctggcacggaaggtagttggctcttctccacctgcggcgcttccggccgtcatggtccaacacagacccaatgtgatggcgcatatgcaggcacaagcgtcgtagttactgttggcgcagcaggacaactgagaggagtgcagttgtggagagtgccaggcccaggacaatacctgatcagcgcctatggagctgccggaggaaaaggagcaaaaaatcatctgtcaagggcgcatggggtattcgtctctgccatcttttcattgggcctcggtgagtctctctatattctagtgggacaacaaggcgaagacgcctgccccggaggttctcctgagagccagctagtctgccttggagaaagccgcgctgtcgaggaacatgccgctatggacggcagcgagggggtacctgggagtcgcaggtgggccggtggcggaggcggtggcggtggtgcaacgtacgtgtttagggtgagagccggagagcttgaaccactgttagtcgctgccggtggcggtggcagagcgtatctgagaccacgagatcgcggtcggactcaagcaagcccagagaaacttgagaacaggagtgaggcccctggcagtggcggtcgcggtggtgcggctggcggtgatgcttcggaaaccgacaacctgtgggctgacggcgaggacggcgtgtctttcatccacccatcatctgagttgttcctgcaacctttggccgtgaccgagaaccacggcgaggttgaaatcaggcgacatctaaactgctcccactgccctctccgggattgccaatggcaggcggaactccaattagccgaatgcctttgtcccgaaggtatggaactcgccgtagacaatgttacctgtatggatctacataaaccaccaggcccactcgtcttgatggttgcagtggtggcaactagtaccttgagtctgctcatggtctgtggggtgttaattttgggaggcgcatggcctggaccggtcctggcaagtgcgactaggtgccatcggggttttccaagtcagtgctattctgcccagacacttcccgagctgtgttccccgcaggacgaattggactttttgatggaggctttgatcatttccaagtttaggcaccagaatatcgttcgatgcgtgggcttgtctcttcgcgctactcctcggcttatactgctggaactgatgtctggaggtgacatgaaaagctttctgcggcactcccggccacatctgggccagccatctccccttgtgatgcgagacctccttcagctggcacaggacatcgcgcagggctgtcactatctagaggaaaaccattttatccatagagacatcgccgctagaaactgtttgctgagctgcgccggtcctagtcgggtcgctaagattggagactttggaatggctagagatatttacagggcctcctactaccggaggggagacagagccctgttaccggtgaagtggatgcctcctgaggcttttctcgagggcatctttacatcgaaaaccgatagctggtctttcggggtgctcctctgggagatcttctccttggggtatatgccatatcctggcagaacaaaccaggaggtcctagacttcgtggtcgggggtggacgaatggaccccccacgcggatgcccagggcctgtgtaccgcatcatgacccagtgctggcagcatgagccggagcttaggccttcattcgcctccatactggaacggttgcagtattgcactcaggatcccgacgtgctgaattcattgctccctatggagctcggcccaaccccagaggaagaagggacaagcggactcggtaatcggtccttggaatgtctgaggcccccacagccacaggaattaagcccagaaaagctgaaaagttggggcggtagccccctcggcccttggctctctagcggacttaaacccctaaaatctagaggtctgcagccacaaaatctgtggaatcctacctaccgcagttag

SEQ ID NO: 228455 - DNA, 180 bp, Artificial Sequence
  Description of Artificial Sequence: Synthetic coding sequence
atgctctctaggaatgacgatatttgcatctacggaggtctaggcctgggtggcctgctcctacttgcggttgtgctgctgagcgcctgcctttgctggctgcataggcgaggcccaggactgttgcgggctggtacgccactgtgcatcagcgccgaggcggcttctgcacaacagtag

SEQ ID NO: 228456 - DNA, 201 bp, Artificial Sequence
  Description of Artificial Sequence: Synthetic coding sequence
atgctctcacgcaacgatgatatctgtatctatggaggcttaggactgggcggattactgctgctcgccgtggtattgttgtctgcatgcctctgctggctccataggcgagcgccaagtgtcctggtgcccggacctggacttctacgggctgggacacccctatgtatttctgctgaagctgcttctgcccaacagtag

SEQ ID NO: 228457 - DNA, 222 bp, Artificial Sequence
  Description of Artificial Sequence: Synthetic coding sequence
atgctgtcccgaaacgatgtgaaaagactggagagaagctggcatctgctgtcctggagtcaggcccagggttcttccgagcaggaactacactacgcctcactgcagagattgcccgtgccttccagcgagggacctgatctgcgtgggagggataagagaggtacaaaggaggatccccgtgctgactatgcatgtatcgccgagaacaaacctacctag

SEQ ID NO: 228458 - DNA, 201 bp, Artificial Sequence
  Description of Artificial Sequence: Synthetic coding sequence
atgctgtcaaggaacgatgtcaagcgtttggagagatcctgggcacaggggtcctccgaacaggaacttcactacgcctccctgcagcggcttcccgtccccagctcggaggggccagacctgcggggaagagataaacggggaaccaaagaggaccctcgggcagattacgcctgcattgcagagaataagcccacttag

SEQ ID NO: 228459 - DNA, 108 bp, Artificial Sequence
  Description of Artificial Sequence: Synthetic coding sequence
atgcttagtcgaaatgacgctccttctgtcctagtgcctggtccaggcctgttgcgcgctggaacccctctgtgtatctctgcagaggcagcctccgctcagcagtag

SEQ ID NO: 228460 - DNA, 315 bp, Artificial Sequence
  Description of Artificial Sequence: Synthetic coding sequence
atgctctcccggaatgatgatatctgcatttatggagggctgggccttggcggactgcttctgctcgctgtggtgctcctgtcagcctgcctttgttggctccacaggagagttaaaaggcttgagagatcatggcacctactctcttggagtcaggcccaggggtcctcagaacaagaattacactatgcttccttgcaaaggctgcccgtgccttcttcagaaggcccagatttgagagggagagacaagcgaggcacaaaagaggaccctcgcgcagactacgcatgtatcgctgagaataagccgacgtag

SEQ ID NO: 228461 - DNA, 42 bp, Artificial Sequence
  Description of Artificial Sequence: Synthetic coding sequence
atgctatcccggaatgatgaggccgctagcgcccaacaatag

SEQ ID NO: 228462 - DNA, 108 bp, Artificial Sequence
  Description of Artificial Sequence: Synthetic coding sequence
atgttatcccggaatgatgcaccgtctgtgctggtaccagggccaggactgctccgcgctggcacacctttatgcatttcggcagaagctgcttcagcccagcagtag

SEQ ID NO: 228463 - DNA, 276 bp, Artificial Sequence
  Description of Artificial Sequence: Synthetic coding sequence
atgatatatgtaagcactggagcctgggggtgggcaggcagctgtttttggcagtggtccttttgtccccctgcctgtgtgggctgcatagaggagcacctgctgagttggtcacaggcccagggatcctccgagcaggaattgcattacgcctcactgcagcgcctccccgtgccctcttctgaggggccagatctgagggggcgtgataaaaggggaactaaagaggaccctcgggcagactacgcatgtatcgccgagaacaaaccaacatag

SEQ ID NO: 228464 - DNA, 156 bp, Artificial Sequence
  Description of Artificial Sequence: Synthetic coding sequence
atgttatccaggaacgatgttaagaggctagagcgcagctggcgtctgccagtcccctcttccgaaggtcccgaccttagagggagggacaagagagggactaaggaggacccccgagctgattacgcttgcatcgctgagaacaaacctacttag

SEQ ID NO: 228465 - DNA, 192 bp, Artificial Sequence
  Description of Artificial Sequence: Synthetic coding sequence
atgcacctttgtcgagggtgccaatgtcctgctgtgcgggatctaacctctggtgccgaaaccagggaagcccctcggaggattcaggagttgactatgccagctctgttacggaccaatccaccagaacacccaagacacctgcctcaaccgcgaagggtagatcgagttcccttatggagtagccagtag

SEQ ID NO: 228466 - DNA, 222 bp, Artificial Sequence
  Description of Artificial Sequence: Synthetic coding sequence
atgctttctcgcaacgacgtgaaaagactggagcggtcttggcacctcctatcttggagccaggcccagggttcatcggagcaggaactgcactacgcttcattgcagcggctcccggtccctagtagcgaaggtccggacctccgcggtcgtgataaacgagggacgaaagaagatcctcgagcggattatgcttgcatcgccgaaaataaacccacgtag

SEQ ID NO: 228467 - DNA, 108 bp, Artificial Sequence
  Description of Artificial Sequence: Synthetic coding sequence
atgctgtcccggaatgacgccccaagcgtgttagttcccggacccggactgctacgagccggaacacccttgtgcatttccgccgaggctgccagcgctcaacagtag

SEQ ID NO: 228468 - DNA, 201 bp, Artificial Sequence
  Description of Artificial Sequence: Synthetic coding sequence
atgcttagcagaaacgatgatatctgtatatacgggggtctcgggttaggtggtctactgttactcgcggtcgtcctgctgagcgcctgcctatgttggctgcaccggagagctccatccgtgttggtgccaggccctgggttgttacgtgctggcacacctctctgcatctccgctgaggcagcgtcagcgcagcagtag

SEQ ID NO: 228469 - DNA, 315 bp, Artificial Sequence
  Description of Artificial Sequence: Synthetic coding sequence
atgctatcccggaacgacgacatctgcatctacgggggtctcggattaggcggactgcttttgctggccgtggtgctcctgagtgcatgtttgtgctggcttcaccggagagtaaaaagacttgagcggtcttggcacctgctatcctggagtcaggcacaggggtcctcagagcaggagcttcactacgcttcactgcagcgactgccagtgcccagcagcgaggggcctgatctgcggggtcgcgataagagagggacaaaagaagatcctcgggcagattatgcctgtatagccgagaacaagcctacatag

SEQ ID NO: 228470 - DNA, 135 bp, Artificial Sequence
  Description of Artificial Sequence: Synthetic coding sequence
atgctatcacgcaatgatgatatctgcatctacggtggcttaggtctggggggtctgcttttgctggccgtcgtgctgttatccgcatgcctgtgttggcttcacagaagagaggccgctagtgcgcagcagtag

SEQ ID NO: 228471 - DNA, 201 bp, Artificial Sequence
  Description of Artificial Sequence: Synthetic coding sequence
atgctcagcagaaacgacgatatttgtatctatggaggcctggggctgggcggtctgctattactcgctgtggtcttactgtctgcctgcctgtgctggttgcaccggcgagtcaaaagactggagcgatcatggcgactcccagtcccctctagtgagggtccagatctgcgcggacgggacaaacggggaacaaagtag

SEQ ID NO: 228472 - DNA, 201 bp, Artificial Sequence
  Description of Artificial Sequence: Synthetic coding sequence
atgttgagcaggaatgatgtaaagcggctcgagcgctcttgggctcagggctcatcagaacaggagctgcattatgcctccttgcagcgtctcccagtcccttccagtgaaggaccagatctcaggggtcgggataagcgcggaacaaaggaagacccccgagccgattacgcttgtatcgccgaaaacaagcccacgtag

SEQ ID NO: 228473 - DNA, 294 bp, Artificial Sequence
  Description of Artificial Sequence: Synthetic coding sequence
atgctgtctcgcaacgatgatatttgtatctatggcggactgggcctgggcggtctcttgctcctcgccgtagttctgctgtctgcctgtctgtgttggctgcatagaagagtgaaaagactggagcgtagctgggcacaagggagctccgaacaggaattgcactatgcgagcctccaacggctgcccgtgccctcgagcgaaggaccagatctgcggggaagagacaaaagaggcactaaggaagacccgagagcagactatgcctgcattgctgaaaacaaaccaacttag

SEQ ID NO: 228474 - DNA, 180 bp, Artificial Sequence
  Description of Artificial Sequence: Synthetic coding sequence
atgctgagtaggaacgatgacatttgtatctatggcggtctgggattgggagggctcttgctgctggccgtggtgcttttatctgcttgtctgtgttggcttcaccgcagggggcctggactcctgagagccggaactccactatgcatcagcgccgaggccgcaagcgctcagcaatag

SEQ ID NO: 228475 - DNA, 87 bp, Artificial Sequence
  Description of Artificial Sequence: Synthetic coding sequence
atgctgtctcggaacgatgggccagggctccttagggccggaacacctctatgtatttctgcagaggcagcctccgcccagcagtag

SEQ ID NO: 228476 - DNA, 87 bp, Artificial Sequence
  Description of Artificial Sequence: Synthetic coding sequence
atgctttcccgtaacgacggaccaggcctgctccgagccggtaccccactgtgcatctcagcggaagccgcatcagcacagcagtag

SEQ ID NO: 228477 - DNA, 87 bp, Artificial Sequence
  Description of Artificial Sequence: Synthetic coding sequence
atgctgagccgcaacgacggtccaggcttgctgcgcgcagggacacccctgtgcattagcgccgaagcagcttccgcgcagcagtag

SEQ ID NO: 228478 - DNA, 87 bp, Artificial Sequence
  Description of Artificial Sequence: Synthetic coding sequence
atgctcagccggaacgacgggcctgggttactcagggctggcacacccctttgcatcagcgctgaggccgcttccgcacagcaatag

SEQ ID NO: 228479 - DNA, 42 bp, Artificial Sequence
  Description of Artificial Sequence: Synthetic coding sequence
atgctgtcgagaaacgacgaggccgcttcagcgcagcaatag

SEQ ID NO: 228480 - DNA, 249 bp, Artificial Sequence
  Description of Artificial Sequence: Synthetic coding sequence
atgctctcaaggaatgacgatatctgcatctacggaggccttggcctcggcggactcttactgctggctgtcgtgctactctccgcctgtctctgctggctgcaccgcagagtcaagcgccttgaacgtagttggagactgcccgtcccatcgtcagaaggacccgaccttcgtggcagagataaacgcggtaccaaagaagatccgagagcagactatgcgtgtatcgcggagaataaacctacgtag

SEQ ID NO: 228481 - DNA, 201 bp, Artificial Sequence
  Description of Artificial Sequence: Synthetic coding sequence
atgttgtcaagaaatgatgtcaaacggctggaacgctcctgggctcaaggctcttccgagcaggaactccattacgcaagcctccagcgattgcctgtgccgtctagcgaaggcccagatttgcgcggacgcgataagaggggcacaaaagaggacccacgcgcagattacgcttgtatagcagaaaacaagccgacctag

SEQ ID NO: 228482 - DNA, 201 bp, Artificial Sequence
  Description of Artificial Sequence: Synthetic coding sequence
atgctctcacggaacgacgttaagcgattggaacggagttgggcacaggggtcatcagaacaggaactgcattacgcgagtcttcagcgtctcccggtcccgtcctcggagggacccgacctgcgtgggagagacaagaggggaactaaggaagaccccagggcggactacgcttgtattgccgaaaataagcctacgtag

SEQ ID NO: 228483 - DNA, 294 bp, Artificial Sequence
  Description of Artificial Sequence: Synthetic coding sequence
atgctgagtcgcaatgacgatatctgcatctatggaggtctaggactgggaggactactgttgctggctgtggtccttctaagcgcctgtttgtgttggctccatcggagggttaagcgcctggagagatcctgggcacagggtagcagtgaacaggagttgcactacgcaagcctgcagagactgcctgtgccatcatcagaaggacccgacctgaggggacgggataagagaggaacaaaggaggatcctagggcagattacgcgtgcatcgcagaaaacaagcctacctag

SEQ ID NO: 228484 - DNA, 156 bp, Artificial Sequence
  Description of Artificial Sequence: Synthetic coding sequence
atgttaagtaggaacgatgttaaaaggctcgaacgtagttggaggctgccagtgccaagtagtgaaggcccagacctcagggggcgagataagagggggaccaaagaagatcccagggcggactacgcctgcatcgcagaaaataagcccacatag

SEQ ID NO: 228485 - DNA, 294 bp, Artificial Sequence
  Description of Artificial Sequence: Synthetic coding sequence
atgctttcccgcaatgacgatatctgtatttacggcggtctggggctggggggtctgcttctgcttgccgtggtgttacttagtgcctgcctctgttggcttcatcgccgagtcaagcgactcgaacggagctgggcccaggggtctagcgagcaggagctgcattatgcctcacttcaaaggctgcctgtcccttcctccgaggggccagaccttcgaggcagagataagcgtggaaccaaagaggatcccagagcggactatgcgtgtatagctgagaataagcccacctag

SEQ ID NO: 228486 - DNA, 315 bp, Artificial Sequence
  Description of Artificial Sequence: Synthetic coding sequence
atgctcagccgtaatgatgatatttgcatttacggcggtctgggcctgggcggactcctcctgctagcagtagtgctcctgagcgcctgtttgtgttggctgcaccggagggtgaaaaggctggagcgatcatggcacctgctgtcgtggagtcaagcacagggtagtagtgagcaagagctgcattatgcttccctacagagactaccggttccttccagcgaggggcctgacctgcgcggtcgcgataaaaggggtacaaaggaagatccccgtgccgactacgcgtgcatcgccgagaataagcccacatag

SEQ ID NO: 228487 - DNA, 132 bp, Artificial Sequence
  Description of Artificial Sequence: Synthetic coding sequence
tatcgcggtatgatgatctacgttagcacgggtgcttggggttgggcagggtcttgcttctggcagtggagtttttgtccccctgcttgcgtaggttgtatcgaggaacggctgcctgttccctcctcttag

SEQ ID NO: 228488 - DNA, 111 bp, Artificial Sequence
  Description of Artificial Sequence: Synthetic coding sequence
atgctgtccaggaacgacgacatatgtatctacggaggcctggggctaggcggactcctgctgctcgccgtcgttttactaagtgcctgtctgtgttggctgcatcgctag

SEQ ID NO: 228489 - DNA, 315 bp, Artificial Sequence
  Description of Artificial Sequence: Synthetic coding sequence
atgttgagccgaaatgatgacatctgtatttacgggggtctgggcctgggtgggttattgttgttagctgtagtgctgctgagcgcctgcctgtgctggttgcatcgacgggtgaaacgtctggaaaggagctggcatctgctttcttggagtcaggcacaaggctcctctgagcaggaattgcattatgctagcctgcaaagactccccgtgcccagttctgaaggacccgacttacggggacgggacaaacgcggaacaaaagaagacccaagagccgattacgcctgcatcgcagagaacaaacccacctag

SEQ ID NO: 228490 - DNA, 141 bp, Artificial Sequence
  Description of Artificial Sequence: Synthetic coding sequence
atgctgtcacggaacgatgatatttgtatttacgggggactggggctcgggggtttactgctcctggctgtcgtgctgttaagtgcttgcctgtgctggctccacagaagagaacattgtctggctctggaaccgctgtag

SEQ ID NO: 228491 - DNA, 42 bp, Artificial Sequence
  Description of Artificial Sequence: Synthetic coding sequence
atgctgtcccggaacgacgaagctgccagcgctcagcaatag

SEQ ID NO: 228492 - DNA, 87 bp, Artificial Sequence
  Description of Artificial Sequence: Synthetic coding sequence
atgctatcacgtaacgatggtcctggtctgttgcgtgcagggaccccattgtgtattagtgcagaggccgcttccgcacagcagtag

SEQ ID NO: 228493 - DNA, 201 bp, Artificial Sequence
  Description of Artificial Sequence: Synthetic coding sequence
atgctgagtcgaaatgatgtcaaaaggttagagagatcctgggcgcaaggctcttctgagcaagagctgcattacgcctccctccaacggttgcccgtgccatcttccgagggtccagacttgcgcggaagagacaagcgaggaacgaaggaggatcctcgcgcagattatgcctgcatcgcagagaacaagcccacctag

SEQ ID NO: 228494 - DNA, 87 bp, Artificial Sequence
  Description of Artificial Sequence: Synthetic coding sequence
atgctctctagaaatgatggccctggcctgctccgtgccggaacccctctttgcatctcagccgaggccgcaagtgcacagcagtag

SEQ ID NO: 228495 - DNA, 87 bp, Artificial Sequence
  Description of Artificial Sequence: Synthetic coding sequence
atgctgtctcgcaatgacggtccaggcctgcttcgggctggaacaccattatgcatatccgcagaggcggcttcagcccagcagtag

SEQ ID NO: 228496 - DNA, 132 bp, Artificial Sequence
  Description of Artificial Sequence: Synthetic coding sequence
tgatctcgtaacgatgatatttgcatctacggcggattaggtcttgggggactgttgctgctggccgttgtgcttttatctgcctgcttgtgctggttgcaccgcagagaagcggcatcggctcaacagtag

SEQ ID NO: 228497 - DNA, 156 bp, Artificial Sequence
  Description of Artificial Sequence: Synthetic coding sequence
atgctgagtcgaaacgacgtgaaacgcctggagcgcagttggcgactgccggtcccctccagcgagggcccagacttgcgcggacgggacaaaagaggcacaaaggaagaccctcgagcagactatgcctgcatagctgaaaataagcccacttag

SEQ ID NO: 228498 - DNA, 108 bp, Artificial Sequence
  Description of Artificial Sequence: Synthetic coding sequence
atgctgtcccgaaacgacgcgccaagcgtcttggtccccggtccgggattgctgagggctggaacgcctttgtgcatcagtgcggaagccgctagcgctcagcagtag

SEQ ID NO: 228499 - DNA, 42 bp, Artificial Sequence
  Description of Artificial Sequence: Synthetic coding sequence
atgctgtcccggaatgacgaagcagcgtctgcccagcagtag

SEQ ID NO: 228500 - DNA, 294 bp, Artificial Sequence
  Description of Artificial Sequence: Synthetic coding sequence
atgctcagccggaacgacgacatctgtatctacggcggtcttggcttgggcggtttgctactgttggcagtggtcctgttgtctgcctgcctgtgttggttgcacagacgcgttaaacggttagaacgaagttgggctcagggatccagtgaacaggaactgcactatgcaagcctgcagagacttcccgtccccagttccgagggacccgatctgagggggcgagataaacgcggaaccaaagaggaccccagggcggattatgcctgcatcgctgaaaacaagcctacttag

SEQ ID NO: 228501 - DNA, 201 bp, Artificial Sequence
  Description of Artificial Sequence: Synthetic coding sequence
atgctgagtcgtaacgacgtgaagcggctggagagaagttgggcccaaggatcttcggaacaggagttgcactatgcaagcttgcagaggcttcccgtcccttcatccgaaggacccgatctgcgaggccgtgacaagcgaggaacgaaggaggatccaagggccgattacgcatgcatagctgagaataagcctacgtag

SEQ ID NO: 228502 - DNA, 141 bp, Artificial Sequence
  Description of Artificial Sequence: Synthetic coding sequence
atgctgagccgcaatgacgacatttgcatttatggcggtctgggcctggggggacttctccttctcgccgtggtgctcctgagtgcatgcctatgctggttacaccgcagggaacactgtctggcactggaacctttgtag

SEQ ID NO: 228503 - DNA, 132 bp, Artificial Sequence
  Description of Artificial Sequence: Synthetic coding sequence
tgaagcagaaacgatgatatatgcatctacggtggtttgggtctaggaggtctgctcctgttagctgtcgtccttctgagcgcctgcttgtgctggttacacagacgagaagctgcttccgcacagcaatag

SEQ ID NO: 228504 - DNA, 141 bp, Artificial Sequence
  Description of Artificial Sequence: Synthetic coding sequence
atgctttcccgaaacgatgatatatgtatatacggcggactcggactcgggggtctcttgctactggctgtggtcctgctgtccgcctgcctgtgttggctacaccggagagagcactgtttagctctggagccgctgtag

SEQ ID NO: 228505 - DNA, 87 bp, Artificial Sequence
  Description of Artificial Sequence: Synthetic coding sequence
atgctgagtaggaatgatgggcctggccttctgagagcaggaactccactttgtatatctgcagaggccgcttctgcccagcagtag

SEQ ID NO: 228506 - DNA, 132 bp, Artificial Sequence
  Description of Artificial Sequence: Synthetic coding sequence
tagagccgtaacgatgatatctgcatatatggaggactgggactggggggattgttgctgcttgctgtagtcctgttgtcggcgtgcctttgctggctccaccgccgtgaagctgctagcgcgcagcaatag

SEQ ID NO: 228507 - DNA, 201 bp, Artificial Sequence
  Description of Artificial Sequence: Synthetic coding sequence
atgttgagcaggaatgatgtcaagcgcctggaacgcagttgggcccaagggtctagcgagcaggaactgcactacgcctcattacagcgattgcctgtccctagcagcgaaggcccagatctgcgcggtagggacaagcgcggaaccaaagaagatccgagagccgattatgcctgtattgcagagaataagccaacctag

SEQ ID NO: 228508 - DNA, 180 bp, Artificial Sequence
  Description of Artificial Sequence: Synthetic coding sequence
atgttgagtcgtaatgatgacatctgtatttacggtggcttgggacttggcggactcctcctgctcgctgtggtactgctttcggcttgtctttgttggttgcacaggcggggtcccggactcctccgcgcaggcactccattgtgtatctccgctgaagctgcctccgcacagcagtag

SEQ ID NO: 228509 - DNA, 222 bp, Artificial Sequence
  Description of Artificial Sequence: Synthetic coding sequence
atgttgtcaaggaacgacgtcaagcgactggagcggtcttggcacctgctctcctggtcccaggctcagggctcaagcgaacaggagctgcattatgctagccttcagagactgcccgtgccttcgagtgagggtcctgatcttaggggcagggacaagagaggaaccaaggaagaccctcgcgcagactacgcatgtatcgccgagaataaaccaacttag

SEQ ID NO: 228510 - DNA, 201 bp, Artificial Sequence
  Description of Artificial Sequence: Synthetic coding sequence
atgttaagccgaaacgatgacatttgcatttacgggggactgggcctcggcggactcctgctcctggctgtggtgctgctttcagcatgcctttgctggctgcaccggagagcccctagtgtgctcgttccagggcctggactcctgagagctggaacgccgctctgtatcagcgccgaggctgcttctgctcaacagtag

SEQ ID NO: 228511 - DNA, 201 bp, Artificial Sequence
  Description of Artificial Sequence: Synthetic coding sequence
atgctctcacggaatgacgtgaagagactcgagcgctcctgggctcaaggttctagcgagcaagagctgcactacgccagcctgcagagactcccggtgccctcctctgaaggacccgacctcagagggcgagataagagaggcacaaaagaggatcctcgggctgactacgcatgcatcgccgaaaacaaacccacctag

SEQ ID NO: 228512 - DNA, 87 bp, Artificial Sequence
  Description of Artificial Sequence: Synthetic coding sequence
atgttatcccgtaacgacggtccagggctcctccgagcaggcaccccattgtgtataagcgctgaggccgcaagcgcccaacagtag

SEQ ID NO: 228513 - DNA, 249 bp, Artificial Sequence
  Description of Artificial Sequence: Synthetic coding sequence
atgctgtcacgcaacgatgatatctgcatatacgggggacttggtctcggcggactcctgctacttgccgtggttctcctgtcggcatgcttgtgttggttacaccgcagggtgaagcgtctggagagatcttggaggcttcccgtcccctcttccgaaggaccagatcttcgaggcagggataagaggggaactaaggaagacccacgcgctgattatgcctgcatcgcagagaacaaaccgacttag

SEQ ID NO: 228514 - DNA, 156 bp, Artificial Sequence
  Description of Artificial Sequence: Synthetic coding sequence
atgttgagtaggaacgatgttaagagactcgagagaagctggcgactgccggtgccatctagtgaaggtcctgacttgcgaggcagagacaaacggggaactaaagaagatcctcgggcagactatgcttgcattgcagaaaataaaccaacttag

SEQ ID NO: 228515 - DNA, 180 bp, Artificial Sequence
  Description of Artificial Sequence: Synthetic coding sequence
atgctgagtagaaacgatgatatctgtatttatggcggtcttggtttaggtggtctgctgcttttggcagttgttctcctctccgcttgcttgtgctggctccacaggaggggtcccggactcctccgggctggcacccccttgtgcatttcagcggaagccgcttccgcccagcagtag

SEQ ID NO: 228516 - DNA, 201 bp, Artificial Sequence
  Description of Artificial Sequence: Synthetic coding sequence
atgctgtccagaaacgatgtgaaaagacttgaacgatcgtgggctcagggctctagcgagcaagagttacattatgcctccctgcagaggctcccagtgccttcaagcgaaggacctgacctgagagggcgtgataaaaggggaaccaaagaggaccccagagctgactacgcctgcatagcagagaacaagccaacttag

SEQ ID NO: 228517 - DNA, 156 bp, Artificial Sequence
  Description of Artificial Sequence: Synthetic coding sequence
atgctgtcgcgaaacgacgttaaacgccttgagcgatcatggcgcctgcctgtgcccagcagtgaggggccagacctccggggaagagataagagaggcactaaagaagaccctcgggctgattatgcctgtatcgctgaaaacaagccaacctag

SEQ ID NO: 228518 - DNA, 249 bp, Artificial Sequence
  Description of Artificial Sequence: Synthetic coding sequence
atgctgtccagaaacgatgatatttgcatttacgggggattaggcctaggtgggcttctgctgttagccgtggtgttgctcagcgcatgtctctgttggctgcacaggcgcgttaagagattagagaggtcttggcggttacctgtgccaagtagcgagggacctgatctcaggggacgtgacaaaagaggcaccaaagaggaccccagagccgactatgcctgtattgctgaaaataagcctacatag

SEQ ID NO: 228519 - DNA, 141 bp, Artificial Sequence
  Description of Artificial Sequence: Synthetic coding sequence
atgctgtctcgcaacgacgacatctgcatctacggaggactagggttgggcggattgcttctgctggccgtcgttcttctgtccgcctgtttgtgctggctgcaccgacgtgagcactgtctggcattagagcccctgtag

SEQ ID NO: 228520 - DNA, 108 bp, Artificial Sequence
  Description of Artificial Sequence: Synthetic coding sequence
atgttgagccgcaacgatgcgccaagcgtcctggtgccaggcccaggactgctcagggcagggactcctttgtgcatcagcgcggaggccgcatctgcacagcagtag

SEQ ID NO: 228521 - DNA, 249 bp, Artificial Sequence
  Description of Artificial Sequence: Synthetic coding sequence
atgctctctcgcaatgacgatatctgcatctacgggggattgggcctgggtggactcctgctgctcgctgtggtgctcctttctgcttgcctgtgctggctccaccggcgtgtcaaacgcttggaaagatcatggagactgcctgtaccaagctcagaaggacctgatctgcgcggtcgagacaagaggggtactaaggaagatccgcgagctgactatgcttgtattgctgagaacaaacccacgtag

SEQ ID NO: 228522 - DNA, 87 bp, Artificial Sequence
  Description of Artificial Sequence: Synthetic coding sequence
atgttaagtaggaacgatggccctggcctcctgcgcgcaggcaccccactatgtattagtgctgaggccgcttcagcacagcagtag

SEQ ID NO: 228523 - DNA, 294 bp, Artificial Sequence
  Description of Artificial Sequence: Synthetic coding sequence
atgctgtctcggaacgacgatatctgcatttatggaggtctgggactgggagggttgctcctgctggcagttgtgttgttgtcagcctgcctatgttggctccaccgcagggtgaagaggttagagaggtcctgggctcaggggagctccgagcaggaattacattatgcctcgctgcaacggcttcccgtgccatctagcgagggacctgacctccggggacgcgataagaggggcactaaggaggatcccagagcggactacgcatgcattgcggagaacaagcctacctag

SEQ ID NO: 228524 - DNA, 87 bp, Artificial Sequence
  Description of Artificial Sequence: Synthetic coding sequence
atgctttcccgaaatgacgggcctggcctgctgcgcgctggcacaccgttatgtattagtgccgaggctgcctccgcacaacagtag

SEQ ID NO: 228525 - DNA, 108 bp, Artificial Sequence
  Description of Artificial Sequence: Synthetic coding sequence
atgttgtctaggaatgatgccccttccgtgctagttccaggccctggtctgcttcgtgccggaactccactgtgtatatccgcagaagccgcatccgcacagcagtag

SEQ ID NO: 228526 - DNA, 294 bp, Artificial Sequence
  Description of Artificial Sequence: Synthetic coding sequence
atgctctctagaaacgacgacatttgcatatacggaggattgggactggggggtctattgctgctggcggtggtgttactgtccgcctgcctatgctggctgcacaggcgtgttaaaaggctggagcgatcctgggcccaaggttcttcagagcaagagcttcactacgcttcactgcagaggttacctgtccctagtagcgaggggccagatctaaggggcagggataaaagaggcacaaaagaggacccccgagcggactatgcctgcatcgcagagaacaagcccacctag

SEQ ID NO: 228527 - DNA, 201 bp, Artificial Sequence
  Description of Artificial Sequence: Synthetic coding sequence
atgctgagccgcaacgacgtgaaaagactggagcgctcttgggcgcaggggtctagcgaacaagaactgcattacgctagtctgcagaggctgcctgtgcctagctccgagggcccagacttgcgtggacgcgataagcggggaacaaaggaggatcctagggccgactacgcatgtatcgccgaaaacaaacctacctag

SEQ ID NO: 228528 - DNA, 201 bp, Artificial Sequence
  Description of Artificial Sequence: Synthetic coding sequence
atgctgagccggaacgacgtgaagcgactggagagatcctgggcacagggctcgagcgaacaagaacttcactacgctagcctgcagcgactgccagtgccaagttcagaaggccctgatctccgcggtcgtgataagaggggtacaaaagaggaccctagagccgactacgcatgcatcgctgagaataaacctacctag

SEQ ID NO: 228529 - DNA, 42 bp, Artificial Sequence
  Description of Artificial Sequence: Synthetic coding sequence
atgctgtctagaaatgacgaagccgcttctgcgcaacagtag

SEQ ID NO: 228530 - DNA, 87 bp, Artificial Sequence
  Description of Artificial Sequence: Synthetic coding sequence
atgctgagtaggaatgatggcccaggactcctgagagccggtactcctctttgtattagtgcagaagctgcgtccgcccagcagtag

SEQ ID NO: 228531 - DNA, 111 bp, Artificial Sequence
  Description of Artificial Sequence: Synthetic coding sequence
atgttgagccgcaacgacgacatctgcatctatggtggtctgggtttagggggacttctgctgctggccgtagtccttttgtccgcctgcttatgttggttacacagatag

SEQ ID NO: 228532 - DNA, 294 bp, Artificial Sequence
  Description of Artificial Sequence: Synthetic coding sequence
atgttgagccgaaatgatgacatttgcatctacggaggcctgggcctgggaggactgctcttgctggccgtggtgttactgtctgcctgtctgtgctggctgcatcgcagggtgaaacggctcgaacgcagctgggcccaagggagtagcgaacaggagcttcactacgcttctttgcagcgcctccctgtcccatcctccgaaggtccagatctgcgcggtcgtgataagcggggtaccaaggaggacccacgggctgactacgcctgtatcgccgaaaataagccaacctag

SEQ ID NO: 228533 - DNA, 180 bp, Artificial Sequence
  Description of Artificial Sequence: Synthetic coding sequence
atgctgagtcgcaatgacgatatttgtatctatggtgggctcgggctcggcggtctgttactgctggccgtcgtgctgttgtcagcttgcctgtgttggctgcaccgtaggggtcccggacttttgcgggcagggacacctttatgtatatctgccgaagccgcttccgcccagcaatag

SEQ ID NO: 228534 - DNA, 294 bp, Artificial Sequence
  Description of Artificial Sequence: Synthetic coding sequence
atgctaagcagaaacgacgatatctgtatttacgggggactgggcctcggcggactgttactactcgctgtggtgttgctcagcgcctgtctatgctggttgcaccgcagagtaaagcgattggaacgctcctgggcacaaggatcttcagagcaggagcttcactatgcttccctgcagcgattgccagtccccagctccgaggggccagatcttagaggccgagacaaaagagggaccaaggaagacccaagggccgattacgcctgcatcgcggaaaacaaacccacgtag

SEQ ID NO: 228535 - DNA, 201 bp, Artificial Sequence
  Description of Artificial Sequence: Synthetic coding sequence
atgctctcaaggaatgatgacatctgtatctacggagggctgggcctgggaggcctcctgctcctcgccgtggtcctcctcagtgcctgtttgtgctggttacaccgacgggctccatctgtgctcgttcccggacctggtttgttaagggctggaacaccactgtgcatcagcgccgaagctgcctccgcccagcaatag

SEQ ID NO: 228536 - DNA, 87 bp, Artificial Sequence
  Description of Artificial Sequence: Synthetic coding sequence
atgctaagccgtaatgacggcccaggtcttttacgagccggaaccccattatgcatttctgcagaggcggcatctgcccagcagtag

SEQ ID NO: 228537 - DNA, 180 bp, Artificial Sequence
  Description of Artificial Sequence: Synthetic coding sequence
atgctgtccagaaacgacgatatttgcatttacggcggactggggctcggcggtttgctacttctcgctgtcgtccttttgagcgcatgtttatgctggttacaccggagaggtcctggcctcttaagagcaggcacccctctgtgtataagtgcggaagctgcatctgcccagcaatag

SEQ ID NO: 228538 - DNA, 201 bp, Artificial Sequence
  Description of Artificial Sequence: Synthetic coding sequence
atgctttccaggaacgacgtcaaacggctcgagaggtcttgggctcaaggctcctcggagcaggaattgcattatgcgagtttgcagcgactgcctgttccttctagcgaaggtcctgacctcagggggagagataagcgaggaacaaaggaggatcctcgtgctgattacgcatgcatagcggaaaataagcccacgtag

SEQ ID NO: 228539 - DNA, 108 bp, Artificial Sequence
  Description of Artificial Sequence: Synthetic coding sequence
atgttgagccggaatgatgctccctccgttctcgttcctgggcctggcttgctgcgagctggcacaccactctgcatcagtgctgaagccgcttccgcccagcagtag

SEQ ID NO: 228540 - DNA, 201 bp, Artificial Sequence
  Description of Artificial Sequence: Synthetic coding sequence
atgctcagccgaaacgacgtcaagcggttggaacgctcttgggcgcaagggagttccgaacaggaattacactacgcaagcctgcagcgtttgcctgtccctagttcagaaggtcccgatctccgtggcagagacaagaggggaacgaaggaagaccctagggccgattacgcctgcatcgccgaaaataaacctacctag

SEQ ID NO: 228541 - DNA, 87 bp, Artificial Sequence
  Description of Artificial Sequence: Synthetic coding sequence
atgttatctcggaatgacggtcccggattgttacgagccggaactcccttgtgcatctcggccgaggctgcaagcgcccagcagtag

SEQ ID NO: 228542 - DNA, 108 bp, Artificial Sequence
  Description of Artificial Sequence: Synthetic coding sequence
atgctgtctcggaatgacgccccttccgtcctggttccaggacctggcctcctcagggccggaacacctttgtgcataagcgccgaggccgcatcagctcaacagtag

SEQ ID NO: 228543 - DNA, 132 bp, Artificial Sequence
  Description of Artificial Sequence: Synthetic coding sequence
taatccagaaatgatgacatttgtatctatgggggtttagggctgggcggactacttctactggcagttgtattactgtcagcctgtctttgttggcttcaccgcagagaggcggcttccgctcagcaatag

SEQ ID NO: 228544 - DNA, 111 bp, Artificial Sequence
  Description of Artificial Sequence: Synthetic coding sequence
atgctgtcaagaaatgacgatatttgtatttatggaggcctcgggcttggcggtttgttgcttctggccgtggtccttttgtcagcttgcctttgttggctccatcgttag

SEQ ID NO: 228545 - DNA, 111 bp, Artificial Sequence
  Description of Artificial Sequence: Synthetic coding sequence
atgctcagcaggaacgatgacatctgcatatacggcggattgggccttggcggattgctgctccttgccgtggtgctcctctcggcctgcttatgctggctgcatagatag

SEQ ID NO: 228546 - DNA, 201 bp, Artificial Sequence
  Description of Artificial Sequence: Synthetic coding sequence
atgctgtcccggaacgacgtcaaacgactagagcgctcttgggcacaggggtcctcggaacaggaattgcattacgcgtccctccagagactcccggtgcccagctcagaagggccagacctgaggggaagagataagcgtggcacaaaagaggaccccagggctgattacgcgtgcatcgctgagaataaacccacttag

SEQ ID NO: 228547 - DNA, 294 bp, Artificial Sequence
  Description of Artificial Sequence: Synthetic coding sequence
atgctctcaaggaacgacgatatctgcatctatggcggactggggttggggggactccttttgctggccgtcgtccttcttagcgcctgtctctgttggctgcatagaagggtcaagcgcttggagcggagctgggcacaggggagcagtgaacaggaacttcactatgcatctctgcagcgccttccagttccatcttccgaggggccagatctgaggggtagggataagcggggaacaaaagaagatccccgagccgactatgcttgtatcgccgagaataagcctacctag

SEQ ID NO: 228548 - DNA, 87 bp, Artificial Sequence
  Description of Artificial Sequence: Synthetic coding sequence
atgttgtcccgcaacgatggccctggtcttctccgcgctggaacacccttatgtatttccgccgaagctgccagcgcccagcagtag

SEQ ID NO: 228549 - DNA, 315 bp, Artificial Sequence
  Description of Artificial Sequence: Synthetic coding sequence
atgctgagcagaaacgatgatatttgcatatacggtggcctgggcctgggaggattgctgctgctggcagtggtactgctcagcgcctgcctgtgctggctgcatcgccgagtgaagcgcttggagcggtcctggcacctcctgagttggtcccaggcgcaaggaagttcagaacaggagctccactatgcctccctacagagactgcctgttccgtcctccgagggtcccgacctgcgaggacgggacaagagaggcaccaaggaggatccccgtgctgattacgcatgcatcgccgagaacaagcctacttag

SEQ ID NO: 228550 - DNA, 201 bp, Artificial Sequence
  Description of Artificial Sequence: Synthetic coding sequence
atgctcagtcgcaacgatgtgaagcgcttagagaggagctgggcacagggttcctccgagcaggagctgcattatgcgagtctgcagcgtctcccggtcccttcctcagaggggcctgacctgagaggacgagacaaacgagggaccaaagaagatcctcgggcagactacgcatgcatcgctgagaacaaaccaacctag

SEQ ID NO: 228551 - DNA, 111 bp, Artificial Sequence
  Description of Artificial Sequence: Synthetic coding sequence
atgctgtccaggaatgatgacatctgtatttacggagggctcggactcggtggcctgttgctgctggcggtcgtgctgctatccgcatgcctctgttggctgcatagatag

SEQ ID NO: 228552 - DNA, 294 bp, Artificial Sequence
  Description of Artificial Sequence: Synthetic coding sequence
atgctctctcgaaacgatgatatctgtatttatggcggattaggcttagggggactcctgctgctcgctgtcgtgctattgtccgcttgcttgtgctggctacaccgtagagtgaagaggctcgaaagatcctgggctcagggctcatctgagcaagagctccactacgcttctctgcagcgactgcctgtgccaagcagtgagggtcccgatctgagagggcgtgataagagagggacgaaggaggacccaagggcagactacgcctgcatcgccgagaacaagccgacatag

SEQ ID NO: 228553 - DNA, 156 bp, Artificial Sequence
  Description of Artificial Sequence: Synthetic coding sequence
atgcttagcaggaatgacgtcaaacgcctcgagagatcctggaggctgcccgttcccagcagcgaagggccagatctgcgcggtcgggacaaaagggggacaaaagaggaccccagggcggattacgcctgcatcgcagagaacaaaccaacttag

SEQ ID NO: 228554 - DNA, 315 bp, Artificial Sequence
  Description of Artificial Sequence: Synthetic coding sequence
atgttaagtagaaacgatgacatttgcatttatgggggtctcggactggggggattactgctgttagcggtggtccttctctcagcctgtttgtgttggctccatagacgcgtcaagaggctggaacgtagctggcacctcctgtcctggtcccaggcacagggctcatcagaacaggaattacactatgcctccctccagcggctgccagtcccaagttcagagggacccgatctgagaggcagagataaacggggaacaaaggaagaccctagggcggattacgcttgtatcgcggaaaacaaaccaacctag

SEQ ID NO: 228555 - DNA, 294 bp, Artificial Sequence
  Description of Artificial Sequence: Synthetic coding sequence
atgctcagccggaatgacgacatctgcatctacggagggctgggccttggaggtctgctgctgctcgcggtggtcctgctgtccgcctgtttatgttggctgcaccgtcgggtcaagagactcgagaggagctgggcgcagggaagttctgagcaagagctgcattatgccagtctgcagcgtctaccggtgccctcttcagaaggcccagacttgaggggcagagataagcggggaactaaggaggatcctagggcagactatgcatgcatcgccgagaataaacccacctag

SEQ ID NO: 228556 - DNA, 315 bp, Artificial Sequence
  Description of Artificial Sequence: Synthetic coding sequence
atgttaagccgtaacgatgacatttgcatatatgggggattaggactgggtggcctgctcctgctggctgtcgtcctcctctcagcatgtctgtgttggttacatagaagagtgaagcggttggagcgctcatggcacctcctgtcttggtctcaggcccagggttctagcgagcaggagctgcactatgcctcactgcagagactgcccgtgccgtctagcgagggacccgaccttaggggaagagataaacgcggaaccaaggaggacccaagagccgattacgcgtgcatagcagaaaataagcctacgtag

SEQ ID NO: 228557 - DNA, 156 bp, Artificial Sequence
  Description of Artificial Sequence: Synthetic coding sequence
atgctgtccaggaatgacgtcaaacgattagaaaggtcctggcggctcccagtgccttcctcagagggcccagacctcagaggacgcgacaagcgcggtactaaggaggatccaagggcggattacgcttgcatagctgagaataaacccacatag

SEQ ID NO: 228558 - DNA, 201 bp, Artificial Sequence
  Description of Artificial Sequence: Synthetic coding sequence
atgttatctcggaacgatgatatctgcatctacggcggactaggactcggtggactgctattactggcagtggtgttgctgtccgcgtgcctatgttggctgcacaggcgggctccctcagtactggtaccgggaccgggactgctcagagcaggaacgcccttatgcatttctgcagaggctgcttctgcgcagcagtag

SEQ ID NO: 228559 - DNA, 111 bp, Artificial Sequence
  Description of Artificial Sequence: Synthetic coding sequence
atgctgtcacgtaacgacgacatatgtatctacggcggacttggcctggggggactgttacttctagctgtagtcctcctcagtgcctgcctctgctggttacacagatag

SEQ ID NO: 228560 - DNA, 222 bp, Artificial Sequence
  Description of Artificial Sequence: Synthetic coding sequence
atgctgtcccgaaacgacgttaaaaggcttgagcgatcctggcatctgttgagttggtctcaggcacagggatccagtgaacaggaactccactacgcctcattacagcgcctgcccgtgccaagctccgaggggccagacttacggggaagagacaagaggggaactaaggaagaccctagggccgattacgcttgtatagccgagaacaagcccacctag

SEQ ID NO: 228561 - DNA, 201 bp, Artificial Sequence
  Description of Artificial Sequence: Synthetic coding sequence
atgctcagccggaatgatgtgaagcgtctggagaggagttgggctcagggcagctccgaacaggagcttcactatgcttccctacagagactgcctgtaccgagctcagagggtcccgatctccgaggtcgggacaagcggggtacgaaggaggacccacgggcagattacgcctgtatcgctgaaaataagcctacctag

SEQ ID NO: 228562 - DNA, 201 bp, Artificial Sequence
  Description of Artificial Sequence: Synthetic coding sequence
atgctgtctcggaatgacgtgaagagactcgaaaggtcctgggcccagggctcctcagagcaggaactgcattacgcctcgctgcagcggctcccagttccatcatctgagggaccagatttgagggggagagataagagaggtaccaaagaggacccccgagccgattacgcgtgtattgctgaaaataagcctacatag

SEQ ID NO: 228563 - DNA, 108 bp, Artificial Sequence
  Description of Artificial Sequence: Synthetic coding sequence
atgttaagcagaaatgacgccccatcagtgctcgtacctggcccagggttgctccgagccggaactcccctctgcatttccgctgaagccgctagcgcccagcaatag

SEQ ID NO: 228564 - DNA, 87 bp, Artificial Sequence
  Description of Artificial Sequence: Synthetic coding sequence
atgctgtcaaggaatgatggaccaggcctactgcgtgctgggactcctttgtgtattagtgctgaagccgctagtgcccagcaatag

SEQ ID NO: 228565 - DNA, 141 bp, Artificial Sequence
  Description of Artificial Sequence: Synthetic coding sequence
atgctgtcacgcaatgacgatatatgtatctatggtggattggggctgggtggtcttctactgctggcagtagtgctactgtcggcctgcctgtgctggctgcatcgcagagaacattgtctagcccttgagccactgtag

SEQ ID NO: 228566 - DNA, 141 bp, Artificial Sequence
  Description of Artificial Sequence: Synthetic coding sequence
atgctgagtaggaacgacgacatctgtatttatggcggtctggggctgggtggattattgttacttgccgtggttctcctgagcgcctgcctctgttggctccatagacgggagcattgcctagcacttgagcccctctag

SEQ ID NO: 228567 - DNA, 201 bp, Artificial Sequence
  Description of Artificial Sequence: Synthetic coding sequence
atgttgagcagaaatgatgacatctgcatctatggcggacttggcctcgggggtctcctactactcgctgtcgtgttgctgagtgcttgcttgtgctggctgcaccggcgtgcccctagcgtacttgtgcctggtccgggtctcctccgcgctggcacccccctctgtatctccgctgaggcagctagcgcacagcagtag

SEQ ID NO: 228568 - DNA, 141 bp, Artificial Sequence
  Description of Artificial Sequence: Synthetic coding sequence
atgctgtctaggaatgacgatatctgcatctatggcggtcttgggttggggggattactgctgctcgcggtggtgctgctgagcgcttgcctgtgttggctgcatcgccgtgagcactgcttggccctggaaccgctctag

SEQ ID NO: 228569 - DNA, 87 bp, Artificial Sequence
  Description of Artificial Sequence: Synthetic coding sequence
atgctgtcaaggaacgacggaccagggctactccgagctggcactcccctgtgtataagcgccgaggccgcatctgcacagcagtag

SEQ ID NO: 228570 - DNA, 294 bp, Artificial Sequence
  Description of Artificial Sequence: Synthetic coding sequence
atgttaagcagaaatgacgatatctgtatctatggtggtttaggactggggggactgcttctactcgctgtggtgctgctcagtgcctgtttgtgctggctgcacagaagagtcaagcgcctggagagaagctgggcacagggttccagcgaacaggagttacattacgcatcactgcagcgcctgcccgtgcctagcagtgaaggccctgacctccggggaagggacaagcgcggtactaaagaagatccgagagccgattacgcatgcattgccgagaataaacctacttag

SEQ ID NO: 228571 - DNA, 180 bp, Artificial Sequence
  Description of Artificial Sequence: Synthetic coding sequence
atgctgagcaggaatgatgatatctgtatctacgggggtctgggattaggtggtttgttgttactggcagttgtgctcctgagcgcctgcctgtgttggttacacaggagaggccctgggctgctgagagccggtactcccttgtgtatatctgcagaggctgcttcagcgcagcaatag

SEQ ID NO: 228572 - DNA, 294 bp, Artificial Sequence
  Description of Artificial Sequence: Synthetic coding sequence
atgttgtcccggaacgacgacatctgtatctacggcggactgggcctcgggggtttactgctcctggccgtggtgctgttgtctgcttgcctgtgttggctgcatagaagagtgaagcgacttgaaaggtcctgggcacagggaagctcggagcaggaactgcactacgccagcctgcagagactccccgttccttccagcgaaggacccgacctgaggggacgggataaacgcggtacgaaggaggatcctcgggctgattatgcctgtattgctgagaacaagccaacatag

SEQ ID NO: 228573 - DNA, 87 bp, Artificial Sequence
  Description of Artificial Sequence: Synthetic coding sequence
atgctgagccggaatgacgggcctggactgctgcgtgctgggactcccctatgtatctcagccgaagcggcatcagctcagcagtag

SEQ ID NO: 228574 - DNA, 111 bp, Artificial Sequence
  Description of Artificial Sequence: Synthetic coding sequence
atgctgagtcggaatgacgatatctgcatatacgggggactcggcctgggcggacttctgttacttgccgtggtactcctatccgcttgtctctgctggctccaccggtag

SEQ ID NO: 228575 - DNA, 156 bp, Artificial Sequence
  Description of Artificial Sequence: Synthetic coding sequence
atgctctctagaaatgatgtcaaacgtctcgaacgcagctggcgacttcctgtaccaagcagtgagggccctgacctgcgcggtcgcgataagcgaggcaccaaagaggaccctagagcagattatgcctgcatagccgaaaacaaacccacatag

SEQ ID NO: 228576 - DNA, 42 bp, Artificial Sequence
  Description of Artificial Sequence: Synthetic coding sequence
atgctgtctaggaatgacgaggccgcttccgcacagcagtag

SEQ ID NO: 228577 - DNA, 201 bp, Artificial Sequence
  Description of Artificial Sequence: Synthetic coding sequence
atgctcagccggaatgacgtgaagcgcctggagaggtcatgggctcagggatcaagcgaacaggagctacactacgctagcctgcagaggttacctgtacccagctctgaggggcctgatctccggggacgcgataagcggggaacaaaagaggatcccagggcagattacgcctgcatcgcagagaacaagccgacatag

SEQ ID NO: 228578 - DNA, 87 bp, Artificial Sequence
  Description of Artificial Sequence: Synthetic coding sequence
atgctgagccgcaacgacggacccggattgctccgagctgggactccactatgtatttcggcagaggcagcaagtgcccagcaatag

SEQ ID NO: 228579 - DNA, 315 bp, Artificial Sequence
  Description of Artificial Sequence: Synthetic coding sequence
atgctgtcccgtaatgatgacatctgcatttacggaggcctcggacttggaggcttattactactggcagtcgtcctgctcagcgcttgcctgtgctggcttcatcgcagggtcaaacgcctggaacggagctggcacctgcttagctggtcccaagctcagggtagcagcgagcaggagctacattatgcctctttacagcgcctgccggtacccagctcagaggggcctgacctccggggacgagacaagagaggcaccaaggaggacccacgggcagattacgcctgtatcgccgagaacaagcctacgtag

SEQ ID NO: 228580 - DNA, 249 bp, Artificial Sequence
  Description of Artificial Sequence: Synthetic coding sequence
atgttatcccgcaacgacgatatttgtatttacgggggactgggcctgggcggtttgctcttgctggccgttgtcctgctgtctgcttgcctttgttggctgcaccgacgcgtgaaacgactagagcgctcttggaggctacctgttcccagctctgaagggccagatttgcgaggtcgcgacaagaggggtacaaaggaggacccacgagctgattacgcatgtatagccgagaacaagccaacatag

SEQ ID NO: 228581 - DNA, 201 bp, Artificial Sequence
  Description of Artificial Sequence: Synthetic coding sequence
atgttatctcggaatgacgtaaaacgattggagcgctcttgggcccagggctcttccgagcaagaattgcactacgccagtctccaacgcctgcctgtgccctcatccgagggtcccgatcttaggggaagagataagagaggcacgaaagaggatccaagggcagactatgcctgcatcgcggaaaataagcctacctag

SEQ ID NO: 228582 - DNA, 87 bp, Artificial Sequence
  Description of Artificial Sequence: Synthetic coding sequence
atgctgtcacggaatgatgggcctggactcttacgggcagggacccccctgtgtatctctgctgaagccgcatccgcacagcaatag

SEQ ID NO: 228583 - DNA, 132 bp, Artificial Sequence
  Description of Artificial Sequence: Synthetic coding sequence
tgaagccgtaatgatgatatctgcatatacggcggtctcggactggggggactgcttttactggcggtggtactgctatcagcctgcctgtgctggctgcatcgccgtgaggctgcctcagcacagcagtag

SEQ ID NO: 228584 - DNA, 249 bp, Artificial Sequence
  Description of Artificial Sequence: Synthetic coding sequence
atgttgtcacgcaacgacgatatatgcatatatggcggattgggcttaggtgggttgttgctgctcgcagtggtcctgttgtctgcatgcttatgttggttgcacagacgagttaaaaggcttgagagaagttggaggctgccagtcccttcgtcagagggcccagatctgcgcggacgggataagcgagggacaaaggaggacccaagggctgactatgcctgtattgcggagaataagccaacttag

SEQ ID NO: 228585 - DNA, 201 bp, Artificial Sequence
  Description of Artificial Sequence: Synthetic coding sequence
atgcttagtaggaatgatgtgaagcgcttggaaagaagctgggcacagggctcttccgagcaagagctccactacgccagtctccagaggctgcccgtgccttctagcgagggacctgacctgcggggaagggataaacgtggcaccaaggaggaccctcgagctgattatgcatgcattgcagagaacaagcctacttag

SEQ ID NO: 228586 - DNA, 180 bp, Artificial Sequence
  Description of Artificial Sequence: Synthetic coding sequence
atgctgtctagaaatgatgacatttgcatttacggaggactgggccttggcggtctgctcctgctggcagtggtcttactatctgcttgcctgtgttggttgcaccgacgcggtcctgggctactgagggccggtacacccctctgcatctcagctgaagcggctagtgcgcagcagtag

SEQ ID NO: 228587 - DNA, 87 bp, Artificial Sequence
  Description of Artificial Sequence: Synthetic coding sequence
atgctctcccgcaacgatgggccagggctgcttcgggcaggcacacccctctgtattagcgcagaggctgcatcagctcagcagtag

SEQ ID NO: 228588 - DNA, 249 bp, Artificial Sequence
  Description of Artificial Sequence: Synthetic coding sequence
atgctgtctagaaatgatgacatttgtatttatggcggactggggctcggtggtcttctactgctggctgtcgtgctgctttctgcttgtctctgttggttgcacaggcgagtgaaacgattagagcggtcatggcggctaccagtcccttccagcgagggacccgacctgcggggtagagacaagaggggcactaaggaagacccccgtgctgactacgcttgcattgcagaaaataaaccgacatag

SEQ ID NO: 228589 - DNA, 111 bp, Artificial Sequence
  Description of Artificial Sequence: Synthetic coding sequence
atgttatcacgaaatgatgacatctgcatctatgggggactgggcctgggtggattactgctgctcgcggtagtcctcctgtccgcttgtctgtgttggctgcataggtag

SEQ ID NO: 228590 - DNA, 222 bp, Artificial Sequence
  Description of Artificial Sequence: Synthetic coding sequence
atgctctccagaaacgacgtgaaaaggctggaacgcagttggcacctcctaagttggtcacaggcccaaggctctagcgagcaggagctgcactatgcatccttgcagcggctcccggttccatcttctgagggcccagatctgagaggtcgcgataagcgaggcactaaagaggacccccgagctgactacgcctgtatcgctgagaacaaacccacctag

SEQ ID NO: 228591 - DNA, 201 bp, Artificial Sequence
  Description of Artificial Sequence: Synthetic coding sequence
atgctcagccgtaacgatgttaagcgactggaaaggagttgggcacagggttcgtcagaacaagagctacactatgcctccctgcagagactcccggtaccttcgtctgagggccctgatctcagaggcagagacaaacgcggaacaaaagaagacccccgagcagattatgcgtgcattgccgagaataagccaacgtag

SEQ ID NO: 228592 - DNA, 87 bp, Artificial Sequence
  Description of Artificial Sequence: Synthetic coding sequence
atgctctctagaaacgacgggccaggactcctgagggctggtacgccactatgcatatccgctgaagccgcttcagctcagcagtag

SEQ ID NO: 228593 - DNA, 201 bp, Artificial Sequence
  Description of Artificial Sequence: Synthetic coding sequence
atgctctccagaaacgacgacatttgcatctatggtggtttaggactcggcggactactgttgctggcagtagtgctgttgtctgcgtgtctgtgttggctacatcggcgtgcaccttcggtcctggtaccaggcccaggcctgctcagagccggaacccccctctgtatctctgccgaggctgcaagcgcacaacagtag

SEQ ID NO: 228594 - DNA, 222 bp, Artificial Sequence
  Description of Artificial Sequence: Synthetic coding sequence
atgctgagtaggaatgacgtcaagcggttggagcggtcctggcacctgctcagctggtcgcaggcccagggaagttccgagcaagaactgcattacgctagccttcagcgcttgccagtgccctccagcgaaggtcctgaccttcgcggtagggacaaaaggggaaccaaggaggatccaagagctgactatgcatgcattgcggaaaacaaaccgacctag

SEQ ID NO: 228595 - DNA, 201 bp, Artificial Sequence
  Description of Artificial Sequence: Synthetic coding sequence
atgctcagcagaaacgatgatatttgcatctatgggggactaggcctgggcggtcttttgttgctggctgtcgtcctgctcagtgcttgcttatgttggctgcacagacgagcacctagcgttctggtgccgggaccaggcttgctaagggctggcacccccctgtgcatcagcgcagaagcagcctcagcccaacaatag

SEQ ID NO: 228596 - DNA, 87 bp, Artificial Sequence
  Description of Artificial Sequence: Synthetic coding sequence
atgttatccaggaatgacgggcctggcctgttgcgggctggcactcccctatgcatctccgcggaggctgcctctgcacagcagtag

SEQ ID NO: 228597 - DNA, 87 bp, Artificial Sequence
  Description of Artificial Sequence: Synthetic coding sequence
atgctctcaagaaacgatggacccggtttgcttcgagctggcactcccctttgcatcagcgctgaagccgcatccgcccaacagtag

SEQ ID NO: 228598 - DNA, 87 bp, Artificial Sequence
  Description of Artificial Sequence: Synthetic coding sequence
atgctctctcgcaatgatggaccaggtctcttgagggcagggacacccctgtgcatctcagctgaagctgcatctgcacagcagtag

SEQ ID NO: 228599 - DNA, 87 bp, Artificial Sequence
  Description of Artificial Sequence: Synthetic coding sequence
atgcttagtagaaatgatggccctggcctcctgcgcgcaggcacccccctgtgtatcagcgccgaggctgccagcgcccagcagtag

SEQ ID NO: 228600 - DNA, 294 bp, Artificial Sequence
  Description of Artificial Sequence: Synthetic coding sequence
atgctttctagaaacgacgacatttgtatttatgggggtctgggcctggggggtctgcttttgctggccgtggtattactatcggcgtgcctgtgctggttgcataggagggttaaaaggctggagcggtcttgggcacagggaagctcagagcaagagctgcattatgccagcctgcagagactgcccgtgcccagttccgagggacctgacttgaggggacgcgacaaacgtggaaccaaggaggatccaagagcggattatgcatgcatcgcagagaacaaaccaacatag

SEQ ID NO: 228601 - DNA, 222 bp, Artificial Sequence
  Description of Artificial Sequence: Synthetic coding sequence
atgctaagccgaaatgacgtgaagcgcttagagaggtcttggcatctgctgtcgtggagtcaggctcaagggtcttcggagcaggagttgcattatgccagcctgcagagactgccagtgcctagtagcgaggggccagacctgagaggaagagataagcgcggtactaaagaggacccaagggctgattacgcttgtattgcggagaacaagcccacatag

SEQ ID NO: 228602 - DNA, 87 bp, Artificial Sequence
  Description of Artificial Sequence: Synthetic coding sequence
atgctttcccgtaatgatggccctggtctccttcgcgctgggactcccctttgcatcagtgccgaagccgcatcagcccagcagtag

SEQ ID NO: 228603 - DNA, 294 bp, Artificial Sequence
  Description of Artificial Sequence: Synthetic coding sequence
atgctctcgcggaacgatgacatttgtatctatggtggcttagggctggggggattacttcttttagcagtcgtgttactgagcgcctgcctatgctggctacaccggagggtgaaacgtttagagcgtagttgggcacaggggtcctccgaacaggaactccattacgctagcctgcagaggctgcccgtgccttcaagtgagggcccagacctgagaggacgtgacaaaaggggaaccaaagaggacccacgcgcagactacgcttgcattgctgagaataaaccgacttag

SEQ ID NO: 228604 - DNA, 201 bp, Artificial Sequence
  Description of Artificial Sequence: Synthetic coding sequence
atgcttagtagaaacgacgtgaagagactcgagagatcttgggctcagggatcctccgaacaggagcttcactacgccagtctgcagagactacccgtgccctcttccgaggggcctgacctgcgaggaagggacaagagggggaccaaagaagatcctcgcgcagattatgcttgcatcgccgagaacaagcctacatag

SEQ ID NO: 228605 - DNA, 87 bp, Artificial Sequence
  Description of Artificial Sequence: Synthetic coding sequence
atgctgtccaggaatgacggacccggattactacgtgccggaacgcctctgtgcatttcagctgaggccgcatctgctcaacagtag

SEQ ID NO: 228606 - DNA, 201 bp, Artificial Sequence
  Description of Artificial Sequence: Synthetic coding sequence
atgctgtcaaggaacgacgtaaaacggcttgagcggtcctgggcccaaggctcaagcgagcaggagttgcattatgcctcactgcagaggttaccggtgccaagcagcgagggacctgacctgaggggaagagacaagcggggaaccaaagaggacccgagggccgactatgcttgtatcgcggagaacaagccaacctag

SEQ ID NO: 228607 - DNA, 42 bp, Artificial Sequence
  Description of Artificial Sequence: Synthetic coding sequence
atgctgagtcgcaatgatgaagccgcaagtgctcaacagtag

SEQ ID NO: 228608 - DNA, 132 bp, Artificial Sequence
  Description of Artificial Sequence: Synthetic coding sequence
taccggggaatgatgatttacgtgagtacaggtgcctggggatgggccggttcttgcttctggcaatggtccttttgccctcccgcatgtgtcggctgcatcgaggaaagattgcctgtcccaagcagctag

SEQ ID NO: 228609 - DNA, 201 bp, Artificial Sequence
  Description of Artificial Sequence: Synthetic coding sequence
atgttatcccgaaatgatgtgaagcgactggagaggtcttgggcccaggggtcctcagagcaggaactgcactatgcgagcctccagcggctgcctgtcccctcctcagaggggcctgatctgcgcggaagggataagcggggaaccaaggaagacccccgagccgattacgcttgtatcgccgagaataaacccacgtag

SEQ ID NO: 228610 - DNA, 294 bp, Artificial Sequence
  Description of Artificial Sequence: Synthetic coding sequence
atgctttcgcggaatgacgacatctgtatttacgggggtctaggtctgggtggactgctgctgctggcggtggttctgcttagtgcttgcctctgttggctgcaccgacgcgtgaagaggctggaaagatcatgggcccagggatcttccgagcaggaactgcactacgccagtcttcagcgtctcccagttccatcatctgagggtcctgatctccggggacgtgacaaaaggggaacaaaagaggatcctcgcgctgactacgcctgcattgctgaaaataagccaacttag

SEQ ID NO: 228611 - DNA, 222 bp, Artificial Sequence
  Description of Artificial Sequence: Synthetic coding sequence
atgctgagcaggaacgatgtgaaacggttagagaggtcctggcacctcctgtcatggtcacaggctcagggatcttcagaacaggagcttcattatgctagcctgcagaggctgcccgtacctagcagcgagggtccagatctgagagggagggacaagcgaggaacaaaagaagacccacgggctgattacgcctgtattgccgagaacaagcctacttag

SEQ ID NO: 228612 - DNA, 42 bp, Artificial Sequence
  Description of Artificial Sequence: Synthetic coding sequence
atgctgagtcgcaatgacgaagcagcctctgcccagcagtag

SEQ ID NO: 228613 - DNA, 276 bp, Artificial Sequence
  Description of Artificial Sequence: Synthetic coding sequence
atgatttacgtgtctacaggtgcctggggctgggccggaagttgcttttggcagtggagcttctgccctcccgcatgtgtcggatgcatcgaggaacatctcttaagttggtcacaggcccaggggtctagcgagcaggaacttcattacgccagtctgcaaaggttgcctgtacctagctccgaaggacccgatctccggggtcgggacaagcgaggcaccaaagaggacccacgcgctgactatgcgtgtattgccgaaaacaaacccacatag

SEQ ID NO: 228614 - DNA, 276 bp, Artificial Sequence
  Description of Artificial Sequence: Synthetic coding sequence
atgatttacgtcagtacaggcgcatggggatgggcaggatcctgtttctggcagtggagcttctgtccacccgcatgcgttggctgcattgaggaacacctactgtcttggagtcaagcacaggggtcttccgagcaggagcttcactatgcatcactgcagcgtctacctgtgccctcttcggaaggaccagacctcagaggtagagataaacggggtaccaaagaagatcccagggctgattacgcctgtatcgcagagaacaaacccacctag

SEQ ID NO: 228615 - DNA, 276 bp, Artificial Sequence
  Description of Artificial Sequence: Synthetic coding sequence
atgatctacgtgtccactggcgcatggggctgggcgggaagctgtttctggcaatggtcattctgtcctccagcttgcgtcgggtgtatcgaagaacaccttctgtcctggtctcaggctcaggggtcaagcgagcaagaactgcactacgcttctctccagagattgccagttccaagttctgaaggacctgatctccggggaagagacaagaggggcaccaaggaggatccgcgtgctgactacgcctgtatagccgagaacaagcctacctag

SEQ ID NO: 228616 - DNA, 108 bp, Artificial Sequence
  Description of Artificial Sequence: Synthetic coding sequence
atgcttagccgcaacgacgctccctccgttttagtgcctggacctgggctcctcagggcgggaacccctttgtgtatcagcgccgaagcagcctccgcacagcaatag

SEQ ID NO: 228617 - DNA, 276 bp, Artificial Sequence
  Description of Artificial Sequence: Synthetic coding sequence
atgatctacgtctctactggcgcttggggttgggcagggtcctgtttctggcagtggtccttctgtcctccagcatgtgtagggtgcattgaggaacacctcttgtcctggagccaggcccaaggttccagcgaacaagagctgcattatgccagtctccagagattaccggtgccttctagcgaagggcctgatttaagaggacgcgataagcgtggtacaaaggaggatcccagagccgactacgcttgcatcgcggaaaataaacctacgtag

SEQ ID NO: 228618 - DNA, 108 bp, Artificial Sequence
  Description of Artificial Sequence: Synthetic coding sequence
atgttgagcagaaatgacgcaccctcagtgctagtgcctggtccaggtttgcttcgggctgggactcccctgtgtatatcggccgaggcagcctctgcacagcagtag

SEQ ID NO: 228619 - DNA, 108 bp, Artificial Sequence
  Description of Artificial Sequence: Synthetic coding sequence
atgctgagccgcaacgatgccccaagcgtgttggttcccggacctgggcttctgcgtgctggcacgccactgtgcatctccgctgaagcagccagtgcacaacagtag

SEQ ID NO: 228620 - DNA, 276 bp, Artificial Sequence
  Description of Artificial Sequence: Synthetic coding sequence
atgatctacgtgagcaccggagcctggggatgggctggctcctgcttttggcaatggagtttctgtccgccagcctgtgtcggatgtattgaggaacacctactgtcctggtcacaagcgcaaggctcgtctgagcaggagctacactatgcctccctgcagcggttgccagtaccttctagcgaggggcctgacctgcgtggtagagacaagcggggaacaaaagaagacccaagagctgattatgcatgcattgcagagaacaagcccacttag

SEQ ID NO: 228621 - DNA, 276 bp, Artificial Sequence
  Description of Artificial Sequence: Synthetic coding sequence
atgatctacgtatctaccggtgcctggggatgggctggttcatgcttttggcagtggtcgttttgtcccccagcctgtgtaggctgtattgaagagcacctcctgagctggtcacaagctcagggctcctccgaacaagagttgcactacgcttccctgcagcggttacctgtaccaagtagcgaaggcccagatctgcgaggtagagacaaaagagggacgaaggaggacccaagggccgactatgcttgtatcgcggagaacaagcccacatag

SEQ ID NO: 228622 - DNA, 108 bp, Artificial Sequence
  Description of Artificial Sequence: Synthetic coding sequence
atgttgagccgcaacgacgctccttccgtgttggttcccggacccggactgctgcgagccggaactcccctatgcatttcagcagaggccgcatccgcacagcagtag

SEQ ID NO: 228623 - DNA, 108 bp, Artificial Sequence
  Description of Artificial Sequence: Synthetic coding sequence
atgctgagtagaaacgacgcaccatctgtcctggtgccgggacccggtctgctgagagccggtacacctctgtgcatttcagccgaggccgcttcagctcaacagtag

SEQ ID NO: 228624 - DNA, 108 bp, Artificial Sequence
  Description of Artificial Sequence: Synthetic coding sequence
atgctcagccgaaacgacgcacctagcgtattggtgccagggcctgggctgcttcgcgcagggacccccctatgtatatctgccgaggctgcctctgcacagcagtag

SEQ ID NO: 228625 - DNA, 108 bp, Artificial Sequence
  Description of Artificial Sequence: Synthetic coding sequence
atgctgtccaggaacgatgctccgtctgtgttagtgcctggtcctgggctactgagagccggaactcccctgtgtatcagcgcagaagctgcctccgctcagcagtag

SEQ ID NO: 228626 - DNA, 276 bp, Artificial Sequence
  Description of Artificial Sequence: Synthetic coding sequence
atgatctacgtgtcaacgggggcatggggttgggctggctcctgcttctggcagtggagtttctgcccccctgcatgcgtgggttgcattgaggaacacctgttgtcatggtcccaggcccaaggctcttctgagcaggagctacactacgccagcctgcaaaggctcccggttcctagctctgagggcccagaccttagggggagggataagagggggacaaaagaggacccaagagctgactacgcatgtattgccgaaaacaaacccacttag

SEQ ID NO: 228627 - DNA, 843 bp, Artificial Sequence
  Description of Artificial Sequence: Synthetic coding sequence
atggagcgtgagatggtgctgtgtctggcccaaactattcatacccaagaagatctccccagaccatccatctcagccgagcccggaaccgtgatccctctaggatcacacgtcacgttcgtgtgtcgtggcccagtgggtgttcagacgttcaggctcgagagggagtcaagatccacctataatgacaccgaagacgtgagccaagcttccccctccgagagtgaagctagattcagaatcgacagcgtcagcgaaggcaacgcagggccttatcgctgcatttattacaagcctcctaagtggagcgaacagtccgattacctcgagctccttgttaaagaaacctctggaggccctgacagccccgataccgagcccggatccagtgcagggccaacacagcggccatccgataatagtcataatgagcacgctcccgcatcccaaggactgaaagccgaacacctctacatcctgatcggtgtgagtgtggtcttcctcttctgtctcctcctgctggttttgttttgtttgcaccggcagaaccaaatcaaacagggtccacctcgctccaaggacgaggagcagaagccgcagcagcggccagacctggccgtcgacgtgctggaaaggacagcagacaaggcgaccgtgaacggcctccccgaaaaggatcgcgaaacggacacgagcgccctcgccgctggttctagccaggaagtcacgtatgcacagcttgatcactgggcattgactcagagaacggccagggccgttagcccacagtctacaaaacccatggcagaaagcataacgtatgctgccgtagctagacattag

SEQ ID NO: 228628 - DNA, 813 bp, Artificial Sequence
  Description of Artificial Sequence: Synthetic coding sequence
atgtcaccccatccgacagctctgctcggtctggtgctctgtctcgctcagaccatccatacccaggaggaggacctccctagaccctccatctccgccgaacccggaactgtcattccactcggtagtcatgttacctttgtctgtagagggccagtgggcgtccaaacctttagactggaacgggaatcacgcagcacatataacgatacagaagacgtctcacaggccagcccgtctgagtcggaggcccgatttcggatcgacagcgtgagtgagggcaatgccggaccttataggtgtatttactataagccccctaaatggtccgagcagagcgactatttggagctgctcgtgaaaggacccacgcagcgaccctctgacaattctcataatgagcacgctccagcgtcacagggcttgaaggcagagcatctctatattctgattggcgtgtctgttgtttttctgttttgcctgctgttattggtgcttttctgtctccaccgacaaaaccagattaagcaagggcctcccaggtccaaagatgaggagcagaagccccagcaaagacctgatttagcagtcgacgtcctcgagcggactgccgataaagcaacagtgaacgggctcccagagaaggatcgcgaaacagacacctcagcccttgccgctggttcttctcaggaggtgacatacgctcagctggatcattgggccctgacacagagaacagccagggcggtgtctcctcagtcgacgaaaccaatggcagagagcatcacatatgcggctgtggcacggcactag

SEQ ID NO: 228629 - DNA, 864 bp, Artificial Sequence
  Description of Artificial Sequence: Synthetic coding sequence
atgagtcctcaccccaccgctctgttggggctcgtgctttgcctcgctcagaccatacacacacaagaggaggatctccctagaccgtccatatctgcagagcccggtaccgtgatcccactcggctcacatgtcaccttcgtgtgtcgcggaccggtaggagtccagactttccgcctggaaagagaatcaaggtcaacctacaacgacacagaggacgtaagtcaggcttcaccatctgagtccgaagcccgattccggattgacagtgtttccgaggggaatgctggaccttacagatgcatctactacaagccccctaagtggagcgaacagagcgactatctcgaactcctggtgaaggaaacctcaggtggacccgattcccccgacacagagccgggatcttcagcgggacctacccagagaccatccgacaattcccataacgagcatgcccctgccagccaagggttgaaggcagagcacctgtacattctaataggtgtgtccgtcgtgttcttgttttgtctgcttctgcttgtgctattctgcctgcatcgccagaaccagatcaagcaaggaccgcctaggtcaaaggacgaggagcagaaaccgcagcagcggccagatttagccgttgatgtgttagagcgaacagccgacaaggcgacagtgaatggccttccagaaaaagaccgcgaaacagacacttccgctctagctgctggaagctcacaggaagtcacttacgctcaattggaccattgggctcttactcagcgaaccgcacgcgctgtgagcccccagtctacgaaacccatggccgagtcaatcacttatgcagctgtggcaagacactag

SEQ ID NO: 228630 - DNA, 1545 bp, Artificial Sequence
  Description of Artificial Sequence: Synthetic coding sequence
atgctcactcgtgtaaagtccgccgttgcgaactttatggggggaataatggctggctccagcgggagcgaacacggcggtggaagctgcgggggatccgacttgccccttcgcttcccatacgggcgacctgagtttctgggcttaagccaggatgaagttgagtgttctgccgatcatatagcacgccctatccttatcttgaaggagaccagaaggttgccttgggccaccgggtacgccgaagtgataaacgccggaaagtcaacacataacgaggaccaggcctcgtgcgaggtgctgacagtgaagaagaaagctggcgcagtgacatcaacgccaaacagaaattcctctaaacgaagatcctccctgcctaatggcgagggtctgcagttaaaggagaactccgaatcggaaggtgtaagctgccattactggtccctgttcgacggacacgcgggttcaggcgcagccgttgtggcatcgcgattgttacagcaccatatcactgagcagctccaggacatcgtcgatatcctcaagaacagcgcagtgctgccacctacctgcctgggcgaggaaccagagaatactcctgcgaattccaggaccctcacccgtgccgcttctctgagaggcggtgtcggggctcccggatcaccgagtacaccacccaccagattctttacagagaagaagattccccacgagtgcctggtcatcggggctctggaatctgcatttaaagagatggatctgcagatcgaacgtgaaaggtcttcatataatataagcgggggttgtaccgctctgatcgtgatatgtttattgggcaaactttatgtggcgaatgccggtgacagccgggctatcattatcagaaatggcgaaatcatccctatgtctagcgagttcacacccgagacagaacggcagcgtttacaatacctcgcgtttatgcagccccacttgctcggcaatgagtttactcacctggaattccctcgtcgagtacaaaggaaagaactgggcaagaagatgctctacagagacttcaatatgacaggctgggcctacaagactatcgaagacgaagacctcaaatttcccctgatctatggcgaaggaaaaaaggcaagggtaatggcgaccatcggagttacacgcggtctgggtgaccacgatcttaaggtccacgactcaaacatctacatcaagcctttcctctcttcagcccctgaagtgcgtatatacgacctgtctaaatatgaccacggaagtgacgatgttctcatcctggcgaccgatggcctatgggatgtgctgtctaatgaggaagttgcagaagctatcacccaattcttacctaactgcgatcctgatgaccctcaccgttatactttagctgcacaggatctcgtcatgcgtgctcgtggcgtactgaaggacagaggatggcgcattagcaacgacaggctcgggagtggagacgacatatctgtgtatgtcattcctcttatccacggaaataaactaagttag

SEQ ID NO: 228631 - DNA, 1527 bp, Artificial Sequence
  Description of Artificial Sequence: Synthetic coding sequence
atgcttccccaacgaaacttatctaaacgacaggtgcctaccatgcatataccagtcaaaacacggaggctgttagccgcactcaaggtccttgacacaaaggatctgaccatagaaaaggtggtcataaatggtcaggaagtcaagtacgcccttggggagcgacagagttataagggatctcccatggaaatctctctacctatcgcactcagtaagaaccaggagatcgtcatcgaaatctcttttgaaacgtctccgaaatccagcgctctgcaatggctgacccccgaacaaacgtctggcaaggagcacccctaccttttctcacagtgtcaggcaattcactgcagggctatcctgccttgtcaggacacaccgagcgtgaagttgacatacacagccgaggtgtccgttcctaaagaactggtcgccctcatgagcgcgattcgggacggcgaaacacctgacccagaagacccatcccggaagatctacaagtttattcagaaagtcccaataccctgttatctaatagcactggttgtgggcgcattagagtcacgtcagatcggccctcgcacgctggtctggtcagaaaaagaacaggttgagaaatcggcctacgagttttcagagaccgagtcgatgctgaagatcgcagaggatttgggcggaccatacgtgtgggggcagtacgatctgctggtgttgcccccatctttcccatacgggggaatggagaacccctgtctgacctttgtgacgccaaccttactggccggtgacaaatccctgtccaacgtgatcgcccacgaaatatcacactcgtggactggcaacctcgtaacaaacaaaacatgggaccacttttggctcaatgaaggacacaccgtgtatctcgaaaggcatatttgcggtcgattattcggcgagaagttcaggcactttaatgcgctcggaggatggggggagctgcagaattcggtgaagacctttggcgagacacacccctttaccaagcttgttgtggatctgacggatatcgaccccgatgtggcctacagttctgttccctacgaaaagggtttcgccctgcttttttacctggaacagctgctcggcggaccagagatctttctcggctttctcaaggcctacgtggagaagttctcctataaatccatcactacagacgactggaaggatttcttgtacagctacttcaaagacaaagtggatgtactgaaccaggttgactggaacgcgtggttgtacagtccaggcctgcctcccatcaaacccaattatgacatgacactcacgaacgcatgtatcgcgcttagccagcgctggattacggctaaagaggatgatctgaactcatttaatgccacggacctcaaagacctctcaagccaccaactcaatgagttcctggcccagacactccagcggatggcagcagcccttcacagtatccaggtgggcggaaggaactctttcggggcaaaggacggcaactag

SEQ ID NO: 228632 - DNA, 1764 bp, Artificial Sequence
  Description of Artificial Sequence: Synthetic coding sequence
atgctgcctcagaggaatctaagcaagagacaggtcccaaccatgcacataccagtgaagacacgcagattactcgccgcactcaaggtgctggataccaaggaccttaccatagagaaggtcgtgataaacggtcaagaggtgaagtacgcacttggagagcgacagtcctataaaggctcaccaatggaaattagtctcccgattgccctgtctaaaaaccaggaaatagtgatcgagatttcctttgagacctctcccaaaagtagtgctctgcagtggttgactcccgaacagacaagcgggaaagaacatccgtacttattctcgcagtgtcaggccattcactgccgcgctatactgccttgtcaagataccccttctgttaaactcacctatacagctgaagtatccgtgcctaaggaactcgttgctcttatgagtgcgatcagggacggcgagactccagacccagaggatccatccaggaaaatctacaaattcattcaaaaggtgcccatcccctgttatctaatcgcgctcgtcgtaggggctcttgaatcacgacagatcggcccacggacattagtctggtcagagaaggagcaagtggaaaagtctgcttatgagtttagtgaaacagaatcaatgctgaagatcgccgaggacctgggcggaccctatgtgtggggacaatacgatctcctggtgctgccccctagtttcccatatgggggaatggaaaacccctgcctcaccttcgtgaccccaacattacttgcaggtgacaaaagtctatcaaacgtgattgcgcatgaaatttcgcattcctggacagggaacctggtcaccaacaaaacatgggatcatttctggctgaatgaaggacacaccgtatatctagagcggcatatctgtggacgtctgttcggcgagaagtttcgccatttcaacgctctggggggttggggggagctgcagaactcggtgaaaacgtttggggagacccacccttttactaagctggtggtcgacctcaccgacatagacccagacgtagcttacagtagcgtcccttatgagaaagggtttgcgctcctattctacctggagcagttgctcggcggaccagagatatttctgggtttcttgaaggcgtacgtggaaaaattcagttataagtctattaccactgacgattggaaggatttcttgtatagctattttaaggataaggtggacgtactcaatcaagtcgactggaatgcttggctgtactctcctgggcttcctcccattaaacctaactacgatatgacactcaccaatgcttgcatcgcactgtctcaacgatggattactgccaaagaggacgacttgaattccttcaatgccacggacctaaaagatctctcctcccatcagctcaatgagtttctggcccagacactgcagagggccccactaccgttaggccatatcaaaagaatgcaggaggtgtataactttaacgctattaacaattctgagatccgatttcgctggctcaggctctgtatacagtccaaatgggaggacgctatccccctggccctgaaaatggccaccgaacagggcaggatgaagtttacacgtcctttgtttaaggatcttgcagcttttgacaaatcacacgaccaggctgtcaggacctatcaggagcataaggcctccatgcaccctgtcacagcaatgctcgtgggaaaagacctaaaggtcgactag

SEQ ID NO: 228633 - DNA, 1059 bp, Artificial Sequence
  Description of Artificial Sequence: Synthetic coding sequence
atgaacaccacttcctccgcagccccacccagcctgggagtcgaattcatcagcctactggcaattattctactgtctgtcgcactggcagtcggtcttcctggcaactcctttgtggtttggagcatcctgaaacggatgcagaaaagatccgtcaccgcacttatggtcctaaatctggctttggctgacctggccgtattgttaactgctcctttctttctccacttcttggcacagggaacctggagcttcgggctggctggttgccgcctgtgtcactatgtttgtggtgtcagtatgtacgccagtgtcctgctgatcaccgctatgtccctggaccggtcccttgcagtggctaggcccttcgtttcacagaagttacgcactaaggccatggccaggcgagtcctcgccggaatttgggtgctctcatttctcttagccactcccgtcctggcctatcgcactgtagtaccctggaaaactaatatgagcctctgtttcccacgttatcccagcgaagggcacagagctttccatctgattttcgaagcggtgacgggtttccttttgccatttctcgcagtggtcgcctcctactctgacatcgggcgaaggctccaggcacgaaggtttcgacggtctagacggactggcagactggtggttttaatcattcttacctttgccgctttttggttgccttaccacgtggtcaaccttgccgaggctggtcgggctctcgcaggacaggctgccggtctaggacttgtcggtaagagactcagccttgccaggaatgtgctgatcgcactggcttttttgtcctcctccgtcaaccccgtgctgtacgcttgcgcagggggagggttactcagaagtgcaggcgtaggtttcgtggcaaaacttttggaaggtactggctcagaggctagcagcacgcgaaggggcggatccttgggacaaaccgcaaggtctggccctgccgcattagagcccggacctagcgagagtttgacggcatcaagtccactgaagctcaacgagctgaattag

SEQ ID NO: 228634 - DNA, 1059 bp, Artificial Sequence
  Description of Artificial Sequence: Synthetic coding sequence
atgaacaccacctcaagtgcggctccgcctagtctgggcgttgaattcatcagtctgctggccattattctcctgtccgtcgcactggcggtgggcttaccagggaattctttcgtagtctggtctatactcaagagaatgcagaagagaagcgtcacagctttaatggttttgaatttagctctcgcagacctcgcggtgctgctcaccgctcctttttttcttcacttccttgctcagggcacgtggtctttcggactcgcaggatgtcgtctctgccactatgtgtgtggagtgagcatgtatgcttccgtgctcctgattacggctatgagcttggacaggagcctggccgtcgccagaccgttcgtgtcacagaaactgcgtactaaagcaatggccagaagagtactcgctggtatctgggtgctttcttttcttttagctactccagtgctggcatataggactgtggtaccttggaagaccaatatgtccctctgctttccaaggtatcctagtgaaggacacagagcgtttcatctaattttcgaggctgtcaccggttttctcctgccctttttagctgtggtggccagctattctgatattggacggaggctccaagctagacgtttccgtaggagtcgtcggacaggaaggctggtggttttgattatccttacctttgcggcattctggctgccttatcatgtggtgaacctggcagaagccggtcgagcgctggcaggacaggccgctggattaggcctggtgggtaagagactgagcctagcgcgtaatgtcctgatcgcactagcgttcttgtcctctagtgttaaccccgtcctctacgcttgcgcagggggagggttgttaaggagcgccggtgtgggattcgtggcaaaattgcttgaggggaccggcagcgaggctagctccactaggcgcggaggctccctgggtcagacagctcgatctgggccagcagctctcgagccaggaccaagtgagagtctaacagcctccagcccactcaaattgaacgagctcaattag

SEQ ID NO: 228635 - DNA, 1059 bp, Artificial Sequence
  Description of Artificial Sequence: Synthetic coding sequence
atgaatactacctcaagtgctgccccaccatccctgggagtggaatttatctctctcctggcaataatactcctgtctgtggcactagccgtggggctgcctggcaatagctttgttgtgtggagtattctgaagcgtatgcagaaacgatcagttacagcgctgatggtgctgaacctggctctcgccgacctcgccgtcttgctgacagctcccttttttcttcacttccttgcacagggcacgtggtcttttggtctcgcgggatgccggctgtgtcattacgtctgcggcgttagtatgtatgctagcgtgctgctgatcacggccatgtccttagatcgcagtttggcggtggctcggcctttcgtttcacagaagctacggaccaaagcaatggccagacgggtgctggcaggaatttgggtcctgtccttcctgcttgcaacaccagtcctggcttaccggaccgttgtgccctggaagacgaatatgtcactgtgcttcccgaggtacccaagcgagggacacagagccttccatttgatcttcgaagccgtgaccggatttctgctgccttttttggctgtagttgcctcctattccgatataggcagaaggctccaggcgcgacgttttcgtagaagccgaaggacgggacgcttagtggtactgatcattctgactttcgccgctttctggttaccctaccatgtggtgaacctggcagaggccggtcgagccttagccggacaggccgcagggctgggcctcgtggggaagagactgtcgttggccagaaacgttctcattgcactagcctttctcagctcatccgtgaaccccgtgctgtacgcctgtgccggaggcggactactgaggtcagcgggtgtagggtttgttgccaaactgctggaaggcaccgggagcgaggccagcagcacacgtagagggggtagtctgggccagaccgctaggagcggccctgccgcactcgagcctggaccttctgagtctctgaccgccagctcgcccctgaaactgaatgaattaaattag

SEQ ID NO: 228636 - DNA, 309 bp, Artificial Sequence
  Description of Artificial Sequence: Synthetic coding sequence
atgaatacaacctcctcagccgctcctccgtctctcggagtggaatttataagtttacttgccatcatcctgttgtccgtagccttggcagttggattgcctggcaactccttcgtggtgtggtcaattctcaagaggatgcaaaagcgcagtgttacggccctcatggtgctgaatctagccctggcggatctagcggtactgctgacagctccattcttcctgcacttcctggcccagggcacctggtcctttggactggcaggatgccgtctgtgccattatgtgtgtggggtgtccatgtactag

SEQ ID NO: 228637 - DNA, 483 bp, Artificial Sequence
  Description of Artificial Sequence: Synthetic coding sequence
atgtcagtgtgctatagacccccaggtaatgagacattgctgagttggaagacctcccgcgcaaccggaacagctttcctcttgttagcagcgctgctcggcttacccggtaatggcttcgtagtctggagcctggccggatggaggccagctagaggcaggcccttggctgccaccctggtgctgcatttggcgttggccgacggagccgtgttattgctaacaccgttgttcgtagcctttttaacgcgccaggcttggcccttggggcaggcaggctgtaaagccgtttattacgtttgtgccctttccatgtatgcgtccgtgctcctgacaggactgctatcgctgcagcggtgcctggccgttactcgtccctttcttgctcctcgcctgcgtagtccagccctggctcgccgactcctgctggccgtttggctggcagcactgctgctcgccgtgccagccgctgtgtacaggtag

SEQ ID NO: 228638 - DNA, 1170 bp, Artificial Sequence
  Description of Artificial Sequence: Synthetic coding sequence
atggcaccctctcacagagcttcccaggtgggattctgtccaactcctgaaaggcccctgtggcgtttgcccccaacttgtcgcccacggcgaatgagcgtgtgctacaggccgccaggcaatgagacacttctgtcgtggaagacttcccgtgcaacaggaactgcttttctcctacttgccgctctgctcggactgccaggtaacggcttcgtggtatggagcctagcaggctggcggccagcccgaggccgtcccctcgctgccaccctcgtgctacacttagccctggctgatggcgctgttctgctgctgacacccctcttcgtggcgttcctcacccgccaagcatggccacttggccaggccggatgcaaagcggtctactacgtgtgtgccctgtccatgtacgcttctgtgctccttaccggcctcttgagcctacagcgttgtctagccgtcaccagaccgtttctcgctcctagactcagaagcccagccctcgctaggcggctcctcctggctgtctggctagcagcactgctcctggccgtgcctgctgccgtttaccgccatttatggagggaccgggtatgtcagttgtgtcatccctcacctgttcatgccgctgcccacttaagccttgagacattgaccgccttcgtacttccgttcggcctcatgctgggctgttacagcgtgactcttgccagactgcggggtgccaggtggggctcaggacgccatggtgcgagggtcgggagactcgttagcgctatagtgctggctttcgggctgctatgggcaccataccatgccgtgaatcttcttcaggcagtggctgctctggccccacccgaaggagctcttgccaaactgggtggggcaggacaagcggctagagccggaaccacggctcttgccttcttcagttcatctgtgaaccccgtgctgtacgtgttcacggctggggatctgctccccagggctggacctcgatttttaacccggctgttcgagggaagcggagaagctcggggtggtggcaggagccgagagggaactatggaactcaggaccaccccacaactgaaggtcgtcggacaagggagaggcaatggagacccaggcggaggaatggagaaagatggacccgagtgggacctgtag

SEQ ID NO: 228639 - DNA, 960 bp, Artificial Sequence
  Description of Artificial Sequence: Synthetic coding sequence
atgtcagtgtgttatagaccccctgggaacgaaacactgctttcttggaagaccagtagggcgaccgggacagcctttctcctgctcgcggcactcctgggcctgccagggaatgggttcgttgtctggagtctggctggctggcgacccgcaagaggcagaccccttgcagccacactagtgttgcacctcgccctggctgacggggcagtcttgctactcacgcctctgtttgtagcatttctcacacgccaggcatggccccttggccaggccggatgtaaagctgtgtactatgtctgtgcactgagcatgtacgcttccgtcctgctaactggcctccttagcctgcagcgatgtcttgctgtgactcgacccttcctcgccccacgtcttcggtctcccgctctcgccaggaggctcctgctggcagtctggcttgctgccctgctgctcgctgtcccagcagcagtgtacaggcacctttggcgggaccgggtatgtcagctctgccatccgtcccccgtgcacgcagctgcacacctgtccctcgagaccctcaccgccttcgtcctgccattcgggttaatgttgggttgctatagcgtgactctggccagactacgaggagctaggtggggctccgggaggcacggagctcgggtagggagactagtttccgctattgtgctcgctttcggattgctttgggctccgtatcacgccgtgaatcttctccaggctgttgccgcactggctccacccgaaggtgctcttgcaaagttgggcggtgcagggcaggccgctcgggcaggcaccaccgctcttgcgtttttttcatcgtccgttaacccagtcctctatgtgttcacggccggtgatttgctcccccgtgcgggtcctcgattcttgacccggctgtttgaggggagcggtgaagcgaggggcggaggacgatag

SEQ ID NO: 228640 - DNA, 1077 bp, Artificial Sequence
  Description of Artificial Sequence: Synthetic coding sequence
atgtccgtgtgttaccgcccaccgggaaatgaaacactcctctcttggaagacctccagagctacagggacagccttcttgctgttagctgcactccttggtctgcctgggaacggcttcgtcgtgtggagcttggccggatggagacctgctcgcggaagaccactggcggcaacgctggtactgcacctggctttggcggacggggcagtactgctgctaactcctctgttcgtagcattccttacgagacaagcttggccactcggccaggcgggttgtaaggccgtctactatgtttgcgctctctcaatgtacgcgtccgtccttttgaccggcctgctgtctctccagcggtgtctggccgtcacgcggccttttctcgcgccaagactccgaagccctgctctcgcgcgacgcctgctcctcgcggtttggctggccgcactactcctggccgtgccagctgcagtttacagacacctctggagggatagagtttgccagctgtgtcacccttctccagtccacgccgcagcccacctcagcctggagactctcaccgcttttgttctgcccttcggtctcatgctcgggtgctattcagtgacattagccaggttaagaggtgcccgttggggttccgggaggcatggggctagagtgggcagactcgtgtcagctatcgtgctggcgtttggtctgctgtgggccccatatcatgccgtgaatctgctgcaggccgtagcggcactagctccacccgaaggagccctcgccaagttgggcggagcaggtcaggccgcaagggccggaacgacggcactcgctttcttttcttcatccgtgaatcctgtgctctacgtctttaccgcaggcgacctgctgccaagggccggtccgaggttcttgactcgcctgtttgaaggatcaggcgaggcgagaggcggaggccgatccagagaaggaacaatggagctgaggaccaccccgcagttgaaggtggtgggtcaagggagggggaacggtgatccagggggtggcatggagaaagacggccctgagtgggacttgtag

SEQ ID NO: 228641 - DNA, 1077 bp, Artificial Sequence
  Description of Artificial Sequence: Synthetic coding sequence
atgtcggtgtgctatcgccctcctggcaatgagacactgctgtcatggaagaccagtcgtgcgacgggcaccgcctttctgttactcgccgcacttctcgggctcccgggaaatggcttcgtggtctggtcccttgccggttggagaccggctagagggaggcctctagccgcaacgttagtgttgcacctggccctagccgacggggcagttctgctacttaccccactattcgtcgcgtttctgactcggcaggcttggcctctgggtcaggccggatgcaaagcagtgtattacgtgtgcgctttgagtatgtacgcctcagttctattgaccggtctgttgtcgctgcagcgatgtctcgcagtgacaaggccattcctcgccccacgcttgaggagccccgcactggctagacggcttctcctggccgtctggttagccgctctgctgcttgctgtgcccgcagccgtgtacaggcacttatggagggacagagtgtgtcagctttgccaccctagccccgtacacgcagccgcacacttgagcctcgaaactttgacagcttttgtgttgccatttgggctgatgctgggctgttattctgttacactcgccagacttaggggcgctcggtgggggagcggtcgccatggcgcacgggtgggcaggcttgtgagtgctatcgtcctcgcttttggtctcttgtgggccccataccacgcagtgaacctgctccaagccgtggcagcccttgccccaccagaaggagctctggcaaagcttgggggagccggacaggcggcaagagccggaacaactgccctggcatttttcagcagttcagttaatccagtcctgtacgtattcactgcaggagacttgttaccacgtgccggacccaggtttctaactagattgttcgaaggttcgggagaggcacgcggaggcggtcgctccagggaaggaactatggaactgaggacgacacctcagttaaaagtggtgggccagggaaggggtaacggggaccctggcggagggatggagaaagacggtcccgaatgggacctttag

SEQ ID NO: 228642 - DNA, 453 bp, Artificial Sequence
  Description of Artificial Sequence: Synthetic coding sequence
atgaaagacgaagttgccttattggccgctgtaacccttttgggggttctccttcaggcctactttagcttgcaggtgatttctgccaggcgggctttcagagtgtccccccctctcacaaccggacctcccgagttcgagcgcgtgtaccgcgctcaagtgaactgttctgagtattttcccctgtttttggcgaccctgtgggtggcagggattttctttcacgagggcgcagcagccctctgtggcctggtgtacctcttcgcacgcctgcgatatttccaggggtacgcacgttctgcgcagctgaggctcgcacccctttatgcttcagccagggcgttgtggttactggtggccctcgccgcactcgggctccttgcccatttcttgcccgcagccctccgtgcagctttgcttggccgtctacggaccctgctcccttgggcgtag

SEQ ID NO: 228643 - DNA, 1161 bp, Artificial Sequence
  Description of Artificial Sequence: Synthetic coding sequence
atggaagaactcgacgccctgctagaagagctggagcggagtactctccaggactcggatgaatattcgaacccagccccattacctttggatcagcatagcaggaaagagaccaacctggatgaaacatcagagatccttagtattcaagacaatacttctcccttacccgctcagctggtatacacaaccaacattcaggaactgaacgtatattcagaggcacaggagcccaaggagtctccacctccgtctaaaacttctgccgctgcacagctggatgagcttatggcccatctgactgagatgcaggctaaggttgccgtccgagccgatgcgggtaaaaagcacctgcccgacaagcaagaccataaggcctcgttagattccatgctcggcggactcgagcaggaactgcaagacctgggaatcgctaccgtgcccaaggggcattgcgccagctgccagaaacccatcgctggcaaagttatccacgctttggggcagagctggcatcccgagcatttcgtgtgcacacactgcaaggaggagattggctccagcccgttcttcgagagaagcgggctggcctactgccctaatgactaccatcagctgttctctccaagatgcgcttactgtgccgcacctattctggacaaggtgctaaccgccatgaatcagacctggcatccggagcacttcttttgcagccactgcggtgaggtgtttggagctgaaggatttcatgaaaaggacaagaaaccgtattgtcgcaaggattttctcgccatgttctcccctaagtgtggcggttgtaaccgccctgtgctcgaaaactacctgagcgccatggacaccgtgtggcatcctgaatgcttcgtgtgcggggactgcttcaccagcttttctaccggctcatttttcgaactcgatggtagacctttctgtgaactccactatcaccaccggagagggaccctgtgccatggctgtgggcagcccatcacaggacggtgtatttcagccatgggttacaagttccatccagaacacttcgtctgtgctttctgccttactcaactgtccaaagggatcttccgggaacagaatgacaaaacctactgtcagccttgcttcaacaagctgtttccactgtag

SEQ ID NO: 228644 - DNA, 1176 bp, Artificial Sequence
  Description of Artificial Sequence: Synthetic coding sequence
atgtctacccttctgatcagctctagtgacgctctgttagaggagttggaacgctcaacgctccaggactcagacgagtactccaatcccgcaccactgccgttggaccagcactccagaaaagagactaacttggatgaaactagcgaaatcctatccatccaggataacactagtcctctgccagcacagctggtctatacaaccaatattcaggagctcaacgtgtactcggaagcgcaggaacccaaggagtctccgcctcccagtaagaccagtgcagccgcacagctcgacgaactgatggcacatctgacggagatgcaagccaaagtggctgtcagagcagacgccggtaagaaacatttacccgataagcaagatcataaagcgtctctggatagcatgctgggcggactcgagcaagaactccaggaccttgggatcgccacggtgccaaaaggacactgcgcttcctgtcagaagcctatcgcaggaaaggtcattcacgcactggggcagagttggcaccctgaacatttcgtatgtacgcattgcaaagaggagattggctccagtcctttttttgagagatcagggctggcctattgtccaaacgactatcaccagctgttctctcccaggtgtgcttattgcgctgcaccaatcctggacaaggtccttacggccatgaaccagacttggcacccagagcacttcttttgcagccactgtggtgaggtgtttggcgcagaaggcttccatgagaaggataagaagccatactgtcgcaaagacttccttgccatgttttcccccaaatgtggcggttgcaacaggccagttctcgaaaattacctgtccgccatggataccgtgtggcacccagaatgttttgtttgcggagattgctttaccagttttagcaccggtagctttttcgagttggacggcagacctttttgcgaactgcactaccaccataggagaggcacactgtgccacggctgtggacaaccaataaccggacgttgtatctctgcgatgggttataaatttcatcctgagcatttcgtttgcgcattctgcctgactcagctatcaaaaggtatcttcagagagcaaaacgacaagacctactgtcaaccgtgctttaacaaactctttcccttgtag

SEQ ID NO: 228645 - DNA, 1131 bp, Artificial Sequence
  Description of Artificial Sequence: Synthetic coding sequence
atgaattacgaatttgagcgcgagatcggattcatcaattcccagccctcactggccgagtgtttgacaagctttccacccgtggccgatactttccagtcatcttctataaaaacctctacacttagccacagcacattaatccctccccctttcgaacaaactattccgagcttgaatccaggttctcacccacgccatggtgccggaggacggccaaagccaagccccgcaggttcccgaggatcgcccgtgccagctggcgcactccaaccacccgaatatccatggatgaaagagaaaaaggctgctaagaaaacagctctgctgccagcagcagccgctgctgcgacagcagctgcaacgggtccagcctgcctcagccacaaagaatccctggagattgctgacggatctgggggaggctccaggcggttacggacggcgtatacaaatacacagctgctggagctcgaaaaggagtttcattttaataaatacctgtgtaggccacggagagtggaaattgccgctctcttagacttgactgagcgacaggtcaaggtgtggttccaaaacaggcgaatgaagcataagcggcagacccagtgcaaggagaatcagaactctgaggggaagtgtaagagcttggaggactcggaaaaggttgaagaagatgaagaggagaagacattgttcgaacaggctctgagtgtatccggggcattgctggagcgggaggggtacactttccagcagaatgccctgtcgcaacaacaggcccctaatggccataacggcgattctcaaagttttcccgtgtcccctttgaccagcaatgagaagaaccttaaacactttcagcaccagtcccccactgtgccgaactgcctcagtacaatgggtcagaattgcggtgccggattgaataacgattccccagaagccctggaggtgcctagtctgcaagatttcagcgtgttttccaccgacagttgcctccagcttagcgacgcagtgtcgcccagcctgcccggatccctagactcccctgtggatatctctgccgacagcctagactttttcaccgacacactgaccacaattgatctgcaacacttaaattattag

SEQ ID NO: 228646 - DNA, 753 bp, Artificial Sequence
  Description of Artificial Sequence: Synthetic coding sequence
atgacacctggtaggtgctgcctggccgctgacatacaggtggaaactttcatttttacagatggagaggatgaggccctggcccgacacaccggcaatgttgtcatcactaactgctctgctgctcactccaggcaggcactatcctgtaaaatggccgtcgagtatgaccgctttattgagtcaggcaggaaatggttctgccacgtggatgacgacaactatgttaacttaagggctctgttgcgccttttggcttcgtatccccacacaagagacgtgtacgttggcaagccaagtcttgacaggcccatccaagccatggagcgtgtctctgagaacaaagtcagacccgtccatttttggttcgctactggaggcgcaggattttgtataagtaggggcttggcactgaagatgtctccctgggcatctgggggtcatttcatgaacacagcggaacggatcaggcttccggacgattgcaccattgggtacattgtcgaggccctgctcggcgtgccactgatccgaagtggcctgttccactctcacttggagaacctgcaacaagtgcctacaagtgagctgcatgaacaagtgaccctgtcatacggaatgttcgagaacaagaggaacgcagttcacgttaaggggccattttccgtggaggcggacccatcgcgattcagatccattcactgccatttataccccgatactccatggtgtcctaggaccgcgatcttttag

SEQ ID NO: 228647 - DNA, 1086 bp, Artificial Sequence
  Description of Artificial Sequence: Synthetic coding sequence
atgttaaaacggtgtgggagaagattgctgttagctttggcaggtgcactgcttgcctgcttgctggtgttgactgcggatccaccgcctcccccactgcccgcagagcggggacggagagcacttcgcagcctggctggccctgccggagccgctcccgctcctgggctgggagccgcagcggcagctccaggtgcgcttgtgcgcgatgtccacagcctatctgaatatttctccctgctcaccagagccagacgcgatgctggccctccccctggcgctgcacccagacctgctgatggacacccccgtccccttgccgaaccactggcaccacgagatgtattcatcgctgtaaagacaaccaagaaattccacagggccaggctggatttgctcttagagacgtggatcagtcgtcataaggaaatgacatttatctttaccgatggtgaggacgaggccctggcacgacatactgggaatgtagtaatcacaaattgctctgccgcacattcaagacaagcactgtcctgtaagatggctgtggagtatgacagatttatagagtccgggaggaagtggttttgtcacgtggatgatgacaactacgtcaaccttagagccctcctccggctgctggcatcatacccccacactcgtgacgtttacgtcgggaaaccttcccttgacaggccaatacaggccatggaacgcgtctctgagaacaaagtgaggccagtgcacttctggtttgccaccggcggagccggattctgtatctctcgcggacttgccctcaaaatgtcaccctgggcatccggagggcatttcatgaataccgccgagcgcataagactccctgatgactgcactattggatacatcgttgaggctctgctgggtgtgcctcttatccgttctggtctctttcacagtcacctggagaacctccagcaagtgccaacgagtgagttgcatgagcaggtgaccctgagctatggcatgttcgaaaacaagcgcaacgccgtgcacgttaaaggtcccttcagtgtggaggccgatcccagccggtggggcaactag

SEQ ID NO: 228648 - DNA, 753 bp, Artificial Sequence
  Description of Artificial Sequence: Synthetic coding sequence
atgactcctgggagatgctgtctggcggcagacatacaggtggagaccttcatctttacggacggcgaagacgaggccctggcgcgtcacaccggcaatgtggtgattactaattgctccgctgcacacagtcgccaggctctctcttgcaaaatggcagtggaatatgatagattcatcgagagtgggcgaaaatggttctgtcatgtcgatgatgacaattacgttaacctgagggctctcttgcgattgcttgcgtcatatccccatactcgggatgtgtacgttggcaaaccctcactcgacagaccgatccaagcgatggaaagagtgagtgaaaataaggttcgccctgtgcatttttggttcgccaccggtggtgctgggttttgcatcagtaggggcctcgctctcaagatgtcgccctgggccagtggaggccatttcatgaacactgctgagcgtattcggctgccggatgactgcactatcggatatatcgtcgaagctctgcttggagtccccctgattaggtctggcctcttccactctcatctggaaaatctgcaacaagttcctacatccgaattacacgaacaggttaccctgtcatatggaatgttcgagaacaaaagaaatgcagtgcacgtcaagggccctttcagtgtggaggccgatcccagccggtttagaagtatacactgccacctttatcctgatacgccctggtgtccgcgtacagccatcttctag

SEQ ID NO: 228649 - DNA, 927 bp, Artificial Sequence
  Description of Artificial Sequence: Synthetic coding sequence
atggatgagcagacgggaagactacgcctggatacatattgcatgagcgcaaaacagatttgggcatggtccaagtgctctggacgtttgtgggatgaacacatgaagtggatggaagggtggacagaccgatggactgatggatggatggacgggtggatggacgaatggtctcctaccccggctctgcggagttacggcggagggctgtcccaacagacatttatttttactgacggagaagatgaagccttggccaggcacaccggaaatgtagtgattacgaattgctctgctgcacactcccgacaggccttatcctgtaaaatggcggtggagtatgatagattcattgaaagtggccgtaagtggttttgtcacgtagacgacgataactacgtcaacctcagagctctactgcggctgttagcttcctaccctcacacccgagacgtatatgtggggaaaccttcgctggacaggcctatccaggccatggaaagagtgtctgaaaataaagtccggcctgtccacttttggttcgccaccggcggagccggattctgtatttcccggggtctggctctgaaaatgtctccgtgggctagcggcggacactttatgaacactgcagagcggattaggctgcctgacgactgtacaatcggctatatcgtggaggcactgctcggggtgcctctcattcgcagcgggttgtttcactcccacttagaaaacctgcagcaagtccctacaagcgaacttcatgaacaggtgacgttgagctatggcatgtttgaaaacaagagaaatgcagttcatgtgaaggggcctttcagcgtggaagccgacccctccaggtttcggtccatccactgccatctgtatccagataccccttggtgtcctcggacagccattttctag

SEQ ID NO: 228650 - DNA, 1302 bp, Artificial Sequence
  Description of Artificial Sequence: Synthetic coding sequence
atgcaacggatgatacagcagtttgcagccgagtatacttccaaaaacagtagcacgcaggatcccagtcagccgaatagcaccaagaatcagtctctgccgaaagcctcccctgttactacatccccaactgccgcaacaactcaaaacccagtgttgagcaagctgctcatggcagatcaggattcacccttggatctcactgtgcggaaatctcagagcgagcctagcgaacaggacggcgttttggacctatcaaccaaaaaatccccatgtgctggctcaacgagtctgagccactctcccggatgttcgagcacccaagggaacgggagacctggacggccaagccagtacagaccagacggcctgagaagtggagacggggtcccaccaaggagtctgcaggatggaaccagagagggcttcggccactcaacctccctgaaggtgccactggctcggagcctccagattagcgaggaattgcttagcaggaaccagctctctactgctgcctccttaggaccatccgggttgcagaatcacgggcagcatctgattctttctagggaagctagttgggcaaagcctcactatgagtttaatctctctaggatgaaatttagaggcaacggtgcgcttagcaacatttcagatttacctttcctggcagagaacagtgcctttcccaagatggctcttcaagccaagcaggacggtaagaaagatgtaagccacagctctccagtagacctcaagatcccccaggtgaggggtatggatctctcgtgggaatcacggactggggaccagtattcatattcaagcctagttatgggctcacagactgagtctgccttatccaagaagctacgagcaatcttgccgaagcaatcacgcaagagcatgctcgatgctggtcctgatagctggggttccgacgcagaacagtccacctccggacagccatatcccacatccgatcaggagggggacccgggatctaagcagcccaggaagaagcggggtaggtatagacaatacaactccgagatactagaagaggccatttccgtggtcatgtcaggaaagatgtccgtgtctaaagctcaatctatttatggcatcccacactctactctggaatataaggtgaaagaacgccttggcactctgaaaaatccacctaagaaaaaaatgaaacttatgcgctcggaaggccctgatgtcagcgtcaaaatagagcttgaccctcagggagaggcagcccagtctgccaatgaatccaagaatgagtag

SEQ ID NO: 228651 - DNA, 1302 bp, Artificial Sequence
  Description of Artificial Sequence: Synthetic coding sequence
atgcagaggatgatccagcaatttgcagcggagtacacgagcaaaaattcttcaacccaggatccatctcagccaaactcgactaaaaatcagtcactgccaaaggccagcccagtgaccacctcccccacagccgcaacgactcagaacccagtgttgagtaaactgttgatggctgatcaggattcacctcttgatcttacggtaaggaaatctcagtctgagccttcagagcaagacggcgtgcttgatctctctaccaaaaagtcgccatgtgcaggcagtacaagtctgtcgcactcccctggctgttcaagtacacaaggcaacggcagaccgggaaggccttcccagtatcgccctgatggactcagaagcggtgatggtgttccacctagatcgctgcaggacggcacccgtgagggctttggccacagcacatctcttaaggtcccccttgcacgcagcttgcaaatcagcgaggaacttctttcgaggaatcagctgtctacagccgctagtctcggcccttctggcctgcagaatcacggccagcatctcattctttccagagaggcatcctgggcaaaaccacactatgagtttaacttatctaggatgaagttccgcggtaacggtgccctaagcaacatcagcgatctgccttttctagcagaaaattccgcttttcccaagatggctttgcaagccaagcaggacggaaaaaaggacgtgagtcactcttcgccagtggacctgaagatccctcaggtaagaggaatggatttaagctgggagtcccgcactggcgaccagtactcttactcctctctggtgatgggctcacaaactgaaagtgctttgtcgaaaaagctcagggcaattctcccgaaacaatcccgcaaatccatgctcgacgccggacctgattcctgggggtcggatgctgagcaatctacgtctggacagccttatccgacttctgatcaggaaggggacccaggttccaagcagccccgaaaaaagaggggaaggtaccgtcaatacaactcagagattctggaggaggctatttcagtcgtgatgtccggaaaaatgtctgtctccaaggctcaatcaatttacggaataccccactcaacactggagtataaagtcaaagaacgactcggaacactgaagaaccccccaaagaagaaaatgaagttaatgcggagcgagggcccagacgtgtctgtgaagattgaattggatccgcagggggaagcagcacagagcgctaatgagtccaaaaacgagtag

SEQ ID NO: 228652 - DNA, 1302 bp, Artificial Sequence
  Description of Artificial Sequence: Synthetic coding sequence
atgcaacggatgatacagcagtttgccgctgagtacaccagcaaaaatagcagcacccaagatccttcacagcctaactcaactaagaatcagtccctgccaaaagcttcccccgtgacaacctcccccactgctgcaaccacgcagaatcccgttctttccaaattgctgatggccgaccaggactcaccgcttgacctgaccgtgcgaaaatcacagagcgagccctcagaacaggatggagtgctagacttatcaaccaagaagagcccgtgcgcagggtctacgtccctgtctcatagtcctggatgcagtagcacgcaaggcaacgggaggccagggaggccgagccaatacaggcccgatggacttcgcagcggggacggggtcccacctcgaagtctgcaggacgggacaagggagggtttcgggcacagcactagcttgaaagtacctcttgctcgctccctgcagatttccgaggaacttttaagtcgaaatcaacttagcaccgctgcaagcctcggacccagcggcctgcagaatcacgggcagcacctgatactcagtagagaggcctcctgggccaaacctcattacgaattcaatctgtcccgcatgaagtttcgcggaaacggtgcactgtctaacatctctgacttgccgtttctggccgagaattccgccttccccaagatggccctgcaggccaaacaggacggcaaaaaagatgtatctcattcgagcccagtcgatctaaagataccgcaggtgcgcggtatggacctgtcatgggaaagtagaacaggggatcagtatagttatagtagcctggtcatgggatcgcaaacagaatcagcgctgtcaaagaaactccgagcgatcttgccgaagcaatcgcgcaagtcaatgctggatgccggaccagatagctggggatctgacgccgaacagtcaacaagcggtcagccttatccaaccagcgaccaggaaggcgatcctggctccaagcagccacgcaagaagcgtggacgctatagacagtacaactccgagattttagaggaggccatctcagtggtcatgagcggcaaaatgagcgtatcgaaggctcaaagcatttatggcattccccattcgaccctggagtacaaggtcaaggaaagactggggacgctgaagaatcctcccaagaaaaaaatgaagctgatgcgctccgagggccctgacgtctctgtaaaaattgagctggatccccaaggggaagctgcccagtcagctaacgaatctaagaacgagtag

SEQ ID NO: 228653 - DNA, 1221 bp, Artificial Sequence
  Description of Artificial Sequence: Synthetic coding sequence
atgcagcgcatgatccaacaatttgccgctgagtacacctcgaagaactcctccactcaggatccttcacagccgaatagtaccaagaatcaaagcctgccaaaggcctcccccgtgacgacgagtcctactgccgctactactcaaaatcctgtgttaagtaaattattgatggctgatcaagacagtccactagacttaaccgttcgcaaatcacagtccgaaccttcagagcaggacggcgtgctggacctgtccacaaagaagtccccttgtgccggatctacaagtctgtcccattctcctgggtgttcatccacacagggaaacgggcgaccaggtagaccatcacagtaccgtccggatggtctgagaagcggggatggggttcctccgaggagcttacaggatggcaccagggaggggtttggacacagtaccagtctgaaagttcctctggctcgatcactccagatctctgaggagctgttgtcaagaaatcagctgtcaaccgcagcaagcctgggaccctccgggctgcagaaccatggacagcacctcattttgtcccgggaggcgtcatgggctaagcctcactacgagttcaacctctctcggatgaagttcaggggcaatggagccttaagtaacattagcgacctgccttttctcgccgagaactctgccttccccaagatggccttgcaagcaaagcaggacggcaaaaaggatgtgagtcactctagccccgtggatctaaaaattccccaggtgaggggtatggacctgtcgtgggaatctaggaccggtgaccaatacagctattcatccctggtcatgggaagtcagacagagtcagcgctctcaaaaaaactcagagccattctaccgaaacaatcaagaaaaagcatgctagatgccggtcccgacagctggggaagcgacgcagagcaatccacatcaggtcagccgtatcccacgtcagatcaggagggcgaccctgggtccaagcagccaaggaaaaagcggggacgctaccgccagtataattctgaaattctggaggaagctattagcgttgttatgtccggcaaaatgagcgtgtctaaagctcaatcaatctacgggattcctcattctacgctggagtataaggtcaaagaacgcctgggcactctgaagaatcctcccaaaaagaagatgaagctgatgtcaggatag

SEQ ID NO: 228654 - DNA, 957 bp, Artificial Sequence
  Description of Artificial Sequence: Synthetic coding sequence
atggataaaggaagggaaaggatggcagccgcagctgcagccgcagcagccgcagctgccgctgctcagtgccgctcccctagatgtgcggcagagcggagaggctttcgacgcgaacttgacagttggagacaccgactgatgcactgcgtcggctttgaaagcattctcgagggcctttacggaccacggctgcggagagacctgtcgcttttcgaggattgtgagccggaggaactaaccgattggagcatggatgagaagtgcagtttttgcaacttacaacgagaagctgtgagcgactgcattccctccttagactcgagccagagcacacccacagaggagctcagttcacaggggcagagcaatactgacaaaatagagtgccaggcagagaactatctgaatgccctatttcggaaaaaagacctaccgcagaattgtgatccaaatattccactcgtcgcccaagagcttatgaaaaagatgatacgccaattcgccatagaatacatctcaaaatcaggcaagactcaggaaaacagaaatggctccattgggccttccattgtctgtaaatcgatccagatgaatcaagctgagaattcactccaggaggagcaggaaggacctttggacttaacagtgaaccggatgcaggagcaaaacacccagcaaggcgatggagtgctcgacctaagcactaagaaaacatcaatcaagtccgaggagagctccatctgcgaccccagttccgaaaattctgtggcaggcatgctgcaggtgaagacagacgagaaactgaacgtgtccgacgagaacactgcgagttgcccgctatctcccatcaaaatgtgcctgaataggccgattgaatggaatttgaatctgacaaccgccagtttaacgagttgcactgtgcacaaccagaacctcaagtcggaggagaagtag

SEQ ID NO: 228655 - DNA, 1557 bp, Artificial Sequence
  Description of Artificial Sequence: Synthetic coding sequence
atggacgagaagtgctcattctgcaacctccagagagaggccgtgtccgactgtatcccatccctggattctagccagtccactccaacagaggagttgtcgtcacagggccagtccaacacagacaagattgagtgccaagcggagaattatttgaacgccttattccgaaagaaagacctgccgcagaattgcgaccccaacatccccctcgtcgcacaggagctgatgaagaagatgattaggcagtttgctatcgaatacatatctaagagtggaaagacccaagagaaccgcaatggttctattggcccatccatcgtttgtaagtcaatccagatgaatcaggccgaaaatagcttgcaggaagagcaggaagggccacttgatctcaccgtgaaccgaatgcaagagcaaaacactcagcaaggggatggtgtgttggacttgagcacaaaaaagacaagcataaaaagcgaggagtcctctatatgcgatcctagcagtgaaaattccgtagctggtcggttacacagaaaccgagaggattatgtggaacgttctgccgaatttgccgacggcctcttgtccaaagctctgaaagatattcagtccggcgctcttgatatcaataaagccggaatcctgtacgggatcccccagaagaccctactgctccacctcgaagcgctgccagccggtaagcctgcatctttcaagaataagacccgcgacttccacgactcttactcatataaggatagtaaggagacttgcgctgtcctgcagaaggtcgccctctgggcaagggcgcaggcggaaaggaccgaaaagtctaagttgaacttactcgagactagtgagattaaatttcccacggcaagcacatacctccaccagctgaccctgcagaagatggtgacccagttcaaagagaagaatgagtccctccagtatgagacttctaatccaaccgtgcaacttaaaattccccagcttagggtctcctccgtttccaagagccaacctgacggaagtggcttgctcgatgtgatgtatcaggtgtcgaagacctcgagcgtgctggaggggagcgcgctccagaagctcaagaatattctacccaaacagaataaaatcgagtgttccggtcctgtcactcattcttcagtggatagctatttcctgcacggagacctgtccccactgtgtctgaacagtaaaaacggtactgtcgacggaacctcagaaaacacagaggatggacttgacaggaaagatagcaagcagccccgtaaaaagcgaggacggtacaggcaatatgatcatgaaatcatggaagaggccattgccatggttatgtcaggtaaaatgtcggtgtccaaggcccaggggatttacggcgtgccccattcaactctagaatacaaggtgaaagagaggtccgggacactgaagacaccgcctaagaagaaactacggctacccgacactgggctctataatatgaccgacagcggaacaggctcttgcaagaatagctcaaagcctgtgtag

SEQ ID NO: 228656 - DNA, 1809 bp, Artificial Sequence
  Description of Artificial Sequence: Synthetic coding sequence
atggacaaggggagagaacggatggcagccgctgcagcagctgccgctgccgcagcagcagctgcccagtgccggagtccgcgatgtgccgctgagagacgaggatttagacgagagttggattcatggcgccaccggttaatgcattgcgtgggctttgagagcatcctcgagggcctgtatggccctcgtctgcggagggatctaagcctgttcgaagactgcgagccggaggagctgacggactggagcatggacgagaaatgtagcttctgtaacctgcagcgggaggctgtgtcggactgcatacccagtctggactcctcgcagagtacacccaccgaagagctgtcttcccaaggccagtccaataccgataaaattgaatgtcaagcagagaactacctgaacgccctgttccggaaaaaggacctaccccaaaactgcgatccaaatatacccttggtagcacaggaactgatgaaaaaaatgatccggcagttcgccattgagtacatttcaaaaagcggtaaaacacaagagaatcgaaatggttcgatcgggccttccattgtgtgcaagtccatccagatgaaccaggcagagaactctctacaggaggagcaggagggacctctggacctaacagttaaccgcatgcaggagcaaaatactcagcagggcgacggagtgctagatctctcgactaagaaaaccagtatcaagagcgaggaatctagcatttgtgatccctcttcagagaacagcgtggccggtagactgcatcggaacagagaggactacgtggagagatctgcagaattcgcagacggcctcctaagcaaagctctgaaggatatccaatctggagccctggacataaataaggcaggcattctttacggaatcccacagaagaccctactattgcacttggaagccctccccgctggaaagcccgcttccttcaaaaataaaacccgcgactttcacgattcttacagttataaggactcaaaagagacctgcgcggtgctacaaaaggtggccctgtgggcacgggcacaggcagaaaggacagagaagtccaaattgaatctcctcgaaacttctgagatcaagtttcctaccgctagcacatacctccaccagctaactttacagaaaatggtaactcaattcaaagagaagaacgagagccttcaatacgaaacctccaacccaaccgttcagcttaagattccccagctgcgtgtatcatctgtctcaaagagccaacccgacggctcagggttgctggacgtcatgtatcaggtctccaaaacaagctccgtcttggagggctctgccctccagaagcttaagaacatccttcccaaacagaataagatcgaatgttctggacccgtgacccacagtagcgttgacagctattttctccatggtgatctcagtcctctgtgcttgaatagcaaaaatggaaccgtcgatgggacctcagaaaacacagaggacggacttgatcggaaggattccaagcagcctaggaagaagcggggacggtatcgccagtacgatcacgaaatcatggaagaagctatcgccatggtgatgagtggtaagatgtccgtctcaaaggcacaggggatttacggcgttcctcactccactctggagtataaggtcaaggaacgctcaggtactctcaaaaccccacctaagaaaaagctgcggttgcccgatactggcctgtataacatgaccgactcaggcaccggcagctgtaagaattccagcaaaccagtgtag

SEQ ID NO: 228657 - DNA, 435 bp, Artificial Sequence
  Description of Artificial Sequence: Synthetic coding sequence
atggaccacggctacgaagagacatccgtttacttaaaggactgtataccatcccttgactcctcccagagcacgccaacagaagagctttcctctcagggccagtccaacaccgacaagatagaatgtcaggctgagaattacctgaacgccctgtttaggaaaaaggacctccctcaaaattgcgacccaaatattcctctcgtagctcaagagctgatgaagaaaatgatccgacagtttgccattgaatacatcagtaagagcggcaagactcaggaaaaccgcaatggatctatcggcccttcaatagtctgtaagtccatccaaatgaaccaggccgagaatagcctgcaagaagaacaggagggccctcttgacctgacagtaaaccgcatgcaggagcagaatacacaacaagcctgctacaaatag

SEQ ID NO: 228658 - DNA, 2187 bp, Artificial Sequence
  Description of Artificial Sequence: Synthetic coding sequence
atgaaccagccagaaagcgccaatgaccctgagcctctgtgtgcggtctgtggacaagcacacagcctggaggagaatcacttttatagctatcccgaggaggtggatgatgatctgatctgtcacatctgcttgcaagcattactcgacccactcgacactccgtgtggtcatacatactgcacactgtgcttaacaaatttcctggtggagaaggatttttgtccgatggaccgcaaaccattggtcctgcagcattgtaagaagtcttctattctcgtcaataaactgctaaacaagttgctcgtcacttgtcctttcagagagcactgcacccaggtactccagcgctgcgacctggagcatcattttcagacatcctgtaaaggagcctctcattatggccttacaaaagatagaaagcggcgatcgcaggacgggtgtccagacggctgtgccagcttgaccgccaccgctccttcacctgaggtgagtgcagctgccacaatctcacttatgaccgacgaaccaggcctcgataaccctgcttatgtaagttccgcagaagacggccagccggctatctctccggtggacagcggaagatccaaccgaacccgcgctcggccatttgaaagatccaccatccgctcccgtagcttcaagaagataaaccgggctctatctgttcttagacgcacgaagtccggcagcgcggtcgccaatcacgccgaccagggcagagaaaatagcgaaaacaccactgccccagaagttttccccaggctgtatcacctcattcccgatggcgagattacttcaataaagatcaaccgcgtggaccctagtgagagtctctccatccgactggtgggcggatccgagacaccccttgttcacataattattcaacacatataccgcgacggggtgattgctcgcgacggaagacttcttcccggagacatcatccttaaagtgaacggaatggatatctccaacgtacctcataactatgctgtgcgactgctgcgccagccttgccaagtgctctggttaacggtgatgcgagaacagaaatttagatcaagaaacaatggccaagctcctgacgcctacaggccaagggacgacagcttccacgttatcctgaacaagtcctcccctgaagaacagctcggaattaaattggtgagaaaggtggacgagcccggtgtctttatttttaatgtcctcgacggaggggttgcctataggcatggtcagctagaggaaaatgaccgcgttctggccatcaatggacacgacttgcgatacggcagtcccgagagtgcggcacacctgattcaggcctccgaacgcagagtgcatctggttgtaagcaggcaggtgcgccagcggtccccagatatcttccaggaggcagggtggaactcaaatggctcttggagtccagggccaggggaaaggtccaataccccaaaacctctccatcctaccattacttgtcacgagaaagttgttaatatccaaaaggatccgggtgaatcccttggcatgactgtggccggtggggcttcgcacagagaatgggaccttcccatctacgttatctctgtcgaacccggtggggtaatttctcgcgacgggaggatcaagaccggggacattctgttgaacgtggacggagtcgaattaactgaggtttcaaggagtgaggctgttgcacttctgaagcgtacttcctccagcatcgtgctcaaagcgctcgaggtgaaggagtacgagccccaggaggactgtagttcaccagctgcccttgactctaatcacaacatggcacccccatcagactggtctccctcctgggtgatgtggttagagctgccccgatgcctgtataactgcaaggatatagttctgcgcaggaatacggcaggcagtttgggattctgcatagtgggtggatacgaggagtacaatgggaacaaacctttctttataaaatctattgtcgagggtactcctgcatacaatgatggtagaatccgctgcggagacatactcctcgccgttaatgggcgaagcacatcaggcatgatccatgcatgcttggccaggcttttaaaagaattaaaaggccgtattacactgaccattgtgagctggccaggaacttttctgtag

SEQ ID NO: 228659 - DNA, 1899 bp, Artificial Sequence
  Description of Artificial Sequence: Synthetic coding sequence
atgaaagccctcctgttacttgtcttaccttggcttagcccagcaaattatattgacaacgtggggaatctgcattttctttacagtgagctatgcaagggggcaagccactatggactaacaaaagacaggaaaagacgcagtcaagatggttgcccagacggttgtgccagcctgaccgcgactgctccttcgcccgaagtgagtgcagcagccacaatctctctcatgaccgacgagccaggcctggataatccggcttacgttagtagtgcagaggatggccagccagctatttctcccgttgattccggacggagcaaccggacacgggctagaccctttgaaaggtcgactatcagaagcaggtcatttaagaagatcaatagagccctgagtgtactcagaagaacaaaatccggctccgccgtggcaaaccacgctgaccagggacgggaaaacagtgagaacaccacagctccagaagtattcccccgactgtaccacctgatcccggacggggaaattacttcaatcaagatcaaccgcgttgacccttccgagtctctgtccattcgcttagtgggcggatccgaaacacctctggtccacatcatcatccagcatatctaccgcgacggagtcatagccagggacggccgacttctgcctggagatattattctaaaggtcaatggaatggacatctctaacgtgcctcacaactacgcagttagactgctgcggcagccatgccaagtgctttggcttacagttatgagagagcagaaattccggtccaggaataatggccaagccccagatgcctatagacctcgggacgacagcttccacgtgatcctcaacaagtcgagccccgaagagcagctgggaatcaagctcgtccgaaaggtcgacgagcctggcgttttcatatttaatgttctcgacgggggagtcgcatacaggcatggccaattggaggagaacgaccgggtgttggccatcaatggccacgatcttagatacggctcaccagagagtgccgcacatttgattcaagcttccgaacggcgtgttcacctggtggtctccagacaagtgagacagcgatcacccgacatctttcaagaggccggatggaacagtaatggcagctggtctcccggtcctggtgagcggtcaaataccccaaagcctctgcaccccaccattacctgccacgaaaaggttgtgaacatccagaaagatcccggagagtcccttggcatgactgtcgccggtggcgcttcacatcgcgaatgggacctgcccatctacgtcatttccgtcgaaccgggaggtgtaatctctagagacgggcgaattaaaactggcgacatcttgcttaacgttgacggcgtggagttaacagaagtgagtaggtccgaggcggttgccttgcttaaacggactagttcatccatcgtgctaaaggctctggaggtcaaggagtatgaaccacaggaggattgttccagtccggcagcccttgactccaaccacaatatggcccctccaagcgattggtcccctagctgggtaatgtggctcgaacttcccaggtgcctgtataactgtaaagacattgtgctaagaaggaacactgcgggtagcctcggattctgtattgtggggggatacgaggagtataacggcaacaaaccctttttcattaagtctattgtcgaaggcacccccgcatacaatgatgggagaatacggtgtggagatattctgctcgcagtgaacggccgaagcacatccggtatgatccacgcctgtctggcaagactgctaaaagagctgaagggacgaataaccctgaccatagtctcatggccagggacattcctgtag

SEQ ID NO: 228660 - DNA, 21 bp, Artificial Sequence
  Description of Artificial Sequence: Synthetic coding sequence
atgaatcagcctgaatcttag

SEQ ID NO: 228661 - DNA, 51 bp, Artificial Sequence
  Description of Artificial Sequence: Synthetic coding sequence
atgaaccagccagaatctgccaacgaccctgagcccctgtgcgctgtgtag

SEQ ID NO: 228662 - DNA, 300 bp, Artificial Sequence
  Description of Artificial Sequence: Synthetic coding sequence
atgaatcagcccgagtccgcaaacgatcccgaacctctgtgtgctgtgtgtggccaggcacatagtctcgaggagaaccacttttattcctatcctgaggaggtggatgacgaccttatttgtcatatttgcctacaagccctccttgaccccttagacactccatgtggtcacacctactgcacattatgcctgactaattttctggtggagaaggatttttgccccatggaccgcaaaccgttggttctgcagcattgtaaaaaatcgtcgatcctcgtaaataaactgttgaactag

SEQ ID NO: 228663 - DNA, 273 bp, Artificial Sequence
  Description of Artificial Sequence: Synthetic coding sequence
atgaaccaacctgagtccgccaacgatccggagcctttgtgcgccgtttgcggacaggcccatagtctggaggagaatcatttctactcatacccagaagaggtggacgatgacctcatttgtcacatctgtctgcaggctctgctcgatccactggatacaccttgcgggcacacatactgtaccttatgcttaacaaatttcctggtggaaaaggatttttgcccgatggatcggaaacccctggtgctgcagcactgcaagaagtcttag

SEQ ID NO: 228664 - DNA, 381 bp, Artificial Sequence
  Description of Artificial Sequence: Synthetic coding sequence
atgaaccaacccgagagcgcaaacgatccggagccgctttgcgccgtttgtggccaggcccactcccttgaggagaatcatttctattcttacccagaggaggtggacgatgacctgatttgccacatttgtcttcaggccctgttggatccactagatactccttgtgggcacacttactgcactctatgccttacaaatttcctggtagagaaagatttctgccccatggacagaaagccactggtgctgcaacattgtaagaaatcatccatacttgtgaacaaactcctgaataagctgctggtcacatgccccttcagggaacactgtacacaagtgctgcagcggtgcgacctggagcatcactttcagacctag

SEQ ID NO: 228665 - DNA, 1701 bp, Artificial Sequence
  Description of Artificial Sequence: Synthetic coding sequence
atggccgtccagactgccgtgagagccagccagccccgactgccaccactggacaacccagcctacgtctctagcgcggaggatggccaacccgctatctcaccagtggactctggcaggtccaacagaacaagggctaggcccttcgagcgctcaactatccgatcgaggtcttttaagaaaatcaacagagcactgagtgttctgcggcgtacaaagagtgggtccgcggtggctaaccatgctgatcagggaagagaaaatagcgagaatacaactgcgccagaagtgttcccgaggctctaccatcttattccggatggcgaaatcacatcaattaaaatcaaccgcgtggatccgtcagagagcttatcaattcgcctagtcggcggaagtgaaacgcctctcgtccatatcattatccagcacatctacagggatggcgtgatcgccagagacggccgacttctcccaggggacattatactgaaggtgaacggcatggacatctccaacgtcccgcataattacgccgtacgtctcctaaggcaaccttgccaggtcctctggcttacagttatgcgcgaacagaagttcaggtccaggaacaacgggcaggcacctgacgcctatcggcctcgggatgatagtttccacgtcattctgaataagagtagccccgaggagcagctgggcattaagctggtacgaaaggttgacgagcctggggtgttcattttcaatgtgctggacggcggtgttgcctacagacatggtcaactggaggagaacgacagggtgctcgccattaatggacacgatctaagatacggcagccccgagtctgcagcccatttgatccaagcaagcgagcgtcgggttcatctggtcgtgagcaggcaggtccgtcagaggtctccggatatcttccaggaggccggttggaatagtaacggatcttggtctcccggaccaggagagagatcaaatacgcctaagcctctgcaccccacaattacctgccacgaaaaagtggtgaacattcagaaggaccccggtgagtctctgggcatgaccgtggccggtggggctagccacagagaatgggatttaccaatatacgtgataagtgttgaaccagggggtgtcatatcacgcgatggaagaataaagactggtgacatcttgcttaatgtcgacggagtcgaactgactgaagtgtcacgaagcgaggctgtcgcacttctaaagcgcactagcagctcgatcgttttgaaggcccttgaagtgaaggaatacgaacctcaggaggattgttcaagccccgcagccctcgactctaatcataacatggcccctccatccgattggtctccttcttgggtgatgtggctggaattaccccgatgcttgtataattgtaaggacattgttctgaggcgcaacactgcaggtagcttgggattctgcatcgtggggggttacgaagagtataacggtaataagcctttcttcatcaaatcaatcgtggagggcacgcccgcttacaatgacggcagaattcgctgcggagatattctgctggccgtcaacggccgatctacctccggtatgatccacgcctgcttagccaggcttctgaaggagttaaaaggcaggattacactgaccattgtatcctggcctgggacttttttgtag

SEQ ID NO: 228666 - DNA, 2073 bp, Artificial Sequence
  Description of Artificial Sequence: Synthetic coding sequence
atgggaacaacatcagatgagatggtgtccgtcgagcagacgtctagcagttccctaaaccccctctgttttgagtgcgggcagcaacattggactcgggagaatcatctgtacaactatcagaacgaagtggatgatgatctcgtgtgtcacatctgtctgcaaccactgttgcagcctctggacaccccctgtggccacaccttctgttataaatgtcttcggaacttcttacaagagaaggacttctgccctctagataggaaacgcctgcacttcaagctgtgcaagaaatcctccatcctcgtgcacaagctcctggataagctgctggtcctgtgtccattctcttccgtgtgcaaagatgtcatgcagagatgcgatctggaggcccacttaaagaaccggtgtcctggtgcgtctcacagacgtgttgcattagagcgcaggaaaacctccagaacacaggcagagatagaaaatgagaacgggccaaccctgcttgacccagcagggacactgagccctgaggcagactgtctgggtactggggcagtgcccgtggaacggcaccttaccagcgccagtttgtctacctggagtgaggagccgggactcgacaatccagcattcgaagagtcagccggagccgataccacacagcagcccctgagtctgccagagggagaaataaccacaatcgagatccatagatctaacccctatattcagttaggcatttctatagttggcggaaatgaaactcccctgatcaatatcgttatccaagaggtctaccgcgatggcgtgatcgctcgggatggcagacttctggctggggaccagatcctgcaggttaataattataacatctctaatgtgtcccataactatgcacgagctgtgttatctcagccatgcaatacactgcacctgaccgtgttaagggagcgcagatttgggaatagggctcataatcactcagacagtaattctccccgtgaggaaatcttccaggtggcactgcacaagagggattctggagagcagctggggatcaagcttgtccggaggacagatgaaccaggagtgtttattctggaccttctcgaggggggactcgccgctcaagacgggagactgtctagtaacgaccgagtgctggcaattaatggtcatgaccttaagtatggcacccctgaactcgccgcacagatcatacaggcttccggtgaacgagtgaatctgactatagccagacccggaaagccacaaccaggcaatactatacgcgaagctggaaatcattcctcttctagccagcatcataccccaccaccctactacagtcgcccttctagccacaaggacttgacgcagtgtgtgacctgtcaagaaaagcacattaccgttaaaaaggaaccccacgaaagtctgggcatgaccgtagcgggtgggaggggttctaaaagcggtgagctgcctatatttgtgacgtctgtacctcctcacggctgtcttgcccgtgatgggcgtatcaagcggggagatgtgctgctgaatatcaatgggattgatctgaccaatctttctcactccgaagcggtggctatgttgaaggcatctgctgcttctccagccgtggcattaaaggccctggaagtgcaaattgtagaggaggccacgcagaatgccgaagagcagccatcgacgtttagcgagaacgagtacgacgcttcatggagtccatcgtgggttatgtggctgggtttgccgtccacattacattcctgccacgacatcgtgctaaggcggagttatctgggtagctggggattttctattgtcggcggatatgaggaaaatcacactaatcagccattcttcattaagacaattgtgctgggaacccctgcatactatgacggcaggttgaaatgcggcgatatgatcgttgcagtgaacgggctgagcaccgtgggtatgagccacagcgccttggttccgatgctcaaggaacaaagaaataaggtcaccttgactgtaatctgctggccagggtcgctcgtctag

SEQ ID NO: 228667 - DNA, 2115 bp, Artificial Sequence
  Description of Artificial Sequence: Synthetic coding sequence
atgttggggatctgtcgaggcagaagaaaattcttggccgctagcctgtccctcctttgcattcccgcaatcacgtggatctacctgtttagcggctccttcgaggatggcaagcctgtgtctctgtcgccacttgaatctcaagcccacagcccaagatatactgcaagtagccagcgcgagcgcgaatcccttgaggtgagaatgagagaagtggaagaggagaatagggccctaaggagacagcttagtctggcccagggacgggctccgtctcaccggagggggaaccactcgaaaacatattctatggaggagggaaccggcgatagtgagaacctgagagcaggcattgtcgcaggcaatagctctgaatgtggccagcagcctgtggtggaaaaatgcgaaacaatccacgtcgcaatcgtatgcgccggatataacgctagccgggatgtcgtcactctggttaagtcagtgttgtttcaccggcgtaacccactccacttccacctaatcgccgactctattgccgaacaaatcctcgcaactctttttcagacctggatggtacctgctgtcagggttgacttttacaatgccgatgaattgaaatctgaagtgagctggattccaaacaaacactacagtggtatctacggattaatgaaactagttctgacgaagacacttccggctaacctcgagcgcgtgattgttctcgacacagatatcactttcgctactgacatcgcagagctgtgggctgtcttccacaagtttaaaggccaacaggtcctgggcctcgtcgaaaaccagtccgactggtatctggggaatctgtggaagaaccacagaccatggccagcactgggtagggggtacaacacaggcgtcatactattattgctcgacaagctcaggaaaatgaagtgggaacaaatgtggaggcttacagccgagagagagctgatggggatgctgtccacctccctcgcggaccaagacatcttcaatgccgtgattaagcagaatcctttcctcgtctaccagctgccctgcttctggaacgttcagttgagcgatcacacgcgctcagaacagtgctaccgcgatgtttctgatctgaagctgcaaaagcaactaagcgaactggatgaggacgacctctgctatgagtttcggagggagcgattcaccgttcaccggacccacctgtacttcctccactatgaatacgagcctgcagctgactccacagacgtgaccctggtggcccaattaagtatggaccgattgcagatgcttgaagcaatctgcaagcactgggaaggtcccatctccttggccttgtacctgtcagacgccgaagcgcaacagttcttgcgttacgcccagggttccgaggtgctgatgagtagacacaacgtaggttatcatattgtctacaaagagggtcagttctaccctgtgaacctcctgcggaatgtagctatgaagcatatctccaccccttatatgtttttgagcgatatcgatttcctgcccatgtatgggctgtacgagtatctcagaaagtcagtgattcagctggacctcgccaatactaagaaggctatgattgttcctgcgttcgagaccctgcggtatcggttgtcgttccccaaaagcaaagccgagctgctgagtatgttggatatgggcacactgtttacgtttcgataccatgtgtggaccaaggggcacgcaccaacaaatttcgccaagtggcgcactgccaccaccccataccgcgtggagtgggaggcagatttcgaaccatatgtggtggtgaggcgcgattgtccagagtacgatcgccgttttgtgggtttcggttggaataaggttgcccacatcatggagttggatgtccaagagtacgagttcattgtactccctaacgcatatatgatccacatgccgcacgctcccagcttcgacatcactaagtttcggagcaataaacaatatagaatctgcctgaaaacacttaaagaagaattccagcaggatatgtcccgacgatatggatttgcagcactcaagtaccttacggcagaaaacaactcgtag

SEQ ID NO: 228668 - DNA, 2271 bp, Artificial Sequence
  Description of Artificial Sequence: Synthetic coding sequence
atgctggggatttgccgaggccgtcgtaagttcctggctgctagcctttcactgctttgcattcccgctattacatggatatacttgttcagcggctccttcgaggacggaaaacctgtatctttgtccccacttgaatcccaggcacacagccctaggtacaccgcctcaagtcagagggaaagggaatccctcgaggttcggatgcgagaggtcgaagaggagaatcgcgctttaaggagacagttgagcctggcccagggtcgagctccctcacaccgcagaggcaaccattcaaagacttattccatggaggagggtacaggagatagcgaaaatctgcgtgcaggaatcgtggccggaaatagttctgagtgcggtcaacaacctgtagtggaaaaatgtgaaaccatacacgttgcaattgtgtgcgcgggatacaacgcttccagagacgtggtcacactagtgaaaagtgtgttgtttcatcgcagaaacccgctgcacttccacctgattgctgatagtatcgccgaacagattcttgcaacgcttttccagacctggatggtcccagctgtcagagtcgacttttataacgcggacgaactgaagtccgaagtcagctggattcctaataagcattactccggtatctacggtctcatgaaactggtgctaactaaaactctgccggcaaacttagagcgtgtcatcgtccttgatacagatattactttcgctacggacatcgcagaattatgggccgttttccataagtttaaaggccaacaggttcttggcttggtcgaaaatcagtccgactggtacctcggaaatctgtggaagaatcacagaccttggccagccctcggcaggggctacaacacgggcgttatcctgctactgttagataagctgcggaaaatgaagtgggaacagatgtggaggctgaccgctgaacgcgagctcatgggtatgctttcgacctccctggcagaccaggatatcttcaacgctgtcattaagcagaaccccttcttggtgtaccagctgccatgtttttggaacgtgcagctcagcgaccacacgagatctgaacagtgttatagggatgtgtccgacctcaaagtcatccactggaattcacctaagaagctgcgggtcaaaaacaagcacgtggagttctttaggaatctgtatctgacatttctagaatacgacgggaatctgcttcgacgcgaactcttcggatgccctagtgaggccgacgtgaactcggaaaacctgcaaaaacagctgagtgaactggacgaggatgatctctgctacgaatttcgccgtgagaggtttacagttcacagaactcatctgtacttcctgcattatgaatatgagcctgccgcagacagcacggacgttacactggttgcccaactctctatggataggcttcagatgctggaagctatctgcaagcactgggagggccctatttctttagctctttacttatctgatgctgaagcccagcagttcctgagatacgcacagggatcagaggtcctcatgtcccggcacaatgtaggttatcacattgtttataaggagggtcagttttatcccgtaaacctccttagaaacgtagcgatgaaacacatttccacgccttatatgtttctgagcgatattgacttcctccccatgtacggtttatatgaatacttgagaaaatcagtcatccagctcgacctggccaataccaagaaagctatgattgttccagcatttgaaaccctgaggtatcggttgagctttcctaagagcaaagccgagcttctgagcatgctggacatgggcactctcttcacattccgctaccacgtgtggaccaagggacatgcgcctaccaattttgccaagtggcgaacagcaacaactccctatagagttgaatgggaagctgacttcgagccgtatgtcgttgtgcgcagggattgtccagagtatgaccgacgctttgtcggtttcggctggaataaggttgcccatatcatggagctggatgtccaggaatacgagttcatagtgctacccaacgcctatatgattcacatgccacacgctccttcttttgatatcaccaaattccggtcaaacaagcaataccgaatttgcctcaagaccctgaaagaagaatttcaacaggatatgagtagacggtacggctttgccgctctgaaatacctgacagctgaaaataacagctag

SEQ ID NO: 228669 - DNA, 2271 bp, Artificial Sequence
  Description of Artificial Sequence: Synthetic coding sequence
atgttgggcatatgccgcggacgccgaaagtttcttgccgcttcactgagcttactgtgcatccccgctataacctggatttacctgttcagtggatcatttgaagacggcaagccagtctcccttagtccactcgaatctcaggcacactcccctagatataccgccagtagtcagcgggagcgtgagtctcttgaggtccggatgagagaagtagaagaagaaaaccgggctctgaggcggcagttgagcctggctcagggcagggcaccctcccatcggaggggcaaccacagcaagacctactccatggaagaaggcaccggcgactccgagaatctcagggcaggcatcgtggccggaaatagctcagaatgcgggcagcagccagtcgttgaaaaatgtgagacgattcacgtggccatcgtatgtgccggttacaatgcctctcgagacgtcgttacgttggtgaaatctgtcctgtttcacagacgcaatccgttgcactttcatctgatagctgacagcattgccgaacagattctcgccacattattccagacatggatggtgccggctgtgcgcgttgacttttacaacgctgatgagctgaaatctgaggttagctggatcccgaacaaacattacagtggcatctacgggctgatgaagctggtgctgactaaaacactgcccgcaaatttagaacgagtcatcgtgctcgacaccgacattacattcgctacagacattgcggagctgtgggctgtcttccacaagtttaaaggccagcaggtgctgggcttagtggaaaaccagtctgattggtacctcggaaacctgtggaaaaaccaccgtccttggcctgccctcgggcgtgggtataacacaggagttatcctgcttctactcgacaaattgaggaagatgaagtgggagcaaatgtggcgcctcactgctgagcgggagcttatgggcatgctgtccactagtctggcagaccaggatattttcaatgccgtcattaaacagaatcctttcctcgtgtatcagctcccgtgtttctggaacgtccagctcagtgaccatacacgttctgaacaatgttacagggatgtttcagatttgaaagtgatccactggaatagcccaaagaaactccgtgtcaaaaacaaacacgttgagttcttccgaaatctgtatctgactttcctggagtatgacggcaacttactaagaagggaactgttcggttgtccgtcggaggccgacgttaactccgaaaaccttcagaaacagctgtccgaactcgatgaggacgacttgtgctacgaatttcgccgtgagcggttcactgtgcatcgaactcatttgtactttctacactacgagtacgagccagccgctgattcgactgacgtgacgctggttgcgcagctgtcgatggacaggcttcagatgctcgaagccatctgtaagcactgggaggggcctattagtctagcactctatctctcagatgctgaagcccagcagttccttcggtacgcccagggatccgaagtgttgatgagtagacacaacgtgggctaccacatcgtctacaaggaggggcaattctatccggtcaacctccttcgaaatgtggctatgaagcatattagcactccctacatgtttctctctgatattgacttcctgcccatgtatggcctgtacgaatatctccgcaaaagcgtcatccagctggacttggctaacacaaaaaaggccatgatcgttcctgctttcgagacacttagatatcgcctgagtttcccaaagagtaaggctgagctgctctcgatgcttgatatggggaccctctttactttccgctatcatgtctggaccaaaggccacgcacccaccaacttcgcgaaatggcgaactgccacaacaccatatcgggtcgagtgggaagccgactttgagccgtatgttgtggtgcgacgcgattgtcctgaatatgatcgtaggttcgtcggctttggctggaacaaagtggcccatataatggagcttgatgttcaggagtatgagtttatcgtcctgccaaacgcctatatgatccatatgccccacgctccttccttcgatatcaccaaatttagatctaacaagcagtaccgcatctgcctgaagaccctcaaagaagaattccagcaggatatgtcgagaagatacggcttcgctgccttaaagtatctgactgccgaaaacaacagctag

SEQ ID NO: 228670 - DNA, 2115 bp, Artificial Sequence
  Description of Artificial Sequence: Synthetic coding sequence
atgctgggaatctgtcggggaaggcgaaagttcctggcagcatctctgagccttctctgtattcccgctatcacgtggatctatctgtttagtggttcctttgaagatgggaaacctgttagcctttccccgctggagtctcaagcacattcacctcgctacaccgcctcctcacagcgtgagcgggaaagcctggaggtgcgcatgcgggaggtggaggaggaaaaccgcgcattgcgcaggcaactatccctggcacagggtagggcgccaagccaccgcagaggcaaccactccaaaacatatagcatggaggaaggtacaggggactcggagaacttgagggctggtatagtggctggcaatagttcggagtgcggtcagcaaccagttgtggagaagtgcgagaccattcacgtggccattgtgtgcgcaggctataacgcttctcgagatgtcgtgaccctggtaaagagcgttctcttccaccggaggaatcctctgcattttcacctgatcgccgattctattgcggagcaaatcctggctaccttattccagacatggatggtccctgcagtaagggttgacttctataatgctgacgagctcaagtccgaggtctcttggatcccgaataagcactacagtggtatctatggcttgatgaaattggttctcacaaagactttacccgctaatctagagcgcgtaatcgtcctggacacagacatcaccttcgcaacagacattgccgagttatgggccgttttccataagttcaagggccagcaggttctcggtctcgttgaaaaccagtctgactggtaccttggaaacctgtggaaaaatcacaggccttggcccgcactgggccgaggctacaatacgggcgtgatcctcctccttctggacaagctgcgtaaaatgaagtgggagcagatgtggagactcaccgcagaacgtgaattgatgggaatgctcagtactagtcttgccgatcaggacatatttaatgccgtcattaagcagaacccttttttggtttatcagctgccttgcttctggaatgttcagcttagcgaccacacaagatcagagcaatgctacagggatgtgtctgatctgaaactacagaaacaattaagcgagctggatgaggatgacctttgctatgaatttagaagagagcgtttcactgtgcatcggactcatctctacttcttgcattatgagtatgaacccgcagccgattcgactgatgtgaccctggttgcccagctgagcatggatagactccagatgctggaggctatttgcaaacattgggagggccctatctcactagctctctatctgtccgacgccgaggctcagcagttcctgcgttacgctcaaggttctgaggtgctgatgtcgaggcacaacgtcggatatcacatcgtttacaaggagggtcagttttacccagtgaacctgttgaggaatgtggcgatgaaacatattagcactccatatatgtttctgtctgatatcgattttcttcccatgtatggtctgtatgaatatttgaggaagtcggtgatccagttggaccttgccaatacaaagaaggcaatgatcgtacctgcctttgagacgcttagatataggctgagttttccgaagtcaaaagcagaattactaagtatgttggatatggggactctgtttaccttcaggtaccacgtgtggacgaagggccatgcccctacaaatttcgctaagtggcgcaccgctacaacaccctatcgtgtagagtgggaagctgactttgagccttatgtcgtggtacggagggattgccccgagtacgaccggcgttttgtgggctttggatggaacaaagttgctcacatcatggaattagatgtgcaggaatatgagttcattgttctcccaaatgcctacatgatccacatgccccatgcgccttcctttgacatcaccaaattccgctcaaacaagcagtatcgtatatgcttgaaaaccctgaaggaggagtttcaacaggacatgagcagaaggtacggatttgctgctctgaaatatctgaccgccgagaataacagctag

SEQ ID NO: 228671 - DNA, 408 bp, Artificial Sequence
  Description of Artificial Sequence: Synthetic coding sequence
atgcttgggatttgtcgaggccgaaggaaattcctggcagctagcctgagcctcttgtgcattccagccattacttggatctacctcttctctggatcctttgaggacgggaaacccgtgagtctgagcccccttgagtcacaggcacatagcccccgatataccgcatcttcccagcgagaacgcgaatccctagaggtacgtatgagggaagtggaggaagagaaccgtgccctcagacgacagctctctctagcccaggggagagctccttctcacaggagaggcaaccacagcaaaacttactctatggaggaggggaccggcgactctgaaaacttgagggccggaatcgttgctgggaattcctcagagtgtgggcagcagcctgtggttgaaaagtgttag

SEQ ID NO: 228672 - DNA, 144 bp, Artificial Sequence
  Description of Artificial Sequence: Synthetic coding sequence
atgttgggcatctgtcgcggtcggaggaagtttttggccgcatctctcagtttactctgcattccggctatcacttggatctatttattcagcggatccttcgaggatggaaagcctgtctccctttcaccgttagaatcttag

SEQ ID NO: 228673 - DNA, 411 bp, Artificial Sequence
  Description of Artificial Sequence: Synthetic coding sequence
atgctgggtatatgcagggggaggcgcaaattcctggccgctagcctgagtctcctctgtattccagccattacctggatttatctgtttagtggaagtttcgaagacgggaaacccgtatccctttcacccctggagtctcaggctcatagccccaggtacaccgcttcaagtcagcgggaacgggagagcctcgaagttcggatgagagaggttgaggaagagaaccgggcacttagaagacagctgagcctcgcccagggacgcgctccgtctcatcgcaggggaaaccactctaagacctatagtatggaggaaggcactggcgacagtgagaacctgcgggctggcattgtagcgggaaatagtagcgagtgtgggcagcagcccgtggtggaaaaatgcgagtag

SEQ ID NO: 228674 - DNA, 183 bp, Artificial Sequence
  Description of Artificial Sequence: Synthetic coding sequence
atgctgggcatctgccgcggaagacggaaatttttggccgcatcactgtccctcctctgcatacctgccataacatggatctatctcttctccggtagttttgaagatggcaagccggtgagcctcagtccactcgaaagccaggcccattcccctcgctacaccgctagctcccaaaggtag

SEQ ID NO: 228675 - DNA, 330 bp, Artificial Sequence
  Description of Artificial Sequence: Synthetic coding sequence
atgctgggtatatgtcggggtcgtcgaaagttcctcgcggcatcactctccctcctatgtattcctgcaataacttggatctacctgttctcaggatctttcgaagacgggaaacccgtaagcttatcaccgctggaaagtcaggctcactctccacggtataccgcttcttcccagagggagcgcgagagtttggaagtccggatgagagaggttgaggaagagaaccgtgcattgagacggcaactatcactcgcacaaggaagggcacccagccacaggagagggaaccactcaaagacgtactccatggaagagggaacaggctag

SEQ ID NO: 228676 - DNA, 2124 bp, Artificial Sequence
  Description of Artificial Sequence: Synthetic coding sequence
atgctcggcatctgccggggtcggagaaagttcttggcagcttctctctctctgctgtgcataccggctatcacttggatctatctgttctctggctcctttgaggatgggaagccggtgtccctctcacccctggaatctcaggctcatagccccaggtatacagcttcatcacagagggagcgagagagcctggaggtccggatgcgggaggtagaagaggagaacagggctcttagaaggcagctttccctcgcacagggtcgggcaccctctcaccgtaggggcaatcactccaagacgtacagcatggaggagggaactggagacagcgaaaatctgcgcgcaggtatcgtggcgggaaattcctcagaatgtggccagcaacccgttgtcgagaagtgcgagactattcacgtggctatcgtctgcgctggatataatgcgagccgtgatgtggtgaccctcgtgaaatcagtgttatttcatcggagaaaccctctgcacttccaccttatcgccgatagcattgccgagcagatcctagccactttatttcagacctggatggtacctgccgtccgggtcgatttctacaatgccgacgaactgaaatcagaggtgtcatggatacctaacaaacactattctggtatctatggcctaatgaaactggttctgacaaaaacactgccagccaacttagagagagttattgtgctagatacagatatcacattcgcaacagatatagccgagctgtgggccgttttccacaagtttaagggtcagcaggtcctagggctcgttgaaaatcagagcgattggtatttgggaaacttatggaagaaccatcggccttggcccgctttgggtcgagggtacaacaccggtgtcattttacttctcttagacaaattgcggaaaatgaaatgggagcagatgtggcgcctgaccgccgagagggagctgatggggatgttgagcaccagtctggcagatcaggacatattcaatgccgttatcaagcaaaacccgttcctcgtttaccaactgccctgtttttggaatgtccagttgtcagaccatacacgctctgagcagtgctatcgcgacgtcagcgatcttaaggtcattcactggaattctcccaaaaaactgagagtaaagaacaaacacgtcgagttttttcggaatctttacctcacattcctagaatacgatgggaatctgctgagacgtgagctctttggttgtcctagcgaagctgatgttaattctgagaatttacagaagcagctgtccgagctggacgaagacgatttgtgctacgagttcaggagggagaggttcacagtgcatcggacacatctctattttcttcattacgagtatgagccagccgctgacagcaccgacgtgacactggttgcgcaactatccatggaccgcctccaaatgctagaggccatttgcaagcactgggaaggacccattagcctggctttatacctctcggatgcagaagcgcagcagttccttcgctatgcgcaaggtagcgaagtgctcatgagcaggcacaatgttgggtatcatatcgtttataaggagggacagttttatcctgtgaatttactcaggaatgttgcgatgaagcacataagtaccccctatatgttcctgtcggatatcgattttttacctatgtatgggctctatgagtatctgaggtaccacgtgtggactaaggggcacgcacccacaaattttgctaagtggcggacggctacaacaccctaccgcgtggaatgggaggcagatttcgaaccctacgtggtggtacgtagggattgccccgaatatgatcggagatttgtggggtttggatggaataaggtggctcacataatggaactggacgtccaggagtacgaattcattgtgctcccaaacgcctatatgattcacatgcctcatgccccatccttcgacatcaccaagtttcgcagcaacaaacagtatcggatatgtctcaagactctgaaagaggaattccaacaggatatgtcccgcaggtatggcttcgctgcactcaagtatcttacggctgagaataacagctag

SEQ ID NO: 228677 - DNA, 1668 bp, Artificial Sequence
  Description of Artificial Sequence: Synthetic coding sequence
atgctgatctggtcagaggtgtcttggattcctaacaagcactacagtggaatctatggcctcatgaagttggttctgaccaagacactcccggcaaacctggagagagttattgtgcttgatactgacataacttttgctacagacatcgcagaactctgggccgtgttccacaaattcaaagggcagcaggtgctaggcttagtagagaatcagtcggattggtatctcggtaacctgtggaagaatcatcggccttggccagcgctcgggagaggatacaataccggtgtgatccttctgctgctcgataagctccgtaagatgaaatgggagcagatgtggcgcctcactgcagagcgcgagctcatgggcatgcttagtacaagcctggcagaccaggacatatttaacgctgttataaagcagaaccctttcctcgtctatcagctcccatgcttttggaatgtgcagttaagcgaccacacacgatccgagcagtgttaccgggacgttagtgacctgaaggtgattcattggaattctcccaagaaattacgggtcaaaaataagcacgtagaattctttcggaatctgtacttgacattcctggagtacgacggcaacctgctgagacgggagctgttcgggtgccctagtgaagctgatgtcaatagcgaaaacctgcagaaacaactaagcgaactagatgaggatgatctgtgctacgagttcaggagagaacgtttcacagtgcaccgcacacatctgtactttctacattatgaatacgagcctgccgctgactcgacagatgtaacactggtggctcagctgtctatggatcgcttacagatgttggaagctatatgcaagcattgggaaggcccaattagcctcgccttatatctaagcgacgcagaggcccagcagtttttgaggtacgctcaaggttcggaggtgctgatgagcaggcataatgtcggttaccatattgtgtacaaggagggacagttctaccctgtcaacctgttgaggaacgtagctatgaaacacattagcactccctatatgtttctttccgatattgattttctcccgatgtacggcctctatgaatatctcaggaagtcagtcattcagctcgatctggccaacaccaaaaaggccatgatcgtccccgcatttgaaaccttgcgctataggttgtcttttccaaaaagcaaagcagaactcctgtctatgcttgatatgggcaccctattcacttttagataccacgtttggaccaagggccacgcgcctaccaattttgcaaagtggcggactgctaccactccctaccgtgtagaatgggaagctgatttcgagccctatgttgtagtccggcgtgattgtcccgaatacgatcggagattcgttggatttgggtggaataaagtcgctcacatcatggagctcgatgtgcaggagtacgagttcatcgttctgcctaatgcatacatgattcacatgcctcacgcaccttcctttgatatcacaaagtttcggtctaataaacagtatcgcatttgccttaagaccctgaaagaagagtttcagcaagatatgtctagacggtatgggtttgcagccctgaaatacctcaccgccgaaaacaactcttag

SEQ ID NO: 228678 - DNA, 1098 bp, Artificial Sequence
  Description of Artificial Sequence: Synthetic coding sequence
atggcgaaagtggcaaaggacctaaacccaggtgtcaagaaaatgagcctgggacagctgcagtccgcgaggggagtggcatgcctcggctgcaaagggacgtgtagcgggtttgaacctcactcttggcggaaaatttgtaaaagttgcaaatgtagccaggaggatcactgcctgacttcagacctggaggatgatcggaagatcgggagacttctgatggatagtaaatattcaacgctaacggccagggtgaagggaggcgatggtattcgtatatacaaaaggaacaggatgattatgactaacccaatcgcaacaggcaaagatcctacctttgataccatcacttatgagtgggcccctccaggtgtgacgcagaagttgggcttgcagtacatggagctgatccccaaggaaaaacagcctgtcactggaaccgagggggctttctatcgacggcgtcagctgatgcaccaactccccatctacgaccaggacccatccaggtgcaggggcctgctcgaaaatgaactgaaactgatggaggagttcgttaaacagtacaaatcagaggccctgggcgttggggaggtggcccttcctgggcaggggggacttccgaaggaagagggaaagcagcaggagaagcctgaaggggcagagacaactgccgctactacaaatgggtcactaagcgaccctagcaaggaagtggagtatgtttgcgagctgtgcaaaggcgcagcaccacctgactcacccgttgtgtacagcgatcgcgctggctataacaaacagtggcacccgacctgcttcgtttgcgctaaatgctccgagccattggtcgatttgatatatttctggaaggacggagcaccgtggtgtggtcgccactactgcgaaagcttgaggccacggtgctctggttgtgacgagattatctttgcagaagactaccaaagggtcgaagatttagcgtggcatcggaagcacttcgtatgtgagggctgtgagcagctgttgagtggacgtgcatacattgtgacaaaaggccagctcctttgcccaacctgcagcaaatcaaaacggtcgtag

SEQ ID NO: 228679 - DNA, 762 bp, Artificial Sequence
  Description of Artificial Sequence: Synthetic coding sequence
atgttcggcatgcagggcgacgtgttcggattgcgtgcaaccttcatggagggcctgcagtatatggagttgatccccaaagagaagcaacccgtcaccggtaccgagggggcattctacagacgacgccagctgatgcatcagctacccatttacgatcaagatcctagcagatgtaggggcctgttagaaaacgaactgaaactcatggaggagtttgttaagcagtataagtctgaggctttgggcgtcggagaggttgccttgccgggacaaggaggtttaccaaaggaggaggggaaacagcaagaaaagccagagggcgcagaaacaaccgccgctactaccaacgggtctctaagtgacccatccaaggaggttgagtacgtttgcgaactgtgcaagggcgctgctcccccagatagccctgtcgtatactctgaccgagccggatataacaaacagtggcatcctacatgcttcgtctgtgctaagtgctccgagccgctggtggatctgatatacttctggaaggacggtgcaccatggtgtggaaggcattactgcgagagtcttaggcccaggtgctccggctgcgacgaaataattttcgcagaggactatcaaagggtcgaagatctggcctggcataggaaacacttcgtgtgtgagggttgcgagcagttgctatctggtagagcttacatcgtcaccaaaggccagttattgtgtccaacctgttccaaatccaagcgctcctag

SEQ ID NO: 228680 - DNA, 879 bp, Artificial Sequence
  Description of Artificial Sequence: Synthetic coding sequence
atggatagtaaatacagtacactgactgcaagggtcaaggggggagatggtattcggatatacaagcgcaataggatgatcatgactaatccaatagcaacgggcaaggatcccacctttgacacaataacttacgagtgggctcctcctggcgtgactcagaagctgggcctccagtacatggagctgattccaaaggagaaacagcctgtgaccgggacagaaggcgcattctatcggagaagacagctgatgcaccagctgcccatctacgatcaagacccttcaaggtgcaggggcttgctagaaaatgaattaaagctgatggaggagttcgtcaaacaatacaagtctgaagcccttggagtcggtgaagtggctctcccagggcaggggggtctgcccaaggaagaaggcaagcagcaggagaagccagagggagccgaaaccaccgctgctactacaaacggcagtctgagcgatccttccaaggaggtggaatatgtttgcgaactgtgtaaaggtgcagcccctcctgactccccggtggtctacagcgatagggccggttataacaagcagtggcaccccacatgcttcgtgtgcgctaaatgcagtgagccgctggtggacctgatatacttttggaaagatggcgcaccttggtgcggacgtcattattgcgagtctcttagaccacgatgctctgggtgtgacgagattatctttgcagaggattatcagagagtcgaggacttggcgtggcatagaaaacacttcgtttgcgaagggtgtgagcagctgctctctgggagggcttatatcgtcacaaaagggcaactcctgtgtccgacttgttctaaaagtaagcgatcgtag

SEQ ID NO: 228681 - DNA, 744 bp, Artificial Sequence
  Description of Artificial Sequence: Synthetic coding sequence
atggctaaggtagcgaaggacctaaaccctggtgtcaaaaaaatgtcgctcgggcagcttcagtctgccagaggagtagcctgccttggttgcaagggcacctgtagcggattcgagccacatagttggcggaagatttgcaagtcctgcaagtgttcccaggaagaccattgcctcacctcggatctcgaggacgatagaaagattggtagactgctgatggactccaagtatagcaccttgactgccagggtgaaagggggagatggaatcaggatctacaaacggaaccgcatgatcatgacaaaccctatcgcaacaggcaaggatcccacattcgataccataacttacgaatgggctcccccaggtgtgactcagaagctgggtctccagtacatggaattaatacccaaggagaaacagcccgtgaccggcacagaaggcgctttttatcggcgaagacagctgatgcaccaacttcccatttatgatcaggatcccagtcggtgcaggggattgctggagaacgagctgaaactgatggaagagttcgtgaaacagtacaaatctgaggccttgggagtgggggaggtcgcactgcccggacaggggggactccccaaggaggaagggaaacagcaggaaaaaccggaaggtgctgagacgacggctgccactacaaatggatccctgtcggaccctagtaaggaagtcgaatataaacctgttccactagtttag

SEQ ID NO: 228682 - DNA, 786 bp, Artificial Sequence
  Description of Artificial Sequence: Synthetic coding sequence
atgaaccccaactgcgctcgctgcgggaagatcgtctatcccactgaaaaggtcaattgtttagacaagttctggcacaaggcttgcttccattgtgagacctgcaaaatgacccttaacatgaagaattacaaaggatacgagaagaaaccttattgcaatgcacattacccaaaacagtctttcactatggtggcggacactcccgaaaacctgcggctgaaacagcagagcgagctccagagccaggtgaggtataaggaggaatttgagaaaaataaaggcaaggggttctccgtcgtcgccgacacccccgagctgcagcggatcaaaaagacacaggatcagatcagcaacataaagtatcacgaagagtttgagaagtcccgcatgggacctagcggcggtgagggcatggaacccgagagacgcgatagccaggatggttcctcctaccgcagacctctcgagcagcagcagccccaccacatcccaactagcgcaccagtctaccaacagccacagcagcaacctgtagcccagagctacggcggttacaaggaacctgccgcacctgtgtccattcagcgcagcgcgcctggagggggtgggaagagatatcgagccgtgtacgactattctgctgccgacgaagatgaggtgtccttccaggacggagacacaatcgtgaacgtccaacaaatcgatgatggctggatgtacggaacagtagaaaggacaggcgataccggtatgctgccggctaattacgttgaggctatctag

SEQ ID NO: 228683 - DNA, 501 bp, Artificial Sequence
  Description of Artificial Sequence: Synthetic coding sequence
atgaccttgaacatgaagaactacaagggttatgaaaaaaaaccctactgcaacgctcattacccaaagcagtccttcacgatggtcgctgatacccctgagaatcttaggctcaaacagcagtccgagcttcagtctcaggtcaggtacaaagaggaattcgaaaagaataaagggaaaggattcagtgtagtcgctgacacacccgagcttcagagaattaagaaaacacaggatcagatctctaatattaaatatcatgaagaattcgagaagtcacgtatggggccttcaggcggtgaaggtatggaaccggagcgcagagatagtcaggacggctcctcttaccgccgaccacttgagcagcagcagccacatcacattccgacctctgctcccgtttatcagcagccacagcaacagccagtggcacagtcttatgggggttacaaggaaccggcagccccagttagtatccaacgatcagctcctggagggtag

SEQ ID NO: 228684 - DNA, 618 bp, Artificial Sequence
  Description of Artificial Sequence: Synthetic coding sequence
atgcttcccctaagagatctgcaagatgacactgagcacgaagagttacaaggtctgcgggaagaggcactgctgcagcgcgtcaggtacaaggaggaattcgagaagaataagggtaaggggtttagcgtagtggctgacaccccagagctgcaaaggattaagaagacacaggatcagatatcgaacattaaataccacgaggagtttgagaaaagccggatggggccttccggcggtgagggtatggagcctgagcggcgtgactcccaggacgggagctcctataggcgaccactagaacaacagcaaccccaccatattccgacatccgcccctgtgtaccagcaaccacagcagcagcccgttgcccagtcgtatggcggttataaggaacccgctgcaccagtcagcatccagaggtcagcgcctggaggcggtgggaaaaggtacagggcagtgtacgattacagcgctgccgacgaggacgaagtgagtttccaggatggtgacacaatcgtgaacgtgcagcagattgacgatgggtggatgtacgggaccgttgaacggaccggcgacacaggcatgctgcccgctaactacgttgaagccatttag

SEQ ID NO: 228685 - DNA, 786 bp, Artificial Sequence
  Description of Artificial Sequence: Synthetic coding sequence
atgaatccaaattgcgcgagatgtgggaaaattgtataccccacagaaaaagtcaattgtctggacaaattttggcacaaggcctgtttccattgtgaaacctgtaagatgacactaaatatgaagaattacaaaggatacgaaaagaagccctattgcaatgcacattaccctaagcagagctttactatggttgcggatactcccgagaatctgcggctgaagcagcaatctgaactgcagagtcaagttaggtacaaagaagagtttgagaagaacaaaggtaaaggtttcagtgtggtagcggacacaccagaactgcagcgaattaagaaaacacaggatcagatatccaacattaagtatcacgaagaattcgagaaaagtaggatgggaccgagcggtggcgagggcatggaaccagaacgaagggattcccaagacggcagtagttaccgcagacctctagagcaacagcagccgcatcatatccctacctctgctcccgtttaccagcagccacagcagcaacctgtcgcccagagctatgggggatacaaagagccagcggctcctgttagcattcagcggagcgcacccggagggggtggcaagagatacagggcagtttatgattacagcgccgcagacgaagacgaagtttcttttcaggatggcgacaccattgttaatgttcaacaaatcgatgacggttggatgtacggcaccgtcgaacgaacaggcgacacgggaatgcttcccgctaattacgtcgaagcaatttag

SEQ ID NO: 228686 - DNA, 378 bp, Artificial Sequence
  Description of Artificial Sequence: Synthetic coding sequence
atgaatcctaattgtgctcgatgcgggaagatcgtgtatccaactgaaaaggtaaactgcctcgataagttctggcacaaagcttgctttcactgcgagacctgtaaaatgacactgaatatgaagaattacaagggctatgagaaaaaaccgtattgtaatgcgcactacccaaagcaaagtttcacaatggttgccgacacacccgagaacctgcgtttgaagcagcagtcagagctgcaatctcaagtgaggtacaaggaagagtttgagaagaataagggtaagggcttttctgtcgtggctgatactcccgaactgcaacggtcaagcctcggctttttgtggaatgagatcccaccttccccccatctgtag

SEQ ID NO: 228687 - DNA, 4050 bp, Artificial Sequence
  Description of Artificial Sequence: Synthetic coding sequence
atgaagaagattcgtatctgtcacatattcacattctactcctggatgtcatatgatgtcctctttcagagaacagaattgggggctctggagatctggcgacagctgatatgcgcacacgtgtgtatttgcgtcgggtggctgtatctcagagatagggtgtgcagtaagaaagacatcatcttgcgcaccgagcagaacagtggcagaactatactcatcaaggccgtaaccgagaaaaacttcgagacaaaggactttcgggcatcactagagaacggggttttactctgtgacctcattaacaaactcaagcccggagtgatcaagaagattaatcggctgtctacgccaattgcagggttagacaacatcaacgttttcctgaaggcgtgcgaacagatcggactgaaggaggcccagctatttcacccaggagatctgcaggatttaagcaaccgcgtaaccgtgaaacaggaggaaacagaccgcagggtgaaaaacgtgcttattacactttactggttagggcgaaaggctcaatcaaatccatactacaatgggccacatttaaacctcaaagcattcgaaaacctcttaggtcaagccctcaccaaggcgctggaagactccagctttttaaaaagatcaggtagagattccggctacggcgatatttggtgtccagagcgcggagagtttctcgctccgcctagacatcataaaagagaggactctttcgagtctctggactcactgggttctaggtctctgacgtcttgctcctccgacatcactcttcgaggcggtcgagagggattcgaatctgacaccgattcagaatttaccttcaagatgcaggattacaataaagatgatatgagctacagacgcatcagtgctgtggagcctaagaccgccctgccatttaataggttcctgcccaataagtcccgtcagcctagttatgttccagcacctttgcggaagaagaaaccagacaagcacgaagataatagaagatcctgggcttctccagtctacaccgaagccgatgggacatttagccgactctttcagaaaatttatggggaaaacggttccaagagcatgtcagatgtgtctgctgaagatgtccagaatctcaggcagctgagatacgaggagatgcagaagattaaatcacagttgaaggagcaggatcaaaagtggcaagacgatctagccaaatggaaggaccggcgaaaatcatacaccagcgacctccaaaaaaaaaaagaggaacgcgaggagatcgagaaacaggctcttgagaagagtaagcgcagcagtaaaacctttaaggagatgttgcaggatcgagaatctcaaaaccagaaatccaccgtgcccagcaggcgcaggatgtacagcttcgacgacgtgttagaagaagggaagcggcctccaaccatgacggtgagtgaggcctcgtaccagagtgagagggttgaggagaagggggctacatatccctccgagattccaaaagaggactctacaacttttgccaagcgagaggacagagtgaccactgagattcaactgccttcacaatcccccgttgaggagcagagtcctgcaagcctgtcatcactgcggagtaggagtactcagatggaaagtactagagtcagcgcatctcttccacggtcctatcggaaaacagacacagtccggctcacatccgtggttacgccccgacctttcggatctcagactcgcggaatatcttccctgccccgatcgtataccatggatgatgcctggaaatataatggagacgtcgaagacatcaagagaacacctaacaatgtggtaagcacgcccgcaccctcgcccgacgcatcacagctggcgtcatctcttagttcccagaaggaggtcgcagcgacggaagaggatgttacccggctcccttctcccacaagcccatttagtagcctgtctcaagaccaggccgcaacaagcaaagccacattgtcttctacatcaggcctagacctaatgtctgaatccggggaaggagagatcagccctcaacgcgaagtgtcacggtctcaggaccagttctccgacatgaggatctcaataaatcagacccccggaaagtctctggacttcggtttcaccataaaatgggacatacctggtatatttgtagcctcagtcgaagccggaagcccagccgaattcagccaactgcaagttgatgatgagataatcgccatcaataatacaaaattcagctacaatgatagcaaagaatgggaggaggccatggccaaggcacaggagactggtcacctagtcatggatgtgaggaggtacggaaaagcgggatctcctgaaactaaatggatcgatgctacgagcgggatctacaactctgaaaagtctagcaatctttccgtgacaactgacttttcagagtcccttcagagctctaacatagagtccaaggagattaacgggatccatgacgaatctaacgcatttgagtcaaaagctagcgaaagtattagtctgaaaaatttgaagcggagatctcagttttttgagcagggatctagcgattctgtagtgccagatcttcctgttcccaccatttccgccccttcccggtgggtgtgggatcaggaggaggagcggaagcgccaggaacgctggcaaaaggaacaagatagactgctccaggaaaagtatcagagggagcaggaaaagctgcgggaagagtggcagagggccaaacaggaggcggagcgagaaaattctaaatacctcgatgaggaactgatggtgctgagctccaactctatgtcgctgactaccagagaaccttcccttgcaacttgggaggctacatggagcgaagggtcaaagtcttccgacagagaaggaacacgtgcaggggaggaggagagaaggcagccccaggaagaggtcgtgcatgaggatcagggcaagaaaccacaggaccagctggtgattgagcgcgagcggaaatgggagcagcagctccaggaggagcaggaacagaagcgcctgcaagccgaggctgaggagcaaaagcggcctgcagaggaacagaagcgccaggcagaaatcgagcgtgagacttccgtccggatctatcaatataggcgcccagttgactcctatgatattcctaaaactgaggaggcctcttctggctttctccctggcgaccgcaacaaatcccgatctacaactgagctggacgactactcaacaaataaaaatggcaataacaaatatcttgatcagatcggtaacatgacttccagtcagagaaggtctaaaaaggaacaagtgccgtctggtgcagagctagagcggcagcagatcctgcaggagatgcgcaaacgcaccccacttcacaatgacaatagttggattcgacagaggtcagcatccgtcaataaagaaccagtgagtctgccgggaatcatgcgcaggggagaatcactcgacaatctggattctccaagatccaattcctggcgccagcccccttggctgaatcagccgactggcttttacgcctcctcttccgtccaggacttctcgcggccaccccctcagctggtatccacctcaaacagagcatatatgcggaatccctcatccagcgtcccgccacctagcgcaggctccgtgaaaaccagcacaaccggcgttgccacaacccaaagcccaactcctaggtcacattcccctagtgccagccagtccggatcacagttgcgcaaccgctccgtgtccggcaagcgaatctgctcttattgcaataacattctgggtaaaggagcagcaatgattattgagagtctcggcttatgttatcacctgcactgttttaaatgtgtggcctgcgaatgtgacctgggtggttcaagcagcggcgctgaggtgcgaattagaaaccatcaactctactgtaacgattgttacctgaggttcaagtcggggagacccacagctatgtag

SEQ ID NO: 228688 - DNA, 5012 bp, Artificial Sequence
  Description of Artificial Sequence: Synthetic coding sequence
atgaagaaaattcgaatttgccacatcttcacattttattcctggatgtcctatgacgttctattccagagaactgaactgggcgctctcgaaatctggcgccagctgatctgcgcccacgtctgtatctgcgtcggatggctgtatttacgggatagagtttgttccaagaaggacattatactccgtaccgaacagaattccggacgtactattcttatcaaggccgtgacagagaaaaattttgaaaccaaagatttccgggctagcttggagaatggggtgctgctttgtgatctgatcaataagctgaagccaggggtcattaagaagatcaatagactctccacacctatcgccggactggataacatcaacgtttttctgaaagcatgtgagcagattggtctgaaggaggcacagctttttcatcctggcgacctgcaggacctgagcaatcgggttacggtcaagcaggaagagaccgatcggagggtcaagaatgtcttgattaccctctattggctggggaggaaagcgcagtccaacccatattacaacggcccacacttaaacctgaaagcgttcgaaaacctgctgggccaggctcttacaaaggctttagaggacagctccttcttgaagagatctggcagagattcaggatacggtgatatatggtgtccagagagaggggaattccttgcccctccccgacatcataagagggaagattccttcgagtccctagacagtttgggttcgaggtctcttacttcttgttccagtgacataacattacgaggcggaagagagggcttcgaatcagatactgacagtgaattcacgttcaaaatgcaagattacaataaagatgacatgtcatataggcgcatcagcgcagtggagccaaagaccgcactaccttttaacaggttccttcctaacaagagccgccaacccagctatgttcctgcaccactaaggaaaaagaagcccgataaacatgaggacaatcgtagaagctgggcgagtcctgtttatacagaagccgatggtacattctcctccaatcaacgaagaatttgggggacaaacgttgaaaactggccaaccgtccagggaacttcgaagtctagttgctacctcgaggaggagaaggctaaaactaggagtatcccaaatatcgttaaggacgacctgtacgttcggaaactttctcccgtgatgcccaacccgggaaatgctttcgatcagttccttcccaagtgctggacacccgaggacgttaactggaaacggattaaaagagagacctataagccctggtataaggagtttcagggattctcgcaattcttgctgctccaggcccttcagacctattctgacgacatactctcgtcagaaactcacacaaaaattgacccgacgtctgggccacgtcttatcactaggcgaaagaatctgtcttacgcaccaggctaccggagagacgacctggaaatggccgctcttgaccctgatctggagaacgatgatttctttgtgaggaaaactggcgcattccatgctaatccatacgtcctccgggcatttgaagactttaggaagttttctgagcaagatgatagcgtggagagggacattatcttgcagtgcagggagggagagctggtgctgcctgacctagagaaggacgacatgattgttcgaagaattccggcacaaaaaaaagaagttcccctgagtggggcaccagatagataccaccccgtcccgttcccggagccttggacattgccacccgaaattcaagccaagttcctgtgcgttctggagaggacttgcccctctaaggagaaatcaaattcctgtagaattcttgtgcctagttaccgccagaagaaggatgacatgctgaccagaaaaattcaatcttggaagctgggcaccacagtcccacctatcagtttcacccctgggccatgtagcgaagccgaccttaagcggtgggaggctatccgcgaggcctctcggttgcgccataaaaagcggctaatggtcgaacgattgtttcagaaaatctacggtgaaaacggcagtaagtcaatgtccgatgtgtcagcggaggatgttcagaacctccgccaactgcgctatgaagagatgcagaagatcaagtcacaattgaaagagcaagatcagaaatggcaagatgaccttgcaaagtggaaggatagacgcaagtcctatacaagcgatcttcagaaaaaaaaagaggagagagaagaaatagagaaacaagcactggaaaaaagtaaacgttcctcaaagacattcaaggagatgttacaagatagggagagtcaaaaccagaaatctactgtgccaagccggagacgcatgtactcattcgatgacgttttggaagagggtaaaagacccccaaccatgacagtttccgaggcctcttaccaaagtgagcgtgttgaagagaaaggggctacctatccgtctgagattcccaaggaggacagcacaacttttgctaagagagaggaccgggtcacaacagagattcaactcccttcccagagccctgtcgaagaacaatcacccgcaagcttgagttcgctaagatctaggtccacacaaatggaaagcaccagagtctctgcatccttgcctaggtcatacaggaagactgatactgttcggctgacctccgtggtcactccccgacccttcgggtctcaaacccggggaattagttctcttcctcgaagttacaccatggacgacgcgtggaaatacaatggagatgtcgaagatattaaaagaaccccaaacaatgtggtgtcaactcccgctccaagcccggatgcttctcagctcgcaagttcactctctagccagaaagaggtagcagccactgaggaagacgtaaccagactcccaagcccaacatccccattctccagcctgagccaggaccaggctgctaccagcaaagctactctgagtagcacttctgggcttgacctgatgtcagagtcaggtgaaggagaaatcagcccgcagagggaagtgtcacgctcccaggatcaattctccgatatgagaattagcataaatcaaacgcccggtaaatctctggacttcggctttactattaaatgggatatacctggtatcttcgtcgcctcagtcgaagcgggatctcctgcagaattctcacagctgcaggtcgacgacgagatcatcgcaatcaacaatactaagtttagctacaacgacagcaaggagtgggaggaggctatggccaaagcccaggaaacaggtcacctggtgatggacgtcagacggtatggcaaagccggatcgcccgagacaaaatggatagacgctacctctggtatctacaactctgagaagtcaagtaatctatctgtgacaaccgactttagcgaaagcttacagagcagcaatattgaatctaaagagatcaatggcattcacgatgagtctaatgctttcgagtccaaggcatctgagtccatttccctgaagaacctaaaacgacggtctcagtttttcgagcaggggtcttctgattcagtagtccctgaccttccagtcccaaccatctcagctcctagccgctgggtgtgggatcaggaagaagagaggaagagacaggagaggtggcagaaggagcaagacaggctcttgcaagagaaataccaaagggagcaggagaaattaagggaagaatggcagagggcgaaacaggaagcagagcgagagaacagcaaatacctggatgaggagctgatggtattgtccagcaattcgatgtcactgactacacgcgagccctcccttgccacatgggaggccacctggtcagaagggtcaaagagctccgaccgcgaagggacgcgggctggcgaggaagagaggagacagccacaggaagaggtggtgcatgaagatcagggaaagaagccccaggaccagctagtcatcgaaagagaacggaagtgggaacagcagctccaggaagaacaagagcagaagcgcttacaggccgaggccgaagaacaaaagagacccgcagaggaacagaaaagacaggcagaaatagaacgggagacctccgtgcgcatctaccagtacagacggccagtagatagctacgacattcccaaaactgaagaggcttcatcaggattccttcccggagacagaaataaatctcgctccaccaccgagctggacgattactccacaaataaaaacgggaacaataaatatctggaccagatcggaaacatgacttccagccaaagaaggagcaaaaaggagcaggtgccatctggggctgaacttgaacgccaacaaatcctccaggaaatgcggaaaaggactcctctgcacaatgataattcttggatccgccagcggtccgcatccgtgaacaaagaacctgttagccttccaggaataatgcgcagaggcgagtcactggacaaccttgatagccctcgcagtaacagctggaggcaacccccttggctcaaccagccgacgggattttacgcaagctctagtgttcaagatttttctagaccgcctccacagctggtgtccacctccaaccgcgcttacatgcgcaatccctcctcgtcagtacctcctccctcggctggttccgtgaaaacgtcaactactggggtggccacgacacagtcacctactccccgatcccattcacccagcgcaagccagtccgggtctcagttgagaaatagcgtgctgcccgtgagcgtcacttccgaagccctcccacaggagctaaaaagcggatctgagactaccaactgcacagctacaacagccatcagtgacagcaatctagatggtcagcccccatgcgacgtatccctccataccaaggccctgctgcagatcgaagaggaggtggtcgctgctcacgttgacctgta

SEQ ID NO: 228689 - DNA, 4844 bp, Artificial Sequence
  Description of Artificial Sequence: Synthetic coding sequence
atgaagaaaatcagaatatgccacattttcacattctacagctggatgagctatgacgtgctgttccagcggaccgagctgggcgcactggaaatttggcgtcagttgatctgcgctcatgtctgcatttgtgttgggtggctgtacttacgggatcgggtctgttcgaaaaaggacattatcttaaggacggaacagaacagcgggaggactatacttattaaggcggtaactgaaaagaatttcgagacaaaagactttcgggcttcccttgagaacggtgtgctcctgtgcgatctgattaacaagttaaaaccgggtgtgataaagaagatcaacaggctgtcgacccctatcgctgggctggacaatatcaacgtttttttgaaggcctgcgaacagattggcttgaaagaggctcagctctttcaccccggtgacctgcaggacttatctaaccgagtcaccgtgaaacaagaagagactgatcgacgggtcaagaatgttctcatcactctgtattggctcggcaggaaagctcagagcaatccctactataacggcccacacctgaacctcaaggcatttgagaacctgctcggacaggcccttaccaaagccctggaggactcgtcattccttaagagatcagggcgtgatagtggttacggggacatatggtgccccgaaaggggcgaattcctagccccacccagacatcacaagcgagaagatagctttgagtcattagattccctaggaagtcgatctcttaccagttgcagttccgatattacactgaggggcggtagggaagggttcgaatctgataccgatagtgagttcacatttaaaatgcaggattacaataaggacgacatgtcctatcggaggatctccgccgttgaacccaagaccgcgctccctttcaaccgattcctgccaaataagagcaggcagcccagctatgtgcctgcgccactcagaaagaagaaacctgacaagcatgaggataaccgtagatcgtgggcatcaccagtctacactgaagcagatggcacattttcctcaaatcagaggcgtatatggggaaccaatgtagagaactggcctaccgtgcagggtacgtccaagtcctcctgctacctggaggaggagaaggccaagacacggagtatacctaacatcgtgaaggacgacctgtacgtaagaaaactttcccctgttatgcctaaccctggaaatgctttcgaccaatttctaccaaagtgttggactccagaggatgtaaactggaaaaggataaagagggagacatacaaaccttggtacaaggagttccaaggcttcagtcagtttctactgctacaggccctgcagacgtattccgatgatatcctctctagcgaaacgcacactaaaattgaccccacaagcggccctcgactgatcacccgcagaaaaaacctgagctacgccccaggctaccggagagatgatctggagatggctgccctggaccccgacctggaaaatgacgacttctttgtgaggaagacaggagctttccacgccaacccctacgtcctccgcgcatttgaagatttccggaagttctctgagcaggacgatagcgtcgagagggatattattctgcagtgtcgtgagggcgaactggtcctgcccgatctcgagaaagatgacatgatcgtgagaaggattcctgctcaaaagaaagaagtccctctgtctggggctccagatcgctaccatcctgtccccttccccgagccctggaccctccctcctgagattcaggccaagtttctctgcgtcctagagaggacctgtccgtccaaggagaagtctaattcttgtagaattctagtgccaagctatcggcagaaaaaagacgatatgctgactcgcaaaatacaaagttggaaacttggcaccacagtgcctcccattagcttcaccccaggaccctgttcagaggcggacctgaagaggtgggaagctattcgggaagcaagcagactgcgccacaagaaaaggcttatggtcgagcgcctcttccaaaagatctatggcgaaaacgggagcaaatctatgtcagacgtgagcgccgaagacgtgcagaatctgcggcagctgagatacgaggaaatgcagaaaatcaagagtcaactgaaggaacaagaccaaaagtggcaggatgatctggccaaatggaaagatcgccgtaagtcttacacatccgacttacaaaagaagaaggaggagcgcgaggagatcgagaagcaggccttggagaaatcaaagcggagctctaaaacttttaaagagatgctgcaggatagggagagtcagaatcagaaatcaacagtcccctcaagacgaagaatgtacagcttcgatgatgtgctcgaagagggcaagagacccccaaccatgacagttagtgaggccagctatcagtctgagagggtggaagagaaaggagcaacctatccctccgagatccccaaggaggattcaaccactttcgcaaagagggaagacagggtgaccactgagattcagctgccctcacaatcccccgtagaagagcagagtccagctagccttagtagcttgcgatctagaagcacacaaatggagtccacacgagtgagcgcctccctgccgaggtcctatagaaagactgatacagtgcgcctgaccagcgtagtgaccccaaggcccttcggaagtcaaacacgtgggatttcatccttgccacgaagctataccatggacgatgcttggaagtacaacggcgacgtggaagacataaagcggacccctaataatgtggtgagcacacctgctccctcgccggacgccagccagttggctagctccctgtcttcgcagaaggaggtggctgctacggaggaggacgtaacgagattgccatcccccacaagtccattctcgagccttagccaggaccaagctgccaccagcaaggccacactgagttctacaagcgggctggacctgatgtccgagtcaggcgagggtgagatctccccccagcgagaagtctccaggtcgcaggatcaattctcagacatgcgtatctctataaaccaaacaccgggtaaatctctggattttgggtttaccatcaagtgggatatacccggtatctttgtggcttcggtagaggcagggtcgcccgcagaatttagccagctgcaggtggatgacgagattatcgccatcaacaataccaaattcagctataatgatagtaaggaatgggaggaagcaatggcaaaggcacaagagacgggccatctggttatggatgtgaggcggtatggtaaagccggatctcctgagactaagtggattgacgccacgagtgggatttataattccgaaaagagttccaatctatccgtgaccacagatttttccgaaagcctacagtcttctaacatagagagcaaagagattaacggcatccatgatgagtctaatgcgtttgaatcgaaggcaagcgagtccatcagcctgaagaatctgaagaggcgtagccagttctttgagcaggggagctctgacagcgtggtgcccgatctgcccgtacctactatttctgcaccttcccgctgggtgtgggaccaggaggaggaacggaagcgccaagagcggtggcagaaagaacaggatagacttctccaagaaaagtaccaacgcgagcaggaaaaactgcgggaggagtggcagcgcgctaaacaggaggcagaaagagagaatagcaaataccttgacgaagaactgatggtcctctccagcaattcaatgagcctaactacaagggagccgagcctcgcaacctgggaggccacttggtcagaggggtccaagtcctcagaccgagagggcacacgggcaggagaggaggaacgcagacaaccccaggaagaggtggtgcacgaggaccagggaaagaaacctcaggaccagctggtgattgaacgggagaggaagtgggagcaacaattgcaagaggaacaggaacaaaaaaggctgcaggctgaggccgaagaacagaaacgccctgcggaggaacagaagcgccaagccgagatagagcgggaaacgtccgttagaatctaccaatacagacggccagtagacagctatgacattcctaagactgaggaagctagttcaggatttctgccaggcgataggaataagagccgcagcaccacggaattggatgattattccacaaacaagaacggcaataataagtacctggaccaaatcggcaatatgacctcctcccagcggagatcaaagaaagaacaggtcccttcaggggcagagttagaacgacagcagatcttgcaggaaatgcggaagagaacccccctgcacaatgataactcttggattaggcagcgttccgcaagcgtaaataaggaacccgtgtctctacctggcattatgaggcgtggagaaagtctggacaacttggactcccccagatctaattcttggcggcagcccccatggcttaatcagcctacgggcttctacgcctcttcttccgtgcaggactttagtcgccctccacctcagctggtgtctacctcaaatagggcatacatgcgtaatccgtcaagctcagtgcccccacccagtgccggaagcgtgaaaacctctactacaggagtggccacaactcagagccctactccgaggagtcacagcccaagtgcgtctcagtctgggagtcagttgcgaaatagttggacagctaacaggcacgtgatgta

SEQ ID NO: 228690 - DNA, 4158 bp, Artificial Sequence
  Description of Artificial Sequence: Synthetic coding sequence
atgcaggattacaataaggacgatatgtcttacaggagaatctccgctgttgagccaaagacagccctcccgtttaacagattcctgcctaacaaatccaggcagccctcatatgttcctgctcctctcagaaagaagaaaccagacaaacacgaagacaatcgcagaagttgggcctcccctgtttacaccgaggcagatggcacttttagctccaaccaacggagaatctggggcacgaacgtggaaaattggccaacagttcaaggcacttcaaaatccagttgctacctggaagaggaaaaagccaaaacacggagtattccgaacatcgtaaaagatgacttgtacgtaaggaaactgtcacctgtgatgccgaatccaggcaatgcctttgaccagtttctgcccaaatgttggactcccgaggacgtgaactggaagcgcatcaagcgcgagacctacaaaccctggtacaaggaatttcaggggttttcccagtttcttctgctacaggccctgcaaacttacagcgatgatattctatcatccgagacccacaccaaaattgaccctacctccggtccacgtttgatcacaaggcggaagaacctgagctatgcacctggctacagaagggacgacctggaaatggctgcactggacccggacctcgagaacgatgacttcttcgtgagaaaaacgggggcttttcacgccaatccgtacgtattacgggcatttgaagatttcaggaaattctcagaacaggacgactccgttgaacgtgatatcatccttcagtgtcgagagggcgagttagtgctgcccgacctggagaaagatgacatgatagtcagacgcattcccgcacagaaaaaggaggtgcctctgagtggtgcacccgataggtaccatcctgtgccgttccccgaaccctggaccttgcctcctgaaatccaagccaagttcctttgtgtcctggaaaggacttgcccaagcaaggagaaatcaaactcatgccggattttggtgccgtcttatagacagaagaaggatgatatgttgactcgcaagatacagtcttggaagttggggaccaccgtgccacccatttccttcactcctggcccttgttccgaggccgacctcaagagatgggaggccatcagggaggcatctagactccggcacaaaaagagactgatggtggagaggctcttccagaaaatttacggtgaaaatggcagcaaatctatgagtgacgtaagcgctgaggacgttcagaacctgcggcaactcaggtatgaggagatgcagaaaatcaagagtcagctgaaggaacaggatcaaaagtggcaagatgatctggctaagtggaaggatcggaggaaaagttatacctccgatcttcagaaaaagaaggaagaacgcgaggagattgaaaagcaggctctcgaaaaaagcaagcgtagctccaaaacattcaaagaaatgctgcaggacagagagtctcaaaaccaaaagtccacagtgcctagccggcgacggatgtactctttcgacgatgttctggaggaaggcaagcggcctcccactatgaccgtgagtgaagcctcgtaccagagcgagcgggtggaggagaagggagccacctacccttccgagatccccaaagaggattccaccacgttcgcaaaaagggaggacagagtgacaaccgagattcaattgcctagccaaagcccggttgaggagcagtccccagcaagccttagtagcctgagaagcaggtctacccagatggagagcacaagggtgagcgcatctctccctagatcctaccgaaagacagacactgtcaggcttaccagcgtcgtcaccccaagacccttcggtagtcagacccgcggaattagctcactgccaaggtcatataccatggacgacgcttggaaatacaacggggatgtggaggacataaaacgaactcccaacaatgttgtttctacccctgcgccaagtcctgatgcatcccagttagccagcagcctctccagccagaaggaggtcgcagcaacagaggaggacgtaacacgattgcctagtccgacatcgccctttagctccctaagccaagaccaggctgctacctccaaagccaccttgtcatctacctccggcctcgatctgatgagcgaatcgggggaaggagaaatttcccctcagagggaagtgtcaaggtctcaggaccaattcagcgacatgcggatatccatcaaccagacccccggtaagtctctagattttggttttactattaagtgggacatccctggcatctttgtggcgtcagtggaggcaggctcaccagctgagttttctcagttgcaggtagacgatgagatcatagctatcaataacacaaaatttagttataatgacagcaaagaatgggaggaggccatggcaaaagctcaggaaacgggacacctagtgatggacgtccgaaggtatggcaaggcagggtcaccagagacaaagtggatagacgctacgtcagggatctacaattctgagaagagcagcaaccttagcgtcaccacggacttctcagaatccctgcagtcatcaaacatagagtctaaggagattaacggcattcatgatgaaagtaacgcctttgagtcaaaagcgtccgaaagtatttcccttaaaaatctgaagaggcgttcccagttctttgaacaaggttctagtgattcggtggtaccggacttgccagtccctaccatctccgcaccttcccggtgggtatgggatcaggaggaggagcggaagagacaggaacgctggcagaaagagcaagacaggctgctgcaggaaaaataccagcgtgaacaggagaagctgagggaggaatggcagagagcaaaacaggaagctgagcgggaaaacagtaagtatctggacgaagagctgatggtgttgtcctctaactccatgagcctcactaccagggagcctagcctggcaacctgggaggctacctggagcgagggctctaaatcctctgatagagaaggcacaagggctggagaagaagaacggaggcagccccaggaagaagtagttcacgaggaccaaggcaagaaaccccaggaccagctggtgattgagagagaacgcaagtgggaacaacagctgcaggaggaacaggaacagaaaaggctccaggccgaggcagaagagcagaagagacccgctgaagaacagaagcgccaagcagaaatcgagagagaaacctcagtcaggatttaccagtaccggaggccagtggattcttatgacattcctaaaaccgaggaggcctctagtgggttccttcctggagatagaaacaagtctaggagtaccacagaacttgacgactattcaactaataagaacggaaacaataaatacttggatcagatcggtaacatgaccagctcacaacgaaggtccaagaaggagcaagtgccttctggagctgagctcgagcggcagcagatcttgcaagaaatgcgaaagagaactcctctgcacaatgataactcatggattcgacagcggtcagccagtgtgaataaggagccagtaagcctgcccggaattatgcgcagaggtgagtctctggataatctggactcacccagaagcaacagctggcgccaaccaccttggttgaaccagccaacgggattctacgccagcagttcagttcaggactttagccgcccacctcctcagctggtgtcaacaagcaatcgagcatatatgcgcaatcccagcagctctgtgccaccgccttctgcaggtagtgtaaagacatcaacaacaggtgtcgcaactacccagtctccgacaccacggtcacattctccgagtgcatctcaaagtggctctcagctacgcaattctgtgctgcccgtttctgtcactagtgaggctctgccgcaggagcttaagtccggcagtgaaaccaccaactgtacagccactacggcaatatcggactcaaacctggatggacagcctccctgcgatgtctcactgcacactaaagccctgcttcaaattgaggaggaggttgtggcagcccatgtcgatctctag

SEQ ID NO: 228691 - DNA, 2280 bp, Artificial Sequence
  Description of Artificial Sequence: Synthetic coding sequence
atggaaagctccccattcaacagaaggcagtggacctcactaagtctgcgtgtgactgctaaggagctctccctggtgaacaagaataagagcagtgccatcgtcgaaatcttctcgaagtatcagaaagctgctgaagagactaatatggaaaaaaagaggagcaatactgagaacttgagccaacacttccggaaggggactctgacagtgctgaagaagaaatgggaaaatccaggcctcggggcagagtctcacacagatagcttgcgtaactccagcacagaaattcgccacagggccgaccaccctcccgcagaggtgactagtcacgccgctagcggggctaaagccgatcaggaggaacagatccatcccagatcacgtctgcgatcacccccagaggccctggtgcagggaaggtatccacacatcaaggacggggaggacctgaaagaccactcaactgagagtaaaaaaatggagaattgcctcggtgagtccagacacgaggtggaaaaatctgagatcagcgagaacaccgatgcttccggcaagattgagaagtataatgtacccttgaacaggcttaaaatgatgttcgaaaaaggagagccgacacagaccaagatcctccgtgctcaaagccgatcagcctctggcaggaagatcagtgagaatagctactccctggacgatctcgaaattggcccaggccagctgtctagctcgactttcgacagcgaaaaaaacgaaagccgccgaaacctggaactgcccaggttgtcagagaccagcattaaagaccgcatggctaagtatcaggctgccgtaagtaagcagagcagctctactaactatacaaacgaactgaaggcctccgggggtgagatcaaaatccataaaatggagcagaaggagaatgttccccctggacccgaggtttgtataacacatcaagagggggagaagatttctgccaatgaaaactcactcgccgtacgatccacccctgccgaggatgacagcagagattcccaagttaaaagtgaggtacaacagcccgtgcatcctaaaccattaagtccagattctagagcctcgtcactaagcgaatccagtccacctaaggcaatgaagaaatttcaggctccagccagagagacatgcgtggaatgccagaagactgtgtatcccatggaaagacttctggccaaccagcaagtgttccacatttcctgtttcaggtgttcctattgtaataacaagctttccctgggaacttacgcttcactgcacgggcgaatctactgcaagccacacttcaatcagttatttaagagtaaaggcaattacgacgaaggattcgggcacagaccccataaagatctgtgggcaagtaaaaacgaaaacgaagaaattctggagcgtccagctcagctggccaatgctagagaaactccgcattcccccggagtggaagatgcaccaatcgcgaaggtgggtgtgttggctgcctctatggaagccaaagctagcagccagcaggagaaggaagacaaacccgctgaaacaaagaaactccggattgcttggcccccacccaccgagctggggtcaagcgggagtgccttagaggaggggataaagatgagcaaaccaaagtggccgccagaagatgagatctcgaagccagaagtgccggaagatgttgacttagacctgaaaaagctgcggcgaagcagttctctgaaggaacgatctcgaccatttacagttgcagcctccttccaaagtaccagtgttaagagtcctaaaaccgtgagtcccccaattcgcaagggttggtcaatgtccgaacagtccgaagaaagtgtcggcggacgagtagccgagcgaaagcaggttgagaatgctaaagcatctaaaaaaaacggcaacgtgggcaagacaacctggcagaacaaggaatccaagggcgaaacaggtaaacggagtaaagaggggcattcactggaaatggagaatgagaatctggtggagaacggggcagacagcgatgaggatgataattcttttctaaagcaacagtccccacaggaaccgaagtcgctgaactggtcatcatttgtcgataatacttttgccgaggaatttaccacacaaaaccagaaaagtcaagacgttgaattatgggaaggtgaggtggtaaaggagctctccgttgaggaacagatcaagcgtaaccgttattacgatgaagatgaagacgaggagtag

SEQ ID NO: 228692 - DNA, 2283 bp, Artificial Sequence
  Description of Artificial Sequence: Synthetic coding sequence
atggaaagcagcccattcaatcgaagacagtggacgagcttaagtctccgggtaacagccaaggaactcagtctcgtgaacaagaataagtcctcagcaattgtcgaaattttttcgaaataccagaaagccgctgaggaaaccaatatggagaaaaaacgctccaacactgagaacctgtcccagcatttccggaaagggacactaacagtgttgaaaaaaaagtgggagaatccaggcctgggggctgagtcgcacacagactctctgcgaaacagttcaacagaaatccgtcatagggctgatcatccgccagccgaggtcacgagccacgccgctagcggagctaaagcagatcaggaggaacagattcacccaagatcccgcctcagatcaccacctgaggcactggtacaggggaggtatccccacatcaaggatggagaggatctgaaggaccattcaactgaaagcaaaaaaatggagaattgcttgggcgagtctcgacacgaggtcgagaaaagcgagatttcagaaaacactgacgcatcaggaaagatcgagaaatataacgtgcccctgaatcggttgaagatgatgttcgaaaaaggggaaccaacccagaccaaaatccttcgggctcaatcacgctccgctagcggcaggaagatctcagagaacagctacagccttgatgaccttgaaatcggcccagggcagctgagcagcagtacgttcgattcagagaaaaatgagagccgaaggaatctcgagttacccagactgtctgagacatcaattaaagacaggatggcgaagtaccaggcggcagtgtccaagcaaagttcaagtactaactacacgaatgaactcaaggcatcaggaggtgagatcaagattcacaagatggaacagaaggaaaatgtgcctccaggaccagaggtctgcattacacaccaggaaggagaaaagatcagtgccaacgaaaactccctggccgtcagaagtactccagccgaggatgactctccaggcgacagccaggtgaagtccgaggtgcagcaacccgttcaccctaaacccctgagccccgatagcagggcctcgtcactgtccgagagctcaccacctaaagccatgaagaagttccaggcacctgcccgtgagacttgcgtggagtgccagaagacagtttaccctatggagcggctgctggccaatcagcaggtgttccacataagttgttttaggtgcagctactgcaataacaaactgtctcttggcacctatgctagcttgcatgggaggatttactgcaaaccacattttaaccagctcttcaagagcaaggggaactacgacgagggatttggacatcgccctcataaggacctctgggcctccaagaacgagaacgaggagatccttgagagaccagcccagctggcgaatgcgcgagaaactccacatagcccaggggtggaggacgccccaatcgctaaagtgggcgtgctcgcggcaagcatggaggccaaagcttcgagtcagcaggaaaaggaggacaaacctgctgaaacaaaaaagctgcggatcgcttggccacccccaacagaactgggctcttcaggatcggcgttggaggagggcattaaaatgtctaagcctaaatggccacctgaggatgagattagtaaacccgaggtgcctgaagatgtagatctggacttaaagaaactacgcagatcgagtagtctcaaggaacgaagccggccattcacagtcgctgcatcctttcagtctacaagcgttaagtccccaaagaccgtttcaccacctatccgtaagggctggtcaatgtcagagcaatcagaggagagcgtgggtggacgcgtggcagaacgcaaacaagtcgagaacgcaaaggcgtctaagaaaaatggcaacgttggtaaaactacctggcagaacaaggagtcgaagggagagactggcaaacggagcaaggaaggtcactcattggaaatggagaatgagaatctcgtcgaaaacggagcggatagcgacgaggacgataattcttttctgaaacagcagagcccccaggaaccaaaaagtctgaattggtcctcctttgtcgataacacgtttgcagaggagtttactactcagaaccagaagtctcaggatgtggagctttgggagggtgaagtagtgaaagagctgtcagtggaagagcaaattaaaagaaaccggtattacgacgaggacgaagatgaggagtag

SEQ ID NO: 228693 - DNA, 2037 bp, Artificial Sequence
  Description of Artificial Sequence: Synthetic coding sequence
atgtggcaaggatgtaactgcagccaattgagtgaaactgccgtggaccaggaacaactgggagtgctcacttttatacttcagaggaccacttgtttaaatgtgtccgctgatcaggaggaacagatacatccccgttcccgccttaggtctccccctgaggcccttgtgcaggggagatatccccatatcaaagacggtgaagatttaaaggatcatagtacagagtccaagaaaatggaaaactgcctgggggagtcccgccatgaagtcgagaaatccgaaatcagcgaaaacacagacgcgagtggtaagatcgagaagtacaacgtacctctcaacagactcaaaatgatgttcgaaaaaggagagcccacccaaactaagatcttaagagcacagtctaggtcagcgagcggtcggaaaataagcgaaaactcgtactctctcgacgatctggaaatcggcccaggccaacttagtagctcaacattcgactccgaaaaaaacgagagccgtcgaaatctggagctgcctagacttagcgagactagcatcaaggacagaatggccaagtaccaggctgccgtatcaaaacaaagcagtagtacaaattacacaaacgagttaaaggccagtgggggtgaaataaagattcacaagatggaacagaaggaaaatgttccaccgggtcccgaagtgtgcattacacatcaagaaggagagaagatctctgcaaatgaaaattcattggctgtacggtctacacccgcagaagatgactctagagacagtcaggttaaaagcgaggtccagcaacccgtgcaccctaagccactttcccctgattctcgcgcttcgtccctgagtgagagctcccccccaaaggccatgaagaagttccaggcgcctgctcgagaaacctgcgttgagtgccagaaaacagtctacccaatggaaaggctgctggctaatcagcaggtgtttcacatttcctgcttccgttgtagttattgtaacaataaactgtctcttggaacctatgcctcccttcatggtcgtatctactgcaagccgcacttcaatcagttgttcaagagtaaagggaactatgatgagggatttggccatcgtccacacaaagacctttgggccagcaaaaatgagaacgaagagatcctcgagcgccctgcccagctggctaatgccagggagaccccccatagccccggtgttgaagatgctcctatcgctaaagtcggcgtgctggccgctagcatggaggctaaggccagttcgcagcaggaaaaggaggataagcccgcagagactaaaaagcttaggatcgcttggcctccgccaacagaactgggtagctccggctctgcacttgaggagggcataaaaatgtccaagccaaagtggcccccagaggatgaaataagcaaacccgaggtacctgaagatgtggacctggatctcaaaaagttacgcagatccagcagcctgaaggagcgctcacgtccctttactgtggccgcaagcttccagtcaacatctgtgaaatcccctaagactgtatcgcccccaatccgtaaggggtggagcatgtcagaacagtctgaagaaagtgtcggaggtagggtggctgaacgtaaacaggtcgaaaacgccaaggcctccaaaaagaatggcaacgtaggtaaaactacctggcagaataaagaatccaagggtgagacaggcaagcgctctaaagaggggcacagtctcgaaatggagaacgagaatctggtggaaaacggagccgacagtgatgaagacgataactcattcctcaagcagcaatctcctcaggagcctaagtctttaaactggtcatccttcgtcgacaataccttcgcggaagagttcacgactcaaaaccagaagtcccaggatgtcgagctgtgggagggcgaagtggtcaaggagctgtcagtggaggaacagatcaaacggaaccgctattacgatgaagacgaggacgaggagtag

SEQ ID NO: 228694 - DNA, 1374 bp, Artificial Sequence
  Description of Artificial Sequence: Synthetic coding sequence
atggagcaaaaagagaacgtaccaccaggcccagaggtgtgcataactcaccaggagggggaaaagatcagtgccaacgaaaactcgcttgctgtacgttccacgccagccgaagacgactccagggactcacaggttaaaagcgaagttcagcaaccagtccacccaaagccgctgagccccgactctagagcatcttctctgagtgaaagctctccaccaaaggctatgaagaagttccaagccccagctcgagaaacatgcgtggaatgccagaaaaccgtgtaccccatggagaggcttctggccaaccagcaggtgtttcacatctcctgtttcagatgcagttactgtaacaataagctcagcttagggacctacgctagcctgcacgggaggatctactgcaaaccccacttcaaccagctgtttaagagcaaagggaactacgacgaggggttcgggcaccggccacacaaggacttatgggcatcaaaaaatgaaaacgaagagatcctagagcgcccagcccagcttgccaacgctcgcgagacacctcatagccccggtgtggaggatgcacccatagctaaggtcggagtgcttgcggcatcaatggaggctaaggccagttcccagcaggagaaagaggataagcctgccgaaactaagaagctgcgaattgcctggcctccgcctacggaactgggctcgagcggctccgcccttgaagagggaattaaaatgtctaagccaaaatggccgccagaagacgagatctccaaacccgaagtacctgaagacgtggatttagacctcaaaaaactgcgcaggagttctagcttgaaagaacggtctaggcctttcacagtggctgcctccttccaatctaccagtgtaaagagccccaagaccgtaagcccccctatccggaaaggatggtctatgtccgaacaaagtgaggagagtgtcgggggacgagtcgcagaaagaaagcaggtcgaaaacgcaaaggctagtaaaaagaatggcaacgttggcaagacgacttggcagaataaggagagcaagggggaaaccggtaagagatccaaggagggccactctctggaaatggagaatgagaatcttgtggagaacggcgcagattccgatgaggatgacaatagtttcctaaagcaacagtccccgcaagagcccaaatctttgaactggtcatccttcgtcgacaatacctttgctgaggagttcacgacgcagaatcaaaaatcccaggacgtggaattatgggaaggcgaagtggtgaaggaattaagcgtggaggagcagattaagagaaatcgctattatgatgaggatgaagacgaggaatag

SEQ ID NO: 228695 - DNA, 336 bp, Artificial Sequence
  Description of Artificial Sequence: Synthetic coding sequence
atggaaagcagtcctttcaaccgcaggcaatggacctctctcagcttgcgtgtgacagccaaggaattatccttagttaacaaaaacaaaagctcagccattgtggagatcttctcaaagtatcagaaagccgcagaagaaaccaacatggagaagaaaaggtcaaatactgaaaacctgtcgcagcactttcgcaaagggacccttactgtactgaaaaaaaaatgggagaacccaggtcttggtgctgaaagccacaccgattcactacggaatagcagcaccgaaatccggcaccgcgcagaccaccctccggcagaggtgaccagccactag

SEQ ID NO: 228696 - DNA, 393 bp, Artificial Sequence
  Description of Artificial Sequence: Synthetic coding sequence
atggaatcctccccttttaaccggaggcagtggacctcactctcactcagggtcaccgctaaagagctctcattagtgaataaaaataaatcaagcgccatcgttgagatcttcagcaagtaccaaaaggcagcggaagaaactaacatggagaaaaaaagatctaacactgagaacctttcgcagcattttcgcaaggggactctgacggtcctgaaaaaaaagtgggagaacccgggactgggggcagagagccacactgatagcttacgcaatagttcaacagaaattcggcatcgcgctgaccaccccccagcagaagtgacaagtcacgccgcatctggcgctaaagcggaccaggaagagcaaatccatccccgttcacgactttag

SEQ ID NO: 228697 - DNA, 1371 bp, Artificial Sequence
  Description of Artificial Sequence: Synthetic coding sequence
atggaacagaaagaaaatgttccgccaggacccgaagtatgtataacccaccaggagggcgaaaagattagcgctaacgaaaatagtctggcagttcgttccacccctgctgaggatgactcacgcgactctcaggttaagtccgaagtgcaacagccagtccatcctaaaccactgagccctgacagcagggcctcttctctgtccgagtcaagcccacctaaggcaatgaaatttcaggccccagcaagagagacttgtgtcgaatgccagaaaactgtgtaccccatggagaggttgctggccaaccagcaggtgtttcatattagttgcttcagatgctcttattgcaacaacaagctgagcctgggcacatacgcctcattgcatggacggatctactgcaagcctcactttaaccagttgttcaaaagcaaaggaaattacgatgaaggctttggacatcggccacataaggacctgtgggcttcgaaaaacgaaaatgaggagattttggagagacccgcacagctggccaatgccagagagactccacactctcccggagttgaggatgccccaatcgccaaggtgggtgtgctggccgcatccatggaggcaaaggcatcttctcagcaggagaaagaggataaacctgctgagaccaagaaactgaggatcgcctggccccctcccacagagcttgggagcagcgggagcgccctggaggaaggcatcaagatgtcgaagccaaaatggccccctgaagatgagatatcaaaaccagaagtcccagaggacgtggatctagacctgaagaaactgcgaagatccagctcactcaaagagagatcacgaccattcaccgtggctgcaagctttcagtcaacaagcgtgaagtctcctaagactgtgtcaccacccattcgaaagggttggagtatgagcgaacagtccgaagaatctgtcggtggcagagtggccgagcgtaaacaggttgagaacgccaaagcctcaaagaagaacggtaacgtcggtaaaacgacttggcagaacaaagaaagcaagggcgagacaggtaaacgctcaaaagaaggccactcccttgagatggaaaacgaaaatctagtcgagaacggggcagactctgatgaggacgacaacagctttcttaagcaacagagtccacaggagcccaaatcccttaattggagtagttttgtggataacacattcgccgaagagtttaccacccagaatcagaagtcacaggacgtggaactgtgggaaggcgaagtcgttaaagagctttctgtggaggagcagattaaaaggaatagatactacgacgaggacgaagatgaggagtag

SEQ ID NO: 228698 - DNA, 1803 bp, Artificial Sequence
  Description of Artificial Sequence: Synthetic coding sequence
atggagaactgcctcggagaaagccggcatgaggtcgagaagtcggagatatccgagaatacagatgcaagcgggaaaatagagaaatacaatgtccccctcaacaggctgaagatgatgtttgaaaaaggggaacccacgcagacaaaaatccttcgcgcacagtctcgaagtgccagcggacgcaaaatcagcgagaacagctactcactcgatgaccttgagatcggcccagggcaactgagttcgtccacatttgacagcgagaagaacgagtctcggaggaaccttgaactcccccgactgtcagagaccagtattaaagaccgtatggctaagtaccaggccgctgtgagcaaacagagcagctccacaaactataccaatgagctcaaagcctcggggggagagattaaaatccacaaaatggagcagaaggagaatgtgccacccggtcctgaagtgtgcattacccaccaggagggtgaaaaaatttcagctaacgaaaactccctggccgtccggtccacacccgctgaggatgacagtccgggagactcacaagtgaaaagcgaagtccagcagcctgtgcatcccaagcccctcagtcccgacagtcgggcaagtagtctatctgaatcaagcccacctaaggccatgaagaaatttcaggccccagcacgagagacatgcgtggagtgccagaagacagtgtaccccatggaaagactcctagccaatcagcaggtcttccatatcagctgctttcgctgcagctactgtaataataaattatccctgggcacgtacgcttccttacacgggaggatttattgcaagcctcactttaatcagttgttcaaatccaaagggaattacgacgagggctttggccaccgccctcataaagacctctgggccagtaaaaacgaaaacgaggagatccttgaacgtcccgctcagctggcgaacgccagggagactcctcactcccccggtgtcgaagacgccccaattgccaaagtgggggtgctggctgcgtccatggaagccaaagcttcttcgcagcaagagaaagaagataagcccgcagagactaagaagctgcgcatagcctggcctccccctactgagctgggttcatccggctctgccctcgaggagggcatcaaaatgtctaaacccaagtggcctcctgaggacgagattagcaaaccggaagttcccgaagacgtagatcttgacttgaaaaaactacgcagaagttcctccttgaaggagagatctagacctttcacagtagccgcatccttccagagcacttcagtaaaatcacccaagacagtgtctccaccaattcgtaagggatggtctatgagcgagcagtctgaggagtccgtgggaggcagggttgccgaacgaaagcaggtggaaaatgccaaagcctcaaagaagaatgggaacgtgggtaagaccacatggcagaataaagaatcgaaaggagaaaccggcaaaagaagcaaggaaggacatagtctggaaatggagaacgaaaatctcgtcgagaacggagccgacagcgacgaagacgacaactctttcctgaaacagcagtctccccaagagcccaagtctttgaattggagctcctttgttgataatacctttgccgaggagttcacaacacagaatcagaaatcccaggatgtggagctgtgggagggtgaggtggtgaaagagctgagcgtggaggagcaaattaagcgtaatcggtattacgacgaggacgaggacgaagaatag

SEQ ID NO: 228699 - DNA, 1800 bp, Artificial Sequence
  Description of Artificial Sequence: Synthetic coding sequence
atggagaactgccttggggaatcccgtcacgaggtggaaaagtctgaaatctccgaaaatacagacgcctcagggaagattgagaagtataatgtgccgctgaacaggcttaagatgatgtttgaaaaaggtgagccaacacagacaaagatcttgagagcccaaagtcggtcagcctccggcaggaagatctcagagaattcctatagcttggacgacctggaaattgggccaggccaactgagttcttccacctttgacagtgagaaaaatgaatcccggcgtaatctcgaactacctcgcctctctgaaacttcaattaaagatcgcatggccaaataccaggcagctgtttccaaacagtccagcagcacaaactacacgaacgagctcaaggcgagcggtggcgagattaagatacacaagatggagcagaaagagaatgtcccccctggccctgaggtttgcatcacacaccaggagggcgagaagatctcagctaatgagaactctctggcagtcaggagcacccccgctgaggatgacagccgggactcccaggttaaatcagaagtccaacagccagtgcaccccaagccactgagtcctgacagtagagcgtcaagcctgtctgaatccagcccccctaaggctatgaagaaattccaggctccggcaagggaaacctgcgtcgagtgtcagaaaacggtgtaccctatggagcggttacttgctaatcagcaggtttttcacatatcgtgttttagatgtagttattgtaacaacaaactgtcactggggacttacgctagcctgcacggcaggatttattgcaagccacattttaaccagctgttcaaatccaaggggaattacgacgagggttttggacatcgaccacacaaagacctctgggcctctaaaaacgaaaacgaagagatcttggaaaggcctgcccaactcgccaacgcccgagagactcctcactctcccggtgtggaagatgctcccattgctaaggtcggcgtgttggcagcttccatggaggcaaaagccagctcacaacaggagaaggaggacaagcctgccgaaacgaaaaagctcaggattgcctggcctccgcctaccgagctgggaagcagcggcagtgcgctggaggagggaattaaaatgagcaagcccaagtggcctccagaagacgaaatctctaaacccgaagtgcccgaggatgtggatttagacctgaagaagctgaggcgaagctcatctctgaaggagcgctctagaccatttacagtggccgcaagctttcagagcaccagtgtgaaatccccgaaaacggtgtcacctcccatcaggaagggatggtcaatgagtgagcagagcgaggaatcggtcggcggtcgcgtggcggaaaggaaacaggtggagaatgcaaaggcatctaaaaaaaatggtaacgtcggcaagactacctggcagaataaagagtctaagggtgagactggcaagcggagtaaagaagggcacagtctggagatggagaatgagaacctcgtagagaatggggcagattccgatgaagacgataattcgtttctgaaacaacagagccctcaggaaccaaaatctctaaactggtcctcgtttgtcgataacaccttcgctgaggaattcaccacccaaaatcagaagtcgcaggacgttgagctctgggagggagaggtggtgaaagaactgtctgtcgaggagcagatcaagagaaatcggtattacgatgaagatgaggatgaggaatag

SEQ ID NO: 228700 - DNA, 1128 bp, Artificial Sequence
  Description of Artificial Sequence: Synthetic coding sequence
atgctggaccgcgacgttggtcccacccccatgtatcctcccacctatctggaacccggtatagggaggcacaccccttacgggaatcagaccgattatcggatcttcgagctgaataagaggctgcaaaattggacggaggagtgtgataatctctggtgggacgccttcactacagagttcttcgaagacgatgcaatgctcacaatcaccttttgccttgaggatggtcctaaaaggtacaccattggtcgtactcttataccacgttacttccggtctattttcgagggcggagctaccgaactgtactacgtgctcaagcatcccaaagaggcctttcattctaacttcgtctcactagattgcgatcagggttcaatggtcacccagcacggtaagccgatgtttacacaagtttgcgttgaagggaggctgtatctggagttcatgttcgatgacatgatgaggatcaagacttggcacttttctattagacaacaccgggagctaattccccgatcaattctggctatgcacgctcaagacccacagatgttggaccagctgagtaagaatataacgcgttgcggtctgagcaactcaaccctaaactacttaagactgtgtgtcattttggagccaatgcaggaactaatgagtaggcataagacttatagcctgtcccctagggattgtctgaaaacttgtctgtttcagaagtggcagagaatggtcgcacctccagcagaacccactcggcaacagccctctaagcgacgaaaacgcaagatgagcggcggaagcacaatgagctctgggggtggcaataccaataattcaaattctaaaaaaaagtctcctgccagcacctttgccctttcctcccaggtgcctgacgtaatggtggtcggtgaaccaaccctcatggggggagagttcggggatgaggacgaaaggctcatcacccgcttggagaatactcagttcgatgctgcaaatggaatcgacgatgaggacagcttcaacaattcaccagccctcggcgctaacagtccctggaactcaaagccacctagctcacaagaatctaagagcgaaaatcccacatcccaggcgtcacagtag

SEQ ID NO: 228701 - DNA, 1236 bp, Artificial Sequence
  Description of Artificial Sequence: Synthetic coding sequence
atgtcagtcggttgcgcttgtccgggatgcagctccaagtcctttaaactgtattctccgaaggaacccccaaatggtaacgcattccctccctttcaccctggaaccatgctggatcgcgatgtcggccctacaccaatgtaccctcctacgtatctggaaccagggatcggcagacacacaccttacggaaaccagacggactaccgcatcttcgagttaaacaaaaggctgcagaattggaccgaggagtgcgacaatctatggtgggatgctttcaccacagaattctttgaagacgacgcgatgctgactattacattttgcctggaggacggtccgaagaggtatactattggacgaactctgattcccaggtatttcagatccatcttcgaaggtggagcgacggagctgtattacgtgttaaaacaccccaaggaggcgtttcattcaaactttgtatctctcgactgtgatcagggcagcatggtcacccagcatggcaagccaatgttcacccaagtgtgtgtagagggacggctgtatctggagttcatgttcgacgatatgatgaggataaaaacatggcacttttctatcagacagcacagagaattgattccgcgatctatcctcgccatgcacgcccaggacccacagatgctggatcagctatcaaagaatataactagatgcggtctatcaaacagcacgctcaactatcttcggctgtgcgtgatcctcgagccaatgcaggagctgatgagcagacataaaacatattctctcagtccgagagactgcttaaagacctgtttgttccagaagtggcaacgaatggtggcaccccctgccgaacccacgaggcagcaaccaagcaagcgcagaaagagaaaaatgagtggcggttccaccatgagtagcgggggaggcaatactaacaattcaaatagcaagaaaaagagccctgcatcaacatttgccctgagttcacaggttccagacgtcatggtcgtaggtgagcctacgttgatgggcggagaatttggagatgaagacgaacgactgattacccggttggaaaacacccagtttgatgccgctaacggaatcgacgacgaggatagcttcaataactctccagcgctgggtgccaacagtccgtggaatagtaaacccccatctagtcaggaaagcaagtcagagaaccctactagtcaagcttcacagtag

SEQ ID NO: 228702 - DNA, 1122 bp, Artificial Sequence
  Description of Artificial Sequence: Synthetic coding sequence
atgtcttcgacaccacacgaccccttctacagctctcctttcgggcctttctatcgtcgccatactccctacatggtgcaacccgagtatcgtatatacgaaatgaacaaacggctccagagcaggactgaggacagcgataacttgtggtgggacgccttcgctacggagttttttgaggacgacgctaccctcactctgtccttttgcttggaagacgggcctaaaaggtataccataggcaggacccttattccaagatatttctccacagttttcgaagggggtgtgaccgacctgtactatatccttaaacactctaaggagagttatcacaattcctcaatcaccgtagactgcgaccagtgtactatggtgacacagcatggcaagccaatgttcacgaaggtgtgtacagaggggagactgatcctcgaatttacatttgatgatctaatgcggattaagacatggcacttcaccatcagacagtatcgcgaattagttccccgatcaatcctggcaatgcacgcacaagacccacaggtcctcgatcagttaagcaagaacatcactagaatggggctgactaattttacacttaactacctccgcctgtgtgtcattctggaaccgatgcaagaactcatgtctaggcacaagacctataacttatcgcctagagattgcctaaaaacttgtcttttccaaaagtggcagagaatggtggcacctccagctgagcctactaggcagccaaccaccaaacggaggaagagaaaaaactccacaagctccactagcaattccagtgctggtaataacgcaaactcaaccggtagtaaaaaaaagaccacagctgcaaacctctccctgtcatctcaggtacctgacgtcatggtggttggagaacctaccctcatgggaggtgaattcggggatgaggatgagcggctgattacccggctcgaaaatacacagtatgatgctgccaacggaatggatgacgaggaggatttcaacaacagccctgcactcggaaataacagcccatggaacagcaagcctccagcaacgcaggaaactaaaagcgagaacccacctccacaggcatcacagtag

SEQ ID NO: 228703 - DNA, 996 bp, Artificial Sequence
  Description of Artificial Sequence: Synthetic coding sequence
atgagctccacaccgcacgatcccttttactccagtccattcggtccgttttacaggcgccacacgccatacatggtccagccagagtaccgcatctacgagatgaataagcggctgcaatctcgaactgaggacagcgataatctgtggtgggacgcatttgcaaccgagtttttcgaggatgacgccaccttgacactgagcttttgcctggaagatggccctaaacgatacacaatagggagaactctgatccctcggtatttttccaccgtttttgaagggggagttactgatctctactacattctgaagcattctaaggagagttaccataattcatctatcacagtggactgcgatcaatgcactatggttactcagcatggaaagccaatgtttacgaaggtatgcacagaggggaggttaatactggagttcacatttgacgatttgatgcggattaagacctggcattttaccatccggcaatatcgcgagctggttcccagatcgatcctggctatgcacgcccaagacccgcaggttctcgaccagctgtccaaaaacattactcgtatgggtctgactaattttactctaaattacttaaggctgtgtgtcattctcgagcctatgcaggagctgatgtcaaggcacaagacttacaatctatcccccagagactgtcttaaaacttgtctgttccagaagtggcagcggatggttgctccccctgccgaaccaacccgtcagccaactacgaagaggagaaagagaaagaactccacatcatcgaccagcaactcttcagcgggtaataacgccaacagcacaggaagcaagaaaaagacaacagcggcaaatctttcattgagctctcaggtgccagggctgggcgctattccaaactgtagcttgaacccgggacgagatggggacctatgtcacagcaccgctgtgacaccgagcggacagtttaaagagaagcactag

SEQ ID NO: 228704 - DNA, 942 bp, Artificial Sequence
  Description of Artificial Sequence: Synthetic coding sequence
atgtcatccaccccacacgaccctttttattcttctcccttcggtcctttttacaggagacatactccgtatatggtacaacccgaatatcgaatctacgaaatgaacaaaagactgcaatcccgtacagaggacagcgataacctctggtgggatgcttttgccacagagttcttcgaggacgatgcaacactaaccctctctttttgcttagaggatggcccaaaacgatataccataggaagaaccctcattcctcgctacttctcaacggtcttcgagggcggagtgacagatctgtattacatccttaagcatagcaaagaatcctatcacaacagctccatcacagtggactgtgaccaatgtaccatggttacccaacacggcaaacccatgtttacaaaggtatgcactgagggtagactcattttggagttcacctttgatgatttgatgcgtatcaagacctggcactttactattcgccagtatagagagcttgtgccaaggagcatcctcgcaatgcacgcacaggaccctcaggtgctggaccagctgtccaaaaacatcacacgtatgggcctgactaactttaccctgaattatctacgtctctgcgtcatccttgagcccatgcaggagctgatgtcccggcataagacttacaatctttctcctagagactgtctgaaaacctgtctgttccagaaatggcaacgaatggtggcaccaccagcggaaccaaccaggcagccaaccaccaagcgcagaaaaagaaaaaatagtaccagcagcacttccaattccagtgcaggaaacaacgccaactcaacagggtccaagaagaagacaactgcagcgaatctgtctttgtctagccaagtgccaatcgcctccattgccaggtctccggtctcgggatgcgcccttagaacctag

SEQ ID NO: 228705 - DNA, 570 bp, Artificial Sequence
  Description of Artificial Sequence: Synthetic coding sequence
atggtgacacagcacggcaaacctatgtttactaaggtgtgtactgaaggaagactcatcctggagtttacctttgacgacctgatgcgcatcaaaacctggcactttacaataagacaatatagagaactggtgcctcgaagtatacttgctatgcacgcccaggacccccaggtgttggatcagctgtcgaagaatattacacggatgggattaacaaatttcacgctgaactatctgcggctctgcgtgatactcgagcccatgcaagagctgatgtcacgccataaaacctataatctttcaccccgagattgcctgaagacctgcttatttcagaaatggcagaggatggtggccccacctgcggagcccaccaggcagcctacaactaaacggaggaaacgtaagaacagcaccagtagtacaagcaactcgtccgctggcaataacgcgaactctactggttcaaagaagaagactacagccgctaatttgagcctgagctctcaggtcccaattgcttcaatcgcaagatcccctgtgtccggttgcgctctgcgcacctag

SEQ ID NO: 228706 - DNA, 495 bp, Artificial Sequence
  Description of Artificial Sequence: Synthetic coding sequence
atggtacagcccgagtaccggatttacgaaatgaacaagcgccttcagtctcgcactgaggattccgacaacctgtggtgggacgcattcgcaaccgagtttttcgaggacgacgcaacccttacactttctttttgcctggaagacggcccaaagagatataccattggaaggaccttaatccccaggtatttttctacggtgtttgaggggggagtgactgatctctactatattcttaaacattctaaggaatcttaccacaactcaagcattaccgtagactgcgatcagtgcactatggtgacacaacacggaaaacctatgtttacaaaggtctgcacagagggcaggctgatcctggaatttacttttgatgatctcatgaggatcaagacctggcacttcactattagacagtatcgagagcttgtcccaaggtctattctggcaatgcatgctcaagatccacaggtgctggaccaactgtcgtag

SEQ ID NO: 228707 - DNA, 333 bp, Artificial Sequence
  Description of Artificial Sequence: Synthetic coding sequence
atgtcatctaccccacacgatcctttttatagcagcccctttggacccttctacagaagacatacgccttacatggtacagcccgagtataggatttatgagatgaataagcggctccagtcccggaccgaagattctgacaatctgtggtgggatgcatttgcaacagagttttttgaggatgatgcaacactgacgttgtccttctgtctcgaggatggccctaagcgatatatcgtgcattccgctgccgatgctagaggcaactgtaatcagttgggagattctgagcctgatgcttgtgatggactgctccagtttcctatcatgtag

SEQ ID NO: 228708 - DNA, 321 bp, Artificial Sequence
  Description of Artificial Sequence: Synthetic coding sequence
atgtcttccacacctcatgatcctttttattcttcgccattcggacccttctatcgcagacacactccgtatatggtccagccggaataccggatttacgaaatgaacaaacgactgcagagcagaaccgaagactctgacaatttatggtgggacgccttcgccaccgagttctttgaggatgacgctacgcttactttatcattctgtctcgaagacggccctaaaaggtataggacaaaaaacctccgccctatcggcgagaaaatgaacattaacggaaagtgctacagacaggatccccatcctcccctgctgtag

SEQ ID NO: 228709 - DNA, 1116 bp, Artificial Sequence
  Description of Artificial Sequence: Synthetic coding sequence
atgtctagcaccccacacgaccccttttattcgagccccttcggcccattctatcgacgccacacgccctacatggtccaacctgagtataggatttatgaaatgaacaagaggctgcaaagccgtacggaggacagtgataacctgtggtgggatgcttttgccactgaatttttcgaggatgatgctaccctgaccctttctttctgcctggaggacgggcctaaacggtacaccattggacgtaccttgattcctcggtactttagcactgtgttcgaaggtggggttacagatttatattatattctgaagcactcaaaggaatcttaccacaactcctccattacagtggattgcgaccagtgcacaatggtaactcagcacgggaaacctatgtttaccaaagtttgtacggaagggagactcatactggagtttaccttcgatgatctgatgaggattaagacgtggcactttactataagacagtacagagagctggttcctcgaagcattctggcaatgcacgcccaggatccacaggtcttggatcaattgtctaagaatataacccgcatgggcctcaccaattttacactgaactatcttcgcctgtgcgtcattctagagcccatgcaggaactgatgtcacgccacaaaacttacaacctatcccctcgggactgtctcaaaacttgcttgttccagaaatggcagaggatggtggcacctccagccgagcccacccggcagccgacaacgaaacgccgaaagaggaagaattcaacttcctccacatcaaactcttcagccggaaataacgccaacagtaccggctctaagaagaagactactgccgctaatttatcactgagctcacaagatgtcatggtggtcggcgaacctactctcatgggaggcgaatttggcgatgaagacgaacgcctgatcacccggctagagaatacacaatatgacgccgctaacgggatggatgacgaagaggatttcaataattctcccgcactgggcaacaacagtccctggaactccaaacccccagcaactcaggagaccaaaagcgagaatcctccgccacaagcttcccagtag

SEQ ID NO: 228710 - DNA, 1854 bp, Artificial Sequence
  Description of Artificial Sequence: Synthetic coding sequence
atgtcctatagcgtcacccttactggaccaggtccatggggcttccgcctccagggcggtaaggattttaacatgccactcactatctctcgaatcacaccaggctctaaagctgcccagagccagctgagtcaaggcgatcttgtagtggccatcgacggcgtaaataccgatacaatgacacatcttgaagcccagaataagatcaaatcagcaagctacaacctgagtctcacactgcagaagtccaagaggcccattcctatttcaaccaccgctcccccagtccagacgccactgccagtcattccccaccagaaagttgtcgtcaactctccagccaatgccgactatcaggagcgatttaacccatctgcgctgaaagattccgccctgagcacacacaagcccatagaggtgaagggccttggaggtaaagctacaatcatccacgcacagtataatacccctattagtatgtatagtcaggacgctatcatggacgccattgcagggcaagcgcaggcccagggatctgattttagtgggtccctgccaattaaagatcttgcggttgacagcgcctccccggtgtatcaggccgtgatcaagtctcagaacaaaccagaagatgaagctgacgagtgggctagaagaagctccaacctccagagtaggagtttccggatactggcacaaatgacagggaccgagttcatgcaggatccagatgaagaagcgctcagacggtcccggcctcaggctagctcctattcaccagctgtcgcggcatccagtgcaccagctactcacacatcatactcggagggccctgccgctcccgctcctaagccccgagtcgtgacaacagccagtatccgcccttccgtgtatcagcctgtccccgcttccacatatagtccaagccccggagctaactattccccaaccccctatacaccctcgccagcccctgcctatacaccaagtcctgcgccagcttataccccgagtcctgtaccaacttacactccctccccagcacctgcctacacgccaagtcctgcgccaaactataatccagcaccttcagtggcctactctggtggacctgcagagccagcatctcggccaccttgggtgaccgacgactccttttcccaaaagttcgctcctggaaaaagtaccactagcattagcaagcaaactcttccccgaggcggtcccgcttatacacctgccggaccccaggtgccccctttagcacggggtacggtacagcgcgctgaacgctttcctgcttctagcagaacacctctatgtgggcactgtaacaatgtgattagggggccattcctcgttgccatgggaaggtcctggcatccggaggaatttacatgcgcgtattgcaaaacttcccttgccgatgtgtgcttcgtggaagagcagaataatgtctattgcgagcgttgttacgagcagttctttgcccctctttgcgcaaaatgcaacacaaagattatgggtgaagtcatgcacgcccttaggcagacttggcacaccacctgtttcgtctgcgccgcttgcaagaaacctttcggtaattctctattccacatggaagacggggagccatattgcgagaaggactacatcaacctgttttctacaaaatgccacggctgtgattttccggtggaagccggagacaagttcatagaggcactcgggcatacatggcatgacacatgtttcatctgcgctgtctgtcatgttaatctggaaggccagcccttctattctaagaaagaccgaccactttgtaaaaaacatgcgcacactatcaatctgtag

SEQ ID NO: 228711 - DNA, 993 bp, Artificial Sequence
  Description of Artificial Sequence: Synthetic coding sequence
atgtcctacagcgtgacccttacaggacccggaccatggggtttcaggttacagggtgggaaggatttcaatatgccactgacaattagtcggatcacccccggtagtaaagctgcacagtcgcagctctctcagggcgatctcgttgtggccattgatggcgtcaataccgatactatgactcatctggaagctcaaaacaagattaaatctgcctcctacaacttgtcattaactctgcaaaagagcaagaggcctatccctatctccactaccgccccacctgtgcagactcctctccccgttattccccatcagaaagaccccgcactagacacgaacggtagtttggttgctccctccccgtcccccgaagcgagagcgagtccaggaaccccaggaacccccgagctcaggccaacattttcgccagccttcagtaggccgtccgctttcagctctctcgccgaggccagtgacccgggacctcctcgagcaagcttgcgcgcaaagactagtcctgagggggcacgcgatctgcttggaccaaaagcactgcccggtagcagccagcctagacagtataacaatcccatcggactgtactctgcggagactctgagggaaatggcgcaaatgtaccagatgtctcttcgcggaaaagcaagcggagtcggactgccaggaggatccctgccaattaaggacctggctgtcgacagtgcctctccggtctaccaggccgtgatcaagagtcagaacaaaccggaggacgaggccgacgagtgggccaggcgctcttccaacttgcaatctcgatctttccgaattctagcgcaaatgaccggaactgagtttatgcaagatcctgatgaagaggccctacgtcgcagccgtgagagattcgagaccgagaggaactcaccgagatttgcaaagttgcgtaattggcaccatgggctcagtgcccaaatcttgaacgtcaaaagttag

SEQ ID NO: 228712 - DNA, 1413 bp, Artificial Sequence
  Description of Artificial Sequence: Synthetic coding sequence
atgtcttacagcgtgactttgaccggccctgggccttggggctttcggctccaggggggaaaggactttaatatgccactcacaatctctcgcataaccccaggcagtaaagccgcacagtcacagctcagccagggggacctggtggtagcaatagacggggtcaataccgatactatgacacaccttgaggcccagaataaaatcaaaagcgcctcctataacttgtctctcactttacagaaaagcaaacgcccaattccgatcagcactactgcccctccggttcagacgccgttgcctgtcatcccacaccagaaggctagcagttattcccccgctgttgctgcctctagcgctcctgcaacccacacttcttacagcgagggccctgcggcacccgctcccaaacctagagtggtcaccactgccagcatcagaccttctgtataccagccagtacccgctagtacttactcaccttctcccggtgcgaactatagtccaacaccctacacccctagccccgcaccagcctacactccatctcctgctcccgcatatactccgtcccccgttcctacttataccccatctcccgctccagcctacaccccatcccccgcaccaaactataatcctgctccctctgtggcatacagtggcggacctgctgaacctgcaagccgtccgccatgggttacagacgactccttcagccagaaattcgccccaggtaaaagcacaacatctattagtaaacagacactgcccaggggtgggccagcctatacaccagcaggtcctcaagtgcctcccctggcaaggggcaccgtacagcgggcagagcgcttccccgcatcttcacgcacaccactgtgtggtcattgtaataacgtgattaggggaccatttctcgttgcgatgggacggagctggcaccctgaagagttcacgtgtgcctactgcaagacaagcctggctgatgtgtgctttgtggaagagcagaataatgtatactgcgagagatgctatgagcaattcttcgctcctctgtgcgccaagtgtaacaccaaaatcatgggtgaagtgatgcacgccttaaggcagacctggcataccacatgtttcgtgtgtgctgcctgcaagaaaccatttgggaactctctatttcacatggaggatggtgagccctactgcgagaaagattacattaacctctttagtacaaaatgccacggctgtgacttcccggtggaggcgggagataaatttatcgaggcactcgggcacacctggcacgatacctgctttatctgtgcggtctgtcacgttaaccttgagggacagccattctactcaaagaaggacaggcccctgtgcaagaaacatgcgcacacgatcaacctgtag

SEQ ID NO: 228713 - DNA, 2184 bp, Artificial Sequence
  Description of Artificial Sequence: Synthetic coding sequence
atgtcttacagcgtcactctgacaggacccggtccctggggatttcggcttcaggggggaaaggattttaatatgccactgacaatctcgcgaataaccccaggcagtaaggccgctcaatcccaactatctcagggcgacctcgttgtggcaattgatggcgttaacacagacaccatgacccatctggaggcacagaacaaaattaagtccgcctcctataatctctctctgaccttgcagaaaagcaagcggccaatccctatttcaaccacagcaccaccagtgcagactccactcccagtcattcctcatcagaaagatccggctcttgacaccaatgggagtctagtggcaccgtctccatctcccgaggcaagagcttcccccggaaccccgggtacaccggagctgcggcctaccttttctcccgctttctctaggccctctgcttttagctccctggctgaggcctcagatcccggtcccccaagagctagtctgcgggctaaaacttcgccagaaggcgctcgagatctactgggaccaaaggcactacccggttcatcacagccccgacagtacaataaccccattggcttatattcagccgagactttgcgggaaatggcccagatgtaccagatgtccctgcggggaaaggcctccggcgttggattgccaggtggatcactaccgatcaaggatctcgccgttgactccgcctctcctgtctatcaggctgtcattaaatcccaaaacaaaccagaagatgaagccgatgagtgggcacggagatcaagcaatttgcagtccaggtcgttcaggatcttggcgcagatgacgggcacggagttcatgcaggacccagacgaagaagcgcttaggagatcaagcacacccatcgaacacgcccctgtttgcacctcccaagccacgacacctctattaccggcttcagctcagcctcccgctgcagctagtcctagcgccgctagccctcccttggcaacagccgcagcccacaccgctatcgcttctgccagtacaacggcccctgctagctctcctgccgattccccacgcccacaggccagtagttattcgccagctgtggccgctagcagcgctcccgctacgcatacctcttactccgaaggccctgctgccccagcccctaagcccagggtggtgacaactgcttccattaggccatccgtgtaccagcctgtacccgcttcgacttacagccctagtccgggagcaaactactcacccactccatatacccctagtcccgctccggcttacactcccagtcccgctcctgcatatactccaagcccagtccctacttacacaccttccccagctccagcatacacaccgagccccgctccaaattataaccctgcgcctagcgtggcatactcagggggtcctgccgaacccgcttcaagacctccttgggtaacagatgacagcttttcccagaagttcgctcctggcaagagtacaacctccatatctaagcagactctaccacgtggcggtcctgcatatacacccgctggaccacaagtccctcctctggcccgagggaccgtccagcgcgcagaaagattcccagcttcctcacgaactcccttgtgtggccactgtaacaatgtgatacggggaccctttctcgttgcgatgggaagatcctggcaccctgaggagtttacatgcgcgtattgcaagacttcactagccgacgtgtgcttcgtggaggagcagaacaatgtgtactgtgagcggtgttatgaacagttttttgctcctctttgtgccaaatgtaatacaaaaatcatgggagaggtgatgcacgctctgcgacagacgtggcacaccacctgctttgtgtgcgcagcctgcaaaaaacccttcgggaactccttgtttcacatggaggacggagagccttattgtgaaaaggattatattaatctgttctccactaagtgtcacgggtgcgattttccagttgaggccggtgataaatttatcgaagccctgggccatacctggcacgatacatgttttatctgcgcagtgtgccacgtcaatttggaaggccaaccattttactcaaaaaaagaccgcccactgtgcaaaaagcacgcccacaccattaacctgtag

SEQ ID NO: 228714 - DNA, 1197 bp, Artificial Sequence
  Description of Artificial Sequence: Synthetic coding sequence
atgagctattctgtgaccctcaccgggcctggaccctggggattcaggttgcagggaggcaaggactttaacatgcctcttaccatctcccgcattacccccggttctaaggctgcccaatctcagctgtcgcaaggggacctggtagtggccattgatggtgttaatacagatactatgacccatctggaagcccagaacaagattaaaagcgcttcatataatctatccctgacgttgcagaaaagcaagcggccaattcctatatccacaaccgctccacccgtccaaaccccattgcctgtgatcccgcaccagaaggaccccgcactggatacgaatggtagcctcgtggcacctagcccttctccggaagccagagcttcacccggaactccaggcactcctgagctgcgacctactttcagccccgcattctcccgccctagtgccttctcctcccttgccgaggcctcagacccagggcctccccgagcttctttgagggctaagacctcccccgaaggggcacgtgatttgctggggccaaaggcactgccaggcagcagtcagcctcgacagtataacaacccgattggactctattccgcggagactctgcgcgaaatggcacaaatgtaccagatgtctctccggggtaaagctagtggcgtcggcctgccgggaggcgctgactaccaggaaaggtttaacccttccgcactcaaagatagcgccttatctacacacaagcctatagaggtgaaaggcctagggggaaaagctacgatcatccacgctcagtataacactcccatttctatgtatagtcaagacgccatcatggacgctatcgccggtcaggcgcaggcacaggggagcgacttttctggaagtcttccaattaaggacttagcagtagattcggccagcccggtgtatcaagctgtgattaaatcacaaaataaaccagaagatgaagccgatgagtgggccaggaggagtagcaacctccaatccaggagctttaggattctggcccagatgactgggaccgagttcatgcaggaccctgacgaagaggctctacggcgatccagggagcggttcgaaaccgagcgtaattcccctcggtttgctaagcttcgcaattggcaccacggattaagtgctcaaatcctaaatgtcaagtcctag

SEQ ID NO: 228715 - DNA, 852 bp, Artificial Sequence
  Description of Artificial Sequence: Synthetic coding sequence
atgtcgtactctgttactctgaccggtcccggaccatgggggttccgactgcagggtgggaaagattttaatatgccgttgacaattagccgcatcacccccggatctaaggctgcccagtcacagctgagtcagggtgacctcgtggtggcaatcgatggggtaaataccgacactatgacacacctggaggctcagaacaagattaagtccgccagctataacctatccctaaccctgcaaaaatctaaaagaccaatcccaatctctaccaccgcgcctcctgtgcagacccctctcccagtcatacctcatcagaaggtggtggtcaacagccccgcaaacgccgattaccaggagaggttcaatccctccgcgctgaaggactcggcactctccacgcataaaccaattgaagtaaagggattgggtggtaaagccaccattatccatgcccaatacaataccccaatcagtatgtactcgcaggatgctattatggacgcaatcgccggacaggcacaggcacagggttccgactttagcgggtccctgccgatcaaggaccttgcggtggactctgcttctcccgtttatcaggccgtaattaagtcccagaacaagcccgaggacgaagcagacgagtgggcaaggcggtcttctaatctccagtcccggagttttcggatcctcgcgcaaatgacaggtacagagttcatgcaggaccccgacgaggaagctttgagaagaagtcgggaacggttcgagactgaaagaaattcgccaaggttcgcaaagcttaggaactggcatcatgggctgtccgcccagatcctcaacgtgaaatcctag

SEQ ID NO: 228716 - DNA, 2199 bp, Artificial Sequence
  Description of Artificial Sequence: Synthetic coding sequence
atgtcttactcagtgactcttacaggccctggaccgtgggggttcagactccagggcggaaaggattttaacatgcctcttacaatctccaggattacaccgggatctaaagccgctcaatcacagctgtcccagggtgatctggtcgtggccatcgatggagtcaataccgatactatgacacatttggaagcccagaataagataaaatcagcctcatacaatctttcattaacactacagaagtccaaaagaccaatccctatttctaccaccgcaccccctgttcagacccccttacctgttataccacaccagaaagacccagccctcgacactaatgggagtcttgtcgcaccatcaccgtcgcccgaggccagagcttcaccaggcacacctggcacgcctgaactgagacctacctttagtcctgccttttccagacctagtgccttcagctcccttgccgaagcctcagatcctggcccaccccgagcgtccctgcgtgctaagactagtccagagggagcacgcgatctgttaggtccaaaggccctccctggctctagtcagccacggcaatacaataacccgatcggcctttacagcgccgagacactcagagaaatggctcagatgtaccagatgtccttacggggaaaggcatccggggttggtctcccagggggtgccgattatcaggaacggttcaatcctagtgccctgaaggattccgctctctccacccataagcctattgaggtcaagggcctgggtggaaaggcaacaattattcacgcccagtacaatactcccatttcaatgtacagccaggacgccatcatggacgctatcgccggacaagcacaggcacagggctccgactttagtgggtccctgcccattaaagacttagcagtggacagcgcgtcgccagtgtaccaggccgtcattaagtcgcagaataaacccgaggacgaagcagatgagtgggcaaggcgctcatcgaatctccagtctcgctcctttcgcatacttgcccagatgacggggacagagttcatgcaagatcctgacgaagaagcgctcaggcgctctaggcctcaagcaagctcttactcccccgctgtcgctgccagctcagcccctgccacccacacatcgtacagcgaaggcccagcagcccctgcccctaagccgagagttgttacaacagctagcatacgtccaagcgtgtatcagcccgtccctgcttccacatatagtccgtctcccggagccaactatagtccgaccccatacaccccttctccagctcccgcttacaccccatcaccagcacccgcatacactccaagccccgtgcccacttacactccctcccctgcccctgcctacacaccttccccggctcccaattacaaccctgctccttctgtggcgtacagtggcggtccagccgaaccggcttcccgccctccgtgggttaccgatgacagtttcagccaaaagttcgcccctggaaagtcaacaacatctatcagtaagcagacactgccacgcggaggcccagcctataccccagccggaccacaggtccccccactggcgcgaggcacagtgcagagggccgaaagattccccgcttcaagtagaacacccctgtgcggtcattgtaataatgtgatccgcggaccatttctggtggcaatggggaggtcatggcaccctgaggaattcacgtgtgcctattgcaagacatcattagctgatgtgtgcttcgtagaagagcaaaataatgtttattgtgagcgttgctatgaacagtttttcgccccattatgtgccaaatgcaacacaaagatcatgggcgaggtgatgcacgcactccgccagacctggcacactacctgcttcgtctgcgcagcgtgtaaaaagccttttggcaactctctgtttcacatggaagacggcgagccatactgtgaaaaggattatatcaatttgttcagcactaagtgtcacggctgcgactttcccgtggaagcaggagacaagttcatcgaggccctgggccatacatggcacgatacctgtttcatttgtgccgtttgccatgtcaatctggaaggccagcccttctacagcaagaaggatcgaccactgtgtaagaagcacgctcatactatcaatctgtag

SEQ ID NO: 228717 - DNA, 1854 bp, Artificial Sequence
  Description of Artificial Sequence: Synthetic coding sequence
atgtcctattctgtgactcttactggccctggcccttgggggtttcgcctccaaggcggaaaggattttaacatgccgcttacaatcagtaggataacaccaggatcgaaggctgctcagagccaattgagtcagggagacctcgttgtcgctatagacggggtaaacaccgataccatgacccacttagaggcgcagaataagattaaatcagcttcttacaatctgtccttgacgctgcagaaaagcaagagacccattccaatttcaacaaccgccccacccgtgcagactcctctccccgttatacctcaccagaaggtagtggtcaactccccagcgaacgctgactaccaggaacgctttaaccccagcgcgctgaaagacagcgctctttcaactcacaaacccattgaagtgaaggggcttgggggaaaagcgaccatcattcatgctcagtacaatacacctatcagtatgtattcccaggatgccatcatggatgcaatcgcgggacaggctcaggctcagggaagcgacttcagtgggtcacttcccatcaaggatctggcagtggacagtgcatcccccgtctatcaggctgtgataaaatctcagaataagcctgaggacgaggcggatgagtgggccaggaggtcttcaaatcttcagtccaggagctttcgtatcttggctcaaatgactgggaccgaattcatgcaggaccccgacgaagaggccctgcggaggtcccgcccacaagcctcgagctattcccctgccgtagcagcctcatctgcacctgctactcataccagctactcagaggggcctgccgctcccgctccaaaacccagagtagtcactacagccagtatcagaccctctgtgtaccaaccagtccctgcctccacatattccccaagccctggcgcaaattattcgccaaccccttacactccatcccctgcgcctgcctacacaccttcacctgcacctgcctacacccctagccctgttccaacatacactccaagtcccgctcccgcttacaccccaagccctgcccctaactacaaccccgctccatctgtcgcctactccggtgggcctgctgaacctgctagccgccctccgtgggttactgatgactcattcagccaaaaattcgctccgggaaagtctacgactagtatttctaagcagacgttaccacggggaggaccagcctatactcctgctggtccccaggtgccccctctcgctaggggtactgtgcaacgggctgaacggttccctgcctcgagccgaacgcctctgtgtggacattgtaataacgttattcgcggtccattcctggtggccatggggaggagctggcaccccgaggagttcacctgtgcctactgcaaaaccagcctcgcagatgtgtgcttcgtcgaagagcagaataatgtgtactgcgaacgatgttacgagcagttcttcgctccactctgcgccaagtgcaacactaagattatgggcgaagtcatgcacgcccttcgccagacctggcacactacctgcttcgtgtgtgctgcttgcaagaagccttttggcaactcacttttccacatggaggacggggaaccctactgcgagaaagattacatcaacctctttagcacaaaatgtcacgggtgtgattttcccgtcgaagcaggcgataaatttattgaggctcttgggcacacttggcacgatacttgcttcatctgtgccgtatgtcacgttaacctggaggggcagccgttctattcaaagaaagaccggccactctgtaaaaaacacgcgcacactatcaacttgtag

SEQ ID NO: 228718 - DNA, 1947 bp, Artificial Sequence
  Description of Artificial Sequence: Synthetic coding sequence
atgtcttattcagttaccttaactggacccggaccatggggattccgactccagggtggtaaggatttcaatatgccgttgaccatctccagaattacccccggatccaaagccgctcagtctcaactctcccaaggtgatttagtagtcgctatcgacggagtcaatactgacacaatgacccacttggaagctcagaataagatcaagtcagcttcatataatctgtccctgactctgcaaaagagcaaacgcccaatccctatctccaccaccgcccctccagtacagacgcccctgccggtaatcccccatcaaaaggatcccgctttagacaccaatggatcactcgtggcgccaagtccaagccccgaggctagagcgtccccagggactccgggtacccccgagctgcggccaaccttttctccagctttttccagacctagtgctttcagttccctggccgaagcttccgaccccggtccgcctagggcctcacttagagcaaaaacctccccagaaggtgccagagacctccttggccctaaagcactccctggaagcagccaaccacgtcagtacaacaaccccataggcctgtattctgcagaaaccctgcgcgagatggctcagatgtaccaaatgtcgctccgcggtaaggcaagcggcgttggcctccccggtggctctctcccgatcaaagacctggctgtggactccgcctcacctgtctaccaggctgtgatcaagtctcaaaacaagccagaagacgaggccgacgagtgggctcgacggtctagcaacctccagtctaggagtttccgaattttggcccagatgacaggcactgaattcatgcaggacccggacgaagaggccctcaggcggagccgccctcaagcttcatcttatagccctgcggtcgccgcttcaagcgctcccgcaactcatacttcttatagcgaagggcctgctgccccagcaccaaaaccacgcgttgtgacaacagcctcgattagacccagtgtttatcagcccgtccccgctagcacctactcccctagtccaggggcaaattactcaccaaccccgtatacaccctctccagttccaacttatactccctccccagcccctgcctatacccccagtcccgctcccaactacaatcccgcaccatcggttgcttattccggaggccctgccgaacctgcctccaggcccccatgggttaccgacgactcgttcagccagaaattcgctcccggaaaaagtaccacttctatctctaaacagacactcccgcgaggtggaccagcatacactcccgctgggccacaagttccccctctcgcaagagggaccgtccaaagagccgagcgttttcctgcttctagtcggacacccttgtgtgggcattgcaataacgtcatcaggggaccgttcttggtagcaatgggaagatcatggcatcctgaagagttcacatgcgcctattgtaagacaagcttagcagacgtttgcttcgtggaggagcagaataacgtgtactgcgagaggtgctacgagcagttcttcgcccctctctgtgcaaaatgcaataccaagatcatgggagaggtgatgcacgctctgagacagacttggcacactacttgttttgtatgcgctgcgtgcaaaaagcctttcggaaactccttgttccatatggaggacggcgagccatactgtgagaaggattatattaatcttttttctaccaagtgtcacggttgtgatttccctgtcgaggcgggagacaagttcatcgaggccctgggtcatacctggcatgatacgtgcttcatttgtgcagtgtgtcacgtgaacctggaggggcagccattctacagcaaaaaagatagacctctctgcaagaaacacgcccatactataaacctttag

SEQ ID NO: 228719 - DNA, 696 bp, Artificial Sequence
  Description of Artificial Sequence: Synthetic coding sequence
atgagctactcagtgacattgacaggaccgggaccgtgggggtttcgcctccaaggcggaaaagacttcaatatgcctctgactatatctaggatcacaccgggttccaaggctgcacaaagccagctgtcccaaggcgacctggtcgtggctatcgatggcgtgaatactgacactatgacacaccttgaggcacagaacaaaatcaaaagtgcatcttataacctgagtctgactttacagaagtctaagcgccctatccccatttctaccaccgcaccccctgtacagacacccctaccagtgatccctcaccagaaggaccctgcgttggacaccaatggcagtttagtggcccctagcccgagccccgaagctcgggcttcacctgggacgccaggcacccccgagttacgacctacctttagccctgcattttctcgaccttctgcctttagtagtctggctgaagcctccgacccaggcccaccgcgtgcctccctgcgagcaaagacatcccctgagggtgcaagagacctgctggggccaaaagccttgcccggaagctcccaaccgcgtcagtacaataatccgattgggctgtacagtgcagaaactctccgtgaaatggcccagatgtaccagatgtcactccgcggaaaagcttcaggtgttggccttccagggggttggtag

SEQ ID NO: 228720 - DNA, 1839 bp, Artificial Sequence
  Description of Artificial Sequence: Synthetic coding sequence
atgagccatccatcttggctgccaccgaagtcaacaggcgagcccctcgggcatgttcctgccaggatggagacgacccattcgttcgggaacccatccatctccgtgtccacacagcagcctcctaaaaaattcgcgccagtggtcgcacctaagcccaagtacaatccctataagcagcctgggggagagggagactttttgcctccaccaccacctcctctcgacgattcatcagcccttcctagtatttctgggaacttcccacccccaccccctttagacgaggaagccttcaaggtgcagggaaatcccggaggcaagaccttagaggagcgcaggtcatctctggacgcagagatcgactctctgacctccatcttggccgatctggaatgttcctccccctacaagcctcgaccgcctcagtcaagcacaggatctacggccagtccgccagtaagcacccccgttaccggccacaaacggatggtcatcccgaatcagcccccactgaccgctacaaaaaaaagtaccctgaagcctcagcccgcaccccaggcaggacccattcctgtggcccctattggcaccttaaaaccccaacctcagcctgtgccagcctcatacacgacagcgagtacttcttctcgacccacttttaacgtgcaggtgaagagtgcgcaaccatcaccgcattacatggcagcgccatcaagcggacagatttatggttccggaccccagggttacaacacacagccagtaccggtgtcgggacaatgtcctccaccatcaacacgcggaggtatggattacgcttacattcccccaccaggtctccagcctgaacccggatacgggtacgcgcctaatcagggcagatactatgaagggtattatgccgctggtccagggtatggtgggagaaacgacagcgaccctacttacggccagcagggacaccctaacacttggaaaagggagcccggatacacacctccaggcgcagggaatcaaaatccacccggaatgtaccccgtgacaggaccgaagaagacatacattaccgacccagtgtctgcgccttgcgccccaccgttgcagcctaaagggggtcattcagggcagctcggtccaagcagcgtggccccttcgtttaggccagaagacgaattggagcacctgactaaaaagatgctgtacgacatggaaaatcccccagccgacgaatactttggaagatgcgcacgctgcggtgaaaacgtggttggcgaggggaccggctgtaccgccatggatcaggtgttccatgtcgattgtttcacttgcatcatttgtaataataaattacgaggacagccattctacgccgtggaaaaaaaagcttattgcgagccgtgctacattaacacactggaacaatgcaacgtctgttccaagcctattatggaaaggatcctgcgggctacaggtaaagcctatcacccccactgtttcacatgtgtcatgtgccaccgatccctggatgggattccttttacagtggacgccggtggacttatccactgcatagaagatttccacaagaaattcgctcctaggtgctctgtttgtaaagagcctatcatgcccgcacctggccaggaggagaccgtgcggatcgttgctcttgacagggactttcacgttcattgttaccgctgcgaagactgcgggggactcctctctgaaggggacaaccaaggatgttacccacttgacgggcacatcctgtgcaaaacctgcaatagtgcccgaattcgagtacttacagcaaaggcttctactgacttgtag

SEQ ID NO: 228721 - DNA, 282 bp, Artificial Sequence
  Description of Artificial Sequence: Synthetic coding sequence
atgagccacccttcctggctgccacccaagtccaccggcgaacctttggggcacgtacccgctagaatggaaaccacccatagtttcgggaacccaagtatcagtgtgagcacacaacaaccgcctaagaagtttgccccagtcgtagcgcctaagccaaaatacaatccttacaagcagccgggtggggagggggattttctgcctccgccacctcccccattggatgattcgtctgcgctccccagcatctccgggaattttccacctcctcctccatag

SEQ ID NO: 228722 - DNA, 456 bp, Artificial Sequence
  Description of Artificial Sequence: Synthetic coding sequence
atgagccaccccagctggcttccaccaaagtctaccggagagcctctaggtcacgtccctgccagaatggagacaacacatagctttggcaatccctcaatctcggtgtctacacaacaaccacccaaaaaatttgctcctgttgtcgccccaaagcctaagtataatccttataaacagccaggaggcgagggagacttcctcccccctcctcccccacccctggacgactcatccgctctcccatctatttccgggaacttccctcctcctcctcccctcgacgaggaagccttcaaagtgcagggcaaccctggtgggaaaacactggaggaacgccgatcttccctggacgccgaaatcgattctctgacttctatcctggcagacctggaatgttctagtccttataaacctcgtcctccgcagtcgtccaccggtagcacagcatcctag

SEQ ID NO: 228723 - DNA, 336 bp, Artificial Sequence
  Description of Artificial Sequence: Synthetic coding sequence
atgtcccacccctcttggctccctccgaaatcaacaggcgagcctctgggacatgtgccagctcggatggagaccactcattcgtttggcaatccctccatctccgtgagtactcaacagccacccaaaaaattcgcacccgtcgtcgcccctaaacccaagtataatccctacaagcagcccggaggcgagggcgatttcttgcccccaccccctcccccactcgacgatagctctgctctgccgagcatctccggcaacttcccacctcccccacccttggacgaggaagcattcaaggtgcaggggaacccaggagggaaaacacttgaatag

SEQ ID NO: 228724 - DNA, 201 bp, Artificial Sequence
  Description of Artificial Sequence: Synthetic coding sequence
atgtcccatcccagttggctaccacctaagtctactggtgaacctctagggcatgtgccagccaggatggaaactactcacagttttggcaatccctccatttccgtgtcaactcaacagcccccaaagaagttcgctcctgtggtggctcctaaaccaaagtataatccttacaagcagccgggaggagagggcgactag

SEQ ID NO: 228725 - DNA, 162 bp, Artificial Sequence
  Description of Artificial Sequence: Synthetic coding sequence
atgtctcatccatcctggctgccccctaagtccacaggcgaacctctgggacacgtccccgcaagaatggagacaacccattccttcggaaacccgtccattagtgtaagtacccaacagccccctaaaaagtttgcccctgtcgtcgcccctaaaccctag

SEQ ID NO: 228726 - DNA, 144 bp, Artificial Sequence
  Description of Artificial Sequence: Synthetic coding sequence
atgtcccacccaagttggctaccgccaaagagtactggggaaccactcggccacgtcccagctaggatggaaactactcactcctttggcaatccttctatttcagtaagtacccagcaaccccctaagaaattcgccccatag

SEQ ID NO: 228727 - DNA, 1287 bp, Artificial Sequence
  Description of Artificial Sequence: Synthetic coding sequence
atgtctcatccgagctggctccctccaaagagcactggcgaaccactgggacacgtgccggcaagaatggagactacacactccttcggaaaccctagcataagtgtgagtacacaacagccacccaaaaaattcgcacctgtggtggctccaaagcctaagtataacccgtacaagcagcctgggggagagggcgactttctccctccccctcctccccctctggatgactcctcagcccttcctagcatctctggcaactttcccccacctccaccgctggatgaagaggctttcaaggtgcagggcaatccaggaggaaagaccctggaggagcgacggagtagccttgatgccgagattgacagcctcacaagtattctcgccgatctagagtgtagttcaccttataaaccacggccaccccaaagcagcacaggtagtaccgccagccccccagttagtacgccagtcactggccacaaacgcatggtcatccctaaccagcccccacttaccgccaccaagaaatccacgctgaagccccagccagcaccgcaggcgggtccgataccagtcgcccctatagggacactgaagccacaacctcagccagtgcccgcatcctatacaacggcctccactagctccagacctacattcaacgtgcaggtgaaatccgctcagccttccccacactatatggccgcaccatcatccggtcagatctatggttctggcccacaaggatacaacacacaacctgtgcctgtgtctggccagtgccctccaccctcgacaagggggggaatggattatgcatacatcccccctccgggtctacagcccgagccaggctatggctacgcaccaaatcagggacgttattatgaagggtactatgccgctggccctggatatggtggaagaaacgacagtgaccctacttacggccaacaggggcaccccaatacttggaagcgcgagccaggctataccccccctggggctggcaatcagaacccccctggcatgtatcccgttacgggtcccaagaagacctatataacagacccagtttcagccccttgtgcccctcccctgcaacccaagggcggacactcaggccaactaggtccctccagtgttgccccatcctttagaccggaggacgaacttgagcacttaaccaagaagatgctttacgacatggaaaatccacccgctgatgagtactttggagagtggggcctggagctgacgagcgaggttactatactgttgtag

SEQ ID NO: 228728 - DNA, 198 bp, Artificial Sequence
  Description of Artificial Sequence: Synthetic coding sequence
atgtctcatccgagctggctgcctcctaagtcaactggggagcccctgggacacgtgcctgccagaatggagaccacacactccttcggaaatcctagtatttccgtgtcaacccaacagcctccaaagaagttcgccccagtggtcgccccaaaacccaagtataacccctacaagcagccaggaggcgagggatag

SEQ ID NO: 228729 - DNA, 174 bp, Artificial Sequence
  Description of Artificial Sequence: Synthetic coding sequence
atgtctcatccaagttggctgcctccaaagtcaacgggagaacctctgggccatgtccctgcaaggatggagactacacattcgttcgggaacccctctatctctgtaagcacccaacagccaccaaagaaatttgctcctgtggtggcacccaaacccaagtacaatccgtag

SEQ ID NO: 228730 - DNA, 1839 bp, Artificial Sequence
  Description of Artificial Sequence: Synthetic coding sequence
atgagccacccatcgtggcttccccctaaatcaactggggagcctttgggccacgtcccagccagaatggaaaccacacattctttcggcaacccctccatctctgttagcacgcaacagcccccaaagaaattcgctcccgtggttgcacccaagccgaaatataacccgtacaaacagccaggtggggagggcgattttttgccacccccaccaccacccctggacgatagttcagctttacctagtatctcgggcaactttccccctccgccaccactagatgaggaagcgtttaaagtacagggaaatcctgggggaaaaaccttagaagaacgcaggtccagcctcgatgcagagatagactctctgacaagcattctggccgatctggaatgctcatccccttataagcctcgcccaccccagtccagcacaggttcgacagcctccccacccgtgtccacacctgttaccgggcataaacgcatggttattccaaatcagccccctctgacggcgactaagaagtctacactcaaaccccagccagcccctcaggccggacctatccctgtggcgccaattggcactcttaaaccgcagccccagcccgtgcccgctagctacacaacagcctcaacgtccagccgcccaacatttaacgtgcaggtgaagtctgcccaaccatccccccattacatggctgctccctctagcggccagatctacggatctggcccacagggttataatacccagcctgtgccagtctctggacagtgcccacctcccagtacacggggagggatggactatgcttacatcccccctcccggactccagcctgagcccggatacggatacgcacctaatcaaggcagatattatgaaggttattacgccgcaggtccgggatacgggggaagaaacgacagcgaccctacgtatggacagcaggggcacccgaatacgtggaagcgtgagccaggctatacgcccccaggggctggcaaccaaaatccaccaggcatgtacccagtgacgggtcccaagaaaacttacatcaccgaccctgttagtgctccgtgtgcccctccgctgcagcccaagggaggccactccggacagttgggcccatccagtgtagctccttcatttcgccctgaggacgaactggaacatcttaccaagaagatgctctacgacatggagaacccacctgctgatgaatacttcgggaggtgtgcgagatgtggggagaatgttgttggggaaggtacggggtgtacagccatggatcaggtgtttcacgtcgactgtttcacttgtattatatgtaacaacaagctgcggggtcagcccttctatgcggtggagaaaaaggcttactgcgagccttgttatattaatactttggaacaatgcaatgtgtgctctaaacctattatggaacgtatcctgcgtgcaacggggaaggcttaccacccacattgttttacctgtgtcatgtgccaccggagtctcgacggcattccttttactgtggacgcgggtggactgatacattgcatcgaagactttcacaagaaatttgcacccaggtgttcggtgtgcaaagagccgatcatgcctgctcctggccaagaggaaaccgtacggatcgtcgcactcgaccgggactttcatgttcattgttacaggtgcgaagactgtggtggcctgttgtccgagggagacaaccagggctgctatcccctggacggccacatcttatgtaaaacttgcaacagtgcgagaatcagggtgctcacagccaaggcctctactgacctttag

SEQ ID NO: 228731 - DNA, 471 bp, Artificial Sequence
  Description of Artificial Sequence: Synthetic coding sequence
atgcagaagaaggagaaatcatttggcattcagatgttgtctgttcaaccagatacaaagccgaagggctgcgccggatgtaataggaagatcaaagaccgatacttgctcaaggctttggacaaatactggcacgaagactgcctgaaatgcgcctgctgcgattgtcgcttaggggaggtgggttccactctatataccaaggctaacttgattctctgcaggagggactatcttcggctgttcggagtgacggggaattgtgctgcttgcagcaagcttattcccgcttttgaaatggtgatgagggccaaggacaatgtgtaccacctcgattgcttcgcctgtcagttgtgcaaccagaggttttgcgtgggggataagttctttcttaagaataacatgattctgtgtcagaccgattacgaagaggggttaatgaaggaagggtatgcccctcaggtacggtag

SEQ ID NO: 228732 - DNA, 438 bp, Artificial Sequence
  Description of Artificial Sequence: Synthetic coding sequence
atgctatcggtgcaacctgataccaagcctaaagggtgcgcgggttgcaatcggaaaattaaagacaggtacctcctgaaggcgcttgataaatactggcatgaggattgtctcaagtgcgcttgctgtgactgtcggctgggcgaagttgggtctacgctttataccaaggctaatctcattctgtgccgtcgggattacctcaggctctttggcgtcaccggcaattgtgccgcttgctctaagttgatacccgctttcgaaatggttatgagagctaaagacaatgtataccatctcgactgttttgcctgtcagctatgcaaccagcggttctgtgtgggcgacaaattcttcttgaagaacaatatgattctgtgtcagaccgattacgaagagggtctgatgaaagagggctatgctccacaggtgaggtag

SEQ ID NO: 228733 - DNA, 438 bp, Artificial Sequence
  Description of Artificial Sequence: Synthetic coding sequence
atgctgtcagtgcaaccagataccaagcctaaaggctgtgctggctgcaataggaaaattaaagatagatacctgctcaaagcccttgacaagtactggcatgaggattgtctgaagtgtgcttgttgcgattgccgcctgggcgaggtagggtccaccttgtacacgaaggcgaatcttattctatgccgccgagactatctaaggctgtttggcgtcacagggaactgtgcagcctgttccaaattgattccagcatttgaaatggtaatgcgggctaaggacaacgtgtaccacctcgattgtttcgcatgccagctatgcaatcagcgtttctgcgtgggcgataagtttttcctcaaaaacaatatgatcctgtgccagacggactatgaggaaggtctaatgaaagaggggtacgccccacaggttcggtag

SEQ ID NO: 228734 - DNA, 438 bp, Artificial Sequence
  Description of Artificial Sequence: Synthetic coding sequence
atgctgagtgtccagccagacaccaagccaaaggggtgtgcagggtgcaaccggaaaattaaggatcggtatcttctcaaggcgttagacaagtactggcatgaagactgtttgaagtgtgcttgttgtgattgccgcctgggggaagtaggatccactctgtatacaaaggctaatctgatactgtgccgaagagactacttgcggcttttcggcgttacaggaaattgcgccgcatgcagcaaactgatccctgccttcgaaatggtaatgagagccaaggacaacgtctatcatttggattgcttcgcttgtcagctgtgcaaccaacgattctgcgtgggcgacaaattttttctcaaaaacaatatgatactctgtcaaactgactacgaagagggccttatgaaggagggttacgcaccccaagtgaggtag

SEQ ID NO: 228735 - DNA, 438 bp, Artificial Sequence
  Description of Artificial Sequence: Synthetic coding sequence
atgcttagcgtgcagcccgacacaaaacctaagggctgtgcaggctgtaacagaaagatcaaggacagatatctgctgaaagcactggataagtactggcatgaagattgtctgaaatgcgcctgttgcgattgccgactgggcgaggtgggctctaccctctataccaaggctaatctgattttatgccgccgagactacctgcgcctgtttggggtaaccggaaactgcgccgcttgctctaaactgatacccgctttcgaaatggttatgagagccaaggacaacgtttaccacctagattgttttgcatgtcaactgtgcaaccaacggttctgcgtgggagacaaattctttttaaagaacaatatgattctctgccaaacagattacgaggagggactgatgaaagaaggctatgccccacaagtcagatag

SEQ ID NO: 228736 - DNA, 438 bp, Artificial Sequence
  Description of Artificial Sequence: Synthetic coding sequence
atgctgagtgtgcaacccgacacaaagccaaaggggtgcgcaggatgtaaccgcaaaatcaaagatcgctacttactgaaggcactcgacaagtactggcacgaggattgtttgaagtgcgcttgctgtgattgtcgtctgggagaggtaggatctaccttatataccaaggcgaatcttattctgtgtaggagagattatctccgcctgtttggcgtgacggggaactgcgcggcttgttcgaaactcattcccgctttcgaaatggtgatgcgggcaaaagataacgtgtaccacttagattgcttcgcttgtcagctgtgcaaccagaggttttgcgtgggagacaaattctttctaaagaataatatgattttgtgccagaccgactacgaggaaggtctgatgaaggagggttacgctccccaggtgagatag

SEQ ID NO: 228737 - DNA, 438 bp, Artificial Sequence
  Description of Artificial Sequence: Synthetic coding sequence
atgctgtctgtgcagcctgataccaagccgaagggctgcgcaggatgcaaccggaaaataaaggaccgctacctgctaaaggctctagacaagtattggcacgaggactgcctgaagtgcgcatgttgtgattgtagactcggtgaagttggatctacattatatactaaagctaacctaatactgtgccgacgagactatctccgcctgtttggcgtaacaggtaattgcgcagcgtgttcaaaactgatccctgcattcgagatggtgatgcgagcaaaagacaacgtgtaccatctggactgcttcgcgtgccagctgtgcaatcaaaggttctgcgtcggcgataagttctttctcaagaacaatatgattctgtgtcaaaccgactacgaggagggcttgatgaaagaaggatatgcaccccaggtgcgctag

SEQ ID NO: 228738 - DNA, 438 bp, Artificial Sequence
  Description of Artificial Sequence: Synthetic coding sequence
atgttgtccgtgcaacctgatacaaagcccaaaggttgtgcaggctgcaaccgaaaaattaaagatcgctatctattaaaggcactagataagtactggcacgaagattgcctgaagtgcgcttgctgcgactgtagactgggcgaagtggggagcacgctgtacactaaggccaacctgatactgtgccggcgagactatctcaggctcttcggtgttaccggaaattgtgccgcatgctccaaactgatacctgcctttgaaatggtaatgcgggctaaggataatgtctatcatctagactgtttcgcatgccagctgtgcaatcaacgattctgtgttggggataaattcttcctcaagaacaacatgatcctgtgccagaccgactatgaggagggactgatgaaggagggctatgccccacaagtgcgctag

SEQ ID NO: 228739 - DNA, 357 bp, Artificial Sequence
  Description of Artificial Sequence: Synthetic coding sequence
atgttatccgtgcagcctgatactaagcctaaaggctgcgcgggatgcaatcggaagatcaaagatcgatatttactcaaggcgctggacaagtattggcatgaagattgtttgaagtgtgcctgctgtgactgtcgccttggagaggtgggctcgactctctacactaaagccaacctgatcctgtgccggagagattacctccgactgtttggcgtgaccggtaattgtgctgcatgtagcaagttaatccctgccttcgagatggtgatgagggcaaaagataacgtttaccacctcgattgtttcgcttgtcagctatgcaaccagaggttctgtgttggagacaagttttag

SEQ ID NO: 228740 - DNA, 177 bp, Artificial Sequence
  Description of Artificial Sequence: Synthetic coding sequence
atgctttccgtgcaaccagacacaaaaccaaaggggtgtgcgggttgcaacaggaagatcaaggaccggtacctattaaaagcattggataagtattggcacgaggactgccttaagtgcgcatgttgtgactgtcgcctgggtgaagtggggtccactttgtacacaaaggcctag

SEQ ID NO: 228741 - DNA, 294 bp, Artificial Sequence
  Description of Artificial Sequence: Synthetic coding sequence
atgctgagcgtccagccggataccaagcctaagggctgcgccggatgtaacaggaagatcaaggatagatatcttttgaaggcacttgacaagtattggcatgaggattgtctcaagtgcgcttgttgtgactgccgtcttggcgaggtgggatctacgctgtatacaaaagcgaatttaatactgtgtagaagggattatctaagactgttcggagtcacaggaaattgtgctgcatgctccaagctcattcctgctttcgaaatggtgatgagggccaaggacaatgtctag

SEQ ID NO: 228742 - DNA, 357 bp, Artificial Sequence
  Description of Artificial Sequence: Synthetic coding sequence
atgctgtcagttcagccagataccaagcccaagggctgcgctggatgcaataggaaaattaaggatcgatacctccttaaggccttggacaaatactggcatgaggattgcctgaaatgtgcctgttgtgactgtaggctgggggaggtgggttctaccctgtacacaaaggccaacttgattctatgtaggagggattacttgcggttattcggagtaaccggaaactgcgcagcctgtagcaagttaatcccggcatttgagatggtcatgagggccaaggacaatgtatatcacctggattgcttcgcatgtcaactctgcaatcagagattttgcgttggagacaagttctag

SEQ ID NO: 228743 - DNA, 255 bp, Artificial Sequence
  Description of Artificial Sequence: Synthetic coding sequence
atgctgtccgttcagcctgatacgaagcccaaaggctgtgccggatgtaacaggaaaatcaaggaccggtatctcctgaaagccctggacaagtattggcacgaggactgtcttaaatgcgcatgttgtgactgccggctaggggaagtaggcagcaccctctatactaaggccaacttgattctgtgtaggcgagactatctgcgtcttttcggagtgacaggtaactgtgctgcttgttctaaattaatctag

SEQ ID NO: 228744 - DNA, 438 bp, Artificial Sequence
  Description of Artificial Sequence: Synthetic coding sequence
atgctgtccgtccagcccgataccaagccaaaaggctgcgccggatgcaatagaaaaattaaggaccgttacctcctgaaggcactggacaagtattggcacgaagattgcctgaaatgtgcgtgttgcgattgccggctcggggaagttggatcgaccttatacacgaaagctaacctgatcttgtgtcggagagattatctacggctatttggagtaaccggtaattgtgctgcatgttctaaattgattcctgcctttgagatggtgatgcgagccaaggacaacgtgtaccacctggactgttttgcatgtcagctgtgcaatcagcgattctgcgtgggcgacaagttcttcttgaaaaacaatatgatactttgccagaccgattatgaagaggggctgatgaaagaggggtacgcacctcaggtgcggtag

SEQ ID NO: 228745 - DNA, 492 bp, Artificial Sequence
  Description of Artificial Sequence: Synthetic coding sequence
atgcttatggagggcggacgcgcagcagcagcccgtaacgtctcaagtatccagatgctgagtgtgcaaccagacacgaagcccaagggctgtgccggatgtaaccggaagatcaaggataggtacctattgaaagcgctcgacaagtactggcacgaagactgtctgaagtgcgcctgttgcgattgccgtctgggcgaagtgggctcaaccctctacaccaaagccaatctgatcctgtgtagacgcgattatctgcggctgttcggggtgaccgggaactgcgctgcctgctccaagcttatcccggctttcgagatggtgatgagggcaaaagataacgtgtatcacctcgattgcttcgcttgccaattatgtaatcagcgcttctgcgtgggcgacaagttcttcctcaaaaacaacatgatcctctgccagaccgactatgaagaggggcttatgaaagaaggctatgctccccaggtccgatag

SEQ ID NO: 228746 - DNA, 438 bp, Artificial Sequence
  Description of Artificial Sequence: Synthetic coding sequence
atgctgagcgtccaaccggacacaaagccaaagggatgtgcaggatgcaaccggaaaatcaaggaccgatacttgctgaaggccctggacaagtattggcacgaggactgcctgaagtgcgcatgctgtgactgtaggcttggggaggtcgggtcgaccctctacaccaaagcaaatctgatcctgtgccgccgtgattacctcaggctgttcggcgtgaccggtaattgcgcagcatgctcaaaattaattcctgccttcgagatggtgatgcgggctaaggataacgtgtaccaccttgactgtttcgcttgtcagctttgcaaccaacgcttttgcgtcggcgacaaatttttcttgaaaaacaacatgattctgtgccaaacggactatgaggagggcttaatgaaagagggctatgctccacaggtcaggtag

SEQ ID NO: 228747 - DNA, 378 bp, Artificial Sequence
  Description of Artificial Sequence: Synthetic coding sequence
atgcttagtgtgcagccggacaccaagccaaaggggtgtgctggctgcaaccgcaagattaaggacagatatttattaaaagcattagacaagtactggcatgaagactgtctgaagtgcgcgtgctgcgattgtaggtgggaaaggctgtttggcgtaaccgggaattgtgcagcttgctccaagttaattccagcattcgagatggtgatgcgggctaaggacaacgtttaccatctagactgcttcgcttgccagctgtgcaaccagagattctgtgttggagataagttctttctcaagaacaatatgatcctctgccagactgattatgaggaagggctaatgaaggagggttacgctccgcaggttcgttag

SEQ ID NO: 228748 - DNA, 267 bp, Artificial Sequence
  Description of Artificial Sequence: Synthetic coding sequence
atgttgtcagtccagcccgatacaaagccaaaagggtgcgcgggatgtaacaggaagataaaagatagatacctgctgaaggcactcgacaaatattggcacgaagattgtcttaagtgtgcctgttgtgattgtaggttgggagaggtgggctctactctgtatactaaagcgaatctgatactgtgtcgtcgggactatctgcgattattcggggtgactgggaactgtgctgcatgtagcaaattaatacctgcttttgaatag

SEQ ID NO: 228749 - DNA, 333 bp, Artificial Sequence
  Description of Artificial Sequence: Synthetic coding sequence
atgctatcagtgcagcctgatacgaagcctaaaggatgcgcaggctgtaatcggaagatcaaagacaggtacctcctgaaggccctggataaatactggcacgaggattgcctgaagtgcgcatgctgtgactgtaggcttggtgaggtgggatccactctttacacgaaagccaatctgattttgtgccgtcgcgattacctcagacttttcggggtgaccggtaactgtgcagcgtgctctaaacttatcccagccttcgagatggttatgcgcgctaaggacaacgtctaccacttggattgtttcgcttgccagttgtgtaatcagtag

SEQ ID NO: 228750 - DNA, 357 bp, Artificial Sequence
  Description of Artificial Sequence: Synthetic coding sequence
atgcttagcgtgcagcctgatacaaagccaaaaggatgtgccggttgcaataggaaaattaaggataggtatctcctgaaagctttagacaagtattggcacgaggattgcctcaagtgcgcctgttgtgattgcagattgggcgaggttggctctaccctctatacgaaggctaacctgatcctatgtagaagagactacctgcgcctcttcggagtgaccggcaattgtgcagcttgctccaagcttattcccgcttttgagatggtgatgagggccaaggacaacgtgtatcatctcgactgctttgcatgccaactttgtaaccagcggttctgcgttggagataagttttag

SEQ ID NO: 228751 - DNA, 498 bp, Artificial Sequence
  Description of Artificial Sequence: Synthetic coding sequence
atggttaatccaggatcttcctcccaaccccctccggtgactgctggttctttaagctggaagagatgcgcaggctgcggcggtaagatcgctgaccggttcttgctatacgccatggattcttactggcactcccgctgtctgaaatgctcgtgttgccaagcacagctgggggacatcggtacatcttgctataccaaatccgggatgatcctctgccggaacgattacattagactgttcggcaactccggcgcatgttccgcctgcgggcagtctattcctgcctccgagctcgtgatgcgcgctcagggaaatgtgtatcacttaaaatgtttcacatgctccacctgtcgaaatcgcttagtgcccggtgaccgcttccactacatcaatgggagtctgttctgtgaacatgatagacccactgccctgataaacggccacctgaattcactgcagtccaacccactgctgccagaccaaaaggtgtgctag

SEQ ID NO: 228752 - DNA, 498 bp, Artificial Sequence
  Description of Artificial Sequence: Synthetic coding sequence
atggtgaatcctggctcatcaagtcaaccgccaccagtcaccgctggcagccttagttggaagcgctgcgcgggatgtggcggaaaaatcgctgaccgctttctgctctacgccatggactcttactggcactccagatgtttaaagtgtagctgttgccaggcccagctcggcgatattgggactagttgttataccaagagcgggatgatcctgtgccgcaacgactatatccgtctttttggcaactcaggtgcctgcagtgcctgcggccagagcatcccagccagcgaactcgttatgcgggctcagggaaacgtgtatcatttgaaatgcttcacctgtagtacctgccgcaacagactggtgccaggcgacagatttcattatatcaacggatcgctgttttgtgagcatgaccgtccaacagcactgatcaatggccacctcaattcgctgcaaagtaacccccttttaccggatcagaaggtgtgctag

SEQ ID NO: 228753 - DNA, 2031 bp, Artificial Sequence
  Description of Artificial Sequence: Synthetic coding sequence
atggacaaatatgacgacctgggtcttgaggcttctaagttcattgaagaccttaacatgtatgaagcaagcaaggacggactgttccgtgtcgataagggcgctggcaataatcccgagtttgaagaaactcgcagagtgttcgcaacaaagatggctaaaattcacctgcagcagcagcaacagcagcttctccaggaggaaactctgccaaggggatcccgcggtccagtcaatgggggaggacggctgggccctcaggcaaggtgggaggtggtaggatctaaactcactgtggatggagcggctaaacccccattggccgcatccaccggagcaccaggggcagtgaccacgcttgccgctggtcagccaccctatcccccacaagagcagcggtccagaccttacctgcacggaacccgacacgggtcccaagattgtggatcgagagaaagtctcgcgacaagcgagatgagcgctttccaccagccaggcccatgcgaggacccctcatgcctgacgcacggtgactattatgacaacctctccctagctagccctaagtggggcgacaagccgggagtctctccctcaatagggctatctgtagggtcaggatggccgagtagtcccggaagtgacccaccactcccaaaaccatgcggagatcacccactcaaccaccggcagttgagtctgagcagctctcgctctagcgagggaagcttaggtggccagaatagcggtatcggcggacgaagctcagaaaagcctacgggactttggagtaccgcaagtagtcaaagggtcagccccggattgccttcccccaatttagagaacggtgccccagccgttggacctgtgcaaccccgtactcctagtgtgagtgcaccactggccctcagttgtcctcgccagggaggacttccaagaagcaattccggattgggcggtgaagtctccggagtcatgtccaaacctaatgtggatccgcagccatggtttcaagacggccctaagtcttacctgagctcctctgctccttcgtcttctccagcgggattggatgggagtcagcagggagccgtgccgggtcttggtcctaaaccgggatgcactgatctgggtacgggccctaagctctcgcccacttcattggtacaccctgtaatgtcaaccctccccgaactgtcttgtaaggaaggccctctcggatggagcagtgacggcagcctgggcagcgtcctgctggacagtcccagctctccgagggtccgtctcccgtgtcagccattggttcccggaccggagctgcgaccatctgctgccgaacttaaactggaagccctgacacaaaggttggaaagagaaatggacgcgcaccctaaggccgactatttcggagcctgtgtcaagtgctccaagggggtcttcggggctggccaagcttgccaagccatgggcaacttataccatgacacatgtttcacatgcgccgcttgtagcaggaagcttcgaggaaaagctttctactttgtgaacggtaaggtgttctgcgaggaagattttctgtattccggttttcagcaaagcgcagatcggtgttttttatgtggccatctcattatggacatgatactacaggctctgggtaagtcttatcacccaggttgtttcaggtgcgttatctgcaacgaatgtcttgacggggtaccattcactgtcgattctgaaaataagatctactgtgtgagggactatcataaggtactggcccctaagtgcgccgcttgtgggcttcctattctccctccagagggcagcgatgaaaccatacgggtggtttccatggacagggattatcacgtggagtgttaccattgcgaggactgcgggctcgagctcaatgacgaggatgggcatagatgttatccccttgaagatcaccttttttgtcactcctgccacgttaagagactcgagaaaagacccagtagtactgccctgcaccagcaccacttctag

SEQ ID NO: 228754 - DNA, 1221 bp, Artificial Sequence
  Description of Artificial Sequence: Synthetic coding sequence
atggtccactgcgccggttgtaagagaccgatactggaccggttccttttgaacgtcctggatcgcgcatggcatgtgaaatgcgtgcaatgttgcgagtgtaagtgtaacctcactgagaaatgtttctcccgagaaggtaagctttactgcaaaaatgacttttttaggtgctttggaactaagtgcgccggttgcgcacagggaatcagtccttctgatctggtgcgcagagcacgctctaaagtgttccatctcaactgtttcacctgcatgatgtgcaataagcagctgtcaaccggggaggagctgtacatcatcgacgagaacaaatttgtatgcaaggaggattatcttagtaactcaagtgttgccaaagaaaactctctccattcagcaactacaggcagtgacccctctctgagcccagactctcaggacccctcacaagatgacgcgaaagactccgaatctgctaacgtaagtgacaaggaggccggaagtaatgagaacgatgatcagaacttgggcgctaagcggcgtggcccaaggacaacaattaaggccaagcagctagagaccctcaaggccgcatttgcagcaaccccaaagccaactagacatatacgagagcagctggcccaagagactggcttgaatatgagagtgattcaagtttggtttcagaacaggagaagcaaggaaaggcggatgaagcagctgtccgctctgggcgcacgtcgacatgcttttttccggagtccaaggcgaatgcgcccactggttgaccggctggaaccaggcgagctcattccaaatgggcctttctctttttatggagattaccagtctgagtactacgggccaggcggtaattatgacttcttccctcaagggcctccttcatcccaggcgcaaacacccgtggatctaccatttgtaccttcatctgggccatcaggcaccccactcgggggtctggagcatcctctccccggtcaccatccatcctcagaggctcagagattcaccgatatcctcgctcacccacccggagactctccctcccccgagccgagcttgccgggtcctctccactccatgagtgccgaggtctttggcccaagtcccccattttcaagtctttcagtaaatggcggtgcctcatacgggaaccacctctctcatcctcccgagatgaacgaagcagccgtctggtag

SEQ ID NO: 228755 - DNA, 1221 bp, Artificial Sequence
  Description of Artificial Sequence: Synthetic coding sequence
atgcttttccattccctctctgggcctgaggtacacggcgtgatcgatgagatggatcggcgtgcaaagtctgaggctcccgctatatcttctgcaatcgacaggggcgataccgaaacaaccatgccgtcaatatcatctgatcgcgcagctttatgcgctgggtgtgggggtaagatctccgatcggtactacctgctcgctgtagacaagcagtggcacatgaggtgcctgaaatgctgcgagtgcaaactgaacttggagtcggagctgacttgtttctcaaaagatggctctatatactgcaaggaggattactatcggaggttctcggtgcagcggtgtgctagatgccacctcggaatctcagcctccgagatggttatgagagccagagacctagtttaccatcttaattgttttacctgcactacatgcaacaaaatgctcacaacaggcgaccatttcggcatgaaagatagccttgtgtattgtaggctgcactttgaggcgttgctgcaaggcgagtatccagctcactttaatcacgcagatgtcgctgccgctgcagctgccgcagcggcagctaagagtgccggactgggggcagctggggctaacccactgggtttgccgtattataacggagtgggaacggtccaaaaaggtcgcccacggaagcgcaagagccctggccctggagcagatctcgccgcttacaacgcagctctgagctgcaatgagaatgacgcagagcacttggaccgggaccagccctacccatcttctcaaaagacaaagcggatgcgcacgagtttcaaacatcaccagcttcgcacaatgaagtcatattttgctataaaccacaaccccgatgcaaaagatctcaagcagctcgcacagaaaaccgggctcactaaaagagtcctgcaggtctggtttcagaatgcaagggccaaatttcggcgtaacctgctacgtcaagaaaataccggggtggataaatcaacagacgccgctcttcagacagggacgccgagtggccctgcctccgagctcagcaatgctagcctgagcccttccagcacaccaaccacacttaccgatctgacatccccaactctgcccaccgttacctccgtgcttacctcagtaccagggaacctggagggacacgagcctcacagtccaagccagaccactctgaccaatctgttttag

SEQ ID NO: 228756 - DNA, 1194 bp, Artificial Sequence
  Description of Artificial Sequence: Synthetic coding sequence
atggaggccaggggtgagctcggacccgctcgagaaagcgctgggggagaccttttactcgcactactggcacggcgagcggatctccgcagggaaataccactgtgcgcaggctgtgatcagcacattctcgataggttcattctgaaggccactgccaccggcacggcctccgtgagttcagcagccacagctacccctcttgccgaacggtgtttttccaggggggagagcgtctattgcaaagatgatttctttaagagatttggaacaaagtgtgccgcatgtcagctgggcatacctcccactcaagtggttagacgggcacaggactttgtttaccatctgcattgtttcgcttgtgtggtgtgcaaaaggcagcttgcgacgggcgacgagttctatctgatggaggactctcgactggtatgtaaagcagattatgagactgctaagcagcgtgaggccgaagcaactgctaaaagacccagaactaccatcaccgctaaacagctcgaaactctcaagtcagcgtataacacatctccaaaacctgcgaggcatgtgagagaacaattatcttctgaaacggggctggacatgcgggtcgtacaagtgtggtttcagaatcgcagggcaaaggaaaagcgcctgaaaaaggacgccggaagacagaggtggggacagtattttaggaatatgaagcgctccaggggaggatcaaaaagtgacaaggattcggtgcaggaggggcaagactccgatgccgaagtgtctttcccagtaagcctgccctggcgcaaatgggcccgacctatggcaagtaccggcgcttggggacaccccggactgggccctgccctggggtcacccggtcagctgcttcccggtgcatggaggcccggacggccaagagcagtgccaagagctgcatccagacaaccactgcggtgtccccctatcccccgaagaccagccgaaccgccttggcccccactcctgtcttcacttgtctatcctgacacgtctctgggcttagtaccttccggagcaccagggggtcctccaccaatgcgggtgctggcaggaaatggtccctcttctgacttatccaccggtagctccgggggataccccgattttcccgcaagcccggctagctggctggacgaagtcgaccatgcccagttctag

SEQ ID NO: 228757 - DNA, 1209 bp, Artificial Sequence
  Description of Artificial Sequence: Synthetic coding sequence
atggaagctagaggcgaactgggccctgccagggaatccgcaggcggtgatctgcttcttgcgctgctggcacgcagagccgacttaagaagggaaatacccctctgcgccggatgcgaccagcatatactggatagatttattctcaaggcactggaccgtcactggcacagtaaatgcctcaagtgctccgactgtcacacacctcttgcggaaaggtgtttttctcgcggtgaatcagtgtactgcaaagacgattttttcaaacgcttcggaacgaagtgcgccgcatgccaactgggtattccgccaactcaagtcgtgagaagggcccaagactttgtctatcatctgcattgcttcgcttgcgtcgtgtgcaaaaggcagcttgccaccggtgacgagttctacctcatggaggactcgaggttggtgtgcaaggccgactatgaaacagctaaacagcgggaggccgaagcaaccgcaaagcgaccacgtaccaccattacggctaagcagctggaaactctcaaaagtgcctataataccagcccaaagccagcaagacatgtacgggagcagttgagcagtgagactgggctggatatgcgtgtggtgcaggtgtggtttcagaaccgccgagctaaggagaaacgactgaaaaaggatgccggaaggcagagatgggggcagtacttcagaaatatgaaaagaagccgcggtgggagtaagagcgataaggacagtgtgcaagagggccaagattccgacgcagaggtgtccttcccggacgagcccagtctggcagaaatgggtcccgcaaacggcttgtatggctcattaggcgagcccactcaggccctcggccgaccctccggggcactcgggaacttctctcttgaacatggaggattggcaggtcctgagcagtacagggaactgcgccctggatcaccctatggcgtcccaccctctcccgcagcccctcaatctctaccagggcctcagccgctcctgtcatcgctggtgtatccagatacttccctcggactagtgccttctggcgctcctggaggtcctccaccaatgcgggtactagccggaaatggcccatctagcgatctctcgaccggctcctctggcggatatcctgactttccagcctcccctgccagttggctcgacgaggtagatcacgctcagttctag

SEQ ID NO: 228758 - DNA, 1194 bp, Artificial Sequence
  Description of Artificial Sequence: Synthetic coding sequence
atgttactggaaacagggttagaacgcgacagagcccgacctggcgctgcggctgtctgcaccctgggaggaacaagggaaatccccctgtgcgctggatgcgaccaacacatattagaccgttttattcttaaagcgctcgatagacattggcacagtaaatgccttaagtgcagcgactgccataccccgctggcagagcggtgtttcagtagaggtgaatcagtgtattgtaaagatgatttcttcaaacgattcggtaccaaatgtgccgcttgccagctgggcattccacctacgcaggtcgttagacgcgcacaggattttgtttatcacctccattgttttgcatgtgtggtgtgtaagcgccagctggctacaggtgatgagttttatctcatggaggactcccgtctggtctgcaaagctgattacgagaccgccaaacagcgagaagccgaagcaaccgccaagcggccacgaacaacaatcaccgcgaagcagctggaaactttaaaaagcgcgtataacaccagtcccaagcccgcaagacatgtgcgagagcaattaagcagcgaaactggcctcgatatgagggtagtacaagtgtggttccagaacagaagagccaaagagaaacggcttaagaaggatgccggacgccagaggtggggccaatacttccggaatatgaaacggagccgcggaggcagcaagtctgacaaggactcagtccaagaggggcaggacagtgacgcagaggtcagcttcccagatgagccaagtctggctgaaatgggtcccgctaatggcctgtatggcagtctcggcgagccgacacaggctctgggtaggccatccggcgctctgggaaactttagtcttgaacatggcggactagccggacctgagcaatacagggagctcaggcctggctccccatacggtgtgccaccctctccagccgcaccacaaagcctcccgggacctcagccactgctgagttcactagtgtatccagatacctcactgggcttagtaccttctggcgcacctggtggaccacctcctatgcgtgtcttagctggcaacggtccttcctccgatctgtctaccggctcctccgggggataccctgatttccccgctagtccagcgtcttggcttgacgaagtcgaccatgcccaattctag

SEQ ID NO: 228759 - DNA, 1173 bp, Artificial Sequence
  Description of Artificial Sequence: Synthetic coding sequence
atgatgcagtcagccactgtgcccgctgagggggcagtaaagggattaccagagatgctgggggtccccatgcaacagataccccagtgtgccggatgcaaccagcatattcttgacaagttcattttgaaggtcttagacagacactggcattccagttgcctcaaatgcgctgattgccaaatgcagctcgcagatcgatgtttttcaagagcaggcagtgtgtactgtaaagaagatttcttcaaaagatttgggaccaagtgtactgcctgccagcagggtatcccccctacacaggtggtgcggaaagcccaggactttgtgtatcaccttcactgcttcgcctgcatcatttgtaatagacagcttgccaccggagatgagttctatctgatggaggacgggcgactggtctgtaaagaggattacgaaacagccaagcagaatgatgacagcgaagcgggtgctaagagacctcgcacaaccattacagctaagcagctcgagacactcaaaaatgcctataaaaactctcccaaaccggcaaggcacgttcgagaacagctctcaagtgagactggtctggatatgagggtcgttcaggtgtggttccaaaataggagagcaaaggaaaagcgactgaaaaaggacgctggccgacatcgatgggggcaattttataagagcgttaaacgcagccggggatctagcaaacaagagaaggaatcgtcggccgaggattgcggggtgtctgatagcgaactgtcctttagagaggatcaaattctgagcgagctgggtcataccaacaggatttacgggaatgtaggcgatgtgaccggcggacagctaatgaacggctcattctctatggacggcacaggacagtcatatcaggacctgcgggacggctcgccatacggaatcccacagtccccatctagcatctcaagcctgccaagtcacgctccgctgcttaacgggctggactatacggttgacagcaatctgggtatcatcgcccacgccggtcagggcgtctcccaaaccctcagagctatggccggaggccctacctcagatatcagtacaggatcgagtgtcggatatcccgactttcccacctctcctggctcatggctggatgagatggaccaccctccattttag

SEQ ID NO: 228760 - DNA, 1209 bp, Artificial Sequence
  Description of Artificial Sequence: Synthetic coding sequence
atgatggtccactgtgccggatgcgagcggcctatccttgacaggttcctgctgaacgttctcgatagagcctggcacattaagtgcgtgcagtgctgcgaatgcaagactaatttgagcgagaagtgtttctctcgcgagggcaagctgtattgcaagaatgacttctttcgcagattcgggactaaatgcgccggttgtgcccaggggatatcaccatctgacctagtgcggaaagcgagatctaaagtctttcacctgaactgttttacatgtatggtgtgtaacaagcagctctccaccggcgaagaattgtacgtcatagacgaaaacaagttcgtctgtaaggacgactacctgtcatcatcatcactgaaggagggtagtctgaacagtgtgtcatcctgtaccgaccgtagtctgagcccggatctgcaggacgccctccaagatgaccccaaggaaactgataattcaacttcctcagataaagaaactgctaacaatgagaacgaggaacagaactccggcaccaaaaggcgaggccctcggaccacaatcaaggctaagcagcttgagaccctgaaggccgctttcgcagctacccccaagcccactcgacacatcagagagcagctcgcacaagagactggcttgaatatgcgagtgattcaggtgtggttccagaatcgcagaagcaaggaacgccgaatgaaacagttgtctgccctcggtgcgagaaggcatgccttttttcggagcccccgtcgcatgcgtcccctcgggggacggttggacgaatctgaaatgctgggaagcaccccatacacttattacggggactatcagggggactattacgcacctgggagcaactatgacttcttcgcccatggacccccatcccaagcacagagtccagccgatagctcttttttagcagcctccggtccagggtctacccctctgggtgctctcgagcctccgctggctggacctcatgctgccgacaatcccagattcacagacatgatctcgcatcctgatacaccttcccccgagccaggtctacctggcaccctgcaccccatgccaggggaagtgttcagcggagggcctagtccacccttcccgatgtccggaactagtgggtacagcggcccactctcacacccaaaccctgaactaaatgaagctgcagtgtggtag

SEQ ID NO: 228761 - DNA, 1071 bp, Artificial Sequence
  Description of Artificial Sequence: Synthetic coding sequence
atgcaaattctgtccaggtgccaaggcctcatgtcagaggagtgtggcagaactaccgcgttggcagctgggagaacccgtaagggagcaggcgaagaaggattggtgagccctgaaggcgctggtgatgaggacagctgtagctcgtctgcccctctttcaccgagctccagtcccaggagtatggcctccggttcaggctgtcccccaggaaagtgtgtgtgtaactcatgcggcctggaaatcgtcgacaaatacctattgaaggtgaacgacttatgttggcacgtcagatgcctaagctgcagcgtatgcaggacaagcctcggaagacatactagctgttacatcaaagataaggatattttttgcaagctcgactactttcgtcgatacggcactagatgctcacgatgtggcagacacatacattctactgactgggtcaggcgcgcaaagggcaatgtctatcatctggcttgttttgcttgcttttcttgtaaaaggcagttgtctacgggggaagaatttgcgctggtagaggagaaagtcttgtgcagagtgcattacgactgtatgctggacaacttgaagagagaagtcgagaatgggaacggaatatctgtcgaaggcgctctgctaaccgagcaggacgtgaaccatcccaaacctgccaagagagccaggacgtcctttacagccgaccaattgcaagtgatgcaggcccagtttgctcaggacaataaccctgacgcccagacgcttcagaagttggctgagcgcacgggactctccaggcgtgtgattcaagtgtggttccagaactgccgggctagacataagaagcacgtctcacctaaccactcatccagtacgcctgttaccgcagtgcccccatctcgtctgtccccacctatgctggaggaaatggcctattccgcatacgtacctcaagatgggactatgctgaccgccctgcatagctatatggacgcccacagccccacaactctgggcctccagccactgttgccgcactccatgacacagcttccaatcagccacacatag

SEQ ID NO: 228762 - DNA, 1041 bp, Artificial Sequence
  Description of Artificial Sequence: Synthetic coding sequence
atgtcagaggaatgtggcagaactactgcactggccgcaggcaggaccaggaaaggagcgggagaggagggtcttgtaagccccgagggcgctggtgacgaagactcttgctcaagctccgcccctctttcaccctctagttctcccaggtccatggcttcaggatccggttgccctcccggaaagtgcgtgtgtaattcgtgcggtctcgaaatagtggacaagtatctgctgaaggtaaatgacctatgctggcatgtgagatgtctttcttgtagtgtgtgtcggacatccctgggacgccacacatcatgctacattaaggacaaggacatcttttgtaaactggattatttccgcagatacggaacacgctgctctcgctgcggaaggcacattcacagtactgattgggtccgacgggctaaagggaatgtctaccatcttgcctgcttcgcttgcttttcatgcaagaggcagctgtccactggcgaggaattcgcgcttgtcgaagaaaaggtgctgtgccgggtgcactacgactgtatgttagataaccttaagcgggaggtcgagaacggcaacggcatcagtgtggagggagcgctcctgaccgagcaggatgtcaatcaccccaaacccgcaaaacgcgctcggaccagtttcaccgcggatcagctgcaggttatgcaggctcaattcgcccaggataacaaccccgatgcacagaccctgcaaaaacttgcggaacggactggtctgtcccggcgagtaatacaagtttggttccagaactgtcgagccagacacaagaaacatgtttcgcccaaccacagctcaagcactcctgtaacagccgtccctccgtctcgacttagcccaccaatgctcgaggagatggcttactccgcctacgtcccacaggatgggaccatgctgacagctttgcattcgtatatggatgctcactctccaacaacgctgggtctgcagccactcctccctcactctatgactcagttaccaatcagccacacttag

SEQ ID NO: 228763 - DNA, 1194 bp, Artificial Sequence
  Description of Artificial Sequence: Synthetic coding sequence
atggagatcgtgggatgtcgggctgaggacaattcatgcccattccgcccaccagccatgctgttccatggcatttccggagggcacattcagggcatcatggaagaaatggagaggcgaagcaagacagaagccagactggcaaagggggctcagctgaatgggagggacgctggtatgccccctctgtccccagaaaagcccgcactctgcgcaggctgcggtgggaaaatctcagatcggtattatctgttggccgtcgacaaacaatggcacctgagatgtctgaaatgctgcgagtgcaagctcgccctggagtcggagctgacctgcttcgcaaaggatggctcaatttactgtaaagaggactactatcgacggttctctgtacaacggtgcgctcggtgtcatttaggaatcagtgcctccgagatggtaatgcgagctcgggacagtgtctaccacctctcatgctttacctgcagtacgtgtaataagaccttaaccaccggtgatcactttggtatgaaagactctctggtgtactgtcgcgcacattttgagacccttctgcaaggggaatacccaccacagcttagctacactgagcttgctgccaaatcagggggactcgcgctgccatatttcaatggtaccggaacagttcagaagggcaggccgaggaagcgaaagagccctgccttgggcgtagatatagtcaattacaactccggatgtaacgagaacgaggcggatcaccttgacagagaccagcaaccatatccaccgtctcagaaaacgaagcgaatgcgtaccagcttcaaacatcaccagctccgaaccatgaagtcatattttgccatcaatcacaatcctgatgccaaggacctgaagcagcttgcccaaaagaccggcttgactaagcgcgttctccaggtttggttccagaacgcaagggctaagttcagacgcaatcttctcagacaagaaaacgggggtgtggacaaggcggatggtaccagcctccctgccccaccctccgctgattccggggctttgaccccacctggaaccgcaactacattaaccgacctgacaaatcccacaattacagtcgtaacatctgtaacttcaaatatggattctcacgagtctggtagcccttctcaaaccacacttacaaacctgttctag

SEQ ID NO: 228764 - DNA, 1167 bp, Artificial Sequence
  Description of Artificial Sequence: Synthetic coding sequence
atgctgaatggaactacactggaagccgctatgctttttcatgggatctccggtgggcatatacaggggatcatggaggagatggagcgccgaagtaagacggaagctaggctggccaaaggagctcagctgaacgggagagatgcaggaatgccaccactgagcccggagaaaccagccctgtgtgctgggtgtggtggaaaaatttcagataggtattacctcctcgcagttgacaagcagtggcacctgagatgcctgaagtgttgcgagtgcaagctggccctggagtcagagctgacctgctttgccaaagatgggagtatttactgcaaggaagactattatagacgtttttccgtgcagaggtgtgcacggtgtcacctaggaatttccgcaagcgaaatggtgatgcgggctagggactcagtttatcatctctcatgcttcacttgttcaacatgcaataaaactttgacaactggggatcacttcggaatgaaggacagcctggtgtactgccgagctcatttcgaaactctgctgcagggggagtaccctcctcagctctcatataccgaactggcggcaaagtctggcggactcgcattgccctattttaacgggacaggaaccgtgcaaaagggaaggccgaggaagaggaagagcccagcactgggcgtcgacattgtcaattacaactcaggatgtaacgagaatgaagctgaccacctggatcgtgatcaacaaccttatcctccctcgcagaagactaaaaggatgagaaccagcttcaaacatcaccagctgaggacgatgaaaagctacttcgccattaaccacaatccagacgctaaagatttgaaacagcttgctcagaagactggcctgaccaagagagtgcttcaggtgtggttccaaaacgctcgagcaaaattcaggcgcaatctgttaaggcaggagaacgggggtgtggataaagccgacggtaccagcttgccagccccaccaagcgccgattcaggcgctctgactcctcctggtacagccacaaccctaaccgatctcactaatccaaccatcacggtcgttacatccgtcacaagtaatatggactcccacgaatcgggcagtcctagccagaccactcttacgaatttgttttag

SEQ ID NO: 228765 - DNA, 1149 bp, Artificial Sequence
  Description of Artificial Sequence: Synthetic coding sequence
atgctggatggcttaaaaatggaagaaaacttccagagtgctattgacacttccgccagtttttcctcgctgctggggagagctgtctcccccaagtctgtgtgcgaaggctgccaacgcgtaatcctagaccgatttctccttcgcctgaatgattcgttttggcacgagcagtgcgtgcagtgtgcctcttgcaaggagccgctggaaaccacttgtttctatcgtgataagaagctgtactgcaaatacgactatgagaaactttttgccgttaagtgcggaggttgctttgaagccatcgctccaaatgaattcgtcatgagggctcaaaagtcggtctatcatctttcgtgtttctgttgttgcgtctgcgaacggcagcttcagaagggcgacgagttcgttctgaaggaaggtcaacttttgtgcaagggtgactatgagaaggagagagaattgctcagtttggtttctcctgctgcctcagacagtgggaaaagcgacgacgaggagtctttgtgtaaaagtgcgcacggagccggtaagggtaccgcagaggaggggaaggatcacaaaagaccaaagaggccccgaacgatactcaccacgcagcagcggcgagcctttaaagcctcgttcgaagtgtcaagtaagccatgcaggaaagttagagagaccttagctgccgagacaggcctgtctgtgcgggtggtgcaagtgtggtttcagaatcagcgggctaagatgaaaaaactggctaggagacagcagcagcagcagcaagatcagcagaacacacagcggctgagctcagcccagacaaacggaggcggatccgcagggatggagggcatcatgaacccctataccgccttaccgacaccccagcaactattggccatcgagcagtcagtatacagctcggaccccttcagacagggacttactccgccacagatgccaggggatcacatgcacccctatggagcagaacccttgttccacgacctagattcggatgacactagcctgagcaatctcggagactgtttcctcgcaacgtctgaagccggaccactgcagagcagggttggcaaccctatagaccatctgtactccatgcagaactcttactttactagctag

SEQ ID NO: 228766 - DNA, 1149 bp, Artificial Sequence
  Description of Artificial Sequence: Synthetic coding sequence
atgttggatgggctgaagatggaagagaattttcagtcagctatcgacacgtctgctagtttttcctccctattgggtcgtgccgtgagccccaaatccgtatgcgaagggtgtcaacgcgtgattttggataggtttcttctaaggctcaatgactctttctggcatgagcagtgcgtgcagtgcgccagttgtaaagaacccctggaaacgacatgcttctatcgcgacaaaaaattgtactgcaagtatgattacgaaaaactctttgctgttaagtgcgggggttgcttcgaagccattgctccaaacgagttcgtgatgagagctcagaaaagtgtgtatcaccttagctgcttctgttgttgtgtctgtgaaaggcaactgcagaagggggacgaattcgtactcaaagaggggcaactcttatgtaaaggagattacgagaaagaacgcgaactgttatcactggtgtcaccagcagcctccgacagcgggaaatcagacgatgaagagagtctatgtaagagcgcccacggcgctgggaagggcacggccgaggaagggaaggatcacaaacgtccaaagcgaccacggaccattctcacaacacagcagcgccgagctttcaaagcctcatttgaagtctcatctaagccatgccggaaggtacgagagacactggccgcagagacaggtttgtcggtccgcgtcgtccaggtttggtttcagaaccagagggccaaaatgaagaagctcgcacggagacagcagcagcaacaacaggaccagcaaaatactcagagactttcatctgcgcagactaacggcggaggctcagccggtatggaaggtattatgaacccctatactgcgctcccaacccctcaacagcttctcgccattgagcaatcagtctactcttcagacccatttcgacaaggcctgacccctccacaaatgccaggggaccacatgcatccttatggggctgagcctctatttcacgatctcgattctgacgacacctctctttcaaatctgggagactgctttctggctacttcggaggcgggaccacttcagtcacgggtcgggaatcctatcgaccatctttactcgatgcaaaactcttactttactagctag

SEQ ID NO: 228767 - DNA, 1149 bp, Artificial Sequence
  Description of Artificial Sequence: Synthetic coding sequence
atgctggatggactgaagatggaggagaactttcagagcgctattgacacatctgcctcctttagctccctgcttggacgagcggtcagccctaaatctgtttgcgagggttgtcagagggtcatcctcgacaggttcctgttgcggcttaacgattctttctggcacgaacaatgtgtacagtgtgcatcttgcaaagaaccactcgaaactacttgcttttatcgtgacaaaaagctttactgcaaatacgactacgaaaagctctttgccgtgaaatgcggaggatgttttgaggctatcgcccctaacgaatttgtaatgcgggcacagaaatcagtataccacctttcgtgcttttgttgctgtgtatgcgagcgccagctgcagaagggagatgagttcgtgttaaaggaaggacagctcctgtgtaaaggcgactatgagaaagaacgcgaacttttatccctggtgtcaccagccgctagcgactctggaaagtcagacgacgaagaaagtctgtgtaagagtgcgcacggtgccggaaagggcaccgcagaagagggcaaagaccacaagcggcctaagagaccaagaacaatcctgacaacgcagcaacggagggctttcaaagcctccttcgaagtctcctctaagccgtgtaggaaggtgcgagaaacgctggccgcagaaacgggacttagtgtgagagtggtgcaggtttggttccagaaccagcgggctaagatgaaaaaactcgctaggagacagcagcagcagcagcaagaccagcaaaacacccaacggctgtcctccgcccaaaccaatggtggagggtccgcaggaatggagggtattatgaacccctacacggccttgcccacccctcagcaacttctagccatcgaacaatcagtctactcaagcgatccattcaggcagggtttaactccacctcagatgccaggtgaccacatgcatccctatggggctgagcctctgtttcacgatctggacagcgacgatacaagtctttcaaatcttggagattgctttctcgcaacctcagaagccggacctctgcaatcgcgtgtgggaaatccaatcgaccatctttactcaatgcagaacagctattttacttcatag

SEQ ID NO: 228768 - DNA, 1221 bp, Artificial Sequence
  Description of Artificial Sequence: Synthetic coding sequence
atggacatagccaccggcccagaaagtttggaaagatgttttcctaggggacagacagactgcgcaaagatgttggatggcataaaaatggaagaacatgcactgagaccaggcccagcgacactaggggtactcttagggtcagattgtccccatcccgctgtgtgtgagggttgccagcgaccaatttctgacagattcctcatgagagtcaacgaatcttcctggcacgaagaatgtctgcagtgcgccgcatgtcagcaggccctcacaacatcctgctattttcgtgatagaaaactgtattgtaagcaagattaccagcagctattcgccgcaaaatgctctggatgtatggagaagattgcgccaacggagtttgtcatgcgggctctggaatgcgtgtatcatcttggttgtttttgttgctgtgtgtgcgaacggcagctgaggaaaggcgacgaattcgtgctcaaggaggggcagcttctgtgcaaaggcgactacgaaaaagaaaaggatctgctctcatctgtatcaccagacgagagcgattctgtaaagtctgaagacgaggatggtgacatgaaaccagccaagggacagggctctcaaagtaagggatctggtgatgacggaaaagatccgaggcggcctaagcgcccacgcaccatacttaccacccagcagcgacgtgccttcaaggcgtcgttcgaggtcagttccaaaccgtgccgaaaagtccgggagacccttgccgctgagacaggcctgagcgtgagggtggtgcaagtatggttccagaatcaaagagcaaaaatgaagaaactcgctagaaggcaccagcaacagcaggagcaacagaacagccagaggctgggacaaggagagcccggacctggccagggacttggccaagaagtgctgagttctagaatggaagggatgatggcctcctacactccactcgctccccctcaacagcagattgtcgcaatggagcagagcccgtacggatcctcggaccctttccagcaagggctgactccaccccagatgcctggtaacgatagcatattccatgacatagattctgatacaagcctgacttcgctgtctgactgctttctgggctcgagcgatgtgggttccttgcaagccagggtgggaaaccccatagataggctgtatagcatgcaatcgtcttactttgcgagttag

SEQ ID NO: 228769 - DNA, 1209 bp, Artificial Sequence
  Description of Artificial Sequence: Synthetic coding sequence
atggatatagcgacagggccagaaagtctcgagcgctgcttcccccgtggccagaccgattgcgctaaaatgctggatgggatcaaaatggaagagcacgccctgaggccaggacctgcgactttgggtgtcctccttggctcagactgtccgcatccggcagtctgtgagggatgccaacgaccaatctcagaccggttcctcatgcgagtcaatgagtcatcttggcacgaggagtgccttcagtgcgcagcgtgtcagcaagctctcacaacatcatgctatttccgggatcgcaagttatactgtaagcaagactaccagcagctgttcgccgctaaatgctcgggctgtatggagaagattgcgccaacggaatttgttatgcgtgcactggaatgcgtttatcatctgggatgcttctgttgttgcgtttgcgagcggcagctgcggaaaggagacgagttcgtattgaaggaaggacagttgctctgtaaaggcgattacgagaaggagaaggatctcctgagctccgtgagtccagatgagagcgactccgtcaaaagcgaagatgaggatggtgatatgaagcctgccaagggacagggatctcagagcaagggcagcggagatgacggaaaggacccccgtcgaccaaaaagaccccgtactatcctgaccacccagcaacgcagagcctttaaggcttcatttgaggtctcttctaagccttgtcgcaaggtccgagaaaccctcgctgccgagactgggcttagcgtgcgtgtggtacaggtctggttccagaaccagcgcgcaaaaatgaaaaagctcgccagaagacatcagcagcagcaggaacagcaaaatagccagaggctgggtcaggaagttctgtctagccggatggaaggaatgatggccagttatactcccctagctccaccacagcaacagatcgtcgctatggagcagagcccttacgggagcagtgaccccttccagcagggtctgaccccacctcaaatgccaggcgatcatatgaatccttacggcaatgacagcatttttcacgatattgactcagacacgtccctcacaagcctgagcgactgctttcttgggagttcagacgtgggatccctgcaggcacgtgtgggtaatccgatcgaccgcctctacagcatgcagtccagttacttcgccagttag

SEQ ID NO: 228770 - DNA, 1119 bp, Artificial Sequence
  Description of Artificial Sequence: Synthetic coding sequence
atgctcgacggtatcaaaatggaggaacacgcactgcgccctgggcctgcgactctgggcgttctgctcggctctgactgccctcacccagccgtgtgcgagggctgtcagcgcccaatttcagaccgcttcctcatgcgggtcaacgagtcgagctggcatgaagaatgcctccagtgtgcagcttgccagcaggccctcaccaccagctgctactttcgagaccgcaagctgtactgtaagcaggactatcaacagctgtttgctgcaaagtgcagtggttgcatggagaagatcgcccctacggaattcgtgatgagggctctggagtgtgtttatcacctggggtgtttttgttgttgcgtatgcgagaggcaacttaggaagggcgacgaattcgtactcaaagaaggccaactcctgtgtaagggggattatgaaaaagagaaagatctactaagctcggtgtcccccgacgaatccgacagcgtcaagagtgaggacgaagacggggacatgaagccagctaaaggtcagggtagtcagagcaaaggcagtggcgatgacggcaaggacccgagacgcccaaaaagaccgagaacaatcttaaccacccaacagcggagagctttcaaggcgtctttcgaggtttctagtaaaccatgtcgtaaagtcagagaaactctggcggctgaaacaggtctgtccgttagggtcgtacaggtgtggttccagaaccagcgcgctaaaatgaaaaaacttgccaggaggcaccaacagcagcaggagcagcagaacagccagcgattaggccaggaggtgctgtccagtcgcatggaaggaatgatggcctcatacacacccctcgctccgcctcagcagcagattgtggccatggagcagtctccctacgggagtagtgatccattccagcagggcctgacaccaccccagatgcccggtaacgacagcatctttcacgacattgatagtgacaccagcctaacctctctgtcggattgtttcctgggtagttccgacgtaggcagcctgcaagccagagtcggcaatccaattgatcgactgtatagtatgcaatcaagctactttgcaagttag

SEQ ID NO: 228771 - DNA, 1188 bp, Artificial Sequence
  Description of Artificial Sequence: Synthetic coding sequence
atggacatcgccaccggccctgagtctctcgagcgttgcttccccaggggccagaccgactgcgccaagatgctcgacgggatcaaaatggaggagcatgctttacgcccagggccagccactctgggtgtgctgctagggtcagactgtccccacccagccgtttgtgaggggtgccagcgacccattagtgacagattcctgatgcgcgtcaatgaaagttcctggcatgaggaatgtctgcagtgtgccgcatgccagcaggctctaaccacttcctgctacttccgcgacagaaaactgtattgcaaacaagactaccagcagctctttgctgccaagtgttcaggctgcatggaaaaaatagcaccaacagagtttgtcatgcgagctctggaatgtgtataccacctgggctgtttttgttgttgtgtttgcgagcgccaactccgcaagggagacgagttcgtgctgaaggaaggccagcttctgtgcaaaggagattatgagaaggaaaaggaccttctctcttctgtgtctcctgatgaaagcgactcagtcaagagcgaagacgaggatggggacatgaagcccgctaaaggccagggctctcagtcaaaaggatcaggcgacgatgggaaggatcccaggcgaccaaaacgacctcgaacaatcctcactactcagcaacggagagcttttaaggcttcatttgaggtgtccagcaagccatgcaggaaggttcgggaaacattggctgccgagactgggctcagtgtccgcgtggtgcaagtgtggtttcagaaccagcgggcaaaaatgaagaagttggcaaggagacatcagcagcaacaggaacaacagaacagccagcgactgggacaagaagtcctatcctcccgcatggagggcatgatggcaagctatacgcctctggccccacctcaacagcaaattgtagccatggagcagagcccctatggcagtagcgacccctttcagcagggtctgacgccaccgcagatgcctggtaatgatagcattttccatgatatcgattccgacactagcctgacatctctgagtgattgctttttgggaagcagtgacgtgggctctttgcaggccagggtcggcaatcccattgatagactgtactcaatgcagtccagctatttcgcatcatag

SEQ ID NO: 228772 - DNA, 318 bp, Artificial Sequence
  Description of Artificial Sequence: Synthetic coding sequence
atgtccatatacttcccaatccactgtcccgactaccttagaagcgcaaaaatgaccgaagttatgatgaatacccagcctatggaagagattgggctttctccgaggaaggatggcctctcctaccagatcttccctgacccctcagatttcgatcgttgttgcaaactcaaggatcgtcttccaagcatcgtggtagaacccacagagggggaggtagagtccggcgagctccggtggccgcctgaggagtttttggtccaggaggacgagcaggataattgcgaagaaacagccaaagaaaataaggagcagtag

SEQ ID NO: 228773 - DNA, 264 bp, Artificial Sequence
  Description of Artificial Sequence: Synthetic coding sequence
atggtgagtagcgtggtcggcttttattctttgaggttcttcggcaactttacacccaagaaagacgatacaacaatgacaaagataatcggcaactgcgtgtctatacttgttctgagttccgcccttccggttatgagtagaacactcggccttcacaaactgcacctcccaaacacttcacgggatagtgagacagctagtgtgatgacttcctccgcacgggacacaggattccatcacctacaggctttaatgtgctag

SEQ ID NO: 228774 - DNA, 687 bp, Artificial Sequence
  Description of Artificial Sequence: Synthetic coding sequence
atggaagggcaggacgaggtgtccgctcgcgagcagcacttccactcacaggttcgagagagtaccatctgctttcttttgttcgctatcctctacgtggttagctacttcatcattacccggtataagagaaagtctgacgagcaagaagacgaagacgcaatcgtaaacaggataagcctattcttgtctacctttaccctggccgtgagcgctggcgctgttctgctcctgccatttagcataatttctaatgagatccttctgagtttcccccagaactattatattcagtggctaaacggctcacttattcacggactctggaatttggccagtttgttctctaacctttgtctcttcgtgctaatgccctttgcatttttctttctggagtcagaaggcttcgcgggactgaagaagggaataagggcccgaatcctggaaacgttagtgatgttgctattgctggccttgctgattctcggcatcgtgtgggtcgcaagtgcattgatcgacaatgacgccgcttcaatggaatctctatatgacctatgggagttttacctaccatacctctatagttgcatctccttgatgggctgcctattgctccacctgccgaatacaagtagggatagtgaaactgcaaagccctctgttaacggccaccagaaagcgctgtag

SEQ ID NO: 228775 - DNA, 1473 bp, Artificial Sequence
  Description of Artificial Sequence: Synthetic coding sequence
atggaaggtcaagatgaagtgtcagcaagggagcagcatttccattctcaagtgcgagagtctaccatctgcttcctgctgttcgctatcctttatgttgtctcctactttatcattacacggtataagagaaagtctgacgagcaggaggacgaggatgccatcgtgaataggattagtctgttcctgtccacatttacgctcgcagtgagcgcaggagcagtgctcctgctgcctttctcaattatctccaacgaaattttgctgtcattcccgcaaaactactatattcaatggctgaacgggagcctcattcatggcttatggaatctggcttccctattcagcaatctttgcctgtttgtgctgatgcctttcgcttttttcttccttgagtccgagggatttgccggtttgaaaaaaggtatcagggcaaggatcttggaaactttagttatgcttctgctgctcgcactcctgattcttggaattgtttgggttgctagcgcccttatagacaatgatgccgcaagcatggaatcactttacgatttgtgggagttttatcttccgtatttgtactcctgtatctctctgatgggatgtctattgctccttctatgcactcccgtgggcctatcccgcatgttcaccgtgatgggacagctcttggttaaaccgactatccttgaagacttagatgagcagatttatataataaccctcgaggaggaggctctccaacgccgactcaatggcctctcttcctctgtggagtataacatcatggaactggagcaggaacttgaaaatgtcaaaacattgaagacaaagctggagaggagaaagaaggcaagcgcatgggagaggaatctcgtctacccggctgtcatggtcctgctgctgattgaaacatcgatctccgtactattagtggcttgcaatattctctgtctgctggtagatgaaactgcaatgccgaaaggaactcgcggacctggcattggcaatgctagcctgtctacctttggctttgttggagccgctctggagattatcctcatcttttatctgatggtgtctagtgtcgttgggttctactccctccggtttttcggaaattttacacccaagaaagacgatacaactatgacgaagattattggcaattgcgtgtctatcctggtgctgtcgagcgctctgcccgttatgtcgcggaccctcggcatcacgcgctttgacctgttaggggatttcggtaggtttaactggctcgggaacttctatatcgtgttatcttacaatctcctctttgcaatcgtaactacgctatgcctggtgcgaaaattcacttccgctgtgcgggaagagctatttaaagcactcgggctacacaagctacacctacccaatacaagtcgggacagcgaaaccgccaaaccgagtgtgaatgggcaccagaaggccctatag

SEQ ID NO: 228776 - DNA, 1596 bp, Artificial Sequence
  Description of Artificial Sequence: Synthetic coding sequence
atggaaggtcaggacgaggtgagcgcgagagagcagcacttccattcacaggtgagagagagcacaatttgttttctcctgttcgctatactgtacgtcgtcagctacttcatcattacaagatacaagcggaagtccgatgaacaggaggacgaagatgccattgtgaaccggatcagtctgtttctgtctaccttcacattggctgtgtctgctggagcagtgctgctgctgcctttctcgatcatttcgaatgaaattctgctgtccttccctcaaaattattacatccagtggttaaacgggtctctgatccacgggctgtggaatcttgcttcgctcttttccaacctttgcctcttcgtgctaatgccttttgcctttttcttcttagaatctgaaggattcgccggattgaagaaaggaatcagagccagaattttagaaacactggtgatgttgctcctactcgccctcctaatcctcggaatcgtttgggtggcatccgccctgatagacaacgacgctgccagtatggagtcattatatgacctctgggagttttacctgccttacttgtatagttgcatctccctcatgggctgcttactgctcctgctatgcacgcccgtgggtctgagccgcatgttcaccgtcatggggcagctgttggtcaaacctactatcttggaagatctggatgagcagatctacataataacactggaagaggaggctctgcagaggagactcaatgtggggatgctgtgtgctggcaaccccgaagtcgcaacggggaggcaggtcccggaagagcaggccggtcaattgctgctcgggaagtggattcaagagggcggagatatgatagccaatccaagattgtcttcctccgtggaatacaatattatggagctggagcaggagctggaaaatgtgaagactctgaaaacaaaactggaacgcagaaaaaaggcctccgcctgggaacgaaacctggtgtacccggctgtgatggtgttattactgatcgaaacgtcaatatcagtcctacttgtggcttgcaacatcctttgtctgctggtcgatgagacagctatgccgaagggcacgcgcggaccgggaatcggcaacgcgagccttagcaccttcggcttcgtaggggcagccttagaaattattctgattttttatctgatggtgtcttctgtggtcggtttctattcccttagattttttgggaactttactcccaaaaaggacgacaccactatgaccaaaatcataggcaattgcgtcagcatattggtactgtcttccgcactgccagtgatgagtagaacgctggggatcacccgattcgatctgctcggggatttcggtcgatttaattggttgggcaacttctatatcgtcctgtcgtataatctgctctttgctatcgtgaccacactgtgcttggtcagaaagtttacgagcgccgtgagggaagaactgtttaaagccctgggcctacataagctgcatctgcccaatactagcagagattcagagactgcaaaacccagcgtgaatgggcaccaaaaggcgttgtag

SEQ ID NO: 228777 - DNA, 855 bp, Artificial Sequence
  Description of Artificial Sequence: Synthetic coding sequence
atgctgctgttgttagcactgttgattctagggattgtgtgggtggcatcggccctgattgacaacgacgccgcttctatggagagtctgtatgacctgtgggagttttatttgccatatctgtactcatgtatcagtctgatgggctgtttactcttgctcctttgtactccggtcgggctctctagaatgttcacggttatgggacagctgctcgtgaaacctacaatcctagaggatttggacgagcaaatctacataatcacactcgaagaggaggctctgcaaaggcgcctcaatggtctctcatcaagtgtcgaatacaatatcatggagctcgagcaggagctggagaacgtgaagaccttgaagactaagttggagaggaggaaaaaagcctctgcttgggagaggaacctcgtttatccggctgtcatggtcctgctccttatcgagacaagcatctctgttttgctggtagcatgtaatatcctgtgcttactggtagacgaaacagccatgcccaagggcacaagagggcctggcataggaaatgccagcctaagcactttcggctttgtgggcgctgctctcgaaatcatcttaatcttctatttgatggtgtctagtgtcgttggcttttacagcctgcgcttttttggaaacttcactcccaaaaaggatgacacgacaatgactaaaatcataggcaactgcgtcagtattctcgtcttgtccagcgccctgcctgtgatgagccgcacattaggcctccataagctgcaccttcccaatactagtcgggatagcgaaaccgccaagcccagtgttaacggacatcagaaggcgctttag

SEQ ID NO: 228778 - DNA, 1590 bp, Artificial Sequence
  Description of Artificial Sequence: Synthetic coding sequence
ggccaggacgaagtcagtgctagagagcaacatttccattctcaggtgcgggagagcacaatttgctttctgcttttcgccatcctttacgtagtcagttatttcattatcaccagatacaaacgcaagagtgacgagcaagaggacgaagacgcgattgtaaacagaataagcctgttcctgagtactttcacactggccgtctcggctggcgctgtgcttttgttaccattcagcattatctctaacgagatactcctgtctttcccacagaactactacattcaatggctgaacgggtcactgatccacgggttatggaatctggcctctctcttctctaatctttgcctatttgttctgatgcccttcgcatttttttttttggagagcgaaggcttcgctggattgaagaaaggaattagggcccgaatcctagagacactcgtaatgttactcctccttgcgctgttgatactggggatcgtctgggtcgcttccgccctgatcgataatgatgccgcttctatggaatcactgtacgatctgtgggagttttatctcccctacctctacagctgtatttcactgatgggttgtctgctcctactgctgtgcacgccggtaggcttaagtcgtatgtttaccgttatgggtcagctcttggtaaagccaaccatactggaagatctcgacgaacagatctacataattacacttgaggaagaggcacttcagagacgcctcaatgttggaatgttgtgcgccggtaatccggaagttgccacaggacgccaagtccctgaagagcaggccggacaattgttgctggggaagtggatccaggaaggaggcgatatgatcgccaacccccgactgtctagctctgtggagtacaacatcatggagctggaacaagaactcgagaacgtgaagactcttaagacaaagttggagcggcgtaagaaggcctccgcctgggagcggaaccttgtgtatcccgctgtgatggtgttgcttctgatcgagaccagtatcagcgttctgctcgtggcgtgcaacatcctatgcctgctggtcgacgaaaccgccatgcccaagggcactaggggacctggcatagggaatgccagtttgtctaccttcggattcgtcggcgctgcattagagatcatactcatattttaccttatggtgtcatccgtcgtcggcttttattctctgaggttcttcggtaatttcacacccaagaaggatgatactacaatgacaaaaattatcggcaactgtgtgtccatactggtgctgagttctgcgttgcccgtgatgagtcgcacgctgggaatcactagattcgatctgctgggggactttggacggtttaattggctgggaaatttttacatcgtgctctcttacaatctcctgtttgcaatcgtcaccactctctgcctggtaaggaaatttacctctgcagtgagagaagaactgtttaaagctctcgggttgcacaaactccacctgccgaatacatctcgcgactcagagacagcgaagccttcggtgaacggccatcagaaggcgctgtag

SEQ ID NO: 228779 - DNA, 1248 bp, Artificial Sequence
  Description of Artificial Sequence: Synthetic coding sequence
atgaaggaagacgggcgtgcgggtaggggagtgggcgcaggcgcagctttgccccagccaagtgcaggggtccacgacgagcaggaagatgaagacgctatagtgaataggatatcattgttcttatcgacgtttacactggctgtgagcgcaggagcggtcctcttacttccttttagcataatcagcaacgaaattcttttatcgtttccacagaattactatatccaatggctcaatgggtctctgattcacgggctgtggaatctcgccagtctgttcagcaacctgtgtctgttcgtcttaatgccattcgcctttttcttccttgagagcgagggttttgctggactcaaaaaggggatccgagctagaatcttagaaacgctggtgatgctgcttttgctggctcttctcattttggggattgtctgggtggcaagtgcactgattgacaacgacgccgcttccatggagtccctgtacgatctatgggaattttacctgccatacttgtatagttgcatctctctgatggggtgcctgctgctgttgctctgtacccccgttgggctcagcagaatgttcaccgtcatggggcagctactggtcaagccaaccatcctggaagatttggacgaacagatttacatcatcaccctcgaagaggaggccttgcagcggagactcaacggactgtcctccagtgtggagtacaacattatggaactggagcaggaactggagaacgtgaaaacactgaaaacaaagctggagaggaggaagaaagccagcgcttgggagcgcaacttagtctatcccgcagtgatggtgctgctcctcattgagacaagcatttcagtcctcctggtggcatgtaatatattgtgcctgctggtggacgagaccgccatgccaaaaggcacacgtggtccagggatcggaaacgctagcctgtctaccttcggctttgtgggagcggcactggagatcatcctgatcttctatttaatggtgtcctcagtggtgggattctattccctaaggttttttgggaacttcactccaaaaaaggacgataccacgatgacaaaaattataggaaactgtgtctctattctagtcctctcctccgctctccccgttatgtcccggaccttaggtttacacaagctgcacttgcccaacacctcacgcgacagcgaaactgctaaaccctcagtgaacggacaccagaaggctttgtag

SEQ ID NO: 228780 - DNA, 1470 bp, Artificial Sequence
  Description of Artificial Sequence: Synthetic coding sequence
atggaggccccagactacgaagtgttgtcggtgcgcgaacaattgttccacgagcgcataagggagtgcatcatctccaccctgctgtttgcaaccctatacattctgtgccacatatttctgacccggtttaaaaaacctgccgaattcactaccgtcgacgacgaggatgctacggtgaataagatcgctttggagctttgcacatttacgctcgccattgccctcggtgctgtccttctgttacctttctccatcatctctaacgaggtactcctgtcactgccccgaaattattacatccagtggttgaacgggagtctgatccatgggctgtggaacttagtattcctgttcagcaacctctcacttatcttcttgatgcccttcgcttacttctttactgaaagcgaaggcttcgcagggtctagaaagggcgtgttgggcagagtgtacgaaactgtggtgatgttgatgctgctgacgctgctggtgttaggaatggtctgggttgcgtcagctatcgtggacaaaaataaggccaaccgggagtccctatacgatttctgggagtactacctgccctatctgtacagttgcatttcctttctgggtgtgctgttgctgctcgtgtgtacaccactgggactcgccaggatgtttagcgtgaccggcaagcttttggtcaaacctcgcctgctggaagacctagaagaacagttgtactgtagcgccttcgaggaggccgcactgacacggcgaatttgcaaccctacttcctgttggcttcccctcgatatggagctgctgcatcggcaagtgttagctctgcagacgcagcgggtgcttctcgagaagagacgtaaggcttcagcttggcaaaggaatttggggtaccccctggctatgctctgcctgcttgttctgacaggcctgagcgtgttaatcgttgccattcatattctagagctgttgatagatgaagctgctatgcccagagggatgcagggcactagcctgggtcaggtctccttttcaaaactagggtccttcggtgccgtgattcaggtggtcctcattttttatctgatggtgagttctgtcgtgggtttttattcttctcccttgtttcggtccctgcggcctcgttggcacgacactgccatgacgcagattatcggcaattgtgtctgtctcctcgttctgtcttcagctctccccgtcttttcacgtactcttggccttacacgatttgatctgctgggagacttcggaaggttcaactggctcggaaacttttatatcgtgttcctatacaatgcggcattcgccggtctgaccactctctgtctcgttaagacatttacggctgccgtgagagcagagctgatcagagcgttcggcctggaccgtctccccttgccagtatccggcttcccacaggctagccgcaaaacccagcaccagtag

SEQ ID NO: 228781 - DNA, 1455 bp, Artificial Sequence
  Description of Artificial Sequence: Synthetic coding sequence
atggtgaacgtgaaagccctctgcgaacccgaagtgtctaactgctggatgaatgtaatcacgggcaccggcagcgtatcatctcctctcctggtccttcctcaacctggcccagagaccagcctcatgacgggcgaacccgtggacgacgaggacgccactgtgaataagatagctctggagctttgtactttcactctggctatagcactaggcgcagtcttattgttacctttttccatcatcagtaacgaggttctgctttcgctgccacggaattattacattcaatggttaaatggctctttgatacacggcctttggaacctcgtcttcctcttttcgaatctgtcactcatcttccttatgccgttcgcctatttttttactgagtctgagggatttgccggatccagaaaaggagtgcttgggagggtgtatgaaacggtggtaatgttaatgctgctgaccctcttggtcctgggcatggtgtgggtagcatcagctatagtcgataaaaataaagcaaacagggagtccctctatgacttttgggaatactacttaccctatctttactcctgcattagtttcctgggcgtactcctgctgctggtttgtaccccactcgggctcgctcgcatgttctctgtcaccggaaaactgctggtcaaacctagacttcttgaagacctggaagaacagttgtattgctcagcttttgaggaagccgcactgactaggcgtatctgtaatccgactagctgttggcttcctttagatatggaactgttacacaggcaggtgttggctttgcaaacccagagagtgcttctcgagaaaagacgaaaagcaagcgcatggcagcggaacttgggttacccgctcgctatgctgtgcctactggtactcaccggcctcagtgtgctgattgtggcaatacacatcttagaattgctgatcgatgaagccgcaatgccaaggggcatgcagggcacgagccttggacaggtctcatttagcaaattgggttctttcggcgcagtgattcaggtcgtgttgattttctacctgatggtctcaagtgtggtagggttttactcatccccgctatttcgaagcctccgccctcgttggcatgatacggccatgacgcagatcatcggaaattgcgtgtgcctgcttgttctgtcttctgcattgccagtgttttctcgaacgttaggcctgactcggtttgacctcctgggcgactttggcaggttcaactggctgggcaatttctacatcgtgtttctctataatgcagcattcgcaggactcacaactttatgcctggtgaagacgttcaccgccgctgttcgtgcggagctcattcgcgcattcggtcttgaccgcttaccgctccccgtgagtgggttcccccaagcaagcaggaagactcagcatcagtag

SEQ ID NO: 228782 - DNA, 1410 bp, Artificial Sequence
  Description of Artificial Sequence: Synthetic coding sequence
atggaagccccagattacgaggtgctctccgttcgtgaacagctttttcacgagcgaatccgcgaatgtattatcagcactctgttgttcgcgaccctatacatcttgtgtcacatatttctcacccggttcaagaaaccagcagagttcaccacagttgacgacgaagatgcgacggttaataagatcgctctagagctttgcacattcacgctggcgattgcccttggggcagtactccttctgcctttttctattatctccaatgaagtcttgttatctttaccaagaaattattacattcagtggctaaacggaagtctgatacacggcctctggaatctggtctttttattctccaatctcagtctcatctttctcatgccttttgcctactttttcacggaaagcgagggattcgcgggaagccgaaaaggagtgctcggacgcgtctacgagacggtggtcatgctgatgctcctcacactattagtgcttggcatggtgtgggtcgcctctgcaattgtggacaagaacaaagctaatagggaatctttgtatgacttttgggagtactatctgccatacctgtatagctgcatcagcttccttggagtgttactgctcctagtatgcacccccctgggcctcgccaggatgttttctgtgaccgggaagctgcttgtaaaaccgcgactgctagaggacctggaagaacagttgtactgctccgcatttgaagaggccgcactcacaaggaggatctgtaaccccacctcgtgctggctgcccctagatatggagcttctacaccgtcaggtgctcgctctgcagacccagcgagtgctcttggaaaagcggagaaaggcctccgcctggcaacgtaaccttggctatcctttagcgatgttgtgtctgcttgtgctaaccggcctgtccgtcctgatcgtcgccatccacatcctagagctcctgattgacgaagccgcaatgccacggggtatgcaggttgtactcattttctatcttatggtctcaagtgtcgttggattctattctagccctctttttcggtccctccggccaaggtggcatgatacggcaatgacccagattattggcaactgcgtctgcttactcgttctcagtagcgcgttacctgtgttttcaaggaccctgggattgacaagatttgacttactgggtgatttcgggaggtttaattggctcggcaacttctacattgtgttcctgtataatgcagccttcgccggactcaccacactgtgtcttgtcaagacttttacagctgctgtgagagccgaactgattagagccttcggcctcgatcgcctgcctctgcccgttagcggatttcctcaggccagccggaagacacagcatcaatag

SEQ ID NO: 228783 - DNA, 384 bp, Artificial Sequence
  Description of Artificial Sequence: Synthetic coding sequence
atggaagcacccgattacgaagtactgtcagtgagggaacagctcttccacgaacggattagggagtgtattatcagtacacttctgttcgcaaccctgtatattctttgccacatattccttacccgcttcaagaagcctgccgagttcacaacagtagacgatgaagacgccaccgtgaacaagatagcattagaactctgcacgttcaccctggcaatcgctttgggggctgtgcttcttctcccatttagtatcatctctaatgaagtcctgttatcgctgccgaggaattactatatccagtggctcaatggcagcctgatacacgggctctggaacctggtattcttattctctaatctgtctttgatctttttgtag

SEQ ID NO: 228784 - DNA, 1017 bp, Artificial Sequence
  Description of Artificial Sequence: Synthetic coding sequence
atggtccgcagagtgcagcctgataggaaacagctgcccttggtcttactgcggctgttatgccttctgcccactggtcttcccgtgcgttcagtagatttcaatcggggaaccgataacatcacagtgcggcaaggcgacactgcaatcctgcggtgtgtggtcgaggataaaaatagtaaagtcgcttggctaaacaggtcaggaattatattcgccggtcacgacaagtggtccctggacccccgtgtagaattagagaaacgccattccctggagtactcacttcggatacaaaaggtggacgtttacgatgaaggttcctacacctgttccgtgcagactcagcacgaacccaagacaagccaggtatatctcatagtgcaggttcctccgaagatttccaacatctcctccgacgttacagttaacgagggctccaatgtgacactggtatgcatggcgaatggccgaccggaaccagttattacctggaggcatcttacacctactgggcgtgaatttgagggtgaggaggagtatctggagattttggggatcaccagggaacagagcgggaaatacgagtgcaaagccgctaatgaagtgtccagtgccgacgtgaaacaggttaaggtcacggtgaactatccccctacgatcactgaatctaagtcaaacgaagccactacaggaaggcaggcatccctgaaatgcgaagcaagtgctgttcctgctccagactttgaatggtaccgagacgacacccgaatcaattcggctaatggactggaaataaaatctactgaaggccagtcaagcctgaccgttactaacgttaccgaggaacactacggtaattatacatgtgtcgcagcgaataagttgggcgtgacaaatgcaagcttagttttgttcaggcccggtagcgtacggggaataaacggctcaatcagtctggccgtccccttatggttacttgctgcctccttgttgtgcctgcttagcaagtgttag

SEQ ID NO: 228785 - DNA, 1077 bp, Artificial Sequence
  Description of Artificial Sequence: Synthetic coding sequence
atgcgaacctattggttgcactcggtttgggtactgggctttttcctgtctctgttcagtctgcagggacttcctgttaggtccgtcgatttcaatcgtgggacggataacatcactgtccgtcaaggtgacacagccatcctccgatgcgtggtggaggataaaaactcaaaagtagcatggctgaaccgatcggggatcatcttcgcaggccacgataagtggtccctcgatccacgggtggaactagaaaagaggcactcacttgagtattcactgaggatccaaaaggtggatgtttacgacgaagggagctacacctgcagcgttcagacccagcatgaacctaagacttctcaggtatacctcatcgtccaggtccctccaaagatatcaaacatctcaagcgatgtcacggtgaatgaaggctctaatgtaaccctggtgtgtatggctaacggcaggcctgaacccgtgatcacctggcgacacttgactcctacaggaagggaatttgagggtgaggaagaatacttagagatcctgggcataacccgggaacagtccgggaaatacgagtgtaaggctgcgaacgaggtttcaagcgctgacgtgaaacaggtgaaggtcacggtaaattatccacctacaattacagagtctaaatcaaacgaggccaccacaggcaggcaagcatctttgaagtgcgaagctagcgccgtgccggctccagactttgaatggtatcgggacgatactcgaattaacagcgccaacggattagaaatcaagtccaccgagggacagtcatcactcacagtcactaacgtgacagaggaacattacggtaactatacgtgcgtggctgccaacaaactgggcgttacaaatgctagcctggtgctcttcaaacgtgtccttcccaccataccccaccctattcaggagatcggaaccaccgttcactttaaacagaaagggcctggtagcgtacggggtatcaacggttccatctccctcgctgtgcccctatggctgttagccgcttcattattgtgcctgctttccaagtgctag

SEQ ID NO: 228786 - DNA, 753 bp, Artificial Sequence
  Description of Artificial Sequence: Synthetic coding sequence
atggcggaaggaggagcatctaaggggggaggcgaagagcctggaaagcttccagaacctgcagaagaagagagtcaggttctgaggggaacaggtcactgtaagtggttcaatgtgagaatgggattcggttttatatcgatgatcaacagggaggggagtccactcgatatccctgtggacgtgtttgtacaccaatcaaaactgtttatggaaggattcagatcgctaaaggagggagagcccgtggaattcactttcaaaaaatcttctaaaggtttagaatcaattagggtgacagggcctggagggtctccatgcctcggcagcgagaggaggcctaaaggaaaaaccctgcaaaaaaggaagcctaaaggagacaggtgttacaattgtggcggactcgatcaccacgctaaagaatgctccctacccccacaacctaagaaatgtcactactgccagagcattatgcatatggtcgccaattgccctcataaaaacgtagcacagccacccgcttcatctcaaggcaggcaggaagcggagtcccaaccctgtacctcaacgctcccccgtgaagttggtggaggccacggatgcacatcgcccccttttcctcaggaggcaagggccgagatctcggagaggagcggaaggagcccacaagaagcctccagcacaaagagttcaatcgctcccgaggagcagagcaaaaagggcccatccgtgcagaagcggaagaaaacatag

SEQ ID NO: 228787 - DNA, 2250 bp, Artificial Sequence
  Description of Artificial Sequence: Synthetic coding sequence
atggaagtggtccctgccgaggtgaatagcttgctccccgaagagattatggacactgggatcacactcgtggacgacgattctattgaggctgtgatcgttagttcgcccattccaatggaaacagagcttgaagaaatcgtcaacatcaactcaacaggagactccactgctacaccaatttctaccgagcctatcactgtatacagcaaccacaccaatcaagtggcagtcaatacaacgatcaccaaagcagactccaatactaccgtcaaacctgccttcccctctgggttgcagaagctgggcgctcagacccctgtgacaatcagtgctaaccagattattctcaacaaggtgagccagacatccgacttgaagctgggcaatcagacactgaagcccgatggtcaaaagctcatactgaccactctcggcaagtcagggtcgcccatagtgcttgccctaccccacagccagctaccacaagcacagaaggttactacacaggctcaatcgggggacgccaaactgccccctcagcagatcaaagtggtcacaatcggaggtaggcctgaggtgaagcccgtgattggtgtgagcgccctgacacccggtagccagctcataaacaccaccacacaaccctcagttctgcagacccaacagctcaaaactgtgcagattgcaaaaaagcctaggactcctacgagcggccctgtcattacaaagctgatttttgccaagccaatcaatagcaaggcagtgaccggtcagactacccaggtgtccccaccagttattgctggccgtgttcttagtcagtctacccccggaacgcccagtaaaacgattacaatttcggagagcggcgtcatcggcagcaccctgaactctacaacccagacccctaataaaattgccattagccccctcaaatccccaaacaaggccgttaagagtaccgttcagacaattacagttggtggcgtgagcacaagccagttcaagacgattattcccttagccacggcacctaacgttcaacagatccaggtccctggttccaagtttcactacgtacgcctcgtcactgccacctctgcctcgtcaagtacccaacccgtctctcagaatcccagcaccaacacccaacccctgcagcaggcaaagcctgtagtggtgaacactacaccagtgaggatgtccgtacccatagtgagcgcccaggctgtgaagcaggttgtgcccaagcctattaacccaacctctcagatagtgacaaccagtcagcctcagcagcggctgatcatgccagcaactccccttccgcaaattcagcccaacctcacgaacttacccccaggaactgttctcgctccggcaccaggcacaggaaacgtgggctacgctgtgctgccagcgcagtacgttacccagctgcagcaaagctcctacgtctcaatcgcatccaatagcacttttaccggtacgagcggaatccagacgcaggctcgcctccccttcaacggaatcatcccctctgaaagcgcctctcgcccaagaaaaccttgtaactgtacaaagtcgctctgtctgaaactgtattgcgactgtttcgccaacggagaattctgtaataattgtaattgtaccaactgttacaataatttggaacatgagaatgaacgtcagaaagcaatcaaagcttgcttggataggaatcctgaagcattcaagcctaagattgggaaagggaaagaaggagaatcagacagacgacatagcaaggggtgtaactgtaagcgtagcggatgcctgaaaaactactgcgagtgttatgaagcgaagattatgtgctccagcatctgtaaatgtattggctgtaagaatttcgaggagtccccagagagaaaaacgctgatgcacttagcggacgcggctgaggtaagggtgcagcagcaaacagccgctaagaccaaactttcgtctcaaatcagtgaccttctgacaaggcctaccccggctctcaattccggaggaggcaagctgccgtttacctttgtgaccaaggaggtagctgaggctacttgcaactgcctcctggcacaagccgagcaagcagacaagaaaggtaagtcgaaagccgcagcggagagaatgattctggaagaatttggacgatgcctgatgagtgtcattaatagtgctggcaaggctaaatcagatccttgcgccatgaattgttag

SEQ ID NO: 228788 - DNA, 732 bp, Artificial Sequence
  Description of Artificial Sequence: Synthetic coding sequence
atggaggtcgtaccagccgaagttaattctttactccccgaggaaatcatggacacggggattacattagtcgatgatgattccatcgaggcggtgattgtttctagtcccattccaatggaaaccgagctggaggaaatcgtcaacataaattccaccggcgacagcacggctacccccatttccacggagccgataaccgtctattccaaccacactaatcaagtcgccgtcaacactactataacaaaggccgactcaaacacaaccgtgaagcccgcatttccctcaggccttcagaaattaggagctcagacccctgtgacaatcagtgctaaccagatcatattgaacaaggtaagccagacgtctgatttgaagctagggaaccagacgttgaaaccagatgggcaaaaactcatactgacaactctgggaaagtctggctcacctattgtcctggctctgccgcactctcaattacctcaggcccaaaaagtcacgacacaggctcagtcaggcgatgctaaacttcctccacagcagattaaggtagtgaccattggcggacgtccggaggtcaaacctgtgattggcgtgtctgctttgactccgggttcccagctcattaataccacgacccagccgagcgtgctccagacccaacagctgaagacagtgcaggttggcttcttccacagtcttctcccagagttgcaccagcgtccttag

SEQ ID NO: 228789 - DNA, 1983 bp, Artificial Sequence
  Description of Artificial Sequence: Synthetic coding sequence
atggaggtcgtgcccgctgaggtaaacagccttctgccggaggagatcatggatacgggcatcaccctcgtcgatgatgactccatcgaggccgtcattgttagctcacccatacctatggagaccgagttggaggaaattgttaatattaacagcactggcgattccactgccactcctattagcaccgagcctataacagtctacagtaaccacaccaaccaagttgccgttaacactaccataacaaaagctgactccaacaccactgtgaagccagcttttccttcaggcctccagaagctgggggcacagacgcccgtgaccataagcgcaaatcaaattatcctaaacaaggtctctcagaccagtgatttgaaactggggaatcagacactcaaacctgacggccaaaagcttattctgacgaccctgggaaagagcggctcccctattgtcctcgccctgccgcatagccagttaccacaggcgcagaaggtgacaactcaggcccaatctggggatgctaagctaccaccccaacagattaaagtcgtaaccatcgggggacgtccggaagtgaagcctgtcatcggggtcagcgccctgacaccaggtagccagctcataaacaccaccactcagcctagtgtgctacagacacaacaactcaaaactgttcaggccgtgaagtcaaccgtccagactataacagtgggaggggtcagtacatcccagtttaagaccattatacccttggctaccgcgcctaatgtccagcagatacaggtcccagggtctaagttccattatgtgagattggtgacggcaacctcagcctcctctagtactcagcctgtgtctcaaaacccttcaacgaatacccaaccactacaacaagccaagcccgtggtggtgaatactactcctgtccgaatgtctgtcccaattgtatctgctcaggctgtaaagcaggtggtcccaaagccaattaaccccactagccagatcgtgaccacatcacagccgcagcagcgcttaatcatgccggctaccccgttgccccagatccagcccaacctaacgaaccttcctccgggtaccgtcctcgctcccgctccgggaacagggaatgtcggatacgctgtgctcccagcccagtatgtgacccagctgcagcagtccagctacgtctctatcgccagcaactcaaccttcacaggcacttcaggcattcaaacacaagcgaggcttccgttcaatggcatcatccctagcgagtccgcgagccggccaaggaagccttgtaactgtacaaaaagcctttgtctcaagctgtattgtgactgcttcgctaatggggagttctgcaataactgcaattgcactaactgttacaacaatctggagcatgagaacgagcgtcagaaagcgattaaagcgtgcctcgataggaacccggaggcgtttaaaccaaagatcggcaaaggaaaagaaggggaatcagaccgtagacactcaaaggggtgtaattgtaagaggagtggctgccttaaaaattactgcgaatgctacgaggcaaagattatgtgctcttctatttgtaaatgcataggatgcaagaactttgaggagagtcccgagaggaaaacactgatgcacctggctgacgccgctgaagtccgcgtgcagcagcagacagctgccaagacaaagctctcctctcaaatttctgacctgcttacccgcccaacccccgctctgaactcaggagggggaaagctcccgtttaccttcgtgaccaaggaggtggccgaagcaacatgcaattgtctgctcgctcaggccgagcaggcggataaaaagggaaaatcaaaagccgcagctgaacggatgatactagaagaattcggacggtgcctcatgagtgtaattaacagcgccggaaaggccaaaagtgatccctgcgcaatgaactgctag

SEQ ID NO: 228790 - DNA, 1587 bp, Artificial Sequence
  Description of Artificial Sequence: Synthetic coding sequence
atggaggtggtgccagccgagattgccaagaaacctcgcaccccaacctctggcccagtcattactaaactgattttcgccaagcccatcaactcaaaagcagtgactggccaaacaacacaggtctcccctcctgtgattgctggcagagtactcagtcagtcgaccccgggaactcctagcaaaactattaccatatcagaatcgggcgtgatcggttccactttgaacagcaccacacaaactccaaataaaattgctatttcgcctctgaagtcacctaacaaagctgtgaaatcaaccgtgcagacaatcactgtagggggagtatccacatcacagtttaaaacgatcatcccactggctaccgccccaaacgtccaacagatccaggtgccaggatcaaaatttcactatgtacgcctcgtaaccgccacatctgcatccagctctacgcaaccggttagtcaaaatcccagcactaatacccaacccctgcaacaggcaaagccagtggtagtgaataccacaccagttagaatgagtgtcccaattgtaagcgcacaagcggtgaaacaagttgtcccaaagccgattaaccctacttcccagatagtcactaccagccagcctcaacagcgcttaattatgccagctactccactgccacagattcagccaaacctgactaacttacctcccggtacagtgctcgcgcctgctccgggaacagggaacgttggctacgctgtgctgccggctcagtatgtgacccagctccagcagtctagctacgtctctattgcgtccaacagtacgttcacgggaacgagtggtattcaaacacaagcaagactaccctttaacggcattatcccatctgagtctgcatctcgcccacgcaagccttgtaactgtactaaaagtctgtgcctcaaactgtactgcgactgtttcgcaaatggcgagttctgcaacaactgcaactgcaccaattgctacaataacttggaacacgaaaatgaaaggcagaaggccataaaagcctgtctggatcgcaacccagaggcgttcaagccaaagattggaaagggtaaggaaggtgaatctgataggagacactcaaagggctgtaactgcaagcggtcagggtgccttaagaattactgtgagtgctacgaggccaaaatcatgtgcagctccatctgcaaatgtattggatgcaaaaactttgaggagtcccccgagcgaaaaacactgatgcatctggccgacgcagccgaggtcagagtgcagcaacaaaccgccgctaaaaccaagttgtcatcacagatatccgacctccttacaaggcctacaccggcattaaattccggcggtggaaagttgcctttcacattcgtaactaaggaggtggcagaagcaacatgcaactgccttctagcccaggcggagcaagccgacaagaaaggaaaatcaaaagctgccgctgagcggatgatacttgaggaattcggtcggtgcctgatgtccgtgattaattccgccggaaaggcaaaatctgacccatgtgcgatgaactgttag

SEQ ID NO: 228791 - DNA, 1587 bp, Artificial Sequence
  Description of Artificial Sequence: Synthetic coding sequence
atggaagtggtgcccgcagaaatcgcaaagaagccgaggacaccaacttccggacccgtgatcacaaagcttatattcgccaagccaatcaactcaaaagctgtgacgggacagacgactcaggtatcacctccagtaattgccggacgggttctttcccaatctaccccgggtacaccgtccaagacaataacaatttcagagagtggtgtcatcggaagtacgctgaatagcactacccagactcccaataaaattgcaatttcacccctcaagtctccgaacaaagctgtgaaatcgacggttcagaccatcaccgtagggggtgtttctacctctcagtttaagaccattattcccctggccacggcacctaacgtgcaacagatccaggtaccaggctcgaagtttcattatgtcagactggtcacagctaccagtgcttcaagtagtactcagcctgtctcccagaacccctcaaccaatacgcagcccctacagcaggccaaaccagtcgtggtcaatacaactccggtccgcatgagtgtgcctatagtcagcgctcaggccgtaaagcaggtggtgcccaagccgattaaccctacttctcagattgtaaccacatcacagccgcagcaacgactgattatgcccgcaactcctctgccacagatccagcccaatctgacaaacctgccacctgggacagtccttgctcccgcacctgggacggggaatgtgggatatgctgtgctgcctgctcagtacgtgacccagctgcagcagagcagctacgtgtccatcgcgagtaactcaaccttcacggggacctctgggattcagacacaggctcggttgccattcaacggcatcatccctagcgagtccgcaagccgtcctcgaaagccatgtaactgcaccaagtctttgtgtctgaaactatattgtgattgtttcgcaaacggagaattttgcaacaactgtaactgtacaaactgttataacaatctggagcacgaaaatgaacgacaaaaggctattaaggcttgtctcgatcgaaatccagaagcttttaaacctaaaataggcaaggggaaagagggtgaaagcgatcgcaggcatagtaaagggtgtaactgcaaaagaagcggatgcttgaagaattactgtgagtgttatgaggcaaagatcatgtgctcgtctatttgcaagtgcattggatgcaagaattttgaggaatccccggagcggaagacactcatgcatctcgccgacgctgccgaagtgagggtgcagcagcagactgctgccaaaaccaaattatcctctcagatatcggacctgctgactcggcctactcctgcactgaatagtgggggaggcaagctgcccttcacattcgtgactaaagaggtggccgaggccacttgtaactgtctgttggcccaggctgaacaggctgataaaaaaggcaagtcgaaagctgctgcagaacggatgatcttggaagaatttggaagatgtctcatgtcagttatcaacagcgctgggaaggccaagagcgacccttgcgccatgaactgctag

SEQ ID NO: 228792 - DNA, 2250 bp, Artificial Sequence
  Description of Artificial Sequence: Synthetic coding sequence
atggaggtggtcccggcagaagtcaacagtctgttaccagaagaaataatggacaccggcatcactttagtggacgacgactcaatagaagccgttatcgttagctctcccatccccatggagaccgagttagaggaaatcgtaaacatcaactccacgggcgactccactgccacccctatcagtacagagcctattactgtatattcgaatcatactaatcaggttgccgtgaacactaccataactaaggccgactctaatactacggtaaagcctgccttcccttccggtctccagaagctaggcgcacagacacccgtgacaatctccgccaaccagatcatcttgaacaaagtgagccagacttcggacttgaagcttggtaaccagacactgaaacctgatgggcagaagctgattctgacgacactcgggaagtctggtagcccaattgtcctggccttaccccacagccagctgcctcaggcacagaaagtgaccacacaagctcagtcaggggacgccaaattgcctccccagcagattaaagttgttacaatcgggggacgaccagaggtcaagccagttatcggcgtgagtgcactgactccgggaagtcagttgataaatactacaacccagccttctgtcctacaaacacagcagctgaagaccgtgcagatcgcaaagaagcctaggacccctaccagcggccctgtcatcactaaacttattttcgcaaagcccatcaactccaaagcggttactggccagactacacaggtgtcccctccggtgattgccggtagggtgctcagtcagagcacgcccggaacccctagtaaaacaataactatctccgagagcggagttatcggttccaccttaaacagtaccacccaaacacctaacaaaatagccatttcacccttgaaatctcccaacaaggccgtgaaatcaactgtgcagacgataaccgtcgggggtgtgagcacttcacaatttaaaacaatcatccctctggcaaccgcgcctaatgtccaacagatccaggtccctggatcaaagtttcattatgttagactcgtgaccgcaacttctgcctccagttctacacaaccagtatcccaaaacccctcgactaatacccaaccgctccaacaggccaagccagtggtggtcaacaccactccggtgcgaatgagcgtccctatcgtgtcggcccaagccgttaaacaggtcgtgcccaagcctatcaatccgacgagtcagatagttacaacttctcagccacagcagagattgatcatgccagcaaccccactgccacagattcaacctaacctcacaaacctccctcccggaacagtcttggctccagctcccggtacagggaatgtgggatacgccgtgcttcccgctcagtatgtaactcaactgcaacaatctagctatgtttcaatagcgtccaactccacgttcaccgggacttcaggtatccaaacacaagcaaggttgcctttcaatggcataatcccctccgaaagcgcatccaggccgagaaagccgtgcaactgtacaaagtccctgtgccttaagctctattgcgactgctttgcgaatggagaattctgtaacaactgtaactgtaccaactgctataataacctggaacacgaaaacgagcgacagaaggctattaaggcatgccttgataggaatcctgaagcgtttaaaccaaagattggcaaagggaaggagggcgagagtgaccgccgacacagcaaagggtgcaactgtaagaggtctggatgtctgaagaactactgcgagtgctacgaagccaaaattatgtgctccagtatatgtaagtgcattgggtgcaagaactttgaggagtctcccgagcgcaaaacactgatgcacctggcagatgccgctgaggtgcgggtgcagcaacagaccgccgcaaaaactaaactttctagccaaatatccgacttgcttacaaggcccacccctgcattgaacagcgggggtggcaaactccccttcaccttcgtaacaaaagaagtggccgaggccacctgtaactgcttgctggcccaggctgagcaagccgataagaagggcaagtccaaggccgctgcggagcgcatgattctcgaggagttcgggcgttgtttgatgtctgtgatcaactccgctgggaaggctaaaagtgacccttgtgccatgaactgctag

SEQ ID NO: 228793 - DNA, 1587 bp, Artificial Sequence
  Description of Artificial Sequence: Synthetic coding sequence
atggaggtagtacctgccgagatcgccaagaagcccagaaccccaacgagcggacccgtgatcaccaagctgatttttgcaaaacctattaactctaaagcagttactgggcagaccacccaggttagtccgccagtgattgcaggacgggttttatctcaatcaacacctggtacgccctccaaaacaatcacaatctcagaatccggggtgatcggaagcaccctgaattctacaactcaaacaccaaacaaaatcgccatcagcccgctaaagtcgcctaataaagccgtgaaatcgaccgtccagaccatcaccgtcggcggtgtaagtacgagccaattcaaaactatcattccactcgcgaccgctcctaatgtgcagcagatacaagtgcctggcagtaaattccactatgtgagactggtcactgccactagcgcgtccagctcaactcagccggtctcgcagaatccttcgacaaacacgcaacccctccagcaagccaagccggtcgtcgtaaatacaacgccggtgaggatgtctgtgcctattgtcagcgcccaggccgtcaaacaggtggtaccaaagccaattaaccccacttcccagatagtgactacctcccagcctcagcagcgcttgataatgcctgcgacacccctgccccagatccagcccaatctgaccaacctgccccctggcacagtgctggcccctgcgccagggacgggaaatgtaggctacgctgtgctgcccgctcagtatgtgacgcaattgcagcagagctcctacgtttcaatcgctagtaacagcacattcaccggcacctcgggaatacagactcaggcacgactgccgttcaatggcatcattccttctgaatcggcaagtaggcctagaaagccatgcaattgtaccaaatccctgtgcctgaaactctactgcgactgcttcgcaaacggcgaattttgcaataactgtaactgtactaactgctacaataatcttgagcacgagaacgaaagacagaaagctattaaggcctgtctggaccggaaccccgaagctttcaagcctaagataggtaagggtaaagagggcgaaagtgataggcgccattctaagggatgtaactgtaaaagatctggctgtttaaagaattactgcgaatgttacgaagccaaaataatgtgttccagcatctgcaaatgcatcggctgcaagaactttgaagagagcccagaaaggaagacactgatgcatttagctgatgccgctgaggttagggtccagcaacaaacagcagcaaagactaaattgtcttcacaaatctctgacctgctgacccgaccaactcccgctttgaactccgggggaggaaagctgccctttaccttcgttacaaaggaagtggccgaagccacctgtaactgtcttctggcccaggcagagcaggctgataaaaaaggaaagtcaaaagctgctgcggaaagaatgattctcgaggagtttggcagatgccttatgagcgtgattaacagtgctggaaaggccaagtccgatccatgcgccatgaactgttag

SEQ ID NO: 228794 - DNA, 2025 bp, Artificial Sequence
  Description of Artificial Sequence: Synthetic coding sequence
atgtggcacgaggcccgtaaacatgaacgtaaactcagaggcatgatggtggattacaaaaaaagagcagagaggcgcagggagtactatgagaagattaagaaggatcccgcacagttcctccaggttcatggaagggcatgtaaggttcacctcgactcagctgtagcgctagccgctgagtcacctgtgaacatgatgccctggcagggcgataccaacaatatgatcgacagatttgacgtacgggcacacctggatcacataccggattatacgcctccactccttacaaccatctcccccgaacaggaaagtgacgaacgtaaatgcaactacgaacggtataggggtctggtgcaaaacgactttgccggaatctccgaggaacagtgcctttaccagatctacattgacgaactttacggaggccttcagaggccctcggaagacgaaaaaaaaaagttagctgaaaagaaagcttcaattgggtatacatatgaagactccaccgtggctaaagtcgagaaagccgcagagaagccagaggaagaagaatcagccgcagaggaggagagcaactcagatgaggacgaagtcatcccggacatcgatgtcgaggtggacgtcgatgagcttaatcaggaacaggtcgccgacctgaataagcaggccacaacctatgggatggctgatggtgattttgttaggatgctcagaaaggataaagaggaagcagaagcgatcaagcacgccaaagctcttgaggaagagaaagccatgtactccggccgtcgctcgagacgacagagacgggagttccgtgaaaaaaggttgagagggaggaagatctcgcctcctagttacgccaggcgggacagcccaacatatgacccttacaagcgctcaccttctgagtctagctctgaatcacggagcaggtcacgtagcccaacacccggacgggaagaaaagatcacatttatcacttcattcggcggttctgacgaagaagctgcagccgcagccgcagccgcagccgcttcgggcgtgaccaccggaaagccgcctgcgccaccacagccagggggtcctgctccgggacgcaacgcttcggctcgacgcaggagcagtagcagcagttcatctagcagcgcatcccgtaccagcagcagtcgtagttcatcgagaagtagctcacggtctaggagagggggtggctattacagatctggtagacacgcccgttccagatctcgctcttggtcaagaagccggtctcgaagcagacggtattctcgatcaagatctcgtggacggagacactccggaggcggtagtagagatgggcatcgatacagcagatctcccgcacggaggggcggatacggacccaggcgcagatctcgaagccgtagccactctggcgatcgatacaggagagggggtcgaggtctgcgccatcacagctccagccgtagtcgctcaagctggtccctcagccccagcagatcacgatccctgactaggtcccggagccactcgccctccccctctcagagtcggtcaagatcacggagcaggtcccagtcccctagtcctagtcctgccagagagaaactgacacgacctgcagcctcccccgctgtcggggagaagctcaagaaaaccgaacccgcagctgggaaagagacaggcgctgccaagccaaagctgactccccaagagaaattgaagcttcgcatgcagaaagccctgaatcgacagtttaaagccgataagaaggctgcccaagagaaaatgattcagcaggagcatgagcgacaagaaagggaggatgagttacgggctatggccaggaagatccgtatgaaagaacgggagcgcagggagaaagagcgggaggaatgggagcggcagtactcacgtcagtcgaggtctccatcgcctagatatagccgggagtactcgagttcaagaagacggtccaggtctaggtcccgctcacctcactataggcactag

SEQ ID NO: 228795 - DNA, 594 bp, Artificial Sequence
  Description of Artificial Sequence: Synthetic coding sequence
atggccgctctcggtgagccagtacgcctggaacgcgacatctgccgggctatcgagctgttagagaagctgcaaaggagcggcgaagttcctccccagaagctgcaagccctgcagagagtccttcaatcagaattttgtaacgcagtgcgcgaggtttatgaacatgtgtatgagactgttgatattagctcaagcccggaagtgagggccaacgccacagccaaggccaccgtggccgcatttgcagcaagcgagggacactcccacccccgtgttgttgagctgcctaagaccgaggaaggcctaggctttaatattatgggaggaaaagagcaaaactcaccaatttatatctcacgcataatcccaggcggaatcgcagacaggcacggcggactgaaacgaggggatcagctgttgtccgttaatggggtgtccgtggagggcgagcaccacgagaaagctgtagaactcttgaaagccgctcaaggcaaggtcaagctggtggtgcgctacacacctaaggtgctggaagagatggagagcaggtttgaaaaaatgcgttccgctaaaaggaggcaacaaacttag

SEQ ID NO: 228796 - DNA, 759 bp, Artificial Sequence
  Description of Artificial Sequence: Synthetic coding sequence
atggaagaggcgatcctagtcccatgtgttctgggacttctgcttcttcctatcctggcgatgctgatggctttatgcgttcattgtcaccggttaccgggaagctacgattcaacgtcatccgactcgctatatccacggggaatccagtttaagcggcctcacaccgtagcaccctggcctcctgcttatccccctgtgactagctacccccctctgtcacaacccgacttgctgcctattcccaggtcaccacagccccgacgggactctgacggagcgaacagtgttgcctcttacgaaaacgaaggagcctctggtattcgcggtgctcaggctggatggggcgtctggggcccttcttggacgagactcacccccgtctctctcccgccagagcccgcttgcgaagatgcagacgaggatgaggacgactaccataaccccggttacctggtggtgctccccgattccacacccgctacttcgacggctgccccttctgccccagcgttatctacccccggtattcgggactcagccttctcaatggagagcattgacgactacgttaatgtaccggaatccggggagtccgccgaagccagtctcgacgggtcccgggaatacgtgaacgtttcacaggaacttcatccaggagctgccaagactgagcctgctgctctcagttcccaagaagcagaggaggtggaggaagaaggcgcacccgactacgaaaacctgcaggaactgaattag

SEQ ID NO: 228797 - DNA, 789 bp, Artificial Sequence
  Description of Artificial Sequence: Synthetic coding sequence
atggaagaggctatcctggtaccgtgcgtcctgggactccttctgctgccaatcttagcgatgctgatggcactgtgtgtccactgtcatcgcctaccaggctcttacgattctacctcttctgacagtctgtaccctagaggtattcagttcaagcggccacataccgtggccccatggcctccagcataccccccagttacaagctatccaccgctctcccaacctgacctgctgcccatacccaggagtccgcaacctcttggtggcagccatagaaccccctctagcagacgagacagcgatggcgcaaactccgtcgctagctacgaaaacgaaggagcttctgggatcaggggcgcacaggctggatggggcgtgtgggggccatcctggaccagactaaccccggtgtcactaccaccggagccagcttgcgaggatgctgatgaggacgaggacgactatcacaatccaggatatcttgtggttctaccagactcaacacccgcaacgtccactgcggctccaagtgccccagctctttctacgccaggaatccgcgatagtgccttcagcatggagagcatcgacgattatgtgaacgtgccggagagcggtgaatctgccgaggcgtccttggacggaagccgcgagtatgtcaacgtgtcacaagaactgcatccaggcgcagcaaaaaccgagcctgctgcccttagcagccaggaagccgaagaagtcgaagaggagggcgctccagattatgaaaacctgcaggagttgaactag

SEQ ID NO: 228798 - DNA, 702 bp, Artificial Sequence
  Description of Artificial Sequence: Synthetic coding sequence
atggaagaagctatactggtgccatgcgtgctcgggctgctgctgttacccattctggctatgttgatggctttatgcgtccactgccacaggctgcccggaagttacgacagcacttccagcgactccctgtacccccgaggtatccaattcaagagaccgcacaccgtcgctccatggcctcccgcataccccccagtgacctcttacccgcctttgagtcagcctgacttgttacctattccaagatccccacagcccctgggcggatcacacagaacaccgtcctctagacgcgattctgatggggcaaatagcgtggcctcttatgagaatgaagaacctgcatgcgaggatgctgatgaggatgaggatgattaccataaccccggatatctcgttgtgctgccagatagcacccccgcaactagcacagccgctccatccgcacccgcactctccacacccggaattcgagatagcgccttttccatggagtctattgatgactacgtcaacgttccagagagtggtgagagcgctgaagcgagtctagacggcagcagagaatacgtaaacgtgtcgcaagaactgcaccctggagccgctaaaactgaacccgcagccctgtctagccaggaggccgaggaggtggaggaagaaggcgctcccgattatgaaaatctgcaggagctgaactag

SEQ ID NO: 228799 - DNA, 810 bp, Artificial Sequence
  Description of Artificial Sequence: Synthetic coding sequence
atggaggctaccgctgcgtcctggcaagtggctgtgcctgtcctgggtggtgccagccgccctctgggcccacgaggggctgccagtttgcttagggcaccattgcagatggaagaggccattctggtgccatgtgtcttaggactcctgttgctacctatcctggccatgctgatggccctgtgtgtccactgccaccgcctgcccggatcctacgactcaactagctccgacagtctttacccaagaggtatacaattcaagaggccgcatacggttgcgccatggccaccagcctatccgccagtgacctcataccccccactaagtcagcctgatctgctgcctatcccaagatcgccgcagccgctgggagggtcccacagaactcccagctccaggcgggattcggatggcgctaacagcgtggcatcttatgagaacgaagaacctgcttgcgaggacgctgatgaggacgaggatgactatcataatcctgggtacttggtcgtcttgccagactccacgccggcaacaagcactgccgctccaagtgctcccgctctgagcacacccggaattcgggactcagccttttctatggagagcattgacgactacgttaacgttcctgagtcaggagagtcagcagaagccagtctggacgggtccagggaatacgtgaatgtttcacaggagttgcaccccggagccgctaaaactgagccggctgccctatcctctcaggaagcagaagaggtcgaggaggagggcgctccagactacgaaaacttacaagagctgaactag

SEQ ID NO: 228800 - DNA, 699 bp, Artificial Sequence
  Description of Artificial Sequence: Synthetic coding sequence
atggaagaagctatactcgtcccttgcgtgctcggcctcctgctgctgccgatactcgccatgcttatggccctgtgcgttcattgtcaccgactccctggatcctatgatagcacatccagtgactcgctgtacccacggggaattcagttcaagagaccccacaccgtcgctccgtggccccctgcctacccacccgttacgtcatacccccctcttagccagcctgatctcctccccatcccaagccctcagcctctggggggatctcatcgcacaccttcaagcaggcgcgactccgatggagcgaacagcgttgctagctacgagaacgaggaacctgcttgtgaggatgccgatgaggatgaagatgattaccataaccccggataccttgtcgtgctgcctgatagtactcccgctacttccacagctgcaccctcagcaccggctctgtcaactcctggaatacgagatagcgccttcagtatggagagtatcgatgattacgtcaatgttcctgaatctggagagagcgcagaggcaagtctcgacggttcgagggagtatgtcaatgttagccaagaacttcaccccggtgctgccaaaaccgaacctgcggcactgagttcacaagaggccgaagaagttgaggaggaaggcgctcccgactatgagaacctccaggaactgaactag

SEQ ID NO: 228801 - DNA, 732 bp, Artificial Sequence
  Description of Artificial Sequence: Synthetic coding sequence
atgagttcaggcacagagcttctgtggcctggtgccgctttgctggtgttattaggcgtggccgcttcactgtgtgtccgatgttcgaggcctggggctaaacgcagcgaaaagatttaccagcaacggtccctgcgggaggatcagcagtcattcaccgggtccaggacctactcattggtgggacaggcctggcccggacctctggccgatatggcacccaccagaaaagacaagcttcttcaattctatccaagcttggaggacccagccagctctaggtaccagaacttcagtaaggggtccaggcacggctctgaagaagcctacatcgacccaattgccatggaatactacaactggggcaggttttctaagcctcccgaagacgacgatgccaacagttatgagaacgttctgatttgtaagcaaaagaccactgagactggcgctcagcaggaaggcataggtggattatgccgcggagacctgtccctgtctcttgcactcaagactggacccacaagcgggctgtgtccgtctgcctcccctgaagaagatgaggagtctgaagattatcagaattctgcctccatccatcagtggcgggaaagtcgaaaggtcatgggtcagcttcagcgagaggcatcacctgggcctgtggggagcccggatgaggaggatggcgaaccagattatgtcaatggggaggttgctgcgaccgaagcctag

SEQ ID NO: 228802 - DNA, 732 bp, Artificial Sequence
  Description of Artificial Sequence: Synthetic coding sequence
atgtctagtgggacagagctcctctggcctggggctgcactcctcgtcctacttggggtggcagcatcactgtgcgttaggtgtagtagacctggagccaagcgctccgaaaagatctaccagcaaagatcactgcgggaagaccaacagtccttcacggggtctcgtacatatagcttagtgggccaggcctggcctggacccttggcagatatggctcctactcgcaaggataaattgctgcagttttaccctagcctggaggatccggcatcctctagataccagaattttagcaaaggcagccgccacggttccgaggaggcctatattgaccccattgccatggagtattataactgggggaggttcagtaaaccgccagaggatgatgacgcaaattcctatgagaacgtgctgatttgcaagcagaaaacaaccgagacgggtgctcaacaggagggcatcggcggactttgtagaggcgacttgtccctatcactggcattgaaaactggacctacaagtggcctatgcccctcagcaagtcccgaagaggacgaagagagcgaagattaccaaaattccgcttctatccatcagtggagagagtccagaaaagtgatgggccagctgcagcgggaagctagtcccggaccggtgggctctcctgatgaggaggacggggaacccgattacgtcaacggcgaagtcgcagctaccgaggcctag

SEQ ID NO: 228803 - DNA, 195 bp, Artificial Sequence
  Description of Artificial Sequence: Synthetic coding sequence
atgagttcgggcactgagctgctctggcccggtgccgcacttctcgtgttgcttggggtcgctgcgtccctctgcgtcaggtgttccagaccaggggctaaacggtcagagaagatctatcaacagcggagtcttcgcgaggatcagcaatccttcaccggcagccgaacctactccctcgtagggcaggcttag

SEQ ID NO: 228804 - DNA, 732 bp, Artificial Sequence
  Description of Artificial Sequence: Synthetic coding sequence
atgtcgtccgggactgaattgttgtggcctggggctgctctgttggtgctgctgggagtagcagcttctctctgtgtccggtgcagtcggcctggcgcaaaacgctcagaaaagatctatcaacagcgctccttgagggaggatcagcagtcctttaccgggagccgcacatattctttggtaggacaagcctggcccggaccactggcggatatggctccaacccggaaagataagcttcttcagttctatcccagcctcgaagaccctgcaagctctcgttaccagaattttagcaaaggaagtagacatgggtcagaggaagcttatatcgacccaatcgccatggaatactacaactggggtagattctctaagccccctgaagacgacgatgctaacagctatgagaacgtgttaatttgcaaacagaagacgacggagaccggagcacaacaggagggaattggcggactgtgccggggagacctcagtttgtcccttgccctgaaaactggacctaccagtggactctgcccctctgcctctcccgaggaggatgaagaatccgaggactatcagaattctgcgtctatccatcagtggagggaatctagaaaagtgatgggccaactgcaacgggaggcctctcccggaccagtgggatctcccgacgaggaagatggcgagcccgactatgtgaatggtgaggtggccgcaactgaggcctag

SEQ ID NO: 228805 - DNA, 732 bp, Artificial Sequence
  Description of Artificial Sequence: Synthetic coding sequence
atgagctctgggacagaactcctatggcctggggctgcactcctcgtcctgttaggggtggcagcgtccctttgcgttcgctgctcaaggcccggtgctaagaggtcggaaaaaatttaccagcagcgcagccttagggaggatcagcagtcctttactgggtctaggacttattccctggtgggacaggcttggccgggtccactggccgacatggctcctacccgcaaagacaagctgctgcaattctacccttccctcgaggaccccgcttctagtcggtaccaaaacttcagcaaggggtctaggcatggcagcgaagaagcctacatagacccaattgccatggagtattacaattggggccgattctccaagccaccggaggacgacgacgctaattcttacgaaaacgtgctgatttgtaagcagaagactacagagacaggcgcacaacaggagggcattgggggtctttgccgaggcgatctatcgttgtctctcgccctgaaaacaggtccaacttccgggctttgcccctctgcatcacccgaggaggatgaagaaagcgaagattatcagaactcagcctctatccatcaatggcgtgaatctagaaaggtaatgggccagttgcagagagaagcatctcctggtcccgtaggctcgcccgatgaggaggacggtgagccagattacgtaaacggggaggtcgcagcaactgaagcatag

SEQ ID NO: 228806 - DNA, 177 bp, Artificial Sequence
  Description of Artificial Sequence: Synthetic coding sequence
atgtcttccggaaccgaactcctgtggccaggagcagctcttctcgttctgttgggagtcgctgccagtctctgcgtaaggtgttccaggcctggggctaagagatctgaaaagatctatcaacagcggtctttaagagaggatcagcagtcattcacaggcagtagaacctactag

SEQ ID NO: 228807 - DNA, 303 bp, Artificial Sequence
  Description of Artificial Sequence: Synthetic coding sequence
atgtcctccggtactgagctcctgtggccaggtgcagctctgctggttctgctgggcgtcgccgcttcactctgcgtccgatgcagcagaccaggagcgaagaggagcgagaagatttatcaacagcggagtctgagagaggaccaacaaagcttcacaggcagtaggacatactctttagtgggccaggcctggcctggacctttggctgacatggctcctacaaggaaagacaaacttcttcagttctacccatcactcgaggatcccgcaagcagccgttaccaaaacttcagtaagtag

SEQ ID NO: 228808 - DNA, 1704 bp, Artificial Sequence
  Description of Artificial Sequence: Synthetic coding sequence
atgaggcctgattctcctacaatggccgctcccgctgaatcccttagaagaaggaaaacaggctatagcgacccggagcccgagtcgcccccagcgccaggccgaggcccagccggatccccagcacaccttcatacaggaacattctggctgactcggatcgttctcttgaaggccctggcattcgtgtatttcgtggcattcctcgtggcttttcaccagaataagcagctaatcggtgataggggacttttgccttgccgggtgttcctcaaaaattttcagcaatacttccaagaccggacctcctgggaagtgtttagctatatgcccactatcctctggcttatggactggtccgacatgaatagcaatctggacctgctggcattattgggactgggaataagctccttcgtccttattaccgggtgtgctaatatgcttttgatggctgccctatgggggctttacatgtccctagtaaatgtaggccatgtttggtatagtttcgggtgggagagtcagttgttggagactggatttttaggcatcttcctgtgtccattatggactttgagcaggctgccccagcacacccctactagccggatcgtgctgtggggcttcaggtggctgatttttcgtatcatgttgggcgcaggcttaatcaaaattcgcggtgataggtgctggcgtgacctgacgtgcatggactttcactatgaaactcagccaatgcccaatccagtggcgtactatcttcatcacagtccgtggtggttccaccgcttcgagactctgagcaatcacttcatcgaactattagtgccgtttttcctattcctaggtcgcagggcttgcattattcacggtgtactccaaatcctttttcaggctgtgcttatcgtgtctggtaatctgagcttcctcaactggctcaccatggtgccatccctcgcgtgcttcgacgatgcaacactgggcttcctcttcccctctggccctggcagcctgaaagaccgagtcctccagatgcagagggatatcagaggtgcccgtcccgaaccacgcttcggtagcgtggtgagacgagcagctaatgtttcactcggcgtactgttggcatggctctccgtccctgtcgtactgaatctcttgagtagccgccaagtgatgaatacacattttaattcgttgcacatcgtcaatacctatggagcgttcggttcaatcactaaagaaagagccgaagtgattctgcaaggcacagcatccagtaatgctagcgcacccgacgcaatgtgggaggattacgagtttaagtgcaagcctggcgatccgtcccgtcgaccctgcctgatcagtccgtaccactacaggttggattggttaatgtggttcgccgcttttcagacttacgagcataatgactggatcatccatcttgcgggtaagttgctagccagcgatgcggaggcactgagccttctcgcccacaatccctttgcaggcagaccgccaccacgctgggttcgcggagagcactatcgctacaaattctcacgtccaggtggacggcatgctgctgaggggaaatggtgggtgcggaaaaggatcggcgcatactttccgcctttaagtctggaagagctgcgcccttactttagggatcggggttggccacttcccggaccgttgtag

SEQ ID NO: 228809 - DNA, 1704 bp, Artificial Sequence
  Description of Artificial Sequence: Synthetic coding sequence
atgagacccgacagtccaaccatggctgcaccagcagagagcctgaggaggagaaaaaccggatactccgatcccgaacccgagagcccaccagctccaggacgtgggcctgctggaagccccgcacaccttcacaccggcactttctggttaaccaggatcgtactactgaaggcgctagcctttgtgtacttcgtggcctttctcgtggcattccaccaaaataagcagctaattggagatcgagggctgttgccgtgccgcgtctttctcaagaatttccagcaatactttcaggaccggacgtcctgggaagtgttctcttacatgcccacgattctctggcttatggattggtccgacatgaactccaaccttgaccttctcgcgctcctgggcctgggaatcagctcctttgtgttgatcaccggatgcgctaatatgcttctgatggctgccctgtggggattgtatatgagtctcgtaaacgtgggtcacgtttggtactcttttagatgggagagccaactgttggagaccgggttccttgggatctttctgtgtcctctgtggacactgtccagattgcctcagcacacccctacctcgcgcatcgtgctgtggggcttcaggtggctgatttttcgaatcatgctaggggcagggctgataaaaatccgcggagaccgctgctggagggatctcacgtgcatggacttccactatgagacacaacccatgcccaatccggttgcctattatctacaccactcaccatggtggttccatcggtttgaaactctgtcgaaccatttcatcgaactgctcgttcccttctttctgtttttaggcaggcgcgcttgcataattcacggcgtgctgcagatcctgtttcaggccgtcctgattgtgtcaggcaatttgtccttcctaaactggctgacaatggtacctagtctggcatgttttgacgacgccaccttgggcttcctgtttccctcaggtccaggcagcttaaaagaccgggtgcttcagatgcagagggatattaggggggcacgtcccgaacctcgattcggcagcgtggtacggagagccgctaatgtctctttgggcgtgcttctggcctggctctctgtgcccgtggtgctgaacctcctgagcagtcgccaggtgatgaatacacatttcaattctttgcatatcgtcaacacctatggcgcattcggatccattacgaaggagagagctgaggtgattctgcagggcacagcttcctctaatgcttccgcacccgatgccatgtgggaagattacgaatttaagtgcaaacctggcgaccctagtagacgcccatgtttgatttccccgtaccactatagactggactggttgatgtggttcgctgccttccagacatacgagcacaatgattggatcatccatctggctggcaagcttcttgccagtgatgctgaggcactgtcactcctggctcacaaccccttcgcaggcaggcctccgcctaggtgggtgagaggtgagcattaccggtacaaattctcccgtccaggcggtcgccacgccgctgagggaaagtggtgggtgcggaagcggattggggcttatttcccacctttgtcactcgaggaactgcgcccatactttcgcgaccggggatggcctctaccgggtccactatag

SEQ ID NO: 228810 - DNA, 558 bp, Artificial Sequence
  Description of Artificial Sequence: Synthetic coding sequence
atgcgccctgattctccaacaatggccgcacctgccgagtccctccggagaagaaaaacaggatacagtgaccctgagcccgaaagcccgccagctccaggcaggggtccggcaggtagtcccgcacaccttcataccggcacattttggctgacacgcatcgtgcttctcaaggcacttgcctttgtctactttgtagcgtttctggtggccttccaccagaataaacagctaatcggcgatcgagggctactcccttgccgtgtctttctcaaaaattttcaacagtatttccaggatcggaccagttgggaagtgttctcttatatgcccactattctgtggctgatggactggtctgacatgaactcaaacttggacttgcttgctctactgggtctggggatctccagcttcgtcctgatcactggctgtgccaacatgctccttatggcggcactgtggggattatacatgtcactggtgaatgtgggccacgtgtggtgcccatccctggcgtcggctataagtcttccttcaatgcacggcggtcagtag

SEQ ID NO: 228811 - DNA, 501 bp, Artificial Sequence
  Description of Artificial Sequence: Synthetic coding sequence
atggcagcacccgcagagtcccttcgcagacgaaaaaccgggtactccgaccctgagcccgagtccccacccgctccagggagagggccagcaggttctcctgcacacctgcataccggaaccttctggttgacgaggattgtcctgctgaaggcattagcttttgtgtattttgtggcatttctggtcgcctttcatcagaataaacagttaatcggggatcgcggtctgttaccatgcagagtctttttgaaaaatttccagcaatattttcaggatcggacctcttgggaagtctttagttacatgccaactatcctgtggctcatggattggtccgacatgaatagcaacctcgacctgttagcccttctgggacttggaatcagcagctttgttcttatcacagggtgcgccaacatgcttctcatggccgctctttgggggctatacatgtcactcgtaaatgtcggccatgtctggtattctttcggcaagtag

SEQ ID NO: 228812 - DNA, 1053 bp, Artificial Sequence
  Description of Artificial Sequence: Synthetic coding sequence
atgcgaggggctgggctgatcaagatcagaggcgatagatgttggcgggatttgacgtgcatggattttcactacgagacacagcctatgcccaatcctgtggcttattacttgcaccatagtccctggtggttccaccggtttgaaacccttagtaatcacttcatcgaattgctcgtccccttcttccttttcctgggacgcagggcttgtattatccatggagtcctgcagatcctgtttcaagcagtgctcatagtttcaggcaatctgagctttctgaactggctaaccatggtgccaagcctggcctgttttgatgatgccactctggggtttctgtttcccagtggcccaggttccttgaaggacagggttctgcagatgcaaagagacatccggggagctcgacctgagccaagatttggctccgtggtgcgcagggccgcaaacgtttctctgggcgtgctcttggcttggctgtccgtccctgtggtattgaatttgctcagctctcggcaggtgatgaacacacacttcaactcactccacatcgttaatacttatggagccttcggctccatcaccaaagaacgagccgaggttattttacaaggcacggccagcagtaatgctagcgcaccagatgcgatgtgggaggattacgagtttaagtgtaaacctggagacccaagccgcagaccatgcttaatatccccttatcattaccgactcgactggctgatgtggtttgccgcatttcagacctacgaacacaacgattggattattcacctcgctggtaagctcctggcaagcgatgcagaggccctcagtttactcgcgcacaacccattcgcgggacggccaccaccgagatgggtgcggggagagcactatcggtacaagttctcacgccctgggggacgccacgctgcagaaggcaaatggtgggttagaaagaggatcggcgcatattttccacccctgtctctggaggaactcagaccttattttcgagaccgtggttggcccctgccaggtcccctttag

SEQ ID NO: 228813 - DNA, 993 bp, Artificial Sequence
  Description of Artificial Sequence: Synthetic coding sequence
atggactttcattacgagacacaacccatgcctaaccccgtggcgtactatctgcaccattctccgtggtggttccacagatttgaaacactctcaaatcacttcatcgagctgttggttccattcttcctgttcctaggaaggcgcgcatgcatcattcatggggttctgcagattctgtttcaggctgtgctcatcgtgagtggaaacctgagttttcttaactggttgacaatggtgccttccttggcctgctttgatgatgccactctgggctttctattccccagcggaccaggaagcttgaaggacagagtactccagatgcagcgtgatattaggggcgctcgcccagagccacgcttcggaagtgtcgtcagacgcgctgcgaacgtgtctttaggggtgctgttggcgtggttgtcagtgcccgtcgttttaaacctattatcatcaaggcaggtgatgaacacacatttcaattctctccatatcgtgaacacctacggtgcattcggcagcatcacgaaggagcgcgcagaggtgattttgcagggcaccgcaagttccaacgcttcggctcccgatgccatgtgggaggactacgagtttaaatgtaaaccaggagatcccagtagaaggccctgcctcatatctccataccactatcgcctagattggttgatgtggtttgctgcattccagacatacgagcacaatgactggattatccacctagctgggaagctcttggcatccgatgccgaagccctctctctgctcgcccataatccatttgctgggagacctccacctcggtgggtcagaggagagcactatcgctacaaattttcacgccctggcggaaggcatgcagctgaggggaaatggtgggtgaggaaaagaattggagcgtactttccaccattgagcctggaggaacttcggccttacttcagagatcgcggatggccacttcccggacccctatag

SEQ ID NO: 228814 - DNA, 792 bp, Artificial Sequence
  Description of Artificial Sequence: Synthetic coding sequence
atgcctaacccagtggcctattatctgcaccactctccttggtggttccataggttcgagaccctcagcaatcattttattgagctgctggtgccttttttcttgtttctcgggcgacgagcctgtatcatacacggagtcctacaaattttattccaggccgttctgatcgtgtcagggaatttgtccttccttaattggttgacaatggtgccatccctagcctgctttgacgatgccacattgggcttcttatttccaagcggccctggcagtctaaaggatcgagtcctgcaaatgcagcgcgatatcagaggcgctagacccgagccaaggtttggttcggtagtgagacgcgctgccaatgtctcgctcggcgttcttctcgcctggctctcagtcccggtagtcctaaatctgctgtcttctcggcaggtcatgaatactcattttaacagcctccacatcgtgaacacatacggggcattcgggtcgatcaccaaggagcgcgctgaagtgatactgcagggcaccgcctccagtaatgctagtgctccagatgccatgtgggaggactatgaatttaaatgcaagcccggagacccaagtagaaggccatgcctcatcagcccttatcactatagacttgactggctgatgtggttcgccgcattccagacctatgagcataacgactggattatccacctggccggtaaactgctggcatcagatgctgaagccctctccctgttggcgcataacccctttgccggaaggcccccaccttag

SEQ ID NO: 228815 - DNA, 1503 bp, Artificial Sequence
  Description of Artificial Sequence: Synthetic coding sequence
atgtccaacagtgtgcctcttctctgtttctggagcctgtgctattgtttcgccgcaggcagtccggttccttttgggccagagggtcggctggaggataagctgcacaagccaaaggccacacagaccgaagtcaaaccttcagtccgattcaacctgagaacatctaaagatccagagcatgagggttgctatctctccgtaggccattctcagcctttggaagactgtagttttaacatgaccgccaagaccttttttattatccacggctggacaatgagtggaatttttgaaaactggcttcacaaactggtctccgccttacacactagggagaaggatgccaacgtggtagtggtcgactggctccctctcgcccaccagctctataccgacgccgttaacaacacacgagtggtaggccacagtattgccaggatgttggattggctgcaggagaaggacgatttctccctggggaacgtccatctcatcggctactcactaggagcccacgtggcagggtatgccggaaacttcgtgaagggtacagtggggagaatcaccggtctcgacccagccggaccaatgtttgagggggcagacatccacaaacggctgagccctgacgacgccgacttcgtggacgtcctacacacttatacccgatctttcggcctgtctattggaatccagatgcctgtgggacacattgacatttacccgaatgggggagattttcagcctgggtgtgggctcaatgacgtattgggatctattgcttatggcactataacagaggtcgtcaagtgtgagcacgaacgcgctgtacatttgtttgtcgatagtctcgtcaatcaagataagccatctttcgcttttcagtgcactgattcaaaccgctttaagaaaggcatctgcctcagctgccgtaaaaataggtgtaactctataggatacaatgccaagaagatgagaaacaaacgcaacagtaagatgtatctgaaaactagggcgggaatgcctttcagagtttatcactaccagatgaaaattcacgttttttcctataagaacatgggggagatcgaacccacattttacgtgaccctttatggtactaatgcggactcacagacccttcctttagaaattgtagagaggatcgaacagaatgctacaaatactttcctcgtgtacacagaggaagacctgggcgatcttctgaagatccagctgacttgggagggcgcttcccaatcatggtacaacctgtggaaggaattccgaagttatctctcacagccccgaaatccagggcgtgagctcaatattagaagaatccgcgtcaaatccggcgaaacccagaggaagctgactttttgtacggaagacccggaaaatacttccatttccccaggacgagagctctggtttcggaagtgtagggatgggtggcgcatgaaaaatgaaacaagccctaccgtggagctcccctag

SEQ ID NO: 228816 - DNA, 1281 bp, Artificial Sequence
  Description of Artificial Sequence: Synthetic coding sequence
atgagcaactctgtcccacttctgtgtttctggagcttatgctattgcttcgccgctggctcaccggttcctttcgggcctgaggggaggctggaagataagctgcacaaaccaaaggccacccagacagaggtgaagccctctgtccgctttaacttgaggacctctaaagatccagagcacgaggggtgttacctcagtgtcggccattctcagcctctcgaggattgcagttttaatatgacagctaaaactttctttattatccatggttggaccatgagtgggatctttgaaaattggttacataagctcgtctccgccctgcacacccgcgagaaggacgccaatgtcgtagtggttgattggctgcctctcgcgcaccagctgtatacagatgcggtgaataacacaagagtggtgggccacagcatcgcgaggatgcttgactggctgcaagaaaaggacgatttttctcttggcaacgtgcacctcatcggatattctctgggcgctcacgtggctggttatgcagggaactttgtcaagggaaccgttggtcggatcaccgctatcacggaggtcgttaaatgcgaacacgaaagggccgtacatctctttgtggatagcctggtgaatcaggataaaccgagttttgccttccagtgtacagattccaaccggtttaaaaaaggcatttgccttagctgccggaagaatcgttgcaattccatcgggtataatgcgaagaagatgcgcaacaagaggaactccaaaatgtatttgaaaacccgagcgggtatgccgtttagagtttaccattatcagatgaagattcatgtgttttcttacaagaacatgggggaaatcgagcctacattttacgtgactctctacggcacgaatgccgattctcagacgctgccgctggaaatagttgagaggattgagcaaaacgccactaatacattcctggtctatactgaggaagacttaggggacctactcaaaattcagctgacctgggagggcgcttctcagtcttggtataacctctggaaagagtttaggagttacttaagccagccaaggaatcccggacgcgagctgaacatcagaaggatcagggtaaaaagtggagaaacccagagaaagcttaccttctgtactgaagatcctgaaaacacaagcatatcaccagggagagaactgtggtttaggaaatgtagagatgggtggcggatgaaaaacgagacctctcccacagtggagctaccgtag

SEQ ID NO: 228817 - DNA, 1101 bp, Artificial Sequence
  Description of Artificial Sequence: Synthetic coding sequence
atgaatatctcacagatcatctcctattggggctacccggatgaggagtacgatattgtgacagaggatgggtatattcttggactgtaccgcattccttactggcggacggacaacaacaagaaccttgcgcaaagagtggtggtgtacttgcagcacggactgctcaccagtgctagttcctggatttctaacctgcccaataattcattaggctttatcttggcagacgccggttacgatgtgtggatgggcaactcccggggaaacacgtggtctagaaagcacctctacctggagacttcttccaaggaattttgggccttttccttcgacgaaatggctaaatatgatcttcctgcatccattgatttcacagtaaaacagacgcgtcaggaggaaatcttctacgtcgggcactcccagggcaccacaataggatttataacgttctccaccatctctaaaatcgccgaacggatcaagatcttttttgccttagctccggtgttcagtacgaaatatctgaagtctcccctgattcgtatgacctacaagtggaagtcgatagtgatggctttttctgggaataaggacttcctacctaagacttctttcaaaaagttcatcggatctaaactctgcccgcttcagatcttcgataaaatttgtctgaacattctgttcatgatgttcgggtacgatccaaaaaacctgaacatgtctcgtctggacgtctatttcagccacaatccagcaggaacaagtgtgcagaacatgctgcactggtcgcagttgctcaactcaacccacttaaaggcctatgattggggtagccccgatcttaatctggtacattacaaccaaaccacctctccgctgtacaatatgacgaatatgaacgtcgctacagctatttggaacggtaagtctgacctgttagcagacccagaggatgtcaatattctgcattcagagatcaccaaccacatatactacaaaacaatttcctactataatcatatcgattctttgtttgggctcgatgtttatgaccaggtgtaccacgagataatagatatcatccaggacaacctttag

SEQ ID NO: 228818 - DNA, 1200 bp, Artificial Sequence
  Description of Artificial Sequence: Synthetic coding sequence
atgtggcagctgctggcagccgcttgttggatgctgctgctggggtcgatgtacggctatgataagaaaggcaataacgccaacccagaagctaatatgaacatcagtcagatcatatcctactggggatatccctatgaagagtacgatgtcacaacgaaagatggatatattcttggcatatatcgcatccctcatggtaggggatgtcctggcaggaccgcacccaaaccagccgtgtacctgcaacacggtctcattgcttcagcttcgaactggatatgcaatctgcccaacaactccctggcttttctgttggctgactccggctacgacgtgtggctgggaaactctaggggcaatacttggtcccggaaacacttgaaactgtctccaaagagccctgagtattgggcctttagtttggacgaaatggcgaagtacgacctgccagcaaccataaattttataattgagaagacgggtcagaaaagactatattacgtgggacactcccagggtactacgatcgcctttattgctttctccaccaaccctgagttggccaagaagataaagatatttttcgcactcgcacccgtggtaacagtgaagtacacccagtctcccatgaagaaactgacaaccttgagcaggcgcgtggtcaaggtgctatttggggataaaatgttccatcctcacacactgtttgaccagtttatagcgacgaaggtctgcaatcggaagttatttagaagaatatgttctaacttcctgttcaccctctctggatttgatccccagaatctgaatatgtctcgactggacgtctatttgtcacataaccccgcagggacttccgtccagaatatgcttcactgggcgcaggccgtcaactcaggccagctacaggcgtttgattgggggaacagtgatcagaacatgatgcatttccatcagctcactccacccctgtacaacatcaccaaaatggaggtcccgaccgccatctggaacggtgggcaggacatcgtagcagatcccaaggatgttgagaacctgcttccacaaatcgctaatctgatctactacaaattgatccctcactacaatcacgtggatttctacctcggagaggatgcacctcaggaaatctatcaggatctcattatcctcatggaagagtacctgcagaactag

SEQ ID NO: 228819 - DNA, 1272 bp, Artificial Sequence
  Description of Artificial Sequence: Synthetic coding sequence
atgctcgagacactgagtcgtcaatggattgtgagccatcgaatggaaatgtggttactgattttagtcgcatatatgttccagaggaacgtgaacagcgtgcacatgccgacaaaggccgttgacccagaagctttcatgaatattagcgagatcatacagcaccaggggtatccgtgcgaggaatatgaggttgcaacagaagatggctacattttgtccgtgaaccggatccctcgaggactggtacaacctaaaaagacgggtagccgccctgtggtgttactgcagcatggtttggttggcggagcttccaactggatttccaacctacccaacaatagtcttgggttcatcctcgccgatgccggatttgacgtatggatgggtaactccaggggtaacgcttggtctcggaagcacaaaaccctgtctattgaccaggacgagttttgggccttctcgtacgatgaaatggctagatttgatctgcccgctgttataaactttatccttcagaagactggacaagagaagatctattacgtaggatattcccaggggaccacgatgggcttcattgcattctccactatgcccgagctggctcagaaaatcaaaatgtactttgcacttgcgcctatagccacagtgaaacacgccaagagtccagggaccaaattcctcctgctgccggatatgatgatcaaggggctatttgggaagaaagaatttctgtatcagacacggttcctgcgtcaactggtgatctacttatgtgggcaggttatcttggaccagatctgtagtaacatcatgctcctgctgggcggtttcaataccaataacatgaatatgtcaagggcaagcgtttacgccgctcatacgctggccggaacgtccgtccagaacattctccattggtctcaggctgtgaacagcggagagttgagggcctttgattggggaagcgaaacaaaaaacctggagaagtgtaaccagccaacccccgtgcgctatagagtcagagacatgacggtgccaactgcaatgtggaccgggggtcaggactggttatcaaaccccgaggacgttaaaatgcttctgagcgaagtgaccaacctcatctatcacaaaaacattcccgaatgggcgcatgtagactttatttggggtctagacgcccctcaccggatgtacaacgaaatcatacatctcatgcagcaggaggagacaaacctgtcacagggcagatgcgaggcagtgctgtag

SEQ ID NO: 228820 - DNA, 1152 bp, Artificial Sequence
  Description of Artificial Sequence: Synthetic coding sequence
atgacacggcctctggaccgtaaacagtcagaaatcatccaacaccagggctatccatgtgaggaatatgaagttgccactgaggatggttatatcctcagcgtgaacagaattcctagaggtctggtccaaccaaaaaagacggggagcaggcccgttgtgctgctgcagcacgggctagtggggggagcctctaattggataagcaaccttcccaacaacagtctcggcttcattctggccgatgctggatttgacgtgtggatggggaatagtagaggcaacgcctggagtcggaaacacaagacattgagcatcgatcaggatgaattctgggccttctcatatgacgagatggctcgctttgaccttcccgctgttataaattttatcttgcagaagaccggccaagagaaaatctattatgttggctatagccaagggaccacaatgggctttattgccttcagcaccatgccagaactagcacagaaaattaagatgtatttcgccctggccccaatagcaacagtaaagcatgccaagtctccaggcaccaaatttctgttgcttccggatatgatgatcaaggggctgtttgggaaaaaggagtttttataccaaacgcgatttctgaggcagctggtaatctatctatgtggccaggtgatcctggaccaaatttgttccaacatcatgttactcctgggaggtttcaataccaataatatgaatatgagccgcgcaagtgtctacgccgctcatacactggccggaacctctgtccagaatatcctgcactggagccaagccgttaatagcggagagttgcgcgcatttgattggggtagtgaaacaaagaatctggaaaaatgcaaccagccgacccccgtaaggtatcgggtgcgggatatgactgttccgaccgcaatgtggacaggcggacaagattggctgtccaaccccgaagatgttaagatgctgctgtcggaggtgacaaatctaatctaccacaagaatatccctgagtgggcccacgtcgattttatatggggtctggatgctccccaccggatgtataacgaaatcatccatctcatgcaacaagaggaaaccaatctatcacagggtaggtgtgaagcagttctctag

SEQ ID NO: 228821 - DNA, 1197 bp, Artificial Sequence
  Description of Artificial Sequence: Synthetic coding sequence
atgatgtggttgctcctgacaaccacatgtttgatttgtggcaccctaaacgccggtggtttcttggatctggaaaatgaagtcaatccagaggtctggatgaatacaagcgagattataatatataatgggtatcctagtgaggagtatgaggtgacaacagaagacggatatatactacttgtcaatcgaattccttacgggcgtacacacgctaggtccactggtccgcgtccagtggtgtacatgcagcacgccctgttcgctgacaatgcttactggctggaaaattacgccaacgggagtctgggatttctcctggccgacgcaggctatgacgtttggatgggcaattctcggggaaacacatggagtaggcgacataagactctatctgaaactgacgaaaaattttgggcgtttagttttgatgagatggctaagtacgatctccctggtgtaatcgactttattgtcaataagaccgggcaggagaaactctactttatcggtcactccctaggcacaaccattggattcgttgccttttcgaccatgcctgagctggctcaacggattaaaatgaacttcgccctggggcctacaattagctttaaataccccaccgggatctttactaggttcttcctcctccccaattctattattaaagcggttttcggcacaaaaggattctttctggaagataaaaagacaaaaatcgcaagtacaaaaatttgcaataataagattctctggctgatttgctcggagttcatgagcttgtgggccggtagcaacaagaaaaacatgaatcagtctcgcatggatgtgtatatgtctcacgccccaacgggctcttctgtgcataacatactccatattaaacaactgtatcactctgacgagttcagggcctatgactggggcaacgacgcagacaatatgaagcattacaaccagagccaccccccaatttatgacctgaccgccatgaaggtgcccactgccatatgggccggaggccacgacgtgttggtgacacctcaagatgttgccaggattctgccccagatcaaatccttgcactacttcaagcttcttcctgattggaatcatttcgacttcgtatggggactagacgcaccccagcgcatgtactcggaaatcattgccctgatgaaggcgtacagctag

SEQ ID NO: 228822 - DNA, 1500 bp, Artificial Sequence
  Description of Artificial Sequence: Synthetic coding sequence
atggacacatctcccctgtgtttcagcatcctgttggttctgtgtatttttatccagagttctgccttgggacaaagcttgaaacccgagccctttgggcgaagggcacaggcagtggaaacaaataaaaccctgcatgagatgaaaacccgctttctgctgtttggggaaaccaaccaggggtgtcagatcagaattaaccaccccgacactctccaagaatgcggattcaatagctccctgccattggtgatgataatacacggctggtccgtggacggtgttctcgagaattggatatggcaaatggtggctgccctgaagagccagcctgcccagcccgttaacgtgggcctggtggactggataaccttggcccacgaccattacactattgctgtacggaatacacgtctcgtggggaaggaggtggctgccttgttgcgctggctggaagagtcagtccaactgtcccgaagccacgtgcacttgataggttattccctcggggctcacgtgtctggcttcgcgggatcttccatcggcggtacccacaagataggaagaatcaccggattggacgcagctggtccacttttcgagggatctgcaccatccaataggctgagcccagacgatgccaactttgtagacgccatacatactttcaccagggagcacatggggttgagtgtgggcattaaacagcctatcggacactacgatttttacccaaatggcggatctttccagcctgggtgtcatttcctggaactgtatcggcatattgctcagcatgggttcaatgcaatcacacagactataaaatgttcacatgagcgtagcgtgcaccttttcatcgacagcctgttgcacgccggaacacagagcatggcgtacccatgcggcgacatgaacagcttcagccagggcctttgcttgagctgcaagaaggggcgatgcaacaccctgggatatcatgttcgacaggaaccacgcagcaagtcaaagcgcctcttccttgttactagggcccagtccccttttaaggtctaccactaccagtttaagatccaattcatcaaccagacagagacacctatccagaccaccttcaccatgtcactcctgggcaccaaggaaaaaatgcagaaaattcctataacattagggaaaggaattgctagcaacaagacttacagttttcttattactctggacgtggacattggcgaactgattatgatcaagtttaagtgggaaaattccgctgtatgggccaacgtgtgggacacagtgcagaccatcatcccctggagtacggggcctcgtcattctggccttgtcttaaaaactatacgggtgaaggccggtgagacccaacagcgcatgaccttttgcagcgaaaatacagatgatctactcttgcgccctacccaggaaaaaattttcgtgaaatgcgagatcaaatctaagacttctaagcgaaagatccggtag

SEQ ID NO: 228823 - DNA, 1500 bp, Artificial Sequence
  Description of Artificial Sequence: Synthetic coding sequence
atggacaccagcccactgtgcttcagtatacttctggtcttgtgtatttttattcagtcttctgccctgggccaatccctcaagcccgaaccattcggacgtagggcgcaagccgttgaaaccaacaaaacactgcacgagatgaagactcgctttctactgttcggcgagaccaaccagggatgccagatacgtattaaccaccccgacaccctccaggaatgtggattcaattcatcccttcctttagtgatgatcatccacggctggtccgtggacggggttctggagaattggatatggcagatggtggctgcactgaagagccagcccgctcagcctgttaacgtcggcctggtagactggattacactcgcgcacgaccattacacaattgctgtgaggaataccagactggtcggcaaagaggtggccgctctgctgcgatggttagaggaaagtgttcagctgtctaggagccacgtacacttgatcgggtattcactgggagcccatgtgagcggatttgctggatcttctattggcggtacacacaagatcggcaggattacaggactcgacgccgcaggtcctctcttcgaggggagtgcccctagcaaccgcctctctcccgacgatgccaattttgtggatgcgatccacacctttacgcgagaacacatggggcttagcgtgggaattaaacagccaatcggccactatgacttctacccaaatggagggagcttccaacctgggtgccattttttggaattatacaggcatatcgctcagcacggcttcaatgctattacacagactataaagtgctctcacgaacggtcagtgcacttgtttattgattccctccttcatgcaggaactcagtccatggcctacccttgcggcgatatgaattctttttcccagggcctatgcctatcctgcaagaagggccgttgtaataccctcggctaccacgtacgccaggagccaagatcaaaaagtaagaggctgttcttggttactcgggcacagagccccttcaaggtgtatcactaccagttcaagatacagtttataaatcaaaccgaaacacccatccaaactacattcaccatgtccctgcttggaaccaaagagaaaatgcagaagatccctattacattggggaagggtatcgcttctaacaagacctacagtttcctcatcaccctcgacgtcgacatcggggagctgatcatgattaagttcaagtgggaaaactctgccgtttgggcaaacgtgtgggatactgtgcagactatcataccctggtctacaggcccaaggcatagtggccttgtcctgaaaacaattcgcgtcaaagccggagagacacagcaacgcatgacattttgttccgaaaacaccgacgatctcctgctgagacccacccaggaaaaaatcttcgttaaatgcgagattaaaagtaagacttcaaagcggaagatccggtag

SEQ ID NO: 228824 - DNA, 3231 bp, Artificial Sequence
  Description of Artificial Sequence: Synthetic coding sequence
atggaacccggtagcaaatcagtatcccgaagcgattggcagccagaaccccatcagcgccctatcacacctttagagccagggcctgaaaagacaccgatagcccagcctgagagtaagaccctccagggctctaacacacagcagaagccggcatctaaccagcggccacttacacagcaggaaacgcccgctcagcatgacgccgagagtcagaaggaacctagagcccagcagaaaagcgcttcacaggaagaatttctcgcaccccaaaaaccagccccacagcaaagcccttacatacaacgagttctgttgacccaacaagaagccgcatctcagcagggccctgggctgggcaaagaatccatcactcagcaggagcccgctcttagacagcgccacgtggcccagccaggaccaggtccgggtgaacccccaccagcacagcaagaagctgagtctacgcctgcagcccaagctaaacccggagccaaaagggagccatctgccccaacagagtccacctctcaagagacccccgagcagagtgacaagcaaactaccccagtgcaaggggctaagagcaagcagggcagcctgacggagctgggatttttaaccaagctgcaggagctcagtatccagagatctgctttggagtggaaggccctgtcagagtgggtgactgactctgaatcggaaagcgacgtgggctcctcttcagacaccgattcccccgctacaatgggcggaatggtagcccaaggtgtcaaactgggtttcaagggcaaatcaggatacaaagtaatgagcgggtacagtggaacttctccccacgagaagacatcggctcgaaatcatagacattatcaggatacagcttctcgtctgattcacaacatggatttaagaacaatgacacagagtctcgtaactttggcagaggataatatcgctttcttttcttctcagggcccaggggagaccgcacagaggcttagcggcgttttcgcaggggtcagggagcaggctctggggcttgaacccgctctcggtcgcttactcggcgtggctcacttattcgatctggatccggaaacaccagccaacgggtacagatcattggtccacacagcccgatgttgcctggctcatctacttcataagagccggtacgttgcctctaaccgtagaagcatcttcttcagaactagccacaacctcgcagagctggaggcctacctcgctgctctgacccagctccgcgcactggtgtattacgcacagagacttctggtgaccaataggcccggagtgttgtttttcgagggtgacgaggggctgaccgccgactttctgcgggagtatgtcactttacataaaggatgcttttacggacgctgtctgggattccaattcacaccagccatccgcccttttctgcagacgataagcattgggttggtctctttcggggaacactacaagcggaatgagaccgggctctcagtggcggctagttcgctctttacttcagggcgattcgccattgatcctgaacttcgcggtgctgagttcgagcgtataacccagaacctcgacgtacacttctggaaagccttctggaatataacggaaatggaggtgctatctagcctcgctaacatggcatcagctactgttcgggtaagccggcttctcagcctgcctccggaagcgttcgagatgcccctgaccgcggaccccactttgaccgtcactattagcccccctctggcccacaccgggccaggcccagtgcttgtgagactgatatcatacgacttaagagagggccaggactctgaggagctttcttctctgatcaagtcaaatgggcagcggtcgctggagttatggccaagaccccagcaggcaccacgctctcgctctctgatagtgcactttcatgggggaggcttcgttgctcaaacaagtcgttctcacgagccgtatctgaaatcatgggctcaggagctgggcgcacctattatctctatagattattctttggctccggaggcacccttccctcgcgctctcgaggaatgcttcttcgcatactgttgggctatcaaacactgtgctctcttggggtccactggtgaacggatttgtctggctggagactcagccggagggaatctgtgcttcacagttgcactgcgggctgctgcctatggtgtccgagtgcccgatggtatcatggcagcgtatcctgccaccatgctgcaacccgcagcttcaccttccagattattatccctgatggatccattactgcccttaagtgttctctcaaaatgcgtttctgcatatgccggagccaagaccgaggatcatagcaactccgaccagaaagccctgggtatgatggggcttgtgcgacgcgacaccgctctgctattgcgggacttccgactaggcgcttcctcatggctcaactccttcctcgagttgagtggtaggaagagccagaagatgtctgaacccatagccgaacctatgagaagatccgtctcggaagctgctctggctcaaccccagggccctctgggcaccgattcattaaagaatctgactctgcgagatttgagcctaagaggcaacagcgaaaccagcagcgacacccccgagatgtctttgtccgccgagacgctgtcaccttcaacgccatcagatgtgaattttctgttgcctccagaagatgctggagaggaggcagaggcaaagaacgaactttcaccgatggacagaggcctcggagtgcgagcagcctttcccgaaggatttcacccacgcaggtctagccagggggctactcagatgcctctgtacagtagccctatcgtgaaaaacccctttatgagcccacttctggcaccagacagtatgttgaagagtttaccaccagttcacatcgtcgcatgcgcactagatcctatgctggacgacagcgtgatgttagccagaagactgcgcaacttgggccagccagtcactctgagggtggtagaggatctccctcacgggtttctgaccctcgcagcactatgtagagagactcgccaagccgctgagctgtgcgttgagcggatacgccttgttctgactcccccagctggagccggaccatccggggaaacaggagccgcaggcgtggatggcggatgtggcggtcgccactag

SEQ ID NO: 228825 - DNA, 1356 bp, Artificial Sequence
  Description of Artificial Sequence: Synthetic coding sequence
atgttacgattttacctgtttatatccttactctgcctgagtcgctccgacgcggaagagacctgcccttcctttaccaggcttagtttccactccgccgttgttggtacgggcttaaatgtgaggcttatgctgtacactaggaaaaaccttacctgcgcccaaactatcaactctagcgcattcggaaatctgaatgtgaccaaaaagacaaccttcattgtccatggctttcgccctactggctctcccccagtttggatggacgacctcgtaaaaggcctcctgtcagttgaagacatgaatgtggttgtcgtcgactggaatcgtggggcaaccaccttaatctacacccacgcgtccagcaagactcgcaaggtggccatggtcctcaaagaatttattgaccagatgctcgcagagggagcctctctggatgacatttacatgatcggggtttctctgggtgcgcatatttccgggtttgtgggcgagatgtacgatgggtggctcggcagaatcactggccttgatcccgcaggcccattgtttaacggaaaaccccatcaggacagactggacccttcagacgcccagtttgttgacgtgatccacagcgatacagacgcccttgggtacaaggagcctctggggaacattgacttttatcccaacgggggacttgaccagcctggatgcccaaagacaatcctgggcggtttccaatacttcaaatgcgatcaccagagatcagtgtacctttatttgagctccctacgcgaatcctgtaccattaccgcatacccttgcgatagttaccaggattatcgcaatggtaaatgcgtcagctgtggtacaagccaaaaagaaagctgcccccttcttggttactacgccgacaattggaaagaccatttacgcggaaaggatccccctatgaccaaagccttttttgatactgccgaggagtctcctttctgcatgtaccattacttcgtcgacattatcacctggaacaaaaacgtgaggaggggcgacatcacaatcaagctgagagacaaagctggcaacaccactgaatcgaagattaatcacgagccgaccactttccagaagtaccaccaggtgagcctgctagccagattcaaccaagacctggataaagtggcggctatttctctcatgtttagtactggcagtctgatcgggcctcggtacaaactgaggatattacgcatgaaattgagaagtttggcccaccccgagagacctcagttgtgtaggtacgacttggtactgatggaaaacgtcgagactgtcttccagccgattctatgtccagagctgcagctttag

SEQ ID NO: 228826 - DNA, 1446 bp, Artificial Sequence
  Description of Artificial Sequence: Synthetic coding sequence
atgctactgaaatgtctgcataacaacctttgtcagaagtatagcgcccacgcgtttcaattctccccgaggaacgtgctatggctgctggtggtttgtctaagaagcgacaacaagagaccatgcctggagttttctcagctgtcagtgaaagattccttcagagatctctttataccccgtatcgaaaccatcctgatgatgtacacacgcaacaatctaaactgtgcggaacccctgtttgaacaaaataactccctgaatgtaaattttaacacgcagaagaagacggtgtggctcattcacggctataggccggtgggatccattccactgtggctgcagaattttgtgaggatcctcctgaatgaggaggacatgaatgtcatagtggtcgattggtctagaggcgctacgaccttcatctataaccgcgctgtcaagaacacccgcaaggttgccgtgtctctctcagtccacatcaagaaccttcttaaacacggagcctcgctggacaacttccatttcatcggggtatctctcggcgctcacatctccgggtttgtgggtaaaattttccatggtcaattgggcaggatcaccggacttgatccagctggccctcgcttcagccgaaaaccaccatacagtagactcgactacacagatgctaaattcgtggatgtaatccattccgactctaatggcctgggcattcaagagcctctgggtcacatcgatttttacccaaatggagggaataagcaacctggctgtccgaagtctatcttctcaggcatccaatttataaagtgcaaccatcaaagagccgtacacctcttcatggcatcattagagactaactgcaacttcatcagttttccctgccggagctataaagactacaagacttctctttgtgtggactgtgactgtttcaaagaaaaatcctgtcccaggttggggtatcaggcgaaactgtttaaaggagtgcttaaggagcggatggaaggtaggcccctgcgcactacggttttcttagataccagtggcacatacccgttttgtacatattatttcgttctctctattattgtgccagacaagacaatgatggacggaagcttttcgttcaagttgctgaaccagctaggtatgatcgaagagcctcgcctgtacgaaaagaataagcctttctataaactccaggaagttaaaatcctggcgcagttttacaacgatttcgtgaacatttctagcatcggcctcacatactttcagagctcaaaccttcagtgctcaacatgtacatacaaaatccagcgcctcatgcttaaatcactgacgtacccagagagaccaccactgtgtaggtataatatagtcctgaaggacagggaggaggtcttccttaatcctaatacttgcacgcccaagaatacctag

SEQ ID NO: 228827 - DNA, 471 bp, Artificial Sequence
  Description of Artificial Sequence: Synthetic coding sequence
atgaacgtgattgtagtcgattggagccggggagcaaccacctttatctacaacagggccgttaaaaacactcgaaaggtggctgtgagcctgagtgttcacatcaagaatcttctgaagcacggggcaagcctggataattttcactttattggggtctctctcggagctcacatttccgggttcgtgggcaagatattccatggtcagcttggcaggatcactgggctggaccccgcagggccacggttctctcgaaaacccccttatagtcggctcgactacaccgatgccaagttcgtggacgtgattcatagtgactctaacggcatacaattcattaaatgtaatcaccaacgcgctgtccacttgtttatggcgtccttggagactaactgtaactttatttcctttccatgtcggagctacaaggactacaagacgagtttatgtgtggactgcgactgctag

SEQ ID NO: 228828 - DNA, 426 bp, Artificial Sequence
  Description of Artificial Sequence: Synthetic coding sequence
taatataaccgtgctgttaaaaatacccgcaaggtagccgtgagtctttcagttcatatcaaaaatctcctcaaacacggagcatcactggacaattttcacttcataggcgtcagtctgggtgcgcacatttcagggttcgtcgggaagatatttcatgggcagttagggcgtatcaccgggctggacccagctggccctcgattttcccgaaagcccccttattcacgcctggactacactgacgcaaagttcgtggacgttatacattcagattctaatgggattcagttcatcaaatgtaaccatcaacgagctgttcatcttttcatggcgtcactggaaacgaactgtaacttcatcagctttccttgtagaagctacaaagactataagaccagtctgtgcgtggactgtgactgctag

SEQ ID NO: 228829 - DNA, 1383 bp, Artificial Sequence
  Description of Artificial Sequence: Synthetic coding sequence
atgcgggtctacatcttcctgtgtctcatgtgttgggtgcgttcagacaacaaacgcccttgtctggagttttcacagctttctgtcaaggactcatttcgagacctgttcattccccgtatagagacaatactgatgatgtacacacgaaataatcttaattgtgcagagcctttgtttgaacaaaataacagtctcaatgtgaattttaatacacagaaaaaaacagtttggctcatccacggatacaggcccgtaggctcaatacctctatggctgcagaactttgtccgcatcctgctgaacgaggaagatatgaacgtgattgtagtggattggtcccggggagccacaacttttatttataatcgcgctgtgaaaaacaccagaaaggtcgcagtctctctgagcgtccacataaaaaatctcctgaagcatggcgcttccttagataacttccacttcatcggtgttagcctcggagcgcatatctctggtttcgttgggaaaatctttcatggccagttgggccgaattacaggcctagacccggcaggccctaggttctcgcggaaaccgccttactccaggctggactatacagatgctaagttcgtggatgtaatacacagtgactccaacggattaggcatccaggaaccactgggtcatattgacttctaccccaatgggggaaacaaacaacctggctgtccaaagagcatctttagcggaattcagtttattaagtgtaaccaccagagggccgtgcacctgttcatggctagcctagaaactaactgtaatttcattagttttccctgtaggagctacaaagactacaagacatcgctgtgcgtggattgtgattgcttcaaggagaagagctgtcccaggctcggctaccaagccaaactgtttaaaggagtcctcaaggagaggatggagggtcggccactaagaacgacagtgtttttggatacgagtgggacctatccattttgtacctactatttcgttctctctatcattgtgccagacaagacgatgatggatggttctttttctttcaaactcctgaaccagctcgggatgattgaggaacctaggctgtatgagaagaacaaaccattttacaagttgcaggaagtcaagatccttgcccagttctacaacgattttgtgaacatctcctcgattggcctgacttacttccagtccagcaacctccagtgctcaacttgtacttacaagatacagcgccttatgctgaagagtttaacatacccggaaaggccacctctgtgtcggtataatattgtcctgaaagatcgcgaagaggtgttcctcaatcccaatacatgtacacctaagaacacctag

SEQ ID NO: 228830 - DNA, 2673 bp, Artificial Sequence
  Description of Artificial Sequence: Synthetic coding sequence
atgaactacgtggggcagttggcgggtcaggtgtttgttactgttaaagagctgtacaagggcctgaatccagcaacactgtccgggtgcatcgacatcatcgtcataaggcaaccaaacggtaatctccaatgtagcccatttcacgtgagattcggtaagatgggtgtcctaaggagtagggaaaaagtggttgatatagaaattaacggagagtcagtcgacctccatatgaaactgggcgacaacggggaggctttcttcgtgcaagagacggacaacgaccaagaggtgatccctatgcacttggcgacttctcctatcctcagcgagggcgcatcccggatggagtgccaactgaaacggggtagcgtggacagaatgcgtgggctggatccctccacgccggcacaagtgattgcccctagcgagacaccttcttcttctagcgtggtcaaaaagcgcaggaagaggagacgaaagagtcaactggactcactcaagagagatgacaacatgaatacgtccgaggacgaggacatgtttcccatcgagatgtcatcggacgaagccatggagcttctggaaagttctcggaccctcccaaacgacattcctcctttccaagatgacatccccgaagaaaacctgagccttgcagttatctatccgcagtctgcttcttacccgaactccgaccgagagtggtcacccactccctcaccttctggcagcagaccttcaactcctaaaagtgactcagagctcgtgtcgaaatctactgaacgcacgggacagaagaaccctgagatgctctggctgtggggagagttgccccaggctgccaagtcatcctcaccacataaaatgaaagaaagctccccactgtcatcacggaaaatctgcgataagtcccacttccaggccattcactctgagtcctccgataccttttcagaccaatctcctacactggtaggtggcgcattgctggaccagaacaagcctcagaccgagatgcaatttgtgaacgaagaggatctcgaaaccctgggggctgcagctcccttgctgcctatgattgaagagcttaagccaccatccgcgtctgtcgtgcagaccgccaataaaacagactcaccgtctcgaaagcgagataagcggtcgagacatttaggagccgatggcgtgtacctggacgatctcacagatatggaccctgaggtggctgctctgtatttccccaaaaatggtgacccttctggactggcaaaacatgccagcgacaatggagccagaagtgctaaccaaagtcctcagagcgtaggatcgtcaggtgtggattccggggtggagtccactagtgacggactacgggaccttccatctatagccatctccctatgcggcggactgtcagaccatcgcgaaatcacaaaagacgcatttctggagcaagccgtgtcatatcagcagtttgtggataatccagcgataattgacgatccaaacctggtcgtgaagataggatcaaagtactacaactggaccacagctgcaccattgttgcttgctatgcaggcatttcagaagccactccccaaagccaccgtcgaatcgatcatgcgtgataagatgccaaagaagggcggacgctggtggtttagctggcggggaaggaataccaccatcaaagaggaatcaaaaccagaacaatgcctcgcaggcaaggcacatagcaccggggagcagccaccccagctatcactggccacccgagttaagcatgagtcctctagctccgacgaggagcgggcagctgcgaagcccagtaacgccggacatctgccactgttgcctaatgtcagttataagaaaactctgcgccttacgtccgagcagttaaagagcttgaaactgaaaaacggcccaaatgacgttgtgttcagcgtcacaacacaataccagggtacatgccgctgtgaggggactatttacttgtggaactgggatgataaggtgatcatttctgacattgacgggaccataacccgcagtgacacattgggccacatcctccccacgctcgggaaagactggacacatcaagggattgccaagctgtaccataaggtgtcgcaaaacggttataagttcttatactgctcagcacgcgcaatcgggatggctgacatgactcgaggatatctgcattgggtaaacgagaggggcacagtgctgccacaggggccactcctgctatccccgtcttcacttttcagtgcattgcatagggaagtcatcgagaagaaacctgagaagtttaaagttcagtgccttactgatataaagaatctgttttttccaaatacggagcccttctacgccgcattcggcaaccgtcccgctgacgtctattcctacaagcaggtgggcgtcagcttgaatcggattttcacagtaaatcccaagggggaattggtccaagaacatgccaagaccaatatcagttcctacgtccgcctgtgtgaggtagtggaccatgtgtttcctcttttgaagaggtcacacagttcagacttcccttgtagcgatacattctcgaattttacattttggcgggagccgctgccaccctttgagaaccaagatatccacagtgcttccgcctag

SEQ ID NO: 228831 - DNA, 1863 bp, Artificial Sequence
  Description of Artificial Sequence: Synthetic coding sequence
atgttatggttgtggggagagcttccacaggcagcaaagtcatctagtccccacaagatgaaggagtcatctcctctcagctcccgaaaaatctgtgacaagtcacacttccaagctattcactctgaaagcagtgacaccttctcagatcagagtcctacccttgttggcggtgcactcctggaccaaaacaaacctcaaactgagatgcagtttgtgaatgaggaggatctggagacactgggggcagcagctcccctcctccctatgattgaggagctgaaacctccttctgctagcgtcgtacaaactgctaacaaaaccgacagccccagccgtaagagagacaagcggtctaggcacttgggcgctgatggcgtctacttggatgacctgacagacatggacccagaagtcgccgctctctacttccccaagaacggcgatccctcaggccttgcgaagcacgctagcgacaatggcgcacgctccgcaaaccagagccctcagtccgtaggctcttctggagtggacagtggagtagaatctacgtcagacggccttagggatctgccctccattgcaatttccttgtgtggcggtctgagcgatcaccgggaaatcacaaaagacgcattcctggagcaagcagtctcctaccagcagttcgtggacaatcccgctatcatcgatgacccgaacttggtcgttaagattggatcgaaatactataattggacaaccgcagccccactgcttctggccatgcaggctttccagaaaccacttcccaaagcaactgtagagtctatcatgcgggacaaaatgcccaagaaggggggtcggtggtggttctcttggcgcggacgcaatactacaatcaaagaggaaagcaagccggaacagtgtttagccggaaaggcccacagcaccggcgaacagcctccccagctgagcctggcgacacgcgtcaagcacgagtcatcaagctcagatgaagaaagagcggcagccaaaccctccaacgcgggtcatctgcctttgcttcctaatgttagctacaagaaaacactacgcttgacttcagagcaattaaaatcccttaagcttaaaaacggacccaatgacgtggtattttctgtgacgacccagtaccagggtacctgtaggtgtgagggtaccatctacctgtggaattgggacgacaaggtgatcatttccgatattgacggtactattacacgttctgacaccctgggtcatattctgcccacactcggaaaagactggactcaccagggaatcgctaaactctaccacaaggtcagtcagaacggttataagttcctgtactgtagcgcacgggctattggaatggccgacatgaccaggggttatcttcactgggtgaatgaaaggggtacagtgctaccacagggccctctgttattatctccttcttctcttttctccgcactccacagagaggtaatcgagaagaaacccgagaagtttaaggttcagtgcttgacggatattaagaatctgttcttccctaatacagagccattttacgcagcgttcggtaacaggcctgccgacgtttactcctacaagcaggtgggagtgtcactaaaccgcatctttacagtgaaccccaaaggcgagcttgtgcaggaacacgcaaagactaatatttcctcatacgtgcggctatgcgaagtcgtcgaccatgtattccccctcctgaaacggagccattcttctgacttcccatgttctgatactttttccaacttcaccttttggcgcgaaccactacctccattcgagaaccaggatattcacagcgctagcgcctag

SEQ ID NO: 228832 - DNA, 2799 bp, Artificial Sequence
  Description of Artificial Sequence: Synthetic coding sequence
atgtcacgggtccagaccatgaactatgtcggacaactagccggtcaggtcttcgtcacagttaaggaactgtataagggcctgaaccctgctaccctttcagggtgcatcgacatcatcgtgatccgtcagcctaacggcaacctccagtgttcaccttttcacgtccggtttgggaaaatgggagtattacgttcccgagaaaaggtggtcgacattgaaattaatggcgaatccgtggatctgcacatgaagttaggtgataatggagaagcattcttcgtgcaggagacagataatgatcaggaagtgattcccatgcacctggccacgtcacctattttgtctgagggtgctagccgaatggagtgtcaactgaagcggggatcagtggacagaatgagaggacttgaccctagtacccctgcacaggttatagcgccatccgagactccaagctctagctccgtggttaaaaagcggagaaagaggagacgtaagtcccagctggacagcctcaagcgcgacgataacatgaacacctccgaagacgaggatatgttccctattgaaatgagttcagatgaagcgatggagcttcttgagagtagcaggactctaccgaatgacatacccccattccaagacgacatccccgaggaaaatctgagcctcgctgtgatctacccacagtcagcttcttaccctaacagtgatcgagagtggtcacccacacccagcagcctcgtggattgtaaaagaacggccccacacctggcagttgctgccgaagggggactgtcctcttcgtgcccccctcagtccagtctgtttcatccatcagaatccccatcgggctcaaggccatccacccccaaatccgactccgagctggtgtctaagtccaccgagaggaccggccagaagaatcctgagatgctctggctctggggcgaactgcctcaagctgccaagtccagctctccccataaaatgaaagaatcatcccccttgagctctagaaagatctgcgataagtctcactttcaggccatacactccgaatcatccgatacattctcagaccagtcgcccaccttggtcgggggtgcccttcttgatcaaaataagccacagactgagatgcagttcgtgaacgaggaagatctggagacgcttggagctgctgccccattgctgccaatgattgaagagcttaaaccacctagtgcaagtgtggttcagaccgccaataagacagacagcccctcccggaaaagggacaagcggtcacgccaccttggtgctgacggcgtttatctagacgacctcaccgacatggacccagaagttgcagctctgtactttccaaaaaacggggatcccagcgggctcgccaaacatgccagtgataatggggctagaagcgctaatcaatctccacagtctgtgggtagctctggagtcgactccggggtggaaagcacaagcgacgggctgcgggatctccccagcatcgcaatttccctatgtggaggcctcagcgaccatcgcgagatcactaaagacgcgttcctggagcaagcagttagctaccagcagttcgtggacaatccagcaatcattgatgatccgaatttggtcgtaaagatcggttcaaagtactataactggaccactgcagcccctctcctactcgccatgcaggctttccagaagccactacctaaggcgaccgtcgagtccatcatgcgggacaagatgccaaaaaagggcggtagatggtggttctcctggcgtggcaggaacactacaattaaggaggagtctaaaccagagcagtgccttgcgggaaaggcccattcaactggcgaacaacctccccaactgtctcttgcaactcgggtgaaacatgaaagtagctcatctgacgaggagagagcagccgctaaaccgtctaacgcaggccacctccccttactgcctaatgtaagttataagaaaacattgcgactaacgagcgaacagttgaagtctttgaagcttaaaaatggacccaatgatgtcgtattctccgttaccacgcagtatcaggggacatgtcgctgtgaggggaccatttatctgtggaattgggatgataaagttattatctccgacatagacggcactataacaagatccgacacactagggcacatcctgccaacattaggcaaagattggacgcatcaggggatagcaaagctataccacaaggtgagtcagaacggctacaagttcctctactgttctgctcgcgctatcgggatggcagacatgacacgcggatatttacattgggtcaacgagcgcggaaccgtacttcctcagggcccactgcttctgtcaccttcttccttgtttagtgccctacacagagaagtaattgaaaaaaaacccgagaaatttaaggtgcaatgtctgactgacatcaaaaacctgttttttcccaatactgagcctttctatgctgccttcgggaatagacccgcagatgtttattcttataagcaggttggagttagcctgaacagaattttcacagtcaatcctaagggcgagttggtgcaagaacatgccaaaaccaatatatctagctacgtcaggttgtgcgaggttgtggatcatgtgttccctttgctgaaacgatcacacagcagcgactttccttgcagcgatacatttagcaacttcacattttggcgggagccgttaccaccctttgagaaccaggatatccattcagcgtcggcgtag

SEQ ID NO: 228833 - DNA, 1176 bp, Artificial Sequence
  Description of Artificial Sequence: Synthetic coding sequence
atgcaagccttccagaagcctctgccaaagtcctcttgcttgtcttacctgcacgtgattcttgacgctattcgattttgtttttctaagatctttaatgcgcagattgcaaccgtggaaagtattatgcgggacaaaatgccaaaaaaagggggtcgatggtggttcagttggaggggaagaaacacaactataaaggaagagagcaagcccgagcagtgtctcgcgggaaaagctcattcaacgggcgaacagccgccacagctgagtctcgcaactcgtgttaagcacgaatctagttcctccgacgaggagcgggcagctgcaaagcctagcaacgcgggtcatctgccactgttgccaaatgtgtcatacaagaagactctgcgcctcacatctgaacagctcaagtctctgaagctgaaaaatggtccaaacgatgtggtgttcagcgtgactacccagtaccaggggacttgcaggtgcgaaggaactatctatctgtggaactgggacgataaggtcattattagcgacatcgatggcaccattacacgatcagacacgctgggacacatcctccccaccctaggcaaggactggacccatcaagggatagccaaactctaccataaggtgagccagaacggctacaagttcctctactgtagcgccagagcgattggaatggctgacatgaccagaggctacctgcactgggtgaacgagcgaggcacagtcctgccccaaggcccattactgctgagcccttcatcactattttctgcactgcaccgcgaagtcatcgaaaagaagcctgaaaagttcaaagtgcaatgcctcaccgacatcaagaatctgtttttccccaacaccgaacccttctatgctgcttttggcaatagaccggctgacgtgtattcctacaagcaggtgggagtcagtttaaatcgtatcttcacagtaaatcctaagggagagttggtgcaggaacatgccaagaccaacatttcatcttacgtcagactctgcgaggtggtcgaccacgtctttcccctgcttaagcggtcccacagcagcgactttccgtgctccgacactttcagtaactttactttttggagggagcccttaccaccctttgagaatcaggacatccactccgccagtgcttag

SEQ ID NO: 228834 - DNA, 87 bp, Artificial Sequence
  Description of Artificial Sequence: Synthetic coding sequence
atgaactatgttggccagctggccggtcaggtcttcgtcactgttaaagagttgtacaagggcttgaatccagctaccttgtcctag

SEQ ID NO: 228835 - DNA, 2691 bp, Artificial Sequence
  Description of Artificial Sequence: Synthetic coding sequence
atgagccgagtgcaaactatgaactatgtagggcagttagccggacaggtgttcgtcacagtgaaggaactttacaagggactgaacccagctaccctctctgggtgtattgacatcattgttatccgacaacctaacggaaatctccagtgctccccctttcatgtacgctttggcaaaatgggagtgctgcgctcccgggagaaagtcgtcgacatcgagattaacggcgaaagcgttgacctacatatgaaactgggtgacaacggtgaggccttcttcgttcaggaaacagacaacgatcaggaggtcattccaatgcatctggcgacttcgcccatattaagtgagggcgcaagccgcatggagtgccagctaaagcgcggttctgtggatcgcatgagaggcttagatccatctactccagcccaagtgattgctcccagcgagacccccagttcatcatccgtggttaagaagagacgaaagagacgaaggaagtcacagctggacagcctcaaaagggacgacaacatgaacacgtcagaggatgaggatatgttcccgatcgaaatgagttcggacgaggcgatggagctgttggaaagcagtcgcacgttacccaatgacatcccgccatttcaagatgacatccctgaagaaaatctatctctcgccgtgatatacccccagtccgctagctacccgaattccgatcgggagtggagccccacgcccagtccaagtggcagtcgcccatccacacccaagtcagacagcgaacttgtgtctaagagtactgaaagaactggacagaagaatcctgagatgctatggctttggggcgagctgccccaggccgctaagagctcatccccccacaagatgaaagaatcctccccccttagttctcggaaaatatgtgataagtcccatttccaggcgatccactccgaatcttccgatactttttcggaccagagtccaactttagtgggaggcgcactcctggatcagaacaaaccccagacggaaatgcaatttgttaatgaggaggatctcgagacattgggcgctgccgctccactccttcctatgattgaggaactgaaaccaccttctgcctccgtggtgcaaaccgccaacaagacggatagtccctctaggaaacgtgacaaaaggagtcggcatttaggagctgacggtgtctatttagacgatctcaccgacatggatcccgaagtggccgctctgtatttcccgaaaaacggcgacccatccggattggccaagcacgcatccgacaatggcgctcggagtgcaaaccagagcccccagtccgttggctctagcggggtggactccggcgtggaatccacgagcgatggtttgagggaccttcccagcattgctatcagcctatgtgggggactttcagatcatcgagaaattacaaaggacgcctttctggagcaggctgtgtcataccagcagttcgtagacaaccccgcaattatcgacgacccgaacctcgtggtcaaaattgggtccaagtattacaactggacaacagccgctcctctgctgttagcaatgcaggcctttcaaaagcctctacctaaggcgacagtcgaatcaatcatgcgcgacaaaatgccaaaaaaagggggacggtggtggttctcttggcggggacgcaacacgacaataaaggaggagagcaagcccgaacagtgcctagctggcaaggcccactcaaccggcgagcagcccccacagcttagtcttgctacaagagtgaagcatgagtcatcaagctcagacgaggagcgcgcagccgctaagccaagtaacgcgggacacctcccgctactgcccaacgtgtcctataaaaaaacattacgacttacctccgaacagcttaaatccctgaagctgaagaacgggccaaacgacgtcgtattttccgtcactacccagtaccagggcacttgcaggtgtgaaggcacaatatacctatggaactgggacgacaaggtcatcatatctgatatcgatggcacgatcacgcggagcgacacactgggccacatactgcctacattgggtaaggactggacacaccaaggcatcgctaagctataccataaagtctctcagaacggttacaaattcctatactgtagtgcgagggcaatcggcatggctgacatgacaaggggttatcttcattgggtcaacgagcgaggaacagtgctcccacaggggcctcttcttctgtcaccatcgagcctttttagtgcgctacacagagaggtgatcgagaagaaacccgaaaagttcaaggtacagtgtctgacagacattaaaaacctctttttcccgaatacggaaccgttctacgcagcctttggaaatcgcccagccgacgtgtattcatataagcaggtgggggtcagtttgaaccggatcttcaccgtgaatcctaaaggagagcttgtgcaggaacatgcaaaaaccaacattagttcctatgttcggctatgtgaagtggtggatcacgtgttcccactgctcaagcgcagccattcttctgatttcccctgttctgatacgttttccaatttcaccttctggagggaacccctgccgccatttgagaaccaagatatccatagtgcctctgcgtag

SEQ ID NO: 228836 - DNA, 291 bp, Artificial Sequence
  Description of Artificial Sequence: Synthetic coding sequence
atgaattacgtggggcaactcgcaggccaagtgttcgtaactgtcaaggagctttacaaaggtttaaacccggctactcttagcggttgtattgacattatcgtcattcgccagcctaacggaaacctgcagtgtagtccctttcacgttagatttgggaagatgggcgtgttacgtagccgggagaaggtcgtggatattgagattaacggagagagcgttgacttgcatatgaaactgggcgataacggcgaggctttcttcgttcaggaaacagacaacgaccagtag

SEQ ID NO: 228837 - DNA, 2928 bp, Artificial Sequence
  Description of Artificial Sequence: Synthetic coding sequence
atgggagagcaagatggtattagaagttccagctgggaaacaagccagggaaagagttctcccgacagtgcttggagctggatccccatcatgagagatcctgggtggatcaggaatgtgtggagctcaaatatcaatgtccagacaatgaattacgtcggccagcttgcaggtcaagtgtttgtgactgtgaaagaactgtacaaggggctcaaccccgctacactgtctggatgcattgatattatcgtaatccgacaacctaacggaaatttgcaatgttcccctttccacgtgcgcttcggtaaaatgggagtacttcgatcgcgtgagaaggtcgttgacatagagatcaacggagaaagtgttgatctacacatgaaactcggcgacaatggagaagccttctttgtgcaggagaccgacaatgaccaagaagtaattcctatgcacctggctacctcccccattctaagcgagggcgctagccgcatggaatgccagctcaaacgcggatcagtagaccggatgcgtggattggacccctcaacacctgcgcaggtgatcgccccttcagagacaccctcatcgtcttctgttgtcaaaaagagacgcaaacgcagaagaaagtctcagctcgacagcctgaagagagacgacaacatgaataccagtgaggatgaagacatgttccccatcgagatgtcttctgatgaagctatggaacttctcgaatcaagcaggactctgcccaacgacattccaccttttcaggacgacatacctgaagagaatctctcattagccgttatttatccccagtccgctagctaccccaattcagaccgcgagtggtcacccaccccaagttctttagtggactgtaagcgaaccgcccctcaccttgctgttgctgccgagggcggactgagtagtagttgtccaccccaatccagtctgtttcacccgtccgagtcaccctcaggcagccgaccctctactccaaagagcgacagcgaattggtctctaagtccaccgaaaggactggtcagaaaaatcctgaaatgttgtggctttggggagagttgccccaagccgcaaagagctcttctccgcacaaaatgaaagaaagctcccctctctcgtcacgaaagatctgcgataaaagccatttccaggccattcattctgagtcttcagacactttctctgatcaatcccccactctggtcggtggcgctttgctcgaccagaacaagccccaaaccgaaatgcagttcgttaatgaagaagatctggagacactaggagccgctgcccctcttttgccaatgatcgaggagctgaagcccccatccgcttcagtggtgcaaaccgctaataagacagactctcctagccgcaagcgggataaacggtctcgtcatttaggagccgatggagtttacctggatgaccttaccgatatggaccctgaagtggctgccctgtattttccaaaaaacggcgacccttccggtctagccaagcatgctagtgataatggcgcacgcagtgcaaaccagtctcctcagtctgttggaagctccggagtggactcgggggtcgaaagcacctctgatgggctcagggacctgccatcaattgccatcagcctctgcggaggactcagcgatcaccgagagattactaaagacgcatttttggagcaggccgtaagctaccaacagtttgttgataatccagcaatcatcgatgacccgaatctggtggtcaaaatcggaagtaaatattataattggacaaccgcagctcccctgctgctcgccatgcaggctttccagaagcctctgccaaaagccaccgtcgagagcattatgagggacaaaatgcctaaaaaaggtgggcgatggtggttcagctggcggggtaggaatacgacaattaaggaggaatcaaaaccagaacaatgtctggccggaaaggcgcactcaaccggggaacagccccctcagttgagtttggcaacccgagtgaaacacgaatcttcttcctcggatgaagagcgggcagctgctaagcccagcaatgccggacatctgcctctgcttcccaacgtgtcatacaagaagaccctgcgattaacatccgagcagctgaaaagcttaaagctaaaaaatggcccaaatgatgtggtctttagtgtgacaacacagtatcagggcacatgccgctgcgagggaaccatctatctctggaactgggatgacaaggtgatcattagcgatattgacgggaccatcacgagaagtgacaccctgggtcacattctaccgaccctgggtaaagactggacacaccagggtatcgccaagctctaccacaaggtctctcaaaatggctataaattcctgtactgtagcgctagagcgatcggtatggcagatatgacccggggatacctgcattgggtgaatgagcggggtacagtgctgccgcagggccctctgttactttctccgagtagcctattttccgcgttacacagagaagtgattgagaagaaaccggagaagtttaaagtgcagtgtctgacagacatcaagaacctgttttttcctaatacagaacctttttatgcagcatttggaaatcgccctgccgacgtgtatagttacaaacaggtgggtgtaagcctcaaccgcatcttcactgtgaatccgaaaggcgaattagtccaggagcacgccaaaactaatatttcaagctacgtcagattgtgtgaggtcgtggaccatgtctttcctctgctcaaaaggtcacatagctccgacttcccatgttccgatacattctccaactttaccttctggcgggagccactgccaccttttgaaaatcaggacatccatagcgcctcagcttag

SEQ ID NO: 228838 - DNA, 1380 bp, Artificial Sequence
  Description of Artificial Sequence: Synthetic coding sequence
atgtcccgcgtccagaccatgaactatgtgggccagctggccggtcaggtcttcgtcacagtgaaggaactgtataaaggcctgaacccagccacccttagcgggtgcatcgatatcattgtgatacggcagcccaacgggaatttgcaatgcagtccattccatgtgcgcttcgggaaaatgggcgttctgcgctccagagagaaggtggttgacatcgagatcaacggtgagtctgtggacctccacatgaagttaggtgacaacggagaagctttctttgttcaggagacagacaatgatcaagaggtgatcccaatgcatctggccacttcccccatcctctccgaaggagcctcccgcatggagtgccagctaaaacgaggttctgtcgaccggatgcgtgggctggatcccagcacccctgctcaagtgattgccccaagcgaaacaccctcgtcttctagcgttgtaaagaagaggcggaagagacggcgtaagtcccagttggattccctgaagagggatgacaatatgaataccagcgaggacgaggacatgttccctattgagatgagcagcgacgaagccatggaattattagagagctcgcgcaccctccccaacgatatccccccatttcaggacgatattccagaggagaatctatccttagctgtcatctatccccagagtgcctcctaccctaactccgatcgggagtggtcaccaacaccttcttctctggtcgactgtaagcggacggcacctcaccttgcagtcgccgctgagggaggcctttcctcttcttgtccaccacagagttctttattccacccctctgaatctccctcaggttccaggccatcgactccgaaatccgattccgagctcgtttctaagtccactgagcgtacagggcagaagaatcctgagatgctgtggctctggggtgaactgccccaggcggctaagtccagctccccgcataagatgaaggagtcttccccattgtcttctcgcaagatttgcgacaagtcccattttcaagcgattcacagtgagagcagtgataccttctctgatcaaagtcctacactggttggcggtgcccttctggaccaaaataagccacaaaccgagatgcagtttgttaacgaagaggacctggaaacacttggcgctgccgcaccactgctgcccatgatcgaagagctgaagcccccttccgcatctgtggtgcagactgctaacaaaacagatagcccctcaagaaagcgagacaagcgtagtagacacctgggtgccgatggagtgtatctggatgatctcactgatatggacccggaagttgctgccttgtacttccccaagaagtag

SEQ ID NO: 228839 - DNA, 2691 bp, Artificial Sequence
  Description of Artificial Sequence: Synthetic coding sequence
atgaactatgttgggcagctcgctggccaagtgatcgtgaccgtgaaggagctgtataaaggaataaatcaggcgaccctgagcggatgcatcgatgtgatagtcgtgcagcagcaggatggttcttatcagtgttcgccattccacgttaggttcggaaagctgggggtccttcgctcaaaagagaaggtcatcgacatagaaatcaatgggagtgccgttgatctgcacatgaaacttggggataatggcgaggccttctttgtagaggagaccgaagaagaatatgaaaaactgccagcctacttagccactagtcctatcccaaccgaggatcagttctttaaagacatagatacaccattggtcaagtctgggggtgatgagacccccagtcaatcctccgatatttcgcatgtcttagagactgagaccatcttcacaccctcgagcgtgaaaaagaagaaaaggagaaggaagaagtacaaacaggatagcaagaaggaggagcaggccgctagcgccgctgcagaggatacatgcgatgtaggcgtgtcttccgacgatgataaaggcgcacaggccgctcgcggttcctctaatgcaagcctaaaggaagaagaatgtaaggaaccactgttgttccattcaggggatcattatccgttgagcgacggggattggtctcctctagagaccacataccctcaaaccgcatgcccaaagagtgactctgaactcgaggtcaagcccgctgaaagcttgctccggagtgagtcacacatggagtggacatggggcggattcccagaaagtacaaaggtctccaaaagagaaagaagcgaccaccatcctagaacagccacaattacaccctctgaaaatacccactttcgggtgattccctctgaggacaatctgattagtgaggtcgagaaggacgcctctatggaggacacggtatgtacaatcgttaagccaaaaccacgggcactgggaactcaaatgtccgaccccacaagtgtagctgagctgctggagcctcctctcgaatctactcagataagcagtatgctggatgccgaccatctccccaatgcagcactcgccgaggccccttcagaatcaaagcctgcggcaaaggtagacagcccaagcaaaaagaagggtgtccacaagagatcacagcaccagggtcccgatgatatctatctagacgacctaaaggggttggagcctgaggtcgcagccctttatttcccgaagagtgaatccgaaccagggtctcgacagtggcccgaatcagataccttaagtgggagtcagtccccccagtccgtaggatcggctgccgctgacagtggtacagaatgtttgagcgattcagcaatggacctgccagacgtgaccctcagtctttgcggtggccttagcgagaacggagaaattagtaaagaaaagtttatggagcacattataacctaccatgagttcgctgagaacccagggcttattgataacccaaatctcgtgatccgaatttacaatcgatattacaattgggccctggccgcaccaatgatactgagcctgcaggttttccagaaaagtctgccgaaagcaactgtggaatcatgggttaaggacaagatgcccaaaaagtccggcagatggtggttctggaggaagcgggagtccatgaccaagcaactaccagagtctaaggaggggaaaagtgaggccccacccgctagcgacctgccaagctcttctaaggaacctgccggtgcacgccctgccgagaatgatagctcttccgatgaaggttcccaggaactagaggaatccattaccgtggacccgatcccaactgaaccattgagccacggcagcaccaccagctataaaaagagtttacgtctctcctcagaccaaattgctaagctgaaattgcacgacggcccaaacgacgtagtgttcagcattactacccagtatcaggggacgtgcaggtgtgccggtactatatatctctggaattggaatgataaaattatcatctccgatattgacggaaccatcacgaagagcgatgctctcgggcaaattctaccccagttgggtaaggattggacacaccagggaattgccaaactataccattctattaatgaaaacggctataaattcttgtattgttccgcacgagccatcggaatggcggacatgacaagaggatatctgcattgggtgaacgacaagggcacaatcctccccagaggcccactcatgctctctcccagcagcctattttctgccttccaccgcgaagttatcgagaaaaagcccgagaaatttaagatagaatgcctgaacgacatcaaaaatctctttgcgccttctaaacaaccattctacgccgcttttgggaacagacccaacgatgtatacgcgtacacccaggtgggtgttcctgactgtcggatcttcactgttaaccccaaaggcgagcttatccaagaacgcaccaaaggcaataaaagtagttaccaccgactgtctgaactggtagagcacgtttttcctcttcttagcaaagagcagaactcagcgttcccatgccccgagtttagcagtttctgctactggagggacccgatccctgaggttgatctggatgacttgtcctag

SEQ ID NO: 228840 - DNA, 702 bp, Artificial Sequence
  Description of Artificial Sequence: Synthetic coding sequence
atgaattacgtgggacagctggcaggccaggttattgtgacagtgaaagagctgtataagggcatcaatcaagccactctgtcaggttgcattgatgtgattgtggtgcagcagcaagatgggagctaccagtgctctcctttccatgttcggttcggcaagctgggagtgctcagatctaaagaaaaagtgatcgacattgaaattaacggcagcgccgtcgacttgcacatgaagctgggagataacggcgaggcattctttgtcgaggaaactgaagaagagtacgaaaagctccctgcctacttagccacttcacccattcccaccgaggatcaattttttaaagatatcgataccccccttgtcaagtccggcggagatgaaaccccttcacagagctccgacatttcccacgtcttggagaccgaaacaattttcactccctcctccgtgaaaaaaaagaaacgacgtaggaagaaatataagcaagactccaagaaggaagagcaggccgcttctgcggcagctgaagacacttgtgatgtaggcgtttcctctgacgatgacaaaggagctcaggctgccaggggcagcagcaacgcttccctgaaagaagaagagtgtaaggaacctctgctgttccactccggcgaccactatccactgtccgacggagattggagtcctctggaaacttag

SEQ ID NO: 228841 - DNA, 2556 bp, Artificial Sequence
  Description of Artificial Sequence: Synthetic coding sequence
atgaactacgtaggacagctggccgagacagtgtttggcacagtcaaagagctttatcgcggactgaatccggctaccttaagcgggggaatcgacgtgttggtagtgaagcaggtggacggctcgtttcgttgctctccgttccacgttcggttcggcaagctgggtgtccttagatccagagagaaggtagttgatatcgaactgaatggagagcctgtggacttgcatatgaaactgggagattctggcgaggcctttttcgttcaggaactggagagtgatgacgaacacgtacctccagggttgtgtacctctccaatcccatggggtggcctgtctggtttcccctccgattcgcagctgggaaccgccagtgagcccgaaggcctggttatggccggtaccgcctcaactggacggagaaaaagacgtagaagaagaaagccaaagcagaaggaagatgccgttgctacagactcgtccccggaggaactggaagccggagccgagtccgaactgagcctgccggagaagctccgacctgaaccccctggggttcagctggaggagaaatcttccctgcagcccaaggatatttatccatatagtgatggagagtggccaccacaggcttccctctccgcaggcgagctcacatctccgaaatcagactctgaacttgaggttcgcacccctgaaccttctcctctccgagctgaatcgcatatgcaatgggcatggggcagactgcccaaggtcgctagagcagagcggcctgaatcgtctgtggttctggaggggcgagcaggcgcaacctctccacctcggggtgggccttctaccccttctactagtgtggccggaggggtggaccccttggggctaccaattcaacaaacggaggctggagcagaccttcagcctgatacagaagaccctacgctggtgggaccacctttgcatacccctgaaaccgaggagagcaaaacccagtcatcgggcgacatgggcctgcccccagcatccaagagttggtcttgggccacattggaggtgcctgtgccgacaggccagcccgaaagagtctcccgagggaaggggagcccaaaaagaagccagcacctggggccatctgacatctacttggatgaccttccttcacttgattctgaaaatgccgcactgtactttccacaatctgatagtggtctaggagccagacggtggtctgaaccttcctctcagaagagtctgcgagacccgaaccctgagcacgaacctgagccaactctcgacaccgtggatacaatagctttgtcactgtgcggtggcctggcagatagtcgcgacatcagtttggagaaatttaaccagcattccgtgagctatcaggacttgacaaagaatccgggtctgctggatgaccctaatctagtagtcaaaataaatgggaagcactataactgggccgtcgctgcccctatgatcctgagcctgcaggcattccagaaaaacttgccaaagagtaccatggataagctggagcgagaaaaaatgccgagaaagggagggcgatggtggttctcttggagaaggcgcgacttcctagccgaagagcggtccgcccaaaaggagaaaacagccgctaaggaacagcagggcgagaagacagaagtcctgagttctgatgatgacgcccctgacagccccgtcatcctggagatcccaagtctccctcccagtactccccctagcactcctacatataaaaagtcgctgcggttatcctccgatcagatcagaaggctgaacctgcaggaaggggctaacgatgtagtgttctccgtgacaactcagtatcaagggacatgccgctgcaaggcaaccatttacttgtggaaatgggacgataaagtcgtaatctcagatattgacgggacaattactaagtccgatgcactgggtcatattcttccacagcttggtaaggattggacgcatcagggcataaccagtctatatcacaaaatacagctgaacggctataaattcctttactgttctgcccgagccattggaatggccgacctgaccaaaggatacctccagtgggtgtcagaaggtggctgtagcctgccaaagggcccaatattgctgtccccatcaagtcttttctccgctctgcaccgcgaagtgatcgagaaaaagcctgaagtgtttaaagtggcatgcctgagcgatatccagcagctgtttctcccccacggtcagcccttttacgctgctttcggcaaccggcctaacgatgtgttcgcctatcgacaggtcggcctgcctgagtccagaatcttcaccgtcaatcccagaggagaactaatccaggaattgattaagaaccacaaaagcacttatgagcggctcggtgaagtggtggagttgctattccccccagtggctcgcggtcctagcactgatcttgcaaatccagagtattccaacttctgctactggcgagagcctctgccagctgtagacctcgatactctcgattag

SEQ ID NO: 228842 - DNA, 1242 bp, Artificial Sequence
  Description of Artificial Sequence: Synthetic coding sequence
atgggtctcccaccggcttccaaaagttggtcatgggccaccttggaagtcccagtgcccaccggccagccggaaagggtatctagaggcaagggcagcccgaaaagatcccagcacctaggaccatctgatatatacctggatgacctgccgtccctggactctgagaatgcggctttgtatttcccacagagtgactctgggctgggcgctcgacggtggagtgagccttcaagtcaaaaatccctcagggaccctaaccccgagcatgagccagagcctacgctcgacacagtggacaccattgcactcagtctctgtgggggactcgcggattctagggacatctccctggagaaattcaaccagcactcagtgtcataccaggatctaactaagaaccctggactgctggacgatcccaatttagtggtgaaaattaatggcaagcattataattgggcggtcgccgctccgatgattctaagtctgcaggcctttcagaagaacctgcccaagcgtagcgcgcaaaaggagaagaccgccgcaaaggagcagcagggggagaaaacagaggtcttaagttccgatgatgacgcgccagattcccccgtgattctggagatacccagcctgcctccaagtactccaccttcaacccctacatacaagaaatcacttagactctcttctgaccagattcggcgactgaatctgcaggagggggctaatgatgtcgtcttttcggtcacaacacaataccagggcacctgtcgatgtaaggcaaccatctacctctggaagtgggacgataaagtggtcatctccgatatcgacggcacaataacaaaaagtgacgcccttggccacatattacctcaactggggaaggattggacgcatcaggggattactagcctgtaccacaagatccaattgaacggatataagttcctctactgtagtgccagggctattggcatggcagatctgacaaaggggtacctccagtgggtttctgagggtgggtgcagtctccctaagggcccaatcctgttgtcgccgtcttctctctttagcgccctccaccgagaggtcatcgagaaaaaacctgaggtgttcaaggttgcatgcctgtccgacattcaacagttattcctcccccacggccaacctttctatgcagcattcgggaaccggcctaacgatgtctttgcatataggcaggtcgggctaccttag

SEQ ID NO: 228843 - DNA, 813 bp, Artificial Sequence
  Description of Artificial Sequence: Synthetic coding sequence
tgagtcaagatcaacgggaaacattacaactgggctgtagccgcaccaatgattttgagcttgcaggcattccagaagaatttacctaaaaggtcagctcagaaagagaagaccgctgccaaggagcagcaaggagaaaaaaccgaggtgctgagctctgacgatgacgcacccgactctcccgtaatcctcgaaattccttcactaccccctagcactccaccgtccactcctacatacaagaagtcccttaggctgagctccgaccaaatacggaggctgaatttgcaagagggagcgaatgacgtggttttcagcgtgaccacccaatatcagggaacttgcaggtgtaaggctaccatttacctctggaaatgggatgacaaagtcgtaatcagcgacatcgatgggactattaccaagagcgacgcattgggtcacattcttcctcaattgggcaaggactggacccatcaaggtattaccagtttataccacaaaattcagctcaacggatacaaattcctctactgttccgcccgagcaattggaatggctgacctcaccaaagggtacctccagtgggtctcagaagggggttgctccttgccaaaaggcccaatcctactgtctccgagttcactcttcagcgcgttacatcgcgaagtgatagagaaaaagcctgaagtgtttaaagttgcatgtctgtctgacattcagcagcttttccttcctcatggacagcccttctatgcagcttttggtaataggccaaatgatgtgttcgcttaccgccaggttggtcttccatag

SEQ ID NO: 228844 - DNA, 531 bp, Artificial Sequence
  Description of Artificial Sequence: Synthetic coding sequence
atgaaacccttgttgctagccgtcagccttgggttgatcgcagcgctgcaagcccaccatctactcgcctcggacgaagagatccaagatgtgagcggcacctggtatctaaaggccatgacagttgatcgagagttcccagaaatgaatttggagtctgtcacccccatgaccctgacaactctcgagggcggaaatcttgaggccaaagttactatgcttattagcggtcgttgtcaggaagtaaaagcggtcttagaaaagaccgacgaaccaggtaagtacaccgcggatggaggaaaacacgtggcctatattatcagaagtcacgtcaaggaccactacattttttactgtgagggagagcttcatggaaagccagttaggggagtaaaattggtgggacgagaccccaaaaataatctggaggccctggaggattttgagaaagccgctggtgctcgcggtttgtctacagagtcaatccttattcccagacaaagcgaaacgtgttccccgggatccgattag

SEQ ID NO: 228845 - DNA, 531 bp, Artificial Sequence
  Description of Artificial Sequence: Synthetic coding sequence
atgaagcctctattgttggccgtctcgttgggactcatcgccgcactccaggcgcatcaccttctggcctccgacgaagaaatccaggacgtgtccggcacttggtatctgaaagctatgaccgtggatagggagtttcctgaaatgaatctggagtccgtgacccctatgacattaacaacactggaaggaggcaaccttgaggcaaaagttaccatgctgatcagcggaaggtgtcaggaggttaaggcggtgctggaaaagacagatgagcctgggaagtacaccgccgatggcggaaagcatgttgcatatataattagaagccacgtcaaagatcactatattttctactgcgaaggggaactccacggtaagcctgtgcggggagtgaaactggtcggacgagatcccaagaataacctggaggccctggaagattttgaaaaggccgctggggctcgaggattatccacggaatctatcctgatacccaggcaaagtgagacctgtagcccaggatccgattag

SEQ ID NO: 228846 - DNA, 564 bp, Artificial Sequence
  Description of Artificial Sequence: Synthetic coding sequence
atgaggcagggcctgctcgtactggccttagtcctcgttcttgtcttggttctcgccgctgggtcacaagtgcaggaatggtatcccagagaaagccacgcacttaattggaataagttcagtgggttctggtatattttagccaccgcgactgacgctcagggcttcctaccagcaagagataaaagaaagcttggcgcatcagtcgtgaaggtaaataaggtgggacagctgcgagtcttgttggcctttaggcggggacagggatgtggccgagctcagcctcgccaccccggaacctctggtcatctgtgggcaagcttatctgtgaaaggggtgaaagcttttcatgtgttgagcaccgattactcctatggtctggtgtatttacgactgggacgtgctacccagaactacaagaatttgctgttgtttcatcggcagaacgttagttcatttcagtccctgaaagagttcatggacgcttgtgacatcctgggcctgagcaaagcagccgtcattctaccaaaggatgccagtaggacccacactatcctaccctag

SEQ ID NO: 228847 - DNA, 603 bp, Artificial Sequence
  Description of Artificial Sequence: Synthetic coding sequence
atgcgccagggcctactggttctggctctcgtgctggttctggtgctggtcctcgccgcaggctcgcaggtgcaggaatggtacccacgcgagtcccacgcgctgaactggaataaattttcaggcttctggtatattctcgcaactgccaccgacgcacagggctttctgccagccagagataagcgcaagctcggtgccagcgtcgtcaaagtcaacaaggtgggacaacttagggtgctgctggcctttcggcgactgaagggctgccagtcacaggaagtcatcctgaggaaagatggcaaaaaacctgttttcggcaacgcatgtgcatatgccgctggacctcgagagggacaggagggcgtgaaaggggtgaaggcattccacgtgctctcgactgattacagctacggcctagtttatctgagactgggaagagcaacacagaattacaagaacctgctcctattccacaggcagaacgtgtcaagctttcaatccctcaaggagtttatggacgcttgcgatatactcggtttgtccaaagccgctgtgatacttccaaaggatgcctctagaacacacactattctcccttag

SEQ ID NO: 228848 - DNA, 273 bp, Artificial Sequence
  Description of Artificial Sequence: Synthetic coding sequence
acgttcgagctttccgatgacggcagattcgaagtttggaatgccatgacgcgcggacaacactgcgatacctggagctacgtgctgatacccgcagcccagcccggtcagtttaccgtagatcatggagttgatactagagctggttggccctcaagtggctctgcgtgctgggccggagctggttgctgtctccctggcagatggactagttcgtcagcctgggctgagttacgagccagtcggatgacaaccagctcgtcccagatgtag

SEQ ID NO: 228849 - DNA, 579 bp, Artificial Sequence
  Description of Artificial Sequence: Synthetic coding sequence
atgagacttttatgtgggctctggctctggctgagtctgctgaaagtcttacaggcacagacacctactcccctcccccttccgccacctatgcagtcttttcaaggcaaccagttccagggagaatggtttgtattgggcttagccggtaatagctttcggccagagcacagggctctgctgaatgctttcacggcaactttcgagctctcagatgacggaaggttcgaagtctggaacgctatgacccgtggtcagcattgtgatacctggtcttatgtgcttatcccagcagcacaacccggacagttcaccgtagatcacggcgtggagcctggcgcagatagggaagaaacccgggtcgtggactcagactatactcagttcgctctcatgcttagtagaagacacacaagccgcttagctgttctgcgcatatctctcctgggaagatcatggttattgcccccaggaaccctggaccagttcatttgtctggggcgagcgcagggattgagcgatgataacatcgtgtttccagatgtgacaggatggagcccccaagccagtgtttgctag

SEQ ID NO: 228850 - DNA, 597 bp, Artificial Sequence
  Description of Artificial Sequence: Synthetic coding sequence
atgccccttggtctcctgtggctaggactcgctttgctcggagctctccacgcccaggcccaggactctacttctgacctcatccccgctcctccgttatctaaggtcccactccagcagaatttccaggataaccaatttcagggcaaatggtatgtggtggggctggccggtaatgctattctgagggaagacaaagaccctcagaaaatgtatgcaaccatctacgaattaaaggaggataagagctataacgtgacctctgtcctgttccgcaagaaaaagtgtgattattggattcggaccttcgtccctggctgccagcccggagaatttaccttaggcaacatcaagtcgtaccctggactgacatcatacctggtgcgggtcgtgtccacgaattataatcagcacgccatggtgttcttcaaaaaagtctctcagaaccgagaatatttcaagatcaccctgtatggcagaaccaaggaattgaccagtgaactgaaggaaaatttcatccggttcagcaagtcgcttggtctgccagagaatcacatagtatttccagtacccattgaccaatgcattgatggctag

SEQ ID NO: 228851 - DNA, 603 bp, Artificial Sequence
  Description of Artificial Sequence: Synthetic coding sequence
atgccgctcggcctattatggctgggactggcgctcctgggcgcactacatgcccaggcacaagactctactagcgacctgatccctgctccgccattgtccaaggttccactgcagcaaaatttccaggacaatcagttccaaggaaagtggtacgtagtcggcctggccggaaatgccattctgagggaagacaaggaccctcaaaagatgtatgccacaatctacgaactgaaagaggacaagagttataacgtgacttctgtactgttccgcgagaaggcacagaaatgcgattattggatccgcacgttcgtccctgggtgccagcccggagagtttactctcggcaacatcaagagctacccaggcttaacctcttacctggtgcgagtggtgtccacaaattataatcagcacgccatggtgttcttcaaaaaagtatcgcaaaaccgcgaatacttcaagattactctatatggcagaactaaagaactgacatctgagttaaaggaaaattttattcgctttagtaagagcctcggcttacccgagaaccatattgtttttcctgtaccaatagatcagtgcatcgacggctag

SEQ ID NO: 228852 - DNA, 603 bp, Artificial Sequence
  Description of Artificial Sequence: Synthetic coding sequence
atgccactggggcttctgtggctggggttggcactccttggcgcactacacgctcaggcgcaagacagtacctccgacttgattccagccccacctctcagcaaagtgcccttgcagcagaacttccaggacaaccaatttcaaggcaaatggtacgtggtagggttggcgggtaacgctatcctgcgagaagacaaggatcctcagaagatgtacgctacaatttatgagctgaaagaagataaatcatacaatgttacttctgttttgtttcggcagtggaagaagaagtgcgactattggatccgtacctttgtccccggatgccagcctggcgagttcacgttgggaaacatcaagtcttacccgggactcacaagttacctggttcgcgtggtctccacaaattataaccagcacgccatggtttttttcaagaaggttagtcagaatagggagtatttcaagataaccttgtacggtcgcacaaaggagctgacatccgaactcaaggagaacttcataagattttccaagtcgctggggctgcccgagaaccatatcgtgtttcccgttcccattgatcaatgtatagacggctag

SEQ ID NO: 228853 - DNA, 597 bp, Artificial Sequence
  Description of Artificial Sequence: Synthetic coding sequence
atgcccctgggtctcctgtggcttggcctggcattgttgggcgctcttcacgcccaggctcaggacagcacctccgatctgatccctgccccacccctgtcgaaggtgccactgcagcaaaactttcaggataatcaatttcagggcaagtggtatgtggtagggctggccggtaacgccatccttagggaagataaggatccccagaaaatgtacgcaactatctacgaactcaaggaagacaagtcttacaacgtgacttcagtgctgtttcgcaagaaaaaatgtgactattggatccgaacctttgtgcctggctgccagcccggtgaatttactcttggtaatatcaagtcttacccaggcctcacatcataccttgtcagggtcgtctccacgaactataatcagcacgccatggttttttttaagaaggtgagtcagaaccgagaatacttcaagattactttatacggtcggacaaaggagctcacaagtgaactgaaagagaactttatccggttcagcaaaagcctgggccttccagaaaaccacattgtgttcccggtgccaattgaccagtgtatagacggttag

SEQ ID NO: 228854 - DNA, 597 bp, Artificial Sequence
  Description of Artificial Sequence: Synthetic coding sequence
atgccactgggcctgctttggcttggcctcgccctgctgggagcactgcatgcgcaggcgcaggactccacctctgacctgattcctgcaccgcctctctcaaaagtacctctccagcagaactttcaagacaatcagttccaagggaagtggtacgtggtgggactcgcaggcaatgcgattctgagagaggataaagacccccagaaaatgtacgctactatctatgaactcaaggaagacaagagctacaacgtgacttccgtcctgttcaggaagaaaaagtgcgattattggatcagaacattcgtcccaggatgtcagcccggtgagttcacgctggggaacatcaaaagttatccaggcctgacctcttacctggtgagggttgttagtactaattataatcagcacgccatggtgttttttaaaaaggttagtcaaaatcgtgaatattttaagattactctgtacggaagaactaaggaactcaccagcgagcttaaggaaaactttatccggttttccaagagcctaggtttgcctgagaatcacattgtattcccagtacccatcggaaacgggcagtctggctag

SEQ ID NO: 228855 - DNA, 492 bp, Artificial Sequence
  Description of Artificial Sequence: Synthetic coding sequence
atgggcggactgctgcttgctgcctttcttgctctggtctccgttcccagagcccaggcagtctggttggggaggctggaccctgaacagctgttaggcccttggtacgtcttggcagtagcatcgagagagaaaggctttgccatggagaaagatatgaaaaacgtggttggcgtggtagtcacgctgacccctgaaaataatctgagaacactgagcagtcagcatggcctgggaggatgtgaccaatcagtgatggacctgatcaagcgcaattctggctgggtctttgagaacccaagtattggtgtgctggagctgtgggtccttgctacgaactttagggactatgcaattatctttacacaattagaattcggagatgaacccttcaacactgtggagttgtattctctgaccgagaccgcatcccaggaagctatggggctcttcaccaagtggtcccgaagtctggggttcctctctcagtag

SEQ ID NO: 228856 - DNA, 459 bp, Artificial Sequence
  Description of Artificial Sequence: Synthetic coding sequence
atggaggagctggacaggcaaaaaataggtggtttttggcgcgaagttggagttgcgtccgatcagtctctggtgctgacagctccaaagcgcgtggagggtctgtttctcacgctgagtggttccaatctgacagttaaggtggcgtacaatagttctggcagctgtgagatagagaagatcgtcggttccgagatcgattccaccggaaagtttgccttcccaggtcaccgagagatacacgtgctcgacaccgattacgaggggtatgcgatacttagagtcagtctgatgtggcgaggtcggaatttcagggtcttgaaatacttcactcgatctctcgaagataaggatcggttgggcttttggaagttccgcgagctcaccgccgacaccgggctgtatctggccgctcggccaggacggtgcgccgaactgctgaaggaggaactgatctag

SEQ ID NO: 228857 - DNA, 531 bp, Artificial Sequence
  Description of Artificial Sequence: Synthetic coding sequence
atggccttactcctgctgagcctaggcctttccctcattgcggctcaggagtttgatccccataccgtcatgcagaggaactataacgtcgctagagtgtcaggcgtttggtacagtatcttcatggctagtgacgacctcaatagaattaaggaaaatggggatctcagagtttttgtccgtaatatcgaacatcttaaaaatggcagccttatttttgatttcgagtacatggtgcaaggtgaatgcgtcgctgtcgtagtggtttgtgagaagacagagaagaatggcgaatatagtatcaactatgaaggacagaataccgtggctgtgagtgaaacggattatagactcttcattacttttcacctgcagaacttcaggaatggcactgagacacacacactggcactatatgaaacctgcgaaaagtacggcttggggtcgcagaacatcatcgacctgaccaataaagacccctgttactccaaacactatcggtctccgccacgtccccctatgcggtggtag

SEQ ID NO: 228858 - DNA, 1119 bp, Artificial Sequence
  Description of Artificial Sequence: Synthetic coding sequence
atgagtcttcgctgcggcgacgcagcacgaaccctcggacctcgggttttcgggcgttatttctgtagccctgtgaggccactgtcttctctccctgacaaaaaaaaagagcttttgcagaacgggcctgatctgcaagatttcgtgtcgggtgatcttgccgaccgatccacgtgggacgagtacaaggggaacctgaaacgtcagaagggggagcggttgcgcttgcctccatggctcaagacggaaatacccatggggaaaaactacaacaaacttaaaaatacgctacgaaacttaaacttgcacaccgtgtgtgaggaagcgcgttgccccaatattggagagtgttggggcggaggcgagtacgccacggcaactgccaccatcatgctgatgggagatacatgtacgaggggctgtagattttgttcagtcaaaaccgctcgcaatccacctccactcgacgcctctgagccctataatacagccaaagcaatcgccgaatggggactcgactacgtcgttctgacttctgttgacagagacgatatgcctgacggcggtgcggaacacatcgccaaaaccgtgtcatatcttaaggaacggaatcctaaaatactggtggagtgtcttacaccggacttccgaggggatctaaaggccattgaaaaggtggctctcagcggcctagatgtttatgcacataacgtcgaaacagtccccgagctgcagtccaaagttcgggaccctcgcgctaactttgatcagtccctccgagtccttaagcacgcaaagaaagttcaacctgatgtgatcagcaagacatctattatgctcggcctgggtgagaatgatgagcaggtgtacgccaccatgaaagctctccgcgaggccgacgtggactgcctgactttgggacaatacatgcagcctacaagacgtcacctgaaagttgaggaatacataacccccgagaagttcaaatactgggaaaaagtgggtaacgagctcggattccattatacagcctctggccctctggtgagatcatcgtacaaagccggagagttttttttgaagaatctcgtggccaagagaaaaaccaaagatctgtag

SEQ ID NO: 228859 - DNA, 969 bp, Artificial Sequence
  Description of Artificial Sequence: Synthetic coding sequence
atgtccctcagatgtggggatgctgccaggactctgggcccacgcgtcttcggcaggtacttctgctcacctgtacgcccactaagttctctacctgataaaaaaaaggagttgttacagaacggtcctgatctccaggacttcgtttctggtgacctcgcggatagatctacttgggacgagtataaagggaatcttaaacggcagaaaggcgagaggctaaggctcccgccatggttgaagaccgaaattccaatgggaaagaactacaacaaactgaagaataccctacgcaacctgaacctgcacaccgtctgcgaggaggcccgttgcccgaatatcggagagtgttggggcggtggcgaatacgccaccgcaactgccacaatcatgctgatgggtgatacctgtactcgaggctgtaggttctgctctgtgaaaacggcaagaaatcccccacccttggatgcctcagaaccgtacaacacggccaaagcgatcgcggagtggggcctggactacgtggtgctgacttccgtggaccgtgacgatatgcccgatgggggtgccgagcacatcgccaaaactgtgtcctatctgaaggaaagaaacccaaaaattctggtggagtgtttgaccccagacttccgcggagatctgaaggccatcgaaaaagtggctctgagcgggctggacgtctacgcgcacaacgtggaaactgtgcccgaactccagtccaaggtacgagatccccgagcgaattttgaccagagcctgagggttctcaaacacgccaagaaggtccaacctgacgtaatctccaagacctcaattatgctcggcctgggggaaaatgatgagcaggtgtatgctacaatgaaggccctcagggaggcagatgtggactgcctgaccctcggacagtacatgcagccaacaagacgacatttgaaggtgaatttcagctag

SEQ ID NO: 228860 - DNA, 603 bp, Artificial Sequence
  Description of Artificial Sequence: Synthetic coding sequence
atggccagtagcctcacctgcacaggtgtcatatgggccctcctctcattcctgtgtgcagccacaagttgtgtcggattctttatgccatactggctctggggttcgcagttaggcaagcctgtgagctttgggacctttcgcagatgtagctatcccgtacacgatgaatctcggcagatgatggtgatggtggaagagtgcggcaggtacgcgtctttccagggcatccccagtgctgaatggcgaatctgtaccatcgttactgggctgggatgtggcctcctgttgctggtagcgctgaccgccctcatgggatgctgcgtgtctgatctgatctcccgcacggtcggcagagtggccggtgggatccagtttctgggtgggctcttgattggggctgggtgtgctctgtatcctttaggatgggattctgaggaggtgcgccaaacttgcgggtacacctcaggccagttcgatttgggtaaatgcgagattgggtgggcctactattgtacaggcgcaggggctaccgcggcaatgcttttgtgtacatggctggcatgtttcagcggcaagaagcagaagcactacccttactag

SEQ ID NO: 228861 - DNA, 663 bp, Artificial Sequence
  Description of Artificial Sequence: Synthetic coding sequence
atgaggtcatctttaacaatggttggcactctatgggcgtttctgagcctggtaaccgcggtcacctcatccacctcctatttcctcccttactggctgtttggctcacagatgggaaagccggtctccttctcgacctttcgcagatgcaattatcccgtgagaggcgaaggccatagcttgatcatggtggaagagtgtggtaggtacgcgtcctttaacgctatccccagcctcgcctggcaaatgtgtactgtggtcaccggtgccggatgcgccctgctgctgctggtggcccttgcagcggtcctcgggtgttgcatggaggagctgatcagccgaatgatgggtcgatgcatgggagccgctcaatttgtcgggggtctgttgattagttccggctgtgctctgtaccctctgggttggaattctccggaaatcatgcaaacatgcggaaatgtgtcaaaccagtttcagctgggaacgtgccgcctgggatgggcctactactgtgcagggggaggcgcagctgccgctatgctgatttgtacatggctgtcttgtttcgccggtaggaatccaaaacctgtgattttagtggaatcaattatgcgcaatacaaacagctacgccatggaattggatcattgtttaaaaccttag

SEQ ID NO: 228862 - DNA, 564 bp, Artificial Sequence
  Description of Artificial Sequence: Synthetic coding sequence
atgcgctcctccctaacaatggtcgggactctctgggccttcctgagtttggtcactgctgttacgagtagtacctcctattttctgccatactggttatttgggagtcagatgggaaagcccgtgagtttctctacatttcggaggtgcaactaccctgtgaggggcgaggggcactcgctgataatggtggaggagtgcggcagatatgcatcttttaacgcaatccccagcttagcatggcagatgtgcaccgtggttacaggtgctggatgtgccttgctcctgcttgtggctttagcagctgttttaggatgctgcatggaggagctcatcagtaggatgatggggagatgtatgggagctgcgcagttcgtgggtggaacctgccggctcgggtgggcctactattgcgctggtggaggcgcagctgcggctatgttgatctgtacttggctgagctgctttgccggacgcaaccctaaacccgtcattctcgtggagtccatcatgagaaacaccaacagttacgccatggaactcgatcactgcttgaaaccctag

SEQ ID NO: 228863 - DNA, 687 bp, Artificial Sequence
  Description of Artificial Sequence: Synthetic coding sequence
atgtgtcacgtcattgtaacttgcagaagtatgctgtggaccctgcttagtatagttgtcgcttttgcagagctcatcgcatttatgagcgctgattggctcatcggaaaggccagatcccgcggtggggtggaaccggctgggcctgggggtgggtctcccgagccgtaccacccaacccttggaatttacgcacggtgtatacgtaaccccggtgttcagcacttccagagggacaccttgtgcggaccatacgccgaaagcttcggcgagatcgccagtggcttttggcaggccacggctatttttctggcggtgggcattttcattctgtgcatggttgccttggtgtctgtgttcacaatgtgcgtgcaatctatcatgaaaaagtccatattcaatgtttgcggcctcctgcagggaatcgccggtctctttctaatcttgggtctgattctgtaccctgccggttggggctgtcaaaaggcgatcgactactgtgggcattatgcctcagcttacaaacctggcgattgttccctaggttgggcgttttacactgcaatcggcggaactgtgctaacatttatctgtgccgtgttctctgctcaggccgaaatcgcaacgtccagtgacaaggtgcaagaggaaattgaagaagggaagaacctgatatgcctactgtag

SEQ ID NO: 228864 - DNA, 687 bp, Artificial Sequence
  Description of Artificial Sequence: Synthetic coding sequence
atgtgccacgttatcgtgacgtgcaggtctatgttgtggaccttgctcagcatagtggtggcctttgccgagcttatcgccttcatgtccgcagattggctcatcggaaaggctagaagccggggtggggtcgagccagcaggaccgggaggtggctctcctgagccttaccatcccacattagggatttacgcgaggtgcatacgaaaccctggagtgcagcacttccagcgggatacgttatgtggcccttacgccgagagttttggagaaattgcttccggattctggcaagccacagccatctttttagcggtgggcatctttatcctgtgcatggttgccctggtgagcgtatttacaatgtgcgttcagagcatcatgaagaagagcatcttcaatgtgtgtggcttacttcaagggattgcaggactgttcctcatacttggtcttatcctttaccctgcaggatggggctgccaaaaagccatcgattattgtgggcactatgcctccgcctacaagcccggagactgcagtctgggttgggccttttacaccgccattgggggaaccgtgctgaccttcatctgcgccgtgttctccgcgcaggctgaaatcgctacgagttctgacaaggtgcaagaggaaatcgaagagggaaaaaatctgatatgtctgctttag

SEQ ID NO: 228865 - DNA, 669 bp, Artificial Sequence
  Description of Artificial Sequence: Synthetic coding sequence
atgctgccggctcaagaagctgccaagctctatcacacgaattacgtgaggaactctagggctattggcgttttgtgggccatattcacgatttgttttgcgatcgtcaatgtggtgtgctttatccaaccctattggatcggcgatggcgtggacacaccccaggccggatactttggcttgttccactattgcatagggaatggcttttctcgcgaactgacttgccgcggaagttttactgatttctcaactctgccttcaggcgctttcaaggcggctagctttttcatcggacttagcatgatgcttattattgcgtgcattatttgcttcaccctcttctttttttgtaacactgcaactgtatacaagatttgtgcatggatgcagctgacttcagccgcttgcctcgttctgggatgtatgatattccccgacggatgggattcagatgaggtcaagagaatgtgtggcgaaaaaactgacaaatacactctgggcgcatgttctgttcggtgggcatacatcctggccattataggtattctggatgctctgattctgtctttcctcgctttcgtgctcggcaacagacaggactcactaatggccgaggagctcaaggccgaaaacaaagttcttctgtctcaatactccctggaatag

SEQ ID NO: 228866 - DNA, 711 bp, Artificial Sequence
  Description of Artificial Sequence: Synthetic coding sequence
atgccaggggctgccgcagccgctgccgcagccgctgctgccatgttgcccgctcaggaggcagcgaaactgtaccatactaactacgttcggaactctcgcgcaatcggcgtactttgggccatatttaccatctgctttgccattgtgaatgtggtttgcttcatccagccatattggattggagatggggtggacacccctcaagccggttattttgggctcttccactactgcataggcaacggcttttccagagagctcacttgccggggatcattcaccgactttagcaccctgccttctggagcctttaaggctgccagtttcttcatcggattgtccatgatgctgatcatcgcgtgtatcatttgcttcacccttttttttttctgcaacacagcaactgtgtataagatttgcgcatggatgcagctcacctctggagactgcctggtactgttcgatctgcacttccccgatggctgggattccgatgaagtcaaaagaatgtgtggggaaaagaccgataagtacaccttaggtgcctgctccgtccggtgggcctatattttggcaatcattggaatcctggacgccttgatactgagctttttggcctttgtgttaggcaaccgccaggatagcctaatggccgaggagctgaaggcagagaacaaggtgcttctgtcccagtactcactggaatag

SEQ ID NO: 228867 - DNA, 699 bp, Artificial Sequence
  Description of Artificial Sequence: Synthetic coding sequence
atgcctggggctgccgcagccgcagccgctgccgctgccgcaatgctgcccgcacaggaggctgcaaaactgtatcacactaattacgtaagaaactcacgcgctattggtgtgctctgggctattttcaccatttgctttgcaatcgtcaatgtggtgtgtttcatccagccatactggatcggagacggagtcgacacaccccaggccggatatttcgggctgttccactactgcatcggcaacgggttttctcgagagcttacatgtcggggaagcttcacagactttagcaccttaccgtcgggggcttttaaggcagccagtttcttcatcggcttgtccatgatgctgataatagcctgcatcatttgtttcacactatttttcttttgcaatacagccactgtttataaaatttgtgcgtggatgcaactgacctctggcgactgtcttgtactgttcgatctgcacttccctgacggctgggatagcgacgaggttaagcgaatgtgcggcgagaagacggacaaatacaccctcggagcctgttcagttaggtgggcttatatcctggccattataggtattctggacgccctgattctcagctttctcgcattcgtgctcgggaatcgccaggacagtttgatggccgaagaattaaaggcagagaataaggatgacgggaacgcatag

SEQ ID NO: 228868 - DNA, 660 bp, Artificial Sequence
  Description of Artificial Sequence: Synthetic coding sequence
atggttaaactcctgcctgcacaggaggccgctaagatttaccacaccaactatgtgcggaattcccgcgcagtgggtgttatgtggggtaccctcacaatatgcttcagcgtgctcgtgatggcactctttatccagccgtactggatcggcgacagtgtgaataccccccaagcaggctactttggtttattttcctactgcgtgggcaacgtcttgagctcggaattgatatgcaagggagggcctctggactttagctccattccctctagagccttcaagacagcaatgttcttcgtggccctaggcatgttcctgatcatcggatcaatcatctgtttcagccttttttttatttgtaacaccgcaacagtgtataagatctgcgcctggatgcagcttgccgctgccacaggactcatgattgggtgtttagtctacccagacggctgggacagttcggaggttcgaagaatgtgtggcgagcagacaggcaaatacactctaggccactgcactatcagatgggcctttatgctcgccatattgtctataggcgatgcgcttatcctatcattcttggcatttgttctcggataccgacaggataaacttttgcctgacgattataaagccgacgggactgaagaagtctag

SEQ ID NO: 228869 - DNA, 660 bp, Artificial Sequence
  Description of Artificial Sequence: Synthetic coding sequence
atggttaagttgttgccggcacaggaggccgcaaagatctatcacactaattatgtacgaaacagccgggctgtgggggtaatgtggggaacactgacaatatgcttctctgtgctcgttatggcactgttcattcagccgtactggattggtgacagcgtaaatacaccacaagccggatacttcgggttgtttagctactgtgttggtaacgtcttgtctagtgaactgatttgcaaaggcggaccccttgacttcagtagcattccctctagggcctttaagacagccatgttttttgtggcacttggaatgtttcttattattggatccataatctgcttctccctgtttttcatctgtaatactgctaccgtgtataaaatctgtgcctggatgcaattggctgcagccacgggcctaatgatcggatgcctagtatatcccgacggctgggactcctccgaggtcagaaggatgtgcggggaacaaactgggaagtatacccttggacattgtactatccgatgggccttcatgcttgccattctttctataggcgacgctctcatcctttcttttcttgcctttgtcttagggtacaggcaggacaagctgctgcccgacgactacaaggcggatggcacagaagaagtgtag

SEQ ID NO: 228870 - DNA, 675 bp, Artificial Sequence
  Description of Artificial Sequence: Synthetic coding sequence
atgagcgtgtttggcaagctgttcggtgccggaggaggcaaggcaggaaaggggggtccgacacctcaagaggcaatacagcggctgcgggataccgaggagatgctttcaaagaagcaggagttcttggagaagaagattgagcaggagctgaccgccgctaagaaacatgggactaaaaacaaacgcgcagccctgcaggcactgaaaagaaaaaagcggtacgagaagcagctcgcgcagattgacggcaccctcagcactatcgagttccagcgtgaggccttagaaaacgcaaataccaatacagaggttctaaagaatatgggatacgctgcaaaagcaatgaaagcagcccacgacaatatggatatcgacaaagtggatgagttaatgcaagacatcgctgatcaacaggagctcgctgaagagatttctacagccatctcaaagcctgttggattcggggaggagtttgacgaggacgagctgatggccgaactggaggagctggagcaagaagaactggacaaaaacctcctagaaattagcggaccggaaaccgttccgctcccaaatgtgccctccatcgctctaccatcaaagccagccaagaaaaaagaggaggaggacgatgatatgaaagagttggagaactgggcaggcagcatgtag

SEQ ID NO: 228871 - DNA, 1434 bp, Artificial Sequence
  Description of Artificial Sequence: Synthetic coding sequence
atgggagccctggccagggctctccccagtattctcctggcgctcttactgacgagtacccccgaagctctgggagctaaccccggtctagtggccaggattacggacaaaggtttgcagtacgctgcccaggagggtttattggcgctgcaatccgagctgctgcgcattaccctccccgatttcacaggagatctgagaatcccccatgttggcaggggcaggtatgaattccactcgctgaacatccactcctgtgaactgctgcattctgcattgaggccggtccctggccagggcctgagtttgtcaatttccgacagctcaatcagagtgcaggggcgatggaaggtccgcaagagtttctttaagttgcagggtagctttgatgtctcggtgaaaggaattagcatctccgtgaatcttctgcttgggagcgagtcctctgggagaccaacagtcaccgccagctcctgctcctcagatatcgctgacgtggaggtcgatatgagtggcgatctgggttggctcctgaatctcttccacaaccagattgaatcaaaattccagaaggtcctggagagtagaatctgtgaaatgattcagaagtccgtttcaagtgatcttcagccttacctgcagacgctaccggtcacaactgaaattgattctttcgccgatatcgattattcactcgtggaagccccacgagccaccgcccagatgttggaggtcatgttcaaaggtgaaattttccatcgcaaccaccgttctcccgtcacgctgctcgcagccgtcatgtctttgccagaggagcacaataaaatggtgtactttgcaatatcagattacgtgtttaacacagcctcgttagtgtatcacgaggaaggctaccttaatttttccattactgatgatatgatcccccctgactccaatatccgactcacgacaaaaagctttagaccgtttgtccctagactggctcggttgtacccgaacatgaacctggagctgcaggggtccgtgccctctgccccactgctgaacttctcacctggcaatttgtctgtggatccttatatggagattgatgctttcgtgcttttaccgtcctcatccaaggagccggtgttcaggctgtcggtggcaacaaacgttagcgccacccttacatttaacacttctaagattactggcttcttgaaacccggtaaggtcaaggtagaactaaaagagagcaaggtcggactatttaacgcggaattgttggaggccctgttgaactactatattcttaacaccttctacccaaagtttaatgacaagctggctgagggcttcccactgcctttactgaagcgtgttcaactatacgacctgggactgcagattcacaaggactttcccagcagaagggatcaccctccatag

SEQ ID NO: 228872 - DNA, 486 bp, Artificial Sequence
  Description of Artificial Sequence: Synthetic coding sequence
atgtcagtcccaggaccctaccaggccgcaaccggcccatcgtctgccccatccgcccctccatcctatgaagagactgtggcggttaactcctactacccgaccccacctgctcctatgccaggtcctaccacggggttggtcaccgggccagatgggaagggaatgaatcctcccagttattatacacagcccgcaccaattcctaacaacaatccaattaccgtgcaaaccgtgtacgtgcaacatcctataacctttctggataggcctatccagatgtgttgcccttcttgcaacaaaatgatcgtcagccagctgagctataatgccggtgcgcttacctggctgtcttgtggttccctgtgtttgctgggttgcattgccggatgctgcttcatcccattttgtgtagatgcactccaagatgtcgaccattactgtccaaactgcagggcactgcttggtacatacaagcgcctgtag

SEQ ID NO: 228873 - DNA, 687 bp, Artificial Sequence
  Description of Artificial Sequence: Synthetic coding sequence
atgtctgttcccggtccttaccaggccgctaccggcccaagttcagccccaagcgcccctccgagttatgaagagaccgtggctgttaactcctattatcccactccacccgcacctatgcctggccctactaccggtctagttacggggcctgatggcaaaggcatgaaccccccatcgtattatacccagcccgcacccattcccaataacaacccaattactgtgcagacggtgtacgtgcaacacccaattactttcttggacagacccattcagatgtgttgcccgtcctgcaacaagatgatcgtgtctcagctcagctacaatgctggagctctcacctggctcagttgtggcagcttatgtctgctgggggtccactctggcctcctgctccaccccctcctgagaggttgtcccgctggtagaggcccactgctcagtcagttgcagtcctcacctgggcacttgcaggcattcgttggattaagtcagacatggagagaacctggtgcagccggatcccccttccatctctcgtcctcctttactcccggtgggggttctgcattggtggtgtctcccttgcagggtgcacacctgcacgtttttttctggggggaatacgtggccaaactcaccaatctgcagactccagagatagcagcctggagcagagcttag

SEQ ID NO: 228874 - DNA, 459 bp, Artificial Sequence
  Description of Artificial Sequence: Synthetic coding sequence
atgtccgtgcccggtccctatcaagcagctactggaccctcttccgcccctagcgctccccctagttacgaagagacagttgcagtgaattcttattaccccacgccccctgctcccatgccaggccctactaccggcctggtgaccggacctgatggcaaagggatgaacccccctagctattacacacagccggctccaatccccaataacaatcccataaccgtgcagacagtttatgtgcagcaccccataacgttcctcgataggccgatccagatgtgctgccctagttgtaacaagatgattgtttcacagctaagctataatgcgggtgctctcacttggctctcctgcggctctctttgtttgctgggccaggaatgcagtggaactattgtcgcccttaggtcgttcgacttactgggctcatgcaacccaccttcaagtgcatcctag

SEQ ID NO: 228875 - DNA, 486 bp, Artificial Sequence
  Description of Artificial Sequence: Synthetic coding sequence
atgagtgtgcctgggccatatcaggcagctaccgggccatcatcagcaccatcagcccctccctcctatgaggaaaccgtggcagtgaactcatattatcccacaccgccagcacctatgccaggaccaaccaccggcctggtcaccggcccagatgggaaaggtatgaaccctccctcgtattatacccagcctgcacccatccctaacaacaatcccatcaccgtccagactgtctatgttcaacaccccattacattcctggaccgcccaatacaaatgtgctgcccttcatgcaacaaaatgatagtgtcccaattgagctacaatgcgggagccttgacttggctgagctgcggaagcctgtgtttgttgggctgcatcgccggatgttgttttatccctttctgcgtggacgcactccaggatgtcgaccactattgcccgaactgccgtgcactcctcggaacctacaagaggctgtag

SEQ ID NO: 228876 - DNA, 6122 bp, Artificial Sequence
  Description of Artificial Sequence: Synthetic coding sequence
atggagcacaaggaggtggtactgctgcttttgctgtttctaaagtccgcagccccagaacagtcgcacgtggtgcaagactgttatcatggcgacggccagtcgtatcggggtacctactccaccacagtgaccgggcgtacctgccaagcctggagtagcatgacgccccatcaacacaatcgcaccaccgaaaattatcctaatgccggacttatcatgaactactgtcggaaccccgacgcggtggctgcaccttattgttatacaagagaccccggagtgagatgggaatattgcaacttgacccaatgctctgacgcagagggaactgctgtcgcgccacctacggtgacacctgtccccagcctggaagctcctagcgaacaggcccctacagaacaacgccctggagttcaggagtgctatcatgggaatggacaatcttataggggtacctactctactactgttaccggtaggacctgtcaggcatggtcaagtatgacgccccattcccattcaaggactccggaatactaccctaatgccggactgatcatgaactactgccggaatccagacgctgtcgcggctccttactgttatactcgcgaccccggagtgagatgggagtattgtaacctcacccagtgttccgatgccgagggaacagccgttgcaccacccaccgtgacccccgtgccgagcctagaagcccctagtgagcaagcacccaccgagcagcgcccaggggttcaagagtgttaccatggaaatggacaatcctaccgtggaacatattccacaacagtgactgggcgaacatgtcaggcctggtcctcaatgactccacatagtcactcccgtacccccgaatattacccgaacgctggcttgataatgaactattgcaggaaccctgatgcagttgccgcaccttactgctatactcgggaccccggagtgcggtgggaatactgtaacctcactcagtgctctgacgccgaagggacagctgtagcaccaccgacagttaccccggtgccctctctcgaagctccctccgagcaggcaccaaccgagcagcgcccaggcgtgcaggagtgttatcatggaaacggccagtcgtatcgcggaacttacagcacaactgtcacaggtcgtacctgccaagcctggagttccatgacgccacatagccattcccgaacccctgaatattatccaaacgccggtcttattatgaactactgcaggaatccagacgcggtcgccgcaccatactgttacacaagagatcctggagtgagatgggaatactgtaacttgacccagtgttccgatgcggaagggacagccgttgcgccacccaccgttaccccagttccaagcctggaggcgccatcagagcaggcccctactgagcagcgtccaggtgtccaggaatgctaccacggtaatggccaatcatatcggggaacttattcaaccaccgtgactggaagaacatgccaggcctggagctcgatgacacctcacagccacagccgtacccctgaatattatcccaacgccggtctcatcatgaattactgtagaaatccagatgccgtcgcagccccatactgctatactagggatccgggagtgaggtgggagtactgtaacctgacacaatgtagcgatgctgagggaactgccgtggcccctcccactgtgacacccgttccctcccttgaggcccctagcgaacaagccccaacagagcagcgccctggtgtacaagaatgctatcatgggaatgggcagtcgtacagagggacgtacagcaccacagtcaccgggaggacgtgccaggcatggtcttctatgacaccccattcacattcaagaacgcctgaatactacccaaacgcgggacttattatgaactactgcaggaaccccgacgcagttgctgcgccttattgctacactagagatccaggcgttaggtgggagtattgcaatctgactcaatgctctgacgccgaggggacggctgtggcgccacccaccgtgacccccgtgccatcgctggaggctccatccgagcaggcaccaactgagcaaaggcccggagtccaggagtgttatcatggtaacggacagagctatcgaggtacctattctacaactgtgaccggacgaacctgtcaggcctggtcctctatgacacctcactcccactcacgcaccccggagtattatccgaacgcaggcctcattatgaattactgtagaaaccccgatgctgtagcagcgccatactgctacacacgggacccaggggtgcggtgggagtactgcaacttgacgcagtgctcggacgccgagggcacagctgtcgccccacctactgtgactcctgtgccctcgttggaggctcccagcgagcaagcacccaccgagcaacggccaggagtccaggaatgctaccatggcaacggccagtcgtatcggggaacctattccaccaccgttactggccgtacgtgtcaagcctggtcaagtatgacaccccacagccactctagaacaccagagtactatccgaatgccggactgataatgaactactgcagaaatccagaccccgtggcagcaccatactgttacactcgcgatccaagcgtgcgctgggaatactgtaatctgactcagtgttcagatgctgaagggacagctgtcgcgcctccgacaataaccccaatcccctcactggaggctccttctgaacaggcacctacagagcagcgcccaggtgtgcaggaatgctaccacggtaatggacagtcttaccaagggacctactttatcaccgtgaccgggaggacgtgtcaggcctggtcgagtatgacgcctcactctcattcacggacgccagcatattatcctaatgccggactgattaaaaattactgtcgcaatcccgatcctgtagccgcaccctggtgctatactactgacccctccgtacgctgggagtactgtaacctcacacgctgttccgatgccgagtggactgcattcgtgccccctaatgtcatcctcgcgccttctctggaagcatttttcgaacaggcccttactgaagagacccctggggtgcaggactgctactaccattatggccagagctatcgaggaacctacagcacaacagtgacaggtcggacctgccaggcttggtcttctatgacgccgcaccaacacagcaggacacccgagaattatcccaacgctggcttgactcgaaactactgtcgaaatcccgatgccgagattcgcccttggtgctacaccatggacccatctgtacgctgggagtattgtaacctaacccagtgcttggtgaccgaatcgtccgttctcgctacactgactgtggtacccgacccgtccaccgaagcctcgtcagaagaagcaccaactgaacagtcccctggggtgcaggactgctatcatggtgacggacaatcctatcggggttcattctcaaccaccgtgacaggccgaacctgccagtcatggtccagtatgacaccccactggcatcagagaactaccgagtattaccccaacggaggtctcacacgtaattattgccgtaaccctgacgccgaaatcagtccatggtgttacacaatggaccctaacgtgcgttgggagtactgtaacttgactcagtgcccagtgacagaatctagcgtgcttgcgacatctacagctgtttccgagcaagccccaaccgaacaatcacccactgtacaggattgctaccacggtgatggacaaagttaccggggttcgtttagtactacggtaacgggcagaacatgccagagctggtcttcaatgactcctcattggcatcagaggacaacggagtattaccctaacggcggactgacgaggaactactgccgcaatcccgacgccgagattaggccatggtgttacacaatggatccttctgtgagatgggagtactgcaacctgacacagtgcccagtgatggaaagcacacttctgacaacaccaactgtcgttcctgttccaagtacggaattgcctagcgaggaagcgccaaccgagaacagcacaggcgttcaagattgctacaggggtgacggtcagagttaccgtgggaccctctccaccactataacagggcgtacgtgtcaatcctggagtagtatgactccgcactggcacaggaggattccgctctactatccaaatgcgggtctgactcgcaattactgtcggaacccggatgccgaaattcgtccttggtgctacacgatggaccccagcgtccgctgggaatattgtaatctcaccaggtgccccgtcactgaatcttccgtgctcaccaccccgacagttgccccagttccttcaaccgaagccccaagcgagcaagcgccacctgaaaagtccccagtcgtgcaggactgctatcacggagatggtaggtcttatagagggatttccagcactacagtgaccggaaggacctgccaatcctggtcatctatgatacctcactggcatcagcggactccggagaactatccaaacgcaggactcaccgagaattactgcaggaacccagattccggaaagcagccctggtgttacacaacggatccttgcgtgaggtgggagtactgcaacctgacccagtgtagcgaaacagagagcggcgtactcgagactcccaccgtcgtccctgttccttctatggaggctcatagtgaggcagcaccaaccgagcagactcctgttgtccgccaatgctatcatggcaatggacagtcatataggggcaccttttcgaccacagtcacaggcaggacttgtcagtcttggtccagtatgacaccccaccggcatcaacggacccccgaaaattatcctaatgacgggctgaccatgaattactgccgaaatcccgacgccgacacaggtccctggtgttttaccatggatccatctatacgctgggagtactgtaacctgacccggtgctccgacaccgaaggcaccgtcgtggctccgcctacagttattcaggttccaagtctcggcccaccaagcgagcaagactgtatgtttgggaatggtaaaggctacagagggaagaaggcaaccaccgttaccggtacaccttgccaagagtgggccgctcaggaaccacaccggcattctactttcatccctggaactaataaatgggctgggctggagaagaattactgtcgcaaccctgacggcgacatcaatggtccatggtgttataccatgaacccacgcaagttgttcgattattgtgacattcccctatgcgcaagcagcagctttgactgcggaaagccacaggtggaaccaaaaaaatgccctgggtctatagtgggtggctgtgtggctcatcctcacagttggccctggcaggtaagtttaagaacccggttcggtaaacacttctgtggtggaacactgatctctcctgagtgggtgctgacagctgcccactgtcttaagaaatcttcccggccaagctcatataaagtgattctcggggcacaccaagaagttaatctggagtcacacgtccaggaaatcgaggttagccgactattcctcgagccaacccaggccgacatcgccttgctcaaacttagtagacccgcagtcataaccgataaagtcatgcccgcatgcctccctagcccagattatatggttacagcgaggactgaatgttatatcaccggttggggggaaacacaggggacatttggtactggcctcttgaaagaagcccagcttctggtgatcgaaaatgaagtttgtaatcattacaagtatatatgcgccgagcatctcgcccgtggcaccgatagctgccagggcgattccgggggaccattagtctgttttgagaaggacaagtacatactccagggagtcactagctgggggttgggatgtgccaggcctaacaagccgggagtgtacgcacgggtgagccgctttgtgacatggattgaggggatgatgcgcaataacta

SEQ ID NO: 228877 - DNA, 6122 bp, Artificial Sequence
  Description of Artificial Sequence: Synthetic coding sequence
atggaacacaaggaagtcgtgttgctgttgctgctcttcctcaaaagtgctgccccagagcagtcacatgtggtccaggattgttaccacggcgatggccagtcctaccggggaacatatagcacaactgttaccggaaggacatgtcaggcttggtcgtccatgacacctcaccagcacaatagaactaccgaaaattacccaaatgccggactgatcatgaactactgtaggaatccagatgccgtcgctgccccttattgttacacccgggatcccggagttcggtgggaatactgcaacctcacgcagtgttcagacgcagagggtaccgctgttgcccctcccacggtgacgcctgtcccctcattggaggctccaagtgagcaggcgccaacagaacagaggcccggtgtccaggaatgctaccacggaaacggccagtcataccgaggcacatactcaacgactgtcacgggacgcacctgccaagcctggagttccatgactccacactcccatagccgaacacctgagtactaccccaacgctgggttgatcatgaattactgccgtaatccagacgctgtggccgctccatattgttatactcgggaccccggagtccggtgggagtattgtaacctcacgcagtgctccgacgcagagggaacggccgtagccccaccgacagtgacaccagttccatcactggaggccccatcagaacaggcaccaactgagcagagacccggagtacaggagtgctatcatggaaacgggcagtcttaccggggaacttacagtacaactgttacaggaaggacatgccaagcctggagttccatgactccccactcccactctagaacacctgagtattacccgaatgcgggactgataatgaactactgtcggaaccctgatgccgttgccgcaccctactgctatacaagggatcccggtgtacgctgggagtactgcaatttaacgcagtgttccgacgcggaagggacagcagtcgccccaccaactgtgaccccggtcccttcactcgaagccccttcagaacaggcacctacagagcaacggcctggtgtgcaggagtgctatcacggaaatggccaaagctaccggggaacctactccaccactgtcacagggagaacttgccaggcttggtccagtatgactccacattctcatagccgaacacccgagtattatcccaacgccggtctgattatgaattattgccggaacccagacgctgtggccgctccatactgctatacacgtgacccaggagtccggtgggagtattgtaacctgacacagtgtagcgacgcagaaggaacggccgtggctcccccaacagtgacacctgtgccctcactggaggctcctagcgagcaagcccctaccgaacagcggccaggagtccaggagtgctatcacggaaatggacaaagttatagaggaacttacagcacgacggtgactgggaggacttgccaagcctggagttcaatgactccacattcccacagcagaacccccgagtactacccaaacgccggactgatcatgaattattgtcggaatcctgacgctgtggcagccccatattgttacactagggacccgggagtgcggtgggagtactgcaacctgacacagtgtagcgacgcagaaggcaccgccgtagcccctcccaccgtgacccctgtcccatctctggaagctccatccgaacaggctccaactgaacagaggcccggagtacaggagtgctaccacggtaacggacagtcttacagaggtacgtactccaccacagtgaccggcaggacttgccaggcttggtcctccatgactcctcactctcattcccgcaccccagagtactacccaaacgctggcctgatcatgaattactgccgcaatcctgacgccgtggctgctccatattgttacacaagagatcctggggtgcgatgggagtactgtaacctgacccagtgctctgatgccgagggtactgccgtggcacccccaacagtgacccccgttccaagcctggaagcacccagcgagcaggcccctacagagcagcgacctggggtgcaggagtgctatcacgggaatgggcagagctacagaggaacctatagtactaccgtaactggccgtacctgccaggcctggagtagcatgacaccccacagccatagtcggaccccagagtactaccccaacgccggactaattatgaactactgtagaaatccagatgccgtggcggctccttactgttacacacgggacccaggtgtgcggtgggagtactgcaatctcacgcaatgctcagatgccgaaggtaccgctgtggcccctcctacagtaacaccagtgccctctctggaagctccatctgaacaggctcccactgaacagagacccggagttcaggaatgttatcatggtaacgggcagagttacagaggcacctatagtactactgtcacagggagaacctgccaggcttggagctccatgaccccacactctcactcacgcacgcccgagtactaccctaatgccggtcttattatgaactactgcagaaatcccgacccagtggcggcaccatattgctacacccgcgaccctagcgtccggtgggaatactgtaacttaacacagtgttctgatgccgaaggtaccgcagttgcccctcctacaatcaccccgattcccagtctggaggccccttcggagcaggcccctactgagcaacgccctggcgttcaggaatgctaccacggaaacggccaatcctaccaggggacctactttatcacagtcaccggaagaacatgccaggcatggagctcaatgactccgcattcccactcccgcacgccggcatactaccccaacgcgggtctgattaaaaactactgtagaaatccagacccagtcgcagcaccttggtgttacacaactgacccttccgtcagatgggagtactgcaatttgactaggtgttctgatgcagaatggactgcgttcgtgcctcctaacgtgattttggctccttcacttgaggccttctttgaacaggcccttacggaagaaacccctggagttcaggattgctactatcattacggtcaatcttaccgcggtacatacagcactactgtcactggaagaacttgtcaagcatggtcatccatgacccctcaccaacactcccggacccctgagaactacccaaacgctgggctgacccgaaattattgccgcaaccccgatgctgaaatccgaccctggtgctacaccatggatcctagtgtaaggtgggaatattgcaacctgacgcagtgcctggttactgagtcgtccgtactggctacattgactgttgtacccgatccgtcgactgaggctagttcggaagaggctccaactgaacagagcccaggggttcaggattgttatcatggtgatggccaaagctatcgaggctccttctccacaactgtcaccggcaggacttgtcaatcgtggtctagcatgaccccccactggcatcagaggacgaccgagtactacccaaatggcggactgacccgcaattattgtcgtaacccagacgcggagatcagcccttggtgctacactatggaccccaatgtgcggtgggaatactgcaacctgactcagtgtcctgtgactgaatcgagtgtgcttgcaacatccactgctgtgtctgaacaagctcccacagagcagagtccaaccgtccaggattgttatcatggagatggacaaagctacagaggcagcttctccactactgttactggcagaacgtgtcagagctggtcctccatgacaccacattggcaccagcgaacgactgaatattacccaaatggaggcctcaccaggaactactgcagaaacccggatgccgaaatccggccttggtgctacacaatggaccccagcgtgaggtgggaatactgtaacctgacacagtgtcccgtaatggagtcaacgctgcttactacgccaaccgttgtgccagtccctagcactgaactgccaagcgaggaggcgccaaccgaaaactctaccggggttcaggactgttaccgtggagacggacagagttataggggaaccctctccaccactatcacagggcgtacatgccagagctggtctagtatgactccccattggcatcgcaggattcccctctactacccgaacgccggactgaccagaaattactgtcgcaaccccgatgctgagatccgcccatggtgttacaccatggacccttcggtcagatgggagtactgcaatctcacccgctgtcctgtgacagagtcttcggttcttaccacacccaccgtggctcccgtgccttctacggaggccccatcggaacaggctcccccagagaagtcacctgttgttcaggattgctatcatggggatggaagatcctatcggggtatctcctctactaccgtaaccggtcgcacctgccaaagttggtcatccatgattccccactggcaccagagaacacccgaaaactatcctaatgccggtttgactgagaactattgccgcaatcccgacagcgggaagcagccctggtgctacactacagacccctgtgtgcgttgggaatattgcaacctgacgcagtgttctgagaccgagagcggagttttggagacgcctactgtcgtccccgtgccatctatggaggcacattctgaagcggcaccaacagagcaaacaccagtggttcggcagtgctaccatggcaatggacagtcatacagaggtacattttcaactactgtgaccggccgaacctgccaatcttggagctcaatgaccccacatagacaccaaaggacccctgaaaattatccgaacgatggtcttaccatgaattactgcaggaatcctgatgcggacacaggaccatggtgtttcactatggaccctagtattcggtgggaatattgtaatctgacgcgctgctccgataccgagggcaccgtcgtggcaccacccaccgtgattcaggtaccctccttaggacctccatccgagcaggattgtatgtttggcaacggaaaaggatatcggggaaagaaggctacaacggtgacaggcaccccgtgtcaggagtgggccgcacaggaaccacaccgacatagtacctttatccctggcacaaacaagtgggccggactcgagaagaactattgtcgaaatccagatggggacattaatggaccttggtgttataccatgaaccctaggaaactcttcgattactgtgacatacccttgtgtgctagctccagttttgactgcggaaaaccccaggttgagcctaaaaaatgtccaggctccattgtgggcggatgcgtggcccacccccattcctggccctggcaggtgagcttacggactcgcttcggtaagcatttttgcggtggcaccttgatatccccagaatgggtgctcacagcggcacactgtctcaagaaatctagtcgacccagctcatacaaggtgatcttgggagcccatcaggaagtcaacctcgaatctcacgttcaagaaatagaggtgagcaggctgtttctcgagcccacccaggccgatatcgcattgctcaagctgagcaggccagcagtaattacagacaaggtgatgccagcttgtctgccatccccagactacatggtcactgcgagaaccgaatgttacattacgggttggggcgagacccagggcacgttcggaactgggctactcaaggaggcacagctgctggtcatcgagaacgaggtgtgtaatcattacaaatatatttgcgctgagcatctggccagagggacagactcgtgccagggcgactctgggggaccactggtctgctttgagaaggataaatacatactgcaaggcgtgacatcctggggcctggggtgtgctcgtcctaataaaccaggagtttatgccagggtgtcccggttcgtaacgtggatcgagggaatgatgcgcaacaacta

SEQ ID NO: 228878 - DNA, 4602 bp, Artificial Sequence
  Description of Artificial Sequence: Synthetic coding sequence
atgatgcagcttactctcaatactttattccctgtcgtctcaactccagccatcacctacattgtgaccgttttcaccggtgacgttcgcggtgccggaaccaaaagcaaaatataccttgtaatgtatggcgctcggggaaacaagaactccggcaagatatttctcgagggtggcgtatttgatcgcggaagaactgacatttttcatattgaattggccgttcttctgtcccctttgtctcgcgtgtctgtcggccatgggaacgtcggcgtcaaccggggttggttttgcgaaaaggtggtcattctgtgtccgtttacgggcattcaacagacatttccttgctccaattggctcgatgaaaagaaagcggacggactcattgagcgacagctgtacgaaatggtttctcttcgtaagaaacgcctgaaaaagttcccctggtccctgtgggtgtggaccactgaccttaagaaggctggtactaattccccaatattcatccaaatctacggtcagaaaggcagaaccgatgagatattgctcaatccaaataacaagtggttcaagcccggtatcatcgagaaattccgaattgagctccccgatctgggcagattctataaaattcgcgtctggcacgataagcggtcaagcggcagtgggtggcaccttgagaggatgacactgatgaacactctgaataaggacaaatataacttcaactgcaaccgctggctggatgcaaacgaggacgataatgagattgtcagggaaatgaccgctgagggccctaccgtgagaaggatcatgggaatggcacgctatcacgttacggtttgtaccggtgaactcgaaggcgcaggcaccgatgctaacgtctacctgtgccttttcggcgacgtcggggacaccggagaaaggctcctgtacaactgcaggaataacactgacctcttcgaaaaagggaatgccgatgagtttacaatcgagtccgtcaccatgcgcaatgtgcgtcgagtacgtatccgacacgacgggaagggttctgggtctggttggtacctcgatcgcgttctggtgagagaggaagggcagcccgagtccgacaatgtggagtttccgtgcttgaggtggctggacaaggacaaggatgatgggcaactggtgcgggaacttctgccttcggatagtagcgccaccctgaaaaactttcgatatcatatcagtctgaagaccggtgacgttagcggagcctcgaccgatagccgcgtctatatcaagctgtacggggataaatcagacaccatcaagcaagtgctcctcgttagcgataacaacctgaaggactatttcgagaggggtcgggttgacgagttcaccctggagacacttaatatcgggaacatcaacaggctggtcatcggtcatgactcaacaggcatgcacgcttcgtggttcctggggtccgtccagattcgggtaccaagacaaggaaaacagtacacatttccagccaatcgatggctcgacaagaatcaggccgacggcagattagaggtggaactatacccctctgaggtggtggagattcagaagctcgttcattacgaggtggagatctggacaggagatgtgggtggcgctggtacaagcgccagggtgtacatgcagatttacggtgagaaggggaagaccgaggtgctattccttagttcccggagcaaggtgtttgagcgcgcatcaaaggacacatttcaactggaggcggctgacgtaggggaagtgtacaagctacgcctggggcacacaggtgagggcttcggcccaagctggttcgttgataccgtctggttgcggcatctggtagttcgtgaagtggatttgacccctgaagaggaggccagaaagaaaaaagaaaaagacaagctcagacagctccttaagaaagagcggctgaaagctaaactccaaagaaagaaaaaaaagcgcaaaggttcagatgaggaagacgagggagaggaggaggaatcctctagtagtgaagagagctcttctgaagaggaagaaatggaggaggaagaagaggaggaagagttcggccctggaatgcaggaagttattgagcagcataaattcgaggcccataggtggctagctagggggaaggaggacaatgagttggtggtcgaactggtacccgctggaaaaccaggcccagagcggaacacgtacgaggtacaagtggtcaccggcaacgtgccaaaggctggaacggacgcaaacgtgtatctgacaatttacggcgaagagtatggggacacaggggagcgcccactgaaaaagagcgacaaatcaaataagtttgaacagggacagactgacacgttcaccatttacgctatcgatctgggcgcactgaccaagattcggatccgacatgacaataccggtaaccgtgccggatggttcctagaccgaatcgatatcactgacatgaacaacgaaatcacttattacttcccatgccagcgatggctagcagtggaggaagatgacgggcagctgtcgcgagaactccttccggtggatgagagctatgtgctcccccaaagcgaagaaggcaggggaggcggtgacaacaaccccctcgataatcttgctctggagcaaaaggataagagcacgacattttccgtgactataaaaacgggtgtgaagaagaacgctggcacggatgctaatgtgttcatcactctgttcggcacacaagatgacacaggcatgaccctgctaaaatcttccaagacaaatagcgacaaattcgaaagagactccattgagatattcactgtggaaaccctggatctgggagacctctggaaagtacgtctgggacacgacaacactggcaaggcacctggctggttcgttgactgggtggaagttgatgccccttcgctgggtaaatgtatgaccttcccctgtggtcgatggcttgccaagaacgaggacgatgggagcataattcgtgatctcttccatgccgagctgcagacccgtctctacacaccctttgtcccgtatgagatcacgctgtacacctcagacgtgtttgccgcagggactgatgctaatatttttatcatcatttatggttgtgatgctgtgtgcacgcagcagaagtacctttgcacaaataagagggagcaaaaacagttcttcgagaggaaatctgcatcccgattcatcgtcgagctggaggacgtcggcgagattatagagaagatcagaatcggacacaataatactggaatgaaccctgggtggcattgcagccatgtagatatcagaaggctgctcccggacaaggatggtgctgagaccctcacttttccgtgtgatagatggctggccacctccgaagacgataaaaagactatccgggaactggtaccttacgatatctttacggagaaatacatgaaggatggatcactcaggcaagtatacaaagaggtggaggaaccacttgatattgtcttgtattccgtccagatctttacagggaacatccctggcgctggaaccgatgctaaggtgtacataacgatttatggggatctcggagatacaggagaaagatatctggggaaaagtgagaacagaaccaacaaattcgagcgcggaaccgcagatacctttatcatcgaggcagcggatttaggagtgatctataaaattaagctacggcatgacaactccaaatggtgcgccgactggtacgttgagaaggtggagatctggaacgacacgaatgaggatgagttcctgttcctgtgtgggaggtggctgagcctgaagaaagaagacggtaggctggaacgcctcttttacgaaaaggagtatactggcgatcggtcttccaactgtagctcaccagcagatttttgggagatagctctgtcttctaagatggctgatgtggacatcagcaccgtgactgggccaatggctgattacgtgcaagaaggacccatcattccctactacgtttctgtgactacagggaagcacaaagacgcagcaacagattcacgggcttttatattcttaattggggaggatgatgagagatctaagcgcatttggctggattaccccagaggaaagcgagggttcagccggggatccgttgaagagttctacgtagctggcttagacgtaggcatcatcaaaaaaatcgaagtgctgtatgagatgaccgtctggacaggcgatgtcgtggggggtggaactgactcaaacatcttcatgactctatatggcatcaacgggtcaacagaagagatgcagctggataaaaagaaggccagattcgaacgcgagcagaatgacacattcatcatggagatcctggacattgccccattcactaaaatgcgaattcggattgatggtttaggaagcaggcccgagtggtttctggagcgagtcaaatgcctcgatccgcactcctcattccagccacctcccactccctctccagggtcctcgggactgtcaatggacctggttaaggcacagatgagtttgtag

SEQ ID NO: 228879 - DNA, 5843 bp, Artificial Sequence
  Description of Artificial Sequence: Synthetic coding sequence
atgatgcagttaacccttaatactctgtttccggtggtcagcaccccagcaatcacttatatcgtaacagtctttaccggagacgtgaggggggctggcaccaagtcaaaaatttacctggtgatgtacggtgccagagggaataagaacagcgggaagatatttttagaaggcggtgtgttcgatcgtgggagaacggatatcttccacatcgagctggcagtcctgctcagtcctttatcccgcgtctcagttggccatgggaacgtaggtgtgaataggggttggttttgcgagaaggtagtgatactatgtccctttactggcatacagcagacttttccctgctccaactggttggacgaaaagaaggctgacggattaattgaacggcagctttacgaaatggtgagtctgaggaaaaaaagacttaagaaatttccctggtccctttgggtttggacaactgatctgaagaaagcaggaactaacagtccaattttcattcaaatatacgggcaaaagggtagaactgatgagatattgttgaaccctaacaacaagtggttcaagcctggaattatcgagaaattcagaattgagctccctgacctggggaggttctataagatccgcgtgtggcatgacaagaggagctctggcagcgggtggcatttggagagaatgaccttgatgaacactttgaacaaggacaaatataacttcaactgcaatcgctggcttgacgctaatgaggatgataatgagatagttcgtgagatgactgccgagggcccaaccgtcagaaggataatgggtatggccaggtaccacgtcactgtgtgcaccggggaactagaaggagctggcactgacgccaacgtgtatctctgcctctttggagatgtcggcgacaccggagagcgcctgctgtacaattgtaggaacaacaccgacctgtttgaaaagggtaatgcggatgagttcactattgaaagcgtgaccatgcgcaacgttaggagagtgagaatccgacatgacggcaagggctctgggtccggctggtacttagaccgcgtactggtgcgcgaggagggacagccagagtcggataacgtggagttcccctgcttacgctggctcgataaggataaggacgacggacagctggtgagagagttgcttccaagcgacagctccgctaccctaaaaaattttaggtaccatattagcttgaagaccggggacgtttccggagcaagcaccgacagcagagtgtacattaagttgtacggggataagtccgacacgatcaagcaggttctcctggttagtgataacaatcttaaggactactttgaacgtggcagagtcgacgagttcactctggagacattaaacattggaaatatcaaccgactggttattggacatgatagcaccggcatgcatgccagttggtttttagggtcagtacagattagagtccctcgccaaggcaagcaatacaccttccctgctaacagatggctcgataagaatcaggcagacggtcggctggaggtggagctgtatcctagcgaagtcgtggaaatccaaaagttggtgcactacgaagtcgaaatctggacgggggacgtggggggagccggtacatcggccagagtatatatgcagatttatggcgagaagggcaaaactgaggtgctttttttgtcgagtcgaagcaaagtcttcgaacgtgcctctaaagacaccttccagctggaagcagccgatgtcggtgaagtgtataagttgcgactgggccataccggcgagggattcggtcctagttggtttgtggacaccgtgtggttaaggcatctggttgtgcgggaagtggacctcaccccggaggaggaggctaggaagaagaaagagaaagacaagctgaggcaactgctgaagaaggagcgattgaaggccaaactgcagaggaagaagaaaaaaagaaagggaagcgatgaggaagacgagggagaagaggaggagtcctcgtcttccgaagaaagttcctccgaagaagaggagatggaggaggaggaggaagaagaagagttcgggcctggaatgcaagaagttatagagcaacacaagtttgaggcccacagatggcttgccagaggtaaggaggataatgagctggtggtagaactcgtgcccgctggcaagcctggacccgagagaaatacctacgaagttcaagtggtcaccggtaacgtgccaaaggctggcacggacgccaacgtttatctgacgatttacggcgaagaatacggggataccggagagagacctcttaaaaaaagtgataaaagtaataaattcgagcagggacaaacagacacatttaccatctacgcaatcgatctgggagcactgacaaagatcaggatccgtcacgacaatacaggtaaccgagccggttggttcttggatagaatcgacatcactgacatgaataacgaaattacctattatttcccttgccagcgctggcttgccgttgaggaggacgatggccagttatcacgagaactgctgcctgtcgacgaaagttatgttctgccacaatcagaggaaggccgaggcggaggggataacaatccgctggataatcttgccctggaacagaaggacaagtccaccacattctccgtgacaattaagactggagtgaagaaaaatgcgggtacagacgcaaacgtctttatcactttgttcggcacgcaagacgatactgggatgactctgctgaaaagctccaagacaaactcagataaatttgagcgcgacagcatagaaatcttcaccgttgagacgctcgacctgggcgatttgtggaaggttagactcggccacgacaacacagggaaggcacccggatggtttgtcgattgggtcgaagtggatgcccctagtctggggaagtgtatgacgtttccttgtggacgttggctggcaaaaaacgaagacgatggctctatcattcgagatctgttccacgcggagctccagacccgattgtatacaccattcgttccatacgagattacactgtacactagtgatgtgtttgcagcgggaactgatgcaaacattttcatcattatttatggctgtgacgcggtttgcacccagcagaaatacttgtgcactaacaaaagggaacaaaagcaattttttgaacgcaaatccgctagccgatttatcgttgaactggaggatgtcggagagatcattgaaaagatccggatcggtcataataacaccggcatgaaccccggatggcactgttcacacgttgacataagacgacttctaccagacaaggatggcgcagagaccctgactttcccatgcgatcgatggttagccacatccgaggatgataaaaagacaatcagggaattagtaccatatgacatcttcacagagaaatatatgaaagacggttcgttaaggcaggtgtacaaagaggtggaggaaccgctcgatattgtactatactccgtgcaaattttcacaggtaacatccctggcgctggaactgatgctaaagtgtacatcacaatctatggcgatttgggagatacaggtgaaagatacctgggaaagagtgagaacagaactaacaagttcgagagagggaccgccgacacattcatcatcgaggctgccgatttgggcgtcatatacaagatcaaactgaggcatgataacagcaagtggtgtgcggattggtatgttgagaaagtggagatatggaatgacacaaatgaagacgaattcctttttctgtgtggcaggtggctgtcactcaagaaagaggatggacgtctcgagagacttttttatgaaaaagagtacaccggcgatcggtcaagcaactgctcttccccagccgatttttgggagatcgctctgtccagtaagatggcagacgtggacatctctacggtcactggccctatggccgactacgtgcaggaagggccaatcataccatactacgtgagtgtcaccaccgggaagcataaagatgcagccactgactctcgtgctttcatatttctcattggggaagacgatgaacggagcaagaggatctggctggattacccccgaggaaagcgcggatttagccggggatccgttgaagagttttatgtggccggtctggacgtcggcattataaaaaaaatcgagctcgggcatgatggtgcctcacctgaaagctgttggcttgtggaagaactctgccttgccgtgccgacgcaaggcactaagtacatgctgaactgcaattgttggcttgctaaagaccggggtgatggcatcacctctcgggttttcgatctgctcgacgctatggtggttaatattggagtcaaggtcttgtacgagatgacggtttggaccggagatgtggtgggcggaggcacagactcgaacatctttatgaccttatacggcattaacgggtcgacagaggagatgcagttggacaaaaagaaggctcgttttgaaagggagcagaatgacacattcattatggagattctcgacattgcaccctttactaaaatgagaattcgaattgacgggctcggaagcaggccagaatggtttctggaacgtattctcctcaagaacatgaacactggggatctgaccatgttctattatggcgactggttgtcacagagaaaggggaagaagaccctggtgtgcgaaatgtgcgcagtgatcgacgaagaagagatgatggaatggaccagttatacagtagccgtgaaaacttccgacatattgggagcaggcacagatgccaacgtgttcatcatcattttcggcgaaaacggcgactccggcacactcgcactcaagcagtccgcgaattggaacaagtttgagaggaataatacggatacgtttaactttccggatatgctgagcctggggcacttgtgtaagttgagggtgtggcatgacaacaaaggcatcttcccaggatggcacctgtcatacgttgacgttaaagataatagcagagacgagacatttcactttcagtgtgactgctggctcagtaaaagcgaaggagacggtcaaacagtgcgagacttcgcctgtgccaacaataaaatctgcgacgaactggaagaaacaacatatgagatcgtaatcgagaccggcaacggtggcgagacaagagagaacgtctggctgatcctagagggaagaaaaaatcggtcaaaggagtttttgatggaaaatagcagccgacagagagcatttagaaagggcaccaccgatacattcgagttcgactccatatacctgggggacattgcaagcttatgtgttggccatctcgccagggaggataggttcatccctaagcgagagctcgcctggcacgttaagactattactataacagagatggaatatggtaatgtgtactttttcaactgcgactgcttaattcccctgaaacgcaaacgtaagtactttaaagtcttcgaagtgacgaagacaacagaaagtttcgcttctaaggttcaaagcctcgtgcccgttaaatatgaggtgattgtgacaacaggctacgaacccggagctggtacagacgccaatgtgtttgtcacaatcttcggagctaacggcgacacgggcaaacgcgagctgaagcagaaaatgcgtaatctttttgagcggggatccacagaccgcttcttcttggagacactggagttggtcgtgacacgactgggtctggccgcagagtgtggcta

SEQ ID NO: 228880 - DNA, 3435 bp, Artificial Sequence
  Description of Artificial Sequence: Synthetic coding sequence
atgctgagacacctgacagatactttcactatttatgccatcgacctgggcgctctcaccaagattaggatcaggcacgataacaccgggaaccgcgcaggctggttcctggaccgaattgacataacagacatgaataatgaaatcacttactacttcccctgccaacggtggctggctgtggaggaggatgacggacaactatcgcgcgagctccttccagtcgacgagtcctacgttctgccacagtctgaagaaggcaggggcggtggagacaataacccattagacaatctcgccttggagcagaaagacaaaagcaccaccttctccgtcaccattaagacgggcgttaagaagaacgccggaacggacgccaacgttttcatcacccttttcggcacacaggatgacactggaatgacactcctgaagagcagcaaaaccaacagcgacaagttcgaaagagattcaatcgaaatcttcaccgttgagaccctagaccttggcgatctgtggaaagtgcggcttgggcacgacaacacaggtaaggctccaggatggttcgtggattgggtggaagtcgatgcaccctctttggggaagtgtatgaccttcccttgtggccgttggctggctaaaaatgaagacgatggctctattattagggatttattccacgccgaactccagaccagactttatacccctttcgtcccctatgagataactctatacacttctgatgtctttgccgcagggactgatgccaacatttttattatcatttacggctgcgacgcagtctgcacccaacagaaatacctctgcacgaacaagcgggagcaaaaacagttcttcgaaaggaagtcagcgtctcgctttatagtagagctggaggacgtgggggagataatcgaaaagattagaattggccacaacaataccggtatgaaccctggatggcactgctcacacgtggacattaggcggctgctgcctgacaaggatggagccgaaactctaactttcccctgcgatcgctggttggccaccagcgaagatgacaagaaaaccatccgcgaattggtgccctatgatatattcacggaaaaatacatgaaagatgggtccctcagacaggtgtacaaggaagtggaggaaccactggatattgtcttgtatagtgttcagatttttaccggaaacattccaggagccggaaccgatgcaaaggtgtacattacaatctatggggacctgggcgacactggtgaacggtacctgggaaagtcagagaacagaacaaataaattcgaaagggggacggccgatactttcattattgaggcagctgacctgggcgttatctataagatcaagctgaggcatgataactcaaagtggtgcgctgactggtatgtagaaaaggtagaaatctggaacgacacgaacgaggacgagttcctgtttttgtgtggaaggtggttgtcactcaagaaagaagacggcaggctggaacgtctgttctacgagaaagaatatactggggataggtcgagtaactgtagctcccctgccgatttctgggagatcgccttgtcaagcaaaatggccgatgtagatatatcgacagtcactggccctatggcagactacgtgcaggaaggcccaattatcccatattacgtgtccgtgactaccggaaaacataaggacgccgctacagattctcgcgctttcattttcttaatcggagaggacgatgagaggagtaagcgaatatggcttgactacccgcgaggaaaaagagggttctctcgcggtagtgttgaggagttttacgtcgcagggttagatgtcggcatcataaagaaaatcgaggtcctctatgagatgacagtctggaccggagacgtggtgggtggaggtacagatagcaatatattcatgacactgtatggcataaatggatcaaccgaggaaatgcagctggataagaagaaggccagatttgagagggagcagaatgatacttttatcatggaaatcctggacattgcaccattcacgaagatgagaattaggattgacgggctgggctcccgccctgagtggtttcttgaaaggatcctattaaagaacatgaatactggagatctcacaatgttctactacggcgattggctttcacagcggaaaggtaagaagacccttgtgtgcgaaatgtgtgctgtgattgacgaggaggaaatgatggaatggacctcttacacggtggccgtaaagacttccgacattctgggggcagggactgacgctaacgttttcattattatctttggggaaaacggcgattccggaaccctggcattgaagcaatcggcaaactggaataagttcgagaggaacaacaccgatacctttaattttccagatatgctgagtctcggccacttatgtaaactgagggtgtggcacgataacaaggggatcttcccagggtggcacctgtcgtacgtcgacgttaaggataattctcgcgacgaaactttccactttcagtgcgattgttggctcagtaagagcgagggagacggccagactgttagggatttcgcttgcgcaaataataagatctgcgacgaacttgaagaaaccacttacgagattgtcatcgaaaccgggaacggcggtgagacgagggagaatgtctggctgatcctcgagggacgtaaaaaccggtctaaggaatttctcatggagaacagttcccggcaaagggcctttaggaaaggtactaccgatacatttgagttcgactccatatatctaggcgatatagcatcgctgtgcgtcggacatctggcacgggaagacaggttcattcctaaaagggaacttgcttggcatgtgaaaacaataaccatcactgagatggagtacgggaatgtatacttttttaattgtgattgtctcatcccacttaagcggaagcgcaaatactttaaggtgtttgaggtcaccaagacaacagaatctttcgcctcaaaggtgcagtccctcgtgcccgtcaagtacgaggtcatcgtcacaactggatacgaaccaggtgcaggcaccgacgctaatgttttcgtcaccatttttggcgcaaatggcgacaccggaaagcgtgagttgaaacagaagatgcgaaacctcttcgaacgtggatctaccgatcgcttttttctggagacactggagctaggcgaactccggaaagtgcgactggaacatgatagctccggttactgtagcgggtggcttgtcgagaaagttgaggttacaaatacttcgaccggcgtggcaacaatctttaattgcggccgatggctggacaagaagagaggcgacggtctgacctggcgcgacctctttccctctgtctag

SEQ ID NO: 228881 - DNA, 921 bp, Artificial Sequence
  Description of Artificial Sequence: Synthetic coding sequence
atgcgactcgggactaattgcgagcatcctcaactgccactagcagctccctccggctattacttcccctgccagcgttggctggctgtcgaggaggacgacggacagctgtcaagggaactgttgcctgtcgacgaaagctacgtgctaccccagagtgaggagggcaggggcggtggagacaataacccccttgacaatctggctctggagcaaaaggataagagcaccactttttccgttaccataaagacgggggttaagaagaacgcgggaaccgatgcaaacgtgtttattactttgttcggtacacaggatgacacaggaatgaccttgcttaaatcgtcgaagaccaactcagataaattcgagcgcgactccatcgaaatcttcaccgtcgaaactctggatctgggagacctttggaaggtccgcttgggtcacgacaacactgggaaggctcctggttggtttgtggactgggttgaagttgatgcccctagtcttggcaagtgcatgacattcccctgcggcaggtggctggctaagaatgaagacgacggctcaattattagggacttatttcatgccgaattacaaacccgactttataccccgtttgtcccgtacgaaattaccctttatacttcagatgtcttcgcagccggaaccgacgctaatatcttcattataatttacgggtgtgacgccgtctgcactcagcagaagtatctctgtaccaataaacgtgagcagaaacaattttttgaaaggaagtctgctagcaggttcattgtcgagttggaggatgtgggcgagattatcgagaaaatccgcattggccataataatacagggatgaatcccggttggcactgctcccacgtagacatcaggaggttactgccagacaaggattag

SEQ ID NO: 228882 - DNA, 6635 bp, Artificial Sequence
  Description of Artificial Sequence: Synthetic coding sequence
atgatgccccaaaagaaacgtcgacggaaaaaggacatagacttcctcgctctttatgaagccgagttgttaaactacgcatcagaggatgacgaaggtgagctggagcacgagtattacaaagctcgagtgtatgaggtcgtgaccgcaactggcgacgtgcggggagcgggaacggatgcaaacgtgtttattaccctgtttggggagaatgggctttcacctaagctccaactaactagtaagagtaagtctgcattcgaaaaaggaaacgttgacgtgttcagggtgagaacaaacaacgtgggcctcatatataaggtgcggattgaacatgacaacaccggcctcaatgcttcctggtacctggatcacgtcatcgtcaccgacatgaaacgaccccacctgagatattactttaattgcaacaactggttatcaaaagtcgagggcgatagacaatggtgtagggatctgttggcttcctttaacccaatggatatgccccgaggcaacaaatatgaagtgaaagtatacaccggcgatgtcatcggcgctggaactgacgccgacgtatttatcaacatatttggtgagtacggcgacacaggggagagacgccttgaaaacgagaaagataatttcgagaagggagcagaagaccgcttcattctggacgctccagatctggggcagcttatgaagattaacgtggggcataacaacaaagggggttccgccggttggtttctcagccaaatcgtgattgaggatatcggcaacaagcgaaagtatgacttcccgctgaataggtggctggccttggatgaagacgacggtaagatccaacgggacatactcgtaggcggtgctgagacaacggccattacgtatattgttacagtctttaccggtgacgtacgcggagctggcacaaagagcaaaatctatctggtaatgtatggcgctcgcggaaataagaacagcggtaaaatcttcctcgaagggggagtttttgatcgagggcgtacggatatttttcacattgagcttgccgtcctcctcagccccctatcccgcgtcagcgttggacatggcaacgttggcgtaaacagagggtggttctgcgaaaaagtggtcattctctgcccttttacgggcatccagcaaacttttccatgtagcaattggctcgatgaaaagaaggctgatggattaatcgagcgccagttgtacgagatggtttcactgagaaaaaagcgattaaaaaaattcccatggtccctgtgggtgtggaccaccgacctgaagaaagcaggaacgaatagtcccatattcatacagatatacgggcaaaagggaaggacagatgagatcctgctgaacccaaataacaagtggtttaaaccaggtataatcgagaagtttcgcatcgaactgccggatctcggacgattctataaaatccgcgtctggcatgataaaagatcatcggggtctgggtggcatctcgagcggatgactctaatgaacaccctgaacaaggataaatacaactttaactgtaatcgatggttagacgcaaatgaagatgacaatgaaatcgttcgtgagatgaccgcagagggccctactgttagaaggatcatgggaatggcacgttatcacgtgactgtgtgcacaggagaactcgagggcgctggcaccgacgcgaacgtgtacctgtgtctattcggggatgtgggtgatacaggggaaagactcttgtacaattgccggaataataccgacctcttcgagaaagggaatgccgacgagtttaccatcgaatcagttaccatgcgaaatgttcggagggttagaattaggcatgacggtaaaggctcaggatcggggtggtacctcgatcgtgttctggtgagggaggaaggacagcccgagtctgacaatgttgaattcccctgtctgcggtggctggataaagataaggacgatggccagctcgtcagagagctgcttcccagcgattcctctgccactctcaagaatttccgctaccacatatccctcaaaaccggcgatgtgtccggcgcttcaaccgattccagggtgtatataaagttgtacggcgacaaatcagacactatcaaacaggttctgctggtatccgacaataatctaaaggactatttcgaaagaggtcgcgtggacgagtttacgcttgagaccttgaatataggtaacattaataggctggtaataggtcatgattccaccggcatgcacgcaagctggttcttgggttccgtacaaatcagggtgcctcgccagggcaagcaatacacctttcctgcaaaccgctggcttgacaaaaaccaggctgatggccgactagaggtggagctttatccttccgaggtggtagagatacagaaactggtgcactacgaagtcgagatttggaccggggacgtgggcggagccggaaccagcgccagagtctacatgcagatctacggcgaaaaggggaaaaccgaggtgctatttctgtcttcccggtcgaaggtcttcgaacgggctagtaaagacacctttcagcttgaggcggctgacgttggtgaggtgtacaaactgcggctaggtcacacaggcgaaggattcggcccttcttggtttgtggataccgtctggctgcgccacctcgtggttcgcgaggtagaccttacccccgaggaggaggcgcgtaagaagaaggaaaaagataagcttcgccagcttctcaagaaggagcgcctgaaggcgaagctccagcgaaaaaaaaaaaagagaaaaggctcagacgaagaggacgagggcgaggaagaagaaagttcaagtagcgaggaatcctcctccgaagaagaggagatggaagaggaagaggaagaagaagagttcgggccaggcatgcaggaggtgatagagcagcataagttcgaagcgcaccgatggctggcgagagggaaagaggataatgagctcgttgttgaactcgttcctgctggtaagccagggcctgagcggaatacctacgaagtgcaggtggtgacaggaaatgtgcccaaggcaggcacagatgcgaacgtgtacctgaccatctatggtgaggaatacggcgacacaggggagcgccctttgaagaagtctgacaaatcgaacaaattcgaacagggccagacggacacattcaccatctatgctatcgacctcggtgccctcaccaaaatacgtatccgccacgataacaccggtaatagggccggatggtttttggacaggattgatatcaccgacatgaacaacgagatcacctattacttcccttgtcaacggtggctagccgtagaagaggacgacgggcagttgtctagggaacttctaccggtggacgagtcttatgttttaccgcagtccgaggaggggagaggcggtggggacaacaacccactcgataacctggcactggagcaaaaagacaagagtactacgttcagcgtgaccattaagaccggggtcaagaaaaatgccggtacagatgccaatgtattcattacgctcttcgggacccaggatgacacaggtatgacacttcttaaatccagtaagaccaatagcgataagttcgaacgggactcgattgagattttcactgtagaaacacttgaccttggcgacttgtggaaggtgagactcggccacgacaatacaggaaaggcacccggttggttcgtagattgggtagaggtcgatgctccatcactcggcaaatgcatgacctttccatgcggcaggtggttggcgaaaaatgaagatgatgggtccatcatccgggatctgtttcacgctgagctgcaaacgcgcctgtacacccctttcgtgccctacgaaatcaccctctacacttctgacgtttttgctgccggaacggatgctaacatcttcatcatcatatatggatgcgatgcggtttgtactcagcaaaaatacctgtgcactaacaaacgcgaacaaaagcagttctttgagaggaagagcgcctccagattcattgtcgagcttgaggacgtgggggagatcatcgaaaagattcgaatcggacataacaacactggcatgaatcctggatggcattgcagccacgtggatatccggagactactccccgataaggatggcgctgagacactgacttttccctgcgatagatggttggccacttcggaggacgacaagaagaccattagagaactggtgccatatgacattttcacagagaaatacatgaaggacgggtcactccggcaggtgtacaaggaggtggaagaacccttggacattgttctgtatagcgtccagatatttaccggcaacataccaggtgccggaaccgacgctaaggtttacattaccatttacggagatctgggagacacaggagagcgatatctaggtaagagcgaaaaccgcacaaacaagttcgaaagggggacagctgacactttcatcattgaggccgcagaccttggggtgatttacaaaatcaaactccggcatgacaattccaaatggtgtgccgactggtatgtggagaaagttgaaatttggaacgataccaatgaggacgagttcctgttcttgtgcggtcgttggctctcgttaaaaaaggaggacggtagactggagcggctattctatgaaaaggaatataccggcgaccggtcctctaattgtagttcacccgcagacttttgggagatcgccctttctagtaaaatggccgacgtggacatttcgacagtgactgggccaatggccgattacgtgcaggagggccctatcatcccttactatgtgtccgtcacaaccggaaaacataaagacgctgcgaccgactcccgcgctttcatttttcttattggagaagatgatgaacggtctaagaggatctggcttgactacccgcgtgggaagcggggattctcccgaggaagcgtggaggagttttatgtggcgggtttggatgtggggatcatcaagaagattgaagtgttgtacgagatgacagtgtggactggcgacgtcgtaggaggcggtactgactctaacatcttcatgacgctgtacggaatcaacggcagcaccgaagagatgcaactagacaaaaagaaagctagatttgaaagagaacagaacgatacctttattatggagattctcgacatcgcgcctttcactaaaatgagaatcaggatcgacggactcggctcccgccctgaatggttcctggaacgcatattgctgaaaaatatgaacaccggcgatctgactatgttttattatggcgattggctcagccagagaaagggaaaaaagacactggtctgcgaaatgtgcgctgtgatcgatgaagaggagatgatggagtggactagttataccgtggcagtgaaaactagtgatatcctgggggctgggactgacgccaatgtgtttatcattattttcggcgaaaacggcgacagcggaaccctagcccttaaacaatcagcaaattggaataagtttgagaggaacaataccgatacattcaacttcccggacatgctgtccctgggtcatttgtgcaagctgagggtctggcacgacaataagggaattttccccggatggcatttatcatacgtggacgtcaaagataactctcgtgatgagactttccattttcagtgtgactgttggctgtccaaaagtgagggtgatggacagacagtgcgggacttcgcatgcgcgaataacaagatttgcgacgaactagaggagacgacctacgagatcgtgattgaaaccggaaacggtggagagacacgagagaacgtatggttgattttggagggtagaaagaaccgatccaaggaattcctcatggagaattcttccagacaaagagccttccgaaagggaacaactgatacattcgagtttgatagcatatacctgggcgacattgcgagcctctgcgtgggtcacttggccagggaggatcggtttattcctaagcgagaactggcctggcacgtgaagactatcactatcacagaaatggagtacggaaatgtttacttctttaactgcgactgcctcatccctctcaaaaggaaacggaaatacttcaaagtctttgaggtgaccaaaactacagagtccttcgcttcaaaagtccaatctctggtcccggtgaagtatgaagttattgtcactacaggttatgaacctggggctggaactgatgccaacgtcttcgtcaccatcttcggtgcaaacggggacacagggaagagggagctgaaacagaagatgcggaatctcttcgagaggggcagcaccgatcggttctttctggaaaccctggaactaggcgaacttagaaaggtgaggctcgagcacgacagctctgggtactgctccgggtggcttgtagagaaagtggaggtcaccaatacatctactggcgttgcgactattttcaattgtgggagatggctggataagaagcggggagatggcctaacatggcgggatctctttccctccgtgta

SEQ ID NO: 228883 - DNA, 3345 bp, Artificial Sequence
  Description of Artificial Sequence: Synthetic coding sequence
atgaacaacgagatcacatattatttcccatgccagcgctggctcgccgtggaagaggatgacggtcagctctccagggaactgctccccgtcgacgagagttacgtgctccctcaatccgaagagggtaggggagggggtgataacaacccactcgataatctggcattggagcagaaagataaaagcaccacatttagcgttacgattaagacaggagtcaagaagaatgcagggaccgatgccaatgtcttcatcaccctgttcggcacccaggacgatacgggcatgacattgcttaaaagctccaagactaatagcgataaatttgaaagggacagcatcgaaatctttacggttgagacactcgatctcggcgacctatggaaggtccgccttggacatgacaacactggaaaagccccaggttggttcgtagactgggtcgaggtcgatgctcctagcctgggtaaatgtatgacatttccctgcgggagatggttggctaaaaacgaagacgatggctcaataatcagagatctctttcacgccgagctgcagactaggctttatactcctttcgtaccttacgagattactctgtacacctctgatgtcttcgccgcaggtacagatgcaaacatttttatcattatctatgggtgcgacgccgtttgtacacaacagaagtacctgtgtaccaataagcgggaacagaagcagttcttcgagaggaagtctgccagcaggttcatcgtagaattggaagacgtgggcgagatcatagagaaaatacgcattggccataacaacactggcatgaatccaggttggcattgcagtcatgtcgacattcggaggctcctgcctgataaggatggggctgagaccctgactttcccctgcgaccggtggttagctacctctgaggacgataaaaaaactatcagagaactggtcccctacgatattttcactgagaaatatatgaaagatggctctctcaggcaagtatacaaggaggtggaggaaccattggatatagtgctgtacagtgttcagatatttacaggcaacattcctggagctggaacggatgccaaagtttatattaccatctatggagacctcggggacaccggcgaacggtacctgggcaagtccgagaatcggaccaataagttcgaaaggggtactgcggatactttcatcattgaagctgccgatctgggcgtcatttacaaaatcaagctcagacatgataacagtaagtggtgcgcagactggtatgtggagaaggtggagatctggaacgacaccaatgaggatgagtttttatttctctgtggtcggtggctctccctgaagaaggaggacggcagactcgagcgtctgttttacgagaaggagtacacaggagacagatcttcaaactgttccagtccagcagacttctgggagattgcactttcaagtaagatggccgacgtggacatctccactgtcactgggcctatggcagactacgtacaggagggcccaattatcccctattacgtgtctgtaacaaccggcaaacataaggatgccgctaccgatagccgcgctttcattttcctgattggggaggatgatgagagatcgaaacgcatttggttggactacccacgaggtaagcgagggttctctcggggatcagtggaggaattttacgttgctggcctcgacgtgggcattattaagaagattgaattgggccatgatggtgctagtcctgaatcctgctggttagttgaggagctgtgcctggctgtgcctactcagggtactaaatacatgttaaattgcaattgctggttggctaaggatagaggggacggcatcacaagcagggtatttgaccttctggacgcaatggtagtgaacatcggagttaaggtgttgtacgagatgaccgtgtggacgggggacgtggttggagggggaaccgatagtaacatttttatgactctctatggcatcaacgggagcactgaagaaatgcagctcgataagaagaaggcacgcttcgagcgcgagcagaacgatactttcattatggagattctggatatcgccccatttacaaaaatgcgcataaggattgacggcctcgggtctcggcctgagtggttcttggagcggatattgctgaagaatatgaacacaggcgatttgactatgttctactatggcgactggttgtcacagcgaaaaggtaaaaagacacttgtgtgcgagatgtgcgccgtcatagatgaagaagagatgatggagtggacgagttacacagtcgcggtcaagaccagcgacatcctgggtgccggaacggacgcaaacgtgtttatcatcatattcggcgaaaacggcgatagtggcacgctagccctcaaacagagcgccaattggaacaaattcgaaagaaacaacacagacacatttaatttcccagacatgttatccctaggacacctctgcaaacttcgtgtttggcatgacaacaaaggcatttttccgggttggcatctctcctatgttgacgtgaaggacaattcgcgagacgaaacatttcatttccagtgtgattgctggttgtcaaaatcagagggagacggacagactgtaagagactttgcatgtgccaacaacaagatttgtgacgagctagaggaaaccacttatgagatagtgatcgaaaccggtaatggtggtgagaccagggagaacgtatggctcatcctcgagggcaggaaaaacaggtccaaggaattcctcatggagaactctagtagacagagggcatttagaaaggggacgacagatacattcgagtttgacagcatctatctcggcgatatagcaagcctgtgcgtaggtcaccttgccagggaagatcgtttcatcccaaagagggaactcgcatggcatgtcaaaactataacaattactgaaatggagtatggaaacgtgtacttttttaattgtgactgccttattcctctgaagagaaagcgtaagtactttaaggtttttgaggttaccaaaaccacggaatcatttgcctccaaagtgcagtccctggttcccgtgaaatatgaggtaatcgtcaccactggttatgaacccggagccggaaccgatgccaatgtgtttgtgaccattttcggtgccaacggcgacaccggcaagagagagttgaaacaaaagatgcggaatctgtttgagagaggaagtacggaccgttttttcttggagactttagagctagtagtgacacggctcggtcttgctgcagaatgcggttag

SEQ ID NO: 228884 - DNA, 1539 bp, Artificial Sequence
  Description of Artificial Sequence: Synthetic coding sequence
atgactgtctggacgggagacgttgtcggcggaggcacagactccaacattttcatgactctctacggaattaatgggtcgacggaggaaatgcagcttgacaagaagaaagcgcgattcgaaagggagcagaacgatactttcattatggaaatcctggacatcgcacccttcaccaagatgcgcattagaatagacggactggggtctcgcccagagtggttcctcgaacgaatcctcctgaaaaatatgaataccggagacctcacaatgttctactacggtgactggctgtcacaacgtaaaggaaaaaagacactcgtctgtgagatgtgcgcagtgatagacgaggaagaaatgatggaatggacttcctacacggtcgctgtgaaaacatccgatatcctgggtgccggtacagacgcgaacgtgttcatcattatatttggagagaacggcgattcgggcaccctagccctgaagcagagtgcaaattggaacaaatttgaacgaaataacactgatactttcaacttcccagatatgctgtcactggggcacctgtgcaagctaagagtttggcacgataataaggggatctttcccggttggcatttaagctacgtggacgtgaaggataattccagggacgaaacctttcactttcaatgcgattgctggctctcgaagtcagagggcgacggtcagaccgttcgggactttgcttgtgccaacaataaaatctgcgatgagctagaagagacgacatatgagatagtgatagagacagggaacggcggtgagacaagagaaaatgtgtggctgattctggaaggtaggaagaacagaagcaaagagttcctgatggaaaactctagcaggcagagagcttttagaaagggtaccacagacacgttcgaattcgactccatatacctgggagacatcgctagtctatgcgtggggcatctcgccagagaggatcgctttatccccaaaagggagctggcttggcacgtgaagaccatcaccatcaccgaaatggagtacggaaacgtctatttttttaattgcgactgtctgatacctcttaaaaggaaacgaaagtattttaaagtgtttgaggtcacaaagaccaccgagtcttttgcttctaaggtccagtctctggtgcctgtgaaatacgaagtgatcgtgacaaccggatatgaaccaggcgcaggtacagacgccaacgtgttcgttaccatctttggggctaatggcgacacagggaagcgcgagttaaagcagaagatgcggaatctgtttgaaagggggtctactgatcggttcttccttgaaactctggagcttggggaactgaggaaggttcgccttgaacatgactcttcaggatattgctcgggttggctcgtggaaaaggtggaagtgactaacactagtacaggcgtagcgacgatttttaactgcggcagatggctagataaaaaaaggggggacggtctgacttggcgcgatttgttcccctctgtgtag

SEQ ID NO: 228885 - DNA, 1374 bp, Artificial Sequence
  Description of Artificial Sequence: Synthetic coding sequence
atgaccgtgtggacaggcgacgttgtgggcggtggaaccgattctaatatcttcatgacattgtatggcataaatggaagcacagaagaaatgcagttagataagaaaaaggcgagattcgaacgcgagcagaatgataccttcatcatggagattttggatatcgcacctttcaccaaaatgaggattcggattgatggactcggctcccggccagaatggtttctggagagaatcctgctgaagaacatgaacactggtgacctcaccatgttctattatggcgattggctctctcagcgaaaaggcaaaaagaccctcgtgtgtgaaatgtgtgctgttattgatgaggaagaaatgatggagtggaccagttacaccgtcgccgtcaagacgagtgacattctcggagccggaacagacgctaatgtctttattataatctttggcgagaatggggattcaggcaccttggccttgaaacagtctgccaactggaataagtttgaacgaaataacactgatacgttcaattttccagacatgctgagcctcggccacctgtgcaaactgcgagtctggcacgataacaagggaatctttccaggctggcacctatcctacgttgacgtgaaagataactcacgcgatgaaacatttcatttccagtgcgattgctggctgagcaaaagcgagggggacggacaaactgtgcgcgatttcgcatgtgcaaacaacaagatttgtgatgagctggaagagacaacttacgagatcgtaattgagaccgggaatggtggcgagactcgcgagaatgtttggctgattctggaagggcgaaagaacagaagtaaagagttcctcatggagaactcctcacgccagagggccttcagaaaagggaccaccgatactttcgagttcgacagcatctatctgggggacatcgcgtcattgtgtgtcggccacctggcccgagaagaccgatttataccaaagagagaactggcatggcacgtgaaaacaattaccattactgagatggaatatggcaatgtctatttctttaattgtgattgcctgatacctctcaagaggaagcgcaagtatttcaaggtgtttgaggttaccaagactactgaaagctttgcctctaaggtccagtccctcgtcccagtaaagtatgaagtcatagtcacaactggttacgagccaggggctggcacggatgcgaatgtgtttgtgaccatttttggcgctaacggggacacagggaagcgcgaactgaagcagaagatgcggaatttgtttgagaggggcagcactgatcgcttttttctggagactctcgagctcggggagttacgcaagtag

SEQ ID NO: 228886 - DNA, 1122 bp, Artificial Sequence
  Description of Artificial Sequence: Synthetic coding sequence
atgctcattcccttttcaatgaagaactgctttcagctactctgtaattgtcaagttcctgctgcaggcttcaaaaagaccgtcaagaatgggctcatcttgcagagcattagcaacgacgtttaccaaaatcttgccgtagaagattggatccacgaccacatgaacctggagggaaaaccaatccttttcttctggcagaattccccatctgttgtaattggcagacatcaaaacccatggcaagaatgtaatctcaatctcatgagggaggaaggaatcaagttggccaggagacggtccgggggtggtacggtgtatcatgatatgggcaatatcaatttaacgttctttaccactaaaaaaaagtatgatcgaatggaaaacctcaaactgatcgtccgggctctgaatgccgtgcagccccagctcgacgtacaggctacaaaacggttcgatttgcttctggacggccagttcaagattagcggcacagcatctaaaatcgggaggacgaccgcctatcaccactgcacactgctgtgtagcactgatggaacctttctctcaagtctgttaaaatctccgtaccaagggataaggtcaaatgctactgcaagtataccctcactcgtgaagaatttactcgagaaagacccaaccctcacatgtgaagtcctaatgaacgccgtcgccactgagtacgccgcatatcaccagatcgataaccacatccatctgatcaatcccaccgatgagaccctgtttccgggtatcaatagcaaggccaaagagctgcagacttgggaatggatttacggaaaaactccaaaattcagcatcaataccagcttccacgtcctgtacgagcaatctcacctggaaataaaagttttcatcgatatcaaaaacggacgcattgagatctgtaatattgaggcacccgaccattggctcccgttagagataagggacaaactcaattctagtttgataggtagcaagttctgtcccactgagactactatgctaacaaacatcctgctcagaacatgccctcaagaccacaagctgaattcaaaatggaacatactgtgtgaaaaaatcaaagggatcatgtag

SEQ ID NO: 228887 - DNA, 1122 bp, Artificial Sequence
  Description of Artificial Sequence: Synthetic coding sequence
atgttgatcccattttctatgaaaaattgttttcagctactctgcaactgccaggtacctgccgcaggtttcaagaagaccgttaagaacgggttgatcctgcagtccataagcaatgacgtctaccagaacctcgctgtcgaagactggattcacgaccatatgaacctggagggcaaaccaatcctgttcttttggcaaaacagccccagcgttgtcatcggtagacaccagaatccgtggcaggagtgcaacctcaaccttatgcgcgaagaaggcatcaagctcgcgaggaggcggtcaggcggaggaaccgtgtatcacgacatgggtaacatcaacttaacctttttcacaacaaagaagaagtacgatcgcatggagaatcttaaactcatagttcgagccctcaacgccgtgcagcctcagctggacgtgcaagccaccaagcgcttcgacttgctcttagacggtcaattcaaaatctcggggacagcatccaagatcggacgcacaactgcctaccaccactgcaccctcctctgcagcaccgacggcacgttcctcagctctttgttaaaaagcccctatcagggcatccgatccaacgctacagcctccataccgtctctggtaaaaaacttactggaaaaggatcccactctcacatgcgaagttcttatgaatgcagtcgccaccgagtacgctgcctaccaccagatcgataatcatattcacctcatcaatccaaccgacgagaccctgttccccggaatcaattcgaaggctaaagagctgcagacttgggaatggatctatgggaaaaccccgaaatttagcatcaacacaagcttccatgtactctacgagcagtcacatctcgagatcaaggtcttcatcgatatcaagaatgggagaatcgaaatatgtaacatcgaggctcctgatcattggctgcccctcgagattagggacaaattgaacagctcgctcatcggcagtaagttctgtcctactgagacaactatgctgaccaacatcctcctcagaacctgcccacaggatcataagctgaattcaaaatggaacattctgtgcgagaagattaagggcatcatgtag

SEQ ID NO: 228888 - DNA, 1122 bp, Artificial Sequence
  Description of Artificial Sequence: Synthetic coding sequence
atgttgatcccgttcagtatgaagaactgttttcagctattgtgcaactgtcaagtaccggctgcagggttcaagaagaccgtgaagaacggcctcatcctccagagcattagcaatgatgtgtatcaaaacctcgccgtcgaggactggatccatgaccatatgaatctcgaaggaaaacctattttgtttttttggcagaattccccgagcgtcgtgattgggagacatcaaaatccatggcaggaatgtaatttgaatctcatgcgtgaggaaggcattaaacttgcccgaagaaggtctggcggaggcacagtgtatcacgatatgggcaacatcaacctgacatttttcaccaccaagaaaaaatacgacagaatggaaaatctgaagctgatcgtacgggcactgaatgccgttcagccccaactggacgtacaggctaccaagcgatttgacctgcttctcgatgggcagtttaagatcagtggcaccgcaagcaagatcggcaggacaacagcctatcaccattgcacactcttgtgcagcacagacgggaccttcctaagttcgctcctgaagagcccctaccaaggtattcgttccaatgctactgcttccatccccagcctcgtgaaaaacctattggagaaggatcctactctgacctgtgaagtcctgatgaacgccgttgctactgaatatgccgcataccatcaaatcgataaccacatccacctgattaatcccactgacgagactctgttcccaggtatcaattcaaaagcaaaggagttacagacatgggagtggatatatggcaagacccctaagttcagtattaatacatctttccatgtgctctatgaacagtcccacctggagattaaggtgttcatagatattaagaacggcagaattgaaatatgcaatatcgaggcccctgaccactggctgcccctcgagatccgggacaagttaaattcatcactgatcggctccaaattttgcccaaccgagactaccatgctcaccaacattctcctacgaacctgcccacaggatcataagctcaactctaaatggaacatattgtgcgagaaaatcaagggcatcatgtag

SEQ ID NO: 228889 - DNA, 1122 bp, Artificial Sequence
  Description of Artificial Sequence: Synthetic coding sequence
atgctgattccgttttctatgaagaactgtttccaactcttgtgtaactgccaggtgccggcagcaggcttcaagaaaacggtaaagaatggactaatactgcagtcaatttccaacgatgtgtatcagaacctggctgtggaggactggatacacgaccacatgaaccttgaaggtaagcctattctgtttttttggcagaatagcccaagtgtagtgatcggcagacaccagaatccttggcaggaatgcaatctgaacctcatgagagaagaaggcatcaagctcgctcggaggcgttccggaggcggaaccgtttatcacgacatgggcaacatcaatctgacattctttaccactaaaaagaagtatgacagaatggaaaacctgaaactgattgtcagagcactcaacgcggttcaaccccagttagatgtgcaggctactaaaagatttgatcttctcttggacggccagttcaagatttcaggaacagcttctaaaattggcaggactacagcctaccaccattgcacactgctttgcagcactgacggaaccttcctgtcatctctactaaaaagtccctatcaggggattcgctccaacgcgacagcaagcataccctccctggtaaaaaatctactggagaaggaccctactttaacatgtgaagtcctgatgaatgctgtcgctacagagtatgccgcttaccaccagatcgacaaccacatccacctgatcaaccccactgacgagacactctttcctggaatcaatagtaaagccaaagaattgcaaacatgggaatggatctatgggaagacacctaagttctccatcaacactagcttccatgtgctctacgagcagtcacatctggagattaaggtgttcattgacattaaaaacggccgaatcgagatctgtaacattgaggcacccgaccactggctgccgctcgagattcgcgacaaactaaactcctcgttgataggctcaaagttctgcccaacagaaactactatgctcacgaacattctcttaaggacatgtcctcaggaccacaagctgaactcaaaatggaacatcctgtgtgaaaaaatcaagggcataatgtag

SEQ ID NO: 228890 - DNA, 1122 bp, Artificial Sequence
  Description of Artificial Sequence: Synthetic coding sequence
atgctcatccctttttccatgaagaactgtttccagctgctgtgtaactgtcaggtgcccgctgctggctttaagaagacagtcaaaaacgggctgattctccagtctatctctaacgatgtataccagaacctggctgtcgaggactggattcacgatcatatgaatctggagggaaagcctatcctctttttctggcagaactcacccagcgtcgtcattggcagacatcagaatccctggcaggaatgtaacttgaacttgatgcgtgaagagggaattaagcttgcaagacgccgttccggcggtggcacggtctatcatgatatgggaaacataaatctgaccttttttactactaaaaaaaagtatgataggatggaaaaccttaaactcattgtacgtgccctgaacgcggttcaaccacagctggatgtgcaggctacaaagaggtttgatctgcttctcgatggacagttcaaaattagcggcaccgcctctaagattgggaggaccaccgcctatcaccactgcactctgctttgcagcacggacggcactttcctgtcttcactgttgaaatccccgtatcaaggcattcgtagcaatgctacagcttccattccatctcttgtgaagaatctcttggaaaaggacccaaccctgacttgtgaagtccttatgaatgccgtcgccaccgagtatgccgcataccatcagattgacaaccacatccaccttatcaaccccactgatgaaaccttgttcccagggatcaattccaaagccaaagaactgcagacgtgggagtggatttacggtaaaaccccaaaattttctattaatacatctttccatgtgctgtacgaacagtcacatcttgaaatcaaggtgtttatcgacatcaaaaacggccgaatagagatatgcaatatcgaagcccctgaccactggttaccactcgagatcagagataaattgaattcgagtttaattgggtccaagttctgcccaacagaaaccaccatgcttactaatatcttactccgaacctgtccacaggatcacaagcttaatagcaagtggaacatactatgtgagaagatcaagggcatcatgtag

SEQ ID NO: 228891 - DNA, 321 bp, Artificial Sequence
  Description of Artificial Sequence: Synthetic coding sequence
atgcttattccatttagtatgaaaaattgtttccaactcctttgcaactgtcaagttcctgccgcagggttcaaaaagacggttaaaaacggccttattttgcaatctatctctaacgacgtctatcagaacctcgctgtggaagattggattcacgaccacatgaatctggaggggaagcccattctatttttctggcagaactctcccagtgtagtcattggtaggcaccaaaacccatggcaagagtgcaaccttaatcttatgcgggaggaggggatcaaattggcacgcagacgcagcggaggcggaacagtttag

SEQ ID NO: 228892 - DNA, 756 bp, Artificial Sequence
  Description of Artificial Sequence: Synthetic coding sequence
atgcttatacctttttctatgaagaattgcttccagttgctgtgcaactgccaggttcctgccgctggctttaagaagaccgtgaaaaacggcctgattctgcagagtatctccaatgacgtgtatcagaacctagccgttgaggattggatacatgatcacatgaacttggagggcaagccaatcctttttttttggcaaaattctccctccgtggtgataggtaggcatcagaacccatggcaggagtgtaacctgaacctgatgcgagaagaaggcataaagctagctagacgacgctccggtggcggtaccgtgtaccatgatatgggcaatataaacttaacattttttactactaaaaagaagtatgaccgcatggagaatctgaagcttatcgtccgggcactcaacgcagtgcaacctcagcttgacgtgcaggccacgaaacgttttgatctcctcctggacgggcagtttaaaatttcaggcacagcctccaagattggacgcaccactgcttaccatcactgtaccttattgtgcagcactgacggaacatttttgtccagtctgctgaaatctccataccaaggcatcagatcgaatgcgactgccagcattccttccctggtgaagaacctgctggaaaaggatcccacactcacatgcgaggtgttgatgaacgccgtggccaccgagtacgccgcatatcaccagattgacaatcacattcatcttattaacccgacatag

SEQ ID NO: 228893 - DNA, 120 bp, Artificial Sequence
  Description of Artificial Sequence: Synthetic coding sequence
atgctcatacccttcagcatgaaaaactgtttccagctcctttgcaattgccaggtccctgcagccggttttaaaaaaactgtcaagaatggactcatattacaaagtatttcgaattag

SEQ ID NO: 228894 - DNA, 408 bp, Artificial Sequence
  Description of Artificial Sequence: Synthetic coding sequence
atgctcattccgttttcaatgaaaaattgcttccagctgttgtgtaattgccaggtcccagccgcaggcttcaagaagacggtaaaaaacgggctgattcttcagtcgatttcgaatgatgtctaccagaatctggctgtggaggattggatacatgatcacatgaacttggaggggaaacccattttgttcttctggcaaaacagcccatcagtggttatcggaaggcaccagaacccgtggcaggagtgcaatctaaatctgatgcgtgaggaaggcattaaactggcaagaagacgcagcggtggtggcacagtgtatcacgatatgggtaacatcaacctcacctttttcacaaccaagaaaaaatacgatcgtatggagaatctcaagctgatcgtgaggtag

SEQ ID NO: 228895 - DNA, 5300 bp, Artificial Sequence
  Description of Artificial Sequence: Synthetic coding sequence
atgggaggcaaaaataaacagcggaccaaaggtaacctacgtccatccaattctgggcgagccgctgaactgctggctaaggaacagggtaccgtgcccggattcatcggtttcggcacctctcagtcagatctcggatatgtccccgctatacagggcgcagaggagattgacagcctggtggattcagactttcgaatggtgctcaggaagctgtcaaagaaagacgtgacaactaagctgaaggcaatgcaggagttcggtaccatgtgtactgagcgcgataccgaaactgttaaaggggttctcccgtattggccaagaatcttctgcaaaatcagcttagatcatgacagacgtgtgcgggaagcaacgcagcaagcctttgaaaaattaattctcaaggtaaagaagcagctggcaccgtacttgaagtcattgatgggctactggctgatggcacagtgtgatacgtacactcccgctgcattcgctgcaaaggacgcattcgaggcagcgtttcctccctctaaacagccagaggcaatcgcgttttgcaaagatgagataacctcggtgctccaggatcacctcatcaaagaaacgcctgataccctgagtgaccctcaaaccgttccagaggaggaaagggaagcaaagttttatcgcgtggtcacgtgctcactccttgctctgaagcgcctcctctgtcttctcccggataatgaactggacagtctggaagagaaatttaagtccttactaagccagaataaattctggaaatatgggaagcacagtgtcccccaaatccgctctgcatattttgagttggtcagcgccttatgccagcggatcccacagcttatgaaagaagaagcgagcaaagtgtcccctagcgtcttgttatccatcgatgacagcgatcctatcgtgtgccctgcgctctgggaggcagtgctgtacacattgactactatcgaggactgttggctgcatgtcaacgctaagaagagcgtgtttccaaagctgagcactgtgattcgtgaaggcggaaggggactggccacggtcatctacccataccttctgccttttatatctaagctgccccaatcaatcaccaacccgaagctcgattttttcaagaactttctgacatctcttgtcgcaggcctcagcaccgagcgaactaagacttcatcactggagagcagtgcggtcatctctgcattttttgagtgcctgagatttattatgcagcagaatttaggcgaagaagaaatcgagcagatgcttgtcaacgatcagcttatcccctttatcgacgcagtgctcaaggaccccggtcttcagcatgggcaattgtttaaccacttagcggagaccctgagcagctgggaggcgaaggccgatactgaaaaagatgaaaaaactgcccacaatctggaaaatgtactcattcacttctgggaacgtctttccgaaatctgtgtggccaaaatttctgagcctgaagctgacgtcgagtccgtcttgggcgtctccaacctactgcaggtgcttcagaaacctaagtcgtctctgaaaagcagcaagaagaagaacggcaaggtgcgattcgcagacgagattctcgagtcaaataaggagaatgagaagtgtgtgtcatctgagggtgagaagatagaaggctgggagctgaccacggaaccaagcctgacacataactcaagcggcctgctgtctccccttcggaaaaaacctctcgaggatctggtctgtaagctggctgatatttccatcaattacgtcaatgagaggaaatctgaacaacacctccgattcttatctaccctgttggattccttctcttcctctcgcgtgtttaaaatgctgctgggcgatgaaaagcaatctattgtgcaggctaagccactggaaatcgcaaaactggttcaaaaaaaccccgctgtacagttcctctatcagaagctgatcggctggttaaacgaggaccagagaaaagatttcggattcttagtggacattctctattctgctctccgctgctgcgataatgacatggaaaggaagaaggtgctggatgatctgactaaagtggatcttaaatggaattccctgctgaagattattgaaaaagcatgtccgagctctgacaaacatgcattggtaacaccgtggctaaagggggacatcttgggcgagaagctggtgaacctggccgattgtctatgcaacgaagacttggagtcgagggtgagttcggaatcacacttctctgagagatggaccctcctcagcctggtgttatcccagcacgtcaagaacgactatctgatcggagacgtctacgtggaacgcattatagttaggttgcacgaaactctgttcaagaccaagaagctgagtgaggccgagtcttcagatagctccgttagttttatctgtgacgtggcttacaactattttagcagtgctaaaggctgtcttctgatgcccagctccgaagacctgctgttgacactatttcagttatgcgctcagtccaaggaaaaaacccacctacccgatttcctgatttgcaagttgaagaatacttggctgtctggcgtgaacctgctggtgcaccaaaccgattcgtcttataaggaatccaccttcctgcacttgtccgcgttatggttaaagaaccaggtgcaagcctccagtctggacattaatagtctgcaggtactgctttctgcagttgatgacctgcttaatacactcctggaatctgaggactcttaccttatgggagtttacatcggcagtgtcatgccaaatgatagcgagtgggagaagatgcgccagagtctgccaatgcagtggctgcacagaccattgctagaaggccgtctcagcttgaattacgagtgcttcaaaactgattttaaagagcaggatattaaaaccctccccagtcatctgtgtacgtccgctctgcttagcaaaatggtgctcatcgctcttcggaaagagacagtgttagagaataatgagctcgaaaaaatcatcgccgagctcctatactcactccagtggtgcgaagaactggacaaccctcccattttccttattggtttttgcgagattctgcagaagatgaacattacttacgataacctgagggtactaggaaatactagcggacttctccagctgttgttcaacaggtcccgggaacatgggacgctctggtcactcatcattgccaagctaattctcagcagatcaatctcgtccgacgaagtaaaaccccactacaaaagaaaggagtcattcttccccttaaccgagggcaacctgcacacgattcagtctttgtgccccttcttgtcaaaggaggaaaagaaggagttctctgctcagtgcattccggctctcttgggttggaccaaaaaggacctctgtagcactaatgggggatttgggcacctggcaatcttcaactcctgtctacaaaccaagtccatagatgacggagaactgttgcatggcatcctgaaaatcatcatttcatggaagaaggagcacgaagacatcttcctcttttcctgcaatctctctgaggccagtcctgaggttctcggggtgaatatcgagattattcgtttcctctctctcttcttgaaatactgttcgtctcccctggcggagtctgagtgggactttatcatgtgtagtatgctcgcctggctggagacaaccagcgagaatcaggcgttgtatagtattcccctggtccagttgtttgcctgcgtctcttgcgacttagcttgcgacctcagtgcctttttcgacagtacaaccctggataccattgggaatctgcctgtgaatcttattagtgagtggaaagagtttttttcccagggtatccattccctgctccttccgatccttgtcaccgttactggcgagaacaaagacgtgtccgagacttcgttccagaacgctatgctcaagccgatgtgcgaaacattgacctacatttccaaggaacaactgctgagtcataaattaccagcacgtctcgttgcagaccagaagacaaatttgcctgagtacctccagacactccttaacaccctagccccactgttgctctttcgtgcaagaccagttcagatagccgtgtatcacatgctgtataaactcatgcccgaactgcctcagtacgaccaggataatttgaaaagttatggcgacgaggaggaggaaccagctctcagcccacccgcagccctaatgagcctgctctcaatacaggaggatctgctggagaacgtgctcggatgcatcccggtgggacagattgtgaccatcaaacctctctctgaggatttctgttatgtgttaggttatttgctcacttggaaactcatcctgacattttttaaggccgcttcttcccagttgcgcgcactgtatagcatgtatttgcggaagaccaagagcctaaacaaactgctttaccatctcttccggcttatgcccgagaaccctacatacgctgagaccgctgttgaggttccaaacaaggatcccaaaacattctttaccgaggaactgcaactgtccatcagggagactactatgcttccctatcacatcccacatctggcctgtagtgtgtatcacatgaccctgaaagacttaccagccatggtcagactttggtggaactcatcagagaaaagagtattcaacattgtcgaccgctttacctctaaatacgtctctagtgtgctgagcttccaagagatatcaagcgtccagaccagcactcagctcttcaacggaatgaccgtcaaggctcgtgccacaacaagggaagtaatggcaacgtacaccattgaagacatcgtgatagaactgatcattcaattaccctctaactatccactcggaagcataatcgtggagagcggaaagcgtgttggcgtcgctgtccagcagtggcgcaactggatgctgcagctttctacataccttacccatcaaaacggttcaattatggagggccttgccctgtggaaaaacaatgtagacaagcgtttcgagggggttgaggactgcatgatctgctttagcgtgatccatgggtttaactatagcctccccaagaaagcctgcagaacttgcaagaaaaagtttcactccgcctgcttgtataagtggttcaccagctcgaacaaatccacctgtccactgtgtcgcgagacattctttta

SEQ ID NO: 228896 - DNA, 1443 bp, Artificial Sequence
  Description of Artificial Sequence: Synthetic coding sequence
atgggaggcaagaacaaacagagaactaaagggaatctcaggccctccaactcaggcagggccgctgagctgttggccaaagagcaggggaccgtcccagggtttataggtttcgggacctcacagtcagaccttggatatgtgccggcaatccagggtgctgaagaaattgattcactagttgacagtgacttcagaatggtgctgcggaagctgagcaaaaaagacgtaactactaaactcaaagcaaacgcaatgcaggagttcgggacaatgtgcacagaacgcgacacagagaccgtaaaaggtgttctgccctattggccgaggatcttctgtaagattagcctggaccatgacaggagggttagagaagctacccagcaggcgtttgaaaaattgatcctaaaagtgaagaagcagctggccccttacctaaagagtctgatggggtattggctgatggcccagtgtgacacgtacaccccggcagcatttgcggctaaggatgccttcgaagccgctttccccccttcaaagcagccagaggctattgctttctgcaaggacgagattacatctgttctgcaggaccacctgatcaaggagacgcccgacactcttagcgacccacaaacagtacctgaagaagagcgtgaggcaaagttctaccgcgtcgtgacatgtagtttgctggctctgaagcgattgctctgtctgctccccgacaatgaactggacagcctggaagaaaagtttaaaagcttactttcccagaacaagttttggaaatacgggaaacatagcgtgccgcaaattaggtcagcgtacttcgagctcgtgtccgcattgtgtcagagaattcctcagctgatgaaggaggaggccagcaaggtatctcccagcgtcctcctgagtattgatgactctgacccgattgtgtgtcctgcactgtgggaggcagttctatacaccctcaccaccattgaggattgttggcttcacgttaacgccaagaagtctgtgtttcctaagctgtctacagtgataagagagggaggcaggggccttgctacagttatctacccctacctgctgccgtttatctcaaagctgccacagagtatcacgaatccaaaacttgactttttcaagaatttccttacgtccctcgtggcaggacttagcaccgagagaacaaaaacctcctccctggagtcatctgccgtgatttccgcatttttcgagtgcttgaggttcatcatgcagcagaacctcggtgaagaggagatcgaacagatgctggtaaatgaccagctaatcccattcattgacgccgtgctgaaggatcccggactgcagcacggtcagctatttaaccatctggcagagacactgagcagctgggaggctaaagccgacaccgaaaaggacgaaaagtag

SEQ ID NO: 228897 - DNA, 5438 bp, Artificial Sequence
  Description of Artificial Sequence: Synthetic coding sequence
atggaccgggtaggaggcggtaagggcccaggcggatcctactatagagtcagctccagcgcagccagaagtagaaagctctgccctggcagagtcaatcgcggactgagtgctcagtccacagccgctacagccacaatgggcggaaagaacaaacagcgcacaaagggtaatttgagacctagcaacagcgggagggcagctgaattactagccaaggagcaagggactgtgccgggattcattggatttggcacaagtcagtcagacctggggtatgttcctgctatccagggagctgaggagatcgattccctggtggacagtgatttccgcatggtgttgaggaagctgtccaagaaagatgtgaccacgaagctgaaagctatgcaggagttcggcaccatgtgtactgagagggacactgaaacagttaaaggggtgctaccctactggccaaggatcttctgcaagattagccttgatcacgatcggagagtgcgcgaggcgacgcagcaggcctttgagaaactcattctcaaggtcaagaaacagttggcaccttacctgaagtctttaatgggctactggttgatggctcagtgcgatacctacactcctgcagcattcgcagccaaggacgcattcgaggcggcttttcctccctctaaacagcctgaagctattgcattctgtaaagatgaaatcacatccgtactgcaggaccacttgattaaagaaactcctgacaccctgtcagacccccaaaccgtgcctgaggaggaaagagaggccaagttctaccgcgtagttacgtgctccctgcttgcattgaaaagactgctgtgcctgctgcctgacaacgaattagattcactcgaagagaagttcaagtctctgctgtctcagaacaaattctggaagtacgggaagcacagtgtgccacagatccgttccgcgtatttcgagctcgtgtcagctctgtgtcagcgaattccgcagctgatgaaagaggaggcctccaaagtgagcccttccgtgctgctgagtattgatgactcagaccccattgtgtgccctgctctgtgggaggcggtactgtacacacttactaccatcgaggactgttggcttcacgtgaacgcgaaaaaatctgtgttcccgaagttgagtaccgttattcgcgaagggggtaggggccttgccacagtcatttacccttaccttttacctttcattagcaagctcccacaaagcatcactaaccccaaactggatttttttaagaattttcttacttctctcgtggcaggcctcagcaccgagcgcaccaagacaagctccttagagtcttctgcagtcattagtgctttttttgagtgtctacggtttataatgcagcagaatttgggcgaagaggagatcgaacaaatgttggtcaatgaccagttaatcccttttatcgatgcagtgcttaaagaccccggactgcaacacggccagctgttcaatcacctggcagagaccctgtctagctgggaggcaaaggccgacacagaaaaggacgaaaagaccgctcacaacctggaaaacgtgctcatacacttctgggaacggttatcagaaatctgtgtagccaagatctctgagcccgaagctgacgtggaatcagtcctgggcgtttccaacctgctgcaagtgcttcagaagccaaagagcagcctaaagagcagcaagaaaaaaaatggcaaggtgcgctttgctgacgagattctggagtccaacaaagaaaatgagaaatgtgtgagctcagaaggggagaagattgaaggttgggaactcacaacagaaccgtctttgacacataactccagtggcctgctctcacccctgcggaaaaaacccctcgaagatctggtgtgcaagctggctgacatctctatcaactacgtcaatgaacgcaagagcgaacaacatctgcgttttctgtcaactttgctggactctttctctagtagccgggtgtttaagatgctcctcggcgatgagaaacagtcaatcgttcaggcgaagcccctggagatcgccaaactggtgcagaaaaacccagccgttcagtttctctatcagaaactcattggttggttgaacgaggaccaacgcaaggatttcgggttccttgttgatatactgtacagtgccctcagatgctgtgataacgacatggaaagaaaaaaagtcctggacgacttgacaaaggttgacctaaaatggaacagcctgttgaaaattattgagaaggcttgccccagcagcgacaaacatgcactggttaccccctggcttaagggcgacatattaggggagaaactggtgaacctggccgactgtctgtgtaatgaagatctggaatcccgcgtttcatcggaaagccacttctccgaacgctggacgctcctctcgcttgtcctgagccaacatgtgaaaaatgactacctgataggtgatgtctacgtcgagcggataatcgtccgtctgcacgagaccttgttcaaaactaagaagctgtcagaagcagagtccagtgacagtagcgtctccttcatctgcgatgtggcgtataactacttttcaagtgccaaggggtgtctgctgatgccctcctccgaggacctgttgttgacgctgttccagctgtgcgcccaatctaaagagaagacacacctccccgacttccttatttgcaagttgaagaatacctggctgtctggggtcaacctgttggtacatcagactgattcgagttacaaagagtccaccttcctccacctgtctgccctgtggctcaagaaccaggtccaggcttcctcactagacatcaatagcttgcaagtgttattatccgctgtcgatgacctgctcaatacacttctggaaagtgaagactcctacctaatgggggtctacatcggaagcgtcatgccgaacgactcagagtgggaaaaaatgaggcagtctctgcccatgcaatggctgcaccgacccctgctagagggaaggctcagcctcaactacgagtgttttaagaccgactttaaggagcaggacatcaagacccttccttcgcatctgtgtacgagcgctttacttagtaagatggtgctgatcgctttgagaaaagagacagtcctggagaataacgagctggagaaaatcattgcggagttgctatacagcctgcagtggtgcgaggaactggacaacccccctatcttccttattgggttctgcgaaatactacagaagatgaatattacttatgacaatctgcgcgtccttggcaatacctccggcttgctgcagctgctcttcaataggagccgggagcacggaaccttatggtccctcattattgcaaagctgattctgagcaggagcatctcttctgacgaggtcaaaccccattataagagaaaggaatcctttttccccttgactgaagggaatctccatacaatccagagtttgtgtccctttttgagtaaggaagaaaaaaaggagttttccgcgcagtgcatcccagcgctactgggttggaccaaaaaagatttatgcagtacgaatggtggttttggtcatctcgcaatatttaactcatgcctccagaccaagtcaatagacgacggagaactgttgcacggcattctgaagatcatcatatcttggaaaaaggaacatgaagatatctttttgttctcatgcaacctgtctgaggcctctccagaggtgctcggcgtgaacattgaaatcatccgtttcttgtccctgtttctgaaatactgcagcagtccgctcgccgagagcgagtgggatttcatcatgtgcagcatgctggcatggctcgagaccacgtccgagaatcaggccctttactccataccgttggtgcagctgttcgcatgcgtttcctgtgatcttgcctgtgacctatcggcgttcttcgactctaccaccctggataccataggcaacctccccgtgaatttaatttccgaatggaaggagttttttagccagggcatccatagcctcttactgccgattttggtgacggttaccggggagaacaaagacgtgagtgaaacaagctttcaaaatgctatgttaaagcctatgtgcgaaaccctgacttacatcagcaaagagcaacttctttctcataagttgccagccagattggtcgcagatcagaagactaacctgcctgagtatttacaaacactgctgaacaccctggccccattgctgctcttcagggctcggccagttcagattgccgtgtatcacatgctttacaagttgatgcccgaactcccccaatatgaccaagataacctgaagagttatggagacgaggaagaagaacccgctttgagtccccctgctgctctgatgagtctcctgtctatccaggaggatttgctagaaaatgtcttgggctgtatccccgtgggccagatcgtgacaatcaagcctctctccgaggacttttgctacgttttgggttacttgctcacctggaagctgatcctcactttttttaaggcagctagctctcagttgcgcgcactttattctatgtacttaaggaagactaagagtctgaacaagctcttgtatcatctttttaggttaatgcccgagaaccccacctacgcagagactgcagtggaggtcccgaacaaagatccaaaaaccttttttaccgaggagcttcagctgtctattagggaaaccaccatgcttccctaccacattcctcatttagcatgtagtgtttaccatatgaccttgaaagatcttcccgcaatggtcagattgtggtggaatagtagtgagaaacgcgtgtttaacattgtggatcggtttacaagtaaatacgtgtcgagcgtcctgagcttccaagagatttcctctgtgcaaacatccacgcaactattcaatgggatgacagtcaaggccagagctacgacacgcgaagtgatggcaacatacactattgaggacattgtcatcgagttaatcatccaactcccatctaattacccccttgggtctatcatcgtcgagagtgggaaaagggttggcgtcgcagtccagcaatggcggaattggatgttgcagttaagcacttacctgacgcatcagaatggtagcatcatggaaggcctcgcgctttggaagaacaatgtggataaacgatttgaaggcgtagaagactgcatgatatgcttcagcgtgatccacggattcaactactcactccccaagaaagcctgcaggacttgcaagaagaagtttcattccgcttgtttatataagtggttcactagctccaacaagtcaacttgcccgctgtgccgcgagacctttttcta

SEQ ID NO: 228898 - DNA, 1404 bp, Artificial Sequence
  Description of Artificial Sequence: Synthetic coding sequence
atgaaaaatcagaacggcaccttcaaggactgggctaatgccaatgtatcaaggcaaatcgaagacacagtgttgtacggatactatacgctttactccgtgatcctgttctgcgtgttcttttggatcccttttgtatatttttactacgaggagaaagacgatgacgacacttctaagtgcacccagatcaaaaccgccctgaagtatactctgggcttcgtggtgatttgtgcacttctcctcttagttggcgctttcgtccctttaaatgtgcccaataacaagaactcgaccgaatgggagaaggtcaagtccttgtttgaggagctggggagctcacacggcctggccgctctatcttttagcatctccagcctgacacttatcgggatgctggctgctatcacatacactgcttacggtatgtcagccctcccgctaaacctcatcaaaggcacccgctccgccgcatacgagcgtctagaaaacactgaggacatcgaggaagtagagcagcatattcagaccataaaaagcaagagcaaggacggcagacctctccccgcacgagataagagggcgctaaaacagttcgaagagcgcctcagaactcttaaaaagcgggagagacatctggagttcatcgaaaattcttggtggacgaaattctgtggggcactgcgccctctcaagatcgtctggggcattttttttatactagtggctcttttgtttgtaatttccctcttcctgtcaaatttagacaaagctctacactccgccggaatcgattctggcttcataattttcggtgccaatctgtccaacccactgaacatgctcctgccactgctccagactgtgttcccactggactacattctcatcactatcataattatgtatttcatatttacatctatggctggcatccggaatattgggatctggtttttttggattaggctctacaagataaggaggggacgaactcggccacaagcgctgctgtttctgtgcatgattttgctcctaatagtcctgcatacgagctacatgatttacagcctcgccccacaatacgtgatgtacgggagccagaactatctgatcgagactaacatcacatcagacaatcataaaggcaattcaacactgtcggttccaaagcgctgcgacgccgatgccccagaagatcagtgtactgtcactcggacttaccttttcttgcataaattttggttttttagcgcagcttactatttcgggaattgggcttttctgggcgttttcctcatcggtctaattgtttcctgctgcaaggggaaaaagagtgtaattgagggggttgatgaggatagtgacatttcagatgacgagcccagtgtgtactctgcctag

SEQ ID NO: 228899 - DNA, 1623 bp, Artificial Sequence
  Description of Artificial Sequence: Synthetic coding sequence
atggccacatcaggggcagcaagcgcagagctggtcattgggtggtgtatctttggattactccttctggccatcttagcattctgttggatctacgtcaggaagtaccagagtcggagagaatcagaggtcgtgtcaacaattaccgctatctttagccttgcaatcgccctcattacatccgctctcttgccagtggacatctttctcgtgagctatatgaagaatcaaaatggcacctttaaggactgggctaatgcgaacgtcagcaggcagattgaggacacagtactctacggttactacaccttgtattcagtgatcctgttttgcgttttcttctggatccccttcgtgtacttctattacgaggagaaggatgatgacgacactagcaaatgcactcagattaagacagccctcaagtataccctgggcttcgtggtgatatgtgccctgctccttctggtgggggctttcgtgcctttaaacgttccaaacaataaaaattcaacagaatgggagaaggttaaaagcttattcgaggagctggggagcagccatggcctggctgccttgtcattctccatttctagtcttactctcattggtatgctcgcggcaattacctacacagcatacggaatgtcagctctgcctctcaacctcatcaaggggacacgatccgcagcttacgagcgtctggaaaacactgaagacatcgaagaggtggagcagcacattcagaccattaagtccaagtcaaaagacgggcgtcctcttcctgcgagagacaaaagggcacttaaacagttcgaggagagactccgcacattgaaaaagagagagcgccacctggaattcattgagaatagctggtggactaaattctgcggggcactacgacccttgaaaattgtgtggggcatcttcttcatcctggttgcgctactgttcgtaatctccctgttcctttccaacctagacaaagcactgcactctgccggaatagactctgggtttattattttcggcgcaaatctgtccaatcctctgaatatgctgctgccactgctgcagaccgtattccccttagactacatacttatcaccatcataatcatgtatttcatcttcacaagcatggccggtattaggaacatcgggatttggttcttttggatcaggttatataagatccggagaggcagaacacgcccacaggcacttctttttctgtgtatgatcctcttgctgatcgtgctgcatacatcctatatgatatactcactggcgcctcagtacgtaatgtacgggagtcagaattatcttatcgagaccaatataacatcagataatcataaaggcaattcaacactctcagtccccaagagatgcgacgccgacgctccggaggaccagtgcacagtcacaaggacctacttatttctccacaaattctggtttttttcggcagcttattatttcgggaactgggcctttttaggtgtgttcctaataggccttatagtgtcttgttgcaaggggaagaagagcgtgatcgagggcgtagatgaagacagcgacatttccgacgatgagccatcagtgtatagtgcatag

SEQ ID NO: 228900 - DNA, 939 bp, Artificial Sequence
  Description of Artificial Sequence: Synthetic coding sequence
atgtcgtaccagaagaaacagcccactccacagccacccgtggactgcgtcaagacatcgggcggtgggggaggcggaggtggatctgggggaggcggttgtggtttcttcgggggaggcggatctggcggtggttcctcaggctcagggtgtggttatagtggaggaggcggttatagcggcggaggttgcggcggtggctcatcagggggaggtggcggaggtggcatcggcggttgcggcggagggtcaggtgggtctgtgaagtattccggcggaggcggtagctccggtggaggttctggatgcttcagtagtgggggaggaggttctggctgttttagctctggcggaggcggatcatcaggcggtggatccggctgcttttccagcggcggtgggggaagctccggcggtggatctgggtgttttagttctggcggaggaggcttttcaggccaggctgtacaatgccagtcatatgggggtgtctcttccggtggatcatctggtgggggatcgggctgtttcagtagcggcggtggaggcggatccgtatgtggctatagcggtgggggtagcgggtgtggtggaggctcctctgggggttcgggaagtgggtacgtgtcatcacagcaggtgacacaaactagttgcgctccacagccttcatacgggggtggtagctccggaggtggtggcagtggagggtcgggctgcttttctagcggaggtggcggaggttcttccggatgcggcggtggctcgagtggcatcggcagcggatgtattatctccggaggaggttccgtgtgcggcggaggatctagtggtggtggcggaggtggtagttctgtcggaggaagcggtagtggtaagggggtaccgatctgtcaccaaacacagcaaaagcaggctccaacatggccctcaaagtag

SEQ ID NO: 228901 - DNA, 1002 bp, Artificial Sequence
  Description of Artificial Sequence: Synthetic coding sequence
atgtcttatcaaaagaaacagcccacaccccagcccccagtcgattgcgtgaaaaccagtggcggagggggaggtggaggcggttctggcggaggaggttgcggtttttttggtggcggtggaagtggcggagggtcaagcgggtccggctgcggttactctgggggaggtggatacagcggtggaggctgcggtgggggatcttccggaggcggtggaggcggtggcatagggggatgtggcggtggttctgggggaagcgtgaaatactcgggcggtggcggttcctccggcggaggatcaggttgcttctcttctggtgggggtgggagtggatgtttctctagtgggggtggcggaagctctggcggtgggagcggatgtttttcgagcggcggaggtggctcgagtggtggcggttctggttgcttttctagcgggggagggggattctctggtcaggccgtgcagtgccaatcctatggcggagtgtccagcggcggtagcagcggcggtggctcaggatgtttcagcagcggagggggaggtggtagtgtttgtgggtactccgggggagggagcgggtgtgggggaggttcgtctggcggatcaggcagcggttacgtatcctcccagcaggttacccaaacaagctgcgctccacagccttcctatggaggaggggtgcggcgtagaagacagcgtaggaaacgcctcttgttgcaacggagggggagacgcgagcttaggttacgtcggcgtttgttaagggactggcagcgacttcaccatcagtggcgcggtttacggctacggagatggttcctttggcgtcggagaaggcggttactacgtggatggctgcgcgaatggcagggtcggcctgatttgcctccagaccccgcagaagcaggggcttacttagcagtgcaaatcgatcccccaggctatcacggaggtgagggcgtggggggtgttttccagggccatagatgggcctag

SEQ ID NO: 228902 - DNA, 927 bp, Artificial Sequence
  Description of Artificial Sequence: Synthetic coding sequence
atggacgctctgaaatctgcgggtagagccctcatacggtcaccatccctcgctaaacagtcttggggagggggagggcgacatcggaagttgcctgagaattggacggatactagagaaacgctattagaaggcatgctgttcagtctgaagtacctcgggatgacactggtggagcagccaaagggggaagaactgagcgccgctgcgattaagaggattgttgcaaccgcgaaagcctctggcaaaaagcttcagaaggtcacccttaaggttagtcctagaggcataatcctgaccgataacttaacgaatcagctgatcgagaatgtctccatctataggatcagttattgcactgctgacaaaatgcacgataaagtcttcgcctacatcgctcagagccagcacaatcagtccctggaatgccacgctttcctgtgtaccaagcgaaaaatggcccaagctgtgactctcacagtcgcccaggcatttaaggtggctttcgagttttggcaggtgtctaaggaggagaaagagaagcgagataaggcttctcaggaggggggtgacgtcctgggggcaagacaggactgtactccctccctaaagagcctggtggcgaccgggaacctgctggacctggaagagacggccaaggccccattatctaccgtgtctgcgaacactacgaacatggacgaggtgccgcgacctcaggccttgtctggctcatccgtggtgtgggagctggatgatggactggatgaggcttttagccggctggcacagagccggacaaatcctcaagtgctcgacaccggactgacagcacaggatatgcattacgcccagtgcctgtcccctgtggattgggacaagccagatagctctggcactgagcaggacgatttgttttctttctag

SEQ ID NO: 228903 - DNA, 810 bp, Artificial Sequence
  Description of Artificial Sequence: Synthetic coding sequence
atgtcatctgatcatttaaacaactccaccctgaaagaagcacagttcaaggatttgttcctgaaaaaggccgagcttgagtttgctcagatcattattattgtggtagtggtgacagtcatggtggtggtaattgtatgtttactcaatcactataaagtgtccacacgatctttcatcaatcgccctaaccagtctcgccgtcgcgaggacggacttccccaggagggctgtctctggccgtctgacagcgctgcaccacggctgggcgctagcgagataatgcacgccccacggtccagggaccgttttaccgctcccagctttatccaaagagaccgattcagcaggttccagccaacatacccctatgtacagcacgaaattgacctgccgcctacaattagcctctcggacggcgaggaaccccctccataccaagggccatgtacgctccaattgcgggacccggagcagcagatggagctcaatcgtgaaagcgttagagcccctccaaaccgaaccatattcgactccgatctcattgacatcgctatgtatagtggtggaccctgtccaccctcctcgaattcaggcatctccgccagcacatgctcatcaaatgggagaatggagggaccaccaccaacgtacagcgaggtgatgggccatcaccccggagcatcttttctgcatcatcagcgcagtaacgcacaccgcggatcccgtcttcagttccaacagaataatgcagaatctaccattgtgccaattaagggaaaagatagaaaacctggaaatctcgtgtag

SEQ ID NO: 228904 - DNA, 13635 bp, Artificial Sequence
  Description of Artificial Sequence: Synthetic coding sequence
atgctgactcctccattacttttactgctaccattgctctccgccctggtggctgcagcgattgacgcacccaagacatgttcaccgaagcagttcgcctgtcgtgatcaaataacttgtatcagcaagggttggcggtgcgatggcgaacgcgattgcccggacggctcagatgaggctcccgaaatttgtccccagagtaaggcccagagatgtcagccaaacgagcacaactgcttgggtaccgagctgtgtgtgcccatgtctaggttgtgcaacggagtacaggattgtatggatggatctgacgaaggacctcattgccgtgagctccaggggaattgtagtaggctggggtgccaacatcactgtgtgccgacacttgacggcccaacctgttactgtaattccagctttcagttacaagcagacggcaaaacatgtaaggatttcgatgagtgtagcgtgtatggtacctgcagccagctgtgtaccaatacagatgggtcattcatttgcgggtgcgtggagggatacttactgcaacccgataatcgatcttgtaaggctaagaatgaacctgtggacagacccccagtgctcctcatagcaaattcacagaacattctcgctacctatctatcaggggcacaagtcagcacaataacccccacctctacccggcagacaacagcgatggacttcagctatgcaaatgagacagtatgttgggtccatgttggggacagtgccgctcagacacagcttaagtgcgcccgaatgcctggcctgaaaggctttgttgacgaacatactatcaatatctctttgtccctgcaccatgttgagcagatggcaatcgattggctgaccggcaacttctactttgtggacgatatcgacgaccgcatttttgtctgcaatcgcaacggagacacctgcgtaaccctcctggatctagaactttataatcctaagggcattgcgttagatccagctatgggaaaggtgttctttaccgactatggacagatccccaaggtggaacgctgcgatatggacggacaaaaccggaccaaattagtcgactcaaagatcgtattcccccatggaattactcttgacctcgtttctaggctggtctactgggcggacgcctacctcgactatattgaagtggtggattacgaggggaagggccgacagaccatcattcaaggaatccttatcgaacacctctatgggctcacggtgttcgagaattacctctacgccaccaacagcgacaatgcaaatgcgcagcaaaagacttctgtgatccgcgtgaataggttcaatagtaccgagtaccaagtcgtgacacgggttgataaaggaggggcattacacatttaccatcagcgcaggcagcccagggtccggtctcatgcgtgcgaaaatgatcagtacggcaagccgggagggtgctcagacatctgccttctcgcgaactcccacaaggcacggacctgtagatgccgaagtggtttcagtctgggctccgacggcaaaagctgcaagaagccagagcacgagctgtttttggtatacggtaaaggccgtcccggtataatccggggaatggacatgggggctaaagtcccagatgagcatatgattcccattgaaaacctgatgaacccccgtgcccttgactttcacgccgagactggttttatttatttcgctgacaccacatcttatctcatagggagacagaaaatcgacggcacagagagggaaacaatcctgaaggacggtatccacaatgtcgaaggggtcgccgtggactggatgggtgataatttgtactggaccgacgacggtcccaagaaaacaatctccgttgcccgactagagaaagcggctcagacaagaaaaacacttatcgaaggcaagatgactcacccgagggcaatcgtagtagacccccttaacggctggatgtactggaccgactgggaagaggatccaaaagactcgagacgaggtaggctggaacgtgcttggatggacggatctcatcgggatatctttgttactagtaagactgtgctttggcctaatggcctgagcctcgatatccccgctggcaggttgtactgggtggacgccttttacgacagaattgagactatacttcttaatggtaccgaccgaaaaattgtctacgaaggacccgagcttaaccacgcatttgggctctgccaccacgggaactatctcttttggacagagtatcgttctgggtcagtttatcggctggagaggggcgtaggcggagctccacctactgtgacgctacttcgtagcgagcgcccacccatcttcgaaattaggatgtacgatgcgcagcagcagcaggtcggaaccaacaagtgcagggtgaacaatggcggatgcagcagcctgtgtctggctaccccaggaagcaggcagtgcgcatgcgccgaagaccaagtgctggacgccgatggcgtcacatgcctcgcgaaccccagctacgtcccgcctccgcagtgccagccaggggagttcgcctgcgccaatagcaggtgcattcaggaaaggtggaaatgcgatggagacaacgattgcctggacaacagcgacgaagctcctgccctctgtcaccagcacacctgcccttcagatagatttaagtgtgaaaataatcggtgcataccaaacaggtggttgtgcgatggggataatgattgcggcaactctgaagacgagagcaacgccacatgcagtgctcgcacttgtccccctaaccagttctcctgtgcgtctggacggtgcatacccatctcctggacttgcgacctcgatgatgattgtggcgataggtctgacgaatcagcttcttgcgcctatccgacctgctttccactgacgcaattcacctgcaataacggcagatgcatcaatatcaactggaggtgcgataacgataatgactgcggagataactccgatgaagctggttgttcacactcatgttcttcaacccagttcaagtgcaattccggcaggtgtatccctgagcactggacctgtgatggggataacgattgtggggactattcagatgagacccacgcaaattgtacaaaccaggctacacggccacctgggggttgccacacagatgagtttcaatgtagacttgacggcctgtgcataccattgagatggaggtgtgatggcgataccgattgcatggattctagtgatgagaagtcctgcgagggcgttactcacgtgtgtgatccaagcgttaaattcgggtgcaaggattcagcccgatgcatttccaaagcctgggtttgcgacggagataatgattgcgaggataactcagacgaggagaactgcgagagcctcgcgtgtcggccaccctcccacccatgtgccaacaacaccagcgtgtgcctgccccctgacaaactctgcgatgggaatgatgattgtggcgatggcagcgacgaaggagagttatgtgaccaatgctcacttaataacgggggttgctcacacaattgctctgtcgcacccggagaagggattgtgtgcagttgtcctcttgggatggaattaggtcctgacaaccacacatgtcagattcagtcttattgcgccaaacatctgaagtgcagccagaagtgtgaccagaataagttttccgtgaaatgcagctgctacgaggggtgggtcttggaaccagatggtgaatcatgtagatctctcgatcctttcaagcccttcatcattttcagcaacagacatgagattagaaggatcgacctgcataagggtgattactcagttctggtgccagggctacgcaataccatagcactggacttccacttgtcgcagagcgcgttgtactggaccgatgtcgtggaggacaagatttatcgcggtaaactcctcgataacggggctctcactagcttcgaagttgtcatacaatacgggttagccacccctgagggtcttgcagtggactggattgccggtaacatatattgggtggagtcaaatctggaccagatcgaggtagcgaaactcgatggcactctccggactacattactggccggtgacatcgagcaccctcgcgctattgcgctggatcctcgggatggtatcctcttttggacagactgggacgcctctctaccacgcatcgaggccgcttctatgagtggagccggacgcaggacagtacacagagaaaccggttccggaggctggccaaacggactgactgtagactatcttgagaagagaattctgtggatagacgctagaagtgacgctatatacagcgcaaggtatgacgggtcggggcatatggaggtcctacgcggacacgaattcctgagccacccgttcgccgtaaccttgtacggcggtgaagtctactggaccgactggcgcacaaataccctggcaaaggcaaacaagtggacaggccacaacgtcacagtcgtccagcgaacaaatacccagcctttcgatttacaggtatatcacccgtcgcggcaacctatggccccaaacccctgcgaggctaatggagggcaagggccttgttcgcatctgtgcctcatcaattacaacaggaccgtcagctgcgcctgtccgcatttgatgaagctccacaaagacaacactacctgttatgagtttaagaagttcctcttatatgcacgtcaaatggagattcggggtgtggatctggacgccccatattataactatattatctcctttactgtccctgatattgataatgtgacagtccttgactatgacgcaagagagcagagagtgtactggtccgatgttcggacccaggctattaagcgtgcattcattaacgggactggcgtggagaccgtggtaagcgccgatctccctaacgcacatgggcttgcggtcgattgggtgtccaggaatttgttttggacatcatatgacacaaataaaaagcagatcaacgtggctagacttgatgggtccttcaagaatgcagttgtgcaaggtctggaacagccccacggcctcgtggttcaccccttaaggggcaaactgtattggacagacggggacaatatttctatggctaatatggatggctcaaacaggacccttcttttttccgggcagaaaggacctgtcggcctggccattgattttccagagtccaaactgtactggatttcatcaggaaaccacacaatcaaccgctgcaacctggatggctccggcttggaggtgatagacgcgatgagatctcagttagggaaagcgaccgcactggctatcatgggagataaactgtggtgggccgaccaggtgtccgaaaagatgggcacttgctcaaaggctgacggctccggaagcgtggtgcttagaaactctacaacgcttgtgatgcacatgaaggtctatgatgagtctatacagctagatcacaaaggcacgaacccctgttcagttaataatggcgactgcagtcaactgtgtctccccacgtcagaaaccaccagatcatgcatgtgtacagctggctactcactcaggtccggccagcaggcatgtgagggcgtgggaagttttctgctgtactccgtgcacgagggcatccggggtatccctcttgacccgaatgataaatctgatgctctggtgccggtgagcggcacctccctggctgtgggcatagattttcacgccgaaaacgacacgatttattgggtagacatggggctctccacaatttctagagctaaaagagatcagacatggagggaggacgttgtgaccaacggtatcggacgggtcgagggaatcgctgtcgattggattgccggtaacatctattggacagaccagggattcgacgtaatcgaggtggccaggctgaatggatccttcaggtacgtcgttatctctcaaggcctcgataaacctcgcgcaatcaccgtgcatccagagaaggggtatttgttttggacagagtggggccagtacccacggatcgagaggagcagactggacggaaccgagcgagtggtacttgttaatgtgtccatcagttggccaaacgggatctctgtggattatcaagatggaaagctgtattggtgcgacgcacgcacagataagatcgagcgcatcgatctcgagacaggcgaaaacagagaggtggtgctcagtagcaacaacatggatatgttttccgtttccgtgtttgaagactttatttactggtctgatcgcacccatgccaatggatcgatcaagcgcggatccaaggacaacgcaacagactccgtaccgctgcgaacaggtatcggggtgcagctcaaggatattaaggtctttaatagagaccggcagaaaggaaccaacgtctgcgctgtggcaaacggcggatgtcagcagctttgtctctataggggcagaggccagcgggcttgcgcctgtgcacacggtatgctggcagaagatggcgcatcctgccgcgagtacgcgggatatctgctctacagtgagagaaccatcctgaaatcaattcatctgtccgatgagaggaatctgaacgcacccgtgcaaccctttgaagacccagagcatatgaagaatgtcatcgcgctggctttcgattaccgagctggcaccagccccggtacaccgaatcggatttttttctcagacatccactttggcaacatccaacagatcaacgatgacggttcacgtaggatcacaattgtcgaaaacgtgggcagtgttgaaggtctggcgtaccaccggggttgggataccctgtactggacaagctacactactagtacgatcacaaggcacactgtcgaccaaacccgcccaggagcatttgagagggagacagtaattaccatgtctggagacgatcaccccagggcttttgtcctcgacgagtgtcagaacctgatgttctggactaactggaacgaacagcatccctcaattatgcgcgctgcattatctggagcgaatgtcctgaccctgatcgaaaaggacatacggaccccaaatggattagccatcgaccaccgggcagagaagttgtacttctctgacgccactctagacaaaatcgaacggtgcgaatacgacgggtcccaccgctacgtgatcctgaaatccgagcccgtgcacccgttcgggctggcagtctatggcgagcatattttttggacagactgggttaggcgggcagtacagagggccaacaaacatgtggggtctaacatgaaattgctgcgcgtggacatcccacagcagccgatgggcattattgctgtggctaatgataccaactcctgcgagttatctccttgtcggatcaacaacggcggttgtcaggatctgtgcctgctgacccatcagggccacgtgaactgttcgtgcagaggagggagaattcttcaggacgatcttacctgcagagccgtcaactcctcttgcagggcgcaggatgaatttgagtgcgccaacggtgagtgcatcaattttagtctgacttgcgatggcgttccgcactgtaaagacaagtcagacgaaaagcctagctattgtaactctaggagatgcaagaagacctttcggcagtgtagcaatggcagatgtgtaagcaacatgctctggtgcaatggcgcagacgactgcggtgacggtagcgatgagatcccttgcaataaaacagcatgcggtgtgggggagtttcgatgtcgcgatgggacctgtatcggcaacagcagcaggtgtaatcagtttgtggactgcgaggacgcaagcgacgagatgaactgctccgccactgattgttctagctacttcagacttggtgtgaaaggcgtgctgtttcagccctgcgaacgcacctcgctttgttatgccccatcatgggtgtgcgacggtgctaacgactgtggcgactatagtgacgagcgagattgccctggggtcaagcgcccacggtgtccacttaactacttcgcctgtccctccgggaggtgcatacctatgtcatggacttgcgataaggaggatgattgtgagcacggagaggacgagacgcactgtaataagttctgctccgaagcccagttcgagtgccagaatcatcgatgcatctctaaacagtggctgtgcgacggcagcgacgattgcggcgacggaagcgacgaagccgcacactgcgaaggtaaaacttgcggtccaagcagctttagctgtcccggtacgcatgtgtgcgtcccagagcggtggttgtgcgacggggacaaggattgcgcagacggggctgacgagtctattgcagctgggtgtctttacaattccacctgcgatgatcgcgaatttatgtgtcagaacaggcagtgtatccctaagcatttcgtgtgtgatcacgatcgcgattgtgcagatggcagcgacgaatcgcccgagtgcgagtatccaacctgcggaccaagtgaattcaggtgcgccaatgggcgatgcctctcatctagacagtgggagtgcgatggcgagaatgattgccacgaccagagcgacgaggcccctaagaatccccattgtacatctcaagagcataagtgtaacgcctcttcacaatttttgtgctcctcaggacgatgcgtggccgaagcccttctctgtaatgggcaggatgattgcggagattcatccgatgagcggggttgtcacatcaacgagtgcttaagccgcaagctgagtggatgctcacaggactgcgaggacttgaagataggctttaagtgccgctgccggcctggctttaggcttaaggacgacggcagaacctgcgccgacgttgacgagtgcagcacaaccttcccgtgcagccaaaggtgcatcaatacccacgggagctacaagtgcctgtgcgtggagggttacgcccctcgaggcggtgatcctcattcctgtaaggctgtcaccgatgaggaaccattcttgatattcgcaaatcgttactacttgcggaagctgaacttggatggatcaaactatacgcttctgaaacaggggctcaacaacgccgtggcactggattttgactatagagagcagatgatctattggacagatgtgaccacacaaggtagtatgattagaaggatgcatcttaacgggtccaatgtccaggtgcttcacaggactggcctctccaatcctgacggactggcggtcgattgggtcggaggtaatctgtactggtgcgataaaggcagagataccattgaagtgtctaagttaaacggtgcttaccggacagtgctggtctcctctggtctgcgggagccccgagctctcgtagttgatgtgcagaatgggtatttgtactggaccgattggggcgatcacagcctgatcggcaggatcggtatggatggaagcagccgtagtgttattgtagacaccaaaattacttggcctaatgggctgaccctcgattatgttactgagcggatctactgggctgatgcacgagaagattacattgaatttgcttctttagacgggagtaatcggcacgtggtgttatcccaggacattcctcacatcttcgctctgaccctgtttgaggactatgtttattggactgactgggagactaagtctatcaaccgagcccacaaaacgaccggcaccaacaagaccttgctaatcagcaccctgcacagacccatggacctgcatgtctttcacgcgctgcgacagccagatgtgcccaatcacccttgtaaagtgaacaacggcggttgcagtaatttgtgtttgctcagccccggaggtggccacaaatgtgcatgtcccaccaatttttacttgggttcggacggtcgcacatgtgtgagtaattgcaccgcctcccagtttgtgtgcaagaacgacaaatgcataccgttctggtggaagtgtgatacggaggacgattgtggggaccactctgacgaaccccctgactgtccggagtttaaatgtcggccaggccagtttcagtgctccaccgggatctgtaccaacccagcttttatatgcgacggagacaatgattgtcaagataacagcgatgaagctaattgtgacatccacgtgtgcctgcctagccagtttaagtgcaccaatactaacaggtgcatcccaggtatcttccgctgcaacgggcaggacaattgcggggatggtgaggatgaacgcgattgtcccgaagttacctgcgcacccaatcagtttcaatgctccattaccaaacgctgcataccacgagtttgggtgtgcgacagggacaatgattgcgtggacgggtcggatgagcctgccaactgcacccaaatgacgtgtggcgtggatgaatttcgatgtaaggacagtggtcggtgtattcctgccagatggaaatgcgacggtgaagatgactgtggcgatggcagcgacgagccgaaggaggaatgcgacgaacgcacatgtgagccttaccagtttcgatgcaagaataaccgctgtgtacccggaagatggcagtgcgactatgacaatgactgcggcgacaacagcgatgaggagtcctgcacacctcggccttgctccgagtcagagttttcatgtgccaatgggaggtgcatagctggcaggtggaagtgcgacggcgaccatgactgtgccgatggtagcgacgagaaagattgtacaccacgttgcgatatggatcagttccagtgcaagtcaggacactgtatcccactgcgttggcggtgcgacgcggacgccgactgtatggacggatccgatgaggaggcatgcggtactggcgtccgcacttgtccccttgatgagtttcagtgcaataatacactttgcaagccactagcgtggaagtgtgacggcgaagatgattgcggggacaattccgacgaaaaccccgaggaatgcgccagattcgtgtgcccacctaacaggccctttcgatgcaagaacgaccgagtgtgcctgtggattggacggcaatgtgacggcacagataattgtggagacggcacggacgaagaggactgcgaacctccaacagcgcatactacccattgcaaagacaaaaaagaattcctgtgtagaaaccaaaggtgccttagcagcagtcttaggtgcaacatgttcgacgactgtggcgacggttcagatgaggaagattgcagcatcgatcccaagctgactagctgtgcaacaaatgcgtcaatctgtggcgatgaggctagatgcgtgaggaccgaaaaggctgcttactgcgcctgtcgcagcgggttccataccgtccctggacaacctggttgtcaggacatcaatgaatgcctgcggtttggtacatgctctcagctgtgtaataacacgaaaggagggcacctgtgttcctgcgctcgaaattttatgaagacacacaacacctgcaaggcagagggatccgagtaccaggtgttatatatcgctgacgataacgaaattcgctccttgtttccagggcatcctcattcagcttatgagcaggctttccagggcgacgagagtgttcgcatcgacgcaatggacgtccacgtgaaagccggaagagtttactggaccaattggcacaccggcaccatatcttataggagcctacctcccgctgcccctcctaccacttcaaatagacatagacggcagattgaccggggagtgacacatctcaatattagcggactaaagatgccaaggggtatcgccattgattgggtcgctggaaatgtttactggaccgattctggacgtgacgtgatcgaggtcgcgcagatgaagggagaaaatcgcaaaaccttgattagcgggatgatagacgagccccatgcaatcgtggtagacccccttcgtgggactatgtattggtctgactgggggaatcatccgaaaatcgagactgctgctatggacgggacccttagggaaacactggttcaggataacattcagtggcctacgggtctcgccgttgattaccacaatgaacggctgtattgggccgacgctaagctgtcagttatcggatccatcagactgaatggcactgaccctattgtggcagccgacagtaaacggggtttaagccacccctttagcatcgacgtgtttgaggactatatctacggtgtaacatacattaacaaccgggtgttcaaaatccacaagtttggacatagccctctggtgaatttaaccggcggactctcccatgcatcggatgttgtgctgtatcaccagcacaaacagccagaggtcaccaatccctgcgacaggaaaaaatgcgagtggctgtgtctgctcagcccttcaggcccagtctgtacctgccctaacggtaagcgtttagataatgggacgtgtgtgcctgtgccgtccccaacccctccaccagatgctcccaggccaggcacttgtaacctacagtgcttcaatggaggatcttgttttcttaacgctcgcagacagcccaagtgtcgttgccaacccaggtacaccggggataaatgcgagctggatcagtgctgggaacactgtagaaacgggggtacatgtgctgcttcaccctcagggatgcccacttgtcgttgccctaccggatttaccggccctaagtgtacccaacaagtgtgtgcagggtactgcgccaataatagtacctgtacagttaatcaggggaaccagccgcaatgtcgatgcctgccaggtttcctgggagatcgctgccagtacagacagtgcagcggctactgtgagaattttgggacatgtcaaatggcagccgacggatccaggcagtgccgctgcactgcatatttcgaaggttccaggtgcgaggtcaacaagtgtagccggtgtctcgaaggagcctgcgtggtaaacaaacagtctggggacgtcacctgcaattgcaccgacggacgggtggcacctagttgtctgacttgtgttgggcactgctccaacgggggatcctgtactatgaacagcaagatgatgcctgagtgccaatgcccaccccacatgacagggccacgatgtgaggagcacgttttctctcaacagcagcctggccacattgctagcattttaattcctttactgctgcttctgctgctggtcctggtggcgggtgtggtattctggtacaaacgcagggtccagggtgccaaggggttccagcatcagcggatgaccaacggcgctatgaacgtggaaatcggaaaccctacctataaaatgtacgaaggcggagaacccgacgatgttggcggtttgctggacgcggactttgccctggaccctgataaacctaccaatttcactaatcccgtatacgcgacactctacatggggggacacgggtcccgccattcccttgcttcgaccgatgagaaacgtgaacttctcggccgaggcccagaagatgaaatcggggatcctttggcttac

SEQ ID NO: 228905 - DNA, 2142 bp, Artificial Sequence
  Description of Artificial Sequence: Synthetic coding sequence
atgctcctggctactcttctgctactcctgctgggcggagcgctggcccatcccgatcgcatcattttccccaatcacgcttgcgaggacccccctgcagttttgctggaagtgcaaggaaccctccaacgaccattggtaagagactcccgcacttctcctgcgaactgtacatggctgatcctcggcagcaaggagcagacagtaactattcgctttcagaagctccaccttgcctgtggtagtgagcggttgactctccgcagccctctgcagccccttatcagtctttgcgaagcaccgccatcgccgctgcagttgccaggtggaaacgtgaccatcacatactcctatgctggagcaagagctcctatgggacaaggcttcctgctctcatattcccaagattggctcatgtgtctgcaggaggaatttcagtgcttgaatcataggtgcgtgagcgctgttcagcgatgcgacggcgtcgacgcgtgtggcgacggctcagacgaagctgggtgttcttccgaccctttccccggtctcactccacgcccagtgccatccctcccgtgtaacgttactttagaagacttttatggagtgttctcctctcctggatacactcaccttgcaagtgtgagtcatccacagagttgccactggctgctggacccccacgacggaagaaggttggcggttagatttactgctctcgatttgggattcggtgatgcagtgcacgtctatgatggcccaggccctcccgagagctcccgactccttcgctcactaacgcattttagtaacggcaaggcagtgaccgttgagactctgtctggtcaggccgttgtctcttatcacactgtggcttggtctaacggaagaggcttcaacgcaacctatcacgtgcggggttactgcctgccatgggataggccgtgtggtttggggtctggtcttggcgctggcgaaggcctcggtgagcgctgttattcagaagcccagcggtgtgacggatcttgggactgcgcggacggcactgacgaggaagactgccccggatgcccgccagggcattttccctgtggcgctgccggaacaagtggggcaacggcgtgttacctgcctgctgatagatgcaattaccagactttctgtgcagatggggcagacgagcggagatgccgccactgtcagcctggaaatttcaggtgtcgcgacgaaaagtgcgtttatgagacctgggtttgcgatggacagcccgactgtgccgacgggtcagacgagtgggactgctcctacgtgctgccaaggaaggtcattacggccgcagtgatcggaagcctggtgtgcggtctcctgttggtaatcgcgcttggttgtacgtgtaagctgtatgccatcagaactcaggagtatagcatctttgcccctctatcccgcatggaagcggaaatcgtgcaacagcaagcacctccgtcgtatgggcagctaatagcccagggcgctattcctcccgtggaggatttccccaccgaaaaccccaacgacaatagtgtgttggggaacctgagatcgctactacaaatcctgaggcaggatatgacccctggcggagggccaggagcaagaaggcgtcagcggggtcgactgatgcgtaggttggttcgcagacttcgtagatggggcttactgcctcgtacaaatacacccgctagggcctccgaggcaagaagtcaggtgactccatcagccgctccgctggaggccttagacggcggtactggcccagcacgggagggaggtgcggtgggtggacaggatggggagcaggcgccacccctccctatcaaggctcctctgccttcagcatccacttcgcccgctccgaccacagttccggaggcacccggacccctgccctcgcttcccttagagcccagcctcctttctggcgtcgtacaggccttaaggggcaggctgcttcccagtcttggccctccaggtccgactcgatcacctcccggaccgcacacggccgtgctcgctctggaggacgaggatgatgtgctgctggtgcccctggcagagcctggcgtctgggtggccgaggcagaggacgaaccgctgctcacctag

SEQ ID NO: 228906 - DNA, 1671 bp, Artificial Sequence
  Description of Artificial Sequence: Synthetic coding sequence
atgctgttggccacactgctgttgctgctgctgggaggtgccctcgcacaccctgaccgtatcatctttccgaatcatgcttgtgaagacccccctgctgtattgctggaggtgcagggaaccctgcagagaccactggtgcgtgattcccggactagccccgctaactgcacctggctgatactgggatccaaagaacaaaccgtgacaatcagatttcaaaagctgcatctcgcatgcggctccgaacgtctgacactgagatcccccctgcagcccctgatcagtctttgtgaggcacccccatcccctctgcagttgcccggaggtaacgtgactattacttacagttatgcgggtgctagagctcccatgggccaaggttttctgctgagttactcccaggactggctgatgtgtctccaagaggagttccaatgtctcaaccaccgatgtgtgtccgcagtgcaacgctgcgatggagtggacgcctgtggcgatggctcggacgaggcaggttgcagttcagatcccttcccaggcctcacccctaggccggttccctcactgccatgcaatgttactctagaggatttctatggtgtgttttcctccccaggctacacgcacctagccagtgtctcccacccacaatcatgccattggttgcttgatcctcacgatggccgaaggctggcagtgaggttcaccgccctcgaccttggcttcggggacgccgtgcatgtgtacgatgggccagggccaccagaatccagcaggctcctccggtcccttacccatttcagcaatggcaaggccgtcaccgtggaaacactctcaggccaggctgttgtaagttaccacaccgtggcttggtctaacggaagaggatttaacgccacttatcacgtgaggggatactgcctcccgtgggacaggccttgcggcctgggctctggtctaggggcaggcgagggcttaggagagagatgctattccgaagcccagcggtgtgacggttcttgggactgtgcggatggtaccgacgaggaagactgccccggatgtccacccggacatttcccctgcggcgctgccggtacctccggggcaacagcatgttatctgccggcagatagatgcaattatcaaacgttctgtgccgacggtgccgatgagaggagatgtagacactgtcagcccggtaatttccgatgcagggatgagaagtgcgtgtacgagacttgggtttgtgacgggcaacccgactgcgctgacggctcggacgaatgggattgctcgtacgtgcttcccaggaaggtgatcaccgccgctgtaattggctccctggtttgcgggctgctgctcgtgatagctttagggtgcacttgtaagctctacgccatccggactcaagagtactctatctttgctcccctgtcacggatggaagccgagatcgtgcagcaacaggcacccccttcctacggacaactaatcgcacagggggcaattcccccagttgaggacttccctaccgaaaatcccaatgataactccgtgcttggtaatctgcggtctctgctgcagattcttagacaggacatgacccccggagggggtccgggagcacgtagaagacaaaggggtcggctgatgagaagactgtag

SEQ ID NO: 228907 - DNA, 13968 bp, Artificial Sequence
  Description of Artificial Sequence: Synthetic coding sequence
atggatagaggtcccgcagctgtcgcatgcacgctgctccttgcactggtagcctgcctagcaccggctagcggacaagaatgtgattcggctcattttcgttgcgggagcggtcactgtatcccggcagactggagatgtgacggaacaaaggattgtagtgacgatgctgacgaaatcggctgtgcagtagtgacatgccagcaaggatattttaaatgtcagtccgagggtcagtgcatcccaaattcttgggtctgcgaccaagaccaagactgcgatgatggaagcgatgagcggcaggactgcagtcagtctacttgtagtagccaccagattacttgttctaacggacagtgcatcccttctgaatatcgatgcgaccatgtcagggattgcccagacggcgctgacgagaatgactgtcaataccctacctgtgagcaactcacctgcgacaacggagcctgttataatacttctcaaaaatgtgattggaaagttgattgccgcgatagctctgatgagattaactgcactgagatttgcttgcataacgaattctcatgtggaaatggtgagtgcattcctagggcttacgtgtgtgatcacgacaatgactgccaggacggctctgacgagcatgcctgcaattatcccacgtgtggaggttatcaatttacttgcccgagcgggcgttgtatctaccagaactgggtctgcgatggggaagatgattgcaaggacaatggagacgaagacggctgcgagagcgggcctcacgacgtgcataagtgcagcccgagagaatggagctgccctgagtccgggagatgtatcagtatttataaggtatgcgacgggatcctggattgtcccggtcgagaagatgaaaacaatacgtccactggcaagtactgctcaatgaccctgtgttcagcgctgaattgccagtatcagtgccacgaaaccccttacggtggagcatgtttttgtcctccaggctacatcatcaaccacaatgacagccggacctgcgttgaatttgatgattgtcaaatttgggggatctgtgatcaaaaatgtgaatctaggcctggaaggcacctgtgtcactgcgaagaaggttatatcctcgagcggggacagtactgtaaggcgaatgactcgttcggagaagcttccattatctttagcaacggacgtgaccttttgatcggggacatacacgggagatccttccgcatactcgtggagtcacagaaccggggagttgctgtcggagttgcatttcactaccatcttcagcgggtgttttggacagacacagtgcagaacaaggtgttctccgttgatatcaacggcctgaatattcaggaggtgctcaacgtttcagtagagaccccggaaaacttagctgtggattgggtgaataataagatttacctcgtagaaaccaaggtgaaccgtattgacatggtaaatctcgacggctcgtaccgggtgaccttaataacagaaaacctgggacatcctcgcggtatagctgtcgaccccaccgttggttacttatttttctccgattgggagtccctgtccggtgagccaaagttggagcgggcttttatggacggcagcaatcggaaggatctggtgaagacaaaactggggtggcccgctggagtgacattagacatgatctctaaacgggtgtactgggtagatagcaggttcgactatattgagactgtgacttacgatggaatccagcgcaagacggttgtgcatggtgggtcacttatcccacatccatttggggtctcactgtttgaaggccaggtgttttttaccgattggaccaagatggccgtgttaaaagcaaacaaatttactgagaccaatccccaggtctattatcaggcaagcctccgcccatacggagtgacagtctatcactcgctgcgccagccttatgccactaatccttgtaaagataataatgggggttgtgagcaagtgtgcgtgttgagccataggacagacaatgacggactgggctttagatgtaagtgcacctttggttttcagctggataccgacgaaaggcattgcatcgctgtccagaacttcttaatctttagctcccaggttgccataagaggcattccttttaccctgtcaactcaagaagacgtcatggtgcccgtttcaggcaacccctcttttttcgtagggatcgattttgatgctcaggattccaccatcttcttttccgatatgtcaaagcatatgatttttaaacagaagatcgacggcaccggcagagaaattcttgccgctaacagggtggaaaatgtggagagcctcgcattcgattggatatctaagaacctgtactggactgatagccactacaagagcatctcggtcatgagacttgctgataagaccagacgcaccgtagtgcagtacctaaataacccaaggtctgtggtggttcatccctttgcaggttacctcttttttactgattggttcagacctgccaagattatgagggcttggtcagatggctcccatctcctgccagtcatcaacaccacgctgggctggccaaacggacttgccattgactgggccgcttcccgcctgtattgggtggacgcctacttcgacaagatcgagcattccaccttcgatggcttggaccgcaggcgcctgggtcacatcgagcagatgacgcatccatttggcctggcaatctttggagaacaccttttctttacggattggcgtctcggtgctatcataagggttcggaaggccgatggaggggaaatgaccgttataagaagtggaatcgcctacatattgcacctgaagagctacgacgtgaacatccagacaggcagtaatgcatgtaatcaaccgacacaccccaacggggattgttctcatttttgtttccctgtgcccaattttcaacgagtttgcggttgcccatatggaatgcggttagcctcgaatcatcttacatgcgagggggaccccacaaacgagcccccaacagagcagtgtggacttttctcattcccctgcaagaatggacgctgtgtccccaattattatctatgcgacggagttgacgactgtcatgacaacagcgatgaacagctatgcggaacccttaataatacatgcagcagcagcgcatttacatgcggccatggggaatgcatcccggcacattggaggtgcgataagaggaatgactgtgtggacggttctgatgaacacaactgtccaacgcatgcacctgcttcctgtttagatacacaatacacgtgtgacaatcaccaatgcatttccaagaactgggtttgcgacaccgataacgactgcggggatggctccgatgagaagaactgcaactcaaccgaaacatgccagccatctcaattcaactgtccaaatcaccgatgcattgacctgagcttcgtgtgcgacggcgacaaagactgcgtggatggctctgacgaggttggatgcgtgctgaattgtaccgctagccagttcaaatgcgcgtcaggggacaagtgtattggagtcaccaatagatgcgacggggtgtttgactgtagcgataactcagacgaagcagggtgtcccacaagacctccaggcatgtgtcatagcgatgaatttcagtgccaagaggacggaatatgtattcccaatttctgggagtgtgatgggcatccggattgtctgtacggctctgatgagcataacgcgtgcgttcccaagacatgtccctcctcttatttccactgcgataatggaaactgtattcatcgggcttggctgtgcgatagggataacgattgtggggatatgtccgacgaaaaggattgcccaactcagccattccgctgtccttcttggcagtggcagtgtttgggccacaacatttgtgtgaacctgtccgtcgtgtgcgatggaatctttgattgccccaacggcaccgacgagagcccactgtgtaatggcaacagttgctcagatttcaatgggggatgcacccatgagtgcgtgcaagagcccttcggtgctaaatgcctctgccctctggggtttctgttagccaacgacagcaagacctgtgaggatattgacgaatgtgatattcttggtagctgttcacagcattgctacaacatgcggggaagcttcagatgtagctgtgatacagggtacatgctggagagcgacggcaggacttgtaaggtcacagcttccgaaagccttttgttgctcgtcgcctctcagaacaaaattatagcagacagcgttactagtcaagtgcacaatatatattccttagtagagaacggaagttacattgtggccgtggatttcgactctatatctgggaggatattctggtcagacgcaacccagggcaagacttggagtgcattccagaacgggacagatagaagggtcgttttcgactcaagcatcatcctgaccgaaacaattgcgattgactgggtgggacgcaacctctactggaccgattacgctctcgaaaccatagaggtctcaaaaatcgacggatcacatcgcacagttctgataagcaaaaatttgaccaaccctaggggacttgctctcgacccccgaatgaacgagcatttgctgttttggtccgactggggccaccatcctcgaattgaaagggcatctatggacggcagtatgcgcactgtgatcgtgcaggacaagatcttctggccttgcggcctaaccatcgactatcctaatcgtctgctgtatttcatggactcatacctggactatatggacttctgtgactacaatggccaccaccgtagacaagtcatcgcatcggacctcattataaggcacccctacgcactaaccctttttgaagatagtgtgtattggacagaccgagccacacgtcgagtgatgagggcaaataagtggcacggaggcaaccagtccgtcgtaatgtataatattcagtggcccctgggcatcgtggcagtccatccaagtaagcagcccaatagtgtgaatccttgcgcatttagtagatgttcccacctctgtttgctctcatcacagggaccgcacttctacagttgtgtctgtccaagcggatggtccctttcacccgacctactgaactgcctaagagatgatcaacctttcctgataaccgtgcgccagcatatcattttcggtatcagcctgaaccccgaggtgaagtccaatgatgccatggtccctatcgctgggattcaaaatggcctggacgtcgaatttgacgacgccgaacaatacatctattgggtcgaaaatcctggagaaatacatagagtcaagacggatgggactaaccgcactgtgttcgcctcaattagcatggtggggccaagcatgaaccttgccctggactggatttctaggaacctgtattctacaaatcctagaacccagagcatcgaagtattgactttacatggcgatatacgctaccgaaaaacccttattgcgaatgacggaaccgcgctgggcgtgggtttccctatcggaatcactgtcgatccagcccgaggaaagctgtattggtctgaccagggcactgactctggtgtgcctgctaagattgcaagcgccaacatggatggcacaagtgtgaaaaccctttttacaggcaacctcgagcatctggagtgcgtaactttagacattgaggaacaaaagctttattgggccgtcactgggaggggagtgatcgagaggggaaatgtagacggtaccgaccgtatgatattggtgcatcagctgtcacatccatggggaattgctgtccatgacagttttttgtattatactgacgagcagtacgaagtcatcgaacgcgtcgataaagccacgggtgccaataagattgtgctgagagacaacgtccccaacctgcgcggactccaggtgtaccatcgaaggaacgctgcggagtcctccaatgggtgttccaataatatgaacgcctgccagcagatctgtctgcctgtgcctggtgggctgttctcatgtgcttgcgcgaccggcttcaaactcaatcccgataaccggagttgttccccgtacaactcttttatcgtagtgtctatgctgtcagctatccggggttttagtttggagctcagtgatcactcagagacaatggtgcctgtagccggtcaaggcagaaatgcccttcatgtagacgtggacgtttcatctgggttcatatattggtgtgacttttcaagtagtgtggcgtctgataatgctattcgtcggatcaaacccgacggcagctcactgatgaatatagtgacccacggaattggagagaacggggtcagaggtattgcagtggattgggtggctgggaatctgtatttcaccaatgcattcgtcagtgagacactaatcgaggtcttgcgcattaatacgacctaccgcagagtcctgctgaaggtcacagttgatatgcccagacatatcgtagtggatccaaagaatcggtatctgttctgggccgactacggacagcgaccaaaaattgaacggtccttcctcgattgcacaaacaggactgttctggttagcgaaggtattgtcacccccaggggattagccgtggacaggtctgatggctacgtatactgggttgatgactccctggatattattgccagaattcgcatcaatggggagaatagcgaagtgataaggtacgggtctagatacccgaccccatatggaatcacagtgtttgaaaattcgattatttgggtcgacagaaatttgaaaaaaatctttcaggcatccaaggaacctgagaacaccgagcccccaacagtgatccgcgacaacatcaactggctaagagatgtgactatttttgacaagcaagtccaacccaggagcccagcagaagtgaacaataacccatgcctggagaacaatggtggatgctcacacttatgttttgctctccccggtctgcatacacctaagtgtgactgcgcgtttggcacgctgcagagtgacggcaagaactgtgcgatcagcacagaaaattttctcatattcgccctgtctaactctttgaggtcattgcacctggatcccgaaaatcattccccgcctttccagacaatcaacgtggaacggacagtgatgtctcttgactacgactctgtcagcgataggatttacttcacccaaaatttggcctcgggtgtcgggcagatctcatatgcaactctttcatccggaatccacactcccacagtaatcgccagtggtattggcacggcagatggaatagcgtttgactggataacacgaaggatatactattctgactatctgaatcaaatgattaactctatggccgaagatggaagcaatcgaacagtgatcgcccgagtgccaaaacctagagccatcgtcctggacccctgccagggatacttgtattgggctgactgggatacccatgccaaaatcgaaagggccaccttggggggtaatttccgcgtccccatcgtgaattcttccctggtgatgccaagtggcctaaccctggactatgaggaggatctgctgtactgggtcgacgcctcactgcaacggatcgaacgaagtacactgacaggggtggacagggaagttattgtcaatgcagctgtgcacgcttttggactcaccctatatggacagtacatatattggacagatctgtatacccagcggatctaccgggcaaacaaatatgacggatccggccagattgcgatgacaacaaatctgctctcccagccccgaggcattaatacagtcgtcaaaaatcaaaaacagcagtgcaataatccttgcgagcagtttaacggtggctgtagccatatctgcgcgcctgggcctaacggtgccgagtgtcagtgcccgcatgaaggaaactggtacctcgccaataataggaagcactgcatagtcgataacggagagcgatgtggcgcaagcagttttacatgcagtaacggcagatgtataagtgaggaatggaagtgtgacaacgataacgactgtggcgatggaagcgacgagatggaatctgtgtgcgctctgcatacttgtagccccactgcattcacatgtgccaatggaagatgtgtgcagtattcatacagatgtgactactacaacgactgtggcgacgggagcgacgaggctgggtgcttattcagggactgtaacgcaacgacagaattcatgtgcaacaacagacgctgtattccgcgagagttcatttgcaacggcgttgacaattgtcacgacaacaatacctctgacgaaaaaaactgtcctgacagaacctgtcagtctggatacactaagtgccacaattcgaacatctgcattccaagagtctatctctgtgacggagataatgactgtggcgacaactctgacgaaaacccgacatactgcacaactcacacctgctcctcttctgaattccagtgcgcatcaggtagatgtataccccagcattggtattgcgatcaggagacagattgcttcgatgctagcgatgaaccagctagttgcggacacagtgagaggacatgtcttgcagatgaattcaaatgtgacggcggtagatgcataccttccgagtggatctgcgatggagacaatgattgtggagatatgtccgatgaggataagcgacaccagtgccaaaatcaaaactgtagcgactccgaattcctttgcgtgaacgatcggccaccggatcggcgatgcataccccaaagttgggtgtgcgacggggatgtggattgcactgacgggtacgacgagaatcaaaactgtacaagacggacatgctcggagaacgagttcacttgcggctatggactgtgcattcccaaaattttccgctgcgacagacacaatgattgcggcgactattcagacgaacgcggatgcctgtatcaaacgtgtcagcagaatcaattcacgtgccagaacggccgatgcatcagcaagacatttgtttgtgatgaagataacgactgcggcgatggttcagacgaactgatgcacctgtgtcacacaccagagcctacgtgcccgcctcacgaattcaagtgcgacaatggccgttgcatagaaatgatgaaactatgtaatcatttggacgattgtctcgacaattccgacgagaaaggttgcgggatcaacgagtgtcacgatccatctatctccggctgcgaccacaattgcactgacaccctgacatccttctattgtagttgtcgccctggctacaaattaatgtcagacaaacgaacctgcgtagacattgatgagtgcaccgagatgccgttcgtctgctcccaaaagtgtgagaacgtgattggatcttacatctgcaagtgcgctcctggatacctccgggagcctgacggcaagacctgccggcagaactccaacatcgaaccctacttgattttcagtaatagatattatcttcgcaacctcaccattgatggctatttctacagcctgatcctcgaaggtctggataacgtcgtggctctggattttgaccgggtggaaaagagattatattggatcgatacccagcggcaggtgatcgaacggatgttccttaacaagacgaacaaggaaaccattattaatcaccgtctgccagccgcagagtctttagctgtggattgggttagtagaaagctgtactggcttgatgctcgcctggatggactctttgtcagcgacctaaacggtggccataggcggatgttggctcaacactgcgtggatgctaacaataccttttgtttcgataatccacgcggacttgcactgcaccctcagtatggatacctgtattgggctgattggggtcaccgtgcctatatcggccgagtcggaatggacggtaccaataaaagcgtcatcatttccactaagctcgaatggcctaatgggattactatagactatactaatgacttgctatactgggccgacgctcatctcggctacatagagtatagcgacctggaagggcatcatagacatacagtgtacgatggggcacttccgcaccctttcgccatcaccatttttgaggacactatctactggacagattggaacacacggacagtggaaaaaggaaacaagtatgacgggtctaacaggcagactctcgtaaacactacccacaggccttttgacatccacgtgtaccacccataccgacagccgattgtgtcaaatccatgcgggaccaataacggaggctgctcacacctttgcctcattaaacccggagggaaaggctttacctgtgagtgccccgatgactttcgcacgctccagctgagtggatctacttactgcatgcctatgtgttcttccacgcagtttctgtgtgccaacaatgaaaaatgcattcccatatggtggaaatgcgatgggcagaaggattgttcagacggctccgacgagctcgctctttgccctcagaggttttgtaggctaggtcagtttcagtgctctgatggaaactgtacaagtccacagacgctatgtaatgctcatcagaattgccccgatggatccgatgaggaccgcctgctgtgcgagaaccaccactgcgatagtaatgagtggcaatgcgccaacaaaaggtgcatccccgagagttggcagtgtgatacttttaacgactgcgaggataactctgatgaggactcatcacattgtgcgtcaagaacctgcaggcccggtcaattccggtgtgccaacggcaggtgtatccctcaagcatggaaatgcgacgtggacaatgactgtggtgaccactcagatgaaccgatagaagaatgcatgagtagcgcacatttgtgtgacaactttaccgaattctcttgcaaaacaaactacagatgtattcccaaatgggcggtctgcaatggggtggacgactgtcgggacaatagcgacgaacagggttgcgaggagagaacctgccaccctgtcggagactttaggtgtaaaaatcaccattgcattcccctgcgctggcagtgtgacggccaaaatgactgtggcgataacagtgacgaggaaaactgtgcaccaagagaatgtactgagagcgagttccgttgtgtcaatcagcagtgcattccctctagatggatatgtgatcattataatgactgtggcgataactcagatgagagagactgcgaaatgcgcacctgccatcctgaatatttccagtgcacaagtggccactgcgtgcattctgagctgaagtgtgacgggtccgcggattgtcttgacgcatcggatgaggcagactgccccactagatttcccgacggcgcttattgtcaggcaactatgttcgagtgcaagaaccatgtgtgcattcctccctactggaaatgtgatggagatgacgactgtggagacggctccgatgaagagctgcacctgtgcctggacgtcccttgtaacagcccgaatcggtttcggtgcgataataatcggtgtatttattcacacgaggtgtgtaacggcgttgatgattgcggagacggcactgacgagacggaagagcactgtcggaagccgacgccgaaaccttgcaccgagtacgagtataagtgcggaaacggtcactgcattcctcatgacaacgtgtgtgacgatgccgacgattgcggcgactggagtgacgaactaggatgtaacaaggggaaagagcgaacctgtgctgaaaacatctgtgaacagaattgtacgcaactaaacgagggtggattcatctgtagttgtacggccggattcgagaccaacgtgtttgatcgaacatcctgcctggacattaacgaatgcgagcagttcggtacatgtcctcagcactgccgaaatacaaagggctcttatgagtgtgtgtgcgctgatggatttacctcaatgagcgatagacctggtaagcggtgcgccgcagagggttcctcccccctcttgctactccctgataacgtaagaattagaaaatataaccttagcagcgaacggttcagcgagtacctgcaagacgaggagtacatccaggccgttgactacgactgggacccaaaggatattgggttgtccgtggtgtactatactgtgcgcggagaggggtctaggtttggagccatcaaaagggcttacatacccaacttcgagagcggccgaaacaacttggttcaggaagtggacctaaaactgaaatatgttatgcagccagacgggattgccgtagactgggtggggagacatatctattggagcgatgtgaagaacaagagaatcgaggtcgccaagctggatggtcgctatcggaagtggctgatcagcactgatctggatcagcccgcagccatcgccgttaatcccaaactcggtcttatgttctggaccgactggggtaaagagccaaagattgagtccgcctggatgaacggcgaagataggaatatcctagtcttcgaggacctcgggtggcccaccggcttgtctattgattacctcaataatgatagaatctactggagcgactttaaggaggacgttatcgagaccatcaagtatgacggcacagacagaagggtcatcgcaaaggaagctatgaacccctacagtttagatatttttgaagaccagttgtattggatcagtaaagaaaagggcgaagtgtggaagcagaataagttcggccaaggaaagaaagaaaagactctggtggttaacccatggctcactcaagttcgaattttccaccaactccgatataataagagtgtccctaatctgtgcaagcagatctgcagccacttgtgcttgctgcgacccggaggctatagctgtgcgtgccctcaaggaagcagctttattgagggatccacaacagagtgtgatgccgcaatcgagctgccaattaacttgcccccaccctgtagatgtatgcatggagggaactgctactttgacgagacagacctgcccaaatgtaaatgtccctccgggtacaccggcaagtattgtgagatggccttctccaagggtatcagcccaggaaccacagccgtggccgttttgctgacgatcctccttattgtcgtgatcggagcgcttgccatcgccggtttttttcactatcgcaggactggatccctgcttccggctctcccaaaactgccttcgctttcctcactcgtgaagccaagtgaaaacggcaacggtgtaacttttagatccggcgctgaccttaacatggacattggcgttagtggattcggacccgagaccgcaatcgaccgatccatggctatgagcgaggatttcgtgatggaaatgggtaagcagcccataattttcgaaaaccctatgtatagcgcccgagacagcgcagtgaaggtggtacagcccatccaggtgaccgtgagtgaaaatgttgataacaaaaattatgggtccccaataaacccaagcgagatcgtgccagagacgaaccctacgagtcccgctgcagatggcacacaagttacgaaatggaacctgttcaaacgaaagagcaaacagaccactaattttgaaaaccccatttacgcacagatggagaatgagcagaaggaaagcgtggcagcaacaccccctccatcaccaagtctgcctgctaagccaaagccaccatctcgcagggatcctactcctacatattctgccactgaggatacgtttaaggacacagctaaccttgtgaaagaggacagcgaggtctat

SEQ ID NO: 228908 - DNA, 3678 bp, Artificial Sequence
  Description of Artificial Sequence: Synthetic coding sequence
atggaccggggacccgcagcagttgcctgcactctgctcctcgctctcgtcgcctgcttggcgcctgctagcggtcaagaatgtgatagtgcccactttcgatgcggtagtgggcattgtattccggctgattggagatgtgacggcacaaaggattgctccgacgatgcagacgagataggttgtgcagtggttacatgccagcaggggtacttcaaatgccagtccgagggccagtgtatacctaattcctgggtgtgtgatcaggaccaagactgcgatgatgggtccgacgagcgtcaagattgttcacagagcacgtgctcttctcaccagatcacctgcagcaacggccaatgcatcccctctgaatacagatgcgatcacgtgcgcgactgtcccgatggggctgacgagaacgattgccagtatcccacgtgcgaacaactgacctgtgacaatggtgcatgctataacaccagtcagaaatgcgattggaaagtcgactgcagagactccagtgatgaaatcaattgtacagaaatttgccttcataacgagttttcgtgtggaaatggcgagtgtattccacgtgcctatgtgtgcgaccacgacaatgactgccaagacggttcagacgagcacgcctgcaattaccccacgtgtggtggctaccagttcacttgcccttctggcagatgcatctatcaaaattgggtgtgtgatggggaagatgactgcaaagataacggcgatgaggacggctgtgaaagtggaccacacgatgttcacaaatgctcgcctagagaatggagctgtccagagtctggcagatgtatttccatctataaggtgtgcgacgggattcttgactgcccgggtcgcgaggatgagaataatacttccactggaaaatattgttccatgacactgtgctctgcgctgaactgccagtatcagtgtcacgagacaccctacggcggtgcctgtttctgccctcctggctacattattaatcacaacgacagtcgcacatgcgtcgaatttgatgattgccagatatggggaatatgcgaccagaaatgcgagtcccgccctgggagacacttatgtcattgtgaggaggggtacatccttgaacgcggacaatactgtaaagcaaatgacagtttcggtgaagcaagcatcattttttctaacggacgggacctcctcatcggggatattcacgggagatcctttcgaattctcgtcgagagccagaaccgcggagtggctgtaggcgtcgcttttcactaccatttacaaagagtgttctggaccgacactgtccaaaacaaagtctttagcgtggatataaatggtctgaatatccaggaggtcttaaacgtgtcggtcgagacacccgagaatctagcagttgactgggtcaataacaagatctatcttgtcgaaactaaagtgaaccgcatcgacatggtaaacctcgacggaagctatagagtcacgctgatcactgagaacttagggcaccccaggggaattgctgtcgaccctacggtggggaaaaccgtggtgcacgggggaagtctgatacctcacccttttggcgtcagcctgttcgaggggcaggtcttctttactgactggaccaagatggccgtcctaaaggcgaacaagtttacagaaactaacccgcaggtttactatcaggcctccctccggccttacggcgtaaccgtataccactccctacgccagccttacgctactaatccttgcaaagacaataacggaggctgcgagcaggtatgtgtcctgagccatcgcacagacaatgacgggctggggtttagatgtaaatgtacttttgggtttcagttagacactgatgagcggcattgtatcggccgagaaatcttagcagcaaatagagtagagaatgtggagtctttagcttttgattggatatctaagaatctgtactggacagacagccactacaagtccatttctgttatgcggctggccgataagacgaggcgcacagttgtccagtatctgaacaatccgagaagtgtggtagtgcaccctttcgccggatatctgttcttcaccgattggttccgcccagccaaaattatgagagcgtggagtgatggatcccatcttttgcccgtgataaacaccacactcggatggccaaatggacttgcgatcgattgggcagccagccggctgtactgggtcgacgcatacttcgacaaaatcgaacacagcaccttcgatggcctggacagacggaggcttggccacattgaacagatgacacacccttttggtttagcaatcttcggtgaacaccttttcttcaccgactggcgacttggagccattatcagagtcagaaaagccgacggtggagaaatgacggtgatccggagcggaatcgcgtacatccttcacctgaagagttatgatgtgaatatccaaaccggcagcaatgcctgcaatcagccaacccaccccaatggtgactgtagccatttttgtttccccgttcctaattttcagcgcgtgtgcggttgtccatatgggatgcggttggccagcaaccacctgacctgcgaaggcgatcccacaaacgagcctccgacagagcagtgcggattattcagcttcccctgcaaaaacggaaggtgtgtccccaactattatctgtgtgacggcgtggatgattgccacgataattcggacgagcagctgtgtggtacattgaacaatacgtgctcttcctccgctttcacgtgcggtcatggagagtgtatccctgcccactggcggtgtgataaacgtaatgattgcgttgatggttctgatgagcacaactgccccacacacgccccagccagctgtctggacacacagtacacctgtgacaaccaccaatgcatttctaagaattgggtctgcgacacagacaatgactgtggtgacggttctgacgagaaaaattgtaattctacagagacatgtcagccatcccagttcaattgccctaatcacagatgcattgacctgtcctttgtctgcgacggcgataaggattgcgtggacggaagtgatgaagtggggtgtgtgttaaattgtaccgcgagtcagtttaaatgcgctagcggggacaaatgcatcggggtaactaatcggtgtgacggcgtcttcgattgcagcgacaattctgacgaagcaggatgccccaccaggccccctggaatgtgtcattcagatgagtttcagtgccaggaagatgggatatgcattcccaatttctgggagtgcgatggccaccccgactgcttatatggcagtgatgaacataatgcctgcgtgcctaaaacttgtcccagttcttacttccattgtgataatggaaattgcatccacagggcttggttatgtgatcgggataacgactgcggcgatatgagtgacgaaaaggattgtcctacccagcctttccgatgccctagttggcagtggcagtgcctcggccacaatatctgcgttaacctctccgtggtgtgcgatgggatctttgactgccccaacggtaccgacgagagtcccctttgtagcaagttcccggatcacagtctgctggctatcaattcattctag

SEQ ID NO: 228909 - DNA, 1941 bp, Artificial Sequence
  Description of Artificial Sequence: Synthetic coding sequence
atgttggcccagcattgtgtcgacgcgaacaacacattctgttttgacaacccacggggacttgccctgcaccctcagtacggctatctctactgggcagactggggccacagggcgtatatcggtcgcgtcggcatggacggaactaataaaagcgtcatcatatctacaaagctggagtggccgaatgggattaccattgactataccaacgacctgttgtattgggccgacgcgcacctcgggtatatcgagtattccgatttagaaggacaccatcggcatactgtatatgacggggctctgccccacccgtttgctatcaccatctttgaggatacaatatattggaccgactggaacacccgaaccgtcgaaaagggcaacaagtacgacggaagtaacaggcaaactctggtgaatacaacacacaggcccttcgacatccatgtgtaccacccgtaccgtcaacccatcgtgtctaacccctgtgggaccaacaacggaggctgtagtcatttgtgcctgataaagccaggcggaaagggctttacgtgcgagtgcccagacgatttccggacgctgcagctgagtggtagcacctactgtatgcctatgtgcagctcaactcaattcctgtgtgccaataacgagaaatgcatccctatttggtggaagtgcgacgggcagaaggattgttcagatggatccgatgaacttgccctgtgcccccagaggttctgccgtttggggcagttccagtgcagcgacggtaactgcacctcaccccagaccctatgtaacgctcaccaaaactgcccggacggaagtgacgaagaccgactcctgtgcgagaaccaccactgcgactcgaatgaatggcagtgtgcaaacaaacggtgtatcccagagtcctggcaatgtgatacttttaatgactgtgaggacaattccgacgaagattcttcacactgcgccagccgcacttgcaggccaggccaattcagatgcgccaacggacgctgtataccacaggcatggaaatgcgatgtggacaatgattgtggggatcattccgatgagcctatcgaagagtgtatgtctagtgcgcacctatgcgacaatttcaccgagttcagctgcaaaaccaattaccgctgcataccaaagtgggcggtgtgcaacggagttgatgattgtcgagataattccgacgaacagggctgtgaggagagaacatgccaccctgtgggcgacttcagatgtaagaaccaccattgcataccacttcggtggcagtgcgacggacaaaacgattgtggggacaattccgacgaagagaactgtgctccgcgagaatgcaccgagagcgaatttcgctgtgtgaaccagcaatgtatcccttctaggtggatttgcgatcattacaacgactgcggcgacaacagtgacgagcgggattgtggaatgcggctcatgaagctcatcgtcccacacgcatttctcatggtgcacacagcacggcttctctgtagcaatgccaaaaccatgtttgtgagccggcacattgggaacgtgatggccatgatgacggtcgctatggtgcagatgaaaaatttcacatgcgcatggatgttcccagttattcaccaaaccgtaagcggagtgacaaccattgctgcgttcatcgtcatgagatgcgcaatggtttggatgacagtggaaatggagctcatgcgacagagatcaacggtcgaaaatagacctctgaacctcgtacagaacatgaatatttccgtggcgatgggcatcgcgttccacatgacaatgtgcgtcatgatgcccatgaccgtcgtcaccgggccaatgaattgggtggcgattaaagaaaaaaaggaacatgtgctcaagatatatgcttccaagattgtgcccaactag

SEQ ID NO: 228910 - DNA, 2313 bp, Artificial Sequence
  Description of Artificial Sequence: Synthetic coding sequence
atggagaaacgcgctgcagcagggttggaaggagctcccggtgcaagagcacagttggccgtggtctgtctagttaatatctttctgactggaaggctttcttccgccgtccctgcattggctgcatgttccggcaagttggagcagcacacagaacgtcggggagtcatctatagtcctgcttggcccttgaactacccccctggaaccaattgctcctggtacatccagggagatcggggtgacatgatcactatctcctttaggaacttcgacgtggaggagagccaccaatgctctctggactggcttcttctgggacccgctgcacccccaagacaggaggctttccggctgtgcgggagtgccatcccaccagcctttattagcgccagagatcacgtgtggattttcttccatagtgatgccagctctagcggtcaggcacaggggtttcgactcagttatatccgaggcaagctcgggcaggccagctgccaggcggacgaattccgttgcgataatggcaagtgcctgccaggcccttggcaatgcaataccgttgatgagtgtggcgatgggtctgatgagggcaactgtagcgcccctgccagcgagcccccaggaagcctgtgccctggtggaacatttccatgttcaggagcacgatcaacaaggtgtcttccggtggaacgtcgctgcgacggactgcaagactgcggtgatggctctgacgaagccggatgtccggatctggcctgcggaagacgtttgggctccttctatggttcctttgcctcgcctgacctctttggcgcagcgcgagggccaagcgatctacattgcacctggctggtcgacacacaggacagtcgacgcgtgttgctgcagctcgagctgcgacttgggtatgatgactacgtacaggtgtacgaaggcttgggcgaacgtggggatcgtctgctgcagacactgagttacaggagcaaccatcgacctgtgtcgttggaagccgctcaggggcgtctgacagtcgcctaccacgcacgggctcgaagtgcaggacacgggtttaacgctacgtatcaagttaaagggtactgcctcccatgggagcagccctgcggctcttccagcgatagcgatggcggaagtcttggcgaccagggctgtttcagcgagccccagcgttgcgatgggtggtggcactgcgcctcaggaagagatgaacaaggctgtccagcctgccctccggaccagtatccttgtgagggcggatccggactttgctatactccagctgatcggtgtaacaatcagaagtcgtgcccagacggtgctgatgagaaaaattgcttcagttgtcagcccggaactttccattgtgggacaaatttgtgtatcttcgagacctggcgctgtgacggacaggaagactgtcaggacggttccgatgaacatgggtgtctggccgcagtgcccaggaaagtcattacagccgctttaatcggaagcctcgtgtgtggtctgctcctcgttatcgcccttggctgcgcattcaaactttactcgctccggacgcaggagtatcgtgcatttgaaacccaaatgacccggctggaagctgaatttgtaagacgcgaagctcctccttcgtatggacaactcatagctcaggggttgattccacccgtggaggactttccggtatacagcgcctcgcaggctagtgtcctgcagaatctgaggaccgctatgcggagacaaatgagaaggcacgccagcaggagggggccaagccgcagaaggcttggcagactatggaatcgcttgtttcacagacccagagcacccaggggtcagatcccccttctgaccgctgcgaggcctagtcagacagtactcggcgacggattcctccagcctgccccaggcgcagctccagatccacctgcgcctctgatggacacgggctccacacgagctgcgggagatcggccaccctcagcacctgggcgagccccagaggtcggaccctcgggccctccgctccctagtggtctcagggatccggagtgtcggccagtggacaaggaccgaaaggtgtgccgcgaaccactggtggacggaccagcgcctgcggacgctccgcgtgagccgtgctctgcccaagacccgcatccccaggtgtccaccgcaagcagcactttgggaccacactccccagaacccctcggcgtgtgtcggaatcctccgcctccttgtagtcccatgctggaggcttctgatgatgaagccctcttggtctgctag

SEQ ID NO: 228911 - DNA, 858 bp, Artificial Sequence
  Description of Artificial Sequence: Synthetic coding sequence
atgggaaaccatctgccagctttcgggccaagacctcctggaaggcgagaagctctactgagtcccgactgcccactgctaaggctgcatcccacgggcaaactgggacaggcctcatgtcaggctgacgagtttagatgcgataacgggaaatgcctgccgggtccctggcaatgtaacactgttgatgagtgtggagacggcagtgatgagggcaactgtagcgcaccagcgagtgagcctccgggatcgctgtgcccaggcggtaccttcccttgttcgggggctcgatctacaaggtgtttaccagtcgaacgaaggtgcgatggccttcaagattgcggcgacggatctgatgaggcaggatgtccggacctggcctgcgggcgtagattgggttcattttatggcagttttgcatctcctgatctgtttggtgcagccaggggaccatccgatctgcattgcacctggttagtggacacgcaggactcgcgcagggtgctgctgcagttagagctgagacttggttacgacgactatgtgcaggtgtacgagggtcttggcgagaggggcgatcggctgcttcagactctctcctacagatctaaccatcgcccagtgtctctggaggcagcccagggcagattgaccgtggcctaccacgccagagcaagatccgccggacatggttttaacgcaacctaccaggtgaaaggttactgcctcccctgggagcagccatgcggatcttcaagcgattctgacgggggatcactaggcgaccaaggttgcttcagcgagccccagcgctgtgacgggtggtggcactgcgccagcggaagagacgagcaatag

SEQ ID NO: 228912 - DNA, 5717 bp, Artificial Sequence
  Description of Artificial Sequence: Synthetic coding sequence
atgcgacggcaatggggtgcgctgctgctgggcgctttgctctgcgcccacggcctggcatcatccccagagtgcgcttgtggccgatctcattttacctgcgcagtgtccgctctgggagagtgcacgtgcataccagcacagtggcagtgtgatggcgacaatgattgtggcgaccactctgacgaggatggttgcattctcccgacctgcagccccttggactttcactgcgataacggcaagtgcatccgcaggtcctgggtgtgcgatggggacaacgattgcgaggacgactccgatgaacaggactgccccccaagagaatgcgaagaggacgaattcccatgtcagaatgggtactgtattcgatcactctggcattgcgatggcgataacgattgtggagacaatagtgacgaacagtgtgacatgagaaagtgttccgacaaggaattcaggtgcagcgacgggagttgtatcgcagaacattggtattgtgatggagatactgactgtaaggatggctcggacgaagaaaactgccccagcgccgtaccagccccaccatgtaaccttgaagaattccagtgtgcgtacgggcgatgtatcctcgacatctatcactgtgacggtgatgatgactgcggcgactggtctgacgagtcagactgctcctcgcatcaaccctgtcgcagcggtgagttcatgtgtgattccggtctgtgcatcaacgctgggtggcgatgtgacggcgatgcggactgcgacgatcagagtgatgaaaggaactgcacaacctctatgtgcactgcagaacaattcagatgccacagcggtcgatgtgtgcgcctgtcttggcggtgcgacggcgaagacgattgtgccgataacagtgacgaagagaattgcgaaaacactgggtcaccccagtgcgccctggatcagttcctgtgttggaatggaagatgcattggacaaaggaaactgtgtaatggagtcaacgactgtggcgataactcagatgagtccccccagcagaactgtcgcccaaggactggggaggagaattgtaatgttaacaatggaggatgcgcacagaaatgtcaaatggttcggggagcagtgcagtgcacctgccacactgggtaccgcttgaccgaggacggccatacatgtcaggatgtgaatgaatgcgcagaggagggctattgcagccagggttgtactaactctgagggggcttttcagtgttggtgcgaaacgggctatgaactgcgccctgatagacgcagctgcaaggcacttggtcccgagcccgtgttactgtttgccaatagaattgatatccggcaggtgttgccacatcgctccgagtatacccttctcctcaacaacctggaaaacgcgatcgcacttgacttccaccacagacgcgaactcgtcttctggagcgacgttacacttgataggattctccgcgcaaatctgaatgggtctaacgtggaagaagtcgtgtctacgggcctggaaagtcccggaggtttggccgtcgattgggttcatgacaaactctattggactgactccgggacctctcggatagaggttgccaacctcgacggcgcacatcgtaaggtgttattgtggcaaaacctagaaaaacccagggccattgctcttcatcctatggagggcaccatctattggacagactggggaaatactcctaggatcgaggcgtccagtatggatggatcaggaaggagaatcatcgctgacacccatttattttggcctaacgggctcactatagattacgccggacgccgtatgtattgggttgatgccaagcatcatgttattgagagagccaacttggacgggtcacatcgtaaggcagtgatcagtcagggtctcccccatccatttgccatcacagtgtttgaggattctctgtactggacagattggcataccaaaagcataaatagcgccaataagtttaccgggaagaatcaggagattatcaggaacaaactgcacttccctatggatatacatacacttcacccccagcggcagcctgccggaaagaatcgctgcggggacaacaacgggggatgcactcacctgtgtctgccatcagggcagaactacacctgcgcgtgtcctacagggtttagaaaaattagctcccatgcgtgcgcacagagtttggataaattcctactttttgctcggcgtatggatatccgaaggatctccttcgacaccgaagacttgtccgacgacgttatacccttggcagacgtccgttccgccgtggctctggactgggacagccgtgacgaccacgtatattggactgatgtgagtacagacaccatttcaagggccaaatgggacggtacaggccaagaagttgtggtggacactagtctcgagagtcccgcaggactggcgatcgattgggtcaccaacaagctttactggacggacgccggtaccgataggattgaggtagcaaacaccgatgggtctatgaggacggtgttaatctgggaaaacctggacagacccagagacatcgtcgtggaacccatgggcggttatatgtattggactgattggggcgcttcccccaagatcgagcgggctggtatggacgcatctggaaggcaggtgatcatatcttcgaacctgacttggccgaacggtctggccatcgactacgggtcccagcgtttgtactgggccgacgccggaatgaagaccatcgaattcgccggactcgacggctccaaacggaaagtcctgatcggcagccagcttccccaccccttcgggttaacactctatggagaaaggatctattggacagattggcagacgaagagtattcagtccgcagacagactgacaggcctggacagggagactctgcaagaaaatctcgagaacctcatggacattcatgtcttccacagacgaaggccccctgtttcaacaccctgcgcaatggaaaacggcggttgctctcatctgtgtctgcggagcccaaacccctccggattctcatgcacctgccctaccgggatcaacctcctgagtgacggaaaaacttgctcccccggtatgaattccttcttgatttttgcgagacgtatagatatccggatggtgtcattagatattccgtattttgctgacgtggtggtgcccatcaatatcacaatgaagaacactatcgcaatcggggtggacccacaagagggtaaggtgtactggagcgacagtacactgcataggatcagtcgggcaaacctcgacggtagtcagcacgaggatataattaccacaggcttacaaaccacggatgggcttgccgtggatgcaattggcagaaaagtgtattggactgacaccggtaccaacagaatagaagtcggaaatttagacggcagtatgcggaaggttctggtgtggcagaacctggattcgcccagggctatcgtgctataccatgagatggggtttatgtattggactgactggggagagaacgccaagctcgaaagatccgggatggatggatctgaccgcgcagttcttatcaacaacaatctgggctggcccaatggcttgacggtggacaaagctagtagccagctgctgtgggcagacgcgcacacagagcggattgaagcagctgatctgaatggagccaatcgccataccttagtatctccggtgcaacatccctacggactaacgcttctggattcctacatttactggactgactggcagactcgctcaatccaccgggctgacaaaggcaccggaagtaacgtcattcttgttcgttcaaacctgccaggcctgatggacatgcaggcagtagacagagctcagcctctcggattcaacaagtgtggaagtcgtaatggcggatgtagtcacctctgcttgccgaggccatcggggttttcttgtgcctgccccaccggaatccagctaaagggagacggcaaaacatgtgatccttcccctgagacatatctcctcttttctagcaggggctcaatcagaagaatctccctggacacctctgaccacaccgacgtgcatgtgcccgtgccggaactgaacaatgtgatctcgctggattacgattccgtggatgggaaagtgtattacacagatgtattcctggatgtcatcaggcgggctgacctgaacggaagcaatatggagacagtgatcgggagaggactgaaaacgaccgacggattagcagtggactgggtggcgcgaaatctgtactggaccgacactgggaggaataccattgaagcaagcaggcttgatggctcatgtaggaaggtgctcattaacaactccttagacgagccacgggcaatcgccgtgtttccacgcaaaggctacctcttttggactgattgggggcatattgccaaaatagaacgcgcaaatctggatggaagcgaaaggaaggttctgatcaacaccgatctgggatggccgaacggactcaccttggactacgatacacggaggatatactgggtggacgcgcacctggatagaatagaatctgctgacctgaacggaaagctcaggcaggttctcgtgagccacgtgtcccaccccttcgctctcacacagcaagatcgatggatctactggacggactggcagactaaaagcatacagcgggtcgataaatattccggcagaaacaaagagaccgtcctcgccaacgtggaaggactcatggatattatagtcgttagtccccagcggcaaaccggtacaaacgcatgtggcgtgaataacggcggatgcactcatctttgcttcgccagggctagcgactttgtatgcgcatgtcccgatgagcctgatagcaggccttgtagcttggtgccaggcctggtgcctccggctcctcgggcaacaggaatgtccgagaagagtcctgtgctccccaatacccccccaaccaccctgtattcgtcaactactcgcactagaacctctttggaggaggttgaggggcgatgtagcgagcgggacgccagactgggcctttgcgcgaggagcaatgacgcggtccccgcagctccgggtgaaggcctgcacatctcatatgctatcgggggtctcctgagcattctcctgattctggttgtgatagcggctcttatgctctataggcacaaaaagtcaaaatttacggacccaggcatgggaaacctgacctactctaatcctagctacaggacatctacacaagaggtgaaaattgaggccattccaaagcccgctatgtataaccaactgtgttataagaaggaaggtgggcctgaccacaactacactaaggaaaaaattaagatcgtcgaaggcatctgcctgctgagtggggatgatgccgaatgggatgaccttaagcagctccggtcaagtagagggggactcctgagagatcatgtttgtatgaagacagacacagtctcaattcaggcctcctcaggttctctcgacgatacagagaccgaacaactcttacaagaagaacaaagcgagtgtagcagcgtgcacactgccgcaacacctgagcggcgaggcagcctgcccgacaccggttggaaacatgaacgtaaactcagctcggagagtcaggtgta

SEQ ID NO: 228913 - DNA, 4848 bp, Artificial Sequence
  Description of Artificial Sequence: Synthetic coding sequence
atggaggcagctcccccaggtcctccctggcctctgttacttctcctgctgttgctccttgcgctgtgcggatgtcccgctcctgcagcagctagccccctccttcttttcgcaaataggagagatgtgaggttggtggacgcaggtggcgtcaaattagagagcaccattgtggttagcggactggaggatgccgctgccgtggactttcagttttcgaagggcgcagtttactggaccgacgtctccgaagaagccatcaagcagacctatctcaatcagaccggcgctgccgttcagaacgtcgtgatctccggtctggtgtcccccgacggattagcttgcgactgggtcggaaagaagctctactggactgactcagagaccaaccgcatagaagtagcaaacctgaacggcacatctcggaaggtgttgttctggcaggatcttgaccagcccagagccattgctctggaccctgcccatggctacatgtattggactgactggggagagactcctagaattgagagagctggaatggacgggtcaactaggaaaatcatcgtggactcagacatctattggcctaacgggcttaccatcgatctagaagaacagaaactgtattgggcggatgccaagttgtcctttatacacagagcaaaccttgatggatcgttccgccagaaggtggtggagggctcccttacccatccctttgccttgaccctgagcggggacactctgtattggacagactggcagaccaggagcattcacgcctgtaacaagaggacaggcggaaaacggaaggaaatcttgagtgctctctactctcctatggacatacaggttcttagccaagagcgtcagcctttttttcacacacgttgtgaggaggacaatggtggatgcagtcacctctgtctgctatcaccgtccgagccattctacacctgtgcttgccccaccggggtccagttgcaggacaacggacgcacctgcaaggcaggcgcagaagaagttctcctgctagctagacggacggatctgcgtagaatttctctggacacaccagactttaccgatattgttctgcaggtggatgatattcgacacgccattgccattgactacgaccccctcgagggctacgtctactggaccgacgacgaggtcagggctatccgccgtgcctatcttgatggctcgggggctcaaactctggtcaatactgaaatcaacgaccctgacgggatagccgtcgattgggtagcccgaaacctctattggactgatacaggtactgataggattgaggtgacaaggctgaatggcacttcacgcaaaattttggtctcagaagatcttgatgagcccagagcgattgctctgcatcctgtcatggggctgatgtattggacagactggggagaaaaccccaaaatagagtgtgccaacttagacgggcaggagaggcgagtgctggtcaatgcctctttgggatggcctaatgggctcgccctcgatctgcaggaaggcaagttgtactggggcgatgccaaaacagataagatcgaagtgatcaacgtggatggcacaaaacgcaggaccctcttggaggataagctgcctcacatcttcgggttcaccctgctcggtgatttcatctattggaccgattggcagagaaggtccatagagcgggtgcacaaagtgaaggcctctcgggatgtgatcattgatcagctccccgaccttatgggactaaaggccgtaaatgtggcaaaagtcgttggcacaaacccatgcgcagacaggaatgggggttgttctcacttatgttttttcacaccccacgcaacaagatgtggctgtcccatcggtttggagctgctttcagatatgaaaacctgcatagtccctgaagccttcctggtgttcacctccagagcggcaatacaccgaatcagtctcgaaacaaacaacaacgacgtggcaattccactgaccggagtgaaggaggcctctgccttggacttcgatgtgtccaataaccacatctattggacagacgtaagcctcaagactatatcccgtgctttcatgaatgggagttcggtggaacacgtagtagaattcggcctcgattacccagagggaatggcggtggactggatggggaagaacctctactgggccgataccggaaccaatcggatcgaggtcgcaaggctggacggccagttcagacaggttctggtgtggagagatctggacaacccgagatcccttgcacttgatcccaccaaaggttatatctactggacagaatgggggggtaagccacgtatcgtaagggcgtttatggatggaacaaactgtatgaccctggtcgacaaagttggtcgcgcaaacgatcttactatagactacgcagaccaacgtctgtactggacggatctggacaccaacatgatcgagtcatccaacatgctcggccaggagagggtagtcatcgctgacgacctgccacatcccttcggactgacgcagtacagtgattacatctactggacagattggaatctccattctatcgagcgagcagataaaacttccgggagaaatagaacactgattcagggacacctggacttcgtaatggacatattggttttccacagcagcagacaggacggtttaaacgactgtatgcacaacaatgggcagtgcggtcagctttgcttggcaatcccaggtgggcataggtgtggttgcgcctcccactacacgctcgatcccagtagcaggaactgtagccccccaacaaccttcctgctattttcccaaaaatctgccattagccgaatgatccctgatgatcagcacagccctgacctcattctaccgctgcacggactgagaaatgtgaaggcgatcgattacgatcccctggacaagttcatttattgggtagacggacggcaaaacattaagcgagcgaaagatgatggcacccagccttttgtcctgaccagcctatctcaagggcagaatcccgacagacagccccatgatctcagcatagacatctacagtcgaactttgttttggacctgtgaggccactaacacaatcaacgtgcaccgccttagtggggaagctatgggtgtagtgctgaggggggaccgcgataaaccacgggctatagtcgtgaatgccgaaagaggatacctatacttcaccaacatgcaagaccgcgcagctaaaatcgaacgggctgctttagacggcacagaacgcgaggtactgttcaccacaggactcattaggcccgtggctctcgtggtagataacaccctgggcaaacttttttgggtagacgccgacttgaaacgcatagagtcttgcgacctgtctggtgctaaccgtttgactctcgaggatgcaaacatcgtccagcccttaggactgaccatactgggcaagcatttatactggatcgataggcagcagcagatgatcgagagggtggagaaaactaccggggacaaacggactaggattcagggaagagtggcgcatctcacggggatccacgctgtggaagaggtgtcactggaggagttttccgcacacccttgtgcacgggacaatgggggatgctcgcatatttgtattgctaaaggagatggcacaccgaggtgctcttgtccagtgcatctggttctgcttcagaatcttctaacttgcggcgaaccacccacctgttctcccgatcagttcgcctgtgcaactggcgagatcgattgtatcccaggtgcctggcggtgcgacgggttccctgaatgcgatgaccagtcagacgaggaaggatgccctgtttgcagcgccgcacagttcccgtgcgccaggggacaatgcgtagatctcagactacgctgtgacggggaggctgattgccaagatcgctctgacgaagccgattgcgacgccatttgcctgccaaaccagttccgatgtgcctctggccaatgtgtactaatcaaacaacagtgcgatagctttcctgactgcattgatggtagcgacgagctgatgtgcgagataaccaagccaccatccgacgattccccggctcacagttctgcaatcggcccagttatcggtatcattctgtcgctgttcgtaatgggcggagtctactttgtttgtcagcgagtggtgtgccaaaggtacgcaggcgctaacggacctttccctcatgaatatgtgagtggaacgccacatgtgcctcttaacttcattgccccaggcggaagccagcacgggccattcaccgggatagcttgcgggaaatccatgatgtcctccgtctcgctaatgggtggtagggggggagtccccctttacgatcgcaatcacgtgactggagcctcctcgagctcatcatcatccacgaaggctactctgtaccccccaatcttgaatccaccgccttctccggcaactgatccttctctgtacaacatggacatgttttacagctccaacataccagccaccgcccgaccctatagaccctatatcatccggggaatggcgcctcccacaacgccatgttccacagatgtgtgcgactcggattattcggcctcccgctggaaggcttccaagtattacttggacctgaattcagattcagatccttaccccccacccccaacgccccactctcaatatctttccgccgaggatagttgtcctcccagcccagccacagagaggtcatatttccaccttttccctcctcctccaagtccatgtactgattcatcatag

SEQ ID NO: 228914 - DNA, 4841 bp, Artificial Sequence
  Description of Artificial Sequence: Synthetic coding sequence
atgggagcggtgctgcggtcactgcttgcctgttcgttctgtgtgctcctgcgtgccgctcccctgctgttatacgcgaatcggcgagacttgcgtctcgtagatgccaccaacggaaaggaaaatgccacaatcgttgtgggtggcctggaagacgccgcagccgtggactttgtcttctcccacggcctcatctattggagtgatgtgtcagaggaggccattaagcgtacagagtttaataagaccgaatctgttcagaatgtggtggtgtccggactgttgagccctgatggattggcatgtgactggttaggcgaaaagctttattggaccgattcagagacgaatcggatagaagtgtccaacctggatggctccttgcggaaagtccttttctggcaggagctcgatcaaccacgagcaatcgctttagatcctagcagtggtttcatgtattggactgactggggcgaagtgccaaagatcgagagggctggtatggacggatctagtcggtttattatcatcaattcagagatctattggccaaatggacttacccttgattacgaagaacagaaactgtattgggccgatgcaaaactcaatttcattcacaagagtaacctggatggaactaaccgtcaggccgtcgttaaggggtcacttcctcacccatttgcgttaaccctgtttgaagacatactttattggaccgactggtccacccactctattctagcatgtaacaagtacaccggcgaaggcctgagagaaatccacagcgatatcttctcaccaatggatattcatgccttctctcagcagcgtcagccaaatgcaacaaacccttgcggaatcgacaatgggggttgttcccacctatgcctgatgtctccagtgaaacccttctaccagtgtgcttgcccaacgggagttaaactgttagagaacggaaagacatgtaaggacggcgcaaccgagctgctcctgctcgccaggagaactgacctgcgccgaatctccctggacactcctgactttaccgatatcgtgctgcagttagaagacatccgccacgcgattgctattgattacgacccggtggagggatacatttattggaccgacgatgaggtgagagcaattcggaggagcttcatagacggatcgggctctcaattcgtggtaaccgcccagattgcccatcccgacgggatcgcggttgactgggtggccaggaacctgtattggaccgataccggcactgataggatcgaagttacaagattgaatggcactatgagaaagatcctgatcagtgaggacttagaggagcctcgggctatcgtacttgatccgatggtggggtacatgtattggactgattggggggagatccctaagatcgaaagggcggctctcgacggttctgatagggtcgttctggtgaatacctccctggggtggcccaatgggctcgcgctcgactacgacgaaggaaaaatctactggggcgacgcaaaaaccgataaaatcgaggtcatgaataccgacggaactgggaggcgggttttggtcgaggacaaaatacctcatatattcgggtttaccctgctgggagactacgtgtactggaccgactggcagaggcggtccattgagcgagtgcataaaagatcagcggaacgcgaggtcataatagaccaactaccggatctcatgggcttgaaagctactaacgtccatcgcgtgatcggtagcaacccctgtgccgaggaaaacgggggatgttctcacctgtgtctgtacaggcctcagggactgaggtgcgcatgtccaatcggatttgaactcataagtgacatgaaaacatgcatcgtgccagaagcctttttactgtttagccgacgggctgacataagaagaatcagtctcgagacaaacaataacaacgtggctataccgttgacaggagtcaaggaggcctccgctctggatttcgacgttaccgacaacagaatttactggacagacattagcctgaaaactattagcagagcttttatgaacggaagtgccttagagcatgtagttgaatttggcctcgactaccccgagggcatggcggtggactggttgggcaagaacttgtactgggcggatacaggcacgaaccggatagaagtcagtaagctggatggacagcacaggcaagtcctcgtctggaaagaccttgactccccgagggctcttgccctagaccccgcagaaggattcatgtactggacagaatggggcggaaaaccgaagatcgatcgggcagctatggatggcagtgaaagaactaccctggtgcccaacgtcgggagggctaatggcctgacaatagattatgcaaagaggaggctgtattggactgacttagacactaatctcatagaaagctccaatatgctggggttgaatcgggaagttatcgcggacgacctgccacatccatttggactgacgcaatatcaggactacatctattggactgactggtcgcgcagaagtatagagcgggcaaacaagactagtggacagaacaggaccattatccagggtcatctggattatgtgatggacattctggtcttccactcttctcgtcaaagtggatggaatgagtgcgcctcctccaatggacactgttcccatttgtgcctggccgtgcccgtgggaggtttcgtctgcggctgccccgctcactactcactaaatgctgacaacagaacatgtagtgctcctacaacctttttgctgttcagccagaagtccgccattaatcgtatggtgatagatgagcagcagtcgcctgacataattctgcccatccattccctccgcaatgtgcgcgctatcgactacgaccccctggataagcagctctactggattgactcaagacaaaatatgatccggaaagctcaggaggatggaagtcagggtttcacagtggtggtctccagtgtacccagccagaatcttgaaatacaaccctacgacctgtccatcgacatctatagccgctacatttattggacatgcgaagctacaaacgtaataaatgtcacccgattagacggtaggagcgtcggcgtagttctcaaaggcgagcaggatcgtcccagggcagtggtagtcaaccctgaaaaagggtatatgtatttcaccaatctgcaggagcgttcgccgaagattgaaagggccgcactagatggcacagagcgggaagtgctgttttttagtggcctgagtaagccaattgcactggcgttggactctagactcggtaagctgttctgggctgattcagacctgcgacgcattgaatcctctgacctgagcggtgccaaccgcattgtgctggaagattccaacattcttcaacctgtgggactgaccgtatttgaaaactggttgtactggatcgacaagcagcagcaaatgattgaaaagattgatatgaccggcagagaggggcgaaccaaggtccaggcacgaatcgctcagctgtccgacatacacgctgttaaggagcttaacctccaggaataccgacaacacccctgtgctcaggataatggaggatgctcccacatctgccttgtaaaaggggatggaaccacaaggtgcagctgcccgatgcacctggtcctgcttcaggacgagttgtcctgtggagagccacccacatgctcacctcagcagttcacttgctttactggcgaaatcgattgtatccctgtggcatggcggtgtgacggttttactgaatgtgaagatcacagcgacgaattaaattgccccgtgtgtagcgagtctcagtttcagtgcgctagcggccagtgtattgatggtgccctgcgttgtaacggcgatgcaaattgtcaggacaaatctgacgagaagaactgcgaagtgctgtgtctgatcgatcagtttcgatgtgccaatggacaatgcatcggcaagcacaagaagtgcgatcataacgttgattgctcggataaaagcgatgaactcgactgctatcctactgaagagcctgcccctcaggccactaacacagtgggatccgtcatcggtgttattgttacgatcttcgtcagtgggacggtgtactttatttgccagaggatgttgtgtccacgaatgaagggggacggcgagactatgacaaacgactacgtcgtacacggcccagcatctgtgcctttgggctatgtgcctcatccctcctccctgtctggctcactgcccggaatgtcccgaggaaagtccatgataagcagcctcagtatcatggggggaagtagtggacccccatatgatagggcccatgttacaggcgcaagtagctcttccagctcctctaccaaaggcacttatttcccagccattctgaatccccctccaagcccagctactgagaggtcccactacaccatggagttcggttactccagcaatagtccatctacacatcgcagctactcctataggccatacagctatcgccactttgctccccctacaacgccctgtagcacggatgtatgcgattctgattatgctccgtcacggcgtatgacttcagtggcaaccgcaaaaggctacacatctgatctgaactacgactccgagcctgttcctcctcctccgacacctaggagccagtatctgagtgccgaagagaattacgaaagctgcccaccaagcccatacaccgagaggtcatacagtcaccacttgtaccccccacctccctctccatgcacggatagtagtta

SEQ ID NO: 228915 - DNA, 4437 bp, Artificial Sequence
  Description of Artificial Sequence: Synthetic coding sequence
taattggaccagccaagggcaatcgcgctggatccgtcatccggctttatgtactggacggactggggagaggtccctaagattgaacgcgctggcatggacgggtcttctaggtttattatcatcaacagtgagatctactggcccaacgggctgacgctggactacgaggagcagaagctgtactgggccgatgctaaattaaattttatacataagagtaacctggatggaacaaaccgccaagctgtggtgaaaggcagtctcccccatccctttgccttaaccttattcgaggatatcctttactggaccgattggtctacccatagtattctggcctgtaacaagtacactggggagggcttgcgggaaatacactctgacatcttcagccccatggacatccacgcattttcacagcagcgtcagcccaacgccacaaacccctgtggaatcgacaatgggggttgtagtcacctgtgcctcatgtcaccggtgaaacctttctatcaatgcgcctgtcccacaggcgtgaagttgctggaaaacggaaagacgtgcaaggatggagccacggaactgcttcttttggccagaagaactgatctgaggcgaataagtttggatacccctgatttcactgacattgtgttacagctggaggacatcagacacgcaatagctatcgattacgatcccgtcgagggctatatatattggacggatgatgaagtcagggccataagacgatctttcattgatggtagtggaagtcaatttgtggtcaccgcccaaatcgcccacccggacggaatcgccgtggattgggtggcgagaaacctgtattggactgatacaggaaccgataggatagaggtcactcggctaaacgggaccatgcggaaaattctaatcagcgaggaccttgaggaaccccgtgccatcgtgctggaccctatggtgggatatatgtactggactgattggggagagattcccaagatagagcgagctgctcttgatgggtctgatagagttgtactcgtcaatacaagtctcggctggcctaacggtctcgcactcgactatgatgagggcaaaatctactggggggacgcaaaaacggataagatcgaggtcatgaacactgatggcacgggtaggagggtgctggtagaagataaaatcccacacatctttgggtttacccttttgggtgattatgtctattggactgactggcagaggaggagcatcgagcgagtgcataagagatctgcagagcgcgaagtgatcattgatcaacttcctgatttaatgggactgaaggctacgaatgtacatcgcgtgatcggctccaacccttgcgctgaagagaacggcggatgtagccacctgtgcctttatagaccacaaggcttaaggtgcgcatgtcccatcgggttcgagctgatctctgatatgaagacatgcatagtaccagaggcttttctcctattctcacgacgggcagatatccgtcgcatatctctagaaactaacaacaataacgttgccatccccctgacaggggttaaggaagcaagcgctttggatttcgatgtgacagacaaccgtatatactggactgatattagtcttaaaacaatttctagagccttcatgaacgggtctgccctcgaacatgttgtcgagttcggcctggactacccagaaggcatggcggtggattggctgggaaagaatctctattgggccgataccggaactaataggattgaggtgagtaaactcgacgggcagcatagacaggtgctagtttggaaagatttggacagcccacgggcattggctcttgatcctgccgagggctttatgtactggaccgaatggggaggcaaacccaagatcgaccgagccgcaatggatggctccgaaaggacgacactggtgcccaacgtggggcgtgccaacggattgacaatcgactatgccaagcgtcgtctgtactggacagacctggacacaaacctcatcgagtcctccaatatgttggggctgaaccgagaagtgatcgccgacgatctgccgcatccatttgggttgacacagtaccaggattatatctattggactgattggtcccgcagaagcatcgaacgagcaaacaagacctccgggcagaatcggaccattatccaaggccaccttgattatgtgatggatatcttggtctttcactcctccagacagagtggctggaatgagtgtgcctcaagcaacggtcactgcagtcatctgtgcctggctgtgcctgttgggggattcgtgtgcggatgtcctgcacactacagtctgaatgccgataacagaacctgcagtgctccaaccaccttccttctgttcagccaaaagtctgccattaatcgaatggtaattgacgaacagcagtcgccagacattattctccccatacacagtctgaggaatgtgagagccattgattacgaccccctggacaagcagctgtactggatcgacagtagacagaacatgattcggaaggcgcaggaggatgggtctcagggatttacggtggtcgtctcttccgtgcccagccaaaaccttgagattcagccctatgatctgtctattgacatctattcacgctatatctactggacctgcgaagccacaaatgttattaatgttacccgtctggatggaagaagcgtgggggtagttttaaagggtgagcaggacagaccacgggctgtggtggtaaaccctgagaagggctatatgtactttaccaatttgcaggagcgaagcccaaagatcgagagagccgcactcgacggaacagagagagaagtgttattcttctccgggctgtctaagcctatcgcgttagccctggattccagactcgggaagctgttttgggccgactccgacctgcgacgcatcgaatcaagtgacctgtccggggctaaccgtatcgtccttgaagactccaacatcctacagcccgtgggactgacagtgtttgaaaattggttgtactggatcgacaagcagcaacagatgattgagaaaatagacatgacagggcgagaaggcaggacaaaagtgcaagcaagaatcgcccaactgtcagacattcatgccgtgaaggagttgaaccttcaggagtaccgacaacatccttgcgctcaggacaatgggggatgttctcacatctgtctggtcaagggcgatggcactactcgctgttcttgtcccatgcatctggtgctgttgcaggacgaactgagctgtggagaacccccaacttgcagccctcagcagtttacatgttttacgggggagattgactgcatccccgtggcttggcggtgtgacggattcacggaatgtgaagatcattccgacgagctgaactgtccagtttgctccgagtcacaattccagtgcgcgtccggacaatgcattgatggcgcactgcgttgcaatggtgatgcaaattgtcaggataaatctgacgagaaaaattgtgaggtactgtgcctgattgaccagttccgctgtgccaatggccagtgtataggtaaacataagaaatgcgaccacaatgttgactgtagcgacaagtccgatgagctggactgttacccaacagaggagccggctcctcaggccacaaacacagttggctccgtcatcggcgtcatcgtcactatcttcgtttccggaacggtctatttcatatgccaacgaatgctgtgccccaggatgaagggagacggtgaaacaatgactaatgactacgtggtccacgggcctgcttcagtgcccctcgggtacgtcccacatccaagctccctgagtggctcgctgcctggaatgagccgtggcaagtctatgatctctagcctatcaattatggggggaagtagtggaccaccctatgaccgggcacatgttacgggggcatcatcctcctcatcctctagtactaagggtacatacttccccgcaattctcaacccacctccctctcctgccactgagagatcccactacactatggagttcggctatagcagtaatagccctagcacgcacaggagttacagctaccgcccttatagctaccgccactttgccccaccaaccacgccgtgcagcaccgacgtctgcgacagcgactacgccccaagcaggagaatgacgagcgtcgccaccgcaaagggttatacatctgatctgaattacgactcagaaccggttccaccacctccaaccccaaggtcacaatacctcagcgccgaagagaactacgagtcttgcccaccaagtccatatacagaaaggtcttactcccatcacctgtaccctccgcctccgagtccctgcaccgactcatcctag

SEQ ID NO: 228916 - DNA, 2382 bp, Artificial Sequence
  Description of Artificial Sequence: Synthetic coding sequence
atgggcctgccagaacccggtcccctgcgcttgctggccctgttgctactactgttgctgctgctgctcctgcagctccagcatctcgccgcagccgctgctgatcccttactcggcggacaaggtcccgcaaaagactgtgagaaggaccagtttcagtgtcggaatgaacgttgtattcccagtgtttggcggtgcgatgaggatgacgattgtttggaccattcagacgaagatgactgtccgaagaagacttgtgcagacagtgactttacctgcgataatggccactgtatacacgaacgatggaaatgcgatggtgaggaggaatgtcccgacggctcggatgagtcggaagcgacctgcaccaagcaggtgtgtcccgctgagaaactgtcttgtggccctacatctcacaagtgtgtgccagcaagttggagatgtgatggagagaaagactgcgagggcggagccgatgaggccggatgtgcaacatggctgaacgagtgcctgcataataacgggggttgttcccacatatgcaccgatttaaagatagggtttgagtgcacatgcccggctgggttccagcttcttgaccagaagacttgcggagacattgacgagtgtaaagatccagacgcatgcagccaaatctgcgtgaattacaagggctacttcaaatgcgaatgttaccccggatacgagatggacctgcttacgaagaattgtaaggcggcagctggcaaaagtccttcgttgattttcacaaatcgccatgaggtgaggaggatcgatcttgttaaacgtaattactcccgcctcattcctatgctgaagaatgtagtggccctagatgtcgaggtggcaacaaaccgcatctattggtgtgacctctcctacaggaaaatctacagtgcctatatggacaaggcgagcgatccaaaagagcaggaagtgcttattgatgaacagctccactccccggaaggcctggccgtcgattgggtgcacaagcatatttattggacagattcagggaataaaaccatatccgttgcaactgttgatgggggacggcgaagaaccttattcagccggaatttgtctgagcccagagcgatcgccgtggaccctttacggggtttcatgtattggagtgactggggagaccaggcaaagatcgagaagtcaggtctgaacggtgtggaccggcagaccctggtatctgataacattgagtggcctaatggtatcactctcgacctcttgagtcagcgactgtattgggtcgactcgaaattacaccaactgtcgtccattgatttttcgggcggtaaccgaaagacactaatctcttcaaccgatttcctgtctcatccattcggaatcgcagtgttcgaggataaggtgttctggacagatttggagaacgaagctatattttccgctaacaggctcaacggtctagaaatttcgatactggccgaaaacctaaataatcctcatgatattgtgatatttcacgaactgaaacagcctcgggctcccgacgcgtgtgagctcagtgtacagccaaacggaggctgcgagtatctttgtcttcctgctccacagatttcttcacacagtccaaaatacacttgtgcgtgcccagataccatgtggctaggaccagacatgaaaaggtgctatcgtgcccctcagtccacgtccacaaccacacttgcctccacaatgacacgcacagtgcctgccactacgcgagcacccggaacaaccgtgcaccgcagtacttatcagaatcatagcactgaaacaccatctctgacagcagcagttccttcctcagtgtctgtccccagggccccttccatttcaccttccacactttcaccagccactagtaatcattctcagcattacgccaacgaggatagcaaaatgggcagtacggttaccgctgccgtcatcggcatcatagtcccaatagtggtgatagcactgttgtgcatgtcaggctaccttatttggaggaattggaaacgcaaaaacacaaagagtatgaattttgataatcctgtctacagaaagactacagaggaggaagatgaagacgagctccacataggacgaaccgcccagattggccacgtctaccctgccgctatttcgtctttcgacagaccactgtgggcagagccatgtctcggagagactcgtgagccggaagaccctgcacccgctctgaaggaactgtttgtgctgccaggtgaaccacggagccagctgcaccaattgcccaagaaccctctcagtgagttacctgtggtcaaatccaaacgggtggcactgagcctggaggatgatggcctcccgtag

SEQ ID NO: 228917 - DNA, 2892 bp, Artificial Sequence
  Description of Artificial Sequence: Synthetic coding sequence
atgggccttcccgaacccggacctttacggttgcttgctttactgttgttactgctgctgcttctgctgttacagttacagcatctggcagccgctgccgctgaccccttattaggcggacagggcccagcaaaagactgtgagaaagaccagtttcagtgccgaaatgaaaggtgtattcccagtgtatggcgctgtgatgaagatgatgattgcctcgaccacagcgatgaggatgattgcccgaaaaaaacctgcgctgactcagattttacctgcgacaacgggcattgcattcatgagagatggaagtgtgacggagaggaagagtgccccgacggaagtgacgaaagcgaggctacctgtacaaaacaagtgtgcccagctgagaagctgtcctgcggtcccacgtcccacaagtgcgtcccagcctcgtggcggtgcgatggcgagaaagattgcgaggggggtgctgatgaagccggttgcgccactctgtgcgccccacatgaatttcagtgcggaaaccgatcttgtctcgcagcggtcttcgtctgcgacggggatgatgactgcggcgacggctcggatgagcgaggctgtgccgatcccgcatgtggcccacgagagttccgctgcggaggcgatggcggaggcgcatgtattcccgagcggtgggtgtgcgaccggcaatttgactgtgaagatcgctcagatgaagctgcggaactatgtggacgccctggcccaggtgctacctcggctcctgcagcttgcgctactgccagccaattcgcctgtcggtctggcgagtgtgttcatctggggtggaggtgcgatggagatcgtgactgtaaggataagagcgacgaggcagattgtccactcggaacctgtaggggcgatgagttccagtgtggcgacggaacctgcgtcctggctattaaacattgcaatcaagaacaagactgccccgacgggagcgatgaagcagggtgccttcagggcctgaatgagtgcttgcacaacaatggagggtgctctcacatttgtaccgacctcaagattggcttcgaatgcacctgccccgcaggattccaactactggatcaaaagacctgtggggacatcgatgaatgcaaagaccctgacgcttgttctcagatatgcgtgaattacaaaggctatttcaagtgtgagtgctacccgggatatgagatggatcttttgaccaagaattgtaaagctgccgcagggaagtctccgagcctgattttcactaacagacatgaagtccgaaggatcgacttggttaagcgaaattactctcgtctgatcccgatgcttaaaaacgtggtggcactggatgtggaggtggccacgaatagaatctactggtgtgatctgagctatagaaaaatctattcagcttatatggacaaagccagtgacccaaaagaacaggaggtgctgattgacgaacaactgcactcccctgagggtttggccgtggactgggtgcataagcacatctactggacggactcagggaataagactatctcggtggcaactgtggatggtgggcgacgtcgtacacttttctctcgaaacctcagcgaacctagagcgattgctgttgatcctctccgtggctttatgtactggtcagactggggagaccaggcaaagatcgaaaagagcggcctgaatggcgtcgatcggcagacattggtctcggataacatagagtggcctaatgggattactttggacctcctgtcccagcgcctgtactgggtggattcaaagctgcatcaactgtcctccatcgattttagcgggggaaatagaaagacgctgatctcatctaccgatttcttgtcccatccatttggaattgccgtgttcgaggacaaggttttctggaccgacctcgagaatgaggctatcttctccgccaataggttgaatggacttgagatatccatcctggcagagaacctcaataacccccacgacatagtgatctttcacgaattgaagcagcccagggcgcctgatgcatgcgagctgtcagtgcaacccaacggaggatgtgagtacttatgcctgcctgccccacagatcagtagccactcacccaagtacacttgtgcttgtcctgatacaatgtggctcggccctgatatgaagcggtgctatcgagcacctcagtccacaagcactaccacgttggcttccacgatgaccagaactgtccccgcaactacacgtgccccaggaaccaccgtccatcgtagtacgtaccaaaatcactctacggaaacaccttcactgacagccgcagtgccatcgagtgtgtcagtgccgcgtgcaccgagtatctccccttcaacattatctccagcaacctcaaatcactcacagcactatgccaatgaagactccaaaatggggtcgactgtaacggcggctgtgatcggcatcatcgtccccatcgtcgtcatcgccttgctgtgcatgagcggctacctcatctggaggaattggaaacgcaaaaataccaagtccatgaatttcgataatcctgtatacaggaagactacagaggaagaggatgaagacgaactgcatatcgggagaacagcgcagattgggcatgtctatccagctgcgatcagtagctttgacagacccctgtgggccgagccatgcctgggcgaaactcgggagccagaggatcccgctcctgcgctgaaagaacttttcgtgttgcctggcgagcccagaagccagcttcaccaactacctaagaatcctcttagtgagttgcctgtggtgaaatctaagcgtgtggccctttccctggaagacgacggattaccatag

SEQ ID NO: 228918 - DNA, 2103 bp, Artificial Sequence
  Description of Artificial Sequence: Synthetic coding sequence
atgggactgccagaacccggacctcttaggttactcgcactcctcctgttacttctgttacttctgttactgcagctgcaacacctcgccgcagcggcagcggaccctctgctcgggggacaaggccctgccaaagactgcgagaaggaccaatttcaatgcaggaatgagagatgcattccttccgtctggcgatgcgacgaggacgatgactgtctggaccattctgacgaggacgactgccctaaaaagacctgcgccgatagcgacttcacttgtgacaatggccactgcattcacgagaggtggaaatgcgacggagaggaggagtgtcccgacgggtcagacgaaagcgaggctacttgcacaaagcaggtctgcccagccgaaaaacttagctgcggtcccacaagccataagtgtgtgcctgcttcttggagatgcgatggagagaaggactgtgaaggcggagctgatgaagccggatgcgctacctctctcgggacctgtagaggggacgagttccagtgcggggatggaacgtgtgtgctagcaatcaaacactgtaatcaggaacaggactgccccgacggtagcgatgaagctggttgtctccagggcctaaacgagtgcctacataataacgggggatgcagccacatttgtacagacctgaaaataggatttgagtgcacctgcccagcaggtttccagctcctggaccaaaaaacttgcggcgatatcgatgaatgcaaagatcccgacgcatgcagccagatttgcgtcaattacaaaggatattttaagtgcgagtgctaccccggatatgagatggacttactaaccaagaactgtaaagctgccgctggcaagtctccgagcctgatcttcaccaatcgacacgaggtccgcaggatagatttggtgaagcgaaattacagccggctcattccgatgctgaagaatgtggtggctctggatgtggaagtggctactaatcgcatctattggtgcgacctgtcatatcgcaagatttattcggcctacatggacaaagcttctgaccccaaagagcaagaggttctcattgacgaacaactccacagccctgagggcctggccgtggattgggtccacaagcacatttattggaccgattctggaaataagacaatatccgtggccaccgtcgacggcggacggaggcggaccctgtttagccggaatctgagcgagccccgagcaatcgccgtggatccactacgcggtttcatgtattggagcgattggggcgaccaggctaagattgaaaagtctggcctcaacggtgtcgacagacagactctggtctcagacaacatagagtggccaaacggcatcactctggacttactgtcccagaggctgtactgggtggactctaagctccaccagctgtctagcatcgacttctcagggggaaatcgcaagacactgatcagttccacagattttctgtcgcaccccttcgggatcgccgtttttgaggacaaagtgttttggacagacctggagaacgaggccatcttttcagctaatagactgaacgggcttgagatttccatcttggctgaaaatctcaacaacccacacgatatcgtgattttccatgagctgaagcagcccagggcacccgacgcttgcgaactcagcgttcagccaaacggtgggtgcgagtatttgtgtctccccgctcctcaaatctcctctcatagccctaagtacacttgtgcctgccctgacaccatgtggttaggcccagacatgaagagatgttaccgggacgcaaacgaggactctaagatgggatccaccgtcaccgcagccgtgatcggcattatcgttcccatcgtggttatcgccctcctctgcatgtccgggtacttaatttggcgtaattggaaaaggaaaaacacaaagagtatgaatttcgataacccagtgtaccgcaagaccaccgaagaagaggacgaggatgagctgcatattggcaggacggcacagattgggcacgtgtatccagccagagtggctctctcccttgaggacgatggtctgccctag

SEQ ID NO: 228919 - DNA, 2715 bp, Artificial Sequence
  Description of Artificial Sequence: Synthetic coding sequence
atgggtctgcccgagcccggaccactcagactcctcgctctgctgctgctgctattgctactactattgttacagttgcagcacctggctgcagcggctgctgatcccctccttgggggacagggccctgcaaaggactgcgagaaagaccagttccagtgccgtaacgaaagatgcattccctctgtctggaggtgtgacgaagatgacgattgcctggatcactcagacgaggatgattgcccaaagaagacttgcgccgatagcgacttcacatgtgataacggacactgtattcacgagcgctggaagtgtgatggagaagaggagtgtccggatggatctgatgagtctgaggccacttgcacaaagcaagtctgtccagctgagaaactcagctgcggacctaccagccacaagtgcgttcctgcctcatggcggtgtgacggcgaaaaagactgtgaaggaggcgctgatgaggccggatgtgcaaccctttgtgctccccacgaatttcagtgcgggaaccggtcatgtttggctgccgtttttgtgtgtgatggggacgacgattgtggtgatggctctgatgagcgaggatgtgcagacccagcatgcggccctagagagttccgttgtgggggtgacgggggaggagcctgtatccctgagaggtgggtgtgcgaccgacagtttgactgtgaggaccgcagcgacgaggccgcagagctgtgtggcagaccgggtcccggagctacatccgccccagcagcatgcgccacagcttcacaattcgcatgccggagtggtgaatgcgtgcacttaggttggaggtgcgatggagatagagactgtaaggacaaaagtgatgaggctgactgtcctctgggcacttgccgcggagatgagttccagtgcggagacggcacctgcgtcctggcgatcaagcactgcaaccaggagcaggactgcccagatggctctgatgaggccggatgcctgcagggcttaaatgagtgccttcataataatggaggctgttctcacatctgcacagatctgaaaatcggcttcgagtgcacctgcccagctggattccagctcctggaccaaaagacttgcggtgatatcgacgagtgtaaggaccctgatgcgtgcagccaaatttgcgttaactacaaaggctatttcaaatgtgagtgctatccagggtatgagatggatctcctgacaaagaattgcaaagctgctgctgggaagagcccttcccttatattcaccaaccgtcacgaggtcaggcgaatcgatctagttaagcgtaattactccaggctgatcccaatgctgaagaatgtggtcgccctagacgtggaggtggccacgaacaggatttactggtgtgatttgtcctatcggaagatttactcggcctacatggacaaggctagcgaccctaaggagcaggaagtgctgatcgatgaacagctgcattcacccgaggggctcgcagtggactgggtgcataaacacatctattggacagactccggcaacaaaacaatttcagtggccaccgttgatggcggacgcagacggaccctgtttagccgcaacctgagcgagccacgtgctattgccgtggatcccctgcgcggatttatgtactggtcggattggggagaccaggcaaaaattgagaaatccggtttaaatggcgtggatcgacaaaccctggtgtccgataacatcgaatggcccaacggcatcactctcgatctgctttcacagagactgtattgggtggactccaaactccaccagctttcctccatagacttctccggaggcaatagaaaaactctgataagctctaccgatttcctatcacacccattcggaatcgccgtgtttgaggacaaggtgttctggacagacctcgaaaacgaagcgatattctcggccaatcggctcaacggccttgagatctctattctcgctgagaacctcaataatccacacgatattgttatatttcatgagctcaagcagccaagggctcctgacgcctgtgaattgtcggttcagcctaacgggggatgcgagtacctttgcctgcctgctccccaaatttcttctcactccccgaaatacacctgcgcctgtccggacaccatgtggctgggtcctgacatgaaaagatgttacagagccccacagtctacctctacaacaacactggcaagtacgatgactcggacagtgccagctacaacacgagctcccggtacgacagtgcaccggtctacatatcagaaccacagtacagagacgccttccttaaccgctgccgtcccttcttccgtgagtgtgcctagagctcctagtatcagcccttccactctgtctcctgccacatcaaaccacagtcaacattacgctaatgaggactctaagatgggatcgacggtcacagctgccgtgatcggtatcatagtgcctatagtggttattgctctgctgtgcatgagcggctacttaatctggcgtaattggaaaaggaagaataccaagtcaatgaacttcgacaaccccgtgtacaggaagacgactgaagaggaagatgaagatgaactgcacattggcagaaccgctcaaatcggccatgtctacccagccagagtcgctctgagcctggaagacgatgggctgccttag

SEQ ID NO: 228920 - DNA, 1074 bp, Artificial Sequence
  Description of Artificial Sequence: Synthetic coding sequence
atggctccccgtcgcgtgcggagttttttaagggggctgcccgctctgctcctgcttctcctttttctggggccatggcccgctgcctcccatggcggaaaatacagccgagagaaaaaccagcctaagccttcaccaaagcgagaatctggagaggagtttcgcatggagaaactcaaccagctctgggagaaggcccaacggctccaccttccgcctgtgcggctggctgaattgcacgccgatttgaagatccaggaacgagatgagttagcctggaaaaaattgaaactcgacgggttagacgaggacggggagaaagaggcccgtctgatccggaatctgaacgtgatacttgccaaatatggcctggatggcaagaaggatgctaggcaagtaacttccaattctcttagcggcacccaggaagacggcctcgatgatccaagactcgaaaagctttggcataaggctaaaacatccggcaagttttcaggagaggaactcgataagctgtggagggaatttttacatcataaggagaaggttcacgagtacaacgtgcttctggagacgctcagcaggacagaagaaatccacgagaatgtgatttccccttctgacctgagcgacattaaagggtcagtgcttcatagccgacacaccgaactcaaagagaagttacgatctattaaccagggcctcgaccggctcagaagggtatcccaccagggatatagtactgaggcagagttcgaggaacctagggtaatcgatctgtgggacctggctcaatcagccaacttaaccgacaaagaactggaagcatttcgcgaggaacttaagcattttgaagccaaaattgagaagcacaaccactatcagaagcagttggagatcgctcacgagaagcttcggcatgccgaatccgtgggagacggggagagggttagtcgtagtcgagagaaacacgctctactggagggacgcactaaggagctgggttatactgtgaagaagcacctgcaggatctgagcggaaggatatcaagagcccgtcacaatgaactctag

SEQ ID NO: 228921 - DNA, 402 bp, Artificial Sequence
  Description of Artificial Sequence: Synthetic coding sequence
atgaattacatgcccggaacagcatcattgatagaagacatcgataaaaagcacctggtgcttctgcgtgatgggagaactcttatcggctttctgcggtctatcgatcagtttgctaacttggtgcttcatcaaacagtagagcgaatccacgtcgggaagaaatatggtgacatacctaggggcatcttcgtcgtgaggggagagaatgtggtgttgctcggagaaattgacctcgagaaggagtccgatacccccctgcagcaggtgagcatcgaagagatcctggaggaacaaagggtggaacagcaaactaaacttgaagctgagaaactaaaagtacaggctctgaaggatcggggactaagcataccgagggctgatacgctggatgagtattag

SEQ ID NO: 228922 - DNA, 588 bp, Artificial Sequence
  Description of Artificial Sequence: Synthetic coding sequence
atggctgcccctccaggcgagtatttcagcgtcggcagccaggttagctgtcggacgtgtcaagagcaacgactgcagggagaagtagtggcttttgattatcagtcaaagatgttggccttgaagtgcccaagtagtagtggtaaacccaaccatgcggatatcctcttgattaatcttcaatatgtgagcgaggttgagatcatcaacgatcggaccgaaacccctcccccattggctagcctgaatgtctccaagctggcatctaaagcaaggaccgaaaaagaggagaaactttcccaagcatatgcaatctctgctggcgtttcactcgagggacagcagctttttcaaaccatacacaaaacaatcaaggattgtaagtggcaggaaaagaatatcgtggtgatggaagaggttgtcatcacaccaccctatcaagtggaaaactgcaagggaaaggagggttcagcacttagccatgttagaaagatcgtagaaaagcactttagagacgtcgaatctcagaagattcttcaacggagccaggcgcagcagccccagaaagaggctgctctgagctcttag

SEQ ID NO: 228923 - DNA, 588 bp, Artificial Sequence
  Description of Artificial Sequence: Synthetic coding sequence
atggcagcccctccaggagagtatttttcggtgggctctcaagtaagttgtcggacctgtcaagagcagcgcttgcaaggggaggtggtggccttcgactatcagtccaaaatgctggcactgaagtgtccatcctcctccggtaagcctaatcatgcagacatcctactcattaatctccagtacgtaagcgaggtcgagataattaacgatcgtacagaaacaccacctccgctggcttccctaaatgtatcgaagctcgcctctaaggcacggacagaaaaggaggagaagttgtcacaggcttacgcaatctcggcaggggtcagcttagaagggcagcagctatttcagactattcataagactatcaaggactgtaaatggcaagagaagaacattgtggtcatggaagaggtggtgattaccccaccataccaggtggagaactgcaagggaaaagaggggagcgccttatcccacgttcgcaagatagtagagaagcattttcgggatgtagagtcccaaaaaattttgcagcgctcgcaggcccagcagccacagaaagaggcagcgctctcttcatag

SEQ ID NO: 228924 - DNA, 288 bp, Artificial Sequence
  Description of Artificial Sequence: Synthetic coding sequence
atgctgttttactccttcttcaaatcactggttggtaaggacgtggtcgtagagctcaagaatgatctgtccatctgcggcacactgcacagtgtcgaccagtatctaaatatcaagttaaccgatatctcggtcaccgaccccgagaaataccctcatatgctcagcgtgaagaactgctttattcggggaagtgtggtgagatacgttcagctgcccgcagatgaggttgatactcagctgctccaggacgcagcaagaaaggaggccttacagcaaaaacagtag

SEQ ID NO: 228925 - DNA, 288 bp, Artificial Sequence
  Description of Artificial Sequence: Synthetic coding sequence
atgttattctactcattttttaagtccctggtgggaaaggacgtggtggtggaactgaaaaacgacctcagcatctgcggtaccctgcactcggtggatcaatacttgaacattaagctgactgatatctccgtgactgatcccgagaagtatccccatatgctaagtgtcaagaattgcttcatcaggggatcagtggtgcgttatgtgcagctgccagctgacgaagtggacacccagctgctacaagacgccgctcgcaaagaagctcttcaacagaagcaatag

SEQ ID NO: 228926 - DNA, 288 bp, Artificial Sequence
  Description of Artificial Sequence: Synthetic coding sequence
atgctgttctacagcttttttaaatccctcgtcggaaaagacgtcgtggtggagctgaaaaacgatttgtctatctgcggaactctgcattccgtggatcagtatttaaatatcaagctgacagatataagcgtcaccgaccccgagaaatatcctcatatgctatccgtaaagaattgttttatccgagggtcagtggtaagatacgtgcagctgccagcagatgaagtggatacccagctcctccaggacgcagccagaaaggaggcccttcagcagaaacagtag

SEQ ID NO: 228927 - DNA, 288 bp, Artificial Sequence
  Description of Artificial Sequence: Synthetic coding sequence
atgcttttctattcattttttaagtccctcgtcggcaaggacgtagttgtggagttgaaaaacgacttgagtatatgcggaactctgcactctgtggaccagtacttgaacatcaagctcacagacattagcgtaaccgacccagaaaagtatccacatatgttatctgtgaagaattgtttcatacggggtagcgtcgtcaggtatgtgcagctgcccgctgacgaagtggatacccagctattgcaagacgcagccagaaaggaagcactgcagcagaagcagtag

SEQ ID NO: 228928 - DNA, 288 bp, Artificial Sequence
  Description of Artificial Sequence: Synthetic coding sequence
atgctcttctattctttcttcaaatcacttgtgggcaaagatgttgtcgtcgagctaaaaaacgatctatccatctgcggtacattgcactccgttgaccaatatttgaacatcaaactcacagacatcagcgtcaccgaccctgaaaaatatcctcacatgttatccgtgaagaattgtttcatccgtggtagcgtggtgcggtacgttcagttacctgctgacgaggtcgatacacaactcttgcaggacgctgccagaaaggaagcattgcagcagaagcagtag

SEQ ID NO: 228929 - DNA, 288 bp, Artificial Sequence
  Description of Artificial Sequence: Synthetic coding sequence
atgttgttctattcatttttcaaatctcttgtgggcaaggacgtggtggtggaactgaaaaacgacttatccatttgtggaaccctccactctgttgatcagtatctgaacattaagctcacggatatcagcgtaaccgaccctgagaaatatccccatatgctgagcgtcaagaactgtttcattagaggttccgtggttcgctacgtacagctccccgcagacgaagtggacacgcagctgctgcaagacgcagccagaaaggaagccctgcagcagaaacagtag

SEQ ID NO: 228930 - DNA, 309 bp, Artificial Sequence
  Description of Artificial Sequence: Synthetic coding sequence
atggcagacgatgtagatcaacagcagaccaccaacactgtagaggagcccctggacttgatcagattgagcctcgacgaaaggatctacgtgaagatgagaaacgacagagagctccgcggacgcctccatgcctacgaccagcaccttaacatgatcctgggagatgtggaggagaccgtaacaacaattgagattgatgaagaaacttacgaggaaatttataagtccaccaagcgtaatatcccaatgttgttcgtgcggggtgacggcgtagtccttgtagccccaccattgcgggtgggctag

SEQ ID NO: 228931 - DNA, 420 bp, Artificial Sequence
  Description of Artificial Sequence: Synthetic coding sequence
atgctcccactgagcctactcaaaactgcacagaaccatcctatgcttgtcgagctgaagaacggagagacgtacaatgggcacctcgtcagctgtgacaattggatgaacatcaatctgcgggaggttatatgcacctcacgggacggagataagttctggaggatgcctgagtgctacatccgaggctccacaatcaagtatctgaggattccggacgagatcattgacatggtgaaggaagaagttgtagctaaaggacgtggtcggggaggtctccaacagcagaagcagcaaaagggtcggggaatggggggtgccggtcgcggagtttttggcggtcggggaagagggggtatccccggaactggcaggggccaaccagagaagaaaccgggtagacaggccggtaagcagtag

SEQ ID NO: 228932 - DNA, 420 bp, Artificial Sequence
  Description of Artificial Sequence: Synthetic coding sequence
atgctgccgctgagcctgctgaaaactgcccaaaatcaccccatgttggttgagttaaaaaatggggaaacctacaatgggcatctcgtctcgtgcgataattggatgaacattaacttaagggaagtgatctgcacctctagagatggagacaagttttggaggatgcccgaatgttacattagaggttcaaccatcaaatacctgagaatcccagatgagatcattgacatggtcaaagaagaggtggtggccaagggacgaggaaggggagggcttcaacaacaaaagcagcagaaggggcgaggcatgggcggtgcagggagaggggtctttggagggagagggcgtggcggaatccccggaactggacgtgggcagccagagaagaagccaggtcggcaagctgggaaacagtag

SEQ ID NO: 228933 - DNA, 276 bp, Artificial Sequence
  Description of Artificial Sequence: Synthetic coding sequence
atggctgccaacgcaacaaccaacccaagccagctgctacctctcgaattggtggacaaatgcatcggttctagaatccatattgtgatgaaatcggacaaagagatcgtcggtactttactcggtttcgacgatttcgttaacatggtacttgaagacgtcaccgaattcgaaatcacgccggaggggaggcggatcacaaaactggaccagatactgctgaatggaaacaatataactatgctggtccccggaggcgaaggtcctgaggtttag

SEQ ID NO: 228934 - DNA, 243 bp, Artificial Sequence
  Description of Artificial Sequence: Synthetic coding sequence
atgtcgcttcgaaagcagacccctagtgatttcctcaaacagatcatagggcgtccagttgtcgttaaactgaactcaggcgtggattataggggtgtgctagcatgcctcgacggatacatgaatattgctctggagcagactgaggaatatgtgaacggccagctaaaaaacaaatatggggatgccttcatccgcggaaataacgtgctttatataagcacacaaaaaaggaggatgtag

SEQ ID NO: 228935 - DNA, 243 bp, Artificial Sequence
  Description of Artificial Sequence: Synthetic coding sequence
atgagtctgcggaaacagacgccgtcagacttcttaaaacagattatagggcgacccgtcgtcgtcaaactcaattcaggcgtggattatcgtggcgtcctagcatgtctggacgggtacatgaacattgcactcgagcaaacggaagagtatgttaacggccagctgaagaataaatacggggacgcattcattcggggaaataacgtcctttacatttcaactcaaaaacggagaatgtag

SEQ ID NO: 228936 - DNA, 243 bp, Artificial Sequence
  Description of Artificial Sequence: Synthetic coding sequence
atgtctcttcgaaagcagaccccttctgattttctgaaacagatcataggcaggcctgtcgtggtgaaactgaattccggagtggattatcgcggagtactcgcatgcctggacggatacatgaacattgccctcgagcaaactgaggaatacgtaaatgggcaactgaaaaataaatacggggatgccttcatcagaggcaataacgtcctgtatatctcaacccagaagcgaagaatgtag

SEQ ID NO: 228937 - DNA, 243 bp, Artificial Sequence
  Description of Artificial Sequence: Synthetic coding sequence
atgagcctccggaagcagaccccaagtgattttctcaaacagataatcggacgccctgtggtggtcaaactcaatagcggagtggattacaggggggtgctggcctgtctcgatggctacatgaatatcgcactggagcaaaccgaggagtacgtcaacgggcagctgaagaacaaatacggcgatgcgtttatccggggaaataacgtgctgtatatctctactcaaaaaaggaggatgtag

SEQ ID NO: 228938 - DNA, 312 bp, Artificial Sequence
  Description of Artificial Sequence: Synthetic coding sequence
atggctgacaaggaaaagaagaagaaggaatctattctggacctgagtaaatacatagacaaaaccattcgtgttaaatttcagggagggagggaagcttccgggatcttaaagggatttgacccactactcaacttagtactggatggaacaatcgagtatatgcgagatcctgacgatcaatataaattaaccgaagatacgcgccagctggggctggtagtgtgtcgcggtacatccgtggtactgatatgtccccaggacgggatggaagccatcccaaacccgtttattcagcagcaggatgcgtag

SEQ ID NO: 228939 - DNA, 1116 bp, Artificial Sequence
  Description of Artificial Sequence: Synthetic coding sequence
atgagtgcgcaggctcagatgcgcgctcttctcgatcagctgatgggcactgcccgagatggcgacgaaactagacagagggtcaagtttacagatgatcgagtctgtaaatcacatctgttggattgttgtccccatgatatacttgccggtaccaggatggacttgggggagtgtaccaagatacatgatctggccttgcgtgcagactatgagatcgcctccaaagagagggacctgttctttgagttggacgcaatggatcaccttgaaagcttcatcgcagaatgcgatcggaggactgaactagctaagaaacgccttgccgaaactcaggaagaaatcagcgccgaagtgtctgcaaaggccgagaaggtgcacgaactaaacgaggagatcggtaagttattggccaaagctgaacaattaggcgctgagggcaatgtggacgagtctcagaagattttaatggaggtcgaaaaggtccgagccaaaaagaaagaggctgaagaggagtatagaaactccatgcccgcttcatcttttcaacagcagaagctgcgggtgtgcgaggtgtgcagtgcgtacctgggattacacgacaatgaccgccgactggccgatcacttcggaggaaaattacatttaggcttcatccaaatccgggagaagctggatcagctgcgtaaaacggttgctgaaaagcaggagaagcgaaatcaagatcgtctgcgcaggcgagaggagagagaacgtgaggagcggctgagccgcagaagcggtagtcgcactagggaccggagaagatcacgctcaagggataggcgcaggcgacggtcgcgatctacatcgcgagaacggagaaagttgtctcggagccgaagccgagatcgccatcgcagacatcgctcaagaagccggagtcattccagggggcaccgacgcgctagtcgagacaggagtgctaaatacaagtttagcagagagagagctagccgcgaagagtcatgggagtctggccgttcggagagagggcctcccgactggcggttggaaagtagcaatggtaagatggcctcccgccgatccgaagagaaagaggcgggagaaatatag

SEQ ID NO: 228940 - DNA, 978 bp, Artificial Sequence
  Description of Artificial Sequence: Synthetic coding sequence
atgtctgcacaggcccagatgcgcgcactgctggatcagctgatgggcaccgcccgagacggcgatgaaacgcggcagcgagtcaaatttactgacgatcgggtgtgtaaaagtcacttacttgattgctgcccccatgatatacttgctggaacacgcatggaccttggcgaatgcaccaaaatccacgacctggcgttgcgggcagactatgaaatcgcctctaaagagagggacttgttctttgaactggacgctatggatcatctcgagagcttcattgccgaatgcgaccgacgtaccgaattggctaagaagcgcctggccgaaacccaagaggaaatcagtgcagaagtgagcgccaaagctgagaaggtgcatgagctcaatgaagagatcggcaaattgctcgcaaaagctgagcagctgggggctgagggaaacgtggacgagtcccagaaaatattaatggaggttgaaaaggttcgggctaagaagaaggaggcggaggaagagtaccggaattcaatgccggcatccagcttccagcagcagaagctgagggtctgcgaggtctgctccgcctacctcggcctccatgacaatgataggcgattagcagatcatttcgggggaaagttgcatctcgggttcattcagatccgggagaaactggatcaactgcggaagaccgtggcagagaaacaggagaagagaaaccaggatagactccggcgtcgggaagagcgggagagagaggaaaggctgagccgccgaagcggatcgaggacgcgggatagaaggagaagcagaagcagagataggaggagacgtagatcgcggtctacgagcagagaaaggaggaagctctcaaggtcgcgttcacgcgatcgccataggcgccaccgttcaagaagtcggtctcatagtcggggacataggagagcatcgagggacaggtcagcaaagtacaaatag

SEQ ID NO: 228941 - DNA, 819 bp, Artificial Sequence
  Description of Artificial Sequence: Synthetic coding sequence
atggatttgggagagtgcaccaagatacacgacctggccctgagggccgattatgaaatagcttccaaagagagggacctgttctttgagttggacgcaatggaccatctcgagagttttatcgccgaatgcgataggagaacagagttggccaagaaacgccttgccgaaacacaggaagagatctccgcagaggtgtcagcaaaagccgaaaaggtacacgaacttaacgaggaaattggtaagcttttagcaaaggcagagcaactgggcgctgagggaaatgtggacgaaagccagaagatcctgatggaagtcgagaaggtcagggccaagaagaaggaagcagaggaggagtatcgtaattccatgcccgctagctcctttcaacaacaaaagctgcgagtgtgcgaggtctgctctgcctatcttggcttgcacgataatgatcgccgactcgccgaccactttggtggcaaattgcacttgggcttcatccagatccgcgaaaagctagatcagttacgcaaaactgtcgcggaaaaacaggaaaagcgaaaccaggacaggttgcgaaggcgggaggaacgcgaacgagaggagcgcctatcgcgcaggagcggcagcaggacccgcgaccgccgaagatctcggagcagagaccgtaggcgcaggcggtctcggtcaacctcacgggagcggagaaagttgtctagatcacggtctagagataggcatcgtagacaccggtcgcgttcaagaagccatagcaggggccatcgaagggccagccgtgacaggtccgccaaatacaaatag

SEQ ID NO: 228942 - DNA, 978 bp, Artificial Sequence
  Description of Artificial Sequence: Synthetic coding sequence
atgtccgctcaagcacagatgcgcgctctgttagatcaactaatgggcaccgctcgagacggagatgaaactcgacagcgcgtaaagtttacagatgaccgggtatgcaagtcccatctactggattgttgtcctcatgacatcttggccggtacccgtatggatctgggtgaatgtaccaaaatccacgacctggctttgagggcggattacgagattgcaagcaaagagagagacttgttttttgagctggatgccatggatcatcttgagagcttcatcgctgaatgtgataggcgcacggagttggccaaaaaaaggcttgcagagacccaggaagaaatctccgctgaggtgagcgcaaaggccgaaaaagtgcacgagctgaatgaagagataggaaagctgttggcaaaagcggagcagttaggggctgagggaaatgtggatgaaagtcaaaaaatcctgatggaagtggaaaaggtgagagccaaaaagaaagaagccgaggaagagtaccgcaactctatgcccgctagttccttccagcagcagaaactccgggtttgcgaagtctgttctgcttaccttgggttgcacgataatgataggcgactggcagatcacttcggcggtaaactgcatctaggatttatccagataagggagaaactggaccagctccgaaaaactgtggctgaaaagcaagagaagcggaatcaggacagactgcgcaggcgagaggaacgggagcgggaggagcggttgtcgcggaggagcgggagtagaacacgagatcgacggaggtctaggagcagagatcgccgaaggaggcgcagccggagcacctcccgtgaaagaaggaaactctctcggagccgttcaagagatagacaccggagacatagaagccggtcacgttctcactcccggggacaccgcagagcgagccgcgaccgatccgcgaaatataagtag

SEQ ID NO: 228943 - DNA, 99 bp, Artificial Sequence
  Description of Artificial Sequence: Synthetic coding sequence
atggatcttggagaatgcaccaagatacacgaccttgccctacgcgcagattacgagattgcgtcaaaggaaagggatctgttcttcgaactcgattag

SEQ ID NO: 228944 - DNA, 549 bp, Artificial Sequence
  Description of Artificial Sequence: Synthetic coding sequence
atggatcacctggagagcttcatcgccgaatgcgacagacgcacagaattagctaagaaaagattagcggaaacccaggaggaaattagcgctgaagtgtcagctaaagccgagaaggtgcatgagttgaatgaggaaatcggcaaattgcttgctaaggctgaacaactcggagccgagggcaacgtggacgaatcgcagaagattctgatggaagtggagaaggtgcgggcaaaaaagaaggaagctgaagaagagtaccgcaactcaatgcccgctagcagcttccagcagcagaagctgcgcgtttgtgaggtgtgcagcgcttatttgggtctacatgacaatgaccgtaggttggccgatcactttgggggaaagcttcatctcggctttattcaaatcagagagaagctggaccaactccggaagaccgtggctgagaagcaggagaagagaaaccaggatagacttcgtaggagggaggagagggagagggaggagcgtctgtctaggcgcagtggcagccgtacaagggacagacgatag

SEQ ID NO: 228945 - DNA, 183 bp, Artificial Sequence
  Description of Artificial Sequence: Synthetic coding sequence
taaagacgtaggagtcgatctcgtgataggagacgccgacgaagtcgcagcacttcccgagaaaggaggaagctgtcacgcagtagatccagggatcgtcatcgtaggcaccgttcgagaagcagaagtcactctaggggacacaggcgagcatcacgagaccgatctgctaaatacaaatag

SEQ ID NO: 228946 - DNA, 255 bp, Artificial Sequence
  Description of Artificial Sequence: Synthetic coding sequence
atggaccatctagaatcattcattgcggaatgcgatcggcgtaccgagttggctaagaagcgcttggccgaaacccaggaagagatctctgcggaagtgtccgctaaggcagagaaagtgcacgaactcaatgaggagattggaaagttacttgctaaagctgagcagctcggcgctgaaggcaacgttgacgaaagccagaaaatactgatggaggttgagaaagtgcgggcaaagaaaaaagaagctgagtag

SEQ ID NO: 228947 - DNA, 1176 bp, Artificial Sequence
  Description of Artificial Sequence: Synthetic coding sequence
atgcccgcatatttaaacctccagggaagcgtcagaaaagcgcctcactcgccgtctagagacacgacaagacagcgtattaagttctctgacgatcgagtttgcaaaagccatcttctgaattgttgcccccacgatgtgctgagtggcactcgtatggatctgggggagtgcctcaaggtccacgatctagccttacgggcagactacgaaatcgcctctaaggaacaagattttttcttcgaacttgatgcaatggaccatttgcagtccttcattgccgattgtgataggaggaccgaagtggcaaagaaaaggctggccgaaactcaggaagagatctccgcggaagtggctgctaaggctgagagggttcacgaactgaacgaggagatcggtaaactgcttgcaaaggttgagcagttgggcgctgagggcaatgtggaagagtctcagaaggtaatggatgaggtggagaaggctcgggctaaaaagcgcgaagcagaggaagtctatagaaattccatgccggcttcctctttccaacaacaaaagctgagagtgtgtgaggtatgttctgcgtacttgggactgcatgataacgataggcgattggccgatcactttggcggtaaactgcacctgggcttcattgagatacgtgaaaaactagaggagctgaagcgagtggtcgccgaaaaacaggaaaaaagaaaccaggaacggctgaaacgcagggaggaaagggaacgtgaagaaagggagaagttgcgaaggtcgcggtcacatagtaaaaaccccaagagaagtcgcagtcgggaacaccgaagacacagatccaggtctatgagtagggagagaaagcggaggacacggagcaagagtcgggagaaacgtcacagacacaggagccggtcaagcagccggtccaggtctaggtctcatcagagatcgaggcactcgagccgcgataggtcacgggaacgcagcaagcgcagatcatcaaaggaacggttccgcgaccaggacctggcctcatgtgaccgggaccgatcctctagagacaggtctcccagggaccgggatcgaaaggacaagaaacgctcgtatgagtctgctaatgggagaagtgaggatcggagatcttctgaggagagagaagcaggagaaatatag

SEQ ID NO: 228948 - DNA, 1179 bp, Artificial Sequence
  Description of Artificial Sequence: Synthetic coding sequence
atgagtgctcaggctcagatgcgcgctatgctggaccagctaatggggacctcgagagatggagacaccacccggcagcggatcaagttctcagacgacagagtatgcaaaagccacctgttaaattgctgtcctcacgacgttctgagtgggacgcgcatggacctcggggaatgcctcaaggttcacgacttagccttgcgagccgactacgaaatagcttccaaggaacaggatttcttctttgaactcgacgctatggatcacctgcaatcgtttattgcagattgtgatcgcagaaccgaggtcgcgaagaaacggttggccgagacacaggaggagatttctgccgaagtggccgctaaggcagaaagggtgcacgagctgaatgaagagatagggaagctgctcgcgaaggtggagcagctcggcgctgagggaaacgtggaggaaagccagaaggttatggacgaggtagagaaggcccgagccaaaaagcgggaggcagaggaggtctaccgtaatagcatgccagcttcaagctttcaacagcaaaaactgcgcgtctgtgaagtgtgttccgcttatttgggactgcacgataatgacagacgactggctgatcacttcggcggaaaactgcacctcgggttcatcgagatcagagaaaaactggaggagctaaaaagggtcgtagccgaaaaacaggaaaagagaaaccaggagaggctcaaacgacgtgaggaaagagagcgcgaagagagggagaaactgagaaggagtcgtagtcacagcaaaaaccctaagaggtctaggagcagagagcacaggcggcatcgcagtagatccatgtccagggaaagaaagcgccgaaccaggagtaagtctcgggagaaaaggcacaggcatcgctcacggtcatcgtctaggagccggagccgcagccatcaaaggtcccgccacagcagtcgggatcgtagtagggagcggtctaagcgtcgctcctccaaggagcgatttagagatcaggatctcgctagctgtgatcgcgaccgtagcagccgagatcgaagtccacgggatcgggaccgaaaggacaagaagcgctcgtacgagtcagccaatggtcgatctgaggatcgcagaagttccgaagagcgcgaagccggagaaatatag

SEQ ID NO: 228949 - DNA, 1170 bp, Artificial Sequence
  Description of Artificial Sequence: Synthetic coding sequence
atggtgatccactctcagctaaaaaagatccagggcgcaagcgaacggatgggcgatacaactcggcagagaattaagttttctgacgacagagtctgcaaaagtcacctgctcaactgctgtccgcatgatgtattatctggtacgaggatggacctgggcgagtgtctgaaggtacacgacttggctctcagggccgactatgagatagcttcaaaggagcaggacttcttcttcgagctggacgccatggaccacttgcagtccttcatcgccgattgtgaccgacgaacagaggtggctaagaagcggctcgccgagacacaggaggagatatccgctgaggttgccgcaaaagcggagcgagtccatgagctcaatgaggagataggaaagctactcgccaaggtggaacagctgggagccgaaggaaatgtggaagagtcccagaaagtgatggacgaggtggagaaagctcgagcgaagaagcgagaggctgaagaagtatataggaactctatgcccgctagtagttttcagcagcaaaagttacgggtttgcgaagtatgttccgcctatctaggccttcacgataacgatagacgcctcgccgatcatttcggaggaaagctgcatctgggcttcatcgaaatcagggaaaagctggaggagcttaaacgcgttgttgcagagaagcaggagaaacgtaatcaggagcgcctgaagcggagagaagaaagagaaagggaagaaagagagaagctaaggaggtcaagaagtcattctaagaaccccaagcgcagtcggagcagggagcaccgacggcaccgcagcagaagtatgagtcgagagcgcaaaaggaggacccgcagcaaatctcgcgagaagagacatcgtcatcgaagtcgctcatcatcaagatctcgatcccgaagccaccagcggtctaggcattcctctagagaccgcagccgcgaacgcagtaagcgacggtcaagtaaggaacgctttcgggaccaagaccttgccagctgcgacagagacagatcatcccgcgatcgttcgccacgagacagagatcgcaaggataaaaaacggtcttacgagagtgccaacggacggtcggaggatcggagatcttcagaagaacgggaggctggagagatctag

SEQ ID NO: 228950 - DNA, 1377 bp, Artificial Sequence
  Description of Artificial Sequence: Synthetic coding sequence
atggccgcactcggcagtccgtctcacacctttcgtggactgctccgtgagttgagatatctatcagcagctacaggaaggccttatagagacaccgctgcgtaccgctaccttgtaaaagcgttcagggcgcatagggtcacctctgagaaactatgcagggcacaacacgagctacatttccaagcagcgacctatctttgtttgctgaggtctattcgaaagcacgtggctctacaccaggagttccatggcaagggtgatacaacgcgccagaggataaaattttctgacgaccgagtgtgtaagtcccacctgctcaactgctgcccccacgatgtgctttcaggtacacggatggatctgggcgagtgtctaaaagtgcatgaccttgcgctaagggctgactacgagatcgcatcgaaagagcaggatttcttttttgaactggatgccatggatcacctgcagtcctttattgcagattgcgaccgcagaaccgaggtggcaaagaaacgcctcgcagaaactcaggaagaaataagcgccgaggtggctgctaaggccgagcgcgtccatgagttaaacgaagaaattggtaagctactggccaaggtggaacaactgggcgcagaaggaaacgttgaagaaagtcagaaagtgatggacgaggtggaaaaggctcgcgcaaaaaagcgcgaagccgaggaagtctacagaaattctatgcctgccagctcgttccaacaacagaagctgcgggtatgtgaagtctgttcagcatacctggggctccacgataacgacaggaggttggctgatcactttgggggaaaactccacttaggcttcatcgagattcgggagaaactggaagagctgaaacgggtcgtggccgaaaaacaagagaagcgcaaccaggagcggctgaagagaagggaggaacgcgaacgggaagaacgcgaaaagctacgcagatcgaggtcacacagcaaaaacccgaagcgctctaggtcacgggagcaccgcagacaccgaagccggtcaatgtcacgggagagaaaacggagaacgcgttctaagtcccgggagaaacggcatagacaccgctcccgatctagcagtcgcagtcgctcgcgctcgcaccagcgatcacgccacagctcgcgtgaccgcagccgtgaacggtcaaagagaagaagcagcaaggagcgctttcgggaccaggatcttgcctcatgcgacagggataggtccagtagagacagatccccccgagaccgggatagaaaagacaagaaacggagctacgagagcgccaatggaaggagcgaagataggcgcagtagcgaggagagggaggccggagagatctag

SEQ ID NO: 228951 - DNA, 1179 bp, Artificial Sequence
  Description of Artificial Sequence: Synthetic coding sequence
atgagtgcgcaggctcagatgagagccatgttagatcaactgatgggaacttctcgagacggcgacaccactaggcagcgtatcaaattctccgatgatagggtatgcaaaagtcacctcctgaactgctgcccccatgatgtgctctcaggaacaagaatggacctgggagaatgtctcaaggtgcatgatctggctctgagggccgactacgagatcgcttccaaggagcaggatttttttttcgagttggacgcgatggaccatcttcagtcctttatcgccgactgtgatcgcagaacagaggtcgccaagaagcgactagccgagacacaggaggagataagtgcagaggtcgctgcaaaagccgaaagggtccacgagctgaatgaagagattggcaaactgcttgctaaggtcgagcaattaggggctgaaggcaacgtcgaagagtcccagaaagtgatggatgaggtcgagaaggcaagggctaagaagagggaggctgaggaggtataccggaacagcatgccggcatcgagcttccagcagcagaaactccgtgtgtgcgaagtgtgctctgcttacctgggtctccatgataacgaccgtcggttagctgaccatttcggtggcaagctgcacctgggatttatcgagattagggagaaactcgaagaacttaaacgcgtcgtcgctgaaaagcaggaaaagcgaaatcaggaacggttgaagaggagagaggagagagagagagaagaacgcgagaagctcaggaggtctcgctcccacagtaaaaatccaaagaggtcccggagtcgtgaacaccgaaggcatcggtcccggagcatgtctagggagcggaagagacggaccaggtccaagagccgggaaaaaaggcatagacaccggagcaggagctcgagccggagccgctcacgcagccaccagcgctctaggcactcttccagggacaggtcacgcgaacgttctaaaaggcgaagttctaaggagcgcttcagggaccaggatcttgcttcctgcgatcgcgacagatccagtcgggacagatcccctcgggaccgggatagaaaggacaagaagcgctcatacgagagtgccaacgggagatcagaagacaggcgatccagcgaggagcgagaggccggagaaatttag

SEQ ID NO: 228952 - DNA, 252 bp, Artificial Sequence
  Description of Artificial Sequence: Synthetic coding sequence
atgtcagcccaggcacagatgagagctatgctcgatcagttgatggggacttcccgggatggatcgatgtacctgtgcctgcccacaagcatctgtaaaggtgtatccgagagacctagaatccggcaagcagaaattcagctcgttaatgaatcaaattcggtgatgactgagtatgccagagtgaccttcagcacggtggttctgatgatgtcattcttggagctggagtggattcttgagaacgtatag

SEQ ID NO: 228953 - DNA, 1299 bp, Artificial Sequence
  Description of Artificial Sequence: Synthetic coding sequence
atgatttcagcagcgcagttgttagatgaactcatggggcgagataggaatctggcccctgacgagaaaaggtcaaacgtgaggtgggaccacgagtccgtctgtaaatactacctgtgtggcttttgccctgccgagttgtttaccaacactcgtagcgacctcggtccatgcgaaaaaatccacgatgagaatctgaggaagcaatacgaaaaaagtagtcggttcatgaaggtgggttacgagcgggactttctgagatacctccagagtcttctcgccgaagtagagcgacggatacggcgaggtcatgctcggttggccttgagccagaatcaacagtcctccggggctgccggtccaaccggtaaaaatgaagaaaagattcaggtgttaaccgataagatagacgtgctgttgcagcagatcgaagagctggggtcggaagggaaggtcgaggaagcccagggcatgatgaaactcgtggaacagcttaaagaggaaagagagctgctgcgttccaccaccagtacaatagagagcttcgccgcacaagaaaagcagatggaggtctgtgaggtgtgcggtgcatttctgatcgttggcgacgcgcaaagcagagttgatgaccacctgatgggaaagcagcatatggggtatgccaagataaaagccaccgttgaggaactgaaggaaaagctcaggaagcgcaccgaggaacccgacagggacgagagacttaagaaagaaaagcaggagagagaggaaagggaaaaggagcgggaaagagaaagggaggagcgagaacgaaagaggcgtcgcgaagaggaggaacgggagaaggagcgcgcaagggacagagagcgacggaagcggagccgctcccgcagtcgtcacagctcaaggacttcagaccgaagatgcagccgctcccgtgaccataagagatccagatcacgagagcgacgccgaagccgcagtcgggataggcggcgttcgcgaagccacgatcgcagcgaaagaaagcatcgatccagaagccgagacaggagacggagcaagtcaagagaccgcaaatcctataagcatcgcagtaaatcccgggatcgggagcaagacaggaagtccaaagaaaaagagaagcgcggaagcgatgacaaaaagtcgtcagtgaaaagcggaagtagagagaagcaatccgaagacaccaacactgagtctaaagagagcgacacaaaaaatgaggtcaacgggacatcagaggacatcaagtctgagggagatacacaatcaaattag

SEQ ID NO: 228954 - DNA, 240 bp, Artificial Sequence
  Description of Artificial Sequence: Synthetic coding sequence
atgatctcagccgcacaactacttgacgagctcatgggcagggaccgtaaccttgctcccgacgaaaagcggtctaacgtacgatgggatcacgagtctgtttgcaaatattacctctgcggtttctgtccagccgagttgttcacaaatactaggtcggatcttgacgtatttggcagaggtgacaacattcgagacgtgagcaagttcctcgaagacgacaagtggatggaagagtag

SEQ ID NO: 228955 - DNA, 1299 bp, Artificial Sequence
  Description of Artificial Sequence: Synthetic coding sequence
atgatttccgccgcacagctgttggatgagctgatgggcagagacaggaacttagcccctgatgaaaagaggtctaacgtacgttgggatcacgaatcagtgtgtaaatattacctgtgcgggttctgtcctgctgaactgttcaccaatacgaggtccgatctgggtccgtgtgagaaaatccacgacgaaaacctgcggaaacagtacgagaaatcctccaggtttatgaaagtcggctacgaaagggactttttacgctatttgcagtcattgctggcagaggttgaaaggagaattcggagagggcatgccagactcgctctgagccagaaccagcagagttcaggagcagccggaccaaccgggaaaaacgaagaaaagatacaagtgctgactgataaaatagacgttctcctccagcagatcgaagagctgggcagcgaggggaaggtcgaagaggcgcagggcatgatgaagctggttgagcagcttaaagaggagcgagagctgctcagaagtactaccagtacaattgaaagctttgctgcccaggagaagcagatggaagtgtgtgaagtatgtggagctttcctgatagttggagatgcacaatctagggtggacgaccacctcatgggcaagcagcatatgggctacgccaaaataaaggccacagtggaagagcttaaggaaaagctcaggaaaaggacagaagaacctgatcgagatgaaaggttgaaaaaggaaaaacaagagcgggaagagcgagaaaaggagcgcgagagagagcgtgaagagcgggaacgtaaaagacgcagagaggaggaagaacgggagaaggagcgggcacgcgacagggagaggaggaaaaggagccggtcaaggagtagacactcctcaaggacaagcgatcgacggtgttcaagaagtcgcgatcataagcgcagccgatctagagagcggaggcggtccagaagccgggacagacgacggtcccggagtcacgacaggagcgagaggaagcacagatcccgtagccgggacagacggagatctaaatctcgcgatcgtaagtcttataagcaccgatcaaaatctagagaccgcgagcaggaccggaaatctaaagaaaaggagaagaggggctcggatgataagaaatccagcgtaaagtctgggagtcgcgagaagcagagtgaagatactaacacggagtccaaagagagtgacacgaaaaatgaggtgaatggtacttctgaggacatcaagtctgagggcgatacacagtccaattag

SEQ ID NO: 228956 - DNA, 711 bp, Artificial Sequence
  Description of Artificial Sequence: Synthetic coding sequence
atgatcagtgccgctcagctgctggacgagctgatgggcagagatcgtaacctagcccctgacgaaaaaagatctaatgtgagatgggaccatgagtcagtctgcaagtattatttatgcggtttctgccccgctgagctgtttacaaacacacgatctgacctgggaccatgtgaaaagattcacgatgagaacttacggaaacaatatgagaaaagcagtaggttcatgaaagtggggtacgaacgcgatttcctgagatacctccagtctctgctggcagaagtggagaggcgcattcggagaggacatgcgaggctcgccctgagccagaaccagcagagctcgggtgccgcaggacccacaggtaagaatgaagagaagatacaggtgctcacggacaaaattgatgtactcctgcaacaaatagaagagctggggtctgagggtaaggtggaggaagcccaggggatgatgaagctcgttgagcaattaaaagaggagagagagctgctgcgctcgactactagtactatcgagtctttcgcggctcaagagaagcaaatggaggtgtgtgaggtctgcggagcattcctaattgtgggagacgcacagtcccgggtcgatgatcaccttatgggtaaacagcacatgggctacgccaagattaaggcaacagtcgaggagaaaaagaagaagaagaaaaagtag

SEQ ID NO: 228957 - DNA, 1071 bp, Artificial Sequence
  Description of Artificial Sequence: Synthetic coding sequence
atgaaagtcggctacgagcgggattttctgcgctacctgcagtcactgcttgcagaagtggagagacgcatacggaggggccatgccaggctggctttgtcccagaatcagcagtcgtcaggcgctgcaggacccaccggaaagaacgaggaaaagatacaggtactcacggataaaatcgatgtgcttctgcagcagattgaggaactgggctctgaaggcaaagtcgaggaagcccagggtatgatgaagctggtagaacaactcaaggaggaacgcgaactgctccggagcactacctctactattgagtctttcgccgctcaagaaaaacagatggaagtctgcgaggtgtgtggcgctttcctgattgtaggcgatgcacagagtcgagtcgatgatcatctgatgggcaagcagcacatgggctacgcgaagattaaggcaacggtcgaggaacttaaagaaaagctgcggaagcggacggaagagccagaccgcgacgagagactgaaaaaggagaagcaggaacgggaggagagagagaaagagagggagagggaacgcgaggaacgcgagcgaaaaagaaggagggaagaggaggagagagagaaagaacgtgcacgtgacagagaaagacggaagagatcccggagcaggtcccggcattcttcccggacaagtgacagacgctgctccagatctcgggatcataaacgaagccgaagtcgcgagcggcgacgttcacgaagcagagatagacgcagatctcgttcccatgatcgaagcgaaaggaagcatagaagcagatctcgggatcgtcggagaagtaagagtagggaccgcaagagctataagcaccgaagtaagtcccgggatcgcgagcaggatcggaagagtaaggagaaggagaagaggggaagtgatgacaagaaatcaagtgtgaagagcggctcacgtgaaaagcagtcagaggataccaacaccgagtctaaggagtccgataccaagaatgaggtcaatggaacatcagaagacattaagagtgagggcctgtttgtgacagtgtag

SEQ ID NO: 228958 - DNA, 1017 bp, Artificial Sequence
  Description of Artificial Sequence: Synthetic coding sequence
atgtctctcagtgccttcacattgttccttgccctgataggaggcacctctggacagtattatgattacgatttccccctgtctatctacggtcagtcgtcccccaactgcgcccctgagtgcaactgtcccgaatcatatcccagcgccatgtattgtgatgagctaaagttaaaaagtgtgcctatggtcccccctggaataaagtatctttatctccggaacaaccagatcgatcatattgatgaaaaggcatttgaaaatgttactgacttgcagtggctgatccttgaccataacttgctggagaacagtaagattaaaggacgggtgtttagtaagcttaaacagctgaagaaactccatatcaaccataacaacctgactgagtccgtcggaccgctccctaagtcgctggaggaccttcagcttacacacaacaagataacaaagctgggctcgtttgaggggttggtgaaccttaccttcatccacctccagcacaacaggctgaaggaagatgctgtcagcgctgcgtttaaggggttgaagtcactggaatacctcgatctgtcgtttaaccagatagctaggctgccctccggtctccctgtatcactgcttacattatatctggataacaataagatctcaaacatacccgacgaatacttcaagagattcaacgcactccagtacctgaggctttcgcacaacgagcttgccgatagcggaatacccggaaattccttcaatgtgagctcattggtagagttggatctgtcttacaacaagttgaagaacatccccactgtcaacgaaaaccttgaaaattactatctcgaggtcaatcaactggaaaaattcgatataaagtctttttgtaagatattaggcccactttcttacagcaaaataaagcatctgcggctcgatggcaatcgaatctctgagacctcactccctccagacatgtacgagtgcctgagggtggctaacgaggtgaccttgaactag

SEQ ID NO: 228959 - DNA, 2100 bp, Artificial Sequence
  Description of Artificial Sequence: Synthetic coding sequence
atgaagcaacgcttttcggccctgcagcttctgaagctactgctgctgctacagccgcctctcccacgcgcactgagagaagccctttgccccgaaccttgcaactgtgtgcctgacggcgcactgcgctgcccagggccaaccgcgggtttgactaggctgagcctagcgtatttgcctgtcaaagtgattcctagtcaggcatttcggggactcaacgaagtgattaagatagaaattagccagatcgacagcttagagagaatcgaggcgaatgctttcgacaacttactgaacctaagcgagattctcattcagaataccaaaaatctgagatatattgagcctggcgctttcatcaatttgcccagacttaaatacttgagcatctgtaatactggaatacgtaaattccctgatgtgacaaaagttttctcgtccgagtccaacttcatcctggagatctgcgataatttacatatcaccactattcccggtaatgcgttccagggcatgaataatgagagcgtaacacttaagctgtatgggaacggtttcgaggaggtgcagtcccatgccttcaatggcacaaccctgacatctctcgagctgaaagaaaatgtccatcttgagaagatgcacaatggtgcttttcgcggagctactggaccgaagacgctggacattagttctaccaagctccaggctctgccatcatatggcctggagtctatccaacgtctgatcgcaacctctagctactctctgaagaagctccccagtagagagacttttgtcaacctgctggaggccacactgacgtacccaagccactgctgcgcgttcaggaatctgccaaccaaagaacagaacttctcgcacagtattagcgaaaactttagtaaacagtgcgaaagtacggtgcgtaaggtgaataacaaaacactttacagcagtatgctggctgagagcgagctgtctggttgggactacgagtacgggttttgtttgcctaaaacccctcgttgcgcaccggagccggacgcatttaatccatgtgaagacatcatggggtatgacttccttcgagtgctgatctggttaatcaacatcctggccattatgggaaacatgactgtcctatttgtgctcctgactagccgctataaactgacagtgccgcgattcctgatgtgtaatctgtcatttgccgatttctgcatgggactatatttgctgctgattgcatctgtcgactctcagaccaaaggacagtactataatcacgccattgattggcagactggttccggctgctccactgcgggtttctttacggtgttcgcctcagaactctcagtgtatacactgactgtaatcacgcttgaaaggtggcacacaatcacgtatgctatacacttggatcagaagcttagactccgtcatgccatccttatcatgttaggaggctggctcttttccagtctcatagctatgctgccattagtgggcgtcagtaactatatgaaagtgtccatctgttttccaatggatgtggagacgactctttcccaagtgtacatactgactatacttatcctgaatgtggtggctttctttattatctgcgcttgctatattaaaatatactttgcagttcgaaaccccgaactcatggctaccaacaaagatacaaaaatcgcaaagaaaatggcgatactgatcttcaccgatttcacatgcatggcccctatttccttcttcgcgatctccgcagcttttaaggtgccactcattacggttacgaactccaaagtcctattggtgttattctacccaataaatagctgcgccaaccccttcttatatgccatattcaccaagacatttcagcgcgacttcttcctgcttctaagcaagttcggttgttgtaagagacgagcagaactctataggagaaaggatttcagtgcctataccagcaactgcaagaacggtttcacagggtcaaataagccttctcaaagcaccctgaaacttagcacactgcactgtcaagggaccgctctactggacaaaacaaggtatacagaatgctag

SEQ ID NO: 228960 - DNA, 1914 bp, Artificial Sequence
  Description of Artificial Sequence: Synthetic coding sequence
atgaagcaaaggttcagcgcactccaactcctcaagctgctgctgttgctgcaaccgccactgcccagagcgctccgggaggctttatgtcccgagccttgcaattgtgtgcccgacggtgcactacgttgcccgggacccacagctggcctgactcggctatcactggcgtatctccctgtaaaggttattccatcccaggcattccgcggacttaacgaggttattaagatagagatttcacagattgactccctggagcgcatcgaagctaatgcctttgacaacctgttgaacctgtctgaaatccttatacagaacacaaaaaacctccggtacatcgagcctggggcttttataaacctgccacggttgaagtatctttccatttgcaatactggcattagaaagttccccgatgtgactaaggtcttttcatctgagtccaattttatactcgaaatctgcgataatctgcatatcactacaatacccggtaacgctttccagggaatgaacaacgagagcgtaacactgaagttatacggcaatggatttgaggaggtacagtcacacgcattcaacggcacaactttaacgagtcttgaactgaaggagaacgtgcacctcgagaaaatgcacaacggtgcctttcgcggtgccaccgggcctaaaaccctccagaattttagtcacagtatttccgagaatttttccaaacagtgcgaatctactgtgcgaaaggtcaacaataagactctgtactcctcgatgctggccgagtctgaactttccggatgggactacgagtacggcttctgcctgcccaagaccccacgttgtgcgcctgagccagacgcttttaacccctgtgaagacattatgggatacgattttcttagagtccttatttggttgattaacatcctggcaataatgggcaacatgactgtgctgtttgtgctactgacgtctcgatacaaactgaccgtgcccaggtttttgatgtgtaacctgagttttgccgatttttgcatgggtctctacctgctgctaatagcaagcgtggattcccagactaagggccagtattataaccatgccattgattggcagacaggctccggttgtagcaccgctggtttctttaccgtcttcgcctcagagctgagcgtgtacactctcacagtgataactctcgaaagatggcatacgatcacctacgcaatccacctggatcagaagctgcgcctgcggcatgccatacttatcatgctgggaggttggctgttctccagtctgattgctatgctgcccctcgtgggagtgagcaattatatgaaagtcagcatttgcttccccatggacgttgagactactttgagccaagtgtacatcctcacgatcctgatacttaatgttgttgccttctttatcatatgcgcatgctacataaaaatatatttcgcagttaggaacccagaacttatggctactaataaagacacaaaaatcgcaaaaaagatggccatactaatatttaccgattttacttgcatggctccaatttcatttttcgctattagcgctgcttttaaagtgcccctcattaccgtcaccaattcaaaagtgctgttggtgctgttctatccaattaatagctgcgccaacccgtttctgtacgcaatcttcacgaaaacatttcagcgggacttttttttactgctctctaagtttgggtgttgcaagcggcgtgccgagttgtaccgcagaaaagatttctccgcctatacaagcaactgtaaaaacggcttcaccggctccaataagccgagtcagagtacccttaaactgtcaaccctgcattgtcaaggcacggccctcttggataagactagatacaccgaatgctag

SEQ ID NO: 228961 - DNA, 978 bp, Artificial Sequence
  Description of Artificial Sequence: Synthetic coding sequence
atgaagcagcggttctctgcccttcagctcctgaagcttcttctgctcttgcagccaccactgcctcgcgcacttagagaggccctttgccctgagccatgcaactgcgttccggatggcgctctgagatgccctggtccaaccgctggtctcacacggctttcactggcatatctccccgtgaaagtaatccctagtcaggcctttaggggactaaacgaggtgatcaaaatagagatctcccagattgactccttggagcgtattgaggcaaacgcattcgataatctcctaaatctctctgaaatcctgatccagaatacaaaaaatctgcgctacatcgagcctggtgcgttcataaacttgcccagattaaagtatctgtccatatgcaacacgggaatccgaaagtttccagacgtgaccaaggtgttttcaagcgaatcaaacttcattctggagatttgtgacaacctccatattaccaccatacccggaaacgcattccagggcatgaacaatgaatctgtgacactgaagctgtacggcaacggctttgaagaagtgcaaagccacgcgtttaacggcaccaccctgactagcctggaacttaaggaaaatgttcacctcgagaaaatgcacaatggggcttttagaggtgcaaccggcccaaagacactggatattagtagcacgaagctccaggccctgccgtcttatggcctggaaagcatacagagactaatagctacgagttcctacagcctgaagaaactccctagtagagagacctttgttaatcttctcgaagccacactcacatacccatcacattgctgcgcctttcgcaaccttccaacaaaagaacagaacttctcccattccatcagcgagaatttttctaaacagtgcgaatcgactgtgaggaaggtgaataataaaaccctttctaagcctcgcataaatggataccaatag

SEQ ID NO: 228962 - DNA, 990 bp, Artificial Sequence
  Description of Artificial Sequence: Synthetic coding sequence
atgaaacagcgcttttcagcactgcagttgcttaagctactgctgctgctgcaacccccattacccagagccctccgagaggccctgtgtcctgaaccatgcaattgcgtgcccgacggcgcacttcgatgtcccggacccactgcaggtttgacgaggttgtccctcgcgtacctcccggttaaggtgatcccatcccaggctttccgcggactgaacgaagtgataaaaattgaaatctcacagattgactctctggaacgaatcgaagcaaatgcctttgataacctgctgaatctcagcgaaattttaattcagaacaccaagaatctgcggtacattgagccaggtgctttcatcaaccttcctaggctcaaatacctgtctatttgtaataccggcattcggaaatttccggatgtcaccaaggtgttcagctctgagtctaattttatcctggagatatgtgacaaccttcacatcacaaccatacctggtaatgcctttcaaggtatgaacaacgaatctgtgaccttaaaactgtatggcaacggtttcgaggaagtgcagagccatgcttttaacggtaccaccttaacgtcactcgagctaaaagagaacgttcacctggagaaaatgcacaacggcgcattcagaggcgctacagggccaaagaccctggatatatcctcgaccaaactccaagcccttcctagctatggccttgaaagcatacagcgactaatcgcgacttccagctattccttaaaaaagttgcctagcagagagacttttgtaaatctactcgaggcaaccctcacttatccctctcattgctgcgctttcaggaacttgcccacaaaggagcagaatttctcccacagcatcagcgagaacttctcaaaacagtgcgagtcaacagtgaggaaagtgaacaacaagacattgctgctgcacggggctctgtcagctgcccacagcctatcctag

SEQ ID NO: 228963 - DNA, 2019 bp, Artificial Sequence
  Description of Artificial Sequence: Synthetic coding sequence
atgaaacagcgattttctgcacttcaactcctcaaactcctgctgttattacaaccacctttgccgagggcactgcgagaggccctgtgtcctgagccatgcaactgtgtcccggatggtgcccttcgctgtcccggacccactgccggtctcacacggttgtcccttgcctatctgcccgtaaaggtcatccccagccaggcgttccgtggtttaaatgaggttatcaagattgagatctctcagatcgattcgctcgaaagaatcgaagccaacgcatttgataatctcctaaacctgtccgaaattttgatccaaaacaccaagaatcttaggtacatcgaaccaggagcttttatcaaccttccacggctcaaatacctatctatctgcaacactgggatacggaaatttcctgatgtcaccaaggttttctccagtgagtcaaattttattcttgagatttgtgataacctccacataacaacaatcccgggaaacgctttccagggaatgaacaatgaatctgtcaccctgaaattatatgggaatgggttcgaggaggtgcagtcccatgcctttaatggcaccaccctgacaagcctcgagttgaaggaaaacgtccacctggaaaagatgcacaacggagcattccggggagcaactggccctaaaactctcgacatcagctccaccaaactccaggcactgcccagctatggcctggagtcgatccagagattaatcgcaacatccagttactctctgaagaaactgccttcgcgggaaacattcgtgaaccttctcgaagcaactctgacatacccctctcattgctgcgcttttaggaatttgcccactaaggactactcctcaatgctcgctgaatctgagttgagtggctgggattatgaatacggtttctgcctgcccaaaacccctaggtgcgcccctgaaccggacgcctttaacccatgcgaggatatcatggggtatgactttctgcgcgtcttgatatggctgattaacatcctggctataatgggtaatatgactgtccttttcgtgctcctgacctcgcggtataaacttacagtcccccgttttttgatgtgtaatctgtcatttgccgacttctgcatggggctctacctcctactgattgcgagcgtggactctcagacaaaggggcagtattataatcatgctatcgattggcagactggatcgggatgctctactgccggattcttcacagtttttgcatcagaactaagcgtgtatactcttacagtgattacactggagcgatggcataccataacctacgcaatccacttggatcagaagttgcggttaaggcatgccatcctgataatgctcggaggttggctgttctcaagtctgattgccatgctacccctggtcggtgtgtcaaactacatgaaggtgagcatctgcttccccatggatgtcgagactacactgagtcaggtctatatcctgacaattctcattctcaatgttgttgcattcttcatcatctgtgcatgttacattaagatttactttgccgtacgaaatcccgaactgatggccacaaacaaagatactaaaatcgccaagaagatggctatcctgatttttacagatttcacgtgcatggcacccattagtttttttgctatctcggcagcgttcaaggtgcctctgataaccgtgaccaattctaaggtcctgttggttctgttttatcccattaattcttgtgccaatcctttcctgtatgcaattttcacaaagacattccagagagatttttttttgctgctctctaaattcggatgttgtaaacggagagcagaactttatagacggaaggatttcagtgcctacaccagcaactgtaagaatggcttcacgggatccaacaaaccctcccagtccacactgaagttgtctaccctccattgtcagggtaccgctctactcgataaaactcgatacacagaatgttag

SEQ ID NO: 228964 - DNA, 396 bp, Artificial Sequence
  Description of Artificial Sequence: Synthetic coding sequence
atgacacctctgctcacactcattctcgtcgtccttatgggattaccactggcccaggccttggattgtcacgtgtgtgcatacaatggagacaactgctttaatccgatgcgatgtcctgcaatggtggcctactgcatgacaacacggacaagtgccgcagaggccatctggtgtcatcaatgcactggattcggaggctgctcgcatggaagcagatgtctgcgcgactccactcattgtgttacgacggcaaccagagtcctcagcaataccgaggatcttccgctcgtgaccaaaatgtgtcatattggatgccctgacataccatcattgggcctgggcccatacgtgtcgattgcctgctgccagactagcctgtgcaatcatgactag

SEQ ID NO: 228965 - DNA, 351 bp, Artificial Sequence
  Description of Artificial Sequence: Synthetic coding sequence
atgactcctctcctgacactgatcttggtggtgctgatgggactgcctcttgcgcaggccctcgactgccatgtctgcgcatacaacggggataactgcttcaatcctatgagatgtcctgcaatggttgcttattgtatgactactcggacttattatactcccaccagaatgaaagtcagtaagtcatgtgtcccacgctgctttgaaactgtttatgatggctacagtaaacacgcctccaccacttcttgttgtcaatacgatctgtgtaacgggaccggtctagctactccagccacgttggctttagcgcctatcctgcttgctacattgtgggggctactgtag

SEQ ID NO: 228966 - DNA, 351 bp, Artificial Sequence
  Description of Artificial Sequence: Synthetic coding sequence
atgaccccacttctgacgctcatcctcgtggtgctgatgggactcccgttagcccaggctttggattgtcacgtttgcgcgtacaatggagataattgtttcaaccctatgagatgccctgcaatggtggcctattgcatgaccactagaacctactacactccaacaaggatgaaggtttccaaaagttgcgtccctcggtgcttcgaaacggtgtacgacggatatagtaaacacgcatctacaacctcctgttgccagtacgacctttgtaatggcaccgggctggccacacctgctaccctggccctggcacctatcctcctggccaccctgtggggtttgttgtag

SEQ ID NO: 228967 - DNA, 351 bp, Artificial Sequence
  Description of Artificial Sequence: Synthetic coding sequence
atgactccccttctaactctgattttagtcgtgctaatgggattacctcttgctcaggccctcgattgtcacgtgtgtgcatacaacggcgacaactgtttcaaccccatgaggtgccctgctatggttgcctactgcatgacaaccagaacctactatacacctacccgcatgaaggtgtctaaatcttgcgtgccaagatgttttgagaccgtgtatgacggctattccaaacacgcttccaccacctcctgctgtcagtacgatctgtgcaacggaaccggtctggctaccccggctacgcttgccctggcacccattttgctcgctacactgtgggggttgctctag

SEQ ID NO: 228968 - DNA, 249 bp, Artificial Sequence
  Description of Artificial Sequence: Synthetic coding sequence
atgacccctctgctcacacttattctggtggtgctcatggggcttcctttggcccaggctctggactgccacgtttgcgcctataacggagacaattgcttcaaccctatgagatgcccggcaatggtggcgtactgcatgactaccaggacttattacacccctacacgaatgaaggtctctaagagctgtgtgcccaggtgttttgaaaccgtgtatgatggatactccaaacatgcctctacctag

SEQ ID NO: 228969 - DNA, 255 bp, Artificial Sequence
  Description of Artificial Sequence: Synthetic coding sequence
atgacacctcttttgacattgatcctcgtggtactgatggggctcccactggctcaggccctggattgccatgtgtgtgcgtacaatggagataactgttttaaccccatgcgatgtcctgctatggtggcctactgtatgaccaccaggacctactatactcccacccgcatgaaggtcagcaagagctgtgtaccccgttgctttgaaactgtctatgatggctatagcaagcacgcctctacgacatcatag

SEQ ID NO: 228970 - DNA, 1041 bp, Artificial Sequence
  Description of Artificial Sequence: Synthetic coding sequence
atggaccctgcccgtaaggcgggagctcaagccatgatttggacggctggttggctcctgctgttgcttctccggggaggcgcacaggccttggagtgctacagttgcgtgcaaaaagcggacgatggatgctctcccaataagatgaaaacagtgaagtgtgcccctggggtggatgtatgtaccgaagcagtcggagctgtggagactatacatgggcagttctctctagccgtccgcggatgcggttcagggctgcccggaaaaaacgatcgaggcctggatctccacgggctgctcgcttttattcagctccagcagtgcgcccaggacaggtgtaacgctaaattgaatctcacttcccgggctctggaccccgctggtaacgagtccgcctacccccctaacggcgtcgagtgttacagctgtgtgggcctttcacgggaagcttgccagggaacatcaccgccagtggtttcctgctacaatgcttctgaccacgtatacaagggctgcttcgacggcaacgtcactctaaccgcagccaacgtcaccgtgtcccttccagtgaggggctgcgtccaagatgaattttgtacacgggacggcgtgaccggccctggctttaccctctcgggcagctgttgccagggcagccggtgtaattccgacttgcggaacaaaacgtatttttctccacgaattccaccactggtaaggctgcctcccccagagccgacaaccgtggcctcaaccacaagtgtgaccacatctacgtcagctccagtgaggcctaccagcaccacaaaacccatgccagctccaacgtctcaaactccgagacagggcgtagagcatgaagcgtcccgtgatgaagagccccgattgaccgggggtgccgctgggcaccaagataggtctaattccggtcagtaccccgcaaagggcggacctcaacagccccacaataaaggctgtgtcgcaccgacagccggtctggccgcactgctgctcgccgtcgccgcaggcgtgctcctctag

SEQ ID NO: 228971 - DNA, 885 bp, Artificial Sequence
  Description of Artificial Sequence: Synthetic coding sequence
atggaccccgcaaggaaggcgggtgcgcaggctatgatctggaccgctgggtggctgctactgctgttgctcagaggtggcgcacaagccctggagtgctattcttgtgtccagaaagctgacgatggctgctctcctaataagatgaagactgtcaagtgcgcacctggtgttgacgtctgcacagaggcagtcggggcagttgagaccattcatggacagttttccctagcagttcgtggctgcgggtccggattgcccggaaaaaatgaccgcggtctcgacctccacggccttctcgcgttcatacagcttcaacagtgtgctcaggaccgctgcaacgctaaactaaacttgacttcaagagctctcgaccctgcagccgcagccaatgtgacagtgagcctgcctgtcagaggatgtgttcaggatgaattctgtacacgggacggagtcactggacctggcttcacgttgtctgggtcttgttgccagggaagcaggtgcaactcagacttgagaaataagacatatttcagtccacgaatccctcctctggtcaggttgccgcctccagagccaaccactgtggccagcactacctctgtaacgacctccactagcgccccagttcgcccaaccagtaccactaagcccatgccagccccaacatcccaaaccccccgacagggggtcgagcacgaagcttccagggacgaagagccccgactgacaggaggcgcagcaggtcaccaggataggagcaattccggacagtaccccgctaagggtggaccccaacaacctcacaataaggggtgcgtggcaccgacagctggactggccgcactcttgttggctgtggccgcaggcgtgctactatag

SEQ ID NO: 228972 - DNA, 516 bp, Artificial Sequence
  Description of Artificial Sequence: Synthetic coding sequence
atggagccagggccagcactagcctggttactgttgcttagcctgctcgctgactgcctgaaggccgcacagagccgcgacttcacagtgaaagatatcatctatttacatccatccaccacaccatatcctggaggattcaagtgttttacctgtgagaaggcggctgacaattatgagtgtaacagatgggccccagacatctactgtcctagagagacccggtattgttatacacagcatacgatggaggttaccggcaatagcatatcagttactaaaaggtgcgtcccgctggaagaatgtctctcaacagggtgtagagacagcgaacatgagggtcataaagtgtgcacgagctgctgtgaagggaacatctgcaacttaccacttccccgaaatgagacagatgccacatttgccactacctccccaatcaatcaaacgaatgggcaccctcggtgcatgtcagtgatcgtcagctgcctctggctatggctgggcctgatgctctag

SEQ ID NO: 228973 - DNA, 516 bp, Artificial Sequence
  Description of Artificial Sequence: Synthetic coding sequence
atggagccaggacccgcacttgcctggcttctgctcctcagcctcctcgcggactgcctaaaagctgcacagtcccgtgatttcacagttaaagatattatttatcttcacccgtccactactccatatcccggtggcttcaaatgttttacatgcgaaaaagcggctgataactatgaatgtaatcgttgggccccagatatttactgccctagagagaccaggtactgttatacgcagcataccatggaggtaacaggcaattctatttcagttacaaagcggtgcgtccccttggaggagtgcctgagtactgggtgccgagattccgagcacgaggggcacaaggtgtgcacctcctgctgtgagggcaacatctgtaatctgccactcccgagaaatgaaacagatgcaacctttgccacaactagtccaatcaatcagactaacggacatccccgttgcatgtccgtgattgttagttgcctttggctatggctgggtcttatgctttag

SEQ ID NO: 228974 - DNA, 162 bp, Artificial Sequence
  Description of Artificial Sequence: Synthetic coding sequence
atggagcctggcccagccctggcgtggctgttgcttctgtctttgctagcagactgtctaaaggccgctcagtccagagactttacggtgaaggatataatttatctgcatccttcgaccacaccttatcccggaggatttaaatgtttcacctgcgaatag

SEQ ID NO: 228975 - DNA, 969 bp, Artificial Sequence
  Description of Artificial Sequence: Synthetic coding sequence
atggcccgatgcttctccttggtgctgctcttaacctctatatggacaactagattactagtccagggttctctgcgcgctgaagaacttagtatccaagtgtcatgccgcattatggggatcacgctcgtgtccaagaaggctaatcaacaactaaatttcactgaggccaaagaggcatgtcggctactgggcctgagtctagccggtaaagatcaagtagagactgccttaaaggccagcttcgagacgtgcagctacggttgggtgggtgacgggtttgtggtgatttcaaggataagccctaatccgaaatgtggaaaaaacggcgtcggcgtgctgatctggaaagtgcccgtgagtagacaatttgctgcttactgttataactcttcagatacatggaccaattcctgtatacccgagattatcaccactaaagaccccatttttaatactcagaccgcgacccagactaccgaatttatagtcagcgatagcacatatagcgttgcgagcccttattccacaattcccgcaccgaccacaactcctcctgctccagcatcaaccagcattcctagacgaaagaagcttatttgcgtcaccgaagtcttcatggagactagcacaatgagtactgaaaccgagccatttgtggagaataaagccgcattcaaaaatgaagcggctggatttgggggagtccctaccgcgctgttagtcctggcgctcctatttttcggagccgctgctggacttggcttttgctatgtgaagaggtacgttaaagcattcccatttacaaataaaaaccagcagaaggaaatgatcgagaccaaagtggtgaaagaggagaaggcaaacgatagcaacccaaatgaggaaagtaagaaaactgataaaaatccagaagaatctaagtctcctagcaaaacaacggtgagatgcctggaggccgaggtctag

SEQ ID NO: 228976 - DNA, 387 bp, Artificial Sequence
  Description of Artificial Sequence: Synthetic coding sequence
atgcgaaccgctctgttgctgctggctgctcttgcagtggccaccgggccagcccttacactaagatgtcacgtttgcacgtcatcatcaaactgcaagcactctgttgtgtgccccgcatcctcgaggttctgtaagacaacgaataccgtggaacccctcaggggaaaccttgtgaaaaaagattgcgcggagagctgtacacccagctacactttacaagggcaggtgtcgtcaggaacctctagcacgcagtgttgtcaggaggatctgtgcaatgaaaaacttcacaatgccgcacctactagaaccgcactggctcacagcgccctatctctgggccttgccctaagtctcttggctgtgattcttgcaccttccctgtag

SEQ ID NO: 228977 - DNA, 396 bp, Artificial Sequence
  Description of Artificial Sequence: Synthetic coding sequence
atgaaaatctttctgccggtgctgctcgcggcactactcggggtagagagggccagctcacttatgtgcttttcgtgtcttaaccaaaaatctaatctgtattgtctgaaaccaacaatctgcagcgaccaggacaattattgcgtcaccgtttcagcaagcgcagggataggcaatctcgtaacattcggccacagcctctctaagacgtgttccccagcctgccccatcccagagggcgtcaacgtgggagtggcctctatgggaatttcatgctgccagtccttcctgtgtaacttttctgctgcggacggaggcctccgggctagcgttactctcttgggcgcaggtctgctgcttagtctgttaccggcactcctgcgcttcggtccatag

SEQ ID NO: 228978 - DNA, 396 bp, Artificial Sequence
  Description of Artificial Sequence: Synthetic coding sequence
atgaaaatctttctgccagtgcttctggcggctctcctgggcgtggagagagcgtctagtctcatgtgcttttcctgcttaaaccaaaagagcaatctgtactgcttaaaacccacgatctgttcagatcaagacaactactgtgtgactgtatctgcctcggctgggattggtaacttggtgactttcggccactccctctcgaaaacctgctcaccggcttgcccaatcccagagggggtaaacgttggcgtggcgagcatgggaattagttgctgccagtcctttctctgcaatttctctgctgcagacggcggactcagggcaagcgtgactctgctgggggcagggcttctgcttagtctgttacccgcactgcttaggtttggaccttag

SEQ ID NO: 228979 - DNA, 267 bp, Artificial Sequence
  Description of Artificial Sequence: Synthetic coding sequence
atgaagatcttcctccccgttctactggcggcactgctcggagttgagcgtgcctcaagcttaatgtgctttagctgcttaaatcaaaaatcaaatctgtattgcctcaagcctacaatttgttctgaccaggacaattattgcgtgactgtgtcggcttcggccggaatcggaaatctggtgacctttggtcacagcctctcaaagacttgctctcccgcatgtcctatccccgagggggtaaatgtgggggtggcctctatgtag

SEQ ID NO: 228980 - DNA, 396 bp, Artificial Sequence
  Description of Artificial Sequence: Synthetic coding sequence
atgaagatttttcttcccgtgctgctagccgcattactcggagtagagcgggctagctctttaatgtgcttcagctgtcttaaccagaaatctaatctgtactgcctaaagcctacaatttgctcagaccaagacaattattgcgtgactgtgagtgcgtccgccggtatcggcaacctcgtgacctttggacattccttgagcaagacctgctcacctgcgtgccctatcccggagggagttaatgtgggcgttgcttcaatgggcattagttgctgtcagtccttcctttgtaacttctccgccgcagatggtggactgcgggcatcggttaccttgttaggtgccggactgctgctctcgttgctccctgccctactgcggtttggtccatag

SEQ ID NO: 228981 - DNA, 396 bp, Artificial Sequence
  Description of Artificial Sequence: Synthetic coding sequence
atgaaaattttcctcccagtcttactcgctgctctattaggagtggaaagggcttcctcacttatgtgtttcagctgtctgaaccaaaagagcaacctgtactgccttaaacccactatctgcagcgatcaagataactactgcgtaacggtttccgcctcagccggaataggcaacctggtgacctttggacacagtctaagcaagacctgctcgcctgcttgccccattcctgaaggggtgaacgtcggtgtagcatcaatgggaatctcctgctgccagtctttcttgtgtaacttcagcgccgctgacggcggtctccgggcatcggtaaccctgctgggcgcaggcttgttgctgagcttattgcctgctttgttgaggtttggaccctag

SEQ ID NO: 228982 - DNA, 396 bp, Artificial Sequence
  Description of Artificial Sequence: Synthetic coding sequence
atgaagatctttctgcccgtcctcttggcggctctactcggcgtggagagggcaagcagtctgatgtgcttctcttgcctgaaccagaaatctaacctgtattgtttgaaaccaaccatctgttctgaccaagacaactattgtgttacagtaagcgcgtctgcaggaatcggcaacctggttaccttcggccactccttgagtaagacatgctctcccgcttgccccatcccagaaggagtcaacgtgggggtcgcatccatggggatctcatgttgccagtccttcctatgtaactttagcgcggctgatggagggctaagagcctcggtgactctgttgggggctggcctgctgctaagccttctgcctgcccttctgcgattcggtccgtag

SEQ ID NO: 228983 - DNA, 396 bp, Artificial Sequence
  Description of Artificial Sequence: Synthetic coding sequence
atgaaaatattcctaccagtgctactggctgccctgctcggagtcgagcgtgcatcatcactgatgtgcttcagctgtctgaatcagaagtcaaacttatactgccttaaacccaccatttgctctgaccaggataattattgcgtcaccgtgtcagcgagcgcgggaatcggcaatctggtaacgttcggtcacagtctgtccaagacatgctcccccgcatgtcctatccctgagggtgtcaacgtcggcgttgcttccatggggatctcgtgctgtcagtcctttctctgcaacttttctgccgctgacggaggccttagagcttctgtaactttacttggtgctggcttgctgctgtcactgcttccggctcttctgcgtttcgggccttag

SEQ ID NO: 228984 - DNA, 396 bp, Artificial Sequence
  Description of Artificial Sequence: Synthetic coding sequence
atgaagatttttttgcccgtgctgctggctgctctccttggagtggaacgcgctagcagtctaatgtgcttttcctgtctgaaccagaagagtaacctgtactgtcttaagcctaccatctgcagcgatcaggataactattgtgtgacggtctctgcaagtgccggtataggtaacttggtgacttttgggcattctctctccaaaacgtgctctccggcatgccccatccccgagggggtgaatgtgggagtggccagcatgggcatttcatgctgtcagtcctttctctgtaattttagcgcagctgacggcggactcagagctagtgttactctgctgggggctggcttgctgctgtctctgcttccagcactgctgagattcggcccatag

SEQ ID NO: 228985 - DNA, 402 bp, Artificial Sequence
  Description of Artificial Sequence: Synthetic coding sequence
atgaaaccccaatttgttggtatcctcctctcaagcctgctgggagcggctcttgggaatagaatgagatgctataattgtggcggatccccctcgtccagctgcaaagaagctgtgaccacctgtggggagggtcggcctcagcccggattggaacagattaaactgcccggaaatccccctgtgaccctgattcatcagcacccagcctgtgtggccgctcatcattgtaaccaagtggagacggaatccgtcggcgacgtcacttaccccgctcatagggattgctacctcggggacctgtgcaattccgccgtcgcttcccacgttgcacccgctggaattctggcagccgcagcaacagctctgacctgtctgttaccaggactctggtccggctag

SEQ ID NO: 228986 - DNA, 525 bp, Artificial Sequence
  Description of Artificial Sequence: Synthetic coding sequence
atgaaaccacagtttgttggcattctgttgagctcgctgctgggcgctgccttgggcaacagaatgaggtgttacaattgtggaggctctccgtccagcagctgcaaggaagctgtaacgacctgtggagaggggaggccacagcccggactggagcagatcaagttacctggaaaccgcagatgctttctgagaggtctgaaaattcctttggggagcctcaaaagtcatctgttgtgtccacgcagacaggtgctgaaaccaggagtgcagcacccctcttttatcctgagtctgtctccctccgatctggatagtccaacttcctcgctccgaaggtctccttccctccagagctcaggggaccgggtcggagggagacgcgatctgtcctcccctcaggggctgctccccggtagacctgtgcagcaacgtcgaggaaagccatgtggcccttgccgccacttcggatgtagcagctataggcccgatctgtctttagcccgtaccgtggaaagaatctag

SEQ ID NO: 228987 - DNA, 402 bp, Artificial Sequence
  Description of Artificial Sequence: Synthetic coding sequence
atgaaaccacaattcgtggggatactcctgagctctctgcttggagctgctctggggaaccggatgaggtgctacaattgcgggggatctccatcaagcagttgtaaagaagccgttacgacctgtggcgagggacgccctcagcctggccttgagcagatcaagttaccaggcaacccccctgtgactctgatacaccagcacccagcttgcgtagccgcacatcattgcaatcaagttgagacagagtcagtgggagacgtgacctatccagctcaccgcgattgttatttgggggatctctgcaatagcgccgtggcatcccacgtggcccctgctggcatactggccgcagccgcaacggccctgacctgcctactgcccggactatggtcagggtag

SEQ ID NO: 228988 - DNA, 1149 bp, Artificial Sequence
  Description of Artificial Sequence: Synthetic coding sequence
atggcagtgcttttcctgcttctgttcttatgcggcactccccaggcggcagacaatatgcaggcaatttacgtggccctcggggaggccgtagaacttccttgcccttcaccccctactctgcatggagacgaacatctctcatggttctgcagcccagctgctggatcctttaccacactggtggctcaagtacaggtgggcaggcctgcccctgatcccggaaaacctggaagagagtcacgtcttcgcctgctgggaaactactcactttggctggaaggctccaaagaagaggacgccggtcgctattggtgtactgtgctcggtcagcatcacaactatcagaattggcgagtatatgacgtgctggtcctgaaaggctcccaacttagtgccagagccgctgacggctctccatgcaatgtgctgctctgttcagtggtcccgtcccgtaggatggacagcgtgacttggcaagaaggaaaagggcctgtgagaggtagagtccagtctttctggggctcagaggcggcattgctgttggtctgtcccggtgaaggcttaagtgagcctcggtcccggaggccaaggatcattcgctgcttgatgacccataataaaggtgtgtcttttagtttagcagcttccatcgatgcaagtcctgccctttgcgcacccagtacaggatgggacatgccctggattctcatgctgctgttgaccatgggtcaaggggtggttatactggcactatcaatagtgctttggcgtcagcgggttcgcggagcccctggacgagggaatcgcatgagatgttataattgtggtgggtctcctagtagttcgtgcaaggaggccgtcactacttgtggcgaggggcgaccgcaaccagggttagaacagatcaagttaccaggcaatccgcctgtgacactgatacatcagcaccctgcctgcgtggcggcacatcattgcaatcaggtagagactgagtccgtgggagatgtaacttacccagcccatcgggattgttacctgggcgatctgtgtaactccgccgtggcctcccatgttgcacccgctggcattctggctgccgctgcaaccgcactgacatgcctgctgccaggcttgtggagtggctag

SEQ ID NO: 228989 - DNA, 402 bp, Artificial Sequence
  Description of Artificial Sequence: Synthetic coding sequence
atgaagcctcagttcgtaggcatccttctctccagcttactgggagcagccctggggaacaggatgagatgctacaactgcggcggaagtccctccagcagctgtaaagaagccgtaactacatgcggagagggcaggcctcaacccggtctggagcagatcaaactcccgggtaatccccctgtgaccctgattcaccagcacccggcttgtgtagccgctcaccactgtaatcaggtggagactgagtcagtcggggatgtgacctaccctgcccaccgagactgttatcttggagatctgtgcaatagcgccgttgctagccacgtggcccctgcaggaatattggccgcagcagccactgccctgacttgtctgttacctggactgtggagcggctag

SEQ ID NO: 228990 - DNA, 402 bp, Artificial Sequence
  Description of Artificial Sequence: Synthetic coding sequence
atgaagccacagtttgtgggaatcctgctgtcttccctgctcggtgcggcacttgggaataggatgaggtgttacaattgcggcggatccccgtccagttcatgtaaagaggctgtgacaacctgtggcgaggggagaccccaacctggcttggagcagatcaagctaccaggaaacccaccggtgacactgatacaccagcatcctgcttgtgtggctgcgcaccattgtaaccaagtggagactgagagtgtaggggatgtcacatacccagcccaccgagattgttatcttggcgatctctgcaacagcgcagtcgcctctcacgttgcccctgctggtatcttagccgctgcagctaccgccctgacttgcctgctccccggattgtggagtgggtag

SEQ ID NO: 228991 - DNA, 1149 bp, Artificial Sequence
  Description of Artificial Sequence: Synthetic coding sequence
atggccgtgctcttcctcttactcttcttgtgcggcaccccccaggctgccgacaatatgcaggctatatacgttgctctaggagaagccgtagagctaccttgcccatcgccgccaacactacatggcgacgagcacttatcttggttctgttccccggctgcaggctcattcacaactctcgtcgctcaagtacaggtgggccgaccagcgccagatcccggtaaacctggacgcgagtccaggttgcgcttacttggtaactatagcctctggctggaggggagcaaagaagaggatgctggaaggtattggtgcgcagtcctcggacaacaccacaactaccagaactggagggtgtacgacgtactggttctcaagggctcccagctctctgctcgcgcagctgacgggagcccatgtaacgtgctgttgtgtagcgtggtgccaagcagacgaatggacagcgtaacatggcaggaaggcaaaggcccagtccgaggacgggtgcagagcttttggggctctgaagctgcccttctccttgtgtgccccggtgaagggctgtctgagcccaggtcaagaagaccgagaattataaggtgcctgatgacacacaacaaaggagtgtcattctccctggcagcctctatcgatgcaagccccgcactttgtgctccatcaaccggctgggacatgccgtggatactgatgctgttgttaacaatgggacagggtgtagttatcctggcgctgtccatcgtcctgtggaggcaaagggtgaggggagcgccaggacggggaaatcggatgcgctgctataattgtggcggatcaccaagcagctcttgtaaagaggctgtcacaacctgcggggagggacgtccacagccgggtcttgaacagattaagctgccaggaaacccacccgtcaccctgattcaccaacatcctgcgtgtgttgccgctcatcactgtaatcaagtggagaccgaatctgtgggggatgtgacttaccctgcccatagagactgctacctgggggatctgtgcaacagcgccgtggcctcccacgtcgctcccgctgggatcctggcagcagctgcaactgctctaacctgcctcctgccgggattgtggtcaggatag

SEQ ID NO: 228992 - DNA, 402 bp, Artificial Sequence
  Description of Artificial Sequence: Synthetic coding sequence
atgaagcctcagttcgtgggcatccttctgtccagcctcttgggcgcagcgctcggcaatcgcatgagatgttacaactgcgggggaagcccttcaagtacatgtaaagaagccgtgacaacctgtggcgaaggtcgaccccagcccggactggagcagatcaagttgcccggaaatcctcccgttactctgatacaccagcacccagcctgtgtagcagctcatcactgcaatcaggtggaaactgagagcgttggggatgtgacgtatcccgcacatagggactgctatctcggagacctttgtaactccgctgtcgccagtcacgtcgcccctgccggaatcctcgcagcggctgcaaccgcattaacttgtctactccccggtctgtggagtggctag

SEQ ID NO: 228993 - DNA, 402 bp, Artificial Sequence
  Description of Artificial Sequence: Synthetic coding sequence
atgaagcctcaattcgttggaatcctgttatctagtctgttgggcgctgcactgggcaaccgcatgcggtgttacaattgtggaggatcaccttcgagctcctgtaaagaggccgtcactacatgcggtgaaggcagacctcagcctgggctggaacagataaaactgcctgggaatcccccagtcactctaattcaccagcatcccgcatgtgtggccgctcatcattgtaaccaggtcgagaccgaaagcgtgggggacgtgacctatcctgcgcaccgcgattgttacctcggcgacctctgcaactccgctgtggcctcccacgtcgcgcctgccggaatattggctgcagccgctaccgctttgacttgcctcctgcccggactctggtccggttag

SEQ ID NO: 228994 - DNA, 402 bp, Artificial Sequence
  Description of Artificial Sequence: Synthetic coding sequence
atgaagccccaattcgtcgggattttgcttagttcgctgcttggcgcagctctcggcaatcggatgcgctgttacaattgtggcggaagtccctcctcttcctgcaaagaggcagtcacaacatgcggggagggccgtccccagcctggcttagaacaaataaagttacccggtaacccccctgtgacattgatacatcagcatccagcctgcgtagctgctcatcactgtaaccaggtggaaacagagagcgtcggcgacgtaacctatccagcgcatcgtgactgttacctcggagacctgtgcaattcggcagttgccagccatgtggcaccagctggaatcttggcagcagctgctaccgccttaacatgccttctccctggactttggagtggctag

SEQ ID NO: 228995 - DNA, 525 bp, Artificial Sequence
  Description of Artificial Sequence: Synthetic coding sequence
atgaaaccccaattcgtgggcatactactgagctcgctactgggagccgctcttggtaaccgcatgagatgctacaactgcgggggtagccccagctcttcatgcaaagaagctgttaccacatgcggtgaaggcaggcctcagccaggcctcgagcaaattaagctccctggaaacagacgttgcttcttacgaggtctgaagatacctctcgggtccctaaagagccacttgttgtgtcccagacgccaggtgcttaagccaggtgttcaacacccttccttcattctcagtctttccccctcagacctggattcccctacctcctctctgcgcagatcaccgagcctacagtcttcaggggatagggtggggggtcgcagagatttatccagtcctcaggggctgctcccaggcagaccagtgcaacaacgcagaggtaagccctgcggcccttgccgacatttcgggtgctcatcttaccggcctgatctatcactcgccaggaccgttgagcgtatctag

SEQ ID NO: 228996 - DNA, 486 bp, Artificial Sequence
  Description of Artificial Sequence: Synthetic coding sequence
atgttggcccctcaaagaacccgagctccttcgccccgtgctgcgcctcgccctacgcgatctatgctccccgcagcaatgaaggggttgggtcttgctcttctcgcagtgctgctctgtagcgctcctgcgcacggactgtggtgccaagattgcacgctgaccactaatagttcccactgtacacccaagcagtgtcaaccaagcgacacagtgtgtgcttccgtgcgcattacagacccctcaagcagccggaaggaccatagtgtgaacaagatgtgcgcctctagctgcgattttgtgaaaaggcacttcttcagtgactaccttatgggtttcatcaacagcggaattctgaaagtcgatgtggactgttgcgaaaaggatctgtgcaatggcgcagccggtgcaggccacagcccctgggccttggcaggtggattgttactgtcattgggtcccgctctgctgtgggccggaccatag

SEQ ID NO: 228997 - DNA, 486 bp, Artificial Sequence
  Description of Artificial Sequence: Synthetic coding sequence
atgctcgccccacagagaactcgggcaccttctcctagagcagcaccgaggcctactcgcagcatgctgcccgctgcaatgaaaggactggggcttgctctgctcgcagtgctcttatgcagtgccccagcccacggactgtggtgtcaagactgtacactgaccaccaatagttctcattgcacccccaagcagtgtcagccatccgacacagtctgcgcctccgtaagaatcaccgatccctctagcagcaggaaggatcattccgtgaacaagatgtgtgccagcagttgcgacttcgtcaagcgtcacttttttagcgactatctgatgggcttcattaacagcggcatcctgaaagtagacgtggattgttgtgagaaggacctttgtaatggcgcagccggtgccggacacagcccatgggctctggcgggaggcttgctgctgtcacttggtccggctttgctgtgggctgggccatag

SEQ ID NO: 228998 - DNA, 423 bp, Artificial Sequence
  Description of Artificial Sequence: Synthetic coding sequence
atgcttccagctgcgatgaaggggctcggacttgccttgctggccgtgttgctttgttcggctcctgcacacggcttgtggtgtcaagattgcactcttacaaccaactctagccactgcacccccaagcaatgccagccatctgacacagtgtgcgcttccgttcggatcactgatccctctagttcacgcaaggatcacagcgtgaataaaatgtgtgctagtagctgtgatttcgtgaagaggcactttttcagcgactacctcatgggcttcatcaactcaggaatattgaaagttgatgtggattgttgcgaaaaggacctgtgtaatggggctgcaggagcgggacactcaccatgggccctagccggagggctcctgttgagcctcggacctgctctgctgtgggccggaccctag

SEQ ID NO: 228999 - DNA, 1971 bp, Artificial Sequence
  Description of Artificial Sequence: Synthetic coding sequence
atggtggcacccaaatctcataccgatgactgggcgcctggtccttttagctcaaagcctcagcgcagtcagctgcagatcttctccagcgttctccagaccagtctgctatttctgcttatgggtctccgcgcatccggaaaggattccgcgccaacagtggtgtctgggatactgggcggatcagttactcttccccttaatatctccgtcgatacagaaatcgagaacgttatttggatcggtcccaagaatgctctcgccttcgcccgtcccaaagaaaacgtaactattatggtgaagagttacctcggcaggctggacatcactaagtggagctattccctctgtatttcaaatctcaccctcaatgatgcaggttcttacaaggcccagattaaccagagaaactttgaagttacgaccgaggaggaattcacattgttcgtgtacgagcagctgcaggaaccccaggtcacaatgaagagcgttaaggtgagcgagaatttcagctgcaacatcactctgatgtgttccgtgaaaggggcagaaaaatctgtcttgtacagttggactccacgggagccgcacgcctccgaatcaaacggaggcagcattctcaccgtctcaaggacaccgtgtgaccccgatcttccctatatttgcactgcccagaatccagtgtcccagcgctcctctttgccggtgcacgtggggcagttttgtacagaccccggagcttcccgcggtggtaccacgggcgaaactgttgtgggcgtcctgggcgagcctgtgaccctgcccctggccctacccgcatgtagggataccgagaaagtcgtgtggctattcaacactagcattatttctaaagagcgcgaggaggctgcgaccgcagacccccttataaagagcagggacccatacaaaaatagagtgtgggtgagttcccaagattgctccttgaaaatttctcagttgaagatcgaagacgccggtccatatcacgcatacgtctgttccgaggcttcgtctgtgaccagtatgacgcatgtgaccctactgatttatcggaggctgcggaaaccgaaaatcacgtggtctctgcgtcactccgaggatggcatatgtcggatcagcctgacttgcagtgtggaggatggaggaaacaccgtgatgtatacatggacaccgctgcaaaaagaggccgtggtaagccaaggtgaatcgcatctcaatgtgagctggcggagttccgagaatcatcccaacctcacttgcacagcgtctaatccagtgagtagaagtagtcatcaatttttgtctgagaatatatgttccggcccagaacgcaacaccaaattatggatcggtctctttcttatggtgtgtctgctatgtgtgggaattttttcctggtgtatttggaagagaaaaggaaggtgtagtgtccctgctttttgctcctctcaagctgaggcaccagcggatactcctgaaccgacggcaggacatactctctatagtgtgctgtcgcaaggctatgagaagctcgatactcccctgcggcctgcccgtcagcagcccacaccaacctctgacagctctagcgattctaacctaacaaccgaagaggatgaggaccgcccagaagtgcacaaacccatcagtgggaggtatgaggtttttgaccaagtgacacaggaaggggcaggacacgatcccgctcccgagggacaagctgactacgatcctgtgaccccatacgtcacagaggtagaaagcgtggtcggcgagaatacaatgtacgcccaggtgttcaatttacaaggaaaaactccggtgtcacagaaagaggagtcgtccgctacaatctactgcagtatccggaaacctcaggtggtggtgccccctcctcagcagaacgacttagagatccccgagtctccaacctacgagaatttcacgtag

SEQ ID NO: 229000 - DNA, 1566 bp, Artificial Sequence
  Description of Artificial Sequence: Synthetic coding sequence
atggtggccccaaaatcccacactgacgactgggcgccaggccctttttcctctaaaccacaaaggagtcaactgcagatcttctcgagcgtcctacagacaagcctcctgtttttgctcatggggcttcgagctagcggaaaggactccgccccaacagtggtgtctgggatcctgggcggttcagtcaccctacctctgaacattagcgtggatacagagatcgagaacgtgatttggattggcccaaagaacgctttggcctttgcacgaccgaaggagaacgttacgatcatggtcaaaagttacttagggaggctagacatcactaaatggtcatactcactgtgtatctccaatctcactctgaacgatgccggttcttataaggctcaaattaaccagcgtaattttgaagtcacgactgaggaggagtttacactatttgtgtacgaacagcttcaggaaccgcaggtgaccatgaagtccgtgaaggtgagtgaaaatttcagctgtaatatcacactgatgtgttctgttaagggagcagagaagtctgttttgtattcctggacaccgagagaacctcacgcctcggagtctaatggcggaagcattctcacagtctctcggactccatgtgaccccgacctaccttatatctgtaccgctcagaatcctgtttctcagaggtcatccctcccggttcacgtgggccaattctgtaccgaccctggcgcatccagaggcggtaccacaggcgagacagtcgtcggtgtgctaggggagccggtgacactcccattggccctgcccgcatgcagagatactgagaaagtggtttggctgtttaatactagcatcatctctaaggaaagggaagaagccgcaacggcggaccccttaataaaatcaagggacccctataaaaatcgcgtgtgggtctcctcccaagactgcagcctcaagatctcgcaactcaaaattgaggatgcgggaccttaccacgcctatgtttgttctgaagcctctagtgtcacctcgatgacccacgtgacacttttgatttaccgtcctgagcgcaacacgaaactctggatcggtctcttcctcatggtatgcctcctgtgtgtgggcatcttctcatggtgcatttggaaacggaagggaagatgcagtgtgcccgcattttgctcgagccaggctgaggctcccgctgacactcccggttatgagaaactggataccccactgaggaagcctatcagcggaaggtatgaggtctttgatcaggttacgcaggaaggcgctggtcacgaccctgcacctgagggtcaggccgactatgacccagttaccccgtacgtcacggaagtagaatcggtggttggggaaaacaccatgtacgcccaagtgttcaacctacagggtaaaactcctgtgagccaaaaagaggagagctcagcgaccatctactgcagcatccgaaaaccacaggtggtccccccaccacaacaaaatgatctggaaatacccgaatcccctacgtacgaaaatttcacttag

SEQ ID NO: 229001 - DNA, 813 bp, Artificial Sequence
  Description of Artificial Sequence: Synthetic coding sequence
atgacacacgtgaccctcctaatctaccgacgcctgcgcaagcccaagattacttggagcctgcgacattccgaggacgggatatgccgtatcagtttgacctgttccgtggaagacggaggcaacaccgttatgtatacttggacgccgctacagaaagaagctgtggtcagccagggggaaagccacctgaatgtctcatggcggtctagtgaaaaccacccaaatctgacatgcaccgcctccaatccagtctcaagatcctcgcaccagtttttgagtgaaaatatttgctctggccctgagagaaacacaaaattgtggattgggctcttcttgatggtttgcctcctgtgtgtgggtatcttctcttggtgtatttggaagcgcaagggacggtgcagtgtccccgcattttgcagttcgcaggcagaggcgcctgccgatacccccggatatgagaaactggataccccactccggccagcaaggcagcaacctactcctaccagtgacagctcgtccgattctaatctgacgacggaggaggacgaagaccgtccagaagttcacaagcccatcagcggcaggtacgaggtattcgatcaggtgacccaagagggcgcaggacacgatcccgcacccgagggacaggccgattacgacccagtgactccatatgtcacagaagtcgaatccgtcgtaggggagaatacgatgtacgctcaggtcttcaatctgcaggttgtgccaccaccccagcagaacgatctggagataccagaaagcccaacgtacgaaaattttacttag

SEQ ID NO: 229002 - DNA, 813 bp, Artificial Sequence
  Description of Artificial Sequence: Synthetic coding sequence
atgactcacgtgaccctactaatctatcggcgtctccgtaaacccaaaattacctggagcttgcgccactccgaagatggcatctgcaggattagtctgacttgctcagttgaagacggagggaataccgtgatgtatacttggactcctctgcagaaggaagccgttgttagccagggagagtcccatctcaatgtgtcctggcgcagcagcgagaaccatccgaatctcacttgcactgcatctaaccccgtaagcaggagctcccaccaattcctctccgagaatatttgctccgggccagagaggaacacaaagctctggattgggctgttcctcatggtgtgcctcttgtgtgtgggaattttcagttggtgtatttggaaacggaagggaaggtgttccgtcccagcattttgtagttcccaggccgaggctccagccgatactcccggttatgaaaaactagacactcccctgcgcccagcccgacagcaaccgactcccacatccgactcaagctccgattccaatctgaccactgaggaggacgaagaccgccctgaggtccacaagcctatttcaggcagatatgaggtgttcgatcaggtgacgcaagagggggcaggccacgaccctgcgccagagggtcaagctgattacgacccggtaacaccatatgttacagaggtggagagcgttgtgggtgagaacaccatgtatgcccaagtgttcaatttacaagtggttcctccacctcagcagaacgatctggagatccccgaaagtcccacctatgaaaatttcacctag

SEQ ID NO: 229003 - DNA, 1968 bp, Artificial Sequence
  Description of Artificial Sequence: Synthetic coding sequence
atggtcgccccaaaatcacacacagatgattgggctccgggaccattcagctctaagccccagaggtcacaactacagatcttctcctccgtgctccagaccagccttttgtttctgttaatggggctgcgggcatcaggaaaggattcagcccctacagtggtcagtggcattttggggggtagtgttactctgccgcttaacatcagtgttgataccgaaattgaaaacgttatctggatcggcccaaagaacgccctggcctttgctcgacctaaggagaatgttactatcatggtcaagtcatatctgggtaggctagacattacaaaatggtcttatagtctgtgtatttccaatctgacactcaacgacgcgggatcttataaagcacagattaatcagcgtaatttcgaggtgaccactgaagaggaatttaccctcttcgtgtatgaacagctgcaggagccacaggtcaccatgaagagtgtgaaggtctctgaaaacttcagctgtaatattactttaatgtgcagtgtaaaaggtgccgaaaaaagcgttctctacagctggacaccacgcgagcctcacgccagtgaatcaaacggcggatctattctcacagtatcacgaacgccttgcgaccctgacttaccatatatctgtactgctcagaaccccgtgtcgcagcggtctagcctcccagtgcacgtaggacagttctgtaccgatcccggtgcctcccgcggaggaaccacgggggaaactgtggtgggtgtgctcggggaacccgtgaccctccccctcgctctgccggcttgtcgcgacacagaaaaggtggtttggctcttcaacacatcgatcatctcgaaggaacgggaagaggccgctacagccgaccctctgatcaagtctagggacccatacaagaaccgcgtctgggtgtccagccaagactgtagcctcaagatctctcagctcaaaatcgaggacgcgggaccgtaccacgcctatgtgtgttctgaggcctcaagtgttacttccatgacacacgtcacactgctgatttatcggcgattgaggaagcctaagatcacatggtccctgcggcattcggaggacgggatttgtcgcattagcctcacatgtagcgtcgaagatggtggcaacaccgtcatgtatacctggactcctcttcagaaagaagcggtagtaagtcagggagaaagtcatctcaacgtttcatggcgttctagcgaaaaccaccccaacctgacctgcacggccagcaatccggtatcacgcagctcccatcagttcctgtccgaaaacatctgttccggtcctgagagaaacacaaagttgtggatcggactgtttttgatggtgtgcctgttgtgcgtcggcatcttttcatggtgcatttggaaacgtaaggggagatgctcagttcctgccttttgctccagtcaggctgaggctccagccgacaccccggagccaaccgccggacatacattatactctgtgctgtctcaaggctacgagaagctcgatacacccttgcgaccagcaaggcagcagccaacaccaacatcggattccagctctgacagcaatctgacaacggaagaggacgaggaccgcccagaggttcacaagcccattagcgggagatatgaagtcttcgaccaggttacgcaggagggagccggacatgaccccgcaccagaggggcaggcagattatgacccagtcaccccctacgtgactgaggtggaaagcgtggttggcgaaaatactatgtacgctcaggtgttcaacctccagggaaaaacccccgtgtcacagaaagaggaatcctcggcaactatctattgctccatcagaaagccacaggtcgtgcctcctccacaacaaaatgacctggagattccggaatccccgacatacgaaaattttacctag

SEQ ID NO: 229004 - DNA, 1116 bp, Artificial Sequence
  Description of Artificial Sequence: Synthetic coding sequence
atggtcgccccaaaatcccacacagacgactgggcgccagggccattctccagcaagccacaaagatctcaattgcagatcttctcaagcgttttgcagacttccctactgtttctgctgatgggcttgagggcttcggggaaggattccgcacctactgttgtgtcaggcatactcggagggtccgttacactgcctctgaacatcagcgtggacactgaaatcgagaatgtgatctggattggacctaagaatgcactggccttcgccaggcctaaggagaatgtgacaatcatggtgaagtcgtatctcggtcgattggatattaccaaatggagctactcattatgtattagtaacctgactctgaacgatgctgggtcttacaaagcccagatcaaccagcgaaactttgaggtcactactgaggaagagtttacacttttcgtatatgaacagctccaagagcctcaggtgactatgaaatctgttaaagtttccgagaacttcagctgtaatatcaccctgatgtgcagcgtcaagggggcagagaaaagcgtcctttatagttggaccccaagagaaccacacgcatctgagagtaacggcggatctatcttgactgtttcaaggacaccctgcgatcccgatctgccctatatctgtaccgctcagaatcccgtgtcccagcggtcatctttgcctgtgcacgttggccaattttgtacagatccaggggcatcaaggggcggaacaaccggcgaaacggtggtcggcgttttgggggagcctgttactctacctcttgcccttccagcatgccgggatactgagaaagtggtctggctgttcaacactagcatcatctctaaagagcgggaggaggctgccacagcggaccctctgatcaagtctagggacccatataaaaaccgggtgtgggtcagcagccaggattgtagtctcaagatcagtcaactgaagatcgaggatgctggaccctaccacgcctacgtgtgctctgaggcttcctccgtgacctcgatgacccatgtcacgctcctgatctatcgggagagtcttggaagggccccaattactcggttcctgctctag

SEQ ID NO: 229005 - DNA, 1809 bp, Artificial Sequence
  Description of Artificial Sequence: Synthetic coding sequence
atgggcctacgggcttccgggaaggatagcgctcccacagtcgtgagtggcattttgggaggctcagtgacactgcctctgaatatctcagtcgataccgagatcgaaaacgtgatttggattggacccaaaaatgctctggcttttgcaagacctaaagaaaatgtaaccatcatggttaaatcctacctgggccgtctggatatcaccaaatggagttattcgctgtgcattagcaacctcaccctcaatgatgcaggttcctacaaagctcaaatcaaccagcgcaatttcgaagtgacaactgaagaggagttcacgctatttgtttatgaacaactgcaggagccccaggttactatgaaaagcgtgaaggtgtccgagaacttcagttgcaatattacactgatgtgcagcgttaaaggggctgagaaaagcgtcctgtactcctggactccaagagaacctcacgcctcagaatccaacgggggtagcatcctcaccgtaagcaggacaccgtgcgaccctgatctgccttatatatgtactgctcagaaccccgtaagccagcgcagtagcctccccgttcatgtggggcagttttgcacagaccccggagcttctcgaggaggcacaaccggcgagaccgttgttggtgtcctcggagagcctgtgactttacctctcgctctgccagcctgtcgggataccgagaaggtggtatggctattcaacactagcatcattagtaaggagagagaagaggcagccaccgccgaccctctgattaaatctagagatccctacaagaatagagtctgggtcagcagtcaagattgtagcctgaaaatctctcaattgaaaatcgaggacgcaggaccatatcatgcctacgtctgcagcgaagccagttcggtcacaagtatgacccacgtcactctgctgatataccgccgactgcggaaacccaagataacttggtcactacgtcatagtgaggacggaatctgcaggatttcactgacttgcagcgtcgaagatggcggaaacacggtgatgtatacttggacacccctccagaaggaagccgttgtgagccagggagaatcccatctgaatgttagctggagaagcagtgagaatcaccctaatctcacctgcaccgcttccaaccccgtctccagatccagccaccaattcctgtccgagaacatatgtagcggacccgaaaggaataccaagctgtggatcggattgttcctgatggtttgtttgctatgtgtgggcatcttttcatggtgcatttggaagcgaaaaggtcggtgctccgtacccgctttctgttcaagccaggccgaagcccctgccgacacaccaggatatgaaaaactggatactcctctccgacctgcccgacagcagcctaccccaacgtccgattctagcagcgatagcaatttgacaaccgaggaggacgaggatcggcctgaagttcacaaacccatctctggacgctatgaagtcttcgaccaagttacccaagagggagctggacacgacccagctccagaaggtcaggccgattatgatcctgttaccccatatgtgactgaggtggagtcggttgtcggggagaataccatgtacgctcaggtgtttaatcttcagggaaagacacctgtgagtcagaaggaggagtcatcagccaccatctactgctcaataagaaagccccaggtggtggtcccacccccacagcaaaacgacctcgagatcccagagtcgccgacctatgaaaacttcacctag

SEQ ID NO: 229006 - DNA, 582 bp, Artificial Sequence
  Description of Artificial Sequence: Synthetic coding sequence
atggtggcaccaaagagtcacactgatgattgggcacctggacccttttcctcaaagcctcagagatctcaacttcagattttttctagcgtgctccagactagtttgctctttcttttgatgggactgcgcgcaagtggtaaagattccgcccctacagtggtctccggaatcctgggtggctcagtcacgctgccgctcaatatcagtgtagatactgagatcgagaatgttatatggataggtcctaagaacgccctggccttcgcacgcccaaaagaaaacgtcacaattatggtcaagagctatctgggacgtctcgatatcacgaagtggagttatagcttgtgcatctcgaacttaacattgaacgatgcgggatcttacaaagcccagataaatcagcggaatttcgaggtcaccacagaagaagaatttacactgtttgtttacgcacctttcatcgagaaactgtccgtgcacgtcatcgaaggagaccatcgtactcttctggaaggcagtggcctagaaagtatcataagtaccctggcagagccaagggtgtcggtacgcgagggatag

SEQ ID NO: 229007 - DNA, 1581 bp, Artificial Sequence
  Description of Artificial Sequence: Synthetic coding sequence
atgggcctgagagcatccggaaaagactcagccccaacagtggttagtgggattctggggggttcagtcaccttgcctttaaatatcagcgtagacactgaaatcgaaaacgtgatatggatcggcccaaaaaacgctctcgcttttgctcgtcctaaggaaaacgttactatcatggtgaaaagctatctcgggagactggacataaccaaatggagttactccctctgcattagtaacctgactctgaatgatgccggttcctacaaagcccagatcaatcaacggaacttcgaggtgaccacagaggaggaatttactctgttcgtgtacgagcagctccaggaaccccaggtcactatgaaaagtgtcaaagtgtccgagaacttcagttgtaacatcaccctgatgtgctccgtgaagggagcagagaagtccgttctgtatagctggacccctcgcgagccccatgcttctgaaagtaatgggggaagcattctgactgtctctcgcactccttgcgaccctgacctgccttacatatgtaccgctcagaacccagtctctcagagatcaagtcttccagtacacgtcggccagttctgcactgatccaggcgctagtagaggcggtaccacaggcgagaccgtggttggggttctgggcgaacctgttaccctccctctcgcgctgcctgcctgccgagatactgagaaggtggtatggctcttcaatacaagcatcatcagtaaggaaagagaggaggcggctaccgcagatcctcttattaagtcgagggacccatacaagaatcgcgtgtgggtttctagccaagactgcagcctgaaaatcagccaactcaagatagaggacgcgggaccttaccacgcctatgtttgcagcgaggcgtcatccgtaacttccatgacgcatgtgacactcttgatttacagacccgagagaaataccaagctgtggattgggctgtttcttatggtttgtctgctgtgcgtgggcattttcagctggtgtatctggaaaagaaaaggacgctgcagcgtaccagcgttctgcagctcccaggctgaagcgccagcggatactccggagcctacagcgggacatacgctctactctgtgctgtcgcaaggttatgaaaaactcgatacccctctccgaccagctcgccagcagccaacgccaaccagcgacagctcttctgacagtaatctgacaactgaagaagacgaggatcgcccagaagtgcataagccaattagcgggcgatatgaggtgtttgaccaggtgacacaggagggagccggtcacgatccagcacctgaggggcaggcagattatgatccagttacgccttacgtaactgaggtggagtcagtggtgggagaaaacacaatgtacgcacaggtctttaatctgcagggaaaaacccctgtgagccagaaggaagagagctctgccaccatttactgttctattagaaaaccccaggtagtggttccgcctccccaacaaaatgacctggagattcccgagtcccccacctacgaaaactttacctag

SEQ ID NO: 229008 - DNA, 1884 bp, Artificial Sequence
  Description of Artificial Sequence: Synthetic coding sequence
atggcgagagggtccgtttccgacgaagagatgatggaactccgggaggccttcgcaaaagtggacacagatggcaacggctacattagcttcaatgagctgaatgatttgttcaaggcagcttgcctgcccctgccaggataccgggtaagggagattacggaaaatttgatggccacaggggacctggaccaggacggccgaataagcttcgatgaatttattaaaatcttccacggtctcaaatccactgatgtggcgaagacgtttcggaaagccattaataagaaagagggaatttgtgccattggcggaacgtctgagcaatctagtgttggaactcagcactcctattcagaagaggagaaatacgccttcgtcaactggatcaacaaggccctcgaaaacgaccctgactgtcgtcacgtgattcccatgaaccccaacacaaacgacctgtttaatgccgtgggagatggaattgtgctctgcaagatgatcaacctctccgtcccagacacaattgacgaaaggacaatcaataaaaagaaactgacccctttcacaattcaggagaatctgaatctagcactgaattcagcaagtgcaatcggctgtcacgtggttaatataggagcagaagatctcaaagaagggaaaccatacctggtcctggggcttctgtggcaggtgatcaagataggtctattcgccgacattgaattgagccgcaacgaagcccttatcgcattgttgagggaaggggagtcgctcgaggatttgatgaagctcagccccgaggaactgctcttgaggtgggcgaactaccatcttgaaaacgccggttgcaataaaatcggaaactttagtaccgatattaaagacagcaaggcctactaccacctgttggaacaagtggctcccaagggcgacgaagagggagtgcccgctgtcgttatcgatatgtcaggtctgagagagaaagacgacattcagagggccgagtgtatgctgcaacaggcggagaggttaggctgtagacagttcgttacagctacagatgttgttcggggtaatcccaagctgaacctggcctttatcgccaacctgtttaatcggtaccccgctctgcataaacccgaaaatcaagatatagattggggcgctctggaaggtgaaactcgggaggagcgcacatttcgcaattggatgaattcattgggcgtgaatccgcgagtgaaccatttgtacagtgacttatccgacgccctggtgatttttcagttatatgaaaaaatcaaggtccccgtggattggaacagggtgaacaaaccaccctaccccaaactgggtggtaacatgaagaagctggagaactgtaactacgccgtggagctaggaaagaaccaagcaaaattttccctggtgggtatcgggggtcaggacctcaatgagggtaaccggacactaacattggcactcatctggcaactgatgagacgatacaccttaaatatcctggaagagataggcggtggacagaaggtgaatgatgatattatcgtcaactgggtcaatgaaaccttacgagaggcaaaaaagagtagctctatcagcagcttcaaagaccctaagataagtacaagtctcccagttttagacttaattgacgccattcaaccgggtagtatcaattacgacctcttgaaaactgaaaacctcaatgacgacgaaaagctgaacaacgccaaatacgccatctccatggcacgaaaaatcggagcgcgtgtctatgctcttcccgaggatctagtagaagtcaacccgaaaatggtcatgaccgtgtttgcgtgccttatgggcaagggcatgaaaagagtgtag

SEQ ID NO: 229009 - DNA, 1884 bp, Artificial Sequence
  Description of Artificial Sequence: Synthetic coding sequence
atggccagaggaagcgtgtccgacgaagaaatgatggagctgcgcgaggccttcgcaaaagtggatactgacgggaatgggtacataagctttaacgagctcaacgatttattcaaagcagcctgcttacccttgcctggttatagagttcgggagatcaccgagaacctgatggccaccggcgacctggaccaggatgggaggatttcatttgatgagttcatcaaaatctttcacgggctcaaatctactgacgtggctaagacttttaggaaggcaattaataagaaggagggtatatgcgccatcggtgggacctccgaacaaagcagtgttggcacacagcattcctatagtgaggaggaaaaatatgctttcgtgaattggattaataaggccctggagaatgatccagattgtaggcacgttatacccatgaatccgaatacaaacgacctgttcaatgctgtaggggacgggatagtcctgtgcaagatgattaacctctccgtgccggatactatagacgaaagaacaataaataagaaaaagctgaccccattcaccatacaggagaatcttaacctggcccttaacagcgcgagcgccatagggtgccatgtggtgaatatcggggcagaagacttgaaggaagggaagccctacctcgtcctcggcctcctctggcaggtcattaagattgggcttttcgctgacatcgagctctccagaaatgaggcgctcatagctttgctgcgcgagggcgaaagcttagaggatttgatgaagctctctccagaggagcttttgcttagatgggccaattaccatctggaaaacgctgggtgtaacaagattgggaatttttctactgacattaaggactctaaagcctattatcatcttttggagcaagtggcccctaaaggggacgaagaaggagtgcccgctgttgtcatagacatgtcaggattaagggagaaagacgacatccaaagagcagagtgtatgctgcagcaggctgagaggctaggatgtcgacagtttgttacggcgaccgacgttgtgagaggaaacccgaagttaaacctggccttcatcgccaatttgttcaataggtaccctgcactccataagcctgaaaatcaggatatcgactggggtgctctggaaggagaaacccgtgaggagcggaccttcaggaattggatgaactctctgggcgtgaaccccagggtcaatcatttgtactcagatctaagcgatgccttagtgatcttccagttgtatgaaaaaatcaaagtacccgtggactggaatcgggtgaataaaccgccatacccgaagctagggggtaatatgaaaaagctggaaaactgcaactacgcggtcgagctcggcaagaatcaggccaagttctctctcgtgggaatcggcggtcaggatctcaacgagggaaaccgaacactcacactggccctcatctggcagctaatgcgaagatacaccctgaatatcctagaggaaatcggcggtggtcagaaggtcaacgacgatatcatcgtgaactgggtaaacgagaccttgcgagaagcaaagaaaagtagctcgatttcctcttttaaggatcccaaaatttctacgtctctccccgtgctcgacctgatcgacgccattcagccagggtccattaactatgacctcttgaagaccgagaatctgaacgacgacgagaaactgaacaacgcaaaatacgctatctctatggccagaaaaataggggctcgcgtgtacgctttaccagaggacttagtggaagtgaatcccaagatggtgatgactgtctttgcctgcctgatgggaaaaggcatgaagcgggtgtag

SEQ ID NO: 229010 - DNA, 741 bp, Artificial Sequence
  Description of Artificial Sequence: Synthetic coding sequence
atggccaggggttccgttagtgacgaggagatgatggagctgagggaagcctttgcaaaggtggatacagatgggaatgggtatatctccttcaacgagttgaatgatctctttaaagccgcatgcctgcctttgcccggttacagagttagagagataactgaaaacctcatggctaccggggatctcgaccaggacggcagaatcagttttgacgagtttattaagatcttccacggtctgaaaagcacggacgtggccaaaaccttccggaaggccattaataagaaagaaggaatctgtgccattggtggtacaagcgagcagtcctctgttggaacccagcactcctattctgaagaggagaagtatgctttcgttaactggatcaacaaagctctcgagaatgaccccgattgcaggcatgtgattcccatgaacccaaatacgaacgatcttttcaacgccgttggcgatggtatcgtgctgtgtaagatgataaatctgtcggtgcctgatacgatagacgagcgcactataaacaagaagaaactcactccttttacaatacaggagaatctgaatctagctctcaactcagcttcggcaatcgggtgtcacgtggtcaacatcggggcagaagaccttaaggaaggaaagccctatctggttctcgggctgctttggcaagtaatcaagataggattgttcgccgacatcgaattgtcgcggaatgagtag

SEQ ID NO: 229011 - DNA, 591 bp, Artificial Sequence
  Description of Artificial Sequence: Synthetic coding sequence
atgtgcgctgaagacggcgactccaagtttagcatgtctattagtatgaacagcccctttctcgagattctccatcttgaaaactgtaattacgccgttgagcttgggaaaaatcaggccaagttcagtttggtaggtatcgggggacaggacctgaatgaggggaacaggacacttaccctcgccttgatctggcagctgatgcggagatacaccctcaacatccttgaggaaattgggggaggacagaaggtgaatgatgacataatcgtgaattgggttaacgaaacactgcgtgaggctaagaagtcttcttctataagctccttcaaagatcctaaaatcagcacatccctgcccgtgttggacctcatcgatgctattcagccaggatcgatcaattacgacttgctgaagactgaaaacctgaacgatgatgaaaagctcaataacgctaaatacgccattagcatggcccgaaaaataggcgctcgcgtttatgccctgcctgaggatctggtagaggtcaatccaaagatggttatgaccgtgttcgcctgcttaatggggaagggcatgaagagggtgtag

SEQ ID NO: 229012 - DNA, 201 bp, Artificial Sequence
  Description of Artificial Sequence: Synthetic coding sequence
atggccagggggtctgtgtctgatgaggagatgatggaactgcgagaagctttcgccaaagtagacaccgacggcaacggttacatttcattcaatgaactgaacgatctgttcaaagccgcatgcctccctctccctggttatcgtgtacgcgagataaccgagaatctcatggcgacgggcgacctcgatcaggactag

SEQ ID NO: 229013 - DNA, 1602 bp, Artificial Sequence
  Description of Artificial Sequence: Synthetic coding sequence
atggccctcagaaacgttcccttccggtcagaagttctggggtgggatccagactctttggccgactatttcaaaaagcttaactataaggattgtgaaaaggcagttaaaaaataccacatcgacggggcaagattcttgaacctcactgaaaatgatatccagaagttccctaagctacgggtccctattctctctaagttaagccaggagatcaataagaacgaagagcggcgttccatatttacccgcaagccacaggtccctaggtttccagaggaaacagaatcccatgaagaagataatgggggatggagcagttttgaggaagacgactacgagtccccaaatgatgatcaggatggagaagacgacggcgattacgagagccccaacgaggaggaggaggctcctgtggaagatgacgctgattacgaacctcctccttcgaatgacgaggaggcccttcagaatagtatcttgcctgcaaaacctttccctaactctaactcaatgtacatcgataggcctccctcgggcaagactcctcagcaacccccagttcccccacaaagacccatggccgcactgccccctcctccagccggtcgtaatcacagcccactgccccctcctcagacgaatcatgaggagccgagtcgttcacgcaaccataaaacagctaaactgcctgctcctagcatcgacagatctacaaaacccccactcgatagatcccttgcacctttcgatagagaaccatttacactaggaaaaaagcctccttttagtgacaagccgtccatacccgcaggacgtagtctaggcgaacatctacccaagatccagaagcccccattgccacccacgacggagaggcacgagagaagcagccccctgcccggaaaaaagcccccagtgcccaagcacggttggggaccagaccgaagggagaatgatgaagatgacgtgcaccagcgacccctaccacaacccgctcttctccctatgagttctaataccttccctagcaggtccactaagccatcaccgatgaaccccctgccatcttcacatatgcctggggctttttctgaaagcaattctagcttcccccagagtgctagcttgcccccttatttcagccaaggacccagtaatcgacctccgatccgtgccgaaggtcgaaactttcccctgccgctgccgaataaacccagacccccatcgccagctgaagaggagaacagcctgaatgaagagtggtatgtcagctacataacccgccctgaggctgaagccgcactgagaaagatcaatcaagacgggacattcctcgtgcgtgacagctctaaaaagacgacaaccaacccctatgttctgatggtgctttataaggataaagtgtacaatatccagatacgctatcagaaagagtcccaggtctatttgttgggtacaggcctgcgcggaaaggaggatttcctgtctgtgtcagacatcatcgattacttccggaagatgcccctcttgcttatcgacgggaagaaccgcggtagccgctaccagtgtacgctgactcatgccgctggctacccttag

SEQ ID NO: 229014 - DNA, 1578 bp, Artificial Sequence
  Description of Artificial Sequence: Synthetic coding sequence
atgtgggaggcacagttccttggcctgctgtttttgcagcctctgtgggtggcaccggtgaagcccctgcagcccggagcagaagtgccagtggtgtgggcccaagaaggtgcccctgctcagctgccgtgctcccctacaatccctctccaggatttatcgctcctcagaagggccggtgtgacatggcagcatcagccagacagcgggccaccagccgctgcgcctgggcatccactggcgccaggaccccacccagctgctccaagcagctgggggcctcgccctcgcagatacaccgtgctgtctgtgggtcctgggggtctccggtcaggccgacttcccctgcagccccgagtgcagctggatgaaagagggaggcagagaggagatttcagtctctggctgagacccgctcgcagagcagacgctggagaatacagggctgcagtgcacctcagagatagggctctcagttgccgtctcaggctcagattgggtcaagcgtcaatgactgcctctccacccggttccttacgcgctagcgactgggtgattctgaactgctcttttagtcggccagaccggccagcctctgtgcactggtttcggaatcgcggacaaggccgagtccccgtacgggaaagtccccaccaccacctggctgagtcatttcttttcctcccgcaggtcagtcctatggattcaggcccttggggttgcatcctcacttatcgcgacggattcaacgtctcaatcatgtacaatttgacggtactcggacttgagccgccaacccccttgaccgtgtacgcaggcgctggtagtagggttggactgccctgtaggcttcccgctggagtggggactaggtcctttctgaccgccaagtggacgccacccggaggcggacccgatctgcttgtgacgggtgataatggggacttcaccttgcgtttagaagacgtctctcaggcccaggctggtacttacacttgccatatccacttgcaagagcagcagctgaatgctacggtaacattggctattattaccgtgacaccgaaatccttcggttccccaggttccctcggaaagctgctgtgtgaggtgacacctgtatcgggccaggaacgatttgtgtggagctctctggacaccccatcccagcgatccttcagcggcccatggctggaagcacaggaggctcagctccttagtcagccctggcagtgtcagctgtaccagggggagagactcctgggcgcagccgtctactttacagagctaagcagccctggagcacagagatccggacgggctcctggggcactcccggctggacacctcctgttgttcctgatcctgggggtgctgtcactactgcttttagtcactggagcattcgggtttcatttgtggcgcagacagtggcgaccacggagatttagtgccttggaacagggcatccatcccccacaggcacaatctaaaatcgaggaactggaacaggagccggaaccagagccagaacccgagccagagcctgaacctgaaccagagccggaacaactgtag

SEQ ID NO: 229015 - DNA, 1020 bp, Artificial Sequence
  Description of Artificial Sequence: Synthetic coding sequence
atggcagaggcaagctccgatcccggagcggaagaacgggaagagctgctgggtcccactgcccagtggagcgtggaggacgaggaggaggccgtgcatgaacagtgtcagcacgagcgagatcgacagttacaggcacaggatgaggagggcggaggtcacgtgccggagcgcccaaagcaagagatgctcttgtcactgaagccctctgaggcccctgagctcgacgaggatgagggctttggggactggagtcagaggcccgagcagaggcagcaacatgagggagcccagggtgccttggattctggcgaaccgcctcagtgtcggagccccgagggcgagcaggaggatcgtcctggcctccacgcctacgagaaagaggactctgacgaggtgcacctggaggaactgtccctgtcgaaggaaggaccaggtcctgaagacaccgtacaggacaacctgggtgccgcaggggctgaagaggaacaagaggaacatcagaagtgccaacaaccgcgaactccctcccctctcgtcctggaaggaacaattgagcagagtagcccccctctatctccaaccacaaagctcattgacagaacggaaagcctgaataggagcatcgagaaaagcaatagcgtgaaaaaaagccagccagacttgccaatctccaaaattgatcagtggctcgagcaatacacccaggctatagagactgcaggacggaccccaaagctcgcaaggcaagcctccattgaactcccttccatggctgttgccagcaccaagagccgctgggaaaccggggaagttcaagcacaatctgctgcaaaaacacccagttgtaaggacattgtagcaggcgatatgagcaagaaatcactgtgggagcaaaagggaggttccaaaacatcgtcaacgatcaagtcaaccccctccggcaaacggtataagtttgtggccacagggcacggcaagtacgaaaaggtgcttgtggagggtgggcctgctccctag

SEQ ID NO: 229016 - DNA, 834 bp, Artificial Sequence
  Description of Artificial Sequence: Synthetic coding sequence
atgctgctgtccctgaagcccagcgaggctcccgagctcgatgaggatgagggtttcggagactggagtcagagacctgagcagagacagcagcatgaaggtgctcagggtgccctggacagcggcgagcctccacagtgtagatcccctgaaggggagcaagaggatcgccctggtttgcacgcctatgagaaggaggatagcgatgaagttcatcttgaggaactgagcttaagcaaggaaggcccaggacccgaagacacggtgcaagataatctgggtgctgcgggtgccgaggaggaacaagaagagcatcagaaatgtcagcagccaagaaccccaagtcctcttgtgcttgagggaacaatcgaacagagtagtcccccactcagcccaactacaaagctgatcgaccgtaccgaaagtttgaatcgctctattgagaaaagcaactcagtaaagaaatcccagcccgacttgccaatcagcaagatcgatcagtggttggaacagtacacacaggcgattgaaaccgccggacgcacacctaaactcgcccgtcaggcctctatcgaactgccctctatggccgtagcctctacgaaaagccgttgggagaccggcgaggtgcaggcacagtcggctgccaagaccccctcctgtaaagacatcgtcgctggggatatgtcaaagaagagtctatgggagcaaaagggcggatcaaaaacgagcagcacaatcaagtccacccctagcggtaagagatataaattcgtggctactggacacggtaagtacgaaaaagtgctcgtggagggcggacctgcgccttag

SEQ ID NO: 229017 - DNA, 834 bp, Artificial Sequence
  Description of Artificial Sequence: Synthetic coding sequence
atgctgctgtccctgaaaccatctgaggcgccagagctagacgaggatgaagggttcggagactggtctcagcggccagaacaaaggcagcagcacgaaggagcccagggcgcactggattcaggcgagccccctcagtgccgatctcccgagggagaacaggaagatcgcccaggtctccacgcctacgaaaaggaagactccgacgaagttcacctggaagaactgtccctttccaaggaaggccctggccctgaggacacggttcaggacaatctcggggcagcgggtgccgaagaagagcaggaggaacatcagaaatgtcagcagccgaggaccccctcccctttagtcctcgaaggcaccatcgagcagagctcacctcccctttccccaacaaccaaactgatcgacagaaccgagagcctgaatcggagcattgaaaaaagtaactccgtcaagaaatcacaaccagatctgccaatcagcaagatcgatcagtggctcgagcaatatacccaggctatcgagaccgctggccgtacccccaaactggccagacaggccagcattgagctgccatcaatggccgtagcatccaccaagtcccgatgggagacaggggaggtccaggctcagtcagccgctaaaaccccaagttgcaaggacatcgtcgcaggcgacatgtctaagaaatccctatgggaacagaaggggggatcaaaaacatcttctactataaaatcgactccatctggaaaacgctataagtttgtggccaccggtcatgggaaatatgagaaggtgctggtggaagggggacccgcaccctag

SEQ ID NO: 229018 - DNA, 669 bp, Artificial Sequence
  Description of Artificial Sequence: Synthetic coding sequence
atgctgctgagcctgaagccatccgaagctccggagctggatgaagacgaagggtttggagactggagccaacgccctgaacagagacagcagcatgaaggagctcaaggggctctcgactcgggcgagccacctcagtgtagatctccggagggagaacaggaagatcgcccaggacttcatgcctacgagaaggaggacagtgatgaggtgcacctagaggagctgtccctttccaaagagggacctgggcctgaggacacagtccaggataatttgggagctgctggcgcagaggaagagcaggaagaacatcagaagtgtcagcagcctcggactccttcgcctctcgtacttgagggaaccatcgagcagagttcacctccactaagccccaccaccaagttgatagatcggacagaaagcctcaacagaagcattgagaagtctaacagcgtgaagaagagccagcccgatttgcccattagcaagattgatcagtggcttgagcagtacacccaagcgatcgagacagcagggagaacccccaaacttgctcgccaggcgagcatcgagctaccaagtatggccgtcgccagcactaagagccggtgggagaccggggaagtccaggctcagagcgctgctaagaccccttcttgcaaatag

SEQ ID NO: 229019 - DNA, 183 bp, Artificial Sequence
  Description of Artificial Sequence: Synthetic coding sequence
atgctgctgtccttgaaacccagtgaggccccagagcttgatgaggatgagggctttggcgattggagtcagcgcccagaacagcgccagcagcacgaaggggcacagggggctctggacagtggggaaccccctcaatgcaggtcccctgagggagagcaggaggaccgccctggactttag

SEQ ID NO: 229020 - DNA, 669 bp, Artificial Sequence
  Description of Artificial Sequence: Synthetic coding sequence
atgctgttaagtctaaaacccagcgaagccccagagctggacgaggatgagggttttggagactggagtcagcggcctgaacagcggcagcagcatgaaggcgcacaaggagccttggactctggcgaaccacctcagtgtcgctcgcccgaaggtgaacaggaggacagaccaggcctgcatgcctatgagaaagaagattctgacgaagtccacctggaggagctctccctatccaaggaggggccagggccagaggatacagtgcaggataacttgggggcagccggagccgaagaagagcaggaagagcatcagaagtgtcagcaacctagaaccccatctcctttggttttggaaggcactatcgagcagagctctcctccgctgagccccacaaccaaactaatcgaccggacagagagtctgaatagatccatcgagaaatcaaacagcgtcaaaaagtcccaacccgacctacctataagtaagattgaccagtggcttgagcagtatactcaagctatcgagactgccggacgaacaccaaaactggctcggcaggccagtatcgagctgccttcaatggcagttgctagtacaaaatcccgatgggaaacgggggaagtgcaggcacaatcagcagcaaaaactccgtcttgcaagtag

SEQ ID NO: 229021 - DNA, 381 bp, Artificial Sequence
  Description of Artificial Sequence: Synthetic coding sequence
atgctgctgtcattaaaaccatctgaagctccggaactagacgaggacgagggtttcggtgactggagccagagacccgaacagaggcagcagcacgagggcgctcagggggctctcgattcaggcgagccccctcagtgtcgtagccccgagggcgaacaggaagacaggcctgggctacacgcatatgaaaaggaggatagcgatgaggtacacctggaagaactcagcctgagcaaagaagggccaggaccagaagatacagttcaggataatctgggggcagccggtgccgaagaagaacaggaggaacaccaaaagtgccagcagccacgaaccccgtcacccctggtgttggaaggaactatcgaacagtcatag

SEQ ID NO: 229022 - DNA, 195 bp, Artificial Sequence
  Description of Artificial Sequence: Synthetic coding sequence
atgctgctctctttgaaaccttctgaagccccagagctcgatgaggacgagggtttcggagactggagtcaaagacctgagcaaaggcagcagcatgagggggctcagggagccctcgacagtggggagcccccacagtgccggtcccccgagggcgagcaggaggataggcctggcctgcacgcatacgaatag

SEQ ID NO: 229023 - DNA, 1404 bp, Artificial Sequence
  Description of Artificial Sequence: Synthetic coding sequence
atggcaccaatctggtctccgcctgggagggtgtcaggttgccacctgtcaagcggccctgccccaggatcagcggtggggccatggctcggcactccacacccctcattacctctgccccttgcgccacataaacccccacctccaggacttcctggaagcgccggacagacctctctgcccgcacagcgggagtgcgtgtttcctggagacgctgccgtccaccaggaactttgcggactgggattcgaggagtgtttgggaagtattccgcaggctcaccagtgttatctgaccaatggccctaagcggcgaaaatgcagcccacgcaggcggggacgggctccagcttggttgtgtggcggatcacccccatgtcatcaaggcctgggccacgagcacccctcgtccggaccaagcacaaattgctcaccgagacctaccgctcagtggtctgttgaggacgaggaggaagcagtgcatgagcaatgccagcacgagagagatcgacagctgcaggctcaagacgaagaaggaggtggccatgtgcctgaaaggcctaaacaggagatgctactgtctttgaagccttctgaggccccagaactcgatgaagacgagggattcggtgactggtcacagagaccagagcagcgccagcaacacgagggtgctcaaggggctctggattctggggaaccccctcagtgccgaagccctgaaggggagcaagaggaccggccagggttgcatgcctatgaaaaggaagactctgatgaggttcacctggaggagctctcattgagcaaggaaggacccggacctgaggatacagtgcaggacaatctgggagccgctggcgctgaagaggaacaggaggagcaccaaaaatgtcaacagccgcgaacaccctcaccacttgtcctagaggggacaattgaacagtctagtcctcccctgagtcctacgactaagctgattgataggacagagagtctaaaccgctctattgagaaatctaattctgtcaaaaagtctcagccagacttgcctattagtaagattgaccagtggttagaacagtatacccaggccatcgagaccgctgggagaaccccgaaactggcaagacaggcatctattgagctgccttctatggctgtagccagcactaaatctcggtgggagaccggcgaagtccaagcacagtcagcagctaagaccccgagctgcaaggatattgttgccggtgacatgtcgaagaagtcgctctgggagcagaagggcggatcaaaaaccagctcaacgatcaaatctactccttctggtaagcgctacaagtttgtggctacgggccacgggaagtatgagaaggtcctcgtagagggaggacctgcgccatag

SEQ ID NO: 229024 - DNA, 618 bp, Artificial Sequence
  Description of Artificial Sequence: Synthetic coding sequence
atgactccaccagagagactgtttttaccacgggtttgcgggacaacgctgcacctgctgctcctgggactactccttgtgctgttaccgggtgcacaggggctcccaggagtgggactgacacccagcgcggcacagactgcccgacagcaccctaaaatgcacctggcccatagcaatctcaagcccgctgcgcacctgattggcgatccttccaaacagaacagtttactatggcgggctaacactgaccgtgcatttctgcaggacggcttttccctctctaacaacagcctactcgttcccacctccgggatctatttcgtgtactcacaggtggttttcagtgggaaggcatattctcccaaggctacatcaagccctctttatctcgcacacgaagtccagttattttcatcccaatatccctttcatgtcccgctcctgtcctcgcagaaaatggtctatcctgggcttcaagaaccgtggctgcacagcatgtaccacggtgctgcattccagcttactcaaggtgaccagctgtcgacccacaccgacggcatccctcatcttgtcctgtcaccaagcactgtgttctttggagccttcgcgctttag

SEQ ID NO: 229025 - DNA, 618 bp, Artificial Sequence
  Description of Artificial Sequence: Synthetic coding sequence
atgacacctcccgaacggttgtttcttccacgggtctgcggcactacgctacacctgctccttctaggactattgcttgtccttctgccaggtgcacaaggcctccctggcgtcggcctgactccctctgctgcacagaccgcacgccagcatccaaagatgcatttagcccactccaatctgaagccggctgcgcacctgatcggagatccttcgaagcagaatagcctgctctggcgagctaacaccgatagagcgtttctgcaggacgggttctcactctcaaataactctctgctcgtcccaacctccggcatctacttcgtttattcccaggtggtcttctctgggaaggcctatagtccgaaagctacaagctctccattgtacctggcccatgaggttcagcttttttccagccagtaccccttccacgtcccactgctgtccagccagaaaatggtgtaccccggtctgcaggaaccctggcttcactcaatgtaccacggggctgcgtttcaattgacccaaggagaccagttgagcactcataccgatgggataccccacctcgtgctaagcccatccacagtgttcttcggcgcttttgctctctag

SEQ ID NO: 229026 - DNA, 618 bp, Artificial Sequence
  Description of Artificial Sequence: Synthetic coding sequence
atgaccccacctgagagactgttcctcccgagagtgtgcggaactacccttcaccttttgctgctgggtttattgctggtactcttgcccggtgctcaaggtctcccaggggtggggttgaccccttcagctgcacagacagcacgtcagcaccctaagatgcatctggctcactccactttgaaacctgcggctcacctaataggagaccccagcaagcagaattcacttctctggagagcaaataccgacagggcctttctccaggatggcttctctctcagcaacaactccctactagtacctaccagcggcatttatttcgtgtactcacaagtggtttttagcgggaaagcttactcccccaaagccaccagcagccctctgtatctcgcccacgaagtccagctgttctcctcccaataccccttccacgtgccgctgctgtcatcacagaagatggtgtaccctggcctgcaagaaccatggcttcattctatgtaccatggtgccgctttccagctcacccagggcgaccagctcagtacgcatacagatggcatcccgcacctggtcttgagcccctccacggtttttttcggcgcatttgcgctttag

SEQ ID NO: 229027 - DNA, 618 bp, Artificial Sequence
  Description of Artificial Sequence: Synthetic coding sequence
atgaccccacccgaaaggctattcctgcccagagtgtgtggaacaacactgcacttgctcctgttaggcctcctgctggtcttattgcccggtgctcaaggtctcccaggcgtgggactaaccccgtcagccgcacagacagctaggcaacatcccaagatgcacctcgcacattcaacactcaagcctgccgctcatctgatcggtgacccctccaagcaaaattcactcctgtggcgggctaacactgaccgtgcttttctgcaagacggcttctcactgtctaacaacagcctattggttcccacttctggaatttatttcgtgtattctcaggtcgtattctccggcaaagcatactctccaaaagccacctcatctcctctttacttggcccatgaagtccagctgttctcttcccagtatccattccatgtgccactacttagctcacagaagatggtgtatccaggtttgcaagaaccttggctccacagcatgtaccatggcgcagcattccagcttacccagggcgaccagctgtccacccataccgacgggattccacacttggtcctgtccccctctacagtcttcttcggcgcttttgcgttatag

SEQ ID NO: 229028 - DNA, 618 bp, Artificial Sequence
  Description of Artificial Sequence: Synthetic coding sequence
atgacccctccggagagactgtttcttccaagggtgtgcgggacaacactccacctgttgctgctgggcctcttgcttgtgctgttaccaggcgctcaggggctccctggcgtggggctgactccctcagctgcccaaaccgctcgccagcatccgaaaatgcacctggcgcactccaccttaaaacctgctgcccatctgatcggcgatccttcaaagcagaattcgctgctttggcgggctaatacggatcgcgctttcctccaagacggattttccttatcgaataatagcctgctggtacctactagcggtatttactttgtctatagccaggtggtgttcagcggcaaggcttatagtcctaaggcgaccagcagtcccctttacctggctcatgaggtgcagctgttctcttcacagtatccttttcacgtgcctcttttatcgtcgcagaagatggtttaccctgggttacaggagccctggctgcattccatgtatcacggtgctgcctttcagctcactcagggcgaccaactgtcaactcatacagacggaattcctcaccttgtgctgagcccaagtacagtcttcttcggcgctttcgcgctgtag

SEQ ID NO: 229029 - DNA, 618 bp, Artificial Sequence
  Description of Artificial Sequence: Synthetic coding sequence
atgaccccaccagagagactgttcctcccccgtgtacgtggcacgaccctccacctcctacttctgggcctcttattggtgcttttaccaggcgctcagggattgcccggtgtcggcctcactccatcagcagcacaaacagcccgacagcaccccaaaatgcacttagctcacagcaccctaaagcccgctgcccacctgattggcgaccccagcaaacagaacagcctcctgtggagagccaatacagatcgggcatttttgcaagatggattttctctgtctaacaatagtctcctggtgccgacttccggaatttactttgtgtactcacaggttgtgttctctggtaaggcctactcccccaaggcgactagctctcccctctatttggcccacgaggtgcagctattttcctcccaatatccgtttcatgtgcctctgctgtccagccaaaaaatggtatatcccggactgcaggagccttggttgcacagcatgtaccacggggctgcattccagttaactcagggcgaccagctgagtacacacaccgacgggatcccacatcttgtcctcagtcctagcacagttttcttcggggcattcgccctatag

SEQ ID NO: 229030 - DNA, 618 bp, Artificial Sequence
  Description of Artificial Sequence: Synthetic coding sequence
atgaccccgccagaacgactctttctccccagagtgtgcggcaccacactgcacctcctgcttctcggactgttgctcgtcttgctgcccggtgcacaaggactgccaggcgtgggtctgaccccctcagctgcccagactgcaaggcagcatccaaaaatgcacttagcccactctactctgaagccagctgcccacctcatcggggacccaagcaagcagaatagtctcctctggagagctaacacagaccgggcttttttgcaggatggtttctcacttagcaataactccctgctggtgcccacttccgggatctacttcgtttattcccaggttgttttcagtggaaaagcctactcccccaaggccacctcaagtccattgtaccttgcacacgaagttcagctcttctccagtcagtacccctttcatgtgccgttgttgagctctcagaaaatggtctatcctggcctgcaggaaccttggttacactccatgtaccatggagctgccttccagctgactcagggcgatcagttaagtacccatacagacggaatccctcatcttgtcctgtccccaagtaccgtctttttcggggcttttgccctctag

SEQ ID NO: 229031 - DNA, 417 bp, Artificial Sequence
  Description of Artificial Sequence: Synthetic coding sequence
atgaccccacccgagcgtctgtttcttccacgggtgtgtgggaccacattacacctgctgttgttggggttgttgctcgtcctgctacccggagcccaaggtctacccggtgtgggactgacaccctcggcggctcagacagcacggcagcacccgaaaatgcacctggcccactctacattgaagccggctgcccatcttatcggcgatccatccaagcaaaattcgctcctttggagggccaacacagatagagcattcctccaggatggcttcagtctgagtaataacagcctgctggtgccaacaagcggaatctattttgtctatagccagggctcctcgccccctctgctgtggcccttccagcaattgaaatcttcactgatcaagtctcctgaattaagtaagaagtag

SEQ ID NO: 229032 - DNA, 618 bp, Artificial Sequence
  Description of Artificial Sequence: Synthetic coding sequence
atgacaccaccagagagattatttttgcccagagtgagagggaccacactgcatttgctcttgctgggattgttgctcgtgctcctacccggtgctcagggcctgcccggtgtggggcttacaccttctgcggcacagaccgcaaggcagcatcccaaaatgcaccttgcccatagtactttaaagccagccgctcacttgattggtgatccctccaagcagaattctttactgtggagagctaatactgatcgtgcgtttctccaggatgggttttccctgtcaaataacagcttgctggtgccaacaagcggaatttacttcgtctacagtcaggttgtgttctccggtaaggcttacagcccaaaggccacttctagcccactttatttggctcatgaagtccagcttttctccagtcaatatccctttcacgtccctctgctgtcctcccagaagatggtctatccagggcttcaagagccctggcttcatagcatgtaccacggcgcagcattccagctaacacaaggcgaccaactgtcaacccacacagatggtattcctcacctggtactctcaccctccaccgtgtttttcggcgcttttgcactttag

SEQ ID NO: 229033 - DNA, 618 bp, Artificial Sequence
  Description of Artificial Sequence: Synthetic coding sequence
atgacccctccggaacgattgttcctaccgcgagtgcggggtacgaccttacatttactcctcctgggactgttgctcgtgctgctgcctggtgctcaaggcctgcccggtgtcggtctcacaccctccgcagcccagactgcccgacagcacccaaagatgcacttggcccatagcacactcaaacctgctgcccatctcatcggggatcctagtaaacaaaattctctcttgtggcgagctaataccgaccgcgctttcctacaggatggcttcagcctgtctaataattcactgctggtccctacctccggcatttactttgtgtactctcaggtggtgttctcagggaaggcgtattctccgaaggcaaccagttcccctctgtacctggcccacgaggtgcaactgtttagttcccagtacccctttcatgtccccctgttgagttcacagaaaatggtctacccaggcctgcaagaaccttggttgcacagcatgtaccatggggcagcctttcagttgacacagggcgaccaactgtctacacacactgatggcataccccatcttgttctctccccctctaccgtttttttcggagcttttgctctgtag

SEQ ID NO: 229034 - DNA, 618 bp, Artificial Sequence
  Description of Artificial Sequence: Synthetic coding sequence
atgacaccccctgaacggctgttcttgcctcgcgtgtgtggaaccacattacacttattgctcctcggccttctgctcgttctgcttccgggagcgcagggcttgcctggtgtcggattgacaccctcggcagcccaaaccgcccgacagcatcccaagatgcacctagctcatagcacgctcaaacccgctgcccacctcatcggagatcccagtaagcagaactcccttttgtggagggctaacaccgatagggctttcctccaagatgggttctcactcagtaataactcactgctcgtgcctacctccggtatttattttgtttattcacaagtagttttcagcggtaaggcttacagtccaaaagctacctcctcccctctgtatctggcccatgaggtgcaactcttttccagccaatatccatttcacgtgcccctactgtcatcccagaagatggtgtaccccggtctgcaggaaccttggctccactccatgtaccatggcgcagcgtttcagttgacacaaggtgatcagctttctactcatactgacggcattcctcacctggttctgtcaccttccaccgtgttttttggtgctttcgccctatag

SEQ ID NO: 229035 - DNA, 618 bp, Artificial Sequence
  Description of Artificial Sequence: Synthetic coding sequence
atgacaccaccagagcgcttgtttctgcccagagtttgtggcaccactctgcacctcctgcttctagggcttctcctggtcctcttacctggtgctcagggcctccccggtgtgggactgacaccatccgctgctcagaccgcaagacagcatcccaagatgcacctggcgcattccacgctgaagcccgcagcccatctgatcggtgatcctagcaagcaaaactctctcctgtggcgcgctaatacggaccgggctttcctgcaggatggattctcactttctaacaactctctgctcgtgccaacgtccggaatctacttcgtgtatagtcaggtggtcttctccggtaaagcatactctccaaaagccacatcctctccactgtacctcgcccatgaggtgcagctttttagcagccagtatcccttccatgtgccccttctttctagccagaaaatggtatatcccggtctccaggagccctggttgcactccatgtatcatggcgctgctttccagttgactcagggagatcaactttctactcacaccgatggaatccctcatcttgtcctcagtccatccactgtgtttttcggtgccttcgcactctag

SEQ ID NO: 229036 - DNA, 618 bp, Artificial Sequence
  Description of Artificial Sequence: Synthetic coding sequence
atgacaccaccagagcgcctgttcttgcctagggtgagggggacaaccttgcacctcctgttacttggtcttttgcttgtgctgctgcctggcgcacagggattgcctggagtcgggttgacccccagcgccgctcaaacagctagacagcatccgaaaatgcacctggcccattctactttgaaaccagccgcacatctgattggcgacccatcgaaacagaatagtttgttgtggcgtgcgaatacagacagagctttcttgcaggatggattcagcctctctaataattcactcctggtcccaacttcaggtatctatttcgtgtacagtcaggtcgtgttcagtggtaaggcctatagccccaaggctacctctagccctctgtatttggcccacgaggtgcagctattttcttctcagtatccatttcacgtccctctcctcagctcccagaaaatggtatatccagggctgcaggaaccctggctccattcaatgtaccacggcgctgccttccagttgacccagggggatcaactcagtacccacaccgacggaatcccacatcttgtgctgtcaccaagcacagtcttcttcggggctttcgcactgtag

SEQ ID NO: 229037 - DNA, 417 bp, Artificial Sequence
  Description of Artificial Sequence: Synthetic coding sequence
atgacgcccccagaaaggctgttcctccccagggtgcggggtacaaccttacatctactactcctcggactgttgctcgtgctgttgcctggagcacaggggctgcctggagtgggcttaaccccaagcgctgcgcagaccgccagacagcaccctaaaatgcatctggcgcatagcactctcaagccggcagctcatttgattggtgacccttccaaacagaacagcttgctctggagggcaaataccgacagagcgttccttcaggacgggttctccctgtccaacaactcgcttctggtgccaacaagtggcatctactttgtctatagtcaaggaagcagtcctccactcttatggcctttccagcagctgaagtccagcctgattaagtctcctgagctgagcaagaagtag

SEQ ID NO: 229038 - DNA, 474 bp, Artificial Sequence
  Description of Artificial Sequence: Synthetic coding sequence
atgactcccccagaacggctgtttctgccgagggtctgtggtactaccctccatttgctgctgctcggcctgctgcttgtgttactacctggtgcccaaggcctgcctggcgtcggcctcacgcctagcgcagcacagaccgctcgacagcaccctaagatgcatttagcgcatagcaaccttaaacctgcagcccacctgattggggacccctcaaaacagaacagcttgctgtggcgtgcaaacacagatcgcgctttcctccaggacgggttcagcctgtcaaacaattcactgttggttcctaccagcggaatatacttcgtctacagccagctacctgaagatggagttagccgcgcagccggtactctggccgcactcgacgtgcccaggggatgtgtccctgcccacccgggaagaccagctatccacccacacagatggcatcctccacccagcccccagccgtag

SEQ ID NO: 229039 - DNA, 417 bp, Artificial Sequence
  Description of Artificial Sequence: Synthetic coding sequence
atgactccacctgaacgtctgtttctcccaagggtttgtggtactaccctccacctcctcctcctggggctcctgctggttctgctgccaggcgcacagggtctccctggcgtgggactgaccccttccgctgctcagacagcaaggcagcatcccaagatgcatttggcccactcaacactgaaaccagctgcacacctgataggcgaccccagcaaacaaaactcattattatggagagcaaatacagacagagcttttctgcaggatggcttcagtctctccaacaactctttattggtgcccacatcaggcatatattttgtatattcacaaggcagcagtccacccctgctctggccatttcaacagctgaaaagttcactcattaaatccccagagctgtctaaaaaatag

SEQ ID NO: 229040 - DNA, 417 bp, Artificial Sequence
  Description of Artificial Sequence: Synthetic coding sequence
atgacccctcccgagaggctgttcttgccgagggtttgcggtaccactctacatttgctcctgctaggccttctgctcgtgctgttacccggtgctcagggacttcctggcgtcggcctgaccccgtctgccgcacaaacggccaggcaacacccaaaaatgcacctggctcactctacattgaagcctgcagcccacttgatcggtgaccccagcaaacagaacagtctcctgtggcgagccaatactgatcgagcttttctccaagacggcttttctctcagcaataactccttgttagtacctacctcaggaatttatttcgtctacagccagggaagttccccaccgctcctttggccattccaacagctgaagtcttcgttgataaagtctccagagctctccaagaaatag

SEQ ID NO: 229041 - DNA, 417 bp, Artificial Sequence
  Description of Artificial Sequence: Synthetic coding sequence
atgacccccccagagaggctctttctaccaagggtgaggggcacaaccttgcacctcctgttgctaggattgctgctcgtgctcctgccaggggcacaggggttgcctggagtcggccttactccttccgctgcccaaacagccagacagcacccgaagatgcaccttgctcatagcacattaaaacccgctgcacacttgattggcgatccttccaaacaaaattccctactctggcgcgcaaatacagatagggcctttctgcaggacggcttctctttgtccaacaatagcctgctcgtacccacctcgggtatctactttgtttactcccaggggagctctccccctctgctgtggccttttcagcagttaaagagtagcctgataaaaagcccggagctctctaagaagtag

SEQ ID NO: 229042 - DNA, 735 bp, Artificial Sequence
  Description of Artificial Sequence: Synthetic coding sequence
atgggggcattggggttggaagggagaggtggcaggttacagggtcggggatctttgctcctcgccgtggctggcgctaccagcctggtaacactgctgctcgcagttcctattaccgtacttgcggtgctggctctagtgccccaagaccagggaggtcttgttacagaaacggcagatccgggtgctcaggcacagcagggcctcgggttccaaaagttacccgaagaagagcctgaaacggaccttagcccgggtctgccggcagcccaccttattggcgcaccccttaagggccagggacttggctgggaaacaaccaaggaacaggcatttttaacatccggcacacagttctcagacgctgaagggctggctttgccccaggacgggctgtactacttgtattgtcttgtgggatataggggtcgggcaccccctggcggaggagaccctcaggggaggtccgttacgctgaggtcaagtctctatagagccggaggcgcatacggacctggaacccccgagctgctcctagagggcgcagaaactgtgacccccgtgttggatcctgctcggagacaggggtacggaccactatggtatacatctgtgggtttcggtggtctcgtgcagctccgcaggggggagcgagtttacgtaaacatctcacatcctgacatggtggactttgccagaggcaaaacattcttcggggcagtgatggtcggctag

SEQ ID NO: 229043 - DNA, 735 bp, Artificial Sequence
  Description of Artificial Sequence: Synthetic coding sequence
atgggtgccctgggcctggaggggcgagggggaaggctgcagggacggggatccctcctcttggccgtagctggggctacaagcctagtgacattgctattagcagttcctattacagtcctggcagtcctcgcactggtcccacaagaccaggggggtcttgtgacagaaactgccgaccccggtgcacaggcccagcagggattaggattccagaaactgccagaggaagaaccagagacggacctgtctcccggtctgcccgctgctcacctgattggggctcccctaaaggggcagggcctgggatgggagaccacgaaagaacaggcctttcttacatctgggacacaattcagtgatgcagaggggctggccctaccccaggatggtctgtactacctttactgcctagtgggctatagaggccgtgctcctcccggtggcggtgacccacaaggtagatcagtcactcttcgatcctctctttatcgagcgggaggggcttatggcccaggcacacctgagttattgctggagggggcagagacggttacccccgtcctagaccctgctcggaggcagggctacggacccctctggtacactagcgtgggattcggtgggctggtacaattgaggagaggcgaacgggtgtacgtgaacatctcccacccagacatggtcgacttcgcaagaggcaagacgtttttcggcgcagtcatggtgggatag

SEQ ID NO: 229044 - DNA, 735 bp, Artificial Sequence
  Description of Artificial Sequence: Synthetic coding sequence
atgggggctttgggcctggaaggccgtggaggacggctgcagggcagagggtccttacttctggcagtggctggagccacaagcttagtgaccctgttactcgcggtacctatcaccgtgctggccgttctggcactcgtgccccaggatcaggggggactggtgacagaaactgcagatcctggtgcccaggcacagcagggattgggatttcaaaagctgcctgaagaagagccagaaacagatttgagcccgggattgcctgccgcacatctgattggagcacctttaaaagggcaagggcttggctgggaaaccactaaggagcaagcattcttgacgagcggcacacagttctccgatgctgaagggctggcgctacctcaagacggactttactatctgtattgtctggtgggctacaggggcagggccccacccggtggaggcgatccgcagggaagatctgtgaccttaaggtctagcttgtaccgagccggtggggcatacgggccaggaacacctgagctgctgctggagggtgcagagactgttactcctgttctggacccggcacgccgacaaggttatggcccactgtggtatacaagtgtgggctttgggggtctggtgcagctgcgaaggggagaaagggtatatgttaatatctcacaccctgacatggttgactttgccagaggaaaaaccttctttggcgctgtgatggtagggtag

SEQ ID NO: 229045 - DNA, 735 bp, Artificial Sequence
  Description of Artificial Sequence: Synthetic coding sequence
atgggagccctgggcctagaaggccgtgggggacgcctgcaggggaggggctctctcctgctggccgtggctggagcaaccagtctagtcaccctgctcctggccgtacccatcacagtactcgcagtcttggccttagttccacaggaccaggggggtttagtgacagaaacggcagaccctggcgcacaggctcagcaagggcttggttttcagaagcttcccgaggaagagcctgagaccgacctttctcccggtctgccggctgcccacctcattggagccccactgaagggccaaggacttgggtgggaaaccaccaaggaacaggcgtttctcacaagcgggacacagtttagcgacgccgaaggacttgcactgcctcaggatggactctattatctgtactgcctggtgggttacaggggcagggctccccctgggggtggcgatccacagggacgctccgtgaccctgagatcgtccctttacagggctggcggtgcatacggccctggcacccccgagcttctgctggaaggagccgagaccgtaacgcccgttctggatccggctagaaggcaaggatatggccctctatggtacacatccgttggctttggaggtctcgtccagctacggaggggcgagcgcgtgtacgttaacatctctcaccctgacatggtcgattttgccaggggcaaaacatttttcggggcagtgatggttgggtag

SEQ ID NO: 229046 - DNA, 735 bp, Artificial Sequence
  Description of Artificial Sequence: Synthetic coding sequence
atgggagcactgggcttggaggggagaggtggacgactgcagggaagaggaagccttctgctggcagttgccggagccacctccctcgtgactcttctgctggccgttcccataactgtcctggccgtactggctcttgtgccccaagatcagggcggtctggtgactgaaactgctgatccaggtgcccaggctcagcaaggcctcgggttccaaaagcttcccgaggaggagcctgaaacagatctgagccctggccttcctgcagcccatctgatcggtgcacccctcaaaggccaaggactggggtgggagacaaccaaggaacaggcctttttaacgagtggaacacagttctctgatgcggagggactagcactgccccaggatggcctgtactatctgtactgtctagttggctatcggggtcgggctccccctggcggaggggacccacagggacggagcgtcactctacgaagcagtctgtacagagccggtggggcttatggacctggtacacctgagttacttttggagggggctgagactgtgacccctgtgctcgaccctgccaggagacaggggtatggacctctttggtacacgagtgttggtttcgggggtttagtgcaactccgcaggggcgagcgagtctacgtcaatatatcccacccggacatggtggatttcgcccgaggcaagaccttttttggtgccgtgatggtgggttag

SEQ ID NO: 229047 - DNA, 735 bp, Artificial Sequence
  Description of Artificial Sequence: Synthetic coding sequence
atgggggcactcggactggagggtcgaggcggtagacttcagggcaggggcagtctgctgctggccgtggcgggagccaccagcctggtcacgttgctgctagccgtccctatcaccgtgctcgccgtgctggcactggtaccccaagatcagggtggactggtcactgagaccgcggatccgggagcccaggcacagcagggactcggcttccagaagctgccagaggaggagccagagacggacttgtccccgggactccccgctgcgcacctgattggagccccattaaaaggacagggcctgggctgggagacaacaaaggagcaggccttcctgaccagtggaacccagttctccgacgctgagggcctggccctgccccaggatggcctctactatctatactgtcttgttgggtaccggggacgggctccgccaggaggaggagatccccaagggcgtagcgttacacttcgcagtagcctctatagggccggtggcgcttacgggccagggacacccgaactattgttagaaggagccgaaaccgtgactccggtcctcgaccctgccagacgacaagggtacggacccctctggtatactagtgtcgggtttggaggcctcgtgcagttacgccgtggcgagagagtatacgtgaatatctcccacccagacatggtggactttgccaggggaaagacgttttttggggcagtgatggtgggttag

SEQ ID NO: 229048 - DNA, 234 bp, Artificial Sequence
  Description of Artificial Sequence: Synthetic coding sequence
atgggtgccctgggtctggaaggaaggggcggtagactgcaaggcaggggctctctactgctggctgtggcaggcgcaacctcgctcgtcactctgctgctagcagtgcctattactgtgcttgctgttctggccctggttccgcaggatcagggcggtctgggcttccggagttgtcaacgcagatctcaaaaacagatcagcgctcccggttcgcaactgcccacgtcctag

SEQ ID NO: 229049 - DNA, 735 bp, Artificial Sequence
  Description of Artificial Sequence: Synthetic coding sequence
atgggtgctctgggcctggaaggcagaggaggaaggctccagggcaggggcagtttactgctggctgtagccggtgcaacttccttggtgaccttgctgttggcggtccctattaccgtcctcgctgtgctggccctcgtcccccaggaccagggaggtcttgtaaccgaaaccgctgatcccggtgctcaggcccagcagggactaggatttcaaaaacttccagaagaggagccagagacagatctgagtcctggccttcccgcagcccacttgattggagccccactaaaaggtcagggcctggggtgggagacgacgaaagaacaggcctttttgacctccggaacacagtttagtgacgccgagggcctggctctacctcaggatggtctgtactatctgtactgtctcgtggggtatcgtgggagagcaccacccggagggggagaccctcaggggaggtccgttaccctgcgctcctccttgtatagggccggaggggcttacggtccaggtacgcccgagctcctacttgagggagccgagaccgtgacacctgttctggacccagcgcgaaggcaagggtatggtcctttatggtacacctccgtagggttcggaggcctggtccagctcaggcgcggtgaaagagtgtatgtaaacatctcacatccagatatggtggatttcgctcgtggaaagacgtttttcggtgccgttatggtgggttag

SEQ ID NO: 229050 - DNA, 735 bp, Artificial Sequence
  Description of Artificial Sequence: Synthetic coding sequence
atgggtgcactgggcctggaggggaggggtggcaggttacagggtagggggagcctgctgctagcagtggctggcgcaacgtccctcgtcaccctactgttggcagtccctatcactgtattggctgtgctggccctagtgccccaggatcagggaggcctcgtgacagagacggcagaccccggagcacaggcccagcaaggccttggttttcaaaagcttcctgaggaagagcctgaaactgatctatcacccggactgcccgctgcacatcttatcggcgcaccactgaagggacaggggctaggatgggaaaccaccaaggaacaagcctttttgacatcgggcacgcaatttagcgatgccgagggacttgcgctgccccaggatgggctgtactatctctactgtctagtggggtatagagggagggcacccccaggagggggagacccacagggcaggtctgtcactctgaggtctagtctctaccgggcaggtggcgcatatggtccgggaacccccgaactgctcctggaaggagcagagacggtgacaccagtgctggatccggcacggagacagggatatggcccactgtggtacactagcgtcggcttcggcggacttgtccagctgcgcagaggcgagagagtgtacgtcaacatcagccatcccgatatggtagattttgccaggggcaaaacattcttcggagcagtcatggtaggctag

SEQ ID NO: 229051 - DNA, 276 bp, Artificial Sequence
  Description of Artificial Sequence: Synthetic coding sequence
atggctgcatcctcccgagcccaggtgttgagtctctacagagctatgttgcgggaaagcaagcggtttagcgcttataactatagaacttatgcagtgcggaggatcagagacgcattccgcgaaaataagaacgtaaaggatccagtggagattcagaccctggtgaacaaggccaaacgcgacctcggagtgatcagacgtcaggttcacataggccagctgtattctacagataagttgatcattgagaacagagacatgcctcgcacttag

SEQ ID NO: 229052 - DNA, 393 bp, Artificial Sequence
  Description of Artificial Sequence: Synthetic coding sequence
atggcggctagcagtcgcgctcaggtgctgagcttatatagagcaatgcttcgcgagtcaaaacgatttagcgcctataattatagaacctatgccgtgagaagaataagagacgcgtttcgtgaaaataagaacgtcaaggatcccgttgaaatccagaccctggtaaataaggccaaacgggacctgggtgtgatccgccgtcagatggacagccatagtgtggctcaggctggggtgcactggaacgacctcagcagtctgcagcccctcccgccatggtttaagcagttttcttgcctcagcctgcctagcagttgggactaccggagaactccccctcgcttagccaatttttgcatcctgtccagggacgtaatatccttatactag

SEQ ID NO: 229053 - DNA, 291 bp, Artificial Sequence
  Description of Artificial Sequence: Synthetic coding sequence
atggctgctagctcaagggcacaggttctgtctctgtaccgggcaatgctacgagagtctaagagattcagcgcctataattacaggacctacgccgtgcgaaggataagggatgccttcagggaaaataaaaatgtgaaggatcctgtagaaatccagaccttagtgaacaaggccaagagagatctcggtgtaatccgccgtcaggtggctgaacagggcactgcagcgaggagaaagagcggtaattcatcccggagcctaggaaagccatgtacatcttggccttag

SEQ ID NO: 229054 - DNA, 2559 bp, Artificial Sequence
  Description of Artificial Sequence: Synthetic coding sequence
atgctctcgggcaaaaaggccgctgccgcagcggctgcagccgctgctgctgcaaccgggacagaggccggtccagggactgctgggggatccgaaaatggctccgaagtggccgcacagcccgcaggcttgagtgggcctgccgaagtgggccctggggcagtgggggagaggaccccccgtaagaaagagcccccaagggcctccccgcctggtggactagccgagccacctgggtcggcgggaccccaggctgggcctaccgtggtgcccggttctgctactcctatggagactggcattgcagagacgcccgagggccgtcgcactagtcgcagaaagagagccaaagtcgagtacagggaaatggacgagtccctggccaacttaagtgaagatgagtactactctgaggaggaaaggaacgcaaaagcagagaaggaaaaaaaactgccccctccccctcctcaggcaccaccagaggaagagaacgagtccgaacccgaagagccgagcggagtggagggggctgccttccagtcacgactgccccatgaccgcatgacatcgcaagaagcggcatgctttcctgatatcatatctgggccacagcagactcagaaggttttcctctttatacgaaacagaacactgcagttgtggctggataacccaaagattcagctgacatttgaagccacactccagcaactggaagccccttacaattctgatacggtactcgtccaccgcgtacacagctatctagaacggcatgggctgatcaatttcggaatatataaacgaattaaaccactccccacaaaaaagacaggaaaagtgatcatcatcggttctggagtgtctggattggccgcagcaagacaactgcagagttttgggatggacgtcacactactggaggctagagacagggtcggaggcagggtggctactttccggaaagggaactacgttgctgatttaggtgctatggtggtgacaggtctgggaggcaatccaatggccgtggtatccaaacaggtgaatatggagctggccaaaataaagcagaagtgtccactgtatgaagccaacggacaggccgtgcctaaagagaaagatgaaatggtcgaacaggagttcaatcgtctcttggaggctactagctacttatcccatcagctcgattttaacgtgctcaataacaagcctgtttctctgggccaggcgctggaagtcgtgatccagctccaggaaaagcatgttaaggatgaacagatcgagcactggaagaaaattgtgaaaacccaggaagagttaaaggagctgctgaataagatggtgaatttgaaagagaagatcaaggaactccatcagcagtacaaagaggcttccgaggtgaagcctcccagagacatcacagctgagttcctcgtgaaatcaaaacaccgcgacctgaccgccttgtgtaaagaatacgacgaacttgcggagacacaaggtaaactggaagaaaaacttcaggagctggaggctaatccaccctccgacgtgtatctcagcagtcgagatcgccagatactcgattggcatttcgccaacctggagttcgcgaatgcaaccccgctgagcacgctaagcctcaaacattgggaccaggatgacgacttcgagtttaccggctcacacctaactgttcgtaatggatactcttgcgtgccagtggccctggcggagggactggatatcaagctgaatactgccgtgcgccaggtcagatacacggcaagcggctgtgaagtgattgcagtgaataccagatcgaccagccagacgtttatctataagtgcgatgccgtgttgtgcactttgcccctgggagtactgaaacagcaacccccagctgtgcagttcgttccacctcttccagagtggaaaacatccgcggtgcagaggatgggatttgggaatcttaacaaagtggttctgtgttttgatagagtcttttgggatccctccgttaatctgttcggccatgtgggttctacaacagccagcaggggagagctcttcctattctggaatttatacaaagccccaatcctcctcgccctcgtcgctggggaggcggctggaattatggagaatattagcgacgatgtgatcgttgggagatgcctggccatcctgaagggaatctttgggtcctcggcagtgccgcagcctaaggagaccgtggtgtccaggtggcgcgcagacccttgggccagagggtcgtattcctatgtggctgccggatctagtggaaacgactacgaccttatggcacagccaataacacctgggccaagcataccgggagctcctcagcctatccccagactgtttttcgccggagagcacacaattagaaactatcccgcaaccgtacacggagcgttattgagtgggttgagagaagcaggcagaatagccgatcagttccttggggctatgtacaccctcccccgtcaggcaacacctggcgtgcctgctcaacagtcacctagcatgtag

SEQ ID NO: 229055 - DNA, 2631 bp, Artificial Sequence
  Description of Artificial Sequence: Synthetic coding sequence
atgcttagtgggaaaaaagcggcagctgcggcagctgcagccgcagcagccgctaccggaacagaagctggacccggaaccgccggtgggtctgaaaatgggtccgaagtggcagcacagcctgcgggacttagcggcccagccgaggtagggcctggggcagtgggagagcgtacgcccagaaagaaggaaccaccaagagcgtctcccccaggcggattagccgagccccctggatccgccggtccccaggctggtcctactgtggtgcccggaagcgctacacccatggagacaggcattgctgagactccagaaggcaggcgcacatcgagaagaaaaagagctaaggtggaatacagagagatggacgaatctctggctaacctctcagaggatgaatactacagcgaggaagagaggaatgctaaggccgaaaaagagaaaaagctgcctcctccgcctccccaggcccctccggaagaggaaaatgagtctgaacctgaagagccctctgggcaggcaggcggattgcaggatgacagcagcggcggatacggagacggccaggcttccggagttgagggcgctgcgttccagtccaggctgcctcacgacaggatgaccagccaggaggccgcttgttttccagacatcatctctgggcctcaacagacgcagaaggtttttctattcatccgtaaccgcacacttcagctgtggctggataatcccaagatccagctgacttttgaggccaccctgcagcagctagaagctccatacaactctgacacggttttggtccatagagttcacagctatctggaaagacatgggctgattaattttggcatatacaagcgaatcaagccactccctacgaagaaaaccggtaaggtcattataattggaagcggtgtgtcagggttggcagcagccagacagctgcaatcattcggtatggacgtcacgttattggaagctcgcgacagagtcggaggacgcgtagccacttttagaaaaggaaactacgtggcagacctcggggcaatggtggtgaccggcctgggtggcaatccaatggcagtggtctcgaagcaggtgaatatggaactggccaagatcaagcaaaagtgccccctgtacgaggcaaatggccaagcggagcgtatcatcgttccaaaggaaaaagacgagatggtggagcaagagttcaatagactactggaggccacctcttacctgagtcatcaactggacttcaacgttcttaacaataagcccgtgtccttggggcaagcgctggaggtggtcatccagctacaagaaaagcatgtgaaggacgaacaaatagagcactggaagaaaattgtaaagacacaggaggagctgaaggaattgctaaacaagatggtcaacttgaaggaaaagatcaaggagctgcatcagcagtacaaagaggcttccgaggtgaagccccctcgggatattacggccgaatttcttgtgaagagtaaacatcgggatttgacggccctgtgtaaagaatatgacgaactggctgaaacccaggggaagctggaagagaaactgcaggaactagaagctaacccccctagcgatgtgtacctaagttctcgcgaccgacagattctggactggcatttcgccaacctcgaattcgccaatgccacccctctctctaccttgtccctcaaacattgggaccaggatgacgatttcgagttcacaggctcccacttgacggtgcgtaatggttacagctgtgtccccgtcgcactggccgagggtctcgatataaaactgaataccgcagtgaggcaagtgagatacacggccagcggttgcgaagtaatcgctgtgaacacccgatccacttctcagaccttcatctacaagtgtgacgccgtactttgtactctcccactgggcgtgctaaaacaacagccacctgctgtgcaatttgtccctcccctgcccgagtggaagactagcgccgtgcaacgcatgggttttggcaacctcaataaagtcgtgctgtgctttgacagagtgttttgggacccttcggtgaatctgttcggacatgtggggtctaccacagcctcacggggagagctgttcctgttctggaatctctataaggcacccatcctgctcgcacttgtggccggagaagcggctggcattatggaaaatatttcagacgatgtgattgttggtagatgtcttgctatactgaagggcatcttcggtagctctgctgttccgcagccgaaagaaaccgttgtctcacgctggcgagctgacccttgggccaggggttcatacagctacgtagccgctggctcttctggtaacgattatgatcttatggctcagcctattacccccggtcctagcattccgggagctccacagcccatccctcgccttttttttgctggagagcatacgatcagaaactatcctgccacagtccatggagccctcctgtcaggcctcagagaagccggaagaattgctgatcagtttctgggagcgatgtatactctgccaagacaggctaccccgggagtacccgctcagcagagtccctctatgtag

SEQ ID NO: 229056 - DNA, 2631 bp, Artificial Sequence
  Description of Artificial Sequence: Synthetic coding sequence
atgctgtccggcaagaaggccgctgcagctgctgccgcagccgcagcagctgctaccgggacagaagctggcccaggtacagcagggggaagcgaaaatggctccgaggtcgcggcacaaccagccggactctcgggaccagcagaggtgggacccggagccgtaggggagcgtacaccacgtaaaaaggaaccgcctcgagcctcacctcctggagggttggcagaacctccaggctccgctgggcctcaggccggaccaacagtagtcccaggctccgcgaccccaatggagacaggtattgctgaaaccccagaaggacgacgaactagtcgacgcaagcgggcaaaggtggaatatcgagagatggatgaaagtctagccaacctgtctgaggatgagtactacagtgaggaagagaggaatgcgaaggccgagaaagaaaagaaactcccgcctcctcccccacaagcacccccagaagaagaaaacgaatcagaacctgaggagccctccggacaggcgggagggttgcaggatgacagtagcgggggatatggggatggtcaggcttctggtgttgagggggctgcgtttcaaagtcgcctccctcatgaccgcatgacgagtcaggaagcagcctgctttcctgacattataagcggccctcagcagacgcagaaagtattcttgtttattagaaaccggaccctgcagctgtggctcgacaatccgaaaatccagcttacctttgaggctacgctgcagcagctggaagccccatacaactctgatacagtattggtgcaccgggttcactcctatttggagagacatgggctgattaatttcggcatatataaaaggatcaaaccactccctacaaaaaaaaccggtaaggtcatcatcatcgggtccggcgtatccgggctggccgcagctaggcagttgcagtccttcggcatggatgtcactctgctggaagctcgggatagagtgggaggtagggtcgcaactttccgcaaaggcaattatgtcgccgatttgggagccatggtggttactggcttgggcggaaacccaatggccgttgtatcaaagcaggttaacatggaactggctaaaattaagcaaaagtgccctctttatgaagctaatggacaggcagacacggtgaaggttcccaaagaaaaggatgagatggttgagcaggaattcaacaggctcctggaagccacttcctacctgtctcaccagctggattttaacgtgctcaataacaagccagtttctctggggcaggcacttgaggtagtaattcagctccaggaaaaacacgtaaaagacgagcaaatcgaacactggaagaagatcgtgaaaacgcaggaagaattaaaggagctgctgaataaaatggttaatctgaaagagaagattaaagagttacaccaacagtacaaggaggcttccgaggtgaaaccaccgagggacatcaccgctgagtttctcgttaagtcgaagcatagggacttgacggccctgtgcaaggaatacgacgagctggcggagacccagggcaagcttgaggaaaaattgcaggagttagaggctaacccgccatccgatgtatacctctccagccgtgatcgtcagattctggactggcacttcgctaatttggagttcgcaaatgcgactccattgtcaaccctttctttaaagcattgggatcaggacgatgatttcgaatttaccggcagccacctaaccgtgcggaacggctattcttgcgtacctgtggccttggccgagggtctcgatatcaagctgaacaccgcagtgcgccaggtgcgctatacagcgagtggatgtgaagttatcgccgtgaacacccgcagtacgtcgcagacttttatttataaatgcgatgcggttttgtgcactttgcccttgggcgtcttgaaacaacagcctccagccgtgcagttcgtacctcctctgccagaatggaaaacatccgctgtacagcgcatggggttcggtaacttgaacaaggttgttctgtgctttgaccgagttttttgggacccctcagttaacttattcggccatgtggggagcactaccgcctctcgcggagaattatttctattttggaatttgtacaaagccccaatcctgttggcgttggtagcgggagaggcggcaggcataatggagaacatatccgacgacgttatagtgggtaggtgtcttgcaattctgaaagggatctttggtagcagcgctgttccccagcctaaagagacagtcgtgtctcggtggcgggcagatccttgggccaggggctcctattcctacgttgctgcagggtcctcaggcaacgattatgatctgatggcccagccaatcacacccggtccctccatccctggggcacctcaacccataccaaggcttttcttcgctggtgagcataccattcggaactatcccgcaacagtgcatggagccctgctaagcgggcttagggaagccggaagaattgcggatcagttcctgggcgcaatgtacacattacccaggcaggccaccccaggagtgcctgcccagcagagccccagcatgtag

SEQ ID NO: 229057 - DNA, 1773 bp, Artificial Sequence
  Description of Artificial Sequence: Synthetic coding sequence
atggcgacccctcggggacgaacaaaaaagaaggcctcatttgatcacagccccgacagcctgcccttgcgtagctcaggacgacaggccaagaagaaggcaactgagacaactgacgaggacgaagacggtgggagtgagaagaagtaccggaagtgcgaaaaggccggatgcacagcaacttgccctgtctgcttcgcctcagcgtccgaacgctgtgctaagaatggttacacttcaaggtggtatcacctctcttgcggcgaacacttctgcaacgaatgttttgatcattactaccggtcacacaaagatgggtatgataagtatacaacctggaagaagatctggacctccaacggcaaaactgagccctcacctaaagcattcatggctgatcagcagcttccctactgggtgcagtgtacaaagcccgagtgccgcaagtggcggcaactgacaaaggaaatccaacttacgccccagatagccaagacctacagatgcgggatgaagcctaacaccgccattaagcccgaaacctccgatcactgctcattaccagaagatctcgaggctcttaccccgcagaagtgcatcccgcatatcatagtacgcggactcgttcggatcagatgtgtccaggaggtagagagaattctctacttcatgaccagaaagggattgattaatacaggcgtcctgtctgtgggcgctgaccagtacctgctaccaaaggactaccataacaagagcgttatcattattggagccggtccggctggcctggccgcagctcggcagctgcataacttcgggattaaggtgacagttctggaggcgaaagaccggataggtggtcgggtgtgggatgataagtcatttaagggcgtgaccgtgggcaggggggcacagattgtgaatggatgcataaacaaccctgtggctctgatgtgcgagcaggtgtctgccagatcttgggatcataacgagttttttgcccagttcgccggagatcacacgttactgactcccggatactccgtgatcatcgaaaagctggccgagggactggatatccaactgaaatcacctgtacaatgcattgactactccggcgacgaggtacaggtcacgacaacggacgggactggatattccgcccaaaaagtgcttgtgaccgtgcctctcgccctccttcagaagggcgcaatccagttcaaccctcctcttagtgagaagaaaatgaaagccatcaattctctgggtgccggtattattgagaagattgcgctgcagttcccctatagattttgggatagcaaagtgcagggcgctgactttttcgggcatgtgcctccgtctgccagcaaaagggggctttttgcagtgttttatgatatggatccacaaaagaaacatagtgtactgatgtctgtgatcgctggtgaagcagtagcctcagtgcggactctcgacgataagcaggtgctgcaacagtgcatggccaccctaagagagctgtttaaagagcaggaggtccctgatcctactaaatattttgtgactaggtggtccacggacccttggatacaaatggcgtattccttcgtgaaaacagggggttccggtgaagcctacgacattatcgcagaggatatccagggtacggtctttttcgccggagaagctacgaatagacactttcctcagaccgtgacgggagcatacctgtccggagtccgagaggccagcaaaatcgcggctttctag

SEQ ID NO: 229058 - DNA, 2463 bp, Artificial Sequence
  Description of Artificial Sequence: Synthetic coding sequence
atggcaactccacgcggtagaaccaaaaaaaaggcttccttcgatcactcccccgactctctaccattgcggtcatccggcagacaggcgaaaaagaaagcaacagagaccacagacgaagacgaagacggagggtcggagaaaaagtataggaagtgcgaaaaagccggttgcaccgcaacttgtccagtgtgcttcgcctcggcctcagagcgatgtgcgaagaacggctacaccagccgctggtatcatctcagttgcggggaacacttttgtaatgaatgctttgaccattattaccgttcccataaagacggctatgataaatacacaacttggaaaaaaatctggacaagtaatggaaagactgaacctagtcccaaggcatttatggcagaccaacagcttccatattgggtccagtgtactaaacctgaatgtcggaagtggaggcaactgacaaaggaaattcagctgacaccacaaattgccaagacttacaggtgcggaatgaagcctaataccgcaattaagcccgagacgagtgatcactgtagcttgcccgaagatctacgggtcctggaagtgtctaatcactggtggtactctatgctgattctgccgccactcctaaaggactccgtggccgctcccttgctgagcgcatactaccccgactgcgtcgggatgagcccaagttgtactagtacaaatagggcagccgctaccggtaacgcctctcccggaaaactggagcatagcaaggcggcactgagcgtgcacgtgcccggaatgaatcgttactttcagcccttctatcagcccaacgaatgtggaaaagcactgtgtgtgagacctgatgtgatggaactggatgagctttatgaattccctgaatatagtcgagacccaactatgtatcttgccttaaggaatcttattttagctctgtggtatactaactgcaaggaggcactgacaccgcagaagtgtattccgcacatcatcgtgagaggactggtccgcatacgatgtgtacaggaggttgagagaatcctttacttcatgacacgaaaaggcctcatcaataccggtgtcctgagcgtgggcgcagatcagtatttgctgcccaaagactatcacaataagagtgtgataatcatcggtgctggcccagcagggctagcggcagccaggcagctccataatttcggcattaaggtcacagtgcttgaggctaaagaccggattggcggaagagtgtgggatgataaaagctttaaaggcgtgacagtggggaggggagcccagatcgttaatgggtgtatcaataacccagtagcgctcatgtgcgaacaattgggtatctccatgcacaaattcggggagcggtgcgacctcattcaggaaggcggtcgcataacagaccccactatagacaaacggatggatttccatttcaacgccctacttgacgttgtcagcgaatggaggaaggataagacacaacttcaagatgttcccctcggcgagaaaattgaagagatctataaagctttcataaaagagtctgggatccagttctctgagcttgaggggcaggttctgcagttccatctatctaacctggagtacgcctgcgggagcaacttacaccaagtctctgcgcgtagctgggaccataatgagttcttcgcccagtttgccggagatcatactctgctcacaccgggttacagtgtgatcattgagaagctggctgagggtctggacatccagctgaagtcccccgtccagtgtatagactatagtggagatgaggttcaggttaccacgacagatgggacagggtacagtgcccagaaagtcctggtgacagtacctctcgctctgctacagaaaggagctatccaatttaaccccccactctcagaaaaaaagatgaaggccattaactccctgggcgctggcatcattgagaaaatagctctccagttcccctaccgcttttgggatagcaaagtgcagggtgccgattttttcggccacgtgccaccctctgccagcaagagaggactgttcgccgtcttctacgacatggatccccaacactctgttctgatgtcagtcatcgcaggcgaggcagtcgcgtccgttcggacactcgacgacaagcaggtgctccagcagtgtatggcgacccttcgagagttattcaaggagcaggaagtccccgaccctactaagtacttcgtgacaagatggtccactgatccatggattcagatggcatattcgttcgtaaagacaggaggttctggcgaggcatatgacatcatcgctgaagacattcagggcaccgtcttttttgctggagaggccactaaccggcacttcccacagactgtcactggagcctacctaagcggcgtcagggaggcctccaagattgctgctttttag

SEQ ID NO: 229059 - DNA, 2472 bp, Artificial Sequence
  Description of Artificial Sequence: Synthetic coding sequence
atggctaccccacgcggacgaacaaaaaaaaaggcttcttttgaccactcacctgatagtctaccgcttcgctcaagtggcagacaagcaaagaaaaaggccactgagactacggacgaggacgaagacggtgggtcagaaaaaaaataccgtaagtgtgagaaggctggttgcaccgccacatgccccgtgtgctttgcatctgctagtgagcggtgtgcaaaaaatggttacacatctaggtggtaccacctgagttgtggagagcacttctgcaatgaatgcttcgatcattactatagatcccataaggacggctacgacaaatatacgacttggaaaaaaatttggaccagtaatggcaaaaccgaaccctcaccaaaggcgttcatggcagatcaacagctcccctactgggtacagtgcacaaaaccggaatgccgcaaatggagacagttgactaaggagattcagctgacccctcagatcgccaaaacttatagatgtggtatgaaacccaacacagccattaaacccgagacctccgatcactgttccctgcctgaagatctgcgggtcctcgaggtgtcgaaccactggtggtactcaatgctcattctccctcctctgctgaaggactctgtcgcagcgccactcctttccgcatactacccagattgcgtgggtatgagcccaagctgtacaagcacaaaccgagccgcagccacaggcaatgcgagccccggtaaacttgaacactctaaggcggcactaagtgttcatgtcccaggaatgaacagatactttcagccattctaccagcccaatgaatgtggcaaggccctgtgtgtgaggcctgacgtcatggagctagacgaactgtatgagtttccagagtactctagagatcctactatgtacctggctttgaggaatctgatcttggctctgtggtatacaaactgcaaggaggcactgacaccgcaaaagtgtatccctcacatcatcgtgcgaggcttggttaggattaggtgcgtacaggaggtggagcgaattctttatttcatgacacgaaaggggcttataaataccggggtactcagtgtgggcgctgaccagtatctgctcccgaaagactaccacaacaaaagcgtgatcatcatcggggcaggacctgctggcctcgcggctgccagacaactgcacaactttggaattaaggtgactgtgcttgaggcaaaggaccgcatcggaggacgcgtgtgggacgacaaaagcttcaagggcgtaactgttggtaggggcgcacagattgtgaatggatgtatcaataatcccgtggctctcatgtgcgaacagctcggcatttcaatgcacaagtttggtgaacgctgcgacctgatccaggagggtgggagaatcactgaccccactattgataagcgcatggatttccattttaacgccctgctcgatgtggtttctgagtggcgcaaggataagactcagctgcaagatgttcccctgggggagaaaattgaagagatctataaggctttcataaaagagagcggcattcagttctcggagctggagggacaagttctccagttccatctttccaacctggaatatgcgtgtgggtccaacttgcatcaggtatctgcaagaagttgggatcataatgaattttttgcccaatttgccggtgatcacacactccttaccccaggctactcagtgattatagagaagctagccgagggcctggacatccagctgaaatccccccaggtgcaatgcattgattattccggagacgaagtgcaggtaactactacagacggcacaggttacagcgctcaaaaggtgttggttaccgtcccccttgcgctccttcagaagggagcaatccagtttaaccctccgttgagcgaaaagaaaatgaaggcaatcaactccctgggcgcagggatcatcgagaaaatagctttacagttcccatatagattttgggactccaaagtgcagggtgcggacttcttcgggcatgtaccaccttccgcctctaagcgcggtctgtttgccgtgttctatgatatggatccccaaaagaagcactcagtcctgatgtctgtgatcgctggtgaggcggtggcttctgtccgtacccttgatgacaagcaagttcttcaacagtgcatggctaccctgcgcgagctttttaaagagcaagaggtacctgatcctactaaatatttcgtgacccgttggtctacagatccctggatccagatggcctattcatttgtgaaaaccgggggatcgggcgaggcctacgacatcatagctgaggacatccaaggcactgtctttttcgctggtgaggccacgaatcgacacttcccacagaccgtgacgggggcatacctaagcggtgtgcgggaagcatccaaaatcgccgctttctag

SEQ ID NO: 229060 - DNA, 1776 bp, Artificial Sequence
  Description of Artificial Sequence: Synthetic coding sequence
atggccaccccacgaggcaggaccaagaaaaaggctagctttgatcatagtccagactcactcccccttcgtagcagcggtcgacaggcaaagaaaaaggcaacagagaccaccgatgaggatgaggacggagggagcgagaaaaagtatcgtaagtgcgagaaagctggttgcactgccacttgccccgtctgcttcgcctccgcgagcgaaagatgtgccaaaaatggatatactagtcgctggtaccatctcagttgtggcgagcatttttgtaatgagtgcttcgaccattattacaggtcccacaaggacgggtacgataagtacactacatggaaaaagatctggactagcaatggtaaaacggagcccagccccaaagcattcatggcagatcagcagctgccttattgggtacagtgcacaaaacccgagtgccgtaaatggcgccagcttacaaaggagattcagttaaccccccagattgctaaaacctacagatgcggcatgaaacccaatacagcgattaaacctgagacctctgaccactgcagcctccctgaggatctggaagccctgacgccccaaaagtgcatcccacatattatcgtccgcggactggttcgcattcggtgtgtccaggaggtggaacgaatcttgtatttcatgacaagaaaggggctgattaatacaggtgtactgtcagtaggagctgaccagtacctgcttcctaaggactatcacaacaagagtgtcattatcatcggagccggacctgcgggtttggctgccgcacgccagctgcacaatttcgggatcaaggtcaccgtgctagaagcaaaagataggatagggggacgggtttgggacgacaagtctttcaagggcgttactgtgggcagaggagctcagatcgtgaatgggtgcataaacaatccagtagcccttatgtgtgagcaggtttccgcccgttcctgggaccacaacgagttctttgcccaatttgctggagatcacaccttacttacccctgggtacagcgttattatcgagaagcttgctgaaggcctcgacattcagctgaagtcaccacaagtgcagtgtattgattactctggcgatgaagtccaggtcactactacagatggcaccggctattccgcccagaaggtgcttgttactgttcccctagccctcttgcagaagggagctatccaattcaacccacctcttagtgagaagaagatgaaagcaatcaatagcttaggcgcagggatcatagaaaagatcgctctgcagtttccctatagattctgggattccaaagtgcagggtgccgacttctttgggcatgtgcccccatccgcatccaaaagaggactattcgccgtgttctacgatatggaccctcagaaaaagcacagcgttcttatgtccgtgatcgctggagaggctgttgcaagtgtgcgaaccttagacgacaagcaggtgctgcagcaatgcatggccaccctgcgcgaactcttcaaggagcaggaagtgcccgaccccacaaaatatttcgtgacccggtggagtaccgacccctggatacaaatggcatactcttttgtgaagacagggggaagtggtgaggcttacgacatcatcgccgaggacattcaggggacggtgttttttgccggagaggccacaaaccgtcactttcctcagactgtcaccggtgcttacctcagtggggtgagagaggcatcaaagatagcggctttctag

SEQ ID NO: 229061 - DNA, 1923 bp, Artificial Sequence
  Description of Artificial Sequence: Synthetic coding sequence
tgatgcagcctacccgaggatctaagagtactggaggtgtcaaaccactggtggtacagtatgctgatacttccaccactcttaaaggactcagtggcagcacccctgcttagcgcttactatcctgattgcgtgggtatgagcccctcatgtacctccacaaaccgggcagccgctaccggcaacgcaagccccggaaagttagaacattctaaagcagcgctatcggttcatgttcccggaatgaatcgttatttccagcccttttaccagcccaacgaatgcggaaaggctctttgcgtcagaccggatgtgatggaactggacgaactgtacgaatttcccgaatactcccgggacccaactatgtacctggctttgcgtaacctcatactggcgctgtggtacactaattgtaaagaagctctgactccgcagaagtgcatcccccacatcatcgttcggggattagtgcgcatccgatgcgtgcaggaagtcgaaaggatcctgtacttcatgacacggaaggggttaattaacacaggagtgctgagcgtgggggcagaccagtacctattgcccaaagactaccacaacaaatctgtaattattatcggcgctgggcctgccggacttgcagcagccaggcagctccacaattttggaataaaggtgacagtgctggaagccaaagatcgtataggaggtagggtttgggacgataagtccttcaagggagtgactgtaggaaggggtgcacagattgtcaacggatgcatcaataacccggttgccctcatgtgtgagcagttgggcatctcaatgcataagtttggcgaacgttgtgacctcatccaggagggcggaaggattaccgatccgaccatagacaaaagaatggactttcatttcaacgccctactggacgtggttagtgagtggcgtaaagataaaacacaactccaagacgttcctttgggggagaagatcgaggagatttacaaagccttcataaaggagtcagggatccaattttcggaactcgaaggtcaggtcctccagttccacctcagcaacctcgaatacgcgtgcggctccaatctgcatcaagtatcggcacgctcctgggaccataacgagttcttcgcccagttcgccggtgatcacactctgttgacacctgggtactctgtgatcatcgaaaaactggccgaaggtctcgacatacagcttaaatcaccacaagtgcagtgtatagactattctggcgacgaagttcaggtcaccacaaccgacgggactggctacagcgctcagaaggttctcgtgaccgtgcctctggctctactgcagaaaggcgcaatccaattcaaccccccattgagcgagaagaagatgaaggccatcaattcacttggcgctggcatcattgagaagattgccctgcagttcccctatagattctgggattcaaaagttcagggcgctgacttcttcggccatgtgccaccttcagcttccaagcggggactgtttgcagtcttttacgatatggacccccaaaagaaacactcagtgctaatgtcagtcattgctggagaggccgtagccagtgttaggacgctggatgataaacaggtgcttcagcagtgtatggccacactgcgagaactctttaaggaacaagaagtacccgaccccacgaaatatttcgtcacccgctggtctacagatccatggatacagatggcctacagcttcgtcaaaacaggaggctcaggtgaggcatatgacattatcgcagaggatatccagggcacagtcttcttcgcaggggaggcaaccaacaggcactttcctcaaacagtgacgggcgcttacctctctggggttagggaagcttccaagatcgccgcattctag

SEQ ID NO: 229062 - DNA, 342 bp, Artificial Sequence
  Description of Artificial Sequence: Synthetic coding sequence
atgagcgtgattgcaggtgaagcagtggccagcgtgcgaacgttggacgacaagcaggttttgcaacagtgcatggccacacttagagagctattcaaggagcaagaagtgcccgatccaacaaagtactttgttacacgatggtcaacggacccatggattcaaatggcatactcttttgtgaaaactggcggatctggggaggcttacgatatcattgctgaagacattcaagggaccgtgttcttcgccggagaggccactaatagacatttcccacagacagtcacaggcgcttacttatccggagtgcgcgaggcgagcaaaattgccgcattctag

SEQ ID NO: 229063 - DNA, 3966 bp, Artificial Sequence
  Description of Artificial Sequence: Synthetic coding sequence
atggtcctgactctaggtgaatcgtggcccgtgctagtaggcagacgcttcttaagcctgagtgcggctgacggctccgacggctctcacgattcttgggacgtggaacgcgtagcggaatggccttggttaagcggcactattagggcagtgtctcacaccgacgtgacgaaaaaagacctgaaggtatgcgtcgaattcgacggggaatcctggaggaaaagaaggtggatagaggtgtattctttgctgaggagggcctttctcgttgaacacaacctggtcctcgccgagaggaagtcacctgaaattagtgagcggatagtccagtggcccgcaataacttacaagcccctgctggacaaagctggcctaggctcaatcacctccgttcgcttcctgggagatcagcagagagtgtttctcagtaaagacttgttgaagcccatccaagacgtgaactcgctgcggctctccctcactgacaaccagatagttagtaaagaatttcaggccctcattgttaagcacctggacgagagccacctcctgaagggggataagaatttggtaggtagtgaagtgaaaatctattccctggacccgtcaacgcaatggttcagcgcaaccgtaatcaacggcaatcctgccagtaaaactcttcaagtaaactgcgaagagatcccggctctcaaaatcgtggatccgagcctgattcatgtggaggtagttcatgacaatctggtgacctgcgggaactctgccagaatcggcgcagtgaaaagaaagtcctcagagaacaacggcacattggtgtcgaagcaggccaagagctgctcagaggcctccccctccatgtgccccgtgcagtccgtgccaaccactgtgttcaaagagatcctcctgggctgcaccgccgcaacacctccttctaaggatccacgacagcagagtacccctcaagctgcaaactccccgcctaacctcggcgcaaaaataccccagggatgccataaacagagtctacctgaggagataagttcctgcttgaacaccaaatcagaagctctgcgcaccaaacccgacgtctgtaaggctgggctcctgagtaaatcctcgcagatcggcaccggggacctgaaaatcctgaccgaacctaagggcagttgtacacaaccaaagactaacacagaccaggaaaaccgacttgagagtgttcctcaggccctgacaggactgccaaaggaatgcctgcctaccaaggcttctagcaaggcagagctcgaaattgccaatcccccagaactgcagaagcatctggaacacgcaccctcaccctccgacgtctctaacgcccctgaggtgaaagccggtgttaactcggactctccaaataattgttcgggaaaaaaggtagagcctagcgctcttgcttgcagatcacagaacctgaaagaatcgtctgttaaggttgataacgagtcctgttgctcacgctcaaataacaagatccagaatgccccttctcgaaaaagtgtgctgactgacccggcaaaattgaaaaagttacagcaatccggagaggcttttgtgcaggacgacagctgtgttaatatcgtcgctcagctacctaaatgtagagagtgtcgcttggattccttgcgcaaggacaaggagcagcagaaagacagccccgtgttctgccgcttcttccacttccggaggctgcagttcaataagcatggagtgctgcgtgttgaaggatttctgacccccaacaagtacgacaatgaagccatcggcctgtggctgcctctgacaaaaaacgtggtaggcattgacctagacactgctaaatatatcctggccaacattggagaccacttttgccagatggtgatctcagaaaaggaagcaatgagcacaattgagccccataggcaggtggcgtggaagcgtgctgttaagggcgtgcgggagatgtgtgacgtctgcgatacaacaatcttcaacctccattgggtgtgccctcgctgcggattcggagtctgcgtagattgctacagaatgaaacggaaaaattgtcaacagggagccgcatataagaccttcagttggttgaagtgcgtaaagagccagatccatgagcccgagaatcttatgccaacacagataattcccggaaaggccctgtacgatgtgggcgacatcgttcacagcgtgcgcgcaaagtggggcatcaaagcaaactgcccatgttcaaacaggcaatttaagctgttctctaagccagcgtccaaagaggatctgaaacaaacttcactcgccggagagaagcctactcttggagctgtcctgcagcagaacccttcggtcttggaacccgcagctgtgggaggagaagcagccagcaaacctgcgggatcgatgaagcccgcatgtccagcctctacgtccccacttaactggttggcggacctgacctccggaaatgtaaataaggaaaataaggaaaaacagcctaccatgccgatcctcaaaaatgaaatcaaatgtctgcctccactacccccactaagcaagagttcaacggtccttcacactttcaacagtaccatcctcacccccgtatcaaataacaattctggattcctgcgtaatctcctcaactcgtctactggcaaaaccgagaatggtctgaagaacacacctaaaatcctggacgacatttttgccagccttgtacagaataagaccaccagtgacctgtctaaacgccctcagggactgaccatcaagccaagtattctgggctttgatacaccccactactggctgtgtgacaaccggttattgtgcctccaagaccccaataacaagagcaattggaacgtgtttagggagtgttggaaacaggggcagcctgttatggtgtctggcgttcaccataagctcaactctgagctgtggaaacctgaatccttccgcaaagaattcggggagcaggaggtggaccttgtgaattgtcggacgaacgagataattaccggagccaccgtgggagacttttgggacggctttgaagatgtccctaaccgtttgaaaaacgaaaaggagcccatggtcctgaaacttaaagattggccccctggcgaggactttcgcgacatgatgccatccagatttgacgacctgatggccaatatcccactgcccgagtatactcgacgcgacggcaagctgaacctggccagtagactgcctaattatttcgttcgtccagatctcgggcctaaaatgtataatgcctacggactgatcacccctgaagaccgtaagtacggcacaaccaatctccatctggatgtgtctgatgctgccaatgttatggtgtatgttggaatcccaaaaggccaatgcgagcaagaagaagaagtattaaaaacaattcaagatggcgacagcgacgaactgacaattaagcgcttcatagagggcaaggagaaaccaggcgctctgtggcacatctacgctgctaaagatactgaaaaaatcagagagtttctgaagaaggtgagcgaagagcagggccaggaaaatccggctgatcatgacccaatacacgaccagagttggtacctggaccgaagcctgagaaagcggctgcatcaggaatacggcgttcagggatgggcaatcgtacagtttttgggcgatgttgtgtttatacctgccggtgcaccccatcaggtacacaatctctatagctgcattaaggtcgctgaggactttgtctctccagaacatgttaagcactgcttttggctgacccaggagtttcgatacctatctcagacacacactaatcacgaagataaattgcaagtcaagaatgtgatctatcacgctgtcaaggacgccgtggctatgctcaaggcatccgagtcgtccttcggcaaaccatag

SEQ ID NO: 229064 - DNA, 3966 bp, Artificial Sequence
  Description of Artificial Sequence: Synthetic coding sequence
atggttctgactctgggagaatcttggcccgtcctcgttgggaggaggtttctgtctctctctgctgccgatggctcggacgggagccacgatagctgggatgtcgagcgcgtagcagagtggccatggctgtccgggactatacgcgcagtgagccatactgacgtcacgaaaaaagatctaaaggtctgtgtagagttcgacggagaatcatggaggaaaagacgctggattgaggtttacagcttactgcgccgagccttcctagttgagcacaacctggtgctcgccgagcggaagtcaccagaaatatcagaaaggatcgtccagtggccggctatcacatataagcctttgctggataaggctggactgggctcgatcacctccgtcagatttcttggggatcagcaaagggtgtttttgtcaaaggatctcctgaagcccattcaggacgtgaattctttgagactgtccctgaccgataaccagattgtaagtaaagaattccaagccctgattgttaagcacctggacgaaagccacctgctgaaaggggataaaaatctcgtgggaagcgaggtgaagatctacagccttgatccctcaacacaatggttctccgccacagtcatcaacggtaaccctgcctccaagaccctgcaagttaactgtgaggagatcccagctctcaagattgtggacccctcactgattcacgtggaagttgtacatgacaacctcgttacgtgtggtaactccgccaggataggggcagtaaagaggaaaagcagcgaaaacaacggtaccctcgtgagtaagcaggccaaatcttgcagcgaagcttctccctcaatgtgtccagtgcaatccgttcccaccacagtattcaaagaaattcttctcggatgtaccgccgcaacaccaccatccaaggatccacgacaacagtcaactccccaggcggcaaactctccacctaatctgggagctaagattccccagggctgccacaagcaatccctccccgaggagatttctagctgtcttaataccaaaagtgaagcactgcgaacgaagcccgatgtgtgcaaggcaggcttgctcagcaagtcctctcagattggcaccggggatctcaagatcctcaccgagcccaaagggtcctgcactcagccaaagactaacaccgatcaggagaaccgcctggagagcgtgcctcaggccctgaccgggctgcccaaggagtgcctgcctacgaaggcctcgagtaaggcggagctggaaattgctaatcctcctgaactgcaaaagcatttagagcacgctccttcccccagcgatgtttctaacgcaccagaggttaaggcaggtgttaactccgattcgcccaataactgcagtgggaagaaagttgagcctagcgcactggcgtgccgatctcagaacctgaaggaaagtagtgttaaagtggataacgaatcatgttgttcaaggagcaataacaagattcaaaatgctcccagtcgcaagtcggtgctgactgatcctgccaagttgaagaagctgcagcagtccggtgaggcatttgtccaagacgactcctgcgtgaatatagtcgctcagctaccaaaatgcagggagtgtaggctggactccctgcgcaaggacaaggagcaacagaaggattcaccagtgttctgtcgcttttttcacttccgaagactacagttcaacaagcatggcgtgttacgggtggaaggcttcctgactcctaataagtacgataacgaggcaattggactctggctgcccctcactaagaacgtagtgggaattgatctcgatactgccaaatacattctggcgaatattggcgaccatttctgccagatggtcatcagcgaaaaggaagctatgtctacgattgaaccccaccgccaggtggcctggaagagggctgtaaaaggtgtgagggaaatgtgcgacgtgtgcgatacgacaatctttaacctgcactgggtgtgtccgcgttgcggctttggcgtgtgtgtggactgctataggatgaagagaaagaattgtcagcagggcgctgcctacaagacatttagttggctcaagtgcgtcaagagtcagattcacgaacccgaaaacctgatgcccactcaaatcatacccggtaaggccctttatgatgtaggcgatatcgtacactctgtgagggcaaaatggggtatcaaggcgaattgcccttgctctaatcgtcagttcaagctgttctccaagccagcatcaaaggaagatctaaagcaaaccagcctggcgggtgagaaacccacgctgggggcagtcctgcagcaaaacccctcagtcttagagcctgccgcagtgggtggcgaggcagcaagcaagcctgccggaagtatgaagcccgcttgtccagcctctacgtctcccctcaattggctggccgatttgacctctggaaatgtcaataaggaaaacaaagagaaacagccaacaatgcccatactgaagaatgagataaagtgtctcccccctctgccacctctatccaagtcctcaacggtattacacaccttcaattctactattctgacacccgtgtccaataacaactcagggtttttacgcaatttgctaaacagcagtactggaaagactgaaaatggcttaaaaaacactccgaagatcctggatgacatcttcgcgtccctagtacagaacaaaacaaccagcgacctctcaaagaggccccaggggctaactatcaagccttcaatcctcggcttcgatactccccattattggctctgcgataataggcttttatgcttacaagacccaaataacaaaagcaattggaatgtctttcgcgagtgctggaagcagggccagcccgtcatggttagcggagtgcaccacaagctgaactctgaactgtggaaacccgaatccttccggaaggaattcggagagcaggaggtagacctagttaactgtagaaccaatgagatcataacaggagctacagtgggcgatttctgggacggatttgaggacgtcccgaaccggctgaaaaacgaaaaggagcccatggtacttaaactgaaggactggcctccaggggaagactttagggacatgatgcccagccgatttgatgatctcatggctaacatacctctgccggagtatacgcgacgagacgggaaactcaacctggccagccggctacctaattatttcgtgcggccagatttaggccctaagatgtataatgcttacggactgattaccccggaagatcgtaaatatggtacaactaacctgcacttggatgtttcagatgctgccaatgtgatggtgtatgtgggtatccccaaggggcaatgtgaacaagaagaagaagtcctaaagactatccaagatggggattccgatgaactgacaatcaagaggttcatcgagggcaaagagaagcccggagcactgtggcacatatatgcggcaaaagataccgaaaagataagagagttcctgaagaaggtaagtgaggagcagggacaggaaaaccccgcagatcacgaccctatccatgaccagagttggtacctggatcggagtctgaggaaaaggctccaccaggaatatggggtgcaggggtgggcaattgtgcaatttcttggggatgttgtgttcatcccagccggagctccacaccaggtacacaacctgtacagctgcatcaaagtggccgaggatttcgtgagtcccgaacacgtcaagcattgtttctggctgacacaggaatttcgatacctgtcccagactcatacgaaccacgaggataaattgcaggtcaaaaacgtcatttaccatgccgtcaaagatgccgtagccatgctgaaagcatccgagtcttccttcggcaagccgtag

SEQ ID NO: 229065 - DNA, 3966 bp, Artificial Sequence
  Description of Artificial Sequence: Synthetic coding sequence
atggtcttgacactgggagagagctggccggtgctagtcggccgacgattcttgagtctgtcagcagccgacgggtctgatggcagccacgatagctgggacgtggagcgggtcgctgagtggccgtggctgagtgggacaattcgcgctgtctcccatacggatgtgaccaaaaaggatttaaaggtgtgcgtggaatttgacggggagtcttggcgtaagcggcgatggatcgaggtgtactccttgcttaggagagcgttcttggtggagcataacctcgtgttagcagagcggaagagtccagagatttcagagcgaatcgtgcaatggcccgcaataacttacaagcccctgctggacaaggcgggtctcggaagcatcacctcagtgcgattcttgggtgaccagcaaagggtcttcctctctaaagacttgctgaagccaattcaggacgttaatagtctgcggctgtccctgacggacaaccagattgtcagcaaggagttccaagctctgattgttaagcacctcgatgagtctcacctgctcaagggtgacaaaaatctggtgggttcagaggtcaaaatctactccctagacccaagtacccaatggttcagtgcgacggtaatcaatgggaaccctgcctccaagaccctgcaagtcaactgcgaggagatcccagccctgaagattgtcgatccttcgttgattcacgtcgaagtggtgcacgataatctggtcacatgcggtaatagtgctcgcatcggagctgtcaaaagaaagtcttccgaaaataatggtacactggttagcaagcaggctaagagctgctcagaagcttctccaagcatgtgtccagttcagagtgtgccaaccaccgtgtttaaagaaatccttttagggtgcaccgctgccacacccccatccaaagatcctagacagcagagcaccccccaggccgctaattcaccgccaaatttgggggctaaaataccacaggggtgccacaagcagtccttgccagaggagatttccagctgcttaaacacaaaaagcgaggcactgaggacaaagcccgacgtatgcaaagctggtttgctgagcaagagctctcagattgggactggtgatcttaagattctgaccgaacctaagggctcctgtacccagcccaaaactaacacagatcaagagaatcgcctggagtcagtacctcaagctctcaccggacttcccaaagagtgtctccctacaaaggcttcttcaaaggctgaactcgagattgccaaccctcctgagctgcaaaaacacctggagcacgctccttcccccagcgacgtatctaacgctccagaggtcaaggcaggcgttaacagtgatagccccaacaattgctctgggaagaaagtggagccatctgctttggcgtgcaggagccaaaatcttaaagaatcctcagtgaaggtggacaatgagtcctgctgctcgcggtcaaataataaaatccaaaatgctcccagtaggaagagtgtgctcaccgatcccgctaagctgaagaagctccagcagtccggagaggcctttgtccaggatgactcctgcgtcaacattgtggctcagcttccaaagtgccgagagtgtcggttagatagcctgaggaaggataaggagcaacaaaaggacagtccggtgttctgtcgcttttttcattttcgacgcctgcagttcaacaagcatggcgttttgagagttgaggggttcctcactcccaataagtacgataatgaggccataggtctgtggctcccattgactaagaacgttgtggggattgaccttgatacagctaagtacattcttgcgaacataggagaccacttctgccaaatggtaattagcgagaaggaagccatgagcacgatcgagccccataggcaggttgcatggaagcgggctgtgaagggcgtgcgcgaaatgtgcgacgtctgcgataccactattttcaatctgcattgggtgtgtcctagatgcggattcggcgtctgcgttgattgttataggatgaagcgcaagaactgtcagcagggcgctgcatacaaaaccttctcctggctgaaatgcgtgaaaagccagattcacgagcctgagaatcttatgcctacacagattattccaggcaaagctctgtacgatgttggggatattgttcacagcgtaagggccaaatggggcatcaaggcaaactgcccttgttccaatcgtcagttcaagctgttttccaaacctgccagcaaggaggacctcaagcagaccagcctcgccggagagaagccgaccctcggggcagtccttcaacagaacccctcagtccttgagccagccgctgtcggaggcgaagcggcaagtaagcccgctggtagcatgaagcccgcttgtccagcttcaacttcgccgctcaattggctagctgatttgacaagcggaaatgtgaacaaagagaataaggagaagcagccgaccatgccaatacttaagaacgaaatcaagtgcctgcctccactccctcccctgtctaaatcctctaccgtcctccacacctttaactcgactattctcactcctgtgtctaacaacaattccggcttcttaaggaacctgctcaacagtagtactggaaagaccgaaaatggtctgaaaaacacccctaagatcctggacgacattttcgcctctctggtgcagaacaaaacaacaagcgacctgagcaagcgaccacagggcttgaccatcaaacctagtatcctaggcttcgacacaccacattactggctctgcgataatcgactgctgtgtctgcaggacccaaacaacaaaagtaattggaacgtgttcagagagtgttggaagcagggacaacccgtgatggtgtctggagtgcatcacaagctgaattctgagctgtggaagccggaaagttttaggaaagaattcggcgagcaggaggtggacctggttaactgtagaactaacgaaattatcactggcgcaacagttggagatttttgggacggctttgaagacgtgccaaatagactgaagaacgagaaagaacctatggtgctgaagttgaaggattggcccccaggcgaagactttagagatatgatgccatctagatttgacgacctgatggctaacatccctctcccagagtacacccgccgtgacggcaagctcaacctggctagtcgtctgcctaattatttcgtaagaccagacctggggcctaaaatgtataacgcttacggccttatcacccctgaggacaggaagtacgggaccacaaatctgcatctcgatgtcagcgatgctgctaacgtaatggtttacgtggggatccccaagggacagtgcgagcaggaggaggaggtgttgaagacgattcaggatggagacagcgacgagctgacaattaagaggtttattgaaggaaaggaaaagccgggtgccctctggcacatttacgccgctaaagacaccgagaagattagagagtttctcaagaaggtttccgaagaacagggccaggagaaccccgcagatcacgaccccattcacgaccaatcctggtatctggaccggagcctgaggaagcggcttcatcaggaatatggggtgcagggatgggcaatagtacagtttctgggagatgtcgtgttcatacctgctggggctccacatcaagtccacaatctctactcttgcataaaagtagccgaggacttcgtaagccccgagcatgtgaagcattgtttctggctcacacaggagttcaggtacctgagccagacacacaccaatcacgaggacaagctacaggttaaaaatgtcatttaccacgcagtgaaagatgctgtggcaatgcttaaggcctctgagagcagcttcggtaagccctag

SEQ ID NO: 229066 - DNA, 513 bp, Artificial Sequence
  Description of Artificial Sequence: Synthetic coding sequence
atggttctcaccctaggcgagtcctggcctgtcctggtgggccgtcgattcctgtctttgtctgctgcggacgggtctgacggcagccatgattcctgggatgtggagcgcgtagcagagtggccgtggctgagtgggactatcagagctgtttcacacacagacgttaccaaaaaggatctgaaggtgtgtgtcgagttcgatggagagtcctggcgcaaaaggcggtggatcgaggtctacagcctgcttcgaagagcctttcttgtcgaacacaatttagtgctcgccgagagaaaatctccagaaatcagcgaaaggattgtccagtggccagcaatcacctataaacctctactggataaagcaggcctgggatctattacctcagtaaggtttctgggcgatcagcagcgcgtatttcttagcaaggatctgttgaagcctattcaggatgtgaattcactaaggctcagcttgactgacaatcagatagtcagtaaagaattttag

SEQ ID NO: 229067 - DNA, 2136 bp, Artificial Sequence
  Description of Artificial Sequence: Synthetic coding sequence
atggtgttgacactcggcgagtcctggcctgtgctggtagggaggcggttcttgagtctgtccgccgcagacggcagcgacggcagtcatgactcatgggatgtcgaacgggtggctgagtggccttggctgtcaggcacaattcgcgctgtcagccatacagacgtgactaagaaagatctcaaagtttgcgtggagtttgatggagaatcctggcgcaagagaagatggatcgaggtctattctctccttcgtagagcatttttggtagaacacaatctggttctggctgaacgaaagtcccctgaaatttccgaaagaatcgtgcaatggcccgctatcacatacaagcctttgctggataaagccggtctgggctctataacttccgttcgctttctgggagatcagcagcgggttttcctcagcaaggatctactgaagcctattcaggatgtgaattccctgcgcctttccttaactgacaatcagatagtgagcaaagagttccaggcgttaatagtcaaacacttagacgagtctcacctgttgaaaggcgacaaaaacctggtgggatctgaggtaaagatctattctcttgacccctccacccagtggttctctgccaccgttattaacggaaacccagcctcaaaaaccctccaggttaactgcgaggagatacctgcactcaagatcgtcgaccctagtctcatacacgttgaggtggtgcatgacaatctcgtgacttgtggcaattctgcccgaattggggctgtcaagagaaaatcctcagaaaataacggaacactagtttcgaaacaggctaagagctgtagtgaggcttctccgagtatgtgtcctgtgcaatccgtacccaccacagtctttaaggagatcttgctcggctgtaccgctgctactcccccaagcaaggaccctcgtcagcagagcactcctcaagccgctaactcccccccaaacctcggcgctaaaataccacagggatgtcataaacaaagcctgcccgaggagatttccagttgcctcaatactaagtctgaggcgcttagaaccaagccagacgtctgtaaggcaggcctccttagtaagagttcccagataggaactggggatctcaagattcttaccgagccaaaagggtcttgtacacaacctaagaccaataccgatcaggagaatcggcttgagtccgtgccgcaggccctgaccggcctgcccaaagaatgcctgccaaccaaagcatcatccaaagcggagctggaaatcgccaaccctcccgaactgcagaagcatttggagcatgccccatctccctccgacgtcagcaacgcccctgaggtgaaggccggagtgaatagtgacagtcccaataattgctcagggaaaaaggtcgaaccctctgcactcgcttgtagaagtcagaacctgaaagaaagctccgtgaaggtggataatgagtcctgttgtagtagatcaaacaacaaaatacagaacgcaccatcccggaaatccgtattgaccgatcctgccaagctgaagaagctgcagcagtcaggtgaagccttcgtgcaggacgactcttgtgtgaacattgttgcccagctgccaaaatgtcgcgagtgccggctggactctttacggaaagacaaggaacagcagaaggacagtcctgtattctgccgatttttccactttaggaggctccagttcaataagcatggcgtgctgagagtggaaggcttcctcaccccaaacaagtacgataacgaagctatcggactgtggctccccttgactaagaacgtggttggaattgacctcgacactgcaaagtacattctggcgaatataggcgatcatttctgtcagatggtgatctccgagaaggaagctatgagtacgattgagccccataggcaggtggcttggaagcgtgcggtaaaaggcgtccgggagatgtgtgatgtgtgcgacaccacgatcttcaatctgcactgggtctgtcctcgttgcggattcggagtatgcgtcgattgctatcgaatgaagcgcaagaattgccaacagggagagaacaggttcgactcacctcctgcaccactccactcttag

SEQ ID NO: 229068 - DNA, 366 bp, Artificial Sequence
  Description of Artificial Sequence: Synthetic coding sequence
atggtgcttaccctgggcgagagctggccagtcctcgtcggtagacggtttctgagcctatctgccgctgatggatcagatggatctcatgactcttgggatgtcgaacgggtggccgagtggccttggctgagtggcaccatccgcgctgtgtcccacaccgatgtcacaaagaaggacctgaaagtctgcgttgaatttgacggagagtcatggaggaagaggcgctggattgaggtatatagcctcctgagaagagcattcctggtcgaacataatttggtgctggcagagaggaagtcacccgaaatctcagaacgaatcgtgcagtggcccgcaattacgtacaagccccttctcgattag

SEQ ID NO: 229069 - DNA, 3984 bp, Artificial Sequence
  Description of Artificial Sequence: Synthetic coding sequence
atggttctcacactcggagagagttggccggtacttgttggtaggcggttcttaagcctgtcagccgcagacggctctgacggcagtcatgattcttgggacgtcgaacgtgtcgctgagtggccctggctgagcgggaccataagagctgtatcccacaccgacgtgaccaaaaaggatctgaaggtttgtgtagagtttgatggggaaagctggaggaagcggcgatggatcgaggtttactcactgttgcggagagcattcctagtggagcacaacctggtgctggccgagaggaagtctcccgaaatcagcgagcgaattgtgcagtggcctgccataacttataaaccattgttggacaaagccggtctgggcagcataacgtctgtcaggttcctgggggatcaacagagggtctttctgagtaaggacttgctgaagccgattcaagatgttaactccctccgtctgagtctaaccgacaaccaaatcgtttcgaaggaattccaggctctcatcgtgaagcaccttgacgagagtcacctgcttaagggcgataagaatcttgtggggagcgaagtgaaaatatatagcctcgacccttctacgcagtggttttccgctactgtaattaatggaaatcctgccagcaagacgctgcaggtgaactgtgaagagatcccagcactcaagatcgttgacccttcactgatacacgtggaggtagttcacgacaacctcgtgacctgcggcaactcagcccgtattggcgctgtgaagagaaagtcgtcagagaataacggcactctcgtgagcaaacaggctaagtcttgtagcgaagcatccccttccatgtgtcctgtgcaatcagtgcccaccaccgtatttaaggagatactgctgggttgcaccgctgcaaccccacccagcaaggatccacgacagcagtctaccccccaagcagcgaactccccaccaaacctgggtgcaaagattccacaaggctgtcacaagcagtcactcccagaagaaatatcgtcttgtctgaatacaaagtctgaggccctgcgtaccaaacctgacgtgtgtaaggccggacttttgagtaagagctcacaaataggaactggcgatctgaagattttgacagaaccaaagggatcctgtacacagccaaagacgaatacagaccaggagaatcggcttgaatccgtaccccaggccctcacaggattgccaaaggaatgtctgcccacgaaagcatccagcaaagctgagcttgaaatcgcaaacccgcctgaactccagaagcacctggaacacgctccctctccctctgacgtttcgaatgctccagaagttaaggcaggagtgaacagcgattctcctaataactgctccggaaaaaaggtggaacccagcgctctggcttgtagaagccagaatctcaaggagtcatcagtgaaagtggataatgagagctgctgctctagatcgaacaataagatacagaacgctccctctagaaaatcagtcttaaccgatccagccaagttaaagaagttgcaacagtccggcgaggctttcgtccaagatgacagctgtgtgaatatcgtcgcccaactcccaaaatgcagggagtgtcggctggacagcctgagaaaagacaaggaacaacagaaagatagcccggttttctgcaggttttttcatttccggagactgcaatttaacaagcatggcgtgctgcgggtggaaggctttttgacacccaataaatacgacaacgaggctattggcctttggctgcccttgacaaagaacgttgttggtatcgaccttgacacagccaaatatattcttgccaacatcggtgaccacttttgccagatggttatcagtgagaaagaagccatgtccactatcgaaccccataggcaagttgcttggaaacgagcagtgaaaggcgttcgggagatgtgcgacgtgtgtgatacaacaatctttaatctgcactgggtctgcccacgctgcggttttggcgtgtgcgttgactgttaccgaatgaagaggaagaactgtcagcagggtgccgcttacaaaacatttagctggctgaagtgcgtgaaatcacagatacacgagcctgaaaacctgatgcccacccagattatccctggtaaagctctgtacgatgtgggggatatagtacactctgttagagcaaagtggggcattaaggctaattgtccctgctctaataggcaattcaagctgttctccaagccggcatcgaaagaggatctgaaacagacaagcctggctggggaaaaaccaactttgggcgctgtgctgcagcagaacccttcagttttggagcctgcagccgtcggaggtgaggccgcaagcaagccagcgggatcaatgaaacccgcttgccccgcttctacaagtccgttgaactggctcgccgatctcacctccggaaacgtaaataaggagaataaggaaaaacagcctacaatgcctatcctgaagaacgagatcaagtgcctgccccctctgccccctctgagcaaatccagcaccgtacttcatacctttaattccaccatcctcacaccagtgagtaacaacaattccggatttctgaggaatctgctaaatagctccaccggcaagactgaaaacggattaaaaaatacccctaagatactggacgacattttcgcaagcctggttcaaaataaaaccacgagcgacctgagcaaaaggccacaaggacttaccatcaagccatctatccttggctttgacacaccccactattggctctgtgacaaccggttactgtgtttgcaggaccccaataataaatctaattggaatgtcttccgggaatgttggaaacaggggcagcctgtgatggtttccggtgtgcaccataagctaaacagtgagctatggaaaccggaatccttccgtaaggaatttggggagcaggaggtggacctcgtaaattgtcggaccaacgaaatcatcacgggggctaccgtcggcgatttctgggatgggtttgaagatgtgcccaataggctgaagaatgagaaagaaccaatggtactgaaactgaaggattggccgcctggggaggactttagggatatgatgccatcgcggttcgacgatctgatggccaatatcccattaccggagtacactagacgagatggtaaactgaacttggctagcaggctccctaactactttgtgagaccagatctggggccaaaaatgtacaatgcgtacggacttatcacccccgaggacaggaaatacggaacaacgaacctccacctggacgtgagcgatgctgccaatgtgatggtgtatgtgggcattccaaagggtcagtgcgagcaagaggaagaggtcctcaaaacgattcaggacggcgactctgatgagctaaccatcaaaagattcatagagggaaaggagaaacccggtgctttatggcacatctacgctgccaaggatactgaaaaaatacgtgagtttctcaagaaggtttctgaagaacaggggcaggaaaatcccgctgaccatgatcctatacacgatcagagctggtacctggaccgctctctccggaaaaggctgcatcaggagtacggcgttcaagggtgggcaattgtgcagttccttggagatgtggttttcatacccgctggcgctccgcatcaagtgcataatctttatagctgcattaaagtggcagaggactttgtgtcccctgagcacgtgaagcactgtttctggctgactcaggagttcagatatctctctcagacccacacaaatcacgaagataagctacaagtcaagaatgtcatctatcacgcagtgaaagacgccgtagctatgctcaaagtgaacccagtgctggctaacctcaacctaccagcccattggaagtag

SEQ ID NO: 229070 - DNA, 3810 bp, Artificial Sequence
  Description of Artificial Sequence: Synthetic coding sequence
atggtgctcacacttggcgagagctggccggtcctcgtgggaaggaggttcttgtcactatccgccgctgacggttccgacggttcacatgattcatgggatgtagagagggttgcggaatggccttggctctcaggtaccatccgcgctgtatcacatactgatgttaccaagaaggacctcaagacttacaaaccgctcctggataaggctgggcttgggtctattacctccgtgaggttcctgggtgatcaacagagagtgttcctgagcaaagatctcctaaaaccaatccaggacgttaactctctccggctcagtttgacagacaaccagatcgtgagcaaagagttccaggcattgattgtaaagcacctcgatgaatcacacctgttgaaaggagacaagaaccttgtgggaagcgaggtaaagatctattcgctggatccaagtacccaatggttttctgcgacagtgattaacggtaatccagcctccaagactctgcaggtgaactgcgaagaaattccagccctgaagattgtggacccttcccttatccacgtggaggtggtgcacgacaacctcgttacctgtgggaacagtgctcgaatcggggctgtcaaacgcaaaagtagcgagaataacgggaccttagtctcaaaacaggccaaatcctgctcagaggcaagtccgagtatgtgccccgtacagtcggtgcccaccaccgtgtttaaagaaatcctcctcggttgcaccgccgctacacccccaagcaaggaccctaggcagcaatctaccccacaggctgccaattcaccccctaacctgggggctaagattccgcagggctgccataagcaatctctgcccgaggagattagctcatgcctcaacactaagtccgaagcgctgcgcacaaagcccgatgtatgtaaggcgggacttttatcgaaatcatcccagattggcacaggggacttaaagattttgacggaaccaaagggatcatgtacccaacccaagacgaacactgaccaggaaaaccggctcgaaagtgtcccacaggcgttgactggattgcccaaggaatgtttgccaaccaaggcatcttctaaggccgaactagagatcgctaacccgccagagctccaaaaacatttggaacacgccccttcaccatcagatgtctccaacgcacctgaagtgaaagccggtgtcaactcagatagccctaacaattgttctggaaagaaagtcgagccttctgccttagcttgccggtcccagaacctaaaggaatctagcgttaaagtggataacgaatcctgttgcagcaggagcaacaacaaaattcagaatgcaccatcgcgtaagtccgttttaactgatcccgcaaagctgaaaaaactgcagcagagcggcgaagcctttgtgcaggatgattcatgtgttaacatcgttgcccagttgcccaaatgtcgggagtgtcgactggactcattgaggaaggacaaggagcaacagaaagattcacctgtgttttgccgttttttccattttagaaggctccagttcaacaagcacggagtcctcagggtagagggattcctgacaccaaataagtatgacaacgaggcgatcggattatggctccccctgaccaaaaatgtagtagggattgatctcgacaccgcaaaatacattcttgccaatattggggaccatttctgccaaatggtcatcagcgaaaaggaagctatgagtacgatcgagccccatagacaagttgcctggaagagggctgttaagggtgtgcgcgagatgtgtgatgtgtgcgacacgactattttcaacctgcattgggtttgcccaaggtgtggcttcggcgtgtgcgtggactgttatcggatgaaaagaaaaaactgccagcaaggagcagcctacaaaacattttcgtggctgaaatgcgtgaaatcccaaattcatgagccagaaaacctgatgccaactcagataatccccggtaaggcgctgtatgatgtcggtgatattgtacattctgtgagagctaagtggggtatcaaagctaactgcccgtgctcgaatcggcagttcaaactgttttctaagcccgcaagtaaagaagatttgaagcagacttcactggccggagaaaagccaacactcggcgcagtcctgcaacagaacccaagcgtgctggagcctgcggcagtgggaggggaggctgcttctaagccagccggaagcatgaagccagcttgcccggcaagcaccagtcccctcaattggctcgccgacctgaccagcggcaacgtgaataaagaaaacaaggagaagcaacctactatgccgatcctaaagaacgagattaagtgtttacctcctctgccacctctctcgaagtcaagtacggtcctgcacacgttcaacagcactattctaacccctgttagcaacaacaacagcggattcctgcgcaatctacttaacagctctacaggcaagaccgagaatggcttgaagaacactcccaaaattcttgatgacattttcgccagcctggtgcagaacaagacaacctcagatctgtccaagcgtccccaggggctgaccatcaagccatctattctcggttttgacacaccacattactggctgtgtgacaacaggttgctctgtttacaggacccaaataacaagagcaactggaatgtgtttcgggagtgctggaagcagggacagcccgtcatggtttctggtgtgcatcacaaactgaactctgaactttggaagcccgaaagtttcaggaaggaattcggggagcaagaggtggatctggtgaattgcagaaccaacgagataatcaccggggcaaccgtaggtgatttttgggacgggttcgaggacgtccccaataggcttaaaaacgaaaaggaaccaatggtgcttaagctgaaggactggccccctggcgaggatttcagggacatgatgcccagtcggttcgacgacctgatggcgaacattccactgcctgagtatacaaggagagacgggaaactcaacttggctagcaggctgcctaactactttgttcgacccgatcttgggccaaagatgtacaatgcttatggcctgatcacaccggaagacagaaagtacggcacaaccaaccttcatttagatgttagcgatgccgctaatgtgatggtttacgtggggattccgaagggtcaatgcgaacaggaagaggaggtgttgaagaccatacaggatggggatagcgatgagctcaccataaaacggtttattgagggaaaggagaagcccggagcactctggcacatctacgccgctaaagataccgagaagatcagggaatttttgaaaaaggtctccgaagagcaaggccaagagaaccctgcagaccacgatccaatacatgaccagtcttggtacctggataggtcactgcgaaaacgactgcatcaagaatacggagtgcagggttgggcgatcgttcaattcctgggagatgtcgtgttcatcccagccggagctccacaccaagtgcataacctatattcatgcataaaagtggcggaagatttcgtgagccctgaacatgtcaaacactgcttttggctgacccaggagttccgatacctgtctcagacacataccaatcacgaggataagttacaggtcaagaatgtcatttatcacgctgtgaaggacgcggtggcaatgctgaaagccagtgagagctcctttgggaaaccgtag

SEQ ID NO: 229071 - DNA, 5285 bp, Artificial Sequence
  Description of Artificial Sequence: Synthetic coding sequence
atggcggacgcggcagccagcccagtaggcaaacgccttctgctgctcttcgcagatacagcggcatccgcttctgctagtgcccctgccgcagccgctgcaagtggcgacccaggacctgcccttcggacccgcgcttggcgggctggcacagtgagagccatgtcgggggcagtccctcaggacctcgccatttttgttgaattcgatggctgtaattggaaacaacacagctgggttaaagtgcatgcagaggaagtgattgtgttacttctggagggcagcctggtgtgggcacccagggaggaccccgtgctattgcagggcatccgtgtgagtatagcccagtggcccgctttaactttcaccccactagttgataaactggggctgggctccgtggtacccgtcgaatacctgttggatcgggagctgcggttcctgtcagatgccaatgggcttcacctgttccaaatgggtactgatagtcagaaccaaatccttctagagcacgcggctctgagggaaaccgttaacgccttgatctcagaccaaaaactgcaagaaatctttagcaggggcccttattcggttcagggccacagagttaagatttatcagcccgaaggcgaagagggttggttgtacggagtggtgtctcatcaggatagcatcactaggctgatggaggtgtctgtgacagagtccggcgaaataaaatcggtcgatccacgcctgattcatgtaatgctcatggacaactcggccccacagtcagagggcggaacgcttaaggctgtgaagtcctccaagggcaaaaaaaaacgggaatctatcgaaggaaaggacggacggagaagaaaatccgcatccgactccggctgcgaccccgcatcgaagaaattgaaaggggacagaggggaggtggactccaatggttcagacggtggagaggccagtcggggaccctggaagggaggtaatgcctccggggaacctgggctggaccagcgggctaaacagccacccagcacgttcgtgccacaaatcaaccgaaacattcggttcgctacatacacgaaggaaaatggtcgtacccttgtggtccaggatgaaccagtgggtggtgacactccggcaagttttacaccatattctactgcaacaggccagacacctctggcaccagaggtagggggagctgaaaacaaggaagccggaaaaaccctggaacaggttgggcagggaatcgtcgcaagtgccgcagtggtcaccactgcctcctccacaccaaataccgttaggatcagtgacaccggtctcgccgcaggcactgtgcctgagaaacagaaaggatccagatcccaggccagcggggagaactccaggaactctattctcgctagctccggctttggggctccactccctagtagctcacaaccactgaccttcggcagcggcagatctcagagtaatggggtcctcgccaccgagaacaaaccactcgggttctcattcggatgttcctcagcccaggaagctcagaaggatactgacctctcaaagaatctgttttttcagtgcatgtcccagacactcccaacttcaaattactttaccacagtctcggaatctttggctgatgattcctcttcacgcgattcctttaagcagtcgctcgaaagtctgagcagcggcctgtgcaagggtagaagcgtcctgggaaccgatacaaagcctggttcaaaggccggttccagcgttgacagaaaggtgcccgcagaatctatgccaacactcacaccagccttccctcgctcattgctgaacgcccgaacacccgaaaatcacgagaaccttttcttacagccacccaaactctcccgcgaggagcctagtaatcctttcctggctttcgtcgagaaagttgagcattcaccattttcatctttcgcatctcaggcctcaggtagttcaagttctgcaacgactgtgaccagtaaagtggccccaagctggccagaatcccatagttccgccgatagtgctagcctcgctaaaaagaagccattattcattaccaccgatagctctaagcttgtctctggagtcctggggagtgctctcacatctgggggaccaagtctatccgcgatgggcaatggcagatcttcatctcctactagttctctcactcagcccatcgagatgccgacactgagtagttcgcctaccgaggagcgacccacggtcggtcctgggcagcaagacaatccccttttgaagactttttctaacgttttcggtaggcatagcgggggatttctgtcgtctccagccgatttcagccaagagaacaaggctccttttgaggctgtgaaacggttcagtttggacgagagaagtctggcctgtcggcaggacagtgactcctccaccaactcggatctgtctgacttgagcgattccgaggagcaactccaggcaaagaccggactgaagggtatacccgaacacctcatggggaagctgggtccaaacggagagaggtctgcagagctgcttttgggcaaaagcaagggcaaacaggccccaaagggcaggcctcgaacggcacccctgaaggtgggacagtccgtactcaaagacgtaagcaaggtcaagaagctaaaacagtccggcgagccctttctgcaggacggatcttgcatcaacgtggctccacatcttcataagtgcagagaatgtagactggagagatataggaagttcaaggagcaggagcaggacgactcaacagtggcgtgccggttctttcacttccggagactcatatttacaaggaagggggtacttagggtcgaaggattcctgtcacctcagcagtctgatcccgatgcgatgaatttatggataccatccagttcattggccgagggcatagatttggagacatctaagtatatcctggctaacgtgggcgaccagttttgccagcttgttatgtccgaaaaggaagctatgatgatggtggagcctcatcagaaggtggcatggaaaagagccgtgcggggtgtgcgggaaatgtgcgatgtgtgcgaaactacactcttcaacattcattgggtgtgcagaaagtgtgggtttggagtgtgtttggactgctatcgcctgaggaagagcagaccgagatctgagaccgaagagatgggcgacgaagaagtgttcagctggctgaaatgcgctaagggccaaagccatgaaccagagaacctgatgcccacacagattatccccggaacggctctctataatattggagacatggttcacgcggctcgcggaaagtggggcattaaggccaactgcccctgcatatcccgccagaacaagtcagtgctaaggccagctgttaccaatgggatgagccaacttcctagcatcaatccaagcgcgagttcgggtaacgagacaacctttagcggcggaggcggtccagctccagtcacaactccggaacccgaccatgtccccaaggccgattctacagacatcagatcagaagagcccctcaagactgatagtagtgcatctaactcaaatagtgaactgaaggcgattaggccaccttgcccggacacagctccaccctcaagtgcattgcattggctggctgaccttgctacacagaaagccaaggaggagacaaaagaggccggatccctgcgctctgtgctgaacaaagagtcccactcccccttcggacttgacagttttaacagcacagccaaagtgtcccctctgaccccgaagctgtttaatagcctgctgctcggaccgactgcttcaaacaataaaacagagggttcctcactaagagacctgctacattccgggcctggaaagcttcctcagaccccattggacactggaatcccattccctcctgttttctctacatccagcgcaggtgtcaaaagtaaagcaagcttgcctaatttcctcgaccacatcattgcttccgtcgttgaaaataagaagacctctgacgctagtaagagagcatgtaacctgaccgacacacaaaaagaggtgaaagaaatggtcatgggtctaaatgtcctcgacccacacacgagtcactcctggctctgtgatggtaggctgctgtgcctccacgatccttcaaataaaaataattggaaaattttccgcgaatgctggaaacaaggccagcctgtccttgtgtctggcgttcataagaaactcaaatcagaactgtggaaaccagaggcgttttcgcaggaatttggggaccaagacgtggatcttgtaaactgccgcaactgtgcaatcatcagcgacgtgaaggttagggacttctgggacggattcgagataatttgtaagcgcctgcggagtgaggatggacagccaatggttctgaaattaaaagactggcctcctggagaggacttccgggacatgatgcctacaaggttcgaagatctcatggagaacctgcccctcccggagtacaccaagcgcgacgggaggcttaacctggcctcgcgtctgccttcttatttcgtacgcccagacctgggaccgaagatgtataatgcttatggcctgattacagctgaagatagacgggtggggaccaccaatcttcatctggatgtgtcagacgccgtcaacgtgatggtgtatgtaggcatccccatcggtgaaggcgctcatgacgaggaagttctgaaaaccattgatgaaggcgacgctgacgaggtcactaaacagcggatacatgacggtaaagagaagccaggtgctctgtggcacatctacgctgccaaagacgccgaaaagattagagagctcctccggaaggttggtgaggagcaggggcaggagaatcctcccgatcatgacccgatacacgaccagtcttggtatctggaccaaacacttcggaagaggttgtacgaagagtacggggtgcaagggtgggccatcgtccagttcctcggcgatgctgtttttatccctgctggtgccccacatcaagtacacaacctgtacagctgcatcaaggtcgccgaagactttgtgagccctgagcacgtcaaacactgttttcgactgacccaagagtttagacatttaagcaatactcataccaaccacgaagataaactacaggtaaagaacattatctaccatgccgtaaaagacgccgtgggaacactgaaagcacatgaaagtaaactcgctcggtcata

SEQ ID NO: 229072 - DNA, 4254 bp, Artificial Sequence
  Description of Artificial Sequence: Synthetic coding sequence
atgggtgccatggagataaatagaaacatccgttttgcaacgtacacaaaggagaacggacgcacactggtcgtgcaggacgagccagtggggggagatactccagcctctttcacaccatatagcacggcaacaggtcagacccccctggctcccgaagttggaggggcagagaataaggaggcgggaaaaacactggagcaggtggggcaaggtatcgtggccagcgcagcagtcgtgaccaccgcatccagcacccccaataccgtaaggatctcagatactgggctggcggctggtactgtgcccgagaagcagaagggctcccgatctcaagccagtggggagaacagcagaaatagcatcctcgcctccagtgggttcggagccccactgcccagcagctcccaacctcttacatttggtagtggaaggtctcagtccaacggcgtgctggctaccgagaacaaacccctgggatttagttttggctgctcttccgcccaggaggctcagaaagacactgatcttagcaagaatctttttttccagtgtatgagccagaccctccctacctccaactattttacgacagtctcagagagtctcgctgacgatagttcgtctcgcgacagctttaagcaatctttggagtccttgtctagcgggctgtgtaaaggaagatcagtcctcgggactgataccaagcccggatctaaggccggaagcagcgtggataggaaagtcccagctgagtcaatgccgacactgactcctgcttttcctcgttcactactcaacgcccgaactcctgaaaaccatgagaacctgttcctccagccaccaaaactttctagagaagagccctccaatcctttcctggccttcgtcgagaaggtggaacatagccctttttcatcttttgcttcccaagcttcggggagtagtagtagtgccaccaccgtcaccagcaaggtggccccttcgtggccggaaagccactcctcagccgatagtgcttctttagctaaaaagaaaccgttgttcatcaccaccgattctagtaagctcgtctccggagttctgggctctgccctcacaagcgggggaccgtcacttagcgctatgggaaatgggagatccagtagtcctacttcatcccttactcagcctatcgagatgcccactctgagcagcagtcccacagaagagcggccaactgttgggcctggtcagcaagacaaccccttgctaaaaactttctcaaacgtcttcggaaggcacagcggcggatttttgtcatcacccgctgacttttcccaggagaataaggcccctttcgaagcagtgaagcgatttagtctggatgagagaagtttggcttgccggcaagattcggattccagtaccaatagcgatctttccgatttgtcggattctgaggagcagctgcaggcaaaaaccggactcaaagggatccccgaacatctgatgggcaaacttgggcctaacggcgagcgtagcgccgagttgctgctgggcaagtccaagggcaagcaagccccaaagggcaggcctcggacagcgccacttaaggtcggccaaagcgtgctgaaggatgtctcgaaggtgaagaagcttaagcagtccggagaacccttcctgcaggatggatcatgtatcaatgtagccccacacttacataagtgtagagagtgccggcttgagcggtaccgcaagttcaaggagcaggagcaagacgatagcaccgtcgcgtgcagattcttccactttcggagactgatctttacgaggaagggggtccttagagtcgaaggtttcctttctccccaacaaagcgaccccgacgccatgaacctgtggataccaagtagctctttagctgagggaatcgatctagagacatcaaagtatatcctcgcaaacgtgggcgaccagttctgccagttggtcatgtccgaaaaagaagctatgatgatggtggagccacatcagaaagtggcttggaaacgcgcagtcaggggggtcagggaaatgtgcgacgtctgtgaaacgacattgtttaatatccactgggtttgtcgcaagtgtggctttggggtgtgcctcgactgctaccgccttcgaaagtctcggccacgatctgagaccgaggagatgggagacgaagaagttttttcgtggcttaagtgcgccaaaggacagagccacgaacctgagaacttgatgcccacacagatcattcccggaaccgccctgtacaacatcggagatatggttcacgctgctaggggtaagtggggtatcaaggctaattgcccctgtattagccgccaaaacaaatctgtcttgagacccgctgtgacaaacggaatgtcccaattaccctctatcaatccatctgcctcatcaggcaatgagaccaccttcagtggcggaggaggtcccgctcccgtcacaacacccgaacctgaccacgttcctaaggctgacagcacagatattaggtcagaggagccattgaaaaccgactcttccgcaagcaactcgaacagcgaactcaaagccattcgcccaccctgccctgacacagccccaccttcaagcgctttgcattggttagccgacctcgcaacccagaaagccaaggaagaaacaaaggaggccggaagccttagatccgtcctcaataaagaaagtcatagccctttcggccttgactccttcaactctacggccaaggtctcacctctgactcccaaactgttcaatagcctcctgctcgggcctacagcaagcaataacaagaccgaaggctcctcactgagagacctcctccatagcggaccagggaaactaccccagacaccactagatacgggaatcccttttcctcctgttttttcaacttctagcgctggcgtgaagtccaaggcaagcctccccaatttcctggaccacatcattgcctccgttgtggagaacaaaaaaacctctgatgccagcaaaagagcctgtaaccttaccgacacgcagaaggaagttaaggagatggtgatgggcttaaatgttctcgatccacatacctctcatagttggctgtgtgacggtagacttttgtgtctgcacgatccttccaataaaaacaactggaagatatttcgggaatgttggaaacaaggtcagcctgtgcttgtgagtggcgttcacaaaaaactgaagagtgagctctggaagcctgaggcatttagccaggagttcggcgaccaagatgtcgacttagtgaactgtagaaattgcgccatcatttctgatgtgaaagtgcgggatttctgggacggtttcgaaatcatctgtaaacgcctgagatccgaggatggtcaaccaatggtgctcaagttgaaagattggcctcccggtgaggacttccgcgatatgatgcctaccagattcgaggatctcatggagaatcttcctctacctgagtacactaagagggacggcagactcaacctggcttcaaggcttccaagctacttcgtgaggcctgacctgggtccaaagatgtacaatgcttacggactgattaccgccgaggatcgccgtgtgggcaccacaaatctgcatcttgacgttagtgatgccgtgaatgtgatggtttatgttggaatccccatcggcgaaggagcccacgatgaagaagtcctcaaaacaatcgacgagggtgacgcagatgaggtgaccaaacagcgaatccacgacggaaaggaaaagcctggagccttgtggcacatatatgccgcaaaggatgcagagaagatcagagagctcttgcgaaaggtcggcgaagaacagggtcaggaaaatccgccagaccacgacccaatccacgaccagtcttggtacctggatcaaacgttgcggaagaggctctatgaggagtatggagtgcaaggatgggccatcgtgcagtttcttggcgatgctgtgtttatccctgccggtgccccacatcaggtgcacaacttatacagctgtataaaagtggccgaagactttgtctccccggaacatgtgaaacactgctttagacttacacaggagttccgccacttgtcaaatactcatactaatcatgaggataaactccaggtgaaaaacatcatttatcatgccgtgaaagacgcagtcggaaccctcaaagctcatgagagtaaattagctcggtcttag

SEQ ID NO: 229073 - DNA, 2382 bp, Artificial Sequence
  Description of Artificial Sequence: Synthetic coding sequence
atgaacctgtggattccctcatcttctctcgcagaagggattgatttagaaactagcaagtatatccttgctaatgttggggaccaattctgccagcttgttatgagcgaaaaggaggcgatgatgatggtggaaccacaccagaaggttgcttggaaacgggcagtccgaggtgtccgggagatgtgtgacgtgtgcgagacaaccctcttcaacatccactgggtgtgtaggaagtgtgggttcggtgtctgcctggattgctaccggttacgcaagtcccgaccaagaagcgagactgaggagatgggcgacgaggaagtgtttagttggctaaagtgtgcaaaggggcaaagtcatgagcccgaaaacctgatgccaacccaaatcatcccgggaacggccctctataacattggggatatggttcatgctgcaagggggaagtggggaattaaagctaactgcccctgtatatcccgtcagaataagagcgtgttgcgaccagcagttaccaacggaatgtctcagctcccttcgatcaatccctctgcatcgagcgggaacgagacaactttctccggaggtggaggcccagcccctgttactaccccagagccagatcatgtacccaaggccgactctaccgatatccggagcgaggagcccctgaaaactgactcctctgcctctaatagtaatagcgaacttaaagcgatcaggccaccctgccccgacacagcaccgccatcatctgcccttcactggcttgcagacttggcaacacaaaaggctaaagaggaaacaaaggaagctggtagtctcagatctgttctcaataaggaaagtcactccccattcggcttggacagttttaacagcaccgcaaaggtgtcccctctgacccccaagctttttaattccctacttctcggccctactgcctcaaataataaaactgagggtagctcactgcgggacctcttgcacagtgggccagggaaactaccccagacgcccctggatactggtataccttttcctcccgtgttctccacctcatctgccggtgtcaaatccaaagcctccttgccaaacttccttgaccacataattgcctcagttgtcgaaaacaaaaagacaagcgatgccagcaaaagagcttgcaatctgactgacacacagaaggaagtgaaagaaatggtcatgggcctgaacgtcctggatccgcacacaagccacagttggctctgtgacggaagactcttgtgcttgcacgatccatcgaataaaaataactggaaaatcttccgggaatgctggaagcaaggacaacccgtactcgtcagcggggttcacaagaagctaaaatcagagttgtggaaacccgaagcattctctcaggagttcggcgatcaggacgtggaccttgtcaattgccgcaactgtgcaataataagtgatgtgaaagtgagggatttctgggatggcttcgagatcatctgcaaacgcttgaggtcagaggatggacagcctatggtcctgaagttgaaagactggcccccaggagaagatttcagggacatgatgccaactaggttcgaggatcttatggagaacctcccacttccagaatataccaaacgggatggtcggctcaatttagcgtcacgcttgcccagttacttcgtgaggccagatctcgggcctaagatgtacaacgcgtacggactcatcaccgccgaggatcggagggtgggtaccaccaatctgcatctcgacgtgtccgacgccgttaatgtaatggtatacgtggggatcccaatcggcgagggcgctcacgacgaggaagtgctgaaaacaatagatgaaggggacgcagatgaagtcacaaaacagcgcattcacgacgggaaggagaagcccggtgccctgtggcacatatacgccgctaaggacgctgagaagatccgcgaactgctgagaaaagtgggagaagagcaaggacaggagaatcctccagatcatgaccctattcacgatcagagctggtatctcgaccagacacttaggaagagactttatgaggagtatggcgtccagggatgggcaatagtacagttccttggggacgctgttttcatccctgctggggctccacatcaggtgcacaacctatactcttgtattaaggtagccgaggattttgtttctccagagcacgtaaagcattgcttcagattgactcaggaattccgacatctgtccaatacacatacgaatcatgaagataaactacaagtcaagaatataatctatcacgcagtcaaggatgcggtgggaaccctgaaagcccacgagtccaagctggccagatcctag

SEQ ID NO: 229074 - DNA, 4656 bp, Artificial Sequence
  Description of Artificial Sequence: Synthetic coding sequence
ggctggcggtggctgtatggcgtcgtcagtcaccaggactctattacccggctgatggaggtgtctgtgactgagtcaggtgagatcaaaagcgtggacccacgactaattcacgttatgcttatggataatagcgcccctcagagcgaagggggaactctgaaggccgtgaagtcatcaaaaggcaagaagaaacgagaaagcatcgaaggcaaggacgggcgtcggagaaaatccgccagtgacagcgggtgcgaccccgcttctaagaagttgaagggagatcgcggagaagtggactctaacgggagcgacggcggagaagcatctcgcggtccttggaagggcggtaacgcctccggagaaccgggtctggatcagagagccaagcaacccccaagcacttttgttcctcagataaatcgcaacattcgctttgccacttacaccaaggagaatggtagaaccctggtggtgcaagacgagccggtgggtggtgataccccagcttcttttacgccatacagtacagccacaggccaaactcctctcgctcccgaggtcggtggtgccgagaataaggaggccggtaagactttggagcaagtgggtcaggggatcgtggcatcagccgcagtcgtcaccaccgcaagctctactcccaacacagtgagaatcagcgatacagggctggccgcagggaccgtgccagagaaacagaaaggaagccgaagtcaggcttctggcgagaacagtcgcaattccatcctggccagtagtgggtttggcgctcccctgccgtctagtagccaacctttgacatttggtagcggtagatcacagagcaacggcgtcttggctactgagaacaagcccctcggtttctcctttgggtgtagctctgctcaggaggcccagaaagacacagacctgagcaagaacctcttcttccaatgtatgtcccagacattgcctacatccaattactttacaacagtatccgaatcacttgcagacgattcctcttcccgggattcttttaaacagtccctggaatctctgtcttcaggcctgtgcaagggtcgcagcgtcttaggtactgatacgaagccagggtcaaaggctggctcctctgtggatcggaaggtgcccgctgagagtatgcccaccctcaccccagcttttcccaggtcactgcttaacgccagaacacctgagaaccacgaaaatctgttcctgcagccacctaagctgtctagggaagaacctagcaatccttttcttgctttcgtggaaaaggtggagcactctccattttcgagcttcgcatcacaggccagcggatccagcagctctgcaacgactgtgacgtccaaagtggctccttcctggcctgagagccattctagtgctgacagtgccagcctggccaaaaaaaagccgctctttatcactaccgacagtagcaagctggtatctggcgtgcttggaagcgcacttacctccggtggacctagtctttctgctatgggaaatggcagatcttcctcccccaccagcagcctgacacagcccattgaaatgcccacattaagctcgtctccgacagaggaaaggcctacagtgggccctggccagcaggataatcctttgttgaaaactttttctaatgtgtttggaagacactctggaggattcttaagctccccggcagacttctcacaggaaaacaaggccccattcgaggctgtcaaaaggttcagcttggatgagaggtccctcgcttgtagacaggactctgatagtagcaccaattcagatctcagcgatttgtctgattctgaagagcaactccaggcaaagaccgggctgaaaggaatccctgaacacctaatgggaaaactgggacccaatggcgaacggtccgccgagctactcctcggcaaatcaaaggggaagcaggcaccaaagggacggcctcgcactgccccactgaaagttggccagagcgtcctgaaggatgtttcaaaggtcaagaagctgaaacagtccggagagccatttctccaggatggcagctgcattaatgtcgctccacacttgcacaagtgccgcgagtgcagacttgagagatatcggaaattcaaagaacaggagcaggatgattccacagtggcatgccgcttctttcactttcggaggctgatctttacacgaaagggggtcttgagggttgagggatttctcagccctcagcagagtgaccccgatgccatgaatctgtggataccctcttccagtctagcagagggaatcgatttggagacctcaaagtacatcctggctaacgttggggaccagttctgtcagttagtgatgtcagagaaggaagcaatgatgatggtagagccccatcagaaggtggcgtggaaacgtgccgtgaggggggtacgggagatgtgcgacgtttgcgaaacaaccctgttcaacattcactgggtgtgtcgtaagtgtgggtttggtgtgtgcctggactgttatagattgcgcaagagtaggcctaggagcgagaccgaagagatgggggatgaggaggtgttttcttggctgaaatgtgctaaagggcagtctcacgaacccgaaaacttgatgcctacccaaattatcccagggaccgccctgtacaatattggggatatggtgcatgcagctcgcggtaagtggggtatcaaggccaactgtccatgcatttctcgccagaacaagtcggtattaagacccgctgtcaccaacggaatgagccagttaccttccatcaacccgtccgccagcagcggcaatgagaccacctttagtggtggcggtggccctgcccctgtgaccactcccgaacccgatcacgtaccaaaggccgattctacagatatcagatctgaggagcctctgaaaacagactcctccgccagcaattcaaactccgaacttaaggctatcagacctccatgtcctgataccgccccaccttcctccgctctgcactggttagctgatctggctactcagaaggccaaggaagagacgaaggaggctggaagtctgcggagtgttttaaacaaagaatcccattccccgttcggcttggactcattcaacagcaccgctaaagtgtctcccctgacaccaaaattatttaattctttgctgcttggccctacggccagcaacaacaagacagagggaagtagcctgagggaccttctgcattcgggaccgggaaaactaccgcagactcccctggacaccggtatcccatttccgccagttttcagtacgtcgtcagccggtgtgaagtccaaagcatcccttcctaacttcctcgatcatatcatagcctccgtggtggagaacaagaaaacttcggatgccagtaagagagcatgtaacctcacagatacccagaaagaggttaaggaaatggtaatgggactgaacgtgttggatccccacaccagccactcctggctctgtgacggacgtttgttgtgcttgcacgatccttcaaataagaacaactggaaaatttttagagaatgctggaaacaggggcagccagtgctggtgtcaggcgtgcacaagaaattaaagtccgagctttggaaacccgaggccttctcacaagaatttggagaccaggacgtggatctggtgaactgtaggaactgcgcaattataagcgacgtaaaggtccgagatttctgggatgggtttgagatcatatgtaaaagactgcgctccgaggacggacagcccatggtgttgaaactgaaagattggcccccaggggaagatttccgtgatatgatgccaactcggttcgaggatctcatggagaatctgcctctccccgagtatacgaagagggacggcaggctgaaccttgcatctagactccctagttacttcgtgcggccagacttaggtccaaagatgtataatgcctatggcctgattaccgccgaggataggagggtgggaacgaccaatctgcacttggacgtgtcagacgccgtgaacgttatggtttatgtgggaatcccgattggagaaggagcccatgatgaggaagttctgaaaactatagacgagggcgatgcagatgaagttaccaaacagcgcatacacgacggtaaggaaaagcctggagccctgtggcacatctacgcagccaaggacgcagaaaagatacgcgagttgttaaggaaagtgggtgaagaacaaggccaagagaatcctcctgaccacgatcccatccatgaccaatcctggtacctggatcagactttgagaaaaagactctatgaggaatacggcgtacaaggatgggcaatcgttcagtttctaggagatgctgtgttcatccccgcaggagctccccaccaggttcataacctatacagctgtattaaagtggcagaggatttcgtttctccagaacatgtgaagcactgtttcagactgacccaagaatttcgccacctttccaatactcataccaatcacgaggataagctgcaggtgaagaatatcatctaccacgccgtgaaagatgccgtcggaacactgaaagcacatgaatccaaactggcacggtcttag

SEQ ID NO: 229075 - DNA, 2148 bp, Artificial Sequence
  Description of Artificial Sequence: Synthetic coding sequence
atggcaggcgtcggcccaggaggatacgcagctgaatttgtgcccccacctgaatgtcccgtatttgaacccagttgggaagaatttactgatcctctttccttcatcggtcggattcggcctctcgccgagaagacagggatctgcaagatcaggccccctaaggaatatgcgcttagcgggtggaacctgaacaacatgcctgtgctagagcagtcagtgttggcacacataaatgttgatatatccgggatgaaggtgccctggctatacgtgggaatgtgtttttcatccttttgctggcatatcgaggaccattggtcctattcaatcaactacctgcattggggggagccaaagacgtggtacggggtaccgtctcacgcagcggagcaactcgaggaggtgatgcgggaactagcacccgagctgttcgaaagccagccggatctcttacaccagcttgttaccattatgaaccctaacgtgctgatggaacatggcgtacccgtgtatagaacgaaccagtgtgcaggggagtttgttgtaacctttcctcgcgcttatcattcagggtttaaccagggttataactttgccgaagcagtgaatttctgcactgcagattggctgcccattggcagacagtgcgtgaaccactataggcggctgcggcgacactgcgtgttttcacacgaggaactgatctttaagatggcagctgacccagaatgcttggatgttgggctggcagccatggtgtgtaaggagctgaccctcatgacagaagaagagaccagactgcgagagagcgtggtccagatgggagtcctgatgtccgaggaggaggtttttgaactcgtccccgatgacgagaggcagtgctccgcatgtcggacaacttgttttttatcagccctgacctgttcttgcaatcctgagcggctggtgtgtctgtaccatcctaccgatctgtgtccgtgccccatgcaaaaaaaatgcctaaggtatcggtatcctctcgaggacctcccatccctcctttacggcgttaaagtgagagcacaaagttatgatacatgggtgtcgagggtgacagaggccctgtctgccaattttaaccataagaaggacctgatcgagctcagggtgatgctggaagatgctgaagaccgaaagtaccccgagaatgatctatttcggaaacttagggatgctgttaaagaagctgaaacttgcgccagcgtcgcacagctgcttctgtccaagaaacagaagcaccggcagagccccgactctggaaggacacgcaccaagctgaccgtcgaagaactgaaggcctttgttcagcagctcttttcccttccctgcgtgatatcccaggccaggcaagtcaaaaatctgctggacgatgtggaagaattccacgagcgcgcacaggaagctatgatggacgagactcccgatagctccaagctgcagatgctgattgacatgggcagttcactgtacgtcgagctcccggagctgccacgcctcaaacaggagctccagcaggcacggtggctagacgaggtgcgcctaacactgtctgacccacaacaggtgaccctcgacgtcatgaagaagcttattgattcaggggtgggacttgcaccgcaccatgccgtggagaaggcgatggccgagctgcaggagctcctgacagtgtcagaacgttgggaggagaaggccaaagtgtgcctgcaagctcgacctcgacactccgtcgcctctctggagtccatagtcaatgaggcaaagaacatacctgcattcctaccaaacgtactatctttgaaagaagctttgcagaaagcgagagagtggactgccaaggtagaggctatccagtctggctccaattacgcctacctggaacagctggaatccctgtcagccaaagggcgtccaatacccgtccggttggaggcactgccacaggttgagtcccaggtggcagccgctcgggcttggagagagagaacaggtagaacctttctgaagaaaaacagttcccataccctgctacaagtacttagccccagaacagacattggcgtttacggatccggaaagaatcgtcggaagaaagtgaaagagttgtag

SEQ ID NO: 229076 - DNA, 4911 bp, Artificial Sequence
  Description of Artificial Sequence: Synthetic coding sequence
atggccggtgttggccctggcggatacgcagccgaattcgtgccaccccctgagtgccccgtcttcgaacctagctgggaagagtttaccgatcctctctccttcattggcagaattcggccactggcagagaagactggaatttgcaagatcagaccccctaaagactggcagccgccattcgcttgcgaggtcaagtcattcaggttcaccccacgcgtccagcggctcaacgagctagaggccatgactagggtcagactggatttcctcgatcagctggcaaagttctgggagctgcagggtagcactctcaaaatcccggtcgttgaacgtaagatcctggacctatacgctctctctaagatcgttgcatccaagggagggtttgagatggtgactaaggaaaaaaagtggtccaaggtgggttcacgtctcggatatttgccaggtaagggcacaggttccttactgaaaagccactacgagaggattctgtacccatacgagctcttccagagcggagtttccctgatgggtgtccaaatgcccaacctggatttgaaggagaaggtggaacccgaggtgctttcgacagatacgcagaccagccccgagccgggaacacgcatgaatattctccctaaacggactcgccgtgtgaagactcagagcgaatccggtgatgtttcaaggaatactgagctcaagaaactccagattttcggagcaggacccaaggtggtggggctggccatgggaaccaaagacaaggaagacgaggtgacaagaaggaggaaagtgaccaacagatccgacgccttcaatatgcaaatgaggcagaggaagggtacactgagtgtgaattttgtggacctctacgtgtgcatgttttgcggacgagggaacaacgaggataagttactgttgtgtgatggttgtgacgatagctatcacacattctgtctgattcccccactgccggatgtacccaaaggtgattggagatgtcctaaatgtgtggcagaggagtgctcaaaaccacgggaggccttcggatttgagcaggccgttcgcgaatatacacttcagagcttcggggaaatggccgataacttcaagtcagattatttcaacatgccggtgcacatggtccccacagagctggtcgaaaaggaattctggagactagtgtcctcaattgaggaggacgtcatagtcgaatatggagcggacattagttctaaagactttggaagtggcttcccagtaaaagacggtagacgaaaaattcttcccgaggaagaagagtatgctcttagcggctggaacttgaacaacatgcctgtcctggagcagtccgtcctcgcacatatcaatgtggatattagtgggatgaaagtgccatggttatatgtgggaatgtgtttttccagcttctgctggcatatagaggatcattggagctactcaattaattaccttcattggggcgaaccgaaaacatggtacggcgtgccctcacacgctgcagagcagctggaggaagttatgcgggaactagcaccagagctcttcgagtcccaacctgatttgttgcaccagttggtcactattatgaaccctaacgtgctcatggaacacggagtgccagtgtataggaccaaccaatgtgcgggagagtttgttgtgactttccccagagcctatcattctggatttaatcaggggtacaattttgccgaggcggtgaacttctgcactgctgactggctgcccatcggcaggcagtgcgttaatcactaccgtcgtctacggagacactgcgtgttttcccacgaagagctcatttttaaaatggccgctgatccagaatgcctggatgttggcctcgccgctatggtctgcaaagagctgaccctgatgacagaggaagagacaaggctccgcgaatccgttgtgcagatgggagtgttaatgtctgaggaagaggtgtttgaactcgtgccagatgacgagcgacagtgctccgcttgccgtacaacatgctttctaagcgccctgacttgttcatgtaatcctgaacgactggtctgcctctatcatcctacagacctgtgtccttgcccaatgcaaaagaaatgcctgaggtacaggtaccccctggaggacctgccaagcctgctgtacggggtgaaggtgcgggcacagagctacgatacgtgggttagtcgtgttacagaagcgctttctgctaatttcaaccataagaaggacttgattgagcttcgggtgatgctggaggatgcagaggatcggaagtatccagaaaatgacctgttcagaaaactacgagacgcagtaaaggaagcggaaacctgcgcctcagtggcccagttgctcctgagtaagaaacagaaacataggcagagcccagacagtggacgcacccgcaccaaattgacagtggaagagttaaaagcattcgtccagcaactgttctccctgccctgcgtcatttcacaggccagacaagtgaaaaatctgctggacgatgtcgaagagtttcatgagcgcgcacaggaggccatgatggatgagacaccagattcgtctaaactgcagatgttgatagatatgggtagttccttgtacgtcgagctgcccgagcttcccagacttaagcaggaattgcaacaggcacgttggttagacgaagttcgcctcaccttgagtgacccgcaacaagttacattagacgtaatgaaaaagctgatcgactccggcgtgggcttggctccccaccatgccgttgagaaagctatggccgaattgcaagagctgctgacagtttcagagcgatgggaggagaaggctaaagtgtgtctccaggccagaccacgtcattctgtggcaagtctagagtcaattgtgaacgaggccaaaaatatcccagccttcctgccgaacgtgctgagcctcaaggaagctctacagaaagctagggagtggacagccaaagttgaagccatccagagtggctccaattacgcctacctggaacagcttgaatctctaagcgctaagggcagacctatcccggttcggctggaggcactccctcaagttgagtcccaggtggctgcagctagggcctggcgggaaagaacaggcagaactttcctgaaaaagaatagcagtcacaccctgcttcaggtgctgtctcctaggactgatatcggagtgtacggttctggcaagaataggaggaagaaggtgaaggagctgattgagaaggaaaaggagaaagacctggacctcgaacccctgagtgacctcgaggaagggttagaggagactcgggacacagctatggtggtggccgtttttaaagagagagagcagaaagaaatagaggcaatgcactctctgagggccgctaaccttgcaaaaatgaccatggttgatcggatcgaggaggtgaagttttgcatctgtcgaaaaacagctagcgggtttatgctgcagtgcgaactgtgtaaggattggtttcacaattcctgcgttccactgcctaagtcttcaagccagaagaagggaagcagttggcaggctaaggaggttaagtttctctgtccgctgtgtatgcggtctcgccgtcctcgtctggaaacaatcctgtcgctgctggtgtcgctgcagaaattgcccgtcaggctgcctgagggcgaagctctgcagtgtctgaccgagcgagctatgagttggcaggaccgagcaagacaggcacttgccaccgatgaactgagcagtgccttggcgaagctgtccgtactctctcaacgcatggtggagcaagcagcaagggagaagaccgagaaaataatctccgctgagctccagaaggccgcagcgaaccctgatttgcagggccacttaccttcctttcaacagagtgctttcaaccgcgttgtgagctctgtcagcagctcccctcggcagactatggattacgacgatgaggaaacggattcggacgaggatatacgcgagacctacggctacgatatgaaagataccgcctccgtgaaatcatccagcagtttggagcccaatctgttctgtgatgaggagataccgatcaagagcgaagaggtagtgacccatatgtggacggcacctagcttctgcgccgaacatgcctatagtagcgcctcaaagagctgttcgcagggaagctccacccctcggaagcagccgaggaagtctcccctggtgccacggtctttggagcctcctgtactggaactgagccctggggctaaggcccagctcgaggaacttatgatggtgggagacctgctcgaagtctccctggacgagactcagcatatttggcggattctgcaggccacacaccccccttctgaggaccggttcctgcatattatggaggacgatagtatggaggaaaagccccttaaagtaaagggcaaagactcgagtgagaagaagcgcaaacgcaaactagagaaggttgaacaactttttggggaaggaaaacagaagtcaaaagaactgaagaagatggataagcctcgcaagaagaagctcaagctgggagctgacaagtctaaagagctaaacaagctggccaaaaagctggccaaggaagaggaacgaaaaaagaagaaggaaaaggccgctgccgctaaagtggagctcgtgaaggaaagtaccgaaaagaagcgtgagaagaaggttctagatattccaagcaaatatgattggagtggagccgaggagagtgatgatgaaaacgccgtgtgcgccgctcagaattgccaacgaccatgcaaggacaagggcgttgtgttcgtaaccgaggaggaaaaaaataagaagtattag

SEQ ID NO: 229077 - DNA, 3150 bp, Artificial Sequence
  Description of Artificial Sequence: Synthetic coding sequence
atggcaggcgtggggccaggcggttacgcagctgaattcgttcccccacccgagtgccccgtgttcgagccctcctgggaagagtttactgacccactgtcgtttatagggaggatcaggccacttgctgagaagactggaatttgtaagatcagacctcccaaagattggcagcccccatttgcctgcgaagttaagtcgttccgcttcacccccagagtacagaggttgaacgaactcgaaatcgtggcatccaagggtgggttcgaaatggttacaaaagaaaagaagtggtcgaaggttgggagccgactgggatacctgccagggaagggcacgggctctctcttgaaatcacactatgagcgcatactctatccctacgagctgtttcagtccggcgttagcctgatgggggtgcagatgcccaaccttgacctgaaagagaaagttgagccggaagtgctttccacggacacacaaaccagccccgagccagggactaggatgaatatcctccctaagaggactagacgggtcaagacacaaagcgaatctggagatgtgtcaagaaacactgagctgaaaaagctgcagatcttcggagcaggccctaaggtggtgggacttgccatgggaaccaaggataaggaagatgaggtcacccgcagacggaaggtgacaaacaggtcagacgcatttaatatgcaaatgcggcaacgcaagggcaccctttctgtgaatttcgtggatctgtatgtctgtatgttctgcggcagaggcaataatgaagataagctcttactgtgcgacgggtgcgatgactcctaccacacgttctgtctcattccacccctgcccgatgtcccgaagggagactggcgttgccctaagtgtgtggcggaagagtgctccaagcccagggaggcattcggcttcgaacaggcagttagggaatacactttgcagtcttttggcgagatggccgataatttcaagagcgattatttcaatatgcccgtgcacatggtcccaacagagttagtggaaaaggaattctggaggttggtttcaagcattgaggaggacgtgattgtggagtatggcgctgacatcagcagcaaagacttcggaagcgggttcccggtcaaagatgggaggcgcaagatcctacccgaagaagaggaatacgcgctgagtggctggaacctcaataacatgccggtgttggagcagtccgtgctggcacacatcaatgtggatataagtggcatgaaggtaccttggctctacgtgggcatgtgctttagcagcttttgctggcatatcgaggatcattggagttattcaattaactacctgcactggggcgaacccaaaacatggtacggcgtgccatctcatgcggcagaacagctggaagaagtcatgcgggagctggcccctgagctgttcgagtcgcagcctgacctcctgcaccagctagttacaatcatgaaccctaatgtgctaatggaacatggggtgcctgtatacaggacaaatcaatgcgcaggtgaatttgtggttacattccccagggcatatcattccggatttaaccagggctacaatttcgctgaagctgtcaacttttgcacagctgactggctccctattgggaggcagtgtgttaatcattaccgcaggctcagacgacattgcgtgttctcacacgaggagctgatttttaaaatggctgccgacccggaatgccttgacgtcggattggcagcaatggtgtgtaaagaactgactctgatgacagaagaagagacacgtctcagggagtcagtagtgcagatgggagtgttgatgtcagaggaagaagttttcgagttagttcctgatgatgaacgccagtgtagcgcgtgtcgaaccacctgctttttatccgccctgacatgttcttgtaatcctgagcggcttgtgtgtttgtatcaccccactgatctttgtccctgccctatgcagaaaaagtgtcttcgatacaggtatccgctggaagatcttcccagcctactctacggtgtgaaagtcagggcccagagctacgatacctgggtgtcacgcgtaactgaggccctgtcagccaactttaaccacaaaaaggaccttatcgaattgcgggtgatgctggaggacgccgaggaccgcaaataccctgaaaacgatttgttcagaaaactgcgggacgcagtcaaggaagctgaaacctgtgcctcagtcgcacagctcctgttatccaagaagcagaaacacaggcagagccccgatagcggccgaacacgcacaaagttaaccgtcgaagagttgaaggcgttcgtgcagcagctgttttccttaccttgcgtgattagtcaggctcgccaggtgaagaatttgctcgacgacgtagaggaatttcatgaacgggcacaagaggcaatgatggatgagacccctgactctagcaagctgcagatgctcatcgatatggggtccagcttatatgttgagctcccagaactgcctagacttaaacaggagctccagcaggctcgatggctagatgaagtgaggctaaccttatccgatccacaacaggtcaccctcgacgttatgaagaagcttatagattccggagttggtctcgctccccatcatgctgtggaaaaggcgatggcagagctccaagaacttctgaccgttagtgaacgctgggaggagaaggccaaagtctgcctgcaagcacgccctcggcattctgtagccagtctagagtccatcgtcaacgaagcaaaaaacatccccgcatttctgccaaatgttctaagtctgaaggaggcgctccagaaggcccgagagtggacagctaaggtggaagcaattcaatccggcagtaattacgcctacctggagcaactcgagtccctgtccgctaagggcagaccaattccggtgcgactggaggccttgccacaggtggagtcgcaggtggccgcagcacgagcatggcgtgagagaactggtcgaacctttctgaaaaagaactctagtcacactctgttgcaagttttgtctcccagaaccgacattggagtgtatggatctggcaaaaatcgacgatag

SEQ ID NO: 229078 - DNA, 5072 bp, Artificial Sequence
  Description of Artificial Sequence: Synthetic coding sequence
atggctggtgtgggccctggaggttacgctgctgagtttgtgccaccaccagaatgtccggtttttgaaccatcatgggaagaatttacggatcctctaagtttcatcggacggattagacccctggctgagaagacagggatctgtaagattagaccacctaaagattggcaaccaccctttgcatgcgaagtaaaaagtttccgtttcacaccccgtgtgcagcgcctcaatgaactggaggcaatgactagggttcgcctcgactttctggaccagctggcaaagttttgggagttgcagggcagcacactgaaaatcccagtcgtggaacgcaaaatcctggatttatacgccctgagtaagatcgtcgcttctaagggaggcttcgagatggtgactaaggagaaaaaatggtccaaagtggggtctcgcttaggatacctgcctggaaagggtacagggagtctgctgaagagccattacgaaagaattctttacccttacgaactgtttcaatccggcgtctctctgatgggagtacagatgcctaacctagacctgaaggagaaggtggaacccgaagtgctttccactgatacccagacgtcccccgagcccggtacgcgcatgaacattttacccaaaagaacacgacgggtaaagacccaatccgaatctggcgatgtgtcccgtaatactgagctgaaaaagctgcagatattcggcgctgggcctaaagtcgtcgggctagccatggggaccaaggataaggaggatgaggttacccgcaggaggaaggtaacaaaccgaagcgacgccttcaatatgcaaatgcggcagcgaaagggcaccctttcggtcaactttgtggacttgtacgtctgcatgttctgtggtcggggaaataacgaagataagttattgttgtgcgacgggtgcgatgattcataccacacattctgtctgatacctcctctgccagacgtgcccaagggcgactggcgatgtcccaagtgcgtggcggaggagtgtagcaagcccagggaggcgttcggctttgagcaggctgtccgagaatataccctccagtcgttcggcgagatggccgataactttaaaagcgactactttaacatgcccgtgcatatggtccctaccgaattagttgagaaggaattctggaggttggtgtctagtattgaagaagatgtgatcgtcgaatacggcgcagatatttcctcgaaagactttggatcaggctttccagttaaggatgggcgtagaaaaatcctacctgaggaggaggaatatgccctatccggttggaacctcaataatatgcctgttctggaacagagtgtcctggcacatattaatgtggacatctctggtatgaaagtcccgtggctatacgtgggcatgtgcttctcctcgttttgttggcacatcgaggaccactggtcatatagtatcaactatctccattggggggagccaaaaacatggtatggcgttccaagccacgctgccgagcagctggaggaagtgatgagagagttggccccagaactcttcgagagtcagccggacttacttcaccagttagtgacaattatgaatcctaatgttttaatggagcatggagtgcctgtctacagaaccaaccagtgtgccggagagtttgtcgttacattcccccgagcctaccactctgggtttaatcaaggctataattttgcagaagccgtgaacttctgtacagccgactggttgccaataggacgccagtgtgtcaatcattatcgccgtctgagacgacattgcgttttctcccacgaagaactgatcttcaaaatggctgcggaccccgaatgcctggacgtaggcctggccgctatggtctgtaaggagttaaccttgatgacagaggaagaaacccgactaagggaatccgtggtgcaaatgggagtgttaatgtctgaagaggaagtattcgaattggtgcctgacgatgaaaggcagtgttcagcatgcaggacaacctgctttctgtcagcactcacttgctcctgtaaccctgagaggcttgtgtgcctgtaccaccccacagatctgtgtccttgccctatgcagaagaagtgcctgcgctataggtaccctttggaggatctgccaagcctgctgtatggtgtaaaggtccgcgctcagagttatgacacttgggtgtcgcgagtcactgaagccctgagcgcaaatttcaaccacaaaaaggacctgattgagctgagggtgatgttggaagatgccgaagatcggaaatacccagagaatgatctctttcgcaagttgcgcgatgccgtgaaggaagccgaaacatgcgcgtccgttgcacagctgctgttgagcaagaagcaaaaacaccgccaatctcccgactctggcagaacccgcacaaaactgacagtagaggaattgaaggctttcgtacagcagctgttttcgcttccctgcgtcatctcgcaggcacggcaggtcaagaatcttctagatgatgtggaagagttccacgagcgcgctcaggaggccatgatggatgaaacaccagactcttctaaactccagatgttaatcgacatgggttcgtctctctacgttgagctgcctgaactgcctcgcctcaagcaggagctgcagcaagctaggtggttggatgaagttcggctcaccctttccgatccacaacaggtcactctggacgttatgaaaaagctgatagattccggagtgggtctggcaccccaccatgccgtggaaaaagctatggccgagctgcaagaactgctgaccgtgtcagagagatgggaggagaaggcgaaggtgtgcttacaggctaggcctcggcattccgttgcatcccttgagagcatcgtcaacgaggctaagaatattcctgccttcttaccaaacgtgctatccctcaaggaggcacttcagaaagcgagagaatggaccgccaaggttgaggctatacagagcggcagtaactacgcttatctagaacagctggaaagcctttccgccaaagggagaccaatccctgtgcggctggaggcactgccccaggtcgagagtcaggtggcagccgctagggcttggagggaacgcaccggcaggacattcttgaaaaagaattcctcacataccctgctccaggttctgtcccccaggaccgacattggggtgtacggcagtggaaagaatcggaggaagaaggttaaggagctgatcgagaaagagaaagagaaggatctggatctcgaaccactgtccgacctggaggaaggcctggaagaaactagggacacagctatggtggtggccgtctttaaagagcgggagcaaaaagagatcgaggccatgcactcacttagggccgcaaatcttgcaaagatgaccatggtggacagaatcgaggaggtgaagttctgtatttgccgaaagaccgcgagcggattcatgttgcagtgcgagctctgtaaagattggtttcataatagttgtgtacccctgcctaaatcctcatcacagaagaaaggctcctcttggcaggcaaaagaggtcaaattcctttgccccctatgtatgcggtctagacgtcccaggcttgagacaatcttgtctctcctggtgtcactccagaaactgccagtgaggcttcccgaaggggaggcccttcagtgtctgaccgaacgagcaatgtcttggcaggatagagctagacaggccctggcaacagatgaactcagcagcgccctggccaagctctcggtgctctcgcagaggatggttgagcaggccgctcgagaaaagacagagaagattatatctgccgaactccagaaggccgcagcaaatccagaccttcaaggtcatcttccctctttccagcaatctgcattcaatagggtcgtcagctccgtaagttcttctccacgacagaccatggattatgacgatgaggagacggattccgatgaagatattcgagagacgtacggatacgacatgaaagacactgccagtgtgaaatcaagtagcagtttggagcccaacctgttttgcgatgaggagatcccaatcaagagtgaagaggtggtgacacacatgtggactgcccctagtttttgtgccgagcacgcctatagttctgcgtccaagtcctgtagccagggcagttccactcctagaaaacagcctagaaagtcccccctagtgcccaggtctttagaacccccagtgctggagctttcccctggagccaaggcccagttggaggagctaatgatggtgggagatctgctggaggtgtctctagatgagacccaacatatatggagaatattgcaggccacgcaccctccttctgaggatcgttttctgcacatcatggaggatgattctatggaggaaaagcctctaaaggtcaaaggaaaggatagttctgagaagaaacgcaagagaaagctggaaaaggtggagcagttattcggggagggaaaacaaaaatcaaaggaactcaagaaaatggacaaaccgaggaaaaagaaattaaaactcggcgctgacaaatccaaagagctgaataagttagccaaaaagttagcaaaggaggaagagaggaagaagaagaaagagaaagcagccgcagctaaagtggaactcgttaaggagagcaccgagaaaaagcgcgaaaagaaggtcttagatataccttcgaagtatgactggtcgggcgctgaggaatccgatgatgagaatgccgtgtgcgccgcacagaactgccagcggccatgcaaagataaagtggactgggtgcagtgtgacggcggatgtgatgaatggtttcatcaggtttgtgttggcgtcagtcccgagatggccgaaaacgaggactacatctgcattaattgtgcaaaaaagcagggccctgtatctcctgggccagcccctcccccttcattcattatgagctataaacttcccatggaggacttaaaggagacttcata

SEQ ID NO: 229079 - DNA, 3828 bp, Artificial Sequence
  Description of Artificial Sequence: Synthetic coding sequence
atgggcttcgcccctggcaaagctgtcggctctcacattcgcggacactacgaacgtatactgaacccttataatctgtttctgagcggtgatagtctaaggtgcctgcaaaaaccaaatcttactactgacaccaaagacaaggagtataagcctcatgacataccccagcgacagagtgtgcagcctagcgagacatgcccacctgcccgtcgcgcaaagcgcatgcgggcagaggcaatgaatattaagattgagcccgaagagactactgaagccaggactcataacctgcgtaggcggatgggctgcccgacaccgaagtgcgagaacgagaaagagatgaaatcatcaataaagcaagaacctatagagcgtaaagattacatagtggagaacgaaaaagaaaagcctaagtctcgctccaagaaagcaacaaacgccgtggacctatacgtgtgtctgctatgcgggagcggaaatgatgaggacagactgctgctgtgtgatggatgtgatgacagttaccacaccttttgcctcatcccgcctctgcatgacgtgcccaagggggattggcggtgtccaaaatgcctggctcaggaatgtagtaaaccccaggaggccttcggattcgagcaagccgcacgggattatactctccgaacctttggagaaatggccgacgccttcaagagtgattatttcaatatgcctgtacacatggtacccaccgagcttgtagagaaggagttttggagactggtaagtactatcgaggaggacgtgactgttgaatacggagccgatatcgcgagtaaagagttcggcagcggcttccctgtgagggatggcaaaatcaaactgagcccagaagaagaggaatacctggattcaggatggaaccttaataacatgcctgtcatggagcagtctgttttggctcacattacagccgatatttgcgggatgaagttgccatggctctacgtgggcatgtgtttctcttccttctgttggcatatcgaggatcactggtcttatagtatcaactatctccactggggcgagcccaagacatggtacggcgtgcctggctatgcggcagaacaactggaaaacgtcatgaaaaagctggccccagagcttttcgtgtctcaacctgacttgttacaccagctagtcactatcatgaatcctaacaccctcatgactcatgaggtgcccgtgtatagaacgaaccagtgtgctggtgaatttgttattactttccccagggcatatcattccggtttcaaccagggctttaacttcgccgaggctgtgaacttctgcactgtcgattggctccccctcggccgtcagtgtgtggagcactatcggcttttacacaggtactgcgtgttttcgcacgatgaaatgatctgcaagatggcttcgaaggccgatgtgctcgacgtggtggtggcgagcactgtccagaaggatatggccatcatgatcgaggacgaaaaggcactccgtgaaacagtgcggaagctcggggttatagattccgaaaggatggacttcgagctgcttcccgacgatgagcggcagtgcgtcaaatgcaaaacaacatgctttatgtctgccattagttgcagttgcaaacccggactcttggtgtgcctgcaccacgtgaaagagctgtgcagctgccccccttacaagtataaactaagatacagatatacactggacgatctgtacccgatgatgaacgccctgaagctgagagcagagagctataatgagtgggctctgaatgtaaacgaggccctggaggcaaagattaataagaagaagtctttggtgagttttaaagcacttatcgaggagtccgaaatgaaaaaattccccgacaacgacctgctcaggcatttaaggctggttacccaagacgccgagaagtgcgcgtcggtcgctcagcagctcttgaatggaaagcggcagaccaggtatagatctgggggtggcaaaagtcaaaaccagctgacagtgaacgaactgagacaatttgtgacgcagctgtacgctctgccgtgtgtcctgagtcaaacaccactcttgaaggacctgctgaatagagttgaggattttcagcaacacagccaaaagctgctttctgaggagaccccatccgccgctgaactgcaggatctgctggatgtgagttttgaatttgatgtggaactgccacaactcgccgagatgaggattcgcctggaacaggctcgatggctggaggaagtccagcaggcttgcttggacccttcttccctaaccctcgatgacatgcggcgtcttatagacctcggagtcggactcgccccttattctgccgtggaaaaagccatggcccgtctgcaggagctgctcacagtcagtgaacattgggacgacaaagccaagagtcttctaaaggccaggcctaggcatagcctcaattctctcgcgacggccgtgaaagagatcgaggagattcctgcttatctgcctaatggggctgctttaaaggatagcgtccagcgagctcgtgattggttgcaggacgttgagggattacaggctggtggaagggtccctgtcctcgatactctgattgagctggtgacccgcggacggtccattcccgtgcatcttaactccttgccccgactcgaaaccctggtagcagaggtccaggcctggaaagagtgtgctgtgaacaccttcctgaccgaaaatagtccctattcactcctggaagtgctatgccctcgatgtgacatcggactgttgggcctgaagagaaaacaaagaaaactcaaggaacccctgcccaacggcaagaagaaatctacaaagctggaatccctgagcgatctggagcgcgctctcacagaatctaaagagacagcatctgccatggccactctgggggaggctaggctacgggagatggaggcactacaaagtctacgacttgccaatgaaggcaagcttcttagccccctccaggacgtggacatcaagatctgtctgtgccaaaaagcgcctgctgccccaatgatccaatgtgaactctgccgagacgcgtttcacacgtcctgcgtggccgttccctcaatttcccagggattaagaatttggctatgccctcactgccggcgatcagagaagccaccactggagaaaattttaccattgttggccagcctgcagaggattcgggtgaggttaccagagggtgatgccctgcgttatatgatcgaacgtactgtgaattggcagcatcgagcccagcagctgctttcttccggaaatctcaagtttgttcaggaccgcgtcggttctggattactgtattcacgctggcaagcctccgctggtcaggtttctgataccaacaaggtttcccagcccccaggcaccacaagttttagcctgcccgacgattgggataacaggacatcatatctccactccccctttagcaccgggaggtcctgcatccctctgcatggagtctctccagaggtgaacgaactgctgatggaagcacaactgttgcaggtgagcctccctgaaatccaggaactgtaccagacactactggccaagccctcccccgcacagcagactgatcgctctagtccagtgcgacccagctctgagaagaacgactgctgccgcggtaagcgggacggcattaactccctggaaaggaaactaaaaaggcggttggagagagaaggactgtcttcagaaagatgggagcgggtcaaaaagatgcgcactccttag

SEQ ID NO: 229080 - DNA, 4743 bp, Artificial Sequence
  Description of Artificial Sequence: Synthetic coding sequence
atggaggccgctaccaccctgcatcctggccctaggcccgctctaccgttgggaggccctggccctctgggggagtttctacctccccctgaatgtcccgtgttcgagccctcatgggaagagttcgccgaccctttcgcgtttatacacaagattcggccaatcgcggagcaaacgggtatctgtaaagtcaggccaccacccgattggcagccaccattcgcttgtgacgtcgataagctgcatttcacccctcggatacagagactgaacgagctagaggcccagactcgcgtgaaactcaactttctcgatcagattgcaaagtactgggaactccaggggtccaccttgaagatcccccacgttgaacgtaaaatactggatttgttccagctcaacaaattagtggcggaagagggcggtttcgcagttgtttgtaaggaccgcaaatggaccaaaatagcgactaagatgggatttgcccctggtaaggccgtgggcagtcatatacgtggacactatgagaggatcctcaatccttacaatttgttcttgagcggggacagtctgaggtgtctgcagaaacctaatctcaccacagacacgaaggacaaagagtataaaccacatgacatcccacaacggcagtccgtgcagcctagcgaaacctgtccccctgccaggcgggctaaacgtatgagagccgagaggcaatcactggctgtattgcccaggctggaatgctcaggagccatcctcgcacactgtaaccttcgcttactcgattctagcaacagttctgcttcggcctcccaggcgatgaacattaagatcgagcccgaggagacaacagaggccagaacacacaatctgcggaggcgtatgggctgcccaacccccaagtgtgagaatgaaaaggaaatgaaaagtagcatcaaacaggagccgatagagcgcaaggattacatcgtcgaaaacgaaaaagaaaagccaaagagccggtccaaaaaagcaacaaacgccgtagacctgtacgtgtgcctgctttgtgggtccgggaacgatgaggatcggttattgttgtgtgacggttgtgatgactcatatcatacgttttgcctcattcccccactgcacgatgtgcctaagggcgattggagatgccccaaatgtctagcacaggagtgctccaaaccacaggaagcattcgggttcgaacaagccgcacgagattataccttacgcacctttggggagatggctgatgcgtttaaaagtgactattttaatatgcctgtgcatatggtcccgacagaattagtggagaaagagttctggcgactcgtttctacaatagaggaggatgtgaccgtggaatacggagcagacatagcgagtaaagaatttggctctggattcccagtgcgagatggaaagattaaactgtcacccgaagaggaggaatatctggatagcggctggaatctgaacaacatgcctgtaatggaacagagcgttctggcgcacatcacagcagacatatgcggcatgaagcttccttggttatatgtgggcatgtgctttagttccttctgttggcatatcgaggatcattggtcttatagcatcaactatctgcactggggtgagcctaaaacttggtacggggtccctggctatgctgctgaacagcttgaaaatgttatgaaaaaacttgcacctgaactgttcgtcagtcagccggatctcctacaccagctggtaacaatcatgaacccaaacacgcttatgactcacgaagtgccagtgtatagaaccaaccagtgtgcaggagaatttgtcatcactttccccagagcctatcatagtgggttcaatcagggctttaatttcgctgaggccgtgaacttctgcaccgtggactggttgccactgggcagacagtgcgtagagcattacaggttgctgcaccggtactgcgtttttagtcacgacgaaatgatctgcaagatggcatctaaagctgatgtcctggacgtggttgtggcatctaccgtgcagaaggacatggctatcatgatagaagacgagaaggccttacgggagaccgtgaggaagttaggcgtcattgacagcgagcgtatggactttgagctacttcccgacgacgagaggcagtgcgtgaagtgtaaaacaacctgctttatgtctgcgatatcatgttcctgtaaacctggactgttggtttgtctccatcatgttaaggagttgtgtagctgtcctccgtataagtataagctaagatataggtacaccttagatgatctttacccaatgatgaatgcccttaaactgcgtgctgagagctacaatgaatgggcattgaacgtgaatgaagctctggaggctaagattaacaaaaaaaagtccttggtgtcgtttaaggccttgattgaggagtcagaaatgaaaaaattcccagataacgacctactcagacacctgcgcctggtcactcaggatgccgagaaatgcgccagcgtcgcccagcagttacttaacggtaaacggcagacccgctatcggagcggaggcggaaagtctcaaaaccagttaacggttaacgagctgcgacagtttgtgacacagctgtacgccctgccatgtgtgctgtcgcagacgcctctgctaaaggacctgctgaaccgtgtcgaagattttcagcagcatagccagaagcttttgagcgaggaaacacctagcgcagccgaactacaagaccttctcgacgtatcttttgaatttgatgtggagctaccacagctcgctgaaatgaggattcggcttgagcaggctcgatggttggaagaagtccagcaggcctgtcttgatccaagtagtctcacactagatgacatgaggagactcatcgacttgggagtaggacttgccccttatagtgcagtggagaaggcaatggcccgtctgcaggaactgctgacagtttctgaacattgggatgataaagccaaaagcctgctgaaggctcgccctcgccacagcttaaatagcctcgccactgcagtgaaagaaattgaagagattccagcatacctgcctaatggcgctgcactgaaggactcagtacagcgagctcgcgattggctgcaggatgtcgaggggttgcaggctgggggacgggtacctgtgctagatactcttattgaactcgtgacccgtggacgcagtatccccgtccacttaaattcacttcccagactggagactctggtagcagaggtgcaggcttggaaagagtgtgccgtgaatactttcttgacagagaatagcccttactccctgctagaagtcctgtgccccagatgcgacatcggtctgcttgggctgaaacggaagcagaggaaattaaaagaaccgttgcctaatggaaagaagaaaagcaccaagctggagtctctgtccgatctagaacgagcgctgacagaatctaaggagacagcatccgcaatggccactctgggagaggcccgtcttcgagaaatggaggcgctacagtctttgcggctggccaatgagggaaaactattaagcccacttcaggatgtggacattaagatctgcctctgtcagaaggctcccgctgcacccatgattcagtgcgagctctgtcgcgatgcgttccatacctcttgtgtcgcagtaccaagcattagccaggggctgagaatttggctatgtccccattgtcggcgttcagaaaagccgccattagaaaagattctgcctctgctcgcttctcttcagaggattagggtgcgtttgcccgagggagatgctctgaggtacatgatcgagaggacagtgaattggcagcatagggcccagcagctcctcagctcgggtaatctgaagtttgtgcaggatcgcgtgggaagcggcctgctgtattcaaggtggcaggcttccgccggacaggtatcggataccaacaaggtatctcaacccccaggcaccaccagcttctccttaccggatgattgggacaatcgtacctcctatctacacagccctttcagtaccggacgctcttgtattccccttcacggcgtctccccagaagtgaacgagttgctaatggaggcccaactattacaagtctcattacccgagatccaggaactgtaccaaaccttgttggctaaaccctctcccgctcaacaaactgacagatcctctccggttcggcctagctctgagaagaatgattgctgcaggggaaagagggatggcatcaactccttagagaggaagctgaaacgaaggctcgagagagagggtctctcttcggagcgatgggagcgggtgaagaagatgcgcacacccaaaaaaaagaaaattaaactcagtcatcccaaggatatgaacaatttcaagcttgaacgtgaacgtagctacgagctggtgcgaagcgctgagacgcactctttacctagtgacacatcatactccgaacaggaagactccgaagatgaggatgctatctgccctgccgtgtcctgtcttcaacctgaaggcgacgaagtagactgggttcagtgcgacggcagctgtaaccaatggtttcaccaagtatgcgtaggcgttagtcccgagatggctgagaaagaagactacatctgcgttaggtgcacggttaaggacgctcctagccggaaatag

SEQ ID NO: 229081 - DNA, 4635 bp, Artificial Sequence
  Description of Artificial Sequence: Synthetic coding sequence
atggaagcagccaccaccttgcaccctggcccacgacccgcactgccattaggaggcccaggtccactgggagaattcctgccgccacccgaatgccccgttttcgagccatcatgggaggagtttgccgatccgttcgctttcattcacaagatcagacctatcgccgaacagaccgggatttgtaaggtacgtccgccacccgactggcaaccaccctttgcttgcgacgttgataagctccactttacccccaggatccagaggctgaacgagcttgaggctcaaactcgggtaaaattgaactttctagaccagatcgctaagtattgggaactgcagggatctactttaaaaatcccacatgtagagaggaaaattttggatctgttccagctgaacaagctggtcgcggaagaaggcggattcgctgtggtctgcaaagatagaaagtggacaaagatcgcaactaagatgggcttcgctccaggcaaggcagttggctcacatatccgcggtcactatgagcgcatactgaatccatacaacctgtttctatctggagacagcctgcggtgcctccagaaacctaatctgacaaccgacacaaaagataaggagtacaagcctcacgacattcctcagagacagagcgtgcaaccaagtgagacatgtccacctgcccgacgagccaagcggatgcgcgcagaggccatgaatattaagatcgagcccgaagagacaacagaggcacgtacacataatctgaggagaaggatgggatgccctactcccaagtgcgaaaatgaaaaagaaatgaagtcctctatcaagcaagaaccgattgagagaaaagattatatagtcgagaacgaaaaggaaaaaccgaagtctaggtccaaaaaagctactaacgccgtggatctttatgtttgtctcttgtgcggaagtgggaacgacgaagatcggttgttactctgtgatgggtgtgatgactcataccacacattttgtcttatacccccactacatgacgtccccaaaggggactggcgttgtccaaaatgtctggcacaagaatgcagtaagcctcaggaggctttcggcttcgagcaggcggctcgtgactataccttgagaacatttggggagatggccgacgcctttaaatccgactatttcaacatgccagtgcatatggtccccactgagttggtggagaaagaattttggcgtttagtgtccaccattgaagaagacgtgactgtggaatacggcgcagatattgcgtcgaaggagttcggatctggattcccagtgagagatgggaaaatcaagctgtctcctgaagaagaggaataccttgactcaggctggaacctgaataacatgcccgtgatggagcagagtgttttggcccacatcaccgctgacatttgcgggatgaaactgccgtggctttatgtggggatgtgtttttctagcttctgctggcacatcgaggatcactggtcctattctatcaactatctccactggggtgagcccaagacctggtatggcgtcccagggtatgcagccgagcaactggagaatgttatgaaaaagctggctccagagctgtttgtgagtcagccggatctgttacaccagctggtaaccattatgaaccccaatactctgatgacccacgaggtgccagtgtatcggactaaccaatgcgcgggagagttcgtgattacctttccaagagcatatcacagcggattcaatcagggctttaacttcgctgaagccgtaaacttttgtaccgtcgactggctgcctttgggccgtcagtgtgtggagcactacagactgcttcaccgctattgcgtattctcccacgacgagatgatctgcaagatggcttccaaggccgacgttctagatgtggtggtcgcctctactgtccaaaaggatatggcaatcatgattgaggatgaaaaagctctgagggaaactgtgagaaaattgggtgtgattgatagcgaaagaatggattttgagctgctgccagatgacgaacggcaatgtgtgaagtgcaaaacgacttgctttatgtctgctatctcctgctcttgtaaaccgggactgctggtctgtctccaccacgtcaaagaactctgttcctgccctccatataagtacaagctgagatatcggtacacacttgatgatctttatcctatgatgaatgcccttaagctgagggccgagagctacaatgagtgggccctgaacgtaaacgaagcactggaagccaagatcaacaagaaaaagtcgttggtgagtttcaaagctttaattgaggagagtgaaatgaaaaagttcccagataatgaccttctgcgccatcttcgactggtgacccaggacgcagaaaagtgcgcttcagttgcacagcagcttctaaatggcaaaaggcagacaagatatcgctccggaggcggaaagtctcagaaccaactgaccgtcaatgagctgcgacagttcgtgacccagctgtacgcactgccgtgcgtgctgtcccagactcctcttttaaaggaccttctgaaccgagtagaggacttccagcagcacagccaaaagctgttaagcgaggagactcctagcgccgcagaattacaagatctgctagatgtgagttttgagttcgatgtagagctgccacagctggctgagatgaggattcgcctggaacaggctaggtggctagaagaagtgcagcaagcctgcctggacccctcgagccttacactagacgacatgcggcgactcatcgacttgggagtagggctggcaccctactccgcggtggagaaggccatggcacgcctccaagaactgctcaccgtaagtgagcattgggatgacaaggctaaatcactcttgaaggcccgtccacgacattctctcaatagcctggccacagccgtcaaagagattgaagagatccccgcataccttcccaacggggctgccctcaaggattccgtgcagcgagccagagattggctccaggatgtggaagggctgcaggccggtggtagagtgcctgtgctggacacactaatagagttggtcactcgcggtcgctccattccagtgcatttgaacagccttcccaggctggagactcttgttgccgaggttcaagcctggaaagagtgtgccgtgaatacctttctgacagagaactccccttactccctcctggaagttctatgtcctcgatgcgacattgggctcctgggactgaaacgaaagcagagaaagctgaaagagcctcttcccaacggtaagaagaaatcaactaaattagaatccctgtcggatctcgaacgggctctcactgaatccaaagaaaccgccagtgccatggctacactgggagaggcgcgactgcgtgaaatggaagcactgcaatccctgcgcctggcaaatgagggaaaattgctgtcacctctgcaggatgtggacattaaaatctgcctttgtcaaaaggcacctgccgctcccatgattcaatgtgagctgtgtcgcgacgccttccacacttcgtgtgtggctgtcccgtccattagccaggggcttcgcatttggctgtgccctcattgtcggaggtccgagaaacctccactggagaagatcctccctctcctggcttccctgcagaggattcgtgtgaggctccccgaaggggacgcgctccgctacatgatcgagcgcaccgtgaattggcagcacagggctcagcagctcctgtcctccgggaacctcaagttcgtccaagacagagtcggctcaggactgctttactcacggtggcaggccagcgccggacaggtgtctgacacaaacaaggtcagccagccgccaggaaccactagtttcagtctacctgacgattgggataaccgcacgtcttatttacattcacccttttctacaggtaggtcatgtatacctttgcatggagtgtctcctgaagtcaacgaattactcatggaagctcagttgctgcaggtttccctgccagagatccaagaactgtaccagaccctgctggctaagcccagtccagcgcaacaaaccgatcggtcatcacctgtgcgccctagctccgagaagaacgattgctgcagggggaagcgcgacggaattaattctctggaacggaagctgaagaggcggctggagagggaagggctctccagtgaaagatgggagcgtgtgaagaagatgcggacaccgaaaaaaaagaagataaagctgagccaccccaaggacatgaataactttaagctggagcgtgagaggtcttatgaacttgtccgctcagccgagactcactccctgccttccgataccagttattccgaacaggaggacagtgaggatgaagacgcaatttgccctgcagtgtcctgcttgcagcctgagggcgacgaagtggattgggttcagtgcgatggttcgtgtaaccagtggtttcaccaggtgtgtgtcggagtttcaccagagatggctgaaaaagaggattacatctgcgtacgctgtactgtgaaagacgctcctagccggaaatag

SEQ ID NO: 229082 - DNA, 4161 bp, Artificial Sequence
  Description of Artificial Sequence: Synthetic coding sequence
atgggcttcgctcccggaaaagccgtgggctcacatatacggggacactacgaacggattttgaatccttataatctgtttctgtcaggagactccctgagatgcctccaaaaacctaatctgacgactgatacgaaggacaaagagtacaaacctcacgacattccacagagacaatcagtgcagccatcagagacttgtcctccggctcggagagccaagaggatgagggccgaggccatgaatatcaaaatcgagccagaagaaaccaccgaggctagaactcacaacttgcggaggcggatgggctgccccaccccgaaatgcgaaaatgagaaggagatgaagtcaagcattaaacaggaacctattgaaagaaaggactacattgtggagaatgagaaagagaagcctaagagcagatctaagaaggccaccaatgccgtagatctctatgtgtgtctactgtgcggttctggtaatgacgaggaccgactcttgctgtgcgacggatgtgacgacagctatcacactttctgcctgattccccctcttcacgatgtacctaaaggcgactggcgctgtccaaagtgtctcgcccaggagtgttcaaaacctcaagaagcgtttgggtttgagcaagcagcgagggattatactctacgaaccttcggcgaaatggcggacgcatttaagtcagactacttcaatatgcctgtccacatggttccaactgagctagtggagaaggaattctggaggttagtctccaccatcgaggaagatgtgacggtggagtatggagcagatatagcttctaaggaattcggctccggatttccagtgcgcgacggaaaaatcaagctgtctccggaagaggaagaatacctcgattctggctggaatttaaataacatgcctgttatggaacaaagtgtcctagcacacattacggccgacatatgcggaatgaaactcccctggctgtacgttggcatgtgcttttccagtttttgttggcacatcgaggaccactggtcctattctatcaattatctgcattggggagaacctaaaacctggtatggcgtcccaggctacgcagcagaacagctcgaaaatgtgatgaaaaagcttgctccagagctttttgtttcgcaacctgatctgctccaccagctggttacaatcatgaatcccaacaccttgatgactcatgaggttcctgtgtatcggactaaccagtgtgcgggagagttcgtgatcacattcccacgagcctatcactcaggctttaatcagggattcaacttcgcggaggctgtgaacttttgtacagttgactggcttcccctaggtaggcagtgcgtggaacactatcgcctgctgcaccgatactgcgtgtttagccacgacgaaatgatctgcaaaatggcgtcaaaggccgacgtcttggacgtcgtggtggcatccaccgtgcaaaaagacatggccatcatgattgaggacgagaaggctctcagggagacagtacgcaagttgggagtaattgattcggaaaggatggattttgaactgctacccgacgacgaaaggcagtgcgttaagtgcaagaccacctgctttatgtccgccatatcctgttcatgtaagccgggactactcgtgtgtctgcaccacgtgaaagaattgtgttcctgccccccatacaagtacaagctgaggtacagatatactcttgacgatctgtatcccatgatgaacgcattgaaactgagagctgaatcctacaatgaatgggccctcaatgtaaatgaagcactggaggccaaaattaacaagaagaagagcttagtatcttttaaggccctgatcgaggaatcagagatgaaaaagttcccagacaacgatcttctgcgtcatcttagactggtaacccaggatgccgagaaatgtgccagcgttgcgcagcagttgctaaacggcaaacgccagacccgctatagatctggcggaggaaagtcacagaatcaactcactgtgaacgagttgaggcaatttgtaacacaactgtatgcactaccgtgcgtcctgtcccaaaccccactgctgaaagatctactcaatagggtcgaagattttcaacagcactctcagaaactgttgagcgaggagacaccatcagctgcagaattgcaggacttattggacgttagttttgaattcgacgttgagctccctcagttagccgaaatgcggatcagactcgagcaggccaggtggctggaggaggtgcagcaggcttgcctagatcctagcagtctgacattggatgacatgcgtcggctgatcgatttgggagtgggccttgctccctactcggctgtggaaaaggctatggctcggttacaagagctgctgaccgttagtgagcactgggatgacaaggccaaaagtctactgaaggctcgccctcgacactcgttgaacagccttgccaccgctgtcaaagagattgaggagatccctgcctatctgccaaacggagctgcccttaaagattcagttcagcgagcaagggattggcttcaggatgttgaggggttgcaggccggtgggagagtgcccgtcctggacacgctcatcgagcttgtgacaagggggaggagcatacccgttcacctgaacagtctgcctaggctagaaactctggtcgctgaagttcaggcttggaaggagtgcgccgtcaatacatttctaacagaaaattccccctacagtttactggaggttctttgtccgagatgtgacatcggactgttagggttaaagcggaaacaacgcaagctcaaggagccgttgccgaacggcaagaagaagtccactaaactagagtcactgagcgacctggaacgagcattgacagagtcaaaggagaccgcttctgcaatggctacattgggcgaggccagactccgggagatggaagccctgcagtccctccggctggccaatgagggtaaactgttaagtccactccaagacgtggacatcaaaatctgcctctgtcagaaggccccagctgcccctatgatacaatgcgagctgtgccgggacgcttttcacacctcctgcgtggctgtcccctcgatctcccaaggccttagaatttggctctgcccgcattgtcggcgaagtgaaaagcctcctctggagaagatcttacccctgctcgctagtctccagagaattagggtccggttgcctgagggtgacgcccttcgctatatgattgagcgcacagtgaattggcaacaccgagctcaacagctgctgtcaagtggcaatctgaagttcgtgcaagacagggtgggctccggtctcctctatagtcgatggcaggctagtgctggtcaggtctccgatactaacaaagtgagtcaacccccaggaacaacatcattttccctgccagacgactgggacaatcgaaccagctatctgcatagtccgttttctaccggcaggtcctgtatccctcttcacggggtatcaccagaggtgaacgagcttctcatggaggcacagctgctccaggtaagcttacccgaaatacaagaactgtatcagaccctcctagcaaaacccagccccgcacagcaaacagaccggagctcaccggttcggcctagctcagaaaagaacgactgttgtcggggaaagcgcgatggcatcaattccctggagcgcaagctcaagagaaggctggaaagggagggactgagcagcgagcgctgggaacgggtcaaaaagatgagaactcccaaaaagaagaaaataaaactgagccatcccaaggatatgaataactttaagttagaaagagagaggtcttacgagctggtaagaagcgccgagacgcacagcctgccaagcgataccagttatagcgaacaggaggatagtgaggatgaagatgccatctgccccgctgtttcctgccttcaaccagaaggagacgaagtcgactgggtccaatgtgacgggagctgcaaccagtggtttcaccaagtatgcgtgggagtctcccctgagatggcagaaaaggaggattatatctgcgttagatgcactgtgaaggacgctcctagtcgtaagtag

SEQ ID NO: 229083 - DNA, 933 bp, Artificial Sequence
  Description of Artificial Sequence: Synthetic coding sequence
atgatatgcaagatggccagcaaggccgacgtgctggatgtggtggtggccagtacagtacaaaaggacatggctattatgatcgaagacgagaaggcactgcgcgagactgtgagaaagctgggcgtcattgactcggaacggatggacttcgagttattaccagatgatgagagacagtgtgtgaaatgcaaaaccacctgcttcatgtcagcgatctcctgctcctgcaagccagggcttctggtttgccttcatcacgtgaaggaactttgttcttgccccccatacaagtataaacttcggtatcggtatacattagacgacctctatcctatgatgaacgccctcaagcttcgagcagagtcatacaatgagtgggcacttaatgtgaacgaagcgttagaggctaagatcaataagaaaaaatccctcgtgtctttcaaggccctaattgaggaaagtgagatgaaaaaattccctgataacgatttgctgcgacaccttagattggttactcaggacgcagagaagtgcgcttctgtcgctcagcaactgctgaatgggaaacggcagacacggtaccgttccgggggaggtaagagccagaatcagctgaccgttaacgaactgcgacaatttgtgacacagctgtatgcccttccatgcgtgctgtcccagaccccgctgctgaaggacctgctgaaccgcgtagaagacttccagcagcacagtcaaaagctcctgagcgaggagacgccatccgctgccgagctgcaagacctgctggacgtgtccttcgagtttgacgtcgagcttccccagctggctgaaatgcggatccggctggaacaggcaaggtggctggaagaagtgcagcaggcttgtctggatccaagcagcctgacgctcgatgacatgagggtgagctag

SEQ ID NO: 229084 - DNA, 4674 bp, Artificial Sequence
  Description of Artificial Sequence: Synthetic coding sequence
atggaaccagggagcgacgatttcctgcccccacccgaatgcccagtgttcgaaccaagttgggccgagtttcgagatcctctgggctatatagctaaaattaggcccatcgccgagaagtccggcatttgcaagatccgacccccagccgattggcaaccccctttcgccgtcgaagtggacaactttaggtttacacccagaatccagcgacttaacgaactggaggcacagactcgcgtgaagcttaactatctagaccagattgcgaagttctgggagatccagggcagcagcctaaagatacctaacgtggagaggcgcattctcgacctctactcactgtccaaaattgtggtcgaggaggggggatatgaggcaatatgcaaggatcggaggtgggcgagagtcgcccagcggctcaactatccgccagggaaaaatatcgggtcactcctgaggagtcactacgagcggatcgtttacccatatgaaatgtatcagtccggagccaacctggtccagtgtaacactcggccatttgacaacgaggagaaggataaagaatacaaaccccactcgattcctctgcgccaatcagtgcagccgagtaaattcaacagctatggcagacgggcaaagcggctccaaccagatccagagcccacggaagaagatatcgaaaaaaaccccgaactgaagaagctgcagatttacggggctggccctaaaatgatgggcctgggactgatggccaaagacaagactctcagaaaaaaagacaaggaaggccctgaatgcccccctacagtggttgtcaaagaagaactaggtggcgatgttaaggtggagagcacatcccccaaaaccttcctggaatccaaggaggaactcagtcacagccccgaaccatgcaccaagatgacgatgcgactcagacggaaccatagcaatgcacagtttatcgaatcctacgtgtgtcgtatgtgctcccggggtgacgaggatgacaagctactgctgtgcgacggatgtgacgacaactatcatatattttgcctgctaccccctttgccggagatcccgaagggtgtatggcgatgtcccaagtgcgtcatggctgagtgtaagcggcctccagaagccttcgggttcgagcaagcaacacgggagtatactctacaaagctttggggagatggctgactcattcaaagcagattacttcaacatgccggtgcacatggtgcccactgagctcgtggagaaggaattctggcgactggtgaactccattgaagaggatgtgaccgtggaatacggcgctgatatacattcaaaggaatttggaagcggcttcccagtttctgatagtaagaggcacctcacccctgaggaggaagagtacgcaaccagcggctggaatctgaatgttatgcctgttctagagcagtctgtgctctgccacataaatgcggacatctccggcatgaaggtgccttggctgtatgttgggatggtgttctccgctttttgttggcacatcgaggaccattggtcatactcaataaactacttgcactggggggaacccaaaacctggtatggcgtgcccagcctcgccgcagagcacctggaagaagttatgaagaagcttacgccagagctattcgactctcaacctgacttactgcatcagcttgtgaccctgatgaaccccaatactctgatgtcacatggtgtgcctgtggtgcggactaatcaatgtgccggagagttcgtcatcaccttccctcgggcttaccactctggcttcaaccagggctacaattttgctgaagctgtgaacttttgcaccgccgactggcttccggctggacggcaatgtatcgagcactataggcgactacggagatactgtgtattcagccacgaggaacttatctgcaaaatggctgcgtgtccagagaagttagatttaaatctggccgcagcagtgcacaaggaaatgttcataatggtacaggaagaacgcaggcttcgtaaagcactgctagagaagggaatcactgaggccgagcgcgaggcattcgagctgcttccagatgatgagagacagtgtattaaatgcaagaccacatgctttctgtctgctttagcctgttacgattgtcctgatgggttggtatgtctttcacatatcaacgacctctgcaaatgctcaagtagcagacagtaccttagatatagatacaccctagatgagctcccagccatgttacacaagttgaaagtccgcgctgagtccttcgatacttgggcaaacaaggtcagggtggccctcgaagtagaggatgggaggaagcgctcgcttgaggagctacgcgctctggaaagcgaagctcgggagcggaggttccccaacagcgagctgcttcaacaactgaagaactgccttagtgaagccgaggcctgtgtctcgcgtgccctgggcttggtcagcggccaggaggctggccctcacagggtagccggacttcagatgacacttaccgaacttagagcatttctggaccagatgaacaatctgccctgcgctatgcatcagatcggtgatgtcaaaggcgttttagaacaggtggaggcgtaccaggccgaagcacgggaggccctggcgtcactccctagtagtccgggtttacttcagagcttgctggagcgcggaagacagctcggagtggaggttcctgaggcccagcagttgcagcgacaggtcgagcaggctaggtggcttgatgaggttaagcggacactggctccctccgcgagacgcggtaccctggcagtaatgcggggattgctggttgcgggagcctccgtagccccttcacccgcagtggacaaggcccaggcagagctgcaggagctgctgacgatcgcggaaagatgggaggagaaggcccacctgtgtctcgaagcaaggcagaagcatccacctgccaccctcgaggcaatcattagagaggcagaaaatattcctgtacaccttccaaacatacaagctctgaaagaagcgctggctaaggccagagcatggatagcagacgtcgacgaaatccaaaatggagatcactatccatgcctggacgatctcgaaggattagtagcggtcggccgtgacctcccagtcgggttggaggagctgcgccaactggaactgcaggtgctgactgcacactcatggagagaaaaagcgtctaagacgttcctgaaaaaaaactcgtgttacacacttctggaggtcctgtgtccctgcgccgatgcaggtagcgactctactaagcggtctcgctggatggaaaaggagctgggactttacaagagcgacaccgagttgctgggcctttcggctcaggatctgagggaccccggttcggtaatcgtggccttcaaagaaggagaacagaaggaaaaggagggcatccttcaacttcggaggactaactcagccaaacccagccccctggccagcagttctacagcatcatcaacaacttccatctgcgtctgcggacaggtgcttgcgggtgcaggtgcactccagtgcgacctgtgccaggattggtttcacggccgttgtgtcagtgtgccaagacttctttcttcaccgaggcctaacccaacctccagcccactactcgcctggtgggagtgggatacgaaattcctctgtccactatgcatgcggtcaagaagaccccgacttgagactattctggctcttctggtggccctgcagagattgcccgtccggctacccgagggcgaggctctgcagtgcctgaccgaaagagcaatctcttggcagggaagggccagacaggccctggcatctgaggatgtgaccgccctgctgggcaggctggcggaactgagacaaaggctgcaggccgagccaagacctgaagagcctcccaattatcctgccgctcccgctagcgacccactcagagagggttcagggaaggatatgcctaaggtacagggactgttggagaatggagattccgtaacatctcccgagaaggtggcacctgaggagggtagcgacttagaactcctgagctcactattaccccagttgacgggccctgtcttggaactgcccgaagcgactagagcgccactggaggaacttatgatggaaggagacctactcgaggtcaccctggatgagaatcactccatctggcaactgttacaagccggacagcctcccgacctcgagaggatcaggacattgctcgagctggagaaagcagaaagacacggaagtcgcgcaaggggtagagccctggagagaagaaggcgcaggaaagtggaccggggtggcgaaggagacgaccccgctcgtgaagaactggaacccaagagagtgcggtcatcaggccctgaggcagaggaggtccaggaggaagaggaactggaggaggagactggcggtgaagggcctcctgcgccaatcccgaccaccggctccccgagtacccaagaaaatcaaaatgggttggagcccgcagaaggcacgactagcggcccttccgccccttttagtaccttaacccccaggttacacctcccctgtccacagcagcctccacagcaacaactttag

SEQ ID NO: 229085 - DNA, 4551 bp, Artificial Sequence
  Description of Artificial Sequence: Synthetic coding sequence
atggaacccggaagtgatgactttctgcctcctcctgagtgcccggttttcgaaccctcttgggccgagtttcgagacccattgggttatatcgctaaaattcgccctattgctgaaaagtccggcatttgtaagattcgcccacctgccgactggcagcctccttttgcggttgaggtggacaactttaggtttacccctaggatccaaaggctgaacgagttggagatcgttgttgaggaggggggatacgaagctatctgcaaggaccggaggtgggccagagttgcacagagacttaattacccgcctggcaagaacatcggctctctgctcagatcccactacgaacgcattgtgtacccatacgagatgtatcagtccggggctaatttggtccaatgtaatacaaggcctttcgacaatgaggaaaaggataaggagtataaaccccactccataccactaaggcaatctgtgcagccttccaaattcaatagctatggccgaagagcgaaacgtttacagcctgatccagagccaactgaggaagacatcgaaaaaaaccccgagctgaagaaattgcaaatctatggagccggacccaagatgatggggctgggccttatggccaaagataaaaccctgcgcaaaaaggacaaagagggacccgagtgcccccctacagtggttgtgaaagaagagttggggggtgacgttaaggtcgagtctacctctcctaaaacttttttggaaagcaaggaggagctttctcactcgcctgagccatgcacgaagatgacaatgagattgcgccgaaatcatagcaacgcacagttcattgagtcatatgtttgcaggatgtgctccagaggagatgaggacgataaactgctgctgtgtgatggctgtgacgataactaccacatcttttgcttgttaccacctctgccggagatccccaagggggtgtggcggtgccctaagtgcgtcatggctgaatgcaagcgcccacctgaagccttcggcttcgaacaggccacccgcgagtacactttacagtccttcggggaaatggctgactcattcaaagctgactacttcaatatgcccgtgcacatggtgccaacagaactggtcgagaaagagttttggagattagtgaacagcatcgaggaggatgtgacagtggaatatggggctgatatccattccaaagaatttggaagtggattccccgtttccgacagtaagcggcatctaactccagaggaggaggaatatgccacaagtggttggaatctgaacgtcatgcctgtcttggaacagagtgttttgtgtcatattaatgctgatatcagcggaatgaaagtgccttggctgtacgttggcatggtgttttccgcattttgttggcatatcgaggatcactggtcatatagtataaactacctgcactggggagagcccaaaacttggtatggggtgccaagcttggctgccgagcatctggaggaggtgatgaaaaaactcaccccagagctcttcgattcccaacctgacttgcttcatcagttggtaaccctcatgaatccaaacaccctgatgtcccacggtgttcctgtagtgcgtaccaaccaatgtgcaggagagttcgttattactttccccagagcctatcattccggattcaaccagggctacaacttcgcagaagcagttaatttttgtactgccgactggctcccggcaggtcggcagtgcatcgagcactaccgtagattaagaagatactgcgtttttagccacgaggaactgatatgtaaaatggctgcctgccctgagaagctggatctgaaccttgctgccgcagtgcacaaagagatgttcataatggtacaagaggaacgcagactgagaaaagccctgcttgagaagggaattaccgaggcagagcgggaagctttcgagctgttaccagatgacgagcggcagtgtatcaagtgcaagaccacctgttttctctccgctcttgcgtgctatgactgccccgacggcttagtgtgcctctctcatattaatgatctgtgcaaatgtagcagctcccggcagtatcttaggtaccgttacacactcgacgagctgccagccatgctacacaagctcaaagtccgcgctgaatcctttgatacctgggccaataaagtccgcgtggcgctggaagtggaggatggacggaagcggagcctcgaggagctccgcgctttggaatcagaagccagagagagacgcttcccgaatagcgagctgctgcaacagctaaaaaactgtttgagcgaggctgaagcgtgtgtttctcgggctcttggcctggtgtccggtcaggaagctggcccacacagagtggccggactccaaatgacactgactgagctaagggccttccttgatcaaatgaacaatctgccttgtgcaatgcatcagataggagatgttaaaggggttttggaacaggtcgaagcctaccaggccgaagccagagaagcactcgcgtctctgccaagtagtcccggtctcctgcagagcctcctcgagagagggcgacagctgggagtggaggtgccagaggctcagcagttacagagacaggtggagcaggctcggtggcttgacgaggtgaaaagaaccctcgcaccgtctgcaaggagggggacactggctgttatgcggggtctgctcgtggcaggggcttccgtggctccatctcctgccgttgataaggcccaggccgagctgcaagaactgctcacaattgcggagcgctgggaggagaaagctcatttgtgcctagaagccagacagaagcacccccctgcaaccttggaggcaatcatccgggaagccgaaaacataccggtacatctccccaacattcaggccttgaaagaagcattggctaaagctagggcttggattgccgatgtcgacgagatccagaacggtgatcattacccttgtttggacgacctggagggactggtggccgtcgggcgtgacctgcctgtggggctggaagaactgcggcagctggagctgcaggtgctcaccgctcactcgtggcgtgagaaggcctccaagacctttctgaagaaaaactcctgttacactctcctggaggtgctgtgtccttgcgcagatgccggaagcgattcaactaagaggtccaggtggatggagaaagagcttggcctgtacaagtccgacaccgagctacttggtctgtccgcccaggatcttagagatcccggttcagtgattgtcgcctttaaggagggcgagcagaaagagaaggaggggatcctgcagctgcggaggaccaacagtgcaaagccctctcctctggcttccagttcaactgctagtagcacgacgtctatctgtgtgtgtggtcaggtcctcgctggggctggggctctgcagtgtgacctgtgccaagactggttccacggaagatgtgtgtccgtcccccgattgctgagttctcctcgtcctaatcctaccagtagccccctcctcgcctggtgggagtgggacaccaaattcttgtgtccactctgcatgcgatcacgaaggccaagacttgaaacgattctggcgctcctggtggccttgcagagactccctgtccgactgcccgagggagaagcactacagtgtctgactgagcgagcaattagctggcaagggcgagctagacaggcccttgcttccgaggatgttactgccttactggggcgactcgcggagctcaggcagagattgcaagccgagccgcgtcccgaggaaccccctaattatcctgcagcccctgcctcagacccactgcgcgagggcagtggtaaggacatgccgaaggtacagggtctcctggagaatggggactcggtaacatccccggaaaaggtggcacctgaggaagggagcgacctggaattgttatctagcctgctgccgcaactaaccggtccagtcttagagctccctgaggcaacaagggctccccttgaagaattgatgatggaaggggacctgcttgaggtgaccctggatgaaaatcactccatctggcagttacttcaggccggacagccaccagatttggagagaattcggaccttgctggagctggagaaagcagagagacatggttctagggccagaggacgcgcactcgagcgacgccgtaggaggaaagtcgaccgtggaggtgaaggagacgatcccgctagagaggaattagaacctaaacgtgtgcggtcgtcagggcctgaggcagaagaagtgcaggaggaagaagaacttgaagaggaaactggcggtgagggaccccctgcccctatcccaaccacaggatctccctccacacaagaaaaccagaacggtcttgagcctgcagagggcacaaccagcggcccatccgccccattctcaactcttaccccccgactccaccttccctgtccgcaacaaccacctcaacagcagctatag

SEQ ID NO: 229086 - DNA, 4683 bp, Artificial Sequence
  Description of Artificial Sequence: Synthetic coding sequence
atggagcccggttccgacgattttctgcctcccccagaatgccccgttttcgaaccctcatgggccgagtttcgagatccgctgggctacatcgcaaagattaggccaatcgctgagaagtctgggatctgtaaaattcgccctcccgcagactggcagcctcccttcgctgtagaggtggacaatttcagattcacaccacgcatccagcgtttgaacgaattggaagcacagacccgtgtgaagctcaactatcttgatcagattgccaagttttgggagatacagggctcaagcctgaagatcccgaatgtagagcggaggatattagacttgtacagtctgagtaaaattgtggtcgaggaaggtggatatgaagccatatgcaaagatcgcaggtgggcgcgtgtggcccaacggctcaattacccccctggcaagaacatcgggtctctactacggagccattacgagaggatcgtttacccctacgagatgtatcagagtggcgctaatctggtgcagtgcaatacaaggccgtttgataatgaggagaaagataaagaatataaaccccactctattccattgaggcagagcgtacagccttccaaattcaactcatacggccgaagggcgaaacggctgcagcccgacccagagcctaccgaggaagacatcgagaagaacccggagcttaaaaagctgcagatttacggtgccggtcccaaaatgatgggtctcggcctcatggcaaaggataaaaccctaagaaagaaggacaaagagggacctgaatgcccgcctaccgtagtggttaaggaagaactgggaggtgatgtaaaagtggaaagcacctcccctaagacattcctggagagcaaagaggaactgtcgcactctccagagccctgcaccaagatgaccatgcggttgaggagaaatcactcaaacgcacagttcatcgagagttacgtgtgccgaatgtgcagtcggggagatgaagatgacaaactgttgttgtgcgatggctgcgatgataattatcatatcttctgccttttgccccctctacccgaaatccctaaaggggtgtggagatgtccgaaatgtgtgatggcagagtgcaagcggcctcctgaggccttcgggttcgagcaggctacccgagaatatacactccagtccttcggcgagatggccgactcctttaaagcagactacttcaatatgcccgtgcacatggtccctactgagctagtagaaaaggaattttggcgtctagttaattccatagaggaagatgtcactgtcgagtatggggcagatatacattccaaggagtttgggagcggttttcctgtctctgactcaaaacgccatttgactcccgaggaggaggagtatgcaaccagcgggtggaatctaaacgtgatgcctgttttagagcagtccgttctatgccatattaacgccgacatttctggcatgaaagtaccctggctgtacgtaggcatggttttttccgccttctgctggcacatcgaagaccattggtcttacagtataaattacctgcactggggtgagcccaagacctggtatggcgttccttctctggcagcggagcacctggaggaagtgatgaagaaactgacgccagagcttttcgatagtcagccagacctgctgcaccagctggtaacactcatgaatcccaacacacttatgagtcacggagtgcccgtcgtacggactaaccaatgtgcgggtgaattcgtgattacatttcctcgcgcatatcacagtggtttcaatcaggggtataattttgcagaagcagtgaatttctgtactgcagactggctgccagcaggacgacaatgcatcgagcattacagacgcttgaggaggtactgtgtgtttagtcacgaagaacttatttgtaagatggccgcttgtccggaaaagctggatctgaatctcgccgcagccgtgcacaaagagatgttcatcatggtacaagaggagcgtaggctgagaaaagcccttcttgagaaaggcatcaccgaagccgagcgggaggcctttgagctcctccccgatgatgagaggcagtgcattaagtgcaagacaacttgcttcctcagcgccttggcctgctacgattgccctgacggcttggtttgcttatcccacatcaatgacttatgcaaatgctctagcagcaggcagtacctcaggtaccgttatacactggatgagctacccgctatgcttcataagctgaaagttagggccgagtcattcgacacctgggcgaataaggtgcgcgtggctctggaagttgaagatggcagaaagcggtctctggaggagctgcgcgctttagaatcagaagcaagagagaggagattcccaaactccgagctcctacaacagctcaaaaattgcctcagcgaagcggaggcctgtgtgtcacgggcactgggattggtctcagggcaggaggcaggaccgcaccgtgtggcgggactgcagatgactctgacggaattaagggcctttctagatcaaatgaacaatttgccttgcgccatgcaccaaattggtgacgtgaagggggtgctggagcaggtggaagcctaccaggcagaggctcgagaagccctggcttccctgccgtcgtccccaggattgctccagtccttgctggaacgcggacgccagcttggggtggaagtgccagaggcacagcagctgcagcgccaggttgagcaggcaaggtggctggatgaagtgaagcggacactcgccccaagcgcaaggcggggaaccctcgccgtgatgagagggctactcgtggctggtgccagcgtcgctccatctcccgcagtggataaggctcaagcggaattacaggaactgctcacaattgccgagcgctgggaagaaaaagctcatctttgtctagaggcacgccagaagcacccccctgccacgctcgaggccatcatccgagaggcagagaacatccccgtccacctcccaaatatacaggcgctaaaggaagcactggctaaagcaagagcctggatcgcagacgttgacgaaatacagaatggcgatcactatccctgcctcgacgatttagagggactagttgcagtcggcagagacctccctgttggtctcgaggagctacgccagctcgagcttcaagttctaacagctcactcttggagagaaaaagcttctaagaccttcctaaagaaaaattcatgttacaccttactcgaggtgctctgtccttgtgcggacgcgggatcggactccacaaaacggtctcggtggatggaaaaagagctcggtctgtataaatctgacacagaactgctaggcctgtcggcacaggatctccgcgaccccggttccgtgattgtggcattcaaagagggcgaacagaaagagaaggaggggatattgcagctgcgcaggacaaattcagcaaaaccgtcgccactggcctcatcctctactgcctcatctaccacttcaatttgtgtttgtggacaggttttggccggtgccggtgcactgcagtgcgacctctgccaggactggtttcatggtcgctgtgtgtcggttcctagactgctctcttctcctagaccaaatcctacatctagtcccctgcttgcctggtgggagtgggacaccaagtttctgtgccctctgtgtatgagatcacggaggccccgactcgaaacaattttggctctgctggtcgccctgcagcgtcttcctgtgcggctcccggaaggagaagctctgcagtgtctgaccgagagagccatttcatggcagggacgcgctcggcaggcccttgcgagcgaggacgtcacagccctcctgggcaggctcgccgaactacgccaacggttacaggctgagcccaggcctgaagagcctcctaattatcctgctgcacctgcatcagatcccctccgggagggtagcggcaaggacatgcccaaggttcagggtttgttagagaacggggactctgtgacatccccggaaaaagtggcacctgaggagggctctggcaagagggatctcgaactgctgtcttcgctcctaccacagctaacgggaccggttctcgaacttccagaggccaccagagctcccctggaagaacttatgatggaaggcgaccttctggaagttacattagatgaaaatcacagcatatggcagctactgcaagccggtcagcctccagatctggaaaggattcgcactctcctggagttagaaaaagctgaacggcacggcagcagggctcgaggcagagctcttgagcggcgaagacgcagaaaggtggaccggggaggcgagggagacgatccagctcgtgaggagctcgagcctaaacgcgtgagaagctccggacctgaggcagaagaagtgcaggaagaggaggaactggaagaggagacaggcggtgaaggaccgcctgcacctattcctacgacaggaagcccctctacccaggagaatcagaatggactggaaccagccgagggaactacgagtggcccttccgcgcctttctctacactcactccgcgtcttcacttgccttgtcctcagcagccgccacagcaacagttatag

SEQ ID NO: 229087 - DNA, 4680 bp, Artificial Sequence
  Description of Artificial Sequence: Synthetic coding sequence
atggaacccggatcagatgacttcctcccccctcccgaatgtcctgtgtttgaaccttcctgggccgaatttcgtgaccctttagggtatattgcaaagataagacctattgccgaaaaatccggaatttgcaagattaggcctccagctgactggcagccccctttcgcggttgaagtagataatttccgattcaccccacgcatccagaggctcaacgagctcgaggcacagaccagagtgaagctcaattatctcgatcagattgccaagttctgggagatccagggctcctctcttaaaatacctaacgtagaacggaggatccttgacctctattctctgagtaagatcgtggtggaagagggcggttatgaggctatatgtaaagacaggagatgggccagggtggcacagaggctgaactacccaccaggcaaaaatattggcagcctgctgagaagccactacgaaagaatcgtgtacccatatgagatgtatcaatctggagctaacctcgtgtgtaatacacgaccctttgacaacgaggagaaggacaaggaatacaagccccattctatcccactccgccagagcgttcagccatcgaagttcaacagttatggcagaagagccaagagacttcagcccgatcccgagcctacagaagaggacatcgagaagaatcctgaactgaaaaaacttcagatttacggtgccggaccgaaaatgatgggactcgggttgatggccaaagataaaactctgcggaaaaaagataaagaaggtcctgaatgccctcctaccgtggtggtgaaggaggagcttggtggagatgtaaaggtcgagagtaccagcccaaaaacctttctcgaaagcaaggaggagctctctcactctccagagccatgcaccaaaatgaccatgagacttcgaagaaatcactcaaacgcccagttcattgagtcttacgtttgtcggatgtgcagccgtggagatgaggacgacaaactgctgctttgcgacggctgtgacgacaactaccacattttctgtctgctgccacccctcccagagattccaaagggcgtgtggcgctgtccgaagtgcgttatggccgaatgcaaaagaccacccgaggcatttggtttcgagcaagctaccagagaatacactctccagagcttcggtgaaatggcagactccttcaaggccgattattttaatatgcctgtccatatggtgccaactgagttggtggagaaagaattctggcgtctggtcaactccatagaggaggatgtcacagtggaatacggagccgacatccactctaaagaattcgggtcgggctttcccgtctccgatagtaagagacatctgacgcctgaggaagaagagtacgccacatcaggttggaacttaaatgtcatgccagtgctcgagcaatccgtcctgtgtcacatcaatgctgatatctcgggcatgaaggtaccctggttgtatgtgggcatggtcttctctgctttctgttggcatatcgaggaccattggtcatatagtatcaactatttacattggggagaaccaaagacatggtacggcgtaccctcactggctgcagaacatctggaagaggttatgaaaaagctgaccccagagctgtttgatagccaaccggatctgctgcatcagcttgttactctgatgaatcccaatacacttatgtcacatggagtgcctgttgtgaggacgaatcagtgtgctggagaattcgtcattacctttcccagagcctaccattccgggtttaatcagggctacaattttgcggaagccgtgaatttttgtaccgcggattggctgcccgctggcaggcaatgcattgaacactatcgaagacttaggcgatactgtgtgttctcccacgaagagcttatttgcaaaatggcagcttgccctgaaaagttggacctgaatctggccgctgccgtccataaagagatgttcatcatggtgcaagaagagcgcagattgagaaaggccttacttgaaaaggggataaccgaagccgaaagagaagccttcgaactgctgccagatgatgaaaggcaatgcatcaaatgcaaaactacctgcttcctgagtgcactggcatgctacgattgcccagacgggctggtatgtctatctcatattaacgacctgtgtaagtgcagctcttcccgccagtaccttcgttatcgttataccctagacgaactaccagccatgttgcacaagctgaaggttcgcgctgagagtttcgatacctgggctaacaaagtccgcgtggctctcgaagtggaggacggacggaagaggtcactggaagaacttcgcgcactggagagtgaggcaagagaaaggagattcccaaacagcgaactgctgcaacagctcaagaattgtctctcggaggcagaagcatgtgtgtcacgggcactaggtttagtgagcggccaagaagccggtccacaccgagttgctgggttacagatgaccctgactgagttacgggcttttctggatcagatgaacaacttaccgtgcgccatgcatcagatcggagatgttaagggtgtcttagaacaggtggaggcataccaggccgaagccagggaagcactggcaagcttaccctcctctccgggattgctgcagagcctgctggaaaggggtaggcaactgggtgtcgaggtgcccgaggcacaacagcttcaacgccaggtggagcaggcaaggtggctggacgaggtgaaaaggacacttgcaccctccgccagacgcggaactctggccgttatgagaggtctgctcgtcgccggtgcgtcagtggctccttcaccagccgtggataaagcccaggcagagttgcaggagctcctaacaatagccgagcggtgggaagaaaaagcccatctgtgtctcgaggcacgccaaaagcacccaccagccacgttggaggctatcattcgggaggctgagaatatccctgtccatctgcctaatattcaggccctcaaagaagcgttagccaaggcacgtgcatggattgctgacgtcgatgagatccagaacggggaccactacccatgtcttgacgatttagaaggactggtcgcagtcggccgtgacttgcctgtcggcttggaagaattgagacagttggaactgcaggttctcactgctcactcttggagggagaaagcttctaaaaccttcctcaaaaagaatagctgttacacattactggaggtcctatgtccttgtgcagacgctgggtctgactccacaaaacgcagcaggtggatggaaaaggaattgggactgtacaaatcagacaccgaactgctgggcctgtctgcccaggacctccgggatccgggaagtgtgatcgtagcatttaaagaaggggaacagaaggaaaaggagggtatcctgcagctacgtaggactaacagcgctaagccttcccccctggcatcatcctcgaccgcgagcagcactacttccatttgcgtgtgtggccaagttctggcgggagcgggtgcccttcagtgtgacctttgtcaggactggtttcacgggagatgtgtgtcagttcctagactgttatcttcccccaggcccaacccaacaagctcgcctctgctagcctggtgggaatgggacactaagttcttgtgcccgctgtgcatgagatcaagacggccaagactggagactatcctcgccctgttagtcgccttgcagagattgccggtgaggctgcccgagggcgaggcacttcagtgtctgacggagagagccatttcttggcaaggcagagccaggcaagcccttgcaagtgaagacgtcacagcactgttaggccgtctagcggaactcagacagcgcttgcaagccgagcccagacccgaggaaccacccaactaccctgcagcccctgcgtctgaccccctacgggaaggctctgggaaggacatgccgaaggttcagggcctgttagagaatggagactctgttaccagccctgaaaaagtggctcccgaagagggaagcgggaagcgcgacttggaactgttgagtagccttctgcctcagcttacaggacctgtgttagaactgccggaggcgaccagagcccctctggaagagctaatgatggagggggacctgctggaggtcacccttgatgaaaaccattccatctggcagctgttgcaggctggacagccaccagatctggagagaatacgcacgctgctggagctggaaaaggcggaacgacatggatcgcgagctaggggcagagctctggagaggaggcgcaggagaaaggtcgatagggggggtgagggtgatgatcccgcacgagaagagctggagcctaagcgtgtcaggagcagtggcccagaggcggaggaggtccaggaagaagaagaactggaggaggaaacaggtggcgaaggccctcctgcgccaattccaaccacaggctctccttcaacccaggaaaatcagaacggcttggaacctgcagaaggcaccaccagcggtccaagtgcaccgtttagcacccttaccccccgattgcatctcccttgtccacagcagcctccccagcagcaactatag

SEQ ID NO: 229088 - DNA, 4140 bp, Artificial Sequence
  Description of Artificial Sequence: Synthetic coding sequence
atggagccgggttctgacgactttttgcccccacccgaatgtcccgtattcgagccctcctgggctgaatttagagatcccctggggtacatagccaaaatccgccctattgctgaaaagtcggggatttgtaagatccgaccacctgctatagtagtggaggagggtggctatgaggccatctgcaaggataggcggtgggccagggttgcacagcgactgaattatccgccaggaaagaatattggcagtttactcagaagccactatgagagaattgtgtacccttacgagatgtaccagagtggtgcaaacctcgtgcagtgtaatactaggccattcgacaatgaggagaaagataaggagtataaaccgcattccatccccctgaggcagagcgtacagcccagcaaatttaattcttatggcaggcgagcgaaacgcctgcagcccgaccccgagcctacggaggaagatatcgaaaagaaccccgaactgaagaaattgcagatctacggtgccggtccgaagatgatgggcctgggacttatggccaaggataaaaccctaagaaaaaaggataaagagggtcccgagtgtccacccacagtggtggttaaggaggaactaggcggagatgtgaaggtggaatcaaccagccccaagaccttcttggagtccaaagaagaactgtcccacagcccagagccatgcacaaagatgactatgagattaaggaggaaccacagcaacgcgcagtttatcgagagttacgtctgccgaatgtgtagcagaggcgacgaagacgataaactgctgctgtgtgacggctgtgacgacaactatcatatcttctgtctcctgccacccttgcctgaaatccctaaaggcgtttggagatgcccaaagtgcgttatggcagaatgcaaacgcccacctgaggccttcggatttgagcaagccacacgcgaatacactctgcaatcctttggggaaatggctgacagtttcaaagccgactatttcaacatgcctgtgcatatggtgcctacagaactcgttgaaaaggaattctggcgcctcgtcaactccatcgaagaagatgtgaccgtcgagtatggtgctgatatccatagcaaggagtttggctccggcttccccgtgtctgattccaagagacacctcactcctgaggaagaggaatacgccacaagcggttggaaccttaatgtgatgcctgtgctggaacagtcagttctttgtcacattaacgccgacataagtgggatgaaggtgccttggttgtacgtggggatggtattttcagccttctgctggcacattgaagatcactggagctattccatcaactacctgcattggggcgaacccaagacttggtacggggttccatcgttagctgcagagcatctcgaggaagttatgaagaaactaactccggaactttttgacagtcagccggacctgctgcaccagctagtcacattaatgaaccccaatacccttatgtcccatggcgtgccggtggttcggactaatcagtgtgccggagagttcgtgatcacattcccacgggcttatcactcaggtttcaaccagggctataatttcgcggaagccgtgaatttttgcactgctgattggctgcccgcagggcgacaatgtatcgaacactaccgcaggttaagacgttactgcgttttctctcacgaagaattgatttgcaagatggctgcctgtcccgaaaagctcgacctgaacctagctgccgcagtacacaaagaaatgtttatcatggtccaggaagagagacgcctgcggaaagccctgctcgaaaagggtattactgaggcggagagagaggccttcgagcttctgcctgatgacgagcggcagtgtattaaatgcaagaccacatgtttcctatccgctttggcctgttacgattgtcctgacgggctcgtgtgtttatcacacataaacgacctgtgtaagtgttctagttcacggcagtacctgcgctatcggtacacgctggatgagctccccgctatgctacataagctcaaagtgcgcgctgaatccttcgacacctgggcaaataaagtaagagttgcactcgaagtagaagacgggaggaagcggtccttggaggagctccgcgcactagaatctgaggctcgcgagcgcagattccctaattcggaactgctccagcaactaaaaaattgcctgtctgaagccgaagcctgtgttagtcgggcactcggcctcgtttcaggccaagaagcgggaccccacagggtggctgggttacagatgaccttgactgaactgagagctttcctggatcagatgaataatttaccttgcgcaatgcatcagatcggcgacgtgaagggagttttggaacaggtggaggcttatcaagctgaggctcgggaggccctggcaagccttccttccagcccgggtctgttgcagtccctgctggaacgcggtaggcagctgggggtggaagtgcccgaagctcagcagctgcagagacaggtcgagcaggccagatggttggacgaggtaaaacgaacgttggccccaagtgccaggcgcggaaccctcgccgtcatgagaggtctgcttgtcgccggagccagcgtcgctccttctcccgctgtggacaaagcacaggccgagttgcaggagcttctgaccatagcagaacgctgggaggagaaagcacatttgtgtctggaagcaagacagaagcacccacctgcgacgctggaggcaattattcgggaggctgaaaacatccctgtgcatctgcccaacatccaggccctgaaagaagcactagctaaggctcgggcttggatcgccgacgttgacgaaattcagaacggcgatcactacccatgtcttgacgatttagaagggctggtggcagtcggtcgcgatcttcccgtgggtcttgaagagctcagacagttagagctccaggtgctgaccgcgcacagttggcgagaaaaagcctccaaaaccttcctgaagaaaaattcttgctatacattattggaggtcctgtgtccatgcgcggacgctggctcggactcaaccaagagatctcgatggatggagaaggaactcggcctttataagtccgataccgaactgctggggttgagcgctcaggacctacgcgatcctgggtcagtaattgtggcattcaaagaaggtgagcagaaagaaaaggagggaatactacaattacgcaggacaaacagtgccaagcccagtcctctggcctcctcctctactgcgtcctctacgacctccatttgtgtgtgtgggcaggtgttagcgggtgccggtgctctgcagtgcgatctgtgtcaggactggtttcacggcagatgtgtgagtgtgccgaggctattatcatccccccgacccaaccctacaagctcaccacttctggcctggtgggaatgggacacgaaattcctgtgccctctttgtatgcgatccaggcgccctagactggaaacaatactggccctactggtggcccttcagagacttcccgtgcgactgcccgaaggggaggcgctccagtgcctcactgagagggctattagctggcaggggcgagcccgacaggcactggcttcagaggacgtaacggctcttctaggaaggctggcagagctccgtcagagactgcaggccgaacctcgcccagaggagccgccaaattaccccgctgctcccgctagcgaccccctccgtgaagggagcggcaaagatatgcccaaggtccaaggccttttggagaacggagattccgtgacatcaccagagaaggtggcgcctgaggaaggttccgatctagagctactgtcctcactcctcccgcagctgaccgggccagtgctggagcttccggaagctacgcgcgcacctctcgaagagttgatgatggagggcgatttgctggaagtgaccctggatgaaaaccactctattccagaatcccttgatttctgcatcttgaccccaagatactgcagtgacctctccagctggggaccagcacccggagtatttcctccctggtag

SEQ ID NO: 229089 - DNA, 4620 bp, Artificial Sequence
  Description of Artificial Sequence: Synthetic coding sequence
atggaacccggatgcgatgagtttctaccaccccctgagtgcccggtgttcgaaccttcttgggccgaatttcaagatccactcggctacatcgcaaagatcagacctattgctgagaaatcgggaatatgtaaaatcaggcccccagcagattggcaacctcccttcgccgttgaagttgataacttccgttttacccctagggtgcagcggctcaacgaactggaggcccagacccgcgtgaagctcaattacctcgaccagatcgccaagttttgggaaatccagggaagctccctaaaaatccccaatgtagagcgcaagattctggatttgtactctttgtccaagatagtcatagaagaaggtggctatgaggccatttgcaaagaccggcgatgggctcgggtggcccagcggttgcactatccacctggcaaaaatatcggatccctgcttcgctctcactacgagagaataatctacccttacgagatgttccagagcggagctaaccatgtgcaatgcaacacacatccttttgacaacgaagttaaagataaggagtataagccacactctattcctctgcgacagtctgttcaacctagcaagttctccagttattctaggcgagccaaaagactccaaccggaccccgaaccgaccgaggaggacattgaaaagcatcctgaactaaagaagcttcagatttacgggcctgggcctaaaatgatgggcctgggtctcatggctaaggataaggacaagaccgtgcacaagaaggtgacctgccctcctacagtgacagttaaggatgagcaatcaggcggagggaatgtgtcaagcaccctgctgaagcagcacctctctctggagccctgtactaagaccactatgcagctgagaaagaaccatagcagcgcgcaattcatagactcctacatctgccaggtgtgctcccgtggcgacgaagatgacaagcttttattttgcgatggatgcgacgataattaccacattttttgcctcctccctccattacccgaaatcccaagaggaatctggcgctgtcccaagtgcattctggccgagtgcaaacaacctcctgaggccttcggcttcgaacaagccacacaagaatatagcttgcagtcctttggtgaaatggccgactccttcaagagtgactacttcaatatgcctgtgcacatggtcccaacagaactggtggagaaggagttctggcgccttgtgtcttccatagaagaggacgtgactgtcgagtacggggctgacatacactcaaaagagttcgggtcagggtttcctgtgagtaattcaaagcaaaacctgtcccctgaagagaaggaatatgccacgtctgggtggaacctgaacgtcatgcccgtcttagaccagagtgtattgtgtcatataaacgctgatatctctgggatgaaagtgccatggctttacgtgggtatggtcttcagcgctttctgctggcacattgaggaccattggagctactccattaattaccttcactggggagaaccgaagacttggtatggtgtccctagcctggccgcagagcatctcgaggaagtgatgaagatgcttacaccggagctgttcgactcccagcctgatctgctgcaccagttagtgacactgatgaacccaaacacactcatgagccacggggtgcctgtggtcagaacaaaccagtgtgcaggcgagtttgtaattaccttccccagagcctatcatagcggctttaaccagggatacaacttcgcggaagcggtgaatttctgcactgcagattggcttcccgctggacgtcagtgcattgaacactatcgacggcttcggagatactgtgttttcagtcacgaggaactgatctgcaagatggctgcatttccagaaaccctggacctgaatctcgcagtggccgtccacaaggaaatgttcattatggttcaggaggaacgtaggctgcgaaaagccctccttgagaaaggtgtgactgaagctgaaagagaggcctttgaattgctgccagatgacgaacgccagtgcatcaaatgcaaaaccacatgcttcctgtcggcattagcctgttacgattgtccagatggactcgtttgcttgagccatataaatgacttatgtaagtgcagcagctcacggcagtacctgagataccggtataccctcgacgaactgcccacgatgctgcacaagctaaaaatccgcgcagaatctttcgatacatgggcaaataaagttcgagtggctctggaagttgaggacgggagaaaacgctccttcgaagaattgagagccctggagtctgaagccagggagaggagattcccgaacagcgagctcttgcagagactcaagaactgtttgtcggaagttgaggcatgtatcgctcaagttcttggactggttagcgggcaggttgcaaggatggatacacctcagctgactctcactgagctgagagtcctcttagaacagatgggttccctgccctgtgccatgcatcagattggggatgtgaaggacgtgctcgagcaggtcgaggcttatcaggcagaggcacgtgaggcgctagccaccctgccgtcttcccctggactgctcagatctctgcttgagagaggacagcagttaggcgtggaggtgcctgaagcccatcagctgcaacagcaagtggaacaggcccaatggctggatgaggttaagcaagccttggctcctagcgctcaccgaggcagcttagtgataatgcaggggctccttgtgatgggggctaagatcgccagctctccttctgtggacaaagcacgggcagagcttcaagaactattgaccatcgccgagagatgggaggagaaagcacacttctgcctggaggccagacaaaagcatccacccgctacactggaagctattatccgcgagaccgaaaacattcccgtgcatctgcctaatatacaggctctaaaagaggccctgacgaaagcacaggcatggatcgctgatgttgatgagatacagaatggcgaccattatccgtgcttagacgatttagaagggttggtggctgtgggcagggacttgcctgtggggctggaagagcttcggcaacttgagctgcaagtgctgacagcacactcttggcgagaaaaagcttcaaagactttccttaagaagaacagttgctacactctgctcgaggtgctctgcccttgcgctgatgctgggtcggattccactaagcggtctaggtggatggagaaggctctgggcctctatcaatgtgataccgagttgctcggcctgtccgcacaggatttacgggatccaggctccgtgatcgtggccttcaaggagggtgagcagaaagagaaggagggaatcctccaactccgtaggactaattcggccaagccctcacccctggcaccctcgctcatggcatcctcgccaacgtcaatttgcgtctgtgggcaggtccctgccggagtcggtgtgttacagtgtgacttgtgtcaggactggttccatggccagtgcgtcagtgttccgcatctcctgactagccctaaaccatcccttacttccagtcctcttctagcctggtgggagtgggataccaaattcctgtgccccctgtgcatgcgctcccgtagaccccgtcttgaaacgatcttagccctgctggtggcactccaacgcctgccggttcgcctacccgagggagaggccctacaatgtttgacagagagggctatcggatggcaggatagagccagaaaagccctagcttcagaggatgtaacagcgctgttgcgacaattggccgagcttcgtcagcagcttcaagccaagcccagacctgaggaagcctctgtatataccagtgctacagcttgtgatcccatacgggagggcagcgggaacaatatatctaaggtgcagggactgctggagaatggtgatagtgtcacctctcccgaaaatatggctccagggaaggggagtgacttggagctcctatcttccctcctgccccagttgactggccctgtgctggagttacctgaggcaataagggctccactggaagagcttatgatggaaggggatctcttggaggtgacgctggacgagaaccactcgatctggcaacttctacaggccggtcaacccccagatttagaccggatccggacactgctggagctggagaaattcgagcaccaaggctcaaggacacggtccagagccctggaacgcaggagacgaagacagaaagttgaccaggggcgaaacgttgaaaacctcgtccagcaagagctgcagagcaagcgggcacgcagttcaggaataatgtcacaggtgggaagagaggaagagcactatcaggaaaaagccgatagggagaatatgttcctgaccccctccacagaccatagccccttcctcaaaggaaatcagaattcattgcagcataaggattcgggctcttctgcggcttgtccgtctttgatgccactgctccagctcagctactcggatgagcagcagctgtag

SEQ ID NO: 229090 - DNA, 4449 bp, Artificial Sequence
  Description of Artificial Sequence: Synthetic coding sequence
atggagccagggtgtgatgagttcctaccaccacccgagtgcccagtctttgagccatcctgggcagaattccaagatccactgggctatatagctaagatacggcctatcgctgaaaaaagtgggatttgcaagattcgacctcccgctgactggcagccgccattcgccgtagaagtcgataactttagatttactccccgagttcagcgattaaatgaactggaggcccagacccgcgtgaagctgaactatctcgaccagattgctaagttctgggagattcagggttcctccctcaagatccccaatgttgagagaaaaattcttgatctgtactctttatcaaaacagtgcaatacccacccctttgacaatgaggtaaaggataaggagtacaagccccatagtatccctctccggcaatctgtgcaacctagtaagttttccagctactccagaagagctaaacgtctccagcctgatcctgaacctactgaggaagatatcgagaagcatccagagctgaagaaactacagatttatggtcccggacccaagatgatggggttaggcctgatggcaaaagacaaagataagactgtgcacaagaaagtgacctgcccacccaccgtgaccgttaaggatgagcagtccggaggcggtaacgtctcatccactctcctgaagcagcacctgtcactggaaccatgtacgaagactaccatgcaactccgaaagaaccactcttctgcccaattcatcgatagctacatttgtcaggtttgctcacgcggtgatgaagatgacaagttgctgttttgcgatggatgtgatgataactaccacattttctgcctgttacctccattgcctgaaattccacggggaatatggagatgtcctaagtgtatcctcgctgagtgtaaacagcctcctgaagctttcggctttgaacaggcaacccaggagtatagccttcagtctttcggggagatggccgactccttcaagagcgattacttcaatatgccagtgcatatggttcctaccgagttggtcgaaaaagaattctggcggcttgttagttctattgaagaggacgtcactgtggaatatggtgccgacatccactccaaagaatttggatccgggttccccgtttccaacagcaagcaaaaccttagcccagaagaaaaggagtatgccactagcggctggaacttaaatgtgatgccagtgctcgatcagtcagttctatgtcacattaatgctgacataagcgggatgaaagtcccatggctatacgtgggcatggtgttctcagctttttgttggcatattgaggaccattggtcttacagcatcaattacctgcactggggggaacctaaaacgtggtacggggtacctagtctcgccgctgagcatctggaggaggtgatgaaaatgctgacacccgagctcttcgacagccaacccgatttacttcatcaattagtgaccctaatgaacccaaacactctgatgtcacatggcgtcccagtggttagaacaaaccagtgcgctggggagttcgtcatcacattccctcgggcatatcactcaggattcaaccagggatacaattttgcagaggcagtgaacttttgcactgcagattggctccctgccggaagacagtgcatcgagcattatagacggctgaggaggtactgcgttttcagtcatgaggaacttatctgtaaaatggcagcatttccggagacattggacctcaatctggccgtggccgtccataaggagatgttcatcatggtacaggaggagcgcaggctgagaaaggcacttcttgagaaaggagttactgaggcagagcgtgaagccttcgaattgctgcccgatgacgagcgccagtgtataaaatgcaagacgacctgtttcctctcagctctggcatgttatgactgcccagacggcttggtgtgtttatcccacataaacgacctctgtaagtgctcgagcagtaggcagtatttgcgctaccgctacacactcgatgagttaccgacaatgctgcacaagttgaaaatcagagctgaatcctttgacacctgggcgaacaaagtgcgggtcgccctggaggtcgaagacggacgcaagagatcgtttgaagagttgagagccttagaatctgaagccagggagcgcagattccctaattccgagctgcttcaacgtctgaagaattgcctttccgaggtagaggcttgtatcgctcaggtcctgggactcgtttctggtcaagttgccaggatggacactcctcagctgactctcacagaactcagagtgttgctagagcagatgggtagcctcccttgcgccatgcaccagatcggggatgtaaaggatgtccttgagcaggttgaagcctaccaggccgaggcccgagaggccctcgcaacgctccctagttcccctgggcttctacgctcgctgctcgagcgcggacagcagctgggcgtcgaagtgcccgaggcccaccagctccagcagcaggttgagcaggcacagtggttagacgaagttaaacaggccctggcacctagcgcccacagaggttctcttgtgattatgcaaggtctcctggtgatgggagctaaaatcgcgagctcgccgagtgtggacaaggccagggctgagcttcaagaattgctaacaatcgccgagagatgggaggaaaaggcccatttttgtctcgaggccaggcagaaacaccctcctgctaccctggaggccatcatcagggagacagaaaatattccggtgcatctgcccaacatacaggctctaaaggaagccctgaccaaggcacaggcctggatagctgacgtggatgagattcaaaacggagatcattatccttgtctcgacgacctggagggattagttgctgtgggaagagacctccccgtggggctggaggaactccgacagcttgaactgcaagtgctgaccgcgcacagctggcgtgagaaagcatctaaaacattcctgaagaagaattcgtgctacactctattagaagtcctgtgcccttgcgccgatgccggttcagattcaactaaacgctctagatggatggaaaaggcactaggcctctatcagtgtgacaccgagctcttggggttatccgctcaagacttgcgagaccctggcagcgtcatcgtggcattcaaagagggggagcaaaaggaaaaggaggggatactccagctcaggcggactaactcagctaagccatcgccacttgctcctagcctgatggcctcaagcccaacctccatatgtgtttgtggccaggtgcccgctggtgttggcgtgctgcaatgcgatttgtgtcaggattggttccatggacagtgcgtcagcgtgccgcatctgctgacctcccccaagccttcactgaccagctctccactactggcctggtgggagtgggatactaagtttttgtgtccattgtgtatgcgctcccgtcgtccgcgtcttgaaacaatcttggcactgctcgttgctctgcagagactgcctgtccgcctgccggagggcgaggccttgcagtgtctgaccgaaagggcaatcggatggcaggatcgcgctcgcaaggccctggcttctgaggacgtgacggctctgctgagacagctcgcggaactgcgccagcaactccaggccaaacctaggccagaggaggcaagcgtgtatacatctgctacagcttgtgacccaatccgagaaggcagcgggaataacattagtaaagtgcagggcctgttggaaaacggagacagcgtgaccagtcccgagaatatggctccgggaaaaggttctgatctcgaattgctcagttcacttttgccgcaactgaccggcccagtgctcgagttgcctgaagccattcgagcccctttagaggagctcatgatggagggcgatcttttggaagtgaccctggacgagaaccactcaatatggcagttattgcaggccggtcaacccccagacttagatagaattcggaccttgctggagctggagaagttcgagcaccaaggttctagaacccggtctagggctctggagcggaggcggaggcgccagaaggtggaccaaggacgcaatgtcgagaacctggtccaacaggaactgcagtcaaagcgggctagatcctctggtattatgtcccaagtcggcagggaggaggaacactatcaggagaaggccgatcgggaaaacatgttcctgaccccgagcacagatcattctcccttcttaaaggggaaccagaactcactgcagcacaaggattctggttcctccgccgcatgcccctctctcatgcctctgttgcagctgtcttactccgacgaacagcagctttag

SEQ ID NO: 229091 - DNA, 882 bp, Artificial Sequence
  Description of Artificial Sequence: Synthetic coding sequence
cttcccaatatacaggctctcaaggaggcgctgaccaaggcgcaagcgtggatcgcagacgtggacgagatccagaatggggatcactacccctgtctagacgatttggagggcctagtggccgtgggaagagacttacctgtcgggcttgaggagctgaggcagctcgagctgcaggttctttgcccttgtgctgatgccggtagcgactcaacgaagcgttctagatggatggagaaggctctggggctctatcagtgtgataccgagctgctgggcttatctgcccaggatctgagagatcccggttcagttatcgttgcattcaaggaaggggagcagaaggaaaaagagggaattctgcagcttcggaggaccaacagcgctaagcctagtcctctagccccttctctgatggcctcatctcccacgagcatatgtgtctgcggccaggtgcccgctggtgtgggggtgctgcagtgcgacctgtgccaggattggtttcatggacagtgcgtttccgtaccacacctgctgactagccccaagcctagcctgaccagtagccccttgctggcatggtgggagtgggacacgaaatttctttgtcctctgtgcatgcgatcaagacgccctcgactagaaacgatcctcgcactcctcgtcgcattacaacggttgcccgtccgtttgcccgaaggcgaagctcttcaatgcttgacagagcgggctatcggatggcaagatagggctcgaaaggccctcgcaagcgaggacgtcactgctctgcttcgacaactggcagaactgcgacaacagctccaggcgaagcctaggccagaggaggcctctgtgtatacaagcgccacggcgtgtgactag

SEQ ID NO: 229092 - DNA, 4431 bp, Artificial Sequence
  Description of Artificial Sequence: Synthetic coding sequence
atggagcctgggtgcgatgaatttctaccccctcccgagtgcccagtttttgagccatcctgggcagagttccaggacccactgggctatatcgccaagatcagaccaatcgcagaaaagagtggcatctgcaagattagaccccctgccgactggcagccaccattcgctgtcgaggtagataacttccgcttcacaccgagagtgcaaagactcaatgaactggagattgtaatcgaagaaggtggctacgaggccatctgcaaagaccggaggtgggctcgagtggctcagcgtcttcattatcctccagggaaaaacattggctccttgctacgatctcactacgaacgtatcatctatccttatgagatgttccagtcaggcgcaaatcacgttcagtgcaacacgcacccttttgacaatgaggtgaaggataaagagtataagccacactcaattcccctcagacagtccgttcagcccagcaaatttagttcctactcccggagggccaagcggctccagcctgatcccgaacctacagaggaagacatcgagaagcaccccgagctgaagaagctccagatatatggccctggcccaaagatgatgggcttgggactaatggccaaagacaaggacaagaccgtacacaaaaaggtgacctgccccccaaccgtgaccgtgaaggatgagcagagcggaggaggaaatgttagttccactttgctgaagcagcacttgtcattagagccctgcactaagactacaatgcagctaaggaagaaccactcttccgctcagtttattgatagctatatttgccaggtgtgcagccgcggagatgaggatgacaaactcctcttttgcgatgggtgcgacgataactatcatatcttctgtttgctaccccctctgccagagattcctcgagggatctggcgctgtcctaagtgtatcttggccgagtgtaagcagcctcctgaagcctttgggtttgaacaggccacccaggagtacagcttacaatcttttggagaaatggctgactcctttaaatccgactactttaatatgccggtgcatatggtgcccactgagttggtcgagaaagagttctggcgcctggtttcctccatagaggaggacgtcactgttgagtacggcgcagatatccattcaaaggagttcggcagcggtttccccgtctcaaatagcaagcaaaacctgagccctgaagagaaagagtatgccacctccggatggaaccttaatgttatgcccgttttggatcagagcgttctctgccacatcaatgccgatatctccggtatgaaagtcccatggctgtacgtagggatggtcttctcagcattctgctggcacattgaggatcattggtcctattccatcaactacctgcactggggtgagccaaagacctggtatggagtgccaagtttagccgcagagcatttggaagaggtcatgaaaatgctaacccctgaactgttcgacagtcagcctgacctgttgcaccagctggtaaccttaatgaacccaaacacccttatgtcccacggggtcccggtagttaggaccaatcagtgcgcgggtgagttcgttatcacttttcccagggcttatcatagcggctttaatcaaggttataactttgccgaggccgttaatttctgtactgccgattggctgcccgcagggcgtcagtgcattgaacattacagacgcttacggaggtactgtgtgttctctcatgaggaactcatctgtaaaatggccgctttcccagagacactggacttgaacctcgccgtggccgtgcacaaagaaatgtttataatggtgcaagaggagcgcagacttagaaaggcccttctcgagaagggtgtgacggaggccgagcgcgaagcctttgaactgctccccgacgacgaaaggcagtgcattaagtgcaaaactacctgcttcctgagtgcactggcatgctacgactgcccggacgggctcgtatgtctctcacacataaacgatctctgtaaatgctccagctccagacagtacttgaggtataggtatacactcgacgagctccctaccatgctacataaattaaagattagagccgagtcatttgatacctgggccaacaaggtgagggtggcgcttgaagtcgaagacggacgcaagcgaagcttcgaggagttgcgtgccctggagtccgaagctagggagcgaaggttccccaacagtgaactgcttcaacgactgaaaaactgtctgagcgaagtggaggcctgtatcgctcaggtgctgggcctggtaagcgggcaggtcgctaggatggatactcctcagctgacactaaccgaactcagagtcttgctcgaacagatggggagcctgccatgcgccatgcatcaaattggcgacgttaaagatgtcctggagcaagtcgaagcctaccaggctgaagcacgagaagccctggccaccctcccttcttcaccaggacttttgaggtccctgctagaaagaggacagcagctgggagtggaggtaccagaggcacaccagctgcaacagcaggtggagcaagcacagtggctcgacgaggtcaagcaggccctcgccccatccgcacacagaggctctctggttattatgcaaggtctgctcgtgatgggagccaaaattgcaagcagcccatccgttgataaagctcgggcagagctgcaagagctgttgaccatcgccgaacggtgggaagagaaggcacatttctgtctggaagcacgacagaaacacccacctgctaccttggaggctataatcagagagacagaaaatattccagtccacctccccaacatccaggctttaaaggaggctctgacgaaggcacaggcctggatagctgatgttgacgagatacagaacggtgatcactatccctgtctggacgatctggagggtttggtagcagtgggcagagaccttcccgttggcctcgaggagttgcgtcaactcgagctgcaggtactgacggcacactcttggcgtgaaaaggctagcaagaccttcctcaaaaagaactcctgttatacactcctggaggtcctctgcccatgcgccgatgcaggatcggacagtacaaaacgatcgagatggatggagaaggcgctgggcctctaccagtgtgatacggagctcctggggctttccgcacaggacctgagagatcccggatctgtgatcgtcgctttcaaagaaggggagcagaaggaaaaggaggggatactgcaactcaggaggacgaactcagcaaagccttctcctctggcgccatccctgatggcttcctctcccacgtctatttgtgtgtgtggacaagtccccgctggcgtcggagtgctgcagtgcgacctttgtcaggactggttccacggccagtgtgttagcgtcccccatctgctgaccagccccaaaccatctctgacttcatcccctctgctggcctggtgggaatgggacaccaaatttctgtgccccctttgtatgcggagcaggcggccacggcttgagacaatactggccttacttgtagctcttcagaggttaccagtgcggcttcccgagggcgaggcactccagtgcctcacggagcgcgcaatcggatggcaggacagggctaggaaggcactcgctagtgaagatgtgaccgcattactgcgacagctggccgaactgaggcaacagctacaggcgaagccacggcctgaggaggcaagcgtgtacaccagtgcaactgcctgtgatccgatacgtgaggggtcaggaaacaacatttccaaagtacagggcctgctggagaatggtgacagcgtcacttcacccgagaatatggcacccggaaaggggagcgacttagagctgttgtcaagtctcctcccacagttgaccggccctgtcctagaactacccgaggcaatccgcgctcccctcgaggaactgatgatggaaggtgatttactggaggtaacgttagacgagaatcattcaatttggcaactgcttcaggcagggcaacctccagatcttgacagaatcagaacactgctggaactcgaaaaatttgaacaccagggctctagaacgcggtcaagggcactcgagcgcaggcggagacggcagaaagtcgaccagggacgcaatgtagaaaacttggtgcagcaggagctccagtctaaacgggcaaggtcctctggaattatgtcccaggtagggagggaggaagaacactaccaggagaaggcagatagagagaacatgttccttacaccctcgaccgatcactcaccctttctgaaaggcaaccagaattccctccaacacaaggacagcggttag

SEQ ID NO: 229093 - DNA, 1278 bp, Artificial Sequence
  Description of Artificial Sequence: Synthetic coding sequence
atggaacctggttgtgatgaatttctgcccccacccgaatgccctgtcttcgagccctcttgggccgagtttcaagatccgttaggctacattgcaaagattcgccctatcgcggaaaaatctggcatctgcaagattagacctcccgcagattggcaacctccgttcgctgttgaagtagataattttagattcactcctagggtccaacgtcttaacgaattagaggcacaaacgcgcgtgaaactgaattacttagaccagatcgccaaattctgggaaattcagggcagctccctcaagatcccaaacgtggaacgtaagatattggacttgtattctctgtcaaaaattgtgatcgaagaaggcggttacgaagctatctgcaaagaccggcgatgggctagagtcgctcagcggctccactatccacccggtaaaaacatcggaagtctcttgcgctcccactatgagcggatcatttacccctacgaaatgtttcagagtggggctaaccacgtaccagaaccaaccgaagaagacatagagaagcatccagagctcaagaagctgcagatctatgggccaggtccaaaaatgatgggcctcggactgatggcaaaagataaggataagaccgtgcacaaaaaggtcacgtgccccccaacagtcaccgtgaaggacgagcaatctgggggagggaatgtctcgagtacgcttttgaagcagcaccttagtctggagccctgcaccaagacaaccatgcagcttcgtaaaaaccatagctcagctcaatttatagatagttacatatgtcaggtgtgtagcaggggcgatgaggatgacaaactcttgttctgtgacggatgtgatgacaattatcatatcttttgcttgctgccacccctgcctgaaatccccagggggatctggcgatgtcctaagtgcatactcgcagagtgtaaacagccccctgaagctttcggttttgaacaggctactcaagagtacagcctacagtcattcggagagatggccgattcattcaaaagcgattattttaacatgcctgttcacatggtgccgacggaactcgtagagaaggaattttggcggctggtgtcctccattgaagaggacgtaactgtggaatacggagccgacatccattctaaggaattcgggtctgggtttccagtttccaactctaaacagaacctctctcccgaagagaaagaatatgccacaagtggatggaacttgaatgtgatgccatag

SEQ ID NO: 229094 - DNA, 2667 bp, Artificial Sequence
  Description of Artificial Sequence: Synthetic coding sequence
atggagcctggctgcgacgaattcttgccaccccctgagtgccccgtgttcgagccatcatgggccgagtttcaggaccccctcggctatattgcgaagattcgccctattgccgaaaaatcaggcatctgcaagatcagaccccctgctgactggcagccgccatttgccgtagaggtggacaatttcaggttcaccccaagagtgcagcgacttaacgaactggaggcccaaacccgtgtgaagctcaattacctcgaccagattgcgaaattttgggagattcaaggcagctcattaaagataccaaatgtggagcgtaaaattctcgatctctactccctctcaaaaatcgtgattgaggagggcggatacgaggccatctgcaaagacaggcggtgggccagagtggcgcagaggctgcactatccaccgggtaaaaacatagggagcctacttcgatcccattacgaaaggattatttatccatacgaaatgttccagtccggagctaatcacgtgcagtgcaacacccatccattcgataacgaagtgaaagataaagagtacaagccccacagtatcccattgcgacagtctgttcaaccctctaaattctcctcctactctaggcgggcaaagcgcctgcagcccgacccagaacctactgaggaggacatcgagaagcaccctgaacttaaaaagttacagatttatggtcctggaccaaaaatgatgggcctaggactgatggcgaaggataaggacaagaccgtgcacaaaaaagtcacatgtcctcctaccgttaccgtgaaggacgagcagtcaggcggtggcaatgtgagttccacgctcctcaagcagcatctatcccttgaaccatgtaccaaaaccaccatgcaactcagaaagaaccatagcagcgctcagttcattgattcctatatttgtcaagtctgtagcagaggagatgaggatgataagctattgttttgtgacggatgtgatgacaactaccacatcttttgtctgttgcctccccttccagaaatcccacgtggcatctggagatgtcctaagtgtattctggcagagtgtaaacagcccccagaagcttttggattcgagcaagctacacaggaatactctctgcagagtttcggagagatggctgactctttcaaaagtgattactttaacatgcccgtgcatatggtgcccacggagctggttgagaaggagttctggcgcctagtcagttccatagaagaggacgtgactgtagagtatggtgctgatatccattctaaggaattcggctcaggttttcccgtgtctaattccaaacagaatctctctcccgaggagaaggaatacgccacaagcgggtggaacctcaatgtgatgcccgttttggaccagtcagttctctgccacataaatgctgatatttcaggcatgaaggtcccatggctgtatgttggcatggtgttttccgcattctgctggcatatcgaggatcattggagctactcaattaattatctgcattggggtgaacccaaaacatggtacggcgtcccttcccttgcggctgagcacctggaagaggtgatgaaaatgcttacgcctgagcttttcgattcgcagccagacctactgcaccagctcgtgaccttgatgaaccccaatacacttatgtctcatggagtccccgtggttcggaccaaccagtgtgccggagagttcgttattacatttccacgggcttaccactctggcttcaatcagggctacaactttgccgaagctgtgaacttctgcaccgcagattggctgcccgctggtcgtcaatgtatcgagcattacagacgacttcgaagatattgtgtgttttcccacgaagagttgatctgcaaaatggctgccttccccgagaccctggacttgaatctcgctgttgctgtccacaaggaaatgttcatcatggtacaagaggaacgtagactgaggaaagcactcctggagaagggcgtcactgaggccgaaagggaggccttcgagctcctgcccgatgatgaaagacagtgcattaaatgtaagaccacttgttttctgtctgctctggcctgctacgactgcccagacgggctggtctgtctgagccacatcaacgatctgtgtaagtgtagttcgtcccgccagtatctgaggtatcgatataccctggacgaactgcccacgatgctccacaagctgaaaatcagagcggaaagttttgacacttgggcgaacaaggtccgagtagcactagaggtcgaggacgggagaaagagaagttttgaagagctgcgggcactcgaatcggaggccagggagcgccgtttccccaattccgagctgctgcagaggctgaaaaactgcctttctgaggtagaggcctgcatcgcacaggtcctcgggttggtgtccgggcaggtggcacggatggacactcctcagttaacacttacagagctacgagtgctgctggagcagatgggaagcctcccttgcgctatgcatcagattggcgacgtgaaggtgttgagctggaaatggaggagatacgtgttcccataccacctgtgtgtgtattcaatgcaggggaatatcctgcccgattag

SEQ ID NO: 229095 - DNA, 4713 bp, Artificial Sequence
  Description of Artificial Sequence: Synthetic coding sequence
atggagccagggtgcgatgaatttttgcctcctcctgagtgtcctgtttttgagccttcatgggcagaattccaggatccccttggttacattgcaaagattcgccctattgccgaaaaatctggaatttgtaagatacggcctccagcggattggcagcccccattcgctgttgaagtagacaatttcaggttcacaccccgagtgcagcggctgaatgaactggaagcgcagacaagggttaaactgaattacttggatcagattgccaagttttgggaaattcaggggtcttctctgaagatccccaacgtcgagcggaagatcctcgatttatatagcttgtccaagattgtcattgaagaggggggatatgaggccatctgcaaggaccgaaggtgggctcgcgtggcacagaggctccattaccctccaggcaaaaacatcggctccctgctccggtctcattacgaaaggatcatatatccgtatgagatgtttcagtctggcgctaaccatgtgcagtgtaacacgcatccattcgacaacgaagttaaagacaaggaatataagccacattctattccactgcgtcaaagtgtccagccatccaagtttagctcttatagccgtcgcgctaagcggttacaacccgatccagagcccacggaggaggatatcgaaaaacatcctgagctcaagaaactgcagatctatggccctggaccaaaaatgatgggcctagggttaatggctaaggacaaggacaagacagtgcacaagaaagtgacttgtccacctaccgtgacagtgaaggatgagcagagtggaggtggcaatgtgagctccacccttttgaaacagcacctatccctcgaaccttgcactaaaacaacaatgcaactgcgcaagaatcacagttccgcgcagttcattgacagctatatttgtcaggtctgttcccgaggcgacgaagacgataaactccttttctgtgatggatgtgacgataattatcacatattctgccttctgcctccactcccggaaattcctagaggaatctggagatgccccaagtgtattctcgctgagtgtaaacagccaccagaagcctttggttttgaacaggcaacccaggaatactctttacagtcatttggggagatggcagactccttcaagtccgattattttaatatgcccgtccacatggtgcctaccgaactggttgagaaggagttctggaggctggtcagtagcatcgaggaagatgtaaccgttgagtacggcgctgatatccactcgaaggagtttggctctgggttccctgttagtaattcaaagcagaaccttagccccgaagaaaagcgccagagtctcacagtgctgacaaggttgatttcaagtttctgggcacaggctgttttgcctccatggcctccaaaggtcctaggactgcaggagtatgccactagcggttggaacctgaacgtgatgcccgtgcttgatcaaagtgtgttgtgtcacatcaatgccgacatttcaggaatgaaggtgccatggctgtatgttggcatggtgttttcagcgttttgttggcacatcgaagaccattggtcatactcaatcaactatctccactggggagagcctaagacctggtacggcgtgccctctctcgccgctgagcacttggaggaggtaatgaagatgctcacccctgagctatttgacagccagcccgacctgttacaccaactagtgactctgatgaatccaaacaccctgatgtctcacggtgttcccgttgtgcggacgaaccaatgtgccggagagtttgtgattacctttccgagagcataccacagcgggtttaaccagggctataacttcgctgaagctgtcaatttttgcaccgctgactggctccccgcaggacgccaatgcatcgaacattacaggcggcttagaaggtactgtgttttctcccatgaggagctgatctgcaaaatggcagcatttcccgaaacactcgacctcaacctcgccgtagctgtacacaaagaaatgttcattatggttcaagaggagagacgcctgcgcaaagctctcctggaaaaaggagtcactgaagcggaaagggaagcgttcgaactcctgcctgatgatgagagacagtgcatcaagtgtaagactacgtgtttcctctccgcactagcttgttatgattgcccggacggactggtctgtctcagccacattaatgatctgtgcaagtgcagttcatctaggcagtatttacgttaccgctatactttggatgagctcccaacaatgctgcataagttaaaaatccgcgcagagagcttcgatacttgggcaaacaaggttcgtgtggcactggaggtcgaagacggacgtaaacgtagcttcgaagaattgagagccctggaatccgaggcccgagagcgaagattcccgaacagcgagctgctacagaggctcaaaaactgtctcagcgaggtggaagcatgtatcgcccaggttttgggtctcgtcagcggccaggtggctaggatggatacaccacagctaacgctcacagagcttcgcgtgctcctggagcagatggggtctttgccttgcgcaatgcaccagattggcgacgtgaaagacgttctggaacaggtggaggcatatcaggctgaggcacgtgaagcactcgcgactctgccttcctcgcccggtctcctgcggtccctactggagcgcggacagcagcttggagtggaagtacctgaagctcaccagttgcagcagcaagtggaacaagcccaatggttagatgaagtcaaacaagccttggctccaagtgcacaccggggaagtttggtcatcatgcagggcctgttggtgatgggagctaaaatagcatccagtcctagcgtggacaaagcacgggctgagctccaggaacttctgactattgccgagaggtgggaagagaaggcccatttttgcctcgaagccagacagaaacacccccctgctacactggaagcaataataagagagactgaaaacattccagtccacttaccaaatatccaggccctcaaggaagccctcaccaaagcccaagcatggatcgcagatgtcgacgaaattcagaacggcgaccattacccatgcttagatgacttggaaggcctcgtggctgtgggaagagacctcccagtgggcctcgaggagctgcggcagctggagctccaagtcctgacagcccactcatggagagagaaggcctcaaaaaccttcctgaagaagaactcttgctacaccttgctggaggtgctctgtccttgtgccgacgctggctcagactcaaccaaaagaagtcgttggatggagaaggctctgggactgtatcagtgtgacaccgagttgctgggtctgagtgcccaggacctccgagatcccggatcagtgattgtggcattcaaagagggagaacagaaggaaaaagaggggatactgcaactcagaaggactaattcagccaaaccctcacctctggccccatctctgatggcctcatccccaacaagtatctgcgtctgcggacaggttccggctggtgttggcgtcttacagtgtgacctctgtcaggactggtttcacggtcaatgcgtgtcagtgcctcatctcctaacctcacctaagccctcgctgacttcatcccctctgctagcctggtgggagtgggacactaagttcctctgtccactctgcatgagaagtcgcaggcctaggctggagacaattctcgcactgctggttgccttgcaacggttgcctgttcgtctccccgagggggaggccctgcagtgcctcactgagagggcaataggatggcaggacagggctcggaaagccctcgcaagcgaggatgtgaccgcgctgttaaggcagctcgcagagctgcggcagcaactgcaggctaaaccaaggcctgaagaggctagtgtgtatacttcagcaaccgcctgtgatccaattagagaaggctcaggaaataacatttcaaaggtgcagggcttgctagaaaacggcgactcagtcacctcacccgagaacatggccccaggcaagggatccgatttagagctgctgtctagtctcttgcctcagcttacaggcccagtgctggaactgccagaagctatcagggccccactagaggagctcatgatggaaggggatctgcttgaagtcacgttggacgagaatcattcgatttggcagctgctgcaggccggacaaccaccagatctggacaggatacgtaccttattagagctcgagaaatttgagcaccaagggagtaggaccagatctagagccctcgaacgcaggaggaggagacagaaggtggatcaaggaaggaatgtggagaatttggtccagcaggagttgcagagcaagagggccagaagttccgggattatgagccaggtcgggagggaagaggagcattaccaggagaaggctgatcgggaaaacatgtttctgacgccaagcactgatcactcccccttcctgaagggaaaccagaattctctgcagcataaggatagtgggagctccgcagcatgtcccagtctgatgcccttgctgcagttgagttactctgatgagcagcaattgtag

SEQ ID NO: 229096 - DNA, 3297 bp, Artificial Sequence
  Description of Artificial Sequence: Synthetic coding sequence
atggacttagggacactttacgaatcctgcaatcagccccaagacgcgatcaagtgctacctcaacgctacccggtctaagtcttgctcgaatacctcagcattggccgcaaggatcaagtacctacaggctcagctgtgtaacctgccccaggggagcttgcagaataaaacaaagctgttaccttcaatcgaagaggcgtggtccctgcccattcctgcagaattgacaagccgacaaggtgccatgaatacagcccagcaggcctgtaaaccccatcatcctaatacagagcccgtactgggtctgtcccaaacaccaataagccagcaatcgctgccgctccacatgataccttcctcccaagtggacgatttaagtagcccagcaaagcggaagagaacttccagtccaacaaagaacacctctgataactggagcggagggcacgccgtgagtcatcctcctgttcagcagcaggcccacagctggtgcctgacacctcagaagctgcagcacctcgagcagctgcgagcgaatagaaacaaccttaacccagcccagaaacttatgctcgagcagctggaaagccaatttgtactaatgcaacaacaccagatgcgtcccacaggcgtggctcaagtgagatctacaggaatacccaacgggccaaccgcagactcaagtctgcccaccaacagcgtgtccggtcaacagcctcagctcgccctgacacgtgttcccagcgtttcccagccaggcgtgcgacccgcttgtcccggtcagcctctagcgaatggaccctttagcgctgggcacgttccgtgctccacaagccgcacattggggtctactgacactattctgataggcaacaatcacatcacgggcagtggatctaatgggaacgtaccatacctgcagaggaatgccctgacattgcctcataacaggacaaacctgaccagtagtgcggaggagccctggaagaaccagctgtctaattccactcaaggcctgcacaagggccaatctagccattccgcgggacccaatggcgagaggcctctctcttccacagggccttcacagcacctccaggctgctgggtctggtattcagaaccagaacgggcaccctacattaccatcgaactcggtgactcagggagcagccctcaaccatctctccagtcacaccgctacctccggcggacagcagggaattacacttactaaggaatccaagccaagcggaaatattctgacagtgccagagaccagccgccacacgggggagacccccaattccaccgcctctgtagagggcctcccaaatcatgtccaccaaatgacggctgatgccgtgtgctcaccttctcatggggatagcaaatctccaggactgctgagctcggataatccacagctttccgcccttctcatgggcaaagctaacaacaatgtcggcacaggtacatgtgacaaggtcaataacatccacccagcagtgcataccaaaacggacaactcagttgccagctcccccagcagcgctatcagtactgctacgccgtcacctaaaagcacagagcagacgacaaccaactcggtcacaagcctcaactccccacactccggtctgcacactattaatggagaggggatggaagaatcccagtcacccatgaaaaccgacctgctattagtgaatcacaagccgtctcctcagattattccatccatgagtgtatcgatataccctagcagtgctgaggtgctgaaggcctgcagaaatttgggcaagaacggcctgagcaacagttccatactgttggataagtgtccgcctcccaggccgccatcctctccataccctccgctccctaaagataaactcaatcctcctacaccaagcatctacctcgaaaacaagagagacgcattcttccccccactgcaccaattctgtaccaacccaaacaatcccgtgaccgttatacgtggattggccggtgcgctgaaattggatttgggtctgttcagtaccaagacactcgttgaagcgaacaatgaacatatggtcgaggtccgtactcagctcctgcagcccgctgatgaaaattgggaccctacgggcaccaagaaaatttggcactgtgaatcaaatcgatctcacactacaatagcaaaatatgctcaatatcaagcaagttccttccaggagtcattacgtgaagaaaatgagaagcggtcccatcacaaagaccatagcgactccgagagtacatcttcggacaattccggacgaagaaggaaggggcctttcaagacaatcaagtttggaactaacatcgatctgtcagacgacaagaaatggaagttacagctacacgagctaacaaagctgcctgctttcgttcgtgtggtgagtgccggtaacttgctcagccacgtcgggcacactattctggggatgaataccgtgcagctgtatatgaaggttcctggttctcggacaccaggacaccaggagaataacaatttttgttccgtgaacatcaatatcggacccggagactgtgaatggtttgtcgtcccggaaggctattggggcgtgctgaatgatttttgcgagaaaaataaccttaatttcttgatgggctcttggtggccaaacctggaagatctgtacgaagctaatgtgcctgtgtacagattcattcagagacctggcgatctggtgtggattaacgccggaaccgtgcattgggttcaggccattggctggtgtaataacatcgcatggaatgtgggtcctctcaccgcctgtcagtacaaactagccgtggagcgatacgagtggaacaaactgcaaagtgttaagagcatcgtccccatggtccatctgtcttggaatatggccagaaatatcaaggttagcgaccccaagctatttgagatgataaagtactgtctgctccgaaccctcaaacaatgccaaacactgcgggaggcactgattgcagccggaaaggagataatttggcacggcaggaccaaagaggaacccgcacactattgcagcatatgtgaggtcgaagtgtttgatctgttatttgtgactaacgagtccaatagcagaaagacatacatcgtgcactgccaggactgcgcaagaaagacgtctgggaatctcgaaaattttgtcgtcctggagcagtacaagatggaagacctgatgcaggtctacgaccagtttacactggccccacccctgcccagcgctagctcttag

SEQ ID NO: 229097 - DNA, 4206 bp, Artificial Sequence
  Description of Artificial Sequence: Synthetic coding sequence
atgaaatcctgtggcgtgtccctcgccactgcagccgcagccgcagcagccttcggagacgaagaaaagaaaatggctgctggcaaggcttcaggggaaagcgaggaggcctctccctccctgactgctgaggagcgcgaggctctgggcggtttggacagtcggttgttcggtttcgtccggtttcatgaggatggagctagaaccaaagcactgctgggaaaggctgtccgctgctacgagtccctcatccttaaagcagaggggaaggttgagtctgacttcttttgccagctgggacacttcaatctgctcctcgaagattaccccaaagccctctctgcttaccaacggtattattccctacagtcggactactggaagaatgctgcattcctctatggcctaggacttgtatacttccactataacgcttttcagtgggcaattaaggcgtttcaggaggtgttatatgtagatccgagcttttgtcgagccaaagaaatccatctgcgattgggactgatgtttaaggttaataccgattatgagtcgagcctgaagcatttccagctggcactggtggattgtaatccttgtaccctgtccaatgctgagattcagtttcacatcgcccatctatatgagacccagcgaaaatatcattctgctaaggaagcctatgaacagctgcttcagaccgaaaatcttagtgctcaagttaaagccacggtgcttcagcagctagggtggatgcaccataccgtggacctgctgggcgataaagccacgaaagagtcatacgctatccaatacctgcagaaaagcttggaagcggacccgaattcagggcagtcttggtattttctcggacgttgttacagttccattggaaaagtgcaggacgccttcatctcctatcgacagagtattgacaagtctgaggcctcagccgatacatggtgctcaattggggtgctgtaccagcagcagaaccagccgatggacgctctccaggcctatatctgtgcagtccagcttgatcacggacacgcagccgcatggatggacctgggcacactttacgaatcctgcaaccaaccgcaggatgcgataaagtgctacttgaacgcgactcgcagtaaaagctgtagtaacacttcggccttggccgcaaggatcaagtatttgcaagcccaactgtgtaacctccctcaggggagtctgcagaacaaaaccaagctgctgccctcaatcgaagaggcctggtccctgccaattcccgctgaactgacaagcaggcagggggctatgaatacagctcagcagaacacatccgacaattggtctggaggccatgccgtgagtcaccccccagtgcagcagcaggctcactcatggtgcctcaccccacagaagctgcagcatttagagcagctgagagccaataggaataacctgaatccggctcaaaagttgatgctggagcagcttgagagccaattcgttctgatgcagcaacaccagatgaggcctaccggcgttgctcaagtgaggagtaccgggatccccaacggtcccacagccgactcatcattgccaacaaactcagtgagtggacagcagccgcaactagctctcaccagagttccttccgtctctcagcccggagtccgccctgcctgcccgggacagccactggccaacggaccctttagcgccggacacgtaccttgttctactagcagaactttaggatctactgataccatactgataggaaataatcacattacggggtccgggtccaacggcaatgtgccctatttgcagcgcaacgccctcacactgccccacaatagaactaatttgacttccagcgccgaggagccttggaagaatcagctgagcaattctacccaggggctgcataaaggacagtcaagccacagcgcaggcccaaatggcgaacgtcccctctccagcactggcccaagtcagcatttacaagctgccggtagtggcatacagaatcagaacgggcatcccactctgcctagcaattctgtgacgcagggcgctgccctgaatcacctctcctcccacaccgcgactagtggagggcagcagggaatcacgctcaccaaagaatcaaagccatcagggaatatcttgacggtgcccgaaacctctagacacacgggggagactccaaattccacagccagtgtagaaggcctgcccaatcatgtgcatcaaatgacggccgacgcagtgtgtagcccttcccacggggattctaagtcccccggtctgctatcatcagacaatccgcagctctcagctctgttgatgggtaaggccaataacaacgtcgggactggaacttgcgataaggttaataatattcaccctgccgtgcatactaagacagacaacagcgtcgcaagctctccgagctccgcaatttctactgccacaccctcgccaaagagtactgaacagacaacaactaattctgtgacttctttaaacagccctcactcagggctgcacaccataaacggcgagggaatggaggagtctcagtcccccatgaagaccgacttattactcgtgaaccataagccctctccacagatcattccgagcatgtctgtgagcatatacccatcttcggctgaagtcctgaaagcgtgccgcaatttgggaaagaacggcctatccaactcttcaatcttgctcgataaatgtccacccccaagacctccatcctcaccttatccacctctaccaaaagacaaactgaatcctccgactccgtcaatctatttggagaacaaacgggacgcgtttttccccccacttcaccagttttgtactaacccaaacaatcccgtcacagtgattcggggtttggcaggggctctgaaactggatttggggctcttctcaaccaagacgctcgtcgaggccaataacgagcatatggtggaggtacgcacacagctcctgcagcccgctgacgaaaattgggatcctacagggaccaaaaagatctggcactgtgagtctaatcggtctcatactaccatcgccaaatatgcgcagtatcaggcatcaagctttcaggagtccctgagagaggagaatgaaaaacggtctcaccacaaagatcactctgattcagaatccacaagttccgataactccggtcggagacgaaaggggccatttaaaacaatcaagttcggtacaaacatcgacttgtcagacgacaaaaaatggaagcttcagctacacgagctgacaaaacttcctgcatttgtgcgggtggtcagcgcgggtaacctgctctcccatgtagggcataccatcttgggcatgaacaccgtgcagctgtatatgaaagtccctgggagcaggactcctggtcaccaggagaacaataacttctgctcagtgaatataaatatcgggcctggagactgtgagtggttcgtagttcccgagggctactggggggtactgaacgacttttgcgagaagaataatttgaactttttaatgggttcatggtggccaaacttggaagatctgtatgaggctaatgttcccgtgtatcgcttcatccaacgccctggcgacttggtgtggataaacgccggtaccgttcattgggtgcaggccattggctggtgcaataatatcgcctggaatgtcggcccattgaccgcatgtcaatataagctggcagtggagcgctatgagtggaataagctacagtcggtgaaaagcattgtccctatggtgcatttatcttggaacatggctagaaacattaaagtcagcgacccaaaattattcgagatgattaagtattgtcttttgcgcactttgaaacagtgccagacattgagggaggctctgatcgcggctggcaaagaaatcatctggcacgggcgtacgaaggaggaacccgctcactactgcagtatctgcgaggtagaggttttcgatctgttgttcgtgaccaacgagtctaactctcggaagacatacatcgtacattgtcaggactgcgccaggaagacctctggcaatctcgagaatttcgtggttttggaacagtataagatggaagatttgatgcaggtctatgaccaatttactctggccccaccactgccgtccgcatcgagttag

SEQ ID NO: 229098 - DNA, 4227 bp, Artificial Sequence
  Description of Artificial Sequence: Synthetic coding sequence
atgaaatcctgcggcgtgtcactggcaacggcagccgctgctgccgctgccttcggggatgaggaaaagaaaatggccgctggcaaggcaagcggtgaaagcgaagaggcgagtccgtcactaacagccgaggaacgcgaggccctgggtggactggacagtaggctgttcgggtttgtccgattccatgaagacggcgctaggaccaaagcgcttctaggtaaagcagtgcggtgctacgagtctttgattctcaaagccgaagggaaagtggaatccgacttcttttgtcagttgggacactttaacctactgctggaggactaccctaaagcactctcggcataccagcgctattacagcctgcagtctgactactggaagaatgcagcctttctctacgggttgggactagtctattttcattacaacgcttttcagtgggctattaaagccttccaagaggttttgtatgtggacccttcattttgccgggctaaggaaattcacctaagactgggactaatgtttaaggtgaataccgactatgagtcttcgctgaagcactttcaactggccttggttgattgcaacccctgcacgctgtcgaatgctgaaatccaattccacattgcccacctctatgaaacgcagaggaagtaccactctgctaaggaggcttatgaacagctgctgcagacagagaacctatctgcccaagtgaaggcgaccgttctgcaacaactgggatggatgcaccatacagttgatctgctcggagataaagccaccaaggaatcttacgccatccaatacctgcaaaaaagtctggaggctgaccccaattcaggtcagtcctggtactttctaggtcgctgctattcgtccattggtaaagttcaagatgcctttatctcctatcgacagtctatagacaaatcagaggccagcgccgatacctggtgttcaattggtgtgctgtaccaacagcagaatcagcccatggatgcattacaggcctacatttgcgcggtgcaacttgatcacggccatgcagccgcttggatggacctcggtacactctacgagtcctgtaatcagcctcaggacgctattaagtgctatctcaacgcgactagaagcaagtcttgttcgaatacctccgccctcgccgctaggataaagtacttacaggcctgtaagccccatcacccgaacacagaaccagtacttggactgtctcagactccgatcagtcagcagtccctgccactacatatgattcctagctcgcaggtcgatgatttgtcatcccccgcaaagcgtaagcgaaccagcagtcccaccaagaatacgtcagacaattggagtggtggacacgcagtctctcatccgccagttcagcagcaggcgcactcatggtgtctgactccacagaagttgcagcatctcgaacagttgagggccaataggaataacctgaatcctgctcaaaaactgatgctggagcagctcgaaagtcagtttgtactgatgcagcagcaccaaatgcgccctactggagtggctcaggtgagatccactggaattccaaacggacccactgcggactcatccttgccaacaaactccgtgtctggccaacagccccagctggcattgacccgcgttccatctgtgtcacaaccaggcgtgcgccctgcttgcccaggacagcctcttgctaacggacccttctctgctggccacgtcccgtgcagtacaagccgcaccctcgggtccaccgatacaattctgattggaaataatcatatcactggttccggcagcaatgggaatgtcccatacctgcagagaaatgcactaaccttaccacacaataggaccaatctgacaagtagtgcggaagaaccgtggaagaaccagctctcgaacagcactcagggcttgcataagggacagtcaagtcattcagctggccctaatggcgaacgacctttatcatctaccggacccagtcagcacctccaggcagcgggaagcgggatacaaaatcaaaatggccacccaaccctgcctagcaactctgtgacccaaggcgcagctttaaatcacctgagtagccacactgcaacctccggcggtcagcagggtataactctcaccaaggagtcgaagcccagcggcaacattctcacagtgcctgaaacttcaaggcacaccggagagacaccaaactctacggcatcagtagagggcttgcccaaccatgttcatcaaatgacagctgacgctgtgtgcagcccaagccacggggacagcaagtccccgggtctactttcgagtgataaccctcaactctccgctctcttgatgggtaaagcaaataacaacgtggggaccggcacctgtgataaggtgaacaatattcatcctgctgtgcacactaaaaccgacaatagcgtggccagttcacccagtagcgccatctcaactgcaaccccaagtcctaagtccactgaacagactaccactaactctgtcacgtcactgaacagtccccactctggtttgcatacaatcaatggagagggcatggaggagagccaatcaccgatgaagactgatcttttacttgtgaaccacaaaccttctccccagattattcccagtatgtccgtgtccatttacccttctagtgccgaagtgctgaaagcctgtcgcaatctggggaagaatggactcagtaattcgtctattttgctcgataagtgtccccctcctcgacccccatcctcgccctatcctccactcccaaaggacaaactcaacccccctacaccgtcaatttatctggagaacaaaagagacgccttctttccaccactacaccagttttgtactaacccaaacaatccagtgacagtgattagaggtctagctggagctctgaagctggacttgggtctcttttccaccaagacactagtagaggcgaacaatgagcacatggtagaggtgagaacgcagcttctgcagcctgccgatgagaattgggatcctacagggactaagaaaatttggcactgcgagtctaacagatcacataccaccattgcaaagtacgctcaatatcaggcatcctcattccaggagtcattaagagaagaaaatgagaagcggtcccatcataaagaccacagcgacagcgagagtacctcatccgacaactctggccgtcgccgaaaggggccattcaaaacgattaaatttggtaccaacatcgatctgtctgacgataagaaatggaaactgcagctccacgaactaacaaaactgcccgcttttgtgagggtggtgtcagctggaaatctgctgagccatgtaggccataccatcctaggcatgaacactgtccagctgtacatgaaagtgcctggctctaggactcctggccaccaggagaacaacaacttctgtagcgtgaacattaatattggcccaggcgattgcgaatggtttgtggtgccagaggggtactggggcgtacttaatgatttttgtgagaaaaataacttaaatttcctcatgggtagctggtggcccaatttagaagatctgtacgaggcaaacgtgccagtatataggtttattcaaaggccaggcgacttagtgtggattaatgccggaaccgtgcactgggtgcaggccatcggatggtgcaataatattgcctggaatgtaggccctcttacagcttgccagtataaattagccgtcgaaaggtacgagtggaacaaacttcaaagcgtgaagtccatagtccccatggtacatttgagttggaatatggcgcgtaacattaaggtttcagatcccaagttattcgagatgattaagtattgtcttctccgcacactgaaacaatgtcagacattgagagaggccctgatcgccgctgggaaggaaatcatctggcatggacgtactaaggaggagcctgcacactactgtagcatttgtgaagtagaagtcttcgatctactattcgtcacaaacgaaagtaacagtaggaaaacctacatcgtgcactgtcaagattgtgccagaaaaaccagtgggaacttagagaatttcgtcgtgctggaacaatacaagatggaagatctgatgcaggtctacgaccagttcacgctagcccctcctctgccatctgcgtcatcatag

SEQ ID NO: 229099 - DNA, 3000 bp, Artificial Sequence
  Description of Artificial Sequence: Synthetic coding sequence
tagggcaccctctacgaatcttgtaaccagccacaggatgctattaaatgctacctgaatgctactagatccaagagctgctctaacactagtgccctggccgcacggatcaagtacctacaaaacacctcggacaactggtccgggggtcacgctgtgtctcaccctccagtccaacagcaggcacacagctggtgtctgacaccccagaagctgcagcatttagagcagctgcgcgctaaccgtaacaatttgaaccccgctcagaaacttatgctggagcagcttgagagccaatttgtgctgatgcagcagcaccagatgaggcccactggcgtcgcccaggtccgtagtactgggattcccaacggacctacagccgatagctcgctgccaactaattccgtcagcggccaacagccacagctggcacttactcgggtgccctcggtgtcacagcccggagtgagaccagcatgccccggtcaaccactcgccaacggcccattttccgccggtcacgtcccatgtagcacatcaagaacactgggctcaacagacacaattcttataggcaataatcatatcactggctctgggtctaatgggaatgtcccctatctgcaaagaaatgccctgaccctcccacataatcgcaccaacctgaccagttcagcggaggagccgtggaagaatcagctctctaacagtacgcagggcttgcataagggtcagtccagccattccgccggaccaaatggagaacgtccactgtcatctacagggccatcccagcacctgcaggccgcaggatccgggattcagaatcagaacggtcacccaactctgccatcgaactctgtgactcagggcgcagccctgaaccatctgagctctcatacagccacctcaggcggtcagcagggcatcaccttgacgaaggaatccaaaccctcaggtaatatcctgaccgttccagagacatctcgacataccggggagactcctaacagtactgcctccgtggaggggctccccaatcacgtacatcagatgacagctgatgcagtgtgctcaccctcacatggggactccaaatcccctggcctcctctccagcgacaatccccaattgagtgccttactcatgggtaaagcaaacaacaatgtgggcaccggcacttgtgacaaggttaacaatatacatcctgccgtgcatactaaaacggataattcagtggcgtctagccctagctcagccatctcaacggccaccccatctcctaagtccactgagcaaacgaccacgaacagcgtcaccagcctgaacagccctcattctggccttcacaccattaacggcgagggaatggaagagagccagtctcctatgaagacggacttgctgctggttaatcacaagccctcacctcagatcataccttccatgtctgtgagcatataccctagtagcgccgaggtgctgaaggcatgtaggaatctgggcaaaaatgggctgtctaattcttctatactcttggataaatgtcccccacctcgccctccatctagtccttatccacccttgcctaaagacaaactgaatccaccgaccccaagcatctacttggaaaataagcgggacgcatttttccctccattacaccagttctgcaccaacccgaacaacccagtgacagtgataaggggactcgcaggagccctaaagttggacctggggctcttcagtacaaaaactctggtggaagcaaacaatgaacacatggttgaagtcagaacacagttgttacaaccagccgacgagaattgggatcctaccggcaccaaaaaaatctggcactgtgagtccaacaggagccatacaacaattgcaaaatatgcacagtaccaagcttcctctttccaggaatctcttagagaagaaaacgaaaagaggtcacatcataaggatcactctgactctgaatccactagttccgataactcagggaggaggcgcaaaggcccatttaaaaccattaagtttgggacaaatattgacctgtctgacgacaaaaagtggaagctgcagttgcatgagctgacaaagctccccgcatttgtgagagtggtgagcgccggaaatctcctgtcacatgtcggacacactatcctgggcatgaataccgtgcaactctacatgaaagtgcccggatccaggacccccggtcaccaggaaaacaacaatttctgctcagtgaatataaacatcggaccaggcgactgtgaatggttcgtggtgcctgagggttattggggggtcctgaacgacttttgtgagaaaaacaacctcaattttctgatgggtagctggtggcctaatctggaggatctatatgaagcgaatgtgcccgtctaccggtttatccagagacccggagacttggtgtggattaacgccggaacggtgcattgggtccaagctataggctggtgcaacaacatcgcatggaatgtcggcccactgacagcctgccagtacaaactggccgttgagcgatacgagtggaacaaacttcagtccgttaagtcaattgttcccatggtgcacctgagctggaacatggctcgaaacattaaggtatcagaccctaagctcttcgaaatgatcaaatattgtctgctccggacgctgaagcagtgtcagaccctgcgcgaagctttgatcgcggcagggaaagagatcatctggcacgggcgaacaaaagaagaaccggcacattactgctcaatttgcgaggtggaggtatttgatttgctcttcgtgacaaacgagtcgaacagtaggaaaacatatatcgtgcattgtcaggattgtgcaaggaaaacaagcggcaatttggagaatttcgttgtgctggagcagtataagatggaggatctcatgcaggtgtacgatcaattcacactggctccccctctcccatccgcatcatcttag

SEQ ID NO: 229100 - DNA, 486 bp, Artificial Sequence
  Description of Artificial Sequence: Synthetic coding sequence
tgagccagaaacattaaggtttctgatcccaagctttttgaaatgattaagattttctccctgagtcccaattttagagcggagaagtgcttgagagaccatctcgtccagccattgaggtctaatggagagcctgagcccctgagatttacgggcgagtattgcctgctccgtaccctgaagcagtgtcagacactgcgagaagcattaatcgctgcgggaaaggaaataatttggcatgggaggacaaaggaagaaccggctcactactgctccatctgcgaagttgaagttttcgacctgctcttcgtaactaacgagtcaaactcacgcaagacctatattgtccactgccaggattgtgcccgaaagacgtccggcaacctcgaaaacttcgtggtcttagagcagtacaagatggaagacttaatgcaggtgtatgatcagttcacgttagctcctcccctgccgagcgccagttcatag

SEQ ID NO: 229101 - DNA, 3135 bp, Artificial Sequence
  Description of Artificial Sequence: Synthetic coding sequence
taaaacaagacaaaactgctaccgagcattgaggaagcctggagtctcccgattcctgcagagctgaccagccggcagggcgctatgaacactgcacagcaagcctgcaaaccacaccaccccaataccgagccggtgctcggattatctcagacccccatctctcaacagtctttgcccctgcatatgatcccttcctcgcaagtcgatgatctgtcctctcctgcgaagaggaaacgtactagcagccccaccaagaacaccagcgataactggtccgggggtcacgccgtcagccatcccccagtgcaacagcaagcacacagttggtgcttgacaccccaaaaacttcaacacctggaacaattgagagcaaatcgcaacaacctaaacccagcccaaaagttaatgctggaacagttggagagtcaattcgttttaatgcagcagcaccagatgagaccaactggtgtcgcccaggttcggagcaccggcatacctaacggaccgactgcagactcaagcttgcctacaaactcagtgagcggccagcaacctcagctggctctgactagagtgccttcagtctctcagcctggggtgcggcctgcatgtcctgggcagcctctcgctaatggccctttttccgctggacacgtaccgtgctccacaagcagaacactcggaagcaccgatactatcctcatcggcaacaaccatattactggcagtggatctaatggtaacgtgccttacctgcagcggaatgctctgacccttcctcacaataggactaatttaaccagttctgctgaagagccctggaagaatcagctgagcaactctactcaggggctccataagggtcagtcatcacatagcgcaggtcctaatggggagcgaccccttagctccacagggcctagtcaacatctacaggctgctggctctgggatccagaaccagaacggtcatccaactttgccgtcaaactccgtgacccagggcgctgcactgaaccacctctctagccacaccgccacttctgggggacagcaggggataactcttactaaagaatccaagccaagtggtaatattttaaccgtccccgagacctcccgacacaccggcgagacacccaacagtaccgcctccgtagaggggctcccaaaccatgttcaccagatgacggccgatgccgtgtgcagcccgagccatggagacagtaaaagccccggtctcttgtcatcagacaacccacagttatcggcactgttaatgggcaaagcgaataacaacgttggcacgggcacgtgtgataaagtgaacaacatccaccctgccgtccacaccaagacagataatagtgtggctagcagtccatcctcggccatttctactgccactccgtccccaaagagcacggagcagaccaccactaattcagtgaccagcctaaattccccccactctggcttacataccatcaacggcgaggggatggaggaatcccagagccctatgaagactgatctcctgcttgtgaaccataagccctccccacagataatcccgtccatgtccgtgtcaatttatcctagctccgcagaggtactgaaagcgtgcagaaacctcggcaagaacggcctgtcaaacagttccatactcctcgacaagtgccccccacctcggccaccttcgagcccatatcctcccctgccaaaagacaaactgaatccacctaccccctccatttatttggagaacaagcgggatgcctttttccctcctctacaccagttttgcacgaaccctaacaaccccgttactgttattcgcggactcgctggtgccctgaaacttgacctaggcttattttccacaaagaccctcgtggaggcgaataacgaacacatggtagaggtaaggactcagttgttgcagccagcggatgagaactgggatcctactggcaccaagaaaatatggcattgcgaaagtaataggtctcacacaactattgcaaagtatgcgcagtaccaggcctcttcctttcaggaatccctgcgggaggaaaacgaaaaacgaagtcaccataaagatcactccgacagcgaatcaacgtcaagcgacaacagcggtaggaggcggaagggcccttttaagaccatcaaattcggtacgaacattgatttgagcgacgataagaaatggaaactgcagttgcacgaactgaccaagctgcccgcttttgtgcgcgttgtgagtgcaggaaacttactctcccacgttggacacaccattctagggatgaatacagtgcagctttacatgaaggtgcctggatcgagaactccaggccatcaggagaataacaatttttgctccgttaacatcaatatcggtcccggtgattgcgagtggtttgttgtcccagagggttattggggggtactgaatgacttctgcgagaaaaataatttaaattttctaatggggagctggtggccaaacctcgaagacctctatgaggccaacgtaccagtttatcggttcatccagcgtcccggagatctggtgtggataaatgctgggacggtgcattgggtgcaggccattggctggtgtaacaacatcgcttggaacgtggggcctctcacagcttgtcagtacaaattggccgtggaacgttatgaatggaacaagctccagtctgttaagtcaatcgtgcccatggtgcacctcagctggaatatggccagaaatatcaaggtgtctgatcccaagttatttgaaatgatcaaatactgtctacttcggacccttaagcagtgtcagaccctgagagaggcccttatcgcggcaggcaaggaaattatctggcacggccgaaccaaagaggaaccggctcattactgtagcatttgtgaggttgaagtgtttgacctgttgtttgtgacaaacgagagcaatagccgtaagacatacattgtacattgtcaagactgcgctcgtaagacttccgggaatctggagaactttgtggtgctagaacagtataaaatggaagatcttatgcaggtgtacgaccagttcacactcgcaccccctctgccgtccgcaagcagctag

SEQ ID NO: 229102 - DNA, 675 bp, Artificial Sequence
  Description of Artificial Sequence: Synthetic coding sequence
taacttcaagcatatatttgtgccgttcagctcgatcacggccatgccgcagcttggatggaccttggaactttatacgaatcttgtaaccagccccaggacgcgatcaaatgttacctgaatgctacacgttcaaaaagctgttccaataccagcgcattggccgcacgcattaaatacctgcaggctcagctgtgcaatcttccccagggatccttgcagaacaagacaaaactgctcccttcaattgaagaggcctggtccctccctatccctgccgagctcacatctcggcagggcgctatgaatacagcccaacagaacacttctgacaattggagcggaggtcacgcagtctcacatcctccagtgcagcaacaggctcattcctggtgcctcactccacagaaattacagatgaggcccactggagtggcccaagtgaggagtaccggcattccaaacggaccaactgcggacagcagcctgccaacaaatagcgtgtccggccagcaacctcagcttgccctgacgagggtacccagtgtctcccagcccggtgttaggcctgcctgccctggccagcccttagcaaatggaccattcagtgctggccatgttccatgctctaccagccgaaccctaggctccacagatacaatactcattggttag

SEQ ID NO: 229103 - DNA, 516 bp, Artificial Sequence
  Description of Artificial Sequence: Synthetic coding sequence
tcgctgcagaataagacaaagttgcttccttcaatcgaggaggcttggtcattacccatcccagctgaacttacaagcaggcagggtgcaatgaacacagctcagcagaatacgtccgacaattggtccggtggtcacgccgtgagccaccctccggtccagcagcaggctcacagttggtgcctgacaccgcaaaaactccagcatttggagcagctcagagcaaaccgcaacaatctaaatcctgctcaaaagctcatgctagagcaactggaatcccagtttgttcttatgcagcagcatcagatgcgccctactggcgtggcacaggtgcgatccacaggaatcccaaatgggccaactgccgacagttcactccctaccaacagcgtgtcagggcaacagcctcagctggccctgactcgggtgccatctgtgtcccagcccggtgtccgacccgcttgccctggccagcccttggcgaacgggccattttgcagaccctgttctctgtag

SEQ ID NO: 229104 - DNA, 4071 bp, Artificial Sequence
  Description of Artificial Sequence: Synthetic coding sequence
atgaaatcctgtggtgtctctctcgccactgccgctgccgctgccgcagcttttggcgatgaggagaaaaaaatggcagccggaaaagctagtggggaaagcgaagaagctagcccctccctgactgccgaagaaagggaggcactgggtgggttggactcaaggctgttcggatttgtgaggttccatgaggatggggctcgcacaaaggcgctgctggggaaggccgtgagatgttatgaaagccttattctaaaagcggagggaaaagtcgagtccgattttttctgtcagcttggtcattttaacctgctcctcgaagactatcctaaagccctctctgcctaccagcggtattattctctgcagtctgattactggaaaaatgccgcatttctgtatggtctgggccttgtgtattttcactacaacgcctttcagtgggccataaaggctttccaggaagtgctttatgtggacccctcattttgccgcgctaaagagatacacctgaggcttggactcatgtttaaagtgaataccgattacgaaagcagcttaaagcacttccagctcgcactggtggattgcaacccctgtacactgtccaatgctgaaatacagtttcacattgcgcacctctacgagactcagcgcaagtatcacagtgccaaggaagcctacgagcagctgctgcagactgagaacttatccgcccaagtcaaggctaccgtgctgcagcagttgggctggatgcaccatactgttgacctcctcggggataaagccactaaggagtcctacgctatccaatacctccagaagtcgctggaggccgaccccaacagcggacagtcatggtattttctgggcaggtgctatagcagcataggtaaggtgcaggacgcctttatcagctataggcagagtattgacaaatccgaggcctccgcggacacgtggtgttccattggcgtgctgtatcagcagcagaaccagccaatggatgccctgcaagcgtatatttgcgcggtacaactcgatcacgggcacgcggctgcatggatggacctgggcaccctgtatgaatcttgcaatcagccacaggacgccataaagtgctacctaaacgcaacacggagtaaatcctgctccaacacctcagctctagcagccagaataaaatacctgcagaacacatctgataactggagcgggggacacgcggtgagccacccccctgtgcagcaacaggctcactcatggtgcctgactcctcagaagctccagcaccttgaacagctgagagccaaccgcaataaccttaatcccgctcagaaattgatgttagagcaattggagagtcagtttgtgctcatgcaacagcaccagatgcggccaactggagttgcccaggttaggagcacagggatccccaatggcccaaccgcagacagcagcctgcctactaattcggtgagcggccagcagcctcagctggctctcacccgcgtgccttcagtgtcacagccaggtgttcgcccagcctgtcccggtcaacccctggcgaacggacccttcagcgccggtcatgttccatgttcaacttcacggactctcggatcaaccgatacaatcctcatcggcaacaaccatattacgggatcgggaagcaacggcaatgtgccatacctacagaggaacgctctgacgttgccccacaatcgcaccaacctcacctcgtctgcggaggagccctggaagaatcagctcagcaacagtactcaggggctgcataagggccagtcttcccattccgcaggaccaaatggggaaagacctctttctagcacagggccttctcaacacctccaggctgctgggtcaggcatccagaatcagaacgggcaccctacattaccctccaactcagttacgcaaggggcagccctcaatcatcttagcagtcacaccgctacaagtggaggtcagcagggcatcactctgacgaaggaaagtaagcccagcggtaatatcctgactgtcccagaaacatcaagacacacaggagagacccccaattctacggcatctgtcgaaggacttcccaaccatgtacatcagatgaccgctgatgcggtgtgctctccctcacatggcgacagtaagtctcccggactactctcttccgataacccacaattgagcgccctgctcatgggtaaggctaacaataatgtaggtacaggaacttgtgacaaagtgaacaacatccatccagcagtgcacactaagaccgacaactccgtggccagctccccctcctctgccatttctaccgccacacccagcccaaagtcaactgaacagacaacgaccaatagcgtcaccagtctgaacagccctcactctggactccatactatcaatggtgaaggtatggaggaatctcagtcaccgatgaagaccgatttgctgctggttaaccacaaacctagtccccaaatcattccgagcatgtccgtctctatttatccgtccagcgccgaggtgcttaaagcttgccggaatctggggaagaatggtctttctaacagctccattctgctcgataagtgtcccccaccacggcctccctcttctccgtacccgcctctcccaaaggataagctgaatccaccgactccctcaatctacctagagaataaacgcgacgctttttttccccctcttcatcaattttgcacgaatcctaacaaccctgtgacagtaatccggggtctagcaggcgcactcaaactggatctgggactgtttagtactaaaactcttgtggaggccaacaacgagcatatggtggaggtgcgcacccaattgttgcagcccgcagatgaaaattgggaccccaccgggactaaaaagatttggcactgcgaatctaacaggtcacacactaccatcgcaaaatacgctcagtaccaggccagcagtttccaggaatctcttagggaagagaatgaaaagaggagtcaccacaaggatcactctgatagcgagtctaccagcagtgacaattcgggacgccgtaggaagggcccttttaagacaattaagtttggtaccaatatagacctgtccgacgacaagaaatggaaattacagctgcatgagttgacaaagcttcccgcatttgtgagagtagttagcgcaggaaacctcctgagccatgtcggtcacaccattctcggcatgaacacagtacaactgtatatgaaagtccccggttctcggaccccaggccaccaggaaaataataatttctgcagcgtgaacattaatatcggaccgggagactgcgaatggtttgtggtgcctgagggttattggggcgtactcaatgacttctgtgagaaaaacaatctgaattttctgatgggctcttggtggccaaatctcgaagacctgtacgaagctaatgtgcccgtgtatcgattcatccagcgacctggcgacctggtctggatcaatgctggtaccgtgcattgggtgcaggccatcggttggtgcaataacatcgcatggaatgtgggcccactcactgcctgccagtataaactggccgtcgagcgctacgaatggaacaaactgcagagtgtgaagagtatagttcctatggtccacctgtcctggaatatggcaaggaacatcaaagtatcggatccgaagctatttgagatgataaaatattgtcttctgcgcactttaaagcaatgtcagactctgcgcgaagccttgattgcagccggaaaagagatcatctggcacggacgaactaaagaagagcctgcacactactgctcaatatgtgaggtggaggtgtttgaccttctgtttgtgaccaatgagtcgaactctcgcaagacatatattgtgcattgtcaagactgtgccagaaagacaagcggtaacctcgagaactttgtagtactggagcagtacaaaatggaagacctcatgcaggtgtatgaccagtttaccttagcaccgccactaccaagcgcaagcagctag

SEQ ID NO: 229105 - DNA, 675 bp, Artificial Sequence
  Description of Artificial Sequence: Synthetic coding sequence
atgaaaagttgtggggtgtccttagccactgcggcagctgccgcagccgctttcggcgatgaagagaagaaaatggccgctggcaaggcatccggggagtcagaggaggcaagtccgtcccttactgccgaagagcgcgaggcccttgggggactcgactcgcgattatttggctttgtgaggtttcacgaggatggcgctagaacaaaggccctgcttggcaaagcggtgcggtgctacgaaagtttgatattaaaagccgaaggaaaagtggaaagcgactttttttgtcaactcggccacttcaacttgctgctggaggattacccaaaggcactgagcgcctaccagcgatattattctctgcagtcagattactggaagaacgccgctttcttgtacggtcttggactcgtttatttccactacaatgccttccagtgggctatcaaagcctttcaggaggttctgtacgtcgatccgagcttctgcagagccaaagaaatccatttgcggctgggtcttatgtttaaggtgaacaccgattacgagtcgtccctcaaacacttccagctcgctttagtcgattgtaatccctgtactctatccaacgccgaaatacagttccacatcgcccatttatacgaaactcaggttggttgcattaccttgtag

SEQ ID NO: 229106 - DNA, 3969 bp, Artificial Sequence
  Description of Artificial Sequence: Synthetic coding sequence
atgaagtcatgtggcgtcagtctagcaaccgccgcagctgccgctgcggcatttggcgatgaggagaagaagatggcagccggtaaggcgtctggcgaaagcgaagaggcaagcccctccctgacggccgaggagcgggaagcattagggggactggactctagactgttcggctttgttcgattccacgaagatggcgctcgtacaaaggctctgttgggaaaggccgtgagatgttacgaaagccttatactcaaggctgagggtaaggtggagtctgatttcttttgccagctgggccacttcaacctcctgttagaggattacccaaaggccttaagcgcgtaccagcggtactattcccttcagagcgactattggaagaacgctgccttcttatacggcttaggactggtgtacttccactataacgcattccagtgggccatcaaggcatttcaggaagtcctttatgtcgacccaagcttctgtagggccaaggagatccatctgcggctcggattgatgtttaaggtcaacactgattacgaatccagtctaaaacatttccagcttgccctggtagactgtaacccctgtaccctgtccaacgcagagatccagttccatatagctcacctatacgaaacgcagaggaaataccactcggccaaagaggcttatgagcagttgcttcaaacagagaacctgtcagcgcaggtgaaagcaacagtcctgcagcagctgggctggatgcatcacacggttgacctgctgggcgacaaagctacaaaggagagctacgcaatacagtatctgcagaaaagcctggaggccgatcccaattccggccagtcctggtattttcttggacgttgttacagctccatcgggaaggtgcaggatgcctttattagctaccgacaaagtatcgataagtcagaggcatctgctgacacttggtgctctattggcgtgttgtaccagcagcaaaaccagcctatggacgccctgcaagcctacatctgcgccgtgcagctggatcatggtcacgcggcagcctggatggatctcggaactctgtatgagtcctgtaatcagccacaagacgcgatcaagtgttatctcaacgccacaagaagcaagagttgctctaacacctcagctctagcggctcgaataaaatatcttcagaatacgagcgacaactggtctggtgggcacgccgtatctcatccacccgtccaacagcaagcccattcttggtgtttgactcctcagaaactacagatgaggcctacgggcgtggcacaggttcgttcaactgggattccgaacggcccaaccgccgattcatccctgcccacgaactcggtcagcggccagcagccgcagttagctctcaccagggtgcccagcgtgtctcagccaggagtgcgcccagcgtgtcctggacagcccttagccaacggtccctttagtgccggtcatgtgccatgcagcacatcaagaacactgggatccaccgatacaatcctaattggcaataaccatatcaccggtagcggctcgaatgggaacgtgccctacttacagcggaacgccctgactctgccgcataaccgcacgaatctgacaagttccgccgaagagccatggaaaaaccagctctccaattccacccagggcctccataagggtcagtcaagccatagtgctggaccaaacggggaaagaccactgagttccacaggtccatctcagcatctccaagcggcaggatccggaattcagaaccaaaacgggcatcccactttgccctcaaactctgtgacccagggtgccgcactcaaccatctttccagtcacacagctacttctgggggtcaacagggaattactctcaccaaggagagtaagcctagcggaaacatactgacagtgcccgagacgtcccgccatactggagagacgcccaatagtacagcttccgtagaagggctgcctaaccacgtgcatcagatgactgccgacgctgtgtgtagtcctagtcacggggatagcaaatcccctggcttactgtcatccgataacccccagctctccgccttactgatggggaaagctaacaacaatgttggtactgggacatgtgataaggtgaacaatatccacccagcagtgcacacaaagaccgacaacagcgtggcaagttccccctcaagcgctatatccactgccacaccatcaccaaagagtaccgagcagaccacaaccaatagcgtgacaagcttgaactccccccactcagggttgcacactataaacggcgagggcatggaagagtcccagagcccgatgaaaacggacctactcttggtgaaccataaaccaagtcctcaaattatcccatccatgtctgtcagtatctacccatcatctgctgaagtgctgaaggcctgcagaaacctcgggaagaacgggctctcgaactcatccattttattggataaatgcccgcctcccagaccacctagtagcccgtaccccccactgcccaaggataaattaaatcctcccacgcctagcatctacctggagaacaagagagacgccttctttcctccactccatcagttctgcactaatcccaacaaccccgtaactgtcattcgcggtctcgctggtgcgctcaaactcgacctgggcctttttagcactaaaactctcgttgaggccaacaacgaacacatggttgaggtccgaactcagctcttgcaacctgccgacgagaactgggatcctaccgggacaaagaaaatctggcattgcgaaagcaatagatcacacactaccatagcaaaatacgcacaatatcaggctagctcattccaggagagccttagggaggagaacgaaaaacgctctcatcacaaggatcacagcgacagtgaatctacaagcagcgataattccggcaggaggcgcaaaggacccttcaaaacaatcaagttcgggacaaacatcgatctgagcgacgataaaaaatggaagctgcagttacacgaactgaccaagctgcctgccttcgtgagagtcgtctcggctggcaacctgctatctcacgtgggacacaccatcctcggaatgaacactgtgcagctctacatgaaggttccagggagcagaacacccggacaccaggaaaataacaatttttgctccgttaatataaacattgggcctggggattgtgaatggttcgtcgtgcctgagggatactggggagtactcaatgacttctgcgaaaagaacaatctgaattttctgatggggtcttggtggccaaatcttgaggacctgtacgaagccaacgttcctgtgtataggtttatacagagacctggcgacctggtttggatcaacgctggaaccgtgcattgggtgcaggcaattgggtggtgcaataacattgcctggaatgtaggacccctgaccgcctgtcagtacaaactggctgtggagagatacgaatggaataagctgcaatccgttaaatctatagtacctatggtacacctgtcttggaacatggccaggaatataaaagtgtccgaccccaagctcttcgagatgattaagtactgcctgctacggactctgaagcaatgtcagaccttgagggaggcacttatcgctgccggtaaggaaatcatctggcacgggaggacgaaagaagaacccgcacactattgttcgatctgtgaggtagaagtcttcgacctgctgtttgtgaccaatgagtcaaacagtcggaagacctacatcgtccattgccaggattgcgccaggaaaacttccggaaacttagaaaatttcgttgtgcttgagcagtacaaaatggaggatctcatgcaagtgtatgaccaattcaccctcgctccgcctttgccctcagcaagttcttag

SEQ ID NO: 229107 - DNA, 5049 bp, Artificial Sequence
  Description of Artificial Sequence: Synthetic coding sequence
atgcaccgggcagtcgacccacctggagcgagggctgctagggaagcattcgctctggggggtctctcctgtgcgggagcttggtcttcttgcccaccccatccccctccaagatctgcctggctccctggcggtaggtgtagcgctagcataggccagccccctctgcccgcaccgctgcctccatctcacggaagttctagtggccacccatccaagccatactacgccccaggtgctcccacgcctcgaccgctgcacgggaagttggagtccctccatggttgcgtgcaggccttactgagagaacctgctcagcccggtctgtgggaacaactcgggcagctttacgagagcgaacacgacagcgaggaggccacgaggtgctaccactccgctctcagatacggtggtagctttgcagagcttggaccccgaatcgggcgtctgcaacaggctcagctgtggaattttcacaccgggtcatgccagcatcgtgccaaagtcctgccaccactggagcaggtatggaacctgctgcatttagaacacaaacgcaattacggagccaagcggggaggcccacctgttaaacgcgctgctgaacctccggttgttcagcctgttcccccagccgcactcagcggcccttctggtgaagaggggttgagccccggtggtaaaaggagacgaggttgtaactccgagcagactggccttcccccaggtctacccctgcctcccccaccattgccccctcctcctcctccccctccaccgcctccgccaccacttccagggttagctacttccccaccattccaactcacgaaaccaggactctggtctacccttcacggagacgcttgggggccagaaaggaaaggtagcgcccctccggaaagacaagagcagcggcactcccttccccatccatacccatacccagctccagcctacacagcccatcccccaggccaccgtctggttcctgcagcccctccagggcctgggccaagaccgcctggcgcagagagccatgggtgtctgcctgcaacaagacctcccggatccgatctccgcgaaagtagagtgcagcgctccaggatggatagttccgtcagccccgctgccacaacagcctgcgtgccctacgccccaagccgcccaccgggactgccagggaccaccacatcctcatctagttcctccagcagtaatactggccttagaggcgtggaaccgaacccaggcatcccaggcgcagaccattaccaaacaccagccctggaagtctcacaccatggcaggttggggccttccgcccactcatcccgtaagccattcctgggagcacctgccgctacacctcacttaagtctgcccccaggacccagcagtccccctcctccgccatgtcctcgattgctcaggccaccaccaccccctgcttggctcaagggtccggcatgtcgagccgctagagaggacggagagatactcgaggagctgtttttcggtaccgaaggcccaccccgacctgctcctccccctttgccacaccgcgaagggttcctcggacctcctgcatctcggttttccgtgggtacacaagatagccatacgccccctacaccccctacacccactacatcgtcgagcaacagcaactcaggttcccatagctcttcacccgctggaccagtttcttttccccctcctccctacttagctcgaagcatagatccccttccgcgtcccccatcccctgctcagaaccctcaagatccgcctctggttccactgactcttgctcttccccctgcccctccatccagctgccatcagaatacctcgggatccttccggagaccagaatctccacgacccagggtcagctttcccaaaacaccggaggtgggccctgggccacctcccggtcctttatccaaggcacctcagcctgtgccccctggcgttggagagcttcctgccagaggccctagattatttgactttcccccaacccccttggaggatcaatttgaagaaccagcagaattcaagatcttaccagacggtctcgctaacatcatgaagatgctggatgagtccattagaaaagaagaggagcagcaacagcatgaggcgggagtggccccacaacccccactgaaggagccgttcgccagtctccagtccccatttcctactgacacagccccaactaccactgctcccgctgtagctgtgacgactactaccacaaccactacaaccacgactgccacccaggaggaggagaagaagccacccccagctctgcctccaccccctccgctggcaaagttcccaccaccttctcagccacaaccacctccaccaccccctcctagtcctgcctctcttctcaagtccctggcatctgttttggaaggtcaaaaatattgctacaggggaacaggagccgctgtgtcaacgcgtcctggccctctgccgaccactcagtattctcctggaccacctagcggggcaaccgctctgccgccaacttctgccgctcctagcgcacaaggatcaccccagccctctgcctcctcgagttctcagttttcaacctctggcggaccatgggctcgggagcgcagagcaggcgaagaacctgtgccgggacccatgactcctacacagccgcctccgccactctcactgccccctgcccgttcagaatccgaagtcctggaggaaatatcacgcgcttgcgaaactctggtggagcgggttggcaggtctgctacggaccccgctgatcctgtcgacaccgccgaacctgccgattcagggacagagcggttactcccccctgctcaggccaaagaggaagccggaggcgtcgccgcagtgagtgggagttgtaagcggagacagaaagagcatcaaaaggagcaccggagacacagacgggcttgtaaagattccgtaggccgaagacccagagagggcagggcaaaggccaaagctaaagtgcccaaggagaagtccaggcgagtgctgggtaaccttgatctgcaatccgaggaaatccagggtagggagaagagtcgacccgacctgggtggagccagcaaggccaagcccccaactgcccctgccccacccagtgccccagcaccaagcgcacagcccacacccccatccgctagtgtacctggcaagaaggcacgcgaggaggcccctggaccccctggcgtctctcgagcagacatgctgaaattgcggagtctgagtgaaggaccacctaaagagctaaaaattcgattgattaaggtggagtctggcgacaaggaaacctttattgccagtgaggtggaggaaagaagactaaggatggccgatctgacaatatcgcactgcgctgctgacgtcgtgcgggcatcaaggaatgctaaagtgaaggggaagttccgagagagttatctctctcctgcccagtccgtaaaacccaagatcaacaccgaggagaaactccctcgggagaaacttaatccccctacgccttcaatctacctggagagcaagcgagacgctttcagccccgtgctgctgcaattttgtacagacccacgtaaccccataaccgtcatcagaggactggcgggatcactgcgactcaacttggggcttttcagcaccaagactctggtcgaagcatccggtgagcatactgtagaggttcggacccaggtgcaacagcccagcgacgagaattgggacctgacaggcacgcggcaaatttggccatgtgaaagctctcggagccacactaccatcgcaaaatatgctcaataccaagcgtccagcttccaggagtccttacaagaggagaaggagtcagaagatgaggaatccgaagaaccagactctacgaccggtacccccccatcctctgcccctgacccaaagaatcatcacatcattaagttcggtactaatattgatctgtccgacgcaaagcgttggaaaccgcaactgcaggaactcttgaagctgcccgcatttatgagggtcacaagcactgggaacatgctgagtcacgtagggcataccattctgggcatgaacactgttcagctctatatgaaggtccccggatccagaactccaggacatcaagaaaacaataatttctgtagcgtgaacattaatattggcccaggtgattgcgaatggtttgccgtccacgaacactactgggagaccattagcgctttctgtgatagacatggggttgattacttgacgggctcctggtggcctatcctggatgacttgtacgcttctaacattcctgtctaccgcttcgtgcagaggccgggagatctggtgtggattaacgcgggaacagtgcattgggttcaggccaccgggtggtgcaacaatatcgcgtggaacgttggtcccctgacagcgtaccagtatcagttggcgctcgaaagatatgaatggaacgaagtgaaaaatgttaagtccatcgtgccgatgatccatgtcagctggaacgttgcacgcaccgtgaaaatatctgacccagatctcttcaagatgataaagttctgtctgcttcagagcatgaagcattgtcaggtccagagagaatctctggtgcgggctggtaagaagatcgcataccagggccgtgtaaaggacgaaccagcatattactgtaatgagtgtgatgtggaggtgttcaacatactgttcgtgacaagcgaaaatggctctaggaacacatacctggtgcattgtgagggatgcgcccgacgacggtcagcgggacttcagggtgtggtcgtgttggagcagtataggaccgaagagcttgctcaggcgtatgacgccttcacactagtccgcgctcgtagggcacgaggacagcgtcggagagctctgggccaggctgcgggaactggatttggatctcctgcagcgccattccccgaaccccctcctgcgttttcccctcaggctcccgcatccaccagccgctaa

SEQ ID NO: 229108 - DNA, 4932 bp, Artificial Sequence
  Description of Artificial Sequence: Synthetic coding sequence
atgcaccgcgcagtggacccccctggcgcacgagcggctcgagaagcctttgctctcggtggcctgtcctgcgccggagcatggtcttcatgccctcctcacccccctcccaggagtgcttggttaccaggaggcaggtgtagtgcctccatcggccagccccctcttccagcgcctctgcccccatcccacggaagctcatccggacaccccagcaagccatactatgcaccaggcgcacccacgccgcgacccctccatggcaagctcgagtccctccatggatgtgtgcaagcgctactcagggagccagcccaaccaggcctctgggaacagctgggtcagttgtatgagtctgaacatgactctgaggaagcaacgaggtgttatcacagcgccctacgatacggtggatctttcgccgagctgggcccaaggatcggtaggttacagcaggcccagctctggaactttcacaccggaagttgccagcatagggccaaggtgctgccaccactggaacaggtttggaatttactccaccttgagcataagcgaaattatggggctaaaagaggaggtcctcctgtgaagagagctgctgaacccccagtggtgcagcccgtgcccccagctgccttatcgggaccgtctggcgaggaaggcctttcccctggaggcaagcgtaggaggggttgcaattccgaacaaacaggcttaccaccgggtctgcctctcccaccgcctcctttgcccccaccacctccaccaccccctccacctccgcctcccctgccagggctcgcaacgtccccaccttttcaactgaccaaacctggtctttggagtaccctccacggtgatgcttgggggcctgagcgcaagggctcagctccaccagaacggcaggaacagagacattcactgccccacccctacccttatcctgcgccagcttatactgcgcacccccctgggcacagactagtgccagctgcgccacctggccctggacctcggccacccggagccgaaagccacggatgcctccctgcaacacgaccacccggaagtgatctgagagaatcgagagtgcagcgttcgcggatggactcgagtgtgtcccctgctgcgactactgcttgcgtcccatacgctcctagtaggcctcccggactgcctggcactaccacctcctcatcatcttcgtcctcttccaacacaggcctccgtggagtggagcctaaccccggaatccctggcgctgatcattaccagacccccgctctggaggtgagtcaccatggcaggctgggccctagcgcccatagctcaaggaagccattcttgggggcacccgctgctactccccacctgtcactcccacctgggccaagcagcccccctccaccaccatgccctcggctgcttaggcctccacccccaccagcatggctgaagggccctgcctgccgcgctgctcgtgaagatggggagatacttgaagaacttttcttcgggaccgaaggccctcctcggccagctccgccaccactgcctcatagggagggcttccttggacctccagcgtccagattctcggtcggtactcaagattcacatactcctcctactccaccaacacctactacatcttccagtaactctaattctggaagccactcctcatcacctgcgggacctgtcagctttccccctcctccctatttggcgcgatctatagatcctctcccacgcccacccagtccagcgcagaacccccaagaccccccattggtgcctttgaccctggcacttcctccggcaccacccagttcttgccatcagaatacttcaggctcattccgtagacctgaatcccctagacctcgagtgagtttcccgaaaacgccggaagtcggccctggccctccaccgggacccctgagtaaagctcctcaaccagtgccacctggcgttggcgagctgcctgcgagaggaccccgtctgttcgatttcccaccaaccccacttgaagatcagttcgaggaacccgctgagtttaaaattctccctgatgggctcgcaaatataatgaaaatgctggatgaatccatcaggaaggaagaggaacagcagcagcacgaagcaggtgtagctccgcagccacccctaaaagagccattcgcttctctgcagtcgccgtttcctactgatactgctcccacaacaaccgccccagccgtcgcagtgactacaacaacaacgacaacaaccacgacaactgctactcaagaggaggaaaagaagccgcctccagcgctgccaccgcctccccctttggccaagtttcctcccccaagccaacctcagcccccacctccccctcctccatctcctgctagtctgcttaagagcctggccagcgtactggaaggacagaaatactgttatcgtggaaccggggctgcagtttctactaggcccggacctctccctacgactcaatactctcctgggcctcctagtggggctaccgctctgccccctactagcgcagctccgtccgcccaggggtcacctcagccttccgcttctagcagctctcagttttccacatccgggggtccttgggccagggaacgaagggctggtgaggagcctgtgcccggacctatgacccctacgcaacccccaccaccgctgtcacttccacctgctcggagcgagagcgaggtgctggaggaaatttctcgtgcttgcgagactctggtcgaaagggtgggcagatcagccactgatccagcggaccctgtggacactgccgagcccgctgactctggaaccgagagactgctcccacccgctcaggccaaggaagaagctggaggggtagcagccgtgagcggatcctgcaaaagaaggcaaaaggagcaccagaaagagcaccgccgtcaccgcagagcgtgtaaggattccgtagggagaagaccccgtgagggacgggcaaaagccaaagccaaagtccctaaggaaaagtcccgacgggtcctcggcaatctcgatctgcagtctgaggaaattcaaggaagagaaaaatccaggcctgacttgggaggcgcttcaaaagctaagccacccacggcccctgctcccccaagcgctcctgccccaagtgctcagcctacaccacctagcgcgagcgttcctgggaagaaggccagagaagaggctcccggaccaccgggagtgagcagggcggatatgttgaaactgcggagcctgagtgaaggaccccctaaggagctaaagataagactgattaaagtggagtctggtgacaaagaaaccttcatcgcgtcggaggtggaggaaaggcggctaagaatggccgatctgactatcagtcactgcgcggctgatgtggtccgagcctcccggaacgcaaaggtgaagggcaagttccgcgaatcttacctgagtcccgctcagagcgtgaaaccaaaaatcaataccgaggaaaagcttccacgggagaaactaaaccccccaactccttccatctacctggaatcgaagagggatgctttctctcccgttctgctgcagttctgcacagaccccaggaatccaataactgtgattcgaggcctcgccggaagcctgcggctcaatctcggtctgttctcaacgaagacacttgtggaggcctcaggcgagcataccgtggaggtcaggacacaggtccagcagccctctgatgagaattgggacctgacaggtacccgccagatctggccctgcgaatcttcaagatcccacaccacaatcgcaaaatatgcacaatatcaggcaagcagctttcaggaatcattgcaggaagagaaagagtccgaggacgaagaatccgaggaaccagactccaccaccggaacaccgcctagctcggctccggaccccaagaaccaccatattattaagtttggcaccaacatcgacttgagcgatgctaagaggtggaagccgcagctgcaggaattacttaagctccctgcatttatgagggttacctctacaggaaatatgctcagtcacgtgggtcatactattctgggaatgaataccgtccagctgtacatgaaggtgcctggttcacgaacacctggtcaccaggagaataacaacttctgttcagttaatatcaatatcggacccggagactgtgagtggttcgctgttcacgaacactattgggagacaatttcagccttctgtgaccgccatggagttgattatctgacaggatcttggtggccaatcctggatgatctctacgcctccaatatccctgtctataggtttgttcagcgcccaggagaccttgtctggattaacgcaggtacagtgcattgggtacaggcaacagggtggtgcaataatatagcctggaatgtgggccctctcacggcatatcagtatcagcttgcgctcgagaggtatgagtggaacgaggttaaaaacgtaaagagtattgtccctatgatccacgtgtcatggaacgtggccaggacagttaagattagcgatcctgacctcttcaaaatgattaagttttgtctgctacagagtatgaagcactgccaagtccagagggagagcctggtcagggcagggaaaaaaatcgcctaccaggggcgagtgaaggatgaaccagcatactattgtaatgagtgcgacgtggaggtgtttaacatcctcttcgtaacctccgaaaatggttcgaggaatacctacctggttcactgtgaagggtgcgcccgacggagaagtgctggattacagggcgtcgtggttcttgagcagtatcgaaccgaggagcttgcccaggcatatgatgcgtttaccctggcccctgccagtacctcgcgttag

SEQ ID NO: 229109 - DNA, 1245 bp, Artificial Sequence
  Description of Artificial Sequence: Synthetic coding sequence
atgcattcccgaggcagagagattgttgtcctactcaatccatggtccatcaacgaagctgtgtcatcttactgtacttacttcattaaacaagacagcaagtcgtttggaattatggtgtcgtggaaaggtatctacttcattttgactctcttctggggctcctttttcgggtcgatctttatgttgagcccttttcttccactcatgtttgtcaacccatcttggtaccgctggatcaacaataggctggtcgccacatggctaacactgcccgtggctttgcttgagaccatgttcggggtgaaggtgattatcaccggagacgcctttgtgcccggtgagcggagcgttatcataatgaatcaccggacaagaatggactggatgttcctgtggaattgccttatgaggtacagctatctgaggcttgagaagatctgcttgaaggccagtctcaagggggtaccgggttttggttgggccatgcaggccgctgcttacatcttcattcataggaaatggaaggatgataaaagtcacttcgaggacatgattgactacttctgcgacatccacgagccccttcagctgctgatttttcctgaaggcactgacctgaccgaaaacagtaagagtcgctcaaatgccttcgccgagaagaatgggttgcaaaaatatgagtacgtcctgcatccacggacaaccgggttcacgtttgtcgtggaccggcttcgcgaggggaagaaccttgacgccgtgcatgacatcactgtggcctacccacacaatattcctcagagcgagaaacacctgctacagggggatttccctagggagattcacttccatgtgcaccgttatcccattgacacactcccgacctcaaaagaggatctacaactttggtgtcataaacgatgggaggagaaagaagaacgactcaggagtttctaccaaggcgagaaaaatttctattttaccgggcagtcagttatacccccatgtaagagtgagttgcgcgttctcgtagtcaagctgttgagcatattgtactggacactattttctcctgccatgtgtttgttgatctacctgtatagcctcgtgaagtggtactttataataaccatcgtcatctttgtgctgcaggagaggatcttcgggggactcgagatcatcgagctggcctgctatagattgctacataagcagcctcaccttaatagcaaaaagaatgaatag

SEQ ID NO: 229110 - DNA, 927 bp, Artificial Sequence
  Description of Artificial Sequence: Synthetic coding sequence
atgcacagtagaggcagggaaattgtcgtcctgctcaacccgtggtccataaacgaagctgttagctcttattgtacctatttcatcaaacaagactccaaaagttttggcataatggtcagttggaaaggtatctacttcattctgactctcttctgggggtccttctttgggtcaatctttatgctaagcccatttctaccactgatgtttgtgaatccttcctggtaccgatggatcaacaatcggctcgttgcaacctggttgactttgcccgtggccctacttgagaccatgttcggcgtgaaagtcattataacaggcgatgcctttgtcccgggagagagaagtgtgatcattatgaaccacagaacaagaatggactggatgttcttatggaattgtcttatgcgctactcctacttacggctggagaagatttgtctcaaggcaagcctgaagggggtcccaggctttggatgggccatgcaggccgctgcttacattttcatccacaggaaatggaaagatgataagtcacacttcgaagacatgattgattacttttgcgacatccatgaaccgctgcaactcctcatcttccctgagggcacggacctcactgagaactcaaagtccaggtctaatgcatttgccgagaagaacggactgcaaaagtatgaatatgtgcttcatccccgaaccacaggattcacattcgttgtggaccgtcttagagaaggtcggaggcaatcagaggggagtaagggccctttacagggggaactgcagatcaccgcacaaggaaatcagcggggacataagcagatggagaagcattcaatgttgatggactggaagaaccaatatcgagagataggtcatactgcacagagtaacctgcagatacagtgctattcgcactag

SEQ ID NO: 229111 - DNA, 927 bp, Artificial Sequence
  Description of Artificial Sequence: Synthetic coding sequence
atgcattccagaggccgagaaatagtcgtgctgcttaatccctggagcatcaatgaggcagtgtccagctattgcacgtatttcattaagcaggatagcaaatctttcggtatcatggtttcctggaagggtatctacttcatactgactcttttctggggatcttttttcggctccatattcatgctgagtccctttctgcctctgatgttcgtgaacccaagctggtacagatggatcaataaccgcctggtggccacctggttgaccctgcccgtcgccctgcttgagaccatgttcggcgtcaaggtgataattaccggagatgccttcgtgcccggtgagcggagcgtgatcatcatgaaccaccggaccaggatggactggatgttcctgtggaattgcctgatgcgttacagctacctccgccttgaaaaaatatgcctgaaagctagcctgaagggggtgccaggcttcgggtgggccatgcaggccgctgcgtatattttcatccatcgcaagtggaaggacgacaagtcacactttgaggatatgatagactatttctgtgatatccacgaacctctgcaactgctcatcttccctgaagggactgatctcacagagaacagtaagtcacggtcaaacgcatttgctgagaaaaacggactgcagaagtatgagtacgttctgcaccctcgaaccaccggtttcacatttgttgtcgacaggttgcgcgagggccgaaggcaaagtgagggctcaaaagggccacttcagggagaactgcagatcacagcacagggaaaccaacgcggtcataaacagatggaaaagcattccatgctgatggattggaagaaccagtatagggaaatcggacacaccgcacagagcaatctacagatccagtgctactctcactag

SEQ ID NO: 229112 - DNA, 1131 bp, Artificial Sequence
  Description of Artificial Sequence: Synthetic coding sequence
atggtatcgtggaaaggcatctatttcattctgactctgttttggggtagcttttttggaagcatcttcatgctgtctcctttcctcccattgatgttcgtgaaccctagctggtaccgctggattaacaacagacttgtagccacctggttgactttacctgtagcattactcgaaacaatgtttggagtgaaagtgatcatcactggagatgcttttgtgcccggtgaaaggagcgtgatcatcatgaaccatcgcactagaatggattggatgttcctgtggaattgtctgatgaggtatagctatctccgcctagaaaagatatgtctcaaagcctcattaaagggggttccaggatttggttgggctatgcaggcggcagcctacatctttatccataggaaatggaaagatgataagagccacttcgaggacatgattgactatttttgcgacatccatgaacctctgcagcttctgatctttcctgagggcactgaccttaccgaaaattccaagagcagatctaacgcctttgccgagaaaaatgggctccagaagtatgagtatgtgctacacccacggaccacaggatttacctttgtggtggaccggctcagagagggcaaaaacctggacgcggtccacgacattacggtcgcttatccccacaatattcctcagtcagagaagcatttgctacagggtgatttccccagggaaattcattttcatgtacacaggtacccgattgatactctgccaacttccaaagaggatctccagctctggtgccataaaaggtgggaggaaaaagaggagaggttaaggagcttttaccagggcgagaagaatttctactttaccggccagagtgtgattcccccatgtaagagcgagctgcgggtgctggttgtgaaattgctgtcaatcctatattggaccctgttctctcccgctatgtgtttactgatttacttgtactccttggttaaatggtacttcatcatcacaattgtgattttcgtgctccaagaacgcatctttgggggactggagattattgagctcgcatgctatcggctcctccacaagcagccccacctgaattccaaaaaaaacgagtag

SEQ ID NO: 229113 - DNA, 993 bp, Artificial Sequence
  Description of Artificial Sequence: Synthetic coding sequence
atggtaagttggaagggcatttattttatcctgactctattttggggttctttctttgggagcattttcatgctcagtccgttcctgcctttgatgtttgttaaccccagctggtacagatggattaataaccggcttgtggctacctggctgacactgccagtagcccttttagagaccatgtttggagtcaaagtcatcatcactggggatgctttcgtgccaggggaacgctcagtcattatcatgaatcatcgtactagaatggactggatgttcctgtggaattgtctgatgcgctatagttatttaagactggaaaaaatatgcctcaaggcaagcttaaagggcgtccctgggtttggatgggcgatgcaagccgctgcttacatttttattcatcggaaatggaaggacgataaatcccactttgaagacatgatagactacttctgcgatattcatgagccgcttcagttactgatctttccagagggcacagacctcactgagaatagcaagtcccggagtaatgcctttgctgagaaaaatggcctacagaagtacgaatacgtgcttcatccgaggaccactgggttcactttcgtggtagataggctgcgcgaagggaagaatcttgacgctgtccacgatattacagtcgcttacccacacaacattcctcagtcggagaaacacttgctgcagggagacttcccacgggagattcatttccacgtgcatagatatcccatcgatactctgccgacgtctaaggaggacctccagctgtggtgccataaaagatgggaggagaaagaggagaggttacgtagtttctaccagggcgagaagaacttttatttcaccggtcagagcgttataccaccctgcaagagtgagcttagagtgctggtggttaagctttacacggtactcgaccctgtacagccttgcaatgttcccacccatatcttcgtacagagttgttag

SEQ ID NO: 229114 - DNA, 462 bp, Artificial Sequence
  Description of Artificial Sequence: Synthetic coding sequence
atgcactcccgcggtcgcgagattgtggtgctgctgaacccatggagcataaatgaagctgtatcaagttactgcacctactttattaagcaggatagcaagtccttcgggatcatggtatcctggaaagggatatattttattctcaccctcttttggggttctttcttcgggagtatcttcatgctgtcaccttttctacctttgatgttcgtaaacccatcatggtacaggtggatcaacaacagactcgtggcaacctggcttactctacccgtggcgttgttggagacgatgttcggagtaaaggtaataataactggtgatgcatttgtgcccggagagcgctctgtcatcatcatgaaccaccggacacgtatggattggatgttcctttggaattgcctgatgagatatagctatctgaggctggaaaagatatgcctgaaagcctcgctttag

SEQ ID NO: 229115 - DNA, 1131 bp, Artificial Sequence
  Description of Artificial Sequence: Synthetic coding sequence
atggtgtcctggaaaggcatctactttatcttgaccctgttctggggcagcttttttggttcaatttttatgctcagcccgtttcttccactcatgttcgtcaacccctcatggtacagatggatcaataaccggctggtggcgacatggctgaccctacctgtggccctgcttgagactatgttcggagtgaaagtgattatcactggtgacgctttcgtaccgggagagcgctcagtgatcattatgaaccaccgcacccgaatggattggatgttcttgtggaattgtctgatgcggtatagttacttacgactagagaaaatatgcttgaaggcttcccttaagggagttcctggattcggctgggccatgcaggcagccgcatatattttcatccatcgcaagtggaaagatgataaatcccacttcgaagatatgatagattacttctgtgatatccacgagcccctgcagctgctgatctttccagaggggaccgatctgaccgaaaattcaaaaagccgctccaatgcttttgctgagaagaatggattacagaaatatgagtacgtcctgcaccctaggaccacaggctttactttcgttgtggacagactgcgggagggtaagaatctggacgctgtccacgacatcaccgttgcatacccacacaacatccctcagagcgagaaacacctattacaaggagactttccacgtgagatccactttcatgtgcatcgataccctattgacaccctcccaacctcgaaggaggacctccagctgtggtgtcataaaagatgggaggagaaggaggagcggctgcgcagcttttaccagggtgagaagaacttctatttcaccggacagtcagttattccgccatgcaagtcagaattgcgcgttctcgtcgtgaaactcctgagtatactgtattggacattgttctcccccgctatgtgtttgctgatctatctttacagcctggttaagtggtattttattataacaatagtaatcttcgtgctgcaagagagaatctttggaggattagagataatcgagctggcctgttaccggcttcttcataagcaaccccacctgaacagcaaaaaaaacgaatag

SEQ ID NO: 229116 - DNA, 1095 bp, Artificial Sequence
  Description of Artificial Sequence: Synthetic coding sequence
atggctgcaatctctacctctattccggtgatctctcagccacaatttactgccatgaacgagccccagtgcttttacaatgaaagcatagctttcttctataacagaagtggaaagcacttggcaacagaatggaacaccgtcagcaagctggtgatggggctgggaataaccgtctgcattttcataatgctcgctaatttactagtgatggtcgccatctatgtgaacagacggtttcatttccccatctattacttaatggccaacctggctgcggcagatttcttcgcagggctcgcctacttttacctgatgtttaacacaggcccaaataccagaagactcactgtgagcacatggcttttgcggcaaggccttatcgacacgtctctcactgccagtgtggccaacctgctggccattgccatcgaaaggcacataactgtgttccgcatgcagcttcacacacgcatgtccaaccgcagagttgtcgtggtaatcgtggtgatttggaccatggccattgtgatgggagccattcctagcgtgggctggaattgcatatgtgacatcgagaattgctcgaacatggcacccctgtactcagactcatacttagtgttctgggccatttttaacctcgtgacctttgtggttatggtcgttctgtatgctcacatctttggatacgtcagacagaggaccatgagaatgtctcgtcacagctctggacccaggaggaatcgtgataccatgatgtctttactcaaaacagtagtgatcgtgctgggcgcttttattatctgctggacccccggtttggtactgctcttactggatgtgtgctgtccacagtgcgacgtcctcgcatacgagaagttcttccttctgttagctgagttcaactccgcaatgaaccctataatttactcgtatcgcgacaaggagatgtccgccacatttagacagattctatgttgccagcgttcggagaatcccaccggtcccacggaagggtccgacagaagcgccagctcattaaaccatactatactggccggtgtgcatagcaacgaccactcagttgtttag

SEQ ID NO: 229117 - DNA, 1095 bp, Artificial Sequence
  Description of Artificial Sequence: Synthetic coding sequence
atggcagcgatttccacctctatccccgtgattagtcaaccccagtttaccgcgatgaacgagcctcagtgtttttacaacgaatcgatagccttcttttataatcggtcgggcaagcatttagcaacagagtggaacaccgtgagtaagttggtgatgggcctggggataaccgtctgcattttcattatgctagctaacctgcttgtgatggtggctatttacgtcaatagacgatttcactttcctatctattatctgatggccaacctggcagctgccgacttcttcgccggtctggcctacttctacctgatgttcaacactggccctaatacaaggaggttgactgtgagcacttggttacttcggcagggccttatcgacaccagcctgacagcgtccgttgctaacttgctcgctattgcaatcgaacggcacattaccgtcttccggatgcagctgcatactcggatgtcaaatcgcagagtcgtggttgtcatagtggttatctggactatggctattgtaatgggtgctattcccagtgtcggttggaactgcatctgcgacattgagaactgctcgaatatggcccctttgtacagtgatagttatctggtattctgggccatcttcaacttagtgactttcgtcgtcatggttgtcttgtatgcacacattttcggatacgtgagacagagaactatgcggatgagccggcattcctctggacccagacgaaatagggatacgatgatgtccctgctgaaaacagtggttattgtcctcggggcatttatcatctgttggactcctggactcgtgctcttgctgttggacgtgtgttgcccacaatgcgacgtactcgcttacgagaagtttttcctgctgctggccgagttcaattctgctatgaacccgatcatctattcatatagggataaagagatgtcggcaactttcagacaaatcctgtgctgccagcgctcagaaaatcctaccggcccaaccgaaggatcagatcggtccgcaagttctttaaatcacactatcctcgcgggagtccactccaacgatcactcagtggtctag

SEQ ID NO: 229118 - DNA, 1095 bp, Artificial Sequence
  Description of Artificial Sequence: Synthetic coding sequence
atggccgcaatttctacatctatccccgtcatctcacagcctcagttcaccgccatgaatgagcctcagtgcttttacaacgagagtattgcctttttctacaatagaagtggaaagcatctggcaacggagtggaacacggtgagcaaactcgttatggggctcgggattacagtgtgcatttttatcatgcttgcgaatcttctcgtaatggtggccatctacgtgaacaggaggttccactttcccatttattatcttatggcgaatcttgccgcagctgacttttttgccggtctggcctacttctacctgatgtttaatacaggcccaaatactaggcgcctgaccgtctccacctggttactacgccagggactgattgacaccagcctaacagctagcgttgccaatctgctcgccatcgcaatagagcgccacatcaccgtcttccgcatgcagctgcacacaagaatgagcaaccggagggtggtggtggtgattgtcgtgatctggaccatggccatcgtgatgggtgccattcccagcgtaggctggaactgcatctgcgatatcgaaaattgctcaaatatggcgcctctgtatagtgactcatatcttgttttctgggcaatttttaacttggtcacattcgtggtgatggttgtgctgtacgcccacatattcggatatgtgagacagagaacaatgcggatgtcccggcactcatctgggccacgacgaaaccgtgacaccatgatgtcgctccttaaaaccgttgtgatcgtcctgggcgcatttatcatttgctggacccctgggctagtgcttttactgttagacgtctgctgtccgcagtgtgatgttttggcttatgaaaagttttttctcctgctggccgaattcaactctgctatgaatcccattatatatagctaccgagacaaagagatgtctgcaacttttagacagatcttatgttgccagagaagcgagaatccgacggggcctaccgaggggtccgataggagcgccagcagcctcaaccacactatcttggctggagtccacagtaacgaccattcggtagtctag

SEQ ID NO: 229119 - DNA, 549 bp, Artificial Sequence
  Description of Artificial Sequence: Synthetic coding sequence
atggccgctatatctacctctataccagtcatctctcagccgcagttcacagcaatgaatgaacctcagtgcttctacaacgagtcaatagcattcttctacaacagatctggaaagcatctagccaccgagtggaatactgtgtccaagctggtcatggggctcggaattactgtctgtatctttattatgctggccaacctgttagttatggtggccatttacgtgaaccgcaggttccactttcccatatactatctcatggctaacctcgcagcagctgatttctttgctgggcttgcgtacttttatctaatgttcaatacggggccaaatacacgccgtcttaccgtatctacctggctcctcaggcaagggctgatagataccagtctgacggccagcgtagccaacctgctagcaattgccattgaaaggcatattactgtattccgaatgcagcttcataccaggatgagtaaccgacgcgtggtcgtggtgattgtagtgatttggactatggcgattgtaatgggtgctattccgtag

SEQ ID NO: 229120 - DNA, 1041 bp, Artificial Sequence
  Description of Artificial Sequence: Synthetic coding sequence
atgaatgagccacagtgcttttataatgaatctatcgccttcttttataatcggtctgggaaacatctggccactgaatggaacaccgtgtctaaactggttatggggcttggaattaccgtgtgtattttcattatgctggctaacctgttagtgatggtggcaatctacgtgaacaggcgttttcattttcccatttactatctcatggctaatctcgccgctgctgattttttcgcgggtttggcttatttctatctgatgttcaatacggggcctaacacaaggcggcttactgtttctacatggttactaagacagggcctgatcgacaccagtttgacggcctccgtcgcaaacttgctcgccatcgccatcgaacgccacatcaccgtgttcagaatgcaactacatacacgaatgtcaaatcggagagttgtggtcgtgatcgtggtcatatggacaatggctatagtcatgggtgccattcctagcgtggggtggaattgcatttgcgacattgagaattgtagcaacatggccccactttactctgatagctatctagtcttttgggctatcttcaatctggttacgtttgtcgtcatggttgtgctgtatgcacacattttcgggtacgttaggcaaaggaccatgcgcatgagtagacactcttcaggaccacgtagaaaccgggatactatgatgagcttactcaagacagtggtcatcgtgctgggcgcattcatcatctgctggacccctgggctcgtgcttttgctactggacgtatgctgcccacagtgcgacgtgctcgcgtatgagaaattttttttgctgttggctgagttcaacagtgccatgaaccctatcatttatagttaccgagacaaagaaatgagcgccacgttcagacaaattctctgttgccagagatccgaaaacccaaccggaccaactgaaggctctgaccgctcagctagcagcctaaatcatactattttagccggagtccatagtaacgatcatagtgtagtctag

SEQ ID NO: 229121 - DNA, 1098 bp, Artificial Sequence
  Description of Artificial Sequence: Synthetic coding sequence
atggaggagggagcccagcggtccggagctctgggagccccacaccagttcacagctatgaatgagcctcagtgcttttacaacgagtccatcgcatttttttataatcgttctgggaaacatctcgccaccgaatggaatactgtgtctaagctcgtgatgggtctggggatcaccgtttgcatattcatcatgctggctaacttgctagtcatggtggctatttacgttaatagaaggttccatttcccgatctactatctgatggctaacttggccgcagctgatttttttgcgggacttgcctatttctatcttatgtttaatacgggaccgaacacgaggagactgactgtcagtacctggctgctgcgacagggactgatcgacacatctctgacagcctccgtggcaaacctccttgccatcgcaatagagcgacatatcaccgtgttcagaatgcagctgcacacacggatgagcaaccggagagtggtggtggtcatcgtggtcatctggacaatggccatcgtcatgggtgcgatacctagtgtgggatggaactgcatctgtgatatcgaaaactgttcaaacatggcgccactatactcagactcatacctcgtgttctgggctatctttaatctggttacatttgtagtgatggtggttctgtacgcccatattttcggctacgtccgacagagaacaatgcgtatgtcacggcattcctcgggaccccgacgcaatagggataccatgatgtccctgctgaagaccgtcgtaatcgtgctcggagcttttatcatctgttggacccctggcctagtgctgctcctccttgatgtatgttgcccccagtgcgatgttctggcatacgagaaattttttttgcttttggccgagtttaacagcgcaatgaaccctatcatctattcctatagagataaagaaatgtcagctacctttcgccagatcttgtgttgccagcggtctgagaatcctactgggccaacagagggaagtgatcgaagcgcctcttccctgaatcatacaatcctcgctggggtgcactccaacgatcactccgttgtttag

SEQ ID NO: 229122 - DNA, 1098 bp, Artificial Sequence
  Description of Artificial Sequence: Synthetic coding sequence
atgcttctgctgctgatccctgctcactctagtgttctagagaatgaatttaccgctatgaacgagccgcagtgtttctacaatgaatccatcgcttttttttataatcgctctggcaagcacctggctactgagtggaatacggtctctaagctggtgatgggactgggcatcacggtctgcatatttatcatgcttgcaaacctcttggtgatggttgctatttacgtcaaccggaggttccattttcccatttactacttgatggcaaatctcgctgccgctgacttctttgcagggctggcttacttctatttgatgtttaacacaggacccaacacccggcgactgaccgtttcgacatggctccttcgccagggtcttatcgacaccagtctcaccgcatctgtggccaacttgctggcaatagccattgagcggcatatcacagttttccgcatgcagttgcatactaggatgagtaaccgcagagtggtggttgtgatcgtcgtgatctggactatggctatagtgatgggggcaatccctagcgtgggctggaactgtatttgcgacattgagaattgttccaacatggcccctctatattctgatagttatctggttttttgggccatcttcaatctagtgactttcgttgtgatggtggtcttgtacgctcacatattcggatacgtcagacagagaacaatgcggatgtcccgccatagctctggaccaaggaggaatagggatactatgatgtccctgctgaaaaccgtcgtcatcgtcctaggtgcatttataatatgctggacgcccggtctggttttgctcctgctggacgtgtgctgtccacagtgcgacgtgctggcctatgagaaattcttcctgctgctggccgagttcaatagcgctatgaaccctataatatactcttaccgcgacaaggaaatgagcgctacttttcggcagatcctgtgttgccagcgctctgaaaaccctacgggacctacagaaggatcggatcggtccgcttcatctttgaatcatactattcttgccggagtccacagtaatgaccatagcgtggtgtag

SEQ ID NO: 229123 - DNA, 1056 bp, Artificial Sequence
  Description of Artificial Sequence: Synthetic coding sequence
atggtgatcatgggtcaatgctattataatgagaccattgggttcttttacaataattctgggaaagaactgagtagccattggcgccctaaggacgtcgttgtggtcgccttaggcctgactgtgtctgttctcgttctgctgacaaacctcctggtgattgcagctatcgcctcaaaccgcaggtttcatcagcctatatattacttgcttggaaatttggctgccgctgatctgtttgccggagttgcttatctgttcttaatgtttcacaccggtccaagaacagcccgactgtccttagagggctggttcctgagacaaggactgttggacacatctttgaccgcctccgtggccaccctgctggccattgcagttgaaaggcaccggtccgtcatggccgtccagttgcacagcaggctcccgcgtggccgtgtagtcatgttgatcgttggagtttgggtggccgctctcggactgggcctgcttcccgcacactcctggcactgtctctgtgccctcgacagatgctcccgcatggctcccctgctgtccaggtcatacttggccgtatgggctctgtccagtcttcttgtgttcctccttatggtggctgtgtacaccagaatatttttttacgtgcggagaagggtacagagaatggctgagcacgtcagttgccacccccgttaccgagagacaaccctgagtctggtgaagaccgttgtgatcatcctgggagcctttgtcgtatgctggacgccgggtcaggtcgtcctcctgttggatggactcggctgcgagagctgcaatgtgctagcggttgaaaaatattttttgctgctcgcagaggccaacagtctggttaatgccgctgtgtactcttgcagggacgccgaaatgcggaggacatttaggcggttactgtgctgcgcttgtctccgccagtcaacgcgcgagagtgtgcattatactagctcagcccaaggcggagcaagtactaggatcatgctgccagagaacgggcatcctctgatggatagcacattgtag

SEQ ID NO: 229124 - DNA, 1056 bp, Artificial Sequence
  Description of Artificial Sequence: Synthetic coding sequence
atggtgatcatgggccaatgctactataatgagaccatagggtttttctacaacaactccggtaaggaactgagttcccactggaggcccaaagatgttgtcgtggtggctctcggcctgaccgtgtccgtgctggtactgttaactaatctattggtgattgccgctatcgcttccaatcggagatttcaccaaccgatatattatctgctgggcaacttggccgctgccgacctgttcgccggtgtggcttatctcttcttaatgttccatacgggaccccgaacagcaagactatccctcgagggatggtttctgaggcagggattgctcgacacctctctcactgcctctgtggctaccctgctcgcgatcgccgtggaacgccatagatcggttatggcagtgcagctccacagtcggttaccaagagggagggtcgtaatgcttatcgtaggcgtgtgggtggcagcccttggtctcggcctcttgccggcacacagctggcactgtctttgtgctcttgatagatgttcgcgaatggcacccctgcttagccgatcatacttagctgtgtgggctctgagctctctcttggtattcttacttatggtggccgtctatacacgtatcttcttctatgtcaggaggcgtgtccagcgtatggcggagcacgtatcatgccatcctcgttatcgggaaactacgttaagtctggttaaaactgtggtgatcattcttggagcctttgtagtgtgttggacccctggccaggtcgtcctactgttagacggcctggggtgcgaatcctgtaatgtgttagctgtggagaagtactttctgctgctagccgaagcaaactcgctcgtcaacgcagctgtctattcatgtagggacgctgaaatgcgcagaacatttagaagactcctgtgctgtgcttgtctgcggcagtccactcgtgaatccgttcactacaccagcagtgcccaaggcggagcctcgactagaattatgctgcccgagaatgggcatcctctgatggattccacactgtag

SEQ ID NO: 229125 - DNA, 1062 bp, Artificial Sequence
  Description of Artificial Sequence: Synthetic coding sequence
atgaatgagtgccactacgacaaacatatggactttttttacaatagatcaaacacagataccgttgacgattggacaggtaccaagctcgtgatcgtgctttgcgtgggcacatttttttgtttgttcatcttcttctctaactcactggtcattgccgctgtgattaaaaatagaaaattccacttccctttttactatctcctggcaaatctcgcggctgccgactttttcgccggaattgcctatgtgttcttaatgttcaacaccgggcctgtaagcaaaacactgacagtgaaccgatggtttctgaggcagggattacttgatagtagtttgaccgcaagcctgaccaatctcttagtcatcgcagtggagaggcatatgtctattatgcgtatgagggtccactctaatttgaccaagaaacgcgttactctcctcattctacttgtctgggcaatcgctatcttcatgggcgcagttccgacactgggatggaactgtctgtgtaacataagtgcatgcagcagcttggccccaatttatagtcgcagttatctggtgttttggacagtcagcaacctcatggccttccttattatggtagtggtgtatctgagaatttacgtttatgtgaaacggaaaaccaatgtgctatcaccacatacgtccgggtcaattagccgcagacggactccaatgaagcttatgaagaccgtgatgacagtgctgggcgcattcgttgtttgctggacccccggtctggtggtacttttactagatggcctcaattgtaggcaatgcggagtacagcatgttaaacgatggttccttctgctagccttgctgaacagtgttgtgaatccgatcatctactcttacaaggatgaggatatgtatgggacgatgaagaagatgatctgctgtttttcccaggagaaccccgagaggcgcccttcccggatcccaagcacagtcctcagtagaagcgacactgggtcccagtacattgaagacagtatttctcagggcgcagtgtgtaacaagtccacatcatag

SEQ ID NO: 229126 - DNA, 1062 bp, Artificial Sequence
  Description of Artificial Sequence: Synthetic coding sequence
atgaatgagtgccattatgacaagcatatggattttttttataataggtccaatacagacacggtagacgattggacaggaactaaattggtgattgtactctgcgtggggacatttttctgtctttttatcttcttcagcaattcactcgtaattgcagctgtaatcaagaatagaaaatttcactttcccttctactacttactcgccaacttagccgctgcggattttttcgcaggaatcgcctacgtgtttctcatgttcaataccggccctgtctcaaaaaccctcacagtcaataggtggttcctgcggcagggactgctcgatagcagtctaactgcttcactgactaatctgctagtgatcgctgtggaacgccatatgtcaattatgaggatgcgagtgcactctaatttgacaaagaagcgagttaccctgctgattctcttagtgtgggccatcgccatttttatgggcgcagtgccaactctcggctggaactgcctctgtaacatcagtgcatgtagctctctggcacccatctattcacggagttacctggtcttctggacagtgagcaatctaatggcattcttaatcatggtggtagtgtacctgaggatttacgtgtacgtgaaacggaagacaaatgtgctgagcccgcacacttccgggagcatttcaagaagacgtacgcccatgaagcttatgaagacagtcatgacggtactgggagccttcgtagtatgttggactcctggtctggtggtgctcttactcgatggtctgaactgtcgccagtgtggcgtgcagcacgttaagcggtggttcttgctgctggcccttctcaactctgtggttaaccccatcatttacagctataaggatgaagacatgtacggaacaatgaaaaaaatgatttgctgtttctcccaggaaaatcctgaaagaagaccgtcccgcataccatcgaccgttctgtcgagaagtgacaccgggtcccagtacattgaagattctatcagtcagggtgcagtctgcaacaagagcacttcctag

SEQ ID NO: 229127 - DNA, 1113 bp, Artificial Sequence
  Description of Artificial Sequence: Synthetic coding sequence
atgggcgaccggaggttcatcgactttcagtttcaggattccaactcctcattaagacctcgtcttggaaatgccactgcaaataatacatgcattgtggacgacagcttcaaatataatttgaatggcgcagtgtattctgtcgtgtttatcctgggcctgatcactaattctgtgtccttgttcgtgttctgtttccgcatgaaaatgagatcagagacagccattttcattaccaatcttgccgtgtccgacctgctgttcgtatgtaccttgccctttaaaatcttttacaacttcaaccggcattggcctttcggggatactctctgtaagatcagtgggaccgcctttctaactaacatttatgggtcaatgctgtttctaacctgtatcagcgtagatcgcttccttgccatagtgtacccatttaggtcacggacgattaggaccaggagaaacagtgccattgtctgtgcaggagtgtggatcttggttctatctggcggaatatcagcaagtctgttctctacaaccaacgttaacaacgctacaactacatgcttcgaagggttttcaaagcgtgtatggaaaacttatctcagcaaaatcaccatcttcatcgaagtcgtgggctttataatccctcttattctaaatgtttcatgttctagcgttgtgctccgaacacttcgtaaacctgcgaccctgtctcagattggcacaaataaaaaaaaggtcctcaagatgattacagtacatatggcagtgtttgtggtgtgcttcgtcccctacaactcagtgctgttcctgtatgctctcgtgcggagccaagcaatcactaattgctttttggagcggttcgccaaaattatgtatcctataacactttgcctggcgacgctaaattgctgcttcgaccctttcatctactacttcacactcgagtcctttcagaagagcttctacatcaacgcacacattcgtatggaaagcctgtttaaaacggagacccctctcaccaccaaaccatctttgccagctatccaggaggaagtctcggaccaaacaacgaataatggaggagaactgatgctggaatccaccttctag

SEQ ID NO: 229128 - DNA, 1113 bp, Artificial Sequence
  Description of Artificial Sequence: Synthetic coding sequence
atgggagaccggaggttcatcgacttccaattccaggattctaacagcagtctgagaccgcgactcgggaacgctaccgcaaataacacctgcatcgtagatgattcttttaagtataacttaaatggagctgtatatagcgtggtattcattcttggcctcataaccaactccgtttccctttttgtgttttgtttccgaatgaaaatgcgatctgagactgccatttttatcaccaacctggccgtgtctgacttgctgttcgtctgtacccttcccttcaagatcttttataacttcaatcgacactggccctttggagacacattgtgcaagatctctggtaccgcattcttaaccaatatctatggcagcatgttatttctgacctgcatatcagtagatagattcctcgctattgtatatcctttcaggtccagaacgatacgaaccagaagaaatagtgccattgtgtgcgccggtgtgtggattctggtcctgagtgggggaattagtgcaagcctgtttagcacaacaaatgtcaacaacgcaacaacaacctgctttgaggggttctcgaaacgggtgtggaagacctatttgagtaaaattacaatttttatagaggtggtcggcttcattatccccctcattctgaacgtgagttgctccagtgttgtgttacgcactctcaggaagcctgcaaccttgtcacagatcggaacaaacaagaagaaggtacttaaaatgatcactgttcacatggctgtgtttgttgtatgtttcgtgccgtacaatagcgtgcttttcctgtacgcactggtcaggagccaggccattacgaactgtttcttggaaaggttcgcaaagattatgtatcctataacgctgtgcctggccaccttgaattgctgcttcgatcccttcatatactactttacattggaatcgtttcagaaaagcttttatatcaacgctcacataaggatggaatccctgtttaaaacggagactccactgactaccaaaccgtctctcccggcaatccaagaggaggtatccgatcaaaccacgaataacgggggagaattgatgttagagagtactttttag

SEQ ID NO: 229129 - DNA, 1119 bp, Artificial Sequence
  Description of Artificial Sequence: Synthetic coding sequence
atgctggctaattctagcagcacaaattctagcgtcctgccatgcccggattataggccaacgcaccggttgcatctggtcgtgtacagcctcgtgctggctgctggcctgccactcaacgctcttgcactgtgggtattccttcgtgccctgcgagtgcacagtgtggtctcagtttacatgtgtaacctagctgccagtgacctgctattcactctgagcctgcctgtgcgtttatcgtattacgcccttcaccactggcctttccctgatttgctatgtcagactactggcgctatattccagatgaatatgtacgggtcctgtattttcttgatgttaataaacgtggatcgttacgctgccatcgtccatcccctcagactccggcacctcaggcgcccacgtgtggctagacttctttgcctcggcgtctgggcactgatcctcgttttcgctgtcccagctgccagagtccacaggccctcccggtgtaggtaccgcgacctggaggtcaggctgtgttttgaaagcttcagtgacgaactctggaaaggaaggcttctccctctggttctgctggcagaagccctcggcttcctgctgcccctagcagccgtcgtgtattcatccgggagggtattttggaccttggctcgacccgacgccacccagtcccagaggcgccgaaaaaccgtcaggctactgctggccaacctggtgatctttctcctctgcttcgtgccttataattccactctggccgtgtacggactgctacgatcaaaactggtcgctgcttctgtgcccgctagggatagggtccggggtgtgctgatggtcatggttcttctggcgggagctaattgcgtcctggatccccttgtttactatttttctgctgaaggattccgcaacaccctccgtggccttggtacccctcaccgagccagaactagcgccacaaacggcaccagagctgcgctggctcagagtgaaaggtctgccgtaactaccgacgccaccaggcctgatgccgcttcgcaggggctcttgaggccttccgattctcacagcttgtccagcttcactcagtgtccacaggatagcgccctgtag

SEQ ID NO: 229130 - DNA, 1119 bp, Artificial Sequence
  Description of Artificial Sequence: Synthetic coding sequence
atgctggccaactcatctagtaccaacagtagtgtcctaccctgccccgactaccggccaacgcacaggctgcatcttgtggtatatagtctggttcttgctgcagggctgcccttaaacgccctggccctctgggtgttcttaagggctctgcgagtgcactccgtggtgagcgtttacatgtgtaacctcgcagcgtcagatttgctgttcacactttccctgcccgtcaggctttcctattatgcccttcaccactggccctttccggacctgctgtgtcagacaaccggggctattttccagatgaacatgtatgggagttgtatattcctgatgctgataaatgttgatcgctatgctgccatagtccaccctctcagactccgccacctgcgccgtcccagggtcgcgaggctgctgtgcttgggagtgtgggctttgattctcgttttcgccgtgcccgcagctcgggttcaccgtccaagtcggtgtcgttaccgagatttggaagtccggctatgctttgagtcattttcagacgaactctggaaagggcgtctgctgccactggtactcctcgcagaggctctgggctttctcctgccactagccgcagttgtgtactcatcaggcagggtgttctggacactcgcccgaccagacgcgacccaaagccagcggagacgcaaaacagtgcgactgctgctggcaaacttagtgatctttctcttatgcttcgttccatacaactcaaccctggccgtgtatggactgcttcgttctaaactggtggcagcttcagttccagccagggatcgggtccgcggtgtgctgatggtaatggttttactggccggagcaaattgcgtcttggaccccctcgtttattattttagcgctgagggcttccgaaacaccttgcggggtcttggcacgcctcatagggcccgaaccagcgctacaaatggaactcgcgctgcgctcgcgcagtccgagagatcagcagtcacaactgatgctactagacccgacgcggctagtcagggcctgctccgtccgtccgacagccactcactcagttctttcacccagtgccctcaggacagcgccttgtag

SEQ ID NO: 229131 - DNA, 1290 bp, Artificial Sequence
  Description of Artificial Sequence: Synthetic coding sequence
atgctggccaattcctcctcaacaaacagttccgtgcttccatgccctgactacagaccaacccaccgtcttcatctggtcgtttactcgctggtattagcagcaggactccctctcaatgcactagccctgtgggtgtttctgcgggctcttcgtgtgcacagcgtggtgagcgtgtatatgtgcaacctcgccgcatctgacttgctgtttactctctcgcttcctgtgcggttgtcatactatgcactgcatcactggccattccctgacctgctgtgtcaaactaccggcgctattttccaaatgaatatgtatggatcttgtatctttctgatgctcatcaacgttgatcgctatgccgcaatcgtgcaccctctgagattacgacacctgagaaggcctagagtcgccagactactgtgtctcggcgtgtgggctttgatactcgtattcgctgtgccagctgcccgagtgcacaggccaagccggtgtcgctatagagacttggaggttagactttgctttgagagcttcagtgatgagctatggaaaggacggttactgcctctcgtcctcttagccgaggctctaggctttcttctgccactggctgccgtagtctattcctcagggcgagtcttttggactttagctcgtccggacgcgacacagagtcagcgcagacgaaagactgtgagactcctccttgctaatctcgtgatctttctgctatgctttgtcccatacaatagcactttggcagtttacggcctcctgagatcaaagcttgtagcagcgtccgttcccgcaagagatcgagtgcgcggagtgcttatggtgatggtcctgctcgcaggcgcaaactgtgtgttggacccgctggtttactacttcagcgctgaaggatttcgaaataccctgcgcggattaggaaccccccaccgagcacgaacgtccgcgactaatggtactcgggctgcgctcgcccaatccgaaagatctgctgttacgaccgacgcaaccaggcctgacgctgcaagtcagggattgttgaggccttccgactcacacagcctgagcagctttacccacgcgatcgctttaagcgtacccgattcacagaggttgagcttctgggaagcctacagggtctatacccaggagggtggattggggacttggacgtttggctggcagtttcagctgagcaacgcagaagaatacaaggtgtggaaacccggtccacgcgagggaagcgccgctggaaacggtttctttaaactgtag

SEQ ID NO: 229132 - DNA, 1605 bp, Artificial Sequence
  Description of Artificial Sequence: Synthetic coding sequence
atgagactgcgaggatgcgggccacgcgctgcaccagctagtagtgcaggggcttcagatgcgaggctgttggcgcctcccggtcggaatcctttcgtccatgaactcagactgagcgctctccagaaagcacaggtcgctctgatgaccttaacactgtttcctgtgagactgctggttgcggctgctatgatgttactcgcttggcctctggctttggtggccagcctcggctccgcagaaaaggagcctgaacagccacctgcactttggcggaaagtcgtggactttctgttaaaagccatcatgagaacaatgtggttcgctggaggctttcatcgggtggcggttaaggggaggcaggcccttcctacagaggccgctatccttactttggctccccactccagctacttcgatgccattccggttacgatgaccatgagctccatcgtcatgaaagctgaaagccgcgacattcccatctggggcacactaattcagtacatccggccagtcttcgtgtctcgttctgatcaggactcacggcgtaagacagtggaggagattaagaggagggcccagagcaacggaaaatggccacagattatgatctttccagaagggacatgcactaatcgaacttgtctcatcactttcaagcccggagcattcatcccaggggctcccgtgcagcccgtggtgcttcgctatcctaataaactggacacgatcacatggacttggcagggtcccggtgcgcttgagatcctctggctgacgctctgccagttccataatcaagtagagattgagtttttgcctgtctacagccccagcgaggaggagaaaagaaaccctgctctgtacgcttccaacgtaagaagggtcatggccgaagccctcggtgtgtccgtgacagactatactttcgaggattgccaactggccctggctgaaggacagcttagattgccagccgacacttgccttctcgagttcgctcgtctcgtcaggggcctgggtctgaaacccgagaaactggaaaaagatctcgacagatattctgagagggcacgaatgaaggggggagagaagattggaattgccgagttcgctgctagcctggaagttccagtctctgacttgctcgaggatatgttctccttgttcgatgaatccgggagcggggaagtggacctccgcgaatgcgtggtggcactgtctgtggtgtgcagacccgctcgaactctggacactattcagctggccttcaaaatgtatggagcccaggaggatggctccgtaggcgagggagatttgtcttgtattctaaagacagccctgggggtggcagagctcactgttactgatctttttagagccatcgatcaggaagagaagggtaagattaccttcgctgacttccaccgattcgcagagatgtatccagccttcgccgaggagtacctgtatcccgatcagacacactttgaatcatgcgcggagacttctccggctcccattcctaatggtttttgcgcagactttagtcccgagaattcagatgcaggacggaagcccgtaagaaagaagctcgactag

SEQ ID NO: 229133 - DNA, 1605 bp, Artificial Sequence
  Description of Artificial Sequence: Synthetic coding sequence
atgcggctccgcggatgtgggccaagggccgcacctgcatcctcggctggagccagcgatgcgagattactggcccctccaggccgtaatcccttcgtgcacgaactgcgactgagtgcccttcagaaggcccaagtggccctgatgactctcactctgtttcccgtgagattactggtcgccgcagcaatgatgctgctggcctggccccttgcactggtcgccagcttggggtccgcagagaaggaacccgaacagccgcctgcactgtggaggaaggtcgtggatttcttgttaaaggccataatgcgcaccatgtggtttgctggaggattccaccgagtggcagtgaagggaaggcaggctcttccaacggaagctgcaatcctgacgctcgcaccccatagctcctacttcgacgctattccggttacaatgacaatgtcctccatagtgatgaaggcagagtccagagatattcctatctggggaacactgattcaatacatccgtcccgtattcgtgagccgctcagatcaggacagtaggaggaaaactgttgaagaaataaagagaagggctcaatcaaatggcaaatggccccagatcatgatcttcccggaaggaacgtgtactaacaggacatgtttgattacctttaagcccggagcctttatacctggtgcgcctgtccagcctgtagtgttgaggtacccaaacaaactggatacaatcacttggacgtggcaaggccctggagctttggaaatactgtggctgaccctgtgtcagtttcataaccaggtcgagattgaatttttgccagtgtacagtccaagcgaagaggaaaagagaaatccggcactgtacgccagcaatgtcaggagagtgatggccgaggcgctgggagtgagcgtgactgactatacatttgaggattgccaattagcgctcgccgaggggcagctccgactgccagctgacacctgtctcctcgaatttgccaggctcgtacgaggactcggccttaaacccgagaagttggagaaggacctcgaccgctatagcgagcgggcaaggatgaagggcggtgaaaagatcggcattgctgaatttgccgcttccctggaggtgccagtgtccgatctcctggaagacatgttctctttgtttgatgaatcaggatctggcgaggtggacctgcgcgaatgtgtggtcgccttgtctgttgtttgccgccctgcccgaactctggataccatccagttagcttttaagatgtacggggctcaagaagatggatctgttggggaaggagatctgtcatgcatcctgaaaaccgctctgggggtggccgaactgacagtcacggatctcttcagagccatcgaccaggaggagaaaggaaagatcacattcgccgacttccaccggtttgcagagatgtatccggcatttgcagaagaatacctgtatccggatcagactcattttgagagctgcgccgagactagccccgctcccatccctaacgggttttgtgcggacttttctccggagaatagcgacgcgggtcgcaagccagtccgcaaaaaactggattag

SEQ ID NO: 229134 - DNA, 1464 bp, Artificial Sequence
  Description of Artificial Sequence: Synthetic coding sequence
atggcaagcagtgcagaaggtgacgagggtactgtggtggccttagccggagtactccaatcaggctttcaagagctgtccttgaacaaactcgcaacaagcttgggggcttcagagcaagcgctgaggctgatcatttccatcttcctgggttatccgttcgctcttttttacaggcactacctgttctacaaggaaacctacctcattcacctgtttcacacttttactggcttgagcatcgcttacttcaacttcggtaaccagctgtaccacagtctgctgtgcatcgttctccaatttcttatactgagacttatggggcgtactattacagcggtcctaactacattttgctttcaaatggcatatctcctcgccggttattattacacagcaacaggcaattatgatatcaaatggacaatgccgcactgtgtcctgacactgaaactaattggccttgccgtggactactttgatggagggaaagatcagaatagcctcagttcagagcagcagaagtatgctattagaggtgtgcctagtctactggaagtcgccggtttctcatacttctacggggctttcctagtgggtccacaattttcgatgaatcactatatgaagctcgttcagggggaactgatcgatataccgggtaagatacctaactcaatcattcccgcattgaagcgcctctctctgggcctgttttacctcgttgggtacactctgctctccccacatattaccgaggattatttacttacagaagactacgacaaccaccccttttggtttagatgcatgtacatgctgatttggggaaagttcgtcttgtataagtacgtcacatgttggctggtgactgagggcgtgtgcattcttacagggctgggtttcaacggttttgaggagaaggggaaagctaaatgggacgcatgcgcaaacatgaaggtatggttgttcgaaacaaatccacgtttcactggaactattgcctcattcaatataaataccaatgcatgggtcgcgaggtatatattcaaacgactgaagttcctgggaaacaaagaactctcccaaggactcagcctgctgttcctggctctttggcacggattgcactcaggctatttagtgtgttttcagatggagtttctgatcgtcatcgttgaacggcaggcagcgagactgattcaagagtcaccaaccctctccaaattggccgcaatcacggttctgcaaccgttttattacctggtacaacaaaccatacactggctgttcatgggctattctatgacagctttctgcctcttcacttgggataaatggctgaaggtgtacaagagcatttactttctcggtcatatattcttcctgtccttgctgttcatcctaccctacatccataaagcaatggtccctaggaaggagaagttaaaaaagatggagtag

SEQ ID NO: 229135 - DNA, 1575 bp, Artificial Sequence
  Description of Artificial Sequence: Synthetic coding sequence
atgagccaggggagccccggagactgggcgccactggaccctacacccggacctccagcatccccgaatccattcgtacacgagctgcatctgtcacgacttcagagagtaaagttctgcctcctgggggcacttctcgcaccgataagagtcctcctcgccttcatcgtactttttttgctctggccgttcgcatggctgcaggtggcaggcttgagcgaagagcagcttcaagagcccatcacagggtggagaaagactgtctgccacaacggggtgctcggtctgtcaagactgctgtttttcttgctggggtttttgaggattagggtacggggacaacgagcatcccggttgcaggcccctgtgctcgtggccgctccccattcaaccttcttcgaccccatagtgctgttaccctgcgacttacctaaggttgtaagccgggctgaaaacctcagcgtacccgtcattggcgcactcttacgatttaaccaagcaattctggtgtcacggcacgatcccgctagccgacgtcgggttgtggaggaggtcagacggagagcaacctcgggcggaaagtggccacaggtcctcttctttcccgaaggtacatgttcaaacaaaaaggctctcctgaaattcaagcccggagctttcattgccggtgtgcctgtgcagcccgtgctgattcgttaccccaactcgctggacacaacctcctgggcgtggcgaggcccaggcgtcctgaaggtactttggctgactgcgtctcaaccatgctctattgtggacgtagaatttttgcctgtctaccacccctcaccagaagagtcccgggatccaacgctgtacgctaacaatgtccagagggttatggcccaggctctgggtatcccagccaccgagtgtgagttcgtgggtagcctcccagtgatcgtcgtaggaagattgaaggttgctttggagccccagctgtgggaactggggaaggttttgaggaaagcgggattgtcagcgggatatgttgacgcaggcgctgaaccaggtcggtctagaatgatctctcaggaggagttcgcaagacaactgcagctgagcgatccgcagactgttgcaggcgcttttgggtatttccagcaagataccaagggcttagttgatttccgggatgttgccctagcactcgccgctcttgatggaggaaggagtctcgaagaattgacgcggttagccttcgaattatttgctgaagaacaggctgaaggaccaaaccgacttctgtataaggatggcttctcaacaatactacacttgttgcttggctccccgcatcctgcagcaactgctcttcatgctgagctctgtcaagccggatcctcacagggactgtcactgtgccagtttcaaaatttcagcctccacgaccctctgtatggcaagctgttcagcacttaccttaggcctccacacacgtccaggggtacttcacaaacccctaacgcttcatcaccaggtaatcccacggccttggccaacgggacggtgcaggcacctaagcagaaaggagactag

SEQ ID NO: 229136 - DNA, 693 bp, Artificial Sequence
  Description of Artificial Sequence: Synthetic coding sequence
atgtgcgggaacaacatgagtacccctttgcctgcaattgtgccggctgctcggaaggccaccgccgctgtgatctttcttcatggactgggagacactggacacgggtgggctgaagcatttgccggtattagaagctcgcatataaagtacatctgccctcatgcccctgtcagacccgtgacactcaacatgaacgttgccatgccaagctggttcgacatcatcggtctcagtccggatagtcaagaggatgagagtggcataaagcaagcagcagagaatataaaagccctgatagatcaggaggtgaagaatggcatcccatctaacagaataatcctgggcggattttctcagggaggggctctctccctatataccgcgctgacgacacaacaaaagcttgccggtgtgactgctttgtcatgctggttgccactgcgggctagcttcccccaggggcctatcggtggcgcaaatcgggacatatcgatcctgcagtgccacggtgattgcgatccactcgtccccctaatgtttggatccctgactgtggagaagctgaaaaccctcgttaacccagccaacgtgaccttcaaaacttatgagggcatgatgcacagctcatgtcagcaggagatgatggatgttaagcagtttatcgacaaattacttcctcctatagactag

SEQ ID NO: 229137 - DNA, 645 bp, Artificial Sequence
  Description of Artificial Sequence: Synthetic coding sequence
atgtgcgggaacaatatgtctacaccactgcctgcaatcgttcccgcagcacgcaaggccactgccgcagtgattttcctgcatggcttgggcgacaccgggcacggatgggctgaggccttcgcaggaattagaagctcgcacataaagtatatctgtcctcacgccttcgatatcatcgggctcagcccagattcccaggaggacgagagcggaataaaacaggctgcggaaaacattaaagccctgatcgatcaggaagtgaaaaacggaatcccttctaaccgcattatcctgggaggcttcagtcagggcggagccttgagcctctacaccgcgctgactactcaacagaagctggccggtgtgacagctctgagctgttggctaccgctcagagcctcgtttccgcagggccctatcggtggggctaatcgagatatctcaatccttcagtgtcacggcgattgtgaccccctggtcccccttatgtttggatctctcactgtcgaaaagctcaagacactagtaaaccccgcaaacgtcactttcaaaacgtacgagggcatgatgcattcctcttgtcagcaggagatgatggacgtcaagcagtttatagacaaattgcttcctccgatcgactag

SEQ ID NO: 229138 - DNA, 1092 bp, Artificial Sequence
  Description of Artificial Sequence: Synthetic coding sequence
atggaattgcatgagagacctgacgaacgacgtaaagctcggaccagtacccaggggaggttgggggattggcgccgtgttcatgcagatgggtttacacatagggtctggagcagctcttcatggcttgaaccggcaatgacctctcggactcgcgtgacttggccgagcccacccagaccattgccagtgccagccgcagccgcagttgccttcggcgcaaagggaaccgatcctgcagaagctcgcagcagtcgcggtatcgaggaggcaggccctagagctcatggcagagcaggccgagagcccgaacgccgtagaagcaggcaacagcgcagaggagggctccaggctaggcgcagtactctccttaaaacatgcgccagggctagggccacagcccctggagctatgaagatggtggccccttggacacgattctattcaaattcttgttgcctgtgctgtcatgtgaggacagggaccattttattaggggtgtggtacctcattatcaacgcagtcgtcctgctgatcctgctttccgctctcgccgaccccgatcaatataacttttcctcttcagaactggggggtgacttcgagttcatggatgatgcaaacatgtgtatcgctatcgcaattagcctattgatgatcctcatctgtgctatggcgacctatggagcttacaagcagcgcgctgcatggatcattccttttttctgttaccagatattcgattttgccctaaacatgttggttgctataacagttttgatctaccccaatagtatacaggaatacattcgccagctgcccccaaattttccatacagggatgatgtgatgagtgttaatcctacttgcctggtcctcatcatactcttgttcatttctatcatactcacttttaaagggtatcttattagttgcgtgtggaactgttatcgttatatcaacggcaggaactcaagcgatgtgcttgtgtacgtcacaagcaatgataccacagtcctgctccctccttacgacgacgcaactgttaacggggcagccaaagaaccccctccaccctatgtgagcgcatag

SEQ ID NO: 229139 - DNA, 954 bp, Artificial Sequence
  Description of Artificial Sequence: Synthetic coding sequence
atgacttctcggactcgtgtgacatggcctagcccacccaggcccctgcccgtacctgctgctgcggctgtggcattcggtgccaaaggcactgacccagcagaagctaggtccagtagaggtatagaggaggccggtccaagagctcacgggagagcgggacgggagccagagagacggcgaagcagacaacaaagaaggggtggactccaggccaggcggtccacattactgaagacttgcgcacgggctagggccaccgcacccggagcaatgaaaatggtggcgccatggacacggttctatagcaattcctgctgtctgtgctgtcacgtgcgtactggcaccattctcctcggggtctggtatctgatcatcaacgcagtggtgcttcttatccttttatctgcgctcgccgatcctgatcagtataacttcagtagctcagagctcggaggtgactttgaattcatggatgatgccaacatgtgtattgccattgcaatctctttgctcatgatcttgatatgcgctatggccacatatggagcatacaagcaacgtgccgcttggattattcccttcttttgctaccagatctttgacttcgcgctgaatatgctggtggcaattaccgtacttatatatcccaacagtatccaggagtatattcgtcaactcccaccaaactttccttacagggacgatgtgatgtcagtcaaccccacctgcctggtcctgatcatcctcttgtttatatcaattattctcacatttaaagggtacttgattagttgtgtttggaattgctataggtacataaacgggcgaaattcctctgatgtgcttgtgtatgttaccagtaatgataccactgttctgttgcccccatacgacgatgccacagttaatggggcagctaaggagcctcctcccccatacgtaagtgcctag

SEQ ID NO: 229140 - DNA, 681 bp, Artificial Sequence
  Description of Artificial Sequence: Synthetic coding sequence
atgaaaatggttgccccttggacccggttttactcgaactcctgttgtctgtgctgtcacgtgagaacgggcacaatccttctgggtgtctggtacctcatcatcaacgctgtggtccttctgatcctccttagcgcccttgccgatccggatcagtataatttctcatctagtgagctcgggggagatttcgaatttatggatgacgcaaatatgtgtattgctatcgcgatctctttactgatgatcctgatttgcgccatggctacatatggggcttataagcagagagccgcatggattattccattcttttgctaccagatctttgatttcgccctcaacatgctggtagctatcacagtgttaatctacccaaatagtatccaggagtacattcggcaactgcctcccaactttccctaccgtgatgatgtgatgtccgtcaatcctacttgtctggttcttataattttgctctttatatcaattattctaacattcaaaggctacctaattagctgtgtgtggaattgctatcgctatataaacggcagaaactcaagcgacgttttggtttacgtgacttctaacgatactacagtgctcctgcctccttatgacgacgcaactgtgaacggggcagctaaggaaccacccccaccttacgtgagcgcatag

SEQ ID NO: 229141 - DNA, 789 bp, Artificial Sequence
  Description of Artificial Sequence: Synthetic coding sequence
atggatccacgactttccaccgttagacagacatgctgttgctttaatgtccggatcgctactactgccctcgctatataccacgtgatcatgtctgtgctcctgtttattgaacactcggtagaggtggcccatggcaaggcgagttgcaaactgagtcaaatggggtatctgcgtattgctgacttgatttcttcctttttactaattaccatgctgttcatcatctcactgtcactgctgatcggggtagtcaaaaatcgcgagaaatacctactacctttcttaagccttcagatcatggattatctgctttgcctgctgactctgcttggatcctatatagagctgcctgcatatctgaagcttgcatctcggagccgggcttcatccagtaagtttccgttgatgactctgcaattgctcgatttctgtttaagcattctgaccttatgtagcagctacatggaagtccctacttaccttaattttaaatcgatgaatcatatgaactacttgccgagccaggaggatatgccgcacaatcagttcatcaagatgatgattattttctctatcgcatttattaccgtactcatatttaaggtctacatgtttaaatgtgtctggcggtgttacagactgattaagtgtatgaacagcgtcgaggagaaacgtaatagtaagatgcttcaaaaggtggtgctgccatcctacgaggaggctctgtcgttgccctctaagacacccgaggggggaccagcccctccaccatattccgaagtttag

SEQ ID NO: 229142 - DNA, 873 bp, Artificial Sequence
  Description of Artificial Sequence: Synthetic coding sequence
atggatccacgtctgtcaacggtgcggcagacatgttgctgcttcaatgtacgcattgccacaacagcactggccatctaccatgtaattatgtccgtcctgctgttcatagaacacagcgttgaggtggcacatggcaaggcatcctgtaaactgtcacaaatggggtatcttagaatcgcagatttaatctctagtttcctcctgattactatgcttttcattatctctctaagcctccttataggcgtggtaaagaatcgcgagaagtatcttcttccatttttgagcttacagattatggactacctattatgtctgctgacgctcctgggaagttacattgagctacctgcctaccttaaactggctagccggtcacgcgcttcatcatctaagttcccattgatgaccctgcagctcctagatttctgtttgagcatcttgactttatgtagctcttacatggaagtacccacctatcttaattttaagtctatgaatcacatgaattacctgccatcacaggaagacatgccacataaccaattcatcaagatgatgattattttttctatcgcttttatcacagtcctcatcttcaaggtctacatgttcaagtgtgtgtggcgttgctatagactgatcaaatgtatgaattctgtcgaagagaaaagaaactcaaagatgctccaaaaggttgtgctgcccagctacgaggaggccctatctcccgctggtccggtgtcttgctcgcagcttgggcaacgctttagactgtctcacagctcagggctgagcataatccaaccaaacaacgcctggttcatcagcatatcctcagatacttgcctggacgactggcctttttag

SEQ ID NO: 229143 - DNA, 11406 bp, Artificial Sequence
  Description of Artificial Sequence: Synthetic coding sequence
atgtccaccgactctaattcactagccagagagtttctgaccgatgtcaatcgcctttgcaacgcagtggtacagcgcgtcgaggctagagaagaggaggaagaggagacacatatggctaccctgggtcagtacctagttcacgggagaggcttcttactacttacaaagttgaatagcataattgaccaggccctgacatgcagggaagagctgctcaccttgttgctgtcactgttgcctctggtgtggaagattcctgtgcaggaggagaaagccactgactttaacctgccattgtctgcagacataatactcactaaggaaaagaacagcagctcgcagagatccactcaggaaaaactacatctggagggctcagcactttctagccaggtctcagcgaaggttaatgtgtttaggaaatccaggcggcaaagaaagattacacacaggtactcagtgcgggatgctcggaaaacacagctcagtacctcagactctgaagctaattcagacgagaaaggcatagcgatgaacaagcatagacgccctcacctgttgcaccattttttgacctcctttcccaaacaggaccaccccaaggcaaaactggatcgtctggcaacaaaggaacagacgcccccagacgctatggcactcgagaattccagggaaatcattccaaggcaagggtctaacacagatattttgtcggagccagctgccttaagcgtgattagcaatatgaataactcccccttcgacctctgtcatgtgctgttatcattgctcgagaaagtatgtaagttcgacgtgacgctgaatcataatagccccctcgctgcctcggttgtacccacgctgactgagttcctggccggttttggtgactgctgttctctgtcagataacttggagagccgcgtggtgtccgccggatggactgaagagcctgttgctctgattcagaggatgctgttccgcaccgtgcttcacctcttgagcgttgatgtcagcacagctgagatgatgccagaaaacctccgaaagaatcttaccgagctgcttagggcagcattgaagatccgtatatgcctggagaagcagcccgatccgttcgccccacgacaaaagaagactttacaagaggttcaggaggactttgtcttctccaaataccggcatagggctctgcttcttccagagctactcgaaggagtcctgcagatcctgatttgttgtttgcagtccgcagcctctaacccattttatttttcgcaagccatggatctggtacaggagtttatccagcaccacggtttcaatctcttcgaaaccgcggtcttacagatggagtggttggttttgagggacggtgtacctccggaggccagcgagcacctcaaggcgctcatcaattcagtgatgaaaatcatgtctaccgtgaagaaggtaaagtcagaacagctccaccatagcatgtgcaccaggaagaggcatcgacgatgtgagtattcgcacttcatgcaccatcatcgggacttaagcggactcctcgtttccgcctttaagaaccaagtgagcaagaatccgttcgaggagactgctgacggggacgtatattaccccgaacgctgttgttgcatcgcagtctgcgcccatcagtgcctccgactcctccagcaggctagtctttcgagcacgtgcgttcagatactttccggggtgcacaatattggaatttgttgttgcatggaccctaaaagtgtgatcattcctctgttgcatgcatttaagctgcccgctctgaaaaactttcagcaacacatcctgaacattctcaacaagttaatcctggaccagttaggaggtgccgaaatatctcctaagatcaaaaaagcagcctgcaatatctgtactgtggactccgaccagctggcacagctcgaagagactttgcagggcaatttgtgcgacgcggaactctcaagctccctgtcttcaccctcctatcggtttcaaggcatcctgccttcaagcgggtcagaggacctgctctggaagtgggatgcgctgaaggcctaccagaacttcgtttttgaggaggaccgcctacactcaatccagatcgctaatcatatttgcaatctcattcaaaagggaaacatcgtggtgcagtggaagctgtataattacatattcaatcccgtgctgcagcggggtgtagagctcgctcaccactgtcagcacttatcagtgacttctgcccagtcacacgtgtgttcccaccataatcagtgtctcccacaggatgtgctccaaatttacgttaagactctgcccattttgctgaaatcaagggtgatccgagacctcttcctaagttgcaatggcgtctcgcaaatcatagagctgaattgcctgaacggcatcaggagccactctcttaaggctttcgaaaccttgatcatctcacttggcgagcagcagaaagacgcatctgtgcctgacatagatggcatcgacatagagcaaaaagagctctcatccgtgcatgtggggacaagcttccaccatcaacaggcctatagtgactcaccacagtcactgtctaaattttacgccggactgaaggaagcctaccctaaacgacggaaaaccgtgaatcaggacgttcacataaacaccattaatctgtttttatgcgtggcctttctatgcgtgtcaaaagaagcggagagcgaccgggagtctgcaaacgactccgaggacacttctgggtacgattcaaccgcctctgagccactcagccatatgctgccctgcatcagtttggagtcactggtgctgccttcccccgaacacatgcatcaggccgcagatatttggtctatgtgtcggtggatctatatgctcagctctgtgttccagaaacagttttacagacttggcggttttagggtgtgtcataaactgatctttatgattatccagaaactgtttagatcccataaagaggaacagggaaaaaaggaaggtgatacatctgttaacgaaaaccaggatcttaaccgtattagtcaacctaagagaacaatgaaagaggacctgctgagcttggccatcaagagtgatcccatccctagcgaactggggagtctgaagaagagcgcggatagccttgggaaattagaacttcaacacattagcagtattaacgttgaagaagtgtccgccacagaggctgctcctgaagaagccaagttgttcacctcccaggagtcagaaacctcattgcagtcaattaggctgttggaggctctgctggccatttgccttcatggggcacggaccagccagcaaaaaatggaactggaactgcctaaccaaaacctgtcagtggagagtattctgtttgagatgcgggatcacctgtcacaatcaaaggtgatcgaaacccagttggcgaaaccgctgtttgacgcactgctccgcgtggccctgggcaactattcagccgactttgaacataacgatgcaatgaccgagaagagccaccagagtgctgaggagctcagctcccagcctggcgatttttcggaagaggctgaagacagccagtgttgctccttcaagctgctcgtagaggaagaagggtacgaggccgactcggaatcgaaccctgaagacggagaaacgcaggacgatggagttgacctgaaatccgagactgagggtttctcagctagctcctctcccaacgacctgcttgagaacctgacacagggggagattatatatcccgaaatttgtatgctcgaactaaacctgctaagtgcatctaaagcaaagctcgatgtgctcgctcatgtgttcgagtccttcttaaagattatccgccagaaagagaagaatgtgttcctgctgatgcagcaggggactgtgaaaaatttgctcggcggattcctttctattttaacccaggacgatagtgattttcaagcctgccagagggtgctggtcgatttgctagtatctcttatgtcctcgagaacgtgctcggaggagctcacattgttgttgaggatcttcctcgagaagagcccgtgtaccaagatacttctcctgggaattcttaagatcattgaaagtgacaccacaatgagcccttctcagtacctgacctttcctctcttgcatgcccctaacctgagcaatggcgtttctagccagaagtatccaggaattctgaattctaaagccatgggcctgttgcgcagggccagggtctcgagatcgaaaaaggaggccgaccgcgaatcgttcccacatcggttactgagttcatggcatatagcaccggtgcatttgccactattgggccagaattgctggccacatctctccgaaggattttccgtgtcactgtggtttaacgttgagtgtattcatgaggctgaatcaaccaccgagaagggcaagaagatcaaaaagaggaataaatcactgatcttgcctgactcctcctttgatggtacggaaagcgacaggccggagggggcagagtacattaatcctggagaacgcctgattgaggagggctgcatccatatcatttctctcggatccaaagccctgatgatccaggtgtgggcagatcctcacaacgccacgcttattttcagagtgtgcatggatagcaacgacgatatgaaggctgtgctgctcgctcaggtggagagccaagagaatatattcctccctagcaaatggcaacacttagttctgacctacctacaacagccgcaagggaagaggaggattcacggcaaaatttctatctgggtatcgggccagcggaagcctgacgtcacactagactttatgctccccagaaaaaccagtctgagcagtgattccaacaagaccttctgtatgatcggccactgtctgagttcccaggaggaattcctgcagctggccggtaaatgggatttaggtaacctactactgttcaacggcgcaaaggttggtagccaggaggcattttacctgtacgcatgcggaccgaaccacacttcagtcatgccttgcaaatacggcaaaccagtgaatgactatagcaaatacatcaacaaggaaattcttcgatgtgaacaaatcagagaacttttcatgacgaaaaaggacgtcgacatagggctcctcatcgaatcactctctgtggtgtataccacatattgcccggctcagtatactatctatgagccagttatcagactaaagggtcagatgaaaacgcagctttctcagcgccctttttcatccaaagaagtccaaagcatactgttggaaccacaccatctcaagaaccttcagcctaccgagtacaaaacaatccagggcattctccacgagatcggcggaacgggcatcttcgtcttcctattcgcgagagtagtggagctgtcctcctgtgaagaaacacaggctctcgctctccgtgtaatcttgtccttaataaagtacaatcaacagcgcgtgcatgaactagaaaactgcaatgggttatcaatgatacaccaggtgctgatcaaacaaaagtgcatagttggattctacatcttgaagaccttgttggaagggtgctgtggagaagacattatctatatgaatgagaacggagaatttaagcttgatgtggatagcaacgccattatccaggatgtcaagctcctggaagagctcttgcttgactggaagatctggtcgaaagccgaacagggagtttgggaaacactactagcagccctcgaagttctgatcagagctgatcatcaccagcagatgtttaacattaagcaacttctcaaggcccaagtagttcatcattttctgctgacgtgccaggtgctacaagagtacaaagaaggacagctgacgcctatgcccagggaggtgtgccgaagcttcgttaagatcatcgctgaagtgctgggctccccccctgaccttgagctattgaccatcatttttaatttcctgctcgccgtgcatccacccacaaatacctatgtttgccataatcccaccaacttttatttctctctacacattgatggaaagatattccaagagaaagttcggtcgataatgtacctgaggcactcatccagcgggggtcggtctctaatgtcgcccggatttatggtcatttccccatccggttttactgcttctccatacgagggcgagaactcaagtaacatcattccacagcagatggccgcacatatgttgagatcacgctcattgcctgctttccccactagtagcctccttacccaatcccagaagctcacaggcagcttgggttgttcaatcgaccgcctgcagaatatagctgacacgtatgttgcaacacagagtaagaagcaaaactccctgggctcttccgacacactgaaaaagggcaaggaagacgctttcatttcatcttgtgagagcgctaagaccgtatgcgagatggaggcagtcttgagcgcacaagtctccgtatccgatgtgccaaagggggtactgggattccccgttgtcaaggctgatcataaacaactcggcgctgagccaagaagcgaggacgattcccccggagacgagagctgcccccgacgacccgattacttgaagggcctggcttcctttcaacgtagtcacagcacgattgcaagtttgggccttgcattccccagtcagaatgggtctgccgctgtggggagatggccctctctagttgaccggaataccgacgactgggagaactttgcgtattctctgggatacgagccaaattacaatcgcaccgcctccgctcactccgtaacagaggactgcctcgtcccgatctgctgcggcctctatgaattgctttcaggagtgctcctgatactcccagacgtgttgctagaggacgtgatggataaattgatccaggccgacaccctcctggtgctggtgaatcacccctctcctgctatacagcagggagtgatcaaactgctcgatgcctatttcgccagggcttctaaagagcagaaggataagttcctcaagaatcggggattctctctcctggccaatcagctgtacctccacagagggacgcaggaactcctcgagtgtttcatagaaatgttttttggacgacacatcggactggatgaagaattcgaccttgaggatgtgaggaatatgggactgtttcagaagtggtcggtgattcccatcttgggattgatcgagacatcactttacgacaatattctcctgcacaatgcgttactgctgttgttgcagattctgaatagttgctctaaagtggccgacatgttactggataatggcctgctgtacgtgctttgtaacactgttgccgctctgaatggcctcgagaaaaatataccaatgtctgaatacaagttattggcttgcgatatccaacagctctttatcgccgtcactatccacgcttgctcaagttcaggttcacagtattttagagtgatagaagatctcatcgtgatgctgggatatctccagaattccaagaacaaaagaacccaaaatatggccgtggccttgcaactgcgggttttgcaggctgccatggagtttattagaacgaccgctaatcatgactctgaaaacctaaccgacagcttgcaaagcccttcagcaccacaccacgccgtggtgcaaaagagaaagtccatagctggccctcggaaattccccctcgcccagacagaatccctgctgatgaagatgaggagcgtggccaacgacgagctccacgttatgatgcagagaaggatgagtcaggaaaatcccagtcaggccactgagactgaactcgcccagaggctccagcgcctgactgtgctcgcagtgaaccgaattatttatcaggaatttaatagcgatataatcgacatcctccggacacctgagaatgttacacaaagcaagaccagtgtgtttcagacagagattagcgaggagaatattcaccacgagcagagctctgtcttcaacccattccagaaagaaatcttcacttaccttgttgagggtttcaaggttagcatcggcagctccaaagctagcggctcaaaacagcaatggacaaaaatactatggtcgtgtaaggagacctttcgtatgcagcttggccgactgctggtgcacattctgtctcctgcccacgccgcacaagagcgtaagcaaatttttgagattgtgcacgagcccaaccaccaagagatcctgagagattgtttatcaccttcattacagcatggagccaagctggtgctctacctgagtgagcttatccataatcatcaaggtgaactcactgaagaggagttaggcacagccgagctcctgatgaacgcattgaagttgtgcgggcataagtgcattcccccaagcgcgtccactaaggctgacctgatcaaaatgattaaagaggagcagaagaagtacgagacagaagaaggggtcaataaggccgcttggcagaagactgtgaacaataaccaacaaagcctcttccagcgcctggattccaaaagcaaagatatatctaagatcgctgcggacatcacacaggctgttagtctgtctcagggcaacgagcgcaaaaaggtgattcaacatattaggggaatgtacaaagtggaccttagtgccagtcgacactggcaagagttaattcaacagctgacccatgacagagcggtgtggtacgacccaatctactacccaacatcctggcagctggaccctacagagggtcccaaccgcgagcgccgaaggctccagcgttgctacctgactattcctaataaatacctgttgagagatcggcaaaagtcggaagatgtggtaaaacctcccctcagttacctgttcgaggataaaactcattcctctttcagctccactgtgaaggacaaggccgcaagcgagtccatccgtgtgaataggcggtgtatatccgtagcaccgtcacgcgaaaccgcgggagaactgctgctgggtaagtgtggaatgtattttgttgaggacaacgccagtgatactgtggaaagcagttccctccagggggagctcgagccagcttccttctcatggacctacgaggagatcaaagaagtacacaaacgctggtggcagttgcgcgataacgcggttgagatttttctaactaacggtcggacgctgctcctcgcttttgacaataccaaggtgagggacgacgtttaccacaacattttaaccaataacctgccaaatctcctggagtacggcaatatcacagctcttacgaatctgtggtataccggccagatcacaaactttgaatatcttactcacctcaataagcatgccggacgaagtttcaacgacttaatgcagtaccccgtctttccgtttatactggctgattatgtatcggaaaccctcgatctgaacgacctgttaatataccgaaatctgagcaagcccattgccgtacaatacaaagagaaggaagacagatatgtggacacttataagtatctggaagaagaataccggaagggtgcacgggaagatgaccctatgcctcctgtgcagccctaccattatgggtctcactattcaaactcggggacagtgctccacttcttagtgcgtatgccgccattcacaaagatgttccttgcctatcaggatcagtcatttgacattcccgatcgcacttttcactcaacgaataccacctggaggctcagttcattcgagtcgatgactgatgttaaagaactcatacccgagttcttttacctgcctgaatttctggttaaccgggagggctttgatttcggcgtgcgccagaacggcgagcgcgtgaatcatgtcaacctgcccccatgggctaggaacgacccaagactttttattctcattcaccggcaggcactcgaaagtgactacgtgtcccagaacatctgccagtggatcgacttagtcttcggctataaacagaagggcaaggcctctgttcaagcgatcaacgtctttcatcccgctacatattttggtatggatgttagtgcagtcgaggatcctgttcagcggagagccttagagactatgatcaaaacatacggtcagacgcccaggcaactattccatatggctcatgtgtcccgacctggcgctaaactgaatatcgagggcgagctcccggcagcagtagggctattggtacagtttgcttttcgcgagaccagagaacaggtgaaagagatcacatatccgtcacccctaagctggataaagggcctcaagtggggcgagtacgtggggtctccctcagcccctgtccctgtcgtgtgcttctctcagccccatggcgagcggttcggctctttacaggccctgcccacaagggcgatatgcggactgtcaaggaatttttgtctgcttatgacctattcgaaagaacaaggcgtgcgcagtatgaatagtacagacatccagtggagcgctattctgtcctggggatatgccgataatatactgagactgaagagtaagcagagcgagcccccagtgaatttcatccaatcttcacaacagtaccaggttacctcctgcgcttgggtccctgatagttgtcagctcttcacggggagtaaatgtggcgtcattacagcctacaccaatagattcaccagctccacaccttctgagattgagatggagactcaaatccatctctacggtcacacggaagagatcacttcgcttttcgtatgtaagccctactccatactaatcagcgtgtcgcgggacgggacctgtataatttgggatctgaatcgactgtgttacgtgcagtcattggccggacataagtctcccgtgacagccgttagcgcatccgaaaccagcggcgatattgctacagtatgcgattctgccggaggcggttccgacctccgactgtggactgtcaatggcgatcttgttgggcacgtgcattgtcgagagattatttgtagcgtggctttcagcaaccagccagaaggagtgtccatcaacgtcattgcaggaggtttagagaacggaatcgtacggctgtggagcacgtgggatctgaagcccgttagagagattacttttcccaaatctaacaagcccattatttctcttaccttttcttgtgacggccaccacctgtacacggctaactccgatggaactgtgattgcttggtgtcgcaaagaccagcagcgtttgaagcagcccatgttctacagttttttgtcctcgtacgccgctggctaa

SEQ ID NO: 229144 - DNA, 11406 bp, Artificial Sequence
  Description of Artificial Sequence: Synthetic coding sequence
atgagcacggacagcaacagccttgcccgagaatttctcacggatgtgaaccgcttgtgcaatgctgtcgtgcagcgggttgaagctcgagaagaagaggaggaggagacacacatggcgaccctcggccaatacctcgtgcacggtcgcggattcctgcttctcaccaagctgaactccattatcgaccaggcactcacttgccgggaagagctactcaccttacttttgagcctccttccactggtttggaagatccctgtgcaggaggagaaagccacggattttaacctgcccctgtccgccgacataatccttacgaaggagaagaatagcagctcgcagcgttccacacaggaaaaactgcacctggagggatctgcacttagctcccaagttagtgccaaagtgaacgtcttcagaaagtcccgcaggcagagaaagatcacacaccgctatagcgtgagggatgccaggaagacccagcttagcacttccgactctgaggcgaactcagacgagaagggaatcgcgatgaataagcaccgacggcctcacctgctgcatcactttctgacttccttcccgaaacaggaccaccccaaagccaagttggatcggctggcgaccaaggaacaaactccgccagacgcgatggcactagagaattcccgcgaaatcatccccaggcagggtagcaatactgatatcctcagtgagccagctgcactttccgttataagcaatatgaataattctccatttgacctttgccacgtgttgctgagcctgctggagaaagtgtgcaagtttgatgtgacccttaatcataattcccctctcgcggctagcgtcgtgcccactctgacagaatttctggcgggatttggggactgctgttcccttagtgacaacctggagagcagagtggtgtcggccggatggactgaggaaccggttgcgctaattcaacgaatgctgtttaggactgttttgcacctcctgagtgtggacgtgtcaactgcggagatgatgcccgagaatctgagaaagaacctgaccgagctgctaagagccgcattgaaaattcgtatatgcttagagaaacagccagatcctttcgcaccaaggcagaaaaaaacgctgcaggaagttcaggaggattttgtgttttccaaatatagacatagggctctgttactgcctgagctgctcgagggcgtccttcaaattctgatctgctgccttcagagcgccgcttccaaccccttttattttagtcaggctatggacttggttcaggaattcatacagcatcacggcttcaatctgtttgaaacagcagttcttcagatggaatggcttgtcttgcgagatggggttccgcctgaagcctcagagcacctgaaggctttaatcaactccgtgatgaaaattatgtccacagtgaagaaagtgaaaagtgaacagttgcatcattccatgtgtacccgtaagcggcaccgcagatgtgaatacagccactttatgcaccatcatagggacctctctgggctgctggtctctgctttcaagaatcaagtctctaagaaccctttcgaagaaacagccgatggtgatgtatactacccggaacgatgctgctgcattgccgtatgcgcccatcagtgcctgaggcttctccagcaggcgtccttaagcagcacctgcgtgcagatcctgtcaggcgtgcacaacattggaatttgttgctgcatggacccgaagagcgtcatcatacccttgcttcacgccttcaagctgccagctttgaagaactttcagcaacacatcttaaatatcctgaataagctgattctcgatcagctgggaggcgcagaaatctctcccaagattaagaaggccgcttgcaatatctgcaccgtggacagcgaccagctggcccagctcgaggaaacattgcaggggaatctttgtgacgctgaactgtcatcttccctgtcttctccatcctaccgattccaaggcatcttgccatcctccggctccgaggatctactttggaaatgggacgcactgaaggcatatcaaaacttcgttttcgaggaagatcgactacatagcatccagatagcaaaccatatttgtaacctgattcagaaaggaaacattgttgtgcaatggaaactctataattacatttttaaccccgttctccaaagaggcgtggaacttgcgcatcactgtcagcatttatctgtgacttctgcccagtcacatgtgtgtagtcatcataatcagtgcttgccccaggacgttctgcagatttatgtcaaaacgttgccgattttgctgaagtcaagagttatccgcgacctgtttctgtcttgtaatggggtgtcccaaattattgaacttaactgcctgaatggaataaggtcacatagcctgaaggccttcgaaaccctgatcatcagtctcggggaacagcaaaaggatgcctcggtacctgacattgacggaattgatattgaacaaaaagagctgtctagcgtacacgtggggacctcatttcatcatcaacaggcctactccgattcaccccagagcctttccaagttctatgctggcctgaaggaggcttatcccaaacgtaggaagactgtcaaccaggacgtgcacattaatacaattaatttattcctttgcgtggcttttctgtgcgtgtccaaagaggctgagagcgatagagagtcagcgaatgactctgaagacacctccggctatgacagtaccgcatcggagccgcttagtcacatgctgccttgtatttcactggaatcacttgttctgccttcgcctgagcatatgcaccaagccgcagacatatggagcatgtgccgctggatctatatgctatccagcgtctttcagaagcagttttaccgcttgggaggatttagagtttgccacaaactcattttcatgatcatccagaagctgttccgctcccacaaggaagagcagggcaagaaggagggggacacgagcgtgaacgaaaaccaggatctcaatcggatctctcaaccaaaacggactatgaaggaggatctcctttccctggctatcaagtccgacccgatccctagtgaactcggcagtctgaagaagtctgccgacagtctgggcaagcttgaattgcaacacatcagctcgataaacgtggaggaggtgtcggccacagaggcagcccctgaagaagcaaagctgttcacatcccaggagtctgaaactagcctgcaatctatacgcctcctcgaggctctgctggcaatttgtctccatggagcacgaacttcccagcagaagatggagctggaactgccgaaccaaaatttgagtgtcgaaagtattttatttgagatgcgagatcacctgtcacaatcaaaagttattgagactcaactcgctaagccactgtttgatgctctgctcagagtggcgctcggcaattacagcgcagacttcgagcacaatgatgctatgacagagaagagtcatcagtccgccgaagaactttcctctcagcccggagactttagcgaggaggccgaggactctcagtgttgtagtttcaagctgctggtcgaagaggaaggttatgaagccgacagcgaatctaaccccgaggatggtgagacgcaagacgatggtgtagacctgaagagcgagacagaggggttctctgcctccagcagtccgaacgatttgctagagaatcttacccaaggagagatcatttaccccgaaatttgtatgttggaacttaacttgctttcagctagcaaagcaaaacttgatgtcctagcccacgtcttcgagagttttcttaagatcatccgccaaaaggaaaaaaacgttttcctccttatgcagcaaggcacagtgaaaaatctactgggtggctttctgtccatcctgacgcaggacgatagtgacttccaggcatgtcagagagtcttagtggacctgctggtatcattgatgtcaagtagaacttgcagtgaggagctcaccttacttctcagaatttttctagaaaaatccccctgcaccaagatcttacttctgggaatccttaagattattgaatctgataccacgatgagcccatctcaatatttaactttccctctgttgcacgctccgaacctaagtaatggggtgtcgtcgcagaagtatcccggtattctgaatagcaaggccatgggtctgttgagaagggccagggtgtccagatccaaaaaagaggcggatagggaatcattccctcatcgcttgcttagcagctggcacatcgcgccagtccaccttccccttctgggtcaaaactgttggcctcacctgtccgagggtttcagcgtgtccctgtggttcaatgtggagtgtattcacgaggccgagagtacgacagagaagggaaaaaagatcaagaagcggaataaaagcttgatacttccagattcatcgttcgacggaacagaatccgaccggcctgaaggtgctgaatacataaatcctggcgaacggctgatcgaggagggctgtatacatattatcagtctcggaagcaaagcactcatgattcaggtctgggccgacccccacaatgctactttaattttcagagtttgtatggacagcaatgacgacatgaaagctgtactgctggcccaggtggaaagccaagaaaacatctttcttccatcaaaatggcagcacctagtgctgacgtatctgcaacagcctcaaggcaaacggagaattcatggtaaaatttcgatatgggtctcaggtcagagaaaacccgacgttactctggactttatgctgcctaggaagacatccctgtctagcgacagtaataaaaccttttgcatgatcgggcattgcctgtcctcacaggaggagttcctgcagttggccggtaagtgggacctgggcaacctgttactttttaacggggctaaagtgggaagccaggaagcgttttatttgtacgcctgtgggccaaatcatacatccgtgatgccttgtaaatacgggaaacctgtgaacgattactctaagtacatcaataaggaaatcctgcgctgcgagcagattcgggagttgttcatgaccaaaaaggacgtcgatatcggcctgctgatagagagtcttagcgtggtgtacaccacgtactgccctgcacagtacaccatttatgagcccgtgatcagactcaagggccagatgaaaacacaactttcccaacgacccttctccagcaaggaagttcagagcatcctgctggaaccccaccacctgaagaatctgcagccgacagagtacaagacgattcagggtatattgcatgaaatagggggaacggggatattcgtcttcctttttgcccgtgtagtagagctgagcagctgtgaggaaacccaagcccttgccctgagagtcatcctcagcttaattaagtacaaccagcagcgcgtccacgaactcgagaattgtaacggcctgtccatgatccatcaggtgttaatcaagcaaaagtgcattgtcggcttctacatacttaagaccctgctggagggatgttgcggcgaggatatcatttatatgaatgaaaatggggagttcaaattagatgtggactctaacgccattatccaggacgtaaagcttttagaggaattgctgctggactggaagatctggagcaaggccgagcagggggtgtgggagaccctgttagcagctttggaggtattaatccgggcagaccatcatcagcagatgtttaacatcaaacagctgctaaaggcacaggtggtccatcactttctccttacttgtcaggtgttgcaggagtacaaagaaggtcaactgactcctatgccaagggaggtctgccggtcctttgttaaaatcattgccgaggtgctgggttctccacccgacctggaattgctgaccatcatctttaacttcctgctggcagtgcacccacctactaacacttacgtctgccacaatccaacgaatttctacttcagcctgcatattgacggcaaaatatttcaggagaaggtgcgaagcatcatgtaccttagacattccagtagcggcggtagatccctaatgtctccaggtttcatggttatctccccttcagggttcaccgcctcaccctatgaaggcgaaaatagtagcaatataattccgcaacagatggctgcccacatgttgaggagccgtagtttgcccgcattccccactagttcactgctgacccaatcccaaaagttaaccggatctctaggctgcagtatcgatcggctccagaacattgcggacacctacgtagcaactcagagcaagaagcagaactccctgggctcctcagacaccctgaagaagggcaaagaggacgccttcatctcttcctgcgagagcgccaagactgtctgcgaaatggaagcagttctctcggcacaggtgtccgtaagcgatgtccctaagggagtgctcggattcccagtggtgaaagctgatcacaagcagttgggcgctgagcccaggtccgaggatgactcaccaggtgatgagtcctgcccacggaggcccgattatctgaaaggcctggctagttttcagcgcagtcactcaaccattgctagcttggggctcgcctttccatcccaaaacggcagcgcggctgttggaaggtggccctccctcgtggatagaaataccgatgactgggaaaacttcgcatactctcttgggtatgagcctaactataacagaacagcttccgcccattccgtcaccgaggactgcctggtacccatttgttgtggtctctatgagctgctgagcggggttctgctcattcttcctgacgtgctgctggaggatgtgatggacaagctgatccaggccgataccctgttggtgctagtgaatcacccaagcccagctatccagcagggagtgatcaaactcttggatgcctactttgcccgtgctagcaaggagcagaaagacaagttcctgaaaaaccgtggcttttctttgctggccaaccagctgtatcttcatcggggaacacaggaactgttagagtgttttatagaaatgttcttcggccgacacattggcctggacgaagaatttgatttagaggacgtacggaatatgggcctattccagaaatggtcagtgatccccatactgggactaatcgaaacatcgctgtacgacaacattctactgcataacgcactacttctactgttgcaaattttgaatagctgtagcaaggttgccgatatgctcttggataatggccttctgtatgtgttatgtaacacagtggccgcactaaacgggttagagaaaaacatacctatgtctgagtacaagctcctggcctgtgacatacagcagttgttcatcgcagtaacaatccatgcctgctcctcatctggatcccagtacttccgcgttattgaggacttgatcgtcatgttggggtatctccaaaattctaaaaacaagcgcacacagaatatggcagtcgctcttcaattgagagttctccaagctgctatggagtttattaggactaccgctaatcatgacagtgaaaacctcacagactctctacaatccccctcagctcctcaccacgccgtggttcagaaacgtaagagcatagccggacctagaaagtttcccctggcgcagaccgagtcattgctgatgaaaatgagaagcgtcgctaatgatgagctgcacgtgatgatgcagagaaggatgtcccaggaaaaccccagccaggccaccgagaccgaactggcgcagagattacagcgcttaacagtgctcgcggtcaatcgaatcatatatcaagagtttaacagcgacatcatagatattctcagaacccctgagaatgtgacacagtcgaaaactagcgtgttccaaactgaaattagcgaggaaaatatacaccacgagcagtccagcgtattcaatccattccaaaaagaaatcttcacctacctggtggaaggattcaaagtcagcattggctcttctaaagccagcggctccaagcagcagtggacaaaaatactctggagctgtaaagaaaccttccgtatgcagctggggcgactccttgtgcatatcttatctcctgcccacgccgctcaggaaagaaaacagatattcgagatcgtacatgaaccgaaccatcaggagatcctgcgagattgtctgtctccaagtctgcaacacggcgcaaaactggttctttatctgtcagaactcatccataaccaccaaggggagctgaccgaggaggagttggggaccgcagagctactgatgaacgccctgaaattatgcggtcacaaatgcatcccacccagcgccagcacaaaggccgatcttattaaaatgatcaaagaagagcagaaaaaatacgagaccgaggaaggtgtgaataaggcggcttggcagaagacagttaacaacaaccagcagtcattgttccagagactggacagcaaaagtaaagacatctcaaaaatagctgccgatatcacacaagcggtaagcctgtcccaggggaacgagcgcaaaaaggtaatccaacacataaggggaatgtataaggtggatttgtcagcttctagacactggcaggaactaatacagcagctgacacacgatagggccgtgtggtacgaccctatatattatcctaccagttggcagctggatccaactgagggacctaacagggagcggaggcggttgcaacggtgttacctgaccatccccaataaatatcttttacgcgacagacagaagtcagaagacgtggtgaaacctcccttgtcctatctgtttgaggacaagacgcatagcagcttttcaagcaccgtcaaggacaaggcagcgagcgagagcattagggttaatagacgctgcatatcagttgcacccagtagggagacagccggtgaactattgctggggaagtgtggaatgtattttgtggaggacaatgcctccgacaccgtggagtcatcatctttgcagggcgaacttgaaccagcctcctttagttggacatatgaagaaattaaggaggtgcataagaggtggtggcagctgcgagacaatgccgtcgaaatcttcctcacaaacggacggacacttctcttggcatttgataacacgaaggtccgggatgacgtgtatcataatatcctgacaaacaatttaccgaatcttcttgagtacggcaacatcactgccttgaccaacctgtggtatacgggacagatcaccaacttcgaatatctgacccaccttaacaagcacgctgggcgtagctttaacgacctcatgcagtacccagtgttccctttcatcctggccgactatgtcagtgagacactcgatctgaatgaccttctcatttaccgcaatttaagcaagcccatcgcagtgcagtacaaagaaaaagaggataggtacgttgacacttacaagtacttagaagaagagtatcgcaagggtgccagggaggatgatcctatgcccccagtacaaccgtatcactacggctcgcactattcaaactcaggaactgttttacactttctggtgcggatgcctccattcactaaaatgtttctagcctaccaggatcaaagttttgacatccctgataggaccttccactctacgaatactacttggaggctctcatcgttcgagagcatgacggatgtcaaggaactgattccggagttcttttacctgccagaattcctcgttaaccgcgagggcttcgattttggcgtgcgacaaaacggagagagggtgaaccacgttaatctgcccccttgggccaggaatgatccacgactgtttatcttgattcatagacaggcactggagtccgattacgtcagccagaacatatgtcagtggatcgatctagtgttcggctacaaacagaagggaaaagcatccgttcaggccattaatgttttccacccggcaacctacttcggcatggacgtttcagccgtcgaggatcccgtgcagaggagggctcttgagaccatgataaagacttacggccaaacccctagacagctttttcacatggcgcatgtgagcagacccggtgccaaactgaacattgagggcgaacttccagcagctgtgggactgctcgtgcagttcgccttccgcgagactagagagcaggtcaaggaaattacttatccatcccccctttcttggatcaaagggcttaagtggggcgagtacgtgggttccccgtcagcacccgttcccgtcgtctgcttcagtcagcctcatggcgaaaggttcggtagcctccaggccctgccaacaagggctatctgtggactctcgcgtaacttctgcctgctgatgacctactcgaaagaacaaggcgtccgatcaatgaacagcacagatatccagtggtccgcaatcctctcttggggctacgccgataacatcctgaggctgaagtcaaaacagtcggagcccccagtaaattttatccagtcttcacaacaataccaggtgactagctgcgcatgggttccggacagttgtcagctcttcactggttcaaagtgcggagtgattaccgcatatacaaacagattcacttcctctacaccctctgaaattgagatggaaacccaaatacatttgtatggccatacagaggagattacaagtctctttgtgtgcaaaccctacagcattcttatctccgtctcacgggatggtacttgtatcatctgggaccttaatcgactgtgctatgtgcagtccctcgccggacataaatcacctgtgactgcagtgtccgcatccgagacgagcggagacatcgctaccgtatgcgattctgctgggggaggcagcgatctgcggctttggaccgtcaacggggatcttgttggacacgtgcattgccgcgaaatcatttgttccgtcgcattctcaaaccagccggaaggcgtgagcatcaatgtaatcgcgggaggactggaaaacggcatagtcagactgtggagtacgtgggacctcaaacccgtgagggagattacctttccgaagtccaacaaaccaattatttctttaacattctcctgcgatgggcaccatctgtataccgctaactcagatggtactgtgatagcttggtgtcgcaaggaccagcagcgccttaagcagcctatgttttactcatttctgtccagctatgcggcaggctac

SEQ ID NO: 229145 - DNA, 4149 bp, Artificial Sequence
  Description of Artificial Sequence: Synthetic coding sequence
atgtccacagacagtaatagcctcgctagggaatttctgaccgacgtgaaccgcctttgtaacgcagttgtacagagagtagaagcccgagaagaagaagaggaggagacacacatggcaacgctgggccagtacctggtgcacgggaggggtttcctgctcctaacaaagcttaattctatcattgatcaggctctaacatgtcgcgaggagctgctgacgttgctgctgtctctgctgcctcttgtttggaaaatccctgtccaggaagagaaggcgacagattttaacttacctctgtcagctgacataatcctcaccaaagaaaaaaatagcagttcgcaacggagcactcaggagaaactccacctggagggcagtgcactttcatctcaggtctcagctaaggttaacgtatttaggaagtctcggcgtcagcgaaaaatcacccataggtacagtgtgcgggatgctcgtaagacgcagctctcgactagcgattcggaggccaatagtgacgagaaggggattgcgatgaacaagcatcgtcggcctcatctgttgcaccacttcctgacttcttttccaaagcaggaccatcctaaggcaaaacttgatcggcttgcgactaaggaacagacccctccggatgcaatggctctggagaacagtagggaaattatccctcgacagggctccaataccgatattctcagtgagccagcagccctctccgttataagcaatatgaacaatagtccttttgatttatgtcatgtgctactgtctctcctagagaaagtgtgtaagttcgatgtcacgctcaatcacaattcacccctcgccgcaagcgttgttccgacattgacagagttcctggcaggatttggtgattgctgctccctttccgacaatctggaatctcgggtggtgtccgccggatggacagaagaacccgtggctctgattcaacgcatgctctttagaactgtgctccacctgctgtcggtggacgtatccactgcagagatgatgcccgaaaacctgcggaagaacctgactgagttgctccgcgcagcactgaaaattaggatatgcctcgaaaaacaacctgatccatttgcaccacggcagaaaaagaccttgcaggaagtccaggaggatttcgtcttcagcaaatataggcatcgtgccctccttcttcctgaactcctcgagggagtgctccagatcctgatctgttgtttgcagtccgccgctagcaatcccttctacttttcccaggccatggacctcgtacaggaatttattcagcatcacggcttcaacctcttcgagaccgccgtattgcagatggaatggctcgtcctccgggatggggtcccccctgaggcatcggaacacctgaaagctctgatcaacagcgtcatgaaaatcatgtccactgttaagaaggtaaagagcgagcaattgcatcacagtatgtgtacacgtaagcggcaccggcgatgtgagtattctcacttcatgcaccaccacagggatctaagcggcctgttggtgtccgctttcaagaaccaagtgtccaagaacccatttgaagagactgctgatggggacgtgtattatccggaacggtgctgctgcatagcagtgtgcgcccaccagtgcctcaggcttctgcagcaggctagcctctcctccacctgtgtccagatactgagtggggtgcacaatatcggcatatgctgttgcatggatcccaaatccgttatcatacctttgctgcacgccttcaagctgccagccctgaagaacttccagcagcatattctcaatatattgaataaactgattctagaccagttgggcggtgctgaaatcagccccaagattaaaaaagccgcttgcaatatctgcacagtggattccgaccagctcgcccaactggaggaaactctgcaggggaacctatgtgacgctgaactgtcctctagtttatcttctccgtcctaccggttccaaggtattttgccctctagtggctcggaggatctgctttggaagtgggacgcccttaaagcctatcagaacttcgtttttgaggaggacaggctccactcgatacagatagcaaaccacatttgtaaccttatccagaagggtaacatagtggtccagtggaagttatataattatatcttcaaccctgtgctgcagcggggtgtcgagctggctcaccactgccaacatctgtccgtgacctctgcccaaagccatgtgtgttcccaccataatcagtgtctgccacaggatgtgctgcagatttacgtgaaaacgcttccaatacttctgaagtcacgagtgattcgagatttattcctatcatgcaacggagtttcccagataattgagctgaactgccttaacggcatccgatcccactctctgaaggcatttgaaacactcattatcagcctgggcgagcagcaaaaggatgctagtgttccagatatcgatggtattgacatcgagcagaaggagctatccagtgtgcacgttggcacatcgttccatcatcaacaggcatacagtgacagccctcaatctctgtccaagttttatgccggtctgaaagaggcataccctaagcgtcgcaaaactgtgaatcaagacgtgcatataaatacgattaacttgttcctgtgtgttgccttcctgtgcgtttcaaaagaggcagaatcggaccgggaatcagctaacgatagtgaagatacgtccggctacgactccaccgcctctgagccacttagtcacatgctgccctgcatttcactcgagtcccttgtcctgcctagtcccgaacatatgcaccaggccgctgatatctggagtatgtgccgatggatttatatgttgtcatccgtattccagaaacaattctatcgcctcggagggtttcgggtatgtcataagctgatcttcatgattattcagaagttgtttcgcagccacaaggaagagcagggcaaaaaagaaggagacacgtccgtgaacgagaaccaagacctgaacagaatctcccaaccgaaaaggactatgaaggaggaccttctgagtctggccataaaatccgatccaattccatctgaactggggagcctgaagaaaagcgctgattctttgggcaaactggagttgcagcacattagttctatcaacgtggaggaggtctcagcaaccgaggccgctccagaggaagccaagcttttcacatcccaggagagtgagaccagtctgcaatcaataagactcctggaggcgctgctggccatttgccttcacggtgcacgcactagtcaacagaaaatggagctggaacttcccaatcagaacctgtcggtcgaaagcatcctgttcgagatgagggatcacctcagccaatcgaaggtcatcgaaacacagctcgccaaaccattgtttgatgcccttcttcgcgtggctcttggaaactattctgcggacttcgagcacaacgatgctatgacagagaaatcccatcagagtgctgaggaactgtcttctcaacctggcgatttctctgaggaggcagaagactctcagtgctgctcttttaaattgttagtggaggaggaaggttatgaggccgacagcgaatccaacccagaagatggcgaaactcaagatgatggcgtggatctaaagagtgagacagaaggcttcagcgcgtccagttcaccgaacgatctgttggagaacctgacacagggcgaaatcatataccccgaaatctgcatgctcgagttgaacctcctgagcgcctcaaaagccaaattggacgtcctggcacacgtattcgagtctttccttaaaataattcggcaaaaagagaagaacgtttttttgttgatgcagcagggcactgtcaagaatctcctaggaggttttttgtctatcttgacgcaagatgacagcgattttcaggcttgccagagggttttggttgatcttctcgtgtcactgatgagcagcagaacttgttccgaagaattgacgctattgctccggatcttcctggagaaatccccatgcaccagagcaacggatcagaaggtgcaaagcacctag

SEQ ID NO: 229146 - DNA, 1254 bp, Artificial Sequence
  Description of Artificial Sequence: Synthetic coding sequence
atggcagccccaggttctgctcggcgtccactgctgctgctgttgctgctgctcctgctggggttgatgcactgcgcttctgccgctatgttcatggttaagaatggcaatggcaccgcatgtataatggctaacttctcagcagcgttctccgtaaattacgacaccaaaagcggtccaaagaatatgacattcgatctcccaagcgacgccactgttgtgctgaatcggtcctcttgcggcaaggaaaatacttccgatccatctctggtcatcgcctttggcaggggacatacacttactctcaacttcacaaggaatgctacacgttattcggtgcagctcatgtctttcgtttataacctctcagacacccacttattccccaacgcctcttctaaggagattaagaccgtggagtctattaccgatatccgggcagatattgacaaaaagtaccgctgtgtcagtggtacccaggtacacatgaacaacgtcaccgtgactctgcatgacgccaccatacaagcctacttgtcgaacagcagcttttcaaggggggagactagatgcgagcaggatcgcccttccccaactacagcacctcctgcacccccaagtccctcgccctccccggttcccaagagccctagtgtcgacaagtataacgtgtcaggcaccaacggaacttgccttttggcatctatgggcctgcaactaaacctgacatacgagagaaaggacaacaccaccgtcacccggctgctcaatatcaacccgaataagacgtctgcttccggatcttgcggagctcacctggtgacccttgaattgcactctgagggtaccaccgtgctgctgtttcagttcgggatgaatgcatcctccagccggtttttccttcagggaatccagctcaacacaatcttgccagacgctagagaccccgctttcaaagccgctaacggttcactcagggccctgcaggctaccgtggggaactcttacaagtgtaacgctgaagagcacgtgcgagttacaaaggcctttagcgtgaatatttttaaggtttgggtgcaggcctttaaggtagaagggggacagttcggcagtgtcgaggaatgccttctcgacgagaacagcatgttgatccctatcgccgtgggaggagcccttgcaggactggtcctgatcgtattgatcgcctatttagttggacgcaaaagatcacacgctggctatcagacaatttag

SEQ ID NO: 229147 - DNA, 1095 bp, Artificial Sequence
  Description of Artificial Sequence: Synthetic coding sequence
atggcggcacccggaagtgcgcgacggcctctgctgctgctccttctgttgcttctactgggcctgatgcactgcgcttcagccgcaatgttcatggtgaaaaacgggaacggaacggcttgtataatggctaacttcagcgctgccttctcagtcaactatgacaccaaatccggtcctaagaacatgaccttcgatctccctagcgacgcaaccgtggtactcaaccgtagctcttgcggtaaggagaatacatcggaccctagcctagtcatcgctttcggcaggggccacacccttaccctaaactttacaaggaatgccacaagatattctgtccagctgatgagcttcgtctataacttgtctgacacccaccttttccctaatgcgtcctccaaggagacaagatgtgaacaggacaggccatcaccaactacagcgccacctgctccaccttccccctcacccagccctgtacccaaaagcccttccgtagacaagtacaatgtatctggaaccaatggcacctgcctgctcgccagcatggggctgcaacttaacctcacttatgaaagaaaggataacactactgtcaccagactgctcaatattaatcccaacaagacttctgcctccgggtcctgcggtgctcacttggtaaccctggaactgcacagcgaaggtacaacagtgctacttttccaatttggcatgaatgcttcctctagccggttcttcctgcaaggaatccagctgaataccattctccccgacgcacgcgatcctgcattcaaggccgcaaacggcagtcttcgcgcactgcaagctactgtaggcaacagttataaatgcaacgctgaagaacacgttagagtgaccaaggccttttccgtcaacattttcaaggtttgggttcaggccttcaaagtcgagggcggacagttcgggtccgttgaggaatgccttttagatgagaactccatgttaatcccaattgcagtgggaggcgctctcgcagggctagtgttgatcgtcctgatcgcatacttagtaggacgtaagcggtcacacgcaggctatcagaccatctag

SEQ ID NO: 229148 - DNA, 1233 bp, Artificial Sequence
  Description of Artificial Sequence: Synthetic coding sequence
atggtgtgttttagacttttccccgttcccggaagcggactcgtgttggtgtgtctagtgctgggagctgtgaggagctacgctctggaattaaatctaacagattcagaaaacgccacatgtctgtatgctaagtggcaaatgaattttacggtgcggtatgagactaccaacaagacctacaagaccgtcaccatctcagatcacggaactgttacttacaatggatccatttgcggggatgaccagaacggccctaagatagcggttcagttcggacctgggttcagttggatagcgaactttactaaagctgcttccacatattctatcgattccgtgagtttttcttataataccggcgacaatacgacttttccagatgctgaagataagggcatcctcaccgtggatgaactgctggctatccgtatccccctgaacgacctcttcaggtgtaactctctcagtacccttgaaaaaaacgatgtcgtacagcactactgggatgtcctggtgcaggcattcgtgcagaatggtaccgtttcgacaaatgagttcctttgcgacaaggacaaaacttccactgtcgcacctacgatacataccaccgtgccaagtccaactacaacccctacccccaaagaaaaacccgaagcagggacctatagcgtcaacaacggcaacgacacatgtttgttggcaacaatgggcctgcagctgaacatcacacaggataaggtagctagtgtgattaacataaatcccaacactacccatagcacgggttcctgccgatcacacacagcactactgcggctaaattcctcgaccattaaatacctggatttcgtgttcgccgtaaaaaacgaaaatagattttatctaaaggaagttaatatcagcatgtatctggtcaacggctcagtcttctctatcgcaaataataacctatcttattgggacgctcccctcgggagctcttatatgtgtaacaaggaacagacggtatctgtgagcggggctttccagatcaataccttcgacttgagagtgcagccttttaacgtcacacagggcaagtactctaccgcccaggattgctccgcagacgacgacaactttcttgtaccaatcgcagttggcgcagcactcgcaggagtgctgatactggtgctgctcgcttactttattggtctgaagcatcatcacgcagggtacgaacagttctag

SEQ ID NO: 229149 - DNA, 1233 bp, Artificial Sequence
  Description of Artificial Sequence: Synthetic coding sequence
atggtctgctttaggctatttccagtgcccggtagtggcttagtcctcgtatgcctggtgctgggcgctgtccgaagctacgcactggagcttaacctgactgactccgaaaacgcgacctgcttgtatgcaaagtggcaaatgaattttaccgtcagatatgagaccaccaataaaacttacaagaccgtgacaatctccgatcatggcactgtgacttataacggctctatttgcggggatgaccagaatggcccaaagattgctgtgcagtttggcccaggcttctcgtggatcgccaatttcactaaagccgcatccacttattcaatcgactctgtgtcatttagctataacacaggcgataacaccactttcccggacgcggaggataaggggatcttgacagtcgacgaactgttagcaatcagaatcccgctgaatgacttgttcagatgcaactccttgtccacccttgagaagaacgacgtcgtgcagcactattgggacgtgcttgtgcaagcattcgtacaaaatggcactgtcagtaccaacgaatttttgtgcgacaaggacaaaacaagtaccgtagccccaactatccacacaactgtgccatccccgacaactactcctacgcccaaagagaaacctgaagctgggacctacagcgtgaacaatggcaacgacacttgtctgcttgccaccatggggctccaactcaatatcacacaggacaaggtggcttcagtgatcaatataaatccaaataccactcactctacaggctcttgccgcagtcacaccgcactgctccgactgaattccagtaccatcaagtacctcgattttgtctttgccgtcaagaatgaaaaccgcttttacttaaaggaggttaatatttctatgtaccttgtgaatggatctgtgttctctatcgctaataacaacctgtcctattgggatgcaccgcttggatcaagctacatgtgtaataaggagcagacagttagcgtgtcaggagcattccagatcaacacttttgatttaagggtgcagcctttcaatgtgacgcaaggcaagtactcaacagcacaagaatgtagcctcgatgatgataccatcctgattcctatcatcgttggagccggactgagcgggttgatcattgtgattgttatcgcctacgtgatcgggaggagaaagagttacgctggctaccagacactgtag

SEQ ID NO: 229150 - DNA, 1236 bp, Artificial Sequence
  Description of Artificial Sequence: Synthetic coding sequence
atggtctgcttccgtttgtttccagttcctgggtcagggcttgttttagtgtgcctggtcttaggtgcagtaagatcatacgccctggaactgaacctgactgattcagagaatgccacctgtctgtacgccaagtggcagatgaactttaccgtgcgatatgaaacaacaaacaaaacgtacaagaccgtgactatttccgatcacggaaccgtgacttataacggcagtatttgcggcgacgatcaaaacgggcctaaaattgccgtgcagtttggtcccggattcagctggatcgctaacttcacgaaagccgcatccacttatagcatcgattcagtctccttttcttacaatacaggggacaacacaacatttccagacgcagaagataaaggaattctgaccgttgacgaactcctggctatcagaatcccactgaatgacctgttcagatgcaattcactatctaccctagagaaaaacgatgtcgtgcagcattactgggacgtcctggtgcaggcttttgtccaaaacggcaccgtttccacaaacgagttcctctgcgataaggacaagacctcaacggtagctccaaccatacataccacagtaccttccccgaccaccacacccacacccaaagagaagccggaagcaggcacatactctgttaataatggaaacgacacctgcctgctagctacaatggggctacagcttaacattacccaggacaaagtggcttccgtgattaatattaatcccaacaccacccactccactggatcatgtcggagccacaccgcgctcctgagattaaatagttccactatcaaatatcttgactttgtgttcgccgttaagaacgagaatcgcttttacttgaaagaggtgaacatctccatgtacttggtgaatgggtccgtcttctctattgcaaacaacaacctctcctattgggacgcaccgctgggctcctcatacatgtgcaacaaggaacagaccgtctccgtttccggagcctttcagattaatacctttgacctccgcgtgcagccttttaatgtgacacaaggtaaatattccaccgccgaggagtgctcagcagacagcgatctgaactttttgatccccgttgcagttggggtggcactgggatttctaatcattgtggtctttatctcgtacatgattgggcgacggaaaagccgcacggggtaccaatcagtgtag

SEQ ID NO: 229151 - DNA, 903 bp, Artificial Sequence
  Description of Artificial Sequence: Synthetic coding sequence
atggtatgctttaggctgttccctgtgcctgggtctggtctggtccttgtctgcctcgtgttagggatcctgacggttgacgagctgctggctatcagaatcccactgaacgacttattcaggtgcaactccctttcaactctcgagaagaacgatgtggtccaacattactgggatgtactggtgcaggcctttgtccaaaatggcacggtctccaccaacgaattcttgtgcgataaggacaagacctcgaccgtcgctcccaccatccacacgactgtgccttccccaacaacaacccccacaccaaaagagaaaccggaggccggaacttactccgtgaacaatggaaacgatacctgcctgttggccacaatgggattacagctgaacattacccaggacaaggttgccagcgtaatcaacattaaccccaacactactcattctactggcagctgccggagccacaccgcactcctccgcctgaacagttcaactatcaaatacctcgatttcgtctttgccgtgaagaacgaaaatagattctatctcaaggaggtcaacatctcgatgtatttggtgaacgggtccgtattctctatagcgaataataacttaagctactgggacgcgccactgggttcctcgtatatgtgtaacaaagagcagaccgtctcagtgtccggggcattccagatcaatacttttgacctgcgggtgcagccattcaatgtgacgcagggcaagtactccacagctgaggagtgctcagcagactctgacctcaacttcctcatcccagttgccgtcggagtggcccttggtttcctgattattgtcgtcttcatctcttacatgatcggcaggcggaagtcccgaacaggctaccagtcagtctag

SEQ ID NO: 229152 - DNA, 1092 bp, Artificial Sequence
  Description of Artificial Sequence: Synthetic coding sequence
atgaacttcactgttagatacgagacgacaaataagacatacaaaacagtgactattagcgatcatggaacagtcacttacaatggcagcatctgcggcgacgaccagaacggacctaagatcgctgtgcagtttggtccgggtttcagttggatagctaattttaccaaagccgcttccacatattcaatcgactcagtgagcttctcatataataccggtgataacactaccttccccgatgccgaggacaagggtattctcacagtggatgaactcttagcgattcgcattcctctgaacgacctttttagatgcaattccctgagcacacttgaaaaaaacgacgtggtccaacattattgggatgtgcttgtgcaggctttcgtgcagaatggaacggtcagcacgaacgagttcctgtgtgataaagataagacctcaacagttgccccaacaattcacaccactgtgccctcaccaaccaccacccctactccgaaggagaaacccgaggccggaacctatagcgtcaataatggaaacgacacgtgtctcttagccaccatgggactacagctgaacataacccaagacaaggtcgccagcgtcatcaatattaatcctaataccacccactcaactggcagctgccgttcacacacagcacttctgaggctcaactcctctaccattaagtatctcgacttcgtctttgcagtgaaaaatgaaaatcgtttttacctgaaagaggtgaacatctccatgtacctggtgaacggctccgttttcagcatagcaaacaacaatttatcttactgggatgcccctcttggcagtagttatatgtgcaacaaagaacagactgtttccgtgagcggcgcttttcagattaatacctttgacctgcgggtgcagccttttaacgtgacgcaaggcaaatatagtaccgcacaggaatgtagtctggacgatgacacaattctgatcccaataatcgtcggcgcaggactgtcaggccttataatcgtgatcgtgatcgcatatgtgatcgggaggaggaaatcatatgccggttaccagaccctgtag

SEQ ID NO: 229153 - DNA, 447 bp, Artificial Sequence
  Description of Artificial Sequence: Synthetic coding sequence
atgaaggccctcattgtcctagggttagtgctgttatccgtgaccgtacaagggaaggtcttcgagcgctgcgaacttgctcggacgctgaaacgtctgggaatggacggataccgcggtatctccttagccaattggatgtgcttagcgaagtgggaatccggatataatactagggcaactaattataacgccggagatagatctaccgattatggtattttccagatcaactccagatattggtgtaacgatggaaaaacacctggggctgtcaacgcctgccatctatcttgcagtgctctccttcaggacaacatagcagatgcagtggcctgcgctaaaagggttgttcgggacccgcaaggcatccgcgcttgggtcgcttggaggaacagatgtcagaaccgggatgtgcgacagtacgttcaggggtgcggtgtgtag

SEQ ID NO: 229154 - DNA, 585 bp, Artificial Sequence
  Description of Artificial Sequence: Synthetic coding sequence
atgcaagacgcccctctgagctgtctgtcccccaccaagtggtcttcagtttcctctgctgactctactgaaaagagtgcctctgccgctggaacacgtaatctgccattccagttttgcctccgccaagcgctgagaatgaaagctgccggaatcttgaccttgattggttgtctggtgaccggtgctgagagcaagatctatactcgctgtaagctagccaagatcttttcccgcgctggcctggacaattattgggggttttcgctaggaaattggatttgtatggcctattatgagtctggctacaacacaacagctcagaccgtcttggatgacggcagcattgactacggcatctttcaaatcaactcttttgcatggtgcaggcgaggtaaactgaaagaaaacaaccactgtcacgtggcatgtagtgccctcgtgacagatgatctgaccgacgccatcatctgcgcaaaaaagatcgtgaaggagactcagggaatgaattactggcaaggatggaagaagcactgcgagggaagggatctgtctgactggaaaaaggattgcgaggtatcctag

SEQ ID NO: 229155 - DNA, 441 bp, Artificial Sequence
  Description of Artificial Sequence: Synthetic coding sequence
atgaaagctagcgttgtcttgtctcttttgggctacctagtagtcccttccggcgcatacattctcggacggtgtacggtggctaagaaactgcacgacggtgggctcgactactttgaggggtactctcttgaaaattgggtgtgtctggcctacttcgaaagcaaattcaacccaatggccatttacgaaaatactcgagaaggctacacaggattcggcctgtttcagatgcgaggaagcgattggtgtggcgatcacggaaggaacaggtgccatatgagctgttctgcacttttaaaccctaatcttgaaaagacgattaaatgtgccaagaccatagtgaaaggaaaagagggcatgggcgcttggccaacctggagcaggtattgccagtacagcgacactctggctcggtggctggacggatgtaagttgtag

SEQ ID NO: 229156 - DNA, 441 bp, Artificial Sequence
  Description of Artificial Sequence: Synthetic coding sequence
atgaaagcctctgttgtcctgagtctgctgggttacctcgtggttccaagcggggcatacatactgggtaggtgcactgttgcgaagaaattacacgatgggggactggattattttgaaggctattctctcgaaaattgggtatgtttggcgtattttgagtcaaaatttaacccaatggccatctatgagaatactcgtgaagggtacacagggttcggcctttttcaaatgcgtggctccgactggtgcggtgatcacggacgtaaccggtgtcacatgtcctgctcagccctgttgaacccaaaccttgagaagacaattaagtgtgctaagaccattgtgaagggtaaggaagggatgggggcatggccaacatggtcccgatactgccaatattctgatacgctggctaggtggctggacggctgcaagttgtag

SEQ ID NO: 229157 - DNA, 447 bp, Artificial Sequence
  Description of Artificial Sequence: Synthetic coding sequence
atgacaaaggctcttctgatatacttggtttcatctttcctagccctaaatcaggctagtctgattagcaggtgtgatcttgcacaggtcctgcagctggaggacttagatggatttgaaggctatagcctgagtgactggttgtgtctcgcttttgtggagtctaagttcaacattagtaagatcaacgaaaacgcagacggatccttcgactacggtttgtttcagatcaactcacactactggtgcaatgattacaagtcatactctgagaacttgtgtcacgtggactgtcaagacctcctgaaccctaatttacttgcgggtatccattgcgccaagaggatcgtgtcaggagccaggggtatgaacaactgggtggaatggcgcctgcattgctccgggaggcccctgttttattggctgacggggtgccgcctgcgctag

SEQ ID NO: 229158 - DNA, 447 bp, Artificial Sequence
  Description of Artificial Sequence: Synthetic coding sequence
atgacgaaagctttactcatatacctcgttagctcgttccttgccttaaaccaggcttccctgatctccaggtgcgatcttgcccaggtgttgcagctggaagacttagatggatttgaaggatacagcctcagcgattggctgtgcctagcttttgttgaatctaaattcaacatctcaaagattaatgaaaacgccgacgggagttttgactacggcctcttccaaataaatagccattactggtgcaatgactacaagagttattctgagaatttgtgccatgtcgactgccaagacctgctaaacccgaacctgcttgccggaatacattgtgcgaagcggattgtgtcaggagcaagaggaatgaataactgggtggagtggagattgcactgctctggaagaccgctcttttactggctcactggctgtaggctgaggtag

SEQ ID NO: 229159 - DNA, 447 bp, Artificial Sequence
  Description of Artificial Sequence: Synthetic coding sequence
atgaccaaggctcttttgatatacctcgtgagttcctttcttgctttaaatcaggcgagcctcatttccaggtgtgacttagctcaggtattgcagctggaagatcttgatggctttgagggttatagcctctcagactggctttgcctggcctttgtggaaagcaaatttaacatcagcaagattaacgagaacgctgatggctcatttgactatgggctgtttcagataaatagccattactggtgcaacgactacaaatcttatagcgaaaacctttgtcacgtcgactgccaagatctccttaatcccaacctcctggctggaattcactgcgctaaaagaatagtgtccggagcgagaggcatgaataattgggtagaatggcggctacactgtagcggtcggccacttttctattggctgaccggatgtcggctcagatag

SEQ ID NO: 229160 - DNA, 2952 bp, Artificial Sequence
  Description of Artificial Sequence: Synthetic coding sequence
atggaaatgaagttacctggccaagaaggttttgaggccagctcagccccacgtaacatcccctcaggcgagctggatagtaaccctgaccccggaactgggcctagtcccgatggaccatcagacacagagagtaaggaactgggtgttcctaaggaccccctgcttttcatccagctaaatgaattgcttggatggcctcaggcactcgagtggcgagagactggtagcagttcagcctccctgctgctggacatgggcgagatgcccagtattactctgagcacgcacctccaccacagatgggtcttattcgaggaaaagctcgaggtggccgctgggagatggagtgcgcctcacgtacctacgttagcgcttccaagcctccagaaacttcgaagcctgctggcagagggattggttctgctggattgtcctgcccaatctttgctcgagctcgtggaacaagtgactagagtggagtcactaagtccagaactgagaggacaactccaagccttactcctgcagcggcctcagcattacaaccaaacaactggaaccaggccatgctggggatccactcaccctagaaaagcgtccgacaatgaagaagccccactgcgtgagcagtgtcagaatccattgagacagaagctgccccctggcgctgaagcaggcactgttctggcaggcgagctggggttcctggcacagcctcttggagcatttgtgcggctgagaaaccccgtcgtccttgggagcctgaccgaggttagtctcccttcaaggtttttctgcctgctgctgggcccttgcatgctgggcaaagggtatcatgagatggggcgtgctgctgccgttttgctgtccgatcctcagtttcagtggagcgtccgtagggcatctaatctgcacgaccttttagcagctttagatgcattcttggaggaggtcaccgtgctccccccaggacggtgggatcccaccgccaggataccccctcctaaatgcctcccgtctcagcataaaagattaccctcccagcagcgggaaatcagaggtccggctgtccccaggcttacctccgcggaggaccgccaccgccacgggcctcacgctcacagtcccgagttgcagcgcaccggacggttatttggcggactaattcaggatgtgcgccgaaaggtgccttggtacccttcagatttcttggatgccctgcacttgcaatgtttcagcgccgtgctgtacatataccttgctaccgtcactaacgcgatcactttcgggggactgctaggtgatgctacggatggtgcccagggggtgctggaatcttttctcggtactgcagtcgcaggtgcagcgttttgtctgatggctggtcagcctctgactatacttagtagtacaggtccagtactggtgtttgagcgtctgctcttctccttttccagggattactctctcgattatctgcccttccggctgtgggtcggtatctgggtcgctactttttgcctggtgctggtcgctacagaagcaagcgttctggtccggtattttaccagattcacagaggaggggttttgtgccttgatatccctgatttttatttatgatgccgttgggaaaatgcttaatctcacacatacgtatcctatccagaagcccggatcctccgcctatggctgtttgtgccagtatccaggccctggcggaaatgagtcacagtggataagaacacgccctaaggaccgggatgacatcgtgtcgatggatttagggcttatcaatgccagccttcttccgcctccagagtgtactcgacaggggggacatccaaggggacctgggtgccacactgtgccagacatagcattcttttccctgcttttgttcttgacatccttcttcttcgccatggcgcttaagtgcgtgaagaccagcagattttttcctagcgtggtgaggaaaggcttatcagacttctcctctgtcctagcaatccttttgggttgtggtctcgatgcttttctgggcctagcaacacctaagcttatggtgccccgagagttcaaacccacactacctgggagaggatggctggtgtcccccttcggagcgaacccatggtggtggagcgtggctgctgccttgcctgctctcttgctttcgatcttaatttttatggaccagcaaatcaccgccgtgattttaaatcgaatggaatacagactgcaaaaaggtgccggtttccatctcgatttattttgcgttgccgttctgatgttgctaaccagtgctcttggcctcccctggtatgtgagcgccactgtgattagtctggcccatatggactcgctgagacgcgagagtcgcgcttgcgccccaggtgaaagacctaattttttaggaatccgagaacagaggctgacaggactcgtggtctttattttgacaggcgcatccattttcctggcgccagttctgaaattcatcccaatgcccgtattgtatggcatcttcttgtatatgggggttgctgctctgtctagtatacaatttaccaatagagtcaagctgctgttgatgccagctaaacaccagccggacctcctactcttacgacatgttccactgactagagtgcaccttttcactgctatccagcttgcgtgcctcggcctcctgtggattattaagtccacaccagctgctatcatctttccactaatgctgctcggtctcgtgggagtgaggaaggcactggagcgagttttctccccccaggaactgctctggctggacgaattaatgcccgaggaagagagaagcattcctgaaaagggactcgaacctgaacacagtttttctggatccgactccgaggacagcgagctgatgtatcagccaaaagcgcctgagataaacatctcggttaactag

SEQ ID NO: 229161 - DNA, 123 bp, Artificial Sequence
  Description of Artificial Sequence: Synthetic coding sequence
atgcgcttcgcgtggactgtgctgttactgggtccgcttcagttgtgcgccctcgtccattgtgcccctcctgctgctggacagcaacagccaccccgagagcccccagctgctccagggtag

SEQ ID NO: 229162 - DNA, 1134 bp, Artificial Sequence
  Description of Artificial Sequence: Synthetic coding sequence
atgagattcgcttggactgtgttgctgttgggacccctccagctgtgcgctctggttcactgcgcacctcctgcagccggacagcagcaacccccaagggagcccccagccgcacctggagcagcttccgcccagcagcctcgcaccccgatccttctaatacgagataacaggaccgcggctgcgagaacccggacagctggttcatctggggtcacagcaggcagaccacgaccaaccgcacggcattggtttcaggccggatattcaaccagtagagcaagagaagcaggtgcctctagggctgaaaatcagacagccccaggcgaggtgcctgccctgagcaatctacgccctcccagcagagttgatggcatggtcggagatgacccttacaacccctataaatactctgatgataacccctactacaattattacgatacctacgaacgtccgcgaccagggggacgttaccgcccaggttacggcactggttacttccaatacggccttcccgatctggttgctgacccatattacattcaggcgtccacctacgtccaaaagatgtcgatgtacaacttgagatgtgctgccgaggagaattgtctagctagtacggcctaccgggctgatgtccgggactatgatcacagggtgctgttacgcttcccacagagggtcaagaaccaaggcacaagcgacttcctaccatcgagacctagatactcttgggaatggcactcttgtcatcagcactatcactccatggatgagttctctcactatgacctcttggacgccaacacgcagcggagggtagctgaaggccataaggcctcgttctgcctggaggatacctcatgtgattatgggtatcaccgcagatttgcttgtacagcccatacccagggactctcgcctggatgctacgatacatatggcgctgacatcgactgtcagtggatcgacattacagacgtgaagccaggtaactatattctcaaggtgagtgtgaacccgagttatctcgtgccagaatcagattacactaataatgttgttcgctgtgacataaggtacactgggcatcatgcatacgccagcggctgcactatttcaccctattag

SEQ ID NO: 229163 - DNA, 2325 bp, Artificial Sequence
  Description of Artificial Sequence: Synthetic coding sequence
atggaaagaccgctttgcagtcatctgtgtagctgtctggccatgctggctctcctctcacctctgtcactcgctcaatacgattcctggccccattatcccgaatattttcagcagccagcaccagagtatcatcagcctcaggctcctgccaacgtggccaagattcagttgcgcctggcaggacagaagagaaaacattctgaaggacgggtggaggtgtactatgacgggcaatggggcaccgtgtgcgacgacgatttctccattcacgcggctcacgtggtgtgtagagaactgggttatgtggaggccaagagctggacggctagcagcagttacggcaagggagaaggccctatttggcttgataatttacactgtactggtaatgaggcaaccttggctgcgtgcaccagtaacggctggggcgtgaccgactgcaagcatacagaggacgtaggggtggtatgctccgataagaggattcctggcttcaagtttgataattccttaatcaaccagatcgagaacctcaatatccaggttgaagacattagaatcagggcaattttgtcgacctacaggaagagaactcctgtgatggagggatatgttgaggtgaaggagggcaaaacttggaaacagatttgcgacaagcactggacagcaaagaattctcgcgtcgtctgtggcatgtttggttttcccggagagaggacctataacacaaaagtgtacaaaatgttcgcatcccggagaaaacaaaggtactggccatttagcatggattgcaccggtactgaggcacacatttccagttgcaagctgggtccccaagtttcattggaccctatgaaaaatgtcacgtgcgaaaacggcttacccgctgtcgtgagctgcgtccccggtcaggtgttttcacctgatgggccatctagattcagaaaggcatataagcccgagcagcccctggtgagattacggggtggagcctatattggcgagggtagagtcgaggttcttaagaacggcgaatggggcacagtctgtgatgataagtgggatctggtgagcgccagcgtggtgtgccgggagctggggtttggttctgctaaggaagcagtgacaggcagtcgactgggccagggcatcggccctatccacctcaatgagatccaatgtaccggtaatgagaaatccatcattgattgtaagtttaatgccgagagtcagggatgcaatcacgaggaagatgcaggcgttcgttgtaatactccagcaatgggtctccaaaagaaattaaggctgaacgggggtaggaacccatacgagggccgtgtggaggtgctggttgagcggaatgggtctctggtgtggggtatggtgtgtggccagaactggggcatagttgaggcaatggtcgtgtgtcggcagcttggcctgggtttcgctagcaatgcttttcaggagacctggtattggcatggagacgttaattctaataaggtcgttatgtccggtgtgaagtgttctggcactgagctgtctctagcgcactgcagacatgacggggaagacgtagcttgtccccaaggtggcgtgcagtatggggcaggcgtggcctgctccgagaccgctcctgacctcgttctgaacgcggagatggtgcagcagacaacctacctggaggatagaccaatgtttatgctacagtgcgcaatggaagaaaattgcctgtcagcttccgccgctcagacagatccaacaaccggctatcggaggttgcttagattcagcagccaaatccacaacaacggccagtctgactttaggccgaaaaatggaaggcatgcgtggatctggcatgactgccatcgccactaccactcaatggaggtcttcacgcattacgatctgctaaacttaaatggaactaaggtcgctgagggtcacaaagcttccttttgtctcgaagatacagaatgcgaaggggacatccagaaaaattacgaatgtgcgaactttggagatcaggggatcaccatgggatgctgggatatgtaccgccatgatatcgactgccagtgggttgatattaccgacgtgccacccggagactacctgtttcaggttgtgataaatccaaactttgaggtcgcagaaagcgattactctaataacattatgaagtgtcggagtagatacgatggccacagaatatggatgtacaactgtcacatcggtgggtcattctctgaagagaccgaaaagaaatttgagcacttctccggccttctcaacaatcaattgtcgccgcagtag

SEQ ID NO: 229164 - DNA, 456 bp, Artificial Sequence
  Description of Artificial Sequence: Synthetic coding sequence
atggagcggccattgtgctctcacctgtgcagctgcctggctatgttagctttgttgagcccactgtccctggcccagtacgattcttggccacactacccagaatactttcaacaacccgctcctgagtatcaccagccgcaggctccagctaatgtcgctaaaatccagcttcgactggcaggacaaaaaagaaaacatagcgaagggagggtggaggtgtactatgatgggcagtggggaacggtttgtgacgatgacttcagtatacacgccgcacatgtcgtctgccgggaactcggttatgtggaagcgaagtcctggacagcaagctcctcctacgggaagggcgagggtccaatttggttagacaatctgcactgtactggaaacgaggcgaccttagcggcttgcacctccaatggatggggtgtgactgactgcaagcacacgtag

SEQ ID NO: 229165 - DNA, 291 bp, Artificial Sequence
  Description of Artificial Sequence: Synthetic coding sequence
atggagaggcccctatgtagccacctgtgtagctgcctcgcaatgctggccctgctctctcccctgagcttagctcagtatgattcttggcctcattatcctgagtactttcagcagccagcacctgagtatcatcagccccaggccccagcaaatgtggctaagattcagcttcgccttgccggtcaaaagcggaaacactccgaaggtagggtggaggtttattatgacggccagtggggcacggtgtgcgatgatgatttttccattcacgccgcacatgtcgtctag

SEQ ID NO: 229166 - DNA, 420 bp, Artificial Sequence
  Description of Artificial Sequence: Synthetic coding sequence
atggaaaggcccctgtgttcccatctctgctcttgccttgctatgttagctctgctgagcccactcagtctggctcagtacgacagctggccccactaccccgaatactttcaacaacccgctcctgagtaccaccagcctcaggccccagccaacgtggctaagatccagctgaggttagcagggcaaaagcgaaagcactcagagggaagggttgaagtgtattacgatggccaatggggcaccgtatgtgatgacgattttagcatacacgcagctcatgtggtttgccgagaactggggtacgttgaggccaaaagctggaccgcttcgagtagctacggcaagggtgagggccctatttggcttgataacctgcattgtacaggcaatgaagctacactagcagcatgcacatag

SEQ ID NO: 229167 - DNA, 2262 bp, Artificial Sequence
  Description of Artificial Sequence: Synthetic coding sequence
atgcgacctgtatctgtatggcagtggtccccgtggggccttctgttgtgcctgctttgcagtagttgcctgggaagtccgtccccctctactggcccagaaaaaaaggcgggatcacagggcctgaggttcaggcttgcaggtttcccgaggaagccctatgagggccgagtggagattcagcgagctggcgagtgggggactatctgtgacgacgacttcactctgcaggccgctcacatcttgtgccgcgagctgggatttaccgaggccacagggtggacacattcagcgaaatatgggccaggcactggaagaatctggcttgacaacctgtcatgtagcggcactgaacagtccgttaccgaatgtgccagtcggggatggggaaacagcgactgcacacacgatgaggacgccggagtcatctgcaaggaccagcgcctccccggtttcagcgattctaatgtcattgaggtcgagcatcacctgcaggtggaagaggtccggataaggccagccgtcggatggggacgccgaccactacccgttaccgaggggctcgtcgaggtcagactacctgacggttggagccaggtctgcgataaggggtggtctgcccacaatagccatgtcgtctgcggaatgctgggttttcctagcgagaagagagtcaacgcggctttctaccgccttctagcacagcgacaacagcactcatttggacttcacggtgtggcctgcgtcgggactgaggcccatctctccctgtgcagtttagagttctatcgtgcaaacgacacagcaaggtgccctggcggtggaccagcagttgtgagctgcgtgcccggacctgtctacgcagcctcgtctggccagaagaagcagcagcagtcaaagccacaaggcgaagccagggtgcgtttgaagggaggggcacaccctggcgaaggtagggtcgaggtgttgaaagcgtcaacttggggtactgtatgcgaccgcaagtgggacctccacgccgctagcgtggtatgccgggaactgggatttggatcagctagagaagcgctgagcggtgcgagaatggggcaaggcatgggggctattcacctgtccgaggtgcggtgctccggccaggaactttctctgtggaaatgtcctcacaagaacataactgctgaggattgctcccatagccaagatgccggtgtcagatgtaatcttccgtacacgggcgctgaaacacgcattcggctgtctggagggagatcacagcacgagggcagggtcgaggtgcaaatcggcggacccggacctttgcgctggggtctcatctgcggtgatgactggggaactctggaggctatggtggcctgtagacagctggggctgggatacgctaaccacggactccaggaaacttggtactgggattcagggaacataactgaggttgttatgtctggggtgcgctgtaccggaaccgagctttccctggatcagtgtgcacaccacggcacacatataacatgcaaacgcaccggcaccagatttactgctggagtgatttgctcagagacagcatcagacctgctcctgcactctgcccttgtgcaggaaactgcttacattgaggatcgacccctccacatgctgtattgcgccgcagaggaaaattgcctggcgtcgagcgctaggagtgccaactggccttatggacataggcgccttctgcggttctcaagtcaaatccataacctgggcagggccgattttcggccaaaggcagggagacatagctgggtgtggcatgagtgtcacggacactaccattcgatggatattttcactcactatgatatcttaacacctaacggtaccaaagtggccgaaggccacaaggctagcttctgtctagaagacacagagtgccaggaagacgtgtctaaacgctatgagtgcgccaacttcggggagcaaggcattaccgtgggctgctgggacctgtatcggcacgatatcgattgtcagtggatcgatataacagatgtgaagcctggtaactatatcctgcaggtggtcatcaatcctaacttcgaagtggccgaaagtgacttcaccaacaacgcaatgaagtgtaactgtaaatatgacggtcaccggatatgggtgcataattgtcatattggcgacgcctttagtgaggaggctaatagaaggtttgaaagataccctggccagacctccaatcagataatctag

SEQ ID NO: 229168 - DNA, 1827 bp, Artificial Sequence
  Description of Artificial Sequence: Synthetic coding sequence
atgcgccctgtttcagtttggcagtggtccccttggggtctcctgctatgcctgctctgctccagctgtttggggtcccctagtccctccactgggccagaaaagaaagctggttcccagggcctacggtttcgcctcgctggattccctcgcaagccctatgagggacgggtggaaattcagcgtgcaggggagtgggggactatttgcgacgacgattttactctgcaggcagctcatattctgtgccgcgaactcgggtttactgaagctacaggttggactcactccgccaaatacggcccaggaactggccgaatctggctcgacaatttgagctgttcagggactgaacaatccgtgaccgagtgtgcttctcgtggctgggggaattccgactgcacccacgatgaggacgctggtgtcatctgtaaggaccagcggctgcctggattttcagatagcaatgttatagaagctcgcgtaaggttgaagggaggagctcatcctggggaaggtcgggtcgaagtcttaaaagcctcgacgtgggggacggtgtgcgaccggaaatgggatctacacgctgccagtgtggtttgccgggagctcggcttcggaagtgctcgtgaagctttgagcggtgctcgaatgggtcaaggaatgggcgcaatccacttatccgaagtgcgatgtagcgggcaggagctgtcgctgtggaaatgtcctcataagaacatcacagccgaagattgcagtcattcccaggatgccggtgtaagatgcaatctgccttatactggggctgaaactcgtatcagattgtccggtggcagatcccaacacgaagggagagtggaggtgcagattggcggtcctggtcctcttcggtggggtttaatttgcggggatgactggggaacgctggaagcaatggtggcgtgccggcaacttggtctaggctacgcaaatcacggattacaggagacctggtactgggactcaggaaacatcacagaggttgtaatgagtggggtccggtgcactgggacagagctcagcctggatcagtgcgcccatcatggcacccacatcacgtgcaagaggacaggcacacgctttactgcaggtgtgatatgttccgaaaccgccagtgacctgctcctccacagtgccctagtccaggagacagcctacatcgaggatcggccattacacatgctttactgcgccgcagaggagaactgtctcgcctcttcggccagaagcgcgaattggccttacggccaccggcgtttactcaggttctcctcccagatccacaatttgggcagggctgatttccggccaaaggcaggacgccattcgtgggtgtggcatgagtgtcatggccactatcactccatggacatcttcacccactacgacatcctcacccctaacggtaccaaggtggcggagggacataaggcatcattttgtctggaggatactgaatgtcaggaggatgtcagcaaacgctacgagtgtgcaaacttcggggaacagggcatcaccgttggctgctgggatctttacaggcacgacatagattgtcagtggattgacatcacagacgtgaagcccggtaactacatccttcaagtggtgatcaatcctaactttgaggtggcagagtctgatttcacaaacaatgcaatgaaatgtaattgcaagtacgatggacacagaatttgggttcataactgccacatcggggacgcctttagcgaagaagcaaatcgtcggtttgaacgttacccaggccagacatcgaatcaaatcatttag

SEQ ID NO: 229169 - DNA, 2094 bp, Artificial Sequence
  Description of Artificial Sequence: Synthetic coding sequence
atgcggcctgtctccgtttggcaatggagcccctgggggctgctgttgtgtctcctgtgttcatcatgcctgggcagcccttccccaagcaccggacctgagaagaaggcaggttcccaaggattgcgttttcggctggccggttttccccgaaagccatatgaggggagagtggagattcagagagctggagaatggggaaccatctgtgatgacgacttcacattgcaagccgctcacatcctttgccgagagctggggtttactgaagccaccggctggactcatagcgcgaaatatggtcctgggactggtcgcatctggcttgacaacctttcatgttcaggaacagagcaaagtgtgaccgagtgcgcatcgagagggtggggcaactcagattgcacacacgatgaggacgctggggtgatctgcaaggaccagcgtctcccaggctttagcgactctaatgtaatcgaggttgagcaccacctgcaggtggaggaagtgcggatacggcctgcagtcgggtggggcagacgaccattgcccgtcacagagggactggtcgaagtccgactgcccgatggttggtcgcaggtgtgtgataaaggatggtcggcccataattcccatgtagtgtgtggaatgttggggttcccttccgagaaaagagttaacgcagctttctaccggctcttagcgcagaggcaacaacactcatttggattacatggcgtcgcatgtgttggaactgaggcccacttgtccctctgttcactcgaattttaccgcgctaatgataccgctagatgtcctgggggtggtccagctgtagtgagctgcgtgcccggaccagtctacgcagcttcttcaggtcagaagaaacaacaacagtctaagccacagggagaggctcgggtgagactgaaggggggtgcccatccaggcgaaggccgagtcgaggtgttgaaagcctcaacttggggcactgtatgcgatcggaagtgggatctgcacgcggctagcgtggtttgtcgagagctggggttcggcagcgccagggaggcgctctccggggcaaggatgggccagggcatgggggcaattcacctctctgaggtccggtgttcgggacaagaactgtctctttggaagtgtcctcataaaaatatcacggctgaggattgcagccactctcaagatgcgggtgtgcgctgcaacctgccttataccggcgctgagactagagagacctggtactgggacagcggaaatataacggaggtggtgatgtctggcgtcagatgtaccggcaccgagctgagcctggaccagtgtgcgcatcacggcacgcatatcacatgcaagcgcactgggaccaggtttaccgctggcgtgatctgcagcgaaacggcctctgacttgctgcttcattcagccctagtgcaggagaccgcatatatagaagaccgcccactccatatgctgtactgtgccgctgaagaaaactgccttgctagctccgcacggagcgcaaactggccctacgggcacaggagacttttgcgcttcagttctcagatacataatctcgggagagcggattttagacccaaagcaggacggcattcttgggtttggcatgaatgtcacggccactaccactccatggacatctttacccattacgacatcctcacacctaacggcactaaagttgctgagggtcataaagctagcttctgccttgaggataccgaatgtcaggaagacgtctctaaacgttacgagtgtgctaactttggcgagcagggcattacagtaggctgttgggatttatataggcacgacatcgactgccagtggatcgacattaccgacgtaaaacctggaaactacatactacaagtcgtgatcaaccccaactttgaagtggctgagtcagattttacaaataatgctatgaaatgcaactgtaagtacgatggacaccgaatttgggtgcacaactgccatataggggacgctttttcggaagaagccaacagaaggttcgagagatacccaggtcagacaagtaaccagataatatag

SEQ ID NO: 229170 - DNA, 912 bp, Artificial Sequence
  Description of Artificial Sequence: Synthetic coding sequence
atgcggccagtgtcggtgtggcagtggtctccctggggcctactcctttgtttgctgtgctctagctgcttagggtcgccctcaccctcaacggggccagagaaaaaggccggatcacagggtctgcgctttagattagccggttttccacggaagccctatgagggacgcgtggaaattcaacgcgctggcgaatggggcactatctgcgatgacgacttcacgctccaggctgctcatatcctttgcagagaactggggttcaccgaagctaccggatggacccatagcgctaaatacggtcctggaacaggcaggatctggctggacaacctttcctgcagcggcacagagcagagcgttacagagtgcgcttccaggggttggggcaattctgactgtactcatgacgaagacgcaggcgttatctgtaaagatcaaagattgccgggtttctcagactcaaacgtgatcgaggtagaacatcatctgcaggttgaggaagtacgcatcaggcctgccgtcggctggggaagacgtcccctccccgtcactgagggccttgtcgaggttcgcctacccgacggttggtctcaggtgtgtgacaagggctggtcagcgcacaacagccacgtcgtctgcgggatgctcgggttcccatccgagaagagagtgaatgcggctttctatcgcctgttggcccagaggcaacagcatagttttggcctgcacggagtggcatgtgtgggcactgaagcgcatctcagtctttgttccctggaattctaccgcgcaaatgacaccgctagatgtccagggggaggccctgcagtggtttcctgcgtgcccggtcctgtctatgctgcctctagtggccagaagaagcagcagcagtccaaacctcagggctag

SEQ ID NO: 229171 - DNA, 2271 bp, Artificial Sequence
  Description of Artificial Sequence: Synthetic coding sequence
atggcgtggagcccccctgcgaccctgttccttttcctccttttacttgggcagccgccaccctcacgaccccagtccctgggcaccacaaaactgcggctcgtcgggccagagtcaaagccagaggaggggcgacttgaggttttacaccagggccaatggggaaccgtctgtgacgacaacttcgcaatacaagaggccaccgttgcttgcaggcaactggggttcgaagccgctctgacttgggcccactctgctaaatacggccagggagaggggcctatttggctagacaatgtaaggtgtgtaggcaccgaatcttcactggatcaatgtgggtcaaacggttggggagtgagtgattgtagccactcagaggatgtcggcgttatttgtcatcctagacggcatcgcggttatctgagcgaaaccgtgtctaacgccctcggaccacaaggaaggagactagaggaagtgcgcctgaagcctattctcgcctcagccaaacagcattcccctgtaactgagggggctgttgaggtcaagtatgagggccactggcgtcaggtgtgtgaccaaggctggaccatgaataactctcgcgtggtgtgtggtatgctcggcttcccaagtgaagtccctgtcgattcccattattacaggaaagtatgggatttaaaaatgagagacccgaaatcacgcttaaagtctttgacaaataagaattccttctggatccaccaggtgacatgtttagggacagaaccccacatggccaactgtcaggtccaggtggcccctgccagaggaaaactgcgacccgcatgtcctggaggcatgcacgccgttgtgtcatgcgttgccggacctcactttcgacctccaaagaccaaacctcagagaaaagggtcatgggcggaagaaccacgagtgagactgcgatcaggagctcaggtgggcgaagggagagtcgaagtgctgatgaaccgacagtggggcactgtttgcgaccaccggtggaatctaattagcgcctcagtggtttgcaggcagttgggtttcggaagcgctagggaggctctgttcggggcaagattaggccagggcttagggccaattcatctcagcgaggtgaggtgcagagggtatgagcgcaccctctccgactgccctgctctggaaggaagccagaatggttgtcaacatgaaaacgacgctgctgtccgatgtaatgttcccaacatgggcttccagaatcaggtgagactggcaggaggcagaatacccgaggaaggattactggaggtccaagtcgaggtgaatggggtgcccagatgggggagtgtctgttccgagaattgggggctgaccgaagcaatggtggcttgccggcagctggggctcggctttgcaattcacgcctataaagagacctggttttggtcgggaactccacgagcccaagaggtcgtgatgtcaggcgtgaggtgctccggcactgagttagccctgcagcagtgtcagcgtcacggcccagtacactgtagccacggcggtgggagattcttggccggagtttcctgcatggacagcgccccagacttagttatgaatgctcagctggtgcaggaaacagcatatctggaagatcgacctttgagtcagctctactgtgcccatgaggaaaactgtctgtctaaaagcgccgatcacatggactggccttacggataccggcgtttgctgaggtttagtacgcagatttacaacctaggaagaaccgactttagaccgaagacaggccgagattcatgggtttggcaccaatgccataggcattatcattctatcgaggtcttcactcattatgacctgctcacacttaatgggagcaaagtggccgaaggccataaagcatctttttgcctggaggatacgaactgccccactggactccaacgtaggtatgcatgtgctaatttcggggagcagggagtgacagtaggctgctgggacacttatcgtcatgacatcgattgccagtgggtggatataaccgatgtgggaccaggcaactacatctttcaggtgatagtcaatcctcattatgaagttgccgaatcggatttttccaacaatatgctgcagtgtagatgtaaatacgatggccacagagtttggctgcataattgccacacaggcaactcctaccctgctaacgccgaattatctctcgagcaggaacagcggctgaggaataatctaatttag

SEQ ID NO: 229172 - DNA, 1794 bp, Artificial Sequence
  Description of Artificial Sequence: Synthetic coding sequence
atggccgcagtgcaagccgcagaagtgaaagttgacggctctgaacctaaactgtctaagaacgagctgaaacgacggcttaaagctgagaaaaaagtcgccgaaaaggaagccaagcagaaagagttaagcgaaaaacagctttctcaggctacagccgctgcgaccaaccacacaactgacaacggcgtcggtcctgaggaggagtctgtggacccgaatcagtactataaaatccgttcacaagccatccaccaactcaaagttaatggcgaagacccatacccccacaaattccacgtggatatatcgctcacagacttcattcagaaatacagccatttgcagccgggtgaccatctcactgacatcactttgaaggttgccggacgcatccacgcgaagcgtgcgtccggagggaaacttattttctacgacctccgcggagaaggcgtgaaacttcaggtgatggctaattcacggaactacaagtcagaggaggaattcattcacatcaataataagcttcggcgaggagacattattggcgttcagggcaaccccggaaaaacgaagaaaggcgagttgagtattatcccctatgagattacactgctctctccatgcctacacatgttacctcacttgcattttgggttgaaggacaaggaaactagataccgtcagagatatctcgatctcatcctgaatgatttcgtgcgccagaagtttatcattagaagcaagatcatcacatacatcaggtcttttctggacgaacttgggtttctggagattgaaacgccaatgatgaatataatacccggaggggcagtggctaaacccttcatcacataccacaatgagctggacatgaatctgtacatgcgcatcgcacctgaattgtatcacaaaatgctagttgttggcggtatcgatcgtgtgtacgaaatcgggagacagttccgcaacgagggcatcgacctcacacacaaccccgagttcacaacctgtgagttctatatggcttatgccgactaccatgacctgatggaaatcacagaaaagatggtatcagggatggtcaaacacatcacggggagctataaggttacctatcaccccgacgggcctgagggccaagcctacgatgtggactttacaccacccttccggagaatcaatatggtagaggaactggagaaagcattggggatgaaactgccagagacgaatctcttcgaaacagaagaaactagaaagatcctggatgacatctgcgtagccaaggcagtggagtgtccaccaccgcgaactacagcacgcttgctcgacaagctagtcggcgagtttctcgaggtgacatgcattaatcctactttcatttgcgaccacccccagataatgtcccctctcgccaagtggcataggtccaaagagggcctcaccgaacgcttcgaactgtttgtaatgaagaaggagatttgcaatgcttacaccgagctaaatgaccctatgcggcagcgacagttgttcgaggagcaggccaaagctaaggccgcaggggatgatgaggctatgtttattgatgagaatttctgtacggcgctagagtatggcctaccacctaccgcgggttgggggatgggaatagatagggtagccatgtttcttacggatagcaataatattaaggaggttctgttgttccccgcaatgaagccagaagataagaaggaaaacgtggcaactacggacactctcgagagcacgaccgtcggtacttcagtgtag

SEQ ID NO: 229173 - DNA, 1878 bp, Artificial Sequence
  Description of Artificial Sequence: Synthetic coding sequence
atgttgacgcaggctgctgtgcgccttgtgagaggttctctccgtaagacctcctgggcggaatggggccatagagaactcagactaggtcaactggcccctttcactgcaccgcacaaggacaagtccttttccgaccaaaggtcagagctaaaacgtcgtctaaaggcggaaaagaaagtggcggagaaggaggccaagcaaaaagagctcagtgagaagcagttgagccaggccaccgccgctgcaacgaaccataccaccgataatggagtaggaccggaagaggaatctgtagaccctaaccagtactacaagatcaggagtcaggccatccatcagctcaaggtgaatggcgaagacccatatccacacaagttccacgttgatatttccctgactgactttattcaaaaatactctcacctacagcccggtgatcatctgactgatattaccctgaaggtggcgggacggatacatgctaaaagggctagtggcggaaaactgattttctacgacctccggggagagggtgtcaaactccaggtaatggcgaactctaggaattacaagtcagaggaagaatttattcatattaacaataagctgcgaaggggggatattattggagtgcaggggaatcccggtaaaactaaaaaaggggaattgagcattatcccctacgaaattactctcctctctccatgtctgcacatgctccctcacctgcacttcggcctgaaggacaaggaaacaaggtaccggcagcgttatctcgacttaatccttaatgacttcgtgaggcagaaattcattatacggtcaaagattatcacatatattcgcagcttcttggacgagctcggattcctggagatcgagacacctatgatgaatatcatccccggaggcgcagtggctaagccattcattacatatcacaacgagcttgatatgaatttatatatgaggattgcccctgaactctatcataaaatgctggttgtgggtggcatagaccgcgtttacgaaatcggcagacagtttcgaaatgagggtattgacctaacacataaccccgaattcactacatgtgagttctacatggcatatgctgattaccatgacctcatggagattacggagaagatggtgtctggtatggttaagcatataacagggagctacaaggtaacttaccatcccgacgggccagaaggacaggcatacgatgtggattttaccccaccattcagaagaattaacatggtagaggagctcgaaaaagccctggggatgaagttgccagaaaccaatctgtttgagacagaagaaactcgtaagatcctggacgatatttgtgtggcaaaggctgtggagtgtccaccaccccgaactactgcccgactccttgataagctcgtgggggaattcttagaagtcacctgcatcaacccaacattcatctgtgatcacccccaaatcatgtcccccttggccaaatggcatcgaagcaaggaaggcctgacggaacgttttgagttgttcgtgatgaaaaaagagatttgtaacgcatacactgagctaaatgatcctatgcggcaacggcagctcttcgaggagcaagccaaagccaaagccgcaggcgatgatgaggccatgtttattgatgaaaatttttgtacagcattagagtacggcttaccgcctacagccggatggggcatgggaattgatagagtggcgatgtttctcactgatagcaacaacatcaaggaagtgctgcttttcccagccatgaagccggaggacaagaaggaaaacgtggccactaccgacacattagagtctaccactgttggtacaagtgtttag

SEQ ID NO: 229174 - DNA, 1569 bp, Artificial Sequence
  Description of Artificial Sequence: Synthetic coding sequence
atgcagccctggcacggcaaagctatgcagcgcgcatctgaggcaggcgctaccgcccctaaggcctctgctcggaacgcccgaggcgcacctatggacccaaccgagtcccctgctgcaccagaagctgccttgcctaaagccggtaagttcgggccagctcggaaatccggctcccgacagaagaagtctgcgccagacacccaagaacggccacccgtgcgcgctactggtgcaagggccaaaaaggctccccagcgggctcaggatacacaaccctccgatgctacatcagctcccggagccgagggcctcgagccaccagccgctagagaacccgcactcagtcgggcaggttcatgccgccagcggggtgcacgctgctccactaaacccaggccaccgccaggaccttgggacgtgcctagtccgggtctcccagtgagtgccccaatattggtgcggagagatgctgcccctggggcttccaagctccgcgcagtgctcgaaaagctgaagctctcacgagatgacatcagcaccgccgcagggatggtgaaaggcgtggtggatcacctgctgctacggctcaagtgcgatagcgcctttagaggggttggcctcctgaacacaggatcttactatgagcatgtgaagatctcagcacccaacgagtttgacgtcatgttcaagctagaggtgcctaggatccagctcgaggaatattctaacacacgggcatattatttcgtgaaattcaaaaggaatcccaaggagaatcccttaagtcagttcttggagggagagatcctctcagcaagcaagatgctgtccaagtttcgtaaaatcattaaggaagagatcaacgacattaaggataccgatgtcataatgaaaagaaagagggggggtagccctgccgtgacgctactgattagtgagaaaatttctgtggacatcacgttagcgcttgagagcaaatcaagctggccagcctcaacgcaggaaggactgagaatccaaaactggttgagtgcaaaagtccgcaagcagttgagactgaagcctttctacctagtgcctaaacatgccaaggaagggaacgggttccaggaggagacctggaggctctcattcagccacattgagaaagaaatcctgaacaaccacggcaagtccaaaacatgctgcgagaacaaggaagagaagtgctgcaggaaagactgcctgaaattgatgaaatacctgctcgagcagctgaaggagcgatttaaggataagaagcatctggataagttttcctcataccatgttaaaactgccttcttccatgtgtgcacccagaatccacaggattcccagtgggacaggaaggacctgggcttgtgttttgacaactgtgtaacttactttctgcagtgtctgcggacagaaaagttagagaattattttattcccgaatttaacttgttcagtagtaatctgatcgacaaaaggagcaaagaatttcttaccaaacagatcgagtatgaacgcaacaatgagttccccgtttttgatgaattctag

SEQ ID NO: 229175 - DNA, 1344 bp, Artificial Sequence
  Description of Artificial Sequence: Synthetic coding sequence
atgcagccatggcacggcaaagcaatgcagagagcttcagaggccggagctaccgccccaaaagcaagtgcaagaaatgcacgcggagcgccaatggaccccacagagtctcccgctgctcctgaagcggctctgccaaaggccggtaaattcgggccagcccgaaaatcgggcagccgccagaaaaagtctgcgcctgacactcaggagaggccacctgttcgggctaccggtgccagggccaaaaaagcccctcaaagggcccaggatacgcaacctagcgatgctacaagcgccccaggcgcagagggtttggagcctccggctgcccgtgagccagcattgagtagagccggatcttgtaggcagaggggcgctagatgctccacaaagcctaggcccccacccggaccatgggacgtcccatctcctggtctcccggtctccgctccaatcttagttcgtagagatgccgctccaggggcttctaagcttagagccgtccttgagaaactcaagctctcacgggacgatatatccactgctgctggaatggtgaaaggcgtggtcgatcatctcctgctgcggctgaaatgtgacagtgccttcagaggagtaggtctgctgaataccggaagttattacgaacacgtcaagatcagcgccccaaacgagtttgacgtgatgttcaaactcgaggtacccagaatccagctcgaagaatactcgaacacacgtgcatattacttcgtgaagtttaaaagaaatcccaaggagaaccccttgtcacagtttcttgagggagagatcttgtctgcctccaagatgcttagcaagtttcggaagatcatcaaagaggagattaatgacattaaggataccgacgtgatcatgaagaggaaacggggagggtcccctgccgtgactttgcttatttccgagaagatctctgtagacattacactggctctcgagagtaagtcctcatggcccgcatctacccaggagggcctccgcattcagaattggctgtctgcaaaagtccggaagcaactgaggctgaagcccttctacctggttccaaagcacgcgaaggaaggaaatggctttcaagaggagacatggcgactgtcttttagtcacatcgagaaggaaattctgaacaaccacggaaaatcaaaaacatgctgcgaaaacaaggaggagaagtgctgcagaaaagactgtctcaagcttatgaaatatctgttggaacaactaaaggagcgctttaaagacaaaaagcatctggataagttttctagttatcacgtgaagacagccttctttcataggctctattag

SEQ ID NO: 229176 - DNA, 1080 bp, Artificial Sequence
  Description of Artificial Sequence: Synthetic coding sequence
atgattgctgcccaggccaagctcgtctaccatctgaataagtattacaatgagaagtgccaggcccgtaaggcagctattgccaaaactatccgggaggtatgcaaggtcgtgtccgacgtgctgaaggaagtcgaggtacaggagcccagattcatctcatcgttgaatgagatggataatcgttatgaagggttggaggtgatttcccccaccgaatttgaggtagtcctttaccttaaccagatgggtgttttcaattttgtggatgacggatccttaccgggttgtgcagtattaaagctctccgacggacggaagaggagcatgtctctgtgggtcgagttcattactgcttccgggtatttgtccgcgagaaagattcggtctcgctttcagaccctggttgcccaggccgtggataaatgtagttacagggatgttgtaaagatggttgctgacacaagcgaggtcaagttgagaattcgggaccggtatgttgtccagatcaccccagcattcaagtgtacaggcatatggcctcgctctgctgcacactggcccctgccccacataccatggcctgggccaaacagggtggctgaagtgaaagcggagggatttaatctcctgtctaaagaatgtcactctttagcaggtaagcagtcttctgctgagtcggacgcttgggtgctgcaatttgcggaagccgagaatcggcttcagatggggggttgtcgcaagaagtgcttatctattctgaaaaccctacgggaccggcacctggagttgcctggccagccactgaacaattatcatatgaaaaccctggtcagctacgaatgtgagaagcaccccagagaaagtgattgggacgaaagttgtcttggggaccggctgaacgggatcctcctccaactcatatcctgcctacaatgtcgcaggtgccctcactacttccttccaaatctggatctgtttcagggaaagccacatagcgcactggagaacgcagcaaaacagacatggcgcttggcccgagaaatcttgaccaaccctaagagtctcgagaaactgtag

SEQ ID NO: 229177 - DNA, 1176 bp, Artificial Sequence
  Description of Artificial Sequence: Synthetic coding sequence
atgtctggtcccgtgccctcccgggctagggtgtatacagatgtcaatacccacagaccacgtgagtactgggactatgagtcccatgtagtagagtggggcaatcaggacgattatcagcttgtcaggaaactggggcgaggcaaatacagtgaggtctttgaggccataaatatcaccaacaacgaaaaagtggtggtcaagatcttgaagcctgtgaaaaaaaagaaaatcaaacgggaaatcaagatcttagaaaacctaaggggtggtccaaacatcattacgttggccgatattgtaaaggatccggtctctagaacccctgcactggttttcgaacatgtaaataatacagattttaagcagctgtaccaaacccttaccgactacgatattcggttctatatgtacgaaatattgaaagccctggactattgtcatagcatgggtataatgcatagagatgtcaagccacacaacgttatgatagaccacgaacataggaaacttcggcttatcgattggggattagccgagttttaccatcctggtcaggagtacaacgtccgcgtcgcatcccgctacttcaaaggtccagaactgctggtggattaccagatgtatgattattcgttggatatgtggtccttgggctgtatgctagcatctatgattttccgtaaagaacctttttttcatggccacgacaactatgatcagcttgtgaggattgctaaagtgctcggaactgaagacctgtacgactacatcgacaagtacaatatcgagcttgaccccagatttaatgatattttgggtagacattctagaaagaggtgggagcgatttgtgcattcggaaaatcaacatctggtatctcctgaagccctggacttcctcgataaactgctgcgttatgaccaccagtccagactgaccgcccgagaggccatggaacatccatacttctatacagtggtaaaagaccaagcccgtatgggttctagcagcatgccaggtggctcaacacctgtttctagcgcgaacatgatgagtgggatctcctccgtcccaacaccatcccccttagggccactagcaggctcccccgtaattgcggcagccaatccactcggcatgccagtgccagcagctgcaggcgctcagcagtag

SEQ ID NO: 229178 - DNA, 1347 bp, Artificial Sequence
  Description of Artificial Sequence: Synthetic coding sequence
atgtacccaagtaataagaagaagaaggtatggcgggaggagaaagaaaggctgctgaagatgactctggaagaaagacggaaagaataccttcgtgattacataccattgaactccatcctttcatggaaggaggaaatgaagggtaagggtcagaatgatgaagagaatactcaggagacatctcaggtgaaaaaatccttgacagaaaaggtgtccctgtatagaggggatatcactctactggaagtggacgccatcgttaatgctgccaatgcatctctgcttggaggcggtggagtggatgggtgcatacatcgagccgcaggaccttgtctgctggcggaatgtaggaaccttaatggttgcgacacaggccacgccaaaattacttgcggatatgatctgcccgctaagtacgttatacataccgtgggaccaatcgcgcgaggacacatcaacggatcacataaggaggatctcgctaattgttataaatcaagtctgaaactggttaaggagaacaatatccgcagcgtagcattcccgtgtatcagcacaggaatctacggcttcccaaatgaacccgctgccgtgattgcattaaacacaattaaagagtggctggctaaaaaccaccatgaagttgaccgcattattttttgcgtgtttcttgaggtggacttcaagatttataaaaagaagatgaatgaattcttttccgtggatgataataatgaggaagaggaggatgttgagatgaaggaagactccgatgagaacggtcccgaagagaagcagagtgtcgaggagatggaggagcagtcccaggacgccgatggagtgaacacggttactgttcctggacctgcctcagaagaggctgtcgaggattgtaaggacgaggatttcgccaaggatgaaaacataaccaagggcggtgaagtaactgaccactcagtgcgagaccaggaccaccctgatgggcaagagaacgatagcaccaaaaatgaaattaaaattgagactgagagtcagagctcctatatggaaactgaggaactgtcatcaaaccaggaagacgctgtgatcgtcgaacagcctgaggttatccctttgacagaagaccaggaggaaaaagaaggagagaaggcccctggggaggatacaccacgtatgccaggaaagtccgaagggtcttcggacttggaaaatactcccggacccgatgtggagatgaattctcaagtggacaaagtcaacgatccaacagagagccagcaggaggatcagttgatcgctggcgctcaagacgaagccaaggagcaacggaacggcactaagtag

SEQ ID NO: 229179 - DNA, 642 bp, Artificial Sequence
  Description of Artificial Sequence: Synthetic coding sequence
atgaacgagtttttcagtgttgacgataacaatgaagaggaggaggatgtcgagatgaaggaggattctgacgagaacggtcccgaggaaaagcagagcgtcgaagaaatggaggaacagtctcaggatgcagatggagttaacacggtgaccgttcccggaccagcctcggaagaagcggtggaggattgtaaggatgaggattttgcaaaggatgaaaatatcacaaagggcggtgaggtgactgaccactccgttagagatcaggatcatccagatgggcaggagaacgatagtacaaaaaacgagatcaaaattgagactgaatcgcagagctcctatatggagacagaggaactgtcgtctaatcaggaagatgctgtcatcgtggagcagccggaagttataccgctgaccgaagatcaggaggagaaggaaggagagaaggcaccaggcgaagacacccctcggatgcccggaaagagtgaggggtcttctgacttggaaaacactcccggtcccgatgtggagatgaattcacaagtggataaagtcaacgatcccactgaaagtcagcaggaggaccagctaatagccggagcccaggacgaagccaaagagcagcgaaatggaaccaaatag

SEQ ID NO: 229180 - DNA, 642 bp, Artificial Sequence
  Description of Artificial Sequence: Synthetic coding sequence
atgaatgagtttttctccgtggacgacaataatgaagaagaggaggacgtggagatgaaagaagattctgatgagaacggaccagaggaaaaacagtccgtggaagagatggaagagcagagccaggacgccgacggggtgaatacggtgaccgtgcctgggccagcttccgaagaggccgtagaggattgcaaggacgaggatttcgccaaagacgaaaacatcaccaaggggggtgaggtgacagatcactcagtaagagaccaagatcatcctgacggtcaggagaacgattccacgaaaaatgaaattaagatcgagaccgagtctcagagctcttatatggagaccgaagaactgtccagcaatcaagaggacgccgtcattgtggagcagcccgaagtcataccactgacagaggaccaagaggagaaggaaggcgaaaaggctcctggagaggatacaccgagaatgcccggtaagtccgagggctcttccgacctggaaaacacaccgggtcccgacgtcgagatgaatagccaggtggacaaggtgaacgatccaaccgagagtcagcaagaagatcaattaattgccggagcccaagatgaggccaaggagcaaaggaatggaacgaagtag

SEQ ID NO: 229181 - DNA, 1068 bp, Artificial Sequence
  Description of Artificial Sequence: Synthetic coding sequence
atggccgtccaagagtccgccgcacagctgagcatgacccttaaggtgcaggaatacccaaccctgaaggtcccatacgagacactcaacaagcgcttccgggcagctcagaaaaacatcgatcgcgaaacctcgcacgtgacaatggtagtggccgaactcgagaaaacattgtctggttgtcccgctgtggactcagtcgtgtcactgctggacggagtcgtcgagaaactctccgttctgaagaggaaggcagtggagagtatccaagcggaagacgaaagcgccaagttgtgtaagagacgcattgagcacttgaaagagcactccagcgaccaaccagctgccgcttccgtctggaaacgcaagagaatggataggatgatggtggaacacctcctgcgttgtggttactataacacagcggtaaaactcgctagacagtctggaatcgaaagttgccttgagtttagcttaagaattcaggagtttatagaactgatccgtcagaacaagaggctggacgccgttagacatgccaggaaacacttttctcaagctgagggtagtcagctcgacgaggtacgccaggctatggggatgctggcgtttccacccgacactcatattagcccttacaaggatcttctggatcccgctcggtggcgtatgctgattcagcagtttaggtatgacaattaccgcctgcaccagctgggcaacaattcagtgtttacgttgacactgcaggctgggctctccgccattaagacgccccagtgctacaaagaggacggctcttccaaaagcccagactgccctgtctgtagcagatcactcaataaattggcacagcccctgcccatggcccactgcgccaacagccggctcgtgtgcaagatttccggagacgtcatgaacgagaacaacccccctatgatgctccctaacggctacgtgtacggctataatagcttgctgagtatacgtcaagatgacaaggtggtgtgtccacgcacgaaagaggttttccatttttcccaagctgagaaagtgtacataatgtag

SEQ ID NO: 229182 - DNA, 1191 bp, Artificial Sequence
  Description of Artificial Sequence: Synthetic coding sequence
atggccgtgcaggagtccgccgctcagctgagcatgaccctgaaagtgcaggaataccctaccctaaaggtcccgtacgaaaccctcaacaaacgatttagggcagcacagaaaaatattgaccgggagaccagtcacgtgactatggtcgtggcagagctcgagaaaacactatccgggtgcccagctgtggactcggtggttagtctgcttgacggagttgtggagaagctctcagtgcttaagcggaaggcagttgagtctatccaggccgaagacgaatccgcgaagctttgcaagcgcagaatcgagcacttgaaagaacactcctcagaccaaccagccgcagcttccgtatggaagagaaaacggatggaccggatgatggtagagcatctccttaggtgcggatattacaataccgccgtgaagctcgccagacagtcaggcatagaggatcttgtcaatatcgagatgttcctaacagccaaggaagtcgaggagtcactggagagacgagaaacagcaacttgcctcgcctggtgtcacgataacaagtctaggctgaggaagatgaaatcatgtcttgaattctctctcagaattcaggagttcattgaactgattcgccagaacaagcgtctggacgctgtcaggcacgcacggaaacattttagccaggctgagggcagccagcttgacgaagtccgacaggccatgggaatgctggcattcccgccagacacccacatttccccctacaaagatctgctggaccctgccagatggcggatgctcatccagcagtttcgctatgacaattatcggctgcatcagttgggtaataactcggtgttcaccttaacactccaggccggtctgtccgccattaagacaccccaatgttacaaagaagatgggtcctcgaagtctcccgattgtccagtgtgctccagatccctgaacaaattggctcagcctctccccatggctcactgcgcaaatagcagacttgtatgcaaaataagtggggatgtaatgaatgagaataacccccctatgatgctccctaatgggtacgtttacgggtacaactctcttctctctattcgtcaggacgataaagtggtgtgtccacgaaccaaggaggttttccactttagtcaagcagaaaaagtgtacatcatgtag

SEQ ID NO: 229183 - DNA, 987 bp, Artificial Sequence
  Description of Artificial Sequence: Synthetic coding sequence
atggctgtccaggaatccgctgcccagctatcaatgacactgaaggtgcaggagtaccctacattgaaagtgccctatgaaactttaaataaacggtttcgggcagcacagaagaacatcgaccgtgaaacatcccatgtgacaatggtggtagccgagcttgagaaaaccctgagcggctgtcccgctgtggactccgtggtctccttactggatggagtggtggagaaactctcagtcctgaagcggaaagctgttgagagtatccaagccgaagacgagtccgccaagctctgtaaacggaggattgagcacctcaaagaacatagcagtgatcagcccgcagccgctagcgtgtggaaacgaaagaggatggatcgcatgatggttgaacacctcctccgttgtgggtactacaacaccgctgtcaaacttgccagacagtccggaattgaaacctgcaaaaaggcattgcagccgtcacggagggagcctgccggtagaggagctcctggccacggccatgctggccttcccgctaggcacgctcatctgcctgtgcagggcccaagtggtccgtgcactgtcgctgacgccgaccccgcagtgcctgtccgtcagctgcctaccactcctgcgggaaagcagttctgtgtgcatcctcacccggcagggtggcctctgtcacaccaggagcagtgctacaaggaggacggcagcagcaaatccccggactgtccggtgtgttcccggagcttgaacaagctggcccaacctctcccgatggcccattgcgccaacagtagactggtttgcaagataagcggggacgtgatgaacgagaataacccgcctatgatgctcccaaacgggtatgtgtacggttacaactcccttctgtcaattaggcaggatgataaggtcgtttgccctcgaaccaaggaggtgtttcatttctcccaagccgaaaaggtctacattatgtag

SEQ ID NO: 229184 - DNA, 954 bp, Artificial Sequence
  Description of Artificial Sequence: Synthetic coding sequence
atgacattaaaggttcaggaatatccaaccctcaaggtgccatacgagacgcttaataagcggttccgagctgctcagaagaacatcgaccgcgaaacttcccacgtcaccatggtcgtggccgaactagaaaaaaccctttccggatgcccggctgtcgacagcgtggtctctctgttagacggagtcgtggagaagctctccgttctgaagagaaaggacttagtgaatatagagatgttccttacagccaaagaggttgaagagtccctagagcggagagaaaccgcaacttgccttgcctggtgccacgacaataagtcaagattacgtaagatgaagtcttgcctcgagttcagcctgaggatccaggaatttattgagctcattcgccagaataagcgacttgacgcagttcggcacgcccgtaagcactttagccaggctgagggttcccaactggacgaagtgcgacaggcgatgggcatgcttgccttccctcctgacacacacatctctccctataaggacttactcgaccccgctaggtggagaatgctgatccaacagtttaggtacgataactataggctgcaccagttaggtaacaactccgtttttaccctcactctgcaggccggtctgtctgccattaaaacgcctcagtgctacaaagaggacggctcctcaaaatcacccgattgtcccgtttgttccaggtccttaaataaactggcgcagccgctgcctatggcgcattgcgcaaatagtagactcgtctgcaagataagcggggatgtaatgaacgaaaacaacccacctatgatgttgccaaacggctatgtgtacgggtataactctctgctgagcattaggcaggatgataaggtggtctgccctcgtacaaaagaagtctttcatttctcccaagccgagaaagtttacatcatgtag

SEQ ID NO: 229185 - DNA, 1305 bp, Artificial Sequence
  Description of Artificial Sequence: Synthetic coding sequence
atggccgtgcaggagtccgcggcacagctgagcatgacactgaaagtgcaggaatatccgacactgaaggtaccatatgaaaccctcaacaagaggtttcgcgctgcccagaaaaatatcgatagagaaacctcacatgtaacaatggtggtggccgagttagaaaaaacgctgtctgggtgtccagccgtggattccgtggtcagcttgttggatggtgttgtagaaaaattatcagtgcttaagcgcaaggcagtagagagcattcaggccgaagatgaatcggccaagttgtgcaaacggagaatcgaacatctcaaagagcattcctccgaccagccagccgctgcgtccgtctggaaacgaaaaaggatggataggatgatggtggagcacctgctgcggtgcggctattataacacagccgtgaagctcgccaggcagagtggcatcgaggacctggtgaatatagaaatgtttctgacagctaaagaggtggaggaatccctcgagcggagggaaacagcaacttgccttgcttggtgccatgataataaatcgcggctgcgcaaaatgaaggggcgacagaataagcacgaggccaagacgggacgtaagtcacgggctgctagctcgtcacccaaggagtctctagatttgggtatggagactctgaagggtaaaccagaactttcctgtctggaattctctctgcgtatccaggagtttattgaactgatccgccagaacaaacgcctggatgctgttcgacatgctaggaagcacttcagccaggccgagggcagccagctagatgaggtgagacaggctatgggcatgttggctttccctcctgatacccatatttccccttacaaggatctcctggatccggctcggtggcggatgctcatccaacagttcagatatgataactatagattgcatcaactgggaaataactctgtcttcacattgacactccaggctggcctgtctgcgataaaaacaccccaatgttataaggaggacgggagctccaagagcccagactgtccagtgtgcagcaggagcttgaacaagctcgcacagcctcttccaatggctcattgcgccaactcccggctcgtgtgtaaaatttccggggacgtaatgaacgaaaataacccaccgatgatgctgccaaatggatacgtgtacggctacaattctctcctctcaatccggcaagacgataaagtcgtttgtccaaggacgaaagaggtcttccacttctctcaggccgagaaagtttatatcatgtag

SEQ ID NO: 229186 - DNA, 1047 bp, Artificial Sequence
  Description of Artificial Sequence: Synthetic coding sequence
atggtggtggcggagctggagaaaaccctgtcggggtgtcctgctgtggactccgtggtttcactgcttgacggggtggtggaaaagctgtccgtgctgaagcggaaggcagtggaatccattcaagccgaggatgagtccgccaaactctgcaagcgtcgcattgaacacctcaaggagcacagtagcgatcagcccgctgcagcgtccgtgtggaagcgcaagcgcatggacaggatgatggtcgaacaccttctacgatgtggctactataacacagccgtcaaactggcccgacagtccggtattgaagaccttgtgaatatcgaaatgtttctgactgccaaagaagtggaggaatctcttgaacgccgtgagacagccacatgcttagcttggtgccacgataataagagcagactgaggaagatgaagtcttgcctggagtttagcctcagaatccaggaatttattgaactaattcgccagaataaaagactggatgccgtgaggcacgctagaaagcacttttctcaggcggaggggagccagctggacgaggtcagacaggctatggggatgctcgcattccctccggacacccatatttctccttataaagacttgctggatccagctcgatggaggatgcttattcagcagttccggtatgacaattacaggctgcaccagctaggaaacaattctgtctttacacttaccctgcaagctggcctaagtgcaattaaaaccccccagtgctataaggaggacggaagtagcaaatcgcctgactgtcccgtgtgctcccggagtctcaacaaactggcacaacccctgcccatggctcactgtgctaactcccggctggtgtgtaagattagcggggacgtgatgaatgagaacaaccctccgatgatgctccctaacggatatgtctatggttacaatagcctgctgagtatccgacaggatgacaaagtggtgtgtccgcgaacaaaagaggttttccacttctcccaggctgagaaagtgtacattatgtag

SEQ ID NO: 229187 - DNA, 1188 bp, Artificial Sequence
  Description of Artificial Sequence: Synthetic coding sequence
atgtggacacttcgggctaccggtcgagaagtcggaagtagctcgtgcgaggacactgtggctcctgttccctacgaaacactgaataaaagattcagggccgcacagaagaatattgaccgcgagacgtctcacgtaactatggtggtggccgagctcgaaaaaacattaagcggctgcccagctgtggacagcgtggtatccctgctcgatggcgtcgtagaaaagctaagtgtactgaagaggaaggctgtggaaagcatccaagctgaggatgagagcgccaaactgtgcaagaggcgtattgaacatctgaaggaacactcctcagatcagccggcagcagccagcgtgtggaagagaaagagaatggacagaatgatggttgagcacctcctcagatgtgggtactataacaccgctgtgaaacttgctcgccagtcaggcatcgaagacctcgttaacatcgaaatgtttctcacagccaaggaagtggaggagagtctggagcgtcgggaaaccgctacctgtctcgcttggtgtcacgataataagtcccgcttgcgcaagatgaagtcttgtctggagttttccctcaggatccaggaattcatcgagctgattcgtcaaaacaaacgtctcgacgccgtcagacacgctcggaagcatttttcacaggctgaaggttcccagcttgatgaggtccggcaggctatgggcatgttagccttcccaccagatacccatatatccccttacaaggacctactagaccccgctcgctggcgaatgctgatccagcagtttaggtatgataactacaggctgcaccagctggggaacaattccgtgttcacactgaccttacaggccggtctgagcgccatcaaaaccccacagtgctacaaagaagacgggtcaagcaaatctcccgactgtcccgtttgttccaggagtctcaacaaattggctcagccattgcccatggcacactgtgctaactcacgtctggtctgcaagataagcggcgacgttatgaatgagaataatccacccatgatgttgccgaacggttatgtctatgggtataatagcttattgagtatccgccaggacgacaaggtcgtttgcccgcgaacaaaagaggttttccacttttctcaggctgaaaaggtgtacattatgtag

SEQ ID NO: 229188 - DNA, 987 bp, Artificial Sequence
  Description of Artificial Sequence: Synthetic coding sequence
atggcggtgcaggagtccgccgctcaactttcgatgacgctgaaggttcaagaatacccgactctgaaggtaccatatgagactcttaataagcgctttcgtgccgctcagaagaatattgaccgggagacatcacatgtgacgatggtagttgccgaactcgaaaaaaccctgagtggctgtcctgcggttgactctgttgtcagcttgcttgacggggttgtggagaagttgtctgtgctgaagcggaaggccgtggagagcatacaggcggaagatgagagtgctaagctatgtaagcgacgcattgaacaccttaaggaacacagcagtgaccaaccagctgccgcaagcgtgtggaaaaggaaacgaatggatcggatgatggtggaacacttgcttcgctgcggttactacaatacagcagttaaattggcacgccagagcggaatcgagacctgcaagaaagccctgcaaccgagccggcgagagccagcgggacgcggagcccctggtcatgggcacgctgggctccccgctagacacgctcatttgccagttcagggcccttccggcccttgtacggtggcagatgccgaccccgctgtgcccgtacggcagctgcctactacccctgctgggaaacaattttgtgtccatccgcatcctgccggatggcccttgtctcaccaagacacgtgctataaggaggacggctcctcaaagtcccccgactgtcctgtgtgctcccgaagcctgaataagttggcgcagccccttccaatggcacactgtgctaactctcgtttggtctgtaaaattagcggcgatgtgatgaacgaaaataaccctcccatgatgttaccaaatggctacgtgtacggatataatagtctgttgtcgatccgtcaagacgacaaggttgtgtgccctcgcacaaaagaggtatttcacttttctcaggccgagaaagtctatattatgtag

SEQ ID NO: 229189 - DNA, 1128 bp, Artificial Sequence
  Description of Artificial Sequence: Synthetic coding sequence
atggctgttcaagagtctgcagctcaactcagcatgaccctgaaggtgcaggagtatcccacactaaaggtaccctatgagactctcaacaaacggtttcgagctgctcaaaaaaacatcgaccgggaaacaagtcacgtgactatggtggtagcggaactggaaaaactcagcgtcctcaagaggaaggccgttgaatcaatacaggcagaggatgagtctgccaagttgtgcaagcggaggatcgaacacctcaaggagcattcatcagaccaaccggctgccgcttcagtctggaaaagaaaacgcatggacagaatgatggtggaacacctgctccgctgtgggtactacaataccgccgtcaagctggccaggcaatccgggatagaggatctggtgaacattgaaatgttcctcacagcaaaggaggtggaagaatcccttgaaaggcgggagacggccacttgtctagcatggtgccatgacaataagagtaggcttagaaagatgaagtcctgtctcgagttttccctgcggattcaagagttcatcgaactgataaggcagaataagcgcttagacgcagtcagacacgccagaaaacatttttcacaggccgagggctctcagttggatgaggtgagacaagccatggggatgctagcattccctcctgatacccacatctctccatacaaggacctcctggaccctgcacgttggcgcatgcttatccagcagtttcgatacgacaattacaggctccatcaacttggaaataattctgtgttcaccctcacactgcaggctggacttagtgcaattaaaacaccgcaatgctacaaggaggatggaagctcaaagtctcctgattgtcccgtttgctcccgctctttaaataagctcgcccagcccctgcccatggcccattgtgctaatagcaggcttgtttgtaagatatccggcgatgtgatgaacgaaaacaatccccctatgatgctgccaaatggctatgtgtatggttataactctctcctgtccatcaggcaggatgacaaggtggtttgtccacgtacaaaggaagtgttccatttctcgcaggccgagaaggtgtatattatgtag

SEQ ID NO: 229190 - DNA, 1467 bp, Artificial Sequence
  Description of Artificial Sequence: Synthetic coding sequence
atggctccagctgcgtggctgcgctcggccgctgcccgagcactcctgccccctatgctgctgctcctgctccagcctcctcccctcctggctcgcgcactacctcccgatgcacatcaccttcatgccgaacgccgaggcccacagccatggcacgcagccttaccatccagccctgcccctgccccagcaactcaggaggctcccaggcccgcaagctcacttaggccgccacgctgcggagtgccagacccatcagacggtctcagcgctaggaatcggcagaaacggtttgtgttgagcggcggtagatgggagaagaccgatctcacatatagaattctgagattcccttggcagctagtccaggagcaggtaagacagaccatggccgaggctctgaaggtttggagcgacgtcaccccacttacctttaccgaagtccatgagggccgagccgacattatgatagacttcgccaggtattggcacggagacgacttgcccttcgatggcccaggcggtattttggcccatgcattttttcctaaaacgcatagggagggcgatgtgcactttgattatgacgagacgtggaccatcggcgatgaccaggggacggatttgttgcaggtggctgcccatgagttcggacatgtcctgggattacagcacacaactgctgccaaggcccttatgagcgccttctacacttttcggtaccccctttcactgtcccccgacgactgcaggggcgtgcaacatttgtatggacagccctggcctacagtaaccagcagaactcccgctctgggaccacaggctggtatagatacaaatgagatagcacccttggagccggatgcccctcctgatgcttgcgaagccagctttgatgcggtctctaccatcagaggagagttgttcttcttcaaggccggattcgtttggagattgcgcggtggtcaactacaaccagggtaccccgcactggcctctaggcactggcaaggtctgccgtccccggtggacgctgcctttgaagacgctcaaggacacatctggttttttcagggggctcagtactgggtgtacgacggcgagaaaccggttctggggcctgcccctctgacagagctcgggctggtgcgatttccagtgcacgcggctcttgtgtggggcccagagaaaaataaaatatacttcttcagggggagagattattggaggtttcacccctctactcggagagtggactccccagtgcctcggcgtgctactgattggcgtggggtcccttcagaaatcgatgcagctttccaggacgccgatggctacgcttatttcctcagagggaggctgtactggaagttcgaccctgtcaaagtcaaagctctcgaaggattcccaagacttgtggggcctgacttttttggctgcgccgaacccgctaacacattcctctag

SEQ ID NO: 229191 - DNA, 1563 bp, Artificial Sequence
  Description of Artificial Sequence: Synthetic coding sequence
atgagaaataagaaaatcctgaaagaagacgagctgttatccgagacccagcaggctgcctttcatcagattgccatggagccattcgaaattaacgtcccgaagccgaagcgcaggaacggcgtcaatttcagtctggctgtggtggtaatatatctcatactcttgaccgcgggagccggattgcttgttgtgcaggttcttaatcttcaagccaggttaagagtgttggagatgtacttcctgaacgatacactggctgccgaagattctccctccttcagcctgctgcagtcagcccatccgggagagcatctggcacagggtgcatcccggctccaggtgctgcaagcgcagctcacatgggtgcgcgtgagtcatgaacatcttttgcaaagggtggataactttacccagaaccccggaatgttccgaattaaaggtgagcagggcgcaccaggtctccaaggacacaaaggcgctatgggcatgcccggtgctccagggcctcccggtcctccggctgagaagggtgctaagggcgctatgggcagagatggggcaaccggtccctccgggccacagggacctcctggcgtgaagggtgaggccggactgcagggaccgcagggcgctccaggcaaacagggggctactggcacccccggaccacagggggagaaggggagtaaaggggatgggggactgatcggcccaaaaggcgagaccgggaccaagggagaaaagggggatttggggcttcctggcagcaagggtgaccggggaatgaagggggacgccggagttatgggcccaccaggggcacaggggtccaaaggggactttgggcgaccaggtccacctggcctggccggtttcccaggggcaaaaggggaccaggggcagcctggcctccagggcgtccccggtccgccaggtgctgtaggacacccgggagcaaaaggtgagcccggatcggctggcagtcctgggcgagctggtctgcccggttccccaggctcgccaggcgcaacaggccttaaggggtccaagggcgacaccggcttgcagggtcagcagggcaggaagggtgaaagtggagtgcctggaccggctggcgttaaaggcgaacaaggcagccccggactcgcaggaccaaaaggagctcccggacaggctggacaaaagggcgaccaaggagtcaaggggagctcgggcgagcagggtgtgaagggggagaagggagaaaggggagagaatagtgtgtccgtaagaatcgtgggatcatccaatagaggcagagccgaggtgtattactcaggaacctggggaactatttgcgacgacgagtggcagaactccgatgcaattgtgttttgccggatgctgggctactccaaggggcgtgctctctacaaggtgggtgccggtacaggacagatctggctggataacgtgcagtgtaggggaaccgagtccactctctggagctgcactaaaaatagctggggacaccacgactgctctcacgaagaggatgcaggcgttgaatgctcagtgtag

SEQ ID NO: 229192 - DNA, 1329 bp, Artificial Sequence
  Description of Artificial Sequence: Synthetic coding sequence
atgtacttcctgaatgatactctggcggcagaggactccccttcattttctctcctccagtccgcgcatccaggtgagcatctcgcacagggggctagcagacttcaggttctgcaagcacaactcacatgggtgcgggtctcccatgagcacttgctgcagagagtggacaactttactcagaaccccggaatgttcaggattaaaggggagcagggcgctccgggtttgcagggccacaagggagcaatgggaatgcccggtgcgcctggccctccaggccctccagcggagaagggagcgaagggcgcaatgggccgagacggtgcgacaggcccttctggaccacagggcccaccgggtgtgaagggcgaggcagggctacagggtccacagggtgccccaggtaagcagggcgcaaccggcactcccggaccccagggcgagaaggggtctaaaggggatggtggactgattggacccaagggagaaaccggtactaagggagaaaaaggagacctgggactacctgggagcaaaggcgaccggggtatgaaaggtgatgcgggtgtgatgggaccgccaggcgcacaaggatctaaaggggacttcgggaggcccggtccccctggactggccggttttcccggtgccaagggtgatcagggacaaccaggtctgcagggggttcccggtcccccaggggcagtaggccacccaggcgctaagggtgaaccaggcagtgctggatcaccaggcagagcaggtctaccagggtccccgggatctcctggcgctacaggcctcaaaggcagcaagggcgataccggactgcaaggacagcaaggtcgaaagggcgagtcaggggtccccggaccagctggggtgaagggtgagcagggcagcccaggactggccggtcctaaaggtgctccaggccaggcaggtcaaaaaggcgaccagggggtgaaagggagttctggtgagcagggagttaagggagaaaaaggcgaacgtggcgaaaactcggtgtcggtacgaatagtgggctcaagtaaccgaggtcgcgctgaagtgtattatagcgggacatggggcacgatctgtgatgacgaatggcagaatagcgacgcgattgtgttttgtaggatgctagggtactcaaagggacgagctctgtacaaggttggcgcagggaccggccagatatggctcgacaatgtccagtgccggggtaccgagagcacactgtggagttgtactaagaactcttggggtcaccacgattgctctcatgaagaggatgccggagtggagtgttcagtctag

SEQ ID NO: 229193 - DNA, 1356 bp, Artificial Sequence
  Description of Artificial Sequence: Synthetic coding sequence
atggaacagtgggaccatttccacaaccagcaggaggatacagactcctgtagtgaatcggtaaaatttgacgccaggagtatgacagccctcctgcccccaaatcctaaaaattctccaagcttgcaggaaaaattgaagtcgttcaaggccgcactaattgcactttacctgctcgtttttgccgtgctcattcctctgataggcatcgtcgcagcacagcttttaaagtgggaaaccaaaaattgttccgttagctccaccaatgcaaatgatataacacagtctcttacaggcaagggaaacgactcagaggaggaaatgcgctttcaggaggtgttcatggaacacatgagtaatatggagaaacggattcagcacattctggacatggaggccaatttgatggacacagagcatttccaaaacttctcgatgacgactgatcaaaggttcaacgacatcctgcttcagctttccacgttattttcttcagttcagggccacggcaacgcaattgatgagatctcaaaatctctgatctctcttaatacaacattgttggacctccagttaaacatcgaaaacctgaatggcaagattcaggaaaatacttttaagcagcaagaagagatcagcaagctggaggagagggtgtacaatgtctctgccgagatcatggcgatgaaagaggaacaggtccatttggaacaagagattaaaggagaagtcaaggtgcttaataatatcaccaatgacttaaggctgaaagactgggagcattcccaaaccctcaggaatattaccctgattcaggggccacccggacccccaggcgagaagggtgatcgaggaccgacaggagaatctggccctagaggtttcccaggcccaattgggccaccgggattgaagggtgataggggagctattggatttcctgggagccgaggcctgccagggtacgccggacggccaggcaatagtgggcctaaaggccagaaaggcgagaaagggtctggcaatacgctaacaccatttacaaaggtccggctggtcggaggctcaggtccacacgagggacgagtcgaaatattacacagcggtcagtggggtactatttgtgacgaccgctgggaggttcgcgtggggcaggtggtgtgcaggtccctgggctatccaggtgtccaggccgtacacaaggccgcacacttcggtcagggtaccggcccaatctggctgaatgaggtcttttgcttcggcagagaaagttccatcgaagagtgtaaaattcggcagtgggggaccagagcttgtagtcattctgaagatgctggcgttacctgcacgctctag

SEQ ID NO: 229194 - DNA, 1167 bp, Artificial Sequence
  Description of Artificial Sequence: Synthetic coding sequence
atggagcagtgggatcatttccacaaccagcaggaggatacagatagttgttcagagagtgtgaaatttgatgcgcgttccatgacggcactcttgccaccaaaccccaagaacagcccgtctctacaggaaaagctgaagagttttaaggctgcactaattgccttgtacctgctggttttcgctgtactgatccctttgattggcatcgttgctgcacagctgctcaaatgggagacgaagaactgctcggtgagtagtacgaacgctaatgatattacgcagtccttgaccggaaaaggcaatgacagcgaagaggagatgcgttttcaagaggtgtttatggagcatatgtctaacatggaaaaacgcatccaacacatcctggacatggaggctaacctgatggacaccgaacacttccaaaatttctctatgaccaccgatcagaggttcaatgatattttactacagctcagtactcttttttcttccgttcagggccatggtaatgcaatcgatgaaatctctaagagcctaatatccctgaatactaccctcctcgatcttcaactgaatatagagaatttgaacggaaaaattcaggagaatacctttaagcaacaggaggagatttcaaaactggaggaaagggtgtacaacgtatctgcagagatcatggccatgaaggaggagcaggtccatctggaacaggaaatcaagggcgaggttaaggtgttgaacaatattaccaacgacttgagactcaaagattgggagcactcgcagactctaaggaacataacgttaatccagggccctcccggtcctcctggggagaagggagacagggggccaactggggaatctggacccaggggttttccagggccaatcgggcctccgggtcttaaaggggaccggggagctattggctttcctggctcccgcggtctacctggctatgctgggcgacccggtaactccggccctaaggggcagaagggagaaaaggggagtggcaacacactgtcaaccggcccaatctggttgaacgaggtcttctgctttggccgagagtccagcattgaggagtgcaagattaggcaatggggaactcgggcatgttctcactctgaagatgctggagtgacctgtactctatag

SEQ ID NO: 229195 - DNA, 1167 bp, Artificial Sequence
  Description of Artificial Sequence: Synthetic coding sequence
atggagcagtgggaccatttccataatcagcaggaggacaccgactcctgctctgaatctgtaaaattcgacgcccgtagcatgacagctctcctcccaccgaaccctaagaacagcccctccttgcaagaaaaacttaagagtttcaaagctgcccttattgccctgtacctgctcgtattcgctgtgcttattcctctgattggtattgtcgctgcccagcttcttaaatgggagactaagaactgtagcgtcagttcgacgaacgctaatgatatcacgcagtcgctgactgggaaaggcaacgattctgaagaggaaatgcgttttcaggaagtgttcatggaacatatgtccaatatggagaagaggatacagcacattcttgatatggaagccaatctcatggatacagaacacttccagaattttagtatgacaaccgatcagaggttcaacgacattctgttacaactgtccaccctgttctcatcggtgcaggggcatggaaacgcgattgacgagatttccaagtctctgatctctttgaacactacgctgctcgatctgcagttgaacattgaaaacctgaatgggaaaatacaggagaatacttttaagcaacaggaagaaatcagtaaactggaggaacgtgtgtacaacgtatcagctgagataatggcgatgaaagaggaacaggtccacctggaacaggagattaagggcgaagtgaaggtgctgaataatatcacaaacgacctgagactcaaagactgggagcacagccagacactgcgtaatattactttaatccagggaccgccagggcctccaggcgagaaaggagacagggggcctactggcgagtcagggcctcggggatttcctggacctatcggcccacccggacttaaaggcgacaggggcgcaatcgggtttccgggaagcagaggattacctggatatgcaggtcggcctggcaatagtggccctaaggggcaaaaaggtgagaaagggtccgggaatacactatctacagggccaatctggctcaatgaagttttctgtttcgggagagagtcatctatcgaggagtgcaaaatacgacaatggggaacaagggcatgctcacacagcgaggacgccggtgtgacctgtaccctttag

SEQ ID NO: 229196 - DNA, 1077 bp, Artificial Sequence
  Description of Artificial Sequence: Synthetic coding sequence
atggaacagtgggaccatttccacaaccagcaagaggacacggactcctgcagcgagtctgttaagttcgacgcccgatcaatgacggcactcctgccccctaacccaaaaaactctccttccctgcaggagaagctaaagtccttcaaagcagccctgatcgcactgtacctgttggtttttgcagtgctcatccctctcatcggcattgtggcagcacaattgctcaagtgggagactaagaattgtagtgtgtcctccacaaacgccaacgacattacccagtccctaacgggaaagggaaatgacagtgaagaggagatgcgcttccaggaggtttttatggagcacatgagtaatatggaaaaacggattcaacatattctggatatggaagctaatctcatggataccgaacacttccaaaacttttctatgaccaccgaccaacgcttcaatgacatccttctgcagctgtcaacactgttcagtagcgtccagggccatggaaatgctatcgatgaaatctcaaagtcgcttattagtctgaataccaccctcttagacctgcagctgaatatagagaacctgaacggcaaaatccaggaaaacacatttaaacaacaggaagagatcagtaaactggaagagagagtctacaacgtttcggcggagataatggctatgaaagaagagcaggtgcacttggagcaagaaattaagggcgaggtgaaagtgctcaataatatcacaaatgatctgcgcctgaaagactgggagcactcccagactctgagaaacatcaccctgatccaggggcctcccggaccaccaggagaaaaaggagatcggggtcccaccggtgaatccggtcccagaggcttcccaggccctatcggcccaccaggtctcaagggtgataggggcgctatcggtttcccgggttctagggggttgcccggatacgcagggagacccggtaatagcgggccaaaaggccagaagggagagaagggctcaggaaacacactaaggccagtgcagctgaccgaccacatcagagccggacccagttag

SEQ ID NO: 229197 - DNA, 1410 bp, Artificial Sequence
  Description of Artificial Sequence: Synthetic coding sequence
atgtgctacctgtctgccatcatcagtattagcctccttaacaaaaaaccatccatggagcagtgggaccacttccataatcagcaggaagataccgactcctgcagtgaatctgtgaagtttgacgctagaagcatgaccgccctgttgccacctaatccgaaaaattccccttccctgcaggaaaagcttaaatctttcaaggctgccttgattgcactgtacctactggtcttcgccgtgctcatacccttaatcggcatcgtcgcagcacagctgttgaagtgggagaccaaaaattgttcggtgtcttctaccaacgctaatgatatcacgcagtcgttgaccggcaaaggcaatgattctgaggaggaaatgcggttccaagaggtgttcatggagcacatgagtaatatggagaagcggatccagcacattctcgacatggaggctaatctcatggacaccgaacactttcaaaatttcagtatgactaccgaccaacgtttcaatgacatcctgctgcagctgtccaccctgttcagctctgtacaggggcatggaaatgcgatagacgaaataagcaagtcccttatttcactgaacacaactctattagacctgcagctgaacattgaaaatctgaatgggaagatccaagagaatacatttaagcagcaagaggagatttccaaactggaggagcgcgtttataatgtgagtgcggaaatcatggcaatgaaagaagaacaagtacacttagagcaggagataaaaggcgaggttaaggttcttaacaatatcaccaatgacctaagactgaaagactgggagcatagccagacactgagaaacattacgctcatacaaggcccacccggaccaccaggagagaagggggaccgaggtccaacgggtgagagtggaccgaggggcttcccaggtcctatcggccctcctggccttaagggagatagaggcgcaattgggttcccaggttccagggggctgccaggctacgccggtaggccgggaaattccgggcctaaaggccaaaaaggggagaaaggctctggcaatacattgaccccctttacaaaagttcgcttggttggcggaagtggccctcatgaaggacgcgttgaaattcttcactctggtcagtgggggacaatctgtgacgatcggtgggaggtgcgcgttggtcaggtggtgtgtcgctctctggggtacccgggtgtccaagcagtgcataaagctgctcacttcgggcagggcacaggccctatctggctgaatgaagtattctgtttcggaagggagtcgagcattgaagaatgtaagatccgccagtgggggactagggcctgtagccactccgaggacgccggagtaacttgcacactgtag

SEQ ID NO: 229198 - DNA, 195 bp, Artificial Sequence
  Description of Artificial Sequence: Synthetic coding sequence
atggagcagtgggaccactttcataatcagcaagaggacacagattcttgcagcgaatcggtcaaattcgatgcgcgatcaatgaccgctctgctcccaccaaatccaaagaactcaccttcactgcaggagaagctgaaatcattcaaggcggctctcattgcgctgtaccttctcgtgttcgcggtcctctag

SEQ ID NO: 229199 - DNA, 399 bp, Artificial Sequence
  Description of Artificial Sequence: Synthetic coding sequence
atggctatgaaagaagaacaggtccatcttgagcaggagattaagggcgaggtcaaggtgctgaataatattactaacgatctgcgacttaaagattgggaacacagccagactttgaggaatatcacactgatccaaggcccaccagggcctcctggagaaaagggcgatcgcggtccaacaggtgagagtgggcctagagggtttccgggacccattggtccccctggactgaaaggcgatcgcggagcaatcgggtttcctggttccaggggactgccgggttacgctgggaggcctggcaactcagggccaaagggccagaaaggagagaaggggtcagggaacacgctgagaccagtacaactcaccgaccacattagagctggtccctcatag

SEQ ID NO: 229200 - DNA, 4203 bp, Artificial Sequence
  Description of Artificial Sequence: Synthetic coding sequence
atggagctgctcccccctctgccacagagtttcctgctactccttcttctgcccgctaaacctgctgctggggaggattggcagtgcccacggacaccatatgctgcttctagagactttgacgtgaaatacgtggttccctcattttctgctggtggactggtacaggccatggtgacatatgagggagatcgtaacgagagtgccgtgtttgtcgccatcagaaacagactccacgtgcttgggcctgatctcaaaagcgtgcagagcctcgctaccggtcccgcaggagatccaggctgtcaaacctgtgctgcttgtggtcccggaccccatggcccaccgggtgacacagacaccaaggttctcgtgctggatccagccctgcctgccttagtgtcctgtggaagcagccttcagggacggtgcttccttcatgacctcgagccacagggcaccgctgtgcaccttgctgcacctgcttgcctgttttcggctcatcataacagacctgacgattgtcctgactgcgtggccagcccgctggggactagagtgaccgtcgtggagcaagggcaagccagttatttttatgtcgcatctagcctcgacgcagccgtggctgcaagctttagtcccaggagtgtctccattaggagactgaaagccgacgcctctggattcgctccaggtttcgtcgctctctcagttctcccaaaacacctagtttcatattcaatagagtatgtgcatagctttcacacaggcgcttttgtctatttcctcacggtgcagccggcttccgtgacagatgaccctagtgccctgcacacgagactggccagactgtctgctaccgaacctgaattgggagactatcgcgagctcgtcctggattgtcggtttgctccaaagaggagacgtcgtggcgctcctgaggggggtcagccttatcctgtgctacgtgtggcccactccgcccctgttggagcacagcttgccaccgagctgagcatcgctgaaggccaagaggtgcttttcggggttttcgttacaggaaaggacggtgggcctggtgtggggcctaattccgtcgtgtgcgccttcccgattgatttgttagacaccctgatcgatgaaggagtcgagcgatgctgcgagtccccagtccatccagggcttcgaagaggactggacttcttccagtctcccagtttctgccccaacccccctggcttggaggcgttatcacctaatacttcctgccgtcactttccactgctcgtctcctcctctttctcccgagtggacctgttcaatggcctcctgggccctgtgcaggtaaccgccctttatgtgacccgattggacaacgttactgtggcacatatgggcactatggatgggagaatcctgcaggtcgaattagtccggtccctcaactaccttttgtatgtgtccaatttttccctcggagattctggacaaccagttcagcgggacgtgtctaggcttggggaccatctacttttcgctagcggcgatcaggtgttccaggtgcccatccaagggcctggttgccgccattttttaacatgcggcaggtgtcttcgcgcatggcattttatgggatgtgggtggtgcggcaacatgtgcggtcagcagaaggagtgccccggaagctggcaacaggatcactgccccccaaagctcacagagttccaccctcacagcgggccactgcggggatctacccggctcactttatgcggctcgaatttttatttgcatcccagcggactcgtacctgaaggcacacatcaggtgactgtggggcagtccccatgcagacctttgcctaaagactccagtaagttgcggcctgtgccgcgtaaggactttgttgaggaattcgagtgcgaactggagcccctgggtacccaggccgtaggcccaactaacgtgtctttaaccgtgaccaatatgccacccggaaagcactttcgagttgatggtacctctgttcttcggggattctccttcatggagcctgtgttaatcgctgtgcagccactgtttgggcctcgtgccggtggaacctgcctcaccctcgaagggcagagccttagcgtggggacctctcgggcagtgctagttaacggcactgaatgtttacttgcacgggtcagtgaaggtcagcttctctgtgccactcccccaggtgcgacagtggcctcagttcccttaagcttgcaggtggggggtgcccaggtgcccggatcctggacattccagtatcgtgaagatcctgtagtcctctccatcagcccgaattgtggatacataaatagccatatcacgatttgcggacagcacctaactagcgcatggcacttggtgctttcctttcacgatgggctaagagccgttgagagccgctgtgaacgccaactgcccgagcagcaactgtgtaggctgcccgaatacgtagtgcgcgatccgcagggatgggtcgccggaaatctgtctgctcggggagacggggctgctgggtttaccctccctggatttagatttttgccgccacctcatccaccatccgcaaacctggtgcctcttaagcccgaggaacacgctatcaagtttgagtatattgggcttggtgcagtcgccgattgtgtgggaatcaatgtgacagtaggcggagagtcatgccagcacgagttccgtggcgatatggtggtttgccctctgcccccatcattgcagttagggcaggatggggcacccctccaggtgtgcgtggacggggaatgtcatatcctgggcagagtggtaaggcccggaccagatggcgttccacagtccaccctgctcggcatcctcctgcctctgctgcttctggtcgccgcactggccactgcactggtgttttcatattggtggcgccgaaaacagttagtcttgcctccaaatctaaacgaccttgcaagtttggaccagactgctggggcaacaccgctgccaattttgtactccgggtccgattaccgcagcggcctggctctgcccgctatagacggccttgatagcactacatgtgtgcatggggcttcattcagcgacagcgaggacgaaagttgcgtgccactgcttcgcaaggagtcaattcagctgagggacttggactcagctctcttagcagaagtgaaagatgttttaattccccacgagagggtagtgacacattcggaccgggtgatcggaaaaggccacttcggcgtggtgtaccacggggaatatatcgaccaggcccagaataggatccaatgtgcgatcaagagtctgagtcgaattactgaaatgcagcaagtggaggccttcctgcgagagggattgctcatgcggggactgaatcatcctaacgtcttggccctgatcggaatcatgcttcctcctgaaggtctcccacatgtgctgctcccatacatgtgtcacggtgacctgcttcagtttatccgcagcccccagcggaatcccaccgtaaaggacctcatttcttttggtctgcaggtggcacgttcgatggaatacctggcggagcagaaattcgtccacagagacctggccgctcgcaattgtatgctagacgaatccttcacagtgaaggttgctgactttgggctggctcgcgatattttagacagagagtattactccgtgcagcagcaccgccatgccaggttacctgtgaagtggatggctttggagagcttacagacatatcgcttcacaacaaagagtgacgtttggtcctttggcgtcctactgtgggagttacttactagaggggctcccccatatcggcatatcgatccattcgacctgacacactttctagcccagggcagaaggctaccccagcccgaatactgtcccgatagcctataccaggtgatgcagcagtgctgggaagcagacccagccgtgcgtcccaccttccgcgtgcttgtcggtgaggttgaacaaattgtctcagccctcctgggggatcactatgtccagctccccgctacatacatgaacctgggacccagcacatcacatgaaatgaatgtccgccctgaacagcctcagttttccccaatgcctggcaacgtgcgcagacctcggccactgagcgagccaccacgacccacctag

SEQ ID NO: 229201 - DNA, 4056 bp, Artificial Sequence
  Description of Artificial Sequence: Synthetic coding sequence
atggagttgctccctcctctccctcagtcgttcttgctgctgctgctgctgcccgctaagcccgctgccggagaggactggcagtgccctaggaccccttacgccgcttccagagattttgacgtgaaatacgtggtgcccagcttcagcgcgggaggcttggttcaggcgatggtcacatatgaaggggaccgcaacgagtctgctgtgtttgttgccattcggaaccgcctccacgtattggggcctgatctcaagtctgttcagtccctggccacggggccagccggagaccccggatgtcagacatgtgcggcttgcggcccaggcccacatggcccaccgggagatacagataccaaggtgttagtactcgacccagctctacctgccctggtgtcatgcggcagttctctccaaggacgttgcttccttcatgatctggagccgcagggcactgctgtccaccttgcagcacccgcttgcttgttctcagcccatcacaatagacctgacgactgcccagattgtgtggcctctccgctcggcacacgcgtgacggtggtggagcagggccaagcctcctacttctacgtcgcgagtagcctagacgctgccgtcgccgcaagcttttccccccgttctgtgtccattcggcgattgaaggctgatgccagtgggtttgccccagggttcgtggcattgtctgtgctgcctaaacacctggtatcctacagcattgagtatgtgcactcattccacacgggagcatttgtctactttttgacagtccagcccgcaagtgtgaccgacgatcctagcgccctccacacccggctagccaggctgagtgctaccgaacccgagctgggcgattatagagaactggtgttggattgcagatttgcacccaaaagacggcgaagaggcgcacctgagggtggacagccttacccagttcttagagttgctcattccgctcccgtgggagcccagctggcaactgagcttagcattgccgagggacaggaagtactgttcggcgtgttcgtgaccggcaaggatggcggacccggagtaggcccaaattctgtggtttgcgcatttcccattgatctgctcgacacccttatagacgaaggagtggagaggtgttgcgagtctcccgtgcatcccggacttaggagagggttggactttttccagtccccctccttttgccccaatcctccagggcttgaagcactgtctccaaacacgagttgtcgccacttccctctgcttgtgagctctagcttctctcgcgtggacctcttcaatggcctgctgggcccagttcaggttaccgccttgtatgtgacaaggttggataatgtaaccgtggctcacatggggaccatggacgggagaattctccaggtcgaacttgtccgtagtctaaactacctgctgtacgtaagcaacttctcccttggggacagtggtcagccagttcagcgagacgttagccggctgggcgaccatctgttgtttgcttccggtgatcaggtgttccaggttcctatccaagggccaggttgtaggcacttccttacttgcggccgttgcttacgagcctggcactttatggggtgcggatggtgtgggaatatgtgcggccaacagaaggagtgtccgggttcatggcagcaagaccactgtcccccaaagctcacagagtttcatccccacagtggcccactgaggggtagtactcgcctgaccctctgcgggagtaatttttatctgcaccccagtgggcttgtgccagaaggtacccaccaagtcaccgtggggcaatccccttgtcggcctctgccaaaagattcatctaaactaaggccagtgcccagaaaagattttgtggaagagttcgagtgcgagttggagccacttggaactcaggcagtgggcccaacaaatgtgagcctgacagtgaccaacatgcctccaggcaaacacttccgtgtggatgggaccagtgtcttgcgtggcttcagctttatggaaccagtcctcattgcagtgcagcccctgtttggcccacgtgcaggaggaacctgtcttacactggagggacagtcgctatcagtgggaacaagcagagctgttctggtaaatggaactgagtgcttgctcgctagagtgtcagaagggcagcttctttgtgctacacccccaggcgctaccgtagcatccgtccccctctcacttcaagttggcggagctcaggtcccgggttcctggacctttcagtaccgcgaggacccggtggtgctgtccattagccccaattgtggttacatcaacagccacatcacgatctgtggccagcacttgacaagtgcctggcatctggtgcttagttttcacgatggtctgcgcgctgtggaatcccggtgtgaaagacaactgccagagcagcaactatgtaggctgcccgaatatgtggtccgcgacccacagggctgggttgctggaaatctcagtgcacgcggtgatggcgctgccggattcacattgcccggtttcagatttttgccacctccacatccaccctcagcaaatttagtgcccttgaagccagaggagcacgcaatcaagttcgaagtatgcgtggacggcgaatgccacatactgggccgtgtggttcgaccgggtccagatggcgtgccccaatccactctactagggatactcctgcctttgcttctactagtcgccgcactggccactgctctcgtcttctcctactggtggcgcagaaagcagttagtgcttcccccaaatctgaacgatttggcttctctggaccagacagcaggagcaacgccactgccaatcctgtactcgggttctgattaccggtcaggtctagccctgcccgctatcgacggactggattcaacgacatgcgttcacggggcaagcttttcagatagtgaggacgaatcttgcgtgccgctgcttaggaaagagtctatccaactgcgcgatctcgatagcgcgttgttggctgaagtcaaggacgtactgataccacatgagagagtagtcactcattctgatcgagtgattgggaaggggcattttggcgtggtgtaccacggggagtacatcgatcaggctcagaatcggatccagtgtgccattaagtctctaagtcgcattactgagatgcagcaggtggaggcctttttgcgcgaaggactgctaatgaggggactaaatcacccaaacgtgctggcgctgattggcattatgctgcctccggagggactgccccacgtgctcctcccttatatgtgtcacggcgacctcctgcaatttatcagaagcccccagcgaaatcctaccgtgaaagatctgatatctttcggcctgcaggtcgcaagatctatggaatatcttgcagaacagaaattcgtccaccgggatctcgctgcccgaaattgtatgctggatgagtccttcacagtgaaggtagcagatttcggcctcgccagggacatccttgacagggaatattacagcgtgcagcagcatcggcacgcccgtctcccagtgaaatggatggctctcgagtcactccagacgtaccgattcacgaccaaatctgacgtgtggagcttcggcgtactcttatgggaactgctcactagaggagcaccgccataccggcacattgacccatttgacttgactcacttcctggcacagggaagaagactcccgcagcccgaatactgtcccgattccttataccaggttatgcagcagtgttgggaagcagacccagcggttcgaccaacatttagggtgttagtgggggaggttgaacaaatagtgtctgctctgcttggcgatcactatgtacagcttcccgctacgtatatgaatctgggaccgtccacttctcacgaaatgaacgtaagaccggaacagccacaattcagtcccatgcccggaaacgtgcgccgaccccgaccactgtccgagccccctcggccaacttag

SEQ ID NO: 229202 - DNA, 2157 bp, Artificial Sequence
  Description of Artificial Sequence: Synthetic coding sequence
atggaagacctgggcgagaacactatggttttatcgacactgcggagtctgaataactttatctcccagagagttgagggaggatcaggtcttgatatcagcacgagcgccccagggagcttacaaatgcaataccagcaaagcatgcagctggaggaacgcgcagaacagatccgaagcaaatcacacctgattcaggtagaaagagaaaaaatgcagatggaactgtcacacaaaagggccagagtggaactcgagagggctgcctcaacgtccgccaggaattacgaacgtgaagtggatcgcaaccaggaactcctgacacggattagacagctgcaggaaagagaggcgggagccgaggaaaaaatgcaggagcagctggagcggaacagacagtgtcagcagaatttggacgccgctagtaagcgactgagggaaaaagaagacagtctcgcacaggcaggagagacaataaatgcgctcaaagggcgtatcagtgagctgcaatggtcagtaatggatcaggagatgcgtgtgaagagattagaatccgaaaaacaagagctgcaagagcaacttgacctgcagcataaaaaatgtcaggaggcgaaccagaaaatacaggaacttcaagcctcgcaggaggcaagggctgaccatgagcagcaaatcaaagaccttgagcagaaactttccctgcaggagcaagatgccgcaatagtgaaaaatatgaaatcagagcttgtccgtctacctaggttagaacgagagctcaaacagctaagggaggagtccgcccacttgcgagaaatgagagaaaccaacggcctcctgcaagaagaactggaaggactgcaaaggaaactgggccgtcaggaaaagatgcaggaaacgctggtgggactggagttggaaaatgagcgccttttagctaagctgcagtcctgggagcgtctggatcagactatgggcttaagcatcagaaccccagaagacctcagtagattcgtggtagaattgcaacagcgggagcttgcactcaaggataagaatagcgctgtgactagcagcgctagagggttagagaaggccaggcagcaattgcaggaggagctcaggcaagtatcaggccagctgttagaggagagaaagaaacgcgaaactcatgaagcccttgccaggaggctgcagaaaagagttttgctgctgaccaaggagcgggatggcatgcgtgccatcttgggatcatacgacagtgaacttactcccgcagagtatagcccacagctcacacgcagaatgagagaagctgaagatatggttcaaaaagttcactctcattccgccgagatggaggctcagttatcccaggcccttgaggagcttggcggacagaaacagagagcagatatgcttgagatggagttaaagatgcttaagtcccaatcatccagcgcggaacagagtttcctattctctagagaggaggccgacaccctacggttaaaggtggaggagcttgaaggggaacgaagccgcctcgaggaagaaaaacgcatgctagaagcccagctggagcggagagccctgcagggtgattacgatcagtctagaacaaaagtgttgcacatgtctctgaatcccacaagcgtcgccagacagaggctgagagaagaccatagccaactccaggcagaatgcgaacggcttcggggactgctgagagccatggaacgcggaggcacagtcccagcagaccttgaagccgctgcagccagccttccatcgagtaaagaggtcgccgagctgaagaaacaggtcgagtcagccgagcttaaaaaccaaaggctgaaagaagttttccagactaagatccaggaattccgcaaagcctgctataccctgacgggttaccagatcgacatcaccaccgagaatcaataccggttaacgagcttatatgccgaacaccccggagactgcctcatcttcaaagcaacatcccctagcggctcgaagatgcagctgctagaaacagagttcagccacactgtcggagagctcatcgaggtgcacctcaggaggcaagatagtataccagcattcttgtcgagtctcaccctggagttgttctcccgacagacagttgcttag

SEQ ID NO: 229203 - DNA, 2157 bp, Artificial Sequence
  Description of Artificial Sequence: Synthetic coding sequence
atggaggatctcggagagaataccatggtgttgagcacactcaggtccctgaacaattttatttctcaacgtgtggagggcggttcagggctcgatatctccacgagcgctccgggttctctccagatgcagtatcaacagagcatgcagttggaggagagggccgagcaaattcgatccaagtctcatctgatccaagttgaacgagaaaagatgcagatggagctttctcacaaaagagctcgggtggagctcgagagagcggcttctaccagcgcacgaaattacgaaagggaggtcgatagaaatcaggagctcctgacccgcataagacaactgcaagaacgggaagccggtgccgaggaaaaaatgcaagaacagctcgaacgcaaccgccaatgtcagcagaatctagatgcagcatcaaaaagattgcgggagaaggaagacagtctggcccaggcaggcgagaccattaacgccctgaaaggtaggataagcgagctccagtggagcgtgatggaccaagaaatgcgagtaaagagactggaaagcgagaaacaggaactccaggagcagctcgacctgcaacacaaaaagtgtcaggaggctaatcagaaaatccaagagctccaggccagccaagaagctcgcgctgaccacgaacagcagataaaggatctggagcaaaaactatcactccaggagcaggatgcagctatcgtcaagaacatgaaatctgaactggtcaggttgccaaggctggaacgagaactcaagcagctacgcgaagagtccgcccaccttcgtgagatgcgtgagaccaacggtctcctccaggaggagctcgagggcctacagcgcaaactgggtcgccaagaaaagatgcaagagaccttggttgggcttgagctcgagaatgagcgactactcgctaaactgcagagctgggagcggttggatcaaacaatgggcctctctatacgcacaccagaggacctgagtcggtttgttgtggaactacaacagagggagctggcactcaaagacaagaacagcgctgtgacgtcctctgcacggggattggagaaagcccgtcagcagttacaagaagaactgcgacaagtgtctggtcagttgctggaggaacggaagaagcgcgagacacacgaggctttggctcgccgtctccaaaagcgtgtcctgctgcttacaaaggagagagatggaatgagagccatactaggttcatacgatagtgagctgacacctgcggagtacagtccacaactgacaagaaggatgagggaggcagaagacatggtccagaaagttcattctcacagcgccgagatggaggcacaactgtctcaagccctcgaagagctggggggacagaagcaacgcgcagatatgttggagatggagctgaagatgttgaagtcacagtcctcctcagccgaacagagcttcctgttttctagagaagaggccgacaccctgcgattaaaagtcgaggagctcgagggggagagatcacggctggaagaagagaaaagaatgctggaagcgcagctcgagaggagggctttgcagggcgactatgaccagagtcgcacgaaggttttgcacatgagtttaaacccaacaagcgtagcgaggcaacgcctaagagaagaccactcccaattacaggcagaatgtgagcgcctccgcggtcttctacgggctatggaacgtggcggaacagttcccgctgatctggaggctgccgcagcatcgctgccctccagtaaagaggttgcggagctaaagaaacaggtggaatctgccgagttgaagaatcaaagactgaaagaggtatttcagacaaaaatacaggagttccgcaaagcatgttacactttgactggctaccaaatcgatatcacaaccgagaatcagtatcggcttactagcctgtacgcagaacaccctggcgattgtctgatttttaaggcaacctccccaagcggcagcaagatgcaactgctggagaccgagttttcacatactgtgggcgagctgattgaggtgcacctgagaaggcaggattccatccccgcttttctcagttctctgaccctcgaactttttagcagacagacggtggcctag

SEQ ID NO: 229204 - DNA, 1881 bp, Artificial Sequence
  Description of Artificial Sequence: Synthetic coding sequence
atgctgcctgccagaggatgcgtaaggaagaggacagtctggcctcggctcgcgcgagtgttgatcgtaactctgcttacactagaactcagctacgctcccctgccctgtcagctaagtggtgtgccatacaacactggagatcctgttggtcgttgggcgagaccttgtatatggccatgtccctggcacacaactatcaatgcgcttaagggaagaatctccgaactgcagtggtcagtaatggaccaagaaatgagagtgaagcgacttgagtctgagaagcaggaactgcaagaacagcttgacctccagcacaagaaatgccaggaggctaatcagaagatccaggagttgcaggcgagccaagaggctcgcgcagatcacgagcaacagataaaggacctggaacagaaactgtctctccaggaacaggatgcagcaattgtcaagaatatgaaatccgaactagttaggctgcctaggcttgagagagagctcaagcagctccgcgaagagtcggctcacttgcgcgaaatgcgtgagaccaacggactgctccaggaagagttggagggactgcagcgcaagttagggcgtcaagagaagatgcaggagaccttggttggactggaacttgagaacgaaagactccttgctaaacttcagtcttgggagcggttagaccagaccatgggcctttccattcgcaccccagaggacttgtctaggtttgtagtcgaactgcagcagcgcgagctggccttaaaggataagaattccgcagtgacatcaagtgctaggggcctggaaaaagcacgccaacagctgcaggaggagcttcgccaggtgtctggtcaactcctggaagaacgaaagaaaagggagacccatgaggccctcgccaggcgcctgcaaaagagagtgctgctcttgactaaggagagagatgggatgcgggctattctcggctcctacgacagtgagctcacccctgccgaatatagccctcagctgaccagacggatgcgcgaagcggaggacatggtccagaaggttcactcgcattctgctgaaatggaagcccaactgagtcaagcacttgaagagcttggaggccagaaacagcgcgctgacatgctggaaatggagctgaagatgctcaagagccagtcttcatccgccgagcaaagcttcctgttctcacgcgaggaggccgacacactgcgcctgaaagtcgaggaactggagggtgaacgctcacgcctggaagaagaaaagcgtatgttagaagcccagctggagaggcgcgcactgcagggagactatgaccagtctcgcacgaaggtgctccacatgagcctgaaccccacctccgtggcccgacagcgactgcgtgaagaccactctcagctacaagccgaatgtgagagactacgaggtctcctgagggcaatggagagaggtggcactgtgcccgctgacctcgaggcggcagctgcttcactcccatcctcaaaggaggtagcagagctgaagaaacaggtggagagtgcggagttgaaaaaccaacggttaaaagaggtctttcaaactaagattcaagaattccggaaggcctgctatacactgacaggttaccagattgatatcacgacggagaatcagtacagactgactagcttgtacgcagaacacccaggtgattgtctgatctttaaagccacctctccaagcgggtcgaagatgcagctgctagaaactgagtttagccacactgtgggagagctcatcgaggtgcacctacgacggcaggacagcatcccagcattcctatccagcctgaccctggagttattttctcggcagaccgtcgcctag

SEQ ID NO: 229205 - DNA, 2157 bp, Artificial Sequence
  Description of Artificial Sequence: Synthetic coding sequence
atggaagacctcggggaaaacaccatggtgctctcgacccttcggtctctgaacaacttcatctcacagcgggtggaaggcggatccgggttggatatctctacaagcgctcctgggagcctgcagatgcagtaccagcaaagcatgcagctggaagaacgtgcagagcaaattcgctccaaatctcacctgatccaggttgagagggagaaaatgcagatggagctgagccataagcgggcaagagtggagctggaacgagctgcatctacatccgccaggaactacgaaagagaagttgatagaaatcaggaattactgacacgcattagacagctacaagaacgggaggccggtgcagaagaaaagatgcaggagcagttggagcgaaaccgccagtgccaacagaacctcgacgcagcatccaagcggctgcgagagaaggaggactccctagcacaggcaggagagacgataaacgcactgaagggacgaatttccgagctccagtggtctgtgatggaccaggaaatgcgcgtaaagcgcctagagagcgagaagcaggaattacaggagcaactcgacctgcagcacaaaaaatgccaggaggcaaatcagaaaatccaagaactgcaagcttcccaggaggctcgggctgatcacgagcaacagatcaaagacctagagcagaagctgagcctgcaagaacaggatgccgcaatcgttaaaaacatgaaatccgaactggtgcgactcccgcgtttagagagagagctgaaacagctgcgggaagaatcagctcatctgagggagatgcgggaaacgaacggactcctccaggaggagctcgaagggctgcagaggaaactgggcagacaggaaaaaatgcaggaaaccctggtcggcttggaattggaaaacgaaagactattagcaaaactacagagttgggaacggctggatcaaacaatggggctgtcaatccgaacacctgaagatctgagtcggtttgtggtcgagttgcagcaacgtgaacttgctctgaaggataagaattctgctgtcacatctagcgccaggggcttggagaaggcacgacagcagctgcaggaagagcttcggcaggtttccggacagcttctggaagaaagaaagaaaagggaaacgcacgaggctctggccaggcggctgcagaagcgcgttctgctgttgaccaaggagcgagacgggatgcgtgctatcctgggctcatatgattcggagctcacccctgctgaatatagccctcaactgacacggcgaatgagggaagccgaggacatggtgcagaaagtccacagccacagcgctgaaatggaagcccagcttagtcaggctttggaggagctcggagggcaaaaacagcgcgctgacatgctggagatggagctcaagatgctcaagagtcagagctcaagcgctgagcaatcttttctgtttagccgggaggaagcggacactctccgcctcaaggtcgaggaattagaaggcgagaggagtcgcttggaggaggagaagaggatgctggaggcccagctggagagacgtgcgctgcagggggactacgatcaatcccgcaccaaagtgctgcatatgtccctgaacccaacatctgtggctaggcagcggttacgggaggaccactcacaactgcaggccgagtgcgagcgcctaagaggcctcctgagagctatggaaagagggggtactgtgcctgcagacctggaagccgcagcagcctcgttgccttcatccaaggaggtggctgagttgaagaagcaggtggaatccgcagaacttaagaaccagcgactcaaggaagtgttccagactaaaattcaagagttccgaaaggcctgttacacactgacgggttaccagatcgacatcacaaccgagaatcagtacaggctcacctccttatatgccgagcacccgggtgactgtcttatctttaaggccactagtccgagtggctcaaagatgcagttactggagacggagttctctcacactgtgggagagctcattgaagtgcatctgaggcggcaggattcgattcccgcattcctgtctagcctgaccctggagctcttctctaggcagaccgtggcttag

SEQ ID NO: 229206 - DNA, 474 bp, Artificial Sequence
  Description of Artificial Sequence: Synthetic coding sequence
atggaggatcttggagagaatacaatggttctatcaacactgcgcagcctcaacaacttcatctcccagcgggtcgaggggggttcgggacttgatatttcaacaagtgcccctggcagcttacagatgcagtaccagcagtcgatgcagctggaggaaagggcagagcagattcggtctaagagccatcttatccaggttgaaagggagaagatgcaaatggagctgtcccataagcgcgctcgcgtagagctggagcgcgctgcttctacatccgctaggaactacgaaagagaagttgataggaaccaagaactgctgactcggattaggcagttgcaggaaagggaagccggagcagaagagaaaatgcaagagcagctggaaagaaataggcagtgtcagcagaacctggatgctgcatctaagaggttgcgggaaaaggaggatagcttagcccaggcgggtgaatag

SEQ ID NO: 229207 - DNA, 810 bp, Artificial Sequence
  Description of Artificial Sequence: Synthetic coding sequence
atgcgtgagctcgagtttgccaagctggagtgctgtctagcatggcagctgcaagcttctagaagagagcttgagatggaacttaagatgctgaagtcacagtcctcctctgctgagcaatccttcctgttcagcagagaggaagctgacaccctgcggttgaaagttgaagaactggaaggcgaaagatcaagactggaagaggagaaaaggatgctggaggcccagcttgagaggcgtgccctacagggcgactacgatcagagtagaacaaaagtcttacacatgtccctcaatcccacatccgtcgctcgccagcgacttcgggaagaccattctcagctgcaagccgaatgcgaacgcctgcgcggtctcctgcgagctatggagagggggggtaccgtgcctgccgatctggaagctgccgcagcttcccttccgtcaagcaaagaagtagccgagctgaaaaagcaggtcgaaagcgccgaactgaagaaccaacggttaaaagaggtgtttcagacaaaaatccaggaattccggaaagcctgttatactcttacaggataccagatcgatattacgacagaaaatcagtaccggctgaccagtctctacgctgagcacccaggggactgcctgatctttaaagctaccagccccagcgggagcaagatgcagctattggaaaccgaatttagccacactgtcggagaactcatagaagtgcatctgcgtcggcaggactccatcccagcctttctgtcttcgctgactttggaattattttcaagacagacagtcgcgtag

SEQ ID NO: 229208 - DNA, 618 bp, Artificial Sequence
  Description of Artificial Sequence: Synthetic coding sequence
atggccctgcagcttagtcgggaacaggggataacactgaggggcagcgcagagatcgttgccgagttttttagcttcggcattaatagtatcctttatcaacgagggatatatccgagcgaaacatttactagggttcagaagtatggcctgactcttttagtcaccacggatttggagctcatcaagtatctgaacaatgttgtggagcagcttaaggactggctgtacaaatgttcagtgcagaagttggtcgtcgtgatttctaatattgagtcaggtgaggttctagagagatggcaatttgatatcgaatgtgacaaaactgccaaggacgattcagcgcctcgcgaaaagtcacagaaggcaatccaagacgagatccgctctgtgattcggcaaatcacagcgaccgttacattcttgccactgttggaggtgtcatgctctttcgacttgctaatctacacagataaggacctggtcgttcctgagaagtgggaggaaagcggaccacagtttatcacaaacagcgaagaagttcgcctcaggagcttcaccaccaccattcacaaagttaactctatggtcgcttacaagatccctgtgaacgactag

SEQ ID NO: 229209 - DNA, 1212 bp, Artificial Sequence
  Description of Artificial Sequence: Synthetic coding sequence
atgcctaataggaaggcaagtaggaatgcttattactttttcgtccaagagaagatcccggagttacgccgtagaggtctgccagtcgctcgggtggccgatgctataccctactgtagctccgactgggcaaaacctgtatttacaccgttgcggaggcccggaatgctcgtcccaaaacaaaatgtcagcccccctgatatgagtgctctaagcttgaaaggggatcaggccctgctcgggggtattttttacttcttaaacattttctcccacggggaactgcctcctcattgcgaacagagattcttgccatgtgagataggatgcgtgaagtactcgctgcaggaaggaatcatggccgatttccatagcttcatcaacccaggtgaaattcctagggggtttcgctttcattgccaggcagcaagcgactcatctcacaagatcccaatatccaacttcgagcgtgggcacaaccaggccaccgtgcttcagaacctttaccgcttcatccaccccaacccagggaattggccacccatctactgcaagtccgacgatcgcactcgtgtgaactggtgtctgaaacacatggccaaggcatccgagatacgacaggatctgcagctgttgaccgtggaagatctggtggtggggatttatcaacagaaatttcttaaagagccctctaagacttggattagaagtctgttggatgtggctatgtgggattactcctcaaatactagatgcaaatggcacgaggagaatgacatcctgttttgcgctctcgcggtctgtaagaaaatcgcctactgcataagtaattctctggccacccttttcggaatccaacttactgaagctcacgttcctctgcaggattacgaggcctctaattcggtcacccccaaaatggttgtcttggacgcgggtcgctaccagaaactacgtgttggtagcagtgggttctctcactttaattcttctaacgaggaacaaagatcgaacacgcccatcggggactatccatcccgagctaaaataagcggacagaactcctccgtgcgtgggagaggtattacaaggctgttggagagcattagcaattctagcagtaacatccacaaattctccaattgcgacacatccctctccccttacatgagccagaaggatggttacaagagcttttcatcactatcctag

SEQ ID NO: 229210 - DNA, 1305 bp, Artificial Sequence
  Description of Artificial Sequence: Synthetic coding sequence
atgccaaaccgaaaagcgagccgtaatgcctattacttcttcgtgcaggaaaaaatccccgagttgcgaaggcgtggactccctgtcgccagagtcgccgatgcaatcccttattgctcctcagattgggctcttcttcgggaggaggaaaaggagaagtatgcagaaatggcacgcgaatggcgcgctgcgcaagggaaagacccaggaccgtccgaaaaacaaaagcccgtcttcactcctctccggaggcccggaatgctggtgcctaaacagaatgtgtccccccctgacatgtcagccttgtcattgaagggggatcaggccttactgggcggaattttttattttctcaacattttctcccatggggaactgccacctcattgcgaacaacgattcctgccctgtgagatcgggtgcgtgaagtactctctccaggaggggattatggccgatttccactcatttatcaatcctggtgagattcctcgcggatttcgcttccattgtcaagcagcttccgactcaagtcacaaaattcctattagcaactttgaacggggacataaccaggcaaccgtcctccagaacctgtatcggtttattcatcctaaccctggtaactggccacccatttactgcaagtccgatgatcggaccagagtaaattggtgtcttaagcatatggcaaaagcttccgaaatccggcaggacctccagttgttgaccgttgaggacctcgtggtgggtatttatcaacagaaatttctgaaggagccctctaagacctggattagatctctgttggacgtggctatgtgggattattcatcaaacacacgttgcaaatggcacgaggagaatgacatattgttctgcgcactggccgtgtgtaagaagatcgcttactgtatcagcaatagcttggcaaccctatttggcatccagttgactgaggcccacgtcccactgcaggattatgaggcatccaattctgtcacgccaaagatggtcgtgttagatgccggtcgatatcagaagctgcgggtcggatctagcggatttagccatttcaactcctcgaacgaggagcaaaggtcgaatactcccatcggtgactacccatcacgagctaagatctcagggcaaaattcctctgtgcgcggtagaggtattacccggctcctcgagtctatttctaacagctcaagtaatattcacaaattctctaactgcgacacctccctgtcaccctatatgtcacaaaaggatgggtacaagtcattctcatccttgagttag

SEQ ID NO: 229211 - DNA, 951 bp, Artificial Sequence
  Description of Artificial Sequence: Synthetic coding sequence
atgccaaacaggaaagcttccaggaatgcttactacttttttgtgcaggagaaaattccagagctaaggcgtaggggcctccccgtagctcgagtggcagacgcaatcccctattgttcatcagactgggccaaacctgttttcacccccctgaggcgtcctggaatgctcgttcccaaacaaaatgtgtcacccccagatatgtccgcactctccctgaagggcgaccaagcactgcttggaggaatcttttatttcctcaacatcttctcacacggggagctgcctcctcattgtgagcaacggtttctcccatgcgaaattggttgcgttaagtactctctgcaggagggtattatggccgacttccatagttttatcaaccccggagagattcctcgagggttccgatttcattgccaggcagcttctgactctagccacaagatacctatcagcaacttcgaaaggggccacaatcaggccaccgtgctgcagaacctgtaccgctttatccatcctaacccgggtaactggccgccaatttactgtaagtcggacgatagaacccgcgtaaactggtgtctcaaacatatggccaaggctagcgagattaggcaggacctgcaacttctcactgtggaagatcttgtggtgggaatttatcagcaaaaatttctgaaagaaccgagtaagacctggatcaggtctctgcttgacgtggctatgtgggattatagctctaataccagatgcaagtggcatgaggagaatgatattcttttctgcgccctagccgtctgcaaaaaaatcgcatactgtatttccaattcactcgccaccctctttgggatccaactgactgaggcccacgtaccgctccaggactatgaggcctcaaactcagtcaccccaaagatggttgtgctcgatgctggcaggtatcaatag

SEQ ID NO: 229212 - DNA, 471 bp, Artificial Sequence
  Description of Artificial Sequence: Synthetic coding sequence
ctgctgcaaaggtgcaagtggcatgaagaaaatgatattctgttttgtgcactggcggtgtgcaagaagatcgcatactgcatatctaactcgctcgctacactgttcggcatccagctcaccgaggcccacgttccactgcaagattatgaggcatcaaatagcgtgacaccaaaaatggtcgtgctcgatgctgggaggtatcagaaactcagggtgggctcatcagggttctctcactttaatagcagcaatgaagagcagaggtcaaacacacccattggcgactatccgtcccgggctaaaataagtggtcagaatagcagtgtgcgcggaaggggaattactcgcctgttagagtccattagtaattcttcgtccaacatacacaaattcagcaattgcgacacgagtttatcaccttacatgagtcagaaggacggttacaagtccttctctagcctatcctag

SEQ ID NO: 229213 - DNA, 747 bp, Artificial Sequence
  Description of Artificial Sequence: Synthetic coding sequence
atggaccagagacagagacggatcctgggacagccactctctatccctacatcccaacccaaacagaaacgcacttcaatgatttcttttttcagcaaagtaagctggaaattacgctttcagaagcgcgagcctcttaaaaatgtgttttttatactagccgagagggccagggatccctcggctaagaaacgacatatggctatgcgcaacttagggaccatggcttatgaggcccctgacaaagtgaggaagtataaaaaaattgttctcgacctgctcgtgtatggtctctatgaccctgtgaacctggaggtgattcacgagtccatgaaaacgctgactgtggtcttgggcaaaatccagggcaagggcttaggctcatttttcatcgatatcacgctgcagactcggaccctcctcgacgatgagaacgactcattgcggtacagcgcctttgtgctgttcggccagctggctgctttcgccggacgcaaatggaagaagtttttcacatctcaggtaaaacagacaagggatagcctacttattcacctgcaggatagaaatccacaggttgcgaaagcgtgtaaaacaacctttcaagcctgctctccatatttaaagttgaaggaagagtactcctttcaatctgaagaggatcagcgcaatactaaactctatcaacaactgagtcactatcatccagagattctgcaattcttctacgcaaataagattttgtag

SEQ ID NO: 229214 - DNA, 747 bp, Artificial Sequence
  Description of Artificial Sequence: Synthetic coding sequence
atggaccagagacagcgacgcatcctcggacagcccctgtcaataccaacaagccagccaaaacaaaagcgcacttctatgatctctttttttagcaaggtgtcctggaaattgcgcttccagaaacgcgagcccttgaaaaacgtgtttttcattttggcagaaagggcccgtgacccatctgccaagaagaggcacatggcgatgcgcaacctcggcaccatggcctacgaggcgccagacaaagtgcgaaagtacaagaaaatcgtgctggacctgcttgtgtacggtctatacgaccccgtcaacctcgaggtaatacatgaaagcatgaaaaccctgacagtggtgctcgggaaaatacagggtaagggcttaggatcattcttcattgacattactctacagacgaggaccctgctcgacgatgagaacgattctcttcggtattctgcctttgttctgttcggtcagcttgcagcattcgctggtagaaagtggaaaaagttcttcacatcccaagttaagcaaaccagagattccttactcatccacctacaagaccgcaatccccaggtggctaaggcttgtaagactacctttcaagcctgctcgccatatctcaagcttaaggaggagtattcctttcagagtgaagaggatcaacgcaacactaaattgtatcagcaactgtcccattatcaccccgaaattctccagtttttttacgcgaataagatcctatag

SEQ ID NO: 229215 - DNA, 591 bp, Artificial Sequence
  Description of Artificial Sequence: Synthetic coding sequence
atggatcagcgccagagaaggatcctgggccagccactttctatacccaccagccagcctaagcagaagagaacttctatgatttcctttttttccaaagtctcttggaagttgcggtttcagaaacgggaacccttgaaaaacgtgttttttattctggccgagcgcgctcgagatccgtcagctaagaagagacacatggcgatgcggaatttagggacaatggcttatgaggctcctgacaaggttcggaagtataagaagatcgtactggacttgctggtgtacggcttgtacgacccagtgaatttggaggtgatccacgagagcatgaaaacgttgacagtagtgctgggcaaaattcagggaaagggtcttggatctttttttatcgatatcaccctccaaaccaggactctcctagatgatgcctgcaagacaacattccaggcatgttccccttatttaaaattgaaggaagaatattctttccaaagtgaagaggatcaacggaacacaaaactgtaccagcagttaagccactatcacccagaaatcttgcaatttttctacgctaacaaaatactgtag

SEQ ID NO: 229216 - DNA, 633 bp, Artificial Sequence
  Description of Artificial Sequence: Synthetic coding sequence
atggcttggggttcgaaaggaatccagggctgggagaatttagcagagagctctcatctggctacaacacgggagtcaagcccacctgaatcagggaccgggagcgggtccagcaggggctcaaggctacaggagccgcaggtttcgtggaagcttcgttttcagaagcgcgagcctctaaaaaatgttttttttatcctagcggaacgggctagagacccctcagctaagaagcgccacatggccatgagaaacctcggtaccatggcctacgaggcccctgacaaggtccgtaagtataagaaaattgtgctggacttgcttgtatacgggctgtacgatccagtaaacttggaggtgatccacgagtccatgaagaccttaacagttgtgctgggcaaaatccaaggtaaggggttgggcagcttcttcatagacatcactcttcagactagaaccctgttggacgatgcgtgcaaaaccaccttccaggcgtgctccccctatctcaaattgaaggaagagtactccttccaatccgaggaggatcagaggaataccaagttgtatcaacagctctcccattatcaccctgagatcctccagtttttctacgccaacaaaatcctgtag

SEQ ID NO: 229217 - DNA, 789 bp, Artificial Sequence
  Description of Artificial Sequence: Synthetic coding sequence
atggcctggggatccaaaggtattcagggctgggaaaatctcgcagagtcctctcacctcgccactacccgggagtcatctccccctgaaagcgggactgggagcggaagctcaagaggtagccgattgcaagaaccccaggtctcttggaagctgaggttccagaagagggagcctctgaagaatgtgttcttcatattggccgagagagcacgggacccaagcgctaagaagaggcacatggccatgagaaacttaggcactatggcttatgaagccccagataaagtcaggaagtataagaagattgtcttggaccttctcgtttacggcctgtatgatcccgtgaatcttgaggtgattcacgaatctatgaagactctgactgtcgtgctcggcaagatccagggaaaggggctcggcagtttttttatagatatcaccctacagactcggacacttctcgacgacgaaaatgattccctcaggtatagcgcatttgttctgttcggtcaactcgctgcttttgctgggcgaaaatggaagaaattcttcacgtcccaggtcaaacagacgcgggattccctgctgatccacttacaggatagaaacccacaggttgctaaagcatgcaaaactaccttccaggcttgtagtccgtatcttaaactaaaagaggagtattctttccagtctgaagaggaccagagaaataccaaattatatcagcagctatcgcattatcacccagagatcctgcagttcttttacgcaaacaaaattctctag

SEQ ID NO: 229218 - DNA, 591 bp, Artificial Sequence
  Description of Artificial Sequence: Synthetic coding sequence
atggaccaacgtcagcgcaggattctaggtcagcctctgtccatccctactagccagccaaaacagaagcgcactagtatgattagtttcttttcaaaggttagttggaagctgagatttcagaaacgggagccacttaagaatgtgtttttcatcctggctgaacgcgcacgcgacccatcagctaaaaagcgtcatatggccatgcgaaacctaggaaccatggcatatgaagcacctgataaagttcgcaaatacaagaaaatagtgctagatctgttagtgtacggtttatacgatcctgtgaatctggaggtgatacacgagtcgatgaaaacactgactgttgtcctgggtaaaatacaggggaaaggactggggagcttcttcatcgacataaccttacagactcggaccctcctcgatgatgcgtgtaaaacaacatttcaggcctgttccccctatttgaaactgaaagaggaatacagttttcagtccgaagaggatcagcgcaatactaagctgtaccaacaactgagccactatcaccctgagatcctgcagttcttttacgccaacaaaatcctatag

SEQ ID NO: 229219 - DNA, 771 bp, Artificial Sequence
  Description of Artificial Sequence: Synthetic coding sequence
atgaaactcctggagaatagctcctttgaagcaattaacagtcagctgacagtagagactggcgatgcccacattatcggtagaatcgagagctattcttgcaaaatggccggtgatgataagcacatgttcaagcagttctgccaagagggccaaccacacgtgctggaggccctaagcccaccgcaaacctccggtctttcaccgtccaggctatccaaatctcaggggggagaggaggaggggccactgagtgataaatgtagtagaaagactttgttttatctaattgccaccctcaacgagtctttccgccctgactacgacttttctacagcgagatcccacgagttctctcgggagccttccctgtcgtgggtcgttaatgccgtaaattgttcccttttttcggcggtgagggaggatttcaaagatttgaagccgcagctttggaacgccgttgatgaagagatttgcctcgcagagtgcgatatctactcgtataacccagacctggactctgatccatttggagaggatggtagcttgtggtcatttaactatttcttttataacaagagactgaagaggatcgtctttttttcatgccgcagtataagcggatccacgtataccccctcagaagccggaaatgaactggacatggaactgggggaggaggaggtggaagaagagtctaggtcaggaggatctggcgctgaagaaacatccacaatggaggaggacagagtgcccgtgatttgtatatag

SEQ ID NO: 229220 - DNA, 213 bp, Artificial Sequence
  Description of Artificial Sequence: Synthetic coding sequence
atgaaacttctggaaaattctagttttgaagccataaatagccagcttaccgtggaaactggggacgcccacataattggcagaatcgagtcttacagctgcaagatggcaggcgatgataaacatatgttcaagcagttctgtcaggagggccagcctcacgtgctggaggcacttagtcctccccagacctccggcctatccccatcttag

SEQ ID NO: 229221 - DNA, 771 bp, Artificial Sequence
  Description of Artificial Sequence: Synthetic coding sequence
atgaagctgttagagaactcctcttttgaggctataaactctcaactgacggtagagactggtgatgcacatattatcggtcgtatcgagagctactcctgcaaaatggccggagacgataagcacatgttcaagcagttctgtcaggagggccagccacacgtgttagaagccctgtctcccccacagacctccggcctcagcccctcacggctgtcaaagagccagggcggagaggaggaagggccactgtcagacaaatgctcaaggaaaactctcttctacctgattgcaactctgaacgaaagtttccgcccagattatgattttagtacagcaaggtcgcacgaatttagccgagagccttcattatcctgggtcgtgaacgccgtcaattgtagtttattttcagccgtgagagaggacttcaaggacctgaagcctcagctctggaatgcggttgacgaggaaatctgtcttgccgaatgtgacatttacagttacaacccggacttagactctgacccttttggcgaagacggatccctgtggtcctttaattactttttttataacaagagactaaagcgcatagtcttttttagctgtagatcaatttctggctccacatatactccttcagaggctgggaacgagctagatatggagctcggcgaggaggaggttgaggaggagtcacggtccgggggtagcggcgctgaggagactagtacaatggaagaagacagagtgcccgtgatctgtatatag

SEQ ID NO: 229222 - DNA, 1104 bp, Artificial Sequence
  Description of Artificial Sequence: Synthetic coding sequence
atgagaaaaggaaagggtcctatatgtctgtttagtagacccacactcaggcccagtcggagtaaagtgtcgctgatagagggaagaggcgctaatatggccgctcggtggcgattttggtgtgtatcagttacaatggtggtggctctgctgatcgtgtgtgacgtccctagcgcttctgcccagaggaaaaaggagatggtattaagcgaaaaggtctctcagttgatggagtggaccaacaaaaggccagttattcgaatgaatggggacaaattcagacgtttggtgaaagcaccacctagaaattattccgtgattgtcatgttcacggcgctccaattgcatcgtcagtgcgtcgtttgtaagcaggcagacgaagaattccaaatcttggctaatagctggcgctattcatctgctttcacgaatcgaatttttttcgcaatggttgacttcgacgagggatcagatgtcttccagatgcttaatatgaactccgcccctacgttcattaacttcccagccaagggtaagcccaaaagaggcgatacatacgaacttcaggtgagaggattcagtgccgagcagattgcacgctggatcgcggaccggaccgatgtaaacattagagtaatcagaccccctaattacgctggccctctgatgctaggactgctgctggctgtgattggcggactcgtgtatctgcgcaggtccaacatggagttcctgtttaacaaaacaggctgggcttttgcagctctgtgctttgtcctggccatgacaagcgggcagatgtggaaccacattcgcggaccgccatatgcacataaaaacccgcacaccgggcacgtcaattatatccacgggagctctcaggctcagtttgtcgctgagactcacatcgtgttgttgttcaatggcggagtgacattaggaatggtccttctctgcgaagccgcaacctcagacatggatatcggaaagcgtaagattatgtgtgtagctggcatcggtcttgtcgtcctcttttttagttggatgttgagtatttttaggtccaaataccatggttacccctactccttcttaatgagttag

SEQ ID NO: 229223 - DNA, 657 bp, Artificial Sequence
  Description of Artificial Sequence: Synthetic coding sequence
atggtggacttcgacgagggatctgacgtcttccagatgctgaacatgaatagcgcccctacatttatcaactttccagctaagggcaagcctaagcgcggagacacctatgagttgcaggttcgcggtttctccgcggaacagattgccaggtggatagcggatcgaactgacgtaaatataagagtgattcggcctccaaattatgccggacccctcatgcttggactgctcctcgccgtcatcggcggtctcgtctatctgcgacggtccaacatggaattcctgtttaacaagactggatgggctttcgctgcattgtgcttcgtattagccatgacctccgggcaaatgtggaaccatatcagaggcccaccctatgcacataaaaatccccacaccgggcatgtgaactatattcacggttcgtcacaggcacagttcgtggccgagacacacatagtgttgttatttaatggtggagtgaccctgggtatggtgttgttatgtgaagcagcaactagcgacatggacatcggaaagaggaagattatgtgtgtggccggaatcggtctggtggtgttgtttttctcgtggatgctctctatctttaggagcaagtatcacggctatccgtattccttcctcatgagctag

SEQ ID NO: 229224 - DNA, 330 bp, Artificial Sequence
  Description of Artificial Sequence: Synthetic coding sequence
atggagtctgacttctaccttcgctattacgtgggccacaagggaaagttcggccatgagtttctcgagtttgagttcagaccagacggcaaactgcgctacgccaacaactcaaactataagaatgacgtgatgattaggaaagaggagttagaaatcgtgataggggacgaacatatatcatttacgacctctaaaatcggatcgctcatagacgtaaaccagagtaaagaccccgaaggactgcgcgtcttttattatctggtgcaggatctaaaatgtcttgtatttagcttaattggtctccacttcaaaattaagcccatatag

SEQ ID NO: 229225 - DNA, 441 bp, Artificial Sequence
  Description of Artificial Sequence: Synthetic coding sequence
atggaaagtgatttctacctgcgctattatgtgggccacaaaggcaagtttgggcacgagttcctcgagttcgagtttagacctgacggtaaactcagatatgctaacaactccaactataagaatgacgtcatgatccgcaaagaagcatatgttcataaaagcgttatggaggagctgaaacggatcatcgacgattccgagatcacaaaagaagacgacgctctctggccacctccagatcgggttgggcgtcaggagttggagattgtgattggggatgagcacattagttttaccaccagtaagattggatctcttatagacgtcaaccagagtaaggaccccgagggcctacgagtgttttattaccttgtgcaagacttgaagtgtcttgtgttctctctgatcggcctgcactttaaaatcaaacctatctag

SEQ ID NO: 229226 - DNA, 1731 bp, Artificial Sequence
  Description of Artificial Sequence: Synthetic coding sequence
atgggctcgatactgagtaggagaattgccggagttgaggacatcgacatccaggctaactccgcttaccgctatccccctaagagcggaaattattttgcatcacactttttcatgggaggtgagaaattcgacacgccccatccagagggttatctcttcggagagaacatggacctaaattttctcggatctcgacccgtccaattcccttatgtcacgcccgcaccacacgagcccgtcaagacccttcggtccctcgttaacataaggaaagactccctgcgactcgtacgctataaggatgatgccgattcacctacagaggatggggacaagccgagggttctgtattccctcgaatttaccttcgacgccgatgccagggtggccatcacgatttattgtcaggccagtgaagagttcttgaacggtagagcggtgtattcccctaagtcgccttccctacaatccgaaactgttcattacaaacgcggagtgtctcagcagtttagtctaccatccttcaagatcgacttttctgaatggaaggatgatgaactgaattttgatttggaccgcggtgtcttcccagtcgtgatccaagccgttgtagacgagggagacgtggtggaggtgactgggcacgcccatgtgctgttggccgctttcgagaagcacatggatggctctttctcggtcaagcccctgaaacagaaacagattgtggacagggtatcatacctcttacaggaaatatacggcatcgagaataaaaacaaccaagaaacaaagccatcggacgacgaaaattcagacaacagcaatgagtgtgtagtttgcttaagcgatttacgggataccttaatcctgccctgccggcatttatgcctctgtacatcctgtgcggatactctcaggtaccaggcaaataactgtccaatctgcagactgcccttccgggctctgctgcagattagagctgtgaggaagaagccgggtgccctttcaccggtctctttctctccggtactggcacagtcgctcgagcatgacgagcattcatgcccttttaagaaaagtaaaccgcaccccgcttccttagcatctaagaagcctaagcgcgagacaaatagcgatagtgtgcctcccggatacgagcctatttcattactggaggcactcaacggacttcgagcggtctcacctgcaattccctccgctccattatatgaggagattacctactctggaatctctgacggcctctcacaggcaagttgccccctggccgcaatcgatcatattttggattccagtcgtcaaaaaggcagacctcagtccaaagctcccgattctacactgagatccccatcaagcccaattcacgaggaagacgaggaaaagctgagcgaggacgtggacgcaccaccgcctctgggcggtgcggagcttgcacttcgagagagcagctcccctgagtccttcatcaccgaggaagtcgacgaatcatcgtcaccccagcagggaactcgggcagcatcaattgaaaacgtgttgcaagacagctcccctgaacactgtggcaggggcccaccggctgatatttacttgccgggtcggcctactagcatggagaccgctcacgggctagctacaactagtcccacttggcccccactgggcggacccagtccagatcctagcgccgctgagctaacacccctctag

SEQ ID NO: 229227 - DNA, 1659 bp, Artificial Sequence
  Description of Artificial Sequence: Synthetic coding sequence
atgggatccatcttgagccgaagaatcgccggagtggaggacattgatatccaggcaaattccgcttaccgctaccctcccaaatccggcaactacttcgccagccacttctttatgggaggcgagaagtttgataccccacatccggaagggtacttgtttggcgagaatatggacctgaactttcttgggtcacggccagttcaattcccctacgttacaccggcaccccacgagcctgtgaagaccttaaggagccttgtcaacattcgaaaagactccctgcgcctggtgcggtataaggatgatgcggactccccaaccgaagacggagataagcctcgggtcctatactcattagagtttacttttgatgctgacgcgagggtcgcgatcacaatttattgccaggctagcgaggaatttcttaatggtcgggctgtctatagtcctaagagtcctagtctccagtctgagacagtgcactataagcggggtgtctcccagcagttttccctgccctcattcaaaatcgatttttctgagtggaaggatgatgagttaaatttcgatctggaccggggagtcttcccagtagttatccaggctgttgtcgatgagggagacgttgtggaagtcactggtcacgcccacgtcctacttgccgctttcgagaaacatatggacggcagcttttcagtcaagccattaaaacaaaagcagattgtggacagagtgtcatacttgctgcaggaaatttatgggatcgagaataaaaacaaccaggagacgaaaccttctgacgacgaaaattctgacaacagcaatgaatgtgtggtttgtctctcagacctgcgggacacactgatactgccatgtaggcatctttgtctgtgtacctcatgcgctgatactctgcgataccaagcaaataattgccccatctgccgactcccttttcgagctctgttacagattcgggctgtcaggaagaaacccggagcactctcccctgtctctttcagtcctgttcttgcgcagagtctggaacatgatgagcacagctgtccctttaagaagtccaaacctcaccccgctagcctggctagtaaaaaacctaagagagagacaaattcagattctgtgccccctggctacgagccaatcagtctgctggaggcattgaacggcctaagggccgtctccccagctataccttccgcaccactgtacgaggagattacctacagtggtattagtgacggcctctctcaggccagttgtccactcgctgcaatcgatcacatcctggacagttctagacagaagggtcgacctcaatccaaggcaccagattccaccctgcggtcaccaagcagtcccatccatgaagaggacgaggagaagctctccgaggacgtagacgccccaccccctctggggggtgcagagcttgctcttcgggaatcgtccagcccagagagctttatcactgaagaggtggatgaatcatcatccccccagcaaggtactagggcagctagtatcgagaacgtcctgcaggattcatctcctgagcactgtggaagggggcctcccgctgacatatatctgcccgctttaggcccagactcttgctctgtgggcattgatgaatag

SEQ ID NO: 229228 - DNA, 1596 bp, Artificial Sequence
  Description of Artificial Sequence: Synthetic coding sequence
atgggatccattttgtccaggaggatcgcaggcgtcgaggacatagacatccaagccaacagcgcctaccggtacccacccaaaagcgggaactattttgccagtcacttcttcatggggggagaaaagtttgacactccccatcccgagggttacctgtttggagagaatatggatctcaatttcctcggatcccgcccagtgcagttcccatacgtgacgccagctccccacgaaccagtgaagacgcttaggagcctggtgaacatccgcaaggatagtttgcgcttagttcgctacaaggatgatgccgactcccctaccgaagacggcgacaagccacgggtactgtactccttagagtttacgtttgacgcagacgctcgggtggccattaccatctattgccaggcctccgaggagtttctgaacggccgtgccgtttatagccccaagtcccccagcttacagtccgagacagttcactacaaacgcggagtgtcccagcagttttcactgccttcattcaagatagactttagcgagtggaaggacgatgaactgaatttcgaccttgatagaggcgtcttcccagtggtcattcaggctgtcgtagatgaaggcgatgctgttgttgaggtgacgggccacgcccacgtcctgctcgccgctttcgaaaagcacatggatggctcattctccgttaagcctctgaagcagaagcagatcgtggatcgcgtatcttatcttctgcaagagatctatggtatcgagaacaaaaataaccaagagactaagccgtcagacgatgagaattctgataacagcaacgaatgtgtggtgtgcctgtctgatctgcgcgacactctcatcctgccctgtcgacatctgtgtttatgtacatcatgcgcggacacactcagataccaggctaacaattgccctatctgccggctccccttccgcgctctgttgcaaattcgggctgtccgcaagaaacctggcgctttaagccccgtaagcttctccccagtcctggcgcaatcacttgagcacgacgaacacagcaacagtgatagcgtcccgcctggttacgaaccaatttctctacttgaggcacttaatggccttagagcagtttcccccgcaatcccctcagcacccctctatgaagaaattacctactctgggataagcgacggcctgtctcaggccagttgccccctcgccgctattgaccacattctggatagctctcgccaaaagggcaggccccagtctaaggccccagactcaaccctaaggagtccttcctctccaatccatgaagaggacgaggaaaaactgagcgaagatgtcgacgcgcctccccctctaggtggagctgaactcgctctccgggaatcttcttcccccgaaagcttcattacagaagaggtggatgaatcctcaagcccccagcaaggaacccgagctgcctcgattgagaatgtgctgcaagattcctcccctgaacactgcggccgaggcccaccagccgatatctatttgccagcgctgggtcccgattcctgtagcgtcgggatagacgaatag

SEQ ID NO: 229229 - DNA, 963 bp, Artificial Sequence
  Description of Artificial Sequence: Synthetic coding sequence
atgggctctatcctatcacgcagaatcgcaggcgtcgaggatattgatatccaagcaaacagtgcttacagatatcccccaaagtctgggaactattttgcctctcatttttttatggggggagaaaaattcgacacgccacatcccgagggctatctgtttggagagaatatggacctgaacttcttggggtcccgccctgtccagttcccctacgtaacacctgcccctcacgaacccgtgaagactcttaggtcactggtgaacatacgtaaggactctctccgcctcgtgcggtacaaggatgatgctgactccccaacagaagatggcgacaaaccccgagtgctgtactccctagagtttacattcgatgcggacgctagggtggccattaccatttactgccaggcctccgaagagttcctcaacggcagagcagtgtactcccccaagagtcccagtctccaaagcgagactgtgcactataaacgtggagtgagccagcagttttcactgccttcctttaaaatcgactttagcgagtggaaggacgacgaactgaattttgatctggatcggggagttttcccggtggtaatccaggctgtagtggacgagggtgatgtcgtggaagtgaccggccacgcgcacgtgctgttggcagccttcgaaaaacacatggatggaagcttttctgtgaagccccttaaacagaagcaaatcgtggatagagtgtcatacctgctgcaagaaatttacggcatcgagaacaagaataatcaggagactaagccttccgacgacgaaaattccgataacagtaatgagtgcgtggtctgcctctctgacctgcgcgacaccctgatccttccctgcagacatctgtgcttgtgcacgagttgcgcggacaccctcaggtatcaagccaataattgccccatctgtaggcttcagctctag

SEQ ID NO: 229230 - DNA, 1632 bp, Artificial Sequence
  Description of Artificial Sequence: Synthetic coding sequence
atggcaaaaggagaaggggcagaatctggctcagccgcagggctgctgccgactagtattctgcagagtaccgagcgtcccgcacaggtcaagaaagagcctaagaagaaaaaacagcaactgtctgtctgcaacaaattatgctacgctctgggcggtgccccttaccaggtcaccggatgcgctttgggcttttttctccagatctatctgttggacgttgcccaaaaagatgaagaagtagtcttttgcttttcctcatttcaggtcggccctttctccgcgtccatcatccttttcgtgggtcgcgcatgggacgctatcaccgatccactggtggggctgtgtatcagcaaatccccttggacatgcctggggagactaatgccgtggattatatttagcactcccctggcagttatcgcatacttcctcatttggtttgttccagacttcccccacggacagacctactggtacctccttttttactgcttgttcgaaactatggttacctgcttccacgtaccctattccgccctgactatgtttataagcaccgagcagacggagcgtgattcagctactgcatacaggatgaccgtagaggtcttgggaaccgtgttgggcacggccatccagggccaaatcgttggccaggcagacacaccttgttttcaagacttgaacagctctaccgtagcaagccaaagcgccaaccacacccacggtaccacttctcatagggaaacacaaaaggcatacttgctcgccgctggtgtcatcgtatgtatctacattatctgtgccgtgatcctgattttaggcgtccgcgagcagcgagaaccctacgaggcccagcagtctgaacccatcgcttacttccgcggactgagactggtaatgtcacacggaccctatattaagctgatcacgggcttcctgtttaccagtctcgcctttatgctggtggagggcaacttcgtgctcttttgcacctacacactgggctttagaaacgaattccaaaatttattgctcgccatcatgctttcggccaccctgactatacctatttggcagtggtttcttacacggtttggcaagaaaaccgctgtatatgttggcatatcatctgccgttccctttctgattttggtggctctgatggagagcaatctgattatcacatatgccgttgctgtggctgccggaatctctgtggcggcagcttttctgttgccctggagtatgttacccgatgtcattgacgacttccatctgaagcaaccacatttccacggaacggagccaatattcttctctttctatgtgttcttcacaaaatttgcctctggagtttcactgggtatcagcacgctgtctctcgactttgccggataccagacacgagggtgttcccaacccgagagggttaagtttactctgaacatgctagtcaccatggcacctatcgttctgatcctcctcgggctgttattgttcaagatgtatccgatcgacgaggagagacggagacagaacaaaaaagcgttacaggccctccgggatgaagcgtcttcatccgggtgtagcgagacagacagtacagaacttgcctcgatcctgtag

SEQ ID NO: 229231 - DNA, 1593 bp, Artificial Sequence
  Description of Artificial Sequence: Synthetic coding sequence
atggcgaaaggcgagggcgctgagagcgggtctgctgccggtctccttcccactagcatactgcagtccaccgaaaggccagcccaggttaagaaggagccaaaaaagaaaaaacaacaactgagtgtgtgtaataaactgtgttatgccctggggggtgcgccttaccaggtgacggggtgtgcgctgggtttttttctgcagatttatctgttagatgttgcgcaggtaggtccattttccgccagcataatactattcgtcgggagagcctgggacgcaatcacggaccctctcgttggtttgtgtatctcaaagagcccctggacatgcctcggccgtctgatgccatggatcatctttagcacaccactggcagtcattgcatactttctgatctggttcgtgccggatttcccacacggccaaacctactggtacctgctgttctattgtctttttgagaccatggtgacttgttttcatgtaccttacagcgctctgaccatgttcatttcaaccgaacagaccgagagggactctgctaccgcgtacaggatgaccgtcgaagtgcttggaaccgttttgggtactgcaatccagggccagatcgtcggtcaggctgacactccctgttttcaggatctcaatagtagcactgtggcttctcaatctgctaatcacactcatggaaccactagccatagggagacgcagaaggcctatttgctggccgcaggtgttatagtctgtatctacatcatctgtgccgtaatcttgattttaggagtgcgagagcagagagaaccatacgaggcacaacaaagcgaacccatcgcttacttcaggggcctccgactagtcatgtcccacggtccgtacatcaaactgatcactgggttcttatttacaagcttagccttcatgctggtagaggggaactttgtattgttctgtacttacacccttgggttcaggaacgagttccagaaccttttgcttgccatcatgctgtctgccacactgaccatccctatctggcagtggttccttacgcgcttcggtaagaaaaccgccgtgtatgtcggtatcagtagcgcagtaccgttcctgatcctggtcgctttaatggagagcaacctgattataacgtatgccgtggccgtggcagcaggcatctcagtggccgcagcattccttctgccttggtccatgctcccggatgtcatcgatgatttccatctaaagcagccgcacttccacggaactgaaccgatcttcttctccttttacgtcttcttcactaaattcgcttccggcgtgtctctgggaatttctactctgagtctcgatttcgccggttaccagactaggggctgctcccagccagaaagggtgaaattcacgcttaacatgctggttactatggcgcctattgtccttatccttttgggcctgctcctgttcaaaatgtatcctatagacgaagaaaggcggaggcagaacaaaaaggccctacaagctctgagggacgaagcctcctcctcaggctgctccgagaccgacagcaccgagcttgcgtcaatcctctag

SEQ ID NO: 229232 - DNA, 1125 bp, Artificial Sequence
  Description of Artificial Sequence: Synthetic coding sequence
atggtgacatgcttccacgtgccttatagtgctctgacaatgttcatttccaccgagcagacagaacgggactctgctacggcctacagaatgacagtcgaggtactcggtaccgtgttagggacagcaattcagggacagatcgtcggtcaggcagataccccgtgcttccaggacctaaattccagcacagttgccagtcagagtgcaaaccatactcacggaacaactagccatagggagactcaaaaagcttatttattggcggcaggggtcatcgtctgtatctatataatttgcgccgttatcctgattctcggagtgagggaacagcgcgagccatacgaagcccagcagagcgagcccatcgcctatttccggggactgcggcttgtgatgagccatggcccatatatcaagttaatcactggtttcttattcacttcactggccttcatgctggtggaaggcaactttgtgctgttctgtacctacaccctcggttttaggaacgagtttcagaatttgctcttggccataatgctttcagcaaccctgaccatcccaatctggcagtggtttctgacacggtttgggaagaaaacagccgtttacgtagggatttcaagcgccgtccctttcctaatcctggtcgctctcatggaatctaacctgattattacctacgctgtcgctgtggcagccggtatttctgtagccgctgcatttctcttaccctggtctatgctgcctgacgtaattgacgattttcacctgaagcagccccactttcatggcactgagcccatattctttagtttctacgttttctttacaaagttcgcttccggagtgagccttggaatctccaccttgagcctcgattttgccggataccagactcgcggatgttcccagccagagcgagtgaaattcacactaaacatgctcgtgacaatggccccaattgttctgatcctattaggccttctgctgttcaaaatgtaccccattgacgaagagcgtcggagacagaacaagaaggctcttcaagctcttcgtgatgaagcaagttcctccggatgcagcgagacagactccaccgaactagccagcatcctgtag

SEQ ID NO: 229233 - DNA, 801 bp, Artificial Sequence
  Description of Artificial Sequence: Synthetic coding sequence
atggcaaaaggcgagggcgcagagtctgggtctgctgcgggtctactgccaactagtatcctgcagtctaccgagcggcctgctcaaaaggaaccgaaaaagaaaaaacagcaactatcagtgtgcaacaaattatgctacgcactaggtggtgcaccataccaggtgacaggttgtgcccttggcttttttctgcagatctacctgctggatgttgcacaggtaggacctttctccgcctccattatcctttttgttggcagggcctgggacgccatcaccgatcctctggttggactgtgcatttccaaatccccctggacctgcctcggccgtctgatgccatggatcattttcagcactccactcgccgttattgcctattttctcatctggtttgttccggacttcccacacggccagacctactggtacctgctgttttattgcctttttgagacaatggtcacttgcttccacgtcccatatagtgcactgacaatgttcatctctacggagcagacagagcgggattccgccaccgcttatagaatgacagtggaagtgttgggcacagtgcttgggactgctatccaggggcagattgtagggcaagccgacactccctgttttcaggatttaaacagctccactgtggcgtcccagtccgcaaatcacacacatggaacaacctcccacagggaaacccagaaggcctacctgttggcagctggcgtgatcgtgtgtatctatattatttgcgctgttatcctgattttaggggtccgtgagcaacgctag

SEQ ID NO: 229234 - DNA, 2376 bp, Artificial Sequence
  Description of Artificial Sequence: Synthetic coding sequence
atggccgatgataaggtcgccatccttactgacgacgaagaagaacagaaaagaaaatacgtgttagcagatccgtttaatggcattagcagggagcctgaacctcctagcaatgaaacgccaagttctaccgagacttccgccattcccgaggaagagatcgattggatcgaaaagcactgcgtcaagattaataacgatctgctcattagtaaggtcttttacttctttttttattccgcctacggatccctgtatccccttctcccagtatactataagcagctggggatgagcccttcacagtcgggtctcctcgtgggaatccgatatttcatagagttttgttctgcccctttctggggagtggttgctgatcgcttcaagaaagggaaaattgttcttcttttctctctcctgtgttgggtgctgtttaatttgggaatcggattcgtgaagcctgccacgctaaggtgtgtgcccaaaatcaggcccaccacccacccaactaatgcatcgcatcagctgaccattttacctacgaactcttcttttacttccttcctcacaatctcccctaagatgagagagaagagaaatctgctcgagacacggttaaacgtctcagatactgtaacactgccaaccgctccaaacatgaattccgaaccaacacttcaaccgcaaaccggcgaaataacaaacagaatgatggacttgacactgaatagctctaccgctactcccgtatccccaggatcagtcaccaaggaaacaacgacagtcatcgtcaccaccactaagtccctgccatcagaccaagtgatgctcgtatacgaccagcaggaggtggaggcgatcttcttagtaatcctcgtggttgttataattggagagttcttcagcgcaagtagcgttacaatcgtggataccgtgactctgcagtacctgggtaagcaccgtgataggtatggcctccagcgaatgtgggggtctctgggatgggggcttgccatgttgagcgtggggattgggattgactatacgcatattgaggttctcatcgatggtaaggggtgtaagccaccagaatatcggaattaccagatcgtcttcatcgtgttcggcgtgctaatgaccatggcgctgattgtcgctacccagtttcgtttcagatacaatcatttcaagaacgatgactcaaaaggcaaggaggtggagattccccaggttgagagaaataattcaacagagagcagtgaggagactcctaccactactagccatagtcaggcattcaacttctgggaccttatcaaactgctgtgctcagtgcaatatggctcagtgttgtttgtcgcgtggtttatgggctttgggtacgggttcgtcttcaccttcctatattggcaccttgaggatcttaacggaactactaccctgttcggcgtctgcagcgtgctgagccacgtgagtgaactcacagcatactttttcagccacaagctgatagaactaattggccatataagagtgttgtatatcggactggcctgtaataccgcacggtacatatacatttcatacctagagaacgcttggactgttttgcctatggaggtgctccagggcgtgacccacgcggctatttgggcagcttgtatatcctatttatctgctgctgtgccccctgagctgaggacctctgcccagggcatactgcagggtttacacctggggcttggccgagggtgcggcgcaatgatcggtggggtgctggtgaactactttggggctgcggcaaccttccgcggaattggaatggcttgtcttgtcatattgttgcttttcgctttgatccaatggctagccgtcccggacgaagaggaagacaagactatgcttgctgagcggatacctgtgccatctagcccagtgcctattgccaccatcgacctcgttcaacagcagactgaggatgtcatgcccaggatagaacctcgcttaccccctaagaagacaaaacatcaggaagagcaggaagacgtgaacaaacccgcttggggcgtttcaagtagtccttgggttacgttcgtatacgccctttatcaaattaaggagatgatgcagttaacccgcgataatcgggcatccgaaatacagcctcttcagggcacaaatgagaatcgcgagaattcccctgctggacgcgcacagccggtgccctgtgagacacactccgacccctcccgcaatcagccctctcctgacgcggcagctagccaaacacaaaccagtccggctcatcccagcgtggacccatgtaccgaggaatccgaagagcagcaggcacaactcgccgcaggaggacattag

SEQ ID NO: 229235 - DNA, 2376 bp, Artificial Sequence
  Description of Artificial Sequence: Synthetic coding sequence
atggccgatgacaaggttgcaatactgactgacgacgaggaggagcagaaacgtaagtatgttctcgccgacccatttaacggcatttcccgcgaaccagagccaccgtctaacgaaacaccctcaagcaccgagacttctgcaatacccgaggaagaaattgactggattgaaaagcactgtgtgaaaatcaacaatgaccttctgatctccaaggtgttctatttttttttttatagtgcctatggatcgttgtatccactcctgcctgtctattacaaacagctggggatgtccccatcccagtctgggttgctggttggtataaggtactttatagagttctgctccgctccattttggggggtcgtggcagacagattcaagaagggcaaaattgttctgctattcagtttgctttgctgggttctattcaacctcggcattggctttgttaagcccgcaaccctcaggtgtgtgcctaagatacgccctaccacacacccgacaaacgcctcacaccagctcaccattcttcctacaaacagcagctttacctcgtttctaacaatatctcccaagatgcgagaaaaacgcaatcttttggagactcgcttgaacgtcagtgacaccgtgacactgccaacagccccaaatatgaatagcgaaccaactcttcagcctcagaccggggaaatcacaaaccggatgatggatttaaccctcaattcctcaacagccactcccgtaagcccgggttcagtcaccaaggagacaacgacagttatagtaactacaacgaagtcactgccaagcgaccaggtgatgcttgtctatgaccaacaagaggtggaagcaatctttctcgtgattctggtcgtggtgataattggcgagttcttttctgccagctcagtcacaattgttgacaccgtgacgctgcagtatctgggcaagcaccgggataggtacggccttcaacggatgtgggggagtctgggttgggggctcgcaatgttatctgtgggcataggcatagactatacacatatagaggtcctcattgatggcaaaggatgtaaacctcctgagtacagaaattatcaaatagttttcattgtgtttggggtgctcatgacgatggcactgattgtcgctactcagttcaggtttcgctacaatcattttaagaacgacgattcaaagggaaaagaagtggaaattccccaggtagagaggaacaactccacagaaagctcggaggagactccaactaccaccagccattcacaggcattcaatttttgggacctcatcaagctactctgctccgtccagtacggcagcgtgttgttcgttgcttggtttatggggtttggctatggattcgtctttacatttctgtattggcacttggaggacctgaacggaaccaccacactttttggcgtgtgctcagttctatcccacgtgtctgagctcacagcttactttttctctcataaactcattgagctgataggacacatccgcgtcctatatataggtctggcatgcaacaccgccagatacatctacatatcctatcttgagaatgcctggaccgtgctcccaatggaggtcctccagggcgtcactcacgcagccatctgggccgcatgtatcagctatctgtcagctgccgttccacctgaactgcgcacctccgctcagggtatacttcaaggactgcacctggggcttggacgaggatgtggtgcaatgatcggaggcgtgctggttaactactttggagccgcagcgacctttcggggaattgggatggcctgtctcgtgattctattgttgttcgcattgattcagtggctggcggtccctgacgaggaagaagataaaacgatgctggctgagcggatcccggtcccctcttcccccgtgccaatcgccacgatagatttggtccagcagcagacggaagacgtgatgcccagaattgagccgaggttgcccccaaaaaagactaagcatcaggaggaacaggaggacgtgaacaagcccgcatggggcgtgtcttccagcccttgggtgacctttgtttacgctctttatcagatcaaagagatgatgcagctgacacgagataaccgcgcatcagaaatccagccgcttcagggcaccaatgagaaccgggagaatagccccgctggaagagcgcaacctgtgccctgcgagacacactctgatcctagccgaaatcagcctagcccagacgcagctgcatcccagacgcagacctcacccgcacacccgagtgttgacccctgcaccgaggagtccgaagagcagcaggctcaattagcggcaggaggccattag

SEQ ID NO: 229236 - DNA, 129 bp, Artificial Sequence
  Description of Artificial Sequence: Synthetic coding sequence
atggctgacgataaggtggccattctcacagacgatgaggaagagcagaaacggaagtacgtgctagcagacccttttaacggcatatcccgggagcccgaaccccctagcaatgaaaccccttcctag

SEQ ID NO: 229237 - DNA, 345 bp, Artificial Sequence
  Description of Artificial Sequence: Synthetic coding sequence
atggcagatgataaagtagctatactcactgatgatgaagaggagcagaagagaaagtacgtcttagctgacccttttaacggcatttcaagggagcccgaaccccctagcaacgaaaccccctcgtccacagaaactagcgctattcccgaagaggagattgattggatcgagaaacactgtgtgaaaatcaacaacgatttactgattagtaaagtcttttatttttttttttacagcgcatacggctcactgtacccactattacccgtgtactataagcagctgggcatgagtccatcccagtctgggttgctggtgggcattcggtacttcatagagtag

SEQ ID NO: 229238 - DNA, 471 bp, Artificial Sequence
  Description of Artificial Sequence: Synthetic coding sequence
atggctgacgataaagttgcgattctaacggatgacgaggaagaacagaaacgcaaatacgtgctggccgacccgttcaatggcatttcccgggagcctgaacctcccagtaacgagaccccaagctctactgagacatcagctatccccgaagaggaaatcgactggatcgagaagcattgtgtgaagattaacaatgacctgttgatctcaaaagtgttttatttctttttctattctgcgtatggaagtctgtatccgctgctgccagtatattacaaacagcttgggatgtccccaagtcagagcgggttgctggtgggtatccgatattttatagagttttgtagcgctccgttctggggtgttgtcgcagaccgattcaaaaaaggcaaaatcgttttactcttcagtctgctgtgttgggtgttattcaatctgggcattggtttcgtaaaacctgcaacttag

SEQ ID NO: 229239 - DNA, 762 bp, Artificial Sequence
  Description of Artificial Sequence: Synthetic coding sequence
atggaggtgctgcaaggagtcacacatgcagcgatttgggcagcctgcatctcttacctgtccgcagccgtgccacccgagttaagaacgtcagcccagggcatcctgcagggtttgcatcttggcctgggtcgaggctgtggcgctatgatcggcggtgtcttggtgaactactttggagccgcagccaccttccgaggaatcggaatggcctgtttggttattctgcttttgttcgcccttattcagtggcttgctgtccccgacgaggaagaggataaaaccatgttggccgaaagaatccctgtgcccagcagcccagtccctatcgcaacaatcgacttagtccagcaacagaccgaagacgtgatgccaagaatcgagcccaggttgccccctaagaagaccaagcaccaggaagaacaagaagacgtgaataagcctgcctggggcgtgtcatctagcccttgggtgactttcgtctacgccctctatcagattaaagaaatgatgcagttgactcgggacaatagagcatcagagattcagcctctgcaggggaccaatgaaaaccgagaaaattcacccgcaggacgggctcagccagttccttgtgaaacacacagcgatcctagccgcaaccagcctagccccgacgcagccgctagccagacgcaaacgagtcctgcccatccttccgtggatccatgcaccgaggaatccgaggaacagcaggcgcagctagctgctggcggtcactag

SEQ ID NO: 229240 - DNA, 696 bp, Artificial Sequence
  Description of Artificial Sequence: Synthetic coding sequence
atggaggtactccagggcgtgactcacgccgcaatttgggcagcctgtatttcctacctgagtgcagccgtgcctcctgagttacgaacttcagcccagggcatcttacagggcctccacctgggcctcggtcggggatgtggtgcaatgatcgggggagtcttggtaaattattttggtgccgctgctacctttagaggtattgggatggcctgtctggtaatcctgctgctctttgcacttatccagtggctggccgtccctgacgaagaggaggataaaacgatgctggcggaacgcatcccagtcccaagtagtcctgtgcccatcgctacaatcgacctcgtgcagcagcagactgaggatgtgaacaagccagcatggggtgtctccagcagcccctgggtgacattcgtctacgcactgtaccagattaaagaaatgatgcagttgacgcgtgataatcgagctagcgaaatacaacccctgcagggtactaacgagaaccgagaaaattctcctgctggaagggcacagccggtcccatgcgaaacccattctgatcccagcagaaaccagccttcccccgatgccgctgctagtcagacacagacatcaccagcgcacccctcagtagacccctgcacggaggagtctgaggaacagcaggcacagctggcagctgggggtcattag

SEQ ID NO: 229241 - DNA, 1557 bp, Artificial Sequence
  Description of Artificial Sequence: Synthetic coding sequence
atggcaggtctgcggaacgagtcagagcaggagcctcttctcggcgatacacccggatctcgggaatgggacatattggagaccgaggagcattataagtcaagatggcgctcgattcggatcctttatcttaccatgtttctttcttccgtaggtttctctgtggttatgatgagcatctggccttacctacaaaagattgatccaaccgcagatactagtttcctgggttgggtgattgcctcgtattcactcggtcagatggtggccagcccaatttttggattgtggtcaaactatcgtcctaggaaagagcccctcatagtatctatccttatttccgttgctgctaactgtctgtatgcgtatctgcatatccctgcctcacataacaagtattatatgcttgtagcgagaggcttgctcggcatcggcgcaggaaatgtcgctgtagtgagaagctataccgctggcgcaacttcactgcaagaacgtactagttctatggccaacatcagtatgtgtcaggccctcggattcatcctcggacccgtgttccagacctgctttacgttcttgggcgagaagggagtcacatgggacgtgataaaactgcagataaatatgtataccacacccgtcctgttaagtgcattcttgggcattctcaacatcatcttgatcctggccattcttcgcgagcaccgagtagatgatagtgggcgtcaatgcaagagtatcaattttgaggaggcgagcacagacgaagcccaagtgccacagggaaatatcgatcaggtggctgtcgtggccatcaacgtcctgttctttgtcacactgttcatatttgcacttttcgaaaccattataactcccctgacaatggacatgtacgcatggacccaggagcaagcggtgctgtacaacggcatcatactggctgctctcggggtcgaggcagtggtgatttttctgggagttaaattactttccaagaaaatcggagagcgggcaatactgttgggaggcctgattgtcgtttgggttggattcttcattctcctgccctggggaaaccagttcccaaagatccaatgggaagacttgcacaataattctatccctaacactacattcggtgagatcatcatcggattgtggaaatccccaatggaggatgacaatgagcgacctacggggtgtagtattgagcaagcctggtgtctgtacactcccgtgatccacctagcacagtttctgacatctgctgttctgatcggactaggataccctgtctgcaacctaatgtcgtatactctttacagcaaaattctgggaccaaagccacagggggtgtacatggggtggctgacggcatccgggtctggtgctagaatcttgggccctatgtttatctcccaggtttacgctcactggggccctcgatgggccttctccctagtgtgtggaatcatcgttctcactatcactctccttggcgttgtgtacaaacgtctgattgcccttagcgtgcgttatggtcggatacaagagtag

SEQ ID NO: 229242 - DNA, 462 bp, Artificial Sequence
  Description of Artificial Sequence: Synthetic coding sequence
atgttcctctcatctgtaggcttttccgtcgtcatgatgtcgatttggccctatttgcaaaagatcgatccaacggctgacaccagcttcctaggttgggtaatcgcttcctattcactggggcagatggtggcgagccctattttcggcttgtggtctaattaccgtccccgaaaggaacctctcattgtgagcatcctcatctccgtggctgccaattgtctctacgcttatctccatatccccgcaagccacaataaatactacatgctggtcgctcgtggactgctgggcattggtgcggtctttcagacatgcttcaccttcttgggcgaaaaaggcgttacttgggatgtgattaagctgcagatcaacatgtatactaccccggtcttgcttagcgctttcctcgggatccttaacatcatcttgatcttggctattctgagcaagtataggtag

SEQ ID NO: 229243 - DNA, 555 bp, Artificial Sequence
  Description of Artificial Sequence: Synthetic coding sequence
atgttcctgtcctccgttgggtttagtgtcgtgatgatgtccatttggccctatttgcaaaagatcgaccccacagctgacacctcattcctgggctgggtcatcgcatcctatagcttggggcagatggtggcttctcccatcttcggcctgtggagcaactaccgcccacgaaaggaacccctgattgtgagcatcctgatctctgtggctgccaattgtctttacgcctacttgcatatccccgcttctcataacaagtactacatgctggtggctcgcggtctgctcgggatcggcgctgggaacgtggcggtggtccggtcctacaccgcgggagcaactagcctccaagaacggacatcttccatggccaatattagcatgtgccaggccctcggcttcatcctggggcctgagaacatagtttggatgacccaggaggactcggttaaagtgcttatattgaaaaagcaggtgcagatgaagctgcgcttcccgaaggagatactgacgcgtctcctcctgtggccaagcatgttttgtttcctctag

SEQ ID NO: 229244 - DNA, 750 bp, Artificial Sequence
  Description of Artificial Sequence: Synthetic coding sequence
atgggggaactgatggctttccttcttccacttatcatcgtccttatggtcaagcatagcgactcccgcactcacagtctccgatacttccgcctgggtgtgagcgatccgatccatggcgtgcccgaattcatcagcgtagggtacgtggactcccatccaatcaccacgtacgacagcgtgacccgacagaaggaacctagggccccttggatggcggaaaatctcgctccggatcactgggagaggtacactcagcttctgcgaggctggcaacaaatgttcaaggttgagctcaaacggctgcaaaggcattataatcacagcggctcacacacctatcagcgtatgataggctgcgaactgcttgaagacggctccaccactgggttcctacagtatgcctacgatggacaggacttccttatcttcaacaaagacacactgtcgtggctcgccgttgacaatgttgctcatacaataaagcaggcatgggaggctaaccagcatgaattgctttatcagaaaaattggctggaggaagaatgcatcgcctggttgaaacggttcctggaatacggcaaggacacactacagcggacggaatccgaaacaatcccactggttatgaaagccgtatcgggtagcatcgtgctcgttatcgtgctagccggagtgggagtgctggtgtggagacgaaggcccagggagcagaacggcgcaatctacctgccgaccccagatcgctag

SEQ ID NO: 229245 - DNA, 783 bp, Artificial Sequence
  Description of Artificial Sequence: Synthetic coding sequence
atgaggcctgaagaccgaatgttccacatcagagctgtaattcttcgcgcattatcacttgccttcctccttagcctcaggggtgccggagccataaaagctgatcacgtgtccacctacgctgcattcgtccagacccacaggccaaccggagagttcatgttcgagttcgacgaggacgagatgttttacgtcgacttggataaaaaagaaacagtctggcacctagaagagttcggtcaggctttcagcttcgaggcccaaggtgggttggccaacattgccattcttaataataacctaaataccctaattcaaagatctaatcatacccaggctacgaatgatcctccagaggtgaccgtttttcccaaggaacctgtggagttaggacaacccaataccctgatctgtcatattgataagttctttccccctgtactgaatgtcacttggctgtgtaacggggaactggttaccgagggagtagctgaaagcctgttccttcctcgaacagactacagttttcacaaattccactacctcacattcgttccctctgccgaggatttttacgattgccgagtggagcattggggactcgaccagcctctgcttaaacattgggaggcacaggagcctattcagatgccagaaaccacggagactgtcctatgtgcgctgggactagtgttgggcctggtgggtattatagtaggcaccgttctcataattaaaagtcttaggtccggacacgatccccgtgcccaaggcacactttag

SEQ ID NO: 229246 - DNA, 783 bp, Artificial Sequence
  Description of Artificial Sequence: Synthetic coding sequence
atgcggcctgaagacaggatgttccatatcagagcagttatccttagagctcttagcctggcgtttctactgagcttgagaggtgctggagccattaaagctgatcatgtgagcacatacgctgccttcgttcagactcacagacctacgggcgaattcatgttcgaattcgatgaggacgaaatgttttacgtggatctggacaaaaaggaaactgtttggcacctggaggaatttggacaagccttcagttttgaagcacagggaggactggccaacatcgcaatcttgaacaacaacctgaataccctgatccagcgctccaaccatactcaagctactaatgacccacctgaggttacggtctttccgaaggagccagtggagcttggacaaccaaacactttgatttgccatattgataaatttttcccccctgtgctcaacgttacctggctgtgcaatggtgagctggtgacagaaggagttgctgaatccctatttctgccaagaactgattattcctttcacaagtttcactatctgaccttcgtgcccagcgccgaagacttttatgactgtagagtggagcactggggcctcgaccaaccactcctgaagcactgggaagcacaagagcccattcaaatgcccgagacaaccgagactgtcttatgcgcactcggtttagtgctcggcctcgtcggtattattgtagggacagtcctcattattaagtcactgcgcagtgggcacgatccaagggcacagggtacactttag

SEQ ID NO: 229247 - DNA, 72 bp, Artificial Sequence
  Description of Artificial Sequence: Synthetic coding sequence
atgcgaccggaagacaggatgttccacatcagagctgtaatattacgggcattatcgctggctttcctgtag

SEQ ID NO: 229248 - DNA, 387 bp, Artificial Sequence
  Description of Artificial Sequence: Synthetic coding sequence
tgaaataccttaatttgtcacattgataaatttttcccgcctgtgctcaacgtaacgtggctctgcaacggtgagctggtaaccgagggcgtagcagaaagcctgttcttaccaaggaccgactatagctttcacaaatttcattacctcacctttgtgccatctgccgaggacttctatgactgccgcgtagagcactggggactcgatcaacccctgctcaagcactgggaagcccaagagcccatacagatgcctgagacgaccgagaccgtgctgtgtgcccttggactggttctaggcctggtcggaatcatcgtcggaactgtgttaataattaagtcgctgagaagcggccacgacccgagggcacagggaacgctctag

SEQ ID NO: 229249 - DNA, 630 bp, Artificial Sequence
  Description of Artificial Sequence: Synthetic coding sequence
atgagaccagaggatcgaatgttccacatcagggcagtgatcctgagggctttatctctggccttccttctgtctttgaggggtgccggagccataaaggcagaccatgtgagcacctacgctgcatttgtgcagacccatcggcctactggagaattcatgtttgagtttgatgaggatgagatgttctatgttgatttagataaaaaggagaccgtttggcacttagaagaattcggacaggccttttcttttgaggcacaggggggattagccaacatcgccatcctcaacaataacctgaatacactcatacagagatccaaccatacccaggctaccaatgatccacccgaagtgacagtcttccctaaagaaccagtggagctgggacagcctaataccttgatctgccacatcgacaagttcttcccccctgttctcaacgtgacctggctgtgtaacggcgagttagtaactgaaggtgtggcagaaagcttgtttttgcccagaacagattacagcttccacaaattccattaccttacgtttgtcccctccgccgaggatttctacgattgtcgagtggagcactgggggcttgatcagccactgctcaaacactggtag

SEQ ID NO: 229250 - DNA, 783 bp, Artificial Sequence
  Description of Artificial Sequence: Synthetic coding sequence
atgagacccgaagaccggatgtttcacattagagcagtcatcctcagggctctcagtctggccttcctgctgtccctaaggggggctggcgctattaaagccgatcatgtttctacgtacgcagcctttgtacaaactcaccgcccaacaggcgaatttatgttcgagtttgatgaggatgaaatgttttacgttgacctcgataagaaagagactgtgtggcacttggaggagtttggacaagccttcagtttcgaggcacagggcggactagcaaatattgctatcttaaacaataatttgaacaccttaatacagcgtagtaatcacactcaggccacaaacgaccctccggaggtgaccgtctttccaaaagagcctgtggagcttggccagcccaatactttaatatgtcacatcgacaagttctttccgcctgtgcttaacgtgacctggctgtgtaacggcgagctcgtcactgagggagttgcagaaagtctctttttaccgagaactgactatagcttccacaaatttcattatcttacattcgttccatccgctgaggatttttatgactgcagggttgaacattggggacttgatcagccacttctgaaacactgggaggctcaggaacctattcaaatgccagagaccacggaaactgttctgtgcgcactgggtctggtgctgggcttggtaggcatcatcgtcggtactgtgttgataataaaaagtctaaggtcaggacatgatccacgggcacagggtacattatag

SEQ ID NO: 229251 - DNA, 72 bp, Artificial Sequence
  Description of Artificial Sequence: Synthetic coding sequence
atgcggccagaggatcgcatgtttcatatcagggcggtgatcctgcgcgctcttagcctggcttttctatag

SEQ ID NO: 229252 - DNA, 783 bp, Artificial Sequence
  Description of Artificial Sequence: Synthetic coding sequence
atgaggccagaagacaggatgttccacatcagggccgtgatcctgcgcgcactgtctctggcttttctgcttagcctgcgtggcgcaggcgcaatcaaggcggatcacgtgagcacctacgcagcctttgttcagacgcaccgtccaactggggagttcatgttcgagttcgacgaggatgaaatgttctatgtagacctcgacaagaaggagaccgtgtggcacctggaggagttcgggcaggctttcagttttgaagcacagggtggactggcaaacatcgctattttaaacaacaacctgaacaccctgatccaacggagcaatcacacccaggctacaaatgaccctcctgaggtgacagtcttccccaaagagccagtcgaactgggacagccaaacacattaatttgccacatcgacaagttcttccctccagttctgaatgtgacctggctgtgcaacggcgagttggtgaccgaaggtgttgcagagagtctgtttctccctaggaccgactattcatttcacaagtttcattacctgaccttcgtgcctagcgccgaggatttctatgactgtagggtggaacattggggcttagatcaaccacttctaaagcattgggaggcccaggagcccatacagatgcccgagactacggaaaccgtgctgtgcgcgctggggctcgttctcggcctggtcgggatcatcgtgggcacagtgcttatcattaaatctctgaggtccggccacgaccccagggcacagggcaccctgtag

SEQ ID NO: 229253 - DNA, 387 bp, Artificial Sequence
  Description of Artificial Sequence: Synthetic coding sequence
tgaaacaccctgatttgccatattgataaatttttccccccagtgcttaatgtgacgtggctctgcaatggtgaacttgtgactgagggtgtggccgaatctttgttcctccctaggactgattacagttttcacaaatttcattaccttacgttcgtgccctctgcggaagacttttatgactgtcgcgtggagcattggggacttgatcaacccttgctgaagcactgggaggcccaggagcccattcagatgcctgagactactgagactgtcctatgcgccctgggccttgtgcttggcttagttggcataatcgtgggaacggttcttatcataaagtccctcaggtcgggacacgacccccgagcccagggcaccctgtag

SEQ ID NO: 229254 - DNA, 783 bp, Artificial Sequence
  Description of Artificial Sequence: Synthetic coding sequence
atgcggccagaagatcgcatgttccatatcagggcagtcatcctccgagccttgtcattggccttccttctgtcattacgtggggctggggctatcaaggcagaccacgtgtcaacgtacgcagctttcgtgcagactcataggcctaccggtgagttcatgttcgaattcgacgaggatgagatgttttatgtcgatttggacaaaaaggagacagtgtggcatttagaagaattcggtcaggcttttagctttgaggcccagggcggactcgcgaacatcgcgattctaaataacaacctgaacacactgatccagcggagtaatcatacccaagcgactaatgatcctccagaggtcacagtgttcccaaaggagcctgtggaacttgggcagcctaacactctaatctgtcatatcgataaatttttcccacccgtgttgaacgtcacttggctttgtaacggcgagctcgtgactgaaggcgtggccgagagcctgtttttgcctaggaccgattattccttccataaattccactatctaacatttgtaccctccgccgaagatttttacgattgtagggttgagcactggggcctggaccagcccctcctgaaacattgggaggcacaagaaccaatccagatgcctgagaccaccgagacggtcctctgtgccttaggactggtgctggggctggttgggattatcgtgggaactgtgctaattatcaaatctctccgcagcggacacgatccaagggcccagggcacactgtag

SEQ ID NO: 229255 - DNA, 72 bp, Artificial Sequence
  Description of Artificial Sequence: Synthetic coding sequence
atgcgcccagaagatcgaatgttccatattagagccgttattctgagagccctttcactcgccttcttgtag

SEQ ID NO: 229256 - DNA, 630 bp, Artificial Sequence
  Description of Artificial Sequence: Synthetic coding sequence
atgcgcccagaagaccgaatgttccatattcgagccgttatcttaagagccctatcgctggctttcctactttccctgcggggtgcaggagctatcaaagcagaccacgtgtccacatatgcagctttcgtgcagacccataggccaaccggggaattcatgttcgaattcgatgaggacgagatgttctacgtcgacctggacaagaaggaaacagtgtggcacttagaggaatttggccaggccttctccttcgaagcgcagggaggattggcgaacatcgcaatacttaataacaatttaaatacgctcatccagcggagcaaccacacccaggcaactaatgatcctccagaggtcaccgtcttccccaaggagcccgtggagttgggccagcccaacacactcatctgccatatagacaagttctttccccctgtcctcaacgtgacgtggttatgtaatggcgaactcgtgacagagggcgtggccgagtctttgtttctgccaaggacagactatagttttcataagttccattaccttaccttcgtcccttctgcagaagatttctacgattgccgggtggagcattggggcctcgaccagccgttgctgaagcattggtag

SEQ ID NO: 229257 - DNA, 72 bp, Artificial Sequence
  Description of Artificial Sequence: Synthetic coding sequence
atgagacctgaagatagaatgttccatatcagagctgttatcctgcgggcactgtcattggccttcctatag

SEQ ID NO: 229258 - DNA, 387 bp, Artificial Sequence
  Description of Artificial Sequence: Synthetic coding sequence
tagaatacgctaatttgccatattgataaatttttccctccagtgctgaacgttacctggctatgtaacggtgagctggttaccgaaggcgtcgccgaatccttattcctgccaaggacagattacagctttcacaagttccattatttgacatttgtcccatcagctgaggacttttatgactgcagagtcgagcattggggcctagatcagccattacttaagcactgggaagcccaggagccaatacagatgcctgaaacaactgagaccgtgctatgcgctcttggattagttttgggattggtcggaatcatagtgggcacggtgcttattattaaaagtctgcgtagcggccacgacccaagagcccagggtaccttgtag

SEQ ID NO: 229259 - DNA, 783 bp, Artificial Sequence
  Description of Artificial Sequence: Synthetic coding sequence
atgcgacccgaggatcgcatgttccacatccgcgcagtcatcttgagagccctttctctggcattcctgctgagcttgagaggagccggagcaattaaggccgaccatgtcagcacatacgccgctttcgtccagactcacagacctacgggggaatttatgttcgaatttgatgaggatgagatgttctatgtggacctggacaagaaagagacagtgtggcatctggaagagtttggacaggcatttagcttcgaagcccaaggtggactagccaacatcgccattctcaataataatctgaatactctgatccagcgttctaaccatacgcaggccactaatgaccctccagaggtgactgtttttccaaaagaaccggttgagctgggacagcccaatactttaatctgtcatattgacaaatttttccctccagtgctaaatgtgacctggctgtgcaatggtgagctcgttacagaaggcgtggcagaatccctttttttaccacgaactgactactcatttcacaagttccattacttaactttcgtcccttcagcggaagatttttacgactgccgagttgaacactggggactggaccagcctttgcttaagcactgggaagctcaagagccaatccagatgccagagactacagagaccgtgttatgcgcactcggactggtgttaggccttgtgggaatcatagtggggaccgtactgatcataaaatcccttcgctcagggcacgatcccagggcccaggggaccctctag

SEQ ID NO: 229260 - DNA, 387 bp, Artificial Sequence
  Description of Artificial Sequence: Synthetic coding sequence
tgaaatactctgatctgtcacatcgacaagttcttccctccagtcttaaacgtgacttggctttgcaacggcgaattggtgaccgaaggtgttgcggagtccctgttcttgcctcgcacggactacagctttcacaaatttcactacctgacatttgtaccctctgccgaggacttttacgactgtcgggtagagcactggggtcttgatcagccgctcttgaaacactgggaggcacaggaaccaattcagatgcctgagacaaccgagaccgtcctgtgtgccttagggctcgtgctgggactggtgggcataatcgtggggactgtgttaatcattaagagtctgaggagcggacacgatcctcgcgctcagggcactctgtag

SEQ ID NO: 229261 - DNA, 72 bp, Artificial Sequence
  Description of Artificial Sequence: Synthetic coding sequence
atgcgccctgaggatagaatgtttcacattcgcgcagtcatcttgcgggctctatctctcgcctttttgtag

SEQ ID NO: 229262 - DNA, 630 bp, Artificial Sequence
  Description of Artificial Sequence: Synthetic coding sequence
atgcgccctgaagatcgcatgtttcatattcgcgctgtcattttgagagcccttagcctggctttcctacttagccttagaggcgctggagctatcaaggctgaccacgtgagtacatacgcagccttcgtccaaacccatagacccactggagagttcatgttcgagtttgacgaggatgaaatgttctatgtggatctggacaagaaagagacagtgtggcacctcgaagaattcggccaagccttctcttttgaggcgcaaggcggactggctaacattgcaatactcaacaataatctaaacacactcatccagagaagcaatcatacccaagctacaaacgaccccccagaggtgacagtttttcctaaagagcccgtagagctggggcagcctaacaccctcatatgtcatattgataagttcttcccacctgtcctgaacgtaacctggctttgcaatggagagcttgtgacagaaggggttgcggagtccctcttcctcccacggacagactattccttccacaagtttcattatctaacgtttgtcccatctgcagaagatttttatgactgcagggtggaacattggggcctggaccagccactcttgaaacactggtag

SEQ ID NO: 229263 - DNA, 639 bp, Artificial Sequence
  Description of Artificial Sequence: Synthetic coding sequence
atgaggcccgaggacaggatgttccatattcgagcggtgatccttagagcgctcagtctggcctttcttctgagtctacgaggagctggcgcaatcaaagccgaccacgtgtcaacctatgccgcttttgtgcagacccacagacctacaggagagttcatgttcgagtttgacgaggatgagatgttttacgtcgatttagacaagaaagagaccgtgtggcacctggaggaattcgggcaggcatttagcttcgaagttaccgtgtttcctaaggaaccagttgagctggggcagcctaacacgctgatctgtcatatagacaaattcttcccaccagtgttaaacgtgacatggctctgtaacggtgaactggttactgaaggcgttgctgagagcttatttcttcctcgcacagactattccttccataaatttcattacctcaccttcgtgccaagtgccgaggatttttatgattgccgggtagagcattggggccttgaccagcctctcctaaaacattgggaggcccaggagcctatacagatgcctgagaccacggagaccgtcctctgcgccctgggcttagtgctgggtttggttgggatcatcgtgggaacggtgctcattatctag

SEQ ID NO: 229264 - DNA, 639 bp, Artificial Sequence
  Description of Artificial Sequence: Synthetic coding sequence
atgcgccctgaggaccggatgtttcacattcgcgctgtcatactcagggctctgagtctcgccttcctattgtccctgagaggagcgggtgcgatcaaagcggatcacgtgtcaacttatgctgccttcgtacagacacacagacctaccggtgagttcatgttcgagttcgacgaggacgagatgttttacgtcgatctggataaaaaagaaactgtgtggcacctggaagaatttgggcaggcatttagcttcgaggtaacggtgttcccgaaggagcctgttgaactgggacaaccaaacaccctgatctgccatatcgataagttctttcccccagtgctaaacgtaacctggctctgtaatggagagctcgttaccgagggggttgccgagagtctgttcttgcctcggaccgattacagttttcacaaattccattatctgacgtttgtgccaagtgccgaggacttctatgactgtcgagttgagcattggggcttggaccagcctcttctcaagcattgggaggcccaggaaccaatccagatgccggagacaacggaaactgtgctatgcgccctcggattagtgttgggcctcgtcggcattatcgtcggtacggtcctaataatttag

SEQ ID NO: 229265 - DNA, 387 bp, Artificial Sequence
  Description of Artificial Sequence: Synthetic coding sequence
tagaatactttgatatgtcatatagataagttctttcctccagtgctgaacgtaacttggctgtgtaatggtgagctggttaccgagggggttgctgaatccttgttccttccccgtaccgactactcctttcataaattccactatctgactttcgtcccctccgctgaagatttctatgactgtcgcgtcgaacattgggggctggaccagccattactgaaacactgggaagcccaagagcctattcaaatgcccgagacaacggaaaccgtgctctgcgcattgggcctggtcctgggtctggtggggattatcgtcggtaccgtcttgatcatcaaatcgctccgttctggtcacgatcctcgggctcagggcactttgtag

SEQ ID NO: 229266 - DNA, 639 bp, Artificial Sequence
  Description of Artificial Sequence: Synthetic coding sequence
atgcggccagaggatcgcatgtttcatataagggccgtgattctccgcgctctttcacttgcattcttactgtcactccggggtgccggagctatcaaggcggaccacgtgtcaacgtatgctgcatttgttcagacccatcggccaacaggagagttcatgttcgagtttgacgaggacgagatgttttacgttgaccttgacaagaaggagactgtgtggcatctggaagaattcgggcaagcattcagttttgaagtcacggtcttccctaaggagcccgtcgagctgggccagccgaacacgctcatttgtcacatagacaagtttttcccgccagtgctcaacgtaacttggctctgtaacggtgagctagtgacggagggcgtagcagagagcctcttcttgccaagaacagactacagcttccacaagtttcattaccttaccttcgtgccaagtgcagaggacttttatgattgtcgtgtcgagcattggggactcgaccagccattgcttaaacactgggaggcacaggagcctatacagatgcctgaaactaccgaaacagtgttatgcgctctagggctggttctcggactggttggcattatcgtgggtactgtgcttataatttag

SEQ ID NO: 229267 - DNA, 630 bp, Artificial Sequence
  Description of Artificial Sequence: Synthetic coding sequence
atgagacctgaggatcgtatgtttcacatccgtgccgtgattctccgcgcattgtctttggcattcttgctcagcttgaggggagctggtgccataaaggcagaccacgtgtccacctacgctgcctttgtccagactcaccgccctactggggagtttatgtttgaattcgacgaggacgaaatgttttatgtcgatctggataagaaggagaccgtctggcacctggaggagtttgggcaggctttctctttcgaggctcagggcggattggctaatattgccatcctaaacaataacctgaatacactcatccaaagaagcaatcacacgcaagctacaaacgatcctcccgaggtgaccgtcttccccaaagaaccggtggagctgggccagcctaacacccttatttgccatattgacaagttctttccacctgtcttgaacgtaacatggttatgtaatggggaactcgttacagaaggagtggccgagagccttttcttgcctcggaccgattatagtttccacaagttccactacctgacctttgtccccagtgctgaagacttctacgattgccgcgtcgagcactgggggctggaccagccgctgcttaaacactggtag

SEQ ID NO: 229268 - DNA, 72 bp, Artificial Sequence
  Description of Artificial Sequence: Synthetic coding sequence
atgcgtcccgaagatagaatgttccacattcgagccgtgattctgcgggctctgagcctggcttttctgtag

SEQ ID NO: 229269 - DNA, 639 bp, Artificial Sequence
  Description of Artificial Sequence: Synthetic coding sequence
atgcgtcctgaagacaggatgttccatatccgcgcagtgatcttacgtgcactgagcttggcattcctgctctccctgaggggagccggtgccattaaggctgaccacgtgagcacatacgctgcatttgtgcagacgcacaggccaaccggagagttcatgttcgaattcgacgaggatgagatgttctatgtcgatctggacaaaaaggaaacggtgtggcatctcgaggagtttggacaggccttctcttttgaggtgacagtttttccgaaagaacccgtggagctcggccagcctaatactctgatctgccatatagacaagttctttcctccagtgctcaacgtcacgtggctttgcaacggtgagcttgtaaccgagggagtggcggaatctctgttccttccccgaaccgattactcatttcataaatttcactatctcaccttcgttccgtccgcagaagacttctatgactgccgcgtagagcactgggggctcgaccagcccctgctgaagcattgggaagcacaagaacccatccagatgcccgagactacggagacggtcttatgtgctctcggcttagtgctgggtttagtgggaatcatcgtaggaacagttcttataatttag

SEQ ID NO: 229270 - DNA, 630 bp, Artificial Sequence
  Description of Artificial Sequence: Synthetic coding sequence
atgcgccctgaggacaggatgtttcatatcagagccgtaattctccgagctttgagcctagcctttcttctatcacttcggggagccggtgcaatcaaagccgaccatgtgagcacttatgccgctttcgtgcagactcataggccaacaggcgagtttatgttcgaatttgatgaggacgagatgttttatgtggacctcgacaagaaggaaacagtctggcatttggaggaattcgggcaggctttctcatttgaggcgcagggaggccttgccaacatcgccattctcaataacaacctgaacacacttatccagaggtccaaccatacgcaggccacaaacgacccacctgaagtaacggtctttccaaaggagcccgtagagctggggcagccaaataccctgatatgccacatagacaagttctttccccctgtattgaatgtgacatggttgtgcaacggagagttggtcactgaaggagtagcggagagcctgttcctgccgagaactgactactcttttcacaagttccactacctgacatttgttcctagcgccgaggatttctatgactgccgtgtcgaacattggggtttggatcagccgttgcttaaacactggtag

SEQ ID NO: 229271 - DNA, 387 bp, Artificial Sequence
  Description of Artificial Sequence: Synthetic coding sequence
tgaaatacattaatttgccacattgataagtttttccctcccgtactgaacgttacgtggctgtgcaatggtgagctggtaactgagggggtggcagagtctctgtttcttcccagaacagattattcatttcataagtttcattatcttaccttcgttccaagcgccgaagacttctatgattgccgcgtggagcactggggccttgatcagcccctactgaagcattgggaggcccaggaaccaatccaaatgccagagacgactgagaccgttctgtgcgcccttggactggtgctaggtctggtgggtatcatcgtaggcaccgtcctgatcataaaatctctgcggtcagggcacgatccgagggctcagggaaccctgtag

SEQ ID NO: 229272 - DNA, 783 bp, Artificial Sequence
  Description of Artificial Sequence: Synthetic coding sequence
atgcgcccagaggacaggatgtttcacatcagagctgttatactccgggcactgtctctcgcttttttactatcattgcggggagccggagccatcaaggccgaccacgtatctacctacgccgctttcgtccagactcatcgccctacaggcgaattcatgttcgagttcgacgaggacgagatgttttacgtcgacctagacaagaaggaaacagtgtggcacttggaggagtttgggcaagcgttcagtttcgaagcccaggggggactggcgaatattgccatcctgaataataatctcaacacactgatacaacggagtaatcatacacaggctactaatgatccacctgaggtgaccgtcttccctaaggaaccagtggaacttggacagccgaacactttaatctgtcacatcgacaagttttttccaccggtgctcaatgtgacctggctgtgcaatggggagttggtgaccgagggcgtagcagaaagcctcttccttcctaggaccgattactctttccacaaattccattaccttacatttgtaccatccgccgaggatttttatgactgtagggtggaacactggggcctggatcaacctctgctgaaacattgggaagctcaggagccaatccaaatgccagagacaaccgagactgtcctgtgcgccctggggctggttctcgggcttgtcggtataatcgtgggcacagtgctgattattaagtcccttagatccgggcacgatccacgggcacaaggaactctctag

SEQ ID NO: 229273 - DNA, 639 bp, Artificial Sequence
  Description of Artificial Sequence: Synthetic coding sequence
atgcgaccggaagaccgcatgttccacataagggcggtgattttgcgtgcactgagcctcgcctttttgctgtccctgaggggagcaggagccatcaaggctgaccacgtctctacatacgccgcattcgtccagactcatcggccaacaggcgagttcatgtttgaatttgacgaagatgagatgttctacgtcgaccttgacaaaaaagaaacggtctggcatcttgaagagtttggccaggcatttagctttgaggtcacagtgttccctaaggaacccgtggaactgggccagccaaacacactgatctgtcatattgacaaattttttccccctgtgctcaatgtgacctggctgtgcaatggcgaacttgtcaccgagggagtggctgagagcctgtttctgccaaggaccgactacagtttccataagttccattatctgaccttcgttccaagtgcagaggatttctatgattgccgcgtcgagcactgggggctggatcagccgttactgaagcattgggaggcacaggagccgatacagatgcctgaaactaccgagaccgttctttgtgccttggggctcgttttgggactggtggggatcatagttgggacagtccttatcatctag

SEQ ID NO: 229274 - DNA, 72 bp, Artificial Sequence
  Description of Artificial Sequence: Synthetic coding sequence
atgcgaccagaagacaggatgttccacattagggccgtaatcctgcgggctctatctctggctttcttgtag

SEQ ID NO: 229275 - DNA, 639 bp, Artificial Sequence
  Description of Artificial Sequence: Synthetic coding sequence
atgcgacccgaggatagaatgttccacatcagagccgtgatcctcagagctttgtccctcgctttccttctaagcctgaggggagccggagcaatcaaggccgatcacgtctccacgtacgcagcgtttgttcagacacatcggcctactggcgagttcatgtttgagtttgacgaagatgaaatgttctacgttgacttggacaagaaggagacggtttggcatttagaggagtttggtcaggcgttcagctttgaagtgaccgtgttcccaaaggagccagtcgagcttggtcagccgaacacgctcatctgtcacattgataaattttttccacctgtattgaacgtgacatggttgtgtaatggcgaacttgtcactgagggtgtggctgaatccctgtttttgcctcggacagattactcatttcataagttccactatctgacattcgtcccttcggctgaggacttttacgactgccgcgttgagcattggggccttgatcagcccctgttaaagcattgggaagcccaagagcccattcagatgcctgagactaccgagactgtgttatgcgcgctgggactggtgctaggactggtcggtatcatagtcggtacagtgctgataatctag

SEQ ID NO: 229276 - DNA, 72 bp, Artificial Sequence
  Description of Artificial Sequence: Synthetic coding sequence
atgaggcccgaagatcgcatgtttcatatccgagccgtgattctgcgcgctctttctctggccttcttatag

SEQ ID NO: 229277 - DNA, 639 bp, Artificial Sequence
  Description of Artificial Sequence: Synthetic coding sequence
atgagacccgaggacagaatgttccatatcagggcagtcatactgagagccctatctctggcgttcctgcttagccttcggggtgctggtgctatcaaggccgaccatgttagcacatacgctgctttcgtccagacccatcgacccacaggcgaatttatgttcgaatttgatgaggacgaaatgttttacgtcgaccttgacaagaaagagacggtgtggcatcttgaggagttcggacaggctttttccttcgaggtgactgtgtttcccaaggaaccagttgagcttgggcaacctaacacccttatttgtcacattgataaattcttcccacctgtgttgaatgtgacatggctgtgcaatggggaattagttacggaaggcgtggccgaaagtctgttcctgccacgcaccgactattcgtttcacaaattccactatttaactttcgtgcctagtgccgaagatttctacgactgcagagtggagcattgggggttagatcagccgctgttgaagcactgggaggctcaagaacccatccagatgccagagactacagagaccgtattatgcgccctgggtctcgttttgggtctagtgggcatcatcgtgggcaccgtcctcattatttag

SEQ ID NO: 229278 - DNA, 387 bp, Artificial Sequence
  Description of Artificial Sequence: Synthetic coding sequence
tagaacacactcatctgccacattgacaagtttttccctcccgtcctcaacgtgacatggctatgtaatggagaactggtcaccgaaggtgtcgccgagtctcttttcttgcctcgcacagattactctttccacaagtttcactatcttacctttgttccgagtgccgaagacttttacgactgtcgggtggaacactggggcctcgatcagcctttgctgaagcattgggaggcacaggaacccatccaaatgccagaaaccactgagacagtgttgtgcgccctggggctcgtgctgggccttgttggcattatcgttggtactgtgctcatcattaagtccctgcgttctggtcatgacccacgggcacagggcacactgtag

SEQ ID NO: 229279 - DNA, 630 bp, Artificial Sequence
  Description of Artificial Sequence: Synthetic coding sequence
atgcgcccagaagatcgtatgttccatattcgagctgttatcctgagggcactttctcttgctttcctcctgtcactgcgcggtgccggagccattaaagccgatcatgtttccacttacgccgctttcgttcagacccacagacctaccggggagtttatgttcgagtttgacgaggacgaaatgttctacgtcgacttggacaaaaaggaaacagtctggcatctcgaggagtttggccaggccttttcctttgaggctcagggcggactggccaacatcgcgattctgaacaacaacttgaatacacttattcagaggagcaaccacacccaggccaccaacgacccacctgaggttaccgtgttccccaaggaacctgtggaactggggcagccaaatacactaatttgtcacattgataaattcttcccaccagtgctgaacgtgacgtggctttgcaatggcgaactggtaacggagggggttgccgaaagcttattcctgcctcgtacggactacagcttccacaagttccactatctaaccttcgttccatctgccgaggatttttacgattgccgagtggaacactgggggttggaccaacccctgcttaagcattggtag

SEQ ID NO: 229280 - DNA, 783 bp, Artificial Sequence
  Description of Artificial Sequence: Synthetic coding sequence
atgaggccagaggaccggatgttccatatccgcgctgtgatcctaagggcgttgagccttgcctttctgctatctctgcggggtgcgggagccatcaaggccgaccatgtttccacgtacgccgcttttgtgcagacccacagaccgactggagagtttatgtttgaatttgacgaagatgagatgttttacgtggacctggacaagaaagaaacagtctggcacttagaggagttcggccaggcatttagcttcgaggcccaaggcggactagctaatattgctatcctgaataacaatctaaacaccctgattcagaggtcaaaccatactcaagcaacgaacgaccccccagaggtgacggtgttcccaaaggaacctgtcgagctgggtcagccaaatactttaatttgccacattgacaagtttttcccgcctgtgctgaatgtgacatggttgtgtaacggagagctggttaccgaaggagttgccgagtctctgtttttgccccgtaccgactactcattccacaagtttcattaccttactttcgtgccatcagcggaagatttttatgactgccgagtggagcactggggcctggaccaaccactcttaaaacattgggaagcccaagagcctatacagatgcctgaaaccacagagaccgttttgtgtgccttgggcttggtgctgggcctcgtgggaattattgtgggtacagtgctcatcataaagtctctgaggtccggtcacgacccccgagcgcagggaaccctgtag

SEQ ID NO: 229281 - DNA, 387 bp, Artificial Sequence
  Description of Artificial Sequence: Synthetic coding sequence
tagaacaccttgatctgccatatcgacaagttctttcctccagtgctcaatgtaacgtggctgtgtaacggggagcttgtgaccgagggcgtggccgaatctctcttcctacctcgcaccgactactcctttcacaaattccattacctgaccttcgtgccgagcgcagaggacttctatgactgtcgagtggaacactggggattggaccagcccctgctgaagcactgggaagcccaggaacccatacagatgcctgagaccacggagaccgtgctgtgcgccttggggctcgtcctaggattagtgggaatcatcgtggggaccgtattgattatcaagagcttacggagtggtcacgaccctagggcccaaggcactctatag

SEQ ID NO: 229282 - DNA, 630 bp, Artificial Sequence
  Description of Artificial Sequence: Synthetic coding sequence
atgcggccagaagatcggatgtttcacatcagggccgtaatcctccgggctctgagcctggcatttcttttatccctcagaggcgctggagcgatcaaggcggatcacgtgtctacatatgcggcttttgtccagactcataggcctactggggaattcatgtttgaattcgacgaagacgagatgttttatgtagacctcgataaaaaggaaaccgtctggcacctagaggaatttggccaggcgttctctttcgaagctcaaggtggactcgctaacatagccatcctgaacaacaatttgaacactctgattcagaggtccaaccatactcaggccaccaacgacccacccgaagtgaccgtctttcccaaagaaccagtagagctggggcagccaaacacactaatctgccacattgataagttctttcccccagtcctgaatgtgacatggctgtgcaatggcgaactggtcaccgaaggggttgctgaatccctgtttctgcccaggactgattactctttccacaaattccactacttaacattcgtgcccagtgccgaggatttctacgactgccgagtggagcactggggattggatcagccactactcaagcactggtag

SEQ ID NO: 229283 - DNA, 630 bp, Artificial Sequence
  Description of Artificial Sequence: Synthetic coding sequence
atgagaccagaagacaggatgttccacataagagccgtgattctgcgtgcattatctctcgcctttctgctgtccctccggggagctggcgctattaaagctgatcatgtcagtacctacgcagcctttgtgcaaacacatcggccaaccggcgaatttatgttcgaattcgacgaggatgagatgttctatgtagacctggataaaaaagagactgtctggcatctcgaagaattcggtcaggcgttctctttcgaggcccagggcggtcttgcaaacatcgccatcctgaataacaatctgaacacgctcatccaaagatctaatcacacccaggcaaccaatgatcccccagaggtgactgtgtttccaaaagagcccgtcgagttaggccagcctaacaccctcatctgtcacattgacaagttcttcccccctgttctcaacgtgacatggctgtgtaacggagaactggtcacagagggcgttgcagaatcactctttcttccccgtacggactactccttccataagttccactaccttacttttgtgccctctgccgaggacttctacgactgcagggtcgagcattggggcctcgatcaacctctgctgaagcattggtag

SEQ ID NO: 229284 - DNA, 783 bp, Artificial Sequence
  Description of Artificial Sequence: Synthetic coding sequence
atgagaccggaggaccgaatgtttcacatcagggcggtgatactgcgcgctctatctctggcctttctgctttctctacggggtgccggagcaataaaggccgatcatgtttccacatacgcagccttcgtgcagacccatcgacccacaggagagttcatgttcgagtttgacgaggacgagatgttctacgtggacctcgacaagaaagagacggtgtggcatctggaagagtttggacaggcattcagcttcgaggcccaggggggtctggccaacattgctatattaaataacaacctgaataccttgatacaacgctccaaccatacccaggccacaaatgatcctccggaagtcacggtattcccaaaggagcccgtggagctcggccagccaaacaccctcatctgccacatcgacaagtttttccctccagtcttgaatgtcacatggctgtgcaatggcgaactagtcaccgagggcgtggcggagtccctgtttcttccgaggaccgactacagctttcataaattccattacctgacttttgtccccagtgctgaggatttctatgactgtagggtggaacattgggggctggatcagccacttctgaaacattgggaggcacaggaaccaatacagatgcccgaaacaaccgaaactgtgctgtgcgcccttggtctggtgctggggctggtgggaatcatcgtgggcaccgtcctgattataaagtcactgcgcagcggacatgatccgagagcgcaaggaactctctag

SEQ ID NO: 229285 - DNA, 639 bp, Artificial Sequence
  Description of Artificial Sequence: Synthetic coding sequence
atgcgtccagaggataggatgttccacattagagccgtgatcctgagagcgttgtctctcgcgtttctgctctctctgagaggggcaggcgctatcaaggcagaccatgttagcacttatgccgcattcgtgcagacccacaggccaacaggagagtttatgtttgagtttgacgaggatgaaatgttctatgtggatttggacaaaaaggagactgtgtggcatcttgaggagttcgggcaggctttcagtttcgaggttacagtctttcccaaagaaccggtcgaactgggacagcctaataccttgatctgtcatatcgacaagtttttccccccagtgctcaacgtcacttggctgtgcaatggggaactggttactgaaggcgtggcagagagcctgttcctgcctagaacggattatagtttccataaatttcactatctgacatttgtaccttctgccgaggatttttatgattgccgcgtggaacattggggcttagatcaacccctcttaaagcattgggaagcccaggagcccatccagatgcctgaaactactgagaccgtcctctgtgccctgggcctcgttttgggcctcgtcggaatcattgtcgggaccgtactgatcatctag

SEQ ID NO: 229286 - DNA, 783 bp, Artificial Sequence
  Description of Artificial Sequence: Synthetic coding sequence
atgaggccggaagaccgcatgttccacatccgtgccgtgatcctccgggcactgtcacttgcatttttacttagcctgcggggagccggtgctattaaggcagatcatgtgtcaacatatgccgctttcgtgcagactcataggccgacaggcgagtttatgtttgagtttgatgaggatgagatgttttatgtggatttggacaaaaaggaaaccgtgtggcacttggaggagttcggtcaagcgttttcctttgaggcccagggcggactggcaaatattgctattctgaacaacaaccttaacaccctcattcaacgcagcaaccatactcaggcaaccaacgaccccccagaagttactgtttttcctaaggagcccgtggaactcggacaaccaaacactttgatctgtcacatcgataagttcttccctcccgtgctgaatgtcacttggctatgcaacggagagttggtcactgaaggcgtcgcggaaagcctgtttcttccacgtacagattacagtttccataaattccattacctcacgttcgtacccagcgcagaggacttttacgattgtcgggtggaacactgggggctggatcaaccactactcaagcactgggaggcacaagagcccattcaaatgcctgaaacgactgaaacagtactgtgtgctctaggtttggtgctggggttggttggaatcattgtaggcaccgtgcttataattaagtccctgcggtccggacatgatccgagggcccagggaaccttatag

SEQ ID NO: 229287 - DNA, 783 bp, Artificial Sequence
  Description of Artificial Sequence: Synthetic coding sequence
atgcggcctgaagacaggatgttccatataagggctgtgattctgagggccctctcactcgcttttcttctgagcctgcggggtgccggagctattaaggcagatcatgtctcaacatacgcagcctttgtgcagacccatcgcccaaccggcgagtttatgttcgagttcgatgaggatgaaatgttttatgtggacctcgataaaaaggagaccgtctggcatctcgaggagttcggtcaggccttttctttcgaggcccaagggggactggccaacatcgccattcttaataacaacctcaacacacttattcaaaggagcaaccatacccaggctacaaacgaccctccggaggtcactgtcttccccaaagagcccgtagagctcggacagcctaatactctgatatgtcatatagacaagttttttccgcctgtcctgaatgtgacatggctgtgcaacggagagcttgtcactgagggcgtggccgaatctctgtttctgcccagaactgactactcattccacaagttccactatttgacgttcgtcccttcagctgaggatttttacgattgccgggtcgaacattggggcctcgaccagccgctccttaaacattgggaggcccaggaaccaatacagatgccggagactacagagaccgtgttgtgcgctctgggcctggtgctcggattggtgggtattatcgtggggactgtgctgattattaaatccctccggtccggacacgaccctcgggcacagggaaccctctag

SEQ ID NO: 229288 - DNA, 783 bp, Artificial Sequence
  Description of Artificial Sequence: Synthetic coding sequence
atgagacctgaagaccggatgtttcacatccgcgctgtgattctcagagctctgagccttgcgtttctgttgagcctgcggggagccggtgctatcaaagccgatcatgtctctacttacgctgcttttgtacagacacatcgccctacaggcgagttcatgtttgagttcgacgaagatgaaatgttctacgttgacttggacaagaaagagaccgtgtggcacctggaagagttcgggcaggcattcagcttcgaggcccagggcggattggcaaacatcgccatcttgaacaataatctaaacaccctgattcagcgctctaaccacactcaagctacaaatgaccctccagaagtaacagtgtttccaaaggagccagtggaactgggccagccaaataccctcatctgccatatagataaattttttccccctgtgctcaatgtgacttggctctgcaacggagagcttgtgaccgaaggcgtggctgaaagcctgttccttccgcgaaccgactacagcttccacaaatttcactatctcacattcgttccatcggccgaggatttttatgactgccgggtggagcattggggcctggaccagcctcttctcaaacactgggaggcacaagagcccatccagatgccagagacaactgaaaccgtcctgtgcgctctgggcctcgttctgggcttggttggaataattgtcggaacagtgctcatcattaagagcctcaggagcggacacgacccaagggcccaaggcactctctag

SEQ ID NO: 229289 - DNA, 783 bp, Artificial Sequence
  Description of Artificial Sequence: Synthetic coding sequence
atgcggcctgaagatcggatgttccacattagagcagtcatcttaagggcactctcactagcgtttctgctgagcctgcggggagccggagccatcaaggcagatcacgtatccacctatgccgctttcgtgcagacacaccgtcccaccggagagttcatgttcgagtttgacgaggatgaaatgttttacgtcgacctcgacaagaaagagaccgtctggcaccttgaggagtttggccaggcctttagcttcgaggcccagggtggcctggccaacattgctatcctgaacaataacctcaatacactgattcagaggtcaaaccacactcaggctacaaacgatccccctgaggtgacggtctttccgaaagaacctgttgagctcggacagccgaatacacttatatgccacatagacaagtttttcccacccgtgttgaacgtcacctggttgtgcaatggagagttagtgaccgaaggtgtggccgagagtctgtttctcccaagaacagactactccttccataagttccattacctcaccttcgtgccttcggcagaggatttctatgattgtcgcgtcgagcactggggcctggaccagccattactcaagcactgggaagcccaggagcccattcagatgcctgagaccactgagaccgtactgtgcgctctgggcctggtgctcggcctcgttggaataattgtgggaaccgtgctcatcatcaaatctttgcggagcggccacgatcctagagcccagggcaccctgtag

SEQ ID NO: 229290 - DNA, 783 bp, Artificial Sequence
  Description of Artificial Sequence: Synthetic coding sequence
atgcgcccagaggatagaatgttccatatcagagcagtgatcctcagagccctgagtctggcttttctgctctctctgagaggtgctggcgcaattaaggctgaccatgtatccacctacgccgcatttgttcagacccacagacctacgggcgagtttatgttcgaatttgatgaagacgagatgttttatgttgatctcgataagaaggaaacagtgtggcatctcgaagaattcgggcaggccttctcatttgaggcacagggcggacttgccaatatcgccatactgaataacaacctcaacacacttatccaaagatcaaatcacacacaggccacaaacgatccgcctgaggttactgtatttccgaaagagcccgtggagctcgggcaaccgaacaccctgatttgccatatcgataagtttttcccaccagtgctgaatgttacatggctgtgtaatggagaattggtgacagaaggggttgcggaaagcctctttctgccacgaaccgattatagctttcacaaatttcactatttaactttcgtaccaagcgccgaggatttctatgattgccgcgttgagcactggggattagaccaacctttgctcaaacattgggaggcccaagagcctatccagatgccggagactacagagacggtgctttgcgcccttggcctggtgttgggactcgtcggtattatcgttggcactgtcttaatcatcaagtccctgcggagtggacacgatcccagggcgcaaggaaccttgtag

SEQ ID NO: 229291 - DNA, 783 bp, Artificial Sequence
  Description of Artificial Sequence: Synthetic coding sequence
atgcgtccagaggatcggatgttccacatacgagctgttatcttgcgggctctgtcccttgccttcctgcttagcctgcgaggcgctggggcaattaaagcagatcacgtgtctacttatgctgccttcgtgcagacccatagacccacaggggaatttatgttcgaattcgatgaagatgagatgttctatgtggatctggacaagaaagaaactgtgtggcatctcgaagaatttggccaggccttcagcttcgaagctcaaggcggactggctaatatcgccattctgaacaacaatttaaatactctgatacaacgctccaaccatacgcaggcaacaaatgatccgccagaggttactgtgttccccaaggaacctgtggaattgggacaacccaataccttaatctgtcacattgataaattcttccccccagtgctgaatgtgacctggctttgcaacggcgagttagttaccgagggggtcgctgaatccctgtttctgccgcgtacggactactctttccataagttccattacctgaccttcgtccctagcgcagaggatttctatgactgccgggttgagcactgggggttagatcagcccctgttaaagcattgggaggctcaggaacctatccagatgcctgagactactgagaccgtgttgtgcgcgctggggcttgtccttggcctcgtggggatcatcgtgggaaccgtgctcatcatcaagtccttacggagtgggcacgatccccgagcgcaggggacactgtag

SEQ ID NO: 229292 - DNA, 777 bp, Artificial Sequence
  Description of Artificial Sequence: Synthetic coding sequence
atgatggtcttacaggtctctgctgcgccaaggacagtggcattaacggcactcctgatggtgttacttacaagcgttgtacaggggagagctacgccggaaaattatgtataccaattacgacaagagtgttacgcctttaatggaacacagagatttctggaacgttatatttacaacagggaggagtttgtccgtttcgactctgacgtgggggaattcagagcagtgacagaactgggtagacctgatgaggattactggaactctcagaaagatctgcttgaagaaaaacgggcagtgccagacagggtctgccggcacaactacgagctcgacgaggcagtgaccctgcaaaggagagttcagcctaaagtgaacgtgtcgcccagcaagaaggggccacttcagcaccacaacctgcttgtgtgccacgttactgacttctatccgggtagcattcaggtgcgctggttcctcaatggccaggaggagacagcgggtgtggtctccacaaaccttatcaggaacggcgactggaccttccaaattctggtcatgctggagatgacacctcagcagggagatgtctatatctgccaggttgaacatacgagcttggatagtccagttactgtcgagtggaaggctcagtcagactctgcgaggagcaaaaccctcactggcgctggcggattcgtgctgggcctcattatctgcggggtgggaatattcatgcaccgcaggtcaaagaaagtacaaagaggtagcgcatag

SEQ ID NO: 229293 - DNA, 687 bp, Artificial Sequence
  Description of Artificial Sequence: Synthetic coding sequence
atgatggtgctgcaggtgtctgccgctcccaggaccgtggcactgacggccctgctgatggtcctgttaacctcggtggtgcagggtcgggctaccccggaaaattatctatttcaaggaaggcaggaatgctacgcattcaatggaacccaacgctttcttgagcgctacatttataatagggaagaactggttagattcgattcagatgttggtgagtttagggccgttaccgaactggggaggccagaggccgaatactggaatagccagaaggatatactggaagaagaaagagccgtgccagatcgcatgtgccgccataactatgaattgggtggcccaatgactctgcagcggagaggcagcattcaggtgaggtggttcctgaatgggcaggaggagaccgccggtgttgtgagcaccaacctgatacggaatggagactggacattccagatcctggtcatgctggagatgacaccccaacagggagatgtgtatacatgccaggttgagcatactagtctggattctccagtgaccgttgagtggaaggcccagtccgattcagccagatccaaaaccctgacaggggctggtggcttcgttctcggactgatcatctgtggagtgggaatcttcatgcacaggcggtcaaaaaaggtgcagagaggctccgcgtag

SEQ ID NO: 229294 - DNA, 777 bp, Artificial Sequence
  Description of Artificial Sequence: Synthetic coding sequence
atgatggtgctccaggtgagcgccgctcccaggaccgtcgcactgacagcgctgttaatggtcctcttaacctccgtggtgcagggcagagcaacaccggagaattatttgtttcagggtcgccaggaatgttatgcctttaacggcacacagcgtttcctggaacggtacatctacaaccgcgaggagctcgtgagatttgatagtgacgtcggcgagtttagagccgtcactgagctgggacgacccgaggctgaatactggaactcacaaaaggacatactcgaggaggaacgcgcagtgcctgaccgaatgtgccgccacaattacgaactggggggtcccatgacacttcagcgccgtgtacagccgagggtaaatgtgagtccatctaagaaaggaccgttgcagcatcataacctgttggtctgtcatgtaaccgacttttacccgggaagcattcaggtgagatggtttctgaatggtcaggaggagactgctggcgtggtgagcacgaacctcatcagaaatggggactggacgttccaaattcttgtgatgctcgaaatgacaccccagcagggggacgtgtacacctgccaggtcgaacacaccagtctcgactcaccagttacagttgaatggaaagcccaaagcgatagtgccaggtccaaaacactgaccggagcaggaggcttcgtccttggtcttataatctgcggggttggaatattcatgcatcggagatctaaaaaagtacagagaggaagcgcctag

SEQ ID NO: 229295 - DNA, 690 bp, Artificial Sequence
  Description of Artificial Sequence: Synthetic coding sequence
aagcaggcatggagaggctctgccacaagactgggccctcaaaacagcgggaggcaagagtgttatgcctttaacggtacccaaaggttcctcgaacggtacatatacaacagggaagagctggtacgcttcgactctgacgtgggggagtttcgggctgtaacggaactggggcgacctgaagccgaatattggaactctcaaaaggacatcctagaagaagaacgggctgtgcctgataggatgtgcaggcataactacgagctgggcggtcctatgacattgcagagaagggtacaaccccgtgttaatgtatcaccttccaaaaaaggccctctgcagcatcataatctcctcgtctgtcacgtgaccgacttttacccaggcagtatccaggtgaggtggtttctgaatggtcaggaagagaccgccggagtcgtaagcaccaatctcatacgcaatggggattggacttttcaaatcctggttatgctggaaatgacaccgcagcaaggcgacgtgtacacttgccaggtggagcatacatctttggacagccccgttactgtggagtggaaggcacagagcgatagcgcgaggagtaagactttgacaggcgcaggcggatttgtgctcggactgatcatttgcggggtcgggatcttcatgcaccgacgttccaagaagtag

SEQ ID NO: 229296 - DNA, 687 bp, Artificial Sequence
  Description of Artificial Sequence: Synthetic coding sequence
atgatggtactgcaggtttccgccgcacctagaactgtcgccctgaccgcactgttaatggtcctcctgacctccgtggttcagggacgcgctacgccagaaaattatctgttccagggaagacaagagtgctatgctttcaatggcacccaacgcttccttgaacgctacatatacaaccgagaggaattcgcacggtttgattctgatgtgggagaatttcgggctgtgaccgaactggggagaccggcagcggagtattggaattcacagaaagacatcctagaggagaagagggccgtccctgataggatgtgtcgccacaactacgagctggggggaccaatgactctgcagcgacgaggctcaatacaggtccgctggttccttaacggccaggaagaaactgccggagttgtcagcacgaacctgattaggaatggggattggacattccagatacttgtgatgttagaaatgacgcctcagcagggagacgtgtacacttgtcaggtagaacacaccagcctcgatagcccggtgacggtcgaatggaaggctcaatcggactctgcacgctcgaagaccctcactggggctgggggttttgtactggggctcatcatttgcggcgtgggcatattcatgcaccgacgaagtaaaaaagtgcaaaggggaagtgcttag

SEQ ID NO: 229297 - DNA, 687 bp, Artificial Sequence
  Description of Artificial Sequence: Synthetic coding sequence
atgatggtactgcaagtctccgcagcccctcgaacagtggctttgaccgccctgctgatggtcttactcaccagcgtagtccaaggacgcgctacccctgaaaattacctatttcagggaagacaggaatgttacgcattcaacgggacccagagatttcttgaacgatatatttataacagagaggagtttgtgagatttgattctgatgtgggtgagttccgagcagtgacggaactgggacgcccagacgaagaatactggaactcacaaaaagacattcttgaagagaaacgggcagtgcctgatcgcatgtgtcggcataactatgagttaggcggtccaatgacactgcagcgaaggggaagcattcaggtgcggtggtttcttaacggccaggaagagacagccggagtggttagcaccaatctgatccgcaacggcgactggacatttcagattctggtcatgctggagatgacaccccagcaaggggacgtgtatacttgccaggtggagcatacctcaatggactctcctgttacggtggaatggaaagcacagtccgactcagccaggtcaaaaacacttacaggtgctgggggtttcgtgcttggactgataatctgtggggtgggtatattcatgcacaggaggagcaaaaaggtgcagcggggatctgcctag

SEQ ID NO: 229298 - DNA, 708 bp, Artificial Sequence
  Description of Artificial Sequence: Synthetic coding sequence
tgaaattacctcttccaggggcgtcaggaatgctatgccttcaacggcactcagagattcctcgagcggtatatttacaaccgcgaggagtttgtccggttcgacagcgacgtgggagagttcagagccgtcaccgagctgggaaggccagatgaggagtactggaattctcagaaagatattctggaggaaaagcgggcagtgccagaccgaatgtgccggcataattatgagcttggcggaccgatgacgctccagcgtcgggttcagcccagagtaaatgtctcaccctcaaagaaggggcctctgcagcaccacaatctgctcgtttgtcacgtgacagacttctatcccggatccattcaagttcgatggtttctgaacggccaggaagagactgccggtgtcgttagcacgaacctgatccgaaatggggattggacattccagattctagtgatgttggagatgacgccccagcaaggggatgtatatacttgccaagtagaacacacctcgatggattcccccgtcaccgtggaatggaaagcccaaagcgattccgcacggtccaagactttgaccggagctggaggctttgtgctgggcctgataatttgcggcgtcgggatctttatgcaccggagatccaaaaagggggagaaggcctgtaggttcaacgaagacctgcataagcagggtagctag

SEQ ID NO: 229299 - DNA, 777 bp, Artificial Sequence
  Description of Artificial Sequence: Synthetic coding sequence
atgatggttcttcaggtctccgccgcacctagaactgtggctttaaccgcactgctgatggtcttgctgaccagtgtagttcagggtcgcgcaaccccagagaattacctgttccaggggcgacaggagtgctatgccttcaatggtacccagcggtttttggaacgctacatttacaaccgtgaggagttcgtcaggttcgatagcgacgtgggcgaattccgggcagtgacagaattgggtcgccctgacgaagagtactggaacagccagaaagacatcctcgaagagaagagagctgtaccagaccggatgtgtagacacaattacgaattaggtgggccaatgactctccagcggagagtgcagcccagagtcaatgtttcaccatccaagaaggggcctctgcagcaccacaatctcctggtttgtcacgtgaccgacttctaccccggaagtatccaggtcaggtggttcctgaatggccaggaagaaacggccggagtggtgtccaccaatctaatccgtaatggagattggactttccagattttggtcatgttggagatgactccacagcagggtgatgtttacacgtgccaggttgaacacacgagcatggacagtcccgtcacggtagagtggaaagcacagagtgacagcgccagatcgaagacactgactggagcaggcggatttgtgctggggctgatcatctgtggtgtgggcatttttatgcaccgcaggtctaaaaaggtccaaagaggctcggcttag

SEQ ID NO: 229300 - DNA, 687 bp, Artificial Sequence
  Description of Artificial Sequence: Synthetic coding sequence
atgatggtgctgcaggtatcagccgcacctagaactgtggcgctgactgccttgcttatggtccttcttacaagcgttgtacagggacgcgcaacaccagagaattatctttttcaagggagacaggagtgttatgccttcaatggaactcagcgcttcttggagagatatatctacaatcgggaagaatttgcacgtttcgactccgatgtcggggagtttcgggctgtcaccgaactcgggcgtccagcagccgagtattggaactcccagaaggatatcctagaggagaagcgtgccgtgcctgaccgcatgtgcaggcataattatgaactaggcggacccatgacgctacagaggaggggtagtattcaggtgcgttggtttctaaacggccaggaggaaacagccggagtcgtgtcaaccaaccttatccggaacggagactggacctttcagatactcgtaatgctggaaatgactcctcaacagggtgatgtctatacttgtcaggtggagcatacatcgttagacagccctgttacagtagaatggaaggctcaaagtgacagcgctagatctaaaaccctgaccggtgccggtggcttcgttttggggctgatcatctgtggcgtcgggatcttcatgcatcggagatcaaagaaggttcaacgaggttctgcttag

SEQ ID NO: 229301 - DNA, 690 bp, Artificial Sequence
  Description of Artificial Sequence: Synthetic coding sequence
aagcaggcctggcgcggaagcgctactaggctaggaccgcagaattctggcaggcaggagtgttatgctttcaacggcacacaacgctttttggaacggtacatatataaccgcgaggagttcgtaagatttgattctgacgtgggcgaattccgcgcagttaccgagttaggacgacccgacgaggaatattggaactcccaaaaggatatcctggaggaggaacgagccgtgcccgaccgaatgtgtcggcacaattatgaactaggtggtcctatgaccctgcagaggcgtgtgcagccacgagtgaacgttagtccatccaaaaaaggcccactgcagcaccataatttgcttgtgtgtcacgtgacagacttctatccaggctcaattcaggtgcgttggtttctgaatggacaggaggagacggccggtgttgtctccacgaatctcatccgtaatggcgattggaccttccagattttggtcatgcttgagatgacccctcaacaaggagacgtttacacctgtcaggtcgagcacacatcactggactctcctgtgactgtggagtggaaggcacaatcagacagcgcacggtccaaaaccctgactggggctggcggtttcgtgctaggtctgataatttgcggggtcggtatcttcatgcatcgtcgctctaagaaatag

SEQ ID NO: 229302 - DNA, 777 bp, Artificial Sequence
  Description of Artificial Sequence: Synthetic coding sequence
atgatggtgttgcaagttagcgcagcacccaggaccgttgctttaaccgccctgcttatggtacttctcacatctgttgtgcaggggagggccacccccgagaactatctgtttcagggcaggcaggaatgctacgcctttaatggcacacagagattcctcgaaaggtatatttataaccgcgaagagttcgtacggttcgactctgacgtgggagagttccgggcagtcactgagttaggccgacccgatgaggaatactggaacagccagaaggacatcttagaggaagagcgggcagtccccgatcggatgtgcaggcataactacgagctgggcggacctatgacactccagcggcgagtgcagcccagggtcaatgtgagtccctccaaaaagggcccattgcaacatcataacctccttgtgtgccatgtgaccgacttctaccctggatctattcaagtgagatggtttctcaatggacaggaggaaactgccggagtggtctccacgaatctgatcaggaacggcgactggacttttcagatcctggtgatgcttgagatgacgccccagcaaggtgacgtctacacctgccaggtggagcacacgtccctggacagtcctgtcaccgttgagtggaaagctcagtctgattctgctagatccaagaccttgaccggcgcaggcggattcgtgttggggctgatcatatgtggcgtgggtatcttcatgcatcgccgtagcaaaaaggtacaacggggatccgcttag

SEQ ID NO: 229303 - DNA, 708 bp, Artificial Sequence
  Description of Artificial Sequence: Synthetic coding sequence
tgaaactatctgttccagggcaggcaggaatgttatgcatttaacggtacccagcgctttctcgaaaggtatatatacaaccgcgaggagtttgctcggtttgacagtgatgttggagagttcagggcagtcacagagctcgggagacctgcagcagagtactggaactcccagaaggacatactggaagagaaaagagcagtgccagaccggatgtgtcggcacaactatgagttggggggtcctatgacacttcagcgaagagtgcagcctcgcgtcaatgtgtcgccgagcaaaaaaggacctctccagcatcataacctacttgtgtgtcacgttaccgacttctatcctgggtccatccaggtcaggtggttcctgaacgggcaagaggaaacagcaggcgtggtgtctactaaccttatcaggaatggagattggacttttcagattctcgtaatgctggagatgacgccacagcagggagacgtttacacgtgtcaggtcgagcatactagcctggactctcccgtgacagtggagtggaaggcccaatctgactcagcgcgatcaaaaacactgactggtgccggtggcttcgtgctgggtttgattatttgtggcgtggggatttttatgcaccgaaggagcaaaaagggcgaaaaagcgtgcaggttcaacgaggaccttcacaagcaaggctcatag

SEQ ID NO: 229304 - DNA, 690 bp, Artificial Sequence
  Description of Artificial Sequence: Synthetic coding sequence
aaacaggcatggcgcggatctgcaactcggcttggccctcagaatagtggaaggcaggagtgttacgcgtttaacggtacacaaagatttcttgagcgatatatttacaacagggaggagttcgccaggttcgactccgacgtcggcgaatttagagcggtgaccgaactcgggcgacctgcagcggagtactggaactcccaaaaagatattctggaggagaagcgagccgttccggaccgcatgtgccgccacaactatgaactcggtggtccgatgaccctgcagcgccgagtccagcctcgcgtaaatgtttctcctagcaagaaaggtcccctgcaacatcacaatctgctcgtgtgccacgtgacggacttttatcctggctctattcaggtgaggtggttcctaaatggccaggaggaaaccgccggagtcgtcagtacaaacctgattcggaatggcgattggacattccaaattctggtcatgctggagatgaccccacaacaaggcgatgtgtacacttgccaagtggaacacacaagcctggactcgccagtgacagttgagtggaaagcacagtctgactccgccaggagtaaaacactgaccggggctgggggatttgttctgggtcttatcatctgcggcgttgggatctttatgcaccgtcgatctaagaaatag

SEQ ID NO: 229305 - DNA, 777 bp, Artificial Sequence
  Description of Artificial Sequence: Synthetic coding sequence
atgatggtattgcaagtgtcagcggctccacgcacggttgccttgacagccctgctcatggtgctgttaacatctgtggtgcaaggaagagctactccggaaaattatttgtttcagggacgccaggaatgctatgcctttaacggtacccaacgtttcctcgagagatacatttacaatcgggaggagtttgctcgcttcgattccgacgtgggcgagttcagagccgtcacagagcttggaagacccgctgccgagtactggaactctcagaaagacatcctggaagagaaaagggccgtgcccgaccggatgtgtcggcacaactacgaactcggcggtcctatgaccctgcaacgccgagtgcagcctagggtcaacgtgagcccttctaagaaaggaccgctgcaacaccacaatcttttggtgtgccatgtgacggatttctatcccggttcgattcaggtgcgatggtttttaaatggacaggaggaaactgccggtgtggtgtctaccaatcttattcgcaacggtgactggacattccagatcctggtgatgctggagatgacaccccagcagggcgacgtatacacgtgccaagtggagcataccagtttagatagtcccgtgacagtcgagtggaaagcacagagcgactccgctcgatctaagacccttacaggagcagggggttttgtcttaggcttaatcatatgtggagtggggatttttatgcacagacggtctaagaaagtgcagagagggagcgcatag

SEQ ID NO: 229306 - DNA, 249 bp, Artificial Sequence
  Description of Artificial Sequence: Synthetic coding sequence
atgactccacaacagggagatgtttatacatgtcaggtggaacatacgtcactggacagccctgtaactgtggagtggaaagctcagtctgatagcgcaagaagtaagactctcaccggcgcaggcggtagggctggcgcacaccacctgtggagtggtcatctgcatgctcaagaggagcaggaaagctcaacccgcatctgtattaatcgagtgcccgaacttactgaaaaaacaatagtgccatag

SEQ ID NO: 229307 - DNA, 777 bp, Artificial Sequence
  Description of Artificial Sequence: Synthetic coding sequence
atgatggtgctgcaagtgagcgccgcacccagaacagtggcactgacagcccttctgatggttttactcacttcagtggtccagggacgcgcaacaccagagaattacctgtttcaggggaggcaggagtgctatgcattcaacgggactcagcgttttttggagcgttatatttacaaccgagaagaatttgtccgatttgactccgacgtaggcgagttccgagcagttacggaactggggagaccagatgaggagtattggaattcccaaaaagacattcttgaagaaaagcgcgcagtgcctgaccggatgtgccggcacaattacgagctggggggacccatgacgctgcagcgccgtgtccagcccagggttaacgttagtccctccaagaagggacctctgcagcatcataatctgttggtgtgccacgttacagatttctaccctggttccattcaagtcagatggtttctgaatggccaagaagaaacagctggggtggtgtcaactaacctgatccggaacggggattggacctttcaaatccttgtaatgctggaaatgacaccacagcagggagacgtatacacctgccaggtcgagcataccagcatggattcaccagtgacagtggagtggaaggcccaatctgactcagctaggtctaaaactttaacaggggctgggggattcgtgctcggacttattatatgcggcgtgggcatctttatgcatcggagaagcaagaaagtgcaaaggggatcggcctag

SEQ ID NO: 229308 - DNA, 690 bp, Artificial Sequence
  Description of Artificial Sequence: Synthetic coding sequence
aagcaggcgtggcggggtagcgccacgcgactgggcccacagaactcaggccgtcaggaatgctacgcattcaacggcactcaaagatttttagaaaggtacatctacaatcgagaggaattcgccaggttcgattccgatgtcggcgaattcagggctgtgacggagctgggtagacctgcagccgaatattggaactctcaaaaggacatcctggaggagaaacgggcagtgccagatcggatgtgccggcacaactatgagctgggcggacccatgacactgcagaggcgggtacagcctcgcgtgaacgtttctccctctaagaaagggcctcttcagcatcacaatcttctcgtatgccacgtcacggatttctaccccggttccatacaggtgcgttggtttcttaatggccaggaggagacagctggcgtggtttcaaccaacctcataagaaacggcgactggactttccagatactcgtcatgcttgaaatgactcctcagcaaggggatgtgtatacctgccaggttgaacacaccagcctagactctcccgtgactgtcgagtggaaagcccagtctgactctgccaggagtaagacattaacaggcgcaggagggttcgtgctgggcctgattatttgcggtgtaggcatattcatgcatagaagatctaagaaatag

SEQ ID NO: 229309 - DNA, 708 bp, Artificial Sequence
  Description of Artificial Sequence: Synthetic coding sequence
taaaattacctgttccagggcagacaagagtgctacgctttcaacggaacccagcgctttctcgagaggtatatctacaatagggaggagctcgtgcgcttcgactcagatgtcggcgagtttcgggctgtgacagaattgggacggccagaagccgagtattggaactcccaaaaggatattttagaagaagaaagagccgttcctgataggatgtgtcggcacaactatgagctcggaggtcctatgactttacagcgccgtgtgcaacccagggtgaacgtctcaccgagcaagaaaggcccactccaacaccataacctgctggtatgccatgtcactgacttttaccctggcagtatccaggtcagatggtttctaaacggtcaagaagaaaccgcaggggtagtgtccacgaacctgatacgaaacggtgactggactttccagatcctcgtcatgcttgagatgaccccccagcaaggagacgtctacacttgtcaagtcgagcacaccagcctcgacagccctgtgaccgtggagtggaaagcgcagtcagacagtgcaagatcaaagactttaactggggctggcggatttgttctgggtctgatcatttgcggcgttggaatctttatgcaccggaggagcaagaaaggtgagaaggcttgtcgatttaacgaagatttgcacaagcaaggctcttag

SEQ ID NO: 229310 - DNA, 777 bp, Artificial Sequence
  Description of Artificial Sequence: Synthetic coding sequence
atgatggtcctccaggtttcagccgcacccagaacagtcgctttgacggccctgctaatggtgctccttacctctgtagtgcagggcagagctactcctgaaaactatctgttccagggaaggcaggaatgttacgcgttcaacggcactcagagattcctggaacgctatatttataatcgtgaggagttcgccaggttcgactcagacgtgggggagtttcgggctgtgaccgagctgggtcggcctgctgccgagtactggaactcacagaaagatattctggaggaaaagcgcgctgtgcccgatagaatgtgtagacataactacgagctgggtgggcctatgacactgcagaggcgggtccagccacgtgtgaacgtgtctccatcaaaaaaaggtcccctgcagcaccataacctgctggtttgccacgtcaccgatttctaccccggttctatccaagtcaggtggtttctgaatgggcaggaagagactgccggtgtagtctcaaccaacttgattcgcaatggagactggactttccagatcctagtgatgctagagatgacaccacaacagggggatgtctatacctgtcaggttgagcacacctctctcgacagccctgtcactgtggaatggaaagctcagagtgatagcgccaggagcaagacgttgacgggggcaggaggctttgtgttgggtctcatcatatgcggggttggaatctttatgcacagaagatctaagaaggtgcagcggggttcggcttag

SEQ ID NO: 229311 - DNA, 708 bp, Artificial Sequence
  Description of Artificial Sequence: Synthetic coding sequence
tagaattacgtctaccagctacggcaagaatgttacgctttcaacggaactcagcggtttctggaaaggtacatctacaatagggaggaattcgtgcggtttgacagtgacgtgggcgagtttagggccgttacagaacttggaagacccgatgaagactattggaattcccagaaagacctgctggaagagaagcgggcagttcctgatagggtttgcagacacaactacgagcttgacgaagcagtgacactgcagcgaagggttcaaccaaaagtgaatgtttcccctagcaagaaggggcctttgcaacaccataacctgcttgtgtgtcacgtgaccgatttttacccaggatcaatacaagtgcgatggtttcttaacgggcaggaggagaccgcgggagtagtctctaccaatttgatccgcaatggcgattggaccttccagatcctcgtaatgctagagatgacaccccagcagggggacgtttatatctgccaagtggaacacaccagcctggacagcccggtgactgtcgaatggaaggcccagtccgacagtgcacggagtaagacccttacaggcgcaggtggattcgtcttgggtctcatcatctgcggggttggtatttttatgcacagacggtcaaaaaagggtgagaaggcatgtaagttcaacgaggatctgcacaagcaaggatcctag

SEQ ID NO: 229312 - DNA, 690 bp, Artificial Sequence
  Description of Artificial Sequence: Synthetic coding sequence
aaacaagcctggaggggttccgccacccgcctgggccctcagaatagtggacgccaggagtgttatgcttttaatggcacccagagattcctagagaggtacatttacaaccgcgaggagtttgttcgattcgactccgatgtgggtgagtttcgcgctgtcaccgagcttggccgacccgatgaggagtattggaattcccagaaggacattttggaggagaagcgggcagtgccagacaggatgtgcagacacaattatgagttgggaggtcctatgaccctccaacgaagagttcagccccgtgtgaatgtgagtccctcaaagaagggtccgctacagcatcacaacctgctcgtgtgccatgtaacagatttttatcccggaagtattcaggtgcggtggttcctgaatggccaagaggagacagccggagtggtttccacaaacctgattagaaacggagattggacatttcagattctcgtcatgctcgaaatgacccctcagcagggagatgtgtacacgtgccaggtggagcacacctccatggactcaccagtcactgtagaatggaaggcacagagcgactcagcccgatctaaaacgttaacaggggcaggcggttttgttctggggctgattatttgcggggtgggcatctttatgcaccgccgttccaaaaaatag

SEQ ID NO: 229313 - DNA, 687 bp, Artificial Sequence
  Description of Artificial Sequence: Synthetic coding sequence
atgatggtcctccaggttagcgcagctccccgaacagtggcacttacagcccttcttatggtgctgctgacatccgtcgtccaaggaagggccacacccgagaattacgtgtaccagctccggcaggaatgttacgctttcaatggcactcagcggttcctcgagaggtatatttataatcgggaggaattcgtgcgcttcgattccgacgtcggtgaatttcgcgcagtgactgagctaggtcggccagacgaagactattggaattcacaaaaggacctgctggaggagaagagggctgttccggatagagtttgtaggcataattacgagctggatgaggctgtcacattgcagcggaggggatccattcaagttcgttggttcctcaacggacaagaggaaactgctggagtagtctcgaccaatttaatacggaacggagattggacattccagatcctggtcatgcttgagatgactccccagcaaggggatgtatatatttgtcaggtcgaacacacaagccttgactcacccgttaccgtcgagtggaaagcacagtccgacagcgccagaagtaaaacgcttaccggggctggtgggttcgtgctggggttgatcatatgcggagtcggcatcttcatgcatcggagaagcaaaaaggtccagagaggtagcgcctag

SEQ ID NO: 229314 - DNA, 687 bp, Artificial Sequence
  Description of Artificial Sequence: Synthetic coding sequence
atgatggtgctccaggtgagtgcggctcccagaacagtcgcacttacagctctgttaatggttctactgaccagtgtggtacaggggagagcaactcctgagaactacctgtttcagggtagacaagagtgttatgccttcaacggaactcagcggttcctggagagatatatttataaccgggaggagtttgtcagatttgactctgatgtgggcgagttccgcgcagtcaccgagttgggaagaccagatgaggagtattggaactctcagaaggacattcttgaagaaaagagagccgtgccagatagaatgtgtaggcacaattatgagctgggtggacccatgaccctccaaagaaggggatcaattcaggtgcgctggttcctgaacggccaggaggagactgccggagtcgtgtcgactaacctcataaggaacggggactggacgttccagatcttagtcatgctagaaatgactccccagcaaggagatgtgtacacgtgccaggtagagcacaccagcatggacagcccagtaaccgtcgagtggaaggcccagagtgattcagcccgtagcaagacactgaccggagcgggaggatttgtcctgggccttatcatttgtggagtgggaatcttcatgcatcgccgttccaagaaggtgcagcgaggtagtgcatag

SEQ ID NO: 229315 - DNA, 687 bp, Artificial Sequence
  Description of Artificial Sequence: Synthetic coding sequence
atgatggttcttcaggtctccgctgcccctagaaccgtggcactcacggctctcttgatggtgctgctgacaagtgtcgttcagggtcgggctaccccggagaattacttattccaaggacggcaggaatgctacgctttcaatggcacacagcgattcctggagcggtatatctacaatagagaggaatttgcaagattcgacagcgatgtgggcgagtttcgcgctgtcactgaactgggccgaccagcggctgagtactggaacagtcagaaagatatccttgaggaaaaaagggctgtccctgataggatgtgccggcataactacgagctgggaggcccaatgactctgcaacgcagggggtcgatccaggtgaggtggttccttaacgggcaagaggagacggcgggagtagtctctacaaatttaatccgtaacggcgactggactttccaaattcttgttatgcttgagatgacgccgcagcagggcgatgtgtacacttgtcaggtggagcacacatctctcgatagccctgtgaccgtcgagtggaaagctcagagcgatagtgcgaggtcaaagaccctcaccggcgctggaggatttgttctcggcctgattatatgcggagtgggtatcttcatgcaccggagaagcaagaaggttcaaagaggaagcgcttag

SEQ ID NO: 229316 - DNA, 690 bp, Artificial Sequence
  Description of Artificial Sequence: Synthetic coding sequence
aagcaggcctggaggggatccgccaccagattgggccctcaaaactctggtaggcaagaatgctatgcattcaatggtacacagagatttctcgaacggtatatctacaatcgcgaagagtttgtccgattcgacagtgatgttggagagtttagagccgtaaccgagttaggcagacctgatgaggaatactggaactcgcagaaagacatcctggaagaaaaaagggctgtccccgaccgtatgtgccgacacaactatgagctggggggaccaatgacattacaacgcagagttcagccacgggtcaatgtgagcccatccaagaaggggcctctccagcaccacaatcttctggtctgccacgtgaccgatttttaccccggttcaattcaggtacggtggttccttaacggccaagaggagaccgcaggggtagtgtctaccaatctgatacgtaacggcgactggacctttcagattttagtaatgctcgagatgacaccacagcagggagacgtctacacatgtcaggtcgaacacaccagcatggatagccccgtgacagtggagtggaaggctcagtctgacagcgcacggtccaagacattgactggggctggaggatttgtcctgggcctgataatctgtggggtgggaatatttatgcacagaagatccaaaaaatag

SEQ ID NO: 229317 - DNA, 708 bp, Artificial Sequence
  Description of Artificial Sequence: Synthetic coding sequence
tgaaactacttgttccagggcagacaggagtgttatgccttcaatggcacccagagattcctggaacggtacatttataatcgtgaggagttcgtgcgctttgatagtgacgtcggcgagtttcgagcagtgaccgaactcgggcgtcctgacgaggaatactggaacagtcagaaggacatcctagaggaagaacgggctgtgcccgacagaatgtgtcgccacaactatgaacttggcggacccatgaccttgcaaagacgagtccagccgagggtcaatgtttcccccagcaagaaaggtccattacagcatcataacctgctggtgtgccacgtgactgacttttatcccggaagcatccaagtccggtggttcttaaatggtcaggaagaaaccgcgggtgtcgtcagtacgaacctgatcaggaacggcgattggacctttcagattctggtcatgttggagatgaccccacaacagggcgatgtctatacctgccaggttgagcacactagcctggactctccggtgacagttgaatggaaggcacaaagtgatagtgccagatccaagaccttgacaggtgcagggggtttcgttctcggcctgatcatatgcggggtgggtatcttcatgcacagaagatccaaaaaaggagagaaagcctgccggttcaacgaagatctgcataagcaggggtcttag

SEQ ID NO: 229318 - DNA, 708 bp, Artificial Sequence
  Description of Artificial Sequence: Synthetic coding sequence
taaaactatctgttccaggggaggcaggaatgctacgctttcaatggaactcagagattcctggagaggtatatttataatagggaggagtttgctcgctttgactctgatgtgggggagtttagagcggtgactgagctcggcagacccgctgcggaatactggaacagccaaaaggatatactggaggagaaaagagcggttcccgatcgaatgtgcaggcataattacgaattaggcggacccatgactctccagcgcagagtgcaacccagggtgaatgtcagccctagcaagaaggggccactacagcaccacaatctgctagtttgccatgtgacagacttctaccccggtagcattcaggttcgctggttccttaatggtcaggaagagacagcaggcgtcgtgtccacaaacctgataagaaacggcgattggacctttcagatcctggtcatgcttgagatgacaccccagcaaggcgacgtttatacttgtcaggtggagcacacttcactagattccccagtgaccgtcgagtggaaggctcaatccgacagtgcacgcagtaagaccctgacgggagcgggtgggttcgtactggggctaatcatttgcggcgtgggaatcttcatgcacagacgtagcaagaaaggagagaaagcgtgtaggtttaacgaagatcttcacaaacagggctcatag

SEQ ID NO: 229319 - DNA, 687 bp, Artificial Sequence
  Description of Artificial Sequence: Synthetic coding sequence
atgatggttctgcaggtctccgctgcacccagaactgtcgccctgaccgctctgctaatggtgctcctgacaagcgtggtgcaggggagggctactcctgaaaactacctgttccaggggagacaggaatgttacgcatttaatggtacacagagatttctcgagagatacatctataacagggaagagtttgtccgatttgatagcgacgttggcgaattccgcgcagtgacggagctgggacgacccgatgaggaatactggaacagccagaaggatatcctggaagaggagagggctgtgccggaccgcatgtgtcggcacaattacgagctgggcggacccatgaccctgcagagacggggaagcattcaggtccggtggttcctcaacgggcaggaggaaacggctggcgttgtcagcacaaacttaattcgaaatggagattggactttccagatcctggtgatgctagagatgaccccacagcagggcgacgtttatacttgccaggtagagcatacgtctttagattctcctgttacagtcgaatggaaggcccagagtgactctgcaagaagtaagacgcttacaggggctggcggatttgtgttgggacttataatttgcggcgtcggcatctttatgcaccgtcgatccaagaaggtgcaaagaggctccgcatag

SEQ ID NO: 229320 - DNA, 690 bp, Artificial Sequence
  Description of Artificial Sequence: Synthetic coding sequence
aaacaggcctggcgtggctctgcgacaaggctgggccctcaaaactccctgcgtcaggaatgttatgcgttcaatggaacccagcgctttttggagcggtatatttataacagagaagaatttgtaaggtttgatagtgatgttggcgagtttcgtgctgtgaccgaattgggtcgtcctgacgaagattattggaactcgcagaaagacctcctcgaggaaaaacgtgctgtgccggacagggtttgcaggcataattacgaactggatgaagcagttaccctgcagcgcagggtgcagcctaaggtcaacgttagcccctctaagaagggacccttgcagcatcataatctgctcgtgtgtcatgtcacagatttctacccaggtagtatccaggtgcgatggttcctgaatgggcaggaagagaccgcaggggtggtgtctaccaaccttatcagaaacggcgattggaccttccagatcctggttatgctggagatgaccccacagcagggggacgtctatatctgccaggtggagcacacgtcactggattctccagtgacagtagaatggaaagctcaaagcgactccgcaaggtctaagactcttaccggcgcaggcggtttcgtgctggggctgataatctgcggcgtgggcatctttatgcaccggagatcaaaaaaatag

SEQ ID NO: 229321 - DNA, 777 bp, Artificial Sequence
  Description of Artificial Sequence: Synthetic coding sequence
atgatggtcctgcaggtgagtgccgctccgagaaccgtggcactcacggctctgctgatggtgctgctcactagcgtggtgcagggcagagccacacccgagaattaccttttccagggtcgacaagagtgctatgcatttaatgggacgcagcggttccttgagaggtatatttataatcgggaggaatttgccagatttgactccgatgtcggcgaattcagggcagtgaccgagctgggcagaccagcagcggagtattggaattcacagaaggacatcctggaggagaaaagggccgtgcccgacaggatgtgccgccacaactacgagcttgggggtccaatgacattacagcggagagtccagccgagggtgaatgtgtcacccagcaagaaggggccattgcaacaccataacctgcttgtgtgtcatgtgacggacttctatcccggatccatccaggtaaggtggtttctgaacggtcaggaagaaaccgccggtgtagtgtctacgaatctgatccgaaatggtgattggaccttccagatcctggtgatgctcgaaatgacgcctcagcaaggagatgtgtacacctgtcaggtcgagcatacctcccttgatagtcctgtgaccgttgagtggaaagcgcagtcagatagtgctcgtagcaagactctgacgggcgctggcggatttgtattgggactgataatctgcggcgttggaatctttatgcatcggagatccaagaaagtgcaaagggggagcgcctag

SEQ ID NO: 229322 - DNA, 708 bp, Artificial Sequence
  Description of Artificial Sequence: Synthetic coding sequence
tagaattatctcttccaaggcagacaagagtgctacgctttcaacggcacccaacgttttctcgagagatacatatacaaccgcgaggagttcgttaggttcgatagcgacgttggagaattccgcgctgtcaccgagctggggagacccgatgaagaatattggaattctcagaaggatatactagaggaaaaacgggctgtgcccgacagaatgtgtcgtcataattacgaactgggcggacccatgacgttacagcggagagtgcagcctagagttaatgtgagcccttcaaaaaaaggcccactgcaacatcacaatttgttagtgtgccatgtcaccgatttctatcctggatcaatccaggtgagatggttccttaacggtcaggaggagacagcaggagtagtgtccacaaacctgattagaaatggcgattggaccttccagattctcgtgatgctggagatgacgcctcagcagggtgacgtgtacacatgccaggtagagcatacgagtatggatagcccagtgacagtcgagtggaaggcccaatctgattcggcccgaagcaagaccttgacaggggcagggggattcgttctggggctgattatatgtggtgtgggaatctttatgcacaggagaagtaagaagggagaaaaagcgtgtagattcaatgaggacctgcacaagcaggggagctag

SEQ ID NO: 229323 - DNA, 690 bp, Artificial Sequence
  Description of Artificial Sequence: Synthetic coding sequence
aaacaggcctggcgcggatccgctacccggttgggacctcagaattctggacgccaggaatgttacgcttttaacggtacacagcgattcctggaacgatatatctacaacagggaggagtttgcacggtttgacagtgacgtgggcgagttccgggcagtgactgaattaggtcggcctgccgctgaatattggaacagccagaaggatatcctggaagaaaagagggccgttcctgacaggatgtgtaggcacaactatgaactcgggggtccaatgacattgcaaaggagagtgcagccgagggtgaacgtctccccgtccaaaaagggccctttgcaacatcataatttacttgtttgtcacgtaacggacttctatccaggatccattcaggtgcgatggtttttaaatgggcaagaagaaacagctggtgtggtatcaactaatttaattcgcaacggcgattggactttccagattttggtaatgctggaaatgactcctcagcagggagacgtctacacatgtcaggttgaacatacatctctggatagccccgtaacagtagaatggaaagcccagtccgactcagcccgaagtaagacactgacaggggctggaggattcgtgctgggattgatcatttgtggggtagggatcttcatgcatagacggagtaagaaatag

SEQ ID NO: 229324 - DNA, 708 bp, Artificial Sequence
  Description of Artificial Sequence: Synthetic coding sequence
tagaactatctgttccagggtaggcaggagtgctatgcttttaatggcacgcagcggttcctcgagcgctacatctacaatcgggaggagttcgccaggttcgattctgacgtgggagaatttagagcggtgaccgagctgggcaggccagcagcagaatactggaatagccagaaagacatccttgaggaaaagagagctgtgcccgataggatgtgtcgacataattatgagctgggtggaccgatgactctccagaggcgagtccagcctcgcgttaacgtgagtcccagcaagaaaggccctctccagcatcataatctgctggtttgccatgttactgatttctaccccggaagcatccaagtccgatggttcctgaatggacaggaagagacagcgggtgtcgtgtccaccaacctgatccgcaacggggattggactttccagatactggtgatgctggagatgacaccccagcagggggacgtgtacacatgtcaggtggagcatacatcattagattcccccgtaactgtggagtggaaagcccagtccgattcagcacgcagtaagaccttaactggcgctggtgggttcgtcctggggctgatcatttgtggagtcggcatctttatgcataggcggtctaaaaaaggggaaaaggcctgtaggttcaatgaagatcttcacaagcagggctcctag

SEQ ID NO: 229325 - DNA, 372 bp, Artificial Sequence
  Description of Artificial Sequence: Synthetic coding sequence
atgatggtcctgcaggtgtccgccgcacccaggaccgtagccctgacagctcttctcatggttctgctcacgtctgtagttcagggtagagccacgcccgagaattacctgtttcaggggaggcaggagtgctatgccttcaatggaacacaacgattcctcgagaggtatatctacaatcgcgaggaattcgccagattcgactcagacgtgggggaattcagagcagttactgaactgggcagacccgctgcggagtattggaactcacagaaggatatactcgaagagaagagagcagtgcccgatcgtatgtgcaggcataattacgagttgggtggacctatgaccctccaacgcagaggggagtag

SEQ ID NO: 229326 - DNA, 249 bp, Artificial Sequence
  Description of Artificial Sequence: Synthetic coding sequence
atgactccccagcagggggatgtgtacacatgtcaggtggaacatacttccctcgacagcccggtcaccgttgagtggaaggcgcagagtgatagtgctcgatccaagacacttactggagcgggaggcagggcaggggctcaccacctctggagcgggcacctccatgcccaggaagagcaggagtccagcacccgaatctgcatcaaccgggtgccagagttaaccgagaaaactatcgtgccgtag

SEQ ID NO: 229327 - DNA, 249 bp, Artificial Sequence
  Description of Artificial Sequence: Synthetic coding sequence
atgacgccccagcagggtgatgtgtacacatgtcaggtcgagcatactagcctggacagccctgtgaccgtcgaatggaaagcccagtcagatagtgctcgttccaaaacccttaccggggcagggggtcgcgcaggggctcaccacttatggagcggccacctccacgcccaggaagagcaggaatcgtccacacggatttgcattaacagagtgcccgaacttacggagaagaccatcgtaccttag

SEQ ID NO: 229328 - DNA, 372 bp, Artificial Sequence
  Description of Artificial Sequence: Synthetic coding sequence
atgatggtgctgcaggtatcagccgctcctagaacagtggcgttgaccgccttgctgatggtgctcttgaccagtgttgtgcagggtagggctaccccggagaattatctgtttcaggggcgacaggagtgctatgccttcaacggcacccagagattcttggagcgatacatctataatcgcgaggagttagtgcggttcgactcagatgtgggagagttcagagccgtgacagagctcggtcgccctgaggcagagtattggaactcacagaaagacattctagaagaggagagagctgtgcccgatagaatgtgtcggcacaattatgaactgggcggaccgatgaccctgcagcgccgaggcgagtag

SEQ ID NO: 229329 - DNA, 372 bp, Artificial Sequence
  Description of Artificial Sequence: Synthetic coding sequence
atgatggtactgcaggtatctgccgcaccaaggacagttgctctgaccgctttactcatggtgctgttgacttccgtcgttcaggggcgagcgacacctgagaactatctatttcagggtcgtcaagaatgttatgcgttcaacggaacccagagatttctagagagatacatctacaaccgtgaagaatttgtccggttcgattctgatgtcggtgagttcagagcggtgacagagctgggaaggcccgacgaggagtattggaacagtcagaaggacatcctggaggaaaaaagggccgtccctgatagaatgtgccgccacaactatgaactcggtggccctatgaccctccaacggaggggtgagtag

SEQ ID NO: 229330 - DNA, 372 bp, Artificial Sequence
  Description of Artificial Sequence: Synthetic coding sequence
atgatggtactccaggtgagcgcagcccctagaaccgtggccctgacagcactcctgatggtgctgttaaccagcgttgtgcaaggccgagccaccccagagaactacctgtttcagggtaggcaagagtgttatgctttcaatggtacccaacgtttcctggaaaggtatatctataacagagaggagtttgtcagattcgattcggacgtaggagagttccgggcagtgaccgaactgggccgtccagatgaggaatattggaatagccagaaagatatcttagaggaggaacgcgcagtcccagacaggatgtgtcggcacaattatgaattaggtgggcctatgacccttcagaggcggggagagtag

SEQ ID NO: 229331 - DNA, 750 bp, Artificial Sequence
  Description of Artificial Sequence: Synthetic coding sequence
atggtgctcctgacaagcgttgtccagggcagagccacccctgagaactatgtatatcaactccggcaggaatgctatgcttttaacggaacacaacggttcctcgagaggtatatttacaacagagaggaattcgttagattcgactctgatgtcggggaatttagggccgtgactgaattaggacgccctgatgaagattattggaactcccaaaaggatctgctggaagagaaacgggcagtccccgaccgtgtgtgtcgccataattacgaacttgacgaggcggtaacgctccagagacgggtccagcccaaggtaaacgtctcccccagcaaaaaaggccctctgcaacaccacaacctgctggtctgtcatgtgacagatttctaccccggttcaattcaagtaaggtggttcctgaacgggcaagaagagactgcaggcgtggtcagcaccaatctgatcagaaacggggactggacgttccaaattctggtgatgctggaaatgaccccccaacagggggacgtatacatttgccaagtagaacacaccagtttggactccccagtgaccgtagaatggaaagcacagagcgattccgccaggagtaagacgctcacaggagcagggggattcgtgcttggcctaatcatctgcggcgttggtatatttatgcaccggaggagcaagaaaggggaaaaggcctgcaagtttaatgaggaccttcacaagcagggttcctag

SEQ ID NO: 229332 - DNA, 249 bp, Artificial Sequence
  Description of Artificial Sequence: Synthetic coding sequence
atgacaccacaacagggtgatgtgtacacttgccaggtagagcatacctctctggatagccccgtgaccgtcgagtggaaggcccagtcagactcggctcgctcaaagaccctgactggagcgggagggagggcgggagctcaccacctctggagcggacaccttcatgcgcaggaggaacaggaaagttctactcgcatttgtattaaccgggtcccagaactcacagagaaaaccattgtgccttag

SEQ ID NO: 229333 - DNA, 372 bp, Artificial Sequence
  Description of Artificial Sequence: Synthetic coding sequence
atgatggtcctccaggtctctgctgcacctcgcacagttgccctgacagctctgctcatggtgttgttgaccagtgtagtgcaaggaagggctactccagagaattacttatttcagggacgccaagagtgttacgctttcaacggcacacaaagattcttggagagatacatctataacagagaggagttcgccagattcgacagcgatgtgggggagttccgggcagtcaccgagcttggcaggcctgccgctgaatattggaatagccagaaagacatcctggaggagaaaagagcggtgccggacagaatgtgtcgccataactacgagctgggcggaccaatgacattgcaacgccgaggagaatag

SEQ ID NO: 229334 - DNA, 372 bp, Artificial Sequence
  Description of Artificial Sequence: Synthetic coding sequence
atgatggttttgcaagtgtccgctgctccacgcaccgtagccctcactgctctgctgatggtgctgcttacgagcgtggtgcagggtagggccacgcctgaaaactacctgtttcaagggagacaggaatgctatgcttttaacggaactcagcggtttctcgagagatatatctataaccgagaagaattcgccagatttgattctgatgtgggagagttccgcgctgtgactgagttggggagaccagccgctgagtattggaatagccagaaagacatactggaagagaaaagagctgtgcccgaccggatgtgcagacacaactacgagcttgggggacctatgaccctccagagacgaggtgagtag

SEQ ID NO: 229335 - DNA, 198 bp, Artificial Sequence
  Description of Artificial Sequence: Synthetic coding sequence
atggactcgccagtcactgtggagtggaaggcacagagtgattccgcccgtagtaagacactcactggggctgggggacgggcaggtgcacaccatttatggtcaggtcacctgcatgcccaagaagaacaggagtcatccacgagaatatgcattaacagggtcccggaactgacggaaaagaccatcgttccgtag

SEQ ID NO: 229336 - DNA, 381 bp, Artificial Sequence
  Description of Artificial Sequence: Synthetic coding sequence
atgatggttctgcaagtgtccgcagctcccagaactgtcgcactgactgcgctgctgatggtgctactgacttccgtcgtacaaggcagggcgaccccagagaattacgtctaccaactgaggcaggaatgttacgctttcaatgggactcagcgtttccttgagcggtatatttataacagagaagaatttgtacgatttgactctgacgtaggggaattcagggctgttaccgagctggggcgacccgacgaagattactggaacagccagaaggatctgttggaggagaaacgagccgtgcccgacagagtttgccggcataactacgagctggacgaggcagtaacactccagcgcagagagcgcggaaagaaatag

SEQ ID NO: 229337 - DNA, 249 bp, Artificial Sequence
  Description of Artificial Sequence: Synthetic coding sequence
atgaccccgcagcagggggatgtatatatttgtcaagtcgaacacacttcattggactctcccgtcacagtggagtggaaggcccagagcgattcagccaggagtaaaacactgaccggcgcagggggtcgggcaggcgctcaccatctctggagcggccatcttcatgctcaggaggagcaagagtccagtactagaatctgcatcaatcgagtgccagatctgactgaaaagactaatgtcccgtag

SEQ ID NO: 229338 - DNA, 249 bp, Artificial Sequence
  Description of Artificial Sequence: Synthetic coding sequence
atgactccacaacaaggagatgtctatacctgtcaggttgaacacacctcgctggacagccctgttacagtggaatggaaggcccaaagcgacagcgccaggagtaagactctgaccggagcaggaggaagagccggtgcccaccacttgtggtcaggccatctgcacgcacaggaagagcaggagagttccacaagaatttgtattaaccgcgtgcctgagctgaccgagaaaaccattgtgccatag

SEQ ID NO: 229339 - DNA, 372 bp, Artificial Sequence
  Description of Artificial Sequence: Synthetic coding sequence
atgatggttctgcaagtgagcgcagctccaagaacggtcgccctaactgccctattaatggtgctcctcacttcggtcgtacagggcagggctacaccagaaaattatttgttccaggggagacaggaatgctacgcttttaatgggacacagcgatttctggaaaggtacatctataatcgggaagagttcgtgcgctttgactccgatgtgggagagttcagggcagttacagagctgggtcggccagacgaagaatattggaattcccaaaaggacatactagaggagaagcgtgcagtccccgacagaatgtgccgacacaattacgagctgggtgggccaatgaccttgcaaagacgaggagagtag

SEQ ID NO: 229340 - DNA, 198 bp, Artificial Sequence
  Description of Artificial Sequence: Synthetic coding sequence
atggactcaccagttacagtggagtggaaggcacagagcgatagtgcacgcagcaagacacttacgggggcaggtggaagagcaggcgcacaccacctttggtccggccaccttcacgcacaggaagaacaagaaagttctactcgaatttgtatcaatagggtgcctgaactgaccgagaagacaatcgtgccatag

SEQ ID NO: 229341 - DNA, 768 bp, Artificial Sequence
  Description of Artificial Sequence: Synthetic coding sequence
atgatcttgaacaaggccttgctgctgggcgcactcgccctcactaccgtgatgtctccgtgcggcggagaagacatcgttgccgaccacgtcgcctcgtgtggtgtaaatctttatcagttctacggccctagtgggcagtatacccacgagttcgacggcgatgaacaattctacgtggaccttgagcggaaggagacagcatggcgatggcctgagttctccaagttcgggggattcgatccacagggagccttacggaacatggcagtggccaaacacaaccttaacatcatgatcaaacgctataatagtacagccgcaactaacgaggtgcccgaagtgaccgtgttttcgaaatcacctgtgacactgggccagcccaatactctgatctgtctggtggacaacatttttccccctgtggtgaatattacctggttaagtaacggccaaagcgtcacagagggcgtatctgaaacttcttttctgagtaaaagtgatcatagcttctttaaaataagctacctaacctttcttccgagtgcagacgagatatacgattgcaaagtagaacattgggggctcgatcagcctctgttgaaacattgggaacctgaaattccagctccaatgtctgagctgacagaaactgtggtgtgcgccttgggtctgtccgtcggcttaatgggcattgtggtagggactgtcttcattatacagggcctcaggagtgtgggcgcatctcggcaccagggaccactctag

SEQ ID NO: 229342 - DNA, 768 bp, Artificial Sequence
  Description of Artificial Sequence: Synthetic coding sequence
atgatcctcaataaggccctgctgctgggcgcactggcactgactacagtgatgtcaccttgcggcggtgaggacatcgtggccgatcacgtggcaagttgtggcgtgaacctgtatcagttctatggaccgtcgggccagtatacccatgaatttgacggggacgagcagttctacgtggacttggaaagaaaagagacggcctggcggtggccggaattttctaagttcggcggattcgacccccagggggctcttaggaacatggcagttgcgaagcacaacctgaacattatgattaagcggtataatagcaccgctgcgacaaatgaagtcccggaggtgacagtcttctccaagtcccctgtgacgttagggcaacccaacacccttatatgtctggtggataatatttttccaccagttgtgaacattacatggctctccaacgggcagagcgtgacagagggagttagcgaaaccagtttcttaagcaaatcagaccacagtttttttaaaatctcatatctgacctttctcccttcagccgacgaaatttatgactgtaaggtggaacactggggacttgaccagcccctcctgaagcactgggagcctgaaatacccgcaccaatgtccgagctgactgagaccgttgtgtgtgccctgggcttgtctgtgggcctgatgggtatcgtagttggaacagtcttcattattcagggcttgcgctccgtgggagccagccggcatcagggtcccctctag

SEQ ID NO: 229343 - DNA, 765 bp, Artificial Sequence
  Description of Artificial Sequence: Synthetic coding sequence
atgatccttaacaaggctctcatgctgggagccctggccctgacaaccgttatgtccccatgcggcggtgaagatattgtcgcagatcatgtggctagttacggggtgaatctttatcagagttatggtcctagcggtcagtatacccatgagtttgatggggacgagcagttttatgtggacctcgggcgaaaggaaactgtttggtgcctcccggttttgcggcagtttagatttgacccgcaatttgcactgaccaacatcgccgtgttgaagcacaatctcaatagtttaatcaagaggtccaactccacagccgctaccaacgaagtgcccgaagtgacagtgttttctaaatctccagtaaccctggggcagcccaatatcttaatatgtctagtggataacatctttccgccagtcgtcaatataacttggcttagtaacggccactccgtgacagaaggcgtgtccgaaaccagcttcttgagcaaatcagaccactccttcttcaagatcagctacctgaccctgctgcccagtgctgaagaaagttatgactgtaaggtagaacactggggacttgacaagcccctgctgaagcactgggagccggagattcctgccccaatgtcagaactgactgagactgtggtctgcgcccttgggctctcggtcggactggtaggaatcgtggttggtacagtctttattatccgcggactccgctctgtgggagcttctaggcatcagggcccactctag

SEQ ID NO: 229344 - DNA, 768 bp, Artificial Sequence
  Description of Artificial Sequence: Synthetic coding sequence
atgatcttgaataaggcgctcctcctcggtgcgctggcactcacgacagttatgtctccatgcggtggcgaagatatagttgccgaccatgtggcatcctgtggtgtcaatctctatcagttttatggcccaagcgggcaatatacacatgagtttgacggcgacgaacagttttacgtcgacctagaacgcaaggagaccgcttggagatggcctgaattctcaaagtttggtggctttgaccctcaaggcgctctgaggaacatggcagttgccaaacataatctgaatatcatgatcaaacgttacaacagtacggccgctacaaatgaggtgccagaggtgaccgtctttagcaagtcacctgttactttgggacagccaaatacattaatttgcctggtggataacatctttccacctgtcgtgaatatcacctggctctcaaacggacaatcggtaaccgaaggagtctcagagacctcctttctttcaaagtcagatcactctttttttaaaatttcatacttgaccttcctgccctccgctgatgagatttacgactgcaaagtggaacactggggcctcgatcagcccctgctcaaacactgggaaccggaaattcctgctcctatgtcagagttaacggaaaccgttgtgtgtgccctggggcttagtgtggggttgatgggcatcgtggtgggaaccgtgttcatcatacagggcctgagaagcgttggagcctcccggcaccaagggcctctttag

SEQ ID NO: 229345 - DNA, 768 bp, Artificial Sequence
  Description of Artificial Sequence: Synthetic coding sequence
atgattctaaacaaagcgcttttgcttggcgcattggccctcaccacggtaatgtccccatgcgggggtgaggatattgtggccgaccacgtagctagctgcggagtcaatctgtaccagttctacggccctagcggccagtatacgcacgaattcgatggcgatgaacagttctatgttgacctggagcgcaaggaaaccgcttggagatggcccgaattctcaaagtttgggggattcgaccctcagggtgcacttaggaacatggccgtcgctaagcacaatctgaatataatgattaaacggtataattccactgccgcaactaacgaagtcccagaggtcaccgtgttttccaagagtcctgtgactttgggacaacccaacacactgatctgtctcgtggacaatatctttccgccagtggtgaacattacatggctgtccaacggccagtcagtcaccgagggggtcagtgagacgtccttcctgtccaaatctgatcactctttcttcaaaattagctatctcacattcctgccttctgccgatgaaatttatgactgcaaagtcgaacattggggactggaccaaccactgctgaagcactgggagcccgagatacccgctcccatgtcggaactcacggagacagttgtgtgcgctctcggactatctgtcggtctgatgggtatcgtggttggcaccgtgttcattattcagggcttacgatcagtgggcgcatccagacaccagggccctctgtag

SEQ ID NO: 229346 - DNA, 765 bp, Artificial Sequence
  Description of Artificial Sequence: Synthetic coding sequence
atgattctcaacaaagccttaatgttgggagcattggctctaaccacggtcatgagtccctgtgggggtgaggacatagttgctgaccacgtggcaagctacggcgtgaatttgtatcagtcatatgggccttcaggacaatacacgcatgagttcgatggagacgaacagttctatgtcgacttgggtagaaaagaaacagtgtggtgcctgcccgtgctgagacagtttcggttcgatccccagtttgcactcactaatattgccgtgctcaaacacaacttgaactctttgataaaacgtagcaacagtaccgcggcaacaaatgaggtacccgaggtgaccgtcttctctaaaagtcctgtaaccctgggacaacctaatattctgatctgcctggtagataacattttcccacccgtcgttaacatcacttggttgtccaacggccattctgtgacagagggcgtgtccgaaacctcattcctttcaaaatccgaccactccttcttcaagatctcatatctcactctcctcccctctgcagaggagagctatgattgcaaggtggagcattgggggctggacaagccactgcttaagcactgggagccagaaattccagctcccatgtctgagctcacagaaactgtggtctgcgcattaggtctgtcagtgggccttgttggaattgtggtcggtaccgtgtttatcatacgcggtctgcgatctgtaggggctagtagacatcagggaccactgtag

SEQ ID NO: 229347 - DNA, 765 bp, Artificial Sequence
  Description of Artificial Sequence: Synthetic coding sequence
atgatactgaataaggccctcatgcttggagcactcgctttgacaactgtgatgtcaccctgcggaggcgaagacattgtggcagaccacgtggctagttatggagtgaacttgtatcagtcatatggcccttcgggacagtatactcatgagttcgatggcgatgagcagttctatgttgatctggggagaaaggagactgtgtggtgcctgcccgtgctcaggcagttccgtttcgatcctcaattcgctctcactaatattgccgtcctgaaacataacttgaacagtctcatcaagaggagtaattcaaccgccgctaccaatgaggtaccagaggtgactgtgttcagcaaaagcccggtgaccttgggccagcccaacatcctgatatgtcttgtggacaatatcttcccccctgtggtgaacatcacctggctctctaatggtcatagtgttacagagggggtgtctgagacatcgtttttgagcaagtcagatcattccttcttcaagatatcctatctgacactcctacctagtgccgaagaaagttacgattgtaaagtggagcattggggattggacaagccactcctgaaacattgggagcctgagatccccgctcccatgtccgagttaactgagacagtggtatgcgcactagggctgtcagtgggtttagtcggtattgtagtcggcacagtgttcatcattcgtggtctgagatccgtgggggctagtcggcaccagggacccttgtag

SEQ ID NO: 229348 - DNA, 75 bp, Artificial Sequence
  Description of Artificial Sequence: Synthetic coding sequence
atgattttaaataaggcgctgatgctcggcgcactggcactcactacagtgatgtccccatgtggcggagaatag

SEQ ID NO: 229349 - DNA, 765 bp, Artificial Sequence
  Description of Artificial Sequence: Synthetic coding sequence
atgattctaaacaaggctctaatgttaggcgcattggcactgactaccgttatgtctccctgcggtggcgaggatattgtagcagatcacgtcgctagctacggagtcaatttgtaccagagctacggcccaagcggacagttcacgcatgaatttgacggggacgaggagttctacgtggacctggagcgaaaggaaactgtgtggaagctccccctattccacagactcagatttgacccccagtttgcgctaactaatatcgcagtcctcaaacacaatctgaacatcctcatcaaacgcagtaacagcacagccgctacgaacgaagtcccagaggtcacagtctttagtaaatcacctgtcaccctcggacagcccaacaccttgatttgtttggtggacaatatcttcccccctgtcgtgaacataacttggctgagtaacgggcatagtgtgacggaaggagtgagtgaaacgtcttttctgagcaaaagcgaccacagctttttcaagatttcgtatctaacctttttgcctagtgctgacgagatttatgattgcaaggtggagcactggggtctggacgagcccctcctgaaacattgggaaccagagatccccgcacccatgtctgagctcaccgaaactgtggtctgcgcgttgggcttgtctgtcggactcgtggggattgtggttggcaccgtgctaatcatcagaggcctgcggtccgtcggagcgtctcggcatcaaggtcctctgtag

SEQ ID NO: 229350 - DNA, 768 bp, Artificial Sequence
  Description of Artificial Sequence: Synthetic coding sequence
atgatcctgaacaaggctctcatgctgggggctttggcccttaccacggtcatgagtccctgtggaggcgaggacatcgttgcagatcacgtggcctcgtatggagtgaacctataccagtcctacggaccatctggacagtatagtcatgaattcgatggcgatgaggaattctacgtcgacttagagcgcaaagagaccgtgtggcagctgcccctattcaggcgatttagacgctttgatcctcagtttgcattgaccaacatcgcagtgctgaagcacaacctcaacatcgtgatcaagaggtccaacagtaccgctgctactaatgaggtgcccgaagttactgtgttcagcaagagtccagtcactctgggccagcctaacaccttgatctgcctggtggacaatatctttcccccagttgtgaatataacatggttaagtaacgggcactctgtgaccgaaggcgtttccgagaccagctttttatccaaatccgaccactccttcttcaagatatcctacctcactttccttccttctgctgatgaaatctacgattgcaaagtggagcattgggggcttgacgaacctttactgaaacactgggaacccgaaatccccacaccgatgtcagagttgaccgaaaccgtggtatgcgcgttaggcctgtctgtcgggcttgtgggtatcgtggttggcaccgtgttgataattagaggattacgaagtgtgggggcaagcaggcaccagggtcctctctag

SEQ ID NO: 229351 - DNA, 768 bp, Artificial Sequence
  Description of Artificial Sequence: Synthetic coding sequence
atgattctgaacaaggcgcttatgctgggcgctctagccctaaccaccgtaatgagcccctgtgggggagaggacatcgtcgcagaccacgtcgcctcttacggggtgaatctgtatcagtcttatgggccttccggccagtactctcacgaatttgacggagatgaggaattctatgtggatttggaacgcaaggagactgtctggcaactgcctctgtttagacgatttagacggttcgacccgcagttcgccctgaccaacatcgctgtcctgaagcacaacctcaacatcgttataaagaggtctaactcgaccgcagccacgaatgaggtaccggaagtcacagtgttcagcaagtctcccgtgacactggggcagccgaataccctaatatgtttggtggataacatttttcccccagtagtgaacattacatggctgagtaatgggcactcagtgactgagggggttagcgagacatcatttctgtccaagagcgaccatagctttttcaagatatcatatctcacctttctgccgtctgacgatgaaatctatgattgtaaagtggaacattgggggctcgacgaaccacttctgaaacattgggagcctgagatcccaaccccgatgagtgaactcacggagactgtcgtatgcgcacttgggctgagtgttgggctggtgggcattgtcgtgggcacagtgcttattattaggggcctgcgcagcgtcggcgcaagtaggcaccaggggcctttgtag

SEQ ID NO: 229352 - DNA, 75 bp, Artificial Sequence
  Description of Artificial Sequence: Synthetic coding sequence
atgatactgaacaaggccttgctgcttggggctttggctttgactaccgtgatgtctccctgtggtggagaatag

SEQ ID NO: 229353 - DNA, 768 bp, Artificial Sequence
  Description of Artificial Sequence: Synthetic coding sequence
atgattcttaataaagcgctcatgttgggagcactggctctgacaaccgtgatgtcaccttgcggcggtgaggatattgtggctgaccatgtggctagctatggggtcaacctatatcaatcgtatggacctagcggacaatattcccatgagtttgacggtgacgaggaattttatgtggatttagagcggaaggagactgtgtggcagctgccactttttagaagattcaggaggtttgatccccagttcgccctgacgaacattgctgtgctcaagcataaccttaatatcgtgatcaaacggtctaacagcactgcggctactaacgaagtgccagaagtgaccgttttttcaaaatcgcccgtaactctgggccagcctaacaccctcatctgcctggtagataatatcttcccccctgtggtgaacattacgtggctgtcaaatggccacagcgttacggaaggtgttagtgaaacctctttcttgtccaaaagcgaccactccttctttaagatctcttatctaacatttctcccgagcgatgacgagatctatgattgtaaagtcgaacattggggactcgacgagcccctactcaaacactgggagccagagatccctactcctatgtctgagctcacggagacagtcgtgtgcgccctgggcctatctgtcggcttggtgggaatcgtcgtgggaaccgtgcttattattcggggtctccgctccgtcggcgcttcgcgtcaccaggggccactgtag

SEQ ID NO: 229354 - DNA, 765 bp, Artificial Sequence
  Description of Artificial Sequence: Synthetic coding sequence
atgatcttgaataaagctcttatgctcggagcgctcgccctgaccactgtgatgtccccatgtggaggtgaagatattgtggcggaccacgtggcttcgtatggggtcaatttgtaccaatcttatggtccatcaggccagttcacacacgagtttgacggggatgaagagttttacgtggaccttgagcgtaaagaaaccgtctggaaactcccccttttccataggctaagatttgatccccagttcgcattgacaaacatagccgttttaaagcacaatttgaatattttgattaagcgcagtaattcaacagcggctacaaacgaggtaccagaggttacagtgtttagtaagtcccccgtcacccttggccagcccaacaccctcatatgcctggtcgacaacattttcccacctgtagtgaatatcacatggttgtctaacggccacagcgttacagaaggtgtctctgagacctccttcctgagcaagagtgaccatagctttttcaaaatcagctacctcacattccttccttctgcagacgaaatctacgattgtaaggtggagcactgggggctggatgaaccactgctaaaacattgggagccagaaattccagcccctatgagtgaactgaccgagactgtggtttgtgcactggggctctctgttggcctcgtaggaattgtggttggtacggtccttattatacggggactgagatcagtcggagcttcccgccaccaaggtccactttag

SEQ ID NO: 229355 - DNA, 765 bp, Artificial Sequence
  Description of Artificial Sequence: Synthetic coding sequence
atgattctgaacaaggctttgatgttaggcgctctcgcccttacaactgttatgtcgccttgcgggggagaagatatcgtcgcagaccatgtggcatcctatggcgtcaatctttatcagtcgtatggtcccagtggccagttcactcacgagttcgacggagatgaggagttctacgttgacctcgagcgtaaggaaaccgtttggaaactcccattattccacaggctgaggtttgatccccagttcgcactcaccaacatcgcggtgttaaaacataatctaaacatcctcatcaaaagatctaatagcactgctgctacaaatgaagtgccggaggtgacagtgttcagcaagtcgccggtgactctcggacagcccaacacacttatctgtctggtggataatattttcccccctgtcgttaacattacctggttgtctaatggacatagcgtgacagaaggcgtctccgagacctccttcttgtctaaatcggatcactccttctttaaaatcagctacctcacattcttaccctccgctgatgagatctatgactgtaaagtggagcactgggggctcgatgagccgcttctcaagcattgggagccagagatccccgctccaatgagcgagttgaccgaaaccgttgtgtgcgctctaggcctctcagttggcttggtcgggatcgtagtgggtacagtcctgattatacggggtctgagatccgtgggagcaagcagacaccagggtccgctgtag

SEQ ID NO: 229356 - DNA, 765 bp, Artificial Sequence
  Description of Artificial Sequence: Synthetic coding sequence
atgattttgaataaggctctcatgctgggggctcttgctcttacgaccgtgatgtctccttgcggcggagaggatatcgtggccgaccacgtggctagctacggggtgaacctatatcagagctacggaccctctgggcaatttacacacgagttcgacggggacgaggaattttacgtagatttggagaggaaggaaaccgtctggaagttacccctctttcaccgactgaggtttgacccgcagtttgccctgaccaatattgcagtgctgaagcacaacctgaatatcttgataaaacggtcaaattccaccgcggcaaccaacgaagtgcctgaagtgacagtgttctcaaaaagtcccgttacattgggacaaccaaatactctgatctgcctcgtggacaatatattcccacccgtagtcaacattacttggctgtctaatgggcacagcgtgaccgagggagtatcggagacatcctttctgagcaaaagcgaccacagcttttttaaaatctcgtatctgaccttcctgccgtccgcagatgagatctacgattgtaaggttgagcactggggtctagacgagcctctcctcaagcactgggagccagagattcccgctccaatgagcgagctgaccgagacggtagtgtgtgcattgggcctcagcgtggggcttgtgggtatagtcgtgggaactgtcctgattatccggggtttaaggtctgtgggagcgagccgacaccagggacctctgtag

SEQ ID NO: 229357 - DNA, 768 bp, Artificial Sequence
  Description of Artificial Sequence: Synthetic coding sequence
atgattctgaataaagcactgatgctgggagcccttgctctcacgaccgtgatgagtccgtgtgggggtgaagatattgtggccgatcatgtggctagctacggggtaaacctgtaccagagctacggaccatccggccaatacagccatgagttcgatggcgatgaggagttctatgtagacttagaacgcaaagaaacggtttggcaattacccctcttcagaaggttcaggcgatttgatccacagtttgccttgaccaacatagccgtgctgaagcataacttaaacatagtgataaagagaagcaacagcaccgcagctaccaacgaggtcccagaggtgacagtgttttccaaaagtccggtcaccctaggacagcctaataccctaatctgcctggtggataacatttttccgccagtggtcaatatcacatggctctctaatggtcatagtgtgaccgagggggtgagcgaaacatcctttctctctaaaagcgaccacagctttttcaagatcagttatcttacttttctcccatctgccgacgagatttatgactgtaaggtcgagcactggggtcttgatgaaccattgctgaaacattgggagccagagattccaacccctatgtcagagttgaccgagactgtggtctgtgctctggggctgagcgtcggacttgtcggtatcgttgtcggtacagtgctaattattcgcggtttgaggagcgtgggcgcttccagacaccaaggcccattgtag

SEQ ID NO: 229358 - DNA, 75 bp, Artificial Sequence
  Description of Artificial Sequence: Synthetic coding sequence
atgatcctaaacaaggcgttgatgctcggagccttagccctcactaccgtgatgagtccttgcggtggcgaatag

SEQ ID NO: 229359 - DNA, 75 bp, Artificial Sequence
  Description of Artificial Sequence: Synthetic coding sequence
atgattctcaacaaggcacttatgctgggcgctcttgcattaactaccgtgatgagcccctgcgggggagagtag

SEQ ID NO: 229360 - DNA, 768 bp, Artificial Sequence
  Description of Artificial Sequence: Synthetic coding sequence
atgatcttgaacaaagcattgatgttgggcgcattagcactaacgacagtgatgtctccttgcggaggggaggacatagtcgccgaccatgtcgccagctacggagtcaatttatatcagtcttacggcccatcaggacaatactcccatgagttcgacggagatgaagagttctacgtagatttggaacggaaagagaccgtatggcagctgccactgttccgcagattcaggaggtttgacccccagtttgccctgacaaacatcgcagtattaaagcacaacctcaatatcgtcatcaagaggtccaattctacagccgcaaccaacgaggtccccgaagtgaccgtgtttagcaaatcccctgtgaccctcggtcaacccaacacactgatctgcttggtggataacattttcccaccggtagtcaatattacttggctatccaatggacattccgtgacagagggtgtctcggagacatcttttctcagcaagtcggatcattctttctttaagatctcatatctgacctttcttccgagtgatgacgagatctacgactgcaaggtcgagcactggggtctggacgaaccactgttaaaacattgggaaccagaaatcccaacaccgatgagcgagctaaccgaaactgtggtttgtgcactagggctttctgtggggctggttgggatcgtcgtgggaaccgtactgatcatccgtgggttacgatccgtgggcgcatcacggcatcaagggccactttag

SEQ ID NO: 229361 - DNA, 765 bp, Artificial Sequence
  Description of Artificial Sequence: Synthetic coding sequence
atgattctcaacaaggcgctgatgttgggcgctctggcgctgaccaccgtgatgtccccttgtgggggagaggacattgtggccgatcatgtggcaagctacggggtcaacctctatcagagctacgggccttcaggtcagtttacccacgagtttgatggggacgaggagttttatgtggacttagagagaaaagagacagtctggaagctcccgctctttcataggctgaggttcgatcctcagtttgcattgactaacattgctgttctgaaacataatctaaacattctcattaagaggagtaactccaccgccgcaaccaacgaggtgcccgaggtaacagtttttagcaaaagccccgtcaccctgggccaacccaatacgttgatttgtctggtcgataatatttttcctcccgtcgtcaatattacatggctcagcaacggacacagtgtgactgagggggtgtctgagacatccttcctgagcaaatcggaccattcctttttcaagattagttaccttactttcctcccaagcgctgatgaaatttacgactgtaaagtggagcattggggattagatgagcctctgctgaaacactgggaaccagaaattcctgcccctatgtctgaactcaccgaaacagtagtgtgtgcattgggcctctccgtgggcttggttggtatcgtcgtgggcacagtcttaatcattaggggtctgcgcagcgtgggcgctagtcgacaccaaggtccactatag

SEQ ID NO: 229362 - DNA, 765 bp, Artificial Sequence
  Description of Artificial Sequence: Synthetic coding sequence
atgatccttaataaagcactgatgctgggggcactggcgttgaccacagttatgagtccatgtggcggagaggatattgtggccgaccacgtcgccagctatggtgtgaacctgtaccagtcttacggcccaagcgggcagttcacacacgagttcgatggtgatgaagagttttatgtggacctggagaggaaagagaccgtgtggaaactacccctttttcataggctccgattcgatccccagtttgctctgacgaacattgccgtgctgaaacataaccttaatatactgatcaaacgtagtaactccactgccgctacaaacgaggtacctgaagtcacggtgttctccaaatcacccgttacattgggtcaacctaacacccttatctgtttggtcgacaacattttccctccagttgtgaatatcacttggctgtcaaatggacatagcgtgacggaaggagtctcagagacatcctttctcagcaaaagcgaccacagtttctttaagatcagctacctcacattccttccctctgctgacgaaatctacgattgcaaagttgagcattgggggctggacgagccacttctgaagcattgggagcctgagatccctgcaccaatgagcgaactgactgaaaccgtagtatgcgcgcttggactctccgttggactagtggggatcgtggtggggaccgttctgattatccgcggactccgaagcgttggtgcaagtcggcaccagggccctctgtag

SEQ ID NO: 229363 - DNA, 765 bp, Artificial Sequence
  Description of Artificial Sequence: Synthetic coding sequence
atgattctgaacaaagcacttatgctaggcgcactagctttgacaactgtaatgtcaccgtgcggcggagaagatattgtggccgaccacgtagcttcctacggtgtgaacctttaccagtcctatggcccttccgggcagtttactcatgaattcgatggtgatgaagagttctatgtggacttggaaaggaaagaaactgtttggaaactgccgctgtttcatcggctacgattcgacccccagttcgcgctgactaacatcgccgtacttaaacacaatttgaacatcctgataaagaggtccaattccactgccgctaccaacgaagtgccagaggtcactgtcttctccaaatcccccgtgaccctgggccagcccaatactctgatctgcctggtggataacatctttcccccagtggtcaacattacttggctgagtaatgggcacagtgtgacggaaggcgtgagtgagacctccttcttaagtaaaagcgaccactctttttttaaaataagttacctgacttttctgccaagtgcagacgagatttacgactgtaaggtcgaacactggggtctggatgagcccttacttaaacactgggaacctgagatacctgctccgatgtccgagcttactgaaacggtggtgtgtgccctgggcttgtcagtcggtcttgtagggatcgtggtgggaactgtactgatcatccggggactccgcagtgtaggagcaagtaggcatcaagggcctctctag

SEQ ID NO: 229364 - DNA, 768 bp, Artificial Sequence
  Description of Artificial Sequence: Synthetic coding sequence
atgatattgaacaaggcattgatgctgggcgcactagccttgacaacggtgatgtccccctgcggcggtgaggacatcgtggccgatcacgttgcctcttacggtgtgaacctctaccagtcttacggccctagtggccaatactcccatgagtttgatggggatgaagagttctacgtcgacctggaaaggaaagaaacagtatggcagctgcctctgtttcgaaggtttcggcgatttgatccccaatttgccctgaccaatatagcagtgctgaagcacaacctcaacattgtaattaaacggtcaaactccactgcggctacaaatgaagtccccgaggtgacggttttctccaaaagccctgtgacattagggcagcctaacactctgatttgtctggtcgataacattttcccacctgtcgtgaacatcacatggttgtccaacgggcacagcgtcacagaaggcgtaagcgagaccagtttcctcagtaaatccgatcacagtttcttcaaaatcagctatttaactttcctgccttcagatgatgagatctacgactgtaaggtggaacattggggcttggatgagccgctactcaagcactgggaacccgagattcccacaccaatgtcggaactgactgaaaccgtcgtgtgtgctctcggattatcagtgggattggtcggtattgtggtcgggactgttctgatcatcaggggcttacggagtgtcggggcaagccgacaccaagggcctctatag

SEQ ID NO: 229365 - DNA, 765 bp, Artificial Sequence
  Description of Artificial Sequence: Synthetic coding sequence
atgatcctgaacaaagccctgatgcttggggcattggctctcactaccgtgatgtcgccatgcggcggagaagatattgtcgccgaccatgtggcttcttacggagtcaacttataccagagttatggcccttccggacagttcactcacgagtttgatggggatgaggagttttacgtcgacctcgaaaggaaagagaccgtctggaaactaccactatttcacaggttgcgatttgatccacagtttgccctcacaaacattgccgtcctgaagcacaacctgaatatactgatcaagcggtccaactcgacagctgctacaaacgaggtacccgaagtgactgtgttctctaaatctcctgtgactctcggacagcccaacacactgatctgcctcgttgacaatattttcccccctgtggtaaatattacatggctgagcaacgggcactctgtcacagagggagtctcagagacctcatttctttccaaatcggaccatagtttcttcaaaattagctatctcacctttcttccctctgcagacgagatttacgattgtaaagtggagcactggggcctggatgaaccactgctcaaacactgggagccagagatacctgcccctatgtccgagctgaccgagactgtggtgtgtgctttgggtctgagcgtgggtttagtgggaatcgtggtaggaaccgtgctcattataaggggactccgctcggtgggagctagtcggcaccagggacctctttag

SEQ ID NO: 229366 - DNA, 645 bp, Artificial Sequence
  Description of Artificial Sequence: Synthetic coding sequence
atgatacttaataaagcactgctgctcggggcactggctctcaccaccgtaatgtctccctgtggaggcgaagacatcgtcgccgatcatgtggcctcttgtggagtgaatttgtaccagttttacggcccatccggtcagtatacgcatgaatttgatggtgacgaacagttttatgtcgacttggagagaaaggagaccgcctggagatggcctgagttcagcaagttcggaggattcgacccccaaggagccttgagaaatatggcagtggccaaacataatctcaatataatgattaaaagatacaatagcactgcggcaacaaacgaggtgccagaagtcactgtcttctccaagtcacccgtcacactgggccagccgaatacactgatttgtctggtggataatatattccctccagtcgtcaacatcacgtggctgtcaaatgggcagagcgtcacagagggcgtctcagaaacgagcttcctttcgaagagcgaccattcattttttaaaatttcttatctaaccttccttccatccgccgacgaaatctacgactgcaaagtggaacattggggtctggatcaacctctactcaagcactggggcgcatctccctccaccggcgcagaagagtag

SEQ ID NO: 229367 - DNA, 576 bp, Artificial Sequence
  Description of Artificial Sequence: Synthetic coding sequence
atgagcccttgtgggggagaggatatcgtggcggatcacgtggcctcatatggggttaatctctatcaaagttacggcccttcgggacagtactcgcatgaatttgatggtgatgaagagttttacgttgatcttgagagaaaagagaccgtatggcagctcccattgttccggagattccgtcgtttcgatcctcaatttgcactcacaaacatagccgtgctgaaacacaatctgaatattgtcataaaaagatctaactctacagccgcaaccaatgaggttcctgaagtcactgtgtttagtaaaagccccgttaccttaggacagcccaacacacttatctgtttagtcgataacatcttcccacccgtggtcaatatcacctggctgtccaacggtcactcagtgactgagggcgtctcagagacctcatttctgtctaagagcgatcattcattctttaagatctcctacttgacattcctgccgtcagcagatgaaatttacgactgcaaggttgagcattggggtctcgacgagcccctgttgaagcattggggactcttgcactag

SEQ ID NO: 229368 - DNA, 441 bp, Artificial Sequence
  Description of Artificial Sequence: Synthetic coding sequence
atgatcctgaataaggccctgatgttgggggcactggcccttacaaccgtcatgagcccttgcggaggcgaggacatcgtggcagatcatgtggcatcctatggggtcaatctgtaccagagttacggtccaagcggccagtatacgcacgaatttgatggagatgaacagttctacgtggacttggggaggaaagagaccgtctggtgtctgcctgtgcttaggcagtttcgcttcgatccccaattcgccctcacaaatatgtgtatcgccatatacagaagccgaagggtggacctcctgcacgacctagcactctttagcggcccaatctaccacataccatttctgctccagatgtttctcctgtcccctctactatgggacctgaattgctatatctgctcagagctgactaacgcttttgagctattcccttag

SEQ ID NO: 229369 - DNA, 762 bp, Artificial Sequence
  Description of Artificial Sequence: Synthetic coding sequence
gggtgcctgggtaagcggatgattctgaacaaggccctcatgctgggtgccttagcccttacaaccgtgatgtccccctgtggtggagaggatattgtggcagaccacgtggccagctatggagtgaatctgtatcagtcctatggaccatccggtcagtatactcacgagttcgatggagatgaacaattctacgttgatctggggaggaaggagacagtctggtgtctgcctgtgctccggcagtttaggtttgatcctcagtttgctctcaccaatatagctgtactcaaacacaatttgaactccttaatcaagaggtctaatagcaccgccgctacaaacgaggtgccagaggtgactgtgttttcaaaatctccagttacgctcggacagcccaatatcctcatttgtttagtcgataacatctttcctcccgttgtcaatatcacttggctgtcgaacgggcactccgtgacagagggagtctcagagactagttttctgtcgaaaagtgatcactctttcttcaagatctcttatctgacgctcctgccctctgcagaggagtcgtacgattgcaaagtagagcactgggggctggacaagccactcctgaagcattggggcaaagacgaattccaccattttctgatgctgtcttgcttgtcctcctcagaactgccggcattctacagctacatcccgaagctggtgttccacacctcctgggtgagctttttcttgatcttctttttttag

SEQ ID NO: 229370 - DNA, 603 bp, Artificial Sequence
  Description of Artificial Sequence: Synthetic coding sequence
atgtctccctgtggtggtgaagacatcgttgccgatcacgtggcttcatacggcgtgaatctgtaccagagctacgggccttctggccagtactcccatgaatttgatggggatgaagagttttatgtggacttagagcggaaagaaactgtatggcagcttccactgttcaggcggtttcgccgtttcgatccacagtttgcattgacaaacatcgcagtgcttaaacataatctcaacattgtgatcaaacgatccaactccaccgccgctaccaatgaagtaccagaagtcacagtgttctcgaaatcccccgtgacgctcgggcaacccaacacactcatttgcttggtggacaacatctttcctccagttgtgaacattacttggttgtctaacgggcactccgtgactgagggggtgtcggaaacctctttcctatcaaaaagtgatcacagttttttcaagatctcttatctcaccttcctgccctccgctgatgagatatacgactgcaaggtggagcactgggggctggacgagccactcttaaaacactgggagagccagagtcgcgagagcgaagagtcaacaaaatcctag

SEQ ID NO: 229371 - DNA, 582 bp, Artificial Sequence
  Description of Artificial Sequence: Synthetic coding sequence
atgagcccttgtggaggcgaagacatagtggcagatcatgtcgctagctatggcgtgaatctttaccaatcctatggccctagtggccagtacactcacgaattcgatggggacgagcagttttacgtcgatctggggaggaaagaaaccgtctggtgcctcccagtgttgcgccagttccgcttcgacccacagttcgcattaaccaacatcgccgtgttgaaacacaacttgaatagcttgataaagcgaagcaatagcactgcagcgactaacgaggtgcctgaagtcacggtgttcagcaagtcccctgtgacactagggcaacctaacattctgatctgtctggtggacaacatctttcctcccgtggtgaatataacatggcttagcaacgggcactcagtgactgaaggcgtgagcgagactagcttcctgagtaaatcagatcactcattctttaagatcagctatcttactttattaccttctgccgaagagagctacgactgtaaggtagagcattggggactggataagcccttacttaagcattgggtgcacggcttcctgagcttttag

SEQ ID NO: 229372 - DNA, 606 bp, Artificial Sequence
  Description of Artificial Sequence: Synthetic coding sequence
atgtcaccatgcggaggggaagacattgtcgccgatcatgtggcctcttacggggttaacctgtaccagtcttacggaccctccggacaatacagtcatgagtttgatggcgatgaagaattctatgtggatctggagaggaaggaaaccgtttggcagttacctttgttccggaggttcaggcgctttgacccacagttcgctcttacaaatatcgcagtgttgaaacataacctgaatatcgtgataaaaaggtcaaattctacagccgctacgaacgaggttcctgaggtcactgtattttccaaatcacctgtaactctaggccagccaaatacactcatctgcctggtggataacatctttcctcctgttgtaaacatcacctggttaagcaatggccatagtgtcacagagggggtatccgagacgtcgttcctgtccaagagtgatcattcatttttcaagatttcctatctgacattcctgcccagtgctgatgaaatttatgattgcaaggtggaacattggggcctggacgaacctctcctgaagcactggggaatccaggccgaggagggtcagcggaggaaaaagctgggttag

SEQ ID NO: 229373 - DNA, 258 bp, Artificial Sequence
  Description of Artificial Sequence: Synthetic coding sequence
aacacattgatttgtttagtggataacatatttcctcctgtggtgaatattacctggcttagcaacggccattctgtgacagagggcgtatccgagacctccttccttagtaaatcggaccactcgttctttaagatttcctaccttacttttttgccgtctgccgatgagatctacgactgcaaggtggagcattggggactggacgagcctttactgaagcattgggggaaggacttcatgagcttcttttattag

SEQ ID NO: 229374 - DNA, 390 bp, Artificial Sequence
  Description of Artificial Sequence: Synthetic coding sequence
gggtgcctcggaaagagaatgatcctcaataaggcgttaatgcttggagcgctggcccttaccaccgtgatgagcccatgtggcggtgaggatatagttgctgaccatgtggcaagctacggagttaacctctatcagagttatgggcctagcggccagtattctcatgagttcgacggcgacgaagagttttacgtggatctcgagagaaaagagaccgtgtggcagctgccactgttccgtcgttttaggcgcttcgatccacagtttgccttaacaaacattgccgtgctgaaacataacctgaacatcgtcattaagcgttcgaactctactgctgccacaaacgaagtgcccgaggtcacagtcttttcgaagtcgccagtgtag

SEQ ID NO: 229375 - DNA, 768 bp, Artificial Sequence
  Description of Artificial Sequence: Synthetic coding sequence
atgattctgaacaaagccctcctcctcggagcattggccctcactgcggtgatgagtccttgcgggggtgaagacatcgtcgcagatcacgttgcgagctatggcgtcaacttttaccagagccacggaccatcaggacagtacactcatgagttcgatggcgatgaagaattttacgtcgatctcgagaccaaagagacagtgtggcaactgccaatgttcagcaagtttatcagtttcgacccgcaatctgctcttaggaatatggcagtcggcaagcacactttagagttcatgatgcgacaatctaattccacggctgcgaccaacgaagttcctgaggtgaccgttttctccaagttccccgtcacactgggacagccaaacacactcatatgtctagtcgataacatcttcccccctgttgtgaacatcacatggctgagcaatggccacagcgtgaccgagggggtcagtgagaccagcttcctctcgaagtcagaccatagctttttcaagatatcatatctaacattcttgccaagtgcagatgagatctatgattgcaaggtagagcactggggactggacgagcctctgctgaagcattgggagccggaaatccccgcacccatgtccgaattaacagagaccctcgtttgtgccctggggctgtccgttggcctgatgggtattgttgtcggcacagtctttattatccagggcctcaggtctgtggacgcaagccgccatcaaggccttctctag

SEQ ID NO: 229376 - DNA, 768 bp, Artificial Sequence
  Description of Artificial Sequence: Synthetic coding sequence
atgatcctcaacaaggccctgctgctgggcgctttggccctcaccgcagtgatgagtccatgtggcggtgaagacatcgtggcagaccatgtggcctcctacggggtcaacttttatcagtcccacggaccgagtggtcagtacacacatgaattcgatggtgatgaggagttttacgtagacctggaaaccaaggagacagtttggcagctgccaatgtttagcaaattcatctcgtttgacccgcagagcgccttaagaaacatggcggtagggaaacatactctggagtttatgatgaggcagtctaactctacggctgctactaacgaggtgcccgaagttacagtgttctcaaagtttccagtcaccttgggacagccaaacactctcatttgtctggtggataatatattccccccagttgttaacattacatggttatcaaatggccatagtgtgacagagggcgtcagcgagacatccttccttagcaaatccgatcatagttttttcaaaatttcctacctgactttcttgccttccgcagacgagatttacgattgcaaggtggagcactggggcttggatgaaccacttctgaagcattgggaaccagaaattccagcacctatgtccgaactgactgagacgctcgtgtgtgcgttgggcctgagtgtgggtctgatgggtatagttgtagggactgtgttcattatacagggattaagatcggtcggagcctcacgccatcaagggctgctctag

SEQ ID NO: 229377 - DNA, 768 bp, Artificial Sequence
  Description of Artificial Sequence: Synthetic coding sequence
atgattctgaacaaggccttactgctcggggctttagcgctgacagcagtaatgagtccatgtggcggagaggatatcgttgccgaccacgtggcatcctacggcgtgaacttctaccaatcacacggacctagcgggcagtacacccacgaattcgatggcgatgaggaattttatgtggacttggagacgaaggaaaccgtatggcagctgcctatgttttcaaagtttatttcttttgaccctcagtccgcccttaggaatatggccgtagggaagcataccttggagtttatgatgggacagagtaacagtacagccgcaacgaacgaagtccctgaagtgaccgtcttttcaaaattcccagtgacattggggcagccaaacactctgatctgtctggtggacaacatcttcccccctgtggtcaacattacgtggctaagcaacggacattcggtaaccgagggtgtcagcgagacgagcttcctgagtaaatccgaccatagtttctttaagattagctatctcacctttttgccctctgcagacgagatctatgactgcaaagtcgagcattggggtctagatgagccattactaaaacattgggaaccggaaatccctgccccaatgtcagagctgactgaaaccctcgtctgtgcgcttggcttgtcagtcggcctcatgggtatagttgtcgggaccgtatttatcattcagggtttgcggtcagttggcgcttctcgccatcaagggttgctgtag

SEQ ID NO: 229378 - DNA, 768 bp, Artificial Sequence
  Description of Artificial Sequence: Synthetic coding sequence
atgatcctaaataaggctctgttactcggagccctggcattgaccgccgtgatgtccccgtgtggcggtgaagatatcgtggccgaccatgtcgcctcctacggtgtgaatttttaccagagccatgggcctagtggccagtacactcacgaattcgatggagacgaggagttctacgtggacctcgagacaaaggagaccgtgtggcagctgcccatgttttccaaattcatatcttttgatccacagagtgctctgcggaacatggcagttggtaagcatacacttgagtttatgatgcgacagagcaactctaccgctgctactaacgaggtcccagaggtgacagtgttttctaagtttcctgtaaccctcgggcagccgaacacactgatttgcctggtggacaacatatttcctccggtggtaaatataacctggctgtccaacgggcactctgtaaccgaaggggtcagtgagacaagctttttgtccaagagtgatcactcgtttttcaagattagctatctgaccttcctgccctccgctgatgagatctatgactgcaaggtcgaacattggggtttagatgagcctcttctaaagcattgggaacccgaaatccccgcacctatgtcggagctgaccgagacactggtgtgcgcattaggcctttctgtcggccttatgggtatcgtagttggaacagtcttcattatccagggtttacgctcagttggagctagccgccaccagggcctcctctag

SEQ ID NO: 229379 - DNA, 768 bp, Artificial Sequence
  Description of Artificial Sequence: Synthetic coding sequence
atgattctgaacaaagcattgctgctcggggcactcgccttgacagctgtaatgtctccttgtggcggagaagacatcgtggccgatcatgtggcttcatatggagtgaatttctatcaatcccacggaccatcgggacagtacacccacgagtttgacggagatgaggagttttacgtggatttagaaactaaggaaacagtgtggcagttgcccatgttcagcaagtttatcagtttcgatcctcagagcgcactccggaacatggctgtaggaaaacacacactagagttcatgatgaggcaatctaattctacagctgctaccaacgaggtgccggaggtcactgtgttctcaaagtttcccgtgaccctgggacaaccaaatacccttatctgcctcgtggacaatatttttccacccgttgtcaacatcacatggctttcaaatggacacagtgtgacagagggggtgagtgaaacctcatttctaagtaagtctgatcattcttttttcaagatttcatatctaaccttcttgccctccgcagacgaaatctacgactgcaaagtagaacattggggcctcgatgaacctcttctgaaacactgggagcccgagattcctgccccaatgtcagagttaactgagacgttagtttgtgctttaggcctgtctgctggactaatgggtattgtggtgggcacagtatttattatacaggggctgcgatccgttggcgcaagccggcaccaaggactcttatag

SEQ ID NO: 229380 - DNA, 768 bp, Artificial Sequence
  Description of Artificial Sequence: Synthetic coding sequence
atgattctcaacaaagccctcttgctaggagcacttgctctgacagcggtgatgtctccttgcggcggtgaagacattgttgccgatcatgtcgcaagctacggagtaaacttctatcagtcccatgggccaagtggccagtatacacatgaattcgatggtgacgaagaattctacgtcgatctggaaaccaaggagacggtctggcagctcccaatgttttctaaattcataagcttcgatcctcagagtgccctcagaaatatggctgtgggtaagcatactctggagttcatgatgcgacagtctaatagcacagctgctactaacgaggtgcctgaggtcactgtctttagcaagttccctgtgaccctgggccaacctaacaccctgatttgcctcgttgacaatattttcccaccggttgtcaatataacttggctctcaaacgggcattcagtgacagagggggtgagtgagacgtcttttctgagcaagtccgatcattccttctttaaaattagttatctgacattcctgccgagcgctgatgagatatacgactgtaaggtcgagcattggggcctggatgagcctctactgaagcattgggagcctgagatcccggctccgatgagtgagcttaccgaaactctggtctgtgcattaggtctgagcgtgggactgatgggtattgtggtggggaccgtgtttattattcagggcctgcgctccgtgggcgcttcacgacatcaaggactcctgtag

SEQ ID NO: 229381 - DNA, 768 bp, Artificial Sequence
  Description of Artificial Sequence: Synthetic coding sequence
atgattcttaacaaggccctgcttctgggtgcactggccttaaccgcagtcatgtctccttgcggtggggaagacattgtcgcagaccacgttgcgtcctatggcgtgaacttttaccaaagtcacggtccttccggacaatatactcatgaattcgatggtgatgaagaattctacgttgacctcgagactaaagagaccgtatggcagttaccaatgttcagtaagttcatctcattcgacccccagagcgccctccgtaatatggccgtggggaagcataccctagagttcatgatgcgacaatctaactcgacagccgctactaacgaagtccccgaagttacagtcttttcgaagttccctgtaacactgggtcagccaaataccctgatctgtcttgtcgataacatttttccgcctgtcgtgaacataacctggctctccaatgggcatagtgtgacagaaggagtgtctgagacaagttttttgagcaagagtgaccactccttcttcaagatctcttacttgacattcctgccatccgccgatgagatctatgactgcaaagtagagcattggggattggacgaacccctgcttaaacactgggaacctgaaataccggcacctatgtcagagttaacagaaacactcgtctgtgctctagggctctctgtggggttgatgggcattgtagtgggcacagtatttatcatacagggccttcggagtgttggcgcttcccgccaccagggactcctgtag

SEQ ID NO: 229382 - DNA, 768 bp, Artificial Sequence
  Description of Artificial Sequence: Synthetic coding sequence
atgattctcaataaagccctactgttgggggcattggccctcacagcagtgatgtcaccctgcggcggtgaggatatcgtcgcggatcatgttgcttcgtacggagtgaatttctatcagagccacgggccatccggccagtacacccacgagttcgacggcgatgaggagttctatgtggatctggaaacaaaggagacagtgtggcagctgcccatgttcagtaagttcatctccttcgatccacagtccgcactcaggaatatggccgtaggcaagcacactctggagtttatgatgcgtcagagtaattctacagcagccaccaacgaggtgcccgaggtgaccgtgttcagcaaatttccagtgacactggggcagcccaacacactgatctgtctggtcgacaacatttttccccctgttgtgaacattacctggctgtcaaacggtcacagcgtcactgagggcgtttctgaaacctcattcttgagcaagtctgatcatagtttctttaagatcagctatttgacttttctgccatctgccgatgagatctatgactgtaaagtagagcactgggggctggacgagccactactcaagcactgggagcctgaaatccctgctccgatgagcgaactcacagaaactctggtttgcgccttgggcctaagcgctgggctgatgggcatcgtcgtgggcactgtgtttatcatccaggggctgcgatcagttggcgctagtagacaccaaggcctcttatag

SEQ ID NO: 229383 - DNA, 768 bp, Artificial Sequence
  Description of Artificial Sequence: Synthetic coding sequence
atgatcctgaacaaagctttgcttctcggggctttagccctaaccgccgtaatgtctccttgcggaggggaggacatcgttgctgaccatgtggcctcctatggcgttaacttctaccagtctcacggcccttccgggcagtacacccatgagttcgatggcgacgaagaattttacgtggacttggaaacgaaagagacagtgtggcagctgccgatgttctcaaaatttatttcctttgacccccagtcagctctgcgtaatatggcagtgggaaaacatactcttgagtttatgatgcgacagtccaatagcaccgccgctaccaacgaggtcccagaagtgactgttttctccaagtttcctgtcaccctgggacaacccaatacactgatctgcctggtagacaacatattcccaccagtcgtgaatattacatggcttagcaacggccattccgtgacggagggggtgagcgagacaagtttcctctctaagagcgatcacagttttttcaaaatcagctatttgacgttcctcccctcagctgacgagatctatgactgcaaggtcgaacattggggactggatgagcccctgttgaagcactgggaaccagagataccagctccgatgtctgaactcaccgagacacttgtatgcgctcttggattatcggtgggcttgatgggtatcgtagtcggtaccgtgtttataattcagggattgaggagtgtgggagcctctagacaccagggtctactctag

SEQ ID NO: 229384 - DNA, 249 bp, Artificial Sequence
  Description of Artificial Sequence: Synthetic coding sequence
gaccatgtcgcttcctacggagtgaacttctaccagtcccacgggccaagcggccagtatacccatgagttcgatggtgatgaggaattttatgtggacttagagacgaaggagacggtgtggcagttgcctatgttttccaagtttatatcattcgaccctcagagtgctctacgaaacatggccgttggcaaacacacactggaattcatgatgcgccagtcaaattccaccgccgctaccaactag

SEQ ID NO: 229385 - DNA, 768 bp, Artificial Sequence
  Description of Artificial Sequence: Synthetic coding sequence
atgatcctgaacaaagctctgttgcttggggctttggccctgactgccgtgatgtccccatgcgggggtgaagatatcgtcgcagaccacgtggccagctacggcgtgaacttttaccagtctcacggcccatcagggcagtacacccacgagttcgacggcgatgaagaattctatgtcgatctggagaccaaggagaccgtctggcaactcccaatgttttccaagtttatttcattcgacccgcagtctgcactgaggaatatggccgtcggcaaacataccttggagtttatgatgcggcaaagcaatagtaccgctgccactaatgaggtgccggaagtcactgtgtttagtaaattcccagtaacattgggccagcccaacaccttgatttgtctcgtggacaatatcttccctcctgtagttaacatcacttggctctctaatggacattcagtgactgagggcgtaagtgaaacgagtttcttaagcaagagtgaccacagcttcttcaaaatttcctatctaacttttttgccatccgccgacgaaatatacgattgtaaggtcgaacattgggggctggacgaaccactattgaagcactgggagcccgagatccctgcgcctatgtctgagctcaccgaaactctggtctgcgctctgggcttatccgttggtttgatgggcattgtggtgggaacggtatttatcatccaggggctgcgatctgtaggcgctagcagacaccagggattgttgtag

SEQ ID NO: 229386 - DNA, 84 bp, Artificial Sequence
  Description of Artificial Sequence: Synthetic coding sequence
atgatacttaacaaggcattacttctgggtgctctggctctgacagcagttatgtccccctgcgggggagaagatattgtgtag

SEQ ID NO: 229387 - DNA, 810 bp, Artificial Sequence
  Description of Artificial Sequence: Synthetic coding sequence
atgtcctggaagaaagcgttgaggatccccggtgatctgcgcgtggctacagtcacactgatgctcgcaatgctgtctagcctgctggccgaaggcagagatagccctgaagatttcgtctttcagtttaaaggcatgtgctattttactaatggaacagagagggttcgactggtgaccaggtatatttacaatagagaggagtatgctaggttcgactccgatgtgggtgtctatcgggctgtgacaccgcagggccgacccgacgcagaatattggaattcccagaaggaggtgctagaaggaactcgagccgaactggatactgtatgtagacacaattacgaagtggcttttcggggtatccttcagaggagggtcgagcctaccgtgactatctccccctcacgtactgaggctctgaaccaccacaacctccttgtgtgttccgtgacggacttttaccctggacaaatcaaggtccgatggtttagaaacgatcaagaagagacagccggagtagtgtccacccctctcatccggaacggtgattggacgtttcagatcctggtgatgctcgagatgacaccccagaggggagacgtttacacatgccatgtggaacaccccagcctccagtcccctattaccgtggagtggagggcccagtctgaatccgcccaatctaaaatgctcagcggtgttggcggttttgtcctcggcctgattttcctcggcttggggctcataattcggcagagaagccagaaggggccacagggtccaccaccagccggtctgctccattag

SEQ ID NO: 229388 - DNA, 786 bp, Artificial Sequence
  Description of Artificial Sequence: Synthetic coding sequence
atgtcttggaagaaggccttgcgcatcccgggaggtctgcgcgctgctactgtcaccctaatgctgagcatgttaagcactcctgtcgccgaaggacgggacagtccagaagacttcgtgtaccagttcaaaggaatgtgctacttcactaatggcacagagcgggtgagactagtcagtaggtctatttacaatagggaggagatcgtccgcttcgactccgatgtaggcgagttccgcgctgtaacccttctcggcctgccggctgcagagtactggaacagccagaaggacattctggagcgtaagcgcgctgctgtagatagagtttgccgtcataactaccagctggagctgaggacaaccctccagcgtcgagtggagcccacagttaccatctccccctcacgcaccgaggctcttaaccatcacaatctgttggtctgctcagttaccgatttttacccagcccaaataaaggtgagatggtttcggaatgaccaagaagaaacagccggagtcgtctccaccccactgattcgcaatggggattggacatttcaaatactggtcatgctggagatgactccgcagcgcggagacgtgtacacctgtcacgttgaacaccctagcctccaatcgcccattactgtagagtggcgtgctcagagtgagtccgcacagagcaagatgctctccggtattggcggatttgtgcttggattgatttttttgggtctgggactgattattcaccatcgctcacagaagggacttctccattag

SEQ ID NO: 229389 - DNA, 786 bp, Artificial Sequence
  Description of Artificial Sequence: Synthetic coding sequence
atgtcttggaaaaaagctttacggattcccggaggactccgcgcagctacagttaccttgatgctgtcaatgctgagtacaccagtggcggagggtagagactcacccgaggatttcgtataccagttcaagggaatgtgttatttcacaaacgggactgaacgagtgagactcgtgtctcggagcatttataatcgtgaggaaattgtgcgttttgacagcgatgtgggggagttcagagcggtcacactgctgggcctgcccgcagctgagtactggaactcacagaaggatatattggagagaaagagagccgctgttgatagagtgtgtcgacacaattaccaactggaattgaggactactcttcagagacgtgtggagccgactgtgacaatctcaccaagcagaacggaggcgctgaatcatcacaatctccttgtctgtagcgttaccgatttctaccctgcgcaaattaaggtacgctggtttagaaacgaccaggaagagaccgcgggagtggtctcaacccctttgattcgaaacggcgactggaccttccagattctggtgatgcttgaaatgactccacaacggggagacgtttacacatgccacgtggagcatccatccctgcaatcgccaataacagtggaatggcgtgcacagagtgagtccgctcagtcaaagatgctgtcaggaattggcggatttgtgctaggactcatcttcttaggcttgggtctgatcattcaccaccgatcgcagaagggactgctgcactag

SEQ ID NO: 229390 - DNA, 810 bp, Artificial Sequence
  Description of Artificial Sequence: Synthetic coding sequence
atgtcatggaaaaaggccctgcggataccaggaggactgcgcgctgccaccgtgactctgatgttagccatgctgagtactcccgtggctgaggggagagactcccccgaagatttcgtctatcagttcaaagccatgtgctatttcacaaacgggacggagagggtccgttacgtgactcgttacatttacaatcgggaagagtatgcccgtttcgactcagacgtcgaagtttacagggctgtcacacccctaggcccaccagacgccgagtattggaattctcagaaagaggtgttggaacgcaccagagccgagttggatacagtctgcaggcataactatcagttagaactgaggacaacattacagcgcagggtcgagcctaccgtgacaatcagcccctcccggacagaagcccttaatcatcacaacctattggtatgcagcgtgacagacttctaccccgctcaaattaaggtcagatggtttaggaacgatcaggaggaaacaacgggcgtcgtgtccacccccctaatccgcaacggagactggacgttccaaatcctggttatgctggaaatgacgccccagcacggcgacgtgtacacatgccacgtggaacaccccagcctacagaaccccattacagtggaatggagggcgcagtcagaatcggcccagtctaaaatgctgtccgggattggtggttttgtcctgggactcatctttctgggcctgggtttgatcattcaccaccgctctcagaaaggcccacagggcccacctccagcaggtctgcttcactag

SEQ ID NO: 229391 - DNA, 810 bp, Artificial Sequence
  Description of Artificial Sequence: Synthetic coding sequence
atgagttggaagaaagctctaaggatcccgggtggactaagagttgctactgtaactctgatgctggccatgctgagtacccccgtcgctgaaggcagagactcccctgaggactttgtctaccagttcaaaggtatgtgctatttcactaacgggacagagcgtgtcagactggttaccaggtacatctacaaccgggaagagtacgctagattcgactccgatgtaggcgtctatagagctgtgaccccgctggggccacccgacgccgagtattggaacagccagaaagaagtcctggagcggacccgggcagagctcgacaccgtgtgccgacataattatcagttggagctgcgcaccacgctgcagagacgagttgaacccactgtgactatcagtccatcaagaacggaggcacttaaccaccataacctgcttgtgtgttctgtcaccgatttctatccggcacaaatcaaggttcggtggtttaggaatgaccaggaggagaccacaggtgttgtttccacacccctaatccgcaatggagactggaccttccaaatactggtcatgctcgagatgacaccgcaacgcggtgatgtttacacatgtcacgtggagcacccgagcctccagaaccccatcattgtggaatggagggcgcagagtgaaagtgctcaatcaaagatgctttccggaatcggcggattcgtcctgggcttaatctttttaggactgggtttgatcatacaccaccgatcgcagaagggtcctcaggggccaccgccagcgggtctgctgcattag

SEQ ID NO: 229392 - DNA, 675 bp, Artificial Sequence
  Description of Artificial Sequence: Synthetic coding sequence
atgtcatggaaaaaagccctgcgcatccccggagacttgcgggttgctacagtgactctgatgctggctatgctttctagtctcttggctgaggggcgtgatagtcccgaagatttcgtgtttcagttcaagggtatgtgttattttacgaacggcaccgaaagagtgcgcctcgtgacccgttatatttataatcgagaggaatacgcaagatttgatagtgacgttggcgtgtatagggccgtcactccccaggggcgaccagacgccgaatactggaatagccagaaggaagtcttggaaggcacgagggctgagcttgatacagtatgcaggcataattacgaagtcgccttccggggtattcttcagcgcagggtggagcccactgttactatctcccccagccgaacagaggctcttaaccatcataatctgctggtgtgtagcgtgacagatttttaccccggtcagatcaaggtccggtggttcagaaacgatcaagaagaaactgcgggagttgtgtcaacccctctcatcaggaacggcgattggaccttccagatactggtgatgctggagatgactccccagaggggtgatgtgtacacatgtcacgtcgaacacccgtctcttcaatcacctatcactgtcgaatggcgacttcttcattag

SEQ ID NO: 229393 - DNA, 786 bp, Artificial Sequence
  Description of Artificial Sequence: Synthetic coding sequence
atgagctggaagaaagcactgagaattccaggcgaccttagggtggccacggttacactgatgctggctatgctctcatcactgctcgccgaggggcgtgatagccctgaggattttgtgtttcagtttaaagggatgtgctacttcactaatggcactgaacgcgtgcggctggtgacccgctacatttacaatcgcgaggagtacgccaggttcgactcagacgtaggagtgtatagagctgttaccccccaggggcgtcccgacgctgaatactggaactcacagaaagaagtgctggagggcacccgcgcagaacttgacaccgtttgccgccacaactacgaagttgctttccggggtatccttcagagacgcgtagaaccaactgtgacaattagtccgtcccgaacggaggcccttaatcaccacaacctgctcgtgtgcagcgtgactgatttctaccccggtcaaatcaaggtacgctggtttcggaatgaccaggaggagacagccggagtagtcagtactcccctgattagaaacggagactggacattccagattctcgtgatgctggaaatgacaccacagcgcggagacgtttatacttgccacgttgaacacccgtccttgcagtcacccattacagtggaatggagagcccagagcgagtccgctcagagcaagatgttgagtggagtggggggtttcgtgctcggtctcatcttcctgggcctgggcctcatcatacggcagagaagtcagaagggcttgctccactag

SEQ ID NO: 229394 - DNA, 786 bp, Artificial Sequence
  Description of Artificial Sequence: Synthetic coding sequence
atgtcctggaaaaaggccttgcgaatacccggaggactgcgcgctgccaccgtgacgctcatgctggcgatgctgtcaacaccagtagccgagggacgcgactctcccgaggactttgtgtaccagttcaaggcgatgtgctactttaccaatggcacagagcgggtgcgctacgtgactaggtacatctacaacagggaagaatacgcccgattcgatagtgacgtggaagtttatcgggcagtcactccactgggtcctcccgacgcggaatattggaactcgcagaaagaagtactagaacgaacaagagccgagctagatacggtgtgcagacataactaccagctagaactgcggacgaccctccaacgtcgtgtagaacctaccgtcaccatctcaccaagccggaccgaagccctgaaccatcacaacctgctggtctgctctgtgacagatttctaccccgctcagataaaagtcagatggtttaggaacgatcaggaagagacaaccggtgtggtcagtacccccttaatccggaacggtgactggacattccagatcctggtgatgcttgaaatgacccctcagcacggtgacgtttacacctgtcatgttgagcacccctcactccaaaatccaattacagtggaatggagggcccagtcggaaagcgcacagtccaagatgctgtctgggattggtggctttgtgctggggttaatcttcttgggcttgggcctaattatccaccatcgtagccagaaaggcctcctacactag

SEQ ID NO: 229395 - DNA, 675 bp, Artificial Sequence
  Description of Artificial Sequence: Synthetic coding sequence
atgagctggaaaaaggccctcaggattcccggtgggctgcgggcagccacggtcacactgatgctctcaatgctgtcaacccctgttgctgagggtagagactctcccgaggatttcgtatatcagttcaaaggtatgtgctatttcactaatggtaccgagcgtgttcgtttggtgtctcgatctatttataatcgcgaggagatcgtcaggttcgattccgacgtgggcgagttccgagctgtcactctgttgggcctgcccgcagcagagtattggaatagtcaaaaggacatcctggagcgaaagagggccgcagtcgacagagtctgcagacacaactaccaattggaactgaggacgactctgcagagaagagtagagcccacagtgaccatcagtccttctagaacagaggcactaaatcatcataatttactggtgtgcagcgttacagatttctatccagcccagatcaaggtgagatggttccggaatgatcaagaggagacagccggagtggtgtctacgccacttatccgaaatggcgattggacttttcaaatactcgtgatgctggagatgacgccccaacgaggcgacgtgtacacctgccatgtggagcacccctcgttgcaaagccctatcaccgtggagtggcgtcttctccactag

SEQ ID NO: 229396 - DNA, 786 bp, Artificial Sequence
  Description of Artificial Sequence: Synthetic coding sequence
atgtcttggaagaaggcactgcgtattcctgggggtctgcgggctgcaacagtcactcttatgttggctatgctttctacgcccgtggccgagggacgagattctccggaggactttgtttatcagtttaaggcgatgtgttacttcacaaatggcactgagcgggtgaggtacgtcactagatatatttacaatagagaggagtatgcgagatttgattctgacgtggaggtctacagggctgtcaccccactgggcccacctgatgccgaatactggaatagccagaaggaggtactggaacgcacccgggcagagctggacacagtgtgtagacacaattaccagctagaacttagaaccacgctgcagcgtcgcgtcgagcccactgtgaccatcagccctagccgaactgaggccctcaaccatcacaacctgctggtgtgctcggttacagatttttacccggctcagataaaagtgcgttggttccggaatgaccaagaggaaacaaccggagtagtgtccacgccattgatcagaaacggtgattggaccttccaaatactggtcatgctggagatgaccccgcagcacggagacgtgtatacatgtcatgtagaacatcccagccttcagaatccaataaccgttgaatggagggcccagtcagaaagcgcccagtccaagatgctaagcggaatcgggggatttgtgctgggactcatctttctggggctgggcctaatcattcatcacagatcacaaaaagggctgctgcactag

SEQ ID NO: 229397 - DNA, 786 bp, Artificial Sequence
  Description of Artificial Sequence: Synthetic coding sequence
atgtcttggaaaaaggctctaagaatccccggtggtttgcgggtcgccactgttacactcatgctcgctatgctgtctacacctgtggcagaaggcagagatagtcccgaggactttgtttaccagttcaaggggatgtgctacttcacaaatggcaccgaacgggtgcggggtgttacccggtacatctacaaccgcgaagaatatgcgagatttgacagcgacgtgggcgtgtaccgggctgtaacccctctgggtcctcccgctgccgagtattggaactcacaaaaagaggtgctggagagaaccagagcagagttagacacagtgtgtagacacaattatcaattggagctcagaactacactgcaacggcgtgttgaacctacggtgaccatttctcctagtcgcaccgaggctctcaatcaccacaatttgctggtgtgcagcgtcactgatttctatcccgcacagattaaagtccgatggtttcgtaacgatcaagaggaaactactggggtggtgagtaccccgttaattagaaatggcgactggactttccagatcctggtaatgctggagatgaccccacagagaggagacgtttatacttgtcatgtcgaacatccgtctctccagaatcctatcatcgtggagtggagggcacaatccgagagcgcacagagcaagatgctgagtggaattggtggctttgtgcttggcttgatctttctgggactcggcctcattattcaccatcggagtcagaaaggcctgctccactag

SEQ ID NO: 229398 - DNA, 675 bp, Artificial Sequence
  Description of Artificial Sequence: Synthetic coding sequence
atgtcttggaagaaagcgctccgtatacccggtgggctcagggcagctacggtcacgttaatgcttagtatgctatctacgccagtcgctgaaggcagagactctcctgaggatttcgtttaccagttcaaaggcatgtgttatttcactaacggaactgagcgcgtcagactcgtgtcaagatccatttataatcgagaggagatcgtgaggtttgactcagatgtgggggagtttcgtgccgttacactgctggggcttcctgctgcagagtactggaactctcagaaggatatcctggagagaaaacgcgctgccgtggaccgcgtgtgccggcataattaccaactggaattaaggactaccctgcagcgtcgggtcgaacctactgtgacaatcagccccagtagaaccgaagccctgaatcaccacaacctcctcgtctgcagcgtgactgacttctacccagcccaaattaaggtgagatggtttaggaacgggcaggaagagaccgccggagtagtcagcacgcctcttattcggaacggcgattggacttttcaaattcttgtgatgctggagatgacccctcaacgaggcgacgtttacacttgtcatgtggagcatccgagcctgcagtctccgatcacggtggagtggagactgcttcactag

SEQ ID NO: 229399 - DNA, 786 bp, Artificial Sequence
  Description of Artificial Sequence: Synthetic coding sequence
atgagctggaagaaggcccttaggattccgggaggtttgagggtggccaccgtgactcttatgctggccatgctcagtactcctgtggctgagggcagggactcccctgaggattttgtgtatcaatttaagggaatgtgttacttcactaacggaacagagcgggttaggttagtaacccggtacatttacaacagggaagagtatgcccgttttgacagcgacgtgggagtctaccgtgctgttaccccgctcgggccacctgacgctgaatactggaattctcagaaagaagttctggagcggaccagagcagaactcgataccgtctgtcgccacaactatcagcttgaattgaggacgactctgcagcgcagagttgaacccactgtgaccatctcccctagtcggacagaggcactcaatcaccacaaccttcttgtgtgtagtgttactgacttctatcctgcgcaaattaaggtcagatggtttaggaacgaccaggaggagaccaccggggtggtttcgactcccctgattagaaacggggattggacattccaaattctcgtcatgctggagatgactccacagcggggtgatgtctacacttgtcacgtggagcatccttccctgcaaaatcctataattgtggaatggcgtgcccagagcgaaagcgcccagagcaagatgctgtcagggatcgggggttttgttctggggcttatctttctggggctcggactgattatccatcaccgctcccagaaggggctgctgcattag

SEQ ID NO: 229400 - DNA, 786 bp, Artificial Sequence
  Description of Artificial Sequence: Synthetic coding sequence
atgtcgtggaaaaaggctctgcgcattcccggagggttgcgagcagccaccgtgactttgatgctcagtatgttgagcacaccggtggctgaggggagggactccccagaagacttcgtgtatcagttcaagggaatgtgttacttcaccaatggcacggagcgtgtgcgcctcgtaagccgcagcatttataatcgcgaagagattgtgcggttcgatagcgacgtgggggagtttcgcgcagtaaccctcctgggactccccgctgccgaatactggaactcgcagaaggacattctcgagcgcaagagagcagcagttgacagggtgtgtaggcacaattaccaactggagctgcgcaccacactgcagcggagggtagagcccaccgtaactatcagtccttccaggacagaggccctgaaccatcacaatctcctcgtttgctccgttacggacttctatccagctcagattaaggtcagatggtttagaaacgggcaggaagagaccgccggagtggtgtctaccccgcttatccgaaacggcgactggacattccagatcctcgtgatgttggaaatgactccccaacggggtgacgtgtatacatgccacgtcgagcatccatccctgcaaagcccaattactgtggaatggagagcccagtcagagagcgcgcagtccaaaatgttgagcggcattggcggtttcgttctcggcctcatttttctaggcctggggcttatcatccaccatcgtagccagaagggcctcctgcactag

SEQ ID NO: 229401 - DNA, 810 bp, Artificial Sequence
  Description of Artificial Sequence: Synthetic coding sequence
atgtcctggaaaaaggcactgagaattccgggtggactccgagccgctacagtaactctgatgctgagcatgctcagcacccccgttgccgaaggtagggacagtcccgaggatttcgtgtatcaattcaaaggtatgtgttactttaccaatggaacagaaagggtgaggcttgtgtctaggtccatttacaatagggaggaaatagtgcgctttgattctgacgtaggggaattccgagctgtgacactgctggggttacccgctgctgagtattggaattcgcagaaggatatattggagcgcaagcgcgcagcggttgaccgcgtgtgccgccacaactaccagctggagctccgaacaacgctacagagacgagtagagcctactgtgaccatctctccgagtcgcaccgaagctctgaaccaccacaatctgttagtgtgcagcgtgactgacttctaccccgcacagatcaaggtgaggtggtttagaaatggacaggaagaaaccgccggagttgttagcacacctctgattcggaacggcgactggactttccagattcttgtgatgctcgagatgactccgcaaagaggggatgtttacacctgccatgtcgagcacccttcgctgcagagtcctataaccgtggaatggcgcgctcagagtgaatccgcccagagcaaaatgttgagcggcattgggggattcgttctgggcctcatctttttgggtttgggcttaataatacatcaccggtctcagaaaggtccacagggtcctccaccggcaggccttctgcattag

SEQ ID NO: 229402 - DNA, 786 bp, Artificial Sequence
  Description of Artificial Sequence: Synthetic coding sequence
atgagttggaagaaggcacttagaattccgggtgggctcagagttgccacagttacattgatgctggctatgctgagcaccccggtggcggaagggagagactccccagaggacttcgtctaccaattcaagggaatgtgttacttcaccaacggaacagaaagggtgcgtctggtgacacggtatatctacaacagggaagaatacgccagattcgatagtgacgtcggagtatacagggcagtcactccactcggccctccggacgctgagtactggaatagccagaaggaagtgcttgagagaacaagggctgaactggataccgtatgtagacacaactaccagctcgaactgcgtaccaccctgcagaggcgagtggaaccaacagttactatatcgccgtctcgaaccgaggccttaaaccatcacaacctcctcgtgtgttcagttaccgatttctatcccgctcaaattaaggtgagatggtttcgtaatgatcaggaggagacaaccggagtcgtgagtacgccactcattcggaatggcgattggaccttccaaatcttagtgatgctggaaatgactccacagcgaggcgacgtatatacctgtcacgtagagcatccgtcactgcagaatcctatcattgtagaatggcgcgcacagtccgagagtgcacagagcaaaatgctgtctggcatcggaggcttcgttttgggtttaatcttcctgggccttgggctgataatccatcaccgatcccaaaaaggtcttttgcattag

SEQ ID NO: 229403 - DNA, 675 bp, Artificial Sequence
  Description of Artificial Sequence: Synthetic coding sequence
atgtcctggaagaaagcccttcggattccaggaggcctccgggcagctacagtgaccctcatgctcgcaatgctcagcacccccgttgcagagggcagggacagtccagaggactttgtgtatcagtttaaagcgatgtgttattttacaaatggcaccgaaagagttcggtatgtgacacgctacatctacaatcgagaggagtacgctcggtttgacagcgacgtggaagtgtatagggcggttacacccctcggtccgccagacgcagagtattggaactcccagaaggaggtgctggagagaaccagagcggagctggacacagtgtgcagacacaattaccagttggagctgcgcaccactctacagaggcgagtcgagccgacggtgactataagcccaagccgaaccgaagcactgaaccatcataacttactggtttgttccgtgacagatttttatccagcccagatcaaagtcagatggttcagaaacgatcaggaagagacgactggggtagtcagtaccccactgattagaaatggggactggacctttcagatcctggtaatgctcgagatgactccacagcacggagatgtgtatacctgtcatgtggagcacccatcgctacaaaatccaatcaccgtggaatggagattactccactag

SEQ ID NO: 229404 - DNA, 786 bp, Artificial Sequence
  Description of Artificial Sequence: Synthetic coding sequence
atgagctggaagaaagcgctgcgcattccaggtggattgagggcagccactgtcacccttatgttgtccatgttaagtacccccgtcgccgaaggcagggactctccggaggactttgtgtatcagtttaaggggatgtgctattttactaacgggactgagcgcgtccgcttggtgagccggtccatatataatagggaagaaatagtacggtttgatagtgatgtcggagaatttagggcagtaacccttctagggcttcccgctgccgagtactggaactcccagaaggacatcttggaacgtaagagggcggcagtggatagggtgtgtagacacaactatcaactcgaattgagaacaaccctgcagagacgggtagagcccacggtgacgatctcacccagtaggactgaggccctaaaccatcacaacctgcttgtatgctctgtgacagatttttatccagcccagataaaagttaggtggtttcgcaatggccaggaagagaccgccggagttgtctcgacacctctcattagaaacggggactggactttccaaatcctggttatgttagagatgactccccagagaggggatgtgtacacgtgtcacgtagagcatccctctctgcagtctccaatcaccgtggagtggcgggcacagagtgaaagcgcgcagagcaagatgctctctggtatcggtggattcgtgctcgggctgatatttctgggcctggggctgatcatacatcatcggtcgcaaaaggggctcctccactag

SEQ ID NO: 229405 - DNA, 405 bp, Artificial Sequence
  Description of Artificial Sequence: Synthetic coding sequence
atgagttggaagaaggcgctgaggatcccgggtggtctaagagctgccacggtgacgctgatgctgagtatgttatctactcctgttgccgaaggcagagatagtccggtggagcctaccgttacgatctcacctagtagaacagaggctctgaatcatcataatctgctggtctgttccgtgaccgatttctatccagcccaaatcaaagtccgctggtttaggaatgggcaagaggagaccgccggagtggtgtccaccccgttaattcgcaatggagattggacttttcagattctagtgatgctcgaaatgactcctcagaggggggacgtctacacctgtcacgtggaacatccttcactgcagtctccgattactgtggagtggagattgctgcactag

SEQ ID NO: 229406 - DNA, 405 bp, Artificial Sequence
  Description of Artificial Sequence: Synthetic coding sequence
atgagctggaaaaaggctctcagaatccccggaggccttcgcgtcgcgactgtgactttaatgttagcaatgttgagtacccccgtggccgaggggagagatagccccgttgagccaacagtcacaatctcgccctctaggactgaggctctgaatcaccataatctcctggtgtgtagtgtgaccgacttttacccggctcaaatcaaagtgaggtggtttcgtaacgaccaagaggagacaacaggcgttgtgtcaacacctctgattaggaatggtgactggacgtttcaaatcctcgtcatgctggagatgaccccccagagaggcgatgtgtatacctgtcatgttgagcatccttcccttcagaaccctattatagtagagtggagactcttgcactag

SEQ ID NO: 229407 - DNA, 435 bp, Artificial Sequence
  Description of Artificial Sequence: Synthetic coding sequence
atgtcttggaaaaaagcattgagaattcccggtggcctgcgcgtagcaaccgttacccctcttgggcctcctgatgctgagtactggaacagtcaaaaggaggtattggaaagaaccagggccgagctggacaccgtgtgcaggcacaactaccagttggaactgagaaccaccctccagagaagagtggagccaacggttaccatcagcccctccaggaccgaagccttgaaccatcataatttactcgtttgttctgtgactgatttttatcctgcccaaattaaagttcgctggtttagaaatgaccaggaggaaactactggggtagtgtccacccctctaattaggaacggggactggactttccaaattttagtgatgctcgagatgaccccacagagaggcgatgtgtacacttgtcacgtggaatag

SEQ ID NO: 229408 - DNA, 405 bp, Artificial Sequence
  Description of Artificial Sequence: Synthetic coding sequence
atgtcttggaagaaggccctgcgcattcctggaggcttgcgcgctgccaccgtgactctgatgctcgccatgctgtcaacacctgtggccgagggaagggatagtcctgtggagccaacagttactattagcccatccaggaccgaagcgcttaatcatcacaacctgctcgtgtgttccgtcactgacttttatccagcccagatcaaggtgcgatggtttcggaacgaccaggaagaaacgactggagtcgtgtcaaccccgctcatcagaaacggggactggacattccaaattctcgtcatgttagagatgaccccccagcacggagacgtttacacctgccatgtagaacatccctctctccagaaccccatcacggtggagtggcggcttctccattag

SEQ ID NO: 229409 - DNA, 786 bp, Artificial Sequence
  Description of Artificial Sequence: Synthetic coding sequence
atgagctggaaaaaagccctccgtataccaggggaccttagggtggctacagtgacattaatgctggcgatgttgagctcactcttagcggaaggcagggacagcccagaggattttgtatttcagttcaagggcatgtgctactttactaacgggactgaacgggttcggctggtcactcggtatatatataatcgagaggagtacgcgagatttgatagtgacgtgggagtgtatcgcgcagttacaccccagggaaggcctgatgccgaatactggaatagtcagaaagaagtccttgaaggtacacgggctgaactggacacggtgtgccgacacaattatgaagtagcctttcgaggcatactccagaggcgggtagagcccacagtgacaatttcgccaagtcgcacagaggcactgaaccatcataatctgctagtgtgctctgtgacagacttctaccctgggcagataaaagtccggtggttcagaaacgatcaggaggagactgccggagtagtctccacacctttgattagaaatggggactggacatttcagattctagttatgctggaaatgacgccccagagaggagatgtctatacttgccacgtagagcaccctagcctccaatcaccaatcactgttgagtggcgcgcacagtccgaatccgctcagagcaagatgctaagtggagtgggcggattcgttctgggcctgatctttttaggcctaggcctgatcatccggcagcggtctcaaaaagggctgctccattag

SEQ ID NO: 229410 - DNA, 675 bp, Artificial Sequence
  Description of Artificial Sequence: Synthetic coding sequence
atgagttggaaaaaggccctgcgaatacccggtgggctcagagtcgcaacggttacgctgatgcttgccatgctcagcacgcctgtggccgaagggcgagattctcctgaagattttgtgtaccagttcaaagggatgtgctattttactaacggcactgaacgcgtgaggctggtgaccaggtatatctataatagggaggaatacgctcgttttgactccgatgtgggagtctaccgggctgtcacacccctaggcccacccgatgcagaatactggaatagccagaaggaggtgctcgaaagaaccagagccgagctggataccgtttgtaggcataattatcaactcgagctgagaactactcttcaacgccgagtggaaccaactgtgacgatcagcccctcacgaacagaggccctgaatcaccataacttattagtgtgctcagtgacagatttctatcctgcacagatcaaagttaggtggttccgcaacgatcaggaggaaaccaccggggtcgtttccaccccgctgataaggaacggagactggacctttcaaatcctggtaatgctggaaatgaccccacaacgaggggatgtttatacgtgccacgtggagcaccccagcttgcagaacccaataattgtggagtggaggcttctgcactag

SEQ ID NO: 229411 - DNA, 435 bp, Artificial Sequence
  Description of Artificial Sequence: Synthetic coding sequence
atgagttggaagaaggctttgcgcattccgggtgatctccgtgttgctactgtgaccccgcaggggaggcccgatgcggaatactggaattctcagaaggaggttctggaaggtacccgcgcagaattggatacggtctgccgccacaactatgaggtagcattccgtggtatactgcagagacgggtagagcctaccgtgaccatcagcccatccagaacagaggccctgaaccaccacaacctgcttgtgtgctccgtaacagatttttatcccggtcaaattaaggttcgatggtttcggaatgaccaggaagagacggccggtgtcgtttccaccccactcatcagaaacggagattggacttttcagattctggtgatgctcgagatgaccccacagcgcggagatgtctatacttgtcatgtagagtag

SEQ ID NO: 229412 - DNA, 435 bp, Artificial Sequence
  Description of Artificial Sequence: Synthetic coding sequence
atgtcctggaagaaggcactgcgaataccaggcggattgcgggctgcgactgtaactctgctgggactcccagctgccgaatattggaattcacagaaggacatcctggagcggaaacgtgcagctgtggatagggtttgtcggcacaattatcagctcgagctaagaactacactgcagaggcgcgtggaaccaacggtgactatcagcccatctaggaccgaagctctaaatcaccataatctcctcgtgtgctccgtaaccgatttctatccggcacaaatcaaggtcagatggtttcgaaatgggcaggaagaaacagccggagtggtatccactccgctcatcaggaacggggactggacctttcagatcctcgtgatgcttgagatgaccccccagagaggggacgtgtacacttgtcatgtcgagtag

SEQ ID NO: 229413 - DNA, 435 bp, Artificial Sequence
  Description of Artificial Sequence: Synthetic coding sequence
atgtcttggaagaaggcactccgaattcccggaggcttgagggccgctacggtcacacctctgggcccacccgacgcggagtactggaacagccagaaggaggttttggaacggactagggctgaattagacaccgtctgtagacataactatcagttagagttgcgaactaccttacaacgtcgggtggagcctactgttacgatttcgccgagtcggactgaggccttgaaccaccacaacctgctcgtgtgttcagtcacagacttctaccccgcacaaattaaagtacgttggttcaggaacgaccaggaggagactacaggagtggtcagcacccctctcatccggaacggcgattggacattccagattctggtgatgctggaaatgacgccccagcatggcgacgtctatacctgccacgtagagtag

SEQ ID NO: 229414 - DNA, 411 bp, Artificial Sequence
  Description of Artificial Sequence: Synthetic coding sequence
atgagctggaagaaggcccttaggatccccggtggtctgcgggctgccaccgttacgctcatgctgtctatgttgtctacacctgtggcagaggggagggacagcccagaggatttcgtctatcagtttaagggcatgtgttattttaccaacggcaccgagagagtcagattggtctcccggtccatctacaaccgtgaggagattgtgaggttcgactccgacgttggcgagttccgcgcagtcaccctgcttgggctccccgcagccgagtactggaacagccagaaggacatcctggagcggaaacgggctgctgtggacagagtttgccgccacaattaccagctcgagcttagaaccactctccagagaagaggcatggtcacaggcccatctcgcagttggtag

SEQ ID NO: 229415 - DNA, 411 bp, Artificial Sequence
  Description of Artificial Sequence: Synthetic coding sequence
atgtcctggaaaaaggccctccgcattcctggtgggcttcgcgctgcaactgtcaccctcatgttagcgatgctgtcaacacccgtggccgaaggacgcgacagccccgaggattttgtataccaattcaaggccatgtgctattttacaaatgggacagaacgcgtgcgttatgttacaagatacatttacaacagggaggagtatgctagattcgacagcgatgtggaagtctatagggccgtgacccccctcgggccaccagacgccgaatactggaacagccagaaagaagtgctagaacgaacacgcgcagagttggataccgtctgtcgacacaattaccagcttgagctgcgcactactcttcaaaggcgcggaaccgtgacaggaccgtcccgctcatggtag

SEQ ID NO: 229416 - DNA, 411 bp, Artificial Sequence
  Description of Artificial Sequence: Synthetic coding sequence
atgagctggaagaaagctttgaggatccctggcgaccttagagtcgcaaccgttactttgatgctggccatgctctcctctctactggcggaaggtcgtgattcccctgaagatttcgtgtttcagttcaaggggatgtgctactttactaacggaacggagcgagtgcgtttggtgacccgatacatctacaatagagaagaatacgccaggttcgactcagatgtgggggtttatcgagcagtgaccccccaggggaggcccgacgctgaatactggaactctcagaaggaggttctagagggtaccagagcagaactcgataccgtctgcaggcataattacgaggtagcttttcggggaattctgcaaagaagaggtatggtgacaggactctctcgtagctggtag

SEQ ID NO: 229417 - DNA, 717 bp, Artificial Sequence
  Description of Artificial Sequence: Synthetic coding sequence
atgctgtcgacccctgtcgccgagggtcgcgacagccccgaagacttcgtttaccagtttaaaggcatgtgctatttcaccaatggcacagaacgcgtgcggttggtcagcagatctatatataatagagaagagattgtgcgcttcgactctgacgtgggcgaatttagggcagtgactcttttgggactccctgccgcagagtattggaactcgcaaaaagacattcttgaaaggaaaagggctgctgtagacagagtttgtcggcataactatcaacttgagttgagaaccacactgcaacggcgagttgagccaacagttactatttcaccctctaggacagaagcattaaaccaccataatctgctggtatgctcagtcaccgacttctatcccgctcaaatcaaagtgcgttggttccgtaacggacaggaagagactgcaggcgtggtgagcacgccactcatcaggaatggggactggacattccagatcctggttatgctcgaaatgactccccagagaggtgatgtgtacacttgtcatgtggaacatccatcgctgcagagtcccattaccgttgagtggcgagctcagtccgagtccgcccagagcaagatgctaagcggtataggcggattcgtcctgggattgatcttcctgggcctgggcctgataatccaccatagatctcagaagggattactgcactag

SEQ ID NO: 229418 - DNA, 543 bp, Artificial Sequence
  Description of Artificial Sequence: Synthetic coding sequence
atgtgttacttcaccaacggaacggaacgcgtgcggggagtgactaggtacatttataatcgggaggagtatgctcgttttgactccgacgttggcgtctatcgggcagtgacgcccctcggtcccccagccgctgaatactggaactcccagaaagaggttctggagcgcacacgggctgagctcgatactgtgtgtcgccacaattaccagctcgagctgcggacaaccctgcagcggagggttgagcccacggttacgatctcgccatcccgtacggaagctctgaaccatcacaatttgctcgtctgctctgtcacagatttttatccagcacaaatcaaggtaaggtggtttaggaatgaccaggaagaaaccactggcgtcgtatctactcctctgattcggaacggagattggacattccaaatattggttatgctggaaatgactccccagcgtggcgacgtgtacacatgtcatgtggagcaccccagtctgcagaatcccattatcgtggagtggcgcatggatgagttttag

SEQ ID NO: 229419 - DNA, 717 bp, Artificial Sequence
  Description of Artificial Sequence: Synthetic coding sequence
atgttgtcaacccctgtcgccgagggcagggacagccctgaggacttcgtgtaccaatttaaaggaatgtgttatttcacgaatggaaccgagcgcgtgagattggtgtcacgtagcatatataaccgcgaggaaatagtccgtttcgacagtgatgtgggtgaatttcgggcagtgactctactcgggctgccggctgcagagtactggaattcgcagaaagacatactggagcgtaagagggccgcagtcgatagggtttgtcgccataattatcaactggaattgcgaactacattacaaaggcgagtggaacctaccgtgaccatttccccatcaaggaccgaggccctgaatcatcacaatttattagtatgctctgtgactgacttttaccccgcacagatcaaagtgcggtggtttcgcaacgaccaggaggaaactgcaggcgtagtttcaacccccctcatccgaaatggtgactggactttccaaatcctggttatgctggaaatgactccccagcgtggagacgtctacacctgtcatgtcgagcatccctctctccagagcccaatcaccgttgagtggcgagcacagtccgaatcggcccagtcaaaaatgttgtcagggattgggggattcgtgctggggttgattttcctcggcctaggactcatcattcatcaccggtctcagaagggcttgctgcattag

SEQ ID NO: 229420 - DNA, 744 bp, Artificial Sequence
  Description of Artificial Sequence: Synthetic coding sequence
atgttgtccactccagtggcagaaggcagggattcgccagaagacttcgtctaccaattcaaggggatgtgctacttcaccaacgggacagagagagtgagaggcgtaactaggtacatttacaaccgggaggaatacgctcgatttgactcagatgtcggggtgtaccgggcagttaccccccttgggcctccagctgctgaatactggaatagtcaaaaggaggtcttggaacgaacccgggcagagctagatacagtgtgtcggcataattaccaattggagcttagaactacccttcaacggcgagttgagcccactgtcactatcagccctagtagaacggaagcactcaaccaccataatctgctggtatgctcagtgaccgacttttatccggcacagatcaaggtgcgatggtttagaaacgatcaagaagagacaaccggagtggtgagtactcctttgatccgtaatggcgattggacatttcaaattctggtaatgctggagatgaccccccagaggggcgatgtatatacttgccatgttgaacatcccagcctgcaaaatcccatcatcgtggagtggagggcccaatcagaatcagcgcagtctaagatgcttagtggcatcggtggtttcgtccttgggctcatttttttgggcttgggcctgatcattcatcaccgtagccagaaggccctaccccagggaccccctccggctggagatatcagctag

SEQ ID NO: 229421 - DNA, 717 bp, Artificial Sequence
  Description of Artificial Sequence: Synthetic coding sequence
atgctgtcaacacctgtagccgaaggccgagactcccccgaagatttcgtctaccagtttaaaggcatgtgctattttaccaacggaacggagagggtaaggcttgtgagcagaagcatttataaccgtgaagaaatcgttcggtttgattctgatgtcggggaattccgggctgtgaccctgctgggactacccgctgcagaatactggaactcccagaaagatatcctggaacgcaaacgcgctgccgtggacagagtctgccgacacaactaccaactagaactgcgcactaccctccagcggagggttgaacccaccgtcactatttctccttccagaacagaggcccttaatcatcacaacctgctagtgtgtagtgtcactgacttctatcctgcccagattaaagttaggtggttccgtaatgatcaggaggaaaccgccggagtcgtctctactccactgatccgcaatggggactggacattccagatcctcgtgatgctagagatgacgccccagcggggagacgtttacacttgtcatgtcgagcatcctagtctgcagagtcccattacggtggagtggagagcgcagtcagaatctgcacaatccaagatgctctcagggatcggtggcttcgtactggggctgatattcttgggcttggggcttatcatccaccaccgtagtcaaaaaggcctgcttcactag

SEQ ID NO: 229422 - DNA, 801 bp, Artificial Sequence
  Description of Artificial Sequence: Synthetic coding sequence
atggtgtgtctccgccttcctggagggtcttgcatggctgtgctcacagtgacccttatggtgctgagttcccctctcgccctggcaggcgacaccaggccgagattccttgaatattccacctctgaatgccatttctttaatgggacagagcgggttcgctaccttgatcgttacttccataaccaggaggagaacgttcgcttcgactctgacgtgggtgaatttagggcggttacggaactaggtcggccagacgcagagtactggaactcccagaaggacctgttagaacaaaaacggggtagggtggataactactgtcggcacaactatggcgtggtagagagcttcactgtgcagcgcagagtgcacccaaaggtgaccgtttatccaagtaaaacgcaaccactgcaacaccacaatttgctggtatgtagcgtgagtggtttttaccccggttctatcgaggttaggtggtttcgtaatggacaggaagagaagacgggcgtggtaagcaccgggctgatacataatggtgattggacttttcagactctggtcatgctggagacagtgccaaggagcggggaggtatatacatgtcaggtcgagcatccctctgtgacttctccactgacggtagagtggcgcgcacgctcggagagcgcacagtcgaagatgctgtctggagttggcggattcgttctggggctgctgtttctaggggcaggccttttcatctacttccggaaccagaagggtcatagtggcttgcagccgcgaggattcctgtcctag

SEQ ID NO: 229423 - DNA, 801 bp, Artificial Sequence
  Description of Artificial Sequence: Synthetic coding sequence
atggtgtgcctgaagttgcctgggggatcctgcatgactgccttaacagtgaccctgatggtcctctctagcccgctggccttgtcaggggacactcgccctcgatttctctggcagccaaaaagggaatgtcacttcttcaacggcacggagagggtgcggtttttggacaggtatttctacaatcaggaggaatcagtgcgtttcgatagtgatgtgggtgagttcagagcggtaaccgagctcggtagaccggacgccgaatattggaatagccagaaagatatcttggagcaagccagggcggcagtcgacacttactgccgtcacaactacggcgtcgttgagtcgttcaccgtccagagaagagttcaacctaaagtgacggtgtatccttcaaaaacccagcctctacagcatcacaaccttctggtgtgctccgtctctgggttttacccaggcagcatcgaagtgcgatggtttctcaatggacaggaggaaaaggctggcatggtgtcaacggggctcattcagaatggcgattggacgtttcaaacgctggtgatgctcgagaccgttcctcggtccggcgaggtatacacttgccaggtcgaacatccaagtgtgacatcgcctctgaccgttgaatggagggctcggtccgagagtgctcagtctaaaatgctgagtggagtcgggggtttcgtccttggtttgctctttctgggcgcaggccttttcatttacttcaggaatcaaaaaggccatagcggacttcagccaacagggttcctgtcatag

SEQ ID NO: 229424 - DNA, 801 bp, Artificial Sequence
  Description of Artificial Sequence: Synthetic coding sequence
atggtttgtttgcggcttcccggaggctcttgcatggcagttctcaccgtgacactgatggtcctgtctagccctcttgcgctggctggggacactagaccacgcttcctggagtattcaaccagtgaatgccacttcttcaacggcaccgagagggtgagatatctggacaggtatttccacaatcaagaggaaaacgtgcgattcgatagcgatgtgggtgaattcagagcagtaacggagctcggcaggccggacgcagagtattggaactcacagaaggaccttctggagcagaagcgaggcagagtagataactactgtagacacaactacggcgttgtggagagttttaccgtgcagcgtcgcgtgcaccccaaagtgactgtgtacccatccaagacccagcctttacagcaccacaacctcttggtatgctcagtctcaggcttctatcccggttctatagaggtgaggtggttccggaacgggcaagaagagaaaaccggagtggtgagcaccggcttaatccataacggcgattggacattccagactttggtgatgcttgagaccgtgcctagatccggcgaggtgtacacctgccaggtggagcacccttccgtgacatcacccctaaccgtcgagtggcgcgctcggagtgagtctgcccagtcaaagatgctgtccggggtgggcggtttcgtgctggggctgctcttcctgggagctgggctgttcatctacttcaggaatcagaaaggacattccggcctccagcctagaggatttttatcttag

SEQ ID NO: 229425 - DNA, 753 bp, Artificial Sequence
  Description of Artificial Sequence: Synthetic coding sequence
ctgcttaagctgacccgggacttcccccagcgacatgaaaaatatcagagctgggcgggaacctttcatctgtgcctgaagaagaacaagtatccagacagccgctctacctttatcaagcacgcgggaagctatctaaaacgcggtgagtttttgtctatccacactgccatcacatgtttcttcttgcagatttctgccagatttctggaacaggtgaaacatgagtgtcattttttcaatggcacagaaagggtgcgtttcctggatcgatatttttaccaccaggaggagtatgtacgtttcgatagcgatgtgggcgagtatcgggcagtaaccgagcttggacgtcccgatgccgagtactggaacagtcagaaggatctcttggagcagcggagagctgaagttgacacctattgccgccataattatggcgttgtggaaagcttcaccgtgcaacggcgtgtctaccctgaagtcacagtctacccggctaagactcagcccctccagcaccacaatttactggtttgttccgtgaatgggttctatccaggctccatcgaagtgagatggtttaggaatgggcaggaagagaaaactggcgtcgtgtctaccggcctgattcagaacggggattggacatttcaaacactggtcatgctggaaactgtccccaggtccggggaggtgtatacctgccaagtggaacatcccagtctgacttcaccactgactgtagagtggtag

SEQ ID NO: 229426 - DNA, 756 bp, Artificial Sequence
  Description of Artificial Sequence: Synthetic coding sequence
tgactcctgaagctgacgcgggatttccctcagagacacgaaaaataccaatcctgggctggcactttccacttgtgcttgaaaaagaacaagtaccccgattcgcggtctacctttatcaagcacgccggttcctatttaaagcggggtgaatttcttgccatccacacagccataacttgttttttccgccagattagcgcaaggttccttgaatatagcacatctgagtgccatttctttaatggaaccgaaagggtgcggtacctagacagatattttcacaatcaggaggagaacgtgcgcttcgattctgacgtgggggaattcagagctgtgacagagctcgggagaccagacgctgaatactggaactctcaaaaggacctgctggagcagaagcggggtcgggtggataattattgtcgacataattacggagttgtggagtcctttacagtgcagcgtcgcgtgcaccccaaggtaaccgtgtacccatctaaaactcagccactccaacatcacaaccttctggtctgcagcgtgagcgggttttatccaggctctatagaggtgagatggtttagaaacggccaggaggaaaaaactggggtcgtctctacgggtcttatccataatggagattggactttccagacactcgttatgttggaaactgtgcccagaagtggcgaggtgtatacctgccaggtcgagcacccgtctgtgacaagccccctgaccgtggagtggtag

SEQ ID NO: 229427 - DNA, 801 bp, Artificial Sequence
  Description of Artificial Sequence: Synthetic coding sequence
atggtatgcctgaaatttcctggcggatcctgcatggcggctctcaccgtgacgctcatggtacttagttcccccttggccctggccggtgatactcgcccacgattcctggaacaagtaaagcatgagtgtcacttctttaacggcactgagagagtccggtttttagacagatacttttatcaccaggaggagtacgtccgatttgacagcgacgtgggggagtatcgggcagtgaccgaacttggacggcctgacgctgagtattggaattcccagaaagacctgctagaacagagacgcgctgaagtggatacctactgcaggcacaactatggcgtggtcgagtcgtttaccgtgcaacggcgagtgtacccagaggtgaccgtatatcccgcaaaaacgcagccattgcagcatcataatctccttgtttgctctgtcaatgggttttatccaggaagcattgaggtgagatggtttcgaaacggacaggaggagaagacaggcgtcgtcagcactgggttaattcagaatggggattggaccttccagactctggtgatgctagagacagtcccaaggtccggagaggtgtacacatgccaggtggaacacccctcgcttacatcaccgttaacggtggaatggcgggctcgtagcgaatccgcccagtctaagatgctgagtggggtgggcggatttgtgctcgggttgttgtttctgggtgcgggactgttcatctactttaggaaccagaaggggcattcaggactccagcctaccggcttcctgagttag

SEQ ID NO: 229428 - DNA, 756 bp, Artificial Sequence
  Description of Artificial Sequence: Synthetic coding sequence
tgactccttaagctaacgagggactttccacaacgccatgagaaatatcagtcatgggccggaactttccatttatgtttgaagaaaaataagtatcctgatagtcgaagcacattcataaaacacgcagggagttacctcaaacggggagagttcctcgcgatacacacagccattacatgcttttttcgtcagattagcgcacgttttctggagtatagtacatccgagtgccacttttttaacggaacagaacgagttcgatatttggaccggtactttcataaccaggaagagaacgttcgcttcgatagcgacgtgggtgagtttagggccgtcacagagttaggacgccctgacgctgaatactggaacagccaaaaggacctgctggaacagaaaagaggcagggtggacaactactgccggcacaactatggcgtggtggaatccttcaccgttcagcgtcgtgttcatcctaaggttacagtctacccgagcaaaacccagcctttgcagcatcataatcttctggtgtgctccgtgtccggcttctatccaggatcaattgaggttcgttggtttcgcaatggtcaagaagaaaagacaggggtcgtgagcacggggctgattcacaacggggattggaccttccagactctagttatgctggagaccgtaccacgctctggcgaagtgtacacttgtcaggtggagcatccctccgtgaccagtcccctgactgtggagtggtag

SEQ ID NO: 229429 - DNA, 753 bp, Artificial Sequence
  Description of Artificial Sequence: Synthetic coding sequence
taactgctgaaactgacccgggattttccgcaacggcacgaaaagtaccagagctgggctggcaccttccacttgtgtctaaaaaagaacaaatatcctgatagtaggagtactttcatcaaacatgctgggtcatacctgaagcggggagagttcttaagcattcatacagctatcacctgtttttttcttcagatctctgccagattcctatggcagggcaaatacaaatgtcactttttcaacggcacagagagagtgcagttcttggagagactgttttacaatcaagaagagttcgtgagattcgatagtgacgtgggagagtaccgcgcagttaccgaactagggcgaccggtggccgaatcatggaatagccagaaagacattctggaagataggcgcggacaggtcgacaccgtatgccgccataattatggtgtgggagagagttttacagtgcagagacgggttcatcctgaggtgaccgtctacccggcaaagacccagcccctgcagcaccataatctacttgtttgctccgtcagtggattttatccgggttctatcgaggtaaggtggtttagaaatggacaggaagagaaggctggagtggtatcaacggggctgattcagaacggggattggaccttccaaacacttgtaatgctggagacggtgcctcggtcaggcgaggtgtatacatgccaagtcgaacacccctctgtgatgtctcctctcacagtagaatag

SEQ ID NO: 229430 - DNA, 801 bp, Artificial Sequence
  Description of Artificial Sequence: Synthetic coding sequence
atggtgtgtctgaaactgccaggagggtcttgtatggccgcactaaccgttaccctgatggtgctgtcatctccactggcactggccggagacacacaacctcgattcctctggcagggcaagtacaagtgccactttttcaacgggactgagagagttcaattcttagagaggctgttttacaaccaggaggaatttgtacggttcgactctgacgtgggagagtacagggctgtgaccgagttggggagacctgtagccgaatcatggaactcacaaaaagacatcctggaggatcgacggggacaggtagacaccgtgtgtagacacaattatggagtcggggaatccttcactgtccagcgtcgcgtgcacccagaggtcactgtttatcctgctaagactcagcctctacaacaccacaacctgctggtgtgtagtgtgtcaggcttctaccccggatcaatcgaggtgcgctggtttaggaacggccaagaggaaaaggctggggtagtcagcacaggcctgatccaaaatggcgattggactttccagacactggtgatgcttgagacagttccacggtcgggtgaagtatacacctgtcaggttgagcatccatccgtgatgagccctctcaccgtcgaatggcgggctcgatccgagtcagcccagagcaagatgttgtctggcgttggtggttttgtcctgggtctgctttttcttggcgctggcctgttcatctacttccgaaatcagaaaggacattcaggcttgcagccaactggattcctgtcctag

SEQ ID NO: 229431 - DNA, 801 bp, Artificial Sequence
  Description of Artificial Sequence: Synthetic coding sequence
atggtctgcttaaagcttccaggaggctcttgcatggcggctctgactgtgactctcatggttttgtcctcccctctggctctggctggggatacacagccaaggtttctgtggcagggaaagtacaaatgccacttcttcaatggtaccgaacgcgtacagtttctggaacgcctcttctataaccaagaagaattcgtgcggtttgacagcgatgtgggagagtacagagccgtcacagaactcggacgccctgtagccgaatcctggaacagtcagaaagatatcctcgaagatcgcagggggcaggttgatacagtctgtagacacaattacggggtaggggagtcgtttactgttcaacgcagagtccatccagaggtcacagtgtacccagctaagacccagccccttcagcaccacaacctcctggtgtgctccgtgagtgggttctatccgggaagcatcgaggtgcgctggtttcgcaatggccaggaggaaaaagcaggggtcgttagtaccggtctgatccaaaacggtgattggactttccagacgcttgtcatgctggaaaccgttcctcgtagcggtgaggtgtacacatgtcaggtggaacacccaagtgttatgtctccccttactgtagaatggagggcgcgttccgagtccgcccagtcaaaaatgttgtcgggcgtcggcggttttgtgctgggtctcctgtttctgggagcgggtctgttcatctacttccgaaatcagaagggccattccggactccagccgactggctttttgagttag

SEQ ID NO: 229432 - DNA, 810 bp, Artificial Sequence
  Description of Artificial Sequence: Synthetic coding sequence
atgagttggaagaaagcattacggatccctggcggactgcgagtggcgaccgtcaccctgatgcttgctatgctgagcaccccggtggcggaggggagagactctcctgaggatttcgtttatcagtttaaggggatgtgttacttcaccaacggaaccgagcgcgtaaggggcgtgacccgctacatttacaaccgcgaggaatacgctcggtttgacagcgatgtgggtgtgtacagagccgtcacacccctggggccaccagcggctgaatattggaactctcaaaaagaggtcctcgaacgaacacgcgcagaactggacaccgtgtgtaggcataactaccaattggaacttcgcactacactgcaacggagagtctacccagaggtcacagtttaccctgctaagacccagcctttacagcatcacaacctgctcgtctgtagtgtgaatggcttctatcccggaagcatcgaagttcggtggtttaggaacggccaagaggaaaaaacaggagtcgtgagcaccgggctgattcagaacggcgattggacctttcagactcttgtgatgctggagaccgtgccacgctctggcgaggtgtatacatgtcaagtcgaacacccctccctgacctctcctcttaccgtcgagtggagggcccgatccgagagcgcccagagtaagatgttgtctggcgtcgggggatttgtacttggccttcttttcctgggagccggtcttttcatttatttcagaaaccagaagggtcattctggtcttcagcctacaggttttctctcctag

SEQ ID NO: 229433 - DNA, 792 bp, Artificial Sequence
  Description of Artificial Sequence: Synthetic coding sequence
atggtgtgtctgaaattcccagggggaagctgtatggcagccctcaccgttacactgatggtgttatccagtcccttagccctagcgggagatactcggcctaggttcttggaacaggtgaagcacgaatgtcatttctttaacgggaccgaaagggtaagattcctcgaccgttatttttaccatcaggaagagtacgtgaggtttgacagcgacgtcggggaataccgagcagtcacagagttaggcaggccagatgcagagtactggaattcccagaaagacttacttgagcagagacgggctgaagtcgatacctattgtagacataattatggagtagtggagagctttacggtccagaggcgcgtttacccagaagtgaccgtctatccagcgaaaacacagccgttgcagcaccataatctgctcgtctgcagcgttaatggattctaccccggttcaatagaggtgcggtggtttcgcaatggtcaggaagaaaagaccggcgtggtatcaacaggacttattcaaaacggagattggacttttcaaacactcgtaatgttggaaacagtgcctagatccggtgaagtctatacttgccaggttgaacatccatcactcacttcccctttgacagtagagtggcgagccagaagtgaatcagcgcagtctaagatgctctctggcgtcggaggctttgtcctgggactgctgttcctgggcgcagggttatttatctattttcgcaaccagaaagggcacagcggcctgcagccaactgggtag

SEQ ID NO: 229434 - DNA, 141 bp, Artificial Sequence
  Description of Artificial Sequence: Synthetic coding sequence
cactcgggccttcagcctaccgggaatacattctcatcctccctgcgaaatcggttcgggggacaggcccagcacgcctgtaacccatccactctggggggaagaggcggaagaatcatgagaatacctgagctcaagtag

SEQ ID NO: 229435 - DNA, 891 bp, Artificial Sequence
  Description of Artificial Sequence: Synthetic coding sequence
atggtgtgtttgaagttcccgggtgggagctgtatggccgctctgactgtcaccctgatggtgctgagctctccgctggctcttgcaggggatacacggccaagatttctagagcaggtgaagcacgagtgccatttttttaatgggactgaacgagtcaggtttctcgaccgctacttctaccatcaggaggagtacgtgcgcttcgatagtgatgtaggtgaatatagggccgtcaccgaattgggacgtcccgacgccgaatattggaatagccaaaaggatctgctggagcaaagacgggcagaggtggacacgtattgccgacacaattacggcgtggtcgagtcttttaccgtccagcgtagggtataccctgaagtgaccgtttaccccgctaagacacaacccctccagcaccacaacctgctagtctgctctgtgaatggattctacccaggaagcatagaggttcgctggttcagaaacggacaggaggaaaaaactggcgtcgtgagtacaggactaatacaaaatggagattggactttccagactctggtaatgttggaaaccgtccctcggtccggcgaggtctacacatgccaggtggagcacccgtctttgacgtcacctctgactgttgaatggcgagcacgcagcgaatcagcacagtctaagatgctttcgggggtgggaggttttgtcctcggcctcctgtttttaggggctggattgttcatttattttcggaaccagaaaggtcattccgggctccaaccaaccggaaatacatttagctcttctctgcggaaccgctttggaggacaggctcagtggttgaccccagtcattccagctctctgggaggccgaggcgggtgagtcttag

SEQ ID NO: 229436 - DNA, 801 bp, Artificial Sequence
  Description of Artificial Sequence: Synthetic coding sequence
atggtctgtttgaaactgcccggaggatcctcgttggcggcactcactgttacacttatggttctgtcaagtcgcctcgcttttgctggagacactagacccagatttttagagctcttaaaatctgagtgccatttcttcaacggaaccgagagagtgcgctttctagagcgacacttccataaccaggaggagtacgccaggtttgactctgatgtgggggaatatcgggcagtgcgcgagttgggtagacctgacgccgagtattggaacagccagaaggatctgcttgaacagaagaggggtcaggttgacaactactgtcggcataattatggagtgggagaatcttttactgtccagcggcgtgtccaccctcaggtgacagtgtaccccgctaaaacgcagcctctccaacaccataaccttctggtctgttctgtgagcggtttttacccaggtagcatcgaggtgcggtggtttagaaatgggcaggaggaaaaagcaggcgttgtaagcaccgggctgattcagaacggagattggaccttccagacactcgtgatgctcgaaacggttccacgtagcggtgaagtgtacacttgtcaggtggagcaccccagcgtgacgtcacccctgactgtggaatggagcgcaaggtccgagtccgcgcaaagcaagatgctttctggtgttggagggttcgtattaggattactgtttttaggcgcaggcctgtttatttactttcgcaatcaaaagggtcattcgggcctccagccaaccggatttctcagctag

SEQ ID NO: 229437 - DNA, 801 bp, Artificial Sequence
  Description of Artificial Sequence: Synthetic coding sequence
atggtgtgcctgaaattgcccggagggtccagcctggccgctctcactgttaccctgatggttctttccagtcgactggcattcgcaggggatactaggcccaggtttctcgaactccggaaatccgagtgccatttcttcaacggcactgagcgggtgcgttacctcgaccgctacttccacaatcaagaagagttcctgcgatttgacagcgatgtcggggagtatcgggctgtgaccgagctgggtcggcctgttgcggaaagttggaatagccaaaaagacctcctggaacaaaaacgcggacgtgtagataactattgtcgacacaactacggtgtgggcgaatctttcaccgtgcaacgcagagtgcacccgcaggtgacagtgtatccagccaaaacgcagcctttacagcaccataatcttcttgtgtgcagcgtctctgggttctatcctggctcaattgaagtgcgctggttccgcaacggccaggaagagaaggcgggagtggtgagtactggactcatccagaatggtgactggaccttccagaccctggtaatgctggaaactgtccctcgctctggtgaggtatatacgtgccaggtggaacacccgtcagtcacatctgcactgaccgtcgaatggcgcgctagatctgaatcagcacagtccaagatgctctccggggttggcggatttgtgctagggctgctcttcctgggtgcgggtctgtttatttatttccgcaaccagaagggccacagcggccttcaacccactggttttttgagttag

SEQ ID NO: 229438 - DNA, 801 bp, Artificial Sequence
  Description of Artificial Sequence: Synthetic coding sequence
atggtttgtttgaaactgcccggtggatcttccctagcagccttaaccgtcactctaatggtgctctcttctagactcgcatttgcaggcgatacacgaccgcgattcttggagttactcaagtcggaatgtcattttttcaatggcaccgaacgcgtgaggtttctcgagcgccactttcacaaccaggaggaatatgccaggtttgatagtgatgttggtgagtatcgcgcagtgagagagcttggtaggcccgacgctgaatactggaactcgcagaaagatttactagagcagaagcggggtcaggtcgacaattactgtcgtcacaactacggtgtcggggaatcttttacagtccagcgcagggtgcacccacaagtaaccgtgtatccagcaaagacccagcctcttcagcatcataacctgctggtatgcagcgtgtcaggcttctatcctgggtccattgaggtgcgctggtttaggaatgggcaggaggagaaggctggagtcgtctcaacaggcctaatccagaatggcgattggacctttcagacactcgtgatgttggaaaccgtgcccaggagcggggaggtgtacacctgccaggttgagcaccccagcgttacctctccactgactgtcgaatggagcgcccgttcagagagtgcccagtcgaagatgctctcaggagtcggaggattcgtcttgggtcttttgtttcttggcgcaggcttattcatctatttcagaaaccagaagggccactctggccttcagcctaccggcttcctgagttag

SEQ ID NO: 229439 - DNA, 801 bp, Artificial Sequence
  Description of Artificial Sequence: Synthetic coding sequence
atggtgtgtcttaaattacccggaggatcttacatggccaagcttacagtgactttaatggtcctgtctagtcccttagcactggcaggggacacccgaccgcgattccttcagcaggataaatatgaatgtcatttctttaacggcacagagagggtccggttcctgcaccgagatatttacaaccaggaggaggacctgaggtttgacagtgacgttggtgagtatagagccgtgactgagctcggtaggccagacgcagagtattggaattctcaaaaagattttcttgaagatcggagagctgctgtggatacgtactgccggcataactatggtgttggcgagtctttcacagtccagcgcagagtggaaccaaaggtgactgtgtacccggcacgtacgcagacgttgcaacatcacaacttgctggtgtgcagcgtgaatggattctatccaggaagcatcgaagtcaggtggttccgcaactcccaagaggagaaagccggtgtagtgagtactggccttattcagaacggcgattggacttttcagacgttagtgatgcttgaaaccgttcctaggtcgggagaagtgtacacatgccaggtggagcatccatctgtcactagtccactgaccgtggaatggcgcgctcagagtgagtcagcccaatccaaaatgttgagcggcgtcggcggatttgtgctagggttgctcttcttgggggctgggttgttcatttacttcaagaatcagaaagggcactctgggctgcaccctaccggcctagtgtcgtag

SEQ ID NO: 229440 - DNA, 891 bp, Artificial Sequence
  Description of Artificial Sequence: Synthetic coding sequence
atgggagagttaatggcctttctgctgccattgatcatcgtgctcatggtaaaacactccgactctaggacacactctctgcggtacttcagattaggggtcagcgatcccatccacggggtaccagagtttatttccgtaggttacgttgattcacacccgatcaccacatacgactctgtcacccgccagaaggaaccaagagctccctggatggcagaaaatttggcacctgatcactgggagcgctacacccaactcctgcgaggctggcagcagatgttcaaagtggagctcaagcgactgcaaagacactataatcattctgataacgtcgcccacaccattaaacaggcatgggaggctaatcaacacgagctcctgtaccagaagaattggcttgaagaggagtgtattgcttggctgaaaaggttcttagagtatgggaaggatacgctgcagcgtaccgaaccacccttggttcgtgtgaatagaaaagagacctttccaggcgtgacagccctgttttgcaaagctcacggattctatccaccagagatctatatgacttggatgaagaacggggaagagattgtgcaagaaatagattatggggatattcttccgagtggggacgggacgtaccaagcctgggctagtatagagttggaccctcaaagctccaatttatacagttgtcacgttgagcactgtggtgtgcacatggttcttcaagtcccgcaggaatccgagacgatccctctggtcatgaaggccgtgagcggatcaattgtcttagtaattgttctagctggggtgggagtgctcgtgtggcgcaggagaccacgcgaacagaatggtgcaatttatttacccacgcccgatcggtag

SEQ ID NO: 229441 - DNA, 1026 bp, Artificial Sequence
  Description of Artificial Sequence: Synthetic coding sequence
atgggagaactcatggcatttctgttgccattaatcatagtgcttatggtgaagcactccgattcacgcacccactccctacgttactttaggcttggggttagcgatcccatccatggcgtacctgagttcatatctgttggctacgttgactcacaccccattaccacgtatgactccgtaaccaggcaaaaggagccacgggctccttggatggcagaaaacctggctccagatcactgggaacgctacactcaattgttgcgcggatggcaacagatgttcaaagtagagctgaaacgtttgcagaggcattataaccatagtggctctcatacctaccagcgaatgattggatgcgagctccttgaggatggaagcaccaccgggttccttcagtacgcctacgatgggcaggacttcctgatatttaacaaggacaccctttcatggcttgcggtggacaatgtggctcacactataaagcaggcctgggaggctaaccagcatgagttgctgtatcagaagaactggctagaggaagagtgtatcgcatggctaaaacgcttcctggagtacgggaaggatactttgcagcggaccgaacctcctcttgtgcgcgtgaaccgaaaagagacattccctggcgtcaccgctctgttctgcaaagctcacggtttttatccacctgagatctacatgacctggatgaagaatggagaagagattgtacaagagatcgattacggggacatccttcctagcggcgatggcacctaccaggcctgggcatcaattgaattggacccccagtcctctaatttatacagttgccatgttgagcactgcggagtgcacatggtgctccaagtgcctcaggaaagcgagaccatccccctggttatgaaagccgtaagtggcagcatcgtgcttgtcattgtgctggccggagttggagtgctagtctggaggcgcaggcccagggagcaaaatggagctatctacctacctacacccgaccgttag

SEQ ID NO: 229442 - DNA, 645 bp, Artificial Sequence
  Description of Artificial Sequence: Synthetic coding sequence
atgggggagctcatggcctttcttctgcctttaattattgtgctgatggttaagcactctgactcacgtacacactcccttcgctacttccgccttggagtctcggatcccattcatggggtgccagaatttataagtgtcgggtacgtcgactctcatcctattacaacttacgactctgttacgagacagaaggaaccaagggcaccgtggatggcagagaatctggcgccagatcattgggagcgctatacgcaacttctgcgagggtggcagcagatgtttaaagtggaattaaagcgcttgcagagacattataaccacagcggcagccacacttatcagcggatgattggctgtgaacttctagaggacggaagcaccaccggatttctgcagtacgcatacgatggccaggattttctaatcttcaacaaggacacactttcatggctggctgtggacaacgtcgctcacacgattaagcaggcatgggaggctaatcaacatgagctcctgtaccaaaagaattggctggaggaggagtgcattgcgtggttgaagaggtttctcgagtatggtaaagataccctgcagaggaccgagcagaacggggctatctacctgcccacccctgacaggtag

SEQ ID NO: 229443 - DNA, 792 bp, Artificial Sequence
  Description of Artificial Sequence: Synthetic coding sequence
atgtgggaacttcgcagcgccagtttttggagagccatcttcgcagaattcttcgccaccctgttctacgtgttcttcggactaggatcctcccttaggtgggcccctggaccgttacacgtgttacaggtagccatggcatttggcctcgcactggctacgttggtccagtccgtcggccatatctcaggcgcacacgtcaatccggcagtgacgttcgcctttctggtgggatctcaaatgtccctgctcagagccttctgctacatggctgctcagttactaggggcagtggcaggtgccgctgtcctgtatagcgtcacccctcccgcagttaggggcaacttagccctcaacaccctccacccagccgtgagtgtggggcaggccacaacagtggaaatcttcctaaccctgcaatttgtgctctgcattttcgcgacgtacgatgaacgccgaaatggccagctggggagtgtggccctcgccgtcggcttcagcctagccctgggacacctcttcggtatgtactataccggagctggtatgaaccccgcaaggagcttcgccccagcaattctgactggtaactttactaaccactgggtatattgggtgggaccaattatcggcggaggactgggttcactgctgtatgattttttgttgtttccaagactcaagtcaatttccgaacgcctttccgttttgaaaggcgctaagccagatgtcagcaatggacagcctgaggtcaccggcgaaccagttgagctgaacacgcaggctctgtag

SEQ ID NO: 229444 - DNA, 2682 bp, Artificial Sequence
  Description of Artificial Sequence: Synthetic coding sequence
atggcaacagaggagtttatcattcggatccctccctatcactatattcacgtcttggatcaaaactcaaacgtgtctcgagtggaggtcgggcctaagacctatattcggcaagacaacgaaagggtgctctttgcaccaatgcggatggtcacagtgccacctagacactactgtaccgtcgcaaatccagtgagtcgggacgcccaggggctagtcctgttcgacgtgacggggcaagttaggttacgccacgcagacctggagataagattagcacaggatcctttccctctttatcctggagaggttttggagaaggacatcacgcctctccaggtggtactgcccaatacagcgttgcatctgaaggccctcctggactttgaggacaaggatggcgataaggttgtagccggtgacgaatggctctttgagggcccagggacatatatcccaaggaaggaagtcgaggtggttgagatcatacaggctaccataattcgccagaaccaggctctgcgactcagggctcgtaaggagtgctgggacagggatggtaaggagcgggtcacaggtgaagagtggctggttaccacggtgggggcttatctccccgctgtatttgaggaggtcctcgatcttgtcgacgccgtgattttgaccgaaaagactgctttgcacttgcgggcaaggcggaacttccgcgacttcaggggcgttagcagaagaaccggagaagaatggcttgtgacggtccaagataccgaagcccatgtgcctgacgtgcacgaggaggtcctcggagtggtgcctatcactacactcgggccacacaactactgcgtgattctcgatcccgttggtcccgatggcaagaaccagttaggacaaaaacgcgtggtaaagggagagaagagcttttttttgcagccaggcgagcagttggagcaagggattcaagacgtttatgtgttgtctgaacagcagggtctgctgttgagggcactgcaaccactggaagaaggggaagatgaagagaaggtttcccaccaggctggcgaccattggctgatcagagggcctctcgaatacgtgccctccgccaaggtggaagtggtggaagaaagacaagccataccactagacgaaaacgagggaatttacgtgcaggacgtcaagactggcaaggtaagggccgtgatcggatcaacttatatgttaactcaggacgaggtcctctgggagaaggagctgccccctggcgtcgaggagttgctgaataaaggccaggaccctctcgcagatcgcggtgaaaaggacacggctaagagcctgcagcctttggcccctagaaacaagacccgggttgttagctatcgcgttcctcataatgccgctgttcaggtgtacgattatagggaaaaacgcgctcgagtcgtttttggccctgagcttgtatcgctgggccctgaagagcagtttaccgtcctcagcctttccgcaggaaggcccaaaaggccccacgcccgtagagccctctgcctactgctgggcccagactttttcacagacgtcattaccatcgaaactgccgatcacgcccgtctgcagctgcaattggcatacaactggcactttgaggtgaacgacagaaaggacccccaggaaacagcaaaactattctccgtgcccgacttcgtgggcgatgcatgtaaagccattgcgtctagagtaaggggggcagttgcaagcgtgaccttcgacgatttccacaagaattccgcccgaatcatcagaacggccgtgtttgggttcgagacctctgaagctaaaggtccagacggaatggcactacccaggcctcgagaccaggctgtttttccacagaatgggctcgtggtgagcagcgtcgatgtgcagtccgtggaacctgtcgaccagaggactagagatgcgctacagcgtagcgtacaattggctatagagattacaactaatagtcaggaagccgctgcaaaacacgaggcccagcgcttagaacaggaggctcggggaagacttgaacgacaaaagatactggaccagagcgaggctgaaaaagccaggaaggaactgctagagctcgaagccctaagcatggccgtggaaagcaccggaaccgctaaagcggaggccgagtcgagggcggaagctgctcgcattgagggggaagggagcgtgctgcaagccaaattgaaggcccaggccctggcgatagagacagaagccgagcttcagagggtgcagaaagttcgggaattagaactggtttatgctagggcccaactggagctcgaagttagcaaggctcagcaactggctgaagtagaagtgaaaaaatttaagcagatgactgaagctattggaccctctacaatcagggatcttgccgtggctggccctgaaatgcaggtgaaattgttgcaatcgctggggctcaaaagcacgctcatcaccgatggatctacaccaatcaatctgtttaatacagccttcgggctgcttggcatgggcccagaagggcagcctctgggaagacgggtggcaagcggtccgtcacccggagagggcattagcccacagtcagcgcaagcgccacaggctcctggcgacaaccacgtcgttcccgttctgcgctag

SEQ ID NO: 229445 - DNA, 2682 bp, Artificial Sequence
  Description of Artificial Sequence: Synthetic coding sequence
atggccacagaagagtttattattcggatccccccttaccactatattcacgtgttggatcagaactctaacgttagtcgcgtggaggtggggccaaagacatatatcagacaggataatgagagggtgctgttcgccccaatgcggatggtcacagtgcctcctagacactactgcacagtagcaaaccctgtctctagggatgctcagggcctggtcctctttgatgtgacggggcaggtaagactgaggcacgccgatctcgagatcaggttggcccaggacccctttcccctgtacccaggggaagttttagagaaagatataacccctctccaggtggtactacccaacaccgcccttcacctcaaggccctcttggacttcgaagataaagacggagataaagtggtggcaggcgacgagtggctatttgaggggccaggaacctacatcccaagaaaagaggtcgaagtagttgagatcatccaggccactatcattcggcagaatcaggcgttgcggctgcgcgcacggaaggaatgttgggaccgtgacgggaaggagcgtgtgactggcgaagaatggctggttaccacagtgggagcctatctgccagccgtgttcgaggaggtgctggatctggtagacgctgtaatccttactgaaaaaactgctcttcaccttagggctcggcgaaactttcgagacttccgcggagtttctagaagaacaggcgaagagtggctcgtaactgttcaagatactgaggcccatgtgcccgatgttcacgaagaggtgctgggcgtagtcccgatcactacattaggaccacataattattgcgtgatcctggaccctgtaggacccgacggaaagaaccagcttgggcagaagcgggttgtcaagggagagaaaagcttcttcctccaacccggtgagcagctagaacagggaattcaagatgtgtatgtgctgagcgagcagcaaggcctcctcttgagagctcttcaaccccttgaagaaggcgaagatgaggaaaaggttagtcaccaagccggagatcactggcttatccggggtccgctggaatatgttccttccgcaaaggtggaagtggtggaagagcgtcaggccattcccctggacgaaaatgaaggcatctatgtccaggacgttaaaaccggaaaagtgagagccgtgatcggtagcacctacatgttaacccaagacgaagttctgtgggagaaagagctcccgccaggtgtggaagaactgctaaacaaaggtcaggatcccctagctgaccggggtgagaaagacaccgccaaatcactgcaacctttggcaccccgtaacaagactcgggtcgtgagctacagagttccacataatgccgcagttcaagtgtacgactatagagaaaagcgtgccagggtggttttcggccctgaactggtgtctctaggtcccgaggagcaattcacagtgctctctcttagtgccggtagaccaaaacgtcctcatgcgagacgcgcactttgtctgctgttggggcctgacttcttcacagatgtgatcaccatcgaaacggccgatcatgcacgccttcagttgcaactcgcctacaattggcattttgaggttaacgatagaaaagaccctcaggaaaccgctaagttgttcagtgtgcctgactttgtcggagacgcgtgcaaagccatcgccagtagagtgcgtggcgctgtcgcttccgtaaccttcgatgatttccataaaaattctgctaggatcatccgcaccgcagtctttggatttgagacaagcgaagccaaggggcctgacggtatggcgctccctagaccaagagatcaggctgtgttcccccagaatggattggtagtgtccagtgtggatgttcagtccgtcgagcctgtggatcagaggactcgcgacgccctgcagagaagcgtgcagctcgcaattgaaataaccaccaactcccaggaggccgctgctaaacatgaggctcagcggctcgaacaggaggcaaggggcaggcttgagaggcagaagattctagaccagtctgaagcagaaaaagctcggaaggaacttctggaattggaggctctgtcaatggccgttgaatctacaggcaccgctaaagccgaggcagagtcccgtgccgaggccgcaaggatcgaaggggagggctccgtcttacaggctaaactaaaggcccaagctctagctatagagactgaagctgagctacagcgcgtgcagaaagtccgggagctggagttggtctatgcccgagctcagctcgagctcgaggtgagcaaagctcaacagctggcggaggtggaagtgaaaaagtttaagcagatgaccgaagcaattgggccatctactattagggaccttgcggttgctggacctgaaatgcaggttaagcttctacaatctttgggactcaaatccaccctcatcaccgacggatccacaccaataaatttgttcaatacggcctttggactgctaggaatgggacctgaggggcagccgctcggtagacgtgtcgcctcaggcccttccccaggggagggcatctctccccagtcagcccaggctccccaggctcctggcgataatcacgtcgtgccggtcctgcgctag

SEQ ID NO: 229446 - DNA, 480 bp, Artificial Sequence
  Description of Artificial Sequence: Synthetic coding sequence
atgtgttggacccgaacagctacatgcccagtgtggcgcagcggtcagcgcccaacgagtggacgcacaatgcgaggcagcggtttcgggggacggcgtcacccgtatggcaaggattcaccagcccctccaggttctgctgagcttcctggtttgcagggatccgtaccaccgcactgggggggagttgctggaaacagcgccggacatcggggtccacgcgctcgctgccctagggggggagccggaggctgcgcccaccaccaccctgggcctcctcagcttctccgtgatagtcggccatgtagaacaggttggcaggagagcgcaggcgcagaggctaggggccagggaagggaagttttcttcccccctgccaggcgcgcagcgggtacgaggcatcccggttgtgtttgcgcagtgggagccgctggggcagccgctgaaggccctgcggcacccggaggcggaggcggatag

SEQ ID NO: 229447 - DNA, 1251 bp, Artificial Sequence
  Description of Artificial Sequence: Synthetic coding sequence
atgtcaactaaacagatcacatgccgctatttcatgcacggagtctgtagagagggtagccagtgtcttttctcccatgacttagctaacagcaagccgtcgactatttgcaagtactatcagaagggctattgtgcttacggtactaggtgcagatatgatcatacacggccttcagctgcagctggaggcgctgttggcactatggcccattctgtgccatcgcccgcattccacagcccccaccccccaagtgaggtgaccgccagcattgtcaagaccaactcccacgagcctggcaagagggagaagcggactctcgtcctccgagatcgcaacctctccgggatggcagaacgaaaaacacagcccagcatggtctccaatccaggatcttgcagtgacccacagcctagtccagaaatgaagccacacagctacttagatgccatccggtctgggttagacgatgtggaggcctcaagctcttattctaacgagcagcaactgtgtccctacgccgctgccggagaatgcaggtttggtgacgcgtgtgtgtatctgcatggagaggtgtgcgaaatttgccggcttcaggtcctgcatccattcgatcccgagcaacgcaaagcccatgaaaagatctgcatgttgaccttcgaacacgagatggagaaagcatttgccttccaagcaagtcaggacaaggtgtgctccatctgcatggaggtgatcctagagaaggcctcggcatctgagaggcgctttggtatactaagtaattgcaaccacacgtactgtctgtcctgcatcagacaatggcggtgcgctaaacagttcgaaaatcctattataaaaagctgccccgagtgtcgagttatctccgagttcgtgatcccctcagtgtactgggtcgaggatcagaataaaaagaacgagcttattgaggcttttaagcagggaatgggtaaaaaggcctgtaagtactttgagcaggggaagggtacttgtcctttcgggtccaaatgtctgtacagacacgcttaccctgatgggaggctggcagaacccgagaaaccaaggaagcaactgtccagtcagggaactgttcgattctttaatagcgtaagactgtgggacttcattgaaaaccgtgaatcaagacacgtccccaataacgaagacgtggacatgactgagttgggggatctgttcatgcacctttccggagtggaaagcagcgagccctag

SEQ ID NO: 229448 - DNA, 1524 bp, Artificial Sequence
  Description of Artificial Sequence: Synthetic coding sequence
atggaggaaccagctgcgccttctgaagcacacgaggctgcgggagcacaggccggtgccgaggcagcgagggagggagtcagcggcccagacctaccagtttgcgaaccctctggagagagtgctgctcctgactcagcattgcctcatgcagcccgtggttgggcaccgttccccgtggctccagtccccgctcatctccggaggggaggtttacgcccagcacccgcatctggtgggggtgcctggcccagccctctgccttcccggtcctcggggatttggactaaacagattatctgtcgttactacatccacgggcagtgtaaagagggagagaactgccgctacagtcatgatctctcaggacggaagatggccacagagggaggcgtatctccccctggagcttctgccggtggcggaccctctaccgccgctcatatcgaacctcccacccaggaagttgcagaggcaccacccgctgcgtcctcgctctccttgcctgtgattggtagtgcggctgagaggggattttttgaggcagaacgagacaacgctgacaggggcgctgcagggggtgcaggagtggagtcttgggctgatgccatagagtttgtgcctggtcaaccgtatagaggcagatgggtggcctcggctcccgaagcacccctacaatctagcgaaacagagagaaagcaaatggctgtgggctcaggactccggttctgctactatgccagccgcggagtgtgtttccgcggagaatcatgcatgtaccttcatggcgacatttgcgacatgtgtgggctgcagacactgcatcctatggatgctgcccagagggaggagcacatgcgggcatgtatcgaagctcacgagaaggatatggaactgagtttcgccgttcagagaggcatggataaggtatgtggtatctgcatggaggtggtgtacgagaaggctaaccctaacgaccggaggtttggaatcttaagcaactgcaaccatagcttctgtatacgatgcatccgccgttggaggagcgctagacagttcgagaatagaattgtcaaatcatgcccgcagtgtagagttacatcagagctggtcatcccctcagagttctgggtcgaggaggaggaggagaagcagaaactaattcagcaatacaaggaggccatgtctaacaaagcctgccgctatttcgctgaaggtagagggaattgcccgttcggtgacacttgtttttataagcacgagtatcccgagggctggggagatgagccgcctgggccaggtggcggatcttttagcgcatactggcatcaactggtggagccagtgcgtatgggagagggaaacatgctttacaagtccataaagaaggagctcgttgtcctgcgactggctagcctgctctttaaacgcttcctgtcactcagagatgaactacccttctcagaggaccagtgggatctcctgcattatgagctggaagaatacttcaacttgatactctag

SEQ ID NO: 229449 - DNA, 462 bp, Artificial Sequence
  Description of Artificial Sequence: Synthetic coding sequence
atggccccagccgctgctacgggaggatcaactttgccatccggcttcagcgtattcacaaccctgcctgatctccttttcatcttcgagttcattttcggtggcctcgtttggattctggtcgcaagtagcctggtgccatggccccttgtgcagggatgggtgatgtttgtgtccgttttctgttttgtcgcaaccacaaccctcataattctgtacattataggagcccatggcggagaaacctcttgggtgacgctggatgcagcgtatcactgtactgctgcccttttctatctgtctgcctctgtgctggaggccctcgcaaccatcaccatgcaggacggattcacatatcggcactatcacgaaaatatcgcagctgtggtcttctcatatatagccactcttctatatgtggtacatgcggtgttctctttgattagatggaaaagcagctag

SEQ ID NO: 229450 - DNA, 168 bp, Artificial Sequence
  Description of Artificial Sequence: Synthetic coding sequence
atggcgcctgccgcagccacaggaggctccaccctcccctccgggttctctgtcttcaccaccctgcccgacctgttgtttattttcgagttcgtgttctcttacatcgcaacacttttgtacgttgtgcatgccgttttcagtttaatcagatggaagtcaagctag

SEQ ID NO: 229451 - DNA, 336 bp, Artificial Sequence
  Description of Artificial Sequence: Synthetic coding sequence
atggcccctgctgccgctaccggcggtagcacccttcccagcggcttcagtgtgttcaccactttacctgatctcctgttcatatttgagtttatttttggcggactggtctggatcctagtcgcaagctcactggttccatggcccttagtccaaggttgggtgatgttcgtcagcgttttttgtttcgttgccacgacaacacttatcattttatacataattggcgcacacgggggagagaccagttgggtaacactggtgttttcttacatcgctacactattgtatgtggtacatgcggttttttccttgatcaggtggaagtcctcttag

SEQ ID NO: 229452 - DNA, 294 bp, Artificial Sequence
  Description of Artificial Sequence: Synthetic coding sequence
atggccccagccgcagcaaccggcggaagcaccctgccgagtgggtttagtgtgttcaccactctccccgatctgctcttcatctttgaatttgacgccgcatatcactgtacagctgcacttttttacctgagcgcgtccgtattagaggcactggccacaatcacaatgcaagatgggtttacctaccggcattatcacgagaatattgctgccgttgtgttctcttatatcgctacactcctctatgtcgtgcatgcagtgttctctctgattaggtggaaaagctcttag

SEQ ID NO: 229453 - DNA, 462 bp, Artificial Sequence
  Description of Artificial Sequence: Synthetic coding sequence
atggcctcacccgaccctcctgccacctcttatgccccatccgacgtgccctccggggtggctttgtttctcacaatcccatttgcctttttccttccagaactgatctttggattcctcgtatggacgatggtggcagcgacccacatagtgtatccgcttttgcagggatgggtaatgtacgtgtccctcacctccttcctgataagtttgatgtttctgttgtcctatttatttggtttctataaacgattcgagagctggcgagtgttggatagtttataccacgggaccacaggaatactatacatgtctgcagctgtcttacaagtccatgccaccatcgtttctgaaaagctgctggatcccagaatttactacattaattcagccgcatcattttttgcatttattgcaaccctgttatacatactacatgcattttctatctattaccactag

SEQ ID NO: 229454 - DNA, 6216 bp, Artificial Sequence
  Description of Artificial Sequence: Synthetic coding sequence
atggagttagcacactccctgttgctaaatgaggaggccctggctcagattaccgaagccaaaagacctgtgtttatcttcgaatggttacggtttctcgataaagttttagtcgctgctaataaaacagatgttaaagagaaacagaagaagctggttgagcaactgaccggcctgatctcgagtagtccagggcctccaactaggaagctgctggcaaagaacctcgcggcactctatagtattggtgatacatttaccgtgttccagaccctcgacaaatgcaacgatattatcagaaacaaagacgacaccgcagcctacctccccactaagctggctgccgtagcttgtgtaggtgctttctatgagaagatgggaaggatgctcggcagcgcatttcccgaaacagttaacaacctactcaagagcttaaaatcagcagaatcacaaggccgaagtgaaatacttatgtcattgcaaaaggtgttaagtggtctgggcggtgcagccgctagctcccacagagacatctacaagaatgcacgctctctgctgactgaccgcagcatggcagtaagatgcgccgtggcaaagtgtctgttggagttacaaaatgaagctgtgtttatgtggaccgctgagcttgagaacatcgcaaccctctgcttcaaagccctcgagaatagcaactacggggtgagagtcgccgtttctaaactgttaggtaccgttatggccaccgccttgatgccaaagcaggctaccgtcatgcgccagaacgttaagcgggcaacttttgacgaggtgctggagctgatggccaccggcttcctgcggggagggtccggcttcctgaagagcggcggagaaatgctcaaagtggggggatcagtgaatagggaagtacgtgtcggggtcacccaggcatatgtggtcttcgtaactacactggggggacagtggcttgagcgctcattcgctacattcttaagccatgtgctggacctagtttcccacccgagggccacccagactcatgttgaggcggtgtattcacggcgatgtgtgtcgttcattctacgcgctacggtcggatccctgctcggagaaaaggcccagattgccgcagctaaagagatttgtcaagccatcggcaagcagatgaaggctgtggaggcggtggtcaacgacacctccggagagaacaagtcaggagccgcagatatcgccgcttctcagcatgtcatggtctgtgcgttgcaggagctgggcagccttgtgcagagccttaacgctacggccagccctcttatacaggaagcttcaattggcctacttgaaattgtgactagcgtcctgctccacccatcaatggctgccagactcgcggcagcatggtgcctgagatgcgtggccgtagcactgcccttccaattgaccccattcctagatagatgtgctgagaggctcaacaatttgaagaccagccctgaagctgttagcgggtatagcttcgcaatggcggctcttctcggtggcgttcaccagtgccctctcggcattccgcatgccaagggaaagatggtagtttctattgccgaggacttgctccgtacagccgcacagaattccagactctctcttcagcgcacacaagccggatggctgctccttggggcattaatgaccctggggccatctgtggtgcggtaccacctgcccaaaatgttgctgctgtggaggaatgtgttcccgcgttctctgaaggaattagaggctgagaaggcccgtggtgactcgttcacttggcaggtcaccttggaaggaagggctggcgctctatgcgccatgcgaagttttgtcgcacactgccccgagctgctgactgaagatgtgatccgcaagcttatgacccctattgaatgtgccatgacaatgatgagtcatatacccagtgttatgaaggcccatggtgctcatctcaaagctagtgccgctatggtgcgactaaggttgtatgacattcttgctttgcttccacccaagacgtatgaagggtccttcaacgctctactccgagaattggtggcagagtttacactgaccgataactccgcgaacaccacaactagcctcttgcgcagtctctgccattatgatgattctgtgttgctggggagctggctgcaggagaccgaccataagagtatagaggatcagctccagcctaacagtgcttcaggaagtggtgcactcgaacacgaccccagcagtatctatttgagaatccccgctggggaggctgtcccaggaccactgccgctgggtgttagtgtcatcgacgcctcagtcgctctgtttggagtggtttttccccacgtttcatacaaacaccggctacaaatgttagaccactttgcagagtgcgtgaagcaggccaagggggtgaggcagcaagctgtccagttgaatatctttactgctgtgctgtcggccctgaagggtcttgcagagaataaatctacactgggccctgaggaggtgcggaaatcagccctgaccctggtaatggggcctctggataatcccaatcccatcctgagatgtgctgcaggagaagctctcggcagaatggcccaggtcgtgggagaggccacctttattgcaaggatggctcaatatagtttcgataaactcaagtccgcgagagatgttgtgtctcgcacaggccatagcctggcactcggctgtttgcatcggtacgtgggcggaatcggcagtggccaacacctgaagacatcagtgtccatcctcctggcactggcgcaggatggcacatcaccggaggtacagacgtggtcactgcattccctggccctcattgtggactcttccgggccaatgtaccgaggctatgttgaacccacactctcacttgtgctcacccttctgcttacggttccgccaagtcataccgaagtgcatcagtgcttgggcaggtgcctgggggcaataataacaacagtgggacctgagttacaagggaatggggctaccacctccaccatcaggagtagttgcttggtaggctgcgctattacacaggatcattctgatagcctcgtccaggccgcagccataagctgtctacagcagcttcacatgttcgctcctcgccacgtgaacctgagcagcctggtgccctcactgtgcgttcatctatgcagcagccacttgctcctgcgtcgagccgcagtggcatgcctcagacagctcgcccagagggaggccgctgaggtgtgtgagtatgctatgtccctcgccaaaaatactggagataaagagtccagtagcgccaacgtgagtcctttcgccccaggagtgtcatccaggactgacatccactgccggcatcagggggtgaatataactgagacaggcctggagggattgctgttcggcatgctcgaccgcgagacagatcggaaactgtgtagtgatattcatgacactctgggacacatgctttccagccttgcggtggagaaactgagtcactggctgatgctatgtaaggacgtgctggccgctagttcagacatgagtacagccacattgttgtctagtggaaaagacgaagaagccgaaaagaaggacgagatggacgatgatactatgttcaccacactcggagaagaggacaaatccaagcccttcgtggctccgcgttgggcaacccgtgtgtttgccgcagattgtctctgtcgcatcattaacctctgcgaaaatgctgatcaggcccacttcgacctagccctggcacgaagcgcaaagttgcggaaccctactaacgatctgctagtcctgcatctgagtgacctgatcaggatggcttttatggccgcaaccgaccactctaaccagctgaggatggcaggcctgcaggcactggaagatattatcaaaaaattcgccagcgtgcccgaaccggaattcccgggacacgtcattctcgaacaatatcaggctaatgtaggagctgcactgagacccgcattctcccaggatactcctagcgatataattgctaaagcctgtcaggtctgctcaacctggattgggagcggggtggtctccgaccttaatgacctaagaagagtgcacaacttgttggtgtcctccttagataaggtgcaggccggtaaaggcagctcttcgcagctgtacagagagagtgccacaaccatggaaaagctcgccgtcctgaaggcctgggccgaagtttatgtcgtagccatgaacattaaaaaggaagctgagtctaagccaaaaagagctattaagaacacagatgacgatgacgatgattgtggcacaatcgacgaattaccccctgattcgttaattacattggtgcagccagagctcccaactctcagtcgcctgtggctggccgctttgaaagactacgccctgcttaccctgcctgccgaattttcaagtcagctgcccccagatggaggcgcattttacacaccagagaccattgacaccgccaggctgcactaccgtaacagttgggcaccaatcctgcatgctgtggccttatggcttaattccaccggctttacctgctcagagagtacagaggctgccgctatctcaggcctgcagaaaagaagcacatccgttaacctgaaccaggccagcggagcggtcgggtccgcgaaaagcctgcccgaaatcaataaggatcggatgcacctgattctgggggtgagcattcaattcctctgctctccgagaccagaggaaccgattgaacacgtgaccgcttgcttacaggctctgcacacactcttagatagtccatacgccagggtgcatatcgctgaagaccagctgattggcgtagagctcctgtccgttctgcaccgattgctgctgacctggaatcccagttctgtccagctcttagtgacaggggtggtgcagcagatcgtgagggccgctcaggattacctgcaagaaaaaagaaacacactgaacgaagacgatatggagaaggaagcctgcaccgtcctgggagaaggtggggacagcggaggactgatccctggcaaaagcctggtgttcgcgactatggagttgttaatgttcattctggtccgccacatgccacatctctccaccaaagtctccgactctccaagtcacatcgccacaaagacgcgactttctgaggagagcgctcgcctggtcgccgctacagtaaccattctatccgatctcccaagcttatgttcccccgctggttgtatgaccattctgccaactatcctgtttctgatcgctagaattctgaaggacacggccattaagagtgccgacaatcaagtgcctcctccggtctcggcagctctgcaaggaataaagtccatagtcacattgagtatggccaagactgaagccggtgtgcaaaaacagtggaccgctctcatacgcagtactctcgcctgcatactggagtattctcagcctgaggattccgttcctacccccgatgaggtgtcaatgctgaccgctatcgctttgttcctctggagtgcgtcaaacgagatcattggagttcagtctcttcagaacggttgtatgaacaggttcaagaacgccctgaatagctgtgacccttgggtgcaggccaaatgttatcagctgttgctgtcggtgtttcaacattcgaaccgagctctgtctaccccatatatccattctttggcccctatcgtggtggaaaaactcaaggccgtggagaggaaccggccagctagcaacattgaattgctcgcggtccaggagggcattaaggtcctggagaccctggtggctctgggggaagaacagaatagagtgcagctgctcgccctcttagtgcccacgctcattagctacctccttgatgaaaattcctttgccagcgcctcctctgcctcgaaagacttacacgaatttgctctgcaaaacctgatgcacattggaccactttacccgcatgccttcaagaccgtgatgggagcagccccagagcttaaagtacgtttggaaacggccgtgagggcctcgcaggcctctaaggccaaggccgcagctaggcagccagcaccggctatccactccgctcctacaattaagctcaaaacaagcttcttttag

SEQ ID NO: 229455 - DNA, 1005 bp, Artificial Sequence
  Description of Artificial Sequence: Synthetic coding sequence
atgagcgagcctattagggtccttgtcactggggcagcgggtcagatcgcttactcacttttgtactcgattgggaacggcagtgtttttggaaaagaccaaccgattattctggtcctcttggacattactcctatgatgggggtactcgatggggtgctcatggagctccaggactgtgccctgccacttctgaaagatgtgattgccactgataaagaggatgtggcctttaaggacctggacgtggccattcttgtgggttcgatgcccaggagggaaggcatggaacgaaaggacttgcttaaagccaacgtaaagattttcaaaagccaaggcgcagcacttgataaatatgccaagaaatcagtgaaggtaattgtcgtcggcaatcccgctaacaccaattgtctgacagccagcaaaagcgcgccatcaatccctaaggaaaattttagctgcctaacgagactcgaccataaccgggcaaaagcgcagattgccctgaaactcggcgtaaccgctaacgacgtgaaaaatgtgattatttggggtaaccatagctcaacccagtatccagacgtgaaccatgcaaaggtaaagttacagggcaaggaggtcggggtgtacgaagccttaaaagatgatagctggctgaagggagaatttgtgaccaccgtacaacaaagaggcgcagcagtgatcaaggctagaaagttgtctagcgccatgtctgccgcaaaggccatttgtgaccatgtgagggatatttggtttggtacacccgaaggggaattcgtgtcaatgggcgtgattagtgacgggaattcttacggggtgcctgacgacctgttgtacagctttccagttgtaataaagaacaagacctggaagttcgtcgaaggactacctatcaacgatttttctcgcgaaaagatggatctgactgcaaaggaactgacagaggagaaggagtccgccttcgaatttctttccagcgcctag

SEQ ID NO: 229456 - DNA, 1059 bp, Artificial Sequence
  Description of Artificial Sequence: Synthetic coding sequence
atgagaaggtgttcctacttccccaaggacgtgacagtatttgataaggacgacaaatccgagcccatcagggtgctggtgactggagctgctggtcagatcgcctattcactgctgtacagcataggcaatggctctgtcttcggcaaagaccagccaatcatcctagtcctacttgatatcactcccatgatgggtgtgttggatggagtgcttatggaattacaggactgcgcactgccacttctgaaagatgtgatagctacagacaaggaggacgtcgcctttaaagatctagacgtggccattcttgtggggtccatgccacgccgagaaggcatggagagaaaagacctgctcaaagctaacgtgaaaatttttaagagccagggggcagccctggacaagtacgcaaaaaagtccgtgaaagtgattgttgtggggaaccccgctaataccaactgtttaactgcctctaagtccgccccatctatccccaaggagaactttagttgtctgacaaggctggaccataacagggccaaggcccaaatcgctctcaaattaggtgttaccgcaaacgatgtcaagaatgtgattatctggggcaaccattcctccacccaatatccggatgtgaatcacgccaaggtgaagctgcagggaaaagaggtaggcgtgtatgaagccctgaaagacgacagctggctgaagggcgaatttgtaaccacagttcagcagcgtggagccgcagtgatcaaggcaagaaaactcagtagcgctatgagcgctgccaaggccatctgcgatcatgtgagagacatctggtttggtactcccgagggggagttcgtttctatgggtgttatttccgacggcaatagctacggagttccggacgatctgctctacagctttccagtcgtcataaaaaacaagacttggaaatttgtggaaggcctacctattaacgacttctctagagagaagatggatctgaccgcaaaggaactcacagaggagaaagagtctgccttcgagttcttgtccagcgcctag

SEQ ID NO: 229457 - DNA, 738 bp, Artificial Sequence
  Description of Artificial Sequence: Synthetic coding sequence
atgccgaggcgggaaggcatggaaagaaaggatctgcttaaagcgaatgttaaaatatttaagagccagggggcagctttagataaatatgcaaagaaatcggtcaaggtgattgttgtaggaaaccctgccaatacaaattgtctgaccgcaagtaaaagcgccccatccatacccaaagaaaacttcagctgcttaactaggctggaccataaccgcgcaaaggctcagattgctctgaagctgggtgtgacagctaacgacgtcaagaatgtgatcatctggggaaaccactcatccacgcagtatccggacgtgaaccatgcaaaggtcaagctacagggaaaagaagtgggagtttacgaagctctgaaagacgattcttggctgaaaggtgaattcgttacaaccgttcagcaacggggagcagctgtgattaaggctagaaaacttagctctgccatgtccgctgctaaagccatctgcgaccacgttcgcgatatttggttcgggactcccgaaggagaattcgtgtctatgggtgtcatttctgacggaaattcatatggagttccggatgacctgttgtacagtttccccgtcgtcatcaaaaataagacctggaagtttgtggagggtcttcccatcaacgacttttcccgcgaaaaaatggatctcaccgccaaagaactgactgaggagaaagagtccgccttcgaattcctaagctctgcatag

SEQ ID NO: 229458 - DNA, 1017 bp, Artificial Sequence
  Description of Artificial Sequence: Synthetic coding sequence
atgttatctgccctggcgagaccagcttccgccgctttgcgacgctccttcagtacttctgcccagaataatgccaaggtagccgtgctgggagcttctggcggaattggccagcctctgtcactgcttctcaaaaacagcccactcgtgagccgcttgacgctgtatgacatcgctcatactcccggagtggctgccgacctatcgcacattgaaaccaaggcagcggtcaagggatacctggggcctgagcagttgcctgattgcctaaagggatgcgatgtggtagttattcccgctggggtccccaggaagcccggtatgacccgagatgatctctttaacacaaacgcaacgatcgttgccactctcaccgctgcgtgtgcacaacattgccctgaggccatgatctgtgtcatcgctaatcccgtcaattccacaattcctatcacagcagaggtctttaagaaacatggtgtttataatcccaataagatcttcggcgtcacaaccctggatattgtcagagctaacaccttcgttgccgagcttaaaggtctggaccctgctagggtgaacgtgccagtaattggcggtcacgccggtaagactatcattccacttatctcacagtgtacccccaaagtggattttccacaagatcagctgaccgccctgaccggcaggatccaggaggccggaacagaagtggtaaaagccaaagcaggcgcagggtccgcaacactcagcatggcctatgcaggcgctaggtttgtgtttagccttgtggacgccatgaacggaaaagaaggagtcgtcgagtgtagttttgtaaaatctcaggagactgaatgtacatacttttcgactcccctgctgctgggcaagaaaggaatcgagaaaaatctgggaataggaaaagtttcctcctttgaggaaaagatgatctcagacgccatcccagagctgaaggcaagtatcaagaaaggagaagattttgtgaaaacactcaaatag

SEQ ID NO: 229459 - DNA, 1872 bp, Artificial Sequence
  Description of Artificial Sequence: Synthetic coding sequence
atgaacaggtacacgaccatgagacagctgggcgatggaacatatgggagcgtcctgatgggaaaatctaacgaaagcggtgagctggtcgctatcaaacgcatgaagcggaagttctactcctgggacgaatgcatgaatctgcgtgaagttaaatccctaaagaaattaaatcacgcaaatgtgattaagttgaaggaagtgattagagagaatgaccacctttacttcatctttgagtatatgaaggagaacctttatcaactcatgaaggatcggaataagctttttcctgaatctgttataaggaatattatgtatcagattttgcagggcctggccttcatccacaagcacgggttcttccatcgagatatgaagcccgaaaatctgttgtgcatgggcccagagcttgtgaaaatcgcagatttcgggctggctcgggagctgaggtcccagcccccatacacggactatgtttccacccgttggtatagggcacctgaggttctccttcgaagttccgtatattcctcacccattgacgtatgggctgtcgggagcattatggcagagctgtacatgctccgccctctatttcccggtacaagcgaggtagacgagatcttcaaaatttgtcaggttctcggcaccccgaagaagtccgattggccggaaggataccagctggctagtagcatgaattttagatttccccagtgtgtccccatcaatctgaagacactaattcccaatgcatcaaacgaggccatccagctgatgaccgaaatgcttaactgggatcctaagaagcgcccaaccgcatcccaggccttgaaacacccatatttccaagtgggccaggtgctggggcctagcagcaaccacctcgaatctaaacagtcgctcaataaacagctgcagcccttggagtcaaagccctcactagttgaagtggagcccaaaccgctgcctgatataatcgatcaagtggtgggccagccgcaaccaaagacctctcagcagcctttacagcctatccagccccctcaaaacttgagcgtccagcagccccctaagcagcagagccaggaaaaaccacctcagacccttttcccaagcattgtgaagaatatgccgacaaaacctaacggaactcttagccacaaatctggcaggcgtcgatggggccagaccatcttcaagtctggcgatagttgggaagagttggaagattacgatttcggagcttcccacagcaaaaagccttccatgggagttttcaaggagaaacggaaaaaggattccccattccgtctccccgagccggtaccatccgggtccaaccattcaacaggcgagaataagtcactccccgctgtgacctccctgaaaagcgattcagagctgagcacagcccctacgtcaaaacagtactatcttaagcagtccaggtatcttcctggggtgaatccaaaaaaagtgagcttaattgctagcgggaaagagatcaatccccacacatggagtaatcagctgtttcccaagtccctgggtcctgttggcgcagaacttgcttttaaaaggtccaacgcagggaatctcggtagttacgctacatataatcaaagtgggtacatcccttcatttttgaaaaaggaggttcagtccgctggtcagcgaatccacttggccccactgaacgctacggcaagtgaatatacttggaatactaaaacggggcgagggcaattcagtggcaggacatacaacccaaccgctaaaaatctcaacattgtgaaccgcgcacaacctatcccgagcgtgcatggtcgcactgactgggtggccaagtatgggggacaccgctag

SEQ ID NO: 229460 - DNA, 1872 bp, Artificial Sequence
  Description of Artificial Sequence: Synthetic coding sequence
atgaatcggtacactaccatgagacagctcggtgacggcacatacggaagtgtcctgatgggaaaatcaaacgaatccggagagctggtagctattaagcggatgaaaaggaagttctactcctgggacgagtgcatgaatctgagggaagtgaaatcccttaaaaaactgaaccacgcaaacgtcatcaaactcaaagaggtcatcagagaaaatgaccatctgtactttatttttgagtacatgaaggaaaacctttatcaactcatgaaagaccggaacaagctgtttcctgagagcgtaatccgaaatattatgtaccagatccttcagggactggccttcatacataagcatggcttcttccacagagatatgaaaccggaaaacctgctctgtatgggccctgaattggtcaagatagctgatttcggcctggccagagagttaaggtctcagccaccctacaccgattatgtctctacgcgctggtatcgggctcctgaggttctgctaaggagctccgtatactccagtccaatcgacgtttgggccgtgggcagcattatggctgagctgtacatgctgcggccactgtttccaggaacctccgaagtggatgaaatcttcaagatatgtcaggtgctcggaacccccaagaaatcagactggcctgagggttaccaacttgcttctagtatgaactttcggttcccacagtgtgtgccgatcaatctcaagacactgatccccaatgcctcaaatgaagcaatacagctgatgactgaaatgctgaattgggatcccaagaaaagaccaacagcatcccaagctctgaaacatccatactttcaggttggtcaagttctcgggccatctagcaatcatttggagagcaagcagagtttgaataagcagttgcagccgctggaatctaaacctagtctcgtagaggttgagccaaaaccattaccagatatcatcgaccaggtcgtggggcagccgcagcccaagacctcccagcagcctttgcaaccaatccagcctccccaaaatctgtcagtacagcagcctccaaaacagcagagccaggaaaagccacctcagacactcttcccatcaatagtgaaaaatatgcctacaaagcctaacggaacactaagccataaatctgggcgaagacggtggggtcagaccatatttaagagcggagactcatgggaggagttggaagattatgacttcggcgctagccattctaagaagccttccatgggcgtgtttaaagagaaaaggaaaaaggacagcccattcaggcttcccgaacctgtaccctccggctccaatcatagcaccggcgagaataagtctctacctgccgttacttcgctgaagagcgactcagaactttctacagcacctacaagtaagcaatattacctgaagcagtcccgttatctgcccggtgtcaacccaaaaaaggtcagtctgatcgcgtccgggaaagagatcaacccacacacgtggtctaaccagctgttccccaaatcattaggccctgtcggcgctgaactcgcttttaaacggtctaacgctgggaacttaggctcctacgcgacctataaccagtccggatacattccatcttttctgaaaaaagaagtccagagcgctgggcagcggatccatcttgcgcctctgaacgctacagcttccgaatatacctggaataccaagaccggacgcggtcagttctccgggagaacatataatcccaccgcaaaaaaccttaatatcgtgaatcgggcacagcccattccgagcgtgcatgggaggaccgactgggtcgccaaatatggcggtcatagatag

SEQ ID NO: 229461 - DNA, 867 bp, Artificial Sequence
  Description of Artificial Sequence: Synthetic coding sequence
atgaaccgctatactactatgcggcaactcggggatggcacttatggaagtgtgctcatgggtaagtcaaacgaatccggcgagctggtcgcaattaagagaatgaagaggaaattctattcgtgggacgagtgcatgaatctgcgcgaggtcaagtctctgaagaaattaaaccacgctaacgttatcaaactgaaagaggtaatccgcgaaaatgaccatctatatttcatctttgagtatatgaaagagaacctgtaccagttaatgaaagaccgcaataagctgttcccggagtctgttattaggaatattatgtatcaaattctccagggcttggcttttattcacaaacacggattttttcaccgagacatgaagcccgaaaacctgttgtgtatgggccctgagttggtcaaaattgcggacttcggactcgctcgggaactcagatcacagcctccatatacagattatgtctccactcgctggtaccgggcaccagaagtgttgctccgcagttcagtctattcctctcccatagacgtgtgggccgttgggtcaatcatggcggaactgtatatgctgaggcctctgtttccgggaactagtgaggtagacgagatattcaaaatatgccaggtgttggggacgcccaaaaagagcgactggcctgaaggctatcaactggcaagcagcatgaactttcgctttccccagtgcgtacctatcaatcttaagaccctaataccgaatgcctctaacgaggccatacagttaatgactgagatgctgaactgggatccgaagaaacgtcctaccgcgagtcagccctgctttctagtggaagttgaacgccctaactag

SEQ ID NO: 229462 - DNA, 1374 bp, Artificial Sequence
  Description of Artificial Sequence: Synthetic coding sequence
atgaaccgatacaccactatgcgccagctgggggatgggacatacggatctgtattgatgggcaagtcaaacgagtcaggggaactggtcgccatcaaacggatgaaacgaaagttctattcctgggacgagtgcatgaacctgcgtgaagttaagagcttgaagaaactcaaccacgcgaacgtgatcaagctaaaagaggtgattcgagaaaatgatcatctttacttcatttttgagtatatgaaggagaatctctaccaactgatgaaagatcgcaataaactcttcccagagagcgtgataagaaatatcatgtatcagatcctgcaggggcttgcctttattcacaagcatggtttttttcatagggacatgaagcccgagaatctcctgtgcatggggcctgaactggttaaaatcgcggatttcggactggccagagagctgagatcccagcccccatacaccgattacgtctccacgcgctggtacagggcacctgaagtactactcaggtcctctgtgtattcgtcacccatcgacgtttgggcagtgggtagcattatggctgagctgtatatgctgcggccactgttcccagggacatccgaggtggacgaaattttcaaaatttgccaggtactgggcacaccgaagaagtctgactggcccgagggctatcagcttgcttcctcaatgaacttcaggtttcctcagtgcgtcccgatcaatttgaaaaccctgatccctaacgcctcaaatgaggcaatccaactcatgacagaaatgctgaattgggatcccaagaagcggcctactgcttcgcaagccctgaagcacccctacttccaagtgggccaggttttagggccatctagtaaccatctggagagcaagcaatccctgaataaacagctgcaaccgctggagtctaaacctagcctggtggaggtggagccaaaaccgttgccggatatcatcgatcaggttgtcggccagccgcagcccaaaacgtcccagcagccgctgcaacccattcagcctccccaaaacctatctgtgcaacaacccccaaagcagcaatctcaggaaaaacctccccaaacactgtttccaagcattgtcaagaatatgcccactaagcctaacggcaccctgtctcataaatccggacggaggaggtggggccagactatcttcaaaagcggcgactcctgggaagaattagaggattatgacttcggggcttctcactctaagaagccttccatgggcgtctttaaagaaaagcgtaagaaggacagtcccttccgccaacaggttaagatggcagtgatctccctgtcagcccaccagtttcccaccctatag

SEQ ID NO: 229463 - DNA, 942 bp, Artificial Sequence
  Description of Artificial Sequence: Synthetic coding sequence
atggaggaaatgtcaggtgagtctgttgtctcatctgcggtgcctgccgcagccaccaggacaacctcatttaagggtacatcaccctcctcaaaatatgtcaagctcaatgtagggggagcgctgtactacacaaccatgcaaaccctgacaaagcaggatacgatgcttaaagcgatgttctctgggaggatggaggttcttacggatagcgaaggctggattctgatcgatcggtgtggcaagcatttcggcactatcttaaattatctgcgggatggagcggtgccactgccagagagcagacgagaaatagaggagctgctggcagaggccaagtactacttagtccagggtctggtggaggagtgccaggctgctctgcagaacaaagatacatacgagcctttctgtaaggtgccagttataactagctccaaggaggaacagaagctaatcgccacttctaacaagccagctgtgaaactcctctacaatcgatctaacaacaaatatagctatacctccaattcagacgacaacatgttgaaaaacatcgaactcttcgataaactcagtctccgatttaacggcagagtccttttcattaaggatgtgatcggcgacgagatctgttgttggtcattttacggacaggggagaaaaatcgccgaggtttgttgcacatccatcgtgtacgcaacggagaagaaacagactaaggtggaattcccagaggcccgaatttatgaagagacactgaacattcttttgtacgaggcccaggacggacgtggacctgacaatgctcttctggaggcaacaggcggagcggctggtcgatcgcaccacctagacgaggatgaggagagagagaggattgagcgggttaggcgtattcacataaaaaggcccgacgatcgggcacatctacaccagtag

SEQ ID NO: 229464 - DNA, 558 bp, Artificial Sequence
  Description of Artificial Sequence: Synthetic coding sequence
atgggacctgaacgacatctttccggcgcacccgcacgcatggccacggtcgtattgggcggagacaccatgggacccgagcgaatctttcccaatcagactgaagagttaggacaccagggaccaagtgaagggaccggcgactggtcatctgaggagcccgaggaggagcaggaggagaccggatctggtcctgccggttactcttaccagcccctgaaccaggatcccgaacaggaagaggttgagctggcgccagtgggggatggggacgtggtcgccgatatccaggaccggattcaggccctgggattacacctccccgatcctccactggagtctgaagacgaagacgaagagggagctactgccctcaacaaccattcatctatacccatggatcccgagcatgtcgagttagtgaaacgtactatggccggtgtgtccctgcccgctccaggagtgccagcctgggccagagagattagtgacgcacagtgggaggatgtggtgcagaaagctctgcaagcacgtcaggcatctccagcgtggaaatag

SEQ ID NO: 229465 - DNA, 1719 bp, Artificial Sequence
  Description of Artificial Sequence: Synthetic coding sequence
atggagcccgaggcacctcgaaggaggcatacacatcaacgcggatacctactgacacgtaacccccacctgaacaaggatctggccttcactctggaagaacggcagcagctgaatattcacggccttctgcccccatctttcaactcacaggaaatacaggttttgagagtcgtgaaaaatttcgagcacctgaattcggacttcgacaggtacctcctcctgatggatctgcaggaccgcaacgaaaaactgttctaccgggttctcacttcagacatcgaaaaattcatgccgatagtgtatacccctacagtcggcctggcctgccagcagtactcattagtgttccgtaagccgaggggcctcttcatcaccattcatgaccgtgggcacattgcttcagtgttaaatgcttggcccgaggacgttatcaaggccatcgtggtcactgacggtgagcggatcctgggattgggagacctggggtgcaatggcatggggatccccgtgggaaaactggcgctctacactgcctgcggcggaatgaacccgcaggagtgcctgcctgtgatcttggatgttggaacagaaaatgaggagctacttaaagacccactgtacattggtcttaggcagcgcagagtccgcggaagcgaatacgatgatttcctggacgagttcatggaagcagtgagtagcaaatatgggatgaattgtttaatacagttcgaagattttgccaatgttaacgcttttcggctcctgaataaatatcgcaatcaatactgcacattcaacgatgacatacagggaacagcgagcgtagccgtcgctggactgctcgctgccttacgcattacaaagaataaactgtccgatcagaccatcctgttccagggagccggagaagcagcactgggcattgctcatttaatagtgatggctctggagaaagagggcctgcccaaggaaaaagccattaaaaaaatttggctggttgactctaaggggcttatcgtgaagggtcgggcttctttaacccaggagaaagaaaagttcgcccacgagcacgaagagatgaagaaccttgaggccattgtgcaagaaataaagcctaccgctctgattggcgtggccgctatcgggggagctttctctgagcaaatcttgaaagatatggcggcattcaacgagaggccaattatatttgcgttaagtaacccaacttcaaaagccgagtgctcagccgagcaatgttacaaaatcaccaaaggacgggctatttttgccagtggttctcccttcgatcctgtgaccctgccgaatgggcagactttgtacccgggtcagggaaacaactcatatgtgttccctggcgtggctcttggcgtggtggcatgtggtctccggcagatcaccgacaatatctttttgactactgcggaggtgatcgcacagcaggttagcgataaacatttagaggaaggacgactgtatccccctctcaataccattagagatgtctcattgaagatcgccgagaagatcgtcaaagacgcctaccaggagaaaaccgcaactgtatatccggagccacagaacaaggaggcttttgtgagatcacaaatgtacagtaccgattatgatcaaattctacctgactgctactcctggcccgaggaggtacagaagatccagactaaagttgatcagtag

SEQ ID NO: 229466 - DNA, 699 bp, Artificial Sequence
  Description of Artificial Sequence: Synthetic coding sequence
gtgaaggggagagcctctctgactcaggagaaggagaaattcgcacatgagcacgaggaaatgaagaatctggaggccattgtgcaggaaatcaagcccactgccctgatcggagtcgccgctatcggcggagcgttctccgaacaaattctgaaggatatggcagcattcaacgaacgcccaattatcttcgccctttcaaacccaacctccaaagctgagtgtagtgctgagcagtgctacaaaattacaaagggcagagccatttttgcttcaggaagtccgttcgatcccgtgaccctgcccaacggccagactctttaccctgggcaaggtaacaatagctacgtcttccccggagtagctttaggggtcgtggcatgtggactcagacagatcaccgataacatttttcttaccaccgccgaagtcattgcccagcaggtgagtgacaaacatcttgaagaaggacgtttgtaccctcccctgaacacaatacgagacgtttccctgaagatcgccgaaaaaattgttaaggacgcctatcaggaaaaaactgccactgtgtatccagaacctcagaataaggaagctttcgtgagatcccagatgtactctacagattatgaccaaatcttgcctgattgctactcctggcctgaggaggtgcagaagattcagactaaagttgatcagtag

SEQ ID NO: 229467 - DNA, 1221 bp, Artificial Sequence
  Description of Artificial Sequence: Synthetic coding sequence
atgggcatcccagtggggaagctcgctctgtacaccgcttgtggcggtatgaatccccaggaatgcctgccagtcatccttgacgtaggtacagagaacgaagaactgcttaaggatcccctttatattggtctgcgccagaggcgggtccgaggcagcgagtatgacgatttcctggacgagttcatggaagctgtctcaagtaaatacggtatgaactgtctgatacagttcgaagacttcgccaatgtaaatgcattccggctcctcaacaaatatcgcaaccagtactgcactttcaacgacgacattcagggaaccgcctcagtggccgtagctgggctgcttgccgctctccgtattactaaaaataagctgtccgatcaaaccatcctctttcaaggcgctggcgaagcggctctcggcatagcacaccttatagtcatggccttagaaaaggagggcctcccaaaggagaaggccatcaagaaaatttggctagtcgactccaagggcctgatagtcaaggggagagccagccttacccaggaaaaggagaagttcgcccatgagcatgaagaaatgaaaaacctcgaagcaatcgtccaggaaataaagcccacggccttgattggggttgccgcaatcggcggagccttttccgaacagatactcaaagacatggctgcatttaacgagcgacctatcattttcgccttaagcaaccccacctcaaaagccgaatgcagtgccgagcagtgctataagatcaccaaaggcagagcaatctttgccagcggaagtcctttcgatccagtgaccctcccaaacgggcagacgttatacccagggcagggcaataatagctatgtcttcccaggtgtggcattaggagtggtcgcttgtgggctgaggcaaataaccgataacatttttttaacaactgccgaagtcattgcacaacaggtcagcgataaacacttggaagaagggaggctctaccctcctctgaataccatccgggacgtcagcttaaaaatcgccgagaaaatagtgaaggacgcgtaccaggagaaaacagctaccgtctatccggagccgcagaataaagaggccttcgttagatctcagatgtactctacggactatgatcagattctcccggactgctactcttggcccgaagaagtgcagaaaatccaaaccaaggtcgaccagtag

SEQ ID NO: 229468 - DNA, 1494 bp, Artificial Sequence
  Description of Artificial Sequence: Synthetic coding sequence
atggatttacaggacaggaacgaaaaactcttttatagagtcttgacgtctgatatagagaagtttatgccaatcgtctacacaccaacggttggacttgcttgccagcagtacagtctcgtatttaggaaaccgagaggactattcattaccattcacgatagaggccacattgcctcagtgctgaatgcttggccagaggacgttatcaaagccatagtggtgacagatggcgaaaggatcctgggactcggcgatctggggtgcaacggcatgggcatacccgtgggcaaattggccctgtacaccgcctgcgggggaatgaatccacaggaatgtctcccagtgattctggacgtcggaaccgagaatgaggagctgctcaaggatccactgtacattgggttgcggcagaggagagtgcgcggtagtgagtacgacgatttcctggacgagtttatggaggccgtgagcagcaagtacggtatgaactgcttaatccagtttgaagattttgctaatgttaatgcctttcggctgctcaacaaatatcgcaatcagtactgcacatttaatgacgatatccaaggcaccgcaagtgtggcagttgccggactgctggctgcactgcgcattactaagaacaaattaagtgatcagaccatccttttccagggtgccggtgaggcagcattgggtatcgcacacctgattgttatggctctggagaaggaaggccttcctaaggaaaaagcgattaagaaaatctggctcgtcgactctaagggcctcattgtgaagggtcgggcttcattgacgcaagaaaaagaaaaatttgcacacgagcacgaggaaatgaaaaacctagaggcgatagttcaggaaatcaaacccactgccttgataggcgtggcagccattggtggggctttttctgaacagatcttgaaggatatggcagcatttaatgagcgaccaatcatttttgctctcagtaaccctacatctaaggccgaatgtagcgctgagcagtgttacaaaataaccaaaggcagggccatctttgccagtggctctccttttgatccagtgacactgccaaacggccagaccctctaccctggacaggggaacaatagttatgtgtttccaggagtagccctgggggtcgtggcctgtggcctacgacagattactgataacatctttttaaccaccgcggaggtcatcgcccagcaagttagtgacaagcatcttgaggagggaaggctctatcctcccctaaacaccatcagagacgtgtcactcaaaatcgcagagaaaatcgttaaggacgcctatcaagagaagacagctacagtctaccccgagcctcagaataaagaggccttcgttcgctctcagatgtattccacagactatgatcaaatccttccggactgctactcttggcccgaagaagttcagaagatccagactaaggtcgaccaatag

SEQ ID NO: 229469 - DNA, 1755 bp, Artificial Sequence
  Description of Artificial Sequence: Synthetic coding sequence
atgttatctcgtctacgggtcgtaagcaccacttgcacattggcctgcaggcacctacatataaaagaaaaaggaaagccactaatgttaaaccccagaaccaacaaagggatggcttttaccctgcaggagcggcagatgctgggactgcagggcctgctgccccctaagatcgagacccaggatattcaagcactccggttccacaggaacctgaaaaagatgactagccccctagagaaatacatttatatcatgggcatccaggagcggaacgagaaactgttttaccggattctccaggacgacatagagagcctgatgcccatcgtatatacacccaccgtggggctagcttgctcacagtacggacatatttttcgcaggcccaaggggctgttcatcagcatttccgaccgaggtcatgtccgtagcatcgtggataactggcctgaaaatcacgtcaaagccgtcgtcgttacagatggagagagaatcttgggcctgggtgacctgggggtgtacgggatgggtattccagtgggtaagctgtgtctgtatactgcctgtgccggtatccggccagaccgctgtctgcctgtatgtattgacgttggaaccgataacattgcactgttgaaagaccccttttacatgggactctaccagaagcgcgatcgaacccagcaatatgacgatctgatcgacgagttcatgaaggctatcacggaccggtacggcaggaacaccctgatacagttcgaagatttcggcaaccacaacgcctttcgcttcctccgaaaatacagggaaaaatattgcaccttcaacgatgatatccagggtacggccgctgtggctttggccggactcttggcagctcaaaaggtaattagcaaacccatttctgagcacaagattctttttcttggggctggagaagcagcccttggtattgccaatctgatcgtgatgagcatggtcgagaatggcctgagcgagcaggaggctcagaaaaagatttggatgtttgataaatacggcttacttgtgaaggggagaaaggccaagatcgacagctaccaagaacccttcacacactctgcacctgaaagcatcccagacacgtttgaggatgcagtgaatatcctaaaaccttccaccattatcggagttgcgggagccggaaggctctttactccagacgttatacgggctatggcaagcataaatgagcggccagtgatctttgctctaagcaacccgacagcccaggctgaatgtaccgcggaagaagcctacactctgaccgaaggtagatgtcttttcgcttccggatccccttttggccctgtgaaactgaccgatggaagagtgtttacaccagggcaggggaacaacgtttatatattccccggagtggccctggccgtgattctttgtaatacaagacacatctccgactcagtgttcttagaagccgcaaaggcactgacaagtcaactaacggatgaggaacttgcccaaggtcgcctctatcctcctcttgcgaacattcaggaggtctccattaatatcgccattaaggtcacggagtatctgtacgcaaataaaatggcatttcggtaccccgaacccgaagacaaagctaagtatgtgaaggagaggacctggagatccgaatatgatagcctgctgcccgacgtctacgagtggccagaaagcgcaagctcaccccctgttattaccgagtag
